United States Patent 11,421,016 (CANCER NEOEPITOPES) - sequence listing, part 14

SEQ ID NO: 601741 - protein, 9 aa, Homo Sapiens
ITSLTSVGF

SEQ ID NO: 601742 - protein, 9 aa, Homo Sapiens
PSGPVLYLH

SEQ ID NO: 601743 - protein, 9 aa, Homo Sapiens
EIEKFSNKS

SEQ ID NO: 601744 - protein, 9 aa, Homo Sapiens
ELALEITKE

SEQ ID NO: 601745 - protein, 9 aa, Homo Sapiens
RMIDDRHIL

SEQ ID NO: 601746 - protein, 9 aa, Homo Sapiens
VFFPPLLII

SEQ ID NO: 601747 - protein, 9 aa, Homo Sapiens
TPVGIPTLS

SEQ ID NO: 601748 - protein, 9 aa, Homo Sapiens
LKAWRDLTT

SEQ ID NO: 601749 - protein, 9 aa, Homo Sapiens
KVKDRTLKL

SEQ ID NO: 601750 - protein, 9 aa, Homo Sapiens
GVDDGTKSD

SEQ ID NO: 601751 - protein, 9 aa, Homo Sapiens
FTLAKIARP

SEQ ID NO: 601752 - protein, 9 aa, Homo Sapiens
AFVKNSSLT

SEQ ID NO: 601753 - protein, 9 aa, Homo Sapiens
KEKKGSKKG

SEQ ID NO: 601754 - protein, 9 aa, Homo Sapiens
DEGGIVLTT

SEQ ID NO: 601755 - protein, 9 aa, Homo Sapiens
RACCFQAAP

SEQ ID NO: 601756 - protein, 9 aa, Homo Sapiens
ESLSRKLLE

SEQ ID NO: 601757 - protein, 9 aa, Homo Sapiens
QGSGIQYCG

SEQ ID NO: 601758 - protein, 9 aa, Homo Sapiens
EENQESLRT

SEQ ID NO: 601759 - protein, 9 aa, Homo Sapiens
NHSESGEVR

SEQ ID NO: 601760 - protein, 9 aa, Homo Sapiens
ADLMKTTLN

SEQ ID NO: 601761 - protein, 9 aa, Homo Sapiens
TWPEGLDAS

SEQ ID NO: 601762 - protein, 9 aa, Homo Sapiens
LFLREKRGK

SEQ ID NO: 601763 - protein, 9 aa, Homo Sapiens
SAPWMPCTT

SEQ ID NO: 601764 - protein, 9 aa, Homo Sapiens
CSRCAFMLD

SEQ ID NO: 601765 - protein, 9 aa, Homo Sapiens
MLVICIKIF

SEQ ID NO: 601766 - protein, 9 aa, Homo Sapiens
FFTFVEEWS

SEQ ID NO: 601767 - protein, 9 aa, Homo Sapiens
EPKEQQKLE

SEQ ID NO: 601768 - protein, 9 aa, Homo Sapiens
SHRTQHYNV

SEQ ID NO: 601769 - protein, 9 aa, Homo Sapiens
IYEDELKQE

SEQ ID NO: 601770 - protein, 9 aa, Homo Sapiens
TNCSYADLM

SEQ ID NO: 601771 - protein, 9 aa, Homo Sapiens
LIQCSLNVQ

SEQ ID NO: 601772 - protein, 9 aa, Homo Sapiens
QPLRSEREP

SEQ ID NO: 601773 - protein, 9 aa, Homo Sapiens
GNQTDVGNF

SEQ ID NO: 601774 - protein, 9 aa, Homo Sapiens
DNYHCHCRI

SEQ ID NO: 601775 - protein, 9 aa, Homo Sapiens
MVMGPNNVG

SEQ ID NO: 601776 - protein, 9 aa, Homo Sapiens
MRCSLIAEH

SEQ ID NO: 601777 - protein, 9 aa, Homo Sapiens
AMAQAHSTI

SEQ ID NO: 601778 - protein, 9 aa, Homo Sapiens
RIAWARTAL

SEQ ID NO: 601779 - protein, 9 aa, Homo Sapiens
LFFRLVNAL

SEQ ID NO: 601780 - protein, 9 aa, Homo Sapiens
NLVFLGIVS

SEQ ID NO: 601781 - protein, 9 aa, Homo Sapiens
AHSTIKGSS

SEQ ID NO: 601782 - protein, 9 aa, Homo Sapiens
ISADSGVNL

SEQ ID NO: 601783 - protein, 9 aa, Homo Sapiens
NDMKVLHQL

SEQ ID NO: 601784 - protein, 9 aa, Homo Sapiens
PAMCSPFTR

SEQ ID NO: 601785 - protein, 9 aa, Homo Sapiens
FGQHESASG

SEQ ID NO: 601786 - protein, 9 aa, Homo Sapiens
CYSVYTSAI

SEQ ID NO: 601787 - protein, 9 aa, Homo Sapiens
DSSTSRMRL

SEQ ID NO: 601788 - protein, 9 aa, Homo Sapiens
SPPYSDKTI

SEQ ID NO: 601789 - protein, 9 aa, Homo Sapiens
GPVSKFAGY

SEQ ID NO: 601790 - protein, 9 aa, Homo Sapiens
GVCHNLSGT

SEQ ID NO: 601791 - protein, 9 aa, Homo Sapiens
PRTIPREDI

SEQ ID NO: 601792 - protein, 9 aa, Homo Sapiens
DSGSRRRHC

SEQ ID NO: 601793 - protein, 9 aa, Homo Sapiens
LTKKQLHFI

SEQ ID NO: 601794 - protein, 9 aa, Homo Sapiens
DPANMVPRI

SEQ ID NO: 601795 - protein, 9 aa, Homo Sapiens
LPGYQKRGE

SEQ ID NO: 601796 - protein, 9 aa, Homo Sapiens
KQKHLEFEL

SEQ ID NO: 601797 - protein, 9 aa, Homo Sapiens
DFSPAIHQS

SEQ ID NO: 601798 - protein, 9 aa, Homo Sapiens
IPREDIKGF

SEQ ID NO: 601799 - protein, 9 aa, Homo Sapiens
VGSVLSAPS

SEQ ID NO: 601800 - protein, 9 aa, Homo Sapiens
GLCSLRFAI

SEQ ID NO: 601801 - protein, 9 aa, Homo Sapiens
VEHSNAAAA

SEQ ID NO: 601802 - protein, 9 aa, Homo Sapiens
VLYMSNHTN

SEQ ID NO: 601803 - protein, 9 aa, Homo Sapiens
TSYRELTRG

SEQ ID NO: 601804 - protein, 9 aa, Homo Sapiens
QALKAWRDL

SEQ ID NO: 601805 - protein, 9 aa, Homo Sapiens
DVGNFLLLG

SEQ ID NO: 601806 - protein, 9 aa, Homo Sapiens
RPPSVGSVL

SEQ ID NO: 601807 - protein, 9 aa, Homo Sapiens
RLFRDFLAS

SEQ ID NO: 601808 - protein, 9 aa, Homo Sapiens
SGFYYVDSD

SEQ ID NO: 601809 - protein, 9 aa, Homo Sapiens
PKGCLCSSA

SEQ ID NO: 601810 - protein, 9 aa, Homo Sapiens
VKAPTMKPS

SEQ ID NO: 601811 - protein, 9 aa, Homo Sapiens
HLEFELKEA

SEQ ID NO: 601812 - protein, 9 aa, Homo Sapiens
TKSDTSVTA

SEQ ID NO: 601813 - protein, 9 aa, Homo Sapiens
TPVPFSFST

SEQ ID NO: 601814 - protein, 9 aa, Homo Sapiens
CSPNPHPLT

SEQ ID NO: 601815 - protein, 9 aa, Homo Sapiens
PEQCSPLPC

SEQ ID NO: 601816 - protein, 9 aa, Homo Sapiens
LHQLKSEST

SEQ ID NO: 601817 - protein, 9 aa, Homo Sapiens
RFIRTSAYQ

SEQ ID NO: 601818 - protein, 9 aa, Homo Sapiens
ELLLVITMS

SEQ ID NO: 601819 - protein, 9 aa, Homo Sapiens
YADLMKTTL

SEQ ID NO: 601820 - protein, 9 aa, Homo Sapiens
EDVFNNKLS

SEQ ID NO: 601821 - protein, 9 aa, Homo Sapiens
TPTRELALE

SEQ ID NO: 601822 - protein, 9 aa, Homo Sapiens
YHSGHIVRA

SEQ ID NO: 601823 - protein, 9 aa, Homo Sapiens
NRISQMHTV

SEQ ID NO: 601824 - protein, 9 aa, Homo Sapiens
YYVDSDGSG

SEQ ID NO: 601825 - protein, 9 aa, Homo Sapiens
SRPFIASIQ

SEQ ID NO: 601826 - protein, 9 aa, Homo Sapiens
EANKDFVKV

SEQ ID NO: 601827 - protein, 9 aa, Homo Sapiens
KSVKAPTMK

SEQ ID NO: 601828 - protein, 9 aa, Homo Sapiens
HIDRLFFTF

SEQ ID NO: 601829 - protein, 9 aa, Homo Sapiens
YRDHENELL

SEQ ID NO: 601830 - protein, 9 aa, Homo Sapiens
EETLGSLAE

SEQ ID NO: 601831 - protein, 9 aa, Homo Sapiens
ENYPIPEPS

SEQ ID NO: 601832 - protein, 9 aa, Homo Sapiens
NIEMVGEPQ

SEQ ID NO: 601833 - protein, 9 aa, Homo Sapiens
MKLFARAKV

SEQ ID NO: 601834 - protein, 9 aa, Homo Sapiens
KKEPKEQQK

SEQ ID NO: 601835 - protein, 9 aa, Homo Sapiens
FALPSGPVL

SEQ ID NO: 601836 - protein, 9 aa, Homo Sapiens
PTSVPSERS

SEQ ID NO: 601837 - protein, 9 aa, Homo Sapiens
INVDIINFG

SEQ ID NO: 601838 - protein, 9 aa, Homo Sapiens
YLTKKQLHF

SEQ ID NO: 601839 - protein, 9 aa, Homo Sapiens
RLFFTFVEE

SEQ ID NO: 601840 - protein, 9 aa, Homo Sapiens
VGEPQAAKV

SEQ ID NO: 601841 - protein, 9 aa, Homo Sapiens
HWLLVDDPS

SEQ ID NO: 601842 - protein, 9 aa, Homo Sapiens
PVLYLHSAP

SEQ ID NO: 601843 - protein, 9 aa, Homo Sapiens
IAYLYGRGV

SEQ ID NO: 601844 - protein, 9 aa, Homo Sapiens
GISWVTLQW

SEQ ID NO: 601845 - protein, 9 aa, Homo Sapiens
KANVISKSM

SEQ ID NO: 601846 - protein, 9 aa, Homo Sapiens
VFRGGYLQR

SEQ ID NO: 601847 - protein, 9 aa, Homo Sapiens
QCSPNPHPL

SEQ ID NO: 601848 - protein, 9 aa, Homo Sapiens
CGIIEPLIN

SEQ ID NO: 601849 - protein, 9 aa, Homo Sapiens
LNVGGFRQS

SEQ ID NO: 601850 - protein, 9 aa, Homo Sapiens
IVASEIEKN

SEQ ID NO: 601851 - protein, 9 aa, Homo Sapiens
AVASDPANM

SEQ ID NO: 601852 - protein, 9 aa, Homo Sapiens
ELRGQRDLV

SEQ ID NO: 601853 - protein, 9 aa, Homo Sapiens
RDFLASVPT

SEQ ID NO: 601854 - protein, 9 aa, Homo Sapiens
SDYSTPSKP

SEQ ID NO: 601855 - protein, 9 aa, Homo Sapiens
LKKEKINVD

SEQ ID NO: 601856 - protein, 9 aa, Homo Sapiens
RTALLNVCM

SEQ ID NO: 601857 - protein, 9 aa, Homo Sapiens
MLKTSTDFS

SEQ ID NO: 601858 - protein, 9 aa, Homo Sapiens
SSSLVWHQR

SEQ ID NO: 601859 - protein, 9 aa, Homo Sapiens
TSTTKLSWS

SEQ ID NO: 601860 - protein, 9 aa, Homo Sapiens
IDEIDKAVA

SEQ ID NO: 601861 - protein, 9 aa, Homo Sapiens
RVLCGWCCP

SEQ ID NO: 601862 - protein, 9 aa, Homo Sapiens
LKSESTKNV

SEQ ID NO: 601863 - protein, 9 aa, Homo Sapiens
MELSKETLD

SEQ ID NO: 601864 - protein, 9 aa, Homo Sapiens
RHNSIQRQL

SEQ ID NO: 601865 - protein, 9 aa, Homo Sapiens
VNLPHMTAS

SEQ ID NO: 601866 - protein, 9 aa, Homo Sapiens
GQTYGNKCV

SEQ ID NO: 601867 - protein, 9 aa, Homo Sapiens
FGALVELLD

SEQ ID NO: 601868 - protein, 9 aa, Homo Sapiens
DREDGERQA

SEQ ID NO: 601869 - protein, 9 aa, Homo Sapiens
VFHWLLVDD

SEQ ID NO: 601870 - protein, 9 aa, Homo Sapiens
VGSTRCGSG

SEQ ID NO: 601871 - protein, 9 aa, Homo Sapiens
GLSMLSPPA

SEQ ID NO: 601872 - protein, 9 aa, Homo Sapiens
KAPTMKPSE

SEQ ID NO: 601873 - protein, 9 aa, Homo Sapiens
PLISSAYSQ

SEQ ID NO: 601874 - protein, 9 aa, Homo Sapiens
PHSRPFIAS

SEQ ID NO: 601875 - protein, 9 aa, Homo Sapiens
PVSLPSWKW

SEQ ID NO: 601876 - protein, 9 aa, Homo Sapiens
SAPLARTTS

SEQ ID NO: 601877 - protein, 9 aa, Homo Sapiens
GVSHQRYLR

SEQ ID NO: 601878 - protein, 9 aa, Homo Sapiens
LEFELKEAE

SEQ ID NO: 601879 - protein, 9 aa, Homo Sapiens
DLRAAQTPE

SEQ ID NO: 601880 - protein, 9 aa, Homo Sapiens
SPRIVPRAP

SEQ ID NO: 601881 - protein, 9 aa, Homo Sapiens
NLTFAPRGP

SEQ ID NO: 601882 - protein, 9 aa, Homo Sapiens
GGFRQSVDQ

SEQ ID NO: 601883 - protein, 9 aa, Homo Sapiens
NEIYKQDVE

SEQ ID NO: 601884 - protein, 9 aa, Homo Sapiens
GKSKYCYGG

SEQ ID NO: 601885 - protein, 9 aa, Homo Sapiens
KPVWYGLVM

SEQ ID NO: 601886 - protein, 9 aa, Homo Sapiens
SAVTMELSK

SEQ ID NO: 601887 - protein, 9 aa, Homo Sapiens
DAMYQEELR

SEQ ID NO: 601888 - protein, 9 aa, Homo Sapiens
RLPFCGNNT

SEQ ID NO: 601889 - protein, 9 aa, Homo Sapiens
PSVPYVMFC

SEQ ID NO: 601890 - protein, 9 aa, Homo Sapiens
GQRTTFANE

SEQ ID NO: 601891 - protein, 9 aa, Homo Sapiens
SVKNRVIDS

SEQ ID NO: 601892 - protein, 9 aa, Homo Sapiens
LLPEKSKTK

SEQ ID NO: 601893 - protein, 9 aa, Homo Sapiens
QEELRGQRD

SEQ ID NO: 601894 - protein, 9 aa, Homo Sapiens
QAHSTIKGS

SEQ ID NO: 601895 - protein, 9 aa, Homo Sapiens
KSMHFSGIL

SEQ ID NO: 601896 - protein, 9 aa, Homo Sapiens
ASGKSSGFG

SEQ ID NO: 601897 - protein, 9 aa, Homo Sapiens
ALKYIRCRR

SEQ ID NO: 601898 - protein, 9 aa, Homo Sapiens
FEQTLGLSS

SEQ ID NO: 601899 - protein, 9 aa, Homo Sapiens
EEGDGDFTI

SEQ ID NO: 601900 - protein, 9 aa, Homo Sapiens
SLPPSSLSS

SEQ ID NO: 601901 - protein, 9 aa, Homo Sapiens
HLQRNSMRK

SEQ ID NO: 601902 - protein, 9 aa, Homo Sapiens
EITKECKKF

SEQ ID NO: 601903 - protein, 9 aa, Homo Sapiens
QHYNVCRES

SEQ ID NO: 601904 - protein, 9 aa, Homo Sapiens
PTSTPSLPP

SEQ ID NO: 601905 - protein, 9 aa, Homo Sapiens
SSTPVPFSF

SEQ ID NO: 601906 - protein, 9 aa, Homo Sapiens
SACQAFQAA

SEQ ID NO: 601907 - protein, 9 aa, Homo Sapiens
SKYCYGGLR

SEQ ID NO: 601908 - protein, 9 aa, Homo Sapiens
WMPCTTSHL

SEQ ID NO: 601909 - protein, 9 aa, Homo Sapiens
GAFHSDLSS

SEQ ID NO: 601910 - protein, 9 aa, Homo Sapiens
WSRPFKLHL

SEQ ID NO: 601911 - protein, 9 aa, Homo Sapiens
WTPVGIPTL

SEQ ID NO: 601912 - protein, 9 aa, Homo Sapiens
DWQQKGCTY

SEQ ID NO: 601913 - protein, 9 aa, Homo Sapiens
SVVYNNYCV

SEQ ID NO: 601914 - protein, 9 aa, Homo Sapiens
LKYIRCRRG

SEQ ID NO: 601915 - protein, 9 aa, Homo Sapiens
CYHRCHTGE

SEQ ID NO: 601916 - protein, 9 aa, Homo Sapiens
SVAQSGTES

SEQ ID NO: 601917 - protein, 9 aa, Homo Sapiens
HESASGKSS

SEQ ID NO: 601918 - protein, 9 aa, Homo Sapiens
VSLASSCVW

SEQ ID NO: 601919 - protein, 9 aa, Homo Sapiens
NKSNICRFL

SEQ ID NO: 601920 - protein, 9 aa, Homo Sapiens
LLVITMSAS

SEQ ID NO: 601921 - protein, 9 aa, Homo Sapiens
KRKNRSYKS

SEQ ID NO: 601922 - protein, 9 aa, Homo Sapiens
LQPQALKAW

SEQ ID NO: 601923 - protein, 9 aa, Homo Sapiens
FQARSLPAC

SEQ ID NO: 601924 - protein, 9 aa, Homo Sapiens
KMSLALKYI

SEQ ID NO: 601925 - protein, 9 aa, Homo Sapiens
HMLPKETVL

SEQ ID NO: 601926 - protein, 9 aa, Homo Sapiens
LQLPEFREM

SEQ ID NO: 601927 - protein, 9 aa, Homo Sapiens
LVELLDNAR

SEQ ID NO: 601928 - protein, 9 aa, Homo Sapiens
LTAHGGRGG

SEQ ID NO: 601929 - protein, 9 aa, Homo Sapiens
LSQCSPNPH

SEQ ID NO: 601930 - protein, 9 aa, Homo Sapiens
YTNKSGDAP

SEQ ID NO: 601931 - protein, 9 aa, Homo Sapiens
DDKDDMDSE

SEQ ID NO: 601932 - protein, 9 aa, Homo Sapiens
EFELKEAEE

SEQ ID NO: 601933 - protein, 9 aa, Homo Sapiens
GSVVYNNYC

SEQ ID NO: 601934 - protein, 9 aa, Homo Sapiens
SVGSTRCGS

SEQ ID NO: 601935 - protein, 9 aa, Homo Sapiens
NQMFVQYIS

SEQ ID NO: 601936 - protein, 9 aa, Homo Sapiens
YGAAAAYEA

SEQ ID NO: 601937 - protein, 9 aa, Homo Sapiens
RTSAYQELL

SEQ ID NO: 601938 - protein, 9 aa, Homo Sapiens
GDMGLWFVR

SEQ ID NO: 601939 - protein, 9 aa, Homo Sapiens
LPETCEELR

SEQ ID NO: 601940 - protein, 9 aa, Homo Sapiens
AWARTALLN

SEQ ID NO: 601941 - protein, 9 aa, Homo Sapiens
DLMKTTLNQ

SEQ ID NO: 601942 - protein, 9 aa, Homo Sapiens
AIATAMAQA

SEQ ID NO: 601943 - protein, 9 aa, Homo Sapiens
SRPFKLHLQ

SEQ ID NO: 601944 - protein, 9 aa, Homo Sapiens
GGIVLTTLP

SEQ ID NO: 601945 - protein, 9 aa, Homo Sapiens
ACSRCAFML

SEQ ID NO: 601946 - protein, 9 aa, Homo Sapiens
MGVKCCKCD

SEQ ID NO: 601947 - protein, 9 aa, Homo Sapiens
YHINAPENV

SEQ ID NO: 601948 - protein, 9 aa, Homo Sapiens
VELLDNARD

SEQ ID NO: 601949 - protein, 9 aa, Homo Sapiens
KPFLTLVLL

SEQ ID NO: 601950 - protein, 9 aa, Homo Sapiens
MQGHCEGVL

SEQ ID NO: 601951 - protein, 9 aa, Homo Sapiens
GDRAGVLAA

SEQ ID NO: 601952 - protein, 9 aa, Homo Sapiens
LRSEREPID

SEQ ID NO: 601953 - protein, 9 aa, Homo Sapiens
TFTWVNHSE

SEQ ID NO: 601954 - protein, 9 aa, Homo Sapiens
PQPTSTPSL

SEQ ID NO: 601955 - protein, 9 aa, Homo Sapiens
LLVDDPSFP

SEQ ID NO: 601956 - protein, 9 aa, Homo Sapiens
PLPYGGFSR

SEQ ID NO: 601957 - protein, 9 aa, Homo Sapiens
VASLHKEKL

SEQ ID NO: 601958 - protein, 9 aa, Homo Sapiens
LARTTSGRG

SEQ ID NO: 601959 - protein, 9 aa, Homo Sapiens
YFTWTPVGI

SEQ ID NO: 601960 - protein, 9 aa, Homo Sapiens
VPGVTDVLR

SEQ ID NO: 601961 - protein, 9 aa, Homo Sapiens
SFRVTVDRS

SEQ ID NO: 601962 - protein, 9 aa, Homo Sapiens
DDNLGLCWQ

SEQ ID NO: 601963 - protein, 9 aa, Homo Sapiens
MKKKCQELC

SEQ ID NO: 601964 - protein, 9 aa, Homo Sapiens
GYFTWTPVG

SEQ ID NO: 601965 - protein, 9 aa, Homo Sapiens
AFLEWTLCF

SEQ ID NO: 601966 - protein, 9 aa, Homo Sapiens
LLEHLFKQL

SEQ ID NO: 601967 - protein, 9 aa, Homo Sapiens
FTNAYRWNG

SEQ ID NO: 601968 - protein, 9 aa, Homo Sapiens
VTAVSEQSN

SEQ ID NO: 601969 - protein, 9 aa, Homo Sapiens
DGDREDGER

SEQ ID NO: 601970 - protein, 9 aa, Homo Sapiens
EHKRESMKK

SEQ ID NO: 601971 - protein, 9 aa, Homo Sapiens
DNASLFEMV

SEQ ID NO: 601972 - protein, 9 aa, Homo Sapiens
LVFLGIVSK

SEQ ID NO: 601973 - protein, 9 aa, Homo Sapiens
FYTPSKFKD

SEQ ID NO: 601974 - protein, 9 aa, Homo Sapiens
EMAEEFEQP

SEQ ID NO: 601975 - protein, 9 aa, Homo Sapiens
TPMNFLLSH

SEQ ID NO: 601976 - protein, 9 aa, Homo Sapiens
RGKARNYLY

SEQ ID NO: 601977 - protein, 9 aa, Homo Sapiens
VGIPTLSNI

SEQ ID NO: 601978 - protein, 9 aa, Homo Sapiens
GAGNTCSVP

SEQ ID NO: 601979 - protein, 9 aa, Homo Sapiens
VFCKAIVKS

SEQ ID NO: 601980 - protein, 9 aa, Homo Sapiens
VAICKGLIP

SEQ ID NO: 601981 - protein, 9 aa, Homo Sapiens
CTLTAHGGR

SEQ ID NO: 601982 - protein, 9 aa, Homo Sapiens
FLLPAAVLP

SEQ ID NO: 601983 - protein, 9 aa, Homo Sapiens
DGHLEVLLN

SEQ ID NO: 601984 - protein, 9 aa, Homo Sapiens
YRLQLHMLP

SEQ ID NO: 601985 - protein, 9 aa, Homo Sapiens
NPCRVLCGW

SEQ ID NO: 601986 - protein, 9 aa, Homo Sapiens
SYRELTRGQ

SEQ ID NO: 601987 - protein, 9 aa, Homo Sapiens
GGITFTWVN

SEQ ID NO: 601988 - protein, 9 aa, Homo Sapiens
FDINSTRGR

SEQ ID NO: 601989 - protein, 9 aa, Homo Sapiens
CVFCKAIVK

SEQ ID NO: 601990 - protein, 9 aa, Homo Sapiens
GLDASARAP

SEQ ID NO: 601991 - protein, 9 aa, Homo Sapiens
VCKMNVHRP

SEQ ID NO: 601992 - protein, 9 aa, Homo Sapiens
TQAQYHINA

SEQ ID NO: 601993 - protein, 9 aa, Homo Sapiens
EVAWKYNYI

SEQ ID NO: 601994 - protein, 9 aa, Homo Sapiens
EKKGSKKGI

SEQ ID NO: 601995 - protein, 9 aa, Homo Sapiens
SVGSVLSAP

SEQ ID NO: 601996 - protein, 9 aa, Homo Sapiens
KFKVALFFR

SEQ ID NO: 601997 - protein, 9 aa, Homo Sapiens
LNAAFEMTL

SEQ ID NO: 601998 - protein, 9 aa, Homo Sapiens
EELRGQRDL

SEQ ID NO: 601999 - protein, 9 aa, Homo Sapiens
GFKSPPILP

SEQ ID NO: 602000 - protein, 9 aa, Homo Sapiens
KEESLSRKL

SEQ ID NO: 602001 - protein, 9 aa, Homo Sapiens
LPEDEQGIV

SEQ ID NO: 602002 - protein, 9 aa, Homo Sapiens
RKAQKEEEQ

SEQ ID NO: 602003 - protein, 9 aa, Homo Sapiens
SPLQGLWTG

SEQ ID NO: 602004 - protein, 9 aa, Homo Sapiens
AYLTKKQLH

SEQ ID NO: 602005 - protein, 9 aa, Homo Sapiens
AIKLSKGQR

SEQ ID NO: 602006 - protein, 9 aa, Homo Sapiens
FVCSECSFL

SEQ ID NO: 602007 - protein, 9 aa, Homo Sapiens
DEIDKAVAI

SEQ ID NO: 602008 - protein, 9 aa, Homo Sapiens
ERQAEATAQ

SEQ ID NO: 602009 - protein, 9 aa, Homo Sapiens
GLAGEKVRW

SEQ ID NO: 602010 - protein, 9 aa, Homo Sapiens
LDDNLGLCW

SEQ ID NO: 602011 - protein, 9 aa, Homo Sapiens
LLPAAVLPR

SEQ ID NO: 602012 - protein, 9 aa, Homo Sapiens
TYRDHENEL

SEQ ID NO: 602013 - protein, 9 aa, Homo Sapiens
PFYYAPFAY

SEQ ID NO: 602014 - protein, 9 aa, Homo Sapiens
LHGFLVFHS

SEQ ID NO: 602015 - protein, 9 aa, Homo Sapiens
YIRCRRGIH

SEQ ID NO: 602016 - protein, 9 aa, Homo Sapiens
VLACLFLRE

SEQ ID NO: 602017 - protein, 9 aa, Homo Sapiens
SPPPQDGPG

SEQ ID NO: 602018 - protein, 9 aa, Homo Sapiens
PSSPPAPQR

SEQ ID NO: 602019 - protein, 9 aa, Homo Sapiens
YCYGGLRKK

SEQ ID NO: 602020 - protein, 9 aa, Homo Sapiens
ADGSFSNIW

SEQ ID NO: 602021 - protein, 9 aa, Homo Sapiens
KGKKRKAQK

SEQ ID NO: 602022 - protein, 9 aa, Homo Sapiens
HSNAAAAAL

SEQ ID NO: 602023 - protein, 9 aa, Homo Sapiens
AEPESWASG

SEQ ID NO: 602024 - protein, 9 aa, Homo Sapiens
DGQDVSACQ

SEQ ID NO: 602025 - protein, 9 aa, Homo Sapiens
GSRRRHCGE

SEQ ID NO: 602026 - protein, 9 aa, Homo Sapiens
KLNVFHWLL

SEQ ID NO: 602027 - protein, 9 aa, Homo Sapiens
CKCDVCGKE

SEQ ID NO: 602028 - protein, 9 aa, Homo Sapiens
PGPESSMSL

SEQ ID NO: 602029 - protein, 9 aa, Homo Sapiens
TTNNCYPNE

SEQ ID NO: 602030 - protein, 9 aa, Homo Sapiens
WCCKNGKGD

SEQ ID NO: 602031 - protein, 9 aa, Homo Sapiens
YDYAQIPYE

SEQ ID NO: 602032 - protein, 9 aa, Homo Sapiens
HRPCETNVA

SEQ ID NO: 602033 - protein, 9 aa, Homo Sapiens
GSAAQLAGP

SEQ ID NO: 602034 - protein, 9 aa, Homo Sapiens
NHWLPGMCN

SEQ ID NO: 602035 - protein, 9 aa, Homo Sapiens
SGNGKLYEL

SEQ ID NO: 602036 - protein, 9 aa, Homo Sapiens
GEGATATQS

SEQ ID NO: 602037 - protein, 9 aa, Homo Sapiens
ARLLEHLFK

SEQ ID NO: 602038 - protein, 9 aa, Homo Sapiens
ARHNSIQRQ

SEQ ID NO: 602039 - protein, 9 aa, Homo Sapiens
MAQAHSTIK

SEQ ID NO: 602040 - protein, 9 aa, Homo Sapiens
KAKVVTFDF

SEQ ID NO: 602041 - protein, 9 aa, Homo Sapiens
GCLCSSAGG

SEQ ID NO: 602042 - protein, 9 aa, Homo Sapiens
VSACQAFQA

SEQ ID NO: 602043 - protein, 9 aa, Homo Sapiens
REDGERQAE

SEQ ID NO: 602044 - protein, 9 aa, Homo Sapiens
SRAPSVANV

SEQ ID NO: 602045 - protein, 9 aa, Homo Sapiens
SLKRSSGPV

SEQ ID NO: 602046 - protein, 9 aa, Homo Sapiens
PSCCLTTCC

SEQ ID NO: 602047 - protein, 9 aa, Homo Sapiens
DPTTSTTKL

SEQ ID NO: 602048 - protein, 9 aa, Homo Sapiens
LHVGRVYRE

SEQ ID NO: 602049 - protein, 9 aa, Homo Sapiens
PNGDMGLWF

SEQ ID NO: 602050 - protein, 9 aa, Homo Sapiens
GAIRKLLNV

SEQ ID NO: 602051 - protein, 9 aa, Homo Sapiens
SSLYFTITS

SEQ ID NO: 602052 - protein, 9 aa, Homo Sapiens
LRKEIEDPP

SEQ ID NO: 602053 - protein, 9 aa, Homo Sapiens
SQKLVGEML

SEQ ID NO: 602054 - protein, 9 aa, Homo Sapiens
LMQSLKMNF

SEQ ID NO: 602055 - protein, 9 aa, Homo Sapiens
YPNETVILT

SEQ ID NO: 602056 - protein, 9 aa, Homo Sapiens
PVGIPTLSN

SEQ ID NO: 602057 - protein, 9 aa, Homo Sapiens
LTCYHRCHT

SEQ ID NO: 602058 - protein, 9 aa, Homo Sapiens
DIKAHTCFV

SEQ ID NO: 602059 - protein, 9 aa, Homo Sapiens
MKPSETRVR

SEQ ID NO: 602060 - protein, 9 aa, Homo Sapiens
VMNRGSQFA

SEQ ID NO: 602061 - protein, 9 aa, Homo Sapiens
EDVTAVSEQ

SEQ ID NO: 602062 - protein, 9 aa, Homo Sapiens
PRIVPRAPW

SEQ ID NO: 602063 - protein, 9 aa, Homo Sapiens
VSDPTTSTT

SEQ ID NO: 602064 - protein, 9 aa, Homo Sapiens
CWNLQNNKW

SEQ ID NO: 602065 - protein, 9 aa, Homo Sapiens
GIQYCGIKR

SEQ ID NO: 602066 - protein, 9 aa, Homo Sapiens
TVASLHKEK

SEQ ID NO: 602067 - protein, 9 aa, Homo Sapiens
ADSGVNLTS

SEQ ID NO: 602068 - protein, 9 aa, Homo Sapiens
IASRLRQWS

SEQ ID NO: 602069 - protein, 9 aa, Homo Sapiens
TRTLMERTV

SEQ ID NO: 602070 - protein, 9 aa, Homo Sapiens
AEHVEAFIT

SEQ ID NO: 602071 - protein, 9 aa, Homo Sapiens
NEDQSKSVS

SEQ ID NO: 602072 - protein, 9 aa, Homo Sapiens
ILLATIQGL

SEQ ID NO: 602073 - protein, 9 aa, Homo Sapiens
VYNNYCVGL

SEQ ID NO: 602074 - protein, 9 aa, Homo Sapiens
QANVWVVDL

SEQ ID NO: 602075 - protein, 9 aa, Homo Sapiens
SVVAGHQQF

SEQ ID NO: 602076 - protein, 9 aa, Homo Sapiens
PQEVGNLKN

SEQ ID NO: 602077 - protein, 9 aa, Homo Sapiens
AVTMELSKE

SEQ ID NO: 602078 - protein, 9 aa, Homo Sapiens
PPSSLSSRS

SEQ ID NO: 602079 - protein, 9 aa, Homo Sapiens
TQVAGKITG

SEQ ID NO: 602080 - protein, 9 aa, Homo Sapiens
VIDFTKPFM

SEQ ID NO: 602081 - protein, 9 aa, Homo Sapiens
GSTRCGSGG

SEQ ID NO: 602082 - protein, 9 aa, Homo Sapiens
ACCFQAAPP

SEQ ID NO: 602083 - protein, 9 aa, Homo Sapiens
QMHTVSCSG

SEQ ID NO: 602084 - protein, 9 aa, Homo Sapiens
CYLKEMKTF

SEQ ID NO: 602085 - protein, 9 aa, Homo Sapiens
SYIKRGKAR

SEQ ID NO: 602086 - protein, 9 aa, Homo Sapiens
NLTSSSQRT

SEQ ID NO: 602087 - protein, 9 aa, Homo Sapiens
GAEPESWAS

SEQ ID NO: 602088 - protein, 9 aa, Homo Sapiens
LSKGQRRGQ

SEQ ID NO: 602089 - protein, 9 aa, Homo Sapiens
GKHILILAN

SEQ ID NO: 602090 - protein, 9 aa, Homo Sapiens
MMKKKKKKN

SEQ ID NO: 602091 - protein, 9 aa, Homo Sapiens
ASARAPPAL

SEQ ID NO: 602092 - protein, 9 aa, Homo Sapiens
GAAAAYEAQ

SEQ ID NO: 602093 - protein, 9 aa, Homo Sapiens
VFGAIEPTS

SEQ ID NO: 602094 - protein, 9 aa, Homo Sapiens
ELTTGAPEL

SEQ ID NO: 602095 - protein, 9 aa, Homo Sapiens
VRAFDIIER

SEQ ID NO: 602096 - protein, 9 aa, Homo Sapiens
WQQKGCTYW

SEQ ID NO: 602097 - protein, 9 aa, Homo Sapiens
VAVMKLFAR

SEQ ID NO: 602098 - protein, 9 aa, Homo Sapiens
LTRGQSQFN

SEQ ID NO: 602099 - protein, 9 aa, Homo Sapiens
TFVEEWSES

SEQ ID NO: 602100 - protein, 9 aa, Homo Sapiens
TAIATAMAQ

SEQ ID NO: 602101 - protein, 9 aa, Homo Sapiens
GKYLFKDLD

SEQ ID NO: 602102 - protein, 9 aa, Homo Sapiens
RTLGAWNLE

SEQ ID NO: 602103 - protein, 9 aa, Homo Sapiens
ALVTCTALT

SEQ ID NO: 602104 - protein, 9 aa, Homo Sapiens
LPQEVGNLK

SEQ ID NO: 602105 - protein, 9 aa, Homo Sapiens
SKSMHFSGI

SEQ ID NO: 602106 - protein, 9 aa, Homo Sapiens
QRTTFANEK

SEQ ID NO: 602107 - protein, 9 aa, Homo Sapiens
RHSSSLVWH

SEQ ID NO: 602108 - protein, 9 aa, Homo Sapiens
LVMNRGSQF

SEQ ID NO: 602109 - protein, 9 aa, Homo Sapiens
ERACCFQAA

SEQ ID NO: 602110 - protein, 9 aa, Homo Sapiens
LTFAPRGPG

SEQ ID NO: 602111 - protein, 9 aa, Homo Sapiens
KASSRELTT

SEQ ID NO: 602112 - protein, 9 aa, Homo Sapiens
QTYGNKCVF

SEQ ID NO: 602113 - protein, 9 aa, Homo Sapiens
NEEEIGSLS

SEQ ID NO: 602114 - protein, 9 aa, Homo Sapiens
LWTGGAAAW

SEQ ID NO: 602115 - protein, 9 aa, Homo Sapiens
VSQFEYNVE

SEQ ID NO: 602116 - protein, 9 aa, Homo Sapiens
NPHPLTRFQ

SEQ ID NO: 602117 - protein, 9 aa, Homo Sapiens
APGKPFLTL

SEQ ID NO: 602118 - protein, 9 aa, Homo Sapiens
LGIVSKPDL

SEQ ID NO: 602119 - protein, 9 aa, Homo Sapiens
PEFREMGDY

SEQ ID NO: 602120 - protein, 9 aa, Homo Sapiens
SHKDNSRQR

SEQ ID NO: 602121 - protein, 9 aa, Homo Sapiens
KSGDAPLTV

SEQ ID NO: 602122 - protein, 9 aa, Homo Sapiens
KFQKLKYKD

SEQ ID NO: 602123 - protein, 9 aa, Homo Sapiens
NKEHMLPKE

SEQ ID NO: 602124 - protein, 9 aa, Homo Sapiens
RSGSRIPSA

SEQ ID NO: 602125 - protein, 9 aa, Homo Sapiens
HFAHRMFGL

SEQ ID NO: 602126 - protein, 9 aa, Homo Sapiens
DGFPSSPPA

SEQ ID NO: 602127 - protein, 9 aa, Homo Sapiens
VNYTNKSGD

SEQ ID NO: 602128 - protein, 9 aa, Homo Sapiens
GNNTINHFA

SEQ ID NO: 602129 - protein, 9 aa, Homo Sapiens
TTGAPELDV

SEQ ID NO: 602130 - protein, 9 aa, Homo Sapiens
SEWATQNPE

SEQ ID NO: 602131 - protein, 9 aa, Homo Sapiens
YKCNRCDHA

SEQ ID NO: 602132 - protein, 9 aa, Homo Sapiens
LKTIQQRNL

SEQ ID NO: 602133 - protein, 9 aa, Homo Sapiens
NCKGKAHAW

SEQ ID NO: 602134 - protein, 9 aa, Homo Sapiens
CGKAFSKYS

SEQ ID NO: 602135 - protein, 9 aa, Homo Sapiens
PKKNGHVSC

SEQ ID NO: 602136 - protein, 9 aa, Homo Sapiens
VVLALAKLA

SEQ ID NO: 602137 - protein, 9 aa, Homo Sapiens
KAHAWCSPC

SEQ ID NO: 602138 - protein, 9 aa, Homo Sapiens
KAFSKYSYL

SEQ ID NO: 602139 - protein, 9 aa, Homo Sapiens
YEQRLEHIM

SEQ ID NO: 602140 - protein, 9 aa, Homo Sapiens
TFALLDAGS

SEQ ID NO: 602141 - protein, 9 aa, Homo Sapiens
GNMTLQCGS

SEQ ID NO: 602142 - protein, 9 aa, Homo Sapiens
LLTPFSLTA

SEQ ID NO: 602143 - protein, 9 aa, Homo Sapiens
KGKAHAWCS

SEQ ID NO: 602144 - protein, 9 aa, Homo Sapiens
GHVSCYNCG

SEQ ID NO: 602145 - protein, 9 aa, Homo Sapiens
QENTGNLGS

SEQ ID NO: 602146 - protein, 9 aa, Homo Sapiens
DEGTPSVRE

SEQ ID NO: 602147 - protein, 9 aa, Homo Sapiens
GKTVEETAD

SEQ ID NO: 602148 - protein, 9 aa, Homo Sapiens
GTREQRPQG

SEQ ID NO: 602149 - protein, 9 aa, Homo Sapiens
ESDHTLYPL

SEQ ID NO: 602150 - protein, 9 aa, Homo Sapiens
FRLFSSLIT

SEQ ID NO: 602151 - protein, 9 aa, Homo Sapiens
VSIPMVCIL

SEQ ID NO: 602152 - protein, 9 aa, Homo Sapiens
HFSWDLAGG

SEQ ID NO: 602153 - protein, 9 aa, Homo Sapiens
ACVEDCFCP

SEQ ID NO: 602154 - protein, 9 aa, Homo Sapiens
LCYHLYLGI

SEQ ID NO: 602155 - protein, 9 aa, Homo Sapiens
QVAIVVKFF

SEQ ID NO: 602156 - protein, 9 aa, Homo Sapiens
GELVSLFDH

SEQ ID NO: 602157 - protein, 9 aa, Homo Sapiens
TPSVRELRS

SEQ ID NO: 602158 - protein, 9 aa, Homo Sapiens
LAKLATSYV

SEQ ID NO: 602159 - protein, 9 aa, Homo Sapiens
TQTVCVTGL

SEQ ID NO: 602160 - protein, 9 aa, Homo Sapiens
HLSQMPYTR

SEQ ID NO: 602161 - protein, 9 aa, Homo Sapiens
QNPENRQMI

SEQ ID NO: 602162 - protein, 9 aa, Homo Sapiens
TADLSLGYM

SEQ ID NO: 602163 - protein, 9 aa, Homo Sapiens
TTHHLVYRE

SEQ ID NO: 602164 - protein, 9 aa, Homo Sapiens
RPEEAGMLS

SEQ ID NO: 602165 - protein, 9 aa, Homo Sapiens
QRPQGWGWG

SEQ ID NO: 602166 - protein, 9 aa, Homo Sapiens
QCFECLKTI

SEQ ID NO: 602167 - protein, 9 aa, Homo Sapiens
SAGTREQRP

SEQ ID NO: 602168 - protein, 9 aa, Homo Sapiens
SKYSYLRQH

SEQ ID NO: 602169 - protein, 9 aa, Homo Sapiens
LQCGSQKGY

SEQ ID NO: 602170 - protein, 9 aa, Homo Sapiens
WLLFAVMWW

SEQ ID NO: 602171 - protein, 9 aa, Homo Sapiens
QPYRSEFYS

SEQ ID NO: 602172 - protein, 9 aa, Homo Sapiens
HQTLLTPFS

SEQ ID NO: 602173 - protein, 9 aa, Homo Sapiens
WTDEGTPSV

SEQ ID NO: 602174 - protein, 9 aa, Homo Sapiens
IVDDFQECN

SEQ ID NO: 602175 - protein, 9 aa, Homo Sapiens
AQHWMERLK

SEQ ID NO: 602176 - protein, 9 aa, Homo Sapiens
SGGELVSLF

SEQ ID NO: 602177 - protein, 9 aa, Homo Sapiens
RHKPRIDSL

SEQ ID NO: 602178 - protein, 9 aa, Homo Sapiens
QGKTVEETA

SEQ ID NO: 602179 - protein, 9 aa, Homo Sapiens
KGSISFQTE

SEQ ID NO: 602180 - protein, 9 aa, Homo Sapiens
ENTGNLGSD

SEQ ID NO: 602181 - protein, 9 aa, Homo Sapiens
PSSQTASAG

SEQ ID NO: 602182 - protein, 9 aa, Homo Sapiens
MVYQYGHFS

SEQ ID NO: 602183 - protein, 9 aa, Homo Sapiens
RQGCFHYYR

SEQ ID NO: 602184 - protein, 9 aa, Homo Sapiens
GNLGSDPSH

SEQ ID NO: 602185 - protein, 9 aa, Homo Sapiens
PQGWGWGAW

SEQ ID NO: 602186 - protein, 9 aa, Homo Sapiens
RQENTGNLG

SEQ ID NO: 602187 - protein, 9 aa, Homo Sapiens
IYRCRFRSY

SEQ ID NO: 602188 - protein, 9 aa, Homo Sapiens
CYHLYLGIE

SEQ ID NO: 602189 - protein, 9 aa, Homo Sapiens
SFQTEEKIH

SEQ ID NO: 602190 - protein, 9 aa, Homo Sapiens
CILAPVLVL

SEQ ID NO: 602191 - protein, 9 aa, Homo Sapiens
KCNRCDHAC

SEQ ID NO: 602192 - protein, 9 aa, Homo Sapiens
CVTGLLHAL

SEQ ID NO: 602193 - protein, 9 aa, Homo Sapiens
PRPEEAGML

SEQ ID NO: 602194 - protein, 9 aa, Homo Sapiens
LLDAGSQRA

SEQ ID NO: 602195 - protein, 9 aa, Homo Sapiens
PEEAGMLSL

SEQ ID NO: 602196 - protein, 9 aa, Homo Sapiens
FLSDISDAL

SEQ ID NO: 602197 - protein, 9 aa, Homo Sapiens
SNKEGASMW

SEQ ID NO: 602198 - protein, 9 aa, Homo Sapiens
SSNKEGASM

SEQ ID NO: 602199 - protein, 9 aa, Homo Sapiens
FFLQLQGLV

SEQ ID NO: 602200 - protein, 9 aa, Homo Sapiens
QRLCYHLYL

SEQ ID NO: 602201 - protein, 9 aa, Homo Sapiens
PYTRMCIKE

SEQ ID NO: 602202 - protein, 9 aa, Homo Sapiens
GLVAGVGLA

SEQ ID NO: 602203 - protein, 9 aa, Homo Sapiens
YYRRNKLIL

SEQ ID NO: 602204 - protein, 9 aa, Homo Sapiens
AVMWWLVAF

SEQ ID NO: 602205 - protein, 9 aa, Homo Sapiens
YYRYVSQKN

SEQ ID NO: 602206 - protein, 9 aa, Homo Sapiens
TGYYRYVSQ

SEQ ID NO: 602207 - protein, 9 aa, Homo Sapiens
LLFAVMWWL

SEQ ID NO: 602208 - protein, 9 aa, Homo Sapiens
KAKYILLLD

SEQ ID NO: 602209 - protein, 9 aa, Homo Sapiens
PFSLTAGAL

SEQ ID NO: 602210 - protein, 9 aa, Homo Sapiens
GWGAWRLDL

SEQ ID NO: 602211 - protein, 9 aa, Homo Sapiens
LVLAQHWME

SEQ ID NO: 602212 - protein, 9 aa, Homo Sapiens
QSSPESDHT

SEQ ID NO: 602213 - protein, 9 aa, Homo Sapiens
WGWGAWRLD

SEQ ID NO: 602214 - protein, 9 aa, Homo Sapiens
SLTAGALPA

SEQ ID NO: 602215 - protein, 9 aa, Homo Sapiens
RLPRPEEAG

SEQ ID NO: 602216 - protein, 9 aa, Homo Sapiens
ERGGGDGTA

SEQ ID NO: 602217 - protein, 9 aa, Homo Sapiens
QGWGWGAWR

SEQ ID NO: 602218 - protein, 9 aa, Homo Sapiens
LDAGHVKLT

SEQ ID NO: 602219 - protein, 9 aa, Homo Sapiens
LGIEEVRAA

SEQ ID NO: 602220 - protein, 9 aa, Homo Sapiens
VRELRSALL

SEQ ID NO: 602221 - protein, 9 aa, Homo Sapiens
LEAAAEKEF

SEQ ID NO: 602222 - protein, 9 aa, Homo Sapiens
ELVSLFDHH

SEQ ID NO: 602223 - protein, 9 aa, Homo Sapiens
GKAHAWCSP

SEQ ID NO: 602224 - protein, 9 aa, Homo Sapiens
SEFYSLQEQ

SEQ ID NO: 602225 - protein, 9 aa, Homo Sapiens
AGVGLAASF

SEQ ID NO: 602226 - protein, 9 aa, Homo Sapiens
QAATEIPSL

SEQ ID NO: 602227 - protein, 9 aa, Homo Sapiens
VYQYGHFSW

SEQ ID NO: 602228 - protein, 9 aa, Homo Sapiens
AKYILLLDI

SEQ ID NO: 602229 - protein, 9 aa, Homo Sapiens
RNYEQRLEH

SEQ ID NO: 602230 - protein, 9 aa, Homo Sapiens
YRSEFYSLQ

SEQ ID NO: 602231 - protein, 9 aa, Homo Sapiens
QYGHFSWDL

SEQ ID NO: 602232 - protein, 9 aa, Homo Sapiens
GRLLYCLNI

SEQ ID NO: 602233 - protein, 9 aa, Homo Sapiens
VSKGSISFQ

SEQ ID NO: 602234 - protein, 9 aa, Homo Sapiens
CLKTIQQRN

SEQ ID NO: 602235 - protein, 9 aa, Homo Sapiens
DAGHVKLTV

SEQ ID NO: 602236 - protein, 9 aa, Homo Sapiens
FQECNYGTM

SEQ ID NO: 602237 - protein, 9 aa, Homo Sapiens
AIVVKFFLQ

SEQ ID NO: 602238 - protein, 9 aa, Homo Sapiens
HVSCYNCGV

SEQ ID NO: 602239 - protein, 9 aa, Homo Sapiens
AGRLLYCLN

SEQ ID NO: 602240 - protein, 9 aa, Homo Sapiens
GGELVSLFD

SEQ ID NO: 602241 - protein, 9 aa, Homo Sapiens
SLVKVGTLK

SEQ ID NO: 602242 - protein, 9 aa, Homo Sapiens
RCRFRSYTS

SEQ ID NO: 602243 - protein, 9 aa, Homo Sapiens
GHVKLTVNL

SEQ ID NO: 602244 - protein, 9 aa, Homo Sapiens
QEQAATEIP

SEQ ID NO: 602245 - protein, 9 aa, Homo Sapiens
VSLFDHHVQ

SEQ ID NO: 602246 - protein, 9 aa, Homo Sapiens
EKEFQGKAR

SEQ ID NO: 602247 - protein, 9 aa, Homo Sapiens
LTGYYRYVS

SEQ ID NO: 602248 - protein, 9 aa, Homo Sapiens
FVAGRLLYC

SEQ ID NO: 602249 - protein, 9 aa, Homo Sapiens
CMVYQYGHF

SEQ ID NO: 602250 - protein, 9 aa, Homo Sapiens
LVAGVGLAA

SEQ ID NO: 602251 - protein, 9 aa, Homo Sapiens
LVYRESFRE

SEQ ID NO: 602252 - protein, 9 aa, Homo Sapiens
SGPKKNGHV

SEQ ID NO: 602253 - protein, 9 aa, Homo Sapiens
LCSWLLFAV

SEQ ID NO: 602254 - protein, 9 aa, Homo Sapiens
VVACVEDCF

SEQ ID NO: 602255 - protein, 9 aa, Homo Sapiens
SSQTASAGT

SEQ ID NO: 602256 - protein, 9 aa, Homo Sapiens
KYILLLDIV

SEQ ID NO: 602257 - protein, 9 aa, Homo Sapiens
VATFALLDA

SEQ ID NO: 602258 - protein, 9 aa, Homo Sapiens
MASSGGELV

SEQ ID NO: 602259 - protein, 9 aa, Homo Sapiens
VLAQHWMER

SEQ ID NO: 602260 - protein, 9 aa, Homo Sapiens
SLITELTHP

SEQ ID NO: 602261 - protein, 9 aa, Homo Sapiens
CKGKAHAWC

SEQ ID NO: 602262 - protein, 9 aa, Homo Sapiens
CSWLLFAVM

SEQ ID NO: 602263 - protein, 9 aa, Homo Sapiens
GHLSGCRLL

SEQ ID NO: 602264 - protein, 9 aa, Homo Sapiens
FQGKARLQD

SEQ ID NO: 602265 - protein, 9 aa, Homo Sapiens
SLAAPQRSG

SEQ ID NO: 602266 - protein, 9 aa, Homo Sapiens
FECLKTIQQ

SEQ ID NO: 602267 - protein, 9 aa, Homo Sapiens
SDHTLYPLQ

SEQ ID NO: 602268 - protein, 9 aa, Homo Sapiens
KTTHHLVYR

SEQ ID NO: 602269 - protein, 9 aa, Homo Sapiens
EPPPSSQTA

SEQ ID NO: 602270 - protein, 9 aa, Homo Sapiens
NKLSDNCKG

SEQ ID NO: 602271 - protein, 9 aa, Homo Sapiens
RVSIPMVCI

SEQ ID NO: 602272 - protein, 9 aa, Homo Sapiens
SGCRLLFLF

SEQ ID NO: 602273 - protein, 9 aa, Homo Sapiens
LDSCLHNPM

SEQ ID NO: 602274 - protein, 9 aa, Homo Sapiens
LITELTHPA

SEQ ID NO: 602275 - protein, 9 aa, Homo Sapiens
QTLLTPFSL

SEQ ID NO: 602276 - protein, 9 aa, Homo Sapiens
LSQMPYTRM

SEQ ID NO: 602277 - protein, 9 aa, Homo Sapiens
EWATQNPEN

SEQ ID NO: 602278 - protein, 9 aa, Homo Sapiens
TEIPSLEEP

SEQ ID NO: 602279 - protein, 9 aa, Homo Sapiens
SSLITELTH

SEQ ID NO: 602280 - protein, 9 aa, Homo Sapiens
DISDALFTM

SEQ ID NO: 602281 - protein, 9 aa, Homo Sapiens
CRFRSYTSP

SEQ ID NO: 602282 - protein, 9 aa, Homo Sapiens
FSLTAGALP

SEQ ID NO: 602283 - protein, 9 aa, Homo Sapiens
YRRNKLILY

SEQ ID NO: 602284 - protein, 9 aa, Homo Sapiens
KTVEETADL

SEQ ID NO: 602285 - protein, 9 aa, Homo Sapiens
YRYVSQKNM

SEQ ID NO: 602286 - protein, 9 aa, Homo Sapiens
TQNPENRQM

SEQ ID NO: 602287 - protein, 9 aa, Homo Sapiens
LQLQGLVAG

SEQ ID NO: 602288 - protein, 9 aa, Homo Sapiens
RRLPRPEEA

SEQ ID NO: 602289 - protein, 9 aa, Homo Sapiens
TGNLGSDPS

SEQ ID NO: 602290 - protein, 9 aa, Homo Sapiens
LYCLNIIFW

SEQ ID NO: 602291 - protein, 9 aa, Homo Sapiens
SIPMVCILA

SEQ ID NO: 602292 - protein, 9 aa, Homo Sapiens
LSDNCKGKA

SEQ ID NO: 602293 - protein, 9 aa, Homo Sapiens
RLELDAGHV

SEQ ID NO: 602294 - protein, 9 aa, Homo Sapiens
PAPRNYEQR

SEQ ID NO: 602295 - protein, 9 aa, Homo Sapiens
WSLAAPQRS

SEQ ID NO: 602296 - protein, 9 aa, Homo Sapiens
QTVCVTGLL

SEQ ID NO: 602297 - protein, 9 aa, Homo Sapiens
WGAWRLDLW

SEQ ID NO: 602298 - protein, 9 aa, Homo Sapiens
RQVAIVVKF

SEQ ID NO: 602299 - protein, 9 aa, Homo Sapiens
GCFHYYRRN

SEQ ID NO: 602300 - protein, 9 aa, Homo Sapiens
LDLWPVSLL

SEQ ID NO: 602301 - protein, 9 aa, Homo Sapiens
AGTREQRPQ

SEQ ID NO: 602302 - protein, 9 aa, Homo Sapiens
AGMLSLPPG

SEQ ID NO: 602303 - protein, 9 aa, Homo Sapiens
IVVKFFLQL

SEQ ID NO: 602304 - protein, 9 aa, Homo Sapiens
ALAKLATSY

SEQ ID NO: 602305 - protein, 9 aa, Homo Sapiens
DCFCPEGTL

SEQ ID NO: 602306 - protein, 9 aa, Homo Sapiens
PSSPEPPPS

SEQ ID NO: 602307 - protein, 9 aa, Homo Sapiens
PRVSIPMVC

SEQ ID NO: 602308 - protein, 9 aa, Homo Sapiens
GHFSWDLAG

SEQ ID NO: 602309 - protein, 9 aa, Homo Sapiens
EQAATEIPS

SEQ ID NO: 602310 - protein, 9 aa, Homo Sapiens
EQRPQGWGW

SEQ ID NO: 602311 - protein, 9 aa, Homo Sapiens
RLCYHLYLG

SEQ ID NO: 602312 - protein, 9 aa, Homo Sapiens
FRSYTSPNV

SEQ ID NO: 602313 - protein, 9 aa, Homo Sapiens
RLVLAQHWM

SEQ ID NO: 602314 - protein, 9 aa, Homo Sapiens
SISFQTEEK

SEQ ID NO: 602315 - protein, 9 aa, Homo Sapiens
QECNYGTME

SEQ ID NO: 602316 - protein, 9 aa, Homo Sapiens
AKLATSYVS

SEQ ID NO: 602317 - protein, 9 aa, Homo Sapiens
VFSSTCYRA

SEQ ID NO: 602318 - protein, 9 aa, Homo Sapiens
QNSEWATQN

SEQ ID NO: 602319 - protein, 9 aa, Homo Sapiens
GLAASFAVS

SEQ ID NO: 602320 - protein, 9 aa, Homo Sapiens
QLQGLVAGV

SEQ ID NO: 602321 - protein, 9 aa, Homo Sapiens
ERQENTGNL

SEQ ID NO: 602322 - protein, 9 aa, Homo Sapiens
VDDFQECNY

SEQ ID NO: 602323 - protein, 9 aa, Homo Sapiens
LDIVAADDC

SEQ ID NO: 602324 - protein, 9 aa, Homo Sapiens
VVKFFLQLQ

SEQ ID NO: 602325 - protein, 9 aa, Homo Sapiens
DLIYRCRFR

SEQ ID NO: 602326 - protein, 9 aa, Homo Sapiens
ASAGTREQR

SEQ ID NO: 602327 - protein, 9 aa, Homo Sapiens
VLALAKLAT

SEQ ID NO: 602328 - protein, 9 aa, Homo Sapiens
TVCVTGLLH

SEQ ID NO: 602329 - protein, 9 aa, Homo Sapiens
GVGLAASFA

SEQ ID NO: 602330 - protein, 9 aa, Homo Sapiens
LRLELDAGH

SEQ ID NO: 602331 - protein, 9 aa, Homo Sapiens
PSVRELRSA

SEQ ID NO: 602332 - protein, 9 aa, Homo Sapiens
IPMVCILAP

SEQ ID NO: 602333 - protein, 9 aa, Homo Sapiens
AAEKEFQGK

SEQ ID NO: 602334 - protein, 9 aa, Homo Sapiens
GKAFSKYSY

SEQ ID NO: 602335 - protein, 9 aa, Homo Sapiens
LAAPQRSGK

SEQ ID NO: 602336 - protein, 9 aa, Homo Sapiens
YQYGHFSWD

SEQ ID NO: 602337 - protein, 9 aa, Homo Sapiens
HLYLGIEEV

SEQ ID NO: 602338 - protein, 9 aa, Homo Sapiens
DDFQECNYG

SEQ ID NO: 602339 - protein, 9 aa, Homo Sapiens
HLSGCRLLF

SEQ ID NO: 602340 - protein, 9 aa, Homo Sapiens
AAPQRSGKK

SEQ ID NO: 602341 - protein, 9 aa, Homo Sapiens
APRNYEQRL

SEQ ID NO: 602342 - protein, 9 aa, Homo Sapiens
HRPAPRNYE

SEQ ID NO: 602343 - protein, 9 aa, Homo Sapiens
LAQHWMERL

SEQ ID NO: 602344 - protein, 9 aa, Homo Sapiens
VYRESFREL

SEQ ID NO: 602345 - protein, 9 aa, Homo Sapiens
ECLKTIQQR

SEQ ID NO: 602346 - protein, 9 aa, Homo Sapiens
TDEGTPSVR

SEQ ID NO: 602347 - protein, 9 aa, Homo Sapiens
CNYGTMESY

SEQ ID NO: 602348 - protein, 9 aa, Homo Sapiens
LAASFAVSS

SEQ ID NO: 602349 - protein, 9 aa, Homo Sapiens
DHTLYPLQS

SEQ ID NO: 602350 - protein, 9 aa, Homo Sapiens
HHLVYRESF

SEQ ID NO: 602351 - protein, 9 aa, Homo Sapiens
LTPFSLTAG

SEQ ID NO: 602352 - protein, 9 aa, Homo Sapiens
VMWWLVAFA

SEQ ID NO: 602353 - protein, 9 aa, Homo Sapiens
NKEGASMWI

SEQ ID NO: 602354 - protein, 9 aa, Homo Sapiens
LLDSCLHNP

SEQ ID NO: 602355 - protein, 9 aa, Homo Sapiens
ILLLDIVAA

SEQ ID NO: 602356 - protein, 9 aa, Homo Sapiens
TLQCGSQKG

SEQ ID NO: 602357 - protein, 9 aa, Homo Sapiens
ESSNKEGAS

SEQ ID NO: 602358 - protein, 9 aa, Homo Sapiens
EETADLSLG

SEQ ID NO: 602359 - protein, 9 aa, Homo Sapiens
SDNCKGKAH

SEQ ID NO: 602360 - protein, 9 aa, Homo Sapiens
VCILAPVLV

SEQ ID NO: 602361 - protein, 9 aa, Homo Sapiens
GGNMTLQCG

SEQ ID NO: 602362 - protein, 9 aa, Homo Sapiens
ASGGNMTLQ

SEQ ID NO: 602363 - protein, 9 aa, Homo Sapiens
RRHKPRIDS

SEQ ID NO: 602364 - protein, 9 aa, Homo Sapiens
PSFNKLSDN

SEQ ID NO: 602365 - protein, 9 aa, Homo Sapiens
EAGMLSLPP

SEQ ID NO: 602366 - protein, 9 aa, Homo Sapiens
GYYRYVSQK

SEQ ID NO: 602367 - protein, 9 aa, Homo Sapiens
TVEETADLS

SEQ ID NO: 602368 - protein, 9 aa, Homo Sapiens
RPAPRNYEQ

SEQ ID NO: 602369 - protein, 9 aa, Homo Sapiens
NGHVSCYNC

SEQ ID NO: 602370 - protein, 9 aa, Homo Sapiens
LCGKAFSKY

SEQ ID NO: 602371 - protein, 9 aa, Homo Sapiens
VTGLLHALL

SEQ ID NO: 602372 - protein, 9 aa, Homo Sapiens
ALLDAGSQR

SEQ ID NO: 602373 - protein, 9 aa, Homo Sapiens
LFRLFSSLI

SEQ ID NO: 602374 - protein, 9 aa, Homo Sapiens
ETADLSLGY

SEQ ID NO: 602375 - protein, 9 aa, Homo Sapiens
PVRMVFSST

SEQ ID NO: 602376 - protein, 9 aa, Homo Sapiens
AGSQRALRG

SEQ ID NO: 602377 - protein, 9 aa, Homo Sapiens
FSKYSYLRQ

SEQ ID NO: 602378 - protein, 9 aa, Homo Sapiens
RCDHACTQA

SEQ ID NO: 602379 - protein, 9 aa, Homo Sapiens
YHLYLGIEE

SEQ ID NO: 602380 - protein, 9 aa, Homo Sapiens
DLPVRMVFS

SEQ ID NO: 602381 - protein, 9 aa, Homo Sapiens
DSLVKVGTL

SEQ ID NO: 602382 - protein, 9 aa, Homo Sapiens
TPFSLTAGA

SEQ ID NO: 602383 - protein, 9 aa, Homo Sapiens
PPLLAIMNI

SEQ ID NO: 602384 - protein, 9 aa, Homo Sapiens
SDALFTMTQ

SEQ ID NO: 602385 - protein, 9 aa, Homo Sapiens
RSEFYSLQE

SEQ ID NO: 602386 - protein, 9 aa, Homo Sapiens
SDISDALFT

SEQ ID NO: 602387 - protein, 9 aa, Homo Sapiens
RMVFSSTCY

SEQ ID NO: 602388 - protein, 9 aa, Homo Sapiens
AFSKYSYLR

SEQ ID NO: 602389 - protein, 9 aa, Homo Sapiens
SMWINDMKM

SEQ ID NO: 602390 - protein, 9 aa, Homo Sapiens
LVSLFDHHV

SEQ ID NO: 602391 - protein, 9 aa, Homo Sapiens
FNKLSDNCK

SEQ ID NO: 602392 - protein, 9 aa, Homo Sapiens
SQTASAGTR

SEQ ID NO: 602393 - protein, 9 aa, Homo Sapiens
LSDISDALF

SEQ ID NO: 602394 - protein, 9 aa, Homo Sapiens
GPKKNGHVS

SEQ ID NO: 602395 - protein, 9 aa, Homo Sapiens
SGGNMTLQC

SEQ ID NO: 602396 - protein, 9 aa, Homo Sapiens
MTLQCGSQK

SEQ ID NO: 602397 - protein, 9 aa, Homo Sapiens
CNRCDHACT

SEQ ID NO: 602398 - protein, 9 aa, Homo Sapiens
GAWRLDLWP

SEQ ID NO: 602399 - protein, 9 aa, Homo Sapiens
DFQECNYGT

SEQ ID NO: 602400 - protein, 9 aa, Homo Sapiens
LLDIVAADD

SEQ ID NO: 602401 - protein, 9 aa, Homo Sapiens
AEKEFQGKA

SEQ ID NO: 602402 - protein, 9 aa, Homo Sapiens
CFECLKTIQ

SEQ ID NO: 602403 - protein, 9 aa, Homo Sapiens
KKAKYILLL

SEQ ID NO: 602404 - protein, 9 aa, Homo Sapiens
DAGSQRALR

SEQ ID NO: 602405 - protein, 9 aa, Homo Sapiens
LPVRMVFSS

SEQ ID NO: 602406 - protein, 9 aa, Homo Sapiens
RMCIKECLR

SEQ ID NO: 602407 - protein, 9 aa, Homo Sapiens
QSTNGPCPP

SEQ ID NO: 602408 - protein, 9 aa, Homo Sapiens
TASAGTREQ

SEQ ID NO: 602409 - protein, 9 aa, Homo Sapiens
VEDCFCPEG

SEQ ID NO: 602410 - protein, 9 aa, Homo Sapiens
WRLDLWPVS

SEQ ID NO: 602411 - protein, 9 aa, Homo Sapiens
GASMWINDM

SEQ ID NO: 602412 - protein, 9 aa, Homo Sapiens
ATQNPENRQ

SEQ ID NO: 602413 - protein, 9 aa, Homo Sapiens
WATQNPENR

SEQ ID NO: 602414 - protein, 9 aa, Homo Sapiens
LALAKLATS

SEQ ID NO: 602415 - protein, 9 aa, Homo Sapiens
ASMWINDMK

SEQ ID NO: 602416 - protein, 9 aa, Homo Sapiens
KKNGHVSCY

SEQ ID NO: 602417 - protein, 9 aa, Homo Sapiens
RDLPVRMVF

SEQ ID NO: 602418 - protein, 9 aa, Homo Sapiens
NLTGYYRYV

SEQ ID NO: 602419 - protein, 9 aa, Homo Sapiens
RPSFNKLSD

SEQ ID NO: 602420 - protein, 9 aa, Homo Sapiens
KPRIDSLVK

SEQ ID NO: 602421 - protein, 9 aa, Homo Sapiens
KYSYLRQHE

SEQ ID NO: 602422 - protein, 9 aa, Homo Sapiens
DVSKGSISF

SEQ ID NO: 602423 - protein, 9 aa, Homo Sapiens
LWRLVLAQH

SEQ ID NO: 602424 - protein, 9 aa, Homo Sapiens
ASQEQAATE

SEQ ID NO: 602425 - protein, 9 aa, Homo Sapiens
LFSSLITEL

SEQ ID NO: 602426 - protein, 9 aa, Homo Sapiens
NSEWATQNP

SEQ ID NO: 602427 - protein, 9 aa, Homo Sapiens
ILLDSCLHN

SEQ ID NO: 602428 - protein, 9 aa, Homo Sapiens
QCMVYQYGH

SEQ ID NO: 602429 - protein, 9 aa, Homo Sapiens
QTASAGTRE

SEQ ID NO: 602430 - protein, 9 aa, Homo Sapiens
RESFRELGD

SEQ ID NO: 602431 - protein, 9 aa, Homo Sapiens
EFYSLQEQH

SEQ ID NO: 602432 - protein, 9 aa, Homo Sapiens
PESDHTLYP

SEQ ID NO: 602433 - protein, 9 aa, Homo Sapiens
LFAVMWWLV

SEQ ID NO: 602434 - protein, 9 aa, Homo Sapiens
CFLSDISDA

SEQ ID NO: 602435 - protein, 9 aa, Homo Sapiens
CVEDCFCPE

SEQ ID NO: 602436 - protein, 9 aa, Homo Sapiens
PMVCILAPV

SEQ ID NO: 602437 - protein, 9 aa, Homo Sapiens
QGLVAGVGL

SEQ ID NO: 602438 - protein, 9 aa, Homo Sapiens
KLSDNCKGK

SEQ ID NO: 602439 - protein, 9 aa, Homo Sapiens
YRCRFRSYT

SEQ ID NO: 602440 - protein, 9 aa, Homo Sapiens
VPSSPEPPP

SEQ ID NO: 602441 - protein, 9 aa, Homo Sapiens
CQPYRSEFY

SEQ ID NO: 602442 - protein, 9 aa, Homo Sapiens
VAGRLLYCL

SEQ ID NO: 602443 - protein, 9 aa, Homo Sapiens
FALLDAGSQ

SEQ ID NO: 602444 - protein, 9 aa, Homo Sapiens
REQRPQGWG

SEQ ID NO: 602445 - protein, 9 aa, Homo Sapiens
SPEPPPSSQ

SEQ ID NO: 602446 - protein, 9 aa, Homo Sapiens
SPESDHTLY

SEQ ID NO: 602447 - protein, 9 aa, Homo Sapiens
NLGSDPSHS

SEQ ID NO: 602448 - protein, 9 aa, Homo Sapiens
SKGSISFQT

SEQ ID NO: 602449 - protein, 9 aa, Homo Sapiens
ASSGGELVS

SEQ ID NO: 602450 - protein, 9 aa, Homo Sapiens
EFQGKARLQ

SEQ ID NO: 602451 - protein, 9 aa, Homo Sapiens
YVSQKNMED

SEQ ID NO: 602452 - protein, 9 aa, Homo Sapiens
EQGKTVEET

SEQ ID NO: 602453 - protein, 9 aa, Homo Sapiens
GLLHALLKL

SEQ ID NO: 602454 - protein, 9 aa, Homo Sapiens
SQMPYTRMC

SEQ ID NO: 602455 - protein, 9 aa, Homo Sapiens
RPQGWGWGA

SEQ ID NO: 602456 - protein, 9 aa, Homo Sapiens
HLVYRESFR

SEQ ID NO: 602457 - protein, 9 aa, Homo Sapiens
LLLDIVAAD

SEQ ID NO: 602458 - protein, 9 aa, Homo Sapiens
YTRMCIKEC

SEQ ID NO: 602459 - protein, 9 aa, Homo Sapiens
SVRELRSAL

SEQ ID NO: 602460 - protein, 9 aa, Homo Sapiens
EAAAEKEFQ

SEQ ID NO: 602461 - protein, 9 aa, Homo Sapiens
MQNSEWATQ

SEQ ID NO: 602462 - protein, 9 aa, Homo Sapiens
EEAGMLSLP

SEQ ID NO: 602463 - protein, 9 aa, Homo Sapiens
GSGPKKNGH

SEQ ID NO: 602464 - protein, 9 aa, Homo Sapiens
DLCQPYRSE

SEQ ID NO: 602465 - protein, 9 aa, Homo Sapiens
YGHFSWDLA

SEQ ID NO: 602466 - protein, 9 aa, Homo Sapiens
RIDSLVKVG

SEQ ID NO: 602467 - protein, 9 aa, Homo Sapiens
SSPEPPPSS

SEQ ID NO: 602468 - protein, 9 aa, Homo Sapiens
RYVSQKNME

SEQ ID NO: 602469 - protein, 9 aa, Homo Sapiens
ELDAGHVKL

SEQ ID NO: 602470 - protein, 9 aa, Homo Sapiens
LQGLVAGVG

SEQ ID NO: 602471 - protein, 9 aa, Homo Sapiens
DLWPVSLLV

SEQ ID NO: 602472 - protein, 9 aa, Homo Sapiens
SWLLFAVMW

SEQ ID NO: 602473 - protein, 9 aa, Homo Sapiens
LWPVSLLVP

SEQ ID NO: 602474 - protein, 9 aa, Homo Sapiens
AHAWCSPCG

SEQ ID NO: 602475 - protein, 9 aa, Homo Sapiens
SSPESDHTL

SEQ ID NO: 602476 - protein, 9 aa, Homo Sapiens
AGHVKLTVN

SEQ ID NO: 602477 - protein, 9 aa, Homo Sapiens
LSGCRLLFL

SEQ ID NO: 602478 - protein, 9 aa, Homo Sapiens
LLHALLKLM

SEQ ID NO: 602479 - protein, 9 aa, Homo Sapiens
KLATSYVSQ

SEQ ID NO: 602480 - protein, 9 aa, Homo Sapiens
LDAGSQRAL

SEQ ID NO: 602481 - protein, 9 aa, Homo Sapiens
TRMCIKECL

SEQ ID NO: 602482 - protein, 9 aa, Homo Sapiens
PPPSSQTAS

SEQ ID NO: 602483 - protein, 9 aa, Homo Sapiens
DNCKGKAHA

SEQ ID NO: 602484 - protein, 9 aa, Homo Sapiens
DALFTMTQS

SEQ ID NO: 602485 - protein, 9 aa, Homo Sapiens
SSGGELVSL

SEQ ID NO: 602486 - protein, 9 aa, Homo Sapiens
AWRLDLWPV

SEQ ID NO: 602487 - protein, 9 aa, Homo Sapiens
VAGVGLAAS

SEQ ID NO: 602488 - protein, 9 aa, Homo Sapiens
ATEIPSLEE

SEQ ID NO: 602489 - protein, 9 aa, Homo Sapiens
HYYRRNKLI

SEQ ID NO: 602490 - protein, 9 aa, Homo Sapiens
NGPCPPLLA

SEQ ID NO: 602491 - protein, 9 aa, Homo Sapiens
PRNYEQRLE

SEQ ID NO: 602492 - protein, 9 aa, Homo Sapiens
CFHYYRRNK

SEQ ID NO: 602493 - protein, 9 aa, Homo Sapiens
LELDAGHVK

SEQ ID NO: 602494 - protein, 9 aa, Homo Sapiens
FQTEEKIHG

SEQ ID NO: 602495 - protein, 9 aa, Homo Sapiens
RSYTSPNVR

SEQ ID NO: 602496 - protein, 9 aa, Homo Sapiens
HAWCSPCGR

SEQ ID NO: 602497 - protein, 9 aa, Homo Sapiens
VCVTGLLHA

SEQ ID NO: 602498 - protein, 9 aa, Homo Sapiens
LIYRCRFRS

SEQ ID NO: 602499 - protein, 9 aa, Homo Sapiens
QHWMERLKT

SEQ ID NO: 602500 - protein, 9 aa, Homo Sapiens
RFRSYTSPN

SEQ ID NO: 602501 - protein, 9 aa, Homo Sapiens
GWGWGAWRL

SEQ ID NO: 602502 - protein, 9 aa, Homo Sapiens
PYKCNRCDH

SEQ ID NO: 602503 - protein, 9 aa, Homo Sapiens
FHYYRRNKL

SEQ ID NO: 602504 - protein, 9 aa, Homo Sapiens
KPYKCNRCD

SEQ ID NO: 602505 - protein, 9 aa, Homo Sapiens
LYLGIEEVR

SEQ ID NO: 602506 - protein, 9 aa, Homo Sapiens
GTPSVRELR

SEQ ID NO: 602507 - protein, 9 aa, Homo Sapiens
RLFSSLITE

SEQ ID NO: 602508 - protein, 9 aa, Homo Sapiens
SQEQAATEI

SEQ ID NO: 602509 - protein, 9 aa, Homo Sapiens
HVFVAGRLL

SEQ ID NO: 602510 - protein, 9 aa, Homo Sapiens
ECNYGTMES

SEQ ID NO: 602511 - protein, 9 aa, Homo Sapiens
NTGNLGSDP

SEQ ID NO: 602512 - protein, 9 aa, Homo Sapiens
KEGASMWIN

SEQ ID NO: 602513 - protein, 9 aa, Homo Sapiens
PRIDSLVKV

SEQ ID NO: 602514 - protein, 9 aa, Homo Sapiens
VHRPAPRNY

SEQ ID NO: 602515 - protein, 9 aa, Homo Sapiens
LLYCLNIIF

SEQ ID NO: 602516 - protein, 9 aa, Homo Sapiens
PQSSPESDH

SEQ ID NO: 602517 - protein, 9 aa, Homo Sapiens
VEETADLSL

SEQ ID NO: 602518 - protein, 9 aa, Homo Sapiens
EFVVLALAK

SEQ ID NO: 602519 - protein, 9 aa, Homo Sapiens
YSYLRQHER

SEQ ID NO: 602520 - protein, 9 aa, Homo Sapiens
WRLVLAQHW

SEQ ID NO: 602521 - protein, 9 aa, Homo Sapiens
AATEIPSLE

SEQ ID NO: 602522 - protein, 9 aa, Homo Sapiens
HKPRIDSLV

SEQ ID NO: 602523 - protein, 9 aa, Homo Sapiens
PNLTGYYRY

SEQ ID NO: 602524 - protein, 9 aa, Homo Sapiens
FVVLALAKL

SEQ ID NO: 602525 - protein, 9 aa, Homo Sapiens
QCGSQKGYH

SEQ ID NO: 602526 - protein, 9 aa, Homo Sapiens
FSSLITELT

SEQ ID NO: 602527 - protein, 9 aa, Homo Sapiens
QGCFHYYRR

SEQ ID NO: 602528 - protein, 9 aa, Homo Sapiens
TGLLHALLK

SEQ ID NO: 602529 - protein, 9 aa, Homo Sapiens
CRLLFLFLS

SEQ ID NO: 602530 - protein, 9 aa, Homo Sapiens
FLQLQGLVA

SEQ ID NO: 602531 - protein, 9 aa, Homo Sapiens
IDSLVKVGT

SEQ ID NO: 602532 - protein, 9 aa, Homo Sapiens
FAVMWWLVA

SEQ ID NO: 602533 - protein, 9 aa, Homo Sapiens
RLLYCLNII

SEQ ID NO: 602534 - protein, 9 aa, Homo Sapiens
VFVAGRLLY

SEQ ID NO: 602535 - protein, 9 aa, Homo Sapiens
KFFLQLQGL

SEQ ID NO: 602536 - protein, 9 aa, Homo Sapiens
PCPPLLAIM

SEQ ID NO: 602537 - protein, 9 aa, Homo Sapiens
TNGPCPPLL

SEQ ID NO: 602538 - protein, 9 aa, Homo Sapiens
ALFTMTQSG

SEQ ID NO: 602539 - protein, 9 aa, Homo Sapiens
SFNKLSDNC

SEQ ID NO: 602540 - protein, 9 aa, Homo Sapiens
VERGGGDGT

SEQ ID NO: 602541 - protein, 9 aa, Homo Sapiens
GPCPPLLAI

SEQ ID NO: 602542 - protein, 9 aa, Homo Sapiens
NYEQRLEHI

SEQ ID NO: 602543 - protein, 9 aa, Homo Sapiens
VGLAASFAV

SEQ ID NO: 602544 - protein, 9 aa, Homo Sapiens
RLDLWPVSL

SEQ ID NO: 602545 - protein, 9 aa, Homo Sapiens
NMTLQCGSQ

SEQ ID NO: 602546 - protein, 9 aa, Homo Sapiens
NIVDDFQEC

SEQ ID NO: 602547 - protein, 9 aa, Homo Sapiens
ISFQTEEKI

SEQ ID NO: 602548 - protein, 9 aa, Homo Sapiens
PPSSQTASA

SEQ ID NO: 602549 - protein, 9 aa, Homo Sapiens
PRQGCFHYY

SEQ ID NO: 602550 - protein, 9 aa, Homo Sapiens
QERQENTGN

SEQ ID NO: 602551 - protein, 9 aa, Homo Sapiens
CQVVACVED

SEQ ID NO: 602552 - protein, 9 aa, Homo Sapiens
EGASMWIND

SEQ ID NO: 602553 - protein, 9 aa, Homo Sapiens
GSISFQTEE

SEQ ID NO: 602554 - protein, 9 aa, Homo Sapiens
NRCDHACTQ

SEQ ID NO: 602555 - protein, 9 aa, Homo Sapiens
YILLLDIVA

SEQ ID NO: 602556 - protein, 9 aa, Homo Sapiens
FSSTCYRAE

SEQ ID NO: 602557 - protein, 9 aa, Homo Sapiens
STNGPCPPL

SEQ ID NO: 602558 - protein, 9 aa, Homo Sapiens
LASQEQAAT

SEQ ID NO: 602559 - protein, 9 aa, Homo Sapiens
RLLFLFLSP

SEQ ID NO: 602560 - protein, 9 aa, Homo Sapiens
VKFFLQLQG

SEQ ID NO: 602561 - protein, 9 aa, Homo Sapiens
EGTPSVREL

SEQ ID NO: 602562 - protein, 9 aa, Homo Sapiens
VAIVVKFFL

SEQ ID NO: 602563 - protein, 9 aa, Homo Sapiens
THHLVYRES

SEQ ID NO: 602564 - protein, 9 aa, Homo Sapiens
HTLYPLQSP

SEQ ID NO: 602565 - protein, 9 aa, Homo Sapiens
MVCILAPVL

SEQ ID NO: 602566 - protein, 9 aa, Homo Sapiens
KNGHVSCYN

SEQ ID NO: 602567 - protein, 9 aa, Homo Sapiens
LPRPEEAGM

SEQ ID NO: 602568 - protein, 9 aa, Homo Sapiens
QVVACVEDC

SEQ ID NO: 602569 - protein, 9 aa, Homo Sapiens
CPPLLAIMN

SEQ ID NO: 602570 - protein, 9 aa, Homo Sapiens
TREQRPQGW

SEQ ID NO: 602571 - protein, 9 aa, Homo Sapiens
ATFALLDAG

SEQ ID NO: 602572 - protein, 9 aa, Homo Sapiens
TLLTPFSLT

SEQ ID NO: 602573 - protein, 9 aa, Homo Sapiens
QMPYTRMCI

SEQ ID NO: 602574 - protein, 9 aa, Homo Sapiens
PEPPPSSQT

SEQ ID NO: 602575 - protein, 9 aa, Homo Sapiens
LCQPYRSEF

SEQ ID NO: 602576 - protein, 9 aa, Homo Sapiens
AAAEKEFQG

SEQ ID NO: 602577 - protein, 9 aa, Homo Sapiens
HVKLTVNLD

SEQ ID NO: 602578 - protein, 9 aa, Homo Sapiens
MVFSSTCYR

SEQ ID NO: 602579 - protein, 9 aa, Homo Sapiens
ISDALFTMT

SEQ ID NO: 602580 - protein, 9 aa, Homo Sapiens
PYRSEFYSL

SEQ ID NO: 602581 - protein, 9 aa, Homo Sapiens
YRESFRELG

SEQ ID NO: 602582 - protein, 9 aa, Homo Sapiens
VRMVFSSTC

SEQ ID NO: 602583 - protein, 9 aa, Homo Sapiens
YLGIEEVRA

SEQ ID NO: 602584 - protein, 9 aa, Homo Sapiens
HWMERLKTV

SEQ ID NO: 602585 - protein, 9 aa, Homo Sapiens
VACVEDCFC

SEQ ID NO: 602586 - protein, 9 aa, Homo Sapiens
GCRLLFLFL

SEQ ID NO: 602587 - protein, 9 aa, Homo Sapiens
EDCFCPEGT

SEQ ID NO: 602588 - protein, 9 aa, Homo Sapiens
KEFQGKARL

SEQ ID NO: 602589 - protein, 9 aa, Homo Sapiens
MPYTRMCIK

SEQ ID NO: 602590 - protein, 9 aa, Homo Sapiens
WLDKWMLTG

SEQ ID NO: 602591 - protein, 9 aa, Homo Sapiens
SKEKGSHTL

SEQ ID NO: 602592 - protein, 9 aa, Homo Sapiens
QFHVKAYNE

SEQ ID NO: 602593 - protein, 9 aa, Homo Sapiens
NIPFFETVF

SEQ ID NO: 602594 - protein, 9 aa, Homo Sapiens
FLLRWQQEI

SEQ ID NO: 602595 - protein, 9 aa, Homo Sapiens
DLRRLRPHA

SEQ ID NO: 602596 - protein, 9 aa, Homo Sapiens
PGQSDNLTI

SEQ ID NO: 602597 - protein, 9 aa, Homo Sapiens
VRVTMERAL

SEQ ID NO: 602598 - protein, 9 aa, Homo Sapiens
SGARKRHLS

SEQ ID NO: 602599 - protein, 9 aa, Homo Sapiens
DKWMLTGKQ

SEQ ID NO: 602600 - protein, 9 aa, Homo Sapiens
GTRCSFYGT

SEQ ID NO: 602601 - protein, 9 aa, Homo Sapiens
LDSYSEDGA

SEQ ID NO: 602602 - protein, 9 aa, Homo Sapiens
CAVVANIVL

SEQ ID NO: 602603 - protein, 9 aa, Homo Sapiens
PPGLPHPCM

SEQ ID NO: 602604 - protein, 9 aa, Homo Sapiens
EYQFHVKAY

SEQ ID NO: 602605 - protein, 9 aa, Homo Sapiens
RKVLHDNIQ

SEQ ID NO: 602606 - protein, 9 aa, Homo Sapiens
PGFERSTCE

SEQ ID NO: 602607 - protein, 9 aa, Homo Sapiens
KYFLKMEMG

SEQ ID NO: 602608 - protein, 9 aa, Homo Sapiens
KVLKPLSVI

SEQ ID NO: 602609 - protein, 9 aa, Homo Sapiens
TCNRRKNEV

SEQ ID NO: 602610 - protein, 9 aa, Homo Sapiens
KNEVRKGGA

SEQ ID NO: 602611 - protein, 9 aa, Homo Sapiens
TLVRHQRTD

SEQ ID NO: 602612 - protein, 9 aa, Homo Sapiens
HLQRQKGDW

SEQ ID NO: 602613 - protein, 9 aa, Homo Sapiens
LQRQKGDWV

SEQ ID NO: 602614 - protein, 9 aa, Homo Sapiens
TRCSFYGTV

SEQ ID NO: 602615 - protein, 9 aa, Homo Sapiens
SSQIYESMA

SEQ ID NO: 602616 - protein, 9 aa, Homo Sapiens
EDGAKSLKG

SEQ ID NO: 602617 - protein, 9 aa, Homo Sapiens
RPHAGDSGP

SEQ ID NO: 602618 - protein, 9 aa, Homo Sapiens
RKNEVRKGG

SEQ ID NO: 602619 - protein, 9 aa, Homo Sapiens
PHAGDSGPL

SEQ ID NO: 602620 - protein, 9 aa, Homo Sapiens
KMQLHGIGS

SEQ ID NO: 602621 - protein, 9 aa, Homo Sapiens
SNKPGQSDN

SEQ ID NO: 602622 - protein, 9 aa, Homo Sapiens
SYNIPFFET

SEQ ID NO: 602623 - protein, 9 aa, Homo Sapiens
TGKQFGLLS

SEQ ID NO: 602624 - protein, 9 aa, Homo Sapiens
NIKYVISKE

SEQ ID NO: 602625 - protein, 9 aa, Homo Sapiens
ITSSSLLLN

SEQ ID NO: 602626 - protein, 9 aa, Homo Sapiens
AGIKYFLKM

SEQ ID NO: 602627 - protein, 9 aa, Homo Sapiens
QIYESMAIK

SEQ ID NO: 602628 - protein, 9 aa, Homo Sapiens
RKGISGKRP

SEQ ID NO: 602629 - protein, 9 aa, Homo Sapiens
HSGMCVCPP

SEQ ID NO: 602630 - protein, 9 aa, Homo Sapiens
PDITWFQIL

SEQ ID NO: 602631 - protein, 9 aa, Homo Sapiens
PLSVIMGVF

SEQ ID NO: 602632 - protein, 9 aa, Homo Sapiens
KPITIGSHA

SEQ ID NO: 602633 - protein, 9 aa, Homo Sapiens
RKRHLSSTS

SEQ ID NO: 602634 - protein, 9 aa, Homo Sapiens
NVTGTQITS

SEQ ID NO: 602635 - protein, 9 aa, Homo Sapiens
TIGSHAHGD

SEQ ID NO: 602636 - protein, 9 aa, Homo Sapiens
HGIGSQDPS

SEQ ID NO: 602637 - protein, 9 aa, Homo Sapiens
LNVDISCDV

SEQ ID NO: 602638 - protein, 9 aa, Homo Sapiens
GMILIYLLP

SEQ ID NO: 602639 - protein, 9 aa, Homo Sapiens
VANIVLTVV

SEQ ID NO: 602640 - protein, 9 aa, Homo Sapiens
KNKGMILIY

SEQ ID NO: 602641 - protein, 9 aa, Homo Sapiens
LDHPDWEEA

SEQ ID NO: 602642 - protein, 9 aa, Homo Sapiens
WQQEIQKLT

SEQ ID NO: 602643 - protein, 9 aa, Homo Sapiens
GMCVCPPPP

SEQ ID NO: 602644 - protein, 9 aa, Homo Sapiens
RTDTGEKPY

SEQ ID NO: 602645 - protein, 9 aa, Homo Sapiens
HRKVLHDNI

SEQ ID NO: 602646 - protein, 9 aa, Homo Sapiens
LLDHPDWEE

SEQ ID NO: 602647 - protein, 9 aa, Homo Sapiens
HYLKPDITW

SEQ ID NO: 602648 - protein, 9 aa, Homo Sapiens
QLLKLYSER

SEQ ID NO: 602649 - protein, 9 aa, Homo Sapiens
IGSHAHGDQ

SEQ ID NO: 602650 - protein, 9 aa, Homo Sapiens
GDWVIPPIN

SEQ ID NO: 602651 - protein, 9 aa, Homo Sapiens
DISCDVCDE

SEQ ID NO: 602652 - protein, 9 aa, Homo Sapiens
KGDWVIPPI

SEQ ID NO: 602653 - protein, 9 aa, Homo Sapiens
ARKRHLSST

SEQ ID NO: 602654 - protein, 9 aa, Homo Sapiens
LLKLYSERK

SEQ ID NO: 602655 - protein, 9 aa, Homo Sapiens
EVLNGLLDH

SEQ ID NO: 602656 - protein, 9 aa, Homo Sapiens
DHPDWEEAV

SEQ ID NO: 602657 - protein, 9 aa, Homo Sapiens
IELRGNWLE

SEQ ID NO: 602658 - protein, 9 aa, Homo Sapiens
TQIELRGNW

SEQ ID NO: 602659 - protein, 9 aa, Homo Sapiens
AVVANIVLT

SEQ ID NO: 602660 - protein, 9 aa, Homo Sapiens
RWQQEIQKL

SEQ ID NO: 602661 - protein, 9 aa, Homo Sapiens
YNIPFFETV

SEQ ID NO: 602662 - protein, 9 aa, Homo Sapiens
HQRTDTGEK

SEQ ID NO: 602663 - protein, 9 aa, Homo Sapiens
QKNKGMILI

SEQ ID NO: 602664 - protein, 9 aa, Homo Sapiens
KRHLSSTSL

SEQ ID NO: 602665 - protein, 9 aa, Homo Sapiens
YQFHVKAYN

SEQ ID NO: 602666 - protein, 9 aa, Homo Sapiens
HRLFLLRWQ

SEQ ID NO: 602667 - protein, 9 aa, Homo Sapiens
IPSSQIYES

SEQ ID NO: 602668 - protein, 9 aa, Homo Sapiens
NRRKNEVRK

SEQ ID NO: 602669 - protein, 9 aa, Homo Sapiens
VSSCAVVAN

SEQ ID NO: 602670 - protein, 9 aa, Homo Sapiens
GHLQRQKGD

SEQ ID NO: 602671 - protein, 9 aa, Homo Sapiens
PREGHVYLW

SEQ ID NO: 602672 - protein, 9 aa, Homo Sapiens
LLRQLLKLY

SEQ ID NO: 602673 - protein, 9 aa, Homo Sapiens
LYSERKLED

SEQ ID NO: 602674 - protein, 9 aa, Homo Sapiens
GSHAHGDQY

SEQ ID NO: 602675 - protein, 9 aa, Homo Sapiens
SHAHGDQYK

SEQ ID NO: 602676 - protein, 9 aa, Homo Sapiens
VSINFKDSQ

SEQ ID NO: 602677 - protein, 9 aa, Homo Sapiens
RSSQKNKGM

SEQ ID NO: 602678 - protein, 9 aa, Homo Sapiens
RLRPHAGDS

SEQ ID NO: 602679 - protein, 9 aa, Homo Sapiens
HLSSTSLAS

SEQ ID NO: 602680 - protein, 9 aa, Homo Sapiens
NCLPGFERS

SEQ ID NO: 602681 - protein, 9 aa, Homo Sapiens
IPFFETVFN

SEQ ID NO: 602682 - protein, 9 aa, Homo Sapiens
MQLHGIGSQ

SEQ ID NO: 602683 - protein, 9 aa, Homo Sapiens
LHDNIQGIT

SEQ ID NO: 602684 - protein, 9 aa, Homo Sapiens
TQITSSSLL

SEQ ID NO: 602685 - protein, 9 aa, Homo Sapiens
TRVHSNKPG

SEQ ID NO: 602686 - protein, 9 aa, Homo Sapiens
NGLLDHPDW

SEQ ID NO: 602687 - protein, 9 aa, Homo Sapiens
CPPPPGLPH

SEQ ID NO: 602688 - protein, 9 aa, Homo Sapiens
MCVCPPPPG

SEQ ID NO: 602689 - protein, 9 aa, Homo Sapiens
FYGTVIYQK

SEQ ID NO: 602690 - protein, 9 aa, Homo Sapiens
KRHRKVLHD

SEQ ID NO: 602691 - protein, 9 aa, Homo Sapiens
LHGIGSQDP

SEQ ID NO: 602692 - protein, 9 aa, Homo Sapiens
KDSQFAEDY

SEQ ID NO: 602693 - protein, 9 aa, Homo Sapiens
LAETPREGH

SEQ ID NO: 602694 - protein, 9 aa, Homo Sapiens
SEDGAKSLK

SEQ ID NO: 602695 - protein, 9 aa, Homo Sapiens
QLHGIGSQD

SEQ ID NO: 602696 - protein, 9 aa, Homo Sapiens
TTCNRRKNE

SEQ ID NO: 602697 - protein, 9 aa, Homo Sapiens
LRPHAGDSG

SEQ ID NO: 602698 - protein, 9 aa, Homo Sapiens
NKPGQSDNL

SEQ ID NO: 602699 - protein, 9 aa, Homo Sapiens
NCSGARKRH

SEQ ID NO: 602700 - protein, 9 aa, Homo Sapiens
IGSQDPSTK

SEQ ID NO: 602701 - protein, 9 aa, Homo Sapiens
HRSSQKNKG

SEQ ID NO: 602702 - protein, 9 aa, Homo Sapiens
CVCPPPPGL

SEQ ID NO: 602703 - protein, 9 aa, Homo Sapiens
FPTHDFPTR

SEQ ID NO: 602704 - protein, 9 aa, Homo Sapiens
QKGDWVIPP

SEQ ID NO: 602705 - protein, 9 aa, Homo Sapiens
VVSINFKDS

SEQ ID NO: 602706 - protein, 9 aa, Homo Sapiens
HVFPTHDFP

SEQ ID NO: 602707 - protein, 9 aa, Homo Sapiens
ETPREGHVY

SEQ ID NO: 602708 - protein, 9 aa, Homo Sapiens
WLECLPVEL

SEQ ID NO: 602709 - protein, 9 aa, Homo Sapiens
REGHVYLWR

SEQ ID NO: 602710 - protein, 9 aa, Homo Sapiens
LFLLRWQQE

SEQ ID NO: 602711 - protein, 9 aa, Homo Sapiens
SQKNKGMIL

SEQ ID NO: 602712 - protein, 9 aa, Homo Sapiens
ITWFQILLN

SEQ ID NO: 602713 - protein, 9 aa, Homo Sapiens
LKKMQLHGI

SEQ ID NO: 602714 - protein, 9 aa, Homo Sapiens
RSTCERNID

SEQ ID NO: 602715 - protein, 9 aa, Homo Sapiens
SSQKNKGMI

SEQ ID NO: 602716 - protein, 9 aa, Homo Sapiens
HSNKPGQSD

SEQ ID NO: 602717 - protein, 9 aa, Homo Sapiens
SSLDSYSED

SEQ ID NO: 602718 - protein, 9 aa, Homo Sapiens
LRGNWLECL

SEQ ID NO: 602719 - protein, 9 aa, Homo Sapiens
TPREGHVYL

SEQ ID NO: 602720 - protein, 9 aa, Homo Sapiens
HVKAYNEKG

SEQ ID NO: 602721 - protein, 9 aa, Homo Sapiens
INFKDSQFA

SEQ ID NO: 602722 - protein, 9 aa, Homo Sapiens
LRRLRPHAG

SEQ ID NO: 602723 - protein, 9 aa, Homo Sapiens
YFLKMEMGS

SEQ ID NO: 602724 - protein, 9 aa, Homo Sapiens
GIPSSQIYE

SEQ ID NO: 602725 - protein, 9 aa, Homo Sapiens
MLTGKQFGL

SEQ ID NO: 602726 - protein, 9 aa, Homo Sapiens
RVHSNKPGQ

SEQ ID NO: 602727 - protein, 9 aa, Homo Sapiens
LDKWMLTGK

SEQ ID NO: 602728 - protein, 9 aa, Homo Sapiens
FKDSQFAED

SEQ ID NO: 602729 - protein, 9 aa, Homo Sapiens
IVSSCAVVA

SEQ ID NO: 602730 - protein, 9 aa, Homo Sapiens
LKPDITWFQ

SEQ ID NO: 602731 - protein, 9 aa, Homo Sapiens
GNWLECLPV

SEQ ID NO: 602732 - protein, 9 aa, Homo Sapiens
FFETVFNAS

SEQ ID NO: 602733 - protein, 9 aa, Homo Sapiens
YVISKEKGS

SEQ ID NO: 602734 - protein, 9 aa, Homo Sapiens
CNCLPGFER

SEQ ID NO: 602735 - protein, 9 aa, Homo Sapiens
KLAETPREG

SEQ ID NO: 602736 - protein, 9 aa, Homo Sapiens
SYSEDGAKS

SEQ ID NO: 602737 - protein, 9 aa, Homo Sapiens
NWLECLPVE

SEQ ID NO: 602738 - protein, 9 aa, Homo Sapiens
FHYLKPDIT

SEQ ID NO: 602739 - protein, 9 aa, Homo Sapiens
SGHLQRQKG

SEQ ID NO: 602740 - protein, 9 aa, Homo Sapiens
SFYGTVIYQ

SEQ ID NO: 602741 - protein, 9 aa, Homo Sapiens
YGTVIYQKP

SEQ ID NO: 602742 - protein, 9 aa, Homo Sapiens
VLKPLSVIM

SEQ ID NO: 602743 - protein, 9 aa, Homo Sapiens
RRKGISGKR

SEQ ID NO: 602744 - protein, 9 aa, Homo Sapiens
RHQRTDTGE

SEQ ID NO: 602745 - protein, 9 aa, Homo Sapiens
RQLLKLYSE

SEQ ID NO: 602746 - protein, 9 aa, Homo Sapiens
GIGSQDPST

SEQ ID NO: 602747 - protein, 9 aa, Homo Sapiens
IKYFLKMEM

SEQ ID NO: 602748 - protein, 9 aa, Homo Sapiens
HDNIQGITK

SEQ ID NO: 602749 - protein, 9 aa, Homo Sapiens
RPGAGEGPG

SEQ ID NO: 602750 - protein, 9 aa, Homo Sapiens
LRWQQEIQK

SEQ ID NO: 602751 - protein, 9 aa, Homo Sapiens
CLPGFERST

SEQ ID NO: 602752 - protein, 9 aa, Homo Sapiens
KGMILIYLL

SEQ ID NO: 602753 - protein, 9 aa, Homo Sapiens
VLNGLLDHP

SEQ ID NO: 602754 - protein, 9 aa, Homo Sapiens
YWASYNIPF

SEQ ID NO: 602755 - protein, 9 aa, Homo Sapiens
SQIYESMAI

SEQ ID NO: 602756 - protein, 9 aa, Homo Sapiens
ISGKRPGAG

SEQ ID NO: 602757 - protein, 9 aa, Homo Sapiens
KLYSERKLE

SEQ ID NO: 602758 - protein, 9 aa, Homo Sapiens
TMERALTAR

SEQ ID NO: 602759 - protein, 9 aa, Homo Sapiens
VHSNKPGQS

SEQ ID NO: 602760 - protein, 9 aa, Homo Sapiens
SGQEYQFHV

SEQ ID NO: 602761 - protein, 9 aa, Homo Sapiens
WASYNIPFF

SEQ ID NO: 602762 - protein, 9 aa, Homo Sapiens
ENVTGTQIT

SEQ ID NO: 602763 - protein, 9 aa, Homo Sapiens
RLFLLRWQQ

SEQ ID NO: 602764 - protein, 9 aa, Homo Sapiens
QQEIQKLTG

SEQ ID NO: 602765 - protein, 9 aa, Homo Sapiens
ISKEKGSHT

SEQ ID NO: 602766 - protein, 9 aa, Homo Sapiens
KYVISKEKG

SEQ ID NO: 602767 - protein, 9 aa, Homo Sapiens
GIKYFLKME

SEQ ID NO: 602768 - protein, 9 aa, Homo Sapiens
VKLAETPRE

SEQ ID NO: 602769 - protein, 9 aa, Homo Sapiens
KPLSVIMGV

SEQ ID NO: 602770 - protein, 9 aa, Homo Sapiens
GKQFGLLSL

SEQ ID NO: 602771 - protein, 9 aa, Homo Sapiens
GISGKRPGA

SEQ ID NO: 602772 - protein, 9 aa, Homo Sapiens
VCPPPPGLP

SEQ ID NO: 602773 - protein, 9 aa, Homo Sapiens
GLLDHPDWE

SEQ ID NO: 602774 - protein, 9 aa, Homo Sapiens
IYESMAIKL

SEQ ID NO: 602775 - protein, 9 aa, Homo Sapiens
RQKGDWVIP

SEQ ID NO: 602776 - protein, 9 aa, Homo Sapiens
KKETKVLKP

SEQ ID NO: 602777 - protein, 9 aa, Homo Sapiens
KPDITWFQI

SEQ ID NO: 602778 - protein, 9 aa, Homo Sapiens
YSERKLEDA

SEQ ID NO: 602779 - protein, 9 aa, Homo Sapiens
DDLRRLRPH

SEQ ID NO: 602780 - protein, 9 aa, Homo Sapiens
WTKPITIGS

SEQ ID NO: 602781 - protein, 9 aa, Homo Sapiens
GTVIYQKPQ

SEQ ID NO: 602782 - protein, 9 aa, Homo Sapiens
FPTHVFPTH

SEQ ID NO: 602783 - protein, 9 aa, Homo Sapiens
GQSDNLTIW

SEQ ID NO: 602784 - protein, 9 aa, Homo Sapiens
LENVTGTQI

SEQ ID NO: 602785 - protein, 9 aa, Homo Sapiens
QEYQFHVKA

SEQ ID NO: 602786 - protein, 9 aa, Homo Sapiens
QIELRGNWL

SEQ ID NO: 602787 - protein, 9 aa, Homo Sapiens
SGMCVCPPP

SEQ ID NO: 602788 - protein, 9 aa, Homo Sapiens
TKPITIGSH

SEQ ID NO: 602789 - protein, 9 aa, Homo Sapiens
DVCDEIAPW

SEQ ID NO: 602790 - protein, 9 aa, Homo Sapiens
SGKRPGAGE

SEQ ID NO: 602791 - protein, 9 aa, Homo Sapiens
ASSLDSYSE

SEQ ID NO: 602792 - protein, 9 aa, Homo Sapiens
FHVKAYNEK

SEQ ID NO: 602793 - protein, 9 aa, Homo Sapiens
ERSTCERNI

SEQ ID NO: 602794 - protein, 9 aa, Homo Sapiens
RGNWLECLP

SEQ ID NO: 602795 - protein, 9 aa, Homo Sapiens
FLKMEMGST

SEQ ID NO: 602796 - protein, 9 aa, Homo Sapiens
GVRVTMERA

SEQ ID NO: 602797 - protein, 9 aa, Homo Sapiens
LNGLLDHPD

SEQ ID NO: 602798 - protein, 9 aa, Homo Sapiens
LVRHQRTDT

SEQ ID NO: 602799 - protein, 9 aa, Homo Sapiens
GFERSTCER

SEQ ID NO: 602800 - protein, 9 aa, Homo Sapiens
SSGQEYQFH

SEQ ID NO: 602801 - protein, 9 aa, Homo Sapiens
KPGQSDNLT

SEQ ID NO: 602802 - protein, 9 aa, Homo Sapiens
CSFYGTVIY

SEQ ID NO: 602803 - protein, 9 aa, Homo Sapiens
AKRHRKVLH

SEQ ID NO: 602804 - protein, 9 aa, Homo Sapiens
IKYVISKEK

SEQ ID NO: 602805 - protein, 9 aa, Homo Sapiens
GQEYQFHVK

SEQ ID NO: 602806 - protein, 9 aa, Homo Sapiens
VRHQRTDTG

SEQ ID NO: 602807 - protein, 9 aa, Homo Sapiens
VAGIKYFLK

SEQ ID NO: 602808 - protein, 9 aa, Homo Sapiens
GARKRHLSS

SEQ ID NO: 602809 - protein, 9 aa, Homo Sapiens
ATTCNRRKN

SEQ ID NO: 602810 - protein, 9 aa, Homo Sapiens
EGHVYLWRH

SEQ ID NO: 602811 - protein, 9 aa, Homo Sapiens
LTGKQFGLL

SEQ ID NO: 602812 - protein, 9 aa, Homo Sapiens
NVDISCDVC

SEQ ID NO: 602813 - protein, 9 aa, Homo Sapiens
QDPQQEQER

SEQ ID NO: 602814 - protein, 9 aa, Homo Sapiens
KMEMGSTDC

SEQ ID NO: 602815 - protein, 9 aa, Homo Sapiens
THVFPTHDF

SEQ ID NO: 602816 - protein, 9 aa, Homo Sapiens
PITIGSHAH

SEQ ID NO: 602817 - protein, 9 aa, Homo Sapiens
YSEDGAKSL

SEQ ID NO: 602818 - protein, 9 aa, Homo Sapiens
ISCDVCDEI

SEQ ID NO: 602819 - protein, 9 aa, Homo Sapiens
AHSGMCVCP

SEQ ID NO: 602820 - protein, 9 aa, Homo Sapiens
FERSTCERN

SEQ ID NO: 602821 - protein, 9 aa, Homo Sapiens
RHRKVLHDN

SEQ ID NO: 602822 - protein, 9 aa, Homo Sapiens
PTHDFPTRD

SEQ ID NO: 602823 - protein, 9 aa, Homo Sapiens
RHLSSTSLA

SEQ ID NO: 602824 - protein, 9 aa, Homo Sapiens
WMLTGKQFG

SEQ ID NO: 602825 - protein, 9 aa, Homo Sapiens
QRQKGDWVI

SEQ ID NO: 602826 - protein, 9 aa, Homo Sapiens
GTQITSSSL

SEQ ID NO: 602827 - protein, 9 aa, Homo Sapiens
HPDWEEAVK

SEQ ID NO: 602828 - protein, 9 aa, Homo Sapiens
DTGEKPYEC

SEQ ID NO: 602829 - protein, 9 aa, Homo Sapiens
VDISCDVCD

SEQ ID NO: 602830 - protein, 9 aa, Homo Sapiens
VCDEIAPWH

SEQ ID NO: 602831 - protein, 9 aa, Homo Sapiens
QITSSSLLL

SEQ ID NO: 602832 - protein, 9 aa, Homo Sapiens
SINFKDSQF

SEQ ID NO: 602833 - protein, 9 aa, Homo Sapiens
VTMERALTA

SEQ ID NO: 602834 - protein, 9 aa, Homo Sapiens
VFPTHDFPT

SEQ ID NO: 602835 - protein, 9 aa, Homo Sapiens
SCDVCDEIA

SEQ ID NO: 602836 - protein, 9 aa, Homo Sapiens
TKVLKPLSV

SEQ ID NO: 602837 - protein, 9 aa, Homo Sapiens
VVANIVLTV

SEQ ID NO: 602838 - protein, 9 aa, Homo Sapiens
VTGTQITSS

SEQ ID NO: 602839 - protein, 9 aa, Homo Sapiens
PSSQIYESM

SEQ ID NO: 602840 - protein, 9 aa, Homo Sapiens
ELRGNWLEC

SEQ ID NO: 602841 - protein, 9 aa, Homo Sapiens
KKMQLHGIG

SEQ ID NO: 602842 - protein, 9 aa, Homo Sapiens
PFFETVFNA

SEQ ID NO: 602843 - protein, 9 aa, Homo Sapiens
DGVRVTMER

SEQ ID NO: 602844 - protein, 9 aa, Homo Sapiens
LLRWQQEIQ

SEQ ID NO: 602845 - protein, 9 aa, Homo Sapiens
CNRRKNEVR

SEQ ID NO: 602846 - protein, 9 aa, Homo Sapiens
NFKDSQFAE

SEQ ID NO: 602847 - protein, 9 aa, Homo Sapiens
DSQFAEDYI

SEQ ID NO: 602848 - protein, 9 aa, Homo Sapiens
RALTARDRV

SEQ ID NO: 602849 - protein, 9 aa, Homo Sapiens
SCAVVANIV

SEQ ID NO: 602850 - protein, 9 aa, Homo Sapiens
RRLRPHAGD

SEQ ID NO: 602851 - protein, 9 aa, Homo Sapiens
EKGIPSSQI

SEQ ID NO: 602852 - protein, 9 aa, Homo Sapiens
TDTGEKPYE

SEQ ID NO: 602853 - protein, 9 aa, Homo Sapiens
DITWFQILL

SEQ ID NO: 602854 - protein, 9 aa, Homo Sapiens
LPGFERSTC

SEQ ID NO: 602855 - protein, 9 aa, Homo Sapiens
LKPLSVIMG

SEQ ID NO: 602856 - protein, 9 aa, Homo Sapiens
HAGDSGPLA

SEQ ID NO: 602857 - protein, 9 aa, Homo Sapiens
QRTDTGEKP

SEQ ID NO: 602858 - protein, 9 aa, Homo Sapiens
VLHDNIQGI

SEQ ID NO: 602859 - protein, 9 aa, Homo Sapiens
KGISGKRPG

SEQ ID NO: 602860 - protein, 9 aa, Homo Sapiens
SQFAEDYIF

SEQ ID NO: 602861 - protein, 9 aa, Homo Sapiens
VISKEKGSH

SEQ ID NO: 602862 - protein, 9 aa, Homo Sapiens
NKGMILIYL

SEQ ID NO: 602863 - protein, 9 aa, Homo Sapiens
PPPGLPHPC

SEQ ID NO: 602864 - protein, 9 aa, Homo Sapiens
CDVCDEIAP

SEQ ID NO: 602865 - protein, 9 aa, Homo Sapiens
KETKVLKPL

SEQ ID NO: 602866 - protein, 9 aa, Homo Sapiens
ASYNIPFFE

SEQ ID NO: 602867 - protein, 9 aa, Homo Sapiens
RRKNEVRKG

SEQ ID NO: 602868 - protein, 9 aa, Homo Sapiens
PPPPGLPHP

SEQ ID NO: 602869 - protein, 9 aa, Homo Sapiens
ETKVLKPLS

SEQ ID NO: 602870 - protein, 9 aa, Homo Sapiens
SLDSYSEDG

SEQ ID NO: 602871 - protein, 9 aa, Homo Sapiens
QQEQERERD

SEQ ID NO: 602872 - protein, 9 aa, Homo Sapiens
KRPGAGEGP

SEQ ID NO: 602873 - protein, 9 aa, Homo Sapiens
ERALTARDR

SEQ ID NO: 602874 - protein, 9 aa, Homo Sapiens
GKRPGAGEG

SEQ ID NO: 602875 - protein, 9 aa, Homo Sapiens
TWFQILLNT

SEQ ID NO: 602876 - protein, 9 aa, Homo Sapiens
MERALTARD

SEQ ID NO: 602877 - protein, 9 aa, Homo Sapiens
RVTMERALT

SEQ ID NO: 602878 - protein, 9 aa, Homo Sapiens
LKMEMGSTD

SEQ ID NO: 602879 - protein, 9 aa, Homo Sapiens
NEVRKGGAL

SEQ ID NO: 602880 - protein, 9 aa, Homo Sapiens
IIVSSCAVV

SEQ ID NO: 602881 - protein, 9 aa, Homo Sapiens
ITIGSHAHG

SEQ ID NO: 602882 - protein, 9 aa, Homo Sapiens
DNIKYVISK

SEQ ID NO: 602883 - protein, 9 aa, Homo Sapiens
PTHVFPTHD

SEQ ID NO: 602884 - protein, 9 aa, Homo Sapiens
CSGARKRHL

SEQ ID NO: 602885 - protein, 9 aa, Homo Sapiens
KVLHDNIQG

SEQ ID NO: 602886 - protein, 9 aa, Homo Sapiens
KWMLTGKQF

SEQ ID NO: 602887 - protein, 9 aa, Homo Sapiens
KGIPSSQIY

SEQ ID NO: 602888 - protein, 9 aa, Homo Sapiens
KEKGSHTLK

SEQ ID NO: 602889 - protein, 9 aa, Homo Sapiens
LKLYSERKL

SEQ ID NO: 602890 - protein, 9 aa, Homo Sapiens
RCSFYGTVI

SEQ ID NO: 602891 - protein, 9 aa, Homo Sapiens
YLKPDITWF

SEQ ID NO: 602892 - protein, 9 aa, Homo Sapiens
TGTQITSSS

SEQ ID NO: 602893 - protein, 9 aa, Homo Sapiens
SSCAVVANI

SEQ ID NO: 602894 - protein, 9 aa, Homo Sapiens
DSYSEDGAK

SEQ ID NO: 602895 - protein, 9 aa, Homo Sapiens
AETPREGHV

SEQ ID NO: 602896 - protein, 9 aa, Homo Sapiens
LGTRCSFYG

SEQ ID NO: 602897 - protein, 9 aa, Homo Sapiens
LRQLLKLYS

SEQ ID NO: 602898 - protein, 9 aa, Homo Sapiens
YAPEITKAC

SEQ ID NO: 602899 - protein, 9 aa, Homo Sapiens
NCSDCGAEL

SEQ ID NO: 602900 - protein, 9 aa, Homo Sapiens
RSHSMSPDA

SEQ ID NO: 602901 - protein, 9 aa, Homo Sapiens
EPSVSKKTD

SEQ ID NO: 602902 - protein, 9 aa, Homo Sapiens
VFSAAICWI

SEQ ID NO: 602903 - protein, 9 aa, Homo Sapiens
QSDAGKQGR

SEQ ID NO: 602904 - protein, 9 aa, Homo Sapiens
FKRRTNLTK

SEQ ID NO: 602905 - protein, 9 aa, Homo Sapiens
PGLLHHHPP

SEQ ID NO: 602906 - protein, 9 aa, Homo Sapiens
RLHQRLPVK

SEQ ID NO: 602907 - protein, 9 aa, Homo Sapiens
RPPSRYLFQ

SEQ ID NO: 602908 - protein, 9 aa, Homo Sapiens
LNLGKFHSM

SEQ ID NO: 602909 - protein, 9 aa, Homo Sapiens
TAILWLNGS

SEQ ID NO: 602910 - protein, 9 aa, Homo Sapiens
FIVFSAAIC

SEQ ID NO: 602911 - protein, 9 aa, Homo Sapiens
TDLENEQTS

SEQ ID NO: 602912 - protein, 9 aa, Homo Sapiens
PKSSRPTLQ

SEQ ID NO: 602913 - protein, 9 aa, Homo Sapiens
RTQNSWTKD

SEQ ID NO: 602914 - protein, 9 aa, Homo Sapiens
TRSTGKLST

SEQ ID NO: 602915 - protein, 9 aa, Homo Sapiens
EQRHDKEDP

SEQ ID NO: 602916 - protein, 9 aa, Homo Sapiens
TYRYESSGY

SEQ ID NO: 602917 - protein, 9 aa, Homo Sapiens
AESANLNVS

SEQ ID NO: 602918 - protein, 9 aa, Homo Sapiens
EPSDAITHV

SEQ ID NO: 602919 - protein, 9 aa, Homo Sapiens
LLHKTSGCL

SEQ ID NO: 602920 - protein, 9 aa, Homo Sapiens
RGEEAQLCC

SEQ ID NO: 602921 - protein, 9 aa, Homo Sapiens
PNKSYSVQG

SEQ ID NO: 602922 - protein, 9 aa, Homo Sapiens
PSVAPSGLG

SEQ ID NO: 602923 - protein, 9 aa, Homo Sapiens
DRIIATLQS

SEQ ID NO: 602924 - protein, 9 aa, Homo Sapiens
ARRSQDLYC

SEQ ID NO: 602925 - protein, 9 aa, Homo Sapiens
ATDNGLLTP

SEQ ID NO: 602926 - protein, 9 aa, Homo Sapiens
PITTRWQHS

SEQ ID NO: 602927 - protein, 9 aa, Homo Sapiens
DFHFVYRSL

SEQ ID NO: 602928 - protein, 9 aa, Homo Sapiens
PEVRMMNGK

SEQ ID NO: 602929 - protein, 9 aa, Homo Sapiens
SKLAKCKPL

SEQ ID NO: 602930 - protein, 9 aa, Homo Sapiens
GSGTRRDSR

SEQ ID NO: 602931 - protein, 9 aa, Homo Sapiens
CQLMAPARL

SEQ ID NO: 602932 - protein, 9 aa, Homo Sapiens
CIIAGRESG

SEQ ID NO: 602933 - protein, 9 aa, Homo Sapiens
NLNGTYNKP

SEQ ID NO: 602934 - protein, 9 aa, Homo Sapiens
HPPEGATKL

SEQ ID NO: 602935 - protein, 9 aa, Homo Sapiens
NFSGNSLHC

SEQ ID NO: 602936 - protein, 9 aa, Homo Sapiens
LLFSALAQH

SEQ ID NO: 602937 - protein, 9 aa, Homo Sapiens
VVNLNPNAK

SEQ ID NO: 602938 - protein, 9 aa, Homo Sapiens
KGNHRIQIF

SEQ ID NO: 602939 - protein, 9 aa, Homo Sapiens
EDYMIHIIE

SEQ ID NO: 602940 - protein, 9 aa, Homo Sapiens
MRYYSSHYT

SEQ ID NO: 602941 - protein, 9 aa, Homo Sapiens
QIELNRLKA

SEQ ID NO: 602942 - protein, 9 aa, Homo Sapiens
GTYNKPRAK

SEQ ID NO: 602943 - protein, 9 aa, Homo Sapiens
HLGERACRC

SEQ ID NO: 602944 - protein, 9 aa, Homo Sapiens
SRYVQSLLD

SEQ ID NO: 602945 - protein, 9 aa, Homo Sapiens
PPAPGEGNF

SEQ ID NO: 602946 - protein, 9 aa, Homo Sapiens
MTAYWTNFA

SEQ ID NO: 602947 - protein, 9 aa, Homo Sapiens
IKLAYTQFG

SEQ ID NO: 602948 - protein, 9 aa, Homo Sapiens
LHCAQLPGQ

SEQ ID NO: 602949 - protein, 9 aa, Homo Sapiens
MKNTGVGPA

SEQ ID NO: 602950 - protein, 9 aa, Homo Sapiens
PSFKKLADM

SEQ ID NO: 602951 - protein, 9 aa, Homo Sapiens
VVFTHLCKF

SEQ ID NO: 602952 - protein, 9 aa, Homo Sapiens
LYVFHSLYP

SEQ ID NO: 602953 - protein, 9 aa, Homo Sapiens
VTSPGLLHH

SEQ ID NO: 602954 - protein, 9 aa, Homo Sapiens
LISNNIMFK

SEQ ID NO: 602955 - protein, 9 aa, Homo Sapiens
LALFRELIP

SEQ ID NO: 602956 - protein, 9 aa, Homo Sapiens
IVMDPLRGT

SEQ ID NO: 602957 - protein, 9 aa, Homo Sapiens
KFSHANAQK

SEQ ID NO: 602958 - protein, 9 aa, Homo Sapiens
AAWKQKARE

SEQ ID NO: 602959 - protein, 9 aa, Homo Sapiens
GEFEMVFNG

SEQ ID NO: 602960 - protein, 9 aa, Homo Sapiens
FRKLPASPL

SEQ ID NO: 602961 - protein, 9 aa, Homo Sapiens
WSALDSSMR

SEQ ID NO: 602962 - protein, 9 aa, Homo Sapiens
AEYQAYIDC

SEQ ID NO: 602963 - protein, 9 aa, Homo Sapiens
PSWECGSRY

SEQ ID NO: 602964 - protein, 9 aa, Homo Sapiens
AYASSSYEP

SEQ ID NO: 602965 - protein, 9 aa, Homo Sapiens
LFASCCHIY

SEQ ID NO: 602966 - protein, 9 aa, Homo Sapiens
SHSGVSEIE

SEQ ID NO: 602967 - protein, 9 aa, Homo Sapiens
ILGFCLTAL

SEQ ID NO: 602968 - protein, 9 aa, Homo Sapiens
SWTKDGMNS

SEQ ID NO: 602969 - protein, 9 aa, Homo Sapiens
VEEEDDESE

SEQ ID NO: 602970 - protein, 9 aa, Homo Sapiens
KSSRPTLQA

SEQ ID NO: 602971 - protein, 9 aa, Homo Sapiens
RRKITRDII

SEQ ID NO: 602972 - protein, 9 aa, Homo Sapiens
AGEASRGRR

SEQ ID NO: 602973 - protein, 9 aa, Homo Sapiens
EEAQLCCWM

SEQ ID NO: 602974 - protein, 9 aa, Homo Sapiens
RAAPGNCQL

SEQ ID NO: 602975 - protein, 9 aa, Homo Sapiens
MYLQMEHFV

SEQ ID NO: 602976 - protein, 9 aa, Homo Sapiens
GAVNAQDSE

SEQ ID NO: 602977 - protein, 9 aa, Homo Sapiens
SSTLFQQQK

SEQ ID NO: 602978 - protein, 9 aa, Homo Sapiens
LVDDLRVYN

SEQ ID NO: 602979 - protein, 9 aa, Homo Sapiens
QAQYHSLEL

SEQ ID NO: 602980 - protein, 9 aa, Homo Sapiens
PARPQRVCC

SEQ ID NO: 602981 - protein, 9 aa, Homo Sapiens
QDDEVLQAL

SEQ ID NO: 602982 - protein, 9 aa, Homo Sapiens
FHSMVRLVA

SEQ ID NO: 602983 - protein, 9 aa, Homo Sapiens
AAPGNCQLM

SEQ ID NO: 602984 - protein, 9 aa, Homo Sapiens
FDHVYKVKP

SEQ ID NO: 602985 - protein, 9 aa, Homo Sapiens
HFALEKSFL

SEQ ID NO: 602986 - protein, 9 aa, Homo Sapiens
ISNNIMFKK

SEQ ID NO: 602987 - protein, 9 aa, Homo Sapiens
GECGKNPEL

SEQ ID NO: 602988 - protein, 9 aa, Homo Sapiens
TLERQTFCC

SEQ ID NO: 602989 - protein, 9 aa, Homo Sapiens
PLLKELWLC

SEQ ID NO: 602990 - protein, 9 aa, Homo Sapiens
NEQTSTVPL

SEQ ID NO: 602991 - protein, 9 aa, Homo Sapiens
PDFASSFKS

SEQ ID NO: 602992 - protein, 9 aa, Homo Sapiens
KEEENLQAV

SEQ ID NO: 602993 - protein, 9 aa, Homo Sapiens
VYRSLDGGG

SEQ ID NO: 602994 - protein, 9 aa, Homo Sapiens
CENRRHEGL

SEQ ID NO: 602995 - protein, 9 aa, Homo Sapiens
DTDLENEQT

SEQ ID NO: 602996 - protein, 9 aa, Homo Sapiens
SPYQLVLPP

SEQ ID NO: 602997 - protein, 9 aa, Homo Sapiens
VATDNGLLT

SEQ ID NO: 602998 - protein, 9 aa, Homo Sapiens
VADKGNHRI

SEQ ID NO: 602999 - protein, 9 aa, Homo Sapiens
FVEVHADNY

SEQ ID NO: 603000 - protein, 9 aa, Homo Sapiens
PPGAPGMMN

SEQ ID NO: 603001 - protein, 9 aa, Homo Sapiens
ARERPAGGA

SEQ ID NO: 603002 - protein, 9 aa, Homo Sapiens
DLTFLTGVH

SEQ ID NO: 603003 - protein, 9 aa, Homo Sapiens
PGGRPSWEC

SEQ ID NO: 603004 - protein, 9 aa, Homo Sapiens
PLNLATYWT

SEQ ID NO: 603005 - protein, 9 aa, Homo Sapiens
WLPKFSHAN

SEQ ID NO: 603006 - protein, 9 aa, Homo Sapiens
DIPTPLVSS

SEQ ID NO: 603007 - protein, 9 aa, Homo Sapiens
RSQDLYCGA

SEQ ID NO: 603008 - protein, 9 aa, Homo Sapiens
AVGQFAAYW

SEQ ID NO: 603009 - protein, 9 aa, Homo Sapiens
FSHANAQKM

SEQ ID NO: 603010 - protein, 9 aa, Homo Sapiens
YRVEMIKGG

SEQ ID NO: 603011 - protein, 9 aa, Homo Sapiens
RVYNGILAM

SEQ ID NO: 603012 - protein, 9 aa, Homo Sapiens
ILAGAFASF

SEQ ID NO: 603013 - protein, 9 aa, Homo Sapiens
NEYPCQFYH

SEQ ID NO: 603014 - protein, 9 aa, Homo Sapiens
SSYEPSVSK

SEQ ID NO: 603015 - protein, 9 aa, Homo Sapiens
MVRLVAFCP

SEQ ID NO: 603016 - protein, 9 aa, Homo Sapiens
QKSHVVVHQ

SEQ ID NO: 603017 - protein, 9 aa, Homo Sapiens
HAIVMDPLR

SEQ ID NO: 603018 - protein, 9 aa, Homo Sapiens
PSEGQFPEH

SEQ ID NO: 603019 - protein, 9 aa, Homo Sapiens
VEGAPENRV

SEQ ID NO: 603020 - protein, 9 aa, Homo Sapiens
ARMGSSGMP

SEQ ID NO: 603021 - protein, 9 aa, Homo Sapiens
RTLAPSCGV

SEQ ID NO: 603022 - protein, 9 aa, Homo Sapiens
LLAEETTAE

SEQ ID NO: 603023 - protein, 9 aa, Homo Sapiens
ERYWKNANE

SEQ ID NO: 603024 - protein, 9 aa, Homo Sapiens
QSTNTQNFS

SEQ ID NO: 603025 - protein, 9 aa, Homo Sapiens
VTPGAEEQT

SEQ ID NO: 603026 - protein, 9 aa, Homo Sapiens
DIYPELYAF

SEQ ID NO: 603027 - protein, 9 aa, Homo Sapiens
LVVQVANMR

SEQ ID NO: 603028 - protein, 9 aa, Homo Sapiens
QRVCTQERE

SEQ ID NO: 603029 - protein, 9 aa, Homo Sapiens
DKGNHRIQI

SEQ ID NO: 603030 - protein, 9 aa, Homo Sapiens
GTPPPPPPE

SEQ ID NO: 603031 - protein, 9 aa, Homo Sapiens
LGPCDTTST

SEQ ID NO: 603032 - protein, 9 aa, Homo Sapiens
RNQCLLHKT

SEQ ID NO: 603033 - protein, 9 aa, Homo Sapiens
DAGKQGRGP

SEQ ID NO: 603034 - protein, 9 aa, Homo Sapiens
ENEQTSTVP

SEQ ID NO: 603035 - protein, 9 aa, Homo Sapiens
SSSYEPSVS

SEQ ID NO: 603036 - protein, 9 aa, Homo Sapiens
GALGPTGRD

SEQ ID NO: 603037 - protein, 9 aa, Homo Sapiens
AITHVKLKV

SEQ ID NO: 603038 - protein, 9 aa, Homo Sapiens
RRSQDLYCG

SEQ ID NO: 603039 - protein, 9 aa, Homo Sapiens
QLMAPARLF

SEQ ID NO: 603040 - protein, 9 aa, Homo Sapiens
KIKNRGEFE

SEQ ID NO: 603041 - protein, 9 aa, Homo Sapiens
TEVWASRTV

SEQ ID NO: 603042 - protein, 9 aa, Homo Sapiens
YPCQFYHTG

SEQ ID NO: 603043 - protein, 9 aa, Homo Sapiens
THSIQRSLP

SEQ ID NO: 603044 - protein, 9 aa, Homo Sapiens
PWRYRVEMI

SEQ ID NO: 603045 - protein, 9 aa, Homo Sapiens
KSISFSGRL

SEQ ID NO: 603046 - protein, 9 aa, Homo Sapiens
AGALTCLSC

SEQ ID NO: 603047 - protein, 9 aa, Homo Sapiens
KRNQCLLHK

SEQ ID NO: 603048 - protein, 9 aa, Homo Sapiens
WLSDALRRP

SEQ ID NO: 603049 - protein, 9 aa, Homo Sapiens
HGDRLVLLK

SEQ ID NO: 603050 - protein, 9 aa, Homo Sapiens
SIDKRKVKP

SEQ ID NO: 603051 - protein, 9 aa, Homo Sapiens
IQLFTNSSH

SEQ ID NO: 603052 - protein, 9 aa, Homo Sapiens
VVADKGNHR

SEQ ID NO: 603053 - protein, 9 aa, Homo Sapiens
SVHYTLNLH

SEQ ID NO: 603054 - protein, 9 aa, Homo Sapiens
VVLASSRPV

SEQ ID NO: 603055 - protein, 9 aa, Homo Sapiens
HFVYRSLDG

SEQ ID NO: 603056 - protein, 9 aa, Homo Sapiens
KAMTAYWTN

SEQ ID NO: 603057 - protein, 9 aa, Homo Sapiens
GCVPASSCS

SEQ ID NO: 603058 - protein, 9 aa, Homo Sapiens
VQVANMRKS

SEQ ID NO: 603059 - protein, 9 aa, Homo Sapiens
FRELIPWGA

SEQ ID NO: 603060 - protein, 9 aa, Homo Sapiens
GYTDQFSRN

SEQ ID NO: 603061 - protein, 9 aa, Homo Sapiens
QLISNNIMF

SEQ ID NO: 603062 - protein, 9 aa, Homo Sapiens
SRTVTVQPS

SEQ ID NO: 603063 - protein, 9 aa, Homo Sapiens
LPKFSHANA

SEQ ID NO: 603064 - protein, 9 aa, Homo Sapiens
GPSFKKLAD

SEQ ID NO: 603065 - protein, 9 aa, Homo Sapiens
GENNLNGTY

SEQ ID NO: 603066 - protein, 9 aa, Homo Sapiens
CGTASGCVP

SEQ ID NO: 603067 - protein, 9 aa, Homo Sapiens
DHVYKVKPN

SEQ ID NO: 603068 - protein, 9 aa, Homo Sapiens
GAPENRVDP

SEQ ID NO: 603069 - protein, 9 aa, Homo Sapiens
RDSRVQVNK

SEQ ID NO: 603070 - protein, 9 aa, Homo Sapiens
ISFSGRLAQ

SEQ ID NO: 603071 - protein, 9 aa, Homo Sapiens
SGMPGGSTP

SEQ ID NO: 603072 - protein, 9 aa, Homo Sapiens
GRLLMRTGD

SEQ ID NO: 603073 - protein, 9 aa, Homo Sapiens
TLQAACSSI

SEQ ID NO: 603074 - protein, 9 aa, Homo Sapiens
MMNYSVTSP

SEQ ID NO: 603075 - protein, 9 aa, Homo Sapiens
VNFLHKLRH

SEQ ID NO: 603076 - protein, 9 aa, Homo Sapiens
YMIHIIEKW

SEQ ID NO: 603077 - protein, 9 aa, Homo Sapiens
MYLRCGDAA

SEQ ID NO: 603078 - protein, 9 aa, Homo Sapiens
SSRPTLQAA

SEQ ID NO: 603079 - protein, 9 aa, Homo Sapiens
PSVQLVQSR

SEQ ID NO: 603080 - protein, 9 aa, Homo Sapiens
DQARMGSSG

SEQ ID NO: 603081 - protein, 9 aa, Homo Sapiens
KYAPKAAST

SEQ ID NO: 603082 - protein, 9 aa, Homo Sapiens
PETLADIPV

SEQ ID NO: 603083 - protein, 9 aa, Homo Sapiens
WKQKAREAA

SEQ ID NO: 603084 - protein, 9 aa, Homo Sapiens
TLADIPVSP

SEQ ID NO: 603085 - protein, 9 aa, Homo Sapiens
CDRPPSRYL

SEQ ID NO: 603086 - protein, 9 aa, Homo Sapiens
VTVQSSTQS

SEQ ID NO: 603087 - protein, 9 aa, Homo Sapiens
ANIGGALSS

SEQ ID NO: 603088 - protein, 9 aa, Homo Sapiens
SHGSESNKY

SEQ ID NO: 603089 - protein, 9 aa, Homo Sapiens
QRVCCAEGY

SEQ ID NO: 603090 - protein, 9 aa, Homo Sapiens
LNLHVFWPL

SEQ ID NO: 603091 - protein, 9 aa, Homo Sapiens
ACITSRLDS

SEQ ID NO: 603092 - protein, 9 aa, Homo Sapiens
MSKLAKCKP

SEQ ID NO: 603093 - protein, 9 aa, Homo Sapiens
LAYTQFGGK

SEQ ID NO: 603094 - protein, 9 aa, Homo Sapiens
VEVHADNYT

SEQ ID NO: 603095 - protein, 9 aa, Homo Sapiens
EKEEENLQA

SEQ ID NO: 603096 - protein, 9 aa, Homo Sapiens
LNITLWSTL

SEQ ID NO: 603097 - protein, 9 aa, Homo Sapiens
YESSGYTDQ

SEQ ID NO: 603098 - protein, 9 aa, Homo Sapiens
DLQEVLSSV

SEQ ID NO: 603099 - protein, 9 aa, Homo Sapiens
QLVRARLCT

SEQ ID NO: 603100 - protein, 9 aa, Homo Sapiens
VILGFCLTA

SEQ ID NO: 603101 - protein, 9 aa, Homo Sapiens
AATDMARQV

SEQ ID NO: 603102 - protein, 9 aa, Homo Sapiens
SEIENSVDD

SEQ ID NO: 603103 - protein, 9 aa, Homo Sapiens
PPPPPEFRR

SEQ ID NO: 603104 - protein, 9 aa, Homo Sapiens
TCDRPPSRY

SEQ ID NO: 603105 - protein, 9 aa, Homo Sapiens
ASFLPPGAP

SEQ ID NO: 603106 - protein, 9 aa, Homo Sapiens
FSALAQHIL

SEQ ID NO: 603107 - protein, 9 aa, Homo Sapiens
TWTHLALGQ

SEQ ID NO: 603108 - protein, 9 aa, Homo Sapiens
KAPGGVITS

SEQ ID NO: 603109 - protein, 9 aa, Homo Sapiens
LLVDDLRVY

SEQ ID NO: 603110 - protein, 9 aa, Homo Sapiens
VKQSIPGPG

SEQ ID NO: 603111 - protein, 9 aa, Homo Sapiens
IYPELYAFF

SEQ ID NO: 603112 - protein, 9 aa, Homo Sapiens
LPCSRPLLQ

SEQ ID NO: 603113 - protein, 9 aa, Homo Sapiens
WKPLNLGEK

SEQ ID NO: 603114 - protein, 9 aa, Homo Sapiens
RICENRRHE

SEQ ID NO: 603115 - protein, 9 aa, Homo Sapiens
SGYTDQFSR

SEQ ID NO: 603116 - protein, 9 aa, Homo Sapiens
NANETRYPH

SEQ ID NO: 603117 - protein, 9 aa, Homo Sapiens
MEKAPGGVI

SEQ ID NO: 603118 - protein, 9 aa, Homo Sapiens
STGIEPSSE

SEQ ID NO: 603119 - protein, 9 aa, Homo Sapiens
AWKQKAREA

SEQ ID NO: 603120 - protein, 9 aa, Homo Sapiens
HKIAYRPPV

SEQ ID NO: 603121 - protein, 9 aa, Homo Sapiens
PALLFSALA

SEQ ID NO: 603122 - protein, 9 aa, Homo Sapiens
STLFQQQKI

SEQ ID NO: 603123 - protein, 9 aa, Homo Sapiens
RERPAGGAR

SEQ ID NO: 603124 - protein, 9 aa, Homo Sapiens
MMNGKPKKV

SEQ ID NO: 603125 - protein, 9 aa, Homo Sapiens
EVLQALLKG

SEQ ID NO: 603126 - protein, 9 aa, Homo Sapiens
YTMAHVRKR

SEQ ID NO: 603127 - protein, 9 aa, Homo Sapiens
EGAPENRVD

SEQ ID NO: 603128 - protein, 9 aa, Homo Sapiens
PHTTDIPHP

SEQ ID NO: 603129 - protein, 9 aa, Homo Sapiens
SYEPSVSKK

SEQ ID NO: 603130 - protein, 9 aa, Homo Sapiens
LSHDLFVNS

SEQ ID NO: 603131 - protein, 9 aa, Homo Sapiens
HVETDLALT

SEQ ID NO: 603132 - protein, 9 aa, Homo Sapiens
FSAAICWIP

SEQ ID NO: 603133 - protein, 9 aa, Homo Sapiens
RRPLARTAD

SEQ ID NO: 603134 - protein, 9 aa, Homo Sapiens
LVTAILWLN

SEQ ID NO: 603135 - protein, 9 aa, Homo Sapiens
YLRCGDAAR

SEQ ID NO: 603136 - protein, 9 aa, Homo Sapiens
DYSVWLHGE

SEQ ID NO: 603137 - protein, 9 aa, Homo Sapiens
PPPPEFRRW

SEQ ID NO: 603138 - protein, 9 aa, Homo Sapiens
LVQSRYVQS

SEQ ID NO: 603139 - protein, 9 aa, Homo Sapiens
ADIPVSPQL

SEQ ID NO: 603140 - protein, 9 aa, Homo Sapiens
LVLPPGPPA

SEQ ID NO: 603141 - protein, 9 aa, Homo Sapiens
QIPSVEETQ

SEQ ID NO: 603142 - protein, 9 aa, Homo Sapiens
YLPSLVILF

SEQ ID NO: 603143 - protein, 9 aa, Homo Sapiens
ATCAPGDYG

SEQ ID NO: 603144 - protein, 9 aa, Homo Sapiens
LAKCKPLWI

SEQ ID NO: 603145 - protein, 9 aa, Homo Sapiens
QGAVNAQDS

SEQ ID NO: 603146 - protein, 9 aa, Homo Sapiens
GSSGMPGGS

SEQ ID NO: 603147 - protein, 9 aa, Homo Sapiens
GRFVDQSAT

SEQ ID NO: 603148 - protein, 9 aa, Homo Sapiens
TYWTCSAST

SEQ ID NO: 603149 - protein, 9 aa, Homo Sapiens
AAVTALYSL

SEQ ID NO: 603150 - protein, 9 aa, Homo Sapiens
RPAGGARGP

SEQ ID NO: 603151 - protein, 9 aa, Homo Sapiens
PLRTPTMAG

SEQ ID NO: 603152 - protein, 9 aa, Homo Sapiens
CLSCGSLCL

SEQ ID NO: 603153 - protein, 9 aa, Homo Sapiens
YTLNLHVFW

SEQ ID NO: 603154 - protein, 9 aa, Homo Sapiens
ASSSYEPSV

SEQ ID NO: 603155 - protein, 9 aa, Homo Sapiens
GECIIAGRE

SEQ ID NO: 603156 - protein, 9 aa, Homo Sapiens
TSLNPSRPS

SEQ ID NO: 603157 - protein, 9 aa, Homo Sapiens
LCPGTGLSA

SEQ ID NO: 603158 - protein, 9 aa, Homo Sapiens
KITRDIIDI

SEQ ID NO: 603159 - protein, 9 aa, Homo Sapiens
ELCRTYVLP

SEQ ID NO: 603160 - protein, 9 aa, Homo Sapiens
VLALGQCIL

SEQ ID NO: 603161 - protein, 9 aa, Homo Sapiens
NFLHKLRHL

SEQ ID NO: 603162 - protein, 9 aa, Homo Sapiens
NHVPKNFFF

SEQ ID NO: 603163 - protein, 9 aa, Homo Sapiens
LQDDEVLQA

SEQ ID NO: 603164 - protein, 9 aa, Homo Sapiens
FLPPGAPGM

SEQ ID NO: 603165 - protein, 9 aa, Homo Sapiens
TRWQHSQTR

SEQ ID NO: 603166 - protein, 9 aa, Homo Sapiens
QMEHFVDTC

SEQ ID NO: 603167 - protein, 9 aa, Homo Sapiens
GLLYHWKTY

SEQ ID NO: 603168 - protein, 9 aa, Homo Sapiens
IAGRESGKL

SEQ ID NO: 603169 - protein, 9 aa, Homo Sapiens
KNTEVWASR

SEQ ID NO: 603170 - protein, 9 aa, Homo Sapiens
MAATDMARQ

SEQ ID NO: 603171 - protein, 9 aa, Homo Sapiens
RLTSHLSLA

SEQ ID NO: 603172 - protein, 9 aa, Homo Sapiens
ILWLNGSQR

SEQ ID NO: 603173 - protein, 9 aa, Homo Sapiens
QRDIPTPLV

SEQ ID NO: 603174 - protein, 9 aa, Homo Sapiens
NGSQRVPEE

SEQ ID NO: 603175 - protein, 9 aa, Homo Sapiens
AGRDTYRRS

SEQ ID NO: 603176 - protein, 9 aa, Homo Sapiens
FVDQSATCV

SEQ ID NO: 603177 - protein, 9 aa, Homo Sapiens
IETNVHFAL

SEQ ID NO: 603178 - protein, 9 aa, Homo Sapiens
VMKNTGVGP

SEQ ID NO: 603179 - protein, 9 aa, Homo Sapiens
RMMNGKPKK

SEQ ID NO: 603180 - protein, 9 aa, Homo Sapiens
NAGALTCLS

SEQ ID NO: 603181 - protein, 9 aa, Homo Sapiens
RHLDKEGAS

SEQ ID NO: 603182 - protein, 9 aa, Homo Sapiens
VKPLLKELW

SEQ ID NO: 603183 - protein, 9 aa, Homo Sapiens
APENRVDPF

SEQ ID NO: 603184 - protein, 9 aa, Homo Sapiens
HLPERYMMN

SEQ ID NO: 603185 - protein, 9 aa, Homo Sapiens
ITLGDFGQG

SEQ ID NO: 603186 - protein, 9 aa, Homo Sapiens
EHEDYEEDK

SEQ ID NO: 603187 - protein, 9 aa, Homo Sapiens
RVPTEDYMI

SEQ ID NO: 603188 - protein, 9 aa, Homo Sapiens
IPVSPQLLT

SEQ ID NO: 603189 - protein, 9 aa, Homo Sapiens
GHCWTCLLI

SEQ ID NO: 603190 - protein, 9 aa, Homo Sapiens
DYMIHIIEK

SEQ ID NO: 603191 - protein, 9 aa, Homo Sapiens
LPLPVVFTH

SEQ ID NO: 603192 - protein, 9 aa, Homo Sapiens
PVVFTHLCK

SEQ ID NO: 603193 - protein, 9 aa, Homo Sapiens
QSAQDTYLD

SEQ ID NO: 603194 - protein, 9 aa, Homo Sapiens
PYQLVLPPG

SEQ ID NO: 603195 - protein, 9 aa, Homo Sapiens
ENGRGPAAR

SEQ ID NO: 603196 - protein, 9 aa, Homo Sapiens
VLQALLKGS

SEQ ID NO: 603197 - protein, 9 aa, Homo Sapiens
FCLTALYFL

SEQ ID NO: 603198 - protein, 9 aa, Homo Sapiens
SPGLLHHHP

SEQ ID NO: 603199 - protein, 9 aa, Homo Sapiens
HNEYPCQFY

SEQ ID NO: 603200 - protein, 9 aa, Homo Sapiens
SESNKYYNP

SEQ ID NO: 603201 - protein, 9 aa, Homo Sapiens
SHANAQKMK

SEQ ID NO: 603202 - protein, 9 aa, Homo Sapiens
DFASSFKSV

SEQ ID NO: 603203 - protein, 9 aa, Homo Sapiens
YNAGALTCL

SEQ ID NO: 603204 - protein, 9 aa, Homo Sapiens
GPGFVRGQL

SEQ ID NO: 603205 - protein, 9 aa, Homo Sapiens
GHVETDLAL

SEQ ID NO: 603206 - protein, 9 aa, Homo Sapiens
KPLNLGEKK

SEQ ID NO: 603207 - protein, 9 aa, Homo Sapiens
HRYFKNALE

SEQ ID NO: 603208 - protein, 9 aa, Homo Sapiens
IRDVTLLFN

SEQ ID NO: 603209 - protein, 9 aa, Homo Sapiens
ENRRHEGLP

SEQ ID NO: 603210 - protein, 9 aa, Homo Sapiens
NFDHVYKVK

SEQ ID NO: 603211 - protein, 9 aa, Homo Sapiens
PAAGTVGVP

SEQ ID NO: 603212 - protein, 9 aa, Homo Sapiens
DDLRVYNGI

SEQ ID NO: 603213 - protein, 9 aa, Homo Sapiens
LHHHPPPFR

SEQ ID NO: 603214 - protein, 9 aa, Homo Sapiens
ACSHTVTTT

SEQ ID NO: 603215 - protein, 9 aa, Homo Sapiens
HMMLNITLW

SEQ ID NO: 603216 - protein, 9 aa, Homo Sapiens
TLNLHVFWP

SEQ ID NO: 603217 - protein, 9 aa, Homo Sapiens
AYIQPWRYR

SEQ ID NO: 603218 - protein, 9 aa, Homo Sapiens
LALGQCILA

SEQ ID NO: 603219 - protein, 9 aa, Homo Sapiens
NAQKMKRLP

SEQ ID NO: 603220 - protein, 9 aa, Homo Sapiens
TKGWIVWSA

SEQ ID NO: 603221 - protein, 9 aa, Homo Sapiens
LRVNCELKM

SEQ ID NO: 603222 - protein, 9 aa, Homo Sapiens
LWTHSIQRS

SEQ ID NO: 603223 - protein, 9 aa, Homo Sapiens
WTCSASTTD

SEQ ID NO: 603224 - protein, 9 aa, Homo Sapiens
RLTRGEAGR

SEQ ID NO: 603225 - protein, 9 aa, Homo Sapiens
MFKKSSILT

SEQ ID NO: 603226 - protein, 9 aa, Homo Sapiens
RQTFCCVPV

SEQ ID NO: 603227 - protein, 9 aa, Homo Sapiens
GSLSTGIEP

SEQ ID NO: 603228 - protein, 9 aa, Homo Sapiens
SVMKNTGVG

SEQ ID NO: 603229 - protein, 9 aa, Homo Sapiens
KRSCPRNQP

SEQ ID NO: 603230 - protein, 9 aa, Homo Sapiens
VVSQNHGDR

SEQ ID NO: 603231 - protein, 9 aa, Homo Sapiens
GGRPSWECG

SEQ ID NO: 603232 - protein, 9 aa, Homo Sapiens
FFIVFSAAI

SEQ ID NO: 603233 - protein, 9 aa, Homo Sapiens
WTHLALGQA

SEQ ID NO: 603234 - protein, 9 aa, Homo Sapiens
QFAAYWLPY

SEQ ID NO: 603235 - protein, 9 aa, Homo Sapiens
TKDGMNSLT

SEQ ID NO: 603236 - protein, 9 aa, Homo Sapiens
ETAQRAYVK

SEQ ID NO: 603237 - protein, 9 aa, Homo Sapiens
RRRARSGPR

SEQ ID NO: 603238 - protein, 9 aa, Homo Sapiens
PLLTTPVEQ

SEQ ID NO: 603239 - protein, 9 aa, Homo Sapiens
TAQRAYVKE

SEQ ID NO: 603240 - protein, 9 aa, Homo Sapiens
LGFCLTALY

SEQ ID NO: 603241 - protein, 9 aa, Homo Sapiens
TVASDQIEL

SEQ ID NO: 603242 - protein, 9 aa, Homo Sapiens
RRSHSMSPD

SEQ ID NO: 603243 - protein, 9 aa, Homo Sapiens
HCAQLPGQW

SEQ ID NO: 603244 - protein, 9 aa, Homo Sapiens
AVATDNGLL

SEQ ID NO: 603245 - protein, 9 aa, Homo Sapiens
DQWKPLNLG

SEQ ID NO: 603246 - protein, 9 aa, Homo Sapiens
TCAPGDYGR

SEQ ID NO: 603247 - protein, 9 aa, Homo Sapiens
QRLPVKQSI

SEQ ID NO: 603248 - protein, 9 aa, Homo Sapiens
FFFIVFSAA

SEQ ID NO: 603249 - protein, 9 aa, Homo Sapiens
SWECGSRYL

SEQ ID NO: 603250 - protein, 9 aa, Homo Sapiens
VFLRVNCEL

SEQ ID NO: 603251 - protein, 9 aa, Homo Sapiens
TNTQNFSSE

SEQ ID NO: 603252 - protein, 9 aa, Homo Sapiens
SCGTASGCV

SEQ ID NO: 603253 - protein, 9 aa, Homo Sapiens
CKFLSSYNE

SEQ ID NO: 603254 - protein, 9 aa, Homo Sapiens
AILWLNGSQ

SEQ ID NO: 603255 - protein, 9 aa, Homo Sapiens
MAYTEKGAV

SEQ ID NO: 603256 - protein, 9 aa, Homo Sapiens
EPHAIVMDP

SEQ ID NO: 603257 - protein, 9 aa, Homo Sapiens
LGRHLVRRI

SEQ ID NO: 603258 - protein, 9 aa, Homo Sapiens
FCCVPVPGE

SEQ ID NO: 603259 - protein, 9 aa, Homo Sapiens
LVILFASCC

SEQ ID NO: 603260 - protein, 9 aa, Homo Sapiens
FRSLTRSYY

SEQ ID NO: 603261 - protein, 9 aa, Homo Sapiens
RTVTVQPSR

SEQ ID NO: 603262 - protein, 9 aa, Homo Sapiens
VPGGRPSWE

SEQ ID NO: 603263 - protein, 9 aa, Homo Sapiens
KQGRGPPST

SEQ ID NO: 603264 - protein, 9 aa, Homo Sapiens
ELFANRGGP

SEQ ID NO: 603265 - protein, 9 aa, Homo Sapiens
LVQQSRPAH

SEQ ID NO: 603266 - protein, 9 aa, Homo Sapiens
KPLLKELWL

SEQ ID NO: 603267 - protein, 9 aa, Homo Sapiens
VCCAEGYWH

SEQ ID NO: 603268 - protein, 9 aa, Homo Sapiens
IIAGRESGK

SEQ ID NO: 603269 - protein, 9 aa, Homo Sapiens
VFKELRRDW

SEQ ID NO: 603270 - protein, 9 aa, Homo Sapiens
GKLCLVVQV

SEQ ID NO: 603271 - protein, 9 aa, Homo Sapiens
AFYGECGKN

SEQ ID NO: 603272 - protein, 9 aa, Homo Sapiens
KELRRDWPG

SEQ ID NO: 603273 - protein, 9 aa, Homo Sapiens
AVLGRHLVR

SEQ ID NO: 603274 - protein, 9 aa, Homo Sapiens
WRTSVETAQ

SEQ ID NO: 603275 - protein, 9 aa, Homo Sapiens
LLMRTGDKE

SEQ ID NO: 603276 - protein, 9 aa, Homo Sapiens
PVSPQLLTD

SEQ ID NO: 603277 - protein, 9 aa, Homo Sapiens
TRGEAGRDT

SEQ ID NO: 603278 - protein, 9 aa, Homo Sapiens
ILVDGSLST

SEQ ID NO: 603279 - protein, 9 aa, Homo Sapiens
LPVKQSIPG

SEQ ID NO: 603280 - protein, 9 aa, Homo Sapiens
TCSASTTDL

SEQ ID NO: 603281 - protein, 9 aa, Homo Sapiens
ANRGGPQGL

SEQ ID NO: 603282 - protein, 9 aa, Homo Sapiens
LVRRIIIAK

SEQ ID NO: 603283 - protein, 9 aa, Homo Sapiens
QLPLPVVFT

SEQ ID NO: 603284 - protein, 9 aa, Homo Sapiens
IQPWRYRVE

SEQ ID NO: 603285 - protein, 9 aa, Homo Sapiens
PPGPHTTDI

SEQ ID NO: 603286 - protein, 9 aa, Homo Sapiens
RGEFEMVFN

SEQ ID NO: 603287 - protein, 9 aa, Homo Sapiens
MATFTMALA

SEQ ID NO: 603288 - protein, 9 aa, Homo Sapiens
ATDMARQVG

SEQ ID NO: 603289 - protein, 9 aa, Homo Sapiens
VSPQLLTDG

SEQ ID NO: 603290 - protein, 9 aa, Homo Sapiens
LSTAGSESS

SEQ ID NO: 603291 - protein, 9 aa, Homo Sapiens
YRSLDGGGG

SEQ ID NO: 603292 - protein, 9 aa, Homo Sapiens
TCQCVCKRS

SEQ ID NO: 603293 - protein, 9 aa, Homo Sapiens
SRGEEAQLC

SEQ ID NO: 603294 - protein, 9 aa, Homo Sapiens
NVHFALEKS

SEQ ID NO: 603295 - protein, 9 aa, Homo Sapiens
RPQRVCCAE

SEQ ID NO: 603296 - protein, 9 aa, Homo Sapiens
ALSSLMMIL

SEQ ID NO: 603297 - protein, 9 aa, Homo Sapiens
LARLTSHLS

SEQ ID NO: 603298 - protein, 9 aa, Homo Sapiens
SRPTLQAAC

SEQ ID NO: 603299 - protein, 9 aa, Homo Sapiens
SPPQNCSPS

SEQ ID NO: 603300 - protein, 9 aa, Homo Sapiens
SGLGGGGGA

SEQ ID NO: 603301 - protein, 9 aa, Homo Sapiens
TNVHFALEK

SEQ ID NO: 603302 - protein, 9 aa, Homo Sapiens
EQTSTVPLA

SEQ ID NO: 603303 - protein, 9 aa, Homo Sapiens
SCGSGTRRD

SEQ ID NO: 603304 - protein, 9 aa, Homo Sapiens
TTTAATLPN

SEQ ID NO: 603305 - protein, 9 aa, Homo Sapiens
NDDNTIPFL

SEQ ID NO: 603306 - protein, 9 aa, Homo Sapiens
HTCDRPPSR

SEQ ID NO: 603307 - protein, 9 aa, Homo Sapiens
AYTEKGAVY

SEQ ID NO: 603308 - protein, 9 aa, Homo Sapiens
VSIHFDAPG

SEQ ID NO: 603309 - protein, 9 aa, Homo Sapiens
VFTHLCKFL

SEQ ID NO: 603310 - protein, 9 aa, Homo Sapiens
NCQLMAPAR

SEQ ID NO: 603311 - protein, 9 aa, Homo Sapiens
PQNCSPSNC

SEQ ID NO: 603312 - protein, 9 aa, Homo Sapiens
SYLDSGIPS

SEQ ID NO: 603313 - protein, 9 aa, Homo Sapiens
LASRGQPAT

SEQ ID NO: 603314 - protein, 9 aa, Homo Sapiens
ALCPAESWH

SEQ ID NO: 603315 - protein, 9 aa, Homo Sapiens
FANRGGPQG

SEQ ID NO: 603316 - protein, 9 aa, Homo Sapiens
HLLCHRYFK

SEQ ID NO: 603317 - protein, 9 aa, Homo Sapiens
GLARLTSHL

SEQ ID NO: 603318 - protein, 9 aa, Homo Sapiens
DGSLSTGIE

SEQ ID NO: 603319 - protein, 9 aa, Homo Sapiens
GKSISFSGR

SEQ ID NO: 603320 - protein, 9 aa, Homo Sapiens
LLSHDLFVN

SEQ ID NO: 603321 - protein, 9 aa, Homo Sapiens
PMIQIHSRI

SEQ ID NO: 603322 - protein, 9 aa, Homo Sapiens
DVVEYFGLD

SEQ ID NO: 603323 - protein, 9 aa, Homo Sapiens
EEEDDESED

SEQ ID NO: 603324 - protein, 9 aa, Homo Sapiens
GRSRRSHSM

SEQ ID NO: 603325 - protein, 9 aa, Homo Sapiens
MMLNITLWS

SEQ ID NO: 603326 - protein, 9 aa, Homo Sapiens
VGQFAAYWL

SEQ ID NO: 603327 - protein, 9 aa, Homo Sapiens
LFSALAQHI

SEQ ID NO: 603328 - protein, 9 aa, Homo Sapiens
TSIETNVHF

SEQ ID NO: 603329 - protein, 9 aa, Homo Sapiens
VAPSGLGGG

SEQ ID NO: 603330 - protein, 9 aa, Homo Sapiens
TDNGLLTPI

SEQ ID NO: 603331 - protein, 9 aa, Homo Sapiens
RTLPLRTPT

SEQ ID NO: 603332 - protein, 9 aa, Homo Sapiens
YTEKGAVYF

SEQ ID NO: 603333 - protein, 9 aa, Homo Sapiens
QDLYCGACR

SEQ ID NO: 603334 - protein, 9 aa, Homo Sapiens
KQYLWMEWN

SEQ ID NO: 603335 - protein, 9 aa, Homo Sapiens
SLAEVQRHL

SEQ ID NO: 603336 - protein, 9 aa, Homo Sapiens
EPQRACSHT

SEQ ID NO: 603337 - protein, 9 aa, Homo Sapiens
YPELYAFFG

SEQ ID NO: 603338 - protein, 9 aa, Homo Sapiens
RRWDYSVWL

SEQ ID NO: 603339 - protein, 9 aa, Homo Sapiens
TCLSCGSLC

SEQ ID NO: 603340 - protein, 9 aa, Homo Sapiens
YQLVLPPGP

SEQ ID NO: 603341 - protein, 9 aa, Homo Sapiens
LYAKIKNRG

SEQ ID NO: 603342 - protein, 9 aa, Homo Sapiens
QWKPLNLGE

SEQ ID NO: 603343 - protein, 9 aa, Homo Sapiens
YFKNALEIA

SEQ ID NO: 603344 - protein, 9 aa, Homo Sapiens
YTTLVVQSK

SEQ ID NO: 603345 - protein, 9 aa, Homo Sapiens
AVLRQMSKH

SEQ ID NO: 603346 - protein, 9 aa, Homo Sapiens
SDWGPSFKK

SEQ ID NO: 603347 - protein, 9 aa, Homo Sapiens
EEHLLCHRY

SEQ ID NO: 603348 - protein, 9 aa, Homo Sapiens
HLVRRIIIA

SEQ ID NO: 603349 - protein, 9 aa, Homo Sapiens
DYESQSTNT

SEQ ID NO: 603350 - protein, 9 aa, Homo Sapiens
RKLPASPLI

SEQ ID NO: 603351 - protein, 9 aa, Homo Sapiens
YLQMEHFVD

SEQ ID NO: 603352 - protein, 9 aa, Homo Sapiens
CLTALYFLI

SEQ ID NO: 603353 - protein, 9 aa, Homo Sapiens
HSGVSEIEN

SEQ ID NO: 603354 - protein, 9 aa, Homo Sapiens
YLWMEWNPG

SEQ ID NO: 603355 - protein, 9 aa, Homo Sapiens
MQHYGVNSY

SEQ ID NO: 603356 - protein, 9 aa, Homo Sapiens
SDQIELNRL

SEQ ID NO: 603357 - protein, 9 aa, Homo Sapiens
TRDIIDIPK

SEQ ID NO: 603358 - protein, 9 aa, Homo Sapiens
QEVLSSVEN

SEQ ID NO: 603359 - protein, 9 aa, Homo Sapiens
TECGKAFRQ

SEQ ID NO: 603360 - protein, 9 aa, Homo Sapiens
VQLVQSRYV

SEQ ID NO: 603361 - protein, 9 aa, Homo Sapiens
LAQHILYLQ

SEQ ID NO: 603362 - protein, 9 aa, Homo Sapiens
GEGNFSQNS

SEQ ID NO: 603363 - protein, 9 aa, Homo Sapiens
KNLGELVHG

SEQ ID NO: 603364 - protein, 9 aa, Homo Sapiens
DRTLAPSCG

SEQ ID NO: 603365 - protein, 9 aa, Homo Sapiens
PTGATCAPG

SEQ ID NO: 603366 - protein, 9 aa, Homo Sapiens
VLPPGPPAR

SEQ ID NO: 603367 - protein, 9 aa, Homo Sapiens
FNSALSCSF

SEQ ID NO: 603368 - protein, 9 aa, Homo Sapiens
VQSRYVQSL

SEQ ID NO: 603369 - protein, 9 aa, Homo Sapiens
GVLVQQSRP

SEQ ID NO: 603370 - protein, 9 aa, Homo Sapiens
NNFSGNSLH

SEQ ID NO: 603371 - protein, 9 aa, Homo Sapiens
TEKGAVYFI

SEQ ID NO: 603372 - protein, 9 aa, Homo Sapiens
PGFVRGQLP

SEQ ID NO: 603373 - protein, 9 aa, Homo Sapiens
SIPGPGFVR

SEQ ID NO: 603374 - protein, 9 aa, Homo Sapiens
NSLHCAQLP

SEQ ID NO: 603375 - protein, 9 aa, Homo Sapiens
CGENNLNGT

SEQ ID NO: 603376 - protein, 9 aa, Homo Sapiens
ALAQHILYL

SEQ ID NO: 603377 - protein, 9 aa, Homo Sapiens
RGPPSTPIA

SEQ ID NO: 603378 - protein, 9 aa, Homo Sapiens
KDYVFKELR

SEQ ID NO: 603379 - protein, 9 aa, Homo Sapiens
TEKVEWMTT

SEQ ID NO: 603380 - protein, 9 aa, Homo Sapiens
DDESEDVKT

SEQ ID NO: 603381 - protein, 9 aa, Homo Sapiens
HAEVQSLLA

SEQ ID NO: 603382 - protein, 9 aa, Homo Sapiens
PQGLERLLV

SEQ ID NO: 603383 - protein, 9 aa, Homo Sapiens
EHPPEGATK

SEQ ID NO: 603384 - protein, 9 aa, Homo Sapiens
NLATYWTCS

SEQ ID NO: 603385 - protein, 9 aa, Homo Sapiens
TSPGLLHHH

SEQ ID NO: 603386 - protein, 9 aa, Homo Sapiens
FLRVNCELK

SEQ ID NO: 603387 - protein, 9 aa, Homo Sapiens
GGPQGLERL

SEQ ID NO: 603388 - protein, 9 aa, Homo Sapiens
IVFSAAICW

SEQ ID NO: 603389 - protein, 9 aa, Homo Sapiens
MCKEGLGPC

SEQ ID NO: 603390 - protein, 9 aa, Homo Sapiens
VNCSDCGAE

SEQ ID NO: 603391 - protein, 9 aa, Homo Sapiens
EFKQFVEVH

SEQ ID NO: 603392 - protein, 9 aa, Homo Sapiens
APGNCQLMA

SEQ ID NO: 603393 - protein, 9 aa, Homo Sapiens
GGGGGAPGE

SEQ ID NO: 603394 - protein, 9 aa, Homo Sapiens
GAPGMMNYS

SEQ ID NO: 603395 - protein, 9 aa, Homo Sapiens
FSQNSRNKR

SEQ ID NO: 603396 - protein, 9 aa, Homo Sapiens
GGRLLMRTG

SEQ ID NO: 603397 - protein, 9 aa, Homo Sapiens
WASRTVTVQ

SEQ ID NO: 603398 - protein, 9 aa, Homo Sapiens
IVWSALDSS

SEQ ID NO: 603399 - protein, 9 aa, Homo Sapiens
CTCADRTLA

SEQ ID NO: 603400 - protein, 9 aa, Homo Sapiens
HSLYPKYIL

SEQ ID NO: 603401 - protein, 9 aa, Homo Sapiens
QTSTVPLAE

SEQ ID NO: 603402 - protein, 9 aa, Homo Sapiens
GRRRARSGP

SEQ ID NO: 603403 - protein, 9 aa, Homo Sapiens
TRQKQYLWM

SEQ ID NO: 603404 - protein, 9 aa, Homo Sapiens
IDPEIQRVC

SEQ ID NO: 603405 - protein, 9 aa, Homo Sapiens
EVRMMNGKP

SEQ ID NO: 603406 - protein, 9 aa, Homo Sapiens
QFPEHPPEG

SEQ ID NO: 603407 - protein, 9 aa, Homo Sapiens
VRKRMVAHT

SEQ ID NO: 603408 - protein, 9 aa, Homo Sapiens
QLFTNSSHR

SEQ ID NO: 603409 - protein, 9 aa, Homo Sapiens
CQFYHTGTK

SEQ ID NO: 603410 - protein, 9 aa, Homo Sapiens
PAYASSSYE

SEQ ID NO: 603411 - protein, 9 aa, Homo Sapiens
LFTNSSHRQ

SEQ ID NO: 603412 - protein, 9 aa, Homo Sapiens
PPKSSRPTL

SEQ ID NO: 603413 - protein, 9 aa, Homo Sapiens
DQIELNRLK

SEQ ID NO: 603414 - protein, 9 aa, Homo Sapiens
KRMVAHTKD

SEQ ID NO: 603415 - protein, 9 aa, Homo Sapiens
SVTLADIYP

SEQ ID NO: 603416 - protein, 9 aa, Homo Sapiens
CLVVQVANM

SEQ ID NO: 603417 - protein, 9 aa, Homo Sapiens
CSHTVTTTA

SEQ ID NO: 603418 - protein, 9 aa, Homo Sapiens
DIPVSPQLL

SEQ ID NO: 603419 - protein, 9 aa, Homo Sapiens
LGPTGRDVV

SEQ ID NO: 603420 - protein, 9 aa, Homo Sapiens
STPTGATCA

SEQ ID NO: 603421 - protein, 9 aa, Homo Sapiens
YWTCSASTT

SEQ ID NO: 603422 - protein, 9 aa, Homo Sapiens
SVWLHGEFS

SEQ ID NO: 603423 - protein, 9 aa, Homo Sapiens
LYPKYILPP

SEQ ID NO: 603424 - protein, 9 aa, Homo Sapiens
NGRGPAARS

SEQ ID NO: 603425 - protein, 9 aa, Homo Sapiens
GVSPSRDSS

SEQ ID NO: 603426 - protein, 9 aa, Homo Sapiens
GRFFKRRTN

SEQ ID NO: 603427 - protein, 9 aa, Homo Sapiens
EGLGPCDTT

SEQ ID NO: 603428 - protein, 9 aa, Homo Sapiens
IGGRLLMRT

SEQ ID NO: 603429 - protein, 9 aa, Homo Sapiens
RELCRTYVL

SEQ ID NO: 603430 - protein, 9 aa, Homo Sapiens
ETWTHLALG

SEQ ID NO: 603431 - protein, 9 aa, Homo Sapiens
ISNMEKAPG

SEQ ID NO: 603432 - protein, 9 aa, Homo Sapiens
LVVNLNPNA

SEQ ID NO: 603433 - protein, 9 aa, Homo Sapiens
SAAICWIPV

SEQ ID NO: 603434 - protein, 9 aa, Homo Sapiens
AEVQSLLAE

SEQ ID NO: 603435 - protein, 9 aa, Homo Sapiens
HGSESNKYY

SEQ ID NO: 603436 - protein, 9 aa, Homo Sapiens
SRYLYPLLA

SEQ ID NO: 603437 - protein, 9 aa, Homo Sapiens
LKSSHSGVS

SEQ ID NO: 603438 - protein, 9 aa, Homo Sapiens
MAHVRKRMV

SEQ ID NO: 603439 - protein, 9 aa, Homo Sapiens
PGPAAGTVG

SEQ ID NO: 603440 - protein, 9 aa, Homo Sapiens
CKVHVRVYL

SEQ ID NO: 603441 - protein, 9 aa, Homo Sapiens
SHVVVHQRT

SEQ ID NO: 603442 - protein, 9 aa, Homo Sapiens
HCWTCLLIA

SEQ ID NO: 603443 - protein, 9 aa, Homo Sapiens
PNLCTCADR

SEQ ID NO: 603444 - protein, 9 aa, Homo Sapiens
QSSTLFQQQ

SEQ ID NO: 603445 - protein, 9 aa, Homo Sapiens
NSWTKDGMN

SEQ ID NO: 603446 - protein, 9 aa, Homo Sapiens
PPPEFRRWD

SEQ ID NO: 603447 - protein, 9 aa, Homo Sapiens
VLGRHLVRR

SEQ ID NO: 603448 - protein, 9 aa, Homo Sapiens
GKLGSRGEE

SEQ ID NO: 603449 - protein, 9 aa, Homo Sapiens
VILFASCCH

SEQ ID NO: 603450 - protein, 9 aa, Homo Sapiens
VNTSLNPSR

SEQ ID NO: 603451 - protein, 9 aa, Homo Sapiens
QFVEVHADN

SEQ ID NO: 603452 - protein, 9 aa, Homo Sapiens
VSQNHGDRL

SEQ ID NO: 603453 - protein, 9 aa, Homo Sapiens
WKNANETRY

SEQ ID NO: 603454 - protein, 9 aa, Homo Sapiens
SQSSASFLP

SEQ ID NO: 603455 - protein, 9 aa, Homo Sapiens
EAQLCCWML

SEQ ID NO: 603456 - protein, 9 aa, Homo Sapiens
GNSLHCAQL

SEQ ID NO: 603457 - protein, 9 aa, Homo Sapiens
EHFVDTCRK

SEQ ID NO: 603458 - protein, 9 aa, Homo Sapiens
FLTGVHEDM

SEQ ID NO: 603459 - protein, 9 aa, Homo Sapiens
GPCDTTSTF

SEQ ID NO: 603460 - protein, 9 aa, Homo Sapiens
VQRHLDKEG

SEQ ID NO: 603461 - protein, 9 aa, Homo Sapiens
RESGKLNQY

SEQ ID NO: 603462 - protein, 9 aa, Homo Sapiens
SGVSEIENS

SEQ ID NO: 603463 - protein, 9 aa, Homo Sapiens
QAYIDCEMK

SEQ ID NO: 603464 - protein, 9 aa, Homo Sapiens
PEIQRVCTQ

SEQ ID NO: 603465 - protein, 9 aa, Homo Sapiens
TDIPHPAIV

SEQ ID NO: 603466 - protein, 9 aa, Homo Sapiens
ARLTSHLSL

SEQ ID NO: 603467 - protein, 9 aa, Homo Sapiens
GLQDDEVLQ

SEQ ID NO: 603468 - protein, 9 aa, Homo Sapiens
TCADRTLAP

SEQ ID NO: 603469 - protein, 9 aa, Homo Sapiens
DDNTIPFLI

SEQ ID NO: 603470 - protein, 9 aa, Homo Sapiens
EIVLPPSGH

SEQ ID NO: 603471 - protein, 9 aa, Homo Sapiens
HVKLKVEQK

SEQ ID NO: 603472 - protein, 9 aa, Homo Sapiens
IQTLVNTSL

SEQ ID NO: 603473 - protein, 9 aa, Homo Sapiens
ADIYPELYA

SEQ ID NO: 603474 - protein, 9 aa, Homo Sapiens
VPTEDYMIH

SEQ ID NO: 603475 - protein, 9 aa, Homo Sapiens
IKNRGEFEM

SEQ ID NO: 603476 - protein, 9 aa, Homo Sapiens
GPAAGTVGV

SEQ ID NO: 603477 - protein, 9 aa, Homo Sapiens
NLCTCADRT

SEQ ID NO: 603478 - protein, 9 aa, Homo Sapiens
RRIIIAKSD

SEQ ID NO: 603479 - protein, 9 aa, Homo Sapiens
IAYRPPVPG

SEQ ID NO: 603480 - protein, 9 aa, Homo Sapiens
YRPPVPGGR

SEQ ID NO: 603481 - protein, 9 aa, Homo Sapiens
VVVHQRTHT

SEQ ID NO: 603482 - protein, 9 aa, Homo Sapiens
PCSRPLLQF

SEQ ID NO: 603483 - protein, 9 aa, Homo Sapiens
SHLAAVTAL

SEQ ID NO: 603484 - protein, 9 aa, Homo Sapiens
TPPPPPPEF

SEQ ID NO: 603485 - protein, 9 aa, Homo Sapiens
LLCHRYFKN

SEQ ID NO: 603486 - protein, 9 aa, Homo Sapiens
LSSLMMILS

SEQ ID NO: 603487 - protein, 9 aa, Homo Sapiens
NGRSRRSHS

SEQ ID NO: 603488 - protein, 9 aa, Homo Sapiens
LCKFLSSYN

SEQ ID NO: 603489 - protein, 9 aa, Homo Sapiens
RHGFVSREL

SEQ ID NO: 603490 - protein, 9 aa, Homo Sapiens
TCLLIAESL

SEQ ID NO: 603491 - protein, 9 aa, Homo Sapiens
HRQPILVAL

SEQ ID NO: 603492 - protein, 9 aa, Homo Sapiens
PFRKLPASP

SEQ ID NO: 603493 - protein, 9 aa, Homo Sapiens
ECIIAGRES

SEQ ID NO: 603494 - protein, 9 aa, Homo Sapiens
RYYSSHYTT

SEQ ID NO: 603495 - protein, 9 aa, Homo Sapiens
AGGARGPRA

SEQ ID NO: 603496 - protein, 9 aa, Homo Sapiens
PIQEYMVTN

SEQ ID NO: 603497 - protein, 9 aa, Homo Sapiens
FLIRYRKEL

SEQ ID NO: 603498 - protein, 9 aa, Homo Sapiens
ERQTFCCVP

SEQ ID NO: 603499 - protein, 9 aa, Homo Sapiens
IPGPGFVRG

SEQ ID NO: 603500 - protein, 9 aa, Homo Sapiens
KIRDVTLLF

SEQ ID NO: 603501 - protein, 9 aa, Homo Sapiens
HHPPPFRKL

SEQ ID NO: 603502 - protein, 9 aa, Homo Sapiens
PKNFFFFFF

SEQ ID NO: 603503 - protein, 9 aa, Homo Sapiens
AVYFIDHNT

SEQ ID NO: 603504 - protein, 9 aa, Homo Sapiens
STKGWIVWS

SEQ ID NO: 603505 - protein, 9 aa, Homo Sapiens
ESHGSESNK

SEQ ID NO: 603506 - protein, 9 aa, Homo Sapiens
VNGRSRRSH

SEQ ID NO: 603507 - protein, 9 aa, Homo Sapiens
TMEQIPSVE

SEQ ID NO: 603508 - protein, 9 aa, Homo Sapiens
ETNVHFALE

SEQ ID NO: 603509 - protein, 9 aa, Homo Sapiens
KQSIPGPGF

SEQ ID NO: 603510 - protein, 9 aa, Homo Sapiens
SYNAGALTC

SEQ ID NO: 603511 - protein, 9 aa, Homo Sapiens
THLCKFLSS

SEQ ID NO: 603512 - protein, 9 aa, Homo Sapiens
AQHILYLQP

SEQ ID NO: 603513 - protein, 9 aa, Homo Sapiens
SHDLFVNSF

SEQ ID NO: 603514 - protein, 9 aa, Homo Sapiens
GFQEEEVSG

SEQ ID NO: 603515 - protein, 9 aa, Homo Sapiens
LSQSSASFL

SEQ ID NO: 603516 - protein, 9 aa, Homo Sapiens
LAVGQFAAY

SEQ ID NO: 603517 - protein, 9 aa, Homo Sapiens
VRTQNSWTK

SEQ ID NO: 603518 - protein, 9 aa, Homo Sapiens
LCRTYVLPA

SEQ ID NO: 603519 - protein, 9 aa, Homo Sapiens
FHFVYRSLD

SEQ ID NO: 603520 - protein, 9 aa, Homo Sapiens
HLAAVTALY

SEQ ID NO: 603521 - protein, 9 aa, Homo Sapiens
SEDVKTATN

SEQ ID NO: 603522 - protein, 9 aa, Homo Sapiens
SSTPTGATC

SEQ ID NO: 603523 - protein, 9 aa, Homo Sapiens
VTALYSLVD

SEQ ID NO: 603524 - protein, 9 aa, Homo Sapiens
EAHAEVQSL

SEQ ID NO: 603525 - protein, 9 aa, Homo Sapiens
LRHLPERYM

SEQ ID NO: 603526 - protein, 9 aa, Homo Sapiens
FSGRLAQIY

SEQ ID NO: 603527 - protein, 9 aa, Homo Sapiens
GLLHHHPPP

SEQ ID NO: 603528 - protein, 9 aa, Homo Sapiens
LGERACRCE

SEQ ID NO: 603529 - protein, 9 aa, Homo Sapiens
TPLVSSGVE

SEQ ID NO: 603530 - protein, 9 aa, Homo Sapiens
MVTNQNGKN

SEQ ID NO: 603531 - protein, 9 aa, Homo Sapiens
FTHLCKFLS

SEQ ID NO: 603532 - protein, 9 aa, Homo Sapiens
ERACRCEHC

SEQ ID NO: 603533 - protein, 9 aa, Homo Sapiens
EDDESEDVK

SEQ ID NO: 603534 - protein, 9 aa, Homo Sapiens
LELECEKLA

SEQ ID NO: 603535 - protein, 9 aa, Homo Sapiens
HPGPAAGTV

SEQ ID NO: 603536 - protein, 9 aa, Homo Sapiens
GNETWTHLA

SEQ ID NO: 603537 - protein, 9 aa, Homo Sapiens
NMEKAPGGV

SEQ ID NO: 603538 - protein, 9 aa, Homo Sapiens
LGSRGEEAQ

SEQ ID NO: 603539 - protein, 9 aa, Homo Sapiens
PSVEETQIK

SEQ ID NO: 603540 - protein, 9 aa, Homo Sapiens
IFVYDVTPG

SEQ ID NO: 603541 - protein, 9 aa, Homo Sapiens
LPLRTPTMA

SEQ ID NO: 603542 - protein, 9 aa, Homo Sapiens
RDVTLLFNE

SEQ ID NO: 603543 - protein, 9 aa, Homo Sapiens
RLHLGERAC

SEQ ID NO: 603544 - protein, 9 aa, Homo Sapiens
EVLSSVENG

SEQ ID NO: 603545 - protein, 9 aa, Homo Sapiens
CGRFFKRRT

SEQ ID NO: 603546 - protein, 9 aa, Homo Sapiens
KFHSMVRLV

SEQ ID NO: 603547 - protein, 9 aa, Homo Sapiens
TLADIYPEL

SEQ ID NO: 603548 - protein, 9 aa, Homo Sapiens
SQSTNTQNF

SEQ ID NO: 603549 - protein, 9 aa, Homo Sapiens
RHLPERYMM

SEQ ID NO: 603550 - protein, 9 aa, Homo Sapiens
AGTVGVPLY

SEQ ID NO: 603551 - protein, 9 aa, Homo Sapiens
EEVAPMIQI

SEQ ID NO: 603552 - protein, 9 aa, Homo Sapiens
QPWRYRVEM

SEQ ID NO: 603553 - protein, 9 aa, Homo Sapiens
PTGRDVVEY

SEQ ID NO: 603554 - protein, 9 aa, Homo Sapiens
TMAHVRKRM

SEQ ID NO: 603555 - protein, 9 aa, Homo Sapiens
FASSFKSVL

SEQ ID NO: 603556 - protein, 9 aa, Homo Sapiens
RDIPTPLVS

SEQ ID NO: 603557 - protein, 9 aa, Homo Sapiens
EQIPSVEET

SEQ ID NO: 603558 - protein, 9 aa, Homo Sapiens
LHLGERACR

SEQ ID NO: 603559 - protein, 9 aa, Homo Sapiens
TLVNTSLNP

SEQ ID NO: 603560 - protein, 9 aa, Homo Sapiens
PSNHVPKNF

SEQ ID NO: 603561 - protein, 9 aa, Homo Sapiens
LTTPVEQNP

SEQ ID NO: 603562 - protein, 9 aa, Homo Sapiens
TKACITSRL

SEQ ID NO: 603563 - protein, 9 aa, Homo Sapiens
YSSHYTTLV

SEQ ID NO: 603564 - protein, 9 aa, Homo Sapiens
VVQVANMRK

SEQ ID NO: 603565 - protein, 9 aa, Homo Sapiens
DHINFDHVY

SEQ ID NO: 603566 - protein, 9 aa, Homo Sapiens
AAYWLPYGC

SEQ ID NO: 603567 - protein, 9 aa, Homo Sapiens
QKQYLWMEW

SEQ ID NO: 603568 - protein, 9 aa, Homo Sapiens
LFRELIPWG

SEQ ID NO: 603569 - protein, 9 aa, Homo Sapiens
PCDTTSTFC

SEQ ID NO: 603570 - protein, 9 aa, Homo Sapiens
SQDLYCGAC

SEQ ID NO: 603571 - protein, 9 aa, Homo Sapiens
YAPKAASTR

SEQ ID NO: 603572 - protein, 9 aa, Homo Sapiens
VQSLLAEET

SEQ ID NO: 603573 - protein, 9 aa, Homo Sapiens
HVYKVKPNP

SEQ ID NO: 603574 - protein, 9 aa, Homo Sapiens
GARERPAGG

SEQ ID NO: 603575 - protein, 9 aa, Homo Sapiens
GERACRCEH

SEQ ID NO: 603576 - protein, 9 aa, Homo Sapiens
IDCEMKIGD

SEQ ID NO: 603577 - protein, 9 aa, Homo Sapiens
TLGDFGQGP

SEQ ID NO: 603578 - protein, 9 aa, Homo Sapiens
ARLCTRVSD

SEQ ID NO: 603579 - protein, 9 aa, Homo Sapiens
VHFALEKSF

SEQ ID NO: 603580 - protein, 9 aa, Homo Sapiens
AQLPGQWPV

SEQ ID NO: 603581 - protein, 9 aa, Homo Sapiens
TEPEVRMMN

SEQ ID NO: 603582 - protein, 9 aa, Homo Sapiens
KVVLASSRP

SEQ ID NO: 603583 - protein, 9 aa, Homo Sapiens
MNYSVTSPG

SEQ ID NO: 603584 - protein, 9 aa, Homo Sapiens
CKPLWIEEP

SEQ ID NO: 603585 - protein, 9 aa, Homo Sapiens
SDAITHVKL

SEQ ID NO: 603586 - protein, 9 aa, Homo Sapiens
SVTVQSSTQ

SEQ ID NO: 603587 - protein, 9 aa, Homo Sapiens
LDTDLENEQ

SEQ ID NO: 603588 - protein, 9 aa, Homo Sapiens
SAMERICEN

SEQ ID NO: 603589 - protein, 9 aa, Homo Sapiens
NITLWSTLL

SEQ ID NO: 603590 - protein, 9 aa, Homo Sapiens
VKEDCKVHV

SEQ ID NO: 603591 - protein, 9 aa, Homo Sapiens
LCLVVQVAN

SEQ ID NO: 603592 - protein, 9 aa, Homo Sapiens
LNLGEKKRY

SEQ ID NO: 603593 - protein, 9 aa, Homo Sapiens
LQLVRARLC

SEQ ID NO: 603594 - protein, 9 aa, Homo Sapiens
RFFFIVFSA

SEQ ID NO: 603595 - protein, 9 aa, Homo Sapiens
HKTSGCLTQ

SEQ ID NO: 603596 - protein, 9 aa, Homo Sapiens
SDNGGIHQE

SEQ ID NO: 603597 - protein, 9 aa, Homo Sapiens
GKFHSMVRL

SEQ ID NO: 603598 - protein, 9 aa, Homo Sapiens
ANAQKMKRL

SEQ ID NO: 603599 - protein, 9 aa, Homo Sapiens
DVTPGAEEQ

SEQ ID NO: 603600 - protein, 9 aa, Homo Sapiens
DSGIPSGAT

SEQ ID NO: 603601 - protein, 9 aa, Homo Sapiens
QFLLLSHDL

SEQ ID NO: 603602 - protein, 9 aa, Homo Sapiens
LLPCSRPLL

SEQ ID NO: 603603 - protein, 9 aa, Homo Sapiens
RRDSRVQVN

SEQ ID NO: 603604 - protein, 9 aa, Homo Sapiens
EVEEEDDES

SEQ ID NO: 603605 - protein, 9 aa, Homo Sapiens
APKAASTRT

SEQ ID NO: 603606 - protein, 9 aa, Homo Sapiens
TLQSKEYSQ

SEQ ID NO: 603607 - protein, 9 aa, Homo Sapiens
HVPKNFFFF

SEQ ID NO: 603608 - protein, 9 aa, Homo Sapiens
YDVTPGAEE

SEQ ID NO: 603609 - protein, 9 aa, Homo Sapiens
ACRCEHCGK

SEQ ID NO: 603610 - protein, 9 aa, Homo Sapiens
PPPPPPEFR

SEQ ID NO: 603611 - protein, 9 aa, Homo Sapiens
LLTMEQIPS

SEQ ID NO: 603612 - protein, 9 aa, Homo Sapiens
LETRQKQYL

SEQ ID NO: 603613 - protein, 9 aa, Homo Sapiens
GIHQESSQI

SEQ ID NO: 603614 - protein, 9 aa, Homo Sapiens
PHAIVMDPL

SEQ ID NO: 603615 - protein, 9 aa, Homo Sapiens
KGDRTLPLR

SEQ ID NO: 603616 - protein, 9 aa, Homo Sapiens
SGCVPASSC

SEQ ID NO: 603617 - protein, 9 aa, Homo Sapiens
NRVDPFDQG

SEQ ID NO: 603618 - protein, 9 aa, Homo Sapiens
LYPLLASRG

SEQ ID NO: 603619 - protein, 9 aa, Homo Sapiens
KQPLTSPGG

SEQ ID NO: 603620 - protein, 9 aa, Homo Sapiens
SCCHIYEKG

SEQ ID NO: 603621 - protein, 9 aa, Homo Sapiens
DRPPSRYLF

SEQ ID NO: 603622 - protein, 9 aa, Homo Sapiens
YVILGFCLT

SEQ ID NO: 603623 - protein, 9 aa, Homo Sapiens
DLERKRKLN

SEQ ID NO: 603624 - protein, 9 aa, Homo Sapiens
SYGRFVDQS

SEQ ID NO: 603625 - protein, 9 aa, Homo Sapiens
NSYSLHAMN

SEQ ID NO: 603626 - protein, 9 aa, Homo Sapiens
RTSVETAQR

SEQ ID NO: 603627 - protein, 9 aa, Homo Sapiens
RLPVKQSIP

SEQ ID NO: 603628 - protein, 9 aa, Homo Sapiens
QLDLERKRK

SEQ ID NO: 603629 - protein, 9 aa, Homo Sapiens
FVSRELCRT

SEQ ID NO: 603630 - protein, 9 aa, Homo Sapiens
QQSRPAHTR

SEQ ID NO: 603631 - protein, 9 aa, Homo Sapiens
QSPPQNCSP

SEQ ID NO: 603632 - protein, 9 aa, Homo Sapiens
LTRGEAGRD

SEQ ID NO: 603633 - protein, 9 aa, Homo Sapiens
LQEVLSSVE

SEQ ID NO: 603634 - protein, 9 aa, Homo Sapiens
YPLLASRGQ

SEQ ID NO: 603635 - protein, 9 aa, Homo Sapiens
MNGKPKKVR

SEQ ID NO: 603636 - protein, 9 aa, Homo Sapiens
VSKAMTAYW

SEQ ID NO: 603637 - protein, 9 aa, Homo Sapiens
GVNCSDCGA

SEQ ID NO: 603638 - protein, 9 aa, Homo Sapiens
LPPGPPARP

SEQ ID NO: 603639 - protein, 9 aa, Homo Sapiens
APEITKACI

SEQ ID NO: 603640 - protein, 9 aa, Homo Sapiens
PLPVVFTHL

SEQ ID NO: 603641 - protein, 9 aa, Homo Sapiens
TGNETWTHL

SEQ ID NO: 603642 - protein, 9 aa, Homo Sapiens
RDFHFVYRS

SEQ ID NO: 603643 - protein, 9 aa, Homo Sapiens
NCELKMLIM

SEQ ID NO: 603644 - protein, 9 aa, Homo Sapiens
SVAVATDNG

SEQ ID NO: 603645 - protein, 9 aa, Homo Sapiens
FGLLVDDLR

SEQ ID NO: 603646 - protein, 9 aa, Homo Sapiens
QSLLAEETT

SEQ ID NO: 603647 - protein, 9 aa, Homo Sapiens
SPLLPCSRP

SEQ ID NO: 603648 - protein, 9 aa, Homo Sapiens
RRIVVADKG

SEQ ID NO: 603649 - protein, 9 aa, Homo Sapiens
FTMALARVC

SEQ ID NO: 603650 - protein, 9 aa, Homo Sapiens
EEEVAPMIQ

SEQ ID NO: 603651 - protein, 9 aa, Homo Sapiens
LWMEWNPGF

SEQ ID NO: 603652 - protein, 9 aa, Homo Sapiens
APGEGNFSQ

SEQ ID NO: 603653 - protein, 9 aa, Homo Sapiens
LSSYNEYLP

SEQ ID NO: 603654 - protein, 9 aa, Homo Sapiens
WDYSVWLHG

SEQ ID NO: 603655 - protein, 9 aa, Homo Sapiens
TRRDSRVQV

SEQ ID NO: 603656 - protein, 9 aa, Homo Sapiens
LDLTFLTGV

SEQ ID NO: 603657 - protein, 9 aa, Homo Sapiens
PSDAITHVK

SEQ ID NO: 603658 - protein, 9 aa, Homo Sapiens
YLHNEYPCQ

SEQ ID NO: 603659 - protein, 9 aa, Homo Sapiens
LGQCILAGA

SEQ ID NO: 603660 - protein, 9 aa, Homo Sapiens
LERKRKLNE

SEQ ID NO: 603661 - protein, 9 aa, Homo Sapiens
SGIPSGATT

SEQ ID NO: 603662 - protein, 9 aa, Homo Sapiens
LCTRVSDTE

SEQ ID NO: 603663 - protein, 9 aa, Homo Sapiens
HDKEDPDCI

SEQ ID NO: 603664 - protein, 9 aa, Homo Sapiens
TGLEQRHDK

SEQ ID NO: 603665 - protein, 9 aa, Homo Sapiens
STAGSESSS

SEQ ID NO: 603666 - protein, 9 aa, Homo Sapiens
FSSFCSQSQ

SEQ ID NO: 603667 - protein, 9 aa, Homo Sapiens
WHLCLMGAT

SEQ ID NO: 603668 - protein, 9 aa, Homo Sapiens
SSFCSQSQN

SEQ ID NO: 603669 - protein, 9 aa, Homo Sapiens
EQQTEKVEW

SEQ ID NO: 603670 - protein, 9 aa, Homo Sapiens
VRRIIIAKS

SEQ ID NO: 603671 - protein, 9 aa, Homo Sapiens
GGALSSLMM

SEQ ID NO: 603672 - protein, 9 aa, Homo Sapiens
AMTAYWTNF

SEQ ID NO: 603673 - protein, 9 aa, Homo Sapiens
KLAYTQFGG

SEQ ID NO: 603674 - protein, 9 aa, Homo Sapiens
FQQQKIHTG

SEQ ID NO: 603675 - protein, 9 aa, Homo Sapiens
NPLLTTPVE

SEQ ID NO: 603676 - protein, 9 aa, Homo Sapiens
DEPHAIVMD

SEQ ID NO: 603677 - protein, 9 aa, Homo Sapiens
GSSTPTGAT

SEQ ID NO: 603678 - protein, 9 aa, Homo Sapiens
YIQPWRYRV

SEQ ID NO: 603679 - protein, 9 aa, Homo Sapiens
QRHLDKEGA

SEQ ID NO: 603680 - protein, 9 aa, Homo Sapiens
IQRSLPAIW

SEQ ID NO: 603681 - protein, 9 aa, Homo Sapiens
IERAAWKQK

SEQ ID NO: 603682 - protein, 9 aa, Homo Sapiens
HLCKFLSSY

SEQ ID NO: 603683 - protein, 9 aa, Homo Sapiens
YSVTSPGLL

SEQ ID NO: 603684 - protein, 9 aa, Homo Sapiens
TFTMALARV

SEQ ID NO: 603685 - protein, 9 aa, Homo Sapiens
FVYDVTPGA

SEQ ID NO: 603686 - protein, 9 aa, Homo Sapiens
GRDVVEYFG

SEQ ID NO: 603687 - protein, 9 aa, Homo Sapiens
TIPFLIRYR

SEQ ID NO: 603688 - protein, 9 aa, Homo Sapiens
LSALCPAES

SEQ ID NO: 603689 - protein, 9 aa, Homo Sapiens
GPASRPSPG

SEQ ID NO: 603690 - protein, 9 aa, Homo Sapiens
EITKACITS

SEQ ID NO: 603691 - protein, 9 aa, Homo Sapiens
IMFKKSSIL

SEQ ID NO: 603692 - protein, 9 aa, Homo Sapiens
LRLHQRLPV

SEQ ID NO: 603693 - protein, 9 aa, Homo Sapiens
ESQSTNTQN

SEQ ID NO: 603694 - protein, 9 aa, Homo Sapiens
LPSLVILFA

SEQ ID NO: 603695 - protein, 9 aa, Homo Sapiens
RQKQYLWME

SEQ ID NO: 603696 - protein, 9 aa, Homo Sapiens
EYQAYIDCE

SEQ ID NO: 603697 - protein, 9 aa, Homo Sapiens
HYGVNSYSL

SEQ ID NO: 603698 - protein, 9 aa, Homo Sapiens
LLRERYWKN

SEQ ID NO: 603699 - protein, 9 aa, Homo Sapiens
LNPLLTTPV

SEQ ID NO: 603700 - protein, 9 aa, Homo Sapiens
SLVILFASC

SEQ ID NO: 603701 - protein, 9 aa, Homo Sapiens
TLWSTLLLG

SEQ ID NO: 603702 - protein, 9 aa, Homo Sapiens
EEPQRACSH

SEQ ID NO: 603703 - protein, 9 aa, Homo Sapiens
LDLERKRKL

SEQ ID NO: 603704 - protein, 9 aa, Homo Sapiens
LKGEKDVIT

SEQ ID NO: 603705 - protein, 9 aa, Homo Sapiens
YMVTNQNGK

SEQ ID NO: 603706 - protein, 9 aa, Homo Sapiens
PKAASTRTD

SEQ ID NO: 603707 - protein, 9 aa, Homo Sapiens
VTEPEVRMM

SEQ ID NO: 603708 - protein, 9 aa, Homo Sapiens
GALSSLMMI

SEQ ID NO: 603709 - protein, 9 aa, Homo Sapiens
LIPWGAPGS

SEQ ID NO: 603710 - protein, 9 aa, Homo Sapiens
CPGTGLSAL

SEQ ID NO: 603711 - protein, 9 aa, Homo Sapiens
EASRGRRRA

SEQ ID NO: 603712 - protein, 9 aa, Homo Sapiens
DIKLAYTQF

SEQ ID NO: 603713 - protein, 9 aa, Homo Sapiens
GLSALCPAE

SEQ ID NO: 603714 - protein, 9 aa, Homo Sapiens
PVEQNPEDM

SEQ ID NO: 603715 - protein, 9 aa, Homo Sapiens
GFVSRELCR

SEQ ID NO: 603716 - protein, 9 aa, Homo Sapiens
HANAQKMKR

SEQ ID NO: 603717 - protein, 9 aa, Homo Sapiens
FAAYWLPYG

SEQ ID NO: 603718 - protein, 9 aa, Homo Sapiens
FLSSYNEYL

SEQ ID NO: 603719 - protein, 9 aa, Homo Sapiens
TPVEQNPED

SEQ ID NO: 603720 - protein, 9 aa, Homo Sapiens
RKVKPLLKE

SEQ ID NO: 603721 - protein, 9 aa, Homo Sapiens
SHLSLASAA

SEQ ID NO: 603722 - protein, 9 aa, Homo Sapiens
FPEHPPEGA

SEQ ID NO: 603723 - protein, 9 aa, Homo Sapiens
PGGVSPSRD

SEQ ID NO: 603724 - protein, 9 aa, Homo Sapiens
SSHSGVSEI

SEQ ID NO: 603725 - protein, 9 aa, Homo Sapiens
AQYHSLELE

SEQ ID NO: 603726 - protein, 9 aa, Homo Sapiens
GNCQLMAPA

SEQ ID NO: 603727 - protein, 9 aa, Homo Sapiens
AAICWIPVF

SEQ ID NO: 603728 - protein, 9 aa, Homo Sapiens
TPTGATCAP

SEQ ID NO: 603729 - protein, 9 aa, Homo Sapiens
LQAVLRQMS

SEQ ID NO: 603730 - protein, 9 aa, Homo Sapiens
GTVGVPLYA

SEQ ID NO: 603731 - protein, 9 aa, Homo Sapiens
ITTRWQHSQ

SEQ ID NO: 603732 - protein, 9 aa, Homo Sapiens
LDRFSSFCS

SEQ ID NO: 603733 - protein, 9 aa, Homo Sapiens
LDPAWHLCL

SEQ ID NO: 603734 - protein, 9 aa, Homo Sapiens
GAVYFIDHN

SEQ ID NO: 603735 - protein, 9 aa, Homo Sapiens
VLVQQSRPA

SEQ ID NO: 603736 - protein, 9 aa, Homo Sapiens
LGKFHSMVR

SEQ ID NO: 603737 - protein, 9 aa, Homo Sapiens
EVQSLLAEE

SEQ ID NO: 603738 - protein, 9 aa, Homo Sapiens
RLVLLKDEL

SEQ ID NO: 603739 - protein, 9 aa, Homo Sapiens
VAPMIQIHS

SEQ ID NO: 603740 - protein, 9 aa, Homo Sapiens
GQLPLPVVF

SEQ ID NO: 603741 - protein, 9 aa, Homo Sapiens
LERQTFCCV

SEQ ID NO: 603742 - protein, 9 aa, Homo Sapiens
PLNLGEKKR

SEQ ID NO: 603743 - protein, 9 aa, Homo Sapiens
YLSDWGPSF

SEQ ID NO: 603744 - protein, 9 aa, Homo Sapiens
KSHVVVHQR

SEQ ID NO: 603745 - protein, 9 aa, Homo Sapiens
TTLERQTFC

SEQ ID NO: 603746 - protein, 9 aa, Homo Sapiens
LHQRLPVKQ

SEQ ID NO: 603747 - protein, 9 aa, Homo Sapiens
GELVHGFQE

SEQ ID NO: 603748 - protein, 9 aa, Homo Sapiens
QDSEGAVMK

SEQ ID NO: 603749 - protein, 9 aa, Homo Sapiens
STNTQNFSS

SEQ ID NO: 603750 - protein, 9 aa, Homo Sapiens
GSESNKYYN

SEQ ID NO: 603751 - protein, 9 aa, Homo Sapiens
KEGLGPCDT

SEQ ID NO: 603752 - protein, 9 aa, Homo Sapiens
EGQFPEHPP

SEQ ID NO: 603753 - protein, 9 aa, Homo Sapiens
WTKDGMNSL

SEQ ID NO: 603754 - protein, 9 aa, Homo Sapiens
YSVWLHGEF

SEQ ID NO: 603755 - protein, 9 aa, Homo Sapiens
EAQISNMEK

SEQ ID NO: 603756 - protein, 9 aa, Homo Sapiens
WARRSQDLY

SEQ ID NO: 603757 - protein, 9 aa, Homo Sapiens
RQLDRIIAT

SEQ ID NO: 603758 - protein, 9 aa, Homo Sapiens
KNRGEFEMV

SEQ ID NO: 603759 - protein, 9 aa, Homo Sapiens
KLRHLPERY

SEQ ID NO: 603760 - protein, 9 aa, Homo Sapiens
QEYMVTNQN

SEQ ID NO: 603761 - protein, 9 aa, Homo Sapiens
TMATFTMAL

SEQ ID NO: 603762 - protein, 9 aa, Homo Sapiens
DCGAELHCQ

SEQ ID NO: 603763 - protein, 9 aa, Homo Sapiens
LCHRYFKNA

SEQ ID NO: 603764 - protein, 9 aa, Homo Sapiens
KACITSRLD

SEQ ID NO: 603765 - protein, 9 aa, Homo Sapiens
AKIKNRGEF

SEQ ID NO: 603766 - protein, 9 aa, Homo Sapiens
VDPFDQGVV

SEQ ID NO: 603767 - protein, 9 aa, Homo Sapiens
ATFTMALAR

SEQ ID NO: 603768 - protein, 9 aa, Homo Sapiens
LTRSYYRGA

SEQ ID NO: 603769 - protein, 9 aa, Homo Sapiens
IASYGRFVD

SEQ ID NO: 603770 - protein, 9 aa, Homo Sapiens
FAESANLNV

SEQ ID NO: 603771 - protein, 9 aa, Homo Sapiens
LQMEHFVDT

SEQ ID NO: 603772 - protein, 9 aa, Homo Sapiens
LLASRGQPA

SEQ ID NO: 603773 - protein, 9 aa, Homo Sapiens
DRLVLLKDE

SEQ ID NO: 603774 - protein, 9 aa, Homo Sapiens
LRRDWPGYS

SEQ ID NO: 603775 - protein, 9 aa, Homo Sapiens
GPPARPQRV

SEQ ID NO: 603776 - protein, 9 aa, Homo Sapiens
FSERSQENG

SEQ ID NO: 603777 - protein, 9 aa, Homo Sapiens
LSDALRRPL

SEQ ID NO: 603778 - protein, 9 aa, Homo Sapiens
LVRARLCTR

SEQ ID NO: 603779 - protein, 9 aa, Homo Sapiens
PHPGPAAGT

SEQ ID NO: 603780 - protein, 9 aa, Homo Sapiens
NTTTAATLP

SEQ ID NO: 603781 - protein, 9 aa, Homo Sapiens
NLQLVRARL

SEQ ID NO: 603782 - protein, 9 aa, Homo Sapiens
IQRVCTQER

SEQ ID NO: 603783 - protein, 9 aa, Homo Sapiens
QNGKLCLVV

SEQ ID NO: 603784 - protein, 9 aa, Homo Sapiens
AIVMDPLRG

SEQ ID NO: 603785 - protein, 9 aa, Homo Sapiens
NSSHRQPIL

SEQ ID NO: 603786 - protein, 9 aa, Homo Sapiens
KLSTAGSES

SEQ ID NO: 603787 - protein, 9 aa, Homo Sapiens
FASCCHIYE

SEQ ID NO: 603788 - protein, 9 aa, Homo Sapiens
HSMVRLVAF

SEQ ID NO: 603789 - protein, 9 aa, Homo Sapiens
SSDNGGIHQ

SEQ ID NO: 603790 - protein, 9 aa, Homo Sapiens
QLPGQWPVA

SEQ ID NO: 603791 - protein, 9 aa, Homo Sapiens
HKLRHLPER

SEQ ID NO: 603792 - protein, 9 aa, Homo Sapiens
RRDWPGYSE

SEQ ID NO: 603793 - protein, 9 aa, Homo Sapiens
ILFASCCHI

SEQ ID NO: 603794 - protein, 9 aa, Homo Sapiens
RARLCTRVS

SEQ ID NO: 603795 - protein, 9 aa, Homo Sapiens
TGDKEVEYN

SEQ ID NO: 603796 - protein, 9 aa, Homo Sapiens
LIRYRKELI

SEQ ID NO: 603797 - protein, 9 aa, Homo Sapiens
ASVLLDLTF

SEQ ID NO: 603798 - protein, 9 aa, Homo Sapiens
LAAVTALYS

SEQ ID NO: 603799 - protein, 9 aa, Homo Sapiens
SLQFLLLSH

SEQ ID NO: 603800 - protein, 9 aa, Homo Sapiens
VGPASRPSP

SEQ ID NO: 603801 - protein, 9 aa, Homo Sapiens
VQSSTQSAQ

SEQ ID NO: 603802 - protein, 9 aa, Homo Sapiens
QYLWMEWNP

SEQ ID NO: 603803 - protein, 9 aa, Homo Sapiens
HSLELECEK

SEQ ID NO: 603804 - protein, 9 aa, Homo Sapiens
NHGDRLVLL

SEQ ID NO: 603805 - protein, 9 aa, Homo Sapiens
ERFRSLTRS

SEQ ID NO: 603806 - protein, 9 aa, Homo Sapiens
ITRDIIDIP

SEQ ID NO: 603807 - protein, 9 aa, Homo Sapiens
RYESSGYTD

SEQ ID NO: 603808 - protein, 9 aa, Homo Sapiens
TTLVVQSKE

SEQ ID NO: 603809 - protein, 9 aa, Homo Sapiens
VQRDIPTPL

SEQ ID NO: 603810 - protein, 9 aa, Homo Sapiens
QFYHTGTKC

SEQ ID NO: 603811 - protein, 9 aa, Homo Sapiens
SHYTTLVVQ

SEQ ID NO: 603812 - protein, 9 aa, Homo Sapiens
RHLVRRIII

SEQ ID NO: 603813 - protein, 9 aa, Homo Sapiens
DLLGVLVQQ

SEQ ID NO: 603814 - protein, 9 aa, Homo Sapiens
DCKVHVRVY

SEQ ID NO: 603815 - protein, 9 aa, Homo Sapiens
SISFSGRLA

SEQ ID NO: 603816 - protein, 9 aa, Homo Sapiens
QQTEKVEWM

SEQ ID NO: 603817 - protein, 9 aa, Homo Sapiens
PKFSHANAQ

SEQ ID NO: 603818 - protein, 9 aa, Homo Sapiens
SGHVETDLA

SEQ ID NO: 603819 - protein, 9 aa, Homo Sapiens
SSKIRDVTL

SEQ ID NO: 603820 - protein, 9 aa, Homo Sapiens
IDEPHAIVM

SEQ ID NO: 603821 - protein, 9 aa, Homo Sapiens
PGNCQLMAP

SEQ ID NO: 603822 - protein, 9 aa, Homo Sapiens
KVEWMTTTC

SEQ ID NO: 603823 - protein, 9 aa, Homo Sapiens
SLHCAQLPG

SEQ ID NO: 603824 - protein, 9 aa, Homo Sapiens
LPPSGHVET

SEQ ID NO: 603825 - protein, 9 aa, Homo Sapiens
VNCELKMLI

SEQ ID NO: 603826 - protein, 9 aa, Homo Sapiens
NQCLLHKTS

SEQ ID NO: 603827 - protein, 9 aa, Homo Sapiens
YRVQRDIPT

SEQ ID NO: 603828 - protein, 9 aa, Homo Sapiens
NCSPSNCKI

SEQ ID NO: 603829 - protein, 9 aa, Homo Sapiens
CAFYGECGK

SEQ ID NO: 603830 - protein, 9 aa, Homo Sapiens
RMGSSGMPG

SEQ ID NO: 603831 - protein, 9 aa, Homo Sapiens
EKGAVYFID

SEQ ID NO: 603832 - protein, 9 aa, Homo Sapiens
SCPRNQPLN

SEQ ID NO: 603833 - protein, 9 aa, Homo Sapiens
PSLVILFAS

SEQ ID NO: 603834 - protein, 9 aa, Homo Sapiens
GLLVDDLRV

SEQ ID NO: 603835 - protein, 9 aa, Homo Sapiens
QSSTQSAQD

SEQ ID NO: 603836 - protein, 9 aa, Homo Sapiens
PELYAFFGD

SEQ ID NO: 603837 - protein, 9 aa, Homo Sapiens
QTFCCVPVP

SEQ ID NO: 603838 - protein, 9 aa, Homo Sapiens
LHNEYPCQF

SEQ ID NO: 603839 - protein, 9 aa, Homo Sapiens
SVQLVQSRY

SEQ ID NO: 603840 - protein, 9 aa, Homo Sapiens
RVCCAEGYW

SEQ ID NO: 603841 - protein, 9 aa, Homo Sapiens
LYCGACRAL

SEQ ID NO: 603842 - protein, 9 aa, Homo Sapiens
HGARERPAG

SEQ ID NO: 603843 - protein, 9 aa, Homo Sapiens
SIFVYDVTP

SEQ ID NO: 603844 - protein, 9 aa, Homo Sapiens
MEQIPSVEE

SEQ ID NO: 603845 - protein, 9 aa, Homo Sapiens
FYVILGFCL

SEQ ID NO: 603846 - protein, 9 aa, Homo Sapiens
VNSYSLHAM

SEQ ID NO: 603847 - protein, 9 aa, Homo Sapiens
ALGPTGRDV

SEQ ID NO: 603848 - protein, 9 aa, Homo Sapiens
LLYHWKTYT

SEQ ID NO: 603849 - protein, 9 aa, Homo Sapiens
EDYEEDKED

SEQ ID NO: 603850 - protein, 9 aa, Homo Sapiens
QQQKIHTGK

SEQ ID NO: 603851 - protein, 9 aa, Homo Sapiens
HPPPFRKLP

SEQ ID NO: 603852 - protein, 9 aa, Homo Sapiens
AFLYVFHSL

SEQ ID NO: 603853 - protein, 9 aa, Homo Sapiens
LTCLSCGSL

SEQ ID NO: 603854 - protein, 9 aa, Homo Sapiens
GRGPPSTPI

SEQ ID NO: 603855 - protein, 9 aa, Homo Sapiens
NLGKFHSMV

SEQ ID NO: 603856 - protein, 9 aa, Homo Sapiens
GPQGLERLL

SEQ ID NO: 603857 - protein, 9 aa, Homo Sapiens
GVNSYSLHA

SEQ ID NO: 603858 - protein, 9 aa, Homo Sapiens
DSEGAVMKE

SEQ ID NO: 603859 - protein, 9 aa, Homo Sapiens
RSCGSGTRR

SEQ ID NO: 603860 - protein, 9 aa, Homo Sapiens
QQKIHTGKK

SEQ ID NO: 603861 - protein, 9 aa, Homo Sapiens
CKEGLGPCD

SEQ ID NO: 603862 - protein, 9 aa, Homo Sapiens
SNMEKAPGG

SEQ ID NO: 603863 - protein, 9 aa, Homo Sapiens
NETWTHLAL

SEQ ID NO: 603864 - protein, 9 aa, Homo Sapiens
VSIFVYDVT

SEQ ID NO: 603865 - protein, 9 aa, Homo Sapiens
GLGPCDTTS

SEQ ID NO: 603866 - protein, 9 aa, Homo Sapiens
GDRTLPLRT

SEQ ID NO: 603867 - protein, 9 aa, Homo Sapiens
VTMATFTMA

SEQ ID NO: 603868 - protein, 9 aa, Homo Sapiens
RYWKNANET

SEQ ID NO: 603869 - protein, 9 aa, Homo Sapiens
TMALARVCL

SEQ ID NO: 603870 - protein, 9 aa, Homo Sapiens
QLDRIIATL

SEQ ID NO: 603871 - protein, 9 aa, Homo Sapiens
STQSAQDTY

SEQ ID NO: 603872 - protein, 9 aa, Homo Sapiens
DCEMKIGDP

SEQ ID NO: 603873 - protein, 9 aa, Homo Sapiens
LTMEQIPSV

SEQ ID NO: 603874 - protein, 9 aa, Homo Sapiens
SLDGGGGGG

SEQ ID NO: 603875 - protein, 9 aa, Homo Sapiens
GYCAFYGEC

SEQ ID NO: 603876 - protein, 9 aa, Homo Sapiens
YGVNSYSLH

SEQ ID NO: 603877 - protein, 9 aa, Homo Sapiens
DLYCGACRA

SEQ ID NO: 603878 - protein, 9 aa, Homo Sapiens
PPEFRRWDY

SEQ ID NO: 603879 - protein, 9 aa, Homo Sapiens
REFKQFVEV

SEQ ID NO: 603880 - protein, 9 aa, Homo Sapiens
DWGPSFKKL

SEQ ID NO: 603881 - protein, 9 aa, Homo Sapiens
ESANLNVSI

SEQ ID NO: 603882 - protein, 9 aa, Homo Sapiens
EVWASRTVT

SEQ ID NO: 603883 - protein, 9 aa, Homo Sapiens
SRGRRRARS

SEQ ID NO: 603884 - protein, 9 aa, Homo Sapiens
SSLEDLVVN

SEQ ID NO: 603885 - protein, 9 aa, Homo Sapiens
VRVYLPPLD

SEQ ID NO: 603886 - protein, 9 aa, Homo Sapiens
VRSHLAAVT

SEQ ID NO: 603887 - protein, 9 aa, Homo Sapiens
GVSEIENSV

SEQ ID NO: 603888 - protein, 9 aa, Homo Sapiens
LADIYPELY

SEQ ID NO: 603889 - protein, 9 aa, Homo Sapiens
NRGEFEMVF

SEQ ID NO: 603890 - protein, 9 aa, Homo Sapiens
GGIHQESSQ

SEQ ID NO: 603891 - protein, 9 aa, Homo Sapiens
PEHPPEGAT

SEQ ID NO: 603892 - protein, 9 aa, Homo Sapiens
DRFSSFCSQ

SEQ ID NO: 603893 - protein, 9 aa, Homo Sapiens
CEMKIGDPA

SEQ ID NO: 603894 - protein, 9 aa, Homo Sapiens
ASDQIELNR

SEQ ID NO: 603895 - protein, 9 aa, Homo Sapiens
LNGTYNKPR

SEQ ID NO: 603896 - protein, 9 aa, Homo Sapiens
NTQNFSSES

SEQ ID NO: 603897 - protein, 9 aa, Homo Sapiens
VPSAGHCWT

SEQ ID NO: 603898 - protein, 9 aa, Homo Sapiens
VPASSCSVE

SEQ ID NO: 603899 - protein, 9 aa, Homo Sapiens
GSRYLYPLL

SEQ ID NO: 603900 - protein, 9 aa, Homo Sapiens
VNLNPNAKE

SEQ ID NO: 603901 - protein, 9 aa, Homo Sapiens
VRARLCTRV

SEQ ID NO: 603902 - protein, 9 aa, Homo Sapiens
PPQNCSPSN

SEQ ID NO: 603903 - protein, 9 aa, Homo Sapiens
KDVITLGDF

SEQ ID NO: 603904 - protein, 9 aa, Homo Sapiens
GSSDNGGIH

SEQ ID NO: 603905 - protein, 9 aa, Homo Sapiens
CELKMLIMM

SEQ ID NO: 603906 - protein, 9 aa, Homo Sapiens
SNNIMFKKS

SEQ ID NO: 603907 - protein, 9 aa, Homo Sapiens
VHADNYTMD

SEQ ID NO: 603908 - protein, 9 aa, Homo Sapiens
DAITHVKLK

SEQ ID NO: 603909 - protein, 9 aa, Homo Sapiens
RDVVEYFGL

SEQ ID NO: 603910 - protein, 9 aa, Homo Sapiens
LLPIERAAW

SEQ ID NO: 603911 - protein, 9 aa, Homo Sapiens
AGKQGRGPP

SEQ ID NO: 603912 - protein, 9 aa, Homo Sapiens
RPSWECGSR

SEQ ID NO: 603913 - protein, 9 aa, Homo Sapiens
PGTGLSALC

SEQ ID NO: 603914 - protein, 9 aa, Homo Sapiens
PLLASRGQP

SEQ ID NO: 603915 - protein, 9 aa, Homo Sapiens
LNRLKAQLE

SEQ ID NO: 603916 - protein, 9 aa, Homo Sapiens
GTRRDSRVQ

SEQ ID NO: 603917 - protein, 9 aa, Homo Sapiens
ERKRKLNEN

SEQ ID NO: 603918 - protein, 9 aa, Homo Sapiens
FKQFVEVHA

SEQ ID NO: 603919 - protein, 9 aa, Homo Sapiens
WVLALGQCI

SEQ ID NO: 603920 - protein, 9 aa, Homo Sapiens
VASDQIELN

SEQ ID NO: 603921 - protein, 9 aa, Homo Sapiens
PSGLGGGGG

SEQ ID NO: 603922 - protein, 9 aa, Homo Sapiens
IQEYMVTNQ

SEQ ID NO: 603923 - protein, 9 aa, Homo Sapiens
YEPSVSKKT

SEQ ID NO: 603924 - protein, 9 aa, Homo Sapiens
DKRKVKPLL

SEQ ID NO: 603925 - protein, 9 aa, Homo Sapiens
WLNGSQRVP

SEQ ID NO: 603926 - protein, 9 aa, Homo Sapiens
AQDSEGAVM

SEQ ID NO: 603927 - protein, 9 aa, Homo Sapiens
WECGSRYLY

SEQ ID NO: 603928 - protein, 9 aa, Homo Sapiens
RFFKRRTNL

SEQ ID NO: 603929 - protein, 9 aa, Homo Sapiens
RKRKLNENA

SEQ ID NO: 603930 - protein, 9 aa, Homo Sapiens
AMYLQMEHF

SEQ ID NO: 603931 - protein, 9 aa, Homo Sapiens
AMERICENR

SEQ ID NO: 603932 - protein, 9 aa, Homo Sapiens
LGGGGGAPG

SEQ ID NO: 603933 - protein, 9 aa, Homo Sapiens
RWQHSQTRA

SEQ ID NO: 603934 - protein, 9 aa, Homo Sapiens
GRRRKITRD

SEQ ID NO: 603935 - protein, 9 aa, Homo Sapiens
VLSSVENGG

SEQ ID NO: 603936 - protein, 9 aa, Homo Sapiens
SVETAQRAY

SEQ ID NO: 603937 - protein, 9 aa, Homo Sapiens
YPIQTLVNT

SEQ ID NO: 603938 - protein, 9 aa, Homo Sapiens
EKVEWMTTT

SEQ ID NO: 603939 - protein, 9 aa, Homo Sapiens
PSGATTTAP

SEQ ID NO: 603940 - protein, 9 aa, Homo Sapiens
NGKLCLVVQ

SEQ ID NO: 603941 - protein, 9 aa, Homo Sapiens
FLYVFHSLY

SEQ ID NO: 603942 - protein, 9 aa, Homo Sapiens
KDGMNSLTY

SEQ ID NO: 603943 - protein, 9 aa, Homo Sapiens
HSIQRSLPA

SEQ ID NO: 603944 - protein, 9 aa, Homo Sapiens
TTPVEQNPE

SEQ ID NO: 603945 - protein, 9 aa, Homo Sapiens
KQFVEVHAD

SEQ ID NO: 603946 - protein, 9 aa, Homo Sapiens
KLCLVVQVA

SEQ ID NO: 603947 - protein, 9 aa, Homo Sapiens
FANIGGALS

SEQ ID NO: 603948 - protein, 9 aa, Homo Sapiens
QRACSHTVT

SEQ ID NO: 603949 - protein, 9 aa, Homo Sapiens
PPARPQRVC

SEQ ID NO: 603950 - protein, 9 aa, Homo Sapiens
SSVENGGTY

SEQ ID NO: 603951 - protein, 9 aa, Homo Sapiens
RHDKEDPDC

SEQ ID NO: 603952 - protein, 9 aa, Homo Sapiens
FSGNSLHCA

SEQ ID NO: 603953 - protein, 9 aa, Homo Sapiens
GRDTYRRSA

SEQ ID NO: 603954 - protein, 9 aa, Homo Sapiens
STGKLSTAG

SEQ ID NO: 603955 - protein, 9 aa, Homo Sapiens
DRTVSKAMT

SEQ ID NO: 603956 - protein, 9 aa, Homo Sapiens
DPEIQRVCT

SEQ ID NO: 603957 - protein, 9 aa, Homo Sapiens
IPSGATTTA

SEQ ID NO: 603958 - protein, 9 aa, Homo Sapiens
QNHGDRLVL

SEQ ID NO: 603959 - protein, 9 aa, Homo Sapiens
VFHSLYPKY

SEQ ID NO: 603960 - protein, 9 aa, Homo Sapiens
QSSASFLPP

SEQ ID NO: 603961 - protein, 9 aa, Homo Sapiens
GRHLVRRII

SEQ ID NO: 603962 - protein, 9 aa, Homo Sapiens
QAVLRQMSK

SEQ ID NO: 603963 - protein, 9 aa, Homo Sapiens
THLALGQAI

SEQ ID NO: 603964 - protein, 9 aa, Homo Sapiens
ETRQKQYLW

SEQ ID NO: 603965 - protein, 9 aa, Homo Sapiens
SFCSQSQNH

SEQ ID NO: 603966 - protein, 9 aa, Homo Sapiens
MDPLRGTMY

SEQ ID NO: 603967 - protein, 9 aa, Homo Sapiens
ECGSRYLYP

SEQ ID NO: 603968 - protein, 9 aa, Homo Sapiens
QGRGPPSTP

SEQ ID NO: 603969 - protein, 9 aa, Homo Sapiens
DNTIPFLIR

SEQ ID NO: 603970 - protein, 9 aa, Homo Sapiens
TGATCAPGD

SEQ ID NO: 603971 - protein, 9 aa, Homo Sapiens
LVNTSLNPS

SEQ ID NO: 603972 - protein, 9 aa, Homo Sapiens
ENRVDPFDQ

SEQ ID NO: 603973 - protein, 9 aa, Homo Sapiens
RRARSGPRR

SEQ ID NO: 603974 - protein, 9 aa, Homo Sapiens
DQSATCVSL

SEQ ID NO: 603975 - protein, 9 aa, Homo Sapiens
AAGTVGVPL

SEQ ID NO: 603976 - protein, 9 aa, Homo Sapiens
NGLLTPIIK

SEQ ID NO: 603977 - protein, 9 aa, Homo Sapiens
SAGHCWTCL

SEQ ID NO: 603978 - protein, 9 aa, Homo Sapiens
NAQDSEGAV

SEQ ID NO: 603979 - protein, 9 aa, Homo Sapiens
SSASFLPPG

SEQ ID NO: 603980 - protein, 9 aa, Homo Sapiens
DRTLPLRTP

SEQ ID NO: 603981 - protein, 9 aa, Homo Sapiens
LLLSHDLFV

SEQ ID NO: 603982 - protein, 9 aa, Homo Sapiens
TAYWTNFAK

SEQ ID NO: 603983 - protein, 9 aa, Homo Sapiens
WQHSQTRAL

SEQ ID NO: 603984 - protein, 9 aa, Homo Sapiens
EYMVTNQNG

SEQ ID NO: 603985 - protein, 9 aa, Homo Sapiens
LVHGFQEEE

SEQ ID NO: 603986 - protein, 9 aa, Homo Sapiens
HLALGQAIA

SEQ ID NO: 603987 - protein, 9 aa, Homo Sapiens
QLVQSRYVQ

SEQ ID NO: 603988 - protein, 9 aa, Homo Sapiens
TVSKAMTAY

SEQ ID NO: 603989 - protein, 9 aa, Homo Sapiens
LHKLRHLPE

SEQ ID NO: 603990 - protein, 9 aa, Homo Sapiens
SKIRDVTLL

SEQ ID NO: 603991 - protein, 9 aa, Homo Sapiens
VHGFQEEEV

SEQ ID NO: 603992 - protein, 9 aa, Homo Sapiens
DKEDPDCIK

SEQ ID NO: 603993 - protein, 9 aa, Homo Sapiens
VAVATDNGL

SEQ ID NO: 603994 - protein, 9 aa, Homo Sapiens
YVFKELRRD

SEQ ID NO: 603995 - protein, 9 aa, Homo Sapiens
PLNPLLTTP

SEQ ID NO: 603996 - protein, 9 aa, Homo Sapiens
KSSHSGVSE

SEQ ID NO: 603997 - protein, 9 aa, Homo Sapiens
HTTDIPHPA

SEQ ID NO: 603998 - protein, 9 aa, Homo Sapiens
QSRYVQSLL

SEQ ID NO: 603999 - protein, 9 aa, Homo Sapiens
RIVVADKGN

SEQ ID NO: 604000 - protein, 9 aa, Homo Sapiens
SRYLFQFHR

SEQ ID NO: 604001 - protein, 9 aa, Homo Sapiens
AYRPPVPGG

SEQ ID NO: 604002 - protein, 9 aa, Homo Sapiens
RVNCELKML

SEQ ID NO: 604003 - protein, 9 aa, Homo Sapiens
SDAGKQGRG

SEQ ID NO: 604004 - protein, 9 aa, Homo Sapiens
KNFFFFFFF

SEQ ID NO: 604005 - protein, 9 aa, Homo Sapiens
NYSVTSPGL

SEQ ID NO: 604006 - protein, 9 aa, Homo Sapiens
YIDCEMKIG

SEQ ID NO: 604007 - protein, 9 aa, Homo Sapiens
APGMMNYSV

SEQ ID NO: 604008 - protein, 9 aa, Homo Sapiens
HGFQEEEVS

SEQ ID NO: 604009 - protein, 9 aa, Homo Sapiens
PWGAPGSAD

SEQ ID NO: 604010 - protein, 9 aa, Homo Sapiens
TGIEPSSEG

SEQ ID NO: 604011 - protein, 9 aa, Homo Sapiens
DYVFKELRR

SEQ ID NO: 604012 - protein, 9 aa, Homo Sapiens
PPPFRKLPA

SEQ ID NO: 604013 - protein, 9 aa, Homo Sapiens
ERPAGGARG

SEQ ID NO: 604014 - protein, 9 aa, Homo Sapiens
SSYNEYLPS

SEQ ID NO: 604015 - protein, 9 aa, Homo Sapiens
LENEQTSTV

SEQ ID NO: 604016 - protein, 9 aa, Homo Sapiens
IPFLIRYRK

SEQ ID NO: 604017 - protein, 9 aa, Homo Sapiens
LGEKKRYDR

SEQ ID NO: 604018 - protein, 9 aa, Homo Sapiens
ELECEKLAS

SEQ ID NO: 604019 - protein, 9 aa, Homo Sapiens
KYYNPVKED

SEQ ID NO: 604020 - protein, 9 aa, Homo Sapiens
LVDGSLSTG

SEQ ID NO: 604021 - protein, 9 aa, Homo Sapiens
YCGACRALV

SEQ ID NO: 604022 - protein, 9 aa, Homo Sapiens
PTPLVSSGV

SEQ ID NO: 604023 - protein, 9 aa, Homo Sapiens
LADIPVSPQ

SEQ ID NO: 604024 - protein, 9 aa, Homo Sapiens
GFVRGQLPL

SEQ ID NO: 604025 - protein, 9 aa, Homo Sapiens
RRRKITRDI

SEQ ID NO: 604026 - protein, 9 aa, Homo Sapiens
EVHADNYTM

SEQ ID NO: 604027 - protein, 9 aa, Homo Sapiens
NHMMLNITL

SEQ ID NO: 604028 - protein, 9 aa, Homo Sapiens
ADRTLAPSC

SEQ ID NO: 604029 - protein, 9 aa, Homo Sapiens
FCSQSQNHP

SEQ ID NO: 604030 - protein, 9 aa, Homo Sapiens
INFDHVYKV

SEQ ID NO: 604031 - protein, 9 aa, Homo Sapiens
CSDCGAELH

SEQ ID NO: 604032 - protein, 9 aa, Homo Sapiens
LHKTSGCLT

SEQ ID NO: 604033 - protein, 9 aa, Homo Sapiens
LAEVQRHLD

SEQ ID NO: 604034 - protein, 9 aa, Homo Sapiens
YRYESSGYT

SEQ ID NO: 604035 - protein, 9 aa, Homo Sapiens
SANLNVSIH

SEQ ID NO: 604036 - protein, 9 aa, Homo Sapiens
PPSRYLFQF

SEQ ID NO: 604037 - protein, 9 aa, Homo Sapiens
WTHSIQRSL

SEQ ID NO: 604038 - protein, 9 aa, Homo Sapiens
GEASRGRRR

SEQ ID NO: 604039 - protein, 9 aa, Homo Sapiens
LCDIKLAYT

SEQ ID NO: 604040 - protein, 9 aa, Homo Sapiens
SIQRSLPAI

SEQ ID NO: 604041 - protein, 9 aa, Homo Sapiens
PAPGEGNFS

SEQ ID NO: 604042 - protein, 9 aa, Homo Sapiens
GLGGGGGAP

SEQ ID NO: 604043 - protein, 9 aa, Homo Sapiens
SERSQENGR

SEQ ID NO: 604044 - protein, 9 aa, Homo Sapiens
IIATLQSKE

SEQ ID NO: 604045 - protein, 9 aa, Homo Sapiens
NGTYNKPRA

SEQ ID NO: 604046 - protein, 9 aa, Homo Sapiens
SDALRRPLA

SEQ ID NO: 604047 - protein, 9 aa, Homo Sapiens
EAGRDTYRR

SEQ ID NO: 604048 - protein, 9 aa, Homo Sapiens
HGLARLTSH

SEQ ID NO: 604049 - protein, 9 aa, Homo Sapiens
MGSSGMPGG

SEQ ID NO: 604050 - protein, 9 aa, Homo Sapiens
TASGCVPAS

SEQ ID NO: 604051 - protein, 9 aa, Homo Sapiens
TTRWQHSQT

SEQ ID NO: 604052 - protein, 9 aa, Homo Sapiens
LLFNEEGKN

SEQ ID NO: 604053 - protein, 9 aa, Homo Sapiens
TGLSALCPA

SEQ ID NO: 604054 - protein, 9 aa, Homo Sapiens
CAQLPGQWP

SEQ ID NO: 604055 - protein, 9 aa, Homo Sapiens
PGPPARPQR

SEQ ID NO: 604056 - protein, 9 aa, Homo Sapiens
YLYPLLASR

SEQ ID NO: 604057 - protein, 9 aa, Homo Sapiens
EYPCQFYHT

SEQ ID NO: 604058 - protein, 9 aa, Homo Sapiens
QARMGSSGM

SEQ ID NO: 604059 - protein, 9 aa, Homo Sapiens
SSLMMILSI

SEQ ID NO: 604060 - protein, 9 aa, Homo Sapiens
HHHPPPFRK

SEQ ID NO: 604061 - protein, 9 aa, Homo Sapiens
VPKNFFFFF

SEQ ID NO: 604062 - protein, 9 aa, Homo Sapiens
TTAATLPNK

SEQ ID NO: 604063 - protein, 9 aa, Homo Sapiens
VTLLFNEEG

SEQ ID NO: 604064 - protein, 9 aa, Homo Sapiens
LLTTPVEQN

SEQ ID NO: 604065 - protein, 9 aa, Homo Sapiens
AKCKPLWIE

SEQ ID NO: 604066 - protein, 9 aa, Homo Sapiens
MARQVGEGC

SEQ ID NO: 604067 - protein, 9 aa, Homo Sapiens
GTGNETWTH

SEQ ID NO: 604068 - protein, 9 aa, Homo Sapiens
YGRFVDQSA

SEQ ID NO: 604069 - protein, 9 aa, Homo Sapiens
HGRRRKITR

SEQ ID NO: 604070 - protein, 9 aa, Homo Sapiens
TVGVPLYAP

SEQ ID NO: 604071 - protein, 9 aa, Homo Sapiens
VYDVTPGAE

SEQ ID NO: 604072 - protein, 9 aa, Homo Sapiens
QPGYCAFYG

SEQ ID NO: 604073 - protein, 9 aa, Homo Sapiens
YEEDKEDDD

SEQ ID NO: 604074 - protein, 9 aa, Homo Sapiens
DPPKSSRPT

SEQ ID NO: 604075 - protein, 9 aa, Homo Sapiens
MSLAEVQRH

SEQ ID NO: 604076 - protein, 9 aa, Homo Sapiens
VDDLRVYNG

SEQ ID NO: 604077 - protein, 9 aa, Homo Sapiens
AGRESGKLN

SEQ ID NO: 604078 - protein, 9 aa, Homo Sapiens
SGTRRDSRV

SEQ ID NO: 604079 - protein, 9 aa, Homo Sapiens
SKRNQCLLH

SEQ ID NO: 604080 - protein, 9 aa, Homo Sapiens
ELRRDWPGY

SEQ ID NO: 604081 - protein, 9 aa, Homo Sapiens
LGVLVQQSR

SEQ ID NO: 604082 - protein, 9 aa, Homo Sapiens
KAASTRTDL

SEQ ID NO: 604083 - protein, 9 aa, Homo Sapiens
VMDPLRGTM

SEQ ID NO: 604084 - protein, 9 aa, Homo Sapiens
SEGQFPEHP

SEQ ID NO: 604085 - protein, 9 aa, Homo Sapiens
VTALCDIKL

SEQ ID NO: 604086 - protein, 9 aa, Homo Sapiens
DESEDVKTA

SEQ ID NO: 604087 - protein, 9 aa, Homo Sapiens
AEVQRHLDK

SEQ ID NO: 604088 - protein, 9 aa, Homo Sapiens
TTDIPHPAI

SEQ ID NO: 604089 - protein, 9 aa, Homo Sapiens
QRSLPAIWA

SEQ ID NO: 604090 - protein, 9 aa, Homo Sapiens
LRRPLARTA

SEQ ID NO: 604091 - protein, 9 aa, Homo Sapiens
ISVAVATDN

SEQ ID NO: 604092 - protein, 9 aa, Homo Sapiens
GSRGEEAQL

SEQ ID NO: 604093 - protein, 9 aa, Homo Sapiens
YDLLGVLVQ

SEQ ID NO: 604094 - protein, 9 aa, Homo Sapiens
QERFRSLTR

SEQ ID NO: 604095 - protein, 9 aa, Homo Sapiens
ECGRFFKRR

SEQ ID NO: 604096 - protein, 9 aa, Homo Sapiens
ALCDIKLAY

SEQ ID NO: 604097 - protein, 9 aa, Homo Sapiens
SQSSTLFQQ

SEQ ID NO: 604098 - protein, 9 aa, Homo Sapiens
HKVVLASSR

SEQ ID NO: 604099 - protein, 9 aa, Homo Sapiens
EDKEDDDDD

SEQ ID NO: 604100 - protein, 9 aa, Homo Sapiens
SGNSLHCAQ

SEQ ID NO: 604101 - protein, 9 aa, Homo Sapiens
VCTQEREQI

SEQ ID NO: 604102 - protein, 9 aa, Homo Sapiens
VETAQRAYV

SEQ ID NO: 604103 - protein, 9 aa, Homo Sapiens
SFSGRLAQI

SEQ ID NO: 604104 - protein, 9 aa, Homo Sapiens
ALTCLSCGS

SEQ ID NO: 604105 - protein, 9 aa, Homo Sapiens
CCHIYEKGP

SEQ ID NO: 604106 - protein, 9 aa, Homo Sapiens
GEAGRDTYR

SEQ ID NO: 604107 - protein, 9 aa, Homo Sapiens
SNHMMLNIT

SEQ ID NO: 604108 - protein, 9 aa, Homo Sapiens
LRTPTMAGG

SEQ ID NO: 604109 - protein, 9 aa, Homo Sapiens
TLLFNEEGK

SEQ ID NO: 604110 - protein, 9 aa, Homo Sapiens
YYSSHYTTL

SEQ ID NO: 604111 - protein, 9 aa, Homo Sapiens
IVLPPSGHV

SEQ ID NO: 604112 - protein, 9 aa, Homo Sapiens
TLPNKSYSV

SEQ ID NO: 604113 - protein, 9 aa, Homo Sapiens
SALAQHILY

SEQ ID NO: 604114 - protein, 9 aa, Homo Sapiens
ASRGRRRAR

SEQ ID NO: 604115 - protein, 9 aa, Homo Sapiens
FLHKLRHLP

SEQ ID NO: 604116 - protein, 9 aa, Homo Sapiens
MERICENRR

SEQ ID NO: 604117 - protein, 9 aa, Homo Sapiens
VLLDLTFLT

SEQ ID NO: 604118 - protein, 9 aa, Homo Sapiens
RTVSKAMTA

SEQ ID NO: 604119 - protein, 9 aa, Homo Sapiens
KGAVYFIDH

SEQ ID NO: 604120 - protein, 9 aa, Homo Sapiens
YLDSGIPSG

SEQ ID NO: 604121 - protein, 9 aa, Homo Sapiens
PPFRKLPAS

SEQ ID NO: 604122 - protein, 9 aa, Homo Sapiens
RSHLAAVTA

SEQ ID NO: 604123 - protein, 9 aa, Homo Sapiens
SVLLDLTFL

SEQ ID NO: 604124 - protein, 9 aa, Homo Sapiens
NTGVGPASR

SEQ ID NO: 604125 - protein, 9 aa, Homo Sapiens
QCILAGAFA

SEQ ID NO: 604126 - protein, 9 aa, Homo Sapiens
DVRSHLAAV

SEQ ID NO: 604127 - protein, 9 aa, Homo Sapiens
GQFAAYWLP

SEQ ID NO: 604128 - protein, 9 aa, Homo Sapiens
RLLMRTGDK

SEQ ID NO: 604129 - protein, 9 aa, Homo Sapiens
IPWGAPGSA

SEQ ID NO: 604130 - protein, 9 aa, Homo Sapiens
RVQRDIPTP

SEQ ID NO: 604131 - protein, 9 aa, Homo Sapiens
LTSPGGVSP

SEQ ID NO: 604132 - protein, 9 aa, Homo Sapiens
EGNFSQNSR

SEQ ID NO: 604133 - protein, 9 aa, Homo Sapiens
WRYRVEMIK

SEQ ID NO: 604134 - protein, 9 aa, Homo Sapiens
AYWLPYGCA

SEQ ID NO: 604135 - protein, 9 aa, Homo Sapiens
ALLFSALAQ

SEQ ID NO: 604136 - protein, 9 aa, Homo Sapiens
PFSERSQEN

SEQ ID NO: 604137 - protein, 9 aa, Homo Sapiens
VITLGDFGQ

SEQ ID NO: 604138 - protein, 9 aa, Homo Sapiens
TALCDIKLA

SEQ ID NO: 604139 - protein, 9 aa, Homo Sapiens
CWTCLLIAE

SEQ ID NO: 604140 - protein, 9 aa, Homo Sapiens
LPNKSYSVQ

SEQ ID NO: 604141 - protein, 9 aa, Homo Sapiens
RGQLPLPVV

SEQ ID NO: 604142 - protein, 9 aa, Homo Sapiens
RYRVEMIKG

SEQ ID NO: 604143 - protein, 9 aa, Homo Sapiens
QTLVNTSLN

SEQ ID NO: 604144 - protein, 9 aa, Homo Sapiens
PGPHTTDIP

SEQ ID NO: 604145 - protein, 9 aa, Homo Sapiens
RIIATLQSK

SEQ ID NO: 604146 - protein, 9 aa, Homo Sapiens
SPGGVSPSR

SEQ ID NO: 604147 - protein, 9 aa, Homo Sapiens
RSLDGGGGG

SEQ ID NO: 604148 - protein, 9 aa, Homo Sapiens
HYTLNLHVF

SEQ ID NO: 604149 - protein, 9 aa, Homo Sapiens
GPHTTDIPH

SEQ ID NO: 604150 - protein, 9 aa, Homo Sapiens
LQAQYHSLE

SEQ ID NO: 604151 - protein, 9 aa, Homo Sapiens
IVVADKGNH

SEQ ID NO: 604152 - protein, 9 aa, Homo Sapiens
TQLDLERKR

SEQ ID NO: 604153 - protein, 9 aa, Homo Sapiens
NRRHEGLPG

SEQ ID NO: 604154 - protein, 9 aa, Homo Sapiens
NRGGPQGLE

SEQ ID NO: 604155 - protein, 9 aa, Homo Sapiens
NLHVFWPLV

SEQ ID NO: 604156 - protein, 9 aa, Homo Sapiens
NKYYNPVKE

SEQ ID NO: 604157 - protein, 9 aa, Homo Sapiens
WIVWSALDS

SEQ ID NO: 604158 - protein, 9 aa, Homo Sapiens
VLPPSGHVE

SEQ ID NO: 604159 - protein, 9 aa, Homo Sapiens
IPSVEETQI

SEQ ID NO: 604160 - protein, 9 aa, Homo Sapiens
VLDPAWHLC

SEQ ID NO: 604161 - protein, 9 aa, Homo Sapiens
AVGSPLLPC

SEQ ID NO: 604162 - protein, 9 aa, Homo Sapiens
TQSAQDTYL

SEQ ID NO: 604163 - protein, 9 aa, Homo Sapiens
RELIPWGAP

SEQ ID NO: 604164 - protein, 9 aa, Homo Sapiens
VRMMNGKPK

SEQ ID NO: 604165 - protein, 9 aa, Homo Sapiens
AVTALYSLV

SEQ ID NO: 604166 - protein, 9 aa, Homo Sapiens
RSLTRSYYR

SEQ ID NO: 604167 - protein, 9 aa, Homo Sapiens
NFSQNSRNK

SEQ ID NO: 604168 - protein, 9 aa, Homo Sapiens
RYLFQFHRL

SEQ ID NO: 604169 - protein, 9 aa, Homo Sapiens
ERAAWKQKA

SEQ ID NO: 604170 - protein, 9 aa, Homo Sapiens
DLENEQTST

SEQ ID NO: 604171 - protein, 9 aa, Homo Sapiens
HINFDHVYK

SEQ ID NO: 604172 - protein, 9 aa, Homo Sapiens
SRELCRTYV

SEQ ID NO: 604173 - protein, 9 aa, Homo Sapiens
CQCVCKRSC

SEQ ID NO: 604174 - protein, 9 aa, Homo Sapiens
VRGQLPLPV

SEQ ID NO: 604175 - protein, 9 aa, Homo Sapiens
SALDSSMRG

SEQ ID NO: 604176 - protein, 9 aa, Homo Sapiens
QRHDKEDPD

SEQ ID NO: 604177 - protein, 9 aa, Homo Sapiens
TSPGGVSPS

SEQ ID NO: 604178 - protein, 9 aa, Homo Sapiens
SFLPPGAPG

SEQ ID NO: 604179 - protein, 9 aa, Homo Sapiens
CGSRYLYPL

SEQ ID NO: 604180 - protein, 9 aa, Homo Sapiens
ESSGYTDQF

SEQ ID NO: 604181 - protein, 9 aa, Homo Sapiens
TDMARQVGE

SEQ ID NO: 604182 - protein, 9 aa, Homo Sapiens
ASGCVPASS

SEQ ID NO: 604183 - protein, 9 aa, Homo Sapiens
NLGELVHGF

SEQ ID NO: 604184 - protein, 9 aa, Homo Sapiens
LASSRPVFK

SEQ ID NO: 604185 - protein, 9 aa, Homo Sapiens
RVDPFDQGV

SEQ ID NO: 604186 - protein, 9 aa, Homo Sapiens
EKAPGGVIT

SEQ ID NO: 604187 - protein, 9 aa, Homo Sapiens
TQNSWTKDG

SEQ ID NO: 604188 - protein, 9 aa, Homo Sapiens
LPIERAAWK

SEQ ID NO: 604189 - protein, 9 aa, Homo Sapiens
ESEDVKTAT

SEQ ID NO: 604190 - protein, 9 aa, Homo Sapiens
VENGGTYVS

SEQ ID NO: 604191 - protein, 9 aa, Homo Sapiens
HQESSQIQI

SEQ ID NO: 604192 - protein, 9 aa, Homo Sapiens
SQKSHVVVH

SEQ ID NO: 604193 - protein, 9 aa, Homo Sapiens
QCVCKRSCP

SEQ ID NO: 604194 - protein, 9 aa, Homo Sapiens
VGSPLLPCS

SEQ ID NO: 604195 - protein, 9 aa, Homo Sapiens
RTSIETNVH

SEQ ID NO: 604196 - protein, 9 aa, Homo Sapiens
LLHHHPPPF

SEQ ID NO: 604197 - protein, 9 aa, Homo Sapiens
SLYPKYILP

SEQ ID NO: 604198 - protein, 9 aa, Homo Sapiens
RKITRDIID

SEQ ID NO: 604199 - protein, 9 aa, Homo Sapiens
YCAFYGECG

SEQ ID NO: 604200 - protein, 9 aa, Homo Sapiens
ENNLNGTYN

SEQ ID NO: 604201 - protein, 9 aa, Homo Sapiens
AVNAQDSEG

SEQ ID NO: 604202 - protein, 9 aa, Homo Sapiens
KEDCKVHVR

SEQ ID NO: 604203 - protein, 9 aa, Homo Sapiens
LDSGIPSGA

SEQ ID NO: 604204 - protein, 9 aa, Homo Sapiens
LRERYWKNA

SEQ ID NO: 604205 - protein, 9 aa, Homo Sapiens
LQFLLLSHD

SEQ ID NO: 604206 - protein, 9 aa, Homo Sapiens
CSPSNCKIS

SEQ ID NO: 604207 - protein, 9 aa, Homo Sapiens
RLCTRVSDT

SEQ ID NO: 604208 - protein, 9 aa, Homo Sapiens
PLTSPGGVS

SEQ ID NO: 604209 - protein, 9 aa, Homo Sapiens
GMMNYSVTS

SEQ ID NO: 604210 - protein, 9 aa, Homo Sapiens
GLWTHSIQR

SEQ ID NO: 604211 - protein, 9 aa, Homo Sapiens
EDLVVNLNP

SEQ ID NO: 604212 - protein, 9 aa, Homo Sapiens
KNTGVGPAS

SEQ ID NO: 604213 - protein, 9 aa, Homo Sapiens
PSGHVETDL

SEQ ID NO: 604214 - protein, 9 aa, Homo Sapiens
IPTPLVSSG

SEQ ID NO: 604215 - protein, 9 aa, Homo Sapiens
RAAWKQKAR

SEQ ID NO: 604216 - protein, 9 aa, Homo Sapiens
CGECIIAGR

SEQ ID NO: 604217 - protein, 9 aa, Homo Sapiens
ERICENRRH

SEQ ID NO: 604218 - protein, 9 aa, Homo Sapiens
LFANRGGPQ

SEQ ID NO: 604219 - protein, 9 aa, Homo Sapiens
LPGQWPVAL

SEQ ID NO: 604220 - protein, 9 aa, Homo Sapiens
ALFRELIPW

SEQ ID NO: 604221 - protein, 9 aa, Homo Sapiens
DVTLLFNEE

SEQ ID NO: 604222 - protein, 9 aa, Homo Sapiens
SSHRQPILV

SEQ ID NO: 604223 - protein, 9 aa, Homo Sapiens
RMVAHTKDM

SEQ ID NO: 604224 - protein, 9 aa, Homo Sapiens
AQRAYVKEH

SEQ ID NO: 604225 - protein, 9 aa, Homo Sapiens
ICENRRHEG

SEQ ID NO: 604226 - protein, 9 aa, Homo Sapiens
RTGDKEVEY

SEQ ID NO: 604227 - protein, 9 aa, Homo Sapiens
EWMSKLAKC

SEQ ID NO: 604228 - protein, 9 aa, Homo Sapiens
LLGVLVQQS

SEQ ID NO: 604229 - protein, 9 aa, Homo Sapiens
VLASSRPVF

SEQ ID NO: 604230 - protein, 9 aa, Homo Sapiens
NLLTMEQIP

SEQ ID NO: 604231 - protein, 9 aa, Homo Sapiens
YGECGKNPE

SEQ ID NO: 604232 - protein, 9 aa, Homo Sapiens
QCLLHKTSG

SEQ ID NO: 604233 - protein, 9 aa, Homo Sapiens
GALTCLSCG

SEQ ID NO: 604234 - protein, 9 aa, Homo Sapiens
LNGSQRVPE

SEQ ID NO: 604235 - protein, 9 aa, Homo Sapiens
LYHWKTYTF

SEQ ID NO: 604236 - protein, 9 aa, Homo Sapiens
PSGVNCSDC

SEQ ID NO: 604237 - protein, 9 aa, Homo Sapiens
AHVRKRMVA

SEQ ID NO: 604238 - protein, 9 aa, Homo Sapiens
CILAGAFAS

SEQ ID NO: 604239 - protein, 9 aa, Homo Sapiens
SVTSPGLLH

SEQ ID NO: 604240 - protein, 9 aa, Homo Sapiens
QLVLPPGPP

SEQ ID NO: 604241 - protein, 9 aa, Homo Sapiens
SGRLAQIYF

SEQ ID NO: 604242 - protein, 9 aa, Homo Sapiens
HQRLPVKQS

SEQ ID NO: 604243 - protein, 9 aa, Homo Sapiens
NEYLPSLVI

SEQ ID NO: 604244 - protein, 9 aa, Homo Sapiens
QYHSLELEC

SEQ ID NO: 604245 - protein, 9 aa, Homo Sapiens
SHRQPILVA

SEQ ID NO: 604246 - protein, 9 aa, Homo Sapiens
KGEKDVITL

SEQ ID NO: 604247 - protein, 9 aa, Homo Sapiens
EVAPMIQIH

SEQ ID NO: 604248 - protein, 9 aa, Homo Sapiens
FVDTCRKFI

SEQ ID NO: 604249 - protein, 9 aa, Homo Sapiens
EIQRVCTQE

SEQ ID NO: 604250 - protein, 9 aa, Homo Sapiens
ARLTRGEAG

SEQ ID NO: 604251 - protein, 9 aa, Homo Sapiens
GGVSPSRDS

SEQ ID NO: 604252 - protein, 9 aa, Homo Sapiens
SSRPVFKAM

SEQ ID NO: 604253 - protein, 9 aa, Homo Sapiens
CITSRLDSV

SEQ ID NO: 604254 - protein, 9 aa, Homo Sapiens
PENRVDPFD

SEQ ID NO: 604255 - protein, 9 aa, Homo Sapiens
AQISNMEKA

SEQ ID NO: 604256 - protein, 9 aa, Homo Sapiens
NLNVSIHFD

SEQ ID NO: 604257 - protein, 9 aa, Homo Sapiens
YAKIKNRGE

SEQ ID NO: 604258 - protein, 9 aa, Homo Sapiens
LFQQQKIHT

SEQ ID NO: 604259 - protein, 9 aa, Homo Sapiens
KRKVKPLLK

SEQ ID NO: 604260 - protein, 9 aa, Homo Sapiens
LPPGAPGMM

SEQ ID NO: 604261 - protein, 9 aa, Homo Sapiens
GSPLLPCSR

SEQ ID NO: 604262 - protein, 9 aa, Homo Sapiens
SECGRFFKR

SEQ ID NO: 604263 - protein, 9 aa, Homo Sapiens
CSECGRFFK

SEQ ID NO: 604264 - protein, 9 aa, Homo Sapiens
TSDHINFDH

SEQ ID NO: 604265 - protein, 9 aa, Homo Sapiens
TNQNGKNYH

SEQ ID NO: 604266 - protein, 9 aa, Homo Sapiens
LGELVHGFQ

SEQ ID NO: 604267 - protein, 9 aa, Homo Sapiens
EHLLCHRYF

SEQ ID NO: 604268 - protein, 9 aa, Homo Sapiens
LEQRHDKED

SEQ ID NO: 604269 - protein, 9 aa, Homo Sapiens
GGARGPRAA

SEQ ID NO: 604270 - protein, 9 aa, Homo Sapiens
NVSIHFDAP

SEQ ID NO: 604271 - protein, 9 aa, Homo Sapiens
ANLNVSIHF

SEQ ID NO: 604272 - protein, 9 aa, Homo Sapiens
HVRVYLPPL

SEQ ID NO: 604273 - protein, 9 aa, Homo Sapiens
KLGSRGEEA

SEQ ID NO: 604274 - protein, 9 aa, Homo Sapiens
NTEVWASRT

SEQ ID NO: 604275 - protein, 9 aa, Homo Sapiens
IATLQSKEY

SEQ ID NO: 604276 - protein, 9 aa, Homo Sapiens
TNSSHRQPI

SEQ ID NO: 604277 - protein, 9 aa, Homo Sapiens
FFKRRTNLT

SEQ ID NO: 604278 - protein, 9 aa, Homo Sapiens
KRRTNLTKH

SEQ ID NO: 604279 - protein, 9 aa, Homo Sapiens
RLAQIYFLH

SEQ ID NO: 604280 - protein, 9 aa, Homo Sapiens
VEWMTTTCN

SEQ ID NO: 604281 - protein, 9 aa, Homo Sapiens
GWIVWSALD

SEQ ID NO: 604282 - protein, 9 aa, Homo Sapiens
LDRIIATLQ

SEQ ID NO: 604283 - protein, 9 aa, Homo Sapiens
TYNKPRAKS

SEQ ID NO: 604284 - protein, 9 aa, Homo Sapiens
IDKRKVKPL

SEQ ID NO: 604285 - protein, 9 aa, Homo Sapiens
DDEVLQALL

SEQ ID NO: 604286 - protein, 9 aa, Homo Sapiens
ATYWTCSAS

SEQ ID NO: 604287 - protein, 9 aa, Homo Sapiens
LLDLTFLTG

SEQ ID NO: 604288 - protein, 9 aa, Homo Sapiens
KCKPLWIEE

SEQ ID NO: 604289 - protein, 9 aa, Homo Sapiens
CSVFLRVNC

SEQ ID NO: 604290 - protein, 9 aa, Homo Sapiens
QSIPGPGFV

SEQ ID NO: 604291 - protein, 9 aa, Homo Sapiens
GTGLSALCP

SEQ ID NO: 604292 - protein, 9 aa, Homo Sapiens
NIMFKKSSI

SEQ ID NO: 604293 - protein, 9 aa, Homo Sapiens
SSGMPGGST

SEQ ID NO: 604294 - protein, 9 aa, Homo Sapiens
LRIHTGEKL

SEQ ID NO: 604295 - protein, 9 aa, Homo Sapiens
EEENLQAVL

SEQ ID NO: 604296 - protein, 9 aa, Homo Sapiens
ELVHGFQEE

SEQ ID NO: 604297 - protein, 9 aa, Homo Sapiens
VHYTLNLHV

SEQ ID NO: 604298 - protein, 9 aa, Homo Sapiens
VDYESQSTN

SEQ ID NO: 604299 - protein, 9 aa, Homo Sapiens
QNSWTKDGM

SEQ ID NO: 604300 - protein, 9 aa, Homo Sapiens
TAATLPNKS

SEQ ID NO: 604301 - protein, 9 aa, Homo Sapiens
EVQRHLDKE

SEQ ID NO: 604302 - protein, 9 aa, Homo Sapiens
KVHVRVYLP

SEQ ID NO: 604303 - protein, 9 aa, Homo Sapiens
MRTGDKEVE

SEQ ID NO: 604304 - protein, 9 aa, Homo Sapiens
HDLFVNSFS

SEQ ID NO: 604305 - protein, 9 aa, Homo Sapiens
HVFWPLVTG

SEQ ID NO: 604306 - protein, 9 aa, Homo Sapiens
NQLISNNIM

SEQ ID NO: 604307 - protein, 9 aa, Homo Sapiens
GQFPEHPPE

SEQ ID NO: 604308 - protein, 9 aa, Homo Sapiens
VQQSRPAHT

SEQ ID NO: 604309 - protein, 9 aa, Homo Sapiens
PLLPCSRPL

SEQ ID NO: 604310 - protein, 9 aa, Homo Sapiens
FSQKSHVVV

SEQ ID NO: 604311 - protein, 9 aa, Homo Sapiens
RVCTQEREQ

SEQ ID NO: 604312 - protein, 9 aa, Homo Sapiens
TLFQQQKIH

SEQ ID NO: 604313 - protein, 9 aa, Homo Sapiens
GVGPASRPS

SEQ ID NO: 604314 - protein, 9 aa, Homo Sapiens
ARPQRVCCA

SEQ ID NO: 604315 - protein, 9 aa, Homo Sapiens
SIETNVHFA

SEQ ID NO: 604316 - protein, 9 aa, Homo Sapiens
RSCPRNQPL

SEQ ID NO: 604317 - protein, 9 aa, Homo Sapiens
PEQQTEKVE

SEQ ID NO: 604318 - protein, 9 aa, Homo Sapiens
PVPGGRPSW

SEQ ID NO: 604319 - protein, 9 aa, Homo Sapiens
CCVPVPGES

SEQ ID NO: 604320 - protein, 9 aa, Homo Sapiens
SYNEYLPSL

SEQ ID NO: 604321 - protein, 9 aa, Homo Sapiens
DIPHPAIVT

SEQ ID NO: 604322 - protein, 9 aa, Homo Sapiens
RSRRSHSMS

SEQ ID NO: 604323 - protein, 9 aa, Homo Sapiens
QPLTSPGGV

SEQ ID NO: 604324 - protein, 9 aa, Homo Sapiens
MLNITLWST

SEQ ID NO: 604325 - protein, 9 aa, Homo Sapiens
SLEDLVVNL

SEQ ID NO: 604326 - protein, 9 aa, Homo Sapiens
SKAMTAYWT

SEQ ID NO: 604327 - protein, 9 aa, Homo Sapiens
GLEQRHDKE

SEQ ID NO: 604328 - protein, 9 aa, Homo Sapiens
PGAPGMMNY

SEQ ID NO: 604329 - protein, 9 aa, Homo Sapiens
GFCLTALYF

SEQ ID NO: 604330 - protein, 9 aa, Homo Sapiens
VWASRTVTV

SEQ ID NO: 604331 - protein, 9 aa, Homo Sapiens
VTLADIYPE

SEQ ID NO: 604332 - protein, 9 aa, Homo Sapiens
SPITTRWQH

SEQ ID NO: 604333 - protein, 9 aa, Homo Sapiens
KVKPLLKEL

SEQ ID NO: 604334 - protein, 9 aa, Homo Sapiens
KGWIVWSAL

SEQ ID NO: 604335 - protein, 9 aa, Homo Sapiens
WGPSFKKLA

SEQ ID NO: 604336 - protein, 9 aa, Homo Sapiens
SRPVFKAMF

SEQ ID NO: 604337 - protein, 9 aa, Homo Sapiens
KLAKCKPLW

SEQ ID NO: 604338 - protein, 9 aa, Homo Sapiens
VNAQDSEGA

SEQ ID NO: 604339 - protein, 9 aa, Homo Sapiens
KSPYQLVLP

SEQ ID NO: 604340 - protein, 9 aa, Homo Sapiens
CHRYFKNAL

SEQ ID NO: 604341 - protein, 9 aa, Homo Sapiens
GMPGGSTPV

SEQ ID NO: 604342 - protein, 9 aa, Homo Sapiens
RKLNENAIS

SEQ ID NO: 604343 - protein, 9 aa, Homo Sapiens
ITKACITSR

SEQ ID NO: 604344 - protein, 9 aa, Homo Sapiens
SMVRLVAFC

SEQ ID NO: 604345 - protein, 9 aa, Homo Sapiens
PTYRYESSG

SEQ ID NO: 604346 - protein, 9 aa, Homo Sapiens
RERYWKNAN

SEQ ID NO: 604347 - protein, 9 aa, Homo Sapiens
GKLSTAGSE

SEQ ID NO: 604348 - protein, 9 aa, Homo Sapiens
TEDYMIHII

SEQ ID NO: 604349 - protein, 9 aa, Homo Sapiens
ERSQENGRG

SEQ ID NO: 604350 - protein, 9 aa, Homo Sapiens
GIPSGATTT

SEQ ID NO: 604351 - protein, 9 aa, Homo Sapiens
CDTTSTFCG

SEQ ID NO: 604352 - protein, 9 aa, Homo Sapiens
VWSALDSSM

SEQ ID NO: 604353 - protein, 9 aa, Homo Sapiens
LPEQQTEKV

SEQ ID NO: 604354 - protein, 9 aa, Homo Sapiens
RKRMVAHTK

SEQ ID NO: 604355 - protein, 9 aa, Homo Sapiens
NFFFFFFFL

SEQ ID NO: 604356 - protein, 9 aa, Homo Sapiens
EFRRWDYSV

SEQ ID NO: 604357 - protein, 9 aa, Homo Sapiens
WMSKLAKCK

SEQ ID NO: 604358 - protein, 9 aa, Homo Sapiens
AWHLCLMGA

SEQ ID NO: 604359 - protein, 9 aa, Homo Sapiens
SRRSHSMSP

SEQ ID NO: 604360 - protein, 9 aa, Homo Sapiens
DYLSDWGPS

SEQ ID NO: 604361 - protein, 9 aa, Homo Sapiens
APSGLGGGG

SEQ ID NO: 604362 - protein, 9 aa, Homo Sapiens
KNANETRYP

SEQ ID NO: 604363 - protein, 9 aa, Homo Sapiens
SASFLPPGA

SEQ ID NO: 604364 - protein, 9 aa, Homo Sapiens
SVFLRVNCE

SEQ ID NO: 604365 - protein, 9 aa, Homo Sapiens
SDCGAELHC

SEQ ID NO: 604366 - protein, 9 aa, Homo Sapiens
ISVNGRSRR

SEQ ID NO: 604367 - protein, 9 aa, Homo Sapiens
EHGRRRKIT

SEQ ID NO: 604368 - protein, 9 aa, Homo Sapiens
FLLLSHDLF

SEQ ID NO: 604369 - protein, 9 aa, Homo Sapiens
SWLSDALRR

SEQ ID NO: 604370 - protein, 9 aa, Homo Sapiens
DEVLQALLK

SEQ ID NO: 604371 - protein, 9 aa, Homo Sapiens
AAYIQPWRY

SEQ ID NO: 604372 - protein, 9 aa, Homo Sapiens
PQRVCCAEG

SEQ ID NO: 604373 - protein, 9 aa, Homo Sapiens
VDQSATCVS

SEQ ID NO: 604374 - protein, 9 aa, Homo Sapiens
ATLPNKSYS

SEQ ID NO: 604375 - protein, 9 aa, Homo Sapiens
CADRTLAPS

SEQ ID NO: 604376 - protein, 9 aa, Homo Sapiens
QRAYVKEHY

SEQ ID NO: 604377 - protein, 9 aa, Homo Sapiens
LSDWGPSFK

SEQ ID NO: 604378 - protein, 9 aa, Homo Sapiens
CTQEREQIK

SEQ ID NO: 604379 - protein, 9 aa, Homo Sapiens
VHVRVYLPP

SEQ ID NO: 604380 - protein, 9 aa, Homo Sapiens
DALRRPLAR

SEQ ID NO: 604381 - protein, 9 aa, Homo Sapiens
DLVVNLNPN

SEQ ID NO: 604382 - protein, 9 aa, Homo Sapiens
FKELRRDWP

SEQ ID NO: 604383 - protein, 9 aa, Homo Sapiens
LMRTGDKEV

SEQ ID NO: 604384 - protein, 9 aa, Homo Sapiens
SDHINFDHV

SEQ ID NO: 604385 - protein, 9 aa, Homo Sapiens
EPEVRMMNG

SEQ ID NO: 604386 - protein, 9 aa, Homo Sapiens
SLELECEKL

SEQ ID NO: 604387 - protein, 9 aa, Homo Sapiens
GRPSWECGS

SEQ ID NO: 604388 - protein, 9 aa, Homo Sapiens
RACSHTVTT

SEQ ID NO: 604389 - protein, 9 aa, Homo Sapiens
ATLQSKEYS

SEQ ID NO: 604390 - protein, 9 aa, Homo Sapiens
KIAYRPPVP

SEQ ID NO: 604391 - protein, 9 aa, Homo Sapiens
RGEAGRDTY

SEQ ID NO: 604392 - protein, 9 aa, Homo Sapiens
HEDYEEDKE

SEQ ID NO: 604393 - protein, 9 aa, Homo Sapiens
CRCEHCGKG

SEQ ID NO: 604394 - protein, 9 aa, Homo Sapiens
APMIQIHSR

SEQ ID NO: 604395 - protein, 9 aa, Homo Sapiens
SLTRSYYRG

SEQ ID NO: 604396 - protein, 9 aa, Homo Sapiens
LTSHLSLAS

SEQ ID NO: 604397 - protein, 9 aa, Homo Sapiens
NIGGALSSL

SEQ ID NO: 604398 - protein, 9 aa, Homo Sapiens
LGLQDDEVL

SEQ ID NO: 604399 - protein, 9 aa, Homo Sapiens
DYEEDKEDD

SEQ ID NO: 604400 - protein, 9 aa, Homo Sapiens
YHSLELECE

SEQ ID NO: 604401 - protein, 9 aa, Homo Sapiens
PPSGVNCSD

SEQ ID NO: 604402 - protein, 9 aa, Homo Sapiens
AGHCWTCLL

SEQ ID NO: 604403 - protein, 9 aa, Homo Sapiens
ETLADIPVS

SEQ ID NO: 604404 - protein, 9 aa, Homo Sapiens
GRESGKLNQ

SEQ ID NO: 604405 - protein, 9 aa, Homo Sapiens
RFRSLTRSY

SEQ ID NO: 604406 - protein, 9 aa, Homo Sapiens
CKRSCPRNQ

SEQ ID NO: 604407 - protein, 9 aa, Homo Sapiens
PPGPPARPQ

SEQ ID NO: 604408 - protein, 9 aa, Homo Sapiens
PGPGFVRGQ

SEQ ID NO: 604409 - protein, 9 aa, Homo Sapiens
ASSRPVFKA

SEQ ID NO: 604410 - protein, 9 aa, Homo Sapiens
MEEPQRACS

SEQ ID NO: 604411 - protein, 9 aa, Homo Sapiens
FYGECGKNP

SEQ ID NO: 604412 - protein, 9 aa, Homo Sapiens
SSTQSAQDT

SEQ ID NO: 604413 - protein, 9 aa, Homo Sapiens
TFCCVPVPG

SEQ ID NO: 604414 - protein, 9 aa, Homo Sapiens
EENLQAVLR

SEQ ID NO: 604415 - protein, 9 aa, Homo Sapiens
ASCCHIYEK

SEQ ID NO: 604416 - protein, 9 aa, Homo Sapiens
CVPASSCSV

SEQ ID NO: 604417 - protein, 9 aa, Homo Sapiens
LCTCADRTL

SEQ ID NO: 604418 - protein, 9 aa, Homo Sapiens
RYFKNALEI

SEQ ID NO: 604419 - protein, 9 aa, Homo Sapiens
ITLWSTLLL

SEQ ID NO: 604420 - protein, 9 aa, Homo Sapiens
TGKLSTAGS

SEQ ID NO: 604421 - protein, 9 aa, Homo Sapiens
IAFSQKSHV

SEQ ID NO: 604422 - protein, 9 aa, Homo Sapiens
THVKLKVEQ

SEQ ID NO: 604423 - protein, 9 aa, Homo Sapiens
TSVETAQRA

SEQ ID NO: 604424 - protein, 9 aa, Homo Sapiens
LMAPARLFL

SEQ ID NO: 604425 - protein, 9 aa, Homo Sapiens
LSTGIEPSS

SEQ ID NO: 604426 - protein, 9 aa, Homo Sapiens
RPTLQAACS

SEQ ID NO: 604427 - protein, 9 aa, Homo Sapiens
GEKKRYDRE

SEQ ID NO: 604428 - protein, 9 aa, Homo Sapiens
GKQGRGPPS

SEQ ID NO: 604429 - protein, 9 aa, Homo Sapiens
EDCKVHVRV

SEQ ID NO: 604430 - protein, 9 aa, Homo Sapiens
SQNHGDRLV

SEQ ID NO: 604431 - protein, 9 aa, Homo Sapiens
PFLIRYRKE

SEQ ID NO: 604432 - protein, 9 aa, Homo Sapiens
QTEKVEWMT

SEQ ID NO: 604433 - protein, 9 aa, Homo Sapiens
DVITLGDFG

SEQ ID NO: 604434 - protein, 9 aa, Homo Sapiens
GNHRIQIFT

SEQ ID NO: 604435 - protein, 9 aa, Homo Sapiens
RLGLQDDEV

SEQ ID NO: 604436 - protein, 9 aa, Homo Sapiens
ITHVKLKVE

SEQ ID NO: 604437 - protein, 9 aa, Homo Sapiens
PAWHLCLMG

SEQ ID NO: 604438 - protein, 9 aa, Homo Sapiens
PEITKACIT

SEQ ID NO: 604439 - protein, 9 aa, Homo Sapiens
LTFLTGVHE

SEQ ID NO: 604440 - protein, 9 aa, Homo Sapiens
SFKKLADMY

SEQ ID NO: 604441 - protein, 9 aa, Homo Sapiens
CDIKLAYTQ

SEQ ID NO: 604442 - protein, 9 aa, Homo Sapiens
IGGALSSLM

SEQ ID NO: 604443 - protein, 9 aa, Homo Sapiens
ENLQAVLRQ

SEQ ID NO: 604444 - protein, 9 aa, Homo Sapiens
PIQTLVNTS

SEQ ID NO: 604445 - protein, 9 aa, Homo Sapiens
RGRRRARSG

SEQ ID NO: 604446 - protein, 9 aa, Homo Sapiens
MEHFVDTCR

SEQ ID NO: 604447 - protein, 9 aa, Homo Sapiens
NLQAVLRQM

SEQ ID NO: 604448 - protein, 9 aa, Homo Sapiens
RACRCEHCG

SEQ ID NO: 604449 - protein, 9 aa, Homo Sapiens
NNIMFKKSS

SEQ ID NO: 604450 - protein, 9 aa, Homo Sapiens
FVYRSLDGG

SEQ ID NO: 604451 - protein, 9 aa, Homo Sapiens
YNEYLPSLV

SEQ ID NO: 604452 - protein, 9 aa, Homo Sapiens
QHSQTRALS

SEQ ID NO: 604453 - protein, 9 aa, Homo Sapiens
TAGSESSSS

SEQ ID NO: 604454 - protein, 9 aa, Homo Sapiens
YASSSYEPS

SEQ ID NO: 604455 - protein, 9 aa, Homo Sapiens
RSLPAIWAA

SEQ ID NO: 604456 - protein, 9 aa, Homo Sapiens
PTLQAACSS

SEQ ID NO: 604457 - protein, 9 aa, Homo Sapiens
PGYCAFYGE

SEQ ID NO: 604458 - protein, 9 aa, Homo Sapiens
RYLYPLLAS

SEQ ID NO: 604459 - protein, 9 aa, Homo Sapiens
IELNRLKAQ

SEQ ID NO: 604460 - protein, 9 aa, Homo Sapiens
PAGGARGPR

SEQ ID NO: 604461 - protein, 9 aa, Homo Sapiens
LEDLVVNLN

SEQ ID NO: 604462 - protein, 9 aa, Homo Sapiens
NNLNGTYNK

SEQ ID NO: 604463 - protein, 9 aa, Homo Sapiens
SSHYTTLVV

SEQ ID NO: 604464 - protein, 9 aa, Homo Sapiens
PQRACSHTV

SEQ ID NO: 604465 - protein, 9 aa, Homo Sapiens
RWDYSVWLH

SEQ ID NO: 604466 - protein, 9 aa, Homo Sapiens
AHAEVQSLL

SEQ ID NO: 604467 - protein, 9 aa, Homo Sapiens
QISNMEKAP

SEQ ID NO: 604468 - protein, 9 aa, Homo Sapiens
LNVSIHFDA

SEQ ID NO: 604469 - protein, 9 aa, Homo Sapiens
ALDRFSSFC

SEQ ID NO: 604470 - protein, 9 aa, Homo Sapiens
LRVYNGILA

SEQ ID NO: 604471 - protein, 9 aa, Homo Sapiens
SALCPAESW

SEQ ID NO: 604472 - protein, 8 aa, Homo Sapiens
SRGFWLAE

SEQ ID NO: 604473 - protein, 9 aa, Homo Sapiens
PSRYLFQFH

SEQ ID NO: 604474 - protein, 9 aa, Homo Sapiens
QNCSPSNCK

SEQ ID NO: 604475 - protein, 9 aa, Homo Sapiens
FTNSSHRQP

SEQ ID NO: 604476 - protein, 9 aa, Homo Sapiens
AYIDCEMKI

SEQ ID NO: 604477 - protein, 9 aa, Homo Sapiens
TSHLSLASA

SEQ ID NO: 604478 - protein, 9 aa, Homo Sapiens
YWLPYGCAC

SEQ ID NO: 604479 - protein, 9 aa, Homo Sapiens
FRRWDYSVW

SEQ ID NO: 604480 - protein, 9 aa, Homo Sapiens
SVNGRSRRS

SEQ ID NO: 604481 - protein, 9 aa, Homo Sapiens
SLLAEETTA

SEQ ID NO: 604482 - protein, 9 aa, Homo Sapiens
LPIQEYMVT

SEQ ID NO: 604483 - protein, 9 aa, Homo Sapiens
PPSGHVETD

SEQ ID NO: 604484 - protein, 9 aa, Homo Sapiens
IHQESSQIQ

SEQ ID NO: 604485 - protein, 9 aa, Homo Sapiens
GDRLVLLKD

SEQ ID NO: 604486 - protein, 9 aa, Homo Sapiens
ALGQCILAG

SEQ ID NO: 604487 - protein, 9 aa, Homo Sapiens
SNKYYNPVK

SEQ ID NO: 604488 - protein, 9 aa, Homo Sapiens
QSYLDSGIP

SEQ ID NO: 604489 - protein, 9 aa, Homo Sapiens
CGSGTRRDS

SEQ ID NO: 604490 - protein, 9 aa, Homo Sapiens
ASRTVTVQP

SEQ ID NO: 604491 - protein, 9 aa, Homo Sapiens
HSQTRALSS

SEQ ID NO: 604492 - protein, 9 aa, Homo Sapiens
NTIPFLIRY

SEQ ID NO: 604493 - protein, 9 aa, Homo Sapiens
PTEDYMIHI

SEQ ID NO: 604494 - protein, 9 aa, Homo Sapiens
QHYGVNSYS

SEQ ID NO: 604495 - protein, 9 aa, Homo Sapiens
VSEIENSVD

SEQ ID NO: 604496 - protein, 9 aa, Homo Sapiens
LHVFWPLVT

SEQ ID NO: 604497 - protein, 9 aa, Homo Sapiens
HGFVSRELC

SEQ ID NO: 604498 - protein, 9 aa, Homo Sapiens
RSQENGRGP

SEQ ID NO: 604499 - protein, 9 aa, Homo Sapiens
YWKNANETR

SEQ ID NO: 604500 - protein, 9 aa, Homo Sapiens
VWLHGEFSY

SEQ ID NO: 604501 - protein, 9 aa, Homo Sapiens
GRLAQIYFL

SEQ ID NO: 604502 - protein, 9 aa, Homo Sapiens
ADKGNHRIQ

SEQ ID NO: 604503 - protein, 9 aa, Homo Sapiens
GPTGRDVVE

SEQ ID NO: 604504 - protein, 9 aa, Homo Sapiens
ASYGRFVDQ

SEQ ID NO: 604505 - protein, 9 aa, Homo Sapiens
EMAYTEKGA

SEQ ID NO: 604506 - protein, 9 aa, Homo Sapiens
RGGPQGLER

SEQ ID NO: 604507 - protein, 9 aa, Homo Sapiens
AFSQKSHVV

SEQ ID NO: 604508 - protein, 9 aa, Homo Sapiens
DTGLEQRHD

SEQ ID NO: 604509 - protein, 9 aa, Homo Sapiens
SVENGGTYV

SEQ ID NO: 604510 - protein, 9 aa, Homo Sapiens
PGMMNYSVT

SEQ ID NO: 604511 - protein, 9 aa, Homo Sapiens
ELNRLKAQL

SEQ ID NO: 604512 - protein, 9 aa, Homo Sapiens
ALRRPLART

SEQ ID NO: 604513 - protein, 9 aa, Homo Sapiens
YQAYIDCEM

SEQ ID NO: 604514 - protein, 9 aa, Homo Sapiens
DNGGIHQES

SEQ ID NO: 604515 - protein, 9 aa, Homo Sapiens
TLPLRTPTM

SEQ ID NO: 604516 - protein, 9 aa, Homo Sapiens
GQCILAGAF

SEQ ID NO: 604517 - protein, 9 aa, Homo Sapiens
NTSLNPSRP

SEQ ID NO: 604518 - protein, 9 aa, Homo Sapiens
HVVVHQRTH

SEQ ID NO: 604519 - protein, 9 aa, Homo Sapiens
KFLSSYNEY

SEQ ID NO: 604520 - protein, 9 aa, Homo Sapiens
WLHGEFSYV

SEQ ID NO: 604521 - protein, 9 aa, Homo Sapiens
HYTTLVVQS

SEQ ID NO: 604522 - protein, 9 aa, Homo Sapiens
MALARVCLC

SEQ ID NO: 604523 - protein, 9 aa, Homo Sapiens
YVFHSLYPK

SEQ ID NO: 604524 - protein, 9 aa, Homo Sapiens
FVRGQLPLP

SEQ ID NO: 604525 - protein, 9 aa, Homo Sapiens
WTCLLIAES

SEQ ID NO: 604526 - protein, 9 aa, Homo Sapiens
RPPVPGGRP

SEQ ID NO: 604527 - protein, 9 aa, Homo Sapiens
RSTGKLSTA

SEQ ID NO: 604528 - protein, 9 aa, Homo Sapiens
RFSSFCSQS

SEQ ID NO: 604529 - protein, 9 aa, Homo Sapiens
QEPSDAITH

SEQ ID NO: 604530 - protein, 9 aa, Homo Sapiens
SEGAVMKEK

SEQ ID NO: 604531 - protein, 9 aa, Homo Sapiens
PSAGHCWTC

SEQ ID NO: 604532 - protein, 9 aa, Homo Sapiens
SGVNCSDCG

SEQ ID NO: 604533 - protein, 9 aa, Homo Sapiens
TGVGPASRP

SEQ ID NO: 604534 - protein, 9 aa, Homo Sapiens
VTNQNGKNY

SEQ ID NO: 604535 - protein, 9 aa, Homo Sapiens
LPVVFTHLC

SEQ ID NO: 604536 - protein, 9 aa, Homo Sapiens
NLGEKKRYD

SEQ ID NO: 604537 - protein, 9 aa, Homo Sapiens
CSRPLLQFH

SEQ ID NO: 604538 - protein, 9 aa, Homo Sapiens
RSWLSDALR

SEQ ID NO: 604539 - protein, 9 aa, Homo Sapiens
EEDDESEDV

SEQ ID NO: 604540 - protein, 9 aa, Homo Sapiens
SSGYTDQFS

SEQ ID NO: 604541 - protein, 9 aa, Homo Sapiens
RPVFKAMFT

SEQ ID NO: 604542 - protein, 9 aa, Homo Sapiens
PIERAAWKQ

SEQ ID NO: 604543 - protein, 9 aa, Homo Sapiens
PCQFYHTGT

SEQ ID NO: 604544 - protein, 9 aa, Homo Sapiens
VTAILWLNG

SEQ ID NO: 604545 - protein, 9 aa, Homo Sapiens
CVCKRSCPR

SEQ ID NO: 604546 - protein, 9 aa, Homo Sapiens
LATYWTCSA

SEQ ID NO: 604547 - protein, 9 aa, Homo Sapiens
RFVDQSATC

SEQ ID NO: 604548 - protein, 9 aa, Homo Sapiens
CSQSQNHPV

SEQ ID NO: 604549 - protein, 9 aa, Homo Sapiens
HVRKRMVAH

SEQ ID NO: 604550 - protein, 9 aa, Homo Sapiens
NGGIHQESS

SEQ ID NO: 604551 - protein, 9 aa, Homo Sapiens
EEDKEDDDD

SEQ ID NO: 604552 - protein, 9 aa, Homo Sapiens
SLSTGIEPS

SEQ ID NO: 604553 - protein, 9 aa, Homo Sapiens
LWLNGSQRV

SEQ ID NO: 604554 - protein, 9 aa, Homo Sapiens
GPPGPHTTD

SEQ ID NO: 604555 - protein, 9 aa, Homo Sapiens
PGEGNFSQN

SEQ ID NO: 604556 - protein, 9 aa, Homo Sapiens
PVKQSIPGP

SEQ ID NO: 604557 - protein, 9 aa, Homo Sapiens
GATCAPGDY

SEQ ID NO: 604558 - protein, 9 aa, Homo Sapiens
AHGLARLTS

SEQ ID NO: 604559 - protein, 9 aa, Homo Sapiens
EKDVITLGD

SEQ ID NO: 604560 - protein, 9 aa, Homo Sapiens
VCKRSCPRN

SEQ ID NO: 604561 - protein, 9 aa, Homo Sapiens
GTASGCVPA

SEQ ID NO: 604562 - protein, 9 aa, Homo Sapiens
TVQSSTQSA

SEQ ID NO: 604563 - protein, 9 aa, Homo Sapiens
DLRVYNGIL

SEQ ID NO: 604564 - protein, 9 aa, Homo Sapiens
TFLTGVHED

SEQ ID NO: 604565 - protein, 9 aa, Homo Sapiens
PEFRRWDYS

SEQ ID NO: 604566 - protein, 9 aa, Homo Sapiens
KRKLNENAI

SEQ ID NO: 604567 - protein, 9 aa, Homo Sapiens
VSRELCRTY

SEQ ID NO: 604568 - protein, 9 aa, Homo Sapiens
GEEAQLCCW

SEQ ID NO: 604569 - protein, 9 aa, Homo Sapiens
ESNKYYNPV

SEQ ID NO: 604570 - protein, 9 aa, Homo Sapiens
HFVDTCRKF

SEQ ID NO: 604571 - protein, 9 aa, Homo Sapiens
DNGLLTPII

SEQ ID NO: 604572 - protein, 9 aa, Homo Sapiens
DMARQVGEG

SEQ ID NO: 604573 - protein, 9 aa, Homo Sapiens
VDGSLSTGI

SEQ ID NO: 604574 - protein, 9 aa, Homo Sapiens
QENGRGPAA

SEQ ID NO: 604575 - protein, 9 aa, Homo Sapiens
SYSLHAMNS

SEQ ID NO: 604576 - protein, 9 aa, Homo Sapiens
DPAWHLCLM

SEQ ID NO: 604577 - protein, 9 aa, Homo Sapiens
FHSLYPKYI

SEQ ID NO: 604578 - protein, 9 aa, Homo Sapiens
ALARVCLCP

SEQ ID NO: 604579 - protein, 9 aa, Homo Sapiens
ELIPWGAPG

SEQ ID NO: 604580 - protein, 9 aa, Homo Sapiens
RKGDRTLPL

SEQ ID NO: 604581 - protein, 9 aa, Homo Sapiens
RYVQSLLDI

SEQ ID NO: 604582 - protein, 9 aa, Homo Sapiens
TPGAEEQTQ

SEQ ID NO: 604583 - protein, 9 aa, Homo Sapiens
SVAPSGLGG

SEQ ID NO: 604584 - protein, 9 aa, Homo Sapiens
LSSVENGGT

SEQ ID NO: 604585 - protein, 9 aa, Homo Sapiens
LNLATYWTC

SEQ ID NO: 604586 - protein, 9 aa, Homo Sapiens
SQENGRGPA

SEQ ID NO: 604587 - protein, 9 aa, Homo Sapiens
GNFSQNSRN

SEQ ID NO: 604588 - protein, 9 aa, Homo Sapiens
EMSLAEVQR

SEQ ID NO: 604589 - protein, 9 aa, Homo Sapiens
CLLHKTSGC

SEQ ID NO: 604590 - protein, 9 aa, Homo Sapiens
AATLPNKSY

SEQ ID NO: 604591 - protein, 9 aa, Homo Sapiens
GEKDVITLG

SEQ ID NO: 604592 - protein, 9 aa, Homo Sapiens
EYLPSLVIL

SEQ ID NO: 604593 - protein, 9 aa, Homo Sapiens
PPVPGGRPS

SEQ ID NO: 604594 - protein, 9 aa, Homo Sapiens
SNHVPKNFF

SEQ ID NO: 604595 - protein, 9 aa, Homo Sapiens
TGRDVVEYF

SEQ ID NO: 604596 - protein, 9 aa, Homo Sapiens
YESQSTNTQ

SEQ ID NO: 604597 - protein, 9 aa, Homo Sapiens
PRMKCGFQS

SEQ ID NO: 604598 - protein, 9 aa, Homo Sapiens
ITSTGIKFA

SEQ ID NO: 604599 - protein, 9 aa, Homo Sapiens
EDRAKMPHT

SEQ ID NO: 604600 - protein, 9 aa, Homo Sapiens
TCCGIVHIA

SEQ ID NO: 604601 - protein, 9 aa, Homo Sapiens
YIGESQGYG

SEQ ID NO: 604602 - protein, 9 aa, Homo Sapiens
KKFSLCCTK

SEQ ID NO: 604603 - protein, 9 aa, Homo Sapiens
LQLCNAEAM

SEQ ID NO: 604604 - protein, 9 aa, Homo Sapiens
GGISGSYFL

SEQ ID NO: 604605 - protein, 9 aa, Homo Sapiens
DPQNIVKQT

SEQ ID NO: 604606 - protein, 9 aa, Homo Sapiens
AKMPHTEAV

SEQ ID NO: 604607 - protein, 9 aa, Homo Sapiens
GVHHLRAAV

SEQ ID NO: 604608 - protein, 9 aa, Homo Sapiens
KVLPLLTDL

SEQ ID NO: 604609 - protein, 9 aa, Homo Sapiens
GFSLRDMWH

SEQ ID NO: 604610 - protein, 9 aa, Homo Sapiens
PSPMPQGPP

SEQ ID NO: 604611 - protein, 9 aa, Homo Sapiens
VLPLLTDLS

SEQ ID NO: 604612 - protein, 9 aa, Homo Sapiens
SAHALQRKS

SEQ ID NO: 604613 - protein, 9 aa, Homo Sapiens
PIAPMPQYS

SEQ ID NO: 604614 - protein, 9 aa, Homo Sapiens
HTEAVIHEI

SEQ ID NO: 604615 - protein, 9 aa, Homo Sapiens
SNVGVSVNV

SEQ ID NO: 604616 - protein, 9 aa, Homo Sapiens
YRAKKFSLC

SEQ ID NO: 604617 - protein, 9 aa, Homo Sapiens
KSMNFIGQG

SEQ ID NO: 604618 - protein, 9 aa, Homo Sapiens
EKTPVSDRD

SEQ ID NO: 604619 - protein, 9 aa, Homo Sapiens
NPLKVLPLL

SEQ ID NO: 604620 - protein, 9 aa, Homo Sapiens
AVPTALPSF

SEQ ID NO: 604621 - protein, 9 aa, Homo Sapiens
APDFSKSPI

SEQ ID NO: 604622 - protein, 9 aa, Homo Sapiens
QEEREQQLR

SEQ ID NO: 604623 - protein, 9 aa, Homo Sapiens
VSRGAGRLQ

SEQ ID NO: 604624 - protein, 9 aa, Homo Sapiens
FSLCCTKPV

SEQ ID NO: 604625 - protein, 9 aa, Homo Sapiens
GKNLEVKEL

SEQ ID NO: 604626 - protein, 9 aa, Homo Sapiens
LAFAVTCCG

SEQ ID NO: 604627 - protein, 9 aa, Homo Sapiens
FPPNLGAKI

SEQ ID NO: 604628 - protein, 9 aa, Homo Sapiens
QQVGLWWAG

SEQ ID NO: 604629 - protein, 9 aa, Homo Sapiens
SIEPEGFLT

SEQ ID NO: 604630 - protein, 9 aa, Homo Sapiens
LRDMWHRRA

SEQ ID NO: 604631 - protein, 9 aa, Homo Sapiens
NGDSLQLCN

SEQ ID NO: 604632 - protein, 9 aa, Homo Sapiens
KCGFQSNYH

SEQ ID NO: 604633 - protein, 9 aa, Homo Sapiens
DIPSSQSGA

SEQ ID NO: 604634 - protein, 9 aa, Homo Sapiens
ESSAHALQR

SEQ ID NO: 604635 - protein, 9 aa, Homo Sapiens
TTASFGCFP

SEQ ID NO: 604636 - protein, 9 aa, Homo Sapiens
AFAVTCCGI

SEQ ID NO: 604637 - protein, 9 aa, Homo Sapiens
VTFKNSADA

SEQ ID NO: 604638 - protein, 9 aa, Homo Sapiens
SLSEEQSRS

SEQ ID NO: 604639 - protein, 9 aa, Homo Sapiens
ARRSGPTPL

SEQ ID NO: 604640 - protein, 9 aa, Homo Sapiens
VKSMNFIGQ

SEQ ID NO: 604641 - protein, 9 aa, Homo Sapiens
PAASQAAAA

SEQ ID NO: 604642 - protein, 9 aa, Homo Sapiens
DVNDHSPAF

SEQ ID NO: 604643 - protein, 9 aa, Homo Sapiens
SGGYQCSCL

SEQ ID NO: 604644 - protein, 9 aa, Homo Sapiens
SSAHALQRK

SEQ ID NO: 604645 - protein, 9 aa, Homo Sapiens
CLIVTRGCE

SEQ ID NO: 604646 - protein, 9 aa, Homo Sapiens
EEEEEPPRQ

SEQ ID NO: 604647 - protein, 9 aa, Homo Sapiens
LDGLGIGTY

SEQ ID NO: 604648 - protein, 9 aa, Homo Sapiens
PPRQSKSTL

SEQ ID NO: 604649 - protein, 9 aa, Homo Sapiens
AAAPPPPPD

SEQ ID NO: 604650 - protein, 9 aa, Homo Sapiens
YCDRLYVPC

SEQ ID NO: 604651 - protein, 9 aa, Homo Sapiens
MPVRGFGTY

SEQ ID NO: 604652 - protein, 9 aa, Homo Sapiens
CGHYICHIK

SEQ ID NO: 604653 - protein, 9 aa, Homo Sapiens
RFETISLII

SEQ ID NO: 604654 - protein, 9 aa, Homo Sapiens
GFGFVTFKN

SEQ ID NO: 604655 - protein, 9 aa, Homo Sapiens
IEDLTKPGA

SEQ ID NO: 604656 - protein, 9 aa, Homo Sapiens
DRDTKCCTE

SEQ ID NO: 604657 - protein, 9 aa, Homo Sapiens
GQKLFITVS

SEQ ID NO: 604658 - protein, 9 aa, Homo Sapiens
SQAAAAAAP

SEQ ID NO: 604659 - protein, 9 aa, Homo Sapiens
DPRMKCGFQ

SEQ ID NO: 604660 - protein, 9 aa, Homo Sapiens
GPKNALDFA

SEQ ID NO: 604661 - protein, 9 aa, Homo Sapiens
GFLTPKKLQ

SEQ ID NO: 604662 - protein, 9 aa, Homo Sapiens
GYLEREQGE

SEQ ID NO: 604663 - protein, 9 aa, Homo Sapiens
KTPVSDRDT

SEQ ID NO: 604664 - protein, 9 aa, Homo Sapiens
LNHLQKLGS

SEQ ID NO: 604665 - protein, 9 aa, Homo Sapiens
LDVNDHSPA

SEQ ID NO: 604666 - protein, 9 aa, Homo Sapiens
KNALDFARP

SEQ ID NO: 604667 - protein, 9 aa, Homo Sapiens
GGSNHDGGI

SEQ ID NO: 604668 - protein, 9 aa, Homo Sapiens
GPPRQSKST

SEQ ID NO: 604669 - protein, 9 aa, Homo Sapiens
KNGDSLQLC

SEQ ID NO: 604670 - protein, 9 aa, Homo Sapiens
PTPLAAELA

SEQ ID NO: 604671 - protein, 9 aa, Homo Sapiens
QSRSFLDQN

SEQ ID NO: 604672 - protein, 9 aa, Homo Sapiens
WKKLTNAQL

SEQ ID NO: 604673 - protein, 9 aa, Homo Sapiens
FVTFKNSAD

SEQ ID NO: 604674 - protein, 9 aa, Homo Sapiens
AIRFETISL

SEQ ID NO: 604675 - protein, 9 aa, Homo Sapiens
LVSTQAVPC

SEQ ID NO: 604676 - protein, 9 aa, Homo Sapiens
WIGPKNALD

SEQ ID NO: 604677 - protein, 9 aa, Homo Sapiens
GCKLCLIVT

SEQ ID NO: 604678 - protein, 9 aa, Homo Sapiens
RVLDVNDHS

SEQ ID NO: 604679 - protein, 9 aa, Homo Sapiens
QSTPQAANF

SEQ ID NO: 604680 - protein, 9 aa, Homo Sapiens
LGQKLFITV

SEQ ID NO: 604681 - protein, 9 aa, Homo Sapiens
DRAKMPHTE

SEQ ID NO: 604682 - protein, 9 aa, Homo Sapiens
KNSADADRA

SEQ ID NO: 604683 - protein, 9 aa, Homo Sapiens
FRNPLKVLP

SEQ ID NO: 604684 - protein, 9 aa, Homo Sapiens
SEEQSRSFL

SEQ ID NO: 604685 - protein, 9 aa, Homo Sapiens
CFPVHSPIT

SEQ ID NO: 604686 - protein, 9 aa, Homo Sapiens
LLVSTQAVP

SEQ ID NO: 604687 - protein, 9 aa, Homo Sapiens
QSKSTLLEI

SEQ ID NO: 604688 - protein, 9 aa, Homo Sapiens
REKFSMDYK

SEQ ID NO: 604689 - protein, 9 aa, Homo Sapiens
YEDPRMKCG

SEQ ID NO: 604690 - protein, 9 aa, Homo Sapiens
MTDSSKTET

SEQ ID NO: 604691 - protein, 9 aa, Homo Sapiens
SKSTLLEIL

SEQ ID NO: 604692 - protein, 9 aa, Homo Sapiens
GPTPLAAEL

SEQ ID NO: 604693 - protein, 9 aa, Homo Sapiens
STPQAANFP

SEQ ID NO: 604694 - protein, 9 aa, Homo Sapiens
RQSKSTLLE

SEQ ID NO: 604695 - protein, 9 aa, Homo Sapiens
INEWSWPIF

SEQ ID NO: 604696 - protein, 9 aa, Homo Sapiens
TGQYCDRLY

SEQ ID NO: 604697 - protein, 9 aa, Homo Sapiens
FSLRDMWHR

SEQ ID NO: 604698 - protein, 9 aa, Homo Sapiens
RDTKCCTES

SEQ ID NO: 604699 - protein, 9 aa, Homo Sapiens
KLIEDLTKP

SEQ ID NO: 604700 - protein, 9 aa, Homo Sapiens
NFPPNLGAK

SEQ ID NO: 604701 - protein, 9 aa, Homo Sapiens
LLSDPQNIV

SEQ ID NO: 604702 - protein, 9 aa, Homo Sapiens
QYCDRLYVP

SEQ ID NO: 604703 - protein, 9 aa, Homo Sapiens
SNAKNAIRF

SEQ ID NO: 604704 - protein, 9 aa, Homo Sapiens
VGYLKKAFK

SEQ ID NO: 604705 - protein, 9 aa, Homo Sapiens
LSVRVLDVN

SEQ ID NO: 604706 - protein, 9 aa, Homo Sapiens
VCGVADIPS

SEQ ID NO: 604707 - protein, 9 aa, Homo Sapiens
VADIPSSQS

SEQ ID NO: 604708 - protein, 9 aa, Homo Sapiens
EEREQQLRR

SEQ ID NO: 604709 - protein, 9 aa, Homo Sapiens
VSDRDTKCC

SEQ ID NO: 604710 - protein, 9 aa, Homo Sapiens
SFIGCKLCL

SEQ ID NO: 604711 - protein, 9 aa, Homo Sapiens
SITEGNIRE

SEQ ID NO: 604712 - protein, 9 aa, Homo Sapiens
EPPSPSEPG

SEQ ID NO: 604713 - protein, 9 aa, Homo Sapiens
ESGENVEKL

SEQ ID NO: 604714 - protein, 9 aa, Homo Sapiens
SGPTPLAAE

SEQ ID NO: 604715 - protein, 9 aa, Homo Sapiens
SLCCTKPVT

SEQ ID NO: 604716 - protein, 9 aa, Homo Sapiens
RHNGVHHLR

SEQ ID NO: 604717 - protein, 9 aa, Homo Sapiens
ILHEQKYDS

SEQ ID NO: 604718 - protein, 9 aa, Homo Sapiens
AANFPPNLG

SEQ ID NO: 604719 - protein, 9 aa, Homo Sapiens
DYIIRHNGV

SEQ ID NO: 604720 - protein, 9 aa, Homo Sapiens
KVKSMNFIG

SEQ ID NO: 604721 - protein, 9 aa, Homo Sapiens
MPHTEAVIH

SEQ ID NO: 604722 - protein, 9 aa, Homo Sapiens
NAKNAIRFE

SEQ ID NO: 604723 - protein, 9 aa, Homo Sapiens
FAVTCCGIV

SEQ ID NO: 604724 - protein, 9 aa, Homo Sapiens
LIEDLTKPG

SEQ ID NO: 604725 - protein, 9 aa, Homo Sapiens
VRVLDVNDH

SEQ ID NO: 604726 - protein, 9 aa, Homo Sapiens
SEPGPNSLG

SEQ ID NO: 604727 - protein, 9 aa, Homo Sapiens
PAVPTALPS

SEQ ID NO: 604728 - protein, 9 aa, Homo Sapiens
WPIFGLTSN

SEQ ID NO: 604729 - protein, 9 aa, Homo Sapiens
RAKMPHTEA

SEQ ID NO: 604730 - protein, 9 aa, Homo Sapiens
VVTLLSDPQ

SEQ ID NO: 604731 - protein, 9 aa, Homo Sapiens
ALSVRVLDV

SEQ ID NO: 604732 - protein, 9 aa, Homo Sapiens
TKPGAEPPE

SEQ ID NO: 604733 - protein, 9 aa, Homo Sapiens
MKCGFQSNY

SEQ ID NO: 604734 - protein, 9 aa, Homo Sapiens
VVGLQDGKN

SEQ ID NO: 604735 - protein, 9 aa, Homo Sapiens
GFVTFKNSA

SEQ ID NO: 604736 - protein, 9 aa, Homo Sapiens
GCFPVHSPI

SEQ ID NO: 604737 - protein, 9 aa, Homo Sapiens
TSTGIKFAN

SEQ ID NO: 604738 - protein, 9 aa, Homo Sapiens
TYEDPRMKC

SEQ ID NO: 604739 - protein, 9 aa, Homo Sapiens
SLQAMSEGD

SEQ ID NO: 604740 - protein, 9 aa, Homo Sapiens
NHDGGISGS

SEQ ID NO: 604741 - protein, 9 aa, Homo Sapiens
STMCGHYIC

SEQ ID NO: 604742 - protein, 9 aa, Homo Sapiens
REPPSPSEP

SEQ ID NO: 604743 - protein, 9 aa, Homo Sapiens
VEKLLQFKR

SEQ ID NO: 604744 - protein, 9 aa, Homo Sapiens
EPSRPSPMP

SEQ ID NO: 604745 - protein, 9 aa, Homo Sapiens
NGVHHLRAA

SEQ ID NO: 604746 - protein, 9 aa, Homo Sapiens
RGFGTYAPA

SEQ ID NO: 604747 - protein, 9 aa, Homo Sapiens
SDPQNIVKQ

SEQ ID NO: 604748 - protein, 9 aa, Homo Sapiens
GYHHIHLLS

SEQ ID NO: 604749 - protein, 9 aa, Homo Sapiens
KNAIRFETI

SEQ ID NO: 604750 - protein, 9 aa, Homo Sapiens
SLQLCNAEA

SEQ ID NO: 604751 - protein, 9 aa, Homo Sapiens
DSSKTETLN

SEQ ID NO: 604752 - protein, 9 aa, Homo Sapiens
EAAPAVPTA

SEQ ID NO: 604753 - protein, 9 aa, Homo Sapiens
SPEAAPAVP

SEQ ID NO: 604754 - protein, 9 aa, Homo Sapiens
ISGSYFLSF

SEQ ID NO: 604755 - protein, 9 aa, Homo Sapiens
IVGPPRQSK

SEQ ID NO: 604756 - protein, 9 aa, Homo Sapiens
ASFGCFPVH

SEQ ID NO: 604757 - protein, 9 aa, Homo Sapiens
SQGYGYLER

SEQ ID NO: 604758 - protein, 9 aa, Homo Sapiens
SRPSPMPQG

SEQ ID NO: 604759 - protein, 9 aa, Homo Sapiens
QGYHHIHLL

SEQ ID NO: 604760 - protein, 9 aa, Homo Sapiens
LATRNNNIP

SEQ ID NO: 604761 - protein, 9 aa, Homo Sapiens
DFARPKENV

SEQ ID NO: 604762 - protein, 9 aa, Homo Sapiens
KTETLNSSS

SEQ ID NO: 604763 - protein, 9 aa, Homo Sapiens
QVGLWWAGS

SEQ ID NO: 604764 - protein, 9 aa, Homo Sapiens
PVRGFGTYA

SEQ ID NO: 604765 - protein, 9 aa, Homo Sapiens
QRKSDNPLD

SEQ ID NO: 604766 - protein, 9 aa, Homo Sapiens
AQRLHCQNG

SEQ ID NO: 604767 - protein, 9 aa, Homo Sapiens
MPQGPPFGG

SEQ ID NO: 604768 - protein, 9 aa, Homo Sapiens
KAFKLYNQM

SEQ ID NO: 604769 - protein, 9 aa, Homo Sapiens
EGFLTPKKL

SEQ ID NO: 604770 - protein, 9 aa, Homo Sapiens
QTLHLRRNR

SEQ ID NO: 604771 - protein, 9 aa, Homo Sapiens
GISGSYFLS

SEQ ID NO: 604772 - protein, 9 aa, Homo Sapiens
TRNNNIPNA

SEQ ID NO: 604773 - protein, 9 aa, Homo Sapiens
VRGFGTYAP

SEQ ID NO: 604774 - protein, 9 aa, Homo Sapiens
MVLCQGPLT

SEQ ID NO: 604775 - protein, 9 aa, Homo Sapiens
EMTDSSKTE

SEQ ID NO: 604776 - protein, 9 aa, Homo Sapiens
AFMKQNLDG

SEQ ID NO: 604777 - protein, 9 aa, Homo Sapiens
AQLSGLNQI

SEQ ID NO: 604778 - protein, 9 aa, Homo Sapiens
AKNAIRFET

SEQ ID NO: 604779 - protein, 9 aa, Homo Sapiens
GYGYLEREQ

SEQ ID NO: 604780 - protein, 9 aa, Homo Sapiens
KLCLIVTRG

SEQ ID NO: 604781 - protein, 9 aa, Homo Sapiens
HNGVHHLRA

SEQ ID NO: 604782 - protein, 9 aa, Homo Sapiens
ATRNNNIPN

SEQ ID NO: 604783 - protein, 9 aa, Homo Sapiens
RLYVPCAPS

SEQ ID NO: 604784 - protein, 9 aa, Homo Sapiens
QEPSRPSPM

SEQ ID NO: 604785 - protein, 9 aa, Homo Sapiens
DLTKPGAEP

SEQ ID NO: 604786 - protein, 9 aa, Homo Sapiens
DCVVGLQDG

SEQ ID NO: 604787 - protein, 9 aa, Homo Sapiens
FILHEQKYD

SEQ ID NO: 604788 - protein, 9 aa, Homo Sapiens
DGHFMPVRG

SEQ ID NO: 604789 - protein, 9 aa, Homo Sapiens
PKNALDFAR

SEQ ID NO: 604790 - protein, 9 aa, Homo Sapiens
PHTEAVIHE

SEQ ID NO: 604791 - protein, 9 aa, Homo Sapiens
QRLHCQNGC

SEQ ID NO: 604792 - protein, 9 aa, Homo Sapiens
DESGENVEK

SEQ ID NO: 604793 - protein, 9 aa, Homo Sapiens
GVADIPSSQ

SEQ ID NO: 604794 - protein, 9 aa, Homo Sapiens
KVPIAPMPQ

SEQ ID NO: 604795 - protein, 9 aa, Homo Sapiens
LDFARPKEN

SEQ ID NO: 604796 - protein, 9 aa, Homo Sapiens
GLWWAGSIC

SEQ ID NO: 604797 - protein, 9 aa, Homo Sapiens
EEQSRSFLD

SEQ ID NO: 604798 - protein, 9 aa, Homo Sapiens
KYDSLLESV

SEQ ID NO: 604799 - protein, 9 aa, Homo Sapiens
TMCGHYICH

SEQ ID NO: 604800 - protein, 9 aa, Homo Sapiens
LHEQKYDSL

SEQ ID NO: 604801 - protein, 9 aa, Homo Sapiens
SLRDMWHRR

SEQ ID NO: 604802 - protein, 9 aa, Homo Sapiens
KFSLCCTKP

SEQ ID NO: 604803 - protein, 9 aa, Homo Sapiens
FIGQGTFSY

SEQ ID NO: 604804 - protein, 9 aa, Homo Sapiens
LSEEQSRSF

SEQ ID NO: 604805 - protein, 9 aa, Homo Sapiens
STGIKFAND

SEQ ID NO: 604806 - protein, 9 aa, Homo Sapiens
SGENVEKLL

SEQ ID NO: 604807 - protein, 9 aa, Homo Sapiens
SVNVVSILG

SEQ ID NO: 604808 - protein, 9 aa, Homo Sapiens
ITVSRGAGR

SEQ ID NO: 604809 - protein, 9 aa, Homo Sapiens
PSGGYQCSC

SEQ ID NO: 604810 - protein, 9 aa, Homo Sapiens
LAQRLHCQN

SEQ ID NO: 604811 - protein, 9 aa, Homo Sapiens
VPIAPMPQY

SEQ ID NO: 604812 - protein, 9 aa, Homo Sapiens
AKKFSLCCT

SEQ ID NO: 604813 - protein, 9 aa, Homo Sapiens
RQTLHLRRN

SEQ ID NO: 604814 - protein, 9 aa, Homo Sapiens
FDIATELNH

SEQ ID NO: 604815 - protein, 9 aa, Homo Sapiens
SKSPIKKKS

SEQ ID NO: 604816 - protein, 9 aa, Homo Sapiens
LPLLTDLSL

SEQ ID NO: 604817 - protein, 9 aa, Homo Sapiens
SRSFLDQNP

SEQ ID NO: 604818 - protein, 9 aa, Homo Sapiens
STTASFGCF

SEQ ID NO: 604819 - protein, 9 aa, Homo Sapiens
SSTTASFGC

SEQ ID NO: 604820 - protein, 9 aa, Homo Sapiens
VPTALPSFS

SEQ ID NO: 604821 - protein, 9 aa, Homo Sapiens
KKAFKLYNQ

SEQ ID NO: 604822 - protein, 9 aa, Homo Sapiens
KLYNQMKKR

SEQ ID NO: 604823 - protein, 9 aa, Homo Sapiens
CCTKPVTLH

SEQ ID NO: 604824 - protein, 9 aa, Homo Sapiens
WWAGSICGL

SEQ ID NO: 604825 - protein, 9 aa, Homo Sapiens
RNNNIPNAV

SEQ ID NO: 604826 - protein, 9 aa, Homo Sapiens
NTYEDPRMK

SEQ ID NO: 604827 - protein, 9 aa, Homo Sapiens
DGGISGSYF

SEQ ID NO: 604828 - protein, 9 aa, Homo Sapiens
TPLAAELAR

SEQ ID NO: 604829 - protein, 9 aa, Homo Sapiens
PPSPSEPGP

SEQ ID NO: 604830 - protein, 9 aa, Homo Sapiens
IGPKNALDF

SEQ ID NO: 604831 - protein, 9 aa, Homo Sapiens
TDSSKTETL

SEQ ID NO: 604832 - protein, 9 aa, Homo Sapiens
EEEPPRQTL

SEQ ID NO: 604833 - protein, 9 aa, Homo Sapiens
VTCCGIVHI

SEQ ID NO: 604834 - protein, 9 aa, Homo Sapiens
NVGVSVNVV

SEQ ID NO: 604835 - protein, 9 aa, Homo Sapiens
GRPVCGVAD

SEQ ID NO: 604836 - protein, 9 aa, Homo Sapiens
AASQAAAAA

SEQ ID NO: 604837 - protein, 9 aa, Homo Sapiens
GVDQQVGLW

SEQ ID NO: 604838 - protein, 9 aa, Homo Sapiens
EEPPRQTLH

SEQ ID NO: 604839 - protein, 9 aa, Homo Sapiens
IHSSNVGVS

SEQ ID NO: 604840 - protein, 9 aa, Homo Sapiens
LPPKVPIAP

SEQ ID NO: 604841 - protein, 9 aa, Homo Sapiens
RMKCGFQSN

SEQ ID NO: 604842 - protein, 9 aa, Homo Sapiens
ENVEKLLQF

SEQ ID NO: 604843 - protein, 9 aa, Homo Sapiens
HFMPVRGFG

SEQ ID NO: 604844 - protein, 9 aa, Homo Sapiens
SPIKKKSFV

SEQ ID NO: 604845 - protein, 9 aa, Homo Sapiens
WLAQRLHCQ

SEQ ID NO: 604846 - protein, 9 aa, Homo Sapiens
MDFIRWPRN

SEQ ID NO: 604847 - protein, 9 aa, Homo Sapiens
WKVRFMVLC

SEQ ID NO: 604848 - protein, 9 aa, Homo Sapiens
AHALQRKSD

SEQ ID NO: 604849 - protein, 9 aa, Homo Sapiens
YLKKAFKLY

SEQ ID NO: 604850 - protein, 9 aa, Homo Sapiens
SYFLATRNN

SEQ ID NO: 604851 - protein, 9 aa, Homo Sapiens
HSSNVGVSV

SEQ ID NO: 604852 - protein, 9 aa, Homo Sapiens
SKTETLNSS

SEQ ID NO: 604853 - protein, 9 aa, Homo Sapiens
QKVKSMNFI

SEQ ID NO: 604854 - protein, 9 aa, Homo Sapiens
RNPLKVLPL

SEQ ID NO: 604855 - protein, 9 aa, Homo Sapiens
KMPHTEAVI

SEQ ID NO: 604856 - protein, 9 aa, Homo Sapiens
FITVSRGAG

SEQ ID NO: 604857 - protein, 9 aa, Homo Sapiens
MCGHYICHI

SEQ ID NO: 604858 - protein, 9 aa, Homo Sapiens
SDRDTKCCT

SEQ ID NO: 604859 - protein, 9 aa, Homo Sapiens
FSKSPIKKK

SEQ ID NO: 604860 - protein, 9 aa, Homo Sapiens
ANFPPNLGA

SEQ ID NO: 604861 - protein, 9 aa, Homo Sapiens
NALDFARPK

SEQ ID NO: 604862 - protein, 9 aa, Homo Sapiens
DIATELNHL

SEQ ID NO: 604863 - protein, 9 aa, Homo Sapiens
RLHCQNGCI

SEQ ID NO: 604864 - protein, 9 aa, Homo Sapiens
APMPQYSIM

SEQ ID NO: 604865 - protein, 9 aa, Homo Sapiens
LTNAQLSGL

SEQ ID NO: 604866 - protein, 9 aa, Homo Sapiens
PQAANFPPN

SEQ ID NO: 604867 - protein, 9 aa, Homo Sapiens
GWGSIEPEG

SEQ ID NO: 604868 - protein, 9 aa, Homo Sapiens
ETSADSLQA

SEQ ID NO: 604869 - protein, 9 aa, Homo Sapiens
PITSTGIKF

SEQ ID NO: 604870 - protein, 9 aa, Homo Sapiens
NDESGENVE

SEQ ID NO: 604871 - protein, 9 aa, Homo Sapiens
FEDRAKMPH

SEQ ID NO: 604872 - protein, 9 aa, Homo Sapiens
NVEKLLQFK

SEQ ID NO: 604873 - protein, 9 aa, Homo Sapiens
IGESQGYGY

SEQ ID NO: 604874 - protein, 9 aa, Homo Sapiens
ITEGNIREK

SEQ ID NO: 604875 - protein, 9 aa, Homo Sapiens
MNFIGQGTF

SEQ ID NO: 604876 - protein, 9 aa, Homo Sapiens
DSLQLCNAE

SEQ ID NO: 604877 - protein, 9 aa, Homo Sapiens
MKQNLDGLG

SEQ ID NO: 604878 - protein, 9 aa, Homo Sapiens
GGYQCSCLS

SEQ ID NO: 604879 - protein, 9 aa, Homo Sapiens
PSEPGPNSL

SEQ ID NO: 604880 - protein, 9 aa, Homo Sapiens
PRQTLHLRR

SEQ ID NO: 604881 - protein, 9 aa, Homo Sapiens
SADSLQAMS

SEQ ID NO: 604882 - protein, 9 aa, Homo Sapiens
EEEEPPRQT

SEQ ID NO: 604883 - protein, 9 aa, Homo Sapiens
IIVGPPRQS

SEQ ID NO: 604884 - protein, 9 aa, Homo Sapiens
PGPNSLGTF

SEQ ID NO: 604885 - protein, 9 aa, Homo Sapiens
KSPIKKKSF

SEQ ID NO: 604886 - protein, 9 aa, Homo Sapiens
FFLDPITST

SEQ ID NO: 604887 - protein, 9 aa, Homo Sapiens
GVSVNVVSI

SEQ ID NO: 604888 - protein, 9 aa, Homo Sapiens
WTCMQQGYH

SEQ ID NO: 604889 - protein, 9 aa, Homo Sapiens
TSADSLQAM

SEQ ID NO: 604890 - protein, 9 aa, Homo Sapiens
VLDVNDHSP

SEQ ID NO: 604891 - protein, 9 aa, Homo Sapiens
HALQRKSDN

SEQ ID NO: 604892 - protein, 9 aa, Homo Sapiens
LCLIVTRGC

SEQ ID NO: 604893 - protein, 9 aa, Homo Sapiens
EDPRMKCGF

SEQ ID NO: 604894 - protein, 9 aa, Homo Sapiens
LCNAEAMLI

SEQ ID NO: 604895 - protein, 9 aa, Homo Sapiens
QDGKNLEVK

SEQ ID NO: 604896 - protein, 9 aa, Homo Sapiens
TCMQQGYHH

SEQ ID NO: 604897 - protein, 9 aa, Homo Sapiens
IRHNGVHHL

SEQ ID NO: 604898 - protein, 9 aa, Homo Sapiens
WSWPIFGLT

SEQ ID NO: 604899 - protein, 9 aa, Homo Sapiens
NEWSWPIFG

SEQ ID NO: 604900 - protein, 9 aa, Homo Sapiens
DGLGIGTYH

SEQ ID NO: 604901 - protein, 9 aa, Homo Sapiens
VRKGFSLRD

SEQ ID NO: 604902 - protein, 9 aa, Homo Sapiens
PVSDRDTKC

SEQ ID NO: 604903 - protein, 9 aa, Homo Sapiens
YIIRHNGVH

SEQ ID NO: 604904 - protein, 9 aa, Homo Sapiens
TASFGCFPV

SEQ ID NO: 604905 - protein, 9 aa, Homo Sapiens
SNHDGGISG

SEQ ID NO: 604906 - protein, 9 aa, Homo Sapiens
CCGIVHIAG

SEQ ID NO: 604907 - protein, 9 aa, Homo Sapiens
ASPEAAPAV

SEQ ID NO: 604908 - protein, 9 aa, Homo Sapiens
FLDPITSTG

SEQ ID NO: 604909 - protein, 9 aa, Homo Sapiens
TNAQLSGLN

SEQ ID NO: 604910 - protein, 9 aa, Homo Sapiens
VGPPRQSKS

SEQ ID NO: 604911 - protein, 9 aa, Homo Sapiens
GESQGYGYL

SEQ ID NO: 604912 - protein, 9 aa, Homo Sapiens
KGFGFVTFK

SEQ ID NO: 604913 - protein, 9 aa, Homo Sapiens
PSPSEPGPN

SEQ ID NO: 604914 - protein, 9 aa, Homo Sapiens
NNNIPNAVW

SEQ ID NO: 604915 - protein, 9 aa, Homo Sapiens
PIKKKSFVQ

SEQ ID NO: 604916 - protein, 9 aa, Homo Sapiens
ELNHLQKLG

SEQ ID NO: 604917 - protein, 9 aa, Homo Sapiens
MLLVSTQAV

SEQ ID NO: 604918 - protein, 9 aa, Homo Sapiens
RRSGPTPLA

SEQ ID NO: 604919 - protein, 9 aa, Homo Sapiens
PLAAELARP

SEQ ID NO: 604920 - protein, 9 aa, Homo Sapiens
CVVGLQDGK

SEQ ID NO: 604921 - protein, 9 aa, Homo Sapiens
KKLTNAQLS

SEQ ID NO: 604922 - protein, 9 aa, Homo Sapiens
LHCQNGCIL

SEQ ID NO: 604923 - protein, 9 aa, Homo Sapiens
LQRKSDNPL

SEQ ID NO: 604924 - protein, 9 aa, Homo Sapiens
VGLWWAGSI

SEQ ID NO: 604925 - protein, 9 aa, Homo Sapiens
CTQEMDFIR

SEQ ID NO: 604926 - protein, 9 aa, Homo Sapiens
TPVSDRDTK

SEQ ID NO: 604927 - protein, 9 aa, Homo Sapiens
DESSAHALQ

SEQ ID NO: 604928 - protein, 9 aa, Homo Sapiens
FIRWPRNDI

SEQ ID NO: 604929 - protein, 9 aa, Homo Sapiens
CKLCLIVTR

SEQ ID NO: 604930 - protein, 9 aa, Homo Sapiens
QAMSEGDAP

SEQ ID NO: 604931 - protein, 9 aa, Homo Sapiens
EQKYDSLLE

SEQ ID NO: 604932 - protein, 9 aa, Homo Sapiens
QKYDSLLES

SEQ ID NO: 604933 - protein, 9 aa, Homo Sapiens
QNIVKQTLM

SEQ ID NO: 604934 - protein, 9 aa, Homo Sapiens
VSVNVVSIL

SEQ ID NO: 604935 - protein, 9 aa, Homo Sapiens
EQSRSFLDQ

SEQ ID NO: 604936 - protein, 9 aa, Homo Sapiens
TQEMDFIRW

SEQ ID NO: 604937 - protein, 9 aa, Homo Sapiens
ESQGYGYLE

SEQ ID NO: 604938 - protein, 9 aa, Homo Sapiens
LQDGKNLEV

SEQ ID NO: 604939 - protein, 9 aa, Homo Sapiens
VNWLAQRLH

SEQ ID NO: 604940 - protein, 9 aa, Homo Sapiens
DTKCCTESL

SEQ ID NO: 604941 - protein, 9 aa, Homo Sapiens
LAAELARPL

SEQ ID NO: 604942 - protein, 9 aa, Homo Sapiens
IGCKLCLIV

SEQ ID NO: 604943 - protein, 9 aa, Homo Sapiens
GDSLQLCNA

SEQ ID NO: 604944 - protein, 9 aa, Homo Sapiens
NDGHFMPVR

SEQ ID NO: 604945 - protein, 9 aa, Homo Sapiens
QCSCLSQFT

SEQ ID NO: 604946 - protein, 9 aa, Homo Sapiens
FMKQNLDGL

SEQ ID NO: 604947 - protein, 9 aa, Homo Sapiens
TELNHLQKL

SEQ ID NO: 604948 - protein, 9 aa, Homo Sapiens
IFILHEQKY

SEQ ID NO: 604949 - protein, 9 aa, Homo Sapiens
CMQQGYHHI

SEQ ID NO: 604950 - protein, 9 aa, Homo Sapiens
GYQCSCLSQ

SEQ ID NO: 604951 - protein, 9 aa, Homo Sapiens
VSTQAVPCC

SEQ ID NO: 604952 - protein, 9 aa, Homo Sapiens
PQNIVKQTL

SEQ ID NO: 604953 - protein, 9 aa, Homo Sapiens
LCCTKPVTL

SEQ ID NO: 604954 - protein, 9 aa, Homo Sapiens
NLDGLGIGT

SEQ ID NO: 604955 - protein, 9 aa, Homo Sapiens
TPQAANFPP

SEQ ID NO: 604956 - protein, 9 aa, Homo Sapiens
EPPRQTLHL

SEQ ID NO: 604957 - protein, 9 aa, Homo Sapiens
QLCNAEAML

SEQ ID NO: 604958 - protein, 9 aa, Homo Sapiens
IAPMPQYSI

SEQ ID NO: 604959 - protein, 9 aa, Homo Sapiens
FGCFPVHSP

SEQ ID NO: 604960 - protein, 9 aa, Homo Sapiens
EMDFIRWPR

SEQ ID NO: 604961 - protein, 9 aa, Homo Sapiens
QKLFITVSR

SEQ ID NO: 604962 - protein, 9 aa, Homo Sapiens
EPGPNSLGT

SEQ ID NO: 604963 - protein, 9 aa, Homo Sapiens
FMPVRGFGT

SEQ ID NO: 604964 - protein, 9 aa, Homo Sapiens
LWWAGSICG

SEQ ID NO: 604965 - protein, 9 aa, Homo Sapiens
TGIKFANDE

SEQ ID NO: 604966 - protein, 9 aa, Homo Sapiens
PKVPIAPMP

SEQ ID NO: 604967 - protein, 9 aa, Homo Sapiens
IEPEGFLTP

SEQ ID NO: 604968 - protein, 9 aa, Homo Sapiens
CGIVHIAGE

SEQ ID NO: 604969 - protein, 9 aa, Homo Sapiens
GWKVRFMVL

SEQ ID NO: 604970 - protein, 9 aa, Homo Sapiens
QNLDGLGIG

SEQ ID NO: 604971 - protein, 9 aa, Homo Sapiens
MQQGYHHIH

SEQ ID NO: 604972 - protein, 9 aa, Homo Sapiens
NIREKFSMD

SEQ ID NO: 604973 - protein, 9 aa, Homo Sapiens
KGFSLRDMW

SEQ ID NO: 604974 - protein, 9 aa, Homo Sapiens
AAAAPPPPP

SEQ ID NO: 604975 - protein, 9 aa, Homo Sapiens
GENVEKLLQ

SEQ ID NO: 604976 - protein, 9 aa, Homo Sapiens
APAVPTALP

SEQ ID NO: 604977 - protein, 9 aa, Homo Sapiens
AAPAVPTAL

SEQ ID NO: 604978 - protein, 9 aa, Homo Sapiens
SPSEPGPNS

SEQ ID NO: 604979 - protein, 9 aa, Homo Sapiens
RREQEEREQ

SEQ ID NO: 604980 - protein, 9 aa, Homo Sapiens
EWSWPIFGL

SEQ ID NO: 604981 - protein, 9 aa, Homo Sapiens
HDGGISGSY

SEQ ID NO: 604982 - protein, 9 aa, Homo Sapiens
LSGLNQIPN

SEQ ID NO: 604983 - protein, 9 aa, Homo Sapiens
RKGFSLRDM

SEQ ID NO: 604984 - protein, 9 aa, Homo Sapiens
NFIGQGTFS

SEQ ID NO: 604985 - protein, 9 aa, Homo Sapiens
GHFMPVRGF

SEQ ID NO: 604986 - protein, 9 aa, Homo Sapiens
FKNSADADR

SEQ ID NO: 604987 - protein, 9 aa, Homo Sapiens
PGWKVRFMV

SEQ ID NO: 604988 - protein, 9 aa, Homo Sapiens
QLSGLNQIP

SEQ ID NO: 604989 - protein, 9 aa, Homo Sapiens
PPKVPIAPM

SEQ ID NO: 604990 - protein, 9 aa, Homo Sapiens
QQGYHHIHL

SEQ ID NO: 604991 - protein, 9 aa, Homo Sapiens
AVTCCGIVH

SEQ ID NO: 604992 - protein, 9 aa, Homo Sapiens
LKKAFKLYN

SEQ ID NO: 604993 - protein, 9 aa, Homo Sapiens
FTGQYCDRL

SEQ ID NO: 604994 - protein, 9 aa, Homo Sapiens
VRFMVLCQG

SEQ ID NO: 604995 - protein, 9 aa, Homo Sapiens
GQYCDRLYV

SEQ ID NO: 604996 - protein, 9 aa, Homo Sapiens
FGFVTFKNS

SEQ ID NO: 604997 - protein, 9 aa, Homo Sapiens
KLFITVSRG

SEQ ID NO: 604998 - protein, 9 aa, Homo Sapiens
RWPRNDIEK

SEQ ID NO: 604999 - protein, 9 aa, Homo Sapiens
PRQSKSTLL

SEQ ID NO: 605000 - protein, 9 aa, Homo Sapiens
LFITVSRGA

SEQ ID NO: 605001 - protein, 9 aa, Homo Sapiens
TFKNSADAD

SEQ ID NO: 605002 - protein, 9 aa, Homo Sapiens
GYLKKAFKL

SEQ ID NO: 605003 - protein, 9 aa, Homo Sapiens
REQEEREQQ

SEQ ID NO: 605004 - protein, 9 aa, Homo Sapiens
ADIPSSQSG

SEQ ID NO: 605005 - protein, 9 aa, Homo Sapiens
LLAFAVTCC

SEQ ID NO: 605006 - protein, 9 aa, Homo Sapiens
NLPPKVPIA

SEQ ID NO: 605007 - protein, 9 aa, Homo Sapiens
RPSPMPQGP

SEQ ID NO: 605008 - protein, 9 aa, Homo Sapiens
LIVTRGCET

SEQ ID NO: 605009 - protein, 9 aa, Homo Sapiens
PLKVLPLLT

SEQ ID NO: 605010 - protein, 9 aa, Homo Sapiens
SSKTETLNS

SEQ ID NO: 605011 - protein, 9 aa, Homo Sapiens
WPGWKVRFM

SEQ ID NO: 605012 - protein, 9 aa, Homo Sapiens
YFLATRNNN

SEQ ID NO: 605013 - protein, 9 aa, Homo Sapiens
EQEEREQQL

SEQ ID NO: 605014 - protein, 9 aa, Homo Sapiens
VDQQVGLWW

SEQ ID NO: 605015 - protein, 9 aa, Homo Sapiens
SSNVGVSVN

SEQ ID NO: 605016 - protein, 9 aa, Homo Sapiens
LINEWSWPI

SEQ ID NO: 605017 - protein, 9 aa, Homo Sapiens
YHHIHLLSK

SEQ ID NO: 605018 - protein, 9 aa, Homo Sapiens
RSGPTPLAA

SEQ ID NO: 605019 - protein, 9 aa, Homo Sapiens
CNAEAMLIL

SEQ ID NO: 605020 - protein, 9 aa, Homo Sapiens
VHHLRAAVH

SEQ ID NO: 605021 - protein, 9 aa, Homo Sapiens
ALDFARPKE

SEQ ID NO: 605022 - protein, 9 aa, Homo Sapiens
TLLSDPQNI

SEQ ID NO: 605023 - protein, 9 aa, Homo Sapiens
TVSRGAGRL

SEQ ID NO: 605024 - protein, 9 aa, Homo Sapiens
NNIPNAVWV

SEQ ID NO: 605025 - protein, 9 aa, Homo Sapiens
SMNFIGQGT

SEQ ID NO: 605026 - protein, 9 aa, Homo Sapiens
PMPQGPPFG

SEQ ID NO: 605027 - protein, 9 aa, Homo Sapiens
EGNIREKFS

SEQ ID NO: 605028 - protein, 9 aa, Homo Sapiens
EPEGFLTPK

SEQ ID NO: 605029 - protein, 9 aa, Homo Sapiens
HHIHLLSKD

SEQ ID NO: 605030 - protein, 9 aa, Homo Sapiens
RFMVLCQGP

SEQ ID NO: 605031 - protein, 9 aa, Homo Sapiens
EDKLIEDLT

SEQ ID NO: 605032 - protein, 9 aa, Homo Sapiens
LSDPQNIVK

SEQ ID NO: 605033 - protein, 9 aa, Homo Sapiens
VNDHSPAFP

SEQ ID NO: 605034 - protein, 9 aa, Homo Sapiens
IATELNHLQ

SEQ ID NO: 605035 - protein, 9 aa, Homo Sapiens
EDLTKPGAE

SEQ ID NO: 605036 - protein, 9 aa, Homo Sapiens
PSRPSPMPQ

SEQ ID NO: 605037 - protein, 9 aa, Homo Sapiens
FNDESGENV

SEQ ID NO: 605038 - protein, 9 aa, Homo Sapiens
IKKKSFVQV

SEQ ID NO: 605039 - protein, 9 aa, Homo Sapiens
PLLTDLSLL

SEQ ID NO: 605040 - protein, 9 aa, Homo Sapiens
PDFSKSPIK

SEQ ID NO: 605041 - protein, 9 aa, Homo Sapiens
ATELNHLQK

SEQ ID NO: 605042 - protein, 9 aa, Homo Sapiens
GSNHDGGIS

SEQ ID NO: 605043 - protein, 9 aa, Homo Sapiens
LQAMSEGDA

SEQ ID NO: 605044 - protein, 9 aa, Homo Sapiens
VGVSVNVVS

SEQ ID NO: 605045 - protein, 9 aa, Homo Sapiens
RPVCGVADI

SEQ ID NO: 605046 - protein, 9 aa, Homo Sapiens
TEGNIREKF

SEQ ID NO: 605047 - protein, 9 aa, Homo Sapiens
FIGCKLCLI

SEQ ID NO: 605048 - protein, 9 aa, Homo Sapiens
SVRVLDVND

SEQ ID NO: 605049 - protein, 9 aa, Homo Sapiens
CDRLYVPCA

SEQ ID NO: 605050 - protein, 9 aa, Homo Sapiens
NWLAQRLHC

SEQ ID NO: 605051 - protein, 9 aa, Homo Sapiens
EREQQLRRE

SEQ ID NO: 605052 - protein, 9 aa, Homo Sapiens
QAAAAAAPP

SEQ ID NO: 605053 - protein, 9 aa, Homo Sapiens
DSLQAMSEG

SEQ ID NO: 605054 - protein, 9 aa, Homo Sapiens
LPSGGYQCS

SEQ ID NO: 605055 - protein, 9 aa, Homo Sapiens
IRWPRNDIE

SEQ ID NO: 605056 - protein, 9 aa, Homo Sapiens
DGKNLEVKE

SEQ ID NO: 605057 - protein, 9 aa, Homo Sapiens
SETSADSLQ

SEQ ID NO: 605058 - protein, 9 aa, Homo Sapiens
WGSIEPEGF

SEQ ID NO: 605059 - protein, 9 aa, Homo Sapiens
HSNAKNAIR

SEQ ID NO: 605060 - protein, 9 aa, Homo Sapiens
KQKVKSMNF

SEQ ID NO: 605061 - protein, 9 aa, Homo Sapiens
KLINEWSWP

SEQ ID NO: 605062 - protein, 9 aa, Homo Sapiens
KVRFMVLCQ

SEQ ID NO: 605063 - protein, 9 aa, Homo Sapiens
QEMDFIRWP

SEQ ID NO: 605064 - protein, 9 aa, Homo Sapiens
DKLIEDLTK

SEQ ID NO: 605065 - protein, 9 aa, Homo Sapiens
FLATRNNNI

SEQ ID NO: 605066 - protein, 9 aa, Homo Sapiens
DFIRWPRND

SEQ ID NO: 605067 - protein, 9 aa, Homo Sapiens
HEQKYDSLL

SEQ ID NO: 605068 - protein, 9 aa, Homo Sapiens
LKVLPLLTD

SEQ ID NO: 605069 - protein, 9 aa, Homo Sapiens
NHLQKLGSV

SEQ ID NO: 605070 - protein, 9 aa, Homo Sapiens
NAQLSGLNQ

SEQ ID NO: 605071 - protein, 9 aa, Homo Sapiens
KQNLDGLGI

SEQ ID NO: 605072 - protein, 9 aa, Homo Sapiens
GSIEPEGFL

SEQ ID NO: 605073 - protein, 9 aa, Homo Sapiens
KLTNAQLSG

SEQ ID NO: 605074 - protein, 9 aa, Homo Sapiens
NAIRFETIS

SEQ ID NO: 605075 - protein, 9 aa, Homo Sapiens
GLGIGTYHN

SEQ ID NO: 605076 - protein, 9 aa, Homo Sapiens
MSLSEEQSR

SEQ ID NO: 605077 - protein, 9 aa, Homo Sapiens
DRLYVPCAP

SEQ ID NO: 605078 - protein, 9 aa, Homo Sapiens
SPMPQGPPF

SEQ ID NO: 605079 - protein, 9 aa, Homo Sapiens
DFSKSPIKK

SEQ ID NO: 605080 - protein, 9 aa, Homo Sapiens
VGLQDGKNL

SEQ ID NO: 605081 - protein, 9 aa, Homo Sapiens
SCLSQFTGR

SEQ ID NO: 605082 - protein, 9 aa, Homo Sapiens
PVCGVADIP

SEQ ID NO: 605083 - protein, 9 aa, Homo Sapiens
GFTGQYCDR

SEQ ID NO: 605084 - protein, 9 aa, Homo Sapiens
IIRHNGVHH

SEQ ID NO: 605085 - protein, 9 aa, Homo Sapiens
SFGCFPVHS

SEQ ID NO: 605086 - protein, 9 aa, Homo Sapiens
GKLINEWSW

SEQ ID NO: 605087 - protein, 9 aa, Homo Sapiens
TSTMCGHYI

SEQ ID NO: 605088 - protein, 9 aa, Homo Sapiens
YQCSCLSQF

SEQ ID NO: 605089 - protein, 9 aa, Homo Sapiens
FMVLCQGPL

SEQ ID NO: 605090 - protein, 9 aa, Homo Sapiens
GVNWLAQRL

SEQ ID NO: 605091 - protein, 9 aa, Homo Sapiens
ALQRKSDNP

SEQ ID NO: 605092 - protein, 9 aa, Homo Sapiens
QGYGYLERE

SEQ ID NO: 605093 - protein, 9 aa, Homo Sapiens
TETLNSSSS

SEQ ID NO: 605094 - protein, 9 aa, Homo Sapiens
ETLNSSSSG

SEQ ID NO: 605095 - protein, 9 aa, Homo Sapiens
DPITSTGIK

SEQ ID NO: 605096 - protein, 9 aa, Homo Sapiens
LTKPGAEPP

SEQ ID NO: 605097 - protein, 9 aa, Homo Sapiens
VTLLSDPQN

SEQ ID NO: 605098 - protein, 9 aa, Homo Sapiens
GLQDGKNLE

SEQ ID NO: 605099 - protein, 9 aa, Homo Sapiens
IRFETISLI

SEQ ID NO: 605100 - protein, 9 aa, Homo Sapiens
PEGFLTPKK

SEQ ID NO: 605101 - protein, 9 aa, Homo Sapiens
AFKLYNQMK

SEQ ID NO: 605102 - protein, 9 aa, Homo Sapiens
CGVADIPSS

SEQ ID NO: 605103 - protein, 9 aa, Homo Sapiens
HLQKLGSVS

SEQ ID NO: 605104 - protein, 9 aa, Homo Sapiens
YSITEGNIR

SEQ ID NO: 605105 - protein, 9 aa, Homo Sapiens
YGYLEREQG

SEQ ID NO: 605106 - protein, 9 aa, Homo Sapiens
QAANFPPNL

SEQ ID NO: 605107 - protein, 9 aa, Homo Sapiens
DIFILHEQK

SEQ ID NO: 605108 - protein, 9 aa, Homo Sapiens
PPRQTLHLR

SEQ ID NO: 605109 - protein, 9 aa, Homo Sapiens
FKLYNQMKK

SEQ ID NO: 605110 - protein, 9 aa, Homo Sapiens
CSCLSQFTG

SEQ ID NO: 605111 - protein, 9 aa, Homo Sapiens
RAKKFSLCC

SEQ ID NO: 605112 - protein, 9 aa, Homo Sapiens
IREKFSMDY

SEQ ID NO: 605113 - protein, 9 aa, Homo Sapiens
PEAAPAVPT

SEQ ID NO: 605114 - protein, 9 aa, Homo Sapiens
ADSLQAMSE

SEQ ID NO: 605115 - protein, 9 aa, Homo Sapiens
LRREQEERE

SEQ ID NO: 605116 - protein, 9 aa, Homo Sapiens
GNIREKFSM

SEQ ID NO: 605117 - protein, 9 aa, Homo Sapiens
LDPITSTGI

SEQ ID NO: 605118 - protein, 9 aa, Homo Sapiens
SWPIFGLTS

SEQ ID NO: 605119 - protein, 9 aa, Homo Sapiens
DQQVGLWWA

SEQ ID NO: 605120 - protein, 9 aa, Homo Sapiens
RERKEREAG

SEQ ID NO: 605121 - protein, 9 aa, Homo Sapiens
WVKPIIIGG

SEQ ID NO: 605122 - protein, 9 aa, Homo Sapiens
VYPIDHGPG

SEQ ID NO: 605123 - protein, 9 aa, Homo Sapiens
AQLQKCLWQ

SEQ ID NO: 605124 - protein, 9 aa, Homo Sapiens
DFISKLPKS

SEQ ID NO: 605125 - protein, 9 aa, Homo Sapiens
VFTSFIMVI

SEQ ID NO: 605126 - protein, 9 aa, Homo Sapiens
ERCGESCLR

SEQ ID NO: 605127 - protein, 9 aa, Homo Sapiens
KLLPEERLI

SEQ ID NO: 605128 - protein, 9 aa, Homo Sapiens
IYVFIVFVF

SEQ ID NO: 605129 - protein, 9 aa, Homo Sapiens
ENVRKLQKL

SEQ ID NO: 605130 - protein, 9 aa, Homo Sapiens
NFMGLSLSS

SEQ ID NO: 605131 - protein, 9 aa, Homo Sapiens
TAFSPATTV

SEQ ID NO: 605132 - protein, 9 aa, Homo Sapiens
YDSPWINDM

SEQ ID NO: 605133 - protein, 9 aa, Homo Sapiens
SLGPGQALQ

SEQ ID NO: 605134 - protein, 9 aa, Homo Sapiens
SPATTVQTV

SEQ ID NO: 605135 - protein, 9 aa, Homo Sapiens
QDLLKPLFR

SEQ ID NO: 605136 - protein, 9 aa, Homo Sapiens
WLLWLPVFI

SEQ ID NO: 605137 - protein, 9 aa, Homo Sapiens
KCLWQVEHR

SEQ ID NO: 605138 - protein, 9 aa, Homo Sapiens
VERCGESCL

SEQ ID NO: 605139 - protein, 9 aa, Homo Sapiens
IVFVFTSFI

SEQ ID NO: 605140 - protein, 9 aa, Homo Sapiens
WLPVFISFS

SEQ ID NO: 605141 - protein, 9 aa, Homo Sapiens
PIRMPNVFA

SEQ ID NO: 605142 - protein, 9 aa, Homo Sapiens
VAPLGPTHD

SEQ ID NO: 605143 - protein, 9 aa, Homo Sapiens
LQENVRKLQ

SEQ ID NO: 605144 - protein, 9 aa, Homo Sapiens
GSNLWDQEY

SEQ ID NO: 605145 - protein, 9 aa, Homo Sapiens
TSQFDGDFI

SEQ ID NO: 605146 - protein, 9 aa, Homo Sapiens
VTDLAANQV

SEQ ID NO: 605147 - protein, 9 aa, Homo Sapiens
EAGASGGPS

SEQ ID NO: 605148 - protein, 9 aa, Homo Sapiens
RLGGLNFPW

SEQ ID NO: 605149 - protein, 9 aa, Homo Sapiens
QKSQGTLPA

SEQ ID NO: 605150 - protein, 9 aa, Homo Sapiens
PRSLRVTDL

SEQ ID NO: 605151 - protein, 9 aa, Homo Sapiens
LWQVEHRVH

SEQ ID NO: 605152 - protein, 9 aa, Homo Sapiens
PNLAELENF

SEQ ID NO: 605153 - protein, 9 aa, Homo Sapiens
GPTAFSPAT

SEQ ID NO: 605154 - protein, 9 aa, Homo Sapiens
KLQKLPNLS

SEQ ID NO: 605155 - protein, 9 aa, Homo Sapiens
LPKNTSVVA

SEQ ID NO: 605156 - protein, 9 aa, Homo Sapiens
LRVTDLAAN

SEQ ID NO: 605157 - protein, 9 aa, Homo Sapiens
QIQEHQPNV

SEQ ID NO: 605158 - protein, 9 aa, Homo Sapiens
PIAPTIIIL

SEQ ID NO: 605159 - protein, 9 aa, Homo Sapiens
TDLAANQVM

SEQ ID NO: 605160 - protein, 9 aa, Homo Sapiens
IILPKNTSV

SEQ ID NO: 605161 - protein, 9 aa, Homo Sapiens
PVFISFSHS

SEQ ID NO: 605162 - protein, 9 aa, Homo Sapiens
QSPTQPSLG

SEQ ID NO: 605163 - protein, 9 aa, Homo Sapiens
VKPIIIGGH

SEQ ID NO: 605164 - protein, 9 aa, Homo Sapiens
FKVFVDLTF

SEQ ID NO: 605165 - protein, 9 aa, Homo Sapiens
TVAPLGPTH

SEQ ID NO: 605166 - protein, 9 aa, Homo Sapiens
DGDFISKLP

SEQ ID NO: 605167 - protein, 9 aa, Homo Sapiens
REAGASGGP

SEQ ID NO: 605168 - protein, 9 aa, Homo Sapiens
MTSRTVGTT

SEQ ID NO: 605169 - protein, 9 aa, Homo Sapiens
VFVDLTFPG

SEQ ID NO: 605170 - protein, 9 aa, Homo Sapiens
HSSSLTVAP

SEQ ID NO: 605171 - protein, 9 aa, Homo Sapiens
FGSNLWDQE

SEQ ID NO: 605172 - protein, 9 aa, Homo Sapiens
SVPTVSRLG

SEQ ID NO: 605173 - protein, 9 aa, Homo Sapiens
VFVFTSFIM

SEQ ID NO: 605174 - protein, 9 aa, Homo Sapiens
WQVEHRVHQ

SEQ ID NO: 605175 - protein, 9 aa, Homo Sapiens
VFGSNLWDQ

SEQ ID NO: 605176 - protein, 9 aa, Homo Sapiens
DVFGSNLWD

SEQ ID NO: 605177 - protein, 9 aa, Homo Sapiens
IAPTIIILP

SEQ ID NO: 605178 - protein, 9 aa, Homo Sapiens
YPIDHGPGG

SEQ ID NO: 605179 - protein, 9 aa, Homo Sapiens
YVFIVFVFT

SEQ ID NO: 605180 - protein, 9 aa, Homo Sapiens
GPGGEDEEW

SEQ ID NO: 605181 - protein, 9 aa, Homo Sapiens
QPNVALSTL

SEQ ID NO: 605182 - protein, 9 aa, Homo Sapiens
IIIGGHAYG

SEQ ID NO: 605183 - protein, 9 aa, Homo Sapiens
SNLWDQEYL

SEQ ID NO: 605184 - protein, 9 aa, Homo Sapiens
LWLPVFISF

SEQ ID NO: 605185 - protein, 9 aa, Homo Sapiens
RCGESCLRT

SEQ ID NO: 605186 - protein, 9 aa, Homo Sapiens
NVFACWEIY

SEQ ID NO: 605187 - protein, 9 aa, Homo Sapiens
ERERKEREA

SEQ ID NO: 605188 - protein, 9 aa, Homo Sapiens
LIPWLLWLP

SEQ ID NO: 605189 - protein, 9 aa, Homo Sapiens
AQTVMTSRT

SEQ ID NO: 605190 - protein, 9 aa, Homo Sapiens
QGTLPAKKR

SEQ ID NO: 605191 - protein, 9 aa, Homo Sapiens
PNLKLLPEE

SEQ ID NO: 605192 - protein, 9 aa, Homo Sapiens
VFIVFVFTS

SEQ ID NO: 605193 - protein, 9 aa, Homo Sapiens
MPSVPTVSR

SEQ ID NO: 605194 - protein, 9 aa, Homo Sapiens
DHGPGGEDE

SEQ ID NO: 605195 - protein, 9 aa, Homo Sapiens
FLPRSLRVT

SEQ ID NO: 605196 - protein, 9 aa, Homo Sapiens
IDHGPGGED

SEQ ID NO: 605197 - protein, 9 aa, Homo Sapiens
PTPNLKLLP

SEQ ID NO: 605198 - protein, 9 aa, Homo Sapiens
HFGHENWEH

SEQ ID NO: 605199 - protein, 9 aa, Homo Sapiens
LLWLPVFIS

SEQ ID NO: 605200 - protein, 9 aa, Homo Sapiens
SPWINDMDV

SEQ ID NO: 605201 - protein, 9 aa, Homo Sapiens
NEEQKKSLQ

SEQ ID NO: 605202 - protein, 9 aa, Homo Sapiens
NTSQFDGDF

SEQ ID NO: 605203 - protein, 9 aa, Homo Sapiens
FIVFVFTSF

SEQ ID NO: 605204 - protein, 9 aa, Homo Sapiens
DMDVFQWPL

SEQ ID NO: 605205 - protein, 9 aa, Homo Sapiens
TIIILPKNT

SEQ ID NO: 605206 - protein, 9 aa, Homo Sapiens
GGEDEEWTD

SEQ ID NO: 605207 - protein, 9 aa, Homo Sapiens
EALEEFKVF

SEQ ID NO: 605208 - protein, 9 aa, Homo Sapiens
GQKSQGTLP

SEQ ID NO: 605209 - protein, 9 aa, Homo Sapiens
SLRVTDLAA

SEQ ID NO: 605210 - protein, 9 aa, Homo Sapiens
PATTVQTVP

SEQ ID NO: 605211 - protein, 9 aa, Homo Sapiens
VPTVSRLGG

SEQ ID NO: 605212 - protein, 9 aa, Homo Sapiens
FDGDFISKL

SEQ ID NO: 605213 - protein, 9 aa, Homo Sapiens
LWDQEYLRG

SEQ ID NO: 605214 - protein, 9 aa, Homo Sapiens
EAQLQKCLW

SEQ ID NO: 605215 - protein, 9 aa, Homo Sapiens
TVGTTAYMA

SEQ ID NO: 605216 - protein, 9 aa, Homo Sapiens
EHQLKLAVA

SEQ ID NO: 605217 - protein, 9 aa, Homo Sapiens
EQKKSLQFS

SEQ ID NO: 605218 - protein, 9 aa, Homo Sapiens
GESCLRTPI

SEQ ID NO: 605219 - protein, 9 aa, Homo Sapiens
CLRTPIRMP

SEQ ID NO: 605220 - protein, 9 aa, Homo Sapiens
RELQDLLKP

SEQ ID NO: 605221 - protein, 9 aa, Homo Sapiens
FGHENWEHQ

SEQ ID NO: 605222 - protein, 9 aa, Homo Sapiens
LQDLLKPLF

SEQ ID NO: 605223 - protein, 9 aa, Homo Sapiens
TSRTVGTTA

SEQ ID NO: 605224 - protein, 9 aa, Homo Sapiens
IPWLLWLPV

SEQ ID NO: 605225 - protein, 9 aa, Homo Sapiens
QEALEEFKV

SEQ ID NO: 605226 - protein, 9 aa, Homo Sapiens
IGGHAYGDQ

SEQ ID NO: 605227 - protein, 9 aa, Homo Sapiens
LRTPIRMPN

SEQ ID NO: 605228 - protein, 9 aa, Homo Sapiens
PWLLWLPVF

SEQ ID NO: 605229 - protein, 9 aa, Homo Sapiens
GTLPAKKRR

SEQ ID NO: 605230 - protein, 9 aa, Homo Sapiens
MPNVFACWE

SEQ ID NO: 605231 - protein, 9 aa, Homo Sapiens
QERERKERE

SEQ ID NO: 605232 - protein, 9 aa, Homo Sapiens
LAELENFMG

SEQ ID NO: 605233 - protein, 9 aa, Homo Sapiens
QFDGDFISK

SEQ ID NO: 605234 - protein, 9 aa, Homo Sapiens
ERELQDLLK

SEQ ID NO: 605235 - protein, 9 aa, Homo Sapiens
GHAYGDQYR

SEQ ID NO: 605236 - protein, 9 aa, Homo Sapiens
ENWEHQLKL

SEQ ID NO: 605237 - protein, 9 aa, Homo Sapiens
AEGQKSQGT

SEQ ID NO: 605238 - protein, 9 aa, Homo Sapiens
FISKLPKSN

SEQ ID NO: 605239 - protein, 9 aa, Homo Sapiens
NATERELQD

SEQ ID NO: 605240 - protein, 9 aa, Homo Sapiens
LPRSLRVTD

SEQ ID NO: 605241 - protein, 9 aa, Homo Sapiens
VFACWEIYD

SEQ ID NO: 605242 - protein, 9 aa, Homo Sapiens
IIILPKNTS

SEQ ID NO: 605243 - protein, 9 aa, Homo Sapiens
TERELQDLL

SEQ ID NO: 605244 - protein, 9 aa, Homo Sapiens
WEHQLKLAV

SEQ ID NO: 605245 - protein, 9 aa, Homo Sapiens
IIGGHAYGD

SEQ ID NO: 605246 - protein, 9 aa, Homo Sapiens
PWINDMDVF

SEQ ID NO: 605247 - protein, 9 aa, Homo Sapiens
EGQKSQGTL

SEQ ID NO: 605248 - protein, 9 aa, Homo Sapiens
SLQFSETST

SEQ ID NO: 605249 - protein, 9 aa, Homo Sapiens
EREAGASGG

SEQ ID NO: 605250 - protein, 9 aa, Homo Sapiens
LPVFISFSH

SEQ ID NO: 605251 - protein, 9 aa, Homo Sapiens
RKEREAGAS

SEQ ID NO: 605252 - protein, 9 aa, Homo Sapiens
RMPNVFACW

SEQ ID NO: 605253 - protein, 9 aa, Homo Sapiens
TVSRLGGLN

SEQ ID NO: 605254 - protein, 9 aa, Homo Sapiens
ILPKNTSVV

SEQ ID NO: 605255 - protein, 9 aa, Homo Sapiens
LMVERCGES

SEQ ID NO: 605256 - protein, 9 aa, Homo Sapiens
TQPSLGPGQ

SEQ ID NO: 605257 - protein, 9 aa, Homo Sapiens
QLQKCLWQV

SEQ ID NO: 605258 - protein, 9 aa, Homo Sapiens
NDMDVFQWP

SEQ ID NO: 605259 - protein, 9 aa, Homo Sapiens
SCLRTPIRM

SEQ ID NO: 605260 - protein, 9 aa, Homo Sapiens
QKLPNLSPL

SEQ ID NO: 605261 - protein, 9 aa, Homo Sapiens
PGGEDEEWT

SEQ ID NO: 605262 - protein, 9 aa, Homo Sapiens
PNVALSTLR

SEQ ID NO: 605263 - protein, 9 aa, Homo Sapiens
KRNEEQKKS

SEQ ID NO: 605264 - protein, 9 aa, Homo Sapiens
SSLTVAPLG

SEQ ID NO: 605265 - protein, 9 aa, Homo Sapiens
VSRLGGLNF

SEQ ID NO: 605266 - protein, 9 aa, Homo Sapiens
EEFKVFVDL

SEQ ID NO: 605267 - protein, 9 aa, Homo Sapiens
MDVFQWPLG

SEQ ID NO: 605268 - protein, 9 aa, Homo Sapiens
PTAFSPATT

SEQ ID NO: 605269 - protein, 9 aa, Homo Sapiens
TPNLKLLPE

SEQ ID NO: 605270 - protein, 9 aa, Homo Sapiens
GGHAYGDQY

SEQ ID NO: 605271 - protein, 9 aa, Homo Sapiens
LTVAPLGPT

SEQ ID NO: 605272 - protein, 9 aa, Homo Sapiens
NLWDQEYLR

SEQ ID NO: 605273 - protein, 9 aa, Homo Sapiens
PIDHGPGGE

SEQ ID NO: 605274 - protein, 9 aa, Homo Sapiens
RTVGTTAYM

SEQ ID NO: 605275 - protein, 9 aa, Homo Sapiens
FSPATTVQT

SEQ ID NO: 605276 - protein, 9 aa, Homo Sapiens
ELENFMGLS

SEQ ID NO: 605277 - protein, 9 aa, Homo Sapiens
SRTVGTTAY

SEQ ID NO: 605278 - protein, 9 aa, Homo Sapiens
PSLGPGQAL

SEQ ID NO: 605279 - protein, 9 aa, Homo Sapiens
LEEFKVFVD

SEQ ID NO: 605280 - protein, 9 aa, Homo Sapiens
NLKLLPEER

SEQ ID NO: 605281 - protein, 9 aa, Homo Sapiens
FVFTSFIMV

SEQ ID NO: 605282 - protein, 9 aa, Homo Sapiens
RSLRVTDLA

SEQ ID NO: 605283 - protein, 9 aa, Homo Sapiens
PPTPNLKLL

SEQ ID NO: 605284 - protein, 9 aa, Homo Sapiens
CIYVFIVFV

SEQ ID NO: 605285 - protein, 9 aa, Homo Sapiens
CGESCLRTP

SEQ ID NO: 605286 - protein, 9 aa, Homo Sapiens
EFKVFVDLT

SEQ ID NO: 605287 - protein, 9 aa, Homo Sapiens
APLGPTHDC

SEQ ID NO: 605288 - protein, 9 aa, Homo Sapiens
SSSLTVAPL

SEQ ID NO: 605289 - protein, 9 aa, Homo Sapiens
ESCLRTPIR

SEQ ID NO: 605290 - protein, 9 aa, Homo Sapiens
TPIRMPNVF

SEQ ID NO: 605291 - protein, 9 aa, Homo Sapiens
WDQEYLRGM

SEQ ID NO: 605292 - protein, 9 aa, Homo Sapiens
RVTDLAANQ

SEQ ID NO: 605293 - protein, 9 aa, Homo Sapiens
IQEHQPNVA

SEQ ID NO: 605294 - protein, 9 aa, Homo Sapiens
DHFGHENWE

SEQ ID NO: 605295 - protein, 9 aa, Homo Sapiens
EEQKKSLQF

SEQ ID NO: 605296 - protein, 9 aa, Homo Sapiens
LQKLPNLSP

SEQ ID NO: 605297 - protein, 9 aa, Homo Sapiens
YQIQEHQPN

SEQ ID NO: 605298 - protein, 9 aa, Homo Sapiens
DLLKPLFRN

SEQ ID NO: 605299 - protein, 9 aa, Homo Sapiens
RKLQKLPNL

SEQ ID NO: 605300 - protein, 9 aa, Homo Sapiens
QKKSLQFSE

SEQ ID NO: 605301 - protein, 9 aa, Homo Sapiens
NVALSTLRD

SEQ ID NO: 605302 - protein, 9 aa, Homo Sapiens
DSPWINDMD

SEQ ID NO: 605303 - protein, 9 aa, Homo Sapiens
TVMTSRTVG

SEQ ID NO: 605304 - protein, 9 aa, Homo Sapiens
AFSPATTVQ

SEQ ID NO: 605305 - protein, 9 aa, Homo Sapiens
KSLQFSETS

SEQ ID NO: 605306 - protein, 9 aa, Homo Sapiens
PTQPSLGPG

SEQ ID NO: 605307 - protein, 9 aa, Homo Sapiens
ATTVQTVPV

SEQ ID NO: 605308 - protein, 9 aa, Homo Sapiens
TTVQTVPVH

SEQ ID NO: 605309 - protein, 9 aa, Homo Sapiens
RNEEQKKSL

SEQ ID NO: 605310 - protein, 9 aa, Homo Sapiens
SQGTLPAKK

SEQ ID NO: 605311 - protein, 9 aa, Homo Sapiens
PSVPTVSRL

SEQ ID NO: 605312 - protein, 9 aa, Homo Sapiens
LGPGQALQN

SEQ ID NO: 605313 - protein, 9 aa, Homo Sapiens
SPTQPSLGP

SEQ ID NO: 605314 - protein, 9 aa, Homo Sapiens
MVERCGESC

SEQ ID NO: 605315 - protein, 9 aa, Homo Sapiens
PTVSRLGGL

SEQ ID NO: 605316 - protein, 9 aa, Homo Sapiens
KSQGTLPAK

SEQ ID NO: 605317 - protein, 9 aa, Homo Sapiens
HGPGGEDEE

SEQ ID NO: 605318 - protein, 9 aa, Homo Sapiens
HQPNVALST

SEQ ID NO: 605319 - protein, 9 aa, Homo Sapiens
QPSLGPGQA

SEQ ID NO: 605320 - protein, 9 aa, Homo Sapiens
WINDMDVFQ

SEQ ID NO: 605321 - protein, 9 aa, Homo Sapiens
QENVRKLQK

SEQ ID NO: 605322 - protein, 9 aa, Homo Sapiens
PNVFACWEI

SEQ ID NO: 605323 - protein, 9 aa, Homo Sapiens
QKCLWQVEH

SEQ ID NO: 605324 - protein, 9 aa, Homo Sapiens
NWEHQLKLA

SEQ ID NO: 605325 - protein, 9 aa, Homo Sapiens
APTIIILPK

SEQ ID NO: 605326 - protein, 9 aa, Homo Sapiens
QEHQPNVAL

SEQ ID NO: 605327 - protein, 9 aa, Homo Sapiens
ENFMGLSLS

SEQ ID NO: 605328 - protein, 9 aa, Homo Sapiens
ELQDLLKPL

SEQ ID NO: 605329 - protein, 9 aa, Homo Sapiens
KEREAGASG

SEQ ID NO: 605330 - protein, 9 aa, Homo Sapiens
PLGPTHDCE

SEQ ID NO: 605331 - protein, 9 aa, Homo Sapiens
EHQPNVALS

SEQ ID NO: 605332 - protein, 9 aa, Homo Sapiens
AELENFMGL

SEQ ID NO: 605333 - protein, 9 aa, Homo Sapiens
KVFVDLTFP

SEQ ID NO: 605334 - protein, 9 aa, Homo Sapiens
HENWEHQLK

SEQ ID NO: 605335 - protein, 9 aa, Homo Sapiens
PIIIGGHAY

SEQ ID NO: 605336 - protein, 9 aa, Homo Sapiens
ALEEFKVFV

SEQ ID NO: 605337 - protein, 9 aa, Homo Sapiens
SRLGGLNFP

SEQ ID NO: 605338 - protein, 9 aa, Homo Sapiens
LQKCLWQVE

SEQ ID NO: 605339 - protein, 9 aa, Homo Sapiens
VMTSRTVGT

SEQ ID NO: 605340 - protein, 9 aa, Homo Sapiens
LENFMGLSL

SEQ ID NO: 605341 - protein, 9 aa, Homo Sapiens
SLTVAPLGP

SEQ ID NO: 605342 - protein, 9 aa, Homo Sapiens
GHENWEHQL

SEQ ID NO: 605343 - protein, 9 aa, Homo Sapiens
INDMDVFQW

SEQ ID NO: 605344 - protein, 9 aa, Homo Sapiens
TQSPTQPSL

SEQ ID NO: 605345 - protein, 9 aa, Homo Sapiens
KPIIIGGHA

SEQ ID NO: 605346 - protein, 9 aa, Homo Sapiens
RTPIRMPNV

SEQ ID NO: 605347 - protein, 9 aa, Homo Sapiens
FMGLSLSSQ

SEQ ID NO: 605348 - protein, 9 aa, Homo Sapiens
TLPAKKRRS

SEQ ID NO: 605349 - protein, 9 aa, Homo Sapiens
SQFDGDFIS

SEQ ID NO: 605350 - protein, 9 aa, Homo Sapiens
CLWQVEHRV

SEQ ID NO: 605351 - protein, 9 aa, Homo Sapiens
QTVMTSRTV

SEQ ID NO: 605352 - protein, 9 aa, Homo Sapiens
ATERELQDL

SEQ ID NO: 605353 - protein, 9 aa, Homo Sapiens
ERKEREAGA

SEQ ID NO: 605354 - protein, 9 aa, Homo Sapiens
VRKLQKLPN

SEQ ID NO: 605355 - protein, 9 aa, Homo Sapiens
NVRKLQKLP

SEQ ID NO: 605356 - protein, 9 aa, Homo Sapiens
NLAELENFM

SEQ ID NO: 605357 - protein, 9 aa, Homo Sapiens
DQEYLRGMD

SEQ ID NO: 605358 - protein, 9 aa, Homo Sapiens
GDFISKLPK

SEQ ID NO: 605359 - protein, 9 aa, Homo Sapiens
KKSLQFSET

SEQ ID NO: 605360 - protein, 9 aa, Homo Sapiens
PTIIILPKN

SEQ ID NO: 605361 - protein, 9 aa, Homo Sapiens
IRMPNVFAC

SEQ ID NO: 605362 - protein, 9 aa, Homo Sapiens
VSLAQWGDS

SEQ ID NO: 605363 - protein, 9 aa, Homo Sapiens
HWGKQYDIP

SEQ ID NO: 605364 - protein, 9 aa, Homo Sapiens
ILYGLSSVF

SEQ ID NO: 605365 - protein, 9 aa, Homo Sapiens
DLGNVMRTM

SEQ ID NO: 605366 - protein, 9 aa, Homo Sapiens
QLDSLTEAP

SEQ ID NO: 605367 - protein, 9 aa, Homo Sapiens
ILKLLSEKV

SEQ ID NO: 605368 - protein, 9 aa, Homo Sapiens
ECISNIGQY

SEQ ID NO: 605369 - protein, 9 aa, Homo Sapiens
VIVRSSHSA

SEQ ID NO: 605370 - protein, 9 aa, Homo Sapiens
VFYHTEGSR

SEQ ID NO: 605371 - protein, 9 aa, Homo Sapiens
SCQFIEMYL

SEQ ID NO: 605372 - protein, 9 aa, Homo Sapiens
QENRAHGKV

SEQ ID NO: 605373 - protein, 9 aa, Homo Sapiens
DFLLSTFDD

SEQ ID NO: 605374 - protein, 9 aa, Homo Sapiens
TLQDKAGKK

SEQ ID NO: 605375 - protein, 9 aa, Homo Sapiens
GTQRSEAVT

SEQ ID NO: 605376 - protein, 9 aa, Homo Sapiens
IQGDFAGRA

SEQ ID NO: 605377 - protein, 9 aa, Homo Sapiens
SQFPELDRH

SEQ ID NO: 605378 - protein, 9 aa, Homo Sapiens
ENKRRRLEE

SEQ ID NO: 605379 - protein, 9 aa, Homo Sapiens
TLNWEAVSD

SEQ ID NO: 605380 - protein, 9 aa, Homo Sapiens
TEFIAWGPM

SEQ ID NO: 605381 - protein, 9 aa, Homo Sapiens
LAQWGDSIP

SEQ ID NO: 605382 - protein, 9 aa, Homo Sapiens
FGQGAEGGL

SEQ ID NO: 605383 - protein, 9 aa, Homo Sapiens
GWDKHIVAL

SEQ ID NO: 605384 - protein, 9 aa, Homo Sapiens
LSTFDDQIW

SEQ ID NO: 605385 - protein, 9 aa, Homo Sapiens
SMWETRSSH

SEQ ID NO: 605386 - protein, 9 aa, Homo Sapiens
EEFRTIWVI

SEQ ID NO: 605387 - protein, 9 aa, Homo Sapiens
IWRKSFQSM

SEQ ID NO: 605388 - protein, 9 aa, Homo Sapiens
LAGSGGVRA

SEQ ID NO: 605389 - protein, 9 aa, Homo Sapiens
CLKKEKQER

SEQ ID NO: 605390 - protein, 9 aa, Homo Sapiens
AILMFEREF

SEQ ID NO: 605391 - protein, 9 aa, Homo Sapiens
FLLLEEVPP

SEQ ID NO: 605392 - protein, 9 aa, Homo Sapiens
GILICEQWV

SEQ ID NO: 605393 - protein, 9 aa, Homo Sapiens
RYALCDATY

SEQ ID NO: 605394 - protein, 9 aa, Homo Sapiens
SAKVSDFIS

SEQ ID NO: 605395 - protein, 9 aa, Homo Sapiens
FVESSREYP

SEQ ID NO: 605396 - protein, 9 aa, Homo Sapiens
IVLERHGMS

SEQ ID NO: 605397 - protein, 9 aa, Homo Sapiens
SAVCVHQLP

SEQ ID NO: 605398 - protein, 9 aa, Homo Sapiens
GAPPGVGSM

SEQ ID NO: 605399 - protein, 9 aa, Homo Sapiens
FPELDRHFR

SEQ ID NO: 605400 - protein, 9 aa, Homo Sapiens
ERERLIPVI

SEQ ID NO: 605401 - protein, 9 aa, Homo Sapiens
LSCPASQHK

SEQ ID NO: 605402 - protein, 9 aa, Homo Sapiens
ISDSIMKFS

SEQ ID NO: 605403 - protein, 9 aa, Homo Sapiens
FLTTKKLQR

SEQ ID NO: 605404 - protein, 9 aa, Homo Sapiens
EMNPCTPDN

SEQ ID NO: 605405 - protein, 9 aa, Homo Sapiens
PDNVEVLET

SEQ ID NO: 605406 - protein, 9 aa, Homo Sapiens
KKKNKNSST

SEQ ID NO: 605407 - protein, 9 aa, Homo Sapiens
VALLQVLAQ

SEQ ID NO: 605408 - protein, 9 aa, Homo Sapiens
LEEVPPMLP

SEQ ID NO: 605409 - protein, 9 aa, Homo Sapiens
FISAQYPVV

SEQ ID NO: 605410 - protein, 9 aa, Homo Sapiens
TNVFYHTEG

SEQ ID NO: 605411 - protein, 9 aa, Homo Sapiens
VRNLRRDAE

SEQ ID NO: 605412 - protein, 9 aa, Homo Sapiens
GSVWIPRFM

SEQ ID NO: 605413 - protein, 9 aa, Homo Sapiens
PAHSGFIGK

SEQ ID NO: 605414 - protein, 9 aa, Homo Sapiens
VNSDLSNYF

SEQ ID NO: 605415 - protein, 9 aa, Homo Sapiens
STPQKNNGS

SEQ ID NO: 605416 - protein, 9 aa, Homo Sapiens
MLTLKLQDG

SEQ ID NO: 605417 - protein, 9 aa, Homo Sapiens
PSTLLDVEV

SEQ ID NO: 605418 - protein, 9 aa, Homo Sapiens
ALVLQTIWV

SEQ ID NO: 605419 - protein, 9 aa, Homo Sapiens
TNTLPNYQS

SEQ ID NO: 605420 - protein, 9 aa, Homo Sapiens
LEQKLLLCN

SEQ ID NO: 605421 - protein, 9 aa, Homo Sapiens
TVFMLEYFS

SEQ ID NO: 605422 - protein, 9 aa, Homo Sapiens
PLSCPASQH

SEQ ID NO: 605423 - protein, 9 aa, Homo Sapiens
TLEELMNLS

SEQ ID NO: 605424 - protein, 9 aa, Homo Sapiens
TVGSTRKLG

SEQ ID NO: 605425 - protein, 9 aa, Homo Sapiens
PGSAVCVHQ

SEQ ID NO: 605426 - protein, 9 aa, Homo Sapiens
SEKVFDFSS

SEQ ID NO: 605427 - protein, 9 aa, Homo Sapiens
APCASLASE

SEQ ID NO: 605428 - protein, 9 aa, Homo Sapiens
IHTGETPNE

SEQ ID NO: 605429 - protein, 9 aa, Homo Sapiens
DYVEYAGQI

SEQ ID NO: 605430 - protein, 9 aa, Homo Sapiens
SSAKQTQVC

SEQ ID NO: 605431 - protein, 9 aa, Homo Sapiens
GQRSRADAS

SEQ ID NO: 605432 - protein, 9 aa, Homo Sapiens
PLEQKLLLC

SEQ ID NO: 605433 - protein, 9 aa, Homo Sapiens
LERLWSKAH

SEQ ID NO: 605434 - protein, 9 aa, Homo Sapiens
LPHPAMDSP

SEQ ID NO: 605435 - protein, 9 aa, Homo Sapiens
QLFFFILNF

SEQ ID NO: 605436 - protein, 9 aa, Homo Sapiens
TTVTFPVTT

SEQ ID NO: 605437 - protein, 9 aa, Homo Sapiens
HDNLQLMKG

SEQ ID NO: 605438 - protein, 9 aa, Homo Sapiens
EARARQLSP

SEQ ID NO: 605439 - protein, 9 aa, Homo Sapiens
VSAQVLLLQ

SEQ ID NO: 605440 - protein, 9 aa, Homo Sapiens
IVLSARMSP

SEQ ID NO: 605441 - protein, 9 aa, Homo Sapiens
VNPDQPLSA

SEQ ID NO: 605442 - protein, 9 aa, Homo Sapiens
DECLKKEKQ

SEQ ID NO: 605443 - protein, 9 aa, Homo Sapiens
MNPCTPDNV

SEQ ID NO: 605444 - protein, 9 aa, Homo Sapiens
GVRAPGGPG

SEQ ID NO: 605445 - protein, 9 aa, Homo Sapiens
DFGEVFVSP

SEQ ID NO: 605446 - protein, 9 aa, Homo Sapiens
ENASPTDPN

SEQ ID NO: 605447 - protein, 9 aa, Homo Sapiens
VSVMINEEH

SEQ ID NO: 605448 - protein, 9 aa, Homo Sapiens
EDDYEEEED

SEQ ID NO: 605449 - protein, 9 aa, Homo Sapiens
RERLIPVIN

SEQ ID NO: 605450 - protein, 9 aa, Homo Sapiens
VTFPVTTNT

SEQ ID NO: 605451 - protein, 9 aa, Homo Sapiens
MWETRSSHL

SEQ ID NO: 605452 - protein, 9 aa, Homo Sapiens
IVVDKIVLF

SEQ ID NO: 605453 - protein, 9 aa, Homo Sapiens
DLSNYFRVA

SEQ ID NO: 605454 - protein, 9 aa, Homo Sapiens
TISPYAITP

SEQ ID NO: 605455 - protein, 9 aa, Homo Sapiens
KEQLQTLQD

SEQ ID NO: 605456 - protein, 9 aa, Homo Sapiens
RLYKKRPQN

SEQ ID NO: 605457 - protein, 9 aa, Homo Sapiens
SSVDQLLQA

SEQ ID NO: 605458 - protein, 9 aa, Homo Sapiens
CISNIGQYI

SEQ ID NO: 605459 - protein, 9 aa, Homo Sapiens
LVAVHPFTV

SEQ ID NO: 605460 - protein, 9 aa, Homo Sapiens
SLAQWGDSI

SEQ ID NO: 605461 - protein, 9 aa, Homo Sapiens
SKAHHYLLT

SEQ ID NO: 605462 - protein, 9 aa, Homo Sapiens
CEDTDTGPK

SEQ ID NO: 605463 - protein, 9 aa, Homo Sapiens
GHEPAHSGF

SEQ ID NO: 605464 - protein, 9 aa, Homo Sapiens
LQRPVWQPQ

SEQ ID NO: 605465 - protein, 9 aa, Homo Sapiens
DKDLRVSDN

SEQ ID NO: 605466 - protein, 9 aa, Homo Sapiens
AGSGGVRAP

SEQ ID NO: 605467 - protein, 9 aa, Homo Sapiens
EPAHSGFIG

SEQ ID NO: 605468 - protein, 9 aa, Homo Sapiens
HHMSMWETR

SEQ ID NO: 605469 - protein, 9 aa, Homo Sapiens
PGHKRTLSE

SEQ ID NO: 605470 - protein, 9 aa, Homo Sapiens
SDGYPLEEI

SEQ ID NO: 605471 - protein, 9 aa, Homo Sapiens
GADFAVNPD

SEQ ID NO: 605472 - protein, 9 aa, Homo Sapiens
ERQGAICDY

SEQ ID NO: 605473 - protein, 9 aa, Homo Sapiens
TDTGPKCGC

SEQ ID NO: 605474 - protein, 9 aa, Homo Sapiens
AGADFAVNP

SEQ ID NO: 605475 - protein, 9 aa, Homo Sapiens
EFAVHLHLE

SEQ ID NO: 605476 - protein, 9 aa, Homo Sapiens
SLTEAPKYE

SEQ ID NO: 605477 - protein, 9 aa, Homo Sapiens
VTTNTLPNY

SEQ ID NO: 605478 - protein, 9 aa, Homo Sapiens
FLQRPVWQP

SEQ ID NO: 605479 - protein, 9 aa, Homo Sapiens
ASGSVWIPR

SEQ ID NO: 605480 - protein, 9 aa, Homo Sapiens
QLMKGCKSM

SEQ ID NO: 605481 - protein, 9 aa, Homo Sapiens
ESLKAGILI

SEQ ID NO: 605482 - protein, 9 aa, Homo Sapiens
VEENKRRRL

SEQ ID NO: 605483 - protein, 9 aa, Homo Sapiens
HTPERRQEN

SEQ ID NO: 605484 - protein, 9 aa, Homo Sapiens
HTGETPNEC

SEQ ID NO: 605485 - protein, 9 aa, Homo Sapiens
QVLAQKHCA

SEQ ID NO: 605486 - protein, 9 aa, Homo Sapiens
NGLGTQRSE

SEQ ID NO: 605487 - protein, 9 aa, Homo Sapiens
GDSIPYGSC

SEQ ID NO: 605488 - protein, 9 aa, Homo Sapiens
WGKQYDIPN

SEQ ID NO: 605489 - protein, 9 aa, Homo Sapiens
GILLLQVLS

SEQ ID NO: 605490 - protein, 9 aa, Homo Sapiens
ASYGRINTF

SEQ ID NO: 605491 - protein, 9 aa, Homo Sapiens
GKALASHHT

SEQ ID NO: 605492 - protein, 9 aa, Homo Sapiens
ALCDATYET

SEQ ID NO: 605493 - protein, 9 aa, Homo Sapiens
ECLKKEKQE

SEQ ID NO: 605494 - protein, 9 aa, Homo Sapiens
LEEIVYQWK

SEQ ID NO: 605495 - protein, 9 aa, Homo Sapiens
EALPEPLKH

SEQ ID NO: 605496 - protein, 9 aa, Homo Sapiens
SDSIMKFSE

SEQ ID NO: 605497 - protein, 9 aa, Homo Sapiens
LHGCEHFYL

SEQ ID NO: 605498 - protein, 9 aa, Homo Sapiens
RARQLSPQL

SEQ ID NO: 605499 - protein, 9 aa, Homo Sapiens
GATMLEHGW

SEQ ID NO: 605500 - protein, 9 aa, Homo Sapiens
AWGPMGDEE

SEQ ID NO: 605501 - protein, 9 aa, Homo Sapiens
PVWQPQAGL

SEQ ID NO: 605502 - protein, 9 aa, Homo Sapiens
KDLGNVMRT

SEQ ID NO: 605503 - protein, 9 aa, Homo Sapiens
AQERKKDLS

SEQ ID NO: 605504 - protein, 9 aa, Homo Sapiens
NNFLLISDE

SEQ ID NO: 605505 - protein, 9 aa, Homo Sapiens
QFIEMYLMV

SEQ ID NO: 605506 - protein, 9 aa, Homo Sapiens
FIAWGPMGD

SEQ ID NO: 605507 - protein, 9 aa, Homo Sapiens
KDLRVSDNY

SEQ ID NO: 605508 - protein, 9 aa, Homo Sapiens
IPLHGCEHF

SEQ ID NO: 605509 - protein, 9 aa, Homo Sapiens
NIGGSPSTL

SEQ ID NO: 605510 - protein, 9 aa, Homo Sapiens
PKIWRKSFQ

SEQ ID NO: 605511 - protein, 9 aa, Homo Sapiens
DRHFREDSQ

SEQ ID NO: 605512 - protein, 9 aa, Homo Sapiens
QVCQSPKIW

SEQ ID NO: 605513 - protein, 9 aa, Homo Sapiens
FLLFILYGL

SEQ ID NO: 605514 - protein, 9 aa, Homo Sapiens
EFIAWGPMG

SEQ ID NO: 605515 - protein, 9 aa, Homo Sapiens
TVLSQSVLS

SEQ ID NO: 605516 - protein, 9 aa, Homo Sapiens
WGDSIPYGS

SEQ ID NO: 605517 - protein, 9 aa, Homo Sapiens
LLLQVLSTV

SEQ ID NO: 605518 - protein, 9 aa, Homo Sapiens
VQSQFPELD

SEQ ID NO: 605519 - protein, 9 aa, Homo Sapiens
EDSQEKLAG

SEQ ID NO: 605520 - protein, 9 aa, Homo Sapiens
QEALPEPLK

SEQ ID NO: 605521 - protein, 9 aa, Homo Sapiens
QKVEENKRR

SEQ ID NO: 605522 - protein, 9 aa, Homo Sapiens
PGVGSMPSS

SEQ ID NO: 605523 - protein, 9 aa, Homo Sapiens
PYLLISGGW

SEQ ID NO: 605524 - protein, 9 aa, Homo Sapiens
SQKIACEKL

SEQ ID NO: 605525 - protein, 9 aa, Homo Sapiens
RYKRIQRTF

SEQ ID NO: 605526 - protein, 9 aa, Homo Sapiens
QIQFDERED

SEQ ID NO: 605527 - protein, 9 aa, Homo Sapiens
QRLYLSHNQ

SEQ ID NO: 605528 - protein, 9 aa, Homo Sapiens
ETLEELMNL

SEQ ID NO: 605529 - protein, 9 aa, Homo Sapiens
LKAGILICE

SEQ ID NO: 605530 - protein, 9 aa, Homo Sapiens
SQEKLAGAT

SEQ ID NO: 605531 - protein, 9 aa, Homo Sapiens
SSREYPAGH

SEQ ID NO: 605532 - protein, 9 aa, Homo Sapiens
QIWVYSFIG

SEQ ID NO: 605533 - protein, 9 aa, Homo Sapiens
RQKVEENKR

SEQ ID NO: 605534 - protein, 9 aa, Homo Sapiens
DVEVVEAEF

SEQ ID NO: 605535 - protein, 9 aa, Homo Sapiens
ATSQVPAGH

SEQ ID NO: 605536 - protein, 9 aa, Homo Sapiens
RQLSPQLGP

SEQ ID NO: 605537 - protein, 9 aa, Homo Sapiens
CQSPKIWRK

SEQ ID NO: 605538 - protein, 9 aa, Homo Sapiens
HCAGVNIGG

SEQ ID NO: 605539 - protein, 9 aa, Homo Sapiens
DTHMRITCY

SEQ ID NO: 605540 - protein, 9 aa, Homo Sapiens
GGVRAPGGP

SEQ ID NO: 605541 - protein, 9 aa, Homo Sapiens
FQRLLQDIS

SEQ ID NO: 605542 - protein, 9 aa, Homo Sapiens
GGKALASHH

SEQ ID NO: 605543 - protein, 9 aa, Homo Sapiens
MGSSSPEPE

SEQ ID NO: 605544 - protein, 9 aa, Homo Sapiens
NLTGYSGFI

SEQ ID NO: 605545 - protein, 9 aa, Homo Sapiens
LPEPLKHES

SEQ ID NO: 605546 - protein, 9 aa, Homo Sapiens
QCCCIVVDK

SEQ ID NO: 605547 - protein, 9 aa, Homo Sapiens
LSNYFRVAT

SEQ ID NO: 605548 - protein, 9 aa, Homo Sapiens
LLLEEVPPM

SEQ ID NO: 605549 - protein, 9 aa, Homo Sapiens
SGFIGKGML

SEQ ID NO: 605550 - protein, 9 aa, Homo Sapiens
LNDCRYALC

SEQ ID NO: 605551 - protein, 9 aa, Homo Sapiens
SRADASHAG

SEQ ID NO: 605552 - protein, 9 aa, Homo Sapiens
LKHGANPNL

SEQ ID NO: 605553 - protein, 9 aa, Homo Sapiens
VYKELRKPL

SEQ ID NO: 605554 - protein, 9 aa, Homo Sapiens
GAICDYEMR

SEQ ID NO: 605555 - protein, 9 aa, Homo Sapiens
CSDCKELSC

SEQ ID NO: 605556 - protein, 9 aa, Homo Sapiens
GSGHEPAHS

SEQ ID NO: 605557 - protein, 9 aa, Homo Sapiens
TMLEHGWDK

SEQ ID NO: 605558 - protein, 9 aa, Homo Sapiens
DGYPLEEIV

SEQ ID NO: 605559 - protein, 9 aa, Homo Sapiens
LMFEREFAL

SEQ ID NO: 605560 - protein, 9 aa, Homo Sapiens
DTVGSTRKL

SEQ ID NO: 605561 - protein, 9 aa, Homo Sapiens
RRQCCCIVV

SEQ ID NO: 605562 - protein, 9 aa, Homo Sapiens
MIPQDEYPD

SEQ ID NO: 605563 - protein, 9 aa, Homo Sapiens
CASLASELF

SEQ ID NO: 605564 - protein, 9 aa, Homo Sapiens
SDELRSVRS

SEQ ID NO: 605565 - protein, 9 aa, Homo Sapiens
RLWSKAHHY

SEQ ID NO: 605566 - protein, 9 aa, Homo Sapiens
CQFIEMYLM

SEQ ID NO: 605567 - protein, 9 aa, Homo Sapiens
ETRSSHLRE

SEQ ID NO: 605568 - protein, 9 aa, Homo Sapiens
IAQERKKDL

SEQ ID NO: 605569 - protein, 9 aa, Homo Sapiens
SLKAGILIC

SEQ ID NO: 605570 - protein, 9 aa, Homo Sapiens
LRVSDNYLL

SEQ ID NO: 605571 - protein, 9 aa, Homo Sapiens
GHVQSQFPE

SEQ ID NO: 605572 - protein, 9 aa, Homo Sapiens
FLLSTFDDQ

SEQ ID NO: 605573 - protein, 9 aa, Homo Sapiens
YEEEEDSDE

SEQ ID NO: 605574 - protein, 9 aa, Homo Sapiens
SIIKIDLHG

SEQ ID NO: 605575 - protein, 9 aa, Homo Sapiens
TEEPDRDEC

SEQ ID NO: 605576 - protein, 9 aa, Homo Sapiens
GGPGSAVCV

SEQ ID NO: 605577 - protein, 9 aa, Homo Sapiens
DFENASPTD

SEQ ID NO: 605578 - protein, 9 aa, Homo Sapiens
DGKDLNQFT

SEQ ID NO: 605579 - protein, 9 aa, Homo Sapiens
RKDGKDLNQ

SEQ ID NO: 605580 - protein, 9 aa, Homo Sapiens
QKHCHIGKG

SEQ ID NO: 605581 - protein, 9 aa, Homo Sapiens
EVPPMLPSH

SEQ ID NO: 605582 - protein, 9 aa, Homo Sapiens
CCIVVDKIV

SEQ ID NO: 605583 - protein, 9 aa, Homo Sapiens
PGSERERLI

SEQ ID NO: 605584 - protein, 9 aa, Homo Sapiens
DSQEKLAGA

SEQ ID NO: 605585 - protein, 9 aa, Homo Sapiens
WTCMPDQNH

SEQ ID NO: 605586 - protein, 9 aa, Homo Sapiens
DDYEEEEDS

SEQ ID NO: 605587 - protein, 9 aa, Homo Sapiens
GGGGRGGFG

SEQ ID NO: 605588 - protein, 9 aa, Homo Sapiens
GQCNESFWY

SEQ ID NO: 605589 - protein, 9 aa, Homo Sapiens
IQFDEREDT

SEQ ID NO: 605590 - protein, 9 aa, Homo Sapiens
GGWDYTIKV

SEQ ID NO: 605591 - protein, 9 aa, Homo Sapiens
RAPGGPGSA

SEQ ID NO: 605592 - protein, 9 aa, Homo Sapiens
EHGWDKHIV

SEQ ID NO: 605593 - protein, 9 aa, Homo Sapiens
VVEAEFAVH

SEQ ID NO: 605594 - protein, 9 aa, Homo Sapiens
ADPTCSDCK

SEQ ID NO: 605595 - protein, 9 aa, Homo Sapiens
MINEEHFSG

SEQ ID NO: 605596 - protein, 9 aa, Homo Sapiens
AQWGDSIPY

SEQ ID NO: 605597 - protein, 9 aa, Homo Sapiens
EFINVSLHE

SEQ ID NO: 605598 - protein, 9 aa, Homo Sapiens
TFQRLLQDI

SEQ ID NO: 605599 - protein, 9 aa, Homo Sapiens
IYQVKSVQV

SEQ ID NO: 605600 - protein, 9 aa, Homo Sapiens
RNLRRDAET

SEQ ID NO: 605601 - protein, 9 aa, Homo Sapiens
EVVRANYDM

SEQ ID NO: 605602 - protein, 9 aa, Homo Sapiens
VHLHLEELK

SEQ ID NO: 605603 - protein, 9 aa, Homo Sapiens
WIPRFMLLE

SEQ ID NO: 605604 - protein, 9 aa, Homo Sapiens
DYTISPYAI

SEQ ID NO: 605605 - protein, 9 aa, Homo Sapiens
LRRQKVEEN

SEQ ID NO: 605606 - protein, 9 aa, Homo Sapiens
MLNPIIYSQ

SEQ ID NO: 605607 - protein, 9 aa, Homo Sapiens
GSTRKLGST

SEQ ID NO: 605608 - protein, 9 aa, Homo Sapiens
KQYDIPNLY

SEQ ID NO: 605609 - protein, 9 aa, Homo Sapiens
NYDMLTLKL

SEQ ID NO: 605610 - protein, 9 aa, Homo Sapiens
ADGYDYTIS

SEQ ID NO: 605611 - protein, 9 aa, Homo Sapiens
IIKIDLHGN

SEQ ID NO: 605612 - protein, 9 aa, Homo Sapiens
VFMLEYFSP

SEQ ID NO: 605613 - protein, 9 aa, Homo Sapiens
VCVDTHMRI

SEQ ID NO: 605614 - protein, 9 aa, Homo Sapiens
HMRITCYGG

SEQ ID NO: 605615 - protein, 9 aa, Homo Sapiens
FQSMGSSSP

SEQ ID NO: 605616 - protein, 9 aa, Homo Sapiens
GFSRTVEAV

SEQ ID NO: 605617 - protein, 9 aa, Homo Sapiens
NPFVESSRE

SEQ ID NO: 605618 - protein, 9 aa, Homo Sapiens
DMLTLKLQD

SEQ ID NO: 605619 - protein, 9 aa, Homo Sapiens
ANDVIVRSS

SEQ ID NO: 605620 - protein, 9 aa, Homo Sapiens
PPCIVLERH

SEQ ID NO: 605621 - protein, 9 aa, Homo Sapiens
STVNSDLSN

SEQ ID NO: 605622 - protein, 9 aa, Homo Sapiens
AGHFGHVQS

SEQ ID NO: 605623 - protein, 9 aa, Homo Sapiens
FSLTPLECI

SEQ ID NO: 605624 - protein, 9 aa, Homo Sapiens
ERRQENRAH

SEQ ID NO: 605625 - protein, 9 aa, Homo Sapiens
GHFGHVQSQ

SEQ ID NO: 605626 - protein, 9 aa, Homo Sapiens
NEEHFSGMY

SEQ ID NO: 605627 - protein, 9 aa, Homo Sapiens
ICDYEMRSC

SEQ ID NO: 605628 - protein, 9 aa, Homo Sapiens
INPFVESSR

SEQ ID NO: 605629 - protein, 9 aa, Homo Sapiens
ENRAHGKVV

SEQ ID NO: 605630 - protein, 9 aa, Homo Sapiens
AMDSPLQPG

SEQ ID NO: 605631 - protein, 9 aa, Homo Sapiens
DFLQRPVWQ

SEQ ID NO: 605632 - protein, 9 aa, Homo Sapiens
WDKHIVALL

SEQ ID NO: 605633 - protein, 9 aa, Homo Sapiens
RTDFLLSTF

SEQ ID NO: 605634 - protein, 9 aa, Homo Sapiens
VFVSPMIGV

SEQ ID NO: 605635 - protein, 9 aa, Homo Sapiens
PAGHFGHVQ

SEQ ID NO: 605636 - protein, 9 aa, Homo Sapiens
QLQTLQDKA

SEQ ID NO: 605637 - protein, 9 aa, Homo Sapiens
ILLDRRTDF

SEQ ID NO: 605638 - protein, 9 aa, Homo Sapiens
AVSAQVLLL

SEQ ID NO: 605639 - protein, 9 aa, Homo Sapiens
LDGGKALAS

SEQ ID NO: 605640 - protein, 9 aa, Homo Sapiens
KELSCPRNW

SEQ ID NO: 605641 - protein, 9 aa, Homo Sapiens
PIIYSQKIA

SEQ ID NO: 605642 - protein, 9 aa, Homo Sapiens
STLLDVEVV

SEQ ID NO: 605643 - protein, 9 aa, Homo Sapiens
SIYQVKSVQ

SEQ ID NO: 605644 - protein, 9 aa, Homo Sapiens
FENASPTDP

SEQ ID NO: 605645 - protein, 9 aa, Homo Sapiens
VAITVFMLE

SEQ ID NO: 605646 - protein, 9 aa, Homo Sapiens
QKIACEKLV

SEQ ID NO: 605647 - protein, 9 aa, Homo Sapiens
LNWEAVSDL

SEQ ID NO: 605648 - protein, 9 aa, Homo Sapiens
AGISDGYPL

SEQ ID NO: 605649 - protein, 9 aa, Homo Sapiens
ECQRYPGHL

SEQ ID NO: 605650 - protein, 9 aa, Homo Sapiens
DCRYALCDA

SEQ ID NO: 605651 - protein, 9 aa, Homo Sapiens
FIGILLLQV

SEQ ID NO: 605652 - protein, 9 aa, Homo Sapiens
ELDRHFRED

SEQ ID NO: 605653 - protein, 9 aa, Homo Sapiens
IGGSPSTLL

SEQ ID NO: 605654 - protein, 9 aa, Homo Sapiens
FMLEYFSPV

SEQ ID NO: 605655 - protein, 9 aa, Homo Sapiens
DCKELSCPR

SEQ ID NO: 605656 - protein, 9 aa, Homo Sapiens
REDSQEKLA

SEQ ID NO: 605657 - protein, 9 aa, Homo Sapiens
QSVLSIPLY

SEQ ID NO: 605658 - protein, 9 aa, Homo Sapiens
GEARARQLS

SEQ ID NO: 605659 - protein, 9 aa, Homo Sapiens
DRDECLKKE

SEQ ID NO: 605660 - protein, 9 aa, Homo Sapiens
TRKLGSTGN

SEQ ID NO: 605661 - protein, 9 aa, Homo Sapiens
ILICEQWVI

SEQ ID NO: 605662 - protein, 9 aa, Homo Sapiens
SLVAVHPFT

SEQ ID NO: 605663 - protein, 9 aa, Homo Sapiens
CKELSCPRN

SEQ ID NO: 605664 - protein, 9 aa, Homo Sapiens
EEVPPMLPS

SEQ ID NO: 605665 - protein, 9 aa, Homo Sapiens
EALYNIRKY

SEQ ID NO: 605666 - protein, 9 aa, Homo Sapiens
NNGLGTQRS

SEQ ID NO: 605667 - protein, 9 aa, Homo Sapiens
IRKYEVFLQ

SEQ ID NO: 605668 - protein, 9 aa, Homo Sapiens
VSDNYLLAM

SEQ ID NO: 605669 - protein, 9 aa, Homo Sapiens
KALASHHTA

SEQ ID NO: 605670 - protein, 9 aa, Homo Sapiens
QRPVWQPQA

SEQ ID NO: 605671 - protein, 9 aa, Homo Sapiens
NLQLMKGCK

SEQ ID NO: 605672 - protein, 9 aa, Homo Sapiens
DEYPDINFV

SEQ ID NO: 605673 - protein, 9 aa, Homo Sapiens
FVSPMIGVV

SEQ ID NO: 605674 - protein, 9 aa, Homo Sapiens
KKRPQNWPE

SEQ ID NO: 605675 - protein, 9 aa, Homo Sapiens
STFDDQIWV

SEQ ID NO: 605676 - protein, 9 aa, Homo Sapiens
LKLLSEKVF

SEQ ID NO: 605677 - protein, 9 aa, Homo Sapiens
LICEQWVIV

SEQ ID NO: 605678 - protein, 9 aa, Homo Sapiens
RIQRTFAAC

SEQ ID NO: 605679 - protein, 9 aa, Homo Sapiens
EEPDRDECL

SEQ ID NO: 605680 - protein, 9 aa, Homo Sapiens
EYPDINFVG

SEQ ID NO: 605681 - protein, 9 aa, Homo Sapiens
YNERQKHCH

SEQ ID NO: 605682 - protein, 9 aa, Homo Sapiens
LQVLAQKHC

SEQ ID NO: 605683 - protein, 9 aa, Homo Sapiens
FRPPPPCIV

SEQ ID NO: 605684 - protein, 9 aa, Homo Sapiens
VQVLFYTFF

SEQ ID NO: 605685 - protein, 9 aa, Homo Sapiens
NFWVTILPA

SEQ ID NO: 605686 - protein, 9 aa, Homo Sapiens
LLFILYGLS

SEQ ID NO: 605687 - protein, 9 aa, Homo Sapiens
FSAPCASLA

SEQ ID NO: 605688 - protein, 9 aa, Homo Sapiens
SDLSNYFRV

SEQ ID NO: 605689 - protein, 9 aa, Homo Sapiens
CTPDNVEVL

SEQ ID NO: 605690 - protein, 9 aa, Homo Sapiens
PLHGCEHFY

SEQ ID NO: 605691 - protein, 9 aa, Homo Sapiens
LLDRRTDFL

SEQ ID NO: 605692 - protein, 9 aa, Homo Sapiens
KIQGDFAGR

SEQ ID NO: 605693 - protein, 9 aa, Homo Sapiens
CEANNGLGT

SEQ ID NO: 605694 - protein, 9 aa, Homo Sapiens
DYEMRSCKP

SEQ ID NO: 605695 - protein, 9 aa, Homo Sapiens
SMEDVHLKE

SEQ ID NO: 605696 - protein, 9 aa, Homo Sapiens
LTEAPKYEP

SEQ ID NO: 605697 - protein, 9 aa, Homo Sapiens
LDRRTDFLL

SEQ ID NO: 605698 - protein, 9 aa, Homo Sapiens
ALPEPLKHE

SEQ ID NO: 605699 - protein, 9 aa, Homo Sapiens
ISDGYPLEE

SEQ ID NO: 605700 - protein, 9 aa, Homo Sapiens
NERQKHCHI

SEQ ID NO: 605701 - protein, 9 aa, Homo Sapiens
KENIAQERK

SEQ ID NO: 605702 - protein, 9 aa, Homo Sapiens
SKENIAQER

SEQ ID NO: 605703 - protein, 9 aa, Homo Sapiens
IPVINTMLQ

SEQ ID NO: 605704 - protein, 9 aa, Homo Sapiens
LNPIIYSQK

SEQ ID NO: 605705 - protein, 9 aa, Homo Sapiens
ASHHTASPW

SEQ ID NO: 605706 - protein, 9 aa, Homo Sapiens
GGLLACSQC

SEQ ID NO: 605707 - protein, 9 aa, Homo Sapiens
ELRSVRSGL

SEQ ID NO: 605708 - protein, 9 aa, Homo Sapiens
DVHLKEPKQ

SEQ ID NO: 605709 - protein, 9 aa, Homo Sapiens
SCKDLGNVM

SEQ ID NO: 605710 - protein, 9 aa, Homo Sapiens
RQGAICDYE

SEQ ID NO: 605711 - protein, 9 aa, Homo Sapiens
YMARLYKKR

SEQ ID NO: 605712 - protein, 9 aa, Homo Sapiens
HILASGSVW

SEQ ID NO: 605713 - protein, 9 aa, Homo Sapiens
KLQRLYLSH

SEQ ID NO: 605714 - protein, 9 aa, Homo Sapiens
RDAETGKPV

SEQ ID NO: 605715 - protein, 9 aa, Homo Sapiens
AVHLHLEEL

SEQ ID NO: 605716 - protein, 9 aa, Homo Sapiens
ARARQLSPQ

SEQ ID NO: 605717 - protein, 9 aa, Homo Sapiens
GKDLNQFTI

SEQ ID NO: 605718 - protein, 9 aa, Homo Sapiens
VCVHQLPPG

SEQ ID NO: 605719 - protein, 9 aa, Homo Sapiens
RYPGHLCGH

SEQ ID NO: 605720 - protein, 9 aa, Homo Sapiens
MKGCKSMNV

SEQ ID NO: 605721 - protein, 9 aa, Homo Sapiens
TLLDVEVVE

SEQ ID NO: 605722 - protein, 9 aa, Homo Sapiens
NTEHISDSI

SEQ ID NO: 605723 - protein, 9 aa, Homo Sapiens
PLELRLTSN

SEQ ID NO: 605724 - protein, 9 aa, Homo Sapiens
KIWRKSFQS

SEQ ID NO: 605725 - protein, 9 aa, Homo Sapiens
HFGHVQSQF

SEQ ID NO: 605726 - protein, 9 aa, Homo Sapiens
LYKKRPQNW

SEQ ID NO: 605727 - protein, 9 aa, Homo Sapiens
SGHEPAHSG

SEQ ID NO: 605728 - protein, 9 aa, Homo Sapiens
SMGSSSPEP

SEQ ID NO: 605729 - protein, 9 aa, Homo Sapiens
FAVHLHLEE

SEQ ID NO: 605730 - protein, 9 aa, Homo Sapiens
QVKSVQVLF

SEQ ID NO: 605731 - protein, 9 aa, Homo Sapiens
VEAEFAVHL

SEQ ID NO: 605732 - protein, 9 aa, Homo Sapiens
CNGEYDWAD

SEQ ID NO: 605733 - protein, 9 aa, Homo Sapiens
RKYEVFLQI

SEQ ID NO: 605734 - protein, 9 aa, Homo Sapiens
LSIPLYLMP

SEQ ID NO: 605735 - protein, 9 aa, Homo Sapiens
HGCEHFYLL

SEQ ID NO: 605736 - protein, 9 aa, Homo Sapiens
THMRITCYG

SEQ ID NO: 605737 - protein, 9 aa, Homo Sapiens
DELRSVRSG

SEQ ID NO: 605738 - protein, 9 aa, Homo Sapiens
KLLLCNSPC

SEQ ID NO: 605739 - protein, 9 aa, Homo Sapiens
CKDLGNVMR

SEQ ID NO: 605740 - protein, 9 aa, Homo Sapiens
PMGDEEALE

SEQ ID NO: 605741 - protein, 9 aa, Homo Sapiens
ALASHHTAS

SEQ ID NO: 605742 - protein, 9 aa, Homo Sapiens
AVILLKHGA

SEQ ID NO: 605743 - protein, 9 aa, Homo Sapiens
ADASHAGVS

SEQ ID NO: 605744 - protein, 9 aa, Homo Sapiens
SVLSIPLYL

SEQ ID NO: 605745 - protein, 9 aa, Homo Sapiens
EYDWADGSD

SEQ ID NO: 605746 - protein, 9 aa, Homo Sapiens
KVFDFSSGQ

SEQ ID NO: 605747 - protein, 9 aa, Homo Sapiens
AVHPFTVNP

SEQ ID NO: 605748 - protein, 9 aa, Homo Sapiens
HFSGMYIDF

SEQ ID NO: 605749 - protein, 9 aa, Homo Sapiens
YLMVTADHG

SEQ ID NO: 605750 - protein, 9 aa, Homo Sapiens
QFPELDRHF

SEQ ID NO: 605751 - protein, 9 aa, Homo Sapiens
MVWLPYSSV

SEQ ID NO: 605752 - protein, 9 aa, Homo Sapiens
AKQTQVCQS

SEQ ID NO: 605753 - protein, 9 aa, Homo Sapiens
GSPSTLLDV

SEQ ID NO: 605754 - protein, 9 aa, Homo Sapiens
LSSKENIAQ

SEQ ID NO: 605755 - protein, 9 aa, Homo Sapiens
DQIWVYSFI

SEQ ID NO: 605756 - protein, 9 aa, Homo Sapiens
LLAGSGGVR

SEQ ID NO: 605757 - protein, 9 aa, Homo Sapiens
DNVEVLETR

SEQ ID NO: 605758 - protein, 9 aa, Homo Sapiens
RQENRAHGK

SEQ ID NO: 605759 - protein, 9 aa, Homo Sapiens
EELMNLSPE

SEQ ID NO: 605760 - protein, 9 aa, Homo Sapiens
GQIQFDERE

SEQ ID NO: 605761 - protein, 9 aa, Homo Sapiens
MPDQNHIIQ

SEQ ID NO: 605762 - protein, 9 aa, Homo Sapiens
AHHYLLTHL

SEQ ID NO: 605763 - protein, 9 aa, Homo Sapiens
EAVLKEAAR

SEQ ID NO: 605764 - protein, 9 aa, Homo Sapiens
YDYTISPYA

SEQ ID NO: 605765 - protein, 9 aa, Homo Sapiens
VVAITVFML

SEQ ID NO: 605766 - protein, 9 aa, Homo Sapiens
EQLQTLQDK

SEQ ID NO: 605767 - protein, 9 aa, Homo Sapiens
LLLAGSGGV

SEQ ID NO: 605768 - protein, 9 aa, Homo Sapiens
CHKNFTPTL

SEQ ID NO: 605769 - protein, 9 aa, Homo Sapiens
GVGSMPSSS

SEQ ID NO: 605770 - protein, 9 aa, Homo Sapiens
KEPLEQKLL

SEQ ID NO: 605771 - protein, 9 aa, Homo Sapiens
MEDVHLKEP

SEQ ID NO: 605772 - protein, 9 aa, Homo Sapiens
IVALLQVLA

SEQ ID NO: 605773 - protein, 9 aa, Homo Sapiens
CDATYETKE

SEQ ID NO: 605774 - protein, 9 aa, Homo Sapiens
SIVIFLLFI

SEQ ID NO: 605775 - protein, 9 aa, Homo Sapiens
LECISNIGQ

SEQ ID NO: 605776 - protein, 9 aa, Homo Sapiens
HRIPLELRL

SEQ ID NO: 605777 - protein, 9 aa, Homo Sapiens
VILLKHGAN

SEQ ID NO: 605778 - protein, 9 aa, Homo Sapiens
RHFREDSQE

SEQ ID NO: 605779 - protein, 9 aa, Homo Sapiens
IWVYSFIGI

SEQ ID NO: 605780 - protein, 9 aa, Homo Sapiens
NESFWYKAH

SEQ ID NO: 605781 - protein, 9 aa, Homo Sapiens
MTLNWEAVS

SEQ ID NO: 605782 - protein, 9 aa, Homo Sapiens
GAGADFAVN

SEQ ID NO: 605783 - protein, 9 aa, Homo Sapiens
NPDQPLSAK

SEQ ID NO: 605784 - protein, 9 aa, Homo Sapiens
YGRINTFQR

SEQ ID NO: 605785 - protein, 9 aa, Homo Sapiens
QDIFEDERK

SEQ ID NO: 605786 - protein, 9 aa, Homo Sapiens
LLISDELRS

SEQ ID NO: 605787 - protein, 9 aa, Homo Sapiens
GKASSAKQT

SEQ ID NO: 605788 - protein, 9 aa, Homo Sapiens
RRDAETGKP

SEQ ID NO: 605789 - protein, 9 aa, Homo Sapiens
FAVNPDQPL

SEQ ID NO: 605790 - protein, 9 aa, Homo Sapiens
AKVSDFISA

SEQ ID NO: 605791 - protein, 9 aa, Homo Sapiens
SQSVLSIPL

SEQ ID NO: 605792 - protein, 9 aa, Homo Sapiens
LEYMARLYK

SEQ ID NO: 605793 - protein, 9 aa, Homo Sapiens
PPFDGEVEE

SEQ ID NO: 605794 - protein, 9 aa, Homo Sapiens
LCDATYETK

SEQ ID NO: 605795 - protein, 9 aa, Homo Sapiens
CCCIVVDKI

SEQ ID NO: 605796 - protein, 9 aa, Homo Sapiens
FTPTLRAST

SEQ ID NO: 605797 - protein, 9 aa, Homo Sapiens
GPMGDEEAL

SEQ ID NO: 605798 - protein, 9 aa, Homo Sapiens
EVEEELFQA

SEQ ID NO: 605799 - protein, 9 aa, Homo Sapiens
TGETPNECK

SEQ ID NO: 605800 - protein, 9 aa, Homo Sapiens
LLEEVPPML

SEQ ID NO: 605801 - protein, 9 aa, Homo Sapiens
LLDVEVVEA

SEQ ID NO: 605802 - protein, 9 aa, Homo Sapiens
MGDEEALES

SEQ ID NO: 605803 - protein, 9 aa, Homo Sapiens
YDMLTLKLQ

SEQ ID NO: 605804 - protein, 9 aa, Homo Sapiens
DLNQFTISR

SEQ ID NO: 605805 - protein, 9 aa, Homo Sapiens
LHLEELKAN

SEQ ID NO: 605806 - protein, 9 aa, Homo Sapiens
HGWDKHIVA

SEQ ID NO: 605807 - protein, 9 aa, Homo Sapiens
YFRVATSQV

SEQ ID NO: 605808 - protein, 9 aa, Homo Sapiens
YSGFILSPN

SEQ ID NO: 605809 - protein, 9 aa, Homo Sapiens
PGGPGSAVC

SEQ ID NO: 605810 - protein, 9 aa, Homo Sapiens
ILLLQVLST

SEQ ID NO: 605811 - protein, 9 aa, Homo Sapiens
LNFWVTILP

SEQ ID NO: 605812 - protein, 9 aa, Homo Sapiens
ANNGLGTQR

SEQ ID NO: 605813 - protein, 9 aa, Homo Sapiens
HTFSAPCAS

SEQ ID NO: 605814 - protein, 9 aa, Homo Sapiens
AFLTTKKLQ

SEQ ID NO: 605815 - protein, 9 aa, Homo Sapiens
SSKENIAQE

SEQ ID NO: 605816 - protein, 9 aa, Homo Sapiens
DINFVGLLI

SEQ ID NO: 605817 - protein, 9 aa, Homo Sapiens
VPPMLPSHF

SEQ ID NO: 605818 - protein, 9 aa, Homo Sapiens
IPLELRLTS

SEQ ID NO: 605819 - protein, 9 aa, Homo Sapiens
QLTSIIKID

SEQ ID NO: 605820 - protein, 9 aa, Homo Sapiens
KLGSTGNIC

SEQ ID NO: 605821 - protein, 9 aa, Homo Sapiens
LEMNPCTPD

SEQ ID NO: 605822 - protein, 9 aa, Homo Sapiens
SCGEARARQ

SEQ ID NO: 605823 - protein, 9 aa, Homo Sapiens
PCASLASEL

SEQ ID NO: 605824 - protein, 9 aa, Homo Sapiens
LSTVNSDLS

SEQ ID NO: 605825 - protein, 9 aa, Homo Sapiens
GYDYTISPY

SEQ ID NO: 605826 - protein, 9 aa, Homo Sapiens
IKIDLHGNP

SEQ ID NO: 605827 - protein, 9 aa, Homo Sapiens
YSQKIACEK

SEQ ID NO: 605828 - protein, 9 aa, Homo Sapiens
EVFVSPMIG

SEQ ID NO: 605829 - protein, 9 aa, Homo Sapiens
SPSTLLDVE

SEQ ID NO: 605830 - protein, 9 aa, Homo Sapiens
DKHIVALLQ

SEQ ID NO: 605831 - protein, 9 aa, Homo Sapiens
VILKLLSEK

SEQ ID NO: 605832 - protein, 9 aa, Homo Sapiens
RVATSQVPA

SEQ ID NO: 605833 - protein, 9 aa, Homo Sapiens
MFEREFALR

SEQ ID NO: 605834 - protein, 9 aa, Homo Sapiens
YAGQIQFDE

SEQ ID NO: 605835 - protein, 9 aa, Homo Sapiens
EVVEAEFAV

SEQ ID NO: 605836 - protein, 9 aa, Homo Sapiens
LQLMKGCKS

SEQ ID NO: 605837 - protein, 9 aa, Homo Sapiens
KAHHYLLTH

SEQ ID NO: 605838 - protein, 9 aa, Homo Sapiens
PTCSDCKEL

SEQ ID NO: 605839 - protein, 9 aa, Homo Sapiens
NYLLAMVIA

SEQ ID NO: 605840 - protein, 9 aa, Homo Sapiens
LVLQTIWVY

SEQ ID NO: 605841 - protein, 9 aa, Homo Sapiens
SPLQPGSAT

SEQ ID NO: 605842 - protein, 9 aa, Homo Sapiens
KESLKAGIL

SEQ ID NO: 605843 - protein, 9 aa, Homo Sapiens
PGHLCGHKC

SEQ ID NO: 605844 - protein, 9 aa, Homo Sapiens
CGGNLTGYS

SEQ ID NO: 605845 - protein, 9 aa, Homo Sapiens
RANYDMLTL

SEQ ID NO: 605846 - protein, 9 aa, Homo Sapiens
SHAGVSANM

SEQ ID NO: 605847 - protein, 9 aa, Homo Sapiens
NKRRRLEEV

SEQ ID NO: 605848 - protein, 9 aa, Homo Sapiens
CAVILLKHG

SEQ ID NO: 605849 - protein, 9 aa, Homo Sapiens
RKSFQSMGS

SEQ ID NO: 605850 - protein, 9 aa, Homo Sapiens
VDTHMRITC

SEQ ID NO: 605851 - protein, 9 aa, Homo Sapiens
SHSAVSAQV

SEQ ID NO: 605852 - protein, 9 aa, Homo Sapiens
DEFINVSLH

SEQ ID NO: 605853 - protein, 9 aa, Homo Sapiens
FSFQLDSLT

SEQ ID NO: 605854 - protein, 9 aa, Homo Sapiens
FFFILNFWV

SEQ ID NO: 605855 - protein, 9 aa, Homo Sapiens
RCAILMFER

SEQ ID NO: 605856 - protein, 9 aa, Homo Sapiens
WEAVSDLDL

SEQ ID NO: 605857 - protein, 9 aa, Homo Sapiens
PPEPPLSCP

SEQ ID NO: 605858 - protein, 9 aa, Homo Sapiens
LPYSSVDQL

SEQ ID NO: 605859 - protein, 9 aa, Homo Sapiens
QGAEGGLLA

SEQ ID NO: 605860 - protein, 9 aa, Homo Sapiens
QTQVCQSPK

SEQ ID NO: 605861 - protein, 9 aa, Homo Sapiens
YKKRPQNWP

SEQ ID NO: 605862 - protein, 9 aa, Homo Sapiens
HLHLEELKA

SEQ ID NO: 605863 - protein, 9 aa, Homo Sapiens
SFQLDSLTE

SEQ ID NO: 605864 - protein, 9 aa, Homo Sapiens
QSQFPELDR

SEQ ID NO: 605865 - protein, 9 aa, Homo Sapiens
VSIPLHGCE

SEQ ID NO: 605866 - protein, 9 aa, Homo Sapiens
EPDRDECLK

SEQ ID NO: 605867 - protein, 9 aa, Homo Sapiens
TRSSHLRER

SEQ ID NO: 605868 - protein, 9 aa, Homo Sapiens
ITVFMLEYF

SEQ ID NO: 605869 - protein, 9 aa, Homo Sapiens
SPEPEISQS

SEQ ID NO: 605870 - protein, 9 aa, Homo Sapiens
KRTLSEPPS

SEQ ID NO: 605871 - protein, 9 aa, Homo Sapiens
ILNFWVTIL

SEQ ID NO: 605872 - protein, 9 aa, Homo Sapiens
GSGGVRAPG

SEQ ID NO: 605873 - protein, 9 aa, Homo Sapiens
VLSQSVLSI

SEQ ID NO: 605874 - protein, 9 aa, Homo Sapiens
AICDYEMRS

SEQ ID NO: 605875 - protein, 9 aa, Homo Sapiens
LMKGCKSMN

SEQ ID NO: 605876 - protein, 9 aa, Homo Sapiens
YSFIGILLL

SEQ ID NO: 605877 - protein, 9 aa, Homo Sapiens
FEREFALRL

SEQ ID NO: 605878 - protein, 9 aa, Homo Sapiens
QRSRADASH

SEQ ID NO: 605879 - protein, 9 aa, Homo Sapiens
DDQIWVYSF

SEQ ID NO: 605880 - protein, 9 aa, Homo Sapiens
MRITCYGGI

SEQ ID NO: 605881 - protein, 9 aa, Homo Sapiens
HKNFTPTLR

SEQ ID NO: 605882 - protein, 9 aa, Homo Sapiens
IWVYKELRK

SEQ ID NO: 605883 - protein, 9 aa, Homo Sapiens
LEELKANDV

SEQ ID NO: 605884 - protein, 9 aa, Homo Sapiens
PDMEEFRTI

SEQ ID NO: 605885 - protein, 9 aa, Homo Sapiens
CRYALCDAT

SEQ ID NO: 605886 - protein, 9 aa, Homo Sapiens
SGSVWIPRF

SEQ ID NO: 605887 - protein, 9 aa, Homo Sapiens
GGSPSTLLD

SEQ ID NO: 605888 - protein, 9 aa, Homo Sapiens
ELKANDVIV

SEQ ID NO: 605889 - protein, 9 aa, Homo Sapiens
VEAVLKEAA

SEQ ID NO: 605890 - protein, 9 aa, Homo Sapiens
SPLDFGEVF

SEQ ID NO: 605891 - protein, 9 aa, Homo Sapiens
NECKECGKA

SEQ ID NO: 605892 - protein, 9 aa, Homo Sapiens
SSYNERQKH

SEQ ID NO: 605893 - protein, 9 aa, Homo Sapiens
SFLLLEEVP

SEQ ID NO: 605894 - protein, 9 aa, Homo Sapiens
DLRVSDNYL

SEQ ID NO: 605895 - protein, 9 aa, Homo Sapiens
PCHKNFTPT

SEQ ID NO: 605896 - protein, 9 aa, Homo Sapiens
PFTVNPLGK

SEQ ID NO: 605897 - protein, 9 aa, Homo Sapiens
CDYEMRSCK

SEQ ID NO: 605898 - protein, 9 aa, Homo Sapiens
ALLQVLAQK

SEQ ID NO: 605899 - protein, 9 aa, Homo Sapiens
RSCGEARAR

SEQ ID NO: 605900 - protein, 9 aa, Homo Sapiens
PLECISNIG

SEQ ID NO: 605901 - protein, 9 aa, Homo Sapiens
KIDLHGNPW

SEQ ID NO: 605902 - protein, 9 aa, Homo Sapiens
TPERRQENR

SEQ ID NO: 605903 - protein, 9 aa, Homo Sapiens
FAGRAEILG

SEQ ID NO: 605904 - protein, 9 aa, Homo Sapiens
PEPLKHESP

SEQ ID NO: 605905 - protein, 9 aa, Homo Sapiens
PLDFGEVFV

SEQ ID NO: 605906 - protein, 9 aa, Homo Sapiens
CPASQHKGG

SEQ ID NO: 605907 - protein, 9 aa, Homo Sapiens
ANYDMLTLK

SEQ ID NO: 605908 - protein, 9 aa, Homo Sapiens
ERLWSKAHH

SEQ ID NO: 605909 - protein, 9 aa, Homo Sapiens
LASHHTASP

SEQ ID NO: 605910 - protein, 9 aa, Homo Sapiens
RQKHCHIGK

SEQ ID NO: 605911 - protein, 9 aa, Homo Sapiens
DMEEFRTIW

SEQ ID NO: 605912 - protein, 9 aa, Homo Sapiens
KKLQRLYLS

SEQ ID NO: 605913 - protein, 9 aa, Homo Sapiens
YVEYAGQIQ

SEQ ID NO: 605914 - protein, 9 aa, Homo Sapiens
FILNFWVTI

SEQ ID NO: 605915 - protein, 9 aa, Homo Sapiens
KYEVFLQII

SEQ ID NO: 605916 - protein, 9 aa, Homo Sapiens
EPVSIPLHG

SEQ ID NO: 605917 - protein, 9 aa, Homo Sapiens
EAEFAVHLH

SEQ ID NO: 605918 - protein, 9 aa, Homo Sapiens
ISGGWDYTI

SEQ ID NO: 605919 - protein, 9 aa, Homo Sapiens
RADASHAGV

SEQ ID NO: 605920 - protein, 9 aa, Homo Sapiens
VLSIPLYLM

SEQ ID NO: 605921 - protein, 9 aa, Homo Sapiens
EREFALRLV

SEQ ID NO: 605922 - protein, 9 aa, Homo Sapiens
VWIPRFMLL

SEQ ID NO: 605923 - protein, 9 aa, Homo Sapiens
RDECLKKEK

SEQ ID NO: 605924 - protein, 9 aa, Homo Sapiens
NVFYHTEGS

SEQ ID NO: 605925 - protein, 9 aa, Homo Sapiens
FPVTTNTLP

SEQ ID NO: 605926 - protein, 9 aa, Homo Sapiens
SYNERQKHC

SEQ ID NO: 605927 - protein, 9 aa, Homo Sapiens
PYQCGQCNE

SEQ ID NO: 605928 - protein, 9 aa, Homo Sapiens
LELRLTSNV

SEQ ID NO: 605929 - protein, 9 aa, Homo Sapiens
LYNIRKYEV

SEQ ID NO: 605930 - protein, 9 aa, Homo Sapiens
KHCAGVNIG

SEQ ID NO: 605931 - protein, 9 aa, Homo Sapiens
ETPNECKEC

SEQ ID NO: 605932 - protein, 9 aa, Homo Sapiens
ILLKHGANP

SEQ ID NO: 605933 - protein, 9 aa, Homo Sapiens
LLSEKVFDF

SEQ ID NO: 605934 - protein, 9 aa, Homo Sapiens
PQDEYPDIN

SEQ ID NO: 605935 - protein, 9 aa, Homo Sapiens
QVPAGHFGH

SEQ ID NO: 605936 - protein, 9 aa, Homo Sapiens
AEGGLLACS

SEQ ID NO: 605937 - protein, 9 aa, Homo Sapiens
EEPPQEALP

SEQ ID NO: 605938 - protein, 9 aa, Homo Sapiens
GWDYTIKVW

SEQ ID NO: 605939 - protein, 9 aa, Homo Sapiens
SEPPSPLPH

SEQ ID NO: 605940 - protein, 9 aa, Homo Sapiens
HIVALLQVL

SEQ ID NO: 605941 - protein, 9 aa, Homo Sapiens
KLAGATMLE

SEQ ID NO: 605942 - protein, 9 aa, Homo Sapiens
EDVHLKEPK

SEQ ID NO: 605943 - protein, 9 aa, Homo Sapiens
ENIAQERKK

SEQ ID NO: 605944 - protein, 9 aa, Homo Sapiens
TDFLLSTFD

SEQ ID NO: 605945 - protein, 9 aa, Homo Sapiens
SAVSAQVLL

SEQ ID NO: 605946 - protein, 9 aa, Homo Sapiens
FRCAILMFE

SEQ ID NO: 605947 - protein, 9 aa, Homo Sapiens
NLRRDAETG

SEQ ID NO: 605948 - protein, 9 aa, Homo Sapiens
GHDNLQLMK

SEQ ID NO: 605949 - protein, 9 aa, Homo Sapiens
VLKEAARKR

SEQ ID NO: 605950 - protein, 9 aa, Homo Sapiens
ESSREYPAG

SEQ ID NO: 605951 - protein, 9 aa, Homo Sapiens
SDNYLLAMV

SEQ ID NO: 605952 - protein, 9 aa, Homo Sapiens
TGPKCGCHQ

SEQ ID NO: 605953 - protein, 9 aa, Homo Sapiens
PQEALPEPL

SEQ ID NO: 605954 - protein, 9 aa, Homo Sapiens
MLEYFSPVS

SEQ ID NO: 605955 - protein, 9 aa, Homo Sapiens
FILYGLSSV

SEQ ID NO: 605956 - protein, 9 aa, Homo Sapiens
VATSQVPAG

SEQ ID NO: 605957 - protein, 9 aa, Homo Sapiens
VAVHPFTVN

SEQ ID NO: 605958 - protein, 9 aa, Homo Sapiens
IFLLFILYG

SEQ ID NO: 605959 - protein, 9 aa, Homo Sapiens
PEPPLSCPA

SEQ ID NO: 605960 - protein, 9 aa, Homo Sapiens
KHGANPNLK

SEQ ID NO: 605961 - protein, 9 aa, Homo Sapiens
VEVVEAEFA

SEQ ID NO: 605962 - protein, 9 aa, Homo Sapiens
MEEFRTIWV

SEQ ID NO: 605963 - protein, 9 aa, Homo Sapiens
NFLLISDEL

SEQ ID NO: 605964 - protein, 9 aa, Homo Sapiens
NTFQRLLQD

SEQ ID NO: 605965 - protein, 9 aa, Homo Sapiens
EELKANDVI

SEQ ID NO: 605966 - protein, 9 aa, Homo Sapiens
GHLCGHKCE

SEQ ID NO: 605967 - protein, 9 aa, Homo Sapiens
LKANDVIVR

SEQ ID NO: 605968 - protein, 9 aa, Homo Sapiens
VTVQPGCYL

SEQ ID NO: 605969 - protein, 9 aa, Homo Sapiens
TQDIFEDER

SEQ ID NO: 605970 - protein, 9 aa, Homo Sapiens
IPYLLISGG

SEQ ID NO: 605971 - protein, 9 aa, Homo Sapiens
AGQIQFDER

SEQ ID NO: 605972 - protein, 9 aa, Homo Sapiens
SPTDPNNNQ

SEQ ID NO: 605973 - protein, 9 aa, Homo Sapiens
YSSVDQLLQ

SEQ ID NO: 605974 - protein, 9 aa, Homo Sapiens
WADGSDEMD

SEQ ID NO: 605975 - protein, 9 aa, Homo Sapiens
VSLHEADND

SEQ ID NO: 605976 - protein, 9 aa, Homo Sapiens
VSLTQDIFE

SEQ ID NO: 605977 - protein, 9 aa, Homo Sapiens
VRANYDMLT

SEQ ID NO: 605978 - protein, 9 aa, Homo Sapiens
YPLEEIVYQ

SEQ ID NO: 605979 - protein, 9 aa, Homo Sapiens
TLSEPPSPL

SEQ ID NO: 605980 - protein, 9 aa, Homo Sapiens
PAMDSPLQP

SEQ ID NO: 605981 - protein, 9 aa, Homo Sapiens
RRQKVEENK

SEQ ID NO: 605982 - protein, 9 aa, Homo Sapiens
VLPHPAMDS

SEQ ID NO: 605983 - protein, 9 aa, Homo Sapiens
LQLNTEHIS

SEQ ID NO: 605984 - protein, 9 aa, Homo Sapiens
LRKDGKDLN

SEQ ID NO: 605985 - protein, 9 aa, Homo Sapiens
RRQENRAHG

SEQ ID NO: 605986 - protein, 9 aa, Homo Sapiens
SLTPLECIS

SEQ ID NO: 605987 - protein, 9 aa, Homo Sapiens
VGSTRKLGS

SEQ ID NO: 605988 - protein, 9 aa, Homo Sapiens
LLISGGWDY

SEQ ID NO: 605989 - protein, 9 aa, Homo Sapiens
HEPAHSGFI

SEQ ID NO: 605990 - protein, 9 aa, Homo Sapiens
GSAVCVHQL

SEQ ID NO: 605991 - protein, 9 aa, Homo Sapiens
AVSLTQDIF

SEQ ID NO: 605992 - protein, 9 aa, Homo Sapiens
INTFQRLLQ

SEQ ID NO: 605993 - protein, 9 aa, Homo Sapiens
DFAGRAEIL

SEQ ID NO: 605994 - protein, 9 aa, Homo Sapiens
RRTDFLLST

SEQ ID NO: 605995 - protein, 9 aa, Homo Sapiens
KSFQSMGSS

SEQ ID NO: 605996 - protein, 9 aa, Homo Sapiens
MARLYKKRP

SEQ ID NO: 605997 - protein, 9 aa, Homo Sapiens
LQTIWVYKE

SEQ ID NO: 605998 - protein, 9 aa, Homo Sapiens
LQDKAGKKC

SEQ ID NO: 605999 - protein, 9 aa, Homo Sapiens
PNLYGYSMA

SEQ ID NO: 606000 - protein, 9 aa, Homo Sapiens
PFVESSREY

SEQ ID NO: 606001 - protein, 9 aa, Homo Sapiens
HTEGSRQAL

SEQ ID NO: 606002 - protein, 9 aa, Homo Sapiens
KVEENKRRR

SEQ ID NO: 606003 - protein, 9 aa, Homo Sapiens
TVQPGCYLP

SEQ ID NO: 606004 - protein, 9 aa, Homo Sapiens
QPPGAPPGV

SEQ ID NO: 606005 - protein, 9 aa, Homo Sapiens
AHSGFIGKG

SEQ ID NO: 606006 - protein, 9 aa, Homo Sapiens
WGPMGDEEA

SEQ ID NO: 606007 - protein, 9 aa, Homo Sapiens
CGHDNLQLM

SEQ ID NO: 606008 - protein, 9 aa, Homo Sapiens
DNLQLMKGC

SEQ ID NO: 606009 - protein, 9 aa, Homo Sapiens
TCMPDQNHI

SEQ ID NO: 606010 - protein, 9 aa, Homo Sapiens
DGEVEEELF

SEQ ID NO: 606011 - protein, 9 aa, Homo Sapiens
IFEDERKVL

SEQ ID NO: 606012 - protein, 9 aa, Homo Sapiens
FINVSLHEA

SEQ ID NO: 606013 - protein, 9 aa, Homo Sapiens
GNEIMTLNW

SEQ ID NO: 606014 - protein, 9 aa, Homo Sapiens
YEMRSCKPL

SEQ ID NO: 606015 - protein, 9 aa, Homo Sapiens
NVMRTMGYM

SEQ ID NO: 606016 - protein, 9 aa, Homo Sapiens
CVHQLPPGQ

SEQ ID NO: 606017 - protein, 9 aa, Homo Sapiens
HAVSLTQDI

SEQ ID NO: 606018 - protein, 9 aa, Homo Sapiens
GNVMRTMGY

SEQ ID NO: 606019 - protein, 9 aa, Homo Sapiens
YPDINFVGL

SEQ ID NO: 606020 - protein, 9 aa, Homo Sapiens
IFPCHKNFT

SEQ ID NO: 606021 - protein, 9 aa, Homo Sapiens
SLHEADNDP

SEQ ID NO: 606022 - protein, 9 aa, Homo Sapiens
EQKLLLCNS

SEQ ID NO: 606023 - protein, 9 aa, Homo Sapiens
PVSIPLHGC

SEQ ID NO: 606024 - protein, 9 aa, Homo Sapiens
FYHTEGSRQ

SEQ ID NO: 606025 - protein, 9 aa, Homo Sapiens
PFDGEVEEE

SEQ ID NO: 606026 - protein, 9 aa, Homo Sapiens
KEALYNIRK

SEQ ID NO: 606027 - protein, 9 aa, Homo Sapiens
LDQLTSIIK

SEQ ID NO: 606028 - protein, 9 aa, Homo Sapiens
NFTPTLRAS

SEQ ID NO: 606029 - protein, 9 aa, Homo Sapiens
TFDDQIWVY

SEQ ID NO: 606030 - protein, 9 aa, Homo Sapiens
SIPYGSCVS

SEQ ID NO: 606031 - protein, 9 aa, Homo Sapiens
LDVEVVEAE

SEQ ID NO: 606032 - protein, 9 aa, Homo Sapiens
ADFAVNPDQ

SEQ ID NO: 606033 - protein, 9 aa, Homo Sapiens
LTPLECISN

SEQ ID NO: 606034 - protein, 9 aa, Homo Sapiens
FTVNPLGKQ

SEQ ID NO: 606035 - protein, 9 aa, Homo Sapiens
TFSAPCASL

SEQ ID NO: 606036 - protein, 9 aa, Homo Sapiens
RLIPVINTM

SEQ ID NO: 606037 - protein, 9 aa, Homo Sapiens
AGILICEQW

SEQ ID NO: 606038 - protein, 9 aa, Homo Sapiens
PPMLPSHFP

SEQ ID NO: 606039 - protein, 9 aa, Homo Sapiens
GNLTGYSGF

SEQ ID NO: 606040 - protein, 9 aa, Homo Sapiens
NYFRVATSQ

SEQ ID NO: 606041 - protein, 9 aa, Homo Sapiens
AEFAVHLHL

SEQ ID NO: 606042 - protein, 9 aa, Homo Sapiens
ELMNLSPEE

SEQ ID NO: 606043 - protein, 9 aa, Homo Sapiens
LRLTSNVKS

SEQ ID NO: 606044 - protein, 9 aa, Homo Sapiens
YPGHLCGHK

SEQ ID NO: 606045 - protein, 9 aa, Homo Sapiens
IVIFLLFIL

SEQ ID NO: 606046 - protein, 9 aa, Homo Sapiens
ERDFLQRPV

SEQ ID NO: 606047 - protein, 9 aa, Homo Sapiens
DGGKALASH

SEQ ID NO: 606048 - protein, 9 aa, Homo Sapiens
GEVEEELFQ

SEQ ID NO: 606049 - protein, 9 aa, Homo Sapiens
PERRQENRA

SEQ ID NO: 606050 - protein, 9 aa, Homo Sapiens
FGHVQSQFP

SEQ ID NO: 606051 - protein, 9 aa, Homo Sapiens
VEYAGQIQF

SEQ ID NO: 606052 - protein, 9 aa, Homo Sapiens
GRINTFQRL

SEQ ID NO: 606053 - protein, 9 aa, Homo Sapiens
NKIQGDFAG

SEQ ID NO: 606054 - protein, 9 aa, Homo Sapiens
SYGRINTFQ

SEQ ID NO: 606055 - protein, 9 aa, Homo Sapiens
TSQVPAGHF

SEQ ID NO: 606056 - protein, 9 aa, Homo Sapiens
LDFGEVFVS

SEQ ID NO: 606057 - protein, 9 aa, Homo Sapiens
EENKRRRLE

SEQ ID NO: 606058 - protein, 9 aa, Homo Sapiens
NVSLHEADN

SEQ ID NO: 606059 - protein, 9 aa, Homo Sapiens
YQCGQCNES

SEQ ID NO: 606060 - protein, 9 aa, Homo Sapiens
QSPKIWRKS

SEQ ID NO: 606061 - protein, 9 aa, Homo Sapiens
SCPASQHKG

SEQ ID NO: 606062 - protein, 9 aa, Homo Sapiens
NEIMTLNWE

SEQ ID NO: 606063 - protein, 9 aa, Homo Sapiens
MNLSPEELL

SEQ ID NO: 606064 - protein, 9 aa, Homo Sapiens
QVLFYTFFL

SEQ ID NO: 606065 - protein, 9 aa, Homo Sapiens
TEGSRQALK

SEQ ID NO: 606066 - protein, 9 aa, Homo Sapiens
RDFLQRPVW

SEQ ID NO: 606067 - protein, 9 aa, Homo Sapiens
QKLLLCNSP

SEQ ID NO: 606068 - protein, 9 aa, Homo Sapiens
PCTPDNVEV

SEQ ID NO: 606069 - protein, 9 aa, Homo Sapiens
VLSTVNSDL

SEQ ID NO: 606070 - protein, 9 aa, Homo Sapiens
LGTQRSEAV

SEQ ID NO: 606071 - protein, 9 aa, Homo Sapiens
LSQSVLSIP

SEQ ID NO: 606072 - protein, 9 aa, Homo Sapiens
QQDFENASP

SEQ ID NO: 606073 - protein, 9 aa, Homo Sapiens
VVRANYDML

SEQ ID NO: 606074 - protein, 9 aa, Homo Sapiens
LQQDFENAS

SEQ ID NO: 606075 - protein, 9 aa, Homo Sapiens
EYAGQIQFD

SEQ ID NO: 606076 - protein, 9 aa, Homo Sapiens
LNTEHISDS

SEQ ID NO: 606077 - protein, 9 aa, Homo Sapiens
QGDFAGRAE

SEQ ID NO: 606078 - protein, 9 aa, Homo Sapiens
GCEHFYLLT

SEQ ID NO: 606079 - protein, 9 aa, Homo Sapiens
VLQTIWVYK

SEQ ID NO: 606080 - protein, 9 aa, Homo Sapiens
CQRYPGHLC

SEQ ID NO: 606081 - protein, 9 aa, Homo Sapiens
IYSQKIACE

SEQ ID NO: 606082 - protein, 9 aa, Homo Sapiens
LSEKVFDFS

SEQ ID NO: 606083 - protein, 9 aa, Homo Sapiens
LDRHFREDS

SEQ ID NO: 606084 - protein, 9 aa, Homo Sapiens
HFREDSQEK

SEQ ID NO: 606085 - protein, 9 aa, Homo Sapiens
QGAICDYEM

SEQ ID NO: 606086 - protein, 9 aa, Homo Sapiens
SGGWDYTIK

SEQ ID NO: 606087 - protein, 9 aa, Homo Sapiens
KLLSEKVFD

SEQ ID NO: 606088 - protein, 9 aa, Homo Sapiens
RPYQCGQCN

SEQ ID NO: 606089 - protein, 9 aa, Homo Sapiens
SQVPAGHFG

SEQ ID NO: 606090 - protein, 9 aa, Homo Sapiens
GYSGFILSP

SEQ ID NO: 606091 - protein, 9 aa, Homo Sapiens
VIFLLFILY

SEQ ID NO: 606092 - protein, 9 aa, Homo Sapiens
QHRIPLELR

SEQ ID NO: 606093 - protein, 9 aa, Homo Sapiens
LRRDAETGK

SEQ ID NO: 606094 - protein, 9 aa, Homo Sapiens
RKLGSTGNI

SEQ ID NO: 606095 - protein, 9 aa, Homo Sapiens
SFSFQLDSL

SEQ ID NO: 606096 - protein, 9 aa, Homo Sapiens
AGVNIGGSP

SEQ ID NO: 606097 - protein, 9 aa, Homo Sapiens
QKHCAGVNI

SEQ ID NO: 606098 - protein, 9 aa, Homo Sapiens
IWVIGLGLK

SEQ ID NO: 606099 - protein, 9 aa, Homo Sapiens
PKEQLQTLQ

SEQ ID NO: 606100 - protein, 9 aa, Homo Sapiens
HSAVSAQVL

SEQ ID NO: 606101 - protein, 9 aa, Homo Sapiens
SPPEPPLSC

SEQ ID NO: 606102 - protein, 9 aa, Homo Sapiens
SFGQGAEGG

SEQ ID NO: 606103 - protein, 9 aa, Homo Sapiens
DNYLLAMVI

SEQ ID NO: 606104 - protein, 9 aa, Homo Sapiens
PDRDECLKK

SEQ ID NO: 606105 - protein, 9 aa, Homo Sapiens
LQTLQDKAG

SEQ ID NO: 606106 - protein, 9 aa, Homo Sapiens
QRYPGHLCG

SEQ ID NO: 606107 - protein, 9 aa, Homo Sapiens
SVWIPRFML

SEQ ID NO: 606108 - protein, 9 aa, Homo Sapiens
SAPCASLAS

SEQ ID NO: 606109 - protein, 9 aa, Homo Sapiens
GHKRTLSEP

SEQ ID NO: 606110 - protein, 9 aa, Homo Sapiens
LFFFILNFW

SEQ ID NO: 606111 - protein, 9 aa, Homo Sapiens
IGILLLQVL

SEQ ID NO: 606112 - protein, 9 aa, Homo Sapiens
ESMEDVHLK

SEQ ID NO: 606113 - protein, 9 aa, Homo Sapiens
MYLMVTADH

SEQ ID NO: 606114 - protein, 9 aa, Homo Sapiens
RIHTGETPN

SEQ ID NO: 606115 - protein, 9 aa, Homo Sapiens
ITCYGGIKK

SEQ ID NO: 606116 - protein, 9 aa, Homo Sapiens
ASPTDPNNN

SEQ ID NO: 606117 - protein, 9 aa, Homo Sapiens
EHFSGMYID

SEQ ID NO: 606118 - protein, 9 aa, Homo Sapiens
ICHTFSAPC

SEQ ID NO: 606119 - protein, 9 aa, Homo Sapiens
WSKAHHYLL

SEQ ID NO: 606120 - protein, 9 aa, Homo Sapiens
KRIQRTFAA

SEQ ID NO: 606121 - protein, 9 aa, Homo Sapiens
PELDRHFRE

SEQ ID NO: 606122 - protein, 9 aa, Homo Sapiens
TGYSGFILS

SEQ ID NO: 606123 - protein, 9 aa, Homo Sapiens
RHHMSMWET

SEQ ID NO: 606124 - protein, 9 aa, Homo Sapiens
VHPFTVNPL

SEQ ID NO: 606125 - protein, 9 aa, Homo Sapiens
KDGKDLNQF

SEQ ID NO: 606126 - protein, 9 aa, Homo Sapiens
CMPDQNHII

SEQ ID NO: 606127 - protein, 9 aa, Homo Sapiens
LEELMNLSP

SEQ ID NO: 606128 - protein, 9 aa, Homo Sapiens
HLCGHKCEN

SEQ ID NO: 606129 - protein, 9 aa, Homo Sapiens
KHCHIGKGV

SEQ ID NO: 606130 - protein, 9 aa, Homo Sapiens
QYDIPNLYG

SEQ ID NO: 606131 - protein, 9 aa, Homo Sapiens
TMVIVLSAR

SEQ ID NO: 606132 - protein, 9 aa, Homo Sapiens
EPPLSCPAS

SEQ ID NO: 606133 - protein, 9 aa, Homo Sapiens
DSLTEAPKY

SEQ ID NO: 606134 - protein, 9 aa, Homo Sapiens
KAGILICEQ

SEQ ID NO: 606135 - protein, 9 aa, Homo Sapiens
WRKSFQSMG

SEQ ID NO: 606136 - protein, 9 aa, Homo Sapiens
VPAGHFGHV

SEQ ID NO: 606137 - protein, 9 aa, Homo Sapiens
TEHISDSIM

SEQ ID NO: 606138 - protein, 9 aa, Homo Sapiens
VWQPQAGLS

SEQ ID NO: 606139 - protein, 9 aa, Homo Sapiens
DSIPYGSCV

SEQ ID NO: 606140 - protein, 9 aa, Homo Sapiens
DPTCSDCKE

SEQ ID NO: 606141 - protein, 9 aa, Homo Sapiens
LLQVLAQKH

SEQ ID NO: 606142 - protein, 9 aa, Homo Sapiens
AITVFMLEY

SEQ ID NO: 606143 - protein, 9 aa, Homo Sapiens
AVCVHQLPP

SEQ ID NO: 606144 - protein, 9 aa, Homo Sapiens
ERLIPVINT

SEQ ID NO: 606145 - protein, 9 aa, Homo Sapiens
NTNVFYHTE

SEQ ID NO: 606146 - protein, 9 aa, Homo Sapiens
NLSPEELLL

SEQ ID NO: 606147 - protein, 9 aa, Homo Sapiens
DSPLQPGSA

SEQ ID NO: 606148 - protein, 9 aa, Homo Sapiens
VEEELFQAI

SEQ ID NO: 606149 - protein, 9 aa, Homo Sapiens
SSTPQKNNG

SEQ ID NO: 606150 - protein, 9 aa, Homo Sapiens
EPPSPLPHG

SEQ ID NO: 606151 - protein, 9 aa, Homo Sapiens
DQNHIIQAK

SEQ ID NO: 606152 - protein, 9 aa, Homo Sapiens
LAQKHCAGV

SEQ ID NO: 606153 - protein, 9 aa, Homo Sapiens
CNESFWYKA

SEQ ID NO: 606154 - protein, 9 aa, Homo Sapiens
EPLEQKLLL

SEQ ID NO: 606155 - protein, 9 aa, Homo Sapiens
TIWVYKELR

SEQ ID NO: 606156 - protein, 9 aa, Homo Sapiens
VLAQKHCAG

SEQ ID NO: 606157 - protein, 9 aa, Homo Sapiens
PPQEALPEP

SEQ ID NO: 606158 - protein, 9 aa, Homo Sapiens
FQLDSLTEA

SEQ ID NO: 606159 - protein, 9 aa, Homo Sapiens
LKEPLEQKL

SEQ ID NO: 606160 - protein, 9 aa, Homo Sapiens
SDCKELSCP

SEQ ID NO: 606161 - protein, 9 aa, Homo Sapiens
KNSSTPQKN

SEQ ID NO: 606162 - protein, 9 aa, Homo Sapiens
EEHFSGMYI

SEQ ID NO: 606163 - protein, 9 aa, Homo Sapiens
QNHIIQAKK

SEQ ID NO: 606164 - protein, 9 aa, Homo Sapiens
YDIPNLYGY

SEQ ID NO: 606165 - protein, 9 aa, Homo Sapiens
DTDTGPKCG

SEQ ID NO: 606166 - protein, 9 aa, Homo Sapiens
FDDQIWVYS

SEQ ID NO: 606167 - protein, 9 aa, Homo Sapiens
PVTTNTLPN

SEQ ID NO: 606168 - protein, 9 aa, Homo Sapiens
LRYKRIQRT

SEQ ID NO: 606169 - protein, 9 aa, Homo Sapiens
FLLISDELR

SEQ ID NO: 606170 - protein, 9 aa, Homo Sapiens
ELRLTSNVK

SEQ ID NO: 606171 - protein, 9 aa, Homo Sapiens
LNINPFVES

SEQ ID NO: 606172 - protein, 9 aa, Homo Sapiens
NIRKYEVFL

SEQ ID NO: 606173 - protein, 9 aa, Homo Sapiens
TSIIKIDLH

SEQ ID NO: 606174 - protein, 9 aa, Homo Sapiens
TPQKNNGST

SEQ ID NO: 606175 - protein, 9 aa, Homo Sapiens
RPVWQPQAG

SEQ ID NO: 606176 - protein, 9 aa, Homo Sapiens
KHIVALLQV

SEQ ID NO: 606177 - protein, 9 aa, Homo Sapiens
VRSSHSAVS

SEQ ID NO: 606178 - protein, 9 aa, Homo Sapiens
PIFPCHKNF

SEQ ID NO: 606179 - protein, 9 aa, Homo Sapiens
FSRTVEAVL

SEQ ID NO: 606180 - protein, 9 aa, Homo Sapiens
LTGYSGFIL

SEQ ID NO: 606181 - protein, 9 aa, Homo Sapiens
SGGVRAPGG

SEQ ID NO: 606182 - protein, 9 aa, Homo Sapiens
GAEGGLLAC

SEQ ID NO: 606183 - protein, 9 aa, Homo Sapiens
QTLQDKAGK

SEQ ID NO: 606184 - protein, 9 aa, Homo Sapiens
VKSVQVLFY

SEQ ID NO: 606185 - protein, 9 aa, Homo Sapiens
NDVIVRSSH

SEQ ID NO: 606186 - protein, 9 aa, Homo Sapiens
VCQSPKIWR

SEQ ID NO: 606187 - protein, 9 aa, Homo Sapiens
HKRTLSEPP

SEQ ID NO: 606188 - protein, 9 aa, Homo Sapiens
TPDNVEVLE

SEQ ID NO: 606189 - protein, 9 aa, Homo Sapiens
PPGAPPGVG

SEQ ID NO: 606190 - protein, 9 aa, Homo Sapiens
LGSTGNICS

SEQ ID NO: 606191 - protein, 9 aa, Homo Sapiens
QLPPGQLHV

SEQ ID NO: 606192 - protein, 9 aa, Homo Sapiens
DAETGKPVT

SEQ ID NO: 606193 - protein, 9 aa, Homo Sapiens
SRTVEAVLK

SEQ ID NO: 606194 - protein, 9 aa, Homo Sapiens
RITCYGGIK

SEQ ID NO: 606195 - protein, 9 aa, Homo Sapiens
VESSREYPA

SEQ ID NO: 606196 - protein, 9 aa, Homo Sapiens
VLERHGMSL

SEQ ID NO: 606197 - protein, 9 aa, Homo Sapiens
ALYNIRKYE

SEQ ID NO: 606198 - protein, 9 aa, Homo Sapiens
RSSHSAVSA

SEQ ID NO: 606199 - protein, 9 aa, Homo Sapiens
IMTLNWEAV

SEQ ID NO: 606200 - protein, 9 aa, Homo Sapiens
SPKIWRKSF

SEQ ID NO: 606201 - protein, 9 aa, Homo Sapiens
INVSLHEAD

SEQ ID NO: 606202 - protein, 9 aa, Homo Sapiens
LKEPKQESS

SEQ ID NO: 606203 - protein, 9 aa, Homo Sapiens
GLLACSQCG

SEQ ID NO: 606204 - protein, 9 aa, Homo Sapiens
EKVFDFSSG

SEQ ID NO: 606205 - protein, 9 aa, Homo Sapiens
NIAQERKKD

SEQ ID NO: 606206 - protein, 9 aa, Homo Sapiens
ILASGSVWI

SEQ ID NO: 606207 - protein, 9 aa, Homo Sapiens
ARLYKKRPQ

SEQ ID NO: 606208 - protein, 9 aa, Homo Sapiens
IACEKLVHK

SEQ ID NO: 606209 - protein, 9 aa, Homo Sapiens
QSMGSSSPE

SEQ ID NO: 606210 - protein, 9 aa, Homo Sapiens
PPLSCPASQ

SEQ ID NO: 606211 - protein, 9 aa, Homo Sapiens
CGEARARQL

SEQ ID NO: 606212 - protein, 9 aa, Homo Sapiens
TQVCQSPKI

SEQ ID NO: 606213 - protein, 9 aa, Homo Sapiens
SERERLIPV

SEQ ID NO: 606214 - protein, 9 aa, Homo Sapiens
VGSMPSSSC

SEQ ID NO: 606215 - protein, 9 aa, Homo Sapiens
NASPTDPNN

SEQ ID NO: 606216 - protein, 9 aa, Homo Sapiens
GSSYNERQK

SEQ ID NO: 606217 - protein, 9 aa, Homo Sapiens
LPSMEVDVK

SEQ ID NO: 606218 - protein, 9 aa, Homo Sapiens
NSDLSNYFR

SEQ ID NO: 606219 - protein, 9 aa, Homo Sapiens
ATMLEHGWD

SEQ ID NO: 606220 - protein, 9 aa, Homo Sapiens
LTQDIFEDE

SEQ ID NO: 606221 - protein, 9 aa, Homo Sapiens
PCGGNLTGY

SEQ ID NO: 606222 - protein, 9 aa, Homo Sapiens
SMEVDVKAP

SEQ ID NO: 606223 - protein, 9 aa, Homo Sapiens
DFAVNPDQP

SEQ ID NO: 606224 - protein, 9 aa, Homo Sapiens
LEHGWDKHI

SEQ ID NO: 606225 - protein, 9 aa, Homo Sapiens
RASAKVSDF

SEQ ID NO: 606226 - protein, 9 aa, Homo Sapiens
TVEAVLKEA

SEQ ID NO: 606227 - protein, 9 aa, Homo Sapiens
GETPNECKE

SEQ ID NO: 606228 - protein, 9 aa, Homo Sapiens
STRKLGSTG

SEQ ID NO: 606229 - protein, 9 aa, Homo Sapiens
QVLSTVNSD

SEQ ID NO: 606230 - protein, 9 aa, Homo Sapiens
LMNLSPEEL

SEQ ID NO: 606231 - protein, 9 aa, Homo Sapiens
MSMWETRSS

SEQ ID NO: 606232 - protein, 9 aa, Homo Sapiens
VNIGGSPST

SEQ ID NO: 606233 - protein, 9 aa, Homo Sapiens
SAKQTQVCQ

SEQ ID NO: 606234 - protein, 9 aa, Homo Sapiens
KCGCHQKYA

SEQ ID NO: 606235 - protein, 9 aa, Homo Sapiens
DNKIQGDFA

SEQ ID NO: 606236 - protein, 9 aa, Homo Sapiens
RTLSEPPSP

SEQ ID NO: 606237 - protein, 9 aa, Homo Sapiens
YDWADGSDE

SEQ ID NO: 606238 - protein, 9 aa, Homo Sapiens
LNQFTISRR

SEQ ID NO: 606239 - protein, 9 aa, Homo Sapiens
VYSFIGILL

SEQ ID NO: 606240 - protein, 9 aa, Homo Sapiens
TIWVIGLGL

SEQ ID NO: 606241 - protein, 9 aa, Homo Sapiens
KDLNQFTIS

SEQ ID NO: 606242 - protein, 9 aa, Homo Sapiens
QWGDSIPYG

SEQ ID NO: 606243 - protein, 9 aa, Homo Sapiens
HLKEPKQES

SEQ ID NO: 606244 - protein, 9 aa, Homo Sapiens
QLNTEHISD

SEQ ID NO: 606245 - protein, 9 aa, Homo Sapiens
RINTFQRLL

SEQ ID NO: 606246 - protein, 9 aa, Homo Sapiens
YQVKSVQVL

SEQ ID NO: 606247 - protein, 9 aa, Homo Sapiens
DASHAGVSA

SEQ ID NO: 606248 - protein, 9 aa, Homo Sapiens
RTIWVIGLG

SEQ ID NO: 606249 - protein, 9 aa, Homo Sapiens
FRTIWVIGL

SEQ ID NO: 606250 - protein, 9 aa, Homo Sapiens
MEVDVKAPG

SEQ ID NO: 606251 - protein, 9 aa, Homo Sapiens
ASAKVSDFI

SEQ ID NO: 606252 - protein, 9 aa, Homo Sapiens
IEMYLMVTA

SEQ ID NO: 606253 - protein, 9 aa, Homo Sapiens
KVSDFISAQ

SEQ ID NO: 606254 - protein, 9 aa, Homo Sapiens
AVLKEAARK

SEQ ID NO: 606255 - protein, 9 aa, Homo Sapiens
QCGQCNESF

SEQ ID NO: 606256 - protein, 9 aa, Homo Sapiens
ERQKHCHIG

SEQ ID NO: 606257 - protein, 9 aa, Homo Sapiens
FRVATSQVP

SEQ ID NO: 606258 - protein, 9 aa, Homo Sapiens
GPGSAVCVH

SEQ ID NO: 606259 - protein, 9 aa, Homo Sapiens
NPCTPDNVE

SEQ ID NO: 606260 - protein, 9 aa, Homo Sapiens
EANNGLGTQ

SEQ ID NO: 606261 - protein, 9 aa, Homo Sapiens
INEEHFSGM

SEQ ID NO: 606262 - protein, 9 aa, Homo Sapiens
PPPPCIVLE

SEQ ID NO: 606263 - protein, 9 aa, Homo Sapiens
NRAHGKVVS

SEQ ID NO: 606264 - protein, 9 aa, Homo Sapiens
CAGVNIGGS

SEQ ID NO: 606265 - protein, 9 aa, Homo Sapiens
SSPEPEISQ

SEQ ID NO: 606266 - protein, 9 aa, Homo Sapiens
DTGPKCGCH

SEQ ID NO: 606267 - protein, 9 aa, Homo Sapiens
TVTFPVTTN

SEQ ID NO: 606268 - protein, 9 aa, Homo Sapiens
ANTNVFYHT

SEQ ID NO: 606269 - protein, 9 aa, Homo Sapiens
ACAVILLKH

SEQ ID NO: 606270 - protein, 9 aa, Homo Sapiens
YSCQFIEMY

SEQ ID NO: 606271 - protein, 9 aa, Homo Sapiens
EYMARLYKK

SEQ ID NO: 606272 - protein, 9 aa, Homo Sapiens
LASGSVWIP

SEQ ID NO: 606273 - protein, 9 aa, Homo Sapiens
LLQVLSTVN

SEQ ID NO: 606274 - protein, 9 aa, Homo Sapiens
GEVFVSPMI

SEQ ID NO: 606275 - protein, 9 aa, Homo Sapiens
SDFISAQYP

SEQ ID NO: 606276 - protein, 9 aa, Homo Sapiens
RQCCCIVVD

SEQ ID NO: 606277 - protein, 9 aa, Homo Sapiens
VRAPGGPGS

SEQ ID NO: 606278 - protein, 9 aa, Homo Sapiens
YLLISGGWD

SEQ ID NO: 606279 - protein, 9 aa, Homo Sapiens
QTIWVYKEL

SEQ ID NO: 606280 - protein, 9 aa, Homo Sapiens
YTISPYAIT

SEQ ID NO: 606281 - protein, 9 aa, Homo Sapiens
MLRKDGKDL

SEQ ID NO: 606282 - protein, 9 aa, Homo Sapiens
HISDSIMKF

SEQ ID NO: 606283 - protein, 9 aa, Homo Sapiens
VDQLLQALG

SEQ ID NO: 606284 - protein, 9 aa, Homo Sapiens
LWSKAHHYL

SEQ ID NO: 606285 - protein, 9 aa, Homo Sapiens
HVQSQFPEL

SEQ ID NO: 606286 - protein, 9 aa, Homo Sapiens
HHYLLTHLP

SEQ ID NO: 606287 - protein, 9 aa, Homo Sapiens
QEKLAGATM

SEQ ID NO: 606288 - protein, 9 aa, Homo Sapiens
RIPLELRLT

SEQ ID NO: 606289 - protein, 9 aa, Homo Sapiens
SVMINEEHF

SEQ ID NO: 606290 - protein, 9 aa, Homo Sapiens
WLDGGKALA

SEQ ID NO: 606291 - protein, 9 aa, Homo Sapiens
VLVRNLRRD

SEQ ID NO: 606292 - protein, 9 aa, Homo Sapiens
TQRSEAVTL

SEQ ID NO: 606293 - protein, 9 aa, Homo Sapiens
EGGLLACSQ

SEQ ID NO: 606294 - protein, 9 aa, Homo Sapiens
LLSTFDDQI

SEQ ID NO: 606295 - protein, 9 aa, Homo Sapiens
KASSAKQTQ

SEQ ID NO: 606296 - protein, 9 aa, Homo Sapiens
VMRTMGYMP

SEQ ID NO: 606297 - protein, 9 aa, Homo Sapiens
HQLPPGQLH

SEQ ID NO: 606298 - protein, 9 aa, Homo Sapiens
VSLVAVHPF

SEQ ID NO: 606299 - protein, 9 aa, Homo Sapiens
GLGTQRSEA

SEQ ID NO: 606300 - protein, 9 aa, Homo Sapiens
FIEMYLMVT

SEQ ID NO: 606301 - protein, 9 aa, Homo Sapiens
NWEAVSDLD

SEQ ID NO: 606302 - protein, 9 aa, Homo Sapiens
CIVLERHGM

SEQ ID NO: 606303 - protein, 9 aa, Homo Sapiens
WVYSFIGIL

SEQ ID NO: 606304 - protein, 9 aa, Homo Sapiens
TKKLQRLYL

SEQ ID NO: 606305 - protein, 9 aa, Homo Sapiens
DIPNLYGYS

SEQ ID NO: 606306 - protein, 9 aa, Homo Sapiens
ILMFEREFA

SEQ ID NO: 606307 - protein, 9 aa, Homo Sapiens
DQLTSIIKI

SEQ ID NO: 606308 - protein, 9 aa, Homo Sapiens
FREDSQEKL

SEQ ID NO: 606309 - protein, 9 aa, Homo Sapiens
DFISAQYPV

SEQ ID NO: 606310 - protein, 9 aa, Homo Sapiens
HPAMDSPLQ

SEQ ID NO: 606311 - protein, 9 aa, Homo Sapiens
NGEYDWADG

SEQ ID NO: 606312 - protein, 9 aa, Homo Sapiens
MLEHGWDKH

SEQ ID NO: 606313 - protein, 9 aa, Homo Sapiens
GISDGYPLE

SEQ ID NO: 606314 - protein, 9 aa, Homo Sapiens
EACAVILLK

SEQ ID NO: 606315 - protein, 9 aa, Homo Sapiens
VHLKEPKQE

SEQ ID NO: 606316 - protein, 9 aa, Homo Sapiens
TCSDCKELS

SEQ ID NO: 606317 - protein, 9 aa, Homo Sapiens
PPPCIVLER

SEQ ID NO: 606318 - protein, 9 aa, Homo Sapiens
GSERERLIP

SEQ ID NO: 606319 - protein, 9 aa, Homo Sapiens
PDINFVGLL

SEQ ID NO: 606320 - protein, 9 aa, Homo Sapiens
CVDTHMRIT

SEQ ID NO: 606321 - protein, 9 aa, Homo Sapiens
DWADGSDEM

SEQ ID NO: 606322 - protein, 9 aa, Homo Sapiens
MVIVLSARM

SEQ ID NO: 606323 - protein, 9 aa, Homo Sapiens
CAILMFERE

SEQ ID NO: 606324 - protein, 9 aa, Homo Sapiens
SSSPEPEIS

SEQ ID NO: 606325 - protein, 9 aa, Homo Sapiens
SVDQLLQAL

SEQ ID NO: 606326 - protein, 9 aa, Homo Sapiens
FDGEVEEEL

SEQ ID NO: 606327 - protein, 9 aa, Homo Sapiens
QDEYPDINF

SEQ ID NO: 606328 - protein, 9 aa, Homo Sapiens
GEYDWADGS

SEQ ID NO: 606329 - protein, 9 aa, Homo Sapiens
GQPPFDGEV

SEQ ID NO: 606330 - protein, 9 aa, Homo Sapiens
KSVQVLFYT

SEQ ID NO: 606331 - protein, 9 aa, Homo Sapiens
DVDEFINVS

SEQ ID NO: 606332 - protein, 9 aa, Homo Sapiens
GVNIGGSPS

SEQ ID NO: 606333 - protein, 9 aa, Homo Sapiens
LEYFSPVSY

SEQ ID NO: 606334 - protein, 9 aa, Homo Sapiens
PDQNHIIQA

SEQ ID NO: 606335 - protein, 9 aa, Homo Sapiens
SNYFRVATS

SEQ ID NO: 606336 - protein, 9 aa, Homo Sapiens
ISPYAITPP

SEQ ID NO: 606337 - protein, 9 aa, Homo Sapiens
LISDELRSV

SEQ ID NO: 606338 - protein, 9 aa, Homo Sapiens
AGATMLEHG

SEQ ID NO: 606339 - protein, 9 aa, Homo Sapiens
RLTSNVKSQ

SEQ ID NO: 606340 - protein, 9 aa, Homo Sapiens
RVSDNYLLA

SEQ ID NO: 606341 - protein, 9 aa, Homo Sapiens
LIPVINTML

SEQ ID NO: 606342 - protein, 9 aa, Homo Sapiens
EDTDTGPKC

SEQ ID NO: 606343 - protein, 9 aa, Homo Sapiens
RTVEAVLKE

SEQ ID NO: 606344 - protein, 9 aa, Homo Sapiens
ARQLSPQLG

SEQ ID NO: 606345 - protein, 9 aa, Homo Sapiens
EADGYDYTI

SEQ ID NO: 606346 - protein, 9 aa, Homo Sapiens
SVQVLFYTF

SEQ ID NO: 606347 - protein, 9 aa, Homo Sapiens
VWLPYSSVD

SEQ ID NO: 606348 - protein, 9 aa, Homo Sapiens
SFIGILLLQ

SEQ ID NO: 606349 - protein, 9 aa, Homo Sapiens
HLEELKAND

SEQ ID NO: 606350 - protein, 9 aa, Homo Sapiens
KCNGEYDWA

SEQ ID NO: 606351 - protein, 9 aa, Homo Sapiens
DVIVRSSHS

SEQ ID NO: 606352 - protein, 9 aa, Homo Sapiens
ASSAKQTQV

SEQ ID NO: 606353 - protein, 9 aa, Homo Sapiens
PGAPPGVGS

SEQ ID NO: 606354 - protein, 9 aa, Homo Sapiens
IPQDEYPDI

SEQ ID NO: 606355 - protein, 9 aa, Homo Sapiens
AFSLTPLEC

SEQ ID NO: 606356 - protein, 9 aa, Homo Sapiens
PSMEVDVKA

SEQ ID NO: 606357 - protein, 9 aa, Homo Sapiens
IQLFFFILN

SEQ ID NO: 606358 - protein, 9 aa, Homo Sapiens
ASHAGVSAN

SEQ ID NO: 606359 - protein, 9 aa, Homo Sapiens
RPPPPCIVL

SEQ ID NO: 606360 - protein, 9 aa, Homo Sapiens
HSGFIGKGM

SEQ ID NO: 606361 - protein, 9 aa, Homo Sapiens
GETLEELMN

SEQ ID NO: 606362 - protein, 9 aa, Homo Sapiens
HIIQAKKAY

SEQ ID NO: 606363 - protein, 9 aa, Homo Sapiens
LFILYGLSS

SEQ ID NO: 606364 - protein, 9 aa, Homo Sapiens
CGQCNESFW

SEQ ID NO: 606365 - protein, 9 aa, Homo Sapiens
LGNVMRTMG

SEQ ID NO: 606366 - protein, 9 aa, Homo Sapiens
GPKCGCHQK

SEQ ID NO: 606367 - protein, 9 aa, Homo Sapiens
KEPKQESSA

SEQ ID NO: 606368 - protein, 9 aa, Homo Sapiens
QCNESFWYK

SEQ ID NO: 606369 - protein, 9 aa, Homo Sapiens
KKNKNSSTP

SEQ ID NO: 606370 - protein, 9 aa, Homo Sapiens
NINPFVESS

SEQ ID NO: 606371 - protein, 9 aa, Homo Sapiens
LKCNGEYDW

SEQ ID NO: 606372 - protein, 9 aa, Homo Sapiens
SLTQDIFED

SEQ ID NO: 606373 - protein, 9 aa, Homo Sapiens
KIACEKLVH

SEQ ID NO: 606374 - protein, 9 aa, Homo Sapiens
LDSLTEAPK

SEQ ID NO: 606375 - protein, 9 aa, Homo Sapiens
WVYKELRKP

SEQ ID NO: 606376 - protein, 9 aa, Homo Sapiens
EIMTLNWEA

SEQ ID NO: 606377 - protein, 9 aa, Homo Sapiens
VDEFINVSL

SEQ ID NO: 606378 - protein, 9 aa, Homo Sapiens
PLEEIVYQW

SEQ ID NO: 606379 - protein, 9 aa, Homo Sapiens
ELSSKENIA

SEQ ID NO: 606380 - protein, 9 aa, Homo Sapiens
TTKKLQRLY

SEQ ID NO: 606381 - protein, 9 aa, Homo Sapiens
APGGPGSAV

SEQ ID NO: 606382 - protein, 9 aa, Homo Sapiens
TTNTLPNYQ

SEQ ID NO: 606383 - protein, 9 aa, Homo Sapiens
NPIIYSQKI

SEQ ID NO: 606384 - protein, 9 aa, Homo Sapiens
KQTQVCQSP

SEQ ID NO: 606385 - protein, 9 aa, Homo Sapiens
EFRTIWVIG

SEQ ID NO: 606386 - protein, 9 aa, Homo Sapiens
WETRSSHLR

SEQ ID NO: 606387 - protein, 9 aa, Homo Sapiens
YNIRKYEVF

SEQ ID NO: 606388 - protein, 9 aa, Homo Sapiens
VDKIVLFGG

SEQ ID NO: 606389 - protein, 9 aa, Homo Sapiens
HMSMWETRS

SEQ ID NO: 606390 - protein, 9 aa, Homo Sapiens
PHPAMDSPL

SEQ ID NO: 606391 - protein, 9 aa, Homo Sapiens
PCIVLERHG

SEQ ID NO: 606392 - protein, 9 aa, Homo Sapiens
GKQYDIPNL

SEQ ID NO: 606393 - protein, 9 aa, Homo Sapiens
YKRIQRTFA

SEQ ID NO: 606394 - protein, 9 aa, Homo Sapiens
LISGGWDYT

SEQ ID NO: 606395 - protein, 9 aa, Homo Sapiens
YHTEGSRQA

SEQ ID NO: 606396 - protein, 9 aa, Homo Sapiens
ISCKDLGNV

SEQ ID NO: 606397 - protein, 9 aa, Homo Sapiens
EPPQEALPE

SEQ ID NO: 606398 - protein, 9 aa, Homo Sapiens
APPGVGSMP

SEQ ID NO: 606399 - protein, 9 aa, Homo Sapiens
DIFEDERKV

SEQ ID NO: 606400 - protein, 9 aa, Homo Sapiens
PKCGCHQKY

SEQ ID NO: 606401 - protein, 9 aa, Homo Sapiens
YALCDATYE

SEQ ID NO: 606402 - protein, 9 aa, Homo Sapiens
NECQRYPGH

SEQ ID NO: 606403 - protein, 9 aa, Homo Sapiens
NDCRYALCD

SEQ ID NO: 606404 - protein, 9 aa, Homo Sapiens
GYPLEEIVY

SEQ ID NO: 606405 - protein, 9 aa, Homo Sapiens
SSHSAVSAQ

SEQ ID NO: 606406 - protein, 9 aa, Homo Sapiens
FFILNFWVT

SEQ ID NO: 606407 - protein, 9 aa, Homo Sapiens
LTTKKLQRL

SEQ ID NO: 606408 - protein, 9 aa, Homo Sapiens
PPGVGSMPS

SEQ ID NO: 606409 - protein, 9 aa, Homo Sapiens
ETVLSQSVL

SEQ ID NO: 606410 - protein, 9 aa, Homo Sapiens
EVTVQPGCY

SEQ ID NO: 606411 - protein, 9 aa, Homo Sapiens
IIYSQKIAC

SEQ ID NO: 606412 - protein, 9 aa, Homo Sapiens
SFQSMGSSS

SEQ ID NO: 606413 - protein, 9 aa, Homo Sapiens
VIVLSARMS

SEQ ID NO: 606414 - protein, 9 aa, Homo Sapiens
NSSTPQKNN

SEQ ID NO: 606415 - protein, 9 aa, Homo Sapiens
HPFTVNPLG

SEQ ID NO: 606416 - protein, 9 aa, Homo Sapiens
IVRSSHSAV

SEQ ID NO: 606417 - protein, 9 aa, Homo Sapiens
QPPFDGEVE

SEQ ID NO: 606418 - protein, 9 aa, Homo Sapiens
LAGATMLEH

SEQ ID NO: 606419 - protein, 9 aa, Homo Sapiens
QDFENASPT

SEQ ID NO: 606420 - protein, 9 aa, Homo Sapiens
EMYLMVTAD

SEQ ID NO: 606421 - protein, 9 aa, Homo Sapiens
FPCHKNFTP

SEQ ID NO: 606422 - protein, 9 aa, Homo Sapiens
DRRTDFLLS

SEQ ID NO: 606423 - protein, 9 aa, Homo Sapiens
LVRNLRRDA

SEQ ID NO: 606424 - protein, 9 aa, Homo Sapiens
IPNLYGYSM

SEQ ID NO: 606425 - protein, 9 aa, Homo Sapiens
VMINEEHFS

SEQ ID NO: 606426 - protein, 9 aa, Homo Sapiens
RSRADASHA

SEQ ID NO: 606427 - protein, 9 aa, Homo Sapiens
LPKEQLQTL

SEQ ID NO: 606428 - protein, 9 aa, Homo Sapiens
DGYDYTISP

SEQ ID NO: 606429 - protein, 9 aa, Homo Sapiens
NKNSSTPQK

SEQ ID NO: 606430 - protein, 9 aa, Homo Sapiens
GGNLTGYSG

SEQ ID NO: 606431 - protein, 9 aa, Homo Sapiens
GQGAEGGLL

SEQ ID NO: 606432 - protein, 9 aa, Homo Sapiens
LTSIIKIDL

SEQ ID NO: 606433 - protein, 9 aa, Homo Sapiens
KANDVIVRS

SEQ ID NO: 606434 - protein, 9 aa, Homo Sapiens
VHQLPPGQL

SEQ ID NO: 606435 - protein, 9 aa, Homo Sapiens
FGEVFVSPM

SEQ ID NO: 606436 - protein, 9 aa, Homo Sapiens
LQVLSTVNS

SEQ ID NO: 606437 - protein, 9 aa, Homo Sapiens
GDFAGRAEI

SEQ ID NO: 606438 - protein, 9 aa, Homo Sapiens
MDSPLQPGS

SEQ ID NO: 606439 - protein, 9 aa, Homo Sapiens
SIPLHGCEH

SEQ ID NO: 606440 - protein, 9 aa, Homo Sapiens
DYEEEEDSD

SEQ ID NO: 606441 - protein, 9 aa, Homo Sapiens
LLKHGANPN

SEQ ID NO: 606442 - protein, 9 aa, Homo Sapiens
TFPVTTNTL

SEQ ID NO: 606443 - protein, 9 aa, Homo Sapiens
AVNPDQPLS

SEQ ID NO: 606444 - protein, 9 aa, Homo Sapiens
EKLAGATML

SEQ ID NO: 606445 - protein, 9 aa, Homo Sapiens
NHIIQAKKA

SEQ ID NO: 606446 - protein, 9 aa, Homo Sapiens
AQKHCAGVN

SEQ ID NO: 606447 - protein, 9 aa, Homo Sapiens
VSDFISAQY

SEQ ID NO: 606448 - protein, 9 aa, Homo Sapiens
KNKNSSTPQ

SEQ ID NO: 606449 - protein, 9 aa, Homo Sapiens
EHISDSIMK

SEQ ID NO: 606450 - protein, 9 aa, Homo Sapiens
LQRLYLSHN

SEQ ID NO: 606451 - protein, 9 aa, Homo Sapiens
WLPYSSVDQ

SEQ ID NO: 606452 - protein, 9 aa, Homo Sapiens
GSSSPEPEI

SEQ ID NO: 606453 - protein, 9 aa, Homo Sapiens
VVDKIVLFG

SEQ ID NO: 606454 - protein, 9 aa, Homo Sapiens
CIVVDKIVL

SEQ ID NO: 606455 - protein, 9 aa, Homo Sapiens
FDNKIQGDF

SEQ ID NO: 606456 - protein, 9 aa, Homo Sapiens
KNFTPTLRA

SEQ ID NO: 606457 - protein, 9 aa, Homo Sapiens
TPNECKECG

SEQ ID NO: 606458 - protein, 9 aa, Homo Sapiens
TPLECISNI

SEQ ID NO: 606459 - protein, 9 aa, Homo Sapiens
IAWGPMGDE

SEQ ID NO: 606460 - protein, 9 aa, Homo Sapiens
TVNSDLSNY

SEQ ID NO: 606461 - protein, 9 aa, Homo Sapiens
CHTFSAPCA

SEQ ID NO: 606462 - protein, 9 aa, Homo Sapiens
LSEPPSPLP

SEQ ID NO: 606463 - protein, 9 aa, Homo Sapiens
PYSSVDQLL

SEQ ID NO: 606464 - protein, 9 aa, Homo Sapiens
ISDELRSVR

SEQ ID NO: 606465 - protein, 9 aa, Homo Sapiens
VYVDGKREI

SEQ ID NO: 606466 - protein, 9 aa, Homo Sapiens
PSFPSSVLF

SEQ ID NO: 606467 - protein, 9 aa, Homo Sapiens
VEADTRSSS

SEQ ID NO: 606468 - protein, 9 aa, Homo Sapiens
AADSGVVEA

SEQ ID NO: 606469 - protein, 9 aa, Homo Sapiens
ETKKETVEQ

SEQ ID NO: 606470 - protein, 9 aa, Homo Sapiens
TKKETVEQL

SEQ ID NO: 606471 - protein, 9 aa, Homo Sapiens
LLCGMREMR

SEQ ID NO: 606472 - protein, 9 aa, Homo Sapiens
MRAGGCCHA

SEQ ID NO: 606473 - protein, 9 aa, Homo Sapiens
EGMNPLTST

SEQ ID NO: 606474 - protein, 9 aa, Homo Sapiens
IFAVEEKVS

SEQ ID NO: 606475 - protein, 9 aa, Homo Sapiens
TSTLSEGMN

SEQ ID NO: 606476 - protein, 9 aa, Homo Sapiens
EGKKDGDKK

SEQ ID NO: 606477 - protein, 9 aa, Homo Sapiens
GELCDAIFA

SEQ ID NO: 606478 - protein, 9 aa, Homo Sapiens
LKPLLTHSR

SEQ ID NO: 606479 - protein, 9 aa, Homo Sapiens
DAIFAVEEK

SEQ ID NO: 606480 - protein, 9 aa, Homo Sapiens
THSRPPLTT

SEQ ID NO: 606481 - protein, 9 aa, Homo Sapiens
LCGMREMRA

SEQ ID NO: 606482 - protein, 9 aa, Homo Sapiens
SFPSSVLFM

SEQ ID NO: 606483 - protein, 9 aa, Homo Sapiens
NSLPETSVA

SEQ ID NO: 606484 - protein, 9 aa, Homo Sapiens
VDGKREIQT

SEQ ID NO: 606485 - protein, 9 aa, Homo Sapiens
VIAIATFLT

SEQ ID NO: 606486 - protein, 9 aa, Homo Sapiens
SGVVEADTR

SEQ ID NO: 606487 - protein, 9 aa, Homo Sapiens
ALLCGMREM

SEQ ID NO: 606488 - protein, 9 aa, Homo Sapiens
YEETKKETV

SEQ ID NO: 606489 - protein, 9 aa, Homo Sapiens
KKETVEQLS

SEQ ID NO: 606490 - protein, 9 aa, Homo Sapiens
TSVANQKEV

SEQ ID NO: 606491 - protein, 9 aa, Homo Sapiens
RPPLTTTLP

SEQ ID NO: 606492 - protein, 9 aa, Homo Sapiens
VSVTDLVGG

SEQ ID NO: 606493 - protein, 9 aa, Homo Sapiens
EGTETSGDF

SEQ ID NO: 606494 - protein, 9 aa, Homo Sapiens
DEEEGKKDG

SEQ ID NO: 606495 - protein, 9 aa, Homo Sapiens
STLSEGMNP

SEQ ID NO: 606496 - protein, 9 aa, Homo Sapiens
VTDLVGGKW

SEQ ID NO: 606497 - protein, 9 aa, Homo Sapiens
PETSVANQK

SEQ ID NO: 606498 - protein, 9 aa, Homo Sapiens
DTERYPQVR

SEQ ID NO: 606499 - protein, 9 aa, Homo Sapiens
SNSLPETSV

SEQ ID NO: 606500 - protein, 9 aa, Homo Sapiens
LLLIDLLWS

SEQ ID NO: 606501 - protein, 9 aa, Homo Sapiens
MDDTERYPQ

SEQ ID NO: 606502 - protein, 9 aa, Homo Sapiens
TGELCDAIF

SEQ ID NO: 606503 - protein, 9 aa, Homo Sapiens
FAVEEKVSY

SEQ ID NO: 606504 - protein, 9 aa, Homo Sapiens
DLLWSVKAS

SEQ ID NO: 606505 - protein, 9 aa, Homo Sapiens
NNPFLMDDT

SEQ ID NO: 606506 - protein, 9 aa, Homo Sapiens
REIQTAQFN

SEQ ID NO: 606507 - protein, 9 aa, Homo Sapiens
LPETSVANQ

SEQ ID NO: 606508 - protein, 9 aa, Homo Sapiens
FSGVIAIAT

SEQ ID NO: 606509 - protein, 9 aa, Homo Sapiens
YVDGKREIQ

SEQ ID NO: 606510 - protein, 9 aa, Homo Sapiens
AIATFLTVI

SEQ ID NO: 606511 - protein, 9 aa, Homo Sapiens
GGLLLLIDL

SEQ ID NO: 606512 - protein, 9 aa, Homo Sapiens
TPSFPSSVL

SEQ ID NO: 606513 - protein, 9 aa, Homo Sapiens
SGVIAIATF

SEQ ID NO: 606514 - protein, 9 aa, Homo Sapiens
TTVSEASLI

SEQ ID NO: 606515 - protein, 9 aa, Homo Sapiens
ADSGVVEAD

SEQ ID NO: 606516 - protein, 9 aa, Homo Sapiens
SVTDLVGGK

SEQ ID NO: 606517 - protein, 9 aa, Homo Sapiens
LCDAIFAVE

SEQ ID NO: 606518 - protein, 9 aa, Homo Sapiens
KNSGSKGTK

SEQ ID NO: 606519 - protein, 9 aa, Homo Sapiens
LIDLLWSVK

SEQ ID NO: 606520 - protein, 9 aa, Homo Sapiens
LLTHSRPPL

SEQ ID NO: 606521 - protein, 9 aa, Homo Sapiens
ETSVANQKE

SEQ ID NO: 606522 - protein, 9 aa, Homo Sapiens
EETKKETVE

SEQ ID NO: 606523 - protein, 9 aa, Homo Sapiens
SEGMNPLTS

SEQ ID NO: 606524 - protein, 9 aa, Homo Sapiens
LLLLIDLLW

SEQ ID NO: 606525 - protein, 9 aa, Homo Sapiens
EEGKKDGDK

SEQ ID NO: 606526 - protein, 9 aa, Homo Sapiens
TVSEASLIG

SEQ ID NO: 606527 - protein, 9 aa, Homo Sapiens
KKTPSFPSS

SEQ ID NO: 606528 - protein, 9 aa, Homo Sapiens
TYNTTVSEA

SEQ ID NO: 606529 - protein, 9 aa, Homo Sapiens
SVANQKEVL

SEQ ID NO: 606530 - protein, 9 aa, Homo Sapiens
TDLVGGKWI

SEQ ID NO: 606531 - protein, 9 aa, Homo Sapiens
LVGGKWIFG

SEQ ID NO: 606532 - protein, 9 aa, Homo Sapiens
GKREIQTAQ

SEQ ID NO: 606533 - protein, 9 aa, Homo Sapiens
DARWMAGCR

SEQ ID NO: 606534 - protein, 9 aa, Homo Sapiens
LTFSGVIAI

SEQ ID NO: 606535 - protein, 9 aa, Homo Sapiens
VEQLSEFND

SEQ ID NO: 606536 - protein, 9 aa, Homo Sapiens
GVIAIATFL

SEQ ID NO: 606537 - protein, 9 aa, Homo Sapiens
KPLLTHSRP

SEQ ID NO: 606538 - protein, 9 aa, Homo Sapiens
QPTYNTTVS

SEQ ID NO: 606539 - protein, 9 aa, Homo Sapiens
IDLLWSVKA

SEQ ID NO: 606540 - protein, 9 aa, Homo Sapiens
STVYVDGKR

SEQ ID NO: 606541 - protein, 9 aa, Homo Sapiens
YNTTVSEAS

SEQ ID NO: 606542 - protein, 9 aa, Homo Sapiens
MNPLTSTPV

SEQ ID NO: 606543 - protein, 9 aa, Homo Sapiens
PLLTHSRPP

SEQ ID NO: 606544 - protein, 9 aa, Homo Sapiens
TERYPQVRS

SEQ ID NO: 606545 - protein, 9 aa, Homo Sapiens
SVKKNSGSK

SEQ ID NO: 606546 - protein, 9 aa, Homo Sapiens
IAIATFLTV

SEQ ID NO: 606547 - protein, 9 aa, Homo Sapiens
QDARWMAGC

SEQ ID NO: 606548 - protein, 9 aa, Homo Sapiens
NTTVSEASL

SEQ ID NO: 606549 - protein, 9 aa, Homo Sapiens
IATFLTVII

SEQ ID NO: 606550 - protein, 9 aa, Homo Sapiens
CDAIFAVEE

SEQ ID NO: 606551 - protein, 9 aa, Homo Sapiens
QQDARWMAG

SEQ ID NO: 606552 - protein, 9 aa, Homo Sapiens
TVEQLSEFN

SEQ ID NO: 606553 - protein, 9 aa, Homo Sapiens
HSRPPLTTT

SEQ ID NO: 606554 - protein, 9 aa, Homo Sapiens
REMRAGGCC

SEQ ID NO: 606555 - protein, 9 aa, Homo Sapiens
VGSDEEEGK

SEQ ID NO: 606556 - protein, 9 aa, Homo Sapiens
DGKREIQTA

SEQ ID NO: 606557 - protein, 9 aa, Homo Sapiens
TLSEGMNPL

SEQ ID NO: 606558 - protein, 9 aa, Homo Sapiens
LLIDLLWSV

SEQ ID NO: 606559 - protein, 9 aa, Homo Sapiens
EMRAGGCCH

SEQ ID NO: 606560 - protein, 9 aa, Homo Sapiens
SRPPLTTTL

SEQ ID NO: 606561 - protein, 9 aa, Homo Sapiens
KREIQTAQF

SEQ ID NO: 606562 - protein, 9 aa, Homo Sapiens
GMNPLTSTP

SEQ ID NO: 606563 - protein, 9 aa, Homo Sapiens
GVVEADTRS

SEQ ID NO: 606564 - protein, 9 aa, Homo Sapiens
GSVKKNSGS

SEQ ID NO: 606565 - protein, 9 aa, Homo Sapiens
GSDEEEGKK

SEQ ID NO: 606566 - protein, 9 aa, Homo Sapiens
KNLKKTPSF

SEQ ID NO: 606567 - protein, 9 aa, Homo Sapiens
IKNLKKTPS

SEQ ID NO: 606568 - protein, 9 aa, Homo Sapiens
ETVEQLSEF

SEQ ID NO: 606569 - protein, 9 aa, Homo Sapiens
GMREMRAGG

SEQ ID NO: 606570 - protein, 9 aa, Homo Sapiens
NPLTSTPVS

SEQ ID NO: 606571 - protein, 9 aa, Homo Sapiens
LKKTPSFPS

SEQ ID NO: 606572 - protein, 9 aa, Homo Sapiens
MREMRAGGC

SEQ ID NO: 606573 - protein, 9 aa, Homo Sapiens
DSGVVEADT

SEQ ID NO: 606574 - protein, 9 aa, Homo Sapiens
NLKKTPSFP

SEQ ID NO: 606575 - protein, 9 aa, Homo Sapiens
VKKNSGSKG

SEQ ID NO: 606576 - protein, 9 aa, Homo Sapiens
EQQDARWMA

SEQ ID NO: 606577 - protein, 9 aa, Homo Sapiens
ESAADSGVV

SEQ ID NO: 606578 - protein, 9 aa, Homo Sapiens
VGGKWIFGH

SEQ ID NO: 606579 - protein, 9 aa, Homo Sapiens
SAADSGVVE

SEQ ID NO: 606580 - protein, 9 aa, Homo Sapiens
TSGDFQLLS

SEQ ID NO: 606581 - protein, 9 aa, Homo Sapiens
RCQDEQQDA

SEQ ID NO: 606582 - protein, 9 aa, Homo Sapiens
FVSVTDLVG

SEQ ID NO: 606583 - protein, 9 aa, Homo Sapiens
KETVEQLSE

SEQ ID NO: 606584 - protein, 9 aa, Homo Sapiens
TETSGDFQL

SEQ ID NO: 606585 - protein, 9 aa, Homo Sapiens
NSGSKGTKK

SEQ ID NO: 606586 - protein, 9 aa, Homo Sapiens
KTPSFPSSV

SEQ ID NO: 606587 - protein, 9 aa, Homo Sapiens
PFLMDDTER

SEQ ID NO: 606588 - protein, 9 aa, Homo Sapiens
ETSGDFQLL

SEQ ID NO: 606589 - protein, 9 aa, Homo Sapiens
EEEGKKDGD

SEQ ID NO: 606590 - protein, 9 aa, Homo Sapiens
QGSVKKNSG

SEQ ID NO: 606591 - protein, 9 aa, Homo Sapiens
DQGSVKKNS

SEQ ID NO: 606592 - protein, 9 aa, Homo Sapiens
ELCDAIFAV

SEQ ID NO: 606593 - protein, 9 aa, Homo Sapiens
GKKDGDKKK

SEQ ID NO: 606594 - protein, 9 aa, Homo Sapiens
GLLLLIDLL

SEQ ID NO: 606595 - protein, 9 aa, Homo Sapiens
KKNSGSKGT

SEQ ID NO: 606596 - protein, 9 aa, Homo Sapiens
VVEADTRSS

SEQ ID NO: 606597 - protein, 9 aa, Homo Sapiens
AGGLLLLID

SEQ ID NO: 606598 - protein, 9 aa, Homo Sapiens
SDEEEGKKD

SEQ ID NO: 606599 - protein, 9 aa, Homo Sapiens
VANQKEVLL

SEQ ID NO: 606600 - protein, 9 aa, Homo Sapiens
GTETSGDFQ

SEQ ID NO: 606601 - protein, 9 aa, Homo Sapiens
VSEASLIGT

SEQ ID NO: 606602 - protein, 9 aa, Homo Sapiens
DLVGGKWIF

SEQ ID NO: 606603 - protein, 9 aa, Homo Sapiens
LTHSRPPLT

SEQ ID NO: 606604 - protein, 9 aa, Homo Sapiens
QDEQQDARW

SEQ ID NO: 606605 - protein, 9 aa, Homo Sapiens
CQDEQQDAR

SEQ ID NO: 606606 - protein, 9 aa, Homo Sapiens
TVYVDGKRE

SEQ ID NO: 606607 - protein, 9 aa, Homo Sapiens
LRCQDEQQD

SEQ ID NO: 606608 - protein, 9 aa, Homo Sapiens
LSEGMNPLT

SEQ ID NO: 606609 - protein, 9 aa, Homo Sapiens
FLMDDTERY

SEQ ID NO: 606610 - protein, 9 aa, Homo Sapiens
TFSGVIAIA

SEQ ID NO: 606611 - protein, 9 aa, Homo Sapiens
CGMREMRAG

SEQ ID NO: 606612 - protein, 9 aa, Homo Sapiens
SLPETSVAN

SEQ ID NO: 606613 - protein, 9 aa, Homo Sapiens
DQPTYNTTV

SEQ ID NO: 606614 - protein, 9 aa, Homo Sapiens
PTYNTTVSE

SEQ ID NO: 606615 - protein, 9 aa, Homo Sapiens
NPFLMDDTE

SEQ ID NO: 606616 - protein, 9 aa, Homo Sapiens
PDQGSVKKN

SEQ ID NO: 606617 - protein, 9 aa, Homo Sapiens
DEQQDARWM

SEQ ID NO: 606618 - protein, 9 aa, Homo Sapiens
DDTERYPQV

SEQ ID NO: 606619 - protein, 9 aa, Homo Sapiens
PFVSVTDLV

SEQ ID NO: 606620 - protein, 9 aa, Homo Sapiens
AIFAVEEKV

SEQ ID NO: 606621 - protein, 9 aa, Homo Sapiens
DVGSDEEEG

SEQ ID NO: 606622 - protein, 9 aa, Homo Sapiens
LMDDTERYP

SEQ ID NO: 606623 - protein, 9 aa, Homo Sapiens
MLFFLGFAI

SEQ ID NO: 606624 - protein, 9 aa, Homo Sapiens
FASVVSSAP

SEQ ID NO: 606625 - protein, 9 aa, Homo Sapiens
LYLLGRNAA

SEQ ID NO: 606626 - protein, 9 aa, Homo Sapiens
GRRSVPEGP

SEQ ID NO: 606627 - protein, 9 aa, Homo Sapiens
VLPFAEHLQ

SEQ ID NO: 606628 - protein, 9 aa, Homo Sapiens
VVFSTPAQL

SEQ ID NO: 606629 - protein, 9 aa, Homo Sapiens
ILGGPGEPG

SEQ ID NO: 606630 - protein, 9 aa, Homo Sapiens
HGVYMWPDG

SEQ ID NO: 606631 - protein, 9 aa, Homo Sapiens
GHLSVLEIL

SEQ ID NO: 606632 - protein, 9 aa, Homo Sapiens
NTNKITGFL

SEQ ID NO: 606633 - protein, 9 aa, Homo Sapiens
QILGGPGEP

SEQ ID NO: 606634 - protein, 9 aa, Homo Sapiens
LTPELSPEL

SEQ ID NO: 606635 - protein, 9 aa, Homo Sapiens
APVPGVAQR

SEQ ID NO: 606636 - protein, 9 aa, Homo Sapiens
GSYHPGVFC

SEQ ID NO: 606637 - protein, 9 aa, Homo Sapiens
APVGRRSVP

SEQ ID NO: 606638 - protein, 9 aa, Homo Sapiens
YHPGVFCGD

SEQ ID NO: 606639 - protein, 9 aa, Homo Sapiens
SRATIQEQG

SEQ ID NO: 606640 - protein, 9 aa, Homo Sapiens
SRATRDNPR

SEQ ID NO: 606641 - protein, 9 aa, Homo Sapiens
FQILGGPGE

SEQ ID NO: 606642 - protein, 9 aa, Homo Sapiens
GKGMQTRQR

SEQ ID NO: 606643 - protein, 9 aa, Homo Sapiens
GAVLGRPLV

SEQ ID NO: 606644 - protein, 9 aa, Homo Sapiens
TCGKGMQTR

SEQ ID NO: 606645 - protein, 9 aa, Homo Sapiens
MSKIEEKKG

SEQ ID NO: 606646 - protein, 9 aa, Homo Sapiens
LKKTSARKH

SEQ ID NO: 606647 - protein, 9 aa, Homo Sapiens
SVLVAREDV

SEQ ID NO: 606648 - protein, 9 aa, Homo Sapiens
VFSTPAQLI

SEQ ID NO: 606649 - protein, 9 aa, Homo Sapiens
FASIVVVLW

SEQ ID NO: 606650 - protein, 9 aa, Homo Sapiens
QMGVLKEWT

SEQ ID NO: 606651 - protein, 9 aa, Homo Sapiens
SSGPRLPAS

SEQ ID NO: 606652 - protein, 9 aa, Homo Sapiens
FNCCALQML

SEQ ID NO: 606653 - protein, 9 aa, Homo Sapiens
RRSVPEGPF

SEQ ID NO: 606654 - protein, 9 aa, Homo Sapiens
LTFNTNKIT

SEQ ID NO: 606655 - protein, 9 aa, Homo Sapiens
VYMWPDGSM

SEQ ID NO: 606656 - protein, 9 aa, Homo Sapiens
GMQTRQRML

SEQ ID NO: 606657 - protein, 9 aa, Homo Sapiens
AAPVGRRSV

SEQ ID NO: 606658 - protein, 9 aa, Homo Sapiens
FTFPGRDSR

SEQ ID NO: 606659 - protein, 9 aa, Homo Sapiens
ASQIVAVKA

SEQ ID NO: 606660 - protein, 9 aa, Homo Sapiens
LPFAEHLQL

SEQ ID NO: 606661 - protein, 9 aa, Homo Sapiens
IFASVVSSA

SEQ ID NO: 606662 - protein, 9 aa, Homo Sapiens
TPELSPELA

SEQ ID NO: 606663 - protein, 9 aa, Homo Sapiens
CSMQQGKTA

SEQ ID NO: 606664 - protein, 9 aa, Homo Sapiens
NLTPELSPE

SEQ ID NO: 606665 - protein, 9 aa, Homo Sapiens
HSVLVARED

SEQ ID NO: 606666 - protein, 9 aa, Homo Sapiens
PGRDSRATI

SEQ ID NO: 606667 - protein, 9 aa, Homo Sapiens
QQVCQEMEL

SEQ ID NO: 606668 - protein, 9 aa, Homo Sapiens
GRDSRATIQ

SEQ ID NO: 606669 - protein, 9 aa, Homo Sapiens
PLVSRIIIA

SEQ ID NO: 606670 - protein, 9 aa, Homo Sapiens
GPRLPASQI

SEQ ID NO: 606671 - protein, 9 aa, Homo Sapiens
PQMGVLKEW

SEQ ID NO: 606672 - protein, 9 aa, Homo Sapiens
AGPVVFSTP

SEQ ID NO: 606673 - protein, 9 aa, Homo Sapiens
MQQGKTAAS

SEQ ID NO: 606674 - protein, 9 aa, Homo Sapiens
VVSSAPVRA

SEQ ID NO: 606675 - protein, 9 aa, Homo Sapiens
VFLYLLGRN

SEQ ID NO: 606676 - protein, 9 aa, Homo Sapiens
PPPQQVRSS

SEQ ID NO: 606677 - protein, 9 aa, Homo Sapiens
RSVPEGPFP

SEQ ID NO: 606678 - protein, 9 aa, Homo Sapiens
SVLEILVTT

SEQ ID NO: 606679 - protein, 9 aa, Homo Sapiens
NGLEENFCH

SEQ ID NO: 606680 - protein, 9 aa, Homo Sapiens
YRIWKDVGC

SEQ ID NO: 606681 - protein, 9 aa, Homo Sapiens
LFFLGFAIT

SEQ ID NO: 606682 - protein, 9 aa, Homo Sapiens
PVGRRSVPE

SEQ ID NO: 606683 - protein, 9 aa, Homo Sapiens
KTAASYGNV

SEQ ID NO: 606684 - protein, 9 aa, Homo Sapiens
LQMLFFLGF

SEQ ID NO: 606685 - protein, 9 aa, Homo Sapiens
KGMQTRQRM

SEQ ID NO: 606686 - protein, 9 aa, Homo Sapiens
VPQSSNMSL

SEQ ID NO: 606687 - protein, 9 aa, Homo Sapiens
EKKKQIQQV

SEQ ID NO: 606688 - protein, 9 aa, Homo Sapiens
HRRIHTGEN

SEQ ID NO: 606689 - protein, 9 aa, Homo Sapiens
SNMSLASFC

SEQ ID NO: 606690 - protein, 9 aa, Homo Sapiens
NHGVYMWPD

SEQ ID NO: 606691 - protein, 9 aa, Homo Sapiens
PAKYSVALN

SEQ ID NO: 606692 - protein, 9 aa, Homo Sapiens
LSPELAKKS

SEQ ID NO: 606693 - protein, 9 aa, Homo Sapiens
ATLTFNTNK

SEQ ID NO: 606694 - protein, 9 aa, Homo Sapiens
SNLTPELSP

SEQ ID NO: 606695 - protein, 9 aa, Homo Sapiens
FREEKDHSN

SEQ ID NO: 606696 - protein, 9 aa, Homo Sapiens
EEVLPFAEH

SEQ ID NO: 606697 - protein, 9 aa, Homo Sapiens
SFREEKDHS

SEQ ID NO: 606698 - protein, 9 aa, Homo Sapiens
FCHNPDGDP

SEQ ID NO: 606699 - protein, 9 aa, Homo Sapiens
TGENPYECQ

SEQ ID NO: 606700 - protein, 9 aa, Homo Sapiens
KIEEKKGIR

SEQ ID NO: 606701 - protein, 9 aa, Homo Sapiens
VLWADLIIC

SEQ ID NO: 606702 - protein, 9 aa, Homo Sapiens
EAFPSWSSH

SEQ ID NO: 606703 - protein, 9 aa, Homo Sapiens
SSTAGSEGG

SEQ ID NO: 606704 - protein, 9 aa, Homo Sapiens
GGAVLGRPL

SEQ ID NO: 606705 - protein, 9 aa, Homo Sapiens
FSHKQPSRS

SEQ ID NO: 606706 - protein, 9 aa, Homo Sapiens
VLEILVTTI

SEQ ID NO: 606707 - protein, 9 aa, Homo Sapiens
VRCTKEMEG

SEQ ID NO: 606708 - protein, 9 aa, Homo Sapiens
ENFCHNPDG

SEQ ID NO: 606709 - protein, 9 aa, Homo Sapiens
PASQIVAVK

SEQ ID NO: 606710 - protein, 9 aa, Homo Sapiens
HNPDGDPGG

SEQ ID NO: 606711 - protein, 9 aa, Homo Sapiens
SAPQMGVLK

SEQ ID NO: 606712 - protein, 9 aa, Homo Sapiens
RKHQQYDCK

SEQ ID NO: 606713 - protein, 9 aa, Homo Sapiens
MSNLTPELS

SEQ ID NO: 606714 - protein, 9 aa, Homo Sapiens
VLVAREDVR

SEQ ID NO: 606715 - protein, 9 aa, Homo Sapiens
VEVPQSSNM

SEQ ID NO: 606716 - protein, 9 aa, Homo Sapiens
EKPAKYSVA

SEQ ID NO: 606717 - protein, 9 aa, Homo Sapiens
KPTEKPAKY

SEQ ID NO: 606718 - protein, 9 aa, Homo Sapiens
SATLTFNTN

SEQ ID NO: 606719 - protein, 9 aa, Homo Sapiens
AKLKKTSAR

SEQ ID NO: 606720 - protein, 9 aa, Homo Sapiens
QMLFFLGFA

SEQ ID NO: 606721 - protein, 9 aa, Homo Sapiens
IRLLGGFQI

SEQ ID NO: 606722 - protein, 9 aa, Homo Sapiens
QKPTEKPAK

SEQ ID NO: 606723 - protein, 9 aa, Homo Sapiens
QLTATVRCT

SEQ ID NO: 606724 - protein, 9 aa, Homo Sapiens
NPYECQDCG

SEQ ID NO: 606725 - protein, 9 aa, Homo Sapiens
FPSWSSHSP

SEQ ID NO: 606726 - protein, 9 aa, Homo Sapiens
VQVFLYLLG

SEQ ID NO: 606727 - protein, 9 aa, Homo Sapiens
LVQVFLYLL

SEQ ID NO: 606728 - protein, 9 aa, Homo Sapiens
KQIQQVCQE

SEQ ID NO: 606729 - protein, 9 aa, Homo Sapiens
GVYMWPDGS

SEQ ID NO: 606730 - protein, 9 aa, Homo Sapiens
CCALQMLFF

SEQ ID NO: 606731 - protein, 9 aa, Homo Sapiens
IWKDVGCNR

SEQ ID NO: 606732 - protein, 9 aa, Homo Sapiens
GFQILGGPG

SEQ ID NO: 606733 - protein, 9 aa, Homo Sapiens
TAASYGNVI

SEQ ID NO: 606734 - protein, 9 aa, Homo Sapiens
GKTAASYGN

SEQ ID NO: 606735 - protein, 9 aa, Homo Sapiens
RSFREEKDH

SEQ ID NO: 606736 - protein, 9 aa, Homo Sapiens
QRGVSLQPG

SEQ ID NO: 606737 - protein, 9 aa, Homo Sapiens
PVVFSTPAQ

SEQ ID NO: 606738 - protein, 9 aa, Homo Sapiens
QIQQVCQEM

SEQ ID NO: 606739 - protein, 9 aa, Homo Sapiens
FLYLLGRNA

SEQ ID NO: 606740 - protein, 9 aa, Homo Sapiens
RGVSLQPGT

SEQ ID NO: 606741 - protein, 9 aa, Homo Sapiens
VEKKKQIQQ

SEQ ID NO: 606742 - protein, 9 aa, Homo Sapiens
SKIEEKKGI

SEQ ID NO: 606743 - protein, 9 aa, Homo Sapiens
ARKHQQYDC

SEQ ID NO: 606744 - protein, 9 aa, Homo Sapiens
FSTPAQLIA

SEQ ID NO: 606745 - protein, 9 aa, Homo Sapiens
HPGVFCGDK

SEQ ID NO: 606746 - protein, 9 aa, Homo Sapiens
LTATVRCTK

SEQ ID NO: 606747 - protein, 9 aa, Homo Sapiens
AFPSWSSHS

SEQ ID NO: 606748 - protein, 9 aa, Homo Sapiens
EHLQLLSGH

SEQ ID NO: 606749 - protein, 9 aa, Homo Sapiens
PGVFCGDKW

SEQ ID NO: 606750 - protein, 9 aa, Homo Sapiens
SHKQPSRSH

SEQ ID NO: 606751 - protein, 9 aa, Homo Sapiens
AEHLQLLSG

SEQ ID NO: 606752 - protein, 9 aa, Homo Sapiens
SDWVIHTCM

SEQ ID NO: 606753 - protein, 9 aa, Homo Sapiens
ENPYECQDC

SEQ ID NO: 606754 - protein, 9 aa, Homo Sapiens
HSPQERSRV

SEQ ID NO: 606755 - protein, 9 aa, Homo Sapiens
SGSGGRLAL

SEQ ID NO: 606756 - protein, 9 aa, Homo Sapiens
TSARKHQQY

SEQ ID NO: 606757 - protein, 9 aa, Homo Sapiens
KLKKTSARK

SEQ ID NO: 606758 - protein, 9 aa, Homo Sapiens
QVCQEMELK

SEQ ID NO: 606759 - protein, 9 aa, Homo Sapiens
TATVRCTKE

SEQ ID NO: 606760 - protein, 9 aa, Homo Sapiens
PFAEHLQLL

SEQ ID NO: 606761 - protein, 9 aa, Homo Sapiens
GRPLVSRII

SEQ ID NO: 606762 - protein, 9 aa, Homo Sapiens
CGKGMQTRQ

SEQ ID NO: 606763 - protein, 9 aa, Homo Sapiens
NFCHNPDGD

SEQ ID NO: 606764 - protein, 9 aa, Homo Sapiens
APQMGVLKE

SEQ ID NO: 606765 - protein, 9 aa, Homo Sapiens
NKITGFLKP

SEQ ID NO: 606766 - protein, 9 aa, Homo Sapiens
PHLIFASVV

SEQ ID NO: 606767 - protein, 9 aa, Homo Sapiens
VPMNHGVYM

SEQ ID NO: 606768 - protein, 9 aa, Homo Sapiens
DHSNKAEKE

SEQ ID NO: 606769 - protein, 9 aa, Homo Sapiens
GFTFPGRDS

SEQ ID NO: 606770 - protein, 9 aa, Homo Sapiens
DWVIHTCMA

SEQ ID NO: 606771 - protein, 9 aa, Homo Sapiens
PQQVRSSTA

SEQ ID NO: 606772 - protein, 9 aa, Homo Sapiens
PSWSSHSPQ

SEQ ID NO: 606773 - protein, 9 aa, Homo Sapiens
YFFLGHLSV

SEQ ID NO: 606774 - protein, 9 aa, Homo Sapiens
LIFASVVSS

SEQ ID NO: 606775 - protein, 9 aa, Homo Sapiens
PESGSGGRL

SEQ ID NO: 606776 - protein, 9 aa, Homo Sapiens
LVAREDVRE

SEQ ID NO: 606777 - protein, 9 aa, Homo Sapiens
GGSQPESGS

SEQ ID NO: 606778 - protein, 9 aa, Homo Sapiens
EENFCHNPD

SEQ ID NO: 606779 - protein, 9 aa, Homo Sapiens
SMQQGKTAA

SEQ ID NO: 606780 - protein, 9 aa, Homo Sapiens
EVLPFAEHL

SEQ ID NO: 606781 - protein, 9 aa, Homo Sapiens
TFNTNKITG

SEQ ID NO: 606782 - protein, 9 aa, Homo Sapiens
DHSVLVARE

SEQ ID NO: 606783 - protein, 9 aa, Homo Sapiens
ASIVVVLWA

SEQ ID NO: 606784 - protein, 9 aa, Homo Sapiens
NCCALQMLF

SEQ ID NO: 606785 - protein, 9 aa, Homo Sapiens
SARKHQQYD

SEQ ID NO: 606786 - protein, 9 aa, Homo Sapiens
QSSNMSLAS

SEQ ID NO: 606787 - protein, 9 aa, Homo Sapiens
QTRQRMLKS

SEQ ID NO: 606788 - protein, 9 aa, Homo Sapiens
PRLPASQIV

SEQ ID NO: 606789 - protein, 9 aa, Homo Sapiens
HLSVLEILV

SEQ ID NO: 606790 - protein, 9 aa, Homo Sapiens
SGPRLPASQ

SEQ ID NO: 606791 - protein, 9 aa, Homo Sapiens
LEENFCHNP

SEQ ID NO: 606792 - protein, 9 aa, Homo Sapiens
TGGAVLGRP

SEQ ID NO: 606793 - protein, 9 aa, Homo Sapiens
WVIHTCMAA

SEQ ID NO: 606794 - protein, 9 aa, Homo Sapiens
RLPASQIVA

SEQ ID NO: 606795 - protein, 9 aa, Homo Sapiens
RIWKDVGCN

SEQ ID NO: 606796 - protein, 9 aa, Homo Sapiens
WKDVGCNRF

SEQ ID NO: 606797 - protein, 9 aa, Homo Sapiens
FVGSAPQMG

SEQ ID NO: 606798 - protein, 9 aa, Homo Sapiens
DCSMQQGKT

SEQ ID NO: 606799 - protein, 9 aa, Homo Sapiens
SQPESGSGG

SEQ ID NO: 606800 - protein, 9 aa, Homo Sapiens
FVCKSSDWV

SEQ ID NO: 606801 - protein, 9 aa, Homo Sapiens
QGKTAASYG

SEQ ID NO: 606802 - protein, 9 aa, Homo Sapiens
SSHSPQERS

SEQ ID NO: 606803 - protein, 9 aa, Homo Sapiens
AANDDHSVL

SEQ ID NO: 606804 - protein, 9 aa, Homo Sapiens
SVVSSAPVR

SEQ ID NO: 606805 - protein, 9 aa, Homo Sapiens
TFPGRDSRA

SEQ ID NO: 606806 - protein, 9 aa, Homo Sapiens
GGFQILGGP

SEQ ID NO: 606807 - protein, 9 aa, Homo Sapiens
RSSTAGSEG

SEQ ID NO: 606808 - protein, 9 aa, Homo Sapiens
VGSAPQMGV

SEQ ID NO: 606809 - protein, 9 aa, Homo Sapiens
AQRGVSLQP

SEQ ID NO: 606810 - protein, 9 aa, Homo Sapiens
LSVLEILVT

SEQ ID NO: 606811 - protein, 9 aa, Homo Sapiens
IQDQLTATV

SEQ ID NO: 606812 - protein, 9 aa, Homo Sapiens
SQIVAVKAP

SEQ ID NO: 606813 - protein, 9 aa, Homo Sapiens
STAGSEGGF

SEQ ID NO: 606814 - protein, 9 aa, Homo Sapiens
VVLWADLII

SEQ ID NO: 606815 - protein, 9 aa, Homo Sapiens
FAEHLQLLS

SEQ ID NO: 606816 - protein, 9 aa, Homo Sapiens
CHNPDGDPG

SEQ ID NO: 606817 - protein, 9 aa, Homo Sapiens
PELSPELAK

SEQ ID NO: 606818 - protein, 9 aa, Homo Sapiens
KSSDWVIHT

SEQ ID NO: 606819 - protein, 9 aa, Homo Sapiens
ESGSGGRLA

SEQ ID NO: 606820 - protein, 9 aa, Homo Sapiens
VLGRPLVSR

SEQ ID NO: 606821 - protein, 9 aa, Homo Sapiens
KKKQIQQVC

SEQ ID NO: 606822 - protein, 9 aa, Homo Sapiens
SSNMSLASF

SEQ ID NO: 606823 - protein, 9 aa, Homo Sapiens
REEKDHSNK

SEQ ID NO: 606824 - protein, 9 aa, Homo Sapiens
ASVVSSAPV

SEQ ID NO: 606825 - protein, 9 aa, Homo Sapiens
KPAKYSVAL

SEQ ID NO: 606826 - protein, 9 aa, Homo Sapiens
RLLGGFQIL

SEQ ID NO: 606827 - protein, 9 aa, Homo Sapiens
SYHPGVFCG

SEQ ID NO: 606828 - protein, 9 aa, Homo Sapiens
HLQLLSGHP

SEQ ID NO: 606829 - protein, 9 aa, Homo Sapiens
LAGPVVFST

SEQ ID NO: 606830 - protein, 9 aa, Homo Sapiens
MGVLKEWTL

SEQ ID NO: 606831 - protein, 9 aa, Homo Sapiens
VPGVAQRGV

SEQ ID NO: 606832 - protein, 9 aa, Homo Sapiens
GRSQSFSHK

SEQ ID NO: 606833 - protein, 9 aa, Homo Sapiens
DNLAGPVVF

SEQ ID NO: 606834 - protein, 9 aa, Homo Sapiens
VGRRSVPEG

SEQ ID NO: 606835 - protein, 9 aa, Homo Sapiens
RDSRATIQE

SEQ ID NO: 606836 - protein, 9 aa, Homo Sapiens
QQVRSSTAG

SEQ ID NO: 606837 - protein, 9 aa, Homo Sapiens
TEKPAKYSV

SEQ ID NO: 606838 - protein, 9 aa, Homo Sapiens
VIHTCMAAK

SEQ ID NO: 606839 - protein, 9 aa, Homo Sapiens
KQPSRSHLM

SEQ ID NO: 606840 - protein, 9 aa, Homo Sapiens
QQGKTAASY

SEQ ID NO: 606841 - protein, 9 aa, Homo Sapiens
FNTNKITGF

SEQ ID NO: 606842 - protein, 9 aa, Homo Sapiens
FFASIVVVL

SEQ ID NO: 606843 - protein, 9 aa, Homo Sapiens
HKQPSRSHL

SEQ ID NO: 606844 - protein, 9 aa, Homo Sapiens
RRIHTGENP

SEQ ID NO: 606845 - protein, 9 aa, Homo Sapiens
FFLGHLSVL

SEQ ID NO: 606846 - protein, 9 aa, Homo Sapiens
ALQMLFFLG

SEQ ID NO: 606847 - protein, 9 aa, Homo Sapiens
SSDWVIHTC

SEQ ID NO: 606848 - protein, 9 aa, Homo Sapiens
HLLLYRIWK

SEQ ID NO: 606849 - protein, 9 aa, Homo Sapiens
SWSSHSPQE

SEQ ID NO: 606850 - protein, 9 aa, Homo Sapiens
LLYRIWKDV

SEQ ID NO: 606851 - protein, 9 aa, Homo Sapiens
KKQIQQVCQ

SEQ ID NO: 606852 - protein, 9 aa, Homo Sapiens
PPQQVRSST

SEQ ID NO: 606853 - protein, 9 aa, Homo Sapiens
KKTSARKHQ

SEQ ID NO: 606854 - protein, 9 aa, Homo Sapiens
KDHSNKAEK

SEQ ID NO: 606855 - protein, 9 aa, Homo Sapiens
EKDHSNKAE

SEQ ID NO: 606856 - protein, 9 aa, Homo Sapiens
ELSPELAKK

SEQ ID NO: 606857 - protein, 9 aa, Homo Sapiens
LLGGFQILG

SEQ ID NO: 606858 - protein, 9 aa, Homo Sapiens
SHSPQERSR

SEQ ID NO: 606859 - protein, 9 aa, Homo Sapiens
SQSFSHKQP

SEQ ID NO: 606860 - protein, 9 aa, Homo Sapiens
TLTFNTNKI

SEQ ID NO: 606861 - protein, 9 aa, Homo Sapiens
LGGFQILGG

SEQ ID NO: 606862 - protein, 9 aa, Homo Sapiens
GSQPESGSG

SEQ ID NO: 606863 - protein, 9 aa, Homo Sapiens
PGVAQRGVS

SEQ ID NO: 606864 - protein, 9 aa, Homo Sapiens
EVPQSSNMS

SEQ ID NO: 606865 - protein, 9 aa, Homo Sapiens
CKSSDWVIH

SEQ ID NO: 606866 - protein, 9 aa, Homo Sapiens
ANDDHSVLV

SEQ ID NO: 606867 - protein, 9 aa, Homo Sapiens
AKYSVALNY

SEQ ID NO: 606868 - protein, 9 aa, Homo Sapiens
SIVVVLWAD

SEQ ID NO: 606869 - protein, 9 aa, Homo Sapiens
FPGRDSRAT

SEQ ID NO: 606870 - protein, 9 aa, Homo Sapiens
QPESGSGGR

SEQ ID NO: 606871 - protein, 9 aa, Homo Sapiens
RAAPVGRRS

SEQ ID NO: 606872 - protein, 9 aa, Homo Sapiens
PTEKPAKYS

SEQ ID NO: 606873 - protein, 9 aa, Homo Sapiens
YLLGRNAAL

SEQ ID NO: 606874 - protein, 9 aa, Homo Sapiens
LLGRNAALF

SEQ ID NO: 606875 - protein, 9 aa, Homo Sapiens
NLAGPVVFS

SEQ ID NO: 606876 - protein, 9 aa, Homo Sapiens
PMNHGVYMW

SEQ ID NO: 606877 - protein, 9 aa, Homo Sapiens
GFVGSAPQM

SEQ ID NO: 606878 - protein, 9 aa, Homo Sapiens
GHLLLYRIW

SEQ ID NO: 606879 - protein, 9 aa, Homo Sapiens
AVLGRPLVS

SEQ ID NO: 606880 - protein, 9 aa, Homo Sapiens
YMWPDGSMY

SEQ ID NO: 606881 - protein, 9 aa, Homo Sapiens
VRSSTAGSE

SEQ ID NO: 606882 - protein, 9 aa, Homo Sapiens
RSQSFSHKQ

SEQ ID NO: 606883 - protein, 9 aa, Homo Sapiens
TLVQVFLYL

SEQ ID NO: 606884 - protein, 9 aa, Homo Sapiens
LPASQIVAV

SEQ ID NO: 606885 - protein, 9 aa, Homo Sapiens
DDHSVLVAR

SEQ ID NO: 606886 - protein, 9 aa, Homo Sapiens
MNHGVYMWP

SEQ ID NO: 606887 - protein, 9 aa, Homo Sapiens
HSNKAEKER

SEQ ID NO: 606888 - protein, 9 aa, Homo Sapiens
RPLVSRIII

SEQ ID NO: 606889 - protein, 9 aa, Homo Sapiens
KTSARKHQQ

SEQ ID NO: 606890 - protein, 9 aa, Homo Sapiens
IVVVLWADL

SEQ ID NO: 606891 - protein, 9 aa, Homo Sapiens
IQQVCQEME

SEQ ID NO: 606892 - protein, 9 aa, Homo Sapiens
GENPYECQD

SEQ ID NO: 606893 - protein, 9 aa, Homo Sapiens
CALQMLFFL

SEQ ID NO: 606894 - protein, 9 aa, Homo Sapiens
GLEENFCHN

SEQ ID NO: 606895 - protein, 9 aa, Homo Sapiens
TVRCTKEME

SEQ ID NO: 606896 - protein, 9 aa, Homo Sapiens
LLLYRIWKD

SEQ ID NO: 606897 - protein, 9 aa, Homo Sapiens
GSAPQMGVL

SEQ ID NO: 606898 - protein, 9 aa, Homo Sapiens
DQLTATVRC

SEQ ID NO: 606899 - protein, 9 aa, Homo Sapiens
GVFCGDKWS

SEQ ID NO: 606900 - protein, 9 aa, Homo Sapiens
MQTRQRMLK

SEQ ID NO: 606901 - protein, 9 aa, Homo Sapiens
SRAAPVGRR

SEQ ID NO: 606902 - protein, 9 aa, Homo Sapiens
ATVRCTKEM

SEQ ID NO: 606903 - protein, 9 aa, Homo Sapiens
LYRIWKDVG

SEQ ID NO: 606904 - protein, 9 aa, Homo Sapiens
SFSHKQPSR

SEQ ID NO: 606905 - protein, 9 aa, Homo Sapiens
IEEKKGIRS

SEQ ID NO: 606906 - protein, 9 aa, Homo Sapiens
QDQLTATVR

SEQ ID NO: 606907 - protein, 9 aa, Homo Sapiens
PVPGVAQRG

SEQ ID NO: 606908 - protein, 9 aa, Homo Sapiens
QVFLYLLGR

SEQ ID NO: 606909 - protein, 9 aa, Homo Sapiens
WSSHSPQER

SEQ ID NO: 606910 - protein, 9 aa, Homo Sapiens
DSRATIQEQ

SEQ ID NO: 606911 - protein, 9 aa, Homo Sapiens
GVAQRGVSL

SEQ ID NO: 606912 - protein, 9 aa, Homo Sapiens
SVTCGKGMQ

SEQ ID NO: 606913 - protein, 9 aa, Homo Sapiens
VCKSSDWVI

SEQ ID NO: 606914 - protein, 9 aa, Homo Sapiens
QVRSSTAGS

SEQ ID NO: 606915 - protein, 9 aa, Homo Sapiens
EEKDHSNKA

SEQ ID NO: 606916 - protein, 9 aa, Homo Sapiens
LGGSQPESG

SEQ ID NO: 606917 - protein, 9 aa, Homo Sapiens
LWADLIICK

SEQ ID NO: 606918 - protein, 9 aa, Homo Sapiens
VAQRGVSLQ

SEQ ID NO: 606919 - protein, 9 aa, Homo Sapiens
EMSNLTPEL

SEQ ID NO: 606920 - protein, 9 aa, Homo Sapiens
FLGHLSVLE

SEQ ID NO: 606921 - protein, 9 aa, Homo Sapiens
VSSAPVRAV

SEQ ID NO: 606922 - protein, 9 aa, Homo Sapiens
GPVVFSTPA

SEQ ID NO: 606923 - protein, 9 aa, Homo Sapiens
QSFSHKQPS

SEQ ID NO: 606924 - protein, 9 aa, Homo Sapiens
NMSLASFCN

SEQ ID NO: 606925 - protein, 9 aa, Homo Sapiens
TNKITGFLK

SEQ ID NO: 606926 - protein, 9 aa, Homo Sapiens
NDDHSVLVA

SEQ ID NO: 606927 - protein, 9 aa, Homo Sapiens
KYSVALNYS

SEQ ID NO: 606928 - protein, 9 aa, Homo Sapiens
VVVLWADLI

SEQ ID NO: 606929 - protein, 9 aa, Homo Sapiens
MSLASFCNK

SEQ ID NO: 606930 - protein, 9 aa, Homo Sapiens
LGHLSVLEI

SEQ ID NO: 606931 - protein, 9 aa, Homo Sapiens
SLGGSQPES

SEQ ID NO: 606932 - protein, 9 aa, Homo Sapiens
MWPDGSMYE

SEQ ID NO: 606933 - protein, 9 aa, Homo Sapiens
PQSSNMSLA

SEQ ID NO: 606934 - protein, 9 aa, Homo Sapiens
VFCGDKWSC

SEQ ID NO: 606935 - protein, 9 aa, Homo Sapiens
LGRPLVSRI

SEQ ID NO: 606936 - protein, 9 aa, Homo Sapiens
VTCGKGMQT

SEQ ID NO: 606937 - protein, 9 aa, Homo Sapiens
HLIFASVVS

SEQ ID NO: 606938 - protein, 9 aa, Homo Sapiens
RFKEFQEDK

SEQ ID NO: 606939 - protein, 9 aa, Homo Sapiens
VHAPEVLLK

SEQ ID NO: 606940 - protein, 9 aa, Homo Sapiens
MAVVRIKYE

SEQ ID NO: 606941 - protein, 9 aa, Homo Sapiens
THTPTNYGN

SEQ ID NO: 606942 - protein, 9 aa, Homo Sapiens
ATKEPDITR

SEQ ID NO: 606943 - protein, 9 aa, Homo Sapiens
LLSILRIRF

SEQ ID NO: 606944 - protein, 9 aa, Homo Sapiens
FPDDMDLRV

SEQ ID NO: 606945 - protein, 9 aa, Homo Sapiens
QCINAGEHM

SEQ ID NO: 606946 - protein, 9 aa, Homo Sapiens
CNKNWNNLI

SEQ ID NO: 606947 - protein, 9 aa, Homo Sapiens
PSSRGAGLP

SEQ ID NO: 606948 - protein, 9 aa, Homo Sapiens
VFFRGWKLT

SEQ ID NO: 606949 - protein, 9 aa, Homo Sapiens
LLPGYYGLA

SEQ ID NO: 606950 - protein, 9 aa, Homo Sapiens
CQKAMQGLM

SEQ ID NO: 606951 - protein, 9 aa, Homo Sapiens
LVALYKYTK

SEQ ID NO: 606952 - protein, 9 aa, Homo Sapiens
TVPQDQRRN

SEQ ID NO: 606953 - protein, 9 aa, Homo Sapiens
LPFLHTHQV

SEQ ID NO: 606954 - protein, 9 aa, Homo Sapiens
SDDLKDAQE

SEQ ID NO: 606955 - protein, 9 aa, Homo Sapiens
QVLDEEGSE

SEQ ID NO: 606956 - protein, 9 aa, Homo Sapiens
GTPTLETAS

SEQ ID NO: 606957 - protein, 9 aa, Homo Sapiens
LGVPGSVAG

SEQ ID NO: 606958 - protein, 9 aa, Homo Sapiens
GVHIWDLQD

SEQ ID NO: 606959 - protein, 9 aa, Homo Sapiens
VVALVFISL

SEQ ID NO: 606960 - protein, 9 aa, Homo Sapiens
AMQGLMGRK

SEQ ID NO: 606961 - protein, 9 aa, Homo Sapiens
RLGVPGSVA

SEQ ID NO: 606962 - protein, 9 aa, Homo Sapiens
KDHLLAEET

SEQ ID NO: 606963 - protein, 9 aa, Homo Sapiens
PRTFCSQAL

SEQ ID NO: 606964 - protein, 9 aa, Homo Sapiens
LAFPDDMDL

SEQ ID NO: 606965 - protein, 9 aa, Homo Sapiens
TSLSIILLT

SEQ ID NO: 606966 - protein, 9 aa, Homo Sapiens
TPTLETASK

SEQ ID NO: 606967 - protein, 9 aa, Homo Sapiens
LKLHSHIKL

SEQ ID NO: 606968 - protein, 9 aa, Homo Sapiens
SQLLSRVWA

SEQ ID NO: 606969 - protein, 9 aa, Homo Sapiens
EHMKYGEQL

SEQ ID NO: 606970 - protein, 9 aa, Homo Sapiens
LLTLISYFW

SEQ ID NO: 606971 - protein, 9 aa, Homo Sapiens
GRLGVPGSV

SEQ ID NO: 606972 - protein, 9 aa, Homo Sapiens
GPVPMVGLG

SEQ ID NO: 606973 - protein, 9 aa, Homo Sapiens
TERSGINRQ

SEQ ID NO: 606974 - protein, 9 aa, Homo Sapiens
HIWDLQDRV

SEQ ID NO: 606975 - protein, 9 aa, Homo Sapiens
RPRTFCSQA

SEQ ID NO: 606976 - protein, 9 aa, Homo Sapiens
PVPGPVPMV

SEQ ID NO: 606977 - protein, 9 aa, Homo Sapiens
LVFFRGWKL

SEQ ID NO: 606978 - protein, 9 aa, Homo Sapiens
FLLVFFRGW

SEQ ID NO: 606979 - protein, 9 aa, Homo Sapiens
LIRYMDNNR

SEQ ID NO: 606980 - protein, 9 aa, Homo Sapiens
MVGLGSLCL

SEQ ID NO: 606981 - protein, 9 aa, Homo Sapiens
ALDMDRTKK

SEQ ID NO: 606982 - protein, 9 aa, Homo Sapiens
EKREPGTTA

SEQ ID NO: 606983 - protein, 9 aa, Homo Sapiens
NVATQGVHI

SEQ ID NO: 606984 - protein, 9 aa, Homo Sapiens
DDMDLRVYG

SEQ ID NO: 606985 - protein, 9 aa, Homo Sapiens
NAGEHMKYG

SEQ ID NO: 606986 - protein, 9 aa, Homo Sapiens
GINRQRSEM

SEQ ID NO: 606987 - protein, 9 aa, Homo Sapiens
QSIRCPCTT

SEQ ID NO: 606988 - protein, 9 aa, Homo Sapiens
CSQKDKRFK

SEQ ID NO: 606989 - protein, 9 aa, Homo Sapiens
SILRIRFLC

SEQ ID NO: 606990 - protein, 9 aa, Homo Sapiens
LAFSSVHAP

SEQ ID NO: 606991 - protein, 9 aa, Homo Sapiens
FYCVIREVI

SEQ ID NO: 606992 - protein, 9 aa, Homo Sapiens
KYSDDLKDA

SEQ ID NO: 606993 - protein, 9 aa, Homo Sapiens
RFNLMAVVR

SEQ ID NO: 606994 - protein, 9 aa, Homo Sapiens
REEKDHLLA

SEQ ID NO: 606995 - protein, 9 aa, Homo Sapiens
PETHTPTNY

SEQ ID NO: 606996 - protein, 9 aa, Homo Sapiens
VSEGAERPH

SEQ ID NO: 606997 - protein, 9 aa, Homo Sapiens
QSPDTTSRE

SEQ ID NO: 606998 - protein, 9 aa, Homo Sapiens
PFAVKSLTY

SEQ ID NO: 606999 - protein, 9 aa, Homo Sapiens
QKDKRFKEF

SEQ ID NO: 607000 - protein, 9 aa, Homo Sapiens
DELDKYSDD

SEQ ID NO: 607001 - protein, 9 aa, Homo Sapiens
WHKILPFFP

SEQ ID NO: 607002 - protein, 9 aa, Homo Sapiens
IGWQRRRQS

SEQ ID NO: 607003 - protein, 9 aa, Homo Sapiens
RELGVFWMG

SEQ ID NO: 607004 - protein, 9 aa, Homo Sapiens
QRRRQSIRC

SEQ ID NO: 607005 - protein, 9 aa, Homo Sapiens
YQITLREKM

SEQ ID NO: 607006 - protein, 9 aa, Homo Sapiens
LHSHIKLHS

SEQ ID NO: 607007 - protein, 9 aa, Homo Sapiens
AIHAKRVAI

SEQ ID NO: 607008 - protein, 9 aa, Homo Sapiens
KREPGTTAW

SEQ ID NO: 607009 - protein, 9 aa, Homo Sapiens
RFLCELVLF

SEQ ID NO: 607010 - protein, 9 aa, Homo Sapiens
SGFSSSAIF

SEQ ID NO: 607011 - protein, 9 aa, Homo Sapiens
PIIIGCHAY

SEQ ID NO: 607012 - protein, 9 aa, Homo Sapiens
IKLHSVVSE

SEQ ID NO: 607013 - protein, 9 aa, Homo Sapiens
SGINRQRSE

SEQ ID NO: 607014 - protein, 9 aa, Homo Sapiens
VKPIIIGCH

SEQ ID NO: 607015 - protein, 9 aa, Homo Sapiens
ESQSPDTTS

SEQ ID NO: 607016 - protein, 9 aa, Homo Sapiens
SPDTTSREP

SEQ ID NO: 607017 - protein, 9 aa, Homo Sapiens
ELDKYSDDL

SEQ ID NO: 607018 - protein, 9 aa, Homo Sapiens
CAIHAKRVA

SEQ ID NO: 607019 - protein, 9 aa, Homo Sapiens
EVIYPYVYE

SEQ ID NO: 607020 - protein, 9 aa, Homo Sapiens
RVAIMPKDI

SEQ ID NO: 607021 - protein, 9 aa, Homo Sapiens
KLHSHIKLH

SEQ ID NO: 607022 - protein, 9 aa, Homo Sapiens
HLLAEETAA

SEQ ID NO: 607023 - protein, 9 aa, Homo Sapiens
KLHSVVSEG

SEQ ID NO: 607024 - protein, 9 aa, Homo Sapiens
WQRRRQSIR

SEQ ID NO: 607025 - protein, 9 aa, Homo Sapiens
VPGPVPMVG

SEQ ID NO: 607026 - protein, 9 aa, Homo Sapiens
EPGTTAWQL

SEQ ID NO: 607027 - protein, 9 aa, Homo Sapiens
PQDQRRNEE

SEQ ID NO: 607028 - protein, 9 aa, Homo Sapiens
VVSEGAERP

SEQ ID NO: 607029 - protein, 9 aa, Homo Sapiens
EDELDKYSD

SEQ ID NO: 607030 - protein, 9 aa, Homo Sapiens
AKRVAIMPK

SEQ ID NO: 607031 - protein, 9 aa, Homo Sapiens
YCVIREVIY

SEQ ID NO: 607032 - protein, 9 aa, Homo Sapiens
ALVFISLSG

SEQ ID NO: 607033 - protein, 9 aa, Homo Sapiens
FFPPSINQT

SEQ ID NO: 607034 - protein, 9 aa, Homo Sapiens
SYHPGIFRG

SEQ ID NO: 607035 - protein, 9 aa, Homo Sapiens
PDTTSREPC

SEQ ID NO: 607036 - protein, 9 aa, Homo Sapiens
HMKYGEQLL

SEQ ID NO: 607037 - protein, 9 aa, Homo Sapiens
LVFISLSGF

SEQ ID NO: 607038 - protein, 9 aa, Homo Sapiens
QITLREKML

SEQ ID NO: 607039 - protein, 9 aa, Homo Sapiens
EPCNKNWNN

SEQ ID NO: 607040 - protein, 9 aa, Homo Sapiens
CNKDPFAVK

SEQ ID NO: 607041 - protein, 9 aa, Homo Sapiens
YLYCYKYQI

SEQ ID NO: 607042 - protein, 9 aa, Homo Sapiens
LETASKNHE

SEQ ID NO: 607043 - protein, 9 aa, Homo Sapiens
NNLISIQTL

SEQ ID NO: 607044 - protein, 9 aa, Homo Sapiens
DMDLRVYGP

SEQ ID NO: 607045 - protein, 9 aa, Homo Sapiens
RPHRHVVAL

SEQ ID NO: 607046 - protein, 9 aa, Homo Sapiens
RQSIRCPCT

SEQ ID NO: 607047 - protein, 9 aa, Homo Sapiens
CVIREVIYP

SEQ ID NO: 607048 - protein, 9 aa, Homo Sapiens
GWQRRRQSI

SEQ ID NO: 607049 - protein, 9 aa, Homo Sapiens
LYCYKYQIT

SEQ ID NO: 607050 - protein, 9 aa, Homo Sapiens
ILLTLISYF

SEQ ID NO: 607051 - protein, 9 aa, Homo Sapiens
SVVSEGAER

SEQ ID NO: 607052 - protein, 9 aa, Homo Sapiens
VPMVGLGSL

SEQ ID NO: 607053 - protein, 9 aa, Homo Sapiens
ETASKNHET

SEQ ID NO: 607054 - protein, 9 aa, Homo Sapiens
CSQALRAHL

SEQ ID NO: 607055 - protein, 9 aa, Homo Sapiens
NLMAVVRIK

SEQ ID NO: 607056 - protein, 9 aa, Homo Sapiens
VAIMPKDIQ

SEQ ID NO: 607057 - protein, 9 aa, Homo Sapiens
TPATKEPDI

SEQ ID NO: 607058 - protein, 9 aa, Homo Sapiens
LPWLHTLCS

SEQ ID NO: 607059 - protein, 9 aa, Homo Sapiens
LLIRYMDNN

SEQ ID NO: 607060 - protein, 9 aa, Homo Sapiens
PFLHTHQVL

SEQ ID NO: 607061 - protein, 9 aa, Homo Sapiens
MDLRVYGPA

SEQ ID NO: 607062 - protein, 9 aa, Homo Sapiens
HPGIFRGDK

SEQ ID NO: 607063 - protein, 9 aa, Homo Sapiens
VFISLSGFS

SEQ ID NO: 607064 - protein, 9 aa, Homo Sapiens
DITRGIFPE

SEQ ID NO: 607065 - protein, 9 aa, Homo Sapiens
TAKLMFRAC

SEQ ID NO: 607066 - protein, 9 aa, Homo Sapiens
AKLMFRACR

SEQ ID NO: 607067 - protein, 9 aa, Homo Sapiens
DTTSREPCN

SEQ ID NO: 607068 - protein, 9 aa, Homo Sapiens
IRYMDNNRA

SEQ ID NO: 607069 - protein, 9 aa, Homo Sapiens
REPGTTAWQ

SEQ ID NO: 607070 - protein, 9 aa, Homo Sapiens
PWLHTLCSG

SEQ ID NO: 607071 - protein, 9 aa, Homo Sapiens
DGSEQVLDE

SEQ ID NO: 607072 - protein, 9 aa, Homo Sapiens
SLSIILLTL

SEQ ID NO: 607073 - protein, 9 aa, Homo Sapiens
APEVLLKLH

SEQ ID NO: 607074 - protein, 9 aa, Homo Sapiens
RNEEKIYHK

SEQ ID NO: 607075 - protein, 9 aa, Homo Sapiens
ISIQTLTTT

SEQ ID NO: 607076 - protein, 9 aa, Homo Sapiens
EQVLDEEGS

SEQ ID NO: 607077 - protein, 9 aa, Homo Sapiens
ERSGINRQR

SEQ ID NO: 607078 - protein, 9 aa, Homo Sapiens
LTATPPPQQ

SEQ ID NO: 607079 - protein, 9 aa, Homo Sapiens
SAIFRTAKL

SEQ ID NO: 607080 - protein, 9 aa, Homo Sapiens
DDLKDAQEK

SEQ ID NO: 607081 - protein, 9 aa, Homo Sapiens
LCRPRTFCS

SEQ ID NO: 607082 - protein, 9 aa, Homo Sapiens
SSVHAPEVL

SEQ ID NO: 607083 - protein, 9 aa, Homo Sapiens
HAKRVAIMP

SEQ ID NO: 607084 - protein, 9 aa, Homo Sapiens
THQVLLLPG

SEQ ID NO: 607085 - protein, 9 aa, Homo Sapiens
GIFRGDKWS

SEQ ID NO: 607086 - protein, 9 aa, Homo Sapiens
FAVKSLTYL

SEQ ID NO: 607087 - protein, 9 aa, Homo Sapiens
STICGFLLV

SEQ ID NO: 607088 - protein, 9 aa, Homo Sapiens
HIKLHSVVS

SEQ ID NO: 607089 - protein, 9 aa, Homo Sapiens
AVLAFPDDM

SEQ ID NO: 607090 - protein, 9 aa, Homo Sapiens
GFSSSAIFR

SEQ ID NO: 607091 - protein, 9 aa, Homo Sapiens
LTLISYFWL

SEQ ID NO: 607092 - protein, 9 aa, Homo Sapiens
NLISIQTLT

SEQ ID NO: 607093 - protein, 9 aa, Homo Sapiens
KRFKEFQED

SEQ ID NO: 607094 - protein, 9 aa, Homo Sapiens
YCYKYQITL

SEQ ID NO: 607095 - protein, 9 aa, Homo Sapiens
QYLGLALDM

SEQ ID NO: 607096 - protein, 9 aa, Homo Sapiens
PPLTATPPP

SEQ ID NO: 607097 - protein, 9 aa, Homo Sapiens
PPPQQPHAL

SEQ ID NO: 607098 - protein, 9 aa, Homo Sapiens
IREVIYPYV

SEQ ID NO: 607099 - protein, 9 aa, Homo Sapiens
HKILPFFPP

SEQ ID NO: 607100 - protein, 9 aa, Homo Sapiens
APVPGPVPM

SEQ ID NO: 607101 - protein, 9 aa, Homo Sapiens
GAGVVSQLL

SEQ ID NO: 607102 - protein, 9 aa, Homo Sapiens
MQGLMGRKF

SEQ ID NO: 607103 - protein, 9 aa, Homo Sapiens
INAGEHMKY

SEQ ID NO: 607104 - protein, 9 aa, Homo Sapiens
AKCPKLLPW

SEQ ID NO: 607105 - protein, 9 aa, Homo Sapiens
KLLPWLHTL

SEQ ID NO: 607106 - protein, 9 aa, Homo Sapiens
PPPLTATPP

SEQ ID NO: 607107 - protein, 9 aa, Homo Sapiens
SSRGAGLPR

SEQ ID NO: 607108 - protein, 9 aa, Homo Sapiens
IQCINAGEH

SEQ ID NO: 607109 - protein, 9 aa, Homo Sapiens
SSSAIFRTA

SEQ ID NO: 607110 - protein, 9 aa, Homo Sapiens
HRHVVALVF

SEQ ID NO: 607111 - protein, 9 aa, Homo Sapiens
FLVALYKYT

SEQ ID NO: 607112 - protein, 9 aa, Homo Sapiens
EDDGSEQVL

SEQ ID NO: 607113 - protein, 9 aa, Homo Sapiens
GPPPLTATP

SEQ ID NO: 607114 - protein, 9 aa, Homo Sapiens
ERPHRHVVA

SEQ ID NO: 607115 - protein, 9 aa, Homo Sapiens
INRQRSEMK

SEQ ID NO: 607116 - protein, 9 aa, Homo Sapiens
SEQVLDEEG

SEQ ID NO: 607117 - protein, 9 aa, Homo Sapiens
PEVLLKLHS

SEQ ID NO: 607118 - protein, 9 aa, Homo Sapiens
AIMPKDIQL

SEQ ID NO: 607119 - protein, 9 aa, Homo Sapiens
VVSQLLSRV

SEQ ID NO: 607120 - protein, 9 aa, Homo Sapiens
DPFAVKSLT

SEQ ID NO: 607121 - protein, 9 aa, Homo Sapiens
AGEHMKYGE

SEQ ID NO: 607122 - protein, 9 aa, Homo Sapiens
YSDDLKDAQ

SEQ ID NO: 607123 - protein, 9 aa, Homo Sapiens
PDITRGIFP

SEQ ID NO: 607124 - protein, 9 aa, Homo Sapiens
ITRGIFPEV

SEQ ID NO: 607125 - protein, 9 aa, Homo Sapiens
LHSVVSEGA

SEQ ID NO: 607126 - protein, 9 aa, Homo Sapiens
TLETASKNH

SEQ ID NO: 607127 - protein, 9 aa, Homo Sapiens
TRNVHMVST

SEQ ID NO: 607128 - protein, 9 aa, Homo Sapiens
HQVLLLPGY

SEQ ID NO: 607129 - protein, 9 aa, Homo Sapiens
DQRRNEEKI

SEQ ID NO: 607130 - protein, 9 aa, Homo Sapiens
EGAERPHRH

SEQ ID NO: 607131 - protein, 9 aa, Homo Sapiens
ETHTPTNYG

SEQ ID NO: 607132 - protein, 9 aa, Homo Sapiens
DLPFLHTHQ

SEQ ID NO: 607133 - protein, 9 aa, Homo Sapiens
HTPTNYGNN

SEQ ID NO: 607134 - protein, 9 aa, Homo Sapiens
NKNWNNLIS

SEQ ID NO: 607135 - protein, 9 aa, Homo Sapiens
SRGAGLPRP

SEQ ID NO: 607136 - protein, 9 aa, Homo Sapiens
VKSLTYLSR

SEQ ID NO: 607137 - protein, 9 aa, Homo Sapiens
LALDMDRTK

SEQ ID NO: 607138 - protein, 9 aa, Homo Sapiens
RYMDNNRAQ

SEQ ID NO: 607139 - protein, 9 aa, Homo Sapiens
FPPSINQTR

SEQ ID NO: 607140 - protein, 9 aa, Homo Sapiens
LLLPGYYGL

SEQ ID NO: 607141 - protein, 9 aa, Homo Sapiens
VATQGVHIW

SEQ ID NO: 607142 - protein, 9 aa, Homo Sapiens
RIRFLCELV

SEQ ID NO: 607143 - protein, 9 aa, Homo Sapiens
LFFYCVIRE

SEQ ID NO: 607144 - protein, 9 aa, Homo Sapiens
GSYHPGIFR

SEQ ID NO: 607145 - protein, 9 aa, Homo Sapiens
KNCSQKDKR

SEQ ID NO: 607146 - protein, 9 aa, Homo Sapiens
HVVALVFIS

SEQ ID NO: 607147 - protein, 9 aa, Homo Sapiens
RSTSTRNVH

SEQ ID NO: 607148 - protein, 9 aa, Homo Sapiens
SIILLTLIS

SEQ ID NO: 607149 - protein, 9 aa, Homo Sapiens
VPQDQRRNE

SEQ ID NO: 607150 - protein, 9 aa, Homo Sapiens
RSGINRQRS

SEQ ID NO: 607151 - protein, 9 aa, Homo Sapiens
QVLLLPGYY

SEQ ID NO: 607152 - protein, 9 aa, Homo Sapiens
CGFLLVFFR

SEQ ID NO: 607153 - protein, 9 aa, Homo Sapiens
TQGVHIWDL

SEQ ID NO: 607154 - protein, 9 aa, Homo Sapiens
FCSQALRAH

SEQ ID NO: 607155 - protein, 9 aa, Homo Sapiens
PGYYGLAFS

SEQ ID NO: 607156 - protein, 9 aa, Homo Sapiens
KNWNNLISI

SEQ ID NO: 607157 - protein, 9 aa, Homo Sapiens
DMDRTKKDQ

SEQ ID NO: 607158 - protein, 9 aa, Homo Sapiens
LCNKDPFAV

SEQ ID NO: 607159 - protein, 9 aa, Homo Sapiens
RRRQSIRCP

SEQ ID NO: 607160 - protein, 9 aa, Homo Sapiens
CINAGEHMK

SEQ ID NO: 607161 - protein, 9 aa, Homo Sapiens
LRIRFLCEL

SEQ ID NO: 607162 - protein, 9 aa, Homo Sapiens
AIFRTAKLM

SEQ ID NO: 607163 - protein, 9 aa, Homo Sapiens
CYKYQITLR

SEQ ID NO: 607164 - protein, 9 aa, Homo Sapiens
WVKPIIIGC

SEQ ID NO: 607165 - protein, 9 aa, Homo Sapiens
HAPEVLLKL

SEQ ID NO: 607166 - protein, 9 aa, Homo Sapiens
SLSGFSSSA

SEQ ID NO: 607167 - protein, 9 aa, Homo Sapiens
PLTATPPPQ

SEQ ID NO: 607168 - protein, 9 aa, Homo Sapiens
ISLSGFSSS

SEQ ID NO: 607169 - protein, 9 aa, Homo Sapiens
QKAMQGLMG

SEQ ID NO: 607170 - protein, 9 aa, Homo Sapiens
PDDMDLRVY

SEQ ID NO: 607171 - protein, 9 aa, Homo Sapiens
PFFPPSINQ

SEQ ID NO: 607172 - protein, 9 aa, Homo Sapiens
GYYGLAFSS

SEQ ID NO: 607173 - protein, 9 aa, Homo Sapiens
GGLDPSSRG

SEQ ID NO: 607174 - protein, 9 aa, Homo Sapiens
EVLLKLHSH

SEQ ID NO: 607175 - protein, 9 aa, Homo Sapiens
KDPFAVKSL

SEQ ID NO: 607176 - protein, 9 aa, Homo Sapiens
NEEKIYHKM

SEQ ID NO: 607177 - protein, 9 aa, Homo Sapiens
LGLALDMDR

SEQ ID NO: 607178 - protein, 9 aa, Homo Sapiens
RQRSTSTRN

SEQ ID NO: 607179 - protein, 9 aa, Homo Sapiens
QLLSRVWAA

SEQ ID NO: 607180 - protein, 9 aa, Homo Sapiens
LLKLHSHIK

SEQ ID NO: 607181 - protein, 9 aa, Homo Sapiens
VLLKLHSHI

SEQ ID NO: 607182 - protein, 9 aa, Homo Sapiens
GVPGSVAGI

SEQ ID NO: 607183 - protein, 9 aa, Homo Sapiens
FWMGSGFAK

SEQ ID NO: 607184 - protein, 9 aa, Homo Sapiens
IRFLCELVL

SEQ ID NO: 607185 - protein, 9 aa, Homo Sapiens
STSTRNVHM

SEQ ID NO: 607186 - protein, 9 aa, Homo Sapiens
FWHKILPFF

SEQ ID NO: 607187 - protein, 9 aa, Homo Sapiens
TFCSQALRA

SEQ ID NO: 607188 - protein, 9 aa, Homo Sapiens
GIGWQRRRQ

SEQ ID NO: 607189 - protein, 9 aa, Homo Sapiens
TSTRNVHMV

SEQ ID NO: 607190 - protein, 9 aa, Homo Sapiens
EPDITRGIF

SEQ ID NO: 607191 - protein, 9 aa, Homo Sapiens
GLALDMDRT

SEQ ID NO: 607192 - protein, 9 aa, Homo Sapiens
RPETHTPTN

SEQ ID NO: 607193 - protein, 9 aa, Homo Sapiens
FFYCVIREV

SEQ ID NO: 607194 - protein, 9 aa, Homo Sapiens
PKLLPWLHT

SEQ ID NO: 607195 - protein, 9 aa, Homo Sapiens
KAMQGLMGR

SEQ ID NO: 607196 - protein, 9 aa, Homo Sapiens
PATKEPDIT

SEQ ID NO: 607197 - protein, 9 aa, Homo Sapiens
VVRIKYEAR

SEQ ID NO: 607198 - protein, 9 aa, Homo Sapiens
YMDNNRAQW

SEQ ID NO: 607199 - protein, 9 aa, Homo Sapiens
ATPPPQQPH

SEQ ID NO: 607200 - protein, 9 aa, Homo Sapiens
WNNLISIQT

SEQ ID NO: 607201 - protein, 9 aa, Homo Sapiens
RTAKLMFRA

SEQ ID NO: 607202 - protein, 9 aa, Homo Sapiens
FEDDGSEQV

SEQ ID NO: 607203 - protein, 9 aa, Homo Sapiens
YPLLIRYMD

SEQ ID NO: 607204 - protein, 9 aa, Homo Sapiens
GLDPSSRGA

SEQ ID NO: 607205 - protein, 9 aa, Homo Sapiens
LLSRVWAAV

SEQ ID NO: 607206 - protein, 9 aa, Homo Sapiens
FNLMAVVRI

SEQ ID NO: 607207 - protein, 9 aa, Homo Sapiens
SVAGIGHEA

SEQ ID NO: 607208 - protein, 9 aa, Homo Sapiens
GLAFSSVHA

SEQ ID NO: 607209 - protein, 9 aa, Homo Sapiens
PTNYGNNFF

SEQ ID NO: 607210 - protein, 9 aa, Homo Sapiens
PMVGLGSLC

SEQ ID NO: 607211 - protein, 9 aa, Homo Sapiens
SEGAERPHR

SEQ ID NO: 607212 - protein, 9 aa, Homo Sapiens
GFLLVFFRG

SEQ ID NO: 607213 - protein, 9 aa, Homo Sapiens
LREEKDHLL

SEQ ID NO: 607214 - protein, 9 aa, Homo Sapiens
MDNNRAQWL

SEQ ID NO: 607215 - protein, 9 aa, Homo Sapiens
RHVVALVFI

SEQ ID NO: 607216 - protein, 9 aa, Homo Sapiens
ICGFLLVFF

SEQ ID NO: 607217 - protein, 9 aa, Homo Sapiens
SQSPDTTSR

SEQ ID NO: 607218 - protein, 9 aa, Homo Sapiens
EKLREEKDH

SEQ ID NO: 607219 - protein, 9 aa, Homo Sapiens
CPKLLPWLH

SEQ ID NO: 607220 - protein, 9 aa, Homo Sapiens
AFSSVHAPE

SEQ ID NO: 607221 - protein, 9 aa, Homo Sapiens
CRPRTFCSQ

SEQ ID NO: 607222 - protein, 9 aa, Homo Sapiens
EEKDHLLAE

SEQ ID NO: 607223 - protein, 9 aa, Homo Sapiens
KLREEKDHL

SEQ ID NO: 607224 - protein, 9 aa, Homo Sapiens
VRIKYEARL

SEQ ID NO: 607225 - protein, 9 aa, Homo Sapiens
GVFWMGSGF

SEQ ID NO: 607226 - protein, 9 aa, Homo Sapiens
YKYQITLRE

SEQ ID NO: 607227 - protein, 9 aa, Homo Sapiens
LGVFWMGSG

SEQ ID NO: 607228 - protein, 9 aa, Homo Sapiens
LGAGVVSQL

SEQ ID NO: 607229 - protein, 9 aa, Homo Sapiens
NYIVEKREP

SEQ ID NO: 607230 - protein, 9 aa, Homo Sapiens
QRSEMKQMT

SEQ ID NO: 607231 - protein, 9 aa, Homo Sapiens
PTLETASKN

SEQ ID NO: 607232 - protein, 9 aa, Homo Sapiens
ATSLSIILL

SEQ ID NO: 607233 - protein, 9 aa, Homo Sapiens
LSILRIRFL

SEQ ID NO: 607234 - protein, 9 aa, Homo Sapiens
YYLYCYKYQ

SEQ ID NO: 607235 - protein, 9 aa, Homo Sapiens
KRVAIMPKD

SEQ ID NO: 607236 - protein, 9 aa, Homo Sapiens
IWDLQDRVL

SEQ ID NO: 607237 - protein, 9 aa, Homo Sapiens
AGVVSQLLS

SEQ ID NO: 607238 - protein, 9 aa, Homo Sapiens
DHLLAEETA

SEQ ID NO: 607239 - protein, 9 aa, Homo Sapiens
QRRNEEKIY

SEQ ID NO: 607240 - protein, 9 aa, Homo Sapiens
AVKSLTYLS

SEQ ID NO: 607241 - protein, 9 aa, Homo Sapiens
LDKYSDDLK

SEQ ID NO: 607242 - protein, 9 aa, Homo Sapiens
LSIILLTLI

SEQ ID NO: 607243 - protein, 9 aa, Homo Sapiens
VLAFPDDMD

SEQ ID NO: 607244 - protein, 9 aa, Homo Sapiens
YLGLALDMD

SEQ ID NO: 607245 - protein, 9 aa, Homo Sapiens
TKEPDITRG

SEQ ID NO: 607246 - protein, 9 aa, Homo Sapiens
SREPCNKNW

SEQ ID NO: 607247 - protein, 9 aa, Homo Sapiens
RNVHMVSTT

SEQ ID NO: 607248 - protein, 9 aa, Homo Sapiens
PCNKNWNNL

SEQ ID NO: 607249 - protein, 9 aa, Homo Sapiens
FSSSAIFRT

SEQ ID NO: 607250 - protein, 9 aa, Homo Sapiens
FKEFQEDKH

SEQ ID NO: 607251 - protein, 9 aa, Homo Sapiens
LDPSSRGAG

SEQ ID NO: 607252 - protein, 9 aa, Homo Sapiens
FSSVHAPEV

SEQ ID NO: 607253 - protein, 9 aa, Homo Sapiens
GCHAYGDQY

SEQ ID NO: 607254 - protein, 9 aa, Homo Sapiens
SHIKLHSVV

SEQ ID NO: 607255 - protein, 9 aa, Homo Sapiens
AERPHRHVV

SEQ ID NO: 607256 - protein, 9 aa, Homo Sapiens
WGGLDPSSR

SEQ ID NO: 607257 - protein, 9 aa, Homo Sapiens
GSVAGIGHE

SEQ ID NO: 607258 - protein, 9 aa, Homo Sapiens
VEKREPGTT

SEQ ID NO: 607259 - protein, 9 aa, Homo Sapiens
GEHMKYGEQ

SEQ ID NO: 607260 - protein, 9 aa, Homo Sapiens
ATQGVHIWD

SEQ ID NO: 607261 - protein, 9 aa, Homo Sapiens
HSHIKLHSV

SEQ ID NO: 607262 - protein, 9 aa, Homo Sapiens
KILPFFPPS

SEQ ID NO: 607263 - protein, 9 aa, Homo Sapiens
VFWMGSGFA

SEQ ID NO: 607264 - protein, 9 aa, Homo Sapiens
RLCRPRTFC

SEQ ID NO: 607265 - protein, 9 aa, Homo Sapiens
YGLAFSSVH

SEQ ID NO: 607266 - protein, 9 aa, Homo Sapiens
IFRGDKWSC

SEQ ID NO: 607267 - protein, 9 aa, Homo Sapiens
TICGFLLVF

SEQ ID NO: 607268 - protein, 9 aa, Homo Sapiens
DDGSEQVLD

SEQ ID NO: 607269 - protein, 9 aa, Homo Sapiens
AVVRIKYEA

SEQ ID NO: 607270 - protein, 9 aa, Homo Sapiens
REVIYPYVY

SEQ ID NO: 607271 - protein, 9 aa, Homo Sapiens
KDKRFKEFQ

SEQ ID NO: 607272 - protein, 9 aa, Homo Sapiens
GSEQVLDEE

SEQ ID NO: 607273 - protein, 9 aa, Homo Sapiens
VAGIGHEAG

SEQ ID NO: 607274 - protein, 9 aa, Homo Sapiens
FRTAKLMFR

SEQ ID NO: 607275 - protein, 9 aa, Homo Sapiens
RGAGLPRPL

SEQ ID NO: 607276 - protein, 9 aa, Homo Sapiens
PHRHVVALV

SEQ ID NO: 607277 - protein, 9 aa, Homo Sapiens
MGRKFANRV

SEQ ID NO: 607278 - protein, 9 aa, Homo Sapiens
IIGCHAYGD

SEQ ID NO: 607279 - protein, 9 aa, Homo Sapiens
LLPWLHTLC

SEQ ID NO: 607280 - protein, 9 aa, Homo Sapiens
ALYKYTKER

SEQ ID NO: 607281 - protein, 9 aa, Homo Sapiens
EFEDDGSEQ

SEQ ID NO: 607282 - protein, 9 aa, Homo Sapiens
LYPLLIRYM

SEQ ID NO: 607283 - protein, 9 aa, Homo Sapiens
MDRTKKDQE

SEQ ID NO: 607284 - protein, 9 aa, Homo Sapiens
LPGYYGLAF

SEQ ID NO: 607285 - protein, 9 aa, Homo Sapiens
LMGRKFANR

SEQ ID NO: 607286 - protein, 9 aa, Homo Sapiens
YHPGIFRGD

SEQ ID NO: 607287 - protein, 9 aa, Homo Sapiens
IIIGCHAYG

SEQ ID NO: 607288 - protein, 9 aa, Homo Sapiens
RQRSEMKQM

SEQ ID NO: 607289 - protein, 9 aa, Homo Sapiens
ELGVFWMGS

SEQ ID NO: 607290 - protein, 9 aa, Homo Sapiens
QGVHIWDLQ

SEQ ID NO: 607291 - protein, 9 aa, Homo Sapiens
GLMGRKFAN

SEQ ID NO: 607292 - protein, 9 aa, Homo Sapiens
AFPDDMDLR

SEQ ID NO: 607293 - protein, 9 aa, Homo Sapiens
DKRFKEFQE

SEQ ID NO: 607294 - protein, 9 aa, Homo Sapiens
TKERKTPIE

SEQ ID NO: 607295 - protein, 9 aa, Homo Sapiens
FLHTHQVLL

SEQ ID NO: 607296 - protein, 9 aa, Homo Sapiens
VALVFISLS

SEQ ID NO: 607297 - protein, 9 aa, Homo Sapiens
PGPVPMVGL

SEQ ID NO: 607298 - protein, 9 aa, Homo Sapiens
LDMDRTKKD

SEQ ID NO: 607299 - protein, 9 aa, Homo Sapiens
SVHAPEVLL

SEQ ID NO: 607300 - protein, 9 aa, Homo Sapiens
KYTKERKTP

SEQ ID NO: 607301 - protein, 9 aa, Homo Sapiens
NCSQKDKRF

SEQ ID NO: 607302 - protein, 9 aa, Homo Sapiens
ASKNHETDG

SEQ ID NO: 607303 - protein, 9 aa, Homo Sapiens
LSGFSSSAI

SEQ ID NO: 607304 - protein, 9 aa, Homo Sapiens
VIREVIYPY

SEQ ID NO: 607305 - protein, 9 aa, Homo Sapiens
RRELGVFWM

SEQ ID NO: 607306 - protein, 9 aa, Homo Sapiens
CHAYGDQYR

SEQ ID NO: 607307 - protein, 9 aa, Homo Sapiens
PGIFRGDKW

SEQ ID NO: 607308 - protein, 9 aa, Homo Sapiens
VLLSILRIR

SEQ ID NO: 607309 - protein, 9 aa, Homo Sapiens
VSQLLSRVW

SEQ ID NO: 607310 - protein, 9 aa, Homo Sapiens
QRSTSTRNV

SEQ ID NO: 607311 - protein, 9 aa, Homo Sapiens
PGTTAWQLV

SEQ ID NO: 607312 - protein, 9 aa, Homo Sapiens
DKYSDDLKD

SEQ ID NO: 607313 - protein, 9 aa, Homo Sapiens
RRQSIRCPC

SEQ ID NO: 607314 - protein, 9 aa, Homo Sapiens
NKDPFAVKS

SEQ ID NO: 607315 - protein, 9 aa, Homo Sapiens
TNYGNNFFH

SEQ ID NO: 607316 - protein, 9 aa, Homo Sapiens
VALYKYTKE

SEQ ID NO: 607317 - protein, 9 aa, Homo Sapiens
GVVSQLLSR

SEQ ID NO: 607318 - protein, 9 aa, Homo Sapiens
ILPFFPPSI

SEQ ID NO: 607319 - protein, 9 aa, Homo Sapiens
HSVVSEGAE

SEQ ID NO: 607320 - protein, 9 aa, Homo Sapiens
KCPKLLPWL

SEQ ID NO: 607321 - protein, 9 aa, Homo Sapiens
PVPMVGLGS

SEQ ID NO: 607322 - protein, 9 aa, Homo Sapiens
TSREPCNKN

SEQ ID NO: 607323 - protein, 9 aa, Homo Sapiens
LMAVVRIKY

SEQ ID NO: 607324 - protein, 9 aa, Homo Sapiens
TPPPQQPHA

SEQ ID NO: 607325 - protein, 9 aa, Homo Sapiens
VLLLPGYYG

SEQ ID NO: 607326 - protein, 9 aa, Homo Sapiens
ILRIRFLCE

SEQ ID NO: 607327 - protein, 9 aa, Homo Sapiens
SQKDKRFKE

SEQ ID NO: 607328 - protein, 9 aa, Homo Sapiens
PLLIRYMDN

SEQ ID NO: 607329 - protein, 9 aa, Homo Sapiens
EKDHLLAEE

SEQ ID NO: 607330 - protein, 9 aa, Homo Sapiens
FISLSGFSS

SEQ ID NO: 607331 - protein, 9 aa, Homo Sapiens
KPIIIGCHA

SEQ ID NO: 607332 - protein, 9 aa, Homo Sapiens
HTHQVLLLP

SEQ ID NO: 607333 - protein, 9 aa, Homo Sapiens
LPFFPPSIN

SEQ ID NO: 607334 - protein, 9 aa, Homo Sapiens
STRNVHMVS

SEQ ID NO: 607335 - protein, 9 aa, Homo Sapiens
SSAIFRTAK

SEQ ID NO: 607336 - protein, 9 aa, Homo Sapiens
IILLTLISY

SEQ ID NO: 607337 - protein, 9 aa, Homo Sapiens
TPTNYGNNF

SEQ ID NO: 607338 - protein, 9 aa, Homo Sapiens
TTSREPCNK

SEQ ID NO: 607339 - protein, 9 aa, Homo Sapiens
TATPPPQQP

SEQ ID NO: 607340 - protein, 9 aa, Homo Sapiens
LLVFFRGWK

SEQ ID NO: 607341 - protein, 9 aa, Homo Sapiens
VHIWDLQDR

SEQ ID NO: 607342 - protein, 9 aa, Homo Sapiens
IFRTAKLMF

SEQ ID NO: 607343 - protein, 9 aa, Homo Sapiens
SKNHETDGG

SEQ ID NO: 607344 - protein, 9 aa, Homo Sapiens
VPGSVAGIG

SEQ ID NO: 607345 - protein, 9 aa, Homo Sapiens
NWNNLISIQ

SEQ ID NO: 607346 - protein, 9 aa, Homo Sapiens
YYGLAFSSV

SEQ ID NO: 607347 - protein, 9 aa, Homo Sapiens
IHAKRVAIM

SEQ ID NO: 607348 - protein, 9 aa, Homo Sapiens
LISIQTLTT

SEQ ID NO: 607349 - protein, 9 aa, Homo Sapiens
WLHTLCSGC

SEQ ID NO: 607350 - protein, 9 aa, Homo Sapiens
LYKYTKERK

SEQ ID NO: 607351 - protein, 9 aa, Homo Sapiens
CRPETHTPT

SEQ ID NO: 607352 - protein, 9 aa, Homo Sapiens
REPCNKNWN

SEQ ID NO: 607353 - protein, 9 aa, Homo Sapiens
TASKNHETD

SEQ ID NO: 607354 - protein, 9 aa, Homo Sapiens
RRNEEKIYH

SEQ ID NO: 607355 - protein, 9 aa, Homo Sapiens
QDQRRNEEK

SEQ ID NO: 607356 - protein, 9 aa, Homo Sapiens
QGLMGRKFA

SEQ ID NO: 607357 - protein, 9 aa, Homo Sapiens
RTFCSQALR

SEQ ID NO: 607358 - protein, 9 aa, Homo Sapiens
WMGSGFAKV

SEQ ID NO: 607359 - protein, 9 aa, Homo Sapiens
YIVEKREPG

SEQ ID NO: 607360 - protein, 9 aa, Homo Sapiens
PGSVAGIGH

SEQ ID NO: 607361 - protein, 9 aa, Homo Sapiens
YKYTKERKT

SEQ ID NO: 607362 - protein, 9 aa, Homo Sapiens
IGCHAYGDQ

SEQ ID NO: 607363 - protein, 9 aa, Homo Sapiens
MGSGFAKVL

SEQ ID NO: 607364 - protein, 9 aa, Homo Sapiens
NRQRSEMKQ

SEQ ID NO: 607365 - protein, 9 aa, Homo Sapiens
IVEKREPGT

SEQ ID NO: 607366 - protein, 9 aa, Homo Sapiens
YTKERKTPI

SEQ ID NO: 607367 - protein, 9 aa, Homo Sapiens
KYQITLREK

SEQ ID NO: 607368 - protein, 9 aa, Homo Sapiens
LHTHQVLLL

SEQ ID NO: 607369 - protein, 9 aa, Homo Sapiens
DPSSRGAGL

SEQ ID NO: 607370 - protein, 9 aa, Homo Sapiens
GAERPHRHV

SEQ ID NO: 607371 - protein, 9 aa, Homo Sapiens
KEPDITRGI

SEQ ID NO: 607372 - protein, 9 aa, Homo Sapiens
QRQRSTSTR

SEQ ID NO: 607373 - protein, 9 aa, Homo Sapiens
RDSTGHYLC

SEQ ID NO: 607374 - protein, 9 aa, Homo Sapiens
QALCPVSTR

SEQ ID NO: 607375 - protein, 9 aa, Homo Sapiens
LKPSSSLAV

SEQ ID NO: 607376 - protein, 9 aa, Homo Sapiens
GALLHRQWT

SEQ ID NO: 607377 - protein, 9 aa, Homo Sapiens
ALPRGGPLD

SEQ ID NO: 607378 - protein, 9 aa, Homo Sapiens
SHRGLASAT

SEQ ID NO: 607379 - protein, 9 aa, Homo Sapiens
ALCPVSTRN

SEQ ID NO: 607380 - protein, 9 aa, Homo Sapiens
QQLEFQEAE

SEQ ID NO: 607381 - protein, 9 aa, Homo Sapiens
RHGDRCFRL

SEQ ID NO: 607382 - protein, 9 aa, Homo Sapiens
FCLWSKELP

SEQ ID NO: 607383 - protein, 9 aa, Homo Sapiens
EKCCFWVKQ

SEQ ID NO: 607384 - protein, 9 aa, Homo Sapiens
TKKTGHRGV

SEQ ID NO: 607385 - protein, 9 aa, Homo Sapiens
MVRPPCGPG

SEQ ID NO: 607386 - protein, 9 aa, Homo Sapiens
PRGGPLDEP

SEQ ID NO: 607387 - protein, 9 aa, Homo Sapiens
EIAEMNNFI

SEQ ID NO: 607388 - protein, 9 aa, Homo Sapiens
MHGLPRARG

SEQ ID NO: 607389 - protein, 9 aa, Homo Sapiens
CGPGRRRKG

SEQ ID NO: 607390 - protein, 9 aa, Homo Sapiens
GSLFEVQWQ

SEQ ID NO: 607391 - protein, 9 aa, Homo Sapiens
KLPDESFCM

SEQ ID NO: 607392 - protein, 9 aa, Homo Sapiens
LTVLLLSLL

SEQ ID NO: 607393 - protein, 9 aa, Homo Sapiens
DLRKELCQI

SEQ ID NO: 607394 - protein, 9 aa, Homo Sapiens
RGGPLDEPG

SEQ ID NO: 607395 - protein, 9 aa, Homo Sapiens
YASGMPTKK

SEQ ID NO: 607396 - protein, 9 aa, Homo Sapiens
QITDLKQLT

SEQ ID NO: 607397 - protein, 9 aa, Homo Sapiens
PQEHPGLGG

SEQ ID NO: 607398 - protein, 9 aa, Homo Sapiens
SDQKIYDQI

SEQ ID NO: 607399 - protein, 9 aa, Homo Sapiens
SGMPTKKTG

SEQ ID NO: 607400 - protein, 9 aa, Homo Sapiens
SHCFVAFPP

SEQ ID NO: 607401 - protein, 9 aa, Homo Sapiens
VKQSGKVQD

SEQ ID NO: 607402 - protein, 9 aa, Homo Sapiens
QEHPGLGGE

SEQ ID NO: 607403 - protein, 9 aa, Homo Sapiens
RFCLWSKEL

SEQ ID NO: 607404 - protein, 9 aa, Homo Sapiens
NSSAVPLKL

SEQ ID NO: 607405 - protein, 9 aa, Homo Sapiens
KVGALLHRQ

SEQ ID NO: 607406 - protein, 9 aa, Homo Sapiens
LLHRQWTLL

SEQ ID NO: 607407 - protein, 9 aa, Homo Sapiens
TPRMHGLPR

SEQ ID NO: 607408 - protein, 9 aa, Homo Sapiens
ILGVPSKCV

SEQ ID NO: 607409 - protein, 9 aa, Homo Sapiens
MAAAPPSHC

SEQ ID NO: 607410 - protein, 9 aa, Homo Sapiens
QKIYDQITD

SEQ ID NO: 607411 - protein, 9 aa, Homo Sapiens
EGGSSARGF

SEQ ID NO: 607412 - protein, 9 aa, Homo Sapiens
VLTNSRVVK

SEQ ID NO: 607413 - protein, 9 aa, Homo Sapiens
WMIRGPVIL

SEQ ID NO: 607414 - protein, 9 aa, Homo Sapiens
CLWSKELPF

SEQ ID NO: 607415 - protein, 9 aa, Homo Sapiens
RLLLHTPRN

SEQ ID NO: 607416 - protein, 9 aa, Homo Sapiens
LRRSNPNIF

SEQ ID NO: 607417 - protein, 9 aa, Homo Sapiens
RSMRMEVTC

SEQ ID NO: 607418 - protein, 9 aa, Homo Sapiens
TPRNAGPAA

SEQ ID NO: 607419 - protein, 9 aa, Homo Sapiens
YDRRSMRME

SEQ ID NO: 607420 - protein, 9 aa, Homo Sapiens
LFYGTTIGI

SEQ ID NO: 607421 - protein, 9 aa, Homo Sapiens
LRKELCQIL

SEQ ID NO: 607422 - protein, 9 aa, Homo Sapiens
NASIWWMIR

SEQ ID NO: 607423 - protein, 9 aa, Homo Sapiens
RTLTPRMHG

SEQ ID NO: 607424 - protein, 9 aa, Homo Sapiens
LFRFCLWSK

SEQ ID NO: 607425 - protein, 9 aa, Homo Sapiens
AAAPPSHCF

SEQ ID NO: 607426 - protein, 9 aa, Homo Sapiens
FPVLAMRRR

SEQ ID NO: 607427 - protein, 9 aa, Homo Sapiens
YGTTIGIYL

SEQ ID NO: 607428 - protein, 9 aa, Homo Sapiens
GFTFSGFCR

SEQ ID NO: 607429 - protein, 9 aa, Homo Sapiens
SNPNIFQYI

SEQ ID NO: 607430 - protein, 9 aa, Homo Sapiens
SVLTNSRVV

SEQ ID NO: 607431 - protein, 9 aa, Homo Sapiens
SLSVTDLLV

SEQ ID NO: 607432 - protein, 9 aa, Homo Sapiens
PPSHCFVAF

SEQ ID NO: 607433 - protein, 9 aa, Homo Sapiens
FTFSGFCRV

SEQ ID NO: 607434 - protein, 9 aa, Homo Sapiens
MEVTCNHCA

SEQ ID NO: 607435 - protein, 9 aa, Homo Sapiens
RRDSTGHYL

SEQ ID NO: 607436 - protein, 9 aa, Homo Sapiens
ARGFPVLAM

SEQ ID NO: 607437 - protein, 9 aa, Homo Sapiens
CRHGDRCFR

SEQ ID NO: 607438 - protein, 9 aa, Homo Sapiens
LLHTPRNAG

SEQ ID NO: 607439 - protein, 9 aa, Homo Sapiens
LHRQWTLLQ

SEQ ID NO: 607440 - protein, 9 aa, Homo Sapiens
LWSKELPFQ

SEQ ID NO: 607441 - protein, 9 aa, Homo Sapiens
RMAAAPPSH

SEQ ID NO: 607442 - protein, 9 aa, Homo Sapiens
RDCSYFNSS

SEQ ID NO: 607443 - protein, 9 aa, Homo Sapiens
SGFCRVTCL

SEQ ID NO: 607444 - protein, 9 aa, Homo Sapiens
HTPRNAGPA

SEQ ID NO: 607445 - protein, 9 aa, Homo Sapiens
GLGGEAVGT

SEQ ID NO: 607446 - protein, 9 aa, Homo Sapiens
IYLCPSSVL

SEQ ID NO: 607447 - protein, 9 aa, Homo Sapiens
GIYLCPSSV

SEQ ID NO: 607448 - protein, 9 aa, Homo Sapiens
VMVRPPCGP

SEQ ID NO: 607449 - protein, 9 aa, Homo Sapiens
PPCGPGRRR

SEQ ID NO: 607450 - protein, 9 aa, Homo Sapiens
DSTGHYLCN

SEQ ID NO: 607451 - protein, 9 aa, Homo Sapiens
NAGPAASRP

SEQ ID NO: 607452 - protein, 9 aa, Homo Sapiens
WVKQSGKVQ

SEQ ID NO: 607453 - protein, 9 aa, Homo Sapiens
TIGIYLCPS

SEQ ID NO: 607454 - protein, 9 aa, Homo Sapiens
VGALLHRQW

SEQ ID NO: 607455 - protein, 9 aa, Homo Sapiens
SGIYCTQKN

SEQ ID NO: 607456 - protein, 9 aa, Homo Sapiens
KQSGKVQDN

SEQ ID NO: 607457 - protein, 9 aa, Homo Sapiens
GMPTKKTGH

SEQ ID NO: 607458 - protein, 9 aa, Homo Sapiens
NGQRALPRG

SEQ ID NO: 607459 - protein, 9 aa, Homo Sapiens
PTKKTGHRG

SEQ ID NO: 607460 - protein, 9 aa, Homo Sapiens
CVASSDGTL

SEQ ID NO: 607461 - protein, 9 aa, Homo Sapiens
VPYASGMPT

SEQ ID NO: 607462 - protein, 9 aa, Homo Sapiens
ILVTEIAEM

SEQ ID NO: 607463 - protein, 9 aa, Homo Sapiens
EQGFTFSGF

SEQ ID NO: 607464 - protein, 9 aa, Homo Sapiens
SAVPLKLSF

SEQ ID NO: 607465 - protein, 9 aa, Homo Sapiens
RKCSVVGPA

SEQ ID NO: 607466 - protein, 9 aa, Homo Sapiens
AKVGALLHR

SEQ ID NO: 607467 - protein, 9 aa, Homo Sapiens
GTLKPSSSL

SEQ ID NO: 607468 - protein, 9 aa, Homo Sapiens
DEGINREVM

SEQ ID NO: 607469 - protein, 9 aa, Homo Sapiens
GDRCFRLHN

SEQ ID NO: 607470 - protein, 9 aa, Homo Sapiens
LVTEIAEMN

SEQ ID NO: 607471 - protein, 9 aa, Homo Sapiens
FWVKQSGKV

SEQ ID NO: 607472 - protein, 9 aa, Homo Sapiens
GGEAVGTGE

SEQ ID NO: 607473 - protein, 9 aa, Homo Sapiens
ACRHGDRCF

SEQ ID NO: 607474 - protein, 9 aa, Homo Sapiens
GGSSARGFP

SEQ ID NO: 607475 - protein, 9 aa, Homo Sapiens
YTSVLTNSR

SEQ ID NO: 607476 - protein, 9 aa, Homo Sapiens
TFSGFCRVT

SEQ ID NO: 607477 - protein, 9 aa, Homo Sapiens
NANASIWWM

SEQ ID NO: 607478 - protein, 9 aa, Homo Sapiens
RKELCQILA

SEQ ID NO: 607479 - protein, 9 aa, Homo Sapiens
VRPPCGPGR

SEQ ID NO: 607480 - protein, 9 aa, Homo Sapiens
VSTRNFVIH

SEQ ID NO: 607481 - protein, 9 aa, Homo Sapiens
GTQQAKTGK

SEQ ID NO: 607482 - protein, 9 aa, Homo Sapiens
RGFPVLAMR

SEQ ID NO: 607483 - protein, 9 aa, Homo Sapiens
YTSSFLYPV

SEQ ID NO: 607484 - protein, 9 aa, Homo Sapiens
YLIASLSVT

SEQ ID NO: 607485 - protein, 9 aa, Homo Sapiens
PQQAQPDSI

SEQ ID NO: 607486 - protein, 9 aa, Homo Sapiens
TGEFLYWKL

SEQ ID NO: 607487 - protein, 9 aa, Homo Sapiens
FYTSSFLYP

SEQ ID NO: 607488 - protein, 9 aa, Homo Sapiens
LFEVQWQLA

SEQ ID NO: 607489 - protein, 9 aa, Homo Sapiens
LIASLSVTD

SEQ ID NO: 607490 - protein, 9 aa, Homo Sapiens
KIYDQITDL

SEQ ID NO: 607491 - protein, 9 aa, Homo Sapiens
RRQALCPVS

SEQ ID NO: 607492 - protein, 9 aa, Homo Sapiens
TTIGIYLCP

SEQ ID NO: 607493 - protein, 9 aa, Homo Sapiens
CFWVKQSGK

SEQ ID NO: 607494 - protein, 9 aa, Homo Sapiens
DQITDLKQL

SEQ ID NO: 607495 - protein, 9 aa, Homo Sapiens
KCSLFRFCL

SEQ ID NO: 607496 - protein, 9 aa, Homo Sapiens
WWMIRGPVI

SEQ ID NO: 607497 - protein, 9 aa, Homo Sapiens
RMHGLPRAR

SEQ ID NO: 607498 - protein, 9 aa, Homo Sapiens
SRVVKIGLG

SEQ ID NO: 607499 - protein, 9 aa, Homo Sapiens
CSVVGPAWA

SEQ ID NO: 607500 - protein, 9 aa, Homo Sapiens
GGPLDEPGL

SEQ ID NO: 607501 - protein, 9 aa, Homo Sapiens
WRRDSTGHY

SEQ ID NO: 607502 - protein, 9 aa, Homo Sapiens
LHTPRNAGP

SEQ ID NO: 607503 - protein, 9 aa, Homo Sapiens
IYDQITDLK

SEQ ID NO: 607504 - protein, 9 aa, Homo Sapiens
AEMNNFINL

SEQ ID NO: 607505 - protein, 9 aa, Homo Sapiens
DPDEGINRE

SEQ ID NO: 607506 - protein, 9 aa, Homo Sapiens
RPPCGPGRR

SEQ ID NO: 607507 - protein, 9 aa, Homo Sapiens
FSGFCRVTC

SEQ ID NO: 607508 - protein, 9 aa, Homo Sapiens
LLLHTPRNA

SEQ ID NO: 607509 - protein, 9 aa, Homo Sapiens
SMRMEVTCN

SEQ ID NO: 607510 - protein, 9 aa, Homo Sapiens
PCGPGRRRK

SEQ ID NO: 607511 - protein, 9 aa, Homo Sapiens
DSILGVPSK

SEQ ID NO: 607512 - protein, 9 aa, Homo Sapiens
GTTIGIYLC

SEQ ID NO: 607513 - protein, 9 aa, Homo Sapiens
VLLLSLLSP

SEQ ID NO: 607514 - protein, 9 aa, Homo Sapiens
TRTLTPRMH

SEQ ID NO: 607515 - protein, 9 aa, Homo Sapiens
HRQWTLLQA

SEQ ID NO: 607516 - protein, 9 aa, Homo Sapiens
SARGFPVLA

SEQ ID NO: 607517 - protein, 9 aa, Homo Sapiens
HPGLGGEAV

SEQ ID NO: 607518 - protein, 9 aa, Homo Sapiens
RQWTLLQAL

SEQ ID NO: 607519 - protein, 9 aa, Homo Sapiens
GINREVMYS

SEQ ID NO: 607520 - protein, 9 aa, Homo Sapiens
QEEEGTQQA

SEQ ID NO: 607521 - protein, 9 aa, Homo Sapiens
EEGTQQAKT

SEQ ID NO: 607522 - protein, 9 aa, Homo Sapiens
IASLSVTDL

SEQ ID NO: 607523 - protein, 9 aa, Homo Sapiens
RRRQALCPV

SEQ ID NO: 607524 - protein, 9 aa, Homo Sapiens
PDSILGVPS

SEQ ID NO: 607525 - protein, 9 aa, Homo Sapiens
SIWWMIRGP

SEQ ID NO: 607526 - protein, 9 aa, Homo Sapiens
FNSSAVPLK

SEQ ID NO: 607527 - protein, 9 aa, Homo Sapiens
SYFNSSAVP

SEQ ID NO: 607528 - protein, 9 aa, Homo Sapiens
PGLGGEAVG

SEQ ID NO: 607529 - protein, 9 aa, Homo Sapiens
FRFCLWSKE

SEQ ID NO: 607530 - protein, 9 aa, Homo Sapiens
ASIWWMIRG

SEQ ID NO: 607531 - protein, 9 aa, Homo Sapiens
LCPVSTRNF

SEQ ID NO: 607532 - protein, 9 aa, Homo Sapiens
SLTVLLLSL

SEQ ID NO: 607533 - protein, 9 aa, Homo Sapiens
PYASGMPTK

SEQ ID NO: 607534 - protein, 9 aa, Homo Sapiens
IYCTQKNSS

SEQ ID NO: 607535 - protein, 9 aa, Homo Sapiens
RQALCPVST

SEQ ID NO: 607536 - protein, 9 aa, Homo Sapiens
MNNFINLSF

SEQ ID NO: 607537 - protein, 9 aa, Homo Sapiens
CFRLHNKPT

SEQ ID NO: 607538 - protein, 9 aa, Homo Sapiens
TQQAKTGKD

SEQ ID NO: 607539 - protein, 9 aa, Homo Sapiens
HCFVAFPPR

SEQ ID NO: 607540 - protein, 9 aa, Homo Sapiens
REVMYSFRN

SEQ ID NO: 607541 - protein, 9 aa, Homo Sapiens
EGTQQAKTG

SEQ ID NO: 607542 - protein, 9 aa, Homo Sapiens
QLEFQEAEN

SEQ ID NO: 607543 - protein, 9 aa, Homo Sapiens
ELCQILASK

SEQ ID NO: 607544 - protein, 9 aa, Homo Sapiens
VQWQLAQLE

SEQ ID NO: 607545 - protein, 9 aa, Homo Sapiens
DRCFRLHNK

SEQ ID NO: 607546 - protein, 9 aa, Homo Sapiens
TDPDEGINR

SEQ ID NO: 607547 - protein, 9 aa, Homo Sapiens
QQAKTGKDP

SEQ ID NO: 607548 - protein, 9 aa, Homo Sapiens
LGGEAVGTG

SEQ ID NO: 607549 - protein, 9 aa, Homo Sapiens
NISFYTSSF

SEQ ID NO: 607550 - protein, 9 aa, Homo Sapiens
QRSRKCSVV

SEQ ID NO: 607551 - protein, 9 aa, Homo Sapiens
SSARGFPVL

SEQ ID NO: 607552 - protein, 9 aa, Homo Sapiens
YCTQKNSSE

SEQ ID NO: 607553 - protein, 9 aa, Homo Sapiens
GIYCTQKNS

SEQ ID NO: 607554 - protein, 9 aa, Homo Sapiens
ASATGEFLY

SEQ ID NO: 607555 - protein, 9 aa, Homo Sapiens
GFPVLAMRR

SEQ ID NO: 607556 - protein, 9 aa, Homo Sapiens
PRMHGLPRA

SEQ ID NO: 607557 - protein, 9 aa, Homo Sapiens
YDQITDLKQ

SEQ ID NO: 607558 - protein, 9 aa, Homo Sapiens
FCMYSKGAS

SEQ ID NO: 607559 - protein, 9 aa, Homo Sapiens
ANASIWWMI

SEQ ID NO: 607560 - protein, 9 aa, Homo Sapiens
VVMVRPPCG

SEQ ID NO: 607561 - protein, 9 aa, Homo Sapiens
GSGIYCTQK

SEQ ID NO: 607562 - protein, 9 aa, Homo Sapiens
VVGPAWATC

SEQ ID NO: 607563 - protein, 9 aa, Homo Sapiens
KCSVVGPAW

SEQ ID NO: 607564 - protein, 9 aa, Homo Sapiens
LPDESFCMY

SEQ ID NO: 607565 - protein, 9 aa, Homo Sapiens
RSNPNIFQY

SEQ ID NO: 607566 - protein, 9 aa, Homo Sapiens
FCRVTCLYG

SEQ ID NO: 607567 - protein, 9 aa, Homo Sapiens
DEKCCFWVK

SEQ ID NO: 607568 - protein, 9 aa, Homo Sapiens
NREVMYSFR

SEQ ID NO: 607569 - protein, 9 aa, Homo Sapiens
GFCRVTCLY

SEQ ID NO: 607570 - protein, 9 aa, Homo Sapiens
NSRVVKIGL

SEQ ID NO: 607571 - protein, 9 aa, Homo Sapiens
TEIAEMNNF

SEQ ID NO: 607572 - protein, 9 aa, Homo Sapiens
VGPAWATCT

SEQ ID NO: 607573 - protein, 9 aa, Homo Sapiens
SSDGTLKPS

SEQ ID NO: 607574 - protein, 9 aa, Homo Sapiens
TPQEHPGLG

SEQ ID NO: 607575 - protein, 9 aa, Homo Sapiens
STGHYLCNA

SEQ ID NO: 607576 - protein, 9 aa, Homo Sapiens
TPLWRRDST

SEQ ID NO: 607577 - protein, 9 aa, Homo Sapiens
EHPGLGGEA

SEQ ID NO: 607578 - protein, 9 aa, Homo Sapiens
ASSDGTLKP

SEQ ID NO: 607579 - protein, 9 aa, Homo Sapiens
MIRGPVILS

SEQ ID NO: 607580 - protein, 9 aa, Homo Sapiens
EMNNFINLS

SEQ ID NO: 607581 - protein, 9 aa, Homo Sapiens
LSLTVLLLS

SEQ ID NO: 607582 - protein, 9 aa, Homo Sapiens
ALLHRQWTL

SEQ ID NO: 607583 - protein, 9 aa, Homo Sapiens
CPVSTRNFV

SEQ ID NO: 607584 - protein, 9 aa, Homo Sapiens
SSAVPLKLS

SEQ ID NO: 607585 - protein, 9 aa, Homo Sapiens
FYGTTIGIY

SEQ ID NO: 607586 - protein, 9 aa, Homo Sapiens
AHDGSGIYC

SEQ ID NO: 607587 - protein, 9 aa, Homo Sapiens
SRKCSVVGP

SEQ ID NO: 607588 - protein, 9 aa, Homo Sapiens
IGIYLCPSS

SEQ ID NO: 607589 - protein, 9 aa, Homo Sapiens
IDLRKELCQ

SEQ ID NO: 607590 - protein, 9 aa, Homo Sapiens
NPNIFQYIG

SEQ ID NO: 607591 - protein, 9 aa, Homo Sapiens
SVVGPAWAT

SEQ ID NO: 607592 - protein, 9 aa, Homo Sapiens
RCFRLHNKP

SEQ ID NO: 607593 - protein, 9 aa, Homo Sapiens
SDGTLKPSS

SEQ ID NO: 607594 - protein, 9 aa, Homo Sapiens
DCSYFNSSA

SEQ ID NO: 607595 - protein, 9 aa, Homo Sapiens
IAEMNNFIN

SEQ ID NO: 607596 - protein, 9 aa, Homo Sapiens
LTNSRVVKI

SEQ ID NO: 607597 - protein, 9 aa, Homo Sapiens
MRMEVTCNH

SEQ ID NO: 607598 - protein, 9 aa, Homo Sapiens
RQQLEFQEA

SEQ ID NO: 607599 - protein, 9 aa, Homo Sapiens
CTQKNSSEQ

SEQ ID NO: 607600 - protein, 9 aa, Homo Sapiens
ATGEFLYWK

SEQ ID NO: 607601 - protein, 9 aa, Homo Sapiens
DGTLKPSSS

SEQ ID NO: 607602 - protein, 9 aa, Homo Sapiens
HDGSGIYCT

SEQ ID NO: 607603 - protein, 9 aa, Homo Sapiens
TLTPRMHGL

SEQ ID NO: 607604 - protein, 9 aa, Homo Sapiens
PLWRRDSTG

SEQ ID NO: 607605 - protein, 9 aa, Homo Sapiens
RALPRGGPL

SEQ ID NO: 607606 - protein, 9 aa, Homo Sapiens
TNSRVVKIG

SEQ ID NO: 607607 - protein, 9 aa, Homo Sapiens
RRSMRMEVT

SEQ ID NO: 607608 - protein, 9 aa, Homo Sapiens
RRSNPNIFQ

SEQ ID NO: 607609 - protein, 9 aa, Homo Sapiens
QRALPRGGP

SEQ ID NO: 607610 - protein, 9 aa, Homo Sapiens
PRNAGPAAS

SEQ ID NO: 607611 - protein, 9 aa, Homo Sapiens
DESFCMYSK

SEQ ID NO: 607612 - protein, 9 aa, Homo Sapiens
QAQPDSILG

SEQ ID NO: 607613 - protein, 9 aa, Homo Sapiens
ESFCMYSKG

SEQ ID NO: 607614 - protein, 9 aa, Homo Sapiens
KELCQILAS

SEQ ID NO: 607615 - protein, 9 aa, Homo Sapiens
SFCMYSKGA

SEQ ID NO: 607616 - protein, 9 aa, Homo Sapiens
GSSARGFPV

SEQ ID NO: 607617 - protein, 9 aa, Homo Sapiens
CQILASKEE

SEQ ID NO: 607618 - protein, 9 aa, Homo Sapiens
HGLPRARGF

SEQ ID NO: 607619 - protein, 9 aa, Homo Sapiens
GILRRSNPN

SEQ ID NO: 607620 - protein, 9 aa, Homo Sapiens
ANYLIASLS

SEQ ID NO: 607621 - protein, 9 aa, Homo Sapiens
CMYSKGASE

SEQ ID NO: 607622 - protein, 9 aa, Homo Sapiens
CSLFRFCLW

SEQ ID NO: 607623 - protein, 9 aa, Homo Sapiens
AAPPSHCFV

SEQ ID NO: 607624 - protein, 9 aa, Homo Sapiens
INREVMYSF

SEQ ID NO: 607625 - protein, 9 aa, Homo Sapiens
SLFEVQWQL

SEQ ID NO: 607626 - protein, 9 aa, Homo Sapiens
IWWMIRGPV

SEQ ID NO: 607627 - protein, 9 aa, Homo Sapiens
LCQILASKE

SEQ ID NO: 607628 - protein, 9 aa, Homo Sapiens
RMEVTCNHC

SEQ ID NO: 607629 - protein, 9 aa, Homo Sapiens
ISFYTSSFL

SEQ ID NO: 607630 - protein, 9 aa, Homo Sapiens
ESDQKIYDQ

SEQ ID NO: 607631 - protein, 9 aa, Homo Sapiens
CSYFNSSAV

SEQ ID NO: 607632 - protein, 9 aa, Homo Sapiens
RNAGPAASR

SEQ ID NO: 607633 - protein, 9 aa, Homo Sapiens
DQEEEGTQQ

SEQ ID NO: 607634 - protein, 9 aa, Homo Sapiens
ASGMPTKKT

SEQ ID NO: 607635 - protein, 9 aa, Homo Sapiens
SGILRRSNP

SEQ ID NO: 607636 - protein, 9 aa, Homo Sapiens
PSHCFVAFP

SEQ ID NO: 607637 - protein, 9 aa, Homo Sapiens
PDEGINREV

SEQ ID NO: 607638 - protein, 9 aa, Homo Sapiens
PNIFQYIGK

SEQ ID NO: 607639 - protein, 9 aa, Homo Sapiens
SVTDLLVSI

SEQ ID NO: 607640 - protein, 9 aa, Homo Sapiens
STPLWRRDS

SEQ ID NO: 607641 - protein, 9 aa, Homo Sapiens
DRRSMRMEV

SEQ ID NO: 607642 - protein, 9 aa, Homo Sapiens
EFQEAENSA

SEQ ID NO: 607643 - protein, 9 aa, Homo Sapiens
LPRGGPLDE

SEQ ID NO: 607644 - protein, 9 aa, Homo Sapiens
LTPRMHGLP

SEQ ID NO: 607645 - protein, 9 aa, Homo Sapiens
LWRRDSTGH

SEQ ID NO: 607646 - protein, 9 aa, Homo Sapiens
PVSTRNFVI

SEQ ID NO: 607647 - protein, 9 aa, Homo Sapiens
FQEAENSAL

SEQ ID NO: 607648 - protein, 9 aa, Homo Sapiens
QWQLAQLEA

SEQ ID NO: 607649 - protein, 9 aa, Homo Sapiens
RGLASATGE

SEQ ID NO: 607650 - protein, 9 aa, Homo Sapiens
VTEIAEMNN

SEQ ID NO: 607651 - protein, 9 aa, Homo Sapiens
MPTKKTGHR

SEQ ID NO: 607652 - protein, 9 aa, Homo Sapiens
QEAENSALE

SEQ ID NO: 607653 - protein, 9 aa, Homo Sapiens
APPSHCFVA

SEQ ID NO: 607654 - protein, 9 aa, Homo Sapiens
IKLPDESFC

SEQ ID NO: 607655 - protein, 9 aa, Homo Sapiens
AQPDSILGV

SEQ ID NO: 607656 - protein, 9 aa, Homo Sapiens
HGDRCFRLH

SEQ ID NO: 607657 - protein, 9 aa, Homo Sapiens
RYTSVLTNS

SEQ ID NO: 607658 - protein, 9 aa, Homo Sapiens
NYLIASLSV

SEQ ID NO: 607659 - protein, 9 aa, Homo Sapiens
GLASATGEF

SEQ ID NO: 607660 - protein, 9 aa, Homo Sapiens
FEVQWQLAQ

SEQ ID NO: 607661 - protein, 9 aa, Homo Sapiens
FRLHNKPTF

SEQ ID NO: 607662 - protein, 9 aa, Homo Sapiens
QQAQPDSIL

SEQ ID NO: 607663 - protein, 9 aa, Homo Sapiens
EVQWQLAQL

SEQ ID NO: 607664 - protein, 9 aa, Homo Sapiens
EGSLFEVQW

SEQ ID NO: 607665 - protein, 9 aa, Homo Sapiens
WQLAQLEAR

SEQ ID NO: 607666 - protein, 9 aa, Homo Sapiens
ARQQLEFQE

SEQ ID NO: 607667 - protein, 9 aa, Homo Sapiens
RSRKCSVVG

SEQ ID NO: 607668 - protein, 9 aa, Homo Sapiens
VARQQLEFQ

SEQ ID NO: 607669 - protein, 9 aa, Homo Sapiens
CCFWVKQSG

SEQ ID NO: 607670 - protein, 9 aa, Homo Sapiens
LEFQEAENS

SEQ ID NO: 607671 - protein, 9 aa, Homo Sapiens
TSSFLYPVT

SEQ ID NO: 607672 - protein, 9 aa, Homo Sapiens
EGINREVMY

SEQ ID NO: 607673 - protein, 9 aa, Homo Sapiens
QPDSILGVP

SEQ ID NO: 607674 - protein, 9 aa, Homo Sapiens
HRGLASATG

SEQ ID NO: 607675 - protein, 9 aa, Homo Sapiens
TVLLLSLLS

SEQ ID NO: 607676 - protein, 9 aa, Homo Sapiens
SILGVPSKC

SEQ ID NO: 607677 - protein, 9 aa, Homo Sapiens
VASSDGTLK

SEQ ID NO: 607678 - protein, 9 aa, Homo Sapiens
SLFRFCLWS

SEQ ID NO: 607679 - protein, 9 aa, Homo Sapiens
QGFTFSGFC

SEQ ID NO: 607680 - protein, 9 aa, Homo Sapiens
LSVTDLLVS

SEQ ID NO: 607681 - protein, 9 aa, Homo Sapiens
KCCFWVKQS

SEQ ID NO: 607682 - protein, 9 aa, Homo Sapiens
EEEGTQQAK

SEQ ID NO: 607683 - protein, 9 aa, Homo Sapiens
PDESFCMYS

SEQ ID NO: 607684 - protein, 9 aa, Homo Sapiens
LASATGEFL

SEQ ID NO: 607685 - protein, 9 aa, Homo Sapiens
TLKPSSSLA

SEQ ID NO: 607686 - protein, 9 aa, Homo Sapiens
FIDLRKELC

SEQ ID NO: 607687 - protein, 9 aa, Homo Sapiens
QAKTGKDPV

SEQ ID NO: 607688 - protein, 9 aa, Homo Sapiens
LVVMVRPPC

SEQ ID NO: 607689 - protein, 9 aa, Homo Sapiens
YFNSSAVPL

SEQ ID NO: 607690 - protein, 9 aa, Homo Sapiens
TSVLTNSRV

SEQ ID NO: 607691 - protein, 9 aa, Homo Sapiens
ILRRSNPNI

SEQ ID NO: 607692 - protein, 9 aa, Homo Sapiens
HYDRRSMRM

SEQ ID NO: 607693 - protein, 9 aa, Homo Sapiens
GQRALPRGG

SEQ ID NO: 607694 - protein, 9 aa, Homo Sapiens
SFYTSSFLY

SEQ ID NO: 607695 - protein, 9 aa, Homo Sapiens
ASLSVTDLL

SEQ ID NO: 607696 - protein, 9 aa, Homo Sapiens
SATGEFLYW

SEQ ID NO: 607697 - protein, 9 aa, Homo Sapiens
DGSGIYCTQ

SEQ ID NO: 607698 - protein, 9 aa, Homo Sapiens
DQKIYDQIT

SEQ ID NO: 607699 - protein, 9 aa, Homo Sapiens
AVPLAFGYF

SEQ ID NO: 607700 - protein, 9 aa, Homo Sapiens
RARRHPDTE

SEQ ID NO: 607701 - protein, 9 aa, Homo Sapiens
NSMMGDDED

SEQ ID NO: 607702 - protein, 9 aa, Homo Sapiens
GVWAQWRGA

SEQ ID NO: 607703 - protein, 9 aa, Homo Sapiens
GKGLNEFDS

SEQ ID NO: 607704 - protein, 9 aa, Homo Sapiens
LNLRELGPR

SEQ ID NO: 607705 - protein, 9 aa, Homo Sapiens
SVCKHGVLS

SEQ ID NO: 607706 - protein, 9 aa, Homo Sapiens
ETDNPRRYQ

SEQ ID NO: 607707 - protein, 9 aa, Homo Sapiens
PGKPYGAYD

SEQ ID NO: 607708 - protein, 9 aa, Homo Sapiens
LFCYIGCTV

SEQ ID NO: 607709 - protein, 9 aa, Homo Sapiens
PAKAGYDQN

SEQ ID NO: 607710 - protein, 9 aa, Homo Sapiens
QRYRAAAAK

SEQ ID NO: 607711 - protein, 9 aa, Homo Sapiens
QSSCSRRMG

SEQ ID NO: 607712 - protein, 9 aa, Homo Sapiens
PVRGSAAVQ

SEQ ID NO: 607713 - protein, 9 aa, Homo Sapiens
RGRRPTSGC

SEQ ID NO: 607714 - protein, 9 aa, Homo Sapiens
SPSTAQLTG

SEQ ID NO: 607715 - protein, 9 aa, Homo Sapiens
LGCSIAKFP

SEQ ID NO: 607716 - protein, 9 aa, Homo Sapiens
FLIFLIALI

SEQ ID NO: 607717 - protein, 9 aa, Homo Sapiens
AEFKKIYAN

SEQ ID NO: 607718 - protein, 9 aa, Homo Sapiens
TEDTDEKEE

SEQ ID NO: 607719 - protein, 9 aa, Homo Sapiens
YRDILRYDS

SEQ ID NO: 607720 - protein, 9 aa, Homo Sapiens
YGSCGYGGL

SEQ ID NO: 607721 - protein, 9 aa, Homo Sapiens
FPPAHSAAP

SEQ ID NO: 607722 - protein, 9 aa, Homo Sapiens
EYCKSNNGR

SEQ ID NO: 607723 - protein, 9 aa, Homo Sapiens
LVPQVLGPV

SEQ ID NO: 607724 - protein, 9 aa, Homo Sapiens
PEEEVPFCT

SEQ ID NO: 607725 - protein, 9 aa, Homo Sapiens
GPLSRASGG

SEQ ID NO: 607726 - protein, 9 aa, Homo Sapiens
CPHPPAAHP

SEQ ID NO: 607727 - protein, 9 aa, Homo Sapiens
VPDELLNKI

SEQ ID NO: 607728 - protein, 9 aa, Homo Sapiens
SLLGARGPL

SEQ ID NO: 607729 - protein, 9 aa, Homo Sapiens
QWAAAGPPP

SEQ ID NO: 607730 - protein, 9 aa, Homo Sapiens
YGHWYDRHK

SEQ ID NO: 607731 - protein, 9 aa, Homo Sapiens
LIFLIFLIA

SEQ ID NO: 607732 - protein, 9 aa, Homo Sapiens
DRLRSEYVR

SEQ ID NO: 607733 - protein, 9 aa, Homo Sapiens
LKSNKYKPW

SEQ ID NO: 607734 - protein, 9 aa, Homo Sapiens
TNNMADNKA

SEQ ID NO: 607735 - protein, 9 aa, Homo Sapiens
GSTLHSKET

SEQ ID NO: 607736 - protein, 9 aa, Homo Sapiens
GMDLGLKQK

SEQ ID NO: 607737 - protein, 9 aa, Homo Sapiens
DIHGLLPCR

SEQ ID NO: 607738 - protein, 9 aa, Homo Sapiens
SADDETDNP

SEQ ID NO: 607739 - protein, 9 aa, Homo Sapiens
TADQLCGEL

SEQ ID NO: 607740 - protein, 9 aa, Homo Sapiens
PQVLGPVTA

SEQ ID NO: 607741 - protein, 9 aa, Homo Sapiens
NPHGMSASP

SEQ ID NO: 607742 - protein, 9 aa, Homo Sapiens
DSSAFGPGC

SEQ ID NO: 607743 - protein, 9 aa, Homo Sapiens
TGWSKHSKV

SEQ ID NO: 607744 - protein, 9 aa, Homo Sapiens
MPAGQRAFN

SEQ ID NO: 607745 - protein, 9 aa, Homo Sapiens
PPAKAGYDQ

SEQ ID NO: 607746 - protein, 9 aa, Homo Sapiens
KIKRRRRRK

SEQ ID NO: 607747 - protein, 9 aa, Homo Sapiens
KNTNTRKRS

SEQ ID NO: 607748 - protein, 9 aa, Homo Sapiens
ELKIVHWKS

SEQ ID NO: 607749 - protein, 9 aa, Homo Sapiens
QLDLEANLT

SEQ ID NO: 607750 - protein, 9 aa, Homo Sapiens
GTSTSQDPM

SEQ ID NO: 607751 - protein, 9 aa, Homo Sapiens
KKPYEKNVR

SEQ ID NO: 607752 - protein, 9 aa, Homo Sapiens
SHRCFPSIS

SEQ ID NO: 607753 - protein, 9 aa, Homo Sapiens
DEPWCNQKT

SEQ ID NO: 607754 - protein, 9 aa, Homo Sapiens
GLLYGCIHA

SEQ ID NO: 607755 - protein, 9 aa, Homo Sapiens
QTLQSLVDI

SEQ ID NO: 607756 - protein, 9 aa, Homo Sapiens
ELANWDATP

SEQ ID NO: 607757 - protein, 9 aa, Homo Sapiens
EVDGLIDCM

SEQ ID NO: 607758 - protein, 9 aa, Homo Sapiens
VSIETRCLV

SEQ ID NO: 607759 - protein, 9 aa, Homo Sapiens
PLLPGLLDS

SEQ ID NO: 607760 - protein, 9 aa, Homo Sapiens
RLLQITTRE

SEQ ID NO: 607761 - protein, 9 aa, Homo Sapiens
PHPHAFIRC

SEQ ID NO: 607762 - protein, 9 aa, Homo Sapiens
APWDRVLDL

SEQ ID NO: 607763 - protein, 9 aa, Homo Sapiens
CNDHCVPRS

SEQ ID NO: 607764 - protein, 9 aa, Homo Sapiens
GFFEVFCQQ

SEQ ID NO: 607765 - protein, 9 aa, Homo Sapiens
DFGPGKGWE

SEQ ID NO: 607766 - protein, 9 aa, Homo Sapiens
IPLHLPDPK

SEQ ID NO: 607767 - protein, 9 aa, Homo Sapiens
LLNHLIYSL

SEQ ID NO: 607768 - protein, 9 aa, Homo Sapiens
EREELCAQI

SEQ ID NO: 607769 - protein, 9 aa, Homo Sapiens
SPTTSTTPT

SEQ ID NO: 607770 - protein, 9 aa, Homo Sapiens
WIPSGSFML

SEQ ID NO: 607771 - protein, 9 aa, Homo Sapiens
PSSTNNMAD

SEQ ID NO: 607772 - protein, 9 aa, Homo Sapiens
DHSRGKRFS

SEQ ID NO: 607773 - protein, 9 aa, Homo Sapiens
VVLMLLDCY

SEQ ID NO: 607774 - protein, 9 aa, Homo Sapiens
ILRRFQQIK

SEQ ID NO: 607775 - protein, 9 aa, Homo Sapiens
PVSFPIFLH

SEQ ID NO: 607776 - protein, 9 aa, Homo Sapiens
ELLLWHEGC

SEQ ID NO: 607777 - protein, 9 aa, Homo Sapiens
IAVGMRRSL

SEQ ID NO: 607778 - protein, 9 aa, Homo Sapiens
LQCFHILNM

SEQ ID NO: 607779 - protein, 9 aa, Homo Sapiens
HKVKASVHF

SEQ ID NO: 607780 - protein, 9 aa, Homo Sapiens
CIENKKSFD

SEQ ID NO: 607781 - protein, 9 aa, Homo Sapiens
YRIHRIFEQ

SEQ ID NO: 607782 - protein, 9 aa, Homo Sapiens
SLGSEALMV

SEQ ID NO: 607783 - protein, 9 aa, Homo Sapiens
LLGCGSNGF

SEQ ID NO: 607784 - protein, 9 aa, Homo Sapiens
PHVVIQPDI

SEQ ID NO: 607785 - protein, 9 aa, Homo Sapiens
YTGAYWRSW

SEQ ID NO: 607786 - protein, 9 aa, Homo Sapiens
YKDVKPVLD

SEQ ID NO: 607787 - protein, 9 aa, Homo Sapiens
LTATTERKD

SEQ ID NO: 607788 - protein, 9 aa, Homo Sapiens
IFLIFLIAL

SEQ ID NO: 607789 - protein, 9 aa, Homo Sapiens
ATEDAFTPL

SEQ ID NO: 607790 - protein, 9 aa, Homo Sapiens
ITILALAGE

SEQ ID NO: 607791 - protein, 9 aa, Homo Sapiens
ELLNKIYFK

SEQ ID NO: 607792 - protein, 9 aa, Homo Sapiens
GTKLGSPAQ

SEQ ID NO: 607793 - protein, 9 aa, Homo Sapiens
HKKFEREER

SEQ ID NO: 607794 - protein, 9 aa, Homo Sapiens
IVGRAEASG

SEQ ID NO: 607795 - protein, 9 aa, Homo Sapiens
IAREKKDVE

SEQ ID NO: 607796 - protein, 9 aa, Homo Sapiens
VNNWKNEFQ

SEQ ID NO: 607797 - protein, 9 aa, Homo Sapiens
DKLSRTFYG

SEQ ID NO: 607798 - protein, 9 aa, Homo Sapiens
EELRTLCRL

SEQ ID NO: 607799 - protein, 9 aa, Homo Sapiens
VEVPMWLAI

SEQ ID NO: 607800 - protein, 9 aa, Homo Sapiens
MGAKSIYKK

SEQ ID NO: 607801 - protein, 9 aa, Homo Sapiens
GGGSNHHHQ

SEQ ID NO: 607802 - protein, 9 aa, Homo Sapiens
GLPVEVPMW

SEQ ID NO: 607803 - protein, 9 aa, Homo Sapiens
MLNDRGNTA

SEQ ID NO: 607804 - protein, 9 aa, Homo Sapiens
QRPLLVTRS

SEQ ID NO: 607805 - protein, 9 aa, Homo Sapiens
NEAGSGRCS

SEQ ID NO: 607806 - protein, 9 aa, Homo Sapiens
TARGLGPSA

SEQ ID NO: 607807 - protein, 9 aa, Homo Sapiens
DTAVDLTSV

SEQ ID NO: 607808 - protein, 9 aa, Homo Sapiens
WQLDHIKPV

SEQ ID NO: 607809 - protein, 9 aa, Homo Sapiens
RVWRISDVH

SEQ ID NO: 607810 - protein, 9 aa, Homo Sapiens
LEASVESAK

SEQ ID NO: 607811 - protein, 9 aa, Homo Sapiens
MLYVGSWLG

SEQ ID NO: 607812 - protein, 9 aa, Homo Sapiens
WLVHVMLAL

SEQ ID NO: 607813 - protein, 9 aa, Homo Sapiens
HLIRERVKQ

SEQ ID NO: 607814 - protein, 9 aa, Homo Sapiens
ALAWQRCRA

SEQ ID NO: 607815 - protein, 9 aa, Homo Sapiens
RFLPGGLEF

SEQ ID NO: 607816 - protein, 9 aa, Homo Sapiens
WLQACAAST

SEQ ID NO: 607817 - protein, 9 aa, Homo Sapiens
ERIEREELC

SEQ ID NO: 607818 - protein, 9 aa, Homo Sapiens
HIGQKREVG

SEQ ID NO: 607819 - protein, 9 aa, Homo Sapiens
GIVAVLFCV

SEQ ID NO: 607820 - protein, 9 aa, Homo Sapiens
LAFFYSPLL

SEQ ID NO: 607821 - protein, 9 aa, Homo Sapiens
AKIPKRASV

SEQ ID NO: 607822 - protein, 9 aa, Homo Sapiens
DAVSRLRYY

SEQ ID NO: 607823 - protein, 9 aa, Homo Sapiens
VIKRIQSLL

SEQ ID NO: 607824 - protein, 9 aa, Homo Sapiens
VFKSSVSCE

SEQ ID NO: 607825 - protein, 9 aa, Homo Sapiens
CISRPSSGL

SEQ ID NO: 607826 - protein, 9 aa, Homo Sapiens
PNYRGRQHL

SEQ ID NO: 607827 - protein, 9 aa, Homo Sapiens
GCMQGRTTY

SEQ ID NO: 607828 - protein, 9 aa, Homo Sapiens
AHEVRITTL

SEQ ID NO: 607829 - protein, 9 aa, Homo Sapiens
DLCISVLLP

SEQ ID NO: 607830 - protein, 9 aa, Homo Sapiens
KIMQFMKGW

SEQ ID NO: 607831 - protein, 9 aa, Homo Sapiens
PDGDIYWGS

SEQ ID NO: 607832 - protein, 9 aa, Homo Sapiens
EEPLEGDMC

SEQ ID NO: 607833 - protein, 9 aa, Homo Sapiens
PLGKERNVL

SEQ ID NO: 607834 - protein, 9 aa, Homo Sapiens
HSSLDPLAF

SEQ ID NO: 607835 - protein, 9 aa, Homo Sapiens
IIEDPATLN

SEQ ID NO: 607836 - protein, 9 aa, Homo Sapiens
EGLYASVKA

SEQ ID NO: 607837 - protein, 9 aa, Homo Sapiens
NIAREKKDV

SEQ ID NO: 607838 - protein, 9 aa, Homo Sapiens
SQSVVFGDV

SEQ ID NO: 607839 - protein, 9 aa, Homo Sapiens
LRRSHGDHS

SEQ ID NO: 607840 - protein, 9 aa, Homo Sapiens
KTIVQAASD

SEQ ID NO: 607841 - protein, 9 aa, Homo Sapiens
LLWAKFTNF

SEQ ID NO: 607842 - protein, 9 aa, Homo Sapiens
LTVSAMPSK

SEQ ID NO: 607843 - protein, 9 aa, Homo Sapiens
SWDLWSTLC

SEQ ID NO: 607844 - protein, 9 aa, Homo Sapiens
VGEGHFSKD

SEQ ID NO: 607845 - protein, 9 aa, Homo Sapiens
GDIYWGSGL

SEQ ID NO: 607846 - protein, 9 aa, Homo Sapiens
TLWLFLSSE

SEQ ID NO: 607847 - protein, 9 aa, Homo Sapiens
EATVLLEAR

SEQ ID NO: 607848 - protein, 9 aa, Homo Sapiens
FLEHRLVSL

SEQ ID NO: 607849 - protein, 9 aa, Homo Sapiens
SCCYFCRTV

SEQ ID NO: 607850 - protein, 9 aa, Homo Sapiens
PQAAPHPQA

SEQ ID NO: 607851 - protein, 9 aa, Homo Sapiens
AQESARRYV

SEQ ID NO: 607852 - protein, 9 aa, Homo Sapiens
TGHFRNRVI

SEQ ID NO: 607853 - protein, 9 aa, Homo Sapiens
NDICLQGLC

SEQ ID NO: 607854 - protein, 9 aa, Homo Sapiens
ERLFRKLFS

SEQ ID NO: 607855 - protein, 9 aa, Homo Sapiens
AFIRCPSSS

SEQ ID NO: 607856 - protein, 9 aa, Homo Sapiens
VNKWVIFRN

SEQ ID NO: 607857 - protein, 9 aa, Homo Sapiens
ASTARGLGP

SEQ ID NO: 607858 - protein, 9 aa, Homo Sapiens
VPLAFGYFG

SEQ ID NO: 607859 - protein, 9 aa, Homo Sapiens
REPDIPPPQ

SEQ ID NO: 607860 - protein, 9 aa, Homo Sapiens
PVLKRRCVE

SEQ ID NO: 607861 - protein, 9 aa, Homo Sapiens
EPAEGRGST

SEQ ID NO: 607862 - protein, 9 aa, Homo Sapiens
DSDGTEDTD

SEQ ID NO: 607863 - protein, 9 aa, Homo Sapiens
RNFISTASP

SEQ ID NO: 607864 - protein, 9 aa, Homo Sapiens
FDKMLNDRG

SEQ ID NO: 607865 - protein, 9 aa, Homo Sapiens
RICGVCFQR

SEQ ID NO: 607866 - protein, 9 aa, Homo Sapiens
CGLVWLQAC

SEQ ID NO: 607867 - protein, 9 aa, Homo Sapiens
HSICEVQSD

SEQ ID NO: 607868 - protein, 9 aa, Homo Sapiens
LWCSPFRRL

SEQ ID NO: 607869 - protein, 9 aa, Homo Sapiens
VNNHLSGIL

SEQ ID NO: 607870 - protein, 9 aa, Homo Sapiens
KLKPYILDP

SEQ ID NO: 607871 - protein, 9 aa, Homo Sapiens
PIVHSAQSG

SEQ ID NO: 607872 - protein, 9 aa, Homo Sapiens
PSLQHNTSR

SEQ ID NO: 607873 - protein, 9 aa, Homo Sapiens
PIRAVPLAF

SEQ ID NO: 607874 - protein, 9 aa, Homo Sapiens
YAKKVAKKD

SEQ ID NO: 607875 - protein, 9 aa, Homo Sapiens
EACIMGAKS

SEQ ID NO: 607876 - protein, 9 aa, Homo Sapiens
KTTVVSPKN

SEQ ID NO: 607877 - protein, 9 aa, Homo Sapiens
RTLTTTASP

SEQ ID NO: 607878 - protein, 9 aa, Homo Sapiens
QNVLQQSAV

SEQ ID NO: 607879 - protein, 9 aa, Homo Sapiens
IRIYFGATG

SEQ ID NO: 607880 - protein, 9 aa, Homo Sapiens
RPQKPASLA

SEQ ID NO: 607881 - protein, 9 aa, Homo Sapiens
PTPRPPRPT

SEQ ID NO: 607882 - protein, 9 aa, Homo Sapiens
QWIDKKPYE

SEQ ID NO: 607883 - protein, 9 aa, Homo Sapiens
RYVSAVFRG

SEQ ID NO: 607884 - protein, 9 aa, Homo Sapiens
LVGLSVGQI

SEQ ID NO: 607885 - protein, 9 aa, Homo Sapiens
RKGLYVEVK

SEQ ID NO: 607886 - protein, 9 aa, Homo Sapiens
ASLNSYLEM

SEQ ID NO: 607887 - protein, 9 aa, Homo Sapiens
DPWIPSGSF

SEQ ID NO: 607888 - protein, 9 aa, Homo Sapiens
HEPVATSLS

SEQ ID NO: 607889 - protein, 9 aa, Homo Sapiens
HVDSGCQGD

SEQ ID NO: 607890 - protein, 9 aa, Homo Sapiens
IWCCLNLKQ

SEQ ID NO: 607891 - protein, 9 aa, Homo Sapiens
RYDSTRVPL

SEQ ID NO: 607892 - protein, 9 aa, Homo Sapiens
QESARRYVS

SEQ ID NO: 607893 - protein, 9 aa, Homo Sapiens
FRFPEDEFD

SEQ ID NO: 607894 - protein, 9 aa, Homo Sapiens
QRPQKPASL

SEQ ID NO: 607895 - protein, 9 aa, Homo Sapiens
TQSRITEQK

SEQ ID NO: 607896 - protein, 9 aa, Homo Sapiens
PSVTKKRLS

SEQ ID NO: 607897 - protein, 9 aa, Homo Sapiens
EDEFDGHQF

SEQ ID NO: 607898 - protein, 9 aa, Homo Sapiens
TCGPSPETY

SEQ ID NO: 607899 - protein, 9 aa, Homo Sapiens
GNYRSFLGI

SEQ ID NO: 607900 - protein, 9 aa, Homo Sapiens
EQELCKQLH

SEQ ID NO: 607901 - protein, 9 aa, Homo Sapiens
PAGQRAFNK

SEQ ID NO: 607902 - protein, 9 aa, Homo Sapiens
TDMNKNDKQ

SEQ ID NO: 607903 - protein, 9 aa, Homo Sapiens
QLAKLCYDL

SEQ ID NO: 607904 - protein, 9 aa, Homo Sapiens
RDQELAALL

SEQ ID NO: 607905 - protein, 9 aa, Homo Sapiens
TSSAHTTGK

SEQ ID NO: 607906 - protein, 9 aa, Homo Sapiens
MVSTEKSAV

SEQ ID NO: 607907 - protein, 9 aa, Homo Sapiens
GVTESHYLH

SEQ ID NO: 607908 - protein, 9 aa, Homo Sapiens
NHLSGILII

SEQ ID NO: 607909 - protein, 9 aa, Homo Sapiens
QTLVIMPLV

SEQ ID NO: 607910 - protein, 9 aa, Homo Sapiens
ETFSISQER

SEQ ID NO: 607911 - protein, 9 aa, Homo Sapiens
YILDPVEDT

SEQ ID NO: 607912 - protein, 9 aa, Homo Sapiens
ATKRHAVLL

SEQ ID NO: 607913 - protein, 9 aa, Homo Sapiens
EEFSHLPCP

SEQ ID NO: 607914 - protein, 9 aa, Homo Sapiens
QVPQPLLEE

SEQ ID NO: 607915 - protein, 9 aa, Homo Sapiens
SEHEKTLLE

SEQ ID NO: 607916 - protein, 9 aa, Homo Sapiens
VKKIMQFMK

SEQ ID NO: 607917 - protein, 9 aa, Homo Sapiens
ECSLSPPTC

SEQ ID NO: 607918 - protein, 9 aa, Homo Sapiens
QAHRGPQPP

SEQ ID NO: 607919 - protein, 9 aa, Homo Sapiens
PSESPPTSP

SEQ ID NO: 607920 - protein, 9 aa, Homo Sapiens
VKVSYCVLT

SEQ ID NO: 607921 - protein, 9 aa, Homo Sapiens
RISELMSTP

SEQ ID NO: 607922 - protein, 9 aa, Homo Sapiens
PAAPRGGPG

SEQ ID NO: 607923 - protein, 9 aa, Homo Sapiens
ALGRVGGWR

SEQ ID NO: 607924 - protein, 9 aa, Homo Sapiens
YEEMARRYE

SEQ ID NO: 607925 - protein, 9 aa, Homo Sapiens
LRKSSGTAT

SEQ ID NO: 607926 - protein, 9 aa, Homo Sapiens
LGKERNVLE

SEQ ID NO: 607927 - protein, 9 aa, Homo Sapiens
ISGPYLPYK

SEQ ID NO: 607928 - protein, 9 aa, Homo Sapiens
KFDLQFPEN

SEQ ID NO: 607929 - protein, 9 aa, Homo Sapiens
PGEGRGDPC

SEQ ID NO: 607930 - protein, 9 aa, Homo Sapiens
ERRGRRPTS

SEQ ID NO: 607931 - protein, 9 aa, Homo Sapiens
LLMHGWFHF

SEQ ID NO: 607932 - protein, 9 aa, Homo Sapiens
LLTKTYRIH

SEQ ID NO: 607933 - protein, 9 aa, Homo Sapiens
RVEGQVGGS

SEQ ID NO: 607934 - protein, 9 aa, Homo Sapiens
VSDSFQYRY

SEQ ID NO: 607935 - protein, 9 aa, Homo Sapiens
EMVLLSVGA

SEQ ID NO: 607936 - protein, 9 aa, Homo Sapiens
HVPISGQPM

SEQ ID NO: 607937 - protein, 9 aa, Homo Sapiens
AVDLTSVRV

SEQ ID NO: 607938 - protein, 9 aa, Homo Sapiens
TPSTRTSAS

SEQ ID NO: 607939 - protein, 9 aa, Homo Sapiens
IQQCMVAHA

SEQ ID NO: 607940 - protein, 9 aa, Homo Sapiens
DSVFEVPKT

SEQ ID NO: 607941 - protein, 9 aa, Homo Sapiens
TCYSHLLVV

SEQ ID NO: 607942 - protein, 9 aa, Homo Sapiens
KSNDNSGEK

SEQ ID NO: 607943 - protein, 9 aa, Homo Sapiens
LWRVTAVPV

SEQ ID NO: 607944 - protein, 9 aa, Homo Sapiens
KKCGKANTR

SEQ ID NO: 607945 - protein, 9 aa, Homo Sapiens
SDQLEKLRR

SEQ ID NO: 607946 - protein, 9 aa, Homo Sapiens
IQELTVSYF

SEQ ID NO: 607947 - protein, 9 aa, Homo Sapiens
PTKSCKPLN

SEQ ID NO: 607948 - protein, 9 aa, Homo Sapiens
RIKHCKMAS

SEQ ID NO: 607949 - protein, 9 aa, Homo Sapiens
WQWIDKKPY

SEQ ID NO: 607950 - protein, 9 aa, Homo Sapiens
LVLSEEIPE

SEQ ID NO: 607951 - protein, 9 aa, Homo Sapiens
GVPIVQFPY

SEQ ID NO: 607952 - protein, 9 aa, Homo Sapiens
NFDTPTSFN

SEQ ID NO: 607953 - protein, 9 aa, Homo Sapiens
YLEMDMEGL

SEQ ID NO: 607954 - protein, 9 aa, Homo Sapiens
PRSLPGAWR

SEQ ID NO: 607955 - protein, 9 aa, Homo Sapiens
DHIQALRWI

SEQ ID NO: 607956 - protein, 9 aa, Homo Sapiens
SDGTEDTDE

SEQ ID NO: 607957 - protein, 9 aa, Homo Sapiens
VEITLQRTK

SEQ ID NO: 607958 - protein, 9 aa, Homo Sapiens
AENIVGRAE

SEQ ID NO: 607959 - protein, 9 aa, Homo Sapiens
SRMMLVNWQ

SEQ ID NO: 607960 - protein, 9 aa, Homo Sapiens
TAERIEREE

SEQ ID NO: 607961 - protein, 9 aa, Homo Sapiens
ERAIKTILK

SEQ ID NO: 607962 - protein, 9 aa, Homo Sapiens
GKTCGPSPE

SEQ ID NO: 607963 - protein, 9 aa, Homo Sapiens
FSLGSLTGP

SEQ ID NO: 607964 - protein, 9 aa, Homo Sapiens
GGSPGGPGC

SEQ ID NO: 607965 - protein, 9 aa, Homo Sapiens
ISTASPLTN

SEQ ID NO: 607966 - protein, 9 aa, Homo Sapiens
KLVLPPVSP

SEQ ID NO: 607967 - protein, 9 aa, Homo Sapiens
KECVSDSFQ

SEQ ID NO: 607968 - protein, 9 aa, Homo Sapiens
SLSKVSIIR

SEQ ID NO: 607969 - protein, 9 aa, Homo Sapiens
PVVAILGSV

SEQ ID NO: 607970 - protein, 9 aa, Homo Sapiens
LSRGKSFLS

SEQ ID NO: 607971 - protein, 9 aa, Homo Sapiens
KRPATIFLT

SEQ ID NO: 607972 - protein, 9 aa, Homo Sapiens
QLWRFLPGG

SEQ ID NO: 607973 - protein, 9 aa, Homo Sapiens
RLYLLTLAW

SEQ ID NO: 607974 - protein, 9 aa, Homo Sapiens
WRKSLPRGT

SEQ ID NO: 607975 - protein, 9 aa, Homo Sapiens
HAAQQERFS

SEQ ID NO: 607976 - protein, 9 aa, Homo Sapiens
SESCERPWE

SEQ ID NO: 607977 - protein, 9 aa, Homo Sapiens
ACDQRLCHP

SEQ ID NO: 607978 - protein, 9 aa, Homo Sapiens
RRSHGDHSR

SEQ ID NO: 607979 - protein, 9 aa, Homo Sapiens
WKNEFQKWL

SEQ ID NO: 607980 - protein, 9 aa, Homo Sapiens
RGTAIHPGT

SEQ ID NO: 607981 - protein, 9 aa, Homo Sapiens
FITAVTSQS

SEQ ID NO: 607982 - protein, 9 aa, Homo Sapiens
TRIRACFTQ

SEQ ID NO: 607983 - protein, 9 aa, Homo Sapiens
CCCQDGEAR

SEQ ID NO: 607984 - protein, 9 aa, Homo Sapiens
AASAPGGRL

SEQ ID NO: 607985 - protein, 9 aa, Homo Sapiens
MKIQDDLQS

SEQ ID NO: 607986 - protein, 9 aa, Homo Sapiens
EGRGDPCEL

SEQ ID NO: 607987 - protein, 9 aa, Homo Sapiens
GSNHHHQSR

SEQ ID NO: 607988 - protein, 9 aa, Homo Sapiens
EDFECIENK

SEQ ID NO: 607989 - protein, 9 aa, Homo Sapiens
CLASPKEID

SEQ ID NO: 607990 - protein, 9 aa, Homo Sapiens
ASLRKCGSG

SEQ ID NO: 607991 - protein, 9 aa, Homo Sapiens
PGRKWRKLV

SEQ ID NO: 607992 - protein, 9 aa, Homo Sapiens
SPFRVWRIS

SEQ ID NO: 607993 - protein, 9 aa, Homo Sapiens
NHLIYSLRN

SEQ ID NO: 607994 - protein, 9 aa, Homo Sapiens
ELTGHFRNR

SEQ ID NO: 607995 - protein, 9 aa, Homo Sapiens
LWYFSQSPH

SEQ ID NO: 607996 - protein, 9 aa, Homo Sapiens
CNINNLCNF

SEQ ID NO: 607997 - protein, 9 aa, Homo Sapiens
ALRGEKDPR

SEQ ID NO: 607998 - protein, 9 aa, Homo Sapiens
CTMPAGQRA

SEQ ID NO: 607999 - protein, 9 aa, Homo Sapiens
AAAANPKTL

SEQ ID NO: 608000 - protein, 9 aa, Homo Sapiens
TDLTFFFED

SEQ ID NO: 608001 - protein, 9 aa, Homo Sapiens
ELQSMSAKL

SEQ ID NO: 608002 - protein, 9 aa, Homo Sapiens
VHVDSGCQG

SEQ ID NO: 608003 - protein, 9 aa, Homo Sapiens
ACYRETCLY

SEQ ID NO: 608004 - protein, 9 aa, Homo Sapiens
FGKFIRIYF

SEQ ID NO: 608005 - protein, 9 aa, Homo Sapiens
ENGGLGWWR

SEQ ID NO: 608006 - protein, 9 aa, Homo Sapiens
GCIPAVISA

SEQ ID NO: 608007 - protein, 9 aa, Homo Sapiens
YYRIVKGLP

SEQ ID NO: 608008 - protein, 9 aa, Homo Sapiens
VGPDGDIYW

SEQ ID NO: 608009 - protein, 9 aa, Homo Sapiens
HSCSVNKWV

SEQ ID NO: 608010 - protein, 9 aa, Homo Sapiens
PRSQRLLGP

SEQ ID NO: 608011 - protein, 9 aa, Homo Sapiens
PQQPQPPLP

SEQ ID NO: 608012 - protein, 9 aa, Homo Sapiens
DAVLNKAAQ

SEQ ID NO: 608013 - protein, 9 aa, Homo Sapiens
IAYLKKKLN

SEQ ID NO: 608014 - protein, 9 aa, Homo Sapiens
TKCAYSLSI

SEQ ID NO: 608015 - protein, 9 aa, Homo Sapiens
KCKLLVLGL

SEQ ID NO: 608016 - protein, 9 aa, Homo Sapiens
VVPQFLVLI

SEQ ID NO: 608017 - protein, 9 aa, Homo Sapiens
VPMWLAINL

SEQ ID NO: 608018 - protein, 9 aa, Homo Sapiens
SITQHTLHS

SEQ ID NO: 608019 - protein, 9 aa, Homo Sapiens
ASHRCFPSI

SEQ ID NO: 608020 - protein, 9 aa, Homo Sapiens
SEQHEVELS

SEQ ID NO: 608021 - protein, 9 aa, Homo Sapiens
LLSRGLLYG

SEQ ID NO: 608022 - protein, 9 aa, Homo Sapiens
ALQDSNSRE

SEQ ID NO: 608023 - protein, 9 aa, Homo Sapiens
GPLSVPQVL

SEQ ID NO: 608024 - protein, 9 aa, Homo Sapiens
RPTSGCGAA

SEQ ID NO: 608025 - protein, 9 aa, Homo Sapiens
TAVDLTSVR

SEQ ID NO: 608026 - protein, 9 aa, Homo Sapiens
RDTFVFQVV

SEQ ID NO: 608027 - protein, 9 aa, Homo Sapiens
FQKYCSVKP

SEQ ID NO: 608028 - protein, 9 aa, Homo Sapiens
KANQRKTAL

SEQ ID NO: 608029 - protein, 9 aa, Homo Sapiens
QVMYAMLVF

SEQ ID NO: 608030 - protein, 9 aa, Homo Sapiens
DNRLVNYFM

SEQ ID NO: 608031 - protein, 9 aa, Homo Sapiens
PGGLEFWGP

SEQ ID NO: 608032 - protein, 9 aa, Homo Sapiens
ITSPICLAS

SEQ ID NO: 608033 - protein, 9 aa, Homo Sapiens
SISLVALRP

SEQ ID NO: 608034 - protein, 9 aa, Homo Sapiens
NCKFVLTGR

SEQ ID NO: 608035 - protein, 9 aa, Homo Sapiens
EQKLGEKML

SEQ ID NO: 608036 - protein, 9 aa, Homo Sapiens
VERRLLSPM

SEQ ID NO: 608037 - protein, 9 aa, Homo Sapiens
LDKKVRERL

SEQ ID NO: 608038 - protein, 9 aa, Homo Sapiens
VEEGVAGFF

SEQ ID NO: 608039 - protein, 9 aa, Homo Sapiens
TEYCIDTGA

SEQ ID NO: 608040 - protein, 9 aa, Homo Sapiens
SSDLCISVL

SEQ ID NO: 608041 - protein, 9 aa, Homo Sapiens
ECDPGAVFL

SEQ ID NO: 608042 - protein, 9 aa, Homo Sapiens
VRTARRRRK

SEQ ID NO: 608043 - protein, 9 aa, Homo Sapiens
QSLVDILPE

SEQ ID NO: 608044 - protein, 9 aa, Homo Sapiens
GLGLSIVRG

SEQ ID NO: 608045 - protein, 9 aa, Homo Sapiens
RDLYSKACI

SEQ ID NO: 608046 - protein, 9 aa, Homo Sapiens
PFPRIVVGS

SEQ ID NO: 608047 - protein, 9 aa, Homo Sapiens
QRTKMTKGI

SEQ ID NO: 608048 - protein, 9 aa, Homo Sapiens
TAAPQAAPH

SEQ ID NO: 608049 - protein, 9 aa, Homo Sapiens
DTRKAHILN

SEQ ID NO: 608050 - protein, 9 aa, Homo Sapiens
WFKNRRQRY

SEQ ID NO: 608051 - protein, 9 aa, Homo Sapiens
SHYAHYAAS

SEQ ID NO: 608052 - protein, 9 aa, Homo Sapiens
SRTPTSTPV

SEQ ID NO: 608053 - protein, 9 aa, Homo Sapiens
YAALLTKTY

SEQ ID NO: 608054 - protein, 9 aa, Homo Sapiens
NRYRDILRY

SEQ ID NO: 608055 - protein, 9 aa, Homo Sapiens
DSLEIQCLV

SEQ ID NO: 608056 - protein, 9 aa, Homo Sapiens
SQSGGNQSW

SEQ ID NO: 608057 - protein, 9 aa, Homo Sapiens
TKECVSDSF

SEQ ID NO: 608058 - protein, 9 aa, Homo Sapiens
LLMDEAAMP

SEQ ID NO: 608059 - protein, 9 aa, Homo Sapiens
RRDDVVAVA

SEQ ID NO: 608060 - protein, 9 aa, Homo Sapiens
LNGTYGDAN

SEQ ID NO: 608061 - protein, 9 aa, Homo Sapiens
HRQAAERAR

SEQ ID NO: 608062 - protein, 9 aa, Homo Sapiens
QVAAGGAQS

SEQ ID NO: 608063 - protein, 9 aa, Homo Sapiens
TVSLATAVC

SEQ ID NO: 608064 - protein, 9 aa, Homo Sapiens
GHILGNYRS

SEQ ID NO: 608065 - protein, 9 aa, Homo Sapiens
YGCIHAIGV

SEQ ID NO: 608066 - protein, 9 aa, Homo Sapiens
RALKQILCK

SEQ ID NO: 608067 - protein, 9 aa, Homo Sapiens
DGQHLCFTR

SEQ ID NO: 608068 - protein, 9 aa, Homo Sapiens
FHKKFEREE

SEQ ID NO: 608069 - protein, 9 aa, Homo Sapiens
IFLFMLFLR

SEQ ID NO: 608070 - protein, 9 aa, Homo Sapiens
REGLVENGG

SEQ ID NO: 608071 - protein, 9 aa, Homo Sapiens
WLISHDPGT

SEQ ID NO: 608072 - protein, 9 aa, Homo Sapiens
TLALVPACL

SEQ ID NO: 608073 - protein, 9 aa, Homo Sapiens
SLPEVFLKP

SEQ ID NO: 608074 - protein, 9 aa, Homo Sapiens
SCDYSIPSR

SEQ ID NO: 608075 - protein, 9 aa, Homo Sapiens
LLPSESCER

SEQ ID NO: 608076 - protein, 9 aa, Homo Sapiens
LQKKEKLRK

SEQ ID NO: 608077 - protein, 9 aa, Homo Sapiens
AVLFCVVTQ

SEQ ID NO: 608078 - protein, 9 aa, Homo Sapiens
ADQDAGWLL

SEQ ID NO: 608079 - protein, 9 aa, Homo Sapiens
LTFFFEDCF

SEQ ID NO: 608080 - protein, 9 aa, Homo Sapiens
LLESAFLDL

SEQ ID NO: 608081 - protein, 9 aa, Homo Sapiens
FCNINNLCN

SEQ ID NO: 608082 - protein, 9 aa, Homo Sapiens
DGTITTQLS

SEQ ID NO: 608083 - protein, 9 aa, Homo Sapiens
CNQKTEHQR

SEQ ID NO: 608084 - protein, 9 aa, Homo Sapiens
NSTLPIGLC

SEQ ID NO: 608085 - protein, 9 aa, Homo Sapiens
SEQVPQPLL

SEQ ID NO: 608086 - protein, 9 aa, Homo Sapiens
DSLWCSPFR

SEQ ID NO: 608087 - protein, 9 aa, Homo Sapiens
QVPYKCPDY

SEQ ID NO: 608088 - protein, 9 aa, Homo Sapiens
KNSYTHCNE

SEQ ID NO: 608089 - protein, 9 aa, Homo Sapiens
TFSISQERS

SEQ ID NO: 608090 - protein, 9 aa, Homo Sapiens
CDNIPCEKG

SEQ ID NO: 608091 - protein, 9 aa, Homo Sapiens
VDLTSVRVT

SEQ ID NO: 608092 - protein, 9 aa, Homo Sapiens
SAMLTVSAM

SEQ ID NO: 608093 - protein, 9 aa, Homo Sapiens
DVVAVAGNE

SEQ ID NO: 608094 - protein, 9 aa, Homo Sapiens
VVHSLIEAY

SEQ ID NO: 608095 - protein, 9 aa, Homo Sapiens
WLPIWGSLN

SEQ ID NO: 608096 - protein, 9 aa, Homo Sapiens
LPIGLCLTK

SEQ ID NO: 608097 - protein, 9 aa, Homo Sapiens
KLHAEVTEN

SEQ ID NO: 608098 - protein, 9 aa, Homo Sapiens
ANPSLRGGR

SEQ ID NO: 608099 - protein, 9 aa, Homo Sapiens
LLGPPASRQ

SEQ ID NO: 608100 - protein, 9 aa, Homo Sapiens
STAGGMAGT

SEQ ID NO: 608101 - protein, 9 aa, Homo Sapiens
KLFCSLSLL

SEQ ID NO: 608102 - protein, 9 aa, Homo Sapiens
NDAVSRLRY

SEQ ID NO: 608103 - protein, 9 aa, Homo Sapiens
NGEEGEPHS

SEQ ID NO: 608104 - protein, 9 aa, Homo Sapiens
SSEVCTSTV

SEQ ID NO: 608105 - protein, 9 aa, Homo Sapiens
PGKGWEVIN

SEQ ID NO: 608106 - protein, 9 aa, Homo Sapiens
EECSIDEYC

SEQ ID NO: 608107 - protein, 9 aa, Homo Sapiens
ATSADASVR

SEQ ID NO: 608108 - protein, 9 aa, Homo Sapiens
LSDKLKEAQ

SEQ ID NO: 608109 - protein, 9 aa, Homo Sapiens
EEPRSKEAV

SEQ ID NO: 608110 - protein, 9 aa, Homo Sapiens
PAFNAKLPN

SEQ ID NO: 608111 - protein, 9 aa, Homo Sapiens
ERDDWQRLC

SEQ ID NO: 608112 - protein, 9 aa, Homo Sapiens
WVNNCIGHC

SEQ ID NO: 608113 - protein, 9 aa, Homo Sapiens
FQYRYTSEK

SEQ ID NO: 608114 - protein, 9 aa, Homo Sapiens
FIRIYFGAT

SEQ ID NO: 608115 - protein, 9 aa, Homo Sapiens
QRALRTRLH

SEQ ID NO: 608116 - protein, 9 aa, Homo Sapiens
LNSDDMSEN

SEQ ID NO: 608117 - protein, 9 aa, Homo Sapiens
MVLLSVGAG

SEQ ID NO: 608118 - protein, 9 aa, Homo Sapiens
VAPLLNTFI

SEQ ID NO: 608119 - protein, 9 aa, Homo Sapiens
ISTELNPHG

SEQ ID NO: 608120 - protein, 9 aa, Homo Sapiens
CLNLKQFIL

SEQ ID NO: 608121 - protein, 9 aa, Homo Sapiens
LPANGGRDF

SEQ ID NO: 608122 - protein, 9 aa, Homo Sapiens
RKNVFRKNY

SEQ ID NO: 608123 - protein, 9 aa, Homo Sapiens
IHMIEEYRR

SEQ ID NO: 608124 - protein, 9 aa, Homo Sapiens
WIDKKPYEK

SEQ ID NO: 608125 - protein, 9 aa, Homo Sapiens
FKPPEVASN

SEQ ID NO: 608126 - protein, 9 aa, Homo Sapiens
LLLWNNYFH

SEQ ID NO: 608127 - protein, 9 aa, Homo Sapiens
LASQISGPY

SEQ ID NO: 608128 - protein, 9 aa, Homo Sapiens
ASAQTLVIM

SEQ ID NO: 608129 - protein, 9 aa, Homo Sapiens
TIISSDLCI

SEQ ID NO: 608130 - protein, 9 aa, Homo Sapiens
EKLHAEVTE

SEQ ID NO: 608131 - protein, 9 aa, Homo Sapiens
EGGKGLGKG

SEQ ID NO: 608132 - protein, 9 aa, Homo Sapiens
LPSSLLDSL

SEQ ID NO: 608133 - protein, 9 aa, Homo Sapiens
RESETTKCA

SEQ ID NO: 608134 - protein, 9 aa, Homo Sapiens
SLGFVISNQ

SEQ ID NO: 608135 - protein, 9 aa, Homo Sapiens
AVSEMVLLS

SEQ ID NO: 608136 - protein, 9 aa, Homo Sapiens
EGLVENGGL

SEQ ID NO: 608137 - protein, 9 aa, Homo Sapiens
NVQPIDYGW

SEQ ID NO: 608138 - protein, 9 aa, Homo Sapiens
GGSGCEERG

SEQ ID NO: 608139 - protein, 9 aa, Homo Sapiens
VLTCFNDAV

SEQ ID NO: 608140 - protein, 9 aa, Homo Sapiens
NEVVQMNLE

SEQ ID NO: 608141 - protein, 9 aa, Homo Sapiens
PNFPGPTGP

SEQ ID NO: 608142 - protein, 9 aa, Homo Sapiens
PQNKNHLVL

SEQ ID NO: 608143 - protein, 9 aa, Homo Sapiens
FLYAYPGIL

SEQ ID NO: 608144 - protein, 9 aa, Homo Sapiens
NFHKKFERE

SEQ ID NO: 608145 - protein, 9 aa, Homo Sapiens
PRVVQAHRG

SEQ ID NO: 608146 - protein, 9 aa, Homo Sapiens
WSWRRSFIT

SEQ ID NO: 608147 - protein, 9 aa, Homo Sapiens
SQETLTLKI

SEQ ID NO: 608148 - protein, 9 aa, Homo Sapiens
RRFALSFGH

SEQ ID NO: 608149 - protein, 9 aa, Homo Sapiens
TVRCFKGLL

SEQ ID NO: 608150 - protein, 9 aa, Homo Sapiens
ASEPCSRQS

SEQ ID NO: 608151 - protein, 9 aa, Homo Sapiens
PISGQPMGS

SEQ ID NO: 608152 - protein, 9 aa, Homo Sapiens
LKIVHWKSQ

SEQ ID NO: 608153 - protein, 9 aa, Homo Sapiens
VLEASVESA

SEQ ID NO: 608154 - protein, 9 aa, Homo Sapiens
HGALFLFIS

SEQ ID NO: 608155 - protein, 9 aa, Homo Sapiens
SMSANTIIF

SEQ ID NO: 608156 - protein, 9 aa, Homo Sapiens
GYSATTCQQ

SEQ ID NO: 608157 - protein, 9 aa, Homo Sapiens
AIHILELLM

SEQ ID NO: 608158 - protein, 9 aa, Homo Sapiens
LWALSLLGP

SEQ ID NO: 608159 - protein, 9 aa, Homo Sapiens
FTGLTFVKK

SEQ ID NO: 608160 - protein, 9 aa, Homo Sapiens
TEEEDFECI

SEQ ID NO: 608161 - protein, 9 aa, Homo Sapiens
LTQYLKRIK

SEQ ID NO: 608162 - protein, 9 aa, Homo Sapiens
RASWRSPSG

SEQ ID NO: 608163 - protein, 9 aa, Homo Sapiens
HRPRPERRG

SEQ ID NO: 608164 - protein, 9 aa, Homo Sapiens
FVKKRALSP

SEQ ID NO: 608165 - protein, 9 aa, Homo Sapiens
HRLALSSGV

SEQ ID NO: 608166 - protein, 9 aa, Homo Sapiens
LKSNEKPLR

SEQ ID NO: 608167 - protein, 9 aa, Homo Sapiens
FLDLFILRL

SEQ ID NO: 608168 - protein, 9 aa, Homo Sapiens
PPSSSEMKA

SEQ ID NO: 608169 - protein, 9 aa, Homo Sapiens
ILLEETPSH

SEQ ID NO: 608170 - protein, 9 aa, Homo Sapiens
TEQQRLAAE

SEQ ID NO: 608171 - protein, 9 aa, Homo Sapiens
TRPWRRPWG

SEQ ID NO: 608172 - protein, 9 aa, Homo Sapiens
TKKRLSSGQ

SEQ ID NO: 608173 - protein, 9 aa, Homo Sapiens
GCERARLAT

SEQ ID NO: 608174 - protein, 9 aa, Homo Sapiens
HGWFHFLQD

SEQ ID NO: 608175 - protein, 9 aa, Homo Sapiens
KCGSGRGKA

SEQ ID NO: 608176 - protein, 9 aa, Homo Sapiens
PTFACNLSR

SEQ ID NO: 608177 - protein, 9 aa, Homo Sapiens
LCISVLLPV

SEQ ID NO: 608178 - protein, 9 aa, Homo Sapiens
SSVSCGHGN

SEQ ID NO: 608179 - protein, 9 aa, Homo Sapiens
FVDTAGLLE

SEQ ID NO: 608180 - protein, 9 aa, Homo Sapiens
KTPVAPKND

SEQ ID NO: 608181 - protein, 9 aa, Homo Sapiens
GAKPHRCQA

SEQ ID NO: 608182 - protein, 9 aa, Homo Sapiens
NQTEPPKVS

SEQ ID NO: 608183 - protein, 9 aa, Homo Sapiens
YRTLLFKAV

SEQ ID NO: 608184 - protein, 9 aa, Homo Sapiens
TITTQLSSG

SEQ ID NO: 608185 - protein, 9 aa, Homo Sapiens
VQPIDYGWM

SEQ ID NO: 608186 - protein, 9 aa, Homo Sapiens
CPFDKLSRT

SEQ ID NO: 608187 - protein, 9 aa, Homo Sapiens
TTNSSGTQY

SEQ ID NO: 608188 - protein, 9 aa, Homo Sapiens
YRETCLYIR

SEQ ID NO: 608189 - protein, 9 aa, Homo Sapiens
EKPCKMCES

SEQ ID NO: 608190 - protein, 9 aa, Homo Sapiens
TDEKEEDEG

SEQ ID NO: 608191 - protein, 9 aa, Homo Sapiens
VDGQVFQGS

SEQ ID NO: 608192 - protein, 9 aa, Homo Sapiens
ERSFVSSLV

SEQ ID NO: 608193 - protein, 9 aa, Homo Sapiens
RKWRKLVLP

SEQ ID NO: 608194 - protein, 9 aa, Homo Sapiens
PSSWKVEFG

SEQ ID NO: 608195 - protein, 9 aa, Homo Sapiens
LNWASLNLG

SEQ ID NO: 608196 - protein, 9 aa, Homo Sapiens
SIETRCLVF

SEQ ID NO: 608197 - protein, 9 aa, Homo Sapiens
FGGIGIIHL

SEQ ID NO: 608198 - protein, 9 aa, Homo Sapiens
RNGSPVSFP

SEQ ID NO: 608199 - protein, 9 aa, Homo Sapiens
VLLVFDFDN

SEQ ID NO: 608200 - protein, 9 aa, Homo Sapiens
AAAGAWSPT

SEQ ID NO: 608201 - protein, 9 aa, Homo Sapiens
SNDTISYPD

SEQ ID NO: 608202 - protein, 9 aa, Homo Sapiens
DFINEGLIA

SEQ ID NO: 608203 - protein, 9 aa, Homo Sapiens
GLRDLYPVE

SEQ ID NO: 608204 - protein, 9 aa, Homo Sapiens
PQKSLPVTL

SEQ ID NO: 608205 - protein, 9 aa, Homo Sapiens
KVKKMPLTQ

SEQ ID NO: 608206 - protein, 9 aa, Homo Sapiens
NISGIILRR

SEQ ID NO: 608207 - protein, 9 aa, Homo Sapiens
MNCHIHGPL

SEQ ID NO: 608208 - protein, 9 aa, Homo Sapiens
DDVVAVAGN

SEQ ID NO: 608209 - protein, 9 aa, Homo Sapiens
LKSVDFLYA

SEQ ID NO: 608210 - protein, 9 aa, Homo Sapiens
WLALLVTMP

SEQ ID NO: 608211 - protein, 9 aa, Homo Sapiens
GRGSTPCVM

SEQ ID NO: 608212 - protein, 9 aa, Homo Sapiens
CCYFCRTVC

SEQ ID NO: 608213 - protein, 9 aa, Homo Sapiens
EPVDTIFGA

SEQ ID NO: 608214 - protein, 9 aa, Homo Sapiens
NQKGVFPGE

SEQ ID NO: 608215 - protein, 9 aa, Homo Sapiens
IGLGVFALP

SEQ ID NO: 608216 - protein, 9 aa, Homo Sapiens
KEGKAKIVV

SEQ ID NO: 608217 - protein, 9 aa, Homo Sapiens
LRKCGSGRG

SEQ ID NO: 608218 - protein, 9 aa, Homo Sapiens
PHWHPHPHP

SEQ ID NO: 608219 - protein, 9 aa, Homo Sapiens
GSPAQQGCY

SEQ ID NO: 608220 - protein, 9 aa, Homo Sapiens
TCHCPFDKL

SEQ ID NO: 608221 - protein, 9 aa, Homo Sapiens
LPSTLFLPH

SEQ ID NO: 608222 - protein, 9 aa, Homo Sapiens
AEGRGSTPC

SEQ ID NO: 608223 - protein, 9 aa, Homo Sapiens
SHSYLINSN

SEQ ID NO: 608224 - protein, 9 aa, Homo Sapiens
RPNCKFVLT

SEQ ID NO: 608225 - protein, 9 aa, Homo Sapiens
SSASAIHTP

SEQ ID NO: 608226 - protein, 9 aa, Homo Sapiens
KIRTRSAED

SEQ ID NO: 608227 - protein, 9 aa, Homo Sapiens
VVNGEEGEP

SEQ ID NO: 608228 - protein, 9 aa, Homo Sapiens
QVLGPVTAA

SEQ ID NO: 608229 - protein, 9 aa, Homo Sapiens
LDEVEKRQG

SEQ ID NO: 608230 - protein, 9 aa, Homo Sapiens
GESHLTKQS

SEQ ID NO: 608231 - protein, 9 aa, Homo Sapiens
ALTVMVLVL

SEQ ID NO: 608232 - protein, 9 aa, Homo Sapiens
SMSAKLQAQ

SEQ ID NO: 608233 - protein, 9 aa, Homo Sapiens
SRGLLYGCI

SEQ ID NO: 608234 - protein, 9 aa, Homo Sapiens
SHSGLTKHQ

SEQ ID NO: 608235 - protein, 9 aa, Homo Sapiens
MVEFVPLFM

SEQ ID NO: 608236 - protein, 9 aa, Homo Sapiens
TCSRESCAS

SEQ ID NO: 608237 - protein, 9 aa, Homo Sapiens
LRDGLRDLY

SEQ ID NO: 608238 - protein, 9 aa, Homo Sapiens
ALFALFRVM

SEQ ID NO: 608239 - protein, 9 aa, Homo Sapiens
DKANQRKTA

SEQ ID NO: 608240 - protein, 9 aa, Homo Sapiens
VFALPLLGV

SEQ ID NO: 608241 - protein, 9 aa, Homo Sapiens
KSPKCKLLV

SEQ ID NO: 608242 - protein, 9 aa, Homo Sapiens
RASGGRERH

SEQ ID NO: 608243 - protein, 9 aa, Homo Sapiens
RPLLVTRSG

SEQ ID NO: 608244 - protein, 9 aa, Homo Sapiens
PKLQEQLSK

SEQ ID NO: 608245 - protein, 9 aa, Homo Sapiens
PQPLLEEQC

SEQ ID NO: 608246 - protein, 9 aa, Homo Sapiens
SNIIASRFY

SEQ ID NO: 608247 - protein, 9 aa, Homo Sapiens
TVTPSTRTS

SEQ ID NO: 608248 - protein, 9 aa, Homo Sapiens
KPLPSSLLD

SEQ ID NO: 608249 - protein, 9 aa, Homo Sapiens
VDKIFSLFC

SEQ ID NO: 608250 - protein, 9 aa, Homo Sapiens
PASYQRPLL

SEQ ID NO: 608251 - protein, 9 aa, Homo Sapiens
FDNRLVNYF

SEQ ID NO: 608252 - protein, 9 aa, Homo Sapiens
PPYNSMMGD

SEQ ID NO: 608253 - protein, 9 aa, Homo Sapiens
HGDEVPYAL

SEQ ID NO: 608254 - protein, 9 aa, Homo Sapiens
PVAPKNDLK

SEQ ID NO: 608255 - protein, 9 aa, Homo Sapiens
NYTISLGSE

SEQ ID NO: 608256 - protein, 9 aa, Homo Sapiens
IPAVISALV

SEQ ID NO: 608257 - protein, 9 aa, Homo Sapiens
WALLMHGWF

SEQ ID NO: 608258 - protein, 9 aa, Homo Sapiens
HPDTRIRAC

SEQ ID NO: 608259 - protein, 9 aa, Homo Sapiens
RKGKRGQRP

SEQ ID NO: 608260 - protein, 9 aa, Homo Sapiens
ARGPLSRAS

SEQ ID NO: 608261 - protein, 9 aa, Homo Sapiens
ELDVSYEEM

SEQ ID NO: 608262 - protein, 9 aa, Homo Sapiens
SFQQMRQEC

SEQ ID NO: 608263 - protein, 9 aa, Homo Sapiens
ALPAFNAKL

SEQ ID NO: 608264 - protein, 9 aa, Homo Sapiens
TSTAWSTPT

SEQ ID NO: 608265 - protein, 9 aa, Homo Sapiens
DCSTLALVP

SEQ ID NO: 608266 - protein, 9 aa, Homo Sapiens
KIQYDVGRI

SEQ ID NO: 608267 - protein, 9 aa, Homo Sapiens
IVVGSTLHS

SEQ ID NO: 608268 - protein, 9 aa, Homo Sapiens
SIASAYREI

SEQ ID NO: 608269 - protein, 9 aa, Homo Sapiens
KAHVPISGQ

SEQ ID NO: 608270 - protein, 9 aa, Homo Sapiens
SDEHDIDPT

SEQ ID NO: 608271 - protein, 9 aa, Homo Sapiens
KQSSCSRRM

SEQ ID NO: 608272 - protein, 9 aa, Homo Sapiens
CNFRFFMLL

SEQ ID NO: 608273 - protein, 9 aa, Homo Sapiens
LGPRASHMR

SEQ ID NO: 608274 - protein, 9 aa, Homo Sapiens
PSISLVALR

SEQ ID NO: 608275 - protein, 9 aa, Homo Sapiens
RDSTHCSLE

SEQ ID NO: 608276 - protein, 9 aa, Homo Sapiens
VQAASDEER

SEQ ID NO: 608277 - protein, 9 aa, Homo Sapiens
GPGKPRLVL

SEQ ID NO: 608278 - protein, 9 aa, Homo Sapiens
HLPDPKYRQ

SEQ ID NO: 608279 - protein, 9 aa, Homo Sapiens
CGKANTRSS

SEQ ID NO: 608280 - protein, 9 aa, Homo Sapiens
SIIRRLGAA

SEQ ID NO: 608281 - protein, 9 aa, Homo Sapiens
ILPRVVQAH

SEQ ID NO: 608282 - protein, 9 aa, Homo Sapiens
DRYLDICHS

SEQ ID NO: 608283 - protein, 9 aa, Homo Sapiens
MASLARKAT

SEQ ID NO: 608284 - protein, 9 aa, Homo Sapiens
SLKVPGDPW

SEQ ID NO: 608285 - protein, 9 aa, Homo Sapiens
LMDGLEYCH

SEQ ID NO: 608286 - protein, 9 aa, Homo Sapiens
LFHPSLLFF

SEQ ID NO: 608287 - protein, 9 aa, Homo Sapiens
LLEETPSHG

SEQ ID NO: 608288 - protein, 9 aa, Homo Sapiens
LEIVCFCGV

SEQ ID NO: 608289 - protein, 9 aa, Homo Sapiens
EEKPYGCYE

SEQ ID NO: 608290 - protein, 9 aa, Homo Sapiens
AGSGRCSFL

SEQ ID NO: 608291 - protein, 9 aa, Homo Sapiens
LLRDSTPLE

SEQ ID NO: 608292 - protein, 9 aa, Homo Sapiens
LVGEGHFSK

SEQ ID NO: 608293 - protein, 9 aa, Homo Sapiens
AAAGPPPLS

SEQ ID NO: 608294 - protein, 9 aa, Homo Sapiens
YGPAESQSV

SEQ ID NO: 608295 - protein, 9 aa, Homo Sapiens
GEKRRGGKN

SEQ ID NO: 608296 - protein, 9 aa, Homo Sapiens
LLQITTRED

SEQ ID NO: 608297 - protein, 9 aa, Homo Sapiens
MKKEKLTSH

SEQ ID NO: 608298 - protein, 9 aa, Homo Sapiens
TATTERKDE

SEQ ID NO: 608299 - protein, 9 aa, Homo Sapiens
LVHAKNSYT

SEQ ID NO: 608300 - protein, 9 aa, Homo Sapiens
EESTEKVKI

SEQ ID NO: 608301 - protein, 9 aa, Homo Sapiens
SSNQNLVEL

SEQ ID NO: 608302 - protein, 9 aa, Homo Sapiens
ESNIIASRF

SEQ ID NO: 608303 - protein, 9 aa, Homo Sapiens
LKSPKCKLL

SEQ ID NO: 608304 - protein, 9 aa, Homo Sapiens
KSSVSCEVF

SEQ ID NO: 608305 - protein, 9 aa, Homo Sapiens
AGFFNAGSQ

SEQ ID NO: 608306 - protein, 9 aa, Homo Sapiens
ASELSFPLH

SEQ ID NO: 608307 - protein, 9 aa, Homo Sapiens
TETITMRTC

SEQ ID NO: 608308 - protein, 9 aa, Homo Sapiens
SPASPLRPL

SEQ ID NO: 608309 - protein, 9 aa, Homo Sapiens
RRPLGPARA

SEQ ID NO: 608310 - protein, 9 aa, Homo Sapiens
SLSNKYRQD

SEQ ID NO: 608311 - protein, 9 aa, Homo Sapiens
RGQRPSKPR

SEQ ID NO: 608312 - protein, 9 aa, Homo Sapiens
PIGLCLTKN

SEQ ID NO: 608313 - protein, 9 aa, Homo Sapiens
HYIFQKYCS

SEQ ID NO: 608314 - protein, 9 aa, Homo Sapiens
LHESILKVI

SEQ ID NO: 608315 - protein, 9 aa, Homo Sapiens
VIMPLVFRD

SEQ ID NO: 608316 - protein, 9 aa, Homo Sapiens
EQARMGSAG

SEQ ID NO: 608317 - protein, 9 aa, Homo Sapiens
QSPHVVIQP

SEQ ID NO: 608318 - protein, 9 aa, Homo Sapiens
TNEPVCEEN

SEQ ID NO: 608319 - protein, 9 aa, Homo Sapiens
ARKATLWLF

SEQ ID NO: 608320 - protein, 9 aa, Homo Sapiens
SSTMGSWRK

SEQ ID NO: 608321 - protein, 9 aa, Homo Sapiens
PHSNGGNTN

SEQ ID NO: 608322 - protein, 9 aa, Homo Sapiens
CRRDPQWAA

SEQ ID NO: 608323 - protein, 9 aa, Homo Sapiens
GQEQLGPED

SEQ ID NO: 608324 - protein, 9 aa, Homo Sapiens
LQYLCYRND

SEQ ID NO: 608325 - protein, 9 aa, Homo Sapiens
CSLLQQQKT

SEQ ID NO: 608326 - protein, 9 aa, Homo Sapiens
NNWKNEFQK

SEQ ID NO: 608327 - protein, 9 aa, Homo Sapiens
NSYTHCNER

SEQ ID NO: 608328 - protein, 9 aa, Homo Sapiens
GLTFVKKRA

SEQ ID NO: 608329 - protein, 9 aa, Homo Sapiens
WGGAMGWAF

SEQ ID NO: 608330 - protein, 9 aa, Homo Sapiens
HWYDRHKVM

SEQ ID NO: 608331 - protein, 9 aa, Homo Sapiens
KRRCVEAAV

SEQ ID NO: 608332 - protein, 9 aa, Homo Sapiens
VSYEEMARR

SEQ ID NO: 608333 - protein, 9 aa, Homo Sapiens
QSLLSLCKE

SEQ ID NO: 608334 - protein, 9 aa, Homo Sapiens
RRRRKMTKK

SEQ ID NO: 608335 - protein, 9 aa, Homo Sapiens
KHRKIQQCM

SEQ ID NO: 608336 - protein, 9 aa, Homo Sapiens
KPYILDPVE

SEQ ID NO: 608337 - protein, 9 aa, Homo Sapiens
KTERVSIET

SEQ ID NO: 608338 - protein, 9 aa, Homo Sapiens
GHFASSAEK

SEQ ID NO: 608339 - protein, 9 aa, Homo Sapiens
VMKKEKLTS

SEQ ID NO: 608340 - protein, 9 aa, Homo Sapiens
WAQGTARVG

SEQ ID NO: 608341 - protein, 9 aa, Homo Sapiens
KKDVEKSRT

SEQ ID NO: 608342 - protein, 9 aa, Homo Sapiens
SSDDAYEEL

SEQ ID NO: 608343 - protein, 9 aa, Homo Sapiens
SCSLARTCS

SEQ ID NO: 608344 - protein, 9 aa, Homo Sapiens
VYGNECANF

SEQ ID NO: 608345 - protein, 9 aa, Homo Sapiens
LQTLARCRR

SEQ ID NO: 608346 - protein, 9 aa, Homo Sapiens
NAQRPNGSS

SEQ ID NO: 608347 - protein, 9 aa, Homo Sapiens
FVNNHLSGI

SEQ ID NO: 608348 - protein, 9 aa, Homo Sapiens
VLSRVIKRS

SEQ ID NO: 608349 - protein, 9 aa, Homo Sapiens
LLFCYIGCT

SEQ ID NO: 608350 - protein, 9 aa, Homo Sapiens
PIDYGWMYG

SEQ ID NO: 608351 - protein, 9 aa, Homo Sapiens
SNGGNTNSH

SEQ ID NO: 608352 - protein, 9 aa, Homo Sapiens
LGRAVAGSV

SEQ ID NO: 608353 - protein, 9 aa, Homo Sapiens
LRFSRATAR

SEQ ID NO: 608354 - protein, 9 aa, Homo Sapiens
QSSHYCQPD

SEQ ID NO: 608355 - protein, 9 aa, Homo Sapiens
FMKQLMDGL

SEQ ID NO: 608356 - protein, 9 aa, Homo Sapiens
NVFRKNYSR

SEQ ID NO: 608357 - protein, 9 aa, Homo Sapiens
QWRASALGH

SEQ ID NO: 608358 - protein, 9 aa, Homo Sapiens
SKTNRFCSV

SEQ ID NO: 608359 - protein, 9 aa, Homo Sapiens
YDSPDFNRR

SEQ ID NO: 608360 - protein, 9 aa, Homo Sapiens
AVESFSWSG

SEQ ID NO: 608361 - protein, 9 aa, Homo Sapiens
KTESTYLAD

SEQ ID NO: 608362 - protein, 9 aa, Homo Sapiens
DLKGDYTAV

SEQ ID NO: 608363 - protein, 9 aa, Homo Sapiens
NKALTSKKS

SEQ ID NO: 608364 - protein, 9 aa, Homo Sapiens
PFSLLPSES

SEQ ID NO: 608365 - protein, 9 aa, Homo Sapiens
VRGSAAVQE

SEQ ID NO: 608366 - protein, 9 aa, Homo Sapiens
WAITNATEY

SEQ ID NO: 608367 - protein, 9 aa, Homo Sapiens
EEGISLEAF

SEQ ID NO: 608368 - protein, 9 aa, Homo Sapiens
TAAPTPRPP

SEQ ID NO: 608369 - protein, 9 aa, Homo Sapiens
LCGLALVAL

SEQ ID NO: 608370 - protein, 9 aa, Homo Sapiens
LGSDEQKRL

SEQ ID NO: 608371 - protein, 9 aa, Homo Sapiens
TARALRIVS

SEQ ID NO: 608372 - protein, 9 aa, Homo Sapiens
QRLSGQEFA

SEQ ID NO: 608373 - protein, 9 aa, Homo Sapiens
QFELKQHQF

SEQ ID NO: 608374 - protein, 9 aa, Homo Sapiens
GSTAGGMAG

SEQ ID NO: 608375 - protein, 9 aa, Homo Sapiens
SLVDILPEI

SEQ ID NO: 608376 - protein, 9 aa, Homo Sapiens
LPGAWRFPG

SEQ ID NO: 608377 - protein, 9 aa, Homo Sapiens
DQASFELLL

SEQ ID NO: 608378 - protein, 9 aa, Homo Sapiens
QQLWDTAGQ

SEQ ID NO: 608379 - protein, 9 aa, Homo Sapiens
IGTNVLELN

SEQ ID NO: 608380 - protein, 9 aa, Homo Sapiens
EKRQGISPA

SEQ ID NO: 608381 - protein, 9 aa, Homo Sapiens
RYKPLPSSL

SEQ ID NO: 608382 - protein, 9 aa, Homo Sapiens
TLTANKATS

SEQ ID NO: 608383 - protein, 9 aa, Homo Sapiens
RAHRPRPER

SEQ ID NO: 608384 - protein, 9 aa, Homo Sapiens
ELSRFLNPL

SEQ ID NO: 608385 - protein, 9 aa, Homo Sapiens
AGIRATAAP

SEQ ID NO: 608386 - protein, 9 aa, Homo Sapiens
VPYKCPDYQ

SEQ ID NO: 608387 - protein, 9 aa, Homo Sapiens
NSADDETDN

SEQ ID NO: 608388 - protein, 9 aa, Homo Sapiens
IEREELCAQ

SEQ ID NO: 608389 - protein, 9 aa, Homo Sapiens
STPTTNAWS

SEQ ID NO: 608390 - protein, 9 aa, Homo Sapiens
CSLSPPTCG

SEQ ID NO: 608391 - protein, 9 aa, Homo Sapiens
KAEAAALEV

SEQ ID NO: 608392 - protein, 9 aa, Homo Sapiens
CDEFGNYIG

SEQ ID NO: 608393 - protein, 9 aa, Homo Sapiens
YFNIPSPAA

SEQ ID NO: 608394 - protein, 9 aa, Homo Sapiens
QLFLEHRLV

SEQ ID NO: 608395 - protein, 9 aa, Homo Sapiens
GTLPVFMEL

SEQ ID NO: 608396 - protein, 9 aa, Homo Sapiens
PKVSLEGRS

SEQ ID NO: 608397 - protein, 9 aa, Homo Sapiens
CPTGHLTVA

SEQ ID NO: 608398 - protein, 9 aa, Homo Sapiens
VLLRDSTPL

SEQ ID NO: 608399 - protein, 9 aa, Homo Sapiens
TYLFKGAHY

SEQ ID NO: 608400 - protein, 9 aa, Homo Sapiens
PGAPETSPG

SEQ ID NO: 608401 - protein, 9 aa, Homo Sapiens
PPPLGQMCQ

SEQ ID NO: 608402 - protein, 9 aa, Homo Sapiens
RLDPWECYQ

SEQ ID NO: 608403 - protein, 9 aa, Homo Sapiens
NNMADNKAL

SEQ ID NO: 608404 - protein, 9 aa, Homo Sapiens
ESSAELYYQ

SEQ ID NO: 608405 - protein, 9 aa, Homo Sapiens
YGRSPSRPP

SEQ ID NO: 608406 - protein, 9 aa, Homo Sapiens
STPCVMQVH

SEQ ID NO: 608407 - protein, 9 aa, Homo Sapiens
DHKTSTRRS

SEQ ID NO: 608408 - protein, 9 aa, Homo Sapiens
TVFCPRLYH

SEQ ID NO: 608409 - protein, 9 aa, Homo Sapiens
FELLLWNNY

SEQ ID NO: 608410 - protein, 9 aa, Homo Sapiens
EPPEPDGWS

SEQ ID NO: 608411 - protein, 9 aa, Homo Sapiens
EKLTSHQSQ

SEQ ID NO: 608412 - protein, 9 aa, Homo Sapiens
TELNPHGMS

SEQ ID NO: 608413 - protein, 9 aa, Homo Sapiens
EACARAGSR

SEQ ID NO: 608414 - protein, 9 aa, Homo Sapiens
HTDEKGFTP

SEQ ID NO: 608415 - protein, 9 aa, Homo Sapiens
RGEKDPRSG

SEQ ID NO: 608416 - protein, 9 aa, Homo Sapiens
LTGTPHYIS

SEQ ID NO: 608417 - protein, 9 aa, Homo Sapiens
SFPIFLHSS

SEQ ID NO: 608418 - protein, 9 aa, Homo Sapiens
FSTASRKQV

SEQ ID NO: 608419 - protein, 9 aa, Homo Sapiens
DGYDDLSES

SEQ ID NO: 608420 - protein, 9 aa, Homo Sapiens
AFVTFCGKE

SEQ ID NO: 608421 - protein, 9 aa, Homo Sapiens
VEGQDADLA

SEQ ID NO: 608422 - protein, 9 aa, Homo Sapiens
QLCAVHALN

SEQ ID NO: 608423 - protein, 9 aa, Homo Sapiens
VRCFKGLLI

SEQ ID NO: 608424 - protein, 9 aa, Homo Sapiens
VLNKAAQIL

SEQ ID NO: 608425 - protein, 9 aa, Homo Sapiens
ETSPGDGAG

SEQ ID NO: 608426 - protein, 9 aa, Homo Sapiens
SQDPMVSTE

SEQ ID NO: 608427 - protein, 9 aa, Homo Sapiens
CGVCFQRPQ

SEQ ID NO: 608428 - protein, 9 aa, Homo Sapiens
ASVRTIKLS

SEQ ID NO: 608429 - protein, 9 aa, Homo Sapiens
ASCCYFCRT

SEQ ID NO: 608430 - protein, 9 aa, Homo Sapiens
IGKGLNEFD

SEQ ID NO: 608431 - protein, 9 aa, Homo Sapiens
DQDAGWLLG

SEQ ID NO: 608432 - protein, 9 aa, Homo Sapiens
EATSADASV

SEQ ID NO: 608433 - protein, 9 aa, Homo Sapiens
VPGDPWSAS

SEQ ID NO: 608434 - protein, 9 aa, Homo Sapiens
VSCEVFCKK

SEQ ID NO: 608435 - protein, 9 aa, Homo Sapiens
ILELLMDEA

SEQ ID NO: 608436 - protein, 9 aa, Homo Sapiens
RDGEAAEPI

SEQ ID NO: 608437 - protein, 9 aa, Homo Sapiens
ANPKTLTSF

SEQ ID NO: 608438 - protein, 9 aa, Homo Sapiens
LTVSYFSPK

SEQ ID NO: 608439 - protein, 9 aa, Homo Sapiens
RQRLQLCAV

SEQ ID NO: 608440 - protein, 9 aa, Homo Sapiens
RLTCKRIMD

SEQ ID NO: 608441 - protein, 9 aa, Homo Sapiens
VTLTANKAT

SEQ ID NO: 608442 - protein, 9 aa, Homo Sapiens
SNTGFRDGL

SEQ ID NO: 608443 - protein, 9 aa, Homo Sapiens
GSGRCSFLV

SEQ ID NO: 608444 - protein, 9 aa, Homo Sapiens
DDLRELRNA

SEQ ID NO: 608445 - protein, 9 aa, Homo Sapiens
VTVTPSTRT

SEQ ID NO: 608446 - protein, 9 aa, Homo Sapiens
SGGNQSWLP

SEQ ID NO: 608447 - protein, 9 aa, Homo Sapiens
AAYLQYLCY

SEQ ID NO: 608448 - protein, 9 aa, Homo Sapiens
IRTRSAEDP

SEQ ID NO: 608449 - protein, 9 aa, Homo Sapiens
EARLQTPMY

SEQ ID NO: 608450 - protein, 9 aa, Homo Sapiens
PLNLAHTVD

SEQ ID NO: 608451 - protein, 9 aa, Homo Sapiens
KMESIQELT

SEQ ID NO: 608452 - protein, 9 aa, Homo Sapiens
AKPHRCQAC

SEQ ID NO: 608453 - protein, 9 aa, Homo Sapiens
EEQELCKQL

SEQ ID NO: 608454 - protein, 9 aa, Homo Sapiens
RSVLLEPPR

SEQ ID NO: 608455 - protein, 9 aa, Homo Sapiens
ACFVRFRNY

SEQ ID NO: 608456 - protein, 9 aa, Homo Sapiens
GSPWPGLRL

SEQ ID NO: 608457 - protein, 9 aa, Homo Sapiens
LYVPEYQLE

SEQ ID NO: 608458 - protein, 9 aa, Homo Sapiens
ALGCSIAKF

SEQ ID NO: 608459 - protein, 9 aa, Homo Sapiens
RKSLPRGTA

SEQ ID NO: 608460 - protein, 9 aa, Homo Sapiens
LCGELERIQ

SEQ ID NO: 608461 - protein, 9 aa, Homo Sapiens
KVFGESHLT

SEQ ID NO: 608462 - protein, 9 aa, Homo Sapiens
VFIWCCLNL

SEQ ID NO: 608463 - protein, 9 aa, Homo Sapiens
VGGWRARDR

SEQ ID NO: 608464 - protein, 9 aa, Homo Sapiens
TTVVSPKNT

SEQ ID NO: 608465 - protein, 9 aa, Homo Sapiens
QGPSESPPT

SEQ ID NO: 608466 - protein, 9 aa, Homo Sapiens
VLTLPRSVL

SEQ ID NO: 608467 - protein, 9 aa, Homo Sapiens
QAAERARRG

SEQ ID NO: 608468 - protein, 9 aa, Homo Sapiens
VGMRRSLDV

SEQ ID NO: 608469 - protein, 9 aa, Homo Sapiens
VWLQACAAS

SEQ ID NO: 608470 - protein, 9 aa, Homo Sapiens
GRKWRKLVL

SEQ ID NO: 608471 - protein, 9 aa, Homo Sapiens
AMKMKGGSN

SEQ ID NO: 608472 - protein, 9 aa, Homo Sapiens
SQVMFVNNH

SEQ ID NO: 608473 - protein, 9 aa, Homo Sapiens
ALKKQRAYL

SEQ ID NO: 608474 - protein, 9 aa, Homo Sapiens
APKLIFDSL

SEQ ID NO: 608475 - protein, 9 aa, Homo Sapiens
CEVFCKKIY

SEQ ID NO: 608476 - protein, 9 aa, Homo Sapiens
FIRCPSSSS

SEQ ID NO: 608477 - protein, 9 aa, Homo Sapiens
RWVHCAEPT

SEQ ID NO: 608478 - protein, 9 aa, Homo Sapiens
RLKRLIKMS

SEQ ID NO: 608479 - protein, 9 aa, Homo Sapiens
TRTSASVSL

SEQ ID NO: 608480 - protein, 9 aa, Homo Sapiens
YNISGIILR

SEQ ID NO: 608481 - protein, 9 aa, Homo Sapiens
QTVIPFTDQ

SEQ ID NO: 608482 - protein, 9 aa, Homo Sapiens
VSPFRVWRI

SEQ ID NO: 608483 - protein, 9 aa, Homo Sapiens
IVHQILHTG

SEQ ID NO: 608484 - protein, 9 aa, Homo Sapiens
NKMLETKCS

SEQ ID NO: 608485 - protein, 9 aa, Homo Sapiens
EVNVVPQEN

SEQ ID NO: 608486 - protein, 9 aa, Homo Sapiens
DVEKSRTVS

SEQ ID NO: 608487 - protein, 9 aa, Homo Sapiens
SDQPSSDGY

SEQ ID NO: 608488 - protein, 9 aa, Homo Sapiens
WVDGVDKIQ

SEQ ID NO: 608489 - protein, 9 aa, Homo Sapiens
LNAPPAKAG

SEQ ID NO: 608490 - protein, 9 aa, Homo Sapiens
PPRDLYSKA

SEQ ID NO: 608491 - protein, 9 aa, Homo Sapiens
DAATDQGPS

SEQ ID NO: 608492 - protein, 9 aa, Homo Sapiens
MKLPEKLHA

SEQ ID NO: 608493 - protein, 9 aa, Homo Sapiens
EELHSRTHK

SEQ ID NO: 608494 - protein, 9 aa, Homo Sapiens
GTYGDANIK

SEQ ID NO: 608495 - protein, 9 aa, Homo Sapiens
IILVGKLAA

SEQ ID NO: 608496 - protein, 9 aa, Homo Sapiens
AIDRKSDLD

SEQ ID NO: 608497 - protein, 9 aa, Homo Sapiens
AHRPRPERR

SEQ ID NO: 608498 - protein, 9 aa, Homo Sapiens
LKVPGDPWS

SEQ ID NO: 608499 - protein, 9 aa, Homo Sapiens
VDKIQYDVG

SEQ ID NO: 608500 - protein, 9 aa, Homo Sapiens
VAEYFQERR

SEQ ID NO: 608501 - protein, 9 aa, Homo Sapiens
SIRNMQALK

SEQ ID NO: 608502 - protein, 9 aa, Homo Sapiens
IDGEPWIQT

SEQ ID NO: 608503 - protein, 9 aa, Homo Sapiens
LGADPAVAT

SEQ ID NO: 608504 - protein, 9 aa, Homo Sapiens
DIKLPDCEQ

SEQ ID NO: 608505 - protein, 9 aa, Homo Sapiens
LARKPAGEP

SEQ ID NO: 608506 - protein, 9 aa, Homo Sapiens
EMELKEYNI

SEQ ID NO: 608507 - protein, 9 aa, Homo Sapiens
SSLHPHLFS

SEQ ID NO: 608508 - protein, 9 aa, Homo Sapiens
NTERLIKIA

SEQ ID NO: 608509 - protein, 9 aa, Homo Sapiens
AHTTGKGTV

SEQ ID NO: 608510 - protein, 9 aa, Homo Sapiens
LGARGPLSR

SEQ ID NO: 608511 - protein, 9 aa, Homo Sapiens
WQRLCTEIV

SEQ ID NO: 608512 - protein, 9 aa, Homo Sapiens
DIDPTGTYH

SEQ ID NO: 608513 - protein, 9 aa, Homo Sapiens
DLSCSRGEA

SEQ ID NO: 608514 - protein, 9 aa, Homo Sapiens
DGEARSQQC

SEQ ID NO: 608515 - protein, 9 aa, Homo Sapiens
LAFGYFGIL

SEQ ID NO: 608516 - protein, 9 aa, Homo Sapiens
VRVTTGEVM

SEQ ID NO: 608517 - protein, 9 aa, Homo Sapiens
PQAFPPAHS

SEQ ID NO: 608518 - protein, 9 aa, Homo Sapiens
ACNLSRKTH

SEQ ID NO: 608519 - protein, 9 aa, Homo Sapiens
GQNRGYAFV

SEQ ID NO: 608520 - protein, 9 aa, Homo Sapiens
STFTIPKML

SEQ ID NO: 608521 - protein, 9 aa, Homo Sapiens
TGTPHYISP

SEQ ID NO: 608522 - protein, 9 aa, Homo Sapiens
HAKNSYTHC

SEQ ID NO: 608523 - protein, 9 aa, Homo Sapiens
MKSGFASVR

SEQ ID NO: 608524 - protein, 9 aa, Homo Sapiens
VNYFMEEFR

SEQ ID NO: 608525 - protein, 9 aa, Homo Sapiens
TQHTLHSFD

SEQ ID NO: 608526 - protein, 9 aa, Homo Sapiens
VGEGPSRGL

SEQ ID NO: 608527 - protein, 9 aa, Homo Sapiens
KKMPLTQYL

SEQ ID NO: 608528 - protein, 9 aa, Homo Sapiens
GIELHAVSP

SEQ ID NO: 608529 - protein, 9 aa, Homo Sapiens
ARALRIVSF

SEQ ID NO: 608530 - protein, 9 aa, Homo Sapiens
GSVGGFRAM

SEQ ID NO: 608531 - protein, 9 aa, Homo Sapiens
PEFTGLTFV

SEQ ID NO: 608532 - protein, 9 aa, Homo Sapiens
ELKEYNISG

SEQ ID NO: 608533 - protein, 9 aa, Homo Sapiens
SSEYSFVEI

SEQ ID NO: 608534 - protein, 9 aa, Homo Sapiens
DPFPELPVR

SEQ ID NO: 608535 - protein, 9 aa, Homo Sapiens
FMKSGFASV

SEQ ID NO: 608536 - protein, 9 aa, Homo Sapiens
CGSRSCSLL

SEQ ID NO: 608537 - protein, 9 aa, Homo Sapiens
RRLLSPMYI

SEQ ID NO: 608538 - protein, 9 aa, Homo Sapiens
PVRGVSDGR

SEQ ID NO: 608539 - protein, 9 aa, Homo Sapiens
LPNAFSAYF

SEQ ID NO: 608540 - protein, 9 aa, Homo Sapiens
FLRLYLLTL

SEQ ID NO: 608541 - protein, 9 aa, Homo Sapiens
NLEIASFSS

SEQ ID NO: 608542 - protein, 9 aa, Homo Sapiens
SDGYLIPIN

SEQ ID NO: 608543 - protein, 9 aa, Homo Sapiens
PTAAPTPRP

SEQ ID NO: 608544 - protein, 9 aa, Homo Sapiens
SRKNDESYE

SEQ ID NO: 608545 - protein, 9 aa, Homo Sapiens
VSFPIFLHS

SEQ ID NO: 608546 - protein, 9 aa, Homo Sapiens
VISNQDLVT

SEQ ID NO: 608547 - protein, 9 aa, Homo Sapiens
SYKKPLYCI

SEQ ID NO: 608548 - protein, 9 aa, Homo Sapiens
VITLYKDVK

SEQ ID NO: 608549 - protein, 9 aa, Homo Sapiens
PSALLEQAC

SEQ ID NO: 608550 - protein, 9 aa, Homo Sapiens
PWDWQIDCS

SEQ ID NO: 608551 - protein, 9 aa, Homo Sapiens
RNPNYEIIH

SEQ ID NO: 608552 - protein, 9 aa, Homo Sapiens
QRYKPLPSS

SEQ ID NO: 608553 - protein, 9 aa, Homo Sapiens
RHAVLLGLQ

SEQ ID NO: 608554 - protein, 9 aa, Homo Sapiens
IEELHSRTH

SEQ ID NO: 608555 - protein, 9 aa, Homo Sapiens
TSAMLTVSA

SEQ ID NO: 608556 - protein, 9 aa, Homo Sapiens
EVPYALGIP

SEQ ID NO: 608557 - protein, 9 aa, Homo Sapiens
RIVVGSTLH

SEQ ID NO: 608558 - protein, 9 aa, Homo Sapiens
FSISQERST

SEQ ID NO: 608559 - protein, 9 aa, Homo Sapiens
LLLKSEHEK

SEQ ID NO: 608560 - protein, 9 aa, Homo Sapiens
IGEKKRPAT

SEQ ID NO: 608561 - protein, 9 aa, Homo Sapiens
ATLWLFLSS

SEQ ID NO: 608562 - protein, 9 aa, Homo Sapiens
ALSLKSNEK

SEQ ID NO: 608563 - protein, 9 aa, Homo Sapiens
WQRCRAAAA

SEQ ID NO: 608564 - protein, 9 aa, Homo Sapiens
PASLRKCGS

SEQ ID NO: 608565 - protein, 9 aa, Homo Sapiens
VDENECSLS

SEQ ID NO: 608566 - protein, 9 aa, Homo Sapiens
RQQMRLQRK

SEQ ID NO: 608567 - protein, 9 aa, Homo Sapiens
DLGLSTFTI

SEQ ID NO: 608568 - protein, 9 aa, Homo Sapiens
WLPGARGLT

SEQ ID NO: 608569 - protein, 9 aa, Homo Sapiens
GRQRAFSPS

SEQ ID NO: 608570 - protein, 9 aa, Homo Sapiens
DDPVRKPVV

SEQ ID NO: 608571 - protein, 9 aa, Homo Sapiens
VLSSNQNLV

SEQ ID NO: 608572 - protein, 9 aa, Homo Sapiens
MLSQETLTL

SEQ ID NO: 608573 - protein, 9 aa, Homo Sapiens
DHPLSEQVP

SEQ ID NO: 608574 - protein, 9 aa, Homo Sapiens
RGAHRQAAE

SEQ ID NO: 608575 - protein, 9 aa, Homo Sapiens
ICGGFGGIG

SEQ ID NO: 608576 - protein, 9 aa, Homo Sapiens
GEHFREVIK

SEQ ID NO: 608577 - protein, 9 aa, Homo Sapiens
ACARAGSRI

SEQ ID NO: 608578 - protein, 9 aa, Homo Sapiens
KTRKEQYEH

SEQ ID NO: 608579 - protein, 9 aa, Homo Sapiens
RPPQSSGVS

SEQ ID NO: 608580 - protein, 9 aa, Homo Sapiens
EWIQPADTG

SEQ ID NO: 608581 - protein, 9 aa, Homo Sapiens
VYHERQRLQ

SEQ ID NO: 608582 - protein, 9 aa, Homo Sapiens
PPEEEVPFC

SEQ ID NO: 608583 - protein, 9 aa, Homo Sapiens
PAILNHHSC

SEQ ID NO: 608584 - protein, 9 aa, Homo Sapiens
VSYCVLTLT

SEQ ID NO: 608585 - protein, 9 aa, Homo Sapiens
GQPLCPAGV

SEQ ID NO: 608586 - protein, 9 aa, Homo Sapiens
PLSPELNNK

SEQ ID NO: 608587 - protein, 9 aa, Homo Sapiens
WCEQQVPYK

SEQ ID NO: 608588 - protein, 9 aa, Homo Sapiens
QIFFFHFVG

SEQ ID NO: 608589 - protein, 9 aa, Homo Sapiens
YAIDRKSDL

SEQ ID NO: 608590 - protein, 9 aa, Homo Sapiens
LEGQIAYLK

SEQ ID NO: 608591 - protein, 9 aa, Homo Sapiens
LSEAPCPQL

SEQ ID NO: 608592 - protein, 9 aa, Homo Sapiens
APCPQLLPR

SEQ ID NO: 608593 - protein, 9 aa, Homo Sapiens
RTVSLATAV

SEQ ID NO: 608594 - protein, 9 aa, Homo Sapiens
HGVNLFDIA

SEQ ID NO: 608595 - protein, 9 aa, Homo Sapiens
NAGDTYLFK

SEQ ID NO: 608596 - protein, 9 aa, Homo Sapiens
SPPPAVPGW

SEQ ID NO: 608597 - protein, 9 aa, Homo Sapiens
EKGNPFTKL

SEQ ID NO: 608598 - protein, 9 aa, Homo Sapiens
LRRFQQIKA

SEQ ID NO: 608599 - protein, 9 aa, Homo Sapiens
ILKQSDKMT

SEQ ID NO: 608600 - protein, 9 aa, Homo Sapiens
SEPCSRQSW

SEQ ID NO: 608601 - protein, 9 aa, Homo Sapiens
GTNVLELND

SEQ ID NO: 608602 - protein, 9 aa, Homo Sapiens
YTHCNERMY

SEQ ID NO: 608603 - protein, 9 aa, Homo Sapiens
NTRKRSQRR

SEQ ID NO: 608604 - protein, 9 aa, Homo Sapiens
GTHINQSEK

SEQ ID NO: 608605 - protein, 9 aa, Homo Sapiens
GGWTASAAC

SEQ ID NO: 608606 - protein, 9 aa, Homo Sapiens
IHPLVPQVL

SEQ ID NO: 608607 - protein, 9 aa, Homo Sapiens
AFEDVKVFG

SEQ ID NO: 608608 - protein, 9 aa, Homo Sapiens
GNTNSHYFT

SEQ ID NO: 608609 - protein, 9 aa, Homo Sapiens
LKQLQKKEK

SEQ ID NO: 608610 - protein, 9 aa, Homo Sapiens
QRPSKPRLI

SEQ ID NO: 608611 - protein, 9 aa, Homo Sapiens
QTEPPKVSL

SEQ ID NO: 608612 - protein, 9 aa, Homo Sapiens
VPVRGSAAV

SEQ ID NO: 608613 - protein, 9 aa, Homo Sapiens
GDTDLTFFF

SEQ ID NO: 608614 - protein, 9 aa, Homo Sapiens
DIYWGSGLG

SEQ ID NO: 608615 - protein, 9 aa, Homo Sapiens
NSGRETESG

SEQ ID NO: 608616 - protein, 9 aa, Homo Sapiens
RGLLYGCIH

SEQ ID NO: 608617 - protein, 9 aa, Homo Sapiens
PSPGRLAYR

SEQ ID NO: 608618 - protein, 9 aa, Homo Sapiens
LSEQVPQPL

SEQ ID NO: 608619 - protein, 9 aa, Homo Sapiens
HIPGSMSEE

SEQ ID NO: 608620 - protein, 9 aa, Homo Sapiens
LQKEIASLT

SEQ ID NO: 608621 - protein, 9 aa, Homo Sapiens
KCAYSLSIR

SEQ ID NO: 608622 - protein, 9 aa, Homo Sapiens
SVVFGDVCP

SEQ ID NO: 608623 - protein, 9 aa, Homo Sapiens
ASALGHRHA

SEQ ID NO: 608624 - protein, 9 aa, Homo Sapiens
APAEATVLL

SEQ ID NO: 608625 - protein, 9 aa, Homo Sapiens
VGYSATTCQ

SEQ ID NO: 608626 - protein, 9 aa, Homo Sapiens
ANHDMYYAL

SEQ ID NO: 608627 - protein, 9 aa, Homo Sapiens
ALLTKTYRI

SEQ ID NO: 608628 - protein, 9 aa, Homo Sapiens
NYRGRQHLL

SEQ ID NO: 608629 - protein, 9 aa, Homo Sapiens
LFCTVITPM

SEQ ID NO: 608630 - protein, 9 aa, Homo Sapiens
TEAAVHGLT

SEQ ID NO: 608631 - protein, 9 aa, Homo Sapiens
RLPSLVGPA

SEQ ID NO: 608632 - protein, 9 aa, Homo Sapiens
SSVSCEVFC

SEQ ID NO: 608633 - protein, 9 aa, Homo Sapiens
RPWRRPWGF

SEQ ID NO: 608634 - protein, 9 aa, Homo Sapiens
RNIKSIRSI

SEQ ID NO: 608635 - protein, 9 aa, Homo Sapiens
LEKQMQRYQ

SEQ ID NO: 608636 - protein, 9 aa, Homo Sapiens
FDLSCSRGE

SEQ ID NO: 608637 - protein, 9 aa, Homo Sapiens
RTPMLNPLI

SEQ ID NO: 608638 - protein, 9 aa, Homo Sapiens
ELSKRIEIH

SEQ ID NO: 608639 - protein, 9 aa, Homo Sapiens
IVSFTKILS

SEQ ID NO: 608640 - protein, 9 aa, Homo Sapiens
YIFQKYCSV

SEQ ID NO: 608641 - protein, 9 aa, Homo Sapiens
FASVRNFGN

SEQ ID NO: 608642 - protein, 9 aa, Homo Sapiens
RVVQAHRGP

SEQ ID NO: 608643 - protein, 9 aa, Homo Sapiens
QSALPAFNA

SEQ ID NO: 608644 - protein, 9 aa, Homo Sapiens
LFFNPIRAV

SEQ ID NO: 608645 - protein, 9 aa, Homo Sapiens
ERGSLREVS

SEQ ID NO: 608646 - protein, 9 aa, Homo Sapiens
SRSCSLLGC

SEQ ID NO: 608647 - protein, 9 aa, Homo Sapiens
LTRRDTRKA

SEQ ID NO: 608648 - protein, 9 aa, Homo Sapiens
RRRKRRKRK

SEQ ID NO: 608649 - protein, 9 aa, Homo Sapiens
RLHLQTMTL

SEQ ID NO: 608650 - protein, 9 aa, Homo Sapiens
QKSLPVTLT

SEQ ID NO: 608651 - protein, 9 aa, Homo Sapiens
CNLSRKTHI

SEQ ID NO: 608652 - protein, 9 aa, Homo Sapiens
SRKQVSILE

SEQ ID NO: 608653 - protein, 9 aa, Homo Sapiens
ALGLSSDDA

SEQ ID NO: 608654 - protein, 9 aa, Homo Sapiens
TEEPRSKEA

SEQ ID NO: 608655 - protein, 9 aa, Homo Sapiens
LDSHGRAHD

SEQ ID NO: 608656 - protein, 9 aa, Homo Sapiens
LMITCLTII

SEQ ID NO: 608657 - protein, 9 aa, Homo Sapiens
HFLVLLVLI

SEQ ID NO: 608658 - protein, 9 aa, Homo Sapiens
CIDTGAPDG

SEQ ID NO: 608659 - protein, 9 aa, Homo Sapiens
AGWLLGVKE

SEQ ID NO: 608660 - protein, 9 aa, Homo Sapiens
TSLSSPQPA

SEQ ID NO: 608661 - protein, 9 aa, Homo Sapiens
IRNFLYVVG

SEQ ID NO: 608662 - protein, 9 aa, Homo Sapiens
VPEASALSL

SEQ ID NO: 608663 - protein, 9 aa, Homo Sapiens
AERIEREEL

SEQ ID NO: 608664 - protein, 9 aa, Homo Sapiens
ELHAVSPPL

SEQ ID NO: 608665 - protein, 9 aa, Homo Sapiens
DAHEVRITT

SEQ ID NO: 608666 - protein, 9 aa, Homo Sapiens
LVCLLICSR

SEQ ID NO: 608667 - protein, 9 aa, Homo Sapiens
SFLHFLVLL

SEQ ID NO: 608668 - protein, 9 aa, Homo Sapiens
RGGKNRKTH

SEQ ID NO: 608669 - protein, 9 aa, Homo Sapiens
SGFASVRNF

SEQ ID NO: 608670 - protein, 9 aa, Homo Sapiens
LIHIFRAHL

SEQ ID NO: 608671 - protein, 9 aa, Homo Sapiens
SGSQSHPRF

SEQ ID NO: 608672 - protein, 9 aa, Homo Sapiens
VGSWLGVAQ

SEQ ID NO: 608673 - protein, 9 aa, Homo Sapiens
LREVSNDTI

SEQ ID NO: 608674 - protein, 9 aa, Homo Sapiens
KKEGKAKIV

SEQ ID NO: 608675 - protein, 9 aa, Homo Sapiens
YGWMYGTVQ

SEQ ID NO: 608676 - protein, 9 aa, Homo Sapiens
PKNDLKIKN

SEQ ID NO: 608677 - protein, 9 aa, Homo Sapiens
EVRDVPFGF

SEQ ID NO: 608678 - protein, 9 aa, Homo Sapiens
SPFRRLSFQ

SEQ ID NO: 608679 - protein, 9 aa, Homo Sapiens
ISSDLCISV

SEQ ID NO: 608680 - protein, 9 aa, Homo Sapiens
EFTGLTFVK

SEQ ID NO: 608681 - protein, 9 aa, Homo Sapiens
TVKVSYCVL

SEQ ID NO: 608682 - protein, 9 aa, Homo Sapiens
PHRCQACGK

SEQ ID NO: 608683 - protein, 9 aa, Homo Sapiens
LLGVPVRGS

SEQ ID NO: 608684 - protein, 9 aa, Homo Sapiens
IASVWEALG

SEQ ID NO: 608685 - protein, 9 aa, Homo Sapiens
KKDATKYAK

SEQ ID NO: 608686 - protein, 9 aa, Homo Sapiens
TNDICLQGL

SEQ ID NO: 608687 - protein, 9 aa, Homo Sapiens
IRSIRNMQA

SEQ ID NO: 608688 - protein, 9 aa, Homo Sapiens
ASFELLLWN

SEQ ID NO: 608689 - protein, 9 aa, Homo Sapiens
AKVLNQTTR

SEQ ID NO: 608690 - protein, 9 aa, Homo Sapiens
DKIFSLFCT

SEQ ID NO: 608691 - protein, 9 aa, Homo Sapiens
TIVQAASDE

SEQ ID NO: 608692 - protein, 9 aa, Homo Sapiens
AWQRCRAAA

SEQ ID NO: 608693 - protein, 9 aa, Homo Sapiens
EYSFVEIRM

SEQ ID NO: 608694 - protein, 9 aa, Homo Sapiens
EDAFTPLAV

SEQ ID NO: 608695 - protein, 9 aa, Homo Sapiens
EGQDADLAD

SEQ ID NO: 608696 - protein, 9 aa, Homo Sapiens
NSTQSRITE

SEQ ID NO: 608697 - protein, 9 aa, Homo Sapiens
PRDTEAVCA

SEQ ID NO: 608698 - protein, 9 aa, Homo Sapiens
KRMQDLEQK

SEQ ID NO: 608699 - protein, 9 aa, Homo Sapiens
SSLGLARKP

SEQ ID NO: 608700 - protein, 9 aa, Homo Sapiens
SKQSPQNKN

SEQ ID NO: 608701 - protein, 9 aa, Homo Sapiens
VEDPDKANQ

SEQ ID NO: 608702 - protein, 9 aa, Homo Sapiens
QAPKASCQA

SEQ ID NO: 608703 - protein, 9 aa, Homo Sapiens
NSDDMSENL

SEQ ID NO: 608704 - protein, 9 aa, Homo Sapiens
PSPVLGTVP

SEQ ID NO: 608705 - protein, 9 aa, Homo Sapiens
QSWRTRPWR

SEQ ID NO: 608706 - protein, 9 aa, Homo Sapiens
HTPGPITTA

SEQ ID NO: 608707 - protein, 9 aa, Homo Sapiens
LLLESAFLD

SEQ ID NO: 608708 - protein, 9 aa, Homo Sapiens
YHERQRLQL

SEQ ID NO: 608709 - protein, 9 aa, Homo Sapiens
EYRTLLFKA

SEQ ID NO: 608710 - protein, 9 aa, Homo Sapiens
LGVPVRGSA

SEQ ID NO: 608711 - protein, 9 aa, Homo Sapiens
TESKCDSKG

SEQ ID NO: 608712 - protein, 9 aa, Homo Sapiens
IYRFDLSCS

SEQ ID NO: 608713 - protein, 9 aa, Homo Sapiens
REATSADAS

SEQ ID NO: 608714 - protein, 9 aa, Homo Sapiens
LVRVEEGIS

SEQ ID NO: 608715 - protein, 9 aa, Homo Sapiens
KNVFRKNYS

SEQ ID NO: 608716 - protein, 9 aa, Homo Sapiens
HHMKHKKLP

SEQ ID NO: 608717 - protein, 9 aa, Homo Sapiens
TGEKLYQCN

SEQ ID NO: 608718 - protein, 9 aa, Homo Sapiens
IEVRDVPFG

SEQ ID NO: 608719 - protein, 9 aa, Homo Sapiens
RSIRNMQAL

SEQ ID NO: 608720 - protein, 9 aa, Homo Sapiens
MSAKLQAQV

SEQ ID NO: 608721 - protein, 9 aa, Homo Sapiens
LRCAAPLAL

SEQ ID NO: 608722 - protein, 9 aa, Homo Sapiens
QVEITLQRT

SEQ ID NO: 608723 - protein, 9 aa, Homo Sapiens
NYFMEEFRR

SEQ ID NO: 608724 - protein, 9 aa, Homo Sapiens
GVCFQRPQN

SEQ ID NO: 608725 - protein, 9 aa, Homo Sapiens
KCFVQQLWD

SEQ ID NO: 608726 - protein, 9 aa, Homo Sapiens
LVGFSRSLA

SEQ ID NO: 608727 - protein, 9 aa, Homo Sapiens
DADLADLGA

SEQ ID NO: 608728 - protein, 9 aa, Homo Sapiens
KGECDNIPC

SEQ ID NO: 608729 - protein, 9 aa, Homo Sapiens
IVFRKNVFR

SEQ ID NO: 608730 - protein, 9 aa, Homo Sapiens
VLLATMAYD

SEQ ID NO: 608731 - protein, 9 aa, Homo Sapiens
ESFGYNITR

SEQ ID NO: 608732 - protein, 9 aa, Homo Sapiens
TESTYLADM

SEQ ID NO: 608733 - protein, 9 aa, Homo Sapiens
QVRRQFKAM

SEQ ID NO: 608734 - protein, 9 aa, Homo Sapiens
GNQSWLPIW

SEQ ID NO: 608735 - protein, 9 aa, Homo Sapiens
TTKCAYSLS

SEQ ID NO: 608736 - protein, 9 aa, Homo Sapiens
PPSLCGLAL

SEQ ID NO: 608737 - protein, 9 aa, Homo Sapiens
CFQRPQNEA

SEQ ID NO: 608738 - protein, 9 aa, Homo Sapiens
WGPGKPRLV

SEQ ID NO: 608739 - protein, 9 aa, Homo Sapiens
QNSGLVSYM

SEQ ID NO: 608740 - protein, 9 aa, Homo Sapiens
NRLVNYFME

SEQ ID NO: 608741 - protein, 9 aa, Homo Sapiens
TAEEMASDD

SEQ ID NO: 608742 - protein, 9 aa, Homo Sapiens
ESKLPPAST

SEQ ID NO: 608743 - protein, 9 aa, Homo Sapiens
YNYIPPPLG

SEQ ID NO: 608744 - protein, 9 aa, Homo Sapiens
FLDTYTLTR

SEQ ID NO: 608745 - protein, 9 aa, Homo Sapiens
IYFGATGKL

SEQ ID NO: 608746 - protein, 9 aa, Homo Sapiens
KLTDVEAKV

SEQ ID NO: 608747 - protein, 9 aa, Homo Sapiens
CSPPQRYKP

SEQ ID NO: 608748 - protein, 9 aa, Homo Sapiens
PYKCPDYQS

SEQ ID NO: 608749 - protein, 9 aa, Homo Sapiens
LMDEAAMPR

SEQ ID NO: 608750 - protein, 9 aa, Homo Sapiens
HAVLLGLQP

SEQ ID NO: 608751 - protein, 9 aa, Homo Sapiens
LTTENIILV

SEQ ID NO: 608752 - protein, 9 aa, Homo Sapiens
PEKLHAEVT

SEQ ID NO: 608753 - protein, 9 aa, Homo Sapiens
LIGKGLNEF

SEQ ID NO: 608754 - protein, 9 aa, Homo Sapiens
ICGVCFQRP

SEQ ID NO: 608755 - protein, 9 aa, Homo Sapiens
DILRYDSTR

SEQ ID NO: 608756 - protein, 9 aa, Homo Sapiens
SDDLEEDSC

SEQ ID NO: 608757 - protein, 9 aa, Homo Sapiens
KGVFPGEQF

SEQ ID NO: 608758 - protein, 9 aa, Homo Sapiens
WSPTRGPSR

SEQ ID NO: 608759 - protein, 9 aa, Homo Sapiens
MELFSVPIT

SEQ ID NO: 608760 - protein, 9 aa, Homo Sapiens
FESSKTSSC

SEQ ID NO: 608761 - protein, 9 aa, Homo Sapiens
ALEREAKEI

SEQ ID NO: 608762 - protein, 9 aa, Homo Sapiens
IELHAVSPP

SEQ ID NO: 608763 - protein, 9 aa, Homo Sapiens
PWGFSGGWT

SEQ ID NO: 608764 - protein, 9 aa, Homo Sapiens
GRDGEAAEP

SEQ ID NO: 608765 - protein, 9 aa, Homo Sapiens
ITCLTIIPS

SEQ ID NO: 608766 - protein, 9 aa, Homo Sapiens
METFSISQE

SEQ ID NO: 608767 - protein, 9 aa, Homo Sapiens
RRDPQWAAA

SEQ ID NO: 608768 - protein, 9 aa, Homo Sapiens
GHWYDRHKV

SEQ ID NO: 608769 - protein, 9 aa, Homo Sapiens
LCPAGVQVS

SEQ ID NO: 608770 - protein, 9 aa, Homo Sapiens
QVDDVKRVY

SEQ ID NO: 608771 - protein, 9 aa, Homo Sapiens
DSHGRAHDP

SEQ ID NO: 608772 - protein, 9 aa, Homo Sapiens
RKQVSILES

SEQ ID NO: 608773 - protein, 9 aa, Homo Sapiens
EQGGLSGSL

SEQ ID NO: 608774 - protein, 9 aa, Homo Sapiens
FISDIMNCG

SEQ ID NO: 608775 - protein, 9 aa, Homo Sapiens
ADASVRTIK

SEQ ID NO: 608776 - protein, 9 aa, Homo Sapiens
SQRLLGPPA

SEQ ID NO: 608777 - protein, 9 aa, Homo Sapiens
MRERHLDQI

SEQ ID NO: 608778 - protein, 9 aa, Homo Sapiens
DEPSPPYNS

SEQ ID NO: 608779 - protein, 9 aa, Homo Sapiens
VFPERVGDK

SEQ ID NO: 608780 - protein, 9 aa, Homo Sapiens
YCVQDTTTA

SEQ ID NO: 608781 - protein, 9 aa, Homo Sapiens
RNMQALKWN

SEQ ID NO: 608782 - protein, 9 aa, Homo Sapiens
SLLFFNPIR

SEQ ID NO: 608783 - protein, 9 aa, Homo Sapiens
STRRSISCK

SEQ ID NO: 608784 - protein, 9 aa, Homo Sapiens
AGGAQSFAL

SEQ ID NO: 608785 - protein, 9 aa, Homo Sapiens
KPCKMCESR

SEQ ID NO: 608786 - protein, 9 aa, Homo Sapiens
VDTIFGASV

SEQ ID NO: 608787 - protein, 9 aa, Homo Sapiens
EVVQMNLEI

SEQ ID NO: 608788 - protein, 9 aa, Homo Sapiens
TVIPFTDQV

SEQ ID NO: 608789 - protein, 9 aa, Homo Sapiens
EKIRTRSAE

SEQ ID NO: 608790 - protein, 9 aa, Homo Sapiens
QFRERFRRE

SEQ ID NO: 608791 - protein, 9 aa, Homo Sapiens
LSFSIPRPD

SEQ ID NO: 608792 - protein, 9 aa, Homo Sapiens
LYIKFDLQF

SEQ ID NO: 608793 - protein, 9 aa, Homo Sapiens
QTTVEGQDA

SEQ ID NO: 608794 - protein, 9 aa, Homo Sapiens
ASRKQVSIL

SEQ ID NO: 608795 - protein, 9 aa, Homo Sapiens
PAETNLRLT

SEQ ID NO: 608796 - protein, 9 aa, Homo Sapiens
PAAPAPAQL

SEQ ID NO: 608797 - protein, 9 aa, Homo Sapiens
RLALSSGVD

SEQ ID NO: 608798 - protein, 9 aa, Homo Sapiens
MKVLLVFDF

SEQ ID NO: 608799 - protein, 9 aa, Homo Sapiens
LKQILCKIP

SEQ ID NO: 608800 - protein, 9 aa, Homo Sapiens
SKGQPLCPA

SEQ ID NO: 608801 - protein, 9 aa, Homo Sapiens
THLQKEIAS

SEQ ID NO: 608802 - protein, 9 aa, Homo Sapiens
ATLELLLWH

SEQ ID NO: 608803 - protein, 9 aa, Homo Sapiens
SEMKAGRPE

SEQ ID NO: 608804 - protein, 9 aa, Homo Sapiens
TGPGQTSGA

SEQ ID NO: 608805 - protein, 9 aa, Homo Sapiens
PRVLLRDST

SEQ ID NO: 608806 - protein, 9 aa, Homo Sapiens
QRLLGPPAS

SEQ ID NO: 608807 - protein, 9 aa, Homo Sapiens
DMHRQSPKE

SEQ ID NO: 608808 - protein, 9 aa, Homo Sapiens
KLGSPAQQG

SEQ ID NO: 608809 - protein, 9 aa, Homo Sapiens
RLAYRLPGG

SEQ ID NO: 608810 - protein, 9 aa, Homo Sapiens
EVFCKKIYF

SEQ ID NO: 608811 - protein, 9 aa, Homo Sapiens
DICFTSTKV

SEQ ID NO: 608812 - protein, 9 aa, Homo Sapiens
HRDHILRRF

SEQ ID NO: 608813 - protein, 9 aa, Homo Sapiens
ELPVRGVSD

SEQ ID NO: 608814 - protein, 9 aa, Homo Sapiens
PKNTTESFV

SEQ ID NO: 608815 - protein, 9 aa, Homo Sapiens
DHILRRFQQ

SEQ ID NO: 608816 - protein, 9 aa, Homo Sapiens
LGSLMITCL

SEQ ID NO: 608817 - protein, 9 aa, Homo Sapiens
STGVLTATT

SEQ ID NO: 608818 - protein, 9 aa, Homo Sapiens
FGPGKGWEV

SEQ ID NO: 608819 - protein, 9 aa, Homo Sapiens
PRKGKRGQR

SEQ ID NO: 608820 - protein, 9 aa, Homo Sapiens
LPVTMLTAR

SEQ ID NO: 608821 - protein, 9 aa, Homo Sapiens
LVTASVNLS

SEQ ID NO: 608822 - protein, 9 aa, Homo Sapiens
FQRPQNEAR

SEQ ID NO: 608823 - protein, 9 aa, Homo Sapiens
ALLEQACAV

SEQ ID NO: 608824 - protein, 9 aa, Homo Sapiens
FLGAVESFS

SEQ ID NO: 608825 - protein, 9 aa, Homo Sapiens
VTASVNLSN

SEQ ID NO: 608826 - protein, 9 aa, Homo Sapiens
AEKSDSSKQ

SEQ ID NO: 608827 - protein, 9 aa, Homo Sapiens
LEIASFSSL

SEQ ID NO: 608828 - protein, 9 aa, Homo Sapiens
LGLKQKLLR

SEQ ID NO: 608829 - protein, 9 aa, Homo Sapiens
LRAGVFPER

SEQ ID NO: 608830 - protein, 9 aa, Homo Sapiens
KGNYGLLDH

SEQ ID NO: 608831 - protein, 9 aa, Homo Sapiens
GSLMITCLT

SEQ ID NO: 608832 - protein, 9 aa, Homo Sapiens
GSAAVQEEQ

SEQ ID NO: 608833 - protein, 9 aa, Homo Sapiens
LGILLGIIR

SEQ ID NO: 608834 - protein, 9 aa, Homo Sapiens
NYGLFQTAT

SEQ ID NO: 608835 - protein, 9 aa, Homo Sapiens
PECVEDPDK

SEQ ID NO: 608836 - protein, 9 aa, Homo Sapiens
PDKPSTSFL

SEQ ID NO: 608837 - protein, 9 aa, Homo Sapiens
PGGGSGCEE

SEQ ID NO: 608838 - protein, 9 aa, Homo Sapiens
GQVFQGSML

SEQ ID NO: 608839 - protein, 9 aa, Homo Sapiens
LEKGAKPCK

SEQ ID NO: 608840 - protein, 9 aa, Homo Sapiens
LGPRTSTAW

SEQ ID NO: 608841 - protein, 9 aa, Homo Sapiens
ARGEATKPS

SEQ ID NO: 608842 - protein, 9 aa, Homo Sapiens
MITCLTIIP

SEQ ID NO: 608843 - protein, 9 aa, Homo Sapiens
LGCYLPQTH

SEQ ID NO: 608844 - protein, 9 aa, Homo Sapiens
VDGVDKIQY

SEQ ID NO: 608845 - protein, 9 aa, Homo Sapiens
VIRNFLYVV

SEQ ID NO: 608846 - protein, 9 aa, Homo Sapiens
GGFGGIGII

SEQ ID NO: 608847 - protein, 9 aa, Homo Sapiens
PLCPAGVQV

SEQ ID NO: 608848 - protein, 9 aa, Homo Sapiens
CYIGCTVFI

SEQ ID NO: 608849 - protein, 9 aa, Homo Sapiens
QMVKDAHEV

SEQ ID NO: 608850 - protein, 9 aa, Homo Sapiens
EHEKTLLEL

SEQ ID NO: 608851 - protein, 9 aa, Homo Sapiens
RIRACFTQW

SEQ ID NO: 608852 - protein, 9 aa, Homo Sapiens
AVSRLRYYA

SEQ ID NO: 608853 - protein, 9 aa, Homo Sapiens
LLQLDLEAN

SEQ ID NO: 608854 - protein, 9 aa, Homo Sapiens
DYTAVRDAH

SEQ ID NO: 608855 - protein, 9 aa, Homo Sapiens
LCTEIVAID

SEQ ID NO: 608856 - protein, 9 aa, Homo Sapiens
SNAGDTYLF

SEQ ID NO: 608857 - protein, 9 aa, Homo Sapiens
VEGLYASVK

SEQ ID NO: 608858 - protein, 9 aa, Homo Sapiens
NLLPGRAKS

SEQ ID NO: 608859 - protein, 9 aa, Homo Sapiens
TIETLKQLE

SEQ ID NO: 608860 - protein, 9 aa, Homo Sapiens
TVDGTITTQ

SEQ ID NO: 608861 - protein, 9 aa, Homo Sapiens
MAFFQDQNY

SEQ ID NO: 608862 - protein, 9 aa, Homo Sapiens
QDADLADLG

SEQ ID NO: 608863 - protein, 9 aa, Homo Sapiens
KHGVLSQEI

SEQ ID NO: 608864 - protein, 9 aa, Homo Sapiens
EPWLPGARG

SEQ ID NO: 608865 - protein, 9 aa, Homo Sapiens
EVASNPSGA

SEQ ID NO: 608866 - protein, 9 aa, Homo Sapiens
LVMEAIGKV

SEQ ID NO: 608867 - protein, 9 aa, Homo Sapiens
IIDGDDIHG

SEQ ID NO: 608868 - protein, 9 aa, Homo Sapiens
RALPSTLFL

SEQ ID NO: 608869 - protein, 9 aa, Homo Sapiens
HEKTLLELV

SEQ ID NO: 608870 - protein, 9 aa, Homo Sapiens
AVISALVSI

SEQ ID NO: 608871 - protein, 9 aa, Homo Sapiens
YLADMHRQS

SEQ ID NO: 608872 - protein, 9 aa, Homo Sapiens
RYRDILRYD

SEQ ID NO: 608873 - protein, 9 aa, Homo Sapiens
KGFTPLMWA

SEQ ID NO: 608874 - protein, 9 aa, Homo Sapiens
DPAVATTPL

SEQ ID NO: 608875 - protein, 9 aa, Homo Sapiens
SLLPSESCE

SEQ ID NO: 608876 - protein, 9 aa, Homo Sapiens
EAPCPQLLP

SEQ ID NO: 608877 - protein, 9 aa, Homo Sapiens
AQNTTGTVF

SEQ ID NO: 608878 - protein, 9 aa, Homo Sapiens
VITNSITQH

SEQ ID NO: 608879 - protein, 9 aa, Homo Sapiens
GVVLMLLDC

SEQ ID NO: 608880 - protein, 9 aa, Homo Sapiens
EAKEIFQQL

SEQ ID NO: 608881 - protein, 9 aa, Homo Sapiens
RSITILALA

SEQ ID NO: 608882 - protein, 9 aa, Homo Sapiens
MNCGIYLFS

SEQ ID NO: 608883 - protein, 9 aa, Homo Sapiens
FPYSNYPDS

SEQ ID NO: 608884 - protein, 9 aa, Homo Sapiens
ISANALGNY

SEQ ID NO: 608885 - protein, 9 aa, Homo Sapiens
CSVGPDGDI

SEQ ID NO: 608886 - protein, 9 aa, Homo Sapiens
SPIPSVTKK

SEQ ID NO: 608887 - protein, 9 aa, Homo Sapiens
TCLGVNLKE

SEQ ID NO: 608888 - protein, 9 aa, Homo Sapiens
KTNRFCSVS

SEQ ID NO: 608889 - protein, 9 aa, Homo Sapiens
LINSNTYES

SEQ ID NO: 608890 - protein, 9 aa, Homo Sapiens
ISDIMNCGI

SEQ ID NO: 608891 - protein, 9 aa, Homo Sapiens
AHRGPQPPP

SEQ ID NO: 608892 - protein, 9 aa, Homo Sapiens
EYNKAVQEI

SEQ ID NO: 608893 - protein, 9 aa, Homo Sapiens
DYGHWYDRH

SEQ ID NO: 608894 - protein, 9 aa, Homo Sapiens
KVSIIRRLG

SEQ ID NO: 608895 - protein, 9 aa, Homo Sapiens
FELKQHQFR

SEQ ID NO: 608896 - protein, 9 aa, Homo Sapiens
RAGSRIAVP

SEQ ID NO: 608897 - protein, 9 aa, Homo Sapiens
HTTRPAATR

SEQ ID NO: 608898 - protein, 9 aa, Homo Sapiens
TLRMIGQNS

SEQ ID NO: 608899 - protein, 9 aa, Homo Sapiens
STLFLPHFL

SEQ ID NO: 608900 - protein, 9 aa, Homo Sapiens
VENTERLIK

SEQ ID NO: 608901 - protein, 9 aa, Homo Sapiens
ATTCQQEGG

SEQ ID NO: 608902 - protein, 9 aa, Homo Sapiens
SRPQDAAVH

SEQ ID NO: 608903 - protein, 9 aa, Homo Sapiens
RTARRRRKR

SEQ ID NO: 608904 - protein, 9 aa, Homo Sapiens
ALSQTGFSY

SEQ ID NO: 608905 - protein, 9 aa, Homo Sapiens
VPQVLPTQS

SEQ ID NO: 608906 - protein, 9 aa, Homo Sapiens
SLMDLMYKI

SEQ ID NO: 608907 - protein, 9 aa, Homo Sapiens
EAQRVFESS

SEQ ID NO: 608908 - protein, 9 aa, Homo Sapiens
GQIAYLKKK

SEQ ID NO: 608909 - protein, 9 aa, Homo Sapiens
LHLATLELL

SEQ ID NO: 608910 - protein, 9 aa, Homo Sapiens
LQSMSAKLQ

SEQ ID NO: 608911 - protein, 9 aa, Homo Sapiens
PMVSTEKSA

SEQ ID NO: 608912 - protein, 9 aa, Homo Sapiens
IMQFMKGWR

SEQ ID NO: 608913 - protein, 9 aa, Homo Sapiens
KWRKLVLPP

SEQ ID NO: 608914 - protein, 9 aa, Homo Sapiens
CGKSYISHS

SEQ ID NO: 608915 - protein, 9 aa, Homo Sapiens
ALGIPMIGP

SEQ ID NO: 608916 - protein, 9 aa, Homo Sapiens
FFFEDCFHF

SEQ ID NO: 608917 - protein, 9 aa, Homo Sapiens
SPGGPGCSL

SEQ ID NO: 608918 - protein, 9 aa, Homo Sapiens
KGQPLCPAG

SEQ ID NO: 608919 - protein, 9 aa, Homo Sapiens
EKSDSSKQL

SEQ ID NO: 608920 - protein, 9 aa, Homo Sapiens
SKGEEDEED

SEQ ID NO: 608921 - protein, 9 aa, Homo Sapiens
EPLEGDMCS

SEQ ID NO: 608922 - protein, 9 aa, Homo Sapiens
SVPQVLPTQ

SEQ ID NO: 608923 - protein, 9 aa, Homo Sapiens
TPACMVTLS

SEQ ID NO: 608924 - protein, 9 aa, Homo Sapiens
PGPSPGRLA

SEQ ID NO: 608925 - protein, 9 aa, Homo Sapiens
NLCNFASRN

SEQ ID NO: 608926 - protein, 9 aa, Homo Sapiens
RMMLVNWQH

SEQ ID NO: 608927 - protein, 9 aa, Homo Sapiens
REVGAALFL

SEQ ID NO: 608928 - protein, 9 aa, Homo Sapiens
VPIVQFPYE

SEQ ID NO: 608929 - protein, 9 aa, Homo Sapiens
TSQDPMVST

SEQ ID NO: 608930 - protein, 9 aa, Homo Sapiens
GAHHQTLQS

SEQ ID NO: 608931 - protein, 9 aa, Homo Sapiens
GYCVQDTTT

SEQ ID NO: 608932 - protein, 9 aa, Homo Sapiens
LHLPDPKYR

SEQ ID NO: 608933 - protein, 9 aa, Homo Sapiens
KAARPGGCE

SEQ ID NO: 608934 - protein, 9 aa, Homo Sapiens
NPMEEEYPR

SEQ ID NO: 608935 - protein, 9 aa, Homo Sapiens
AGRRMQAPW

SEQ ID NO: 608936 - protein, 9 aa, Homo Sapiens
YNELSKRIE

SEQ ID NO: 608937 - protein, 9 aa, Homo Sapiens
DFLMQRRVP

SEQ ID NO: 608938 - protein, 9 aa, Homo Sapiens
GTLPVLKRR

SEQ ID NO: 608939 - protein, 9 aa, Homo Sapiens
RRKRRKRKN

SEQ ID NO: 608940 - protein, 9 aa, Homo Sapiens
FRVMAQDYP

SEQ ID NO: 608941 - protein, 9 aa, Homo Sapiens
AFFYSPLLL

SEQ ID NO: 608942 - protein, 9 aa, Homo Sapiens
LSVDPNMEI

SEQ ID NO: 608943 - protein, 9 aa, Homo Sapiens
YISHSGLTK

SEQ ID NO: 608944 - protein, 9 aa, Homo Sapiens
TKSCKPLNI

SEQ ID NO: 608945 - protein, 9 aa, Homo Sapiens
ELRTLCRLL

SEQ ID NO: 608946 - protein, 9 aa, Homo Sapiens
TSAISTELN

SEQ ID NO: 608947 - protein, 9 aa, Homo Sapiens
ASFLRAGVF

SEQ ID NO: 608948 - protein, 9 aa, Homo Sapiens
LQRFNSTHR

SEQ ID NO: 608949 - protein, 9 aa, Homo Sapiens
RVFESSKTS

SEQ ID NO: 608950 - protein, 9 aa, Homo Sapiens
KGKRGQRPS

SEQ ID NO: 608951 - protein, 9 aa, Homo Sapiens
GPNFPGPTG

SEQ ID NO: 608952 - protein, 9 aa, Homo Sapiens
SWRRSFITA

SEQ ID NO: 608953 - protein, 9 aa, Homo Sapiens
PGRAKSVHP

SEQ ID NO: 608954 - protein, 9 aa, Homo Sapiens
KCSPPQRYK

SEQ ID NO: 608955 - protein, 9 aa, Homo Sapiens
GSDLPQDSK

SEQ ID NO: 608956 - protein, 9 aa, Homo Sapiens
KRSQRRTKI

SEQ ID NO: 608957 - protein, 9 aa, Homo Sapiens
DCYGDRLTS

SEQ ID NO: 608958 - protein, 9 aa, Homo Sapiens
KQFILFHPS

SEQ ID NO: 608959 - protein, 9 aa, Homo Sapiens
CSRQSWRTR

SEQ ID NO: 608960 - protein, 9 aa, Homo Sapiens
KRIEIHTYG

SEQ ID NO: 608961 - protein, 9 aa, Homo Sapiens
LSVLSRVIK

SEQ ID NO: 608962 - protein, 9 aa, Homo Sapiens
PSPPYNSMM

SEQ ID NO: 608963 - protein, 9 aa, Homo Sapiens
LDLEANLTS

SEQ ID NO: 608964 - protein, 9 aa, Homo Sapiens
QRAYLGGEN

SEQ ID NO: 608965 - protein, 9 aa, Homo Sapiens
KQLMDGLEY

SEQ ID NO: 608966 - protein, 9 aa, Homo Sapiens
DWESFGYNI

SEQ ID NO: 608967 - protein, 9 aa, Homo Sapiens
CGHGNAGQS

SEQ ID NO: 608968 - protein, 9 aa, Homo Sapiens
RKPVVQIHP

SEQ ID NO: 608969 - protein, 9 aa, Homo Sapiens
SAMPSKFIE

SEQ ID NO: 608970 - protein, 9 aa, Homo Sapiens
LRACFVRFR

SEQ ID NO: 608971 - protein, 9 aa, Homo Sapiens
ECVLLATMA

SEQ ID NO: 608972 - protein, 9 aa, Homo Sapiens
TPGPITTAT

SEQ ID NO: 608973 - protein, 9 aa, Homo Sapiens
PQSSGVSLV

SEQ ID NO: 608974 - protein, 9 aa, Homo Sapiens
ESARRYVSA

SEQ ID NO: 608975 - protein, 9 aa, Homo Sapiens
YLPQTHSLG

SEQ ID NO: 608976 - protein, 9 aa, Homo Sapiens
SPVLGTVPG

SEQ ID NO: 608977 - protein, 9 aa, Homo Sapiens
TFGSLEVMP

SEQ ID NO: 608978 - protein, 9 aa, Homo Sapiens
YKCPDYQSY

SEQ ID NO: 608979 - protein, 9 aa, Homo Sapiens
MVVALGRAV

SEQ ID NO: 608980 - protein, 9 aa, Homo Sapiens
GPYLPYKVL

SEQ ID NO: 608981 - protein, 9 aa, Homo Sapiens
SLTGPGQTS

SEQ ID NO: 608982 - protein, 9 aa, Homo Sapiens
HYLHLYMPA

SEQ ID NO: 608983 - protein, 9 aa, Homo Sapiens
NHFYSADPP

SEQ ID NO: 608984 - protein, 9 aa, Homo Sapiens
VEGQGPRSR

SEQ ID NO: 608985 - protein, 9 aa, Homo Sapiens
NIEVVKVLT

SEQ ID NO: 608986 - protein, 9 aa, Homo Sapiens
DPQWAAAGP

SEQ ID NO: 608987 - protein, 9 aa, Homo Sapiens
CNRYLTRRR

SEQ ID NO: 608988 - protein, 9 aa, Homo Sapiens
LSGQEFAVK

SEQ ID NO: 608989 - protein, 9 aa, Homo Sapiens
IEGREPKLN

SEQ ID NO: 608990 - protein, 9 aa, Homo Sapiens
DKMLNDRGN

SEQ ID NO: 608991 - protein, 9 aa, Homo Sapiens
KKRPATIFL

SEQ ID NO: 608992 - protein, 9 aa, Homo Sapiens
DSHSYLINS

SEQ ID NO: 608993 - protein, 9 aa, Homo Sapiens
DPATLNKPE

SEQ ID NO: 608994 - protein, 9 aa, Homo Sapiens
VEEFRPDSD

SEQ ID NO: 608995 - protein, 9 aa, Homo Sapiens
KNDESYEEL

SEQ ID NO: 608996 - protein, 9 aa, Homo Sapiens
LSRASGGRE

SEQ ID NO: 608997 - protein, 9 aa, Homo Sapiens
LRLTCKRIM

SEQ ID NO: 608998 - protein, 9 aa, Homo Sapiens
LATAVCKIV

SEQ ID NO: 608999 - protein, 9 aa, Homo Sapiens
MNLEIASFS

SEQ ID NO: 609000 - protein, 9 aa, Homo Sapiens
KMPGAPETS

SEQ ID NO: 609001 - protein, 9 aa, Homo Sapiens
GFFNAGSQG

SEQ ID NO: 609002 - protein, 9 aa, Homo Sapiens
SIYKKRKSE

SEQ ID NO: 609003 - protein, 9 aa, Homo Sapiens
YGLLDHIQA

SEQ ID NO: 609004 - protein, 9 aa, Homo Sapiens
ESHRCRPNV

SEQ ID NO: 609005 - protein, 9 aa, Homo Sapiens
SESSSKSDY

SEQ ID NO: 609006 - protein, 9 aa, Homo Sapiens
LPDPKYRQD

SEQ ID NO: 609007 - protein, 9 aa, Homo Sapiens
PTLKISLIH

SEQ ID NO: 609008 - protein, 9 aa, Homo Sapiens
WRLPGLLGQ

SEQ ID NO: 609009 - protein, 9 aa, Homo Sapiens
ASVARTAQQ

SEQ ID NO: 609010 - protein, 9 aa, Homo Sapiens
NVLQQSAVQ

SEQ ID NO: 609011 - protein, 9 aa, Homo Sapiens
AVVYMHRFY

SEQ ID NO: 609012 - protein, 9 aa, Homo Sapiens
PVLGTVPGA

SEQ ID NO: 609013 - protein, 9 aa, Homo Sapiens
WWGGAMGWA

SEQ ID NO: 609014 - protein, 9 aa, Homo Sapiens
SRVTVTPST

SEQ ID NO: 609015 - protein, 9 aa, Homo Sapiens
STSQDPMVS

SEQ ID NO: 609016 - protein, 9 aa, Homo Sapiens
LYPVEDYLD

SEQ ID NO: 609017 - protein, 9 aa, Homo Sapiens
CGELERIQN

SEQ ID NO: 609018 - protein, 9 aa, Homo Sapiens
SELMSTPVA

SEQ ID NO: 609019 - protein, 9 aa, Homo Sapiens
SSKSDYEED

SEQ ID NO: 609020 - protein, 9 aa, Homo Sapiens
RCQACGKSF

SEQ ID NO: 609021 - protein, 9 aa, Homo Sapiens
LPQKSLPVT

SEQ ID NO: 609022 - protein, 9 aa, Homo Sapiens
THKSQEGTQ

SEQ ID NO: 609023 - protein, 9 aa, Homo Sapiens
PPQSSGVSL

SEQ ID NO: 609024 - protein, 9 aa, Homo Sapiens
PRSKEAVVA

SEQ ID NO: 609025 - protein, 9 aa, Homo Sapiens
IVHVDSGCQ

SEQ ID NO: 609026 - protein, 9 aa, Homo Sapiens
FSLLPSESC

SEQ ID NO: 609027 - protein, 9 aa, Homo Sapiens
ALDVLQSPL

SEQ ID NO: 609028 - protein, 9 aa, Homo Sapiens
IGHCNFRFF

SEQ ID NO: 609029 - protein, 9 aa, Homo Sapiens
EHTLHLIRE

SEQ ID NO: 609030 - protein, 9 aa, Homo Sapiens
NQHISSHKE

SEQ ID NO: 609031 - protein, 9 aa, Homo Sapiens
SDNLLDSIT

SEQ ID NO: 609032 - protein, 9 aa, Homo Sapiens
LQRLLSTMS

SEQ ID NO: 609033 - protein, 9 aa, Homo Sapiens
SKMPGEGRG

SEQ ID NO: 609034 - protein, 9 aa, Homo Sapiens
TERKDEEGT

SEQ ID NO: 609035 - protein, 9 aa, Homo Sapiens
TKTYRIHRI

SEQ ID NO: 609036 - protein, 9 aa, Homo Sapiens
GETEEKRGG

SEQ ID NO: 609037 - protein, 9 aa, Homo Sapiens
LPLGKERNV

SEQ ID NO: 609038 - protein, 9 aa, Homo Sapiens
VHCQQSPVL

SEQ ID NO: 609039 - protein, 9 aa, Homo Sapiens
KNESKLPPA

SEQ ID NO: 609040 - protein, 9 aa, Homo Sapiens
LLGQALPRT

SEQ ID NO: 609041 - protein, 9 aa, Homo Sapiens
QKRIKHCKM

SEQ ID NO: 609042 - protein, 9 aa, Homo Sapiens
QGRTTYVLP

SEQ ID NO: 609043 - protein, 9 aa, Homo Sapiens
QKGVFPGEQ

SEQ ID NO: 609044 - protein, 9 aa, Homo Sapiens
CSLPEVFLK

SEQ ID NO: 609045 - protein, 9 aa, Homo Sapiens
MLNLFVDVI

SEQ ID NO: 609046 - protein, 9 aa, Homo Sapiens
GIFLELGSD

SEQ ID NO: 609047 - protein, 9 aa, Homo Sapiens
TTGTVFCPR

SEQ ID NO: 609048 - protein, 9 aa, Homo Sapiens
NTNSHYFTN

SEQ ID NO: 609049 - protein, 9 aa, Homo Sapiens
QEACARAGS

SEQ ID NO: 609050 - protein, 9 aa, Homo Sapiens
DGLEYCHKK

SEQ ID NO: 609051 - protein, 9 aa, Homo Sapiens
QRLCHPRCI

SEQ ID NO: 609052 - protein, 9 aa, Homo Sapiens
ASVVHSLIE

SEQ ID NO: 609053 - protein, 9 aa, Homo Sapiens
ERHRDPFPE

SEQ ID NO: 609054 - protein, 9 aa, Homo Sapiens
RESHRCRPN

SEQ ID NO: 609055 - protein, 9 aa, Homo Sapiens
PLEGDMCSP

SEQ ID NO: 609056 - protein, 9 aa, Homo Sapiens
RAIKTILKS

SEQ ID NO: 609057 - protein, 9 aa, Homo Sapiens
SPNIYPGAN

SEQ ID NO: 609058 - protein, 9 aa, Homo Sapiens
TQNLNWASL

SEQ ID NO: 609059 - protein, 9 aa, Homo Sapiens
SLVLSSNQN

SEQ ID NO: 609060 - protein, 9 aa, Homo Sapiens
SQEISHYSF

SEQ ID NO: 609061 - protein, 9 aa, Homo Sapiens
REFPRWVHC

SEQ ID NO: 609062 - protein, 9 aa, Homo Sapiens
LDPLAFFYS

SEQ ID NO: 609063 - protein, 9 aa, Homo Sapiens
EATKPSPSP

SEQ ID NO: 609064 - protein, 9 aa, Homo Sapiens
KLKEAQTRA

SEQ ID NO: 609065 - protein, 9 aa, Homo Sapiens
KVADFLMQR

SEQ ID NO: 609066 - protein, 9 aa, Homo Sapiens
ISLGSEALM

SEQ ID NO: 609067 - protein, 9 aa, Homo Sapiens
QKMESIQEL

SEQ ID NO: 609068 - protein, 9 aa, Homo Sapiens
APQAAPHPQ

SEQ ID NO: 609069 - protein, 9 aa, Homo Sapiens
RTVCSLIHL

SEQ ID NO: 609070 - protein, 9 aa, Homo Sapiens
SDGYDDLSE

SEQ ID NO: 609071 - protein, 9 aa, Homo Sapiens
LRNGYFGVG

SEQ ID NO: 609072 - protein, 9 aa, Homo Sapiens
ASPLTNDLL

SEQ ID NO: 609073 - protein, 9 aa, Homo Sapiens
ASCTMPAGQ

SEQ ID NO: 609074 - protein, 9 aa, Homo Sapiens
FFVDTAGLL

SEQ ID NO: 609075 - protein, 9 aa, Homo Sapiens
SDVEGLYAS

SEQ ID NO: 609076 - protein, 9 aa, Homo Sapiens
ATDQGPSES

SEQ ID NO: 609077 - protein, 9 aa, Homo Sapiens
AEAALSQTG

SEQ ID NO: 609078 - protein, 9 aa, Homo Sapiens
YFGVGEGPS

SEQ ID NO: 609079 - protein, 9 aa, Homo Sapiens
LVNNWKNEF

SEQ ID NO: 609080 - protein, 9 aa, Homo Sapiens
RGATTLVVT

SEQ ID NO: 609081 - protein, 9 aa, Homo Sapiens
LVLEKGWEI

SEQ ID NO: 609082 - protein, 9 aa, Homo Sapiens
GPGPAAPAP

SEQ ID NO: 609083 - protein, 9 aa, Homo Sapiens
ALQILLEKG

SEQ ID NO: 609084 - protein, 9 aa, Homo Sapiens
VGKLAALEE

SEQ ID NO: 609085 - protein, 9 aa, Homo Sapiens
SPSPVLGTV

SEQ ID NO: 609086 - protein, 9 aa, Homo Sapiens
LLQTAGPHP

SEQ ID NO: 609087 - protein, 9 aa, Homo Sapiens
KCSLLQQQK

SEQ ID NO: 609088 - protein, 9 aa, Homo Sapiens
TRKAHILNN

SEQ ID NO: 609089 - protein, 9 aa, Homo Sapiens
SQKKKSARS

SEQ ID NO: 609090 - protein, 9 aa, Homo Sapiens
ESTYLADMH

SEQ ID NO: 609091 - protein, 9 aa, Homo Sapiens
APLLNTFIY

SEQ ID NO: 609092 - protein, 9 aa, Homo Sapiens
DGYLIPINK

SEQ ID NO: 609093 - protein, 9 aa, Homo Sapiens
GPSPETYLL

SEQ ID NO: 609094 - protein, 9 aa, Homo Sapiens
GWLLGVKES

SEQ ID NO: 609095 - protein, 9 aa, Homo Sapiens
QYLKRIKLP

SEQ ID NO: 609096 - protein, 9 aa, Homo Sapiens
TDEKGFTPL

SEQ ID NO: 609097 - protein, 9 aa, Homo Sapiens
ALRGFRRGV

SEQ ID NO: 609098 - protein, 9 aa, Homo Sapiens
NINNLCNFA

SEQ ID NO: 609099 - protein, 9 aa, Homo Sapiens
FGVGEGPSR

SEQ ID NO: 609100 - protein, 9 aa, Homo Sapiens
QFHSICEVQ

SEQ ID NO: 609101 - protein, 9 aa, Homo Sapiens
GGYKTCPTV

SEQ ID NO: 609102 - protein, 9 aa, Homo Sapiens
MAGQCKDKG

SEQ ID NO: 609103 - protein, 9 aa, Homo Sapiens
CSLLGCGSN

SEQ ID NO: 609104 - protein, 9 aa, Homo Sapiens
GAVESFSWS

SEQ ID NO: 609105 - protein, 9 aa, Homo Sapiens
LKEERINEN

SEQ ID NO: 609106 - protein, 9 aa, Homo Sapiens
VLVLEKGWE

SEQ ID NO: 609107 - protein, 9 aa, Homo Sapiens
RFALSFGHQ

SEQ ID NO: 609108 - protein, 9 aa, Homo Sapiens
EPRSKEAVV

SEQ ID NO: 609109 - protein, 9 aa, Homo Sapiens
VYYYRMHTK

SEQ ID NO: 609110 - protein, 9 aa, Homo Sapiens
KGWEVINSK

SEQ ID NO: 609111 - protein, 9 aa, Homo Sapiens
RFGKFIRIY

SEQ ID NO: 609112 - protein, 9 aa, Homo Sapiens
HPHLFSCVE

SEQ ID NO: 609113 - protein, 9 aa, Homo Sapiens
IVHWKSQTC

SEQ ID NO: 609114 - protein, 9 aa, Homo Sapiens
RDWSQQELH

SEQ ID NO: 609115 - protein, 9 aa, Homo Sapiens
GPAAPAPAQ

SEQ ID NO: 609116 - protein, 9 aa, Homo Sapiens
AELYYQDPD

SEQ ID NO: 609117 - protein, 9 aa, Homo Sapiens
RRRRRKMTK

SEQ ID NO: 609118 - protein, 9 aa, Homo Sapiens
RLQLCAVHA

SEQ ID NO: 609119 - protein, 9 aa, Homo Sapiens
IVVILFFGE

SEQ ID NO: 609120 - protein, 9 aa, Homo Sapiens
PCPQLLPRG

SEQ ID NO: 609121 - protein, 9 aa, Homo Sapiens
VDHAIQKAF

SEQ ID NO: 609122 - protein, 9 aa, Homo Sapiens
NSDGYLIPI

SEQ ID NO: 609123 - protein, 9 aa, Homo Sapiens
RASALGHRH

SEQ ID NO: 609124 - protein, 9 aa, Homo Sapiens
MKNCAGKTP

SEQ ID NO: 609125 - protein, 9 aa, Homo Sapiens
IKTERVSIE

SEQ ID NO: 609126 - protein, 9 aa, Homo Sapiens
PGGRLLSAL

SEQ ID NO: 609127 - protein, 9 aa, Homo Sapiens
QKKEGKAKI

SEQ ID NO: 609128 - protein, 9 aa, Homo Sapiens
GRSPSRPPS

SEQ ID NO: 609129 - protein, 9 aa, Homo Sapiens
LARCRRPLG

SEQ ID NO: 609130 - protein, 9 aa, Homo Sapiens
DVEAKVLNQ

SEQ ID NO: 609131 - protein, 9 aa, Homo Sapiens
KSRVLQASG

SEQ ID NO: 609132 - protein, 9 aa, Homo Sapiens
AGARAGGYK

SEQ ID NO: 609133 - protein, 9 aa, Homo Sapiens
YDDLSESEP

SEQ ID NO: 609134 - protein, 9 aa, Homo Sapiens
NNCIGHCNF

SEQ ID NO: 609135 - protein, 9 aa, Homo Sapiens
KQTRSITIL

SEQ ID NO: 609136 - protein, 9 aa, Homo Sapiens
VISDEHDID

SEQ ID NO: 609137 - protein, 9 aa, Homo Sapiens
GVNLFDIAE

SEQ ID NO: 609138 - protein, 9 aa, Homo Sapiens
HGDRPLLGT

SEQ ID NO: 609139 - protein, 9 aa, Homo Sapiens
LHGALFLFI

SEQ ID NO: 609140 - protein, 9 aa, Homo Sapiens
GLCLTKNIL

SEQ ID NO: 609141 - protein, 9 aa, Homo Sapiens
PQRYKPLPS

SEQ ID NO: 609142 - protein, 9 aa, Homo Sapiens
QWRRPRVRR

SEQ ID NO: 609143 - protein, 9 aa, Homo Sapiens
DGSKFSMTV

SEQ ID NO: 609144 - protein, 9 aa, Homo Sapiens
YIGPCAGRD

SEQ ID NO: 609145 - protein, 9 aa, Homo Sapiens
VAVLFCVVT

SEQ ID NO: 609146 - protein, 9 aa, Homo Sapiens
IRRLGAAAL

SEQ ID NO: 609147 - protein, 9 aa, Homo Sapiens
WRASALGHR

SEQ ID NO: 609148 - protein, 9 aa, Homo Sapiens
QIDCSTLAL

SEQ ID NO: 609149 - protein, 9 aa, Homo Sapiens
VHQILHTGE

SEQ ID NO: 609150 - protein, 9 aa, Homo Sapiens
PGSMSEEQE

SEQ ID NO: 609151 - protein, 9 aa, Homo Sapiens
YNAQRPNGS

SEQ ID NO: 609152 - protein, 9 aa, Homo Sapiens
LTEYCIDTG

SEQ ID NO: 609153 - protein, 9 aa, Homo Sapiens
IAEVYAAGK

SEQ ID NO: 609154 - protein, 9 aa, Homo Sapiens
HVTVQIQDI

SEQ ID NO: 609155 - protein, 9 aa, Homo Sapiens
MPRNMEGAT

SEQ ID NO: 609156 - protein, 9 aa, Homo Sapiens
CSLARTCSR

SEQ ID NO: 609157 - protein, 9 aa, Homo Sapiens
TEHVAGVLL

SEQ ID NO: 609158 - protein, 9 aa, Homo Sapiens
LKDTDMNKN

SEQ ID NO: 609159 - protein, 9 aa, Homo Sapiens
GPPGPQGNR

SEQ ID NO: 609160 - protein, 9 aa, Homo Sapiens
CTVFIWCCL

SEQ ID NO: 609161 - protein, 9 aa, Homo Sapiens
CCQDGEARS

SEQ ID NO: 609162 - protein, 9 aa, Homo Sapiens
AYDSPDFNR

SEQ ID NO: 609163 - protein, 9 aa, Homo Sapiens
LSAAAGRRM

SEQ ID NO: 609164 - protein, 9 aa, Homo Sapiens
WEVISDEHD

SEQ ID NO: 609165 - protein, 9 aa, Homo Sapiens
ADAQSLLSL

SEQ ID NO: 609166 - protein, 9 aa, Homo Sapiens
YLDVDKDIH

SEQ ID NO: 609167 - protein, 9 aa, Homo Sapiens
CAASTRVSL

SEQ ID NO: 609168 - protein, 9 aa, Homo Sapiens
PCAGRDCSV

SEQ ID NO: 609169 - protein, 9 aa, Homo Sapiens
SLSPPTCGS

SEQ ID NO: 609170 - protein, 9 aa, Homo Sapiens
VLQQSAVQK

SEQ ID NO: 609171 - protein, 9 aa, Homo Sapiens
LLLFSSDSN

SEQ ID NO: 609172 - protein, 9 aa, Homo Sapiens
LPGLLDSHG

SEQ ID NO: 609173 - protein, 9 aa, Homo Sapiens
AIHTPGPIT

SEQ ID NO: 609174 - protein, 9 aa, Homo Sapiens
EIPDSCYSE

SEQ ID NO: 609175 - protein, 9 aa, Homo Sapiens
KDTDMNKND

SEQ ID NO: 609176 - protein, 9 aa, Homo Sapiens
FMLFLRLYL

SEQ ID NO: 609177 - protein, 9 aa, Homo Sapiens
GALRGFRRG

SEQ ID NO: 609178 - protein, 9 aa, Homo Sapiens
RSPSRPPSS

SEQ ID NO: 609179 - protein, 9 aa, Homo Sapiens
EKEELKEER

SEQ ID NO: 609180 - protein, 9 aa, Homo Sapiens
ARKPAGEPG

SEQ ID NO: 609181 - protein, 9 aa, Homo Sapiens
VAPKNDLKI

SEQ ID NO: 609182 - protein, 9 aa, Homo Sapiens
RALGRVGGW

SEQ ID NO: 609183 - protein, 9 aa, Homo Sapiens
MCESRHKIQ

SEQ ID NO: 609184 - protein, 9 aa, Homo Sapiens
DLQFPENNW

SEQ ID NO: 609185 - protein, 9 aa, Homo Sapiens
EVVPQFLVL

SEQ ID NO: 609186 - protein, 9 aa, Homo Sapiens
FDSLSRGKS

SEQ ID NO: 609187 - protein, 9 aa, Homo Sapiens
RNEAQVDGA

SEQ ID NO: 609188 - protein, 9 aa, Homo Sapiens
QYLTQVMTS

SEQ ID NO: 609189 - protein, 9 aa, Homo Sapiens
AANPKTLTS

SEQ ID NO: 609190 - protein, 9 aa, Homo Sapiens
QRRTKIKRR

SEQ ID NO: 609191 - protein, 9 aa, Homo Sapiens
WRGAHRQAA

SEQ ID NO: 609192 - protein, 9 aa, Homo Sapiens
MSEEQELCK

SEQ ID NO: 609193 - protein, 9 aa, Homo Sapiens
RMLGTKHSY

SEQ ID NO: 609194 - protein, 9 aa, Homo Sapiens
LSKWSTFGS

SEQ ID NO: 609195 - protein, 9 aa, Homo Sapiens
SSLIVHQIL

SEQ ID NO: 609196 - protein, 9 aa, Homo Sapiens
DVSYEEMAR

SEQ ID NO: 609197 - protein, 9 aa, Homo Sapiens
ALKWNWKKA

SEQ ID NO: 609198 - protein, 9 aa, Homo Sapiens
CETQNLNWA

SEQ ID NO: 609199 - protein, 9 aa, Homo Sapiens
DLGLKQKLL

SEQ ID NO: 609200 - protein, 9 aa, Homo Sapiens
RDTRKAHIL

SEQ ID NO: 609201 - protein, 9 aa, Homo Sapiens
SQSLATEDA

SEQ ID NO: 609202 - protein, 9 aa, Homo Sapiens
FFEDCFHFS

SEQ ID NO: 609203 - protein, 9 aa, Homo Sapiens
GIVVSLSFS

SEQ ID NO: 609204 - protein, 9 aa, Homo Sapiens
VLICGGFGG

SEQ ID NO: 609205 - protein, 9 aa, Homo Sapiens
LVPACLVST

SEQ ID NO: 609206 - protein, 9 aa, Homo Sapiens
HSGLTKHQI

SEQ ID NO: 609207 - protein, 9 aa, Homo Sapiens
HILNMLFNL

SEQ ID NO: 609208 - protein, 9 aa, Homo Sapiens
FETCALDND

SEQ ID NO: 609209 - protein, 9 aa, Homo Sapiens
CANGSEQSG

SEQ ID NO: 609210 - protein, 9 aa, Homo Sapiens
ERPGDRPAF

SEQ ID NO: 609211 - protein, 9 aa, Homo Sapiens
DRVLDLCRN

SEQ ID NO: 609212 - protein, 9 aa, Homo Sapiens
WIRLDPWEC

SEQ ID NO: 609213 - protein, 9 aa, Homo Sapiens
AACDQRLCH

SEQ ID NO: 609214 - protein, 9 aa, Homo Sapiens
GVILGSSEQ

SEQ ID NO: 609215 - protein, 9 aa, Homo Sapiens
EKRRGGKNR

SEQ ID NO: 609216 - protein, 9 aa, Homo Sapiens
PDGWSGGLR

SEQ ID NO: 609217 - protein, 9 aa, Homo Sapiens
HEKEELKEE

SEQ ID NO: 609218 - protein, 9 aa, Homo Sapiens
QSFALSLCG

SEQ ID NO: 609219 - protein, 9 aa, Homo Sapiens
GSTPMPRNM

SEQ ID NO: 609220 - protein, 9 aa, Homo Sapiens
HILGNYRSF

SEQ ID NO: 609221 - protein, 9 aa, Homo Sapiens
PSAVPPQAF

SEQ ID NO: 609222 - protein, 9 aa, Homo Sapiens
KFIRIYFGA

SEQ ID NO: 609223 - protein, 9 aa, Homo Sapiens
NWKNEFQKW

SEQ ID NO: 609224 - protein, 9 aa, Homo Sapiens
MEDCLQLPD

SEQ ID NO: 609225 - protein, 9 aa, Homo Sapiens
QSSGVSLVS

SEQ ID NO: 609226 - protein, 9 aa, Homo Sapiens
GHNQRIFVE

SEQ ID NO: 609227 - protein, 9 aa, Homo Sapiens
AFHFNIMKP

SEQ ID NO: 609228 - protein, 9 aa, Homo Sapiens
EQMAAFHQS

SEQ ID NO: 609229 - protein, 9 aa, Homo Sapiens
RRAIEMAST

SEQ ID NO: 609230 - protein, 9 aa, Homo Sapiens
KEKLRKQAG

SEQ ID NO: 609231 - protein, 9 aa, Homo Sapiens
ALGRAVAGS

SEQ ID NO: 609232 - protein, 9 aa, Homo Sapiens
NIVRNNIGK

SEQ ID NO: 609233 - protein, 9 aa, Homo Sapiens
SSRQDVPYV

SEQ ID NO: 609234 - protein, 9 aa, Homo Sapiens
ILDEVEKRQ

SEQ ID NO: 609235 - protein, 9 aa, Homo Sapiens
VGAALFLGW

SEQ ID NO: 609236 - protein, 9 aa, Homo Sapiens
SRNEAQVDG

SEQ ID NO: 609237 - protein, 9 aa, Homo Sapiens
PICLASPKE

SEQ ID NO: 609238 - protein, 9 aa, Homo Sapiens
KSDLDQIFD

SEQ ID NO: 609239 - protein, 9 aa, Homo Sapiens
TLRNELLVT

SEQ ID NO: 609240 - protein, 9 aa, Homo Sapiens
TAGGMAGTF

SEQ ID NO: 609241 - protein, 9 aa, Homo Sapiens
PEYQLENQK

SEQ ID NO: 609242 - protein, 9 aa, Homo Sapiens
HNYTISLGS

SEQ ID NO: 609243 - protein, 9 aa, Homo Sapiens
PEATVAVPA

SEQ ID NO: 609244 - protein, 9 aa, Homo Sapiens
GRPVVNGEE

SEQ ID NO: 609245 - protein, 9 aa, Homo Sapiens
VFPGEQFKP

SEQ ID NO: 609246 - protein, 9 aa, Homo Sapiens
STYLADMHR

SEQ ID NO: 609247 - protein, 9 aa, Homo Sapiens
RSQQCALCP

SEQ ID NO: 609248 - protein, 9 aa, Homo Sapiens
APSPSPVLG

SEQ ID NO: 609249 - protein, 9 aa, Homo Sapiens
GHLTVAEFK

SEQ ID NO: 609250 - protein, 9 aa, Homo Sapiens
SLEKALEIC

SEQ ID NO: 609251 - protein, 9 aa, Homo Sapiens
SIDRLRSEY

SEQ ID NO: 609252 - protein, 9 aa, Homo Sapiens
APGQEQLGP

SEQ ID NO: 609253 - protein, 9 aa, Homo Sapiens
LVLRRDHKT

SEQ ID NO: 609254 - protein, 9 aa, Homo Sapiens
QQMRQECLQ

SEQ ID NO: 609255 - protein, 9 aa, Homo Sapiens
RKRRKRKNT

SEQ ID NO: 609256 - protein, 9 aa, Homo Sapiens
DTDMNKNDK

SEQ ID NO: 609257 - protein, 9 aa, Homo Sapiens
AALLQTAGP

SEQ ID NO: 609258 - protein, 9 aa, Homo Sapiens
GKSFLSRAA

SEQ ID NO: 609259 - protein, 9 aa, Homo Sapiens
DVRKRMQDL

SEQ ID NO: 609260 - protein, 9 aa, Homo Sapiens
FPRIVVGST

SEQ ID NO: 609261 - protein, 9 aa, Homo Sapiens
HQILHTGEK

SEQ ID NO: 609262 - protein, 9 aa, Homo Sapiens
AWSTPTTNA

SEQ ID NO: 609263 - protein, 9 aa, Homo Sapiens
GWSGGLRGL

SEQ ID NO: 609264 - protein, 9 aa, Homo Sapiens
HLTVAEFKK

SEQ ID NO: 609265 - protein, 9 aa, Homo Sapiens
NTMVPVASH

SEQ ID NO: 609266 - protein, 9 aa, Homo Sapiens
LEPAEGRGS

SEQ ID NO: 609267 - protein, 9 aa, Homo Sapiens
TDSKDNEVD

SEQ ID NO: 609268 - protein, 9 aa, Homo Sapiens
TDQGPSESP

SEQ ID NO: 609269 - protein, 9 aa, Homo Sapiens
CFPYSNYPD

SEQ ID NO: 609270 - protein, 9 aa, Homo Sapiens
FLEWIQPAD

SEQ ID NO: 609271 - protein, 9 aa, Homo Sapiens
FNIMKPYIK

SEQ ID NO: 609272 - protein, 9 aa, Homo Sapiens
LQTAGPHPG

SEQ ID NO: 609273 - protein, 9 aa, Homo Sapiens
NEEYNKAVQ

SEQ ID NO: 609274 - protein, 9 aa, Homo Sapiens
SGARAHRPR

SEQ ID NO: 609275 - protein, 9 aa, Homo Sapiens
QQPQPPLPQ

SEQ ID NO: 609276 - protein, 9 aa, Homo Sapiens
SEYVRKFLL

SEQ ID NO: 609277 - protein, 9 aa, Homo Sapiens
ITQHTLHSF

SEQ ID NO: 609278 - protein, 9 aa, Homo Sapiens
SADPPLIKL

SEQ ID NO: 609279 - protein, 9 aa, Homo Sapiens
PSSLLDSLW

SEQ ID NO: 609280 - protein, 9 aa, Homo Sapiens
RGPLSRASG

SEQ ID NO: 609281 - protein, 9 aa, Homo Sapiens
TPPRDLYSK

SEQ ID NO: 609282 - protein, 9 aa, Homo Sapiens
PGQEQLGPE

SEQ ID NO: 609283 - protein, 9 aa, Homo Sapiens
GGRERHRDP

SEQ ID NO: 609284 - protein, 9 aa, Homo Sapiens
LELLLWHEG

SEQ ID NO: 609285 - protein, 9 aa, Homo Sapiens
LYCISHKIM

SEQ ID NO: 609286 - protein, 9 aa, Homo Sapiens
SGVLLLENP

SEQ ID NO: 609287 - protein, 9 aa, Homo Sapiens
TYVLPFSMG

SEQ ID NO: 609288 - protein, 9 aa, Homo Sapiens
AFTPLAVAL

SEQ ID NO: 609289 - protein, 9 aa, Homo Sapiens
RFQQIKARY

SEQ ID NO: 609290 - protein, 9 aa, Homo Sapiens
AVGMRRSLD

SEQ ID NO: 609291 - protein, 9 aa, Homo Sapiens
GQHLCFTRH

SEQ ID NO: 609292 - protein, 9 aa, Homo Sapiens
VVRIQSALP

SEQ ID NO: 609293 - protein, 9 aa, Homo Sapiens
LTIISSDLC

SEQ ID NO: 609294 - protein, 9 aa, Homo Sapiens
VSNDTISYP

SEQ ID NO: 609295 - protein, 9 aa, Homo Sapiens
IPPPLGQMC

SEQ ID NO: 609296 - protein, 9 aa, Homo Sapiens
KQLQKKEKL

SEQ ID NO: 609297 - protein, 9 aa, Homo Sapiens
SLWCSPFRR

SEQ ID NO: 609298 - protein, 9 aa, Homo Sapiens
HILELLMDE

SEQ ID NO: 609299 - protein, 9 aa, Homo Sapiens
DDSDGTEDT

SEQ ID NO: 609300 - protein, 9 aa, Homo Sapiens
LEARPEATV

SEQ ID NO: 609301 - protein, 9 aa, Homo Sapiens
FSGFSTASR

SEQ ID NO: 609302 - protein, 9 aa, Homo Sapiens
PHELIPTKS

SEQ ID NO: 609303 - protein, 9 aa, Homo Sapiens
QTLARCRRP

SEQ ID NO: 609304 - protein, 9 aa, Homo Sapiens
DSNGICHLE

SEQ ID NO: 609305 - protein, 9 aa, Homo Sapiens
PGKPRLVLS

SEQ ID NO: 609306 - protein, 9 aa, Homo Sapiens
GRLAYRLPG

SEQ ID NO: 609307 - protein, 9 aa, Homo Sapiens
EVQVDDVKR

SEQ ID NO: 609308 - protein, 9 aa, Homo Sapiens
SAKGSNAIE

SEQ ID NO: 609309 - protein, 9 aa, Homo Sapiens
VFQGSMLHV

SEQ ID NO: 609310 - protein, 9 aa, Homo Sapiens
RLGPRTSTA

SEQ ID NO: 609311 - protein, 9 aa, Homo Sapiens
LLALICSFQ

SEQ ID NO: 609312 - protein, 9 aa, Homo Sapiens
PVVNGEEGE

SEQ ID NO: 609313 - protein, 9 aa, Homo Sapiens
MSGRGEGGK

SEQ ID NO: 609314 - protein, 9 aa, Homo Sapiens
SNHSLGNYG

SEQ ID NO: 609315 - protein, 9 aa, Homo Sapiens
LLPPRCISR

SEQ ID NO: 609316 - protein, 9 aa, Homo Sapiens
ERCALGYYR

SEQ ID NO: 609317 - protein, 9 aa, Homo Sapiens
AFPPAHSAA

SEQ ID NO: 609318 - protein, 9 aa, Homo Sapiens
GGRDFTDPL

SEQ ID NO: 609319 - protein, 9 aa, Homo Sapiens
QDAAVHPAC

SEQ ID NO: 609320 - protein, 9 aa, Homo Sapiens
VFYTIRTPM

SEQ ID NO: 609321 - protein, 9 aa, Homo Sapiens
GQRVCYVPK

SEQ ID NO: 609322 - protein, 9 aa, Homo Sapiens
RVMAQDYPE

SEQ ID NO: 609323 - protein, 9 aa, Homo Sapiens
TRRSISCKK

SEQ ID NO: 609324 - protein, 9 aa, Homo Sapiens
VMYAMLVFT

SEQ ID NO: 609325 - protein, 9 aa, Homo Sapiens
LVSTALCQS

SEQ ID NO: 609326 - protein, 9 aa, Homo Sapiens
WRFLPGGLE

SEQ ID NO: 609327 - protein, 9 aa, Homo Sapiens
FEREERLIL

SEQ ID NO: 609328 - protein, 9 aa, Homo Sapiens
YRMHTKINS

SEQ ID NO: 609329 - protein, 9 aa, Homo Sapiens
IMNCGIYLF

SEQ ID NO: 609330 - protein, 9 aa, Homo Sapiens
NAAAYLQYL

SEQ ID NO: 609331 - protein, 9 aa, Homo Sapiens
TRFFETCAL

SEQ ID NO: 609332 - protein, 9 aa, Homo Sapiens
ANTRSSHLT

SEQ ID NO: 609333 - protein, 9 aa, Homo Sapiens
FISANALGN

SEQ ID NO: 609334 - protein, 9 aa, Homo Sapiens
KHKAFSTCY

SEQ ID NO: 609335 - protein, 9 aa, Homo Sapiens
NGEAEGRDG

SEQ ID NO: 609336 - protein, 9 aa, Homo Sapiens
SRLEQKLGE

SEQ ID NO: 609337 - protein, 9 aa, Homo Sapiens
GSPGGPGCS

SEQ ID NO: 609338 - protein, 9 aa, Homo Sapiens
NIVGRAEAS

SEQ ID NO: 609339 - protein, 9 aa, Homo Sapiens
SFLSRAASH

SEQ ID NO: 609340 - protein, 9 aa, Homo Sapiens
ATVLLEARP

SEQ ID NO: 609341 - protein, 9 aa, Homo Sapiens
SFQYRYTSE

SEQ ID NO: 609342 - protein, 9 aa, Homo Sapiens
AHTVDTWPP

SEQ ID NO: 609343 - protein, 9 aa, Homo Sapiens
DYCEGSEAE

SEQ ID NO: 609344 - protein, 9 aa, Homo Sapiens
VRRLHQRSV

SEQ ID NO: 609345 - protein, 9 aa, Homo Sapiens
LMHGWFHFL

SEQ ID NO: 609346 - protein, 9 aa, Homo Sapiens
IRKMLSSEV

SEQ ID NO: 609347 - protein, 9 aa, Homo Sapiens
VEEGISLEA

SEQ ID NO: 609348 - protein, 9 aa, Homo Sapiens
VTVKSMNTM

SEQ ID NO: 609349 - protein, 9 aa, Homo Sapiens
GLSSDDAYE

SEQ ID NO: 609350 - protein, 9 aa, Homo Sapiens
VDMETINVD

SEQ ID NO: 609351 - protein, 9 aa, Homo Sapiens
TAGLLEIVC

SEQ ID NO: 609352 - protein, 9 aa, Homo Sapiens
HTLRNELLV

SEQ ID NO: 609353 - protein, 9 aa, Homo Sapiens
FGASVEREI

SEQ ID NO: 609354 - protein, 9 aa, Homo Sapiens
TPAFHFNIM

SEQ ID NO: 609355 - protein, 9 aa, Homo Sapiens
GTQYLTQVM

SEQ ID NO: 609356 - protein, 9 aa, Homo Sapiens
ECIENKKSF

SEQ ID NO: 609357 - protein, 9 aa, Homo Sapiens
IHTPGPITT

SEQ ID NO: 609358 - protein, 9 aa, Homo Sapiens
RIVSFTKIL

SEQ ID NO: 609359 - protein, 9 aa, Homo Sapiens
ICLASPKEI

SEQ ID NO: 609360 - protein, 9 aa, Homo Sapiens
NVITLYKDV

SEQ ID NO: 609361 - protein, 9 aa, Homo Sapiens
LNHHSCSVN

SEQ ID NO: 609362 - protein, 9 aa, Homo Sapiens
SQTRREEAL

SEQ ID NO: 609363 - protein, 9 aa, Homo Sapiens
AKIVVPVTF

SEQ ID NO: 609364 - protein, 9 aa, Homo Sapiens
QQWRRPRVR

SEQ ID NO: 609365 - protein, 9 aa, Homo Sapiens
VLTGRDTAC

SEQ ID NO: 609366 - protein, 9 aa, Homo Sapiens
GSLLGARGP

SEQ ID NO: 609367 - protein, 9 aa, Homo Sapiens
GEVNVVPQE

SEQ ID NO: 609368 - protein, 9 aa, Homo Sapiens
PDCEQFQMP

SEQ ID NO: 609369 - protein, 9 aa, Homo Sapiens
GWEVINSKP

SEQ ID NO: 609370 - protein, 9 aa, Homo Sapiens
QSQHMEGTH

SEQ ID NO: 609371 - protein, 9 aa, Homo Sapiens
RVCYVPKLW

SEQ ID NO: 609372 - protein, 9 aa, Homo Sapiens
TEEKRGGET

SEQ ID NO: 609373 - protein, 9 aa, Homo Sapiens
IIRRLGAAA

SEQ ID NO: 609374 - protein, 9 aa, Homo Sapiens
QAFPPAHSA

SEQ ID NO: 609375 - protein, 9 aa, Homo Sapiens
SLLGCGSNG

SEQ ID NO: 609376 - protein, 9 aa, Homo Sapiens
TEAAVHDSR

SEQ ID NO: 609377 - protein, 9 aa, Homo Sapiens
SGLGLSIVR

SEQ ID NO: 609378 - protein, 9 aa, Homo Sapiens
LIVHVDSGC

SEQ ID NO: 609379 - protein, 9 aa, Homo Sapiens
EPVATSLSS

SEQ ID NO: 609380 - protein, 9 aa, Homo Sapiens
IQSALPAFN

SEQ ID NO: 609381 - protein, 9 aa, Homo Sapiens
QKNSTGSGH

SEQ ID NO: 609382 - protein, 9 aa, Homo Sapiens
SSFNGEVNV

SEQ ID NO: 609383 - protein, 9 aa, Homo Sapiens
LDSITGPLP

SEQ ID NO: 609384 - protein, 9 aa, Homo Sapiens
PETSPGDGA

SEQ ID NO: 609385 - protein, 9 aa, Homo Sapiens
LSSNQNLVE

SEQ ID NO: 609386 - protein, 9 aa, Homo Sapiens
VESFSWSGG

SEQ ID NO: 609387 - protein, 9 aa, Homo Sapiens
QDSNSREPD

SEQ ID NO: 609388 - protein, 9 aa, Homo Sapiens
PRSVLLEPP

SEQ ID NO: 609389 - protein, 9 aa, Homo Sapiens
KLWRVTAVP

SEQ ID NO: 609390 - protein, 9 aa, Homo Sapiens
EALQILLEK

SEQ ID NO: 609391 - protein, 9 aa, Homo Sapiens
LSTMSKYYN

SEQ ID NO: 609392 - protein, 9 aa, Homo Sapiens
SLPVTLTAN

SEQ ID NO: 609393 - protein, 9 aa, Homo Sapiens
ERQRLQLCA

SEQ ID NO: 609394 - protein, 9 aa, Homo Sapiens
GFSKQSPQN

SEQ ID NO: 609395 - protein, 9 aa, Homo Sapiens
TKQEKDFLW

SEQ ID NO: 609396 - protein, 9 aa, Homo Sapiens
SRLEARLQT

SEQ ID NO: 609397 - protein, 9 aa, Homo Sapiens
MAAGFFNAG

SEQ ID NO: 609398 - protein, 9 aa, Homo Sapiens
RTSTAWSTP

SEQ ID NO: 609399 - protein, 9 aa, Homo Sapiens
ALTSKKSKI

SEQ ID NO: 609400 - protein, 9 aa, Homo Sapiens
GSSEQHEVE

SEQ ID NO: 609401 - protein, 9 aa, Homo Sapiens
DTYTLTRLN

SEQ ID NO: 609402 - protein, 9 aa, Homo Sapiens
SDEQKRLPA

SEQ ID NO: 609403 - protein, 9 aa, Homo Sapiens
LATEDAFTP

SEQ ID NO: 609404 - protein, 9 aa, Homo Sapiens
QCFHILNML

SEQ ID NO: 609405 - protein, 9 aa, Homo Sapiens
PKLIFDSLS

SEQ ID NO: 609406 - protein, 9 aa, Homo Sapiens
PRDCFPYSN

SEQ ID NO: 609407 - protein, 9 aa, Homo Sapiens
QSGVLLLEN

SEQ ID NO: 609408 - protein, 9 aa, Homo Sapiens
DGWSGGLRG

SEQ ID NO: 609409 - protein, 9 aa, Homo Sapiens
QEQARMGSA

SEQ ID NO: 609410 - protein, 9 aa, Homo Sapiens
MQALKWNWK

SEQ ID NO: 609411 - protein, 9 aa, Homo Sapiens
NLRLTCKRI

SEQ ID NO: 609412 - protein, 9 aa, Homo Sapiens
PSTRTSASV

SEQ ID NO: 609413 - protein, 9 aa, Homo Sapiens
SSGVDIISS

SEQ ID NO: 609414 - protein, 9 aa, Homo Sapiens
SGVILGSSE

SEQ ID NO: 609415 - protein, 9 aa, Homo Sapiens
PLAFFYSPL

SEQ ID NO: 609416 - protein, 9 aa, Homo Sapiens
LEIQCLVAG

SEQ ID NO: 609417 - protein, 9 aa, Homo Sapiens
AEATVLLEA

SEQ ID NO: 609418 - protein, 9 aa, Homo Sapiens
LICGGFGGI

SEQ ID NO: 609419 - protein, 9 aa, Homo Sapiens
LLVGEGHFS

SEQ ID NO: 609420 - protein, 9 aa, Homo Sapiens
KELQSMSAK

SEQ ID NO: 609421 - protein, 9 aa, Homo Sapiens
SLRKCGSGR

SEQ ID NO: 609422 - protein, 9 aa, Homo Sapiens
DGSRLLQRF

SEQ ID NO: 609423 - protein, 9 aa, Homo Sapiens
QNEYELMRE

SEQ ID NO: 609424 - protein, 9 aa, Homo Sapiens
HIGVMKKEK

SEQ ID NO: 609425 - protein, 9 aa, Homo Sapiens
FYLVARTSR

SEQ ID NO: 609426 - protein, 9 aa, Homo Sapiens
MQVSSVRCI

SEQ ID NO: 609427 - protein, 9 aa, Homo Sapiens
CKLLVLGLC

SEQ ID NO: 609428 - protein, 9 aa, Homo Sapiens
TNSLQVRRQ

SEQ ID NO: 609429 - protein, 9 aa, Homo Sapiens
QPLCPAGVQ

SEQ ID NO: 609430 - protein, 9 aa, Homo Sapiens
ISDEHDIDP

SEQ ID NO: 609431 - protein, 9 aa, Homo Sapiens
AWRFPGLPL

SEQ ID NO: 609432 - protein, 9 aa, Homo Sapiens
SFQLGDACL

SEQ ID NO: 609433 - protein, 9 aa, Homo Sapiens
YFPVLIVHV

SEQ ID NO: 609434 - protein, 9 aa, Homo Sapiens
TERVSIETR

SEQ ID NO: 609435 - protein, 9 aa, Homo Sapiens
SAPWDRVLD

SEQ ID NO: 609436 - protein, 9 aa, Homo Sapiens
SALPAAPRG

SEQ ID NO: 609437 - protein, 9 aa, Homo Sapiens
VGIAGIRAT

SEQ ID NO: 609438 - protein, 9 aa, Homo Sapiens
HHQTLQSLV

SEQ ID NO: 609439 - protein, 9 aa, Homo Sapiens
YLINSNTYE

SEQ ID NO: 609440 - protein, 9 aa, Homo Sapiens
SAQTLVIMP

SEQ ID NO: 609441 - protein, 9 aa, Homo Sapiens
PELKIVHWK

SEQ ID NO: 609442 - protein, 9 aa, Homo Sapiens
MSMSANTII

SEQ ID NO: 609443 - protein, 9 aa, Homo Sapiens
DMNKNDKQK

SEQ ID NO: 609444 - protein, 9 aa, Homo Sapiens
ETLTLKIHG

SEQ ID NO: 609445 - protein, 9 aa, Homo Sapiens
PPAPPGGGS

SEQ ID NO: 609446 - protein, 9 aa, Homo Sapiens
GDTVSQFHS

SEQ ID NO: 609447 - protein, 9 aa, Homo Sapiens
SVLYSWTTR

SEQ ID NO: 609448 - protein, 9 aa, Homo Sapiens
MKPYIKIFN

SEQ ID NO: 609449 - protein, 9 aa, Homo Sapiens
TINVDRDAE

SEQ ID NO: 609450 - protein, 9 aa, Homo Sapiens
SDSNGICHL

SEQ ID NO: 609451 - protein, 9 aa, Homo Sapiens
TGLRKSSGT

SEQ ID NO: 609452 - protein, 9 aa, Homo Sapiens
RDHKTSTRR

SEQ ID NO: 609453 - protein, 9 aa, Homo Sapiens
PLAFGYFGI

SEQ ID NO: 609454 - protein, 9 aa, Homo Sapiens
YTAVRDAHS

SEQ ID NO: 609455 - protein, 9 aa, Homo Sapiens
PQGNRGERG

SEQ ID NO: 609456 - protein, 9 aa, Homo Sapiens
PQAQHSHYA

SEQ ID NO: 609457 - protein, 9 aa, Homo Sapiens
HEFRFPEDE

SEQ ID NO: 609458 - protein, 9 aa, Homo Sapiens
PSTAQLTGV

SEQ ID NO: 609459 - protein, 9 aa, Homo Sapiens
TLQRTKMTK

SEQ ID NO: 609460 - protein, 9 aa, Homo Sapiens
LFQTATSGR

SEQ ID NO: 609461 - protein, 9 aa, Homo Sapiens
RPYVSANPS

SEQ ID NO: 609462 - protein, 9 aa, Homo Sapiens
KMKGGSNCL

SEQ ID NO: 609463 - protein, 9 aa, Homo Sapiens
LNMKNCAGK

SEQ ID NO: 609464 - protein, 9 aa, Homo Sapiens
KKPLYCISH

SEQ ID NO: 609465 - protein, 9 aa, Homo Sapiens
RLEARLQTP

SEQ ID NO: 609466 - protein, 9 aa, Homo Sapiens
IRESHRCRP

SEQ ID NO: 609467 - protein, 9 aa, Homo Sapiens
CGRTGMQVS

SEQ ID NO: 609468 - protein, 9 aa, Homo Sapiens
LARKATLWL

SEQ ID NO: 609469 - protein, 9 aa, Homo Sapiens
FPLLWALSL

SEQ ID NO: 609470 - protein, 9 aa, Homo Sapiens
HLYPPCSTV

SEQ ID NO: 609471 - protein, 9 aa, Homo Sapiens
SLRFSRATA

SEQ ID NO: 609472 - protein, 9 aa, Homo Sapiens
QPADTGGRK

SEQ ID NO: 609473 - protein, 9 aa, Homo Sapiens
AQQGCYAEA

SEQ ID NO: 609474 - protein, 9 aa, Homo Sapiens
GLGVFALPL

SEQ ID NO: 609475 - protein, 9 aa, Homo Sapiens
REAEDAERE

SEQ ID NO: 609476 - protein, 9 aa, Homo Sapiens
LSCSRGEAQ

SEQ ID NO: 609477 - protein, 9 aa, Homo Sapiens
SCSLLGCGS

SEQ ID NO: 609478 - protein, 9 aa, Homo Sapiens
ELYYQDPDA

SEQ ID NO: 609479 - protein, 9 aa, Homo Sapiens
HFEDYCEGS

SEQ ID NO: 609480 - protein, 9 aa, Homo Sapiens
IVQFPYEDI

SEQ ID NO: 609481 - protein, 9 aa, Homo Sapiens
RMQAPWREF

SEQ ID NO: 609482 - protein, 9 aa, Homo Sapiens
LRRWHKSRV

SEQ ID NO: 609483 - protein, 9 aa, Homo Sapiens
RKSSGTATL

SEQ ID NO: 609484 - protein, 9 aa, Homo Sapiens
TPSPSPLSR

SEQ ID NO: 609485 - protein, 9 aa, Homo Sapiens
VPYALGIPM

SEQ ID NO: 609486 - protein, 9 aa, Homo Sapiens
LEKAMKMKG

SEQ ID NO: 609487 - protein, 9 aa, Homo Sapiens
PGLRLPSLV

SEQ ID NO: 609488 - protein, 9 aa, Homo Sapiens
QFILFHPSL

SEQ ID NO: 609489 - protein, 9 aa, Homo Sapiens
SDWIRLDPW

SEQ ID NO: 609490 - protein, 9 aa, Homo Sapiens
PPRALGRVG

SEQ ID NO: 609491 - protein, 9 aa, Homo Sapiens
LIPTKSCKP

SEQ ID NO: 609492 - protein, 9 aa, Homo Sapiens
ASRMEDCLQ

SEQ ID NO: 609493 - protein, 9 aa, Homo Sapiens
GQLWRFLPG

SEQ ID NO: 609494 - protein, 9 aa, Homo Sapiens
GLSTFTIPK

SEQ ID NO: 609495 - protein, 9 aa, Homo Sapiens
LVNYFMEEF

SEQ ID NO: 609496 - protein, 9 aa, Homo Sapiens
DTEHVAGVL

SEQ ID NO: 609497 - protein, 9 aa, Homo Sapiens
GAGQGQWRA

SEQ ID NO: 609498 - protein, 9 aa, Homo Sapiens
ASLAAQGQL

SEQ ID NO: 609499 - protein, 9 aa, Homo Sapiens
KCGKANTRS

SEQ ID NO: 609500 - protein, 9 aa, Homo Sapiens
TASPLTNDL

SEQ ID NO: 609501 - protein, 9 aa, Homo Sapiens
RARRGQAQA

SEQ ID NO: 609502 - protein, 9 aa, Homo Sapiens
TASPTTSTT

SEQ ID NO: 609503 - protein, 9 aa, Homo Sapiens
QATALHHIP

SEQ ID NO: 609504 - protein, 9 aa, Homo Sapiens
IKQEVNLQL

SEQ ID NO: 609505 - protein, 9 aa, Homo Sapiens
QVHCQQSPV

SEQ ID NO: 609506 - protein, 9 aa, Homo Sapiens
HYAHYAASA

SEQ ID NO: 609507 - protein, 9 aa, Homo Sapiens
SNSTQSRIT

SEQ ID NO: 609508 - protein, 9 aa, Homo Sapiens
MNKNDKQKR

SEQ ID NO: 609509 - protein, 9 aa, Homo Sapiens
DTDLTFFFE

SEQ ID NO: 609510 - protein, 9 aa, Homo Sapiens
KPASLAAQG

SEQ ID NO: 609511 - protein, 9 aa, Homo Sapiens
FEDVKVFGE

SEQ ID NO: 609512 - protein, 9 aa, Homo Sapiens
RRHPDTEHV

SEQ ID NO: 609513 - protein, 9 aa, Homo Sapiens
LSLKSNEKP

SEQ ID NO: 609514 - protein, 9 aa, Homo Sapiens
LPPSSSEMK

SEQ ID NO: 609515 - protein, 9 aa, Homo Sapiens
HILRRFQQI

SEQ ID NO: 609516 - protein, 9 aa, Homo Sapiens
KNDKQKRTA

SEQ ID NO: 609517 - protein, 9 aa, Homo Sapiens
VINHFYSAD

SEQ ID NO: 609518 - protein, 9 aa, Homo Sapiens
VSDSLEIQC

SEQ ID NO: 609519 - protein, 9 aa, Homo Sapiens
SEEQELCKQ

SEQ ID NO: 609520 - protein, 9 aa, Homo Sapiens
TVSAMPSKF

SEQ ID NO: 609521 - protein, 9 aa, Homo Sapiens
HLATLELLL

SEQ ID NO: 609522 - protein, 9 aa, Homo Sapiens
AVDWESFGY

SEQ ID NO: 609523 - protein, 9 aa, Homo Sapiens
VMFVNNHLS

SEQ ID NO: 609524 - protein, 9 aa, Homo Sapiens
LRTRLHLQT

SEQ ID NO: 609525 - protein, 9 aa, Homo Sapiens
VVYNAQRPN

SEQ ID NO: 609526 - protein, 9 aa, Homo Sapiens
RDILRYDST

SEQ ID NO: 609527 - protein, 9 aa, Homo Sapiens
VAGFFEVFC

SEQ ID NO: 609528 - protein, 9 aa, Homo Sapiens
VSLEKYNQH

SEQ ID NO: 609529 - protein, 9 aa, Homo Sapiens
GKELQSMSA

SEQ ID NO: 609530 - protein, 9 aa, Homo Sapiens
PAESQSVVF

SEQ ID NO: 609531 - protein, 9 aa, Homo Sapiens
PLTQYLKRI

SEQ ID NO: 609532 - protein, 9 aa, Homo Sapiens
VVGYSATTC

SEQ ID NO: 609533 - protein, 9 aa, Homo Sapiens
YAYPGILDQ

SEQ ID NO: 609534 - protein, 9 aa, Homo Sapiens
LVWLQACAA

SEQ ID NO: 609535 - protein, 9 aa, Homo Sapiens
AQVAAGGAQ

SEQ ID NO: 609536 - protein, 9 aa, Homo Sapiens
LLICSRVTV

SEQ ID NO: 609537 - protein, 9 aa, Homo Sapiens
EKKDVEKSR

SEQ ID NO: 609538 - protein, 9 aa, Homo Sapiens
VCYVPKLWF

SEQ ID NO: 609539 - protein, 9 aa, Homo Sapiens
EKGFTPLMW

SEQ ID NO: 609540 - protein, 9 aa, Homo Sapiens
KGAEKSDSS

SEQ ID NO: 609541 - protein, 9 aa, Homo Sapiens
TALHHIPPS

SEQ ID NO: 609542 - protein, 9 aa, Homo Sapiens
IVRGKDTPL

SEQ ID NO: 609543 - protein, 9 aa, Homo Sapiens
QKAFQLWSN

SEQ ID NO: 609544 - protein, 9 aa, Homo Sapiens
IVFQLQRLL

SEQ ID NO: 609545 - protein, 9 aa, Homo Sapiens
HSRGKRFSQ

SEQ ID NO: 609546 - protein, 9 aa, Homo Sapiens
NGYNELTGH

SEQ ID NO: 609547 - protein, 9 aa, Homo Sapiens
PKTPVAPKN

SEQ ID NO: 609548 - protein, 9 aa, Homo Sapiens
FSKQSPQNK

SEQ ID NO: 609549 - protein, 9 aa, Homo Sapiens
TAVPVAFQL

SEQ ID NO: 609550 - protein, 9 aa, Homo Sapiens
LLLWHEGCP

SEQ ID NO: 609551 - protein, 9 aa, Homo Sapiens
GCFELKEDT

SEQ ID NO: 609552 - protein, 9 aa, Homo Sapiens
YQHGIAVIR

SEQ ID NO: 609553 - protein, 9 aa, Homo Sapiens
GSRPQDAAV

SEQ ID NO: 609554 - protein, 9 aa, Homo Sapiens
RPNGSSGKA

SEQ ID NO: 609555 - protein, 9 aa, Homo Sapiens
YFQRLGRYN

SEQ ID NO: 609556 - protein, 9 aa, Homo Sapiens
VRGKDTPLN

SEQ ID NO: 609557 - protein, 9 aa, Homo Sapiens
CEECSIDEY

SEQ ID NO: 609558 - protein, 9 aa, Homo Sapiens
HAFIRCPSS

SEQ ID NO: 609559 - protein, 9 aa, Homo Sapiens
VTFCGKEAA

SEQ ID NO: 609560 - protein, 9 aa, Homo Sapiens
DCGIKFMET

SEQ ID NO: 609561 - protein, 9 aa, Homo Sapiens
KWSTFGSLE

SEQ ID NO: 609562 - protein, 9 aa, Homo Sapiens
DDMPIGTNV

SEQ ID NO: 609563 - protein, 9 aa, Homo Sapiens
VDTAGLLEI

SEQ ID NO: 609564 - protein, 9 aa, Homo Sapiens
NCIGHCNFR

SEQ ID NO: 609565 - protein, 9 aa, Homo Sapiens
LTKTYRIHR

SEQ ID NO: 609566 - protein, 9 aa, Homo Sapiens
RPGEPWLPG

SEQ ID NO: 609567 - protein, 9 aa, Homo Sapiens
MHTKINSNQ

SEQ ID NO: 609568 - protein, 9 aa, Homo Sapiens
EVSLEKYNQ

SEQ ID NO: 609569 - protein, 9 aa, Homo Sapiens
CLTKNILGF

SEQ ID NO: 609570 - protein, 9 aa, Homo Sapiens
AAPTPRPPR

SEQ ID NO: 609571 - protein, 9 aa, Homo Sapiens
QVGGSPGGP

SEQ ID NO: 609572 - protein, 9 aa, Homo Sapiens
PLALLDRPL

SEQ ID NO: 609573 - protein, 9 aa, Homo Sapiens
LQQSAVQKH

SEQ ID NO: 609574 - protein, 9 aa, Homo Sapiens
ALGHRHAAS

SEQ ID NO: 609575 - protein, 9 aa, Homo Sapiens
FQRLGRYNL

SEQ ID NO: 609576 - protein, 9 aa, Homo Sapiens
SHTRISKLV

SEQ ID NO: 609577 - protein, 9 aa, Homo Sapiens
FLRAGVFPE

SEQ ID NO: 609578 - protein, 9 aa, Homo Sapiens
LFVDVIMDN

SEQ ID NO: 609579 - protein, 9 aa, Homo Sapiens
LICSRVTVT

SEQ ID NO: 609580 - protein, 9 aa, Homo Sapiens
NHCWKERPG

SEQ ID NO: 609581 - protein, 9 aa, Homo Sapiens
EAAVAAVRL

SEQ ID NO: 609582 - protein, 9 aa, Homo Sapiens
GTITTQLSS

SEQ ID NO: 609583 - protein, 9 aa, Homo Sapiens
SLLVGEGHF

SEQ ID NO: 609584 - protein, 9 aa, Homo Sapiens
QELAALLEC

SEQ ID NO: 609585 - protein, 9 aa, Homo Sapiens
KASVHFVEP

SEQ ID NO: 609586 - protein, 9 aa, Homo Sapiens
LLEQACAVQ

SEQ ID NO: 609587 - protein, 9 aa, Homo Sapiens
SGGRERHRD

SEQ ID NO: 609588 - protein, 9 aa, Homo Sapiens
HRGPQPPPG

SEQ ID NO: 609589 - protein, 9 aa, Homo Sapiens
IFQQLQDSQ

SEQ ID NO: 609590 - protein, 9 aa, Homo Sapiens
ALASLNSYL

SEQ ID NO: 609591 - protein, 9 aa, Homo Sapiens
CEGSEAELS

SEQ ID NO: 609592 - protein, 9 aa, Homo Sapiens
RNFLYVVGG

SEQ ID NO: 609593 - protein, 9 aa, Homo Sapiens
SCEVFCKKI

SEQ ID NO: 609594 - protein, 9 aa, Homo Sapiens
KSIYKKRKS

SEQ ID NO: 609595 - protein, 9 aa, Homo Sapiens
CEPASCTMP

SEQ ID NO: 609596 - protein, 9 aa, Homo Sapiens
TLKISLIHI

SEQ ID NO: 609597 - protein, 9 aa, Homo Sapiens
GLNEFDSLK

SEQ ID NO: 609598 - protein, 9 aa, Homo Sapiens
LLKSEHEKT

SEQ ID NO: 609599 - protein, 9 aa, Homo Sapiens
VGFSRSLAK

SEQ ID NO: 609600 - protein, 9 aa, Homo Sapiens
LDHIKPVYG

SEQ ID NO: 609601 - protein, 9 aa, Homo Sapiens
ALPAAPRGG

SEQ ID NO: 609602 - protein, 9 aa, Homo Sapiens
KEYNISGII

SEQ ID NO: 609603 - protein, 9 aa, Homo Sapiens
PWWGGAMGW

SEQ ID NO: 609604 - protein, 9 aa, Homo Sapiens
QRLCTEIVA

SEQ ID NO: 609605 - protein, 9 aa, Homo Sapiens
KKSARSIFQ

SEQ ID NO: 609606 - protein, 9 aa, Homo Sapiens
LHSGTTYLF

SEQ ID NO: 609607 - protein, 9 aa, Homo Sapiens
AILNGTYGD

SEQ ID NO: 609608 - protein, 9 aa, Homo Sapiens
IMYGADLNM

SEQ ID NO: 609609 - protein, 9 aa, Homo Sapiens
PAPAQLRWH

SEQ ID NO: 609610 - protein, 9 aa, Homo Sapiens
GEGTITYLQ

SEQ ID NO: 609611 - protein, 9 aa, Homo Sapiens
CSRGEAQAA

SEQ ID NO: 609612 - protein, 9 aa, Homo Sapiens
MNIEVVKVL

SEQ ID NO: 609613 - protein, 9 aa, Homo Sapiens
TSPICLASP

SEQ ID NO: 609614 - protein, 9 aa, Homo Sapiens
DSCDYSIPS

SEQ ID NO: 609615 - protein, 9 aa, Homo Sapiens
LFRVMAQDY

SEQ ID NO: 609616 - protein, 9 aa, Homo Sapiens
QVTVDDPVR

SEQ ID NO: 609617 - protein, 9 aa, Homo Sapiens
DDETDNPRR

SEQ ID NO: 609618 - protein, 9 aa, Homo Sapiens
PLASCKTYV

SEQ ID NO: 609619 - protein, 9 aa, Homo Sapiens
IDYGWMYGT

SEQ ID NO: 609620 - protein, 9 aa, Homo Sapiens
LRDLGADPA

SEQ ID NO: 609621 - protein, 9 aa, Homo Sapiens
LEQLFLEHR

SEQ ID NO: 609622 - protein, 9 aa, Homo Sapiens
VLLEPPRGT

SEQ ID NO: 609623 - protein, 9 aa, Homo Sapiens
NLHSGTTYL

SEQ ID NO: 609624 - protein, 9 aa, Homo Sapiens
AQRVFESSK

SEQ ID NO: 609625 - protein, 9 aa, Homo Sapiens
ARTCSRESC

SEQ ID NO: 609626 - protein, 9 aa, Homo Sapiens
VAGNETENE

SEQ ID NO: 609627 - protein, 9 aa, Homo Sapiens
TTERKDEEG

SEQ ID NO: 609628 - protein, 9 aa, Homo Sapiens
ATTERKDEE

SEQ ID NO: 609629 - protein, 9 aa, Homo Sapiens
ASRFYLVAR

SEQ ID NO: 609630 - protein, 9 aa, Homo Sapiens
FGRPVVNGE

SEQ ID NO: 609631 - protein, 9 aa, Homo Sapiens
GNLSVDPNM

SEQ ID NO: 609632 - protein, 9 aa, Homo Sapiens
NHHHQSRGA

SEQ ID NO: 609633 - protein, 9 aa, Homo Sapiens
LSQEISHYS

SEQ ID NO: 609634 - protein, 9 aa, Homo Sapiens
AREKKDVEK

SEQ ID NO: 609635 - protein, 9 aa, Homo Sapiens
DKLKEAQTR

SEQ ID NO: 609636 - protein, 9 aa, Homo Sapiens
HIEVRDVPF

SEQ ID NO: 609637 - protein, 9 aa, Homo Sapiens
TEKVKIEVL

SEQ ID NO: 609638 - protein, 9 aa, Homo Sapiens
VHCAEPTYF

SEQ ID NO: 609639 - protein, 9 aa, Homo Sapiens
HRDPFPELP

SEQ ID NO: 609640 - protein, 9 aa, Homo Sapiens
YALGCSIAK

SEQ ID NO: 609641 - protein, 9 aa, Homo Sapiens
DMLTCYMFN

SEQ ID NO: 609642 - protein, 9 aa, Homo Sapiens
ADFLMQRRV

SEQ ID NO: 609643 - protein, 9 aa, Homo Sapiens
HYGITSPIC

SEQ ID NO: 609644 - protein, 9 aa, Homo Sapiens
SQISGPYLP

SEQ ID NO: 609645 - protein, 9 aa, Homo Sapiens
VKSRMMLVN

SEQ ID NO: 609646 - protein, 9 aa, Homo Sapiens
GTAIHPGTP

SEQ ID NO: 609647 - protein, 9 aa, Homo Sapiens
IIHMIEEYR

SEQ ID NO: 609648 - protein, 9 aa, Homo Sapiens
RLLSALPAA

SEQ ID NO: 609649 - protein, 9 aa, Homo Sapiens
VKKMPLTQY

SEQ ID NO: 609650 - protein, 9 aa, Homo Sapiens
VQQLWDTAG

SEQ ID NO: 609651 - protein, 9 aa, Homo Sapiens
TVFIWCCLN

SEQ ID NO: 609652 - protein, 9 aa, Homo Sapiens
KKRLSSGQN

SEQ ID NO: 609653 - protein, 9 aa, Homo Sapiens
EEAKRKQKN

SEQ ID NO: 609654 - protein, 9 aa, Homo Sapiens
LERPLPLNQ

SEQ ID NO: 609655 - protein, 9 aa, Homo Sapiens
AVLNKAAQI

SEQ ID NO: 609656 - protein, 9 aa, Homo Sapiens
VFRKNVFRK

SEQ ID NO: 609657 - protein, 9 aa, Homo Sapiens
RHEFRFPED

SEQ ID NO: 609658 - protein, 9 aa, Homo Sapiens
CLQGLCRQA

SEQ ID NO: 609659 - protein, 9 aa, Homo Sapiens
PGPQGNRGE

SEQ ID NO: 609660 - protein, 9 aa, Homo Sapiens
DDKMNCHIH

SEQ ID NO: 609661 - protein, 9 aa, Homo Sapiens
AALSQTGFS

SEQ ID NO: 609662 - protein, 9 aa, Homo Sapiens
HHSCSVNKW

SEQ ID NO: 609663 - protein, 9 aa, Homo Sapiens
LDVLQSPLQ

SEQ ID NO: 609664 - protein, 9 aa, Homo Sapiens
SDLPQDSKV

SEQ ID NO: 609665 - protein, 9 aa, Homo Sapiens
RNEECDPGA

SEQ ID NO: 609666 - protein, 9 aa, Homo Sapiens
PLSEITKQE

SEQ ID NO: 609667 - protein, 9 aa, Homo Sapiens
VYTVLGILL

SEQ ID NO: 609668 - protein, 9 aa, Homo Sapiens
KLYQCNECG

SEQ ID NO: 609669 - protein, 9 aa, Homo Sapiens
SLEKQMQRY

SEQ ID NO: 609670 - protein, 9 aa, Homo Sapiens
HFRNRVINT

SEQ ID NO: 609671 - protein, 9 aa, Homo Sapiens
PCSTVVRPC

SEQ ID NO: 609672 - protein, 9 aa, Homo Sapiens
KMPGEGRGD

SEQ ID NO: 609673 - protein, 9 aa, Homo Sapiens
PEIQGHFAS

SEQ ID NO: 609674 - protein, 9 aa, Homo Sapiens
RDPPEEEVP

SEQ ID NO: 609675 - protein, 9 aa, Homo Sapiens
KYKPWLVHV

SEQ ID NO: 609676 - protein, 9 aa, Homo Sapiens
QGNRGERGS

SEQ ID NO: 609677 - protein, 9 aa, Homo Sapiens
CGYGSCGYG

SEQ ID NO: 609678 - protein, 9 aa, Homo Sapiens
YSADPPLIK

SEQ ID NO: 609679 - protein, 9 aa, Homo Sapiens
HLGKELQSM

SEQ ID NO: 609680 - protein, 9 aa, Homo Sapiens
KISLIHIFR

SEQ ID NO: 609681 - protein, 9 aa, Homo Sapiens
DETDNPRRY

SEQ ID NO: 609682 - protein, 9 aa, Homo Sapiens
VSLEGRSTT

SEQ ID NO: 609683 - protein, 9 aa, Homo Sapiens
IKHCKMASK

SEQ ID NO: 609684 - protein, 9 aa, Homo Sapiens
SDGLYVPEY

SEQ ID NO: 609685 - protein, 9 aa, Homo Sapiens
TARRKIRRG

SEQ ID NO: 609686 - protein, 9 aa, Homo Sapiens
AKLCYDLDF

SEQ ID NO: 609687 - protein, 9 aa, Homo Sapiens
MEAIGKVSD

SEQ ID NO: 609688 - protein, 9 aa, Homo Sapiens
QRDDLQCFH

SEQ ID NO: 609689 - protein, 9 aa, Homo Sapiens
LSSLSNKYR

SEQ ID NO: 609690 - protein, 9 aa, Homo Sapiens
VPHELIPTK

SEQ ID NO: 609691 - protein, 9 aa, Homo Sapiens
LPSVNPMEE

SEQ ID NO: 609692 - protein, 9 aa, Homo Sapiens
QEMAAGFFN

SEQ ID NO: 609693 - protein, 9 aa, Homo Sapiens
SLSRGKSFL

SEQ ID NO: 609694 - protein, 9 aa, Homo Sapiens
ADDETDNPR

SEQ ID NO: 609695 - protein, 9 aa, Homo Sapiens
SGAGQGQWR

SEQ ID NO: 609696 - protein, 9 aa, Homo Sapiens
SPGRLAYRL

SEQ ID NO: 609697 - protein, 9 aa, Homo Sapiens
APKASCQAS

SEQ ID NO: 609698 - protein, 9 aa, Homo Sapiens
LPHSNGGNT

SEQ ID NO: 609699 - protein, 9 aa, Homo Sapiens
GFSGGWTAS

SEQ ID NO: 609700 - protein, 9 aa, Homo Sapiens
EKRGGETQP

SEQ ID NO: 609701 - protein, 9 aa, Homo Sapiens
LGYYRIVKG

SEQ ID NO: 609702 - protein, 9 aa, Homo Sapiens
FEHHKALDK

SEQ ID NO: 609703 - protein, 9 aa, Homo Sapiens
KRLIKMSHL

SEQ ID NO: 609704 - protein, 9 aa, Homo Sapiens
DFLYAYPGI

SEQ ID NO: 609705 - protein, 9 aa, Homo Sapiens
WNIVRNNIG

SEQ ID NO: 609706 - protein, 9 aa, Homo Sapiens
GEKGNPFTK

SEQ ID NO: 609707 - protein, 9 aa, Homo Sapiens
RMHTKINSN

SEQ ID NO: 609708 - protein, 9 aa, Homo Sapiens
VQAHRGPQP

SEQ ID NO: 609709 - protein, 9 aa, Homo Sapiens
VSPPLRNGY

SEQ ID NO: 609710 - protein, 9 aa, Homo Sapiens
LSFLHFLVL

SEQ ID NO: 609711 - protein, 9 aa, Homo Sapiens
VLQASGGSL

SEQ ID NO: 609712 - protein, 9 aa, Homo Sapiens
ELLLKSEHE

SEQ ID NO: 609713 - protein, 9 aa, Homo Sapiens
QLDHIKPVY

SEQ ID NO: 609714 - protein, 9 aa, Homo Sapiens
ATTEAAVHG

SEQ ID NO: 609715 - protein, 9 aa, Homo Sapiens
ATTEAAVHD

SEQ ID NO: 609716 - protein, 9 aa, Homo Sapiens
LSYEYRTLL

SEQ ID NO: 609717 - protein, 9 aa, Homo Sapiens
KSMNTMVPV

SEQ ID NO: 609718 - protein, 9 aa, Homo Sapiens
IQWALLMHG

SEQ ID NO: 609719 - protein, 9 aa, Homo Sapiens
MELKEYNIS

SEQ ID NO: 609720 - protein, 9 aa, Homo Sapiens
EGQIAYLKK

SEQ ID NO: 609721 - protein, 9 aa, Homo Sapiens
CHIHGPLVK

SEQ ID NO: 609722 - protein, 9 aa, Homo Sapiens
ASVRNFGNR

SEQ ID NO: 609723 - protein, 9 aa, Homo Sapiens
MQFMKGWRP

SEQ ID NO: 609724 - protein, 9 aa, Homo Sapiens
APRGGPGPS

SEQ ID NO: 609725 - protein, 9 aa, Homo Sapiens
CEQQVPYKC

SEQ ID NO: 609726 - protein, 9 aa, Homo Sapiens
NNDDKMNCH

SEQ ID NO: 609727 - protein, 9 aa, Homo Sapiens
DENECSLSP

SEQ ID NO: 609728 - protein, 9 aa, Homo Sapiens
FFYSPLLLF

SEQ ID NO: 609729 - protein, 9 aa, Homo Sapiens
KNLVFLRSR

SEQ ID NO: 609730 - protein, 9 aa, Homo Sapiens
CRAAAAGAW

SEQ ID NO: 609731 - protein, 9 aa, Homo Sapiens
DLEANLTSS

SEQ ID NO: 609732 - protein, 9 aa, Homo Sapiens
LYGCIHAIG

SEQ ID NO: 609733 - protein, 9 aa, Homo Sapiens
TIEGREPKL

SEQ ID NO: 609734 - protein, 9 aa, Homo Sapiens
GGCGYGSCG

SEQ ID NO: 609735 - protein, 9 aa, Homo Sapiens
EIFQQLQDS

SEQ ID NO: 609736 - protein, 9 aa, Homo Sapiens
IIASRFYLV

SEQ ID NO: 609737 - protein, 9 aa, Homo Sapiens
AGRDCSVCH

SEQ ID NO: 609738 - protein, 9 aa, Homo Sapiens
RDLTRRDTR

SEQ ID NO: 609739 - protein, 9 aa, Homo Sapiens
VPLFMPWER

SEQ ID NO: 609740 - protein, 9 aa, Homo Sapiens
DPMVSTEKS

SEQ ID NO: 609741 - protein, 9 aa, Homo Sapiens
KKQRAYLGG

SEQ ID NO: 609742 - protein, 9 aa, Homo Sapiens
RLVNYFMEE

SEQ ID NO: 609743 - protein, 9 aa, Homo Sapiens
KVSDDMRRH

SEQ ID NO: 609744 - protein, 9 aa, Homo Sapiens
ETKCSLLQQ

SEQ ID NO: 609745 - protein, 9 aa, Homo Sapiens
SSLLVGEGH

SEQ ID NO: 609746 - protein, 9 aa, Homo Sapiens
SSAELYYQD

SEQ ID NO: 609747 - protein, 9 aa, Homo Sapiens
LDLLSQSQS

SEQ ID NO: 609748 - protein, 9 aa, Homo Sapiens
CYGDRLTSG

SEQ ID NO: 609749 - protein, 9 aa, Homo Sapiens
QIDGEPWIQ

SEQ ID NO: 609750 - protein, 9 aa, Homo Sapiens
SLGSLTGPG

SEQ ID NO: 609751 - protein, 9 aa, Homo Sapiens
LPRSQRLLG

SEQ ID NO: 609752 - protein, 9 aa, Homo Sapiens
VQATALHHI

SEQ ID NO: 609753 - protein, 9 aa, Homo Sapiens
PGCMQGRTT

SEQ ID NO: 609754 - protein, 9 aa, Homo Sapiens
DEPRDTEAV

SEQ ID NO: 609755 - protein, 9 aa, Homo Sapiens
KRKNTRNIK

SEQ ID NO: 609756 - protein, 9 aa, Homo Sapiens
HRCFPSISL

SEQ ID NO: 609757 - protein, 9 aa, Homo Sapiens
AMLVFTLVL

SEQ ID NO: 609758 - protein, 9 aa, Homo Sapiens
AVQKHQQTF

SEQ ID NO: 609759 - protein, 9 aa, Homo Sapiens
PRPERRGRR

SEQ ID NO: 609760 - protein, 9 aa, Homo Sapiens
MDGQHLCFT

SEQ ID NO: 609761 - protein, 9 aa, Homo Sapiens
TYTCVAENI

SEQ ID NO: 609762 - protein, 9 aa, Homo Sapiens
TLPVFMELF

SEQ ID NO: 609763 - protein, 9 aa, Homo Sapiens
GSTPCVMQV

SEQ ID NO: 609764 - protein, 9 aa, Homo Sapiens
LASCKTYVL

SEQ ID NO: 609765 - protein, 9 aa, Homo Sapiens
YGNECANFT

SEQ ID NO: 609766 - protein, 9 aa, Homo Sapiens
SNYPDSDDD

SEQ ID NO: 609767 - protein, 9 aa, Homo Sapiens
LSQSQSRLS

SEQ ID NO: 609768 - protein, 9 aa, Homo Sapiens
QQQQVSAHQ

SEQ ID NO: 609769 - protein, 9 aa, Homo Sapiens
SPLLLFCYI

SEQ ID NO: 609770 - protein, 9 aa, Homo Sapiens
APHPQAPND

SEQ ID NO: 609771 - protein, 9 aa, Homo Sapiens
FKTRKEQYE

SEQ ID NO: 609772 - protein, 9 aa, Homo Sapiens
EIYNQKGVF

SEQ ID NO: 609773 - protein, 9 aa, Homo Sapiens
RVSWDLWST

SEQ ID NO: 609774 - protein, 9 aa, Homo Sapiens
LLDCYGDRL

SEQ ID NO: 609775 - protein, 9 aa, Homo Sapiens
DPGRPGEPW

SEQ ID NO: 609776 - protein, 9 aa, Homo Sapiens
HIASVWEAL

SEQ ID NO: 609777 - protein, 9 aa, Homo Sapiens
KSDYEEDVQ

SEQ ID NO: 609778 - protein, 9 aa, Homo Sapiens
IHTGEKLYQ

SEQ ID NO: 609779 - protein, 9 aa, Homo Sapiens
KQEKDFLWS

SEQ ID NO: 609780 - protein, 9 aa, Homo Sapiens
SITILALAG

SEQ ID NO: 609781 - protein, 9 aa, Homo Sapiens
KPWLVHVML

SEQ ID NO: 609782 - protein, 9 aa, Homo Sapiens
VHSAQSGQL

SEQ ID NO: 609783 - protein, 9 aa, Homo Sapiens
EMAAGFFNA

SEQ ID NO: 609784 - protein, 9 aa, Homo Sapiens
KHHMKHKKL

SEQ ID NO: 609785 - protein, 9 aa, Homo Sapiens
VLSEEIPEV

SEQ ID NO: 609786 - protein, 9 aa, Homo Sapiens
PKWVDGVDK

SEQ ID NO: 609787 - protein, 9 aa, Homo Sapiens
SEVCTSTVQ

SEQ ID NO: 609788 - protein, 9 aa, Homo Sapiens
CIIDGDDIH

SEQ ID NO: 609789 - protein, 9 aa, Homo Sapiens
TDNPRRYQK

SEQ ID NO: 609790 - protein, 9 aa, Homo Sapiens
PAPSPSPVL

SEQ ID NO: 609791 - protein, 9 aa, Homo Sapiens
QYLCYRNDK

SEQ ID NO: 609792 - protein, 9 aa, Homo Sapiens
SPKCKLLVL

SEQ ID NO: 609793 - protein, 9 aa, Homo Sapiens
AASHRCFPS

SEQ ID NO: 609794 - protein, 9 aa, Homo Sapiens
AKAGYDQNK

SEQ ID NO: 609795 - protein, 9 aa, Homo Sapiens
LSALPAAPR

SEQ ID NO: 609796 - protein, 9 aa, Homo Sapiens
QCKDKGNFS

SEQ ID NO: 609797 - protein, 9 aa, Homo Sapiens
FLPGGLEFW

SEQ ID NO: 609798 - protein, 9 aa, Homo Sapiens
FYSPLLLFC

SEQ ID NO: 609799 - protein, 9 aa, Homo Sapiens
SRVESSMRK

SEQ ID NO: 609800 - protein, 9 aa, Homo Sapiens
TEVQVDDVK

SEQ ID NO: 609801 - protein, 9 aa, Homo Sapiens
KRRKRKNTR

SEQ ID NO: 609802 - protein, 9 aa, Homo Sapiens
AAPASAPAE

SEQ ID NO: 609803 - protein, 9 aa, Homo Sapiens
RPPSSTNNM

SEQ ID NO: 609804 - protein, 9 aa, Homo Sapiens
RADAQSLLS

SEQ ID NO: 609805 - protein, 9 aa, Homo Sapiens
EKLWRVTAV

SEQ ID NO: 609806 - protein, 9 aa, Homo Sapiens
QEQLGPEDQ

SEQ ID NO: 609807 - protein, 9 aa, Homo Sapiens
VAKNESKLP

SEQ ID NO: 609808 - protein, 9 aa, Homo Sapiens
DFLDKHHMK

SEQ ID NO: 609809 - protein, 9 aa, Homo Sapiens
SIFQEIAQE

SEQ ID NO: 609810 - protein, 9 aa, Homo Sapiens
RERHLDQIM

SEQ ID NO: 609811 - protein, 9 aa, Homo Sapiens
RLRSEYVRK

SEQ ID NO: 609812 - protein, 9 aa, Homo Sapiens
LDICHSLYY

SEQ ID NO: 609813 - protein, 9 aa, Homo Sapiens
FNAGSQGLG

SEQ ID NO: 609814 - protein, 9 aa, Homo Sapiens
RTCSRESCA

SEQ ID NO: 609815 - protein, 9 aa, Homo Sapiens
SFGHQQLQN

SEQ ID NO: 609816 - protein, 9 aa, Homo Sapiens
IRTPMLNPL

SEQ ID NO: 609817 - protein, 9 aa, Homo Sapiens
NGSPVSFPI

SEQ ID NO: 609818 - protein, 9 aa, Homo Sapiens
PAQQGCYAE

SEQ ID NO: 609819 - protein, 9 aa, Homo Sapiens
SRSPLSPEL

SEQ ID NO: 609820 - protein, 9 aa, Homo Sapiens
ILFFGEGTI

SEQ ID NO: 609821 - protein, 9 aa, Homo Sapiens
VCRRCRQRL

SEQ ID NO: 609822 - protein, 9 aa, Homo Sapiens
TTATTEAAV

SEQ ID NO: 609823 - protein, 9 aa, Homo Sapiens
APVFDRTLC

SEQ ID NO: 609824 - protein, 9 aa, Homo Sapiens
LHRLALSSG

SEQ ID NO: 609825 - protein, 9 aa, Homo Sapiens
RGGETQPEG

SEQ ID NO: 609826 - protein, 9 aa, Homo Sapiens
TVVSPKNTT

SEQ ID NO: 609827 - protein, 9 aa, Homo Sapiens
YDGRDSLST

SEQ ID NO: 609828 - protein, 9 aa, Homo Sapiens
TVEGQGPRS

SEQ ID NO: 609829 - protein, 9 aa, Homo Sapiens
IEEVVPQFL

SEQ ID NO: 609830 - protein, 9 aa, Homo Sapiens
NIYPGANPT

SEQ ID NO: 609831 - protein, 9 aa, Homo Sapiens
GAAWRPEAA

SEQ ID NO: 609832 - protein, 9 aa, Homo Sapiens
VSSVRCIQP

SEQ ID NO: 609833 - protein, 9 aa, Homo Sapiens
INEAGSGRC

SEQ ID NO: 609834 - protein, 9 aa, Homo Sapiens
LICWQYTIE

SEQ ID NO: 609835 - protein, 9 aa, Homo Sapiens
TYTLTRLNQ

SEQ ID NO: 609836 - protein, 9 aa, Homo Sapiens
WDGPEQERD

SEQ ID NO: 609837 - protein, 9 aa, Homo Sapiens
PVDMETINV

SEQ ID NO: 609838 - protein, 9 aa, Homo Sapiens
VLLSVGAGV

SEQ ID NO: 609839 - protein, 9 aa, Homo Sapiens
KVFEKMNQT

SEQ ID NO: 609840 - protein, 9 aa, Homo Sapiens
EKLALDCGI

SEQ ID NO: 609841 - protein, 9 aa, Homo Sapiens
VMEAIGKVS

SEQ ID NO: 609842 - protein, 9 aa, Homo Sapiens
KLLRHFLVQ

SEQ ID NO: 609843 - protein, 9 aa, Homo Sapiens
AGQGQWRAS

SEQ ID NO: 609844 - protein, 9 aa, Homo Sapiens
FVTFCGKEA

SEQ ID NO: 609845 - protein, 9 aa, Homo Sapiens
LMRERHLDQ

SEQ ID NO: 609846 - protein, 9 aa, Homo Sapiens
DVKEEDKSN

SEQ ID NO: 609847 - protein, 9 aa, Homo Sapiens
LDSLWCSPF

SEQ ID NO: 609848 - protein, 9 aa, Homo Sapiens
FQVVPMLNP

SEQ ID NO: 609849 - protein, 9 aa, Homo Sapiens
DPVRKPVVQ

SEQ ID NO: 609850 - protein, 9 aa, Homo Sapiens
SAIGAPHLH

SEQ ID NO: 609851 - protein, 9 aa, Homo Sapiens
SATTCQQEG

SEQ ID NO: 609852 - protein, 9 aa, Homo Sapiens
SPKNTTESF

SEQ ID NO: 609853 - protein, 9 aa, Homo Sapiens
LWNIVRNNI

SEQ ID NO: 609854 - protein, 9 aa, Homo Sapiens
CYLDVDKDI

SEQ ID NO: 609855 - protein, 9 aa, Homo Sapiens
KAVQEIQAT

SEQ ID NO: 609856 - protein, 9 aa, Homo Sapiens
CMVAHACNP

SEQ ID NO: 609857 - protein, 9 aa, Homo Sapiens
ALVPACLVS

SEQ ID NO: 609858 - protein, 9 aa, Homo Sapiens
SVFYTIRTP

SEQ ID NO: 609859 - protein, 9 aa, Homo Sapiens
GLRSEHRRK

SEQ ID NO: 609860 - protein, 9 aa, Homo Sapiens
TPLLNHLIY

SEQ ID NO: 609861 - protein, 9 aa, Homo Sapiens
NPIRAVPLA

SEQ ID NO: 609862 - protein, 9 aa, Homo Sapiens
KSDQLEKLR

SEQ ID NO: 609863 - protein, 9 aa, Homo Sapiens
GEPWLPGAR

SEQ ID NO: 609864 - protein, 9 aa, Homo Sapiens
HSAQSGQLF

SEQ ID NO: 609865 - protein, 9 aa, Homo Sapiens
YCKSNNGRW

SEQ ID NO: 609866 - protein, 9 aa, Homo Sapiens
LKKIKQEVN

SEQ ID NO: 609867 - protein, 9 aa, Homo Sapiens
LMLLQLDLE

SEQ ID NO: 609868 - protein, 9 aa, Homo Sapiens
AGAWSPTRG

SEQ ID NO: 609869 - protein, 9 aa, Homo Sapiens
LVLSSNQNL

SEQ ID NO: 609870 - protein, 9 aa, Homo Sapiens
TMPAGQRAF

SEQ ID NO: 609871 - protein, 9 aa, Homo Sapiens
SALPAFNAK

SEQ ID NO: 609872 - protein, 9 aa, Homo Sapiens
HSHYAHYAA

SEQ ID NO: 609873 - protein, 9 aa, Homo Sapiens
WIQTPCTIK

SEQ ID NO: 609874 - protein, 9 aa, Homo Sapiens
VRKRMQDLE

SEQ ID NO: 609875 - protein, 9 aa, Homo Sapiens
SGSSEYSFV

SEQ ID NO: 609876 - protein, 9 aa, Homo Sapiens
SYLEMDMEG

SEQ ID NO: 609877 - protein, 9 aa, Homo Sapiens
GEATKPSPS

SEQ ID NO: 609878 - protein, 9 aa, Homo Sapiens
VALKKQRAY

SEQ ID NO: 609879 - protein, 9 aa, Homo Sapiens
KIVVPVTFR

SEQ ID NO: 609880 - protein, 9 aa, Homo Sapiens
QEIYNQKGV

SEQ ID NO: 609881 - protein, 9 aa, Homo Sapiens
LGSRIEEVV

SEQ ID NO: 609882 - protein, 9 aa, Homo Sapiens
LDLFILRLA

SEQ ID NO: 609883 - protein, 9 aa, Homo Sapiens
DLNMKNCAG

SEQ ID NO: 609884 - protein, 9 aa, Homo Sapiens
PGNLSVDPN

SEQ ID NO: 609885 - protein, 9 aa, Homo Sapiens
SGGLRGLPP

SEQ ID NO: 609886 - protein, 9 aa, Homo Sapiens
SLSTLIGSF

SEQ ID NO: 609887 - protein, 9 aa, Homo Sapiens
NLAHTVDTW

SEQ ID NO: 609888 - protein, 9 aa, Homo Sapiens
LLEARPEAT

SEQ ID NO: 609889 - protein, 9 aa, Homo Sapiens
RSRSPLSPE

SEQ ID NO: 609890 - protein, 9 aa, Homo Sapiens
STVRCFKGL

SEQ ID NO: 609891 - protein, 9 aa, Homo Sapiens
EPCSRQSWR

SEQ ID NO: 609892 - protein, 9 aa, Homo Sapiens
ISDFLDKHH

SEQ ID NO: 609893 - protein, 9 aa, Homo Sapiens
ASPSLQHNT

SEQ ID NO: 609894 - protein, 9 aa, Homo Sapiens
VVQMNLEIA

SEQ ID NO: 609895 - protein, 9 aa, Homo Sapiens
GAYDFLPVL

SEQ ID NO: 609896 - protein, 9 aa, Homo Sapiens
SLVCLLICS

SEQ ID NO: 609897 - protein, 9 aa, Homo Sapiens
APPGGGSGC

SEQ ID NO: 609898 - protein, 9 aa, Homo Sapiens
SLVTAERIE

SEQ ID NO: 609899 - protein, 9 aa, Homo Sapiens
KRKQKNSTG

SEQ ID NO: 609900 - protein, 9 aa, Homo Sapiens
LAHTVDTWP

SEQ ID NO: 609901 - protein, 9 aa, Homo Sapiens
RRYVSAVFR

SEQ ID NO: 609902 - protein, 9 aa, Homo Sapiens
LGLQPATEY

SEQ ID NO: 609903 - protein, 9 aa, Homo Sapiens
NKYRQDAKY

SEQ ID NO: 609904 - protein, 9 aa, Homo Sapiens
TQYLKRIKL

SEQ ID NO: 609905 - protein, 9 aa, Homo Sapiens
TASPSLQHN

SEQ ID NO: 609906 - protein, 9 aa, Homo Sapiens
QMQRYQEPC

SEQ ID NO: 609907 - protein, 9 aa, Homo Sapiens
RGKSFLSRA

SEQ ID NO: 609908 - protein, 9 aa, Homo Sapiens
QDLKGDYTA

SEQ ID NO: 609909 - protein, 9 aa, Homo Sapiens
ETTKCAYSL

SEQ ID NO: 609910 - protein, 9 aa, Homo Sapiens
IAVIRNFLY

SEQ ID NO: 609911 - protein, 9 aa, Homo Sapiens
QFAYTGCFE

SEQ ID NO: 609912 - protein, 9 aa, Homo Sapiens
CQDGEARSQ

SEQ ID NO: 609913 - protein, 9 aa, Homo Sapiens
LDLCRNVKE

SEQ ID NO: 609914 - protein, 9 aa, Homo Sapiens
IRLDPWECY

SEQ ID NO: 609915 - protein, 9 aa, Homo Sapiens
PDTRIRACF

SEQ ID NO: 609916 - protein, 9 aa, Homo Sapiens
QDPMVSTEK

SEQ ID NO: 609917 - protein, 9 aa, Homo Sapiens
DPLSEITKQ

SEQ ID NO: 609918 - protein, 9 aa, Homo Sapiens
FHFNIMKPY

SEQ ID NO: 609919 - protein, 9 aa, Homo Sapiens
ASCQASAGA

SEQ ID NO: 609920 - protein, 9 aa, Homo Sapiens
TGMQVSSVR

SEQ ID NO: 609921 - protein, 9 aa, Homo Sapiens
VPSSWKVEF

SEQ ID NO: 609922 - protein, 9 aa, Homo Sapiens
RPERRGRRP

SEQ ID NO: 609923 - protein, 9 aa, Homo Sapiens
PLHLPDPKY

SEQ ID NO: 609924 - protein, 9 aa, Homo Sapiens
SLSLLTNFE

SEQ ID NO: 609925 - protein, 9 aa, Homo Sapiens
QERDWSQQE

SEQ ID NO: 609926 - protein, 9 aa, Homo Sapiens
RQRPQKPAS

SEQ ID NO: 609927 - protein, 9 aa, Homo Sapiens
YSKACISIG

SEQ ID NO: 609928 - protein, 9 aa, Homo Sapiens
NLQLINQET

SEQ ID NO: 609929 - protein, 9 aa, Homo Sapiens
SCERPWEGP

SEQ ID NO: 609930 - protein, 9 aa, Homo Sapiens
SRFLNPLSI

SEQ ID NO: 609931 - protein, 9 aa, Homo Sapiens
DKHHMKHKK

SEQ ID NO: 609932 - protein, 9 aa, Homo Sapiens
AWSPTRGPS

SEQ ID NO: 609933 - protein, 9 aa, Homo Sapiens
RTHKSQEGT

SEQ ID NO: 609934 - protein, 9 aa, Homo Sapiens
AFLDLFILR

SEQ ID NO: 609935 - protein, 9 aa, Homo Sapiens
LSRGLLYGC

SEQ ID NO: 609936 - protein, 9 aa, Homo Sapiens
YIGCTVFIW

SEQ ID NO: 609937 - protein, 9 aa, Homo Sapiens
ACLVSTALC

SEQ ID NO: 609938 - protein, 9 aa, Homo Sapiens
EQQVPYKCP

SEQ ID NO: 609939 - protein, 9 aa, Homo Sapiens
LIKMSHLKP

SEQ ID NO: 609940 - protein, 9 aa, Homo Sapiens
IGKVSDDMR

SEQ ID NO: 609941 - protein, 9 aa, Homo Sapiens
VGGSPGGPG

SEQ ID NO: 609942 - protein, 9 aa, Homo Sapiens
VFSNLHSGT

SEQ ID NO: 609943 - protein, 9 aa, Homo Sapiens
RQAAERARR

SEQ ID NO: 609944 - protein, 9 aa, Homo Sapiens
RRPWGFSGG

SEQ ID NO: 609945 - protein, 9 aa, Homo Sapiens
MESIQELTV

SEQ ID NO: 609946 - protein, 9 aa, Homo Sapiens
VCLGVSVTV

SEQ ID NO: 609947 - protein, 9 aa, Homo Sapiens
RMEDCLQLP

SEQ ID NO: 609948 - protein, 9 aa, Homo Sapiens
NAFSAYFNI

SEQ ID NO: 609949 - protein, 9 aa, Homo Sapiens
FHFVGGAMV

SEQ ID NO: 609950 - protein, 9 aa, Homo Sapiens
CKMCESRHK

SEQ ID NO: 609951 - protein, 9 aa, Homo Sapiens
SWRSPSGAR

SEQ ID NO: 609952 - protein, 9 aa, Homo Sapiens
WAGMAAIKV

SEQ ID NO: 609953 - protein, 9 aa, Homo Sapiens
KLCSSLHPH

SEQ ID NO: 609954 - protein, 9 aa, Homo Sapiens
SPPLRNGYF

SEQ ID NO: 609955 - protein, 9 aa, Homo Sapiens
VDDPVRKPV

SEQ ID NO: 609956 - protein, 9 aa, Homo Sapiens
NPFTKLEEN

SEQ ID NO: 609957 - protein, 9 aa, Homo Sapiens
GCYECGKDF

SEQ ID NO: 609958 - protein, 9 aa, Homo Sapiens
QRPQNEARS

SEQ ID NO: 609959 - protein, 9 aa, Homo Sapiens
PFDKLSRTF

SEQ ID NO: 609960 - protein, 9 aa, Homo Sapiens
NDIKLPDCE

SEQ ID NO: 609961 - protein, 9 aa, Homo Sapiens
IGQNSGLVS

SEQ ID NO: 609962 - protein, 9 aa, Homo Sapiens
FPYFQRLGR

SEQ ID NO: 609963 - protein, 9 aa, Homo Sapiens
DWQIDCSTL

SEQ ID NO: 609964 - protein, 9 aa, Homo Sapiens
SPRVLLRDS

SEQ ID NO: 609965 - protein, 9 aa, Homo Sapiens
RLLYHMQNT

SEQ ID NO: 609966 - protein, 9 aa, Homo Sapiens
PGRLLYHMQ

SEQ ID NO: 609967 - protein, 9 aa, Homo Sapiens
MVLVLEKGW

SEQ ID NO: 609968 - protein, 9 aa, Homo Sapiens
LYQDDLENP

SEQ ID NO: 609969 - protein, 9 aa, Homo Sapiens
QDSKVLQYY

SEQ ID NO: 609970 - protein, 9 aa, Homo Sapiens
KVPWDWQID

SEQ ID NO: 609971 - protein, 9 aa, Homo Sapiens
FRVWRISDV

SEQ ID NO: 609972 - protein, 9 aa, Homo Sapiens
EVESFILYQ

SEQ ID NO: 609973 - protein, 9 aa, Homo Sapiens
TMAGQCKDK

SEQ ID NO: 609974 - protein, 9 aa, Homo Sapiens
SVRNFGNRD

SEQ ID NO: 609975 - protein, 9 aa, Homo Sapiens
LLTIISSDL

SEQ ID NO: 609976 - protein, 9 aa, Homo Sapiens
RCISRPSSG

SEQ ID NO: 609977 - protein, 9 aa, Homo Sapiens
HNGDFCYLD

SEQ ID NO: 609978 - protein, 9 aa, Homo Sapiens
WDRVLDLCR

SEQ ID NO: 609979 - protein, 9 aa, Homo Sapiens
CYFCRTVCS

SEQ ID NO: 609980 - protein, 9 aa, Homo Sapiens
FSTCYSHLL

SEQ ID NO: 609981 - protein, 9 aa, Homo Sapiens
RAAAEAALS

SEQ ID NO: 609982 - protein, 9 aa, Homo Sapiens
SMLHVLPST

SEQ ID NO: 609983 - protein, 9 aa, Homo Sapiens
SNPSGAPII

SEQ ID NO: 609984 - protein, 9 aa, Homo Sapiens
NTRSSHLTR

SEQ ID NO: 609985 - protein, 9 aa, Homo Sapiens
LDCYGDRLT

SEQ ID NO: 609986 - protein, 9 aa, Homo Sapiens
HCNRYLTRR

SEQ ID NO: 609987 - protein, 9 aa, Homo Sapiens
ESQSVVFGD

SEQ ID NO: 609988 - protein, 9 aa, Homo Sapiens
TLKQLENLK

SEQ ID NO: 609989 - protein, 9 aa, Homo Sapiens
QKVDVYDEV

SEQ ID NO: 609990 - protein, 9 aa, Homo Sapiens
RSSASAIHT

SEQ ID NO: 609991 - protein, 9 aa, Homo Sapiens
FGSLEVMPQ

SEQ ID NO: 609992 - protein, 9 aa, Homo Sapiens
RLEQKLGEK

SEQ ID NO: 609993 - protein, 9 aa, Homo Sapiens
EVEKRQGIS

SEQ ID NO: 609994 - protein, 9 aa, Homo Sapiens
DCLQLPDDY

SEQ ID NO: 609995 - protein, 9 aa, Homo Sapiens
TFVKKRALS

SEQ ID NO: 609996 - protein, 9 aa, Homo Sapiens
TVAVPAQQK

SEQ ID NO: 609997 - protein, 9 aa, Homo Sapiens
ADQLCGELE

SEQ ID NO: 609998 - protein, 9 aa, Homo Sapiens
YYECPGTCL

SEQ ID NO: 609999 - protein, 9 aa, Homo Sapiens
LYAYPGILD

SEQ ID NO: 610000 - protein, 9 aa, Homo Sapiens
VVAILGSVG

SEQ ID NO: 610001 - protein, 9 aa, Homo Sapiens
SFVSHYIFQ

SEQ ID NO: 610002 - protein, 9 aa, Homo Sapiens
NMEIDAFVL

SEQ ID NO: 610003 - protein, 9 aa, Homo Sapiens
HHIPPSAQA

SEQ ID NO: 610004 - protein, 9 aa, Homo Sapiens
KRKGLYVEV

SEQ ID NO: 610005 - protein, 9 aa, Homo Sapiens
AQTRAEFAE

SEQ ID NO: 610006 - protein, 9 aa, Homo Sapiens
KALAWQRCR

SEQ ID NO: 610007 - protein, 9 aa, Homo Sapiens
LWVEEGVAG

SEQ ID NO: 610008 - protein, 9 aa, Homo Sapiens
TGHLTVAEF

SEQ ID NO: 610009 - protein, 9 aa, Homo Sapiens
VLIVHVDSG

SEQ ID NO: 610010 - protein, 9 aa, Homo Sapiens
GEDFGPGKG

SEQ ID NO: 610011 - protein, 9 aa, Homo Sapiens
SGSNTGFRD

SEQ ID NO: 610012 - protein, 9 aa, Homo Sapiens
QGISPALVQ

SEQ ID NO: 610013 - protein, 9 aa, Homo Sapiens
KSVLYSWTT

SEQ ID NO: 610014 - protein, 9 aa, Homo Sapiens
VTVEGQGPR

SEQ ID NO: 610015 - protein, 9 aa, Homo Sapiens
FINEGLIAA

SEQ ID NO: 610016 - protein, 9 aa, Homo Sapiens
YDRHKVMLK

SEQ ID NO: 610017 - protein, 9 aa, Homo Sapiens
AYTGCFELK

SEQ ID NO: 610018 - protein, 9 aa, Homo Sapiens
ARRHPDTEH

SEQ ID NO: 610019 - protein, 9 aa, Homo Sapiens
AVVQVGIAG

SEQ ID NO: 610020 - protein, 9 aa, Homo Sapiens
RACFVRFRN

SEQ ID NO: 610021 - protein, 9 aa, Homo Sapiens
ELKSRKNDE

SEQ ID NO: 610022 - protein, 9 aa, Homo Sapiens
IDKKPYEKN

SEQ ID NO: 610023 - protein, 9 aa, Homo Sapiens
EGHLYPPCS

SEQ ID NO: 610024 - protein, 9 aa, Homo Sapiens
YECPGTCLG

SEQ ID NO: 610025 - protein, 9 aa, Homo Sapiens
TTREPHASE

SEQ ID NO: 610026 - protein, 9 aa, Homo Sapiens
ILGNYRSFL

SEQ ID NO: 610027 - protein, 9 aa, Homo Sapiens
LGKELQSMS

SEQ ID NO: 610028 - protein, 9 aa, Homo Sapiens
GEKKRPATI

SEQ ID NO: 610029 - protein, 9 aa, Homo Sapiens
CYRETCLYI

SEQ ID NO: 610030 - protein, 9 aa, Homo Sapiens
SPQNKNHLV

SEQ ID NO: 610031 - protein, 9 aa, Homo Sapiens
EKLYQCNEC

SEQ ID NO: 610032 - protein, 9 aa, Homo Sapiens
NWDATPFVK

SEQ ID NO: 610033 - protein, 9 aa, Homo Sapiens
ATKPSPSPE

SEQ ID NO: 610034 - protein, 9 aa, Homo Sapiens
HGVLSQEIS

SEQ ID NO: 610035 - protein, 9 aa, Homo Sapiens
REAFFSKTN

SEQ ID NO: 610036 - protein, 9 aa, Homo Sapiens
FPYEDIKTL

SEQ ID NO: 610037 - protein, 9 aa, Homo Sapiens
QDAGWLLGV

SEQ ID NO: 610038 - protein, 9 aa, Homo Sapiens
RGNSDGYLI

SEQ ID NO: 610039 - protein, 9 aa, Homo Sapiens
PHSQTRREE

SEQ ID NO: 610040 - protein, 9 aa, Homo Sapiens
IVQAASDEE

SEQ ID NO: 610041 - protein, 9 aa, Homo Sapiens
PDPRALPST

SEQ ID NO: 610042 - protein, 9 aa, Homo Sapiens
LAALLECLT

SEQ ID NO: 610043 - protein, 9 aa, Homo Sapiens
LKEYNISGI

SEQ ID NO: 610044 - protein, 9 aa, Homo Sapiens
HQFRERFRR

SEQ ID NO: 610045 - protein, 9 aa, Homo Sapiens
SKVLQYYFN

SEQ ID NO: 610046 - protein, 9 aa, Homo Sapiens
RMKIQDDLQ

SEQ ID NO: 610047 - protein, 9 aa, Homo Sapiens
PGLPVEVPM

SEQ ID NO: 610048 - protein, 9 aa, Homo Sapiens
CGLALVALV

SEQ ID NO: 610049 - protein, 9 aa, Homo Sapiens
TTVEGQDAD

SEQ ID NO: 610050 - protein, 9 aa, Homo Sapiens
EEQGGLSGS

SEQ ID NO: 610051 - protein, 9 aa, Homo Sapiens
GHQQLQNRD

SEQ ID NO: 610052 - protein, 9 aa, Homo Sapiens
NHSLGNYGL

SEQ ID NO: 610053 - protein, 9 aa, Homo Sapiens
RHTEDVAEV

SEQ ID NO: 610054 - protein, 9 aa, Homo Sapiens
VRGVSDGRL

SEQ ID NO: 610055 - protein, 9 aa, Homo Sapiens
EEHFEDYCE

SEQ ID NO: 610056 - protein, 9 aa, Homo Sapiens
GRLLSALPA

SEQ ID NO: 610057 - protein, 9 aa, Homo Sapiens
INEGLIAAD

SEQ ID NO: 610058 - protein, 9 aa, Homo Sapiens
VVLRGALRG

SEQ ID NO: 610059 - protein, 9 aa, Homo Sapiens
VDVYDEVSY

SEQ ID NO: 610060 - protein, 9 aa, Homo Sapiens
NLNWASLNL

SEQ ID NO: 610061 - protein, 9 aa, Homo Sapiens
PMWLAINLK

SEQ ID NO: 610062 - protein, 9 aa, Homo Sapiens
YGLFQTATS

SEQ ID NO: 610063 - protein, 9 aa, Homo Sapiens
DLYSKACIS

SEQ ID NO: 610064 - protein, 9 aa, Homo Sapiens
IASLTGTTN

SEQ ID NO: 610065 - protein, 9 aa, Homo Sapiens
DTPACMVTL

SEQ ID NO: 610066 - protein, 9 aa, Homo Sapiens
EAWAQGTAR

SEQ ID NO: 610067 - protein, 9 aa, Homo Sapiens
GVFALPLLG

SEQ ID NO: 610068 - protein, 9 aa, Homo Sapiens
GHFWQLDHI

SEQ ID NO: 610069 - protein, 9 aa, Homo Sapiens
TKLVYGNEC

SEQ ID NO: 610070 - protein, 9 aa, Homo Sapiens
TVELDVSYE

SEQ ID NO: 610071 - protein, 9 aa, Homo Sapiens
FLFISANAL

SEQ ID NO: 610072 - protein, 9 aa, Homo Sapiens
FFHVTVQIQ

SEQ ID NO: 610073 - protein, 9 aa, Homo Sapiens
ISGQPMGSQ

SEQ ID NO: 610074 - protein, 9 aa, Homo Sapiens
LTCKRIMDM

SEQ ID NO: 610075 - protein, 9 aa, Homo Sapiens
GQWRASALG

SEQ ID NO: 610076 - protein, 9 aa, Homo Sapiens
PLSEQVPQP

SEQ ID NO: 610077 - protein, 9 aa, Homo Sapiens
QSWLPIWGS

SEQ ID NO: 610078 - protein, 9 aa, Homo Sapiens
DEVEKRQGI

SEQ ID NO: 610079 - protein, 9 aa, Homo Sapiens
GKKYIGPCA

SEQ ID NO: 610080 - protein, 9 aa, Homo Sapiens
SRGKSFLSR

SEQ ID NO: 610081 - protein, 9 aa, Homo Sapiens
EGTEQQRLA

SEQ ID NO: 610082 - protein, 9 aa, Homo Sapiens
YFMEEFRRK

SEQ ID NO: 610083 - protein, 9 aa, Homo Sapiens
YEIIHMIEE

SEQ ID NO: 610084 - protein, 9 aa, Homo Sapiens
LFSWLPSHN

SEQ ID NO: 610085 - protein, 9 aa, Homo Sapiens
FIVRMAFFQ

SEQ ID NO: 610086 - protein, 9 aa, Homo Sapiens
FVPLFMPWE

SEQ ID NO: 610087 - protein, 9 aa, Homo Sapiens
HKSRVLQAS

SEQ ID NO: 610088 - protein, 9 aa, Homo Sapiens
EDPDKANQR

SEQ ID NO: 610089 - protein, 9 aa, Homo Sapiens
RQEIRESHR

SEQ ID NO: 610090 - protein, 9 aa, Homo Sapiens
FSHLPCPVE

SEQ ID NO: 610091 - protein, 9 aa, Homo Sapiens
AERARRGQA

SEQ ID NO: 610092 - protein, 9 aa, Homo Sapiens
RAVAGSVNV

SEQ ID NO: 610093 - protein, 9 aa, Homo Sapiens
KRQGISPAL

SEQ ID NO: 610094 - protein, 9 aa, Homo Sapiens
SCGHGNAGQ

SEQ ID NO: 610095 - protein, 9 aa, Homo Sapiens
LPVFMELFS

SEQ ID NO: 610096 - protein, 9 aa, Homo Sapiens
GMAGTFALG

SEQ ID NO: 610097 - protein, 9 aa, Homo Sapiens
SRMEDCLQL

SEQ ID NO: 610098 - protein, 9 aa, Homo Sapiens
TEPPKVSLE

SEQ ID NO: 610099 - protein, 9 aa, Homo Sapiens
EIQCLVAGA

SEQ ID NO: 610100 - protein, 9 aa, Homo Sapiens
LIPINKEGC

SEQ ID NO: 610101 - protein, 9 aa, Homo Sapiens
FRKNVFRKN

SEQ ID NO: 610102 - protein, 9 aa, Homo Sapiens
LARTCSRES

SEQ ID NO: 610103 - protein, 9 aa, Homo Sapiens
NKNDKQKRT

SEQ ID NO: 610104 - protein, 9 aa, Homo Sapiens
DDVKRVYSL

SEQ ID NO: 610105 - protein, 9 aa, Homo Sapiens
RRSYVFKTR

SEQ ID NO: 610106 - protein, 9 aa, Homo Sapiens
AIHPGTPEW

SEQ ID NO: 610107 - protein, 9 aa, Homo Sapiens
VKSMNTMVP

SEQ ID NO: 610108 - protein, 9 aa, Homo Sapiens
RLIKIASRE

SEQ ID NO: 610109 - protein, 9 aa, Homo Sapiens
PLLALSCSH

SEQ ID NO: 610110 - protein, 9 aa, Homo Sapiens
CLGVNLKEV

SEQ ID NO: 610111 - protein, 9 aa, Homo Sapiens
LDVSPRRLS

SEQ ID NO: 610112 - protein, 9 aa, Homo Sapiens
QERSTLWDQ

SEQ ID NO: 610113 - protein, 9 aa, Homo Sapiens
LGLSSDDAY

SEQ ID NO: 610114 - protein, 9 aa, Homo Sapiens
EREAKEIFQ

SEQ ID NO: 610115 - protein, 9 aa, Homo Sapiens
LRLYLLTLA

SEQ ID NO: 610116 - protein, 9 aa, Homo Sapiens
PHAFIRCPS

SEQ ID NO: 610117 - protein, 9 aa, Homo Sapiens
AATRQALPG

SEQ ID NO: 610118 - protein, 9 aa, Homo Sapiens
QRVCYVPKL

SEQ ID NO: 610119 - protein, 9 aa, Homo Sapiens
NMEGATLTL

SEQ ID NO: 610120 - protein, 9 aa, Homo Sapiens
LLGKELANW

SEQ ID NO: 610121 - protein, 9 aa, Homo Sapiens
IASRFYLVA

SEQ ID NO: 610122 - protein, 9 aa, Homo Sapiens
YCIDTGAPD

SEQ ID NO: 610123 - protein, 9 aa, Homo Sapiens
LFDIAEVYA

SEQ ID NO: 610124 - protein, 9 aa, Homo Sapiens
FQTATSGRD

SEQ ID NO: 610125 - protein, 9 aa, Homo Sapiens
RLLSPMYIF

SEQ ID NO: 610126 - protein, 9 aa, Homo Sapiens
IKRRRRRKM

SEQ ID NO: 610127 - protein, 9 aa, Homo Sapiens
SNQNLVELD

SEQ ID NO: 610128 - protein, 9 aa, Homo Sapiens
LTCYMFNMY

SEQ ID NO: 610129 - protein, 9 aa, Homo Sapiens
KEFHCNRYL

SEQ ID NO: 610130 - protein, 9 aa, Homo Sapiens
VLERPLPLN

SEQ ID NO: 610131 - protein, 9 aa, Homo Sapiens
KYNQHISSH

SEQ ID NO: 610132 - protein, 9 aa, Homo Sapiens
NGGNTNSHY

SEQ ID NO: 610133 - protein, 9 aa, Homo Sapiens
RVRRLHQRS

SEQ ID NO: 610134 - protein, 9 aa, Homo Sapiens
RTRSAEDPV

SEQ ID NO: 610135 - protein, 9 aa, Homo Sapiens
RGSTPCVMQ

SEQ ID NO: 610136 - protein, 9 aa, Homo Sapiens
KSGFASVRN

SEQ ID NO: 610137 - protein, 9 aa, Homo Sapiens
QKEIASLTG

SEQ ID NO: 610138 - protein, 9 aa, Homo Sapiens
TLKIHGWKS

SEQ ID NO: 610139 - protein, 9 aa, Homo Sapiens
YNQHISSHK

SEQ ID NO: 610140 - protein, 9 aa, Homo Sapiens
LGIIREISL

SEQ ID NO: 610141 - protein, 9 aa, Homo Sapiens
PPCSTVVRP

SEQ ID NO: 610142 - protein, 9 aa, Homo Sapiens
NYGLSCQHN

SEQ ID NO: 610143 - protein, 9 aa, Homo Sapiens
ASLRFSRAT

SEQ ID NO: 610144 - protein, 9 aa, Homo Sapiens
ALSCSHTRI

SEQ ID NO: 610145 - protein, 9 aa, Homo Sapiens
TANTTLVHQ

SEQ ID NO: 610146 - protein, 9 aa, Homo Sapiens
YVERRLLSP

SEQ ID NO: 610147 - protein, 9 aa, Homo Sapiens
KIPKRASVV

SEQ ID NO: 610148 - protein, 9 aa, Homo Sapiens
ETGWSKHSK

SEQ ID NO: 610149 - protein, 9 aa, Homo Sapiens
TPSHGDRPL

SEQ ID NO: 610150 - protein, 9 aa, Homo Sapiens
GDYTAVRDA

SEQ ID NO: 610151 - protein, 9 aa, Homo Sapiens
ECSIDEYCK

SEQ ID NO: 610152 - protein, 9 aa, Homo Sapiens
RVSPFRVWR

SEQ ID NO: 610153 - protein, 9 aa, Homo Sapiens
RRDTRKAHI

SEQ ID NO: 610154 - protein, 9 aa, Homo Sapiens
NVINHTDEK

SEQ ID NO: 610155 - protein, 9 aa, Homo Sapiens
ASETCSGCK

SEQ ID NO: 610156 - protein, 9 aa, Homo Sapiens
GGKNRKTHQ

SEQ ID NO: 610157 - protein, 9 aa, Homo Sapiens
RIYFGATGK

SEQ ID NO: 610158 - protein, 9 aa, Homo Sapiens
HTRISKLVV

SEQ ID NO: 610159 - protein, 9 aa, Homo Sapiens
QVMFVNNHL

SEQ ID NO: 610160 - protein, 9 aa, Homo Sapiens
TIPMDGQHL

SEQ ID NO: 610161 - protein, 9 aa, Homo Sapiens
AIEMASTAR

SEQ ID NO: 610162 - protein, 9 aa, Homo Sapiens
LSSDDAYEE

SEQ ID NO: 610163 - protein, 9 aa, Homo Sapiens
MLSSEVCTS

SEQ ID NO: 610164 - protein, 9 aa, Homo Sapiens
DQPSSDGYD

SEQ ID NO: 610165 - protein, 9 aa, Homo Sapiens
SKCDSKGEE

SEQ ID NO: 610166 - protein, 9 aa, Homo Sapiens
CAVQMDFNL

SEQ ID NO: 610167 - protein, 9 aa, Homo Sapiens
EAPGQEQLG

SEQ ID NO: 610168 - protein, 9 aa, Homo Sapiens
GKPRLVLSE

SEQ ID NO: 610169 - protein, 9 aa, Homo Sapiens
EHHKALDKK

SEQ ID NO: 610170 - protein, 9 aa, Homo Sapiens
AMETFSISQ

SEQ ID NO: 610171 - protein, 9 aa, Homo Sapiens
ASWYAVPSQ

SEQ ID NO: 610172 - protein, 9 aa, Homo Sapiens
VYNAQRPNG

SEQ ID NO: 610173 - protein, 9 aa, Homo Sapiens
FSLFCTVIT

SEQ ID NO: 610174 - protein, 9 aa, Homo Sapiens
QMTAGSYLA

SEQ ID NO: 610175 - protein, 9 aa, Homo Sapiens
LRRDHKTST

SEQ ID NO: 610176 - protein, 9 aa, Homo Sapiens
IIFMILGAS

SEQ ID NO: 610177 - protein, 9 aa, Homo Sapiens
NDNSGEKTD

SEQ ID NO: 610178 - protein, 9 aa, Homo Sapiens
NPRRYQKYG

SEQ ID NO: 610179 - protein, 9 aa, Homo Sapiens
PTTSTTPTT

SEQ ID NO: 610180 - protein, 9 aa, Homo Sapiens
HQQLQNRDL

SEQ ID NO: 610181 - protein, 9 aa, Homo Sapiens
PRPRSRSPL

SEQ ID NO: 610182 - protein, 9 aa, Homo Sapiens
STLPIGLCL

SEQ ID NO: 610183 - protein, 9 aa, Homo Sapiens
RRSLDVSPR

SEQ ID NO: 610184 - protein, 9 aa, Homo Sapiens
IEVVKVLTL

SEQ ID NO: 610185 - protein, 9 aa, Homo Sapiens
GSLTGPGQT

SEQ ID NO: 610186 - protein, 9 aa, Homo Sapiens
VCKHGVLSQ

SEQ ID NO: 610187 - protein, 9 aa, Homo Sapiens
ATAAPASAP

SEQ ID NO: 610188 - protein, 9 aa, Homo Sapiens
DEVSYTCSV

SEQ ID NO: 610189 - protein, 9 aa, Homo Sapiens
PEDEFDGHQ

SEQ ID NO: 610190 - protein, 9 aa, Homo Sapiens
KRICKTIVQ

SEQ ID NO: 610191 - protein, 9 aa, Homo Sapiens
EFHCNRYLT

SEQ ID NO: 610192 - protein, 9 aa, Homo Sapiens
GSNTGFRDG

SEQ ID NO: 610193 - protein, 9 aa, Homo Sapiens
NQNLVELDL

SEQ ID NO: 610194 - protein, 9 aa, Homo Sapiens
CAEPTYFLR

SEQ ID NO: 610195 - protein, 9 aa, Homo Sapiens
KPAGEPGTE

SEQ ID NO: 610196 - protein, 9 aa, Homo Sapiens
PWDRVLDLC

SEQ ID NO: 610197 - protein, 9 aa, Homo Sapiens
AYKQDGFTY

SEQ ID NO: 610198 - protein, 9 aa, Homo Sapiens
LHHPHPHAF

SEQ ID NO: 610199 - protein, 9 aa, Homo Sapiens
KIASRELEK

SEQ ID NO: 610200 - protein, 9 aa, Homo Sapiens
AAGFFNAGS

SEQ ID NO: 610201 - protein, 9 aa, Homo Sapiens
TIRTPMLNP

SEQ ID NO: 610202 - protein, 9 aa, Homo Sapiens
VGKGECDNI

SEQ ID NO: 610203 - protein, 9 aa, Homo Sapiens
SLEIQCLVA

SEQ ID NO: 610204 - protein, 9 aa, Homo Sapiens
RSHSCSEGQ

SEQ ID NO: 610205 - protein, 9 aa, Homo Sapiens
FSNLHSGTT

SEQ ID NO: 610206 - protein, 9 aa, Homo Sapiens
PAPASLRKC

SEQ ID NO: 610207 - protein, 9 aa, Homo Sapiens
SPVSFPIFL

SEQ ID NO: 610208 - protein, 9 aa, Homo Sapiens
SGSTAGGMA

SEQ ID NO: 610209 - protein, 9 aa, Homo Sapiens
LPVRGVSDG

SEQ ID NO: 610210 - protein, 9 aa, Homo Sapiens
SDSSKQLSK

SEQ ID NO: 610211 - protein, 9 aa, Homo Sapiens
ARTAQQYER

SEQ ID NO: 610212 - protein, 9 aa, Homo Sapiens
RLPGGGIGL

SEQ ID NO: 610213 - protein, 9 aa, Homo Sapiens
DIMNCGIYL

SEQ ID NO: 610214 - protein, 9 aa, Homo Sapiens
GPSAVPPQA

SEQ ID NO: 610215 - protein, 9 aa, Homo Sapiens
VVTQAHYTY

SEQ ID NO: 610216 - protein, 9 aa, Homo Sapiens
NRRGASVDD

SEQ ID NO: 610217 - protein, 9 aa, Homo Sapiens
LLGARGPLS

SEQ ID NO: 610218 - protein, 9 aa, Homo Sapiens
VRLKRLIKM

SEQ ID NO: 610219 - protein, 9 aa, Homo Sapiens
SFDKMLNDR

SEQ ID NO: 610220 - protein, 9 aa, Homo Sapiens
DRNFISTAS

SEQ ID NO: 610221 - protein, 9 aa, Homo Sapiens
SGPYLPYKV

SEQ ID NO: 610222 - protein, 9 aa, Homo Sapiens
LHFLVLLVL

SEQ ID NO: 610223 - protein, 9 aa, Homo Sapiens
SLMITCLTI

SEQ ID NO: 610224 - protein, 9 aa, Homo Sapiens
ELFSVPITM

SEQ ID NO: 610225 - protein, 9 aa, Homo Sapiens
AAAASRRQS

SEQ ID NO: 610226 - protein, 9 aa, Homo Sapiens
LTIIPSAIG

SEQ ID NO: 610227 - protein, 9 aa, Homo Sapiens
ISLEAFVCY

SEQ ID NO: 610228 - protein, 9 aa, Homo Sapiens
ICLQGLCRQ

SEQ ID NO: 610229 - protein, 9 aa, Homo Sapiens
LQGLCRQAG

SEQ ID NO: 610230 - protein, 9 aa, Homo Sapiens
AWSWRRSFI

SEQ ID NO: 610231 - protein, 9 aa, Homo Sapiens
ETCLYIRDP

SEQ ID NO: 610232 - protein, 9 aa, Homo Sapiens
TATTEAAVH

SEQ ID NO: 610233 - protein, 9 aa, Homo Sapiens
LSKVSIIRR

SEQ ID NO: 610234 - protein, 9 aa, Homo Sapiens
TRNPNYEII

SEQ ID NO: 610235 - protein, 9 aa, Homo Sapiens
YWAITNATE

SEQ ID NO: 610236 - protein, 9 aa, Homo Sapiens
EDTDEKEED

SEQ ID NO: 610237 - protein, 9 aa, Homo Sapiens
LFKGAHYWR

SEQ ID NO: 610238 - protein, 9 aa, Homo Sapiens
PWLPGARGL

SEQ ID NO: 610239 - protein, 9 aa, Homo Sapiens
ITNSITQHT

SEQ ID NO: 610240 - protein, 9 aa, Homo Sapiens
PEQTVIPFT

SEQ ID NO: 610241 - protein, 9 aa, Homo Sapiens
TFIYTLRNK

SEQ ID NO: 610242 - protein, 9 aa, Homo Sapiens
KEIFQQLQD

SEQ ID NO: 610243 - protein, 9 aa, Homo Sapiens
DGDDIHGLL

SEQ ID NO: 610244 - protein, 9 aa, Homo Sapiens
FVALKKQRA

SEQ ID NO: 610245 - protein, 9 aa, Homo Sapiens
VRMAFFQDQ

SEQ ID NO: 610246 - protein, 9 aa, Homo Sapiens
GEAEGRDGE

SEQ ID NO: 610247 - protein, 9 aa, Homo Sapiens
LPLLPGLLD

SEQ ID NO: 610248 - protein, 9 aa, Homo Sapiens
SKVSIIRRL

SEQ ID NO: 610249 - protein, 9 aa, Homo Sapiens
PRVRRLHQR

SEQ ID NO: 610250 - protein, 9 aa, Homo Sapiens
SLQHNTSRY

SEQ ID NO: 610251 - protein, 9 aa, Homo Sapiens
PLLVTRSGR

SEQ ID NO: 610252 - protein, 9 aa, Homo Sapiens
ASVESAKVE

SEQ ID NO: 610253 - protein, 9 aa, Homo Sapiens
SNQDLVTCL

SEQ ID NO: 610254 - protein, 9 aa, Homo Sapiens
QILHTGEKP

SEQ ID NO: 610255 - protein, 9 aa, Homo Sapiens
EKLRRELEA

SEQ ID NO: 610256 - protein, 9 aa, Homo Sapiens
QSGSDSNCG

SEQ ID NO: 610257 - protein, 9 aa, Homo Sapiens
ARSQQCALC

SEQ ID NO: 610258 - protein, 9 aa, Homo Sapiens
YRFDLSCSR

SEQ ID NO: 610259 - protein, 9 aa, Homo Sapiens
SYCVLTLTP

SEQ ID NO: 610260 - protein, 9 aa, Homo Sapiens
GLLDSHGRA

SEQ ID NO: 610261 - protein, 9 aa, Homo Sapiens
VAQNTTGTV

SEQ ID NO: 610262 - protein, 9 aa, Homo Sapiens
PSYKKPLYC

SEQ ID NO: 610263 - protein, 9 aa, Homo Sapiens
WCSPFRRLS

SEQ ID NO: 610264 - protein, 9 aa, Homo Sapiens
RDTEAVCAM

SEQ ID NO: 610265 - protein, 9 aa, Homo Sapiens
ESKKDATKY

SEQ ID NO: 610266 - protein, 9 aa, Homo Sapiens
KPRLVLSEE

SEQ ID NO: 610267 - protein, 9 aa, Homo Sapiens
KSDSSKQLS

SEQ ID NO: 610268 - protein, 9 aa, Homo Sapiens
VLACSLPEV

SEQ ID NO: 610269 - protein, 9 aa, Homo Sapiens
STGALLAIL

SEQ ID NO: 610270 - protein, 9 aa, Homo Sapiens
QDGFTYTGA

SEQ ID NO: 610271 - protein, 9 aa, Homo Sapiens
DVPFGFSPI

SEQ ID NO: 610272 - protein, 9 aa, Homo Sapiens
FREVIKRIQ

SEQ ID NO: 610273 - protein, 9 aa, Homo Sapiens
CKHGVLSQE

SEQ ID NO: 610274 - protein, 9 aa, Homo Sapiens
DGVDKIQYD

SEQ ID NO: 610275 - protein, 9 aa, Homo Sapiens
RALRTRLHL

SEQ ID NO: 610276 - protein, 9 aa, Homo Sapiens
FCYLDVDKD

SEQ ID NO: 610277 - protein, 9 aa, Homo Sapiens
TTANTTLVH

SEQ ID NO: 610278 - protein, 9 aa, Homo Sapiens
LPPIQVKRS

SEQ ID NO: 610279 - protein, 9 aa, Homo Sapiens
PGDRPAFSR

SEQ ID NO: 610280 - protein, 9 aa, Homo Sapiens
LSVGQIHVT

SEQ ID NO: 610281 - protein, 9 aa, Homo Sapiens
GSDEQKRLP

SEQ ID NO: 610282 - protein, 9 aa, Homo Sapiens
EKKRPATIF

SEQ ID NO: 610283 - protein, 9 aa, Homo Sapiens
PDFNRRGAS

SEQ ID NO: 610284 - protein, 9 aa, Homo Sapiens
FELKEDTIE

SEQ ID NO: 610285 - protein, 9 aa, Homo Sapiens
CSPNSTGIQ

SEQ ID NO: 610286 - protein, 9 aa, Homo Sapiens
KWVIFRNGS

SEQ ID NO: 610287 - protein, 9 aa, Homo Sapiens
WRRPWGFSG

SEQ ID NO: 610288 - protein, 9 aa, Homo Sapiens
PSLCGLALV

SEQ ID NO: 610289 - protein, 9 aa, Homo Sapiens
LISHDPGTP

SEQ ID NO: 610290 - protein, 9 aa, Homo Sapiens
ILYQDDLEN

SEQ ID NO: 610291 - protein, 9 aa, Homo Sapiens
DLFILRLAY

SEQ ID NO: 610292 - protein, 9 aa, Homo Sapiens
PSTFISDIM

SEQ ID NO: 610293 - protein, 9 aa, Homo Sapiens
VVYMHRFYM

SEQ ID NO: 610294 - protein, 9 aa, Homo Sapiens
AAVHPACQI

SEQ ID NO: 610295 - protein, 9 aa, Homo Sapiens
HCSLEKALE

SEQ ID NO: 610296 - protein, 9 aa, Homo Sapiens
VMVLVLEKG

SEQ ID NO: 610297 - protein, 9 aa, Homo Sapiens
PWRRPWGFS

SEQ ID NO: 610298 - protein, 9 aa, Homo Sapiens
TTQLSSGRC

SEQ ID NO: 610299 - protein, 9 aa, Homo Sapiens
RPQDAAVHP

SEQ ID NO: 610300 - protein, 9 aa, Homo Sapiens
HKEESPASP

SEQ ID NO: 610301 - protein, 9 aa, Homo Sapiens
GPAESQSVV

SEQ ID NO: 610302 - protein, 9 aa, Homo Sapiens
RVTVTPSTR

SEQ ID NO: 610303 - protein, 9 aa, Homo Sapiens
SYLINSNTY

SEQ ID NO: 610304 - protein, 9 aa, Homo Sapiens
IFLIALIGN

SEQ ID NO: 610305 - protein, 9 aa, Homo Sapiens
DVLQSPLQE

SEQ ID NO: 610306 - protein, 9 aa, Homo Sapiens
LFFGEGTIT

SEQ ID NO: 610307 - protein, 9 aa, Homo Sapiens
YIEQLPEQT

SEQ ID NO: 610308 - protein, 9 aa, Homo Sapiens
QHCQSLVFS

SEQ ID NO: 610309 - protein, 9 aa, Homo Sapiens
VHWKSQTCQ

SEQ ID NO: 610310 - protein, 9 aa, Homo Sapiens
LACSLPEVF

SEQ ID NO: 610311 - protein, 9 aa, Homo Sapiens
NNLCNFASR

SEQ ID NO: 610312 - protein, 9 aa, Homo Sapiens
MQDLEQKMK

SEQ ID NO: 610313 - protein, 9 aa, Homo Sapiens
VAENIVGRA

SEQ ID NO: 610314 - protein, 9 aa, Homo Sapiens
LPGTLPVLK

SEQ ID NO: 610315 - protein, 9 aa, Homo Sapiens
VQIQDINDN

SEQ ID NO: 610316 - protein, 9 aa, Homo Sapiens
GQNSGLVSY

SEQ ID NO: 610317 - protein, 9 aa, Homo Sapiens
RPGGCERAR

SEQ ID NO: 610318 - protein, 9 aa, Homo Sapiens
LQEAIVSSW

SEQ ID NO: 610319 - protein, 9 aa, Homo Sapiens
AGQCKDKGN

SEQ ID NO: 610320 - protein, 9 aa, Homo Sapiens
GGAQSFALS

SEQ ID NO: 610321 - protein, 9 aa, Homo Sapiens
RASHMRWLV

SEQ ID NO: 610322 - protein, 9 aa, Homo Sapiens
WDWQIDCST

SEQ ID NO: 610323 - protein, 9 aa, Homo Sapiens
NVYPWWGGA

SEQ ID NO: 610324 - protein, 9 aa, Homo Sapiens
DHIEVRDVP

SEQ ID NO: 610325 - protein, 9 aa, Homo Sapiens
QNKNHLVLE

SEQ ID NO: 610326 - protein, 9 aa, Homo Sapiens
PNGEAEGRD

SEQ ID NO: 610327 - protein, 9 aa, Homo Sapiens
RAVPLAFGY

SEQ ID NO: 610328 - protein, 9 aa, Homo Sapiens
ERARRGQAQ

SEQ ID NO: 610329 - protein, 9 aa, Homo Sapiens
LYASVKALV

SEQ ID NO: 610330 - protein, 9 aa, Homo Sapiens
SAFLDLFIL

SEQ ID NO: 610331 - protein, 9 aa, Homo Sapiens
IKVFEKMNQ

SEQ ID NO: 610332 - protein, 9 aa, Homo Sapiens
PLPLNQRGF

SEQ ID NO: 610333 - protein, 9 aa, Homo Sapiens
FNEVVQMNL

SEQ ID NO: 610334 - protein, 9 aa, Homo Sapiens
GLSYEYRTL

SEQ ID NO: 610335 - protein, 9 aa, Homo Sapiens
PLQEAIVSS

SEQ ID NO: 610336 - protein, 9 aa, Homo Sapiens
LVENGGLGW

SEQ ID NO: 610337 - protein, 9 aa, Homo Sapiens
APASLRKCG

SEQ ID NO: 610338 - protein, 9 aa, Homo Sapiens
PQKKEGKAK

SEQ ID NO: 610339 - protein, 9 aa, Homo Sapiens
AWVPIVHSA

SEQ ID NO: 610340 - protein, 9 aa, Homo Sapiens
QAQASGAGQ

SEQ ID NO: 610341 - protein, 9 aa, Homo Sapiens
TKPSPSPEE

SEQ ID NO: 610342 - protein, 9 aa, Homo Sapiens
YLESSRQDV

SEQ ID NO: 610343 - protein, 9 aa, Homo Sapiens
SETCSGCKA

SEQ ID NO: 610344 - protein, 9 aa, Homo Sapiens
SDSFQYRYT

SEQ ID NO: 610345 - protein, 9 aa, Homo Sapiens
NLFVDVIMD

SEQ ID NO: 610346 - protein, 9 aa, Homo Sapiens
CKDKGNFSF

SEQ ID NO: 610347 - protein, 9 aa, Homo Sapiens
PFPELPVRG

SEQ ID NO: 610348 - protein, 9 aa, Homo Sapiens
EGRGSTPCV

SEQ ID NO: 610349 - protein, 9 aa, Homo Sapiens
GWTASAACL

SEQ ID NO: 610350 - protein, 9 aa, Homo Sapiens
SRDGSKFSM

SEQ ID NO: 610351 - protein, 9 aa, Homo Sapiens
VLGILLGII

SEQ ID NO: 610352 - protein, 9 aa, Homo Sapiens
RSFVSSLVK

SEQ ID NO: 610353 - protein, 9 aa, Homo Sapiens
IKFDLQFPE

SEQ ID NO: 610354 - protein, 9 aa, Homo Sapiens
VTVDDPVRK

SEQ ID NO: 610355 - protein, 9 aa, Homo Sapiens
LRSEYVRKF

SEQ ID NO: 610356 - protein, 9 aa, Homo Sapiens
LPKLFCSLS

SEQ ID NO: 610357 - protein, 9 aa, Homo Sapiens
ESPASPLRP

SEQ ID NO: 610358 - protein, 9 aa, Homo Sapiens
EIRESHRCR

SEQ ID NO: 610359 - protein, 9 aa, Homo Sapiens
EQHIASVWE

SEQ ID NO: 610360 - protein, 9 aa, Homo Sapiens
RKRMQDLEQ

SEQ ID NO: 610361 - protein, 9 aa, Homo Sapiens
NLFDIAEVY

SEQ ID NO: 610362 - protein, 9 aa, Homo Sapiens
ETEEKRGGE

SEQ ID NO: 610363 - protein, 9 aa, Homo Sapiens
RNYCWCWDL

SEQ ID NO: 610364 - protein, 9 aa, Homo Sapiens
QPPPSLCGL

SEQ ID NO: 610365 - protein, 9 aa, Homo Sapiens
PLSAKGSNA

SEQ ID NO: 610366 - protein, 9 aa, Homo Sapiens
QMAAFHQSS

SEQ ID NO: 610367 - protein, 9 aa, Homo Sapiens
LNLAHTVDT

SEQ ID NO: 610368 - protein, 9 aa, Homo Sapiens
IFDSLSRGK

SEQ ID NO: 610369 - protein, 9 aa, Homo Sapiens
ALLQTAGPH

SEQ ID NO: 610370 - protein, 9 aa, Homo Sapiens
QSRITEQKL

SEQ ID NO: 610371 - protein, 9 aa, Homo Sapiens
LALICSFQL

SEQ ID NO: 610372 - protein, 9 aa, Homo Sapiens
VSANPSLRG

SEQ ID NO: 610373 - protein, 9 aa, Homo Sapiens
HTLHLIRER

SEQ ID NO: 610374 - protein, 9 aa, Homo Sapiens
SAYFNIPSP

SEQ ID NO: 610375 - protein, 9 aa, Homo Sapiens
RGAKPHRCQ

SEQ ID NO: 610376 - protein, 9 aa, Homo Sapiens
TCALDNDKY

SEQ ID NO: 610377 - protein, 9 aa, Homo Sapiens
VCEENFTFF

SEQ ID NO: 610378 - protein, 9 aa, Homo Sapiens
GCPHPPAAH

SEQ ID NO: 610379 - protein, 9 aa, Homo Sapiens
SRASGGRER

SEQ ID NO: 610380 - protein, 9 aa, Homo Sapiens
EQVPQPLLE

SEQ ID NO: 610381 - protein, 9 aa, Homo Sapiens
HCAEPTYFL

SEQ ID NO: 610382 - protein, 9 aa, Homo Sapiens
KHSKVLELE

SEQ ID NO: 610383 - protein, 9 aa, Homo Sapiens
GPQGNRGER

SEQ ID NO: 610384 - protein, 9 aa, Homo Sapiens
PSPLSRTPT

SEQ ID NO: 610385 - protein, 9 aa, Homo Sapiens
LDVDKDIHD

SEQ ID NO: 610386 - protein, 9 aa, Homo Sapiens
VSAVFRGCF

SEQ ID NO: 610387 - protein, 9 aa, Homo Sapiens
DQELAALLE

SEQ ID NO: 610388 - protein, 9 aa, Homo Sapiens
FHVTVQIQD

SEQ ID NO: 610389 - protein, 9 aa, Homo Sapiens
NLSSLSNKY

SEQ ID NO: 610390 - protein, 9 aa, Homo Sapiens
FQERRMLGT

SEQ ID NO: 610391 - protein, 9 aa, Homo Sapiens
LSRFLNPLS

SEQ ID NO: 610392 - protein, 9 aa, Homo Sapiens
QNLVELDLS

SEQ ID NO: 610393 - protein, 9 aa, Homo Sapiens
LLDSHGRAH

SEQ ID NO: 610394 - protein, 9 aa, Homo Sapiens
CRRPLGPAR

SEQ ID NO: 610395 - protein, 9 aa, Homo Sapiens
GDEVPYALG

SEQ ID NO: 610396 - protein, 9 aa, Homo Sapiens
EKGAKPCKS

SEQ ID NO: 610397 - protein, 9 aa, Homo Sapiens
KKKNLVFLR

SEQ ID NO: 610398 - protein, 9 aa, Homo Sapiens
NGSEQSGVL

SEQ ID NO: 610399 - protein, 9 aa, Homo Sapiens
YTIRTPMLN

SEQ ID NO: 610400 - protein, 9 aa, Homo Sapiens
IPTKSCKPL

SEQ ID NO: 610401 - protein, 9 aa, Homo Sapiens
SVLLEPPRG

SEQ ID NO: 610402 - protein, 9 aa, Homo Sapiens
AVQEIQATF

SEQ ID NO: 610403 - protein, 9 aa, Homo Sapiens
LGRVGGWRA

SEQ ID NO: 610404 - protein, 9 aa, Homo Sapiens
YAFVTFCGK

SEQ ID NO: 610405 - protein, 9 aa, Homo Sapiens
TTPTAAPTP

SEQ ID NO: 610406 - protein, 9 aa, Homo Sapiens
EGTHINQSE

SEQ ID NO: 610407 - protein, 9 aa, Homo Sapiens
DTTATTEAA

SEQ ID NO: 610408 - protein, 9 aa, Homo Sapiens
SLATAVCKI

SEQ ID NO: 610409 - protein, 9 aa, Homo Sapiens
TFVFQVVPM

SEQ ID NO: 610410 - protein, 9 aa, Homo Sapiens
VQVGIAGIR

SEQ ID NO: 610411 - protein, 9 aa, Homo Sapiens
LESSRQDVP

SEQ ID NO: 610412 - protein, 9 aa, Homo Sapiens
NLLDSITGP

SEQ ID NO: 610413 - protein, 9 aa, Homo Sapiens
PYILDPVED

SEQ ID NO: 610414 - protein, 9 aa, Homo Sapiens
IAGIRATAA

SEQ ID NO: 610415 - protein, 9 aa, Homo Sapiens
VLSSLLVGE

SEQ ID NO: 610416 - protein, 9 aa, Homo Sapiens
NTNTRKRSQ

SEQ ID NO: 610417 - protein, 9 aa, Homo Sapiens
ALGYYRIVK

SEQ ID NO: 610418 - protein, 9 aa, Homo Sapiens
ALDNDKYIA

SEQ ID NO: 610419 - protein, 9 aa, Homo Sapiens
GDRPAFSRL

SEQ ID NO: 610420 - protein, 9 aa, Homo Sapiens
GIGIIHLGS

SEQ ID NO: 610421 - protein, 9 aa, Homo Sapiens
HRKIQQCMV

SEQ ID NO: 610422 - protein, 9 aa, Homo Sapiens
RFRNYCWCW

SEQ ID NO: 610423 - protein, 9 aa, Homo Sapiens
TRNIKSIRS

SEQ ID NO: 610424 - protein, 9 aa, Homo Sapiens
TPMPRNMEG

SEQ ID NO: 610425 - protein, 9 aa, Homo Sapiens
FRNYCWCWD

SEQ ID NO: 610426 - protein, 9 aa, Homo Sapiens
GVFPGEQFK

SEQ ID NO: 610427 - protein, 9 aa, Homo Sapiens
DCETQNLNW

SEQ ID NO: 610428 - protein, 9 aa, Homo Sapiens
EHGVNLFDI

SEQ ID NO: 610429 - protein, 9 aa, Homo Sapiens
ATEYARKRT

SEQ ID NO: 610430 - protein, 9 aa, Homo Sapiens
TVVLRGALR

SEQ ID NO: 610431 - protein, 9 aa, Homo Sapiens
KFVLTGRDT

SEQ ID NO: 610432 - protein, 9 aa, Homo Sapiens
GYKTCPTVQ

SEQ ID NO: 610433 - protein, 9 aa, Homo Sapiens
IKRIQSLLD

SEQ ID NO: 610434 - protein, 9 aa, Homo Sapiens
RRFQQIKAR

SEQ ID NO: 610435 - protein, 9 aa, Homo Sapiens
IKIASRELE

SEQ ID NO: 610436 - protein, 9 aa, Homo Sapiens
TSDPWIPSG

SEQ ID NO: 610437 - protein, 9 aa, Homo Sapiens
SRATARRKI

SEQ ID NO: 610438 - protein, 9 aa, Homo Sapiens
RVEEGISLE

SEQ ID NO: 610439 - protein, 9 aa, Homo Sapiens
YLVRQQMRL

SEQ ID NO: 610440 - protein, 9 aa, Homo Sapiens
PSSLKVPGD

SEQ ID NO: 610441 - protein, 9 aa, Homo Sapiens
KLPEKLHAE

SEQ ID NO: 610442 - protein, 9 aa, Homo Sapiens
PAVPGWVWE

SEQ ID NO: 610443 - protein, 9 aa, Homo Sapiens
QKLGEKMLK

SEQ ID NO: 610444 - protein, 9 aa, Homo Sapiens
GFSTASRKQ

SEQ ID NO: 610445 - protein, 9 aa, Homo Sapiens
LPRGTAIHP

SEQ ID NO: 610446 - protein, 9 aa, Homo Sapiens
RPRVRRLHQ

SEQ ID NO: 610447 - protein, 9 aa, Homo Sapiens
TARVGVREP

SEQ ID NO: 610448 - protein, 9 aa, Homo Sapiens
LEQHIASVW

SEQ ID NO: 610449 - protein, 9 aa, Homo Sapiens
PATLNKPEK

SEQ ID NO: 610450 - protein, 9 aa, Homo Sapiens
EIQGHFASS

SEQ ID NO: 610451 - protein, 9 aa, Homo Sapiens
VAVAGNETE

SEQ ID NO: 610452 - protein, 9 aa, Homo Sapiens
PGGCERARL

SEQ ID NO: 610453 - protein, 9 aa, Homo Sapiens
SKSDYEEDV

SEQ ID NO: 610454 - protein, 9 aa, Homo Sapiens
FLPNAFSAY

SEQ ID NO: 610455 - protein, 9 aa, Homo Sapiens
VNLQLINQE

SEQ ID NO: 610456 - protein, 9 aa, Homo Sapiens
VQDLKGDYT

SEQ ID NO: 610457 - protein, 9 aa, Homo Sapiens
DNPRRYQKY

SEQ ID NO: 610458 - protein, 9 aa, Homo Sapiens
RRGATTLVV

SEQ ID NO: 610459 - protein, 9 aa, Homo Sapiens
GIQWALLMH

SEQ ID NO: 610460 - protein, 9 aa, Homo Sapiens
TTEAAVHGL

SEQ ID NO: 610461 - protein, 9 aa, Homo Sapiens
PAYSPNIYP

SEQ ID NO: 610462 - protein, 9 aa, Homo Sapiens
GRAKSVHPQ

SEQ ID NO: 610463 - protein, 9 aa, Homo Sapiens
NHSRVESSM

SEQ ID NO: 610464 - protein, 9 aa, Homo Sapiens
AATDQGPSE

SEQ ID NO: 610465 - protein, 9 aa, Homo Sapiens
ITLYKDVKP

SEQ ID NO: 610466 - protein, 9 aa, Homo Sapiens
VRDVPFGFS

SEQ ID NO: 610467 - protein, 9 aa, Homo Sapiens
SLDVSPRRL

SEQ ID NO: 610468 - protein, 9 aa, Homo Sapiens
RICKTIVQA

SEQ ID NO: 610469 - protein, 9 aa, Homo Sapiens
DLGADPAVA

SEQ ID NO: 610470 - protein, 9 aa, Homo Sapiens
IVAVLFCVV

SEQ ID NO: 610471 - protein, 9 aa, Homo Sapiens
ITLQRTKMT

SEQ ID NO: 610472 - protein, 9 aa, Homo Sapiens
DPLAFFYSP

SEQ ID NO: 610473 - protein, 9 aa, Homo Sapiens
PDPHSQTRR

SEQ ID NO: 610474 - protein, 9 aa, Homo Sapiens
SGSLLGARG

SEQ ID NO: 610475 - protein, 9 aa, Homo Sapiens
ETPSHGDRP

SEQ ID NO: 610476 - protein, 9 aa, Homo Sapiens
YIPPPLGQM

SEQ ID NO: 610477 - protein, 9 aa, Homo Sapiens
EIIHMIEEY

SEQ ID NO: 610478 - protein, 9 aa, Homo Sapiens
RASVVHSLI

SEQ ID NO: 610479 - protein, 9 aa, Homo Sapiens
IVSCCWLAL

SEQ ID NO: 610480 - protein, 9 aa, Homo Sapiens
NTAVVYMHR

SEQ ID NO: 610481 - protein, 9 aa, Homo Sapiens
LAAAAANPK

SEQ ID NO: 610482 - protein, 9 aa, Homo Sapiens
RKAQREAED

SEQ ID NO: 610483 - protein, 9 aa, Homo Sapiens
LAILNGTYG

SEQ ID NO: 610484 - protein, 9 aa, Homo Sapiens
KSLPRGTAI

SEQ ID NO: 610485 - protein, 9 aa, Homo Sapiens
QNSDWIRLD

SEQ ID NO: 610486 - protein, 9 aa, Homo Sapiens
DVIMDNFEY

SEQ ID NO: 610487 - protein, 9 aa, Homo Sapiens
RFPGLPLLA

SEQ ID NO: 610488 - protein, 9 aa, Homo Sapiens
MPIGTNVLE

SEQ ID NO: 610489 - protein, 9 aa, Homo Sapiens
HLQTMTLEH

SEQ ID NO: 610490 - protein, 9 aa, Homo Sapiens
NRADAQSLL

SEQ ID NO: 610491 - protein, 9 aa, Homo Sapiens
GDDIHGLLP

SEQ ID NO: 610492 - protein, 9 aa, Homo Sapiens
VLLGLQPAT

SEQ ID NO: 610493 - protein, 9 aa, Homo Sapiens
LAYRLPGGG

SEQ ID NO: 610494 - protein, 9 aa, Homo Sapiens
GSLEVMPQN

SEQ ID NO: 610495 - protein, 9 aa, Homo Sapiens
RKAARPGGC

SEQ ID NO: 610496 - protein, 9 aa, Homo Sapiens
TEILKQSDK

SEQ ID NO: 610497 - protein, 9 aa, Homo Sapiens
YSHLLVVSL

SEQ ID NO: 610498 - protein, 9 aa, Homo Sapiens
GLRLPSLVG

SEQ ID NO: 610499 - protein, 9 aa, Homo Sapiens
AARPGGCER

SEQ ID NO: 610500 - protein, 9 aa, Homo Sapiens
FSGGWTASA

SEQ ID NO: 610501 - protein, 9 aa, Homo Sapiens
AIGKVSDDM

SEQ ID NO: 610502 - protein, 9 aa, Homo Sapiens
DACYRETCL

SEQ ID NO: 610503 - protein, 9 aa, Homo Sapiens
RKRSQRRTK

SEQ ID NO: 610504 - protein, 9 aa, Homo Sapiens
ALFLFISAN

SEQ ID NO: 610505 - protein, 9 aa, Homo Sapiens
NELTGHFRN

SEQ ID NO: 610506 - protein, 9 aa, Homo Sapiens
YEYRTLLFK

SEQ ID NO: 610507 - protein, 9 aa, Homo Sapiens
YQDDLENPM

SEQ ID NO: 610508 - protein, 9 aa, Homo Sapiens
TERLIKIAS

SEQ ID NO: 610509 - protein, 9 aa, Homo Sapiens
PSTLFLPHF

SEQ ID NO: 610510 - protein, 9 aa, Homo Sapiens
WCNQKTEHQ

SEQ ID NO: 610511 - protein, 9 aa, Homo Sapiens
SSCSLARTC

SEQ ID NO: 610512 - protein, 9 aa, Homo Sapiens
MDLGLKQKL

SEQ ID NO: 610513 - protein, 9 aa, Homo Sapiens
VWLISHDPG

SEQ ID NO: 610514 - protein, 9 aa, Homo Sapiens
LEEKAHVPI

SEQ ID NO: 610515 - protein, 9 aa, Homo Sapiens
LSQETLTLK

SEQ ID NO: 610516 - protein, 9 aa, Homo Sapiens
KEESPASPL

SEQ ID NO: 610517 - protein, 9 aa, Homo Sapiens
CFHILNMLF

SEQ ID NO: 610518 - protein, 9 aa, Homo Sapiens
TSTRRSISC

SEQ ID NO: 610519 - protein, 9 aa, Homo Sapiens
PWPGLRLPS

SEQ ID NO: 610520 - protein, 9 aa, Homo Sapiens
AHVPISGQP

SEQ ID NO: 610521 - protein, 9 aa, Homo Sapiens
KQILCKIPD

SEQ ID NO: 610522 - protein, 9 aa, Homo Sapiens
VEFVPLFMP

SEQ ID NO: 610523 - protein, 9 aa, Homo Sapiens
ECIIDGDDI

SEQ ID NO: 610524 - protein, 9 aa, Homo Sapiens
DLYPVEDYL

SEQ ID NO: 610525 - protein, 9 aa, Homo Sapiens
DATKYAKKV

SEQ ID NO: 610526 - protein, 9 aa, Homo Sapiens
QLRWHSGPL

SEQ ID NO: 610527 - protein, 9 aa, Homo Sapiens
LGPEDQDIS

SEQ ID NO: 610528 - protein, 9 aa, Homo Sapiens
SHAGERPYK

SEQ ID NO: 610529 - protein, 9 aa, Homo Sapiens
EVPMWLAIN

SEQ ID NO: 610530 - protein, 9 aa, Homo Sapiens
RSISCKKSG

SEQ ID NO: 610531 - protein, 9 aa, Homo Sapiens
RGSNHSLGN

SEQ ID NO: 610532 - protein, 9 aa, Homo Sapiens
YTISLGSEA

SEQ ID NO: 610533 - protein, 9 aa, Homo Sapiens
ERRMLGTKH

SEQ ID NO: 610534 - protein, 9 aa, Homo Sapiens
RKLVLPPVS

SEQ ID NO: 610535 - protein, 9 aa, Homo Sapiens
GDFCYLDVD

SEQ ID NO: 610536 - protein, 9 aa, Homo Sapiens
CIMGAKSIY

SEQ ID NO: 610537 - protein, 9 aa, Homo Sapiens
IGVMKKEKL

SEQ ID NO: 610538 - protein, 9 aa, Homo Sapiens
FIYRFDLSC

SEQ ID NO: 610539 - protein, 9 aa, Homo Sapiens
GYLVRQQMR

SEQ ID NO: 610540 - protein, 9 aa, Homo Sapiens
PGTLPVLKR

SEQ ID NO: 610541 - protein, 9 aa, Homo Sapiens
TLTTTASPT

SEQ ID NO: 610542 - protein, 9 aa, Homo Sapiens
ARAHRPRPE

SEQ ID NO: 610543 - protein, 9 aa, Homo Sapiens
LLFFNPIRA

SEQ ID NO: 610544 - protein, 9 aa, Homo Sapiens
LPEQTVIPF

SEQ ID NO: 610545 - protein, 9 aa, Homo Sapiens
FLHSSLDPL

SEQ ID NO: 610546 - protein, 9 aa, Homo Sapiens
SWLPIWGSL

SEQ ID NO: 610547 - protein, 9 aa, Homo Sapiens
RDSTPLEPP

SEQ ID NO: 610548 - protein, 9 aa, Homo Sapiens
LMLLDCYGD

SEQ ID NO: 610549 - protein, 9 aa, Homo Sapiens
IGCTVFIWC

SEQ ID NO: 610550 - protein, 9 aa, Homo Sapiens
SEVESFILY

SEQ ID NO: 610551 - protein, 9 aa, Homo Sapiens
DSKDNEVDG

SEQ ID NO: 610552 - protein, 9 aa, Homo Sapiens
APAQLRWHS

SEQ ID NO: 610553 - protein, 9 aa, Homo Sapiens
VRFRNYCWC

SEQ ID NO: 610554 - protein, 9 aa, Homo Sapiens
KIQQCMVAH

SEQ ID NO: 610555 - protein, 9 aa, Homo Sapiens
KQRAYLGGE

SEQ ID NO: 610556 - protein, 9 aa, Homo Sapiens
KIYFKNMRT

SEQ ID NO: 610557 - protein, 9 aa, Homo Sapiens
QEIRESHRC

SEQ ID NO: 610558 - protein, 9 aa, Homo Sapiens
WKSQTCQSQ

SEQ ID NO: 610559 - protein, 9 aa, Homo Sapiens
FDMGQRVCY

SEQ ID NO: 610560 - protein, 9 aa, Homo Sapiens
DLEEDSCDY

SEQ ID NO: 610561 - protein, 9 aa, Homo Sapiens
IGAPHLHHQ

SEQ ID NO: 610562 - protein, 9 aa, Homo Sapiens
IKEKIRTRS

SEQ ID NO: 610563 - protein, 9 aa, Homo Sapiens
QNETRVSWD

SEQ ID NO: 610564 - protein, 9 aa, Homo Sapiens
MASTARGLG

SEQ ID NO: 610565 - protein, 9 aa, Homo Sapiens
VEKRQGISP

SEQ ID NO: 610566 - protein, 9 aa, Homo Sapiens
TTPTTPTAA

SEQ ID NO: 610567 - protein, 9 aa, Homo Sapiens
QSMSAKLQA

SEQ ID NO: 610568 - protein, 9 aa, Homo Sapiens
LICFQVIAT

SEQ ID NO: 610569 - protein, 9 aa, Homo Sapiens
SASWYAVPS

SEQ ID NO: 610570 - protein, 9 aa, Homo Sapiens
TSVRVTTGE

SEQ ID NO: 610571 - protein, 9 aa, Homo Sapiens
TTENIILVG

SEQ ID NO: 610572 - protein, 9 aa, Homo Sapiens
LVRQQMRLQ

SEQ ID NO: 610573 - protein, 9 aa, Homo Sapiens
KEEDKSNDN

SEQ ID NO: 610574 - protein, 9 aa, Homo Sapiens
RVIKRSSSI

SEQ ID NO: 610575 - protein, 9 aa, Homo Sapiens
PGEPWLPGA

SEQ ID NO: 610576 - protein, 9 aa, Homo Sapiens
GTTKLVYGN

SEQ ID NO: 610577 - protein, 9 aa, Homo Sapiens
DVYQQEQAR

SEQ ID NO: 610578 - protein, 9 aa, Homo Sapiens
DTGDAVLNK

SEQ ID NO: 610579 - protein, 9 aa, Homo Sapiens
WHSGPLQTL

SEQ ID NO: 610580 - protein, 9 aa, Homo Sapiens
SLHPHLFSC

SEQ ID NO: 610581 - protein, 9 aa, Homo Sapiens
DLDSHSYLI

SEQ ID NO: 610582 - protein, 9 aa, Homo Sapiens
GASPPPAVP

SEQ ID NO: 610583 - protein, 9 aa, Homo Sapiens
HDMYYALGC

SEQ ID NO: 610584 - protein, 9 aa, Homo Sapiens
IKTILKSKL

SEQ ID NO: 610585 - protein, 9 aa, Homo Sapiens
HSQTRREEA

SEQ ID NO: 610586 - protein, 9 aa, Homo Sapiens
SRDQELAAL

SEQ ID NO: 610587 - protein, 9 aa, Homo Sapiens
KVPKMLQII

SEQ ID NO: 610588 - protein, 9 aa, Homo Sapiens
PNMEIDAFV

SEQ ID NO: 610589 - protein, 9 aa, Homo Sapiens
PVFDRTLCT

SEQ ID NO: 610590 - protein, 9 aa, Homo Sapiens
ICFTSTKVP

SEQ ID NO: 610591 - protein, 9 aa, Homo Sapiens
EYCIDTGAP

SEQ ID NO: 610592 - protein, 9 aa, Homo Sapiens
ACLLPPIQV

SEQ ID NO: 610593 - protein, 9 aa, Homo Sapiens
GTARVGVRE

SEQ ID NO: 610594 - protein, 9 aa, Homo Sapiens
ENECSLSPP

SEQ ID NO: 610595 - protein, 9 aa, Homo Sapiens
RVGVREPLV

SEQ ID NO: 610596 - protein, 9 aa, Homo Sapiens
DTAGLLEIV

SEQ ID NO: 610597 - protein, 9 aa, Homo Sapiens
GTEVQVDDV

SEQ ID NO: 610598 - protein, 9 aa, Homo Sapiens
NLSVDPNME

SEQ ID NO: 610599 - protein, 9 aa, Homo Sapiens
NKAAQILRL

SEQ ID NO: 610600 - protein, 9 aa, Homo Sapiens
DEQKRLPAF

SEQ ID NO: 610601 - protein, 9 aa, Homo Sapiens
HIQALRWIE

SEQ ID NO: 610602 - protein, 9 aa, Homo Sapiens
SAFGPGCPH

SEQ ID NO: 610603 - protein, 9 aa, Homo Sapiens
PDLDSHSYL

SEQ ID NO: 610604 - protein, 9 aa, Homo Sapiens
LLALSCSHT

SEQ ID NO: 610605 - protein, 9 aa, Homo Sapiens
SDKLKEAQT

SEQ ID NO: 610606 - protein, 9 aa, Homo Sapiens
RGPSRTLTT

SEQ ID NO: 610607 - protein, 9 aa, Homo Sapiens
PGEGHFWQL

SEQ ID NO: 610608 - protein, 9 aa, Homo Sapiens
RLRCAAPLA

SEQ ID NO: 610609 - protein, 9 aa, Homo Sapiens
WALFALFRV

SEQ ID NO: 610610 - protein, 9 aa, Homo Sapiens
KSSGTATLE

SEQ ID NO: 610611 - protein, 9 aa, Homo Sapiens
VSVFYTIRT

SEQ ID NO: 610612 - protein, 9 aa, Homo Sapiens
AAGRRMQAP

SEQ ID NO: 610613 - protein, 9 aa, Homo Sapiens
HFNIMKPYI

SEQ ID NO: 610614 - protein, 9 aa, Homo Sapiens
DYEASEPCS

SEQ ID NO: 610615 - protein, 9 aa, Homo Sapiens
AVAGNETEN

SEQ ID NO: 610616 - protein, 9 aa, Homo Sapiens
ARRYVSAVF

SEQ ID NO: 610617 - protein, 9 aa, Homo Sapiens
CSRESCASV

SEQ ID NO: 610618 - protein, 9 aa, Homo Sapiens
PSESCERPW

SEQ ID NO: 610619 - protein, 9 aa, Homo Sapiens
LLDHIQALR

SEQ ID NO: 610620 - protein, 9 aa, Homo Sapiens
PPPSLCGLA

SEQ ID NO: 610621 - protein, 9 aa, Homo Sapiens
SCSVNKWVI

SEQ ID NO: 610622 - protein, 9 aa, Homo Sapiens
RIFVEEFRP

SEQ ID NO: 610623 - protein, 9 aa, Homo Sapiens
FVSHYIFQK

SEQ ID NO: 610624 - protein, 9 aa, Homo Sapiens
YDFLPVLMY

SEQ ID NO: 610625 - protein, 9 aa, Homo Sapiens
SRAASHRCF

SEQ ID NO: 610626 - protein, 9 aa, Homo Sapiens
RLCHPRCIE

SEQ ID NO: 610627 - protein, 9 aa, Homo Sapiens
AYRHAQIMI

SEQ ID NO: 610628 - protein, 9 aa, Homo Sapiens
QKKEKLRKQ

SEQ ID NO: 610629 - protein, 9 aa, Homo Sapiens
ERRLLSPMY

SEQ ID NO: 610630 - protein, 9 aa, Homo Sapiens
LRRELEAKA

SEQ ID NO: 610631 - protein, 9 aa, Homo Sapiens
TGTVFCPRL

SEQ ID NO: 610632 - protein, 9 aa, Homo Sapiens
WKETGWSKH

SEQ ID NO: 610633 - protein, 9 aa, Homo Sapiens
VNVQPIDYG

SEQ ID NO: 610634 - protein, 9 aa, Homo Sapiens
SGTQYLTQV

SEQ ID NO: 610635 - protein, 9 aa, Homo Sapiens
LVVTTPAVS

SEQ ID NO: 610636 - protein, 9 aa, Homo Sapiens
SVGPDGDIY

SEQ ID NO: 610637 - protein, 9 aa, Homo Sapiens
LQSLVDILP

SEQ ID NO: 610638 - protein, 9 aa, Homo Sapiens
HTGEKLYQC

SEQ ID NO: 610639 - protein, 9 aa, Homo Sapiens
ESHLTKQSS

SEQ ID NO: 610640 - protein, 9 aa, Homo Sapiens
GIAVIRNFL

SEQ ID NO: 610641 - protein, 9 aa, Homo Sapiens
ILFHPSLLF

SEQ ID NO: 610642 - protein, 9 aa, Homo Sapiens
TCSGCKAAR

SEQ ID NO: 610643 - protein, 9 aa, Homo Sapiens
CPQLLPRGI

SEQ ID NO: 610644 - protein, 9 aa, Homo Sapiens
KRRGGKNRK

SEQ ID NO: 610645 - protein, 9 aa, Homo Sapiens
KFLDTYTLT

SEQ ID NO: 610646 - protein, 9 aa, Homo Sapiens
FLMLNLFVD

SEQ ID NO: 610647 - protein, 9 aa, Homo Sapiens
GEGRGDPCE

SEQ ID NO: 610648 - protein, 9 aa, Homo Sapiens
ELPKLFCSL

SEQ ID NO: 610649 - protein, 9 aa, Homo Sapiens
ITKQEKDFL

SEQ ID NO: 610650 - protein, 9 aa, Homo Sapiens
LLFSSDSNG

SEQ ID NO: 610651 - protein, 9 aa, Homo Sapiens
CVGIELHAV

SEQ ID NO: 610652 - protein, 9 aa, Homo Sapiens
YDTTATTEA

SEQ ID NO: 610653 - protein, 9 aa, Homo Sapiens
QIAYLKKKL

SEQ ID NO: 610654 - protein, 9 aa, Homo Sapiens
TGVLTATTE

SEQ ID NO: 610655 - protein, 9 aa, Homo Sapiens
DVYDEVSYT

SEQ ID NO: 610656 - protein, 9 aa, Homo Sapiens
GYYRIVKGL

SEQ ID NO: 610657 - protein, 9 aa, Homo Sapiens
HCVPRSHSC

SEQ ID NO: 610658 - protein, 9 aa, Homo Sapiens
VQEEQGGLS

SEQ ID NO: 610659 - protein, 9 aa, Homo Sapiens
TCYMFNMYV

SEQ ID NO: 610660 - protein, 9 aa, Homo Sapiens
LLYGCIHAI

SEQ ID NO: 610661 - protein, 9 aa, Homo Sapiens
ELHSRTHKS

SEQ ID NO: 610662 - protein, 9 aa, Homo Sapiens
RPEATVAVP

SEQ ID NO: 610663 - protein, 9 aa, Homo Sapiens
PAQLRWHSG

SEQ ID NO: 610664 - protein, 9 aa, Homo Sapiens
PTYMRHTED

SEQ ID NO: 610665 - protein, 9 aa, Homo Sapiens
IDTGAPDGS

SEQ ID NO: 610666 - protein, 9 aa, Homo Sapiens
VPIVHSAQS

SEQ ID NO: 610667 - protein, 9 aa, Homo Sapiens
AKNESKLPP

SEQ ID NO: 610668 - protein, 9 aa, Homo Sapiens
SGPLQTLAR

SEQ ID NO: 610669 - protein, 9 aa, Homo Sapiens
TLNKPEKLK

SEQ ID NO: 610670 - protein, 9 aa, Homo Sapiens
SSTPPRDLY

SEQ ID NO: 610671 - protein, 9 aa, Homo Sapiens
GFVISNQDL

SEQ ID NO: 610672 - protein, 9 aa, Homo Sapiens
LQLINQETS

SEQ ID NO: 610673 - protein, 9 aa, Homo Sapiens
HRDPPEEEV

SEQ ID NO: 610674 - protein, 9 aa, Homo Sapiens
IGPCAGRDC

SEQ ID NO: 610675 - protein, 9 aa, Homo Sapiens
QWRGAHRQA

SEQ ID NO: 610676 - protein, 9 aa, Homo Sapiens
FGESHLTKQ

SEQ ID NO: 610677 - protein, 9 aa, Homo Sapiens
YELMRERHL

SEQ ID NO: 610678 - protein, 9 aa, Homo Sapiens
RSLAKEVAR

SEQ ID NO: 610679 - protein, 9 aa, Homo Sapiens
TILKSKLEQ

SEQ ID NO: 610680 - protein, 9 aa, Homo Sapiens
FDRTLCTVK

SEQ ID NO: 610681 - protein, 9 aa, Homo Sapiens
RFSRATARR

SEQ ID NO: 610682 - protein, 9 aa, Homo Sapiens
NSDWIRLDP

SEQ ID NO: 610683 - protein, 9 aa, Homo Sapiens
LGNYRSFLG

SEQ ID NO: 610684 - protein, 9 aa, Homo Sapiens
RRGRRPTSG

SEQ ID NO: 610685 - protein, 9 aa, Homo Sapiens
IGLCLTKNI

SEQ ID NO: 610686 - protein, 9 aa, Homo Sapiens
LLWHEGCPA

SEQ ID NO: 610687 - protein, 9 aa, Homo Sapiens
NTRNIKSIR

SEQ ID NO: 610688 - protein, 9 aa, Homo Sapiens
ALPLLGVPV

SEQ ID NO: 610689 - protein, 9 aa, Homo Sapiens
TCFNDAVSR

SEQ ID NO: 610690 - protein, 9 aa, Homo Sapiens
TNRFCSVSC

SEQ ID NO: 610691 - protein, 9 aa, Homo Sapiens
LNHLIYSLR

SEQ ID NO: 610692 - protein, 9 aa, Homo Sapiens
RTLCRLLQI

SEQ ID NO: 610693 - protein, 9 aa, Homo Sapiens
VVILFFGEG

SEQ ID NO: 610694 - protein, 9 aa, Homo Sapiens
GSRIEEVVP

SEQ ID NO: 610695 - protein, 9 aa, Homo Sapiens
RDVYQQEQA

SEQ ID NO: 610696 - protein, 9 aa, Homo Sapiens
LVFSVAELQ

SEQ ID NO: 610697 - protein, 9 aa, Homo Sapiens
RIEEVVPQF

SEQ ID NO: 610698 - protein, 9 aa, Homo Sapiens
QHMEGTHIN

SEQ ID NO: 610699 - protein, 9 aa, Homo Sapiens
KEIASLTGT

SEQ ID NO: 610700 - protein, 9 aa, Homo Sapiens
KVSLEGRST

SEQ ID NO: 610701 - protein, 9 aa, Homo Sapiens
LTRLNQEEV

SEQ ID NO: 610702 - protein, 9 aa, Homo Sapiens
LSRAASHRC

SEQ ID NO: 610703 - protein, 9 aa, Homo Sapiens
SIPTYMRHT

SEQ ID NO: 610704 - protein, 9 aa, Homo Sapiens
GPTGPAPPF

SEQ ID NO: 610705 - protein, 9 aa, Homo Sapiens
KEESTEKVK

SEQ ID NO: 610706 - protein, 9 aa, Homo Sapiens
RYRAAAAKN

SEQ ID NO: 610707 - protein, 9 aa, Homo Sapiens
TSPGDGAGA

SEQ ID NO: 610708 - protein, 9 aa, Homo Sapiens
PRDLYSKAC

SEQ ID NO: 610709 - protein, 9 aa, Homo Sapiens
VTESHYLHL

SEQ ID NO: 610710 - protein, 9 aa, Homo Sapiens
LFLRLYLLT

SEQ ID NO: 610711 - protein, 9 aa, Homo Sapiens
AEGTEQQRL

SEQ ID NO: 610712 - protein, 9 aa, Homo Sapiens
GSSSTFAGL

SEQ ID NO: 610713 - protein, 9 aa, Homo Sapiens
RTRPWRRPW

SEQ ID NO: 610714 - protein, 9 aa, Homo Sapiens
STARGLGPS

SEQ ID NO: 610715 - protein, 9 aa, Homo Sapiens
ECGKSYISH

SEQ ID NO: 610716 - protein, 9 aa, Homo Sapiens
KRRRRRKMT

SEQ ID NO: 610717 - protein, 9 aa, Homo Sapiens
PKASCQASA

SEQ ID NO: 610718 - protein, 9 aa, Homo Sapiens
GRETESGSQ

SEQ ID NO: 610719 - protein, 9 aa, Homo Sapiens
HCPFDKLSR

SEQ ID NO: 610720 - protein, 9 aa, Homo Sapiens
VTAERIERE

SEQ ID NO: 610721 - protein, 9 aa, Homo Sapiens
EGVAGFFEV

SEQ ID NO: 610722 - protein, 9 aa, Homo Sapiens
RQGQSSHYC

SEQ ID NO: 610723 - protein, 9 aa, Homo Sapiens
PEVFLKPWI

SEQ ID NO: 610724 - protein, 9 aa, Homo Sapiens
VPEYQLENQ

SEQ ID NO: 610725 - protein, 9 aa, Homo Sapiens
SEYSFVEIR

SEQ ID NO: 610726 - protein, 9 aa, Homo Sapiens
NTGVRLKRL

SEQ ID NO: 610727 - protein, 9 aa, Homo Sapiens
LLRDTFVFQ

SEQ ID NO: 610728 - protein, 9 aa, Homo Sapiens
VNNCIGHCN

SEQ ID NO: 610729 - protein, 9 aa, Homo Sapiens
CAYSLSIRD

SEQ ID NO: 610730 - protein, 9 aa, Homo Sapiens
LCNFASRND

SEQ ID NO: 610731 - protein, 9 aa, Homo Sapiens
NMYVGVRAG

SEQ ID NO: 610732 - protein, 9 aa, Homo Sapiens
ELLMDEAAM

SEQ ID NO: 610733 - protein, 9 aa, Homo Sapiens
VQVDDVKRV

SEQ ID NO: 610734 - protein, 9 aa, Homo Sapiens
LFRKLFSHY

SEQ ID NO: 610735 - protein, 9 aa, Homo Sapiens
TQYLTQVMT

SEQ ID NO: 610736 - protein, 9 aa, Homo Sapiens
LRWHSGPLQ

SEQ ID NO: 610737 - protein, 9 aa, Homo Sapiens
DEKGFTPLM

SEQ ID NO: 610738 - protein, 9 aa, Homo Sapiens
MLSFLHFLV

SEQ ID NO: 610739 - protein, 9 aa, Homo Sapiens
LTKQSSCSR

SEQ ID NO: 610740 - protein, 9 aa, Homo Sapiens
QTRAEFAER

SEQ ID NO: 610741 - protein, 9 aa, Homo Sapiens
CQASAGATG

SEQ ID NO: 610742 - protein, 9 aa, Homo Sapiens
DRTLCTVKL

SEQ ID NO: 610743 - protein, 9 aa, Homo Sapiens
APTPRPPRP

SEQ ID NO: 610744 - protein, 9 aa, Homo Sapiens
GGLSGSLLG

SEQ ID NO: 610745 - protein, 9 aa, Homo Sapiens
VRNFGNRDA

SEQ ID NO: 610746 - protein, 9 aa, Homo Sapiens
NKWVIFRNG

SEQ ID NO: 610747 - protein, 9 aa, Homo Sapiens
LEEDSCDYS

SEQ ID NO: 610748 - protein, 9 aa, Homo Sapiens
FSAYFNIPS

SEQ ID NO: 610749 - protein, 9 aa, Homo Sapiens
MDGLEYCHK

SEQ ID NO: 610750 - protein, 9 aa, Homo Sapiens
SLARTCSRE

SEQ ID NO: 610751 - protein, 9 aa, Homo Sapiens
RRMQAPWRE

SEQ ID NO: 610752 - protein, 9 aa, Homo Sapiens
IDRLRSEYV

SEQ ID NO: 610753 - protein, 9 aa, Homo Sapiens
CLGVSVTVE

SEQ ID NO: 610754 - protein, 9 aa, Homo Sapiens
LLQRFNSTH

SEQ ID NO: 610755 - protein, 9 aa, Homo Sapiens
SSVINHFYS

SEQ ID NO: 610756 - protein, 9 aa, Homo Sapiens
MTAGSYLAG

SEQ ID NO: 610757 - protein, 9 aa, Homo Sapiens
ARRKIRRGP

SEQ ID NO: 610758 - protein, 9 aa, Homo Sapiens
LSAKGSNAI

SEQ ID NO: 610759 - protein, 9 aa, Homo Sapiens
LPRSVLLEP

SEQ ID NO: 610760 - protein, 9 aa, Homo Sapiens
LGLARKPAG

SEQ ID NO: 610761 - protein, 9 aa, Homo Sapiens
QNTTGTVFC

SEQ ID NO: 610762 - protein, 9 aa, Homo Sapiens
PTRGPSRTL

SEQ ID NO: 610763 - protein, 9 aa, Homo Sapiens
GCYLPQTHS

SEQ ID NO: 610764 - protein, 9 aa, Homo Sapiens
QIRKMLSSE

SEQ ID NO: 610765 - protein, 9 aa, Homo Sapiens
LNPHGMSAS

SEQ ID NO: 610766 - protein, 9 aa, Homo Sapiens
FMKGWRPKI

SEQ ID NO: 610767 - protein, 9 aa, Homo Sapiens
QRCRAAAAG

SEQ ID NO: 610768 - protein, 9 aa, Homo Sapiens
PRALPSTLF

SEQ ID NO: 610769 - protein, 9 aa, Homo Sapiens
IHGLLPCRS

SEQ ID NO: 610770 - protein, 9 aa, Homo Sapiens
HRCQACGKS

SEQ ID NO: 610771 - protein, 9 aa, Homo Sapiens
NSITQHTLH

SEQ ID NO: 610772 - protein, 9 aa, Homo Sapiens
PVLIVHVDS

SEQ ID NO: 610773 - protein, 9 aa, Homo Sapiens
FGYFGILLS

SEQ ID NO: 610774 - protein, 9 aa, Homo Sapiens
GGMAGTFAL

SEQ ID NO: 610775 - protein, 9 aa, Homo Sapiens
YISPEALKH

SEQ ID NO: 610776 - protein, 9 aa, Homo Sapiens
LKKQRAYLG

SEQ ID NO: 610777 - protein, 9 aa, Homo Sapiens
TEYARKRTA

SEQ ID NO: 610778 - protein, 9 aa, Homo Sapiens
GAWRFPGLP

SEQ ID NO: 610779 - protein, 9 aa, Homo Sapiens
VQDTTTANT

SEQ ID NO: 610780 - protein, 9 aa, Homo Sapiens
KLSRNEAQV

SEQ ID NO: 610781 - protein, 9 aa, Homo Sapiens
VHAKNSYTH

SEQ ID NO: 610782 - protein, 9 aa, Homo Sapiens
GVLIGKGLN

SEQ ID NO: 610783 - protein, 9 aa, Homo Sapiens
SLIVHQILH

SEQ ID NO: 610784 - protein, 9 aa, Homo Sapiens
ASLARKATL

SEQ ID NO: 610785 - protein, 9 aa, Homo Sapiens
PTSGCGAAW

SEQ ID NO: 610786 - protein, 9 aa, Homo Sapiens
TLTLKIHGW

SEQ ID NO: 610787 - protein, 9 aa, Homo Sapiens
VDCETQNLN

SEQ ID NO: 610788 - protein, 9 aa, Homo Sapiens
IFSLFCTVI

SEQ ID NO: 610789 - protein, 9 aa, Homo Sapiens
QILLEKGAK

SEQ ID NO: 610790 - protein, 9 aa, Homo Sapiens
GSWLGVAQL

SEQ ID NO: 610791 - protein, 9 aa, Homo Sapiens
EPSPPYNSM

SEQ ID NO: 610792 - protein, 9 aa, Homo Sapiens
AAPAPAQLR

SEQ ID NO: 610793 - protein, 9 aa, Homo Sapiens
GLSVGQIHV

SEQ ID NO: 610794 - protein, 9 aa, Homo Sapiens
RDCFPYSNY

SEQ ID NO: 610795 - protein, 9 aa, Homo Sapiens
ESETTKCAY

SEQ ID NO: 610796 - protein, 9 aa, Homo Sapiens
GAMGWAFVL

SEQ ID NO: 610797 - protein, 9 aa, Homo Sapiens
TREPHASES

SEQ ID NO: 610798 - protein, 9 aa, Homo Sapiens
LELLMDEAA

SEQ ID NO: 610799 - protein, 9 aa, Homo Sapiens
VGGAMVFFL

SEQ ID NO: 610800 - protein, 9 aa, Homo Sapiens
EDYCEGSEA

SEQ ID NO: 610801 - protein, 9 aa, Homo Sapiens
SSWKVEFGP

SEQ ID NO: 610802 - protein, 9 aa, Homo Sapiens
GTPHYISPE

SEQ ID NO: 610803 - protein, 9 aa, Homo Sapiens
AALLTKTYR

SEQ ID NO: 610804 - protein, 9 aa, Homo Sapiens
IMPLVFRDS

SEQ ID NO: 610805 - protein, 9 aa, Homo Sapiens
RSCSLLGCG

SEQ ID NO: 610806 - protein, 9 aa, Homo Sapiens
VDGTITTQL

SEQ ID NO: 610807 - protein, 9 aa, Homo Sapiens
LFCNINNLC

SEQ ID NO: 610808 - protein, 9 aa, Homo Sapiens
YVSAVFRGC

SEQ ID NO: 610809 - protein, 9 aa, Homo Sapiens
RVLACSLPE

SEQ ID NO: 610810 - protein, 9 aa, Homo Sapiens
GVFPERVGD

SEQ ID NO: 610811 - protein, 9 aa, Homo Sapiens
AVAAVRLGP

SEQ ID NO: 610812 - protein, 9 aa, Homo Sapiens
PARASWRSP

SEQ ID NO: 610813 - protein, 9 aa, Homo Sapiens
ALSFGHQQL

SEQ ID NO: 610814 - protein, 9 aa, Homo Sapiens
LSEITKQEK

SEQ ID NO: 610815 - protein, 9 aa, Homo Sapiens
EAQVDGARA

SEQ ID NO: 610816 - protein, 9 aa, Homo Sapiens
PPQRYKPLP

SEQ ID NO: 610817 - protein, 9 aa, Homo Sapiens
SYEYRTLLF

SEQ ID NO: 610818 - protein, 9 aa, Homo Sapiens
WEALGVESH

SEQ ID NO: 610819 - protein, 9 aa, Homo Sapiens
LDPWECYQD

SEQ ID NO: 610820 - protein, 9 aa, Homo Sapiens
YKKPLYCIS

SEQ ID NO: 610821 - protein, 9 aa, Homo Sapiens
GLVENGGLG

SEQ ID NO: 610822 - protein, 9 aa, Homo Sapiens
YWAGMAAIK

SEQ ID NO: 610823 - protein, 9 aa, Homo Sapiens
GDMCSPNST

SEQ ID NO: 610824 - protein, 9 aa, Homo Sapiens
SLWNIVRNN

SEQ ID NO: 610825 - protein, 9 aa, Homo Sapiens
ASYQRPLLV

SEQ ID NO: 610826 - protein, 9 aa, Homo Sapiens
RIVKGLPND

SEQ ID NO: 610827 - protein, 9 aa, Homo Sapiens
LSQTGFSYD

SEQ ID NO: 610828 - protein, 9 aa, Homo Sapiens
VESSMRKSA

SEQ ID NO: 610829 - protein, 9 aa, Homo Sapiens
VLMLLDCYG

SEQ ID NO: 610830 - protein, 9 aa, Homo Sapiens
FVQQLWDTA

SEQ ID NO: 610831 - protein, 9 aa, Homo Sapiens
TEDAFTPLA

SEQ ID NO: 610832 - protein, 9 aa, Homo Sapiens
METINVDRD

SEQ ID NO: 610833 - protein, 9 aa, Homo Sapiens
LPIWGSLNG

SEQ ID NO: 610834 - protein, 9 aa, Homo Sapiens
EDFGPGKGW

SEQ ID NO: 610835 - protein, 9 aa, Homo Sapiens
NVSDSLEIQ

SEQ ID NO: 610836 - protein, 9 aa, Homo Sapiens
PSVNPMEEE

SEQ ID NO: 610837 - protein, 9 aa, Homo Sapiens
TFTVWPYIC

SEQ ID NO: 610838 - protein, 9 aa, Homo Sapiens
YNQKGVFPG

SEQ ID NO: 610839 - protein, 9 aa, Homo Sapiens
LTDVEAKVL

SEQ ID NO: 610840 - protein, 9 aa, Homo Sapiens
FSKTNRFCS

SEQ ID NO: 610841 - protein, 9 aa, Homo Sapiens
SGGWTASAA

SEQ ID NO: 610842 - protein, 9 aa, Homo Sapiens
LGNYGLSCQ

SEQ ID NO: 610843 - protein, 9 aa, Homo Sapiens
CKKCGKANT

SEQ ID NO: 610844 - protein, 9 aa, Homo Sapiens
LCYDLDFEK

SEQ ID NO: 610845 - protein, 9 aa, Homo Sapiens
TLELLLWHE

SEQ ID NO: 610846 - protein, 9 aa, Homo Sapiens
FGILLSREG

SEQ ID NO: 610847 - protein, 9 aa, Homo Sapiens
PPGGGSGCE

SEQ ID NO: 610848 - protein, 9 aa, Homo Sapiens
EEVPFCTLK

SEQ ID NO: 610849 - protein, 9 aa, Homo Sapiens
LKEAQTRAE

SEQ ID NO: 610850 - protein, 9 aa, Homo Sapiens
VGLSVGQIH

SEQ ID NO: 610851 - protein, 9 aa, Homo Sapiens
SDEAQRVFE

SEQ ID NO: 610852 - protein, 9 aa, Homo Sapiens
KWVDGVDKI

SEQ ID NO: 610853 - protein, 9 aa, Homo Sapiens
DGFTYTGAY

SEQ ID NO: 610854 - protein, 9 aa, Homo Sapiens
RDGSKFSMT

SEQ ID NO: 610855 - protein, 9 aa, Homo Sapiens
LALLDRPLL

SEQ ID NO: 610856 - protein, 9 aa, Homo Sapiens
DAAVHPACQ

SEQ ID NO: 610857 - protein, 9 aa, Homo Sapiens
LQDSNSREP

SEQ ID NO: 610858 - protein, 9 aa, Homo Sapiens
KKEEAKRKQ

SEQ ID NO: 610859 - protein, 9 aa, Homo Sapiens
QPASYQRPL

SEQ ID NO: 610860 - protein, 9 aa, Homo Sapiens
CTNSLQVRR

SEQ ID NO: 610861 - protein, 9 aa, Homo Sapiens
VENGGLGWW

SEQ ID NO: 610862 - protein, 9 aa, Homo Sapiens
LRDSTPLEP

SEQ ID NO: 610863 - protein, 9 aa, Homo Sapiens
RLLQRFNST

SEQ ID NO: 610864 - protein, 9 aa, Homo Sapiens
GPGKGWEVI

SEQ ID NO: 610865 - protein, 9 aa, Homo Sapiens
SRPPSSTNN

SEQ ID NO: 610866 - protein, 9 aa, Homo Sapiens
ARPGGCERA

SEQ ID NO: 610867 - protein, 9 aa, Homo Sapiens
AGVLLQHIE

SEQ ID NO: 610868 - protein, 9 aa, Homo Sapiens
RRSFITAVT

SEQ ID NO: 610869 - protein, 9 aa, Homo Sapiens
GGLVGFSRS

SEQ ID NO: 610870 - protein, 9 aa, Homo Sapiens
DHRDHILRR

SEQ ID NO: 610871 - protein, 9 aa, Homo Sapiens
RTCLGVNLK

SEQ ID NO: 610872 - protein, 9 aa, Homo Sapiens
KKIMQFMKG

SEQ ID NO: 610873 - protein, 9 aa, Homo Sapiens
AGFFEVFCQ

SEQ ID NO: 610874 - protein, 9 aa, Homo Sapiens
HDPGTPLCG

SEQ ID NO: 610875 - protein, 9 aa, Homo Sapiens
VVQVGIAGI

SEQ ID NO: 610876 - protein, 9 aa, Homo Sapiens
LNTFIYTLR

SEQ ID NO: 610877 - protein, 9 aa, Homo Sapiens
LNSYLEMDM

SEQ ID NO: 610878 - protein, 9 aa, Homo Sapiens
VVALGRAVA

SEQ ID NO: 610879 - protein, 9 aa, Homo Sapiens
GCGAAWRPE

SEQ ID NO: 610880 - protein, 9 aa, Homo Sapiens
TNLRLTCKR

SEQ ID NO: 610881 - protein, 9 aa, Homo Sapiens
GTVFCPRLY

SEQ ID NO: 610882 - protein, 9 aa, Homo Sapiens
GRRPTSGCG

SEQ ID NO: 610883 - protein, 9 aa, Homo Sapiens
LGVKESDWL

SEQ ID NO: 610884 - protein, 9 aa, Homo Sapiens
YVRKFLLTF

SEQ ID NO: 610885 - protein, 9 aa, Homo Sapiens
NSLQVRRQF

SEQ ID NO: 610886 - protein, 9 aa, Homo Sapiens
GPDPHSQTR

SEQ ID NO: 610887 - protein, 9 aa, Homo Sapiens
FFFHFVGGA

SEQ ID NO: 610888 - protein, 9 aa, Homo Sapiens
PANGGRDFT

SEQ ID NO: 610889 - protein, 9 aa, Homo Sapiens
PPLPLSAKG

SEQ ID NO: 610890 - protein, 9 aa, Homo Sapiens
QPYGRSPSR

SEQ ID NO: 610891 - protein, 9 aa, Homo Sapiens
DVKVFGESH

SEQ ID NO: 610892 - protein, 9 aa, Homo Sapiens
SRFYLVART

SEQ ID NO: 610893 - protein, 9 aa, Homo Sapiens
RQQWRRPRV

SEQ ID NO: 610894 - protein, 9 aa, Homo Sapiens
LFAYWEKLW

SEQ ID NO: 610895 - protein, 9 aa, Homo Sapiens
AEVLSSLLV

SEQ ID NO: 610896 - protein, 9 aa, Homo Sapiens
VSLATAVCK

SEQ ID NO: 610897 - protein, 9 aa, Homo Sapiens
DMYYALGCS

SEQ ID NO: 610898 - protein, 9 aa, Homo Sapiens
SVAPLLNTF

SEQ ID NO: 610899 - protein, 9 aa, Homo Sapiens
GLYVEVKIV

SEQ ID NO: 610900 - protein, 9 aa, Homo Sapiens
VEKSRTVSF

SEQ ID NO: 610901 - protein, 9 aa, Homo Sapiens
GNSDGYLIP

SEQ ID NO: 610902 - protein, 9 aa, Homo Sapiens
YYRMHTKIN

SEQ ID NO: 610903 - protein, 9 aa, Homo Sapiens
VAILGSVGG

SEQ ID NO: 610904 - protein, 9 aa, Homo Sapiens
FIWCCLNLK

SEQ ID NO: 610905 - protein, 9 aa, Homo Sapiens
TLPVLKRRC

SEQ ID NO: 610906 - protein, 9 aa, Homo Sapiens
SPSLQHNTS

SEQ ID NO: 610907 - protein, 9 aa, Homo Sapiens
ISPEALKHQ

SEQ ID NO: 610908 - protein, 9 aa, Homo Sapiens
DSLSTLIGS

SEQ ID NO: 610909 - protein, 9 aa, Homo Sapiens
EVCTSTVQL

SEQ ID NO: 610910 - protein, 9 aa, Homo Sapiens
THTLRMIGQ

SEQ ID NO: 610911 - protein, 9 aa, Homo Sapiens
FSQSPHVVI

SEQ ID NO: 610912 - protein, 9 aa, Homo Sapiens
KEEAKRKQK

SEQ ID NO: 610913 - protein, 9 aa, Homo Sapiens
ISGIILRRN

SEQ ID NO: 610914 - protein, 9 aa, Homo Sapiens
CAAPLALLD

SEQ ID NO: 610915 - protein, 9 aa, Homo Sapiens
LPVLKRRCV

SEQ ID NO: 610916 - protein, 9 aa, Homo Sapiens
ADNKALAWQ

SEQ ID NO: 610917 - protein, 9 aa, Homo Sapiens
DTTTANTTL

SEQ ID NO: 610918 - protein, 9 aa, Homo Sapiens
KMLETKCSL

SEQ ID NO: 610919 - protein, 9 aa, Homo Sapiens
EDDMPIGTN

SEQ ID NO: 610920 - protein, 9 aa, Homo Sapiens
TKHRKIQQC

SEQ ID NO: 610921 - protein, 9 aa, Homo Sapiens
GLYVPEYQL

SEQ ID NO: 610922 - protein, 9 aa, Homo Sapiens
IVVSLSFSI

SEQ ID NO: 610923 - protein, 9 aa, Homo Sapiens
AAAEAALSQ

SEQ ID NO: 610924 - protein, 9 aa, Homo Sapiens
SRVIKRSSS

SEQ ID NO: 610925 - protein, 9 aa, Homo Sapiens
GSCGYGGLG

SEQ ID NO: 610926 - protein, 9 aa, Homo Sapiens
FCTVITPML

SEQ ID NO: 610927 - protein, 9 aa, Homo Sapiens
KKGAEKSDS

SEQ ID NO: 610928 - protein, 9 aa, Homo Sapiens
LRKTEEPRS

SEQ ID NO: 610929 - protein, 9 aa, Homo Sapiens
LTLKIHGWK

SEQ ID NO: 610930 - protein, 9 aa, Homo Sapiens
FFETCALDN

SEQ ID NO: 610931 - protein, 9 aa, Homo Sapiens
RALRIVSFT

SEQ ID NO: 610932 - protein, 9 aa, Homo Sapiens
GQAPKASCQ

SEQ ID NO: 610933 - protein, 9 aa, Homo Sapiens
KTCGPSPET

SEQ ID NO: 610934 - protein, 9 aa, Homo Sapiens
AGPDPHSQT

SEQ ID NO: 610935 - protein, 9 aa, Homo Sapiens
AAAAANPKT

SEQ ID NO: 610936 - protein, 9 aa, Homo Sapiens
SPLSPELNN

SEQ ID NO: 610937 - protein, 9 aa, Homo Sapiens
TLCRLLQIT

SEQ ID NO: 610938 - protein, 9 aa, Homo Sapiens
KQMQRYQEP

SEQ ID NO: 610939 - protein, 9 aa, Homo Sapiens
AQSLLSLCK

SEQ ID NO: 610940 - protein, 9 aa, Homo Sapiens
ENIILVGKL

SEQ ID NO: 610941 - protein, 9 aa, Homo Sapiens
ETCSGCKAA

SEQ ID NO: 610942 - protein, 9 aa, Homo Sapiens
SNLHSGTTY

SEQ ID NO: 610943 - protein, 9 aa, Homo Sapiens
ANGGRDFTD

SEQ ID NO: 610944 - protein, 9 aa, Homo Sapiens
SFNGEVNVV

SEQ ID NO: 610945 - protein, 9 aa, Homo Sapiens
MYMQSGSDS

SEQ ID NO: 610946 - protein, 9 aa, Homo Sapiens
TGTTKLVYG

SEQ ID NO: 610947 - protein, 9 aa, Homo Sapiens
SAELYYQDP

SEQ ID NO: 610948 - protein, 9 aa, Homo Sapiens
LIKIASREL

SEQ ID NO: 610949 - protein, 9 aa, Homo Sapiens
APLLPPRCI

SEQ ID NO: 610950 - protein, 9 aa, Homo Sapiens
TASLRFSRA

SEQ ID NO: 610951 - protein, 9 aa, Homo Sapiens
IGQKREVGA

SEQ ID NO: 610952 - protein, 9 aa, Homo Sapiens
GLFGVWAQW

SEQ ID NO: 610953 - protein, 9 aa, Homo Sapiens
SLPRGTAIH

SEQ ID NO: 610954 - protein, 9 aa, Homo Sapiens
SISQERSTL

SEQ ID NO: 610955 - protein, 9 aa, Homo Sapiens
MQRYQEPCS

SEQ ID NO: 610956 - protein, 9 aa, Homo Sapiens
PLQTLARCR

SEQ ID NO: 610957 - protein, 9 aa, Homo Sapiens
FTDPLYEEK

SEQ ID NO: 610958 - protein, 9 aa, Homo Sapiens
VALGRAVAG

SEQ ID NO: 610959 - protein, 9 aa, Homo Sapiens
GFNGTFTVW

SEQ ID NO: 610960 - protein, 9 aa, Homo Sapiens
NDRGNTAAY

SEQ ID NO: 610961 - protein, 9 aa, Homo Sapiens
ETLKQLENL

SEQ ID NO: 610962 - protein, 9 aa, Homo Sapiens
HSHPHWHPH

SEQ ID NO: 610963 - protein, 9 aa, Homo Sapiens
EGDTVSQFH

SEQ ID NO: 610964 - protein, 9 aa, Homo Sapiens
PCKMCESRH

SEQ ID NO: 610965 - protein, 9 aa, Homo Sapiens
APRKGKRGQ

SEQ ID NO: 610966 - protein, 9 aa, Homo Sapiens
FEHTLHLIR

SEQ ID NO: 610967 - protein, 9 aa, Homo Sapiens
PERRGRRPT

SEQ ID NO: 610968 - protein, 9 aa, Homo Sapiens
SFPLHESIL

SEQ ID NO: 610969 - protein, 9 aa, Homo Sapiens
LTVAEFKKI

SEQ ID NO: 610970 - protein, 9 aa, Homo Sapiens
YSPNIYPGA

SEQ ID NO: 610971 - protein, 9 aa, Homo Sapiens
CVLTLTPTP

SEQ ID NO: 610972 - protein, 9 aa, Homo Sapiens
MWLAINLKQ

SEQ ID NO: 610973 - protein, 9 aa, Homo Sapiens
TVAEFKKIY

SEQ ID NO: 610974 - protein, 9 aa, Homo Sapiens
LTCFNDAVS

SEQ ID NO: 610975 - protein, 9 aa, Homo Sapiens
LLDSITGPL

SEQ ID NO: 610976 - protein, 9 aa, Homo Sapiens
VSLSFSIPR

SEQ ID NO: 610977 - protein, 9 aa, Homo Sapiens
NQDLVTCLE

SEQ ID NO: 610978 - protein, 9 aa, Homo Sapiens
IDGDDIHGL

SEQ ID NO: 610979 - protein, 9 aa, Homo Sapiens
AGLHQHERM

SEQ ID NO: 610980 - protein, 9 aa, Homo Sapiens
SSTFAGLHQ

SEQ ID NO: 610981 - protein, 9 aa, Homo Sapiens
QQVSAHQEA

SEQ ID NO: 610982 - protein, 9 aa, Homo Sapiens
SFILYQDDL

SEQ ID NO: 610983 - protein, 9 aa, Homo Sapiens
PIPSVTKKR

SEQ ID NO: 610984 - protein, 9 aa, Homo Sapiens
SLPSSLKVP

SEQ ID NO: 610985 - protein, 9 aa, Homo Sapiens
PWCNQKTEH

SEQ ID NO: 610986 - protein, 9 aa, Homo Sapiens
TFAGLHQHE

SEQ ID NO: 610987 - protein, 9 aa, Homo Sapiens
WRFPGLPLL

SEQ ID NO: 610988 - protein, 9 aa, Homo Sapiens
KIFSLFCTV

SEQ ID NO: 610989 - protein, 9 aa, Homo Sapiens
GDTKLKPYI

SEQ ID NO: 610990 - protein, 9 aa, Homo Sapiens
LFIVFRKNV

SEQ ID NO: 610991 - protein, 9 aa, Homo Sapiens
EMASDDLRE

SEQ ID NO: 610992 - protein, 9 aa, Homo Sapiens
LPGRAKSVH

SEQ ID NO: 610993 - protein, 9 aa, Homo Sapiens
QVGIAGIRA

SEQ ID NO: 610994 - protein, 9 aa, Homo Sapiens
LKRLIKMSH

SEQ ID NO: 610995 - protein, 9 aa, Homo Sapiens
RLCTEIVAI

SEQ ID NO: 610996 - protein, 9 aa, Homo Sapiens
WENGLSYEY

SEQ ID NO: 610997 - protein, 9 aa, Homo Sapiens
LRNELLVTA

SEQ ID NO: 610998 - protein, 9 aa, Homo Sapiens
WRRSFITAV

SEQ ID NO: 610999 - protein, 9 aa, Homo Sapiens
AQSFALSLC

SEQ ID NO: 611000 - protein, 9 aa, Homo Sapiens
QETSSAHTT

SEQ ID NO: 611001 - protein, 9 aa, Homo Sapiens
VSWDLWSTL

SEQ ID NO: 611002 - protein, 9 aa, Homo Sapiens
LYQCNECGK

SEQ ID NO: 611003 - protein, 9 aa, Homo Sapiens
YTCHCPFDK

SEQ ID NO: 611004 - protein, 9 aa, Homo Sapiens
ASAPAEATV

SEQ ID NO: 611005 - protein, 9 aa, Homo Sapiens
TFACNLSRK

SEQ ID NO: 611006 - protein, 9 aa, Homo Sapiens
PLNQRGFFG

SEQ ID NO: 611007 - protein, 9 aa, Homo Sapiens
LIALIGNLS

SEQ ID NO: 611008 - protein, 9 aa, Homo Sapiens
ELGSDEQKR

SEQ ID NO: 611009 - protein, 9 aa, Homo Sapiens
VSVTVEGQG

SEQ ID NO: 611010 - protein, 9 aa, Homo Sapiens
PHAAQQERF

SEQ ID NO: 611011 - protein, 9 aa, Homo Sapiens
NHHSCSVNK

SEQ ID NO: 611012 - protein, 9 aa, Homo Sapiens
GLYASVKAL

SEQ ID NO: 611013 - protein, 9 aa, Homo Sapiens
DIAEVYAAG

SEQ ID NO: 611014 - protein, 9 aa, Homo Sapiens
APDFQETRP

SEQ ID NO: 611015 - protein, 9 aa, Homo Sapiens
EDVKVFGES

SEQ ID NO: 611016 - protein, 9 aa, Homo Sapiens
QQFELKQHQ

SEQ ID NO: 611017 - protein, 9 aa, Homo Sapiens
ACMVTLSGN

SEQ ID NO: 611018 - protein, 9 aa, Homo Sapiens
RKQKNSTGS

SEQ ID NO: 611019 - protein, 9 aa, Homo Sapiens
EASEPCSRQ

SEQ ID NO: 611020 - protein, 9 aa, Homo Sapiens
LKSEHEKTL

SEQ ID NO: 611021 - protein, 9 aa, Homo Sapiens
HFYSADPPL

SEQ ID NO: 611022 - protein, 9 aa, Homo Sapiens
DTEHVQQTF

SEQ ID NO: 611023 - protein, 9 aa, Homo Sapiens
ESSRQDVPY

SEQ ID NO: 611024 - protein, 9 aa, Homo Sapiens
NEECDPGAV

SEQ ID NO: 611025 - protein, 9 aa, Homo Sapiens
GVDYVPSSW

SEQ ID NO: 611026 - protein, 9 aa, Homo Sapiens
FDLQFPENN

SEQ ID NO: 611027 - protein, 9 aa, Homo Sapiens
SLGLARKPA

SEQ ID NO: 611028 - protein, 9 aa, Homo Sapiens
DGLFLGAVE

SEQ ID NO: 611029 - protein, 9 aa, Homo Sapiens
PVEVPMWLA

SEQ ID NO: 611030 - protein, 9 aa, Homo Sapiens
AVHPACQIF

SEQ ID NO: 611031 - protein, 9 aa, Homo Sapiens
KQEVNLQLI

SEQ ID NO: 611032 - protein, 9 aa, Homo Sapiens
SGRCSFLVT

SEQ ID NO: 611033 - protein, 9 aa, Homo Sapiens
INVDRDAED

SEQ ID NO: 611034 - protein, 9 aa, Homo Sapiens
ITMRTCLGV

SEQ ID NO: 611035 - protein, 9 aa, Homo Sapiens
QEAKKHIPK

SEQ ID NO: 611036 - protein, 9 aa, Homo Sapiens
TNVLELNDV

SEQ ID NO: 611037 - protein, 9 aa, Homo Sapiens
IELPSVNPM

SEQ ID NO: 611038 - protein, 9 aa, Homo Sapiens
HASAQTLVI

SEQ ID NO: 611039 - protein, 9 aa, Homo Sapiens
CIPAVISAL

SEQ ID NO: 611040 - protein, 9 aa, Homo Sapiens
PQLLPRGIP

SEQ ID NO: 611041 - protein, 9 aa, Homo Sapiens
PYNSMMGDD

SEQ ID NO: 611042 - protein, 9 aa, Homo Sapiens
MSANTIIFM

SEQ ID NO: 611043 - protein, 9 aa, Homo Sapiens
MAAIKVFEK

SEQ ID NO: 611044 - protein, 9 aa, Homo Sapiens
GSMSEEQEL

SEQ ID NO: 611045 - protein, 9 aa, Homo Sapiens
NTGFRDGLG

SEQ ID NO: 611046 - protein, 9 aa, Homo Sapiens
AFSTCYSHL

SEQ ID NO: 611047 - protein, 9 aa, Homo Sapiens
LGFVISNQD

SEQ ID NO: 611048 - protein, 9 aa, Homo Sapiens
NKALGLSSD

SEQ ID NO: 611049 - protein, 9 aa, Homo Sapiens
MYYALGCSI

SEQ ID NO: 611050 - protein, 9 aa, Homo Sapiens
EETPSHGDR

SEQ ID NO: 611051 - protein, 9 aa, Homo Sapiens
LSIVRGKDT

SEQ ID NO: 611052 - protein, 9 aa, Homo Sapiens
HPHWHPHPH

SEQ ID NO: 611053 - protein, 9 aa, Homo Sapiens
ASGAGQGQW

SEQ ID NO: 611054 - protein, 9 aa, Homo Sapiens
GAPHLHHQL

SEQ ID NO: 611055 - protein, 9 aa, Homo Sapiens
PQKPASLAA

SEQ ID NO: 611056 - protein, 9 aa, Homo Sapiens
YVFKTRKEQ

SEQ ID NO: 611057 - protein, 9 aa, Homo Sapiens
GSRLLQRFN

SEQ ID NO: 611058 - protein, 9 aa, Homo Sapiens
KQKNSTGSG

SEQ ID NO: 611059 - protein, 9 aa, Homo Sapiens
PKCKLLVLG

SEQ ID NO: 611060 - protein, 9 aa, Homo Sapiens
ENLNAPPAK

SEQ ID NO: 611061 - protein, 9 aa, Homo Sapiens
ITTQLSSGR

SEQ ID NO: 611062 - protein, 9 aa, Homo Sapiens
SEAPCPQLL

SEQ ID NO: 611063 - protein, 9 aa, Homo Sapiens
QACAVQMDF

SEQ ID NO: 611064 - protein, 9 aa, Homo Sapiens
QNMCVCLKY

SEQ ID NO: 611065 - protein, 9 aa, Homo Sapiens
FCRTVCSLI

SEQ ID NO: 611066 - protein, 9 aa, Homo Sapiens
RKPAGEPGT

SEQ ID NO: 611067 - protein, 9 aa, Homo Sapiens
DMSENLLMD

SEQ ID NO: 611068 - protein, 9 aa, Homo Sapiens
GAEKSDSSK

SEQ ID NO: 611069 - protein, 9 aa, Homo Sapiens
GRTTYVLPF

SEQ ID NO: 611070 - protein, 9 aa, Homo Sapiens
QLAEGTEQQ

SEQ ID NO: 611071 - protein, 9 aa, Homo Sapiens
IGPPGPQGN

SEQ ID NO: 611072 - protein, 9 aa, Homo Sapiens
PAEGRGSTP

SEQ ID NO: 611073 - protein, 9 aa, Homo Sapiens
EVRITTLRK

SEQ ID NO: 611074 - protein, 9 aa, Homo Sapiens
ICSFQLGDA

SEQ ID NO: 611075 - protein, 9 aa, Homo Sapiens
CALGYYRIV

SEQ ID NO: 611076 - protein, 9 aa, Homo Sapiens
PFRVWRISD

SEQ ID NO: 611077 - protein, 9 aa, Homo Sapiens
CVDCETQNL

SEQ ID NO: 611078 - protein, 9 aa, Homo Sapiens
LKWNWKKAK

SEQ ID NO: 611079 - protein, 9 aa, Homo Sapiens
SDLCISVLL

SEQ ID NO: 611080 - protein, 9 aa, Homo Sapiens
GRVGGWRAR

SEQ ID NO: 611081 - protein, 9 aa, Homo Sapiens
LKVHSYSHA

SEQ ID NO: 611082 - protein, 9 aa, Homo Sapiens
LFCVVTQAH

SEQ ID NO: 611083 - protein, 9 aa, Homo Sapiens
SHRCRPNVT

SEQ ID NO: 611084 - protein, 9 aa, Homo Sapiens
LPNYRGRQH

SEQ ID NO: 611085 - protein, 9 aa, Homo Sapiens
HFWQLDHIK

SEQ ID NO: 611086 - protein, 9 aa, Homo Sapiens
GPLQTLARC

SEQ ID NO: 611087 - protein, 9 aa, Homo Sapiens
KKIKQEVNL

SEQ ID NO: 611088 - protein, 9 aa, Homo Sapiens
HSGPLQTLA

SEQ ID NO: 611089 - protein, 9 aa, Homo Sapiens
GHRHAASAP

SEQ ID NO: 611090 - protein, 9 aa, Homo Sapiens
PKSEEFSHL

SEQ ID NO: 611091 - protein, 9 aa, Homo Sapiens
FLFMLFLRL

SEQ ID NO: 611092 - protein, 9 aa, Homo Sapiens
IDEPSPPYN

SEQ ID NO: 611093 - protein, 9 aa, Homo Sapiens
RVLDLCRNV

SEQ ID NO: 611094 - protein, 9 aa, Homo Sapiens
LKVAKNESK

SEQ ID NO: 611095 - protein, 9 aa, Homo Sapiens
WRTRPWRRP

SEQ ID NO: 611096 - protein, 9 aa, Homo Sapiens
ETSSAHTTG

SEQ ID NO: 611097 - protein, 9 aa, Homo Sapiens
RAFSPSTAQ

SEQ ID NO: 611098 - protein, 9 aa, Homo Sapiens
KLIFDSLSR

SEQ ID NO: 611099 - protein, 9 aa, Homo Sapiens
LGSVGGFRA

SEQ ID NO: 611100 - protein, 9 aa, Homo Sapiens
YKQDGFTYT

SEQ ID NO: 611101 - protein, 9 aa, Homo Sapiens
VGDTKLKPY

SEQ ID NO: 611102 - protein, 9 aa, Homo Sapiens
AFFSKTNRF

SEQ ID NO: 611103 - protein, 9 aa, Homo Sapiens
DLQCFHILN

SEQ ID NO: 611104 - protein, 9 aa, Homo Sapiens
FLELGSDEQ

SEQ ID NO: 611105 - protein, 9 aa, Homo Sapiens
VFSSVSCGH

SEQ ID NO: 611106 - protein, 9 aa, Homo Sapiens
LCFTRHEPV

SEQ ID NO: 611107 - protein, 9 aa, Homo Sapiens
KNDLKIKNM

SEQ ID NO: 611108 - protein, 9 aa, Homo Sapiens
STFISDIMN

SEQ ID NO: 611109 - protein, 9 aa, Homo Sapiens
SEITKQEKD

SEQ ID NO: 611110 - protein, 9 aa, Homo Sapiens
RSFITAVTS

SEQ ID NO: 611111 - protein, 9 aa, Homo Sapiens
QRLLSTMSK

SEQ ID NO: 611112 - protein, 9 aa, Homo Sapiens
CLLPPIQVK

SEQ ID NO: 611113 - protein, 9 aa, Homo Sapiens
PQPPLPQPQ

SEQ ID NO: 611114 - protein, 9 aa, Homo Sapiens
RLRDGLRDL

SEQ ID NO: 611115 - protein, 9 aa, Homo Sapiens
PLYCISHKI

SEQ ID NO: 611116 - protein, 9 aa, Homo Sapiens
SGTATLENG

SEQ ID NO: 611117 - protein, 9 aa, Homo Sapiens
EEVVPQFLV

SEQ ID NO: 611118 - protein, 9 aa, Homo Sapiens
RDLYPVEDY

SEQ ID NO: 611119 - protein, 9 aa, Homo Sapiens
KAKNTNTRK

SEQ ID NO: 611120 - protein, 9 aa, Homo Sapiens
RVLQASGGS

SEQ ID NO: 611121 - protein, 9 aa, Homo Sapiens
RSQRLLGPP

SEQ ID NO: 611122 - protein, 9 aa, Homo Sapiens
TEERLFRKL

SEQ ID NO: 611123 - protein, 9 aa, Homo Sapiens
VWAQWRGAH

SEQ ID NO: 611124 - protein, 9 aa, Homo Sapiens
ISLIHIFRA

SEQ ID NO: 611125 - protein, 9 aa, Homo Sapiens
CWLALLVTM

SEQ ID NO: 611126 - protein, 9 aa, Homo Sapiens
NFPGPTGPA

SEQ ID NO: 611127 - protein, 9 aa, Homo Sapiens
QRAFSPSTA

SEQ ID NO: 611128 - protein, 9 aa, Homo Sapiens
NPSGAPIIG

SEQ ID NO: 611129 - protein, 9 aa, Homo Sapiens
PGPTGPAPP

SEQ ID NO: 611130 - protein, 9 aa, Homo Sapiens
DEAPGQEQL

SEQ ID NO: 611131 - protein, 9 aa, Homo Sapiens
SYQRPLLVT

SEQ ID NO: 611132 - protein, 9 aa, Homo Sapiens
SESPPTSPS

SEQ ID NO: 611133 - protein, 9 aa, Homo Sapiens
EATVAVPAQ

SEQ ID NO: 611134 - protein, 9 aa, Homo Sapiens
FEVPKTYEL

SEQ ID NO: 611135 - protein, 9 aa, Homo Sapiens
AYREIPDSC

SEQ ID NO: 611136 - protein, 9 aa, Homo Sapiens
DNKALAWQR

SEQ ID NO: 611137 - protein, 9 aa, Homo Sapiens
LPEKLHAEV

SEQ ID NO: 611138 - protein, 9 aa, Homo Sapiens
LKGDGKTCG

SEQ ID NO: 611139 - protein, 9 aa, Homo Sapiens
DLTRRDTRK

SEQ ID NO: 611140 - protein, 9 aa, Homo Sapiens
RPLGPARAS

SEQ ID NO: 611141 - protein, 9 aa, Homo Sapiens
DLTFFFEDC

SEQ ID NO: 611142 - protein, 9 aa, Homo Sapiens
EVNLQLINQ

SEQ ID NO: 611143 - protein, 9 aa, Homo Sapiens
ISELMSTPV

SEQ ID NO: 611144 - protein, 9 aa, Homo Sapiens
SQLTINTAV

SEQ ID NO: 611145 - protein, 9 aa, Homo Sapiens
EKAHVPISG

SEQ ID NO: 611146 - protein, 9 aa, Homo Sapiens
ASAYREIPD

SEQ ID NO: 611147 - protein, 9 aa, Homo Sapiens
FDKLSRTFY

SEQ ID NO: 611148 - protein, 9 aa, Homo Sapiens
VTMLTARYS

SEQ ID NO: 611149 - protein, 9 aa, Homo Sapiens
QIQDINDNP

SEQ ID NO: 611150 - protein, 9 aa, Homo Sapiens
RSGFDIKVP

SEQ ID NO: 611151 - protein, 9 aa, Homo Sapiens
QNKMLETKC

SEQ ID NO: 611152 - protein, 9 aa, Homo Sapiens
GSGSNTGFR

SEQ ID NO: 611153 - protein, 9 aa, Homo Sapiens
LLAILLCVL

SEQ ID NO: 611154 - protein, 9 aa, Homo Sapiens
GQAQASGAG

SEQ ID NO: 611155 - protein, 9 aa, Homo Sapiens
TYMRHTEDV

SEQ ID NO: 611156 - protein, 9 aa, Homo Sapiens
YNSPRVLLR

SEQ ID NO: 611157 - protein, 9 aa, Homo Sapiens
IPSVTKKRL

SEQ ID NO: 611158 - protein, 9 aa, Homo Sapiens
IDLGLSTFT

SEQ ID NO: 611159 - protein, 9 aa, Homo Sapiens
TEYLESSRQ

SEQ ID NO: 611160 - protein, 9 aa, Homo Sapiens
PVRYAIDRK

SEQ ID NO: 611161 - protein, 9 aa, Homo Sapiens
WRRPRVRRL

SEQ ID NO: 611162 - protein, 9 aa, Homo Sapiens
TVEGQDADL

SEQ ID NO: 611163 - protein, 9 aa, Homo Sapiens
VQNSDWIRL

SEQ ID NO: 611164 - protein, 9 aa, Homo Sapiens
TSSGRAQPL

SEQ ID NO: 611165 - protein, 9 aa, Homo Sapiens
LKLKQLQKK

SEQ ID NO: 611166 - protein, 9 aa, Homo Sapiens
SLRGGRLRQ

SEQ ID NO: 611167 - protein, 9 aa, Homo Sapiens
WQYTIEGRE

SEQ ID NO: 611168 - protein, 9 aa, Homo Sapiens
TTCQQEGGQ

SEQ ID NO: 611169 - protein, 9 aa, Homo Sapiens
VEGQVGGSP

SEQ ID NO: 611170 - protein, 9 aa, Homo Sapiens
ETINVDRDA

SEQ ID NO: 611171 - protein, 9 aa, Homo Sapiens
LGTVPGASE

SEQ ID NO: 611172 - protein, 9 aa, Homo Sapiens
IPSGSFMLV

SEQ ID NO: 611173 - protein, 9 aa, Homo Sapiens
MYRISELMS

SEQ ID NO: 611174 - protein, 9 aa, Homo Sapiens
NPLSIETTQ

SEQ ID NO: 611175 - protein, 9 aa, Homo Sapiens
NRFCSVSCS

SEQ ID NO: 611176 - protein, 9 aa, Homo Sapiens
PDTPACMVT

SEQ ID NO: 611177 - protein, 9 aa, Homo Sapiens
GMAAIKVFE

SEQ ID NO: 611178 - protein, 9 aa, Homo Sapiens
EFIVRMAFF

SEQ ID NO: 611179 - protein, 9 aa, Homo Sapiens
EQACAVQMD

SEQ ID NO: 611180 - protein, 9 aa, Homo Sapiens
TRREEALAC

SEQ ID NO: 611181 - protein, 9 aa, Homo Sapiens
PVATSLSSP

SEQ ID NO: 611182 - protein, 9 aa, Homo Sapiens
HLSGILIIL

SEQ ID NO: 611183 - protein, 9 aa, Homo Sapiens
VFDRTLCTV

SEQ ID NO: 611184 - protein, 9 aa, Homo Sapiens
YSPLLLFCY

SEQ ID NO: 611185 - protein, 9 aa, Homo Sapiens
IFEHTLHLI

SEQ ID NO: 611186 - protein, 9 aa, Homo Sapiens
SKRIEIHTY

SEQ ID NO: 611187 - protein, 9 aa, Homo Sapiens
HHNGDFCYL

SEQ ID NO: 611188 - protein, 9 aa, Homo Sapiens
VAEFKKIYA

SEQ ID NO: 611189 - protein, 9 aa, Homo Sapiens
HPSLLFFNP

SEQ ID NO: 611190 - protein, 9 aa, Homo Sapiens
DCFPYSNYP

SEQ ID NO: 611191 - protein, 9 aa, Homo Sapiens
LVLGLCKEA

SEQ ID NO: 611192 - protein, 9 aa, Homo Sapiens
LFCSLSLLT

SEQ ID NO: 611193 - protein, 9 aa, Homo Sapiens
SQRRTKIKR

SEQ ID NO: 611194 - protein, 9 aa, Homo Sapiens
ISLVALRPF

SEQ ID NO: 611195 - protein, 9 aa, Homo Sapiens
PRASHMRWL

SEQ ID NO: 611196 - protein, 9 aa, Homo Sapiens
SGCKAARYC

SEQ ID NO: 611197 - protein, 9 aa, Homo Sapiens
CVPRSHSCS

SEQ ID NO: 611198 - protein, 9 aa, Homo Sapiens
NGLSYEYRT

SEQ ID NO: 611199 - protein, 9 aa, Homo Sapiens
SSGTQYLTQ

SEQ ID NO: 611200 - protein, 9 aa, Homo Sapiens
GGSNHHHQS

SEQ ID NO: 611201 - protein, 9 aa, Homo Sapiens
DLEPVDTIF

SEQ ID NO: 611202 - protein, 9 aa, Homo Sapiens
RGSLREVSN

SEQ ID NO: 611203 - protein, 9 aa, Homo Sapiens
EVKIVEHAE

SEQ ID NO: 611204 - protein, 9 aa, Homo Sapiens
SNSREPDIP

SEQ ID NO: 611205 - protein, 9 aa, Homo Sapiens
SREPDIPPP

SEQ ID NO: 611206 - protein, 9 aa, Homo Sapiens
VSFTKILSL

SEQ ID NO: 611207 - protein, 9 aa, Homo Sapiens
ALICSFQLG

SEQ ID NO: 611208 - protein, 9 aa, Homo Sapiens
FRRLSFQFP

SEQ ID NO: 611209 - protein, 9 aa, Homo Sapiens
DKIQYDVGR

SEQ ID NO: 611210 - protein, 9 aa, Homo Sapiens
GAPETSPGD

SEQ ID NO: 611211 - protein, 9 aa, Homo Sapiens
RVLLRDSTP

SEQ ID NO: 611212 - protein, 9 aa, Homo Sapiens
HTEDVAEVL

SEQ ID NO: 611213 - protein, 9 aa, Homo Sapiens
VSRLRYYAC

SEQ ID NO: 611214 - protein, 9 aa, Homo Sapiens
LNFFHVTVQ

SEQ ID NO: 611215 - protein, 9 aa, Homo Sapiens
KGLLIFGNV

SEQ ID NO: 611216 - protein, 9 aa, Homo Sapiens
TSGCGAAWR

SEQ ID NO: 611217 - protein, 9 aa, Homo Sapiens
PYGRSPSRP

SEQ ID NO: 611218 - protein, 9 aa, Homo Sapiens
TAIHPGTPE

SEQ ID NO: 611219 - protein, 9 aa, Homo Sapiens
LYHKEESPA

SEQ ID NO: 611220 - protein, 9 aa, Homo Sapiens
SAPGGRLLS

SEQ ID NO: 611221 - protein, 9 aa, Homo Sapiens
EHDIDPTGT

SEQ ID NO: 611222 - protein, 9 aa, Homo Sapiens
VINHTDEKG

SEQ ID NO: 611223 - protein, 9 aa, Homo Sapiens
VLRGALRGF

SEQ ID NO: 611224 - protein, 9 aa, Homo Sapiens
SYISHSGLT

SEQ ID NO: 611225 - protein, 9 aa, Homo Sapiens
HPAPASLRK

SEQ ID NO: 611226 - protein, 9 aa, Homo Sapiens
SSEQHEVEL

SEQ ID NO: 611227 - protein, 9 aa, Homo Sapiens
ASPTTSTTP

SEQ ID NO: 611228 - protein, 9 aa, Homo Sapiens
RKLTDVEAK

SEQ ID NO: 611229 - protein, 9 aa, Homo Sapiens
AAPRGGPGP

SEQ ID NO: 611230 - protein, 9 aa, Homo Sapiens
RNMEGATLT

SEQ ID NO: 611231 - protein, 9 aa, Homo Sapiens
PGCIPAVIS

SEQ ID NO: 611232 - protein, 9 aa, Homo Sapiens
KGLYVEVKI

SEQ ID NO: 611233 - protein, 9 aa, Homo Sapiens
ARLQTPMYF

SEQ ID NO: 611234 - protein, 9 aa, Homo Sapiens
ASLTGTTNS

SEQ ID NO: 611235 - protein, 9 aa, Homo Sapiens
RQGISPALV

SEQ ID NO: 611236 - protein, 9 aa, Homo Sapiens
VESFILYQD

SEQ ID NO: 611237 - protein, 9 aa, Homo Sapiens
VYNYIPPPL

SEQ ID NO: 611238 - protein, 9 aa, Homo Sapiens
MVTKKKNLV

SEQ ID NO: 611239 - protein, 9 aa, Homo Sapiens
GLICWQYTI

SEQ ID NO: 611240 - protein, 9 aa, Homo Sapiens
LIELPSVNP

SEQ ID NO: 611241 - protein, 9 aa, Homo Sapiens
KATTAPDFQ

SEQ ID NO: 611242 - protein, 9 aa, Homo Sapiens
KKEKLRKQA

SEQ ID NO: 611243 - protein, 9 aa, Homo Sapiens
QQEQARMGS

SEQ ID NO: 611244 - protein, 9 aa, Homo Sapiens
MNTMVPVAS

SEQ ID NO: 611245 - protein, 9 aa, Homo Sapiens
SCGYGGLGF

SEQ ID NO: 611246 - protein, 9 aa, Homo Sapiens
MQRRVPWRR

SEQ ID NO: 611247 - protein, 9 aa, Homo Sapiens
KKVRERLRA

SEQ ID NO: 611248 - protein, 9 aa, Homo Sapiens
QHQFRERFR

SEQ ID NO: 611249 - protein, 9 aa, Homo Sapiens
HLQKEIASL

SEQ ID NO: 611250 - protein, 9 aa, Homo Sapiens
PRPPQSSGV

SEQ ID NO: 611251 - protein, 9 aa, Homo Sapiens
KVSYCVLTL

SEQ ID NO: 611252 - protein, 9 aa, Homo Sapiens
NEGLIAADN

SEQ ID NO: 611253 - protein, 9 aa, Homo Sapiens
DPNMEIDAF

SEQ ID NO: 611254 - protein, 9 aa, Homo Sapiens
AFSPSTAQL

SEQ ID NO: 611255 - protein, 9 aa, Homo Sapiens
QQCMVAHAC

SEQ ID NO: 611256 - protein, 9 aa, Homo Sapiens
LEARLQTPM

SEQ ID NO: 611257 - protein, 9 aa, Homo Sapiens
PEDDMPIGT

SEQ ID NO: 611258 - protein, 9 aa, Homo Sapiens
NGGRDFTDP

SEQ ID NO: 611259 - protein, 9 aa, Homo Sapiens
QRYQEPCSV

SEQ ID NO: 611260 - protein, 9 aa, Homo Sapiens
VCACQNMCV

SEQ ID NO: 611261 - protein, 9 aa, Homo Sapiens
QRVFESSKT

SEQ ID NO: 611262 - protein, 9 aa, Homo Sapiens
EKPYGCYEC

SEQ ID NO: 611263 - protein, 9 aa, Homo Sapiens
QSFQQMRQE

SEQ ID NO: 611264 - protein, 9 aa, Homo Sapiens
GKELANWDA

SEQ ID NO: 611265 - protein, 9 aa, Homo Sapiens
TMRTCLGVN

SEQ ID NO: 611266 - protein, 9 aa, Homo Sapiens
HKTSTRRSI

SEQ ID NO: 611267 - protein, 9 aa, Homo Sapiens
TLQSLVDIL

SEQ ID NO: 611268 - protein, 9 aa, Homo Sapiens
ENIVGRAEA

SEQ ID NO: 611269 - protein, 9 aa, Homo Sapiens
REVSNDTIS

SEQ ID NO: 611270 - protein, 9 aa, Homo Sapiens
LNQRGFFGL

SEQ ID NO: 611271 - protein, 9 aa, Homo Sapiens
NSTVRCFKG

SEQ ID NO: 611272 - protein, 9 aa, Homo Sapiens
ARRRRKRRK

SEQ ID NO: 611273 - protein, 9 aa, Homo Sapiens
EVVKVLTLN

SEQ ID NO: 611274 - protein, 9 aa, Homo Sapiens
DLDFEKLKP

SEQ ID NO: 611275 - protein, 9 aa, Homo Sapiens
GKSYISHSG

SEQ ID NO: 611276 - protein, 9 aa, Homo Sapiens
LPDCEQFQM

SEQ ID NO: 611277 - protein, 9 aa, Homo Sapiens
NVDRDAEDV

SEQ ID NO: 611278 - protein, 9 aa, Homo Sapiens
YDRYLDICH

SEQ ID NO: 611279 - protein, 9 aa, Homo Sapiens
SYSHAGERP

SEQ ID NO: 611280 - protein, 9 aa, Homo Sapiens
AQWRGAHRQ

SEQ ID NO: 611281 - protein, 9 aa, Homo Sapiens
SGVPLPSLM

SEQ ID NO: 611282 - protein, 9 aa, Homo Sapiens
PLLNHLIYS

SEQ ID NO: 611283 - protein, 9 aa, Homo Sapiens
KPTSDPWIP

SEQ ID NO: 611284 - protein, 9 aa, Homo Sapiens
EMKAGRPEA

SEQ ID NO: 611285 - protein, 9 aa, Homo Sapiens
DGLYVPEYQ

SEQ ID NO: 611286 - protein, 9 aa, Homo Sapiens
EAKRKQKNS

SEQ ID NO: 611287 - protein, 9 aa, Homo Sapiens
HFDMGQRVC

SEQ ID NO: 611288 - protein, 9 aa, Homo Sapiens
TKIKRRRRR

SEQ ID NO: 611289 - protein, 9 aa, Homo Sapiens
GVRLKRLIK

SEQ ID NO: 611290 - protein, 9 aa, Homo Sapiens
YPWWGGAMG

SEQ ID NO: 611291 - protein, 9 aa, Homo Sapiens
VHSYSHAGE

SEQ ID NO: 611292 - protein, 9 aa, Homo Sapiens
TRRDDVVAV

SEQ ID NO: 611293 - protein, 9 aa, Homo Sapiens
RETCLYIRD

SEQ ID NO: 611294 - protein, 9 aa, Homo Sapiens
KDNEVDGLI

SEQ ID NO: 611295 - protein, 9 aa, Homo Sapiens
AILGSVGGF

SEQ ID NO: 611296 - protein, 9 aa, Homo Sapiens
SVTVEGQGP

SEQ ID NO: 611297 - protein, 9 aa, Homo Sapiens
PGSRPQDAA

SEQ ID NO: 611298 - protein, 9 aa, Homo Sapiens
VARTAQQYE

SEQ ID NO: 611299 - protein, 9 aa, Homo Sapiens
NGEVNVVPQ

SEQ ID NO: 611300 - protein, 9 aa, Homo Sapiens
IRATAAPAS

SEQ ID NO: 611301 - protein, 9 aa, Homo Sapiens
ENGLSYEYR

SEQ ID NO: 611302 - protein, 9 aa, Homo Sapiens
SPPYNSMMG

SEQ ID NO: 611303 - protein, 9 aa, Homo Sapiens
KKFEREERL

SEQ ID NO: 611304 - protein, 9 aa, Homo Sapiens
NPLASCKTY

SEQ ID NO: 611305 - protein, 9 aa, Homo Sapiens
AAETKAEAA

SEQ ID NO: 611306 - protein, 9 aa, Homo Sapiens
PEVASNPSG

SEQ ID NO: 611307 - protein, 9 aa, Homo Sapiens
KDKGNFSFP

SEQ ID NO: 611308 - protein, 9 aa, Homo Sapiens
GALFLFISA

SEQ ID NO: 611309 - protein, 9 aa, Homo Sapiens
IHILELLMD

SEQ ID NO: 611310 - protein, 9 aa, Homo Sapiens
HVVIQPDIY

SEQ ID NO: 611311 - protein, 9 aa, Homo Sapiens
SDDLRELRN

SEQ ID NO: 611312 - protein, 9 aa, Homo Sapiens
MCSPNSTGI

SEQ ID NO: 611313 - protein, 9 aa, Homo Sapiens
AQQYERSFH

SEQ ID NO: 611314 - protein, 9 aa, Homo Sapiens
RGALRGFRR

SEQ ID NO: 611315 - protein, 9 aa, Homo Sapiens
STAQLTGVL

SEQ ID NO: 611316 - protein, 9 aa, Homo Sapiens
SLDPLAFFY

SEQ ID NO: 611317 - protein, 9 aa, Homo Sapiens
SVVHSLIEA

SEQ ID NO: 611318 - protein, 9 aa, Homo Sapiens
SFTKILSLL

SEQ ID NO: 611319 - protein, 9 aa, Homo Sapiens
PGRLAYRLP

SEQ ID NO: 611320 - protein, 9 aa, Homo Sapiens
VFQVVPMLN

SEQ ID NO: 611321 - protein, 9 aa, Homo Sapiens
DSFQYRYTS

SEQ ID NO: 611322 - protein, 9 aa, Homo Sapiens
KDAHEVRIT

SEQ ID NO: 611323 - protein, 9 aa, Homo Sapiens
GQIFFFHFV

SEQ ID NO: 611324 - protein, 9 aa, Homo Sapiens
AKSVHPQSE

SEQ ID NO: 611325 - protein, 9 aa, Homo Sapiens
IPDSCYSER

SEQ ID NO: 611326 - protein, 9 aa, Homo Sapiens
MLTCYMFNM

SEQ ID NO: 611327 - protein, 9 aa, Homo Sapiens
DDLQSSENS

SEQ ID NO: 611328 - protein, 9 aa, Homo Sapiens
LASCCYFCR

SEQ ID NO: 611329 - protein, 9 aa, Homo Sapiens
LQLCAVHAL

SEQ ID NO: 611330 - protein, 9 aa, Homo Sapiens
IHPGTPEWR

SEQ ID NO: 611331 - protein, 9 aa, Homo Sapiens
EFVPLFMPW

SEQ ID NO: 611332 - protein, 9 aa, Homo Sapiens
EQTVIPFTD

SEQ ID NO: 611333 - protein, 9 aa, Homo Sapiens
SHYLHLYMP

SEQ ID NO: 611334 - protein, 9 aa, Homo Sapiens
RLARRAEMM

SEQ ID NO: 611335 - protein, 9 aa, Homo Sapiens
QKREVGAAL

SEQ ID NO: 611336 - protein, 9 aa, Homo Sapiens
MKAGRPEAR

SEQ ID NO: 611337 - protein, 9 aa, Homo Sapiens
PLASQISGP

SEQ ID NO: 611338 - protein, 9 aa, Homo Sapiens
CKAARYCGS

SEQ ID NO: 611339 - protein, 9 aa, Homo Sapiens
LSTIETLKQ

SEQ ID NO: 611340 - protein, 9 aa, Homo Sapiens
LALDCGIKF

SEQ ID NO: 611341 - protein, 9 aa, Homo Sapiens
KHCKMASKL

SEQ ID NO: 611342 - protein, 9 aa, Homo Sapiens
EITKQEKDF

SEQ ID NO: 611343 - protein, 9 aa, Homo Sapiens
GQDADLADL

SEQ ID NO: 611344 - protein, 9 aa, Homo Sapiens
IMKLPEKLH

SEQ ID NO: 611345 - protein, 9 aa, Homo Sapiens
AERSFVSSL

SEQ ID NO: 611346 - protein, 9 aa, Homo Sapiens
HKVMLKEIH

SEQ ID NO: 611347 - protein, 9 aa, Homo Sapiens
GAQSFALSL

SEQ ID NO: 611348 - protein, 9 aa, Homo Sapiens
PDKANQRKT

SEQ ID NO: 611349 - protein, 9 aa, Homo Sapiens
HFVGGAMVF

SEQ ID NO: 611350 - protein, 9 aa, Homo Sapiens
LNRADAQSL

SEQ ID NO: 611351 - protein, 9 aa, Homo Sapiens
LIAADNDPT

SEQ ID NO: 611352 - protein, 9 aa, Homo Sapiens
RGQAQASGA

SEQ ID NO: 611353 - protein, 9 aa, Homo Sapiens
SLNSYLEMD

SEQ ID NO: 611354 - protein, 9 aa, Homo Sapiens
EPWCNQKTE

SEQ ID NO: 611355 - protein, 9 aa, Homo Sapiens
EKAMKMKGG

SEQ ID NO: 611356 - protein, 9 aa, Homo Sapiens
IDEYCKSNN

SEQ ID NO: 611357 - protein, 9 aa, Homo Sapiens
DGKTCGPSP

SEQ ID NO: 611358 - protein, 9 aa, Homo Sapiens
PSSSEMKAG

SEQ ID NO: 611359 - protein, 9 aa, Homo Sapiens
GSNHSLGNY

SEQ ID NO: 611360 - protein, 9 aa, Homo Sapiens
PSPSPEEKA

SEQ ID NO: 611361 - protein, 9 aa, Homo Sapiens
EERLFRKLF

SEQ ID NO: 611362 - protein, 9 aa, Homo Sapiens
HVFSNLHSG

SEQ ID NO: 611363 - protein, 9 aa, Homo Sapiens
SPMYIFLGN

SEQ ID NO: 611364 - protein, 9 aa, Homo Sapiens
GKFIRIYFG

SEQ ID NO: 611365 - protein, 9 aa, Homo Sapiens
KFEREERLI

SEQ ID NO: 611366 - protein, 9 aa, Homo Sapiens
YTIEGREPK

SEQ ID NO: 611367 - protein, 9 aa, Homo Sapiens
LVQDLKGDY

SEQ ID NO: 611368 - protein, 9 aa, Homo Sapiens
DHAIQKAFQ

SEQ ID NO: 611369 - protein, 9 aa, Homo Sapiens
SRQSWRTRP

SEQ ID NO: 611370 - protein, 9 aa, Homo Sapiens
VDNKCFVQQ

SEQ ID NO: 611371 - protein, 9 aa, Homo Sapiens
DEFDGHQFQ

SEQ ID NO: 611372 - protein, 9 aa, Homo Sapiens
GCTVFIWCC

SEQ ID NO: 611373 - protein, 9 aa, Homo Sapiens
AAEAKATTA

SEQ ID NO: 611374 - protein, 9 aa, Homo Sapiens
CRTVCSLIH

SEQ ID NO: 611375 - protein, 9 aa, Homo Sapiens
SMSEEQELC

SEQ ID NO: 611376 - protein, 9 aa, Homo Sapiens
AKFTNFDTP

SEQ ID NO: 611377 - protein, 9 aa, Homo Sapiens
KKHIPKLQE

SEQ ID NO: 611378 - protein, 9 aa, Homo Sapiens
CGGFGGIGI

SEQ ID NO: 611379 - protein, 9 aa, Homo Sapiens
IISSDLCIS

SEQ ID NO: 611380 - protein, 9 aa, Homo Sapiens
GGGIGLGVF

SEQ ID NO: 611381 - protein, 9 aa, Homo Sapiens
SDGVTESHY

SEQ ID NO: 611382 - protein, 9 aa, Homo Sapiens
PQVLPTQSL

SEQ ID NO: 611383 - protein, 9 aa, Homo Sapiens
GSDSNCGVM

SEQ ID NO: 611384 - protein, 9 aa, Homo Sapiens
LSKRIEIHT

SEQ ID NO: 611385 - protein, 9 aa, Homo Sapiens
TMLTARYSL

SEQ ID NO: 611386 - protein, 9 aa, Homo Sapiens
YVGSWLGVA

SEQ ID NO: 611387 - protein, 9 aa, Homo Sapiens
DDWQRLCTE

SEQ ID NO: 611388 - protein, 9 aa, Homo Sapiens
EKRSSTMGS

SEQ ID NO: 611389 - protein, 9 aa, Homo Sapiens
YFGILLSRE

SEQ ID NO: 611390 - protein, 9 aa, Homo Sapiens
LPVEVPMWL

SEQ ID NO: 611391 - protein, 9 aa, Homo Sapiens
RLLSTMSKY

SEQ ID NO: 611392 - protein, 9 aa, Homo Sapiens
IYWGSGLGG

SEQ ID NO: 611393 - protein, 9 aa, Homo Sapiens
HTYYECPGT

SEQ ID NO: 611394 - protein, 9 aa, Homo Sapiens
TAGSYLAGN

SEQ ID NO: 611395 - protein, 9 aa, Homo Sapiens
IINEAGSGR

SEQ ID NO: 611396 - protein, 9 aa, Homo Sapiens
FRKLFSHYN

SEQ ID NO: 611397 - protein, 9 aa, Homo Sapiens
LPGGGIGLG

SEQ ID NO: 611398 - protein, 9 aa, Homo Sapiens
SGVDIISSV

SEQ ID NO: 611399 - protein, 9 aa, Homo Sapiens
MIIEDPATL

SEQ ID NO: 611400 - protein, 9 aa, Homo Sapiens
QAASDEERL

SEQ ID NO: 611401 - protein, 9 aa, Homo Sapiens
PPPAVPGWV

SEQ ID NO: 611402 - protein, 9 aa, Homo Sapiens
MKMKGGSNC

SEQ ID NO: 611403 - protein, 9 aa, Homo Sapiens
VAAGGAQSF

SEQ ID NO: 611404 - protein, 9 aa, Homo Sapiens
YGAYDFLPV

SEQ ID NO: 611405 - protein, 9 aa, Homo Sapiens
LQHNTSRYE

SEQ ID NO: 611406 - protein, 9 aa, Homo Sapiens
GVPLPSLMD

SEQ ID NO: 611407 - protein, 9 aa, Homo Sapiens
LLVLGLCKE

SEQ ID NO: 611408 - protein, 9 aa, Homo Sapiens
DASVRTIKL

SEQ ID NO: 611409 - protein, 9 aa, Homo Sapiens
FSMTVPVKQ

SEQ ID NO: 611410 - protein, 9 aa, Homo Sapiens
LDTYTLTRL

SEQ ID NO: 611411 - protein, 9 aa, Homo Sapiens
DGKQTRSIT

SEQ ID NO: 611412 - protein, 9 aa, Homo Sapiens
FVRGYLVRQ

SEQ ID NO: 611413 - protein, 9 aa, Homo Sapiens
SQPASYQRP

SEQ ID NO: 611414 - protein, 9 aa, Homo Sapiens
SMTVPVKQG

SEQ ID NO: 611415 - protein, 9 aa, Homo Sapiens
EVPFCTLKS

SEQ ID NO: 611416 - protein, 9 aa, Homo Sapiens
ARRAEMMTG

SEQ ID NO: 611417 - protein, 9 aa, Homo Sapiens
LFLEHRLVS

SEQ ID NO: 611418 - protein, 9 aa, Homo Sapiens
IPTYMRHTE

SEQ ID NO: 611419 - protein, 9 aa, Homo Sapiens
PLPSSLLDS

SEQ ID NO: 611420 - protein, 9 aa, Homo Sapiens
MSENLLMDL

SEQ ID NO: 611421 - protein, 9 aa, Homo Sapiens
TPHYISPEA

SEQ ID NO: 611422 - protein, 9 aa, Homo Sapiens
QDTNDICLQ

SEQ ID NO: 611423 - protein, 9 aa, Homo Sapiens
MLFSWLPSH

SEQ ID NO: 611424 - protein, 9 aa, Homo Sapiens
RHPDTEHVQ

SEQ ID NO: 611425 - protein, 9 aa, Homo Sapiens
QFMKGWRPK

SEQ ID NO: 611426 - protein, 9 aa, Homo Sapiens
LCLTKNILG

SEQ ID NO: 611427 - protein, 9 aa, Homo Sapiens
QVLPTQSLA

SEQ ID NO: 611428 - protein, 9 aa, Homo Sapiens
ADFSLGSLT

SEQ ID NO: 611429 - protein, 9 aa, Homo Sapiens
DFDNRLVNY

SEQ ID NO: 611430 - protein, 9 aa, Homo Sapiens
LSGAERSFV

SEQ ID NO: 611431 - protein, 9 aa, Homo Sapiens
NYGLLDHIQ

SEQ ID NO: 611432 - protein, 9 aa, Homo Sapiens
FGEGTITYL

SEQ ID NO: 611433 - protein, 9 aa, Homo Sapiens
TRVSWDLWS

SEQ ID NO: 611434 - protein, 9 aa, Homo Sapiens
CVAENIVGR

SEQ ID NO: 611435 - protein, 9 aa, Homo Sapiens
FTNFDTPTS

SEQ ID NO: 611436 - protein, 9 aa, Homo Sapiens
RFFETCALD

SEQ ID NO: 611437 - protein, 9 aa, Homo Sapiens
IVHSAQSGQ

SEQ ID NO: 611438 - protein, 9 aa, Homo Sapiens
LGPSAVPPQ

SEQ ID NO: 611439 - protein, 9 aa, Homo Sapiens
SQERSTLWD

SEQ ID NO: 611440 - protein, 9 aa, Homo Sapiens
GEGETEEKR

SEQ ID NO: 611441 - protein, 9 aa, Homo Sapiens
RGGPGPSPG

SEQ ID NO: 611442 - protein, 9 aa, Homo Sapiens
FPRWVHCAE

SEQ ID NO: 611443 - protein, 9 aa, Homo Sapiens
GAACDQRLC

SEQ ID NO: 611444 - protein, 9 aa, Homo Sapiens
IGIIHLGSS

SEQ ID NO: 611445 - protein, 9 aa, Homo Sapiens
VKPVLDSYV

SEQ ID NO: 611446 - protein, 9 aa, Homo Sapiens
GAERSFVSS

SEQ ID NO: 611447 - protein, 9 aa, Homo Sapiens
TYELMPSFD

SEQ ID NO: 611448 - protein, 9 aa, Homo Sapiens
QRLGRYNLN

SEQ ID NO: 611449 - protein, 9 aa, Homo Sapiens
NLNAPPAKA

SEQ ID NO: 611450 - protein, 9 aa, Homo Sapiens
ELEGQIAYL

SEQ ID NO: 611451 - protein, 9 aa, Homo Sapiens
TGAACDQRL

SEQ ID NO: 611452 - protein, 9 aa, Homo Sapiens
NPGKPYGAY

SEQ ID NO: 611453 - protein, 9 aa, Homo Sapiens
STASPLTND

SEQ ID NO: 611454 - protein, 9 aa, Homo Sapiens
QELTVSYFS

SEQ ID NO: 611455 - protein, 9 aa, Homo Sapiens
QHNTSRYET

SEQ ID NO: 611456 - protein, 9 aa, Homo Sapiens
IQCLVAGAH

SEQ ID NO: 611457 - protein, 9 aa, Homo Sapiens
ETVELDVSY

SEQ ID NO: 611458 - protein, 9 aa, Homo Sapiens
SVGGFRAMV

SEQ ID NO: 611459 - protein, 9 aa, Homo Sapiens
RAASHRCFP

SEQ ID NO: 611460 - protein, 9 aa, Homo Sapiens
GNYGLSCQH

SEQ ID NO: 611461 - protein, 9 aa, Homo Sapiens
GSMLHVLPS

SEQ ID NO: 611462 - protein, 9 aa, Homo Sapiens
AGMAAIKVF

SEQ ID NO: 611463 - protein, 9 aa, Homo Sapiens
MLVNWQHPR

SEQ ID NO: 611464 - protein, 9 aa, Homo Sapiens
MLTVSAMPS

SEQ ID NO: 611465 - protein, 9 aa, Homo Sapiens
AAVVQVGIA

SEQ ID NO: 611466 - protein, 9 aa, Homo Sapiens
FWQLDHIKP

SEQ ID NO: 611467 - protein, 9 aa, Homo Sapiens
ENKTTVVSP

SEQ ID NO: 611468 - protein, 9 aa, Homo Sapiens
LQLDLEANL

SEQ ID NO: 611469 - protein, 9 aa, Homo Sapiens
QHGIAVIRN

SEQ ID NO: 611470 - protein, 9 aa, Homo Sapiens
EHFEDYCEG

SEQ ID NO: 611471 - protein, 9 aa, Homo Sapiens
MYGADLNMK

SEQ ID NO: 611472 - protein, 9 aa, Homo Sapiens
QTVDGTITT

SEQ ID NO: 611473 - protein, 9 aa, Homo Sapiens
GPSPGRLAY

SEQ ID NO: 611474 - protein, 9 aa, Homo Sapiens
ESTEKVKIE

SEQ ID NO: 611475 - protein, 9 aa, Homo Sapiens
ASVWEALGV

SEQ ID NO: 611476 - protein, 9 aa, Homo Sapiens
AAWRPEAAV

SEQ ID NO: 611477 - protein, 9 aa, Homo Sapiens
LALVALVLA

SEQ ID NO: 611478 - protein, 9 aa, Homo Sapiens
KSLPVTLTA

SEQ ID NO: 611479 - protein, 9 aa, Homo Sapiens
PYEDIKTLE

SEQ ID NO: 611480 - protein, 9 aa, Homo Sapiens
TRSITILAL

SEQ ID NO: 611481 - protein, 9 aa, Homo Sapiens
RVESSMRKS

SEQ ID NO: 611482 - protein, 9 aa, Homo Sapiens
MQAPWREFT

SEQ ID NO: 611483 - protein, 9 aa, Homo Sapiens
YCISHKIME

SEQ ID NO: 611484 - protein, 9 aa, Homo Sapiens
CDQRLCHPR

SEQ ID NO: 611485 - protein, 9 aa, Homo Sapiens
FSIPRPDEI

SEQ ID NO: 611486 - protein, 9 aa, Homo Sapiens
QQMRLQRKA

SEQ ID NO: 611487 - protein, 9 aa, Homo Sapiens
PLLGVPVRG

SEQ ID NO: 611488 - protein, 9 aa, Homo Sapiens
QMLYVGSWL

SEQ ID NO: 611489 - protein, 9 aa, Homo Sapiens
QQGCYAEAL

SEQ ID NO: 611490 - protein, 9 aa, Homo Sapiens
KKEESTEKV

SEQ ID NO: 611491 - protein, 9 aa, Homo Sapiens
LYSWTTREP

SEQ ID NO: 611492 - protein, 9 aa, Homo Sapiens
EGISLEAFV

SEQ ID NO: 611493 - protein, 9 aa, Homo Sapiens
VNGEEGEPH

SEQ ID NO: 611494 - protein, 9 aa, Homo Sapiens
ARPEATVAV

SEQ ID NO: 611495 - protein, 9 aa, Homo Sapiens
MEGTHINQS

SEQ ID NO: 611496 - protein, 9 aa, Homo Sapiens
TPTAAPTPR

SEQ ID NO: 611497 - protein, 9 aa, Homo Sapiens
RKTEEPRSK

SEQ ID NO: 611498 - protein, 9 aa, Homo Sapiens
SGCGAAWRP

SEQ ID NO: 611499 - protein, 9 aa, Homo Sapiens
GSEQSGVLL

SEQ ID NO: 611500 - protein, 9 aa, Homo Sapiens
FIVFRKNVF

SEQ ID NO: 611501 - protein, 9 aa, Homo Sapiens
KSKLEQVQQ

SEQ ID NO: 611502 - protein, 9 aa, Homo Sapiens
QQSAVQKHQ

SEQ ID NO: 611503 - protein, 9 aa, Homo Sapiens
DHKVKASVH

SEQ ID NO: 611504 - protein, 9 aa, Homo Sapiens
LLSALPAAP

SEQ ID NO: 611505 - protein, 9 aa, Homo Sapiens
SGRETESGS

SEQ ID NO: 611506 - protein, 9 aa, Homo Sapiens
TAVTSQSGG

SEQ ID NO: 611507 - protein, 9 aa, Homo Sapiens
QLQRLLSTM

SEQ ID NO: 611508 - protein, 9 aa, Homo Sapiens
HLQDVRKRM

SEQ ID NO: 611509 - protein, 9 aa, Homo Sapiens
CKIPDEIND

SEQ ID NO: 611510 - protein, 9 aa, Homo Sapiens
LSTLIGSFY

SEQ ID NO: 611511 - protein, 9 aa, Homo Sapiens
NPKTLTSFI

SEQ ID NO: 611512 - protein, 9 aa, Homo Sapiens
SLYHKEESP

SEQ ID NO: 611513 - protein, 9 aa, Homo Sapiens
DGPEQERDW

SEQ ID NO: 611514 - protein, 9 aa, Homo Sapiens
GVDKIQYDV

SEQ ID NO: 611515 - protein, 9 aa, Homo Sapiens
MQIDGEPWI

SEQ ID NO: 611516 - protein, 9 aa, Homo Sapiens
DSPDFNRRG

SEQ ID NO: 611517 - protein, 9 aa, Homo Sapiens
KELANWDAT

SEQ ID NO: 611518 - protein, 9 aa, Homo Sapiens
SSGRAQPLA

SEQ ID NO: 611519 - protein, 9 aa, Homo Sapiens
TLARCRRPL

SEQ ID NO: 611520 - protein, 9 aa, Homo Sapiens
VRRQFKAMM

SEQ ID NO: 611521 - protein, 9 aa, Homo Sapiens
STASRKQVS

SEQ ID NO: 611522 - protein, 9 aa, Homo Sapiens
MRTCLGVNL

SEQ ID NO: 611523 - protein, 9 aa, Homo Sapiens
GVSVTVEGQ

SEQ ID NO: 611524 - protein, 9 aa, Homo Sapiens
PSRTLTTTA

SEQ ID NO: 611525 - protein, 9 aa, Homo Sapiens
VFLRSRLYM

SEQ ID NO: 611526 - protein, 9 aa, Homo Sapiens
QCKLEQLFL

SEQ ID NO: 611527 - protein, 9 aa, Homo Sapiens
PAVATTPLG

SEQ ID NO: 611528 - protein, 9 aa, Homo Sapiens
RDGLRDLYP

SEQ ID NO: 611529 - protein, 9 aa, Homo Sapiens
LLWNNYFHL

SEQ ID NO: 611530 - protein, 9 aa, Homo Sapiens
EAEDAEREE

SEQ ID NO: 611531 - protein, 9 aa, Homo Sapiens
LSVGAGVVV

SEQ ID NO: 611532 - protein, 9 aa, Homo Sapiens
ETQNLNWAS

SEQ ID NO: 611533 - protein, 9 aa, Homo Sapiens
TKRHAVLLG

SEQ ID NO: 611534 - protein, 9 aa, Homo Sapiens
TFISDIMNC

SEQ ID NO: 611535 - protein, 9 aa, Homo Sapiens
DSNSREPDI

SEQ ID NO: 611536 - protein, 9 aa, Homo Sapiens
SVRVTTGEV

SEQ ID NO: 611537 - protein, 9 aa, Homo Sapiens
FKSSVSCEV

SEQ ID NO: 611538 - protein, 9 aa, Homo Sapiens
NYGEKGNPF

SEQ ID NO: 611539 - protein, 9 aa, Homo Sapiens
DDIHGLLPC

SEQ ID NO: 611540 - protein, 9 aa, Homo Sapiens
YMLSFLHFL

SEQ ID NO: 611541 - protein, 9 aa, Homo Sapiens
PSPSPLSRT

SEQ ID NO: 611542 - protein, 9 aa, Homo Sapiens
ILLLFSSDS

SEQ ID NO: 611543 - protein, 9 aa, Homo Sapiens
VLLEARPEA

SEQ ID NO: 611544 - protein, 9 aa, Homo Sapiens
VDRDAEDVD

SEQ ID NO: 611545 - protein, 9 aa, Homo Sapiens
KGDYTAVRD

SEQ ID NO: 611546 - protein, 9 aa, Homo Sapiens
SGSDSNCGV

SEQ ID NO: 611547 - protein, 9 aa, Homo Sapiens
KFTNFDTPT

SEQ ID NO: 611548 - protein, 9 aa, Homo Sapiens
CVQDTTTAN

SEQ ID NO: 611549 - protein, 9 aa, Homo Sapiens
YFGATGKLA

SEQ ID NO: 611550 - protein, 9 aa, Homo Sapiens
LGAVESFSW

SEQ ID NO: 611551 - protein, 9 aa, Homo Sapiens
TKPTSDPWI

SEQ ID NO: 611552 - protein, 9 aa, Homo Sapiens
QDVRKRMQD

SEQ ID NO: 611553 - protein, 9 aa, Homo Sapiens
PLHESILKV

SEQ ID NO: 611554 - protein, 9 aa, Homo Sapiens
ADVDHAIQK

SEQ ID NO: 611555 - protein, 9 aa, Homo Sapiens
QVVPMLNPD

SEQ ID NO: 611556 - protein, 9 aa, Homo Sapiens
PETGLRKSS

SEQ ID NO: 611557 - protein, 9 aa, Homo Sapiens
ISHSGLTKH

SEQ ID NO: 611558 - protein, 9 aa, Homo Sapiens
LGPARASWR

SEQ ID NO: 611559 - protein, 9 aa, Homo Sapiens
TPRPPRPTR

SEQ ID NO: 611560 - protein, 9 aa, Homo Sapiens
RTGMQVSSV

SEQ ID NO: 611561 - protein, 9 aa, Homo Sapiens
IFLHSSLDP

SEQ ID NO: 611562 - protein, 9 aa, Homo Sapiens
QKKKSARSI

SEQ ID NO: 611563 - protein, 9 aa, Homo Sapiens
RELGPRASH

SEQ ID NO: 611564 - protein, 9 aa, Homo Sapiens
RRQFKAMMI

SEQ ID NO: 611565 - protein, 9 aa, Homo Sapiens
SGRGEGGKG

SEQ ID NO: 611566 - protein, 9 aa, Homo Sapiens
GEESSAELY

SEQ ID NO: 611567 - protein, 9 aa, Homo Sapiens
TEQKLGSSC

SEQ ID NO: 611568 - protein, 9 aa, Homo Sapiens
PPLPQPQPA

SEQ ID NO: 611569 - protein, 9 aa, Homo Sapiens
ACAVQMDFN

SEQ ID NO: 611570 - protein, 9 aa, Homo Sapiens
VLIGKGLNE

SEQ ID NO: 611571 - protein, 9 aa, Homo Sapiens
SAAVQEEQG

SEQ ID NO: 611572 - protein, 9 aa, Homo Sapiens
GYLIPINKE

SEQ ID NO: 611573 - protein, 9 aa, Homo Sapiens
IETRCLVFE

SEQ ID NO: 611574 - protein, 9 aa, Homo Sapiens
THCNERMYR

SEQ ID NO: 611575 - protein, 9 aa, Homo Sapiens
IFGRPVVNG

SEQ ID NO: 611576 - protein, 9 aa, Homo Sapiens
RPRSRSPLS

SEQ ID NO: 611577 - protein, 9 aa, Homo Sapiens
AVELKSRKN

SEQ ID NO: 611578 - protein, 9 aa, Homo Sapiens
GNPFTKLEE

SEQ ID NO: 611579 - protein, 9 aa, Homo Sapiens
QQQVSAHQE

SEQ ID NO: 611580 - protein, 9 aa, Homo Sapiens
PKLFCSLSL

SEQ ID NO: 611581 - protein, 9 aa, Homo Sapiens
INHFYSADP

SEQ ID NO: 611582 - protein, 9 aa, Homo Sapiens
INQETSSAH

SEQ ID NO: 611583 - protein, 9 aa, Homo Sapiens
PSPSPVLGT

SEQ ID NO: 611584 - protein, 9 aa, Homo Sapiens
VVSLSFSIP

SEQ ID NO: 611585 - protein, 9 aa, Homo Sapiens
GGRLLSALP

SEQ ID NO: 611586 - protein, 9 aa, Homo Sapiens
SPLSRTPTS

SEQ ID NO: 611587 - protein, 9 aa, Homo Sapiens
GSYLAGNLH

SEQ ID NO: 611588 - protein, 9 aa, Homo Sapiens
ATPDTPACM

SEQ ID NO: 611589 - protein, 9 aa, Homo Sapiens
LQRTKMTKG

SEQ ID NO: 611590 - protein, 9 aa, Homo Sapiens
KPHRCQACG

SEQ ID NO: 611591 - protein, 9 aa, Homo Sapiens
HTLHSFDAA

SEQ ID NO: 611592 - protein, 9 aa, Homo Sapiens
ALRIVSFTK

SEQ ID NO: 611593 - protein, 9 aa, Homo Sapiens
GGGSGCEER

SEQ ID NO: 611594 - protein, 9 aa, Homo Sapiens
QDLVTCLEQ

SEQ ID NO: 611595 - protein, 9 aa, Homo Sapiens
DVSLWNIVR

SEQ ID NO: 611596 - protein, 9 aa, Homo Sapiens
ILGSSEQHE

SEQ ID NO: 611597 - protein, 9 aa, Homo Sapiens
VLGPVTAAM

SEQ ID NO: 611598 - protein, 9 aa, Homo Sapiens
ILRLFPHAA

SEQ ID NO: 611599 - protein, 9 aa, Homo Sapiens
VVPQENTDP

SEQ ID NO: 611600 - protein, 9 aa, Homo Sapiens
ETESGSQSH

SEQ ID NO: 611601 - protein, 9 aa, Homo Sapiens
RPATIFLTV

SEQ ID NO: 611602 - protein, 9 aa, Homo Sapiens
RCAAPLALL

SEQ ID NO: 611603 - protein, 9 aa, Homo Sapiens
IQKAFQLWS

SEQ ID NO: 611604 - protein, 9 aa, Homo Sapiens
EYNISGIIL

SEQ ID NO: 611605 - protein, 9 aa, Homo Sapiens
GRGEGGKGL

SEQ ID NO: 611606 - protein, 9 aa, Homo Sapiens
QPSSDGYDD

SEQ ID NO: 611607 - protein, 9 aa, Homo Sapiens
PHPQAPNDE

SEQ ID NO: 611608 - protein, 9 aa, Homo Sapiens
GADLNMKNC

SEQ ID NO: 611609 - protein, 9 aa, Homo Sapiens
VSTALCQSS

SEQ ID NO: 611610 - protein, 9 aa, Homo Sapiens
PNIYPGANP

SEQ ID NO: 611611 - protein, 9 aa, Homo Sapiens
KGLRSEHRR

SEQ ID NO: 611612 - protein, 9 aa, Homo Sapiens
PQDAAVHPA

SEQ ID NO: 611613 - protein, 9 aa, Homo Sapiens
SGGGSNHHH

SEQ ID NO: 611614 - protein, 9 aa, Homo Sapiens
YALGIPMIG

SEQ ID NO: 611615 - protein, 9 aa, Homo Sapiens
VKRVYSLFL

SEQ ID NO: 611616 - protein, 9 aa, Homo Sapiens
REAKEIFQQ

SEQ ID NO: 611617 - protein, 9 aa, Homo Sapiens
PLSIETTQP

SEQ ID NO: 611618 - protein, 9 aa, Homo Sapiens
VLQSPLQEA

SEQ ID NO: 611619 - protein, 9 aa, Homo Sapiens
YKTNEPVCE

SEQ ID NO: 611620 - protein, 9 aa, Homo Sapiens
PLSRTPTST

SEQ ID NO: 611621 - protein, 9 aa, Homo Sapiens
YGDANIKSP

SEQ ID NO: 611622 - protein, 9 aa, Homo Sapiens
ELLVTASVN

SEQ ID NO: 611623 - protein, 9 aa, Homo Sapiens
RTLCTVKLP

SEQ ID NO: 611624 - protein, 9 aa, Homo Sapiens
FKNRRQRYR

SEQ ID NO: 611625 - protein, 9 aa, Homo Sapiens
YRLPGGGIG

SEQ ID NO: 611626 - protein, 9 aa, Homo Sapiens
NLRELGPRA

SEQ ID NO: 611627 - protein, 9 aa, Homo Sapiens
GDFINEGLI

SEQ ID NO: 611628 - protein, 9 aa, Homo Sapiens
SCKTYVLVT

SEQ ID NO: 611629 - protein, 9 aa, Homo Sapiens
AFGYFGILL

SEQ ID NO: 611630 - protein, 9 aa, Homo Sapiens
CCLNLKQFI

SEQ ID NO: 611631 - protein, 9 aa, Homo Sapiens
LRTLCRLLQ

SEQ ID NO: 611632 - protein, 9 aa, Homo Sapiens
YHVFSNLHS

SEQ ID NO: 611633 - protein, 9 aa, Homo Sapiens
HLPCPVEEI

SEQ ID NO: 611634 - protein, 9 aa, Homo Sapiens
VWRISDVHS

SEQ ID NO: 611635 - protein, 9 aa, Homo Sapiens
EARSQQCAL

SEQ ID NO: 611636 - protein, 9 aa, Homo Sapiens
YMFNMYVGV

SEQ ID NO: 611637 - protein, 9 aa, Homo Sapiens
GEIFEHTLH

SEQ ID NO: 611638 - protein, 9 aa, Homo Sapiens
KNRRQRYRA

SEQ ID NO: 611639 - protein, 9 aa, Homo Sapiens
ESGSQSHPR

SEQ ID NO: 611640 - protein, 9 aa, Homo Sapiens
SKWSTFGSL

SEQ ID NO: 611641 - protein, 9 aa, Homo Sapiens
QSLATEDAF

SEQ ID NO: 611642 - protein, 9 aa, Homo Sapiens
LLECLTFED

SEQ ID NO: 611643 - protein, 9 aa, Homo Sapiens
TALQDSNSR

SEQ ID NO: 611644 - protein, 9 aa, Homo Sapiens
PLLLFCYIG

SEQ ID NO: 611645 - protein, 9 aa, Homo Sapiens
QSLVFSVAE

SEQ ID NO: 611646 - protein, 9 aa, Homo Sapiens
QLCGELERI

SEQ ID NO: 611647 - protein, 9 aa, Homo Sapiens
LASLNSYLE

SEQ ID NO: 611648 - protein, 9 aa, Homo Sapiens
CFTSTKVPK

SEQ ID NO: 611649 - protein, 9 aa, Homo Sapiens
SFSIPRPDE

SEQ ID NO: 611650 - protein, 9 aa, Homo Sapiens
EQHEVELSR

SEQ ID NO: 611651 - protein, 9 aa, Homo Sapiens
ANTIIFMIL

SEQ ID NO: 611652 - protein, 9 aa, Homo Sapiens
RVGGWRARD

SEQ ID NO: 611653 - protein, 9 aa, Homo Sapiens
SRHKIQAKY

SEQ ID NO: 611654 - protein, 9 aa, Homo Sapiens
AAERARRGQ

SEQ ID NO: 611655 - protein, 9 aa, Homo Sapiens
HPDTEHVQQ

SEQ ID NO: 611656 - protein, 9 aa, Homo Sapiens
ARALKQILC

SEQ ID NO: 611657 - protein, 9 aa, Homo Sapiens
QHLCFTRHE

SEQ ID NO: 611658 - protein, 9 aa, Homo Sapiens
KYYNELSKR

SEQ ID NO: 611659 - protein, 9 aa, Homo Sapiens
FVEEFRPDS

SEQ ID NO: 611660 - protein, 9 aa, Homo Sapiens
GAKSIYKKR

SEQ ID NO: 611661 - protein, 9 aa, Homo Sapiens
EGLIAADND

SEQ ID NO: 611662 - protein, 9 aa, Homo Sapiens
AAAAASRRQ

SEQ ID NO: 611663 - protein, 9 aa, Homo Sapiens
VLTATTERK

SEQ ID NO: 611664 - protein, 9 aa, Homo Sapiens
KVLLVFDFD

SEQ ID NO: 611665 - protein, 9 aa, Homo Sapiens
CTVITPMLN

SEQ ID NO: 611666 - protein, 9 aa, Homo Sapiens
VEVKIVEHA

SEQ ID NO: 611667 - protein, 9 aa, Homo Sapiens
LERIQNLLG

SEQ ID NO: 611668 - protein, 9 aa, Homo Sapiens
GISLEAFVC

SEQ ID NO: 611669 - protein, 9 aa, Homo Sapiens
PGGGIGLGV

SEQ ID NO: 611670 - protein, 9 aa, Homo Sapiens
NLKQFILFH

SEQ ID NO: 611671 - protein, 9 aa, Homo Sapiens
EEEVPFCTL

SEQ ID NO: 611672 - protein, 9 aa, Homo Sapiens
AAGAWSPTR

SEQ ID NO: 611673 - protein, 9 aa, Homo Sapiens
GDHSRGKRF

SEQ ID NO: 611674 - protein, 9 aa, Homo Sapiens
HVAGVLLQH

SEQ ID NO: 611675 - protein, 9 aa, Homo Sapiens
ANNLSSLSN

SEQ ID NO: 611676 - protein, 9 aa, Homo Sapiens
SLEVMPQNE

SEQ ID NO: 611677 - protein, 9 aa, Homo Sapiens
SARRYVSAV

SEQ ID NO: 611678 - protein, 9 aa, Homo Sapiens
SLSSPQPAE

SEQ ID NO: 611679 - protein, 9 aa, Homo Sapiens
RQDVPYVLK

SEQ ID NO: 611680 - protein, 9 aa, Homo Sapiens
LADGSRLLQ

SEQ ID NO: 611681 - protein, 9 aa, Homo Sapiens
SRIEEVVPQ

SEQ ID NO: 611682 - protein, 9 aa, Homo Sapiens
PPQAFPPAH

SEQ ID NO: 611683 - protein, 9 aa, Homo Sapiens
YNSMMGDDE

SEQ ID NO: 611684 - protein, 9 aa, Homo Sapiens
NRKTHQGPV

SEQ ID NO: 611685 - protein, 9 aa, Homo Sapiens
SQSPHVVIQ

SEQ ID NO: 611686 - protein, 9 aa, Homo Sapiens
KVDVYDEVS

SEQ ID NO: 611687 - protein, 9 aa, Homo Sapiens
PLGPARASW

SEQ ID NO: 611688 - protein, 9 aa, Homo Sapiens
KAMKMKGGS

SEQ ID NO: 611689 - protein, 9 aa, Homo Sapiens
LINQETSSA

SEQ ID NO: 611690 - protein, 9 aa, Homo Sapiens
NNHLSGILI

SEQ ID NO: 611691 - protein, 9 aa, Homo Sapiens
ELKEERINE

SEQ ID NO: 611692 - protein, 9 aa, Homo Sapiens
LPGGLEFWG

SEQ ID NO: 611693 - protein, 9 aa, Homo Sapiens
PRTSTAWST

SEQ ID NO: 611694 - protein, 9 aa, Homo Sapiens
VISALVSII

SEQ ID NO: 611695 - protein, 9 aa, Homo Sapiens
WTTREPHAS

SEQ ID NO: 611696 - protein, 9 aa, Homo Sapiens
PPKVSLEGR

SEQ ID NO: 611697 - protein, 9 aa, Homo Sapiens
QEVNLQLIN

SEQ ID NO: 611698 - protein, 9 aa, Homo Sapiens
GYFGILLSR

SEQ ID NO: 611699 - protein, 9 aa, Homo Sapiens
LSSEVCTST

SEQ ID NO: 611700 - protein, 9 aa, Homo Sapiens
AKSIYKKRK

SEQ ID NO: 611701 - protein, 9 aa, Homo Sapiens
IQMTAGSYL

SEQ ID NO: 611702 - protein, 9 aa, Homo Sapiens
DTYLFKGAH

SEQ ID NO: 611703 - protein, 9 aa, Homo Sapiens
CRLLQITTR

SEQ ID NO: 611704 - protein, 9 aa, Homo Sapiens
YSATTCQQE

SEQ ID NO: 611705 - protein, 9 aa, Homo Sapiens
EQKRIKHCK

SEQ ID NO: 611706 - protein, 9 aa, Homo Sapiens
TLYKDVKPV

SEQ ID NO: 611707 - protein, 9 aa, Homo Sapiens
IAEIKEKIR

SEQ ID NO: 611708 - protein, 9 aa, Homo Sapiens
FSWLPSHNG

SEQ ID NO: 611709 - protein, 9 aa, Homo Sapiens
VSVLSGAER

SEQ ID NO: 611710 - protein, 9 aa, Homo Sapiens
FRNGSPVSF

SEQ ID NO: 611711 - protein, 9 aa, Homo Sapiens
VNVSDSLEI

SEQ ID NO: 611712 - protein, 9 aa, Homo Sapiens
CSLSLLTNF

SEQ ID NO: 611713 - protein, 9 aa, Homo Sapiens
KQSDKMTAK

SEQ ID NO: 611714 - protein, 9 aa, Homo Sapiens
LLRRSHGDH

SEQ ID NO: 611715 - protein, 9 aa, Homo Sapiens
QEELSVLSR

SEQ ID NO: 611716 - protein, 9 aa, Homo Sapiens
SKHSKVLEL

SEQ ID NO: 611717 - protein, 9 aa, Homo Sapiens
APKSEEFSH

SEQ ID NO: 611718 - protein, 9 aa, Homo Sapiens
IYNQKGVFP

SEQ ID NO: 611719 - protein, 9 aa, Homo Sapiens
HPQAPNDEG

SEQ ID NO: 611720 - protein, 9 aa, Homo Sapiens
WDTEHVAGV

SEQ ID NO: 611721 - protein, 9 aa, Homo Sapiens
KQDGFTYTG

SEQ ID NO: 611722 - protein, 9 aa, Homo Sapiens
SLLDSLWCS

SEQ ID NO: 611723 - protein, 9 aa, Homo Sapiens
YVSANPSLR

SEQ ID NO: 611724 - protein, 9 aa, Homo Sapiens
LSIETTQPS

SEQ ID NO: 611725 - protein, 9 aa, Homo Sapiens
AVLLGLQPA

SEQ ID NO: 611726 - protein, 9 aa, Homo Sapiens
SCCWLALLV

SEQ ID NO: 611727 - protein, 9 aa, Homo Sapiens
VVFPYFQRL

SEQ ID NO: 611728 - protein, 9 aa, Homo Sapiens
VDWESFGYN

SEQ ID NO: 611729 - protein, 9 aa, Homo Sapiens
KYIGPCAGR

SEQ ID NO: 611730 - protein, 9 aa, Homo Sapiens
SITGPLPLS

SEQ ID NO: 611731 - protein, 9 aa, Homo Sapiens
MAYDRYLDI

SEQ ID NO: 611732 - protein, 9 aa, Homo Sapiens
GMRRSLDVS

SEQ ID NO: 611733 - protein, 9 aa, Homo Sapiens
RHKVMLKEI

SEQ ID NO: 611734 - protein, 9 aa, Homo Sapiens
AGSRIAVPR

SEQ ID NO: 611735 - protein, 9 aa, Homo Sapiens
RKAHILNNL

SEQ ID NO: 611736 - protein, 9 aa, Homo Sapiens
RLLPRSQRL

SEQ ID NO: 611737 - protein, 9 aa, Homo Sapiens
VYDEVSYTC

SEQ ID NO: 611738 - protein, 9 aa, Homo Sapiens
TLCTVKLPE

SEQ ID NO: 611739 - protein, 9 aa, Homo Sapiens
DQLCGELER

SEQ ID NO: 611740 - protein, 9 aa, Homo Sapiens
LTPLLNHLI

SEQ ID NO: 611741 - protein, 9 aa, Homo Sapiens
YKPLPSSLL

SEQ ID NO: 611742 - protein, 9 aa, Homo Sapiens
MAAAVAAAA

SEQ ID NO: 611743 - protein, 9 aa, Homo Sapiens
KNEFQKWLG

SEQ ID NO: 611744 - protein, 9 aa, Homo Sapiens
SNHHHQSRG

SEQ ID NO: 611745 - protein, 9 aa, Homo Sapiens
QPQPPLPQP

SEQ ID NO: 611746 - protein, 9 aa, Homo Sapiens
KAFSTCYSH

SEQ ID NO: 611747 - protein, 9 aa, Homo Sapiens
RQRLSGQEF

SEQ ID NO: 611748 - protein, 9 aa, Homo Sapiens
GLVWLQACA

SEQ ID NO: 611749 - protein, 9 aa, Homo Sapiens
QYTIEGREP

SEQ ID NO: 611750 - protein, 9 aa, Homo Sapiens
DHCVPRSHS

SEQ ID NO: 611751 - protein, 9 aa, Homo Sapiens
HDIDPTGTY

SEQ ID NO: 611752 - protein, 9 aa, Homo Sapiens
HCQQSPVLA

SEQ ID NO: 611753 - protein, 9 aa, Homo Sapiens
RAAAAGAWS

SEQ ID NO: 611754 - protein, 9 aa, Homo Sapiens
IVHEKEELK

SEQ ID NO: 611755 - protein, 9 aa, Homo Sapiens
DLTSVRVTT

SEQ ID NO: 611756 - protein, 9 aa, Homo Sapiens
ASVHFVEPL

SEQ ID NO: 611757 - protein, 9 aa, Homo Sapiens
TVMVLVLEK

SEQ ID NO: 611758 - protein, 9 aa, Homo Sapiens
RAGVFPERV

SEQ ID NO: 611759 - protein, 9 aa, Homo Sapiens
CDPGAVFLN

SEQ ID NO: 611760 - protein, 9 aa, Homo Sapiens
IAVDWESFG

SEQ ID NO: 611761 - protein, 9 aa, Homo Sapiens
WYDRHKVML

SEQ ID NO: 611762 - protein, 9 aa, Homo Sapiens
GTEQQRLAA

SEQ ID NO: 611763 - protein, 9 aa, Homo Sapiens
LHHQLLHLL

SEQ ID NO: 611764 - protein, 9 aa, Homo Sapiens
ADLNMKNCA

SEQ ID NO: 611765 - protein, 9 aa, Homo Sapiens
QASFELLLW

SEQ ID NO: 611766 - protein, 9 aa, Homo Sapiens
ICSLGCYLP

SEQ ID NO: 611767 - protein, 9 aa, Homo Sapiens
MIDLGLSTF

SEQ ID NO: 611768 - protein, 9 aa, Homo Sapiens
EDCLQLPDD

SEQ ID NO: 611769 - protein, 9 aa, Homo Sapiens
PTGPAPPFP

SEQ ID NO: 611770 - protein, 9 aa, Homo Sapiens
DPDKANQRK

SEQ ID NO: 611771 - protein, 9 aa, Homo Sapiens
VTVQIQDIN

SEQ ID NO: 611772 - protein, 9 aa, Homo Sapiens
GPLNRADAQ

SEQ ID NO: 611773 - protein, 9 aa, Homo Sapiens
LTVMVLVLE

SEQ ID NO: 611774 - protein, 9 aa, Homo Sapiens
ISNQDLVTC

SEQ ID NO: 611775 - protein, 9 aa, Homo Sapiens
LYVGSWLGV

SEQ ID NO: 611776 - protein, 9 aa, Homo Sapiens
VTKKRLSSG

SEQ ID NO: 611777 - protein, 9 aa, Homo Sapiens
PSGARAHRP

SEQ ID NO: 611778 - protein, 9 aa, Homo Sapiens
FSRDGSKFS

SEQ ID NO: 611779 - protein, 9 aa, Homo Sapiens
SVARTAQQY

SEQ ID NO: 611780 - protein, 9 aa, Homo Sapiens
NHDMYYALG

SEQ ID NO: 611781 - protein, 9 aa, Homo Sapiens
FFGEGTITY

SEQ ID NO: 611782 - protein, 9 aa, Homo Sapiens
VILGSSEQH

SEQ ID NO: 611783 - protein, 9 aa, Homo Sapiens
FTVWPYICE

SEQ ID NO: 611784 - protein, 9 aa, Homo Sapiens
ATVAVPAQQ

SEQ ID NO: 611785 - protein, 9 aa, Homo Sapiens
VLSGAERSF

SEQ ID NO: 611786 - protein, 9 aa, Homo Sapiens
RPVVNGEEG

SEQ ID NO: 611787 - protein, 9 aa, Homo Sapiens
TTHLQKEIA

SEQ ID NO: 611788 - protein, 9 aa, Homo Sapiens
AVSPPLRNG

SEQ ID NO: 611789 - protein, 9 aa, Homo Sapiens
ICTVKVSYC

SEQ ID NO: 611790 - protein, 9 aa, Homo Sapiens
DIPLHLPDP

SEQ ID NO: 611791 - protein, 9 aa, Homo Sapiens
DQGPSESPP

SEQ ID NO: 611792 - protein, 9 aa, Homo Sapiens
IFGASVERE

SEQ ID NO: 611793 - protein, 9 aa, Homo Sapiens
NEYELMRER

SEQ ID NO: 611794 - protein, 9 aa, Homo Sapiens
LGKELANWD

SEQ ID NO: 611795 - protein, 9 aa, Homo Sapiens
SICSLGCYL

SEQ ID NO: 611796 - protein, 9 aa, Homo Sapiens
SVLSGAERS

SEQ ID NO: 611797 - protein, 9 aa, Homo Sapiens
ASNPSGAPI

SEQ ID NO: 611798 - protein, 9 aa, Homo Sapiens
YSNYPDSDD

SEQ ID NO: 611799 - protein, 9 aa, Homo Sapiens
VDGLIDCMD

SEQ ID NO: 611800 - protein, 9 aa, Homo Sapiens
DTNDICLQG

SEQ ID NO: 611801 - protein, 9 aa, Homo Sapiens
DNFHKKFER

SEQ ID NO: 611802 - protein, 9 aa, Homo Sapiens
LRIVSFTKI

SEQ ID NO: 611803 - protein, 9 aa, Homo Sapiens
ARSIFQEIA

SEQ ID NO: 611804 - protein, 9 aa, Homo Sapiens
LEREAKEIF

SEQ ID NO: 611805 - protein, 9 aa, Homo Sapiens
KRGGETQPE

SEQ ID NO: 611806 - protein, 9 aa, Homo Sapiens
ALLAILLCV

SEQ ID NO: 611807 - protein, 9 aa, Homo Sapiens
GCGYGSCGY

SEQ ID NO: 611808 - protein, 9 aa, Homo Sapiens
LYMLSFLHF

SEQ ID NO: 611809 - protein, 9 aa, Homo Sapiens
PLKSVDFLY

SEQ ID NO: 611810 - protein, 9 aa, Homo Sapiens
ELLLWNNYF

SEQ ID NO: 611811 - protein, 9 aa, Homo Sapiens
DMPIGTNVL

SEQ ID NO: 611812 - protein, 9 aa, Homo Sapiens
KTNEPVCEE

SEQ ID NO: 611813 - protein, 9 aa, Homo Sapiens
ILEKAMKMK

SEQ ID NO: 611814 - protein, 9 aa, Homo Sapiens
ICANGSEQS

SEQ ID NO: 611815 - protein, 9 aa, Homo Sapiens
FSRATARRK

SEQ ID NO: 611816 - protein, 9 aa, Homo Sapiens
LYSKACISI

SEQ ID NO: 611817 - protein, 9 aa, Homo Sapiens
DAGWLLGVK

SEQ ID NO: 611818 - protein, 9 aa, Homo Sapiens
THNYTISLG

SEQ ID NO: 611819 - protein, 9 aa, Homo Sapiens
PYVSANPSL

SEQ ID NO: 611820 - protein, 9 aa, Homo Sapiens
HFASSAEKL

SEQ ID NO: 611821 - protein, 9 aa, Homo Sapiens
IKLPDCEQF

SEQ ID NO: 611822 - protein, 9 aa, Homo Sapiens
PYLPYKVLP

SEQ ID NO: 611823 - protein, 9 aa, Homo Sapiens
TPVAPKNDL

SEQ ID NO: 611824 - protein, 9 aa, Homo Sapiens
GVMKKEKLT

SEQ ID NO: 611825 - protein, 9 aa, Homo Sapiens
LPAFNAKLP

SEQ ID NO: 611826 - protein, 9 aa, Homo Sapiens
IHIGQKREV

SEQ ID NO: 611827 - protein, 9 aa, Homo Sapiens
ESSKTSSCD

SEQ ID NO: 611828 - protein, 9 aa, Homo Sapiens
PEQERDWSQ

SEQ ID NO: 611829 - protein, 9 aa, Homo Sapiens
VGQIHVTKL

SEQ ID NO: 611830 - protein, 9 aa, Homo Sapiens
TARRRRKRR

SEQ ID NO: 611831 - protein, 9 aa, Homo Sapiens
ATSLSSPQP

SEQ ID NO: 611832 - protein, 9 aa, Homo Sapiens
ATRQALPGV

SEQ ID NO: 611833 - protein, 9 aa, Homo Sapiens
SAVFSASWY

SEQ ID NO: 611834 - protein, 9 aa, Homo Sapiens
QDDLQSSEN

SEQ ID NO: 611835 - protein, 9 aa, Homo Sapiens
QKLLRHFLV

SEQ ID NO: 611836 - protein, 9 aa, Homo Sapiens
ILNHHSCSV

SEQ ID NO: 611837 - protein, 9 aa, Homo Sapiens
WGFSGGWTA

SEQ ID NO: 611838 - protein, 9 aa, Homo Sapiens
ERPLPLNQR

SEQ ID NO: 611839 - protein, 9 aa, Homo Sapiens
KPYGAYDFL

SEQ ID NO: 611840 - protein, 9 aa, Homo Sapiens
LFLGAVESF

SEQ ID NO: 611841 - protein, 9 aa, Homo Sapiens
SIQELTVSY

SEQ ID NO: 611842 - protein, 9 aa, Homo Sapiens
PWLVHVMLA

SEQ ID NO: 611843 - protein, 9 aa, Homo Sapiens
AAVHGLTQL

SEQ ID NO: 611844 - protein, 9 aa, Homo Sapiens
QERRMLGTK

SEQ ID NO: 611845 - protein, 9 aa, Homo Sapiens
TTASPTTST

SEQ ID NO: 611846 - protein, 9 aa, Homo Sapiens
VFEVPKTYE

SEQ ID NO: 611847 - protein, 9 aa, Homo Sapiens
EEDFECIEN

SEQ ID NO: 611848 - protein, 9 aa, Homo Sapiens
DFCYLDVDK

SEQ ID NO: 611849 - protein, 9 aa, Homo Sapiens
AQQKVRTAR

SEQ ID NO: 611850 - protein, 9 aa, Homo Sapiens
LTFVKKRAL

SEQ ID NO: 611851 - protein, 9 aa, Homo Sapiens
SALGHRHAA

SEQ ID NO: 611852 - protein, 9 aa, Homo Sapiens
FLHFLVLLV

SEQ ID NO: 611853 - protein, 9 aa, Homo Sapiens
AVIRNFLYV

SEQ ID NO: 611854 - protein, 9 aa, Homo Sapiens
SSSEMKAGR

SEQ ID NO: 611855 - protein, 9 aa, Homo Sapiens
VKDAHEVRI

SEQ ID NO: 611856 - protein, 9 aa, Homo Sapiens
ASCKTYVLV

SEQ ID NO: 611857 - protein, 9 aa, Homo Sapiens
QTAGPHPGH

SEQ ID NO: 611858 - protein, 9 aa, Homo Sapiens
SELPTSSGR

SEQ ID NO: 611859 - protein, 9 aa, Homo Sapiens
HSSGQSFQQ

SEQ ID NO: 611860 - protein, 9 aa, Homo Sapiens
VDDVKRVYS

SEQ ID NO: 611861 - protein, 9 aa, Homo Sapiens
FSFDKMLND

SEQ ID NO: 611862 - protein, 9 aa, Homo Sapiens
STMGSWRKS

SEQ ID NO: 611863 - protein, 9 aa, Homo Sapiens
YRISELMST

SEQ ID NO: 611864 - protein, 9 aa, Homo Sapiens
CTVKLPENV

SEQ ID NO: 611865 - protein, 9 aa, Homo Sapiens
LLPPSSSEM

SEQ ID NO: 611866 - protein, 9 aa, Homo Sapiens
AFFQDQNYT

SEQ ID NO: 611867 - protein, 9 aa, Homo Sapiens
MASDDLREL

SEQ ID NO: 611868 - protein, 9 aa, Homo Sapiens
NAGSQGLGP

SEQ ID NO: 611869 - protein, 9 aa, Homo Sapiens
RVGFAEAAH

SEQ ID NO: 611870 - protein, 9 aa, Homo Sapiens
FKDVLEASV

SEQ ID NO: 611871 - protein, 9 aa, Homo Sapiens
ITEQKLGSS

SEQ ID NO: 611872 - protein, 9 aa, Homo Sapiens
QTRREEALA

SEQ ID NO: 611873 - protein, 9 aa, Homo Sapiens
EKQMQRYQE

SEQ ID NO: 611874 - protein, 9 aa, Homo Sapiens
RYSLICHEI

SEQ ID NO: 611875 - protein, 9 aa, Homo Sapiens
DWQRLCTEI

SEQ ID NO: 611876 - protein, 9 aa, Homo Sapiens
HAASAPGGR

SEQ ID NO: 611877 - protein, 9 aa, Homo Sapiens
VRYAIDRKS

SEQ ID NO: 611878 - protein, 9 aa, Homo Sapiens
LTLPRSVLL

SEQ ID NO: 611879 - protein, 9 aa, Homo Sapiens
TKYAKKVAK

SEQ ID NO: 611880 - protein, 9 aa, Homo Sapiens
LPAAPRGGP

SEQ ID NO: 611881 - protein, 9 aa, Homo Sapiens
ILLEKGAKP

SEQ ID NO: 611882 - protein, 9 aa, Homo Sapiens
LNPLSIETT

SEQ ID NO: 611883 - protein, 9 aa, Homo Sapiens
SIINEAGSG

SEQ ID NO: 611884 - protein, 9 aa, Homo Sapiens
QKPASLAAQ

SEQ ID NO: 611885 - protein, 9 aa, Homo Sapiens
VKIVEHAEK

SEQ ID NO: 611886 - protein, 9 aa, Homo Sapiens
VLKRRCVEA

SEQ ID NO: 611887 - protein, 9 aa, Homo Sapiens
AAVQEEQGG

SEQ ID NO: 611888 - protein, 9 aa, Homo Sapiens
NSPRVLLRD

SEQ ID NO: 611889 - protein, 9 aa, Homo Sapiens
QWDTEHVAG

SEQ ID NO: 611890 - protein, 9 aa, Homo Sapiens
SANPSLRGG

SEQ ID NO: 611891 - protein, 9 aa, Homo Sapiens
LLPPIQVKR

SEQ ID NO: 611892 - protein, 9 aa, Homo Sapiens
ILRYDSTRV

SEQ ID NO: 611893 - protein, 9 aa, Homo Sapiens
TRRDTRKAH

SEQ ID NO: 611894 - protein, 9 aa, Homo Sapiens
FHPSLLFFN

SEQ ID NO: 611895 - protein, 9 aa, Homo Sapiens
KIVHWKSQT

SEQ ID NO: 611896 - protein, 9 aa, Homo Sapiens
RGFRRGVAG

SEQ ID NO: 611897 - protein, 9 aa, Homo Sapiens
EPPKVSLEG

SEQ ID NO: 611898 - protein, 9 aa, Homo Sapiens
PGRPGEPWL

SEQ ID NO: 611899 - protein, 9 aa, Homo Sapiens
STLHSKETS

SEQ ID NO: 611900 - protein, 9 aa, Homo Sapiens
AFGPGCPHP

SEQ ID NO: 611901 - protein, 9 aa, Homo Sapiens
LLEIVCFCG

SEQ ID NO: 611902 - protein, 9 aa, Homo Sapiens
ITGPLPLSL

SEQ ID NO: 611903 - protein, 9 aa, Homo Sapiens
GLSIVRGKD

SEQ ID NO: 611904 - protein, 9 aa, Homo Sapiens
VDFLYAYPG

SEQ ID NO: 611905 - protein, 9 aa, Homo Sapiens
KRIKHCKMA

SEQ ID NO: 611906 - protein, 9 aa, Homo Sapiens
NKNHLVLEK

SEQ ID NO: 611907 - protein, 9 aa, Homo Sapiens
QLEKLRREL

SEQ ID NO: 611908 - protein, 9 aa, Homo Sapiens
EGRDGEAAE

SEQ ID NO: 611909 - protein, 9 aa, Homo Sapiens
YYYRMHTKI

SEQ ID NO: 611910 - protein, 9 aa, Homo Sapiens
EHFREVIKR

SEQ ID NO: 611911 - protein, 9 aa, Homo Sapiens
CFKGLLIFG

SEQ ID NO: 611912 - protein, 9 aa, Homo Sapiens
NVVPQENTD

SEQ ID NO: 611913 - protein, 9 aa, Homo Sapiens
SMRKSAKEK

SEQ ID NO: 611914 - protein, 9 aa, Homo Sapiens
QSPQNKNHL

SEQ ID NO: 611915 - protein, 9 aa, Homo Sapiens
PSLMDLMYK

SEQ ID NO: 611916 - protein, 9 aa, Homo Sapiens
LQSPLQEAI

SEQ ID NO: 611917 - protein, 9 aa, Homo Sapiens
ESRHKIQAK

SEQ ID NO: 611918 - protein, 9 aa, Homo Sapiens
DNEVDGLID

SEQ ID NO: 611919 - protein, 9 aa, Homo Sapiens
SKFSMTVPV

SEQ ID NO: 611920 - protein, 9 aa, Homo Sapiens
THCSLEKAL

SEQ ID NO: 611921 - protein, 9 aa, Homo Sapiens
MYAMLVFTL

SEQ ID NO: 611922 - protein, 9 aa, Homo Sapiens
AITNATEYA

SEQ ID NO: 611923 - protein, 9 aa, Homo Sapiens
FFHFVGGAM

SEQ ID NO: 611924 - protein, 9 aa, Homo Sapiens
GAVSEMVLL

SEQ ID NO: 611925 - protein, 9 aa, Homo Sapiens
FPEDEFDGH

SEQ ID NO: 611926 - protein, 9 aa, Homo Sapiens
LPSSLKVPG

SEQ ID NO: 611927 - protein, 9 aa, Homo Sapiens
GDANIKSPA

SEQ ID NO: 611928 - protein, 9 aa, Homo Sapiens
ARVGVREPL

SEQ ID NO: 611929 - protein, 9 aa, Homo Sapiens
LRGALRGFR

SEQ ID NO: 611930 - protein, 9 aa, Homo Sapiens
SALVSIIKV

SEQ ID NO: 611931 - protein, 9 aa, Homo Sapiens
VESAKVEAH

SEQ ID NO: 611932 - protein, 9 aa, Homo Sapiens
KDVLEASVE

SEQ ID NO: 611933 - protein, 9 aa, Homo Sapiens
NYIPPPLGQ

SEQ ID NO: 611934 - protein, 9 aa, Homo Sapiens
EHVAGVLLQ

SEQ ID NO: 611935 - protein, 9 aa, Homo Sapiens
MRRSLDVSP

SEQ ID NO: 611936 - protein, 9 aa, Homo Sapiens
ASPPPAVPG

SEQ ID NO: 611937 - protein, 9 aa, Homo Sapiens
VVTTPAVSW

SEQ ID NO: 611938 - protein, 9 aa, Homo Sapiens
ELIPTKSCK

SEQ ID NO: 611939 - protein, 9 aa, Homo Sapiens
VIFRNGSPV

SEQ ID NO: 611940 - protein, 9 aa, Homo Sapiens
QDGEARSQQ

SEQ ID NO: 611941 - protein, 9 aa, Homo Sapiens
FQGSMLHVL

SEQ ID NO: 611942 - protein, 9 aa, Homo Sapiens
HPHAFIRCP

SEQ ID NO: 611943 - protein, 9 aa, Homo Sapiens
DKKPYEKNV

SEQ ID NO: 611944 - protein, 9 aa, Homo Sapiens
ESFSWSGGA

SEQ ID NO: 611945 - protein, 9 aa, Homo Sapiens
VAAVRLGPR

SEQ ID NO: 611946 - protein, 9 aa, Homo Sapiens
TYLADMHRQ

SEQ ID NO: 611947 - protein, 9 aa, Homo Sapiens
VCDEPRDTE

SEQ ID NO: 611948 - protein, 9 aa, Homo Sapiens
FYTIRTPML

SEQ ID NO: 611949 - protein, 9 aa, Homo Sapiens
YLKKKLNEQ

SEQ ID NO: 611950 - protein, 9 aa, Homo Sapiens
KRVVYNAQR

SEQ ID NO: 611951 - protein, 9 aa, Homo Sapiens
HCKMASKLI

SEQ ID NO: 611952 - protein, 9 aa, Homo Sapiens
STFAGLHQH

SEQ ID NO: 611953 - protein, 8 aa, Homo Sapiens
GGRGADAG

SEQ ID NO: 611954 - protein, 9 aa, Homo Sapiens
EDAEREERK

SEQ ID NO: 611955 - protein, 9 aa, Homo Sapiens
FLSRAASHR

SEQ ID NO: 611956 - protein, 9 aa, Homo Sapiens
DKPSTSFLL

SEQ ID NO: 611957 - protein, 9 aa, Homo Sapiens
ESAIGAPHL

SEQ ID NO: 611958 - protein, 9 aa, Homo Sapiens
AKEIFQQLQ

SEQ ID NO: 611959 - protein, 9 aa, Homo Sapiens
KSICSLGCY

SEQ ID NO: 611960 - protein, 9 aa, Homo Sapiens
RSPSGARAH

SEQ ID NO: 611961 - protein, 9 aa, Homo Sapiens
SVFLEWIQP

SEQ ID NO: 611962 - protein, 9 aa, Homo Sapiens
SVLERPLPL

SEQ ID NO: 611963 - protein, 9 aa, Homo Sapiens
PFTKLEENA

SEQ ID NO: 611964 - protein, 9 aa, Homo Sapiens
EEYNKAVQE

SEQ ID NO: 611965 - protein, 9 aa, Homo Sapiens
AGGMAGTFA

SEQ ID NO: 611966 - protein, 9 aa, Homo Sapiens
SGSSSTFAG

SEQ ID NO: 611967 - protein, 9 aa, Homo Sapiens
FSSDSNGIC

SEQ ID NO: 611968 - protein, 9 aa, Homo Sapiens
EGKAKIVVP

SEQ ID NO: 611969 - protein, 9 aa, Homo Sapiens
TYTGAYWRS

SEQ ID NO: 611970 - protein, 9 aa, Homo Sapiens
VSHYIFQKY

SEQ ID NO: 611971 - protein, 9 aa, Homo Sapiens
ELVQHCQSL

SEQ ID NO: 611972 - protein, 9 aa, Homo Sapiens
GHGNAGQSN

SEQ ID NO: 611973 - protein, 9 aa, Homo Sapiens
KTILKSKLE

SEQ ID NO: 611974 - protein, 9 aa, Homo Sapiens
DNLLDSITG

SEQ ID NO: 611975 - protein, 9 aa, Homo Sapiens
NGYFGVGEG

SEQ ID NO: 611976 - protein, 9 aa, Homo Sapiens
WAQWRGAHR

SEQ ID NO: 611977 - protein, 9 aa, Homo Sapiens
IEDPATLNK

SEQ ID NO: 611978 - protein, 9 aa, Homo Sapiens
AKNSYTHCN

SEQ ID NO: 611979 - protein, 9 aa, Homo Sapiens
SLSLSHSLR

SEQ ID NO: 611980 - protein, 9 aa, Homo Sapiens
ELNPHGMSA

SEQ ID NO: 611981 - protein, 9 aa, Homo Sapiens
WNWKKAKNT

SEQ ID NO: 611982 - protein, 9 aa, Homo Sapiens
TKQSSCSRR

SEQ ID NO: 611983 - protein, 9 aa, Homo Sapiens
PAQQKVRTA

SEQ ID NO: 611984 - protein, 9 aa, Homo Sapiens
EPASCTMPA

SEQ ID NO: 611985 - protein, 9 aa, Homo Sapiens
TNATEYARK

SEQ ID NO: 611986 - protein, 9 aa, Homo Sapiens
CYMFNMYVG

SEQ ID NO: 611987 - protein, 9 aa, Homo Sapiens
LHAEVTENG

SEQ ID NO: 611988 - protein, 9 aa, Homo Sapiens
FDIAEVYAA

SEQ ID NO: 611989 - protein, 9 aa, Homo Sapiens
YNELTGHFR

SEQ ID NO: 611990 - protein, 9 aa, Homo Sapiens
GDTYLFKGA

SEQ ID NO: 611991 - protein, 9 aa, Homo Sapiens
FLNPLSIET

SEQ ID NO: 611992 - protein, 9 aa, Homo Sapiens
SGVSLVSSG

SEQ ID NO: 611993 - protein, 9 aa, Homo Sapiens
DSNCGVMRG

SEQ ID NO: 611994 - protein, 9 aa, Homo Sapiens
KERPGDRPA

SEQ ID NO: 611995 - protein, 9 aa, Homo Sapiens
QSSTPNPLE

SEQ ID NO: 611996 - protein, 9 aa, Homo Sapiens
RNHPDTRIR

SEQ ID NO: 611997 - protein, 9 aa, Homo Sapiens
MMLVNWQHP

SEQ ID NO: 611998 - protein, 9 aa, Homo Sapiens
ALFRVMAQD

SEQ ID NO: 611999 - protein, 9 aa, Homo Sapiens
RIAVDWESF

SEQ ID NO: 612000 - protein, 9 aa, Homo Sapiens
ARAGGYKTC

SEQ ID NO: 612001 - protein, 9 aa, Homo Sapiens
NKTTVVSPK

SEQ ID NO: 612002 - protein, 9 aa, Homo Sapiens
YYNELSKRI

SEQ ID NO: 612003 - protein, 9 aa, Homo Sapiens
QRIFVEEFR

SEQ ID NO: 612004 - protein, 9 aa, Homo Sapiens
SGRAQPLAN

SEQ ID NO: 612005 - protein, 9 aa, Homo Sapiens
AVQEEQGGL

SEQ ID NO: 612006 - protein, 9 aa, Homo Sapiens
ATARRKIRR

SEQ ID NO: 612007 - protein, 9 aa, Homo Sapiens
DLCDEFGNY

SEQ ID NO: 612008 - protein, 9 aa, Homo Sapiens
SVDFLYAYP

SEQ ID NO: 612009 - protein, 9 aa, Homo Sapiens
MDTDLCDEF

SEQ ID NO: 612010 - protein, 9 aa, Homo Sapiens
GGLEFWGPA

SEQ ID NO: 612011 - protein, 9 aa, Homo Sapiens
RLVLSEEIP

SEQ ID NO: 612012 - protein, 9 aa, Homo Sapiens
KGEEDEEDM

SEQ ID NO: 612013 - protein, 9 aa, Homo Sapiens
FALPLLGVP

SEQ ID NO: 612014 - protein, 9 aa, Homo Sapiens
EAKATTAPD

SEQ ID NO: 612015 - protein, 9 aa, Homo Sapiens
HMKHKKLPL

SEQ ID NO: 612016 - protein, 9 aa, Homo Sapiens
NTIIFMILG

SEQ ID NO: 612017 - protein, 9 aa, Homo Sapiens
LIVHQILHT

SEQ ID NO: 612018 - protein, 9 aa, Homo Sapiens
TVLLEARPE

SEQ ID NO: 612019 - protein, 9 aa, Homo Sapiens
ANGSEQSGV

SEQ ID NO: 612020 - protein, 9 aa, Homo Sapiens
SRQDVPYVL

SEQ ID NO: 612021 - protein, 9 aa, Homo Sapiens
LRYDSTRVP

SEQ ID NO: 612022 - protein, 9 aa, Homo Sapiens
CKTIVQAAS

SEQ ID NO: 612023 - protein, 9 aa, Homo Sapiens
AAPAYSPNI

SEQ ID NO: 612024 - protein, 9 aa, Homo Sapiens
LGEKMLKEE

SEQ ID NO: 612025 - protein, 9 aa, Homo Sapiens
PTSDPWIPS

SEQ ID NO: 612026 - protein, 9 aa, Homo Sapiens
KPYGCYECG

SEQ ID NO: 612027 - protein, 9 aa, Homo Sapiens
FLMQRRVPW

SEQ ID NO: 612028 - protein, 9 aa, Homo Sapiens
MDNFHKKFE

SEQ ID NO: 612029 - protein, 9 aa, Homo Sapiens
MKQLMDGLE

SEQ ID NO: 612030 - protein, 9 aa, Homo Sapiens
CSKMPGEGR

SEQ ID NO: 612031 - protein, 9 aa, Homo Sapiens
LNDRGNTAA

SEQ ID NO: 612032 - protein, 9 aa, Homo Sapiens
LICSFQLGD

SEQ ID NO: 612033 - protein, 9 aa, Homo Sapiens
KILEKAMKM

SEQ ID NO: 612034 - protein, 9 aa, Homo Sapiens
SPTFACNLS

SEQ ID NO: 612035 - protein, 9 aa, Homo Sapiens
AYFNIPSPA

SEQ ID NO: 612036 - protein, 9 aa, Homo Sapiens
CSTLALVPA

SEQ ID NO: 612037 - protein, 9 aa, Homo Sapiens
SSGTATLEN

SEQ ID NO: 612038 - protein, 9 aa, Homo Sapiens
HGIAVIRNF

SEQ ID NO: 612039 - protein, 9 aa, Homo Sapiens
SGQSFQQMR

SEQ ID NO: 612040 - protein, 9 aa, Homo Sapiens
RCRQRLSGQ

SEQ ID NO: 612041 - protein, 9 aa, Homo Sapiens
LRLPSLVGP

SEQ ID NO: 612042 - protein, 9 aa, Homo Sapiens
CFPSISLVA

SEQ ID NO: 612043 - protein, 9 aa, Homo Sapiens
SCTMPAGQR

SEQ ID NO: 612044 - protein, 9 aa, Homo Sapiens
GVVFPYFQR

SEQ ID NO: 612045 - protein, 9 aa, Homo Sapiens
LTGPGQTSG

SEQ ID NO: 612046 - protein, 9 aa, Homo Sapiens
CKTYVLVTE

SEQ ID NO: 612047 - protein, 9 aa, Homo Sapiens
VYQQEQARM

SEQ ID NO: 612048 - protein, 9 aa, Homo Sapiens
AEDAEREER

SEQ ID NO: 612049 - protein, 9 aa, Homo Sapiens
VPQVLGPVT

SEQ ID NO: 612050 - protein, 9 aa, Homo Sapiens
YIKFDLQFP

SEQ ID NO: 612051 - protein, 9 aa, Homo Sapiens
LVDNKCFVQ

SEQ ID NO: 612052 - protein, 9 aa, Homo Sapiens
QLMDGLEYC

SEQ ID NO: 612053 - protein, 9 aa, Homo Sapiens
PGTCLGTCT

SEQ ID NO: 612054 - protein, 9 aa, Homo Sapiens
AEILRLFPH

SEQ ID NO: 612055 - protein, 9 aa, Homo Sapiens
EESSAELYY

SEQ ID NO: 612056 - protein, 9 aa, Homo Sapiens
LRLFPHAAQ

SEQ ID NO: 612057 - protein, 9 aa, Homo Sapiens
SDPWIPSGS

SEQ ID NO: 612058 - protein, 9 aa, Homo Sapiens
PHPHSHPHW

SEQ ID NO: 612059 - protein, 9 aa, Homo Sapiens
NLLMDLTNH

SEQ ID NO: 612060 - protein, 9 aa, Homo Sapiens
VFMELFSVP

SEQ ID NO: 612061 - protein, 9 aa, Homo Sapiens
KSEEFSHLP

SEQ ID NO: 612062 - protein, 9 aa, Homo Sapiens
FPLHESILK

SEQ ID NO: 612063 - protein, 9 aa, Homo Sapiens
SASAIHTPG

SEQ ID NO: 612064 - protein, 9 aa, Homo Sapiens
DYGWMYGTV

SEQ ID NO: 612065 - protein, 9 aa, Homo Sapiens
RFPEDEFDG

SEQ ID NO: 612066 - protein, 9 aa, Homo Sapiens
SKKDATKYA

SEQ ID NO: 612067 - protein, 9 aa, Homo Sapiens
KSEHEKTLL

SEQ ID NO: 612068 - protein, 9 aa, Homo Sapiens
LLYHMQNTP

SEQ ID NO: 612069 - protein, 9 aa, Homo Sapiens
SRTHKSQEG

SEQ ID NO: 612070 - protein, 9 aa, Homo Sapiens
PLVPQVLGP

SEQ ID NO: 612071 - protein, 9 aa, Homo Sapiens
VAVPAQQKV

SEQ ID NO: 612072 - protein, 9 aa, Homo Sapiens
GEARSQQCA

SEQ ID NO: 612073 - protein, 9 aa, Homo Sapiens
SSHYCQPDT

SEQ ID NO: 612074 - protein, 9 aa, Homo Sapiens
SERDDWQRL

SEQ ID NO: 612075 - protein, 9 aa, Homo Sapiens
LEPVDTIFG

SEQ ID NO: 612076 - protein, 9 aa, Homo Sapiens
GVSLVSSGS

SEQ ID NO: 612077 - protein, 9 aa, Homo Sapiens
LHSRTHKSQ

SEQ ID NO: 612078 - protein, 9 aa, Homo Sapiens
VLNYGLFQT

SEQ ID NO: 612079 - protein, 9 aa, Homo Sapiens
GLRKSSGTA

SEQ ID NO: 612080 - protein, 9 aa, Homo Sapiens
AVWLISHDP

SEQ ID NO: 612081 - protein, 9 aa, Homo Sapiens
ALLVTMPAA

SEQ ID NO: 612082 - protein, 9 aa, Homo Sapiens
EGASPPPAV

SEQ ID NO: 612083 - protein, 9 aa, Homo Sapiens
SLATEDAFT

SEQ ID NO: 612084 - protein, 9 aa, Homo Sapiens
QLINQETSS

SEQ ID NO: 612085 - protein, 9 aa, Homo Sapiens
VPFCTLKSF

SEQ ID NO: 612086 - protein, 9 aa, Homo Sapiens
FSASWYAVP

SEQ ID NO: 612087 - protein, 9 aa, Homo Sapiens
KMLSSEVCT

SEQ ID NO: 612088 - protein, 9 aa, Homo Sapiens
AQRPNGSSG

SEQ ID NO: 612089 - protein, 9 aa, Homo Sapiens
TDICFTSTK

SEQ ID NO: 612090 - protein, 9 aa, Homo Sapiens
TVPDELLNK

SEQ ID NO: 612091 - protein, 9 aa, Homo Sapiens
EKDPRSGFD

SEQ ID NO: 612092 - protein, 9 aa, Homo Sapiens
LSSPQPAET

SEQ ID NO: 612093 - protein, 9 aa, Homo Sapiens
LLEKGAKPC

SEQ ID NO: 612094 - protein, 9 aa, Homo Sapiens
RTRLHLQTM

SEQ ID NO: 612095 - protein, 9 aa, Homo Sapiens
CFQVIATLI

SEQ ID NO: 612096 - protein, 9 aa, Homo Sapiens
PYALGIPMI

SEQ ID NO: 612097 - protein, 9 aa, Homo Sapiens
LHLIRERVK

SEQ ID NO: 612098 - protein, 9 aa, Homo Sapiens
LPPLPLSAK

SEQ ID NO: 612099 - protein, 9 aa, Homo Sapiens
QVFQGSMLH

SEQ ID NO: 612100 - protein, 9 aa, Homo Sapiens
TLHLIRERV

SEQ ID NO: 612101 - protein, 9 aa, Homo Sapiens
SSGSSSTFA

SEQ ID NO: 612102 - protein, 9 aa, Homo Sapiens
VRQQMRLQR

SEQ ID NO: 612103 - protein, 9 aa, Homo Sapiens
AYLKKKLNE

SEQ ID NO: 612104 - protein, 9 aa, Homo Sapiens
FAGLHQHER

SEQ ID NO: 612105 - protein, 9 aa, Homo Sapiens
YRGRQHLLR

SEQ ID NO: 612106 - protein, 9 aa, Homo Sapiens
GECDNIPCE

SEQ ID NO: 612107 - protein, 9 aa, Homo Sapiens
FGYNITRCH

SEQ ID NO: 612108 - protein, 9 aa, Homo Sapiens
IRESETTKC

SEQ ID NO: 612109 - protein, 9 aa, Homo Sapiens
AQTLVIMPL

SEQ ID NO: 612110 - protein, 9 aa, Homo Sapiens
CDYSIPSRT

SEQ ID NO: 612111 - protein, 9 aa, Homo Sapiens
ARGLGPSAV

SEQ ID NO: 612112 - protein, 9 aa, Homo Sapiens
MADNKALAW

SEQ ID NO: 612113 - protein, 9 aa, Homo Sapiens
EEDSCDYSI

SEQ ID NO: 612114 - protein, 9 aa, Homo Sapiens
TAAPASAPA

SEQ ID NO: 612115 - protein, 9 aa, Homo Sapiens
DLRELRNAM

SEQ ID NO: 612116 - protein, 9 aa, Homo Sapiens
KSFLSRAAS

SEQ ID NO: 612117 - protein, 9 aa, Homo Sapiens
NLVELDLSD

SEQ ID NO: 612118 - protein, 9 aa, Homo Sapiens
GFGGIGIIH

SEQ ID NO: 612119 - protein, 9 aa, Homo Sapiens
LIFLIALIG

SEQ ID NO: 612120 - protein, 9 aa, Homo Sapiens
WVPIVHSAQ

SEQ ID NO: 612121 - protein, 9 aa, Homo Sapiens
TPTTPTAAP

SEQ ID NO: 612122 - protein, 9 aa, Homo Sapiens
EQQRLAAEQ

SEQ ID NO: 612123 - protein, 9 aa, Homo Sapiens
KSCKPLNIA

SEQ ID NO: 612124 - protein, 9 aa, Homo Sapiens
AVATTPLGP

SEQ ID NO: 612125 - protein, 9 aa, Homo Sapiens
ERHLDQIMM

SEQ ID NO: 612126 - protein, 9 aa, Homo Sapiens
TCVAENIVG

SEQ ID NO: 612127 - protein, 9 aa, Homo Sapiens
EIASLTGTT

SEQ ID NO: 612128 - protein, 9 aa, Homo Sapiens
KQHQFRERF

SEQ ID NO: 612129 - protein, 9 aa, Homo Sapiens
RRGQAQASG

SEQ ID NO: 612130 - protein, 9 aa, Homo Sapiens
KCPDYQSYF

SEQ ID NO: 612131 - protein, 9 aa, Homo Sapiens
VQFAYTGCF

SEQ ID NO: 612132 - protein, 9 aa, Homo Sapiens
YRSFLGINK

SEQ ID NO: 612133 - protein, 9 aa, Homo Sapiens
KPEFTGLTF

SEQ ID NO: 612134 - protein, 9 aa, Homo Sapiens
SDDAYEELR

SEQ ID NO: 612135 - protein, 9 aa, Homo Sapiens
HLCFTRHEP

SEQ ID NO: 612136 - protein, 9 aa, Homo Sapiens
AMLTVSAMP

SEQ ID NO: 612137 - protein, 9 aa, Homo Sapiens
WVIFRNGSP

SEQ ID NO: 612138 - protein, 9 aa, Homo Sapiens
GHCNFRFFM

SEQ ID NO: 612139 - protein, 9 aa, Homo Sapiens
DEAQRVFES

SEQ ID NO: 612140 - protein, 9 aa, Homo Sapiens
RMAFFQDQN

SEQ ID NO: 612141 - protein, 9 aa, Homo Sapiens
RWHSGPLQT

SEQ ID NO: 612142 - protein, 9 aa, Homo Sapiens
KEAQTRAEF

SEQ ID NO: 612143 - protein, 9 aa, Homo Sapiens
RGRQHLLRP

SEQ ID NO: 612144 - protein, 9 aa, Homo Sapiens
GKQVEITLQ

SEQ ID NO: 612145 - protein, 9 aa, Homo Sapiens
AKKHIPKLQ

SEQ ID NO: 612146 - protein, 9 aa, Homo Sapiens
TASRKQVSI

SEQ ID NO: 612147 - protein, 9 aa, Homo Sapiens
RADVDHAIQ

SEQ ID NO: 612148 - protein, 9 aa, Homo Sapiens
QHISSHKES

SEQ ID NO: 612149 - protein, 9 aa, Homo Sapiens
IMGAKSIYK

SEQ ID NO: 612150 - protein, 9 aa, Homo Sapiens
LGPVTAAMA

SEQ ID NO: 612151 - protein, 9 aa, Homo Sapiens
LNLFVDVIM

SEQ ID NO: 612152 - protein, 9 aa, Homo Sapiens
GATTLVVTT

SEQ ID NO: 612153 - protein, 9 aa, Homo Sapiens
KVKASVHFV

SEQ ID NO: 612154 - protein, 9 aa, Homo Sapiens
RRGGKNRKT

SEQ ID NO: 612155 - protein, 9 aa, Homo Sapiens
CCWLALLVT

SEQ ID NO: 612156 - protein, 9 aa, Homo Sapiens
TLVIMPLVF

SEQ ID NO: 612157 - protein, 9 aa, Homo Sapiens
LHSSLDPLA

SEQ ID NO: 612158 - protein, 9 aa, Homo Sapiens
ILLGIIREI

SEQ ID NO: 612159 - protein, 9 aa, Homo Sapiens
SELSFPLHE

SEQ ID NO: 612160 - protein, 9 aa, Homo Sapiens
LGLSTFTIP

SEQ ID NO: 612161 - protein, 9 aa, Homo Sapiens
SWTTREPHA

SEQ ID NO: 612162 - protein, 9 aa, Homo Sapiens
SPSGARAHR

SEQ ID NO: 612163 - protein, 9 aa, Homo Sapiens
STLIGSFYG

SEQ ID NO: 612164 - protein, 9 aa, Homo Sapiens
VPACLVSTA

SEQ ID NO: 612165 - protein, 9 aa, Homo Sapiens
GSSEYSFVE

SEQ ID NO: 612166 - protein, 9 aa, Homo Sapiens
PRALGRVGG

SEQ ID NO: 612167 - protein, 9 aa, Homo Sapiens
ELGPRASHM

SEQ ID NO: 612168 - protein, 9 aa, Homo Sapiens
NIILVGKLA

SEQ ID NO: 612169 - protein, 9 aa, Homo Sapiens
VRITTLRKK

SEQ ID NO: 612170 - protein, 9 aa, Homo Sapiens
SVTKKRLSS

SEQ ID NO: 612171 - protein, 9 aa, Homo Sapiens
CARAGSRIA

SEQ ID NO: 612172 - protein, 9 aa, Homo Sapiens
KANTRSSHL

SEQ ID NO: 612173 - protein, 9 aa, Homo Sapiens
RLYMLSFLH

SEQ ID NO: 612174 - protein, 9 aa, Homo Sapiens
CMVTLSGNQ

SEQ ID NO: 612175 - protein, 9 aa, Homo Sapiens
GGAMGWAFV

SEQ ID NO: 612176 - protein, 9 aa, Homo Sapiens
YSHAGERPY

SEQ ID NO: 612177 - protein, 9 aa, Homo Sapiens
MRKSAKEKK

SEQ ID NO: 612178 - protein, 9 aa, Homo Sapiens
NQLICFQVI

SEQ ID NO: 612179 - protein, 9 aa, Homo Sapiens
KRGQRPSKP

SEQ ID NO: 612180 - protein, 9 aa, Homo Sapiens
SCSHTRISK

SEQ ID NO: 612181 - protein, 9 aa, Homo Sapiens
DGLRDLYPV

SEQ ID NO: 612182 - protein, 9 aa, Homo Sapiens
NPSLRGGRL

SEQ ID NO: 612183 - protein, 9 aa, Homo Sapiens
SVDPNMEID

SEQ ID NO: 612184 - protein, 9 aa, Homo Sapiens
DVDHAIQKA

SEQ ID NO: 612185 - protein, 9 aa, Homo Sapiens
NLSEAPCPQ

SEQ ID NO: 612186 - protein, 9 aa, Homo Sapiens
ILKSKLEQV

SEQ ID NO: 612187 - protein, 9 aa, Homo Sapiens
LYVEVKIVE

SEQ ID NO: 612188 - protein, 9 aa, Homo Sapiens
FFSKTNRFC

SEQ ID NO: 612189 - protein, 9 aa, Homo Sapiens
PLGQMCQNP

SEQ ID NO: 612190 - protein, 9 aa, Homo Sapiens
IVNVQPIDY

SEQ ID NO: 612191 - protein, 9 aa, Homo Sapiens
KALTSKKSK

SEQ ID NO: 612192 - protein, 9 aa, Homo Sapiens
ECVEDPDKA

SEQ ID NO: 612193 - protein, 9 aa, Homo Sapiens
SIAWVPIVH

SEQ ID NO: 612194 - protein, 9 aa, Homo Sapiens
GSIPTYMRH

SEQ ID NO: 612195 - protein, 9 aa, Homo Sapiens
DGEPWIQTP

SEQ ID NO: 612196 - protein, 9 aa, Homo Sapiens
GITSPICLA

SEQ ID NO: 612197 - protein, 9 aa, Homo Sapiens
VVAVAGNET

SEQ ID NO: 612198 - protein, 9 aa, Homo Sapiens
LMDLMYKIL

SEQ ID NO: 612199 - protein, 9 aa, Homo Sapiens
LQILLEKGA

SEQ ID NO: 612200 - protein, 9 aa, Homo Sapiens
VPRSHSCSE

SEQ ID NO: 612201 - protein, 9 aa, Homo Sapiens
PLPQPQPAP

SEQ ID NO: 612202 - protein, 9 aa, Homo Sapiens
SRGNSDGYL

SEQ ID NO: 612203 - protein, 9 aa, Homo Sapiens
EIVHEKEEL

SEQ ID NO: 612204 - protein, 9 aa, Homo Sapiens
SENLLMDLT

SEQ ID NO: 612205 - protein, 9 aa, Homo Sapiens
GRQHLLRPQ

SEQ ID NO: 612206 - protein, 9 aa, Homo Sapiens
RATARRKIR

SEQ ID NO: 612207 - protein, 9 aa, Homo Sapiens
RNEEYNKAV

SEQ ID NO: 612208 - protein, 9 aa, Homo Sapiens
GYGGCGYGS

SEQ ID NO: 612209 - protein, 9 aa, Homo Sapiens
ETITMRTCL

SEQ ID NO: 612210 - protein, 9 aa, Homo Sapiens
RRLSFQFPK

SEQ ID NO: 612211 - protein, 9 aa, Homo Sapiens
GARGEATKP

SEQ ID NO: 612212 - protein, 9 aa, Homo Sapiens
QHSHYAHYA

SEQ ID NO: 612213 - protein, 9 aa, Homo Sapiens
NGTYGDANI

SEQ ID NO: 612214 - protein, 9 aa, Homo Sapiens
KMPLTQYLK

SEQ ID NO: 612215 - protein, 9 aa, Homo Sapiens
TTRPAATRQ

SEQ ID NO: 612216 - protein, 9 aa, Homo Sapiens
KAKIVVPVT

SEQ ID NO: 612217 - protein, 9 aa, Homo Sapiens
RMIGQNSGL

SEQ ID NO: 612218 - protein, 9 aa, Homo Sapiens
AEIKEKIRT

SEQ ID NO: 612219 - protein, 9 aa, Homo Sapiens
IVRNNIGKD

SEQ ID NO: 612220 - protein, 9 aa, Homo Sapiens
GLLDHIQAL

SEQ ID NO: 612221 - protein, 9 aa, Homo Sapiens
FHQSSTPNP

SEQ ID NO: 612222 - protein, 9 aa, Homo Sapiens
NFISTASPL

SEQ ID NO: 612223 - protein, 9 aa, Homo Sapiens
RAGGYKTCP

SEQ ID NO: 612224 - protein, 9 aa, Homo Sapiens
TVDDPVRKP

SEQ ID NO: 612225 - protein, 9 aa, Homo Sapiens
AAGPPPLSF

SEQ ID NO: 612226 - protein, 9 aa, Homo Sapiens
LDKHHMKHK

SEQ ID NO: 612227 - protein, 9 aa, Homo Sapiens
TYRIHRIFE

SEQ ID NO: 612228 - protein, 9 aa, Homo Sapiens
EAEGRDGEA

SEQ ID NO: 612229 - protein, 9 aa, Homo Sapiens
EVGAALFLG

SEQ ID NO: 612230 - protein, 9 aa, Homo Sapiens
QILCKIPDE

SEQ ID NO: 612231 - protein, 9 aa, Homo Sapiens
QKKEESTEK

SEQ ID NO: 612232 - protein, 9 aa, Homo Sapiens
SLEKYNQHI

SEQ ID NO: 612233 - protein, 9 aa, Homo Sapiens
LFSSDSNGI

SEQ ID NO: 612234 - protein, 9 aa, Homo Sapiens
ATEERLFRK

SEQ ID NO: 612235 - protein, 9 aa, Homo Sapiens
LVLPPVSPR

SEQ ID NO: 612236 - protein, 9 aa, Homo Sapiens
RKSDLDQIF

SEQ ID NO: 612237 - protein, 9 aa, Homo Sapiens
GPDGDIYWG

SEQ ID NO: 612238 - protein, 9 aa, Homo Sapiens
ASDDLRELR

SEQ ID NO: 612239 - protein, 9 aa, Homo Sapiens
YSWTTREPH

SEQ ID NO: 612240 - protein, 9 aa, Homo Sapiens
VLSQEISHY

SEQ ID NO: 612241 - protein, 9 aa, Homo Sapiens
SSDSNGICH

SEQ ID NO: 612242 - protein, 9 aa, Homo Sapiens
KASCQASAG

SEQ ID NO: 612243 - protein, 9 aa, Homo Sapiens
KPLNLAHTV

SEQ ID NO: 612244 - protein, 9 aa, Homo Sapiens
LGVFALPLL

SEQ ID NO: 612245 - protein, 9 aa, Homo Sapiens
NNQLICFQV

SEQ ID NO: 612246 - protein, 9 aa, Homo Sapiens
VATPGRLLY

SEQ ID NO: 612247 - protein, 9 aa, Homo Sapiens
VDVIMDNFE

SEQ ID NO: 612248 - protein, 9 aa, Homo Sapiens
CSSLHPHLF

SEQ ID NO: 612249 - protein, 9 aa, Homo Sapiens
GHLYPPCST

SEQ ID NO: 612250 - protein, 9 aa, Homo Sapiens
SKDNEVDGL

SEQ ID NO: 612251 - protein, 9 aa, Homo Sapiens
SAVQKHQQT

SEQ ID NO: 612252 - protein, 9 aa, Homo Sapiens
EGTITYLQP

SEQ ID NO: 612253 - protein, 9 aa, Homo Sapiens
PLLPPRCIS

SEQ ID NO: 612254 - protein, 9 aa, Homo Sapiens
KLVYGNECA

SEQ ID NO: 612255 - protein, 9 aa, Homo Sapiens
LPLLGVPVR

SEQ ID NO: 612256 - protein, 9 aa, Homo Sapiens
SHYIFQKYC

SEQ ID NO: 612257 - protein, 9 aa, Homo Sapiens
GLIAADNDP

SEQ ID NO: 612258 - protein, 9 aa, Homo Sapiens
KLEQLFLEH

SEQ ID NO: 612259 - protein, 9 aa, Homo Sapiens
NRMKIQDDL

SEQ ID NO: 612260 - protein, 9 aa, Homo Sapiens
YLQYLCYRN

SEQ ID NO: 612261 - protein, 9 aa, Homo Sapiens
AIKVFEKMN

SEQ ID NO: 612262 - protein, 9 aa, Homo Sapiens
LSRLEARLQ

SEQ ID NO: 612263 - protein, 9 aa, Homo Sapiens
EAQTRAEFA

SEQ ID NO: 612264 - protein, 9 aa, Homo Sapiens
PSSDGYDDL

SEQ ID NO: 612265 - protein, 9 aa, Homo Sapiens
QGPLSVPQV

SEQ ID NO: 612266 - protein, 9 aa, Homo Sapiens
TSLYHKEES

SEQ ID NO: 612267 - protein, 9 aa, Homo Sapiens
SDKMTAKLC

SEQ ID NO: 612268 - protein, 9 aa, Homo Sapiens
EILRLFPHA

SEQ ID NO: 612269 - protein, 9 aa, Homo Sapiens
NNRMKIQDD

SEQ ID NO: 612270 - protein, 9 aa, Homo Sapiens
LLNTFIYTL

SEQ ID NO: 612271 - protein, 9 aa, Homo Sapiens
LPGLLGQAL

SEQ ID NO: 612272 - protein, 9 aa, Homo Sapiens
PRIVVGSTL

SEQ ID NO: 612273 - protein, 9 aa, Homo Sapiens
PEPDGWSGG

SEQ ID NO: 612274 - protein, 9 aa, Homo Sapiens
QETLTLKIH

SEQ ID NO: 612275 - protein, 9 aa, Homo Sapiens
HLIYSLRNR

SEQ ID NO: 612276 - protein, 9 aa, Homo Sapiens
GEGGKGLGK

SEQ ID NO: 612277 - protein, 9 aa, Homo Sapiens
VSLWNIVRN

SEQ ID NO: 612278 - protein, 9 aa, Homo Sapiens
LFGVWAQWR

SEQ ID NO: 612279 - protein, 9 aa, Homo Sapiens
SCSRGEAQA

SEQ ID NO: 612280 - protein, 9 aa, Homo Sapiens
ASVKALVCV

SEQ ID NO: 612281 - protein, 9 aa, Homo Sapiens
PFRRLSFQF

SEQ ID NO: 612282 - protein, 9 aa, Homo Sapiens
EGHFWQLDH

SEQ ID NO: 612283 - protein, 9 aa, Homo Sapiens
HNTSRYETS

SEQ ID NO: 612284 - protein, 9 aa, Homo Sapiens
RRRRKRRKR

SEQ ID NO: 612285 - protein, 9 aa, Homo Sapiens
AVRLGPRTS

SEQ ID NO: 612286 - protein, 9 aa, Homo Sapiens
GGIGLGVFA

SEQ ID NO: 612287 - protein, 9 aa, Homo Sapiens
FLLCARQGA

SEQ ID NO: 612288 - protein, 9 aa, Homo Sapiens
CFVQQLWDT

SEQ ID NO: 612289 - protein, 9 aa, Homo Sapiens
GQVGGSPGG

SEQ ID NO: 612290 - protein, 9 aa, Homo Sapiens
IDCSTLALV

SEQ ID NO: 612291 - protein, 9 aa, Homo Sapiens
VGSTLHSKE

SEQ ID NO: 612292 - protein, 9 aa, Homo Sapiens
RLLTEYCID

SEQ ID NO: 612293 - protein, 9 aa, Homo Sapiens
VCFQRPQNE

SEQ ID NO: 612294 - protein, 9 aa, Homo Sapiens
FHSICEVQS

SEQ ID NO: 612295 - protein, 9 aa, Homo Sapiens
VPPRALGRV

SEQ ID NO: 612296 - protein, 9 aa, Homo Sapiens
KSYISHSGL

SEQ ID NO: 612297 - protein, 9 aa, Homo Sapiens
QGGLSGSLL

SEQ ID NO: 612298 - protein, 9 aa, Homo Sapiens
DTFVFQVVP

SEQ ID NO: 612299 - protein, 9 aa, Homo Sapiens
TLTGTPHYI

SEQ ID NO: 612300 - protein, 9 aa, Homo Sapiens
YCQPDTQDQ

SEQ ID NO: 612301 - protein, 9 aa, Homo Sapiens
RGSAAVQEE

SEQ ID NO: 612302 - protein, 9 aa, Homo Sapiens
AAFHQSSTP

SEQ ID NO: 612303 - protein, 9 aa, Homo Sapiens
RLPGLLGQA

SEQ ID NO: 612304 - protein, 9 aa, Homo Sapiens
FGPGCPHPP

SEQ ID NO: 612305 - protein, 9 aa, Homo Sapiens
LSSGVDIIS

SEQ ID NO: 612306 - protein, 9 aa, Homo Sapiens
QDTTTANTT

SEQ ID NO: 612307 - protein, 9 aa, Homo Sapiens
WSGGLRGLP

SEQ ID NO: 612308 - protein, 9 aa, Homo Sapiens
AIKTILKSK

SEQ ID NO: 612309 - protein, 9 aa, Homo Sapiens
STPMPRNME

SEQ ID NO: 612310 - protein, 9 aa, Homo Sapiens
MYRRSYVFK

SEQ ID NO: 612311 - protein, 9 aa, Homo Sapiens
GQDTNDICL

SEQ ID NO: 612312 - protein, 9 aa, Homo Sapiens
CRPNCKFVL

SEQ ID NO: 612313 - protein, 9 aa, Homo Sapiens
ADGSRLLQR

SEQ ID NO: 612314 - protein, 9 aa, Homo Sapiens
IQTVDGTIT

SEQ ID NO: 612315 - protein, 9 aa, Homo Sapiens
FHFDMGQRV

SEQ ID NO: 612316 - protein, 9 aa, Homo Sapiens
LALSCSHTR

SEQ ID NO: 612317 - protein, 9 aa, Homo Sapiens
YAMLVFTLV

SEQ ID NO: 612318 - protein, 9 aa, Homo Sapiens
PNCKFVLTG

SEQ ID NO: 612319 - protein, 9 aa, Homo Sapiens
SHLTKQSSC

SEQ ID NO: 612320 - protein, 9 aa, Homo Sapiens
TCLTIIPSA

SEQ ID NO: 612321 - protein, 9 aa, Homo Sapiens
HLHRLALSS

SEQ ID NO: 612322 - protein, 9 aa, Homo Sapiens
GEEHFEDYC

SEQ ID NO: 612323 - protein, 9 aa, Homo Sapiens
DDLQCFHIL

SEQ ID NO: 612324 - protein, 9 aa, Homo Sapiens
TTYVLPFSM

SEQ ID NO: 612325 - protein, 9 aa, Homo Sapiens
GIAGIRATA

SEQ ID NO: 612326 - protein, 9 aa, Homo Sapiens
PPEPDGWSG

SEQ ID NO: 612327 - protein, 9 aa, Homo Sapiens
WLGVAQLRL

SEQ ID NO: 612328 - protein, 9 aa, Homo Sapiens
APGGRLLSA

SEQ ID NO: 612329 - protein, 9 aa, Homo Sapiens
QNRGYAFVT

SEQ ID NO: 612330 - protein, 9 aa, Homo Sapiens
GAYRHAQIM

SEQ ID NO: 612331 - protein, 9 aa, Homo Sapiens
DRHKVMLKE

SEQ ID NO: 612332 - protein, 9 aa, Homo Sapiens
GYNELTGHF

SEQ ID NO: 612333 - protein, 9 aa, Homo Sapiens
DDMSENLLM

SEQ ID NO: 612334 - protein, 9 aa, Homo Sapiens
FTIPKMLGI

SEQ ID NO: 612335 - protein, 9 aa, Homo Sapiens
VEAKVLNQT

SEQ ID NO: 612336 - protein, 9 aa, Homo Sapiens
TILNDIKLP

SEQ ID NO: 612337 - protein, 9 aa, Homo Sapiens
GGIGIIHLG

SEQ ID NO: 612338 - protein, 9 aa, Homo Sapiens
EAAVHGLTQ

SEQ ID NO: 612339 - protein, 9 aa, Homo Sapiens
YFSQSPHVV

SEQ ID NO: 612340 - protein, 9 aa, Homo Sapiens
ATLNKPEKL

SEQ ID NO: 612341 - protein, 9 aa, Homo Sapiens
GGPGPSPGR

SEQ ID NO: 612342 - protein, 9 aa, Homo Sapiens
VLDLCRNVK

SEQ ID NO: 612343 - protein, 9 aa, Homo Sapiens
PVTMLTARY

SEQ ID NO: 612344 - protein, 9 aa, Homo Sapiens
CQQEGGQPV

SEQ ID NO: 612345 - protein, 9 aa, Homo Sapiens
RYKTNEPVC

SEQ ID NO: 612346 - protein, 9 aa, Homo Sapiens
SLVFSVAEL

SEQ ID NO: 612347 - protein, 9 aa, Homo Sapiens
SEALQILLE

SEQ ID NO: 612348 - protein, 9 aa, Homo Sapiens
SALSLKSNE

SEQ ID NO: 612349 - protein, 9 aa, Homo Sapiens
YREIPDSCY

SEQ ID NO: 612350 - protein, 9 aa, Homo Sapiens
IASAYREIP

SEQ ID NO: 612351 - protein, 9 aa, Homo Sapiens
CKFVLTGRD

SEQ ID NO: 612352 - protein, 9 aa, Homo Sapiens
DSITGPLPL

SEQ ID NO: 612353 - protein, 9 aa, Homo Sapiens
HYCQPDTQD

SEQ ID NO: 612354 - protein, 9 aa, Homo Sapiens
LLPGLLDSH

SEQ ID NO: 612355 - protein, 9 aa, Homo Sapiens
LYIRDPLNG

SEQ ID NO: 612356 - protein, 9 aa, Homo Sapiens
HMEGTHINQ

SEQ ID NO: 612357 - protein, 9 aa, Homo Sapiens
GHFRNRVIN

SEQ ID NO: 612358 - protein, 9 aa, Homo Sapiens
QACAASTRV

SEQ ID NO: 612359 - protein, 9 aa, Homo Sapiens
RIQSALPAF

SEQ ID NO: 612360 - protein, 9 aa, Homo Sapiens
TDVEAKVLN

SEQ ID NO: 612361 - protein, 9 aa, Homo Sapiens
YFQERRMLG

SEQ ID NO: 612362 - protein, 9 aa, Homo Sapiens
ELSFPLHES

SEQ ID NO: 612363 - protein, 9 aa, Homo Sapiens
SHSCSEGQI

SEQ ID NO: 612364 - protein, 9 aa, Homo Sapiens
ASALSLKSN

SEQ ID NO: 612365 - protein, 9 aa, Homo Sapiens
GVKLPLGKE

SEQ ID NO: 612366 - protein, 9 aa, Homo Sapiens
KLTSHQSQL

SEQ ID NO: 612367 - protein, 9 aa, Homo Sapiens
EVIKRIQSL

SEQ ID NO: 612368 - protein, 9 aa, Homo Sapiens
TTAPDFQET

SEQ ID NO: 612369 - protein, 9 aa, Homo Sapiens
HPLSEQVPQ

SEQ ID NO: 612370 - protein, 9 aa, Homo Sapiens
VYPWWGGAM

SEQ ID NO: 612371 - protein, 9 aa, Homo Sapiens
LSGSLLGAR

SEQ ID NO: 612372 - protein, 9 aa, Homo Sapiens
SVKALVCVV

SEQ ID NO: 612373 - protein, 9 aa, Homo Sapiens
STPSPSPLS

SEQ ID NO: 612374 - protein, 9 aa, Homo Sapiens
SREGLVENG

SEQ ID NO: 612375 - protein, 9 aa, Homo Sapiens
GDAVLNKAA

SEQ ID NO: 612376 - protein, 9 aa, Homo Sapiens
HRCRPNVTT

SEQ ID NO: 612377 - protein, 9 aa, Homo Sapiens
RPEAAVAAV

SEQ ID NO: 612378 - protein, 9 aa, Homo Sapiens
PACLVSTAL

SEQ ID NO: 612379 - protein, 9 aa, Homo Sapiens
TSTKVPKML

SEQ ID NO: 612380 - protein, 9 aa, Homo Sapiens
SPWPGLRLP

SEQ ID NO: 612381 - protein, 9 aa, Homo Sapiens
SLGCYLPQT

SEQ ID NO: 612382 - protein, 9 aa, Homo Sapiens
SPGDGAGAS

SEQ ID NO: 612383 - protein, 9 aa, Homo Sapiens
ARCRRPLGP

SEQ ID NO: 612384 - protein, 9 aa, Homo Sapiens
QGVDIPLHL

SEQ ID NO: 612385 - protein, 9 aa, Homo Sapiens
KDVEKSRTV

SEQ ID NO: 612386 - protein, 9 aa, Homo Sapiens
TDTTATTEA

SEQ ID NO: 612387 - protein, 9 aa, Homo Sapiens
PSPIPSVTK

SEQ ID NO: 612388 - protein, 9 aa, Homo Sapiens
EAALSQTGF

SEQ ID NO: 612389 - protein, 9 aa, Homo Sapiens
PWIPSGSFM

SEQ ID NO: 612390 - protein, 9 aa, Homo Sapiens
GRLLYHMQN

SEQ ID NO: 612391 - protein, 9 aa, Homo Sapiens
AETKAEAAA

SEQ ID NO: 612392 - protein, 9 aa, Homo Sapiens
QISGPYLPY

SEQ ID NO: 612393 - protein, 9 aa, Homo Sapiens
QQKVRTARR

SEQ ID NO: 612394 - protein, 9 aa, Homo Sapiens
VNVVPQENT

SEQ ID NO: 612395 - protein, 9 aa, Homo Sapiens
FVDVIMDNF

SEQ ID NO: 612396 - protein, 9 aa, Homo Sapiens
LKSKLEQVQ

SEQ ID NO: 612397 - protein, 9 aa, Homo Sapiens
QGQWRASAL

SEQ ID NO: 612398 - protein, 9 aa, Homo Sapiens
GRDSLSTLI

SEQ ID NO: 612399 - protein, 9 aa, Homo Sapiens
RSQRRTKIK

SEQ ID NO: 612400 - protein, 9 aa, Homo Sapiens
FNDAVSRLR

SEQ ID NO: 612401 - protein, 9 aa, Homo Sapiens
VLGTVPGAS

SEQ ID NO: 612402 - protein, 9 aa, Homo Sapiens
LSREGLVEN

SEQ ID NO: 612403 - protein, 9 aa, Homo Sapiens
LRRGATTLV

SEQ ID NO: 612404 - protein, 9 aa, Homo Sapiens
TRLNQEEVE

SEQ ID NO: 612405 - protein, 9 aa, Homo Sapiens
AIGAPHLHH

SEQ ID NO: 612406 - protein, 9 aa, Homo Sapiens
AFSAYFNIP

SEQ ID NO: 612407 - protein, 9 aa, Homo Sapiens
AIQKAFQLW

SEQ ID NO: 612408 - protein, 9 aa, Homo Sapiens
LLPRSQRLL

SEQ ID NO: 612409 - protein, 9 aa, Homo Sapiens
DFECIENKK

SEQ ID NO: 612410 - protein, 9 aa, Homo Sapiens
IEQLPEQTV

SEQ ID NO: 612411 - protein, 9 aa, Homo Sapiens
TIIVYYYRM

SEQ ID NO: 612412 - protein, 9 aa, Homo Sapiens
LRGFRRGVA

SEQ ID NO: 612413 - protein, 9 aa, Homo Sapiens
CTDSKDNEV

SEQ ID NO: 612414 - protein, 9 aa, Homo Sapiens
PASCTMPAG

SEQ ID NO: 612415 - protein, 9 aa, Homo Sapiens
AEEKPYGCY

SEQ ID NO: 612416 - protein, 9 aa, Homo Sapiens
EEFRPDSDT

SEQ ID NO: 612417 - protein, 9 aa, Homo Sapiens
LQVRRQFKA

SEQ ID NO: 612418 - protein, 9 aa, Homo Sapiens
DGRDSLSTL

SEQ ID NO: 612419 - protein, 9 aa, Homo Sapiens
KWDEPWCNQ

SEQ ID NO: 612420 - protein, 9 aa, Homo Sapiens
YEASEPCSR

SEQ ID NO: 612421 - protein, 9 aa, Homo Sapiens
NMKNCAGKT

SEQ ID NO: 612422 - protein, 9 aa, Homo Sapiens
CISHKIMEK

SEQ ID NO: 612423 - protein, 9 aa, Homo Sapiens
RKMLSSEVC

SEQ ID NO: 612424 - protein, 9 aa, Homo Sapiens
VLFCVVTQA

SEQ ID NO: 612425 - protein, 9 aa, Homo Sapiens
GLKQKLLRH

SEQ ID NO: 612426 - protein, 9 aa, Homo Sapiens
HGDHSRGKR

SEQ ID NO: 612427 - protein, 9 aa, Homo Sapiens
KDPRSGFDI

SEQ ID NO: 612428 - protein, 9 aa, Homo Sapiens
RAKSVHPQS

SEQ ID NO: 612429 - protein, 9 aa, Homo Sapiens
SANTIIFMI

SEQ ID NO: 612430 - protein, 9 aa, Homo Sapiens
EAGSGRCSF

SEQ ID NO: 612431 - protein, 9 aa, Homo Sapiens
KKAKNTNTR

SEQ ID NO: 612432 - protein, 9 aa, Homo Sapiens
SLKSNEKPL

SEQ ID NO: 612433 - protein, 9 aa, Homo Sapiens
CSVNKWVIF

SEQ ID NO: 612434 - protein, 9 aa, Homo Sapiens
VRGYLVRQQ

SEQ ID NO: 612435 - protein, 9 aa, Homo Sapiens
QLTINTAVV

SEQ ID NO: 612436 - protein, 9 aa, Homo Sapiens
FTSTKVPKM

SEQ ID NO: 612437 - protein, 9 aa, Homo Sapiens
YYQDPDATS

SEQ ID NO: 612438 - protein, 9 aa, Homo Sapiens
REIPDSCYS

SEQ ID NO: 612439 - protein, 9 aa, Homo Sapiens
PYFQRLGRY

SEQ ID NO: 612440 - protein, 9 aa, Homo Sapiens
GPARASWRS

SEQ ID NO: 612441 - protein, 9 aa, Homo Sapiens
HAIQKAFQL

SEQ ID NO: 612442 - protein, 9 aa, Homo Sapiens
FPGPTGPAP

SEQ ID NO: 612443 - protein, 9 aa, Homo Sapiens
HQTLQSLVD

SEQ ID NO: 612444 - protein, 9 aa, Homo Sapiens
DGTEDTDEK

SEQ ID NO: 612445 - protein, 9 aa, Homo Sapiens
KEKIRTRSA

SEQ ID NO: 612446 - protein, 9 aa, Homo Sapiens
SADASVRTI

SEQ ID NO: 612447 - protein, 9 aa, Homo Sapiens
INHTDEKGF

SEQ ID NO: 612448 - protein, 9 aa, Homo Sapiens
VVGSTLHSK

SEQ ID NO: 612449 - protein, 9 aa, Homo Sapiens
WEKLWRVTA

SEQ ID NO: 612450 - protein, 9 aa, Homo Sapiens
GVLLQHIEV

SEQ ID NO: 612451 - protein, 9 aa, Homo Sapiens
SGTTYLFSV

SEQ ID NO: 612452 - protein, 9 aa, Homo Sapiens
YLFKGAHYW

SEQ ID NO: 612453 - protein, 9 aa, Homo Sapiens
LPQPQPAPQ

SEQ ID NO: 612454 - protein, 9 aa, Homo Sapiens
IVYYYRMHT

SEQ ID NO: 612455 - protein, 9 aa, Homo Sapiens
VPLPSLMDL

SEQ ID NO: 612456 - protein, 9 aa, Homo Sapiens
STQSRITEQ

SEQ ID NO: 612457 - protein, 9 aa, Homo Sapiens
GGSGGGSNH

SEQ ID NO: 612458 - protein, 9 aa, Homo Sapiens
RSSTMGSWR

SEQ ID NO: 612459 - protein, 9 aa, Homo Sapiens
VTAVPVAFQ

SEQ ID NO: 612460 - protein, 9 aa, Homo Sapiens
SWRKSLPRG

SEQ ID NO: 612461 - protein, 9 aa, Homo Sapiens
MLETKCSLL

SEQ ID NO: 612462 - protein, 9 aa, Homo Sapiens
IFVEEFRPD

SEQ ID NO: 612463 - protein, 9 aa, Homo Sapiens
EYELMRERH

SEQ ID NO: 612464 - protein, 9 aa, Homo Sapiens
QSGGNQSWL

SEQ ID NO: 612465 - protein, 9 aa, Homo Sapiens
CFNDAVSRL

SEQ ID NO: 612466 - protein, 9 aa, Homo Sapiens
GEPWIQTPC

SEQ ID NO: 612467 - protein, 9 aa, Homo Sapiens
YGCYECGKD

SEQ ID NO: 612468 - protein, 9 aa, Homo Sapiens
DNIPCEKGD

SEQ ID NO: 612469 - protein, 9 aa, Homo Sapiens
YWEKLWRVT

SEQ ID NO: 612470 - protein, 9 aa, Homo Sapiens
KVLTLNQEV

SEQ ID NO: 612471 - protein, 9 aa, Homo Sapiens
MLLQLDLEA

SEQ ID NO: 612472 - protein, 9 aa, Homo Sapiens
SIVRGKDTP

SEQ ID NO: 612473 - protein, 9 aa, Homo Sapiens
LLSPMYIFL

SEQ ID NO: 612474 - protein, 9 aa, Homo Sapiens
RQHLLRPQE

SEQ ID NO: 612475 - protein, 9 aa, Homo Sapiens
NEVDGLIDC

SEQ ID NO: 612476 - protein, 9 aa, Homo Sapiens
RLIKMSHLK

SEQ ID NO: 612477 - protein, 9 aa, Homo Sapiens
LIFDSLSRG

SEQ ID NO: 612478 - protein, 9 aa, Homo Sapiens
RRVPWRRGS

SEQ ID NO: 612479 - protein, 9 aa, Homo Sapiens
SVLSRVIKR

SEQ ID NO: 612480 - protein, 9 aa, Homo Sapiens
PDTEHVQQT

SEQ ID NO: 612481 - protein, 9 aa, Homo Sapiens
SEMVLLSVG

SEQ ID NO: 612482 - protein, 9 aa, Homo Sapiens
SVWEALGVE

SEQ ID NO: 612483 - protein, 9 aa, Homo Sapiens
FHQVMYAML

SEQ ID NO: 612484 - protein, 9 aa, Homo Sapiens
IENKKSFDI

SEQ ID NO: 612485 - protein, 9 aa, Homo Sapiens
TKCSLLQQQ

SEQ ID NO: 612486 - protein, 9 aa, Homo Sapiens
KLSRTFYGG

SEQ ID NO: 612487 - protein, 9 aa, Homo Sapiens
EVISDEHDI

SEQ ID NO: 612488 - protein, 9 aa, Homo Sapiens
TATSGRDAN

SEQ ID NO: 612489 - protein, 9 aa, Homo Sapiens
NKIYFKNMR

SEQ ID NO: 612490 - protein, 9 aa, Homo Sapiens
GIGLGVFAL

SEQ ID NO: 612491 - protein, 9 aa, Homo Sapiens
AKNTNTRKR

SEQ ID NO: 612492 - protein, 9 aa, Homo Sapiens
PVDTIFGAS

SEQ ID NO: 612493 - protein, 9 aa, Homo Sapiens
PLSSESSSK

SEQ ID NO: 612494 - protein, 9 aa, Homo Sapiens
SYVFKTRKE

SEQ ID NO: 612495 - protein, 9 aa, Homo Sapiens
TVWPYICEA

SEQ ID NO: 612496 - protein, 9 aa, Homo Sapiens
YYALGCSIA

SEQ ID NO: 612497 - protein, 9 aa, Homo Sapiens
KQVEITLQR

SEQ ID NO: 612498 - protein, 9 aa, Homo Sapiens
PLGSRIEEV

SEQ ID NO: 612499 - protein, 9 aa, Homo Sapiens
LLLALICSF

SEQ ID NO: 612500 - protein, 9 aa, Homo Sapiens
HIPKLQEQL

SEQ ID NO: 612501 - protein, 9 aa, Homo Sapiens
IKDLSTIET

SEQ ID NO: 612502 - protein, 9 aa, Homo Sapiens
LFMLFLRLY

SEQ ID NO: 612503 - protein, 9 aa, Homo Sapiens
GFASVRNFG

SEQ ID NO: 612504 - protein, 9 aa, Homo Sapiens
LSCSHTRIS

SEQ ID NO: 612505 - protein, 9 aa, Homo Sapiens
VTSQSGGNQ

SEQ ID NO: 612506 - protein, 9 aa, Homo Sapiens
GAHRQAAER

SEQ ID NO: 612507 - protein, 9 aa, Homo Sapiens
LHLQTMTLE

SEQ ID NO: 612508 - protein, 9 aa, Homo Sapiens
ELAALLECL

SEQ ID NO: 612509 - protein, 9 aa, Homo Sapiens
GVLSQEISH

SEQ ID NO: 612510 - protein, 9 aa, Homo Sapiens
CYECGKDFS

SEQ ID NO: 612511 - protein, 9 aa, Homo Sapiens
EEMASDDLR

SEQ ID NO: 612512 - protein, 9 aa, Homo Sapiens
ARRGQAQAS

SEQ ID NO: 612513 - protein, 9 aa, Homo Sapiens
DTGAPDGSF

SEQ ID NO: 612514 - protein, 9 aa, Homo Sapiens
ACAASTRVS

SEQ ID NO: 612515 - protein, 9 aa, Homo Sapiens
NQSWLPIWG

SEQ ID NO: 612516 - protein, 9 aa, Homo Sapiens
LNSSGSSEY

SEQ ID NO: 612517 - protein, 9 aa, Homo Sapiens
EAAETKAEA

SEQ ID NO: 612518 - protein, 9 aa, Homo Sapiens
LELGSDEQK

SEQ ID NO: 612519 - protein, 9 aa, Homo Sapiens
VDYEASEPC

SEQ ID NO: 612520 - protein, 9 aa, Homo Sapiens
SVRTIKLSP

SEQ ID NO: 612521 - protein, 9 aa, Homo Sapiens
PPIQVKRSR

SEQ ID NO: 612522 - protein, 9 aa, Homo Sapiens
YCEGSEAEL

SEQ ID NO: 612523 - protein, 9 aa, Homo Sapiens
SPRDCFPYS

SEQ ID NO: 612524 - protein, 9 aa, Homo Sapiens
KDATKYAKK

SEQ ID NO: 612525 - protein, 9 aa, Homo Sapiens
AQGTARVGV

SEQ ID NO: 612526 - protein, 9 aa, Homo Sapiens
WAAAGPPPL

SEQ ID NO: 612527 - protein, 9 aa, Homo Sapiens
AAGGAQSFA

SEQ ID NO: 612528 - protein, 9 aa, Homo Sapiens
PKTLTSFIT

SEQ ID NO: 612529 - protein, 9 aa, Homo Sapiens
SAAAGRRMQ

SEQ ID NO: 612530 - protein, 9 aa, Homo Sapiens
LPTSSGRAQ

SEQ ID NO: 612531 - protein, 9 aa, Homo Sapiens
HWKSQTCQS

SEQ ID NO: 612532 - protein, 9 aa, Homo Sapiens
GFSRSLAKE

SEQ ID NO: 612533 - protein, 9 aa, Homo Sapiens
KVKIEVLHR

SEQ ID NO: 612534 - protein, 9 aa, Homo Sapiens
ALKQILCKI

SEQ ID NO: 612535 - protein, 9 aa, Homo Sapiens
EESPTFACN

SEQ ID NO: 612536 - protein, 9 aa, Homo Sapiens
TGDAVLNKA

SEQ ID NO: 612537 - protein, 9 aa, Homo Sapiens
YPPCSTVVR

SEQ ID NO: 612538 - protein, 9 aa, Homo Sapiens
HSKVLELEA

SEQ ID NO: 612539 - protein, 9 aa, Homo Sapiens
AGLLEIVCF

SEQ ID NO: 612540 - protein, 9 aa, Homo Sapiens
AAPQAAPHP

SEQ ID NO: 612541 - protein, 9 aa, Homo Sapiens
RPWGFSGGW

SEQ ID NO: 612542 - protein, 9 aa, Homo Sapiens
DTIFGASVE

SEQ ID NO: 612543 - protein, 9 aa, Homo Sapiens
NGTFTVWPY

SEQ ID NO: 612544 - protein, 9 aa, Homo Sapiens
VVQAHRGPQ

SEQ ID NO: 612545 - protein, 9 aa, Homo Sapiens
SYTHCNERM

SEQ ID NO: 612546 - protein, 9 aa, Homo Sapiens
TVLGILLGI

SEQ ID NO: 612547 - protein, 9 aa, Homo Sapiens
SFLRAGVFP

SEQ ID NO: 612548 - protein, 9 aa, Homo Sapiens
SEEGVKLPL

SEQ ID NO: 612549 - protein, 9 aa, Homo Sapiens
WQIDCSTLA

SEQ ID NO: 612550 - protein, 9 aa, Homo Sapiens
VPPQAFPPA

SEQ ID NO: 612551 - protein, 9 aa, Homo Sapiens
QACGKSFKY

SEQ ID NO: 612552 - protein, 9 aa, Homo Sapiens
LSSESSSKS

SEQ ID NO: 612553 - protein, 9 aa, Homo Sapiens
ASGGRERHR

SEQ ID NO: 612554 - protein, 9 aa, Homo Sapiens
KIKQEVNLQ

SEQ ID NO: 612555 - protein, 9 aa, Homo Sapiens
LGVSVTVEG

SEQ ID NO: 612556 - protein, 9 aa, Homo Sapiens
WHPHPHPHP

SEQ ID NO: 612557 - protein, 9 aa, Homo Sapiens
YLTQVMTSQ

SEQ ID NO: 612558 - protein, 9 aa, Homo Sapiens
TNAWSWRRS

SEQ ID NO: 612559 - protein, 9 aa, Homo Sapiens
NELSKRIEI

SEQ ID NO: 612560 - protein, 9 aa, Homo Sapiens
SLIHIFRAH

SEQ ID NO: 612561 - protein, 9 aa, Homo Sapiens
GPRTSTAWS

SEQ ID NO: 612562 - protein, 9 aa, Homo Sapiens
SLSFSIPRP

SEQ ID NO: 612563 - protein, 9 aa, Homo Sapiens
ITNATEYAR

SEQ ID NO: 612564 - protein, 9 aa, Homo Sapiens
PTSSGRAQP

SEQ ID NO: 612565 - protein, 9 aa, Homo Sapiens
LCSSLHPHL

SEQ ID NO: 612566 - protein, 9 aa, Homo Sapiens
PKTYELMPS

SEQ ID NO: 612567 - protein, 9 aa, Homo Sapiens
EELSVLSRV

SEQ ID NO: 612568 - protein, 9 aa, Homo Sapiens
SSGVSLVSS

SEQ ID NO: 612569 - protein, 9 aa, Homo Sapiens
FGVWAQWRG

SEQ ID NO: 612570 - protein, 9 aa, Homo Sapiens
EAFFSKTNR

SEQ ID NO: 612571 - protein, 9 aa, Homo Sapiens
AESQSVVFG

SEQ ID NO: 612572 - protein, 9 aa, Homo Sapiens
PLRNGYFGV

SEQ ID NO: 612573 - protein, 9 aa, Homo Sapiens
KYAKKVAKK

SEQ ID NO: 612574 - protein, 9 aa, Homo Sapiens
GAWSPTRGP

SEQ ID NO: 612575 - protein, 9 aa, Homo Sapiens
TENIILVGK

SEQ ID NO: 612576 - protein, 9 aa, Homo Sapiens
FVRFRNYCW

SEQ ID NO: 612577 - protein, 9 aa, Homo Sapiens
TGPLPLSLR

SEQ ID NO: 612578 - protein, 9 aa, Homo Sapiens
ATMAYDRYA

SEQ ID NO: 612579 - protein, 9 aa, Homo Sapiens
LVFLRSRLY

SEQ ID NO: 612580 - protein, 9 aa, Homo Sapiens
GEKLYQCNE

SEQ ID NO: 612581 - protein, 9 aa, Homo Sapiens
DSSKQLSKG

SEQ ID NO: 612582 - protein, 9 aa, Homo Sapiens
LGQALPRTL

SEQ ID NO: 612583 - protein, 9 aa, Homo Sapiens
SPAQQGCYA

SEQ ID NO: 612584 - protein, 9 aa, Homo Sapiens
MLVRVEEGI

SEQ ID NO: 612585 - protein, 9 aa, Homo Sapiens
GRERHRDPF

SEQ ID NO: 612586 - protein, 9 aa, Homo Sapiens
PEAAVAAVR

SEQ ID NO: 612587 - protein, 9 aa, Homo Sapiens
IFQKYCSVK

SEQ ID NO: 612588 - protein, 9 aa, Homo Sapiens
DSLSRGKSF

SEQ ID NO: 612589 - protein, 9 aa, Homo Sapiens
LKQHQFRER

SEQ ID NO: 612590 - protein, 9 aa, Homo Sapiens
QGHFASSAE

SEQ ID NO: 612591 - protein, 9 aa, Homo Sapiens
STTPTTPTA

SEQ ID NO: 612592 - protein, 9 aa, Homo Sapiens
NATEYARKR

SEQ ID NO: 612593 - protein, 9 aa, Homo Sapiens
FQQMRQECL

SEQ ID NO: 612594 - protein, 9 aa, Homo Sapiens
QNNQLICFQ

SEQ ID NO: 612595 - protein, 9 aa, Homo Sapiens
CIGHCNFRF

SEQ ID NO: 612596 - protein, 9 aa, Homo Sapiens
FVLTGRDTA

SEQ ID NO: 612597 - protein, 9 aa, Homo Sapiens
STSFLLCAR

SEQ ID NO: 612598 - protein, 9 aa, Homo Sapiens
KATLWLFLS

SEQ ID NO: 612599 - protein, 9 aa, Homo Sapiens
LNDIKLPDC

SEQ ID NO: 612600 - protein, 9 aa, Homo Sapiens
AGDTYLFKG

SEQ ID NO: 612601 - protein, 9 aa, Homo Sapiens
EAKVLNQTT

SEQ ID NO: 612602 - protein, 9 aa, Homo Sapiens
RNELLVTAS

SEQ ID NO: 612603 - protein, 9 aa, Homo Sapiens
LPEVFLKPW

SEQ ID NO: 612604 - protein, 9 aa, Homo Sapiens
WSKHSKVLE

SEQ ID NO: 612605 - protein, 9 aa, Homo Sapiens
FVISNQDLV

SEQ ID NO: 612606 - protein, 9 aa, Homo Sapiens
YRRSYVFKT

SEQ ID NO: 612607 - protein, 9 aa, Homo Sapiens
ETCALDNDK

SEQ ID NO: 612608 - protein, 9 aa, Homo Sapiens
YMRHTEDVA

SEQ ID NO: 612609 - protein, 9 aa, Homo Sapiens
QLICFQVIA

SEQ ID NO: 612610 - protein, 9 aa, Homo Sapiens
SAIHTPGPI

SEQ ID NO: 612611 - protein, 9 aa, Homo Sapiens
HERQRLQLC

SEQ ID NO: 612612 - protein, 9 aa, Homo Sapiens
DWIRLDPWE

SEQ ID NO: 612613 - protein, 9 aa, Homo Sapiens
FSSVSCGHG

SEQ ID NO: 612614 - protein, 9 aa, Homo Sapiens
FLRDSTHCS

SEQ ID NO: 612615 - protein, 9 aa, Homo Sapiens
SSKQLSKGI

SEQ ID NO: 612616 - protein, 9 aa, Homo Sapiens
QRDVYQQEQ

SEQ ID NO: 612617 - protein, 9 aa, Homo Sapiens
MQSGSDSNC

SEQ ID NO: 612618 - protein, 9 aa, Homo Sapiens
VLPPVSPRD

SEQ ID NO: 612619 - protein, 9 aa, Homo Sapiens
RFDLSCSRG

SEQ ID NO: 612620 - protein, 9 aa, Homo Sapiens
GALLAILLC

SEQ ID NO: 612621 - protein, 9 aa, Homo Sapiens
RRTKIKRRR

SEQ ID NO: 612622 - protein, 9 aa, Homo Sapiens
LLGLQPATE

SEQ ID NO: 612623 - protein, 9 aa, Homo Sapiens
SIRSIRNMQ

SEQ ID NO: 612624 - protein, 9 aa, Homo Sapiens
ARRAIEMAS

SEQ ID NO: 612625 - protein, 9 aa, Homo Sapiens
NDLKIKNMG

SEQ ID NO: 612626 - protein, 9 aa, Homo Sapiens
SEEFSHLPC

SEQ ID NO: 612627 - protein, 9 aa, Homo Sapiens
HKALDKKVR

SEQ ID NO: 612628 - protein, 9 aa, Homo Sapiens
RDVPFGFSP

SEQ ID NO: 612629 - protein, 9 aa, Homo Sapiens
SSLLDSLWC

SEQ ID NO: 612630 - protein, 9 aa, Homo Sapiens
ICKTIVQAA

SEQ ID NO: 612631 - protein, 9 aa, Homo Sapiens
FISTASPLT

SEQ ID NO: 612632 - protein, 9 aa, Homo Sapiens
LARRAEMMT

SEQ ID NO: 612633 - protein, 9 aa, Homo Sapiens
PEASALSLK

SEQ ID NO: 612634 - protein, 9 aa, Homo Sapiens
EQLFLEHRL

SEQ ID NO: 612635 - protein, 9 aa, Homo Sapiens
GKNRKTHQG

SEQ ID NO: 612636 - protein, 9 aa, Homo Sapiens
STLALVPAC

SEQ ID NO: 612637 - protein, 9 aa, Homo Sapiens
DYVPSSWKV

SEQ ID NO: 612638 - protein, 9 aa, Homo Sapiens
NAPPAKAGY

SEQ ID NO: 612639 - protein, 9 aa, Homo Sapiens
CLQLPDDYD

SEQ ID NO: 612640 - protein, 9 aa, Homo Sapiens
RHTTRPAAT

SEQ ID NO: 612641 - protein, 9 aa, Homo Sapiens
RGEKLALDC

SEQ ID NO: 612642 - protein, 9 aa, Homo Sapiens
AISTELNPH

SEQ ID NO: 612643 - protein, 9 aa, Homo Sapiens
KMNCHIHGP

SEQ ID NO: 612644 - protein, 9 aa, Homo Sapiens
RLFRKLFSH

SEQ ID NO: 612645 - protein, 9 aa, Homo Sapiens
FNGTFTVWP

SEQ ID NO: 612646 - protein, 9 aa, Homo Sapiens
DTDLCDEFG

SEQ ID NO: 612647 - protein, 9 aa, Homo Sapiens
KSFMKQLMD

SEQ ID NO: 612648 - protein, 9 aa, Homo Sapiens
LANWDATPF

SEQ ID NO: 612649 - protein, 9 aa, Homo Sapiens
LDSHSYLIN

SEQ ID NO: 612650 - protein, 9 aa, Homo Sapiens
FCYIGCTVF

SEQ ID NO: 612651 - protein, 9 aa, Homo Sapiens
DGQVFQGSM

SEQ ID NO: 612652 - protein, 9 aa, Homo Sapiens
EEGVKLPLG

SEQ ID NO: 612653 - protein, 9 aa, Homo Sapiens
YRIVKGLPN

SEQ ID NO: 612654 - protein, 9 aa, Homo Sapiens
YTVLGILLG

SEQ ID NO: 612655 - protein, 9 aa, Homo Sapiens
SQHMEGTHI

SEQ ID NO: 612656 - protein, 9 aa, Homo Sapiens
ASAIHTPGP

SEQ ID NO: 612657 - protein, 9 aa, Homo Sapiens
RCFKGLLIF

SEQ ID NO: 612658 - protein, 9 aa, Homo Sapiens
SHPHWHPHP

SEQ ID NO: 612659 - protein, 9 aa, Homo Sapiens
AHGDEVPYA

SEQ ID NO: 612660 - protein, 9 aa, Homo Sapiens
CVEDPDKAN

SEQ ID NO: 612661 - protein, 9 aa, Homo Sapiens
HAEVTENGE

SEQ ID NO: 612662 - protein, 9 aa, Homo Sapiens
KNRKTHQGP

SEQ ID NO: 612663 - protein, 9 aa, Homo Sapiens
SLARKATLW

SEQ ID NO: 612664 - protein, 9 aa, Homo Sapiens
YGADLNMKN

SEQ ID NO: 612665 - protein, 9 aa, Homo Sapiens
MGSWRKSLP

SEQ ID NO: 612666 - protein, 9 aa, Homo Sapiens
RIEIHTYGQ

SEQ ID NO: 612667 - protein, 9 aa, Homo Sapiens
PPLRNGYFG

SEQ ID NO: 612668 - protein, 9 aa, Homo Sapiens
CSIDEYCKS

SEQ ID NO: 612669 - protein, 9 aa, Homo Sapiens
FDTPTSFNH

SEQ ID NO: 612670 - protein, 9 aa, Homo Sapiens
SSESSSKSD

SEQ ID NO: 612671 - protein, 9 aa, Homo Sapiens
QAAPHPQAP

SEQ ID NO: 612672 - protein, 9 aa, Homo Sapiens
DMCSPNSTG

SEQ ID NO: 612673 - protein, 9 aa, Homo Sapiens
TTTANTTLV

SEQ ID NO: 612674 - protein, 9 aa, Homo Sapiens
GLGVCACQN

SEQ ID NO: 612675 - protein, 9 aa, Homo Sapiens
CSPFRRLSF

SEQ ID NO: 612676 - protein, 9 aa, Homo Sapiens
QRRVPWRRG

SEQ ID NO: 612677 - protein, 9 aa, Homo Sapiens
DFNRRGASV

SEQ ID NO: 612678 - protein, 9 aa, Homo Sapiens
TLVVTTPAV

SEQ ID NO: 612679 - protein, 9 aa, Homo Sapiens
LKQSDKMTA

SEQ ID NO: 612680 - protein, 9 aa, Homo Sapiens
PVFMELFSV

SEQ ID NO: 612681 - protein, 9 aa, Homo Sapiens
HWHPHPHPH

SEQ ID NO: 612682 - protein, 9 aa, Homo Sapiens
RGSPWPGLR

SEQ ID NO: 612683 - protein, 9 aa, Homo Sapiens
EGDMCSPNS

SEQ ID NO: 612684 - protein, 9 aa, Homo Sapiens
AVTSQSGGN

SEQ ID NO: 612685 - protein, 9 aa, Homo Sapiens
KVHSYSHAG

SEQ ID NO: 612686 - protein, 9 aa, Homo Sapiens
EPDGWSGGL

SEQ ID NO: 612687 - protein, 9 aa, Homo Sapiens
NSREPDIPP

SEQ ID NO: 612688 - protein, 9 aa, Homo Sapiens
FASSAEKLQ

SEQ ID NO: 612689 - protein, 9 aa, Homo Sapiens
ERLIKIASR

SEQ ID NO: 612690 - protein, 9 aa, Homo Sapiens
PPAHSAAPG

SEQ ID NO: 612691 - protein, 9 aa, Homo Sapiens
GFTYTGAYW

SEQ ID NO: 612692 - protein, 9 aa, Homo Sapiens
TCLYIRDPL

SEQ ID NO: 612693 - protein, 9 aa, Homo Sapiens
PKCSPPQRY

SEQ ID NO: 612694 - protein, 9 aa, Homo Sapiens
LGQMCQNPI

SEQ ID NO: 612695 - protein, 9 aa, Homo Sapiens
VQMNLEIAS

SEQ ID NO: 612696 - protein, 9 aa, Homo Sapiens
HCQSLVFSV

SEQ ID NO: 612697 - protein, 9 aa, Homo Sapiens
ICTNSLQVR

SEQ ID NO: 612698 - protein, 9 aa, Homo Sapiens
GSLVNNWKN

SEQ ID NO: 612699 - protein, 9 aa, Homo Sapiens
HPHSHPHWH

SEQ ID NO: 612700 - protein, 9 aa, Homo Sapiens
TTRFFETCA

SEQ ID NO: 612701 - protein, 9 aa, Homo Sapiens
LGSPAQQGC

SEQ ID NO: 612702 - protein, 9 aa, Homo Sapiens
DGVTESHYL

SEQ ID NO: 612703 - protein, 9 aa, Homo Sapiens
WSTFGSLEV

SEQ ID NO: 612704 - protein, 9 aa, Homo Sapiens
GSWRKSLPR

SEQ ID NO: 612705 - protein, 9 aa, Homo Sapiens
TITMRTCLG

SEQ ID NO: 612706 - protein, 9 aa, Homo Sapiens
GQSSHYCQP

SEQ ID NO: 612707 - protein, 9 aa, Homo Sapiens
NFFHVTVQI

SEQ ID NO: 612708 - protein, 9 aa, Homo Sapiens
PVTLTANKA

SEQ ID NO: 612709 - protein, 9 aa, Homo Sapiens
YTGCFELKE

SEQ ID NO: 612710 - protein, 9 aa, Homo Sapiens
EYFQERRML

SEQ ID NO: 612711 - protein, 9 aa, Homo Sapiens
WDEPWCNQK

SEQ ID NO: 612712 - protein, 9 aa, Homo Sapiens
HSRVESSMR

SEQ ID NO: 612713 - protein, 9 aa, Homo Sapiens
TGALLAILL

SEQ ID NO: 612714 - protein, 9 aa, Homo Sapiens
GLSGSLLGA

SEQ ID NO: 612715 - protein, 9 aa, Homo Sapiens
RDDVVAVAG

SEQ ID NO: 612716 - protein, 9 aa, Homo Sapiens
IRICGVCFQ

SEQ ID NO: 612717 - protein, 9 aa, Homo Sapiens
IFFFHFVGG

SEQ ID NO: 612718 - protein, 9 aa, Homo Sapiens
AVPAQQKVR

SEQ ID NO: 612719 - protein, 9 aa, Homo Sapiens
FSPSTAQLT

SEQ ID NO: 612720 - protein, 9 aa, Homo Sapiens
WRISDVHSL

SEQ ID NO: 612721 - protein, 9 aa, Homo Sapiens
DSKGEEDEE

SEQ ID NO: 612722 - protein, 9 aa, Homo Sapiens
PYGCYECGK

SEQ ID NO: 612723 - protein, 9 aa, Homo Sapiens
PLPLSAKGS

SEQ ID NO: 612724 - protein, 9 aa, Homo Sapiens
REVIKRIQS

SEQ ID NO: 612725 - protein, 9 aa, Homo Sapiens
IHIFRAHLW

SEQ ID NO: 612726 - protein, 9 aa, Homo Sapiens
DTVSQFHSI

SEQ ID NO: 612727 - protein, 9 aa, Homo Sapiens
RGDPCELCP

SEQ ID NO: 612728 - protein, 9 aa, Homo Sapiens
VHEKEELKE

SEQ ID NO: 612729 - protein, 9 aa, Homo Sapiens
LVYGNECAN

SEQ ID NO: 612730 - protein, 9 aa, Homo Sapiens
GPEQERDWS

SEQ ID NO: 612731 - protein, 9 aa, Homo Sapiens
AYWEKLWRV

SEQ ID NO: 612732 - protein, 9 aa, Homo Sapiens
YMQSGSDSN

SEQ ID NO: 612733 - protein, 9 aa, Homo Sapiens
RDHILRRFQ

SEQ ID NO: 612734 - protein, 9 aa, Homo Sapiens
CQPDTQDQS

SEQ ID NO: 612735 - protein, 9 aa, Homo Sapiens
RRELEAKAG

SEQ ID NO: 612736 - protein, 9 aa, Homo Sapiens
YECGKDFSS

SEQ ID NO: 612737 - protein, 9 aa, Homo Sapiens
QAPLLPPRC

SEQ ID NO: 612738 - protein, 9 aa, Homo Sapiens
FQVIATLII

SEQ ID NO: 612739 - protein, 9 aa, Homo Sapiens
PMPRNMEGA

SEQ ID NO: 612740 - protein, 9 aa, Homo Sapiens
DVLEASVES

SEQ ID NO: 612741 - protein, 9 aa, Homo Sapiens
DNKCFVQQL

SEQ ID NO: 612742 - protein, 9 aa, Homo Sapiens
ALDCGIKFM

SEQ ID NO: 612743 - protein, 9 aa, Homo Sapiens
YVLVTEDPA

SEQ ID NO: 612744 - protein, 9 aa, Homo Sapiens
MEAAETKAE

SEQ ID NO: 612745 - protein, 9 aa, Homo Sapiens
APAYSPNIY

SEQ ID NO: 612746 - protein, 9 aa, Homo Sapiens
RRDHKTSTR

SEQ ID NO: 612747 - protein, 9 aa, Homo Sapiens
HSRTHKSQE

SEQ ID NO: 612748 - protein, 9 aa, Homo Sapiens
PPGPQGNRG

SEQ ID NO: 612749 - protein, 9 aa, Homo Sapiens
LRAAAEAAL

SEQ ID NO: 612750 - protein, 9 aa, Homo Sapiens
PRLVLSEEI

SEQ ID NO: 612751 - protein, 9 aa, Homo Sapiens
LPLNQRGFF

SEQ ID NO: 612752 - protein, 9 aa, Homo Sapiens
QVKKIMQFM

SEQ ID NO: 612753 - protein, 9 aa, Homo Sapiens
FPELPVRGV

SEQ ID NO: 612754 - protein, 9 aa, Homo Sapiens
HSYLINSNT

SEQ ID NO: 612755 - protein, 9 aa, Homo Sapiens
GRAQPLANA

SEQ ID NO: 612756 - protein, 9 aa, Homo Sapiens
LVIMPLVFR

SEQ ID NO: 612757 - protein, 9 aa, Homo Sapiens
HSYSHAGER

SEQ ID NO: 612758 - protein, 9 aa, Homo Sapiens
RRKRKNTRN

SEQ ID NO: 612759 - protein, 9 aa, Homo Sapiens
QHTLHSFDA

SEQ ID NO: 612760 - protein, 9 aa, Homo Sapiens
GPCAGRDCS

SEQ ID NO: 612761 - protein, 9 aa, Homo Sapiens
MGQRVCYVP

SEQ ID NO: 612762 - protein, 9 aa, Homo Sapiens
TGPAPPFPE

SEQ ID NO: 612763 - protein, 9 aa, Homo Sapiens
EKYNQHISS

SEQ ID NO: 612764 - protein, 9 aa, Homo Sapiens
LSPMYIFLG

SEQ ID NO: 612765 - protein, 9 aa, Homo Sapiens
PIGEKKRPA

SEQ ID NO: 612766 - protein, 9 aa, Homo Sapiens
SGSDLPQDS

SEQ ID NO: 612767 - protein, 9 aa, Homo Sapiens
QRPNGSSGK

SEQ ID NO: 612768 - protein, 9 aa, Homo Sapiens
ACIMGAKSI

SEQ ID NO: 612769 - protein, 9 aa, Homo Sapiens
EQLGPEDQD

SEQ ID NO: 612770 - protein, 9 aa, Homo Sapiens
SNKYRQDAK

SEQ ID NO: 612771 - protein, 9 aa, Homo Sapiens
SSGSSEYSF

SEQ ID NO: 612772 - protein, 9 aa, Homo Sapiens
LKRRCVEAA

SEQ ID NO: 612773 - protein, 9 aa, Homo Sapiens
VVKVLTLNQ

SEQ ID NO: 612774 - protein, 9 aa, Homo Sapiens
AAANPKTLT

SEQ ID NO: 612775 - protein, 9 aa, Homo Sapiens
HLHHQLLHL

SEQ ID NO: 612776 - protein, 9 aa, Homo Sapiens
PAFHFNIMK

SEQ ID NO: 612777 - protein, 9 aa, Homo Sapiens
TGCFELKED

SEQ ID NO: 612778 - protein, 9 aa, Homo Sapiens
DKSNDNSGE

SEQ ID NO: 612779 - protein, 9 aa, Homo Sapiens
SPHVVIQPD

SEQ ID NO: 612780 - protein, 9 aa, Homo Sapiens
NWQWIDKKP

SEQ ID NO: 612781 - protein, 9 aa, Homo Sapiens
ECKKCGKAN

SEQ ID NO: 612782 - protein, 9 aa, Homo Sapiens
LDVSYEEMA

SEQ ID NO: 612783 - protein, 9 aa, Homo Sapiens
NPNYEIIHM

SEQ ID NO: 612784 - protein, 9 aa, Homo Sapiens
AMASVARTA

SEQ ID NO: 612785 - protein, 9 aa, Homo Sapiens
AEAKATTAP

SEQ ID NO: 612786 - protein, 9 aa, Homo Sapiens
RRWHKSRVL

SEQ ID NO: 612787 - protein, 9 aa, Homo Sapiens
HQVMYAMLV

SEQ ID NO: 612788 - protein, 9 aa, Homo Sapiens
TVSQFHSIC

SEQ ID NO: 612789 - protein, 9 aa, Homo Sapiens
NTFIYTLRN

SEQ ID NO: 612790 - protein, 9 aa, Homo Sapiens
AVFSASWYA

SEQ ID NO: 612791 - protein, 9 aa, Homo Sapiens
NEPVCEENF

SEQ ID NO: 612792 - protein, 9 aa, Homo Sapiens
MPLTQYLKR

SEQ ID NO: 612793 - protein, 9 aa, Homo Sapiens
SPTRGPSRT

SEQ ID NO: 612794 - protein, 9 aa, Homo Sapiens
VVFGDVCPL

SEQ ID NO: 612795 - protein, 9 aa, Homo Sapiens
LVAQNTTGT

SEQ ID NO: 612796 - protein, 9 aa, Homo Sapiens
LVGKLAALE

SEQ ID NO: 612797 - protein, 9 aa, Homo Sapiens
EEGVAGFFE

SEQ ID NO: 612798 - protein, 9 aa, Homo Sapiens
HIPPSAQAS

SEQ ID NO: 612799 - protein, 9 aa, Homo Sapiens
RTSAMLTVS

SEQ ID NO: 612800 - protein, 9 aa, Homo Sapiens
SHYCQPDTQ

SEQ ID NO: 612801 - protein, 9 aa, Homo Sapiens
YDLDFEKLK

SEQ ID NO: 612802 - protein, 9 aa, Homo Sapiens
MASVARTAQ

SEQ ID NO: 612803 - protein, 9 aa, Homo Sapiens
AGVFPERVG

SEQ ID NO: 612804 - protein, 9 aa, Homo Sapiens
ARAGSRIAV

SEQ ID NO: 612805 - protein, 9 aa, Homo Sapiens
QALKWNWKK

SEQ ID NO: 612806 - protein, 9 aa, Homo Sapiens
HCNFRFFML

SEQ ID NO: 612807 - protein, 9 aa, Homo Sapiens
LSSLLVGEG

SEQ ID NO: 612808 - protein, 9 aa, Homo Sapiens
ICFQVIATL

SEQ ID NO: 612809 - protein, 9 aa, Homo Sapiens
WPELKIVHW

SEQ ID NO: 612810 - protein, 9 aa, Homo Sapiens
HGNAGQSNY

SEQ ID NO: 612811 - protein, 9 aa, Homo Sapiens
TFTIPKMLG

SEQ ID NO: 612812 - protein, 9 aa, Homo Sapiens
YFCRTVCSL

SEQ ID NO: 612813 - protein, 9 aa, Homo Sapiens
VWPYICEAT

SEQ ID NO: 612814 - protein, 9 aa, Homo Sapiens
ERDWSQQEL

SEQ ID NO: 612815 - protein, 9 aa, Homo Sapiens
GADPAVATT

SEQ ID NO: 612816 - protein, 9 aa, Homo Sapiens
MVKDAHEVR

SEQ ID NO: 612817 - protein, 9 aa, Homo Sapiens
EPVCEENFT

SEQ ID NO: 612818 - protein, 9 aa, Homo Sapiens
YNKAVQEIQ

SEQ ID NO: 612819 - protein, 9 aa, Homo Sapiens
IMKPYIKIF

SEQ ID NO: 612820 - protein, 9 aa, Homo Sapiens
KTYELMPSF

SEQ ID NO: 612821 - protein, 9 aa, Homo Sapiens
KVRTARRRR

SEQ ID NO: 612822 - protein, 9 aa, Homo Sapiens
PIFLHSSLD

SEQ ID NO: 612823 - protein, 9 aa, Homo Sapiens
GPRASHMRW

SEQ ID NO: 612824 - protein, 9 aa, Homo Sapiens
TYVLVTEDP

SEQ ID NO: 612825 - protein, 9 aa, Homo Sapiens
LEHRLVSLI

SEQ ID NO: 612826 - protein, 9 aa, Homo Sapiens
LATLELLLW

SEQ ID NO: 612827 - protein, 9 aa, Homo Sapiens
GQGQWRASA

SEQ ID NO: 612828 - protein, 9 aa, Homo Sapiens
LGVCACQNM

SEQ ID NO: 612829 - protein, 9 aa, Homo Sapiens
CACQNMCVC

SEQ ID NO: 612830 - protein, 9 aa, Homo Sapiens
GYDDLSESE

SEQ ID NO: 612831 - protein, 9 aa, Homo Sapiens
KLQEQLSKA

SEQ ID NO: 612832 - protein, 9 aa, Homo Sapiens
LQDVRKRMQ

SEQ ID NO: 612833 - protein, 9 aa, Homo Sapiens
AILNHHSCS

SEQ ID NO: 612834 - protein, 9 aa, Homo Sapiens
EEKRGGETQ

SEQ ID NO: 612835 - protein, 9 aa, Homo Sapiens
GARGPLSRA

SEQ ID NO: 612836 - protein, 9 aa, Homo Sapiens
LTINTAVVY

SEQ ID NO: 612837 - protein, 9 aa, Homo Sapiens
LPSESCERP

SEQ ID NO: 612838 - protein, 9 aa, Homo Sapiens
FRNEEYNKA

SEQ ID NO: 612839 - protein, 9 aa, Homo Sapiens
MDQASFELL

SEQ ID NO: 612840 - protein, 9 aa, Homo Sapiens
KLRRELEAK

SEQ ID NO: 612841 - protein, 9 aa, Homo Sapiens
GYAFVTFCG

SEQ ID NO: 612842 - protein, 9 aa, Homo Sapiens
PACMVTLSG

SEQ ID NO: 612843 - protein, 9 aa, Homo Sapiens
QCMVAHACN

SEQ ID NO: 612844 - protein, 9 aa, Homo Sapiens
SKEAVVAMI

SEQ ID NO: 612845 - protein, 9 aa, Homo Sapiens
KQSPQNKNH

SEQ ID NO: 612846 - protein, 9 aa, Homo Sapiens
VFPYFQRLG

SEQ ID NO: 612847 - protein, 9 aa, Homo Sapiens
KTCPTVQPN

SEQ ID NO: 612848 - protein, 9 aa, Homo Sapiens
PRSRSPLSP

SEQ ID NO: 612849 - protein, 9 aa, Homo Sapiens
HLLRPQEYR

SEQ ID NO: 612850 - protein, 9 aa, Homo Sapiens
KKKSARSIF

SEQ ID NO: 612851 - protein, 9 aa, Homo Sapiens
ELERIQNLL

SEQ ID NO: 612852 - protein, 9 aa, Homo Sapiens
FTYTGAYWR

SEQ ID NO: 612853 - protein, 9 aa, Homo Sapiens
CVSDSFQYR

SEQ ID NO: 612854 - protein, 9 aa, Homo Sapiens
EFPRWVHCA

SEQ ID NO: 612855 - protein, 9 aa, Homo Sapiens
SWLGVAQLR

SEQ ID NO: 612856 - protein, 9 aa, Homo Sapiens
STELNPHGM

SEQ ID NO: 612857 - protein, 9 aa, Homo Sapiens
MLFLRLYLL

SEQ ID NO: 612858 - protein, 9 aa, Homo Sapiens
MIGQNSGLV

SEQ ID NO: 612859 - protein, 9 aa, Homo Sapiens
YSFVEIRMA

SEQ ID NO: 612860 - protein, 9 aa, Homo Sapiens
PTGHLTVAE

SEQ ID NO: 612861 - protein, 9 aa, Homo Sapiens
CEESPTFAC

SEQ ID NO: 612862 - protein, 9 aa, Homo Sapiens
VFSASWYAV

SEQ ID NO: 612863 - protein, 9 aa, Homo Sapiens
ATKYAKKVA

SEQ ID NO: 612864 - protein, 9 aa, Homo Sapiens
HSGTTYLFS

SEQ ID NO: 612865 - protein, 9 aa, Homo Sapiens
LNKAAQILR

SEQ ID NO: 612866 - protein, 9 aa, Homo Sapiens
QGVVFPYFQ

SEQ ID NO: 612867 - protein, 9 aa, Homo Sapiens
STIETLKQL

SEQ ID NO: 612868 - protein, 9 aa, Homo Sapiens
LADMHRQSP

SEQ ID NO: 612869 - protein, 9 aa, Homo Sapiens
SIPRPDEIS

SEQ ID NO: 612870 - protein, 9 aa, Homo Sapiens
SMAYDRYLD

SEQ ID NO: 612871 - protein, 9 aa, Homo Sapiens
TMVPVASHN

SEQ ID NO: 612872 - protein, 9 aa, Homo Sapiens
LAEGTEQQR

SEQ ID NO: 612873 - protein, 9 aa, Homo Sapiens
EITLQRTKM

SEQ ID NO: 612874 - protein, 9 aa, Homo Sapiens
RKATLWLFL

SEQ ID NO: 612875 - protein, 9 aa, Homo Sapiens
FKGLLIFGN

SEQ ID NO: 612876 - protein, 9 aa, Homo Sapiens
VSPKNTTES

SEQ ID NO: 612877 - protein, 9 aa, Homo Sapiens
RGYLVRQQM

SEQ ID NO: 612878 - protein, 9 aa, Homo Sapiens
IQPADTGGR

SEQ ID NO: 612879 - protein, 9 aa, Homo Sapiens
PIWGSLNGR

SEQ ID NO: 612880 - protein, 9 aa, Homo Sapiens
ITAVTSQSG

SEQ ID NO: 612881 - protein, 9 aa, Homo Sapiens
INTAVVYMH

SEQ ID NO: 612882 - protein, 9 aa, Homo Sapiens
DFTDPLYEE

SEQ ID NO: 612883 - protein, 9 aa, Homo Sapiens
TARYSLICH

SEQ ID NO: 612884 - protein, 9 aa, Homo Sapiens
PIFHQVMYA

SEQ ID NO: 612885 - protein, 9 aa, Homo Sapiens
HPLVPQVLG

SEQ ID NO: 612886 - protein, 9 aa, Homo Sapiens
CLYIRDPLN

SEQ ID NO: 612887 - protein, 9 aa, Homo Sapiens
TNSHYFTNP

SEQ ID NO: 612888 - protein, 9 aa, Homo Sapiens
ERVSIETRC

SEQ ID NO: 612889 - protein, 9 aa, Homo Sapiens
EYLESSRQD

SEQ ID NO: 612890 - protein, 9 aa, Homo Sapiens
IVRMAFFQD

SEQ ID NO: 612891 - protein, 9 aa, Homo Sapiens
DVKPVLDSY

SEQ ID NO: 612892 - protein, 9 aa, Homo Sapiens
CYSHLLVVS

SEQ ID NO: 612893 - protein, 9 aa, Homo Sapiens
IPDPRALPS

SEQ ID NO: 612894 - protein, 9 aa, Homo Sapiens
IRACFTQWL

SEQ ID NO: 612895 - protein, 9 aa, Homo Sapiens
FPSISLVAL

SEQ ID NO: 612896 - protein, 9 aa, Homo Sapiens
TRKRSQRRT

SEQ ID NO: 612897 - protein, 9 aa, Homo Sapiens
DAEREERKR

SEQ ID NO: 612898 - protein, 9 aa, Homo Sapiens
ATPGRLLYH

SEQ ID NO: 612899 - protein, 9 aa, Homo Sapiens
KHIPKLQEQ

SEQ ID NO: 612900 - protein, 9 aa, Homo Sapiens
LVNWQHPRK

SEQ ID NO: 612901 - protein, 9 aa, Homo Sapiens
TKKKNLVFL

SEQ ID NO: 612902 - protein, 9 aa, Homo Sapiens
AWRPEAAVA

SEQ ID NO: 612903 - protein, 9 aa, Homo Sapiens
NKCFVQQLW

SEQ ID NO: 612904 - protein, 9 aa, Homo Sapiens
TSTTPTTPT

SEQ ID NO: 612905 - protein, 9 aa, Homo Sapiens
KTEEPRSKE

SEQ ID NO: 612906 - protein, 9 aa, Homo Sapiens
AHRQAAERA

SEQ ID NO: 612907 - protein, 9 aa, Homo Sapiens
QQQQQVSAH

SEQ ID NO: 612908 - protein, 9 aa, Homo Sapiens
LNEFDSLKD

SEQ ID NO: 612909 - protein, 9 aa, Homo Sapiens
GARAGGYKT

SEQ ID NO: 612910 - protein, 9 aa, Homo Sapiens
SNDNSGEKT

SEQ ID NO: 612911 - protein, 9 aa, Homo Sapiens
FALSFGHQQ

SEQ ID NO: 612912 - protein, 9 aa, Homo Sapiens
RRAEMMTGG

SEQ ID NO: 612913 - protein, 9 aa, Homo Sapiens
QQNETRVSW

SEQ ID NO: 612914 - protein, 9 aa, Homo Sapiens
PTTNAWSWR

SEQ ID NO: 612915 - protein, 9 aa, Homo Sapiens
SRSLAKEVA

SEQ ID NO: 612916 - protein, 9 aa, Homo Sapiens
VAAAAASRR

SEQ ID NO: 612917 - protein, 9 aa, Homo Sapiens
LLVTMPAAL

SEQ ID NO: 612918 - protein, 9 aa, Homo Sapiens
VNPMEEEYP

SEQ ID NO: 612919 - protein, 9 aa, Homo Sapiens
VQFPYEDIK

SEQ ID NO: 612920 - protein, 9 aa, Homo Sapiens
SLAKEVARK

SEQ ID NO: 612921 - protein, 9 aa, Homo Sapiens
NGDFCYLDV

SEQ ID NO: 612922 - protein, 9 aa, Homo Sapiens
CRQRLSGQE

SEQ ID NO: 612923 - protein, 9 aa, Homo Sapiens
DKMNCHIHG

SEQ ID NO: 612924 - protein, 9 aa, Homo Sapiens
FVFQVVPML

SEQ ID NO: 612925 - protein, 9 aa, Homo Sapiens
AQASGAGQG

SEQ ID NO: 612926 - protein, 9 aa, Homo Sapiens
DEHDIDPTG

SEQ ID NO: 612927 - protein, 9 aa, Homo Sapiens
EEKAHVPIS

SEQ ID NO: 612928 - protein, 9 aa, Homo Sapiens
PLLWALSLL

SEQ ID NO: 612929 - protein, 9 aa, Homo Sapiens
GIRATAAPA

SEQ ID NO: 612930 - protein, 9 aa, Homo Sapiens
ETKAEAAAL

SEQ ID NO: 612931 - protein, 9 aa, Homo Sapiens
AALLECLTF

SEQ ID NO: 612932 - protein, 9 aa, Homo Sapiens
AGPHPGHQL

SEQ ID NO: 612933 - protein, 9 aa, Homo Sapiens
GQIHVTKLA

SEQ ID NO: 612934 - protein, 9 aa, Homo Sapiens
SGQAPKASC

SEQ ID NO: 612935 - protein, 9 aa, Homo Sapiens
VRKPVVQIH

SEQ ID NO: 612936 - protein, 9 aa, Homo Sapiens
DAQSLLSLC

SEQ ID NO: 612937 - protein, 9 aa, Homo Sapiens
GPGPSPGRL

SEQ ID NO: 612938 - protein, 9 aa, Homo Sapiens
YLIPINKEG

SEQ ID NO: 612939 - protein, 9 aa, Homo Sapiens
TRGPSRTLT

SEQ ID NO: 612940 - protein, 9 aa, Homo Sapiens
KEKLTSHQS

SEQ ID NO: 612941 - protein, 9 aa, Homo Sapiens
HAGERPYKC

SEQ ID NO: 612942 - protein, 9 aa, Homo Sapiens
RRLRCAAPL

SEQ ID NO: 612943 - protein, 9 aa, Homo Sapiens
GEGHFWQLD

SEQ ID NO: 612944 - protein, 9 aa, Homo Sapiens
SVSCEVFCK

SEQ ID NO: 612945 - protein, 9 aa, Homo Sapiens
LGLSIVRGK

SEQ ID NO: 612946 - protein, 9 aa, Homo Sapiens
WGLGVCACQ

SEQ ID NO: 612947 - protein, 9 aa, Homo Sapiens
NEFQKWLGS

SEQ ID NO: 612948 - protein, 9 aa, Homo Sapiens
NEFDSLKDP

SEQ ID NO: 612949 - protein, 9 aa, Homo Sapiens
LETKCSLLQ

SEQ ID NO: 612950 - protein, 9 aa, Homo Sapiens
VPFGFSPII

SEQ ID NO: 612951 - protein, 9 aa, Homo Sapiens
STCYSHLLV

SEQ ID NO: 612952 - protein, 9 aa, Homo Sapiens
EFRFPEDEF

SEQ ID NO: 612953 - protein, 9 aa, Homo Sapiens
RCALGYYRI

SEQ ID NO: 612954 - protein, 9 aa, Homo Sapiens
VVGKGECDN

SEQ ID NO: 612955 - protein, 9 aa, Homo Sapiens
RLLGPPASR

SEQ ID NO: 612956 - protein, 9 aa, Homo Sapiens
STEKVKIEV

SEQ ID NO: 612957 - protein, 9 aa, Homo Sapiens
NAWSWRRSF

SEQ ID NO: 612958 - protein, 9 aa, Homo Sapiens
LLWALSLLG

SEQ ID NO: 612959 - protein, 9 aa, Homo Sapiens
KLCYDLDFE

SEQ ID NO: 612960 - protein, 9 aa, Homo Sapiens
TSVFLEWIQ

SEQ ID NO: 612961 - protein, 9 aa, Homo Sapiens
SCGSRSCSL

SEQ ID NO: 612962 - protein, 9 aa, Homo Sapiens
EELKEERIN

SEQ ID NO: 612963 - protein, 9 aa, Homo Sapiens
PNNDDKMNC

SEQ ID NO: 612964 - protein, 9 aa, Homo Sapiens
EQSGVLLLE

SEQ ID NO: 612965 - protein, 9 aa, Homo Sapiens
ELMRERHLD

SEQ ID NO: 612966 - protein, 9 aa, Homo Sapiens
VDIPLHLPD

SEQ ID NO: 612967 - protein, 9 aa, Homo Sapiens
FLIALIGNL

SEQ ID NO: 612968 - protein, 9 aa, Homo Sapiens
TKAEAAALE

SEQ ID NO: 612969 - protein, 9 aa, Homo Sapiens
RSKEAVVAM

SEQ ID NO: 612970 - protein, 9 aa, Homo Sapiens
VKLPLGKER

SEQ ID NO: 612971 - protein, 9 aa, Homo Sapiens
SDSLEIQCL

SEQ ID NO: 612972 - protein, 9 aa, Homo Sapiens
SQFHSICEV

SEQ ID NO: 612973 - protein, 9 aa, Homo Sapiens
KREVGAALF

SEQ ID NO: 612974 - protein, 9 aa, Homo Sapiens
PKRASVVHS

SEQ ID NO: 612975 - protein, 9 aa, Homo Sapiens
ALSSGVDII

SEQ ID NO: 612976 - protein, 9 aa, Homo Sapiens
LALTVMVLV

SEQ ID NO: 612977 - protein, 9 aa, Homo Sapiens
YAHYAASAT

SEQ ID NO: 612978 - protein, 9 aa, Homo Sapiens
LQTTVEGQD

SEQ ID NO: 612979 - protein, 9 aa, Homo Sapiens
GKANTRSSH

SEQ ID NO: 612980 - protein, 9 aa, Homo Sapiens
RTAQQYERS

SEQ ID NO: 612981 - protein, 9 aa, Homo Sapiens
CEENFTFFI

SEQ ID NO: 612982 - protein, 9 aa, Homo Sapiens
SDFLDKHHM

SEQ ID NO: 612983 - protein, 9 aa, Homo Sapiens
VADFLMQRR

SEQ ID NO: 612984 - protein, 9 aa, Homo Sapiens
GEKLALDCG

SEQ ID NO: 612985 - protein, 9 aa, Homo Sapiens
LNLKQFILF

SEQ ID NO: 612986 - protein, 9 aa, Homo Sapiens
LEGDMCSPN

SEQ ID NO: 612987 - protein, 9 aa, Homo Sapiens
EQLPEQTVI

SEQ ID NO: 612988 - protein, 9 aa, Homo Sapiens
GPSRTLTTT

SEQ ID NO: 612989 - protein, 9 aa, Homo Sapiens
RHRDPFPEL

SEQ ID NO: 612990 - protein, 9 aa, Homo Sapiens
DPGTPLCGT

SEQ ID NO: 612991 - protein, 9 aa, Homo Sapiens
TAQQYERSF

SEQ ID NO: 612992 - protein, 9 aa, Homo Sapiens
PLSVPQVLP

SEQ ID NO: 612993 - protein, 9 aa, Homo Sapiens
KVAKNESKL

SEQ ID NO: 612994 - protein, 9 aa, Homo Sapiens
GKGWEVINS

SEQ ID NO: 612995 - protein, 9 aa, Homo Sapiens
GDLYIKFDL

SEQ ID NO: 612996 - protein, 9 aa, Homo Sapiens
SVESAKVEA

SEQ ID NO: 612997 - protein, 9 aa, Homo Sapiens
WPGLRLPSL

SEQ ID NO: 612998 - protein, 9 aa, Homo Sapiens
SSSKSDYEE

SEQ ID NO: 612999 - protein, 9 aa, Homo Sapiens
RAQPLANAV

SEQ ID NO: 613000 - protein, 9 aa, Homo Sapiens
NKALAWQRC

SEQ ID NO: 613001 - protein, 9 aa, Homo Sapiens
FNGEVNVVP

SEQ ID NO: 613002 - protein, 9 aa, Homo Sapiens
FPHAAQQER

SEQ ID NO: 613003 - protein, 9 aa, Homo Sapiens
SSMRKSAKE

SEQ ID NO: 613004 - protein, 9 aa, Homo Sapiens
AAEAALSQT

SEQ ID NO: 613005 - protein, 9 aa, Homo Sapiens
YVPSSWKVE

SEQ ID NO: 613006 - protein, 9 aa, Homo Sapiens
DLSTIETLK

SEQ ID NO: 613007 - protein, 9 aa, Homo Sapiens
ESPTFACNL

SEQ ID NO: 613008 - protein, 9 aa, Homo Sapiens
KIQDDLQSS

SEQ ID NO: 613009 - protein, 9 aa, Homo Sapiens
LCDEFGNYI

SEQ ID NO: 613010 - protein, 9 aa, Homo Sapiens
KPSPSPEEK

SEQ ID NO: 613011 - protein, 9 aa, Homo Sapiens
EGETEEKRG

SEQ ID NO: 613012 - protein, 9 aa, Homo Sapiens
YHTYYECPG

SEQ ID NO: 613013 - protein, 9 aa, Homo Sapiens
NMQALKWNW

SEQ ID NO: 613014 - protein, 9 aa, Homo Sapiens
EVSNDTISY

SEQ ID NO: 613015 - protein, 9 aa, Homo Sapiens
HSNGGNTNS

SEQ ID NO: 613016 - protein, 9 aa, Homo Sapiens
TMAYDRYAA

SEQ ID NO: 613017 - protein, 9 aa, Homo Sapiens
LEWIQPADT

SEQ ID NO: 613018 - protein, 9 aa, Homo Sapiens
GVPVRGSAA

SEQ ID NO: 613019 - protein, 9 aa, Homo Sapiens
HLALTVMVL

SEQ ID NO: 613020 - protein, 9 aa, Homo Sapiens
VILFFGEGT

SEQ ID NO: 613021 - protein, 9 aa, Homo Sapiens
ILTPLLNHL

SEQ ID NO: 613022 - protein, 9 aa, Homo Sapiens
SSVRCIQPL

SEQ ID NO: 613023 - protein, 9 aa, Homo Sapiens
KKNLVFLRS

SEQ ID NO: 613024 - protein, 9 aa, Homo Sapiens
LLDSLWCSP

SEQ ID NO: 613025 - protein, 9 aa, Homo Sapiens
RSEYVRKFL

SEQ ID NO: 613026 - protein, 9 aa, Homo Sapiens
KAAQILRLL

SEQ ID NO: 613027 - protein, 9 aa, Homo Sapiens
SWKVEFGPG

SEQ ID NO: 613028 - protein, 9 aa, Homo Sapiens
RSFLGINKE

SEQ ID NO: 613029 - protein, 9 aa, Homo Sapiens
LEETPSHGD

SEQ ID NO: 613030 - protein, 9 aa, Homo Sapiens
TGVRLKRLI

SEQ ID NO: 613031 - protein, 9 aa, Homo Sapiens
RATAAPASA

SEQ ID NO: 613032 - protein, 9 aa, Homo Sapiens
CQSLVFSVA

SEQ ID NO: 613033 - protein, 9 aa, Homo Sapiens
PASLAAQGQ

SEQ ID NO: 613034 - protein, 9 aa, Homo Sapiens
SALLEQACA

SEQ ID NO: 613035 - protein, 9 aa, Homo Sapiens
GARAHRPRP

SEQ ID NO: 613036 - protein, 9 aa, Homo Sapiens
TMLSQETLT

SEQ ID NO: 613037 - protein, 9 aa, Homo Sapiens
ILNDIKLPD

SEQ ID NO: 613038 - protein, 9 aa, Homo Sapiens
VPVAFQLKT

SEQ ID NO: 613039 - protein, 9 aa, Homo Sapiens
TRLHLQTMT

SEQ ID NO: 613040 - protein, 9 aa, Homo Sapiens
RVVYNAQRP

SEQ ID NO: 613041 - protein, 9 aa, Homo Sapiens
PLLNTFIYT

SEQ ID NO: 613042 - protein, 9 aa, Homo Sapiens
QARMGSAGL

SEQ ID NO: 613043 - protein, 9 aa, Homo Sapiens
YHKEESPAS

SEQ ID NO: 613044 - protein, 9 aa, Homo Sapiens
VGGFRAMVG

SEQ ID NO: 613045 - protein, 9 aa, Homo Sapiens
ALDKKVRER

SEQ ID NO: 613046 - protein, 9 aa, Homo Sapiens
IFRNGSPVS

SEQ ID NO: 613047 - protein, 9 aa, Homo Sapiens
NELLLKSEH

SEQ ID NO: 613048 - protein, 9 aa, Homo Sapiens
ESAFLDLFI

SEQ ID NO: 613049 - protein, 9 aa, Homo Sapiens
YCVLTLTPT

SEQ ID NO: 613050 - protein, 9 aa, Homo Sapiens
PRCISRPSS

SEQ ID NO: 613051 - protein, 9 aa, Homo Sapiens
RETESGSQS

SEQ ID NO: 613052 - protein, 9 aa, Homo Sapiens
KVPGDPWSA

SEQ ID NO: 613053 - protein, 9 aa, Homo Sapiens
PRGTAIHPG

SEQ ID NO: 613054 - protein, 9 aa, Homo Sapiens
SNGICHLET

SEQ ID NO: 613055 - protein, 9 aa, Homo Sapiens
MGSGSNTGF

SEQ ID NO: 613056 - protein, 9 aa, Homo Sapiens
ILLSREGLV

SEQ ID NO: 613057 - protein, 9 aa, Homo Sapiens
WIQPADTGG

SEQ ID NO: 613058 - protein, 9 aa, Homo Sapiens
PRGGPGPSP

SEQ ID NO: 613059 - protein, 9 aa, Homo Sapiens
GCKAARYCG

SEQ ID NO: 613060 - protein, 9 aa, Homo Sapiens
ILCKIPDEI

SEQ ID NO: 613061 - protein, 9 aa, Homo Sapiens
EFSHLPCPV

SEQ ID NO: 613062 - protein, 9 aa, Homo Sapiens
ILNGTYGDA

SEQ ID NO: 613063 - protein, 9 aa, Homo Sapiens
KLPDCEQFQ

SEQ ID NO: 613064 - protein, 9 aa, Homo Sapiens
LYHMQNTPG

SEQ ID NO: 613065 - protein, 9 aa, Homo Sapiens
RYAIDRKSD

SEQ ID NO: 613066 - protein, 9 aa, Homo Sapiens
FPERVGDKE

SEQ ID NO: 613067 - protein, 9 aa, Homo Sapiens
SRITEQKLG

SEQ ID NO: 613068 - protein, 9 aa, Homo Sapiens
CSLEKALEI

SEQ ID NO: 613069 - protein, 9 aa, Homo Sapiens
AYRLPGGGI

SEQ ID NO: 613070 - protein, 9 aa, Homo Sapiens
ELSVLSRVI

SEQ ID NO: 613071 - protein, 9 aa, Homo Sapiens
VSNAGDTYL

SEQ ID NO: 613072 - protein, 9 aa, Homo Sapiens
ASWRSPSGA

SEQ ID NO: 613073 - protein, 9 aa, Homo Sapiens
RDPLSEITK

SEQ ID NO: 613074 - protein, 9 aa, Homo Sapiens
DSKVLQYYF

SEQ ID NO: 613075 - protein, 9 aa, Homo Sapiens
RKNDESYEE

SEQ ID NO: 613076 - protein, 9 aa, Homo Sapiens
SNAAAYLQY

SEQ ID NO: 613077 - protein, 9 aa, Homo Sapiens
PSLLFFNPI

SEQ ID NO: 613078 - protein, 9 aa, Homo Sapiens
LEKYNQHIS

SEQ ID NO: 613079 - protein, 9 aa, Homo Sapiens
GSGCEERGA

SEQ ID NO: 613080 - protein, 9 aa, Homo Sapiens
SLREVSNDT

SEQ ID NO: 613081 - protein, 9 aa, Homo Sapiens
DKKVRERLR

SEQ ID NO: 613082 - protein, 9 aa, Homo Sapiens
DDLEEDSCD

SEQ ID NO: 613083 - protein, 9 aa, Homo Sapiens
DASELSFPL

SEQ ID NO: 613084 - protein, 9 aa, Homo Sapiens
CMQGRTTYV

SEQ ID NO: 613085 - protein, 9 aa, Homo Sapiens
EKWDEPWCN

SEQ ID NO: 613086 - protein, 9 aa, Homo Sapiens
WESFGYNIT

SEQ ID NO: 613087 - protein, 9 aa, Homo Sapiens
WVEEGVAGF

SEQ ID NO: 613088 - protein, 9 aa, Homo Sapiens
FFNAGSQGL

SEQ ID NO: 613089 - protein, 9 aa, Homo Sapiens
VFKTRKEQY

SEQ ID NO: 613090 - protein, 9 aa, Homo Sapiens
QPPLPQPQP

SEQ ID NO: 613091 - protein, 9 aa, Homo Sapiens
AVPPQAFPP

SEQ ID NO: 613092 - protein, 9 aa, Homo Sapiens
ETESKCDSK

SEQ ID NO: 613093 - protein, 9 aa, Homo Sapiens
WKERPGDRP

SEQ ID NO: 613094 - protein, 9 aa, Homo Sapiens
VPKTYELMP

SEQ ID NO: 613095 - protein, 9 aa, Homo Sapiens
YGGCGYGSC

SEQ ID NO: 613096 - protein, 9 aa, Homo Sapiens
LGSLSLSHS

SEQ ID NO: 613097 - protein, 9 aa, Homo Sapiens
KLLVLGLCK

SEQ ID NO: 613098 - protein, 9 aa, Homo Sapiens
VNWQHPRKS

SEQ ID NO: 613099 - protein, 9 aa, Homo Sapiens
NLKVAKNES

SEQ ID NO: 613100 - protein, 9 aa, Homo Sapiens
CATEERLFR

SEQ ID NO: 613101 - protein, 9 aa, Homo Sapiens
CALDNDKYI

SEQ ID NO: 613102 - protein, 9 aa, Homo Sapiens
LCRLLQITT

SEQ ID NO: 613103 - protein, 9 aa, Homo Sapiens
IYPGANPTF

SEQ ID NO: 613104 - protein, 9 aa, Homo Sapiens
RPRPERRGR

SEQ ID NO: 613105 - protein, 9 aa, Homo Sapiens
KSRMMLVNW

SEQ ID NO: 613106 - protein, 9 aa, Homo Sapiens
HEVRITTLR

SEQ ID NO: 613107 - protein, 9 aa, Homo Sapiens
EVFLKPWIF

SEQ ID NO: 613108 - protein, 9 aa, Homo Sapiens
SVINHFYSA

SEQ ID NO: 613109 - protein, 9 aa, Homo Sapiens
GRPGEPWLP

SEQ ID NO: 613110 - protein, 9 aa, Homo Sapiens
EMASTARGL

SEQ ID NO: 613111 - protein, 9 aa, Homo Sapiens
HRHAASAPG

SEQ ID NO: 613112 - protein, 9 aa, Homo Sapiens
WALSLLGPV

SEQ ID NO: 613113 - protein, 9 aa, Homo Sapiens
VELDVSYEE

SEQ ID NO: 613114 - protein, 9 aa, Homo Sapiens
ARYSLICHE

SEQ ID NO: 613115 - protein, 9 aa, Homo Sapiens
VRLGPRTST

SEQ ID NO: 613116 - protein, 9 aa, Homo Sapiens
CKMASKLIL

SEQ ID NO: 613117 - protein, 9 aa, Homo Sapiens
LLTEYCIDT

SEQ ID NO: 613118 - protein, 9 aa, Homo Sapiens
LLVTASVNL

SEQ ID NO: 613119 - protein, 9 aa, Homo Sapiens
TINTAVVYM

SEQ ID NO: 613120 - protein, 9 aa, Homo Sapiens
RLADGSRLL

SEQ ID NO: 613121 - protein, 9 aa, Homo Sapiens
NDKQKRTAL

SEQ ID NO: 613122 - protein, 9 aa, Homo Sapiens
LYHTYYECP

SEQ ID NO: 613123 - protein, 9 aa, Homo Sapiens
LRDLYPVED

SEQ ID NO: 613124 - protein, 9 aa, Homo Sapiens
RPAATRQAL

SEQ ID NO: 613125 - protein, 9 aa, Homo Sapiens
QTATSGRDA

SEQ ID NO: 613126 - protein, 9 aa, Homo Sapiens
DFSLGSLTG

SEQ ID NO: 613127 - protein, 9 aa, Homo Sapiens
ESIQELTVS

SEQ ID NO: 613128 - protein, 9 aa, Homo Sapiens
RRLGAAALV

SEQ ID NO: 613129 - protein, 9 aa, Homo Sapiens
NQETSSAHT

SEQ ID NO: 613130 - protein, 9 aa, Homo Sapiens
AHYAASATP

SEQ ID NO: 613131 - protein, 9 aa, Homo Sapiens
GEFIVRMAF

SEQ ID NO: 613132 - protein, 9 aa, Homo Sapiens
FPVLIVHVD

SEQ ID NO: 613133 - protein, 9 aa, Homo Sapiens
RGLGPSAVP

SEQ ID NO: 613134 - protein, 9 aa, Homo Sapiens
STFGSLEVM

SEQ ID NO: 613135 - protein, 9 aa, Homo Sapiens
LPLSAKGSN

SEQ ID NO: 613136 - protein, 9 aa, Homo Sapiens
SSLSNKYRQ

SEQ ID NO: 613137 - protein, 9 aa, Homo Sapiens
ISHDPGTPL

SEQ ID NO: 613138 - protein, 9 aa, Homo Sapiens
TIFGASVER

SEQ ID NO: 613139 - protein, 9 aa, Homo Sapiens
NHPDTRIRA

SEQ ID NO: 613140 - protein, 9 aa, Homo Sapiens
SLQVRRQFK

SEQ ID NO: 613141 - protein, 9 aa, Homo Sapiens
RRMLGTKHS

SEQ ID NO: 613142 - protein, 9 aa, Homo Sapiens
VGFAEAAHL

SEQ ID NO: 613143 - protein, 9 aa, Homo Sapiens
KCDSKGEED

SEQ ID NO: 613144 - protein, 9 aa, Homo Sapiens
KTYRIHRIF

SEQ ID NO: 613145 - protein, 9 aa, Homo Sapiens
PDELLNKIY

SEQ ID NO: 613146 - protein, 9 aa, Homo Sapiens
AQVDGARAL

SEQ ID NO: 613147 - protein, 9 aa, Homo Sapiens
VLFIVFRKN

SEQ ID NO: 613148 - protein, 9 aa, Homo Sapiens
DKGNFSFPI

SEQ ID NO: 613149 - protein, 9 aa, Homo Sapiens
VMAQDYPEV

SEQ ID NO: 613150 - protein, 9 aa, Homo Sapiens
IPKRASVVH

SEQ ID NO: 613151 - protein, 9 aa, Homo Sapiens
YASVKALVC

SEQ ID NO: 613152 - protein, 9 aa, Homo Sapiens
LKQKLLRHF

SEQ ID NO: 613153 - protein, 9 aa, Homo Sapiens
NKYKPWLVH

SEQ ID NO: 613154 - protein, 9 aa, Homo Sapiens
RGEATKPSP

SEQ ID NO: 613155 - protein, 9 aa, Homo Sapiens
TAVVYMHRF

SEQ ID NO: 613156 - protein, 9 aa, Homo Sapiens
KQKLLRHFL

SEQ ID NO: 613157 - protein, 9 aa, Homo Sapiens
SPSPLSRTP

SEQ ID NO: 613158 - protein, 9 aa, Homo Sapiens
ARASWRSPS

SEQ ID NO: 613159 - protein, 9 aa, Homo Sapiens
LSNKYRQDA

SEQ ID NO: 613160 - protein, 9 aa, Homo Sapiens
FQLQRLLST

SEQ ID NO: 613161 - protein, 9 aa, Homo Sapiens
LDHIQALRW

SEQ ID NO: 613162 - protein, 9 aa, Homo Sapiens
RAYLGGENL

SEQ ID NO: 613163 - protein, 9 aa, Homo Sapiens
YQRPLLVTR

SEQ ID NO: 613164 - protein, 9 aa, Homo Sapiens
VLSKGQPLC

SEQ ID NO: 613165 - protein, 9 aa, Homo Sapiens
CFVRFRNYC

SEQ ID NO: 613166 - protein, 9 aa, Homo Sapiens
CGIKFMETS

SEQ ID NO: 613167 - protein, 9 aa, Homo Sapiens
CQACGKSFK

SEQ ID NO: 613168 - protein, 9 aa, Homo Sapiens
CIQMTAGSY

SEQ ID NO: 613169 - protein, 9 aa, Homo Sapiens
ESSMRKSAK

SEQ ID NO: 613170 - protein, 9 aa, Homo Sapiens
GRGDPCELC

SEQ ID NO: 613171 - protein, 9 aa, Homo Sapiens
RIEREELCA

SEQ ID NO: 613172 - protein, 9 aa, Homo Sapiens
GRDFTDPLY

SEQ ID NO: 613173 - protein, 9 aa, Homo Sapiens
GLLEIVCFC

SEQ ID NO: 613174 - protein, 9 aa, Homo Sapiens
VFGESHLTK

SEQ ID NO: 613175 - protein, 9 aa, Homo Sapiens
LFISANALG

SEQ ID NO: 613176 - protein, 9 aa, Homo Sapiens
HTVDTWPPR

SEQ ID NO: 613177 - protein, 9 aa, Homo Sapiens
FFQDQNYTN

SEQ ID NO: 613178 - protein, 9 aa, Homo Sapiens
RDPQWAAAG

SEQ ID NO: 613179 - protein, 9 aa, Homo Sapiens
LLSTMSKYY

SEQ ID NO: 613180 - protein, 9 aa, Homo Sapiens
INNLCNFAS

SEQ ID NO: 613181 - protein, 9 aa, Homo Sapiens
ASQISGPYL

SEQ ID NO: 613182 - protein, 9 aa, Homo Sapiens
ADPAVATTP

SEQ ID NO: 613183 - protein, 9 aa, Homo Sapiens
CFELKEDTI

SEQ ID NO: 613184 - protein, 9 aa, Homo Sapiens
HGPNFPGPT

SEQ ID NO: 613185 - protein, 9 aa, Homo Sapiens
MDEAAMPRG

SEQ ID NO: 613186 - protein, 9 aa, Homo Sapiens
LAKLCYDLD

SEQ ID NO: 613187 - protein, 9 aa, Homo Sapiens
IFLELGSDE

SEQ ID NO: 613188 - protein, 9 aa, Homo Sapiens
LGVPIVQFP

SEQ ID NO: 613189 - protein, 9 aa, Homo Sapiens
FQLGDACLD

SEQ ID NO: 613190 - protein, 9 aa, Homo Sapiens
VLYSWTTRE

SEQ ID NO: 613191 - protein, 9 aa, Homo Sapiens
GILLSREGL

SEQ ID NO: 613192 - protein, 9 aa, Homo Sapiens
AFHQSSTPN

SEQ ID NO: 613193 - protein, 9 aa, Homo Sapiens
NIKSIRSIR

SEQ ID NO: 613194 - protein, 9 aa, Homo Sapiens
PMDGQHLCF

SEQ ID NO: 613195 - protein, 9 aa, Homo Sapiens
MVSVFYTIR

SEQ ID NO: 613196 - protein, 9 aa, Homo Sapiens
PNAFSAYFN

SEQ ID NO: 613197 - protein, 9 aa, Homo Sapiens
ILGSVGGFR

SEQ ID NO: 613198 - protein, 9 aa, Homo Sapiens
RFVALKKQR

SEQ ID NO: 613199 - protein, 9 aa, Homo Sapiens
TTLVVTTPA

SEQ ID NO: 613200 - protein, 9 aa, Homo Sapiens
ASFVSHYIF

SEQ ID NO: 613201 - protein, 9 aa, Homo Sapiens
IFHQVMYAM

SEQ ID NO: 613202 - protein, 9 aa, Homo Sapiens
RMQDLEQKM

SEQ ID NO: 613203 - protein, 9 aa, Homo Sapiens
KTYVLVTED

SEQ ID NO: 613204 - protein, 9 aa, Homo Sapiens
GNECANFTT

SEQ ID NO: 613205 - protein, 9 aa, Homo Sapiens
MQVHCQQSP

SEQ ID NO: 613206 - protein, 9 aa, Homo Sapiens
FLDKHHMKH

SEQ ID NO: 613207 - protein, 9 aa, Homo Sapiens
GVDIPLHLP

SEQ ID NO: 613208 - protein, 9 aa, Homo Sapiens
ATTLVVTTP

SEQ ID NO: 613209 - protein, 9 aa, Homo Sapiens
RRKIRRGPR

SEQ ID NO: 613210 - protein, 9 aa, Homo Sapiens
KGNPFTKLE

SEQ ID NO: 613211 - protein, 9 aa, Homo Sapiens
EESPASPLR

SEQ ID NO: 613212 - protein, 9 aa, Homo Sapiens
PAPPGGGSG

SEQ ID NO: 613213 - protein, 9 aa, Homo Sapiens
NNWQWIDKK

SEQ ID NO: 613214 - protein, 9 aa, Homo Sapiens
VDSGCQGDG

SEQ ID NO: 613215 - protein, 9 aa, Homo Sapiens
DSTHCSLEK

SEQ ID NO: 613216 - protein, 9 aa, Homo Sapiens
IHVTKLAEP

SEQ ID NO: 613217 - protein, 9 aa, Homo Sapiens
SRTLTTTAS

SEQ ID NO: 613218 - protein, 9 aa, Homo Sapiens
WPYICEATV

SEQ ID NO: 613219 - protein, 9 aa, Homo Sapiens
RAIEMASTA

SEQ ID NO: 613220 - protein, 9 aa, Homo Sapiens
ESCERPWEG

SEQ ID NO: 613221 - protein, 9 aa, Homo Sapiens
EPIGEKKRP

SEQ ID NO: 613222 - protein, 9 aa, Homo Sapiens
PGAWRFPGL

SEQ ID NO: 613223 - protein, 9 aa, Homo Sapiens
ENTERLIKI

SEQ ID NO: 613224 - protein, 9 aa, Homo Sapiens
SAVPPQAFP

SEQ ID NO: 613225 - protein, 9 aa, Homo Sapiens
LSFGHQQLQ

SEQ ID NO: 613226 - protein, 9 aa, Homo Sapiens
GWSKHSKVL

SEQ ID NO: 613227 - protein, 9 aa, Homo Sapiens
TGLTFVKKR

SEQ ID NO: 613228 - protein, 9 aa, Homo Sapiens
ACQNMCVCL

SEQ ID NO: 613229 - protein, 9 aa, Homo Sapiens
CSGCKAARY

SEQ ID NO: 613230 - protein, 9 aa, Homo Sapiens
RCRAAAAGA

SEQ ID NO: 613231 - protein, 9 aa, Homo Sapiens
EQERDWSQQ

SEQ ID NO: 613232 - protein, 9 aa, Homo Sapiens
VKASVHFVE

SEQ ID NO: 613233 - protein, 9 aa, Homo Sapiens
YDEVSYTCS

SEQ ID NO: 613234 - protein, 9 aa, Homo Sapiens
NYRSFLGIN

SEQ ID NO: 613235 - protein, 9 aa, Homo Sapiens
DTDEKEEDE

SEQ ID NO: 613236 - protein, 9 aa, Homo Sapiens
VAGVLLQHI

SEQ ID NO: 613237 - protein, 9 aa, Homo Sapiens
YVPEYQLEN

SEQ ID NO: 613238 - protein, 9 aa, Homo Sapiens
TLIFLIFLI

SEQ ID NO: 613239 - protein, 9 aa, Homo Sapiens
WVHCAEPTY

SEQ ID NO: 613240 - protein, 9 aa, Homo Sapiens
GQKREVGAA

SEQ ID NO: 613241 - protein, 9 aa, Homo Sapiens
STNNMADNK

SEQ ID NO: 613242 - protein, 9 aa, Homo Sapiens
DLLSQSQSR

SEQ ID NO: 613243 - protein, 9 aa, Homo Sapiens
MFNMYVGVR

SEQ ID NO: 613244 - protein, 9 aa, Homo Sapiens
SMNTMVPVA

SEQ ID NO: 613245 - protein, 9 aa, Homo Sapiens
RCFPSISLV

SEQ ID NO: 613246 - protein, 9 aa, Homo Sapiens
HCWKERPGD

SEQ ID NO: 613247 - protein, 9 aa, Homo Sapiens
GLFLGAVES

SEQ ID NO: 613248 - protein, 9 aa, Homo Sapiens
PTTPTAAPT

SEQ ID NO: 613249 - protein, 9 aa, Homo Sapiens
WYFSQSPHV

SEQ ID NO: 613250 - protein, 9 aa, Homo Sapiens
YQLENQKPL

SEQ ID NO: 613251 - protein, 9 aa, Homo Sapiens
DTKLKPYIL

SEQ ID NO: 613252 - protein, 9 aa, Homo Sapiens
LRDSTHCSL

SEQ ID NO: 613253 - protein, 9 aa, Homo Sapiens
TSVAPLLNT

SEQ ID NO: 613254 - protein, 9 aa, Homo Sapiens
GEQMAAFHQ

SEQ ID NO: 613255 - protein, 9 aa, Homo Sapiens
YLHLYMPAG

SEQ ID NO: 613256 - protein, 9 aa, Homo Sapiens
GLGPSAVPP

SEQ ID NO: 613257 - protein, 9 aa, Homo Sapiens
LEKLRRELE

SEQ ID NO: 613258 - protein, 9 aa, Homo Sapiens
CKLEQLFLE

SEQ ID NO: 613259 - protein, 9 aa, Homo Sapiens
TYGDANIKS

SEQ ID NO: 613260 - protein, 9 aa, Homo Sapiens
LWAKFTNFD

SEQ ID NO: 613261 - protein, 9 aa, Homo Sapiens
QRQLAEGTE

SEQ ID NO: 613262 - protein, 9 aa, Homo Sapiens
AKRKQKNST

SEQ ID NO: 613263 - protein, 9 aa, Homo Sapiens
SPDFNRRGA

SEQ ID NO: 613264 - protein, 9 aa, Homo Sapiens
LALLVTMPA

SEQ ID NO: 613265 - protein, 9 aa, Homo Sapiens
KLPLGKERN

SEQ ID NO: 613266 - protein, 9 aa, Homo Sapiens
HIFRAHLWQ

SEQ ID NO: 613267 - protein, 9 aa, Homo Sapiens
KKYIGPCAG

SEQ ID NO: 613268 - protein, 9 aa, Homo Sapiens
ISALVSIIK

SEQ ID NO: 613269 - protein, 9 aa, Homo Sapiens
CQNMCVCLK

SEQ ID NO: 613270 - protein, 9 aa, Homo Sapiens
EYQLENQKP

SEQ ID NO: 613271 - protein, 9 aa, Homo Sapiens
KEELKEERI

SEQ ID NO: 613272 - protein, 9 aa, Homo Sapiens
GKAKIVVPV

SEQ ID NO: 613273 - protein, 9 aa, Homo Sapiens
PGLLGQALP

SEQ ID NO: 613274 - protein, 9 aa, Homo Sapiens
RSPLSPELN

SEQ ID NO: 613275 - protein, 9 aa, Homo Sapiens
EGVKLPLGK

SEQ ID NO: 613276 - protein, 9 aa, Homo Sapiens
RTTYVLPFS

SEQ ID NO: 613277 - protein, 9 aa, Homo Sapiens
RAVWLISHD

SEQ ID NO: 613278 - protein, 9 aa, Homo Sapiens
EAIGKVSDD

SEQ ID NO: 613279 - protein, 9 aa, Homo Sapiens
WRVTAVPVA

SEQ ID NO: 613280 - protein, 9 aa, Homo Sapiens
TAWSTPTTN

SEQ ID NO: 613281 - protein, 9 aa, Homo Sapiens
LLGVKESDW

SEQ ID NO: 613282 - protein, 9 aa, Homo Sapiens
LKSRKNDES

SEQ ID NO: 613283 - protein, 9 aa, Homo Sapiens
CERARLATA

SEQ ID NO: 613284 - protein, 9 aa, Homo Sapiens
RQLAEGTEQ

SEQ ID NO: 613285 - protein, 9 aa, Homo Sapiens
TAPDFQETR

SEQ ID NO: 613286 - protein, 9 aa, Homo Sapiens
APKNDLKIK

SEQ ID NO: 613287 - protein, 9 aa, Homo Sapiens
GLVGFSRSL

SEQ ID NO: 613288 - protein, 9 aa, Homo Sapiens
ETGLRKSSG

SEQ ID NO: 613289 - protein, 9 aa, Homo Sapiens
QHIASVWEA

SEQ ID NO: 613290 - protein, 9 aa, Homo Sapiens
NKAVQEIQA

SEQ ID NO: 613291 - protein, 9 aa, Homo Sapiens
VQHCQSLVF

SEQ ID NO: 613292 - protein, 9 aa, Homo Sapiens
DQLEKLRRE

SEQ ID NO: 613293 - protein, 9 aa, Homo Sapiens
LEQKLGEKM

SEQ ID NO: 613294 - protein, 9 aa, Homo Sapiens
YTCVAENIV

SEQ ID NO: 613295 - protein, 9 aa, Homo Sapiens
HTLRMIGQN

SEQ ID NO: 613296 - protein, 9 aa, Homo Sapiens
GSGGGSNHH

SEQ ID NO: 613297 - protein, 9 aa, Homo Sapiens
CSFQLGDAC

SEQ ID NO: 613298 - protein, 9 aa, Homo Sapiens
TKVPKMLQI

SEQ ID NO: 613299 - protein, 9 aa, Homo Sapiens
FGHQQLQNR

SEQ ID NO: 613300 - protein, 9 aa, Homo Sapiens
HNQRIFVEE

SEQ ID NO: 613301 - protein, 9 aa, Homo Sapiens
DNLLPGRAK

SEQ ID NO: 613302 - protein, 9 aa, Homo Sapiens
SSEMKAGRP

SEQ ID NO: 613303 - protein, 9 aa, Homo Sapiens
PGLLDSHGR

SEQ ID NO: 613304 - protein, 9 aa, Homo Sapiens
QSDKMTAKL

SEQ ID NO: 613305 - protein, 9 aa, Homo Sapiens
QGEHFREVI

SEQ ID NO: 613306 - protein, 9 aa, Homo Sapiens
SGGSGGGSN

SEQ ID NO: 613307 - protein, 9 aa, Homo Sapiens
QQVPYKCPD

SEQ ID NO: 613308 - protein, 9 aa, Homo Sapiens
TTTASPTTS

SEQ ID NO: 613309 - protein, 9 aa, Homo Sapiens
IIVYYYRMH

SEQ ID NO: 613310 - protein, 9 aa, Homo Sapiens
GSPVSFPIF

SEQ ID NO: 613311 - protein, 9 aa, Homo Sapiens
EVSYTCSVQ

SEQ ID NO: 613312 - protein, 9 aa, Homo Sapiens
DPPEEEVPF

SEQ ID NO: 613313 - protein, 9 aa, Homo Sapiens
QQQQQQVSA

SEQ ID NO: 613314 - protein, 9 aa, Homo Sapiens
NDESYEELL

SEQ ID NO: 613315 - protein, 9 aa, Homo Sapiens
EIFEHTLHL

SEQ ID NO: 613316 - protein, 9 aa, Homo Sapiens
NDDKMNCHI

SEQ ID NO: 613317 - protein, 9 aa, Homo Sapiens
RLSFQFPKA

SEQ ID NO: 613318 - protein, 9 aa, Homo Sapiens
ILVGKLAAL

SEQ ID NO: 613319 - protein, 9 aa, Homo Sapiens
QGQSSHYCQ

SEQ ID NO: 613320 - protein, 9 aa, Homo Sapiens
NLLGKELAN

SEQ ID NO: 613321 - protein, 9 aa, Homo Sapiens
CEPIGEKKR

SEQ ID NO: 613322 - protein, 9 aa, Homo Sapiens
PIVQFPYED

SEQ ID NO: 613323 - protein, 9 aa, Homo Sapiens
SHLPCPVEE

SEQ ID NO: 613324 - protein, 9 aa, Homo Sapiens
QSPLQEAIV

SEQ ID NO: 613325 - protein, 9 aa, Homo Sapiens
VRVEEGISL

SEQ ID NO: 613326 - protein, 9 aa, Homo Sapiens
RHAASAPGG

SEQ ID NO: 613327 - protein, 9 aa, Homo Sapiens
YTLTRLNQE

SEQ ID NO: 613328 - protein, 9 aa, Homo Sapiens
KPPEVASNP

SEQ ID NO: 613329 - protein, 9 aa, Homo Sapiens
VTKKKNLVF

SEQ ID NO: 613330 - protein, 9 aa, Homo Sapiens
KDLSTIETL

SEQ ID NO: 613331 - protein, 9 aa, Homo Sapiens
TNVYPWWGG

SEQ ID NO: 613332 - protein, 9 aa, Homo Sapiens
CSLGCYLPQ

SEQ ID NO: 613333 - protein, 9 aa, Homo Sapiens
VSCCWLALL

SEQ ID NO: 613334 - protein, 9 aa, Homo Sapiens
TILTPLLNH

SEQ ID NO: 613335 - protein, 9 aa, Homo Sapiens
TESHYLHLY

SEQ ID NO: 613336 - protein, 9 aa, Homo Sapiens
CAALLQTAG

SEQ ID NO: 613337 - protein, 9 aa, Homo Sapiens
AYSPNIYPG

SEQ ID NO: 613338 - protein, 9 aa, Homo Sapiens
NTSRYETSL

SEQ ID NO: 613339 - protein, 9 aa, Homo Sapiens
QDHKVKASV

SEQ ID NO: 613340 - protein, 9 aa, Homo Sapiens
TSFLLCARQ

SEQ ID NO: 613341 - protein, 9 aa, Homo Sapiens
PGLFGVWAQ

SEQ ID NO: 613342 - protein, 9 aa, Homo Sapiens
HINQSEKWN

SEQ ID NO: 613343 - protein, 9 aa, Homo Sapiens
FLFCNINNL

SEQ ID NO: 613344 - protein, 9 aa, Homo Sapiens
RDFTDPLYE

SEQ ID NO: 613345 - protein, 9 aa, Homo Sapiens
LGHRHAASA

SEQ ID NO: 613346 - protein, 9 aa, Homo Sapiens
FAYWEKLWR

SEQ ID NO: 613347 - protein, 9 aa, Homo Sapiens
SVHFVEPLS

SEQ ID NO: 613348 - protein, 9 aa, Homo Sapiens
EYVRKFLLT

SEQ ID NO: 613349 - protein, 9 aa, Homo Sapiens
EKPLNLAHT

SEQ ID NO: 613350 - protein, 9 aa, Homo Sapiens
SAYREIPDS

SEQ ID NO: 613351 - protein, 9 aa, Homo Sapiens
SLVNNWKNE

SEQ ID NO: 613352 - protein, 9 aa, Homo Sapiens
EIKEKIRTR

SEQ ID NO: 613353 - protein, 9 aa, Homo Sapiens
KTLTSFITS

SEQ ID NO: 613354 - protein, 9 aa, Homo Sapiens
KPYEKNVRF

SEQ ID NO: 613355 - protein, 9 aa, Homo Sapiens
VRNNIGKDL

SEQ ID NO: 613356 - protein, 9 aa, Homo Sapiens
KTSTRRSIS

SEQ ID NO: 613357 - protein, 9 aa, Homo Sapiens
STRTSASVS

SEQ ID NO: 613358 - protein, 9 aa, Homo Sapiens
IRARRHPDT

SEQ ID NO: 613359 - protein, 9 aa, Homo Sapiens
ANWDATPFV

SEQ ID NO: 613360 - protein, 9 aa, Homo Sapiens
TLPIGLCLT

SEQ ID NO: 613361 - protein, 9 aa, Homo Sapiens
VDPNMEIDA

SEQ ID NO: 613362 - protein, 9 aa, Homo Sapiens
DVEGLYASV

SEQ ID NO: 613363 - protein, 9 aa, Homo Sapiens
RRCRQRLSG

SEQ ID NO: 613364 - protein, 9 aa, Homo Sapiens
RFLNPLSIE

SEQ ID NO: 613365 - protein, 9 aa, Homo Sapiens
TNFDTPTSF

SEQ ID NO: 613366 - protein, 9 aa, Homo Sapiens
AEGRDGEAA

SEQ ID NO: 613367 - protein, 9 aa, Homo Sapiens
AAVRLGPRT

SEQ ID NO: 613368 - protein, 9 aa, Homo Sapiens
LFPHAAQQE

SEQ ID NO: 613369 - protein, 9 aa, Homo Sapiens
TTSTTPTTP

SEQ ID NO: 613370 - protein, 9 aa, Homo Sapiens
HSLPSSLKV

SEQ ID NO: 613371 - protein, 9 aa, Homo Sapiens
SSSTFAGLH

SEQ ID NO: 613372 - protein, 9 aa, Homo Sapiens
NSSGTQYLT

SEQ ID NO: 613373 - protein, 9 aa, Homo Sapiens
MRHTEDVAE

SEQ ID NO: 613374 - protein, 9 aa, Homo Sapiens
EEKWDEPWC

SEQ ID NO: 613375 - protein, 9 aa, Homo Sapiens
APLALLDRP

SEQ ID NO: 613376 - protein, 9 aa, Homo Sapiens
EVPKTYELM

SEQ ID NO: 613377 - protein, 9 aa, Homo Sapiens
TVQIQDIND

SEQ ID NO: 613378 - protein, 9 aa, Homo Sapiens
MPGAPETSP

SEQ ID NO: 613379 - protein, 9 aa, Homo Sapiens
TSAPWDRVL

SEQ ID NO: 613380 - protein, 9 aa, Homo Sapiens
GYGSCGYGG

SEQ ID NO: 613381 - protein, 9 aa, Homo Sapiens
YRAAAAKNR

SEQ ID NO: 613382 - protein, 9 aa, Homo Sapiens
KALDKKVRE

SEQ ID NO: 613383 - protein, 9 aa, Homo Sapiens
TEAVCAMEC

SEQ ID NO: 613384 - protein, 9 aa, Homo Sapiens
GGNQSWLPI

SEQ ID NO: 613385 - protein, 9 aa, Homo Sapiens
HKAFSTCYS

SEQ ID NO: 613386 - protein, 9 aa, Homo Sapiens
LHHIPPSAQ

SEQ ID NO: 613387 - protein, 9 aa, Homo Sapiens
CVVTQAHYT

SEQ ID NO: 613388 - protein, 9 aa, Homo Sapiens
PPRCISRPS

SEQ ID NO: 613389 - protein, 9 aa, Homo Sapiens
GRAVAGSVN

SEQ ID NO: 613390 - protein, 9 aa, Homo Sapiens
VKEEDKSND

SEQ ID NO: 613391 - protein, 9 aa, Homo Sapiens
VPQPLLEEQ

SEQ ID NO: 613392 - protein, 9 aa, Homo Sapiens
IETLKQLEN

SEQ ID NO: 613393 - protein, 9 aa, Homo Sapiens
SNCGVMRGC

SEQ ID NO: 613394 - protein, 9 aa, Homo Sapiens
AAAYLQYLC

SEQ ID NO: 613395 - protein, 9 aa, Homo Sapiens
NEAQVDGAR

SEQ ID NO: 613396 - protein, 9 aa, Homo Sapiens
GSLREVSND

SEQ ID NO: 613397 - protein, 9 aa, Homo Sapiens
FMELFSVPI

SEQ ID NO: 613398 - protein, 9 aa, Homo Sapiens
LCHPRCIEH

SEQ ID NO: 613399 - protein, 9 aa, Homo Sapiens
DPRALPSTL

SEQ ID NO: 613400 - protein, 9 aa, Homo Sapiens
SPSRPPSST

SEQ ID NO: 613401 - protein, 9 aa, Homo Sapiens
SSTNNMADN

SEQ ID NO: 613402 - protein, 9 aa, Homo Sapiens
SPEIQGHFA

SEQ ID NO: 613403 - protein, 9 aa, Homo Sapiens
GDGKTCGPS

SEQ ID NO: 613404 - protein, 9 aa, Homo Sapiens
SIDEYCKSN

SEQ ID NO: 613405 - protein, 9 aa, Homo Sapiens
LPRVVQAHR

SEQ ID NO: 613406 - protein, 9 aa, Homo Sapiens
PPEVASNPS

SEQ ID NO: 613407 - protein, 9 aa, Homo Sapiens
GKQTRSITI

SEQ ID NO: 613408 - protein, 9 aa, Homo Sapiens
SLFCTVITP

SEQ ID NO: 613409 - protein, 9 aa, Homo Sapiens
GILLGIIRE

SEQ ID NO: 613410 - protein, 9 aa, Homo Sapiens
LTGHFRNRV

SEQ ID NO: 613411 - protein, 9 aa, Homo Sapiens
QWALLMHGW

SEQ ID NO: 613412 - protein, 9 aa, Homo Sapiens
APAPAQLRW

SEQ ID NO: 613413 - protein, 9 aa, Homo Sapiens
CLVSTALCQ

SEQ ID NO: 613414 - protein, 9 aa, Homo Sapiens
IPKLQEQLS

SEQ ID NO: 613415 - protein, 9 aa, Homo Sapiens
STPPRDLYS

SEQ ID NO: 613416 - protein, 9 aa, Homo Sapiens
LCKIPDEIN

SEQ ID NO: 613417 - protein, 9 aa, Homo Sapiens
SWYAVPSQP

SEQ ID NO: 613418 - protein, 9 aa, Homo Sapiens
HCAALLQTA

SEQ ID NO: 613419 - protein, 9 aa, Homo Sapiens
GQSFQQMRQ

SEQ ID NO: 613420 - protein, 9 aa, Homo Sapiens
NEKLSRNEA

SEQ ID NO: 613421 - protein, 9 aa, Homo Sapiens
VSCGHGNAG

SEQ ID NO: 613422 - protein, 9 aa, Homo Sapiens
ESSSKSDYE

SEQ ID NO: 613423 - protein, 9 aa, Homo Sapiens
NWQHPRKSN

SEQ ID NO: 613424 - protein, 9 aa, Homo Sapiens
MAGTFALGS

SEQ ID NO: 613425 - protein, 9 aa, Homo Sapiens
TISLGSEAL

SEQ ID NO: 613426 - protein, 9 aa, Homo Sapiens
KMCESRHKI

SEQ ID NO: 613427 - protein, 9 aa, Homo Sapiens
NCHIHGPLV

SEQ ID NO: 613428 - protein, 9 aa, Homo Sapiens
YGITSPICL

SEQ ID NO: 613429 - protein, 9 aa, Homo Sapiens
SRLLQRFNS

SEQ ID NO: 613430 - protein, 9 aa, Homo Sapiens
SSDGYDDLS

SEQ ID NO: 613431 - protein, 9 aa, Homo Sapiens
CVLTLPRSV

SEQ ID NO: 613432 - protein, 9 aa, Homo Sapiens
VFQLQRLLS

SEQ ID NO: 613433 - protein, 9 aa, Homo Sapiens
EEDKSNDNS

SEQ ID NO: 613434 - protein, 9 aa, Homo Sapiens
SYEEMARRY

SEQ ID NO: 613435 - protein, 9 aa, Homo Sapiens
RPLPLNQRG

SEQ ID NO: 613436 - protein, 9 aa, Homo Sapiens
NDHCVPRSH

SEQ ID NO: 613437 - protein, 9 aa, Homo Sapiens
GMGSGSNTG

SEQ ID NO: 613438 - protein, 9 aa, Homo Sapiens
LLNKIYFKN

SEQ ID NO: 613439 - protein, 9 aa, Homo Sapiens
VNKALGLSS

SEQ ID NO: 613440 - protein, 9 aa, Homo Sapiens
GRRMQAPWR

SEQ ID NO: 613441 - protein, 9 aa, Homo Sapiens
CGPSPETYL

SEQ ID NO: 613442 - protein, 9 aa, Homo Sapiens
VPWDWQIDC

SEQ ID NO: 613443 - protein, 9 aa, Homo Sapiens
IMIIEDPAT

SEQ ID NO: 613444 - protein, 9 aa, Homo Sapiens
RWHKSRVLQ

SEQ ID NO: 613445 - protein, 9 aa, Homo Sapiens
AQREAEDAE

SEQ ID NO: 613446 - protein, 9 aa, Homo Sapiens
EGQVGGSPG

SEQ ID NO: 613447 - protein, 9 aa, Homo Sapiens
VKVLTLNQE

SEQ ID NO: 613448 - protein, 9 aa, Homo Sapiens
QTRSITILA

SEQ ID NO: 613449 - protein, 9 aa, Homo Sapiens
LTTTASPTT

SEQ ID NO: 613450 - protein, 9 aa, Homo Sapiens
TESGSQSHP

SEQ ID NO: 613451 - protein, 9 aa, Homo Sapiens
PPQQPQPPL

SEQ ID NO: 613452 - protein, 9 aa, Homo Sapiens
LEANLTSSV

SEQ ID NO: 613453 - protein, 9 aa, Homo Sapiens
GVAGFFEVF

SEQ ID NO: 613454 - protein, 9 aa, Homo Sapiens
GTFTVWPYI

SEQ ID NO: 613455 - protein, 9 aa, Homo Sapiens
WKVEFGPGV

SEQ ID NO: 613456 - protein, 9 aa, Homo Sapiens
SNKYKPWLV

SEQ ID NO: 613457 - protein, 9 aa, Homo Sapiens
CPAGVQVSL

SEQ ID NO: 613458 - protein, 9 aa, Homo Sapiens
CRRCRQRLS

SEQ ID NO: 613459 - protein, 9 aa, Homo Sapiens
GQCKDKGNF

SEQ ID NO: 613460 - protein, 9 aa, Homo Sapiens
GLLGQALPR

SEQ ID NO: 613461 - protein, 9 aa, Homo Sapiens
REKKDVEKS

SEQ ID NO: 613462 - protein, 9 aa, Homo Sapiens
DGDIYWGSG

SEQ ID NO: 613463 - protein, 9 aa, Homo Sapiens
FEDYCEGSE

SEQ ID NO: 613464 - protein, 9 aa, Homo Sapiens
FPIFLHSSL

SEQ ID NO: 613465 - protein, 9 aa, Homo Sapiens
HLTKQSSCS

SEQ ID NO: 613466 - protein, 9 aa, Homo Sapiens
QSAVQKHQQ

SEQ ID NO: 613467 - protein, 9 aa, Homo Sapiens
YQQEQARMG

SEQ ID NO: 613468 - protein, 9 aa, Homo Sapiens
KRSSTMGSW

SEQ ID NO: 613469 - protein, 9 aa, Homo Sapiens
CYDLDFEKL

SEQ ID NO: 613470 - protein, 9 aa, Homo Sapiens
SALASLNSY

SEQ ID NO: 613471 - protein, 9 aa, Homo Sapiens
AVAAAAASR

SEQ ID NO: 613472 - protein, 9 aa, Homo Sapiens
PPAVPGWVW

SEQ ID NO: 613473 - protein, 9 aa, Homo Sapiens
ETNLRLTCK

SEQ ID NO: 613474 - protein, 9 aa, Homo Sapiens
VSDDMRRHF

SEQ ID NO: 613475 - protein, 9 aa, Homo Sapiens
IPPSAQASA

SEQ ID NO: 613476 - protein, 9 aa, Homo Sapiens
PAEATVLLE

SEQ ID NO: 613477 - protein, 9 aa, Homo Sapiens
RCRRPLGPA

SEQ ID NO: 613478 - protein, 9 aa, Homo Sapiens
AGERPYKCI

SEQ ID NO: 613479 - protein, 9 aa, Homo Sapiens
GPGCPHPPA

SEQ ID NO: 613480 - protein, 9 aa, Homo Sapiens
PLPSLMDLM

SEQ ID NO: 613481 - protein, 9 aa, Homo Sapiens
LYYQDPDAT

SEQ ID NO: 613482 - protein, 9 aa, Homo Sapiens
AVVGKGECD

SEQ ID NO: 613483 - protein, 9 aa, Homo Sapiens
ALPSTLFLP

SEQ ID NO: 613484 - protein, 9 aa, Homo Sapiens
KSVHPQSEN

SEQ ID NO: 613485 - protein, 9 aa, Homo Sapiens
ECPGTCLGT

SEQ ID NO: 613486 - protein, 9 aa, Homo Sapiens
PNYEIIHMI

SEQ ID NO: 613487 - protein, 9 aa, Homo Sapiens
GTASLRFSR

SEQ ID NO: 613488 - protein, 9 aa, Homo Sapiens
TRPAATRQA

SEQ ID NO: 613489 - protein, 9 aa, Homo Sapiens
TSTSQDPMV

SEQ ID NO: 613490 - protein, 9 aa, Homo Sapiens
RKNTRNIKS

SEQ ID NO: 613491 - protein, 9 aa, Homo Sapiens
TKLGSPAQQ

SEQ ID NO: 613492 - protein, 9 aa, Homo Sapiens
MHGWFHFLQ

SEQ ID NO: 613493 - protein, 9 aa, Homo Sapiens
RNLKVAKNE

SEQ ID NO: 613494 - protein, 9 aa, Homo Sapiens
TNSSGTQYL

SEQ ID NO: 613495 - protein, 9 aa, Homo Sapiens
IEMASTARG

SEQ ID NO: 613496 - protein, 9 aa, Homo Sapiens
GVLTATTER

SEQ ID NO: 613497 - protein, 9 aa, Homo Sapiens
TLIGSFYGS

SEQ ID NO: 613498 - protein, 9 aa, Homo Sapiens
GKGECDNIP

SEQ ID NO: 613499 - protein, 9 aa, Homo Sapiens
PVRKPVVQI

SEQ ID NO: 613500 - protein, 9 aa, Homo Sapiens
HACLLPPIQ

SEQ ID NO: 613501 - protein, 9 aa, Homo Sapiens
RGKDTPLNA

SEQ ID NO: 613502 - protein, 9 aa, Homo Sapiens
THSSGQSFQ

SEQ ID NO: 613503 - protein, 9 aa, Homo Sapiens
LNYGLFQTA

SEQ ID NO: 613504 - protein, 9 aa, Homo Sapiens
SSAHTTGKG

SEQ ID NO: 613505 - protein, 9 aa, Homo Sapiens
TSQSGGNQS

SEQ ID NO: 613506 - protein, 9 aa, Homo Sapiens
SRVLQASGG

SEQ ID NO: 613507 - protein, 9 aa, Homo Sapiens
RVSIETRCL

SEQ ID NO: 613508 - protein, 9 aa, Homo Sapiens
RNGYFGVGE

SEQ ID NO: 613509 - protein, 9 aa, Homo Sapiens
QASGAGQGQ

SEQ ID NO: 613510 - protein, 9 aa, Homo Sapiens
LRMIGQNSG

SEQ ID NO: 613511 - protein, 9 aa, Homo Sapiens
QGSMLHVLP

SEQ ID NO: 613512 - protein, 9 aa, Homo Sapiens
AYDFLPVLM

SEQ ID NO: 613513 - protein, 9 aa, Homo Sapiens
NTTGTVFCP

SEQ ID NO: 613514 - protein, 9 aa, Homo Sapiens
NHTDEKGFT

SEQ ID NO: 613515 - protein, 9 aa, Homo Sapiens
QGTARVGVR

SEQ ID NO: 613516 - protein, 9 aa, Homo Sapiens
RQQNETRVS

SEQ ID NO: 613517 - protein, 9 aa, Homo Sapiens
DMETINVDR

SEQ ID NO: 613518 - protein, 9 aa, Homo Sapiens
PQWAAAGPP

SEQ ID NO: 613519 - protein, 9 aa, Homo Sapiens
LKQFILFHP

SEQ ID NO: 613520 - protein, 9 aa, Homo Sapiens
VELKSRKND

SEQ ID NO: 613521 - protein, 9 aa, Homo Sapiens
DNSTVRCFK

SEQ ID NO: 613522 - protein, 9 aa, Homo Sapiens
NECSLSPPT

SEQ ID NO: 613523 - protein, 9 aa, Homo Sapiens
FTKLEENAW

SEQ ID NO: 613524 - protein, 9 aa, Homo Sapiens
TTKLVYGNE

SEQ ID NO: 613525 - protein, 9 aa, Homo Sapiens
GKRGQRPSK

SEQ ID NO: 613526 - protein, 9 aa, Homo Sapiens
LSPELNNKC

SEQ ID NO: 613527 - protein, 9 aa, Homo Sapiens
RDDWQRLCT

SEQ ID NO: 613528 - protein, 9 aa, Homo Sapiens
CPGTCLGTC

SEQ ID NO: 613529 - protein, 9 aa, Homo Sapiens
MPGEGRGDP

SEQ ID NO: 613530 - protein, 9 aa, Homo Sapiens
STAWSTPTT

SEQ ID NO: 613531 - protein, 9 aa, Homo Sapiens
SLCGLALVA

SEQ ID NO: 613532 - protein, 9 aa, Homo Sapiens
AWAQGTARV

SEQ ID NO: 613533 - protein, 9 aa, Homo Sapiens
AAAAGAWSP

SEQ ID NO: 613534 - protein, 9 aa, Homo Sapiens
TVKSMNTMV

SEQ ID NO: 613535 - protein, 9 aa, Homo Sapiens
ASAPGGRLL

SEQ ID NO: 613536 - protein, 9 aa, Homo Sapiens
VCLLICSRV

SEQ ID NO: 613537 - protein, 9 aa, Homo Sapiens
KSARSIFQE

SEQ ID NO: 613538 - protein, 9 aa, Homo Sapiens
GLFQTATSG

SEQ ID NO: 613539 - protein, 9 aa, Homo Sapiens
ELKQHQFRE

SEQ ID NO: 613540 - protein, 9 aa, Homo Sapiens
CHCPFDKLS

SEQ ID NO: 613541 - protein, 9 aa, Homo Sapiens
PIEELHSRT

SEQ ID NO: 613542 - protein, 9 aa, Homo Sapiens
ESKCDSKGE

SEQ ID NO: 613543 - protein, 9 aa, Homo Sapiens
RYQEPCSVE

SEQ ID NO: 613544 - protein, 9 aa, Homo Sapiens
CVLLATMAY

SEQ ID NO: 613545 - protein, 9 aa, Homo Sapiens
KMLNDRGNT

SEQ ID NO: 613546 - protein, 9 aa, Homo Sapiens
LSRTPTSTP

SEQ ID NO: 613547 - protein, 9 aa, Homo Sapiens
MLTARYSLI

SEQ ID NO: 613548 - protein, 9 aa, Homo Sapiens
PPLGQMCQN

SEQ ID NO: 613549 - protein, 9 aa, Homo Sapiens
ADMHRQSPK

SEQ ID NO: 613550 - protein, 9 aa, Homo Sapiens
AQLRWHSGP

SEQ ID NO: 613551 - protein, 9 aa, Homo Sapiens
SSLDPLAFF

SEQ ID NO: 613552 - protein, 9 aa, Homo Sapiens
PSTSFLLCA

SEQ ID NO: 613553 - protein, 9 aa, Homo Sapiens
APPAKAGYD

SEQ ID NO: 613554 - protein, 9 aa, Homo Sapiens
YAVPSQPPA

SEQ ID NO: 613555 - protein, 9 aa, Homo Sapiens
RRSISCKKS

SEQ ID NO: 613556 - protein, 9 aa, Homo Sapiens
SEQSGVLLL

SEQ ID NO: 613557 - protein, 9 aa, Homo Sapiens
IRNMQALKW

SEQ ID NO: 613558 - protein, 9 aa, Homo Sapiens
VATSLSSPQ

SEQ ID NO: 613559 - protein, 9 aa, Homo Sapiens
AAAGRRMQA

SEQ ID NO: 613560 - protein, 9 aa, Homo Sapiens
QSRLEQKLG

SEQ ID NO: 613561 - protein, 9 aa, Homo Sapiens
LVQHCQSLV

SEQ ID NO: 613562 - protein, 9 aa, Homo Sapiens
SVNPMEEEY

SEQ ID NO: 613563 - protein, 9 aa, Homo Sapiens
ADVSLWNIV

SEQ ID NO: 613564 - protein, 9 aa, Homo Sapiens
FVGGAMVFF

SEQ ID NO: 613565 - protein, 9 aa, Homo Sapiens
GNYGLLDHI

SEQ ID NO: 613566 - protein, 9 aa, Homo Sapiens
LWRFLPGGL

SEQ ID NO: 613567 - protein, 9 aa, Homo Sapiens
CDSKGEEDE

SEQ ID NO: 613568 - protein, 9 aa, Homo Sapiens
LYPPCSTVV

SEQ ID NO: 613569 - protein, 9 aa, Homo Sapiens
YLDICHSLY

SEQ ID NO: 613570 - protein, 9 aa, Homo Sapiens
SWRTRPWRR

SEQ ID NO: 613571 - protein, 9 aa, Homo Sapiens
PCSRQSWRT

SEQ ID NO: 613572 - protein, 9 aa, Homo Sapiens
LLSVGAGVV

SEQ ID NO: 613573 - protein, 9 aa, Homo Sapiens
AAVHDSRAG

SEQ ID NO: 613574 - protein, 9 aa, Homo Sapiens
LKPYILDPV

SEQ ID NO: 613575 - protein, 9 aa, Homo Sapiens
GVCACQNMC

SEQ ID NO: 613576 - protein, 9 aa, Homo Sapiens
YKTCPTVQP

SEQ ID NO: 613577 - protein, 9 aa, Homo Sapiens
LCIQMTAGS

SEQ ID NO: 613578 - protein, 9 aa, Homo Sapiens
IQDDLQSSE

SEQ ID NO: 613579 - protein, 9 aa, Homo Sapiens
SPLQEAIVS

SEQ ID NO: 613580 - protein, 9 aa, Homo Sapiens
GVGEGPSRG

SEQ ID NO: 613581 - protein, 9 aa, Homo Sapiens
GGCERARLA

SEQ ID NO: 613582 - protein, 9 aa, Homo Sapiens
YHMQNTPGF

SEQ ID NO: 613583 - protein, 9 aa, Homo Sapiens
FFNPIRAVP

SEQ ID NO: 613584 - protein, 9 aa, Homo Sapiens
FFPLLWALS

SEQ ID NO: 613585 - protein, 9 aa, Homo Sapiens
TRQALPGVH

SEQ ID NO: 613586 - protein, 9 aa, Homo Sapiens
VRIQSALPA

SEQ ID NO: 613587 - protein, 9 aa, Homo Sapiens
WSTPTTNAW

SEQ ID NO: 613588 - protein, 9 aa, Homo Sapiens
NELLVTASV

SEQ ID NO: 613589 - protein, 9 aa, Homo Sapiens
DPRSGFDIK

SEQ ID NO: 613590 - protein, 9 aa, Homo Sapiens
PSRPPSSTN

SEQ ID NO: 613591 - protein, 9 aa, Homo Sapiens
SFELLLWNN

SEQ ID NO: 613592 - protein, 9 aa, Homo Sapiens
QRLQLCAVH

SEQ ID NO: 613593 - protein, 9 aa, Homo Sapiens
EPNGEAEGR

SEQ ID NO: 613594 - protein, 9 aa, Homo Sapiens
IRAVPLAFG

SEQ ID NO: 613595 - protein, 9 aa, Homo Sapiens
YQEPCSVER

SEQ ID NO: 613596 - protein, 9 aa, Homo Sapiens
LSRVIKRSS

SEQ ID NO: 613597 - protein, 9 aa, Homo Sapiens
ELMSTPVAS

SEQ ID NO: 613598 - protein, 9 aa, Homo Sapiens
GYFGVGEGP

SEQ ID NO: 613599 - protein, 9 aa, Homo Sapiens
SETTKCAYS

SEQ ID NO: 613600 - protein, 9 aa, Homo Sapiens
CRNHPDTRI

SEQ ID NO: 613601 - protein, 9 aa, Homo Sapiens
PMEEEYPRI

SEQ ID NO: 613602 - protein, 9 aa, Homo Sapiens
PIQVKRSRS

SEQ ID NO: 613603 - protein, 9 aa, Homo Sapiens
EKVKIEVLH

SEQ ID NO: 613604 - protein, 9 aa, Homo Sapiens
LMQRRVPWR

SEQ ID NO: 613605 - protein, 9 aa, Homo Sapiens
VLPTQSLAS

SEQ ID NO: 613606 - protein, 9 aa, Homo Sapiens
CLTIIPSAI

SEQ ID NO: 613607 - protein, 9 aa, Homo Sapiens
QLGPEDQDI

SEQ ID NO: 613608 - protein, 9 aa, Homo Sapiens
AEYFQERRM

SEQ ID NO: 613609 - protein, 9 aa, Homo Sapiens
WLLGVKESD

SEQ ID NO: 613610 - protein, 9 aa, Homo Sapiens
SHGDRPLLG

SEQ ID NO: 613611 - protein, 9 aa, Homo Sapiens
SQDHKVKAS

SEQ ID NO: 613612 - protein, 9 aa, Homo Sapiens
LSRNEAQVD

SEQ ID NO: 613613 - protein, 9 aa, Homo Sapiens
SSAFGPGCP

SEQ ID NO: 613614 - protein, 9 aa, Homo Sapiens
CSPEIQGHF

SEQ ID NO: 613615 - protein, 9 aa, Homo Sapiens
KSNKYKPWL

SEQ ID NO: 613616 - protein, 9 aa, Homo Sapiens
PWIQTPCTI

SEQ ID NO: 613617 - protein, 9 aa, Homo Sapiens
LQFPENNWI

SEQ ID NO: 613618 - protein, 9 aa, Homo Sapiens
SLPGAWRFP

SEQ ID NO: 613619 - protein, 9 aa, Homo Sapiens
GKLCSSLHP

SEQ ID NO: 613620 - protein, 9 aa, Homo Sapiens
LSLLTNFED

SEQ ID NO: 613621 - protein, 9 aa, Homo Sapiens
LSKGQPLCP

SEQ ID NO: 613622 - protein, 9 aa, Homo Sapiens
YVEVKIVEH

SEQ ID NO: 613623 - protein, 9 aa, Homo Sapiens
LTEYLESSR

SEQ ID NO: 613624 - protein, 9 aa, Homo Sapiens
PRSHSCSEG

SEQ ID NO: 613625 - protein, 9 aa, Homo Sapiens
TIRARRHPD

SEQ ID NO: 613626 - protein, 9 aa, Homo Sapiens
VKVFGESHL

SEQ ID NO: 613627 - protein, 9 aa, Homo Sapiens
PYGAYDFLP

SEQ ID NO: 613628 - protein, 9 aa, Homo Sapiens
KLALDCGIK

SEQ ID NO: 613629 - protein, 9 aa, Homo Sapiens
RPAETNLRL

SEQ ID NO: 613630 - protein, 9 aa, Homo Sapiens
LLSQSQSRL

SEQ ID NO: 613631 - protein, 9 aa, Homo Sapiens
FNMYVGVRA

SEQ ID NO: 613632 - protein, 9 aa, Homo Sapiens
KFSMTVPVK

SEQ ID NO: 613633 - protein, 9 aa, Homo Sapiens
SFLLCARQG

SEQ ID NO: 613634 - protein, 9 aa, Homo Sapiens
LHAVSPPLR

SEQ ID NO: 613635 - protein, 9 aa, Homo Sapiens
TTNAWSWRR

SEQ ID NO: 613636 - protein, 9 aa, Homo Sapiens
KWNWKKAKN

SEQ ID NO: 613637 - protein, 9 aa, Homo Sapiens
VFLEWIQPA

SEQ ID NO: 613638 - protein, 9 aa, Homo Sapiens
WRSPSGARA

SEQ ID NO: 613639 - protein, 9 aa, Homo Sapiens
AQHSHYAHY

SEQ ID NO: 613640 - protein, 9 aa, Homo Sapiens
LESAFLDLF

SEQ ID NO: 613641 - protein, 9 aa, Homo Sapiens
EASVESAKV

SEQ ID NO: 613642 - protein, 9 aa, Homo Sapiens
SGKLCSSLH

SEQ ID NO: 613643 - protein, 9 aa, Homo Sapiens
APETSPGDG

SEQ ID NO: 613644 - protein, 9 aa, Homo Sapiens
RRQEIRESH

SEQ ID NO: 613645 - protein, 9 aa, Homo Sapiens
SPICLASPK

SEQ ID NO: 613646 - protein, 9 aa, Homo Sapiens
FECIENKKS

SEQ ID NO: 613647 - protein, 9 aa, Homo Sapiens
EVLSSLLVG

SEQ ID NO: 613648 - protein, 9 aa, Homo Sapiens
MAAFHQSST

SEQ ID NO: 613649 - protein, 9 aa, Homo Sapiens
NESKLPPAS

SEQ ID NO: 613650 - protein, 9 aa, Homo Sapiens
VPISGQPMG

SEQ ID NO: 613651 - protein, 9 aa, Homo Sapiens
QALPRTLGP

SEQ ID NO: 613652 - protein, 9 aa, Homo Sapiens
GPSESPPTS

SEQ ID NO: 613653 - protein, 9 aa, Homo Sapiens
DLPQDSKVL

SEQ ID NO: 613654 - protein, 9 aa, Homo Sapiens
CVDENECSL

SEQ ID NO: 613655 - protein, 9 aa, Homo Sapiens
YLCYRNDKV

SEQ ID NO: 613656 - protein, 9 aa, Homo Sapiens
WKKAKNTNT

SEQ ID NO: 613657 - protein, 9 aa, Homo Sapiens
LMLNLFVDV

SEQ ID NO: 613658 - protein, 9 aa, Homo Sapiens
GRTGMQVSS

SEQ ID NO: 613659 - protein, 9 aa, Homo Sapiens
KNTRNIKSI

SEQ ID NO: 613660 - protein, 9 aa, Homo Sapiens
SFITAVTSQ

SEQ ID NO: 613661 - protein, 9 aa, Homo Sapiens
DAYDSPDFN

SEQ ID NO: 613662 - protein, 9 aa, Homo Sapiens
CTVKVSYCV

SEQ ID NO: 613663 - protein, 9 aa, Homo Sapiens
TMGSWRKSL

SEQ ID NO: 613664 - protein, 9 aa, Homo Sapiens
VPAQQKVRT

SEQ ID NO: 613665 - protein, 9 aa, Homo Sapiens
FACNLSRKT

SEQ ID NO: 613666 - protein, 9 aa, Homo Sapiens
LVTAERIER

SEQ ID NO: 613667 - protein, 9 aa, Homo Sapiens
PRNMEGATL

SEQ ID NO: 613668 - protein, 9 aa, Homo Sapiens
ESHYLHLYM

SEQ ID NO: 613669 - protein, 9 aa, Homo Sapiens
PSHGDRPLL

SEQ ID NO: 613670 - protein, 9 aa, Homo Sapiens
GEKMLKEES

SEQ ID NO: 613671 - protein, 9 aa, Homo Sapiens
ELLSRGLLY

SEQ ID NO: 613672 - protein, 9 aa, Homo Sapiens
FNRRGASVD

SEQ ID NO: 613673 - protein, 9 aa, Homo Sapiens
RKCGSGRGK

SEQ ID NO: 613674 - protein, 9 aa, Homo Sapiens
HHPHPHAFI

SEQ ID NO: 613675 - protein, 9 aa, Homo Sapiens
GSLSLSHSL

SEQ ID NO: 613676 - protein, 9 aa, Homo Sapiens
RDSLSTLIG

SEQ ID NO: 613677 - protein, 9 aa, Homo Sapiens
SAPAEATVL

SEQ ID NO: 613678 - protein, 9 aa, Homo Sapiens
PQDSKVLQY

SEQ ID NO: 613679 - protein, 9 aa, Homo Sapiens
HHKALDKKV

SEQ ID NO: 613680 - protein, 9 aa, Homo Sapiens
RDDLQCFHI

SEQ ID NO: 613681 - protein, 9 aa, Homo Sapiens
EAAVHDSRA

SEQ ID NO: 613682 - protein, 9 aa, Homo Sapiens
KALGLSSDD

SEQ ID NO: 613683 - protein, 9 aa, Homo Sapiens
PSLRGGRLR

SEQ ID NO: 613684 - protein, 9 aa, Homo Sapiens
AKGSNAIEE

SEQ ID NO: 613685 - protein, 9 aa, Homo Sapiens
LCTVKLPEN

SEQ ID NO: 613686 - protein, 9 aa, Homo Sapiens
GSRIAVPRN

SEQ ID NO: 613687 - protein, 9 aa, Homo Sapiens
YGEKGNPFT

SEQ ID NO: 613688 - protein, 9 aa, Homo Sapiens
KKEKLTSHQ

SEQ ID NO: 613689 - protein, 9 aa, Homo Sapiens
MQGRTTYVL

SEQ ID NO: 613690 - protein, 9 aa, Homo Sapiens
RPGDRPAFS

SEQ ID NO: 613691 - protein, 9 aa, Homo Sapiens
PAATRQALP

SEQ ID NO: 613692 - protein, 9 aa, Homo Sapiens
ENLSEAPCP

SEQ ID NO: 613693 - protein, 9 aa, Homo Sapiens
VFESSKTSS

SEQ ID NO: 613694 - protein, 9 aa, Homo Sapiens
NIMKPYIKI

SEQ ID NO: 613695 - protein, 9 aa, Homo Sapiens
KSRKNDESY

SEQ ID NO: 613696 - protein, 9 aa, Homo Sapiens
AAIKVFEKM

SEQ ID NO: 613697 - protein, 9 aa, Homo Sapiens
RRPTSGCGA

SEQ ID NO: 613698 - protein, 9 aa, Homo Sapiens
CSHTRISKL

SEQ ID NO: 613699 - protein, 9 aa, Homo Sapiens
TDLCDEFGN

SEQ ID NO: 613700 - protein, 9 aa, Homo Sapiens
QEEQGGLSG

SEQ ID NO: 613701 - protein, 9 aa, Homo Sapiens
KPSTSFLLC

SEQ ID NO: 613702 - protein, 9 aa, Homo Sapiens
QLQKKEKLR

SEQ ID NO: 613703 - protein, 9 aa, Homo Sapiens
NIIASRFYL

SEQ ID NO: 613704 - protein, 9 aa, Homo Sapiens
PHSHPHWHP

SEQ ID NO: 613705 - protein, 9 aa, Homo Sapiens
SNNRMKIQD

SEQ ID NO: 613706 - protein, 9 aa, Homo Sapiens
AKATTAPDF

SEQ ID NO: 613707 - protein, 9 aa, Homo Sapiens
RRQRYRAAA

SEQ ID NO: 613708 - protein, 9 aa, Homo Sapiens
LTARYSLIC

SEQ ID NO: 613709 - protein, 9 aa, Homo Sapiens
VSAMPSKFI

SEQ ID NO: 613710 - protein, 9 aa, Homo Sapiens
LPPRCISRP

SEQ ID NO: 613711 - protein, 9 aa, Homo Sapiens
CWKERPGDR

SEQ ID NO: 613712 - protein, 9 aa, Homo Sapiens
ESGVPLPSL

SEQ ID NO: 613713 - protein, 9 aa, Homo Sapiens
CESRHKIQA

SEQ ID NO: 613714 - protein, 9 aa, Homo Sapiens
KRASVVHSL

SEQ ID NO: 613715 - protein, 9 aa, Homo Sapiens
EILKQSDKM

SEQ ID NO: 613716 - protein, 9 aa, Homo Sapiens
RQRAFSPST

SEQ ID NO: 613717 - protein, 9 aa, Homo Sapiens
AAPLALLDR

SEQ ID NO: 613718 - protein, 9 aa, Homo Sapiens
CLLICSRVT

SEQ ID NO: 613719 - protein, 9 aa, Homo Sapiens
PELPVRGVS

SEQ ID NO: 613720 - protein, 9 aa, Homo Sapiens
LGSSEQHEV

SEQ ID NO: 613721 - protein, 9 aa, Homo Sapiens
HPHPHAFIR

SEQ ID NO: 613722 - protein, 9 aa, Homo Sapiens
LTGRDTACV

SEQ ID NO: 613723 - protein, 9 aa, Homo Sapiens
KSVDFLYAY

SEQ ID NO: 613724 - protein, 9 aa, Homo Sapiens
QMNLEIASF

SEQ ID NO: 613725 - protein, 9 aa, Homo Sapiens
FSRSLAKEV

SEQ ID NO: 613726 - protein, 9 aa, Homo Sapiens
RKRKNTRNI

SEQ ID NO: 613727 - protein, 9 aa, Homo Sapiens
VSEMVLLSV

SEQ ID NO: 613728 - protein, 9 aa, Homo Sapiens
EPRDTEAVC

SEQ ID NO: 613729 - protein, 9 aa, Homo Sapiens
QPIDYGWMY

SEQ ID NO: 613730 - protein, 9 aa, Homo Sapiens
ASGSTAGGM

SEQ ID NO: 613731 - protein, 9 aa, Homo Sapiens
HAVSPPLRN

SEQ ID NO: 613732 - protein, 9 aa, Homo Sapiens
DSSLGLARK

SEQ ID NO: 613733 - protein, 9 aa, Homo Sapiens
SEQKRIKHC

SEQ ID NO: 613734 - protein, 9 aa, Homo Sapiens
STHCSLEKA

SEQ ID NO: 613735 - protein, 9 aa, Homo Sapiens
QAQHSHYAH

SEQ ID NO: 613736 - protein, 9 aa, Homo Sapiens
RQSWRTRPW

SEQ ID NO: 613737 - protein, 9 aa, Homo Sapiens
PYSNYPDSD

SEQ ID NO: 613738 - protein, 9 aa, Homo Sapiens
FDHIEVRDV

SEQ ID NO: 613739 - protein, 9 aa, Homo Sapiens
SRIAVPRNP

SEQ ID NO: 613740 - protein, 9 aa, Homo Sapiens
SDGKQTRSI

SEQ ID NO: 613741 - protein, 9 aa, Homo Sapiens
MKGGSNCLE

SEQ ID NO: 613742 - protein, 9 aa, Homo Sapiens
SFGYNITRC

SEQ ID NO: 613743 - protein, 9 aa, Homo Sapiens
DEYCKSNNG

SEQ ID NO: 613744 - protein, 9 aa, Homo Sapiens
LPQDSKVLQ

SEQ ID NO: 613745 - protein, 9 aa, Homo Sapiens
SLEGRSTTS

SEQ ID NO: 613746 - protein, 9 aa, Homo Sapiens
GLALVALVL

SEQ ID NO: 613747 - protein, 9 aa, Homo Sapiens
LSVPQVLPT

SEQ ID NO: 613748 - protein, 9 aa, Homo Sapiens
ATTAPDFQE

SEQ ID NO: 613749 - protein, 9 aa, Homo Sapiens
VNLFDIAEV

SEQ ID NO: 613750 - protein, 9 aa, Homo Sapiens
SDDMSENLL

SEQ ID NO: 613751 - protein, 9 aa, Homo Sapiens
SLGNYGLSC

SEQ ID NO: 613752 - protein, 9 aa, Homo Sapiens
TPGRLLYHM

SEQ ID NO: 613753 - protein, 9 aa, Homo Sapiens
ELPTSSGRA

SEQ ID NO: 613754 - protein, 9 aa, Homo Sapiens
CDEPRDTEA

SEQ ID NO: 613755 - protein, 9 aa, Homo Sapiens
IQGHFASSA

SEQ ID NO: 613756 - protein, 9 aa, Homo Sapiens
VASNPSGAP

SEQ ID NO: 613757 - protein, 9 aa, Homo Sapiens
GMQVSSVRC

SEQ ID NO: 613758 - protein, 9 aa, Homo Sapiens
LFSVPITMG

SEQ ID NO: 613759 - protein, 9 aa, Homo Sapiens
NSYLEMDME

SEQ ID NO: 613760 - protein, 9 aa, Homo Sapiens
RSHGDHSRG

SEQ ID NO: 613761 - protein, 9 aa, Homo Sapiens
LKISLIHIF

SEQ ID NO: 613762 - protein, 9 aa, Homo Sapiens
TNSITQHTL

SEQ ID NO: 613763 - protein, 9 aa, Homo Sapiens
KSIRSIRNM

SEQ ID NO: 613764 - protein, 9 aa, Homo Sapiens
LDFEKLKPE

SEQ ID NO: 613765 - protein, 9 aa, Homo Sapiens
CGAAWRPEA

SEQ ID NO: 613766 - protein, 9 aa, Homo Sapiens
QFPYEDIKT

SEQ ID NO: 613767 - protein, 9 aa, Homo Sapiens
SGAERSFVS

SEQ ID NO: 613768 - protein, 9 aa, Homo Sapiens
LPSLMDLMY

SEQ ID NO: 613769 - protein, 9 aa, Homo Sapiens
DLMLLQLDL

SEQ ID NO: 613770 - protein, 9 aa, Homo Sapiens
ESFILYQDD

SEQ ID NO: 613771 - protein, 9 aa, Homo Sapiens
EMDNFHKKF

SEQ ID NO: 613772 - protein, 9 aa, Homo Sapiens
PVCEENFTF

SEQ ID NO: 613773 - protein, 9 aa, Homo Sapiens
ENLLMDLTN

SEQ ID NO: 613774 - protein, 9 aa, Homo Sapiens
TPTTNAWSW

SEQ ID NO: 613775 - protein, 9 aa, Homo Sapiens
VVSPKNTTE

SEQ ID NO: 613776 - protein, 9 aa, Homo Sapiens
TVDTWPPRP

SEQ ID NO: 613777 - protein, 9 aa, Homo Sapiens
LFLFISANA

SEQ ID NO: 613778 - protein, 9 aa, Homo Sapiens
KETGWSKHS

SEQ ID NO: 613779 - protein, 9 aa, Homo Sapiens
GRVSPFRVW

SEQ ID NO: 613780 - protein, 9 aa, Homo Sapiens
SPPQRYKPL

SEQ ID NO: 613781 - protein, 9 aa, Homo Sapiens
IPGSMSEEQ

SEQ ID NO: 613782 - protein, 9 aa, Homo Sapiens
PHYISPEAL

SEQ ID NO: 613783 - protein, 9 aa, Homo Sapiens
DVKRVYSLF

SEQ ID NO: 613784 - protein, 9 aa, Homo Sapiens
GGNTNSHYF

SEQ ID NO: 613785 - protein, 9 aa, Homo Sapiens
ISQERSTLW

SEQ ID NO: 613786 - protein, 9 aa, Homo Sapiens
LNKIYFKNM

SEQ ID NO: 613787 - protein, 9 aa, Homo Sapiens
LFALFRVMA

SEQ ID NO: 613788 - protein, 9 aa, Homo Sapiens
QVIATLIIN

SEQ ID NO: 613789 - protein, 9 aa, Homo Sapiens
EEEDFECIE

SEQ ID NO: 613790 - protein, 9 aa, Homo Sapiens
IDRKSDLDQ

SEQ ID NO: 613791 - protein, 9 aa, Homo Sapiens
SSGQSFQQM

SEQ ID NO: 613792 - protein, 9 aa, Homo Sapiens
CYLPQTHSL

SEQ ID NO: 613793 - protein, 9 aa, Homo Sapiens
ELPSVNPME

SEQ ID NO: 613794 - protein, 9 aa, Homo Sapiens
HSLGNYGLS

SEQ ID NO: 613795 - protein, 9 aa, Homo Sapiens
IFSFDKMLN

SEQ ID NO: 613796 - protein, 9 aa, Homo Sapiens
CSTVVRPCE

SEQ ID NO: 613797 - protein, 9 aa, Homo Sapiens
ATALHHIPP

SEQ ID NO: 613798 - protein, 9 aa, Homo Sapiens
PPSSTNNMA

SEQ ID NO: 613799 - protein, 9 aa, Homo Sapiens
SFMKQLMDG

SEQ ID NO: 613800 - protein, 9 aa, Homo Sapiens
LLSREGLVE

SEQ ID NO: 613801 - protein, 9 aa, Homo Sapiens
DEVPYALGI

SEQ ID NO: 613802 - protein, 9 aa, Homo Sapiens
AVPVAFQLK

SEQ ID NO: 613803 - protein, 9 aa, Homo Sapiens
TYYECPGTC

SEQ ID NO: 613804 - protein, 9 aa, Homo Sapiens
TLTRLNQEE

SEQ ID NO: 613805 - protein, 9 aa, Homo Sapiens
GTEDTDEKE

SEQ ID NO: 613806 - protein, 9 aa, Homo Sapiens
SDSNCGVMR

SEQ ID NO: 613807 - protein, 9 aa, Homo Sapiens
NSSGSSEYS

SEQ ID NO: 613808 - protein, 9 aa, Homo Sapiens
EECDPGAVF

SEQ ID NO: 613809 - protein, 9 aa, Homo Sapiens
NHEPVATSL

SEQ ID NO: 613810 - protein, 9 aa, Homo Sapiens
SLAAQGQLP

SEQ ID NO: 613811 - protein, 9 aa, Homo Sapiens
GEKDPRSGF

SEQ ID NO: 613812 - protein, 9 aa, Homo Sapiens
LGSLTGPGQ

SEQ ID NO: 613813 - protein, 9 aa, Homo Sapiens
WCCLNLKQF

SEQ ID NO: 613814 - protein, 9 aa, Homo Sapiens
EKLSRNEAQ

SEQ ID NO: 613815 - protein, 9 aa, Homo Sapiens
TFFFEDCFH

SEQ ID NO: 613816 - protein, 9 aa, Homo Sapiens
KDVKPVLDS

SEQ ID NO: 613817 - protein, 9 aa, Homo Sapiens
RSYVFKTRK

SEQ ID NO: 613818 - protein, 9 aa, Homo Sapiens
VSIIRRLGA

SEQ ID NO: 613819 - protein, 9 aa, Homo Sapiens
GQRPSKPRL

SEQ ID NO: 613820 - protein, 9 aa, Homo Sapiens
MVPVASHNR

SEQ ID NO: 613821 - protein, 9 aa, Homo Sapiens
NWKKAKNTN

SEQ ID NO: 613822 - protein, 9 aa, Homo Sapiens
ETRVSWDLW

SEQ ID NO: 613823 - protein, 9 aa, Homo Sapiens
QSVVFGDVC

SEQ ID NO: 613824 - protein, 9 aa, Homo Sapiens
AIASRMEDC

SEQ ID NO: 613825 - protein, 9 aa, Homo Sapiens
GNSGRETES

SEQ ID NO: 613826 - protein, 9 aa, Homo Sapiens
DTEAVCAME

SEQ ID NO: 613827 - protein, 9 aa, Homo Sapiens
AGGYKTCPT

SEQ ID NO: 613828 - protein, 9 aa, Homo Sapiens
DELLNKIYF

SEQ ID NO: 613829 - protein, 9 aa, Homo Sapiens
SYLAGNLHP

SEQ ID NO: 613830 - protein, 9 aa, Homo Sapiens
YKPWLVHVM

SEQ ID NO: 613831 - protein, 9 aa, Homo Sapiens
KGMGSGSNT

SEQ ID NO: 613832 - protein, 9 aa, Homo Sapiens
KGDGKTCGP

SEQ ID NO: 613833 - protein, 9 aa, Homo Sapiens
FHILNMLFN

SEQ ID NO: 613834 - protein, 9 aa, Homo Sapiens
QHLLRPQEY

SEQ ID NO: 613835 - protein, 9 aa, Homo Sapiens
QKVRTARRR

SEQ ID NO: 613836 - protein, 9 aa, Homo Sapiens
KPLYCISHK

SEQ ID NO: 613837 - protein, 9 aa, Homo Sapiens
GKPYGAYDF

SEQ ID NO: 613838 - protein, 9 aa, Homo Sapiens
VWEALGVES

SEQ ID NO: 613839 - protein, 9 aa, Homo Sapiens
KLGEKMLKE

SEQ ID NO: 613840 - protein, 9 aa, Homo Sapiens
LTSVRVTTG

SEQ ID NO: 613841 - protein, 9 aa, Homo Sapiens
SVNKWVIFR

SEQ ID NO: 613842 - protein, 9 aa, Homo Sapiens
IPMDGQHLC

SEQ ID NO: 613843 - protein, 9 aa, Homo Sapiens
EAKKHIPKL

SEQ ID NO: 613844 - protein, 9 aa, Homo Sapiens
DICHSLYYP

SEQ ID NO: 613845 - protein, 9 aa, Homo Sapiens
LKGDYTAVR

SEQ ID NO: 613846 - protein, 9 aa, Homo Sapiens
DMGQRVCYV

SEQ ID NO: 613847 - protein, 9 aa, Homo Sapiens
SVSCGHGNA

SEQ ID NO: 613848 - protein, 9 aa, Homo Sapiens
PKGMGSGSN

SEQ ID NO: 613849 - protein, 9 aa, Homo Sapiens
VTPSTRTSA

SEQ ID NO: 613850 - protein, 9 aa, Homo Sapiens
LDCGIKFME

SEQ ID NO: 613851 - protein, 9 aa, Homo Sapiens
FEDCFHFSD

SEQ ID NO: 613852 - protein, 9 aa, Homo Sapiens
LHPHLFSCV

SEQ ID NO: 613853 - protein, 9 aa, Homo Sapiens
SAISTELNP

SEQ ID NO: 613854 - protein, 9 aa, Homo Sapiens
AAVAAVRLG

SEQ ID NO: 613855 - protein, 9 aa, Homo Sapiens
TIIFMILGA

SEQ ID NO: 613856 - protein, 9 aa, Homo Sapiens
RDLGADPAV

SEQ ID NO: 613857 - protein, 9 aa, Homo Sapiens
ICWQYTIEG

SEQ ID NO: 613858 - protein, 9 aa, Homo Sapiens
LRGEKDPRS

SEQ ID NO: 613859 - protein, 9 aa, Homo Sapiens
SAHTTGKGT

SEQ ID NO: 613860 - protein, 9 aa, Homo Sapiens
RDPFPELPV

SEQ ID NO: 613861 - protein, 9 aa, Homo Sapiens
DLYIKFDLQ

SEQ ID NO: 613862 - protein, 9 aa, Homo Sapiens
NQRIFVEEF

SEQ ID NO: 613863 - protein, 9 aa, Homo Sapiens
RKIQQCMVA

SEQ ID NO: 613864 - protein, 9 aa, Homo Sapiens
KLKQLQKKE

SEQ ID NO: 613865 - protein, 9 aa, Homo Sapiens
STKVPKMLQ

SEQ ID NO: 613866 - protein, 9 aa, Homo Sapiens
RITEQKLGS

SEQ ID NO: 613867 - protein, 9 aa, Homo Sapiens
MPPAPPGGG

SEQ ID NO: 613868 - protein, 9 aa, Homo Sapiens
LEQACAVQM

SEQ ID NO: 613869 - protein, 9 aa, Homo Sapiens
PGCPHPPAA

SEQ ID NO: 613870 - protein, 9 aa, Homo Sapiens
PLSRASGGR

SEQ ID NO: 613871 - protein, 8 aa, Homo Sapiens
NLEPPKAE

SEQ ID NO: 613872 - protein, 9 aa, Homo Sapiens
SVGQIHVTK

SEQ ID NO: 613873 - protein, 9 aa, Homo Sapiens
VSQFHSICE

SEQ ID NO: 613874 - protein, 9 aa, Homo Sapiens
GSKFSMTVP

SEQ ID NO: 613875 - protein, 9 aa, Homo Sapiens
APHLHHQLL

SEQ ID NO: 613876 - protein, 9 aa, Homo Sapiens
LLGIIREIS

SEQ ID NO: 613877 - protein, 9 aa, Homo Sapiens
PLNRADAQS

SEQ ID NO: 613878 - protein, 9 aa, Homo Sapiens
SARSIFQEI

SEQ ID NO: 613879 - protein, 9 aa, Homo Sapiens
GQALPRTLG

SEQ ID NO: 613880 - protein, 9 aa, Homo Sapiens
LLPGRAKSV

SEQ ID NO: 613881 - protein, 9 aa, Homo Sapiens
WRPEAAVAA

SEQ ID NO: 613882 - protein, 9 aa, Homo Sapiens
LSFPLHESI

SEQ ID NO: 613883 - protein, 9 aa, Homo Sapiens
LAILLCVLI

SEQ ID NO: 613884 - protein, 9 aa, Homo Sapiens
VQKHQQTFL

SEQ ID NO: 613885 - protein, 9 aa, Homo Sapiens
KGSNAIEEE

SEQ ID NO: 613886 - protein, 9 aa, Homo Sapiens
KGNFSFPIS

SEQ ID NO: 613887 - protein, 9 aa, Homo Sapiens
NLVFLRSRL

SEQ ID NO: 613888 - protein, 9 aa, Homo Sapiens
TAGPHPGHQ

SEQ ID NO: 613889 - protein, 9 aa, Homo Sapiens
RGEGGKGLG

SEQ ID NO: 613890 - protein, 9 aa, Homo Sapiens
FCSLSLLTN

SEQ ID NO: 613891 - protein, 9 aa, Homo Sapiens
PHLHHQLLH

SEQ ID NO: 613892 - protein, 9 aa, Homo Sapiens
AETNLRLTC

SEQ ID NO: 613893 - protein, 9 aa, Homo Sapiens
IQTPCTIKI

SEQ ID NO: 613894 - protein, 9 aa, Homo Sapiens
QIHVTKLAE

SEQ ID NO: 613895 - protein, 9 aa, Homo Sapiens
AAPHPQAPN

SEQ ID NO: 613896 - protein, 9 aa, Homo Sapiens
IAADNDPTA

SEQ ID NO: 613897 - protein, 9 aa, Homo Sapiens
LLLFCYIGC

SEQ ID NO: 613898 - protein, 9 aa, Homo Sapiens
RQRYRAAAA

SEQ ID NO: 613899 - protein, 9 aa, Homo Sapiens
AHHQTLQSL

SEQ ID NO: 613900 - protein, 9 aa, Homo Sapiens
IAWVPIVHS

SEQ ID NO: 613901 - protein, 9 aa, Homo Sapiens
TPDTPACMV

SEQ ID NO: 613902 - protein, 9 aa, Homo Sapiens
SHDPGTPLC

SEQ ID NO: 613903 - protein, 9 aa, Homo Sapiens
ALLMHGWFH

SEQ ID NO: 613904 - protein, 9 aa, Homo Sapiens
EDKSNDNSG

SEQ ID NO: 613905 - protein, 9 aa, Homo Sapiens
ELTVSYFSP

SEQ ID NO: 613906 - protein, 9 aa, Homo Sapiens
KNRYRDILR

SEQ ID NO: 613907 - protein, 9 aa, Homo Sapiens
ACSLPEVFL

SEQ ID NO: 613908 - protein, 9 aa, Homo Sapiens
RLFPHAAQQ

SEQ ID NO: 613909 - protein, 9 aa, Homo Sapiens
PRSGFDIKV

SEQ ID NO: 613910 - protein, 9 aa, Homo Sapiens
APASAPAEA

SEQ ID NO: 613911 - protein, 9 aa, Homo Sapiens
TWDGPEQER

SEQ ID NO: 613912 - protein, 9 aa, Homo Sapiens
DQRLCHPRC

SEQ ID NO: 613913 - protein, 9 aa, Homo Sapiens
MLLDCYGDR

SEQ ID NO: 613914 - protein, 9 aa, Homo Sapiens
RFYLVARTS

SEQ ID NO: 613915 - protein, 9 aa, Homo Sapiens
TCQQEGGQP

SEQ ID NO: 613916 - protein, 9 aa, Homo Sapiens
HEGHLYPPC

SEQ ID NO: 613917 - protein, 9 aa, Homo Sapiens
TNTRKRSQR

SEQ ID NO: 613918 - protein, 9 aa, Homo Sapiens
HYISPEALK

SEQ ID NO: 613919 - protein, 9 aa, Homo Sapiens
VDYVPSSWK

SEQ ID NO: 613920 - protein, 9 aa, Homo Sapiens
VLRRDHKTS

SEQ ID NO: 613921 - protein, 9 aa, Homo Sapiens
DICLQGLCR

SEQ ID NO: 613922 - protein, 9 aa, Homo Sapiens
ALLECLTFE

SEQ ID NO: 613923 - protein, 9 aa, Homo Sapiens
EASALSLKS

SEQ ID NO: 613924 - protein, 9 aa, Homo Sapiens
RSLDVSPRR

SEQ ID NO: 613925 - protein, 9 aa, Homo Sapiens
KPDKPSTSF

SEQ ID NO: 613926 - protein, 9 aa, Homo Sapiens
RTKIKRRRR

SEQ ID NO: 613927 - protein, 9 aa, Homo Sapiens
TGAYRHAQI

SEQ ID NO: 613928 - protein, 9 aa, Homo Sapiens
LALSSGVDI

SEQ ID NO: 613929 - protein, 9 aa, Homo Sapiens
HQSSTPNPL

SEQ ID NO: 613930 - protein, 9 aa, Homo Sapiens
TSADASVRT

SEQ ID NO: 613931 - protein, 9 aa, Homo Sapiens
GKVSDDMRR

SEQ ID NO: 613932 - protein, 9 aa, Homo Sapiens
GSRSCSLLG

SEQ ID NO: 613933 - protein, 9 aa, Homo Sapiens
FAYTGCFEL

SEQ ID NO: 613934 - protein, 9 aa, Homo Sapiens
LSTFTIPKM

SEQ ID NO: 613935 - protein, 9 aa, Homo Sapiens
CAGRDCSVC

SEQ ID NO: 613936 - protein, 9 aa, Homo Sapiens
RYWAITNAT

SEQ ID NO: 613937 - protein, 9 aa, Homo Sapiens
SVFEVPKTY

SEQ ID NO: 613938 - protein, 9 aa, Homo Sapiens
HFREVIKRI

SEQ ID NO: 613939 - protein, 9 aa, Homo Sapiens
FILYQDDLE

SEQ ID NO: 613940 - protein, 9 aa, Homo Sapiens
RRPRVRRLH

SEQ ID NO: 613941 - protein, 9 aa, Homo Sapiens
VGIELHAVS

SEQ ID NO: 613942 - protein, 9 aa, Homo Sapiens
LQACAASTR

SEQ ID NO: 613943 - protein, 9 aa, Homo Sapiens
FYSADPPLI

SEQ ID NO: 613944 - protein, 9 aa, Homo Sapiens
AIFGRPVVN

SEQ ID NO: 613945 - protein, 9 aa, Homo Sapiens
IASRMEDCL

SEQ ID NO: 613946 - protein, 9 aa, Homo Sapiens
RVTAVPVAF

SEQ ID NO: 613947 - protein, 9 aa, Homo Sapiens
DTRIRACFT

SEQ ID NO: 613948 - protein, 9 aa, Homo Sapiens
PIGTNVLEL

SEQ ID NO: 613949 - protein, 9 aa, Homo Sapiens
DAFTPLAVA

SEQ ID NO: 613950 - protein, 9 aa, Homo Sapiens
FALFRVMAQ

SEQ ID NO: 613951 - protein, 9 aa, Homo Sapiens
LRELGPRAS

SEQ ID NO: 613952 - protein, 9 aa, Homo Sapiens
ICSRVTVTP

SEQ ID NO: 613953 - protein, 9 aa, Homo Sapiens
PAVISALVS

SEQ ID NO: 613954 - protein, 9 aa, Homo Sapiens
FCVVTQAHY

SEQ ID NO: 613955 - protein, 9 aa, Homo Sapiens
GELERIQNL

SEQ ID NO: 613956 - protein, 9 aa, Homo Sapiens
SDIMNCGIY

SEQ ID NO: 613957 - protein, 9 aa, Homo Sapiens
TKLKPYILD

SEQ ID NO: 613958 - protein, 9 aa, Homo Sapiens
ECDNIPCEK

SEQ ID NO: 613959 - protein, 9 aa, Homo Sapiens
RYLDICHSL

SEQ ID NO: 613960 - protein, 9 aa, Homo Sapiens
RERHRDPFP

SEQ ID NO: 613961 - protein, 9 aa, Homo Sapiens
MEGATLTLQ

SEQ ID NO: 613962 - protein, 9 aa, Homo Sapiens
WRKLVLPPV

SEQ ID NO: 613963 - protein, 9 aa, Homo Sapiens
HELIPTKSC

SEQ ID NO: 613964 - protein, 9 aa, Homo Sapiens
FHCNRYLTR

SEQ ID NO: 613965 - protein, 9 aa, Homo Sapiens
KAARYCGSF

SEQ ID NO: 613966 - protein, 9 aa, Homo Sapiens
CWQYTIEGR

SEQ ID NO: 613967 - protein, 9 aa, Homo Sapiens
RKLFSHYNQ

SEQ ID NO: 613968 - protein, 9 aa, Homo Sapiens
THINQSEKW

SEQ ID NO: 613969 - protein, 9 aa, Homo Sapiens
LAWQRCRAA

SEQ ID NO: 613970 - protein, 9 aa, Homo Sapiens
QELEGQIAY

SEQ ID NO: 613971 - protein, 9 aa, Homo Sapiens
WHKSRVLQA

SEQ ID NO: 613972 - protein, 9 aa, Homo Sapiens
LYKDVKPVL

SEQ ID NO: 613973 - protein, 9 aa, Homo Sapiens
DPHSQTRRE

SEQ ID NO: 613974 - protein, 9 aa, Homo Sapiens
SLVALRPFS

SEQ ID NO: 613975 - protein, 9 aa, Homo Sapiens
LALVPACLV

SEQ ID NO: 613976 - protein, 9 aa, Homo Sapiens
SSLKVPGDP

SEQ ID NO: 613977 - protein, 9 aa, Homo Sapiens
NYEIIHMIE

SEQ ID NO: 613978 - protein, 9 aa, Homo Sapiens
KAGYDQNKT

SEQ ID NO: 613979 - protein, 9 aa, Homo Sapiens
NRRQRYRAA

SEQ ID NO: 613980 - protein, 9 aa, Homo Sapiens
ALRTRLHLQ

SEQ ID NO: 613981 - protein, 9 aa, Homo Sapiens
NETRVSWDL

SEQ ID NO: 613982 - protein, 9 aa, Homo Sapiens
FGHILGNYR

SEQ ID NO: 613983 - protein, 9 aa, Homo Sapiens
RQMLYVGSW

SEQ ID NO: 613984 - protein, 9 aa, Homo Sapiens
LRDTFVFQV

SEQ ID NO: 613985 - protein, 9 aa, Homo Sapiens
QLPEQTVIP

SEQ ID NO: 613986 - protein, 9 aa, Homo Sapiens
NNLSSLSNK

SEQ ID NO: 613987 - protein, 9 aa, Homo Sapiens
WAKFTNFDT

SEQ ID NO: 613988 - protein, 9 aa, Homo Sapiens
RLSGQEFAV

SEQ ID NO: 613989 - protein, 9 aa, Homo Sapiens
KGLNEFDSL

SEQ ID NO: 613990 - protein, 9 aa, Homo Sapiens
MVTLSGNQS

SEQ ID NO: 613991 - protein, 9 aa, Homo Sapiens
ECVSDSFQY

SEQ ID NO: 613992 - protein, 9 aa, Homo Sapiens
KRHAVLLGL

SEQ ID NO: 613993 - protein, 9 aa, Homo Sapiens
PPRPPQSSG

SEQ ID NO: 613994 - protein, 9 aa, Homo Sapiens
NMADNKALA

SEQ ID NO: 613995 - protein, 9 aa, Homo Sapiens
GLARKPAGE

SEQ ID NO: 613996 - protein, 9 aa, Homo Sapiens
EARPEATVA

SEQ ID NO: 613997 - protein, 9 aa, Homo Sapiens
QVSSVRCIQ

SEQ ID NO: 613998 - protein, 9 aa, Homo Sapiens
TTEAAVHDS

SEQ ID NO: 613999 - protein, 9 aa, Homo Sapiens
MFVNNHLSG

SEQ ID NO: 614000 - protein, 9 aa, Homo Sapiens
NVCDEPRDT

SEQ ID NO: 614001 - protein, 9 aa, Homo Sapiens
QREAEDAER

SEQ ID NO: 614002 - protein, 9 aa, Homo Sapiens
SGFSTASRK

SEQ ID NO: 614003 - protein, 9 aa, Homo Sapiens
TLPRSVLLE

SEQ ID NO: 614004 - protein, 9 aa, Homo Sapiens
EPWIQTPCT

SEQ ID NO: 614005 - protein, 9 aa, Homo Sapiens
ALHHIPPSA

SEQ ID NO: 614006 - protein, 9 aa, Homo Sapiens
LPVTLTANK

SEQ ID NO: 614007 - protein, 9 aa, Homo Sapiens
PRWVHCAEP

SEQ ID NO: 614008 - protein, 9 aa, Homo Sapiens
CSRVTVTPS

SEQ ID NO: 614009 - protein, 9 aa, Homo Sapiens
FNPIRAVPL

SEQ ID NO: 614010 - protein, 9 aa, Homo Sapiens
IKSIRSIRN

SEQ ID NO: 614011 - protein, 9 aa, Homo Sapiens
EDPATLNKP

SEQ ID NO: 614012 - protein, 9 aa, Homo Sapiens
SCQASAGAT

SEQ ID NO: 614013 - protein, 9 aa, Homo Sapiens
FILFHPSLL

SEQ ID NO: 614014 - protein, 9 aa, Homo Sapiens
KAQREAEDA

SEQ ID NO: 614015 - protein, 9 aa, Homo Sapiens
VSYTCSVQT

SEQ ID NO: 614016 - protein, 9 aa, Homo Sapiens
SHGDHSRGK

SEQ ID NO: 614017 - protein, 9 aa, Homo Sapiens
CSIINEAGS

SEQ ID NO: 614018 - protein, 9 aa, Homo Sapiens
AYLQYLCYR

SEQ ID NO: 614019 - protein, 9 aa, Homo Sapiens
WYAVPSQPP

SEQ ID NO: 614020 - protein, 9 aa, Homo Sapiens
DRKSDLDQI

SEQ ID NO: 614021 - protein, 9 aa, Homo Sapiens
PHACLLPPI

SEQ ID NO: 614022 - protein, 9 aa, Homo Sapiens
RSLPGAWRF

SEQ ID NO: 614023 - protein, 9 aa, Homo Sapiens
AGSYLAGNL

SEQ ID NO: 614024 - protein, 9 aa, Homo Sapiens
IYVERRLLS

SEQ ID NO: 614025 - protein, 9 aa, Homo Sapiens
AYDRYLDIC

SEQ ID NO: 614026 - protein, 9 aa, Homo Sapiens
IALIGNLSM

SEQ ID NO: 614027 - protein, 9 aa, Homo Sapiens
QNLNWASLN

SEQ ID NO: 614028 - protein, 9 aa, Homo Sapiens
SPLTNDLLH

SEQ ID NO: 614029 - protein, 9 aa, Homo Sapiens
EDSCDYSIP

SEQ ID NO: 614030 - protein, 9 aa, Homo Sapiens
RSIFQEIAQ

SEQ ID NO: 614031 - protein, 9 aa, Homo Sapiens
LLAACTEEK

SEQ ID NO: 614032 - protein, 9 aa, Homo Sapiens
IHLAGQVMH

SEQ ID NO: 614033 - protein, 9 aa, Homo Sapiens
TTVSCEMKN

SEQ ID NO: 614034 - protein, 9 aa, Homo Sapiens
HSLDQPMFY

SEQ ID NO: 614035 - protein, 9 aa, Homo Sapiens
GPGPEGGWR

SEQ ID NO: 614036 - protein, 9 aa, Homo Sapiens
FDKMQYPIS

SEQ ID NO: 614037 - protein, 9 aa, Homo Sapiens
LQLSWLWSQ

SEQ ID NO: 614038 - protein, 9 aa, Homo Sapiens
PAFWYNPSS

SEQ ID NO: 614039 - protein, 9 aa, Homo Sapiens
HHSTPLGAY

SEQ ID NO: 614040 - protein, 9 aa, Homo Sapiens
GLFDDSDIQ

SEQ ID NO: 614041 - protein, 9 aa, Homo Sapiens
PSRLRRRWR

SEQ ID NO: 614042 - protein, 9 aa, Homo Sapiens
SSSPHMFVG

SEQ ID NO: 614043 - protein, 9 aa, Homo Sapiens
WTLNPNCEK

SEQ ID NO: 614044 - protein, 9 aa, Homo Sapiens
LKSEVVSLP

SEQ ID NO: 614045 - protein, 9 aa, Homo Sapiens
YIESLTGGL

SEQ ID NO: 614046 - protein, 9 aa, Homo Sapiens
GDSRMFFTD

SEQ ID NO: 614047 - protein, 9 aa, Homo Sapiens
QDGLDLPSD

SEQ ID NO: 614048 - protein, 9 aa, Homo Sapiens
LALRGGGQS

SEQ ID NO: 614049 - protein, 9 aa, Homo Sapiens
EKLEASQLF

SEQ ID NO: 614050 - protein, 9 aa, Homo Sapiens
LENPVTQLI

SEQ ID NO: 614051 - protein, 9 aa, Homo Sapiens
VFLVLLFWE

SEQ ID NO: 614052 - protein, 9 aa, Homo Sapiens
VKVNSGGSN

SEQ ID NO: 614053 - protein, 9 aa, Homo Sapiens
EETRIQLQK

SEQ ID NO: 614054 - protein, 9 aa, Homo Sapiens
PPGSGVSSV

SEQ ID NO: 614055 - protein, 9 aa, Homo Sapiens
KSSDDLMVP

SEQ ID NO: 614056 - protein, 9 aa, Homo Sapiens
LGNAKLTQA

SEQ ID NO: 614057 - protein, 9 aa, Homo Sapiens
ERYVAILHR

SEQ ID NO: 614058 - protein, 9 aa, Homo Sapiens
RGGPKGKSS

SEQ ID NO: 614059 - protein, 9 aa, Homo Sapiens
PLRLVKSQL

SEQ ID NO: 614060 - protein, 9 aa, Homo Sapiens
ERYEDLLCF

SEQ ID NO: 614061 - protein, 9 aa, Homo Sapiens
KFKMPKLKM

SEQ ID NO: 614062 - protein, 9 aa, Homo Sapiens
MKLGFTQGD

SEQ ID NO: 614063 - protein, 9 aa, Homo Sapiens
TKTWLSSAT

SEQ ID NO: 614064 - protein, 9 aa, Homo Sapiens
ERKPQDFWV

SEQ ID NO: 614065 - protein, 9 aa, Homo Sapiens
LLTYKYMIH

SEQ ID NO: 614066 - protein, 9 aa, Homo Sapiens
CHYTDACTE

SEQ ID NO: 614067 - protein, 9 aa, Homo Sapiens
SFYHTPEKD

SEQ ID NO: 614068 - protein, 9 aa, Homo Sapiens
TPPAGAIST

SEQ ID NO: 614069 - protein, 9 aa, Homo Sapiens
YEDLLCFPG

SEQ ID NO: 614070 - protein, 9 aa, Homo Sapiens
LLLPHIKKI

SEQ ID NO: 614071 - protein, 9 aa, Homo Sapiens
QLSWLWSQQ

SEQ ID NO: 614072 - protein, 9 aa, Homo Sapiens
AYDRLMKES

SEQ ID NO: 614073 - protein, 9 aa, Homo Sapiens
PCTSRRLTS

SEQ ID NO: 614074 - protein, 9 aa, Homo Sapiens
DASISYTYF

SEQ ID NO: 614075 - protein, 9 aa, Homo Sapiens
LRACTKVSS

SEQ ID NO: 614076 - protein, 9 aa, Homo Sapiens
CGKAFFRSS

SEQ ID NO: 614077 - protein, 9 aa, Homo Sapiens
IQRYRGYPV

SEQ ID NO: 614078 - protein, 9 aa, Homo Sapiens
YDRLMKESR

SEQ ID NO: 614079 - protein, 9 aa, Homo Sapiens
LRRRENLRL

SEQ ID NO: 614080 - protein, 9 aa, Homo Sapiens
KKEKKKKEH

SEQ ID NO: 614081 - protein, 9 aa, Homo Sapiens
FLFNCATFA

SEQ ID NO: 614082 - protein, 9 aa, Homo Sapiens
FAYDRLMKE

SEQ ID NO: 614083 - protein, 9 aa, Homo Sapiens
VYYCIVKVG

SEQ ID NO: 614084 - protein, 9 aa, Homo Sapiens
RDGLRERQG

SEQ ID NO: 614085 - protein, 9 aa, Homo Sapiens
GNYWTLNPN

SEQ ID NO: 614086 - protein, 9 aa, Homo Sapiens
YCYSHVGIV

SEQ ID NO: 614087 - protein, 9 aa, Homo Sapiens
VYYCIVKVA

SEQ ID NO: 614088 - protein, 9 aa, Homo Sapiens
FGGTNRLNS

SEQ ID NO: 614089 - protein, 9 aa, Homo Sapiens
STPCFKTCS

SEQ ID NO: 614090 - protein, 9 aa, Homo Sapiens
IEADHKQLL

SEQ ID NO: 614091 - protein, 9 aa, Homo Sapiens
ACAKLSLWD

SEQ ID NO: 614092 - protein, 9 aa, Homo Sapiens
RGNWDEDSV

SEQ ID NO: 614093 - protein, 9 aa, Homo Sapiens
ADVPASARR

SEQ ID NO: 614094 - protein, 9 aa, Homo Sapiens
AKTVAQSLN

SEQ ID NO: 614095 - protein, 9 aa, Homo Sapiens
FQLQLREFI

SEQ ID NO: 614096 - protein, 9 aa, Homo Sapiens
HKKEKKKKE

SEQ ID NO: 614097 - protein, 9 aa, Homo Sapiens
PKYYKIEDM

SEQ ID NO: 614098 - protein, 9 aa, Homo Sapiens
LHTCQYIDP

SEQ ID NO: 614099 - protein, 9 aa, Homo Sapiens
CQCIECKCC

SEQ ID NO: 614100 - protein, 9 aa, Homo Sapiens
PNFKGPLVN

SEQ ID NO: 614101 - protein, 9 aa, Homo Sapiens
SILTPREYE

SEQ ID NO: 614102 - protein, 9 aa, Homo Sapiens
CWIMMATSW

SEQ ID NO: 614103 - protein, 9 aa, Homo Sapiens
YFSPSIKSW

SEQ ID NO: 614104 - protein, 9 aa, Homo Sapiens
TEETRIQLQ

SEQ ID NO: 614105 - protein, 9 aa, Homo Sapiens
GGELSYVLL

SEQ ID NO: 614106 - protein, 9 aa, Homo Sapiens
LASYRDLLI

SEQ ID NO: 614107 - protein, 9 aa, Homo Sapiens
MFFTDNGSW

SEQ ID NO: 614108 - protein, 9 aa, Homo Sapiens
WPTPPAGAI

SEQ ID NO: 614109 - protein, 9 aa, Homo Sapiens
DDLMVPNEH

SEQ ID NO: 614110 - protein, 9 aa, Homo Sapiens
LTDPYRAPS

SEQ ID NO: 614111 - protein, 9 aa, Homo Sapiens
AEEEPLLVL

SEQ ID NO: 614112 - protein, 9 aa, Homo Sapiens
NDLYHEMIK

SEQ ID NO: 614113 - protein, 9 aa, Homo Sapiens
PRVCWIMMA

SEQ ID NO: 614114 - protein, 9 aa, Homo Sapiens
VELMGSGIE

SEQ ID NO: 614115 - protein, 9 aa, Homo Sapiens
KEEPFVWPG

SEQ ID NO: 614116 - protein, 9 aa, Homo Sapiens
SLDQPMFYF

SEQ ID NO: 614117 - protein, 9 aa, Homo Sapiens
KLLDLYNCT

SEQ ID NO: 614118 - protein, 9 aa, Homo Sapiens
DGLDLPSDT

SEQ ID NO: 614119 - protein, 9 aa, Homo Sapiens
LDRGFHPSS

SEQ ID NO: 614120 - protein, 9 aa, Homo Sapiens
FTDNGSWNG

SEQ ID NO: 614121 - protein, 9 aa, Homo Sapiens
CPYLQTKLL

SEQ ID NO: 614122 - protein, 9 aa, Homo Sapiens
ILQPHSPTY

SEQ ID NO: 614123 - protein, 9 aa, Homo Sapiens
EFTIEELKE

SEQ ID NO: 614124 - protein, 9 aa, Homo Sapiens
SHFPPSSIL

SEQ ID NO: 614125 - protein, 9 aa, Homo Sapiens
EDAEFYLTL

SEQ ID NO: 614126 - protein, 9 aa, Homo Sapiens
DSAGSLFGS

SEQ ID NO: 614127 - protein, 9 aa, Homo Sapiens
FKAEDLLSE

SEQ ID NO: 614128 - protein, 9 aa, Homo Sapiens
ALPQYIESL

SEQ ID NO: 614129 - protein, 9 aa, Homo Sapiens
IVWAQTYAT

SEQ ID NO: 614130 - protein, 9 aa, Homo Sapiens
LYNCTERAE

SEQ ID NO: 614131 - protein, 9 aa, Homo Sapiens
KQEPGRGPS

SEQ ID NO: 614132 - protein, 9 aa, Homo Sapiens
QSILQPHSP

SEQ ID NO: 614133 - protein, 9 aa, Homo Sapiens
QPAKSAPAP

SEQ ID NO: 614134 - protein, 9 aa, Homo Sapiens
HDHVEDCMD

SEQ ID NO: 614135 - protein, 9 aa, Homo Sapiens
CPPYVLSKG

SEQ ID NO: 614136 - protein, 9 aa, Homo Sapiens
NAKLTQAFL

SEQ ID NO: 614137 - protein, 9 aa, Homo Sapiens
SSIVCLYKK

SEQ ID NO: 614138 - protein, 9 aa, Homo Sapiens
DLLCFPGWA

SEQ ID NO: 614139 - protein, 9 aa, Homo Sapiens
AGYIRQACD

SEQ ID NO: 614140 - protein, 9 aa, Homo Sapiens
GPQYYPRSN

SEQ ID NO: 614141 - protein, 9 aa, Homo Sapiens
GPLVNVSCN

SEQ ID NO: 614142 - protein, 9 aa, Homo Sapiens
YEEKLEASQ

SEQ ID NO: 614143 - protein, 9 aa, Homo Sapiens
FSRPFPNSP

SEQ ID NO: 614144 - protein, 9 aa, Homo Sapiens
FITVLGHTP

SEQ ID NO: 614145 - protein, 9 aa, Homo Sapiens
QHHNLHMTG

SEQ ID NO: 614146 - protein, 9 aa, Homo Sapiens
RQKHLNVDN

SEQ ID NO: 614147 - protein, 9 aa, Homo Sapiens
GRYYTLTGR

SEQ ID NO: 614148 - protein, 9 aa, Homo Sapiens
PVLNSWAQA

SEQ ID NO: 614149 - protein, 9 aa, Homo Sapiens
LCFPGWALT

SEQ ID NO: 614150 - protein, 9 aa, Homo Sapiens
NPSTSSHFP

SEQ ID NO: 614151 - protein, 9 aa, Homo Sapiens
SGVFQLQLR

SEQ ID NO: 614152 - protein, 9 aa, Homo Sapiens
LSVRPSQLE

SEQ ID NO: 614153 - protein, 9 aa, Homo Sapiens
RTFPQAISG

SEQ ID NO: 614154 - protein, 9 aa, Homo Sapiens
VNQNILENK

SEQ ID NO: 614155 - protein, 9 aa, Homo Sapiens
KNKIIHTGE

SEQ ID NO: 614156 - protein, 9 aa, Homo Sapiens
RKFKFELNQ

SEQ ID NO: 614157 - protein, 9 aa, Homo Sapiens
NIEADHKQL

SEQ ID NO: 614158 - protein, 9 aa, Homo Sapiens
SSFSRPFPN

SEQ ID NO: 614159 - protein, 9 aa, Homo Sapiens
DLCYVGLRF

SEQ ID NO: 614160 - protein, 9 aa, Homo Sapiens
LLGLLVSSS

SEQ ID NO: 614161 - protein, 9 aa, Homo Sapiens
NTFAYYTYL

SEQ ID NO: 614162 - protein, 9 aa, Homo Sapiens
TQAFLLVAA

SEQ ID NO: 614163 - protein, 9 aa, Homo Sapiens
IYTYMLPSF

SEQ ID NO: 614164 - protein, 9 aa, Homo Sapiens
SVLAIPSWR

SEQ ID NO: 614165 - protein, 9 aa, Homo Sapiens
IVRASGGEL

SEQ ID NO: 614166 - protein, 9 aa, Homo Sapiens
LVTLALIPL

SEQ ID NO: 614167 - protein, 9 aa, Homo Sapiens
LPKRSYKFT

SEQ ID NO: 614168 - protein, 9 aa, Homo Sapiens
SKSLCMGNS

SEQ ID NO: 614169 - protein, 9 aa, Homo Sapiens
VDDRGQDHN

SEQ ID NO: 614170 - protein, 9 aa, Homo Sapiens
VDHDYCQVL

SEQ ID NO: 614171 - protein, 9 aa, Homo Sapiens
QLEDGHTAL

SEQ ID NO: 614172 - protein, 9 aa, Homo Sapiens
MEDAEFYLT

SEQ ID NO: 614173 - protein, 9 aa, Homo Sapiens
PQYIESLTG

SEQ ID NO: 614174 - protein, 9 aa, Homo Sapiens
DFWVLLPEH

SEQ ID NO: 614175 - protein, 9 aa, Homo Sapiens
AKTNEFNRT

SEQ ID NO: 614176 - protein, 9 aa, Homo Sapiens
TFSSNFMSI

SEQ ID NO: 614177 - protein, 9 aa, Homo Sapiens
AKLSLWDHG

SEQ ID NO: 614178 - protein, 9 aa, Homo Sapiens
LSEAASLSE

SEQ ID NO: 614179 - protein, 9 aa, Homo Sapiens
MAAVKTYRC

SEQ ID NO: 614180 - protein, 9 aa, Homo Sapiens
PLFHSRFSQ

SEQ ID NO: 614181 - protein, 9 aa, Homo Sapiens
EYALVNQNI

SEQ ID NO: 614182 - protein, 9 aa, Homo Sapiens
PPSSILKRE

SEQ ID NO: 614183 - protein, 9 aa, Homo Sapiens
YKDFKIHWL

SEQ ID NO: 614184 - protein, 9 aa, Homo Sapiens
SLNTDPMLL

SEQ ID NO: 614185 - protein, 9 aa, Homo Sapiens
LTVQFSCDE

SEQ ID NO: 614186 - protein, 9 aa, Homo Sapiens
IKTEHSLDQ

SEQ ID NO: 614187 - protein, 9 aa, Homo Sapiens
RLIPLFHSR

SEQ ID NO: 614188 - protein, 9 aa, Homo Sapiens
MTLGSLTGS

SEQ ID NO: 614189 - protein, 9 aa, Homo Sapiens
WFLLVRPGA

SEQ ID NO: 614190 - protein, 9 aa, Homo Sapiens
QGFSEGGRQ

SEQ ID NO: 614191 - protein, 9 aa, Homo Sapiens
SESATDPPA

SEQ ID NO: 614192 - protein, 9 aa, Homo Sapiens
FVGSHMQQS

SEQ ID NO: 614193 - protein, 9 aa, Homo Sapiens
EEDAWIEHD

SEQ ID NO: 614194 - protein, 9 aa, Homo Sapiens
YRGYPVSGR

SEQ ID NO: 614195 - protein, 9 aa, Homo Sapiens
KEEERKKTL

SEQ ID NO: 614196 - protein, 9 aa, Homo Sapiens
LLILDRGFH

SEQ ID NO: 614197 - protein, 9 aa, Homo Sapiens
NEKLAAKTN

SEQ ID NO: 614198 - protein, 9 aa, Homo Sapiens
WIDQRLHIK

SEQ ID NO: 614199 - protein, 9 aa, Homo Sapiens
GCTDIDNAL

SEQ ID NO: 614200 - protein, 9 aa, Homo Sapiens
MKHEDVKQY

SEQ ID NO: 614201 - protein, 9 aa, Homo Sapiens
QCDRCHMLC

SEQ ID NO: 614202 - protein, 9 aa, Homo Sapiens
AGQVMHCSA

SEQ ID NO: 614203 - protein, 9 aa, Homo Sapiens
IKEGDNHYF

SEQ ID NO: 614204 - protein, 9 aa, Homo Sapiens
ITVLGHTPE

SEQ ID NO: 614205 - protein, 9 aa, Homo Sapiens
PCPENNSKG

SEQ ID NO: 614206 - protein, 9 aa, Homo Sapiens
LILDRGFHP

SEQ ID NO: 614207 - protein, 9 aa, Homo Sapiens
EEYALVNQN

SEQ ID NO: 614208 - protein, 9 aa, Homo Sapiens
GDNHYFTCI

SEQ ID NO: 614209 - protein, 9 aa, Homo Sapiens
QNEEDAWIE

SEQ ID NO: 614210 - protein, 9 aa, Homo Sapiens
AAKTNEFNR

SEQ ID NO: 614211 - protein, 9 aa, Homo Sapiens
VAILHRFRA

SEQ ID NO: 614212 - protein, 9 aa, Homo Sapiens
SFTFSSNFM

SEQ ID NO: 614213 - protein, 9 aa, Homo Sapiens
EELKEWMEY

SEQ ID NO: 614214 - protein, 9 aa, Homo Sapiens
EGSGLGYLE

SEQ ID NO: 614215 - protein, 9 aa, Homo Sapiens
LRIKSMEPF

SEQ ID NO: 614216 - protein, 9 aa, Homo Sapiens
RTSLRSSSP

SEQ ID NO: 614217 - protein, 9 aa, Homo Sapiens
AECPYLQTK

SEQ ID NO: 614218 - protein, 9 aa, Homo Sapiens
LAAKTNEFN

SEQ ID NO: 614219 - protein, 9 aa, Homo Sapiens
ILWLQLSWL

SEQ ID NO: 614220 - protein, 9 aa, Homo Sapiens
LWEDYRSLV

SEQ ID NO: 614221 - protein, 9 aa, Homo Sapiens
LGYLEQVKP

SEQ ID NO: 614222 - protein, 9 aa, Homo Sapiens
EEEEKSTSV

SEQ ID NO: 614223 - protein, 9 aa, Homo Sapiens
IDILIQKEY

SEQ ID NO: 614224 - protein, 9 aa, Homo Sapiens
ISYTYFDKM

SEQ ID NO: 614225 - protein, 9 aa, Homo Sapiens
CNQNFQERN

SEQ ID NO: 614226 - protein, 9 aa, Homo Sapiens
TAMFQDEDI

SEQ ID NO: 614227 - protein, 9 aa, Homo Sapiens
RYYTLTGRD

SEQ ID NO: 614228 - protein, 9 aa, Homo Sapiens
VSGRVSCHT

SEQ ID NO: 614229 - protein, 9 aa, Homo Sapiens
SELAVEVKV

SEQ ID NO: 614230 - protein, 9 aa, Homo Sapiens
GNAKLTQAF

SEQ ID NO: 614231 - protein, 9 aa, Homo Sapiens
SSPSKDCSL

SEQ ID NO: 614232 - protein, 9 aa, Homo Sapiens
TKVNHVPSG

SEQ ID NO: 614233 - protein, 9 aa, Homo Sapiens
CCCLRPVSG

SEQ ID NO: 614234 - protein, 9 aa, Homo Sapiens
GGKPGDEGV

SEQ ID NO: 614235 - protein, 9 aa, Homo Sapiens
RYSGICTKD

SEQ ID NO: 614236 - protein, 9 aa, Homo Sapiens
RLNQHQRVQ

SEQ ID NO: 614237 - protein, 9 aa, Homo Sapiens
VSDVKMEYT

SEQ ID NO: 614238 - protein, 9 aa, Homo Sapiens
TTRKRMASP

SEQ ID NO: 614239 - protein, 9 aa, Homo Sapiens
PHIKKIDGM

SEQ ID NO: 614240 - protein, 9 aa, Homo Sapiens
KKCIDILIQ

SEQ ID NO: 614241 - protein, 9 aa, Homo Sapiens
SILQPHSPT

SEQ ID NO: 614242 - protein, 9 aa, Homo Sapiens
KYYKIEDMA

SEQ ID NO: 614243 - protein, 9 aa, Homo Sapiens
NCTFKDKIS

SEQ ID NO: 614244 - protein, 9 aa, Homo Sapiens
LEGAEINRS

SEQ ID NO: 614245 - protein, 9 aa, Homo Sapiens
RRRENLRLD

SEQ ID NO: 614246 - protein, 9 aa, Homo Sapiens
DVKMEYTMD

SEQ ID NO: 614247 - protein, 9 aa, Homo Sapiens
KTQNQNQHI

SEQ ID NO: 614248 - protein, 9 aa, Homo Sapiens
NISQPVVVV

SEQ ID NO: 614249 - protein, 9 aa, Homo Sapiens
TTGGNTRNR

SEQ ID NO: 614250 - protein, 9 aa, Homo Sapiens
LRQACAKLS

SEQ ID NO: 614251 - protein, 9 aa, Homo Sapiens
HHQLAEKKQ

SEQ ID NO: 614252 - protein, 9 aa, Homo Sapiens
KTNEFNRTV

SEQ ID NO: 614253 - protein, 9 aa, Homo Sapiens
FGSIYPLKT

SEQ ID NO: 614254 - protein, 9 aa, Homo Sapiens
WAQAILLPQ

SEQ ID NO: 614255 - protein, 9 aa, Homo Sapiens
SDIQCSPTR

SEQ ID NO: 614256 - protein, 9 aa, Homo Sapiens
ETAYVDDRG

SEQ ID NO: 614257 - protein, 9 aa, Homo Sapiens
LNVDNFLAH

SEQ ID NO: 614258 - protein, 9 aa, Homo Sapiens
AASVLNHSK

SEQ ID NO: 614259 - protein, 9 aa, Homo Sapiens
FKGRHIYTF

SEQ ID NO: 614260 - protein, 9 aa, Homo Sapiens
LAQEEEESG

SEQ ID NO: 614261 - protein, 9 aa, Homo Sapiens
GDLCYVGLR

SEQ ID NO: 614262 - protein, 9 aa, Homo Sapiens
PSTSSHFPP

SEQ ID NO: 614263 - protein, 9 aa, Homo Sapiens
ERKKTLDER

SEQ ID NO: 614264 - protein, 9 aa, Homo Sapiens
QFEPCPENN

SEQ ID NO: 614265 - protein, 9 aa, Homo Sapiens
QVRIEDLEK

SEQ ID NO: 614266 - protein, 9 aa, Homo Sapiens
GMPLRACTK

SEQ ID NO: 614267 - protein, 9 aa, Homo Sapiens
KLYRCDEVD

SEQ ID NO: 614268 - protein, 9 aa, Homo Sapiens
SSFLLFNTT

SEQ ID NO: 614269 - protein, 9 aa, Homo Sapiens
GRDGLRERQ

SEQ ID NO: 614270 - protein, 9 aa, Homo Sapiens
LQLLTSGDP

SEQ ID NO: 614271 - protein, 9 aa, Homo Sapiens
LDLPSDTDL

SEQ ID NO: 614272 - protein, 9 aa, Homo Sapiens
HAHPPGSGV

SEQ ID NO: 614273 - protein, 9 aa, Homo Sapiens
KPDQRPVTN

SEQ ID NO: 614274 - protein, 9 aa, Homo Sapiens
NKDIQSVEA

SEQ ID NO: 614275 - protein, 9 aa, Homo Sapiens
RRMKLGFTQ

SEQ ID NO: 614276 - protein, 9 aa, Homo Sapiens
IFQEAPETN

SEQ ID NO: 614277 - protein, 9 aa, Homo Sapiens
LFSLLCDNI

SEQ ID NO: 614278 - protein, 9 aa, Homo Sapiens
QSVEADVIL

SEQ ID NO: 614279 - protein, 9 aa, Homo Sapiens
ATKVKEEPF

SEQ ID NO: 614280 - protein, 9 aa, Homo Sapiens
QEEEESGQE

SEQ ID NO: 614281 - protein, 9 aa, Homo Sapiens
PWWVPTGAT

SEQ ID NO: 614282 - protein, 9 aa, Homo Sapiens
LAIPSWRDH

SEQ ID NO: 614283 - protein, 9 aa, Homo Sapiens
LRPVSGRVS

SEQ ID NO: 614284 - protein, 9 aa, Homo Sapiens
GLLGLLVSS

SEQ ID NO: 614285 - protein, 9 aa, Homo Sapiens
TIEELKEWM

SEQ ID NO: 614286 - protein, 9 aa, Homo Sapiens
GAHSLGLTL

SEQ ID NO: 614287 - protein, 9 aa, Homo Sapiens
LENISQPVV

SEQ ID NO: 614288 - protein, 9 aa, Homo Sapiens
QLASYRDLL

SEQ ID NO: 614289 - protein, 9 aa, Homo Sapiens
EVKRQAMKE

SEQ ID NO: 614290 - protein, 9 aa, Homo Sapiens
AILHRFRAK

SEQ ID NO: 614291 - protein, 9 aa, Homo Sapiens
PAVCLKMDK

SEQ ID NO: 614292 - protein, 9 aa, Homo Sapiens
LAACTEEKN

SEQ ID NO: 614293 - protein, 9 aa, Homo Sapiens
PKGKSSSRS

SEQ ID NO: 614294 - protein, 9 aa, Homo Sapiens
KFWIFSIIM

SEQ ID NO: 614295 - protein, 9 aa, Homo Sapiens
DGARGSFTF

SEQ ID NO: 614296 - protein, 9 aa, Homo Sapiens
SIVCLYKKL

SEQ ID NO: 614297 - protein, 9 aa, Homo Sapiens
EPFDSGLYQ

SEQ ID NO: 614298 - protein, 9 aa, Homo Sapiens
TSRRLTSLL

SEQ ID NO: 614299 - protein, 9 aa, Homo Sapiens
IMVIVFLVL

SEQ ID NO: 614300 - protein, 9 aa, Homo Sapiens
LNSWAQAIL

SEQ ID NO: 614301 - protein, 9 aa, Homo Sapiens
RRGGPKGKS

SEQ ID NO: 614302 - protein, 9 aa, Homo Sapiens
RYVAILHRF

SEQ ID NO: 614303 - protein, 9 aa, Homo Sapiens
GTVFLFFIT

SEQ ID NO: 614304 - protein, 9 aa, Homo Sapiens
GGFGGTNRL

SEQ ID NO: 614305 - protein, 9 aa, Homo Sapiens
PLGAYGSVK

SEQ ID NO: 614306 - protein, 9 aa, Homo Sapiens
RSSSPTWTL

SEQ ID NO: 614307 - protein, 9 aa, Homo Sapiens
KPGDEGVPG

SEQ ID NO: 614308 - protein, 9 aa, Homo Sapiens
ERQHHNLHM

SEQ ID NO: 614309 - protein, 9 aa, Homo Sapiens
KKEKKCKAD

SEQ ID NO: 614310 - protein, 9 aa, Homo Sapiens
RTAGLVRCL

SEQ ID NO: 614311 - protein, 9 aa, Homo Sapiens
PPYVLSKGG

SEQ ID NO: 614312 - protein, 9 aa, Homo Sapiens
TFKDKISRA

SEQ ID NO: 614313 - protein, 9 aa, Homo Sapiens
VLSKGGHPE

SEQ ID NO: 614314 - protein, 9 aa, Homo Sapiens
IDPWWVPTG

SEQ ID NO: 614315 - protein, 9 aa, Homo Sapiens
YYTLTGRDS

SEQ ID NO: 614316 - protein, 9 aa, Homo Sapiens
FEDDVDSAG

SEQ ID NO: 614317 - protein, 9 aa, Homo Sapiens
KPQDFWVLL

SEQ ID NO: 614318 - protein, 9 aa, Homo Sapiens
FKDKISRAA

SEQ ID NO: 614319 - protein, 9 aa, Homo Sapiens
SRLRGGKIR

SEQ ID NO: 614320 - protein, 9 aa, Homo Sapiens
HLDKLIFQE

SEQ ID NO: 614321 - protein, 9 aa, Homo Sapiens
TPSLLSPSS

SEQ ID NO: 614322 - protein, 9 aa, Homo Sapiens
LKFAYDRLM

SEQ ID NO: 614323 - protein, 9 aa, Homo Sapiens
HAYSMALWE

SEQ ID NO: 614324 - protein, 9 aa, Homo Sapiens
CQYIDPRCS

SEQ ID NO: 614325 - protein, 9 aa, Homo Sapiens
PSQGASALW

SEQ ID NO: 614326 - protein, 9 aa, Homo Sapiens
QNMGIGKND

SEQ ID NO: 614327 - protein, 9 aa, Homo Sapiens
PKSSDDLMV

SEQ ID NO: 614328 - protein, 9 aa, Homo Sapiens
RKKTLDERL

SEQ ID NO: 614329 - protein, 9 aa, Homo Sapiens
NHSKQEPGR

SEQ ID NO: 614330 - protein, 9 aa, Homo Sapiens
FMAVLLVQL

SEQ ID NO: 614331 - protein, 9 aa, Homo Sapiens
FPRESGQRL

SEQ ID NO: 614332 - protein, 9 aa, Homo Sapiens
TEHSLDQPM

SEQ ID NO: 614333 - protein, 9 aa, Homo Sapiens
QFKINMKHE

SEQ ID NO: 614334 - protein, 9 aa, Homo Sapiens
DILIQKEYL

SEQ ID NO: 614335 - protein, 9 aa, Homo Sapiens
RVCWIMMAT

SEQ ID NO: 614336 - protein, 9 aa, Homo Sapiens
FGEEEEKST

SEQ ID NO: 614337 - protein, 9 aa, Homo Sapiens
QYEFLDQTE

SEQ ID NO: 614338 - protein, 9 aa, Homo Sapiens
RKEEERKKT

SEQ ID NO: 614339 - protein, 9 aa, Homo Sapiens
LEFPKSSDD

SEQ ID NO: 614340 - protein, 9 aa, Homo Sapiens
EVCRIHVRI

SEQ ID NO: 614341 - protein, 9 aa, Homo Sapiens
RVFDRQSAV

SEQ ID NO: 614342 - protein, 9 aa, Homo Sapiens
LILGNAKLT

SEQ ID NO: 614343 - protein, 9 aa, Homo Sapiens
MFVGSHMQQ

SEQ ID NO: 614344 - protein, 9 aa, Homo Sapiens
FTYRSEVKG

SEQ ID NO: 614345 - protein, 9 aa, Homo Sapiens
DDRKECLTN

SEQ ID NO: 614346 - protein, 9 aa, Homo Sapiens
TAQFKINMK

SEQ ID NO: 614347 - protein, 9 aa, Homo Sapiens
RRRSISCHS

SEQ ID NO: 614348 - protein, 9 aa, Homo Sapiens
VYYCIVKVC

SEQ ID NO: 614349 - protein, 9 aa, Homo Sapiens
TPIVRASGG

SEQ ID NO: 614350 - protein, 9 aa, Homo Sapiens
LIHPSQGAS

SEQ ID NO: 614351 - protein, 9 aa, Homo Sapiens
SRAGSHCGG

SEQ ID NO: 614352 - protein, 9 aa, Homo Sapiens
VPWECCPVC

SEQ ID NO: 614353 - protein, 9 aa, Homo Sapiens
SYTYFDKMQ

SEQ ID NO: 614354 - protein, 9 aa, Homo Sapiens
DVTLWKTMT

SEQ ID NO: 614355 - protein, 9 aa, Homo Sapiens
TVTKEFVVF

SEQ ID NO: 614356 - protein, 9 aa, Homo Sapiens
QACDFHQVI

SEQ ID NO: 614357 - protein, 9 aa, Homo Sapiens
YEPCSTPCF

SEQ ID NO: 614358 - protein, 9 aa, Homo Sapiens
WLIEINPRM

SEQ ID NO: 614359 - protein, 9 aa, Homo Sapiens
KCYYFSPSI

SEQ ID NO: 614360 - protein, 9 aa, Homo Sapiens
NLLNDDKGT

SEQ ID NO: 614361 - protein, 9 aa, Homo Sapiens
EIYDVPGIL

SEQ ID NO: 614362 - protein, 9 aa, Homo Sapiens
SSDDLMVPN

SEQ ID NO: 614363 - protein, 9 aa, Homo Sapiens
LKMPSFGVS

SEQ ID NO: 614364 - protein, 9 aa, Homo Sapiens
HFPPSSILK

SEQ ID NO: 614365 - protein, 9 aa, Homo Sapiens
GFLCLSELA

SEQ ID NO: 614366 - protein, 9 aa, Homo Sapiens
NYWTLNPNC

SEQ ID NO: 614367 - protein, 9 aa, Homo Sapiens
EDLLSEAAS

SEQ ID NO: 614368 - protein, 9 aa, Homo Sapiens
ELEGRPHLL

SEQ ID NO: 614369 - protein, 9 aa, Homo Sapiens
CPELRRLEF

SEQ ID NO: 614370 - protein, 9 aa, Homo Sapiens
CTKDRCKLY

SEQ ID NO: 614371 - protein, 9 aa, Homo Sapiens
RKPQDFWVL

SEQ ID NO: 614372 - protein, 9 aa, Homo Sapiens
CLMNHNKGK

SEQ ID NO: 614373 - protein, 9 aa, Homo Sapiens
PPKYYKIED

SEQ ID NO: 614374 - protein, 9 aa, Homo Sapiens
IRQYKEVLK

SEQ ID NO: 614375 - protein, 9 aa, Homo Sapiens
DQRLHIKMY

SEQ ID NO: 614376 - protein, 9 aa, Homo Sapiens
WRKFKFELN

SEQ ID NO: 614377 - protein, 9 aa, Homo Sapiens
YNTLLSETV

SEQ ID NO: 614378 - protein, 9 aa, Homo Sapiens
PQNLLNDDK

SEQ ID NO: 614379 - protein, 9 aa, Homo Sapiens
HLAGQVMHC

SEQ ID NO: 614380 - protein, 9 aa, Homo Sapiens
WEDYRSLVI

SEQ ID NO: 614381 - protein, 9 aa, Homo Sapiens
QYYPRSNSE

SEQ ID NO: 614382 - protein, 9 aa, Homo Sapiens
ASARRRGAR

SEQ ID NO: 614383 - protein, 9 aa, Homo Sapiens
TVLGHTPEA

SEQ ID NO: 614384 - protein, 9 aa, Homo Sapiens
SSSSPHMFV

SEQ ID NO: 614385 - protein, 9 aa, Homo Sapiens
SHDHVEDCM

SEQ ID NO: 614386 - protein, 9 aa, Homo Sapiens
ILHRFRAKL

SEQ ID NO: 614387 - protein, 9 aa, Homo Sapiens
YVDDRGQDH

SEQ ID NO: 614388 - protein, 9 aa, Homo Sapiens
FVWPGKKTI

SEQ ID NO: 614389 - protein, 9 aa, Homo Sapiens
TAGLVRCLL

SEQ ID NO: 614390 - protein, 9 aa, Homo Sapiens
DKSHRPVKL

SEQ ID NO: 614391 - protein, 9 aa, Homo Sapiens
EVSQKYNVL

SEQ ID NO: 614392 - protein, 9 aa, Homo Sapiens
ELAVEVKVP

SEQ ID NO: 614393 - protein, 9 aa, Homo Sapiens
CLAILVFLF

SEQ ID NO: 614394 - protein, 9 aa, Homo Sapiens
PPSRLRRRW

SEQ ID NO: 614395 - protein, 9 aa, Homo Sapiens
DEKPDQRPV

SEQ ID NO: 614396 - protein, 9 aa, Homo Sapiens
ISCHSCNGL

SEQ ID NO: 614397 - protein, 9 aa, Homo Sapiens
AILVFLFNC

SEQ ID NO: 614398 - protein, 9 aa, Homo Sapiens
THQDKKLVE

SEQ ID NO: 614399 - protein, 9 aa, Homo Sapiens
VFDRQSAVS

SEQ ID NO: 614400 - protein, 9 aa, Homo Sapiens
PFSCSFVDH

SEQ ID NO: 614401 - protein, 9 aa, Homo Sapiens
YFDKMQYPI

SEQ ID NO: 614402 - protein, 9 aa, Homo Sapiens
EPLRLVKSQ

SEQ ID NO: 614403 - protein, 9 aa, Homo Sapiens
NYFLYLPLA

SEQ ID NO: 614404 - protein, 9 aa, Homo Sapiens
LFPRESGQR

SEQ ID NO: 614405 - protein, 9 aa, Homo Sapiens
LGAYGSVKA

SEQ ID NO: 614406 - protein, 9 aa, Homo Sapiens
VFNRLWFLL

SEQ ID NO: 614407 - protein, 9 aa, Homo Sapiens
IMMATSWIL

SEQ ID NO: 614408 - protein, 9 aa, Homo Sapiens
RPFSCSFVD

SEQ ID NO: 614409 - protein, 9 aa, Homo Sapiens
SATDPPAQP

SEQ ID NO: 614410 - protein, 9 aa, Homo Sapiens
YVGLRFCNP

SEQ ID NO: 614411 - protein, 9 aa, Homo Sapiens
QLQLREFIN

SEQ ID NO: 614412 - protein, 9 aa, Homo Sapiens
LLIHPSQGA

SEQ ID NO: 614413 - protein, 9 aa, Homo Sapiens
YKQSVLNVV

SEQ ID NO: 614414 - protein, 9 aa, Homo Sapiens
DKLIFQEAP

SEQ ID NO: 614415 - protein, 9 aa, Homo Sapiens
MALWEDYRS

SEQ ID NO: 614416 - protein, 9 aa, Homo Sapiens
RPSQLEDGH

SEQ ID NO: 614417 - protein, 9 aa, Homo Sapiens
KIHWLENVY

SEQ ID NO: 614418 - protein, 9 aa, Homo Sapiens
QYIDPRCSV

SEQ ID NO: 614419 - protein, 9 aa, Homo Sapiens
GKKLYRCDE

SEQ ID NO: 614420 - protein, 9 aa, Homo Sapiens
SALLQQYEF

SEQ ID NO: 614421 - protein, 9 aa, Homo Sapiens
NQPKSSIVC

SEQ ID NO: 614422 - protein, 9 aa, Homo Sapiens
VVVGAVGVG

SEQ ID NO: 614423 - protein, 9 aa, Homo Sapiens
PHMFVGSHM

SEQ ID NO: 614424 - protein, 9 aa, Homo Sapiens
KTMTLQQQY

SEQ ID NO: 614425 - protein, 9 aa, Homo Sapiens
MGSVELMGS

SEQ ID NO: 614426 - protein, 9 aa, Homo Sapiens
KNDDLPWPP

SEQ ID NO: 614427 - protein, 9 aa, Homo Sapiens
KTVAQSLNT

SEQ ID NO: 614428 - protein, 9 aa, Homo Sapiens
MVLGAYMTS

SEQ ID NO: 614429 - protein, 9 aa, Homo Sapiens
SPIYMCVDS

SEQ ID NO: 614430 - protein, 9 aa, Homo Sapiens
CRIHVRIAE

SEQ ID NO: 614431 - protein, 9 aa, Homo Sapiens
EVVRRYPHH

SEQ ID NO: 614432 - protein, 9 aa, Homo Sapiens
PNDVTLWKT

SEQ ID NO: 614433 - protein, 9 aa, Homo Sapiens
YGRNNGMPL

SEQ ID NO: 614434 - protein, 9 aa, Homo Sapiens
HVLHCQGRY

SEQ ID NO: 614435 - protein, 9 aa, Homo Sapiens
YCIVKVAHW

SEQ ID NO: 614436 - protein, 9 aa, Homo Sapiens
ENISQPVVV

SEQ ID NO: 614437 - protein, 9 aa, Homo Sapiens
LGDSRMFFT

SEQ ID NO: 614438 - protein, 9 aa, Homo Sapiens
AGPWLIEIN

SEQ ID NO: 614439 - protein, 9 aa, Homo Sapiens
PKSQVVKNT

SEQ ID NO: 614440 - protein, 9 aa, Homo Sapiens
PREYEDLIF

SEQ ID NO: 614441 - protein, 9 aa, Homo Sapiens
IQPPKEDGD

SEQ ID NO: 614442 - protein, 9 aa, Homo Sapiens
GKAFFRSSK

SEQ ID NO: 614443 - protein, 9 aa, Homo Sapiens
DTDLRILGC

SEQ ID NO: 614444 - protein, 9 aa, Homo Sapiens
LWKTMTLQQ

SEQ ID NO: 614445 - protein, 9 aa, Homo Sapiens
TQNQNQHIT

SEQ ID NO: 614446 - protein, 9 aa, Homo Sapiens
REFINERGV

SEQ ID NO: 614447 - protein, 9 aa, Homo Sapiens
SPSIKSWDE

SEQ ID NO: 614448 - protein, 9 aa, Homo Sapiens
RCDEVDGNF

SEQ ID NO: 614449 - protein, 9 aa, Homo Sapiens
VAQSLNTDP

SEQ ID NO: 614450 - protein, 9 aa, Homo Sapiens
SISCHSCNG

SEQ ID NO: 614451 - protein, 9 aa, Homo Sapiens
HRFRAKLQS

SEQ ID NO: 614452 - protein, 9 aa, Homo Sapiens
AGLQLLTSG

SEQ ID NO: 614453 - protein, 9 aa, Homo Sapiens
ARPKSQVVK

SEQ ID NO: 614454 - protein, 9 aa, Homo Sapiens
YQQVQQNEE

SEQ ID NO: 614455 - protein, 9 aa, Homo Sapiens
LCRSHQLAS

SEQ ID NO: 614456 - protein, 9 aa, Homo Sapiens
RRENLRLDQ

SEQ ID NO: 614457 - protein, 9 aa, Homo Sapiens
CPENNSKGL

SEQ ID NO: 614458 - protein, 9 aa, Homo Sapiens
MKELQKAVS

SEQ ID NO: 614459 - protein, 9 aa, Homo Sapiens
VYYCIVKVN

SEQ ID NO: 614460 - protein, 9 aa, Homo Sapiens
RYPHHERCS

SEQ ID NO: 614461 - protein, 9 aa, Homo Sapiens
GVSSVTDFL

SEQ ID NO: 614462 - protein, 9 aa, Homo Sapiens
VVRRYPHHE

SEQ ID NO: 614463 - protein, 9 aa, Homo Sapiens
YTYFDKMQY

SEQ ID NO: 614464 - protein, 9 aa, Homo Sapiens
KLTQAFLLV

SEQ ID NO: 614465 - protein, 9 aa, Homo Sapiens
VKVPWECCP

SEQ ID NO: 614466 - protein, 9 aa, Homo Sapiens
NQNILENKE

SEQ ID NO: 614467 - protein, 9 aa, Homo Sapiens
FKINMKHED

SEQ ID NO: 614468 - protein, 9 aa, Homo Sapiens
QLLTSGDPA

SEQ ID NO: 614469 - protein, 9 aa, Homo Sapiens
LKLTGAGPW

SEQ ID NO: 614470 - protein, 9 aa, Homo Sapiens
ALPSKLPTK

SEQ ID NO: 614471 - protein, 9 aa, Homo Sapiens
LCLSELAVE

SEQ ID NO: 614472 - protein, 9 aa, Homo Sapiens
EKLHHQLAE

SEQ ID NO: 614473 - protein, 9 aa, Homo Sapiens
IHGRGNWDE

SEQ ID NO: 614474 - protein, 9 aa, Homo Sapiens
RGNCTFKDK

SEQ ID NO: 614475 - protein, 9 aa, Homo Sapiens
GGQSANALA

SEQ ID NO: 614476 - protein, 9 aa, Homo Sapiens
SPKELKRCN

SEQ ID NO: 614477 - protein, 9 aa, Homo Sapiens
RGYPVSGRN

SEQ ID NO: 614478 - protein, 9 aa, Homo Sapiens
LCNATNCSS

SEQ ID NO: 614479 - protein, 9 aa, Homo Sapiens
KELQKAVSE

SEQ ID NO: 614480 - protein, 9 aa, Homo Sapiens
LGAYMTSLT

SEQ ID NO: 614481 - protein, 9 aa, Homo Sapiens
CSHRHLSVG

SEQ ID NO: 614482 - protein, 9 aa, Homo Sapiens
LVFNRLWFL

SEQ ID NO: 614483 - protein, 9 aa, Homo Sapiens
KSRLRGGKI

SEQ ID NO: 614484 - protein, 9 aa, Homo Sapiens
RPVLNSWAQ

SEQ ID NO: 614485 - protein, 9 aa, Homo Sapiens
VWAQTYATD

SEQ ID NO: 614486 - protein, 9 aa, Homo Sapiens
HMFVGSHMQ

SEQ ID NO: 614487 - protein, 9 aa, Homo Sapiens
VEDCMDVAV

SEQ ID NO: 614488 - protein, 9 aa, Homo Sapiens
IKMYFFLRN

SEQ ID NO: 614489 - protein, 9 aa, Homo Sapiens
LSWLWSQQK

SEQ ID NO: 614490 - protein, 9 aa, Homo Sapiens
LGLTVQFSC

SEQ ID NO: 614491 - protein, 9 aa, Homo Sapiens
LRRLEFSGC

SEQ ID NO: 614492 - protein, 9 aa, Homo Sapiens
NVVGEAGGK

SEQ ID NO: 614493 - protein, 9 aa, Homo Sapiens
HGHRQKHLN

SEQ ID NO: 614494 - protein, 9 aa, Homo Sapiens
PWECCPVCE

SEQ ID NO: 614495 - protein, 9 aa, Homo Sapiens
DEGVPGDPG

SEQ ID NO: 614496 - protein, 9 aa, Homo Sapiens
QNSSERQHH

SEQ ID NO: 614497 - protein, 9 aa, Homo Sapiens
LTSLLDREV

SEQ ID NO: 614498 - protein, 9 aa, Homo Sapiens
EVPLQEMIQ

SEQ ID NO: 614499 - protein, 9 aa, Homo Sapiens
QLFKDKKAL

SEQ ID NO: 614500 - protein, 9 aa, Homo Sapiens
GGQRGLRGC

SEQ ID NO: 614501 - protein, 9 aa, Homo Sapiens
RVLLTYKYM

SEQ ID NO: 614502 - protein, 9 aa, Homo Sapiens
YGEQYAGNY

SEQ ID NO: 614503 - protein, 9 aa, Homo Sapiens
ETSVLAIPS

SEQ ID NO: 614504 - protein, 9 aa, Homo Sapiens
HGRRGGPKG

SEQ ID NO: 614505 - protein, 9 aa, Homo Sapiens
SIDPWWVPT

SEQ ID NO: 614506 - protein, 9 aa, Homo Sapiens
KFAYDRLMK

SEQ ID NO: 614507 - protein, 9 aa, Homo Sapiens
DPWWVPTGA

SEQ ID NO: 614508 - protein, 9 aa, Homo Sapiens
AGSHCGGGG

SEQ ID NO: 614509 - protein, 9 aa, Homo Sapiens
AGSLFGSPP

SEQ ID NO: 614510 - protein, 9 aa, Homo Sapiens
GIGKNDDLP

SEQ ID NO: 614511 - protein, 9 aa, Homo Sapiens
IFWEHKKEK

SEQ ID NO: 614512 - protein, 9 aa, Homo Sapiens
CNSSSSMSS

SEQ ID NO: 614513 - protein, 9 aa, Homo Sapiens
NAKSLRPLG

SEQ ID NO: 614514 - protein, 9 aa, Homo Sapiens
YYPPRVVIL

SEQ ID NO: 614515 - protein, 9 aa, Homo Sapiens
RKRMASPFR

SEQ ID NO: 614516 - protein, 9 aa, Homo Sapiens
CRSHQLASY

SEQ ID NO: 614517 - protein, 9 aa, Homo Sapiens
QIDDRKECL

SEQ ID NO: 614518 - protein, 9 aa, Homo Sapiens
ILHVHPNGT

SEQ ID NO: 614519 - protein, 9 aa, Homo Sapiens
SETTAMFQD

SEQ ID NO: 614520 - protein, 9 aa, Homo Sapiens
DVPGILHVH

SEQ ID NO: 614521 - protein, 9 aa, Homo Sapiens
GLRERQGFS

SEQ ID NO: 614522 - protein, 9 aa, Homo Sapiens
EGHHSTPLG

SEQ ID NO: 614523 - protein, 9 aa, Homo Sapiens
SDTSSKSLC

SEQ ID NO: 614524 - protein, 9 aa, Homo Sapiens
SHVGIVWAQ

SEQ ID NO: 614525 - protein, 9 aa, Homo Sapiens
LLGFLCLSE

SEQ ID NO: 614526 - protein, 9 aa, Homo Sapiens
NSALPQYIE

SEQ ID NO: 614527 - protein, 9 aa, Homo Sapiens
PMNPPKYYK

SEQ ID NO: 614528 - protein, 9 aa, Homo Sapiens
YCIVKVGGK

SEQ ID NO: 614529 - protein, 9 aa, Homo Sapiens
TFGEEEEKS

SEQ ID NO: 614530 - protein, 9 aa, Homo Sapiens
AFWKGSESA

SEQ ID NO: 614531 - protein, 9 aa, Homo Sapiens
EGVPGDPGA

SEQ ID NO: 614532 - protein, 9 aa, Homo Sapiens
LLLIHPSQG

SEQ ID NO: 614533 - protein, 9 aa, Homo Sapiens
SRMFFTDNG

SEQ ID NO: 614534 - protein, 9 aa, Homo Sapiens
VSCEMKNKV

SEQ ID NO: 614535 - protein, 9 aa, Homo Sapiens
LMNHNKGKI

SEQ ID NO: 614536 - protein, 9 aa, Homo Sapiens
NFVPIDLDV

SEQ ID NO: 614537 - protein, 9 aa, Homo Sapiens
MLCHYTDAC

SEQ ID NO: 614538 - protein, 9 aa, Homo Sapiens
SSTRRHKAF

SEQ ID NO: 614539 - protein, 9 aa, Homo Sapiens
CGGGGWGHP

SEQ ID NO: 614540 - protein, 9 aa, Homo Sapiens
FAYYTYLLL

SEQ ID NO: 614541 - protein, 9 aa, Homo Sapiens
MNHNKGKIM

SEQ ID NO: 614542 - protein, 9 aa, Homo Sapiens
ETFGEVSQK

SEQ ID NO: 614543 - protein, 9 aa, Homo Sapiens
QLEGAEINR

SEQ ID NO: 614544 - protein, 9 aa, Homo Sapiens
SAISYQTTG

SEQ ID NO: 614545 - protein, 9 aa, Homo Sapiens
PVSGRVSCH

SEQ ID NO: 614546 - protein, 9 aa, Homo Sapiens
YCIVKVNSG

SEQ ID NO: 614547 - protein, 9 aa, Homo Sapiens
SLLSPSSTE

SEQ ID NO: 614548 - protein, 9 aa, Homo Sapiens
MKESRRQKT

SEQ ID NO: 614549 - protein, 9 aa, Homo Sapiens
NEDEKEPKE

SEQ ID NO: 614550 - protein, 9 aa, Homo Sapiens
HIYTFDGAL

SEQ ID NO: 614551 - protein, 9 aa, Homo Sapiens
CDLRLIPLF

SEQ ID NO: 614552 - protein, 9 aa, Homo Sapiens
AIPSWRDHS

SEQ ID NO: 614553 - protein, 9 aa, Homo Sapiens
DNALHCREL

SEQ ID NO: 614554 - protein, 9 aa, Homo Sapiens
TRKRMASPF

SEQ ID NO: 614555 - protein, 9 aa, Homo Sapiens
DQIFWEHKK

SEQ ID NO: 614556 - protein, 9 aa, Homo Sapiens
ETSETTAMF

SEQ ID NO: 614557 - protein, 9 aa, Homo Sapiens
CTEEKNVYT

SEQ ID NO: 614558 - protein, 9 aa, Homo Sapiens
SDVKMEYTM

SEQ ID NO: 614559 - protein, 9 aa, Homo Sapiens
ILVFLFNCA

SEQ ID NO: 614560 - protein, 9 aa, Homo Sapiens
TVFLFFITV

SEQ ID NO: 614561 - protein, 9 aa, Homo Sapiens
KELKRCNSS

SEQ ID NO: 614562 - protein, 9 aa, Homo Sapiens
GELQLINIF

SEQ ID NO: 614563 - protein, 9 aa, Homo Sapiens
SSHFPPSSI

SEQ ID NO: 614564 - protein, 9 aa, Homo Sapiens
MTEVVRRYP

SEQ ID NO: 614565 - protein, 9 aa, Homo Sapiens
ILENISQPV

SEQ ID NO: 614566 - protein, 9 aa, Homo Sapiens
KVKEEPFVW

SEQ ID NO: 614567 - protein, 9 aa, Homo Sapiens
NHYFTCITK

SEQ ID NO: 614568 - protein, 9 aa, Homo Sapiens
PVSDVKMEY

SEQ ID NO: 614569 - protein, 9 aa, Homo Sapiens
TDIDNALHC

SEQ ID NO: 614570 - protein, 9 aa, Homo Sapiens
NHIGKKLYR

SEQ ID NO: 614571 - protein, 9 aa, Homo Sapiens
AAVKTYRCQ

SEQ ID NO: 614572 - protein, 9 aa, Homo Sapiens
DEKEPKEVS

SEQ ID NO: 614573 - protein, 9 aa, Homo Sapiens
RHIYTFDGA

SEQ ID NO: 614574 - protein, 9 aa, Homo Sapiens
GAEINRSLL

SEQ ID NO: 614575 - protein, 9 aa, Homo Sapiens
VKMEYTMDV

SEQ ID NO: 614576 - protein, 9 aa, Homo Sapiens
LLHTCQYID

SEQ ID NO: 614577 - protein, 9 aa, Homo Sapiens
YIRQACDFH

SEQ ID NO: 614578 - protein, 9 aa, Homo Sapiens
ASISYTYFD

SEQ ID NO: 614579 - protein, 9 aa, Homo Sapiens
YQTTGGNTR

SEQ ID NO: 614580 - protein, 9 aa, Homo Sapiens
KCIDILIQK

SEQ ID NO: 614581 - protein, 9 aa, Homo Sapiens
TFPQAISGI

SEQ ID NO: 614582 - protein, 9 aa, Homo Sapiens
RCHFLLPDP

SEQ ID NO: 614583 - protein, 9 aa, Homo Sapiens
VGIVWAQTY

SEQ ID NO: 614584 - protein, 9 aa, Homo Sapiens
GWRHHRRGS

SEQ ID NO: 614585 - protein, 9 aa, Homo Sapiens
SGVSSVTDF

SEQ ID NO: 614586 - protein, 9 aa, Homo Sapiens
LRCHFLLPD

SEQ ID NO: 614587 - protein, 9 aa, Homo Sapiens
NEEDAWIEH

SEQ ID NO: 614588 - protein, 9 aa, Homo Sapiens
MASPFRRLR

SEQ ID NO: 614589 - protein, 9 aa, Homo Sapiens
KNYFLYLPL

SEQ ID NO: 614590 - protein, 9 aa, Homo Sapiens
GPWLIEINP

SEQ ID NO: 614591 - protein, 9 aa, Homo Sapiens
INIFQSSVF

SEQ ID NO: 614592 - protein, 9 aa, Homo Sapiens
CVCNQNFQE

SEQ ID NO: 614593 - protein, 9 aa, Homo Sapiens
NTSEKCDWK

SEQ ID NO: 614594 - protein, 9 aa, Homo Sapiens
QQVQQNEED

SEQ ID NO: 614595 - protein, 9 aa, Homo Sapiens
SVLNHSKQE

SEQ ID NO: 614596 - protein, 9 aa, Homo Sapiens
SPCTEETRI

SEQ ID NO: 614597 - protein, 9 aa, Homo Sapiens
FPGWALTPG

SEQ ID NO: 614598 - protein, 9 aa, Homo Sapiens
TMGEPLRLV

SEQ ID NO: 614599 - protein, 9 aa, Homo Sapiens
DGLRERQGF

SEQ ID NO: 614600 - protein, 9 aa, Homo Sapiens
GPEGGWRHH

SEQ ID NO: 614601 - protein, 9 aa, Homo Sapiens
IQILENISQ

SEQ ID NO: 614602 - protein, 9 aa, Homo Sapiens
QVDKKGKIV

SEQ ID NO: 614603 - protein, 9 aa, Homo Sapiens
RSHQLASYR

SEQ ID NO: 614604 - protein, 9 aa, Homo Sapiens
PRVVILEEP

SEQ ID NO: 614605 - protein, 9 aa, Homo Sapiens
PLPLRCHFL

SEQ ID NO: 614606 - protein, 9 aa, Homo Sapiens
VVKNTMEMY

SEQ ID NO: 614607 - protein, 9 aa, Homo Sapiens
AARPKSQVV

SEQ ID NO: 614608 - protein, 9 aa, Homo Sapiens
ELMGSGIER

SEQ ID NO: 614609 - protein, 9 aa, Homo Sapiens
KDMERCARS

SEQ ID NO: 614610 - protein, 9 aa, Homo Sapiens
LGPQYYPRS

SEQ ID NO: 614611 - protein, 9 aa, Homo Sapiens
FKQRRMKLG

SEQ ID NO: 614612 - protein, 9 aa, Homo Sapiens
SLGLTLSPG

SEQ ID NO: 614613 - protein, 9 aa, Homo Sapiens
NPCPSLKAE

SEQ ID NO: 614614 - protein, 9 aa, Homo Sapiens
KNPQSILQP

SEQ ID NO: 614615 - protein, 9 aa, Homo Sapiens
GRSRFSSQG

SEQ ID NO: 614616 - protein, 9 aa, Homo Sapiens
LITEVPLQE

SEQ ID NO: 614617 - protein, 9 aa, Homo Sapiens
KKKKEHRRP

SEQ ID NO: 614618 - protein, 9 aa, Homo Sapiens
IDQRLHIKM

SEQ ID NO: 614619 - protein, 9 aa, Homo Sapiens
SFSRPFPNS

SEQ ID NO: 614620 - protein, 9 aa, Homo Sapiens
SQGGQRGRP

SEQ ID NO: 614621 - protein, 9 aa, Homo Sapiens
IHVRIAEAA

SEQ ID NO: 614622 - protein, 9 aa, Homo Sapiens
LLYAVGGFG

SEQ ID NO: 614623 - protein, 9 aa, Homo Sapiens
QNPCPSLKA

SEQ ID NO: 614624 - protein, 9 aa, Homo Sapiens
PVSSFSRPF

SEQ ID NO: 614625 - protein, 9 aa, Homo Sapiens
LHIKMYFFL

SEQ ID NO: 614626 - protein, 9 aa, Homo Sapiens
KEPKEVSSS

SEQ ID NO: 614627 - protein, 9 aa, Homo Sapiens
QAEVQRAQV

SEQ ID NO: 614628 - protein, 9 aa, Homo Sapiens
SHGNSLFPR

SEQ ID NO: 614629 - protein, 9 aa, Homo Sapiens
YRCTLENPV

SEQ ID NO: 614630 - protein, 9 aa, Homo Sapiens
IQCSPTRQS

SEQ ID NO: 614631 - protein, 9 aa, Homo Sapiens
TYRCQCIEC

SEQ ID NO: 614632 - protein, 9 aa, Homo Sapiens
LHVHPNGTL

SEQ ID NO: 614633 - protein, 9 aa, Homo Sapiens
QQAIQILEN

SEQ ID NO: 614634 - protein, 9 aa, Homo Sapiens
YKETAYVDD

SEQ ID NO: 614635 - protein, 9 aa, Homo Sapiens
EERKKTLDE

SEQ ID NO: 614636 - protein, 9 aa, Homo Sapiens
DLRLIPLFH

SEQ ID NO: 614637 - protein, 9 aa, Homo Sapiens
GPKPTTVSC

SEQ ID NO: 614638 - protein, 9 aa, Homo Sapiens
FGEVSQKYN

SEQ ID NO: 614639 - protein, 9 aa, Homo Sapiens
HNKGKIMVV

SEQ ID NO: 614640 - protein, 9 aa, Homo Sapiens
RRRGARTSL

SEQ ID NO: 614641 - protein, 9 aa, Homo Sapiens
PSFYHTPEK

SEQ ID NO: 614642 - protein, 9 aa, Homo Sapiens
ENIHLAGQV

SEQ ID NO: 614643 - protein, 9 aa, Homo Sapiens
ALVNQNILE

SEQ ID NO: 614644 - protein, 9 aa, Homo Sapiens
EEPFVWPGK

SEQ ID NO: 614645 - protein, 9 aa, Homo Sapiens
IVFLVLLFW

SEQ ID NO: 614646 - protein, 9 aa, Homo Sapiens
QYIESLTGG

SEQ ID NO: 614647 - protein, 9 aa, Homo Sapiens
HFLLPDPLF

SEQ ID NO: 614648 - protein, 9 aa, Homo Sapiens
NDVTLWKTM

SEQ ID NO: 614649 - protein, 9 aa, Homo Sapiens
ETRIQLQKG

SEQ ID NO: 614650 - protein, 9 aa, Homo Sapiens
EPLLVLSPE

SEQ ID NO: 614651 - protein, 9 aa, Homo Sapiens
WLQLSWLWS

SEQ ID NO: 614652 - protein, 9 aa, Homo Sapiens
EGSYKCVCN

SEQ ID NO: 614653 - protein, 9 aa, Homo Sapiens
VFQLQLREF

SEQ ID NO: 614654 - protein, 9 aa, Homo Sapiens
SLVTLALIP

SEQ ID NO: 614655 - protein, 9 aa, Homo Sapiens
SLFPRESGQ

SEQ ID NO: 614656 - protein, 9 aa, Homo Sapiens
QLINIFQSS

SEQ ID NO: 614657 - protein, 9 aa, Homo Sapiens
QVVKNTMEM

SEQ ID NO: 614658 - protein, 9 aa, Homo Sapiens
VGVGKSALT

SEQ ID NO: 614659 - protein, 9 aa, Homo Sapiens
SRRLTSLLD

SEQ ID NO: 614660 - protein, 9 aa, Homo Sapiens
LPHIKKIDG

SEQ ID NO: 614661 - protein, 9 aa, Homo Sapiens
DDVDSAGSL

SEQ ID NO: 614662 - protein, 9 aa, Homo Sapiens
PGPEGGWRH

SEQ ID NO: 614663 - protein, 9 aa, Homo Sapiens
TLENPVTQL

SEQ ID NO: 614664 - protein, 9 aa, Homo Sapiens
PTTVSCEMK

SEQ ID NO: 614665 - protein, 9 aa, Homo Sapiens
KLVESTCLC

SEQ ID NO: 614666 - protein, 9 aa, Homo Sapiens
TKEFVVFGQ

SEQ ID NO: 614667 - protein, 9 aa, Homo Sapiens
PTEDGSLVT

SEQ ID NO: 614668 - protein, 9 aa, Homo Sapiens
FKIHWLENV

SEQ ID NO: 614669 - protein, 9 aa, Homo Sapiens
VKVCEFWGL

SEQ ID NO: 614670 - protein, 9 aa, Homo Sapiens
NRSLLALKE

SEQ ID NO: 614671 - protein, 9 aa, Homo Sapiens
PQAISGIHD

SEQ ID NO: 614672 - protein, 9 aa, Homo Sapiens
ICTKDRCKL

SEQ ID NO: 614673 - protein, 9 aa, Homo Sapiens
QKEYLERVD

SEQ ID NO: 614674 - protein, 9 aa, Homo Sapiens
NLLPKRSYK

SEQ ID NO: 614675 - protein, 9 aa, Homo Sapiens
DGGVPESCN

SEQ ID NO: 614676 - protein, 9 aa, Homo Sapiens
NIFQSSVFE

SEQ ID NO: 614677 - protein, 9 aa, Homo Sapiens
TSLLDREVQ

SEQ ID NO: 614678 - protein, 9 aa, Homo Sapiens
LEQVKPMAG

SEQ ID NO: 614679 - protein, 9 aa, Homo Sapiens
SASPCSHRH

SEQ ID NO: 614680 - protein, 9 aa, Homo Sapiens
CNLRLCTLD

SEQ ID NO: 614681 - protein, 9 aa, Homo Sapiens
VLGAYMTSL

SEQ ID NO: 614682 - protein, 9 aa, Homo Sapiens
PIDLDVWWA

SEQ ID NO: 614683 - protein, 9 aa, Homo Sapiens
YNIVKTQNQ

SEQ ID NO: 614684 - protein, 9 aa, Homo Sapiens
LYHEMIKSG

SEQ ID NO: 614685 - protein, 9 aa, Homo Sapiens
HPPGSGVSS

SEQ ID NO: 614686 - protein, 9 aa, Homo Sapiens
TYMLPSFYH

SEQ ID NO: 614687 - protein, 9 aa, Homo Sapiens
LGLLGLLVS

SEQ ID NO: 614688 - protein, 9 aa, Homo Sapiens
RRSISCHSC

SEQ ID NO: 614689 - protein, 9 aa, Homo Sapiens
TSLTASLFQ

SEQ ID NO: 614690 - protein, 9 aa, Homo Sapiens
LKMDKSHRP

SEQ ID NO: 614691 - protein, 9 aa, Homo Sapiens
NDDLPWPPL

SEQ ID NO: 614692 - protein, 9 aa, Homo Sapiens
LCMGNSTHT

SEQ ID NO: 614693 - protein, 9 aa, Homo Sapiens
QVQQNEEDA

SEQ ID NO: 614694 - protein, 9 aa, Homo Sapiens
KENQETCES

SEQ ID NO: 614695 - protein, 9 aa, Homo Sapiens
LNVRTFPQA

SEQ ID NO: 614696 - protein, 9 aa, Homo Sapiens
PSLLSPSST

SEQ ID NO: 614697 - protein, 9 aa, Homo Sapiens
PCPSLKAEP

SEQ ID NO: 614698 - protein, 9 aa, Homo Sapiens
HSKQEPGRG

SEQ ID NO: 614699 - protein, 9 aa, Homo Sapiens
KVGGKLIFG

SEQ ID NO: 614700 - protein, 9 aa, Homo Sapiens
PLLVLSPEE

SEQ ID NO: 614701 - protein, 9 aa, Homo Sapiens
PPKEDGDYV

SEQ ID NO: 614702 - protein, 9 aa, Homo Sapiens
LTHQDKKLV

SEQ ID NO: 614703 - protein, 9 aa, Homo Sapiens
QVAKTVAQS

SEQ ID NO: 614704 - protein, 9 aa, Homo Sapiens
KEMYHDYIR

SEQ ID NO: 614705 - protein, 9 aa, Homo Sapiens
YKCVCNQNF

SEQ ID NO: 614706 - protein, 9 aa, Homo Sapiens
YHEMIKSGV

SEQ ID NO: 614707 - protein, 9 aa, Homo Sapiens
PWLIEINPR

SEQ ID NO: 614708 - protein, 9 aa, Homo Sapiens
FRSSKLIQH

SEQ ID NO: 614709 - protein, 9 aa, Homo Sapiens
STPLGAYGS

SEQ ID NO: 614710 - protein, 9 aa, Homo Sapiens
FSLGLTVQF

SEQ ID NO: 614711 - protein, 9 aa, Homo Sapiens
DAEALELEG

SEQ ID NO: 614712 - protein, 9 aa, Homo Sapiens
GNCTFKDKI

SEQ ID NO: 614713 - protein, 9 aa, Homo Sapiens
DLYHEMIKS

SEQ ID NO: 614714 - protein, 9 aa, Homo Sapiens
FKPIFGSIY

SEQ ID NO: 614715 - protein, 9 aa, Homo Sapiens
INKENQETC

SEQ ID NO: 614716 - protein, 9 aa, Homo Sapiens
CHFLLPDPL

SEQ ID NO: 614717 - protein, 9 aa, Homo Sapiens
EEEKSTSVT

SEQ ID NO: 614718 - protein, 9 aa, Homo Sapiens
HYFTCITKA

SEQ ID NO: 614719 - protein, 9 aa, Homo Sapiens
YYKIEDMAM

SEQ ID NO: 614720 - protein, 9 aa, Homo Sapiens
GQVMHCSAC

SEQ ID NO: 614721 - protein, 9 aa, Homo Sapiens
RLIREVCRI

SEQ ID NO: 614722 - protein, 9 aa, Homo Sapiens
SAVSLLEER

SEQ ID NO: 614723 - protein, 9 aa, Homo Sapiens
IKKIDGMLN

SEQ ID NO: 614724 - protein, 9 aa, Homo Sapiens
RLTSLLDRE

SEQ ID NO: 614725 - protein, 9 aa, Homo Sapiens
FLFFITVLG

SEQ ID NO: 614726 - protein, 9 aa, Homo Sapiens
LWFLLVRPG

SEQ ID NO: 614727 - protein, 9 aa, Homo Sapiens
RASGGELSY

SEQ ID NO: 614728 - protein, 9 aa, Homo Sapiens
NNSKGLLGI

SEQ ID NO: 614729 - protein, 9 aa, Homo Sapiens
NSASPCSHR

SEQ ID NO: 614730 - protein, 9 aa, Homo Sapiens
RIHGRGNWD

SEQ ID NO: 614731 - protein, 9 aa, Homo Sapiens
IYPLKTTPM

SEQ ID NO: 614732 - protein, 9 aa, Homo Sapiens
TEEKNVYTE

SEQ ID NO: 614733 - protein, 9 aa, Homo Sapiens
KRMASPFRR

SEQ ID NO: 614734 - protein, 9 aa, Homo Sapiens
KLEASQLFK

SEQ ID NO: 614735 - protein, 9 aa, Homo Sapiens
INRSLLALK

SEQ ID NO: 614736 - protein, 9 aa, Homo Sapiens
SVELMGSGI

SEQ ID NO: 614737 - protein, 9 aa, Homo Sapiens
DDRGQDHNL

SEQ ID NO: 614738 - protein, 9 aa, Homo Sapiens
NIYTESRSF

SEQ ID NO: 614739 - protein, 9 aa, Homo Sapiens
QNQNQHITE

SEQ ID NO: 614740 - protein, 9 aa, Homo Sapiens
KQRRMKLGF

SEQ ID NO: 614741 - protein, 9 aa, Homo Sapiens
KYGEQYAGN

SEQ ID NO: 614742 - protein, 9 aa, Homo Sapiens
LQVFMAVLL

SEQ ID NO: 614743 - protein, 9 aa, Homo Sapiens
RPVTNECVP

SEQ ID NO: 614744 - protein, 9 aa, Homo Sapiens
QGASALWRA

SEQ ID NO: 614745 - protein, 9 aa, Homo Sapiens
HQRVQTGEK

SEQ ID NO: 614746 - protein, 9 aa, Homo Sapiens
RRWRSVLWV

SEQ ID NO: 614747 - protein, 9 aa, Homo Sapiens
QVFMAVLLV

SEQ ID NO: 614748 - protein, 9 aa, Homo Sapiens
HSTQNPCPS

SEQ ID NO: 614749 - protein, 9 aa, Homo Sapiens
GAISTKQEA

SEQ ID NO: 614750 - protein, 9 aa, Homo Sapiens
QRVQTGEKP

SEQ ID NO: 614751 - protein, 9 aa, Homo Sapiens
KVPWECCPV

SEQ ID NO: 614752 - protein, 9 aa, Homo Sapiens
NMKHEDVKQ

SEQ ID NO: 614753 - protein, 9 aa, Homo Sapiens
ALLQQYEFL

SEQ ID NO: 614754 - protein, 9 aa, Homo Sapiens
VPGILHVHP

SEQ ID NO: 614755 - protein, 9 aa, Homo Sapiens
VLGMPSSTR

SEQ ID NO: 614756 - protein, 9 aa, Homo Sapiens
MGEPLRLVK

SEQ ID NO: 614757 - protein, 9 aa, Homo Sapiens
NHNKGKIMV

SEQ ID NO: 614758 - protein, 9 aa, Homo Sapiens
IDLDVWWAQ

SEQ ID NO: 614759 - protein, 9 aa, Homo Sapiens
PPRVVILEE

SEQ ID NO: 614760 - protein, 9 aa, Homo Sapiens
QKHLNVDNF

SEQ ID NO: 614761 - protein, 9 aa, Homo Sapiens
DRGFHPSSP

SEQ ID NO: 614762 - protein, 9 aa, Homo Sapiens
ISTKQEARR

SEQ ID NO: 614763 - protein, 9 aa, Homo Sapiens
GKPGDEGVP

SEQ ID NO: 614764 - protein, 9 aa, Homo Sapiens
YPLKTTPMI

SEQ ID NO: 614765 - protein, 9 aa, Homo Sapiens
LNSALPQYI

SEQ ID NO: 614766 - protein, 9 aa, Homo Sapiens
EYEDLIFDI

SEQ ID NO: 614767 - protein, 9 aa, Homo Sapiens
LLNDDKGTI

SEQ ID NO: 614768 - protein, 9 aa, Homo Sapiens
SERQHHNLH

SEQ ID NO: 614769 - protein, 9 aa, Homo Sapiens
TCPPYVLSK

SEQ ID NO: 614770 - protein, 9 aa, Homo Sapiens
DQRPVTNEC

SEQ ID NO: 614771 - protein, 9 aa, Homo Sapiens
AYMTSLTAS

SEQ ID NO: 614772 - protein, 9 aa, Homo Sapiens
EGAEINRSL

SEQ ID NO: 614773 - protein, 9 aa, Homo Sapiens
IVKVGGKLI

SEQ ID NO: 614774 - protein, 9 aa, Homo Sapiens
LVVVGAVGV

SEQ ID NO: 614775 - protein, 9 aa, Homo Sapiens
VCLKMDKSH

SEQ ID NO: 614776 - protein, 9 aa, Homo Sapiens
WKFKGRHIY

SEQ ID NO: 614777 - protein, 9 aa, Homo Sapiens
PLRCHFLLP

SEQ ID NO: 614778 - protein, 9 aa, Homo Sapiens
ELRRLEFSG

SEQ ID NO: 614779 - protein, 9 aa, Homo Sapiens
WYNPSSPSK

SEQ ID NO: 614780 - protein, 9 aa, Homo Sapiens
KECLTNFME

SEQ ID NO: 614781 - protein, 9 aa, Homo Sapiens
PVGDTRVLL

SEQ ID NO: 614782 - protein, 9 aa, Homo Sapiens
ILGLLGLLV

SEQ ID NO: 614783 - protein, 9 aa, Homo Sapiens
AEFYLTLPG

SEQ ID NO: 614784 - protein, 9 aa, Homo Sapiens
PIFGSIYPL

SEQ ID NO: 614785 - protein, 9 aa, Homo Sapiens
FLLPDPLFC

SEQ ID NO: 614786 - protein, 9 aa, Homo Sapiens
ENNSKGLLG

SEQ ID NO: 614787 - protein, 9 aa, Homo Sapiens
KKKEHRRPA

SEQ ID NO: 614788 - protein, 9 aa, Homo Sapiens
VRIEDLEKA

SEQ ID NO: 614789 - protein, 9 aa, Homo Sapiens
CTSRRLTSL

SEQ ID NO: 614790 - protein, 9 aa, Homo Sapiens
AYSMALWED

SEQ ID NO: 614791 - protein, 9 aa, Homo Sapiens
SSVSSFLLF

SEQ ID NO: 614792 - protein, 9 aa, Homo Sapiens
EPFVWPGKK

SEQ ID NO: 614793 - protein, 9 aa, Homo Sapiens
CNATNCSST

SEQ ID NO: 614794 - protein, 9 aa, Homo Sapiens
ASPFRRLRE

SEQ ID NO: 614795 - protein, 9 aa, Homo Sapiens
STQNPCPSL

SEQ ID NO: 614796 - protein, 9 aa, Homo Sapiens
YPVSGRNYP

SEQ ID NO: 614797 - protein, 9 aa, Homo Sapiens
LGETFGEVS

SEQ ID NO: 614798 - protein, 9 aa, Homo Sapiens
IPSWRDHSV

SEQ ID NO: 614799 - protein, 9 aa, Homo Sapiens
KGSESATDP

SEQ ID NO: 614800 - protein, 9 aa, Homo Sapiens
FTFSSNFMS

SEQ ID NO: 614801 - protein, 9 aa, Homo Sapiens
QIAKDMERC

SEQ ID NO: 614802 - protein, 9 aa, Homo Sapiens
GGKIRYQEE

SEQ ID NO: 614803 - protein, 9 aa, Homo Sapiens
MDKSHRPVK

SEQ ID NO: 614804 - protein, 9 aa, Homo Sapiens
SHCGGGGWG

SEQ ID NO: 614805 - protein, 9 aa, Homo Sapiens
ACTEEKNVY

SEQ ID NO: 614806 - protein, 9 aa, Homo Sapiens
DYIRQYKEV

SEQ ID NO: 614807 - protein, 9 aa, Homo Sapiens
QTTGGNTRN

SEQ ID NO: 614808 - protein, 9 aa, Homo Sapiens
AYQQVQQNE

SEQ ID NO: 614809 - protein, 9 aa, Homo Sapiens
AGETSVLAI

SEQ ID NO: 614810 - protein, 9 aa, Homo Sapiens
LLCDNIEAD

SEQ ID NO: 614811 - protein, 9 aa, Homo Sapiens
VHRIHGRGN

SEQ ID NO: 614812 - protein, 9 aa, Homo Sapiens
CLNLQVFMA

SEQ ID NO: 614813 - protein, 9 aa, Homo Sapiens
QPKSSIVCL

SEQ ID NO: 614814 - protein, 9 aa, Homo Sapiens
RCARSLNKQ

SEQ ID NO: 614815 - protein, 9 aa, Homo Sapiens
FLYLPLAGV

SEQ ID NO: 614816 - protein, 9 aa, Homo Sapiens
VGDTRVLLT

SEQ ID NO: 614817 - protein, 9 aa, Homo Sapiens
RSRFSSQGG

SEQ ID NO: 614818 - protein, 9 aa, Homo Sapiens
GKGNYWTLN

SEQ ID NO: 614819 - protein, 9 aa, Homo Sapiens
FSLLCDNIE

SEQ ID NO: 614820 - protein, 9 aa, Homo Sapiens
FPRPVLNSW

SEQ ID NO: 614821 - protein, 9 aa, Homo Sapiens
VAKTVAQSL

SEQ ID NO: 614822 - protein, 9 aa, Homo Sapiens
KAEDLLSEA

SEQ ID NO: 614823 - protein, 9 aa, Homo Sapiens
SPHMFVGSH

SEQ ID NO: 614824 - protein, 9 aa, Homo Sapiens
SVLNVVGEA

SEQ ID NO: 614825 - protein, 9 aa, Homo Sapiens
PSLGPQYYP

SEQ ID NO: 614826 - protein, 9 aa, Homo Sapiens
RAGSHCGGG

SEQ ID NO: 614827 - protein, 9 aa, Homo Sapiens
LNPNCEKMF

SEQ ID NO: 614828 - protein, 9 aa, Homo Sapiens
SHQLASYRD

SEQ ID NO: 614829 - protein, 9 aa, Homo Sapiens
MTSLTASLF

SEQ ID NO: 614830 - protein, 9 aa, Homo Sapiens
ESTPSLLSP

SEQ ID NO: 614831 - protein, 9 aa, Homo Sapiens
EGPWENAKS

SEQ ID NO: 614832 - protein, 9 aa, Homo Sapiens
PLEFPKSSD

SEQ ID NO: 614833 - protein, 9 aa, Homo Sapiens
SWLWSQQKE

SEQ ID NO: 614834 - protein, 9 aa, Homo Sapiens
EFPKSSDDL

SEQ ID NO: 614835 - protein, 9 aa, Homo Sapiens
ILGNAKLTQ

SEQ ID NO: 614836 - protein, 9 aa, Homo Sapiens
STSSHFPPS

SEQ ID NO: 614837 - protein, 9 aa, Homo Sapiens
ACYNTSEKC

SEQ ID NO: 614838 - protein, 9 aa, Homo Sapiens
VRCLLPGLL

SEQ ID NO: 614839 - protein, 9 aa, Homo Sapiens
QLRTAGLVR

SEQ ID NO: 614840 - protein, 9 aa, Homo Sapiens
KSHRPVKLQ

SEQ ID NO: 614841 - protein, 9 aa, Homo Sapiens
KKEHRRPAE

SEQ ID NO: 614842 - protein, 9 aa, Homo Sapiens
LYRCDEVDG

SEQ ID NO: 614843 - protein, 9 aa, Homo Sapiens
AEALELEGR

SEQ ID NO: 614844 - protein, 9 aa, Homo Sapiens
VPLQEMIQH

SEQ ID NO: 614845 - protein, 9 aa, Homo Sapiens
DFSLGLTVQ

SEQ ID NO: 614846 - protein, 9 aa, Homo Sapiens
EKNVYTEIK

SEQ ID NO: 614847 - protein, 9 aa, Homo Sapiens
NSWAQAILL

SEQ ID NO: 614848 - protein, 9 aa, Homo Sapiens
LCYVGLRFC

SEQ ID NO: 614849 - protein, 9 aa, Homo Sapiens
HRQKHLNVD

SEQ ID NO: 614850 - protein, 9 aa, Homo Sapiens
SEVKGVYQF

SEQ ID NO: 614851 - protein, 9 aa, Homo Sapiens
FLCLSELAV

SEQ ID NO: 614852 - protein, 9 aa, Homo Sapiens
GRRRSISCH

SEQ ID NO: 614853 - protein, 9 aa, Homo Sapiens
VEADVILEC

SEQ ID NO: 614854 - protein, 9 aa, Homo Sapiens
VFLFFITVL

SEQ ID NO: 614855 - protein, 9 aa, Homo Sapiens
LCLMNHNKG

SEQ ID NO: 614856 - protein, 9 aa, Homo Sapiens
GSESATDPP

SEQ ID NO: 614857 - protein, 9 aa, Homo Sapiens
QLREFINER

SEQ ID NO: 614858 - protein, 9 aa, Homo Sapiens
NTTRKRMAS

SEQ ID NO: 614859 - protein, 9 aa, Homo Sapiens
LEINEKLHH

SEQ ID NO: 614860 - protein, 9 aa, Homo Sapiens
GRHIYTFDG

SEQ ID NO: 614861 - protein, 9 aa, Homo Sapiens
SNISSVSSF

SEQ ID NO: 614862 - protein, 9 aa, Homo Sapiens
SLLLIHPSQ

SEQ ID NO: 614863 - protein, 9 aa, Homo Sapiens
CLITEVPLQ

SEQ ID NO: 614864 - protein, 9 aa, Homo Sapiens
YNTSEKCDW

SEQ ID NO: 614865 - protein, 9 aa, Homo Sapiens
STPSLLSPS

SEQ ID NO: 614866 - protein, 9 aa, Homo Sapiens
KPIFGSIYP

SEQ ID NO: 614867 - protein, 9 aa, Homo Sapiens
RGGKIRYQE

SEQ ID NO: 614868 - protein, 9 aa, Homo Sapiens
RCHMLCHYT

SEQ ID NO: 614869 - protein, 9 aa, Homo Sapiens
VMTLGSLTG

SEQ ID NO: 614870 - protein, 9 aa, Homo Sapiens
FFITVLGHT

SEQ ID NO: 614871 - protein, 9 aa, Homo Sapiens
FSIIMKPLF

SEQ ID NO: 614872 - protein, 9 aa, Homo Sapiens
IREVCRIHV

SEQ ID NO: 614873 - protein, 9 aa, Homo Sapiens
PHSTQNPCP

SEQ ID NO: 614874 - protein, 9 aa, Homo Sapiens
GSFTFSSNF

SEQ ID NO: 614875 - protein, 9 aa, Homo Sapiens
IYTESRSFN

SEQ ID NO: 614876 - protein, 9 aa, Homo Sapiens
PKSSIVCLY

SEQ ID NO: 614877 - protein, 9 aa, Homo Sapiens
EQYAGNYSG

SEQ ID NO: 614878 - protein, 9 aa, Homo Sapiens
RCQCIECKC

SEQ ID NO: 614879 - protein, 9 aa, Homo Sapiens
IVKTQNQNQ

SEQ ID NO: 614880 - protein, 9 aa, Homo Sapiens
AFWYNPSSP

SEQ ID NO: 614881 - protein, 9 aa, Homo Sapiens
TVYTINKEN

SEQ ID NO: 614882 - protein, 9 aa, Homo Sapiens
TDPYRAPSD

SEQ ID NO: 614883 - protein, 9 aa, Homo Sapiens
LKRCNSSSS

SEQ ID NO: 614884 - protein, 9 aa, Homo Sapiens
PKPTTVSCE

SEQ ID NO: 614885 - protein, 9 aa, Homo Sapiens
SLGPQYYPR

SEQ ID NO: 614886 - protein, 9 aa, Homo Sapiens
HSSTLTKNK

SEQ ID NO: 614887 - protein, 9 aa, Homo Sapiens
EVQRAQVRI

SEQ ID NO: 614888 - protein, 9 aa, Homo Sapiens
LVNQNILEN

SEQ ID NO: 614889 - protein, 9 aa, Homo Sapiens
ENSKNIYTE

SEQ ID NO: 614890 - protein, 9 aa, Homo Sapiens
TLLSETVVC

SEQ ID NO: 614891 - protein, 9 aa, Homo Sapiens
GSDFSLGLT

SEQ ID NO: 614892 - protein, 9 aa, Homo Sapiens
IGSDFSLGL

SEQ ID NO: 614893 - protein, 9 aa, Homo Sapiens
GNSLFPRES

SEQ ID NO: 614894 - protein, 9 aa, Homo Sapiens
GSGVSSVTD

SEQ ID NO: 614895 - protein, 9 aa, Homo Sapiens
EDGSLVTLA

SEQ ID NO: 614896 - protein, 9 aa, Homo Sapiens
ERQGFSEGG

SEQ ID NO: 614897 - protein, 9 aa, Homo Sapiens
LAILVFLFN

SEQ ID NO: 614898 - protein, 9 aa, Homo Sapiens
MATSWILAS

SEQ ID NO: 614899 - protein, 9 aa, Homo Sapiens
QAMKELQKA

SEQ ID NO: 614900 - protein, 9 aa, Homo Sapiens
ISSVSSFLL

SEQ ID NO: 614901 - protein, 9 aa, Homo Sapiens
RRGELQLIN

SEQ ID NO: 614902 - protein, 9 aa, Homo Sapiens
PGCTDIDNA

SEQ ID NO: 614903 - protein, 9 aa, Homo Sapiens
KGPLVNVSC

SEQ ID NO: 614904 - protein, 9 aa, Homo Sapiens
ATGGQRGLR

SEQ ID NO: 614905 - protein, 9 aa, Homo Sapiens
LHHQLAEKK

SEQ ID NO: 614906 - protein, 9 aa, Homo Sapiens
AQVRIEDLE

SEQ ID NO: 614907 - protein, 9 aa, Homo Sapiens
KTLDERLRF

SEQ ID NO: 614908 - protein, 9 aa, Homo Sapiens
MMATSWILA

SEQ ID NO: 614909 - protein, 9 aa, Homo Sapiens
PAGAISTKQ

SEQ ID NO: 614910 - protein, 9 aa, Homo Sapiens
FSGCYNISN

SEQ ID NO: 614911 - protein, 9 aa, Homo Sapiens
RYRCTLENP

SEQ ID NO: 614912 - protein, 9 aa, Homo Sapiens
CCLRPVSGR

SEQ ID NO: 614913 - protein, 9 aa, Homo Sapiens
FQEAPETNI

SEQ ID NO: 614914 - protein, 9 aa, Homo Sapiens
VDSAGSLFG

SEQ ID NO: 614915 - protein, 9 aa, Homo Sapiens
SEKCDWKVD

SEQ ID NO: 614916 - protein, 9 aa, Homo Sapiens
PAASIDPWW

SEQ ID NO: 614917 - protein, 9 aa, Homo Sapiens
RRGARTSLR

SEQ ID NO: 614918 - protein, 9 aa, Homo Sapiens
PYVLSKGGH

SEQ ID NO: 614919 - protein, 9 aa, Homo Sapiens
LLQLTNTFA

SEQ ID NO: 614920 - protein, 9 aa, Homo Sapiens
QRYRGYPVS

SEQ ID NO: 614921 - protein, 9 aa, Homo Sapiens
GKNDDLPWP

SEQ ID NO: 614922 - protein, 9 aa, Homo Sapiens
RCTLENPVT

SEQ ID NO: 614923 - protein, 9 aa, Homo Sapiens
MGIGKNDDL

SEQ ID NO: 614924 - protein, 9 aa, Homo Sapiens
LVFLFNCAT

SEQ ID NO: 614925 - protein, 9 aa, Homo Sapiens
RGFHPSSPV

SEQ ID NO: 614926 - protein, 9 aa, Homo Sapiens
QSAVSLLEE

SEQ ID NO: 614927 - protein, 9 aa, Homo Sapiens
MPLRACTKV

SEQ ID NO: 614928 - protein, 9 aa, Homo Sapiens
VYTINKENQ

SEQ ID NO: 614929 - protein, 9 aa, Homo Sapiens
EPCSTPCFK

SEQ ID NO: 614930 - protein, 9 aa, Homo Sapiens
PESCNLRLC

SEQ ID NO: 614931 - protein, 9 aa, Homo Sapiens
MPSSTRRHK

SEQ ID NO: 614932 - protein, 9 aa, Homo Sapiens
EPIKEGDNH

SEQ ID NO: 614933 - protein, 9 aa, Homo Sapiens
VKRQAMKEL

SEQ ID NO: 614934 - protein, 9 aa, Homo Sapiens
CAKLSLWDH

SEQ ID NO: 614935 - protein, 9 aa, Homo Sapiens
PCCCLRPVS

SEQ ID NO: 614936 - protein, 9 aa, Homo Sapiens
YYCIVKVNS

SEQ ID NO: 614937 - protein, 9 aa, Homo Sapiens
KTEHSLDQP

SEQ ID NO: 614938 - protein, 9 aa, Homo Sapiens
GGGWGHPSR

SEQ ID NO: 614939 - protein, 9 aa, Homo Sapiens
VSGRNYPGY

SEQ ID NO: 614940 - protein, 9 aa, Homo Sapiens
ELAQEEEES

SEQ ID NO: 614941 - protein, 9 aa, Homo Sapiens
GSGRATGGQ

SEQ ID NO: 614942 - protein, 9 aa, Homo Sapiens
LYLPLAGVL

SEQ ID NO: 614943 - protein, 9 aa, Homo Sapiens
FKGPLVNVS

SEQ ID NO: 614944 - protein, 9 aa, Homo Sapiens
LPSKLPTKV

SEQ ID NO: 614945 - protein, 9 aa, Homo Sapiens
VSLAVKCLK

SEQ ID NO: 614946 - protein, 9 aa, Homo Sapiens
IRYQEEEAR

SEQ ID NO: 614947 - protein, 9 aa, Homo Sapiens
NLQVFMAVL

SEQ ID NO: 614948 - protein, 9 aa, Homo Sapiens
WRYEPCSTP

SEQ ID NO: 614949 - protein, 9 aa, Homo Sapiens
NLRLCTLDP

SEQ ID NO: 614950 - protein, 9 aa, Homo Sapiens
AHGRRGGPK

SEQ ID NO: 614951 - protein, 9 aa, Homo Sapiens
SGRVSCHTT

SEQ ID NO: 614952 - protein, 9 aa, Homo Sapiens
HKKEKKCKA

SEQ ID NO: 614953 - protein, 9 aa, Homo Sapiens
CEMKNKVWN

SEQ ID NO: 614954 - protein, 9 aa, Homo Sapiens
IFGSIYPLK

SEQ ID NO: 614955 - protein, 9 aa, Homo Sapiens
IKSWDEARM

SEQ ID NO: 614956 - protein, 9 aa, Homo Sapiens
AISAECPYL

SEQ ID NO: 614957 - protein, 9 aa, Homo Sapiens
YALVNQNIL

SEQ ID NO: 614958 - protein, 9 aa, Homo Sapiens
EKPDQRPVT

SEQ ID NO: 614959 - protein, 9 aa, Homo Sapiens
VIQPPKEDG

SEQ ID NO: 614960 - protein, 9 aa, Homo Sapiens
ECLTNFMED

SEQ ID NO: 614961 - protein, 9 aa, Homo Sapiens
KEKKKKEHR

SEQ ID NO: 614962 - protein, 9 aa, Homo Sapiens
LNVVGEAGG

SEQ ID NO: 614963 - protein, 9 aa, Homo Sapiens
ATMGEPLRL

SEQ ID NO: 614964 - protein, 9 aa, Homo Sapiens
YRSEVKGVY

SEQ ID NO: 614965 - protein, 9 aa, Homo Sapiens
MDRMGSVEL

SEQ ID NO: 614966 - protein, 9 aa, Homo Sapiens
ARGSFTFSS

SEQ ID NO: 614967 - protein, 9 aa, Homo Sapiens
KGNYWTLNP

SEQ ID NO: 614968 - protein, 9 aa, Homo Sapiens
DNIEADHKQ

SEQ ID NO: 614969 - protein, 9 aa, Homo Sapiens
REVCRIHVR

SEQ ID NO: 614970 - protein, 9 aa, Homo Sapiens
LQIQVDKKG

SEQ ID NO: 614971 - protein, 9 aa, Homo Sapiens
GYGGDLCYV

SEQ ID NO: 614972 - protein, 9 aa, Homo Sapiens
LREFINERG

SEQ ID NO: 614973 - protein, 9 aa, Homo Sapiens
AVKTYRCQC

SEQ ID NO: 614974 - protein, 9 aa, Homo Sapiens
IKSGVINLK

SEQ ID NO: 614975 - protein, 9 aa, Homo Sapiens
ECPYLQTKL

SEQ ID NO: 614976 - protein, 9 aa, Homo Sapiens
YIRQYKEVL

SEQ ID NO: 614977 - protein, 9 aa, Homo Sapiens
SVSSFLLFN

SEQ ID NO: 614978 - protein, 9 aa, Homo Sapiens
KSEVVSLPV

SEQ ID NO: 614979 - protein, 9 aa, Homo Sapiens
WPVSSFSRP

SEQ ID NO: 614980 - protein, 9 aa, Homo Sapiens
LPLAGVLEH

SEQ ID NO: 614981 - protein, 9 aa, Homo Sapiens
GKTVSLAVK

SEQ ID NO: 614982 - protein, 9 aa, Homo Sapiens
MLTKTWLSS

SEQ ID NO: 614983 - protein, 9 aa, Homo Sapiens
TLSPGDSAQ

SEQ ID NO: 614984 - protein, 9 aa, Homo Sapiens
YFEAYLCNA

SEQ ID NO: 614985 - protein, 9 aa, Homo Sapiens
DCMDVAVNL

SEQ ID NO: 614986 - protein, 9 aa, Homo Sapiens
LVKYGEQYA

SEQ ID NO: 614987 - protein, 9 aa, Homo Sapiens
DLPSDTDLR

SEQ ID NO: 614988 - protein, 9 aa, Homo Sapiens
SDDLMVPNE

SEQ ID NO: 614989 - protein, 9 aa, Homo Sapiens
TAVYYCIVK

SEQ ID NO: 614990 - protein, 9 aa, Homo Sapiens
VDKKGKIVD

SEQ ID NO: 614991 - protein, 9 aa, Homo Sapiens
RQSAVSLLE

SEQ ID NO: 614992 - protein, 9 aa, Homo Sapiens
LKPQNLLND

SEQ ID NO: 614993 - protein, 9 aa, Homo Sapiens
NSKGLLGID

SEQ ID NO: 614994 - protein, 9 aa, Homo Sapiens
LDVWWAQQF

SEQ ID NO: 614995 - protein, 9 aa, Homo Sapiens
DLRQACAKL

SEQ ID NO: 614996 - protein, 9 aa, Homo Sapiens
LVESTCLCF

SEQ ID NO: 614997 - protein, 9 aa, Homo Sapiens
YTINKENQE

SEQ ID NO: 614998 - protein, 9 aa, Homo Sapiens
WECCPVCEE

SEQ ID NO: 614999 - protein, 9 aa, Homo Sapiens
EDEKEPKEV

SEQ ID NO: 615000 - protein, 9 aa, Homo Sapiens
GLSTLRRRE

SEQ ID NO: 615001 - protein, 9 aa, Homo Sapiens
VVGAVGVGK

SEQ ID NO: 615002 - protein, 9 aa, Homo Sapiens
GAFWKGSES

SEQ ID NO: 615003 - protein, 9 aa, Homo Sapiens
LTGAGPWLI

SEQ ID NO: 615004 - protein, 9 aa, Homo Sapiens
GETFGEVSQ

SEQ ID NO: 615005 - protein, 9 aa, Homo Sapiens
LQPHSPTYN

SEQ ID NO: 615006 - protein, 9 aa, Homo Sapiens
GYPVSGRNY

SEQ ID NO: 615007 - protein, 9 aa, Homo Sapiens
FHSRFSQYV

SEQ ID NO: 615008 - protein, 9 aa, Homo Sapiens
DNKKMEDAE

SEQ ID NO: 615009 - protein, 9 aa, Homo Sapiens
ATVMTLGSL

SEQ ID NO: 615010 - protein, 9 aa, Homo Sapiens
LQQYEFLDQ

SEQ ID NO: 615011 - protein, 9 aa, Homo Sapiens
IHPSQGASA

SEQ ID NO: 615012 - protein, 9 aa, Homo Sapiens
SCEMKNKVW

SEQ ID NO: 615013 - protein, 9 aa, Homo Sapiens
AACTEEKNV

SEQ ID NO: 615014 - protein, 9 aa, Homo Sapiens
LVRCLLPGL

SEQ ID NO: 615015 - protein, 9 aa, Homo Sapiens
HRIHGRGNW

SEQ ID NO: 615016 - protein, 9 aa, Homo Sapiens
IPLFHSRFS

SEQ ID NO: 615017 - protein, 9 aa, Homo Sapiens
VLNVVGEAG

SEQ ID NO: 615018 - protein, 9 aa, Homo Sapiens
YYCIVKVAH

SEQ ID NO: 615019 - protein, 9 aa, Homo Sapiens
LWLQLSWLW

SEQ ID NO: 615020 - protein, 9 aa, Homo Sapiens
YGGDLCYVG

SEQ ID NO: 615021 - protein, 9 aa, Homo Sapiens
ESCNLRLCT

SEQ ID NO: 615022 - protein, 9 aa, Homo Sapiens
NPVKVPWEC

SEQ ID NO: 615023 - protein, 9 aa, Homo Sapiens
RLTDPYRAP

SEQ ID NO: 615024 - protein, 9 aa, Homo Sapiens
LNHSKQEPG

SEQ ID NO: 615025 - protein, 9 aa, Homo Sapiens
YWTLNPNCE

SEQ ID NO: 615026 - protein, 9 aa, Homo Sapiens
RESPIYMCV

SEQ ID NO: 615027 - protein, 9 aa, Homo Sapiens
CDNIEADHK

SEQ ID NO: 615028 - protein, 9 aa, Homo Sapiens
IKSMEPFDS

SEQ ID NO: 615029 - protein, 9 aa, Homo Sapiens
CPSLKAEPR

SEQ ID NO: 615030 - protein, 9 aa, Homo Sapiens
IYFEAYLCN

SEQ ID NO: 615031 - protein, 9 aa, Homo Sapiens
KNIYTESRS

SEQ ID NO: 615032 - protein, 9 aa, Homo Sapiens
EEPLLVLSP

SEQ ID NO: 615033 - protein, 9 aa, Homo Sapiens
QNLLNDDKG

SEQ ID NO: 615034 - protein, 9 aa, Homo Sapiens
RAQVRIEDL

SEQ ID NO: 615035 - protein, 9 aa, Homo Sapiens
HQENSKNIY

SEQ ID NO: 615036 - protein, 9 aa, Homo Sapiens
VLLTYKYMI

SEQ ID NO: 615037 - protein, 9 aa, Homo Sapiens
AVSLLEERK

SEQ ID NO: 615038 - protein, 9 aa, Homo Sapiens
LRGGGQSAN

SEQ ID NO: 615039 - protein, 9 aa, Homo Sapiens
IQVDKKGKI

SEQ ID NO: 615040 - protein, 9 aa, Homo Sapiens
VLNHSKQEP

SEQ ID NO: 615041 - protein, 9 aa, Homo Sapiens
KDFKIHWLE

SEQ ID NO: 615042 - protein, 9 aa, Homo Sapiens
CTLENPVTQ

SEQ ID NO: 615043 - protein, 9 aa, Homo Sapiens
SSKSLCMGN

SEQ ID NO: 615044 - protein, 9 aa, Homo Sapiens
STATVMTLG

SEQ ID NO: 615045 - protein, 9 aa, Homo Sapiens
CSFVDHDYC

SEQ ID NO: 615046 - protein, 9 aa, Homo Sapiens
IIMVIVFLV

SEQ ID NO: 615047 - protein, 9 aa, Homo Sapiens
PKEDGDYVE

SEQ ID NO: 615048 - protein, 9 aa, Homo Sapiens
DGSLVTLAL

SEQ ID NO: 615049 - protein, 9 aa, Homo Sapiens
SPHSTQNPC

SEQ ID NO: 615050 - protein, 9 aa, Homo Sapiens
FWYNPSSPS

SEQ ID NO: 615051 - protein, 9 aa, Homo Sapiens
TWLSSATGD

SEQ ID NO: 615052 - protein, 9 aa, Homo Sapiens
GLVKYGEQY

SEQ ID NO: 615053 - protein, 9 aa, Homo Sapiens
CDRLTDPYR

SEQ ID NO: 615054 - protein, 9 aa, Homo Sapiens
MLPSFYHTP

SEQ ID NO: 615055 - protein, 9 aa, Homo Sapiens
RLRRRWRSV

SEQ ID NO: 615056 - protein, 9 aa, Homo Sapiens
TRRHKAFST

SEQ ID NO: 615057 - protein, 9 aa, Homo Sapiens
PVTRESPIY

SEQ ID NO: 615058 - protein, 9 aa, Homo Sapiens
NPYNTLLSE

SEQ ID NO: 615059 - protein, 9 aa, Homo Sapiens
REFTIEELK

SEQ ID NO: 615060 - protein, 9 aa, Homo Sapiens
PLAGVLEHL

SEQ ID NO: 615061 - protein, 9 aa, Homo Sapiens
YRCDEVDGN

SEQ ID NO: 615062 - protein, 9 aa, Homo Sapiens
PGLFDDSDI

SEQ ID NO: 615063 - protein, 9 aa, Homo Sapiens
AMFQDEDIS

SEQ ID NO: 615064 - protein, 9 aa, Homo Sapiens
PEGGWRHHR

SEQ ID NO: 615065 - protein, 9 aa, Homo Sapiens
KMEYTMDVF

SEQ ID NO: 615066 - protein, 9 aa, Homo Sapiens
EINRSLLAL

SEQ ID NO: 615067 - protein, 9 aa, Homo Sapiens
SGGELSYVL

SEQ ID NO: 615068 - protein, 9 aa, Homo Sapiens
TPREYEDLI

SEQ ID NO: 615069 - protein, 9 aa, Homo Sapiens
SLTASLFQI

SEQ ID NO: 615070 - protein, 9 aa, Homo Sapiens
LFFITVLGH

SEQ ID NO: 615071 - protein, 9 aa, Homo Sapiens
VMHCSACSE

SEQ ID NO: 615072 - protein, 9 aa, Homo Sapiens
RATGGQRGL

SEQ ID NO: 615073 - protein, 9 aa, Homo Sapiens
ELKEWMEYE

SEQ ID NO: 615074 - protein, 9 aa, Homo Sapiens
KCVCNQNFQ

SEQ ID NO: 615075 - protein, 9 aa, Homo Sapiens
DLWRKFKFE

SEQ ID NO: 615076 - protein, 9 aa, Homo Sapiens
KEWMEYELQ

SEQ ID NO: 615077 - protein, 9 aa, Homo Sapiens
GVPESCNLR

SEQ ID NO: 615078 - protein, 9 aa, Homo Sapiens
DRCHMLCHY

SEQ ID NO: 615079 - protein, 9 aa, Homo Sapiens
YSGICTKDR

SEQ ID NO: 615080 - protein, 9 aa, Homo Sapiens
GLTLSPGDS

SEQ ID NO: 615081 - protein, 9 aa, Homo Sapiens
EMYHDYIRQ

SEQ ID NO: 615082 - protein, 9 aa, Homo Sapiens
NPQSILQPH

SEQ ID NO: 615083 - protein, 9 aa, Homo Sapiens
RSLLALKEC

SEQ ID NO: 615084 - protein, 9 aa, Homo Sapiens
LRTAGLVRC

SEQ ID NO: 615085 - protein, 9 aa, Homo Sapiens
HIGKKLYRC

SEQ ID NO: 615086 - protein, 9 aa, Homo Sapiens
NPPKYYKIE

SEQ ID NO: 615087 - protein, 9 aa, Homo Sapiens
EEKLEASQL

SEQ ID NO: 615088 - protein, 9 aa, Homo Sapiens
PGDEGVPGD

SEQ ID NO: 615089 - protein, 9 aa, Homo Sapiens
YLQTKLLVS

SEQ ID NO: 615090 - protein, 9 aa, Homo Sapiens
NTMLTKTWL

SEQ ID NO: 615091 - protein, 9 aa, Homo Sapiens
GSIYPLKTT

SEQ ID NO: 615092 - protein, 9 aa, Homo Sapiens
KKGKIVDAR

SEQ ID NO: 615093 - protein, 9 aa, Homo Sapiens
LRRRWRSVL

SEQ ID NO: 615094 - protein, 9 aa, Homo Sapiens
GSLVTLALI

SEQ ID NO: 615095 - protein, 9 aa, Homo Sapiens
STLTKNKII

SEQ ID NO: 615096 - protein, 9 aa, Homo Sapiens
DTSSKSLCM

SEQ ID NO: 615097 - protein, 9 aa, Homo Sapiens
GILHVHPNG

SEQ ID NO: 615098 - protein, 9 aa, Homo Sapiens
KSLCMGNST

SEQ ID NO: 615099 - protein, 9 aa, Homo Sapiens
NALHCRELE

SEQ ID NO: 615100 - protein, 9 aa, Homo Sapiens
VLHCQGRYY

SEQ ID NO: 615101 - protein, 9 aa, Homo Sapiens
VTRESPIYM

SEQ ID NO: 615102 - protein, 9 aa, Homo Sapiens
YDVPGILHV

SEQ ID NO: 615103 - protein, 9 aa, Homo Sapiens
GRRGGPKGK

SEQ ID NO: 615104 - protein, 9 aa, Homo Sapiens
LAARPKSQV

SEQ ID NO: 615105 - protein, 9 aa, Homo Sapiens
VGAVGVGKS

SEQ ID NO: 615106 - protein, 9 aa, Homo Sapiens
CFPGWALTP

SEQ ID NO: 615107 - protein, 9 aa, Homo Sapiens
ASGGELSYV

SEQ ID NO: 615108 - protein, 9 aa, Homo Sapiens
KLQIQVDKK

SEQ ID NO: 615109 - protein, 9 aa, Homo Sapiens
MGRYRCTLE

SEQ ID NO: 615110 - protein, 9 aa, Homo Sapiens
ELLLPHIKK

SEQ ID NO: 615111 - protein, 9 aa, Homo Sapiens
PFDSGLYQC

SEQ ID NO: 615112 - protein, 9 aa, Homo Sapiens
PYLQTKLLV

SEQ ID NO: 615113 - protein, 9 aa, Homo Sapiens
FHPSSPVLH

SEQ ID NO: 615114 - protein, 9 aa, Homo Sapiens
KGKSSSRSP

SEQ ID NO: 615115 - protein, 9 aa, Homo Sapiens
SPCSHRHLS

SEQ ID NO: 615116 - protein, 9 aa, Homo Sapiens
SYKCVCNQN

SEQ ID NO: 615117 - protein, 9 aa, Homo Sapiens
ENFSTATVM

SEQ ID NO: 615118 - protein, 9 aa, Homo Sapiens
CHQENSKNI

SEQ ID NO: 615119 - protein, 9 aa, Homo Sapiens
EEKSTSVTY

SEQ ID NO: 615120 - protein, 9 aa, Homo Sapiens
KLTGAGPWL

SEQ ID NO: 615121 - protein, 9 aa, Homo Sapiens
SFTYRSEVK

SEQ ID NO: 615122 - protein, 9 aa, Homo Sapiens
YCIVKVCEF

SEQ ID NO: 615123 - protein, 9 aa, Homo Sapiens
GLGYLEQVK

SEQ ID NO: 615124 - protein, 9 aa, Homo Sapiens
LNDDKGTIK

SEQ ID NO: 615125 - protein, 9 aa, Homo Sapiens
PFVWPGKKT

SEQ ID NO: 615126 - protein, 9 aa, Homo Sapiens
GACYNTSEK

SEQ ID NO: 615127 - protein, 9 aa, Homo Sapiens
CLKMDKSHR

SEQ ID NO: 615128 - protein, 9 aa, Homo Sapiens
QAIQILENI

SEQ ID NO: 615129 - protein, 9 aa, Homo Sapiens
PGSGVSSVT

SEQ ID NO: 615130 - protein, 9 aa, Homo Sapiens
HCQGRYYTL

SEQ ID NO: 615131 - protein, 9 aa, Homo Sapiens
TCQYIDPRC

SEQ ID NO: 615132 - protein, 9 aa, Homo Sapiens
RWRSVLWVE

SEQ ID NO: 615133 - protein, 9 aa, Homo Sapiens
KINMKHEDV

SEQ ID NO: 615134 - protein, 9 aa, Homo Sapiens
YPPRVVILE

SEQ ID NO: 615135 - protein, 9 aa, Homo Sapiens
KIRYQEEEA

SEQ ID NO: 615136 - protein, 9 aa, Homo Sapiens
EHKKEKKCK

SEQ ID NO: 615137 - protein, 9 aa, Homo Sapiens
AEINRSLLA

SEQ ID NO: 615138 - protein, 9 aa, Homo Sapiens
IYMCVDSPP

SEQ ID NO: 615139 - protein, 9 aa, Homo Sapiens
LRSSSPTWT

SEQ ID NO: 615140 - protein, 9 aa, Homo Sapiens
KVNSGGSNY

SEQ ID NO: 615141 - protein, 9 aa, Homo Sapiens
QNILENKES

SEQ ID NO: 615142 - protein, 9 aa, Homo Sapiens
KKMEDAEFY

SEQ ID NO: 615143 - protein, 9 aa, Homo Sapiens
SLRSSSPTW

SEQ ID NO: 615144 - protein, 9 aa, Homo Sapiens
QRPVTNECV

SEQ ID NO: 615145 - protein, 9 aa, Homo Sapiens
QRLHIKMYF

SEQ ID NO: 615146 - protein, 9 aa, Homo Sapiens
ICLYSITVT

SEQ ID NO: 615147 - protein, 9 aa, Homo Sapiens
EALELEGRP

SEQ ID NO: 615148 - protein, 9 aa, Homo Sapiens
NKENQETCE

SEQ ID NO: 615149 - protein, 9 aa, Homo Sapiens
YYFSPSIKS

SEQ ID NO: 615150 - protein, 9 aa, Homo Sapiens
KLHHQLAEK

SEQ ID NO: 615151 - protein, 9 aa, Homo Sapiens
KNKDIQSVE

SEQ ID NO: 615152 - protein, 9 aa, Homo Sapiens
YLEQVKPMA

SEQ ID NO: 615153 - protein, 9 aa, Homo Sapiens
INMKHEDVK

SEQ ID NO: 615154 - protein, 9 aa, Homo Sapiens
HTCQYIDPR

SEQ ID NO: 615155 - protein, 9 aa, Homo Sapiens
RQACAKLSL

SEQ ID NO: 615156 - protein, 9 aa, Homo Sapiens
GDTRVLLTY

SEQ ID NO: 615157 - protein, 9 aa, Homo Sapiens
KRFDKLLDL

SEQ ID NO: 615158 - protein, 9 aa, Homo Sapiens
GEVSQKYNV

SEQ ID NO: 615159 - protein, 9 aa, Homo Sapiens
MNPPKYYKI

SEQ ID NO: 615160 - protein, 9 aa, Homo Sapiens
FWKGSESAT

SEQ ID NO: 615161 - protein, 9 aa, Homo Sapiens
HMTEVVRRY

SEQ ID NO: 615162 - protein, 9 aa, Homo Sapiens
SPRVCWIMM

SEQ ID NO: 615163 - protein, 9 aa, Homo Sapiens
DYKETAYVD

SEQ ID NO: 615164 - protein, 9 aa, Homo Sapiens
YLCNATNCS

SEQ ID NO: 615165 - protein, 9 aa, Homo Sapiens
VFMAVLLVQ

SEQ ID NO: 615166 - protein, 9 aa, Homo Sapiens
PCSTPCFKT

SEQ ID NO: 615167 - protein, 9 aa, Homo Sapiens
LLPKRSYKF

SEQ ID NO: 615168 - protein, 9 aa, Homo Sapiens
EMIKSGVIN

SEQ ID NO: 615169 - protein, 9 aa, Homo Sapiens
ECGKAFFRS

SEQ ID NO: 615170 - protein, 9 aa, Homo Sapiens
KSLRPLGRR

SEQ ID NO: 615171 - protein, 9 aa, Homo Sapiens
VRPSQLEDG

SEQ ID NO: 615172 - protein, 9 aa, Homo Sapiens
MAERKPQDF

SEQ ID NO: 615173 - protein, 9 aa, Homo Sapiens
SVRPSQLED

SEQ ID NO: 615174 - protein, 9 aa, Homo Sapiens
YNPSSPSKD

SEQ ID NO: 615175 - protein, 9 aa, Homo Sapiens
RQACDFHQV

SEQ ID NO: 615176 - protein, 9 aa, Homo Sapiens
GFHPSSPVL

SEQ ID NO: 615177 - protein, 9 aa, Homo Sapiens
SAGSLFGSP

SEQ ID NO: 615178 - protein, 9 aa, Homo Sapiens
HMLCHYTDA

SEQ ID NO: 615179 - protein, 9 aa, Homo Sapiens
GNEDEKEPK

SEQ ID NO: 615180 - protein, 9 aa, Homo Sapiens
SRFSSQGGQ

SEQ ID NO: 615181 - protein, 9 aa, Homo Sapiens
IVKVNSGGS

SEQ ID NO: 615182 - protein, 9 aa, Homo Sapiens
LINIFQSSV

SEQ ID NO: 615183 - protein, 9 aa, Homo Sapiens
VGESTPSLL

SEQ ID NO: 615184 - protein, 9 aa, Homo Sapiens
NNGMPLRAC

SEQ ID NO: 615185 - protein, 9 aa, Homo Sapiens
FKNKDIQSV

SEQ ID NO: 615186 - protein, 9 aa, Homo Sapiens
ELQLINIFQ

SEQ ID NO: 615187 - protein, 9 aa, Homo Sapiens
VCWIMMATS

SEQ ID NO: 615188 - protein, 9 aa, Homo Sapiens
AHSLGLTLS

SEQ ID NO: 615189 - protein, 9 aa, Homo Sapiens
PSKLPTKVN

SEQ ID NO: 615190 - protein, 9 aa, Homo Sapiens
TVMTLGSLT

SEQ ID NO: 615191 - protein, 9 aa, Homo Sapiens
NDLATMGEP

SEQ ID NO: 615192 - protein, 9 aa, Homo Sapiens
GMPSSTRRH

SEQ ID NO: 615193 - protein, 9 aa, Homo Sapiens
WVPTGATVQ

SEQ ID NO: 615194 - protein, 9 aa, Homo Sapiens
VFLFNCATF

SEQ ID NO: 615195 - protein, 9 aa, Homo Sapiens
DQGNEDEKE

SEQ ID NO: 615196 - protein, 9 aa, Homo Sapiens
KQSVLNVVG

SEQ ID NO: 615197 - protein, 9 aa, Homo Sapiens
DLDVWWAQQ

SEQ ID NO: 615198 - protein, 9 aa, Homo Sapiens
YEDLIFDID

SEQ ID NO: 615199 - protein, 9 aa, Homo Sapiens
NNPYNTLLS

SEQ ID NO: 615200 - protein, 9 aa, Homo Sapiens
YSHVGIVWA

SEQ ID NO: 615201 - protein, 9 aa, Homo Sapiens
RMASPFRRL

SEQ ID NO: 615202 - protein, 9 aa, Homo Sapiens
AQEEEESGQ

SEQ ID NO: 615203 - protein, 9 aa, Homo Sapiens
ELGETFGEV

SEQ ID NO: 615204 - protein, 9 aa, Homo Sapiens
NIHLAGQVM

SEQ ID NO: 615205 - protein, 9 aa, Homo Sapiens
GPVSDVKME

SEQ ID NO: 615206 - protein, 9 aa, Homo Sapiens
PTPPAGAIS

SEQ ID NO: 615207 - protein, 9 aa, Homo Sapiens
YFLYLPLAG

SEQ ID NO: 615208 - protein, 9 aa, Homo Sapiens
NFKGPLVNV

SEQ ID NO: 615209 - protein, 9 aa, Homo Sapiens
SYRDLLIKE

SEQ ID NO: 615210 - protein, 9 aa, Homo Sapiens
DSDIQCSPT

SEQ ID NO: 615211 - protein, 9 aa, Homo Sapiens
ENTTRKRMA

SEQ ID NO: 615212 - protein, 9 aa, Homo Sapiens
DKLLDLYNC

SEQ ID NO: 615213 - protein, 9 aa, Homo Sapiens
HVEDCMDVA

SEQ ID NO: 615214 - protein, 9 aa, Homo Sapiens
FDRQSAVSL

SEQ ID NO: 615215 - protein, 9 aa, Homo Sapiens
CIVKVNSGG

SEQ ID NO: 615216 - protein, 9 aa, Homo Sapiens
EPCPENNSK

SEQ ID NO: 615217 - protein, 9 aa, Homo Sapiens
YMTSLTASL

SEQ ID NO: 615218 - protein, 9 aa, Homo Sapiens
LEGHHSTPL

SEQ ID NO: 615219 - protein, 9 aa, Homo Sapiens
CYVGLRFCN

SEQ ID NO: 615220 - protein, 9 aa, Homo Sapiens
KDKISRAAF

SEQ ID NO: 615221 - protein, 9 aa, Homo Sapiens
CMGNSTHTS

SEQ ID NO: 615222 - protein, 9 aa, Homo Sapiens
SKQEPGRGP

SEQ ID NO: 615223 - protein, 9 aa, Homo Sapiens
LVGESTPSL

SEQ ID NO: 615224 - protein, 9 aa, Homo Sapiens
GGGQSANAL

SEQ ID NO: 615225 - protein, 9 aa, Homo Sapiens
TLWKTMTLQ

SEQ ID NO: 615226 - protein, 9 aa, Homo Sapiens
AKLTQAFLL

SEQ ID NO: 615227 - protein, 9 aa, Homo Sapiens
FNRLWFLLV

SEQ ID NO: 615228 - protein, 9 aa, Homo Sapiens
LHRFRAKLQ

SEQ ID NO: 615229 - protein, 9 aa, Homo Sapiens
LSTLRRREN

SEQ ID NO: 615230 - protein, 9 aa, Homo Sapiens
QEMIQHLKA

SEQ ID NO: 615231 - protein, 9 aa, Homo Sapiens
YMLPSFYHT

SEQ ID NO: 615232 - protein, 9 aa, Homo Sapiens
KETAYVDDR

SEQ ID NO: 615233 - protein, 9 aa, Homo Sapiens
VGGFGGTNR

SEQ ID NO: 615234 - protein, 9 aa, Homo Sapiens
QMGRYRCTL

SEQ ID NO: 615235 - protein, 9 aa, Homo Sapiens
GRATGGQRG

SEQ ID NO: 615236 - protein, 9 aa, Homo Sapiens
YKIEDMAMM

SEQ ID NO: 615237 - protein, 9 aa, Homo Sapiens
LTNTFAYYT

SEQ ID NO: 615238 - protein, 9 aa, Homo Sapiens
GGDLCYVGL

SEQ ID NO: 615239 - protein, 9 aa, Homo Sapiens
YEGPWENAK

SEQ ID NO: 615240 - protein, 9 aa, Homo Sapiens
LIREVCRIH

SEQ ID NO: 615241 - protein, 9 aa, Homo Sapiens
RQYKEVLKQ

SEQ ID NO: 615242 - protein, 9 aa, Homo Sapiens
SIYPLKTTP

SEQ ID NO: 615243 - protein, 9 aa, Homo Sapiens
FSCSFVDHD

SEQ ID NO: 615244 - protein, 9 aa, Homo Sapiens
KRSYKFTIK

SEQ ID NO: 615245 - protein, 9 aa, Homo Sapiens
WENAKSLRP

SEQ ID NO: 615246 - protein, 9 aa, Homo Sapiens
NSKNIYTES

SEQ ID NO: 615247 - protein, 9 aa, Homo Sapiens
AYLCNATNC

SEQ ID NO: 615248 - protein, 9 aa, Homo Sapiens
KSMEPFDSG

SEQ ID NO: 615249 - protein, 9 aa, Homo Sapiens
IFKAEDLLS

SEQ ID NO: 615250 - protein, 9 aa, Homo Sapiens
LSKGGHPED

SEQ ID NO: 615251 - protein, 9 aa, Homo Sapiens
VSSFLLFNT

SEQ ID NO: 615252 - protein, 9 aa, Homo Sapiens
QAISGIHDQ

SEQ ID NO: 615253 - protein, 9 aa, Homo Sapiens
RRYPHHERC

SEQ ID NO: 615254 - protein, 9 aa, Homo Sapiens
IDNALHCRE

SEQ ID NO: 615255 - protein, 9 aa, Homo Sapiens
PELSVRPSQ

SEQ ID NO: 615256 - protein, 9 aa, Homo Sapiens
ALELEGRPH

SEQ ID NO: 615257 - protein, 9 aa, Homo Sapiens
RFDKLLDLY

SEQ ID NO: 615258 - protein, 9 aa, Homo Sapiens
GEEEEKSTS

SEQ ID NO: 615259 - protein, 9 aa, Homo Sapiens
SGRATGGQR

SEQ ID NO: 615260 - protein, 9 aa, Homo Sapiens
AQSLNTDPM

SEQ ID NO: 615261 - protein, 9 aa, Homo Sapiens
DTRVLLTYK

SEQ ID NO: 615262 - protein, 9 aa, Homo Sapiens
YTYMLPSFY

SEQ ID NO: 615263 - protein, 9 aa, Homo Sapiens
RGSFTFSSN

SEQ ID NO: 615264 - protein, 9 aa, Homo Sapiens
NVDNFLAHE

SEQ ID NO: 615265 - protein, 9 aa, Homo Sapiens
TYRSEVKGV

SEQ ID NO: 615266 - protein, 9 aa, Homo Sapiens
CSTPCFKTC

SEQ ID NO: 615267 - protein, 9 aa, Homo Sapiens
ALRGGGQSA

SEQ ID NO: 615268 - protein, 9 aa, Homo Sapiens
NKGKIMVVW

SEQ ID NO: 615269 - protein, 9 aa, Homo Sapiens
GKIRYQEEE

SEQ ID NO: 615270 - protein, 9 aa, Homo Sapiens
LTQAFLLVA

SEQ ID NO: 615271 - protein, 9 aa, Homo Sapiens
LENVYGFDM

SEQ ID NO: 615272 - protein, 9 aa, Homo Sapiens
PGYGGDLCY

SEQ ID NO: 615273 - protein, 9 aa, Homo Sapiens
EDDVDSAGS

SEQ ID NO: 615274 - protein, 9 aa, Homo Sapiens
KFKFELNQS

SEQ ID NO: 615275 - protein, 9 aa, Homo Sapiens
VRRYPHHER

SEQ ID NO: 615276 - protein, 9 aa, Homo Sapiens
KRPFSCSFV

SEQ ID NO: 615277 - protein, 9 aa, Homo Sapiens
RYEPCSTPC

SEQ ID NO: 615278 - protein, 9 aa, Homo Sapiens
RMGSVELMG

SEQ ID NO: 615279 - protein, 9 aa, Homo Sapiens
RRLTSLLDR

SEQ ID NO: 615280 - protein, 9 aa, Homo Sapiens
YYCIVKVCE

SEQ ID NO: 615281 - protein, 9 aa, Homo Sapiens
GLDLPSDTD

SEQ ID NO: 615282 - protein, 9 aa, Homo Sapiens
QRGNCTFKD

SEQ ID NO: 615283 - protein, 9 aa, Homo Sapiens
RLTHQDKKL

SEQ ID NO: 615284 - protein, 9 aa, Homo Sapiens
SCHSCNGLA

SEQ ID NO: 615285 - protein, 9 aa, Homo Sapiens
PKELKRCNS

SEQ ID NO: 615286 - protein, 9 aa, Homo Sapiens
DLKPQNLLN

SEQ ID NO: 615287 - protein, 9 aa, Homo Sapiens
KKLVESTCL

SEQ ID NO: 615288 - protein, 9 aa, Homo Sapiens
HIKMYFFLR

SEQ ID NO: 615289 - protein, 9 aa, Homo Sapiens
DVPASARRR

SEQ ID NO: 615290 - protein, 9 aa, Homo Sapiens
DLYNCTERA

SEQ ID NO: 615291 - protein, 9 aa, Homo Sapiens
SYQTTGGNT

SEQ ID NO: 615292 - protein, 9 aa, Homo Sapiens
IGKNDDLPW

SEQ ID NO: 615293 - protein, 9 aa, Homo Sapiens
KHSSTLTKN

SEQ ID NO: 615294 - protein, 9 aa, Homo Sapiens
CYSHVGIVW

SEQ ID NO: 615295 - protein, 9 aa, Homo Sapiens
IVKVCEFWG

SEQ ID NO: 615296 - protein, 9 aa, Homo Sapiens
PSSPSKDCS

SEQ ID NO: 615297 - protein, 9 aa, Homo Sapiens
PCTEETRIQ

SEQ ID NO: 615298 - protein, 9 aa, Homo Sapiens
WRSVLWVEC

SEQ ID NO: 615299 - protein, 9 aa, Homo Sapiens
EEERKKTLD

SEQ ID NO: 615300 - protein, 9 aa, Homo Sapiens
TFGEVSQKY

SEQ ID NO: 615301 - protein, 9 aa, Homo Sapiens
LDLYNCTER

SEQ ID NO: 615302 - protein, 9 aa, Homo Sapiens
INEKLHHQL

SEQ ID NO: 615303 - protein, 9 aa, Homo Sapiens
TSSKSLCMG

SEQ ID NO: 615304 - protein, 9 aa, Homo Sapiens
EKLAAKTNE

SEQ ID NO: 615305 - protein, 9 aa, Homo Sapiens
GEGGKPGDE

SEQ ID NO: 615306 - protein, 9 aa, Homo Sapiens
PNSASPCSH

SEQ ID NO: 615307 - protein, 9 aa, Homo Sapiens
TNEFNRTVF

SEQ ID NO: 615308 - protein, 9 aa, Homo Sapiens
ELKRCNSSS

SEQ ID NO: 615309 - protein, 9 aa, Homo Sapiens
FSSNFMSIR

SEQ ID NO: 615310 - protein, 9 aa, Homo Sapiens
QGNEDEKEP

SEQ ID NO: 615311 - protein, 9 aa, Homo Sapiens
FPQAISGIH

SEQ ID NO: 615312 - protein, 9 aa, Homo Sapiens
NDELLLPHI

SEQ ID NO: 615313 - protein, 9 aa, Homo Sapiens
DKKLVESTC

SEQ ID NO: 615314 - protein, 9 aa, Homo Sapiens
FPMNPPKYY

SEQ ID NO: 615315 - protein, 9 aa, Homo Sapiens
KFKGRHIYT

SEQ ID NO: 615316 - protein, 9 aa, Homo Sapiens
LATMGEPLR

SEQ ID NO: 615317 - protein, 9 aa, Homo Sapiens
SVEADVILE

SEQ ID NO: 615318 - protein, 9 aa, Homo Sapiens
VIKTEHSLD

SEQ ID NO: 615319 - protein, 9 aa, Homo Sapiens
VCLYKKLEI

SEQ ID NO: 615320 - protein, 9 aa, Homo Sapiens
SDQGNEDEK

SEQ ID NO: 615321 - protein, 9 aa, Homo Sapiens
NISSVSSFL

SEQ ID NO: 615322 - protein, 9 aa, Homo Sapiens
GDEGVPGDP

SEQ ID NO: 615323 - protein, 9 aa, Homo Sapiens
SKLPTKVNH

SEQ ID NO: 615324 - protein, 9 aa, Homo Sapiens
VSSFSRPFP

SEQ ID NO: 615325 - protein, 9 aa, Homo Sapiens
CYYFSPSIK

SEQ ID NO: 615326 - protein, 9 aa, Homo Sapiens
GESTPSLLS

SEQ ID NO: 615327 - protein, 9 aa, Homo Sapiens
LDQPMFYFL

SEQ ID NO: 615328 - protein, 9 aa, Homo Sapiens
RLEFSGCYN

SEQ ID NO: 615329 - protein, 9 aa, Homo Sapiens
RSISCHSCN

SEQ ID NO: 615330 - protein, 9 aa, Homo Sapiens
QYAGNYSGG

SEQ ID NO: 615331 - protein, 9 aa, Homo Sapiens
FKFELNQSA

SEQ ID NO: 615332 - protein, 9 aa, Homo Sapiens
ILTPREYED

SEQ ID NO: 615333 - protein, 9 aa, Homo Sapiens
PRESGQRLG

SEQ ID NO: 615334 - protein, 9 aa, Homo Sapiens
ANSAISYQT

SEQ ID NO: 615335 - protein, 9 aa, Homo Sapiens
SKGGHPEDG

SEQ ID NO: 615336 - protein, 9 aa, Homo Sapiens
KWKFKGRHI

SEQ ID NO: 615337 - protein, 9 aa, Homo Sapiens
LIPLFHSRF

SEQ ID NO: 615338 - protein, 9 aa, Homo Sapiens
RLMKESRRQ

SEQ ID NO: 615339 - protein, 9 aa, Homo Sapiens
SDFSLGLTV

SEQ ID NO: 615340 - protein, 9 aa, Homo Sapiens
VRTFPQAIS

SEQ ID NO: 615341 - protein, 9 aa, Homo Sapiens
SLLDREVQA

SEQ ID NO: 615342 - protein, 9 aa, Homo Sapiens
LYSITVTKE

SEQ ID NO: 615343 - protein, 9 aa, Homo Sapiens
GELSYVLLT

SEQ ID NO: 615344 - protein, 9 aa, Homo Sapiens
NSAISYQTT

SEQ ID NO: 615345 - protein, 9 aa, Homo Sapiens
TLDERLRFE

SEQ ID NO: 615346 - protein, 9 aa, Homo Sapiens
LLSEAASLS

SEQ ID NO: 615347 - protein, 9 aa, Homo Sapiens
RYEDLLCFP

SEQ ID NO: 615348 - protein, 9 aa, Homo Sapiens
IIMKPLFES

SEQ ID NO: 615349 - protein, 9 aa, Homo Sapiens
AIQILENIS

SEQ ID NO: 615350 - protein, 9 aa, Homo Sapiens
SWAQAILLP

SEQ ID NO: 615351 - protein, 9 aa, Homo Sapiens
GLVRCLLPG

SEQ ID NO: 615352 - protein, 9 aa, Homo Sapiens
KSSIVCLYK

SEQ ID NO: 615353 - protein, 9 aa, Homo Sapiens
FVDHDYCQV

SEQ ID NO: 615354 - protein, 9 aa, Homo Sapiens
ILIQKEYLE

SEQ ID NO: 615355 - protein, 9 aa, Homo Sapiens
ITEVPLQEM

SEQ ID NO: 615356 - protein, 9 aa, Homo Sapiens
FWVLLPEHS

SEQ ID NO: 615357 - protein, 9 aa, Homo Sapiens
STLRRRENL

SEQ ID NO: 615358 - protein, 9 aa, Homo Sapiens
IAKDMERCA

SEQ ID NO: 615359 - protein, 9 aa, Homo Sapiens
LLLQLTNTF

SEQ ID NO: 615360 - protein, 9 aa, Homo Sapiens
LGLVKYGEQ

SEQ ID NO: 615361 - protein, 9 aa, Homo Sapiens
FYHTPEKDM

SEQ ID NO: 615362 - protein, 9 aa, Homo Sapiens
TSVLAIPSW

SEQ ID NO: 615363 - protein, 9 aa, Homo Sapiens
ILEEPELRL

SEQ ID NO: 615364 - protein, 9 aa, Homo Sapiens
GEQYAGNYS

SEQ ID NO: 615365 - protein, 9 aa, Homo Sapiens
KMYFFLRNF

SEQ ID NO: 615366 - protein, 9 aa, Homo Sapiens
MPQPAKSAP

SEQ ID NO: 615367 - protein, 9 aa, Homo Sapiens
VPAFWYNPS

SEQ ID NO: 615368 - protein, 9 aa, Homo Sapiens
YYNIVKTQN

SEQ ID NO: 615369 - protein, 9 aa, Homo Sapiens
KGGHPEDGN

SEQ ID NO: 615370 - protein, 9 aa, Homo Sapiens
NRLWFLLVR

SEQ ID NO: 615371 - protein, 9 aa, Homo Sapiens
LAGVLEHLN

SEQ ID NO: 615372 - protein, 9 aa, Homo Sapiens
EAPETNISV

SEQ ID NO: 615373 - protein, 9 aa, Homo Sapiens
DSKFKMPKL

SEQ ID NO: 615374 - protein, 9 aa, Homo Sapiens
LTKNKIIHT

SEQ ID NO: 615375 - protein, 9 aa, Homo Sapiens
PQSILQPHS

SEQ ID NO: 615376 - protein, 9 aa, Homo Sapiens
ISAECPYLQ

SEQ ID NO: 615377 - protein, 9 aa, Homo Sapiens
VKYGEQYAG

SEQ ID NO: 615378 - protein, 9 aa, Homo Sapiens
EDCMDVAVN

SEQ ID NO: 615379 - protein, 9 aa, Homo Sapiens
TNTFAYYTY

SEQ ID NO: 615380 - protein, 9 aa, Homo Sapiens
ALWEDYRSL

SEQ ID NO: 615381 - protein, 9 aa, Homo Sapiens
REYEDLIFD

SEQ ID NO: 615382 - protein, 9 aa, Homo Sapiens
DVRNLLPKR

SEQ ID NO: 615383 - protein, 9 aa, Homo Sapiens
LRLIPLFHS

SEQ ID NO: 615384 - protein, 9 aa, Homo Sapiens
QQYEFLDQT

SEQ ID NO: 615385 - protein, 9 aa, Homo Sapiens
LWRKFKFEL

SEQ ID NO: 615386 - protein, 9 aa, Homo Sapiens
QIFWEHKKE

SEQ ID NO: 615387 - protein, 9 aa, Homo Sapiens
YDSFTYRSE

SEQ ID NO: 615388 - protein, 9 aa, Homo Sapiens
IQKEYLERV

SEQ ID NO: 615389 - protein, 9 aa, Homo Sapiens
NFSTATVMT

SEQ ID NO: 615390 - protein, 9 aa, Homo Sapiens
NQNQHITEV

SEQ ID NO: 615391 - protein, 9 aa, Homo Sapiens
YSITVTKEF

SEQ ID NO: 615392 - protein, 9 aa, Homo Sapiens
AVYYCIVKV

SEQ ID NO: 615393 - protein, 9 aa, Homo Sapiens
LLSETVVCN

SEQ ID NO: 615394 - protein, 9 aa, Homo Sapiens
HNLHMTGIT

SEQ ID NO: 615395 - protein, 9 aa, Homo Sapiens
QENSKNIYT

SEQ ID NO: 615396 - protein, 9 aa, Homo Sapiens
VKEEPFVWP

SEQ ID NO: 615397 - protein, 9 aa, Homo Sapiens
AQFKINMKH

SEQ ID NO: 615398 - protein, 9 aa, Homo Sapiens
QRGLRGCFF

SEQ ID NO: 615399 - protein, 9 aa, Homo Sapiens
CLRPVSGRV

SEQ ID NO: 615400 - protein, 9 aa, Homo Sapiens
KDIQSVEAD

SEQ ID NO: 615401 - protein, 9 aa, Homo Sapiens
VVILEEPEL

SEQ ID NO: 615402 - protein, 9 aa, Homo Sapiens
RFRAKLQST

SEQ ID NO: 615403 - protein, 9 aa, Homo Sapiens
VRASGGELS

SEQ ID NO: 615404 - protein, 9 aa, Homo Sapiens
SILGLLGLL

SEQ ID NO: 615405 - protein, 9 aa, Homo Sapiens
GETSVLAIP

SEQ ID NO: 615406 - protein, 9 aa, Homo Sapiens
PSQLEDGHT

SEQ ID NO: 615407 - protein, 9 aa, Homo Sapiens
FGPVSDVKM

SEQ ID NO: 615408 - protein, 9 aa, Homo Sapiens
DVDSAGSLF

SEQ ID NO: 615409 - protein, 9 aa, Homo Sapiens
LPLRCHFLL

SEQ ID NO: 615410 - protein, 9 aa, Homo Sapiens
DIQCSPTRQ

SEQ ID NO: 615411 - protein, 9 aa, Homo Sapiens
TKVKEEPFV

SEQ ID NO: 615412 - protein, 9 aa, Homo Sapiens
LPRYSGICT

SEQ ID NO: 615413 - protein, 9 aa, Homo Sapiens
HVGIVWAQT

SEQ ID NO: 615414 - protein, 9 aa, Homo Sapiens
RIHVRIAEA

SEQ ID NO: 615415 - protein, 9 aa, Homo Sapiens
QACAKLSLW

SEQ ID NO: 615416 - protein, 9 aa, Homo Sapiens
SLAVKCLKP

SEQ ID NO: 615417 - protein, 9 aa, Homo Sapiens
FSTATVMTL

SEQ ID NO: 615418 - protein, 9 aa, Homo Sapiens
VTLWKTMTL

SEQ ID NO: 615419 - protein, 9 aa, Homo Sapiens
NDDKGTIKL

SEQ ID NO: 615420 - protein, 9 aa, Homo Sapiens
PQPAKSAPA

SEQ ID NO: 615421 - protein, 9 aa, Homo Sapiens
CDRCHMLCH

SEQ ID NO: 615422 - protein, 9 aa, Homo Sapiens
TSETTAMFQ

SEQ ID NO: 615423 - protein, 9 aa, Homo Sapiens
DRLMKESRR

SEQ ID NO: 615424 - protein, 9 aa, Homo Sapiens
GRNNGMPLR

SEQ ID NO: 615425 - protein, 9 aa, Homo Sapiens
QPPKEDGDY

SEQ ID NO: 615426 - protein, 9 aa, Homo Sapiens
AASIDPWWV

SEQ ID NO: 615427 - protein, 9 aa, Homo Sapiens
EHSLDQPMF

SEQ ID NO: 615428 - protein, 9 aa, Homo Sapiens
VKTQNQNQH

SEQ ID NO: 615429 - protein, 9 aa, Homo Sapiens
AKDMERCAR

SEQ ID NO: 615430 - protein, 9 aa, Homo Sapiens
PSGKTVSLA

SEQ ID NO: 615431 - protein, 9 aa, Homo Sapiens
PSDTDLRIL

SEQ ID NO: 615432 - protein, 9 aa, Homo Sapiens
KLKSEVVSL

SEQ ID NO: 615433 - protein, 9 aa, Homo Sapiens
ARRRGARTS

SEQ ID NO: 615434 - protein, 9 aa, Homo Sapiens
PQYYPRSNS

SEQ ID NO: 615435 - protein, 9 aa, Homo Sapiens
RSEVKGVYQ

SEQ ID NO: 615436 - protein, 9 aa, Homo Sapiens
LSSATGDEK

SEQ ID NO: 615437 - protein, 9 aa, Homo Sapiens
QLTNTFAYY

SEQ ID NO: 615438 - protein, 9 aa, Homo Sapiens
SEVVSLPVT

SEQ ID NO: 615439 - protein, 9 aa, Homo Sapiens
SARRRGART

SEQ ID NO: 615440 - protein, 9 aa, Homo Sapiens
QSANALAFG

SEQ ID NO: 615441 - protein, 9 aa, Homo Sapiens
EASQLFKDK

SEQ ID NO: 615442 - protein, 9 aa, Homo Sapiens
LPQYIESLT

SEQ ID NO: 615443 - protein, 9 aa, Homo Sapiens
KSGVINLKD

SEQ ID NO: 615444 - protein, 9 aa, Homo Sapiens
HIKKIDGML

SEQ ID NO: 615445 - protein, 9 aa, Homo Sapiens
VSSVTDFLS

SEQ ID NO: 615446 - protein, 9 aa, Homo Sapiens
KAFFRSSKL

SEQ ID NO: 615447 - protein, 9 aa, Homo Sapiens
SCSFVDHDY

SEQ ID NO: 615448 - protein, 9 aa, Homo Sapiens
QDKKLVEST

SEQ ID NO: 615449 - protein, 9 aa, Homo Sapiens
EQVKPMAGD

SEQ ID NO: 615450 - protein, 9 aa, Homo Sapiens
IRPNFKGPL

SEQ ID NO: 615451 - protein, 9 aa, Homo Sapiens
LLPHIKKID

SEQ ID NO: 615452 - protein, 9 aa, Homo Sapiens
CLYSITVTK

SEQ ID NO: 615453 - protein, 9 aa, Homo Sapiens
EWPVSSFSR

SEQ ID NO: 615454 - protein, 9 aa, Homo Sapiens
LCHYTDACT

SEQ ID NO: 615455 - protein, 9 aa, Homo Sapiens
SSILGLLGL

SEQ ID NO: 615456 - protein, 9 aa, Homo Sapiens
LPSFYHTPE

SEQ ID NO: 615457 - protein, 9 aa, Homo Sapiens
KLAAKTNEF

SEQ ID NO: 615458 - protein, 9 aa, Homo Sapiens
FWIFSIIMK

SEQ ID NO: 615459 - protein, 9 aa, Homo Sapiens
ISDLWRKFK

SEQ ID NO: 615460 - protein, 9 aa, Homo Sapiens
VKWKFKGRH

SEQ ID NO: 615461 - protein, 9 aa, Homo Sapiens
PRYSGICTK

SEQ ID NO: 615462 - protein, 9 aa, Homo Sapiens
WIMMATSWI

SEQ ID NO: 615463 - protein, 9 aa, Homo Sapiens
PYRAPSDTG

SEQ ID NO: 615464 - protein, 9 aa, Homo Sapiens
VQRAQVRIE

SEQ ID NO: 615465 - protein, 9 aa, Homo Sapiens
WIFSIIMKP

SEQ ID NO: 615466 - protein, 9 aa, Homo Sapiens
QRAQVRIED

SEQ ID NO: 615467 - protein, 9 aa, Homo Sapiens
DDLPWPPLR

SEQ ID NO: 615468 - protein, 9 aa, Homo Sapiens
GRYRCTLEN

SEQ ID NO: 615469 - protein, 9 aa, Homo Sapiens
QEAPETNIS

SEQ ID NO: 615470 - protein, 9 aa, Homo Sapiens
EGRPHLLLA

SEQ ID NO: 615471 - protein, 9 aa, Homo Sapiens
QDFWVLLPE

SEQ ID NO: 615472 - protein, 9 aa, Homo Sapiens
TTAMFQDED

SEQ ID NO: 615473 - protein, 9 aa, Homo Sapiens
LMGSGIERM

SEQ ID NO: 615474 - protein, 9 aa, Homo Sapiens
LLCFPGWAL

SEQ ID NO: 615475 - protein, 9 aa, Homo Sapiens
NTLLSETVV

SEQ ID NO: 615476 - protein, 9 aa, Homo Sapiens
RGELQLINI

SEQ ID NO: 615477 - protein, 9 aa, Homo Sapiens
LVNVSCNIF

SEQ ID NO: 615478 - protein, 9 aa, Homo Sapiens
SLLCDNIEA

SEQ ID NO: 615479 - protein, 9 aa, Homo Sapiens
YVAILHRFR

SEQ ID NO: 615480 - protein, 9 aa, Homo Sapiens
VVGEAGGKQ

SEQ ID NO: 615481 - protein, 9 aa, Homo Sapiens
RNNGMPLRA

SEQ ID NO: 615482 - protein, 9 aa, Homo Sapiens
MYHDYIRQY

SEQ ID NO: 615483 - protein, 9 aa, Homo Sapiens
RENLRLDQL

SEQ ID NO: 615484 - protein, 9 aa, Homo Sapiens
NIVKTQNQN

SEQ ID NO: 615485 - protein, 9 aa, Homo Sapiens
CTEETRIQL

SEQ ID NO: 615486 - protein, 9 aa, Homo Sapiens
HRHLSVGAP

SEQ ID NO: 615487 - protein, 9 aa, Homo Sapiens
GGGGWGHPS

SEQ ID NO: 615488 - protein, 9 aa, Homo Sapiens
LFDDSDIQC

SEQ ID NO: 615489 - protein, 9 aa, Homo Sapiens
WKTMTLQQQ

SEQ ID NO: 615490 - protein, 9 aa, Homo Sapiens
RLHIKMYFF

SEQ ID NO: 615491 - protein, 9 aa, Homo Sapiens
EGGKPGDEG

SEQ ID NO: 615492 - protein, 9 aa, Homo Sapiens
GSYKCVCNQ

SEQ ID NO: 615493 - protein, 9 aa, Homo Sapiens
EEKNVYTEI

SEQ ID NO: 615494 - protein, 9 aa, Homo Sapiens
HGNSLFPRE

SEQ ID NO: 615495 - protein, 9 aa, Homo Sapiens
LTLSPGDSA

SEQ ID NO: 615496 - protein, 9 aa, Homo Sapiens
TAYVDDRGQ

SEQ ID NO: 615497 - protein, 9 aa, Homo Sapiens
SMEPFDSGL

SEQ ID NO: 615498 - protein, 9 aa, Homo Sapiens
RVVILEEPE

SEQ ID NO: 615499 - protein, 9 aa, Homo Sapiens
ESATDPPAQ

SEQ ID NO: 615500 - protein, 9 aa, Homo Sapiens
GYLEQVKPM

SEQ ID NO: 615501 - protein, 9 aa, Homo Sapiens
LKEWMEYEL

SEQ ID NO: 615502 - protein, 9 aa, Homo Sapiens
ARTFKQRRM

SEQ ID NO: 615503 - protein, 9 aa, Homo Sapiens
TGAGPWLIE

SEQ ID NO: 615504 - protein, 9 aa, Homo Sapiens
YIDPRCSVS

SEQ ID NO: 615505 - protein, 9 aa, Homo Sapiens
IRQACDFHQ

SEQ ID NO: 615506 - protein, 9 aa, Homo Sapiens
DSRMFFTDN

SEQ ID NO: 615507 - protein, 9 aa, Homo Sapiens
KEGDNHYFT

SEQ ID NO: 615508 - protein, 9 aa, Homo Sapiens
HWLENVYGF

SEQ ID NO: 615509 - protein, 9 aa, Homo Sapiens
ARTSLRSSS

SEQ ID NO: 615510 - protein, 9 aa, Homo Sapiens
RCNSSSSMS

SEQ ID NO: 615511 - protein, 9 aa, Homo Sapiens
EDDEKPDQR

SEQ ID NO: 615512 - protein, 9 aa, Homo Sapiens
EKEPKEVSS

SEQ ID NO: 615513 - protein, 9 aa, Homo Sapiens
KTYRCQCIE

SEQ ID NO: 615514 - protein, 9 aa, Homo Sapiens
TRVLLTYKY

SEQ ID NO: 615515 - protein, 9 aa, Homo Sapiens
DQPMFYFLA

SEQ ID NO: 615516 - protein, 9 aa, Homo Sapiens
MIKSGVINL

SEQ ID NO: 615517 - protein, 9 aa, Homo Sapiens
CTNPVKVPW

SEQ ID NO: 615518 - protein, 9 aa, Homo Sapiens
LPSDTDLRI

SEQ ID NO: 615519 - protein, 9 aa, Homo Sapiens
LDKLIFQEA

SEQ ID NO: 615520 - protein, 9 aa, Homo Sapiens
VRNLLPKRS

SEQ ID NO: 615521 - protein, 9 aa, Homo Sapiens
SSSILGLLG

SEQ ID NO: 615522 - protein, 9 aa, Homo Sapiens
QQNEEDAWI

SEQ ID NO: 615523 - protein, 9 aa, Homo Sapiens
FSPSIKSWD

SEQ ID NO: 615524 - protein, 9 aa, Homo Sapiens
SSHGNSLFP

SEQ ID NO: 615525 - protein, 9 aa, Homo Sapiens
TQNPCPSLK

SEQ ID NO: 615526 - protein, 9 aa, Homo Sapiens
DSFTYRSEV

SEQ ID NO: 615527 - protein, 9 aa, Homo Sapiens
PYNTLLSET

SEQ ID NO: 615528 - protein, 9 aa, Homo Sapiens
KRQAMKELQ

SEQ ID NO: 615529 - protein, 9 aa, Homo Sapiens
YVLSKGGHP

SEQ ID NO: 615530 - protein, 9 aa, Homo Sapiens
ERCARSLNK

SEQ ID NO: 615531 - protein, 9 aa, Homo Sapiens
RKECLTNFM

SEQ ID NO: 615532 - protein, 9 aa, Homo Sapiens
EVVSLPVTC

SEQ ID NO: 615533 - protein, 9 aa, Homo Sapiens
FDDSDIQCS

SEQ ID NO: 615534 - protein, 9 aa, Homo Sapiens
SMALWEDYR

SEQ ID NO: 615535 - protein, 9 aa, Homo Sapiens
RFSSQGGQR

SEQ ID NO: 615536 - protein, 9 aa, Homo Sapiens
GIVWAQTYA

SEQ ID NO: 615537 - protein, 9 aa, Homo Sapiens
SKNIYTESR

SEQ ID NO: 615538 - protein, 9 aa, Homo Sapiens
FPKSSDDLM

SEQ ID NO: 615539 - protein, 9 aa, Homo Sapiens
ESPIYMCVD

SEQ ID NO: 615540 - protein, 9 aa, Homo Sapiens
KKTLDERLR

SEQ ID NO: 615541 - protein, 9 aa, Homo Sapiens
DNHYFTCIT

SEQ ID NO: 615542 - protein, 9 aa, Homo Sapiens
GGPKGKSSS

SEQ ID NO: 615543 - protein, 9 aa, Homo Sapiens
FNCATFALK

SEQ ID NO: 615544 - protein, 9 aa, Homo Sapiens
SQLEDGHTA

SEQ ID NO: 615545 - protein, 9 aa, Homo Sapiens
SLGLTVQFS

SEQ ID NO: 615546 - protein, 9 aa, Homo Sapiens
YSMALWEDY

SEQ ID NO: 615547 - protein, 9 aa, Homo Sapiens
NPNCEKMFD

SEQ ID NO: 615548 - protein, 9 aa, Homo Sapiens
WKGSESATD

SEQ ID NO: 615549 - protein, 9 aa, Homo Sapiens
QVMHCSACS

SEQ ID NO: 615550 - protein, 9 aa, Homo Sapiens
DPRCSVSTV

SEQ ID NO: 615551 - protein, 9 aa, Homo Sapiens
ARLNQHQRV

SEQ ID NO: 615552 - protein, 9 aa, Homo Sapiens
TSEKCDWKV

SEQ ID NO: 615553 - protein, 9 aa, Homo Sapiens
RQAMKELQK

SEQ ID NO: 615554 - protein, 9 aa, Homo Sapiens
IQSVEADVI

SEQ ID NO: 615555 - protein, 9 aa, Homo Sapiens
DAEFYLTLP

SEQ ID NO: 615556 - protein, 9 aa, Homo Sapiens
HQDKKLVES

SEQ ID NO: 615557 - protein, 9 aa, Homo Sapiens
SQGASALWR

SEQ ID NO: 615558 - protein, 9 aa, Homo Sapiens
TNPVKVPWE

SEQ ID NO: 615559 - protein, 9 aa, Homo Sapiens
SANALAFGN

SEQ ID NO: 615560 - protein, 9 aa, Homo Sapiens
FKMPKLKMP

SEQ ID NO: 615561 - protein, 9 aa, Homo Sapiens
QSVLNVVGE

SEQ ID NO: 615562 - protein, 9 aa, Homo Sapiens
ADLRQACAK

SEQ ID NO: 615563 - protein, 9 aa, Homo Sapiens
RLRGGKIRY

SEQ ID NO: 615564 - protein, 9 aa, Homo Sapiens
LPTKVNHVP

SEQ ID NO: 615565 - protein, 9 aa, Homo Sapiens
VYYPPRVVI

SEQ ID NO: 615566 - protein, 9 aa, Homo Sapiens
LNQHQRVQT

SEQ ID NO: 615567 - protein, 9 aa, Homo Sapiens
NQHQRVQTG

SEQ ID NO: 615568 - protein, 9 aa, Homo Sapiens
EKKKKEHRR

SEQ ID NO: 615569 - protein, 9 aa, Homo Sapiens
ASYRDLLIK

SEQ ID NO: 615570 - protein, 9 aa, Homo Sapiens
RPKSQVVKN

SEQ ID NO: 615571 - protein, 9 aa, Homo Sapiens
QGRYYTLTG

SEQ ID NO: 615572 - protein, 9 aa, Homo Sapiens
EWRYEPCST

SEQ ID NO: 615573 - protein, 9 aa, Homo Sapiens
EAYLCNATN

SEQ ID NO: 615574 - protein, 9 aa, Homo Sapiens
VPESCNLRL

SEQ ID NO: 615575 - protein, 9 aa, Homo Sapiens
HSTPLGAYG

SEQ ID NO: 615576 - protein, 9 aa, Homo Sapiens
DDSDIQCSP

SEQ ID NO: 615577 - protein, 9 aa, Homo Sapiens
PIVRASGGE

SEQ ID NO: 615578 - protein, 9 aa, Homo Sapiens
VAGYIRQAC

SEQ ID NO: 615579 - protein, 9 aa, Homo Sapiens
FSSQGGQRG

SEQ ID NO: 615580 - protein, 9 aa, Homo Sapiens
RRLEFSGCY

SEQ ID NO: 615581 - protein, 9 aa, Homo Sapiens
GFGGTNRLN

SEQ ID NO: 615582 - protein, 9 aa, Homo Sapiens
SFVDHDYCQ

SEQ ID NO: 615583 - protein, 9 aa, Homo Sapiens
GRGNWDEDS

SEQ ID NO: 615584 - protein, 9 aa, Homo Sapiens
TRIQLQKGE

SEQ ID NO: 615585 - protein, 9 aa, Homo Sapiens
LELEGRPHL

SEQ ID NO: 615586 - protein, 9 aa, Homo Sapiens
GVFQLQLRE

SEQ ID NO: 615587 - protein, 9 aa, Homo Sapiens
KLSLWDHGA

SEQ ID NO: 615588 - protein, 9 aa, Homo Sapiens
NSLFPRESG

SEQ ID NO: 615589 - protein, 9 aa, Homo Sapiens
APVIQPPKE

SEQ ID NO: 615590 - protein, 9 aa, Homo Sapiens
WWVPTGATV

SEQ ID NO: 615591 - protein, 9 aa, Homo Sapiens
IMKPLFESF

SEQ ID NO: 615592 - protein, 9 aa, Homo Sapiens
MIIMVIVFL

SEQ ID NO: 615593 - protein, 9 aa, Homo Sapiens
YYPRSNSES

SEQ ID NO: 615594 - protein, 9 aa, Homo Sapiens
GARTSLRSS

SEQ ID NO: 615595 - protein, 9 aa, Homo Sapiens
PVSGRNYPG

SEQ ID NO: 615596 - protein, 9 aa, Homo Sapiens
SALPQYIES

SEQ ID NO: 615597 - protein, 9 aa, Homo Sapiens
TSPCTEETR

SEQ ID NO: 615598 - protein, 9 aa, Homo Sapiens
LQLINIFQS

SEQ ID NO: 615599 - protein, 9 aa, Homo Sapiens
IDDRKECLT

SEQ ID NO: 615600 - protein, 9 aa, Homo Sapiens
GQSANALAF

SEQ ID NO: 615601 - protein, 9 aa, Homo Sapiens
VTKEFVVFG

SEQ ID NO: 615602 - protein, 9 aa, Homo Sapiens
LCDNIEADH

SEQ ID NO: 615603 - protein, 9 aa, Homo Sapiens
SDTDLRILG

SEQ ID NO: 615604 - protein, 9 aa, Homo Sapiens
LLSPSSTET

SEQ ID NO: 615605 - protein, 9 aa, Homo Sapiens
PPAGAISTK

SEQ ID NO: 615606 - protein, 9 aa, Homo Sapiens
LFEDDVDSA

SEQ ID NO: 615607 - protein, 9 aa, Homo Sapiens
SCNLRLCTL

SEQ ID NO: 615608 - protein, 9 aa, Homo Sapiens
LEGRPHLLL

SEQ ID NO: 615609 - protein, 9 aa, Homo Sapiens
VSQKYNVLF

SEQ ID NO: 615610 - protein, 9 aa, Homo Sapiens
CQGRYYTLT

SEQ ID NO: 615611 - protein, 9 aa, Homo Sapiens
GAYMTSLTA

SEQ ID NO: 615612 - protein, 9 aa, Homo Sapiens
TRESPIYMC

SEQ ID NO: 615613 - protein, 9 aa, Homo Sapiens
KLIFQEAPE

SEQ ID NO: 615614 - protein, 9 aa, Homo Sapiens
FTIEELKEW

SEQ ID NO: 615615 - protein, 9 aa, Homo Sapiens
CIDILIQKE

SEQ ID NO: 615616 - protein, 9 aa, Homo Sapiens
IYDVPGILH

SEQ ID NO: 615617 - protein, 9 aa, Homo Sapiens
IGKKLYRCD

SEQ ID NO: 615618 - protein, 9 aa, Homo Sapiens
CYNTSEKCD

SEQ ID NO: 615619 - protein, 9 aa, Homo Sapiens
SIIMKPLFE

SEQ ID NO: 615620 - protein, 9 aa, Homo Sapiens
PENNSKGLL

SEQ ID NO: 615621 - protein, 9 aa, Homo Sapiens
PFSALLQQY

SEQ ID NO: 615622 - protein, 9 aa, Homo Sapiens
GARGSFTFS

SEQ ID NO: 615623 - protein, 9 aa, Homo Sapiens
AEDLLSEAA

SEQ ID NO: 615624 - protein, 9 aa, Homo Sapiens
YHDYIRQYK

SEQ ID NO: 615625 - protein, 9 aa, Homo Sapiens
PVIQPPKED

SEQ ID NO: 615626 - protein, 9 aa, Homo Sapiens
DIDNALHCR

SEQ ID NO: 615627 - protein, 9 aa, Homo Sapiens
TDTVYTINK

SEQ ID NO: 615628 - protein, 9 aa, Homo Sapiens
YRCQCIECK

SEQ ID NO: 615629 - protein, 9 aa, Homo Sapiens
NECGKAFFR

SEQ ID NO: 615630 - protein, 9 aa, Homo Sapiens
YPRSNSESS

SEQ ID NO: 615631 - protein, 9 aa, Homo Sapiens
RRRWRSVLW

SEQ ID NO: 615632 - protein, 9 aa, Homo Sapiens
GHRQKHLNV

SEQ ID NO: 615633 - protein, 9 aa, Homo Sapiens
FDKLLDLYN

SEQ ID NO: 615634 - protein, 9 aa, Homo Sapiens
DRKECLTNF

SEQ ID NO: 615635 - protein, 9 aa, Homo Sapiens
PPSLGPQYY

SEQ ID NO: 615636 - protein, 9 aa, Homo Sapiens
SGKTVSLAV

SEQ ID NO: 615637 - protein, 9 aa, Homo Sapiens
QSSSILGLL

SEQ ID NO: 615638 - protein, 9 aa, Homo Sapiens
HQLAEKKQQ

SEQ ID NO: 615639 - protein, 9 aa, Homo Sapiens
QHQRVQTGE

SEQ ID NO: 615640 - protein, 9 aa, Homo Sapiens
TEVVRRYPH

SEQ ID NO: 615641 - protein, 9 aa, Homo Sapiens
WLWSQQKEV

SEQ ID NO: 615642 - protein, 9 aa, Homo Sapiens
ARVFDRQSA

SEQ ID NO: 615643 - protein, 9 aa, Homo Sapiens
MVIVFLVLL

SEQ ID NO: 615644 - protein, 9 aa, Homo Sapiens
SSTLTKNKI

SEQ ID NO: 615645 - protein, 9 aa, Homo Sapiens
LTKTWLSSA

SEQ ID NO: 615646 - protein, 9 aa, Homo Sapiens
RQHHNLHMT

SEQ ID NO: 615647 - protein, 9 aa, Homo Sapiens
KVCEFWGLP

SEQ ID NO: 615648 - protein, 9 aa, Homo Sapiens
GYIRQACDF

SEQ ID NO: 615649 - protein, 9 aa, Homo Sapiens
FAEEEPLLV

SEQ ID NO: 615650 - protein, 9 aa, Homo Sapiens
ATAQFKINM

SEQ ID NO: 615651 - protein, 9 aa, Homo Sapiens
NLNVRTFPQ

SEQ ID NO: 615652 - protein, 9 aa, Homo Sapiens
YLPLAGVLE

SEQ ID NO: 615653 - protein, 9 aa, Homo Sapiens
TMLTKTWLS

SEQ ID NO: 615654 - protein, 9 aa, Homo Sapiens
SHRHLSVGA

SEQ ID NO: 615655 - protein, 9 aa, Homo Sapiens
FQDEDISSD

SEQ ID NO: 615656 - protein, 9 aa, Homo Sapiens
SQLFKDKKA

SEQ ID NO: 615657 - protein, 9 aa, Homo Sapiens
HSCNGLADG

SEQ ID NO: 615658 - protein, 9 aa, Homo Sapiens
YPHHERCSD

SEQ ID NO: 615659 - protein, 9 aa, Homo Sapiens
WRHHRRGSP

SEQ ID NO: 615660 - protein, 9 aa, Homo Sapiens
DTVYTINKE

SEQ ID NO: 615661 - protein, 9 aa, Homo Sapiens
RERQGFSEG

SEQ ID NO: 615662 - protein, 9 aa, Homo Sapiens
TLRRRENLR

SEQ ID NO: 615663 - protein, 9 aa, Homo Sapiens
TEDGSLVTL

SEQ ID NO: 615664 - protein, 9 aa, Homo Sapiens
CLTNFMEDR

SEQ ID NO: 615665 - protein, 9 aa, Homo Sapiens
PSIKSWDEA

SEQ ID NO: 615666 - protein, 9 aa, Homo Sapiens
GGGRSRFSS

SEQ ID NO: 615667 - protein, 9 aa, Homo Sapiens
LIQKEYLER

SEQ ID NO: 615668 - protein, 9 aa, Homo Sapiens
NCLNLQVFM

SEQ ID NO: 615669 - protein, 9 aa, Homo Sapiens
TEVPLQEMI

SEQ ID NO: 615670 - protein, 9 aa, Homo Sapiens
LLVRPGALA

SEQ ID NO: 615671 - protein, 9 aa, Homo Sapiens
YAVGGFGGT

SEQ ID NO: 615672 - protein, 9 aa, Homo Sapiens
KSQVVKNTM

SEQ ID NO: 615673 - protein, 9 aa, Homo Sapiens
ISYQTTGGN

SEQ ID NO: 615674 - protein, 9 aa, Homo Sapiens
ASIDPWWVP

SEQ ID NO: 615675 - protein, 9 aa, Homo Sapiens
FEPCPENNS

SEQ ID NO: 615676 - protein, 9 aa, Homo Sapiens
HVGQAGLQL

SEQ ID NO: 615677 - protein, 9 aa, Homo Sapiens
HGRGNWDED

SEQ ID NO: 615678 - protein, 9 aa, Homo Sapiens
NPSSPSKDC

SEQ ID NO: 615679 - protein, 9 aa, Homo Sapiens
TSSHFPPSS

SEQ ID NO: 615680 - protein, 9 aa, Homo Sapiens
AGAISTKQE

SEQ ID NO: 615681 - protein, 9 aa, Homo Sapiens
KVNHVPSGP

SEQ ID NO: 615682 - protein, 9 aa, Homo Sapiens
FDSGLYQCI

SEQ ID NO: 615683 - protein, 9 aa, Homo Sapiens
TVSCEMKNK

SEQ ID NO: 615684 - protein, 9 aa, Homo Sapiens
YRAPSDTGS

SEQ ID NO: 615685 - protein, 9 aa, Homo Sapiens
PLVNVSCNI

SEQ ID NO: 615686 - protein, 9 aa, Homo Sapiens
MKLQIQVDK

SEQ ID NO: 615687 - protein, 9 aa, Homo Sapiens
HEMIKSGVI

SEQ ID NO: 615688 - protein, 9 aa, Homo Sapiens
NQNFQERNN

SEQ ID NO: 615689 - protein, 9 aa, Homo Sapiens
GGTNRLNSA

SEQ ID NO: 615690 - protein, 9 aa, Homo Sapiens
KLKMPSFGV

SEQ ID NO: 615691 - protein, 9 aa, Homo Sapiens
LRERQGFSE

SEQ ID NO: 615692 - protein, 9 aa, Homo Sapiens
FLLFNTTEN

SEQ ID NO: 615693 - protein, 9 aa, Homo Sapiens
LSELAVEVK

SEQ ID NO: 615694 - protein, 9 aa, Homo Sapiens
VKTYRCQCI

SEQ ID NO: 615695 - protein, 9 aa, Homo Sapiens
EGGWRHHRR

SEQ ID NO: 615696 - protein, 9 aa, Homo Sapiens
EFYLTLPGT

SEQ ID NO: 615697 - protein, 9 aa, Homo Sapiens
DELLLPHIK

SEQ ID NO: 615698 - protein, 9 aa, Homo Sapiens
NKKMEDAEF

SEQ ID NO: 615699 - protein, 9 aa, Homo Sapiens
ACDFHQVII

SEQ ID NO: 615700 - protein, 9 aa, Homo Sapiens
MEPFDSGLY

SEQ ID NO: 615701 - protein, 9 aa, Homo Sapiens
GAVGVGKSA

SEQ ID NO: 615702 - protein, 9 aa, Homo Sapiens
NILENKESW

SEQ ID NO: 615703 - protein, 9 aa, Homo Sapiens
GGRSRFSSQ

SEQ ID NO: 615704 - protein, 9 aa, Homo Sapiens
NMGIGKNDD

SEQ ID NO: 615705 - protein, 9 aa, Homo Sapiens
ILDRGFHPS

SEQ ID NO: 615706 - protein, 9 aa, Homo Sapiens
RGPGPEGGW

SEQ ID NO: 615707 - protein, 9 aa, Homo Sapiens
PCSHRHLSV

SEQ ID NO: 615708 - protein, 9 aa, Homo Sapiens
YEFLDQTEV

SEQ ID NO: 615709 - protein, 9 aa, Homo Sapiens
DFKIHWLEN

SEQ ID NO: 615710 - protein, 9 aa, Homo Sapiens
SFGPVSDVK

SEQ ID NO: 615711 - protein, 9 aa, Homo Sapiens
QIPTEDGSL

SEQ ID NO: 615712 - protein, 9 aa, Homo Sapiens
CLSELAVEV

SEQ ID NO: 615713 - protein, 9 aa, Homo Sapiens
KRCNSSSSM

SEQ ID NO: 615714 - protein, 9 aa, Homo Sapiens
PLCLMNHNK

SEQ ID NO: 615715 - protein, 9 aa, Homo Sapiens
YMCVDSPPP

SEQ ID NO: 615716 - protein, 9 aa, Homo Sapiens
PRPVLNSWA

SEQ ID NO: 615717 - protein, 9 aa, Homo Sapiens
IDPRCSVST

SEQ ID NO: 615718 - protein, 9 aa, Homo Sapiens
HPSSPVLHE

SEQ ID NO: 615719 - protein, 9 aa, Homo Sapiens
SITVTKEFV

SEQ ID NO: 615720 - protein, 9 aa, Homo Sapiens
CTDIDNALH

SEQ ID NO: 615721 - protein, 9 aa, Homo Sapiens
VCNQNFQER

SEQ ID NO: 615722 - protein, 9 aa, Homo Sapiens
LEFSGCYNI

SEQ ID NO: 615723 - protein, 9 aa, Homo Sapiens
KKLYRCDEV

SEQ ID NO: 615724 - protein, 9 aa, Homo Sapiens
EEEPLLVLS

SEQ ID NO: 615725 - protein, 9 aa, Homo Sapiens
CTFKDKISR

SEQ ID NO: 615726 - protein, 9 aa, Homo Sapiens
SSERQHHNL

SEQ ID NO: 615727 - protein, 9 aa, Homo Sapiens
VILEEPELR

SEQ ID NO: 615728 - protein, 9 aa, Homo Sapiens
SAECPYLQT

SEQ ID NO: 615729 - protein, 9 aa, Homo Sapiens
VGSHMQQSS

SEQ ID NO: 615730 - protein, 9 aa, Homo Sapiens
KEWPVSSFS

SEQ ID NO: 615731 - protein, 9 aa, Homo Sapiens
GQRGLRGCF

SEQ ID NO: 615732 - protein, 9 aa, Homo Sapiens
TGGQRGLRG

SEQ ID NO: 615733 - protein, 9 aa, Homo Sapiens
ASPCSHRHL

SEQ ID NO: 615734 - protein, 9 aa, Homo Sapiens
VWWAQQFLA

SEQ ID NO: 615735 - protein, 9 aa, Homo Sapiens
QSLNTDPML

SEQ ID NO: 615736 - protein, 9 aa, Homo Sapiens
LLGDSRMFF

SEQ ID NO: 615737 - protein, 9 aa, Homo Sapiens
SRLRRRWRS

SEQ ID NO: 615738 - protein, 9 aa, Homo Sapiens
VGEAGGKQK

SEQ ID NO: 615739 - protein, 9 aa, Homo Sapiens
HSLGLTLSP

SEQ ID NO: 615740 - protein, 9 aa, Homo Sapiens
SSQGGQRGR

SEQ ID NO: 615741 - protein, 9 aa, Homo Sapiens
GPKGKSSSR

SEQ ID NO: 615742 - protein, 9 aa, Homo Sapiens
ETTAMFQDE

SEQ ID NO: 615743 - protein, 9 aa, Homo Sapiens
RPNFKGPLV

SEQ ID NO: 615744 - protein, 9 aa, Homo Sapiens
LMKESRRQK

SEQ ID NO: 615745 - protein, 9 aa, Homo Sapiens
LGFLCLSEL

SEQ ID NO: 615746 - protein, 9 aa, Homo Sapiens
DRMGSVELM

SEQ ID NO: 615747 - protein, 9 aa, Homo Sapiens
FTSPCTEET

SEQ ID NO: 615748 - protein, 9 aa, Homo Sapiens
CIVKVCEFW

SEQ ID NO: 615749 - protein, 9 aa, Homo Sapiens
SGLGYLEQV

SEQ ID NO: 615750 - protein, 9 aa, Homo Sapiens
LQLREFINE

SEQ ID NO: 615751 - protein, 9 aa, Homo Sapiens
SGICTKDRC

SEQ ID NO: 615752 - protein, 9 aa, Homo Sapiens
SLCMGNSTH

SEQ ID NO: 615753 - protein, 9 aa, Homo Sapiens
EKCDWKVDC

SEQ ID NO: 615754 - protein, 9 aa, Homo Sapiens
DHVEDCMDV

SEQ ID NO: 615755 - protein, 9 aa, Homo Sapiens
PTKVNHVPS

SEQ ID NO: 615756 - protein, 9 aa, Homo Sapiens
STRRHKAFS

SEQ ID NO: 615757 - protein, 9 aa, Homo Sapiens
FFRSSKLIQ

SEQ ID NO: 615758 - protein, 9 aa, Homo Sapiens
DLATMGEPL

SEQ ID NO: 615759 - protein, 9 aa, Homo Sapiens
WLPRYSGIC

SEQ ID NO: 615760 - protein, 9 aa, Homo Sapiens
ELLAACTEE

SEQ ID NO: 615761 - protein, 9 aa, Homo Sapiens
LHCQGRYYT

SEQ ID NO: 615762 - protein, 9 aa, Homo Sapiens
VLAIPSWRD

SEQ ID NO: 615763 - protein, 9 aa, Homo Sapiens
PSSTRRHKA

SEQ ID NO: 615764 - protein, 9 aa, Homo Sapiens
MERCARSLN

SEQ ID NO: 615765 - protein, 9 aa, Homo Sapiens
AEVQRAQVR

SEQ ID NO: 615766 - protein, 9 aa, Homo Sapiens
LYAVGGFGG

SEQ ID NO: 615767 - protein, 9 aa, Homo Sapiens
PVKVPWECC

SEQ ID NO: 615768 - protein, 9 aa, Homo Sapiens
LFHSRFSQY

SEQ ID NO: 615769 - protein, 9 aa, Homo Sapiens
QYDSFTYRS

SEQ ID NO: 615770 - protein, 9 aa, Homo Sapiens
CMDVAVNLL

SEQ ID NO: 615771 - protein, 9 aa, Homo Sapiens
GGWRHHRRG

SEQ ID NO: 615772 - protein, 9 aa, Homo Sapiens
TPLGAYGSV

SEQ ID NO: 615773 - protein, 9 aa, Homo Sapiens
FVPIDLDVW

SEQ ID NO: 615774 - protein, 9 aa, Homo Sapiens
SIYFEAYLC

SEQ ID NO: 615775 - protein, 9 aa, Homo Sapiens
EFSGCYNIS

SEQ ID NO: 615776 - protein, 9 aa, Homo Sapiens
GPLPLRCHF

SEQ ID NO: 615777 - protein, 9 aa, Homo Sapiens
EVTFGEEEE

SEQ ID NO: 615778 - protein, 9 aa, Homo Sapiens
LGLTLSPGD

SEQ ID NO: 615779 - protein, 9 aa, Homo Sapiens
KPQNLLNDD

SEQ ID NO: 615780 - protein, 9 aa, Homo Sapiens
DLLSEAASL

SEQ ID NO: 615781 - protein, 9 aa, Homo Sapiens
KFELNQSAT

SEQ ID NO: 615782 - protein, 9 aa, Homo Sapiens
HHNLHMTGI

SEQ ID NO: 615783 - protein, 9 aa, Homo Sapiens
APSGKTVSL

SEQ ID NO: 615784 - protein, 9 aa, Homo Sapiens
QRRMKLGFT

SEQ ID NO: 615785 - protein, 9 aa, Homo Sapiens
GPWENAKSL

SEQ ID NO: 615786 - protein, 9 aa, Homo Sapiens
PQDFWVLLP

SEQ ID NO: 615787 - protein, 8 aa, Homo Sapiens
SHLPGLEL

SEQ ID NO: 615788 - protein, 9 aa, Homo Sapiens
SIKSWDEAR

SEQ ID NO: 615789 - protein, 9 aa, Homo Sapiens
IHWLENVYG

SEQ ID NO: 615790 - protein, 9 aa, Homo Sapiens
TKNKIIHTG

SEQ ID NO: 615791 - protein, 9 aa, Homo Sapiens
AMKELQKAV

SEQ ID NO: 615792 - protein, 9 aa, Homo Sapiens
TATVMTLGS

SEQ ID NO: 615793 - protein, 9 aa, Homo Sapiens
LFNCATFAL

SEQ ID NO: 615794 - protein, 9 aa, Homo Sapiens
AVGVGKSAL

SEQ ID NO: 615795 - protein, 9 aa, Homo Sapiens
NWDEDSVVS

SEQ ID NO: 615796 - protein, 9 aa, Homo Sapiens
DMERCARSL

SEQ ID NO: 615797 - protein, 9 aa, Homo Sapiens
KLPTKVNHV

SEQ ID NO: 615798 - protein, 9 aa, Homo Sapiens
LTPREYEDL

SEQ ID NO: 615799 - protein, 9 aa, Homo Sapiens
GSVELMGSG

SEQ ID NO: 615800 - protein, 9 aa, Homo Sapiens
LLQQYEFLD

SEQ ID NO: 615801 - protein, 9 aa, Homo Sapiens
GSHCGGGGW

SEQ ID NO: 615802 - protein, 9 aa, Homo Sapiens
RTFKQRRMK

SEQ ID NO: 615803 - protein, 9 aa, Homo Sapiens
CEWRYEPCS

SEQ ID NO: 615804 - protein, 9 aa, Homo Sapiens
KEDGDYVEL

SEQ ID NO: 615805 - protein, 9 aa, Homo Sapiens
DKISRAAFH

SEQ ID NO: 615806 - protein, 9 aa, Homo Sapiens
DRQSAVSLL

SEQ ID NO: 615807 - protein, 9 aa, Homo Sapiens
GGVPESCNL

SEQ ID NO: 615808 - protein, 9 aa, Homo Sapiens
SDLWRKFKF

SEQ ID NO: 615809 - protein, 9 aa, Homo Sapiens
FEAYLCNAT

SEQ ID NO: 615810 - protein, 9 aa, Homo Sapiens
QNCLNLQVF

SEQ ID NO: 615811 - protein, 9 aa, Homo Sapiens
LRGGKIRYQ

SEQ ID NO: 615812 - protein, 9 aa, Homo Sapiens
GEPLRLVKS

SEQ ID NO: 615813 - protein, 9 aa, Homo Sapiens
SKFKMPKLK

SEQ ID NO: 615814 - protein, 9 aa, Homo Sapiens
RMKLGFTQG

SEQ ID NO: 615815 - protein, 9 aa, Homo Sapiens
QHAYSMALW

SEQ ID NO: 615816 - protein, 9 aa, Homo Sapiens
GICTKDRCK

SEQ ID NO: 615817 - protein, 9 aa, Homo Sapiens
AVCLKMDKS

SEQ ID NO: 615818 - protein, 9 aa, Homo Sapiens
SCDRLTDPY

SEQ ID NO: 615819 - protein, 9 aa, Homo Sapiens
ASVLNHSKQ

SEQ ID NO: 615820 - protein, 9 aa, Homo Sapiens
CHSCNGLAD

SEQ ID NO: 615821 - protein, 9 aa, Homo Sapiens
ELSVRPSQL

SEQ ID NO: 615822 - protein, 9 aa, Homo Sapiens
NSSERQHHN

SEQ ID NO: 615823 - protein, 9 aa, Homo Sapiens
QPHSPTYND

SEQ ID NO: 615824 - protein, 9 aa, Homo Sapiens
QIQVDKKGK

SEQ ID NO: 615825 - protein, 9 aa, Homo Sapiens
LAVKCLKPD

SEQ ID NO: 615826 - protein, 9 aa, Homo Sapiens
LNLQVFMAV

SEQ ID NO: 615827 - protein, 9 aa, Homo Sapiens
MFQDEDISS

SEQ ID NO: 615828 - protein, 9 aa, Homo Sapiens
HHVGQAGLQ

SEQ ID NO: 615829 - protein, 9 aa, Homo Sapiens
KGRHIYTFD

SEQ ID NO: 615830 - protein, 9 aa, Homo Sapiens
PWENAKSLR

SEQ ID NO: 615831 - protein, 9 aa, Homo Sapiens
TSHDHVEDC

SEQ ID NO: 615832 - protein, 9 aa, Homo Sapiens
LQLTNTFAY

SEQ ID NO: 615833 - protein, 9 aa, Homo Sapiens
VCRIHVRIA

SEQ ID NO: 615834 - protein, 9 aa, Homo Sapiens
NVRTFPQAI

SEQ ID NO: 615835 - protein, 9 aa, Homo Sapiens
RNLLPKRSY

SEQ ID NO: 615836 - protein, 9 aa, Homo Sapiens
PKRSYKFTI

SEQ ID NO: 615837 - protein, 9 aa, Homo Sapiens
DAISAECPY

SEQ ID NO: 615838 - protein, 9 aa, Homo Sapiens
LGMPSSTRR

SEQ ID NO: 615839 - protein, 9 aa, Homo Sapiens
AVGGFGGTN

SEQ ID NO: 615840 - protein, 9 aa, Homo Sapiens
TVSLAVKCL

SEQ ID NO: 615841 - protein, 9 aa, Homo Sapiens
PDQRPVTNE

SEQ ID NO: 615842 - protein, 9 aa, Homo Sapiens
LQEMIQHLK

SEQ ID NO: 615843 - protein, 9 aa, Homo Sapiens
NEVKRQAMK

SEQ ID NO: 615844 - protein, 8 aa, Homo Sapiens
PGLSRAAL

SEQ ID NO: 615845 - protein, 9 aa, Homo Sapiens
TVAQSLNTD

SEQ ID NO: 615846 - protein, 9 aa, Homo Sapiens
FSALLQQYE

SEQ ID NO: 615847 - protein, 9 aa, Homo Sapiens
YYCIVKVGG

SEQ ID NO: 615848 - protein, 9 aa, Homo Sapiens
DSILTPREY

SEQ ID NO: 615849 - protein, 9 aa, Homo Sapiens
TLNPNCEKM

SEQ ID NO: 615850 - protein, 9 aa, Homo Sapiens
PQLRTAGLV

SEQ ID NO: 615851 - protein, 9 aa, Homo Sapiens
SFLLFNTTE

SEQ ID NO: 615852 - protein, 9 aa, Homo Sapiens
TGLSTLRRR

SEQ ID NO: 615853 - protein, 9 aa, Homo Sapiens
AHPPGSGVS

SEQ ID NO: 615854 - protein, 9 aa, Homo Sapiens
IFSIIMKPL

SEQ ID NO: 615855 - protein, 9 aa, Homo Sapiens
QILENISQP

SEQ ID NO: 615856 - protein, 9 aa, Homo Sapiens
SQVVKNTME

SEQ ID NO: 615857 - protein, 9 aa, Homo Sapiens
GHHSTPLGA

SEQ ID NO: 615858 - protein, 9 aa, Homo Sapiens
WLENVYGFD

SEQ ID NO: 615859 - protein, 9 aa, Homo Sapiens
PELRRLEFS

SEQ ID NO: 615860 - protein, 9 aa, Homo Sapiens
SEAASLSEN

SEQ ID NO: 615861 - protein, 9 aa, Homo Sapiens
PIKEGDNHY

SEQ ID NO: 615862 - protein, 9 aa, Homo Sapiens
FPPSSILKR

SEQ ID NO: 615863 - protein, 9 aa, Homo Sapiens
AKSLRPLGR

SEQ ID NO: 615864 - protein, 9 aa, Homo Sapiens
PIYMCVDSP

SEQ ID NO: 615865 - protein, 9 aa, Homo Sapiens
DRLTDPYRA

SEQ ID NO: 615866 - protein, 9 aa, Homo Sapiens
VQQNEEDAW

SEQ ID NO: 615867 - protein, 9 aa, Homo Sapiens
AYVDDRGQD

SEQ ID NO: 615868 - protein, 9 aa, Homo Sapiens
AISTKQEAR

SEQ ID NO: 615869 - protein, 9 aa, Homo Sapiens
EINEKLHHQ

SEQ ID NO: 615870 - protein, 9 aa, Homo Sapiens
RGARTSLRS

SEQ ID NO: 615871 - protein, 9 aa, Homo Sapiens
TYFDKMQYP

SEQ ID NO: 615872 - protein, 9 aa, Homo Sapiens
VPASARRRG

SEQ ID NO: 615873 - protein, 9 aa, Homo Sapiens
DVWWAQQFL

SEQ ID NO: 615874 - protein, 9 aa, Homo Sapiens
PLQEMIQHL

SEQ ID NO: 615875 - protein, 9 aa, Homo Sapiens
KLVVVGAVG

SEQ ID NO: 615876 - protein, 9 aa, Homo Sapiens
LEASQLFKD

SEQ ID NO: 615877 - protein, 9 aa, Homo Sapiens
FLLVRPGAL

SEQ ID NO: 615878 - protein, 9 aa, Homo Sapiens
VKVGGKLIF

SEQ ID NO: 615879 - protein, 9 aa, Homo Sapiens
RPVSGRVSC

SEQ ID NO: 615880 - protein, 9 aa, Homo Sapiens
AISYQTTGG

SEQ ID NO: 615881 - protein, 9 aa, Homo Sapiens
FDVRNLLPK

SEQ ID NO: 615882 - protein, 9 aa, Homo Sapiens
HQLASYRDL

SEQ ID NO: 615883 - protein, 9 aa, Homo Sapiens
VIVFLVLLF

SEQ ID NO: 615884 - protein, 9 aa, Homo Sapiens
DSPKELKRC

SEQ ID NO: 615885 - protein, 9 aa, Homo Sapiens
CARSLNKQK

SEQ ID NO: 615886 - protein, 9 aa, Homo Sapiens
SISYTYFDK

SEQ ID NO: 615887 - protein, 9 aa, Homo Sapiens
SETVVCNAP

SEQ ID NO: 615888 - protein, 9 aa, Homo Sapiens
CDFHQVIIR

SEQ ID NO: 615889 - protein, 9 aa, Homo Sapiens
NEFNRTVFR

SEQ ID NO: 615890 - protein, 9 aa, Homo Sapiens
GNWDEDSVV

SEQ ID NO: 615891 - protein, 9 aa, Homo Sapiens
RRHKAFSTC

SEQ ID NO: 615892 - protein, 9 aa, Homo Sapiens
GSGLGYLEQ

SEQ ID NO: 615893 - protein, 9 aa, Homo Sapiens
CLYKKLEIK

SEQ ID NO: 615894 - protein, 9 aa, Homo Sapiens
HPSQGASAL

SEQ ID NO: 615895 - protein, 9 aa, Homo Sapiens
VPIDLDVWW

SEQ ID NO: 615896 - protein, 9 aa, Homo Sapiens
EDLLCFPGW

SEQ ID NO: 615897 - protein, 9 aa, Homo Sapiens
WEHKKEKKC

SEQ ID NO: 615898 - protein, 9 aa, Homo Sapiens
CHMLCHYTD

SEQ ID NO: 615899 - protein, 9 aa, Homo Sapiens
HLNVDNFLA

SEQ ID NO: 615900 - protein, 9 aa, Homo Sapiens
RYRGYPVSG

SEQ ID NO: 615901 - protein, 9 aa, Homo Sapiens
QLNSALPQY

SEQ ID NO: 615902 - protein, 9 aa, Homo Sapiens
LIFQEAPET

SEQ ID NO: 615903 - protein, 9 aa, Homo Sapiens
AGLVRCLLP

SEQ ID NO: 615904 - protein, 9 aa, Homo Sapiens
KTWLSSATG

SEQ ID NO: 615905 - protein, 9 aa, Homo Sapiens
DDEKPDQRP

SEQ ID NO: 615906 - protein, 9 aa, Homo Sapiens
KMDKSHRPV

SEQ ID NO: 615907 - protein, 9 aa, Homo Sapiens
FFTDNGSWN

SEQ ID NO: 615908 - protein, 9 aa, Homo Sapiens
SSPHMFVGS

SEQ ID NO: 615909 - protein, 9 aa, Homo Sapiens
NGACYNTSE

SEQ ID NO: 615910 - protein, 9 aa, Homo Sapiens
IPTEDGSLV

SEQ ID NO: 615911 - protein, 9 aa, Homo Sapiens
LPNDVTLWK

SEQ ID NO: 615912 - protein, 9 aa, Homo Sapiens
EKNPQSILQ

SEQ ID NO: 615913 - protein, 9 aa, Homo Sapiens
RIKSMEPFD

SEQ ID NO: 615914 - protein, 9 aa, Homo Sapiens
KHLNVDNFL

SEQ ID NO: 615915 - protein, 9 aa, Homo Sapiens
SQSSSILGL

SEQ ID NO: 615916 - protein, 9 aa, Homo Sapiens
TEVTFGEEE

SEQ ID NO: 615917 - protein, 9 aa, Homo Sapiens
RQGFSEGGR

SEQ ID NO: 615918 - protein, 9 aa, Homo Sapiens
TFKQRRMKL

SEQ ID NO: 615919 - protein, 9 aa, Homo Sapiens
TSLRSSSPT

SEQ ID NO: 615920 - protein, 9 aa, Homo Sapiens
RLWFLLVRP

SEQ ID NO: 615921 - protein, 9 aa, Homo Sapiens
ITVTKEFVV

SEQ ID NO: 615922 - protein, 9 aa, Homo Sapiens
VTFGEEEEK

SEQ ID NO: 615923 - protein, 9 aa, Homo Sapiens
HCGGGGWGH

SEQ ID NO: 615924 - protein, 9 aa, Homo Sapiens
IPVGDTRVL

SEQ ID NO: 615925 - protein, 9 aa, Homo Sapiens
DIQSVEADV

SEQ ID NO: 615926 - protein, 9 aa, Homo Sapiens
TLTKNKIIH

SEQ ID NO: 615927 - protein, 9 aa, Homo Sapiens
AFFRSSKLI

SEQ ID NO: 615928 - protein, 9 aa, Homo Sapiens
PPGCTDIDN

SEQ ID NO: 615929 - protein, 9 aa, Homo Sapiens
KMEDAEFYL

SEQ ID NO: 615930 - protein, 9 aa, Homo Sapiens
GAGPWLIEI

SEQ ID NO: 615931 - protein, 9 aa, Homo Sapiens
ENAKSLRPL

SEQ ID NO: 615932 - protein, 9 aa, Homo Sapiens
IVCLYKKLE

SEQ ID NO: 615933 - protein, 9 aa, Homo Sapiens
NEKLHHQLA

SEQ ID NO: 615934 - protein, 9 aa, Homo Sapiens
SSSPTWTLT

SEQ ID NO: 615935 - protein, 9 aa, Homo Sapiens
NGMPLRACT

SEQ ID NO: 615936 - protein, 9 aa, Homo Sapiens
FWEHKKEKK

SEQ ID NO: 615937 - protein, 9 aa, Homo Sapiens
TDAEALELE

SEQ ID NO: 615938 - protein, 9 aa, Homo Sapiens
ADQIFWEHK

SEQ ID NO: 615939 - protein, 9 aa, Homo Sapiens
LLVLSPEEP

SEQ ID NO: 615940 - protein, 9 aa, Homo Sapiens
ASQLFKDKK

SEQ ID NO: 615941 - protein, 9 aa, Homo Sapiens
PLRACTKVS

SEQ ID NO: 615942 - protein, 9 aa, Homo Sapiens
DPYRAPSDT

SEQ ID NO: 615943 - protein, 9 aa, Homo Sapiens
TFAYYTYLL

SEQ ID NO: 615944 - protein, 9 aa, Homo Sapiens
RGGGQSANA

SEQ ID NO: 615945 - protein, 9 aa, Homo Sapiens
AERKPQDFW

SEQ ID NO: 615946 - protein, 9 aa, Homo Sapiens
EFAEEEPLL

SEQ ID NO: 615947 - protein, 9 aa, Homo Sapiens
NEFAEEEPL

SEQ ID NO: 615948 - protein, 9 aa, Homo Sapiens
KTVSLAVKC

SEQ ID NO: 615949 - protein, 9 aa, Homo Sapiens
LLDLYNCTE

SEQ ID NO: 615950 - protein, 9 aa, Homo Sapiens
KQIDDRKEC

SEQ ID NO: 615951 - protein, 9 aa, Homo Sapiens
LWSQQKEVE

SEQ ID NO: 615952 - protein, 9 aa, Homo Sapiens
KPTTVSCEM

SEQ ID NO: 615953 - protein, 9 aa, Homo Sapiens
IEELKEWME

SEQ ID NO: 615954 - protein, 9 aa, Homo Sapiens
MKPLFESFK

SEQ ID NO: 615955 - protein, 9 aa, Homo Sapiens
CIVKVGGKL

SEQ ID NO: 615956 - protein, 9 aa, Homo Sapiens
VPLCLMNHN

SEQ ID NO: 615957 - protein, 9 aa, Homo Sapiens
TINKENQET

SEQ ID NO: 615958 - protein, 9 aa, Homo Sapiens
LSETVVCNA

SEQ ID NO: 615959 - protein, 9 aa, Homo Sapiens
LAGQVMHCS

SEQ ID NO: 615960 - protein, 9 aa, Homo Sapiens
RMFFTDNGS

SEQ ID NO: 615961 - protein, 9 aa, Homo Sapiens
GLTVQFSCD

SEQ ID NO: 615962 - protein, 9 aa, Homo Sapiens
EGDNHYFTC

SEQ ID NO: 615963 - protein, 9 aa, Homo Sapiens
GLQLLTSGD

SEQ ID NO: 615964 - protein, 9 aa, Homo Sapiens
PGILHVHPN

SEQ ID NO: 615965 - protein, 9 aa, Homo Sapiens
WLSSATGDE

SEQ ID NO: 615966 - protein, 9 aa, Homo Sapiens
PASARRRGA

SEQ ID NO: 615967 - protein, 9 aa, Homo Sapiens
YKLVVVGAV

SEQ ID NO: 615968 - protein, 9 aa, Homo Sapiens
LSPGDSAQH

SEQ ID NO: 615969 - protein, 9 aa, Homo Sapiens
HDYIRQYKE

SEQ ID NO: 615970 - protein, 9 aa, Homo Sapiens
PAPVIQPPK

SEQ ID NO: 615971 - protein, 9 aa, Homo Sapiens
KPLSEQIAI

SEQ ID NO: 615972 - protein, 9 aa, Homo Sapiens
SRALEAAEP

SEQ ID NO: 615973 - protein, 9 aa, Homo Sapiens
KLKFAAYLK

SEQ ID NO: 615974 - protein, 9 aa, Homo Sapiens
ASTVSAFCV

SEQ ID NO: 615975 - protein, 9 aa, Homo Sapiens
LPGPVTLVI

SEQ ID NO: 615976 - protein, 9 aa, Homo Sapiens
GMETKIKNY

SEQ ID NO: 615977 - protein, 9 aa, Homo Sapiens
RAIVHSTSD

SEQ ID NO: 615978 - protein, 9 aa, Homo Sapiens
DVFKLKQFS

SEQ ID NO: 615979 - protein, 9 aa, Homo Sapiens
EKCRKMIPA

SEQ ID NO: 615980 - protein, 9 aa, Homo Sapiens
SGQLTEQQN

SEQ ID NO: 615981 - protein, 9 aa, Homo Sapiens
EKENYRYTV

SEQ ID NO: 615982 - protein, 9 aa, Homo Sapiens
LKVMLEYEP

SEQ ID NO: 615983 - protein, 9 aa, Homo Sapiens
EALAHFTIL

SEQ ID NO: 615984 - protein, 9 aa, Homo Sapiens
NLGYALDYT

SEQ ID NO: 615985 - protein, 9 aa, Homo Sapiens
TILTALVPS

SEQ ID NO: 615986 - protein, 9 aa, Homo Sapiens
AVVFAPSVK

SEQ ID NO: 615987 - protein, 9 aa, Homo Sapiens
HFHVVFSSP

SEQ ID NO: 615988 - protein, 9 aa, Homo Sapiens
QGATLVNRG

SEQ ID NO: 615989 - protein, 9 aa, Homo Sapiens
DSCACPGNT

SEQ ID NO: 615990 - protein, 9 aa, Homo Sapiens
SITQDILEK

SEQ ID NO: 615991 - protein, 9 aa, Homo Sapiens
GPVTLVIER

SEQ ID NO: 615992 - protein, 9 aa, Homo Sapiens
RNNFYCMAQ

SEQ ID NO: 615993 - protein, 9 aa, Homo Sapiens
RRVSQLLHL

SEQ ID NO: 615994 - protein, 9 aa, Homo Sapiens
ITQDILEKF

SEQ ID NO: 615995 - protein, 9 aa, Homo Sapiens
VHSSFPSST

SEQ ID NO: 615996 - protein, 9 aa, Homo Sapiens
LLLGSECFL

SEQ ID NO: 615997 - protein, 9 aa, Homo Sapiens
TEEESKLDR

SEQ ID NO: 615998 - protein, 9 aa, Homo Sapiens
TLYNELRVA

SEQ ID NO: 615999 - protein, 9 aa, Homo Sapiens
NQEQRQAFA

SEQ ID NO: 616000 - protein, 9 aa, Homo Sapiens
LRSFPDPQG

SEQ ID NO: 616001 - protein, 9 aa, Homo Sapiens
DAEFDESYK

SEQ ID NO: 616002 - protein, 9 aa, Homo Sapiens
NSNSMYINR

SEQ ID NO: 616003 - protein, 9 aa, Homo Sapiens
AVNKVDVSH

SEQ ID NO: 616004 - protein, 9 aa, Homo Sapiens
AWERNPYTI

SEQ ID NO: 616005 - protein, 9 aa, Homo Sapiens
GMSKRKTKR

SEQ ID NO: 616006 - protein, 9 aa, Homo Sapiens
DDKTSVFVA

SEQ ID NO: 616007 - protein, 9 aa, Homo Sapiens
EGTLPTFHP

SEQ ID NO: 616008 - protein, 9 aa, Homo Sapiens
EAPFRDRSH

SEQ ID NO: 616009 - protein, 9 aa, Homo Sapiens
QHTFGSKEA

SEQ ID NO: 616010 - protein, 9 aa, Homo Sapiens
VGDDAEDSL

SEQ ID NO: 616011 - protein, 9 aa, Homo Sapiens
MKRLRGAKD

SEQ ID NO: 616012 - protein, 9 aa, Homo Sapiens
QNGTDNWKV

SEQ ID NO: 616013 - protein, 9 aa, Homo Sapiens
GKFSTYGGR

SEQ ID NO: 616014 - protein, 9 aa, Homo Sapiens
FSLLPAQAG

SEQ ID NO: 616015 - protein, 9 aa, Homo Sapiens
KGDVKPLSE

SEQ ID NO: 616016 - protein, 9 aa, Homo Sapiens
DVCQLCLLA

SEQ ID NO: 616017 - protein, 9 aa, Homo Sapiens
MTAYWTNFA

SEQ ID NO: 616018 - protein, 9 aa, Homo Sapiens
ELCEPIEVK

SEQ ID NO: 616019 - protein, 9 aa, Homo Sapiens
VEHVPVADI

SEQ ID NO: 616020 - protein, 9 aa, Homo Sapiens
PRHTMRELL

SEQ ID NO: 616021 - protein, 9 aa, Homo Sapiens
HTCGNPEEI

SEQ ID NO: 616022 - protein, 9 aa, Homo Sapiens
ANDVKHDRW

SEQ ID NO: 616023 - protein, 9 aa, Homo Sapiens
KSQYKSTIL

SEQ ID NO: 616024 - protein, 9 aa, Homo Sapiens
WGRALYWAC

SEQ ID NO: 616025 - protein, 9 aa, Homo Sapiens
QNDLLQIIR

SEQ ID NO: 616026 - protein, 9 aa, Homo Sapiens
CLTLFEAAI

SEQ ID NO: 616027 - protein, 9 aa, Homo Sapiens
KQVINGVES

SEQ ID NO: 616028 - protein, 9 aa, Homo Sapiens
ILASFARKN

SEQ ID NO: 616029 - protein, 9 aa, Homo Sapiens
KEEEEREFR

SEQ ID NO: 616030 - protein, 9 aa, Homo Sapiens
LSGSAKVAF

SEQ ID NO: 616031 - protein, 9 aa, Homo Sapiens
SRKQRQTAR

SEQ ID NO: 616032 - protein, 9 aa, Homo Sapiens
SEQIAITAG

SEQ ID NO: 616033 - protein, 9 aa, Homo Sapiens
EEKENYRYT

SEQ ID NO: 616034 - protein, 9 aa, Homo Sapiens
LGGEKTVAA

SEQ ID NO: 616035 - protein, 9 aa, Homo Sapiens
TNASRTMVF

SEQ ID NO: 616036 - protein, 9 aa, Homo Sapiens
NIFERIASE

SEQ ID NO: 616037 - protein, 9 aa, Homo Sapiens
MNSFVNNIF

SEQ ID NO: 616038 - protein, 9 aa, Homo Sapiens
DSWLHKPMY

SEQ ID NO: 616039 - protein, 9 aa, Homo Sapiens
QRRRQSIRC

SEQ ID NO: 616040 - protein, 9 aa, Homo Sapiens
GTGNHRDAA

SEQ ID NO: 616041 - protein, 9 aa, Homo Sapiens
HPKKGQELI

SEQ ID NO: 616042 - protein, 9 aa, Homo Sapiens
TQQIFDAKN

SEQ ID NO: 616043 - protein, 9 aa, Homo Sapiens
LQVGPKEKI

SEQ ID NO: 616044 - protein, 9 aa, Homo Sapiens
FLARILGMV

SEQ ID NO: 616045 - protein, 9 aa, Homo Sapiens
FRISEENKT

SEQ ID NO: 616046 - protein, 9 aa, Homo Sapiens
RKDHQSTAP

SEQ ID NO: 616047 - protein, 9 aa, Homo Sapiens
NDLELDTPS

SEQ ID NO: 616048 - protein, 9 aa, Homo Sapiens
LRKKLGKCK

SEQ ID NO: 616049 - protein, 9 aa, Homo Sapiens
THTWRARST

SEQ ID NO: 616050 - protein, 9 aa, Homo Sapiens
NASRTMVFN

SEQ ID NO: 616051 - protein, 9 aa, Homo Sapiens
QLQVGPKEK

SEQ ID NO: 616052 - protein, 9 aa, Homo Sapiens
NTKRLAIIH

SEQ ID NO: 616053 - protein, 9 aa, Homo Sapiens
LLDIRYRIN

SEQ ID NO: 616054 - protein, 9 aa, Homo Sapiens
WNNTKRLAI

SEQ ID NO: 616055 - protein, 9 aa, Homo Sapiens
VKRNILATG

SEQ ID NO: 616056 - protein, 9 aa, Homo Sapiens
FVNNIFERI

SEQ ID NO: 616057 - protein, 9 aa, Homo Sapiens
PDPQGTLLP

SEQ ID NO: 616058 - protein, 9 aa, Homo Sapiens
KRLRGAKDF

SEQ ID NO: 616059 - protein, 9 aa, Homo Sapiens
SQEINSNKT

SEQ ID NO: 616060 - protein, 9 aa, Homo Sapiens
TLVIERSEE

SEQ ID NO: 616061 - protein, 9 aa, Homo Sapiens
RIFTRAKSY

SEQ ID NO: 616062 - protein, 9 aa, Homo Sapiens
KPHCYRPGT

SEQ ID NO: 616063 - protein, 9 aa, Homo Sapiens
WQRRRQSIR

SEQ ID NO: 616064 - protein, 9 aa, Homo Sapiens
CISELFQGH

SEQ ID NO: 616065 - protein, 9 aa, Homo Sapiens
YQGILMEYI

SEQ ID NO: 616066 - protein, 9 aa, Homo Sapiens
LGNLSFSCV

SEQ ID NO: 616067 - protein, 9 aa, Homo Sapiens
IAHEMGDNM

SEQ ID NO: 616068 - protein, 9 aa, Homo Sapiens
RGKWNPNCL

SEQ ID NO: 616069 - protein, 9 aa, Homo Sapiens
GQAEHKAEV

SEQ ID NO: 616070 - protein, 9 aa, Homo Sapiens
RGVATGPGF

SEQ ID NO: 616071 - protein, 9 aa, Homo Sapiens
PLYLQVMCI

SEQ ID NO: 616072 - protein, 9 aa, Homo Sapiens
DYKTKPPKL

SEQ ID NO: 616073 - protein, 9 aa, Homo Sapiens
VLDTLDYLR

SEQ ID NO: 616074 - protein, 9 aa, Homo Sapiens
LDGIRIAMA

SEQ ID NO: 616075 - protein, 9 aa, Homo Sapiens
DKSSILRRR

SEQ ID NO: 616076 - protein, 9 aa, Homo Sapiens
QHPVGTGNH

SEQ ID NO: 616077 - protein, 9 aa, Homo Sapiens
RTECAEPPG

SEQ ID NO: 616078 - protein, 9 aa, Homo Sapiens
VNNIFERIA

SEQ ID NO: 616079 - protein, 9 aa, Homo Sapiens
LGETKANQE

SEQ ID NO: 616080 - protein, 9 aa, Homo Sapiens
KHDRWFRSV

SEQ ID NO: 616081 - protein, 9 aa, Homo Sapiens
LSRGKWNPN

SEQ ID NO: 616082 - protein, 9 aa, Homo Sapiens
TLQAPKGAL

SEQ ID NO: 616083 - protein, 9 aa, Homo Sapiens
KPYIRRDYK

SEQ ID NO: 616084 - protein, 9 aa, Homo Sapiens
MTEEESKLD

SEQ ID NO: 616085 - protein, 9 aa, Homo Sapiens
GFFIILASQ

SEQ ID NO: 616086 - protein, 9 aa, Homo Sapiens
RACFCALLN

SEQ ID NO: 616087 - protein, 9 aa, Homo Sapiens
SFPSSTNSS

SEQ ID NO: 616088 - protein, 9 aa, Homo Sapiens
PRRVSQLLH

SEQ ID NO: 616089 - protein, 9 aa, Homo Sapiens
DIYATDQKG

SEQ ID NO: 616090 - protein, 9 aa, Homo Sapiens
VGTGNHRDA

SEQ ID NO: 616091 - protein, 9 aa, Homo Sapiens
TDNWKVIAN

SEQ ID NO: 616092 - protein, 9 aa, Homo Sapiens
WKDFELPVD

SEQ ID NO: 616093 - protein, 9 aa, Homo Sapiens
DGIRIAMAA

SEQ ID NO: 616094 - protein, 9 aa, Homo Sapiens
RQFCQKMLE

SEQ ID NO: 616095 - protein, 9 aa, Homo Sapiens
TGNHRDAAQ

SEQ ID NO: 616096 - protein, 9 aa, Homo Sapiens
GNITDDWDR

SEQ ID NO: 616097 - protein, 9 aa, Homo Sapiens
LRNNFYCMA

SEQ ID NO: 616098 - protein, 9 aa, Homo Sapiens
QTMDVPVLV

SEQ ID NO: 616099 - protein, 9 aa, Homo Sapiens
IRRDYKTKP

SEQ ID NO: 616100 - protein, 9 aa, Homo Sapiens
GQYWCHFQN

SEQ ID NO: 616101 - protein, 9 aa, Homo Sapiens
VSQLLHLCL

SEQ ID NO: 616102 - protein, 9 aa, Homo Sapiens
KGALGNVGA

SEQ ID NO: 616103 - protein, 9 aa, Homo Sapiens
GATVHDLFN

SEQ ID NO: 616104 - protein, 9 aa, Homo Sapiens
ATGPGFPSL

SEQ ID NO: 616105 - protein, 9 aa, Homo Sapiens
PAEAPRAGT

SEQ ID NO: 616106 - protein, 9 aa, Homo Sapiens
RLKVNPLSP

SEQ ID NO: 616107 - protein, 9 aa, Homo Sapiens
LVIERSEEL

SEQ ID NO: 616108 - protein, 9 aa, Homo Sapiens
INDSYRFSA

SEQ ID NO: 616109 - protein, 9 aa, Homo Sapiens
DFAIQYEED

SEQ ID NO: 616110 - protein, 9 aa, Homo Sapiens
EEPGKFSTY

SEQ ID NO: 616111 - protein, 9 aa, Homo Sapiens
HPRLKVNPL

SEQ ID NO: 616112 - protein, 9 aa, Homo Sapiens
MDKSSILRR

SEQ ID NO: 616113 - protein, 9 aa, Homo Sapiens
GDVKPLSEQ

SEQ ID NO: 616114 - protein, 9 aa, Homo Sapiens
IPGQQHPVQ

SEQ ID NO: 616115 - protein, 9 aa, Homo Sapiens
KVNPLSPQA

SEQ ID NO: 616116 - protein, 9 aa, Homo Sapiens
TGPGFPSLE

SEQ ID NO: 616117 - protein, 9 aa, Homo Sapiens
NPYTISSPG

SEQ ID NO: 616118 - protein, 9 aa, Homo Sapiens
HGHRQKYLI

SEQ ID NO: 616119 - protein, 9 aa, Homo Sapiens
KALKEKIRK

SEQ ID NO: 616120 - protein, 9 aa, Homo Sapiens
GGCGTAKIP

SEQ ID NO: 616121 - protein, 9 aa, Homo Sapiens
NTIRREVTV

SEQ ID NO: 616122 - protein, 9 aa, Homo Sapiens
GYALDYTQR

SEQ ID NO: 616123 - protein, 9 aa, Homo Sapiens
KCRKMIPAF

SEQ ID NO: 616124 - protein, 9 aa, Homo Sapiens
SLCHKNYIH

SEQ ID NO: 616125 - protein, 9 aa, Homo Sapiens
DHQSTAPVQ

SEQ ID NO: 616126 - protein, 9 aa, Homo Sapiens
TVLSNPACH

SEQ ID NO: 616127 - protein, 9 aa, Homo Sapiens
LLGGEKTVA

SEQ ID NO: 616128 - protein, 9 aa, Homo Sapiens
YLGETKANQ

SEQ ID NO: 616129 - protein, 9 aa, Homo Sapiens
ECEMLKKIW

SEQ ID NO: 616130 - protein, 9 aa, Homo Sapiens
FGEPPTKLQ

SEQ ID NO: 616131 - protein, 9 aa, Homo Sapiens
QEFLPIQEA

SEQ ID NO: 616132 - protein, 9 aa, Homo Sapiens
NSFVNNIFE

SEQ ID NO: 616133 - protein, 9 aa, Homo Sapiens
RRDYKTKPP

SEQ ID NO: 616134 - protein, 9 aa, Homo Sapiens
EGAPRSFLA

SEQ ID NO: 616135 - protein, 9 aa, Homo Sapiens
LHKFKLQDD

SEQ ID NO: 616136 - protein, 9 aa, Homo Sapiens
KTSRMISST

SEQ ID NO: 616137 - protein, 9 aa, Homo Sapiens
SQLHPSGLR

SEQ ID NO: 616138 - protein, 9 aa, Homo Sapiens
AFLKFDTLN

SEQ ID NO: 616139 - protein, 9 aa, Homo Sapiens
GLARLIKHD

SEQ ID NO: 616140 - protein, 9 aa, Homo Sapiens
KAMTAYWTN

SEQ ID NO: 616141 - protein, 9 aa, Homo Sapiens
PKGALGNVG

SEQ ID NO: 616142 - protein, 9 aa, Homo Sapiens
RPIKDLDGI

SEQ ID NO: 616143 - protein, 9 aa, Homo Sapiens
RGSLECIAE

SEQ ID NO: 616144 - protein, 9 aa, Homo Sapiens
EKIWHHTLY

SEQ ID NO: 616145 - protein, 9 aa, Homo Sapiens
TIGLQVHFL

SEQ ID NO: 616146 - protein, 9 aa, Homo Sapiens
NPRRPPASS

SEQ ID NO: 616147 - protein, 9 aa, Homo Sapiens
HTFGSKEAF

SEQ ID NO: 616148 - protein, 9 aa, Homo Sapiens
ELRSFPDPQ

SEQ ID NO: 616149 - protein, 9 aa, Homo Sapiens
HKFKLQDDF

SEQ ID NO: 616150 - protein, 9 aa, Homo Sapiens
GGVKKPHCY

SEQ ID NO: 616151 - protein, 9 aa, Homo Sapiens
VFSLLPAQA

SEQ ID NO: 616152 - protein, 9 aa, Homo Sapiens
HRTLQAPKG

SEQ ID NO: 616153 - protein, 9 aa, Homo Sapiens
QGHFTINDS

SEQ ID NO: 616154 - protein, 9 aa, Homo Sapiens
HTWRARSTS

SEQ ID NO: 616155 - protein, 9 aa, Homo Sapiens
ERPLRRPRL

SEQ ID NO: 616156 - protein, 9 aa, Homo Sapiens
LTHTHTWRA

SEQ ID NO: 616157 - protein, 9 aa, Homo Sapiens
SMYINRPPS

SEQ ID NO: 616158 - protein, 9 aa, Homo Sapiens
CSENSGSSG

SEQ ID NO: 616159 - protein, 9 aa, Homo Sapiens
EKYSHLVSV

SEQ ID NO: 616160 - protein, 9 aa, Homo Sapiens
IEACHGYLN

SEQ ID NO: 616161 - protein, 9 aa, Homo Sapiens
KYSHLVSVG

SEQ ID NO: 616162 - protein, 9 aa, Homo Sapiens
VASTVSAFC

SEQ ID NO: 616163 - protein, 9 aa, Homo Sapiens
IILWRQFCQ

SEQ ID NO: 616164 - protein, 9 aa, Homo Sapiens
TQFCTKSTG

SEQ ID NO: 616165 - protein, 9 aa, Homo Sapiens
RPDSTCHSA

SEQ ID NO: 616166 - protein, 9 aa, Homo Sapiens
ARSTSTSTI

SEQ ID NO: 616167 - protein, 9 aa, Homo Sapiens
IPDQSQVEK

SEQ ID NO: 616168 - protein, 9 aa, Homo Sapiens
PNIRSTAAL

SEQ ID NO: 616169 - protein, 9 aa, Homo Sapiens
NSVQKHGEY

SEQ ID NO: 616170 - protein, 9 aa, Homo Sapiens
VPFSSDSPR

SEQ ID NO: 616171 - protein, 9 aa, Homo Sapiens
TAQLQVGPK

SEQ ID NO: 616172 - protein, 9 aa, Homo Sapiens
LSEQIAITA

SEQ ID NO: 616173 - protein, 9 aa, Homo Sapiens
VKNHYEKHK

SEQ ID NO: 616174 - protein, 9 aa, Homo Sapiens
LVCERMDDW

SEQ ID NO: 616175 - protein, 9 aa, Homo Sapiens
ANERECEML

SEQ ID NO: 616176 - protein, 9 aa, Homo Sapiens
GDNMGINHD

SEQ ID NO: 616177 - protein, 9 aa, Homo Sapiens
KSTILLQVA

SEQ ID NO: 616178 - protein, 9 aa, Homo Sapiens
KENYRYTVR

SEQ ID NO: 616179 - protein, 9 aa, Homo Sapiens
TEATNSHFT

SEQ ID NO: 616180 - protein, 9 aa, Homo Sapiens
SRTMVFNIH

SEQ ID NO: 616181 - protein, 9 aa, Homo Sapiens
SIHADVCQL

SEQ ID NO: 616182 - protein, 9 aa, Homo Sapiens
GSELVGWAD

SEQ ID NO: 616183 - protein, 9 aa, Homo Sapiens
YWCHFQNGN

SEQ ID NO: 616184 - protein, 9 aa, Homo Sapiens
PHCSIRCHC

SEQ ID NO: 616185 - protein, 9 aa, Homo Sapiens
GAKDFRLPG

SEQ ID NO: 616186 - protein, 9 aa, Homo Sapiens
TPWVAIGSA

SEQ ID NO: 616187 - protein, 9 aa, Homo Sapiens
LDYLRPVAL

SEQ ID NO: 616188 - protein, 9 aa, Homo Sapiens
FRDRSHIEK

SEQ ID NO: 616189 - protein, 9 aa, Homo Sapiens
LEPSNLGNL

SEQ ID NO: 616190 - protein, 9 aa, Homo Sapiens
YTISSPGHC

SEQ ID NO: 616191 - protein, 9 aa, Homo Sapiens
NKVDVSHFT

SEQ ID NO: 616192 - protein, 9 aa, Homo Sapiens
REEKENYRY

SEQ ID NO: 616193 - protein, 9 aa, Homo Sapiens
LSSTIQRKL

SEQ ID NO: 616194 - protein, 9 aa, Homo Sapiens
NASTGRVNE

SEQ ID NO: 616195 - protein, 9 aa, Homo Sapiens
VGMETKIKN

SEQ ID NO: 616196 - protein, 9 aa, Homo Sapiens
PGQQHPVQQ

SEQ ID NO: 616197 - protein, 9 aa, Homo Sapiens
ATDQKGNFK

SEQ ID NO: 616198 - protein, 9 aa, Homo Sapiens
GRTEISPEE

SEQ ID NO: 616199 - protein, 9 aa, Homo Sapiens
VNNLVEAFW

SEQ ID NO: 616200 - protein, 9 aa, Homo Sapiens
FYNQEQRQA

SEQ ID NO: 616201 - protein, 9 aa, Homo Sapiens
CDDYFIQNN

SEQ ID NO: 616202 - protein, 9 aa, Homo Sapiens
IPSESSTQW

SEQ ID NO: 616203 - protein, 9 aa, Homo Sapiens
HLCLYNLIV

SEQ ID NO: 616204 - protein, 9 aa, Homo Sapiens
TFSVTLFTI

SEQ ID NO: 616205 - protein, 9 aa, Homo Sapiens
GIRIAMAAL

SEQ ID NO: 616206 - protein, 9 aa, Homo Sapiens
ILLDQVMGV

SEQ ID NO: 616207 - protein, 9 aa, Homo Sapiens
VVFSSPPNI

SEQ ID NO: 616208 - protein, 9 aa, Homo Sapiens
DNINEWHAG

SEQ ID NO: 616209 - protein, 9 aa, Homo Sapiens
KIRQKNTIR

SEQ ID NO: 616210 - protein, 9 aa, Homo Sapiens
GHRPYEGPG

SEQ ID NO: 616211 - protein, 9 aa, Homo Sapiens
PVTLVIERS

SEQ ID NO: 616212 - protein, 9 aa, Homo Sapiens
HHTLYNELR

SEQ ID NO: 616213 - protein, 9 aa, Homo Sapiens
RLSSTIQRK

SEQ ID NO: 616214 - protein, 9 aa, Homo Sapiens
YNLIVIHKK

SEQ ID NO: 616215 - protein, 9 aa, Homo Sapiens
SRLVSSYRL

SEQ ID NO: 616216 - protein, 9 aa, Homo Sapiens
QGILMEYIC

SEQ ID NO: 616217 - protein, 9 aa, Homo Sapiens
SVTVPKILL

SEQ ID NO: 616218 - protein, 9 aa, Homo Sapiens
YIRRDYKTK

SEQ ID NO: 616219 - protein, 9 aa, Homo Sapiens
DLRCSGHES

SEQ ID NO: 616220 - protein, 9 aa, Homo Sapiens
LDSPQDRES

SEQ ID NO: 616221 - protein, 9 aa, Homo Sapiens
GGETAAKYV

SEQ ID NO: 616222 - protein, 9 aa, Homo Sapiens
TKRSVQEGE

SEQ ID NO: 616223 - protein, 9 aa, Homo Sapiens
GGHRPYEGP

SEQ ID NO: 616224 - protein, 9 aa, Homo Sapiens
WWGHVAQPA

SEQ ID NO: 616225 - protein, 9 aa, Homo Sapiens
RTLQAPKGA

SEQ ID NO: 616226 - protein, 9 aa, Homo Sapiens
KDFELPVDT

SEQ ID NO: 616227 - protein, 9 aa, Homo Sapiens
LAHFTILTA

SEQ ID NO: 616228 - protein, 9 aa, Homo Sapiens
QAVPRHTMR

SEQ ID NO: 616229 - protein, 9 aa, Homo Sapiens
FWQCLHYYK

SEQ ID NO: 616230 - protein, 9 aa, Homo Sapiens
VIEDSWLHK

SEQ ID NO: 616231 - protein, 9 aa, Homo Sapiens
TFGSKEAFG

SEQ ID NO: 616232 - protein, 9 aa, Homo Sapiens
RLAIIHELM

SEQ ID NO: 616233 - protein, 9 aa, Homo Sapiens
FGEIMYGGN

SEQ ID NO: 616234 - protein, 9 aa, Homo Sapiens
RLRAAVGDD

SEQ ID NO: 616235 - protein, 9 aa, Homo Sapiens
QLRKQHSMA

SEQ ID NO: 616236 - protein, 9 aa, Homo Sapiens
TALSEKEEE

SEQ ID NO: 616237 - protein, 9 aa, Homo Sapiens
SGDPAHIGL

SEQ ID NO: 616238 - protein, 9 aa, Homo Sapiens
EQLEKNLSP

SEQ ID NO: 616239 - protein, 9 aa, Homo Sapiens
RMEGKMPDG

SEQ ID NO: 616240 - protein, 9 aa, Homo Sapiens
PSIPPHAQS

SEQ ID NO: 616241 - protein, 9 aa, Homo Sapiens
QTSYLAAFA

SEQ ID NO: 616242 - protein, 9 aa, Homo Sapiens
PAHIGLCLW

SEQ ID NO: 616243 - protein, 9 aa, Homo Sapiens
NEMKNIQPG

SEQ ID NO: 616244 - protein, 9 aa, Homo Sapiens
KSKTKLGPE

SEQ ID NO: 616245 - protein, 9 aa, Homo Sapiens
VLLLGSECF

SEQ ID NO: 616246 - protein, 9 aa, Homo Sapiens
ILSESPLSE

SEQ ID NO: 616247 - protein, 9 aa, Homo Sapiens
YENGFGNSV

SEQ ID NO: 616248 - protein, 9 aa, Homo Sapiens
LMNGLGIDN

SEQ ID NO: 616249 - protein, 9 aa, Homo Sapiens
PGSANPSRL

SEQ ID NO: 616250 - protein, 9 aa, Homo Sapiens
FVQGHFTIN

SEQ ID NO: 616251 - protein, 9 aa, Homo Sapiens
GTLPTFHPT

SEQ ID NO: 616252 - protein, 9 aa, Homo Sapiens
DKEGAVVFA

SEQ ID NO: 616253 - protein, 9 aa, Homo Sapiens
RRISNMVGL

SEQ ID NO: 616254 - protein, 9 aa, Homo Sapiens
SRGFNDLEL

SEQ ID NO: 616255 - protein, 9 aa, Homo Sapiens
GLIVEQDTE

SEQ ID NO: 616256 - protein, 9 aa, Homo Sapiens
EFDESYKTG

SEQ ID NO: 616257 - protein, 9 aa, Homo Sapiens
AIIDQFVQR

SEQ ID NO: 616258 - protein, 9 aa, Homo Sapiens
GNPKKEGGD

SEQ ID NO: 616259 - protein, 9 aa, Homo Sapiens
HRQKYLIVD

SEQ ID NO: 616260 - protein, 9 aa, Homo Sapiens
APAASAPVT

SEQ ID NO: 616261 - protein, 9 aa, Homo Sapiens
LLLGHERIF

SEQ ID NO: 616262 - protein, 9 aa, Homo Sapiens
KDGADTHGR

SEQ ID NO: 616263 - protein, 9 aa, Homo Sapiens
DITEATNSH

SEQ ID NO: 616264 - protein, 9 aa, Homo Sapiens
LKKCISELF

SEQ ID NO: 616265 - protein, 9 aa, Homo Sapiens
LVEQNGTDN

SEQ ID NO: 616266 - protein, 9 aa, Homo Sapiens
MAQTSYLAA

SEQ ID NO: 616267 - protein, 9 aa, Homo Sapiens
PYHSMMGND

SEQ ID NO: 616268 - protein, 9 aa, Homo Sapiens
FPSSTNSSS

SEQ ID NO: 616269 - protein, 9 aa, Homo Sapiens
KPGMGGDPG

SEQ ID NO: 616270 - protein, 9 aa, Homo Sapiens
VQQPSFQQL

SEQ ID NO: 616271 - protein, 9 aa, Homo Sapiens
QNDLHHCPL

SEQ ID NO: 616272 - protein, 9 aa, Homo Sapiens
LEETGRTEI

SEQ ID NO: 616273 - protein, 9 aa, Homo Sapiens
IQPGDVCCW

SEQ ID NO: 616274 - protein, 9 aa, Homo Sapiens
HVAQCAQAV

SEQ ID NO: 616275 - protein, 9 aa, Homo Sapiens
LSQNDLHHC

SEQ ID NO: 616276 - protein, 9 aa, Homo Sapiens
NVFGEPPTK

SEQ ID NO: 616277 - protein, 9 aa, Homo Sapiens
MYINRPPSG

SEQ ID NO: 616278 - protein, 9 aa, Homo Sapiens
RPPACWVAG

SEQ ID NO: 616279 - protein, 9 aa, Homo Sapiens
PYIRRDYKT

SEQ ID NO: 616280 - protein, 9 aa, Homo Sapiens
HQSTAPVQY

SEQ ID NO: 616281 - protein, 9 aa, Homo Sapiens
GYCLTLFEA

SEQ ID NO: 616282 - protein, 9 aa, Homo Sapiens
QFVQRIISE

SEQ ID NO: 616283 - protein, 9 aa, Homo Sapiens
ACWVAGSWG

SEQ ID NO: 616284 - protein, 9 aa, Homo Sapiens
VTTDPFQQA

SEQ ID NO: 616285 - protein, 9 aa, Homo Sapiens
KRRVDIGVK

SEQ ID NO: 616286 - protein, 9 aa, Homo Sapiens
GDPGGVGAG

SEQ ID NO: 616287 - protein, 9 aa, Homo Sapiens
KNHYEKHKE

SEQ ID NO: 616288 - protein, 9 aa, Homo Sapiens
YHQTMDVPV

SEQ ID NO: 616289 - protein, 9 aa, Homo Sapiens
RILYLFYKD

SEQ ID NO: 616290 - protein, 9 aa, Homo Sapiens
NGGSCRQTG

SEQ ID NO: 616291 - protein, 9 aa, Homo Sapiens
VLSGSAKVA

SEQ ID NO: 616292 - protein, 9 aa, Homo Sapiens
ADLRKKLGK

SEQ ID NO: 616293 - protein, 9 aa, Homo Sapiens
PIKDLDGIR

SEQ ID NO: 616294 - protein, 9 aa, Homo Sapiens
QSIRCPCTT

SEQ ID NO: 616295 - protein, 9 aa, Homo Sapiens
CLYNLIVIH

SEQ ID NO: 616296 - protein, 9 aa, Homo Sapiens
FAFFVGITK

SEQ ID NO: 616297 - protein, 9 aa, Homo Sapiens
TKQVINGVE

SEQ ID NO: 616298 - protein, 9 aa, Homo Sapiens
LCHKNYIHL

SEQ ID NO: 616299 - protein, 9 aa, Homo Sapiens
KYFLGYNPM

SEQ ID NO: 616300 - protein, 9 aa, Homo Sapiens
EIMYGGNIT

SEQ ID NO: 616301 - protein, 9 aa, Homo Sapiens
DFLMWKENV

SEQ ID NO: 616302 - protein, 9 aa, Homo Sapiens
LGNTIFAFF

SEQ ID NO: 616303 - protein, 9 aa, Homo Sapiens
LDLKLLNNH

SEQ ID NO: 616304 - protein, 9 aa, Homo Sapiens
VFAQEISIG

SEQ ID NO: 616305 - protein, 9 aa, Homo Sapiens
FQKLRDAFL

SEQ ID NO: 616306 - protein, 9 aa, Homo Sapiens
QVLLGQAEH

SEQ ID NO: 616307 - protein, 9 aa, Homo Sapiens
FYKDMKKNP

SEQ ID NO: 616308 - protein, 9 aa, Homo Sapiens
HCYRPGTVA

SEQ ID NO: 616309 - protein, 9 aa, Homo Sapiens
PSESSTQWD

SEQ ID NO: 616310 - protein, 9 aa, Homo Sapiens
FTINDSYRF

SEQ ID NO: 616311 - protein, 9 aa, Homo Sapiens
LLKLKKCIS

SEQ ID NO: 616312 - protein, 9 aa, Homo Sapiens
TVTQFCTKS

SEQ ID NO: 616313 - protein, 9 aa, Homo Sapiens
PACHILAIY

SEQ ID NO: 616314 - protein, 9 aa, Homo Sapiens
METKIKNYY

SEQ ID NO: 616315 - protein, 9 aa, Homo Sapiens
PSNLGNLSF

SEQ ID NO: 616316 - protein, 9 aa, Homo Sapiens
GIEQLEKNL

SEQ ID NO: 616317 - protein, 9 aa, Homo Sapiens
TGVIIQPLQ

SEQ ID NO: 616318 - protein, 9 aa, Homo Sapiens
GGGGHRPYE

SEQ ID NO: 616319 - protein, 9 aa, Homo Sapiens
ALLSRQTKK

SEQ ID NO: 616320 - protein, 9 aa, Homo Sapiens
LGLRNNFYC

SEQ ID NO: 616321 - protein, 9 aa, Homo Sapiens
TGEKTGMTR

SEQ ID NO: 616322 - protein, 9 aa, Homo Sapiens
THTHTHTLT

SEQ ID NO: 616323 - protein, 9 aa, Homo Sapiens
LVIKAEQEN

SEQ ID NO: 616324 - protein, 9 aa, Homo Sapiens
TACSQRHFE

SEQ ID NO: 616325 - protein, 9 aa, Homo Sapiens
ESYKTGFKT

SEQ ID NO: 616326 - protein, 9 aa, Homo Sapiens
VILLAVLCW

SEQ ID NO: 616327 - protein, 9 aa, Homo Sapiens
KQDGSADLE

SEQ ID NO: 616328 - protein, 9 aa, Homo Sapiens
CRRPDSTCH

SEQ ID NO: 616329 - protein, 9 aa, Homo Sapiens
SANPSRLVS

SEQ ID NO: 616330 - protein, 9 aa, Homo Sapiens
ETKIKNYYK

SEQ ID NO: 616331 - protein, 9 aa, Homo Sapiens
QQIFDAKNM

SEQ ID NO: 616332 - protein, 9 aa, Homo Sapiens
DKTRVVSPI

SEQ ID NO: 616333 - protein, 9 aa, Homo Sapiens
QAEHKAEVD

SEQ ID NO: 616334 - protein, 9 aa, Homo Sapiens
YKDVMLEKY

SEQ ID NO: 616335 - protein, 9 aa, Homo Sapiens
SVPEGMVAS

SEQ ID NO: 616336 - protein, 9 aa, Homo Sapiens
IAPLKALVC

SEQ ID NO: 616337 - protein, 9 aa, Homo Sapiens
ETKANQEKV

SEQ ID NO: 616338 - protein, 9 aa, Homo Sapiens
QKGNFKCPA

SEQ ID NO: 616339 - protein, 9 aa, Homo Sapiens
MRELLDPSR

SEQ ID NO: 616340 - protein, 9 aa, Homo Sapiens
TWGLGHDHH

SEQ ID NO: 616341 - protein, 9 aa, Homo Sapiens
LEGMSKRKT

SEQ ID NO: 616342 - protein, 9 aa, Homo Sapiens
EAAEPALQA

SEQ ID NO: 616343 - protein, 9 aa, Homo Sapiens
GKRNNMKIS

SEQ ID NO: 616344 - protein, 9 aa, Homo Sapiens
YSHYIYWTC

SEQ ID NO: 616345 - protein, 9 aa, Homo Sapiens
TAPVQYGEL

SEQ ID NO: 616346 - protein, 9 aa, Homo Sapiens
GKWNPNCLM

SEQ ID NO: 616347 - protein, 9 aa, Homo Sapiens
ATLVNRGDN

SEQ ID NO: 616348 - protein, 9 aa, Homo Sapiens
LEKFQDTFT

SEQ ID NO: 616349 - protein, 9 aa, Homo Sapiens
PLSPQAALG

SEQ ID NO: 616350 - protein, 9 aa, Homo Sapiens
VGLIVEQDT

SEQ ID NO: 616351 - protein, 9 aa, Homo Sapiens
HFGIAIHLE

SEQ ID NO: 616352 - protein, 9 aa, Homo Sapiens
TYGGRKLIY

SEQ ID NO: 616353 - protein, 9 aa, Homo Sapiens
TIKSWREEG

SEQ ID NO: 616354 - protein, 9 aa, Homo Sapiens
AEQENGHPL

SEQ ID NO: 616355 - protein, 9 aa, Homo Sapiens
GVESCLYRL

SEQ ID NO: 616356 - protein, 9 aa, Homo Sapiens
LGIDNINEW

SEQ ID NO: 616357 - protein, 9 aa, Homo Sapiens
LISLVFAQE

SEQ ID NO: 616358 - protein, 9 aa, Homo Sapiens
HYIYWTCEA

SEQ ID NO: 616359 - protein, 9 aa, Homo Sapiens
RHGHRQKYL

SEQ ID NO: 616360 - protein, 9 aa, Homo Sapiens
RKNRVWVIS

SEQ ID NO: 616361 - protein, 9 aa, Homo Sapiens
SANSLISRR

SEQ ID NO: 616362 - protein, 9 aa, Homo Sapiens
RGRACFCAL

SEQ ID NO: 616363 - protein, 9 aa, Homo Sapiens
SVVHYLPVR

SEQ ID NO: 616364 - protein, 9 aa, Homo Sapiens
APKGALGNV

SEQ ID NO: 616365 - protein, 9 aa, Homo Sapiens
PVTTDPFQQ

SEQ ID NO: 616366 - protein, 9 aa, Homo Sapiens
AGATVHDLF

SEQ ID NO: 616367 - protein, 9 aa, Homo Sapiens
HDRWFRSVD

SEQ ID NO: 616368 - protein, 9 aa, Homo Sapiens
DGADTHGRL

SEQ ID NO: 616369 - protein, 9 aa, Homo Sapiens
DTPVSSAGE

SEQ ID NO: 616370 - protein, 9 aa, Homo Sapiens
VFKLKQFSQ

SEQ ID NO: 616371 - protein, 9 aa, Homo Sapiens
FCQKMLEKA

SEQ ID NO: 616372 - protein, 9 aa, Homo Sapiens
QRPADRAIV

SEQ ID NO: 616373 - protein, 9 aa, Homo Sapiens
CGTAKIPAC

SEQ ID NO: 616374 - protein, 9 aa, Homo Sapiens
VLTMKRLDV

SEQ ID NO: 616375 - protein, 9 aa, Homo Sapiens
ILGNTIFAF

SEQ ID NO: 616376 - protein, 9 aa, Homo Sapiens
GTAKIPACS

SEQ ID NO: 616377 - protein, 9 aa, Homo Sapiens
QTIKSWREE

SEQ ID NO: 616378 - protein, 9 aa, Homo Sapiens
PNCLMIDGL

SEQ ID NO: 616379 - protein, 9 aa, Homo Sapiens
VVAVTIGLQ

SEQ ID NO: 616380 - protein, 9 aa, Homo Sapiens
PRAGTTRAP

SEQ ID NO: 616381 - protein, 8 aa, Homo Sapiens
EQHNLTTV

SEQ ID NO: 616382 - protein, 9 aa, Homo Sapiens
KGNIPDQSQ

SEQ ID NO: 616383 - protein, 9 aa, Homo Sapiens
IQRKLNEEH

SEQ ID NO: 616384 - protein, 9 aa, Homo Sapiens
RLSFTVHSL

SEQ ID NO: 616385 - protein, 9 aa, Homo Sapiens
QQNDLLQII

SEQ ID NO: 616386 - protein, 9 aa, Homo Sapiens
AALEISLSN

SEQ ID NO: 616387 - protein, 9 aa, Homo Sapiens
IAAACIHMM

SEQ ID NO: 616388 - protein, 9 aa, Homo Sapiens
WRAALPDKS

SEQ ID NO: 616389 - protein, 9 aa, Homo Sapiens
QDGSADLEK

SEQ ID NO: 616390 - protein, 9 aa, Homo Sapiens
NLMKSQYKS

SEQ ID NO: 616391 - protein, 9 aa, Homo Sapiens
LQVMCIVCC

SEQ ID NO: 616392 - protein, 9 aa, Homo Sapiens
EGMSKRKTK

SEQ ID NO: 616393 - protein, 9 aa, Homo Sapiens
PSHTCGNPE

SEQ ID NO: 616394 - protein, 9 aa, Homo Sapiens
VKKPGSFPK

SEQ ID NO: 616395 - protein, 9 aa, Homo Sapiens
MWMAQTSYL

SEQ ID NO: 616396 - protein, 9 aa, Homo Sapiens
VSAGTLTFS

SEQ ID NO: 616397 - protein, 9 aa, Homo Sapiens
QEINSNKTV

SEQ ID NO: 616398 - protein, 9 aa, Homo Sapiens
RRQSIRCPC

SEQ ID NO: 616399 - protein, 9 aa, Homo Sapiens
AIIHELMHF

SEQ ID NO: 616400 - protein, 9 aa, Homo Sapiens
LLRDAALMV

SEQ ID NO: 616401 - protein, 9 aa, Homo Sapiens
LEISLSNME

SEQ ID NO: 616402 - protein, 9 aa, Homo Sapiens
ESPLSEKLR

SEQ ID NO: 616403 - protein, 9 aa, Homo Sapiens
YEGPGGGMG

SEQ ID NO: 616404 - protein, 9 aa, Homo Sapiens
ERECEMLKK

SEQ ID NO: 616405 - protein, 9 aa, Homo Sapiens
LTEQQNKES

SEQ ID NO: 616406 - protein, 9 aa, Homo Sapiens
YNQEQRQAF

SEQ ID NO: 616407 - protein, 9 aa, Homo Sapiens
DGQRPADRA

SEQ ID NO: 616408 - protein, 9 aa, Homo Sapiens
EQEASVALP

SEQ ID NO: 616409 - protein, 9 aa, Homo Sapiens
HFQNGNYCG

SEQ ID NO: 616410 - protein, 9 aa, Homo Sapiens
SNPACHILA

SEQ ID NO: 616411 - protein, 9 aa, Homo Sapiens
NDVKHDRWF

SEQ ID NO: 616412 - protein, 9 aa, Homo Sapiens
LMMQVGMET

SEQ ID NO: 616413 - protein, 9 aa, Homo Sapiens
DIYSHYIYW

SEQ ID NO: 616414 - protein, 9 aa, Homo Sapiens
GNMWESSRS

SEQ ID NO: 616415 - protein, 9 aa, Homo Sapiens
ECIAEHVDA

SEQ ID NO: 616416 - protein, 9 aa, Homo Sapiens
TVSEGVKTA

SEQ ID NO: 616417 - protein, 9 aa, Homo Sapiens
DSGSTAKRY

SEQ ID NO: 616418 - protein, 9 aa, Homo Sapiens
VNETLSNSN

SEQ ID NO: 616419 - protein, 9 aa, Homo Sapiens
KDWQWWGHV

SEQ ID NO: 616420 - protein, 9 aa, Homo Sapiens
EEPRLHGAW

SEQ ID NO: 616421 - protein, 9 aa, Homo Sapiens
TQIFFCVLL

SEQ ID NO: 616422 - protein, 9 aa, Homo Sapiens
ISEENKTTC

SEQ ID NO: 616423 - protein, 9 aa, Homo Sapiens
EHKAEVDMD

SEQ ID NO: 616424 - protein, 9 aa, Homo Sapiens
KPTVSEGVK

SEQ ID NO: 616425 - protein, 9 aa, Homo Sapiens
HMHPKKGQE

SEQ ID NO: 616426 - protein, 9 aa, Homo Sapiens
EKIRKYEQT

SEQ ID NO: 616427 - protein, 9 aa, Homo Sapiens
ASTPWVAIG

SEQ ID NO: 616428 - protein, 9 aa, Homo Sapiens
FHPTKVLEA

SEQ ID NO: 616429 - protein, 9 aa, Homo Sapiens
LKLKKCISE

SEQ ID NO: 616430 - protein, 9 aa, Homo Sapiens
GFGNSVQKH

SEQ ID NO: 616431 - protein, 9 aa, Homo Sapiens
AHDVFKLKQ

SEQ ID NO: 616432 - protein, 9 aa, Homo Sapiens
HFTILTALV

SEQ ID NO: 616433 - protein, 9 aa, Homo Sapiens
RERPHKCSL

SEQ ID NO: 616434 - protein, 9 aa, Homo Sapiens
LSPRIVKTH

SEQ ID NO: 616435 - protein, 9 aa, Homo Sapiens
IPPHAQSRP

SEQ ID NO: 616436 - protein, 9 aa, Homo Sapiens
QANERECEM

SEQ ID NO: 616437 - protein, 9 aa, Homo Sapiens
RSFLARILG

SEQ ID NO: 616438 - protein, 9 aa, Homo Sapiens
YPSSGIAQF

SEQ ID NO: 616439 - protein, 9 aa, Homo Sapiens
MSSGDPAHI

SEQ ID NO: 616440 - protein, 9 aa, Homo Sapiens
PEINSTAPV

SEQ ID NO: 616441 - protein, 9 aa, Homo Sapiens
NPLSPQAAL

SEQ ID NO: 616442 - protein, 9 aa, Homo Sapiens
PVGTGNHRD

SEQ ID NO: 616443 - protein, 9 aa, Homo Sapiens
NGTDNWKVI

SEQ ID NO: 616444 - protein, 9 aa, Homo Sapiens
FAGATVHDL

SEQ ID NO: 616445 - protein, 9 aa, Homo Sapiens
STILLQVAA

SEQ ID NO: 616446 - protein, 9 aa, Homo Sapiens
PPYHSMMGN

SEQ ID NO: 616447 - protein, 9 aa, Homo Sapiens
VIILWRQFC

SEQ ID NO: 616448 - protein, 9 aa, Homo Sapiens
LNVFSLLPA

SEQ ID NO: 616449 - protein, 9 aa, Homo Sapiens
PRSFLARIL

SEQ ID NO: 616450 - protein, 9 aa, Homo Sapiens
QWDLGGFSE

SEQ ID NO: 616451 - protein, 9 aa, Homo Sapiens
SQNDLHHCP

SEQ ID NO: 616452 - protein, 9 aa, Homo Sapiens
YSLVLDSPQ

SEQ ID NO: 616453 - protein, 9 aa, Homo Sapiens
ETLSNSNME

SEQ ID NO: 616454 - protein, 9 aa, Homo Sapiens
SRTALSEKE

SEQ ID NO: 616455 - protein, 9 aa, Homo Sapiens
ILMEYICLF

SEQ ID NO: 616456 - protein, 9 aa, Homo Sapiens
ILWRQFCQK

SEQ ID NO: 616457 - protein, 9 aa, Homo Sapiens
VLCWGRALY

SEQ ID NO: 616458 - protein, 9 aa, Homo Sapiens
DLVIKAEQE

SEQ ID NO: 616459 - protein, 9 aa, Homo Sapiens
SGKDGADTH

SEQ ID NO: 616460 - protein, 9 aa, Homo Sapiens
EEESKLDRK

SEQ ID NO: 616461 - protein, 9 aa, Homo Sapiens
RLIKHDEYN

SEQ ID NO: 616462 - protein, 9 aa, Homo Sapiens
IRAVPAEAP

SEQ ID NO: 616463 - protein, 9 aa, Homo Sapiens
TQNIENLGT

SEQ ID NO: 616464 - protein, 9 aa, Homo Sapiens
KILLDQVMG

SEQ ID NO: 616465 - protein, 9 aa, Homo Sapiens
RFVSMWMAQ

SEQ ID NO: 616466 - protein, 9 aa, Homo Sapiens
LLAVLCWGR

SEQ ID NO: 616467 - protein, 9 aa, Homo Sapiens
KEKIRKYEQ

SEQ ID NO: 616468 - protein, 9 aa, Homo Sapiens
TIEKCRKMI

SEQ ID NO: 616469 - protein, 9 aa, Homo Sapiens
MEKIWHHTL

SEQ ID NO: 616470 - protein, 9 aa, Homo Sapiens
GPEEKTLKD

SEQ ID NO: 616471 - protein, 9 aa, Homo Sapiens
GGNITDDWD

SEQ ID NO: 616472 - protein, 9 aa, Homo Sapiens
IYATDQKGN

SEQ ID NO: 616473 - protein, 9 aa, Homo Sapiens
AIQYEEDLE

SEQ ID NO: 616474 - protein, 9 aa, Homo Sapiens
FDDKTSVFV

SEQ ID NO: 616475 - protein, 9 aa, Homo Sapiens
QFCQKMLEK

SEQ ID NO: 616476 - protein, 9 aa, Homo Sapiens
PLRRPRLVQ

SEQ ID NO: 616477 - protein, 9 aa, Homo Sapiens
IIQPLQILF

SEQ ID NO: 616478 - protein, 9 aa, Homo Sapiens
GSDSCACPG

SEQ ID NO: 616479 - protein, 9 aa, Homo Sapiens
TLPTFHPTK

SEQ ID NO: 616480 - protein, 9 aa, Homo Sapiens
RPFDDKTSV

SEQ ID NO: 616481 - protein, 9 aa, Homo Sapiens
EKNLSPRIV

SEQ ID NO: 616482 - protein, 9 aa, Homo Sapiens
NVTASSPVA

SEQ ID NO: 616483 - protein, 9 aa, Homo Sapiens
GSYYPSSGI

SEQ ID NO: 616484 - protein, 9 aa, Homo Sapiens
GVKKPHCYR

SEQ ID NO: 616485 - protein, 9 aa, Homo Sapiens
GVIIQPLQI

SEQ ID NO: 616486 - protein, 9 aa, Homo Sapiens
LKVNPLSPQ

SEQ ID NO: 616487 - protein, 9 aa, Homo Sapiens
LMKSQYKST

SEQ ID NO: 616488 - protein, 9 aa, Homo Sapiens
ANHTSQEIN

SEQ ID NO: 616489 - protein, 9 aa, Homo Sapiens
NMWESSRSI

SEQ ID NO: 616490 - protein, 9 aa, Homo Sapiens
MYRRISNMV

SEQ ID NO: 616491 - protein, 9 aa, Homo Sapiens
ERSRGSLEC

SEQ ID NO: 616492 - protein, 9 aa, Homo Sapiens
PPERRMEGK

SEQ ID NO: 616493 - protein, 9 aa, Homo Sapiens
LPLLLISLV

SEQ ID NO: 616494 - protein, 9 aa, Homo Sapiens
MHPKKGQEL

SEQ ID NO: 616495 - protein, 9 aa, Homo Sapiens
RQTFLKLKY

SEQ ID NO: 616496 - protein, 9 aa, Homo Sapiens
KVMLEYEPA

SEQ ID NO: 616497 - protein, 9 aa, Homo Sapiens
TINDSYRFS

SEQ ID NO: 616498 - protein, 9 aa, Homo Sapiens
NLIVIHKKK

SEQ ID NO: 616499 - protein, 9 aa, Homo Sapiens
SRQTKKRRV

SEQ ID NO: 616500 - protein, 9 aa, Homo Sapiens
ASAPVTTDP

SEQ ID NO: 616501 - protein, 9 aa, Homo Sapiens
KRVSSPKKP

SEQ ID NO: 616502 - protein, 9 aa, Homo Sapiens
EGAVVFAPS

SEQ ID NO: 616503 - protein, 9 aa, Homo Sapiens
KREYKVHIN

SEQ ID NO: 616504 - protein, 9 aa, Homo Sapiens
YSANSLISR

SEQ ID NO: 616505 - protein, 9 aa, Homo Sapiens
EQENGHPLP

SEQ ID NO: 616506 - protein, 9 aa, Homo Sapiens
LLEHEVPPF

SEQ ID NO: 616507 - protein, 9 aa, Homo Sapiens
DEGNPKKEG

SEQ ID NO: 616508 - protein, 9 aa, Homo Sapiens
LYNELRVAP

SEQ ID NO: 616509 - protein, 9 aa, Homo Sapiens
QYKSTILLQ

SEQ ID NO: 616510 - protein, 9 aa, Homo Sapiens
NNFYCMAQL

SEQ ID NO: 616511 - protein, 9 aa, Homo Sapiens
AFWQCLHYY

SEQ ID NO: 616512 - protein, 9 aa, Homo Sapiens
TVHSLLDLP

SEQ ID NO: 616513 - protein, 9 aa, Homo Sapiens
QVGLDERRG

SEQ ID NO: 616514 - protein, 9 aa, Homo Sapiens
ATQIFFCVL

SEQ ID NO: 616515 - protein, 9 aa, Homo Sapiens
PGALAGAVV

SEQ ID NO: 616516 - protein, 9 aa, Homo Sapiens
SLVFAQEIS

SEQ ID NO: 616517 - protein, 9 aa, Homo Sapiens
HKEIAAACI

SEQ ID NO: 616518 - protein, 9 aa, Homo Sapiens
PPLSGKRNN

SEQ ID NO: 616519 - protein, 9 aa, Homo Sapiens
QKQKRSNHR

SEQ ID NO: 616520 - protein, 9 aa, Homo Sapiens
GNIPDQSQV

SEQ ID NO: 616521 - protein, 9 aa, Homo Sapiens
KRLAIIHEL

SEQ ID NO: 616522 - protein, 9 aa, Homo Sapiens
EESKLDRKH

SEQ ID NO: 616523 - protein, 9 aa, Homo Sapiens
STGRVNETL

SEQ ID NO: 616524 - protein, 9 aa, Homo Sapiens
ESGPHDLME

SEQ ID NO: 616525 - protein, 9 aa, Homo Sapiens
NGEASEGAE

SEQ ID NO: 616526 - protein, 9 aa, Homo Sapiens
EKTKRVSSP

SEQ ID NO: 616527 - protein, 9 aa, Homo Sapiens
NLSPRIVKT

SEQ ID NO: 616528 - protein, 9 aa, Homo Sapiens
WLHKPMYYF

SEQ ID NO: 616529 - protein, 9 aa, Homo Sapiens
VTNASRTMV

SEQ ID NO: 616530 - protein, 9 aa, Homo Sapiens
QTFLKLKYY

SEQ ID NO: 616531 - protein, 9 aa, Homo Sapiens
GVSVGLIVE

SEQ ID NO: 616532 - protein, 9 aa, Homo Sapiens
KANQEKVLC

SEQ ID NO: 616533 - protein, 9 aa, Homo Sapiens
TKANQEKVL

SEQ ID NO: 616534 - protein, 9 aa, Homo Sapiens
LQILFTGNK

SEQ ID NO: 616535 - protein, 9 aa, Homo Sapiens
APRSFLARI

SEQ ID NO: 616536 - protein, 9 aa, Homo Sapiens
SSSAKLILL

SEQ ID NO: 616537 - protein, 9 aa, Homo Sapiens
PGRGVATGP

SEQ ID NO: 616538 - protein, 9 aa, Homo Sapiens
LIVIHKKKY

SEQ ID NO: 616539 - protein, 9 aa, Homo Sapiens
VNRGDNTYG

SEQ ID NO: 616540 - protein, 9 aa, Homo Sapiens
SQYKSTILL

SEQ ID NO: 616541 - protein, 9 aa, Homo Sapiens
PIALDDLRC

SEQ ID NO: 616542 - protein, 9 aa, Homo Sapiens
MDVPVLVGD

SEQ ID NO: 616543 - protein, 9 aa, Homo Sapiens
SAACDDYFI

SEQ ID NO: 616544 - protein, 9 aa, Homo Sapiens
PGTNPRLME

SEQ ID NO: 616545 - protein, 9 aa, Homo Sapiens
LSIDIYSHY

SEQ ID NO: 616546 - protein, 9 aa, Homo Sapiens
DQHPVGTGN

SEQ ID NO: 616547 - protein, 9 aa, Homo Sapiens
PDIRGRACF

SEQ ID NO: 616548 - protein, 9 aa, Homo Sapiens
FGTLVLLCY

SEQ ID NO: 616549 - protein, 9 aa, Homo Sapiens
QKNTIRREV

SEQ ID NO: 616550 - protein, 9 aa, Homo Sapiens
LSEKEEEER

SEQ ID NO: 616551 - protein, 9 aa, Homo Sapiens
AVLCWGRAL

SEQ ID NO: 616552 - protein, 9 aa, Homo Sapiens
PNSNSMYIN

SEQ ID NO: 616553 - protein, 9 aa, Homo Sapiens
LAGAVVGAA

SEQ ID NO: 616554 - protein, 9 aa, Homo Sapiens
YCAEDQTIK

SEQ ID NO: 616555 - protein, 9 aa, Homo Sapiens
AVTIGLQVH

SEQ ID NO: 616556 - protein, 9 aa, Homo Sapiens
GHERIFTRA

SEQ ID NO: 616557 - protein, 9 aa, Homo Sapiens
PYRCVHHGC

SEQ ID NO: 616558 - protein, 9 aa, Homo Sapiens
GGVGAGDMA

SEQ ID NO: 616559 - protein, 9 aa, Homo Sapiens
IFYQFRARS

SEQ ID NO: 616560 - protein, 9 aa, Homo Sapiens
DVMLEKYSH

SEQ ID NO: 616561 - protein, 9 aa, Homo Sapiens
RFLDLSQND

SEQ ID NO: 616562 - protein, 9 aa, Homo Sapiens
EKDITEATN

SEQ ID NO: 616563 - protein, 9 aa, Homo Sapiens
MISSTYNSE

SEQ ID NO: 616564 - protein, 9 aa, Homo Sapiens
ETAAKYVKS

SEQ ID NO: 616565 - protein, 9 aa, Homo Sapiens
LPFTSKTPN

SEQ ID NO: 616566 - protein, 9 aa, Homo Sapiens
YLLLKLKKC

SEQ ID NO: 616567 - protein, 9 aa, Homo Sapiens
YEPEINSTA

SEQ ID NO: 616568 - protein, 9 aa, Homo Sapiens
SFVNNIFER

SEQ ID NO: 616569 - protein, 9 aa, Homo Sapiens
RQSIRCPCT

SEQ ID NO: 616570 - protein, 9 aa, Homo Sapiens
SDSGSTAKR

SEQ ID NO: 616571 - protein, 9 aa, Homo Sapiens
MAGCAHVAQ

SEQ ID NO: 616572 - protein, 9 aa, Homo Sapiens
CAPNEMKNI

SEQ ID NO: 616573 - protein, 9 aa, Homo Sapiens
CNTGSSGCS

SEQ ID NO: 616574 - protein, 9 aa, Homo Sapiens
VEVLQQQPP

SEQ ID NO: 616575 - protein, 9 aa, Homo Sapiens
NPSRLVSSY

SEQ ID NO: 616576 - protein, 9 aa, Homo Sapiens
TVEVLQQQP

SEQ ID NO: 616577 - protein, 9 aa, Homo Sapiens
KEVGFFIIL

SEQ ID NO: 616578 - protein, 9 aa, Homo Sapiens
YKTKPPKLQ

SEQ ID NO: 616579 - protein, 9 aa, Homo Sapiens
QRHFEISKF

SEQ ID NO: 616580 - protein, 9 aa, Homo Sapiens
LLNNHILVK

SEQ ID NO: 616581 - protein, 9 aa, Homo Sapiens
MWESSRSIC

SEQ ID NO: 616582 - protein, 9 aa, Homo Sapiens
APFRDRSHI

SEQ ID NO: 616583 - protein, 9 aa, Homo Sapiens
DAFLKFDTL

SEQ ID NO: 616584 - protein, 9 aa, Homo Sapiens
LVQRTQSVP

SEQ ID NO: 616585 - protein, 9 aa, Homo Sapiens
RPMDNLLGG

SEQ ID NO: 616586 - protein, 9 aa, Homo Sapiens
TGSSGCSEN

SEQ ID NO: 616587 - protein, 9 aa, Homo Sapiens
DQTIKSWRE

SEQ ID NO: 616588 - protein, 9 aa, Homo Sapiens
VPLSQLHPS

SEQ ID NO: 616589 - protein, 9 aa, Homo Sapiens
LSGSNVTAS

SEQ ID NO: 616590 - protein, 9 aa, Homo Sapiens
YFLGYNPMI

SEQ ID NO: 616591 - protein, 9 aa, Homo Sapiens
SLLPAQAGA

SEQ ID NO: 616592 - protein, 9 aa, Homo Sapiens
SYRAKMLLR

SEQ ID NO: 616593 - protein, 9 aa, Homo Sapiens
ASLDQLKGL

SEQ ID NO: 616594 - protein, 9 aa, Homo Sapiens
LKFAAYLKR

SEQ ID NO: 616595 - protein, 9 aa, Homo Sapiens
VADLRKKLG

SEQ ID NO: 616596 - protein, 9 aa, Homo Sapiens
TQDILEKFQ

SEQ ID NO: 616597 - protein, 9 aa, Homo Sapiens
DYFIQNNVT

SEQ ID NO: 616598 - protein, 9 aa, Homo Sapiens
LNLVHMHPK

SEQ ID NO: 616599 - protein, 9 aa, Homo Sapiens
TCGNPEEIL

SEQ ID NO: 616600 - protein, 9 aa, Homo Sapiens
AVAKYFLGY

SEQ ID NO: 616601 - protein, 9 aa, Homo Sapiens
SRGKWNPNC

SEQ ID NO: 616602 - protein, 9 aa, Homo Sapiens
DNLLGGEKT

SEQ ID NO: 616603 - protein, 9 aa, Homo Sapiens
LASQSSPGD

SEQ ID NO: 616604 - protein, 9 aa, Homo Sapiens
TCDECGKSC

SEQ ID NO: 616605 - protein, 9 aa, Homo Sapiens
VTASVQADL

SEQ ID NO: 616606 - protein, 9 aa, Homo Sapiens
HYLPVRVLP

SEQ ID NO: 616607 - protein, 9 aa, Homo Sapiens
KDFRLPGLS

SEQ ID NO: 616608 - protein, 9 aa, Homo Sapiens
LQIIRRSQE

SEQ ID NO: 616609 - protein, 9 aa, Homo Sapiens
EAPRAGTTR

SEQ ID NO: 616610 - protein, 9 aa, Homo Sapiens
DFELPVDTL

SEQ ID NO: 616611 - protein, 9 aa, Homo Sapiens
TAAKYVKSR

SEQ ID NO: 616612 - protein, 9 aa, Homo Sapiens
ERPHKCSLC

SEQ ID NO: 616613 - protein, 9 aa, Homo Sapiens
FELPVDTLY

SEQ ID NO: 616614 - protein, 9 aa, Homo Sapiens
FKLKQFSQL

SEQ ID NO: 616615 - protein, 9 aa, Homo Sapiens
SCACPGNTE

SEQ ID NO: 616616 - protein, 9 aa, Homo Sapiens
PPTKLQIKQ

SEQ ID NO: 616617 - protein, 9 aa, Homo Sapiens
QALEPKNGE

SEQ ID NO: 616618 - protein, 9 aa, Homo Sapiens
LPTFHPTKV

SEQ ID NO: 616619 - protein, 9 aa, Homo Sapiens
IEKCRKMIP

SEQ ID NO: 616620 - protein, 9 aa, Homo Sapiens
MTMTDPYKF

SEQ ID NO: 616621 - protein, 9 aa, Homo Sapiens
GIDNINEWH

SEQ ID NO: 616622 - protein, 9 aa, Homo Sapiens
SSTIQRKLN

SEQ ID NO: 616623 - protein, 9 aa, Homo Sapiens
SSDTESIPC

SEQ ID NO: 616624 - protein, 9 aa, Homo Sapiens
WERNPYTIS

SEQ ID NO: 616625 - protein, 9 aa, Homo Sapiens
LGYCLTLFE

SEQ ID NO: 616626 - protein, 9 aa, Homo Sapiens
LEKYSHLVS

SEQ ID NO: 616627 - protein, 9 aa, Homo Sapiens
PPDTNLLPG

SEQ ID NO: 616628 - protein, 9 aa, Homo Sapiens
HGGETAAKY

SEQ ID NO: 616629 - protein, 9 aa, Homo Sapiens
PLSEQIAIT

SEQ ID NO: 616630 - protein, 9 aa, Homo Sapiens
ADRAIVHST

SEQ ID NO: 616631 - protein, 9 aa, Homo Sapiens
VESCLYRLG

SEQ ID NO: 616632 - protein, 9 aa, Homo Sapiens
KKPHCYRPG

SEQ ID NO: 616633 - protein, 9 aa, Homo Sapiens
RTALSEKEE

SEQ ID NO: 616634 - protein, 9 aa, Homo Sapiens
GNDEDACRD

SEQ ID NO: 616635 - protein, 9 aa, Homo Sapiens
EPGKFSTYG

SEQ ID NO: 616636 - protein, 9 aa, Homo Sapiens
SEQEASVAL

SEQ ID NO: 616637 - protein, 9 aa, Homo Sapiens
SIPCPHTEA

SEQ ID NO: 616638 - protein, 9 aa, Homo Sapiens
NGLGIDNIN

SEQ ID NO: 616639 - protein, 9 aa, Homo Sapiens
GILMEYICL

SEQ ID NO: 616640 - protein, 9 aa, Homo Sapiens
CAPTVTQFC

SEQ ID NO: 616641 - protein, 9 aa, Homo Sapiens
PDDRPPACW

SEQ ID NO: 616642 - protein, 9 aa, Homo Sapiens
KYVKSRLPE

SEQ ID NO: 616643 - protein, 9 aa, Homo Sapiens
MYHQTMDVP

SEQ ID NO: 616644 - protein, 9 aa, Homo Sapiens
AIVPFSSDS

SEQ ID NO: 616645 - protein, 9 aa, Homo Sapiens
HFTINDSYR

SEQ ID NO: 616646 - protein, 9 aa, Homo Sapiens
PTFHPTKVL

SEQ ID NO: 616647 - protein, 9 aa, Homo Sapiens
GGGHRPYEG

SEQ ID NO: 616648 - protein, 9 aa, Homo Sapiens
NSVLSHFHV

SEQ ID NO: 616649 - protein, 9 aa, Homo Sapiens
VSRGFNDLE

SEQ ID NO: 616650 - protein, 9 aa, Homo Sapiens
SSYPGSDSC

SEQ ID NO: 616651 - protein, 9 aa, Homo Sapiens
CKAIIDQFV

SEQ ID NO: 616652 - protein, 9 aa, Homo Sapiens
NGANDVKHD

SEQ ID NO: 616653 - protein, 9 aa, Homo Sapiens
CHFQNGNYC

SEQ ID NO: 616654 - protein, 9 aa, Homo Sapiens
PSSDRLKPT

SEQ ID NO: 616655 - protein, 9 aa, Homo Sapiens
LRKQHSMAI

SEQ ID NO: 616656 - protein, 9 aa, Homo Sapiens
LRVKNHYEK

SEQ ID NO: 616657 - protein, 9 aa, Homo Sapiens
VHPRLKVNP

SEQ ID NO: 616658 - protein, 9 aa, Homo Sapiens
KKCISELFQ

SEQ ID NO: 616659 - protein, 9 aa, Homo Sapiens
CIAEHVDAS

SEQ ID NO: 616660 - protein, 9 aa, Homo Sapiens
WQWWGHVAQ

SEQ ID NO: 616661 - protein, 9 aa, Homo Sapiens
LGEVLHKFK

SEQ ID NO: 616662 - protein, 9 aa, Homo Sapiens
LPIQEAQQD

SEQ ID NO: 616663 - protein, 9 aa, Homo Sapiens
TKKRRVDIG

SEQ ID NO: 616664 - protein, 9 aa, Homo Sapiens
GIMNSFVNN

SEQ ID NO: 616665 - protein, 9 aa, Homo Sapiens
LGQAEHKAE

SEQ ID NO: 616666 - protein, 9 aa, Homo Sapiens
NPLSRSVAD

SEQ ID NO: 616667 - protein, 9 aa, Homo Sapiens
NSLISRREH

SEQ ID NO: 616668 - protein, 9 aa, Homo Sapiens
VMCIVCCQS

SEQ ID NO: 616669 - protein, 9 aa, Homo Sapiens
QIFDAKNMM

SEQ ID NO: 616670 - protein, 9 aa, Homo Sapiens
KKGDVKPLS

SEQ ID NO: 616671 - protein, 9 aa, Homo Sapiens
LFNWLSVLV

SEQ ID NO: 616672 - protein, 9 aa, Homo Sapiens
SWLHKPMYY

SEQ ID NO: 616673 - protein, 9 aa, Homo Sapiens
PWVAIGSAY

SEQ ID NO: 616674 - protein, 9 aa, Homo Sapiens
SMWMAQTSY

SEQ ID NO: 616675 - protein, 9 aa, Homo Sapiens
LWGMFGTLV

SEQ ID NO: 616676 - protein, 9 aa, Homo Sapiens
GHGGETAAK

SEQ ID NO: 616677 - protein, 9 aa, Homo Sapiens
FARKNRVWV

SEQ ID NO: 616678 - protein, 9 aa, Homo Sapiens
DQSQVEKLN

SEQ ID NO: 616679 - protein, 9 aa, Homo Sapiens
EMKNIQPGD

SEQ ID NO: 616680 - protein, 9 aa, Homo Sapiens
QHSMAIPSG

SEQ ID NO: 616681 - protein, 9 aa, Homo Sapiens
QSQVEKLNV

SEQ ID NO: 616682 - protein, 9 aa, Homo Sapiens
QIIRRSQEV

SEQ ID NO: 616683 - protein, 9 aa, Homo Sapiens
KFAAYLKRE

SEQ ID NO: 616684 - protein, 9 aa, Homo Sapiens
AQLQVGPKE

SEQ ID NO: 616685 - protein, 9 aa, Homo Sapiens
NDEDACRDT

SEQ ID NO: 616686 - protein, 9 aa, Homo Sapiens
ALAHFTILT

SEQ ID NO: 616687 - protein, 9 aa, Homo Sapiens
VLQQQPPDL

SEQ ID NO: 616688 - protein, 9 aa, Homo Sapiens
ALDDLRCSG

SEQ ID NO: 616689 - protein, 9 aa, Homo Sapiens
LSNPACHIL

SEQ ID NO: 616690 - protein, 9 aa, Homo Sapiens
ALPFTSKTP

SEQ ID NO: 616691 - protein, 9 aa, Homo Sapiens
EDQTIKSWR

SEQ ID NO: 616692 - protein, 9 aa, Homo Sapiens
SDRLKPTVS

SEQ ID NO: 616693 - protein, 9 aa, Homo Sapiens
LQVGLDERR

SEQ ID NO: 616694 - protein, 9 aa, Homo Sapiens
KLDRKHSEV

SEQ ID NO: 616695 - protein, 9 aa, Homo Sapiens
LRCSGHESY

SEQ ID NO: 616696 - protein, 9 aa, Homo Sapiens
DKTSVFVAE

SEQ ID NO: 616697 - protein, 9 aa, Homo Sapiens
SSLGISVLS

SEQ ID NO: 616698 - protein, 9 aa, Homo Sapiens
SVTASVQAD

SEQ ID NO: 616699 - protein, 9 aa, Homo Sapiens
MGDNMGINH

SEQ ID NO: 616700 - protein, 9 aa, Homo Sapiens
TEISPEENG

SEQ ID NO: 616701 - protein, 9 aa, Homo Sapiens
PKILLDQVM

SEQ ID NO: 616702 - protein, 9 aa, Homo Sapiens
KNDVDLPGN

SEQ ID NO: 616703 - protein, 9 aa, Homo Sapiens
SSAGEAPGG

SEQ ID NO: 616704 - protein, 9 aa, Homo Sapiens
TRQTFLKLK

SEQ ID NO: 616705 - protein, 9 aa, Homo Sapiens
EAFGFQHPV

SEQ ID NO: 616706 - protein, 9 aa, Homo Sapiens
VCAPTVTQF

SEQ ID NO: 616707 - protein, 9 aa, Homo Sapiens
HCEDGGFTC

SEQ ID NO: 616708 - protein, 9 aa, Homo Sapiens
YFAWERNPY

SEQ ID NO: 616709 - protein, 9 aa, Homo Sapiens
GVATGPGFP

SEQ ID NO: 616710 - protein, 9 aa, Homo Sapiens
AHSRKQRQT

SEQ ID NO: 616711 - protein, 9 aa, Homo Sapiens
CQKMLEKAS

SEQ ID NO: 616712 - protein, 9 aa, Homo Sapiens
RKMIPAFRT

SEQ ID NO: 616713 - protein, 9 aa, Homo Sapiens
GLQVGLDER

SEQ ID NO: 616714 - protein, 9 aa, Homo Sapiens
SPLSEKLRT

SEQ ID NO: 616715 - protein, 9 aa, Homo Sapiens
NVKKPGSFP

SEQ ID NO: 616716 - protein, 9 aa, Homo Sapiens
IALDDLRCS

SEQ ID NO: 616717 - protein, 9 aa, Homo Sapiens
ISLVFAQEI

SEQ ID NO: 616718 - protein, 9 aa, Homo Sapiens
QIFFCVLLL

SEQ ID NO: 616719 - protein, 9 aa, Homo Sapiens
RRRQSIRCP

SEQ ID NO: 616720 - protein, 9 aa, Homo Sapiens
KAIIDQFVQ

SEQ ID NO: 616721 - protein, 9 aa, Homo Sapiens
ISVLSGSAK

SEQ ID NO: 616722 - protein, 9 aa, Homo Sapiens
QKLRDAFLK

SEQ ID NO: 616723 - protein, 9 aa, Homo Sapiens
VALPFTSKT

SEQ ID NO: 616724 - protein, 9 aa, Homo Sapiens
FVCIQQDIL

SEQ ID NO: 616725 - protein, 9 aa, Homo Sapiens
FTIAHEMGD

SEQ ID NO: 616726 - protein, 9 aa, Homo Sapiens
KNIQPGDVC

SEQ ID NO: 616727 - protein, 9 aa, Homo Sapiens
STRQTFLKL

SEQ ID NO: 616728 - protein, 9 aa, Homo Sapiens
EVLQQQPPD

SEQ ID NO: 616729 - protein, 9 aa, Homo Sapiens
DPGGVGAGD

SEQ ID NO: 616730 - protein, 9 aa, Homo Sapiens
STAPVEKPY

SEQ ID NO: 616731 - protein, 9 aa, Homo Sapiens
WNPNCLMID

SEQ ID NO: 616732 - protein, 9 aa, Homo Sapiens
LTQQIFDAK

SEQ ID NO: 616733 - protein, 9 aa, Homo Sapiens
GQQHPVQQP

SEQ ID NO: 616734 - protein, 9 aa, Homo Sapiens
SFPDPQGTL

SEQ ID NO: 616735 - protein, 9 aa, Homo Sapiens
NNIFERIAS

SEQ ID NO: 616736 - protein, 9 aa, Homo Sapiens
RPPASSVNT

SEQ ID NO: 616737 - protein, 9 aa, Homo Sapiens
GYAVSRGFN

SEQ ID NO: 616738 - protein, 9 aa, Homo Sapiens
MKELRVKNH

SEQ ID NO: 616739 - protein, 9 aa, Homo Sapiens
LKFDTLNHS

SEQ ID NO: 616740 - protein, 9 aa, Homo Sapiens
KWNPNCLMI

SEQ ID NO: 616741 - protein, 9 aa, Homo Sapiens
KAKTWGLGH

SEQ ID NO: 616742 - protein, 9 aa, Homo Sapiens
GPIALDDLR

SEQ ID NO: 616743 - protein, 9 aa, Homo Sapiens
SVQKHGEYW

SEQ ID NO: 616744 - protein, 9 aa, Homo Sapiens
HTHTLTHTH

SEQ ID NO: 616745 - protein, 9 aa, Homo Sapiens
ERIFTRAKS

SEQ ID NO: 616746 - protein, 9 aa, Homo Sapiens
ALAGAVVGA

SEQ ID NO: 616747 - protein, 9 aa, Homo Sapiens
ALKEKIRKY

SEQ ID NO: 616748 - protein, 9 aa, Homo Sapiens
ELGYCLTLF

SEQ ID NO: 616749 - protein, 9 aa, Homo Sapiens
QTGVIIQPL

SEQ ID NO: 616750 - protein, 9 aa, Homo Sapiens
GQGATLVNR

SEQ ID NO: 616751 - protein, 9 aa, Homo Sapiens
SMAIPSGGL

SEQ ID NO: 616752 - protein, 9 aa, Homo Sapiens
NTEKDITEA

SEQ ID NO: 616753 - protein, 9 aa, Homo Sapiens
AEPALQAQA

SEQ ID NO: 616754 - protein, 9 aa, Homo Sapiens
GHRQKYLIV

SEQ ID NO: 616755 - protein, 9 aa, Homo Sapiens
LLLDIRYRI

SEQ ID NO: 616756 - protein, 9 aa, Homo Sapiens
RVSQLLHLC

SEQ ID NO: 616757 - protein, 9 aa, Homo Sapiens
AKDFRLPGL

SEQ ID NO: 616758 - protein, 9 aa, Homo Sapiens
DYTQRYIFV

SEQ ID NO: 616759 - protein, 9 aa, Homo Sapiens
YLWGMFGTL

SEQ ID NO: 616760 - protein, 9 aa, Homo Sapiens
TDAEFDESY

SEQ ID NO: 616761 - protein, 9 aa, Homo Sapiens
PHCYRPGTV

SEQ ID NO: 616762 - protein, 9 aa, Homo Sapiens
ADLEKSYSF

SEQ ID NO: 616763 - protein, 9 aa, Homo Sapiens
INRPPSGKT

SEQ ID NO: 616764 - protein, 9 aa, Homo Sapiens
KYEQTLKNQ

SEQ ID NO: 616765 - protein, 9 aa, Homo Sapiens
FLNVFSLLP

SEQ ID NO: 616766 - protein, 9 aa, Homo Sapiens
KSWREEGFP

SEQ ID NO: 616767 - protein, 9 aa, Homo Sapiens
KEGGDRRAS

SEQ ID NO: 616768 - protein, 9 aa, Homo Sapiens
GTNPRLMEL

SEQ ID NO: 616769 - protein, 9 aa, Homo Sapiens
RAGTTRAPM

SEQ ID NO: 616770 - protein, 9 aa, Homo Sapiens
ASSVNTGGI

SEQ ID NO: 616771 - protein, 9 aa, Homo Sapiens
SVLSGSAKV

SEQ ID NO: 616772 - protein, 9 aa, Homo Sapiens
LIPGQQHPV

SEQ ID NO: 616773 - protein, 9 aa, Homo Sapiens
SSLSGQLTE

SEQ ID NO: 616774 - protein, 9 aa, Homo Sapiens
KRLLVERSN

SEQ ID NO: 616775 - protein, 9 aa, Homo Sapiens
PMAGCAHVA

SEQ ID NO: 616776 - protein, 9 aa, Homo Sapiens
YKTGFKTST

SEQ ID NO: 616777 - protein, 9 aa, Homo Sapiens
PVSSAGEAP

SEQ ID NO: 616778 - protein, 9 aa, Homo Sapiens
ELTQQIFDA

SEQ ID NO: 616779 - protein, 9 aa, Homo Sapiens
RTMVFNIHS

SEQ ID NO: 616780 - protein, 9 aa, Homo Sapiens
CPHTEAAKD

SEQ ID NO: 616781 - protein, 9 aa, Homo Sapiens
CHCEDGGFT

SEQ ID NO: 616782 - protein, 9 aa, Homo Sapiens
ARKNRVWVI

SEQ ID NO: 616783 - protein, 9 aa, Homo Sapiens
LKALVCERM

SEQ ID NO: 616784 - protein, 9 aa, Homo Sapiens
LYKDVMLEK

SEQ ID NO: 616785 - protein, 9 aa, Homo Sapiens
KTKPPKLQL

SEQ ID NO: 616786 - protein, 9 aa, Homo Sapiens
IELCEPIEV

SEQ ID NO: 616787 - protein, 9 aa, Homo Sapiens
NTGSSGCSE

SEQ ID NO: 616788 - protein, 9 aa, Homo Sapiens
PLSDLLKVM

SEQ ID NO: 616789 - protein, 9 aa, Homo Sapiens
LVEAFWQCL

SEQ ID NO: 616790 - protein, 9 aa, Homo Sapiens
PPACWVAGS

SEQ ID NO: 616791 - protein, 9 aa, Homo Sapiens
ELVGWADGR

SEQ ID NO: 616792 - protein, 9 aa, Homo Sapiens
HKDWQWWGH

SEQ ID NO: 616793 - protein, 9 aa, Homo Sapiens
VFAPSVKGV

SEQ ID NO: 616794 - protein, 9 aa, Homo Sapiens
IRYRINRLA

SEQ ID NO: 616795 - protein, 9 aa, Homo Sapiens
ITEATNSHF

SEQ ID NO: 616796 - protein, 9 aa, Homo Sapiens
GMGGDPGGV

SEQ ID NO: 616797 - protein, 9 aa, Homo Sapiens
HHGCFAAFT

SEQ ID NO: 616798 - protein, 9 aa, Homo Sapiens
PSSSLSGQL

SEQ ID NO: 616799 - protein, 9 aa, Homo Sapiens
LKREYKVHI

SEQ ID NO: 616800 - protein, 9 aa, Homo Sapiens
DTLDYLRPV

SEQ ID NO: 616801 - protein, 9 aa, Homo Sapiens
AHVAQCAQA

SEQ ID NO: 616802 - protein, 9 aa, Homo Sapiens
SHFHVVFSS

SEQ ID NO: 616803 - protein, 9 aa, Homo Sapiens
GFRISEENK

SEQ ID NO: 616804 - protein, 9 aa, Homo Sapiens
LRRPRLVQR

SEQ ID NO: 616805 - protein, 9 aa, Homo Sapiens
AEFDESYKT

SEQ ID NO: 616806 - protein, 9 aa, Homo Sapiens
WHHTLYNEL

SEQ ID NO: 616807 - protein, 9 aa, Homo Sapiens
VSSPKKPSL

SEQ ID NO: 616808 - protein, 9 aa, Homo Sapiens
ESSRSICPL

SEQ ID NO: 616809 - protein, 9 aa, Homo Sapiens
NSMYINRPP

SEQ ID NO: 616810 - protein, 9 aa, Homo Sapiens
SNSMYINRP

SEQ ID NO: 616811 - protein, 9 aa, Homo Sapiens
RQKYLIVDN

SEQ ID NO: 616812 - protein, 9 aa, Homo Sapiens
YRPYRCVHH

SEQ ID NO: 616813 - protein, 9 aa, Homo Sapiens
RSNHRERNK

SEQ ID NO: 616814 - protein, 9 aa, Homo Sapiens
IDNINEWHA

SEQ ID NO: 616815 - protein, 9 aa, Homo Sapiens
SAGTLTFSV

SEQ ID NO: 616816 - protein, 9 aa, Homo Sapiens
AEDQTIKSW

SEQ ID NO: 616817 - protein, 9 aa, Homo Sapiens
HDVFKLKQF

SEQ ID NO: 616818 - protein, 9 aa, Homo Sapiens
GAVVGAAGP

SEQ ID NO: 616819 - protein, 9 aa, Homo Sapiens
ILASQSSPG

SEQ ID NO: 616820 - protein, 9 aa, Homo Sapiens
CAEDQTIKS

SEQ ID NO: 616821 - protein, 9 aa, Homo Sapiens
KSCCYSSAL

SEQ ID NO: 616822 - protein, 9 aa, Homo Sapiens
QGYTVEVLQ

SEQ ID NO: 616823 - protein, 9 aa, Homo Sapiens
DLSGSNVTA

SEQ ID NO: 616824 - protein, 9 aa, Homo Sapiens
HLCLWCFMK

SEQ ID NO: 616825 - protein, 9 aa, Homo Sapiens
SRPIRAVPA

SEQ ID NO: 616826 - protein, 9 aa, Homo Sapiens
TWEEPRLHG

SEQ ID NO: 616827 - protein, 9 aa, Homo Sapiens
IIRRSQEVQ

SEQ ID NO: 616828 - protein, 9 aa, Homo Sapiens
KLGKCKNIL

SEQ ID NO: 616829 - protein, 9 aa, Homo Sapiens
TVGVHSSFP

SEQ ID NO: 616830 - protein, 9 aa, Homo Sapiens
TKRLAIIHE

SEQ ID NO: 616831 - protein, 9 aa, Homo Sapiens
IRGRACFCA

SEQ ID NO: 616832 - protein, 9 aa, Homo Sapiens
ILFSLDLKL

SEQ ID NO: 616833 - protein, 9 aa, Homo Sapiens
LSSAIVPFS

SEQ ID NO: 616834 - protein, 9 aa, Homo Sapiens
HDLMETSYL

SEQ ID NO: 616835 - protein, 9 aa, Homo Sapiens
IRREVTVEL

SEQ ID NO: 616836 - protein, 9 aa, Homo Sapiens
DLSIDIYSH

SEQ ID NO: 616837 - protein, 9 aa, Homo Sapiens
DQCFYNQEQ

SEQ ID NO: 616838 - protein, 9 aa, Homo Sapiens
SSPKKPSLE

SEQ ID NO: 616839 - protein, 9 aa, Homo Sapiens
QEASVALPF

SEQ ID NO: 616840 - protein, 9 aa, Homo Sapiens
ERRMEGKMP

SEQ ID NO: 616841 - protein, 9 aa, Homo Sapiens
LAIIHELMH

SEQ ID NO: 616842 - protein, 9 aa, Homo Sapiens
VEAFWQCLH

SEQ ID NO: 616843 - protein, 9 aa, Homo Sapiens
CSLCHKNYI

SEQ ID NO: 616844 - protein, 9 aa, Homo Sapiens
LSDLLKVML

SEQ ID NO: 616845 - protein, 9 aa, Homo Sapiens
ALSEKEEEE

SEQ ID NO: 616846 - protein, 9 aa, Homo Sapiens
KTTCYMGKW

SEQ ID NO: 616847 - protein, 9 aa, Homo Sapiens
PNILASFAR

SEQ ID NO: 616848 - protein, 9 aa, Homo Sapiens
MKSQYKSTI

SEQ ID NO: 616849 - protein, 9 aa, Homo Sapiens
EDANEEAPF

SEQ ID NO: 616850 - protein, 9 aa, Homo Sapiens
YSTRQTFLK

SEQ ID NO: 616851 - protein, 9 aa, Homo Sapiens
MMGNDEDAC

SEQ ID NO: 616852 - protein, 9 aa, Homo Sapiens
RRPDSTCHS

SEQ ID NO: 616853 - protein, 9 aa, Homo Sapiens
KQLRKQHSM

SEQ ID NO: 616854 - protein, 9 aa, Homo Sapiens
NTVGVHSSF

SEQ ID NO: 616855 - protein, 9 aa, Homo Sapiens
GITSGGCGT

SEQ ID NO: 616856 - protein, 9 aa, Homo Sapiens
ACDDYFIQN

SEQ ID NO: 616857 - protein, 9 aa, Homo Sapiens
TLSGNMWES

SEQ ID NO: 616858 - protein, 9 aa, Homo Sapiens
WADGRWNNQ

SEQ ID NO: 616859 - protein, 9 aa, Homo Sapiens
EDGLQVGLD

SEQ ID NO: 616860 - protein, 9 aa, Homo Sapiens
HVSAGTLTF

SEQ ID NO: 616861 - protein, 9 aa, Homo Sapiens
CVHHGCFAA

SEQ ID NO: 616862 - protein, 9 aa, Homo Sapiens
PPPLSGKRN

SEQ ID NO: 616863 - protein, 9 aa, Homo Sapiens
LEKTSRMIS

SEQ ID NO: 616864 - protein, 9 aa, Homo Sapiens
EKEEEEREF

SEQ ID NO: 616865 - protein, 9 aa, Homo Sapiens
AAHDVFKLK

SEQ ID NO: 616866 - protein, 9 aa, Homo Sapiens
LTLFEAAIE

SEQ ID NO: 616867 - protein, 9 aa, Homo Sapiens
MGSGKNNMG

SEQ ID NO: 616868 - protein, 9 aa, Homo Sapiens
TLTFSVTLF

SEQ ID NO: 616869 - protein, 9 aa, Homo Sapiens
KRLRAAVGD

SEQ ID NO: 616870 - protein, 9 aa, Homo Sapiens
FCVLLLGSE

SEQ ID NO: 616871 - protein, 9 aa, Homo Sapiens
WRARSTSTS

SEQ ID NO: 616872 - protein, 9 aa, Homo Sapiens
PACWVAGSW

SEQ ID NO: 616873 - protein, 9 aa, Homo Sapiens
LHAVAKYFL

SEQ ID NO: 616874 - protein, 9 aa, Homo Sapiens
DRPPACWVA

SEQ ID NO: 616875 - protein, 9 aa, Homo Sapiens
HIGLCLWLW

SEQ ID NO: 616876 - protein, 9 aa, Homo Sapiens
KTKLGPEEK

SEQ ID NO: 616877 - protein, 9 aa, Homo Sapiens
YEEDLEFKE

SEQ ID NO: 616878 - protein, 9 aa, Homo Sapiens
CWGRALYWA

SEQ ID NO: 616879 - protein, 9 aa, Homo Sapiens
EINSNKTVL

SEQ ID NO: 616880 - protein, 9 aa, Homo Sapiens
EYSANSLIS

SEQ ID NO: 616881 - protein, 9 aa, Homo Sapiens
LFEAAIEYI

SEQ ID NO: 616882 - protein, 9 aa, Homo Sapiens
DQFVQRIIS

SEQ ID NO: 616883 - protein, 9 aa, Homo Sapiens
PYEGPGGGM

SEQ ID NO: 616884 - protein, 9 aa, Homo Sapiens
DWQWWGHVA

SEQ ID NO: 616885 - protein, 9 aa, Homo Sapiens
SAIVPFSSD

SEQ ID NO: 616886 - protein, 9 aa, Homo Sapiens
KLLNNHILV

SEQ ID NO: 616887 - protein, 9 aa, Homo Sapiens
CFYNQEQRQ

SEQ ID NO: 616888 - protein, 9 aa, Homo Sapiens
SHYIYWTCE

SEQ ID NO: 616889 - protein, 9 aa, Homo Sapiens
RSFPDPQGT

SEQ ID NO: 616890 - protein, 9 aa, Homo Sapiens
AEPPGTNPR

SEQ ID NO: 616891 - protein, 9 aa, Homo Sapiens
SIRCHCEDG

SEQ ID NO: 616892 - protein, 9 aa, Homo Sapiens
AMTAYWTNF

SEQ ID NO: 616893 - protein, 9 aa, Homo Sapiens
MVFNIHSLE

SEQ ID NO: 616894 - protein, 9 aa, Homo Sapiens
HTLTHTHTW

SEQ ID NO: 616895 - protein, 9 aa, Homo Sapiens
EATNSHFTH

SEQ ID NO: 616896 - protein, 9 aa, Homo Sapiens
KENVKKPGS

SEQ ID NO: 616897 - protein, 9 aa, Homo Sapiens
LQQQPPDLV

SEQ ID NO: 616898 - protein, 9 aa, Homo Sapiens
TIAHEMGDN

SEQ ID NO: 616899 - protein, 9 aa, Homo Sapiens
GSADLEKSY

SEQ ID NO: 616900 - protein, 9 aa, Homo Sapiens
SGNMWESSR

SEQ ID NO: 616901 - protein, 9 aa, Homo Sapiens
VKKPHCYRP

SEQ ID NO: 616902 - protein, 9 aa, Homo Sapiens
SDLLKVMLE

SEQ ID NO: 616903 - protein, 9 aa, Homo Sapiens
EPSNLGNLS

SEQ ID NO: 616904 - protein, 9 aa, Homo Sapiens
RKWVLTMKR

SEQ ID NO: 616905 - protein, 9 aa, Homo Sapiens
LVFAQEISI

SEQ ID NO: 616906 - protein, 9 aa, Homo Sapiens
STAKRYLLR

SEQ ID NO: 616907 - protein, 9 aa, Homo Sapiens
EDKTRVVSP

SEQ ID NO: 616908 - protein, 9 aa, Homo Sapiens
SNSVTASVQ

SEQ ID NO: 616909 - protein, 9 aa, Homo Sapiens
DLKLLNNHI

SEQ ID NO: 616910 - protein, 9 aa, Homo Sapiens
AGCAHVAQC

SEQ ID NO: 616911 - protein, 9 aa, Homo Sapiens
SVALPFTSK

SEQ ID NO: 616912 - protein, 9 aa, Homo Sapiens
YLIVDNFLA

SEQ ID NO: 616913 - protein, 9 aa, Homo Sapiens
VLLGQAEHK

SEQ ID NO: 616914 - protein, 9 aa, Homo Sapiens
VVHYLPVRV

SEQ ID NO: 616915 - protein, 9 aa, Homo Sapiens
GNPEEILKG

SEQ ID NO: 616916 - protein, 9 aa, Homo Sapiens
KYEPEINST

SEQ ID NO: 616917 - protein, 9 aa, Homo Sapiens
SSTQWDLGG

SEQ ID NO: 616918 - protein, 9 aa, Homo Sapiens
PPDIRGRAC

SEQ ID NO: 616919 - protein, 9 aa, Homo Sapiens
AIHLEYFLN

SEQ ID NO: 616920 - protein, 9 aa, Homo Sapiens
PPLSDLLKV

SEQ ID NO: 616921 - protein, 9 aa, Homo Sapiens
YPGSDSCAC

SEQ ID NO: 616922 - protein, 9 aa, Homo Sapiens
FLDLSQNDL

SEQ ID NO: 616923 - protein, 9 aa, Homo Sapiens
QLHPSGLRS

SEQ ID NO: 616924 - protein, 9 aa, Homo Sapiens
KWVLTMKRL

SEQ ID NO: 616925 - protein, 9 aa, Homo Sapiens
HERIFTRAK

SEQ ID NO: 616926 - protein, 9 aa, Homo Sapiens
NCLMIDGLV

SEQ ID NO: 616927 - protein, 9 aa, Homo Sapiens
QRKLNEEHT

SEQ ID NO: 616928 - protein, 9 aa, Homo Sapiens
AAACIHMMP

SEQ ID NO: 616929 - protein, 9 aa, Homo Sapiens
LKTIEKCRK

SEQ ID NO: 616930 - protein, 9 aa, Homo Sapiens
VPVLVGDLK

SEQ ID NO: 616931 - protein, 9 aa, Homo Sapiens
TIFAFFVGI

SEQ ID NO: 616932 - protein, 9 aa, Homo Sapiens
KIWHHTLYN

SEQ ID NO: 616933 - protein, 9 aa, Homo Sapiens
KYLGETKAN

SEQ ID NO: 616934 - protein, 9 aa, Homo Sapiens
KHFGIAIHL

SEQ ID NO: 616935 - protein, 9 aa, Homo Sapiens
CCYSSALRI

SEQ ID NO: 616936 - protein, 9 aa, Homo Sapiens
EVLHKFKLQ

SEQ ID NO: 616937 - protein, 9 aa, Homo Sapiens
FFIILASQS

SEQ ID NO: 616938 - protein, 9 aa, Homo Sapiens
LLHLCLWCF

SEQ ID NO: 616939 - protein, 9 aa, Homo Sapiens
VKPLSEQIA

SEQ ID NO: 616940 - protein, 9 aa, Homo Sapiens
HQTMDVPVL

SEQ ID NO: 616941 - protein, 9 aa, Homo Sapiens
LSGKRNNMK

SEQ ID NO: 616942 - protein, 9 aa, Homo Sapiens
AFFVGITKV

SEQ ID NO: 616943 - protein, 9 aa, Homo Sapiens
TNLLPGINL

SEQ ID NO: 616944 - protein, 9 aa, Homo Sapiens
IMAVNKVDV

SEQ ID NO: 616945 - protein, 9 aa, Homo Sapiens
INGVESCLY

SEQ ID NO: 616946 - protein, 9 aa, Homo Sapiens
RVKRNILAT

SEQ ID NO: 616947 - protein, 9 aa, Homo Sapiens
NSRTALSEK

SEQ ID NO: 616948 - protein, 9 aa, Homo Sapiens
DRAIVHSTS

SEQ ID NO: 616949 - protein, 9 aa, Homo Sapiens
TVAELTQQI

SEQ ID NO: 616950 - protein, 9 aa, Homo Sapiens
SSGCSENSG

SEQ ID NO: 616951 - protein, 9 aa, Homo Sapiens
IMYGGNITD

SEQ ID NO: 616952 - protein, 9 aa, Homo Sapiens
TGGVKKPHC

SEQ ID NO: 616953 - protein, 9 aa, Homo Sapiens
RPYEGPGGG

SEQ ID NO: 616954 - protein, 9 aa, Homo Sapiens
SCRQTGDFT

SEQ ID NO: 616955 - protein, 9 aa, Homo Sapiens
VHYLPVRVL

SEQ ID NO: 616956 - protein, 9 aa, Homo Sapiens
QPSAACDDY

SEQ ID NO: 616957 - protein, 9 aa, Homo Sapiens
NDLLQIIRR

SEQ ID NO: 616958 - protein, 9 aa, Homo Sapiens
PVDTLYYRF

SEQ ID NO: 616959 - protein, 9 aa, Homo Sapiens
SKTKLGPEE

SEQ ID NO: 616960 - protein, 9 aa, Homo Sapiens
DPYKFVKGK

SEQ ID NO: 616961 - protein, 9 aa, Homo Sapiens
MEGKMPDGT

SEQ ID NO: 616962 - protein, 9 aa, Homo Sapiens
VGVHSSFPS

SEQ ID NO: 616963 - protein, 9 aa, Homo Sapiens
KRSNSVTAS

SEQ ID NO: 616964 - protein, 9 aa, Homo Sapiens
LASFARKNR

SEQ ID NO: 616965 - protein, 9 aa, Homo Sapiens
FHVSAGTLT

SEQ ID NO: 616966 - protein, 9 aa, Homo Sapiens
SYYPSSGIA

SEQ ID NO: 616967 - protein, 9 aa, Homo Sapiens
HPSGLRSCA

SEQ ID NO: 616968 - protein, 9 aa, Homo Sapiens
YHSMMGNDE

SEQ ID NO: 616969 - protein, 9 aa, Homo Sapiens
GSTAKRYLL

SEQ ID NO: 616970 - protein, 9 aa, Homo Sapiens
SLPLYLQVM

SEQ ID NO: 616971 - protein, 9 aa, Homo Sapiens
TDEGNPKKE

SEQ ID NO: 616972 - protein, 9 aa, Homo Sapiens
AKMLLRDAA

SEQ ID NO: 616973 - protein, 9 aa, Homo Sapiens
WCHFQNGNY

SEQ ID NO: 616974 - protein, 9 aa, Homo Sapiens
MVASLDQLK

SEQ ID NO: 616975 - protein, 9 aa, Homo Sapiens
NILATGEKT

SEQ ID NO: 616976 - protein, 9 aa, Homo Sapiens
PSSGIAQFH

SEQ ID NO: 616977 - protein, 9 aa, Homo Sapiens
ENKTTCYMG

SEQ ID NO: 616978 - protein, 9 aa, Homo Sapiens
ANEEAPFRD

SEQ ID NO: 616979 - protein, 9 aa, Homo Sapiens
LFYKDMKKN

SEQ ID NO: 616980 - protein, 9 aa, Homo Sapiens
IHLEYFLNK

SEQ ID NO: 616981 - protein, 9 aa, Homo Sapiens
HGYLNIALW

SEQ ID NO: 616982 - protein, 9 aa, Homo Sapiens
TMDVPVLVG

SEQ ID NO: 616983 - protein, 9 aa, Homo Sapiens
PRLHGAWTL

SEQ ID NO: 616984 - protein, 9 aa, Homo Sapiens
MNGLGIDNI

SEQ ID NO: 616985 - protein, 9 aa, Homo Sapiens
IGSAYGSCT

SEQ ID NO: 616986 - protein, 9 aa, Homo Sapiens
ILTALVPSE

SEQ ID NO: 616987 - protein, 9 aa, Homo Sapiens
SSAIVPFSS

SEQ ID NO: 616988 - protein, 9 aa, Homo Sapiens
DPAHIGLCL

SEQ ID NO: 616989 - protein, 9 aa, Homo Sapiens
SESPLSEKL

SEQ ID NO: 616990 - protein, 9 aa, Homo Sapiens
DSPQDRESV

SEQ ID NO: 616991 - protein, 9 aa, Homo Sapiens
CCMGSGKNN

SEQ ID NO: 616992 - protein, 9 aa, Homo Sapiens
KEAFGFQHP

SEQ ID NO: 616993 - protein, 9 aa, Homo Sapiens
AEHKAEVDM

SEQ ID NO: 616994 - protein, 9 aa, Homo Sapiens
LLPAQAGAV

SEQ ID NO: 616995 - protein, 9 aa, Homo Sapiens
LAVLCWGRA

SEQ ID NO: 616996 - protein, 9 aa, Homo Sapiens
FVQRIISEH

SEQ ID NO: 616997 - protein, 9 aa, Homo Sapiens
TEKDITEAT

SEQ ID NO: 616998 - protein, 9 aa, Homo Sapiens
IWHHTLYNE

SEQ ID NO: 616999 - protein, 9 aa, Homo Sapiens
GETKANQEK

SEQ ID NO: 617000 - protein, 9 aa, Homo Sapiens
FAPSVKGVS

SEQ ID NO: 617001 - protein, 9 aa, Homo Sapiens
CIQQDILAS

SEQ ID NO: 617002 - protein, 9 aa, Homo Sapiens
TFHPTKVLE

SEQ ID NO: 617003 - protein, 9 aa, Homo Sapiens
SSDRLKPTV

SEQ ID NO: 617004 - protein, 9 aa, Homo Sapiens
RHTMRELLD

SEQ ID NO: 617005 - protein, 9 aa, Homo Sapiens
TESIPCPHT

SEQ ID NO: 617006 - protein, 9 aa, Homo Sapiens
HPVQQPSFQ

SEQ ID NO: 617007 - protein, 9 aa, Homo Sapiens
RISNMVGLS

SEQ ID NO: 617008 - protein, 9 aa, Homo Sapiens
FQNGNYCGE

SEQ ID NO: 617009 - protein, 9 aa, Homo Sapiens
EEDLEFKEP

SEQ ID NO: 617010 - protein, 9 aa, Homo Sapiens
QSTAPVQYG

SEQ ID NO: 617011 - protein, 9 aa, Homo Sapiens
VGFFIILAS

SEQ ID NO: 617012 - protein, 9 aa, Homo Sapiens
CKYLGETKA

SEQ ID NO: 617013 - protein, 9 aa, Homo Sapiens
PFRDRSHIE

SEQ ID NO: 617014 - protein, 9 aa, Homo Sapiens
CVLSSGPGL

SEQ ID NO: 617015 - protein, 9 aa, Homo Sapiens
FGNSVQKHG

SEQ ID NO: 617016 - protein, 9 aa, Homo Sapiens
MLKKIWGSA

SEQ ID NO: 617017 - protein, 9 aa, Homo Sapiens
LGVSVGLIV

SEQ ID NO: 617018 - protein, 9 aa, Homo Sapiens
MDNLLGGEK

SEQ ID NO: 617019 - protein, 9 aa, Homo Sapiens
NILASFARK

SEQ ID NO: 617020 - protein, 9 aa, Homo Sapiens
PLSYRAKML

SEQ ID NO: 617021 - protein, 9 aa, Homo Sapiens
EGKMPDGTL

SEQ ID NO: 617022 - protein, 9 aa, Homo Sapiens
VAIGSAYGS

SEQ ID NO: 617023 - protein, 9 aa, Homo Sapiens
DQKGNIPDQ

SEQ ID NO: 617024 - protein, 9 aa, Homo Sapiens
TMKRLDVNA

SEQ ID NO: 617025 - protein, 9 aa, Homo Sapiens
SPCVNGGSC

SEQ ID NO: 617026 - protein, 9 aa, Homo Sapiens
LTSIHADVC

SEQ ID NO: 617027 - protein, 9 aa, Homo Sapiens
APNEMKNIQ

SEQ ID NO: 617028 - protein, 9 aa, Homo Sapiens
PKKPSLEAT

SEQ ID NO: 617029 - protein, 9 aa, Homo Sapiens
GANDVKHDR

SEQ ID NO: 617030 - protein, 9 aa, Homo Sapiens
QVGMETKIK

SEQ ID NO: 617031 - protein, 9 aa, Homo Sapiens
LLVERSNTP

SEQ ID NO: 617032 - protein, 9 aa, Homo Sapiens
GTDNWKVIA

SEQ ID NO: 617033 - protein, 9 aa, Homo Sapiens
RPLRRPRLV

SEQ ID NO: 617034 - protein, 9 aa, Homo Sapiens
ARLIKHDEY

SEQ ID NO: 617035 - protein, 9 aa, Homo Sapiens
NPNCLMIDG

SEQ ID NO: 617036 - protein, 9 aa, Homo Sapiens
VLDSPQDRE

SEQ ID NO: 617037 - protein, 9 aa, Homo Sapiens
SEKEEEERE

SEQ ID NO: 617038 - protein, 9 aa, Homo Sapiens
GTLVLLCYA

SEQ ID NO: 617039 - protein, 9 aa, Homo Sapiens
RSNSVTASV

SEQ ID NO: 617040 - protein, 9 aa, Homo Sapiens
TGRTEISPE

SEQ ID NO: 617041 - protein, 9 aa, Homo Sapiens
FDESYKTGF

SEQ ID NO: 617042 - protein, 9 aa, Homo Sapiens
CHGYLNIAL

SEQ ID NO: 617043 - protein, 9 aa, Homo Sapiens
WESSRSICP

SEQ ID NO: 617044 - protein, 9 aa, Homo Sapiens
PKKEGGDRR

SEQ ID NO: 617045 - protein, 9 aa, Homo Sapiens
VVGAAGPLE

SEQ ID NO: 617046 - protein, 9 aa, Homo Sapiens
IVEQDTEES

SEQ ID NO: 617047 - protein, 9 aa, Homo Sapiens
TQWDLGGFS

SEQ ID NO: 617048 - protein, 9 aa, Homo Sapiens
NGFGNSVQK

SEQ ID NO: 617049 - protein, 9 aa, Homo Sapiens
APTVTQFCT

SEQ ID NO: 617050 - protein, 9 aa, Homo Sapiens
KNGEASEGA

SEQ ID NO: 617051 - protein, 9 aa, Homo Sapiens
NINEWHAGE

SEQ ID NO: 617052 - protein, 9 aa, Homo Sapiens
LDDLRCSGH

SEQ ID NO: 617053 - protein, 9 aa, Homo Sapiens
LYNLIVIHK

SEQ ID NO: 617054 - protein, 9 aa, Homo Sapiens
IGWQRRRQS

SEQ ID NO: 617055 - protein, 9 aa, Homo Sapiens
PTKLQIKQQ

SEQ ID NO: 617056 - protein, 9 aa, Homo Sapiens
GRVNETLSN

SEQ ID NO: 617057 - protein, 9 aa, Homo Sapiens
KEKIALKHL

SEQ ID NO: 617058 - protein, 9 aa, Homo Sapiens
FVSMWMAQT

SEQ ID NO: 617059 - protein, 9 aa, Homo Sapiens
LTALVPSEA

SEQ ID NO: 617060 - protein, 9 aa, Homo Sapiens
HKTWEEPRL

SEQ ID NO: 617061 - protein, 9 aa, Homo Sapiens
AHIGLCLWL

SEQ ID NO: 617062 - protein, 9 aa, Homo Sapiens
LDLSQNDLH

SEQ ID NO: 617063 - protein, 9 aa, Homo Sapiens
TSRMISSTY

SEQ ID NO: 617064 - protein, 9 aa, Homo Sapiens
TDQKGNFKC

SEQ ID NO: 617065 - protein, 9 aa, Homo Sapiens
AILSESPLS

SEQ ID NO: 617066 - protein, 9 aa, Homo Sapiens
EACHGYLNI

SEQ ID NO: 617067 - protein, 9 aa, Homo Sapiens
QEVADLRKK

SEQ ID NO: 617068 - protein, 9 aa, Homo Sapiens
NPKKEGGDR

SEQ ID NO: 617069 - protein, 9 aa, Homo Sapiens
ENLGTGIII

SEQ ID NO: 617070 - protein, 9 aa, Homo Sapiens
IEEYSANSL

SEQ ID NO: 617071 - protein, 9 aa, Homo Sapiens
CEMLKKIWG

SEQ ID NO: 617072 - protein, 9 aa, Homo Sapiens
ENGFGNSVQ

SEQ ID NO: 617073 - protein, 9 aa, Homo Sapiens
GETAAKYVK

SEQ ID NO: 617074 - protein, 9 aa, Homo Sapiens
VEQNGTDNW

SEQ ID NO: 617075 - protein, 9 aa, Homo Sapiens
VDTLYYRFT

SEQ ID NO: 617076 - protein, 9 aa, Homo Sapiens
VTIGLQVHF

SEQ ID NO: 617077 - protein, 9 aa, Homo Sapiens
VAKYFLGYN

SEQ ID NO: 617078 - protein, 9 aa, Homo Sapiens
QKGNIPDQS

SEQ ID NO: 617079 - protein, 9 aa, Homo Sapiens
PCVNGGSCR

SEQ ID NO: 617080 - protein, 9 aa, Homo Sapiens
SSGDPAHIG

SEQ ID NO: 617081 - protein, 9 aa, Homo Sapiens
HAQSRPIRA

SEQ ID NO: 617082 - protein, 9 aa, Homo Sapiens
FGSKEAFGF

SEQ ID NO: 617083 - protein, 9 aa, Homo Sapiens
DIEEYSANS

SEQ ID NO: 617084 - protein, 9 aa, Homo Sapiens
VITQNIENL

SEQ ID NO: 617085 - protein, 9 aa, Homo Sapiens
VIIQPLQIL

SEQ ID NO: 617086 - protein, 9 aa, Homo Sapiens
WEEPRLHGA

SEQ ID NO: 617087 - protein, 9 aa, Homo Sapiens
HADVCQLCL

SEQ ID NO: 617088 - protein, 9 aa, Homo Sapiens
ILLAVLCWG

SEQ ID NO: 617089 - protein, 9 aa, Homo Sapiens
ALEAAEPAL

SEQ ID NO: 617090 - protein, 9 aa, Homo Sapiens
CRKMIPAFR

SEQ ID NO: 617091 - protein, 9 aa, Homo Sapiens
GEAPGGSAS

SEQ ID NO: 617092 - protein, 9 aa, Homo Sapiens
GATLVNRGD

SEQ ID NO: 617093 - protein, 9 aa, Homo Sapiens
KAEQENGHP

SEQ ID NO: 617094 - protein, 9 aa, Homo Sapiens
EINSTAPVE

SEQ ID NO: 617095 - protein, 9 aa, Homo Sapiens
PLLLISLVF

SEQ ID NO: 617096 - protein, 9 aa, Homo Sapiens
MQVGMETKI

SEQ ID NO: 617097 - protein, 9 aa, Homo Sapiens
PPHAQSRPI

SEQ ID NO: 617098 - protein, 9 aa, Homo Sapiens
AQNRPFDDK

SEQ ID NO: 617099 - protein, 9 aa, Homo Sapiens
QQHPVQQPS

SEQ ID NO: 617100 - protein, 9 aa, Homo Sapiens
LAILSESPL

SEQ ID NO: 617101 - protein, 9 aa, Homo Sapiens
QKRSNHRER

SEQ ID NO: 617102 - protein, 9 aa, Homo Sapiens
RNPYTISSP

SEQ ID NO: 617103 - protein, 9 aa, Homo Sapiens
LVHMHPKKG

SEQ ID NO: 617104 - protein, 9 aa, Homo Sapiens
LPGINLWLG

SEQ ID NO: 617105 - protein, 9 aa, Homo Sapiens
GPPPLSGKR

SEQ ID NO: 617106 - protein, 9 aa, Homo Sapiens
GCAHVAQCA

SEQ ID NO: 617107 - protein, 9 aa, Homo Sapiens
NTIFAFFVG

SEQ ID NO: 617108 - protein, 9 aa, Homo Sapiens
FYCMAQLLD

SEQ ID NO: 617109 - protein, 9 aa, Homo Sapiens
QLLHLCLWC

SEQ ID NO: 617110 - protein, 9 aa, Homo Sapiens
TLVNRGDNT

SEQ ID NO: 617111 - protein, 9 aa, Homo Sapiens
NIQPGDVCC

SEQ ID NO: 617112 - protein, 9 aa, Homo Sapiens
PSPCVNGGS

SEQ ID NO: 617113 - protein, 9 aa, Homo Sapiens
KKLGKCKNI

SEQ ID NO: 617114 - protein, 9 aa, Homo Sapiens
VDVSHFTKR

SEQ ID NO: 617115 - protein, 9 aa, Homo Sapiens
ALHAVAKYF

SEQ ID NO: 617116 - protein, 9 aa, Homo Sapiens
CVNGGSCRQ

SEQ ID NO: 617117 - protein, 9 aa, Homo Sapiens
TSQEINSNK

SEQ ID NO: 617118 - protein, 9 aa, Homo Sapiens
LDTLDYLRP

SEQ ID NO: 617119 - protein, 9 aa, Homo Sapiens
SQRHFEISK

SEQ ID NO: 617120 - protein, 9 aa, Homo Sapiens
AVPAEAPRA

SEQ ID NO: 617121 - protein, 9 aa, Homo Sapiens
YAVSRGFND

SEQ ID NO: 617122 - protein, 9 aa, Homo Sapiens
DNMGINHDN

SEQ ID NO: 617123 - protein, 9 aa, Homo Sapiens
RSRGSLECI

SEQ ID NO: 617124 - protein, 9 aa, Homo Sapiens
SQLLHLCLW

SEQ ID NO: 617125 - protein, 9 aa, Homo Sapiens
FTVHSLLDL

SEQ ID NO: 617126 - protein, 9 aa, Homo Sapiens
NYRYTVRAV

SEQ ID NO: 617127 - protein, 9 aa, Homo Sapiens
KVDVSHFTK

SEQ ID NO: 617128 - protein, 9 aa, Homo Sapiens
LKEKIRKYE

SEQ ID NO: 617129 - protein, 9 aa, Homo Sapiens
WMAQTSYLA

SEQ ID NO: 617130 - protein, 9 aa, Homo Sapiens
LFDIEACHG

SEQ ID NO: 617131 - protein, 9 aa, Homo Sapiens
LEKNLSPRI

SEQ ID NO: 617132 - protein, 9 aa, Homo Sapiens
YATDQKGNF

SEQ ID NO: 617133 - protein, 9 aa, Homo Sapiens
RARSTSTST

SEQ ID NO: 617134 - protein, 9 aa, Homo Sapiens
AHFTILTAL

SEQ ID NO: 617135 - protein, 9 aa, Homo Sapiens
PGNPLSRSV

SEQ ID NO: 617136 - protein, 9 aa, Homo Sapiens
LPVDTLYYR

SEQ ID NO: 617137 - protein, 9 aa, Homo Sapiens
KELRVKNHY

SEQ ID NO: 617138 - protein, 9 aa, Homo Sapiens
KDITEATNS

SEQ ID NO: 617139 - protein, 9 aa, Homo Sapiens
GLQVHFLVF

SEQ ID NO: 617140 - protein, 9 aa, Homo Sapiens
KPPGRGVAT

SEQ ID NO: 617141 - protein, 9 aa, Homo Sapiens
LLGHERIFT

SEQ ID NO: 617142 - protein, 9 aa, Homo Sapiens
RMISSTYNS

SEQ ID NO: 617143 - protein, 9 aa, Homo Sapiens
LVGWADGRW

SEQ ID NO: 617144 - protein, 9 aa, Homo Sapiens
RLRGAKDFR

SEQ ID NO: 617145 - protein, 9 aa, Homo Sapiens
RGAKDFRLP

SEQ ID NO: 617146 - protein, 9 aa, Homo Sapiens
AQTSYLAAF

SEQ ID NO: 617147 - protein, 9 aa, Homo Sapiens
TKRVSSPKK

SEQ ID NO: 617148 - protein, 9 aa, Homo Sapiens
FRPMDNLLG

SEQ ID NO: 617149 - protein, 9 aa, Homo Sapiens
GNPLSRSVA

SEQ ID NO: 617150 - protein, 9 aa, Homo Sapiens
VTKQVINGV

SEQ ID NO: 617151 - protein, 9 aa, Homo Sapiens
NNLVEAFWQ

SEQ ID NO: 617152 - protein, 9 aa, Homo Sapiens
QPHCSIRCH

SEQ ID NO: 617153 - protein, 9 aa, Homo Sapiens
GKMPDGTLG

SEQ ID NO: 617154 - protein, 9 aa, Homo Sapiens
INSNKTVLH

SEQ ID NO: 617155 - protein, 9 aa, Homo Sapiens
IQPLQILFT

SEQ ID NO: 617156 - protein, 9 aa, Homo Sapiens
SNVTASSPV

SEQ ID NO: 617157 - protein, 9 aa, Homo Sapiens
PGGVGAGDM

SEQ ID NO: 617158 - protein, 9 aa, Homo Sapiens
VQGHFTIND

SEQ ID NO: 617159 - protein, 9 aa, Homo Sapiens
YYPSSGIAQ

SEQ ID NO: 617160 - protein, 9 aa, Homo Sapiens
AKYVKSRLP

SEQ ID NO: 617161 - protein, 9 aa, Homo Sapiens
EASVALPFT

SEQ ID NO: 617162 - protein, 9 aa, Homo Sapiens
SFTVHSLLD

SEQ ID NO: 617163 - protein, 9 aa, Homo Sapiens
KQHSMAIPS

SEQ ID NO: 617164 - protein, 9 aa, Homo Sapiens
KSLPLYLQV

SEQ ID NO: 617165 - protein, 9 aa, Homo Sapiens
SFLARILGM

SEQ ID NO: 617166 - protein, 9 aa, Homo Sapiens
EPEINSTAP

SEQ ID NO: 617167 - protein, 9 aa, Homo Sapiens
VSKAMTAYW

SEQ ID NO: 617168 - protein, 9 aa, Homo Sapiens
FLMWKENVK

SEQ ID NO: 617169 - protein, 9 aa, Homo Sapiens
NGVESCLYR

SEQ ID NO: 617170 - protein, 9 aa, Homo Sapiens
AIGSAYGSC

SEQ ID NO: 617171 - protein, 9 aa, Homo Sapiens
QLTEQQNKE

SEQ ID NO: 617172 - protein, 9 aa, Homo Sapiens
TTDPFQQAQ

SEQ ID NO: 617173 - protein, 9 aa, Homo Sapiens
DVDLPGNPL

SEQ ID NO: 617174 - protein, 9 aa, Homo Sapiens
AVCAPTVTQ

SEQ ID NO: 617175 - protein, 9 aa, Homo Sapiens
LVLDSPQDR

SEQ ID NO: 617176 - protein, 9 aa, Homo Sapiens
GLSSAIVPF

SEQ ID NO: 617177 - protein, 9 aa, Homo Sapiens
TAKRYLLRK

SEQ ID NO: 617178 - protein, 9 aa, Homo Sapiens
TIQRKLNEE

SEQ ID NO: 617179 - protein, 9 aa, Homo Sapiens
SAGEAPGGS

SEQ ID NO: 617180 - protein, 9 aa, Homo Sapiens
NLLPGINLW

SEQ ID NO: 617181 - protein, 9 aa, Homo Sapiens
TARLQLPAP

SEQ ID NO: 617182 - protein, 9 aa, Homo Sapiens
IEDSWLHKP

SEQ ID NO: 617183 - protein, 9 aa, Homo Sapiens
GRGVATGPG

SEQ ID NO: 617184 - protein, 9 aa, Homo Sapiens
PEEILKGVL

SEQ ID NO: 617185 - protein, 9 aa, Homo Sapiens
PRLVQRTQS

SEQ ID NO: 617186 - protein, 9 aa, Homo Sapiens
SSVDLSGSN

SEQ ID NO: 617187 - protein, 9 aa, Homo Sapiens
LLLKLKKCI

SEQ ID NO: 617188 - protein, 9 aa, Homo Sapiens
EETGRTEIS

SEQ ID NO: 617189 - protein, 9 aa, Homo Sapiens
KHDEYNPCQ

SEQ ID NO: 617190 - protein, 9 aa, Homo Sapiens
DSTCHSAEV

SEQ ID NO: 617191 - protein, 9 aa, Homo Sapiens
QLDREEKEN

SEQ ID NO: 617192 - protein, 9 aa, Homo Sapiens
HTHTHTHTL

SEQ ID NO: 617193 - protein, 9 aa, Homo Sapiens
AGTLTFSVT

SEQ ID NO: 617194 - protein, 9 aa, Homo Sapiens
VAEDKTRVV

SEQ ID NO: 617195 - protein, 9 aa, Homo Sapiens
VEQDTEESD

SEQ ID NO: 617196 - protein, 9 aa, Homo Sapiens
AYLKREYKV

SEQ ID NO: 617197 - protein, 9 aa, Homo Sapiens
SGPIALDDL

SEQ ID NO: 617198 - protein, 9 aa, Homo Sapiens
WRQFCQKML

SEQ ID NO: 617199 - protein, 9 aa, Homo Sapiens
IRQKNTIRR

SEQ ID NO: 617200 - protein, 9 aa, Homo Sapiens
DLPGNPLSR

SEQ ID NO: 617201 - protein, 9 aa, Homo Sapiens
RQTARLQLP

SEQ ID NO: 617202 - protein, 9 aa, Homo Sapiens
TLTHTHTWR

SEQ ID NO: 617203 - protein, 9 aa, Homo Sapiens
QHPVQQPSF

SEQ ID NO: 617204 - protein, 9 aa, Homo Sapiens
HGCFAAFTI

SEQ ID NO: 617205 - protein, 9 aa, Homo Sapiens
GDSSQEFLP

SEQ ID NO: 617206 - protein, 9 aa, Homo Sapiens
PKEKIALKH

SEQ ID NO: 617207 - protein, 9 aa, Homo Sapiens
KYLIVDNFL

SEQ ID NO: 617208 - protein, 9 aa, Homo Sapiens
TAYWTNFAK

SEQ ID NO: 617209 - protein, 9 aa, Homo Sapiens
HPVGTGNHR

SEQ ID NO: 617210 - protein, 9 aa, Homo Sapiens
IDFAIQYEE

SEQ ID NO: 617211 - protein, 9 aa, Homo Sapiens
CMGSGKNNM

SEQ ID NO: 617212 - protein, 9 aa, Homo Sapiens
EGNPKKEGG

SEQ ID NO: 617213 - protein, 9 aa, Homo Sapiens
NIENLGTGI

SEQ ID NO: 617214 - protein, 9 aa, Homo Sapiens
QWWGHVAQP

SEQ ID NO: 617215 - protein, 9 aa, Homo Sapiens
EKGSYYPSS

SEQ ID NO: 617216 - protein, 9 aa, Homo Sapiens
QTKKRRVDI

SEQ ID NO: 617217 - protein, 9 aa, Homo Sapiens
LDYTQRYIF

SEQ ID NO: 617218 - protein, 9 aa, Homo Sapiens
LTFSVTLFT

SEQ ID NO: 617219 - protein, 9 aa, Homo Sapiens
RSVVHYLPV

SEQ ID NO: 617220 - protein, 9 aa, Homo Sapiens
HVVFSSPPN

SEQ ID NO: 617221 - protein, 9 aa, Homo Sapiens
SPKKPSLEA

SEQ ID NO: 617222 - protein, 9 aa, Homo Sapiens
ALEISLSNM

SEQ ID NO: 617223 - protein, 9 aa, Homo Sapiens
PLSGKRNNM

SEQ ID NO: 617224 - protein, 9 aa, Homo Sapiens
ESSTQWDLG

SEQ ID NO: 617225 - protein, 9 aa, Homo Sapiens
KDVMLEKYS

SEQ ID NO: 617226 - protein, 9 aa, Homo Sapiens
NLGNLSFSC

SEQ ID NO: 617227 - protein, 9 aa, Homo Sapiens
VHSLLDLPE

SEQ ID NO: 617228 - protein, 9 aa, Homo Sapiens
MFGTLVLLC

SEQ ID NO: 617229 - protein, 9 aa, Homo Sapiens
SLGISVLSG

SEQ ID NO: 617230 - protein, 9 aa, Homo Sapiens
HLEYFLNKP

SEQ ID NO: 617231 - protein, 9 aa, Homo Sapiens
CGKSCCYSS

SEQ ID NO: 617232 - protein, 9 aa, Homo Sapiens
KIRKYEQTL

SEQ ID NO: 617233 - protein, 9 aa, Homo Sapiens
KMLLRDAAL

SEQ ID NO: 617234 - protein, 9 aa, Homo Sapiens
QDRESVSAY

SEQ ID NO: 617235 - protein, 9 aa, Homo Sapiens
VGWADGRWN

SEQ ID NO: 617236 - protein, 9 aa, Homo Sapiens
RAVPAEAPR

SEQ ID NO: 617237 - protein, 9 aa, Homo Sapiens
TSIHADVCQ

SEQ ID NO: 617238 - protein, 9 aa, Homo Sapiens
TLWVTPNIR

SEQ ID NO: 617239 - protein, 9 aa, Homo Sapiens
SPQDRESVS

SEQ ID NO: 617240 - protein, 9 aa, Homo Sapiens
QENGHPLPA

SEQ ID NO: 617241 - protein, 9 aa, Homo Sapiens
DRTVSKAMT

SEQ ID NO: 617242 - protein, 9 aa, Homo Sapiens
RKGEEDGLQ

SEQ ID NO: 617243 - protein, 9 aa, Homo Sapiens
IDQFVQRII

SEQ ID NO: 617244 - protein, 9 aa, Homo Sapiens
VSSAGEAPG

SEQ ID NO: 617245 - protein, 9 aa, Homo Sapiens
HTLYNELRV

SEQ ID NO: 617246 - protein, 9 aa, Homo Sapiens
PGKFSTYGG

SEQ ID NO: 617247 - protein, 9 aa, Homo Sapiens
INSTAPVEK

SEQ ID NO: 617248 - protein, 9 aa, Homo Sapiens
DNWKVIANY

SEQ ID NO: 617249 - protein, 9 aa, Homo Sapiens
RYRINRLAP

SEQ ID NO: 617250 - protein, 9 aa, Homo Sapiens
THTHTWRAR

SEQ ID NO: 617251 - protein, 9 aa, Homo Sapiens
FHVLDTLDY

SEQ ID NO: 617252 - protein, 9 aa, Homo Sapiens
KSSILRRRG

SEQ ID NO: 617253 - protein, 9 aa, Homo Sapiens
NLLGGEKTV

SEQ ID NO: 617254 - protein, 9 aa, Homo Sapiens
HRILYLFYK

SEQ ID NO: 617255 - protein, 9 aa, Homo Sapiens
TDPYKFVKG

SEQ ID NO: 617256 - protein, 9 aa, Homo Sapiens
PVADILNSY

SEQ ID NO: 617257 - protein, 9 aa, Homo Sapiens
LHPSGLRSC

SEQ ID NO: 617258 - protein, 9 aa, Homo Sapiens
QNIENLGTG

SEQ ID NO: 617259 - protein, 9 aa, Homo Sapiens
RVKNHYEKH

SEQ ID NO: 617260 - protein, 9 aa, Homo Sapiens
AAEPALQAQ

SEQ ID NO: 617261 - protein, 9 aa, Homo Sapiens
AAVGDDAED

SEQ ID NO: 617262 - protein, 9 aa, Homo Sapiens
LEHEVPPFF

SEQ ID NO: 617263 - protein, 9 aa, Homo Sapiens
GSNVTASSP

SEQ ID NO: 617264 - protein, 9 aa, Homo Sapiens
ITQNIENLG

SEQ ID NO: 617265 - protein, 9 aa, Homo Sapiens
IKRKWVLTM

SEQ ID NO: 617266 - protein, 9 aa, Homo Sapiens
PMDNLLGGE

SEQ ID NO: 617267 - protein, 9 aa, Homo Sapiens
QNRPFDDKT

SEQ ID NO: 617268 - protein, 9 aa, Homo Sapiens
YTQRYIFVK

SEQ ID NO: 617269 - protein, 9 aa, Homo Sapiens
GHFTINDSY

SEQ ID NO: 617270 - protein, 9 aa, Homo Sapiens
SLSNMERSR

SEQ ID NO: 617271 - protein, 9 aa, Homo Sapiens
KDLEETGRT

SEQ ID NO: 617272 - protein, 9 aa, Homo Sapiens
KFKLQDDFS

SEQ ID NO: 617273 - protein, 9 aa, Homo Sapiens
TTDSGKDGA

SEQ ID NO: 617274 - protein, 9 aa, Homo Sapiens
QNGNYCGET

SEQ ID NO: 617275 - protein, 9 aa, Homo Sapiens
FHKEIAAAC

SEQ ID NO: 617276 - protein, 9 aa, Homo Sapiens
FPCCMGSGK

SEQ ID NO: 617277 - protein, 9 aa, Homo Sapiens
TSSLGISVL

SEQ ID NO: 617278 - protein, 9 aa, Homo Sapiens
GGDPGGVGA

SEQ ID NO: 617279 - protein, 9 aa, Homo Sapiens
IKSWREEGF

SEQ ID NO: 617280 - protein, 9 aa, Homo Sapiens
TGRVNETLS

SEQ ID NO: 617281 - protein, 9 aa, Homo Sapiens
LKLLNNHIL

SEQ ID NO: 617282 - protein, 9 aa, Homo Sapiens
SQALEPKNG

SEQ ID NO: 617283 - protein, 9 aa, Homo Sapiens
TECAEPPGT

SEQ ID NO: 617284 - protein, 9 aa, Homo Sapiens
KLKQFSQLP

SEQ ID NO: 617285 - protein, 9 aa, Homo Sapiens
IKDLDGIRI

SEQ ID NO: 617286 - protein, 9 aa, Homo Sapiens
VKHDRWFRS

SEQ ID NO: 617287 - protein, 9 aa, Homo Sapiens
RDAFLKFDT

SEQ ID NO: 617288 - protein, 9 aa, Homo Sapiens
TVSKAMTAY

SEQ ID NO: 617289 - protein, 9 aa, Homo Sapiens
EMGDNMGIN

SEQ ID NO: 617290 - protein, 9 aa, Homo Sapiens
YISVTVPKI

SEQ ID NO: 617291 - protein, 9 aa, Homo Sapiens
GPHDLMETS

SEQ ID NO: 617292 - protein, 9 aa, Homo Sapiens
GNTIFAFFV

SEQ ID NO: 617293 - protein, 9 aa, Homo Sapiens
RKKLEPSNL

SEQ ID NO: 617294 - protein, 9 aa, Homo Sapiens
DGRWNNQSI

SEQ ID NO: 617295 - protein, 9 aa, Homo Sapiens
AVITQNIEN

SEQ ID NO: 617296 - protein, 9 aa, Homo Sapiens
DIRGRACFC

SEQ ID NO: 617297 - protein, 9 aa, Homo Sapiens
PGMGGDPGG

SEQ ID NO: 617298 - protein, 9 aa, Homo Sapiens
RKTKRSVQE

SEQ ID NO: 617299 - protein, 9 aa, Homo Sapiens
RKKLGKCKN

SEQ ID NO: 617300 - protein, 9 aa, Homo Sapiens
IHKTWEEPR

SEQ ID NO: 617301 - protein, 9 aa, Homo Sapiens
YWDQCFYNQ

SEQ ID NO: 617302 - protein, 9 aa, Homo Sapiens
SGLRSCAVV

SEQ ID NO: 617303 - protein, 9 aa, Homo Sapiens
KVPELFVCI

SEQ ID NO: 617304 - protein, 9 aa, Homo Sapiens
CCFPCCMGS

SEQ ID NO: 617305 - protein, 9 aa, Homo Sapiens
PPASSVNTG

SEQ ID NO: 617306 - protein, 9 aa, Homo Sapiens
KTKRSVQEG

SEQ ID NO: 617307 - protein, 9 aa, Homo Sapiens
LLLISLVFA

SEQ ID NO: 617308 - protein, 9 aa, Homo Sapiens
VMLEKYSHL

SEQ ID NO: 617309 - protein, 9 aa, Homo Sapiens
SNLGNLSFS

SEQ ID NO: 617310 - protein, 9 aa, Homo Sapiens
VHHGCFAAF

SEQ ID NO: 617311 - protein, 9 aa, Homo Sapiens
NEEAPFRDR

SEQ ID NO: 617312 - protein, 9 aa, Homo Sapiens
LMETSYLPR

SEQ ID NO: 617313 - protein, 9 aa, Homo Sapiens
KLEPSNLGN

SEQ ID NO: 617314 - protein, 9 aa, Homo Sapiens
MTDPYKFVK

SEQ ID NO: 617315 - protein, 9 aa, Homo Sapiens
LSEKLRTCH

SEQ ID NO: 617316 - protein, 9 aa, Homo Sapiens
DREEKENYR

SEQ ID NO: 617317 - protein, 9 aa, Homo Sapiens
EIPSESSTQ

SEQ ID NO: 617318 - protein, 9 aa, Homo Sapiens
REGTLPTFH

SEQ ID NO: 617319 - protein, 9 aa, Homo Sapiens
IVIHKKKYF

SEQ ID NO: 617320 - protein, 9 aa, Homo Sapiens
AACDDYFIQ

SEQ ID NO: 617321 - protein, 9 aa, Homo Sapiens
VHMHPKKGQ

SEQ ID NO: 617322 - protein, 9 aa, Homo Sapiens
IDIYSHYIY

SEQ ID NO: 617323 - protein, 9 aa, Homo Sapiens
SGKRNNMKI

SEQ ID NO: 617324 - protein, 9 aa, Homo Sapiens
VEKGSYYPS

SEQ ID NO: 617325 - protein, 9 aa, Homo Sapiens
FLPIQEAQQ

SEQ ID NO: 617326 - protein, 9 aa, Homo Sapiens
VIVEHVPVA

SEQ ID NO: 617327 - protein, 9 aa, Homo Sapiens
TCHSAEVIQ

SEQ ID NO: 617328 - protein, 9 aa, Homo Sapiens
LRAAVGDDA

SEQ ID NO: 617329 - protein, 9 aa, Homo Sapiens
VTLVIERSE

SEQ ID NO: 617330 - protein, 9 aa, Homo Sapiens
ELFVCIQQD

SEQ ID NO: 617331 - protein, 9 aa, Homo Sapiens
QLEKNLSPR

SEQ ID NO: 617332 - protein, 9 aa, Homo Sapiens
VLSNPACHI

SEQ ID NO: 617333 - protein, 9 aa, Homo Sapiens
SVGLIVEQD

SEQ ID NO: 617334 - protein, 9 aa, Homo Sapiens
FHVVFSSPP

SEQ ID NO: 617335 - protein, 9 aa, Homo Sapiens
ERMYRRISN

SEQ ID NO: 617336 - protein, 9 aa, Homo Sapiens
YRCVHHGCF

SEQ ID NO: 617337 - protein, 9 aa, Homo Sapiens
ASRTMVFNI

SEQ ID NO: 617338 - protein, 9 aa, Homo Sapiens
IVPFSSDSP

SEQ ID NO: 617339 - protein, 9 aa, Homo Sapiens
CHSAEVIQS

SEQ ID NO: 617340 - protein, 9 aa, Homo Sapiens
TWRARSTST

SEQ ID NO: 617341 - protein, 9 aa, Homo Sapiens
DPQGTLLPT

SEQ ID NO: 617342 - protein, 9 aa, Homo Sapiens
NSNKTVLHL

SEQ ID NO: 617343 - protein, 9 aa, Homo Sapiens
CCCCFPCCM

SEQ ID NO: 617344 - protein, 9 aa, Homo Sapiens
NHRDAAQLG

SEQ ID NO: 617345 - protein, 9 aa, Homo Sapiens
SESSTQWDL

SEQ ID NO: 617346 - protein, 9 aa, Homo Sapiens
WFTTDSGKD

SEQ ID NO: 617347 - protein, 9 aa, Homo Sapiens
TLQAIFYQF

SEQ ID NO: 617348 - protein, 9 aa, Homo Sapiens
SSAKLILLE

SEQ ID NO: 617349 - protein, 9 aa, Homo Sapiens
SIHKTWEEP

SEQ ID NO: 617350 - protein, 9 aa, Homo Sapiens
RGFNDLELD

SEQ ID NO: 617351 - protein, 9 aa, Homo Sapiens
AFCVLSSGP

SEQ ID NO: 617352 - protein, 9 aa, Homo Sapiens
TKLGPEEKT

SEQ ID NO: 617353 - protein, 9 aa, Homo Sapiens
HRPYEGPGG

SEQ ID NO: 617354 - protein, 9 aa, Homo Sapiens
YLFYKDMKK

SEQ ID NO: 617355 - protein, 9 aa, Homo Sapiens
PHDLMETSY

SEQ ID NO: 617356 - protein, 9 aa, Homo Sapiens
VFGEPPTKL

SEQ ID NO: 617357 - protein, 9 aa, Homo Sapiens
LYLQVMCIV

SEQ ID NO: 617358 - protein, 9 aa, Homo Sapiens
DLLKVMLEY

SEQ ID NO: 617359 - protein, 9 aa, Homo Sapiens
AVIVEHVPV

SEQ ID NO: 617360 - protein, 9 aa, Homo Sapiens
PKNGEASEG

SEQ ID NO: 617361 - protein, 9 aa, Homo Sapiens
AKRYLLRKQ

SEQ ID NO: 617362 - protein, 9 aa, Homo Sapiens
AHLCLYNLI

SEQ ID NO: 617363 - protein, 9 aa, Homo Sapiens
RLLVERSNT

SEQ ID NO: 617364 - protein, 9 aa, Homo Sapiens
APRAGTTRA

SEQ ID NO: 617365 - protein, 9 aa, Homo Sapiens
NERECEMLK

SEQ ID NO: 617366 - protein, 9 aa, Homo Sapiens
VSHFTKRDE

SEQ ID NO: 617367 - protein, 9 aa, Homo Sapiens
SGRLSFTVH

SEQ ID NO: 617368 - protein, 9 aa, Homo Sapiens
FDIEACHGY

SEQ ID NO: 617369 - protein, 9 aa, Homo Sapiens
STVSAFCVL

SEQ ID NO: 617370 - protein, 9 aa, Homo Sapiens
VTPNIRSTA

SEQ ID NO: 617371 - protein, 9 aa, Homo Sapiens
LEAAEPALQ

SEQ ID NO: 617372 - protein, 9 aa, Homo Sapiens
VKQLRKQHS

SEQ ID NO: 617373 - protein, 9 aa, Homo Sapiens
IKHDEYNPC

SEQ ID NO: 617374 - protein, 9 aa, Homo Sapiens
TVSAFCVLS

SEQ ID NO: 617375 - protein, 9 aa, Homo Sapiens
INTVLSNPA

SEQ ID NO: 617376 - protein, 9 aa, Homo Sapiens
NNTKRLAII

SEQ ID NO: 617377 - protein, 9 aa, Homo Sapiens
AGLSSAIVP

SEQ ID NO: 617378 - protein, 9 aa, Homo Sapiens
LDIRYRINR

SEQ ID NO: 617379 - protein, 9 aa, Homo Sapiens
AAYLKREYK

SEQ ID NO: 617380 - protein, 9 aa, Homo Sapiens
DDYFIQNNV

SEQ ID NO: 617381 - protein, 9 aa, Homo Sapiens
FVERMYRRI

SEQ ID NO: 617382 - protein, 9 aa, Homo Sapiens
EHVPVADIL

SEQ ID NO: 617383 - protein, 9 aa, Homo Sapiens
NETLSNSNM

SEQ ID NO: 617384 - protein, 9 aa, Homo Sapiens
AVGDDAEDS

SEQ ID NO: 617385 - protein, 9 aa, Homo Sapiens
PYKFVKGKR

SEQ ID NO: 617386 - protein, 9 aa, Homo Sapiens
TFLKLKYYS

SEQ ID NO: 617387 - protein, 9 aa, Homo Sapiens
GCGTAKIPA

SEQ ID NO: 617388 - protein, 9 aa, Homo Sapiens
THTHTLTHT

SEQ ID NO: 617389 - protein, 9 aa, Homo Sapiens
CAEPPGTNP

SEQ ID NO: 617390 - protein, 9 aa, Homo Sapiens
HPTKVLEAG

SEQ ID NO: 617391 - protein, 9 aa, Homo Sapiens
KNTIRREVT

SEQ ID NO: 617392 - protein, 9 aa, Homo Sapiens
RVNETLSNS

SEQ ID NO: 617393 - protein, 9 aa, Homo Sapiens
LYLFYKDMK

SEQ ID NO: 617394 - protein, 9 aa, Homo Sapiens
VPVADILNS

SEQ ID NO: 617395 - protein, 9 aa, Homo Sapiens
HDLFNWLSV

SEQ ID NO: 617396 - protein, 9 aa, Homo Sapiens
ENYRYTVRA

SEQ ID NO: 617397 - protein, 9 aa, Homo Sapiens
SPGALAGAV

SEQ ID NO: 617398 - protein, 9 aa, Homo Sapiens
DLHHCPLQI

SEQ ID NO: 617399 - protein, 9 aa, Homo Sapiens
VMLEYEPAK

SEQ ID NO: 617400 - protein, 9 aa, Homo Sapiens
VINTVLSNP

SEQ ID NO: 617401 - protein, 9 aa, Homo Sapiens
DSSQEFLPI

SEQ ID NO: 617402 - protein, 9 aa, Homo Sapiens
LSGQLTEQQ

SEQ ID NO: 617403 - protein, 9 aa, Homo Sapiens
PTVTQFCTK

SEQ ID NO: 617404 - protein, 9 aa, Homo Sapiens
IMNSFVNNI

SEQ ID NO: 617405 - protein, 9 aa, Homo Sapiens
EGMVASLDQ

SEQ ID NO: 617406 - protein, 9 aa, Homo Sapiens
QYEEDLEFK

SEQ ID NO: 617407 - protein, 9 aa, Homo Sapiens
LFVCIQQDI

SEQ ID NO: 617408 - protein, 9 aa, Homo Sapiens
CYRPGTVAL

SEQ ID NO: 617409 - protein, 9 aa, Homo Sapiens
IRKYEQTLK

SEQ ID NO: 617410 - protein, 9 aa, Homo Sapiens
NILGLRNNF

SEQ ID NO: 617411 - protein, 9 aa, Homo Sapiens
IPCPHTEAA

SEQ ID NO: 617412 - protein, 9 aa, Homo Sapiens
LWVTPNIRS

SEQ ID NO: 617413 - protein, 9 aa, Homo Sapiens
QVMCIVCCQ

SEQ ID NO: 617414 - protein, 9 aa, Homo Sapiens
HVPVADILN

SEQ ID NO: 617415 - protein, 9 aa, Homo Sapiens
KFQDTFTSR

SEQ ID NO: 617416 - protein, 9 aa, Homo Sapiens
TMVFNIHSL

SEQ ID NO: 617417 - protein, 9 aa, Homo Sapiens
GLRNNFYCM

SEQ ID NO: 617418 - protein, 9 aa, Homo Sapiens
KKEGGDRRA

SEQ ID NO: 617419 - protein, 9 aa, Homo Sapiens
CGNPEEILK

SEQ ID NO: 617420 - protein, 9 aa, Homo Sapiens
FAAYLKREY

SEQ ID NO: 617421 - protein, 9 aa, Homo Sapiens
PAVCAPTVT

SEQ ID NO: 617422 - protein, 9 aa, Homo Sapiens
HVLDTLDYL

SEQ ID NO: 617423 - protein, 9 aa, Homo Sapiens
FTILTALVP

SEQ ID NO: 617424 - protein, 9 aa, Homo Sapiens
EAQNRPFDD

SEQ ID NO: 617425 - protein, 9 aa, Homo Sapiens
FFCVLLLGS

SEQ ID NO: 617426 - protein, 9 aa, Homo Sapiens
RWAAHDVFK

SEQ ID NO: 617427 - protein, 9 aa, Homo Sapiens
HDEYNPCQG

SEQ ID NO: 617428 - protein, 9 aa, Homo Sapiens
LCRRPDSTC

SEQ ID NO: 617429 - protein, 9 aa, Homo Sapiens
KGNFKCPAL

SEQ ID NO: 617430 - protein, 9 aa, Homo Sapiens
TKLQIKQQE

SEQ ID NO: 617431 - protein, 9 aa, Homo Sapiens
CACPGNTED

SEQ ID NO: 617432 - protein, 9 aa, Homo Sapiens
DLSQNDLHH

SEQ ID NO: 617433 - protein, 9 aa, Homo Sapiens
PLSEKLRTC

SEQ ID NO: 617434 - protein, 9 aa, Homo Sapiens
EEAPFRDRS

SEQ ID NO: 617435 - protein, 9 aa, Homo Sapiens
KDHQSTAPV

SEQ ID NO: 617436 - protein, 9 aa, Homo Sapiens
MWKENVKKP

SEQ ID NO: 617437 - protein, 9 aa, Homo Sapiens
ECAEPPGTN

SEQ ID NO: 617438 - protein, 9 aa, Homo Sapiens
VPKILLDQV

SEQ ID NO: 617439 - protein, 9 aa, Homo Sapiens
ISSTYNSEK

SEQ ID NO: 617440 - protein, 9 aa, Homo Sapiens
QSRPIRAVP

SEQ ID NO: 617441 - protein, 9 aa, Homo Sapiens
FHKDWQWWG

SEQ ID NO: 617442 - protein, 9 aa, Homo Sapiens
EESGPHDLM

SEQ ID NO: 617443 - protein, 9 aa, Homo Sapiens
GRLSFTVHS

SEQ ID NO: 617444 - protein, 9 aa, Homo Sapiens
ALEPKNGEA

SEQ ID NO: 617445 - protein, 9 aa, Homo Sapiens
PPGRGVATG

SEQ ID NO: 617446 - protein, 9 aa, Homo Sapiens
KTWEEPRLH

SEQ ID NO: 617447 - protein, 9 aa, Homo Sapiens
ILEKFQDTF

SEQ ID NO: 617448 - protein, 9 aa, Homo Sapiens
GAVVFAPSV

SEQ ID NO: 617449 - protein, 9 aa, Homo Sapiens
RISEENKTT

SEQ ID NO: 617450 - protein, 9 aa, Homo Sapiens
LEPKNGEAS

SEQ ID NO: 617451 - protein, 9 aa, Homo Sapiens
RSTSTSTIS

SEQ ID NO: 617452 - protein, 9 aa, Homo Sapiens
PSAACDDYF

SEQ ID NO: 617453 - protein, 9 aa, Homo Sapiens
GSANPSRLV

SEQ ID NO: 617454 - protein, 9 aa, Homo Sapiens
RECEMLKKI

SEQ ID NO: 617455 - protein, 9 aa, Homo Sapiens
VLSHFHVVF

SEQ ID NO: 617456 - protein, 9 aa, Homo Sapiens
PNEMKNIQP

SEQ ID NO: 617457 - protein, 9 aa, Homo Sapiens
VNKVDVSHF

SEQ ID NO: 617458 - protein, 9 aa, Homo Sapiens
YCLTLFEAA

SEQ ID NO: 617459 - protein, 9 aa, Homo Sapiens
LQAPKGALG

SEQ ID NO: 617460 - protein, 9 aa, Homo Sapiens
VCKYLGETK

SEQ ID NO: 617461 - protein, 9 aa, Homo Sapiens
LLPGINLWL

SEQ ID NO: 617462 - protein, 9 aa, Homo Sapiens
DLDGIRIAM

SEQ ID NO: 617463 - protein, 9 aa, Homo Sapiens
RMYRRISNM

SEQ ID NO: 617464 - protein, 9 aa, Homo Sapiens
GEEDGLQVG

SEQ ID NO: 617465 - protein, 9 aa, Homo Sapiens
MLEKYSHLV

SEQ ID NO: 617466 - protein, 9 aa, Homo Sapiens
IEQLEKNLS

SEQ ID NO: 617467 - protein, 9 aa, Homo Sapiens
GKDGADTHG

SEQ ID NO: 617468 - protein, 9 aa, Homo Sapiens
DGSADLEKS

SEQ ID NO: 617469 - protein, 9 aa, Homo Sapiens
ASFARKNRV

SEQ ID NO: 617470 - protein, 9 aa, Homo Sapiens
NLKRLLVER

SEQ ID NO: 617471 - protein, 9 aa, Homo Sapiens
EVADLRKKL

SEQ ID NO: 617472 - protein, 9 aa, Homo Sapiens
SKLDRKHSE

SEQ ID NO: 617473 - protein, 9 aa, Homo Sapiens
RTVSKAMTA

SEQ ID NO: 617474 - protein, 9 aa, Homo Sapiens
SQEFLPIQE

SEQ ID NO: 617475 - protein, 9 aa, Homo Sapiens
LGISVLSGS

SEQ ID NO: 617476 - protein, 9 aa, Homo Sapiens
VGGGGHRPY

SEQ ID NO: 617477 - protein, 9 aa, Homo Sapiens
KEIAAACIH

SEQ ID NO: 617478 - protein, 9 aa, Homo Sapiens
YGGNITDDW

SEQ ID NO: 617479 - protein, 9 aa, Homo Sapiens
TRMTMTDPY

SEQ ID NO: 617480 - protein, 9 aa, Homo Sapiens
ARSVVHYLP

SEQ ID NO: 617481 - protein, 9 aa, Homo Sapiens
EVKQLDIAN

SEQ ID NO: 617482 - protein, 9 aa, Homo Sapiens
AVSRGFNDL

SEQ ID NO: 617483 - protein, 9 aa, Homo Sapiens
RPYRCVHHG

SEQ ID NO: 617484 - protein, 9 aa, Homo Sapiens
ANSLISRRE

SEQ ID NO: 617485 - protein, 9 aa, Homo Sapiens
GTLTFSVTL

SEQ ID NO: 617486 - protein, 9 aa, Homo Sapiens
SDSCACPGN

SEQ ID NO: 617487 - protein, 9 aa, Homo Sapiens
QPSIPPHAQ

SEQ ID NO: 617488 - protein, 9 aa, Homo Sapiens
CSQRHFEIS

SEQ ID NO: 617489 - protein, 9 aa, Homo Sapiens
YRINRLAPP

SEQ ID NO: 617490 - protein, 9 aa, Homo Sapiens
PEGMVASLD

SEQ ID NO: 617491 - protein, 9 aa, Homo Sapiens
EDKEGAVVF

SEQ ID NO: 617492 - protein, 9 aa, Homo Sapiens
GYLNIALWC

SEQ ID NO: 617493 - protein, 9 aa, Homo Sapiens
KPMYYFLSV

SEQ ID NO: 617494 - protein, 9 aa, Homo Sapiens
DNTEKDITE

SEQ ID NO: 617495 - protein, 9 aa, Homo Sapiens
KCISELFQG

SEQ ID NO: 617496 - protein, 9 aa, Homo Sapiens
TMRELLDPS

SEQ ID NO: 617497 - protein, 9 aa, Homo Sapiens
AGEAPGGSA

SEQ ID NO: 617498 - protein, 9 aa, Homo Sapiens
LDREEKENY

SEQ ID NO: 617499 - protein, 9 aa, Homo Sapiens
FKLQDDFSE

SEQ ID NO: 617500 - protein, 9 aa, Homo Sapiens
NKTTCYMGK

SEQ ID NO: 617501 - protein, 9 aa, Homo Sapiens
STCHSAEVI

SEQ ID NO: 617502 - protein, 9 aa, Homo Sapiens
SNMERSRED

SEQ ID NO: 617503 - protein, 9 aa, Homo Sapiens
LRDAFLKFD

SEQ ID NO: 617504 - protein, 9 aa, Homo Sapiens
NDLHHCPLQ

SEQ ID NO: 617505 - protein, 9 aa, Homo Sapiens
VAVTIGLQV

SEQ ID NO: 617506 - protein, 9 aa, Homo Sapiens
FAIQYEEDL

SEQ ID NO: 617507 - protein, 9 aa, Homo Sapiens
QAIFYQFRA

SEQ ID NO: 617508 - protein, 9 aa, Homo Sapiens
LERVAEDKT

SEQ ID NO: 617509 - protein, 9 aa, Homo Sapiens
AEAPRAGTT

SEQ ID NO: 617510 - protein, 9 aa, Homo Sapiens
KLGPEEKTL

SEQ ID NO: 617511 - protein, 9 aa, Homo Sapiens
KTKRVSSPK

SEQ ID NO: 617512 - protein, 9 aa, Homo Sapiens
PKELRSFPD

SEQ ID NO: 617513 - protein, 9 aa, Homo Sapiens
WGMFGTLVL

SEQ ID NO: 617514 - protein, 9 aa, Homo Sapiens
KLRDAFLKF

SEQ ID NO: 617515 - protein, 9 aa, Homo Sapiens
EEDGLQVGL

SEQ ID NO: 617516 - protein, 9 aa, Homo Sapiens
VPEGMVASL

SEQ ID NO: 617517 - protein, 9 aa, Homo Sapiens
RKLNEEHTV

SEQ ID NO: 617518 - protein, 9 aa, Homo Sapiens
VVFAPSVKG

SEQ ID NO: 617519 - protein, 9 aa, Homo Sapiens
PIRAVPAEA

SEQ ID NO: 617520 - protein, 9 aa, Homo Sapiens
KKLEPSNLG

SEQ ID NO: 617521 - protein, 9 aa, Homo Sapiens
LSHFHVVFS

SEQ ID NO: 617522 - protein, 9 aa, Homo Sapiens
TIRREVTVE

SEQ ID NO: 617523 - protein, 9 aa, Homo Sapiens
TEEPGKFST

SEQ ID NO: 617524 - protein, 9 aa, Homo Sapiens
PSGLRSCAV

SEQ ID NO: 617525 - protein, 9 aa, Homo Sapiens
KNLSPRIVK

SEQ ID NO: 617526 - protein, 9 aa, Homo Sapiens
ETGRTEISP

SEQ ID NO: 617527 - protein, 9 aa, Homo Sapiens
KQRQTARLQ

SEQ ID NO: 617528 - protein, 9 aa, Homo Sapiens
STSTSTISA

SEQ ID NO: 617529 - protein, 9 aa, Homo Sapiens
STYGGRKLI

SEQ ID NO: 617530 - protein, 9 aa, Homo Sapiens
LPAQAGAVG

SEQ ID NO: 617531 - protein, 9 aa, Homo Sapiens
DVKPLSEQI

SEQ ID NO: 617532 - protein, 9 aa, Homo Sapiens
VINGVESCL

SEQ ID NO: 617533 - protein, 9 aa, Homo Sapiens
ILATGEKTG

SEQ ID NO: 617534 - protein, 9 aa, Homo Sapiens
HTHTHTLTH

SEQ ID NO: 617535 - protein, 9 aa, Homo Sapiens
RCVHHGCFA

SEQ ID NO: 617536 - protein, 9 aa, Homo Sapiens
ACIHMMPNA

SEQ ID NO: 617537 - protein, 9 aa, Homo Sapiens
KRSNHRERN

SEQ ID NO: 617538 - protein, 9 aa, Homo Sapiens
RKQHSMAIP

SEQ ID NO: 617539 - protein, 9 aa, Homo Sapiens
KDMKKNPKH

SEQ ID NO: 617540 - protein, 9 aa, Homo Sapiens
VNPLSPQAA

SEQ ID NO: 617541 - protein, 9 aa, Homo Sapiens
SGSTAKRYL

SEQ ID NO: 617542 - protein, 9 aa, Homo Sapiens
TSGGCGTAK

SEQ ID NO: 617543 - protein, 9 aa, Homo Sapiens
QAPKGALGN

SEQ ID NO: 617544 - protein, 9 aa, Homo Sapiens
EKTSRMISS

SEQ ID NO: 617545 - protein, 9 aa, Homo Sapiens
HYEKHKEVE

SEQ ID NO: 617546 - protein, 9 aa, Homo Sapiens
SSFPSSTNS

SEQ ID NO: 617547 - protein, 9 aa, Homo Sapiens
PPPGSANPS

SEQ ID NO: 617548 - protein, 9 aa, Homo Sapiens
IILASQSSP

SEQ ID NO: 617549 - protein, 9 aa, Homo Sapiens
PRLKVNPLS

SEQ ID NO: 617550 - protein, 9 aa, Homo Sapiens
AACIHMMPN

SEQ ID NO: 617551 - protein, 9 aa, Homo Sapiens
CDECGKSCC

SEQ ID NO: 617552 - protein, 9 aa, Homo Sapiens
HSRKQRQTA

SEQ ID NO: 617553 - protein, 9 aa, Homo Sapiens
KNLKRLLVE

SEQ ID NO: 617554 - protein, 9 aa, Homo Sapiens
RLKPTVSEG

SEQ ID NO: 617555 - protein, 9 aa, Homo Sapiens
PCCMGSGKN

SEQ ID NO: 617556 - protein, 9 aa, Homo Sapiens
KMPDGTLGS

SEQ ID NO: 617557 - protein, 9 aa, Homo Sapiens
GYTVEVLQQ

SEQ ID NO: 617558 - protein, 9 aa, Homo Sapiens
ELPVDTLYY

SEQ ID NO: 617559 - protein, 9 aa, Homo Sapiens
DIRYRINRL

SEQ ID NO: 617560 - protein, 9 aa, Homo Sapiens
DSGKDGADT

SEQ ID NO: 617561 - protein, 9 aa, Homo Sapiens
SDTESIPCP

SEQ ID NO: 617562 - protein, 9 aa, Homo Sapiens
SAALEISLS

SEQ ID NO: 617563 - protein, 9 aa, Homo Sapiens
DELGYCLTL

SEQ ID NO: 617564 - protein, 9 aa, Homo Sapiens
QVINGVESC

SEQ ID NO: 617565 - protein, 9 aa, Homo Sapiens
LARILGMVW

SEQ ID NO: 617566 - protein, 9 aa, Homo Sapiens
TWRAALPDK

SEQ ID NO: 617567 - protein, 9 aa, Homo Sapiens
TTLWVTPNI

SEQ ID NO: 617568 - protein, 9 aa, Homo Sapiens
GVHSSFPSS

SEQ ID NO: 617569 - protein, 9 aa, Homo Sapiens
DLRKKLGKC

SEQ ID NO: 617570 - protein, 9 aa, Homo Sapiens
RVSSPKKPS

SEQ ID NO: 617571 - protein, 9 aa, Homo Sapiens
SSRSICPLF

SEQ ID NO: 617572 - protein, 9 aa, Homo Sapiens
LSQLHPSGL

SEQ ID NO: 617573 - protein, 9 aa, Homo Sapiens
TLFEAAIEY

SEQ ID NO: 617574 - protein, 9 aa, Homo Sapiens
ILLEHEVPP

SEQ ID NO: 617575 - protein, 9 aa, Homo Sapiens
QKYLIVDNF

SEQ ID NO: 617576 - protein, 9 aa, Homo Sapiens
GRARSVVHY

SEQ ID NO: 617577 - protein, 9 aa, Homo Sapiens
LPLYLQVMC

SEQ ID NO: 617578 - protein, 9 aa, Homo Sapiens
IHADVCQLC

SEQ ID NO: 617579 - protein, 9 aa, Homo Sapiens
IKAEQENGH

SEQ ID NO: 617580 - protein, 9 aa, Homo Sapiens
PLSQLHPSG

SEQ ID NO: 617581 - protein, 9 aa, Homo Sapiens
HEMGDNMGI

SEQ ID NO: 617582 - protein, 9 aa, Homo Sapiens
IIDQFVQRI

SEQ ID NO: 617583 - protein, 9 aa, Homo Sapiens
EGQGATLVN

SEQ ID NO: 617584 - protein, 9 aa, Homo Sapiens
LVNRGDNTY

SEQ ID NO: 617585 - protein, 9 aa, Homo Sapiens
YLPVRVLPR

SEQ ID NO: 617586 - protein, 9 aa, Homo Sapiens
DRKHSEVIL

SEQ ID NO: 617587 - protein, 9 aa, Homo Sapiens
RALEAAEPA

SEQ ID NO: 617588 - protein, 9 aa, Homo Sapiens
IHTHTHTHT

SEQ ID NO: 617589 - protein, 9 aa, Homo Sapiens
KTTLWVTPN

SEQ ID NO: 617590 - protein, 9 aa, Homo Sapiens
PTVSEGVKT

SEQ ID NO: 617591 - protein, 9 aa, Homo Sapiens
SVQADLELE

SEQ ID NO: 617592 - protein, 9 aa, Homo Sapiens
QPLQILFTG

SEQ ID NO: 617593 - protein, 9 aa, Homo Sapiens
LPGNPLSRS

SEQ ID NO: 617594 - protein, 9 aa, Homo Sapiens
QDILEKFQD

SEQ ID NO: 617595 - protein, 9 aa, Homo Sapiens
CSIRCHCED

SEQ ID NO: 617596 - protein, 9 aa, Homo Sapiens
LRKDHQSTA

SEQ ID NO: 617597 - protein, 9 aa, Homo Sapiens
ITSGGCGTA

SEQ ID NO: 617598 - protein, 9 aa, Homo Sapiens
LRGAKDFRL

SEQ ID NO: 617599 - protein, 9 aa, Homo Sapiens
RNPRRPPAS

SEQ ID NO: 617600 - protein, 9 aa, Homo Sapiens
STQWDLGGF

SEQ ID NO: 617601 - protein, 9 aa, Homo Sapiens
DRWFRSVDW

SEQ ID NO: 617602 - protein, 9 aa, Homo Sapiens
HSLLDLPEQ

SEQ ID NO: 617603 - protein, 9 aa, Homo Sapiens
ATVHDLFNW

SEQ ID NO: 617604 - protein, 9 aa, Homo Sapiens
EPRLHGAWT

SEQ ID NO: 617605 - protein, 9 aa, Homo Sapiens
TASVQADLE

SEQ ID NO: 617606 - protein, 9 aa, Homo Sapiens
DANEEAPFR

SEQ ID NO: 617607 - protein, 9 aa, Homo Sapiens
ERVAEDKTR

SEQ ID NO: 617608 - protein, 9 aa, Homo Sapiens
DDLRCSGHE

SEQ ID NO: 617609 - protein, 9 aa, Homo Sapiens
GFNDLELDT

SEQ ID NO: 617610 - protein, 9 aa, Homo Sapiens
NLVHMHPKK

SEQ ID NO: 617611 - protein, 9 aa, Homo Sapiens
EKFQDTFTS

SEQ ID NO: 617612 - protein, 9 aa, Homo Sapiens
TLDYLRPVA

SEQ ID NO: 617613 - protein, 9 aa, Homo Sapiens
NHTSQEINS

SEQ ID NO: 617614 - protein, 9 aa, Homo Sapiens
HSSFPSSTN

SEQ ID NO: 617615 - protein, 9 aa, Homo Sapiens
RLVQRTQSV

SEQ ID NO: 617616 - protein, 9 aa, Homo Sapiens
FAWERNPYT

SEQ ID NO: 617617 - protein, 9 aa, Homo Sapiens
FSTYGGRKL

SEQ ID NO: 617618 - protein, 9 aa, Homo Sapiens
RQTKKRRVD

SEQ ID NO: 617619 - protein, 9 aa, Homo Sapiens
ACHGYLNIA

SEQ ID NO: 617620 - protein, 9 aa, Homo Sapiens
ALDYTQRYI

SEQ ID NO: 617621 - protein, 9 aa, Homo Sapiens
PLMMQVGME

SEQ ID NO: 617622 - protein, 9 aa, Homo Sapiens
EMLKKIWGS

SEQ ID NO: 617623 - protein, 9 aa, Homo Sapiens
YRRISNMVG

SEQ ID NO: 617624 - protein, 9 aa, Homo Sapiens
IGLCLWLWL

SEQ ID NO: 617625 - protein, 9 aa, Homo Sapiens
APLKALVCE

SEQ ID NO: 617626 - protein, 9 aa, Homo Sapiens
FSLDLKLLN

SEQ ID NO: 617627 - protein, 9 aa, Homo Sapiens
IFTRAKSYE

SEQ ID NO: 617628 - protein, 9 aa, Homo Sapiens
VLQQKQKRS

SEQ ID NO: 617629 - protein, 9 aa, Homo Sapiens
QTARLQLPA

SEQ ID NO: 617630 - protein, 9 aa, Homo Sapiens
EEILKGVLH

SEQ ID NO: 617631 - protein, 9 aa, Homo Sapiens
LLKVMLEYE

SEQ ID NO: 617632 - protein, 9 aa, Homo Sapiens
KLKKCISEL

SEQ ID NO: 617633 - protein, 9 aa, Homo Sapiens
AQSRPIRAV

SEQ ID NO: 617634 - protein, 9 aa, Homo Sapiens
AVPRHTMRE

SEQ ID NO: 617635 - protein, 9 aa, Homo Sapiens
VDLSGSNVT

SEQ ID NO: 617636 - protein, 9 aa, Homo Sapiens
QKIRQKNTI

SEQ ID NO: 617637 - protein, 9 aa, Homo Sapiens
KLILLEHEV

SEQ ID NO: 617638 - protein, 9 aa, Homo Sapiens
LGPPPLSGK

SEQ ID NO: 617639 - protein, 9 aa, Homo Sapiens
PVLVGDLKL

SEQ ID NO: 617640 - protein, 9 aa, Homo Sapiens
LLERVAEDK

SEQ ID NO: 617641 - protein, 9 aa, Homo Sapiens
YKSTILLQV

SEQ ID NO: 617642 - protein, 9 aa, Homo Sapiens
SLSGQLTEQ

SEQ ID NO: 617643 - protein, 9 aa, Homo Sapiens
SRGSLECIA

SEQ ID NO: 617644 - protein, 9 aa, Homo Sapiens
VSVGLIVEQ

SEQ ID NO: 617645 - protein, 9 aa, Homo Sapiens
VPELFVCIQ

SEQ ID NO: 617646 - protein, 9 aa, Homo Sapiens
TDGQRPADR

SEQ ID NO: 617647 - protein, 9 aa, Homo Sapiens
GEGAPRSFL

SEQ ID NO: 617648 - protein, 9 aa, Homo Sapiens
APVQYGELQ

SEQ ID NO: 617649 - protein, 9 aa, Homo Sapiens
KLQIKQQEL

SEQ ID NO: 617650 - protein, 9 aa, Homo Sapiens
KWKDFELPV

SEQ ID NO: 617651 - protein, 9 aa, Homo Sapiens
LKPTVSEGV

SEQ ID NO: 617652 - protein, 9 aa, Homo Sapiens
PVQQPSFQQ

SEQ ID NO: 617653 - protein, 9 aa, Homo Sapiens
KGEEDGLQV

SEQ ID NO: 617654 - protein, 9 aa, Homo Sapiens
LLISLVFAQ

SEQ ID NO: 617655 - protein, 9 aa, Homo Sapiens
CVLLLGSEC

SEQ ID NO: 617656 - protein, 9 aa, Homo Sapiens
RARSVVHYL

SEQ ID NO: 617657 - protein, 9 aa, Homo Sapiens
RTEISPEEN

SEQ ID NO: 617658 - protein, 9 aa, Homo Sapiens
ADGRWNNQS

SEQ ID NO: 617659 - protein, 9 aa, Homo Sapiens
LFLNVFSLL

SEQ ID NO: 617660 - protein, 9 aa, Homo Sapiens
GALAGAVVG

SEQ ID NO: 617661 - protein, 9 aa, Homo Sapiens
PSRLVSSYR

SEQ ID NO: 617662 - protein, 9 aa, Homo Sapiens
SQAVPRHTM

SEQ ID NO: 617663 - protein, 9 aa, Homo Sapiens
TVHDLFNWL

SEQ ID NO: 617664 - protein, 9 aa, Homo Sapiens
SVLSHFHVV

SEQ ID NO: 617665 - protein, 9 aa, Homo Sapiens
GAPRSFLAR

SEQ ID NO: 617666 - protein, 9 aa, Homo Sapiens
PIEVKQLDI

SEQ ID NO: 617667 - protein, 9 aa, Homo Sapiens
VQRIISEHF

SEQ ID NO: 617668 - protein, 9 aa, Homo Sapiens
SLDLKLLNN

SEQ ID NO: 617669 - protein, 9 aa, Homo Sapiens
IERSEELNK

SEQ ID NO: 617670 - protein, 9 aa, Homo Sapiens
EVGFFIILA

SEQ ID NO: 617671 - protein, 9 aa, Homo Sapiens
EEYSANSLI

SEQ ID NO: 617672 - protein, 9 aa, Homo Sapiens
QCFYNQEQR

SEQ ID NO: 617673 - protein, 9 aa, Homo Sapiens
FCVLSSGPG

SEQ ID NO: 617674 - protein, 9 aa, Homo Sapiens
FFVGITKVV

SEQ ID NO: 617675 - protein, 9 aa, Homo Sapiens
ANPSRLVSS

SEQ ID NO: 617676 - protein, 9 aa, Homo Sapiens
SAFCVLSSG

SEQ ID NO: 617677 - protein, 9 aa, Homo Sapiens
PKKGQELIQ

SEQ ID NO: 617678 - protein, 9 aa, Homo Sapiens
HTSQEINSN

SEQ ID NO: 617679 - protein, 9 aa, Homo Sapiens
PEEKTLKDS

SEQ ID NO: 617680 - protein, 9 aa, Homo Sapiens
AKNLKRLLV

SEQ ID NO: 617681 - protein, 9 aa, Homo Sapiens
LEKRLRAAV

SEQ ID NO: 617682 - protein, 9 aa, Homo Sapiens
QPMAGCAHV

SEQ ID NO: 617683 - protein, 9 aa, Homo Sapiens
HTHTWRARS

SEQ ID NO: 617684 - protein, 9 aa, Homo Sapiens
KKRRVDIGV

SEQ ID NO: 617685 - protein, 9 aa, Homo Sapiens
PERRMEGKM

SEQ ID NO: 617686 - protein, 9 aa, Homo Sapiens
NRPPSGKTP

SEQ ID NO: 617687 - protein, 9 aa, Homo Sapiens
VASLDQLKG

SEQ ID NO: 617688 - protein, 9 aa, Homo Sapiens
SMMGNDEDA

SEQ ID NO: 617689 - protein, 9 aa, Homo Sapiens
SQPSAACDD

SEQ ID NO: 617690 - protein, 9 aa, Homo Sapiens
KGSYYPSSG

SEQ ID NO: 617691 - protein, 9 aa, Homo Sapiens
KTIEKCRKM

SEQ ID NO: 617692 - protein, 9 aa, Homo Sapiens
GSLECIAEH

SEQ ID NO: 617693 - protein, 9 aa, Homo Sapiens
NTVLSNPAC

SEQ ID NO: 617694 - protein, 9 aa, Homo Sapiens
PHAQSRPIR

SEQ ID NO: 617695 - protein, 9 aa, Homo Sapiens
DLEETGRTE

SEQ ID NO: 617696 - protein, 9 aa, Homo Sapiens
LIVEQDTEE

SEQ ID NO: 617697 - protein, 9 aa, Homo Sapiens
KKGQELIQK

SEQ ID NO: 617698 - protein, 9 aa, Homo Sapiens
GKSCCYSSA

SEQ ID NO: 617699 - protein, 9 aa, Homo Sapiens
TLVLLCYAL

SEQ ID NO: 617700 - protein, 9 aa, Homo Sapiens
GMVASLDQL

SEQ ID NO: 617701 - protein, 9 aa, Homo Sapiens
WKENVKKPG

SEQ ID NO: 617702 - protein, 9 aa, Homo Sapiens
SIPPHAQSR

SEQ ID NO: 617703 - protein, 9 aa, Homo Sapiens
NRPFDDKTS

SEQ ID NO: 617704 - protein, 9 aa, Homo Sapiens
QVGPKEKIA

SEQ ID NO: 617705 - protein, 9 aa, Homo Sapiens
HKCSLCHKN

SEQ ID NO: 617706 - protein, 9 aa, Homo Sapiens
MLLLLDIRY

SEQ ID NO: 617707 - protein, 9 aa, Homo Sapiens
NSTAPVEKP

SEQ ID NO: 617708 - protein, 9 aa, Homo Sapiens
HIDFAIQYE

SEQ ID NO: 617709 - protein, 9 aa, Homo Sapiens
KAKNLKRLL

SEQ ID NO: 617710 - protein, 9 aa, Homo Sapiens
SYLWGMFGT

SEQ ID NO: 617711 - protein, 9 aa, Homo Sapiens
KRKWVLTMK

SEQ ID NO: 617712 - protein, 9 aa, Homo Sapiens
YALDYTQRY

SEQ ID NO: 617713 - protein, 9 aa, Homo Sapiens
HFEISKFYL

SEQ ID NO: 617714 - protein, 9 aa, Homo Sapiens
VIERSEELN

SEQ ID NO: 617715 - protein, 9 aa, Homo Sapiens
RPRLVQRTQ

SEQ ID NO: 617716 - protein, 9 aa, Homo Sapiens
RPADRAIVH

SEQ ID NO: 617717 - protein, 9 aa, Homo Sapiens
IENLGTGII

SEQ ID NO: 617718 - protein, 9 aa, Homo Sapiens
LKRLLVERS

SEQ ID NO: 617719 - protein, 9 aa, Homo Sapiens
ADVCQLCLL

SEQ ID NO: 617720 - protein, 9 aa, Homo Sapiens
VIKAEQENG

SEQ ID NO: 617721 - protein, 9 aa, Homo Sapiens
KTRVVSPII

SEQ ID NO: 617722 - protein, 9 aa, Homo Sapiens
LQQKQKRSN

SEQ ID NO: 617723 - protein, 9 aa, Homo Sapiens
DVKHDRWFR

SEQ ID NO: 617724 - protein, 9 aa, Homo Sapiens
APVTTDPFQ

SEQ ID NO: 617725 - protein, 9 aa, Homo Sapiens
LQPMAGCAH

SEQ ID NO: 617726 - protein, 9 aa, Homo Sapiens
TVPKILLDQ

SEQ ID NO: 617727 - protein, 9 aa, Homo Sapiens
CFTACSQRH

SEQ ID NO: 617728 - protein, 9 aa, Homo Sapiens
FSLKQDGSA

SEQ ID NO: 617729 - protein, 9 aa, Homo Sapiens
RYSTRQTFL

SEQ ID NO: 617730 - protein, 9 aa, Homo Sapiens
IQYEEDLEF

SEQ ID NO: 617731 - protein, 9 aa, Homo Sapiens
ENVKKPGSF

SEQ ID NO: 617732 - protein, 9 aa, Homo Sapiens
SKAMTAYWT

SEQ ID NO: 617733 - protein, 9 aa, Homo Sapiens
LDRKHSEVI

SEQ ID NO: 617734 - protein, 9 aa, Homo Sapiens
ILYLFYKDM

SEQ ID NO: 617735 - protein, 9 aa, Homo Sapiens
VPRHTMREL

SEQ ID NO: 617736 - protein, 9 aa, Homo Sapiens
CKYEPEINS

SEQ ID NO: 617737 - protein, 9 aa, Homo Sapiens
FPDPQGTLL

SEQ ID NO: 617738 - protein, 9 aa, Homo Sapiens
AKTWGLGHD

SEQ ID NO: 617739 - protein, 9 aa, Homo Sapiens
HTRMTMTDP

SEQ ID NO: 617740 - protein, 9 aa, Homo Sapiens
HFHVLDTLD

SEQ ID NO: 617741 - protein, 9 aa, Homo Sapiens
YLKREYKVH

SEQ ID NO: 617742 - protein, 9 aa, Homo Sapiens
PTLQAIFYQ

SEQ ID NO: 617743 - protein, 9 aa, Homo Sapiens
DILEKFQDT

SEQ ID NO: 617744 - protein, 9 aa, Homo Sapiens
IFFCVLLLG

SEQ ID NO: 617745 - protein, 9 aa, Homo Sapiens
GCSENSGSS

SEQ ID NO: 617746 - protein, 9 aa, Homo Sapiens
NHYEKHKEV

SEQ ID NO: 617747 - protein, 9 aa, Homo Sapiens
VDLPGNPLS

SEQ ID NO: 617748 - protein, 9 aa, Homo Sapiens
SEENKTTCY

SEQ ID NO: 617749 - protein, 9 aa, Homo Sapiens
NWKVIANYL

SEQ ID NO: 617750 - protein, 9 aa, Homo Sapiens
SRMISSTYN

SEQ ID NO: 617751 - protein, 9 aa, Homo Sapiens
PLQILFTGN

SEQ ID NO: 617752 - protein, 9 aa, Homo Sapiens
HTMRELLDP

SEQ ID NO: 617753 - protein, 9 aa, Homo Sapiens
NSVTASVQA

SEQ ID NO: 617754 - protein, 9 aa, Homo Sapiens
LARLIKHDE

SEQ ID NO: 617755 - protein, 9 aa, Homo Sapiens
QVHFLVFDQ

SEQ ID NO: 617756 - protein, 9 aa, Homo Sapiens
QQKQKRSNH

SEQ ID NO: 617757 - protein, 9 aa, Homo Sapiens
EIAAACIHM

SEQ ID NO: 617758 - protein, 9 aa, Homo Sapiens
VAELTQQIF

SEQ ID NO: 617759 - protein, 9 aa, Homo Sapiens
FTTDSGKDG

SEQ ID NO: 617760 - protein, 9 aa, Homo Sapiens
THTLTHTHT

SEQ ID NO: 617761 - protein, 9 aa, Homo Sapiens
VIELCEPIE

SEQ ID NO: 617762 - protein, 9 aa, Homo Sapiens
DVSHFTKRD

SEQ ID NO: 617763 - protein, 9 aa, Homo Sapiens
IRCHCEDGG

SEQ ID NO: 617764 - protein, 9 aa, Homo Sapiens
FGIAIHLEY

SEQ ID NO: 617765 - protein, 9 aa, Homo Sapiens
LGYALDYTQ

SEQ ID NO: 617766 - protein, 9 aa, Homo Sapiens
EPPGTNPRL

SEQ ID NO: 617767 - protein, 9 aa, Homo Sapiens
HKAEVDMDT

SEQ ID NO: 617768 - protein, 9 aa, Homo Sapiens
LSFTVHSLL

SEQ ID NO: 617769 - protein, 9 aa, Homo Sapiens
GWADGRWNN

SEQ ID NO: 617770 - protein, 9 aa, Homo Sapiens
TPVSSAGEA

SEQ ID NO: 617771 - protein, 9 aa, Homo Sapiens
RQKNTIRRE

SEQ ID NO: 617772 - protein, 9 aa, Homo Sapiens
SSQALEPKN

SEQ ID NO: 617773 - protein, 9 aa, Homo Sapiens
GLGIDNINE

SEQ ID NO: 617774 - protein, 9 aa, Homo Sapiens
MYGGNITDD

SEQ ID NO: 617775 - protein, 9 aa, Homo Sapiens
PGPVTLVIE

SEQ ID NO: 617776 - protein, 9 aa, Homo Sapiens
NIKRKWVLT

SEQ ID NO: 617777 - protein, 9 aa, Homo Sapiens
IIHELMHFC

SEQ ID NO: 617778 - protein, 9 aa, Homo Sapiens
WVLTMKRLD

SEQ ID NO: 617779 - protein, 9 aa, Homo Sapiens
LATGEKTGM

SEQ ID NO: 617780 - protein, 9 aa, Homo Sapiens
EENKTTCYM

SEQ ID NO: 617781 - protein, 9 aa, Homo Sapiens
RKYEQTLKN

SEQ ID NO: 617782 - protein, 9 aa, Homo Sapiens
TQRYIFVKS

SEQ ID NO: 617783 - protein, 9 aa, Homo Sapiens
ALVCERMDD

SEQ ID NO: 617784 - protein, 9 aa, Homo Sapiens
STPWVAIGS

SEQ ID NO: 617785 - protein, 9 aa, Homo Sapiens
FGLARLIKH

SEQ ID NO: 617786 - protein, 9 aa, Homo Sapiens
SAKLILLEH

SEQ ID NO: 617787 - protein, 9 aa, Homo Sapiens
DQKGNFKCP

SEQ ID NO: 617788 - protein, 9 aa, Homo Sapiens
LGPEEKTLK

SEQ ID NO: 617789 - protein, 9 aa, Homo Sapiens
ASTGRVNET

SEQ ID NO: 617790 - protein, 9 aa, Homo Sapiens
AAKYVKSRL

SEQ ID NO: 617791 - protein, 9 aa, Homo Sapiens
VTVPKILLD

SEQ ID NO: 617792 - protein, 9 aa, Homo Sapiens
SENSGSSGC

SEQ ID NO: 617793 - protein, 9 aa, Homo Sapiens
LLGQAEHKA

SEQ ID NO: 617794 - protein, 9 aa, Homo Sapiens
KEGAVVFAP

SEQ ID NO: 617795 - protein, 9 aa, Homo Sapiens
LCEPIEVKQ

SEQ ID NO: 617796 - protein, 9 aa, Homo Sapiens
NLVEAFWQC

SEQ ID NO: 617797 - protein, 9 aa, Homo Sapiens
VTQFCTKST

SEQ ID NO: 617798 - protein, 9 aa, Homo Sapiens
KRKTKRSVQ

SEQ ID NO: 617799 - protein, 9 aa, Homo Sapiens
DECGKSCCY

SEQ ID NO: 617800 - protein, 9 aa, Homo Sapiens
SELVGWADG

SEQ ID NO: 617801 - protein, 9 aa, Homo Sapiens
RRYSTRQTF

SEQ ID NO: 617802 - protein, 9 aa, Homo Sapiens
GMFGTLVLL

SEQ ID NO: 617803 - protein, 9 aa, Homo Sapiens
DLFNWLSVL

SEQ ID NO: 617804 - protein, 9 aa, Homo Sapiens
KELRSFPDP

SEQ ID NO: 617805 - protein, 9 aa, Homo Sapiens
ESIPCPHTE

SEQ ID NO: 617806 - protein, 9 aa, Homo Sapiens
LVERSNTPD

SEQ ID NO: 617807 - protein, 9 aa, Homo Sapiens
KRNILATGE

SEQ ID NO: 617808 - protein, 9 aa, Homo Sapiens
GGSCRQTGD

SEQ ID NO: 617809 - protein, 9 aa, Homo Sapiens
PLKALVCER

SEQ ID NO: 617810 - protein, 9 aa, Homo Sapiens
GEIMYGGNI

SEQ ID NO: 617811 - protein, 9 aa, Homo Sapiens
RRPPASSVN

SEQ ID NO: 617812 - protein, 9 aa, Homo Sapiens
EPKNGEASE

SEQ ID NO: 617813 - protein, 9 aa, Homo Sapiens
RRPRLVQRT

SEQ ID NO: 617814 - protein, 9 aa, Homo Sapiens
NPEEILKGV

SEQ ID NO: 617815 - protein, 9 aa, Homo Sapiens
CIHMMPNAV

SEQ ID NO: 617816 - protein, 9 aa, Homo Sapiens
IFAFFVGIT

SEQ ID NO: 617817 - protein, 9 aa, Homo Sapiens
SIDIYSHYI

SEQ ID NO: 617818 - protein, 9 aa, Homo Sapiens
LLSRQTKKR

SEQ ID NO: 617819 - protein, 9 aa, Homo Sapiens
CFPCCMGSG

SEQ ID NO: 617820 - protein, 9 aa, Homo Sapiens
VNGGSCRQT

SEQ ID NO: 617821 - protein, 9 aa, Homo Sapiens
SNHRERNKT

SEQ ID NO: 617822 - protein, 9 aa, Homo Sapiens
YLQVMCIVC

SEQ ID NO: 617823 - protein, 9 aa, Homo Sapiens
EAPGGSASS

SEQ ID NO: 617824 - protein, 9 aa, Homo Sapiens
QYWCHFQNG

SEQ ID NO: 617825 - protein, 9 aa, Homo Sapiens
NFHKDWQWW

SEQ ID NO: 617826 - protein, 9 aa, Homo Sapiens
KLQDDFSEF

SEQ ID NO: 617827 - protein, 9 aa, Homo Sapiens
DTNLLPGIN

SEQ ID NO: 617828 - protein, 9 aa, Homo Sapiens
VCQLCLLAK

SEQ ID NO: 617829 - protein, 9 aa, Homo Sapiens
LQVHFLVFD

SEQ ID NO: 617830 - protein, 9 aa, Homo Sapiens
VFNIHSLEW

SEQ ID NO: 617831 - protein, 9 aa, Homo Sapiens
DIEACHGYL

SEQ ID NO: 617832 - protein, 9 aa, Homo Sapiens
RFVQGHFTI

SEQ ID NO: 617833 - protein, 9 aa, Homo Sapiens
AKLILLEHE

SEQ ID NO: 617834 - protein, 9 aa, Homo Sapiens
RPIRAVPAE

SEQ ID NO: 617835 - protein, 9 aa, Homo Sapiens
LTMKRLDVN

SEQ ID NO: 617836 - protein, 9 aa, Homo Sapiens
EPIEVKQLD

SEQ ID NO: 617837 - protein, 9 aa, Homo Sapiens
HSMAIPSGG

SEQ ID NO: 617838 - protein, 9 aa, Homo Sapiens
KTWGLGHDH

SEQ ID NO: 617839 - protein, 9 aa, Homo Sapiens
VADILNSYA

SEQ ID NO: 617840 - protein, 9 aa, Homo Sapiens
LWRQFCQKM

SEQ ID NO: 617841 - protein, 9 aa, Homo Sapiens
SHTCGNPEE

SEQ ID NO: 617842 - protein, 9 aa, Homo Sapiens
LLLLDIRYR

SEQ ID NO: 617843 - protein, 9 aa, Homo Sapiens
LAVITQNIE

SEQ ID NO: 617844 - protein, 9 aa, Homo Sapiens
VSAFCVLSS

SEQ ID NO: 617845 - protein, 9 aa, Homo Sapiens
GWQRRRQSI

SEQ ID NO: 617846 - protein, 9 aa, Homo Sapiens
IEVKQLDIA

SEQ ID NO: 617847 - protein, 9 aa, Homo Sapiens
NRGDNTYGG

SEQ ID NO: 617848 - protein, 9 aa, Homo Sapiens
CWVAGSWGP

SEQ ID NO: 617849 - protein, 9 aa, Homo Sapiens
ISNMVGLSY

SEQ ID NO: 617850 - protein, 9 aa, Homo Sapiens
YKDMKKNPK

SEQ ID NO: 617851 - protein, 9 aa, Homo Sapiens
GQRPADRAI

SEQ ID NO: 617852 - protein, 9 aa, Homo Sapiens
IQQDILASS

SEQ ID NO: 617853 - protein, 9 aa, Homo Sapiens
SADLEKSYS

SEQ ID NO: 617854 - protein, 9 aa, Homo Sapiens
NKHFGIAIH

SEQ ID NO: 617855 - protein, 9 aa, Homo Sapiens
MGGDPGGVG

SEQ ID NO: 617856 - protein, 9 aa, Homo Sapiens
GSKEAFGFQ

SEQ ID NO: 617857 - protein, 9 aa, Homo Sapiens
SKEAFGFQH

SEQ ID NO: 617858 - protein, 9 aa, Homo Sapiens
TDSGKDGAD

SEQ ID NO: 617859 - protein, 9 aa, Homo Sapiens
AVVGAAGPL

SEQ ID NO: 617860 - protein, 9 aa, Homo Sapiens
GIGWQRRRQ

SEQ ID NO: 617861 - protein, 9 aa, Homo Sapiens
KQKRSNHRE

SEQ ID NO: 617862 - protein, 9 aa, Homo Sapiens
PGSDSCACP

SEQ ID NO: 617863 - protein, 9 aa, Homo Sapiens
LSRQTKKRR

SEQ ID NO: 617864 - protein, 9 aa, Homo Sapiens
MSKRKTKRS

SEQ ID NO: 617865 - protein, 9 aa, Homo Sapiens
STIQRKLNE

SEQ ID NO: 617866 - protein, 9 aa, Homo Sapiens
GRACFCALL

SEQ ID NO: 617867 - protein, 9 aa, Homo Sapiens
SYKTGFKTS

SEQ ID NO: 617868 - protein, 9 aa, Homo Sapiens
QPDDRPPAC

SEQ ID NO: 617869 - protein, 9 aa, Homo Sapiens
PDTNLLPGI

SEQ ID NO: 617870 - protein, 9 aa, Homo Sapiens
SRNPRRPPA

SEQ ID NO: 617871 - protein, 9 aa, Homo Sapiens
ESKLDRKHS

SEQ ID NO: 617872 - protein, 9 aa, Homo Sapiens
KLNEEHTVE

SEQ ID NO: 617873 - protein, 9 aa, Homo Sapiens
PYTISSPGH

SEQ ID NO: 617874 - protein, 9 aa, Homo Sapiens
EEKTLKDSR

SEQ ID NO: 617875 - protein, 9 aa, Homo Sapiens
KMIPAFRTF

SEQ ID NO: 617876 - protein, 9 aa, Homo Sapiens
LKQDGSADL

SEQ ID NO: 617877 - protein, 9 aa, Homo Sapiens
QRQTARLQL

SEQ ID NO: 617878 - protein, 9 aa, Homo Sapiens
FNDLELDTP

SEQ ID NO: 617879 - protein, 9 aa, Homo Sapiens
LMWKENVKK

SEQ ID NO: 617880 - protein, 9 aa, Homo Sapiens
NVFSLLPAQ

SEQ ID NO: 617881 - protein, 9 aa, Homo Sapiens
AASTPWVAI

SEQ ID NO: 617882 - protein, 9 aa, Homo Sapiens
GQLTEQQNK

SEQ ID NO: 617883 - protein, 9 aa, Homo Sapiens
NIRSTAALT

SEQ ID NO: 617884 - protein, 9 aa, Homo Sapiens
EPPTKLQIK

SEQ ID NO: 617885 - protein, 9 aa, Homo Sapiens
GNHRDAAQL

SEQ ID NO: 617886 - protein, 9 aa, Homo Sapiens
HAVAKYFLG

SEQ ID NO: 617887 - protein, 9 aa, Homo Sapiens
METSYLPRQ

SEQ ID NO: 617888 - protein, 9 aa, Homo Sapiens
NFYCMAQLL

SEQ ID NO: 617889 - protein, 9 aa, Homo Sapiens
SLKQDGSAD

SEQ ID NO: 617890 - protein, 9 aa, Homo Sapiens
EDIEEYSAN

SEQ ID NO: 617891 - protein, 9 aa, Homo Sapiens
DHRTLQAPK

SEQ ID NO: 617892 - protein, 9 aa, Homo Sapiens
PADRAIVHS

SEQ ID NO: 617893 - protein, 9 aa, Homo Sapiens
QAGLSSAIV

SEQ ID NO: 617894 - protein, 9 aa, Homo Sapiens
PDQSQVEKL

SEQ ID NO: 617895 - protein, 9 aa, Homo Sapiens
EQNGTDNWK

SEQ ID NO: 617896 - protein, 9 aa, Homo Sapiens
RAAVGDDAE

SEQ ID NO: 617897 - protein, 9 aa, Homo Sapiens
MKNIQPGDV

SEQ ID NO: 617898 - protein, 9 aa, Homo Sapiens
STAPVQYGE

SEQ ID NO: 617899 - protein, 9 aa, Homo Sapiens
SGPHDLMET

SEQ ID NO: 617900 - protein, 9 aa, Homo Sapiens
CERMDDWKV

SEQ ID NO: 617901 - protein, 9 aa, Homo Sapiens
GNSVQKHGE

SEQ ID NO: 617902 - protein, 9 aa, Homo Sapiens
SSGIAQFHI

SEQ ID NO: 617903 - protein, 9 aa, Homo Sapiens
ENGHPLPAF

SEQ ID NO: 617904 - protein, 9 aa, Homo Sapiens
GSCRQTGDF

SEQ ID NO: 617905 - protein, 9 aa, Homo Sapiens
DFRLPGLSR

SEQ ID NO: 617906 - protein, 9 aa, Homo Sapiens
HSMMGNDED

SEQ ID NO: 617907 - protein, 9 aa, Homo Sapiens
PPGSANPSR

SEQ ID NO: 617908 - protein, 9 aa, Homo Sapiens
KRNNMKISS

SEQ ID NO: 617909 - protein, 9 aa, Homo Sapiens
KDIYATDQK

SEQ ID NO: 617910 - protein, 9 aa, Homo Sapiens
CEPIEVKQL

SEQ ID NO: 617911 - protein, 9 aa, Homo Sapiens
WAAHDVFKL

SEQ ID NO: 617912 - protein, 9 aa, Homo Sapiens
SKRKTKRSV

SEQ ID NO: 617913 - protein, 9 aa, Homo Sapiens
RFRPMDNLL

SEQ ID NO: 617914 - protein, 9 aa, Homo Sapiens
NITDDWDRR

SEQ ID NO: 617915 - protein, 9 aa, Homo Sapiens
RPHKCSLCH

SEQ ID NO: 617916 - protein, 9 aa, Homo Sapiens
VLHKFKLQD

SEQ ID NO: 617917 - protein, 9 aa, Homo Sapiens
ILGLRNNFY

SEQ ID NO: 617918 - protein, 9 aa, Homo Sapiens
AKYFLGYNP

SEQ ID NO: 617919 - protein, 9 aa, Homo Sapiens
PELFVCIQQ

SEQ ID NO: 617920 - protein, 9 aa, Homo Sapiens
EDSWLHKPM

SEQ ID NO: 617921 - protein, 9 aa, Homo Sapiens
LGHERIFTR

SEQ ID NO: 617922 - protein, 9 aa, Homo Sapiens
RAKMLLRDA

SEQ ID NO: 617923 - protein, 9 aa, Homo Sapiens
ISVTVPKIL

SEQ ID NO: 617924 - protein, 9 aa, Homo Sapiens
ASVQADLEL

SEQ ID NO: 617925 - protein, 9 aa, Homo Sapiens
RMTMTDPYK

SEQ ID NO: 617926 - protein, 9 aa, Homo Sapiens
YTVEVLQQQ

SEQ ID NO: 617927 - protein, 9 aa, Homo Sapiens
SGCSENSGS

SEQ ID NO: 617928 - protein, 9 aa, Homo Sapiens
LILLEHEVP

SEQ ID NO: 617929 - protein, 9 aa, Homo Sapiens
WGHVAQPAH

SEQ ID NO: 617930 - protein, 9 aa, Homo Sapiens
NGNYCGETS

SEQ ID NO: 617931 - protein, 9 aa, Homo Sapiens
DRLKPTVSE

SEQ ID NO: 617932 - protein, 9 aa, Homo Sapiens
DGLQVGLDE

SEQ ID NO: 617933 - protein, 9 aa, Homo Sapiens
TPNIRSTAA

SEQ ID NO: 617934 - protein, 9 aa, Homo Sapiens
EPALQAQAQ

SEQ ID NO: 617935 - protein, 9 aa, Homo Sapiens
EQQNDLLQI

SEQ ID NO: 617936 - protein, 9 aa, Homo Sapiens
QYWDQCFYN

SEQ ID NO: 617937 - protein, 9 aa, Homo Sapiens
SVDLSGSNV

SEQ ID NO: 617938 - protein, 9 aa, Homo Sapiens
VGPKEKIAL

SEQ ID NO: 617939 - protein, 9 aa, Homo Sapiens
STDEGNPKK

SEQ ID NO: 617940 - protein, 9 aa, Homo Sapiens
PRRPPASSV

SEQ ID NO: 617941 - protein, 9 aa, Homo Sapiens
DLMETSYLP

SEQ ID NO: 617942 - protein, 9 aa, Homo Sapiens
KCSLCHKNY

SEQ ID NO: 617943 - protein, 9 aa, Homo Sapiens
RNILATGEK

SEQ ID NO: 617944 - protein, 9 aa, Homo Sapiens
GSSGCSENS

SEQ ID NO: 617945 - protein, 9 aa, Homo Sapiens
RRMEGKMPD

SEQ ID NO: 617946 - protein, 9 aa, Homo Sapiens
ISLSNMERS

SEQ ID NO: 617947 - protein, 9 aa, Homo Sapiens
FTRAKSYEC

SEQ ID NO: 617948 - protein, 9 aa, Homo Sapiens
QSVPEGMVA

SEQ ID NO: 617949 - protein, 9 aa, Homo Sapiens
GPKEKIALK

SEQ ID NO: 617950 - protein, 9 aa, Homo Sapiens
EKRLRAAVG

SEQ ID NO: 617951 - protein, 9 aa, Homo Sapiens
KALVCERMD

SEQ ID NO: 617952 - protein, 9 aa, Homo Sapiens
SSSLSGQLT

SEQ ID NO: 617953 - protein, 9 aa, Homo Sapiens
CAHVAQCAQ

SEQ ID NO: 617954 - protein, 9 aa, Homo Sapiens
SLECIAEHV

SEQ ID NO: 617955 - protein, 9 aa, Homo Sapiens
AELTQQIFD

SEQ ID NO: 617956 - protein, 9 aa, Homo Sapiens
LIKHDEYNP

SEQ ID NO: 617957 - protein, 9 aa, Homo Sapiens
QLTSIHADV

SEQ ID NO: 617958 - protein, 9 aa, Homo Sapiens
PAASAPVTT

SEQ ID NO: 617959 - protein, 9 aa, Homo Sapiens
GEPPTKLQI

SEQ ID NO: 617960 - protein, 9 aa, Homo Sapiens
FLKFDTLNH

SEQ ID NO: 617961 - protein, 9 aa, Homo Sapiens
CCCFPCCMG

SEQ ID NO: 617962 - protein, 9 aa, Homo Sapiens
LFSLDLKLL

SEQ ID NO: 617963 - protein, 9 aa, Homo Sapiens
VHDLFNWLS

SEQ ID NO: 617964 - protein, 9 aa, Homo Sapiens
DVPVLVGDL

SEQ ID NO: 617965 - protein, 9 aa, Homo Sapiens
LECIAEHVD

SEQ ID NO: 617966 - protein, 9 aa, Homo Sapiens
GDPAHIGLC

SEQ ID NO: 617967 - protein, 9 aa, Homo Sapiens
MGNDEDACR

SEQ ID NO: 617968 - protein, 9 aa, Homo Sapiens
AASAPVTTD

SEQ ID NO: 617969 - protein, 9 aa, Homo Sapiens
PASSVNTGG

SEQ ID NO: 617970 - protein, 9 aa, Homo Sapiens
VATGPGFPS

SEQ ID NO: 617971 - protein, 9 aa, Homo Sapiens
ASVALPFTS

SEQ ID NO: 617972 - protein, 9 aa, Homo Sapiens
IGLQVHFLV

SEQ ID NO: 617973 - protein, 9 aa, Homo Sapiens
VSMWMAQTS

SEQ ID NO: 617974 - protein, 9 aa, Homo Sapiens
LCLYNLIVI

SEQ ID NO: 617975 - protein, 9 aa, Homo Sapiens
RKQRQTARL

SEQ ID NO: 617976 - protein, 9 aa, Homo Sapiens
YINRPPSGK

SEQ ID NO: 617977 - protein, 9 aa, Homo Sapiens
VGDSSQEFL

SEQ ID NO: 617978 - protein, 9 aa, Homo Sapiens
DPPDTNLLP

SEQ ID NO: 617979 - protein, 9 aa, Homo Sapiens
PPGTNPRLM

SEQ ID NO: 617980 - protein, 9 aa, Homo Sapiens
SGGCGTAKI

SEQ ID NO: 617981 - protein, 9 aa, Homo Sapiens
HCSIRCHCE

SEQ ID NO: 617982 - protein, 9 aa, Homo Sapiens
FTACSQRHF

SEQ ID NO: 617983 - protein, 9 aa, Homo Sapiens
LCWGRALYW

SEQ ID NO: 617984 - protein, 9 aa, Homo Sapiens
KFSTYGGRK

SEQ ID NO: 617985 - protein, 9 aa, Homo Sapiens
ATGEKTGMT

SEQ ID NO: 617986 - protein, 9 aa, Homo Sapiens
SYPGSDSCA

SEQ ID NO: 617987 - protein, 9 aa, Homo Sapiens
IYSHYIYWT

SEQ ID NO: 617988 - protein, 9 aa, Homo Sapiens
PQDRESVSA

SEQ ID NO: 617989 - protein, 9 aa, Homo Sapiens
AEDKTRVVS

SEQ ID NO: 617990 - protein, 9 aa, Homo Sapiens
IVEHVPVAD

SEQ ID NO: 617991 - protein, 9 aa, Homo Sapiens
IDPPDTNLL

SEQ ID NO: 617992 - protein, 9 aa, Homo Sapiens
SSQEFLPIQ

SEQ ID NO: 617993 - protein, 9 aa, Homo Sapiens
DDRPPACWV

SEQ ID NO: 617994 - protein, 9 aa, Homo Sapiens
WDQCFYNQE

SEQ ID NO: 617995 - protein, 9 aa, Homo Sapiens
VPAEAPRAG

SEQ ID NO: 617996 - protein, 9 aa, Homo Sapiens
GIAIHLEYF

SEQ ID NO: 617997 - protein, 9 aa, Homo Sapiens
NDVDLPGNP

SEQ ID NO: 617998 - protein, 9 aa, Homo Sapiens
KDLDGIRIA

SEQ ID NO: 617999 - protein, 9 aa, Homo Sapiens
NIPDQSQVE

SEQ ID NO: 618000 - protein, 9 aa, Homo Sapiens
NRHGHRQKY

SEQ ID NO: 618001 - protein, 9 aa, Homo Sapiens
FIILASQSS

SEQ ID NO: 618002 - protein, 9 aa, Homo Sapiens
LHFHVLDTL

SEQ ID NO: 618003 - protein, 9 aa, Homo Sapiens
LQAIFYQFR

SEQ ID NO: 618004 - protein, 9 aa, Homo Sapiens
SCCYSSALR

SEQ ID NO: 618005 - protein, 9 aa, Homo Sapiens
SAPVTTDPF

SEQ ID NO: 618006 - protein, 9 aa, Homo Sapiens
QQQPPDLVE

SEQ ID NO: 618007 - protein, 9 aa, Homo Sapiens
TMTDPYKFV

SEQ ID NO: 618008 - protein, 9 aa, Homo Sapiens
QALHAVAKY

SEQ ID NO: 618009 - protein, 9 aa, Homo Sapiens
RDYKTKPPK

SEQ ID NO: 618010 - protein, 9 aa, Homo Sapiens
PFDDKTSVF

SEQ ID NO: 618011 - protein, 9 aa, Homo Sapiens
GEVLHKFKL

SEQ ID NO: 618012 - protein, 9 aa, Homo Sapiens
VCIQQDILA

SEQ ID NO: 618013 - protein, 9 aa, Homo Sapiens
LSYRAKMLL

SEQ ID NO: 618014 - protein, 9 aa, Homo Sapiens
LGITSGGCG

SEQ ID NO: 618015 - protein, 9 aa, Homo Sapiens
LSNMERSRE

SEQ ID NO: 618016 - protein, 9 aa, Homo Sapiens
DLLQIIRRS

SEQ ID NO: 618017 - protein, 9 aa, Homo Sapiens
SFARKNRVW

SEQ ID NO: 618018 - protein, 9 aa, Homo Sapiens
PCPHTEAAK

SEQ ID NO: 618019 - protein, 9 aa, Homo Sapiens
AHEMGDNMG

SEQ ID NO: 618020 - protein, 9 aa, Homo Sapiens
MMQVGMETK

SEQ ID NO: 618021 - protein, 9 aa, Homo Sapiens
WVAIGSAYG

SEQ ID NO: 618022 - protein, 9 aa, Homo Sapiens
NPACHILAI

SEQ ID NO: 618023 - protein, 9 aa, Homo Sapiens
LHLCLWCFM

SEQ ID NO: 618024 - protein, 9 aa, Homo Sapiens
DESYKTGFK

SEQ ID NO: 618025 - protein, 9 aa, Homo Sapiens
SGSNVTASS

SEQ ID NO: 618026 - protein, 9 aa, Homo Sapiens
ACSQRHFEI

SEQ ID NO: 618027 - protein, 9 aa, Homo Sapiens
ERNPYTISS

SEQ ID NO: 618028 - protein, 9 aa, Homo Sapiens
EFLPIQEAQ

SEQ ID NO: 618029 - protein, 9 aa, Homo Sapiens
DQHTFGSKE

SEQ ID NO: 618030 - protein, 9 aa, Homo Sapiens
EAFWQCLHY

SEQ ID NO: 618031 - protein, 9 aa, Homo Sapiens
DTESIPCPH

SEQ ID NO: 618032 - protein, 9 aa, Homo Sapiens
GISVLSGSA

SEQ ID NO: 618033 - protein, 9 aa, Homo Sapiens
EISLSNMER

SEQ ID NO: 618034 - protein, 9 aa, Homo Sapiens
RVAEDKTRV

SEQ ID NO: 618035 - protein, 9 aa, Homo Sapiens
ELRVKNHYE

SEQ ID NO: 618036 - protein, 9 aa, Homo Sapiens
NRPIKDLDG

SEQ ID NO: 618037 - protein, 9 aa, Homo Sapiens
ECGKSCCYS

SEQ ID NO: 618038 - protein, 9 aa, Homo Sapiens
LLQIIRRSQ

SEQ ID NO: 618039 - protein, 9 aa, Homo Sapiens
MAVNKVDVS

SEQ ID NO: 618040 - protein, 9 aa, Homo Sapiens
VERMYRRIS

SEQ ID NO: 618041 - protein, 9 aa, Homo Sapiens
MLLRDAALM

SEQ ID NO: 618042 - protein, 9 aa, Homo Sapiens
CLEKTSRMI

SEQ ID NO: 618043 - protein, 9 aa, Homo Sapiens
PALQAQAQE

SEQ ID NO: 618044 - protein, 9 aa, Homo Sapiens
RCHCEDGGF

SEQ ID NO: 618045 - protein, 9 aa, Homo Sapiens
KRYLLRKQQ

SEQ ID NO: 618046 - protein, 9 aa, Homo Sapiens
AIFYQFRAR

SEQ ID NO: 618047 - protein, 9 aa, Homo Sapiens
WRRYSTRQT

SEQ ID NO: 618048 - protein, 9 aa, Homo Sapiens
IAIHLEYFL

SEQ ID NO: 618049 - protein, 9 aa, Homo Sapiens
VCERMDDWK

SEQ ID NO: 618050 - protein, 9 aa, Homo Sapiens
PHKCSLCHK

SEQ ID NO: 618051 - protein, 9 aa, Homo Sapiens
WGLGHDHHK

SEQ ID NO: 618052 - protein, 9 aa, Homo Sapiens
PDSTCHSAE

SEQ ID NO: 618053 - protein, 9 aa, Homo Sapiens
LSGNMWESS

SEQ ID NO: 618054 - protein, 9 aa, Homo Sapiens
LSESPLSEK

SEQ ID NO: 618055 - protein, 9 aa, Homo Sapiens
WVTPNIRST

SEQ ID NO: 618056 - protein, 9 aa, Homo Sapiens
SLVLDSPQD

SEQ ID NO: 618057 - protein, 9 aa, Homo Sapiens
RHFEISKFY

SEQ ID NO: 618058 - protein, 9 aa, Homo Sapiens
DYENGFGNS

SEQ ID NO: 618059 - protein, 9 aa, Homo Sapiens
IFDAKNMMA

SEQ ID NO: 618060 - protein, 9 aa, Homo Sapiens
YRAKMLLRD

SEQ ID NO: 618061 - protein, 9 aa, Homo Sapiens
GSDSGSTAK

SEQ ID NO: 618062 - protein, 9 aa, Homo Sapiens
QENSILLDA

SEQ ID NO: 618063 - protein, 9 aa, Homo Sapiens
RRLDNKTTN

SEQ ID NO: 618064 - protein, 9 aa, Homo Sapiens
DLEMVHYRI

SEQ ID NO: 618065 - protein, 9 aa, Homo Sapiens
SMAACPEAP

SEQ ID NO: 618066 - protein, 9 aa, Homo Sapiens
PTVPIPRGW

SEQ ID NO: 618067 - protein, 9 aa, Homo Sapiens
LTAVPSLSA

SEQ ID NO: 618068 - protein, 9 aa, Homo Sapiens
VGSRVSKEL

SEQ ID NO: 618069 - protein, 9 aa, Homo Sapiens
CSMNCKHLN

SEQ ID NO: 618070 - protein, 9 aa, Homo Sapiens
EADVSQLDP

SEQ ID NO: 618071 - protein, 9 aa, Homo Sapiens
TTSSPRRSP

SEQ ID NO: 618072 - protein, 9 aa, Homo Sapiens
PLLGASLGG

SEQ ID NO: 618073 - protein, 9 aa, Homo Sapiens
NQGQTASRA

SEQ ID NO: 618074 - protein, 9 aa, Homo Sapiens
ERERESLGG

SEQ ID NO: 618075 - protein, 9 aa, Homo Sapiens
PMPSLPWAW

SEQ ID NO: 618076 - protein, 9 aa, Homo Sapiens
RIHTVEKPY

SEQ ID NO: 618077 - protein, 9 aa, Homo Sapiens
LGGAGKHGE

SEQ ID NO: 618078 - protein, 9 aa, Homo Sapiens
EAEVYRITS

SEQ ID NO: 618079 - protein, 9 aa, Homo Sapiens
PPTTTTTSS

SEQ ID NO: 618080 - protein, 9 aa, Homo Sapiens
DSSRMFDGK

SEQ ID NO: 618081 - protein, 9 aa, Homo Sapiens
WATAGTRWD

SEQ ID NO: 618082 - protein, 9 aa, Homo Sapiens
TSWYFGVLQ

SEQ ID NO: 618083 - protein, 9 aa, Homo Sapiens
SQLVARIQK

SEQ ID NO: 618084 - protein, 9 aa, Homo Sapiens
AGTRWDSRK

SEQ ID NO: 618085 - protein, 9 aa, Homo Sapiens
RHSSILNPI

SEQ ID NO: 618086 - protein, 9 aa, Homo Sapiens
KLDAPFTQD

SEQ ID NO: 618087 - protein, 9 aa, Homo Sapiens
PNRLNKIRN

SEQ ID NO: 618088 - protein, 9 aa, Homo Sapiens
IQKSSYNYL

SEQ ID NO: 618089 - protein, 9 aa, Homo Sapiens
PITGDLEMV

SEQ ID NO: 618090 - protein, 9 aa, Homo Sapiens
EERERERES

SEQ ID NO: 618091 - protein, 9 aa, Homo Sapiens
IVSVLMDEK

SEQ ID NO: 618092 - protein, 9 aa, Homo Sapiens
MNCKHLNGT

SEQ ID NO: 618093 - protein, 9 aa, Homo Sapiens
EGILIFHRG

SEQ ID NO: 618094 - protein, 9 aa, Homo Sapiens
GSLFRNGSR

SEQ ID NO: 618095 - protein, 9 aa, Homo Sapiens
QNHVFPLLS

SEQ ID NO: 618096 - protein, 9 aa, Homo Sapiens
SGLLGYQHE

SEQ ID NO: 618097 - protein, 9 aa, Homo Sapiens
AFSAQAHPP

SEQ ID NO: 618098 - protein, 9 aa, Homo Sapiens
KYKKEISQH

SEQ ID NO: 618099 - protein, 9 aa, Homo Sapiens
CCLEMRTLV

SEQ ID NO: 618100 - protein, 9 aa, Homo Sapiens
CPGPGPSPG

SEQ ID NO: 618101 - protein, 9 aa, Homo Sapiens
RAVKEHMDR

SEQ ID NO: 618102 - protein, 9 aa, Homo Sapiens
QPACSAARG

SEQ ID NO: 618103 - protein, 9 aa, Homo Sapiens
NPAMRLILE

SEQ ID NO: 618104 - protein, 9 aa, Homo Sapiens
GLLGYQHEP

SEQ ID NO: 618105 - protein, 9 aa, Homo Sapiens
SMNHAYDIV

SEQ ID NO: 618106 - protein, 9 aa, Homo Sapiens
VQPSQGGKL

SEQ ID NO: 618107 - protein, 9 aa, Homo Sapiens
NHKRIHTVE

SEQ ID NO: 618108 - protein, 9 aa, Homo Sapiens
RDYLEKYYR

SEQ ID NO: 618109 - protein, 9 aa, Homo Sapiens
PALNRMFCQ

SEQ ID NO: 618110 - protein, 9 aa, Homo Sapiens
LRVLILNYN

SEQ ID NO: 618111 - protein, 9 aa, Homo Sapiens
GPGLPLSVP

SEQ ID NO: 618112 - protein, 9 aa, Homo Sapiens
SAFSAQAHP

SEQ ID NO: 618113 - protein, 9 aa, Homo Sapiens
RVHVPQGGR

SEQ ID NO: 618114 - protein, 9 aa, Homo Sapiens
QLTQKLGTA

SEQ ID NO: 618115 - protein, 9 aa, Homo Sapiens
SAVPMAESQ

SEQ ID NO: 618116 - protein, 9 aa, Homo Sapiens
RSEFNRKYG

SEQ ID NO: 618117 - protein, 9 aa, Homo Sapiens
QHSAADKHK

SEQ ID NO: 618118 - protein, 9 aa, Homo Sapiens
PRSLDSSRM

SEQ ID NO: 618119 - protein, 9 aa, Homo Sapiens
TPNRLNKIR

SEQ ID NO: 618120 - protein, 9 aa, Homo Sapiens
YCSMNCKHL

SEQ ID NO: 618121 - protein, 9 aa, Homo Sapiens
LDAPFTQDD

SEQ ID NO: 618122 - protein, 9 aa, Homo Sapiens
SLRDGSHLS

SEQ ID NO: 618123 - protein, 9 aa, Homo Sapiens
VTCKQLGCP

SEQ ID NO: 618124 - protein, 9 aa, Homo Sapiens
QDAMCCPGT

SEQ ID NO: 618125 - protein, 9 aa, Homo Sapiens
SSALSKPLP

SEQ ID NO: 618126 - protein, 9 aa, Homo Sapiens
TDCDTEGEN

SEQ ID NO: 618127 - protein, 9 aa, Homo Sapiens
KAIQVAKQF

SEQ ID NO: 618128 - protein, 9 aa, Homo Sapiens
SCNGWHFHP

SEQ ID NO: 618129 - protein, 9 aa, Homo Sapiens
EISMTRVLD

SEQ ID NO: 618130 - protein, 9 aa, Homo Sapiens
PCGSPTVPI

SEQ ID NO: 618131 - protein, 9 aa, Homo Sapiens
EAETNRRSF

SEQ ID NO: 618132 - protein, 9 aa, Homo Sapiens
SPTVPIPRG

SEQ ID NO: 618133 - protein, 9 aa, Homo Sapiens
PIIYFFMGS

SEQ ID NO: 618134 - protein, 9 aa, Homo Sapiens
RFFKAVNCQ

SEQ ID NO: 618135 - protein, 9 aa, Homo Sapiens
NLIKFNASH

SEQ ID NO: 618136 - protein, 9 aa, Homo Sapiens
PGLPLSVPP

SEQ ID NO: 618137 - protein, 9 aa, Homo Sapiens
GMMGSLFRN

SEQ ID NO: 618138 - protein, 9 aa, Homo Sapiens
MTRVLDEAD

SEQ ID NO: 618139 - protein, 9 aa, Homo Sapiens
RSSNCRSPA

SEQ ID NO: 618140 - protein, 9 aa, Homo Sapiens
HMLEDGQGR

SEQ ID NO: 618141 - protein, 9 aa, Homo Sapiens
MLKIRSEFN

SEQ ID NO: 618142 - protein, 9 aa, Homo Sapiens
GLGRNMCDR

SEQ ID NO: 618143 - protein, 9 aa, Homo Sapiens
SGGYLNIVK

SEQ ID NO: 618144 - protein, 9 aa, Homo Sapiens
HKRIHTVEK

SEQ ID NO: 618145 - protein, 9 aa, Homo Sapiens
TNRRSFRLD

SEQ ID NO: 618146 - protein, 9 aa, Homo Sapiens
RSKLISSAL

SEQ ID NO: 618147 - protein, 9 aa, Homo Sapiens
QLRPGPPGK

SEQ ID NO: 618148 - protein, 9 aa, Homo Sapiens
FLTVLACYP

SEQ ID NO: 618149 - protein, 9 aa, Homo Sapiens
YKGDRNESA

SEQ ID NO: 618150 - protein, 9 aa, Homo Sapiens
YFFMGSFRQ

SEQ ID NO: 618151 - protein, 9 aa, Homo Sapiens
FVICKKPLE

SEQ ID NO: 618152 - protein, 9 aa, Homo Sapiens
RMFCQLAKT

SEQ ID NO: 618153 - protein, 9 aa, Homo Sapiens
FTISALDSS

SEQ ID NO: 618154 - protein, 9 aa, Homo Sapiens
QILDKEMKL

SEQ ID NO: 618155 - protein, 9 aa, Homo Sapiens
SPGRSKLIS

SEQ ID NO: 618156 - protein, 9 aa, Homo Sapiens
WAWATAGTR

SEQ ID NO: 618157 - protein, 9 aa, Homo Sapiens
SYAMGRHKK

SEQ ID NO: 618158 - protein, 9 aa, Homo Sapiens
PPPDKAGSC

SEQ ID NO: 618159 - protein, 9 aa, Homo Sapiens
DKEMKLNVH

SEQ ID NO: 618160 - protein, 9 aa, Homo Sapiens
KELHYTKEK

SEQ ID NO: 618161 - protein, 9 aa, Homo Sapiens
LYCSMNCKH

SEQ ID NO: 618162 - protein, 9 aa, Homo Sapiens
NSHPPTTTT

SEQ ID NO: 618163 - protein, 9 aa, Homo Sapiens
VQADVSLSS

SEQ ID NO: 618164 - protein, 9 aa, Homo Sapiens
ANSSSEKTS

SEQ ID NO: 618165 - protein, 9 aa, Homo Sapiens
DRSSNCRSP

SEQ ID NO: 618166 - protein, 9 aa, Homo Sapiens
YNIPGISPV

SEQ ID NO: 618167 - protein, 9 aa, Homo Sapiens
GTRWDSRKW

SEQ ID NO: 618168 - protein, 9 aa, Homo Sapiens
RMFDGKAKE

SEQ ID NO: 618169 - protein, 9 aa, Homo Sapiens
LDSSRMFDG

SEQ ID NO: 618170 - protein, 9 aa, Homo Sapiens
LILNYNLIP

SEQ ID NO: 618171 - protein, 9 aa, Homo Sapiens
FLYVVGAQS

SEQ ID NO: 618172 - protein, 9 aa, Homo Sapiens
ILDKEMKLN

SEQ ID NO: 618173 - protein, 9 aa, Homo Sapiens
RDPKRVTIF

SEQ ID NO: 618174 - protein, 9 aa, Homo Sapiens
VPLDLNTSL

SEQ ID NO: 618175 - protein, 9 aa, Homo Sapiens
HLSASTVPL

SEQ ID NO: 618176 - protein, 9 aa, Homo Sapiens
DCDTEGENI

SEQ ID NO: 618177 - protein, 9 aa, Homo Sapiens
IHTVEKPYT

SEQ ID NO: 618178 - protein, 9 aa, Homo Sapiens
ILSQLVARI

SEQ ID NO: 618179 - protein, 9 aa, Homo Sapiens
VPQGGRKVV

SEQ ID NO: 618180 - protein, 9 aa, Homo Sapiens
AWTSWYFGV

SEQ ID NO: 618181 - protein, 9 aa, Homo Sapiens
ASAVPMAES

SEQ ID NO: 618182 - protein, 9 aa, Homo Sapiens
LSYAMGRHK

SEQ ID NO: 618183 - protein, 9 aa, Homo Sapiens
GLPLSVPPI

SEQ ID NO: 618184 - protein, 9 aa, Homo Sapiens
ESNNLIKFN

SEQ ID NO: 618185 - protein, 9 aa, Homo Sapiens
DTEGENIGF

SEQ ID NO: 618186 - protein, 9 aa, Homo Sapiens
VGAQSNYDT

SEQ ID NO: 618187 - protein, 9 aa, Homo Sapiens
MGSFRQRQN

SEQ ID NO: 618188 - protein, 9 aa, Homo Sapiens
STTSGTSAD

SEQ ID NO: 618189 - protein, 9 aa, Homo Sapiens
ILIFHRGKT

SEQ ID NO: 618190 - protein, 9 aa, Homo Sapiens
RGWCWSPMP

SEQ ID NO: 618191 - protein, 9 aa, Homo Sapiens
EVQQIMSNP

SEQ ID NO: 618192 - protein, 9 aa, Homo Sapiens
PIPRGWCWS

SEQ ID NO: 618193 - protein, 9 aa, Homo Sapiens
NPKVPLDLN

SEQ ID NO: 618194 - protein, 9 aa, Homo Sapiens
DLGTESVDA

SEQ ID NO: 618195 - protein, 9 aa, Homo Sapiens
RRRCQQDAM

SEQ ID NO: 618196 - protein, 9 aa, Homo Sapiens
CDTEGENIG

SEQ ID NO: 618197 - protein, 9 aa, Homo Sapiens
ERESLGGAG

SEQ ID NO: 618198 - protein, 9 aa, Homo Sapiens
VQLGACCLE

SEQ ID NO: 618199 - protein, 9 aa, Homo Sapiens
AARGGPFVN

SEQ ID NO: 618200 - protein, 9 aa, Homo Sapiens
MVHYRISKS

SEQ ID NO: 618201 - protein, 9 aa, Homo Sapiens
TAVPSLSAA

SEQ ID NO: 618202 - protein, 9 aa, Homo Sapiens
YEGRFHVQN

SEQ ID NO: 618203 - protein, 9 aa, Homo Sapiens
VLACYPNTL

SEQ ID NO: 618204 - protein, 9 aa, Homo Sapiens
GGYLNIVKL

SEQ ID NO: 618205 - protein, 9 aa, Homo Sapiens
ENVGAFGRD

SEQ ID NO: 618206 - protein, 9 aa, Homo Sapiens
QLQKIDKYE

SEQ ID NO: 618207 - protein, 9 aa, Homo Sapiens
HPPTTTTTS

SEQ ID NO: 618208 - protein, 9 aa, Homo Sapiens
KNPKVPLDL

SEQ ID NO: 618209 - protein, 9 aa, Homo Sapiens
NCQEGKLVA

SEQ ID NO: 618210 - protein, 9 aa, Homo Sapiens
TCDLFAPPS

SEQ ID NO: 618211 - protein, 9 aa, Homo Sapiens
MVTYKGDRN

SEQ ID NO: 618212 - protein, 9 aa, Homo Sapiens
GPSPCPGPG

SEQ ID NO: 618213 - protein, 9 aa, Homo Sapiens
SPSMASKLD

SEQ ID NO: 618214 - protein, 9 aa, Homo Sapiens
KYYRFGSRH

SEQ ID NO: 618215 - protein, 9 aa, Homo Sapiens
QSSSANSSS

SEQ ID NO: 618216 - protein, 9 aa, Homo Sapiens
SHFHDTLSQ

SEQ ID NO: 618217 - protein, 9 aa, Homo Sapiens
PPLLLLDVP

SEQ ID NO: 618218 - protein, 9 aa, Homo Sapiens
TVSLRDGSH

SEQ ID NO: 618219 - protein, 9 aa, Homo Sapiens
SISGLGSNK

SEQ ID NO: 618220 - protein, 9 aa, Homo Sapiens
SPLFSQHSA

SEQ ID NO: 618221 - protein, 9 aa, Homo Sapiens
KVAINILNS

SEQ ID NO: 618222 - protein, 9 aa, Homo Sapiens
GWCWSPMPS

SEQ ID NO: 618223 - protein, 9 aa, Homo Sapiens
VNAILPAMS

SEQ ID NO: 618224 - protein, 9 aa, Homo Sapiens
KHGEMSMSM

SEQ ID NO: 618225 - protein, 9 aa, Homo Sapiens
NADITITDS

SEQ ID NO: 618226 - protein, 9 aa, Homo Sapiens
FINRMEEEF

SEQ ID NO: 618227 - protein, 9 aa, Homo Sapiens
GKHGEMSMS

SEQ ID NO: 618228 - protein, 9 aa, Homo Sapiens
QDVARFINR

SEQ ID NO: 618229 - protein, 9 aa, Homo Sapiens
LGTESVDAE

SEQ ID NO: 618230 - protein, 9 aa, Homo Sapiens
GRRACLSDL

SEQ ID NO: 618231 - protein, 9 aa, Homo Sapiens
DDFVICKKP

SEQ ID NO: 618232 - protein, 9 aa, Homo Sapiens
MQPACSAAR

SEQ ID NO: 618233 - protein, 9 aa, Homo Sapiens
VFPLLSNLG

SEQ ID NO: 618234 - protein, 9 aa, Homo Sapiens
KLGTAFFQQ

SEQ ID NO: 618235 - protein, 9 aa, Homo Sapiens
TVPIPRGWC

SEQ ID NO: 618236 - protein, 9 aa, Homo Sapiens
ARFINRMEE

SEQ ID NO: 618237 - protein, 9 aa, Homo Sapiens
LEMVHYRIS

SEQ ID NO: 618238 - protein, 9 aa, Homo Sapiens
WTDCDTEGE

SEQ ID NO: 618239 - protein, 9 aa, Homo Sapiens
SSSEKTSSA

SEQ ID NO: 618240 - protein, 9 aa, Homo Sapiens
ASPLFSQHS

SEQ ID NO: 618241 - protein, 9 aa, Homo Sapiens
SMASKLDAP

SEQ ID NO: 618242 - protein, 9 aa, Homo Sapiens
ASLGGIIYL

SEQ ID NO: 618243 - protein, 9 aa, Homo Sapiens
SSEKTSSAK

SEQ ID NO: 618244 - protein, 9 aa, Homo Sapiens
PSLPWAWAT

SEQ ID NO: 618245 - protein, 9 aa, Homo Sapiens
THTNPPPCG

SEQ ID NO: 618246 - protein, 9 aa, Homo Sapiens
PPGPGLPLS

SEQ ID NO: 618247 - protein, 9 aa, Homo Sapiens
TAQTVAQQS

SEQ ID NO: 618248 - protein, 9 aa, Homo Sapiens
AARLYRHSS

SEQ ID NO: 618249 - protein, 9 aa, Homo Sapiens
IMSNPAMRL

SEQ ID NO: 618250 - protein, 9 aa, Homo Sapiens
PLLLLDVPT

SEQ ID NO: 618251 - protein, 9 aa, Homo Sapiens
SWYFGVLQR

SEQ ID NO: 618252 - protein, 9 aa, Homo Sapiens
DAPFTQDDT

SEQ ID NO: 618253 - protein, 9 aa, Homo Sapiens
APLLGASLG

SEQ ID NO: 618254 - protein, 9 aa, Homo Sapiens
EVGSRVSKE

SEQ ID NO: 618255 - protein, 9 aa, Homo Sapiens
SVAQLTQKL

SEQ ID NO: 618256 - protein, 9 aa, Homo Sapiens
MSMSMAACP

SEQ ID NO: 618257 - protein, 9 aa, Homo Sapiens
AVEGILIFH

SEQ ID NO: 618258 - protein, 9 aa, Homo Sapiens
HTNPPPCGS

SEQ ID NO: 618259 - protein, 9 aa, Homo Sapiens
DLNTSLKDC

SEQ ID NO: 618260 - protein, 9 aa, Homo Sapiens
FFMGSFRQR

SEQ ID NO: 618261 - protein, 9 aa, Homo Sapiens
SVLMDEKGS

SEQ ID NO: 618262 - protein, 9 aa, Homo Sapiens
ARGGTTIGE

SEQ ID NO: 618263 - protein, 9 aa, Homo Sapiens
PRPPGPGLP

SEQ ID NO: 618264 - protein, 9 aa, Homo Sapiens
ALNRMFCQL

SEQ ID NO: 618265 - protein, 9 aa, Homo Sapiens
PKVPLDLNT

SEQ ID NO: 618266 - protein, 9 aa, Homo Sapiens
GAGKHGEMS

SEQ ID NO: 618267 - protein, 9 aa, Homo Sapiens
NLSYAMGRH

SEQ ID NO: 618268 - protein, 9 aa, Homo Sapiens
GNFLYVVGA

SEQ ID NO: 618269 - protein, 9 aa, Homo Sapiens
ACCLEMRTL

SEQ ID NO: 618270 - protein, 9 aa, Homo Sapiens
TERVRTTLA

SEQ ID NO: 618271 - protein, 9 aa, Homo Sapiens
YYRFGSRHS

SEQ ID NO: 618272 - protein, 9 aa, Homo Sapiens
LDSSFTFWV

SEQ ID NO: 618273 - protein, 9 aa, Homo Sapiens
VAQLTQKLG

SEQ ID NO: 618274 - protein, 9 aa, Homo Sapiens
YKYKKEISQ

SEQ ID NO: 618275 - protein, 9 aa, Homo Sapiens
RLNKIRNWR

SEQ ID NO: 618276 - protein, 9 aa, Homo Sapiens
QHLLSTTSG

SEQ ID NO: 618277 - protein, 9 aa, Homo Sapiens
PFFGIVSVL

SEQ ID NO: 618278 - protein, 9 aa, Homo Sapiens
ERERERESL

SEQ ID NO: 618279 - protein, 9 aa, Homo Sapiens
RGGPFVNVS

SEQ ID NO: 618280 - protein, 9 aa, Homo Sapiens
ADITITDSI

SEQ ID NO: 618281 - protein, 9 aa, Homo Sapiens
EPIHMTNLG

SEQ ID NO: 618282 - protein, 9 aa, Homo Sapiens
QQENSILLD

SEQ ID NO: 618283 - protein, 9 aa, Homo Sapiens
TTTTTSSPR

SEQ ID NO: 618284 - protein, 9 aa, Homo Sapiens
SLFRNGSRQ

SEQ ID NO: 618285 - protein, 9 aa, Homo Sapiens
MGRHKKPNP

SEQ ID NO: 618286 - protein, 9 aa, Homo Sapiens
SLDSSRMFD

SEQ ID NO: 618287 - protein, 9 aa, Homo Sapiens
AVKEHMDRQ

SEQ ID NO: 618288 - protein, 9 aa, Homo Sapiens
YVVGAQSNY

SEQ ID NO: 618289 - protein, 9 aa, Homo Sapiens
KKPLELLGE

SEQ ID NO: 618290 - protein, 9 aa, Homo Sapiens
QIHILPELP

SEQ ID NO: 618291 - protein, 9 aa, Homo Sapiens
LQQENSILL

SEQ ID NO: 618292 - protein, 9 aa, Homo Sapiens
SILLDALNQ

SEQ ID NO: 618293 - protein, 9 aa, Homo Sapiens
CDLFAPPSP

SEQ ID NO: 618294 - protein, 9 aa, Homo Sapiens
SPVMMKLII

SEQ ID NO: 618295 - protein, 9 aa, Homo Sapiens
TYSPALNRM

SEQ ID NO: 618296 - protein, 9 aa, Homo Sapiens
CPPPDKAGS

SEQ ID NO: 618297 - protein, 9 aa, Homo Sapiens
ADVSQLDPL

SEQ ID NO: 618298 - protein, 9 aa, Homo Sapiens
AQQIHILPE

SEQ ID NO: 618299 - protein, 9 aa, Homo Sapiens
MSMAACPEA

SEQ ID NO: 618300 - protein, 9 aa, Homo Sapiens
KQEVGIDPL

SEQ ID NO: 618301 - protein, 9 aa, Homo Sapiens
ILNYNLIPM

SEQ ID NO: 618302 - protein, 9 aa, Homo Sapiens
LYVVGAQSN

SEQ ID NO: 618303 - protein, 9 aa, Homo Sapiens
TYKGDRNES

SEQ ID NO: 618304 - protein, 9 aa, Homo Sapiens
FNLSYAMGR

SEQ ID NO: 618305 - protein, 9 aa, Homo Sapiens
SSILNPINI

SEQ ID NO: 618306 - protein, 9 aa, Homo Sapiens
RGLRRRCQQ

SEQ ID NO: 618307 - protein, 9 aa, Homo Sapiens
GISPVMMKL

SEQ ID NO: 618308 - protein, 9 aa, Homo Sapiens
TRHPLQPEK

SEQ ID NO: 618309 - protein, 9 aa, Homo Sapiens
VAPLLGASL

SEQ ID NO: 618310 - protein, 9 aa, Homo Sapiens
DVSQLDPLL

SEQ ID NO: 618311 - protein, 9 aa, Homo Sapiens
RKVVSVQAA

SEQ ID NO: 618312 - protein, 9 aa, Homo Sapiens
RDGSHLSAS

SEQ ID NO: 618313 - protein, 9 aa, Homo Sapiens
WCWSPMPSL

SEQ ID NO: 618314 - protein, 9 aa, Homo Sapiens
ENSHPPTTT

SEQ ID NO: 618315 - protein, 9 aa, Homo Sapiens
YSLSHMVSN

SEQ ID NO: 618316 - protein, 9 aa, Homo Sapiens
VPSLSAASS

SEQ ID NO: 618317 - protein, 9 aa, Homo Sapiens
DSSFTFWVP

SEQ ID NO: 618318 - protein, 9 aa, Homo Sapiens
VPGRRACLS

SEQ ID NO: 618319 - protein, 9 aa, Homo Sapiens
DSLQKMSSR

SEQ ID NO: 618320 - protein, 9 aa, Homo Sapiens
GDLEMVHYR

SEQ ID NO: 618321 - protein, 9 aa, Homo Sapiens
IDKYEGRFH

SEQ ID NO: 618322 - protein, 9 aa, Homo Sapiens
ELTAVPSLS

SEQ ID NO: 618323 - protein, 9 aa, Homo Sapiens
MPSLPWAWA

SEQ ID NO: 618324 - protein, 9 aa, Homo Sapiens
KAGSCSHPG

SEQ ID NO: 618325 - protein, 9 aa, Homo Sapiens
TNSFNSHQL

SEQ ID NO: 618326 - protein, 9 aa, Homo Sapiens
VGAFGRDPK

SEQ ID NO: 618327 - protein, 9 aa, Homo Sapiens
IKFNASHKI

SEQ ID NO: 618328 - protein, 9 aa, Homo Sapiens
SYDAAVTCK

SEQ ID NO: 618329 - protein, 9 aa, Homo Sapiens
NGSRQTLFA

SEQ ID NO: 618330 - protein, 9 aa, Homo Sapiens
GAVQLGACC

SEQ ID NO: 618331 - protein, 9 aa, Homo Sapiens
PLYCSMNCK

SEQ ID NO: 618332 - protein, 9 aa, Homo Sapiens
YDAAVTCKQ

SEQ ID NO: 618333 - protein, 9 aa, Homo Sapiens
CLSDLTDLE

SEQ ID NO: 618334 - protein, 9 aa, Homo Sapiens
QCPPPDKAG

SEQ ID NO: 618335 - protein, 9 aa, Homo Sapiens
AVQLGACCL

SEQ ID NO: 618336 - protein, 9 aa, Homo Sapiens
DSRKWKWTV

SEQ ID NO: 618337 - protein, 9 aa, Homo Sapiens
LPWAWATAG

SEQ ID NO: 618338 - protein, 9 aa, Homo Sapiens
TVTQNGTYV

SEQ ID NO: 618339 - protein, 9 aa, Homo Sapiens
NLSMNHAYD

SEQ ID NO: 618340 - protein, 9 aa, Homo Sapiens
RIIIAVTSY

SEQ ID NO: 618341 - protein, 9 aa, Homo Sapiens
YSFRRLDNK

SEQ ID NO: 618342 - protein, 9 aa, Homo Sapiens
NSILLDALN

SEQ ID NO: 618343 - protein, 9 aa, Homo Sapiens
EICLSVHML

SEQ ID NO: 618344 - protein, 9 aa, Homo Sapiens
LSQSDDLIH

SEQ ID NO: 618345 - protein, 9 aa, Homo Sapiens
QGQMWHSFS

SEQ ID NO: 618346 - protein, 9 aa, Homo Sapiens
CEAEVYRIT

SEQ ID NO: 618347 - protein, 9 aa, Homo Sapiens
QAMVTYKGD

SEQ ID NO: 618348 - protein, 9 aa, Homo Sapiens
HMVSNIELP

SEQ ID NO: 618349 - protein, 9 aa, Homo Sapiens
SLQEAETNR

SEQ ID NO: 618350 - protein, 9 aa, Homo Sapiens
SSRMFDGKA

SEQ ID NO: 618351 - protein, 9 aa, Homo Sapiens
GEICLSVHM

SEQ ID NO: 618352 - protein, 9 aa, Homo Sapiens
FSLQEAETN

SEQ ID NO: 618353 - protein, 9 aa, Homo Sapiens
QFNLSYAMG

SEQ ID NO: 618354 - protein, 9 aa, Homo Sapiens
TGEISMTRV

SEQ ID NO: 618355 - protein, 9 aa, Homo Sapiens
LRYSTTTTL

SEQ ID NO: 618356 - protein, 9 aa, Homo Sapiens
HQHLLSTTS

SEQ ID NO: 618357 - protein, 9 aa, Homo Sapiens
LFSQHSAAD

SEQ ID NO: 618358 - protein, 9 aa, Homo Sapiens
AGKHGEMSM

SEQ ID NO: 618359 - protein, 9 aa, Homo Sapiens
FFLGLDSIL

SEQ ID NO: 618360 - protein, 9 aa, Homo Sapiens
TCKQLGCPT

SEQ ID NO: 618361 - protein, 9 aa, Homo Sapiens
SQHSAADKH

SEQ ID NO: 618362 - protein, 9 aa, Homo Sapiens
YRFGSRHSA

SEQ ID NO: 618363 - protein, 9 aa, Homo Sapiens
CGSPTVPIP

SEQ ID NO: 618364 - protein, 9 aa, Homo Sapiens
VSAPKVQAD

SEQ ID NO: 618365 - protein, 9 aa, Homo Sapiens
AESQWFKEE

SEQ ID NO: 618366 - protein, 9 aa, Homo Sapiens
AASSGGYLN

SEQ ID NO: 618367 - protein, 9 aa, Homo Sapiens
AVNCQEGKL

SEQ ID NO: 618368 - protein, 9 aa, Homo Sapiens
AQLTQKLGT

SEQ ID NO: 618369 - protein, 9 aa, Homo Sapiens
VQAMVTYKG

SEQ ID NO: 618370 - protein, 9 aa, Homo Sapiens
LSHMVSNIE

SEQ ID NO: 618371 - protein, 9 aa, Homo Sapiens
QADVSLSSM

SEQ ID NO: 618372 - protein, 9 aa, Homo Sapiens
GASLGGIIY

SEQ ID NO: 618373 - protein, 9 aa, Homo Sapiens
LGYQHEPIH

SEQ ID NO: 618374 - protein, 9 aa, Homo Sapiens
SHLSASTVP

SEQ ID NO: 618375 - protein, 9 aa, Homo Sapiens
SRVSKELHY

SEQ ID NO: 618376 - protein, 9 aa, Homo Sapiens
SANSSSEKT

SEQ ID NO: 618377 - protein, 9 aa, Homo Sapiens
NSFNSHQLR

SEQ ID NO: 618378 - protein, 9 aa, Homo Sapiens
PEVQQIMSN

SEQ ID NO: 618379 - protein, 9 aa, Homo Sapiens
NHRDEEEET

SEQ ID NO: 618380 - protein, 9 aa, Homo Sapiens
QTVAQQSAA

SEQ ID NO: 618381 - protein, 9 aa, Homo Sapiens
FGNHRDEEE

SEQ ID NO: 618382 - protein, 9 aa, Homo Sapiens
PPPCGSPTV

SEQ ID NO: 618383 - protein, 9 aa, Homo Sapiens
AEVYRITSA

SEQ ID NO: 618384 - protein, 9 aa, Homo Sapiens
RNQGQTASR

SEQ ID NO: 618385 - protein, 9 aa, Homo Sapiens
MSSRLVCDN

SEQ ID NO: 618386 - protein, 9 aa, Homo Sapiens
LNRMFCQLA

SEQ ID NO: 618387 - protein, 9 aa, Homo Sapiens
ESLGGAGKH

SEQ ID NO: 618388 - protein, 9 aa, Homo Sapiens
TASRARGGA

SEQ ID NO: 618389 - protein, 9 aa, Homo Sapiens
YKKEISQHN

SEQ ID NO: 618390 - protein, 9 aa, Homo Sapiens
RSPALRARG

SEQ ID NO: 618391 - protein, 9 aa, Homo Sapiens
SMNCKHLNG

SEQ ID NO: 618392 - protein, 9 aa, Homo Sapiens
SLGGIIYLV

SEQ ID NO: 618393 - protein, 9 aa, Homo Sapiens
TTTTLASWV

SEQ ID NO: 618394 - protein, 9 aa, Homo Sapiens
EKTPNRLNK

SEQ ID NO: 618395 - protein, 9 aa, Homo Sapiens
AMGRHKKPN

SEQ ID NO: 618396 - protein, 9 aa, Homo Sapiens
LQEAETNRR

SEQ ID NO: 618397 - protein, 9 aa, Homo Sapiens
AAVTCKQLG

SEQ ID NO: 618398 - protein, 9 aa, Homo Sapiens
FVPGRRACL

SEQ ID NO: 618399 - protein, 9 aa, Homo Sapiens
NFLYVVGAQ

SEQ ID NO: 618400 - protein, 9 aa, Homo Sapiens
SSANSSSEK

SEQ ID NO: 618401 - protein, 9 aa, Homo Sapiens
PRNQGQTAS

SEQ ID NO: 618402 - protein, 9 aa, Homo Sapiens
QQDAMCCPG

SEQ ID NO: 618403 - protein, 9 aa, Homo Sapiens
LQKIDKYEG

SEQ ID NO: 618404 - protein, 9 aa, Homo Sapiens
QTASRARGG

SEQ ID NO: 618405 - protein, 9 aa, Homo Sapiens
QMWHSFSAG

SEQ ID NO: 618406 - protein, 9 aa, Homo Sapiens
DGFKVAINI

SEQ ID NO: 618407 - protein, 9 aa, Homo Sapiens
KAVNCQEGK

SEQ ID NO: 618408 - protein, 9 aa, Homo Sapiens
FKAVNCQEG

SEQ ID NO: 618409 - protein, 9 aa, Homo Sapiens
KSQGGVQPS

SEQ ID NO: 618410 - protein, 9 aa, Homo Sapiens
QQLVQILDK

SEQ ID NO: 618411 - protein, 9 aa, Homo Sapiens
KTVTQNGTY

SEQ ID NO: 618412 - protein, 9 aa, Homo Sapiens
QQIMSNPAM

SEQ ID NO: 618413 - protein, 9 aa, Homo Sapiens
TTLAVLKRI

SEQ ID NO: 618414 - protein, 9 aa, Homo Sapiens
SLGGAGKHG

SEQ ID NO: 618415 - protein, 9 aa, Homo Sapiens
TGDRSSNCR

SEQ ID NO: 618416 - protein, 9 aa, Homo Sapiens
LRRRCQQDA

SEQ ID NO: 618417 - protein, 9 aa, Homo Sapiens
VGDGFKVAI

SEQ ID NO: 618418 - protein, 9 aa, Homo Sapiens
MNHAYDIVK

SEQ ID NO: 618419 - protein, 9 aa, Homo Sapiens
TAGTRWDSR

SEQ ID NO: 618420 - protein, 9 aa, Homo Sapiens
PEKQEVGID

SEQ ID NO: 618421 - protein, 9 aa, Homo Sapiens
KAWTSWYFG

SEQ ID NO: 618422 - protein, 9 aa, Homo Sapiens
GILIFHRGK

SEQ ID NO: 618423 - protein, 9 aa, Homo Sapiens
LNIVKLLLL

SEQ ID NO: 618424 - protein, 9 aa, Homo Sapiens
IRSEFNRKY

SEQ ID NO: 618425 - protein, 9 aa, Homo Sapiens
KIDKYEGRF

SEQ ID NO: 618426 - protein, 9 aa, Homo Sapiens
LSTTSGTSA

SEQ ID NO: 618427 - protein, 9 aa, Homo Sapiens
GGVQPSQGG

SEQ ID NO: 618428 - protein, 9 aa, Homo Sapiens
QGGVQPSQG

SEQ ID NO: 618429 - protein, 9 aa, Homo Sapiens
TNPPPCGSP

SEQ ID NO: 618430 - protein, 9 aa, Homo Sapiens
WDSYDAAVT

SEQ ID NO: 618431 - protein, 9 aa, Homo Sapiens
DSISGLGSN

SEQ ID NO: 618432 - protein, 9 aa, Homo Sapiens
HSHFHDTLS

SEQ ID NO: 618433 - protein, 9 aa, Homo Sapiens
GQFNLSYAM

SEQ ID NO: 618434 - protein, 9 aa, Homo Sapiens
SEFNRKYGK

SEQ ID NO: 618435 - protein, 9 aa, Homo Sapiens
LLSTTSGTS

SEQ ID NO: 618436 - protein, 9 aa, Homo Sapiens
GTQCPPPDK

SEQ ID NO: 618437 - protein, 9 aa, Homo Sapiens
GSHLSASTV

SEQ ID NO: 618438 - protein, 9 aa, Homo Sapiens
AMSRCFELN

SEQ ID NO: 618439 - protein, 9 aa, Homo Sapiens
AILPAMSRC

SEQ ID NO: 618440 - protein, 9 aa, Homo Sapiens
KVQADVSLS

SEQ ID NO: 618441 - protein, 9 aa, Homo Sapiens
ADGTHTNPP

SEQ ID NO: 618442 - protein, 9 aa, Homo Sapiens
IRIIIAVTS

SEQ ID NO: 618443 - protein, 9 aa, Homo Sapiens
RFINRMEEE

SEQ ID NO: 618444 - protein, 9 aa, Homo Sapiens
SQWFKEETR

SEQ ID NO: 618445 - protein, 9 aa, Homo Sapiens
FGIVSVLMD

SEQ ID NO: 618446 - protein, 9 aa, Homo Sapiens
AWATAGTRW

SEQ ID NO: 618447 - protein, 9 aa, Homo Sapiens
RHPLQPEKQ

SEQ ID NO: 618448 - protein, 9 aa, Homo Sapiens
LIFHRGKTT

SEQ ID NO: 618449 - protein, 9 aa, Homo Sapiens
YEYKYKKEI

SEQ ID NO: 618450 - protein, 9 aa, Homo Sapiens
RQLQKIDKY

SEQ ID NO: 618451 - protein, 9 aa, Homo Sapiens
DGSHLSAST

SEQ ID NO: 618452 - protein, 9 aa, Homo Sapiens
DSYDAAVTC

SEQ ID NO: 618453 - protein, 9 aa, Homo Sapiens
ERVKAWTSW

SEQ ID NO: 618454 - protein, 9 aa, Homo Sapiens
EMSMSMAAC

SEQ ID NO: 618455 - protein, 9 aa, Homo Sapiens
GYLNIVKLL

SEQ ID NO: 618456 - protein, 9 aa, Homo Sapiens
SQGGVQPSQ

SEQ ID NO: 618457 - protein, 9 aa, Homo Sapiens
RSLDSSRMF

SEQ ID NO: 618458 - protein, 9 aa, Homo Sapiens
IIIAVTSYK

SEQ ID NO: 618459 - protein, 9 aa, Homo Sapiens
SPALRARGG

SEQ ID NO: 618460 - protein, 9 aa, Homo Sapiens
AMVTYKGDR

SEQ ID NO: 618461 - protein, 9 aa, Homo Sapiens
HMDRQCAQV

SEQ ID NO: 618462 - protein, 9 aa, Homo Sapiens
LLSAFSAQA

SEQ ID NO: 618463 - protein, 9 aa, Homo Sapiens
FPLLSNLGY

SEQ ID NO: 618464 - protein, 9 aa, Homo Sapiens
PGISPVMMK

SEQ ID NO: 618465 - protein, 9 aa, Homo Sapiens
MMGSLFRNG

SEQ ID NO: 618466 - protein, 9 aa, Homo Sapiens
GLRRRCQQD

SEQ ID NO: 618467 - protein, 9 aa, Homo Sapiens
GFKVAINIL

SEQ ID NO: 618468 - protein, 9 aa, Homo Sapiens
YAMGRHKKP

SEQ ID NO: 618469 - protein, 9 aa, Homo Sapiens
HTVEKPYTC

SEQ ID NO: 618470 - protein, 9 aa, Homo Sapiens
QLVQILDKE

SEQ ID NO: 618471 - protein, 9 aa, Homo Sapiens
LNYNLIPML

SEQ ID NO: 618472 - protein, 9 aa, Homo Sapiens
MSRCFELNT

SEQ ID NO: 618473 - protein, 9 aa, Homo Sapiens
PDKAGSCSH

SEQ ID NO: 618474 - protein, 9 aa, Homo Sapiens
TLAVLKRIV

SEQ ID NO: 618475 - protein, 9 aa, Homo Sapiens
PRGWCWSPM

SEQ ID NO: 618476 - protein, 9 aa, Homo Sapiens
QHEPIHMTN

SEQ ID NO: 618477 - protein, 9 aa, Homo Sapiens
FFKAVNCQE

SEQ ID NO: 618478 - protein, 9 aa, Homo Sapiens
VEGILIFHR

SEQ ID NO: 618479 - protein, 9 aa, Homo Sapiens
LNLLLSAFS

SEQ ID NO: 618480 - protein, 9 aa, Homo Sapiens
GGTTIGEVT

SEQ ID NO: 618481 - protein, 9 aa, Homo Sapiens
GSCNGWHFH

SEQ ID NO: 618482 - protein, 9 aa, Homo Sapiens
RVLILNYNL

SEQ ID NO: 618483 - protein, 9 aa, Homo Sapiens
EKQEVGIDP

SEQ ID NO: 618484 - protein, 9 aa, Homo Sapiens
SPCPGPGPS

SEQ ID NO: 618485 - protein, 9 aa, Homo Sapiens
AFGRDPKRV

SEQ ID NO: 618486 - protein, 9 aa, Homo Sapiens
FRNGSRQTL

SEQ ID NO: 618487 - protein, 9 aa, Homo Sapiens
PLFSQHSAA

SEQ ID NO: 618488 - protein, 9 aa, Homo Sapiens
VKAWTSWYF

SEQ ID NO: 618489 - protein, 9 aa, Homo Sapiens
QIMSNPAMR

SEQ ID NO: 618490 - protein, 9 aa, Homo Sapiens
RYSTTTTLA

SEQ ID NO: 618491 - protein, 9 aa, Homo Sapiens
TSFLTVLAC

SEQ ID NO: 618492 - protein, 9 aa, Homo Sapiens
LYTGEISMT

SEQ ID NO: 618493 - protein, 9 aa, Homo Sapiens
QKLGTAFFQ

SEQ ID NO: 618494 - protein, 9 aa, Homo Sapiens
RRSPALRAR

SEQ ID NO: 618495 - protein, 9 aa, Homo Sapiens
ESQWFKEET

SEQ ID NO: 618496 - protein, 9 aa, Homo Sapiens
FRRLDNKTT

SEQ ID NO: 618497 - protein, 9 aa, Homo Sapiens
SSGGYLNIV

SEQ ID NO: 618498 - protein, 9 aa, Homo Sapiens
FMGSFRQRQ

SEQ ID NO: 618499 - protein, 9 aa, Homo Sapiens
DNKTTNVSL

SEQ ID NO: 618500 - protein, 9 aa, Homo Sapiens
EEKHEETKA

SEQ ID NO: 618501 - protein, 9 aa, Homo Sapiens
LKLLRYSTT

SEQ ID NO: 618502 - protein, 9 aa, Homo Sapiens
VDVSAPKVQ

SEQ ID NO: 618503 - protein, 9 aa, Homo Sapiens
VKEHMDRQC

SEQ ID NO: 618504 - protein, 9 aa, Homo Sapiens
VYEYKYKKE

SEQ ID NO: 618505 - protein, 9 aa, Homo Sapiens
WTSWYFGVL

SEQ ID NO: 618506 - protein, 9 aa, Homo Sapiens
QEGKLVAKR

SEQ ID NO: 618507 - protein, 9 aa, Homo Sapiens
PNRDLGTES

SEQ ID NO: 618508 - protein, 9 aa, Homo Sapiens
EQPCEAEVY

SEQ ID NO: 618509 - protein, 9 aa, Homo Sapiens
MWHSFSAGP

SEQ ID NO: 618510 - protein, 9 aa, Homo Sapiens
HFHDTLSQS

SEQ ID NO: 618511 - protein, 9 aa, Homo Sapiens
SSNCRSPAD

SEQ ID NO: 618512 - protein, 9 aa, Homo Sapiens
APKVQADVS

SEQ ID NO: 618513 - protein, 9 aa, Homo Sapiens
PTTTTTSSP

SEQ ID NO: 618514 - protein, 9 aa, Homo Sapiens
GQMWHSFSA

SEQ ID NO: 618515 - protein, 9 aa, Homo Sapiens
HFHPPPRGI

SEQ ID NO: 618516 - protein, 9 aa, Homo Sapiens
LEKTPNRLN

SEQ ID NO: 618517 - protein, 9 aa, Homo Sapiens
SAARGGPFV

SEQ ID NO: 618518 - protein, 9 aa, Homo Sapiens
QGEICLSVH

SEQ ID NO: 618519 - protein, 9 aa, Homo Sapiens
QQSAATLLL

SEQ ID NO: 618520 - protein, 9 aa, Homo Sapiens
CKHLNGTIT

SEQ ID NO: 618521 - protein, 9 aa, Homo Sapiens
LACYPNTLL

SEQ ID NO: 618522 - protein, 9 aa, Homo Sapiens
HVPQGGRKV

SEQ ID NO: 618523 - protein, 9 aa, Homo Sapiens
FFNTLTEYI

SEQ ID NO: 618524 - protein, 9 aa, Homo Sapiens
WSPMPSLPW

SEQ ID NO: 618525 - protein, 9 aa, Homo Sapiens
LSAASSHVV

SEQ ID NO: 618526 - protein, 9 aa, Homo Sapiens
FNSHQLRPG

SEQ ID NO: 618527 - protein, 9 aa, Homo Sapiens
PSPCPGPGP

SEQ ID NO: 618528 - protein, 9 aa, Homo Sapiens
GRSKLISSA

SEQ ID NO: 618529 - protein, 9 aa, Homo Sapiens
AIQVAKQFF

SEQ ID NO: 618530 - protein, 9 aa, Homo Sapiens
LIKFNASHK

SEQ ID NO: 618531 - protein, 9 aa, Homo Sapiens
SLPWAWATA

SEQ ID NO: 618532 - protein, 9 aa, Homo Sapiens
ICLSVHMLE

SEQ ID NO: 618533 - protein, 9 aa, Homo Sapiens
SMSMAACPE

SEQ ID NO: 618534 - protein, 9 aa, Homo Sapiens
FKVAINILN

SEQ ID NO: 618535 - protein, 9 aa, Homo Sapiens
WDSRKWKWT

SEQ ID NO: 618536 - protein, 9 aa, Homo Sapiens
VQILDKEMK

SEQ ID NO: 618537 - protein, 9 aa, Homo Sapiens
VAKQFFNTL

SEQ ID NO: 618538 - protein, 9 aa, Homo Sapiens
GTYVASVPT

SEQ ID NO: 618539 - protein, 9 aa, Homo Sapiens
GGAGKHGEM

SEQ ID NO: 618540 - protein, 9 aa, Homo Sapiens
HDTLSQSDD

SEQ ID NO: 618541 - protein, 9 aa, Homo Sapiens
VPMAESQWF

SEQ ID NO: 618542 - protein, 9 aa, Homo Sapiens
QVAKQFFNT

SEQ ID NO: 618543 - protein, 9 aa, Homo Sapiens
AVPSLSAAS

SEQ ID NO: 618544 - protein, 9 aa, Homo Sapiens
KFNASHKIE

SEQ ID NO: 618545 - protein, 9 aa, Homo Sapiens
TSSPRRSPA

SEQ ID NO: 618546 - protein, 9 aa, Homo Sapiens
VAQQSAATL

SEQ ID NO: 618547 - protein, 9 aa, Homo Sapiens
VLILNYNLI

SEQ ID NO: 618548 - protein, 9 aa, Homo Sapiens
STTTTLASW

SEQ ID NO: 618549 - protein, 9 aa, Homo Sapiens
QVYEYKYKK

SEQ ID NO: 618550 - protein, 9 aa, Homo Sapiens
AQQSAATLL

SEQ ID NO: 618551 - protein, 9 aa, Homo Sapiens
SSSANSSSE

SEQ ID NO: 618552 - protein, 9 aa, Homo Sapiens
WYFGVLQRS

SEQ ID NO: 618553 - protein, 9 aa, Homo Sapiens
PLQPEKQEV

SEQ ID NO: 618554 - protein, 9 aa, Homo Sapiens
GNHRDEEEE

SEQ ID NO: 618555 - protein, 9 aa, Homo Sapiens
SLCHRNSNC

SEQ ID NO: 618556 - protein, 9 aa, Homo Sapiens
RFGSRHSAE

SEQ ID NO: 618557 - protein, 9 aa, Homo Sapiens
KGDRNESAV

SEQ ID NO: 618558 - protein, 9 aa, Homo Sapiens
EQSIFGNHR

SEQ ID NO: 618559 - protein, 9 aa, Homo Sapiens
GLDSILCLC

SEQ ID NO: 618560 - protein, 9 aa, Homo Sapiens
ATAGTRWDS

SEQ ID NO: 618561 - protein, 9 aa, Homo Sapiens
ACLSDLTDL

SEQ ID NO: 618562 - protein, 9 aa, Homo Sapiens
SFLTVLACY

SEQ ID NO: 618563 - protein, 9 aa, Homo Sapiens
HPPPRGITS

SEQ ID NO: 618564 - protein, 9 aa, Homo Sapiens
SPRRSPALR

SEQ ID NO: 618565 - protein, 9 aa, Homo Sapiens
KEQSIFGNH

SEQ ID NO: 618566 - protein, 9 aa, Homo Sapiens
AKQFFNTLT

SEQ ID NO: 618567 - protein, 9 aa, Homo Sapiens
DAVEGILIF

SEQ ID NO: 618568 - protein, 9 aa, Homo Sapiens
ASKLDAPFT

SEQ ID NO: 618569 - protein, 9 aa, Homo Sapiens
YRHSSILNP

SEQ ID NO: 618570 - protein, 9 aa, Homo Sapiens
SAPKVQADV

SEQ ID NO: 618571 - protein, 9 aa, Homo Sapiens
KRIHTVEKP

SEQ ID NO: 618572 - protein, 9 aa, Homo Sapiens
NHAYDIVKM

SEQ ID NO: 618573 - protein, 9 aa, Homo Sapiens
EYKYKKEIS

SEQ ID NO: 618574 - protein, 9 aa, Homo Sapiens
HGEMSMSMA

SEQ ID NO: 618575 - protein, 9 aa, Homo Sapiens
NPIIYFFMG

SEQ ID NO: 618576 - protein, 9 aa, Homo Sapiens
LDKEMKLNV

SEQ ID NO: 618577 - protein, 9 aa, Homo Sapiens
HILPELPDI

SEQ ID NO: 618578 - protein, 9 aa, Homo Sapiens
CAQQIHILP

SEQ ID NO: 618579 - protein, 9 aa, Homo Sapiens
YSTTTTLAS

SEQ ID NO: 618580 - protein, 9 aa, Homo Sapiens
MDQGQMWHS

SEQ ID NO: 618581 - protein, 9 aa, Homo Sapiens
SHMVSNIEL

SEQ ID NO: 618582 - protein, 9 aa, Homo Sapiens
LDLNTSLKD

SEQ ID NO: 618583 - protein, 9 aa, Homo Sapiens
IIYFFMGSF

SEQ ID NO: 618584 - protein, 9 aa, Homo Sapiens
NPPPCGSPT

SEQ ID NO: 618585 - protein, 9 aa, Homo Sapiens
LVQAMVTYK

SEQ ID NO: 618586 - protein, 9 aa, Homo Sapiens
VICKKPLEL

SEQ ID NO: 618587 - protein, 9 aa, Homo Sapiens
DFVICKKPL

SEQ ID NO: 618588 - protein, 9 aa, Homo Sapiens
LSQLVARIQ

SEQ ID NO: 618589 - protein, 9 aa, Homo Sapiens
NRKYGKSLY

SEQ ID NO: 618590 - protein, 9 aa, Homo Sapiens
LRDGSHLSA

SEQ ID NO: 618591 - protein, 9 aa, Homo Sapiens
VDTEIEEKH

SEQ ID NO: 618592 - protein, 9 aa, Homo Sapiens
CLSVHMLED

SEQ ID NO: 618593 - protein, 9 aa, Homo Sapiens
YLEKYYRFG

SEQ ID NO: 618594 - protein, 9 aa, Homo Sapiens
GACCLEMRT

SEQ ID NO: 618595 - protein, 9 aa, Homo Sapiens
CQEGKLVAK

SEQ ID NO: 618596 - protein, 9 aa, Homo Sapiens
RVKAWTSWY

SEQ ID NO: 618597 - protein, 9 aa, Homo Sapiens
TLSQSDDLI

SEQ ID NO: 618598 - protein, 9 aa, Homo Sapiens
QGGRKVVSV

SEQ ID NO: 618599 - protein, 9 aa, Homo Sapiens
LLDALNQAT

SEQ ID NO: 618600 - protein, 9 aa, Homo Sapiens
TYVASVPTA

SEQ ID NO: 618601 - protein, 9 aa, Homo Sapiens
DQGQMWHSF

SEQ ID NO: 618602 - protein, 9 aa, Homo Sapiens
MFDGKAKEP

SEQ ID NO: 618603 - protein, 9 aa, Homo Sapiens
SKLISSALS

SEQ ID NO: 618604 - protein, 9 aa, Homo Sapiens
NCKHLNGTI

SEQ ID NO: 618605 - protein, 9 aa, Homo Sapiens
SLQKMSSRL

SEQ ID NO: 618606 - protein, 9 aa, Homo Sapiens
GGRKVVSVQ

SEQ ID NO: 618607 - protein, 9 aa, Homo Sapiens
GLYTGEISM

SEQ ID NO: 618608 - protein, 9 aa, Homo Sapiens
RCQQDAMCC

SEQ ID NO: 618609 - protein, 9 aa, Homo Sapiens
AQSNYDTKG

SEQ ID NO: 618610 - protein, 9 aa, Homo Sapiens
NHVFPLLSN

SEQ ID NO: 618611 - protein, 9 aa, Homo Sapiens
NAILPAMSR

SEQ ID NO: 618612 - protein, 9 aa, Homo Sapiens
SIFGNHRDE

SEQ ID NO: 618613 - protein, 9 aa, Homo Sapiens
SPMPSLPWA

SEQ ID NO: 618614 - protein, 9 aa, Homo Sapiens
KKEISQHNI

SEQ ID NO: 618615 - protein, 9 aa, Homo Sapiens
SSYSLSHMV

SEQ ID NO: 618616 - protein, 9 aa, Homo Sapiens
QLDPLLTLE

SEQ ID NO: 618617 - protein, 9 aa, Homo Sapiens
AETNRRSFR

SEQ ID NO: 618618 - protein, 9 aa, Homo Sapiens
DKYEGRFHV

SEQ ID NO: 618619 - protein, 9 aa, Homo Sapiens
RNGSRQTLF

SEQ ID NO: 618620 - protein, 9 aa, Homo Sapiens
NIPGISPVM

SEQ ID NO: 618621 - protein, 9 aa, Homo Sapiens
TEGENIGFE

SEQ ID NO: 618622 - protein, 9 aa, Homo Sapiens
NSHQLRPGP

SEQ ID NO: 618623 - protein, 9 aa, Homo Sapiens
PVMMKLIIE

SEQ ID NO: 618624 - protein, 9 aa, Homo Sapiens
ILPAMSRCF

SEQ ID NO: 618625 - protein, 9 aa, Homo Sapiens
CQQDAMCCP

SEQ ID NO: 618626 - protein, 9 aa, Homo Sapiens
VRTTLAVLK

SEQ ID NO: 618627 - protein, 9 aa, Homo Sapiens
PGRRACLSD

SEQ ID NO: 618628 - protein, 9 aa, Homo Sapiens
TISALDSSF

SEQ ID NO: 618629 - protein, 9 aa, Homo Sapiens
RWDSRKWKW

SEQ ID NO: 618630 - protein, 9 aa, Homo Sapiens
GRNMCDRCS

SEQ ID NO: 618631 - protein, 9 aa, Homo Sapiens
TVEKPYTCE

SEQ ID NO: 618632 - protein, 9 aa, Homo Sapiens
QPEKQEVGI

SEQ ID NO: 618633 - protein, 9 aa, Homo Sapiens
KLRVLILNY

SEQ ID NO: 618634 - protein, 9 aa, Homo Sapiens
KLLRYSTTT

SEQ ID NO: 618635 - protein, 9 aa, Homo Sapiens
LSAFSAQAH

SEQ ID NO: 618636 - protein, 9 aa, Homo Sapiens
MRPFFGIVS

SEQ ID NO: 618637 - protein, 9 aa, Homo Sapiens
SLSAASSHV

SEQ ID NO: 618638 - protein, 9 aa, Homo Sapiens
KMSSRLVCD

SEQ ID NO: 618639 - protein, 9 aa, Homo Sapiens
LRPGPPGKA

SEQ ID NO: 618640 - protein, 9 aa, Homo Sapiens
VYRITSAAA

SEQ ID NO: 618641 - protein, 9 aa, Homo Sapiens
IYFFMGSFR

SEQ ID NO: 618642 - protein, 9 aa, Homo Sapiens
KLNLSMNHA

SEQ ID NO: 618643 - protein, 9 aa, Homo Sapiens
TRWDSRKWK

SEQ ID NO: 618644 - protein, 9 aa, Homo Sapiens
AVTCKQLGC

SEQ ID NO: 618645 - protein, 9 aa, Homo Sapiens
DYLEKYYRF

SEQ ID NO: 618646 - protein, 9 aa, Homo Sapiens
IILQSRIRI

SEQ ID NO: 618647 - protein, 9 aa, Homo Sapiens
VAINILNSG

SEQ ID NO: 618648 - protein, 9 aa, Homo Sapiens
ILQSRIRII

SEQ ID NO: 618649 - protein, 9 aa, Homo Sapiens
PVHQHLLST

SEQ ID NO: 618650 - protein, 9 aa, Homo Sapiens
GTTIGEVTS

SEQ ID NO: 618651 - protein, 9 aa, Homo Sapiens
RARGGTTIG

SEQ ID NO: 618652 - protein, 9 aa, Homo Sapiens
QSAATLLLT

SEQ ID NO: 618653 - protein, 9 aa, Homo Sapiens
PALRARGGT

SEQ ID NO: 618654 - protein, 9 aa, Homo Sapiens
NKIRNWRAN

SEQ ID NO: 618655 - protein, 9 aa, Homo Sapiens
GSPTVPIPR

SEQ ID NO: 618656 - protein, 9 aa, Homo Sapiens
SLKLLRYST

SEQ ID NO: 618657 - protein, 9 aa, Homo Sapiens
VNCQEGKLV

SEQ ID NO: 618658 - protein, 9 aa, Homo Sapiens
KQFFNTLTE

SEQ ID NO: 618659 - protein, 9 aa, Homo Sapiens
ISMTRVLDE

SEQ ID NO: 618660 - protein, 9 aa, Homo Sapiens
LKIRSEFNR

SEQ ID NO: 618661 - protein, 9 aa, Homo Sapiens
VARFINRME

SEQ ID NO: 618662 - protein, 9 aa, Homo Sapiens
CWSPMPSLP

SEQ ID NO: 618663 - protein, 9 aa, Homo Sapiens
LKEQSIFGN

SEQ ID NO: 618664 - protein, 9 aa, Homo Sapiens
ARGGPFVNV

SEQ ID NO: 618665 - protein, 9 aa, Homo Sapiens
GQTASRARG

SEQ ID NO: 618666 - protein, 9 aa, Homo Sapiens
LFRNGSRQT

SEQ ID NO: 618667 - protein, 9 aa, Homo Sapiens
ITITDSISG

SEQ ID NO: 618668 - protein, 9 aa, Homo Sapiens
DTLSQSDDL

SEQ ID NO: 618669 - protein, 9 aa, Homo Sapiens
VMMKLIIEY

SEQ ID NO: 618670 - protein, 9 aa, Homo Sapiens
SLSHMVSNI

SEQ ID NO: 618671 - protein, 9 aa, Homo Sapiens
RERESLGGA

SEQ ID NO: 618672 - protein, 9 aa, Homo Sapiens
IEEKHEETK

SEQ ID NO: 618673 - protein, 9 aa, Homo Sapiens
VIWTDCDTE

SEQ ID NO: 618674 - protein, 9 aa, Homo Sapiens
HEPIHMTNL

SEQ ID NO: 618675 - protein, 9 aa, Homo Sapiens
LYRHSSILN

SEQ ID NO: 618676 - protein, 9 aa, Homo Sapiens
DTEIEEKHE

SEQ ID NO: 618677 - protein, 9 aa, Homo Sapiens
ISALDSSFT

SEQ ID NO: 618678 - protein, 9 aa, Homo Sapiens
ESDDFVICK

SEQ ID NO: 618679 - protein, 9 aa, Homo Sapiens
NIVKLLLLH

SEQ ID NO: 618680 - protein, 9 aa, Homo Sapiens
KEHMDRQCA

SEQ ID NO: 618681 - protein, 9 aa, Homo Sapiens
GWHFHPPPR

SEQ ID NO: 618682 - protein, 9 aa, Homo Sapiens
NRLNKIRNW

SEQ ID NO: 618683 - protein, 9 aa, Homo Sapiens
LQPEKQEVG

SEQ ID NO: 618684 - protein, 9 aa, Homo Sapiens
ASRARGGAP

SEQ ID NO: 618685 - protein, 9 aa, Homo Sapiens
NRMEEEFNY

SEQ ID NO: 618686 - protein, 9 aa, Homo Sapiens
FCAQQIHIL

SEQ ID NO: 618687 - protein, 9 aa, Homo Sapiens
LPRPPGPGL

SEQ ID NO: 618688 - protein, 9 aa, Homo Sapiens
PPDKAGSCS

SEQ ID NO: 618689 - protein, 9 aa, Homo Sapiens
SPALNRMFC

SEQ ID NO: 618690 - protein, 9 aa, Homo Sapiens
SSRLVCDNT

SEQ ID NO: 618691 - protein, 9 aa, Homo Sapiens
LEQPCEAEV

SEQ ID NO: 618692 - protein, 9 aa, Homo Sapiens
DVSAPKVQA

SEQ ID NO: 618693 - protein, 9 aa, Homo Sapiens
PGRSKLISS

SEQ ID NO: 618694 - protein, 9 aa, Homo Sapiens
GSRVSKELH

SEQ ID NO: 618695 - protein, 9 aa, Homo Sapiens
SAADKHKLQ

SEQ ID NO: 618696 - protein, 9 aa, Homo Sapiens
IFGNHRDEE

SEQ ID NO: 618697 - protein, 9 aa, Homo Sapiens
QLGACCLEM

SEQ ID NO: 618698 - protein, 9 aa, Homo Sapiens
AVPMAESQW

SEQ ID NO: 618699 - protein, 9 aa, Homo Sapiens
AQTVAQQSA

SEQ ID NO: 618700 - protein, 9 aa, Homo Sapiens
ISSALSKPL

SEQ ID NO: 618701 - protein, 9 aa, Homo Sapiens
SKELHYTKE

SEQ ID NO: 618702 - protein, 9 aa, Homo Sapiens
SYSLSHMVS

SEQ ID NO: 618703 - protein, 9 aa, Homo Sapiens
ILPELPDIL

SEQ ID NO: 618704 - protein, 9 aa, Homo Sapiens
GIVSVLMDE

SEQ ID NO: 618705 - protein, 9 aa, Homo Sapiens
QFFNTLTEY

SEQ ID NO: 618706 - protein, 9 aa, Homo Sapiens
KEMKLNVHM

SEQ ID NO: 618707 - protein, 9 aa, Homo Sapiens
TDSISGLGS

SEQ ID NO: 618708 - protein, 9 aa, Homo Sapiens
KYEGRFHVQ

SEQ ID NO: 618709 - protein, 9 aa, Homo Sapiens
YQHEPIHMT

SEQ ID NO: 618710 - protein, 9 aa, Homo Sapiens
LTQKLGTAF

SEQ ID NO: 618711 - protein, 9 aa, Homo Sapiens
HLLSTTSGT

SEQ ID NO: 618712 - protein, 9 aa, Homo Sapiens
MAESQWFKE

SEQ ID NO: 618713 - protein, 9 aa, Homo Sapiens
MENSHPPTT

SEQ ID NO: 618714 - protein, 9 aa, Homo Sapiens
GEMSMSMAA

SEQ ID NO: 618715 - protein, 9 aa, Homo Sapiens
LGACCLEMR

SEQ ID NO: 618716 - protein, 9 aa, Homo Sapiens
ARIQKSSYN

SEQ ID NO: 618717 - protein, 9 aa, Homo Sapiens
FSAQAHPPK

SEQ ID NO: 618718 - protein, 9 aa, Homo Sapiens
GAQSNYDTK

SEQ ID NO: 618719 - protein, 9 aa, Homo Sapiens
ALDSSFTFW

SEQ ID NO: 618720 - protein, 9 aa, Homo Sapiens
HEETKAFEA

SEQ ID NO: 618721 - protein, 9 aa, Homo Sapiens
HVFPLLSNL

SEQ ID NO: 618722 - protein, 9 aa, Homo Sapiens
VSQLDPLLT

SEQ ID NO: 618723 - protein, 9 aa, Homo Sapiens
ANHKRIHTV

SEQ ID NO: 618724 - protein, 9 aa, Homo Sapiens
RERERESLG

SEQ ID NO: 618725 - protein, 9 aa, Homo Sapiens
LSVHMLEDG

SEQ ID NO: 618726 - protein, 9 aa, Homo Sapiens
LPELPDILK

SEQ ID NO: 618727 - protein, 9 aa, Homo Sapiens
LRARGGTTI

SEQ ID NO: 618728 - protein, 9 aa, Homo Sapiens
DVARFINRM

SEQ ID NO: 618729 - protein, 9 aa, Homo Sapiens
RPPGPGLPL

SEQ ID NO: 618730 - protein, 9 aa, Homo Sapiens
KDSLQKMSS

SEQ ID NO: 618731 - protein, 9 aa, Homo Sapiens
AVLKRIVTS

SEQ ID NO: 618732 - protein, 9 aa, Homo Sapiens
QNGTYVASV

SEQ ID NO: 618733 - protein, 9 aa, Homo Sapiens
SDDFVICKK

SEQ ID NO: 618734 - protein, 9 aa, Homo Sapiens
VPIPRGWCW

SEQ ID NO: 618735 - protein, 9 aa, Homo Sapiens
GKAFNRIHR

SEQ ID NO: 618736 - protein, 9 aa, Homo Sapiens
GEISMTRVL

SEQ ID NO: 618737 - protein, 9 aa, Homo Sapiens
CKKPLELLG

SEQ ID NO: 618738 - protein, 9 aa, Homo Sapiens
ERVRTTLAV

SEQ ID NO: 618739 - protein, 9 aa, Homo Sapiens
TPLYCSMNC

SEQ ID NO: 618740 - protein, 9 aa, Homo Sapiens
FGRDPKRVT

SEQ ID NO: 618741 - protein, 9 aa, Homo Sapiens
VHMLEDGQG

SEQ ID NO: 618742 - protein, 9 aa, Homo Sapiens
KSSYSLSHM

SEQ ID NO: 618743 - protein, 9 aa, Homo Sapiens
PCEAEVYRI

SEQ ID NO: 618744 - protein, 9 aa, Homo Sapiens
ITDSISGLG

SEQ ID NO: 618745 - protein, 9 aa, Homo Sapiens
NYNLIPMLP

SEQ ID NO: 618746 - protein, 9 aa, Homo Sapiens
EFNRKYGKS

SEQ ID NO: 618747 - protein, 9 aa, Homo Sapiens
VSLRDGSHL

SEQ ID NO: 618748 - protein, 9 aa, Homo Sapiens
VSKELHYTK

SEQ ID NO: 618749 - protein, 9 aa, Homo Sapiens
LLGASLGGI

SEQ ID NO: 618750 - protein, 9 aa, Homo Sapiens
CSAARGGPF

SEQ ID NO: 618751 - protein, 9 aa, Homo Sapiens
FSQHSAADK

SEQ ID NO: 618752 - protein, 9 aa, Homo Sapiens
INILNSGRF

SEQ ID NO: 618753 - protein, 9 aa, Homo Sapiens
KEISQHNIN

SEQ ID NO: 618754 - protein, 9 aa, Homo Sapiens
DTCDLFAPP

SEQ ID NO: 618755 - protein, 9 aa, Homo Sapiens
QSIFGNHRD

SEQ ID NO: 618756 - protein, 9 aa, Homo Sapiens
FHRGKTTLE

SEQ ID NO: 618757 - protein, 9 aa, Homo Sapiens
NKTTNVSLY

SEQ ID NO: 618758 - protein, 9 aa, Homo Sapiens
DHPNRDLGT

SEQ ID NO: 618759 - protein, 9 aa, Homo Sapiens
NGTYVASVP

SEQ ID NO: 618760 - protein, 9 aa, Homo Sapiens
LPAMSRCFE

SEQ ID NO: 618761 - protein, 9 aa, Homo Sapiens
RRACLSDLT

SEQ ID NO: 618762 - protein, 9 aa, Homo Sapiens
DKAGSCSHP

SEQ ID NO: 618763 - protein, 9 aa, Homo Sapiens
RSPADFWEI

SEQ ID NO: 618764 - protein, 9 aa, Homo Sapiens
RTTLAVLKR

SEQ ID NO: 618765 - protein, 9 aa, Homo Sapiens
QKLNLSMNH

SEQ ID NO: 618766 - protein, 9 aa, Homo Sapiens
SNPAMRLIL

SEQ ID NO: 618767 - protein, 9 aa, Homo Sapiens
QLVARIQKS

SEQ ID NO: 618768 - protein, 9 aa, Homo Sapiens
SSPRRSPAL

SEQ ID NO: 618769 - protein, 9 aa, Homo Sapiens
DPLLTLENI

SEQ ID NO: 618770 - protein, 9 aa, Homo Sapiens
PRRSPALRA

SEQ ID NO: 618771 - protein, 9 aa, Homo Sapiens
RLDNKTTNV

SEQ ID NO: 618772 - protein, 9 aa, Homo Sapiens
VEKPYTCEE

SEQ ID NO: 618773 - protein, 9 aa, Homo Sapiens
YTGEISMTR

SEQ ID NO: 618774 - protein, 9 aa, Homo Sapiens
VQQIMSNPA

SEQ ID NO: 618775 - protein, 9 aa, Homo Sapiens
LISSALSKP

SEQ ID NO: 618776 - protein, 9 aa, Homo Sapiens
PAMSRCFEL

SEQ ID NO: 618777 - protein, 9 aa, Homo Sapiens
CNGWHFHPP

SEQ ID NO: 618778 - protein, 9 aa, Homo Sapiens
SRIRIIIAV

SEQ ID NO: 618779 - protein, 9 aa, Homo Sapiens
LTVLACYPN

SEQ ID NO: 618780 - protein, 9 aa, Homo Sapiens
HSAADKHKL

SEQ ID NO: 618781 - protein, 9 aa, Homo Sapiens
KHEETKAFE

SEQ ID NO: 618782 - protein, 9 aa, Homo Sapiens
RVRTTLAVL

SEQ ID NO: 618783 - protein, 9 aa, Homo Sapiens
HLMDQGQMW

SEQ ID NO: 618784 - protein, 9 aa, Homo Sapiens
HPLQPEKQE

SEQ ID NO: 618785 - protein, 9 aa, Homo Sapiens
TTTSSPRRS

SEQ ID NO: 618786 - protein, 9 aa, Homo Sapiens
LDPLLTLEN

SEQ ID NO: 618787 - protein, 9 aa, Homo Sapiens
NRRSFRLDP

SEQ ID NO: 618788 - protein, 9 aa, Homo Sapiens
LGRNMCDRC

SEQ ID NO: 618789 - protein, 9 aa, Homo Sapiens
IWTDCDTEG

SEQ ID NO: 618790 - protein, 9 aa, Homo Sapiens
LEKYYRFGS

SEQ ID NO: 618791 - protein, 9 aa, Homo Sapiens
QPCEAEVYR

SEQ ID NO: 618792 - protein, 9 aa, Homo Sapiens
SFVPGRRAC

SEQ ID NO: 618793 - protein, 9 aa, Homo Sapiens
CYPNTLLRT

SEQ ID NO: 618794 - protein, 9 aa, Homo Sapiens
SHPPTTTTT

SEQ ID NO: 618795 - protein, 9 aa, Homo Sapiens
LDALNQATS

SEQ ID NO: 618796 - protein, 9 aa, Homo Sapiens
DITITDSIS

SEQ ID NO: 618797 - protein, 9 aa, Homo Sapiens
ASVAQLTQK

SEQ ID NO: 618798 - protein, 9 aa, Homo Sapiens
IPRGWCWSP

SEQ ID NO: 618799 - protein, 9 aa, Homo Sapiens
INRMEEEFN

SEQ ID NO: 618800 - protein, 9 aa, Homo Sapiens
NLLLSAFSA

SEQ ID NO: 618801 - protein, 9 aa, Homo Sapiens
QGQTASRAR

SEQ ID NO: 618802 - protein, 9 aa, Homo Sapiens
RPFFGIVSV

SEQ ID NO: 618803 - protein, 9 aa, Homo Sapiens
LMDQGQMWH

SEQ ID NO: 618804 - protein, 9 aa, Homo Sapiens
SNNLIKFNA

SEQ ID NO: 618805 - protein, 9 aa, Homo Sapiens
RIRIIIAVT

SEQ ID NO: 618806 - protein, 9 aa, Homo Sapiens
RESLGGAGK

SEQ ID NO: 618807 - protein, 9 aa, Homo Sapiens
RACLSDLTD

SEQ ID NO: 618808 - protein, 9 aa, Homo Sapiens
SHQLRPGPP

SEQ ID NO: 618809 - protein, 9 aa, Homo Sapiens
LLRYSTTTT

SEQ ID NO: 618810 - protein, 9 aa, Homo Sapiens
NNLIKFNAS

SEQ ID NO: 618811 - protein, 9 aa, Homo Sapiens
KVPLDLNTS

SEQ ID NO: 618812 - protein, 9 aa, Homo Sapiens
MGSLFRNGS

SEQ ID NO: 618813 - protein, 9 aa, Homo Sapiens
VVGAQSNYD

SEQ ID NO: 618814 - protein, 9 aa, Homo Sapiens
PGPGLPLSV

SEQ ID NO: 618815 - protein, 9 aa, Homo Sapiens
ETNRRSFRL

SEQ ID NO: 618816 - protein, 9 aa, Homo Sapiens
LLGYQHEPI

SEQ ID NO: 618817 - protein, 9 aa, Homo Sapiens
PLLSNLGYL

SEQ ID NO: 618818 - protein, 9 aa, Homo Sapiens
TQKLGTAFF

SEQ ID NO: 618819 - protein, 9 aa, Homo Sapiens
VARIQKSSY

SEQ ID NO: 618820 - protein, 9 aa, Homo Sapiens
IHILPELPD

SEQ ID NO: 618821 - protein, 9 aa, Homo Sapiens
GVQPSQGGK

SEQ ID NO: 618822 - protein, 9 aa, Homo Sapiens
FHDTLSQSD

SEQ ID NO: 618823 - protein, 9 aa, Homo Sapiens
LQKMSSRLV

SEQ ID NO: 618824 - protein, 9 aa, Homo Sapiens
TQCPPPDKA

SEQ ID NO: 618825 - protein, 9 aa, Homo Sapiens
FKSSYSLSH

SEQ ID NO: 618826 - protein, 9 aa, Homo Sapiens
PSMASKLDA

SEQ ID NO: 618827 - protein, 9 aa, Homo Sapiens
FNASHKIEV

SEQ ID NO: 618828 - protein, 9 aa, Homo Sapiens
SALDSSFTF

SEQ ID NO: 618829 - protein, 9 aa, Homo Sapiens
ASSGGYLNI

SEQ ID NO: 618830 - protein, 9 aa, Homo Sapiens
DGTHTNPPP

SEQ ID NO: 618831 - protein, 9 aa, Homo Sapiens
LVIWTDCDT

SEQ ID NO: 618832 - protein, 9 aa, Homo Sapiens
GRKVVSVQA

SEQ ID NO: 618833 - protein, 9 aa, Homo Sapiens
IPGISPVMM

SEQ ID NO: 618834 - protein, 9 aa, Homo Sapiens
HPNRDLGTE

SEQ ID NO: 618835 - protein, 9 aa, Homo Sapiens
LAVLKRIVT

SEQ ID NO: 618836 - protein, 9 aa, Homo Sapiens
LFAPPSPGD

SEQ ID NO: 618837 - protein, 9 aa, Homo Sapiens
LDNKTTNVS

SEQ ID NO: 618838 - protein, 9 aa, Homo Sapiens
PQGGRKVVS

SEQ ID NO: 618839 - protein, 9 aa, Homo Sapiens
NPITGDLEM

SEQ ID NO: 618840 - protein, 9 aa, Homo Sapiens
LGLDSILCL

SEQ ID NO: 618841 - protein, 9 aa, Homo Sapiens
WHFHPPPRG

SEQ ID NO: 618842 - protein, 9 aa, Homo Sapiens
KLISSALSK

SEQ ID NO: 618843 - protein, 9 aa, Homo Sapiens
LPLSVPPIL

SEQ ID NO: 618844 - protein, 9 aa, Homo Sapiens
EENVGAFGR

SEQ ID NO: 618845 - protein, 9 aa, Homo Sapiens
EMVHYRISK

SEQ ID NO: 618846 - protein, 9 aa, Homo Sapiens
NMCDRCSTA

SEQ ID NO: 618847 - protein, 9 aa, Homo Sapiens
RIQKSSYNY

SEQ ID NO: 618848 - protein, 9 aa, Homo Sapiens
SRMFDGKAK

SEQ ID NO: 618849 - protein, 9 aa, Homo Sapiens
KIRSEFNRK

SEQ ID NO: 618850 - protein, 9 aa, Homo Sapiens
PPCGSPTVP

SEQ ID NO: 618851 - protein, 9 aa, Homo Sapiens
PKVQADVSL

SEQ ID NO: 618852 - protein, 9 aa, Homo Sapiens
DAAVTCKQL

SEQ ID NO: 618853 - protein, 9 aa, Homo Sapiens
GTESVDAEE

SEQ ID NO: 618854 - protein, 9 aa, Homo Sapiens
LGASLGGII

SEQ ID NO: 618855 - protein, 9 aa, Homo Sapiens
TESVDAEEV

SEQ ID NO: 618856 - protein, 9 aa, Homo Sapiens
EVYRITSAA

SEQ ID NO: 618857 - protein, 9 aa, Homo Sapiens
EKYYRFGSR

SEQ ID NO: 618858 - protein, 9 aa, Homo Sapiens
ACYPNTLLR

SEQ ID NO: 618859 - protein, 9 aa, Homo Sapiens
LNLSMNHAY

SEQ ID NO: 618860 - protein, 9 aa, Homo Sapiens
VTQNGTYVA

SEQ ID NO: 618861 - protein, 9 aa, Homo Sapiens
ILLDALNQA

SEQ ID NO: 618862 - protein, 9 aa, Homo Sapiens
ALRARGGTT

SEQ ID NO: 618863 - protein, 9 aa, Homo Sapiens
TVLACYPNT

SEQ ID NO: 618864 - protein, 9 aa, Homo Sapiens
EEGLGRNMC

SEQ ID NO: 618865 - protein, 9 aa, Homo Sapiens
RRCQQDAMC

SEQ ID NO: 618866 - protein, 9 aa, Homo Sapiens
LPPLLLLDV

SEQ ID NO: 618867 - protein, 9 aa, Homo Sapiens
SNCRSPADF

SEQ ID NO: 618868 - protein, 9 aa, Homo Sapiens
MSNPAMRLI

SEQ ID NO: 618869 - protein, 9 aa, Homo Sapiens
PLDLNTSLK

SEQ ID NO: 618870 - protein, 9 aa, Homo Sapiens
FNRKYGKSL

SEQ ID NO: 618871 - protein, 9 aa, Homo Sapiens
QPSQGGKLE

SEQ ID NO: 618872 - protein, 9 aa, Homo Sapiens
PCPGPGPSP

SEQ ID NO: 618873 - protein, 9 aa, Homo Sapiens
ISPVMMKLI

SEQ ID NO: 618874 - protein, 9 aa, Homo Sapiens
VVAPLLGAS

SEQ ID NO: 618875 - protein, 9 aa, Homo Sapiens
SAATLLLTL

SEQ ID NO: 618876 - protein, 9 aa, Homo Sapiens
CLEMRTLVE

SEQ ID NO: 618877 - protein, 9 aa, Homo Sapiens
QEAETNRRS

SEQ ID NO: 618878 - protein, 9 aa, Homo Sapiens
VTYKGDRNE

SEQ ID NO: 618879 - protein, 9 aa, Homo Sapiens
NVGAFGRDP

SEQ ID NO: 618880 - protein, 9 aa, Homo Sapiens
QVNAILPAM

SEQ ID NO: 618881 - protein, 9 aa, Homo Sapiens
GFTISALDS

SEQ ID NO: 618882 - protein, 9 aa, Homo Sapiens
VEVGSRVSK

SEQ ID NO: 618883 - protein, 9 aa, Homo Sapiens
ITGDLEMVH

SEQ ID NO: 618884 - protein, 9 aa, Homo Sapiens
HSSILNPIN

SEQ ID NO: 618885 - protein, 9 aa, Homo Sapiens
IPVHQHLLS

SEQ ID NO: 618886 - protein, 9 aa, Homo Sapiens
FFGIVSVLM

SEQ ID NO: 618887 - protein, 9 aa, Homo Sapiens
LNKIRNWRA

SEQ ID NO: 618888 - protein, 9 aa, Homo Sapiens
RNMCDRCST

SEQ ID NO: 618889 - protein, 9 aa, Homo Sapiens
VSVLMDEKG

SEQ ID NO: 618890 - protein, 9 aa, Homo Sapiens
GTHTNPPPC

SEQ ID NO: 618891 - protein, 9 aa, Homo Sapiens
DLFAPPSPG

SEQ ID NO: 618892 - protein, 9 aa, Homo Sapiens
GAFGRDPKR

SEQ ID NO: 618893 - protein, 9 aa, Homo Sapiens
ICKKPLELL

SEQ ID NO: 618894 - protein, 9 aa, Homo Sapiens
SAASSHVVS

SEQ ID NO: 618895 - protein, 9 aa, Homo Sapiens
PACSAARGG

SEQ ID NO: 618896 - protein, 9 aa, Homo Sapiens
RMEEEFNYP

SEQ ID NO: 618897 - protein, 9 aa, Homo Sapiens
PMAESQWFK

SEQ ID NO: 618898 - protein, 9 aa, Homo Sapiens
PSLSAASSH

SEQ ID NO: 618899 - protein, 9 aa, Homo Sapiens
AHTRAVKEH

SEQ ID NO: 618900 - protein, 9 aa, Homo Sapiens
QKIDKYEGR

SEQ ID NO: 618901 - protein, 9 aa, Homo Sapiens
ARLYRHSSI

SEQ ID NO: 618902 - protein, 9 aa, Homo Sapiens
YLNIVKLLL

SEQ ID NO: 618903 - protein, 9 aa, Homo Sapiens
LVARIQKSS

SEQ ID NO: 618904 - protein, 9 aa, Homo Sapiens
TQNGTYVAS

SEQ ID NO: 618905 - protein, 9 aa, Homo Sapiens
IFHRGKTTL

SEQ ID NO: 618906 - protein, 9 aa, Homo Sapiens
QSRIRIIIA

SEQ ID NO: 618907 - protein, 9 aa, Homo Sapiens
TTTTSSPRR

SEQ ID NO: 618908 - protein, 9 aa, Homo Sapiens
HQLRPGPPG

SEQ ID NO: 618909 - protein, 9 aa, Homo Sapiens
TRAVKEHMD

SEQ ID NO: 618910 - protein, 9 aa, Homo Sapiens
TGDLEMVHY

SEQ ID NO: 618911 - protein, 9 aa, Homo Sapiens
MASKLDAPF

SEQ ID NO: 618912 - protein, 9 aa, Homo Sapiens
RGGTTIGEV

SEQ ID NO: 618913 - protein, 9 aa, Homo Sapiens
TEIEEKHEE

SEQ ID NO: 618914 - protein, 9 aa, Homo Sapiens
HTRAVKEHM

SEQ ID NO: 618915 - protein, 9 aa, Homo Sapiens
AINILNSGR

SEQ ID NO: 618916 - protein, 9 aa, Homo Sapiens
TVAQQSAAT

SEQ ID NO: 618917 - protein, 9 aa, Homo Sapiens
LSMNHAYDI

SEQ ID NO: 618918 - protein, 9 aa, Homo Sapiens
NSSSEKTSS

SEQ ID NO: 618919 - protein, 9 aa, Homo Sapiens
MCDRCSTAI

SEQ ID NO: 618920 - protein, 9 aa, Homo Sapiens
PEADVSQLD

SEQ ID NO: 618921 - protein, 9 aa, Homo Sapiens
ACSAARGGP

SEQ ID NO: 618922 - protein, 9 aa, Homo Sapiens
CGKAFNRIH

SEQ ID NO: 618923 - protein, 9 aa, Homo Sapiens
VHVPQGGRK

SEQ ID NO: 618924 - protein, 9 aa, Homo Sapiens
NRDLGTESV

SEQ ID NO: 618925 - protein, 9 aa, Homo Sapiens
RDLGTESVD

SEQ ID NO: 618926 - protein, 9 aa, Homo Sapiens
LQSRIRIII

SEQ ID NO: 618927 - protein, 9 aa, Homo Sapiens
EGLGRNMCD

SEQ ID NO: 618928 - protein, 9 aa, Homo Sapiens
IQVAKQFFN

SEQ ID NO: 618929 - protein, 9 aa, Homo Sapiens
FHPPPRGIT

SEQ ID NO: 618930 - protein, 9 aa, Homo Sapiens
SFRRLDNKT

SEQ ID NO: 618931 - protein, 9 aa, Homo Sapiens
QQIHILPEL

SEQ ID NO: 618932 - protein, 9 aa, Homo Sapiens
CTYSPALNR

SEQ ID NO: 618933 - protein, 9 aa, Homo Sapiens
PQSSSANSS

SEQ ID NO: 618934 - protein, 9 aa, Homo Sapiens
NGWHFHPPP

SEQ ID NO: 618935 - protein, 9 aa, Homo Sapiens
IGFTISALD

SEQ ID NO: 618936 - protein, 9 aa, Homo Sapiens
NRMFCQLAK

SEQ ID NO: 618937 - protein, 9 aa, Homo Sapiens
EIEEKHEET

SEQ ID NO: 618938 - protein, 9 aa, Homo Sapiens
SVHMLEDGQ

SEQ ID NO: 618939 - protein, 9 aa, Homo Sapiens
HAYDIVKMK

SEQ ID NO: 618940 - protein, 9 aa, Homo Sapiens
SQSDDLIHH

SEQ ID NO: 618941 - protein, 9 aa, Homo Sapiens
NASHKIEVE

SEQ ID NO: 618942 - protein, 9 aa, Homo Sapiens
GDRSSNCRS

SEQ ID NO: 618943 - protein, 9 aa, Homo Sapiens
GYQHEPIHM

SEQ ID NO: 618944 - protein, 9 aa, Homo Sapiens
MKNPKVPLD

SEQ ID NO: 618945 - protein, 9 aa, Homo Sapiens
CDRCSTAIT

SEQ ID NO: 618946 - protein, 9 aa, Homo Sapiens
YVASVPTAV

SEQ ID NO: 618947 - protein, 9 aa, Homo Sapiens
YSPALNRMF

SEQ ID NO: 618948 - protein, 9 aa, Homo Sapiens
RLYRHSSIL

SEQ ID NO: 618949 - protein, 9 aa, Homo Sapiens
QKMSSRLVC

SEQ ID NO: 618950 - protein, 9 aa, Homo Sapiens
SFNSHQLRP

SEQ ID NO: 618951 - protein, 9 aa, Homo Sapiens
NCRSPADFW

SEQ ID NO: 618952 - protein, 9 aa, Homo Sapiens
KTPNRLNKI

SEQ ID NO: 618953 - protein, 9 aa, Homo Sapiens
FLGLDSILC

SEQ ID NO: 618954 - protein, 9 aa, Homo Sapiens
ENSILLDAL

SEQ ID NO: 618955 - protein, 9 aa, Homo Sapiens
FLPPLLLLD

SEQ ID NO: 618956 - protein, 9 aa, Homo Sapiens
LCHRNSNCL

SEQ ID NO: 618957 - protein, 9 aa, Homo Sapiens
SMTRVLDEA

SEQ ID NO: 618958 - protein, 9 aa, Homo Sapiens
CRSPADFWE

SEQ ID NO: 618959 - protein, 9 aa, Homo Sapiens
WHSFSAGPE

SEQ ID NO: 618960 - protein, 9 aa, Homo Sapiens
ANPIIYFFM

SEQ ID NO: 618961 - protein, 9 aa, Homo Sapiens
GDGFKVAIN

SEQ ID NO: 618962 - protein, 9 aa, Homo Sapiens
SLNLLLSAF

SEQ ID NO: 618963 - protein, 9 aa, Homo Sapiens
VHQHLLSTT

SEQ ID NO: 618964 - protein, 9 aa, Homo Sapiens
LVQILDKEM

SEQ ID NO: 618965 - protein, 9 aa, Homo Sapiens
GRDPKRVTI

SEQ ID NO: 618966 - protein, 9 aa, Homo Sapiens
TAARLYRHS

SEQ ID NO: 618967 - protein, 9 aa, Homo Sapiens
TITDSISGL

SEQ ID NO: 618968 - protein, 9 aa, Homo Sapiens
EKHEETKAF

SEQ ID NO: 618969 - protein, 9 aa, Homo Sapiens
SRARGGAPP

SEQ ID NO: 618970 - protein, 9 aa, Homo Sapiens
PWAWATAGT

SEQ ID NO: 618971 - protein, 9 aa, Homo Sapiens
EHMDRQCAQ

SEQ ID NO: 618972 - protein, 9 aa, Homo Sapiens
RVSKELHYT

SEQ ID NO: 618973 - protein, 9 aa, Homo Sapiens
SQLDPLLTL

SEQ ID NO: 618974 - protein, 9 aa, Homo Sapiens
KYSFRRLDN

SEQ ID NO: 618975 - protein, 9 aa, Homo Sapiens
SKLDAPFTQ

SEQ ID NO: 618976 - protein, 9 aa, Homo Sapiens
YNLIPMLPT

SEQ ID NO: 618977 - protein, 9 aa, Homo Sapiens
VEEDVHSFV

SEQ ID NO: 618978 - protein, 9 aa, Homo Sapiens
IFAKPEEKR

SEQ ID NO: 618979 - protein, 9 aa, Homo Sapiens
NNRISYVQN

SEQ ID NO: 618980 - protein, 9 aa, Homo Sapiens
HWRRRGSPA

SEQ ID NO: 618981 - protein, 9 aa, Homo Sapiens
LGMQIEKTK

SEQ ID NO: 618982 - protein, 9 aa, Homo Sapiens
SSVADSNGV

SEQ ID NO: 618983 - protein, 9 aa, Homo Sapiens
AVRGAQPHW

SEQ ID NO: 618984 - protein, 9 aa, Homo Sapiens
ASQIWNLNP

SEQ ID NO: 618985 - protein, 9 aa, Homo Sapiens
PEQDSKLTS

SEQ ID NO: 618986 - protein, 9 aa, Homo Sapiens
RTGTSCRCG

SEQ ID NO: 618987 - protein, 9 aa, Homo Sapiens
TLLDESEKN

SEQ ID NO: 618988 - protein, 9 aa, Homo Sapiens
HRVGDATAV

SEQ ID NO: 618989 - protein, 9 aa, Homo Sapiens
LIGSTPCTP

SEQ ID NO: 618990 - protein, 9 aa, Homo Sapiens
LLGASLGGI

SEQ ID NO: 618991 - protein, 9 aa, Homo Sapiens
WLRVLARDT

SEQ ID NO: 618992 - protein, 9 aa, Homo Sapiens
GAQPHWAAQ

SEQ ID NO: 618993 - protein, 9 aa, Homo Sapiens
EYRKPLSYP

SEQ ID NO: 618994 - protein, 9 aa, Homo Sapiens
GANGGGYGG

SEQ ID NO: 618995 - protein, 9 aa, Homo Sapiens
LLPFIDAFQ

SEQ ID NO: 618996 - protein, 9 aa, Homo Sapiens
MRRGANGGG

SEQ ID NO: 618997 - protein, 9 aa, Homo Sapiens
LGDYSEYFG

SEQ ID NO: 618998 - protein, 9 aa, Homo Sapiens
PLRVLELPG

SEQ ID NO: 618999 - protein, 9 aa, Homo Sapiens
FTSFADAEC

SEQ ID NO: 619000 - protein, 9 aa, Homo Sapiens
CTPHRVGDA

SEQ ID NO: 619001 - protein, 9 aa, Homo Sapiens
RRNSRTGTS

SEQ ID NO: 619002 - protein, 9 aa, Homo Sapiens
DSKLTSEEE

SEQ ID NO: 619003 - protein, 9 aa, Homo Sapiens
QMFFFTSFA

SEQ ID NO: 619004 - protein, 9 aa, Homo Sapiens
LLLPFIDAF

SEQ ID NO: 619005 - protein, 9 aa, Homo Sapiens
KAFIRMSHF

SEQ ID NO: 619006 - protein, 9 aa, Homo Sapiens
HPSGRGYYF

SEQ ID NO: 619007 - protein, 9 aa, Homo Sapiens
CALQMFFFT

SEQ ID NO: 619008 - protein, 9 aa, Homo Sapiens
CSSVADSNG

SEQ ID NO: 619009 - protein, 9 aa, Homo Sapiens
VKKCLFQKF

SEQ ID NO: 619010 - protein, 9 aa, Homo Sapiens
ERMNLSHLK

SEQ ID NO: 619011 - protein, 9 aa, Homo Sapiens
DALVEEDVH

SEQ ID NO: 619012 - protein, 9 aa, Homo Sapiens
SGSFCPGTS

SEQ ID NO: 619013 - protein, 9 aa, Homo Sapiens
WRRNRKEKQ

SEQ ID NO: 619014 - protein, 9 aa, Homo Sapiens
RVGDATAVR

SEQ ID NO: 619015 - protein, 9 aa, Homo Sapiens
NGGGYGGYD

SEQ ID NO: 619016 - protein, 9 aa, Homo Sapiens
SYVQNGAFI

SEQ ID NO: 619017 - protein, 9 aa, Homo Sapiens
GSLFEVQWQ

SEQ ID NO: 619018 - protein, 9 aa, Homo Sapiens
DTTKPSHWC

SEQ ID NO: 619019 - protein, 9 aa, Homo Sapiens
KRKTLEEDV

SEQ ID NO: 619020 - protein, 9 aa, Homo Sapiens
FFFTSFADA

SEQ ID NO: 619021 - protein, 9 aa, Homo Sapiens
NDLAVIPAS

SEQ ID NO: 619022 - protein, 9 aa, Homo Sapiens
KIFAKPEEK

SEQ ID NO: 619023 - protein, 9 aa, Homo Sapiens
WRRRGSPAA

SEQ ID NO: 619024 - protein, 9 aa, Homo Sapiens
VGQGFLGDY

SEQ ID NO: 619025 - protein, 9 aa, Homo Sapiens
ALVEEDVHS

SEQ ID NO: 619026 - protein, 9 aa, Homo Sapiens
VWRRNRKEK

SEQ ID NO: 619027 - protein, 9 aa, Homo Sapiens
SVADSNGVL

SEQ ID NO: 619028 - protein, 9 aa, Homo Sapiens
CGHWRRRGS

SEQ ID NO: 619029 - protein, 9 aa, Homo Sapiens
MAICKQSQH

SEQ ID NO: 619030 - protein, 9 aa, Homo Sapiens
PLLGASLGG

SEQ ID NO: 619031 - protein, 9 aa, Homo Sapiens
CNIDEVKKC

SEQ ID NO: 619032 - protein, 9 aa, Homo Sapiens
SKLGMQIEK

SEQ ID NO: 619033 - protein, 9 aa, Homo Sapiens
AVIPASVVH

SEQ ID NO: 619034 - protein, 9 aa, Homo Sapiens
LLDESEKNK

SEQ ID NO: 619035 - protein, 9 aa, Homo Sapiens
INKSGLTPL

SEQ ID NO: 619036 - protein, 9 aa, Homo Sapiens
AGRWLRVLA

SEQ ID NO: 619037 - protein, 9 aa, Homo Sapiens
KELTYQMEE

SEQ ID NO: 619038 - protein, 9 aa, Homo Sapiens
NKPQQKEDV

SEQ ID NO: 619039 - protein, 9 aa, Homo Sapiens
FLLVPLLMN

SEQ ID NO: 619040 - protein, 9 aa, Homo Sapiens
LTYQMEEDR

SEQ ID NO: 619041 - protein, 9 aa, Homo Sapiens
IVLAPENEK

SEQ ID NO: 619042 - protein, 9 aa, Homo Sapiens
MSPDTTKPS

SEQ ID NO: 619043 - protein, 9 aa, Homo Sapiens
DTAGVLGQP

SEQ ID NO: 619044 - protein, 9 aa, Homo Sapiens
SVVHNWDFE

SEQ ID NO: 619045 - protein, 9 aa, Homo Sapiens
GIIVLAPEN

SEQ ID NO: 619046 - protein, 9 aa, Homo Sapiens
ASPPASSPL

SEQ ID NO: 619047 - protein, 9 aa, Homo Sapiens
YTFYEFSWT

SEQ ID NO: 619048 - protein, 9 aa, Homo Sapiens
PHRVGDATA

SEQ ID NO: 619049 - protein, 9 aa, Homo Sapiens
CGKAFIRMS

SEQ ID NO: 619050 - protein, 9 aa, Homo Sapiens
LFQKFYTFY

SEQ ID NO: 619051 - protein, 9 aa, Homo Sapiens
AGHRGCAHR

SEQ ID NO: 619052 - protein, 9 aa, Homo Sapiens
EYSFLCTSV

SEQ ID NO: 619053 - protein, 9 aa, Homo Sapiens
KNKPQQKED

SEQ ID NO: 619054 - protein, 9 aa, Homo Sapiens
EHFASGSFC

SEQ ID NO: 619055 - protein, 9 aa, Homo Sapiens
AGVLGQPAD

SEQ ID NO: 619056 - protein, 9 aa, Homo Sapiens
KPEEKRKTL

SEQ ID NO: 619057 - protein, 9 aa, Homo Sapiens
AVAKDEYRK

SEQ ID NO: 619058 - protein, 9 aa, Homo Sapiens
YVLATRELQ

SEQ ID NO: 619059 - protein, 9 aa, Homo Sapiens
AACETLKER

SEQ ID NO: 619060 - protein, 9 aa, Homo Sapiens
AHRLQAQVT

SEQ ID NO: 619061 - protein, 9 aa, Homo Sapiens
GTQIDLRDN

SEQ ID NO: 619062 - protein, 9 aa, Homo Sapiens
PASSPLRVL

SEQ ID NO: 619063 - protein, 9 aa, Homo Sapiens
ASLGGIIYL

SEQ ID NO: 619064 - protein, 9 aa, Homo Sapiens
VHSFVIPPP

SEQ ID NO: 619065 - protein, 9 aa, Homo Sapiens
HLKLAIKYN

SEQ ID NO: 619066 - protein, 9 aa, Homo Sapiens
APLLGASLG

SEQ ID NO: 619067 - protein, 9 aa, Homo Sapiens
MFFFTSFAD

SEQ ID NO: 619068 - protein, 9 aa, Homo Sapiens
VAKDEYRKP

SEQ ID NO: 619069 - protein, 9 aa, Homo Sapiens
QSQAAHASC

SEQ ID NO: 619070 - protein, 9 aa, Homo Sapiens
LLMNPIVYC

SEQ ID NO: 619071 - protein, 9 aa, Homo Sapiens
PPASSPLRV

SEQ ID NO: 619072 - protein, 9 aa, Homo Sapiens
VQNGAFINL

SEQ ID NO: 619073 - protein, 9 aa, Homo Sapiens
ACHCGHWRR

SEQ ID NO: 619074 - protein, 9 aa, Homo Sapiens
HASCRRNSR

SEQ ID NO: 619075 - protein, 9 aa, Homo Sapiens
QAAHASCRR

SEQ ID NO: 619076 - protein, 9 aa, Homo Sapiens
CFCVWRRNR

SEQ ID NO: 619077 - protein, 9 aa, Homo Sapiens
ANVNLINKS

SEQ ID NO: 619078 - protein, 9 aa, Homo Sapiens
AKEALIAAC

SEQ ID NO: 619079 - protein, 9 aa, Homo Sapiens
VLARDTAGV

SEQ ID NO: 619080 - protein, 9 aa, Homo Sapiens
CRRNSRTGT

SEQ ID NO: 619081 - protein, 9 aa, Homo Sapiens
YCVRGMDYY

SEQ ID NO: 619082 - protein, 9 aa, Homo Sapiens
TPCTPHRVG

SEQ ID NO: 619083 - protein, 9 aa, Homo Sapiens
RISYVQNGA

SEQ ID NO: 619084 - protein, 9 aa, Homo Sapiens
AQGHGAGRW

SEQ ID NO: 619085 - protein, 9 aa, Homo Sapiens
STPCTPHRV

SEQ ID NO: 619086 - protein, 9 aa, Homo Sapiens
HSFVIPPPA

SEQ ID NO: 619087 - protein, 9 aa, Homo Sapiens
KAPTIGLGA

SEQ ID NO: 619088 - protein, 9 aa, Homo Sapiens
APTIGLGAV

SEQ ID NO: 619089 - protein, 9 aa, Homo Sapiens
KDEYRKPLS

SEQ ID NO: 619090 - protein, 9 aa, Homo Sapiens
NRKEKQSET

SEQ ID NO: 619091 - protein, 9 aa, Homo Sapiens
DLRDNPSTI

SEQ ID NO: 619092 - protein, 9 aa, Homo Sapiens
LDESEKNKP

SEQ ID NO: 619093 - protein, 9 aa, Homo Sapiens
LEERMNLSH

SEQ ID NO: 619094 - protein, 9 aa, Homo Sapiens
TGTSCRCGC

SEQ ID NO: 619095 - protein, 9 aa, Homo Sapiens
EKRKTLEED

SEQ ID NO: 619096 - protein, 9 aa, Homo Sapiens
VLATRELQE

SEQ ID NO: 619097 - protein, 9 aa, Homo Sapiens
QIWNLNPVF

SEQ ID NO: 619098 - protein, 9 aa, Homo Sapiens
CKQSQHMTE

SEQ ID NO: 619099 - protein, 9 aa, Homo Sapiens
TPHRVGDAT

SEQ ID NO: 619100 - protein, 9 aa, Homo Sapiens
SHLKLAIKY

SEQ ID NO: 619101 - protein, 9 aa, Homo Sapiens
PTIGLGAVV

SEQ ID NO: 619102 - protein, 9 aa, Homo Sapiens
APENEKDEG

SEQ ID NO: 619103 - protein, 9 aa, Homo Sapiens
VAPLLGASL

SEQ ID NO: 619104 - protein, 9 aa, Homo Sapiens
WEKRMSHPS

SEQ ID NO: 619105 - protein, 9 aa, Homo Sapiens
SSPLRVLEL

SEQ ID NO: 619106 - protein, 9 aa, Homo Sapiens
ASMSPDTTK

SEQ ID NO: 619107 - protein, 9 aa, Homo Sapiens
RELQEVVGT

SEQ ID NO: 619108 - protein, 9 aa, Homo Sapiens
NLINKSGLT

SEQ ID NO: 619109 - protein, 9 aa, Homo Sapiens
GSFCPGTSP

SEQ ID NO: 619110 - protein, 9 aa, Homo Sapiens
ARFGYVSAA

SEQ ID NO: 619111 - protein, 9 aa, Homo Sapiens
IWNLNPVFG

SEQ ID NO: 619112 - protein, 9 aa, Homo Sapiens
EKRMSHPSG

SEQ ID NO: 619113 - protein, 9 aa, Homo Sapiens
GTSCRCGCA

SEQ ID NO: 619114 - protein, 9 aa, Homo Sapiens
RAMAICKQS

SEQ ID NO: 619115 - protein, 9 aa, Homo Sapiens
FIDAFQRVD

SEQ ID NO: 619116 - protein, 9 aa, Homo Sapiens
GMQIEKTKK

SEQ ID NO: 619117 - protein, 9 aa, Homo Sapiens
HCGHWRRRG

SEQ ID NO: 619118 - protein, 9 aa, Homo Sapiens
PEVARFGYV

SEQ ID NO: 619119 - protein, 9 aa, Homo Sapiens
CLFQKFYTF

SEQ ID NO: 619120 - protein, 9 aa, Homo Sapiens
GCAHRLQAQ

SEQ ID NO: 619121 - protein, 9 aa, Homo Sapiens
IDLRDNPST

SEQ ID NO: 619122 - protein, 9 aa, Homo Sapiens
ACSGRHYCV

SEQ ID NO: 619123 - protein, 9 aa, Homo Sapiens
MNLSHLKLA

SEQ ID NO: 619124 - protein, 9 aa, Homo Sapiens
LCLRLLQSQ

SEQ ID NO: 619125 - protein, 9 aa, Homo Sapiens
FCPGTSPAF

SEQ ID NO: 619126 - protein, 9 aa, Homo Sapiens
RIKELTYQM

SEQ ID NO: 619127 - protein, 9 aa, Homo Sapiens
DSVSKLGMQ

SEQ ID NO: 619128 - protein, 9 aa, Homo Sapiens
FFTSFADAE

SEQ ID NO: 619129 - protein, 9 aa, Homo Sapiens
TTKPSHWCS

SEQ ID NO: 619130 - protein, 9 aa, Homo Sapiens
VVAPLLGAS

SEQ ID NO: 619131 - protein, 9 aa, Homo Sapiens
VLLLPFIDA

SEQ ID NO: 619132 - protein, 9 aa, Homo Sapiens
GASLGGIIY

SEQ ID NO: 619133 - protein, 9 aa, Homo Sapiens
FYEFSWTCN

SEQ ID NO: 619134 - protein, 9 aa, Homo Sapiens
LRVLARDTA

SEQ ID NO: 619135 - protein, 9 aa, Homo Sapiens
HPSCCPSCC

SEQ ID NO: 619136 - protein, 9 aa, Homo Sapiens
EQDSKLTSE

SEQ ID NO: 619137 - protein, 9 aa, Homo Sapiens
KKCLFQKFY

SEQ ID NO: 619138 - protein, 9 aa, Homo Sapiens
VIPASVVHN

SEQ ID NO: 619139 - protein, 9 aa, Homo Sapiens
RMSHPSGRG

SEQ ID NO: 619140 - protein, 9 aa, Homo Sapiens
TKEYSFLCT

SEQ ID NO: 619141 - protein, 9 aa, Homo Sapiens
QGHGAGRWL

SEQ ID NO: 619142 - protein, 9 aa, Homo Sapiens
SHPSGRGYY

SEQ ID NO: 619143 - protein, 9 aa, Homo Sapiens
RKPLSYPLE

SEQ ID NO: 619144 - protein, 9 aa, Homo Sapiens
GDATAVRGA

SEQ ID NO: 619145 - protein, 9 aa, Homo Sapiens
VRGMDYYAS

SEQ ID NO: 619146 - protein, 9 aa, Homo Sapiens
GQPADAACH

SEQ ID NO: 619147 - protein, 9 aa, Homo Sapiens
TFYEFSWTC

SEQ ID NO: 619148 - protein, 9 aa, Homo Sapiens
DEYRKPLSY

SEQ ID NO: 619149 - protein, 9 aa, Homo Sapiens
CVWRRNRKE

SEQ ID NO: 619150 - protein, 9 aa, Homo Sapiens
RLLQSQAAH

SEQ ID NO: 619151 - protein, 9 aa, Homo Sapiens
DLAVIPASV

SEQ ID NO: 619152 - protein, 9 aa, Homo Sapiens
SLFEVQWQL

SEQ ID NO: 619153 - protein, 9 aa, Homo Sapiens
DEVKKCLFQ

SEQ ID NO: 619154 - protein, 9 aa, Homo Sapiens
SASQIWNLN

SEQ ID NO: 619155 - protein, 9 aa, Homo Sapiens
SVSKLGMQI

SEQ ID NO: 619156 - protein, 9 aa, Homo Sapiens
HQDSVSKLG

SEQ ID NO: 619157 - protein, 9 aa, Homo Sapiens
AFIRMSHFI

SEQ ID NO: 619158 - protein, 9 aa, Homo Sapiens
PGWEKRMSH

SEQ ID NO: 619159 - protein, 9 aa, Homo Sapiens
GAVVPPLPS

SEQ ID NO: 619160 - protein, 9 aa, Homo Sapiens
RNRKEKQSE

SEQ ID NO: 619161 - protein, 9 aa, Homo Sapiens
DAACHCGHW

SEQ ID NO: 619162 - protein, 9 aa, Homo Sapiens
LFEVQWQLA

SEQ ID NO: 619163 - protein, 9 aa, Homo Sapiens
RMRRGANGG

SEQ ID NO: 619164 - protein, 9 aa, Homo Sapiens
GKAFIRMSH

SEQ ID NO: 619165 - protein, 9 aa, Homo Sapiens
VRGAQPHWA

SEQ ID NO: 619166 - protein, 9 aa, Homo Sapiens
ELQEVVGTT

SEQ ID NO: 619167 - protein, 9 aa, Homo Sapiens
RGAQPHWAA

SEQ ID NO: 619168 - protein, 9 aa, Homo Sapiens
SPDTTKPSH

SEQ ID NO: 619169 - protein, 9 aa, Homo Sapiens
ELTYQMEED

SEQ ID NO: 619170 - protein, 9 aa, Homo Sapiens
GVLGQPADA

SEQ ID NO: 619171 - protein, 9 aa, Homo Sapiens
EVKKCLFQK

SEQ ID NO: 619172 - protein, 9 aa, Homo Sapiens
VNLINKSGL

SEQ ID NO: 619173 - protein, 9 aa, Homo Sapiens
NANVNLINK

SEQ ID NO: 619174 - protein, 9 aa, Homo Sapiens
NSRTGTSCR

SEQ ID NO: 619175 - protein, 9 aa, Homo Sapiens
VSKLGMQIE

SEQ ID NO: 619176 - protein, 9 aa, Homo Sapiens
ERMRRGANG

SEQ ID NO: 619177 - protein, 9 aa, Homo Sapiens
PFIDAFQRV

SEQ ID NO: 619178 - protein, 9 aa, Homo Sapiens
MTKEYSFLC

SEQ ID NO: 619179 - protein, 9 aa, Homo Sapiens
LVPLLMNPI

SEQ ID NO: 619180 - protein, 9 aa, Homo Sapiens
SCRRNSRTG

SEQ ID NO: 619181 - protein, 9 aa, Homo Sapiens
CHPSCCPSC

SEQ ID NO: 619182 - protein, 9 aa, Homo Sapiens
AGIIVLAPE

SEQ ID NO: 619183 - protein, 9 aa, Homo Sapiens
CHCGHWRRR

SEQ ID NO: 619184 - protein, 9 aa, Homo Sapiens
YRKPLSYPL

SEQ ID NO: 619185 - protein, 9 aa, Homo Sapiens
SQIWNLNPV

SEQ ID NO: 619186 - protein, 9 aa, Homo Sapiens
WNLNPVFGG

SEQ ID NO: 619187 - protein, 9 aa, Homo Sapiens
CETLKERKA

SEQ ID NO: 619188 - protein, 9 aa, Homo Sapiens
AQPHWAAQG

SEQ ID NO: 619189 - protein, 9 aa, Homo Sapiens
WAAQGHGAG

SEQ ID NO: 619190 - protein, 9 aa, Homo Sapiens
RWLRVLARD

SEQ ID NO: 619191 - protein, 9 aa, Homo Sapiens
SKLTSEEES

SEQ ID NO: 619192 - protein, 9 aa, Homo Sapiens
SGRHYCVRG

SEQ ID NO: 619193 - protein, 9 aa, Homo Sapiens
KRMSHPSGR

SEQ ID NO: 619194 - protein, 9 aa, Homo Sapiens
TQIDLRDNP

SEQ ID NO: 619195 - protein, 9 aa, Homo Sapiens
ICKQSQHMT

SEQ ID NO: 619196 - protein, 9 aa, Homo Sapiens
GVGQGFLGD

SEQ ID NO: 619197 - protein, 9 aa, Homo Sapiens
QMEEDRKNL

SEQ ID NO: 619198 - protein, 9 aa, Homo Sapiens
SRLSASQIW

SEQ ID NO: 619199 - protein, 9 aa, Homo Sapiens
RRGANGGGY

SEQ ID NO: 619200 - protein, 9 aa, Homo Sapiens
EKNKPQQKE

SEQ ID NO: 619201 - protein, 9 aa, Homo Sapiens
SPPASSPLR

SEQ ID NO: 619202 - protein, 9 aa, Homo Sapiens
TSFADAECL

SEQ ID NO: 619203 - protein, 9 aa, Homo Sapiens
LINKSGLTP

SEQ ID NO: 619204 - protein, 9 aa, Homo Sapiens
DNPSTIEKL

SEQ ID NO: 619205 - protein, 9 aa, Homo Sapiens
CCHPSCCPS

SEQ ID NO: 619206 - protein, 9 aa, Homo Sapiens
PCTPHRVGD

SEQ ID NO: 619207 - protein, 9 aa, Homo Sapiens
PLLMNPIVY

SEQ ID NO: 619208 - protein, 9 aa, Homo Sapiens
LRVLELPGV

SEQ ID NO: 619209 - protein, 9 aa, Homo Sapiens
ASGSFCPGT

SEQ ID NO: 619210 - protein, 9 aa, Homo Sapiens
ADAACHCGH

SEQ ID NO: 619211 - protein, 9 aa, Homo Sapiens
FLCTSVPRG

SEQ ID NO: 619212 - protein, 9 aa, Homo Sapiens
HGAGRWLRV

SEQ ID NO: 619213 - protein, 9 aa, Homo Sapiens
GSTPCTPHR

SEQ ID NO: 619214 - protein, 9 aa, Homo Sapiens
FIRMSHFIT

SEQ ID NO: 619215 - protein, 9 aa, Homo Sapiens
YQMEEDRKN

SEQ ID NO: 619216 - protein, 9 aa, Homo Sapiens
NGAFINLPN

SEQ ID NO: 619217 - protein, 9 aa, Homo Sapiens
IGLGAVVPP

SEQ ID NO: 619218 - protein, 9 aa, Homo Sapiens
GQGFLGDYS

SEQ ID NO: 619219 - protein, 9 aa, Homo Sapiens
SQAAHASCR

SEQ ID NO: 619220 - protein, 9 aa, Homo Sapiens
SRTGTSCRC

SEQ ID NO: 619221 - protein, 9 aa, Homo Sapiens
LSASQIWNL

SEQ ID NO: 619222 - protein, 9 aa, Homo Sapiens
VPLLMNPIV

SEQ ID NO: 619223 - protein, 9 aa, Homo Sapiens
LAPENEKDE

SEQ ID NO: 619224 - protein, 9 aa, Homo Sapiens
QGFLGDYSE

SEQ ID NO: 619225 - protein, 9 aa, Homo Sapiens
DSNGVLTEG

SEQ ID NO: 619226 - protein, 9 aa, Homo Sapiens
AMAICKQSQ

SEQ ID NO: 619227 - protein, 9 aa, Homo Sapiens
FCVWRRNRK

SEQ ID NO: 619228 - protein, 9 aa, Homo Sapiens
IGSTPCTPH

SEQ ID NO: 619229 - protein, 9 aa, Homo Sapiens
HWAAQGHGA

SEQ ID NO: 619230 - protein, 9 aa, Homo Sapiens
PENEKDEGK

SEQ ID NO: 619231 - protein, 9 aa, Homo Sapiens
VADSNGVLT

SEQ ID NO: 619232 - protein, 9 aa, Homo Sapiens
LVEEDVHSF

SEQ ID NO: 619233 - protein, 9 aa, Homo Sapiens
MSHPSGRGY

SEQ ID NO: 619234 - protein, 9 aa, Homo Sapiens
PEEKRKTLE

SEQ ID NO: 619235 - protein, 9 aa, Homo Sapiens
ALIAACETL

SEQ ID NO: 619236 - protein, 9 aa, Homo Sapiens
DAFQRVDLR

SEQ ID NO: 619237 - protein, 9 aa, Homo Sapiens
EVARFGYVS

SEQ ID NO: 619238 - protein, 9 aa, Homo Sapiens
TYQMEEDRK

SEQ ID NO: 619239 - protein, 9 aa, Homo Sapiens
LKAPTIGLG

SEQ ID NO: 619240 - protein, 9 aa, Homo Sapiens
ARDTAGVLG

SEQ ID NO: 619241 - protein, 9 aa, Homo Sapiens
RGSPAAGHR

SEQ ID NO: 619242 - protein, 9 aa, Homo Sapiens
NLSHLKLAI

SEQ ID NO: 619243 - protein, 9 aa, Homo Sapiens
LYVLATREL

SEQ ID NO: 619244 - protein, 9 aa, Homo Sapiens
TSCRCGCAR

SEQ ID NO: 619245 - protein, 9 aa, Homo Sapiens
YVQNGAFIN

SEQ ID NO: 619246 - protein, 9 aa, Homo Sapiens
PDTTKPSHW

SEQ ID NO: 619247 - protein, 9 aa, Homo Sapiens
VQWQLAQLE

SEQ ID NO: 619248 - protein, 9 aa, Homo Sapiens
KFYTFYEFS

SEQ ID NO: 619249 - protein, 9 aa, Homo Sapiens
AAHASCRRN

SEQ ID NO: 619250 - protein, 9 aa, Homo Sapiens
YEFSWTCNI

SEQ ID NO: 619251 - protein, 9 aa, Homo Sapiens
AKPEEKRKT

SEQ ID NO: 619252 - protein, 9 aa, Homo Sapiens
GLGAVVPPL

SEQ ID NO: 619253 - protein, 9 aa, Homo Sapiens
DESEKNKPQ

SEQ ID NO: 619254 - protein, 9 aa, Homo Sapiens
SFCPGTSPA

SEQ ID NO: 619255 - protein, 9 aa, Homo Sapiens
NRISYVQNG

SEQ ID NO: 619256 - protein, 9 aa, Homo Sapiens
MSHFITHER

SEQ ID NO: 619257 - protein, 9 aa, Homo Sapiens
PHWAAQGHG

SEQ ID NO: 619258 - protein, 9 aa, Homo Sapiens
DASMSPDTT

SEQ ID NO: 619259 - protein, 9 aa, Homo Sapiens
IDEVKKCLF

SEQ ID NO: 619260 - protein, 9 aa, Homo Sapiens
SEKNKPQQK

SEQ ID NO: 619261 - protein, 9 aa, Homo Sapiens
ESCSSVADS

SEQ ID NO: 619262 - protein, 9 aa, Homo Sapiens
AKDEYRKPL

SEQ ID NO: 619263 - protein, 9 aa, Homo Sapiens
RGANGGGYG

SEQ ID NO: 619264 - protein, 9 aa, Homo Sapiens
DATAVRGAQ

SEQ ID NO: 619265 - protein, 9 aa, Homo Sapiens
HRGCAHRLQ

SEQ ID NO: 619266 - protein, 9 aa, Homo Sapiens
TCCHPSCCP

SEQ ID NO: 619267 - protein, 9 aa, Homo Sapiens
RRRGSPAAG

SEQ ID NO: 619268 - protein, 9 aa, Homo Sapiens
LIAACETLK

SEQ ID NO: 619269 - protein, 9 aa, Homo Sapiens
YAVAKDEYR

SEQ ID NO: 619270 - protein, 9 aa, Homo Sapiens
SCSSVADSN

SEQ ID NO: 619271 - protein, 9 aa, Homo Sapiens
NPEQDSKLT

SEQ ID NO: 619272 - protein, 9 aa, Homo Sapiens
LLQSQAAHA

SEQ ID NO: 619273 - protein, 9 aa, Homo Sapiens
RLQAQVTRC

SEQ ID NO: 619274 - protein, 9 aa, Homo Sapiens
QIDLRDNPS

SEQ ID NO: 619275 - protein, 9 aa, Homo Sapiens
ASCRRNSRT

SEQ ID NO: 619276 - protein, 9 aa, Homo Sapiens
QWQLAQLEA

SEQ ID NO: 619277 - protein, 9 aa, Homo Sapiens
QDSVSKLGM

SEQ ID NO: 619278 - protein, 9 aa, Homo Sapiens
IAACETLKE

SEQ ID NO: 619279 - protein, 9 aa, Homo Sapiens
QPHWAAQGH

SEQ ID NO: 619280 - protein, 9 aa, Homo Sapiens
WQLAQLEAR

SEQ ID NO: 619281 - protein, 9 aa, Homo Sapiens
SNPEQDSKL

SEQ ID NO: 619282 - protein, 9 aa, Homo Sapiens
YSFLCTSVP

SEQ ID NO: 619283 - protein, 9 aa, Homo Sapiens
RNSRTGTSC

SEQ ID NO: 619284 - protein, 9 aa, Homo Sapiens
DVHSFVIPP

SEQ ID NO: 619285 - protein, 9 aa, Homo Sapiens
NPSTIEKLA

SEQ ID NO: 619286 - protein, 9 aa, Homo Sapiens
GHRGCAHRL

SEQ ID NO: 619287 - protein, 9 aa, Homo Sapiens
RRGSPAAGH

SEQ ID NO: 619288 - protein, 9 aa, Homo Sapiens
NVNLINKSG

SEQ ID NO: 619289 - protein, 9 aa, Homo Sapiens
ENSNPEQDS

SEQ ID NO: 619290 - protein, 9 aa, Homo Sapiens
LAVIPASVV

SEQ ID NO: 619291 - protein, 9 aa, Homo Sapiens
ADMFLLVPL

SEQ ID NO: 619292 - protein, 9 aa, Homo Sapiens
EDVHSFVIP

SEQ ID NO: 619293 - protein, 9 aa, Homo Sapiens
ANGGGYGGY

SEQ ID NO: 619294 - protein, 9 aa, Homo Sapiens
VGDATAVRG

SEQ ID NO: 619295 - protein, 9 aa, Homo Sapiens
IDAFQRVDL

SEQ ID NO: 619296 - protein, 9 aa, Homo Sapiens
LATRELQEV

SEQ ID NO: 619297 - protein, 9 aa, Homo Sapiens
KLGMQIEKT

SEQ ID NO: 619298 - protein, 9 aa, Homo Sapiens
LQEVVGTTS

SEQ ID NO: 619299 - protein, 9 aa, Homo Sapiens
CVRGMDYYA

SEQ ID NO: 619300 - protein, 9 aa, Homo Sapiens
NSNPEQDSK

SEQ ID NO: 619301 - protein, 9 aa, Homo Sapiens
LQSQAAHAS

SEQ ID NO: 619302 - protein, 9 aa, Homo Sapiens
LRDNPSTIE

SEQ ID NO: 619303 - protein, 9 aa, Homo Sapiens
LRLLQSQAA

SEQ ID NO: 619304 - protein, 9 aa, Homo Sapiens
TRELQEVVG

SEQ ID NO: 619305 - protein, 9 aa, Homo Sapiens
TAVRGAQPH

SEQ ID NO: 619306 - protein, 9 aa, Homo Sapiens
LCTSVPRGP

SEQ ID NO: 619307 - protein, 9 aa, Homo Sapiens
RLSASQIWN

SEQ ID NO: 619308 - protein, 9 aa, Homo Sapiens
FASGSFCPG

SEQ ID NO: 619309 - protein, 9 aa, Homo Sapiens
RRNRKEKQS

SEQ ID NO: 619310 - protein, 9 aa, Homo Sapiens
EEKRKTLEE

SEQ ID NO: 619311 - protein, 9 aa, Homo Sapiens
ALQMFFFTS

SEQ ID NO: 619312 - protein, 9 aa, Homo Sapiens
RVRAMAICK

SEQ ID NO: 619313 - protein, 9 aa, Homo Sapiens
TAGVLGQPA

SEQ ID NO: 619314 - protein, 9 aa, Homo Sapiens
CPGTSPAFL

SEQ ID NO: 619315 - protein, 9 aa, Homo Sapiens
LGAVVPPLP

SEQ ID NO: 619316 - protein, 9 aa, Homo Sapiens
RMNLSHLKL

SEQ ID NO: 619317 - protein, 9 aa, Homo Sapiens
QNGAFINLP

SEQ ID NO: 619318 - protein, 9 aa, Homo Sapiens
VRAMAICKQ

SEQ ID NO: 619319 - protein, 9 aa, Homo Sapiens
GRHYCVRGM

SEQ ID NO: 619320 - protein, 9 aa, Homo Sapiens
FQKFYTFYE

SEQ ID NO: 619321 - protein, 9 aa, Homo Sapiens
FGYVSAALL

SEQ ID NO: 619322 - protein, 9 aa, Homo Sapiens
CAHRLQAQV

SEQ ID NO: 619323 - protein, 9 aa, Homo Sapiens
GWEKRMSHP

SEQ ID NO: 619324 - protein, 9 aa, Homo Sapiens
NIDEVKKCL

SEQ ID NO: 619325 - protein, 9 aa, Homo Sapiens
QDSKLTSEE

SEQ ID NO: 619326 - protein, 9 aa, Homo Sapiens
AHASCRRNS

SEQ ID NO: 619327 - protein, 9 aa, Homo Sapiens
RDTAGVLGQ

SEQ ID NO: 619328 - protein, 9 aa, Homo Sapiens
PASVVHNWD

SEQ ID NO: 619329 - protein, 9 aa, Homo Sapiens
AFQRVDLRT

SEQ ID NO: 619330 - protein, 9 aa, Homo Sapiens
LQMFFFTSF

SEQ ID NO: 619331 - protein, 9 aa, Homo Sapiens
RMSHFITHE

SEQ ID NO: 619332 - protein, 9 aa, Homo Sapiens
AAQGHGAGR

SEQ ID NO: 619333 - protein, 9 aa, Homo Sapiens
CSGRHYCVR

SEQ ID NO: 619334 - protein, 9 aa, Homo Sapiens
VLGQPADAA

SEQ ID NO: 619335 - protein, 9 aa, Homo Sapiens
ATAVRGAQP

SEQ ID NO: 619336 - protein, 9 aa, Homo Sapiens
FYTFYEFSW

SEQ ID NO: 619337 - protein, 9 aa, Homo Sapiens
ADSNGVLTE

SEQ ID NO: 619338 - protein, 9 aa, Homo Sapiens
LPFIDAFQR

SEQ ID NO: 619339 - protein, 9 aa, Homo Sapiens
RHYCVRGMD

SEQ ID NO: 619340 - protein, 9 aa, Homo Sapiens
EEDVHSFVI

SEQ ID NO: 619341 - protein, 9 aa, Homo Sapiens
EGSLFEVQW

SEQ ID NO: 619342 - protein, 9 aa, Homo Sapiens
AICKQSQHM

SEQ ID NO: 619343 - protein, 9 aa, Homo Sapiens
VSAALLAPH

SEQ ID NO: 619344 - protein, 9 aa, Homo Sapiens
ATRELQEVV

SEQ ID NO: 619345 - protein, 9 aa, Homo Sapiens
AACHCGHWR

SEQ ID NO: 619346 - protein, 9 aa, Homo Sapiens
LARDTAGVL

SEQ ID NO: 619347 - protein, 9 aa, Homo Sapiens
ACETLKERK

SEQ ID NO: 619348 - protein, 9 aa, Homo Sapiens
LSHLKLAIK

SEQ ID NO: 619349 - protein, 9 aa, Homo Sapiens
SMSPDTTKP

SEQ ID NO: 619350 - protein, 9 aa, Homo Sapiens
YVSAALLAP

SEQ ID NO: 619351 - protein, 9 aa, Homo Sapiens
LGASLGGII

SEQ ID NO: 619352 - protein, 9 aa, Homo Sapiens
GRWLRVLAR

SEQ ID NO: 619353 - protein, 9 aa, Homo Sapiens
SPLRVLELP

SEQ ID NO: 619354 - protein, 9 aa, Homo Sapiens
QPADAACHC

SEQ ID NO: 619355 - protein, 9 aa, Homo Sapiens
PESCSSVAD

SEQ ID NO: 619356 - protein, 9 aa, Homo Sapiens
HRLQAQVTR

SEQ ID NO: 619357 - protein, 9 aa, Homo Sapiens
TRVRAMAIC

SEQ ID NO: 619358 - protein, 9 aa, Homo Sapiens
PADAACHCG

SEQ ID NO: 619359 - protein, 9 aa, Homo Sapiens
HHGVGQGFL

SEQ ID NO: 619360 - protein, 9 aa, Homo Sapiens
KCLFQKFYT

SEQ ID NO: 619361 - protein, 9 aa, Homo Sapiens
AAGHRGCAH

SEQ ID NO: 619362 - protein, 9 aa, Homo Sapiens
SFLCTSVPR

SEQ ID NO: 619363 - protein, 9 aa, Homo Sapiens
MFLLVPLLM

SEQ ID NO: 619364 - protein, 9 aa, Homo Sapiens
ENEKDEGKE

SEQ ID NO: 619365 - protein, 9 aa, Homo Sapiens
ISYVQNGAF

SEQ ID NO: 619366 - protein, 9 aa, Homo Sapiens
RFGYVSAAL

SEQ ID NO: 619367 - protein, 9 aa, Homo Sapiens
ECNIDEVKK

SEQ ID NO: 619368 - protein, 9 aa, Homo Sapiens
FERMRRGAN

SEQ ID NO: 619369 - protein, 9 aa, Homo Sapiens
IKELTYQME

SEQ ID NO: 619370 - protein, 9 aa, Homo Sapiens
LGQPADAAC

SEQ ID NO: 619371 - protein, 9 aa, Homo Sapiens
RVLARDTAG

SEQ ID NO: 619372 - protein, 9 aa, Homo Sapiens
IPASVVHNW

SEQ ID NO: 619373 - protein, 9 aa, Homo Sapiens
IIVLAPENE

SEQ ID NO: 619374 - protein, 9 aa, Homo Sapiens
HYCVRGMDY

SEQ ID NO: 619375 - protein, 9 aa, Homo Sapiens
EERMNLSHL

SEQ ID NO: 619376 - protein, 9 aa, Homo Sapiens
IRMSHFITH

SEQ ID NO: 619377 - protein, 9 aa, Homo Sapiens
SDASMSPDT

SEQ ID NO: 619378 - protein, 9 aa, Homo Sapiens
ACFCVWRRN

SEQ ID NO: 619379 - protein, 9 aa, Homo Sapiens
RNANVNLIN

SEQ ID NO: 619380 - protein, 9 aa, Homo Sapiens
HFASGSFCP

SEQ ID NO: 619381 - protein, 9 aa, Homo Sapiens
LLVPLLMNP

SEQ ID NO: 619382 - protein, 9 aa, Homo Sapiens
GFLGDYSEY

SEQ ID NO: 619383 - protein, 9 aa, Homo Sapiens
RDNPSTIEK

SEQ ID NO: 619384 - protein, 9 aa, Homo Sapiens
GYVSAALLA

SEQ ID NO: 619385 - protein, 9 aa, Homo Sapiens
RGCAHRLQA

SEQ ID NO: 619386 - protein, 9 aa, Homo Sapiens
SLGGIIYLV

SEQ ID NO: 619387 - protein, 9 aa, Homo Sapiens
FAKPEEKRK

SEQ ID NO: 619388 - protein, 9 aa, Homo Sapiens
VARFGYVSA

SEQ ID NO: 619389 - protein, 9 aa, Homo Sapiens
EALIAACET

SEQ ID NO: 619390 - protein, 9 aa, Homo Sapiens
GSPAAGHRG

SEQ ID NO: 619391 - protein, 9 aa, Homo Sapiens
PAAGHRGCA

SEQ ID NO: 619392 - protein, 9 aa, Homo Sapiens
HGVGQGFLG

SEQ ID NO: 619393 - protein, 9 aa, Homo Sapiens
ESEKNKPQQ

SEQ ID NO: 619394 - protein, 9 aa, Homo Sapiens
GHGAGRWLR

SEQ ID NO: 619395 - protein, 9 aa, Homo Sapiens
CLRLLQSQA

SEQ ID NO: 619396 - protein, 9 aa, Homo Sapiens
GHWRRRGSP

SEQ ID NO: 619397 - protein, 9 aa, Homo Sapiens
FEVQWQLAQ

SEQ ID NO: 619398 - protein, 9 aa, Homo Sapiens
TIGLGAVVP

SEQ ID NO: 619399 - protein, 9 aa, Homo Sapiens
EVQWQLAQL

SEQ ID NO: 619400 - protein, 9 aa, Homo Sapiens
ASVVHNWDF

SEQ ID NO: 619401 - protein, 9 aa, Homo Sapiens
DMFLLVPLL

SEQ ID NO: 619402 - protein, 9 aa, Homo Sapiens
VLAPENEKD

SEQ ID NO: 619403 - protein, 9 aa, Homo Sapiens
GAGRWLRVL

SEQ ID NO: 619404 - protein, 9 aa, Homo Sapiens
ECGKAFIRM

SEQ ID NO: 619405 - protein, 9 aa, Homo Sapiens
CTSVPRGPK

SEQ ID NO: 619406 - protein, 9 aa, Homo Sapiens
FLGDYSEYF

SEQ ID NO: 619407 - protein, 9 aa, Homo Sapiens
MEEDRKNLL

SEQ ID NO: 619408 - protein, 9 aa, Homo Sapiens
QKFYTFYEF

SEQ ID NO: 619409 - protein, 9 aa, Homo Sapiens
SPAAGHRGC

SEQ ID NO: 619410 - protein, 9 aa, Homo Sapiens
KEYSFLCTS

SEQ ID NO: 619411 - protein, 9 aa, Homo Sapiens
GRNANVNLI

SEQ ID NO: 619412 - protein, 9 aa, Homo Sapiens
KEALIAACE

SEQ ID NO: 619413 - protein, 9 aa, Homo Sapiens
RLVERQLLS

SEQ ID NO: 619414 - protein, 9 aa, Homo Sapiens
IDNCGMIEG

SEQ ID NO: 619415 - protein, 9 aa, Homo Sapiens
GAHGPRRPF

SEQ ID NO: 619416 - protein, 9 aa, Homo Sapiens
DIHWGPVGV

SEQ ID NO: 619417 - protein, 9 aa, Homo Sapiens
AALVGVNPV

SEQ ID NO: 619418 - protein, 9 aa, Homo Sapiens
SRLFLGPGG

SEQ ID NO: 619419 - protein, 9 aa, Homo Sapiens
AGLSSRREV

SEQ ID NO: 619420 - protein, 9 aa, Homo Sapiens
AALHDWKRD

SEQ ID NO: 619421 - protein, 9 aa, Homo Sapiens
KVIDNCGMI

SEQ ID NO: 619422 - protein, 9 aa, Homo Sapiens
IQKVIDNCG

SEQ ID NO: 619423 - protein, 9 aa, Homo Sapiens
RREVAKNPE

SEQ ID NO: 619424 - protein, 9 aa, Homo Sapiens
SGCCRLVER

SEQ ID NO: 619425 - protein, 9 aa, Homo Sapiens
DNCGMIEGF

SEQ ID NO: 619426 - protein, 9 aa, Homo Sapiens
HWILRGVDL

SEQ ID NO: 619427 - protein, 9 aa, Homo Sapiens
VVAVQLVAH

SEQ ID NO: 619428 - protein, 9 aa, Homo Sapiens
VIDNCGMIE

SEQ ID NO: 619429 - protein, 9 aa, Homo Sapiens
VQLVAHEAR

SEQ ID NO: 619430 - protein, 9 aa, Homo Sapiens
QAALHDWKR

SEQ ID NO: 619431 - protein, 9 aa, Homo Sapiens
GVHVGELLP

SEQ ID NO: 619432 - protein, 9 aa, Homo Sapiens
LVLSVIILM

SEQ ID NO: 619433 - protein, 9 aa, Homo Sapiens
EVLASCGTQ

SEQ ID NO: 619434 - protein, 9 aa, Homo Sapiens
HDGIQKVID

SEQ ID NO: 619435 - protein, 9 aa, Homo Sapiens
LQLQAQRCE

SEQ ID NO: 619436 - protein, 9 aa, Homo Sapiens
RQLLSIGAK

SEQ ID NO: 619437 - protein, 9 aa, Homo Sapiens
PERVPRAAL

SEQ ID NO: 619438 - protein, 9 aa, Homo Sapiens
RRRCNPTEA

SEQ ID NO: 619439 - protein, 9 aa, Homo Sapiens
VTLETNSSA

SEQ ID NO: 619440 - protein, 9 aa, Homo Sapiens
FPIRQVRVV

SEQ ID NO: 619441 - protein, 9 aa, Homo Sapiens
SIGAKEAGG

SEQ ID NO: 619442 - protein, 9 aa, Homo Sapiens
GELLPSTEC

SEQ ID NO: 619443 - protein, 9 aa, Homo Sapiens
WEEDLLAGI

SEQ ID NO: 619444 - protein, 9 aa, Homo Sapiens
LRGVDLLCD

SEQ ID NO: 619445 - protein, 9 aa, Homo Sapiens
QGSRVTLET

SEQ ID NO: 619446 - protein, 9 aa, Homo Sapiens
IGAKEAGGV

SEQ ID NO: 619447 - protein, 9 aa, Homo Sapiens
DADSGCCRL

SEQ ID NO: 619448 - protein, 9 aa, Homo Sapiens
GIQKVIDNC

SEQ ID NO: 619449 - protein, 9 aa, Homo Sapiens
ILRGVDLLC

SEQ ID NO: 619450 - protein, 9 aa, Homo Sapiens
VVTRGFVQP

SEQ ID NO: 619451 - protein, 9 aa, Homo Sapiens
QLGRGTRGA

SEQ ID NO: 619452 - protein, 9 aa, Homo Sapiens
DLLAGIIPR

SEQ ID NO: 619453 - protein, 9 aa, Homo Sapiens
WWACRSSVS

SEQ ID NO: 619454 - protein, 9 aa, Homo Sapiens
SYTGKSLKD

SEQ ID NO: 619455 - protein, 9 aa, Homo Sapiens
STPFSSLTL

SEQ ID NO: 619456 - protein, 9 aa, Homo Sapiens
SRREVAKNP

SEQ ID NO: 619457 - protein, 9 aa, Homo Sapiens
PASRLFLGP

SEQ ID NO: 619458 - protein, 9 aa, Homo Sapiens
LFCDDCNRG

SEQ ID NO: 619459 - protein, 9 aa, Homo Sapiens
GDADSGCCR

SEQ ID NO: 619460 - protein, 9 aa, Homo Sapiens
HDLKLLVGI

SEQ ID NO: 619461 - protein, 9 aa, Homo Sapiens
SLTLNHAFS

SEQ ID NO: 619462 - protein, 9 aa, Homo Sapiens
GVDLLCDIK

SEQ ID NO: 619463 - protein, 9 aa, Homo Sapiens
RLTGRAQRW

SEQ ID NO: 619464 - protein, 9 aa, Homo Sapiens
PAQPMQLGR

SEQ ID NO: 619465 - protein, 9 aa, Homo Sapiens
SSVSTGAHG

SEQ ID NO: 619466 - protein, 9 aa, Homo Sapiens
GTQQFQEVQ

SEQ ID NO: 619467 - protein, 9 aa, Homo Sapiens
EVQLHDIHW

SEQ ID NO: 619468 - protein, 9 aa, Homo Sapiens
CERGQHLLQ

SEQ ID NO: 619469 - protein, 9 aa, Homo Sapiens
RALRSAGRT

SEQ ID NO: 619470 - protein, 9 aa, Homo Sapiens
SVIILMLGL

SEQ ID NO: 619471 - protein, 9 aa, Homo Sapiens
LSVIILMLG

SEQ ID NO: 619472 - protein, 9 aa, Homo Sapiens
MKILNLVRK

SEQ ID NO: 619473 - protein, 9 aa, Homo Sapiens
HDWKRDWDE

SEQ ID NO: 619474 - protein, 9 aa, Homo Sapiens
TPQLLQLQA

SEQ ID NO: 619475 - protein, 9 aa, Homo Sapiens
RAQRWDMKE

SEQ ID NO: 619476 - protein, 9 aa, Homo Sapiens
MHGIVGPYV

SEQ ID NO: 619477 - protein, 9 aa, Homo Sapiens
VAKNPERVP

SEQ ID NO: 619478 - protein, 9 aa, Homo Sapiens
QLHDIHWGP

SEQ ID NO: 619479 - protein, 9 aa, Homo Sapiens
AGGVAVVTR

SEQ ID NO: 619480 - protein, 9 aa, Homo Sapiens
VQLHDIHWG

SEQ ID NO: 619481 - protein, 9 aa, Homo Sapiens
AVVTRGFVQ

SEQ ID NO: 619482 - protein, 9 aa, Homo Sapiens
ERQLLSIGA

SEQ ID NO: 619483 - protein, 9 aa, Homo Sapiens
SRVTLETNS

SEQ ID NO: 619484 - protein, 9 aa, Homo Sapiens
LFLGPGGQF

SEQ ID NO: 619485 - protein, 9 aa, Homo Sapiens
RAALVGVNP

SEQ ID NO: 619486 - protein, 9 aa, Homo Sapiens
VAVQLVAHE

SEQ ID NO: 619487 - protein, 9 aa, Homo Sapiens
CRLVERQLL

SEQ ID NO: 619488 - protein, 9 aa, Homo Sapiens
CILAGVGEV

SEQ ID NO: 619489 - protein, 9 aa, Homo Sapiens
LHDIHWGPV

SEQ ID NO: 619490 - protein, 9 aa, Homo Sapiens
IILMLGLII

SEQ ID NO: 619491 - protein, 9 aa, Homo Sapiens
ILGDADSGC

SEQ ID NO: 619492 - protein, 9 aa, Homo Sapiens
VGEVLASCG

SEQ ID NO: 619493 - protein, 9 aa, Homo Sapiens
LKLLVGIEA

SEQ ID NO: 619494 - protein, 9 aa, Homo Sapiens
LDRSYTGKS

SEQ ID NO: 619495 - protein, 9 aa, Homo Sapiens
GTRGAWWAC

SEQ ID NO: 619496 - protein, 9 aa, Homo Sapiens
CCRLVERQL

SEQ ID NO: 619497 - protein, 9 aa, Homo Sapiens
PFSSLTLNH

SEQ ID NO: 619498 - protein, 9 aa, Homo Sapiens
LLAGIIPRT

SEQ ID NO: 619499 - protein, 9 aa, Homo Sapiens
AFGLDRSYT

SEQ ID NO: 619500 - protein, 9 aa, Homo Sapiens
EYTWEEDLL

SEQ ID NO: 619501 - protein, 9 aa, Homo Sapiens
TLETNSSAR

SEQ ID NO: 619502 - protein, 9 aa, Homo Sapiens
RSYTGKSLK

SEQ ID NO: 619503 - protein, 9 aa, Homo Sapiens
KRDWDEAPA

SEQ ID NO: 619504 - protein, 9 aa, Homo Sapiens
LGPGGQFHD

SEQ ID NO: 619505 - protein, 9 aa, Homo Sapiens
LGDADSGCC

SEQ ID NO: 619506 - protein, 9 aa, Homo Sapiens
RSSVSTGAH

SEQ ID NO: 619507 - protein, 9 aa, Homo Sapiens
LVAHEARAL

SEQ ID NO: 619508 - protein, 9 aa, Homo Sapiens
VQPGSCILA

SEQ ID NO: 619509 - protein, 9 aa, Homo Sapiens
SCILAGVGE

SEQ ID NO: 619510 - protein, 9 aa, Homo Sapiens
IRQVRVVAV

SEQ ID NO: 619511 - protein, 9 aa, Homo Sapiens
RLSFPEPAA

SEQ ID NO: 619512 - protein, 9 aa, Homo Sapiens
QQFQEVQLH

SEQ ID NO: 619513 - protein, 9 aa, Homo Sapiens
DCNRGYHMY

SEQ ID NO: 619514 - protein, 9 aa, Homo Sapiens
ALVGVNPVF

SEQ ID NO: 619515 - protein, 9 aa, Homo Sapiens
IRIDAMHGI

SEQ ID NO: 619516 - protein, 9 aa, Homo Sapiens
WDEAPAPAQ

SEQ ID NO: 619517 - protein, 9 aa, Homo Sapiens
GRGTRGAWW

SEQ ID NO: 619518 - protein, 9 aa, Homo Sapiens
AKNPERVPR

SEQ ID NO: 619519 - protein, 9 aa, Homo Sapiens
TRGFVQPGS

SEQ ID NO: 619520 - protein, 9 aa, Homo Sapiens
GPGGQFHDL

SEQ ID NO: 619521 - protein, 9 aa, Homo Sapiens
HEARALRSA

SEQ ID NO: 619522 - protein, 9 aa, Homo Sapiens
SRPRRRCNP

SEQ ID NO: 619523 - protein, 9 aa, Homo Sapiens
LHDWKRDWD

SEQ ID NO: 619524 - protein, 9 aa, Homo Sapiens
ILAGVGEVL

SEQ ID NO: 619525 - protein, 9 aa, Homo Sapiens
SSLTLNHAF

SEQ ID NO: 619526 - protein, 9 aa, Homo Sapiens
LLQLQAQRC

SEQ ID NO: 619527 - protein, 9 aa, Homo Sapiens
TGRAQRWDM

SEQ ID NO: 619528 - protein, 9 aa, Homo Sapiens
GAWWACRSS

SEQ ID NO: 619529 - protein, 9 aa, Homo Sapiens
DLKLLVGIE

SEQ ID NO: 619530 - protein, 9 aa, Homo Sapiens
VGVHVGELL

SEQ ID NO: 619531 - protein, 9 aa, Homo Sapiens
ALHDWKRDW

SEQ ID NO: 619532 - protein, 9 aa, Homo Sapiens
KLLVGIEAG

SEQ ID NO: 619533 - protein, 9 aa, Homo Sapiens
DWKRDWDEA

SEQ ID NO: 619534 - protein, 9 aa, Homo Sapiens
CGTQQFQEV

SEQ ID NO: 619535 - protein, 9 aa, Homo Sapiens
GSRVTLETN

SEQ ID NO: 619536 - protein, 9 aa, Homo Sapiens
ISRPRRRCN

SEQ ID NO: 619537 - protein, 9 aa, Homo Sapiens
PVFPIRQVR

SEQ ID NO: 619538 - protein, 9 aa, Homo Sapiens
CAIPASRLF

SEQ ID NO: 619539 - protein, 9 aa, Homo Sapiens
WACRSSVST

SEQ ID NO: 619540 - protein, 9 aa, Homo Sapiens
ERLTGRAQR

SEQ ID NO: 619541 - protein, 9 aa, Homo Sapiens
GGQFHDLKL

SEQ ID NO: 619542 - protein, 9 aa, Homo Sapiens
TQQFQEVQL

SEQ ID NO: 619543 - protein, 9 aa, Homo Sapiens
FGLDRSYTG

SEQ ID NO: 619544 - protein, 9 aa, Homo Sapiens
QPMQLGRGT

SEQ ID NO: 619545 - protein, 9 aa, Homo Sapiens
QLLQLQAQR

SEQ ID NO: 619546 - protein, 9 aa, Homo Sapiens
AQRCERGQH

SEQ ID NO: 619547 - protein, 9 aa, Homo Sapiens
DEAPAPAQP

SEQ ID NO: 619548 - protein, 9 aa, Homo Sapiens
QRWDMKEDK

SEQ ID NO: 619549 - protein, 9 aa, Homo Sapiens
AWWACRSSV

SEQ ID NO: 619550 - protein, 9 aa, Homo Sapiens
EPAAILGDA

SEQ ID NO: 619551 - protein, 9 aa, Homo Sapiens
YTGKSLKDL

SEQ ID NO: 619552 - protein, 9 aa, Homo Sapiens
GVNPVFPIR

SEQ ID NO: 619553 - protein, 9 aa, Homo Sapiens
RGVDLLCDI

SEQ ID NO: 619554 - protein, 9 aa, Homo Sapiens
QLQAQRCER

SEQ ID NO: 619555 - protein, 9 aa, Homo Sapiens
YTWEEDLLA

SEQ ID NO: 619556 - protein, 9 aa, Homo Sapiens
PGGQFHDLK

SEQ ID NO: 619557 - protein, 9 aa, Homo Sapiens
VHVGELLPS

SEQ ID NO: 619558 - protein, 9 aa, Homo Sapiens
AVQLVAHEA

SEQ ID NO: 619559 - protein, 9 aa, Homo Sapiens
IVGPYVKKI

SEQ ID NO: 619560 - protein, 9 aa, Homo Sapiens
EDLLAGIIP

SEQ ID NO: 619561 - protein, 9 aa, Homo Sapiens
EEYTWEEDL

SEQ ID NO: 619562 - protein, 9 aa, Homo Sapiens
LLQAALHDW

SEQ ID NO: 619563 - protein, 9 aa, Homo Sapiens
ELLPSTECA

SEQ ID NO: 619564 - protein, 9 aa, Homo Sapiens
GGVAVVTRG

SEQ ID NO: 619565 - protein, 9 aa, Homo Sapiens
TECAIPASR

SEQ ID NO: 619566 - protein, 9 aa, Homo Sapiens
VPRAALVGV

SEQ ID NO: 619567 - protein, 9 aa, Homo Sapiens
QLVAHEARA

SEQ ID NO: 619568 - protein, 9 aa, Homo Sapiens
WILRGVDLL

SEQ ID NO: 619569 - protein, 9 aa, Homo Sapiens
EAPAPAQPM

SEQ ID NO: 619570 - protein, 9 aa, Homo Sapiens
GVAVVTRGF

SEQ ID NO: 619571 - protein, 9 aa, Homo Sapiens
EVAKNPERV

SEQ ID NO: 619572 - protein, 9 aa, Homo Sapiens
SSRREVAKN

SEQ ID NO: 619573 - protein, 9 aa, Homo Sapiens
EEDLLAGII

SEQ ID NO: 619574 - protein, 9 aa, Homo Sapiens
FLGPGGQFH

SEQ ID NO: 619575 - protein, 9 aa, Homo Sapiens
GLDRSYTGK

SEQ ID NO: 619576 - protein, 9 aa, Homo Sapiens
LSSTPFSSL

SEQ ID NO: 619577 - protein, 9 aa, Homo Sapiens
HLLQAALHD

SEQ ID NO: 619578 - protein, 9 aa, Homo Sapiens
VGELLPSTE

SEQ ID NO: 619579 - protein, 9 aa, Homo Sapiens
RGQHLLQAA

SEQ ID NO: 619580 - protein, 9 aa, Homo Sapiens
LLFCDDCNR

SEQ ID NO: 619581 - protein, 9 aa, Homo Sapiens
FSSLTLNHA

SEQ ID NO: 619582 - protein, 9 aa, Homo Sapiens
VLASCGTQQ

SEQ ID NO: 619583 - protein, 9 aa, Homo Sapiens
GCCRLVERQ

SEQ ID NO: 619584 - protein, 9 aa, Homo Sapiens
VAVVTRGFV

SEQ ID NO: 619585 - protein, 9 aa, Homo Sapiens
RGAWWACRS

SEQ ID NO: 619586 - protein, 9 aa, Homo Sapiens
LLPSTECAI

SEQ ID NO: 619587 - protein, 9 aa, Homo Sapiens
VLSVIILML

SEQ ID NO: 619588 - protein, 9 aa, Homo Sapiens
LSSRREVAK

SEQ ID NO: 619589 - protein, 9 aa, Homo Sapiens
LQAQRCERG

SEQ ID NO: 619590 - protein, 9 aa, Homo Sapiens
FPEPAAILG

SEQ ID NO: 619591 - protein, 9 aa, Homo Sapiens
VRVVAVQLV

SEQ ID NO: 619592 - protein, 9 aa, Homo Sapiens
QPGSCILAG

SEQ ID NO: 619593 - protein, 9 aa, Homo Sapiens
GRTPQLLQL

SEQ ID NO: 619594 - protein, 9 aa, Homo Sapiens
PRRRCNPTE

SEQ ID NO: 619595 - protein, 9 aa, Homo Sapiens
LAGVGEVLA

SEQ ID NO: 619596 - protein, 9 aa, Homo Sapiens
QRCERGQHL

SEQ ID NO: 619597 - protein, 9 aa, Homo Sapiens
PQLLQLQAQ

SEQ ID NO: 619598 - protein, 9 aa, Homo Sapiens
WGPVGVHVG

SEQ ID NO: 619599 - protein, 9 aa, Homo Sapiens
AILGDADSG

SEQ ID NO: 619600 - protein, 9 aa, Homo Sapiens
LVERQLLSI

SEQ ID NO: 619601 - protein, 9 aa, Homo Sapiens
ILNLVRKSQ

SEQ ID NO: 619602 - protein, 9 aa, Homo Sapiens
DDCNRGYHM

SEQ ID NO: 619603 - protein, 9 aa, Homo Sapiens
PAAILGDAD

SEQ ID NO: 619604 - protein, 9 aa, Homo Sapiens
GQFHDLKLL

SEQ ID NO: 619605 - protein, 9 aa, Homo Sapiens
RLFLGPGGQ

SEQ ID NO: 619606 - protein, 9 aa, Homo Sapiens
PAPAQPMQL

SEQ ID NO: 619607 - protein, 9 aa, Homo Sapiens
PMQLGRGTR

SEQ ID NO: 619608 - protein, 9 aa, Homo Sapiens
AQGSRVTLE

SEQ ID NO: 619609 - protein, 9 aa, Homo Sapiens
QFHDLKLLV

SEQ ID NO: 619610 - protein, 9 aa, Homo Sapiens
DWDEAPAPA

SEQ ID NO: 619611 - protein, 9 aa, Homo Sapiens
KEAGGVAVV

SEQ ID NO: 619612 - protein, 9 aa, Homo Sapiens
LTLNHAFSC

SEQ ID NO: 619613 - protein, 9 aa, Homo Sapiens
CRSSVSTGA

SEQ ID NO: 619614 - protein, 9 aa, Homo Sapiens
SVSTGAHGP

SEQ ID NO: 619615 - protein, 9 aa, Homo Sapiens
RSAGRTPQL

SEQ ID NO: 619616 - protein, 9 aa, Homo Sapiens
EAGLSSRRE

SEQ ID NO: 619617 - protein, 9 aa, Homo Sapiens
ALRSAGRTP

SEQ ID NO: 619618 - protein, 9 aa, Homo Sapiens
ILMLGLIIW

SEQ ID NO: 619619 - protein, 9 aa, Homo Sapiens
NPTEAAVRF

SEQ ID NO: 619620 - protein, 9 aa, Homo Sapiens
LPSTECAIP

SEQ ID NO: 619621 - protein, 9 aa, Homo Sapiens
VERQLLSIG

SEQ ID NO: 619622 - protein, 9 aa, Homo Sapiens
VSTGAHGPR

SEQ ID NO: 619623 - protein, 9 aa, Homo Sapiens
ASCGTQQFQ

SEQ ID NO: 619624 - protein, 9 aa, Homo Sapiens
NLVRKSQEI

SEQ ID NO: 619625 - protein, 9 aa, Homo Sapiens
HWGPVGVHV

SEQ ID NO: 619626 - protein, 9 aa, Homo Sapiens
RCERGQHLL

SEQ ID NO: 619627 - protein, 9 aa, Homo Sapiens
RQVRVVAVQ

SEQ ID NO: 619628 - protein, 9 aa, Homo Sapiens
IPASRLFLG

SEQ ID NO: 619629 - protein, 9 aa, Homo Sapiens
DRSYTGKSL

SEQ ID NO: 619630 - protein, 9 aa, Homo Sapiens
DHWILRGVD

SEQ ID NO: 619631 - protein, 9 aa, Homo Sapiens
RCNPTEAAV

SEQ ID NO: 619632 - protein, 9 aa, Homo Sapiens
GVGEVLASC

SEQ ID NO: 619633 - protein, 9 aa, Homo Sapiens
TGKSLKDLG

SEQ ID NO: 619634 - protein, 9 aa, Homo Sapiens
PGSCILAGV

SEQ ID NO: 619635 - protein, 9 aa, Homo Sapiens
PEPAAILGD

SEQ ID NO: 619636 - protein, 9 aa, Homo Sapiens
PRAALVGVN

SEQ ID NO: 619637 - protein, 9 aa, Homo Sapiens
QLLFCDDCN

SEQ ID NO: 619638 - protein, 9 aa, Homo Sapiens
AKEAGGVAV

SEQ ID NO: 619639 - protein, 9 aa, Homo Sapiens
ASRLFLGPG

SEQ ID NO: 619640 - protein, 9 aa, Homo Sapiens
GIEAGLSSR

SEQ ID NO: 619641 - protein, 9 aa, Homo Sapiens
NPERVPRAA

SEQ ID NO: 619642 - protein, 9 aa, Homo Sapiens
RTPQLLQLQ

SEQ ID NO: 619643 - protein, 9 aa, Homo Sapiens
IHWGPVGVH

SEQ ID NO: 619644 - protein, 9 aa, Homo Sapiens
VGIEAGLSS

SEQ ID NO: 619645 - protein, 9 aa, Homo Sapiens
APAQPMQLG

SEQ ID NO: 619646 - protein, 9 aa, Homo Sapiens
EAGGVAVVT

SEQ ID NO: 619647 - protein, 9 aa, Homo Sapiens
STECAIPAS

SEQ ID NO: 619648 - protein, 9 aa, Homo Sapiens
PKAQGSRVT

SEQ ID NO: 619649 - protein, 9 aa, Homo Sapiens
LGRGTRGAW

SEQ ID NO: 619650 - protein, 9 aa, Homo Sapiens
QAQRCERGQ

SEQ ID NO: 619651 - protein, 9 aa, Homo Sapiens
VGVNPVFPI

SEQ ID NO: 619652 - protein, 9 aa, Homo Sapiens
KNPERVPRA

SEQ ID NO: 619653 - protein, 9 aa, Homo Sapiens
VTRGFVQPG

SEQ ID NO: 619654 - protein, 9 aa, Homo Sapiens
IDAMHGIVG

SEQ ID NO: 619655 - protein, 9 aa, Homo Sapiens
RVPRAALVG

SEQ ID NO: 619656 - protein, 9 aa, Homo Sapiens
IEAGLSSRR

SEQ ID NO: 619657 - protein, 9 aa, Homo Sapiens
RPRRRCNPT

SEQ ID NO: 619658 - protein, 9 aa, Homo Sapiens
GRAQRWDMK

SEQ ID NO: 619659 - protein, 9 aa, Homo Sapiens
MLGLIIWLV

SEQ ID NO: 619660 - protein, 9 aa, Homo Sapiens
LNLVRKSQE

SEQ ID NO: 619661 - protein, 9 aa, Homo Sapiens
QEVQLHDIH

SEQ ID NO: 619662 - protein, 9 aa, Homo Sapiens
HVGELLPST

SEQ ID NO: 619663 - protein, 9 aa, Homo Sapiens
TPFSSLTLN

SEQ ID NO: 619664 - protein, 9 aa, Homo Sapiens
RVTLETNSS

SEQ ID NO: 619665 - protein, 9 aa, Homo Sapiens
LLSIGAKEA

SEQ ID NO: 619666 - protein, 9 aa, Homo Sapiens
SCGTQQFQE

SEQ ID NO: 619667 - protein, 9 aa, Homo Sapiens
LASCGTQQF

SEQ ID NO: 619668 - protein, 9 aa, Homo Sapiens
PVGVHVGEL

SEQ ID NO: 619669 - protein, 9 aa, Homo Sapiens
RDWDEAPAP

SEQ ID NO: 619670 - protein, 9 aa, Homo Sapiens
SAGRTPQLL

SEQ ID NO: 619671 - protein, 9 aa, Homo Sapiens
QFQEVQLHD

SEQ ID NO: 619672 - protein, 9 aa, Homo Sapiens
RGTRGAWWA

SEQ ID NO: 619673 - protein, 9 aa, Homo Sapiens
KAQGSRVTL

SEQ ID NO: 619674 - protein, 9 aa, Homo Sapiens
GAKEAGGVA

SEQ ID NO: 619675 - protein, 9 aa, Homo Sapiens
GSCILAGVG

SEQ ID NO: 619676 - protein, 9 aa, Homo Sapiens
FHDLKLLVG

SEQ ID NO: 619677 - protein, 9 aa, Homo Sapiens
CNRGYHMYC

SEQ ID NO: 619678 - protein, 9 aa, Homo Sapiens
DAMHGIVGP

SEQ ID NO: 619679 - protein, 9 aa, Homo Sapiens
SSTPFSSLT

SEQ ID NO: 619680 - protein, 9 aa, Homo Sapiens
RRCNPTEAA

SEQ ID NO: 619681 - protein, 9 aa, Homo Sapiens
GQHLLQAAL

SEQ ID NO: 619682 - protein, 9 aa, Homo Sapiens
VAHEARALR

SEQ ID NO: 619683 - protein, 9 aa, Homo Sapiens
LQAALHDWK

SEQ ID NO: 619684 - protein, 9 aa, Homo Sapiens
NPVFPIRQV

SEQ ID NO: 619685 - protein, 9 aa, Homo Sapiens
LSFPEPAAI

SEQ ID NO: 619686 - protein, 9 aa, Homo Sapiens
QVRVVAVQL

SEQ ID NO: 619687 - protein, 9 aa, Homo Sapiens
AQRWDMKED

SEQ ID NO: 619688 - protein, 9 aa, Homo Sapiens
CDDCNRGYH

SEQ ID NO: 619689 - protein, 9 aa, Homo Sapiens
AGRTPQLLQ

SEQ ID NO: 619690 - protein, 9 aa, Homo Sapiens
DSGCCRLVE

SEQ ID NO: 619691 - protein, 9 aa, Homo Sapiens
ADSGCCRLV

SEQ ID NO: 619692 - protein, 9 aa, Homo Sapiens
ECAIPASRL

SEQ ID NO: 619693 - protein, 9 aa, Homo Sapiens
PIRQVRVVA

SEQ ID NO: 619694 - protein, 9 aa, Homo Sapiens
LVGIEAGLS

SEQ ID NO: 619695 - protein, 9 aa, Homo Sapiens
MQLGRGTRG

SEQ ID NO: 619696 - protein, 9 aa, Homo Sapiens
VNPVFPIRQ

SEQ ID NO: 619697 - protein, 9 aa, Homo Sapiens
NRGYHMYCL

SEQ ID NO: 619698 - protein, 9 aa, Homo Sapiens
TGAHGPRRP

SEQ ID NO: 619699 - protein, 9 aa, Homo Sapiens
HGIVGPYVK

SEQ ID NO: 619700 - protein, 9 aa, Homo Sapiens
STGAHGPRR

SEQ ID NO: 619701 - protein, 9 aa, Homo Sapiens
AIPASRLFL

SEQ ID NO: 619702 - protein, 9 aa, Homo Sapiens
DGIQKVIDN

SEQ ID NO: 619703 - protein, 9 aa, Homo Sapiens
GIVGPYVKK

SEQ ID NO: 619704 - protein, 9 aa, Homo Sapiens
KERLTGRAQ

SEQ ID NO: 619705 - protein, 9 aa, Homo Sapiens
TRGAWWACR

SEQ ID NO: 619706 - protein, 9 aa, Homo Sapiens
LMLGLIIWL

SEQ ID NO: 619707 - protein, 9 aa, Homo Sapiens
FCDDCNRGY

SEQ ID NO: 619708 - protein, 9 aa, Homo Sapiens
GLSSRREVA

SEQ ID NO: 619709 - protein, 9 aa, Homo Sapiens
SFPEPAAIL

SEQ ID NO: 619710 - protein, 9 aa, Homo Sapiens
CNPTEAAVR

SEQ ID NO: 619711 - protein, 9 aa, Homo Sapiens
ERVPRAALV

SEQ ID NO: 619712 - protein, 9 aa, Homo Sapiens
LTGRAQRWD

SEQ ID NO: 619713 - protein, 9 aa, Homo Sapiens
LLVGIEAGL

SEQ ID NO: 619714 - protein, 9 aa, Homo Sapiens
APAPAQPMQ

SEQ ID NO: 619715 - protein, 9 aa, Homo Sapiens
REVAKNPER

SEQ ID NO: 619716 - protein, 9 aa, Homo Sapiens
LRSAGRTPQ

SEQ ID NO: 619717 - protein, 9 aa, Homo Sapiens
RGFVQPGSC

SEQ ID NO: 619718 - protein, 9 aa, Homo Sapiens
AMHGIVGPY

SEQ ID NO: 619719 - protein, 9 aa, Homo Sapiens
LVGVNPVFP

SEQ ID NO: 619720 - protein, 9 aa, Homo Sapiens
QKVIDNCGM

SEQ ID NO: 619721 - protein, 9 aa, Homo Sapiens
HDIHWGPVG

SEQ ID NO: 619722 - protein, 9 aa, Homo Sapiens
WKRDWDEAP

SEQ ID NO: 619723 - protein, 9 aa, Homo Sapiens
TWEEDLLAG

SEQ ID NO: 619724 - protein, 9 aa, Homo Sapiens
PSTECAIPA

SEQ ID NO: 619725 - protein, 9 aa, Homo Sapiens
GEVLASCGT

SEQ ID NO: 619726 - protein, 9 aa, Homo Sapiens
RIDAMHGIV

SEQ ID NO: 619727 - protein, 9 aa, Homo Sapiens
QLLSIGAKE

SEQ ID NO: 619728 - protein, 9 aa, Homo Sapiens
FVQPGSCIL

SEQ ID NO: 619729 - protein, 9 aa, Homo Sapiens
AQPMQLGRG

SEQ ID NO: 619730 - protein, 9 aa, Homo Sapiens
LSIGAKEAG

SEQ ID NO: 619731 - protein, 9 aa, Homo Sapiens
VIILMLGLI

SEQ ID NO: 619732 - protein, 9 aa, Homo Sapiens
FQEVQLHDI

SEQ ID NO: 619733 - protein, 9 aa, Homo Sapiens
RVVAVQLVA

SEQ ID NO: 619734 - protein, 9 aa, Homo Sapiens
AHEARALRS

SEQ ID NO: 619735 - protein, 9 aa, Homo Sapiens
EARALRSAG

SEQ ID NO: 619736 - protein, 9 aa, Homo Sapiens
QHLLQAALH

SEQ ID NO: 619737 - protein, 9 aa, Homo Sapiens
ACRSSVSTG

SEQ ID NO: 619738 - protein, 9 aa, Homo Sapiens
AGVGEVLAS

SEQ ID NO: 619739 - protein, 9 aa, Homo Sapiens
AAILGDADS

SEQ ID NO: 619740 - protein, 9 aa, Homo Sapiens
GPVGVHVGE

SEQ ID NO: 619741 - protein, 9 aa, Homo Sapiens
KILNLVRKS

SEQ ID NO: 619742 - protein, 9 aa, Homo Sapiens
ERGQHLLQA

SEQ ID NO: 619743 - protein, 9 aa, Homo Sapiens
GFVQPGSCI

SEQ ID NO: 619744 - protein, 9 aa, Homo Sapiens
VFPIRQVRV

SEQ ID NO: 619745 - protein, 9 aa, Homo Sapiens
SQPQQKDLQ

SEQ ID NO: 619746 - protein, 9 aa, Homo Sapiens
GFLAPAYIY

SEQ ID NO: 619747 - protein, 9 aa, Homo Sapiens
GIQRVSIQG

SEQ ID NO: 619748 - protein, 9 aa, Homo Sapiens
IDAFMGFLA

SEQ ID NO: 619749 - protein, 9 aa, Homo Sapiens
SVFTLKKGR

SEQ ID NO: 619750 - protein, 9 aa, Homo Sapiens
LGKKMRAIL

SEQ ID NO: 619751 - protein, 9 aa, Homo Sapiens
QERGEEKGT

SEQ ID NO: 619752 - protein, 9 aa, Homo Sapiens
VNVAESLSR

SEQ ID NO: 619753 - protein, 9 aa, Homo Sapiens
QPACHENHE

SEQ ID NO: 619754 - protein, 9 aa, Homo Sapiens
LVNIHVTEM

SEQ ID NO: 619755 - protein, 9 aa, Homo Sapiens
HFIHNAKRA

SEQ ID NO: 619756 - protein, 9 aa, Homo Sapiens
EPALRGEAA

SEQ ID NO: 619757 - protein, 9 aa, Homo Sapiens
TPLKTLQKW

SEQ ID NO: 619758 - protein, 9 aa, Homo Sapiens
YLKYSSLLA

SEQ ID NO: 619759 - protein, 9 aa, Homo Sapiens
WLEPALRGE

SEQ ID NO: 619760 - protein, 9 aa, Homo Sapiens
PKEVTGCKT

SEQ ID NO: 619761 - protein, 9 aa, Homo Sapiens
LDEENSELW

SEQ ID NO: 619762 - protein, 9 aa, Homo Sapiens
SWRSASCCW

SEQ ID NO: 619763 - protein, 9 aa, Homo Sapiens
NPTSRSLLN

SEQ ID NO: 619764 - protein, 9 aa, Homo Sapiens
KDSNQEVYN

SEQ ID NO: 619765 - protein, 9 aa, Homo Sapiens
ASAASPCRA

SEQ ID NO: 619766 - protein, 9 aa, Homo Sapiens
FQKVFAHIF

SEQ ID NO: 619767 - protein, 9 aa, Homo Sapiens
HDDLKEDPL

SEQ ID NO: 619768 - protein, 9 aa, Homo Sapiens
CHATLDVDG

SEQ ID NO: 619769 - protein, 9 aa, Homo Sapiens
SACGSHLTL

SEQ ID NO: 619770 - protein, 9 aa, Homo Sapiens
RSCRRRSRS

SEQ ID NO: 619771 - protein, 9 aa, Homo Sapiens
KREQKGTVS

SEQ ID NO: 619772 - protein, 9 aa, Homo Sapiens
VQDAGPLLV

SEQ ID NO: 619773 - protein, 9 aa, Homo Sapiens
PSHQVILEA

SEQ ID NO: 619774 - protein, 9 aa, Homo Sapiens
TDGIIRVGS

SEQ ID NO: 619775 - protein, 9 aa, Homo Sapiens
GIIRVGSTA

SEQ ID NO: 619776 - protein, 9 aa, Homo Sapiens
HHEHCSDSD

SEQ ID NO: 619777 - protein, 9 aa, Homo Sapiens
GKKMRAILW

SEQ ID NO: 619778 - protein, 9 aa, Homo Sapiens
PVGGSPVGC

SEQ ID NO: 619779 - protein, 9 aa, Homo Sapiens
PSMEATGCE

SEQ ID NO: 619780 - protein, 9 aa, Homo Sapiens
TLKLRCQPA

SEQ ID NO: 619781 - protein, 9 aa, Homo Sapiens
PGHRSPGSG

SEQ ID NO: 619782 - protein, 9 aa, Homo Sapiens
SCSGSCRRA

SEQ ID NO: 619783 - protein, 9 aa, Homo Sapiens
AESLSRESD

SEQ ID NO: 619784 - protein, 9 aa, Homo Sapiens
EQKGTVSCA

SEQ ID NO: 619785 - protein, 9 aa, Homo Sapiens
DPASAASPC

SEQ ID NO: 619786 - protein, 9 aa, Homo Sapiens
TGVSRETSS

SEQ ID NO: 619787 - protein, 9 aa, Homo Sapiens
AGIQRVSIQ

SEQ ID NO: 619788 - protein, 9 aa, Homo Sapiens
QPQQKDLQQ

SEQ ID NO: 619789 - protein, 9 aa, Homo Sapiens
PSQPQQKDL

SEQ ID NO: 619790 - protein, 9 aa, Homo Sapiens
LKTLQKWAQ

SEQ ID NO: 619791 - protein, 9 aa, Homo Sapiens
PRGTCSPSG

SEQ ID NO: 619792 - protein, 9 aa, Homo Sapiens
RSPGSGHVA

SEQ ID NO: 619793 - protein, 9 aa, Homo Sapiens
LKLRCQPAM

SEQ ID NO: 619794 - protein, 9 aa, Homo Sapiens
GSGSQERGE

SEQ ID NO: 619795 - protein, 9 aa, Homo Sapiens
NGVQDAGPL

SEQ ID NO: 619796 - protein, 9 aa, Homo Sapiens
GPAKAVAKA

SEQ ID NO: 619797 - protein, 9 aa, Homo Sapiens
SGSQERGEE

SEQ ID NO: 619798 - protein, 9 aa, Homo Sapiens
VSCAGIRRS

SEQ ID NO: 619799 - protein, 9 aa, Homo Sapiens
RSCSGSCRR

SEQ ID NO: 619800 - protein, 9 aa, Homo Sapiens
DDRRSFFCH

SEQ ID NO: 619801 - protein, 9 aa, Homo Sapiens
SPGSGHVAK

SEQ ID NO: 619802 - protein, 9 aa, Homo Sapiens
ASCCWPRGT

SEQ ID NO: 619803 - protein, 9 aa, Homo Sapiens
YSKTRVTPV

SEQ ID NO: 619804 - protein, 9 aa, Homo Sapiens
LRRAKDSNQ

SEQ ID NO: 619805 - protein, 9 aa, Homo Sapiens
LLFTCVFCR

SEQ ID NO: 619806 - protein, 9 aa, Homo Sapiens
SPSGSSPSC

SEQ ID NO: 619807 - protein, 9 aa, Homo Sapiens
LHDLGRFNG

SEQ ID NO: 619808 - protein, 9 aa, Homo Sapiens
GTCSPSGSS

SEQ ID NO: 619809 - protein, 9 aa, Homo Sapiens
VPRLHDLGR

SEQ ID NO: 619810 - protein, 9 aa, Homo Sapiens
GCEKSSTPI

SEQ ID NO: 619811 - protein, 9 aa, Homo Sapiens
GLLGDQGLE

SEQ ID NO: 619812 - protein, 9 aa, Homo Sapiens
DEENSELWS

SEQ ID NO: 619813 - protein, 9 aa, Homo Sapiens
NVTSVSGSA

SEQ ID NO: 619814 - protein, 9 aa, Homo Sapiens
EIKINLEKL

SEQ ID NO: 619815 - protein, 9 aa, Homo Sapiens
LPKEVTGCK

SEQ ID NO: 619816 - protein, 9 aa, Homo Sapiens
AHMWQLLVR

SEQ ID NO: 619817 - protein, 9 aa, Homo Sapiens
EGLLFTCVF

SEQ ID NO: 619818 - protein, 9 aa, Homo Sapiens
THPKEGLLF

SEQ ID NO: 619819 - protein, 9 aa, Homo Sapiens
DLQQPAQQQ

SEQ ID NO: 619820 - protein, 9 aa, Homo Sapiens
WNGVQDAGP

SEQ ID NO: 619821 - protein, 9 aa, Homo Sapiens
GATRRHSAS

SEQ ID NO: 619822 - protein, 9 aa, Homo Sapiens
ISQHYSKTR

SEQ ID NO: 619823 - protein, 9 aa, Homo Sapiens
LAPAYIYEI

SEQ ID NO: 619824 - protein, 9 aa, Homo Sapiens
HMRETSVFT

SEQ ID NO: 619825 - protein, 9 aa, Homo Sapiens
DLRRAKDSN

SEQ ID NO: 619826 - protein, 9 aa, Homo Sapiens
PHHEHCSDS

SEQ ID NO: 619827 - protein, 9 aa, Homo Sapiens
VSRETSSDV

SEQ ID NO: 619828 - protein, 9 aa, Homo Sapiens
NIHVTEMES

SEQ ID NO: 619829 - protein, 9 aa, Homo Sapiens
YHVEEQWQK

SEQ ID NO: 619830 - protein, 9 aa, Homo Sapiens
GSVPRLHDL

SEQ ID NO: 619831 - protein, 9 aa, Homo Sapiens
ALRGEAAPG

SEQ ID NO: 619832 - protein, 9 aa, Homo Sapiens
FSACGSHLT

SEQ ID NO: 619833 - protein, 9 aa, Homo Sapiens
ECMTGYAGD

SEQ ID NO: 619834 - protein, 9 aa, Homo Sapiens
KNFVVIMVT

SEQ ID NO: 619835 - protein, 9 aa, Homo Sapiens
EEQWQKEYL

SEQ ID NO: 619836 - protein, 9 aa, Homo Sapiens
SAYDNTEND

SEQ ID NO: 619837 - protein, 9 aa, Homo Sapiens
TSVSGSASG

SEQ ID NO: 619838 - protein, 9 aa, Homo Sapiens
TPAKLPAKQ

SEQ ID NO: 619839 - protein, 9 aa, Homo Sapiens
CPHHEHCSD

SEQ ID NO: 619840 - protein, 9 aa, Homo Sapiens
SLLAAFIIE

SEQ ID NO: 619841 - protein, 9 aa, Homo Sapiens
PPGRMDPLA

SEQ ID NO: 619842 - protein, 9 aa, Homo Sapiens
EVDAVDTGV

SEQ ID NO: 619843 - protein, 9 aa, Homo Sapiens
KLRCQPAMA

SEQ ID NO: 619844 - protein, 9 aa, Homo Sapiens
DTLKSAYDN

SEQ ID NO: 619845 - protein, 9 aa, Homo Sapiens
QDGCLPKEV

SEQ ID NO: 619846 - protein, 9 aa, Homo Sapiens
YSVNVAESL

SEQ ID NO: 619847 - protein, 9 aa, Homo Sapiens
YSSLLAAFI

SEQ ID NO: 619848 - protein, 9 aa, Homo Sapiens
DQDGCLPKE

SEQ ID NO: 619849 - protein, 9 aa, Homo Sapiens
FHTHRSLFK

SEQ ID NO: 619850 - protein, 9 aa, Homo Sapiens
GCLPKEVTG

SEQ ID NO: 619851 - protein, 9 aa, Homo Sapiens
GREWGLLGD

SEQ ID NO: 619852 - protein, 9 aa, Homo Sapiens
KMRAILWTM

SEQ ID NO: 619853 - protein, 9 aa, Homo Sapiens
WPRGTCSPS

SEQ ID NO: 619854 - protein, 9 aa, Homo Sapiens
PPASGLESG

SEQ ID NO: 619855 - protein, 9 aa, Homo Sapiens
CHENHERPF

SEQ ID NO: 619856 - protein, 9 aa, Homo Sapiens
KEIKINLEK

SEQ ID NO: 619857 - protein, 9 aa, Homo Sapiens
LSRESDISL

SEQ ID NO: 619858 - protein, 9 aa, Homo Sapiens
SWRSCRRRS

SEQ ID NO: 619859 - protein, 9 aa, Homo Sapiens
IHNAKRAHQ

SEQ ID NO: 619860 - protein, 9 aa, Homo Sapiens
TRRHSASHD

SEQ ID NO: 619861 - protein, 9 aa, Homo Sapiens
GKTYHVEEQ

SEQ ID NO: 619862 - protein, 9 aa, Homo Sapiens
RSFFCHATL

SEQ ID NO: 619863 - protein, 9 aa, Homo Sapiens
VFAHIFPQW

SEQ ID NO: 619864 - protein, 9 aa, Homo Sapiens
AAPRVFPLA

SEQ ID NO: 619865 - protein, 9 aa, Homo Sapiens
IQRVSIQGG

SEQ ID NO: 619866 - protein, 9 aa, Homo Sapiens
PKEGLLFTC

SEQ ID NO: 619867 - protein, 9 aa, Homo Sapiens
SRSLLNAVD

SEQ ID NO: 619868 - protein, 9 aa, Homo Sapiens
SNQEVYNFL

SEQ ID NO: 619869 - protein, 9 aa, Homo Sapiens
HYSKTRVTP

SEQ ID NO: 619870 - protein, 9 aa, Homo Sapiens
FFCHATLDV

SEQ ID NO: 619871 - protein, 9 aa, Homo Sapiens
LWSCTPCLK

SEQ ID NO: 619872 - protein, 9 aa, Homo Sapiens
SCCWPRGTC

SEQ ID NO: 619873 - protein, 9 aa, Homo Sapiens
KYDEPSHQV

SEQ ID NO: 619874 - protein, 9 aa, Homo Sapiens
KLPAKQREQ

SEQ ID NO: 619875 - protein, 9 aa, Homo Sapiens
PPADPASAA

SEQ ID NO: 619876 - protein, 9 aa, Homo Sapiens
KINLEKLID

SEQ ID NO: 619877 - protein, 9 aa, Homo Sapiens
RRSRSSCRR

SEQ ID NO: 619878 - protein, 9 aa, Homo Sapiens
QKDLQQPAQ

SEQ ID NO: 619879 - protein, 9 aa, Homo Sapiens
CPPASGLES

SEQ ID NO: 619880 - protein, 9 aa, Homo Sapiens
TLNPTSRSL

SEQ ID NO: 619881 - protein, 9 aa, Homo Sapiens
RRRSSWRSA

SEQ ID NO: 619882 - protein, 9 aa, Homo Sapiens
KDLQQPAQQ

SEQ ID NO: 619883 - protein, 9 aa, Homo Sapiens
SEYLKYSSL

SEQ ID NO: 619884 - protein, 9 aa, Homo Sapiens
KEVTGCKTV

SEQ ID NO: 619885 - protein, 9 aa, Homo Sapiens
SAASPCRAA

SEQ ID NO: 619886 - protein, 9 aa, Homo Sapiens
YQLVNIHVT

SEQ ID NO: 619887 - protein, 9 aa, Homo Sapiens
LGRFNGSLR

SEQ ID NO: 619888 - protein, 9 aa, Homo Sapiens
DGKTYHVEE

SEQ ID NO: 619889 - protein, 9 aa, Homo Sapiens
QKTHPKEGL

SEQ ID NO: 619890 - protein, 9 aa, Homo Sapiens
PSCSAEPRL

SEQ ID NO: 619891 - protein, 9 aa, Homo Sapiens
LGFQIKKKN

SEQ ID NO: 619892 - protein, 9 aa, Homo Sapiens
DTGVSRETS

SEQ ID NO: 619893 - protein, 9 aa, Homo Sapiens
CAGIRRSWR

SEQ ID NO: 619894 - protein, 9 aa, Homo Sapiens
DPNTCLAVF

SEQ ID NO: 619895 - protein, 9 aa, Homo Sapiens
SQHYSKTRV

SEQ ID NO: 619896 - protein, 9 aa, Homo Sapiens
VHNVTSVSG

SEQ ID NO: 619897 - protein, 9 aa, Homo Sapiens
SSCRRRSSW

SEQ ID NO: 619898 - protein, 9 aa, Homo Sapiens
RELGATRRH

SEQ ID NO: 619899 - protein, 9 aa, Homo Sapiens
LVRFRSCSG

SEQ ID NO: 619900 - protein, 9 aa, Homo Sapiens
LEKLIDVQK

SEQ ID NO: 619901 - protein, 9 aa, Homo Sapiens
HTHRSLFKH

SEQ ID NO: 619902 - protein, 9 aa, Homo Sapiens
WGLLGDQGL

SEQ ID NO: 619903 - protein, 9 aa, Homo Sapiens
EPSHQVILE

SEQ ID NO: 619904 - protein, 9 aa, Homo Sapiens
GLGGEAVGT

SEQ ID NO: 619905 - protein, 9 aa, Homo Sapiens
DNTENDLKG

SEQ ID NO: 619906 - protein, 9 aa, Homo Sapiens
VVIMVTKPK

SEQ ID NO: 619907 - protein, 9 aa, Homo Sapiens
RMDPLAPQP

SEQ ID NO: 619908 - protein, 9 aa, Homo Sapiens
AGIRRSWRS

SEQ ID NO: 619909 - protein, 9 aa, Homo Sapiens
SSRLSSSSS

SEQ ID NO: 619910 - protein, 9 aa, Homo Sapiens
EGSGSQERG

SEQ ID NO: 619911 - protein, 9 aa, Homo Sapiens
LLFQKVFAH

SEQ ID NO: 619912 - protein, 9 aa, Homo Sapiens
APAYIYEIC

SEQ ID NO: 619913 - protein, 9 aa, Homo Sapiens
CRELGATRR

SEQ ID NO: 619914 - protein, 9 aa, Homo Sapiens
NFVVIMVTK

SEQ ID NO: 619915 - protein, 9 aa, Homo Sapiens
RKREQKGTV

SEQ ID NO: 619916 - protein, 9 aa, Homo Sapiens
SGRNLTPAK

SEQ ID NO: 619917 - protein, 9 aa, Homo Sapiens
RVFPLAWTV

SEQ ID NO: 619918 - protein, 9 aa, Homo Sapiens
RAKDSNQEV

SEQ ID NO: 619919 - protein, 9 aa, Homo Sapiens
ESLSRESDI

SEQ ID NO: 619920 - protein, 9 aa, Homo Sapiens
GGEAVGTGE

SEQ ID NO: 619921 - protein, 9 aa, Homo Sapiens
PAKAVAKAP

SEQ ID NO: 619922 - protein, 9 aa, Homo Sapiens
ELVRFRSCS

SEQ ID NO: 619923 - protein, 9 aa, Homo Sapiens
LRGPAKAVA

SEQ ID NO: 619924 - protein, 9 aa, Homo Sapiens
SSCQKAFSA

SEQ ID NO: 619925 - protein, 9 aa, Homo Sapiens
KTYHVEEQW

SEQ ID NO: 619926 - protein, 9 aa, Homo Sapiens
QGAGIQRVS

SEQ ID NO: 619927 - protein, 9 aa, Homo Sapiens
VAKAPRPPG

SEQ ID NO: 619928 - protein, 9 aa, Homo Sapiens
KYSSLLAAF

SEQ ID NO: 619929 - protein, 9 aa, Homo Sapiens
RFRSCSGSC

SEQ ID NO: 619930 - protein, 9 aa, Homo Sapiens
TSRSLLNAV

SEQ ID NO: 619931 - protein, 9 aa, Homo Sapiens
QHYSKTRVT

SEQ ID NO: 619932 - protein, 9 aa, Homo Sapiens
FMGFLAPAY

SEQ ID NO: 619933 - protein, 9 aa, Homo Sapiens
LTPAKLPAK

SEQ ID NO: 619934 - protein, 9 aa, Homo Sapiens
CRRRSRSSC

SEQ ID NO: 619935 - protein, 9 aa, Homo Sapiens
TLQKWAQLA

SEQ ID NO: 619936 - protein, 9 aa, Homo Sapiens
GSGHVAKMP

SEQ ID NO: 619937 - protein, 9 aa, Homo Sapiens
LNPTSRSLL

SEQ ID NO: 619938 - protein, 9 aa, Homo Sapiens
LRGEAAPGQ

SEQ ID NO: 619939 - protein, 9 aa, Homo Sapiens
SCQKAFSAC

SEQ ID NO: 619940 - protein, 9 aa, Homo Sapiens
YDNTENDLK

SEQ ID NO: 619941 - protein, 9 aa, Homo Sapiens
RCECMTGYA

SEQ ID NO: 619942 - protein, 9 aa, Homo Sapiens
VIMVTKPKA

SEQ ID NO: 619943 - protein, 9 aa, Homo Sapiens
HPGLGGEAV

SEQ ID NO: 619944 - protein, 9 aa, Homo Sapiens
NSELWSCTP

SEQ ID NO: 619945 - protein, 9 aa, Homo Sapiens
GVSRETSSD

SEQ ID NO: 619946 - protein, 9 aa, Homo Sapiens
DSNQEVYNF

SEQ ID NO: 619947 - protein, 9 aa, Homo Sapiens
PASAASPCR

SEQ ID NO: 619948 - protein, 9 aa, Homo Sapiens
CWPRGTCSP

SEQ ID NO: 619949 - protein, 9 aa, Homo Sapiens
AYDNTENDL

SEQ ID NO: 619950 - protein, 9 aa, Homo Sapiens
PLKTLQKWA

SEQ ID NO: 619951 - protein, 9 aa, Homo Sapiens
EITPLKTLQ

SEQ ID NO: 619952 - protein, 9 aa, Homo Sapiens
EEQEGSGSQ

SEQ ID NO: 619953 - protein, 9 aa, Homo Sapiens
SISQHYSKT

SEQ ID NO: 619954 - protein, 9 aa, Homo Sapiens
GRTREAWKM

SEQ ID NO: 619955 - protein, 9 aa, Homo Sapiens
YDEPSHQVI

SEQ ID NO: 619956 - protein, 9 aa, Homo Sapiens
KEGLLFTCV

SEQ ID NO: 619957 - protein, 9 aa, Homo Sapiens
VDAVDTGVS

SEQ ID NO: 619958 - protein, 9 aa, Homo Sapiens
LLTDGIIRV

SEQ ID NO: 619959 - protein, 9 aa, Homo Sapiens
KSAYDNTEN

SEQ ID NO: 619960 - protein, 9 aa, Homo Sapiens
TSVFTLKKG

SEQ ID NO: 619961 - protein, 9 aa, Homo Sapiens
LGATRRHSA

SEQ ID NO: 619962 - protein, 9 aa, Homo Sapiens
QKAFSACGS

SEQ ID NO: 619963 - protein, 9 aa, Homo Sapiens
HPKEGLLFT

SEQ ID NO: 619964 - protein, 9 aa, Homo Sapiens
ATRRHSASH

SEQ ID NO: 619965 - protein, 9 aa, Homo Sapiens
CLAVFGLSL

SEQ ID NO: 619966 - protein, 9 aa, Homo Sapiens
QEGSGSQER

SEQ ID NO: 619967 - protein, 9 aa, Homo Sapiens
IIRVGSTAS

SEQ ID NO: 619968 - protein, 9 aa, Homo Sapiens
DRRSFFCHA

SEQ ID NO: 619969 - protein, 9 aa, Homo Sapiens
SLSRESDIS

SEQ ID NO: 619970 - protein, 9 aa, Homo Sapiens
GMQGAGIQR

SEQ ID NO: 619971 - protein, 9 aa, Homo Sapiens
PTSRSLLNA

SEQ ID NO: 619972 - protein, 9 aa, Homo Sapiens
KTRVTPVEV

SEQ ID NO: 619973 - protein, 9 aa, Homo Sapiens
SHQVILEAL

SEQ ID NO: 619974 - protein, 9 aa, Homo Sapiens
EHPGLGGEA

SEQ ID NO: 619975 - protein, 9 aa, Homo Sapiens
FAHIFPQWR

SEQ ID NO: 619976 - protein, 9 aa, Homo Sapiens
RETSVFTLK

SEQ ID NO: 619977 - protein, 9 aa, Homo Sapiens
AFMGFLAPA

SEQ ID NO: 619978 - protein, 9 aa, Homo Sapiens
KPPADPASA

SEQ ID NO: 619979 - protein, 9 aa, Homo Sapiens
CSSRLSSSS

SEQ ID NO: 619980 - protein, 9 aa, Homo Sapiens
PASGLESGV

SEQ ID NO: 619981 - protein, 9 aa, Homo Sapiens
PPVHNVTSV

SEQ ID NO: 619982 - protein, 9 aa, Homo Sapiens
NLTPAKLPA

SEQ ID NO: 619983 - protein, 9 aa, Homo Sapiens
CMTGYAGDN

SEQ ID NO: 619984 - protein, 9 aa, Homo Sapiens
CRRRSSWRS

SEQ ID NO: 619985 - protein, 9 aa, Homo Sapiens
EYLKYSSLL

SEQ ID NO: 619986 - protein, 9 aa, Homo Sapiens
DDLKEDPLL

SEQ ID NO: 619987 - protein, 9 aa, Homo Sapiens
SPVGCLSDV

SEQ ID NO: 619988 - protein, 9 aa, Homo Sapiens
ACGSHLTLV

SEQ ID NO: 619989 - protein, 9 aa, Homo Sapiens
RTREAWKML

SEQ ID NO: 619990 - protein, 9 aa, Homo Sapiens
LKEDPLLDQ

SEQ ID NO: 619991 - protein, 9 aa, Homo Sapiens
NCLLRFHTH

SEQ ID NO: 619992 - protein, 9 aa, Homo Sapiens
HNAHMWQLL

SEQ ID NO: 619993 - protein, 9 aa, Homo Sapiens
HMWQLLVRV

SEQ ID NO: 619994 - protein, 9 aa, Homo Sapiens
ILWTMKKKV

SEQ ID NO: 619995 - protein, 9 aa, Homo Sapiens
KLFSLTPPL

SEQ ID NO: 619996 - protein, 9 aa, Homo Sapiens
IDEKNFVVI

SEQ ID NO: 619997 - protein, 9 aa, Homo Sapiens
REWGLLGDQ

SEQ ID NO: 619998 - protein, 9 aa, Homo Sapiens
LWTMKKKVG

SEQ ID NO: 619999 - protein, 9 aa, Homo Sapiens
QQKDLQQPA

SEQ ID NO: 620000 - protein, 9 aa, Homo Sapiens
QLVNIHVTE

SEQ ID NO: 620001 - protein, 9 aa, Homo Sapiens
DGPRCECMT

SEQ ID NO: 620002 - protein, 9 aa, Homo Sapiens
EENSELWSC

SEQ ID NO: 620003 - protein, 9 aa, Homo Sapiens
MDPLAPQPR

SEQ ID NO: 620004 - protein, 9 aa, Homo Sapiens
VSGSASGSA

SEQ ID NO: 620005 - protein, 9 aa, Homo Sapiens
GGGREWGLL

SEQ ID NO: 620006 - protein, 9 aa, Homo Sapiens
KTHPKEGLL

SEQ ID NO: 620007 - protein, 9 aa, Homo Sapiens
DPLAPQPRA

SEQ ID NO: 620008 - protein, 9 aa, Homo Sapiens
AKAVAKAPR

SEQ ID NO: 620009 - protein, 9 aa, Homo Sapiens
FCHATLDVD

SEQ ID NO: 620010 - protein, 9 aa, Homo Sapiens
VDTGVSRET

SEQ ID NO: 620011 - protein, 9 aa, Homo Sapiens
GSSPSCSAE

SEQ ID NO: 620012 - protein, 9 aa, Homo Sapiens
STLNPTSRS

SEQ ID NO: 620013 - protein, 9 aa, Homo Sapiens
GRMDPLAPQ

SEQ ID NO: 620014 - protein, 9 aa, Homo Sapiens
VFTLKKGRS

SEQ ID NO: 620015 - protein, 9 aa, Homo Sapiens
DELVRFRSC

SEQ ID NO: 620016 - protein, 9 aa, Homo Sapiens
EHCSDSDGL

SEQ ID NO: 620017 - protein, 9 aa, Homo Sapiens
FLRAGRTRE

SEQ ID NO: 620018 - protein, 9 aa, Homo Sapiens
PGSGHVAKM

SEQ ID NO: 620019 - protein, 9 aa, Homo Sapiens
NAHMWQLLV

SEQ ID NO: 620020 - protein, 9 aa, Homo Sapiens
RDQDGCLPK

SEQ ID NO: 620021 - protein, 9 aa, Homo Sapiens
RSLLNAVDG

SEQ ID NO: 620022 - protein, 9 aa, Homo Sapiens
KEDPLLDQR

SEQ ID NO: 620023 - protein, 9 aa, Homo Sapiens
KVFAHIFPQ

SEQ ID NO: 620024 - protein, 9 aa, Homo Sapiens
ENSELWSCT

SEQ ID NO: 620025 - protein, 9 aa, Homo Sapiens
AKDSNQEVY

SEQ ID NO: 620026 - protein, 9 aa, Homo Sapiens
PPPGRMDPL

SEQ ID NO: 620027 - protein, 9 aa, Homo Sapiens
ENHERPFYQ

SEQ ID NO: 620028 - protein, 9 aa, Homo Sapiens
LRAGRTREA

SEQ ID NO: 620029 - protein, 9 aa, Homo Sapiens
NPDPNTCLA

SEQ ID NO: 620030 - protein, 9 aa, Homo Sapiens
VKEIKINLE

SEQ ID NO: 620031 - protein, 9 aa, Homo Sapiens
GIRRSWRSC

SEQ ID NO: 620032 - protein, 9 aa, Homo Sapiens
CSPSGSSPS

SEQ ID NO: 620033 - protein, 9 aa, Homo Sapiens
CLSDVRVIV

SEQ ID NO: 620034 - protein, 9 aa, Homo Sapiens
CLLRFHTHR

SEQ ID NO: 620035 - protein, 9 aa, Homo Sapiens
RHSASHDKD

SEQ ID NO: 620036 - protein, 9 aa, Homo Sapiens
RRAKDSNQE

SEQ ID NO: 620037 - protein, 9 aa, Homo Sapiens
GSQERGEEK

SEQ ID NO: 620038 - protein, 9 aa, Homo Sapiens
SSPSCSAEP

SEQ ID NO: 620039 - protein, 9 aa, Homo Sapiens
PLAPQPRAE

SEQ ID NO: 620040 - protein, 9 aa, Homo Sapiens
SSKYDEPSH

SEQ ID NO: 620041 - protein, 9 aa, Homo Sapiens
SCRRRSRSS

SEQ ID NO: 620042 - protein, 9 aa, Homo Sapiens
GLLFTCVFC

SEQ ID NO: 620043 - protein, 9 aa, Homo Sapiens
VVVSHNAHM

SEQ ID NO: 620044 - protein, 9 aa, Homo Sapiens
SQERGEEKG

SEQ ID NO: 620045 - protein, 9 aa, Homo Sapiens
GVQDAGPLL

SEQ ID NO: 620046 - protein, 9 aa, Homo Sapiens
PVGCLSDVR

SEQ ID NO: 620047 - protein, 9 aa, Homo Sapiens
TGYAGDNCS

SEQ ID NO: 620048 - protein, 9 aa, Homo Sapiens
EATGCEKSS

SEQ ID NO: 620049 - protein, 9 aa, Homo Sapiens
ELWSCTPCL

SEQ ID NO: 620050 - protein, 9 aa, Homo Sapiens
VSHNAHMWQ

SEQ ID NO: 620051 - protein, 9 aa, Homo Sapiens
HVEEQWQKE

SEQ ID NO: 620052 - protein, 9 aa, Homo Sapiens
EDPLLDQRR

SEQ ID NO: 620053 - protein, 9 aa, Homo Sapiens
RSWRSCRRR

SEQ ID NO: 620054 - protein, 9 aa, Homo Sapiens
ENCLLRFHT

SEQ ID NO: 620055 - protein, 9 aa, Homo Sapiens
KAFSACGSH

SEQ ID NO: 620056 - protein, 9 aa, Homo Sapiens
HNAKRAHQL

SEQ ID NO: 620057 - protein, 9 aa, Homo Sapiens
SGGCPPASG

SEQ ID NO: 620058 - protein, 9 aa, Homo Sapiens
SFFCHATLD

SEQ ID NO: 620059 - protein, 9 aa, Homo Sapiens
PDPNTCLAV

SEQ ID NO: 620060 - protein, 9 aa, Homo Sapiens
GHSAAPRVF

SEQ ID NO: 620061 - protein, 9 aa, Homo Sapiens
RLSSSSSSS

SEQ ID NO: 620062 - protein, 9 aa, Homo Sapiens
NTENDLKGA

SEQ ID NO: 620063 - protein, 9 aa, Homo Sapiens
LKLFSLTPP

SEQ ID NO: 620064 - protein, 9 aa, Homo Sapiens
TREAWKMLG

SEQ ID NO: 620065 - protein, 9 aa, Homo Sapiens
TRVTPVEVM

SEQ ID NO: 620066 - protein, 9 aa, Homo Sapiens
ATLKLRCQP

SEQ ID NO: 620067 - protein, 9 aa, Homo Sapiens
NVAESLSRE

SEQ ID NO: 620068 - protein, 9 aa, Homo Sapiens
ASGLESGVG

SEQ ID NO: 620069 - protein, 9 aa, Homo Sapiens
PGPGHRSPG

SEQ ID NO: 620070 - protein, 9 aa, Homo Sapiens
LGSTYQLVN

SEQ ID NO: 620071 - protein, 9 aa, Homo Sapiens
RRCPHHEHC

SEQ ID NO: 620072 - protein, 9 aa, Homo Sapiens
ACHENHERP

SEQ ID NO: 620073 - protein, 9 aa, Homo Sapiens
LFLRAGRTR

SEQ ID NO: 620074 - protein, 9 aa, Homo Sapiens
SRLLTDGII

SEQ ID NO: 620075 - protein, 9 aa, Homo Sapiens
VFPLAWTVL

SEQ ID NO: 620076 - protein, 9 aa, Homo Sapiens
LLRFHTHRS

SEQ ID NO: 620077 - protein, 9 aa, Homo Sapiens
HNVTSVSGS

SEQ ID NO: 620078 - protein, 9 aa, Homo Sapiens
MQGAGIQRV

SEQ ID NO: 620079 - protein, 9 aa, Homo Sapiens
SVNVAESLS

SEQ ID NO: 620080 - protein, 9 aa, Homo Sapiens
GCPPASGLE

SEQ ID NO: 620081 - protein, 9 aa, Homo Sapiens
LGGEAVGTG

SEQ ID NO: 620082 - protein, 9 aa, Homo Sapiens
SGLESGVGA

SEQ ID NO: 620083 - protein, 9 aa, Homo Sapiens
IRVGSTASK

SEQ ID NO: 620084 - protein, 9 aa, Homo Sapiens
NTCLAVFGL

SEQ ID NO: 620085 - protein, 9 aa, Homo Sapiens
REAWKMLGL

SEQ ID NO: 620086 - protein, 9 aa, Homo Sapiens
PRCECMTGY

SEQ ID NO: 620087 - protein, 9 aa, Homo Sapiens
GHRSPGSGH

SEQ ID NO: 620088 - protein, 9 aa, Homo Sapiens
SGSSPSCSA

SEQ ID NO: 620089 - protein, 9 aa, Homo Sapiens
MRAILWTMK

SEQ ID NO: 620090 - protein, 9 aa, Homo Sapiens
TYHVEEQWQ

SEQ ID NO: 620091 - protein, 9 aa, Homo Sapiens
SELWSCTPC

SEQ ID NO: 620092 - protein, 9 aa, Homo Sapiens
VRRCPHHEH

SEQ ID NO: 620093 - protein, 9 aa, Homo Sapiens
LRTWLEPAL

SEQ ID NO: 620094 - protein, 9 aa, Homo Sapiens
TPQEHPGLG

SEQ ID NO: 620095 - protein, 9 aa, Homo Sapiens
RGTCSPSGS

SEQ ID NO: 620096 - protein, 9 aa, Homo Sapiens
HQVILEALA

SEQ ID NO: 620097 - protein, 9 aa, Homo Sapiens
RLHDLGRFN

SEQ ID NO: 620098 - protein, 9 aa, Homo Sapiens
REQKGTVSC

SEQ ID NO: 620099 - protein, 9 aa, Homo Sapiens
AGRTREAWK

SEQ ID NO: 620100 - protein, 9 aa, Homo Sapiens
DGCLPKEVT

SEQ ID NO: 620101 - protein, 9 aa, Homo Sapiens
ADPASAASP

SEQ ID NO: 620102 - protein, 9 aa, Homo Sapiens
PVHNVTSVS

SEQ ID NO: 620103 - protein, 9 aa, Homo Sapiens
TLKSAYDNT

SEQ ID NO: 620104 - protein, 9 aa, Homo Sapiens
DLGRFNGSL

SEQ ID NO: 620105 - protein, 9 aa, Homo Sapiens
CLPKEVTGC

SEQ ID NO: 620106 - protein, 9 aa, Homo Sapiens
TVSCAGIRR

SEQ ID NO: 620107 - protein, 9 aa, Homo Sapiens
HERPFYQKT

SEQ ID NO: 620108 - protein, 9 aa, Homo Sapiens
VRFRSCSGS

SEQ ID NO: 620109 - protein, 9 aa, Homo Sapiens
CQPAMAPGV

SEQ ID NO: 620110 - protein, 9 aa, Homo Sapiens
AGGGREWGL

SEQ ID NO: 620111 - protein, 9 aa, Homo Sapiens
LKYSSLLAA

SEQ ID NO: 620112 - protein, 9 aa, Homo Sapiens
KLRKREQKG

SEQ ID NO: 620113 - protein, 9 aa, Homo Sapiens
VGCLSDVRV

SEQ ID NO: 620114 - protein, 9 aa, Homo Sapiens
AHIFPQWRK

SEQ ID NO: 620115 - protein, 9 aa, Homo Sapiens
SVSGSASGS

SEQ ID NO: 620116 - protein, 9 aa, Homo Sapiens
HENHERPFY

SEQ ID NO: 620117 - protein, 9 aa, Homo Sapiens
NHERPFYQK

SEQ ID NO: 620118 - protein, 9 aa, Homo Sapiens
SCAGIRRSW

SEQ ID NO: 620119 - protein, 9 aa, Homo Sapiens
SSCSSRLSS

SEQ ID NO: 620120 - protein, 9 aa, Homo Sapiens
AVDTGVSRE

SEQ ID NO: 620121 - protein, 9 aa, Homo Sapiens
PVKEIKINL

SEQ ID NO: 620122 - protein, 9 aa, Homo Sapiens
QEHPGLGGE

SEQ ID NO: 620123 - protein, 9 aa, Homo Sapiens
HATLDVDGE

SEQ ID NO: 620124 - protein, 9 aa, Homo Sapiens
DAFMGFLAP

SEQ ID NO: 620125 - protein, 9 aa, Homo Sapiens
ELRGPAKAV

SEQ ID NO: 620126 - protein, 9 aa, Homo Sapiens
PGLGGEAVG

SEQ ID NO: 620127 - protein, 9 aa, Homo Sapiens
TYQLVNIHV

SEQ ID NO: 620128 - protein, 9 aa, Homo Sapiens
HCSDSDGLA

SEQ ID NO: 620129 - protein, 9 aa, Homo Sapiens
NAQGSWNGV

SEQ ID NO: 620130 - protein, 9 aa, Homo Sapiens
CYLKLFSLT

SEQ ID NO: 620131 - protein, 9 aa, Homo Sapiens
VTSVSGSAS

SEQ ID NO: 620132 - protein, 8 aa, Homo Sapiens
RFVVALVL

SEQ ID NO: 620133 - protein, 9 aa, Homo Sapiens
RVSIQGGGI

SEQ ID NO: 620134 - protein, 9 aa, Homo Sapiens
VEEQWQKEY

SEQ ID NO: 620135 - protein, 9 aa, Homo Sapiens
SKTRVTPVE

SEQ ID NO: 620136 - protein, 9 aa, Homo Sapiens
HIFPQWRKG

SEQ ID NO: 620137 - protein, 9 aa, Homo Sapiens
FLAPAYIYE

SEQ ID NO: 620138 - protein, 9 aa, Homo Sapiens
VVSHNAHMW

SEQ ID NO: 620139 - protein, 9 aa, Homo Sapiens
GPRCECMTG

SEQ ID NO: 620140 - protein, 9 aa, Homo Sapiens
SASCCWPRG

SEQ ID NO: 620141 - protein, 9 aa, Homo Sapiens
RGPAKAVAK

SEQ ID NO: 620142 - protein, 9 aa, Homo Sapiens
AILWTMKKK

SEQ ID NO: 620143 - protein, 9 aa, Homo Sapiens
TWLEPALRG

SEQ ID NO: 620144 - protein, 9 aa, Homo Sapiens
GRNLTPAKL

SEQ ID NO: 620145 - protein, 9 aa, Homo Sapiens
SDELVRFRS

SEQ ID NO: 620146 - protein, 9 aa, Homo Sapiens
MTGYAGDNC

SEQ ID NO: 620147 - protein, 9 aa, Homo Sapiens
FSLTPPLVL

SEQ ID NO: 620148 - protein, 9 aa, Homo Sapiens
GSTYQLVNI

SEQ ID NO: 620149 - protein, 9 aa, Homo Sapiens
LPSMEATGC

SEQ ID NO: 620150 - protein, 9 aa, Homo Sapiens
MEATGCEKS

SEQ ID NO: 620151 - protein, 9 aa, Homo Sapiens
RRSSWRSAS

SEQ ID NO: 620152 - protein, 9 aa, Homo Sapiens
PQQKDLQQP

SEQ ID NO: 620153 - protein, 9 aa, Homo Sapiens
CQKAFSACG

SEQ ID NO: 620154 - protein, 9 aa, Homo Sapiens
PALRGEAAP

SEQ ID NO: 620155 - protein, 9 aa, Homo Sapiens
PQEHPGLGG

SEQ ID NO: 620156 - protein, 9 aa, Homo Sapiens
SSLLAAFII

SEQ ID NO: 620157 - protein, 9 aa, Homo Sapiens
PGRMDPLAP

SEQ ID NO: 620158 - protein, 9 aa, Homo Sapiens
PAKLPAKQR

SEQ ID NO: 620159 - protein, 9 aa, Homo Sapiens
ISHDDLKED

SEQ ID NO: 620160 - protein, 9 aa, Homo Sapiens
HEHCSDSDG

SEQ ID NO: 620161 - protein, 9 aa, Homo Sapiens
IMVTKPKAV

SEQ ID NO: 620162 - protein, 9 aa, Homo Sapiens
ILHFIHNAK

SEQ ID NO: 620163 - protein, 9 aa, Homo Sapiens
MRETSVFTL

SEQ ID NO: 620164 - protein, 9 aa, Homo Sapiens
PNTCLAVFG

SEQ ID NO: 620165 - protein, 9 aa, Homo Sapiens
SCSSRLSSS

SEQ ID NO: 620166 - protein, 9 aa, Homo Sapiens
WRSCRRRSR

SEQ ID NO: 620167 - protein, 9 aa, Homo Sapiens
PRVFPLAWT

SEQ ID NO: 620168 - protein, 9 aa, Homo Sapiens
DGIIRVGST

SEQ ID NO: 620169 - protein, 9 aa, Homo Sapiens
PGSCYLKLF

SEQ ID NO: 620170 - protein, 9 aa, Homo Sapiens
HDLGRFNGS

SEQ ID NO: 620171 - protein, 9 aa, Homo Sapiens
KTLQKWAQL

SEQ ID NO: 620172 - protein, 9 aa, Homo Sapiens
RCQPAMAPG

SEQ ID NO: 620173 - protein, 9 aa, Homo Sapiens
RCPHHEHCS

SEQ ID NO: 620174 - protein, 9 aa, Homo Sapiens
LKSAYDNTE

SEQ ID NO: 620175 - protein, 9 aa, Homo Sapiens
LRKREQKGT

SEQ ID NO: 620176 - protein, 9 aa, Homo Sapiens
QKWAQLAIA

SEQ ID NO: 620177 - protein, 9 aa, Homo Sapiens
GGREWGLLG

SEQ ID NO: 620178 - protein, 9 aa, Homo Sapiens
AVAKAPRPP

SEQ ID NO: 620179 - protein, 9 aa, Homo Sapiens
QKGTVSCAG

SEQ ID NO: 620180 - protein, 9 aa, Homo Sapiens
SSWRSASCC

SEQ ID NO: 620181 - protein, 9 aa, Homo Sapiens
EWGLLGDQG

SEQ ID NO: 620182 - protein, 9 aa, Homo Sapiens
VGGSPVGCL

SEQ ID NO: 620183 - protein, 9 aa, Homo Sapiens
PADPASAAS

SEQ ID NO: 620184 - protein, 9 aa, Homo Sapiens
ERSSCSSRL

SEQ ID NO: 620185 - protein, 9 aa, Homo Sapiens
CCWPRGTCS

SEQ ID NO: 620186 - protein, 9 aa, Homo Sapiens
IKINLEKLI

SEQ ID NO: 620187 - protein, 9 aa, Homo Sapiens
GGSPVGCLS

SEQ ID NO: 620188 - protein, 9 aa, Homo Sapiens
LHFIHNAKR

SEQ ID NO: 620189 - protein, 9 aa, Homo Sapiens
SCYLKLFSL

SEQ ID NO: 620190 - protein, 9 aa, Homo Sapiens
AFSACGSHL

SEQ ID NO: 620191 - protein, 9 aa, Homo Sapiens
HSAAPRVFP

SEQ ID NO: 620192 - protein, 9 aa, Homo Sapiens
AQGSWNGVQ

SEQ ID NO: 620193 - protein, 9 aa, Homo Sapiens
GSPVGCLSD

SEQ ID NO: 620194 - protein, 9 aa, Homo Sapiens
LQKWAQLAI

SEQ ID NO: 620195 - protein, 9 aa, Homo Sapiens
IRRSWRSCR

SEQ ID NO: 620196 - protein, 9 aa, Homo Sapiens
ETSVFTLKK

SEQ ID NO: 620197 - protein, 9 aa, Homo Sapiens
LFSLTPPLV

SEQ ID NO: 620198 - protein, 9 aa, Homo Sapiens
AVFGLSLYT

SEQ ID NO: 620199 - protein, 9 aa, Homo Sapiens
PVVVSHNAH

SEQ ID NO: 620200 - protein, 9 aa, Homo Sapiens
LRFHTHRSL

SEQ ID NO: 620201 - protein, 9 aa, Homo Sapiens
PAATLKLRC

SEQ ID NO: 620202 - protein, 9 aa, Homo Sapiens
RFHTHRSLF

SEQ ID NO: 620203 - protein, 9 aa, Homo Sapiens
AATLKLRCQ

SEQ ID NO: 620204 - protein, 9 aa, Homo Sapiens
DEKNFVVIM

SEQ ID NO: 620205 - protein, 9 aa, Homo Sapiens
CEKSSTPIK

SEQ ID NO: 620206 - protein, 9 aa, Homo Sapiens
TGCEKSSTP

SEQ ID NO: 620207 - protein, 9 aa, Homo Sapiens
RSASCCWPR

SEQ ID NO: 620208 - protein, 9 aa, Homo Sapiens
RSRSSCRRR

SEQ ID NO: 620209 - protein, 9 aa, Homo Sapiens
INLEKLIDV

SEQ ID NO: 620210 - protein, 9 aa, Homo Sapiens
GISHDDLKE

SEQ ID NO: 620211 - protein, 9 aa, Homo Sapiens
LLAAFIIER

SEQ ID NO: 620212 - protein, 9 aa, Homo Sapiens
GAGIQRVSI

SEQ ID NO: 620213 - protein, 9 aa, Homo Sapiens
KAVAKAPRP

SEQ ID NO: 620214 - protein, 9 aa, Homo Sapiens
PACHENHER

SEQ ID NO: 620215 - protein, 9 aa, Homo Sapiens
RSSCSSRLS

SEQ ID NO: 620216 - protein, 9 aa, Homo Sapiens
SHNAHMWQL

SEQ ID NO: 620217 - protein, 9 aa, Homo Sapiens
SHDDLKEDP

SEQ ID NO: 620218 - protein, 9 aa, Homo Sapiens
SRSSCRRRS

SEQ ID NO: 620219 - protein, 9 aa, Homo Sapiens
DEPSHQVIL

SEQ ID NO: 620220 - protein, 9 aa, Homo Sapiens
AKLPAKQRE

SEQ ID NO: 620221 - protein, 9 aa, Homo Sapiens
SWNGVQDAG

SEQ ID NO: 620222 - protein, 9 aa, Homo Sapiens
GCLSDVRVI

SEQ ID NO: 620223 - protein, 9 aa, Homo Sapiens
GSCYLKLFS

SEQ ID NO: 620224 - protein, 9 aa, Homo Sapiens
GSGGCPPAS

SEQ ID NO: 620225 - protein, 9 aa, Homo Sapiens
SPSCSAEPR

SEQ ID NO: 620226 - protein, 9 aa, Homo Sapiens
EQEGSGSQE

SEQ ID NO: 620227 - protein, 9 aa, Homo Sapiens
EKNFVVIMV

SEQ ID NO: 620228 - protein, 9 aa, Homo Sapiens
RAILWTMKK

SEQ ID NO: 620229 - protein, 9 aa, Homo Sapiens
LAPQPRAET

SEQ ID NO: 620230 - protein, 9 aa, Homo Sapiens
RSSWRSASC

SEQ ID NO: 620231 - protein, 9 aa, Homo Sapiens
STYQLVNIH

SEQ ID NO: 620232 - protein, 9 aa, Homo Sapiens
LLGDQGLEW

SEQ ID NO: 620233 - protein, 9 aa, Homo Sapiens
QKVFAHIFP

SEQ ID NO: 620234 - protein, 9 aa, Homo Sapiens
KQPACHENH

SEQ ID NO: 620235 - protein, 9 aa, Homo Sapiens
KKMRAILWT

SEQ ID NO: 620236 - protein, 9 aa, Homo Sapiens
RTEILHFIH

SEQ ID NO: 620237 - protein, 9 aa, Homo Sapiens
KDLRRAKDS

SEQ ID NO: 620238 - protein, 9 aa, Homo Sapiens
RLLTDGIIR

SEQ ID NO: 620239 - protein, 9 aa, Homo Sapiens
VNIHVTEME

SEQ ID NO: 620240 - protein, 9 aa, Homo Sapiens
SAAPRVFPL

SEQ ID NO: 620241 - protein, 9 aa, Homo Sapiens
EILHFIHNA

SEQ ID NO: 620242 - protein, 9 aa, Homo Sapiens
TCLAVFGLS

SEQ ID NO: 620243 - protein, 9 aa, Homo Sapiens
ITPLKTLQK

SEQ ID NO: 620244 - protein, 9 aa, Homo Sapiens
TEILHFIHN

SEQ ID NO: 620245 - protein, 9 aa, Homo Sapiens
FVVIMVTKP

SEQ ID NO: 620246 - protein, 9 aa, Homo Sapiens
DLKEDPLLD

SEQ ID NO: 620247 - protein, 9 aa, Homo Sapiens
SCRRRSSWR

SEQ ID NO: 620248 - protein, 9 aa, Homo Sapiens
LTDGIIRVG

SEQ ID NO: 620249 - protein, 9 aa, Homo Sapiens
LQQPAQQQQ

SEQ ID NO: 620250 - protein, 9 aa, Homo Sapiens
FRSCSGSCR

SEQ ID NO: 620251 - protein, 9 aa, Homo Sapiens
LFQKVFAHI

SEQ ID NO: 620252 - protein, 9 aa, Homo Sapiens
YLKLFSLTP

SEQ ID NO: 620253 - protein, 9 aa, Homo Sapiens
SMEATGCEK

SEQ ID NO: 620254 - protein, 9 aa, Homo Sapiens
CECMTGYAG

SEQ ID NO: 620255 - protein, 9 aa, Homo Sapiens
LRCQPAMAP

SEQ ID NO: 620256 - protein, 9 aa, Homo Sapiens
QRVSIQGGG

SEQ ID NO: 620257 - protein, 9 aa, Homo Sapiens
ATGCEKSST

SEQ ID NO: 620258 - protein, 9 aa, Homo Sapiens
RRSWRSCRR

SEQ ID NO: 620259 - protein, 9 aa, Homo Sapiens
RRRSRSSCR

SEQ ID NO: 620260 - protein, 9 aa, Homo Sapiens
RTWLEPALR

SEQ ID NO: 620261 - protein, 9 aa, Homo Sapiens
HRSPGSGHV

SEQ ID NO: 620262 - protein, 9 aa, Homo Sapiens
APRVFPLAW

SEQ ID NO: 620263 - protein, 9 aa, Homo Sapiens
RRHSASHDK

SEQ ID NO: 620264 - protein, 9 aa, Homo Sapiens
QGSWNGVQD

SEQ ID NO: 620265 - protein, 9 aa, Homo Sapiens
IGHSAAPRV

SEQ ID NO: 620266 - protein, 9 aa, Homo Sapiens
LAVFGLSLY

SEQ ID NO: 620267 - protein, 9 aa, Homo Sapiens
GTVSCAGIR

SEQ ID NO: 620268 - protein, 9 aa, Homo Sapiens
SKYDEPSHQ

SEQ ID NO: 620269 - protein, 9 aa, Homo Sapiens
AKPPADPAS

SEQ ID NO: 620270 - protein, 9 aa, Homo Sapiens
GGCPPASGL

SEQ ID NO: 620271 - protein, 9 aa, Homo Sapiens
CENCLLRFH

SEQ ID NO: 620272 - protein, 9 aa, Homo Sapiens
LEPALRGEA

SEQ ID NO: 620273 - protein, 9 aa, Homo Sapiens
ELGATRRHS

SEQ ID NO: 620274 - protein, 9 aa, Homo Sapiens
GSWNGVQDA

SEQ ID NO: 620275 - protein, 9 aa, Homo Sapiens
SVPRLHDLG

SEQ ID NO: 620276 - protein, 9 aa, Homo Sapiens
WSCTPCLKA

SEQ ID NO: 620277 - protein, 9 aa, Homo Sapiens
FIHNAKRAH

SEQ ID NO: 620278 - protein, 9 aa, Homo Sapiens
RNLTPAKLP

SEQ ID NO: 620279 - protein, 9 aa, Homo Sapiens
RRSFFCHAT

SEQ ID NO: 620280 - protein, 9 aa, Homo Sapiens
NLEKLIDVQ

SEQ ID NO: 620281 - protein, 9 aa, Homo Sapiens
DDGKTYHVE

SEQ ID NO: 620282 - protein, 9 aa, Homo Sapiens
PRLHDLGRF

SEQ ID NO: 620283 - protein, 9 aa, Homo Sapiens
KGTVSCAGI

SEQ ID NO: 620284 - protein, 9 aa, Homo Sapiens
GPGHRSPGS

SEQ ID NO: 620285 - protein, 9 aa, Homo Sapiens
PSTLNPTSR

SEQ ID NO: 620286 - protein, 9 aa, Homo Sapiens
MHMRETSVF

SEQ ID NO: 620287 - protein, 9 aa, Homo Sapiens
WRSASCCWP

SEQ ID NO: 620288 - protein, 9 aa, Homo Sapiens
VAESLSRES

SEQ ID NO: 620289 - protein, 9 aa, Homo Sapiens
PSGSSPSCS

SEQ ID NO: 620290 - protein, 9 aa, Homo Sapiens
RAGRTREAW

SEQ ID NO: 620291 - protein, 9 aa, Homo Sapiens
MGFLAPAYI

SEQ ID NO: 620292 - protein, 9 aa, Homo Sapiens
TCSPSGSSP

SEQ ID NO: 620293 - protein, 9 aa, Homo Sapiens
RSSCRRRSS

SEQ ID NO: 620294 - protein, 9 aa, Homo Sapiens
DAVDTGVSR

SEQ ID NO: 620295 - protein, 9 aa, Homo Sapiens
GEEKEASPL

SEQ ID NO: 620296 - protein, 9 aa, Homo Sapiens
SASETSGYI

SEQ ID NO: 620297 - protein, 9 aa, Homo Sapiens
TIEEFHYKL

SEQ ID NO: 620298 - protein, 9 aa, Homo Sapiens
LPTSTACCV

SEQ ID NO: 620299 - protein, 9 aa, Homo Sapiens
LLSHGSHSL

SEQ ID NO: 620300 - protein, 9 aa, Homo Sapiens
FHYKLQEAT

SEQ ID NO: 620301 - protein, 9 aa, Homo Sapiens
FLEHLSGAD

SEQ ID NO: 620302 - protein, 9 aa, Homo Sapiens
YPAKAYADC

SEQ ID NO: 620303 - protein, 9 aa, Homo Sapiens
YDKHLGKSN

SEQ ID NO: 620304 - protein, 9 aa, Homo Sapiens
LVSTTEMAM

SEQ ID NO: 620305 - protein, 9 aa, Homo Sapiens
FKNKLYDKH

SEQ ID NO: 620306 - protein, 9 aa, Homo Sapiens
SLVSTTEMA

SEQ ID NO: 620307 - protein, 9 aa, Homo Sapiens
LYDKHLGKS

SEQ ID NO: 620308 - protein, 9 aa, Homo Sapiens
LLPVFSQLA

SEQ ID NO: 620309 - protein, 9 aa, Homo Sapiens
AGIKTWLQT

SEQ ID NO: 620310 - protein, 9 aa, Homo Sapiens
GGHWAEISP

SEQ ID NO: 620311 - protein, 9 aa, Homo Sapiens
STLPTNINY

SEQ ID NO: 620312 - protein, 9 aa, Homo Sapiens
EMVWTAKQH

SEQ ID NO: 620313 - protein, 9 aa, Homo Sapiens
ICYSTPLMY

SEQ ID NO: 620314 - protein, 9 aa, Homo Sapiens
GLSESSGSS

SEQ ID NO: 620315 - protein, 9 aa, Homo Sapiens
ITVFDIPEM

SEQ ID NO: 620316 - protein, 9 aa, Homo Sapiens
KEPIEFISN

SEQ ID NO: 620317 - protein, 9 aa, Homo Sapiens
GLQLFHLFV

SEQ ID NO: 620318 - protein, 9 aa, Homo Sapiens
CCVKGRNAL

SEQ ID NO: 620319 - protein, 9 aa, Homo Sapiens
PGLQLQQFR

SEQ ID NO: 620320 - protein, 9 aa, Homo Sapiens
LREKGLQLF

SEQ ID NO: 620321 - protein, 9 aa, Homo Sapiens
TVAEPPSCP

SEQ ID NO: 620322 - protein, 9 aa, Homo Sapiens
VVMQKTCSM

SEQ ID NO: 620323 - protein, 9 aa, Homo Sapiens
QDAGAIAGL

SEQ ID NO: 620324 - protein, 9 aa, Homo Sapiens
LDMLSTPQQ

SEQ ID NO: 620325 - protein, 9 aa, Homo Sapiens
NSQRQATQD

SEQ ID NO: 620326 - protein, 9 aa, Homo Sapiens
SISKIVLTM

SEQ ID NO: 620327 - protein, 9 aa, Homo Sapiens
ILNNLLERY

SEQ ID NO: 620328 - protein, 9 aa, Homo Sapiens
VSASETSGY

SEQ ID NO: 620329 - protein, 9 aa, Homo Sapiens
VAGIKTWLQ

SEQ ID NO: 620330 - protein, 9 aa, Homo Sapiens
RALGLSESS

SEQ ID NO: 620331 - protein, 9 aa, Homo Sapiens
GCCGSTPDY

SEQ ID NO: 620332 - protein, 9 aa, Homo Sapiens
LDICYSTPL

SEQ ID NO: 620333 - protein, 9 aa, Homo Sapiens
SRRQPRVMS

SEQ ID NO: 620334 - protein, 9 aa, Homo Sapiens
REPEPTVAE

SEQ ID NO: 620335 - protein, 9 aa, Homo Sapiens
SGSQLYAGP

SEQ ID NO: 620336 - protein, 9 aa, Homo Sapiens
IGLNRLLTS

SEQ ID NO: 620337 - protein, 9 aa, Homo Sapiens
YKLQEATNF

SEQ ID NO: 620338 - protein, 9 aa, Homo Sapiens
TNINYTLWS

SEQ ID NO: 620339 - protein, 9 aa, Homo Sapiens
SSGVSGSQL

SEQ ID NO: 620340 - protein, 9 aa, Homo Sapiens
YADCSYASS

SEQ ID NO: 620341 - protein, 9 aa, Homo Sapiens
DIGGPYSPN

SEQ ID NO: 620342 - protein, 9 aa, Homo Sapiens
TPLMYFELP

SEQ ID NO: 620343 - protein, 9 aa, Homo Sapiens
ETQTPSSGI

SEQ ID NO: 620344 - protein, 9 aa, Homo Sapiens
SQLATLLAC

SEQ ID NO: 620345 - protein, 9 aa, Homo Sapiens
ISFGGCVFQ

SEQ ID NO: 620346 - protein, 9 aa, Homo Sapiens
ELDDRRQET

SEQ ID NO: 620347 - protein, 9 aa, Homo Sapiens
DRRQETEEK

SEQ ID NO: 620348 - protein, 9 aa, Homo Sapiens
QFRPALMPR

SEQ ID NO: 620349 - protein, 9 aa, Homo Sapiens
QSMELVYNK

SEQ ID NO: 620350 - protein, 9 aa, Homo Sapiens
KAYADCSYA

SEQ ID NO: 620351 - protein, 9 aa, Homo Sapiens
PETQTPSSG

SEQ ID NO: 620352 - protein, 9 aa, Homo Sapiens
TACCVKGRN

SEQ ID NO: 620353 - protein, 9 aa, Homo Sapiens
PVAGIKTWL

SEQ ID NO: 620354 - protein, 9 aa, Homo Sapiens
QGFVVMQKT

SEQ ID NO: 620355 - protein, 9 aa, Homo Sapiens
AKTPLALLA

SEQ ID NO: 620356 - protein, 9 aa, Homo Sapiens
PSSETAVDI

SEQ ID NO: 620357 - protein, 9 aa, Homo Sapiens
DKHLGKSNN

SEQ ID NO: 620358 - protein, 9 aa, Homo Sapiens
EISPLRLCG

SEQ ID NO: 620359 - protein, 9 aa, Homo Sapiens
VETGENLDP

SEQ ID NO: 620360 - protein, 9 aa, Homo Sapiens
SLHLLSHGS

SEQ ID NO: 620361 - protein, 9 aa, Homo Sapiens
LVSEERCEL

SEQ ID NO: 620362 - protein, 9 aa, Homo Sapiens
VNAFYSSRR

SEQ ID NO: 620363 - protein, 9 aa, Homo Sapiens
DKAIGVLTS

SEQ ID NO: 620364 - protein, 9 aa, Homo Sapiens
ADCSYASSY

SEQ ID NO: 620365 - protein, 9 aa, Homo Sapiens
ISIPLCIMY

SEQ ID NO: 620366 - protein, 9 aa, Homo Sapiens
PLALLAPNL

SEQ ID NO: 620367 - protein, 9 aa, Homo Sapiens
QRQATQDAG

SEQ ID NO: 620368 - protein, 9 aa, Homo Sapiens
VCKPLHYPV

SEQ ID NO: 620369 - protein, 9 aa, Homo Sapiens
HDRYVAVCK

SEQ ID NO: 620370 - protein, 9 aa, Homo Sapiens
PVFSQLATL

SEQ ID NO: 620371 - protein, 9 aa, Homo Sapiens
GFVVMQKTC

SEQ ID NO: 620372 - protein, 9 aa, Homo Sapiens
EEFHYKLQE

SEQ ID NO: 620373 - protein, 9 aa, Homo Sapiens
PQQSMELVY

SEQ ID NO: 620374 - protein, 9 aa, Homo Sapiens
VDILRFCTA

SEQ ID NO: 620375 - protein, 9 aa, Homo Sapiens
LHLLSHGSH

SEQ ID NO: 620376 - protein, 9 aa, Homo Sapiens
RLLTSGSYE

SEQ ID NO: 620377 - protein, 9 aa, Homo Sapiens
EPEPTVAEP

SEQ ID NO: 620378 - protein, 9 aa, Homo Sapiens
LALLAPNLG

SEQ ID NO: 620379 - protein, 9 aa, Homo Sapiens
DSCPETQTP

SEQ ID NO: 620380 - protein, 9 aa, Homo Sapiens
GSQLYAGPP

SEQ ID NO: 620381 - protein, 9 aa, Homo Sapiens
DILRFCTAL

SEQ ID NO: 620382 - protein, 9 aa, Homo Sapiens
PLVSEERCE

SEQ ID NO: 620383 - protein, 9 aa, Homo Sapiens
RSAFQYQPK

SEQ ID NO: 620384 - protein, 9 aa, Homo Sapiens
DYIREIAEA

SEQ ID NO: 620385 - protein, 9 aa, Homo Sapiens
SAVGVQPIL

SEQ ID NO: 620386 - protein, 9 aa, Homo Sapiens
ADSLVSTTE

SEQ ID NO: 620387 - protein, 9 aa, Homo Sapiens
TISFGGCVF

SEQ ID NO: 620388 - protein, 9 aa, Homo Sapiens
HGSHSLFTR

SEQ ID NO: 620389 - protein, 9 aa, Homo Sapiens
ISNQWFGAT

SEQ ID NO: 620390 - protein, 9 aa, Homo Sapiens
FVVMQKTCS

SEQ ID NO: 620391 - protein, 9 aa, Homo Sapiens
DDRRQETEE

SEQ ID NO: 620392 - protein, 9 aa, Homo Sapiens
RVEFLDDRN

SEQ ID NO: 620393 - protein, 9 aa, Homo Sapiens
PEPTVAEPP

SEQ ID NO: 620394 - protein, 9 aa, Homo Sapiens
EEKEASPLG

SEQ ID NO: 620395 - protein, 9 aa, Homo Sapiens
LLAPNLGKP

SEQ ID NO: 620396 - protein, 9 aa, Homo Sapiens
HSISKIVLT

SEQ ID NO: 620397 - protein, 9 aa, Homo Sapiens
SGYIATVCD

SEQ ID NO: 620398 - protein, 9 aa, Homo Sapiens
LDDRRQETE

SEQ ID NO: 620399 - protein, 9 aa, Homo Sapiens
PAKAYADCS

SEQ ID NO: 620400 - protein, 9 aa, Homo Sapiens
TSTACCVKG

SEQ ID NO: 620401 - protein, 9 aa, Homo Sapiens
SCVINIVVA

SEQ ID NO: 620402 - protein, 9 aa, Homo Sapiens
WKAPKSAVG

SEQ ID NO: 620403 - protein, 9 aa, Homo Sapiens
SGSYEAAFP

SEQ ID NO: 620404 - protein, 9 aa, Homo Sapiens
ADKAIGVLT

SEQ ID NO: 620405 - protein, 9 aa, Homo Sapiens
IPLCIMYLV

SEQ ID NO: 620406 - protein, 9 aa, Homo Sapiens
FQYQPKLHT

SEQ ID NO: 620407 - protein, 9 aa, Homo Sapiens
VILNNLLER

SEQ ID NO: 620408 - protein, 9 aa, Homo Sapiens
EPGTAPCPT

SEQ ID NO: 620409 - protein, 9 aa, Homo Sapiens
REKGLQLFH

SEQ ID NO: 620410 - protein, 9 aa, Homo Sapiens
STACCVKGR

SEQ ID NO: 620411 - protein, 9 aa, Homo Sapiens
VFGEEKEAS

SEQ ID NO: 620412 - protein, 9 aa, Homo Sapiens
EMQGFVVMQ

SEQ ID NO: 620413 - protein, 9 aa, Homo Sapiens
STPLMYFEL

SEQ ID NO: 620414 - protein, 9 aa, Homo Sapiens
VSLHLLSHG

SEQ ID NO: 620415 - protein, 9 aa, Homo Sapiens
LYAGPPPSG

SEQ ID NO: 620416 - protein, 9 aa, Homo Sapiens
KSAVGVQPI

SEQ ID NO: 620417 - protein, 9 aa, Homo Sapiens
AFQYQPKLH

SEQ ID NO: 620418 - protein, 9 aa, Homo Sapiens
RRQETEEKV

SEQ ID NO: 620419 - protein, 9 aa, Homo Sapiens
TQTPSSGIK

SEQ ID NO: 620420 - protein, 9 aa, Homo Sapiens
WISIPLCIM

SEQ ID NO: 620421 - protein, 9 aa, Homo Sapiens
TYWYRQDPG

SEQ ID NO: 620422 - protein, 9 aa, Homo Sapiens
SETSGYIAT

SEQ ID NO: 620423 - protein, 9 aa, Homo Sapiens
PRVMSQWSR

SEQ ID NO: 620424 - protein, 9 aa, Homo Sapiens
TPDYIREIA

SEQ ID NO: 620425 - protein, 9 aa, Homo Sapiens
DPTLREKGL

SEQ ID NO: 620426 - protein, 9 aa, Homo Sapiens
EGNLRVEFL

SEQ ID NO: 620427 - protein, 9 aa, Homo Sapiens
VGRSAFQYQ

SEQ ID NO: 620428 - protein, 9 aa, Homo Sapiens
IQLVAEKLG

SEQ ID NO: 620429 - protein, 9 aa, Homo Sapiens
QATQDAGAI

SEQ ID NO: 620430 - protein, 9 aa, Homo Sapiens
KHLGKSNNF

SEQ ID NO: 620431 - protein, 9 aa, Homo Sapiens
ATQDAGAIA

SEQ ID NO: 620432 - protein, 9 aa, Homo Sapiens
CYSTPLMYF

SEQ ID NO: 620433 - protein, 9 aa, Homo Sapiens
ETAVDILRF

SEQ ID NO: 620434 - protein, 9 aa, Homo Sapiens
KPLHYPVIV

SEQ ID NO: 620435 - protein, 9 aa, Homo Sapiens
VFSQLATLL

SEQ ID NO: 620436 - protein, 9 aa, Homo Sapiens
KDVAEECKR

SEQ ID NO: 620437 - protein, 9 aa, Homo Sapiens
TTEMAMFRR

SEQ ID NO: 620438 - protein, 9 aa, Homo Sapiens
EHSCVINIV

SEQ ID NO: 620439 - protein, 9 aa, Homo Sapiens
EEMQGFVVM

SEQ ID NO: 620440 - protein, 9 aa, Homo Sapiens
SSETAVDIL

SEQ ID NO: 620441 - protein, 9 aa, Homo Sapiens
PYREPEPTV

SEQ ID NO: 620442 - protein, 9 aa, Homo Sapiens
PGPCLEPGT

SEQ ID NO: 620443 - protein, 9 aa, Homo Sapiens
TKEPIEFIS

SEQ ID NO: 620444 - protein, 9 aa, Homo Sapiens
DMLSTPQQS

SEQ ID NO: 620445 - protein, 9 aa, Homo Sapiens
YIATVCDSA

SEQ ID NO: 620446 - protein, 9 aa, Homo Sapiens
HLSGADKAI

SEQ ID NO: 620447 - protein, 9 aa, Homo Sapiens
DPLEEIEFW

SEQ ID NO: 620448 - protein, 9 aa, Homo Sapiens
FRPALMPRT

SEQ ID NO: 620449 - protein, 9 aa, Homo Sapiens
SCPETQTPS

SEQ ID NO: 620450 - protein, 9 aa, Homo Sapiens
PKSAVGVQP

SEQ ID NO: 620451 - protein, 9 aa, Homo Sapiens
NLNHDATYW

SEQ ID NO: 620452 - protein, 9 aa, Homo Sapiens
RPLVSEERC

SEQ ID NO: 620453 - protein, 9 aa, Homo Sapiens
IEEFHYKLQ

SEQ ID NO: 620454 - protein, 9 aa, Homo Sapiens
EKEASPLGA

SEQ ID NO: 620455 - protein, 9 aa, Homo Sapiens
CVINIVVAK

SEQ ID NO: 620456 - protein, 9 aa, Homo Sapiens
VVNAFYSSR

SEQ ID NO: 620457 - protein, 9 aa, Homo Sapiens
SHGSHSLFT

SEQ ID NO: 620458 - protein, 9 aa, Homo Sapiens
TSGYIATVC

SEQ ID NO: 620459 - protein, 9 aa, Homo Sapiens
EFLDDRNTF

SEQ ID NO: 620460 - protein, 9 aa, Homo Sapiens
EQNLNHDAT

SEQ ID NO: 620461 - protein, 9 aa, Homo Sapiens
FDIPEMVWT

SEQ ID NO: 620462 - protein, 9 aa, Homo Sapiens
LNNLLERYD

SEQ ID NO: 620463 - protein, 9 aa, Homo Sapiens
CKRKLENMY

SEQ ID NO: 620464 - protein, 9 aa, Homo Sapiens
FIQLVAEKL

SEQ ID NO: 620465 - protein, 9 aa, Homo Sapiens
ETSGYIATV

SEQ ID NO: 620466 - protein, 9 aa, Homo Sapiens
EHLSGADKA

SEQ ID NO: 620467 - protein, 9 aa, Homo Sapiens
QQFRPALMP

SEQ ID NO: 620468 - protein, 9 aa, Homo Sapiens
RQATQDAGA

SEQ ID NO: 620469 - protein, 9 aa, Homo Sapiens
PLMYFELPD

SEQ ID NO: 620470 - protein, 9 aa, Homo Sapiens
YSTPLMYFE

SEQ ID NO: 620471 - protein, 9 aa, Homo Sapiens
NLRVEFLDD

SEQ ID NO: 620472 - protein, 9 aa, Homo Sapiens
GLKDVAEEC

SEQ ID NO: 620473 - protein, 9 aa, Homo Sapiens
SGVSGSQLY

SEQ ID NO: 620474 - protein, 9 aa, Homo Sapiens
QQSMELVYN

SEQ ID NO: 620475 - protein, 9 aa, Homo Sapiens
DPPGPCLEP

SEQ ID NO: 620476 - protein, 9 aa, Homo Sapiens
DCSYASSYH

SEQ ID NO: 620477 - protein, 9 aa, Homo Sapiens
KEASPLGAG

SEQ ID NO: 620478 - protein, 9 aa, Homo Sapiens
LERYDNKLR

SEQ ID NO: 620479 - protein, 9 aa, Homo Sapiens
EKGLQLFHL

SEQ ID NO: 620480 - protein, 9 aa, Homo Sapiens
CSYASSYHQ

SEQ ID NO: 620481 - protein, 9 aa, Homo Sapiens
CGSTPDYIR

SEQ ID NO: 620482 - protein, 9 aa, Homo Sapiens
EPIEFISNQ

SEQ ID NO: 620483 - protein, 9 aa, Homo Sapiens
QNLNHDATY

SEQ ID NO: 620484 - protein, 9 aa, Homo Sapiens
QLYAGPPPS

SEQ ID NO: 620485 - protein, 9 aa, Homo Sapiens
QPKLHTLSL

SEQ ID NO: 620486 - protein, 9 aa, Homo Sapiens
IPEMVWTAK

SEQ ID NO: 620487 - protein, 9 aa, Homo Sapiens
KWKAPKSAV

SEQ ID NO: 620488 - protein, 9 aa, Homo Sapiens
RGKAAERPL

SEQ ID NO: 620489 - protein, 9 aa, Homo Sapiens
HLLSHGSHS

SEQ ID NO: 620490 - protein, 9 aa, Homo Sapiens
NNLLERYDN

SEQ ID NO: 620491 - protein, 9 aa, Homo Sapiens
SVSLHLLSH

SEQ ID NO: 620492 - protein, 9 aa, Homo Sapiens
EECKRKLEN

SEQ ID NO: 620493 - protein, 9 aa, Homo Sapiens
LSGADKAIG

SEQ ID NO: 620494 - protein, 9 aa, Homo Sapiens
PLCIMYLVS

SEQ ID NO: 620495 - protein, 9 aa, Homo Sapiens
FLHSISKIV

SEQ ID NO: 620496 - protein, 9 aa, Homo Sapiens
DSLVSTTEM

SEQ ID NO: 620497 - protein, 9 aa, Homo Sapiens
NQGGHWAEI

SEQ ID NO: 620498 - protein, 9 aa, Homo Sapiens
QKELDDRRQ

SEQ ID NO: 620499 - protein, 9 aa, Homo Sapiens
PCLEPGTAP

SEQ ID NO: 620500 - protein, 9 aa, Homo Sapiens
KGLQLFHLF

SEQ ID NO: 620501 - protein, 9 aa, Homo Sapiens
LSHGSHSLF

SEQ ID NO: 620502 - protein, 9 aa, Homo Sapiens
NLLRNDIGG

SEQ ID NO: 620503 - protein, 9 aa, Homo Sapiens
LLTSGSYEA

SEQ ID NO: 620504 - protein, 9 aa, Homo Sapiens
FGEEKEASP

SEQ ID NO: 620505 - protein, 9 aa, Homo Sapiens
QPYREPEPT

SEQ ID NO: 620506 - protein, 9 aa, Homo Sapiens
KAPKSAVGV

SEQ ID NO: 620507 - protein, 9 aa, Homo Sapiens
GAKTPLALL

SEQ ID NO: 620508 - protein, 9 aa, Homo Sapiens
GADKAIGVL

SEQ ID NO: 620509 - protein, 9 aa, Homo Sapiens
TLPTNINYT

SEQ ID NO: 620510 - protein, 9 aa, Homo Sapiens
VEFLDDRNT

SEQ ID NO: 620511 - protein, 9 aa, Homo Sapiens
YIREIAEAV

SEQ ID NO: 620512 - protein, 9 aa, Homo Sapiens
YQPKLHTLS

SEQ ID NO: 620513 - protein, 9 aa, Homo Sapiens
KNKLYDKHL

SEQ ID NO: 620514 - protein, 9 aa, Homo Sapiens
PTVAEPPSC

SEQ ID NO: 620515 - protein, 9 aa, Homo Sapiens
TPLALLAPN

SEQ ID NO: 620516 - protein, 9 aa, Homo Sapiens
RRNQIVFPA

SEQ ID NO: 620517 - protein, 9 aa, Homo Sapiens
TEEMQGFVV

SEQ ID NO: 620518 - protein, 9 aa, Homo Sapiens
TVETGENLD

SEQ ID NO: 620519 - protein, 9 aa, Homo Sapiens
IEFISNQWF

SEQ ID NO: 620520 - protein, 9 aa, Homo Sapiens
GLDSCPETQ

SEQ ID NO: 620521 - protein, 9 aa, Homo Sapiens
MQGFVVMQK

SEQ ID NO: 620522 - protein, 9 aa, Homo Sapiens
WAEISPLRL

SEQ ID NO: 620523 - protein, 9 aa, Homo Sapiens
GGAKTPLAL

SEQ ID NO: 620524 - protein, 9 aa, Homo Sapiens
HSCVINIVV

SEQ ID NO: 620525 - protein, 9 aa, Homo Sapiens
TWLQTRLGD

SEQ ID NO: 620526 - protein, 9 aa, Homo Sapiens
SFKNKLYDK

SEQ ID NO: 620527 - protein, 9 aa, Homo Sapiens
HDATYWYRQ

SEQ ID NO: 620528 - protein, 9 aa, Homo Sapiens
LKDVAEECK

SEQ ID NO: 620529 - protein, 9 aa, Homo Sapiens
GHWAEISPL

SEQ ID NO: 620530 - protein, 9 aa, Homo Sapiens
ALGLSESSG

SEQ ID NO: 620531 - protein, 9 aa, Homo Sapiens
GIKTWLQTR

SEQ ID NO: 620532 - protein, 9 aa, Homo Sapiens
LNHDATYWY

SEQ ID NO: 620533 - protein, 9 aa, Homo Sapiens
GKAAERPLV

SEQ ID NO: 620534 - protein, 9 aa, Homo Sapiens
SQLYAGPPP

SEQ ID NO: 620535 - protein, 9 aa, Homo Sapiens
AEECKRKLE

SEQ ID NO: 620536 - protein, 9 aa, Homo Sapiens
TLREKGLQL

SEQ ID NO: 620537 - protein, 9 aa, Homo Sapiens
PKWKAPKSA

SEQ ID NO: 620538 - protein, 9 aa, Homo Sapiens
GENLDPLEE

SEQ ID NO: 620539 - protein, 9 aa, Homo Sapiens
DIPEMVWTA

SEQ ID NO: 620540 - protein, 9 aa, Homo Sapiens
NDIGGPYSP

SEQ ID NO: 620541 - protein, 9 aa, Homo Sapiens
TSGSYEAAF

SEQ ID NO: 620542 - protein, 9 aa, Homo Sapiens
LNQGGHWAE

SEQ ID NO: 620543 - protein, 9 aa, Homo Sapiens
TGENLDPLE

SEQ ID NO: 620544 - protein, 9 aa, Homo Sapiens
RQPRVMSQW

SEQ ID NO: 620545 - protein, 9 aa, Homo Sapiens
NLDPLEEIE

SEQ ID NO: 620546 - protein, 9 aa, Homo Sapiens
IGGPYSPNQ

SEQ ID NO: 620547 - protein, 9 aa, Homo Sapiens
VSGSQLYAG

SEQ ID NO: 620548 - protein, 9 aa, Homo Sapiens
LPTNINYTL

SEQ ID NO: 620549 - protein, 9 aa, Homo Sapiens
PTNINYTLW

SEQ ID NO: 620550 - protein, 9 aa, Homo Sapiens
AVCKPLHYP

SEQ ID NO: 620551 - protein, 9 aa, Homo Sapiens
PGTAPCPTW

SEQ ID NO: 620552 - protein, 9 aa, Homo Sapiens
NHDATYWYR

SEQ ID NO: 620553 - protein, 9 aa, Homo Sapiens
NIVVAKNLD

SEQ ID NO: 620554 - protein, 9 aa, Homo Sapiens
KLYDKHLGK

SEQ ID NO: 620555 - protein, 9 aa, Homo Sapiens
TVFDIPEMV

SEQ ID NO: 620556 - protein, 9 aa, Homo Sapiens
QGGHWAEIS

SEQ ID NO: 620557 - protein, 9 aa, Homo Sapiens
ALLAPNLGK

SEQ ID NO: 620558 - protein, 9 aa, Homo Sapiens
DDPTLREKG

SEQ ID NO: 620559 - protein, 9 aa, Homo Sapiens
GYIATVCDS

SEQ ID NO: 620560 - protein, 9 aa, Homo Sapiens
LRNDIGGPY

SEQ ID NO: 620561 - protein, 9 aa, Homo Sapiens
IMYLVSIPG

SEQ ID NO: 620562 - protein, 9 aa, Homo Sapiens
SDNLLRNDI

SEQ ID NO: 620563 - protein, 9 aa, Homo Sapiens
CCGSTPDYI

SEQ ID NO: 620564 - protein, 9 aa, Homo Sapiens
DATYWYRQD

SEQ ID NO: 620565 - protein, 9 aa, Homo Sapiens
AKAYADCSY

SEQ ID NO: 620566 - protein, 9 aa, Homo Sapiens
ASPLGAGGL

SEQ ID NO: 620567 - protein, 9 aa, Homo Sapiens
LMYFELPDS

SEQ ID NO: 620568 - protein, 9 aa, Homo Sapiens
LEHLSGADK

SEQ ID NO: 620569 - protein, 9 aa, Homo Sapiens
HWAEISPLR

SEQ ID NO: 620570 - protein, 9 aa, Homo Sapiens
RRQPRVMSQ

SEQ ID NO: 620571 - protein, 9 aa, Homo Sapiens
KTWLQTRLG

SEQ ID NO: 620572 - protein, 9 aa, Homo Sapiens
ASTLPTNIN

SEQ ID NO: 620573 - protein, 9 aa, Homo Sapiens
SQRQATQDA

SEQ ID NO: 620574 - protein, 9 aa, Homo Sapiens
CIMYLVSIP

SEQ ID NO: 620575 - protein, 9 aa, Homo Sapiens
LLERYDNKL

SEQ ID NO: 620576 - protein, 9 aa, Homo Sapiens
WLQTRLGDY

SEQ ID NO: 620577 - protein, 9 aa, Homo Sapiens
LVAEKLGAH

SEQ ID NO: 620578 - protein, 9 aa, Homo Sapiens
GGCVFQIFF

SEQ ID NO: 620579 - protein, 9 aa, Homo Sapiens
MVWTAKQHF

SEQ ID NO: 620580 - protein, 9 aa, Homo Sapiens
VFQIFFIHA

SEQ ID NO: 620581 - protein, 9 aa, Homo Sapiens
AFYSSRRNQ

SEQ ID NO: 620582 - protein, 9 aa, Homo Sapiens
LTIEEFHYK

SEQ ID NO: 620583 - protein, 9 aa, Homo Sapiens
VPGLQLQQF

SEQ ID NO: 620584 - protein, 9 aa, Homo Sapiens
KTPLALLAP

SEQ ID NO: 620585 - protein, 9 aa, Homo Sapiens
GASTLPTNI

SEQ ID NO: 620586 - protein, 9 aa, Homo Sapiens
LPVFSQLAT

SEQ ID NO: 620587 - protein, 9 aa, Homo Sapiens
PDYIREIAE

SEQ ID NO: 620588 - protein, 9 aa, Homo Sapiens
DTEEMQGFV

SEQ ID NO: 620589 - protein, 9 aa, Homo Sapiens
QYQPKLHTL

SEQ ID NO: 620590 - protein, 9 aa, Homo Sapiens
LDPLEEIEF

SEQ ID NO: 620591 - protein, 9 aa, Homo Sapiens
INIVVAKNL

SEQ ID NO: 620592 - protein, 9 aa, Homo Sapiens
LQTRLGDYQ

SEQ ID NO: 620593 - protein, 9 aa, Homo Sapiens
FQIFFIHAV

SEQ ID NO: 620594 - protein, 9 aa, Homo Sapiens
GPCLEPGTA

SEQ ID NO: 620595 - protein, 9 aa, Homo Sapiens
LHSISKIVL

SEQ ID NO: 620596 - protein, 9 aa, Homo Sapiens
SGSSLPVVV

SEQ ID NO: 620597 - protein, 9 aa, Homo Sapiens
LGLSESSGS

SEQ ID NO: 620598 - protein, 9 aa, Homo Sapiens
YREPEPTVA

SEQ ID NO: 620599 - protein, 9 aa, Homo Sapiens
GLQLQQFRP

SEQ ID NO: 620600 - protein, 9 aa, Homo Sapiens
SRRNQIVFP

SEQ ID NO: 620601 - protein, 9 aa, Homo Sapiens
SFGGCVFQI

SEQ ID NO: 620602 - protein, 9 aa, Homo Sapiens
QETEEKVGN

SEQ ID NO: 620603 - protein, 9 aa, Homo Sapiens
TAVDILRFC

SEQ ID NO: 620604 - protein, 9 aa, Homo Sapiens
SKIVLTMNL

SEQ ID NO: 620605 - protein, 9 aa, Homo Sapiens
TLTIEEFHY

SEQ ID NO: 620606 - protein, 9 aa, Homo Sapiens
IGFLHSISK

SEQ ID NO: 620607 - protein, 9 aa, Homo Sapiens
STPQQSMEL

SEQ ID NO: 620608 - protein, 9 aa, Homo Sapiens
LNRLLTSGS

SEQ ID NO: 620609 - protein, 9 aa, Homo Sapiens
LCIMYLVSI

SEQ ID NO: 620610 - protein, 9 aa, Homo Sapiens
EASPLGAGG

SEQ ID NO: 620611 - protein, 9 aa, Homo Sapiens
VAEECKRKL

SEQ ID NO: 620612 - protein, 9 aa, Homo Sapiens
FLDDRNTFR

SEQ ID NO: 620613 - protein, 9 aa, Homo Sapiens
IKTWLQTRL

SEQ ID NO: 620614 - protein, 9 aa, Homo Sapiens
KAAERPLVS

SEQ ID NO: 620615 - protein, 9 aa, Homo Sapiens
SNSQRQATQ

SEQ ID NO: 620616 - protein, 9 aa, Homo Sapiens
SPLGAGGLG

SEQ ID NO: 620617 - protein, 9 aa, Homo Sapiens
LLRNDIGGP

SEQ ID NO: 620618 - protein, 9 aa, Homo Sapiens
SSGSSLPVV

SEQ ID NO: 620619 - protein, 9 aa, Homo Sapiens
ATYWYRQDP

SEQ ID NO: 620620 - protein, 9 aa, Homo Sapiens
EFISNQWFG

SEQ ID NO: 620621 - protein, 9 aa, Homo Sapiens
AERPLVSEE

SEQ ID NO: 620622 - protein, 9 aa, Homo Sapiens
LSTPQQSME

SEQ ID NO: 620623 - protein, 9 aa, Homo Sapiens
KIVLTMNLP

SEQ ID NO: 620624 - protein, 9 aa, Homo Sapiens
GRSAFQYQP

SEQ ID NO: 620625 - protein, 9 aa, Homo Sapiens
CLEPGTAPC

SEQ ID NO: 620626 - protein, 9 aa, Homo Sapiens
SIPLCIMYL

SEQ ID NO: 620627 - protein, 9 aa, Homo Sapiens
QLQQFRPAL

SEQ ID NO: 620628 - protein, 9 aa, Homo Sapiens
RADSLVSTT

SEQ ID NO: 620629 - protein, 9 aa, Homo Sapiens
HSRRQPRVM

SEQ ID NO: 620630 - protein, 9 aa, Homo Sapiens
NLLERYDNK

SEQ ID NO: 620631 - protein, 9 aa, Homo Sapiens
CKPLHYPVI

SEQ ID NO: 620632 - protein, 9 aa, Homo Sapiens
FYSSRRNQI

SEQ ID NO: 620633 - protein, 9 aa, Homo Sapiens
VINIVVAKN

SEQ ID NO: 620634 - protein, 9 aa, Homo Sapiens
VFDIPEMVW

SEQ ID NO: 620635 - protein, 9 aa, Homo Sapiens
ETGENLDPL

SEQ ID NO: 620636 - protein, 9 aa, Homo Sapiens
CPETQTPSS

SEQ ID NO: 620637 - protein, 9 aa, Homo Sapiens
LDSCPETQT

SEQ ID NO: 620638 - protein, 9 aa, Homo Sapiens
QLATLLACV

SEQ ID NO: 620639 - protein, 9 aa, Homo Sapiens
NKLYDKHLG

SEQ ID NO: 620640 - protein, 9 aa, Homo Sapiens
IWISIPLCI

SEQ ID NO: 620641 - protein, 9 aa, Homo Sapiens
RQETEEKVG

SEQ ID NO: 620642 - protein, 9 aa, Homo Sapiens
VSTTEMAMF

SEQ ID NO: 620643 - protein, 9 aa, Homo Sapiens
AEISPLRLC

SEQ ID NO: 620644 - protein, 9 aa, Homo Sapiens
SGADKAIGV

SEQ ID NO: 620645 - protein, 9 aa, Homo Sapiens
PEMVWTAKQ

SEQ ID NO: 620646 - protein, 9 aa, Homo Sapiens
SSRRNQIVF

SEQ ID NO: 620647 - protein, 9 aa, Homo Sapiens
APKSAVGVQ

SEQ ID NO: 620648 - protein, 9 aa, Homo Sapiens
AVDILRFCT

SEQ ID NO: 620649 - protein, 9 aa, Homo Sapiens
ACCVKGRNA

SEQ ID NO: 620650 - protein, 9 aa, Homo Sapiens
HYKLQEATN

SEQ ID NO: 620651 - protein, 9 aa, Homo Sapiens
VEGNLRVEF

SEQ ID NO: 620652 - protein, 9 aa, Homo Sapiens
GNLRVEFLD

SEQ ID NO: 620653 - protein, 9 aa, Homo Sapiens
IVVAKNLDM

SEQ ID NO: 620654 - protein, 9 aa, Homo Sapiens
GCVFQIFFI

SEQ ID NO: 620655 - protein, 9 aa, Homo Sapiens
GVSGSQLYA

SEQ ID NO: 620656 - protein, 9 aa, Homo Sapiens
MLSTPQQSM

SEQ ID NO: 620657 - protein, 9 aa, Homo Sapiens
RVMSQWSRS

SEQ ID NO: 620658 - protein, 9 aa, Homo Sapiens
STPDYIREI

SEQ ID NO: 620659 - protein, 9 aa, Homo Sapiens
AYADCSYAS

SEQ ID NO: 620660 - protein, 9 aa, Homo Sapiens
RRADSLVST

SEQ ID NO: 620661 - protein, 9 aa, Homo Sapiens
LRVEFLDDR

SEQ ID NO: 620662 - protein, 9 aa, Homo Sapiens
SAFQYQPKL

SEQ ID NO: 620663 - protein, 9 aa, Homo Sapiens
FSQLATLLA

SEQ ID NO: 620664 - protein, 9 aa, Homo Sapiens
GSTPDYIRE

SEQ ID NO: 620665 - protein, 9 aa, Homo Sapiens
PIEFISNQW

SEQ ID NO: 620666 - protein, 9 aa, Homo Sapiens
ECKRKLENM

SEQ ID NO: 620667 - protein, 9 aa, Homo Sapiens
NFLLPVFSQ

SEQ ID NO: 620668 - protein, 9 aa, Homo Sapiens
NRLLTSGSY

SEQ ID NO: 620669 - protein, 9 aa, Homo Sapiens
QLVAEKLGA

SEQ ID NO: 620670 - protein, 9 aa, Homo Sapiens
CVKGRNALQ

SEQ ID NO: 620671 - protein, 9 aa, Homo Sapiens
ESSGSSLPV

SEQ ID NO: 620672 - protein, 9 aa, Homo Sapiens
QPRVMSQWS

SEQ ID NO: 620673 - protein, 9 aa, Homo Sapiens
ERPLVSEER

SEQ ID NO: 620674 - protein, 9 aa, Homo Sapiens
TPQQSMELV

SEQ ID NO: 620675 - protein, 9 aa, Homo Sapiens
STTEMAMFR

SEQ ID NO: 620676 - protein, 9 aa, Homo Sapiens
DVAEECKRK

SEQ ID NO: 620677 - protein, 9 aa, Homo Sapiens
LEPGTAPCP

SEQ ID NO: 620678 - protein, 9 aa, Homo Sapiens
TQDAGAIAG

SEQ ID NO: 620679 - protein, 9 aa, Homo Sapiens
FLLPVFSQL

SEQ ID NO: 620680 - protein, 9 aa, Homo Sapiens
LSESSGSSL

SEQ ID NO: 620681 - protein, 9 aa, Homo Sapiens
GTKEPIEFI

SEQ ID NO: 620682 - protein, 9 aa, Homo Sapiens
SESSGSSLP

SEQ ID NO: 620683 - protein, 9 aa, Homo Sapiens
AAERPLVSE

SEQ ID NO: 620684 - protein, 9 aa, Homo Sapiens
IGLDSCPET

SEQ ID NO: 620685 - protein, 9 aa, Homo Sapiens
NAFYSSRRN

SEQ ID NO: 620686 - protein, 9 aa, Homo Sapiens
VVAKNLDML

SEQ ID NO: 620687 - protein, 9 aa, Homo Sapiens
FGGCVFQIF

SEQ ID NO: 620688 - protein, 9 aa, Homo Sapiens
GFLHSISKI

SEQ ID NO: 620689 - protein, 9 aa, Homo Sapiens
YSSRRNQIV

SEQ ID NO: 620690 - protein, 9 aa, Homo Sapiens
LTSGSYEAA

SEQ ID NO: 620691 - protein, 9 aa, Homo Sapiens
AVGVQPILN

SEQ ID NO: 620692 - protein, 9 aa, Homo Sapiens
PTLREKGLQ

SEQ ID NO: 620693 - protein, 9 aa, Homo Sapiens
ISKIVLTMN

SEQ ID NO: 620694 - protein, 9 aa, Homo Sapiens
KELDDRRQE

SEQ ID NO: 620695 - protein, 9 aa, Homo Sapiens
LQLQQFRPA

SEQ ID NO: 620696 - protein, 9 aa, Homo Sapiens
EPTVAEPPS

SEQ ID NO: 620697 - protein, 9 aa, Homo Sapiens
LQQFRPALM

SEQ ID NO: 620698 - protein, 9 aa, Homo Sapiens
GLNRLLTSG

SEQ ID NO: 620699 - protein, 9 aa, Homo Sapiens
DNLLRNDIG

SEQ ID NO: 620700 - protein, 9 aa, Homo Sapiens
QPSSETAVD

SEQ ID NO: 620701 - protein, 9 aa, Homo Sapiens
QGASTLPTN

SEQ ID NO: 620702 - protein, 9 aa, Homo Sapiens
PTSTACCVK

SEQ ID NO: 620703 - protein, 9 aa, Homo Sapiens
ERYDNKLRP

SEQ ID NO: 620704 - protein, 9 aa, Homo Sapiens
VKGRNALQR

SEQ ID NO: 620705 - protein, 9 aa, Homo Sapiens
SETAVDILR

SEQ ID NO: 620706 - protein, 9 aa, Homo Sapiens
PPGPCLEPG

SEQ ID NO: 620707 - protein, 9 aa, Homo Sapiens
CVFQIFFIH

SEQ ID NO: 620708 - protein, 9 aa, Homo Sapiens
DICYSTPLM

SEQ ID NO: 620709 - protein, 9 aa, Homo Sapiens
ENLDPLEEI

SEQ ID NO: 620710 - protein, 9 aa, Homo Sapiens
FISNQWFGA

SEQ ID NO: 620711 - protein, 9 aa, Homo Sapiens
ASETSGYIA

SEQ ID NO: 620712 - protein, 9 aa, Homo Sapiens
RYDNKLRPD

SEQ ID NO: 620713 - protein, 9 aa, Homo Sapiens
NINYTLWSQ

SEQ ID NO: 620714 - protein, 9 aa, Homo Sapiens
RNDIGGPYS

SEQ ID NO: 620715 - protein, 9 aa, Homo Sapiens
EFHYKLQEA

SEQ ID NO: 620716 - protein, 9 aa, Homo Sapiens
SPLWPSVPD

SEQ ID NO: 620717 - protein, 9 aa, Homo Sapiens
GCLSEPGLI

SEQ ID NO: 620718 - protein, 9 aa, Homo Sapiens
VVELNVGSQ

SEQ ID NO: 620719 - protein, 9 aa, Homo Sapiens
LDRCVCILH

SEQ ID NO: 620720 - protein, 9 aa, Homo Sapiens
KVAQDLDLR

SEQ ID NO: 620721 - protein, 9 aa, Homo Sapiens
MAVLPPLIA

SEQ ID NO: 620722 - protein, 9 aa, Homo Sapiens
EHACVHSGE

SEQ ID NO: 620723 - protein, 9 aa, Homo Sapiens
ASETLEFGN

SEQ ID NO: 620724 - protein, 9 aa, Homo Sapiens
CILHPVWTQ

SEQ ID NO: 620725 - protein, 9 aa, Homo Sapiens
LYTGEVVEN

SEQ ID NO: 620726 - protein, 9 aa, Homo Sapiens
SGTNTQVTY

SEQ ID NO: 620727 - protein, 9 aa, Homo Sapiens
IPLYTGEVV

SEQ ID NO: 620728 - protein, 9 aa, Homo Sapiens
ATWRSVGAR

SEQ ID NO: 620729 - protein, 9 aa, Homo Sapiens
KGQCSSDLF

SEQ ID NO: 620730 - protein, 9 aa, Homo Sapiens
CVCILHPVW

SEQ ID NO: 620731 - protein, 9 aa, Homo Sapiens
SHNGMLTGY

SEQ ID NO: 620732 - protein, 9 aa, Homo Sapiens
CFRQYLASK

SEQ ID NO: 620733 - protein, 9 aa, Homo Sapiens
CHEAVLPQE

SEQ ID NO: 620734 - protein, 9 aa, Homo Sapiens
KGCKWTLQC

SEQ ID NO: 620735 - protein, 9 aa, Homo Sapiens
TLQCFRQYL

SEQ ID NO: 620736 - protein, 9 aa, Homo Sapiens
SQVYVTKHS

SEQ ID NO: 620737 - protein, 9 aa, Homo Sapiens
LVLKDARAK

SEQ ID NO: 620738 - protein, 9 aa, Homo Sapiens
TLEFGNESG

SEQ ID NO: 620739 - protein, 9 aa, Homo Sapiens
TDRDSGTNT

SEQ ID NO: 620740 - protein, 9 aa, Homo Sapiens
AVLPQERLH

SEQ ID NO: 620741 - protein, 9 aa, Homo Sapiens
KWKGQCSSD

SEQ ID NO: 620742 - protein, 9 aa, Homo Sapiens
ELNVGSQVY

SEQ ID NO: 620743 - protein, 9 aa, Homo Sapiens
ANLIPPMKA

SEQ ID NO: 620744 - protein, 9 aa, Homo Sapiens
AEERGELVL

SEQ ID NO: 620745 - protein, 9 aa, Homo Sapiens
LIPPMKATP

SEQ ID NO: 620746 - protein, 9 aa, Homo Sapiens
TNTQVTYSL

SEQ ID NO: 620747 - protein, 9 aa, Homo Sapiens
SVMGILCTF

SEQ ID NO: 620748 - protein, 9 aa, Homo Sapiens
FGNESGVLY

SEQ ID NO: 620749 - protein, 9 aa, Homo Sapiens
GELVLKDAR

SEQ ID NO: 620750 - protein, 9 aa, Homo Sapiens
NGMLTGYVL

SEQ ID NO: 620751 - protein, 9 aa, Homo Sapiens
GYTCMCAGC

SEQ ID NO: 620752 - protein, 9 aa, Homo Sapiens
PARLSLWQT

SEQ ID NO: 620753 - protein, 9 aa, Homo Sapiens
HEAVLPQER

SEQ ID NO: 620754 - protein, 9 aa, Homo Sapiens
LNVGSQVYV

SEQ ID NO: 620755 - protein, 9 aa, Homo Sapiens
LANLIPPMK

SEQ ID NO: 620756 - protein, 9 aa, Homo Sapiens
WQTGSPGMI

SEQ ID NO: 620757 - protein, 9 aa, Homo Sapiens
SPNRKSPLW

SEQ ID NO: 620758 - protein, 9 aa, Homo Sapiens
QAPATATED

SEQ ID NO: 620759 - protein, 9 aa, Homo Sapiens
INAVLLYLL

SEQ ID NO: 620760 - protein, 9 aa, Homo Sapiens
LKWKGQCSS

SEQ ID NO: 620761 - protein, 9 aa, Homo Sapiens
WKGQCSSDL

SEQ ID NO: 620762 - protein, 9 aa, Homo Sapiens
SETLEFGNE

SEQ ID NO: 620763 - protein, 9 aa, Homo Sapiens
LCKHIPLYT

SEQ ID NO: 620764 - protein, 9 aa, Homo Sapiens
CKWTLQCFR

SEQ ID NO: 620765 - protein, 9 aa, Homo Sapiens
KWTLQCFRQ

SEQ ID NO: 620766 - protein, 9 aa, Homo Sapiens
MGILCTFFA

SEQ ID NO: 620767 - protein, 9 aa, Homo Sapiens
RAEAATWRS

SEQ ID NO: 620768 - protein, 9 aa, Homo Sapiens
IPPMKATPL

SEQ ID NO: 620769 - protein, 9 aa, Homo Sapiens
EAEERGELV

SEQ ID NO: 620770 - protein, 9 aa, Homo Sapiens
PPLSHNGML

SEQ ID NO: 620771 - protein, 9 aa, Homo Sapiens
NDLRRLCIL

SEQ ID NO: 620772 - protein, 9 aa, Homo Sapiens
NLIPPMKAT

SEQ ID NO: 620773 - protein, 9 aa, Homo Sapiens
LWQTGSPGM

SEQ ID NO: 620774 - protein, 9 aa, Homo Sapiens
MLTGYVLSY

SEQ ID NO: 620775 - protein, 9 aa, Homo Sapiens
PNRKSPLWP

SEQ ID NO: 620776 - protein, 9 aa, Homo Sapiens
HLQINAVLL

SEQ ID NO: 620777 - protein, 9 aa, Homo Sapiens
KAIEKVAQD

SEQ ID NO: 620778 - protein, 9 aa, Homo Sapiens
EAATWRSVG

SEQ ID NO: 620779 - protein, 9 aa, Homo Sapiens
NRGISQAPA

SEQ ID NO: 620780 - protein, 9 aa, Homo Sapiens
RDSGTNTQV

SEQ ID NO: 620781 - protein, 9 aa, Homo Sapiens
CTFFATFLS

SEQ ID NO: 620782 - protein, 9 aa, Homo Sapiens
ILCTFFATF

SEQ ID NO: 620783 - protein, 9 aa, Homo Sapiens
VLKDARAKQ

SEQ ID NO: 620784 - protein, 9 aa, Homo Sapiens
FCKAIEKVA

SEQ ID NO: 620785 - protein, 9 aa, Homo Sapiens
PLYTGEVVE

SEQ ID NO: 620786 - protein, 9 aa, Homo Sapiens
RLSLWQTGS

SEQ ID NO: 620787 - protein, 9 aa, Homo Sapiens
SLWQTGSPG

SEQ ID NO: 620788 - protein, 9 aa, Homo Sapiens
ALRAEAATW

SEQ ID NO: 620789 - protein, 9 aa, Homo Sapiens
PPMKATPLK

SEQ ID NO: 620790 - protein, 9 aa, Homo Sapiens
SQAPATATE

SEQ ID NO: 620791 - protein, 9 aa, Homo Sapiens
PFCKAIEKV

SEQ ID NO: 620792 - protein, 9 aa, Homo Sapiens
NESGVLYKT

SEQ ID NO: 620793 - protein, 9 aa, Homo Sapiens
ARLSLWQTG

SEQ ID NO: 620794 - protein, 9 aa, Homo Sapiens
QHLKWKGQC

SEQ ID NO: 620795 - protein, 9 aa, Homo Sapiens
CSPNRKSPL

SEQ ID NO: 620796 - protein, 9 aa, Homo Sapiens
RCVCILHPV

SEQ ID NO: 620797 - protein, 9 aa, Homo Sapiens
RKSPLWPSV

SEQ ID NO: 620798 - protein, 9 aa, Homo Sapiens
QERLHLEPI

SEQ ID NO: 620799 - protein, 9 aa, Homo Sapiens
TFFATFLSI

SEQ ID NO: 620800 - protein, 9 aa, Homo Sapiens
GNESGVLYK

SEQ ID NO: 620801 - protein, 9 aa, Homo Sapiens
QPPLSHNGM

SEQ ID NO: 620802 - protein, 9 aa, Homo Sapiens
GTNTQVTYS

SEQ ID NO: 620803 - protein, 9 aa, Homo Sapiens
AVLLYLLYL

SEQ ID NO: 620804 - protein, 9 aa, Homo Sapiens
EKVAQDLDL

SEQ ID NO: 620805 - protein, 9 aa, Homo Sapiens
TWRSVGARM

SEQ ID NO: 620806 - protein, 9 aa, Homo Sapiens
NRKSPLWPS

SEQ ID NO: 620807 - protein, 9 aa, Homo Sapiens
HLKWKGQCS

SEQ ID NO: 620808 - protein, 9 aa, Homo Sapiens
VLPPLIALV

SEQ ID NO: 620809 - protein, 9 aa, Homo Sapiens
LLYLLYLVE

SEQ ID NO: 620810 - protein, 9 aa, Homo Sapiens
APATATEDL

SEQ ID NO: 620811 - protein, 9 aa, Homo Sapiens
ATATEDLEI

SEQ ID NO: 620812 - protein, 9 aa, Homo Sapiens
DPFCKAIEK

SEQ ID NO: 620813 - protein, 9 aa, Homo Sapiens
LEFGNESGV

SEQ ID NO: 620814 - protein, 9 aa, Homo Sapiens
GCKWTLQCF

SEQ ID NO: 620815 - protein, 9 aa, Homo Sapiens
ILHPVWTQN

SEQ ID NO: 620816 - protein, 9 aa, Homo Sapiens
GHLQINAVL

SEQ ID NO: 620817 - protein, 9 aa, Homo Sapiens
LEHACVHSG

SEQ ID NO: 620818 - protein, 9 aa, Homo Sapiens
SFALLEHAC

SEQ ID NO: 620819 - protein, 9 aa, Homo Sapiens
GSQVYVTKH

SEQ ID NO: 620820 - protein, 9 aa, Homo Sapiens
RGELVLKDA

SEQ ID NO: 620821 - protein, 9 aa, Homo Sapiens
VCILHPVWT

SEQ ID NO: 620822 - protein, 9 aa, Homo Sapiens
PCHEAVLPQ

SEQ ID NO: 620823 - protein, 9 aa, Homo Sapiens
ERGELVLKD

SEQ ID NO: 620824 - protein, 9 aa, Homo Sapiens
QINAVLLYL

SEQ ID NO: 620825 - protein, 9 aa, Homo Sapiens
PMKATPLKR

SEQ ID NO: 620826 - protein, 9 aa, Homo Sapiens
TGEVVENTH

SEQ ID NO: 620827 - protein, 9 aa, Homo Sapiens
VGSQVYVTK

SEQ ID NO: 620828 - protein, 9 aa, Homo Sapiens
WTLQCFRQY

SEQ ID NO: 620829 - protein, 9 aa, Homo Sapiens
AGCLSEPGL

SEQ ID NO: 620830 - protein, 9 aa, Homo Sapiens
NTQVTYSLL

SEQ ID NO: 620831 - protein, 9 aa, Homo Sapiens
AAGIGVNDL

SEQ ID NO: 620832 - protein, 9 aa, Homo Sapiens
NAVLLYLLY

SEQ ID NO: 620833 - protein, 9 aa, Homo Sapiens
MCAGCLSEP

SEQ ID NO: 620834 - protein, 9 aa, Homo Sapiens
QCFRQYLAS

SEQ ID NO: 620835 - protein, 9 aa, Homo Sapiens
RGISQAPAT

SEQ ID NO: 620836 - protein, 9 aa, Homo Sapiens
ETLEFGNES

SEQ ID NO: 620837 - protein, 9 aa, Homo Sapiens
ISQAPATAT

SEQ ID NO: 620838 - protein, 9 aa, Homo Sapiens
ELVLKDARA

SEQ ID NO: 620839 - protein, 9 aa, Homo Sapiens
KHIPLYTGE

SEQ ID NO: 620840 - protein, 9 aa, Homo Sapiens
LQHLKWKGQ

SEQ ID NO: 620841 - protein, 9 aa, Homo Sapiens
FALLEHACV

SEQ ID NO: 620842 - protein, 9 aa, Homo Sapiens
AATWRSVGA

SEQ ID NO: 620843 - protein, 9 aa, Homo Sapiens
DRCVCILHP

SEQ ID NO: 620844 - protein, 9 aa, Homo Sapiens
LSHNGMLTG

SEQ ID NO: 620845 - protein, 9 aa, Homo Sapiens
PPLIALVYS

SEQ ID NO: 620846 - protein, 9 aa, Homo Sapiens
IGVNDLRRL

SEQ ID NO: 620847 - protein, 9 aa, Homo Sapiens
YTGEVVENT

SEQ ID NO: 620848 - protein, 9 aa, Homo Sapiens
NVGSQVYVT

SEQ ID NO: 620849 - protein, 9 aa, Homo Sapiens
CAGCLSEPG

SEQ ID NO: 620850 - protein, 9 aa, Homo Sapiens
VMGILCTFF

SEQ ID NO: 620851 - protein, 9 aa, Homo Sapiens
LQCFRQYLA

SEQ ID NO: 620852 - protein, 9 aa, Homo Sapiens
LRAEAATWR

SEQ ID NO: 620853 - protein, 9 aa, Homo Sapiens
HIPLYTGEV

SEQ ID NO: 620854 - protein, 9 aa, Homo Sapiens
VNDLRRLCI

SEQ ID NO: 620855 - protein, 9 aa, Homo Sapiens
TCMCAGCLS

SEQ ID NO: 620856 - protein, 9 aa, Homo Sapiens
GMLTGYVLS

SEQ ID NO: 620857 - protein, 9 aa, Homo Sapiens
PQERLHLEP

SEQ ID NO: 620858 - protein, 9 aa, Homo Sapiens
EERGELVLK

SEQ ID NO: 620859 - protein, 9 aa, Homo Sapiens
DRDSGTNTQ

SEQ ID NO: 620860 - protein, 9 aa, Homo Sapiens
PATATEDLE

SEQ ID NO: 620861 - protein, 9 aa, Homo Sapiens
EVVELNVGS

SEQ ID NO: 620862 - protein, 9 aa, Homo Sapiens
YTCMCAGCL

SEQ ID NO: 620863 - protein, 9 aa, Homo Sapiens
HNGMLTGYV

SEQ ID NO: 620864 - protein, 9 aa, Homo Sapiens
SPARLSLWQ

SEQ ID NO: 620865 - protein, 9 aa, Homo Sapiens
AEAATWRSV

SEQ ID NO: 620866 - protein, 9 aa, Homo Sapiens
HACVHSGER

SEQ ID NO: 620867 - protein, 9 aa, Homo Sapiens
SNLQHLKWK

SEQ ID NO: 620868 - protein, 9 aa, Homo Sapiens
AAAGIGVND

SEQ ID NO: 620869 - protein, 9 aa, Homo Sapiens
LCCSPNRKS

SEQ ID NO: 620870 - protein, 9 aa, Homo Sapiens
NLQHLKWKG

SEQ ID NO: 620871 - protein, 9 aa, Homo Sapiens
AVLPPLIAL

SEQ ID NO: 620872 - protein, 9 aa, Homo Sapiens
CVHSGERPY

SEQ ID NO: 620873 - protein, 9 aa, Homo Sapiens
AIEKVAQDL

SEQ ID NO: 620874 - protein, 9 aa, Homo Sapiens
EAVLPQERL

SEQ ID NO: 620875 - protein, 9 aa, Homo Sapiens
VLPQERLHL

SEQ ID NO: 620876 - protein, 9 aa, Homo Sapiens
PLSHNGMLT

SEQ ID NO: 620877 - protein, 9 aa, Homo Sapiens
IEKVAQDLD

SEQ ID NO: 620878 - protein, 9 aa, Homo Sapiens
ALLEHACVH

SEQ ID NO: 620879 - protein, 9 aa, Homo Sapiens
TQVTYSLLP

SEQ ID NO: 620880 - protein, 9 aa, Homo Sapiens
LPQERLHLE

SEQ ID NO: 620881 - protein, 9 aa, Homo Sapiens
CMCAGCLSE

SEQ ID NO: 620882 - protein, 9 aa, Homo Sapiens
AALRAEAAT

SEQ ID NO: 620883 - protein, 9 aa, Homo Sapiens
SLANLIPPM

SEQ ID NO: 620884 - protein, 9 aa, Homo Sapiens
GILCTFFAT

SEQ ID NO: 620885 - protein, 9 aa, Homo Sapiens
GVNDLRRLC

SEQ ID NO: 620886 - protein, 9 aa, Homo Sapiens
LCTFFATFL

SEQ ID NO: 620887 - protein, 9 aa, Homo Sapiens
ACVHSGERP

SEQ ID NO: 620888 - protein, 9 aa, Homo Sapiens
VELNVGSQV

SEQ ID NO: 620889 - protein, 9 aa, Homo Sapiens
KSPLWPSVP

SEQ ID NO: 620890 - protein, 9 aa, Homo Sapiens
IALDRCVCI

SEQ ID NO: 620891 - protein, 9 aa, Homo Sapiens
AGIGVNDLR

SEQ ID NO: 620892 - protein, 9 aa, Homo Sapiens
GSPARLSLW

SEQ ID NO: 620893 - protein, 9 aa, Homo Sapiens
CCSPNRKSP

SEQ ID NO: 620894 - protein, 9 aa, Homo Sapiens
LSLWQTGSP

SEQ ID NO: 620895 - protein, 9 aa, Homo Sapiens
CLSEPGLIC

SEQ ID NO: 620896 - protein, 9 aa, Homo Sapiens
GISQAPATA

SEQ ID NO: 620897 - protein, 9 aa, Homo Sapiens
GIGVNDLRR

SEQ ID NO: 620898 - protein, 9 aa, Homo Sapiens
ALDRCVCIL

SEQ ID NO: 620899 - protein, 9 aa, Homo Sapiens
SAAAGIGVN

SEQ ID NO: 620900 - protein, 9 aa, Homo Sapiens
LLEHACVHS

SEQ ID NO: 620901 - protein, 9 aa, Homo Sapiens
EFGNESGVL

SEQ ID NO: 620902 - protein, 9 aa, Homo Sapiens
DSGTNTQVT

SEQ ID NO: 620903 - protein, 9 aa, Homo Sapiens
MKATPLKRF

SEQ ID NO: 620904 - protein, 9 aa, Homo Sapiens
EDAGVECSI

SEQ ID NO: 620905 - protein, 9 aa, Homo Sapiens
VLLYLLYLV

SEQ ID NO: 620906 - protein, 9 aa, Homo Sapiens
CKAIEKVAQ

SEQ ID NO: 620907 - protein, 9 aa, Homo Sapiens
LPPLIALVY

SEQ ID NO: 620908 - protein, 9 aa, Homo Sapiens
LQINAVLLY

SEQ ID NO: 620909 - protein, 9 aa, Homo Sapiens
CKHIPLYTG

SEQ ID NO: 620910 - protein, 9 aa, Homo Sapiens
LQKHTQEET

SEQ ID NO: 620911 - protein, 9 aa, Homo Sapiens
GATEMEGSK

SEQ ID NO: 620912 - protein, 9 aa, Homo Sapiens
QVENKKKYI

SEQ ID NO: 620913 - protein, 9 aa, Homo Sapiens
EEIELAYVQ

SEQ ID NO: 620914 - protein, 9 aa, Homo Sapiens
ESQTAKAQL

SEQ ID NO: 620915 - protein, 9 aa, Homo Sapiens
AKLDVLTLK

SEQ ID NO: 620916 - protein, 9 aa, Homo Sapiens
LASKAHKPG

SEQ ID NO: 620917 - protein, 9 aa, Homo Sapiens
VKGFPIVYC

SEQ ID NO: 620918 - protein, 9 aa, Homo Sapiens
RTCTSQWSW

SEQ ID NO: 620919 - protein, 9 aa, Homo Sapiens
PTLKRRHRA

SEQ ID NO: 620920 - protein, 9 aa, Homo Sapiens
CAMLLNIPL

SEQ ID NO: 620921 - protein, 9 aa, Homo Sapiens
STHRKADFQ

SEQ ID NO: 620922 - protein, 9 aa, Homo Sapiens
QLSAAALTD

SEQ ID NO: 620923 - protein, 9 aa, Homo Sapiens
SWIIVSINA

SEQ ID NO: 620924 - protein, 9 aa, Homo Sapiens
QVVKGFPIV

SEQ ID NO: 620925 - protein, 9 aa, Homo Sapiens
LQDSGQSRT

SEQ ID NO: 620926 - protein, 9 aa, Homo Sapiens
GQSLRAMLE

SEQ ID NO: 620927 - protein, 9 aa, Homo Sapiens
GENVLTALS

SEQ ID NO: 620928 - protein, 9 aa, Homo Sapiens
PRATGLHPD

SEQ ID NO: 620929 - protein, 9 aa, Homo Sapiens
HEAENFVEK

SEQ ID NO: 620930 - protein, 9 aa, Homo Sapiens
MIHEAENFV

SEQ ID NO: 620931 - protein, 9 aa, Homo Sapiens
FFTGPSITS

SEQ ID NO: 620932 - protein, 9 aa, Homo Sapiens
GHSFRASAT

SEQ ID NO: 620933 - protein, 9 aa, Homo Sapiens
LKLWPGTTG

SEQ ID NO: 620934 - protein, 9 aa, Homo Sapiens
DCHQLLASW

SEQ ID NO: 620935 - protein, 9 aa, Homo Sapiens
SCGIISGPY

SEQ ID NO: 620936 - protein, 9 aa, Homo Sapiens
LEREMGINS

SEQ ID NO: 620937 - protein, 9 aa, Homo Sapiens
CHQQVLETR

SEQ ID NO: 620938 - protein, 9 aa, Homo Sapiens
TPEEIKYIL

SEQ ID NO: 620939 - protein, 9 aa, Homo Sapiens
AFLLASKAH

SEQ ID NO: 620940 - protein, 9 aa, Homo Sapiens
FLLASKAHK

SEQ ID NO: 620941 - protein, 9 aa, Homo Sapiens
PMHFFLFLP

SEQ ID NO: 620942 - protein, 9 aa, Homo Sapiens
GFPGRDGVP

SEQ ID NO: 620943 - protein, 9 aa, Homo Sapiens
DEDSDLNFD

SEQ ID NO: 620944 - protein, 9 aa, Homo Sapiens
AECLEHLHR

SEQ ID NO: 620945 - protein, 9 aa, Homo Sapiens
ASANVVCAW

SEQ ID NO: 620946 - protein, 9 aa, Homo Sapiens
DASQEIIVI

SEQ ID NO: 620947 - protein, 9 aa, Homo Sapiens
MSTNICSFM

SEQ ID NO: 620948 - protein, 9 aa, Homo Sapiens
LLPLDGELD

SEQ ID NO: 620949 - protein, 9 aa, Homo Sapiens
MLERYTDKL

SEQ ID NO: 620950 - protein, 9 aa, Homo Sapiens
DMWGDKDFT

SEQ ID NO: 620951 - protein, 9 aa, Homo Sapiens
RRCPHQERC

SEQ ID NO: 620952 - protein, 9 aa, Homo Sapiens
AGEKPYQCT

SEQ ID NO: 620953 - protein, 9 aa, Homo Sapiens
KFQNLVMAH

SEQ ID NO: 620954 - protein, 9 aa, Homo Sapiens
NVEGMWLWI

SEQ ID NO: 620955 - protein, 9 aa, Homo Sapiens
RPSVENFFT

SEQ ID NO: 620956 - protein, 9 aa, Homo Sapiens
SRAGTPMHW

SEQ ID NO: 620957 - protein, 9 aa, Homo Sapiens
LSQAGPCVP

SEQ ID NO: 620958 - protein, 9 aa, Homo Sapiens
AYAKAGEVA

SEQ ID NO: 620959 - protein, 9 aa, Homo Sapiens
VENKKKYIE

SEQ ID NO: 620960 - protein, 9 aa, Homo Sapiens
PLCILMAAL

SEQ ID NO: 620961 - protein, 9 aa, Homo Sapiens
LGRTCTSQW

SEQ ID NO: 620962 - protein, 9 aa, Homo Sapiens
GCHNVKVID

SEQ ID NO: 620963 - protein, 9 aa, Homo Sapiens
PLQKPLNPT

SEQ ID NO: 620964 - protein, 9 aa, Homo Sapiens
PPSPDTPLK

SEQ ID NO: 620965 - protein, 9 aa, Homo Sapiens
ATRAHAGSY

SEQ ID NO: 620966 - protein, 9 aa, Homo Sapiens
YLGKGGVVI

SEQ ID NO: 620967 - protein, 9 aa, Homo Sapiens
VGAFTVCLL

SEQ ID NO: 620968 - protein, 9 aa, Homo Sapiens
QNSTPSSSL

SEQ ID NO: 620969 - protein, 9 aa, Homo Sapiens
FAAILRNRS

SEQ ID NO: 620970 - protein, 9 aa, Homo Sapiens
PDSHVCCVF

SEQ ID NO: 620971 - protein, 9 aa, Homo Sapiens
ALPSNWALG

SEQ ID NO: 620972 - protein, 9 aa, Homo Sapiens
KWEPATRLW

SEQ ID NO: 620973 - protein, 9 aa, Homo Sapiens
IVGAFTVCL

SEQ ID NO: 620974 - protein, 9 aa, Homo Sapiens
LRNGTKVVP

SEQ ID NO: 620975 - protein, 9 aa, Homo Sapiens
ANVVCAWIA

SEQ ID NO: 620976 - protein, 9 aa, Homo Sapiens
GGSWAVTSD

SEQ ID NO: 620977 - protein, 9 aa, Homo Sapiens
EARGGCYTN

SEQ ID NO: 620978 - protein, 9 aa, Homo Sapiens
VVDLFHAVK

SEQ ID NO: 620979 - protein, 9 aa, Homo Sapiens
KPGQKWEPA

SEQ ID NO: 620980 - protein, 9 aa, Homo Sapiens
IVCVELHQR

SEQ ID NO: 620981 - protein, 9 aa, Homo Sapiens
GQGVHARCS

SEQ ID NO: 620982 - protein, 9 aa, Homo Sapiens
NAIDKIRVK

SEQ ID NO: 620983 - protein, 9 aa, Homo Sapiens
AGTPMHWLK

SEQ ID NO: 620984 - protein, 9 aa, Homo Sapiens
GEVAEEVLA

SEQ ID NO: 620985 - protein, 9 aa, Homo Sapiens
HHDVAVLLN

SEQ ID NO: 620986 - protein, 9 aa, Homo Sapiens
VGGYNYEEN

SEQ ID NO: 620987 - protein, 9 aa, Homo Sapiens
LGELNKEND

SEQ ID NO: 620988 - protein, 9 aa, Homo Sapiens
KACAMLLNI

SEQ ID NO: 620989 - protein, 9 aa, Homo Sapiens
NRKDICAGF

SEQ ID NO: 620990 - protein, 8 aa, Homo Sapiens
VLGTVLLP

SEQ ID NO: 620991 - protein, 9 aa, Homo Sapiens
VLLELVMKN

SEQ ID NO: 620992 - protein, 9 aa, Homo Sapiens
RVYEGFGQG

SEQ ID NO: 620993 - protein, 9 aa, Homo Sapiens
MPSASCLKL

SEQ ID NO: 620994 - protein, 9 aa, Homo Sapiens
DYLGKGGVV

SEQ ID NO: 620995 - protein, 9 aa, Homo Sapiens
GYQLIPLCI

SEQ ID NO: 620996 - protein, 9 aa, Homo Sapiens
NICSFMDRC

SEQ ID NO: 620997 - protein, 9 aa, Homo Sapiens
DRCREALLL

SEQ ID NO: 620998 - protein, 9 aa, Homo Sapiens
YTVELNGSR

SEQ ID NO: 620999 - protein, 9 aa, Homo Sapiens
GDTATNVSM

SEQ ID NO: 621000 - protein, 9 aa, Homo Sapiens
SLCGYCGIK

SEQ ID NO: 621001 - protein, 9 aa, Homo Sapiens
QRAISSRVQ

SEQ ID NO: 621002 - protein, 9 aa, Homo Sapiens
QGSINDKEA

SEQ ID NO: 621003 - protein, 9 aa, Homo Sapiens
GSWAVTSDQ

SEQ ID NO: 621004 - protein, 9 aa, Homo Sapiens
NLMRSGTLV

SEQ ID NO: 621005 - protein, 9 aa, Homo Sapiens
LDGTPCRPY

SEQ ID NO: 621006 - protein, 9 aa, Homo Sapiens
WPGTTGPWA

SEQ ID NO: 621007 - protein, 9 aa, Homo Sapiens
AYNVSTKSS

SEQ ID NO: 621008 - protein, 9 aa, Homo Sapiens
EDAGSYNLH

SEQ ID NO: 621009 - protein, 9 aa, Homo Sapiens
LLAQDEERD

SEQ ID NO: 621010 - protein, 9 aa, Homo Sapiens
AAAEAALSQ

SEQ ID NO: 621011 - protein, 9 aa, Homo Sapiens
DAVYQCMAE

SEQ ID NO: 621012 - protein, 9 aa, Homo Sapiens
EKAKQVRSE

SEQ ID NO: 621013 - protein, 9 aa, Homo Sapiens
HFFLFLPSV

SEQ ID NO: 621014 - protein, 9 aa, Homo Sapiens
LLQERLRGL

SEQ ID NO: 621015 - protein, 9 aa, Homo Sapiens
LQEESQTAK

SEQ ID NO: 621016 - protein, 9 aa, Homo Sapiens
GQERPVSLT

SEQ ID NO: 621017 - protein, 9 aa, Homo Sapiens
GELFAAILR

SEQ ID NO: 621018 - protein, 9 aa, Homo Sapiens
NLHIIKRGD

SEQ ID NO: 621019 - protein, 9 aa, Homo Sapiens
SPELLEDVR

SEQ ID NO: 621020 - protein, 9 aa, Homo Sapiens
GMWLWINNS

SEQ ID NO: 621021 - protein, 9 aa, Homo Sapiens
LTPPSTPTK

SEQ ID NO: 621022 - protein, 9 aa, Homo Sapiens
PHKECKTLS

SEQ ID NO: 621023 - protein, 9 aa, Homo Sapiens
QCLLYKNSG

SEQ ID NO: 621024 - protein, 9 aa, Homo Sapiens
EEIKYILKF

SEQ ID NO: 621025 - protein, 9 aa, Homo Sapiens
SDMTVRKEC

SEQ ID NO: 621026 - protein, 9 aa, Homo Sapiens
KGTRTSFTA

SEQ ID NO: 621027 - protein, 9 aa, Homo Sapiens
WRDCSCPMS

SEQ ID NO: 621028 - protein, 9 aa, Homo Sapiens
LSRAGTPMH

SEQ ID NO: 621029 - protein, 9 aa, Homo Sapiens
PSTGGSTTI

SEQ ID NO: 621030 - protein, 9 aa, Homo Sapiens
VENFFTLVT

SEQ ID NO: 621031 - protein, 9 aa, Homo Sapiens
WAQTVVTGL

SEQ ID NO: 621032 - protein, 9 aa, Homo Sapiens
CDTPGSSIV

SEQ ID NO: 621033 - protein, 9 aa, Homo Sapiens
NRFSPKSPN

SEQ ID NO: 621034 - protein, 9 aa, Homo Sapiens
VIHSKNLMR

SEQ ID NO: 621035 - protein, 9 aa, Homo Sapiens
SKRTPLRRK

SEQ ID NO: 621036 - protein, 9 aa, Homo Sapiens
FAERLSAVK

SEQ ID NO: 621037 - protein, 9 aa, Homo Sapiens
DLRDCVTYH

SEQ ID NO: 621038 - protein, 9 aa, Homo Sapiens
VRPFREYEL

SEQ ID NO: 621039 - protein, 9 aa, Homo Sapiens
WQTRDMPPC

SEQ ID NO: 621040 - protein, 9 aa, Homo Sapiens
IGTVPSASC

SEQ ID NO: 621041 - protein, 9 aa, Homo Sapiens
LLQHLKGHE

SEQ ID NO: 621042 - protein, 9 aa, Homo Sapiens
SYSCEPTLK

SEQ ID NO: 621043 - protein, 9 aa, Homo Sapiens
SHVCCVFWL

SEQ ID NO: 621044 - protein, 9 aa, Homo Sapiens
PSVSDIGLV

SEQ ID NO: 621045 - protein, 9 aa, Homo Sapiens
VALRPLTKE

SEQ ID NO: 621046 - protein, 9 aa, Homo Sapiens
IRSTEGSRK

SEQ ID NO: 621047 - protein, 9 aa, Homo Sapiens
PIKTNLEIA

SEQ ID NO: 621048 - protein, 9 aa, Homo Sapiens
FLQFQRNVF

SEQ ID NO: 621049 - protein, 9 aa, Homo Sapiens
NLTQDNQDR

SEQ ID NO: 621050 - protein, 9 aa, Homo Sapiens
KCLDESNCR

SEQ ID NO: 621051 - protein, 9 aa, Homo Sapiens
PELLEDVRL

SEQ ID NO: 621052 - protein, 9 aa, Homo Sapiens
GTKVVPSFR

SEQ ID NO: 621053 - protein, 9 aa, Homo Sapiens
PDPYKSAPA

SEQ ID NO: 621054 - protein, 9 aa, Homo Sapiens
KIPIPDTKL

SEQ ID NO: 621055 - protein, 9 aa, Homo Sapiens
ALVLFYPTL

SEQ ID NO: 621056 - protein, 9 aa, Homo Sapiens
GLALVLFYP

SEQ ID NO: 621057 - protein, 9 aa, Homo Sapiens
ASSYLLSPE

SEQ ID NO: 621058 - protein, 9 aa, Homo Sapiens
ILGELNKEN

SEQ ID NO: 621059 - protein, 9 aa, Homo Sapiens
LFPQRSDGK

SEQ ID NO: 621060 - protein, 9 aa, Homo Sapiens
GCYTNRTFE

SEQ ID NO: 621061 - protein, 9 aa, Homo Sapiens
SAHISLLEK

SEQ ID NO: 621062 - protein, 9 aa, Homo Sapiens
TPLIEVNQG

SEQ ID NO: 621063 - protein, 9 aa, Homo Sapiens
LSGKLDIVC

SEQ ID NO: 621064 - protein, 9 aa, Homo Sapiens
ICSFMDRCV

SEQ ID NO: 621065 - protein, 9 aa, Homo Sapiens
DAGSYNLHI

SEQ ID NO: 621066 - protein, 9 aa, Homo Sapiens
EIKYILKFQ

SEQ ID NO: 621067 - protein, 9 aa, Homo Sapiens
ITMQCTKQY

SEQ ID NO: 621068 - protein, 9 aa, Homo Sapiens
HSSTALHPC

SEQ ID NO: 621069 - protein, 9 aa, Homo Sapiens
VAAKWRASS

SEQ ID NO: 621070 - protein, 9 aa, Homo Sapiens
IFFTGPSIT

SEQ ID NO: 621071 - protein, 9 aa, Homo Sapiens
EAENFVEKI

SEQ ID NO: 621072 - protein, 9 aa, Homo Sapiens
DINTNMYQQ

SEQ ID NO: 621073 - protein, 9 aa, Homo Sapiens
TQLCTPGLH

SEQ ID NO: 621074 - protein, 9 aa, Homo Sapiens
LDVLTLKEE

SEQ ID NO: 621075 - protein, 9 aa, Homo Sapiens
DDAVYQCMA

SEQ ID NO: 621076 - protein, 9 aa, Homo Sapiens
VFAFSRVLR

SEQ ID NO: 621077 - protein, 9 aa, Homo Sapiens
WRALQSIPT

SEQ ID NO: 621078 - protein, 9 aa, Homo Sapiens
MREIPKTIT

SEQ ID NO: 621079 - protein, 9 aa, Homo Sapiens
CSCPMSQRS

SEQ ID NO: 621080 - protein, 9 aa, Homo Sapiens
NAQVVKGFP

SEQ ID NO: 621081 - protein, 9 aa, Homo Sapiens
QSRTVGPNP

SEQ ID NO: 621082 - protein, 9 aa, Homo Sapiens
SQAQVMLLT

SEQ ID NO: 621083 - protein, 9 aa, Homo Sapiens
LCSRPAPST

SEQ ID NO: 621084 - protein, 9 aa, Homo Sapiens
DEENLTQDN

SEQ ID NO: 621085 - protein, 9 aa, Homo Sapiens
KPGIPLCSR

SEQ ID NO: 621086 - protein, 9 aa, Homo Sapiens
KEKELQKHT

SEQ ID NO: 621087 - protein, 9 aa, Homo Sapiens
GTPCRPYET

SEQ ID NO: 621088 - protein, 9 aa, Homo Sapiens
HLKGHEAAR

SEQ ID NO: 621089 - protein, 9 aa, Homo Sapiens
FNYLAKLDV

SEQ ID NO: 621090 - protein, 9 aa, Homo Sapiens
NKKKYIEEL

SEQ ID NO: 621091 - protein, 9 aa, Homo Sapiens
DKPVDLSDR

SEQ ID NO: 621092 - protein, 9 aa, Homo Sapiens
LENVTLARS

SEQ ID NO: 621093 - protein, 9 aa, Homo Sapiens
ERTVLRKGQ

SEQ ID NO: 621094 - protein, 9 aa, Homo Sapiens
FMLLLALNL

SEQ ID NO: 621095 - protein, 9 aa, Homo Sapiens
DPYKSAPAP

SEQ ID NO: 621096 - protein, 9 aa, Homo Sapiens
NSTGKIVIA

SEQ ID NO: 621097 - protein, 9 aa, Homo Sapiens
SDVEMRNEE

SEQ ID NO: 621098 - protein, 9 aa, Homo Sapiens
VRLAQQHLP

SEQ ID NO: 621099 - protein, 9 aa, Homo Sapiens
IANFAEQIV

SEQ ID NO: 621100 - protein, 9 aa, Homo Sapiens
SGQSRTVGP

SEQ ID NO: 621101 - protein, 9 aa, Homo Sapiens
DLDRPKGTR

SEQ ID NO: 621102 - protein, 9 aa, Homo Sapiens
NVDQIFQET

SEQ ID NO: 621103 - protein, 9 aa, Homo Sapiens
LMKQLSILL

SEQ ID NO: 621104 - protein, 9 aa, Homo Sapiens
NVVDLFHAV

SEQ ID NO: 621105 - protein, 9 aa, Homo Sapiens
WSWKVTSPS

SEQ ID NO: 621106 - protein, 9 aa, Homo Sapiens
PQLSAAALT

SEQ ID NO: 621107 - protein, 9 aa, Homo Sapiens
VQRVNGTIS

SEQ ID NO: 621108 - protein, 9 aa, Homo Sapiens
AYRILIFAD

SEQ ID NO: 621109 - protein, 9 aa, Homo Sapiens
SLIISIHSC

SEQ ID NO: 621110 - protein, 9 aa, Homo Sapiens
DKIRVKLRR

SEQ ID NO: 621111 - protein, 9 aa, Homo Sapiens
LECVDVDKC

SEQ ID NO: 621112 - protein, 9 aa, Homo Sapiens
DKCLDESNC

SEQ ID NO: 621113 - protein, 9 aa, Homo Sapiens
SRVLRAHVR

SEQ ID NO: 621114 - protein, 9 aa, Homo Sapiens
NLVMAHRAK

SEQ ID NO: 621115 - protein, 9 aa, Homo Sapiens
CRPYETDLC

SEQ ID NO: 621116 - protein, 9 aa, Homo Sapiens
TSQWSWKVT

SEQ ID NO: 621117 - protein, 9 aa, Homo Sapiens
QQLSYPLSF

SEQ ID NO: 621118 - protein, 9 aa, Homo Sapiens
GFMLLLALN

SEQ ID NO: 621119 - protein, 9 aa, Homo Sapiens
DSEDMWGDK

SEQ ID NO: 621120 - protein, 9 aa, Homo Sapiens
CLPGVAGAP

SEQ ID NO: 621121 - protein, 9 aa, Homo Sapiens
EIELAYVQV

SEQ ID NO: 621122 - protein, 9 aa, Homo Sapiens
VTQAALGEI

SEQ ID NO: 621123 - protein, 9 aa, Homo Sapiens
FIDLNKKGN

SEQ ID NO: 621124 - protein, 9 aa, Homo Sapiens
HCRGPRATG

SEQ ID NO: 621125 - protein, 9 aa, Homo Sapiens
HQERCSDSD

SEQ ID NO: 621126 - protein, 9 aa, Homo Sapiens
YEGFGQGKK

SEQ ID NO: 621127 - protein, 9 aa, Homo Sapiens
IKAKRFSWR

SEQ ID NO: 621128 - protein, 9 aa, Homo Sapiens
ERGNRESFL

SEQ ID NO: 621129 - protein, 9 aa, Homo Sapiens
AVASFVTRP

SEQ ID NO: 621130 - protein, 9 aa, Homo Sapiens
ITLFPQRSD

SEQ ID NO: 621131 - protein, 9 aa, Homo Sapiens
SFITYSSDN

SEQ ID NO: 621132 - protein, 9 aa, Homo Sapiens
LQERLRGLE

SEQ ID NO: 621133 - protein, 9 aa, Homo Sapiens
PEVGDEVAL

SEQ ID NO: 621134 - protein, 9 aa, Homo Sapiens
TWGLPMWRL

SEQ ID NO: 621135 - protein, 9 aa, Homo Sapiens
LAKLDVLTL

SEQ ID NO: 621136 - protein, 9 aa, Homo Sapiens
NIIKNCICC

SEQ ID NO: 621137 - protein, 9 aa, Homo Sapiens
WATTSHRVT

SEQ ID NO: 621138 - protein, 9 aa, Homo Sapiens
FSQICHLIK

SEQ ID NO: 621139 - protein, 9 aa, Homo Sapiens
VSAQQGQGV

SEQ ID NO: 621140 - protein, 9 aa, Homo Sapiens
GSYSCQAQD

SEQ ID NO: 621141 - protein, 9 aa, Homo Sapiens
IIKNCICCN

SEQ ID NO: 621142 - protein, 9 aa, Homo Sapiens
IILVGQTGC

SEQ ID NO: 621143 - protein, 9 aa, Homo Sapiens
SILLRDNYS

SEQ ID NO: 621144 - protein, 9 aa, Homo Sapiens
FADTPYIPF

SEQ ID NO: 621145 - protein, 9 aa, Homo Sapiens
DMCISVKEG

SEQ ID NO: 621146 - protein, 9 aa, Homo Sapiens
VHHFFCYVP

SEQ ID NO: 621147 - protein, 9 aa, Homo Sapiens
TACRKNDDA

SEQ ID NO: 621148 - protein, 9 aa, Homo Sapiens
QDRAERDYT

SEQ ID NO: 621149 - protein, 9 aa, Homo Sapiens
GRELSEQLW

SEQ ID NO: 621150 - protein, 9 aa, Homo Sapiens
DVEMRNEEN

SEQ ID NO: 621151 - protein, 9 aa, Homo Sapiens
RTDLPDSHV

SEQ ID NO: 621152 - protein, 9 aa, Homo Sapiens
ILISKPERS

SEQ ID NO: 621153 - protein, 9 aa, Homo Sapiens
CQPGYTVEL

SEQ ID NO: 621154 - protein, 9 aa, Homo Sapiens
TSDQRMDSI

SEQ ID NO: 621155 - protein, 9 aa, Homo Sapiens
AACLPGVAG

SEQ ID NO: 621156 - protein, 9 aa, Homo Sapiens
QERLRGLEQ

SEQ ID NO: 621157 - protein, 9 aa, Homo Sapiens
EWQTRDMPP

SEQ ID NO: 621158 - protein, 9 aa, Homo Sapiens
RPSGRKPLP

SEQ ID NO: 621159 - protein, 9 aa, Homo Sapiens
DLASGAGFG

SEQ ID NO: 621160 - protein, 9 aa, Homo Sapiens
LNIPLYLNI

SEQ ID NO: 621161 - protein, 9 aa, Homo Sapiens
DSIVLCPTY

SEQ ID NO: 621162 - protein, 9 aa, Homo Sapiens
QARKVKKAR

SEQ ID NO: 621163 - protein, 9 aa, Homo Sapiens
KPPTPGGAN

SEQ ID NO: 621164 - protein, 9 aa, Homo Sapiens
GSDVRVKIL

SEQ ID NO: 621165 - protein, 9 aa, Homo Sapiens
CQPGHFLSQ

SEQ ID NO: 621166 - protein, 9 aa, Homo Sapiens
RVHHASPAG

SEQ ID NO: 621167 - protein, 9 aa, Homo Sapiens
AAYRILIFA

SEQ ID NO: 621168 - protein, 9 aa, Homo Sapiens
KMQVDGERR

SEQ ID NO: 621169 - protein, 9 aa, Homo Sapiens
CLLCKPPTP

SEQ ID NO: 621170 - protein, 9 aa, Homo Sapiens
KLEGNDFQE

SEQ ID NO: 621171 - protein, 9 aa, Homo Sapiens
DLRFPLEGA

SEQ ID NO: 621172 - protein, 9 aa, Homo Sapiens
RVNGTISRY

SEQ ID NO: 621173 - protein, 9 aa, Homo Sapiens
STPSSSLKG

SEQ ID NO: 621174 - protein, 9 aa, Homo Sapiens
RTVVGFWMD

SEQ ID NO: 621175 - protein, 9 aa, Homo Sapiens
RSAITLFPQ

SEQ ID NO: 621176 - protein, 9 aa, Homo Sapiens
LIPLCILMA

SEQ ID NO: 621177 - protein, 9 aa, Homo Sapiens
VRVKILAAP

SEQ ID NO: 621178 - protein, 9 aa, Homo Sapiens
TRVHHASPA

SEQ ID NO: 621179 - protein, 9 aa, Homo Sapiens
EPTLKRRHR

SEQ ID NO: 621180 - protein, 9 aa, Homo Sapiens
PLESGGRQD

SEQ ID NO: 621181 - protein, 9 aa, Homo Sapiens
KATPEEIKY

SEQ ID NO: 621182 - protein, 9 aa, Homo Sapiens
DLLSVPVTQ

SEQ ID NO: 621183 - protein, 9 aa, Homo Sapiens
RTDEQTDFG

SEQ ID NO: 621184 - protein, 9 aa, Homo Sapiens
REKPGQKWE

SEQ ID NO: 621185 - protein, 9 aa, Homo Sapiens
YQLIPLCIL

SEQ ID NO: 621186 - protein, 9 aa, Homo Sapiens
EALSYSCEP

SEQ ID NO: 621187 - protein, 9 aa, Homo Sapiens
SKQSDLRFP

SEQ ID NO: 621188 - protein, 9 aa, Homo Sapiens
TKPDKIRNL

SEQ ID NO: 621189 - protein, 9 aa, Homo Sapiens
RFSPKSPNK

SEQ ID NO: 621190 - protein, 9 aa, Homo Sapiens
FLFLPSVSD

SEQ ID NO: 621191 - protein, 9 aa, Homo Sapiens
SSLAGISDS

SEQ ID NO: 621192 - protein, 9 aa, Homo Sapiens
EEDRALTPH

SEQ ID NO: 621193 - protein, 9 aa, Homo Sapiens
SKVEIAESR

SEQ ID NO: 621194 - protein, 9 aa, Homo Sapiens
EIARKLKLL

SEQ ID NO: 621195 - protein, 9 aa, Homo Sapiens
AISSRVQEA

SEQ ID NO: 621196 - protein, 9 aa, Homo Sapiens
KDNVEDIQN

SEQ ID NO: 621197 - protein, 9 aa, Homo Sapiens
RGGCYTNRT

SEQ ID NO: 621198 - protein, 9 aa, Homo Sapiens
ILVGENVLT

SEQ ID NO: 621199 - protein, 9 aa, Homo Sapiens
PKLDGARLE

SEQ ID NO: 621200 - protein, 9 aa, Homo Sapiens
LLCKPPTPG

SEQ ID NO: 621201 - protein, 9 aa, Homo Sapiens
LSEQLWQAE

SEQ ID NO: 621202 - protein, 9 aa, Homo Sapiens
APAFGELQN

SEQ ID NO: 621203 - protein, 9 aa, Homo Sapiens
CTKQYACLH

SEQ ID NO: 621204 - protein, 9 aa, Homo Sapiens
LQPNAQQDG

SEQ ID NO: 621205 - protein, 9 aa, Homo Sapiens
DRPKGTRTS

SEQ ID NO: 621206 - protein, 9 aa, Homo Sapiens
FEPDQLQEL

SEQ ID NO: 621207 - protein, 9 aa, Homo Sapiens
THGHSSTAL

SEQ ID NO: 621208 - protein, 9 aa, Homo Sapiens
AQALSPKLF

SEQ ID NO: 621209 - protein, 9 aa, Homo Sapiens
TRDMPPCGW

SEQ ID NO: 621210 - protein, 9 aa, Homo Sapiens
LVTHQKIHA

SEQ ID NO: 621211 - protein, 9 aa, Homo Sapiens
NVVDGLRDC

SEQ ID NO: 621212 - protein, 9 aa, Homo Sapiens
IAESRVSVL

SEQ ID NO: 621213 - protein, 9 aa, Homo Sapiens
NVSMWLWPT

SEQ ID NO: 621214 - protein, 9 aa, Homo Sapiens
LSTPGDYLG

SEQ ID NO: 621215 - protein, 9 aa, Homo Sapiens
KNSGCLTQM

SEQ ID NO: 621216 - protein, 9 aa, Homo Sapiens
QPAIGTVPS

SEQ ID NO: 621217 - protein, 9 aa, Homo Sapiens
LNFDISKLE

SEQ ID NO: 621218 - protein, 9 aa, Homo Sapiens
PNKAHLNLH

SEQ ID NO: 621219 - protein, 9 aa, Homo Sapiens
EIGLQERNV

SEQ ID NO: 621220 - protein, 9 aa, Homo Sapiens
DSFLTPPST

SEQ ID NO: 621221 - protein, 9 aa, Homo Sapiens
RDMFVRCIA

SEQ ID NO: 621222 - protein, 9 aa, Homo Sapiens
HHASPAGTY

SEQ ID NO: 621223 - protein, 9 aa, Homo Sapiens
CRVPRGGCR

SEQ ID NO: 621224 - protein, 9 aa, Homo Sapiens
VYKIGDDWG

SEQ ID NO: 621225 - protein, 9 aa, Homo Sapiens
ILAAPINPS

SEQ ID NO: 621226 - protein, 9 aa, Homo Sapiens
LNNRFRLGF

SEQ ID NO: 621227 - protein, 9 aa, Homo Sapiens
GLIHSDRCR

SEQ ID NO: 621228 - protein, 9 aa, Homo Sapiens
GAYNVSTKS

SEQ ID NO: 621229 - protein, 9 aa, Homo Sapiens
YRILIFADT

SEQ ID NO: 621230 - protein, 9 aa, Homo Sapiens
EMREIPKTI

SEQ ID NO: 621231 - protein, 9 aa, Homo Sapiens
PWRDCSCPM

SEQ ID NO: 621232 - protein, 9 aa, Homo Sapiens
LVHHFFCYV

SEQ ID NO: 621233 - protein, 9 aa, Homo Sapiens
ERLSAVKAI

SEQ ID NO: 621234 - protein, 9 aa, Homo Sapiens
RQPPGQMAE

SEQ ID NO: 621235 - protein, 9 aa, Homo Sapiens
QVRSEYEKK

SEQ ID NO: 621236 - protein, 9 aa, Homo Sapiens
NKDITMQCT

SEQ ID NO: 621237 - protein, 9 aa, Homo Sapiens
VILGKRTDE

SEQ ID NO: 621238 - protein, 9 aa, Homo Sapiens
SLVVLLLLV

SEQ ID NO: 621239 - protein, 9 aa, Homo Sapiens
VQDRAERDY

SEQ ID NO: 621240 - protein, 9 aa, Homo Sapiens
SVIHSKNLM

SEQ ID NO: 621241 - protein, 9 aa, Homo Sapiens
PMHWLKDRK

SEQ ID NO: 621242 - protein, 9 aa, Homo Sapiens
WTPYLNSNG

SEQ ID NO: 621243 - protein, 9 aa, Homo Sapiens
GDYLGKGGV

SEQ ID NO: 621244 - protein, 9 aa, Homo Sapiens
QDLLSVPVT

SEQ ID NO: 621245 - protein, 9 aa, Homo Sapiens
ELVDEPFLY

SEQ ID NO: 621246 - protein, 9 aa, Homo Sapiens
PSPDTPLKN

SEQ ID NO: 621247 - protein, 9 aa, Homo Sapiens
LIKVINAGQ

SEQ ID NO: 621248 - protein, 9 aa, Homo Sapiens
SLRNKDLKA

SEQ ID NO: 621249 - protein, 9 aa, Homo Sapiens
QICHLIKHR

SEQ ID NO: 621250 - protein, 9 aa, Homo Sapiens
THFSVHDLI

SEQ ID NO: 621251 - protein, 9 aa, Homo Sapiens
YFIDLNKKG

SEQ ID NO: 621252 - protein, 9 aa, Homo Sapiens
GLPMWRLGT

SEQ ID NO: 621253 - protein, 9 aa, Homo Sapiens
CRGPRATGL

SEQ ID NO: 621254 - protein, 9 aa, Homo Sapiens
VLSIVGPSE

SEQ ID NO: 621255 - protein, 9 aa, Homo Sapiens
GDGMTCVDL

SEQ ID NO: 621256 - protein, 9 aa, Homo Sapiens
GLQGSINDK

SEQ ID NO: 621257 - protein, 9 aa, Homo Sapiens
QRMDSIVLC

SEQ ID NO: 621258 - protein, 9 aa, Homo Sapiens
WTDGNSASP

SEQ ID NO: 621259 - protein, 9 aa, Homo Sapiens
WIIVSINAC

SEQ ID NO: 621260 - protein, 9 aa, Homo Sapiens
RNLHCRPQN

SEQ ID NO: 621261 - protein, 9 aa, Homo Sapiens
DPDSFLTPP

SEQ ID NO: 621262 - protein, 9 aa, Homo Sapiens
EDDAVYQCM

SEQ ID NO: 621263 - protein, 9 aa, Homo Sapiens
RPKLDGARL

SEQ ID NO: 621264 - protein, 9 aa, Homo Sapiens
YQQLSYPLS

SEQ ID NO: 621265 - protein, 9 aa, Homo Sapiens
SAITLFPQR

SEQ ID NO: 621266 - protein, 9 aa, Homo Sapiens
RKVKKARER

SEQ ID NO: 621267 - protein, 9 aa, Homo Sapiens
NRFRLGFKH

SEQ ID NO: 621268 - protein, 9 aa, Homo Sapiens
VINAGQLPA

SEQ ID NO: 621269 - protein, 9 aa, Homo Sapiens
APLESGGRQ

SEQ ID NO: 621270 - protein, 9 aa, Homo Sapiens
RTITILISK

SEQ ID NO: 621271 - protein, 9 aa, Homo Sapiens
LDLASGAGF

SEQ ID NO: 621272 - protein, 9 aa, Homo Sapiens
VLIWDMCIS

SEQ ID NO: 621273 - protein, 9 aa, Homo Sapiens
CLEHLHRDE

SEQ ID NO: 621274 - protein, 9 aa, Homo Sapiens
CVCQPGHFL

SEQ ID NO: 621275 - protein, 9 aa, Homo Sapiens
LYLGKSFHS

SEQ ID NO: 621276 - protein, 9 aa, Homo Sapiens
VGEKPSAFY

SEQ ID NO: 621277 - protein, 9 aa, Homo Sapiens
SQEIIVICS

SEQ ID NO: 621278 - protein, 9 aa, Homo Sapiens
QGHSFRASA

SEQ ID NO: 621279 - protein, 9 aa, Homo Sapiens
DCRSFHGPY

SEQ ID NO: 621280 - protein, 9 aa, Homo Sapiens
AKGAACLPG

SEQ ID NO: 621281 - protein, 9 aa, Homo Sapiens
GWDPHRGAY

SEQ ID NO: 621282 - protein, 9 aa, Homo Sapiens
TKDNVEDIQ

SEQ ID NO: 621283 - protein, 9 aa, Homo Sapiens
ALQSIPTTS

SEQ ID NO: 621284 - protein, 9 aa, Homo Sapiens
QKLEGNDFQ

SEQ ID NO: 621285 - protein, 9 aa, Homo Sapiens
KKYIEELQQ

SEQ ID NO: 621286 - protein, 9 aa, Homo Sapiens
QRTSRSGGG

SEQ ID NO: 621287 - protein, 9 aa, Homo Sapiens
FDARGAHSD

SEQ ID NO: 621288 - protein, 9 aa, Homo Sapiens
RPKGTRTSF

SEQ ID NO: 621289 - protein, 9 aa, Homo Sapiens
ECLEHLHRD

SEQ ID NO: 621290 - protein, 9 aa, Homo Sapiens
HSKNLMRSG

SEQ ID NO: 621291 - protein, 9 aa, Homo Sapiens
LVTTYAQVS

SEQ ID NO: 621292 - protein, 9 aa, Homo Sapiens
NLLATQLVY

SEQ ID NO: 621293 - protein, 9 aa, Homo Sapiens
FMDRCVSIL

SEQ ID NO: 621294 - protein, 9 aa, Homo Sapiens
HQDGGQERP

SEQ ID NO: 621295 - protein, 9 aa, Homo Sapiens
PGLRGRGGR

SEQ ID NO: 621296 - protein, 9 aa, Homo Sapiens
IVSINACAH

SEQ ID NO: 621297 - protein, 9 aa, Homo Sapiens
SFRASATES

SEQ ID NO: 621298 - protein, 9 aa, Homo Sapiens
GSLLYHLAV

SEQ ID NO: 621299 - protein, 9 aa, Homo Sapiens
MHWLKDRKA

SEQ ID NO: 621300 - protein, 9 aa, Homo Sapiens
IHSDRCREA

SEQ ID NO: 621301 - protein, 9 aa, Homo Sapiens
AAALTDSEG

SEQ ID NO: 621302 - protein, 9 aa, Homo Sapiens
RALTPHEDG

SEQ ID NO: 621303 - protein, 9 aa, Homo Sapiens
IRRQARKVK

SEQ ID NO: 621304 - protein, 9 aa, Homo Sapiens
DNQDRGTHV

SEQ ID NO: 621305 - protein, 9 aa, Homo Sapiens
DCSCPMSQR

SEQ ID NO: 621306 - protein, 9 aa, Homo Sapiens
MLENVTLAR

SEQ ID NO: 621307 - protein, 9 aa, Homo Sapiens
HQQVLETRP

SEQ ID NO: 621308 - protein, 9 aa, Homo Sapiens
WSAECPEIS

SEQ ID NO: 621309 - protein, 9 aa, Homo Sapiens
LSILLRDNY

SEQ ID NO: 621310 - protein, 9 aa, Homo Sapiens
ELAYVQVAK

SEQ ID NO: 621311 - protein, 9 aa, Homo Sapiens
PFLYLGKSF

SEQ ID NO: 621312 - protein, 9 aa, Homo Sapiens
CPSVSCERT

SEQ ID NO: 621313 - protein, 9 aa, Homo Sapiens
SAHCRGPRA

SEQ ID NO: 621314 - protein, 9 aa, Homo Sapiens
WAVQRAISS

SEQ ID NO: 621315 - protein, 9 aa, Homo Sapiens
MWRLGTQPE

SEQ ID NO: 621316 - protein, 9 aa, Homo Sapiens
KLQSKVEIA

SEQ ID NO: 621317 - protein, 9 aa, Homo Sapiens
SGRKPLPMG

SEQ ID NO: 621318 - protein, 9 aa, Homo Sapiens
SASCPSHPF

SEQ ID NO: 621319 - protein, 9 aa, Homo Sapiens
VTGLARLGG

SEQ ID NO: 621320 - protein, 9 aa, Homo Sapiens
TPLRRKRQL

SEQ ID NO: 621321 - protein, 9 aa, Homo Sapiens
VIETNSTLP

SEQ ID NO: 621322 - protein, 9 aa, Homo Sapiens
GRRICSEFS

SEQ ID NO: 621323 - protein, 9 aa, Homo Sapiens
LRQPPGQMA

SEQ ID NO: 621324 - protein, 9 aa, Homo Sapiens
SFSQICHLI

SEQ ID NO: 621325 - protein, 9 aa, Homo Sapiens
FLKFQNLVM

SEQ ID NO: 621326 - protein, 9 aa, Homo Sapiens
CTPGLHTTS

SEQ ID NO: 621327 - protein, 9 aa, Homo Sapiens
LTPHEDGGP

SEQ ID NO: 621328 - protein, 9 aa, Homo Sapiens
TTSHRVTRE

SEQ ID NO: 621329 - protein, 9 aa, Homo Sapiens
LMRHYCLCC

SEQ ID NO: 621330 - protein, 9 aa, Homo Sapiens
DLNKKGNKN

SEQ ID NO: 621331 - protein, 9 aa, Homo Sapiens
SPDTPLKNI

SEQ ID NO: 621332 - protein, 9 aa, Homo Sapiens
GDKDFTFGA

SEQ ID NO: 621333 - protein, 9 aa, Homo Sapiens
GSLCHPEET

SEQ ID NO: 621334 - protein, 9 aa, Homo Sapiens
LAQDEERDT

SEQ ID NO: 621335 - protein, 9 aa, Homo Sapiens
SDRCREALL

SEQ ID NO: 621336 - protein, 9 aa, Homo Sapiens
LSQLVRPFR

SEQ ID NO: 621337 - protein, 9 aa, Homo Sapiens
NDFQENLVE

SEQ ID NO: 621338 - protein, 9 aa, Homo Sapiens
HTITATDKD

SEQ ID NO: 621339 - protein, 9 aa, Homo Sapiens
LRAAAEAAL

SEQ ID NO: 621340 - protein, 9 aa, Homo Sapiens
RMREQPIYW

SEQ ID NO: 621341 - protein, 9 aa, Homo Sapiens
AAGKNYIFF

SEQ ID NO: 621342 - protein, 9 aa, Homo Sapiens
LAYAKAGEV

SEQ ID NO: 621343 - protein, 9 aa, Homo Sapiens
GCRVPRGGC

SEQ ID NO: 621344 - protein, 9 aa, Homo Sapiens
RSPTIRDMF

SEQ ID NO: 621345 - protein, 9 aa, Homo Sapiens
DFQENLVEK

SEQ ID NO: 621346 - protein, 9 aa, Homo Sapiens
SPPSPDTPL

SEQ ID NO: 621347 - protein, 9 aa, Homo Sapiens
RNKDLKAAI

SEQ ID NO: 621348 - protein, 9 aa, Homo Sapiens
PEEEEEQAA

SEQ ID NO: 621349 - protein, 9 aa, Homo Sapiens
NQDSCHQQV

SEQ ID NO: 621350 - protein, 9 aa, Homo Sapiens
GNLLQPNAQ

SEQ ID NO: 621351 - protein, 9 aa, Homo Sapiens
MYQQLSYPL

SEQ ID NO: 621352 - protein, 9 aa, Homo Sapiens
STGKIVIAR

SEQ ID NO: 621353 - protein, 9 aa, Homo Sapiens
LSAHCRGPR

SEQ ID NO: 621354 - protein, 9 aa, Homo Sapiens
QAQVMLLTQ

SEQ ID NO: 621355 - protein, 9 aa, Homo Sapiens
YVQVAKALK

SEQ ID NO: 621356 - protein, 9 aa, Homo Sapiens
YLNAESLVN

SEQ ID NO: 621357 - protein, 9 aa, Homo Sapiens
SCERTVLRK

SEQ ID NO: 621358 - protein, 9 aa, Homo Sapiens
SLKMQVDGE

SEQ ID NO: 621359 - protein, 9 aa, Homo Sapiens
EGMWLWINN

SEQ ID NO: 621360 - protein, 9 aa, Homo Sapiens
CLPSWLEQD

SEQ ID NO: 621361 - protein, 9 aa, Homo Sapiens
CSLSLGRTC

SEQ ID NO: 621362 - protein, 9 aa, Homo Sapiens
QEESQTAKA

SEQ ID NO: 621363 - protein, 9 aa, Homo Sapiens
TIRDMFVRC

SEQ ID NO: 621364 - protein, 9 aa, Homo Sapiens
LANAQVVKG

SEQ ID NO: 621365 - protein, 9 aa, Homo Sapiens
AMALSGCHN

SEQ ID NO: 621366 - protein, 9 aa, Homo Sapiens
SAECPEISA

SEQ ID NO: 621367 - protein, 9 aa, Homo Sapiens
RKFGSFIWE

SEQ ID NO: 621368 - protein, 9 aa, Homo Sapiens
EPHKECKTL

SEQ ID NO: 621369 - protein, 9 aa, Homo Sapiens
GTRTSFTAE

SEQ ID NO: 621370 - protein, 9 aa, Homo Sapiens
EGSLFEVQW

SEQ ID NO: 621371 - protein, 9 aa, Homo Sapiens
YHTEYRWEV

SEQ ID NO: 621372 - protein, 9 aa, Homo Sapiens
HRGAYNVST

SEQ ID NO: 621373 - protein, 9 aa, Homo Sapiens
KFKECGKAF

SEQ ID NO: 621374 - protein, 9 aa, Homo Sapiens
VHLLQHLKG

SEQ ID NO: 621375 - protein, 9 aa, Homo Sapiens
VHAELHPSF

SEQ ID NO: 621376 - protein, 9 aa, Homo Sapiens
NVVCAWIAE

SEQ ID NO: 621377 - protein, 9 aa, Homo Sapiens
PLGVLTAVG

SEQ ID NO: 621378 - protein, 9 aa, Homo Sapiens
PCEQYAKMI

SEQ ID NO: 621379 - protein, 9 aa, Homo Sapiens
LGNLLQPNA

SEQ ID NO: 621380 - protein, 9 aa, Homo Sapiens
QDGGQERPV

SEQ ID NO: 621381 - protein, 9 aa, Homo Sapiens
PIPDTKLGT

SEQ ID NO: 621382 - protein, 9 aa, Homo Sapiens
TYLNVQRVN

SEQ ID NO: 621383 - protein, 9 aa, Homo Sapiens
ALSPKLFEP

SEQ ID NO: 621384 - protein, 9 aa, Homo Sapiens
SSDVEMRNE

SEQ ID NO: 621385 - protein, 9 aa, Homo Sapiens
LSHKLLEFT

SEQ ID NO: 621386 - protein, 9 aa, Homo Sapiens
LGKRTDEQT

SEQ ID NO: 621387 - protein, 9 aa, Homo Sapiens
NQGSLCHPE

SEQ ID NO: 621388 - protein, 9 aa, Homo Sapiens
QAGGGSWAV

SEQ ID NO: 621389 - protein, 9 aa, Homo Sapiens
DLKAAIKYL

SEQ ID NO: 621390 - protein, 9 aa, Homo Sapiens
SLVNRRQMP

SEQ ID NO: 621391 - protein, 9 aa, Homo Sapiens
HAPVPCLLD

SEQ ID NO: 621392 - protein, 9 aa, Homo Sapiens
ELHPSFFWL

SEQ ID NO: 621393 - protein, 9 aa, Homo Sapiens
IHTITATDK

SEQ ID NO: 621394 - protein, 9 aa, Homo Sapiens
IRRKFGSFI

SEQ ID NO: 621395 - protein, 9 aa, Homo Sapiens
DQRMDSIVL

SEQ ID NO: 621396 - protein, 9 aa, Homo Sapiens
SLLEKNLLL

SEQ ID NO: 621397 - protein, 9 aa, Homo Sapiens
ATPEEIKYI

SEQ ID NO: 621398 - protein, 9 aa, Homo Sapiens
GINSTGKIV

SEQ ID NO: 621399 - protein, 9 aa, Homo Sapiens
ALRIILVGQ

SEQ ID NO: 621400 - protein, 9 aa, Homo Sapiens
PGYTVELNG

SEQ ID NO: 621401 - protein, 9 aa, Homo Sapiens
ICSEFSAGS

SEQ ID NO: 621402 - protein, 9 aa, Homo Sapiens
SGDASQEII

SEQ ID NO: 621403 - protein, 9 aa, Homo Sapiens
HRAGDTATN

SEQ ID NO: 621404 - protein, 9 aa, Homo Sapiens
LLYHLAVKA

SEQ ID NO: 621405 - protein, 9 aa, Homo Sapiens
FENQDSCHQ

SEQ ID NO: 621406 - protein, 9 aa, Homo Sapiens
LAYVQVAKA

SEQ ID NO: 621407 - protein, 9 aa, Homo Sapiens
INDKEAVTI

SEQ ID NO: 621408 - protein, 9 aa, Homo Sapiens
GQNSTPSSS

SEQ ID NO: 621409 - protein, 9 aa, Homo Sapiens
LERYTDKLE

SEQ ID NO: 621410 - protein, 9 aa, Homo Sapiens
FEGSFEQFD

SEQ ID NO: 621411 - protein, 9 aa, Homo Sapiens
FFTLVTEGA

SEQ ID NO: 621412 - protein, 9 aa, Homo Sapiens
KRTPLRRKR

SEQ ID NO: 621413 - protein, 9 aa, Homo Sapiens
AKQVRSEYE

SEQ ID NO: 621414 - protein, 9 aa, Homo Sapiens
NKIDQAAID

SEQ ID NO: 621415 - protein, 9 aa, Homo Sapiens
QGQNSTPSS

SEQ ID NO: 621416 - protein, 9 aa, Homo Sapiens
WAVTSDQSG

SEQ ID NO: 621417 - protein, 9 aa, Homo Sapiens
AALSQTGFS

SEQ ID NO: 621418 - protein, 9 aa, Homo Sapiens
EDSDLNFDI

SEQ ID NO: 621419 - protein, 9 aa, Homo Sapiens
FPQSLVVLL

SEQ ID NO: 621420 - protein, 9 aa, Homo Sapiens
RTKPDKIRN

SEQ ID NO: 621421 - protein, 9 aa, Homo Sapiens
PNAQQDGKD

SEQ ID NO: 621422 - protein, 9 aa, Homo Sapiens
GVIRTSVPD

SEQ ID NO: 621423 - protein, 9 aa, Homo Sapiens
PGSKNPNPL

SEQ ID NO: 621424 - protein, 9 aa, Homo Sapiens
GQVIHTITA

SEQ ID NO: 621425 - protein, 9 aa, Homo Sapiens
ISDSSSSQP

SEQ ID NO: 621426 - protein, 9 aa, Homo Sapiens
EVVRRCPHQ

SEQ ID NO: 621427 - protein, 9 aa, Homo Sapiens
VKRQNVVDL

SEQ ID NO: 621428 - protein, 9 aa, Homo Sapiens
QPHSEPGAP

SEQ ID NO: 621429 - protein, 9 aa, Homo Sapiens
TLVTTYAQV

SEQ ID NO: 621430 - protein, 9 aa, Homo Sapiens
SKSGKDFSY

SEQ ID NO: 621431 - protein, 9 aa, Homo Sapiens
GVLTAVGWG

SEQ ID NO: 621432 - protein, 9 aa, Homo Sapiens
EGPRGLPGF

SEQ ID NO: 621433 - protein, 9 aa, Homo Sapiens
EIIVICSTR

SEQ ID NO: 621434 - protein, 9 aa, Homo Sapiens
LKFQNLVMA

SEQ ID NO: 621435 - protein, 9 aa, Homo Sapiens
SSRVQEAAA

SEQ ID NO: 621436 - protein, 9 aa, Homo Sapiens
LPSNWALGF

SEQ ID NO: 621437 - protein, 9 aa, Homo Sapiens
PWATTSHRV

SEQ ID NO: 621438 - protein, 9 aa, Homo Sapiens
RKQVENKKK

SEQ ID NO: 621439 - protein, 9 aa, Homo Sapiens
KRQNVVDLF

SEQ ID NO: 621440 - protein, 9 aa, Homo Sapiens
QGDGGSETS

SEQ ID NO: 621441 - protein, 9 aa, Homo Sapiens
SCLKLWPGT

SEQ ID NO: 621442 - protein, 9 aa, Homo Sapiens
TQPEALSYS

SEQ ID NO: 621443 - protein, 9 aa, Homo Sapiens
RGGCRLGGR

SEQ ID NO: 621444 - protein, 9 aa, Homo Sapiens
AHRKPIDLK

SEQ ID NO: 621445 - protein, 9 aa, Homo Sapiens
TPAVTSTLV

SEQ ID NO: 621446 - protein, 9 aa, Homo Sapiens
EIRRKFGSF

SEQ ID NO: 621447 - protein, 9 aa, Homo Sapiens
YQRVEAFAS

SEQ ID NO: 621448 - protein, 9 aa, Homo Sapiens
ELLEDVRLA

SEQ ID NO: 621449 - protein, 9 aa, Homo Sapiens
GRTCTSQWS

SEQ ID NO: 621450 - protein, 9 aa, Homo Sapiens
LSQGDGGSE

SEQ ID NO: 621451 - protein, 9 aa, Homo Sapiens
YSLIISIHS

SEQ ID NO: 621452 - protein, 9 aa, Homo Sapiens
VSLASLKMQ

SEQ ID NO: 621453 - protein, 9 aa, Homo Sapiens
KWRASSYLL

SEQ ID NO: 621454 - protein, 9 aa, Homo Sapiens
SHVVQDRAE

SEQ ID NO: 621455 - protein, 9 aa, Homo Sapiens
IFPQSLVVL

SEQ ID NO: 621456 - protein, 9 aa, Homo Sapiens
KAVGGLIGR

SEQ ID NO: 621457 - protein, 9 aa, Homo Sapiens
ARKMRALYD

SEQ ID NO: 621458 - protein, 9 aa, Homo Sapiens
ILIKVINAG

SEQ ID NO: 621459 - protein, 9 aa, Homo Sapiens
VCQPGHFLS

SEQ ID NO: 621460 - protein, 9 aa, Homo Sapiens
RYTDKLERD

SEQ ID NO: 621461 - protein, 9 aa, Homo Sapiens
EHFFDARGA

SEQ ID NO: 621462 - protein, 9 aa, Homo Sapiens
ESIRSTEGS

SEQ ID NO: 621463 - protein, 9 aa, Homo Sapiens
ISVKTSSYS

SEQ ID NO: 621464 - protein, 9 aa, Homo Sapiens
LELVMKNIQ

SEQ ID NO: 621465 - protein, 9 aa, Homo Sapiens
QFDVSADET

SEQ ID NO: 621466 - protein, 9 aa, Homo Sapiens
DNVEDIQNI

SEQ ID NO: 621467 - protein, 9 aa, Homo Sapiens
TPGLHTTSH

SEQ ID NO: 621468 - protein, 9 aa, Homo Sapiens
RMFVLIWDM

SEQ ID NO: 621469 - protein, 9 aa, Homo Sapiens
HFFCYVPAV

SEQ ID NO: 621470 - protein, 9 aa, Homo Sapiens
ITILISKPE

SEQ ID NO: 621471 - protein, 9 aa, Homo Sapiens
AERDYTIED

SEQ ID NO: 621472 - protein, 9 aa, Homo Sapiens
PWLWRSCLQ

SEQ ID NO: 621473 - protein, 9 aa, Homo Sapiens
NDKEAVTIP

SEQ ID NO: 621474 - protein, 9 aa, Homo Sapiens
ASSSVGEKP

SEQ ID NO: 621475 - protein, 9 aa, Homo Sapiens
FNLRSPLDF

SEQ ID NO: 621476 - protein, 9 aa, Homo Sapiens
RSCLQEERL

SEQ ID NO: 621477 - protein, 9 aa, Homo Sapiens
LVRPFREYE

SEQ ID NO: 621478 - protein, 9 aa, Homo Sapiens
GLHTTSHCH

SEQ ID NO: 621479 - protein, 9 aa, Homo Sapiens
RVKLRRRLC

SEQ ID NO: 621480 - protein, 9 aa, Homo Sapiens
LALVLFYPT

SEQ ID NO: 621481 - protein, 9 aa, Homo Sapiens
STVVLPTVL

SEQ ID NO: 621482 - protein, 9 aa, Homo Sapiens
GQSRTVGPN

SEQ ID NO: 621483 - protein, 9 aa, Homo Sapiens
QPGHFLSQA

SEQ ID NO: 621484 - protein, 9 aa, Homo Sapiens
PSWLEQDTS

SEQ ID NO: 621485 - protein, 9 aa, Homo Sapiens
LARPGSKNP

SEQ ID NO: 621486 - protein, 9 aa, Homo Sapiens
VYEGFGQGK

SEQ ID NO: 621487 - protein, 9 aa, Homo Sapiens
LHPSFFWLR

SEQ ID NO: 621488 - protein, 9 aa, Homo Sapiens
RGSDVRVKI

SEQ ID NO: 621489 - protein, 9 aa, Homo Sapiens
PTPGGANPG

SEQ ID NO: 621490 - protein, 9 aa, Homo Sapiens
VVCAWIAEQ

SEQ ID NO: 621491 - protein, 9 aa, Homo Sapiens
TTPAVTSTL

SEQ ID NO: 621492 - protein, 9 aa, Homo Sapiens
MDSGNKAST

SEQ ID NO: 621493 - protein, 9 aa, Homo Sapiens
CASTPGATE

SEQ ID NO: 621494 - protein, 9 aa, Homo Sapiens
MCQPGYTVE

SEQ ID NO: 621495 - protein, 9 aa, Homo Sapiens
VDQIFQETQ

SEQ ID NO: 621496 - protein, 9 aa, Homo Sapiens
NTPWTLWLP

SEQ ID NO: 621497 - protein, 9 aa, Homo Sapiens
FVLIWDMCI

SEQ ID NO: 621498 - protein, 9 aa, Homo Sapiens
GSYNLHIIK

SEQ ID NO: 621499 - protein, 9 aa, Homo Sapiens
NCTMEIESY

SEQ ID NO: 621500 - protein, 9 aa, Homo Sapiens
LQEERLLGD

SEQ ID NO: 621501 - protein, 9 aa, Homo Sapiens
CPHQERCSD

SEQ ID NO: 621502 - protein, 9 aa, Homo Sapiens
CGIKAKRFS

SEQ ID NO: 621503 - protein, 9 aa, Homo Sapiens
KLEKWTPYL

SEQ ID NO: 621504 - protein, 9 aa, Homo Sapiens
LRNKDLKAA

SEQ ID NO: 621505 - protein, 9 aa, Homo Sapiens
LQKEIRRKF

SEQ ID NO: 621506 - protein, 9 aa, Homo Sapiens
GGSETSQPP

SEQ ID NO: 621507 - protein, 9 aa, Homo Sapiens
GPCQDGWVC

SEQ ID NO: 621508 - protein, 9 aa, Homo Sapiens
QLSYPLSFQ

SEQ ID NO: 621509 - protein, 9 aa, Homo Sapiens
TDENGKILG

SEQ ID NO: 621510 - protein, 9 aa, Homo Sapiens
VDLSDRFSA

SEQ ID NO: 621511 - protein, 9 aa, Homo Sapiens
QLLAQDEER

SEQ ID NO: 621512 - protein, 9 aa, Homo Sapiens
VIRTSVPDL

SEQ ID NO: 621513 - protein, 9 aa, Homo Sapiens
NFAEQIVCV

SEQ ID NO: 621514 - protein, 9 aa, Homo Sapiens
QLLASWLVC

SEQ ID NO: 621515 - protein, 9 aa, Homo Sapiens
ENQDSCHQQ

SEQ ID NO: 621516 - protein, 9 aa, Homo Sapiens
KVSAQQGQG

SEQ ID NO: 621517 - protein, 9 aa, Homo Sapiens
PGDYLGKGG

SEQ ID NO: 621518 - protein, 9 aa, Homo Sapiens
FGQGKKLIA

SEQ ID NO: 621519 - protein, 9 aa, Homo Sapiens
VKILAAPIN

SEQ ID NO: 621520 - protein, 9 aa, Homo Sapiens
LPGADSIPD

SEQ ID NO: 621521 - protein, 9 aa, Homo Sapiens
KILAAPINP

SEQ ID NO: 621522 - protein, 9 aa, Homo Sapiens
QQGQGVHAR

SEQ ID NO: 621523 - protein, 9 aa, Homo Sapiens
LNVQRVNGT

SEQ ID NO: 621524 - protein, 9 aa, Homo Sapiens
ALSGCHNVK

SEQ ID NO: 621525 - protein, 9 aa, Homo Sapiens
LVMKNIQDV

SEQ ID NO: 621526 - protein, 9 aa, Homo Sapiens
KEMREIPKT

SEQ ID NO: 621527 - protein, 9 aa, Homo Sapiens
DVDKCLDES

SEQ ID NO: 621528 - protein, 9 aa, Homo Sapiens
GGYNYEENS

SEQ ID NO: 621529 - protein, 9 aa, Homo Sapiens
QPPGQMAET

SEQ ID NO: 621530 - protein, 9 aa, Homo Sapiens
NPFSSLAGI

SEQ ID NO: 621531 - protein, 9 aa, Homo Sapiens
WKVTSPSGK

SEQ ID NO: 621532 - protein, 9 aa, Homo Sapiens
AGSYNLHII

SEQ ID NO: 621533 - protein, 9 aa, Homo Sapiens
KTSSYSLII

SEQ ID NO: 621534 - protein, 9 aa, Homo Sapiens
KNDDADTVV

SEQ ID NO: 621535 - protein, 9 aa, Homo Sapiens
TSRSGGGET

SEQ ID NO: 621536 - protein, 9 aa, Homo Sapiens
KNCICCNLS

SEQ ID NO: 621537 - protein, 9 aa, Homo Sapiens
RLRGLEQAL

SEQ ID NO: 621538 - protein, 9 aa, Homo Sapiens
IEPHKECKT

SEQ ID NO: 621539 - protein, 9 aa, Homo Sapiens
EHLHRDEQA

SEQ ID NO: 621540 - protein, 9 aa, Homo Sapiens
EILIKVINA

SEQ ID NO: 621541 - protein, 9 aa, Homo Sapiens
LKIFSRNSP

SEQ ID NO: 621542 - protein, 9 aa, Homo Sapiens
SFLQALGLL

SEQ ID NO: 621543 - protein, 9 aa, Homo Sapiens
LSSCSAQPT

SEQ ID NO: 621544 - protein, 9 aa, Homo Sapiens
HRGELFAAI

SEQ ID NO: 621545 - protein, 9 aa, Homo Sapiens
TGGSTTITT

SEQ ID NO: 621546 - protein, 9 aa, Homo Sapiens
RDCRSFHGP

SEQ ID NO: 621547 - protein, 9 aa, Homo Sapiens
VDCHQLLAS

SEQ ID NO: 621548 - protein, 9 aa, Homo Sapiens
AAKWRASSY

SEQ ID NO: 621549 - protein, 9 aa, Homo Sapiens
TLEEDRALT

SEQ ID NO: 621550 - protein, 9 aa, Homo Sapiens
SQLVRPFRE

SEQ ID NO: 621551 - protein, 9 aa, Homo Sapiens
GKHWTSTHR

SEQ ID NO: 621552 - protein, 9 aa, Homo Sapiens
SGEFNLRSP

SEQ ID NO: 621553 - protein, 9 aa, Homo Sapiens
QDSGQSRTV

SEQ ID NO: 621554 - protein, 9 aa, Homo Sapiens
CQDGWVCDT

SEQ ID NO: 621555 - protein, 9 aa, Homo Sapiens
GLFRNVEGM

SEQ ID NO: 621556 - protein, 9 aa, Homo Sapiens
LSHVVQDRA

SEQ ID NO: 621557 - protein, 9 aa, Homo Sapiens
KEIRRKFGS

SEQ ID NO: 621558 - protein, 9 aa, Homo Sapiens
SCLQEERLL

SEQ ID NO: 621559 - protein, 9 aa, Homo Sapiens
IHAGEKPYQ

SEQ ID NO: 621560 - protein, 9 aa, Homo Sapiens
ELDLASGAG

SEQ ID NO: 621561 - protein, 9 aa, Homo Sapiens
CGKSFSQIC

SEQ ID NO: 621562 - protein, 9 aa, Homo Sapiens
QPEALSYSC

SEQ ID NO: 621563 - protein, 9 aa, Homo Sapiens
TAKAQLRKF

SEQ ID NO: 621564 - protein, 9 aa, Homo Sapiens
SGKDFSYYL

SEQ ID NO: 621565 - protein, 9 aa, Homo Sapiens
AFLKFQNLV

SEQ ID NO: 621566 - protein, 9 aa, Homo Sapiens
MAETPNSSV

SEQ ID NO: 621567 - protein, 9 aa, Homo Sapiens
AQVMLLTQP

SEQ ID NO: 621568 - protein, 9 aa, Homo Sapiens
IPQLSAAAL

SEQ ID NO: 621569 - protein, 9 aa, Homo Sapiens
EHISWWGPG

SEQ ID NO: 621570 - protein, 9 aa, Homo Sapiens
RGAHSDENP

SEQ ID NO: 621571 - protein, 9 aa, Homo Sapiens
RGELFAAIL

SEQ ID NO: 621572 - protein, 9 aa, Homo Sapiens
TTTRVHHAS

SEQ ID NO: 621573 - protein, 9 aa, Homo Sapiens
GRKPLPMGI

SEQ ID NO: 621574 - protein, 9 aa, Homo Sapiens
GLEQALRFE

SEQ ID NO: 621575 - protein, 9 aa, Homo Sapiens
SGPWRDCSC

SEQ ID NO: 621576 - protein, 9 aa, Homo Sapiens
RGLPGFPGR

SEQ ID NO: 621577 - protein, 9 aa, Homo Sapiens
LNLLATQLV

SEQ ID NO: 621578 - protein, 9 aa, Homo Sapiens
RNVQLEVDI

SEQ ID NO: 621579 - protein, 9 aa, Homo Sapiens
GISDSSSSQ

SEQ ID NO: 621580 - protein, 9 aa, Homo Sapiens
SLLYHLAVK

SEQ ID NO: 621581 - protein, 9 aa, Homo Sapiens
VPSFRPDFV

SEQ ID NO: 621582 - protein, 9 aa, Homo Sapiens
GKSFSQICH

SEQ ID NO: 621583 - protein, 9 aa, Homo Sapiens
FHNSCLPSW

SEQ ID NO: 621584 - protein, 9 aa, Homo Sapiens
NNRFRLGFK

SEQ ID NO: 621585 - protein, 9 aa, Homo Sapiens
DKDFTFGAY

SEQ ID NO: 621586 - protein, 9 aa, Homo Sapiens
INSTGKIVI

SEQ ID NO: 621587 - protein, 9 aa, Homo Sapiens
MKQLSILLR

SEQ ID NO: 621588 - protein, 9 aa, Homo Sapiens
TPGATEMEG

SEQ ID NO: 621589 - protein, 9 aa, Homo Sapiens
FWMDPDLQM

SEQ ID NO: 621590 - protein, 9 aa, Homo Sapiens
SRNSPGNKC

SEQ ID NO: 621591 - protein, 9 aa, Homo Sapiens
QKEIRRKFG

SEQ ID NO: 621592 - protein, 9 aa, Homo Sapiens
DECLKIFSR

SEQ ID NO: 621593 - protein, 9 aa, Homo Sapiens
LLGKRSMFT

SEQ ID NO: 621594 - protein, 9 aa, Homo Sapiens
LLASKAHKP

SEQ ID NO: 621595 - protein, 9 aa, Homo Sapiens
FKECGKAFN

SEQ ID NO: 621596 - protein, 9 aa, Homo Sapiens
NGKILGELN

SEQ ID NO: 621597 - protein, 9 aa, Homo Sapiens
KASTVAATN

SEQ ID NO: 621598 - protein, 9 aa, Homo Sapiens
ERPSGRKPL

SEQ ID NO: 621599 - protein, 9 aa, Homo Sapiens
VMAHRAKVA

SEQ ID NO: 621600 - protein, 9 aa, Homo Sapiens
EGNDFQENL

SEQ ID NO: 621601 - protein, 9 aa, Homo Sapiens
KPVDLSDRF

SEQ ID NO: 621602 - protein, 9 aa, Homo Sapiens
QKQCASTPG

SEQ ID NO: 621603 - protein, 9 aa, Homo Sapiens
STVAATNMN

SEQ ID NO: 621604 - protein, 9 aa, Homo Sapiens
LAMALSGCH

SEQ ID NO: 621605 - protein, 9 aa, Homo Sapiens
PDPDSFLTP

SEQ ID NO: 621606 - protein, 9 aa, Homo Sapiens
YSCEPTLKR

SEQ ID NO: 621607 - protein, 9 aa, Homo Sapiens
VEMRNEENN

SEQ ID NO: 621608 - protein, 9 aa, Homo Sapiens
LHRGELFAA

SEQ ID NO: 621609 - protein, 9 aa, Homo Sapiens
IHEAENFVE

SEQ ID NO: 621610 - protein, 9 aa, Homo Sapiens
KHTQEETNF

SEQ ID NO: 621611 - protein, 9 aa, Homo Sapiens
DGGSETSQP

SEQ ID NO: 621612 - protein, 9 aa, Homo Sapiens
LSAAALTDS

SEQ ID NO: 621613 - protein, 9 aa, Homo Sapiens
ASQEIIVIC

SEQ ID NO: 621614 - protein, 9 aa, Homo Sapiens
TPGGANPGA

SEQ ID NO: 621615 - protein, 9 aa, Homo Sapiens
VEAFASQPE

SEQ ID NO: 621616 - protein, 9 aa, Homo Sapiens
FLWCRVLSI

SEQ ID NO: 621617 - protein, 9 aa, Homo Sapiens
PAIGTVPSA

SEQ ID NO: 621618 - protein, 9 aa, Homo Sapiens
EREMGINST

SEQ ID NO: 621619 - protein, 9 aa, Homo Sapiens
DGWVCDTPG

SEQ ID NO: 621620 - protein, 9 aa, Homo Sapiens
APVPCLLDS

SEQ ID NO: 621621 - protein, 9 aa, Homo Sapiens
DFSYYLPAV

SEQ ID NO: 621622 - protein, 9 aa, Homo Sapiens
LEQALRFEQ

SEQ ID NO: 621623 - protein, 9 aa, Homo Sapiens
AMLENVTLA

SEQ ID NO: 621624 - protein, 9 aa, Homo Sapiens
NKKGNKNSN

SEQ ID NO: 621625 - protein, 9 aa, Homo Sapiens
PDKIRNLHC

SEQ ID NO: 621626 - protein, 9 aa, Homo Sapiens
ASQVILGKR

SEQ ID NO: 621627 - protein, 9 aa, Homo Sapiens
VNFTVIRKR

SEQ ID NO: 621628 - protein, 9 aa, Homo Sapiens
TYHTEYRWE

SEQ ID NO: 621629 - protein, 9 aa, Homo Sapiens
GSTTITTKK

SEQ ID NO: 621630 - protein, 9 aa, Homo Sapiens
VDLFHAVKT

SEQ ID NO: 621631 - protein, 9 aa, Homo Sapiens
PKLFEPDQL

SEQ ID NO: 621632 - protein, 9 aa, Homo Sapiens
KVVPSFRPD

SEQ ID NO: 621633 - protein, 9 aa, Homo Sapiens
LFAAILRNR

SEQ ID NO: 621634 - protein, 9 aa, Homo Sapiens
YSSDNTIRL

SEQ ID NO: 621635 - protein, 9 aa, Homo Sapiens
YIFFTGPSI

SEQ ID NO: 621636 - protein, 9 aa, Homo Sapiens
GAVASFVTR

SEQ ID NO: 621637 - protein, 9 aa, Homo Sapiens
LKRRHRAGD

SEQ ID NO: 621638 - protein, 9 aa, Homo Sapiens
SFLTPPSTP

SEQ ID NO: 621639 - protein, 9 aa, Homo Sapiens
ATRLWDSLS

SEQ ID NO: 621640 - protein, 9 aa, Homo Sapiens
YASTVVLPT

SEQ ID NO: 621641 - protein, 9 aa, Homo Sapiens
CAWIAEQHG

SEQ ID NO: 621642 - protein, 9 aa, Homo Sapiens
IPDTKLGTF

SEQ ID NO: 621643 - protein, 9 aa, Homo Sapiens
MDEPFLQFQ

SEQ ID NO: 621644 - protein, 9 aa, Homo Sapiens
DLLSQLVRP

SEQ ID NO: 621645 - protein, 9 aa, Homo Sapiens
EMRNEENNS

SEQ ID NO: 621646 - protein, 9 aa, Homo Sapiens
AVYQCMAEN

SEQ ID NO: 621647 - protein, 9 aa, Homo Sapiens
LHFPAKESM

SEQ ID NO: 621648 - protein, 9 aa, Homo Sapiens
RLGTQPEAL

SEQ ID NO: 621649 - protein, 9 aa, Homo Sapiens
EPGAPAFGE

SEQ ID NO: 621650 - protein, 9 aa, Homo Sapiens
MTWEASGSG

SEQ ID NO: 621651 - protein, 9 aa, Homo Sapiens
WLWPTMPSA

SEQ ID NO: 621652 - protein, 9 aa, Homo Sapiens
SKNPNPLWA

SEQ ID NO: 621653 - protein, 9 aa, Homo Sapiens
RNSPGNKCP

SEQ ID NO: 621654 - protein, 9 aa, Homo Sapiens
TSPSGKEPS

SEQ ID NO: 621655 - protein, 9 aa, Homo Sapiens
CLNNRFRLG

SEQ ID NO: 621656 - protein, 9 aa, Homo Sapiens
IHSKNLMRS

SEQ ID NO: 621657 - protein, 9 aa, Homo Sapiens
RDMPPCGWP

SEQ ID NO: 621658 - protein, 9 aa, Homo Sapiens
QIESIRSTE

SEQ ID NO: 621659 - protein, 9 aa, Homo Sapiens
KFGSFIWEQ

SEQ ID NO: 621660 - protein, 9 aa, Homo Sapiens
LEKNLLLPE

SEQ ID NO: 621661 - protein, 9 aa, Homo Sapiens
TRAHAGSYS

SEQ ID NO: 621662 - protein, 9 aa, Homo Sapiens
VKAIANAIS

SEQ ID NO: 621663 - protein, 9 aa, Homo Sapiens
GDASQEIIV

SEQ ID NO: 621664 - protein, 9 aa, Homo Sapiens
DIVCTELSP

SEQ ID NO: 621665 - protein, 9 aa, Homo Sapiens
DKEAVTIPK

SEQ ID NO: 621666 - protein, 9 aa, Homo Sapiens
PGHFLSQAG

SEQ ID NO: 621667 - protein, 9 aa, Homo Sapiens
AHISLLEKN

SEQ ID NO: 621668 - protein, 9 aa, Homo Sapiens
PYKSAPAPK

SEQ ID NO: 621669 - protein, 9 aa, Homo Sapiens
QKWEPATRL

SEQ ID NO: 621670 - protein, 9 aa, Homo Sapiens
KWSAECPEI

SEQ ID NO: 621671 - protein, 9 aa, Homo Sapiens
HSDRCREAL

SEQ ID NO: 621672 - protein, 9 aa, Homo Sapiens
SHRVTREKP

SEQ ID NO: 621673 - protein, 9 aa, Homo Sapiens
RAGDTATNV

SEQ ID NO: 621674 - protein, 9 aa, Homo Sapiens
NIPLYLNIA

SEQ ID NO: 621675 - protein, 9 aa, Homo Sapiens
VELNGSRIR

SEQ ID NO: 621676 - protein, 9 aa, Homo Sapiens
RPYETDLCV

SEQ ID NO: 621677 - protein, 9 aa, Homo Sapiens
VTHQKIHAG

SEQ ID NO: 621678 - protein, 9 aa, Homo Sapiens
IIYVYKIGD

SEQ ID NO: 621679 - protein, 9 aa, Homo Sapiens
RALQSIPTT

SEQ ID NO: 621680 - protein, 9 aa, Homo Sapiens
LKEMREIPK

SEQ ID NO: 621681 - protein, 9 aa, Homo Sapiens
DSGNKASTV

SEQ ID NO: 621682 - protein, 9 aa, Homo Sapiens
VEAPRPKLD

SEQ ID NO: 621683 - protein, 9 aa, Homo Sapiens
LARLLTHFS

SEQ ID NO: 621684 - protein, 9 aa, Homo Sapiens
NSTPSSSLK

SEQ ID NO: 621685 - protein, 9 aa, Homo Sapiens
AHAGSYSCQ

SEQ ID NO: 621686 - protein, 9 aa, Homo Sapiens
CLLDSPSTP

SEQ ID NO: 621687 - protein, 9 aa, Homo Sapiens
EKPGQKWEP

SEQ ID NO: 621688 - protein, 9 aa, Homo Sapiens
LRGLEQALR

SEQ ID NO: 621689 - protein, 9 aa, Homo Sapiens
EKEKELQKH

SEQ ID NO: 621690 - protein, 9 aa, Homo Sapiens
VVPSFRPDF

SEQ ID NO: 621691 - protein, 9 aa, Homo Sapiens
YAKAGEVAE

SEQ ID NO: 621692 - protein, 9 aa, Homo Sapiens
STLPGADSI

SEQ ID NO: 621693 - protein, 9 aa, Homo Sapiens
IRTSVPDLD

SEQ ID NO: 621694 - protein, 9 aa, Homo Sapiens
NTLIISAHR

SEQ ID NO: 621695 - protein, 9 aa, Homo Sapiens
GAPAFGELQ

SEQ ID NO: 621696 - protein, 9 aa, Homo Sapiens
VTSTLVTTY

SEQ ID NO: 621697 - protein, 9 aa, Homo Sapiens
DSGQSRTVG

SEQ ID NO: 621698 - protein, 9 aa, Homo Sapiens
PDTKLGTFS

SEQ ID NO: 621699 - protein, 9 aa, Homo Sapiens
AGISDSSSS

SEQ ID NO: 621700 - protein, 9 aa, Homo Sapiens
ARTDLPDSH

SEQ ID NO: 621701 - protein, 9 aa, Homo Sapiens
HYCLCCATK

SEQ ID NO: 621702 - protein, 9 aa, Homo Sapiens
TSSYSLIIS

SEQ ID NO: 621703 - protein, 9 aa, Homo Sapiens
HAELHPSFF

SEQ ID NO: 621704 - protein, 9 aa, Homo Sapiens
PDSFLTPPS

SEQ ID NO: 621705 - protein, 9 aa, Homo Sapiens
PSTWGLPMW

SEQ ID NO: 621706 - protein, 9 aa, Homo Sapiens
VCVELHQRA

SEQ ID NO: 621707 - protein, 9 aa, Homo Sapiens
IYQRVEAFA

SEQ ID NO: 621708 - protein, 9 aa, Homo Sapiens
PGLHTTSHC

SEQ ID NO: 621709 - protein, 9 aa, Homo Sapiens
RRNTPWTLW

SEQ ID NO: 621710 - protein, 9 aa, Homo Sapiens
PISGEFNLR

SEQ ID NO: 621711 - protein, 9 aa, Homo Sapiens
LLALNLLAT

SEQ ID NO: 621712 - protein, 9 aa, Homo Sapiens
KAHKPGIPL

SEQ ID NO: 621713 - protein, 9 aa, Homo Sapiens
VTCWTDGNS

SEQ ID NO: 621714 - protein, 9 aa, Homo Sapiens
CCLNNRFRL

SEQ ID NO: 621715 - protein, 9 aa, Homo Sapiens
SYSCQAQDA

SEQ ID NO: 621716 - protein, 9 aa, Homo Sapiens
PHQERCSDS

SEQ ID NO: 621717 - protein, 9 aa, Homo Sapiens
LTHFSVHDL

SEQ ID NO: 621718 - protein, 9 aa, Homo Sapiens
SLAGISDSS

SEQ ID NO: 621719 - protein, 9 aa, Homo Sapiens
TITILISKP

SEQ ID NO: 621720 - protein, 9 aa, Homo Sapiens
DGRKAGGEE

SEQ ID NO: 621721 - protein, 9 aa, Homo Sapiens
TATNVSMWL

SEQ ID NO: 621722 - protein, 9 aa, Homo Sapiens
CSAQPTDSL

SEQ ID NO: 621723 - protein, 9 aa, Homo Sapiens
LFRNVEGMW

SEQ ID NO: 621724 - protein, 9 aa, Homo Sapiens
AGLALVLFY

SEQ ID NO: 621725 - protein, 9 aa, Homo Sapiens
LISKPERSY

SEQ ID NO: 621726 - protein, 9 aa, Homo Sapiens
VVKGFPIVY

SEQ ID NO: 621727 - protein, 9 aa, Homo Sapiens
EDMWGDKDF

SEQ ID NO: 621728 - protein, 9 aa, Homo Sapiens
SIVLCPTYF

SEQ ID NO: 621729 - protein, 9 aa, Homo Sapiens
RMDSIVLCP

SEQ ID NO: 621730 - protein, 9 aa, Homo Sapiens
AAEAALSQT

SEQ ID NO: 621731 - protein, 9 aa, Homo Sapiens
FFLFLPSVS

SEQ ID NO: 621732 - protein, 9 aa, Homo Sapiens
KGAACLPGV

SEQ ID NO: 621733 - protein, 9 aa, Homo Sapiens
PVTQAALGE

SEQ ID NO: 621734 - protein, 9 aa, Homo Sapiens
MITGSWIIV

SEQ ID NO: 621735 - protein, 9 aa, Homo Sapiens
PQLSQGDGG

SEQ ID NO: 621736 - protein, 9 aa, Homo Sapiens
HKPGIPLCS

SEQ ID NO: 621737 - protein, 9 aa, Homo Sapiens
TNLEIARKL

SEQ ID NO: 621738 - protein, 9 aa, Homo Sapiens
RSKRTPLRR

SEQ ID NO: 621739 - protein, 9 aa, Homo Sapiens
SIRSTEGSR

SEQ ID NO: 621740 - protein, 9 aa, Homo Sapiens
TVVTGLARL

SEQ ID NO: 621741 - protein, 9 aa, Homo Sapiens
GSGEHQRTS

SEQ ID NO: 621742 - protein, 9 aa, Homo Sapiens
GVSLASLKM

SEQ ID NO: 621743 - protein, 9 aa, Homo Sapiens
ETNSTLPGA

SEQ ID NO: 621744 - protein, 9 aa, Homo Sapiens
EGFGQGKKL

SEQ ID NO: 621745 - protein, 9 aa, Homo Sapiens
VLLNRKDIC

SEQ ID NO: 621746 - protein, 9 aa, Homo Sapiens
KAQLRKFTE

SEQ ID NO: 621747 - protein, 9 aa, Homo Sapiens
DTPLKNIVK

SEQ ID NO: 621748 - protein, 9 aa, Homo Sapiens
LDLDRPKGT

SEQ ID NO: 621749 - protein, 9 aa, Homo Sapiens
VCAWIAEQH

SEQ ID NO: 621750 - protein, 9 aa, Homo Sapiens
HQRTSRSGG

SEQ ID NO: 621751 - protein, 9 aa, Homo Sapiens
LLTNVDQIF

SEQ ID NO: 621752 - protein, 9 aa, Homo Sapiens
NFTVIRKRK

SEQ ID NO: 621753 - protein, 9 aa, Homo Sapiens
NKVARKMRA

SEQ ID NO: 621754 - protein, 9 aa, Homo Sapiens
LLKNYYKWS

SEQ ID NO: 621755 - protein, 9 aa, Homo Sapiens
LVLFYPTLL

SEQ ID NO: 621756 - protein, 9 aa, Homo Sapiens
ESSDVEMRN

SEQ ID NO: 621757 - protein, 9 aa, Homo Sapiens
AQDEERDTL

SEQ ID NO: 621758 - protein, 9 aa, Homo Sapiens
FLYLGKSFH

SEQ ID NO: 621759 - protein, 9 aa, Homo Sapiens
SGKEPSRQQ

SEQ ID NO: 621760 - protein, 9 aa, Homo Sapiens
HRKPIDLKA

SEQ ID NO: 621761 - protein, 9 aa, Homo Sapiens
KIVGGYNYE

SEQ ID NO: 621762 - protein, 9 aa, Homo Sapiens
HRVTREKPG

SEQ ID NO: 621763 - protein, 9 aa, Homo Sapiens
FFCYVPAVM

SEQ ID NO: 621764 - protein, 9 aa, Homo Sapiens
TVVGFWMDP

SEQ ID NO: 621765 - protein, 9 aa, Homo Sapiens
MKFWRKAVG

SEQ ID NO: 621766 - protein, 9 aa, Homo Sapiens
TLKRRHRAG

SEQ ID NO: 621767 - protein, 9 aa, Homo Sapiens
ENGKILGEL

SEQ ID NO: 621768 - protein, 9 aa, Homo Sapiens
TVELNGSRI

SEQ ID NO: 621769 - protein, 9 aa, Homo Sapiens
KITNLKGSL

SEQ ID NO: 621770 - protein, 9 aa, Homo Sapiens
CVMDKPVDL

SEQ ID NO: 621771 - protein, 9 aa, Homo Sapiens
TVKVSAQQG

SEQ ID NO: 621772 - protein, 9 aa, Homo Sapiens
VLDGTPCRP

SEQ ID NO: 621773 - protein, 9 aa, Homo Sapiens
ICHLIKHRR

SEQ ID NO: 621774 - protein, 9 aa, Homo Sapiens
VFNYLAKLD

SEQ ID NO: 621775 - protein, 9 aa, Homo Sapiens
SEPEEEEEQ

SEQ ID NO: 621776 - protein, 9 aa, Homo Sapiens
MDKPVDLSD

SEQ ID NO: 621777 - protein, 9 aa, Homo Sapiens
SPKSPNKAH

SEQ ID NO: 621778 - protein, 9 aa, Homo Sapiens
AKAGEVAEE

SEQ ID NO: 621779 - protein, 9 aa, Homo Sapiens
WKKACQLFL

SEQ ID NO: 621780 - protein, 9 aa, Homo Sapiens
EESSDVEMR

SEQ ID NO: 621781 - protein, 9 aa, Homo Sapiens
LLHFPAKES

SEQ ID NO: 621782 - protein, 9 aa, Homo Sapiens
GFTGDGMTC

SEQ ID NO: 621783 - protein, 9 aa, Homo Sapiens
GSKNPNPLW

SEQ ID NO: 621784 - protein, 9 aa, Homo Sapiens
QRNVFFPKR

SEQ ID NO: 621785 - protein, 9 aa, Homo Sapiens
LVGQTGCGK

SEQ ID NO: 621786 - protein, 9 aa, Homo Sapiens
MHFFLFLPS

SEQ ID NO: 621787 - protein, 9 aa, Homo Sapiens
KDLKAAIKY

SEQ ID NO: 621788 - protein, 9 aa, Homo Sapiens
GEHQRTSRS

SEQ ID NO: 621789 - protein, 9 aa, Homo Sapiens
IIFIDKIDA

SEQ ID NO: 621790 - protein, 9 aa, Homo Sapiens
GPRATGLHP

SEQ ID NO: 621791 - protein, 9 aa, Homo Sapiens
GGCYTNRTF

SEQ ID NO: 621792 - protein, 9 aa, Homo Sapiens
KVARKMRAL

SEQ ID NO: 621793 - protein, 9 aa, Homo Sapiens
ECITAKYVD

SEQ ID NO: 621794 - protein, 9 aa, Homo Sapiens
EKELQKHTQ

SEQ ID NO: 621795 - protein, 9 aa, Homo Sapiens
RWKKACQLF

SEQ ID NO: 621796 - protein, 9 aa, Homo Sapiens
KECITAKYV

SEQ ID NO: 621797 - protein, 9 aa, Homo Sapiens
LSGCHNVKV

SEQ ID NO: 621798 - protein, 9 aa, Homo Sapiens
LHQDGGQER

SEQ ID NO: 621799 - protein, 9 aa, Homo Sapiens
KDFSYYLPA

SEQ ID NO: 621800 - protein, 9 aa, Homo Sapiens
CEQYAKMIF

SEQ ID NO: 621801 - protein, 9 aa, Homo Sapiens
SKGYQLIPL

SEQ ID NO: 621802 - protein, 9 aa, Homo Sapiens
SKAHKPGIP

SEQ ID NO: 621803 - protein, 9 aa, Homo Sapiens
LNRKDICAG

SEQ ID NO: 621804 - protein, 9 aa, Homo Sapiens
TMPSASCLK

SEQ ID NO: 621805 - protein, 9 aa, Homo Sapiens
EPFLQFQRN

SEQ ID NO: 621806 - protein, 9 aa, Homo Sapiens
RRHRAGDTA

SEQ ID NO: 621807 - protein, 9 aa, Homo Sapiens
EMIHEAENF

SEQ ID NO: 621808 - protein, 9 aa, Homo Sapiens
LWRALQSIP

SEQ ID NO: 621809 - protein, 9 aa, Homo Sapiens
QDGWVCDTP

SEQ ID NO: 621810 - protein, 9 aa, Homo Sapiens
REARGGCYT

SEQ ID NO: 621811 - protein, 9 aa, Homo Sapiens
TSLHQDGGQ

SEQ ID NO: 621812 - protein, 9 aa, Homo Sapiens
FSPKSPNKA

SEQ ID NO: 621813 - protein, 9 aa, Homo Sapiens
GYNYEENSV

SEQ ID NO: 621814 - protein, 9 aa, Homo Sapiens
VDVDKCLDE

SEQ ID NO: 621815 - protein, 9 aa, Homo Sapiens
GCRLGGRLE

SEQ ID NO: 621816 - protein, 9 aa, Homo Sapiens
GHFLSQAGP

SEQ ID NO: 621817 - protein, 9 aa, Homo Sapiens
LWLPVNVTQ

SEQ ID NO: 621818 - protein, 9 aa, Homo Sapiens
ERNVQLEVD

SEQ ID NO: 621819 - protein, 9 aa, Homo Sapiens
LVMAHRAKV

SEQ ID NO: 621820 - protein, 9 aa, Homo Sapiens
SPTIRDMFV

SEQ ID NO: 621821 - protein, 9 aa, Homo Sapiens
HLLQHLKGH

SEQ ID NO: 621822 - protein, 9 aa, Homo Sapiens
DRALTPHED

SEQ ID NO: 621823 - protein, 9 aa, Homo Sapiens
DLFHAVKTL

SEQ ID NO: 621824 - protein, 9 aa, Homo Sapiens
PVPCLLDSP

SEQ ID NO: 621825 - protein, 9 aa, Homo Sapiens
GGSTTITTK

SEQ ID NO: 621826 - protein, 9 aa, Homo Sapiens
CWTDGNSAS

SEQ ID NO: 621827 - protein, 9 aa, Homo Sapiens
GAERGNRES

SEQ ID NO: 621828 - protein, 9 aa, Homo Sapiens
YLAKLDVLT

SEQ ID NO: 621829 - protein, 9 aa, Homo Sapiens
QEGFTGDGM

SEQ ID NO: 621830 - protein, 9 aa, Homo Sapiens
AGQSLRAML

SEQ ID NO: 621831 - protein, 9 aa, Homo Sapiens
PPPDPDSFL

SEQ ID NO: 621832 - protein, 9 aa, Homo Sapiens
ADDLSHKLL

SEQ ID NO: 621833 - protein, 9 aa, Homo Sapiens
TRPGPLKPS

SEQ ID NO: 621834 - protein, 9 aa, Homo Sapiens
QGQGVHARC

SEQ ID NO: 621835 - protein, 9 aa, Homo Sapiens
FFWLRGLLG

SEQ ID NO: 621836 - protein, 9 aa, Homo Sapiens
AQTVVTGLA

SEQ ID NO: 621837 - protein, 9 aa, Homo Sapiens
DGLRDCRSF

SEQ ID NO: 621838 - protein, 9 aa, Homo Sapiens
GGGSWAVTS

SEQ ID NO: 621839 - protein, 9 aa, Homo Sapiens
NLKGSLLYH

SEQ ID NO: 621840 - protein, 9 aa, Homo Sapiens
KQLSILLRD

SEQ ID NO: 621841 - protein, 9 aa, Homo Sapiens
IIVSINACA

SEQ ID NO: 621842 - protein, 9 aa, Homo Sapiens
VCREARGGC

SEQ ID NO: 621843 - protein, 9 aa, Homo Sapiens
ACAMLLNIP

SEQ ID NO: 621844 - protein, 9 aa, Homo Sapiens
NNKVARKMR

SEQ ID NO: 621845 - protein, 9 aa, Homo Sapiens
VVTGLARLG

SEQ ID NO: 621846 - protein, 9 aa, Homo Sapiens
CVTYHTEYR

SEQ ID NO: 621847 - protein, 9 aa, Homo Sapiens
DLNFDISKL

SEQ ID NO: 621848 - protein, 9 aa, Homo Sapiens
WRASSYLLS

SEQ ID NO: 621849 - protein, 9 aa, Homo Sapiens
PKGTRTSFT

SEQ ID NO: 621850 - protein, 9 aa, Homo Sapiens
SCEPTLKRR

SEQ ID NO: 621851 - protein, 9 aa, Homo Sapiens
NTNMYQQLS

SEQ ID NO: 621852 - protein, 9 aa, Homo Sapiens
EEESSDVEM

SEQ ID NO: 621853 - protein, 9 aa, Homo Sapiens
PPGQMAETP

SEQ ID NO: 621854 - protein, 9 aa, Homo Sapiens
LQDLLSQLV

SEQ ID NO: 621855 - protein, 9 aa, Homo Sapiens
EQPIYWSFK

SEQ ID NO: 621856 - protein, 9 aa, Homo Sapiens
LPSVSDIGL

SEQ ID NO: 621857 - protein, 9 aa, Homo Sapiens
HMKFWRKAV

SEQ ID NO: 621858 - protein, 9 aa, Homo Sapiens
QDLLSQLVR

SEQ ID NO: 621859 - protein, 9 aa, Homo Sapiens
PKSPNKAHL

SEQ ID NO: 621860 - protein, 9 aa, Homo Sapiens
QNLVMAHRA

SEQ ID NO: 621861 - protein, 9 aa, Homo Sapiens
LFHNSCLPS

SEQ ID NO: 621862 - protein, 9 aa, Homo Sapiens
PQSLVVLLL

SEQ ID NO: 621863 - protein, 9 aa, Homo Sapiens
LRIILVGQT

SEQ ID NO: 621864 - protein, 9 aa, Homo Sapiens
IGLQERNVQ

SEQ ID NO: 621865 - protein, 9 aa, Homo Sapiens
IFSRNSPGN

SEQ ID NO: 621866 - protein, 9 aa, Homo Sapiens
QDNQDRGTH

SEQ ID NO: 621867 - protein, 9 aa, Homo Sapiens
VVLPTVLEK

SEQ ID NO: 621868 - protein, 9 aa, Homo Sapiens
TGVIRTSVP

SEQ ID NO: 621869 - protein, 9 aa, Homo Sapiens
ALTPHEDGG

SEQ ID NO: 621870 - protein, 9 aa, Homo Sapiens
RAAAEAALS

SEQ ID NO: 621871 - protein, 9 aa, Homo Sapiens
STNICSFMD

SEQ ID NO: 621872 - protein, 9 aa, Homo Sapiens
NLVHHFFCY

SEQ ID NO: 621873 - protein, 9 aa, Homo Sapiens
SQVILGKRT

SEQ ID NO: 621874 - protein, 9 aa, Homo Sapiens
ALSYSCEPT

SEQ ID NO: 621875 - protein, 9 aa, Homo Sapiens
MWVQGHSFR

SEQ ID NO: 621876 - protein, 9 aa, Homo Sapiens
ELQKHTQEE

SEQ ID NO: 621877 - protein, 9 aa, Homo Sapiens
QFAQEHISW

SEQ ID NO: 621878 - protein, 9 aa, Homo Sapiens
EKWTPYLNS

SEQ ID NO: 621879 - protein, 9 aa, Homo Sapiens
PPDPDSFLT

SEQ ID NO: 621880 - protein, 9 aa, Homo Sapiens
VKTSSYSLI

SEQ ID NO: 621881 - protein, 9 aa, Homo Sapiens
TVRKECITA

SEQ ID NO: 621882 - protein, 9 aa, Homo Sapiens
PCSLSLGRT

SEQ ID NO: 621883 - protein, 9 aa, Homo Sapiens
HHFFCYVPA

SEQ ID NO: 621884 - protein, 9 aa, Homo Sapiens
QDEERDTLL

SEQ ID NO: 621885 - protein, 9 aa, Homo Sapiens
QDRMREQPI

SEQ ID NO: 621886 - protein, 9 aa, Homo Sapiens
PLRRKRQLM

SEQ ID NO: 621887 - protein, 9 aa, Homo Sapiens
LRFPLEGAS

SEQ ID NO: 621888 - protein, 9 aa, Homo Sapiens
AFEGSFEQF

SEQ ID NO: 621889 - protein, 9 aa, Homo Sapiens
IISGPYKST

SEQ ID NO: 621890 - protein, 9 aa, Homo Sapiens
GEHFFDARG

SEQ ID NO: 621891 - protein, 9 aa, Homo Sapiens
GPYKSTLLK

SEQ ID NO: 621892 - protein, 9 aa, Homo Sapiens
PDKATGQPC

SEQ ID NO: 621893 - protein, 9 aa, Homo Sapiens
AERLSAVKA

SEQ ID NO: 621894 - protein, 9 aa, Homo Sapiens
DPHRGAYNV

SEQ ID NO: 621895 - protein, 9 aa, Homo Sapiens
QTLEEDRAL

SEQ ID NO: 621896 - protein, 9 aa, Homo Sapiens
RILIFADTP

SEQ ID NO: 621897 - protein, 9 aa, Homo Sapiens
INTNMYQQL

SEQ ID NO: 621898 - protein, 9 aa, Homo Sapiens
EINPISGEF

SEQ ID NO: 621899 - protein, 9 aa, Homo Sapiens
FQRNVFFPK

SEQ ID NO: 621900 - protein, 9 aa, Homo Sapiens
QKPLNPTIK

SEQ ID NO: 621901 - protein, 9 aa, Homo Sapiens
TLFPQRSDG

SEQ ID NO: 621902 - protein, 9 aa, Homo Sapiens
VVTTTRVHH

SEQ ID NO: 621903 - protein, 9 aa, Homo Sapiens
PYKSTLLKQ

SEQ ID NO: 621904 - protein, 9 aa, Homo Sapiens
LPDSHVCCV

SEQ ID NO: 621905 - protein, 9 aa, Homo Sapiens
NGAVASFVT

SEQ ID NO: 621906 - protein, 9 aa, Homo Sapiens
VLPTVLEKL

SEQ ID NO: 621907 - protein, 9 aa, Homo Sapiens
SCLPSWLEQ

SEQ ID NO: 621908 - protein, 9 aa, Homo Sapiens
LPSWLEQDT

SEQ ID NO: 621909 - protein, 9 aa, Homo Sapiens
QEIIVICST

SEQ ID NO: 621910 - protein, 9 aa, Homo Sapiens
YIIGMLERY

SEQ ID NO: 621911 - protein, 9 aa, Homo Sapiens
DQAAIDLLH

SEQ ID NO: 621912 - protein, 9 aa, Homo Sapiens
MRHYCLCCA

SEQ ID NO: 621913 - protein, 9 aa, Homo Sapiens
CREARGGCY

SEQ ID NO: 621914 - protein, 9 aa, Homo Sapiens
KKKYIEELQ

SEQ ID NO: 621915 - protein, 9 aa, Homo Sapiens
LPGFPGRDG

SEQ ID NO: 621916 - protein, 9 aa, Homo Sapiens
LFEVQWQLA

SEQ ID NO: 621917 - protein, 9 aa, Homo Sapiens
KEPSRQQPF

SEQ ID NO: 621918 - protein, 9 aa, Homo Sapiens
IVGGYNYEE

SEQ ID NO: 621919 - protein, 9 aa, Homo Sapiens
VTYHTEYRW

SEQ ID NO: 621920 - protein, 9 aa, Homo Sapiens
DGTPCRPYE

SEQ ID NO: 621921 - protein, 9 aa, Homo Sapiens
NKAHLNLHI

SEQ ID NO: 621922 - protein, 9 aa, Homo Sapiens
GKRTDEQTD

SEQ ID NO: 621923 - protein, 9 aa, Homo Sapiens
SYSEEKAKQ

SEQ ID NO: 621924 - protein, 9 aa, Homo Sapiens
TCWTDGNSA

SEQ ID NO: 621925 - protein, 9 aa, Homo Sapiens
VDGLRDCRS

SEQ ID NO: 621926 - protein, 9 aa, Homo Sapiens
DMPPCGWPA

SEQ ID NO: 621927 - protein, 9 aa, Homo Sapiens
PSADDLSHK

SEQ ID NO: 621928 - protein, 9 aa, Homo Sapiens
NPTIKYQYL

SEQ ID NO: 621929 - protein, 9 aa, Homo Sapiens
PMFYASTVV

SEQ ID NO: 621930 - protein, 9 aa, Homo Sapiens
RPAPSTWGL

SEQ ID NO: 621931 - protein, 9 aa, Homo Sapiens
RKMRALYDF

SEQ ID NO: 621932 - protein, 9 aa, Homo Sapiens
YNLHIIKRG

SEQ ID NO: 621933 - protein, 9 aa, Homo Sapiens
ASKAHKPGI

SEQ ID NO: 621934 - protein, 9 aa, Homo Sapiens
ELVMKNIQD

SEQ ID NO: 621935 - protein, 9 aa, Homo Sapiens
QKHTQEETN

SEQ ID NO: 621936 - protein, 9 aa, Homo Sapiens
QTRDMPPCG

SEQ ID NO: 621937 - protein, 9 aa, Homo Sapiens
GQDLLSVPV

SEQ ID NO: 621938 - protein, 9 aa, Homo Sapiens
QSLVVLLLL

SEQ ID NO: 621939 - protein, 9 aa, Homo Sapiens
VRRNTPWTL

SEQ ID NO: 621940 - protein, 9 aa, Homo Sapiens
ELFAAILRN

SEQ ID NO: 621941 - protein, 9 aa, Homo Sapiens
KSFSQICHL

SEQ ID NO: 621942 - protein, 9 aa, Homo Sapiens
VMDKPVDLS

SEQ ID NO: 621943 - protein, 9 aa, Homo Sapiens
SDVRVKILA

SEQ ID NO: 621944 - protein, 9 aa, Homo Sapiens
MDGRKAGGE

SEQ ID NO: 621945 - protein, 9 aa, Homo Sapiens
PCQDGWVCD

SEQ ID NO: 621946 - protein, 9 aa, Homo Sapiens
VGFWMDPDL

SEQ ID NO: 621947 - protein, 9 aa, Homo Sapiens
PGQKWEPAT

SEQ ID NO: 621948 - protein, 9 aa, Homo Sapiens
LQHLKGHEA

SEQ ID NO: 621949 - protein, 9 aa, Homo Sapiens
FSRVLRAHV

SEQ ID NO: 621950 - protein, 9 aa, Homo Sapiens
NKASTVAAT

SEQ ID NO: 621951 - protein, 9 aa, Homo Sapiens
LWQAERAAA

SEQ ID NO: 621952 - protein, 9 aa, Homo Sapiens
YNVSTKSSD

SEQ ID NO: 621953 - protein, 9 aa, Homo Sapiens
ASSKSGKDF

SEQ ID NO: 621954 - protein, 9 aa, Homo Sapiens
KTVTCWTDG

SEQ ID NO: 621955 - protein, 9 aa, Homo Sapiens
LLNRKDICA

SEQ ID NO: 621956 - protein, 9 aa, Homo Sapiens
RCPHQERCS

SEQ ID NO: 621957 - protein, 9 aa, Homo Sapiens
RGLIHSDRC

SEQ ID NO: 621958 - protein, 9 aa, Homo Sapiens
QAAIDLLHN

SEQ ID NO: 621959 - protein, 9 aa, Homo Sapiens
HILLHFPAK

SEQ ID NO: 621960 - protein, 9 aa, Homo Sapiens
GFWMDPDLQ

SEQ ID NO: 621961 - protein, 9 aa, Homo Sapiens
SNWALGFHL

SEQ ID NO: 621962 - protein, 9 aa, Homo Sapiens
NLLQPNAQQ

SEQ ID NO: 621963 - protein, 9 aa, Homo Sapiens
PCLLDSPST

SEQ ID NO: 621964 - protein, 9 aa, Homo Sapiens
RLFTHGHSS

SEQ ID NO: 621965 - protein, 9 aa, Homo Sapiens
STGGSTTIT

SEQ ID NO: 621966 - protein, 9 aa, Homo Sapiens
LSVPVTQAA

SEQ ID NO: 621967 - protein, 9 aa, Homo Sapiens
FVRCIAQMV

SEQ ID NO: 621968 - protein, 9 aa, Homo Sapiens
KPLSTPGDY

SEQ ID NO: 621969 - protein, 9 aa, Homo Sapiens
DDWGDKKVI

SEQ ID NO: 621970 - protein, 9 aa, Homo Sapiens
SGNKASTVA

SEQ ID NO: 621971 - protein, 9 aa, Homo Sapiens
HRDEQAQLG

SEQ ID NO: 621972 - protein, 9 aa, Homo Sapiens
RKECITAKY

SEQ ID NO: 621973 - protein, 9 aa, Homo Sapiens
RQNVVDLFH

SEQ ID NO: 621974 - protein, 9 aa, Homo Sapiens
DLSHKLLEF

SEQ ID NO: 621975 - protein, 9 aa, Homo Sapiens
MRALYDFEA

SEQ ID NO: 621976 - protein, 9 aa, Homo Sapiens
QRVEAFASQ

SEQ ID NO: 621977 - protein, 9 aa, Homo Sapiens
FVTRPGPLK

SEQ ID NO: 621978 - protein, 9 aa, Homo Sapiens
ENKKKYIEE

SEQ ID NO: 621979 - protein, 9 aa, Homo Sapiens
THRKADFQH

SEQ ID NO: 621980 - protein, 9 aa, Homo Sapiens
NSTLPGADS

SEQ ID NO: 621981 - protein, 9 aa, Homo Sapiens
RVLRAHVRS

SEQ ID NO: 621982 - protein, 9 aa, Homo Sapiens
ATTSHRVTR

SEQ ID NO: 621983 - protein, 9 aa, Homo Sapiens
EGFTGDGMT

SEQ ID NO: 621984 - protein, 9 aa, Homo Sapiens
AIYQRVEAF

SEQ ID NO: 621985 - protein, 9 aa, Homo Sapiens
GKILGELNK

SEQ ID NO: 621986 - protein, 9 aa, Homo Sapiens
PLIEVNQGS

SEQ ID NO: 621987 - protein, 9 aa, Homo Sapiens
AVLLNRKDI

SEQ ID NO: 621988 - protein, 9 aa, Homo Sapiens
IFIDKIDAI

SEQ ID NO: 621989 - protein, 9 aa, Homo Sapiens
VTRPGPLKP

SEQ ID NO: 621990 - protein, 9 aa, Homo Sapiens
EAFASQPEA

SEQ ID NO: 621991 - protein, 9 aa, Homo Sapiens
STTITTKKY

SEQ ID NO: 621992 - protein, 9 aa, Homo Sapiens
SEQLWQAER

SEQ ID NO: 621993 - protein, 9 aa, Homo Sapiens
HPSFFWLRG

SEQ ID NO: 621994 - protein, 9 aa, Homo Sapiens
LIWDMCISV

SEQ ID NO: 621995 - protein, 9 aa, Homo Sapiens
EIMCKILKT

SEQ ID NO: 621996 - protein, 9 aa, Homo Sapiens
RAKLEKWTP

SEQ ID NO: 621997 - protein, 9 aa, Homo Sapiens
YILKFQEKL

SEQ ID NO: 621998 - protein, 9 aa, Homo Sapiens
TGQPCEQYA

SEQ ID NO: 621999 - protein, 9 aa, Homo Sapiens
PGQVIHTIT

SEQ ID NO: 622000 - protein, 9 aa, Homo Sapiens
FAQEHISWW

SEQ ID NO: 622001 - protein, 9 aa, Homo Sapiens
TTYLNVQRV

SEQ ID NO: 622002 - protein, 9 aa, Homo Sapiens
KGNKNSNKF

SEQ ID NO: 622003 - protein, 9 aa, Homo Sapiens
ARLLTHFSV

SEQ ID NO: 622004 - protein, 9 aa, Homo Sapiens
FEQFDVSAD

SEQ ID NO: 622005 - protein, 9 aa, Homo Sapiens
PRPKLDGAR

SEQ ID NO: 622006 - protein, 9 aa, Homo Sapiens
NKDLKAAIK

SEQ ID NO: 622007 - protein, 9 aa, Homo Sapiens
DVDCHQLLA

SEQ ID NO: 622008 - protein, 9 aa, Homo Sapiens
GRSLSSCSA

SEQ ID NO: 622009 - protein, 9 aa, Homo Sapiens
LMRSGTLVG

SEQ ID NO: 622010 - protein, 9 aa, Homo Sapiens
AKLEKWTPY

SEQ ID NO: 622011 - protein, 9 aa, Homo Sapiens
GGEEQECLD

SEQ ID NO: 622012 - protein, 9 aa, Homo Sapiens
VGQTGCGKS

SEQ ID NO: 622013 - protein, 9 aa, Homo Sapiens
TITATDKDD

SEQ ID NO: 622014 - protein, 9 aa, Homo Sapiens
EIAESRVSV

SEQ ID NO: 622015 - protein, 9 aa, Homo Sapiens
DCVMDKPVD

SEQ ID NO: 622016 - protein, 9 aa, Homo Sapiens
TGLARLGGI

SEQ ID NO: 622017 - protein, 9 aa, Homo Sapiens
HSFRASATE

SEQ ID NO: 622018 - protein, 9 aa, Homo Sapiens
NCICCNLSV

SEQ ID NO: 622019 - protein, 9 aa, Homo Sapiens
GIPLCSRPA

SEQ ID NO: 622020 - protein, 9 aa, Homo Sapiens
QENLVEKQH

SEQ ID NO: 622021 - protein, 9 aa, Homo Sapiens
LCGYCGIKA

SEQ ID NO: 622022 - protein, 9 aa, Homo Sapiens
AMLLNIPLY

SEQ ID NO: 622023 - protein, 9 aa, Homo Sapiens
SSASSSVGE

SEQ ID NO: 622024 - protein, 9 aa, Homo Sapiens
PSGKEPSRQ

SEQ ID NO: 622025 - protein, 9 aa, Homo Sapiens
YCLCCATKG

SEQ ID NO: 622026 - protein, 9 aa, Homo Sapiens
PALPSNWAL

SEQ ID NO: 622027 - protein, 9 aa, Homo Sapiens
IRVKLRRRL

SEQ ID NO: 622028 - protein, 9 aa, Homo Sapiens
VVQDRAERD

SEQ ID NO: 622029 - protein, 9 aa, Homo Sapiens
VLLKEMREI

SEQ ID NO: 622030 - protein, 9 aa, Homo Sapiens
DDADTVVVV

SEQ ID NO: 622031 - protein, 9 aa, Homo Sapiens
LHTTSHCHV

SEQ ID NO: 622032 - protein, 9 aa, Homo Sapiens
TPYLNSNGL

SEQ ID NO: 622033 - protein, 9 aa, Homo Sapiens
SFVTRPGPL

SEQ ID NO: 622034 - protein, 9 aa, Homo Sapiens
RSPEVGDEV

SEQ ID NO: 622035 - protein, 9 aa, Homo Sapiens
IETNSTLPG

SEQ ID NO: 622036 - protein, 9 aa, Homo Sapiens
ARKVKKARE

SEQ ID NO: 622037 - protein, 9 aa, Homo Sapiens
TTGPWATTS

SEQ ID NO: 622038 - protein, 9 aa, Homo Sapiens
SFENQDSCH

SEQ ID NO: 622039 - protein, 9 aa, Homo Sapiens
KLDVLTLKE

SEQ ID NO: 622040 - protein, 9 aa, Homo Sapiens
RQARKVKKA

SEQ ID NO: 622041 - protein, 9 aa, Homo Sapiens
EASGSGLLP

SEQ ID NO: 622042 - protein, 9 aa, Homo Sapiens
CYVPAVMAL

SEQ ID NO: 622043 - protein, 9 aa, Homo Sapiens
KPLPMGIIA

SEQ ID NO: 622044 - protein, 9 aa, Homo Sapiens
ILLHFPAKE

SEQ ID NO: 622045 - protein, 9 aa, Homo Sapiens
MLLNIPLYL

SEQ ID NO: 622046 - protein, 9 aa, Homo Sapiens
AWSHILLHF

SEQ ID NO: 622047 - protein, 9 aa, Homo Sapiens
PIYWSFKTR

SEQ ID NO: 622048 - protein, 9 aa, Homo Sapiens
TSPELLEDV

SEQ ID NO: 622049 - protein, 9 aa, Homo Sapiens
QHLKGHEAA

SEQ ID NO: 622050 - protein, 9 aa, Homo Sapiens
DRAERDYTI

SEQ ID NO: 622051 - protein, 9 aa, Homo Sapiens
WGDKDFTFG

SEQ ID NO: 622052 - protein, 9 aa, Homo Sapiens
QFQRNVFFP

SEQ ID NO: 622053 - protein, 9 aa, Homo Sapiens
RVEAFASQP

SEQ ID NO: 622054 - protein, 9 aa, Homo Sapiens
EPEEEEEQA

SEQ ID NO: 622055 - protein, 9 aa, Homo Sapiens
HQLLASWLV

SEQ ID NO: 622056 - protein, 9 aa, Homo Sapiens
NQIESIRST

SEQ ID NO: 622057 - protein, 9 aa, Homo Sapiens
PGQMAETPN

SEQ ID NO: 622058 - protein, 9 aa, Homo Sapiens
NPISGEFNL

SEQ ID NO: 622059 - protein, 9 aa, Homo Sapiens
PSVENFFTL

SEQ ID NO: 622060 - protein, 9 aa, Homo Sapiens
EVAEEVLAA

SEQ ID NO: 622061 - protein, 9 aa, Homo Sapiens
PEDDAVYQC

SEQ ID NO: 622062 - protein, 9 aa, Homo Sapiens
VRKECITAK

SEQ ID NO: 622063 - protein, 9 aa, Homo Sapiens
PVDLSDRFS

SEQ ID NO: 622064 - protein, 9 aa, Homo Sapiens
SQWSWKVTS

SEQ ID NO: 622065 - protein, 9 aa, Homo Sapiens
IAFEGSFEQ

SEQ ID NO: 622066 - protein, 9 aa, Homo Sapiens
ENLYKFKEC

SEQ ID NO: 622067 - protein, 9 aa, Homo Sapiens
KAKQVRSEY

SEQ ID NO: 622068 - protein, 9 aa, Homo Sapiens
LNNKVARKM

SEQ ID NO: 622069 - protein, 9 aa, Homo Sapiens
SFGQGQNST

SEQ ID NO: 622070 - protein, 9 aa, Homo Sapiens
ATGQPCEQY

SEQ ID NO: 622071 - protein, 9 aa, Homo Sapiens
LDRPKGTRT

SEQ ID NO: 622072 - protein, 9 aa, Homo Sapiens
KGYQLIPLC

SEQ ID NO: 622073 - protein, 9 aa, Homo Sapiens
RESFLQALG

SEQ ID NO: 622074 - protein, 9 aa, Homo Sapiens
IGDDWGDKK

SEQ ID NO: 622075 - protein, 9 aa, Homo Sapiens
NVLTALSYL

SEQ ID NO: 622076 - protein, 9 aa, Homo Sapiens
DEQNCTMEI

SEQ ID NO: 622077 - protein, 9 aa, Homo Sapiens
PTTSTSQRL

SEQ ID NO: 622078 - protein, 9 aa, Homo Sapiens
MDRCVSILC

SEQ ID NO: 622079 - protein, 9 aa, Homo Sapiens
VNGTISRYV

SEQ ID NO: 622080 - protein, 9 aa, Homo Sapiens
QLCTPGLHT

SEQ ID NO: 622081 - protein, 9 aa, Homo Sapiens
KDITMQCTK

SEQ ID NO: 622082 - protein, 9 aa, Homo Sapiens
LEGNDFQEN

SEQ ID NO: 622083 - protein, 9 aa, Homo Sapiens
QKTKDNVED

SEQ ID NO: 622084 - protein, 9 aa, Homo Sapiens
RSGDASQEI

SEQ ID NO: 622085 - protein, 9 aa, Homo Sapiens
DMFVRCIAQ

SEQ ID NO: 622086 - protein, 9 aa, Homo Sapiens
ASFVTRPGP

SEQ ID NO: 622087 - protein, 9 aa, Homo Sapiens
DARGAHSDE

SEQ ID NO: 622088 - protein, 9 aa, Homo Sapiens
ELSRAGTPM

SEQ ID NO: 622089 - protein, 9 aa, Homo Sapiens
GAKGAACLP

SEQ ID NO: 622090 - protein, 9 aa, Homo Sapiens
ENVLTALSY

SEQ ID NO: 622091 - protein, 9 aa, Homo Sapiens
SCHQQVLET

SEQ ID NO: 622092 - protein, 9 aa, Homo Sapiens
LLYKNSGCL

SEQ ID NO: 622093 - protein, 9 aa, Homo Sapiens
DILVGENVL

SEQ ID NO: 622094 - protein, 9 aa, Homo Sapiens
RHYCLCCAT

SEQ ID NO: 622095 - protein, 9 aa, Homo Sapiens
WEASGSGLL

SEQ ID NO: 622096 - protein, 9 aa, Homo Sapiens
FEIEPHKEC

SEQ ID NO: 622097 - protein, 9 aa, Homo Sapiens
KPDKIRNLH

SEQ ID NO: 622098 - protein, 9 aa, Homo Sapiens
ERYTDKLER

SEQ ID NO: 622099 - protein, 9 aa, Homo Sapiens
VRRCPHQER

SEQ ID NO: 622100 - protein, 9 aa, Homo Sapiens
TVCLLPFFL

SEQ ID NO: 622101 - protein, 9 aa, Homo Sapiens
HLGNLLQPN

SEQ ID NO: 622102 - protein, 9 aa, Homo Sapiens
YTDKLERDR

SEQ ID NO: 622103 - protein, 9 aa, Homo Sapiens
LPPSSFITY

SEQ ID NO: 622104 - protein, 9 aa, Homo Sapiens
NVEDIQNIM

SEQ ID NO: 622105 - protein, 9 aa, Homo Sapiens
HFSVHDLIF

SEQ ID NO: 622106 - protein, 9 aa, Homo Sapiens
DGELDLASG

SEQ ID NO: 622107 - protein, 9 aa, Homo Sapiens
PIIYCCLNN

SEQ ID NO: 622108 - protein, 9 aa, Homo Sapiens
IPLCSRPAP

SEQ ID NO: 622109 - protein, 9 aa, Homo Sapiens
WDPHRGAYN

SEQ ID NO: 622110 - protein, 9 aa, Homo Sapiens
TNMYQQLSY

SEQ ID NO: 622111 - protein, 9 aa, Homo Sapiens
GQMAETPNS

SEQ ID NO: 622112 - protein, 9 aa, Homo Sapiens
PSGRKPLPM

SEQ ID NO: 622113 - protein, 9 aa, Homo Sapiens
VVRRCPHQE

SEQ ID NO: 622114 - protein, 9 aa, Homo Sapiens
LQFQRNVFF

SEQ ID NO: 622115 - protein, 9 aa, Homo Sapiens
FSDEDSDLN

SEQ ID NO: 622116 - protein, 9 aa, Homo Sapiens
CEPTLKRRH

SEQ ID NO: 622117 - protein, 9 aa, Homo Sapiens
PLPMGIIAA

SEQ ID NO: 622118 - protein, 9 aa, Homo Sapiens
DDLSHKLLE

SEQ ID NO: 622119 - protein, 9 aa, Homo Sapiens
EQFDVSADE

SEQ ID NO: 622120 - protein, 9 aa, Homo Sapiens
ESKQSDLRF

SEQ ID NO: 622121 - protein, 9 aa, Homo Sapiens
CKPPTPGGA

SEQ ID NO: 622122 - protein, 9 aa, Homo Sapiens
LARLGGIPV

SEQ ID NO: 622123 - protein, 9 aa, Homo Sapiens
LRAMLENVT

SEQ ID NO: 622124 - protein, 9 aa, Homo Sapiens
QSDLRFPLE

SEQ ID NO: 622125 - protein, 9 aa, Homo Sapiens
GLARLGGIP

SEQ ID NO: 622126 - protein, 9 aa, Homo Sapiens
WTSTHRKAD

SEQ ID NO: 622127 - protein, 9 aa, Homo Sapiens
LRTITILIS

SEQ ID NO: 622128 - protein, 9 aa, Homo Sapiens
ANAQVVKGF

SEQ ID NO: 622129 - protein, 9 aa, Homo Sapiens
HNSCLPSWL

SEQ ID NO: 622130 - protein, 9 aa, Homo Sapiens
RTSVPDLDR

SEQ ID NO: 622131 - protein, 9 aa, Homo Sapiens
GLRDCRSFH

SEQ ID NO: 622132 - protein, 9 aa, Homo Sapiens
GIKAKRFSW

SEQ ID NO: 622133 - protein, 9 aa, Homo Sapiens
LSIVGPSEA

SEQ ID NO: 622134 - protein, 9 aa, Homo Sapiens
NYEENSVPY

SEQ ID NO: 622135 - protein, 9 aa, Homo Sapiens
GRPALPSNW

SEQ ID NO: 622136 - protein, 9 aa, Homo Sapiens
CCATKGGNE

SEQ ID NO: 622137 - protein, 9 aa, Homo Sapiens
YNYEENSVP

SEQ ID NO: 622138 - protein, 9 aa, Homo Sapiens
FLPSVSDIG

SEQ ID NO: 622139 - protein, 9 aa, Homo Sapiens
PDTPLKNIV

SEQ ID NO: 622140 - protein, 9 aa, Homo Sapiens
ILANAQVVK

SEQ ID NO: 622141 - protein, 9 aa, Homo Sapiens
GARTDLPDS

SEQ ID NO: 622142 - protein, 9 aa, Homo Sapiens
IYCCLNNRF

SEQ ID NO: 622143 - protein, 9 aa, Homo Sapiens
HISWWGPGS

SEQ ID NO: 622144 - protein, 9 aa, Homo Sapiens
TYSSDNTIR

SEQ ID NO: 622145 - protein, 9 aa, Homo Sapiens
FWRKAVGGL

SEQ ID NO: 622146 - protein, 9 aa, Homo Sapiens
KSGKDFSYY

SEQ ID NO: 622147 - protein, 9 aa, Homo Sapiens
MFYASTVVL

SEQ ID NO: 622148 - protein, 9 aa, Homo Sapiens
HTEYRWEVY

SEQ ID NO: 622149 - protein, 9 aa, Homo Sapiens
SVPVTQAAL

SEQ ID NO: 622150 - protein, 9 aa, Homo Sapiens
SSYSLIISI

SEQ ID NO: 622151 - protein, 9 aa, Homo Sapiens
LAGISDSSS

SEQ ID NO: 622152 - protein, 9 aa, Homo Sapiens
GMTCVDLDE

SEQ ID NO: 622153 - protein, 9 aa, Homo Sapiens
IIGMLERYT

SEQ ID NO: 622154 - protein, 9 aa, Homo Sapiens
ELSEQLWQA

SEQ ID NO: 622155 - protein, 9 aa, Homo Sapiens
LWPTMPSAS

SEQ ID NO: 622156 - protein, 9 aa, Homo Sapiens
KRMDGRKAG

SEQ ID NO: 622157 - protein, 9 aa, Homo Sapiens
EVDVEAPRP

SEQ ID NO: 622158 - protein, 9 aa, Homo Sapiens
QEERLLGDR

SEQ ID NO: 622159 - protein, 9 aa, Homo Sapiens
WVQGHSFRA

SEQ ID NO: 622160 - protein, 9 aa, Homo Sapiens
GSWIIVSIN

SEQ ID NO: 622161 - protein, 9 aa, Homo Sapiens
WRSCLQEER

SEQ ID NO: 622162 - protein, 9 aa, Homo Sapiens
VDEMIHEAE

SEQ ID NO: 622163 - protein, 9 aa, Homo Sapiens
LNAESLVNR

SEQ ID NO: 622164 - protein, 9 aa, Homo Sapiens
VYQCMAENS

SEQ ID NO: 622165 - protein, 9 aa, Homo Sapiens
RHRAGDTAT

SEQ ID NO: 622166 - protein, 9 aa, Homo Sapiens
KCKECGMAF

SEQ ID NO: 622167 - protein, 9 aa, Homo Sapiens
PPCGWPACH

SEQ ID NO: 622168 - protein, 9 aa, Homo Sapiens
GWVCDTPGS

SEQ ID NO: 622169 - protein, 9 aa, Homo Sapiens
SLQDSGQSR

SEQ ID NO: 622170 - protein, 9 aa, Homo Sapiens
VCTELSPSE

SEQ ID NO: 622171 - protein, 9 aa, Homo Sapiens
HISLLEKNL

SEQ ID NO: 622172 - protein, 9 aa, Homo Sapiens
DENGKILGE

SEQ ID NO: 622173 - protein, 9 aa, Homo Sapiens
PLSTPGDYL

SEQ ID NO: 622174 - protein, 9 aa, Homo Sapiens
SWAVTSDQS

SEQ ID NO: 622175 - protein, 9 aa, Homo Sapiens
GTVPSASCP

SEQ ID NO: 622176 - protein, 9 aa, Homo Sapiens
WQAERAAAG

SEQ ID NO: 622177 - protein, 9 aa, Homo Sapiens
ITATDKDDF

SEQ ID NO: 622178 - protein, 9 aa, Homo Sapiens
WLWRSCLQE

SEQ ID NO: 622179 - protein, 9 aa, Homo Sapiens
SGSGLLPSP

SEQ ID NO: 622180 - protein, 9 aa, Homo Sapiens
AAAPLGVLT

SEQ ID NO: 622181 - protein, 9 aa, Homo Sapiens
DQIFQETQR

SEQ ID NO: 622182 - protein, 9 aa, Homo Sapiens
LPLDGELDL

SEQ ID NO: 622183 - protein, 9 aa, Homo Sapiens
QVMLLTQPL

SEQ ID NO: 622184 - protein, 9 aa, Homo Sapiens
NVQRVNGTI

SEQ ID NO: 622185 - protein, 9 aa, Homo Sapiens
NWALGFHLS

SEQ ID NO: 622186 - protein, 9 aa, Homo Sapiens
RNTPWTLWL

SEQ ID NO: 622187 - protein, 9 aa, Homo Sapiens
LCTPGLHTT

SEQ ID NO: 622188 - protein, 9 aa, Homo Sapiens
RRKFGSFIW

SEQ ID NO: 622189 - protein, 9 aa, Homo Sapiens
LSLGRTCTS

SEQ ID NO: 622190 - protein, 9 aa, Homo Sapiens
AGGEEQECL

SEQ ID NO: 622191 - protein, 9 aa, Homo Sapiens
LDIVCTELS

SEQ ID NO: 622192 - protein, 9 aa, Homo Sapiens
LMDSGNKAS

SEQ ID NO: 622193 - protein, 9 aa, Homo Sapiens
KGHEAARVL

SEQ ID NO: 622194 - protein, 9 aa, Homo Sapiens
SSYLLSPEL

SEQ ID NO: 622195 - protein, 9 aa, Homo Sapiens
PMWRLGTQP

SEQ ID NO: 622196 - protein, 9 aa, Homo Sapiens
NAESLVNRR

SEQ ID NO: 622197 - protein, 9 aa, Homo Sapiens
GYTVELNGS

SEQ ID NO: 622198 - protein, 9 aa, Homo Sapiens
GVVTTTRVH

SEQ ID NO: 622199 - protein, 9 aa, Homo Sapiens
APAIIFIDK

SEQ ID NO: 622200 - protein, 9 aa, Homo Sapiens
QRVNGTISR

SEQ ID NO: 622201 - protein, 9 aa, Homo Sapiens
MQCTKQYAC

SEQ ID NO: 622202 - protein, 9 aa, Homo Sapiens
KILKTVTCW

SEQ ID NO: 622203 - protein, 9 aa, Homo Sapiens
RMDGRKAGG

SEQ ID NO: 622204 - protein, 9 aa, Homo Sapiens
RSTEGSRKN

SEQ ID NO: 622205 - protein, 9 aa, Homo Sapiens
VMLLTQPLE

SEQ ID NO: 622206 - protein, 9 aa, Homo Sapiens
VCLLPFFLL

SEQ ID NO: 622207 - protein, 9 aa, Homo Sapiens
PFLQFQRNV

SEQ ID NO: 622208 - protein, 9 aa, Homo Sapiens
AVKAIANAI

SEQ ID NO: 622209 - protein, 9 aa, Homo Sapiens
LASWLVCLC

SEQ ID NO: 622210 - protein, 9 aa, Homo Sapiens
VDVEAPRPK

SEQ ID NO: 622211 - protein, 9 aa, Homo Sapiens
KSPNKAHLN

SEQ ID NO: 622212 - protein, 9 aa, Homo Sapiens
QIVCVELHQ

SEQ ID NO: 622213 - protein, 9 aa, Homo Sapiens
QTVVTGLAR

SEQ ID NO: 622214 - protein, 9 aa, Homo Sapiens
VGENVLTAL

SEQ ID NO: 622215 - protein, 9 aa, Homo Sapiens
VTSPSGKEP

SEQ ID NO: 622216 - protein, 9 aa, Homo Sapiens
SQGDGGSET

SEQ ID NO: 622217 - protein, 9 aa, Homo Sapiens
TVTCWTDGN

SEQ ID NO: 622218 - protein, 9 aa, Homo Sapiens
QPIYWSFKT

SEQ ID NO: 622219 - protein, 9 aa, Homo Sapiens
DKATGQPCE

SEQ ID NO: 622220 - protein, 9 aa, Homo Sapiens
VKVSAQQGQ

SEQ ID NO: 622221 - protein, 9 aa, Homo Sapiens
CICCNLSVS

SEQ ID NO: 622222 - protein, 9 aa, Homo Sapiens
STSQAQVML

SEQ ID NO: 622223 - protein, 9 aa, Homo Sapiens
DIQNIMKTW

SEQ ID NO: 622224 - protein, 9 aa, Homo Sapiens
EEILIKVIN

SEQ ID NO: 622225 - protein, 9 aa, Homo Sapiens
MWLWPTMPS

SEQ ID NO: 622226 - protein, 9 aa, Homo Sapiens
QSKVEIAES

SEQ ID NO: 622227 - protein, 9 aa, Homo Sapiens
LGTFSLRKL

SEQ ID NO: 622228 - protein, 9 aa, Homo Sapiens
ISKPERSYL

SEQ ID NO: 622229 - protein, 9 aa, Homo Sapiens
DVRVKILAA

SEQ ID NO: 622230 - protein, 9 aa, Homo Sapiens
RPGSKNPNP

SEQ ID NO: 622231 - protein, 9 aa, Homo Sapiens
WTLWLPVNV

SEQ ID NO: 622232 - protein, 9 aa, Homo Sapiens
LLSVPVTQA

SEQ ID NO: 622233 - protein, 9 aa, Homo Sapiens
NFFTLVTEG

SEQ ID NO: 622234 - protein, 9 aa, Homo Sapiens
KTNLEIARK

SEQ ID NO: 622235 - protein, 9 aa, Homo Sapiens
CRLGGRLER

SEQ ID NO: 622236 - protein, 9 aa, Homo Sapiens
QWSWKVTSP

SEQ ID NO: 622237 - protein, 9 aa, Homo Sapiens
PAIIFIDKI

SEQ ID NO: 622238 - protein, 9 aa, Homo Sapiens
RGPRATGLH

SEQ ID NO: 622239 - protein, 9 aa, Homo Sapiens
VGDEVALRP

SEQ ID NO: 622240 - protein, 9 aa, Homo Sapiens
STSLHQDGG

SEQ ID NO: 622241 - protein, 9 aa, Homo Sapiens
GHSSTALHP

SEQ ID NO: 622242 - protein, 9 aa, Homo Sapiens
FRNVEGMWL

SEQ ID NO: 622243 - protein, 9 aa, Homo Sapiens
YEWQTRDMP

SEQ ID NO: 622244 - protein, 9 aa, Homo Sapiens
QPCEQYAKM

SEQ ID NO: 622245 - protein, 9 aa, Homo Sapiens
LTDSEGESS

SEQ ID NO: 622246 - protein, 9 aa, Homo Sapiens
IDQAAIDLL

SEQ ID NO: 622247 - protein, 9 aa, Homo Sapiens
QTAKAQLRK

SEQ ID NO: 622248 - protein, 9 aa, Homo Sapiens
WIAEQHGYG

SEQ ID NO: 622249 - protein, 9 aa, Homo Sapiens
HSEPGAPAF

SEQ ID NO: 622250 - protein, 9 aa, Homo Sapiens
FPGRDGVPG

SEQ ID NO: 622251 - protein, 9 aa, Homo Sapiens
GVAAKWRAS

SEQ ID NO: 622252 - protein, 9 aa, Homo Sapiens
ASTVAATNM

SEQ ID NO: 622253 - protein, 9 aa, Homo Sapiens
RAISSRVQE

SEQ ID NO: 622254 - protein, 9 aa, Homo Sapiens
SAVKAIANA

SEQ ID NO: 622255 - protein, 9 aa, Homo Sapiens
SVIETNSTL

SEQ ID NO: 622256 - protein, 9 aa, Homo Sapiens
TVNKIDQAA

SEQ ID NO: 622257 - protein, 9 aa, Homo Sapiens
LGLQGSIND

SEQ ID NO: 622258 - protein, 9 aa, Homo Sapiens
VPVTQAALG

SEQ ID NO: 622259 - protein, 9 aa, Homo Sapiens
AGSYSCQAQ

SEQ ID NO: 622260 - protein, 9 aa, Homo Sapiens
ARGGCYTNR

SEQ ID NO: 622261 - protein, 9 aa, Homo Sapiens
RAGTPMHWL

SEQ ID NO: 622262 - protein, 9 aa, Homo Sapiens
SSFITYSSD

SEQ ID NO: 622263 - protein, 9 aa, Homo Sapiens
QALSPKLFE

SEQ ID NO: 622264 - protein, 9 aa, Homo Sapiens
RKNDDADTV

SEQ ID NO: 622265 - protein, 9 aa, Homo Sapiens
AKWRASSYL

SEQ ID NO: 622266 - protein, 9 aa, Homo Sapiens
SLSLGRTCT

SEQ ID NO: 622267 - protein, 9 aa, Homo Sapiens
QVFAFSRVL

SEQ ID NO: 622268 - protein, 9 aa, Homo Sapiens
GRKAGGEEQ

SEQ ID NO: 622269 - protein, 9 aa, Homo Sapiens
IPLYLNIAL

SEQ ID NO: 622270 - protein, 9 aa, Homo Sapiens
STSSASSSV

SEQ ID NO: 622271 - protein, 9 aa, Homo Sapiens
FQENLVEKQ

SEQ ID NO: 622272 - protein, 9 aa, Homo Sapiens
MTVRKECIT

SEQ ID NO: 622273 - protein, 9 aa, Homo Sapiens
ASCLKLWPG

SEQ ID NO: 622274 - protein, 9 aa, Homo Sapiens
REDAGSYNL

SEQ ID NO: 622275 - protein, 9 aa, Homo Sapiens
TPLKNIVKV

SEQ ID NO: 622276 - protein, 9 aa, Homo Sapiens
DSCHQQVLE

SEQ ID NO: 622277 - protein, 9 aa, Homo Sapiens
MFTEGREDE

SEQ ID NO: 622278 - protein, 9 aa, Homo Sapiens
ISAHRKPID

SEQ ID NO: 622279 - protein, 9 aa, Homo Sapiens
LEIARKLKL

SEQ ID NO: 622280 - protein, 9 aa, Homo Sapiens
NSASPCSLS

SEQ ID NO: 622281 - protein, 9 aa, Homo Sapiens
CLCCATKGG

SEQ ID NO: 622282 - protein, 9 aa, Homo Sapiens
LYKNSGCLT

SEQ ID NO: 622283 - protein, 9 aa, Homo Sapiens
VDVDCHQLL

SEQ ID NO: 622284 - protein, 9 aa, Homo Sapiens
KRRHRAGDT

SEQ ID NO: 622285 - protein, 9 aa, Homo Sapiens
SGCHNVKVI

SEQ ID NO: 622286 - protein, 9 aa, Homo Sapiens
SAAALTDSE

SEQ ID NO: 622287 - protein, 9 aa, Homo Sapiens
RKAVGGLIG

SEQ ID NO: 622288 - protein, 9 aa, Homo Sapiens
TVLRKGQCC

SEQ ID NO: 622289 - protein, 9 aa, Homo Sapiens
NRESFLQAL

SEQ ID NO: 622290 - protein, 9 aa, Homo Sapiens
PATRLWDSL

SEQ ID NO: 622291 - protein, 9 aa, Homo Sapiens
RKPLPMGII

SEQ ID NO: 622292 - protein, 9 aa, Homo Sapiens
DGMTCVDLD

SEQ ID NO: 622293 - protein, 9 aa, Homo Sapiens
NQCLLYKNS

SEQ ID NO: 622294 - protein, 9 aa, Homo Sapiens
EVALRPLTK

SEQ ID NO: 622295 - protein, 9 aa, Homo Sapiens
MWGDKDFTF

SEQ ID NO: 622296 - protein, 9 aa, Homo Sapiens
VVGFWMDPD

SEQ ID NO: 622297 - protein, 9 aa, Homo Sapiens
SYNLHIIKR

SEQ ID NO: 622298 - protein, 9 aa, Homo Sapiens
TAPGLRGRG

SEQ ID NO: 622299 - protein, 9 aa, Homo Sapiens
SIVGPSEAL

SEQ ID NO: 622300 - protein, 9 aa, Homo Sapiens
RTVLRKGQC

SEQ ID NO: 622301 - protein, 9 aa, Homo Sapiens
VSCERTVLR

SEQ ID NO: 622302 - protein, 9 aa, Homo Sapiens
IKNCICCNL

SEQ ID NO: 622303 - protein, 9 aa, Homo Sapiens
VSINACAHT

SEQ ID NO: 622304 - protein, 9 aa, Homo Sapiens
AALTDSEGE

SEQ ID NO: 622305 - protein, 9 aa, Homo Sapiens
CITAKYVDH

SEQ ID NO: 622306 - protein, 9 aa, Homo Sapiens
RCREALLLL

SEQ ID NO: 622307 - protein, 9 aa, Homo Sapiens
KMRALYDFE

SEQ ID NO: 622308 - protein, 9 aa, Homo Sapiens
DLPDSHVCC

SEQ ID NO: 622309 - protein, 9 aa, Homo Sapiens
WCRVLSIVG

SEQ ID NO: 622310 - protein, 9 aa, Homo Sapiens
CRWKKACQL

SEQ ID NO: 622311 - protein, 9 aa, Homo Sapiens
RRKRQLMHS

SEQ ID NO: 622312 - protein, 9 aa, Homo Sapiens
GKEPSRQQP

SEQ ID NO: 622313 - protein, 9 aa, Homo Sapiens
ALTDSEGES

SEQ ID NO: 622314 - protein, 9 aa, Homo Sapiens
LGKRSMFTE

SEQ ID NO: 622315 - protein, 9 aa, Homo Sapiens
KLWPGTTGP

SEQ ID NO: 622316 - protein, 9 aa, Homo Sapiens
QEHISWWGP

SEQ ID NO: 622317 - protein, 9 aa, Homo Sapiens
IDKIDAIAT

SEQ ID NO: 622318 - protein, 9 aa, Homo Sapiens
LLDSPSTPP

SEQ ID NO: 622319 - protein, 9 aa, Homo Sapiens
EDRALTPHE

SEQ ID NO: 622320 - protein, 9 aa, Homo Sapiens
IQRVLLELV

SEQ ID NO: 622321 - protein, 9 aa, Homo Sapiens
QGLLGKRSM

SEQ ID NO: 622322 - protein, 9 aa, Homo Sapiens
RKAGGEEQE

SEQ ID NO: 622323 - protein, 9 aa, Homo Sapiens
MPDPYKSAP

SEQ ID NO: 622324 - protein, 9 aa, Homo Sapiens
FAEQIVCVE

SEQ ID NO: 622325 - protein, 9 aa, Homo Sapiens
ADTVVVVEK

SEQ ID NO: 622326 - protein, 9 aa, Homo Sapiens
NSGCLTQMP

SEQ ID NO: 622327 - protein, 9 aa, Homo Sapiens
VARKMRALY

SEQ ID NO: 622328 - protein, 9 aa, Homo Sapiens
LRDCRSFHG

SEQ ID NO: 622329 - protein, 9 aa, Homo Sapiens
PASSKSGKD

SEQ ID NO: 622330 - protein, 9 aa, Homo Sapiens
YYKWSAECP

SEQ ID NO: 622331 - protein, 9 aa, Homo Sapiens
HKLLEFTSA

SEQ ID NO: 622332 - protein, 9 aa, Homo Sapiens
QSIPTTSTS

SEQ ID NO: 622333 - protein, 9 aa, Homo Sapiens
DEVALRPLT

SEQ ID NO: 622334 - protein, 9 aa, Homo Sapiens
SEEKAKQVR

SEQ ID NO: 622335 - protein, 9 aa, Homo Sapiens
NSVNFTVIR

SEQ ID NO: 622336 - protein, 9 aa, Homo Sapiens
VQWQLAQLE

SEQ ID NO: 622337 - protein, 9 aa, Homo Sapiens
TQDNQDRGT

SEQ ID NO: 622338 - protein, 9 aa, Homo Sapiens
GYCGIKAKR

SEQ ID NO: 622339 - protein, 9 aa, Homo Sapiens
VRTKPDKIR

SEQ ID NO: 622340 - protein, 9 aa, Homo Sapiens
CGYCGIKAK

SEQ ID NO: 622341 - protein, 9 aa, Homo Sapiens
LRKQVENKK

SEQ ID NO: 622342 - protein, 9 aa, Homo Sapiens
PLCSRPAPS

SEQ ID NO: 622343 - protein, 9 aa, Homo Sapiens
RSLSSCSAQ

SEQ ID NO: 622344 - protein, 9 aa, Homo Sapiens
SMWLWPTMP

SEQ ID NO: 622345 - protein, 9 aa, Homo Sapiens
ENFFTLVTE

SEQ ID NO: 622346 - protein, 9 aa, Homo Sapiens
KKGNKNSNK

SEQ ID NO: 622347 - protein, 9 aa, Homo Sapiens
RYGRRICSE

SEQ ID NO: 622348 - protein, 9 aa, Homo Sapiens
LFTHGHSST

SEQ ID NO: 622349 - protein, 9 aa, Homo Sapiens
SKLQSKVEI

SEQ ID NO: 622350 - protein, 9 aa, Homo Sapiens
KNYYKWSAE

SEQ ID NO: 622351 - protein, 9 aa, Homo Sapiens
YKNSGCLTQ

SEQ ID NO: 622352 - protein, 9 aa, Homo Sapiens
SGPYKSTLL

SEQ ID NO: 622353 - protein, 9 aa, Homo Sapiens
FLTPPSTPT

SEQ ID NO: 622354 - protein, 9 aa, Homo Sapiens
NDDADTVVV

SEQ ID NO: 622355 - protein, 9 aa, Homo Sapiens
DIRRQARKV

SEQ ID NO: 622356 - protein, 9 aa, Homo Sapiens
RNGTKVVPS

SEQ ID NO: 622357 - protein, 9 aa, Homo Sapiens
LLECVDVDK

SEQ ID NO: 622358 - protein, 9 aa, Homo Sapiens
SSSVGEKPS

SEQ ID NO: 622359 - protein, 9 aa, Homo Sapiens
FTHGHSSTA

SEQ ID NO: 622360 - protein, 9 aa, Homo Sapiens
KAGGEEQEC

SEQ ID NO: 622361 - protein, 9 aa, Homo Sapiens
VEDIQNIMK

SEQ ID NO: 622362 - protein, 9 aa, Homo Sapiens
SYSLIISIH

SEQ ID NO: 622363 - protein, 9 aa, Homo Sapiens
PYKCKECGM

SEQ ID NO: 622364 - protein, 9 aa, Homo Sapiens
IGRPALPSN

SEQ ID NO: 622365 - protein, 9 aa, Homo Sapiens
TNICSFMDR

SEQ ID NO: 622366 - protein, 9 aa, Homo Sapiens
QNCTMEIES

SEQ ID NO: 622367 - protein, 9 aa, Homo Sapiens
AHKPGIPLC

SEQ ID NO: 622368 - protein, 9 aa, Homo Sapiens
TILISKPER

SEQ ID NO: 622369 - protein, 9 aa, Homo Sapiens
DEPFLYLGK

SEQ ID NO: 622370 - protein, 9 aa, Homo Sapiens
DTKLGTFSL

SEQ ID NO: 622371 - protein, 9 aa, Homo Sapiens
DVEAPRPKL

SEQ ID NO: 622372 - protein, 9 aa, Homo Sapiens
AAIDLLHNV

SEQ ID NO: 622373 - protein, 9 aa, Homo Sapiens
NKLARPGSK

SEQ ID NO: 622374 - protein, 9 aa, Homo Sapiens
ILRQPPGQM

SEQ ID NO: 622375 - protein, 9 aa, Homo Sapiens
SVENFFTLV

SEQ ID NO: 622376 - protein, 9 aa, Homo Sapiens
SSCSAQPTD

SEQ ID NO: 622377 - protein, 9 aa, Homo Sapiens
LRDCVTYHT

SEQ ID NO: 622378 - protein, 9 aa, Homo Sapiens
SGEHQRTSR

SEQ ID NO: 622379 - protein, 9 aa, Homo Sapiens
QWQLAQLEA

SEQ ID NO: 622380 - protein, 9 aa, Homo Sapiens
INPISGEFN

SEQ ID NO: 622381 - protein, 9 aa, Homo Sapiens
QRVLLELVM

SEQ ID NO: 622382 - protein, 9 aa, Homo Sapiens
LKMQVDGER

SEQ ID NO: 622383 - protein, 9 aa, Homo Sapiens
QNVVDLFHA

SEQ ID NO: 622384 - protein, 9 aa, Homo Sapiens
PWTLWLPVN

SEQ ID NO: 622385 - protein, 9 aa, Homo Sapiens
LIFADTPYI

SEQ ID NO: 622386 - protein, 9 aa, Homo Sapiens
GRGGRAAVG

SEQ ID NO: 622387 - protein, 9 aa, Homo Sapiens
ISGEFNLRS

SEQ ID NO: 622388 - protein, 9 aa, Homo Sapiens
WQLAQLEAR

SEQ ID NO: 622389 - protein, 9 aa, Homo Sapiens
ESGGRQDLT

SEQ ID NO: 622390 - protein, 9 aa, Homo Sapiens
TPWTLWLPV

SEQ ID NO: 622391 - protein, 9 aa, Homo Sapiens
CVDVDKCLD

SEQ ID NO: 622392 - protein, 9 aa, Homo Sapiens
THQKIHAGE

SEQ ID NO: 622393 - protein, 9 aa, Homo Sapiens
TREDAGSYN

SEQ ID NO: 622394 - protein, 9 aa, Homo Sapiens
QLVRPFREY

SEQ ID NO: 622395 - protein, 9 aa, Homo Sapiens
VQLEVDIIQ

SEQ ID NO: 622396 - protein, 9 aa, Homo Sapiens
YCGIKAKRF

SEQ ID NO: 622397 - protein, 9 aa, Homo Sapiens
YKIGDDWGD

SEQ ID NO: 622398 - protein, 9 aa, Homo Sapiens
LDGELDLAS

SEQ ID NO: 622399 - protein, 9 aa, Homo Sapiens
DKIDAIATK

SEQ ID NO: 622400 - protein, 9 aa, Homo Sapiens
GTTGPWATT

SEQ ID NO: 622401 - protein, 9 aa, Homo Sapiens
ADTPYIPFR

SEQ ID NO: 622402 - protein, 9 aa, Homo Sapiens
CGIISGPYK

SEQ ID NO: 622403 - protein, 9 aa, Homo Sapiens
ITYSSDNTI

SEQ ID NO: 622404 - protein, 9 aa, Homo Sapiens
AEEILIKVI

SEQ ID NO: 622405 - protein, 9 aa, Homo Sapiens
CATKGGNEL

SEQ ID NO: 622406 - protein, 9 aa, Homo Sapiens
LLSQLVRPF

SEQ ID NO: 622407 - protein, 9 aa, Homo Sapiens
KLARPGSKN

SEQ ID NO: 622408 - protein, 9 aa, Homo Sapiens
RGRGGRAAV

SEQ ID NO: 622409 - protein, 9 aa, Homo Sapiens
RPALPSNWA

SEQ ID NO: 622410 - protein, 9 aa, Homo Sapiens
GNSASPCSL

SEQ ID NO: 622411 - protein, 9 aa, Homo Sapiens
LTGAKGAAC

SEQ ID NO: 622412 - protein, 9 aa, Homo Sapiens
VQGHSFRAS

SEQ ID NO: 622413 - protein, 9 aa, Homo Sapiens
LRSKRTPLR

SEQ ID NO: 622414 - protein, 9 aa, Homo Sapiens
DEMIHEAEN

SEQ ID NO: 622415 - protein, 9 aa, Homo Sapiens
VTDENGKIL

SEQ ID NO: 622416 - protein, 9 aa, Homo Sapiens
IARKLKLLM

SEQ ID NO: 622417 - protein, 9 aa, Homo Sapiens
YCCLNNRFR

SEQ ID NO: 622418 - protein, 9 aa, Homo Sapiens
ARPGSKNPN

SEQ ID NO: 622419 - protein, 9 aa, Homo Sapiens
AVQRAISSR

SEQ ID NO: 622420 - protein, 9 aa, Homo Sapiens
CHNVKVIDK

SEQ ID NO: 622421 - protein, 9 aa, Homo Sapiens
RVPRGGCRL

SEQ ID NO: 622422 - protein, 9 aa, Homo Sapiens
ASLKMQVDG

SEQ ID NO: 622423 - protein, 9 aa, Homo Sapiens
SHKLLEFTS

SEQ ID NO: 622424 - protein, 9 aa, Homo Sapiens
GGRQDLTYA

SEQ ID NO: 622425 - protein, 9 aa, Homo Sapiens
LRRKRQLMH

SEQ ID NO: 622426 - protein, 9 aa, Homo Sapiens
GQKWEPATR

SEQ ID NO: 622427 - protein, 9 aa, Homo Sapiens
LFEPDQLQE

SEQ ID NO: 622428 - protein, 9 aa, Homo Sapiens
YKSTLLKQY

SEQ ID NO: 622429 - protein, 9 aa, Homo Sapiens
SFFWLRGLL

SEQ ID NO: 622430 - protein, 9 aa, Homo Sapiens
EHLGNLLQP

SEQ ID NO: 622431 - protein, 9 aa, Homo Sapiens
LKNYYKWSA

SEQ ID NO: 622432 - protein, 9 aa, Homo Sapiens
SINDKEAVT

SEQ ID NO: 622433 - protein, 9 aa, Homo Sapiens
PAPSTWGLP

SEQ ID NO: 622434 - protein, 9 aa, Homo Sapiens
SSLCGYCGI

SEQ ID NO: 622435 - protein, 9 aa, Homo Sapiens
CPMSQRSFP

SEQ ID NO: 622436 - protein, 9 aa, Homo Sapiens
KVKKARERL

SEQ ID NO: 622437 - protein, 9 aa, Homo Sapiens
PGIPLCSRP

SEQ ID NO: 622438 - protein, 9 aa, Homo Sapiens
CRVLSIVGP

SEQ ID NO: 622439 - protein, 9 aa, Homo Sapiens
VAVLLNRKD

SEQ ID NO: 622440 - protein, 9 aa, Homo Sapiens
IGMLERYTD

SEQ ID NO: 622441 - protein, 9 aa, Homo Sapiens
FAWSHILLH

SEQ ID NO: 622442 - protein, 9 aa, Homo Sapiens
WSHILLHFP

SEQ ID NO: 622443 - protein, 9 aa, Homo Sapiens
LTAVGWGLA

SEQ ID NO: 622444 - protein, 9 aa, Homo Sapiens
LLEAGLALV

SEQ ID NO: 622445 - protein, 9 aa, Homo Sapiens
VKLRRRLCE

SEQ ID NO: 622446 - protein, 9 aa, Homo Sapiens
YVYKIGDDW

SEQ ID NO: 622447 - protein, 9 aa, Homo Sapiens
WVCDTPGSS

SEQ ID NO: 622448 - protein, 9 aa, Homo Sapiens
LLQPNAQQD

SEQ ID NO: 622449 - protein, 9 aa, Homo Sapiens
KATGQPCEQ

SEQ ID NO: 622450 - protein, 9 aa, Homo Sapiens
EVGDEVALR

SEQ ID NO: 622451 - protein, 9 aa, Homo Sapiens
PRGGCRLGG

SEQ ID NO: 622452 - protein, 9 aa, Homo Sapiens
KNLLLPEKG

SEQ ID NO: 622453 - protein, 9 aa, Homo Sapiens
GRQDLTYAL

SEQ ID NO: 622454 - protein, 9 aa, Homo Sapiens
KQVENKKKY

SEQ ID NO: 622455 - protein, 9 aa, Homo Sapiens
LSYSCEPTL

SEQ ID NO: 622456 - protein, 9 aa, Homo Sapiens
DGGQERPVS

SEQ ID NO: 622457 - protein, 9 aa, Homo Sapiens
ASTVVLPTV

SEQ ID NO: 622458 - protein, 9 aa, Homo Sapiens
PAFGELQNQ

SEQ ID NO: 622459 - protein, 9 aa, Homo Sapiens
DITMQCTKQ

SEQ ID NO: 622460 - protein, 9 aa, Homo Sapiens
NLEIARKLK

SEQ ID NO: 622461 - protein, 9 aa, Homo Sapiens
AHCRGPRAT

SEQ ID NO: 622462 - protein, 9 aa, Homo Sapiens
LFLPSVSDI

SEQ ID NO: 622463 - protein, 9 aa, Homo Sapiens
RICSEFSAG

SEQ ID NO: 622464 - protein, 9 aa, Homo Sapiens
FIDKIDAIA

SEQ ID NO: 622465 - protein, 9 aa, Homo Sapiens
LTQDNQDRG

SEQ ID NO: 622466 - protein, 9 aa, Homo Sapiens
RVTREKPGQ

SEQ ID NO: 622467 - protein, 9 aa, Homo Sapiens
IISAHRKPI

SEQ ID NO: 622468 - protein, 9 aa, Homo Sapiens
LNKKGNKNS

SEQ ID NO: 622469 - protein, 9 aa, Homo Sapiens
GFGQGKKLI

SEQ ID NO: 622470 - protein, 9 aa, Homo Sapiens
HFFDARGAH

SEQ ID NO: 622471 - protein, 9 aa, Homo Sapiens
SLFEVQWQL

SEQ ID NO: 622472 - protein, 9 aa, Homo Sapiens
LLKEMREIP

SEQ ID NO: 622473 - protein, 9 aa, Homo Sapiens
SASSSVGEK

SEQ ID NO: 622474 - protein, 9 aa, Homo Sapiens
FRASATESV

SEQ ID NO: 622475 - protein, 9 aa, Homo Sapiens
LRVYEGFGQ

SEQ ID NO: 622476 - protein, 9 aa, Homo Sapiens
ACLPGVAGA

SEQ ID NO: 622477 - protein, 9 aa, Homo Sapiens
IRKRKTAAL

SEQ ID NO: 622478 - protein, 9 aa, Homo Sapiens
QGKKLIASF

SEQ ID NO: 622479 - protein, 9 aa, Homo Sapiens
RLSAVKAIA

SEQ ID NO: 622480 - protein, 9 aa, Homo Sapiens
LKAAIKYLL

SEQ ID NO: 622481 - protein, 9 aa, Homo Sapiens
PKTGVIRTS

SEQ ID NO: 622482 - protein, 9 aa, Homo Sapiens
PGATEMEGS

SEQ ID NO: 622483 - protein, 9 aa, Homo Sapiens
AVTSTLVTT

SEQ ID NO: 622484 - protein, 9 aa, Homo Sapiens
HAGEKPYQC

SEQ ID NO: 622485 - protein, 9 aa, Homo Sapiens
SLHQDGGQE

SEQ ID NO: 622486 - protein, 9 aa, Homo Sapiens
PDILVGENV

SEQ ID NO: 622487 - protein, 9 aa, Homo Sapiens
YKWSAECPE

SEQ ID NO: 622488 - protein, 9 aa, Homo Sapiens
CKILKTVTC

SEQ ID NO: 622489 - protein, 9 aa, Homo Sapiens
IYVYKIGDD

SEQ ID NO: 622490 - protein, 9 aa, Homo Sapiens
KIDQAAIDL

SEQ ID NO: 622491 - protein, 9 aa, Homo Sapiens
SDEDSDLNF

SEQ ID NO: 622492 - protein, 9 aa, Homo Sapiens
LRGRGGRAA

SEQ ID NO: 622493 - protein, 9 aa, Homo Sapiens
PLNPTIKYQ

SEQ ID NO: 622494 - protein, 9 aa, Homo Sapiens
FSRNSPGNK

SEQ ID NO: 622495 - protein, 9 aa, Homo Sapiens
VLTAVGWGL

SEQ ID NO: 622496 - protein, 9 aa, Homo Sapiens
NMYQQLSYP

SEQ ID NO: 622497 - protein, 9 aa, Homo Sapiens
WPTMPSASC

SEQ ID NO: 622498 - protein, 9 aa, Homo Sapiens
KIFSRNSPG

SEQ ID NO: 622499 - protein, 9 aa, Homo Sapiens
YLLIFPQSL

SEQ ID NO: 622500 - protein, 9 aa, Homo Sapiens
STPGDYLGK

SEQ ID NO: 622501 - protein, 9 aa, Homo Sapiens
ASTSQAQVM

SEQ ID NO: 622502 - protein, 9 aa, Homo Sapiens
VQRAISSRV

SEQ ID NO: 622503 - protein, 9 aa, Homo Sapiens
QLIPLCILM

SEQ ID NO: 622504 - protein, 9 aa, Homo Sapiens
MEFEIEPHK

SEQ ID NO: 622505 - protein, 9 aa, Homo Sapiens
SQICHLIKH

SEQ ID NO: 622506 - protein, 9 aa, Homo Sapiens
TSVPDLDRE

SEQ ID NO: 622507 - protein, 9 aa, Homo Sapiens
GGCRLGGRL

SEQ ID NO: 622508 - protein, 9 aa, Homo Sapiens
MRSGTLVGS

SEQ ID NO: 622509 - protein, 9 aa, Homo Sapiens
LQSKVEIAE

SEQ ID NO: 622510 - protein, 9 aa, Homo Sapiens
EFNLRSPLD

SEQ ID NO: 622511 - protein, 9 aa, Homo Sapiens
WEPATRLWD

SEQ ID NO: 622512 - protein, 9 aa, Homo Sapiens
IRNLHCRPQ

SEQ ID NO: 622513 - protein, 9 aa, Homo Sapiens
SSKSGKDFS

SEQ ID NO: 622514 - protein, 9 aa, Homo Sapiens
ICCNLSVSK

SEQ ID NO: 622515 - protein, 9 aa, Homo Sapiens
KNYIFFTGP

SEQ ID NO: 622516 - protein, 9 aa, Homo Sapiens
MEIESYGYT

SEQ ID NO: 622517 - protein, 9 aa, Homo Sapiens
FSSLAGISD

SEQ ID NO: 622518 - protein, 9 aa, Homo Sapiens
LKGHEAARV

SEQ ID NO: 622519 - protein, 9 aa, Homo Sapiens
ASTPGATEM

SEQ ID NO: 622520 - protein, 9 aa, Homo Sapiens
DEERDTLLH

SEQ ID NO: 622521 - protein, 9 aa, Homo Sapiens
SVKTSSYSL

SEQ ID NO: 622522 - protein, 9 aa, Homo Sapiens
STWGLPMWR

SEQ ID NO: 622523 - protein, 9 aa, Homo Sapiens
VPRGGCRLG

SEQ ID NO: 622524 - protein, 9 aa, Homo Sapiens
EDVRLAQQH

SEQ ID NO: 622525 - protein, 9 aa, Homo Sapiens
GHEAARVLP

SEQ ID NO: 622526 - protein, 9 aa, Homo Sapiens
DVAVLLNRK

SEQ ID NO: 622527 - protein, 9 aa, Homo Sapiens
ANKLARPGS

SEQ ID NO: 622528 - protein, 9 aa, Homo Sapiens
ECLKIFSRN

SEQ ID NO: 622529 - protein, 9 aa, Homo Sapiens
MPPCGWPAC

SEQ ID NO: 622530 - protein, 9 aa, Homo Sapiens
LLIFPQSLV

SEQ ID NO: 622531 - protein, 9 aa, Homo Sapiens
LEHLHRDEQ

SEQ ID NO: 622532 - protein, 9 aa, Homo Sapiens
IESIRSTEG

SEQ ID NO: 622533 - protein, 9 aa, Homo Sapiens
TPMHWLKDR

SEQ ID NO: 622534 - protein, 9 aa, Homo Sapiens
SVPDLDRES

SEQ ID NO: 622535 - protein, 9 aa, Homo Sapiens
LLLALNLLA

SEQ ID NO: 622536 - protein, 9 aa, Homo Sapiens
VGGLIGRKG

SEQ ID NO: 622537 - protein, 9 aa, Homo Sapiens
FYASTVVLP

SEQ ID NO: 622538 - protein, 9 aa, Homo Sapiens
HLHRDEQAQ

SEQ ID NO: 622539 - protein, 9 aa, Homo Sapiens
GAACLPGVA

SEQ ID NO: 622540 - protein, 9 aa, Homo Sapiens
ITGSWIIVS

SEQ ID NO: 622541 - protein, 9 aa, Homo Sapiens
ENFVEKIRF

SEQ ID NO: 622542 - protein, 9 aa, Homo Sapiens
TGPWATTSH

SEQ ID NO: 622543 - protein, 9 aa, Homo Sapiens
RTPLRRKRQ

SEQ ID NO: 622544 - protein, 9 aa, Homo Sapiens
STPGATEME

SEQ ID NO: 622545 - protein, 9 aa, Homo Sapiens
KGSLLYHLA

SEQ ID NO: 622546 - protein, 9 aa, Homo Sapiens
GMLERYTDK

SEQ ID NO: 622547 - protein, 9 aa, Homo Sapiens
TKLGTFSLR

SEQ ID NO: 622548 - protein, 9 aa, Homo Sapiens
YKSAPAPKK

SEQ ID NO: 622549 - protein, 9 aa, Homo Sapiens
AGGGSWAVT

SEQ ID NO: 622550 - protein, 9 aa, Homo Sapiens
QERNVQLEV

SEQ ID NO: 622551 - protein, 9 aa, Homo Sapiens
FQETQRLEL

SEQ ID NO: 622552 - protein, 9 aa, Homo Sapiens
IVGPSEALQ

SEQ ID NO: 622553 - protein, 9 aa, Homo Sapiens
RVLDGTPCR

SEQ ID NO: 622554 - protein, 9 aa, Homo Sapiens
QLSILLRDN

SEQ ID NO: 622555 - protein, 9 aa, Homo Sapiens
FITYSSDNT

SEQ ID NO: 622556 - protein, 9 aa, Homo Sapiens
GGQERPVSL

SEQ ID NO: 622557 - protein, 9 aa, Homo Sapiens
TGSWIIVSI

SEQ ID NO: 622558 - protein, 9 aa, Homo Sapiens
CLLYKNSGC

SEQ ID NO: 622559 - protein, 9 aa, Homo Sapiens
GRMFVLIWD

SEQ ID NO: 622560 - protein, 9 aa, Homo Sapiens
VDEPFLYLG

SEQ ID NO: 622561 - protein, 9 aa, Homo Sapiens
IYWSFKTRS

SEQ ID NO: 622562 - protein, 9 aa, Homo Sapiens
KIGDDWGDK

SEQ ID NO: 622563 - protein, 9 aa, Homo Sapiens
HNQPSTGGS

SEQ ID NO: 622564 - protein, 9 aa, Homo Sapiens
SFEQFDVSA

SEQ ID NO: 622565 - protein, 9 aa, Homo Sapiens
VTSDQSGGG

SEQ ID NO: 622566 - protein, 9 aa, Homo Sapiens
PEEIKYILK

SEQ ID NO: 622567 - protein, 9 aa, Homo Sapiens
VEIAESRVS

SEQ ID NO: 622568 - protein, 9 aa, Homo Sapiens
DADTVVVVE

SEQ ID NO: 622569 - protein, 9 aa, Homo Sapiens
PHSEPGAPA

SEQ ID NO: 622570 - protein, 9 aa, Homo Sapiens
APGLRGRGG

SEQ ID NO: 622571 - protein, 9 aa, Homo Sapiens
AKAQLRKFT

SEQ ID NO: 622572 - protein, 9 aa, Homo Sapiens
LLELVMKNI

SEQ ID NO: 622573 - protein, 9 aa, Homo Sapiens
SRVQEAAAA

SEQ ID NO: 622574 - protein, 9 aa, Homo Sapiens
QVILGKRTD

SEQ ID NO: 622575 - protein, 9 aa, Homo Sapiens
KKACQLFLD

SEQ ID NO: 622576 - protein, 9 aa, Homo Sapiens
HPRLFTHGH

SEQ ID NO: 622577 - protein, 9 aa, Homo Sapiens
PRYGRRICS

SEQ ID NO: 622578 - protein, 9 aa, Homo Sapiens
KHWTSTHRK

SEQ ID NO: 622579 - protein, 9 aa, Homo Sapiens
VLTALSYLH

SEQ ID NO: 622580 - protein, 9 aa, Homo Sapiens
EPATRLWDS

SEQ ID NO: 622581 - protein, 9 aa, Homo Sapiens
RDTLLHLFA

SEQ ID NO: 622582 - protein, 9 aa, Homo Sapiens
GDDWGDKKV

SEQ ID NO: 622583 - protein, 9 aa, Homo Sapiens
FCYVPAVMA

SEQ ID NO: 622584 - protein, 9 aa, Homo Sapiens
ERDTLLHLF

SEQ ID NO: 622585 - protein, 9 aa, Homo Sapiens
AITLFPQRS

SEQ ID NO: 622586 - protein, 9 aa, Homo Sapiens
FTLVTEGAL

SEQ ID NO: 622587 - protein, 9 aa, Homo Sapiens
SGKLDIVCT

SEQ ID NO: 622588 - protein, 9 aa, Homo Sapiens
TLWLPVNVT

SEQ ID NO: 622589 - protein, 9 aa, Homo Sapiens
QIFQETQRL

SEQ ID NO: 622590 - protein, 9 aa, Homo Sapiens
AESKQSDLR

SEQ ID NO: 622591 - protein, 9 aa, Homo Sapiens
TGAKGAACL

SEQ ID NO: 622592 - protein, 9 aa, Homo Sapiens
ATNVSMWLW

SEQ ID NO: 622593 - protein, 9 aa, Homo Sapiens
CTSQWSWKV

SEQ ID NO: 622594 - protein, 9 aa, Homo Sapiens
YKCKECGMA

SEQ ID NO: 622595 - protein, 9 aa, Homo Sapiens
DRMREQPIY

SEQ ID NO: 622596 - protein, 9 aa, Homo Sapiens
TNSTLPGAD

SEQ ID NO: 622597 - protein, 9 aa, Homo Sapiens
HKECKTLSP

SEQ ID NO: 622598 - protein, 9 aa, Homo Sapiens
EDIQNIMKT

SEQ ID NO: 622599 - protein, 9 aa, Homo Sapiens
MFVLIWDMC

SEQ ID NO: 622600 - protein, 9 aa, Homo Sapiens
LRPSVENFF

SEQ ID NO: 622601 - protein, 9 aa, Homo Sapiens
APRPKLDGA

SEQ ID NO: 622602 - protein, 9 aa, Homo Sapiens
RIILVGQTG

SEQ ID NO: 622603 - protein, 9 aa, Homo Sapiens
DEPFLQFQR

SEQ ID NO: 622604 - protein, 9 aa, Homo Sapiens
ACRKNDDAD

SEQ ID NO: 622605 - protein, 9 aa, Homo Sapiens
AESLVNRRQ

SEQ ID NO: 622606 - protein, 9 aa, Homo Sapiens
LGTQPEALS

SEQ ID NO: 622607 - protein, 9 aa, Homo Sapiens
PSASCLKLW

SEQ ID NO: 622608 - protein, 9 aa, Homo Sapiens
LESGGRQDL

SEQ ID NO: 622609 - protein, 9 aa, Homo Sapiens
ENLTQDNQD

SEQ ID NO: 622610 - protein, 9 aa, Homo Sapiens
ALSQTGFSY

SEQ ID NO: 622611 - protein, 9 aa, Homo Sapiens
GNKNSNKFK

SEQ ID NO: 622612 - protein, 9 aa, Homo Sapiens
REMGINSTG

SEQ ID NO: 622613 - protein, 9 aa, Homo Sapiens
LASLKMQVD

SEQ ID NO: 622614 - protein, 9 aa, Homo Sapiens
IIVICSTRQ

SEQ ID NO: 622615 - protein, 9 aa, Homo Sapiens
QLSQGDGGS

SEQ ID NO: 622616 - protein, 9 aa, Homo Sapiens
FQNLVMAHR

SEQ ID NO: 622617 - protein, 9 aa, Homo Sapiens
TDLPDSHVC

SEQ ID NO: 622618 - protein, 9 aa, Homo Sapiens
TMEIESYGY

SEQ ID NO: 622619 - protein, 9 aa, Homo Sapiens
SRPAPSTWG

SEQ ID NO: 622620 - protein, 9 aa, Homo Sapiens
YMCQPGYTV

SEQ ID NO: 622621 - protein, 9 aa, Homo Sapiens
KLDIVCTEL

SEQ ID NO: 622622 - protein, 9 aa, Homo Sapiens
IVCTELSPS

SEQ ID NO: 622623 - protein, 9 aa, Homo Sapiens
RVLLELVMK

SEQ ID NO: 622624 - protein, 9 aa, Homo Sapiens
ARGAHSDEN

SEQ ID NO: 622625 - protein, 9 aa, Homo Sapiens
IIPEDDAVY

SEQ ID NO: 622626 - protein, 9 aa, Homo Sapiens
GPHAPVPCL

SEQ ID NO: 622627 - protein, 9 aa, Homo Sapiens
CSEFSAGSI

SEQ ID NO: 622628 - protein, 9 aa, Homo Sapiens
IKTNLEIAR

SEQ ID NO: 622629 - protein, 9 aa, Homo Sapiens
TNVSMWLWP

SEQ ID NO: 622630 - protein, 9 aa, Homo Sapiens
WRKAVGGLI

SEQ ID NO: 622631 - protein, 9 aa, Homo Sapiens
SRTVGPNPE

SEQ ID NO: 622632 - protein, 9 aa, Homo Sapiens
GNRESFLQA

SEQ ID NO: 622633 - protein, 9 aa, Homo Sapiens
SLASLKMQV

SEQ ID NO: 622634 - protein, 9 aa, Homo Sapiens
YKFKECGKA

SEQ ID NO: 622635 - protein, 9 aa, Homo Sapiens
TSLQDSGQS

SEQ ID NO: 622636 - protein, 9 aa, Homo Sapiens
IRSAITLFP

SEQ ID NO: 622637 - protein, 9 aa, Homo Sapiens
AYVQVAKAL

SEQ ID NO: 622638 - protein, 9 aa, Homo Sapiens
ADIRRQARK

SEQ ID NO: 622639 - protein, 9 aa, Homo Sapiens
DPKEGKRKY

SEQ ID NO: 622640 - protein, 9 aa, Homo Sapiens
LWCRVLSIV

SEQ ID NO: 622641 - protein, 9 aa, Homo Sapiens
APLGVLTAV

SEQ ID NO: 622642 - protein, 9 aa, Homo Sapiens
RNQCLLYKN

SEQ ID NO: 622643 - protein, 9 aa, Homo Sapiens
MTCVDLDEC

SEQ ID NO: 622644 - protein, 9 aa, Homo Sapiens
GGRAAVGQE

SEQ ID NO: 622645 - protein, 9 aa, Homo Sapiens
TKVVPSFRP

SEQ ID NO: 622646 - protein, 9 aa, Homo Sapiens
LKTVTCWTD

SEQ ID NO: 622647 - protein, 9 aa, Homo Sapiens
NTVNKIDQA

SEQ ID NO: 622648 - protein, 9 aa, Homo Sapiens
QCASTPGAT

SEQ ID NO: 622649 - protein, 9 aa, Homo Sapiens
CLKIFSRNS

SEQ ID NO: 622650 - protein, 9 aa, Homo Sapiens
LQSIPTTST

SEQ ID NO: 622651 - protein, 9 aa, Homo Sapiens
TARTVVGFW

SEQ ID NO: 622652 - protein, 9 aa, Homo Sapiens
LWPGTTGPW

SEQ ID NO: 622653 - protein, 9 aa, Homo Sapiens
KYILKFQEK

SEQ ID NO: 622654 - protein, 9 aa, Homo Sapiens
RAHAGSYSC

SEQ ID NO: 622655 - protein, 9 aa, Homo Sapiens
QSLRAMLEN

SEQ ID NO: 622656 - protein, 9 aa, Homo Sapiens
RQDLTYALR

SEQ ID NO: 622657 - protein, 9 aa, Homo Sapiens
EMGINSTGK

SEQ ID NO: 622658 - protein, 9 aa, Homo Sapiens
HLFHNSCLP

SEQ ID NO: 622659 - protein, 9 aa, Homo Sapiens
TVPSASCPS

SEQ ID NO: 622660 - protein, 9 aa, Homo Sapiens
GVFNYLAKL

SEQ ID NO: 622661 - protein, 9 aa, Homo Sapiens
EQIVCVELH

SEQ ID NO: 622662 - protein, 9 aa, Homo Sapiens
FFDARGAHS

SEQ ID NO: 622663 - protein, 9 aa, Homo Sapiens
SADDLSHKL

SEQ ID NO: 622664 - protein, 9 aa, Homo Sapiens
DVRLAQQHL

SEQ ID NO: 622665 - protein, 9 aa, Homo Sapiens
IVLCPTYFK

SEQ ID NO: 622666 - protein, 9 aa, Homo Sapiens
AVTSDQSGG

SEQ ID NO: 622667 - protein, 9 aa, Homo Sapiens
MWLWINNSP

SEQ ID NO: 622668 - protein, 9 aa, Homo Sapiens
DHLHRGELF

SEQ ID NO: 622669 - protein, 9 aa, Homo Sapiens
LLPFFLLST

SEQ ID NO: 622670 - protein, 9 aa, Homo Sapiens
KLFEPDQLQ

SEQ ID NO: 622671 - protein, 9 aa, Homo Sapiens
HDVAVLLNR

SEQ ID NO: 622672 - protein, 9 aa, Homo Sapiens
SPSGKEPSR

SEQ ID NO: 622673 - protein, 9 aa, Homo Sapiens
AQVVKGFPI

SEQ ID NO: 622674 - protein, 9 aa, Homo Sapiens
ANFAEQIVC

SEQ ID NO: 622675 - protein, 9 aa, Homo Sapiens
GNIRSAITL

SEQ ID NO: 622676 - protein, 9 aa, Homo Sapiens
SKPERSYLE

SEQ ID NO: 622677 - protein, 9 aa, Homo Sapiens
HTQEETNFK

SEQ ID NO: 622678 - protein, 9 aa, Homo Sapiens
EAGLALVLF

SEQ ID NO: 622679 - protein, 9 aa, Homo Sapiens
QIIPEDDAV

SEQ ID NO: 622680 - protein, 9 aa, Homo Sapiens
SVSCERTVL

SEQ ID NO: 622681 - protein, 9 aa, Homo Sapiens
CRSFHGPYT

SEQ ID NO: 622682 - protein, 9 aa, Homo Sapiens
VVDGLRDCR

SEQ ID NO: 622683 - protein, 9 aa, Homo Sapiens
AQEHISWWG

SEQ ID NO: 622684 - protein, 9 aa, Homo Sapiens
RSMFTEGRE

SEQ ID NO: 622685 - protein, 9 aa, Homo Sapiens
AQQGQGVHA

SEQ ID NO: 622686 - protein, 9 aa, Homo Sapiens
EERDTLLHL

SEQ ID NO: 622687 - protein, 9 aa, Homo Sapiens
VDKCLDESN

SEQ ID NO: 622688 - protein, 9 aa, Homo Sapiens
AFASQPEAA

SEQ ID NO: 622689 - protein, 9 aa, Homo Sapiens
LEDVRLAQQ

SEQ ID NO: 622690 - protein, 9 aa, Homo Sapiens
KLGTFSLRK

SEQ ID NO: 622691 - protein, 9 aa, Homo Sapiens
MALSGCHNV

SEQ ID NO: 622692 - protein, 9 aa, Homo Sapiens
SVGEKPSAF

SEQ ID NO: 622693 - protein, 9 aa, Homo Sapiens
GTPMHWLKD

SEQ ID NO: 622694 - protein, 9 aa, Homo Sapiens
GLPGFPGRD

SEQ ID NO: 622695 - protein, 9 aa, Homo Sapiens
FLSQAGPCV

SEQ ID NO: 622696 - protein, 9 aa, Homo Sapiens
LRDNYSLLS

SEQ ID NO: 622697 - protein, 9 aa, Homo Sapiens
HNVKVIDKT

SEQ ID NO: 622698 - protein, 9 aa, Homo Sapiens
GEFNLRSPL

SEQ ID NO: 622699 - protein, 9 aa, Homo Sapiens
LLASWLVCL

SEQ ID NO: 622700 - protein, 9 aa, Homo Sapiens
GLDLDRPKG

SEQ ID NO: 622701 - protein, 9 aa, Homo Sapiens
PGAPAFGEL

SEQ ID NO: 622702 - protein, 9 aa, Homo Sapiens
ECVDVDKCL

SEQ ID NO: 622703 - protein, 9 aa, Homo Sapiens
CCNLSVSKL

SEQ ID NO: 622704 - protein, 9 aa, Homo Sapiens
SWKVTSPSG

SEQ ID NO: 622705 - protein, 9 aa, Homo Sapiens
SPCSLSLGR

SEQ ID NO: 622706 - protein, 9 aa, Homo Sapiens
IIYCCLNNR

SEQ ID NO: 622707 - protein, 9 aa, Homo Sapiens
EQNCTMEIE

SEQ ID NO: 622708 - protein, 9 aa, Homo Sapiens
KNKDITMQC

SEQ ID NO: 622709 - protein, 9 aa, Homo Sapiens
RRICSEFSA

SEQ ID NO: 622710 - protein, 9 aa, Homo Sapiens
LCKPPTPGG

SEQ ID NO: 622711 - protein, 9 aa, Homo Sapiens
IEVNQGSLC

SEQ ID NO: 622712 - protein, 9 aa, Homo Sapiens
CYTNRTFEF

SEQ ID NO: 622713 - protein, 9 aa, Homo Sapiens
KFWRKAVGG

SEQ ID NO: 622714 - protein, 9 aa, Homo Sapiens
YVPAVMALS

SEQ ID NO: 622715 - protein, 9 aa, Homo Sapiens
PCRPYETDL

SEQ ID NO: 622716 - protein, 9 aa, Homo Sapiens
STLVTTYAQ

SEQ ID NO: 622717 - protein, 9 aa, Homo Sapiens
HVLARLLTH

SEQ ID NO: 622718 - protein, 9 aa, Homo Sapiens
AFSRVLRAH

SEQ ID NO: 622719 - protein, 9 aa, Homo Sapiens
PRLFTHGHS

SEQ ID NO: 622720 - protein, 9 aa, Homo Sapiens
SKNLMRSGT

SEQ ID NO: 622721 - protein, 9 aa, Homo Sapiens
SGGRQDLTY

SEQ ID NO: 622722 - protein, 9 aa, Homo Sapiens
TSTLVTTYA

SEQ ID NO: 622723 - protein, 9 aa, Homo Sapiens
IRDMFVRCI

SEQ ID NO: 622724 - protein, 9 aa, Homo Sapiens
CSPPSPDTP

SEQ ID NO: 622725 - protein, 9 aa, Homo Sapiens
NAAGKNYIF

SEQ ID NO: 622726 - protein, 9 aa, Homo Sapiens
KPLNPTIKY

SEQ ID NO: 622727 - protein, 9 aa, Homo Sapiens
GKRSMFTEG

SEQ ID NO: 622728 - protein, 9 aa, Homo Sapiens
ALLEAGLAL

SEQ ID NO: 622729 - protein, 9 aa, Homo Sapiens
TSQAQVMLL

SEQ ID NO: 622730 - protein, 9 aa, Homo Sapiens
AWIAEQHGY

SEQ ID NO: 622731 - protein, 9 aa, Homo Sapiens
KAIANAISV

SEQ ID NO: 622732 - protein, 9 aa, Homo Sapiens
TPSSSLKGF

SEQ ID NO: 622733 - protein, 9 aa, Homo Sapiens
RGLEQALRF

SEQ ID NO: 622734 - protein, 9 aa, Homo Sapiens
SEDMWGDKD

SEQ ID NO: 622735 - protein, 9 aa, Homo Sapiens
EPFLYLGKS

SEQ ID NO: 622736 - protein, 9 aa, Homo Sapiens
CNLSVSKLS

SEQ ID NO: 622737 - protein, 9 aa, Homo Sapiens
VAEEILIKV

SEQ ID NO: 622738 - protein, 9 aa, Homo Sapiens
TNLKGSLLY

SEQ ID NO: 622739 - protein, 9 aa, Homo Sapiens
SAQQGQGVH

SEQ ID NO: 622740 - protein, 9 aa, Homo Sapiens
PSVSCERTV

SEQ ID NO: 622741 - protein, 9 aa, Homo Sapiens
IFQETQRLE

SEQ ID NO: 622742 - protein, 9 aa, Homo Sapiens
KTKDNVEDI

SEQ ID NO: 622743 - protein, 9 aa, Homo Sapiens
QPSTGGSTT

SEQ ID NO: 622744 - protein, 9 aa, Homo Sapiens
DSDLNFDIS

SEQ ID NO: 622745 - protein, 9 aa, Homo Sapiens
TPCRPYETD

SEQ ID NO: 622746 - protein, 9 aa, Homo Sapiens
KIDAIATKR

SEQ ID NO: 622747 - protein, 9 aa, Homo Sapiens
RDCVTYHTE

SEQ ID NO: 622748 - protein, 9 aa, Homo Sapiens
LWRSCLQEE

SEQ ID NO: 622749 - protein, 9 aa, Homo Sapiens
VHHASPAGT

SEQ ID NO: 622750 - protein, 9 aa, Homo Sapiens
YGRRICSEF

SEQ ID NO: 622751 - protein, 9 aa, Homo Sapiens
GQGKKLIAS

SEQ ID NO: 622752 - protein, 9 aa, Homo Sapiens
ITNLKGSLL

SEQ ID NO: 622753 - protein, 9 aa, Homo Sapiens
IELAYVQVA

SEQ ID NO: 622754 - protein, 9 aa, Homo Sapiens
EMEFEIEPH

SEQ ID NO: 622755 - protein, 9 aa, Homo Sapiens
PSFRPDFVL

SEQ ID NO: 622756 - protein, 9 aa, Homo Sapiens
NLYKFKECG

SEQ ID NO: 622757 - protein, 9 aa, Homo Sapiens
GSFEQFDVS

SEQ ID NO: 622758 - protein, 9 aa, Homo Sapiens
PEALSYSCE

SEQ ID NO: 622759 - protein, 9 aa, Homo Sapiens
TNVDQIFQE

SEQ ID NO: 622760 - protein, 9 aa, Homo Sapiens
GTQPEALSY

SEQ ID NO: 622761 - protein, 9 aa, Homo Sapiens
NIRSAITLF

SEQ ID NO: 622762 - protein, 9 aa, Homo Sapiens
WRLGTQPEA

SEQ ID NO: 622763 - protein, 9 aa, Homo Sapiens
VSMWLWPTM

SEQ ID NO: 622764 - protein, 9 aa, Homo Sapiens
HGHSSTALH

SEQ ID NO: 622765 - protein, 9 aa, Homo Sapiens
DKIRNLHCR

SEQ ID NO: 622766 - protein, 9 aa, Homo Sapiens
VMKNIQDVL

SEQ ID NO: 622767 - protein, 9 aa, Homo Sapiens
RAMLENVTL

SEQ ID NO: 622768 - protein, 9 aa, Homo Sapiens
KTGVIRTSV

SEQ ID NO: 622769 - protein, 9 aa, Homo Sapiens
MDSIVLCPT

SEQ ID NO: 622770 - protein, 9 aa, Homo Sapiens
QDLTYALRC

SEQ ID NO: 622771 - protein, 9 aa, Homo Sapiens
KRAKLEKWT

SEQ ID NO: 622772 - protein, 9 aa, Homo Sapiens
EHQRTSRSG

SEQ ID NO: 622773 - protein, 9 aa, Homo Sapiens
CLKLWPGTT

SEQ ID NO: 622774 - protein, 9 aa, Homo Sapiens
VNKIDQAAI

SEQ ID NO: 622775 - protein, 9 aa, Homo Sapiens
TATDKDDFA

SEQ ID NO: 622776 - protein, 9 aa, Homo Sapiens
TSTHRKADF

SEQ ID NO: 622777 - protein, 9 aa, Homo Sapiens
SLRAMLENV

SEQ ID NO: 622778 - protein, 9 aa, Homo Sapiens
CSRPAPSTW

SEQ ID NO: 622779 - protein, 9 aa, Homo Sapiens
QLWQAERAA

SEQ ID NO: 622780 - protein, 9 aa, Homo Sapiens
GQPCEQYAK

SEQ ID NO: 622781 - protein, 9 aa, Homo Sapiens
WDMCISVKE

SEQ ID NO: 622782 - protein, 9 aa, Homo Sapiens
QPGYTVELN

SEQ ID NO: 622783 - protein, 9 aa, Homo Sapiens
GKLDIVCTE

SEQ ID NO: 622784 - protein, 9 aa, Homo Sapiens
HAGSYSCQA

SEQ ID NO: 622785 - protein, 9 aa, Homo Sapiens
QPVLLKEMR

SEQ ID NO: 622786 - protein, 9 aa, Homo Sapiens
GAFTVCLLP

SEQ ID NO: 622787 - protein, 9 aa, Homo Sapiens
LVDEPFLYL

SEQ ID NO: 622788 - protein, 9 aa, Homo Sapiens
TAVGWGLAI

SEQ ID NO: 622789 - protein, 9 aa, Homo Sapiens
IFADTPYIP

SEQ ID NO: 622790 - protein, 9 aa, Homo Sapiens
TGENLYKFK

SEQ ID NO: 622791 - protein, 9 aa, Homo Sapiens
AGEVAEEVL

SEQ ID NO: 622792 - protein, 9 aa, Homo Sapiens
AFTVCLLPF

SEQ ID NO: 622793 - protein, 9 aa, Homo Sapiens
ISLLEKNLL

SEQ ID NO: 622794 - protein, 9 aa, Homo Sapiens
IPLCILMAA

SEQ ID NO: 622795 - protein, 9 aa, Homo Sapiens
AENFVEKIR

SEQ ID NO: 622796 - protein, 9 aa, Homo Sapiens
VCDTPGSSI

SEQ ID NO: 622797 - protein, 9 aa, Homo Sapiens
GLQERNVQL

SEQ ID NO: 622798 - protein, 9 aa, Homo Sapiens
AEAALSQTG

SEQ ID NO: 622799 - protein, 9 aa, Homo Sapiens
GKNYIFFTG

SEQ ID NO: 622800 - protein, 9 aa, Homo Sapiens
TTRVHHASP

SEQ ID NO: 622801 - protein, 9 aa, Homo Sapiens
HFPAKESMW

SEQ ID NO: 622802 - protein, 9 aa, Homo Sapiens
FTGDGMTCV

SEQ ID NO: 622803 - protein, 9 aa, Homo Sapiens
PFSSLAGIS

SEQ ID NO: 622804 - protein, 9 aa, Homo Sapiens
LYKFKECGK

SEQ ID NO: 622805 - protein, 9 aa, Homo Sapiens
LDEQNCTME

SEQ ID NO: 622806 - protein, 9 aa, Homo Sapiens
SANVVCAWI

SEQ ID NO: 622807 - protein, 9 aa, Homo Sapiens
CLQEERLLG

SEQ ID NO: 622808 - protein, 9 aa, Homo Sapiens
MLLLALNLL

SEQ ID NO: 622809 - protein, 9 aa, Homo Sapiens
KIRNLHCRP

SEQ ID NO: 622810 - protein, 9 aa, Homo Sapiens
GSLFEVQWQ

SEQ ID NO: 622811 - protein, 9 aa, Homo Sapiens
AAPLGVLTA

SEQ ID NO: 622812 - protein, 9 aa, Homo Sapiens
LLTHFSVHD

SEQ ID NO: 622813 - protein, 9 aa, Homo Sapiens
PLKNIVKVI

SEQ ID NO: 622814 - protein, 9 aa, Homo Sapiens
GPWATTSHR

SEQ ID NO: 622815 - protein, 9 aa, Homo Sapiens
WGLPMWRLG

SEQ ID NO: 622816 - protein, 9 aa, Homo Sapiens
GLRGRGGRA

SEQ ID NO: 622817 - protein, 9 aa, Homo Sapiens
SDQRMDSIV

SEQ ID NO: 622818 - protein, 9 aa, Homo Sapiens
AGKNYIFFT

SEQ ID NO: 622819 - protein, 9 aa, Homo Sapiens
ISGPYKSTL

SEQ ID NO: 622820 - protein, 9 aa, Homo Sapiens
QDSCHQQVL

SEQ ID NO: 622821 - protein, 9 aa, Homo Sapiens
SFMDRCVSI

SEQ ID NO: 622822 - protein, 9 aa, Homo Sapiens
VPSASCPSH

SEQ ID NO: 622823 - protein, 9 aa, Homo Sapiens
LIHSDRCRE

SEQ ID NO: 622824 - protein, 9 aa, Homo Sapiens
KNLMRSGTL

SEQ ID NO: 622825 - protein, 9 aa, Homo Sapiens
GQGQNSTPS

SEQ ID NO: 622826 - protein, 9 aa, Homo Sapiens
QCTKQYACL

SEQ ID NO: 622827 - protein, 9 aa, Homo Sapiens
YLNVQRVNG

SEQ ID NO: 622828 - protein, 9 aa, Homo Sapiens
SDLRFPLEG

SEQ ID NO: 622829 - protein, 9 aa, Homo Sapiens
CTELSPSEE

SEQ ID NO: 622830 - protein, 9 aa, Homo Sapiens
GAIYQRVEA

SEQ ID NO: 622831 - protein, 9 aa, Homo Sapiens
DEEIELAYV

SEQ ID NO: 622832 - protein, 9 aa, Homo Sapiens
FNAIDKIRV

SEQ ID NO: 622833 - protein, 9 aa, Homo Sapiens
TWEASGSGL

SEQ ID NO: 622834 - protein, 9 aa, Homo Sapiens
MQVDGERRE

SEQ ID NO: 622835 - protein, 9 aa, Homo Sapiens
VTREKPGQK

SEQ ID NO: 622836 - protein, 9 aa, Homo Sapiens
ILVGQTGCG

SEQ ID NO: 622837 - protein, 9 aa, Homo Sapiens
RVKILAAPI

SEQ ID NO: 622838 - protein, 9 aa, Homo Sapiens
LFHAVKTLR

SEQ ID NO: 622839 - protein, 9 aa, Homo Sapiens
FILANAQVV

SEQ ID NO: 622840 - protein, 9 aa, Homo Sapiens
TVIRKRKTA

SEQ ID NO: 622841 - protein, 9 aa, Homo Sapiens
GKDFSYYLP

SEQ ID NO: 622842 - protein, 9 aa, Homo Sapiens
PVLLKEMRE

SEQ ID NO: 622843 - protein, 9 aa, Homo Sapiens
GNDFQENLV

SEQ ID NO: 622844 - protein, 9 aa, Homo Sapiens
RKRKTAALQ

SEQ ID NO: 622845 - protein, 9 aa, Homo Sapiens
LPMGIIAAN

SEQ ID NO: 622846 - protein, 9 aa, Homo Sapiens
STEGSRKNP

SEQ ID NO: 622847 - protein, 9 aa, Homo Sapiens
PSNWALGFH

SEQ ID NO: 622848 - protein, 9 aa, Homo Sapiens
KELQKHTQE

SEQ ID NO: 622849 - protein, 9 aa, Homo Sapiens
NFDISKLEQ

SEQ ID NO: 622850 - protein, 9 aa, Homo Sapiens
AIGTVPSAS

SEQ ID NO: 622851 - protein, 9 aa, Homo Sapiens
PHRGAYNVS

SEQ ID NO: 622852 - protein, 9 aa, Homo Sapiens
RATGLHPDL

SEQ ID NO: 622853 - protein, 9 aa, Homo Sapiens
CSFMDRCVS

SEQ ID NO: 622854 - protein, 9 aa, Homo Sapiens
LLEDVRLAQ

SEQ ID NO: 622855 - protein, 9 aa, Homo Sapiens
EQLWQAERA

SEQ ID NO: 622856 - protein, 9 aa, Homo Sapiens
RVLSIVGPS

SEQ ID NO: 622857 - protein, 9 aa, Homo Sapiens
EEKAKQVRS

SEQ ID NO: 622858 - protein, 9 aa, Homo Sapiens
GAHSDENPS

SEQ ID NO: 622859 - protein, 9 aa, Homo Sapiens
KILGELNKE

SEQ ID NO: 622860 - protein, 9 aa, Homo Sapiens
TSHRVTREK

SEQ ID NO: 622861 - protein, 9 aa, Homo Sapiens
MRNEENNSG

SEQ ID NO: 622862 - protein, 9 aa, Homo Sapiens
TREKPGQKW

SEQ ID NO: 622863 - protein, 9 aa, Homo Sapiens
PGTTGPWAT

SEQ ID NO: 622864 - protein, 9 aa, Homo Sapiens
LEAGLALVL

SEQ ID NO: 622865 - protein, 9 aa, Homo Sapiens
MREQPIYWS

SEQ ID NO: 622866 - protein, 9 aa, Homo Sapiens
LAECLEHLH

SEQ ID NO: 622867 - protein, 9 aa, Homo Sapiens
TVVLPTVLE

SEQ ID NO: 622868 - protein, 9 aa, Homo Sapiens
SCPMSQRSF

SEQ ID NO: 622869 - protein, 9 aa, Homo Sapiens
KDFTFGAYQ

SEQ ID NO: 622870 - protein, 9 aa, Homo Sapiens
VASFVTRPG

SEQ ID NO: 622871 - protein, 9 aa, Homo Sapiens
ILIFADTPY

SEQ ID NO: 622872 - protein, 9 aa, Homo Sapiens
DCVTYHTEY

SEQ ID NO: 622873 - protein, 9 aa, Homo Sapiens
VLARLLTHF

SEQ ID NO: 622874 - protein, 9 aa, Homo Sapiens
LVGENVLTA

SEQ ID NO: 622875 - protein, 9 aa, Homo Sapiens
SEPGAPAFG

SEQ ID NO: 622876 - protein, 9 aa, Homo Sapiens
VEGMWLWIN

SEQ ID NO: 622877 - protein, 9 aa, Homo Sapiens
RASSYLLSP

SEQ ID NO: 622878 - protein, 9 aa, Homo Sapiens
NQVFAFSRV

SEQ ID NO: 622879 - protein, 9 aa, Homo Sapiens
LHRDEQAQL

SEQ ID NO: 622880 - protein, 9 aa, Homo Sapiens
FAFSRVLRA

SEQ ID NO: 622881 - protein, 9 aa, Homo Sapiens
FTVCLLPFF

SEQ ID NO: 622882 - protein, 9 aa, Homo Sapiens
HLHRGELFA

SEQ ID NO: 622883 - protein, 9 aa, Homo Sapiens
EPRYGRRIC

SEQ ID NO: 622884 - protein, 9 aa, Homo Sapiens
ESFLQALGL

SEQ ID NO: 622885 - protein, 9 aa, Homo Sapiens
ASPCSLSLG

SEQ ID NO: 622886 - protein, 9 aa, Homo Sapiens
IKYILKFQE

SEQ ID NO: 622887 - protein, 9 aa, Homo Sapiens
NYYKWSAEC

SEQ ID NO: 622888 - protein, 9 aa, Homo Sapiens
MFVRCIAQM

SEQ ID NO: 622889 - protein, 9 aa, Homo Sapiens
EDPLQKPLN

SEQ ID NO: 622890 - protein, 9 aa, Homo Sapiens
HFLSQAGPC

SEQ ID NO: 622891 - protein, 9 aa, Homo Sapiens
AIIFIDKID

SEQ ID NO: 622892 - protein, 9 aa, Homo Sapiens
AGDTATNVS

SEQ ID NO: 622893 - protein, 9 aa, Homo Sapiens
SIPTTSTSQ

SEQ ID NO: 622894 - protein, 9 aa, Homo Sapiens
QPNAQQDGK

SEQ ID NO: 622895 - protein, 9 aa, Homo Sapiens
QVIHTITAT

SEQ ID NO: 622896 - protein, 9 aa, Homo Sapiens
KIRVKLRRR

SEQ ID NO: 622897 - protein, 9 aa, Homo Sapiens
ARKLKLLMG

SEQ ID NO: 622898 - protein, 9 aa, Homo Sapiens
CHQLLASWL

SEQ ID NO: 622899 - protein, 9 aa, Homo Sapiens
HTTSHCHVN

SEQ ID NO: 622900 - protein, 9 aa, Homo Sapiens
GDCVMDKPV

SEQ ID NO: 622901 - protein, 9 aa, Homo Sapiens
QGSLCHPEE

SEQ ID NO: 622902 - protein, 9 aa, Homo Sapiens
DKIVGGYNY

SEQ ID NO: 622903 - protein, 9 aa, Homo Sapiens
IWDMCISVK

SEQ ID NO: 622904 - protein, 9 aa, Homo Sapiens
GELDLASGA

SEQ ID NO: 622905 - protein, 9 aa, Homo Sapiens
RLLTHFSVH

SEQ ID NO: 622906 - protein, 9 aa, Homo Sapiens
PPSSFITYS

SEQ ID NO: 622907 - protein, 9 aa, Homo Sapiens
YSEEKAKQV

SEQ ID NO: 622908 - protein, 9 aa, Homo Sapiens
AIDKIRVKL

SEQ ID NO: 622909 - protein, 9 aa, Homo Sapiens
AELHPSFFW

SEQ ID NO: 622910 - protein, 9 aa, Homo Sapiens
LPMWRLGTQ

SEQ ID NO: 622911 - protein, 9 aa, Homo Sapiens
HRKADFQHP

SEQ ID NO: 622912 - protein, 9 aa, Homo Sapiens
PLDEQNCTM

SEQ ID NO: 622913 - protein, 9 aa, Homo Sapiens
TSSASSSVG

SEQ ID NO: 622914 - protein, 9 aa, Homo Sapiens
SVNFTVIRK

SEQ ID NO: 622915 - protein, 9 aa, Homo Sapiens
NQPSTGGST

SEQ ID NO: 622916 - protein, 9 aa, Homo Sapiens
SPKLFEPDQ

SEQ ID NO: 622917 - protein, 9 aa, Homo Sapiens
EIEPHKECK

SEQ ID NO: 622918 - protein, 9 aa, Homo Sapiens
AVGGLIGRK

SEQ ID NO: 622919 - protein, 9 aa, Homo Sapiens
DPLQKPLNP

SEQ ID NO: 622920 - protein, 9 aa, Homo Sapiens
SQTAKAQLR

SEQ ID NO: 622921 - protein, 9 aa, Homo Sapiens
RGNRESFLQ

SEQ ID NO: 622922 - protein, 9 aa, Homo Sapiens
CLLPFFLLS

SEQ ID NO: 622923 - protein, 9 aa, Homo Sapiens
LLEKNLLLP

SEQ ID NO: 622924 - protein, 9 aa, Homo Sapiens
ILLRDNYSL

SEQ ID NO: 622925 - protein, 9 aa, Homo Sapiens
SMFTEGRED

SEQ ID NO: 622926 - protein, 9 aa, Homo Sapiens
HWTSTHRKA

SEQ ID NO: 622927 - protein, 9 aa, Homo Sapiens
LLNIPLYLN

SEQ ID NO: 622928 - protein, 9 aa, Homo Sapiens
TEGSRKNPA

SEQ ID NO: 622929 - protein, 9 aa, Homo Sapiens
REIPKTITG

SEQ ID NO: 622930 - protein, 9 aa, Homo Sapiens
QCLLCKPPT

SEQ ID NO: 622931 - protein, 9 aa, Homo Sapiens
TCTSQWSWK

SEQ ID NO: 622932 - protein, 9 aa, Homo Sapiens
SAHRKPIDL

SEQ ID NO: 622933 - protein, 9 aa, Homo Sapiens
LLRDNYSLL

SEQ ID NO: 622934 - protein, 9 aa, Homo Sapiens
EFEIEPHKE

SEQ ID NO: 622935 - protein, 9 aa, Homo Sapiens
PTMPSASCL

SEQ ID NO: 622936 - protein, 9 aa, Homo Sapiens
EKNLLLPEK

SEQ ID NO: 622937 - protein, 9 aa, Homo Sapiens
LSPKLFEPD

SEQ ID NO: 622938 - protein, 9 aa, Homo Sapiens
LIEVNQGSL

SEQ ID NO: 622939 - protein, 9 aa, Homo Sapiens
LIISAHRKP

SEQ ID NO: 622940 - protein, 9 aa, Homo Sapiens
EDYLNAESL

SEQ ID NO: 622941 - protein, 9 aa, Homo Sapiens
IAESKQSDL

SEQ ID NO: 622942 - protein, 9 aa, Homo Sapiens
TMQCTKQYA

SEQ ID NO: 622943 - protein, 9 aa, Homo Sapiens
QGKHWTSTH

SEQ ID NO: 622944 - protein, 9 aa, Homo Sapiens
LLAYAKAGE

SEQ ID NO: 622945 - protein, 9 aa, Homo Sapiens
SSVGEKPSA

SEQ ID NO: 622946 - protein, 9 aa, Homo Sapiens
ISSRVQEAA

SEQ ID NO: 622947 - protein, 9 aa, Homo Sapiens
ILGKRTDEQ

SEQ ID NO: 622948 - protein, 9 aa, Homo Sapiens
ASGSGLLPS

SEQ ID NO: 622949 - protein, 9 aa, Homo Sapiens
IPIPDTKLG

SEQ ID NO: 622950 - protein, 9 aa, Homo Sapiens
AEQIVCVEL

SEQ ID NO: 622951 - protein, 9 aa, Homo Sapiens
KRSMFTEGR

SEQ ID NO: 622952 - protein, 9 aa, Homo Sapiens
EGSFEQFDV

SEQ ID NO: 622953 - protein, 9 aa, Homo Sapiens
LTNVDQIFQ

SEQ ID NO: 622954 - protein, 9 aa, Homo Sapiens
NSCLPSWLE

SEQ ID NO: 622955 - protein, 9 aa, Homo Sapiens
CNQVFAFSR

SEQ ID NO: 622956 - protein, 9 aa, Homo Sapiens
LCILMAALA

SEQ ID NO: 622957 - protein, 9 aa, Homo Sapiens
WMDPDLQMD

SEQ ID NO: 622958 - protein, 9 aa, Homo Sapiens
GENLYKFKE

SEQ ID NO: 622959 - protein, 9 aa, Homo Sapiens
PGFPGRDGV

SEQ ID NO: 622960 - protein, 9 aa, Homo Sapiens
RDCSCPMSQ

SEQ ID NO: 622961 - protein, 9 aa, Homo Sapiens
PSFFWLRGL

SEQ ID NO: 622962 - protein, 9 aa, Homo Sapiens
AERGNRESF

SEQ ID NO: 622963 - protein, 9 aa, Homo Sapiens
YEENSVPYQ

SEQ ID NO: 622964 - protein, 9 aa, Homo Sapiens
APSTWGLPM

SEQ ID NO: 622965 - protein, 9 aa, Homo Sapiens
FGSFIWEQD

SEQ ID NO: 622966 - protein, 9 aa, Homo Sapiens
RELSEQLWQ

SEQ ID NO: 622967 - protein, 9 aa, Homo Sapiens
GSINDKEAV

SEQ ID NO: 622968 - protein, 9 aa, Homo Sapiens
PSSFITYSS

SEQ ID NO: 622969 - protein, 9 aa, Homo Sapiens
LALNLLATQ

SEQ ID NO: 622970 - protein, 9 aa, Homo Sapiens
SASPCSLSL

SEQ ID NO: 622971 - protein, 9 aa, Homo Sapiens
MCKILKTVT

SEQ ID NO: 622972 - protein, 9 aa, Homo Sapiens
KQVRSEYEK

SEQ ID NO: 622973 - protein, 9 aa, Homo Sapiens
VNQGSLCHP

SEQ ID NO: 622974 - protein, 9 aa, Homo Sapiens
ARTVVGFWM

SEQ ID NO: 622975 - protein, 9 aa, Homo Sapiens
RAERDYTIE

SEQ ID NO: 622976 - protein, 9 aa, Homo Sapiens
GDEVALRPL

SEQ ID NO: 622977 - protein, 9 aa, Homo Sapiens
LVNRRQMPD

SEQ ID NO: 622978 - protein, 9 aa, Homo Sapiens
QTGCGKSAT

SEQ ID NO: 622979 - protein, 9 aa, Homo Sapiens
IPTTSTSQR

SEQ ID NO: 622980 - protein, 9 aa, Homo Sapiens
SPNKAHLNL

SEQ ID NO: 622981 - protein, 9 aa, Homo Sapiens
FEVQWQLAQ

SEQ ID NO: 622982 - protein, 9 aa, Homo Sapiens
LQGSINDKE

SEQ ID NO: 622983 - protein, 9 aa, Homo Sapiens
VPCLLDSPS

SEQ ID NO: 622984 - protein, 9 aa, Homo Sapiens
HVVQDRAER

SEQ ID NO: 622985 - protein, 9 aa, Homo Sapiens
IKVINAGQL

SEQ ID NO: 622986 - protein, 9 aa, Homo Sapiens
GGSGEHQRT

SEQ ID NO: 622987 - protein, 9 aa, Homo Sapiens
SCSAQPTDS

SEQ ID NO: 622988 - protein, 9 aa, Homo Sapiens
IDLNKKGNK

SEQ ID NO: 622989 - protein, 9 aa, Homo Sapiens
FGQGQNSTP

SEQ ID NO: 622990 - protein, 9 aa, Homo Sapiens
TDGNSASPC

SEQ ID NO: 622991 - protein, 9 aa, Homo Sapiens
EVNQGSLCH

SEQ ID NO: 622992 - protein, 9 aa, Homo Sapiens
GDGGSETSQ

SEQ ID NO: 622993 - protein, 9 aa, Homo Sapiens
KAGEVAEEV

SEQ ID NO: 622994 - protein, 9 aa, Homo Sapiens
LKGSLLYHL

SEQ ID NO: 622995 - protein, 9 aa, Homo Sapiens
EAALSQTGF

SEQ ID NO: 622996 - protein, 9 aa, Homo Sapiens
SPEVGDEVA

SEQ ID NO: 622997 - protein, 9 aa, Homo Sapiens
NVQLEVDII

SEQ ID NO: 622998 - protein, 9 aa, Homo Sapiens
VIHTITATD

SEQ ID NO: 622999 - protein, 9 aa, Homo Sapiens
PHAPVPCLL

SEQ ID NO: 623000 - protein, 9 aa, Homo Sapiens
PPTPGGANP

SEQ ID NO: 623001 - protein, 9 aa, Homo Sapiens
PAVTSTLVT

SEQ ID NO: 623002 - protein, 9 aa, Homo Sapiens
REQPIYWSF

SEQ ID NO: 623003 - protein, 9 aa, Homo Sapiens
EENLTQDNQ

SEQ ID NO: 623004 - protein, 9 aa, Homo Sapiens
SLSSCSAQP

SEQ ID NO: 623005 - protein, 9 aa, Homo Sapiens
GPWRDCSCP

SEQ ID NO: 623006 - protein, 9 aa, Homo Sapiens
CERTVLRKG

SEQ ID NO: 623007 - protein, 9 aa, Homo Sapiens
DTATNVSMW

SEQ ID NO: 623008 - protein, 9 aa, Homo Sapiens
LIFPQSLVV

SEQ ID NO: 623009 - protein, 9 aa, Homo Sapiens
NYIFFTGPS

SEQ ID NO: 623010 - protein, 9 aa, Homo Sapiens
TGDGMTCVD

SEQ ID NO: 623011 - protein, 9 aa, Homo Sapiens
LSQTGFSYD

SEQ ID NO: 623012 - protein, 9 aa, Homo Sapiens
CTMEIESYG

SEQ ID NO: 623013 - protein, 9 aa, Homo Sapiens
GSETSQPPT

SEQ ID NO: 623014 - protein, 9 aa, Homo Sapiens
DSHVCCVFW

SEQ ID NO: 623015 - protein, 9 aa, Homo Sapiens
DGNSASPCS

SEQ ID NO: 623016 - protein, 9 aa, Homo Sapiens
LCCATKGGN

SEQ ID NO: 623017 - protein, 9 aa, Homo Sapiens
TPGDYLGKG

SEQ ID NO: 623018 - protein, 9 aa, Homo Sapiens
AQPTDSLVL

SEQ ID NO: 623019 - protein, 9 aa, Homo Sapiens
GIISGPYKS

SEQ ID NO: 623020 - protein, 9 aa, Homo Sapiens
PSASCPSHP

SEQ ID NO: 623021 - protein, 9 aa, Homo Sapiens
MGINSTGKI

SEQ ID NO: 623022 - protein, 9 aa, Homo Sapiens
EESQTAKAQ

SEQ ID NO: 623023 - protein, 9 aa, Homo Sapiens
NYLAKLDVL

SEQ ID NO: 623024 - protein, 9 aa, Homo Sapiens
CRKNDDADT

SEQ ID NO: 623025 - protein, 9 aa, Homo Sapiens
KVEIAESRV

SEQ ID NO: 623026 - protein, 9 aa, Homo Sapiens
LGVLTAVGW

SEQ ID NO: 623027 - protein, 9 aa, Homo Sapiens
GNKASTVAA

SEQ ID NO: 623028 - protein, 9 aa, Homo Sapiens
KWTPYLNSN

SEQ ID NO: 623029 - protein, 9 aa, Homo Sapiens
RNVEGMWLW

SEQ ID NO: 623030 - protein, 9 aa, Homo Sapiens
IMCKILKTV

SEQ ID NO: 623031 - protein, 9 aa, Homo Sapiens
KRTDEQTDF

SEQ ID NO: 623032 - protein, 9 aa, Homo Sapiens
EAPRPKLDG

SEQ ID NO: 623033 - protein, 9 aa, Homo Sapiens
DMTVRKECI

SEQ ID NO: 623034 - protein, 9 aa, Homo Sapiens
GQTGCGKSA

SEQ ID NO: 623035 - protein, 9 aa, Homo Sapiens
RGAYNVSTK

SEQ ID NO: 623036 - protein, 9 aa, Homo Sapiens
LQKPLNPTI

SEQ ID NO: 623037 - protein, 9 aa, Homo Sapiens
ERLRGLEQA

SEQ ID NO: 623038 - protein, 9 aa, Homo Sapiens
FTVIRKRKT

SEQ ID NO: 623039 - protein, 9 aa, Homo Sapiens
GLLGKRSMF

SEQ ID NO: 623040 - protein, 9 aa, Homo Sapiens
IPEDDAVYQ

SEQ ID NO: 623041 - protein, 9 aa, Homo Sapiens
IDKIRVKLR

SEQ ID NO: 623042 - protein, 9 aa, Homo Sapiens
KQCASTPGA

SEQ ID NO: 623043 - protein, 9 aa, Homo Sapiens
SAQPTDSLV

SEQ ID NO: 623044 - protein, 9 aa, Homo Sapiens
CREALLLLE

SEQ ID NO: 623045 - protein, 9 aa, Homo Sapiens
KQSDLRFPL

SEQ ID NO: 623046 - protein, 9 aa, Homo Sapiens
RTSRSGGGE

SEQ ID NO: 623047 - protein, 9 aa, Homo Sapiens
SLGRTCTSQ

SEQ ID NO: 623048 - protein, 9 aa, Homo Sapiens
YLGKSFHSQ

SEQ ID NO: 623049 - protein, 9 aa, Homo Sapiens
PLDGELDLA

SEQ ID NO: 623050 - protein, 9 aa, Homo Sapiens
TLIISAHRK

SEQ ID NO: 623051 - protein, 9 aa, Homo Sapiens
ESLVNRRQM

SEQ ID NO: 623052 - protein, 9 aa, Homo Sapiens
RKPIDLKAI

SEQ ID NO: 623053 - protein, 9 aa, Homo Sapiens
QERCSDSDG

SEQ ID NO: 623054 - protein, 9 aa, Homo Sapiens
SHILLHFPA

SEQ ID NO: 623055 - protein, 9 aa, Homo Sapiens
LSAVKAIAN

SEQ ID NO: 623056 - protein, 9 aa, Homo Sapiens
NGTKVVPSF

SEQ ID NO: 623057 - protein, 9 aa, Homo Sapiens
LEEDRALTP

SEQ ID NO: 623058 - protein, 9 aa, Homo Sapiens
ALNLLATQL

SEQ ID NO: 623059 - protein, 9 aa, Homo Sapiens
TLPGADSIP

SEQ ID NO: 623060 - protein, 9 aa, Homo Sapiens
PTIRDMFVR

SEQ ID NO: 623061 - protein, 9 aa, Homo Sapiens
VIRKRKTAA

SEQ ID NO: 623062 - protein, 9 aa, Homo Sapiens
RGGRAAVGQ

SEQ ID NO: 623063 - protein, 9 aa, Homo Sapiens
SASCLKLWP

SEQ ID NO: 623064 - protein, 9 aa, Homo Sapiens
RPSADDLSH

SEQ ID NO: 623065 - protein, 9 aa, Homo Sapiens
EVQWQLAQL

SEQ ID NO: 623066 - protein, 9 aa, Homo Sapiens
VATRAHAGS

SEQ ID NO: 623067 - protein, 9 aa, Homo Sapiens
KVTSPSGKE

SEQ ID NO: 623068 - protein, 9 aa, Homo Sapiens
DYLNAESLV

SEQ ID NO: 623069 - protein, 9 aa, Homo Sapiens
RRQARKVKK

SEQ ID NO: 623070 - protein, 9 aa, Homo Sapiens
LNPTIKYQY

SEQ ID NO: 623071 - protein, 9 aa, Homo Sapiens
LQERNVQLE

SEQ ID NO: 623072 - protein, 9 aa, Homo Sapiens
QMAETPNSS

SEQ ID NO: 623073 - protein, 9 aa, Homo Sapiens
KVINAGQLP

SEQ ID NO: 623074 - protein, 9 aa, Homo Sapiens
SDLNFDISK

SEQ ID NO: 623075 - protein, 9 aa, Homo Sapiens
ILKTVTCWT

SEQ ID NO: 623076 - protein, 9 aa, Homo Sapiens
VTTTRVHHA

SEQ ID NO: 623077 - protein, 9 aa, Homo Sapiens
LEKWTPYLN

SEQ ID NO: 623078 - protein, 9 aa, Homo Sapiens
LVVLLLLVF

SEQ ID NO: 623079 - protein, 9 aa, Homo Sapiens
LDEENLTQD

SEQ ID NO: 623080 - protein, 9 aa, Homo Sapiens
SGVPGLQGP

SEQ ID NO: 623081 - protein, 9 aa, Homo Sapiens
FVLGSVLYK

SEQ ID NO: 623082 - protein, 9 aa, Homo Sapiens
YSIDHTRVD

SEQ ID NO: 623083 - protein, 9 aa, Homo Sapiens
RYCLTELNM

SEQ ID NO: 623084 - protein, 9 aa, Homo Sapiens
YSNSGVELP

SEQ ID NO: 623085 - protein, 9 aa, Homo Sapiens
IPQLLTLEN

SEQ ID NO: 623086 - protein, 9 aa, Homo Sapiens
RYCRWKDSL

SEQ ID NO: 623087 - protein, 9 aa, Homo Sapiens
AKPLQEEGD

SEQ ID NO: 623088 - protein, 9 aa, Homo Sapiens
TVQTTLLFS

SEQ ID NO: 623089 - protein, 9 aa, Homo Sapiens
GGIYPNRNV

SEQ ID NO: 623090 - protein, 9 aa, Homo Sapiens
VREVDLMRC

SEQ ID NO: 623091 - protein, 9 aa, Homo Sapiens
AGERALTRV

SEQ ID NO: 623092 - protein, 9 aa, Homo Sapiens
AENALQSDS

SEQ ID NO: 623093 - protein, 9 aa, Homo Sapiens
KPTPGNPLP

SEQ ID NO: 623094 - protein, 9 aa, Homo Sapiens
LQEALSIYG

SEQ ID NO: 623095 - protein, 9 aa, Homo Sapiens
LGMDIVQVT

SEQ ID NO: 623096 - protein, 9 aa, Homo Sapiens
DVAAPDVPK

SEQ ID NO: 623097 - protein, 9 aa, Homo Sapiens
ARVRLKLKI

SEQ ID NO: 623098 - protein, 9 aa, Homo Sapiens
DSQVNTILP

SEQ ID NO: 623099 - protein, 9 aa, Homo Sapiens
RLKLKIILC

SEQ ID NO: 623100 - protein, 9 aa, Homo Sapiens
DSWVPIKYQ

SEQ ID NO: 623101 - protein, 9 aa, Homo Sapiens
FNKTLVTDN

SEQ ID NO: 623102 - protein, 9 aa, Homo Sapiens
GGKSIPITG

SEQ ID NO: 623103 - protein, 9 aa, Homo Sapiens
CGTFRPGVL

SEQ ID NO: 623104 - protein, 9 aa, Homo Sapiens
TRKLLVAVE

SEQ ID NO: 623105 - protein, 9 aa, Homo Sapiens
PQFNVNGPG

SEQ ID NO: 623106 - protein, 9 aa, Homo Sapiens
DILDTAGLE

SEQ ID NO: 623107 - protein, 9 aa, Homo Sapiens
HKAEIWSPL

SEQ ID NO: 623108 - protein, 9 aa, Homo Sapiens
SFRPASCAN

SEQ ID NO: 623109 - protein, 9 aa, Homo Sapiens
PSLPHSFLM

SEQ ID NO: 623110 - protein, 9 aa, Homo Sapiens
NPFPPGVLS

SEQ ID NO: 623111 - protein, 9 aa, Homo Sapiens
DLDYQYKLD

SEQ ID NO: 623112 - protein, 9 aa, Homo Sapiens
LVKHLYHQV

SEQ ID NO: 623113 - protein, 9 aa, Homo Sapiens
TLQPHQAPA

SEQ ID NO: 623114 - protein, 9 aa, Homo Sapiens
SGQDGSPQE

SEQ ID NO: 623115 - protein, 9 aa, Homo Sapiens
YGNSYNSQS

SEQ ID NO: 623116 - protein, 9 aa, Homo Sapiens
RQDNRVVTV

SEQ ID NO: 623117 - protein, 9 aa, Homo Sapiens
WIWLDGSEV

SEQ ID NO: 623118 - protein, 9 aa, Homo Sapiens
PRSIEAGAG

SEQ ID NO: 623119 - protein, 9 aa, Homo Sapiens
DYPTLYNIL

SEQ ID NO: 623120 - protein, 9 aa, Homo Sapiens
AMWTFLNYY

SEQ ID NO: 623121 - protein, 9 aa, Homo Sapiens
VLCSPQMAL

SEQ ID NO: 623122 - protein, 9 aa, Homo Sapiens
AEISLKSPG

SEQ ID NO: 623123 - protein, 9 aa, Homo Sapiens
VELPLTDGG

SEQ ID NO: 623124 - protein, 9 aa, Homo Sapiens
DFHLWLTSL

SEQ ID NO: 623125 - protein, 9 aa, Homo Sapiens
PKTSPKVVA

SEQ ID NO: 623126 - protein, 9 aa, Homo Sapiens
LQANKIVQG

SEQ ID NO: 623127 - protein, 9 aa, Homo Sapiens
CIYLQPRSI

SEQ ID NO: 623128 - protein, 9 aa, Homo Sapiens
QFLLNFDHF

SEQ ID NO: 623129 - protein, 9 aa, Homo Sapiens
GGRPGLPQT

SEQ ID NO: 623130 - protein, 9 aa, Homo Sapiens
NLSPVISNE

SEQ ID NO: 623131 - protein, 9 aa, Homo Sapiens
CPGIDRRTE

SEQ ID NO: 623132 - protein, 9 aa, Homo Sapiens
VLVHSQERV

SEQ ID NO: 623133 - protein, 9 aa, Homo Sapiens
KIQPAFQEK

SEQ ID NO: 623134 - protein, 9 aa, Homo Sapiens
PVRQDLLWT

SEQ ID NO: 623135 - protein, 9 aa, Homo Sapiens
RSVAVKIYG

SEQ ID NO: 623136 - protein, 9 aa, Homo Sapiens
MYFFLIFGN

SEQ ID NO: 623137 - protein, 9 aa, Homo Sapiens
YTGEKPYEC

SEQ ID NO: 623138 - protein, 9 aa, Homo Sapiens
GSVLYKNLD

SEQ ID NO: 623139 - protein, 9 aa, Homo Sapiens
SKLNQNYCR

SEQ ID NO: 623140 - protein, 9 aa, Homo Sapiens
SEEEETIGS

SEQ ID NO: 623141 - protein, 9 aa, Homo Sapiens
LRHFTLWRG

SEQ ID NO: 623142 - protein, 9 aa, Homo Sapiens
CGMSFSRRS

SEQ ID NO: 623143 - protein, 9 aa, Homo Sapiens
KDSLGAYCI

SEQ ID NO: 623144 - protein, 9 aa, Homo Sapiens
SGVELPLTD

SEQ ID NO: 623145 - protein, 9 aa, Homo Sapiens
ATVQTTLLF

SEQ ID NO: 623146 - protein, 9 aa, Homo Sapiens
KYVWEQRTS

SEQ ID NO: 623147 - protein, 9 aa, Homo Sapiens
PRAFSSCSY

SEQ ID NO: 623148 - protein, 9 aa, Homo Sapiens
LSIYGGNSP

SEQ ID NO: 623149 - protein, 9 aa, Homo Sapiens
MKIRSAEGR

SEQ ID NO: 623150 - protein, 9 aa, Homo Sapiens
LEEYSAMRD

SEQ ID NO: 623151 - protein, 9 aa, Homo Sapiens
HREVNGIHG

SEQ ID NO: 623152 - protein, 9 aa, Homo Sapiens
GELPSASTS

SEQ ID NO: 623153 - protein, 9 aa, Homo Sapiens
SFIILFIVL

SEQ ID NO: 623154 - protein, 9 aa, Homo Sapiens
LERLTGADG

SEQ ID NO: 623155 - protein, 9 aa, Homo Sapiens
FRDERRAQR

SEQ ID NO: 623156 - protein, 9 aa, Homo Sapiens
KPLQEEGDP

SEQ ID NO: 623157 - protein, 9 aa, Homo Sapiens
NLYNNPVTA

SEQ ID NO: 623158 - protein, 9 aa, Homo Sapiens
ILDTAGLEE

SEQ ID NO: 623159 - protein, 9 aa, Homo Sapiens
QDNRVVTVL

SEQ ID NO: 623160 - protein, 9 aa, Homo Sapiens
LTLENLLNI

SEQ ID NO: 623161 - protein, 9 aa, Homo Sapiens
EPTNYSVEV

SEQ ID NO: 623162 - protein, 9 aa, Homo Sapiens
SQERVLTQL

SEQ ID NO: 623163 - protein, 9 aa, Homo Sapiens
KKPTPGNPL

SEQ ID NO: 623164 - protein, 9 aa, Homo Sapiens
IGDIDNAMW

SEQ ID NO: 623165 - protein, 9 aa, Homo Sapiens
AACEAGLSP

SEQ ID NO: 623166 - protein, 9 aa, Homo Sapiens
APSTGSPSQ

SEQ ID NO: 623167 - protein, 9 aa, Homo Sapiens
VLLYVFAHT

SEQ ID NO: 623168 - protein, 9 aa, Homo Sapiens
DSLCAKCTL

SEQ ID NO: 623169 - protein, 9 aa, Homo Sapiens
AANHSSVWI

SEQ ID NO: 623170 - protein, 9 aa, Homo Sapiens
YTEKDLYSY

SEQ ID NO: 623171 - protein, 9 aa, Homo Sapiens
GAAREGALV

SEQ ID NO: 623172 - protein, 9 aa, Homo Sapiens
GLRNLGNAC

SEQ ID NO: 623173 - protein, 9 aa, Homo Sapiens
TVLYGTPMK

SEQ ID NO: 623174 - protein, 9 aa, Homo Sapiens
VPCIFVYLH

SEQ ID NO: 623175 - protein, 9 aa, Homo Sapiens
SYAVPGKAN

SEQ ID NO: 623176 - protein, 9 aa, Homo Sapiens
ESQVVSENV

SEQ ID NO: 623177 - protein, 9 aa, Homo Sapiens
RLGAHLDLL

SEQ ID NO: 623178 - protein, 9 aa, Homo Sapiens
SRDARWESQ

SEQ ID NO: 623179 - protein, 9 aa, Homo Sapiens
FFQWDDLCK

SEQ ID NO: 623180 - protein, 9 aa, Homo Sapiens
ASAAGGTAR

SEQ ID NO: 623181 - protein, 9 aa, Homo Sapiens
EGLVLCHCI

SEQ ID NO: 623182 - protein, 9 aa, Homo Sapiens
KVRIAETWL

SEQ ID NO: 623183 - protein, 9 aa, Homo Sapiens
KKSPALKVT

SEQ ID NO: 623184 - protein, 9 aa, Homo Sapiens
VGSGDINNF

SEQ ID NO: 623185 - protein, 9 aa, Homo Sapiens
QAHRGYTDQ

SEQ ID NO: 623186 - protein, 9 aa, Homo Sapiens
SSLAALCSE

SEQ ID NO: 623187 - protein, 9 aa, Homo Sapiens
MKRDSWVPI

SEQ ID NO: 623188 - protein, 9 aa, Homo Sapiens
EELDGENSY

SEQ ID NO: 623189 - protein, 9 aa, Homo Sapiens
QRVLLYVFA

SEQ ID NO: 623190 - protein, 9 aa, Homo Sapiens
LPQTPPLLL

SEQ ID NO: 623191 - protein, 9 aa, Homo Sapiens
CLPPASVTM

SEQ ID NO: 623192 - protein, 9 aa, Homo Sapiens
DNRVVTVLK

SEQ ID NO: 623193 - protein, 9 aa, Homo Sapiens
GYGEIFANG

SEQ ID NO: 623194 - protein, 9 aa, Homo Sapiens
MEKIQPAFQ

SEQ ID NO: 623195 - protein, 9 aa, Homo Sapiens
RSFEGQAHG

SEQ ID NO: 623196 - protein, 9 aa, Homo Sapiens
FGGQAEGQP

SEQ ID NO: 623197 - protein, 9 aa, Homo Sapiens
FHLMELRNK

SEQ ID NO: 623198 - protein, 9 aa, Homo Sapiens
RPIELDGKK

SEQ ID NO: 623199 - protein, 9 aa, Homo Sapiens
FTAKRTLII

SEQ ID NO: 623200 - protein, 9 aa, Homo Sapiens
ACYMNSILQ

SEQ ID NO: 623201 - protein, 9 aa, Homo Sapiens
SFEGQAHGA

SEQ ID NO: 623202 - protein, 9 aa, Homo Sapiens
GTFNKTLVT

SEQ ID NO: 623203 - protein, 9 aa, Homo Sapiens
ATGNGLESA

SEQ ID NO: 623204 - protein, 9 aa, Homo Sapiens
GFPCSARFT

SEQ ID NO: 623205 - protein, 9 aa, Homo Sapiens
SIYGGNSPA

SEQ ID NO: 623206 - protein, 9 aa, Homo Sapiens
QANKIVQGS

SEQ ID NO: 623207 - protein, 9 aa, Homo Sapiens
HSQERVLTQ

SEQ ID NO: 623208 - protein, 9 aa, Homo Sapiens
PLKYGSQME

SEQ ID NO: 623209 - protein, 9 aa, Homo Sapiens
KLILAENAL

SEQ ID NO: 623210 - protein, 9 aa, Homo Sapiens
EDFRKNEDK

SEQ ID NO: 623211 - protein, 9 aa, Homo Sapiens
VVSLWGRPV

SEQ ID NO: 623212 - protein, 9 aa, Homo Sapiens
RTFEDITRS

SEQ ID NO: 623213 - protein, 9 aa, Homo Sapiens
AKYVWEQRT

SEQ ID NO: 623214 - protein, 9 aa, Homo Sapiens
GPLAGAKPL

SEQ ID NO: 623215 - protein, 9 aa, Homo Sapiens
CMDQWSTQN

SEQ ID NO: 623216 - protein, 9 aa, Homo Sapiens
KGSSSSSSG

SEQ ID NO: 623217 - protein, 9 aa, Homo Sapiens
VSSLAALCS

SEQ ID NO: 623218 - protein, 9 aa, Homo Sapiens
GGYAPEFVP

SEQ ID NO: 623219 - protein, 9 aa, Homo Sapiens
LECFQDNFS

SEQ ID NO: 623220 - protein, 9 aa, Homo Sapiens
VPKVKITVN

SEQ ID NO: 623221 - protein, 9 aa, Homo Sapiens
WGRPVVLAV

SEQ ID NO: 623222 - protein, 9 aa, Homo Sapiens
RMYFLIGNL

SEQ ID NO: 623223 - protein, 9 aa, Homo Sapiens
DKLILAENA

SEQ ID NO: 623224 - protein, 9 aa, Homo Sapiens
LKHIRNNHD

SEQ ID NO: 623225 - protein, 9 aa, Homo Sapiens
SVAVKIYGA

SEQ ID NO: 623226 - protein, 9 aa, Homo Sapiens
VRDVSRRYP

SEQ ID NO: 623227 - protein, 9 aa, Homo Sapiens
LTTHRKLFR

SEQ ID NO: 623228 - protein, 9 aa, Homo Sapiens
EGALVALGS

SEQ ID NO: 623229 - protein, 9 aa, Homo Sapiens
LEKSYELPV

SEQ ID NO: 623230 - protein, 9 aa, Homo Sapiens
GGLYFIISG

SEQ ID NO: 623231 - protein, 9 aa, Homo Sapiens
PPGVLSPPG

SEQ ID NO: 623232 - protein, 9 aa, Homo Sapiens
MIPQIDLNQ

SEQ ID NO: 623233 - protein, 9 aa, Homo Sapiens
CKMTYLTMC

SEQ ID NO: 623234 - protein, 9 aa, Homo Sapiens
LAGAKPLQE

SEQ ID NO: 623235 - protein, 9 aa, Homo Sapiens
LPVGQVITI

SEQ ID NO: 623236 - protein, 9 aa, Homo Sapiens
RYVRAGFPC

SEQ ID NO: 623237 - protein, 9 aa, Homo Sapiens
IWRFQELVP

SEQ ID NO: 623238 - protein, 9 aa, Homo Sapiens
PTGGIYPNR

SEQ ID NO: 623239 - protein, 9 aa, Homo Sapiens
QSDQIDLDY

SEQ ID NO: 623240 - protein, 9 aa, Homo Sapiens
VMCTLLIIL

SEQ ID NO: 623241 - protein, 9 aa, Homo Sapiens
GVLVSSGNK

SEQ ID NO: 623242 - protein, 9 aa, Homo Sapiens
QTLPGISIS

SEQ ID NO: 623243 - protein, 9 aa, Homo Sapiens
LTRVGALVG

SEQ ID NO: 623244 - protein, 9 aa, Homo Sapiens
HQGNHGSQG

SEQ ID NO: 623245 - protein, 9 aa, Homo Sapiens
YVVPQEHGQ

SEQ ID NO: 623246 - protein, 9 aa, Homo Sapiens
QMYFFLIFG

SEQ ID NO: 623247 - protein, 9 aa, Homo Sapiens
VSALEKQEP

SEQ ID NO: 623248 - protein, 9 aa, Homo Sapiens
EVKDSLGAY

SEQ ID NO: 623249 - protein, 9 aa, Homo Sapiens
RPGVLVSSG

SEQ ID NO: 623250 - protein, 9 aa, Homo Sapiens
SRVRHHPSN

SEQ ID NO: 623251 - protein, 9 aa, Homo Sapiens
NFSELLCCQ

SEQ ID NO: 623252 - protein, 9 aa, Homo Sapiens
QEGLCGQCA

SEQ ID NO: 623253 - protein, 9 aa, Homo Sapiens
EPVAGERAL

SEQ ID NO: 623254 - protein, 9 aa, Homo Sapiens
QEPDSENIP

SEQ ID NO: 623255 - protein, 9 aa, Homo Sapiens
IGIDFKIRP

SEQ ID NO: 623256 - protein, 9 aa, Homo Sapiens
VPTIRVLHE

SEQ ID NO: 623257 - protein, 9 aa, Homo Sapiens
VTDLNVKRK

SEQ ID NO: 623258 - protein, 9 aa, Homo Sapiens
VGTRKLLVA

SEQ ID NO: 623259 - protein, 9 aa, Homo Sapiens
DQLFRCLQA

SEQ ID NO: 623260 - protein, 9 aa, Homo Sapiens
LNLSTRCSE

SEQ ID NO: 623261 - protein, 9 aa, Homo Sapiens
ILSRRVEAN

SEQ ID NO: 623262 - protein, 9 aa, Homo Sapiens
QDKMYSYSI

SEQ ID NO: 623263 - protein, 9 aa, Homo Sapiens
RKSILLLNF

SEQ ID NO: 623264 - protein, 9 aa, Homo Sapiens
TFRPGVLVS

SEQ ID NO: 623265 - protein, 9 aa, Homo Sapiens
LISRTKCAD

SEQ ID NO: 623266 - protein, 9 aa, Homo Sapiens
SQVNTILPA

SEQ ID NO: 623267 - protein, 9 aa, Homo Sapiens
PAGDEPAET

SEQ ID NO: 623268 - protein, 9 aa, Homo Sapiens
NRNVPRHPN

SEQ ID NO: 623269 - protein, 9 aa, Homo Sapiens
GPPGHQGNH

SEQ ID NO: 623270 - protein, 9 aa, Homo Sapiens
GIDFKIRPI

SEQ ID NO: 623271 - protein, 9 aa, Homo Sapiens
MLKFSGLYE

SEQ ID NO: 623272 - protein, 9 aa, Homo Sapiens
LVHSQERVL

SEQ ID NO: 623273 - protein, 9 aa, Homo Sapiens
NMGMKGQWH

SEQ ID NO: 623274 - protein, 9 aa, Homo Sapiens
SLLVLNVSV

SEQ ID NO: 623275 - protein, 9 aa, Homo Sapiens
VDQSWIWLD

SEQ ID NO: 623276 - protein, 9 aa, Homo Sapiens
GTRSVAVKI

SEQ ID NO: 623277 - protein, 9 aa, Homo Sapiens
KDSLRSKPF

SEQ ID NO: 623278 - protein, 9 aa, Homo Sapiens
AWDVVRAEI

SEQ ID NO: 623279 - protein, 9 aa, Homo Sapiens
SILEGQFAI

SEQ ID NO: 623280 - protein, 9 aa, Homo Sapiens
SSTSSPSTS

SEQ ID NO: 623281 - protein, 9 aa, Homo Sapiens
SRKSAPSTG

SEQ ID NO: 623282 - protein, 9 aa, Homo Sapiens
PDTCQNAQL

SEQ ID NO: 623283 - protein, 9 aa, Homo Sapiens
WELFCCDTC

SEQ ID NO: 623284 - protein, 9 aa, Homo Sapiens
LFLVHHLDN

SEQ ID NO: 623285 - protein, 9 aa, Homo Sapiens
MWTFLNYYT

SEQ ID NO: 623286 - protein, 9 aa, Homo Sapiens
IRPIELDGK

SEQ ID NO: 623287 - protein, 9 aa, Homo Sapiens
HSREGLVLC

SEQ ID NO: 623288 - protein, 9 aa, Homo Sapiens
GGWAAATRG

SEQ ID NO: 623289 - protein, 9 aa, Homo Sapiens
VALACLVGG

SEQ ID NO: 623290 - protein, 9 aa, Homo Sapiens
GKANEIVLI

SEQ ID NO: 623291 - protein, 9 aa, Homo Sapiens
FSRRSNLHI

SEQ ID NO: 623292 - protein, 9 aa, Homo Sapiens
VEANTQREV

SEQ ID NO: 623293 - protein, 9 aa, Homo Sapiens
VKLSDSAVY

SEQ ID NO: 623294 - protein, 9 aa, Homo Sapiens
KFSGLYEET

SEQ ID NO: 623295 - protein, 9 aa, Homo Sapiens
LVLNVSVMH

SEQ ID NO: 623296 - protein, 9 aa, Homo Sapiens
DIETDVLCS

SEQ ID NO: 623297 - protein, 9 aa, Homo Sapiens
LTAFALADT

SEQ ID NO: 623298 - protein, 9 aa, Homo Sapiens
VVAGQLVGT

SEQ ID NO: 623299 - protein, 9 aa, Homo Sapiens
INNFPYLEK

SEQ ID NO: 623300 - protein, 9 aa, Homo Sapiens
PPGHQGNHG

SEQ ID NO: 623301 - protein, 9 aa, Homo Sapiens
RYACQSHED

SEQ ID NO: 623302 - protein, 9 aa, Homo Sapiens
RGSDKCYTH

SEQ ID NO: 623303 - protein, 9 aa, Homo Sapiens
LVALGSRCD

SEQ ID NO: 623304 - protein, 9 aa, Homo Sapiens
HGGPFSRLQ

SEQ ID NO: 623305 - protein, 9 aa, Homo Sapiens
PAKYVWEQR

SEQ ID NO: 623306 - protein, 9 aa, Homo Sapiens
GDIDNAMWT

SEQ ID NO: 623307 - protein, 9 aa, Homo Sapiens
MVWCQRSRA

SEQ ID NO: 623308 - protein, 9 aa, Homo Sapiens
QTRRYISSD

SEQ ID NO: 623309 - protein, 9 aa, Homo Sapiens
RRILGVCGI

SEQ ID NO: 623310 - protein, 9 aa, Homo Sapiens
GVAHMIEWQ

SEQ ID NO: 623311 - protein, 9 aa, Homo Sapiens
PASCANHRD

SEQ ID NO: 623312 - protein, 9 aa, Homo Sapiens
ISDDNARLL

SEQ ID NO: 623313 - protein, 9 aa, Homo Sapiens
ESSEASLDG

SEQ ID NO: 623314 - protein, 9 aa, Homo Sapiens
QTTLLFSFP

SEQ ID NO: 623315 - protein, 9 aa, Homo Sapiens
DAAVSSLAA

SEQ ID NO: 623316 - protein, 9 aa, Homo Sapiens
HRLSEDMLS

SEQ ID NO: 623317 - protein, 9 aa, Homo Sapiens
EGQFATVYR

SEQ ID NO: 623318 - protein, 9 aa, Homo Sapiens
NGNHAAQTL

SEQ ID NO: 623319 - protein, 9 aa, Homo Sapiens
GLVRDVSRR

SEQ ID NO: 623320 - protein, 9 aa, Homo Sapiens
FFRGYGEIF

SEQ ID NO: 623321 - protein, 9 aa, Homo Sapiens
SQTRRYISS

SEQ ID NO: 623322 - protein, 9 aa, Homo Sapiens
SRRSNLHIH

SEQ ID NO: 623323 - protein, 9 aa, Homo Sapiens
TKKSLSKPA

SEQ ID NO: 623324 - protein, 9 aa, Homo Sapiens
LNVKRKAIH

SEQ ID NO: 623325 - protein, 9 aa, Homo Sapiens
QVEPLLLLC

SEQ ID NO: 623326 - protein, 9 aa, Homo Sapiens
VKPEPTNYS

SEQ ID NO: 623327 - protein, 9 aa, Homo Sapiens
VCACPGIDR

SEQ ID NO: 623328 - protein, 9 aa, Homo Sapiens
AAACEAGLS

SEQ ID NO: 623329 - protein, 9 aa, Homo Sapiens
DDLCKMTYL

SEQ ID NO: 623330 - protein, 9 aa, Homo Sapiens
RQDLLWTLQ

SEQ ID NO: 623331 - protein, 9 aa, Homo Sapiens
TVEGNNVVV

SEQ ID NO: 623332 - protein, 9 aa, Homo Sapiens
RNKVRIAET

SEQ ID NO: 623333 - protein, 9 aa, Homo Sapiens
GYPFWGGLY

SEQ ID NO: 623334 - protein, 9 aa, Homo Sapiens
QSSILEGQF

SEQ ID NO: 623335 - protein, 9 aa, Homo Sapiens
SRRVEANTQ

SEQ ID NO: 623336 - protein, 9 aa, Homo Sapiens
PFPSTIVAV

SEQ ID NO: 623337 - protein, 9 aa, Homo Sapiens
GQAEGQPVT

SEQ ID NO: 623338 - protein, 9 aa, Homo Sapiens
SNYSNSGVE

SEQ ID NO: 623339 - protein, 9 aa, Homo Sapiens
YLQPRSIEA

SEQ ID NO: 623340 - protein, 9 aa, Homo Sapiens
VDLMRCLRL

SEQ ID NO: 623341 - protein, 9 aa, Homo Sapiens
GERALTRVG

SEQ ID NO: 623342 - protein, 9 aa, Homo Sapiens
LHYASYVPT

SEQ ID NO: 623343 - protein, 9 aa, Homo Sapiens
FYSAIIWGK

SEQ ID NO: 623344 - protein, 9 aa, Homo Sapiens
NPPMYFFLS

SEQ ID NO: 623345 - protein, 9 aa, Homo Sapiens
KSILLLNFQ

SEQ ID NO: 623346 - protein, 9 aa, Homo Sapiens
LRNKVRIAE

SEQ ID NO: 623347 - protein, 9 aa, Homo Sapiens
WNLHVERNT

SEQ ID NO: 623348 - protein, 9 aa, Homo Sapiens
GGQAEGQPV

SEQ ID NO: 623349 - protein, 9 aa, Homo Sapiens
SAPAVVTMV

SEQ ID NO: 623350 - protein, 9 aa, Homo Sapiens
MCRLKLLEI

SEQ ID NO: 623351 - protein, 9 aa, Homo Sapiens
TASGYGNSY

SEQ ID NO: 623352 - protein, 9 aa, Homo Sapiens
CKECGKDFT

SEQ ID NO: 623353 - protein, 9 aa, Homo Sapiens
IWLDGSEVT

SEQ ID NO: 623354 - protein, 9 aa, Homo Sapiens
AVTGVVSLW

SEQ ID NO: 623355 - protein, 9 aa, Homo Sapiens
LFGGQAEGQ

SEQ ID NO: 623356 - protein, 9 aa, Homo Sapiens
GNGLESASQ

SEQ ID NO: 623357 - protein, 9 aa, Homo Sapiens
HLGFPERGW

SEQ ID NO: 623358 - protein, 9 aa, Homo Sapiens
RAVMKIRSA

SEQ ID NO: 623359 - protein, 9 aa, Homo Sapiens
PGKANEIVL

SEQ ID NO: 623360 - protein, 9 aa, Homo Sapiens
VLVSSGNKM

SEQ ID NO: 623361 - protein, 9 aa, Homo Sapiens
IKLLLHWIP

SEQ ID NO: 623362 - protein, 9 aa, Homo Sapiens
PLTLLLKTI

SEQ ID NO: 623363 - protein, 9 aa, Homo Sapiens
NSPQFNVNG

SEQ ID NO: 623364 - protein, 9 aa, Homo Sapiens
PGVLVSSGN

SEQ ID NO: 623365 - protein, 9 aa, Homo Sapiens
CLTELNMAG

SEQ ID NO: 623366 - protein, 9 aa, Homo Sapiens
LSLPLENTI

SEQ ID NO: 623367 - protein, 9 aa, Homo Sapiens
LSAIGLECF

SEQ ID NO: 623368 - protein, 9 aa, Homo Sapiens
AGTGDFAVV

SEQ ID NO: 623369 - protein, 9 aa, Homo Sapiens
GAGTGDFAV

SEQ ID NO: 623370 - protein, 9 aa, Homo Sapiens
APEFVPPPE

SEQ ID NO: 623371 - protein, 9 aa, Homo Sapiens
YSLAWRHGS

SEQ ID NO: 623372 - protein, 9 aa, Homo Sapiens
GPRAFSSCS

SEQ ID NO: 623373 - protein, 9 aa, Homo Sapiens
YRGPEEECD

SEQ ID NO: 623374 - protein, 9 aa, Homo Sapiens
IYPNRNVPR

SEQ ID NO: 623375 - protein, 9 aa, Homo Sapiens
QQIYRQQPS

SEQ ID NO: 623376 - protein, 9 aa, Homo Sapiens
RVRLKLKII

SEQ ID NO: 623377 - protein, 9 aa, Homo Sapiens
TAGLEEYSA

SEQ ID NO: 623378 - protein, 9 aa, Homo Sapiens
RDSDSFVNI

SEQ ID NO: 623379 - protein, 9 aa, Homo Sapiens
TPGNPLPPQ

SEQ ID NO: 623380 - protein, 9 aa, Homo Sapiens
IGTRSVAVK

SEQ ID NO: 623381 - protein, 9 aa, Homo Sapiens
NVMCTLLII

SEQ ID NO: 623382 - protein, 9 aa, Homo Sapiens
CFRVALACL

SEQ ID NO: 623383 - protein, 9 aa, Homo Sapiens
CSPQMALKL

SEQ ID NO: 623384 - protein, 9 aa, Homo Sapiens
SFATFNVMC

SEQ ID NO: 623385 - protein, 9 aa, Homo Sapiens
VGPPGSYGP

SEQ ID NO: 623386 - protein, 9 aa, Homo Sapiens
RGRPSAPAV

SEQ ID NO: 623387 - protein, 9 aa, Homo Sapiens
VAVEPVAGE

SEQ ID NO: 623388 - protein, 9 aa, Homo Sapiens
NLILLVKHL

SEQ ID NO: 623389 - protein, 9 aa, Homo Sapiens
CNKCCKAFT

SEQ ID NO: 623390 - protein, 9 aa, Homo Sapiens
EVRRLVIGF

SEQ ID NO: 623391 - protein, 9 aa, Homo Sapiens
SLQEALSIY

SEQ ID NO: 623392 - protein, 9 aa, Homo Sapiens
YCRWKDSLC

SEQ ID NO: 623393 - protein, 9 aa, Homo Sapiens
DVWLGGLPE

SEQ ID NO: 623394 - protein, 9 aa, Homo Sapiens
HRGYTDQAI

SEQ ID NO: 623395 - protein, 9 aa, Homo Sapiens
LKYGSQMES

SEQ ID NO: 623396 - protein, 9 aa, Homo Sapiens
CHCISRPSS

SEQ ID NO: 623397 - protein, 9 aa, Homo Sapiens
AGGTARVPS

SEQ ID NO: 623398 - protein, 9 aa, Homo Sapiens
GNACYMNSI

SEQ ID NO: 623399 - protein, 9 aa, Homo Sapiens
GAISTFTPE

SEQ ID NO: 623400 - protein, 9 aa, Homo Sapiens
IPSLPHSFL

SEQ ID NO: 623401 - protein, 9 aa, Homo Sapiens
KPSVKLSDS

SEQ ID NO: 623402 - protein, 9 aa, Homo Sapiens
PHGREPSYA

SEQ ID NO: 623403 - protein, 9 aa, Homo Sapiens
ECGKGFTAK

SEQ ID NO: 623404 - protein, 9 aa, Homo Sapiens
GNSYNSQSG

SEQ ID NO: 623405 - protein, 9 aa, Homo Sapiens
RGQSHCVKR

SEQ ID NO: 623406 - protein, 9 aa, Homo Sapiens
FAHTAIIYN

SEQ ID NO: 623407 - protein, 9 aa, Homo Sapiens
QSHCVKRTT

SEQ ID NO: 623408 - protein, 9 aa, Homo Sapiens
QDGSPQEEP

SEQ ID NO: 623409 - protein, 9 aa, Homo Sapiens
KYIAYRLIK

SEQ ID NO: 623410 - protein, 9 aa, Homo Sapiens
PDASKLNQN

SEQ ID NO: 623411 - protein, 9 aa, Homo Sapiens
IPLTLLLKT

SEQ ID NO: 623412 - protein, 9 aa, Homo Sapiens
EVCRDGWEL

SEQ ID NO: 623413 - protein, 9 aa, Homo Sapiens
DFTFSSTLN

SEQ ID NO: 623414 - protein, 9 aa, Homo Sapiens
SLLKHIRNN

SEQ ID NO: 623415 - protein, 9 aa, Homo Sapiens
EATLRNKVR

SEQ ID NO: 623416 - protein, 9 aa, Homo Sapiens
KLRGQSHCV

SEQ ID NO: 623417 - protein, 9 aa, Homo Sapiens
ETREAIVHR

SEQ ID NO: 623418 - protein, 9 aa, Homo Sapiens
PMPWETLLA

SEQ ID NO: 623419 - protein, 9 aa, Homo Sapiens
GLSQSSILE

SEQ ID NO: 623420 - protein, 9 aa, Homo Sapiens
DFRKNEDKL

SEQ ID NO: 623421 - protein, 9 aa, Homo Sapiens
RAQRAYRFV

SEQ ID NO: 623422 - protein, 9 aa, Homo Sapiens
WLYVGIVFS

SEQ ID NO: 623423 - protein, 9 aa, Homo Sapiens
STSSPSTSS

SEQ ID NO: 623424 - protein, 9 aa, Homo Sapiens
IARAVMKIR

SEQ ID NO: 623425 - protein, 9 aa, Homo Sapiens
ALACLVGGL

SEQ ID NO: 623426 - protein, 9 aa, Homo Sapiens
HLMELRNKD

SEQ ID NO: 623427 - protein, 9 aa, Homo Sapiens
SPCAWDVVR

SEQ ID NO: 623428 - protein, 9 aa, Homo Sapiens
AYSLMKLVL

SEQ ID NO: 623429 - protein, 9 aa, Homo Sapiens
RLKLLEISC

SEQ ID NO: 623430 - protein, 9 aa, Homo Sapiens
REVDLMRCL

SEQ ID NO: 623431 - protein, 9 aa, Homo Sapiens
TMWHQDQEG

SEQ ID NO: 623432 - protein, 9 aa, Homo Sapiens
SAAGGTARV

SEQ ID NO: 623433 - protein, 9 aa, Homo Sapiens
TTANYDNDD

SEQ ID NO: 623434 - protein, 9 aa, Homo Sapiens
RRAQRAYRF

SEQ ID NO: 623435 - protein, 9 aa, Homo Sapiens
CDRPPPGRL

SEQ ID NO: 623436 - protein, 9 aa, Homo Sapiens
GQVHGGPFS

SEQ ID NO: 623437 - protein, 9 aa, Homo Sapiens
ETPQHKPSV

SEQ ID NO: 623438 - protein, 9 aa, Homo Sapiens
NACYMNSIL

SEQ ID NO: 623439 - protein, 9 aa, Homo Sapiens
LGIGLGMDI

SEQ ID NO: 623440 - protein, 9 aa, Homo Sapiens
FWGGLYFII

SEQ ID NO: 623441 - protein, 9 aa, Homo Sapiens
SFSRKSAPS

SEQ ID NO: 623442 - protein, 9 aa, Homo Sapiens
LDQLFRCLQ

SEQ ID NO: 623443 - protein, 9 aa, Homo Sapiens
ALVGLEVRR

SEQ ID NO: 623444 - protein, 9 aa, Homo Sapiens
IGLGMDIVQ

SEQ ID NO: 623445 - protein, 9 aa, Homo Sapiens
KPEELDGEN

SEQ ID NO: 623446 - protein, 9 aa, Homo Sapiens
TDVLCSPQM

SEQ ID NO: 623447 - protein, 9 aa, Homo Sapiens
EELFLDNEL

SEQ ID NO: 623448 - protein, 9 aa, Homo Sapiens
FQFLLNFDH

SEQ ID NO: 623449 - protein, 9 aa, Homo Sapiens
QKDVFFGPK

SEQ ID NO: 623450 - protein, 9 aa, Homo Sapiens
APAVVTMVW

SEQ ID NO: 623451 - protein, 9 aa, Homo Sapiens
TAMGQGGVA

SEQ ID NO: 623452 - protein, 9 aa, Homo Sapiens
GQPVTNIMF

SEQ ID NO: 623453 - protein, 9 aa, Homo Sapiens
GDINNFPYL

SEQ ID NO: 623454 - protein, 9 aa, Homo Sapiens
THPYSPKVD

SEQ ID NO: 623455 - protein, 9 aa, Homo Sapiens
SPKVDGTRT

SEQ ID NO: 623456 - protein, 9 aa, Homo Sapiens
TSPKVVARR

SEQ ID NO: 623457 - protein, 9 aa, Homo Sapiens
KRKLELPTG

SEQ ID NO: 623458 - protein, 9 aa, Homo Sapiens
EKKPTPGNP

SEQ ID NO: 623459 - protein, 9 aa, Homo Sapiens
FFQPHGREP

SEQ ID NO: 623460 - protein, 9 aa, Homo Sapiens
KCADPMRAP

SEQ ID NO: 623461 - protein, 9 aa, Homo Sapiens
LYVGIVFSA

SEQ ID NO: 623462 - protein, 9 aa, Homo Sapiens
RVVTVLKKQ

SEQ ID NO: 623463 - protein, 9 aa, Homo Sapiens
WSTQNLYNN

SEQ ID NO: 623464 - protein, 9 aa, Homo Sapiens
DRRLLNHMR

SEQ ID NO: 623465 - protein, 9 aa, Homo Sapiens
PLFDSKDSM

SEQ ID NO: 623466 - protein, 9 aa, Homo Sapiens
VDGTRTPRD

SEQ ID NO: 623467 - protein, 9 aa, Homo Sapiens
LIRGGGGAC

SEQ ID NO: 623468 - protein, 9 aa, Homo Sapiens
HVERNTDLP

SEQ ID NO: 623469 - protein, 9 aa, Homo Sapiens
SSVWIAILL

SEQ ID NO: 623470 - protein, 9 aa, Homo Sapiens
PKVVARRFT

SEQ ID NO: 623471 - protein, 9 aa, Homo Sapiens
PPGRLIRGG

SEQ ID NO: 623472 - protein, 9 aa, Homo Sapiens
SPQEGRPNQ

SEQ ID NO: 623473 - protein, 9 aa, Homo Sapiens
TQSSGQDGS

SEQ ID NO: 623474 - protein, 9 aa, Homo Sapiens
CPPLGSTSQ

SEQ ID NO: 623475 - protein, 9 aa, Homo Sapiens
QLLTLENLL

SEQ ID NO: 623476 - protein, 9 aa, Homo Sapiens
SYGPVGEPG

SEQ ID NO: 623477 - protein, 9 aa, Homo Sapiens
CEVCRDGWE

SEQ ID NO: 623478 - protein, 9 aa, Homo Sapiens
GSPKTSPKV

SEQ ID NO: 623479 - protein, 9 aa, Homo Sapiens
TSWTPVPSQ

SEQ ID NO: 623480 - protein, 9 aa, Homo Sapiens
TTLLFSFPF

SEQ ID NO: 623481 - protein, 9 aa, Homo Sapiens
NQVQIPRER

SEQ ID NO: 623482 - protein, 9 aa, Homo Sapiens
AVPGKANEI

SEQ ID NO: 623483 - protein, 9 aa, Homo Sapiens
QPETPQHKP

SEQ ID NO: 623484 - protein, 9 aa, Homo Sapiens
MSAAVGSVA

SEQ ID NO: 623485 - protein, 9 aa, Homo Sapiens
PEVKDSLGA

SEQ ID NO: 623486 - protein, 9 aa, Homo Sapiens
KLLIRRTEL

SEQ ID NO: 623487 - protein, 9 aa, Homo Sapiens
RPSAPAVVT

SEQ ID NO: 623488 - protein, 9 aa, Homo Sapiens
RAGFPCSAR

SEQ ID NO: 623489 - protein, 9 aa, Homo Sapiens
SSPSTSSPS

SEQ ID NO: 623490 - protein, 9 aa, Homo Sapiens
NKQRLHCEY

SEQ ID NO: 623491 - protein, 9 aa, Homo Sapiens
LPWLRWLLW

SEQ ID NO: 623492 - protein, 9 aa, Homo Sapiens
TLRNKVRIA

SEQ ID NO: 623493 - protein, 9 aa, Homo Sapiens
IPEDILPDV

SEQ ID NO: 623494 - protein, 9 aa, Homo Sapiens
HRLGAHLDL

SEQ ID NO: 623495 - protein, 9 aa, Homo Sapiens
GHTIPQAHC

SEQ ID NO: 623496 - protein, 9 aa, Homo Sapiens
QVQIPRERS

SEQ ID NO: 623497 - protein, 9 aa, Homo Sapiens
LYGTPMKCF

SEQ ID NO: 623498 - protein, 9 aa, Homo Sapiens
PFMCMYLQP

SEQ ID NO: 623499 - protein, 9 aa, Homo Sapiens
SDGAISTFT

SEQ ID NO: 623500 - protein, 9 aa, Homo Sapiens
PMSEMYSIP

SEQ ID NO: 623501 - protein, 9 aa, Homo Sapiens
TDLPPEELE

SEQ ID NO: 623502 - protein, 9 aa, Homo Sapiens
EDCCGAPDN

SEQ ID NO: 623503 - protein, 9 aa, Homo Sapiens
VNIFPEKQV

SEQ ID NO: 623504 - protein, 9 aa, Homo Sapiens
AGAKPLQEE

SEQ ID NO: 623505 - protein, 9 aa, Homo Sapiens
IYTGEKPYE

SEQ ID NO: 623506 - protein, 9 aa, Homo Sapiens
LLLKTIILG

SEQ ID NO: 623507 - protein, 9 aa, Homo Sapiens
LGSVLYKNL

SEQ ID NO: 623508 - protein, 9 aa, Homo Sapiens
TCQNAQLCQ

SEQ ID NO: 623509 - protein, 9 aa, Homo Sapiens
LKTIILGKQ

SEQ ID NO: 623510 - protein, 9 aa, Homo Sapiens
YQQIYRQQP

SEQ ID NO: 623511 - protein, 9 aa, Homo Sapiens
FRKNEDKLN

SEQ ID NO: 623512 - protein, 9 aa, Homo Sapiens
FPDTCQNAQ

SEQ ID NO: 623513 - protein, 9 aa, Homo Sapiens
ELRSYSLAW

SEQ ID NO: 623514 - protein, 9 aa, Homo Sapiens
VNKSMYLTV

SEQ ID NO: 623515 - protein, 9 aa, Homo Sapiens
AEGQPVTNI

SEQ ID NO: 623516 - protein, 9 aa, Homo Sapiens
QRKRQQYWK

SEQ ID NO: 623517 - protein, 9 aa, Homo Sapiens
EGNNVVVKK

SEQ ID NO: 623518 - protein, 9 aa, Homo Sapiens
GLSPVYVKV

SEQ ID NO: 623519 - protein, 9 aa, Homo Sapiens
QRIYTGEKP

SEQ ID NO: 623520 - protein, 9 aa, Homo Sapiens
HWIPEDILP

SEQ ID NO: 623521 - protein, 9 aa, Homo Sapiens
DCCGAPDNS

SEQ ID NO: 623522 - protein, 9 aa, Homo Sapiens
FLVHHLDNN

SEQ ID NO: 623523 - protein, 9 aa, Homo Sapiens
VVPQEHGQH

SEQ ID NO: 623524 - protein, 9 aa, Homo Sapiens
KSLSKPAFF

SEQ ID NO: 623525 - protein, 9 aa, Homo Sapiens
DRETRPFPS

SEQ ID NO: 623526 - protein, 9 aa, Homo Sapiens
PFWGGLYFI

SEQ ID NO: 623527 - protein, 9 aa, Homo Sapiens
ELQQVDRRL

SEQ ID NO: 623528 - protein, 9 aa, Homo Sapiens
KTSPKVVAR

SEQ ID NO: 623529 - protein, 9 aa, Homo Sapiens
AEIWSPLGA

SEQ ID NO: 623530 - protein, 9 aa, Homo Sapiens
LAVKNKGFS

SEQ ID NO: 623531 - protein, 9 aa, Homo Sapiens
IYTVLLERL

SEQ ID NO: 623532 - protein, 9 aa, Homo Sapiens
EKIQPAFQE

SEQ ID NO: 623533 - protein, 9 aa, Homo Sapiens
AVAWWRGPA

SEQ ID NO: 623534 - protein, 9 aa, Homo Sapiens
GFEHTIEVY

SEQ ID NO: 623535 - protein, 9 aa, Homo Sapiens
VWLGGLPEN

SEQ ID NO: 623536 - protein, 9 aa, Homo Sapiens
SPQEEPPAE

SEQ ID NO: 623537 - protein, 9 aa, Homo Sapiens
WIPEDILPD

SEQ ID NO: 623538 - protein, 9 aa, Homo Sapiens
GLEEYSAMR

SEQ ID NO: 623539 - protein, 9 aa, Homo Sapiens
VPESGESSE

SEQ ID NO: 623540 - protein, 9 aa, Homo Sapiens
RKLLVAVEP

SEQ ID NO: 623541 - protein, 9 aa, Homo Sapiens
ANKIVQGSR

SEQ ID NO: 623542 - protein, 9 aa, Homo Sapiens
NARLLCFNG

SEQ ID NO: 623543 - protein, 9 aa, Homo Sapiens
VAGQLVGTR

SEQ ID NO: 623544 - protein, 9 aa, Homo Sapiens
VFAHTAIIY

SEQ ID NO: 623545 - protein, 9 aa, Homo Sapiens
MKCFVGQSK

SEQ ID NO: 623546 - protein, 9 aa, Homo Sapiens
GLVLCHCIS

SEQ ID NO: 623547 - protein, 9 aa, Homo Sapiens
YELPVGQVI

SEQ ID NO: 623548 - protein, 9 aa, Homo Sapiens
NSYNSQSGL

SEQ ID NO: 623549 - protein, 9 aa, Homo Sapiens
LEFAANHSS

SEQ ID NO: 623550 - protein, 9 aa, Homo Sapiens
LPGISISQR

SEQ ID NO: 623551 - protein, 9 aa, Homo Sapiens
VFLMLGSVL

SEQ ID NO: 623552 - protein, 9 aa, Homo Sapiens
YGGKSIPIT

SEQ ID NO: 623553 - protein, 9 aa, Homo Sapiens
ENVQEKVVD

SEQ ID NO: 623554 - protein, 9 aa, Homo Sapiens
GIGLGMDIV

SEQ ID NO: 623555 - protein, 9 aa, Homo Sapiens
GSPQEEPPA

SEQ ID NO: 623556 - protein, 9 aa, Homo Sapiens
IEAGAGAPA

SEQ ID NO: 623557 - protein, 9 aa, Homo Sapiens
KLLRKSPQE

SEQ ID NO: 623558 - protein, 9 aa, Homo Sapiens
ECGKDFTFS

SEQ ID NO: 623559 - protein, 9 aa, Homo Sapiens
QNYCRNPDD

SEQ ID NO: 623560 - protein, 9 aa, Homo Sapiens
VKTLPLFDS

SEQ ID NO: 623561 - protein, 9 aa, Homo Sapiens
MAPFPDYPT

SEQ ID NO: 623562 - protein, 9 aa, Homo Sapiens
ALTRVGALV

SEQ ID NO: 623563 - protein, 9 aa, Homo Sapiens
TRRYISSDT

SEQ ID NO: 623564 - protein, 9 aa, Homo Sapiens
EKPSVKLSD

SEQ ID NO: 623565 - protein, 9 aa, Homo Sapiens
GIHPHHQET

SEQ ID NO: 623566 - protein, 9 aa, Homo Sapiens
VKNLSPVIS

SEQ ID NO: 623567 - protein, 9 aa, Homo Sapiens
SVKLSDSAV

SEQ ID NO: 623568 - protein, 9 aa, Homo Sapiens
GVGGWAAAT

SEQ ID NO: 623569 - protein, 9 aa, Homo Sapiens
YFRDERRAQ

SEQ ID NO: 623570 - protein, 9 aa, Homo Sapiens
VLTQLREKL

SEQ ID NO: 623571 - protein, 9 aa, Homo Sapiens
PGVLSPPGS

SEQ ID NO: 623572 - protein, 9 aa, Homo Sapiens
QMKDAAVSS

SEQ ID NO: 623573 - protein, 9 aa, Homo Sapiens
AFSSCSYTS

SEQ ID NO: 623574 - protein, 9 aa, Homo Sapiens
GTRKSILLL

SEQ ID NO: 623575 - protein, 9 aa, Homo Sapiens
TFNKTLVTD

SEQ ID NO: 623576 - protein, 9 aa, Homo Sapiens
RSRATSASA

SEQ ID NO: 623577 - protein, 9 aa, Homo Sapiens
TQNSQTRRY

SEQ ID NO: 623578 - protein, 9 aa, Homo Sapiens
NVQEKVVDL

SEQ ID NO: 623579 - protein, 9 aa, Homo Sapiens
WLGGLPENF

SEQ ID NO: 623580 - protein, 9 aa, Homo Sapiens
GQFATVYRA

SEQ ID NO: 623581 - protein, 9 aa, Homo Sapiens
RLGIYTVLL

SEQ ID NO: 623582 - protein, 9 aa, Homo Sapiens
ECDVREVDL

SEQ ID NO: 623583 - protein, 9 aa, Homo Sapiens
QDQEGLCGQ

SEQ ID NO: 623584 - protein, 9 aa, Homo Sapiens
FSSCSYTSG

SEQ ID NO: 623585 - protein, 9 aa, Homo Sapiens
SSQTVPASA

SEQ ID NO: 623586 - protein, 9 aa, Homo Sapiens
ETDVLCSPQ

SEQ ID NO: 623587 - protein, 9 aa, Homo Sapiens
THGFEHTIE

SEQ ID NO: 623588 - protein, 9 aa, Homo Sapiens
LLWTLQPHQ

SEQ ID NO: 623589 - protein, 9 aa, Homo Sapiens
TDLNVKRKA

SEQ ID NO: 623590 - protein, 9 aa, Homo Sapiens
NGPGLLEED

SEQ ID NO: 623591 - protein, 9 aa, Homo Sapiens
KVGSGDINN

SEQ ID NO: 623592 - protein, 9 aa, Homo Sapiens
YISSDTSSN

SEQ ID NO: 623593 - protein, 9 aa, Homo Sapiens
FRCLQAPLE

SEQ ID NO: 623594 - protein, 9 aa, Homo Sapiens
LLHHLGFPE

SEQ ID NO: 623595 - protein, 9 aa, Homo Sapiens
TMVWCQRSR

SEQ ID NO: 623596 - protein, 9 aa, Homo Sapiens
VWCQRSRAT

SEQ ID NO: 623597 - protein, 9 aa, Homo Sapiens
PDFYVDMKW

SEQ ID NO: 623598 - protein, 9 aa, Homo Sapiens
TAIIWVVCP

SEQ ID NO: 623599 - protein, 9 aa, Homo Sapiens
VISNELLEQ

SEQ ID NO: 623600 - protein, 9 aa, Homo Sapiens
TLTKKSLSK

SEQ ID NO: 623601 - protein, 9 aa, Homo Sapiens
NTDLPPEEL

SEQ ID NO: 623602 - protein, 9 aa, Homo Sapiens
KTTSAGGES

SEQ ID NO: 623603 - protein, 9 aa, Homo Sapiens
GFNGLQHYE

SEQ ID NO: 623604 - protein, 9 aa, Homo Sapiens
LADTAVCVQ

SEQ ID NO: 623605 - protein, 9 aa, Homo Sapiens
IVQGSRRRL

SEQ ID NO: 623606 - protein, 9 aa, Homo Sapiens
FVLCNSLLQ

SEQ ID NO: 623607 - protein, 9 aa, Homo Sapiens
VDMKWEFTS

SEQ ID NO: 623608 - protein, 9 aa, Homo Sapiens
YLHSVTTLP

SEQ ID NO: 623609 - protein, 9 aa, Homo Sapiens
VGGWAAATR

SEQ ID NO: 623610 - protein, 9 aa, Homo Sapiens
CSTTANYDN

SEQ ID NO: 623611 - protein, 9 aa, Homo Sapiens
YHREVNGIH

SEQ ID NO: 623612 - protein, 9 aa, Homo Sapiens
RSATGNGLE

SEQ ID NO: 623613 - protein, 9 aa, Homo Sapiens
LSPVYVKVK

SEQ ID NO: 623614 - protein, 9 aa, Homo Sapiens
SPLKYGSQM

SEQ ID NO: 623615 - protein, 9 aa, Homo Sapiens
HEDTLVCRR

SEQ ID NO: 623616 - protein, 9 aa, Homo Sapiens
GTNGTFNKT

SEQ ID NO: 623617 - protein, 9 aa, Homo Sapiens
NQIFLCPNC

SEQ ID NO: 623618 - protein, 9 aa, Homo Sapiens
PEENLSLWL

SEQ ID NO: 623619 - protein, 9 aa, Homo Sapiens
NVPESGESS

SEQ ID NO: 623620 - protein, 9 aa, Homo Sapiens
YSSKRSKAP

SEQ ID NO: 623621 - protein, 9 aa, Homo Sapiens
GLECFQDNF

SEQ ID NO: 623622 - protein, 9 aa, Homo Sapiens
NIRSNDLFL

SEQ ID NO: 623623 - protein, 9 aa, Homo Sapiens
GMDIVQVTS

SEQ ID NO: 623624 - protein, 9 aa, Homo Sapiens
PESGESSEA

SEQ ID NO: 623625 - protein, 9 aa, Homo Sapiens
FVNIFPEKQ

SEQ ID NO: 623626 - protein, 9 aa, Homo Sapiens
DTAVCVQAV

SEQ ID NO: 623627 - protein, 9 aa, Homo Sapiens
MLVSPLKYG

SEQ ID NO: 623628 - protein, 9 aa, Homo Sapiens
FKIRPIELD

SEQ ID NO: 623629 - protein, 9 aa, Homo Sapiens
LCSPQMALK

SEQ ID NO: 623630 - protein, 9 aa, Homo Sapiens
FFIPFMCMY

SEQ ID NO: 623631 - protein, 9 aa, Homo Sapiens
FDHFYIPSL

SEQ ID NO: 623632 - protein, 9 aa, Homo Sapiens
IMAIGTRSV

SEQ ID NO: 623633 - protein, 9 aa, Homo Sapiens
KTIILGKQY

SEQ ID NO: 623634 - protein, 9 aa, Homo Sapiens
YSNGNHAAQ

SEQ ID NO: 623635 - protein, 9 aa, Homo Sapiens
IVHRLSEDM

SEQ ID NO: 623636 - protein, 9 aa, Homo Sapiens
SATGNGLES

SEQ ID NO: 623637 - protein, 9 aa, Homo Sapiens
VYRGPEEEC

SEQ ID NO: 623638 - protein, 9 aa, Homo Sapiens
AAREGALVA

SEQ ID NO: 623639 - protein, 9 aa, Homo Sapiens
FATFNVMCT

SEQ ID NO: 623640 - protein, 9 aa, Homo Sapiens
LTLLLKTII

SEQ ID NO: 623641 - protein, 9 aa, Homo Sapiens
QWSTQNLYN

SEQ ID NO: 623642 - protein, 9 aa, Homo Sapiens
ASKLNQNYC

SEQ ID NO: 623643 - protein, 9 aa, Homo Sapiens
KLHYASYVP

SEQ ID NO: 623644 - protein, 9 aa, Homo Sapiens
MPHPLIPVC

SEQ ID NO: 623645 - protein, 9 aa, Homo Sapiens
RRDSDSFVN

SEQ ID NO: 623646 - protein, 9 aa, Homo Sapiens
TCKVRGSDK

SEQ ID NO: 623647 - protein, 9 aa, Homo Sapiens
CDSAVRVQA

SEQ ID NO: 623648 - protein, 9 aa, Homo Sapiens
EAVAWWRGP

SEQ ID NO: 623649 - protein, 9 aa, Homo Sapiens
MGQGGVAHM

SEQ ID NO: 623650 - protein, 9 aa, Homo Sapiens
FRVALACLV

SEQ ID NO: 623651 - protein, 9 aa, Homo Sapiens
IKHARNNIM

SEQ ID NO: 623652 - protein, 9 aa, Homo Sapiens
GPVGPPGSY

SEQ ID NO: 623653 - protein, 9 aa, Homo Sapiens
KGTEVFLML

SEQ ID NO: 623654 - protein, 9 aa, Homo Sapiens
FNVNGPGLL

SEQ ID NO: 623655 - protein, 9 aa, Homo Sapiens
GLYEETCSD

SEQ ID NO: 623656 - protein, 9 aa, Homo Sapiens
VPASADVFS

SEQ ID NO: 623657 - protein, 9 aa, Homo Sapiens
HPSSMVTAI

SEQ ID NO: 623658 - protein, 9 aa, Homo Sapiens
APDFYVDMK

SEQ ID NO: 623659 - protein, 9 aa, Homo Sapiens
TLPGISISQ

SEQ ID NO: 623660 - protein, 9 aa, Homo Sapiens
HYQQIYRQQ

SEQ ID NO: 623661 - protein, 9 aa, Homo Sapiens
SQSSILEGQ

SEQ ID NO: 623662 - protein, 9 aa, Homo Sapiens
MWHQDQEGL

SEQ ID NO: 623663 - protein, 9 aa, Homo Sapiens
DFKIRPIEL

SEQ ID NO: 623664 - protein, 9 aa, Homo Sapiens
KSPQEGRPN

SEQ ID NO: 623665 - protein, 9 aa, Homo Sapiens
LILAENALQ

SEQ ID NO: 623666 - protein, 9 aa, Homo Sapiens
HQDQEGLCG

SEQ ID NO: 623667 - protein, 9 aa, Homo Sapiens
IPFMCMYLQ

SEQ ID NO: 623668 - protein, 9 aa, Homo Sapiens
LRKSPQEGR

SEQ ID NO: 623669 - protein, 9 aa, Homo Sapiens
FNGLQHYEL

SEQ ID NO: 623670 - protein, 9 aa, Homo Sapiens
DTCQNAQLC

SEQ ID NO: 623671 - protein, 9 aa, Homo Sapiens
SNDLFLVHH

SEQ ID NO: 623672 - protein, 9 aa, Homo Sapiens
NDVAAPDVP

SEQ ID NO: 623673 - protein, 9 aa, Homo Sapiens
TGRSVSRRE

SEQ ID NO: 623674 - protein, 9 aa, Homo Sapiens
EDKLILAEN

SEQ ID NO: 623675 - protein, 9 aa, Homo Sapiens
TQRKRQQYW

SEQ ID NO: 623676 - protein, 9 aa, Homo Sapiens
RGPEEECDM

SEQ ID NO: 623677 - protein, 9 aa, Homo Sapiens
IVFSAFCWH

SEQ ID NO: 623678 - protein, 9 aa, Homo Sapiens
LRATKLEEF

SEQ ID NO: 623679 - protein, 9 aa, Homo Sapiens
LPLRHFTLW

SEQ ID NO: 623680 - protein, 9 aa, Homo Sapiens
IPSSSQTVP

SEQ ID NO: 623681 - protein, 9 aa, Homo Sapiens
SQTVPASAD

SEQ ID NO: 623682 - protein, 9 aa, Homo Sapiens
GNHAAQTLE

SEQ ID NO: 623683 - protein, 9 aa, Homo Sapiens
YSAIIWGKI

SEQ ID NO: 623684 - protein, 9 aa, Homo Sapiens
DLLWTLQPH

SEQ ID NO: 623685 - protein, 9 aa, Homo Sapiens
ITRTCPPLG

SEQ ID NO: 623686 - protein, 9 aa, Homo Sapiens
VGSRVRHHP

SEQ ID NO: 623687 - protein, 9 aa, Homo Sapiens
GSDKCYTHP

SEQ ID NO: 623688 - protein, 9 aa, Homo Sapiens
TQNLYNNPV

SEQ ID NO: 623689 - protein, 9 aa, Homo Sapiens
SCANHRDSR

SEQ ID NO: 623690 - protein, 9 aa, Homo Sapiens
VHRLSEDML

SEQ ID NO: 623691 - protein, 9 aa, Homo Sapiens
PQLLTLENL

SEQ ID NO: 623692 - protein, 9 aa, Homo Sapiens
LTYSSKRSK

SEQ ID NO: 623693 - protein, 9 aa, Homo Sapiens
RERSQYKHM

SEQ ID NO: 623694 - protein, 9 aa, Homo Sapiens
QAIRGEAFD

SEQ ID NO: 623695 - protein, 9 aa, Homo Sapiens
RSYSLAWRH

SEQ ID NO: 623696 - protein, 9 aa, Homo Sapiens
NAKFDLGLD

SEQ ID NO: 623697 - protein, 9 aa, Homo Sapiens
AERVRSQLE

SEQ ID NO: 623698 - protein, 9 aa, Homo Sapiens
RFQELVPWI

SEQ ID NO: 623699 - protein, 9 aa, Homo Sapiens
YGTPMKCFV

SEQ ID NO: 623700 - protein, 9 aa, Homo Sapiens
LLCCQKDVF

SEQ ID NO: 623701 - protein, 9 aa, Homo Sapiens
ENPSPTVEG

SEQ ID NO: 623702 - protein, 9 aa, Homo Sapiens
ENLPLRHFT

SEQ ID NO: 623703 - protein, 9 aa, Homo Sapiens
CRDGWELFC

SEQ ID NO: 623704 - protein, 9 aa, Homo Sapiens
EKSYELPVG

SEQ ID NO: 623705 - protein, 9 aa, Homo Sapiens
AWWRGPAGP

SEQ ID NO: 623706 - protein, 9 aa, Homo Sapiens
QTPPLLLLL

SEQ ID NO: 623707 - protein, 9 aa, Homo Sapiens
RLTAFALAD

SEQ ID NO: 623708 - protein, 9 aa, Homo Sapiens
YTCKVRGSD

SEQ ID NO: 623709 - protein, 9 aa, Homo Sapiens
ACPGIDRRT

SEQ ID NO: 623710 - protein, 9 aa, Homo Sapiens
NDDRFGFCP

SEQ ID NO: 623711 - protein, 9 aa, Homo Sapiens
VVARRFTTR

SEQ ID NO: 623712 - protein, 9 aa, Homo Sapiens
LDLLVPLVE

SEQ ID NO: 623713 - protein, 9 aa, Homo Sapiens
NGTFNKTLV

SEQ ID NO: 623714 - protein, 9 aa, Homo Sapiens
ATLRNKVRI

SEQ ID NO: 623715 - protein, 9 aa, Homo Sapiens
AGLSPVYVK

SEQ ID NO: 623716 - protein, 9 aa, Homo Sapiens
LNPPMYFFL

SEQ ID NO: 623717 - protein, 9 aa, Homo Sapiens
HAATCSSSS

SEQ ID NO: 623718 - protein, 9 aa, Homo Sapiens
PSVKLSDSA

SEQ ID NO: 623719 - protein, 9 aa, Homo Sapiens
PLQEEGDPY

SEQ ID NO: 623720 - protein, 9 aa, Homo Sapiens
YVWEQRTSE

SEQ ID NO: 623721 - protein, 9 aa, Homo Sapiens
IDHTRVDEY

SEQ ID NO: 623722 - protein, 9 aa, Homo Sapiens
GSRDARWES

SEQ ID NO: 623723 - protein, 9 aa, Homo Sapiens
HSEEEETIG

SEQ ID NO: 623724 - protein, 9 aa, Homo Sapiens
WDVVRAEIM

SEQ ID NO: 623725 - protein, 9 aa, Homo Sapiens
TLLFSFPFC

SEQ ID NO: 623726 - protein, 9 aa, Homo Sapiens
AATRGRPSA

SEQ ID NO: 623727 - protein, 9 aa, Homo Sapiens
FQEKHAMKQ

SEQ ID NO: 623728 - protein, 9 aa, Homo Sapiens
GAYCIDAYN

SEQ ID NO: 623729 - protein, 9 aa, Homo Sapiens
TAFALADTA

SEQ ID NO: 623730 - protein, 9 aa, Homo Sapiens
DNSAVGFDY

SEQ ID NO: 623731 - protein, 9 aa, Homo Sapiens
DIDNAMWTF

SEQ ID NO: 623732 - protein, 9 aa, Homo Sapiens
FCGTFRPGV

SEQ ID NO: 623733 - protein, 9 aa, Homo Sapiens
PETPQHKPS

SEQ ID NO: 623734 - protein, 9 aa, Homo Sapiens
WHQDQEGLC

SEQ ID NO: 623735 - protein, 9 aa, Homo Sapiens
LPPMPWETL

SEQ ID NO: 623736 - protein, 9 aa, Homo Sapiens
LLYVFAHTA

SEQ ID NO: 623737 - protein, 9 aa, Homo Sapiens
LLNFDHFYI

SEQ ID NO: 623738 - protein, 9 aa, Homo Sapiens
YPFWGGLYF

SEQ ID NO: 623739 - protein, 9 aa, Homo Sapiens
VAWWRGPAG

SEQ ID NO: 623740 - protein, 9 aa, Homo Sapiens
EDSEEDCCG

SEQ ID NO: 623741 - protein, 9 aa, Homo Sapiens
PLLLLCLQQ

SEQ ID NO: 623742 - protein, 9 aa, Homo Sapiens
PVDHQELTR

SEQ ID NO: 623743 - protein, 9 aa, Homo Sapiens
DRPPPGRLI

SEQ ID NO: 623744 - protein, 9 aa, Homo Sapiens
IPITGATGF

SEQ ID NO: 623745 - protein, 9 aa, Homo Sapiens
GEPGPPGHQ

SEQ ID NO: 623746 - protein, 9 aa, Homo Sapiens
FHTPNSLLK

SEQ ID NO: 623747 - protein, 9 aa, Homo Sapiens
TAKRTLIIH

SEQ ID NO: 623748 - protein, 9 aa, Homo Sapiens
VGSSTRYCL

SEQ ID NO: 623749 - protein, 9 aa, Homo Sapiens
HQELTRDLE

SEQ ID NO: 623750 - protein, 9 aa, Homo Sapiens
SHCVKRTTL

SEQ ID NO: 623751 - protein, 9 aa, Homo Sapiens
DGSPQEEPP

SEQ ID NO: 623752 - protein, 9 aa, Homo Sapiens
FFLIFGNID

SEQ ID NO: 623753 - protein, 9 aa, Homo Sapiens
ARAVMKIRS

SEQ ID NO: 623754 - protein, 9 aa, Homo Sapiens
LAENALQSD

SEQ ID NO: 623755 - protein, 9 aa, Homo Sapiens
ESSVFVLGS

SEQ ID NO: 623756 - protein, 9 aa, Homo Sapiens
PGIDRRTEE

SEQ ID NO: 623757 - protein, 9 aa, Homo Sapiens
ETLAEDLMK

SEQ ID NO: 623758 - protein, 9 aa, Homo Sapiens
ANQVQIPRE

SEQ ID NO: 623759 - protein, 9 aa, Homo Sapiens
TECDVREVD

SEQ ID NO: 623760 - protein, 9 aa, Homo Sapiens
VAHKAEIWS

SEQ ID NO: 623761 - protein, 9 aa, Homo Sapiens
SYNSQSGLQ

SEQ ID NO: 623762 - protein, 9 aa, Homo Sapiens
GKDFTFSST

SEQ ID NO: 623763 - protein, 9 aa, Homo Sapiens
VGLEVRRLV

SEQ ID NO: 623764 - protein, 9 aa, Homo Sapiens
VEEDAYSLM

SEQ ID NO: 623765 - protein, 9 aa, Homo Sapiens
DLNVKRKAI

SEQ ID NO: 623766 - protein, 9 aa, Homo Sapiens
SISQRVTGL

SEQ ID NO: 623767 - protein, 9 aa, Homo Sapiens
NCGTRKSIL

SEQ ID NO: 623768 - protein, 9 aa, Homo Sapiens
KLLEISCNL

SEQ ID NO: 623769 - protein, 9 aa, Homo Sapiens
TPPLLLLLL

SEQ ID NO: 623770 - protein, 9 aa, Homo Sapiens
IPEENLSLW

SEQ ID NO: 623771 - protein, 9 aa, Homo Sapiens
IILFIVLLL

SEQ ID NO: 623772 - protein, 9 aa, Homo Sapiens
LVEFHLMEL

SEQ ID NO: 623773 - protein, 9 aa, Homo Sapiens
LGFPERGWP

SEQ ID NO: 623774 - protein, 9 aa, Homo Sapiens
KSIPITGAT

SEQ ID NO: 623775 - protein, 9 aa, Homo Sapiens
SRTLQVLHA

SEQ ID NO: 623776 - protein, 9 aa, Homo Sapiens
NFDHFYIPS

SEQ ID NO: 623777 - protein, 9 aa, Homo Sapiens
SVFVLGSVL

SEQ ID NO: 623778 - protein, 9 aa, Homo Sapiens
RRYISSDTS

SEQ ID NO: 623779 - protein, 9 aa, Homo Sapiens
CEAGLSPVY

SEQ ID NO: 623780 - protein, 9 aa, Homo Sapiens
QKNQKPAKY

SEQ ID NO: 623781 - protein, 9 aa, Homo Sapiens
ESGVGGWAA

SEQ ID NO: 623782 - protein, 9 aa, Homo Sapiens
PGRLIRGGG

SEQ ID NO: 623783 - protein, 9 aa, Homo Sapiens
SLCAKCTLI

SEQ ID NO: 623784 - protein, 9 aa, Homo Sapiens
MGMKGQWHY

SEQ ID NO: 623785 - protein, 9 aa, Homo Sapiens
TPSETPGPR

SEQ ID NO: 623786 - protein, 9 aa, Homo Sapiens
FQDNFSKFG

SEQ ID NO: 623787 - protein, 9 aa, Homo Sapiens
FIPFMCMYL

SEQ ID NO: 623788 - protein, 9 aa, Homo Sapiens
IPQAHCTKL

SEQ ID NO: 623789 - protein, 9 aa, Homo Sapiens
HEQLTYSSK

SEQ ID NO: 623790 - protein, 9 aa, Homo Sapiens
ISLKSPGEL

SEQ ID NO: 623791 - protein, 9 aa, Homo Sapiens
VQKLIPQLL

SEQ ID NO: 623792 - protein, 9 aa, Homo Sapiens
LCHCISRPS

SEQ ID NO: 623793 - protein, 9 aa, Homo Sapiens
PPMYFFLSN

SEQ ID NO: 623794 - protein, 9 aa, Homo Sapiens
SSVFVLGSV

SEQ ID NO: 623795 - protein, 9 aa, Homo Sapiens
RRSNLHIHQ

SEQ ID NO: 623796 - protein, 9 aa, Homo Sapiens
RETRPFPST

SEQ ID NO: 623797 - protein, 9 aa, Homo Sapiens
LLVLNVSVM

SEQ ID NO: 623798 - protein, 9 aa, Homo Sapiens
TRSFEGQAH

SEQ ID NO: 623799 - protein, 9 aa, Homo Sapiens
MGVSALEKQ

SEQ ID NO: 623800 - protein, 9 aa, Homo Sapiens
GALVALGSR

SEQ ID NO: 623801 - protein, 9 aa, Homo Sapiens
LFVLCNSLL

SEQ ID NO: 623802 - protein, 9 aa, Homo Sapiens
YGPVGEPGP

SEQ ID NO: 623803 - protein, 9 aa, Homo Sapiens
SVNVQVSVL

SEQ ID NO: 623804 - protein, 9 aa, Homo Sapiens
GSGDINNFP

SEQ ID NO: 623805 - protein, 9 aa, Homo Sapiens
ETCQFPDTC

SEQ ID NO: 623806 - protein, 9 aa, Homo Sapiens
QSWIWLDGS

SEQ ID NO: 623807 - protein, 9 aa, Homo Sapiens
GYGNSYNSQ

SEQ ID NO: 623808 - protein, 9 aa, Homo Sapiens
LESASQPGE

SEQ ID NO: 623809 - protein, 9 aa, Homo Sapiens
TRCSEMPQN

SEQ ID NO: 623810 - protein, 9 aa, Homo Sapiens
KSYELPVGQ

SEQ ID NO: 623811 - protein, 9 aa, Homo Sapiens
FKVGSGDIN

SEQ ID NO: 623812 - protein, 9 aa, Homo Sapiens
NRMYFLIGN

SEQ ID NO: 623813 - protein, 9 aa, Homo Sapiens
YVRAGFPCS

SEQ ID NO: 623814 - protein, 9 aa, Homo Sapiens
PVGPPGSYG

SEQ ID NO: 623815 - protein, 9 aa, Homo Sapiens
GLDLKDSQS

SEQ ID NO: 623816 - protein, 9 aa, Homo Sapiens
SQSDQIDLD

SEQ ID NO: 623817 - protein, 9 aa, Homo Sapiens
GGQVHGGPF

SEQ ID NO: 623818 - protein, 9 aa, Homo Sapiens
FRPASCANH

SEQ ID NO: 623819 - protein, 9 aa, Homo Sapiens
TPVPSQSSV

SEQ ID NO: 623820 - protein, 9 aa, Homo Sapiens
YHYQQIYRQ

SEQ ID NO: 623821 - protein, 9 aa, Homo Sapiens
LIKHARNNI

SEQ ID NO: 623822 - protein, 9 aa, Homo Sapiens
HLDLLVPLV

SEQ ID NO: 623823 - protein, 9 aa, Homo Sapiens
DMKWEFTSW

SEQ ID NO: 623824 - protein, 9 aa, Homo Sapiens
LQHYELLNG

SEQ ID NO: 623825 - protein, 9 aa, Homo Sapiens
NHSSVWIAI

SEQ ID NO: 623826 - protein, 9 aa, Homo Sapiens
ILLAILNMQ

SEQ ID NO: 623827 - protein, 9 aa, Homo Sapiens
HFTLWRGPV

SEQ ID NO: 623828 - protein, 9 aa, Homo Sapiens
SMKDSLRSK

SEQ ID NO: 623829 - protein, 9 aa, Homo Sapiens
TWYVVPQEH

SEQ ID NO: 623830 - protein, 9 aa, Homo Sapiens
DHFYIPSLP

SEQ ID NO: 623831 - protein, 9 aa, Homo Sapiens
KLLVAVEPV

SEQ ID NO: 623832 - protein, 9 aa, Homo Sapiens
QVVSENVQE

SEQ ID NO: 623833 - protein, 9 aa, Homo Sapiens
AIIWGKILQ

SEQ ID NO: 623834 - protein, 9 aa, Homo Sapiens
MGKMSAAVG

SEQ ID NO: 623835 - protein, 9 aa, Homo Sapiens
LLFSFPFCG

SEQ ID NO: 623836 - protein, 9 aa, Homo Sapiens
TSLNPPMYF

SEQ ID NO: 623837 - protein, 9 aa, Homo Sapiens
PQEHGQHLE

SEQ ID NO: 623838 - protein, 9 aa, Homo Sapiens
LLEISCNLR

SEQ ID NO: 623839 - protein, 9 aa, Homo Sapiens
LDYQYKLDF

SEQ ID NO: 623840 - protein, 9 aa, Homo Sapiens
MEDSEEDCC

SEQ ID NO: 623841 - protein, 9 aa, Homo Sapiens
AVFSTSWTP

SEQ ID NO: 623842 - protein, 9 aa, Homo Sapiens
NKCCKAFTV

SEQ ID NO: 623843 - protein, 9 aa, Homo Sapiens
KSPGELPSA

SEQ ID NO: 623844 - protein, 9 aa, Homo Sapiens
FLDNELSLP

SEQ ID NO: 623845 - protein, 9 aa, Homo Sapiens
FSFATFNVM

SEQ ID NO: 623846 - protein, 9 aa, Homo Sapiens
SHEDTLVCR

SEQ ID NO: 623847 - protein, 9 aa, Homo Sapiens
KLSDSAVYY

SEQ ID NO: 623848 - protein, 9 aa, Homo Sapiens
FLRATKLEE

SEQ ID NO: 623849 - protein, 9 aa, Homo Sapiens
LDILDTAGL

SEQ ID NO: 623850 - protein, 9 aa, Homo Sapiens
RAFSSCSYT

SEQ ID NO: 623851 - protein, 9 aa, Homo Sapiens
YGEIFANGN

SEQ ID NO: 623852 - protein, 9 aa, Homo Sapiens
KFHNRMYFL

SEQ ID NO: 623853 - protein, 9 aa, Homo Sapiens
VDRRLLNHM

SEQ ID NO: 623854 - protein, 9 aa, Homo Sapiens
PSTSSPSSS

SEQ ID NO: 623855 - protein, 9 aa, Homo Sapiens
GRPGLPQTP

SEQ ID NO: 623856 - protein, 9 aa, Homo Sapiens
DQAIRGEAF

SEQ ID NO: 623857 - protein, 9 aa, Homo Sapiens
LPTGPEVQT

SEQ ID NO: 623858 - protein, 9 aa, Homo Sapiens
CSEMPQNLS

SEQ ID NO: 623859 - protein, 9 aa, Homo Sapiens
SLKSPGELP

SEQ ID NO: 623860 - protein, 9 aa, Homo Sapiens
QHQRIYTGE

SEQ ID NO: 623861 - protein, 9 aa, Homo Sapiens
QNLYNNPVT

SEQ ID NO: 623862 - protein, 9 aa, Homo Sapiens
VSLFFIPFM

SEQ ID NO: 623863 - protein, 9 aa, Homo Sapiens
VLGSVLYKN

SEQ ID NO: 623864 - protein, 9 aa, Homo Sapiens
FVKPEELDG

SEQ ID NO: 623865 - protein, 9 aa, Homo Sapiens
LRGQSHCVK

SEQ ID NO: 623866 - protein, 9 aa, Homo Sapiens
AYRLIKHAR

SEQ ID NO: 623867 - protein, 9 aa, Homo Sapiens
QRSRATSAS

SEQ ID NO: 623868 - protein, 9 aa, Homo Sapiens
VGADVNKSM

SEQ ID NO: 623869 - protein, 9 aa, Homo Sapiens
RLLCFNGRV

SEQ ID NO: 623870 - protein, 9 aa, Homo Sapiens
LSQSSILEG

SEQ ID NO: 623871 - protein, 9 aa, Homo Sapiens
GMKGQWHYM

SEQ ID NO: 623872 - protein, 9 aa, Homo Sapiens
WWRGPAGPE

SEQ ID NO: 623873 - protein, 9 aa, Homo Sapiens
IYRQQPSTP

SEQ ID NO: 623874 - protein, 9 aa, Homo Sapiens
NSLLQLAQL

SEQ ID NO: 623875 - protein, 9 aa, Homo Sapiens
CRLKLLEIS

SEQ ID NO: 623876 - protein, 9 aa, Homo Sapiens
IDRRTEEEN

SEQ ID NO: 623877 - protein, 9 aa, Homo Sapiens
TVPASADVF

SEQ ID NO: 623878 - protein, 9 aa, Homo Sapiens
HSSVWIAIL

SEQ ID NO: 623879 - protein, 9 aa, Homo Sapiens
SWIWLDGSE

SEQ ID NO: 623880 - protein, 9 aa, Homo Sapiens
TIGSSASEE

SEQ ID NO: 623881 - protein, 9 aa, Homo Sapiens
LILLVKHLY

SEQ ID NO: 623882 - protein, 9 aa, Homo Sapiens
FPTHAPASC

SEQ ID NO: 623883 - protein, 9 aa, Homo Sapiens
GMSFSRRSN

SEQ ID NO: 623884 - protein, 9 aa, Homo Sapiens
NTILPALSR

SEQ ID NO: 623885 - protein, 9 aa, Homo Sapiens
VSRTLQVLH

SEQ ID NO: 623886 - protein, 9 aa, Homo Sapiens
CPHSTLRTP

SEQ ID NO: 623887 - protein, 9 aa, Homo Sapiens
TILPALSRC

SEQ ID NO: 623888 - protein, 9 aa, Homo Sapiens
HSVDQSWIW

SEQ ID NO: 623889 - protein, 9 aa, Homo Sapiens
TLPLFDSKD

SEQ ID NO: 623890 - protein, 9 aa, Homo Sapiens
NYSNSGVEL

SEQ ID NO: 623891 - protein, 9 aa, Homo Sapiens
PRERSQYKH

SEQ ID NO: 623892 - protein, 9 aa, Homo Sapiens
NQKPAKYVW

SEQ ID NO: 623893 - protein, 9 aa, Homo Sapiens
SLAALCSEY

SEQ ID NO: 623894 - protein, 9 aa, Homo Sapiens
TPNSLLKHI

SEQ ID NO: 623895 - protein, 9 aa, Homo Sapiens
DFAVVIVDP

SEQ ID NO: 623896 - protein, 9 aa, Homo Sapiens
VTSSLQHLR

SEQ ID NO: 623897 - protein, 9 aa, Homo Sapiens
ILLVKHLYH

SEQ ID NO: 623898 - protein, 9 aa, Homo Sapiens
WTPVPSQSS

SEQ ID NO: 623899 - protein, 9 aa, Homo Sapiens
GDFAVVIVD

SEQ ID NO: 623900 - protein, 9 aa, Homo Sapiens
PENFLPRAR

SEQ ID NO: 623901 - protein, 9 aa, Homo Sapiens
TGDFAVVIV

SEQ ID NO: 623902 - protein, 9 aa, Homo Sapiens
SGLYEETCS

SEQ ID NO: 623903 - protein, 9 aa, Homo Sapiens
EALLHHLGF

SEQ ID NO: 623904 - protein, 9 aa, Homo Sapiens
WLRWLLWLL

SEQ ID NO: 623905 - protein, 9 aa, Homo Sapiens
EISLKSPGE

SEQ ID NO: 623906 - protein, 9 aa, Homo Sapiens
LRGSNLTTH

SEQ ID NO: 623907 - protein, 9 aa, Homo Sapiens
FMCMYLQPP

SEQ ID NO: 623908 - protein, 9 aa, Homo Sapiens
RVLTQLREK

SEQ ID NO: 623909 - protein, 9 aa, Homo Sapiens
IQHQRIYTG

SEQ ID NO: 623910 - protein, 9 aa, Homo Sapiens
IVLLLSTII

SEQ ID NO: 623911 - protein, 9 aa, Homo Sapiens
AIGTRSVAV

SEQ ID NO: 623912 - protein, 9 aa, Homo Sapiens
FYGGKSIPI

SEQ ID NO: 623913 - protein, 9 aa, Homo Sapiens
LQQVDRRLL

SEQ ID NO: 623914 - protein, 9 aa, Homo Sapiens
GSYGPVGEP

SEQ ID NO: 623915 - protein, 9 aa, Homo Sapiens
NLHVERNTD

SEQ ID NO: 623916 - protein, 9 aa, Homo Sapiens
LLCFNGRVV

SEQ ID NO: 623917 - protein, 9 aa, Homo Sapiens
LLLLCLQQG

SEQ ID NO: 623918 - protein, 9 aa, Homo Sapiens
SDDNARLLC

SEQ ID NO: 623919 - protein, 9 aa, Homo Sapiens
TDQAIRGEA

SEQ ID NO: 623920 - protein, 9 aa, Homo Sapiens
QQMAPFPDY

SEQ ID NO: 623921 - protein, 9 aa, Homo Sapiens
NRNLVDHHR

SEQ ID NO: 623922 - protein, 9 aa, Homo Sapiens
VSFSRKSAP

SEQ ID NO: 623923 - protein, 9 aa, Homo Sapiens
SSGQDGSPQ

SEQ ID NO: 623924 - protein, 9 aa, Homo Sapiens
PGLRGPSGV

SEQ ID NO: 623925 - protein, 9 aa, Homo Sapiens
VPWLYVGIV

SEQ ID NO: 623926 - protein, 9 aa, Homo Sapiens
SGPMSEMYS

SEQ ID NO: 623927 - protein, 9 aa, Homo Sapiens
HGREPSYAR

SEQ ID NO: 623928 - protein, 9 aa, Homo Sapiens
WVVCPHSTL

SEQ ID NO: 623929 - protein, 9 aa, Homo Sapiens
VALGSRCDR

SEQ ID NO: 623930 - protein, 9 aa, Homo Sapiens
RILGVCGIH

SEQ ID NO: 623931 - protein, 9 aa, Homo Sapiens
DNARLLCFN

SEQ ID NO: 623932 - protein, 9 aa, Homo Sapiens
ERVRSQLEP

SEQ ID NO: 623933 - protein, 9 aa, Homo Sapiens
THEAVAWWR

SEQ ID NO: 623934 - protein, 9 aa, Homo Sapiens
LLCLQQGQL

SEQ ID NO: 623935 - protein, 9 aa, Homo Sapiens
STTANYDND

SEQ ID NO: 623936 - protein, 9 aa, Homo Sapiens
PCIFVYLHS

SEQ ID NO: 623937 - protein, 9 aa, Homo Sapiens
GDEPAETPS

SEQ ID NO: 623938 - protein, 9 aa, Homo Sapiens
SDKCYTHPS

SEQ ID NO: 623939 - protein, 9 aa, Homo Sapiens
NWYHREVNG

SEQ ID NO: 623940 - protein, 9 aa, Homo Sapiens
YFIISGSLS

SEQ ID NO: 623941 - protein, 9 aa, Homo Sapiens
RTHPYSPKV

SEQ ID NO: 623942 - protein, 9 aa, Homo Sapiens
SCVKRKTTS

SEQ ID NO: 623943 - protein, 9 aa, Homo Sapiens
CQFPDTCQN

SEQ ID NO: 623944 - protein, 9 aa, Homo Sapiens
WKPKKQGST

SEQ ID NO: 623945 - protein, 9 aa, Homo Sapiens
PCAWDVVRA

SEQ ID NO: 623946 - protein, 9 aa, Homo Sapiens
GLPQTPPLL

SEQ ID NO: 623947 - protein, 9 aa, Homo Sapiens
EDITRSFEG

SEQ ID NO: 623948 - protein, 9 aa, Homo Sapiens
VQTTLLFSF

SEQ ID NO: 623949 - protein, 9 aa, Homo Sapiens
RADTSLNPP

SEQ ID NO: 623950 - protein, 9 aa, Homo Sapiens
YFQIEKALV

SEQ ID NO: 623951 - protein, 9 aa, Homo Sapiens
LGSRCDRPP

SEQ ID NO: 623952 - protein, 9 aa, Homo Sapiens
SVDQSWIWL

SEQ ID NO: 623953 - protein, 9 aa, Homo Sapiens
VMKIRSAEG

SEQ ID NO: 623954 - protein, 9 aa, Homo Sapiens
AVEEDAYSL

SEQ ID NO: 623955 - protein, 9 aa, Homo Sapiens
LNMQSAEGR

SEQ ID NO: 623956 - protein, 9 aa, Homo Sapiens
SIKSVEKED

SEQ ID NO: 623957 - protein, 9 aa, Homo Sapiens
PAETPSETP

SEQ ID NO: 623958 - protein, 9 aa, Homo Sapiens
QEALSIYGG

SEQ ID NO: 623959 - protein, 9 aa, Homo Sapiens
SSCSYTSGP

SEQ ID NO: 623960 - protein, 9 aa, Homo Sapiens
TSFRPASCA

SEQ ID NO: 623961 - protein, 9 aa, Homo Sapiens
VGALVGLEV

SEQ ID NO: 623962 - protein, 9 aa, Homo Sapiens
WTFFLRATK

SEQ ID NO: 623963 - protein, 9 aa, Homo Sapiens
SGDINNFPY

SEQ ID NO: 623964 - protein, 9 aa, Homo Sapiens
GQLVGTRKL

SEQ ID NO: 623965 - protein, 9 aa, Homo Sapiens
NVKRKAIHE

SEQ ID NO: 623966 - protein, 9 aa, Homo Sapiens
GQSHCVKRT

SEQ ID NO: 623967 - protein, 9 aa, Homo Sapiens
ILNMQSAEG

SEQ ID NO: 623968 - protein, 9 aa, Homo Sapiens
IWVVCPHST

SEQ ID NO: 623969 - protein, 9 aa, Homo Sapiens
SQLEPTPGR

SEQ ID NO: 623970 - protein, 9 aa, Homo Sapiens
HPLIPVCLP

SEQ ID NO: 623971 - protein, 9 aa, Homo Sapiens
DSFVNIFPE

SEQ ID NO: 623972 - protein, 9 aa, Homo Sapiens
EECDMLDPG

SEQ ID NO: 623973 - protein, 9 aa, Homo Sapiens
QQYWKPKKQ

SEQ ID NO: 623974 - protein, 9 aa, Homo Sapiens
PPMTIYTEK

SEQ ID NO: 623975 - protein, 9 aa, Homo Sapiens
IITRTCPPL

SEQ ID NO: 623976 - protein, 9 aa, Homo Sapiens
SAGGESALA

SEQ ID NO: 623977 - protein, 9 aa, Homo Sapiens
VLNVSVMHK

SEQ ID NO: 623978 - protein, 9 aa, Homo Sapiens
PQTPPLLLL

SEQ ID NO: 623979 - protein, 9 aa, Homo Sapiens
QLTYSSKRS

SEQ ID NO: 623980 - protein, 9 aa, Homo Sapiens
VATVQTTLL

SEQ ID NO: 623981 - protein, 9 aa, Homo Sapiens
SIQPETPQH

SEQ ID NO: 623982 - protein, 9 aa, Homo Sapiens
SSCSSRLAA

SEQ ID NO: 623983 - protein, 9 aa, Homo Sapiens
VSRREKVRE

SEQ ID NO: 623984 - protein, 9 aa, Homo Sapiens
LVGTRKLLV

SEQ ID NO: 623985 - protein, 9 aa, Homo Sapiens
QFVKPEELD

SEQ ID NO: 623986 - protein, 9 aa, Homo Sapiens
AWRHGSTEP

SEQ ID NO: 623987 - protein, 9 aa, Homo Sapiens
DITRSFEGQ

SEQ ID NO: 623988 - protein, 9 aa, Homo Sapiens
FFKVGSGDI

SEQ ID NO: 623989 - protein, 9 aa, Homo Sapiens
TSAGGESAL

SEQ ID NO: 623990 - protein, 9 aa, Homo Sapiens
SIPITGATG

SEQ ID NO: 623991 - protein, 9 aa, Homo Sapiens
PPGSYGPVG

SEQ ID NO: 623992 - protein, 9 aa, Homo Sapiens
SNLTTHRKL

SEQ ID NO: 623993 - protein, 9 aa, Homo Sapiens
QPVTNIMFL

SEQ ID NO: 623994 - protein, 9 aa, Homo Sapiens
PVAGERALT

SEQ ID NO: 623995 - protein, 9 aa, Homo Sapiens
TREAIVHRL

SEQ ID NO: 623996 - protein, 9 aa, Homo Sapiens
SPGELPSAS

SEQ ID NO: 623997 - protein, 9 aa, Homo Sapiens
RFVVGSRVR

SEQ ID NO: 623998 - protein, 9 aa, Homo Sapiens
DEPAETPSE

SEQ ID NO: 623999 - protein, 9 aa, Homo Sapiens
RQRVLLYVF

SEQ ID NO: 624000 - protein, 9 aa, Homo Sapiens
DGWELFCCD

SEQ ID NO: 624001 - protein, 9 aa, Homo Sapiens
YACQSHEDT

SEQ ID NO: 624002 - protein, 9 aa, Homo Sapiens
DQWSTQNLY

SEQ ID NO: 624003 - protein, 9 aa, Homo Sapiens
ERSQYKHMG

SEQ ID NO: 624004 - protein, 9 aa, Homo Sapiens
WTLQPHQAP

SEQ ID NO: 624005 - protein, 9 aa, Homo Sapiens
EMYSIPVNN

SEQ ID NO: 624006 - protein, 9 aa, Homo Sapiens
EPLLLLCLQ

SEQ ID NO: 624007 - protein, 9 aa, Homo Sapiens
RPPPGRLIR

SEQ ID NO: 624008 - protein, 9 aa, Homo Sapiens
PWLRWLLWL

SEQ ID NO: 624009 - protein, 9 aa, Homo Sapiens
RLVIGFGAA

SEQ ID NO: 624010 - protein, 9 aa, Homo Sapiens
CDVREVDLM

SEQ ID NO: 624011 - protein, 9 aa, Homo Sapiens
LIGNLALCD

SEQ ID NO: 624012 - protein, 9 aa, Homo Sapiens
DFFQWDDLC

SEQ ID NO: 624013 - protein, 9 aa, Homo Sapiens
QHLRGSNLT

SEQ ID NO: 624014 - protein, 9 aa, Homo Sapiens
VGQVITIGN

SEQ ID NO: 624015 - protein, 9 aa, Homo Sapiens
QIDLNQIFL

SEQ ID NO: 624016 - protein, 9 aa, Homo Sapiens
SSMKDSLRS

SEQ ID NO: 624017 - protein, 9 aa, Homo Sapiens
RGYTDQAIR

SEQ ID NO: 624018 - protein, 9 aa, Homo Sapiens
TIPQAHCTK

SEQ ID NO: 624019 - protein, 9 aa, Homo Sapiens
SGYGNSYNS

SEQ ID NO: 624020 - protein, 9 aa, Homo Sapiens
LFRCLQAPL

SEQ ID NO: 624021 - protein, 9 aa, Homo Sapiens
AHRGYTDQA

SEQ ID NO: 624022 - protein, 9 aa, Homo Sapiens
EIFANGNRW

SEQ ID NO: 624023 - protein, 9 aa, Homo Sapiens
RGSNLTTHR

SEQ ID NO: 624024 - protein, 9 aa, Homo Sapiens
KANEIVLIE

SEQ ID NO: 624025 - protein, 9 aa, Homo Sapiens
IGSSASEES

SEQ ID NO: 624026 - protein, 9 aa, Homo Sapiens
SLGAYCIDA

SEQ ID NO: 624027 - protein, 9 aa, Homo Sapiens
ACEAGLSPV

SEQ ID NO: 624028 - protein, 9 aa, Homo Sapiens
IPRERSQYK

SEQ ID NO: 624029 - protein, 9 aa, Homo Sapiens
LESQHYFQI

SEQ ID NO: 624030 - protein, 9 aa, Homo Sapiens
MKDSLRSKP

SEQ ID NO: 624031 - protein, 9 aa, Homo Sapiens
ADTSLNPPM

SEQ ID NO: 624032 - protein, 9 aa, Homo Sapiens
REAIVHRLS

SEQ ID NO: 624033 - protein, 9 aa, Homo Sapiens
SLAWRHGST

SEQ ID NO: 624034 - protein, 9 aa, Homo Sapiens
LFFIPFMCM

SEQ ID NO: 624035 - protein, 9 aa, Homo Sapiens
NDVGADVNK

SEQ ID NO: 624036 - protein, 9 aa, Homo Sapiens
MNMGMKGQW

SEQ ID NO: 624037 - protein, 9 aa, Homo Sapiens
HSDGAISTF

SEQ ID NO: 624038 - protein, 9 aa, Homo Sapiens
NKVRIAETW

SEQ ID NO: 624039 - protein, 9 aa, Homo Sapiens
SIDHTRVDE

SEQ ID NO: 624040 - protein, 9 aa, Homo Sapiens
TNGTFNKTL

SEQ ID NO: 624041 - protein, 9 aa, Homo Sapiens
SCSYTSGPG

SEQ ID NO: 624042 - protein, 9 aa, Homo Sapiens
VAAPDVPKV

SEQ ID NO: 624043 - protein, 9 aa, Homo Sapiens
FPSTIVAVE

SEQ ID NO: 624044 - protein, 9 aa, Homo Sapiens
LHAATCSSS

SEQ ID NO: 624045 - protein, 9 aa, Homo Sapiens
QNSQTRRYI

SEQ ID NO: 624046 - protein, 9 aa, Homo Sapiens
PHPLIPVCL

SEQ ID NO: 624047 - protein, 9 aa, Homo Sapiens
LVHHLDNNE

SEQ ID NO: 624048 - protein, 9 aa, Homo Sapiens
PGSYGPVGE

SEQ ID NO: 624049 - protein, 9 aa, Homo Sapiens
EIENLPLRH

SEQ ID NO: 624050 - protein, 9 aa, Homo Sapiens
GTFRPGVLV

SEQ ID NO: 624051 - protein, 9 aa, Homo Sapiens
KFDLGLDLK

SEQ ID NO: 624052 - protein, 9 aa, Homo Sapiens
TINHDAPWH

SEQ ID NO: 624053 - protein, 9 aa, Homo Sapiens
SYSIDHTRV

SEQ ID NO: 624054 - protein, 9 aa, Homo Sapiens
DVSRRYPHY

SEQ ID NO: 624055 - protein, 9 aa, Homo Sapiens
VPWIFQFLL

SEQ ID NO: 624056 - protein, 9 aa, Homo Sapiens
MELRNKDTN

SEQ ID NO: 624057 - protein, 9 aa, Homo Sapiens
NPSPTVEGN

SEQ ID NO: 624058 - protein, 9 aa, Homo Sapiens
PEEECDMLD

SEQ ID NO: 624059 - protein, 9 aa, Homo Sapiens
TIWRFQELV

SEQ ID NO: 624060 - protein, 9 aa, Homo Sapiens
NKSMYLTVK

SEQ ID NO: 624061 - protein, 9 aa, Homo Sapiens
PHSTLRTPM

SEQ ID NO: 624062 - protein, 9 aa, Homo Sapiens
SPQFNVNGP

SEQ ID NO: 624063 - protein, 9 aa, Homo Sapiens
KVVARRFTT

SEQ ID NO: 624064 - protein, 9 aa, Homo Sapiens
VYSNGNHAA

SEQ ID NO: 624065 - protein, 9 aa, Homo Sapiens
PALKVTHFK

SEQ ID NO: 624066 - protein, 9 aa, Homo Sapiens
APDVPKVKI

SEQ ID NO: 624067 - protein, 9 aa, Homo Sapiens
LGIYTVLLE

SEQ ID NO: 624068 - protein, 9 aa, Homo Sapiens
LFSFATFNV

SEQ ID NO: 624069 - protein, 9 aa, Homo Sapiens
TYSSKRSKA

SEQ ID NO: 624070 - protein, 9 aa, Homo Sapiens
KYSPCAWDV

SEQ ID NO: 624071 - protein, 9 aa, Homo Sapiens
GNCGTRKSI

SEQ ID NO: 624072 - protein, 9 aa, Homo Sapiens
IGLECFQDN

SEQ ID NO: 624073 - protein, 9 aa, Homo Sapiens
CQSHEDTLV

SEQ ID NO: 624074 - protein, 9 aa, Homo Sapiens
VDGSDEHNF

SEQ ID NO: 624075 - protein, 9 aa, Homo Sapiens
EEECDMLDP

SEQ ID NO: 624076 - protein, 9 aa, Homo Sapiens
NIKLFVLCN

SEQ ID NO: 624077 - protein, 9 aa, Homo Sapiens
KLKIILCFS

SEQ ID NO: 624078 - protein, 9 aa, Homo Sapiens
PYSPKVDGT

SEQ ID NO: 624079 - protein, 9 aa, Homo Sapiens
GAERVRSQL

SEQ ID NO: 624080 - protein, 9 aa, Homo Sapiens
ILNLSTRCS

SEQ ID NO: 624081 - protein, 9 aa, Homo Sapiens
IQPAFQEKH

SEQ ID NO: 624082 - protein, 9 aa, Homo Sapiens
LVGLEVRRL

SEQ ID NO: 624083 - protein, 9 aa, Homo Sapiens
EQFVKPEEL

SEQ ID NO: 624084 - protein, 9 aa, Homo Sapiens
LLERLTGAD

SEQ ID NO: 624085 - protein, 9 aa, Homo Sapiens
RPFPSTIVA

SEQ ID NO: 624086 - protein, 9 aa, Homo Sapiens
CACPGIDRR

SEQ ID NO: 624087 - protein, 9 aa, Homo Sapiens
LPKGTEVFL

SEQ ID NO: 624088 - protein, 9 aa, Homo Sapiens
ATCWQAEHP

SEQ ID NO: 624089 - protein, 9 aa, Homo Sapiens
GYTDQAIRG

SEQ ID NO: 624090 - protein, 9 aa, Homo Sapiens
SWTPVPSQS

SEQ ID NO: 624091 - protein, 9 aa, Homo Sapiens
QSHEDTLVC

SEQ ID NO: 624092 - protein, 9 aa, Homo Sapiens
DERRAQRAY

SEQ ID NO: 624093 - protein, 9 aa, Homo Sapiens
ETIWRFQEL

SEQ ID NO: 624094 - protein, 9 aa, Homo Sapiens
QEGRPNQSL

SEQ ID NO: 624095 - protein, 9 aa, Homo Sapiens
SSLQHLRGS

SEQ ID NO: 624096 - protein, 9 aa, Homo Sapiens
DQEATLRNK

SEQ ID NO: 624097 - protein, 9 aa, Homo Sapiens
NKTLVTDNN

SEQ ID NO: 624098 - protein, 9 aa, Homo Sapiens
QELVPWIFQ

SEQ ID NO: 624099 - protein, 9 aa, Homo Sapiens
PDTGFNGLQ

SEQ ID NO: 624100 - protein, 9 aa, Homo Sapiens
GLEVRRLVI

SEQ ID NO: 624101 - protein, 9 aa, Homo Sapiens
DLMKLLIRR

SEQ ID NO: 624102 - protein, 9 aa, Homo Sapiens
IIDSQVNTI

SEQ ID NO: 624103 - protein, 9 aa, Homo Sapiens
CIFVYLHSV

SEQ ID NO: 624104 - protein, 9 aa, Homo Sapiens
PSGVPGLQG

SEQ ID NO: 624105 - protein, 9 aa, Homo Sapiens
ACQSHEDTL

SEQ ID NO: 624106 - protein, 9 aa, Homo Sapiens
QVNTILPAL

SEQ ID NO: 624107 - protein, 9 aa, Homo Sapiens
HNFPTHAPA

SEQ ID NO: 624108 - protein, 9 aa, Homo Sapiens
QVAHKAEIW

SEQ ID NO: 624109 - protein, 9 aa, Homo Sapiens
QPAFQEKHA

SEQ ID NO: 624110 - protein, 9 aa, Homo Sapiens
GVSALEKQE

SEQ ID NO: 624111 - protein, 9 aa, Homo Sapiens
ALEKQEPDS

SEQ ID NO: 624112 - protein, 9 aa, Homo Sapiens
VKQNGSSCS

SEQ ID NO: 624113 - protein, 9 aa, Homo Sapiens
ATFNVMCTL

SEQ ID NO: 624114 - protein, 9 aa, Homo Sapiens
ALSIYGGNS

SEQ ID NO: 624115 - protein, 9 aa, Homo Sapiens
EALSIYGGN

SEQ ID NO: 624116 - protein, 9 aa, Homo Sapiens
VTVLKKQRR

SEQ ID NO: 624117 - protein, 9 aa, Homo Sapiens
ALADTAVCV

SEQ ID NO: 624118 - protein, 9 aa, Homo Sapiens
LMKLLIRRT

SEQ ID NO: 624119 - protein, 9 aa, Homo Sapiens
RWKDSLCAK

SEQ ID NO: 624120 - protein, 9 aa, Homo Sapiens
YSPKVDGTR

SEQ ID NO: 624121 - protein, 9 aa, Homo Sapiens
LSRRVEANT

SEQ ID NO: 624122 - protein, 9 aa, Homo Sapiens
INHDAPWHT

SEQ ID NO: 624123 - protein, 9 aa, Homo Sapiens
NPMNKQRLH

SEQ ID NO: 624124 - protein, 9 aa, Homo Sapiens
AFFQPHGRE

SEQ ID NO: 624125 - protein, 9 aa, Homo Sapiens
NFPTHAPAS

SEQ ID NO: 624126 - protein, 9 aa, Homo Sapiens
KNLSPVISN

SEQ ID NO: 624127 - protein, 9 aa, Homo Sapiens
LLRKSPQEG

SEQ ID NO: 624128 - protein, 9 aa, Homo Sapiens
ACLVGGLVP

SEQ ID NO: 624129 - protein, 9 aa, Homo Sapiens
AVKNKGFSV

SEQ ID NO: 624130 - protein, 9 aa, Homo Sapiens
KILSRRVEA

SEQ ID NO: 624131 - protein, 9 aa, Homo Sapiens
PEKKPTPGN

SEQ ID NO: 624132 - protein, 9 aa, Homo Sapiens
RVLLYVFAH

SEQ ID NO: 624133 - protein, 9 aa, Homo Sapiens
YSVEVSPDI

SEQ ID NO: 624134 - protein, 9 aa, Homo Sapiens
YRQQPSTPR

SEQ ID NO: 624135 - protein, 9 aa, Homo Sapiens
VVSENVQEK

SEQ ID NO: 624136 - protein, 9 aa, Homo Sapiens
RVRHHPSNK

SEQ ID NO: 624137 - protein, 9 aa, Homo Sapiens
HLEKPSVKL

SEQ ID NO: 624138 - protein, 9 aa, Homo Sapiens
VRALPWLRW

SEQ ID NO: 624139 - protein, 9 aa, Homo Sapiens
FRPGVLVSS

SEQ ID NO: 624140 - protein, 9 aa, Homo Sapiens
GPVDHQELT

SEQ ID NO: 624141 - protein, 9 aa, Homo Sapiens
DPFFRGYGE

SEQ ID NO: 624142 - protein, 9 aa, Homo Sapiens
RKLLRKSPQ

SEQ ID NO: 624143 - protein, 9 aa, Homo Sapiens
FSRKSAPST

SEQ ID NO: 624144 - protein, 9 aa, Homo Sapiens
PGLPQTPPL

SEQ ID NO: 624145 - protein, 9 aa, Homo Sapiens
SPPGSSWNI

SEQ ID NO: 624146 - protein, 9 aa, Homo Sapiens
EGQFAIWEK

SEQ ID NO: 624147 - protein, 9 aa, Homo Sapiens
AMGQGGVAH

SEQ ID NO: 624148 - protein, 9 aa, Homo Sapiens
DSLRSKPFL

SEQ ID NO: 624149 - protein, 9 aa, Homo Sapiens
ELLCCQKDV

SEQ ID NO: 624150 - protein, 9 aa, Homo Sapiens
VIGFGAARE

SEQ ID NO: 624151 - protein, 9 aa, Homo Sapiens
ECEVCRDGW

SEQ ID NO: 624152 - protein, 9 aa, Homo Sapiens
LVGGLVPVL

SEQ ID NO: 624153 - protein, 9 aa, Homo Sapiens
RKLQANKIV

SEQ ID NO: 624154 - protein, 9 aa, Homo Sapiens
LELPTGPEV

SEQ ID NO: 624155 - protein, 9 aa, Homo Sapiens
HYASYVPTI

SEQ ID NO: 624156 - protein, 9 aa, Homo Sapiens
PSAPAVVTM

SEQ ID NO: 624157 - protein, 9 aa, Homo Sapiens
PPPGRLIRG

SEQ ID NO: 624158 - protein, 9 aa, Homo Sapiens
PVATVQTTL

SEQ ID NO: 624159 - protein, 9 aa, Homo Sapiens
TVTSSLQHL

SEQ ID NO: 624160 - protein, 9 aa, Homo Sapiens
PAVVTMVWC

SEQ ID NO: 624161 - protein, 9 aa, Homo Sapiens
VSLWGRPVV

SEQ ID NO: 624162 - protein, 9 aa, Homo Sapiens
VPQEHGQHL

SEQ ID NO: 624163 - protein, 9 aa, Homo Sapiens
LLVPLVEDF

SEQ ID NO: 624164 - protein, 9 aa, Homo Sapiens
NQNYCRNPD

SEQ ID NO: 624165 - protein, 9 aa, Homo Sapiens
EDIETDVLC

SEQ ID NO: 624166 - protein, 9 aa, Homo Sapiens
EISLQEALS

SEQ ID NO: 624167 - protein, 9 aa, Homo Sapiens
DSAVRVQAV

SEQ ID NO: 624168 - protein, 9 aa, Homo Sapiens
DLFLVHHLD

SEQ ID NO: 624169 - protein, 9 aa, Homo Sapiens
SLGIGLGMD

SEQ ID NO: 624170 - protein, 9 aa, Homo Sapiens
TIEVYTEGE

SEQ ID NO: 624171 - protein, 9 aa, Homo Sapiens
SRCDRPPPG

SEQ ID NO: 624172 - protein, 9 aa, Homo Sapiens
DTGFNGLQH

SEQ ID NO: 624173 - protein, 9 aa, Homo Sapiens
ALVALGSRC

SEQ ID NO: 624174 - protein, 9 aa, Homo Sapiens
MNKQRLHCE

SEQ ID NO: 624175 - protein, 9 aa, Homo Sapiens
IQPETPQHK

SEQ ID NO: 624176 - protein, 9 aa, Homo Sapiens
ILFIVLLLS

SEQ ID NO: 624177 - protein, 9 aa, Homo Sapiens
KRDSWVPIK

SEQ ID NO: 624178 - protein, 9 aa, Homo Sapiens
PVCLPPASV

SEQ ID NO: 624179 - protein, 9 aa, Homo Sapiens
HCTKLQHSL

SEQ ID NO: 624180 - protein, 9 aa, Homo Sapiens
RVDNSAVGF

SEQ ID NO: 624181 - protein, 9 aa, Homo Sapiens
DINNFPYLE

SEQ ID NO: 624182 - protein, 9 aa, Homo Sapiens
CRWKDSLCA

SEQ ID NO: 624183 - protein, 9 aa, Homo Sapiens
QPHGREPSY

SEQ ID NO: 624184 - protein, 9 aa, Homo Sapiens
IGFGAAREG

SEQ ID NO: 624185 - protein, 9 aa, Homo Sapiens
QAHCTKLQH

SEQ ID NO: 624186 - protein, 9 aa, Homo Sapiens
GWAAATRGR

SEQ ID NO: 624187 - protein, 9 aa, Homo Sapiens
NLGNACYMN

SEQ ID NO: 624188 - protein, 9 aa, Homo Sapiens
MLGLVGRVA

SEQ ID NO: 624189 - protein, 9 aa, Homo Sapiens
VTKRKLELP

SEQ ID NO: 624190 - protein, 9 aa, Homo Sapiens
EQLTYSSKR

SEQ ID NO: 624191 - protein, 9 aa, Homo Sapiens
PWLYVGIVF

SEQ ID NO: 624192 - protein, 9 aa, Homo Sapiens
DGSDEHNFP

SEQ ID NO: 624193 - protein, 9 aa, Homo Sapiens
SLPHSFLMK

SEQ ID NO: 624194 - protein, 9 aa, Homo Sapiens
YFFLIFGNI

SEQ ID NO: 624195 - protein, 9 aa, Homo Sapiens
RQQYWKPKK

SEQ ID NO: 624196 - protein, 9 aa, Homo Sapiens
EHSEEEETI

SEQ ID NO: 624197 - protein, 9 aa, Homo Sapiens
FQPHGREPS

SEQ ID NO: 624198 - protein, 9 aa, Homo Sapiens
FEHTIEVYT

SEQ ID NO: 624199 - protein, 9 aa, Homo Sapiens
LGAYCIDAY

SEQ ID NO: 624200 - protein, 9 aa, Homo Sapiens
YGTNGTFNK

SEQ ID NO: 624201 - protein, 9 aa, Homo Sapiens
ECFQDNFSK

SEQ ID NO: 624202 - protein, 9 aa, Homo Sapiens
DLGLDLKDS

SEQ ID NO: 624203 - protein, 9 aa, Homo Sapiens
GLGMDIVQV

SEQ ID NO: 624204 - protein, 9 aa, Homo Sapiens
LAEDLMKLL

SEQ ID NO: 624205 - protein, 9 aa, Homo Sapiens
IFGNIDSYL

SEQ ID NO: 624206 - protein, 9 aa, Homo Sapiens
KTLPLFDSK

SEQ ID NO: 624207 - protein, 9 aa, Homo Sapiens
KTVLYGTPM

SEQ ID NO: 624208 - protein, 9 aa, Homo Sapiens
VVCPHSTLR

SEQ ID NO: 624209 - protein, 9 aa, Homo Sapiens
SIPDTLTKK

SEQ ID NO: 624210 - protein, 9 aa, Homo Sapiens
PDYPTLYNI

SEQ ID NO: 624211 - protein, 9 aa, Homo Sapiens
GQIKKSPAL

SEQ ID NO: 624212 - protein, 9 aa, Homo Sapiens
RDVSRRYPH

SEQ ID NO: 624213 - protein, 9 aa, Homo Sapiens
RATKLEEFI

SEQ ID NO: 624214 - protein, 9 aa, Homo Sapiens
MAIGTRSVA

SEQ ID NO: 624215 - protein, 9 aa, Homo Sapiens
VYLHSVTTL

SEQ ID NO: 624216 - protein, 9 aa, Homo Sapiens
FEDITRSFE

SEQ ID NO: 624217 - protein, 9 aa, Homo Sapiens
DPMRAPKGL

SEQ ID NO: 624218 - protein, 9 aa, Homo Sapiens
MKDAAVSSL

SEQ ID NO: 624219 - protein, 9 aa, Homo Sapiens
PGLESGVGG

SEQ ID NO: 624220 - protein, 9 aa, Homo Sapiens
NKIVQGSRR

SEQ ID NO: 624221 - protein, 9 aa, Homo Sapiens
SLMKLVLRW

SEQ ID NO: 624222 - protein, 9 aa, Homo Sapiens
TKRKLELPT

SEQ ID NO: 624223 - protein, 9 aa, Homo Sapiens
QLVGTRKLL

SEQ ID NO: 624224 - protein, 9 aa, Homo Sapiens
IKLFVLCNS

SEQ ID NO: 624225 - protein, 9 aa, Homo Sapiens
SPTVEGNNV

SEQ ID NO: 624226 - protein, 9 aa, Homo Sapiens
FHNPMNKQR

SEQ ID NO: 624227 - protein, 9 aa, Homo Sapiens
CGKDFTFSS

SEQ ID NO: 624228 - protein, 9 aa, Homo Sapiens
ADVNKSMYL

SEQ ID NO: 624229 - protein, 9 aa, Homo Sapiens
PQIDLNQIF

SEQ ID NO: 624230 - protein, 9 aa, Homo Sapiens
RRVEANTQR

SEQ ID NO: 624231 - protein, 9 aa, Homo Sapiens
FIILFIVLL

SEQ ID NO: 624232 - protein, 9 aa, Homo Sapiens
VKRKTTSAG

SEQ ID NO: 624233 - protein, 9 aa, Homo Sapiens
FKELQQVDR

SEQ ID NO: 624234 - protein, 9 aa, Homo Sapiens
PGHQGNHGS

SEQ ID NO: 624235 - protein, 9 aa, Homo Sapiens
DENWYHREV

SEQ ID NO: 624236 - protein, 9 aa, Homo Sapiens
EKDLYSYVI

SEQ ID NO: 624237 - protein, 9 aa, Homo Sapiens
SEMYSIPVN

SEQ ID NO: 624238 - protein, 9 aa, Homo Sapiens
DSDSFVNIF

SEQ ID NO: 624239 - protein, 9 aa, Homo Sapiens
TFTPEFLVQ

SEQ ID NO: 624240 - protein, 9 aa, Homo Sapiens
PYQCNKCCK

SEQ ID NO: 624241 - protein, 9 aa, Homo Sapiens
VAVKIYGAP

SEQ ID NO: 624242 - protein, 9 aa, Homo Sapiens
KQEPDSENI

SEQ ID NO: 624243 - protein, 9 aa, Homo Sapiens
KLLLHWIPE

SEQ ID NO: 624244 - protein, 9 aa, Homo Sapiens
KDFTFSSTL

SEQ ID NO: 624245 - protein, 9 aa, Homo Sapiens
CFQDNFSKF

SEQ ID NO: 624246 - protein, 9 aa, Homo Sapiens
AVRVQAVDS

SEQ ID NO: 624247 - protein, 9 aa, Homo Sapiens
RNLGNACYM

SEQ ID NO: 624248 - protein, 9 aa, Homo Sapiens
ETRPFPSTI

SEQ ID NO: 624249 - protein, 9 aa, Homo Sapiens
YPTLYNILM

SEQ ID NO: 624250 - protein, 9 aa, Homo Sapiens
WTFLNYYTV

SEQ ID NO: 624251 - protein, 9 aa, Homo Sapiens
LHVERNTDL

SEQ ID NO: 624252 - protein, 9 aa, Homo Sapiens
LPLFDSKDS

SEQ ID NO: 624253 - protein, 9 aa, Homo Sapiens
PSTIVAVEV

SEQ ID NO: 624254 - protein, 9 aa, Homo Sapiens
AIGLECFQD

SEQ ID NO: 624255 - protein, 9 aa, Homo Sapiens
PFPVYSNGN

SEQ ID NO: 624256 - protein, 9 aa, Homo Sapiens
TIPLTLLLK

SEQ ID NO: 624257 - protein, 9 aa, Homo Sapiens
CSARFTPTH

SEQ ID NO: 624258 - protein, 9 aa, Homo Sapiens
SCSSRLAAN

SEQ ID NO: 624259 - protein, 9 aa, Homo Sapiens
DVGADVNKS

SEQ ID NO: 624260 - protein, 9 aa, Homo Sapiens
IPQIDLNQI

SEQ ID NO: 624261 - protein, 9 aa, Homo Sapiens
GIKTLEDFR

SEQ ID NO: 624262 - protein, 9 aa, Homo Sapiens
WDDLCKMTY

SEQ ID NO: 624263 - protein, 9 aa, Homo Sapiens
ERNTDLPPE

SEQ ID NO: 624264 - protein, 9 aa, Homo Sapiens
RALTRVGAL

SEQ ID NO: 624265 - protein, 9 aa, Homo Sapiens
SAIGLECFQ

SEQ ID NO: 624266 - protein, 9 aa, Homo Sapiens
QFATVYRAR

SEQ ID NO: 624267 - protein, 9 aa, Homo Sapiens
FHNRMYFLI

SEQ ID NO: 624268 - protein, 9 aa, Homo Sapiens
VVTVLKKQR

SEQ ID NO: 624269 - protein, 9 aa, Homo Sapiens
AVVTMVWCQ

SEQ ID NO: 624270 - protein, 9 aa, Homo Sapiens
LLHWIPEDI

SEQ ID NO: 624271 - protein, 9 aa, Homo Sapiens
NYHYQQIYR

SEQ ID NO: 624272 - protein, 9 aa, Homo Sapiens
LSTRCSEMP

SEQ ID NO: 624273 - protein, 9 aa, Homo Sapiens
TRVGALVGL

SEQ ID NO: 624274 - protein, 9 aa, Homo Sapiens
QIYRQQPST

SEQ ID NO: 624275 - protein, 9 aa, Homo Sapiens
KVPWLYVGI

SEQ ID NO: 624276 - protein, 9 aa, Homo Sapiens
VLKKQRRKR

SEQ ID NO: 624277 - protein, 9 aa, Homo Sapiens
YVGIVFSAF

SEQ ID NO: 624278 - protein, 9 aa, Homo Sapiens
IYAFFQPHG

SEQ ID NO: 624279 - protein, 9 aa, Homo Sapiens
QTLTSILSI

SEQ ID NO: 624280 - protein, 9 aa, Homo Sapiens
RKSAPSTGS

SEQ ID NO: 624281 - protein, 9 aa, Homo Sapiens
ALLHHLGFP

SEQ ID NO: 624282 - protein, 9 aa, Homo Sapiens
VERNTDLPP

SEQ ID NO: 624283 - protein, 9 aa, Homo Sapiens
CGTRKSILL

SEQ ID NO: 624284 - protein, 9 aa, Homo Sapiens
KHARNNIMK

SEQ ID NO: 624285 - protein, 9 aa, Homo Sapiens
DVRALPWLR

SEQ ID NO: 624286 - protein, 9 aa, Homo Sapiens
DVREVDLMR

SEQ ID NO: 624287 - protein, 9 aa, Homo Sapiens
SNDVGADVN

SEQ ID NO: 624288 - protein, 9 aa, Homo Sapiens
QFPDTCQNA

SEQ ID NO: 624289 - protein, 9 aa, Homo Sapiens
GISISQRVT

SEQ ID NO: 624290 - protein, 9 aa, Homo Sapiens
DTSLNPPMY

SEQ ID NO: 624291 - protein, 9 aa, Homo Sapiens
YPNRNVPRH

SEQ ID NO: 624292 - protein, 9 aa, Homo Sapiens
IFQFLLNFD

SEQ ID NO: 624293 - protein, 9 aa, Homo Sapiens
PTPGNPLPP

SEQ ID NO: 624294 - protein, 9 aa, Homo Sapiens
LVAVEPVAG

SEQ ID NO: 624295 - protein, 9 aa, Homo Sapiens
VSPLKYGSQ

SEQ ID NO: 624296 - protein, 9 aa, Homo Sapiens
GVGPGGYAP

SEQ ID NO: 624297 - protein, 9 aa, Homo Sapiens
GFTICCDSA

SEQ ID NO: 624298 - protein, 9 aa, Homo Sapiens
TLAEDLMKL

SEQ ID NO: 624299 - protein, 9 aa, Homo Sapiens
PNSLLKHIR

SEQ ID NO: 624300 - protein, 9 aa, Homo Sapiens
EMCRLKLLE

SEQ ID NO: 624301 - protein, 9 aa, Homo Sapiens
LRWLLWLLC

SEQ ID NO: 624302 - protein, 9 aa, Homo Sapiens
LLKTIILGK

SEQ ID NO: 624303 - protein, 9 aa, Homo Sapiens
VEGNNVVVK

SEQ ID NO: 624304 - protein, 9 aa, Homo Sapiens
GLVGRVAAA

SEQ ID NO: 624305 - protein, 9 aa, Homo Sapiens
ERRDSDSFV

SEQ ID NO: 624306 - protein, 9 aa, Homo Sapiens
VDENWYHRE

SEQ ID NO: 624307 - protein, 9 aa, Homo Sapiens
CAWDVVRAE

SEQ ID NO: 624308 - protein, 9 aa, Homo Sapiens
TRKSILLLN

SEQ ID NO: 624309 - protein, 9 aa, Homo Sapiens
GMGMNMGMK

SEQ ID NO: 624310 - protein, 9 aa, Homo Sapiens
PLRHFTLWR

SEQ ID NO: 624311 - protein, 9 aa, Homo Sapiens
GIDRRTEEE

SEQ ID NO: 624312 - protein, 9 aa, Homo Sapiens
PVISNELLE

SEQ ID NO: 624313 - protein, 9 aa, Homo Sapiens
DNDDRFGFC

SEQ ID NO: 624314 - protein, 9 aa, Homo Sapiens
ANHSSVWIA

SEQ ID NO: 624315 - protein, 9 aa, Homo Sapiens
PIKYQFLCS

SEQ ID NO: 624316 - protein, 9 aa, Homo Sapiens
FTICCDSAV

SEQ ID NO: 624317 - protein, 9 aa, Homo Sapiens
AHLDLLVPL

SEQ ID NO: 624318 - protein, 9 aa, Homo Sapiens
WYVVPQEHG

SEQ ID NO: 624319 - protein, 9 aa, Homo Sapiens
RVRSQLEPT

SEQ ID NO: 624320 - protein, 9 aa, Homo Sapiens
RDERRAQRA

SEQ ID NO: 624321 - protein, 9 aa, Homo Sapiens
FLMLGSVLR

SEQ ID NO: 624322 - protein, 9 aa, Homo Sapiens
MDQWSTQNL

SEQ ID NO: 624323 - protein, 9 aa, Homo Sapiens
IKTLEDFRK

SEQ ID NO: 624324 - protein, 9 aa, Homo Sapiens
YAVPGKANE

SEQ ID NO: 624325 - protein, 9 aa, Homo Sapiens
TPQHKPSVQ

SEQ ID NO: 624326 - protein, 9 aa, Homo Sapiens
PNRNVPRHP

SEQ ID NO: 624327 - protein, 8 aa, Homo Sapiens
YSRLFYLK

SEQ ID NO: 624328 - protein, 9 aa, Homo Sapiens
TRGRPSAPA

SEQ ID NO: 624329 - protein, 9 aa, Homo Sapiens
GWELFCCDT

SEQ ID NO: 624330 - protein, 9 aa, Homo Sapiens
LFDSKDSMI

SEQ ID NO: 624331 - protein, 9 aa, Homo Sapiens
EDLMKLLIR

SEQ ID NO: 624332 - protein, 9 aa, Homo Sapiens
SREGLVLCH

SEQ ID NO: 624333 - protein, 9 aa, Homo Sapiens
QQVDRRLLN

SEQ ID NO: 624334 - protein, 9 aa, Homo Sapiens
SKRSKAPSV

SEQ ID NO: 624335 - protein, 9 aa, Homo Sapiens
LQHLRGSNL

SEQ ID NO: 624336 - protein, 9 aa, Homo Sapiens
DGAISTFTP

SEQ ID NO: 624337 - protein, 9 aa, Homo Sapiens
CGAPDNSHP

SEQ ID NO: 624338 - protein, 9 aa, Homo Sapiens
TGFNGLQHY

SEQ ID NO: 624339 - protein, 9 aa, Homo Sapiens
GPGGYAPEF

SEQ ID NO: 624340 - protein, 9 aa, Homo Sapiens
SGESSEASL

SEQ ID NO: 624341 - protein, 9 aa, Homo Sapiens
YIPSLPHSF

SEQ ID NO: 624342 - protein, 9 aa, Homo Sapiens
NLSTRCSEM

SEQ ID NO: 624343 - protein, 9 aa, Homo Sapiens
ELPTGPEVQ

SEQ ID NO: 624344 - protein, 9 aa, Homo Sapiens
LACLVGGLV

SEQ ID NO: 624345 - protein, 9 aa, Homo Sapiens
KPAKYVWEQ

SEQ ID NO: 624346 - protein, 9 aa, Homo Sapiens
LGLVGRVAA

SEQ ID NO: 624347 - protein, 9 aa, Homo Sapiens
KQNGSSCSS

SEQ ID NO: 624348 - protein, 9 aa, Homo Sapiens
KLELPTGPE

SEQ ID NO: 624349 - protein, 9 aa, Homo Sapiens
EPAETPSET

SEQ ID NO: 624350 - protein, 9 aa, Homo Sapiens
PIELDGKKI

SEQ ID NO: 624351 - protein, 9 aa, Homo Sapiens
GTGDFAVVI

SEQ ID NO: 624352 - protein, 9 aa, Homo Sapiens
VLCHCISRP

SEQ ID NO: 624353 - protein, 9 aa, Homo Sapiens
VLHAATCSS

SEQ ID NO: 624354 - protein, 9 aa, Homo Sapiens
TCWQAEHPA

SEQ ID NO: 624355 - protein, 9 aa, Homo Sapiens
AGDEPAETP

SEQ ID NO: 624356 - protein, 9 aa, Homo Sapiens
RCSEMPQNL

SEQ ID NO: 624357 - protein, 9 aa, Homo Sapiens
ELVPWIFQF

SEQ ID NO: 624358 - protein, 9 aa, Homo Sapiens
ERALTRVGA

SEQ ID NO: 624359 - protein, 9 aa, Homo Sapiens
PQHKPSVQK

SEQ ID NO: 624360 - protein, 9 aa, Homo Sapiens
SAAVGSVAT

SEQ ID NO: 624361 - protein, 9 aa, Homo Sapiens
RLESQHYFQ

SEQ ID NO: 624362 - protein, 9 aa, Homo Sapiens
LHWIPEDIL

SEQ ID NO: 624363 - protein, 9 aa, Homo Sapiens
NSQTRRYIS

SEQ ID NO: 624364 - protein, 9 aa, Homo Sapiens
VHRDFHLWL

SEQ ID NO: 624365 - protein, 9 aa, Homo Sapiens
ECGMSFSRR

SEQ ID NO: 624366 - protein, 9 aa, Homo Sapiens
QSSGQDGSP

SEQ ID NO: 624367 - protein, 9 aa, Homo Sapiens
QKPAKYVWE

SEQ ID NO: 624368 - protein, 9 aa, Homo Sapiens
SSVNVQVSV

SEQ ID NO: 624369 - protein, 9 aa, Homo Sapiens
VEPLLLLCL

SEQ ID NO: 624370 - protein, 9 aa, Homo Sapiens
KVRGSDKCY

SEQ ID NO: 624371 - protein, 9 aa, Homo Sapiens
IFVYLHSVT

SEQ ID NO: 624372 - protein, 9 aa, Homo Sapiens
SGPRAFSSC

SEQ ID NO: 624373 - protein, 9 aa, Homo Sapiens
GVCGIHPHH

SEQ ID NO: 624374 - protein, 9 aa, Homo Sapiens
LYHQVCLQG

SEQ ID NO: 624375 - protein, 9 aa, Homo Sapiens
ALGSRCDRP

SEQ ID NO: 624376 - protein, 9 aa, Homo Sapiens
TLLLKTIIL

SEQ ID NO: 624377 - protein, 9 aa, Homo Sapiens
REVNGIHGF

SEQ ID NO: 624378 - protein, 9 aa, Homo Sapiens
WGEALLHHL

SEQ ID NO: 624379 - protein, 9 aa, Homo Sapiens
QKLIPQLLT

SEQ ID NO: 624380 - protein, 9 aa, Homo Sapiens
GPMSEMYSI

SEQ ID NO: 624381 - protein, 9 aa, Homo Sapiens
TRSVAVKIY

SEQ ID NO: 624382 - protein, 9 aa, Homo Sapiens
DQEGLCGQC

SEQ ID NO: 624383 - protein, 9 aa, Homo Sapiens
GETREAIVH

SEQ ID NO: 624384 - protein, 9 aa, Homo Sapiens
VQADRVDNS

SEQ ID NO: 624385 - protein, 9 aa, Homo Sapiens
SPKTSPKVV

SEQ ID NO: 624386 - protein, 9 aa, Homo Sapiens
QPRSIEAGA

SEQ ID NO: 624387 - protein, 9 aa, Homo Sapiens
ELSLPLENT

SEQ ID NO: 624388 - protein, 9 aa, Homo Sapiens
GEIFANGNR

SEQ ID NO: 624389 - protein, 9 aa, Homo Sapiens
YTVLLERLT

SEQ ID NO: 624390 - protein, 9 aa, Homo Sapiens
EFHLMELRN

SEQ ID NO: 624391 - protein, 9 aa, Homo Sapiens
LYFIISGSL

SEQ ID NO: 624392 - protein, 9 aa, Homo Sapiens
PPMPWETLL

SEQ ID NO: 624393 - protein, 9 aa, Homo Sapiens
HSVTTLPID

SEQ ID NO: 624394 - protein, 9 aa, Homo Sapiens
QHKPSVQKT

SEQ ID NO: 624395 - protein, 9 aa, Homo Sapiens
GKWTFFLRA

SEQ ID NO: 624396 - protein, 9 aa, Homo Sapiens
FQELVPWIF

SEQ ID NO: 624397 - protein, 9 aa, Homo Sapiens
RHFTLWRGP

SEQ ID NO: 624398 - protein, 9 aa, Homo Sapiens
ERVLTQLRE

SEQ ID NO: 624399 - protein, 9 aa, Homo Sapiens
LDTAGLEEY

SEQ ID NO: 624400 - protein, 9 aa, Homo Sapiens
PKTMWHQDQ

SEQ ID NO: 624401 - protein, 9 aa, Homo Sapiens
PTVEGNNVV

SEQ ID NO: 624402 - protein, 9 aa, Homo Sapiens
QHYFQIEKA

SEQ ID NO: 624403 - protein, 9 aa, Homo Sapiens
LCCQKDVFF

SEQ ID NO: 624404 - protein, 9 aa, Homo Sapiens
AYCIDAYNE

SEQ ID NO: 624405 - protein, 9 aa, Homo Sapiens
VEPVAGERA

SEQ ID NO: 624406 - protein, 9 aa, Homo Sapiens
LVIGFGAAR

SEQ ID NO: 624407 - protein, 9 aa, Homo Sapiens
IENLPLRHF

SEQ ID NO: 624408 - protein, 9 aa, Homo Sapiens
LAWRHGSTE

SEQ ID NO: 624409 - protein, 9 aa, Homo Sapiens
NGSSCSSRL

SEQ ID NO: 624410 - protein, 9 aa, Homo Sapiens
AVSFSRKSA

SEQ ID NO: 624411 - protein, 9 aa, Homo Sapiens
SSQSDQIDL

SEQ ID NO: 624412 - protein, 9 aa, Homo Sapiens
MTIYTEKDL

SEQ ID NO: 624413 - protein, 9 aa, Homo Sapiens
HIARAVMKI

SEQ ID NO: 624414 - protein, 9 aa, Homo Sapiens
KLFVLCNSL

SEQ ID NO: 624415 - protein, 9 aa, Homo Sapiens
VRGSDKCYT

SEQ ID NO: 624416 - protein, 9 aa, Homo Sapiens
SWVPIKYQF

SEQ ID NO: 624417 - protein, 9 aa, Homo Sapiens
LLAILNMQS

SEQ ID NO: 624418 - protein, 9 aa, Homo Sapiens
GSSCSSRLA

SEQ ID NO: 624419 - protein, 9 aa, Homo Sapiens
LRNLGNACY

SEQ ID NO: 624420 - protein, 9 aa, Homo Sapiens
EGHLDQLFR

SEQ ID NO: 624421 - protein, 9 aa, Homo Sapiens
GSNLTTHRK

SEQ ID NO: 624422 - protein, 9 aa, Homo Sapiens
RGYGEIFAN

SEQ ID NO: 624423 - protein, 9 aa, Homo Sapiens
TFNVMCTLL

SEQ ID NO: 624424 - protein, 9 aa, Homo Sapiens
SPKVVARRF

SEQ ID NO: 624425 - protein, 9 aa, Homo Sapiens
VFVLGSVLY

SEQ ID NO: 624426 - protein, 9 aa, Homo Sapiens
KDLYSYVIS

SEQ ID NO: 624427 - protein, 9 aa, Homo Sapiens
QMEKIQPAF

SEQ ID NO: 624428 - protein, 9 aa, Homo Sapiens
DSSVNVQVS

SEQ ID NO: 624429 - protein, 9 aa, Homo Sapiens
PGISISQRV

SEQ ID NO: 624430 - protein, 9 aa, Homo Sapiens
RGGQVHGGP

SEQ ID NO: 624431 - protein, 9 aa, Homo Sapiens
GTEVFLMLG

SEQ ID NO: 624432 - protein, 9 aa, Homo Sapiens
YSYSIDHTR

SEQ ID NO: 624433 - protein, 9 aa, Homo Sapiens
LYEETCSDL

SEQ ID NO: 624434 - protein, 9 aa, Homo Sapiens
ISISQRVTG

SEQ ID NO: 624435 - protein, 9 aa, Homo Sapiens
NAMWTFLNY

SEQ ID NO: 624436 - protein, 9 aa, Homo Sapiens
LRSYSLAWR

SEQ ID NO: 624437 - protein, 9 aa, Homo Sapiens
VNYHYQQIY

SEQ ID NO: 624438 - protein, 9 aa, Homo Sapiens
QVDRRLLNH

SEQ ID NO: 624439 - protein, 9 aa, Homo Sapiens
VPIKYQFLC

SEQ ID NO: 624440 - protein, 9 aa, Homo Sapiens
LLLCLQQGQ

SEQ ID NO: 624441 - protein, 9 aa, Homo Sapiens
GIYTVLLER

SEQ ID NO: 624442 - protein, 9 aa, Homo Sapiens
TAGAGTGDF

SEQ ID NO: 624443 - protein, 9 aa, Homo Sapiens
VDNSAVGFD

SEQ ID NO: 624444 - protein, 9 aa, Homo Sapiens
FGPVDHQEL

SEQ ID NO: 624445 - protein, 9 aa, Homo Sapiens
ENWYHREVN

SEQ ID NO: 624446 - protein, 9 aa, Homo Sapiens
QAPDFYVDM

SEQ ID NO: 624447 - protein, 9 aa, Homo Sapiens
HNRMYFLIG

SEQ ID NO: 624448 - protein, 9 aa, Homo Sapiens
LLKHIRNNH

SEQ ID NO: 624449 - protein, 9 aa, Homo Sapiens
AAPDVPKVK

SEQ ID NO: 624450 - protein, 9 aa, Homo Sapiens
KRQQYWKPK

SEQ ID NO: 624451 - protein, 9 aa, Homo Sapiens
PGGYAPEFV

SEQ ID NO: 624452 - protein, 9 aa, Homo Sapiens
RLTSFRPAS

SEQ ID NO: 624453 - protein, 9 aa, Homo Sapiens
RDARWESQP

SEQ ID NO: 624454 - protein, 9 aa, Homo Sapiens
PWIFQFLLN

SEQ ID NO: 624455 - protein, 9 aa, Homo Sapiens
QYWKPKKQG

SEQ ID NO: 624456 - protein, 9 aa, Homo Sapiens
SFHTPNSLL

SEQ ID NO: 624457 - protein, 9 aa, Homo Sapiens
YSLMKLVLR

SEQ ID NO: 624458 - protein, 9 aa, Homo Sapiens
TIITRTCPP

SEQ ID NO: 624459 - protein, 9 aa, Homo Sapiens
REGALVALG

SEQ ID NO: 624460 - protein, 9 aa, Homo Sapiens
HHLGFPERG

SEQ ID NO: 624461 - protein, 9 aa, Homo Sapiens
FATVYRARD

SEQ ID NO: 624462 - protein, 9 aa, Homo Sapiens
LLVAVEPVA

SEQ ID NO: 624463 - protein, 9 aa, Homo Sapiens
NSGVELPLT

SEQ ID NO: 624464 - protein, 9 aa, Homo Sapiens
WVPIKYQFL

SEQ ID NO: 624465 - protein, 9 aa, Homo Sapiens
GVLSPPGSS

SEQ ID NO: 624466 - protein, 9 aa, Homo Sapiens
YQCNKCCKA

SEQ ID NO: 624467 - protein, 9 aa, Homo Sapiens
AFALADTAV

SEQ ID NO: 624468 - protein, 9 aa, Homo Sapiens
KAEIWSPLG

SEQ ID NO: 624469 - protein, 9 aa, Homo Sapiens
TMIPQIDLN

SEQ ID NO: 624470 - protein, 9 aa, Homo Sapiens
VVTMVWCQR

SEQ ID NO: 624471 - protein, 9 aa, Homo Sapiens
QVLHAATCS

SEQ ID NO: 624472 - protein, 9 aa, Homo Sapiens
HFYIPSLPH

SEQ ID NO: 624473 - protein, 9 aa, Homo Sapiens
EAGLSPVYV

SEQ ID NO: 624474 - protein, 9 aa, Homo Sapiens
TVYRARDKN

SEQ ID NO: 624475 - protein, 9 aa, Homo Sapiens
NMTIITRTC

SEQ ID NO: 624476 - protein, 9 aa, Homo Sapiens
FIPSSSQTV

SEQ ID NO: 624477 - protein, 9 aa, Homo Sapiens
VRQDLLWTL

SEQ ID NO: 624478 - protein, 9 aa, Homo Sapiens
LYVFAHTAI

SEQ ID NO: 624479 - protein, 9 aa, Homo Sapiens
GRSVSRREK

SEQ ID NO: 624480 - protein, 9 aa, Homo Sapiens
VDPRGGQVH

SEQ ID NO: 624481 - protein, 9 aa, Homo Sapiens
SVLYKNLDL

SEQ ID NO: 624482 - protein, 9 aa, Homo Sapiens
LGAHLDLLV

SEQ ID NO: 624483 - protein, 9 aa, Homo Sapiens
ETIGSSASE

SEQ ID NO: 624484 - protein, 9 aa, Homo Sapiens
PSSSQTVPA

SEQ ID NO: 624485 - protein, 9 aa, Homo Sapiens
VRVCACPGI

SEQ ID NO: 624486 - protein, 9 aa, Homo Sapiens
SNSGVELPL

SEQ ID NO: 624487 - protein, 9 aa, Homo Sapiens
FLLNFDHFY

SEQ ID NO: 624488 - protein, 9 aa, Homo Sapiens
ILGVCGIHP

SEQ ID NO: 624489 - protein, 9 aa, Homo Sapiens
FHLEKPSVK

SEQ ID NO: 624490 - protein, 9 aa, Homo Sapiens
EETIGSSAS

SEQ ID NO: 624491 - protein, 9 aa, Homo Sapiens
TVKTLPLFD

SEQ ID NO: 624492 - protein, 9 aa, Homo Sapiens
IDFKIRPIE

SEQ ID NO: 624493 - protein, 9 aa, Homo Sapiens
EKQEPDSEN

SEQ ID NO: 624494 - protein, 9 aa, Homo Sapiens
GQGGVAHMI

SEQ ID NO: 624495 - protein, 9 aa, Homo Sapiens
FFLRATKLE

SEQ ID NO: 624496 - protein, 9 aa, Homo Sapiens
GLESGVGGW

SEQ ID NO: 624497 - protein, 9 aa, Homo Sapiens
DKVHRDFHL

SEQ ID NO: 624498 - protein, 9 aa, Homo Sapiens
TGVVSLWGR

SEQ ID NO: 624499 - protein, 9 aa, Homo Sapiens
PQEGRPNQS

SEQ ID NO: 624500 - protein, 9 aa, Homo Sapiens
IIWGKILQL

SEQ ID NO: 624501 - protein, 9 aa, Homo Sapiens
ADRVDNSAV

SEQ ID NO: 624502 - protein, 9 aa, Homo Sapiens
LEKQEPDSE

SEQ ID NO: 624503 - protein, 9 aa, Homo Sapiens
QAEGQPVTN

SEQ ID NO: 624504 - protein, 9 aa, Homo Sapiens
STQNLYNNP

SEQ ID NO: 624505 - protein, 9 aa, Homo Sapiens
HLETIWRFQ

SEQ ID NO: 624506 - protein, 9 aa, Homo Sapiens
PQTLPGISI

SEQ ID NO: 624507 - protein, 9 aa, Homo Sapiens
TGGIYPNRN

SEQ ID NO: 624508 - protein, 9 aa, Homo Sapiens
NLVDHHRVH

SEQ ID NO: 624509 - protein, 9 aa, Homo Sapiens
QCNKCCKAF

SEQ ID NO: 624510 - protein, 9 aa, Homo Sapiens
KDAAVSSLA

SEQ ID NO: 624511 - protein, 9 aa, Homo Sapiens
CCQKDVFFG

SEQ ID NO: 624512 - protein, 9 aa, Homo Sapiens
DSEEDCCGA

SEQ ID NO: 624513 - protein, 9 aa, Homo Sapiens
LWGRPVVLA

SEQ ID NO: 624514 - protein, 9 aa, Homo Sapiens
KLNQNYCRN

SEQ ID NO: 624515 - protein, 9 aa, Homo Sapiens
KCCKAFTVR

SEQ ID NO: 624516 - protein, 9 aa, Homo Sapiens
DGNAKFDLG

SEQ ID NO: 624517 - protein, 9 aa, Homo Sapiens
NELSLPLEN

SEQ ID NO: 624518 - protein, 9 aa, Homo Sapiens
DHHRVHTGE

SEQ ID NO: 624519 - protein, 9 aa, Homo Sapiens
ELFLDNELS

SEQ ID NO: 624520 - protein, 9 aa, Homo Sapiens
CLVGGLVPV

SEQ ID NO: 624521 - protein, 9 aa, Homo Sapiens
AGLEEYSAM

SEQ ID NO: 624522 - protein, 9 aa, Homo Sapiens
FAANHSSVW

SEQ ID NO: 624523 - protein, 9 aa, Homo Sapiens
NHAAQTLER

SEQ ID NO: 624524 - protein, 9 aa, Homo Sapiens
AVSSLAALC

SEQ ID NO: 624525 - protein, 9 aa, Homo Sapiens
FNRLESQHY

SEQ ID NO: 624526 - protein, 9 aa, Homo Sapiens
AAGGTARVP

SEQ ID NO: 624527 - protein, 9 aa, Homo Sapiens
STHEAVAWW

SEQ ID NO: 624528 - protein, 9 aa, Homo Sapiens
PSTVTSSLQ

SEQ ID NO: 624529 - protein, 9 aa, Homo Sapiens
PTAMGQGGV

SEQ ID NO: 624530 - protein, 9 aa, Homo Sapiens
WGGLYFIIS

SEQ ID NO: 624531 - protein, 9 aa, Homo Sapiens
ILLLNFQGG

SEQ ID NO: 624532 - protein, 9 aa, Homo Sapiens
SIEAGAGAP

SEQ ID NO: 624533 - protein, 9 aa, Homo Sapiens
LSIKSVEKE

SEQ ID NO: 624534 - protein, 9 aa, Homo Sapiens
EVFLMLGSV

SEQ ID NO: 624535 - protein, 9 aa, Homo Sapiens
GVELPLTDG

SEQ ID NO: 624536 - protein, 9 aa, Homo Sapiens
CKVRGSDKC

SEQ ID NO: 624537 - protein, 9 aa, Homo Sapiens
EVDLMRCLR

SEQ ID NO: 624538 - protein, 9 aa, Homo Sapiens
WRFQELVPW

SEQ ID NO: 624539 - protein, 9 aa, Homo Sapiens
VSRRYPHYP

SEQ ID NO: 624540 - protein, 9 aa, Homo Sapiens
WYHREVNGI

SEQ ID NO: 624541 - protein, 9 aa, Homo Sapiens
ECDMLDPGL

SEQ ID NO: 624542 - protein, 9 aa, Homo Sapiens
CGKGFTAKR

SEQ ID NO: 624543 - protein, 9 aa, Homo Sapiens
PKVKITVNY

SEQ ID NO: 624544 - protein, 9 aa, Homo Sapiens
FGGLVRDVS

SEQ ID NO: 624545 - protein, 9 aa, Homo Sapiens
WKDSLCAKC

SEQ ID NO: 624546 - protein, 9 aa, Homo Sapiens
TRYCLTELN

SEQ ID NO: 624547 - protein, 9 aa, Homo Sapiens
EGQPVTNIM

SEQ ID NO: 624548 - protein, 9 aa, Homo Sapiens
AGFPCSARF

SEQ ID NO: 624549 - protein, 9 aa, Homo Sapiens
PGNPLPPQI

SEQ ID NO: 624550 - protein, 9 aa, Homo Sapiens
GSRCDRPPP

SEQ ID NO: 624551 - protein, 9 aa, Homo Sapiens
QNGSSCSSR

SEQ ID NO: 624552 - protein, 9 aa, Homo Sapiens
RVALACLVG

SEQ ID NO: 624553 - protein, 9 aa, Homo Sapiens
LKLHYASYV

SEQ ID NO: 624554 - protein, 9 aa, Homo Sapiens
EDAYSLMKL

SEQ ID NO: 624555 - protein, 9 aa, Homo Sapiens
GTARVPSAP

SEQ ID NO: 624556 - protein, 9 aa, Homo Sapiens
FLIGNLALC

SEQ ID NO: 624557 - protein, 9 aa, Homo Sapiens
YEETCSDLY

SEQ ID NO: 624558 - protein, 9 aa, Homo Sapiens
YWKPKKQGS

SEQ ID NO: 624559 - protein, 9 aa, Homo Sapiens
SAIIWGKIL

SEQ ID NO: 624560 - protein, 9 aa, Homo Sapiens
WGKILQLIR

SEQ ID NO: 624561 - protein, 9 aa, Homo Sapiens
GKMSAAVGS

SEQ ID NO: 624562 - protein, 9 aa, Homo Sapiens
KLIPQLLTL

SEQ ID NO: 624563 - protein, 9 aa, Homo Sapiens
FHLWLTSLP

SEQ ID NO: 624564 - protein, 9 aa, Homo Sapiens
GGTARVPSA

SEQ ID NO: 624565 - protein, 9 aa, Homo Sapiens
CIYAFFQPH

SEQ ID NO: 624566 - protein, 9 aa, Homo Sapiens
QLFRCLQAP

SEQ ID NO: 624567 - protein, 9 aa, Homo Sapiens
PKVDGTRTP

SEQ ID NO: 624568 - protein, 9 aa, Homo Sapiens
FSTSWTPVP

SEQ ID NO: 624569 - protein, 9 aa, Homo Sapiens
RDSWVPIKY

SEQ ID NO: 624570 - protein, 9 aa, Homo Sapiens
LVRDVSRRY

SEQ ID NO: 624571 - protein, 9 aa, Homo Sapiens
LSPPGSSWN

SEQ ID NO: 624572 - protein, 9 aa, Homo Sapiens
ESQHYFQIE

SEQ ID NO: 624573 - protein, 9 aa, Homo Sapiens
LPENFLPRA

SEQ ID NO: 624574 - protein, 9 aa, Homo Sapiens
IRSNDLFLV

SEQ ID NO: 624575 - protein, 9 aa, Homo Sapiens
QQTGRSVSR

SEQ ID NO: 624576 - protein, 9 aa, Homo Sapiens
SRATSASAA

SEQ ID NO: 624577 - protein, 9 aa, Homo Sapiens
KRSATGNGL

SEQ ID NO: 624578 - protein, 9 aa, Homo Sapiens
SNRNLVDHH

SEQ ID NO: 624579 - protein, 9 aa, Homo Sapiens
LEKPSVKLS

SEQ ID NO: 624580 - protein, 9 aa, Homo Sapiens
SRRYPHYPS

SEQ ID NO: 624581 - protein, 9 aa, Homo Sapiens
MDHQQLYWS

SEQ ID NO: 624582 - protein, 9 aa, Homo Sapiens
DNELSLPLE

SEQ ID NO: 624583 - protein, 9 aa, Homo Sapiens
VDHQELTRD

SEQ ID NO: 624584 - protein, 9 aa, Homo Sapiens
VGIVFSAFC

SEQ ID NO: 624585 - protein, 9 aa, Homo Sapiens
LVPWIFQFL

SEQ ID NO: 624586 - protein, 9 aa, Homo Sapiens
AHCTKLQHS

SEQ ID NO: 624587 - protein, 9 aa, Homo Sapiens
NKLAVKNKG

SEQ ID NO: 624588 - protein, 9 aa, Homo Sapiens
PCSARFTPT

SEQ ID NO: 624589 - protein, 9 aa, Homo Sapiens
REGLVLCHC

SEQ ID NO: 624590 - protein, 9 aa, Homo Sapiens
SYELPVGQV

SEQ ID NO: 624591 - protein, 9 aa, Homo Sapiens
RSIEAGAGA

SEQ ID NO: 624592 - protein, 9 aa, Homo Sapiens
SSSMKDSLR

SEQ ID NO: 624593 - protein, 9 aa, Homo Sapiens
FLIFGNIDS

SEQ ID NO: 624594 - protein, 9 aa, Homo Sapiens
LFLDNELSL

SEQ ID NO: 624595 - protein, 9 aa, Homo Sapiens
LLVKHLYHQ

SEQ ID NO: 624596 - protein, 9 aa, Homo Sapiens
QIPRERSQY

SEQ ID NO: 624597 - protein, 9 aa, Homo Sapiens
PEFVPPPEC

SEQ ID NO: 624598 - protein, 9 aa, Homo Sapiens
LCNSLLQLA

SEQ ID NO: 624599 - protein, 9 aa, Homo Sapiens
ICCDSAVRV

SEQ ID NO: 624600 - protein, 9 aa, Homo Sapiens
GRPSAPAVV

SEQ ID NO: 624601 - protein, 9 aa, Homo Sapiens
GFGAAREGA

SEQ ID NO: 624602 - protein, 9 aa, Homo Sapiens
NRVVTVLKK

SEQ ID NO: 624603 - protein, 9 aa, Homo Sapiens
SELLCCQKD

SEQ ID NO: 624604 - protein, 9 aa, Homo Sapiens
STVTSSLQH

SEQ ID NO: 624605 - protein, 9 aa, Homo Sapiens
GPPGSYGPV

SEQ ID NO: 624606 - protein, 9 aa, Homo Sapiens
RTLQVLHAA

SEQ ID NO: 624607 - protein, 9 aa, Homo Sapiens
TRPFPSTIV

SEQ ID NO: 624608 - protein, 9 aa, Homo Sapiens
PGEPGPPGH

SEQ ID NO: 624609 - protein, 9 aa, Homo Sapiens
ILSIKSVEK

SEQ ID NO: 624610 - protein, 9 aa, Homo Sapiens
PQAHCTKLQ

SEQ ID NO: 624611 - protein, 9 aa, Homo Sapiens
DLNQIFLCP

SEQ ID NO: 624612 - protein, 9 aa, Homo Sapiens
AVKPEPTNY

SEQ ID NO: 624613 - protein, 9 aa, Homo Sapiens
DKLRGQSHC

SEQ ID NO: 624614 - protein, 9 aa, Homo Sapiens
LVFHNPMNK

SEQ ID NO: 624615 - protein, 9 aa, Homo Sapiens
FILLAILNM

SEQ ID NO: 624616 - protein, 9 aa, Homo Sapiens
IDSQVNTIL

SEQ ID NO: 624617 - protein, 9 aa, Homo Sapiens
SILSIKSVE

SEQ ID NO: 624618 - protein, 9 aa, Homo Sapiens
KQRLHCEYW

SEQ ID NO: 624619 - protein, 9 aa, Homo Sapiens
GIIDSQVNT

SEQ ID NO: 624620 - protein, 9 aa, Homo Sapiens
NVNGPGLLE

SEQ ID NO: 624621 - protein, 9 aa, Homo Sapiens
GYAPEFVPP

SEQ ID NO: 624622 - protein, 9 aa, Homo Sapiens
KECGKDFTF

SEQ ID NO: 624623 - protein, 9 aa, Homo Sapiens
RPASCANHR

SEQ ID NO: 624624 - protein, 9 aa, Homo Sapiens
RRLLNHMRL

SEQ ID NO: 624625 - protein, 9 aa, Homo Sapiens
EEDCCGAPD

SEQ ID NO: 624626 - protein, 9 aa, Homo Sapiens
TLEDFRKNE

SEQ ID NO: 624627 - protein, 9 aa, Homo Sapiens
ILAENALQS

SEQ ID NO: 624628 - protein, 9 aa, Homo Sapiens
TKCADPMRA

SEQ ID NO: 624629 - protein, 9 aa, Homo Sapiens
STRCSEMPQ

SEQ ID NO: 624630 - protein, 9 aa, Homo Sapiens
LGVCGIHPH

SEQ ID NO: 624631 - protein, 9 aa, Homo Sapiens
TLQVLHAAT

SEQ ID NO: 624632 - protein, 9 aa, Homo Sapiens
KKYSPCAWD

SEQ ID NO: 624633 - protein, 9 aa, Homo Sapiens
VCPHSTLRT

SEQ ID NO: 624634 - protein, 9 aa, Homo Sapiens
FQWDDLCKM

SEQ ID NO: 624635 - protein, 9 aa, Homo Sapiens
VTMVWCQRS

SEQ ID NO: 624636 - protein, 9 aa, Homo Sapiens
LNQIFLCPN

SEQ ID NO: 624637 - protein, 9 aa, Homo Sapiens
RALPWLRWL

SEQ ID NO: 624638 - protein, 9 aa, Homo Sapiens
LSFIILFIV

SEQ ID NO: 624639 - protein, 9 aa, Homo Sapiens
GAHLDLLVP

SEQ ID NO: 624640 - protein, 9 aa, Homo Sapiens
VKRKAIHEL

SEQ ID NO: 624641 - protein, 9 aa, Homo Sapiens
LNFDHFYIP

SEQ ID NO: 624642 - protein, 9 aa, Homo Sapiens
DPDTGFNGL

SEQ ID NO: 624643 - protein, 9 aa, Homo Sapiens
SALEKQEPD

SEQ ID NO: 624644 - protein, 9 aa, Homo Sapiens
AVEPVAGER

SEQ ID NO: 624645 - protein, 9 aa, Homo Sapiens
FALADTAVC

SEQ ID NO: 624646 - protein, 9 aa, Homo Sapiens
SDQIDLDYQ

SEQ ID NO: 624647 - protein, 9 aa, Homo Sapiens
SYVPTIRVL

SEQ ID NO: 624648 - protein, 9 aa, Homo Sapiens
LIPVCLPPA

SEQ ID NO: 624649 - protein, 9 aa, Homo Sapiens
VNTILPALS

SEQ ID NO: 624650 - protein, 9 aa, Homo Sapiens
CSYTSGPGS

SEQ ID NO: 624651 - protein, 9 aa, Homo Sapiens
YGHIARAVM

SEQ ID NO: 624652 - protein, 9 aa, Homo Sapiens
QEHGQHLER

SEQ ID NO: 624653 - protein, 9 aa, Homo Sapiens
WRHGSTEPL

SEQ ID NO: 624654 - protein, 9 aa, Homo Sapiens
PPEKKPTPG

SEQ ID NO: 624655 - protein, 9 aa, Homo Sapiens
FSELLCCQK

SEQ ID NO: 624656 - protein, 9 aa, Homo Sapiens
RSTHEAVAW

SEQ ID NO: 624657 - protein, 9 aa, Homo Sapiens
KKSLSKPAF

SEQ ID NO: 624658 - protein, 9 aa, Homo Sapiens
ILEFAANHS

SEQ ID NO: 624659 - protein, 9 aa, Homo Sapiens
EGIKTLEDF

SEQ ID NO: 624660 - protein, 9 aa, Homo Sapiens
DLCKMTYLT

SEQ ID NO: 624661 - protein, 9 aa, Homo Sapiens
LLTLENLLN

SEQ ID NO: 624662 - protein, 9 aa, Homo Sapiens
NGLQHYELL

SEQ ID NO: 624663 - protein, 9 aa, Homo Sapiens
GLESASQPG

SEQ ID NO: 624664 - protein, 9 aa, Homo Sapiens
AISTFTPEF

SEQ ID NO: 624665 - protein, 9 aa, Homo Sapiens
LFGPVDHQE

SEQ ID NO: 624666 - protein, 9 aa, Homo Sapiens
SSSQTVPAS

SEQ ID NO: 624667 - protein, 9 aa, Homo Sapiens
GAKPLQEEG

SEQ ID NO: 624668 - protein, 9 aa, Homo Sapiens
STSWTPVPS

SEQ ID NO: 624669 - protein, 9 aa, Homo Sapiens
RKRQQYWKP

SEQ ID NO: 624670 - protein, 9 aa, Homo Sapiens
KIRPIELDG

SEQ ID NO: 624671 - protein, 9 aa, Homo Sapiens
LKLKIILCF

SEQ ID NO: 624672 - protein, 9 aa, Homo Sapiens
LQPRSIEAG

SEQ ID NO: 624673 - protein, 9 aa, Homo Sapiens
HLDQLFRCL

SEQ ID NO: 624674 - protein, 9 aa, Homo Sapiens
GVPGLQGPA

SEQ ID NO: 624675 - protein, 9 aa, Homo Sapiens
KTMWHQDQE

SEQ ID NO: 624676 - protein, 9 aa, Homo Sapiens
IHPHHQETL

SEQ ID NO: 624677 - protein, 9 aa, Homo Sapiens
WCQRSRATS

SEQ ID NO: 624678 - protein, 9 aa, Homo Sapiens
IYLQPRSIE

SEQ ID NO: 624679 - protein, 9 aa, Homo Sapiens
KPYQCNKCC

SEQ ID NO: 624680 - protein, 9 aa, Homo Sapiens
CKAFTVRSN

SEQ ID NO: 624681 - protein, 9 aa, Homo Sapiens
LTINHDAPW

SEQ ID NO: 624682 - protein, 9 aa, Homo Sapiens
STRYCLTEL

SEQ ID NO: 624683 - protein, 9 aa, Homo Sapiens
SGVGGWAAA

SEQ ID NO: 624684 - protein, 9 aa, Homo Sapiens
LQEEGDPYA

SEQ ID NO: 624685 - protein, 9 aa, Homo Sapiens
GFILLAILN

SEQ ID NO: 624686 - protein, 9 aa, Homo Sapiens
SSRLAANTI

SEQ ID NO: 624687 - protein, 9 aa, Homo Sapiens
VFSTSWTPV

SEQ ID NO: 624688 - protein, 9 aa, Homo Sapiens
MARVRLKLK

SEQ ID NO: 624689 - protein, 9 aa, Homo Sapiens
IIFYSAIIW

SEQ ID NO: 624690 - protein, 9 aa, Homo Sapiens
SLRSKPFLG

SEQ ID NO: 624691 - protein, 9 aa, Homo Sapiens
STIVAVEVQ

SEQ ID NO: 624692 - protein, 9 aa, Homo Sapiens
GHLDQLFRC

SEQ ID NO: 624693 - protein, 9 aa, Homo Sapiens
VGPGGYAPE

SEQ ID NO: 624694 - protein, 9 aa, Homo Sapiens
YIAYRLIKH

SEQ ID NO: 624695 - protein, 9 aa, Homo Sapiens
RDGWELFCC

SEQ ID NO: 624696 - protein, 9 aa, Homo Sapiens
TGNGLESAS

SEQ ID NO: 624697 - protein, 9 aa, Homo Sapiens
TCPPLGSTS

SEQ ID NO: 624698 - protein, 9 aa, Homo Sapiens
GGLVRDVSR

SEQ ID NO: 624699 - protein, 9 aa, Homo Sapiens
PLAGAKPLQ

SEQ ID NO: 624700 - protein, 9 aa, Homo Sapiens
IDVWLGGLP

SEQ ID NO: 624701 - protein, 9 aa, Homo Sapiens
DVNKSMYLT

SEQ ID NO: 624702 - protein, 9 aa, Homo Sapiens
PMTIYTEKD

SEQ ID NO: 624703 - protein, 9 aa, Homo Sapiens
VKHLYHQVC

SEQ ID NO: 624704 - protein, 9 aa, Homo Sapiens
ISNYSNSGV

SEQ ID NO: 624705 - protein, 9 aa, Homo Sapiens
IWGKILQLI

SEQ ID NO: 624706 - protein, 9 aa, Homo Sapiens
VPGLQGPAG

SEQ ID NO: 624707 - protein, 9 aa, Homo Sapiens
GFTAKRTLI

SEQ ID NO: 624708 - protein, 9 aa, Homo Sapiens
VKNKGFSVA

SEQ ID NO: 624709 - protein, 9 aa, Homo Sapiens
KWTFFLRAT

SEQ ID NO: 624710 - protein, 9 aa, Homo Sapiens
PFPPGVLSP

SEQ ID NO: 624711 - protein, 9 aa, Homo Sapiens
YLMNKLAVK

SEQ ID NO: 624712 - protein, 9 aa, Homo Sapiens
KHLYHQVCL

SEQ ID NO: 624713 - protein, 9 aa, Homo Sapiens
ARFVVGSRV

SEQ ID NO: 624714 - protein, 9 aa, Homo Sapiens
IEVYTEGER

SEQ ID NO: 624715 - protein, 9 aa, Homo Sapiens
SYSLAWRHG

SEQ ID NO: 624716 - protein, 9 aa, Homo Sapiens
KRKTTSAGG

SEQ ID NO: 624717 - protein, 9 aa, Homo Sapiens
SDSFVNIFP

SEQ ID NO: 624718 - protein, 9 aa, Homo Sapiens
ISQRVTGLE

SEQ ID NO: 624719 - protein, 9 aa, Homo Sapiens
KLAVKNKGF

SEQ ID NO: 624720 - protein, 9 aa, Homo Sapiens
GVQADRVDN

SEQ ID NO: 624721 - protein, 9 aa, Homo Sapiens
IIWVVCPHS

SEQ ID NO: 624722 - protein, 9 aa, Homo Sapiens
FYIPSLPHS

SEQ ID NO: 624723 - protein, 9 aa, Homo Sapiens
VCRDGWELF

SEQ ID NO: 624724 - protein, 9 aa, Homo Sapiens
RLIKHARNN

SEQ ID NO: 624725 - protein, 9 aa, Homo Sapiens
KMYSYSIDH

SEQ ID NO: 624726 - protein, 9 aa, Homo Sapiens
VRKLQANKI

SEQ ID NO: 624727 - protein, 9 aa, Homo Sapiens
GHQGNHGSQ

SEQ ID NO: 624728 - protein, 9 aa, Homo Sapiens
HRDFHLWLT

SEQ ID NO: 624729 - protein, 9 aa, Homo Sapiens
NLFGPVDHQ

SEQ ID NO: 624730 - protein, 9 aa, Homo Sapiens
NGLESASQP

SEQ ID NO: 624731 - protein, 9 aa, Homo Sapiens
MDIVQVTSV

SEQ ID NO: 624732 - protein, 9 aa, Homo Sapiens
ENALQSDSK

SEQ ID NO: 624733 - protein, 9 aa, Homo Sapiens
KTLVTDNNG

SEQ ID NO: 624734 - protein, 9 aa, Homo Sapiens
LGGLPENFL

SEQ ID NO: 624735 - protein, 9 aa, Homo Sapiens
IAYRLIKHA

SEQ ID NO: 624736 - protein, 9 aa, Homo Sapiens
ITRSFEGQA

SEQ ID NO: 624737 - protein, 9 aa, Homo Sapiens
ATSASAAGG

SEQ ID NO: 624738 - protein, 9 aa, Homo Sapiens
LKFSGLYEE

SEQ ID NO: 624739 - protein, 9 aa, Homo Sapiens
VAGERALTR

SEQ ID NO: 624740 - protein, 9 aa, Homo Sapiens
SPVISNELL

SEQ ID NO: 624741 - protein, 9 aa, Homo Sapiens
DRVDNSAVG

SEQ ID NO: 624742 - protein, 9 aa, Homo Sapiens
EHNFPTHAP

SEQ ID NO: 624743 - protein, 9 aa, Homo Sapiens
YCLTELNMA

SEQ ID NO: 624744 - protein, 9 aa, Homo Sapiens
TSILSIKSV

SEQ ID NO: 624745 - protein, 9 aa, Homo Sapiens
YVPTIRVLH

SEQ ID NO: 624746 - protein, 9 aa, Homo Sapiens
ILEGQFAIW

SEQ ID NO: 624747 - protein, 9 aa, Homo Sapiens
ISNELLEQA

SEQ ID NO: 624748 - protein, 9 aa, Homo Sapiens
LEDFRKNED

SEQ ID NO: 624749 - protein, 9 aa, Homo Sapiens
CQRSRATSA

SEQ ID NO: 624750 - protein, 9 aa, Homo Sapiens
IRADTSLNP

SEQ ID NO: 624751 - protein, 9 aa, Homo Sapiens
SQHYFQIEK

SEQ ID NO: 624752 - protein, 9 aa, Homo Sapiens
MYFLIGNLA

SEQ ID NO: 624753 - protein, 9 aa, Homo Sapiens
QVDENWYHR

SEQ ID NO: 624754 - protein, 9 aa, Homo Sapiens
MDDVLPPMP

SEQ ID NO: 624755 - protein, 9 aa, Homo Sapiens
TLTSILSIK

SEQ ID NO: 624756 - protein, 9 aa, Homo Sapiens
YAFFQPHGR

SEQ ID NO: 624757 - protein, 9 aa, Homo Sapiens
VLPPMPWET

SEQ ID NO: 624758 - protein, 9 aa, Homo Sapiens
IKYQFLCSD

SEQ ID NO: 624759 - protein, 9 aa, Homo Sapiens
MYSYSIDHT

SEQ ID NO: 624760 - protein, 9 aa, Homo Sapiens
RLSLLVLNV

SEQ ID NO: 624761 - protein, 9 aa, Homo Sapiens
SPALKVTHF

SEQ ID NO: 624762 - protein, 9 aa, Homo Sapiens
SSSTSSPST

SEQ ID NO: 624763 - protein, 9 aa, Homo Sapiens
LCFNGRVVS

SEQ ID NO: 624764 - protein, 9 aa, Homo Sapiens
HNPMNKQRL

SEQ ID NO: 624765 - protein, 9 aa, Homo Sapiens
QIDLDYQYK

SEQ ID NO: 624766 - protein, 9 aa, Homo Sapiens
HTIPQAHCT

SEQ ID NO: 624767 - protein, 9 aa, Homo Sapiens
SNGNHAAQT

SEQ ID NO: 624768 - protein, 9 aa, Homo Sapiens
GHIARAVMK

SEQ ID NO: 624769 - protein, 9 aa, Homo Sapiens
MSEMYSIPV

SEQ ID NO: 624770 - protein, 9 aa, Homo Sapiens
GSSTRYCLT

SEQ ID NO: 624771 - protein, 9 aa, Homo Sapiens
LMLGSVLRD

SEQ ID NO: 624772 - protein, 9 aa, Homo Sapiens
EEEETIGSS

SEQ ID NO: 624773 - protein, 9 aa, Homo Sapiens
IPDTLTKKS

SEQ ID NO: 624774 - protein, 9 aa, Homo Sapiens
SENVQEKVV

SEQ ID NO: 624775 - protein, 9 aa, Homo Sapiens
VLCNSLLQL

SEQ ID NO: 624776 - protein, 9 aa, Homo Sapiens
HSLVEFHLM

SEQ ID NO: 624777 - protein, 9 aa, Homo Sapiens
LIPQLLTLE

SEQ ID NO: 624778 - protein, 9 aa, Homo Sapiens
LHHLGFPER

SEQ ID NO: 624779 - protein, 9 aa, Homo Sapiens
VNGPGLLEE

SEQ ID NO: 624780 - protein, 9 aa, Homo Sapiens
ESGESSEAS

SEQ ID NO: 624781 - protein, 9 aa, Homo Sapiens
GLPENFLPR

SEQ ID NO: 624782 - protein, 9 aa, Homo Sapiens
LTKKSLSKP

SEQ ID NO: 624783 - protein, 9 aa, Homo Sapiens
DHQELTRDL

SEQ ID NO: 624784 - protein, 9 aa, Homo Sapiens
HQQTGRSVS

SEQ ID NO: 624785 - protein, 9 aa, Homo Sapiens
CNSLLQLAQ

SEQ ID NO: 624786 - protein, 9 aa, Homo Sapiens
STFTPEFLV

SEQ ID NO: 624787 - protein, 9 aa, Homo Sapiens
VVGSRVRHH

SEQ ID NO: 624788 - protein, 9 aa, Homo Sapiens
MYSIPVNNS

SEQ ID NO: 624789 - protein, 9 aa, Homo Sapiens
IETDVLCSP

SEQ ID NO: 624790 - protein, 9 aa, Homo Sapiens
TTVKTLPLF

SEQ ID NO: 624791 - protein, 9 aa, Homo Sapiens
GMNMGMKGQ

SEQ ID NO: 624792 - protein, 9 aa, Homo Sapiens
RARDKNTNQ

SEQ ID NO: 624793 - protein, 9 aa, Homo Sapiens
QTVPASADV

SEQ ID NO: 624794 - protein, 9 aa, Homo Sapiens
RWLLWLLCR

SEQ ID NO: 624795 - protein, 9 aa, Homo Sapiens
IYTEKDLYS

SEQ ID NO: 624796 - protein, 9 aa, Homo Sapiens
AILNMQSAE

SEQ ID NO: 624797 - protein, 9 aa, Homo Sapiens
KGFTAKRTL

SEQ ID NO: 624798 - protein, 9 aa, Homo Sapiens
DTAGLEEYS

SEQ ID NO: 624799 - protein, 9 aa, Homo Sapiens
AVMKIRSAE

SEQ ID NO: 624800 - protein, 9 aa, Homo Sapiens
HYFQIEKAL

SEQ ID NO: 624801 - protein, 9 aa, Homo Sapiens
DPRGGQVHG

SEQ ID NO: 624802 - protein, 9 aa, Homo Sapiens
EAIVHRLSE

SEQ ID NO: 624803 - protein, 9 aa, Homo Sapiens
GEALLHHLG

SEQ ID NO: 624804 - protein, 9 aa, Homo Sapiens
FSYAVPGKA

SEQ ID NO: 624805 - protein, 9 aa, Homo Sapiens
NSAVGFDYQ

SEQ ID NO: 624806 - protein, 9 aa, Homo Sapiens
TVLLERLTG

SEQ ID NO: 624807 - protein, 9 aa, Homo Sapiens
GNAKFDLGL

SEQ ID NO: 624808 - protein, 9 aa, Homo Sapiens
TRTCPPLGS

SEQ ID NO: 624809 - protein, 9 aa, Homo Sapiens
PMNKQRLHC

SEQ ID NO: 624810 - protein, 9 aa, Homo Sapiens
CDMLDPGLV

SEQ ID NO: 624811 - protein, 9 aa, Homo Sapiens
KELQQVDRR

SEQ ID NO: 624812 - protein, 9 aa, Homo Sapiens
RRLVIGFGA

SEQ ID NO: 624813 - protein, 9 aa, Homo Sapiens
FFMARVRLK

SEQ ID NO: 624814 - protein, 9 aa, Homo Sapiens
LARFVVGSR

SEQ ID NO: 624815 - protein, 9 aa, Homo Sapiens
MSFSRRSNL

SEQ ID NO: 624816 - protein, 9 aa, Homo Sapiens
PKGTEVFLM

SEQ ID NO: 624817 - protein, 9 aa, Homo Sapiens
VTGVVSLWG

SEQ ID NO: 624818 - protein, 9 aa, Homo Sapiens
LVDHHRVHT

SEQ ID NO: 624819 - protein, 9 aa, Homo Sapiens
DVLPPMPWE

SEQ ID NO: 624820 - protein, 9 aa, Homo Sapiens
RLIRGGGGA

SEQ ID NO: 624821 - protein, 9 aa, Homo Sapiens
GIVFSAFCW

SEQ ID NO: 624822 - protein, 9 aa, Homo Sapiens
DAYSLMKLV

SEQ ID NO: 624823 - protein, 9 aa, Homo Sapiens
FPVYSNGNH

SEQ ID NO: 624824 - protein, 9 aa, Homo Sapiens
AGAGTGDFA

SEQ ID NO: 624825 - protein, 9 aa, Homo Sapiens
QWDDLCKMT

SEQ ID NO: 624826 - protein, 9 aa, Homo Sapiens
SAPSTGSPS

SEQ ID NO: 624827 - protein, 9 aa, Homo Sapiens
ASCANHRDS

SEQ ID NO: 624828 - protein, 9 aa, Homo Sapiens
HEAVAWWRG

SEQ ID NO: 624829 - protein, 9 aa, Homo Sapiens
AVGSSTRYC

SEQ ID NO: 624830 - protein, 9 aa, Homo Sapiens
KTLEDFRKN

SEQ ID NO: 624831 - protein, 9 aa, Homo Sapiens
TGLRNLGNA

SEQ ID NO: 624832 - protein, 9 aa, Homo Sapiens
YVDMKWEFT

SEQ ID NO: 624833 - protein, 9 aa, Homo Sapiens
QVHGGPFSR

SEQ ID NO: 624834 - protein, 9 aa, Homo Sapiens
NSLLKHIRN

SEQ ID NO: 624835 - protein, 9 aa, Homo Sapiens
LGLDLKDSQ

SEQ ID NO: 624836 - protein, 9 aa, Homo Sapiens
TVLKKQRRK

SEQ ID NO: 624837 - protein, 9 aa, Homo Sapiens
PEELDGENS

SEQ ID NO: 624838 - protein, 9 aa, Homo Sapiens
DHQQLYWSH

SEQ ID NO: 624839 - protein, 9 aa, Homo Sapiens
PRGGQVHGG

SEQ ID NO: 624840 - protein, 9 aa, Homo Sapiens
VRSQLEPTP

SEQ ID NO: 624841 - protein, 9 aa, Homo Sapiens
FRGYGEIFA

SEQ ID NO: 624842 - protein, 9 aa, Homo Sapiens
LQVLHAATC

SEQ ID NO: 624843 - protein, 9 aa, Homo Sapiens
DDNARLLCF

SEQ ID NO: 624844 - protein, 9 aa, Homo Sapiens
MLTINHDAP

SEQ ID NO: 624845 - protein, 9 aa, Homo Sapiens
VFHNPMNKQ

SEQ ID NO: 624846 - protein, 9 aa, Homo Sapiens
DVVRAEIMR

SEQ ID NO: 624847 - protein, 9 aa, Homo Sapiens
EPGPPGHQG

SEQ ID NO: 624848 - protein, 9 aa, Homo Sapiens
RQAPDFYVD

SEQ ID NO: 624849 - protein, 9 aa, Homo Sapiens
PSPTVEGNN

SEQ ID NO: 624850 - protein, 9 aa, Homo Sapiens
PVYSNGNHA

SEQ ID NO: 624851 - protein, 9 aa, Homo Sapiens
RSQLEPTPG

SEQ ID NO: 624852 - protein, 9 aa, Homo Sapiens
GKGFTAKRT

SEQ ID NO: 624853 - protein, 9 aa, Homo Sapiens
ALPWLRWLL

SEQ ID NO: 624854 - protein, 9 aa, Homo Sapiens
FPPGVLSPP

SEQ ID NO: 624855 - protein, 9 aa, Homo Sapiens
PDVPKVKIT

SEQ ID NO: 624856 - protein, 9 aa, Homo Sapiens
AKFDLGLDL

SEQ ID NO: 624857 - protein, 9 aa, Homo Sapiens
QELTRDLEK

SEQ ID NO: 624858 - protein, 9 aa, Homo Sapiens
DQSWIWLDG

SEQ ID NO: 624859 - protein, 9 aa, Homo Sapiens
LHSVTTLPI

SEQ ID NO: 624860 - protein, 9 aa, Homo Sapiens
KRKAIHELI

SEQ ID NO: 624861 - protein, 9 aa, Homo Sapiens
CEDKLILAE

SEQ ID NO: 624862 - protein, 9 aa, Homo Sapiens
TLSSSMKDS

SEQ ID NO: 624863 - protein, 9 aa, Homo Sapiens
SDEHNFPTH

SEQ ID NO: 624864 - protein, 9 aa, Homo Sapiens
RVCACPGID

SEQ ID NO: 624865 - protein, 9 aa, Homo Sapiens
LQRLSLLVL

SEQ ID NO: 624866 - protein, 9 aa, Homo Sapiens
NYDNDDRFG

SEQ ID NO: 624867 - protein, 9 aa, Homo Sapiens
DTHGFEHTI

SEQ ID NO: 624868 - protein, 9 aa, Homo Sapiens
TSSLQHLRG

SEQ ID NO: 624869 - protein, 9 aa, Homo Sapiens
RSNDLFLVH

SEQ ID NO: 624870 - protein, 9 aa, Homo Sapiens
PMKCFVGQS

SEQ ID NO: 624871 - protein, 9 aa, Homo Sapiens
KTWYVVPQE

SEQ ID NO: 624872 - protein, 9 aa, Homo Sapiens
PDTLTKKSL

SEQ ID NO: 624873 - protein, 9 aa, Homo Sapiens
YRARDKNTN

SEQ ID NO: 624874 - protein, 9 aa, Homo Sapiens
IMLVSPLKY

SEQ ID NO: 624875 - protein, 9 aa, Homo Sapiens
KRSKAPSVI

SEQ ID NO: 624876 - protein, 9 aa, Homo Sapiens
ADPMRAPKG

SEQ ID NO: 624877 - protein, 9 aa, Homo Sapiens
RATSASAAG

SEQ ID NO: 624878 - protein, 9 aa, Homo Sapiens
LKSPGELPS

SEQ ID NO: 624879 - protein, 9 aa, Homo Sapiens
VVSLFFIPF

SEQ ID NO: 624880 - protein, 9 aa, Homo Sapiens
SQTLTSILS

SEQ ID NO: 624881 - protein, 9 aa, Homo Sapiens
NECGKGFTA

SEQ ID NO: 624882 - protein, 9 aa, Homo Sapiens
PAFQEKHAM

SEQ ID NO: 624883 - protein, 9 aa, Homo Sapiens
DFYVDMKWE

SEQ ID NO: 624884 - protein, 9 aa, Homo Sapiens
RSVSRREKV

SEQ ID NO: 624885 - protein, 9 aa, Homo Sapiens
VRAGFPCSA

SEQ ID NO: 624886 - protein, 9 aa, Homo Sapiens
LCKMTYLTM

SEQ ID NO: 624887 - protein, 9 aa, Homo Sapiens
VPGKANEIV

SEQ ID NO: 624888 - protein, 9 aa, Homo Sapiens
MKLLIRRTE

SEQ ID NO: 624889 - protein, 9 aa, Homo Sapiens
CVKRKTTSA

SEQ ID NO: 624890 - protein, 9 aa, Homo Sapiens
PNSPQFNVN

SEQ ID NO: 624891 - protein, 9 aa, Homo Sapiens
LEGQFAIWE

SEQ ID NO: 624892 - protein, 9 aa, Homo Sapiens
LVLCHCISR

SEQ ID NO: 624893 - protein, 9 aa, Homo Sapiens
LTSILSIKS

SEQ ID NO: 624894 - protein, 9 aa, Homo Sapiens
RTCPPLGST

SEQ ID NO: 624895 - protein, 9 aa, Homo Sapiens
KSPALKVTH

SEQ ID NO: 624896 - protein, 9 aa, Homo Sapiens
QRAYRFVKE

SEQ ID NO: 624897 - protein, 9 aa, Homo Sapiens
SASAAGGTA

SEQ ID NO: 624898 - protein, 9 aa, Homo Sapiens
ISLQEALSI

SEQ ID NO: 624899 - protein, 9 aa, Homo Sapiens
PAVFSTSWT

SEQ ID NO: 624900 - protein, 9 aa, Homo Sapiens
VQIPRERSQ

SEQ ID NO: 624901 - protein, 9 aa, Homo Sapiens
YSIPVNNSA

SEQ ID NO: 624902 - protein, 9 aa, Homo Sapiens
PITGATGFL

SEQ ID NO: 624903 - protein, 9 aa, Homo Sapiens
IWSPLGALY

SEQ ID NO: 624904 - protein, 9 aa, Homo Sapiens
HLWLTSLPS

SEQ ID NO: 624905 - protein, 9 aa, Homo Sapiens
LEGHLDQLF

SEQ ID NO: 624906 - protein, 9 aa, Homo Sapiens
AVKILSRRV

SEQ ID NO: 624907 - protein, 9 aa, Homo Sapiens
SSTRYCLTE

SEQ ID NO: 624908 - protein, 9 aa, Homo Sapiens
TSASAAGGT

SEQ ID NO: 624909 - protein, 9 aa, Homo Sapiens
KPTAMGQGG

SEQ ID NO: 624910 - protein, 9 aa, Homo Sapiens
NMQSAEGRR

SEQ ID NO: 624911 - protein, 9 aa, Homo Sapiens
ARLLCFNGR

SEQ ID NO: 624912 - protein, 9 aa, Homo Sapiens
EFAANHSSV

SEQ ID NO: 624913 - protein, 9 aa, Homo Sapiens
QGGVAHMIE

SEQ ID NO: 624914 - protein, 9 aa, Homo Sapiens
VRLKLKIIL

SEQ ID NO: 624915 - protein, 9 aa, Homo Sapiens
VRRLVIGFG

SEQ ID NO: 624916 - protein, 9 aa, Homo Sapiens
LSSSMKDSL

SEQ ID NO: 624917 - protein, 9 aa, Homo Sapiens
RNVPRHPNT

SEQ ID NO: 624918 - protein, 9 aa, Homo Sapiens
KYGSQMESW

SEQ ID NO: 624919 - protein, 9 aa, Homo Sapiens
FMARVRLKL

SEQ ID NO: 624920 - protein, 9 aa, Homo Sapiens
KSAPSTGSP

SEQ ID NO: 624921 - protein, 9 aa, Homo Sapiens
CCKAFTVRS

SEQ ID NO: 624922 - protein, 9 aa, Homo Sapiens
SLVEFHLME

SEQ ID NO: 624923 - protein, 9 aa, Homo Sapiens
DVLCSPQMA

SEQ ID NO: 624924 - protein, 9 aa, Homo Sapiens
IFYSAIIWG

SEQ ID NO: 624925 - protein, 9 aa, Homo Sapiens
CCDSAVRVQ

SEQ ID NO: 624926 - protein, 9 aa, Homo Sapiens
HTIEVYTEG

SEQ ID NO: 624927 - protein, 9 aa, Homo Sapiens
AKRTLIIHQ

SEQ ID NO: 624928 - protein, 9 aa, Homo Sapiens
TANYDNDDR

SEQ ID NO: 624929 - protein, 9 aa, Homo Sapiens
VEFHLMELR

SEQ ID NO: 624930 - protein, 9 aa, Homo Sapiens
GTPMKCFVG

SEQ ID NO: 624931 - protein, 9 aa, Homo Sapiens
VHSQERVLT

SEQ ID NO: 624932 - protein, 9 aa, Homo Sapiens
PFSYAVPGK

SEQ ID NO: 624933 - protein, 9 aa, Homo Sapiens
ERRAQRAYR

SEQ ID NO: 624934 - protein, 9 aa, Homo Sapiens
YTDQAIRGE

SEQ ID NO: 624935 - protein, 9 aa, Homo Sapiens
YRLIKHARN

SEQ ID NO: 624936 - protein, 9 aa, Homo Sapiens
YGSQMESWG

SEQ ID NO: 624937 - protein, 9 aa, Homo Sapiens
YSVTDLNVK

SEQ ID NO: 624938 - protein, 9 aa, Homo Sapiens
FSGLYEETC

SEQ ID NO: 624939 - protein, 9 aa, Homo Sapiens
KIVQGSRRR

SEQ ID NO: 624940 - protein, 9 aa, Homo Sapiens
DDVLPPMPW

SEQ ID NO: 624941 - protein, 9 aa, Homo Sapiens
GSRVRHHPS

SEQ ID NO: 624942 - protein, 9 aa, Homo Sapiens
CTKLQHSLD

SEQ ID NO: 624943 - protein, 9 aa, Homo Sapiens
LEQFVKPEE

SEQ ID NO: 624944 - protein, 9 aa, Homo Sapiens
LIQHQRIYT

SEQ ID NO: 624945 - protein, 9 aa, Homo Sapiens
RPGLPQTPP

SEQ ID NO: 624946 - protein, 9 aa, Homo Sapiens
ATRGRPSAP

SEQ ID NO: 624947 - protein, 9 aa, Homo Sapiens
KIKLLLHWI

SEQ ID NO: 624948 - protein, 9 aa, Homo Sapiens
AIIWVVCPH

SEQ ID NO: 624949 - protein, 9 aa, Homo Sapiens
RKTTSAGGE

SEQ ID NO: 624950 - protein, 9 aa, Homo Sapiens
QFNVNGPGL

SEQ ID NO: 624951 - protein, 9 aa, Homo Sapiens
KVDGTRTPR

SEQ ID NO: 624952 - protein, 9 aa, Homo Sapiens
ALKVTHFKG

SEQ ID NO: 624953 - protein, 9 aa, Homo Sapiens
LVSPLKYGS

SEQ ID NO: 624954 - protein, 9 aa, Homo Sapiens
AFYGGKSIP

SEQ ID NO: 624955 - protein, 9 aa, Homo Sapiens
GNNVVVKKQ

SEQ ID NO: 624956 - protein, 9 aa, Homo Sapiens
EETCSDLYV

SEQ ID NO: 624957 - protein, 9 aa, Homo Sapiens
AAAACEAGL

SEQ ID NO: 624958 - protein, 9 aa, Homo Sapiens
SVTDLNVKR

SEQ ID NO: 624959 - protein, 9 aa, Homo Sapiens
AHKAEIWSP

SEQ ID NO: 624960 - protein, 9 aa, Homo Sapiens
VYRARDKNT

SEQ ID NO: 624961 - protein, 9 aa, Homo Sapiens
PFPDYPTLY

SEQ ID NO: 624962 - protein, 9 aa, Homo Sapiens
ADTAVCVQA

SEQ ID NO: 624963 - protein, 9 aa, Homo Sapiens
GADVNKSMY

SEQ ID NO: 624964 - protein, 9 aa, Homo Sapiens
DNAMWTFLN

SEQ ID NO: 624965 - protein, 9 aa, Homo Sapiens
DIVQVTSVF

SEQ ID NO: 624966 - protein, 9 aa, Homo Sapiens
LMKLVLRWY

SEQ ID NO: 624967 - protein, 9 aa, Homo Sapiens
VCGIHPHHQ

SEQ ID NO: 624968 - protein, 9 aa, Homo Sapiens
IDNAMWTFL

SEQ ID NO: 624969 - protein, 9 aa, Homo Sapiens
ASGYGNSYN

SEQ ID NO: 624970 - protein, 9 aa, Homo Sapiens
LAILNMQSA

SEQ ID NO: 624971 - protein, 9 aa, Homo Sapiens
AAVSSLAAL

SEQ ID NO: 624972 - protein, 9 aa, Homo Sapiens
VKPEELDGE

SEQ ID NO: 624973 - protein, 9 aa, Homo Sapiens
GQDGSPQEE

SEQ ID NO: 624974 - protein, 9 aa, Homo Sapiens
TSGPMSEMY

SEQ ID NO: 624975 - protein, 9 aa, Homo Sapiens
GGLPENFLP

SEQ ID NO: 624976 - protein, 9 aa, Homo Sapiens
FDLGLDLKD

SEQ ID NO: 624977 - protein, 9 aa, Homo Sapiens
PVGQVITIG

SEQ ID NO: 624978 - protein, 9 aa, Homo Sapiens
IDLNQIFLC

SEQ ID NO: 624979 - protein, 9 aa, Homo Sapiens
QDLLWTLQP

SEQ ID NO: 624980 - protein, 9 aa, Homo Sapiens
VQEKVVDLS

SEQ ID NO: 624981 - protein, 9 aa, Homo Sapiens
EIWSPLGAL

SEQ ID NO: 624982 - protein, 9 aa, Homo Sapiens
QHSVDQSWI

SEQ ID NO: 624983 - protein, 9 aa, Homo Sapiens
TCQFPDTCQ

SEQ ID NO: 624984 - protein, 9 aa, Homo Sapiens
QTGRSVSRR

SEQ ID NO: 624985 - protein, 9 aa, Homo Sapiens
SEEDCCGAP

SEQ ID NO: 624986 - protein, 9 aa, Homo Sapiens
KPEPTNYSV

SEQ ID NO: 624987 - protein, 9 aa, Homo Sapiens
VDHHRVHTG

SEQ ID NO: 624988 - protein, 9 aa, Homo Sapiens
DASKLNQNY

SEQ ID NO: 624989 - protein, 9 aa, Homo Sapiens
TNYSVEVSP

SEQ ID NO: 624990 - protein, 9 aa, Homo Sapiens
AREGALVAL

SEQ ID NO: 624991 - protein, 9 aa, Homo Sapiens
CGIHPHHQE

SEQ ID NO: 624992 - protein, 9 aa, Homo Sapiens
HTPNSLLKH

SEQ ID NO: 624993 - protein, 9 aa, Homo Sapiens
DKMYSYSID

SEQ ID NO: 624994 - protein, 9 aa, Homo Sapiens
HLRGSNLTT

SEQ ID NO: 624995 - protein, 9 aa, Homo Sapiens
LMELRNKDT

SEQ ID NO: 624996 - protein, 9 aa, Homo Sapiens
LKVTHFKGC

SEQ ID NO: 624997 - protein, 9 aa, Homo Sapiens
GETCQFPDT

SEQ ID NO: 624998 - protein, 9 aa, Homo Sapiens
YSPCAWDVV

SEQ ID NO: 624999 - protein, 9 aa, Homo Sapiens
SEASLDGSR

SEQ ID NO: 625000 - protein, 9 aa, Homo Sapiens
TVKNLSPVI

SEQ ID NO: 625001 - protein, 9 aa, Homo Sapiens
SLQHLRGSN

SEQ ID NO: 625002 - protein, 9 aa, Homo Sapiens
AIVHRLSED

SEQ ID NO: 625003 - protein, 9 aa, Homo Sapiens
DFRYACQSH

SEQ ID NO: 625004 - protein, 9 aa, Homo Sapiens
QMAPFPDYP

SEQ ID NO: 625005 - protein, 9 aa, Homo Sapiens
CVKRTTLVD

SEQ ID NO: 625006 - protein, 9 aa, Homo Sapiens
SGEMCRLKL

SEQ ID NO: 625007 - protein, 9 aa, Homo Sapiens
YNSQSGLQS

SEQ ID NO: 625008 - protein, 9 aa, Homo Sapiens
AFQEKHAMK

SEQ ID NO: 625009 - protein, 9 aa, Homo Sapiens
FPDYPTLYN

SEQ ID NO: 625010 - protein, 9 aa, Homo Sapiens
WIFQFLLNF

SEQ ID NO: 625011 - protein, 9 aa, Homo Sapiens
IPVCLPPAS

SEQ ID NO: 625012 - protein, 9 aa, Homo Sapiens
AGAERVRSQ

SEQ ID NO: 625013 - protein, 9 aa, Homo Sapiens
PEPTNYSVE

SEQ ID NO: 625014 - protein, 9 aa, Homo Sapiens
LTSFRPASC

SEQ ID NO: 625015 - protein, 9 aa, Homo Sapiens
VHGGPFSRL

SEQ ID NO: 625016 - protein, 9 aa, Homo Sapiens
EEETIGSSA

SEQ ID NO: 625017 - protein, 9 aa, Homo Sapiens
NRLESQHYF

SEQ ID NO: 625018 - protein, 9 aa, Homo Sapiens
VLLERLTGA

SEQ ID NO: 625019 - protein, 9 aa, Homo Sapiens
SLNPPMYFF

SEQ ID NO: 625020 - protein, 9 aa, Homo Sapiens
CQKDVFFGP

SEQ ID NO: 625021 - protein, 9 aa, Homo Sapiens
SEMPQNLST

SEQ ID NO: 625022 - protein, 9 aa, Homo Sapiens
EHTIEVYTE

SEQ ID NO: 625023 - protein, 9 aa, Homo Sapiens
AQRAYRFVK

SEQ ID NO: 625024 - protein, 9 aa, Homo Sapiens
LESGVGGWA

SEQ ID NO: 625025 - protein, 9 aa, Homo Sapiens
FPCSARFTP

SEQ ID NO: 625026 - protein, 9 aa, Homo Sapiens
LMNKLAVKN

SEQ ID NO: 625027 - protein, 9 aa, Homo Sapiens
ANYDNDDRF

SEQ ID NO: 625028 - protein, 9 aa, Homo Sapiens
LAQMYFFLI

SEQ ID NO: 625029 - protein, 9 aa, Homo Sapiens
SLFFIPFMC

SEQ ID NO: 625030 - protein, 9 aa, Homo Sapiens
PDKVHRDFH

SEQ ID NO: 625031 - protein, 9 aa, Homo Sapiens
SHQQTGRSV

SEQ ID NO: 625032 - protein, 9 aa, Homo Sapiens
PSSMVTAIG

SEQ ID NO: 625033 - protein, 9 aa, Homo Sapiens
TSSPSTSSP

SEQ ID NO: 625034 - protein, 9 aa, Homo Sapiens
RNTDLPPEE

SEQ ID NO: 625035 - protein, 9 aa, Homo Sapiens
DQIDLDYQY

SEQ ID NO: 625036 - protein, 9 aa, Homo Sapiens
QADRVDNSA

SEQ ID NO: 625037 - protein, 9 aa, Homo Sapiens
VKDSLGAYC

SEQ ID NO: 625038 - protein, 9 aa, Homo Sapiens
KNQKPAKYV

SEQ ID NO: 625039 - protein, 9 aa, Homo Sapiens
AEDLMKLLI

SEQ ID NO: 625040 - protein, 9 aa, Homo Sapiens
VSENVQEKV

SEQ ID NO: 625041 - protein, 9 aa, Homo Sapiens
CADPMRAPK

SEQ ID NO: 625042 - protein, 9 aa, Homo Sapiens
LSLLVLNVS

SEQ ID NO: 625043 - protein, 9 aa, Homo Sapiens
TTSAGGESA

SEQ ID NO: 625044 - protein, 9 aa, Homo Sapiens
PKTWYVVPQ

SEQ ID NO: 625045 - protein, 9 aa, Homo Sapiens
VLYGTPMKC

SEQ ID NO: 625046 - protein, 9 aa, Homo Sapiens
QRLSLLVLN

SEQ ID NO: 625047 - protein, 9 aa, Homo Sapiens
GEMCRLKLL

SEQ ID NO: 625048 - protein, 9 aa, Homo Sapiens
GLYFIISGS

SEQ ID NO: 625049 - protein, 9 aa, Homo Sapiens
PGELPSAST

SEQ ID NO: 625050 - protein, 9 aa, Homo Sapiens
SVSRREKVR

SEQ ID NO: 625051 - protein, 9 aa, Homo Sapiens
KVHRDFHLW

SEQ ID NO: 625052 - protein, 9 aa, Homo Sapiens
LEVRRLVIG

SEQ ID NO: 625053 - protein, 9 aa, Homo Sapiens
DTLTKKSLS

SEQ ID NO: 625054 - protein, 9 aa, Homo Sapiens
YASYVPTIR

SEQ ID NO: 625055 - protein, 9 aa, Homo Sapiens
LDNELSLPL

SEQ ID NO: 625056 - protein, 9 aa, Homo Sapiens
VLSPPGSSW

SEQ ID NO: 625057 - protein, 9 aa, Homo Sapiens
EPDASKLNQ

SEQ ID NO: 625058 - protein, 9 aa, Homo Sapiens
RNLVDHHRV

SEQ ID NO: 625059 - protein, 9 aa, Homo Sapiens
EECGMSFSR

SEQ ID NO: 625060 - protein, 9 aa, Homo Sapiens
HQRIYTGEK

SEQ ID NO: 625061 - protein, 9 aa, Homo Sapiens
ETPSETPGP

SEQ ID NO: 625062 - protein, 9 aa, Homo Sapiens
ISRTKCADP

SEQ ID NO: 625063 - protein, 9 aa, Homo Sapiens
RKLELPTGP

SEQ ID NO: 625064 - protein, 9 aa, Homo Sapiens
RDFHLWLTS

SEQ ID NO: 625065 - protein, 9 aa, Homo Sapiens
SPSTSSPSS

SEQ ID NO: 625066 - protein, 9 aa, Homo Sapiens
LETIWRFQE

SEQ ID NO: 625067 - protein, 9 aa, Homo Sapiens
GTRKLLVAV

SEQ ID NO: 625068 - protein, 9 aa, Homo Sapiens
LFIVLLLST

SEQ ID NO: 625069 - protein, 9 aa, Homo Sapiens
KMSAAVGSV

SEQ ID NO: 625070 - protein, 9 aa, Homo Sapiens
KLQANKIVQ

SEQ ID NO: 625071 - protein, 9 aa, Homo Sapiens
DEHNFPTHA

SEQ ID NO: 625072 - protein, 9 aa, Homo Sapiens
GGVAHMIEW

SEQ ID NO: 625073 - protein, 9 aa, Homo Sapiens
APFPDYPTL

SEQ ID NO: 625074 - protein, 9 aa, Homo Sapiens
SQVVSENVQ

SEQ ID NO: 625075 - protein, 9 aa, Homo Sapiens
VPPEKKPTP

SEQ ID NO: 625076 - protein, 9 aa, Homo Sapiens
WVTKRKLEL

SEQ ID NO: 625077 - protein, 9 aa, Homo Sapiens
FYVDMKWEF

SEQ ID NO: 625078 - protein, 9 aa, Homo Sapiens
PFFRGYGEI

SEQ ID NO: 625079 - protein, 9 aa, Homo Sapiens
GGKWTFFLR

SEQ ID NO: 625080 - protein, 9 aa, Homo Sapiens
LIFGNIDSY

SEQ ID NO: 625081 - protein, 9 aa, Homo Sapiens
VCLPPASVT

SEQ ID NO: 625082 - protein, 9 aa, Homo Sapiens
THSDGAIST

SEQ ID NO: 625083 - protein, 9 aa, Homo Sapiens
VKILSRRVE

SEQ ID NO: 625084 - protein, 9 aa, Homo Sapiens
KRYCRWKDS

SEQ ID NO: 625085 - protein, 9 aa, Homo Sapiens
PYTCKVRGS

SEQ ID NO: 625086 - protein, 9 aa, Homo Sapiens
LGNACYMNS

SEQ ID NO: 625087 - protein, 9 aa, Homo Sapiens
TIYTEKDLY

SEQ ID NO: 625088 - protein, 9 aa, Homo Sapiens
AETPSETPG

SEQ ID NO: 625089 - protein, 9 aa, Homo Sapiens
FAVVIVDPQ

SEQ ID NO: 625090 - protein, 9 aa, Homo Sapiens
YDNDDRFGF

SEQ ID NO: 625091 - protein, 9 aa, Homo Sapiens
SYLMNKLAV

SEQ ID NO: 625092 - protein, 9 aa, Homo Sapiens
SSILEGQFA

SEQ ID NO: 625093 - protein, 9 aa, Homo Sapiens
QEATLRNKV

SEQ ID NO: 625094 - protein, 9 aa, Homo Sapiens
GVVSLWGRP

SEQ ID NO: 625095 - protein, 9 aa, Homo Sapiens
GPSGVPGLQ

SEQ ID NO: 625096 - protein, 9 aa, Homo Sapiens
RKSPQEGRP

SEQ ID NO: 625097 - protein, 9 aa, Homo Sapiens
LWTLQPHQA

SEQ ID NO: 625098 - protein, 9 aa, Homo Sapiens
YAPEFVPPP

SEQ ID NO: 625099 - protein, 9 aa, Homo Sapiens
FDSKDSMIL

SEQ ID NO: 625100 - protein, 9 aa, Homo Sapiens
GSDEHNFPT

SEQ ID NO: 625101 - protein, 9 aa, Homo Sapiens
HGFEHTIEV

SEQ ID NO: 625102 - protein, 9 aa, Homo Sapiens
IDLDYQYKL

SEQ ID NO: 625103 - protein, 9 aa, Homo Sapiens
SAVRVQAVD

SEQ ID NO: 625104 - protein, 9 aa, Homo Sapiens
RVEANTQRE

SEQ ID NO: 625105 - protein, 9 aa, Homo Sapiens
FIVLLLSTI

SEQ ID NO: 625106 - protein, 9 aa, Homo Sapiens
LDSSVNVQV

SEQ ID NO: 625107 - protein, 9 aa, Homo Sapiens
LLLHWIPED

SEQ ID NO: 625108 - protein, 9 aa, Homo Sapiens
GALVGLEVR

SEQ ID NO: 625109 - protein, 9 aa, Homo Sapiens
LNVSVMHKS

SEQ ID NO: 625110 - protein, 9 aa, Homo Sapiens
FRYACQSHE

SEQ ID NO: 625111 - protein, 9 aa, Homo Sapiens
SILLLNFQG

SEQ ID NO: 625112 - protein, 9 aa, Homo Sapiens
IKKSPALKV

SEQ ID NO: 625113 - protein, 9 aa, Homo Sapiens
AAATRGRPS

SEQ ID NO: 625114 - protein, 9 aa, Homo Sapiens
LSPVISNEL

SEQ ID NO: 625115 - protein, 9 aa, Homo Sapiens
RYISSDTSS

SEQ ID NO: 625116 - protein, 9 aa, Homo Sapiens
HCVKRTTLV

SEQ ID NO: 625117 - protein, 9 aa, Homo Sapiens
ELIQHQRIY

SEQ ID NO: 625118 - protein, 9 aa, Homo Sapiens
CSSRLAANT

SEQ ID NO: 625119 - protein, 9 aa, Homo Sapiens
TICCDSAVR

SEQ ID NO: 625120 - protein, 9 aa, Homo Sapiens
YVFAHTAII

SEQ ID NO: 625121 - protein, 9 aa, Homo Sapiens
TFFLRATKL

SEQ ID NO: 625122 - protein, 9 aa, Homo Sapiens
DSLGAYCID

SEQ ID NO: 625123 - protein, 9 aa, Homo Sapiens
CCGAPDNSH

SEQ ID NO: 625124 - protein, 9 aa, Homo Sapiens
FGAAREGAL

SEQ ID NO: 625125 - protein, 9 aa, Homo Sapiens
NDLFLVHHL

SEQ ID NO: 625126 - protein, 9 aa, Homo Sapiens
SSEASLDGS

SEQ ID NO: 625127 - protein, 9 aa, Homo Sapiens
LVGRVAAAP

SEQ ID NO: 625128 - protein, 9 aa, Homo Sapiens
AQMYFFLIF

SEQ ID NO: 625129 - protein, 9 aa, Homo Sapiens
NYSVEVSPD

SEQ ID NO: 625130 - protein, 9 aa, Homo Sapiens
DVPKVKITV

SEQ ID NO: 625131 - protein, 9 aa, Homo Sapiens
SFVNIFPEK

SEQ ID NO: 625132 - protein, 9 aa, Homo Sapiens
PTNYSVEVS

SEQ ID NO: 625133 - protein, 9 aa, Homo Sapiens
TFEDITRSF

SEQ ID NO: 625134 - protein, 9 aa, Homo Sapiens
HLYHQVCLQ

SEQ ID NO: 625135 - protein, 9 aa, Homo Sapiens
ELPVGQVIT

SEQ ID NO: 625136 - protein, 9 aa, Homo Sapiens
LKLLEISCN

SEQ ID NO: 625137 - protein, 9 aa, Homo Sapiens
TEVFLMLGS

SEQ ID NO: 625138 - protein, 9 aa, Homo Sapiens
FNVMCTLLI

SEQ ID NO: 625139 - protein, 9 aa, Homo Sapiens
HKPSVQKTK

SEQ ID NO: 625140 - protein, 9 aa, Homo Sapiens
HPYSPKVDG

SEQ ID NO: 625141 - protein, 9 aa, Homo Sapiens
GESSEASLD

SEQ ID NO: 625142 - protein, 9 aa, Homo Sapiens
NLPLRHFTL

SEQ ID NO: 625143 - protein, 9 aa, Homo Sapiens
LNQNYCRNP

SEQ ID NO: 625144 - protein, 9 aa, Homo Sapiens
MNKLAVKNK

SEQ ID NO: 625145 - protein, 9 aa, Homo Sapiens
IRGGGGACP

SEQ ID NO: 625146 - protein, 9 aa, Homo Sapiens
QERVLTQLR

SEQ ID NO: 625147 - protein, 9 aa, Homo Sapiens
LPHSFLMKL

SEQ ID NO: 625148 - protein, 9 aa, Homo Sapiens
TPMKCFVGQ

SEQ ID NO: 625149 - protein, 9 aa, Homo Sapiens
MTIITRTCP

SEQ ID NO: 625150 - protein, 9 aa, Homo Sapiens
GLQHYELLN

SEQ ID NO: 625151 - protein, 9 aa, Homo Sapiens
NLTTHRKLF

SEQ ID NO: 625152 - protein, 9 aa, Homo Sapiens
ATVYRARDK

SEQ ID NO: 625153 - protein, 9 aa, Homo Sapiens
RCDRPPPGR

SEQ ID NO: 625154 - protein, 9 aa, Homo Sapiens
ISTFTPEFL

SEQ ID NO: 625155 - protein, 9 aa, Homo Sapiens
SSKRSKAPS

SEQ ID NO: 625156 - protein, 9 aa, Homo Sapiens
WSPLGALYY

SEQ ID NO: 625157 - protein, 9 aa, Homo Sapiens
QIKKSPALK

SEQ ID NO: 625158 - protein, 9 aa, Homo Sapiens
ELDGENSYK

SEQ ID NO: 625159 - protein, 9 aa, Homo Sapiens
SLWGRPVVL

SEQ ID NO: 625160 - protein, 9 aa, Homo Sapiens
DLMRCLRLR

SEQ ID NO: 625161 - protein, 9 aa, Homo Sapiens
AGQLVGTRK

SEQ ID NO: 625162 - protein, 9 aa, Homo Sapiens
GRLIRGGGG

SEQ ID NO: 625163 - protein, 9 aa, Homo Sapiens
ASYVPTIRV

SEQ ID NO: 625164 - protein, 9 aa, Homo Sapiens
DLLVPLVED

SEQ ID NO: 625165 - protein, 9 aa, Homo Sapiens
QLEPTPGRF

SEQ ID NO: 625166 - protein, 9 aa, Homo Sapiens
GPEEECDML

SEQ ID NO: 625167 - protein, 9 aa, Homo Sapiens
YFLIGNLAL

SEQ ID NO: 625168 - protein, 9 aa, Homo Sapiens
GIYPNRNVP

SEQ ID NO: 625169 - protein, 9 aa, Homo Sapiens
EEDAYSLMK

SEQ ID NO: 625170 - protein, 9 aa, Homo Sapiens
PLIPVCLPP

SEQ ID NO: 625171 - protein, 9 aa, Homo Sapiens
TEKDLYSYV

SEQ ID NO: 625172 - protein, 9 aa, Homo Sapiens
SRTKCADPM

SEQ ID NO: 625173 - protein, 9 aa, Homo Sapiens
PGPPGHQGN

SEQ ID NO: 625174 - protein, 9 aa, Homo Sapiens
FVVGSRVRH

SEQ ID NO: 625175 - protein, 9 aa, Homo Sapiens
WAAATRGRP

SEQ ID NO: 625176 - protein, 9 aa, Homo Sapiens
GKSIPITGA

SEQ ID NO: 625177 - protein, 9 aa, Homo Sapiens
RVGALVGLE

SEQ ID NO: 625178 - protein, 9 aa, Homo Sapiens
MGMNMGMKG

SEQ ID NO: 625179 - protein, 9 aa, Homo Sapiens
KDSLCAKCT

SEQ ID NO: 625180 - protein, 9 aa, Homo Sapiens
FVYLHSVTT

SEQ ID NO: 625181 - protein, 9 aa, Homo Sapiens
FRGIPGPVG

SEQ ID NO: 625182 - protein, 9 aa, Homo Sapiens
VMEFSRSKS

SEQ ID NO: 625183 - protein, 9 aa, Homo Sapiens
KIINKVSKP

SEQ ID NO: 625184 - protein, 9 aa, Homo Sapiens
CISNETKDL

SEQ ID NO: 625185 - protein, 9 aa, Homo Sapiens
LNHEIHVWR

SEQ ID NO: 625186 - protein, 9 aa, Homo Sapiens
TLTPDSYGG

SEQ ID NO: 625187 - protein, 9 aa, Homo Sapiens
RLDQLIYIQ

SEQ ID NO: 625188 - protein, 9 aa, Homo Sapiens
MGGAKVMAS

SEQ ID NO: 625189 - protein, 9 aa, Homo Sapiens
LVKAYQHCV

SEQ ID NO: 625190 - protein, 9 aa, Homo Sapiens
CFLLAKMAY

SEQ ID NO: 625191 - protein, 9 aa, Homo Sapiens
DNGKLGHGY

SEQ ID NO: 625192 - protein, 9 aa, Homo Sapiens
PPSASVVRA

SEQ ID NO: 625193 - protein, 9 aa, Homo Sapiens
PVEVDHSTR

SEQ ID NO: 625194 - protein, 9 aa, Homo Sapiens
ILVLLPGTK

SEQ ID NO: 625195 - protein, 9 aa, Homo Sapiens
SHRDPVDGT

SEQ ID NO: 625196 - protein, 9 aa, Homo Sapiens
VSHGTSPGE

SEQ ID NO: 625197 - protein, 9 aa, Homo Sapiens
EQILNLYTK

SEQ ID NO: 625198 - protein, 9 aa, Homo Sapiens
TVNFSGVNR

SEQ ID NO: 625199 - protein, 9 aa, Homo Sapiens
NEGFEDDLD

SEQ ID NO: 625200 - protein, 9 aa, Homo Sapiens
CSLSMTVSM

SEQ ID NO: 625201 - protein, 9 aa, Homo Sapiens
SEIVELNHE

SEQ ID NO: 625202 - protein, 9 aa, Homo Sapiens
CVGLQDHLF

SEQ ID NO: 625203 - protein, 9 aa, Homo Sapiens
IKSKSLDRT

SEQ ID NO: 625204 - protein, 9 aa, Homo Sapiens
IAVLLSFSR

SEQ ID NO: 625205 - protein, 9 aa, Homo Sapiens
LLNSCLSHF

SEQ ID NO: 625206 - protein, 9 aa, Homo Sapiens
FVMGLLGSS

SEQ ID NO: 625207 - protein, 9 aa, Homo Sapiens
VLLSFSRIA

SEQ ID NO: 625208 - protein, 9 aa, Homo Sapiens
NLLVYIKIY

SEQ ID NO: 625209 - protein, 9 aa, Homo Sapiens
SKDSWHWST

SEQ ID NO: 625210 - protein, 9 aa, Homo Sapiens
TCPSSPPLC

SEQ ID NO: 625211 - protein, 9 aa, Homo Sapiens
DAATKIINK

SEQ ID NO: 625212 - protein, 9 aa, Homo Sapiens
LVLLPGTKY

SEQ ID NO: 625213 - protein, 9 aa, Homo Sapiens
TAQCAFTVA

SEQ ID NO: 625214 - protein, 9 aa, Homo Sapiens
DSNDDPLEA

SEQ ID NO: 625215 - protein, 9 aa, Homo Sapiens
LRNINPING

SEQ ID NO: 625216 - protein, 9 aa, Homo Sapiens
PVLEWAVSH

SEQ ID NO: 625217 - protein, 9 aa, Homo Sapiens
GLQDHLFEF

SEQ ID NO: 625218 - protein, 9 aa, Homo Sapiens
LKDAHKEEI

SEQ ID NO: 625219 - protein, 9 aa, Homo Sapiens
GVCELPGGT

SEQ ID NO: 625220 - protein, 9 aa, Homo Sapiens
SSSREGLSS

SEQ ID NO: 625221 - protein, 9 aa, Homo Sapiens
RGLVSHGTS

SEQ ID NO: 625222 - protein, 9 aa, Homo Sapiens
LNLYTKLLE

SEQ ID NO: 625223 - protein, 9 aa, Homo Sapiens
TDQSGTMNS

SEQ ID NO: 625224 - protein, 9 aa, Homo Sapiens
SIQDDVSFI

SEQ ID NO: 625225 - protein, 9 aa, Homo Sapiens
PSASSEHMR

SEQ ID NO: 625226 - protein, 9 aa, Homo Sapiens
GPEGFRGIP

SEQ ID NO: 625227 - protein, 9 aa, Homo Sapiens
QHCVSAAHK

SEQ ID NO: 625228 - protein, 9 aa, Homo Sapiens
QALSGCEIC

SEQ ID NO: 625229 - protein, 9 aa, Homo Sapiens
SVNGVALRV

SEQ ID NO: 625230 - protein, 9 aa, Homo Sapiens
PSSPPLCAS

SEQ ID NO: 625231 - protein, 9 aa, Homo Sapiens
NIVGLLIPF

SEQ ID NO: 625232 - protein, 9 aa, Homo Sapiens
ASKLPYAAA

SEQ ID NO: 625233 - protein, 9 aa, Homo Sapiens
LAKMAYDRY

SEQ ID NO: 625234 - protein, 9 aa, Homo Sapiens
SVGGERVSV

SEQ ID NO: 625235 - protein, 9 aa, Homo Sapiens
GNRDSAEIR

SEQ ID NO: 625236 - protein, 9 aa, Homo Sapiens
GQMGLTANK

SEQ ID NO: 625237 - protein, 9 aa, Homo Sapiens
SLSMTVSMD

SEQ ID NO: 625238 - protein, 9 aa, Homo Sapiens
LPCFSIVGF

SEQ ID NO: 625239 - protein, 9 aa, Homo Sapiens
NGKLGHGYT

SEQ ID NO: 625240 - protein, 9 aa, Homo Sapiens
GLPHEESIK

SEQ ID NO: 625241 - protein, 9 aa, Homo Sapiens
NPEIQKVRA

SEQ ID NO: 625242 - protein, 9 aa, Homo Sapiens
NFSGVNRPF

SEQ ID NO: 625243 - protein, 9 aa, Homo Sapiens
TVSMQEFLM

SEQ ID NO: 625244 - protein, 9 aa, Homo Sapiens
QESGAEQPR

SEQ ID NO: 625245 - protein, 9 aa, Homo Sapiens
EGLSSQLLR

SEQ ID NO: 625246 - protein, 9 aa, Homo Sapiens
ITSVSLNHS

SEQ ID NO: 625247 - protein, 9 aa, Homo Sapiens
CEICISNET

SEQ ID NO: 625248 - protein, 9 aa, Homo Sapiens
LTANKHSFQ

SEQ ID NO: 625249 - protein, 9 aa, Homo Sapiens
ANPTVSMQE

SEQ ID NO: 625250 - protein, 9 aa, Homo Sapiens
QDDVSFILK

SEQ ID NO: 625251 - protein, 9 aa, Homo Sapiens
VSIINIYKK

SEQ ID NO: 625252 - protein, 9 aa, Homo Sapiens
LEAELALTP

SEQ ID NO: 625253 - protein, 9 aa, Homo Sapiens
VCSGLDHDV

SEQ ID NO: 625254 - protein, 9 aa, Homo Sapiens
SEHMRTLFG

SEQ ID NO: 625255 - protein, 9 aa, Homo Sapiens
TILKIHYAE

SEQ ID NO: 625256 - protein, 9 aa, Homo Sapiens
LVLGLRGCQ

SEQ ID NO: 625257 - protein, 9 aa, Homo Sapiens
YKFAGGWTL

SEQ ID NO: 625258 - protein, 9 aa, Homo Sapiens
VMMNVNTRG

SEQ ID NO: 625259 - protein, 9 aa, Homo Sapiens
SFILKPSVE

SEQ ID NO: 625260 - protein, 9 aa, Homo Sapiens
YIQLPDEKS

SEQ ID NO: 625261 - protein, 9 aa, Homo Sapiens
LATYVIILL

SEQ ID NO: 625262 - protein, 9 aa, Homo Sapiens
ALSGCEICI

SEQ ID NO: 625263 - protein, 9 aa, Homo Sapiens
SSPPLCASA

SEQ ID NO: 625264 - protein, 9 aa, Homo Sapiens
MPLRGRLSV

SEQ ID NO: 625265 - protein, 9 aa, Homo Sapiens
LADREKTAA

SEQ ID NO: 625266 - protein, 9 aa, Homo Sapiens
SCWEFFPAG

SEQ ID NO: 625267 - protein, 9 aa, Homo Sapiens
RVSTKVRDY

SEQ ID NO: 625268 - protein, 9 aa, Homo Sapiens
YLPVLVCSG

SEQ ID NO: 625269 - protein, 9 aa, Homo Sapiens
AKMAYDRYV

SEQ ID NO: 625270 - protein, 9 aa, Homo Sapiens
KRQRRKEPL

SEQ ID NO: 625271 - protein, 9 aa, Homo Sapiens
KMYQESCWE

SEQ ID NO: 625272 - protein, 9 aa, Homo Sapiens
LLQEAKDDV

SEQ ID NO: 625273 - protein, 9 aa, Homo Sapiens
RDLEHWQGR

SEQ ID NO: 625274 - protein, 9 aa, Homo Sapiens
MDEYVLTTL

SEQ ID NO: 625275 - protein, 9 aa, Homo Sapiens
KMAYDRYVA

SEQ ID NO: 625276 - protein, 9 aa, Homo Sapiens
SGVNRPFCS

SEQ ID NO: 625277 - protein, 9 aa, Homo Sapiens
VPGVEGKEG

SEQ ID NO: 625278 - protein, 9 aa, Homo Sapiens
QRNYARLQQ

SEQ ID NO: 625279 - protein, 9 aa, Homo Sapiens
RKEPLIISK

SEQ ID NO: 625280 - protein, 9 aa, Homo Sapiens
SLRNINPIN

SEQ ID NO: 625281 - protein, 9 aa, Homo Sapiens
FKMNIVGLL

SEQ ID NO: 625282 - protein, 9 aa, Homo Sapiens
RQRRKEPLI

SEQ ID NO: 625283 - protein, 9 aa, Homo Sapiens
CQTIEVPTI

SEQ ID NO: 625284 - protein, 9 aa, Homo Sapiens
LTKVRLTFR

SEQ ID NO: 625285 - protein, 9 aa, Homo Sapiens
VFGSFKLES

SEQ ID NO: 625286 - protein, 9 aa, Homo Sapiens
GVSNDAVVS

SEQ ID NO: 625287 - protein, 9 aa, Homo Sapiens
MNIVGLLIP

SEQ ID NO: 625288 - protein, 9 aa, Homo Sapiens
GLYAIAVLL

SEQ ID NO: 625289 - protein, 9 aa, Homo Sapiens
QFMVNDLSR

SEQ ID NO: 625290 - protein, 9 aa, Homo Sapiens
DPVEVDHST

SEQ ID NO: 625291 - protein, 9 aa, Homo Sapiens
NANNNVGNP

SEQ ID NO: 625292 - protein, 9 aa, Homo Sapiens
GVALRVSSM

SEQ ID NO: 625293 - protein, 9 aa, Homo Sapiens
HEESIKEFT

SEQ ID NO: 625294 - protein, 9 aa, Homo Sapiens
REGLSSQLL

SEQ ID NO: 625295 - protein, 9 aa, Homo Sapiens
PEGFRGIPG

SEQ ID NO: 625296 - protein, 9 aa, Homo Sapiens
DREKTAAEQ

SEQ ID NO: 625297 - protein, 9 aa, Homo Sapiens
SWERVSTKV

SEQ ID NO: 625298 - protein, 9 aa, Homo Sapiens
PGPKLGKCP

SEQ ID NO: 625299 - protein, 9 aa, Homo Sapiens
EKLEQADAH

SEQ ID NO: 625300 - protein, 9 aa, Homo Sapiens
SRKSSLQTH

SEQ ID NO: 625301 - protein, 9 aa, Homo Sapiens
HPYLPVLVC

SEQ ID NO: 625302 - protein, 9 aa, Homo Sapiens
VLNHLLYAV

SEQ ID NO: 625303 - protein, 9 aa, Homo Sapiens
RRLELESIQ

SEQ ID NO: 625304 - protein, 9 aa, Homo Sapiens
TFLSLRNIN

SEQ ID NO: 625305 - protein, 9 aa, Homo Sapiens
TTFLSIYVA

SEQ ID NO: 625306 - protein, 9 aa, Homo Sapiens
WDERLRALN

SEQ ID NO: 625307 - protein, 9 aa, Homo Sapiens
IKDKEAIFI

SEQ ID NO: 625308 - protein, 9 aa, Homo Sapiens
LRGCQAARW

SEQ ID NO: 625309 - protein, 9 aa, Homo Sapiens
LFEFGSCMS

SEQ ID NO: 625310 - protein, 9 aa, Homo Sapiens
TECFLLAKM

SEQ ID NO: 625311 - protein, 9 aa, Homo Sapiens
FLSLRNINP

SEQ ID NO: 625312 - protein, 9 aa, Homo Sapiens
RVLFLTPQF

SEQ ID NO: 625313 - protein, 9 aa, Homo Sapiens
SSEHMRTLF

SEQ ID NO: 625314 - protein, 9 aa, Homo Sapiens
ATYVIILLL

SEQ ID NO: 625315 - protein, 9 aa, Homo Sapiens
DGSSSREGL

SEQ ID NO: 625316 - protein, 9 aa, Homo Sapiens
YSCNANNNV

SEQ ID NO: 625317 - protein, 9 aa, Homo Sapiens
ALRVSSMRR

SEQ ID NO: 625318 - protein, 9 aa, Homo Sapiens
ILNLYTKLL

SEQ ID NO: 625319 - protein, 9 aa, Homo Sapiens
HKGGEEGHV

SEQ ID NO: 625320 - protein, 9 aa, Homo Sapiens
QPEPGVADK

SEQ ID NO: 625321 - protein, 9 aa, Homo Sapiens
GFRGIPGPV

SEQ ID NO: 625322 - protein, 9 aa, Homo Sapiens
IRRLELESI

SEQ ID NO: 625323 - protein, 9 aa, Homo Sapiens
LFNGVFPPL

SEQ ID NO: 625324 - protein, 9 aa, Homo Sapiens
IHYAESRHK

SEQ ID NO: 625325 - protein, 9 aa, Homo Sapiens
KTLQRNYAR

SEQ ID NO: 625326 - protein, 9 aa, Homo Sapiens
KEIQQKTEN

SEQ ID NO: 625327 - protein, 9 aa, Homo Sapiens
ATWDERLRA

SEQ ID NO: 625328 - protein, 9 aa, Homo Sapiens
DALSYDRYV

SEQ ID NO: 625329 - protein, 9 aa, Homo Sapiens
KLESSAPKP

SEQ ID NO: 625330 - protein, 9 aa, Homo Sapiens
KAYQHCVSA

SEQ ID NO: 625331 - protein, 9 aa, Homo Sapiens
SSRHSGIPC

SEQ ID NO: 625332 - protein, 9 aa, Homo Sapiens
LGIMSNSTL

SEQ ID NO: 625333 - protein, 9 aa, Homo Sapiens
NACCATRFP

SEQ ID NO: 625334 - protein, 9 aa, Homo Sapiens
FTNFKMNIV

SEQ ID NO: 625335 - protein, 9 aa, Homo Sapiens
SYEILVLLP

SEQ ID NO: 625336 - protein, 9 aa, Homo Sapiens
SKLPYAAAK

SEQ ID NO: 625337 - protein, 9 aa, Homo Sapiens
QKLADREKT

SEQ ID NO: 625338 - protein, 9 aa, Homo Sapiens
GIKSKSLDR

SEQ ID NO: 625339 - protein, 9 aa, Homo Sapiens
LIYIQLPDE

SEQ ID NO: 625340 - protein, 9 aa, Homo Sapiens
KCSLSMTVS

SEQ ID NO: 625341 - protein, 9 aa, Homo Sapiens
DSCFSTSTS

SEQ ID NO: 625342 - protein, 9 aa, Homo Sapiens
GLRGCQAAR

SEQ ID NO: 625343 - protein, 9 aa, Homo Sapiens
RVSSMRRRW

SEQ ID NO: 625344 - protein, 9 aa, Homo Sapiens
RLDVMMNVN

SEQ ID NO: 625345 - protein, 9 aa, Homo Sapiens
PGVEGKEGM

SEQ ID NO: 625346 - protein, 9 aa, Homo Sapiens
HGEICLSVQ

SEQ ID NO: 625347 - protein, 9 aa, Homo Sapiens
LLSVNGVAL

SEQ ID NO: 625348 - protein, 9 aa, Homo Sapiens
DHLFEFGSC

SEQ ID NO: 625349 - protein, 9 aa, Homo Sapiens
VMASTGGTN

SEQ ID NO: 625350 - protein, 9 aa, Homo Sapiens
LVLYNRVAF

SEQ ID NO: 625351 - protein, 9 aa, Homo Sapiens
ETVNFSGVN

SEQ ID NO: 625352 - protein, 9 aa, Homo Sapiens
EGMAAVADP

SEQ ID NO: 625353 - protein, 9 aa, Homo Sapiens
YVLTTLKIL

SEQ ID NO: 625354 - protein, 9 aa, Homo Sapiens
WQGRKTDDL

SEQ ID NO: 625355 - protein, 9 aa, Homo Sapiens
VFSIPRLDW

SEQ ID NO: 625356 - protein, 9 aa, Homo Sapiens
EYVLTTLKI

SEQ ID NO: 625357 - protein, 9 aa, Homo Sapiens
CPSSPPLCA

SEQ ID NO: 625358 - protein, 9 aa, Homo Sapiens
GKEVLGLPH

SEQ ID NO: 625359 - protein, 9 aa, Homo Sapiens
ESIQAEESV

SEQ ID NO: 625360 - protein, 9 aa, Homo Sapiens
IQLPDEKSR

SEQ ID NO: 625361 - protein, 9 aa, Homo Sapiens
LQEAKDDVD

SEQ ID NO: 625362 - protein, 9 aa, Homo Sapiens
YDTDQSGTM

SEQ ID NO: 625363 - protein, 9 aa, Homo Sapiens
GLSSQLLRR

SEQ ID NO: 625364 - protein, 9 aa, Homo Sapiens
HQILPGNRD

SEQ ID NO: 625365 - protein, 9 aa, Homo Sapiens
ERVGVCELP

SEQ ID NO: 625366 - protein, 9 aa, Homo Sapiens
WFGTFIRNA

SEQ ID NO: 625367 - protein, 9 aa, Homo Sapiens
GWQLVFSIP

SEQ ID NO: 625368 - protein, 9 aa, Homo Sapiens
STSPRLIVD

SEQ ID NO: 625369 - protein, 9 aa, Homo Sapiens
IMSNSTLTP

SEQ ID NO: 625370 - protein, 9 aa, Homo Sapiens
SGTSRKVLF

SEQ ID NO: 625371 - protein, 9 aa, Homo Sapiens
CRKTFSWGS

SEQ ID NO: 625372 - protein, 9 aa, Homo Sapiens
PLCASACSS

SEQ ID NO: 625373 - protein, 9 aa, Homo Sapiens
TKRLDVMMN

SEQ ID NO: 625374 - protein, 9 aa, Homo Sapiens
LGPVLEWAV

SEQ ID NO: 625375 - protein, 9 aa, Homo Sapiens
SPVASAPPA

SEQ ID NO: 625376 - protein, 9 aa, Homo Sapiens
ALLIRESSK

SEQ ID NO: 625377 - protein, 9 aa, Homo Sapiens
LSVNGVALR

SEQ ID NO: 625378 - protein, 9 aa, Homo Sapiens
TANKHSFQD

SEQ ID NO: 625379 - protein, 9 aa, Homo Sapiens
DRHPDGYIA

SEQ ID NO: 625380 - protein, 9 aa, Homo Sapiens
KVQEQILNL

SEQ ID NO: 625381 - protein, 9 aa, Homo Sapiens
EQDLGPVLE

SEQ ID NO: 625382 - protein, 9 aa, Homo Sapiens
VLLPCFSIV

SEQ ID NO: 625383 - protein, 9 aa, Homo Sapiens
RDSAEIRGL

SEQ ID NO: 625384 - protein, 9 aa, Homo Sapiens
ANKHSFQDT

SEQ ID NO: 625385 - protein, 9 aa, Homo Sapiens
RVDPDAEVH

SEQ ID NO: 625386 - protein, 9 aa, Homo Sapiens
PDGALLIRE

SEQ ID NO: 625387 - protein, 9 aa, Homo Sapiens
LVSHGTSPG

SEQ ID NO: 625388 - protein, 9 aa, Homo Sapiens
DSWHWSTRK

SEQ ID NO: 625389 - protein, 9 aa, Homo Sapiens
ILTCTAPGD

SEQ ID NO: 625390 - protein, 9 aa, Homo Sapiens
RVAFQGDVV

SEQ ID NO: 625391 - protein, 9 aa, Homo Sapiens
KDSWHWSTR

SEQ ID NO: 625392 - protein, 9 aa, Homo Sapiens
IQDDVSFIL

SEQ ID NO: 625393 - protein, 9 aa, Homo Sapiens
FSTSTSPRL

SEQ ID NO: 625394 - protein, 9 aa, Homo Sapiens
VELNHEIHV

SEQ ID NO: 625395 - protein, 9 aa, Homo Sapiens
FGGSVGGER

SEQ ID NO: 625396 - protein, 9 aa, Homo Sapiens
EIVELNHEI

SEQ ID NO: 625397 - protein, 9 aa, Homo Sapiens
SKYHIQEHQ

SEQ ID NO: 625398 - protein, 9 aa, Homo Sapiens
ECFLLAKMA

SEQ ID NO: 625399 - protein, 9 aa, Homo Sapiens
YEILVLLPG

SEQ ID NO: 625400 - protein, 9 aa, Homo Sapiens
VASAPPAYD

SEQ ID NO: 625401 - protein, 9 aa, Homo Sapiens
PGNRDSAEI

SEQ ID NO: 625402 - protein, 9 aa, Homo Sapiens
KVMASTGGT

SEQ ID NO: 625403 - protein, 9 aa, Homo Sapiens
NHEIHVWRL

SEQ ID NO: 625404 - protein, 9 aa, Homo Sapiens
AQCAFTVAL

SEQ ID NO: 625405 - protein, 9 aa, Homo Sapiens
VAVLNHLLY

SEQ ID NO: 625406 - protein, 9 aa, Homo Sapiens
VLYNRVAFQ

SEQ ID NO: 625407 - protein, 9 aa, Homo Sapiens
TDPVEVDHS

SEQ ID NO: 625408 - protein, 9 aa, Homo Sapiens
PTKRLDVMM

SEQ ID NO: 625409 - protein, 9 aa, Homo Sapiens
ELPGGTLED

SEQ ID NO: 625410 - protein, 9 aa, Homo Sapiens
TDMGAGEDN

SEQ ID NO: 625411 - protein, 9 aa, Homo Sapiens
TKVRDYVYR

SEQ ID NO: 625412 - protein, 9 aa, Homo Sapiens
FKLESSAPK

SEQ ID NO: 625413 - protein, 9 aa, Homo Sapiens
SSYSDCLVN

SEQ ID NO: 625414 - protein, 9 aa, Homo Sapiens
GSLSPSSYS

SEQ ID NO: 625415 - protein, 9 aa, Homo Sapiens
WLPITAKYR

SEQ ID NO: 625416 - protein, 9 aa, Homo Sapiens
VALISTTFL

SEQ ID NO: 625417 - protein, 9 aa, Homo Sapiens
LAPLNVELN

SEQ ID NO: 625418 - protein, 9 aa, Homo Sapiens
NLRNPPNPS

SEQ ID NO: 625419 - protein, 9 aa, Homo Sapiens
MVLIDISVD

SEQ ID NO: 625420 - protein, 9 aa, Homo Sapiens
CSKAFNRFT

SEQ ID NO: 625421 - protein, 9 aa, Homo Sapiens
QEAKDDVDP

SEQ ID NO: 625422 - protein, 9 aa, Homo Sapiens
GTYSCNANN

SEQ ID NO: 625423 - protein, 9 aa, Homo Sapiens
LGTATWDER

SEQ ID NO: 625424 - protein, 9 aa, Homo Sapiens
ETGTKGVKG

SEQ ID NO: 625425 - protein, 9 aa, Homo Sapiens
MNNSSSGME

SEQ ID NO: 625426 - protein, 9 aa, Homo Sapiens
RLSVHTCSS

SEQ ID NO: 625427 - protein, 9 aa, Homo Sapiens
SKPVDSDSN

SEQ ID NO: 625428 - protein, 9 aa, Homo Sapiens
PGYYPDNNG

SEQ ID NO: 625429 - protein, 9 aa, Homo Sapiens
EIQQKTENY

SEQ ID NO: 625430 - protein, 9 aa, Homo Sapiens
KRLDVMMNV

SEQ ID NO: 625431 - protein, 9 aa, Homo Sapiens
GALLIRESS

SEQ ID NO: 625432 - protein, 9 aa, Homo Sapiens
NPELMNNSS

SEQ ID NO: 625433 - protein, 9 aa, Homo Sapiens
KECRKTFSW

SEQ ID NO: 625434 - protein, 9 aa, Homo Sapiens
GIMSNSTLT

SEQ ID NO: 625435 - protein, 9 aa, Homo Sapiens
GAGEDNEGF

SEQ ID NO: 625436 - protein, 9 aa, Homo Sapiens
FNGVFPPLL

SEQ ID NO: 625437 - protein, 9 aa, Homo Sapiens
MQEFLMAEE

SEQ ID NO: 625438 - protein, 9 aa, Homo Sapiens
VGVCELPGG

SEQ ID NO: 625439 - protein, 9 aa, Homo Sapiens
PGFLKDNLR

SEQ ID NO: 625440 - protein, 9 aa, Homo Sapiens
VNFSGVNRP

SEQ ID NO: 625441 - protein, 9 aa, Homo Sapiens
GYTNRVYKP

SEQ ID NO: 625442 - protein, 9 aa, Homo Sapiens
NHSSSESSK

SEQ ID NO: 625443 - protein, 9 aa, Homo Sapiens
HSGIPCRQA

SEQ ID NO: 625444 - protein, 9 aa, Homo Sapiens
DQSGTMNSY

SEQ ID NO: 625445 - protein, 9 aa, Homo Sapiens
KMNIVGLLI

SEQ ID NO: 625446 - protein, 9 aa, Homo Sapiens
GVADKDQTA

SEQ ID NO: 625447 - protein, 9 aa, Homo Sapiens
SSREGLSSQ

SEQ ID NO: 625448 - protein, 9 aa, Homo Sapiens
IIAVMEFSR

SEQ ID NO: 625449 - protein, 9 aa, Homo Sapiens
TYSCNANNN

SEQ ID NO: 625450 - protein, 9 aa, Homo Sapiens
LTPKVLEAT

SEQ ID NO: 625451 - protein, 9 aa, Homo Sapiens
KCPSRPSCS

SEQ ID NO: 625452 - protein, 9 aa, Homo Sapiens
TDRHPDGYI

SEQ ID NO: 625453 - protein, 9 aa, Homo Sapiens
KLADREKTA

SEQ ID NO: 625454 - protein, 9 aa, Homo Sapiens
TSTSPRLIV

SEQ ID NO: 625455 - protein, 9 aa, Homo Sapiens
AQQRKRETS

SEQ ID NO: 625456 - protein, 9 aa, Homo Sapiens
VELNPEIQK

SEQ ID NO: 625457 - protein, 9 aa, Homo Sapiens
VEGKEGMAA

SEQ ID NO: 625458 - protein, 9 aa, Homo Sapiens
ELNPEIQKV

SEQ ID NO: 625459 - protein, 9 aa, Homo Sapiens
DVSFILKPS

SEQ ID NO: 625460 - protein, 9 aa, Homo Sapiens
TPITSVSLN

SEQ ID NO: 625461 - protein, 9 aa, Homo Sapiens
MNSYEMRNA

SEQ ID NO: 625462 - protein, 9 aa, Homo Sapiens
GSVGGERVS

SEQ ID NO: 625463 - protein, 9 aa, Homo Sapiens
AFQGDVVRE

SEQ ID NO: 625464 - protein, 9 aa, Homo Sapiens
NSTLTPDSY

SEQ ID NO: 625465 - protein, 9 aa, Homo Sapiens
IEVANLSGT

SEQ ID NO: 625466 - protein, 9 aa, Homo Sapiens
ESCWEFFPA

SEQ ID NO: 625467 - protein, 9 aa, Homo Sapiens
DVMMNVNTR

SEQ ID NO: 625468 - protein, 9 aa, Homo Sapiens
LGKCPSRPS

SEQ ID NO: 625469 - protein, 9 aa, Homo Sapiens
PSEIVELNH

SEQ ID NO: 625470 - protein, 9 aa, Homo Sapiens
QDHLFEFGS

SEQ ID NO: 625471 - protein, 9 aa, Homo Sapiens
ELPGPKLGK

SEQ ID NO: 625472 - protein, 9 aa, Homo Sapiens
SRCGLATYV

SEQ ID NO: 625473 - protein, 9 aa, Homo Sapiens
VSPSASSEH

SEQ ID NO: 625474 - protein, 9 aa, Homo Sapiens
KSSLQTHKI

SEQ ID NO: 625475 - protein, 9 aa, Homo Sapiens
LYKFAGGWT

SEQ ID NO: 625476 - protein, 9 aa, Homo Sapiens
ATKIINKVS

SEQ ID NO: 625477 - protein, 9 aa, Homo Sapiens
ECSKAFNRF

SEQ ID NO: 625478 - protein, 9 aa, Homo Sapiens
VLFLTPQFM

SEQ ID NO: 625479 - protein, 9 aa, Homo Sapiens
VMGLLGSSA

SEQ ID NO: 625480 - protein, 9 aa, Homo Sapiens
TSVSLNHSS

SEQ ID NO: 625481 - protein, 9 aa, Homo Sapiens
SCNANNNVG

SEQ ID NO: 625482 - protein, 9 aa, Homo Sapiens
AKDDVDPGH

SEQ ID NO: 625483 - protein, 9 aa, Homo Sapiens
VANLSGTSR

SEQ ID NO: 625484 - protein, 9 aa, Homo Sapiens
SIVGFFIRT

SEQ ID NO: 625485 - protein, 9 aa, Homo Sapiens
LISWLPITA

SEQ ID NO: 625486 - protein, 9 aa, Homo Sapiens
PLRDGVSND

SEQ ID NO: 625487 - protein, 9 aa, Homo Sapiens
HLFEFGSCM

SEQ ID NO: 625488 - protein, 9 aa, Homo Sapiens
NDDPLEAFM

SEQ ID NO: 625489 - protein, 9 aa, Homo Sapiens
TKIINKVSK

SEQ ID NO: 625490 - protein, 9 aa, Homo Sapiens
KPERVGVCE

SEQ ID NO: 625491 - protein, 9 aa, Homo Sapiens
FSGVNRPFC

SEQ ID NO: 625492 - protein, 9 aa, Homo Sapiens
ADFNIPSPV

SEQ ID NO: 625493 - protein, 9 aa, Homo Sapiens
KLGHGYTNR

SEQ ID NO: 625494 - protein, 9 aa, Homo Sapiens
KLEQADAHK

SEQ ID NO: 625495 - protein, 9 aa, Homo Sapiens
PITSVSLNH

SEQ ID NO: 625496 - protein, 9 aa, Homo Sapiens
KPDGALLIR

SEQ ID NO: 625497 - protein, 9 aa, Homo Sapiens
ATRFPTLGG

SEQ ID NO: 625498 - protein, 9 aa, Homo Sapiens
LVFSIPRLD

SEQ ID NO: 625499 - protein, 9 aa, Homo Sapiens
DFNIPSPVA

SEQ ID NO: 625500 - protein, 9 aa, Homo Sapiens
HFLCLMASA

SEQ ID NO: 625501 - protein, 9 aa, Homo Sapiens
LIDISVDLS

SEQ ID NO: 625502 - protein, 9 aa, Homo Sapiens
VDPDAEVHG

SEQ ID NO: 625503 - protein, 9 aa, Homo Sapiens
HRDPVDGTI

SEQ ID NO: 625504 - protein, 9 aa, Homo Sapiens
HSYEILVLL

SEQ ID NO: 625505 - protein, 9 aa, Homo Sapiens
LISTTFLSI

SEQ ID NO: 625506 - protein, 9 aa, Homo Sapiens
CELPGGTLE

SEQ ID NO: 625507 - protein, 9 aa, Homo Sapiens
AVLLSFSRI

SEQ ID NO: 625508 - protein, 9 aa, Homo Sapiens
YAIAVLLSF

SEQ ID NO: 625509 - protein, 9 aa, Homo Sapiens
TTILKIHYA

SEQ ID NO: 625510 - protein, 9 aa, Homo Sapiens
LLAKMAYDR

SEQ ID NO: 625511 - protein, 9 aa, Homo Sapiens
PFIVNLLVY

SEQ ID NO: 625512 - protein, 9 aa, Homo Sapiens
VVRASVGGH

SEQ ID NO: 625513 - protein, 9 aa, Homo Sapiens
PLVTVTAQC

SEQ ID NO: 625514 - protein, 9 aa, Homo Sapiens
LVNPELMNN

SEQ ID NO: 625515 - protein, 9 aa, Homo Sapiens
EECSKAFNR

SEQ ID NO: 625516 - protein, 9 aa, Homo Sapiens
NAQQRKRET

SEQ ID NO: 625517 - protein, 9 aa, Homo Sapiens
YSYKAMIQF

SEQ ID NO: 625518 - protein, 9 aa, Homo Sapiens
ACQTIEVPT

SEQ ID NO: 625519 - protein, 9 aa, Homo Sapiens
DISVDLSTQ

SEQ ID NO: 625520 - protein, 9 aa, Homo Sapiens
LSGTSRKVL

SEQ ID NO: 625521 - protein, 9 aa, Homo Sapiens
SDSNDDPLE

SEQ ID NO: 625522 - protein, 9 aa, Homo Sapiens
TINHLYKFA

SEQ ID NO: 625523 - protein, 9 aa, Homo Sapiens
ASSEHMRTL

SEQ ID NO: 625524 - protein, 9 aa, Homo Sapiens
NFKMNIVGL

SEQ ID NO: 625525 - protein, 9 aa, Homo Sapiens
KFAGGWTLL

SEQ ID NO: 625526 - protein, 9 aa, Homo Sapiens
LKDNLRNPP

SEQ ID NO: 625527 - protein, 9 aa, Homo Sapiens
LDALSYDRY

SEQ ID NO: 625528 - protein, 9 aa, Homo Sapiens
FSRKSSLQT

SEQ ID NO: 625529 - protein, 9 aa, Homo Sapiens
PSGGSQESG

SEQ ID NO: 625530 - protein, 9 aa, Homo Sapiens
HGYTNRVYK

SEQ ID NO: 625531 - protein, 9 aa, Homo Sapiens
YVIILLLVF

SEQ ID NO: 625532 - protein, 9 aa, Homo Sapiens
PQFMVNDLS

SEQ ID NO: 625533 - protein, 9 aa, Homo Sapiens
ILISWLPIT

SEQ ID NO: 625534 - protein, 9 aa, Homo Sapiens
KLGKCPSRP

SEQ ID NO: 625535 - protein, 9 aa, Homo Sapiens
KTVIIEENI

SEQ ID NO: 625536 - protein, 9 aa, Homo Sapiens
NHLLYAVGG

SEQ ID NO: 625537 - protein, 9 aa, Homo Sapiens
MCQGLALDA

SEQ ID NO: 625538 - protein, 9 aa, Homo Sapiens
GLLGSSATI

SEQ ID NO: 625539 - protein, 9 aa, Homo Sapiens
VSSMRRRWS

SEQ ID NO: 625540 - protein, 9 aa, Homo Sapiens
DGTIWLQSK

SEQ ID NO: 625541 - protein, 9 aa, Homo Sapiens
FIVNLLVYI

SEQ ID NO: 625542 - protein, 9 aa, Homo Sapiens
PLRGRLSVH

SEQ ID NO: 625543 - protein, 9 aa, Homo Sapiens
RVSVLVLSP

SEQ ID NO: 625544 - protein, 9 aa, Homo Sapiens
AIAVLLSFS

SEQ ID NO: 625545 - protein, 9 aa, Homo Sapiens
NMNIKDKEA

SEQ ID NO: 625546 - protein, 9 aa, Homo Sapiens
ESGAEQPRK

SEQ ID NO: 625547 - protein, 9 aa, Homo Sapiens
SCFSTSTSP

SEQ ID NO: 625548 - protein, 9 aa, Homo Sapiens
YGKPDGALL

SEQ ID NO: 625549 - protein, 9 aa, Homo Sapiens
FKRPIIAVM

SEQ ID NO: 625550 - protein, 9 aa, Homo Sapiens
CQHPSSSSS

SEQ ID NO: 625551 - protein, 9 aa, Homo Sapiens
ACCATRFPT

SEQ ID NO: 625552 - protein, 9 aa, Homo Sapiens
CTAPGDNFD

SEQ ID NO: 625553 - protein, 9 aa, Homo Sapiens
IVNLLVYIK

SEQ ID NO: 625554 - protein, 9 aa, Homo Sapiens
NRIEVANLS

SEQ ID NO: 625555 - protein, 9 aa, Homo Sapiens
SNDDPLEAF

SEQ ID NO: 625556 - protein, 9 aa, Homo Sapiens
IYIQLPDEK

SEQ ID NO: 625557 - protein, 9 aa, Homo Sapiens
ESSHRDPVD

SEQ ID NO: 625558 - protein, 9 aa, Homo Sapiens
PFFQASTQS

SEQ ID NO: 625559 - protein, 9 aa, Homo Sapiens
VLEWAVSHR

SEQ ID NO: 625560 - protein, 9 aa, Homo Sapiens
FGSFKLESS

SEQ ID NO: 625561 - protein, 9 aa, Homo Sapiens
PSASVVRAS

SEQ ID NO: 625562 - protein, 9 aa, Homo Sapiens
EPGVADKDQ

SEQ ID NO: 625563 - protein, 9 aa, Homo Sapiens
IQALKDAHK

SEQ ID NO: 625564 - protein, 9 aa, Homo Sapiens
LCASACSSF

SEQ ID NO: 625565 - protein, 9 aa, Homo Sapiens
PHPYLPVLV

SEQ ID NO: 625566 - protein, 9 aa, Homo Sapiens
ALTKVRLTF

SEQ ID NO: 625567 - protein, 9 aa, Homo Sapiens
SDGSSSREG

SEQ ID NO: 625568 - protein, 9 aa, Homo Sapiens
AHKEEIQQI

SEQ ID NO: 625569 - protein, 9 aa, Homo Sapiens
NGVFPPLLE

SEQ ID NO: 625570 - protein, 9 aa, Homo Sapiens
TRAETVSTP

SEQ ID NO: 625571 - protein, 9 aa, Homo Sapiens
FQGDVVREL

SEQ ID NO: 625572 - protein, 9 aa, Homo Sapiens
SSATIRVTQ

SEQ ID NO: 625573 - protein, 9 aa, Homo Sapiens
GETGTKGVK

SEQ ID NO: 625574 - protein, 9 aa, Homo Sapiens
SVSLNHSSS

SEQ ID NO: 625575 - protein, 9 aa, Homo Sapiens
QILPGNRDS

SEQ ID NO: 625576 - protein, 9 aa, Homo Sapiens
LELESIQAE

SEQ ID NO: 625577 - protein, 9 aa, Homo Sapiens
AALKRQRRK

SEQ ID NO: 625578 - protein, 9 aa, Homo Sapiens
KIRRLELES

SEQ ID NO: 625579 - protein, 9 aa, Homo Sapiens
THGGTLCSY

SEQ ID NO: 625580 - protein, 9 aa, Homo Sapiens
DAGTYSCNA

SEQ ID NO: 625581 - protein, 9 aa, Homo Sapiens
ESSAPKPRL

SEQ ID NO: 625582 - protein, 9 aa, Homo Sapiens
WHWSTRKSS

SEQ ID NO: 625583 - protein, 9 aa, Homo Sapiens
LLTRFSPFF

SEQ ID NO: 625584 - protein, 9 aa, Homo Sapiens
VSNDAVVSA

SEQ ID NO: 625585 - protein, 9 aa, Homo Sapiens
NIPSPVASA

SEQ ID NO: 625586 - protein, 9 aa, Homo Sapiens
GVEGKEGMA

SEQ ID NO: 625587 - protein, 9 aa, Homo Sapiens
VLGLPHEES

SEQ ID NO: 625588 - protein, 9 aa, Homo Sapiens
DAVVSAKLK

SEQ ID NO: 625589 - protein, 9 aa, Homo Sapiens
VLVLLPCFS

SEQ ID NO: 625590 - protein, 9 aa, Homo Sapiens
GLATYVIIL

SEQ ID NO: 625591 - protein, 9 aa, Homo Sapiens
DEYVLTTLK

SEQ ID NO: 625592 - protein, 9 aa, Homo Sapiens
NRPFCSEGC

SEQ ID NO: 625593 - protein, 9 aa, Homo Sapiens
YAAAKSKPQ

SEQ ID NO: 625594 - protein, 9 aa, Homo Sapiens
LRDGVSNDA

SEQ ID NO: 625595 - protein, 9 aa, Homo Sapiens
GHGYTNRVY

SEQ ID NO: 625596 - protein, 9 aa, Homo Sapiens
VLGLRGCQA

SEQ ID NO: 625597 - protein, 9 aa, Homo Sapiens
CDKRVGSIC

SEQ ID NO: 625598 - protein, 9 aa, Homo Sapiens
GSQESGAEQ

SEQ ID NO: 625599 - protein, 9 aa, Homo Sapiens
RNYARLQQD

SEQ ID NO: 625600 - protein, 9 aa, Homo Sapiens
KDDVDPGHS

SEQ ID NO: 625601 - protein, 9 aa, Homo Sapiens
SGIPCRQAS

SEQ ID NO: 625602 - protein, 9 aa, Homo Sapiens
EVPTILNSL

SEQ ID NO: 625603 - protein, 9 aa, Homo Sapiens
APLNVELNP

SEQ ID NO: 625604 - protein, 9 aa, Homo Sapiens
KNPGFLKDN

SEQ ID NO: 625605 - protein, 9 aa, Homo Sapiens
KLPYAAAKS

SEQ ID NO: 625606 - protein, 9 aa, Homo Sapiens
PVLVCSGLD

SEQ ID NO: 625607 - protein, 9 aa, Homo Sapiens
RHQILPGNR

SEQ ID NO: 625608 - protein, 9 aa, Homo Sapiens
LNSCLSHFL

SEQ ID NO: 625609 - protein, 9 aa, Homo Sapiens
LLGSSATIR

SEQ ID NO: 625610 - protein, 9 aa, Homo Sapiens
TPQFMVNDL

SEQ ID NO: 625611 - protein, 9 aa, Homo Sapiens
CASKDSWHW

SEQ ID NO: 625612 - protein, 9 aa, Homo Sapiens
FGTFIRNAQ

SEQ ID NO: 625613 - protein, 9 aa, Homo Sapiens
VTAQCAFTV

SEQ ID NO: 625614 - protein, 9 aa, Homo Sapiens
TVTAQCAFT

SEQ ID NO: 625615 - protein, 9 aa, Homo Sapiens
SSHRDPVDG

SEQ ID NO: 625616 - protein, 9 aa, Homo Sapiens
YPDNNGIYN

SEQ ID NO: 625617 - protein, 9 aa, Homo Sapiens
GGSVGGERV

SEQ ID NO: 625618 - protein, 9 aa, Homo Sapiens
FYPGYYPDN

SEQ ID NO: 625619 - protein, 9 aa, Homo Sapiens
VCSIQDDVS

SEQ ID NO: 625620 - protein, 9 aa, Homo Sapiens
QLVFSIPRL

SEQ ID NO: 625621 - protein, 9 aa, Homo Sapiens
SPSASSEHM

SEQ ID NO: 625622 - protein, 9 aa, Homo Sapiens
LYNRVAFQG

SEQ ID NO: 625623 - protein, 9 aa, Homo Sapiens
AGKPGPEGF

SEQ ID NO: 625624 - protein, 9 aa, Homo Sapiens
LRVSSMRRR

SEQ ID NO: 625625 - protein, 9 aa, Homo Sapiens
VINGCQHPS

SEQ ID NO: 625626 - protein, 9 aa, Homo Sapiens
ANLSGTSRK

SEQ ID NO: 625627 - protein, 9 aa, Homo Sapiens
IEVPTILNS

SEQ ID NO: 625628 - protein, 9 aa, Homo Sapiens
ESRCGLATY

SEQ ID NO: 625629 - protein, 9 aa, Homo Sapiens
HEDKIILTC

SEQ ID NO: 625630 - protein, 9 aa, Homo Sapiens
LCSYIVKNI

SEQ ID NO: 625631 - protein, 9 aa, Homo Sapiens
RHSGIPCRQ

SEQ ID NO: 625632 - protein, 9 aa, Homo Sapiens
AKVMASTGG

SEQ ID NO: 625633 - protein, 9 aa, Homo Sapiens
ERPPYSYKA

SEQ ID NO: 625634 - protein, 9 aa, Homo Sapiens
KIHYAESRH

SEQ ID NO: 625635 - protein, 9 aa, Homo Sapiens
PVDSDSNDD

SEQ ID NO: 625636 - protein, 9 aa, Homo Sapiens
SHGTSPGER

SEQ ID NO: 625637 - protein, 9 aa, Homo Sapiens
GTATWDERL

SEQ ID NO: 625638 - protein, 9 aa, Homo Sapiens
LVLLPCFSI

SEQ ID NO: 625639 - protein, 9 aa, Homo Sapiens
HYAESRHKA

SEQ ID NO: 625640 - protein, 9 aa, Homo Sapiens
SSMRRRWSC

SEQ ID NO: 625641 - protein, 9 aa, Homo Sapiens
SIQAEESVK

SEQ ID NO: 625642 - protein, 9 aa, Homo Sapiens
EVANLSGTS

SEQ ID NO: 625643 - protein, 9 aa, Homo Sapiens
QTHKIGHTG

SEQ ID NO: 625644 - protein, 9 aa, Homo Sapiens
GVGVAVLNH

SEQ ID NO: 625645 - protein, 9 aa, Homo Sapiens
RDGVSNDAV

SEQ ID NO: 625646 - protein, 9 aa, Homo Sapiens
SWGIKSKSL

SEQ ID NO: 625647 - protein, 9 aa, Homo Sapiens
VCPQVPVCL

SEQ ID NO: 625648 - protein, 9 aa, Homo Sapiens
QVPVCLPRG

SEQ ID NO: 625649 - protein, 9 aa, Homo Sapiens
PDAEVHGEI

SEQ ID NO: 625650 - protein, 9 aa, Homo Sapiens
VPVCLPRGP

SEQ ID NO: 625651 - protein, 9 aa, Homo Sapiens
SLQTHKIGH

SEQ ID NO: 625652 - protein, 9 aa, Homo Sapiens
KDKEAIFIT

SEQ ID NO: 625653 - protein, 9 aa, Homo Sapiens
LNHSSSESS

SEQ ID NO: 625654 - protein, 9 aa, Homo Sapiens
CRQASSAVR

SEQ ID NO: 625655 - protein, 9 aa, Homo Sapiens
DAHKGGEEG

SEQ ID NO: 625656 - protein, 9 aa, Homo Sapiens
KEGMAAVAD

SEQ ID NO: 625657 - protein, 9 aa, Homo Sapiens
SVRDLEHWQ

SEQ ID NO: 625658 - protein, 9 aa, Homo Sapiens
KKGNLAIQQ

SEQ ID NO: 625659 - protein, 9 aa, Homo Sapiens
VCLPRGPGL

SEQ ID NO: 625660 - protein, 9 aa, Homo Sapiens
FLLDALSYD

SEQ ID NO: 625661 - protein, 9 aa, Homo Sapiens
NILGTATWD

SEQ ID NO: 625662 - protein, 9 aa, Homo Sapiens
RHPDGYIAR

SEQ ID NO: 625663 - protein, 9 aa, Homo Sapiens
SPRLIVDAL

SEQ ID NO: 625664 - protein, 9 aa, Homo Sapiens
PVDGTIWLQ

SEQ ID NO: 625665 - protein, 9 aa, Homo Sapiens
SANPTVSMQ

SEQ ID NO: 625666 - protein, 9 aa, Homo Sapiens
ASKDSWHWS

SEQ ID NO: 625667 - protein, 9 aa, Homo Sapiens
HWSTRKSSR

SEQ ID NO: 625668 - protein, 9 aa, Homo Sapiens
PENMNIKDK

SEQ ID NO: 625669 - protein, 9 aa, Homo Sapiens
GCQAARWRG

SEQ ID NO: 625670 - protein, 9 aa, Homo Sapiens
STSTSPRLI

SEQ ID NO: 625671 - protein, 9 aa, Homo Sapiens
GIPCRQASS

SEQ ID NO: 625672 - protein, 9 aa, Homo Sapiens
VGVAVLNHL

SEQ ID NO: 625673 - protein, 9 aa, Homo Sapiens
ITAKYRRGQ

SEQ ID NO: 625674 - protein, 9 aa, Homo Sapiens
KIMYCTDPV

SEQ ID NO: 625675 - protein, 9 aa, Homo Sapiens
PCRQASSAV

SEQ ID NO: 625676 - protein, 9 aa, Homo Sapiens
KSWGIKSKS

SEQ ID NO: 625677 - protein, 9 aa, Homo Sapiens
LQTHKIGHT

SEQ ID NO: 625678 - protein, 9 aa, Homo Sapiens
CLPRGPGLS

SEQ ID NO: 625679 - protein, 9 aa, Homo Sapiens
YQESCWEFF

SEQ ID NO: 625680 - protein, 9 aa, Homo Sapiens
SMTVSMDSE

SEQ ID NO: 625681 - protein, 9 aa, Homo Sapiens
DLVKAYQHC

SEQ ID NO: 625682 - protein, 9 aa, Homo Sapiens
GYIARQRKR

SEQ ID NO: 625683 - protein, 9 aa, Homo Sapiens
YTNRVYKPK

SEQ ID NO: 625684 - protein, 9 aa, Homo Sapiens
VRASVGGHR

SEQ ID NO: 625685 - protein, 9 aa, Homo Sapiens
YNRVAFQGD

SEQ ID NO: 625686 - protein, 9 aa, Homo Sapiens
STLTPDSYG

SEQ ID NO: 625687 - protein, 9 aa, Homo Sapiens
TAAEQQRKK

SEQ ID NO: 625688 - protein, 9 aa, Homo Sapiens
RRKEPLIIS

SEQ ID NO: 625689 - protein, 9 aa, Homo Sapiens
VNGVALRVS

SEQ ID NO: 625690 - protein, 9 aa, Homo Sapiens
KIILTCTAP

SEQ ID NO: 625691 - protein, 9 aa, Homo Sapiens
PYLPVLVCS

SEQ ID NO: 625692 - protein, 9 aa, Homo Sapiens
RKSSLQTHK

SEQ ID NO: 625693 - protein, 9 aa, Homo Sapiens
VSMQEFLMA

SEQ ID NO: 625694 - protein, 9 aa, Homo Sapiens
TPKVLEATA

SEQ ID NO: 625695 - protein, 9 aa, Homo Sapiens
MALTKVRLT

SEQ ID NO: 625696 - protein, 9 aa, Homo Sapiens
SERPPYSYK

SEQ ID NO: 625697 - protein, 9 aa, Homo Sapiens
NVELNPEIQ

SEQ ID NO: 625698 - protein, 9 aa, Homo Sapiens
ILLNSCLSH

SEQ ID NO: 625699 - protein, 9 aa, Homo Sapiens
SHACQTIEV

SEQ ID NO: 625700 - protein, 9 aa, Homo Sapiens
IPSPVASAP

SEQ ID NO: 625701 - protein, 9 aa, Homo Sapiens
WERVSTKVR

SEQ ID NO: 625702 - protein, 9 aa, Homo Sapiens
HGTSPGERW

SEQ ID NO: 625703 - protein, 9 aa, Homo Sapiens
PKVLEATAD

SEQ ID NO: 625704 - protein, 9 aa, Homo Sapiens
LGAAVINGC

SEQ ID NO: 625705 - protein, 9 aa, Homo Sapiens
VLIDISVDL

SEQ ID NO: 625706 - protein, 9 aa, Homo Sapiens
DPDAEVHGE

SEQ ID NO: 625707 - protein, 9 aa, Homo Sapiens
ASVVRASVG

SEQ ID NO: 625708 - protein, 9 aa, Homo Sapiens
VGGERVSVL

SEQ ID NO: 625709 - protein, 9 aa, Homo Sapiens
SVVRASVGG

SEQ ID NO: 625710 - protein, 9 aa, Homo Sapiens
SLSPSSYSD

SEQ ID NO: 625711 - protein, 9 aa, Homo Sapiens
EENITTVVK

SEQ ID NO: 625712 - protein, 9 aa, Homo Sapiens
VNLLVYIKI

SEQ ID NO: 625713 - protein, 9 aa, Homo Sapiens
PERVGVCEL

SEQ ID NO: 625714 - protein, 9 aa, Homo Sapiens
HLLYAVGGF

SEQ ID NO: 625715 - protein, 9 aa, Homo Sapiens
AATKIINKV

SEQ ID NO: 625716 - protein, 9 aa, Homo Sapiens
LDQLIYIQL

SEQ ID NO: 625717 - protein, 9 aa, Homo Sapiens
KKSWGIKSK

SEQ ID NO: 625718 - protein, 9 aa, Homo Sapiens
SDLVKAYQH

SEQ ID NO: 625719 - protein, 9 aa, Homo Sapiens
PVASAPPAY

SEQ ID NO: 625720 - protein, 9 aa, Homo Sapiens
GAAVINGCQ

SEQ ID NO: 625721 - protein, 9 aa, Homo Sapiens
KGVKGDLGL

SEQ ID NO: 625722 - protein, 9 aa, Homo Sapiens
LTTILKIHY

SEQ ID NO: 625723 - protein, 9 aa, Homo Sapiens
IDISVDLST

SEQ ID NO: 625724 - protein, 9 aa, Homo Sapiens
GTKGVKGDL

SEQ ID NO: 625725 - protein, 9 aa, Homo Sapiens
DQLIYIQLP

SEQ ID NO: 625726 - protein, 9 aa, Homo Sapiens
SVALISTTF

SEQ ID NO: 625727 - protein, 9 aa, Homo Sapiens
FSPFFQAST

SEQ ID NO: 625728 - protein, 9 aa, Homo Sapiens
GAKVMASTG

SEQ ID NO: 625729 - protein, 9 aa, Homo Sapiens
LRGRLSVHT

SEQ ID NO: 625730 - protein, 9 aa, Homo Sapiens
YQHCVSAAH

SEQ ID NO: 625731 - protein, 9 aa, Homo Sapiens
IRNAQQRKR

SEQ ID NO: 625732 - protein, 9 aa, Homo Sapiens
IASKLPYAA

SEQ ID NO: 625733 - protein, 9 aa, Homo Sapiens
RFSPFFQAS

SEQ ID NO: 625734 - protein, 9 aa, Homo Sapiens
ISVDLSTQV

SEQ ID NO: 625735 - protein, 9 aa, Homo Sapiens
MSNSTLTPD

SEQ ID NO: 625736 - protein, 9 aa, Homo Sapiens
GTFIRNAQQ

SEQ ID NO: 625737 - protein, 9 aa, Homo Sapiens
TVGRGLVSH

SEQ ID NO: 625738 - protein, 9 aa, Homo Sapiens
THGKCSLSM

SEQ ID NO: 625739 - protein, 9 aa, Homo Sapiens
CMCQGLALD

SEQ ID NO: 625740 - protein, 9 aa, Homo Sapiens
VLVCSGLDH

SEQ ID NO: 625741 - protein, 9 aa, Homo Sapiens
QTIEVPTIL

SEQ ID NO: 625742 - protein, 9 aa, Homo Sapiens
YCTDPVEVD

SEQ ID NO: 625743 - protein, 9 aa, Homo Sapiens
KSKSLDRTV

SEQ ID NO: 625744 - protein, 9 aa, Homo Sapiens
QDLGPVLEW

SEQ ID NO: 625745 - protein, 9 aa, Homo Sapiens
KPGCMCQGL

SEQ ID NO: 625746 - protein, 9 aa, Homo Sapiens
QHSYEILVL

SEQ ID NO: 625747 - protein, 9 aa, Homo Sapiens
RDSAVKEIQ

SEQ ID NO: 625748 - protein, 9 aa, Homo Sapiens
VGLLIPFTI

SEQ ID NO: 625749 - protein, 9 aa, Homo Sapiens
FQASTQSLA

SEQ ID NO: 625750 - protein, 9 aa, Homo Sapiens
RPPYSYKAM

SEQ ID NO: 625751 - protein, 9 aa, Homo Sapiens
ASANPTVSM

SEQ ID NO: 625752 - protein, 9 aa, Homo Sapiens
PSSYSDCLV

SEQ ID NO: 625753 - protein, 9 aa, Homo Sapiens
GTLCSYIVK

SEQ ID NO: 625754 - protein, 9 aa, Homo Sapiens
TCTAPGDNF

SEQ ID NO: 625755 - protein, 9 aa, Homo Sapiens
SPCKPGCMC

SEQ ID NO: 625756 - protein, 9 aa, Homo Sapiens
PIIAVMEFS

SEQ ID NO: 625757 - protein, 9 aa, Homo Sapiens
KEEIQQILA

SEQ ID NO: 625758 - protein, 9 aa, Homo Sapiens
RNNEIILFN

SEQ ID NO: 625759 - protein, 9 aa, Homo Sapiens
ASTGGTNLR

SEQ ID NO: 625760 - protein, 9 aa, Homo Sapiens
REKTAAEQQ

SEQ ID NO: 625761 - protein, 9 aa, Homo Sapiens
EICISNETK

SEQ ID NO: 625762 - protein, 9 aa, Homo Sapiens
LLSFSRIAY

SEQ ID NO: 625763 - protein, 9 aa, Homo Sapiens
VQEQILNLY

SEQ ID NO: 625764 - protein, 9 aa, Homo Sapiens
FLLAKMAYD

SEQ ID NO: 625765 - protein, 9 aa, Homo Sapiens
TYVIILLLV

SEQ ID NO: 625766 - protein, 9 aa, Homo Sapiens
DAEVHGEIC

SEQ ID NO: 625767 - protein, 9 aa, Homo Sapiens
MYQESCWEF

SEQ ID NO: 625768 - protein, 9 aa, Homo Sapiens
TRFSPFFQA

SEQ ID NO: 625769 - protein, 9 aa, Homo Sapiens
SSLQTHKIG

SEQ ID NO: 625770 - protein, 9 aa, Homo Sapiens
SGGSQESGA

SEQ ID NO: 625771 - protein, 9 aa, Homo Sapiens
PPLCASACS

SEQ ID NO: 625772 - protein, 9 aa, Homo Sapiens
QLLSVNGVA

SEQ ID NO: 625773 - protein, 9 aa, Homo Sapiens
NYARLQQDV

SEQ ID NO: 625774 - protein, 9 aa, Homo Sapiens
AVKEIQQKT

SEQ ID NO: 625775 - protein, 9 aa, Homo Sapiens
SPFFQASTQ

SEQ ID NO: 625776 - protein, 9 aa, Homo Sapiens
VTINHLYKF

SEQ ID NO: 625777 - protein, 9 aa, Homo Sapiens
CLLQEAKDD

SEQ ID NO: 625778 - protein, 9 aa, Homo Sapiens
TPTKRLDVM

SEQ ID NO: 625779 - protein, 9 aa, Homo Sapiens
PPYSYKAMI

SEQ ID NO: 625780 - protein, 9 aa, Homo Sapiens
YAESRHKAF

SEQ ID NO: 625781 - protein, 9 aa, Homo Sapiens
ISTTFLSIY

SEQ ID NO: 625782 - protein, 9 aa, Homo Sapiens
LNVELNPEI

SEQ ID NO: 625783 - protein, 9 aa, Homo Sapiens
AAVINGCQH

SEQ ID NO: 625784 - protein, 9 aa, Homo Sapiens
GSSATIRVT

SEQ ID NO: 625785 - protein, 9 aa, Homo Sapiens
CSYIVKNIA

SEQ ID NO: 625786 - protein, 9 aa, Homo Sapiens
GKCPSRPSC

SEQ ID NO: 625787 - protein, 9 aa, Homo Sapiens
RNIASKLPY

SEQ ID NO: 625788 - protein, 9 aa, Homo Sapiens
KEVLGLPHE

SEQ ID NO: 625789 - protein, 9 aa, Homo Sapiens
VPFIVNLLV

SEQ ID NO: 625790 - protein, 9 aa, Homo Sapiens
RIEVANLSG

SEQ ID NO: 625791 - protein, 9 aa, Homo Sapiens
LSPSSYSDC

SEQ ID NO: 625792 - protein, 9 aa, Homo Sapiens
EHMRTLFGF

SEQ ID NO: 625793 - protein, 9 aa, Homo Sapiens
AETVSTPLS

SEQ ID NO: 625794 - protein, 9 aa, Homo Sapiens
IYKKGNLAI

SEQ ID NO: 625795 - protein, 9 aa, Homo Sapiens
GKEGMAAVA

SEQ ID NO: 625796 - protein, 9 aa, Homo Sapiens
QEQILNLYT

SEQ ID NO: 625797 - protein, 9 aa, Homo Sapiens
VEVDHSTRL

SEQ ID NO: 625798 - protein, 9 aa, Homo Sapiens
DRDSAVKEI

SEQ ID NO: 625799 - protein, 9 aa, Homo Sapiens
CNANNNVGN

SEQ ID NO: 625800 - protein, 9 aa, Homo Sapiens
SREGLSSQL

SEQ ID NO: 625801 - protein, 9 aa, Homo Sapiens
IINKVSKPL

SEQ ID NO: 625802 - protein, 9 aa, Homo Sapiens
TFIRNAQQR

SEQ ID NO: 625803 - protein, 9 aa, Homo Sapiens
STKVRDYVY

SEQ ID NO: 625804 - protein, 9 aa, Homo Sapiens
DKEAIFITL

SEQ ID NO: 625805 - protein, 9 aa, Homo Sapiens
DNNGIYNQK

SEQ ID NO: 625806 - protein, 9 aa, Homo Sapiens
EQHSYEILV

SEQ ID NO: 625807 - protein, 9 aa, Homo Sapiens
RTLITRAET

SEQ ID NO: 625808 - protein, 9 aa, Homo Sapiens
VGTHGGTLC

SEQ ID NO: 625809 - protein, 9 aa, Homo Sapiens
AVPGVEGKE

SEQ ID NO: 625810 - protein, 9 aa, Homo Sapiens
VSTKVRDYV

SEQ ID NO: 625811 - protein, 9 aa, Homo Sapiens
SASSEHMRT

SEQ ID NO: 625812 - protein, 9 aa, Homo Sapiens
SYFSKYHIQ

SEQ ID NO: 625813 - protein, 9 aa, Homo Sapiens
VKEIQQKTE

SEQ ID NO: 625814 - protein, 9 aa, Homo Sapiens
KGNLAIQQA

SEQ ID NO: 625815 - protein, 9 aa, Homo Sapiens
KGETGTKGV

SEQ ID NO: 625816 - protein, 9 aa, Homo Sapiens
IINIYKKGN

SEQ ID NO: 625817 - protein, 9 aa, Homo Sapiens
TTECFLLAK

SEQ ID NO: 625818 - protein, 9 aa, Homo Sapiens
CFSIVGFFI

SEQ ID NO: 625819 - protein, 9 aa, Homo Sapiens
PDGYIARQR

SEQ ID NO: 625820 - protein, 9 aa, Homo Sapiens
MYCTDPVEV

SEQ ID NO: 625821 - protein, 9 aa, Homo Sapiens
VHGEICLSV

SEQ ID NO: 625822 - protein, 9 aa, Homo Sapiens
TATWDERLR

SEQ ID NO: 625823 - protein, 9 aa, Homo Sapiens
EGFRGIPGP

SEQ ID NO: 625824 - protein, 9 aa, Homo Sapiens
QALKDAHKE

SEQ ID NO: 625825 - protein, 9 aa, Homo Sapiens
QRRKEPLII

SEQ ID NO: 625826 - protein, 9 aa, Homo Sapiens
LQDHLFEFG

SEQ ID NO: 625827 - protein, 9 aa, Homo Sapiens
IFVMGLLGS

SEQ ID NO: 625828 - protein, 9 aa, Homo Sapiens
GLTANKHSF

SEQ ID NO: 625829 - protein, 9 aa, Homo Sapiens
GGSQESGAE

SEQ ID NO: 625830 - protein, 9 aa, Homo Sapiens
YSDCLVNRG

SEQ ID NO: 625831 - protein, 9 aa, Homo Sapiens
PSPCKPGCM

SEQ ID NO: 625832 - protein, 9 aa, Homo Sapiens
FLKDNLRNP

SEQ ID NO: 625833 - protein, 9 aa, Homo Sapiens
KVSKPLAHH

SEQ ID NO: 625834 - protein, 9 aa, Homo Sapiens
LLDALSYDR

SEQ ID NO: 625835 - protein, 9 aa, Homo Sapiens
LLIRESSKK

SEQ ID NO: 625836 - protein, 9 aa, Homo Sapiens
GRLSVHTCS

SEQ ID NO: 625837 - protein, 9 aa, Homo Sapiens
KYHIQEHQP

SEQ ID NO: 625838 - protein, 9 aa, Homo Sapiens
TWDERLRAL

SEQ ID NO: 625839 - protein, 9 aa, Homo Sapiens
TLCSYIVKN

SEQ ID NO: 625840 - protein, 9 aa, Homo Sapiens
SGCEICISN

SEQ ID NO: 625841 - protein, 9 aa, Homo Sapiens
KDNLRNPPN

SEQ ID NO: 625842 - protein, 9 aa, Homo Sapiens
GVNRPFCSE

SEQ ID NO: 625843 - protein, 9 aa, Homo Sapiens
KRPIIAVME

SEQ ID NO: 625844 - protein, 9 aa, Homo Sapiens
SRHSGIPCR

SEQ ID NO: 625845 - protein, 9 aa, Homo Sapiens
FSIVGFFIR

SEQ ID NO: 625846 - protein, 9 aa, Homo Sapiens
LGLRGCQAA

SEQ ID NO: 625847 - protein, 9 aa, Homo Sapiens
ENMNIKDKE

SEQ ID NO: 625848 - protein, 9 aa, Homo Sapiens
LGLPHEESI

SEQ ID NO: 625849 - protein, 9 aa, Homo Sapiens
WSTRKSSRG

SEQ ID NO: 625850 - protein, 9 aa, Homo Sapiens
MGAGEDNEG

SEQ ID NO: 625851 - protein, 9 aa, Homo Sapiens
DLVNPELMN

SEQ ID NO: 625852 - protein, 9 aa, Homo Sapiens
HACQTIEVP

SEQ ID NO: 625853 - protein, 9 aa, Homo Sapiens
LESSAPKPR

SEQ ID NO: 625854 - protein, 9 aa, Homo Sapiens
GTCPSSPPL

SEQ ID NO: 625855 - protein, 9 aa, Homo Sapiens
GKPGPEGFR

SEQ ID NO: 625856 - protein, 9 aa, Homo Sapiens
EDKIILTCT

SEQ ID NO: 625857 - protein, 9 aa, Homo Sapiens
LHSVALIST

SEQ ID NO: 625858 - protein, 9 aa, Homo Sapiens
GERVSVLVL

SEQ ID NO: 625859 - protein, 9 aa, Homo Sapiens
LPITAKYRR

SEQ ID NO: 625860 - protein, 9 aa, Homo Sapiens
NPTVSMQEF

SEQ ID NO: 625861 - protein, 9 aa, Homo Sapiens
GKCSLSMTV

SEQ ID NO: 625862 - protein, 9 aa, Homo Sapiens
AEVHGEICL

SEQ ID NO: 625863 - protein, 9 aa, Homo Sapiens
HGKCSLSMT

SEQ ID NO: 625864 - protein, 9 aa, Homo Sapiens
EVHGEICLS

SEQ ID NO: 625865 - protein, 9 aa, Homo Sapiens
VKAYQHCVS

SEQ ID NO: 625866 - protein, 9 aa, Homo Sapiens
ERVSTKVRD

SEQ ID NO: 625867 - protein, 9 aa, Homo Sapiens
EGKEGMAAV

SEQ ID NO: 625868 - protein, 9 aa, Homo Sapiens
LHEQDLGPV

SEQ ID NO: 625869 - protein, 9 aa, Homo Sapiens
VCELPGGTL

SEQ ID NO: 625870 - protein, 9 aa, Homo Sapiens
EPSEIVELN

SEQ ID NO: 625871 - protein, 9 aa, Homo Sapiens
SIPRLDWPI

SEQ ID NO: 625872 - protein, 9 aa, Homo Sapiens
RCGLATYVI

SEQ ID NO: 625873 - protein, 9 aa, Homo Sapiens
CKVQEQILN

SEQ ID NO: 625874 - protein, 9 aa, Homo Sapiens
TMKKSWGIK

SEQ ID NO: 625875 - protein, 9 aa, Homo Sapiens
FNIPSPVAS

SEQ ID NO: 625876 - protein, 9 aa, Homo Sapiens
ILKIHYAES

SEQ ID NO: 625877 - protein, 9 aa, Homo Sapiens
RLELESIQA

SEQ ID NO: 625878 - protein, 9 aa, Homo Sapiens
SEPLVTVTA

SEQ ID NO: 625879 - protein, 9 aa, Homo Sapiens
LKIHYAESR

SEQ ID NO: 625880 - protein, 9 aa, Homo Sapiens
VSLNHSSSE

SEQ ID NO: 625881 - protein, 9 aa, Homo Sapiens
RKTFSWGSS

SEQ ID NO: 625882 - protein, 9 aa, Homo Sapiens
LALTPKVLE

SEQ ID NO: 625883 - protein, 9 aa, Homo Sapiens
HGGTLCSYI

SEQ ID NO: 625884 - protein, 9 aa, Homo Sapiens
IPCRQASSA

SEQ ID NO: 625885 - protein, 9 aa, Homo Sapiens
ANACCATRF

SEQ ID NO: 625886 - protein, 9 aa, Homo Sapiens
KVRDYVYRQ

SEQ ID NO: 625887 - protein, 9 aa, Homo Sapiens
EIILFNGVF

SEQ ID NO: 625888 - protein, 9 aa, Homo Sapiens
YVWKMYQES

SEQ ID NO: 625889 - protein, 9 aa, Homo Sapiens
HWQGRKTDD

SEQ ID NO: 625890 - protein, 9 aa, Homo Sapiens
GYYPDNNGI

SEQ ID NO: 625891 - protein, 9 aa, Homo Sapiens
LGSSATIRV

SEQ ID NO: 625892 - protein, 9 aa, Homo Sapiens
NKVSKPLAH

SEQ ID NO: 625893 - protein, 9 aa, Homo Sapiens
MNIKDKEAI

SEQ ID NO: 625894 - protein, 9 aa, Homo Sapiens
TLQRNYARL

SEQ ID NO: 625895 - protein, 9 aa, Homo Sapiens
WGIKSKSLD

SEQ ID NO: 625896 - protein, 9 aa, Homo Sapiens
ADREKTAAE

SEQ ID NO: 625897 - protein, 9 aa, Homo Sapiens
CTDPVEVDH

SEQ ID NO: 625898 - protein, 9 aa, Homo Sapiens
CSIQDDVSF

SEQ ID NO: 625899 - protein, 9 aa, Homo Sapiens
INHLYKFAG

SEQ ID NO: 625900 - protein, 9 aa, Homo Sapiens
HEQDLGPVL

SEQ ID NO: 625901 - protein, 9 aa, Homo Sapiens
TVIIEENIT

SEQ ID NO: 625902 - protein, 9 aa, Homo Sapiens
GEDNEGFED

SEQ ID NO: 625903 - protein, 9 aa, Homo Sapiens
ELNHEIHVW

SEQ ID NO: 625904 - protein, 9 aa, Homo Sapiens
QLPDEKSRV

SEQ ID NO: 625905 - protein, 9 aa, Homo Sapiens
VGRGLVSHG

SEQ ID NO: 625906 - protein, 9 aa, Homo Sapiens
GCEICISNE

SEQ ID NO: 625907 - protein, 9 aa, Homo Sapiens
VCKVQEQIL

SEQ ID NO: 625908 - protein, 9 aa, Homo Sapiens
LQRNYARLQ

SEQ ID NO: 625909 - protein, 9 aa, Homo Sapiens
SNSTLTPDS

SEQ ID NO: 625910 - protein, 9 aa, Homo Sapiens
NEIILFNGV

SEQ ID NO: 625911 - protein, 9 aa, Homo Sapiens
SASVVRASV

SEQ ID NO: 625912 - protein, 9 aa, Homo Sapiens
SLNHSSSES

SEQ ID NO: 625913 - protein, 9 aa, Homo Sapiens
DNLRNPPNP

SEQ ID NO: 625914 - protein, 9 aa, Homo Sapiens
TLITRAETV

SEQ ID NO: 625915 - protein, 9 aa, Homo Sapiens
FFLLDALSY

SEQ ID NO: 625916 - protein, 9 aa, Homo Sapiens
EHWQGRKTD

SEQ ID NO: 625917 - protein, 9 aa, Homo Sapiens
VNRPFCSEG

SEQ ID NO: 625918 - protein, 9 aa, Homo Sapiens
FSKYHIQEH

SEQ ID NO: 625919 - protein, 9 aa, Homo Sapiens
DVTINHLYK

SEQ ID NO: 625920 - protein, 9 aa, Homo Sapiens
PSPVASAPP

SEQ ID NO: 625921 - protein, 9 aa, Homo Sapiens
YARLQQDVL

SEQ ID NO: 625922 - protein, 9 aa, Homo Sapiens
KPVDSDSND

SEQ ID NO: 625923 - protein, 9 aa, Homo Sapiens
RDPVDGTIW

SEQ ID NO: 625924 - protein, 9 aa, Homo Sapiens
FIRNAQQRK

SEQ ID NO: 625925 - protein, 9 aa, Homo Sapiens
LDVMMNVNT

SEQ ID NO: 625926 - protein, 9 aa, Homo Sapiens
FMVNDLSRG

SEQ ID NO: 625927 - protein, 9 aa, Homo Sapiens
EFFLLDALS

SEQ ID NO: 625928 - protein, 9 aa, Homo Sapiens
GKLGHGYTN

SEQ ID NO: 625929 - protein, 9 aa, Homo Sapiens
SRTLITRAE

SEQ ID NO: 625930 - protein, 9 aa, Homo Sapiens
IANACCATR

SEQ ID NO: 625931 - protein, 9 aa, Homo Sapiens
WQLVFSIPR

SEQ ID NO: 625932 - protein, 9 aa, Homo Sapiens
VTEFFLLDA

SEQ ID NO: 625933 - protein, 9 aa, Homo Sapiens
VSFILKPSV

SEQ ID NO: 625934 - protein, 9 aa, Homo Sapiens
FFQASTQSL

SEQ ID NO: 625935 - protein, 9 aa, Homo Sapiens
LLPCFSIVG

SEQ ID NO: 625936 - protein, 9 aa, Homo Sapiens
DSAVKEIQQ

SEQ ID NO: 625937 - protein, 9 aa, Homo Sapiens
LPVLVCSGL

SEQ ID NO: 625938 - protein, 9 aa, Homo Sapiens
AVMEFSRSK

SEQ ID NO: 625939 - protein, 9 aa, Homo Sapiens
GAEQPRKGG

SEQ ID NO: 625940 - protein, 9 aa, Homo Sapiens
NPGFLKDNL

SEQ ID NO: 625941 - protein, 9 aa, Homo Sapiens
GTHGGTLCS

SEQ ID NO: 625942 - protein, 9 aa, Homo Sapiens
DKIILTCTA

SEQ ID NO: 625943 - protein, 9 aa, Homo Sapiens
GCMCQGLAL

SEQ ID NO: 625944 - protein, 9 aa, Homo Sapiens
RGRLSVHTC

SEQ ID NO: 625945 - protein, 9 aa, Homo Sapiens
PLNVELNPE

SEQ ID NO: 625946 - protein, 9 aa, Homo Sapiens
LSLRNINPI

SEQ ID NO: 625947 - protein, 9 aa, Homo Sapiens
EAKDDVDPG

SEQ ID NO: 625948 - protein, 9 aa, Homo Sapiens
ADAHKGGEE

SEQ ID NO: 625949 - protein, 9 aa, Homo Sapiens
EDNEGFEDD

SEQ ID NO: 625950 - protein, 9 aa, Homo Sapiens
PYSYKAMIQ

SEQ ID NO: 625951 - protein, 9 aa, Homo Sapiens
KPGPEGFRG

SEQ ID NO: 625952 - protein, 9 aa, Homo Sapiens
HPDGYIARQ

SEQ ID NO: 625953 - protein, 9 aa, Homo Sapiens
GSFKLESSA

SEQ ID NO: 625954 - protein, 9 aa, Homo Sapiens
SPSSYSDCL

SEQ ID NO: 625955 - protein, 9 aa, Homo Sapiens
KTAAEQQRK

SEQ ID NO: 625956 - protein, 9 aa, Homo Sapiens
PITAKYRRG

SEQ ID NO: 625957 - protein, 9 aa, Homo Sapiens
VLLPGTKYI

SEQ ID NO: 625958 - protein, 9 aa, Homo Sapiens
RNAQQRKRE

SEQ ID NO: 625959 - protein, 9 aa, Homo Sapiens
EQADAHKGG

SEQ ID NO: 625960 - protein, 9 aa, Homo Sapiens
FYVPFIVNL

SEQ ID NO: 625961 - protein, 9 aa, Homo Sapiens
IPRLDWPIE

SEQ ID NO: 625962 - protein, 9 aa, Homo Sapiens
WKMYQESCW

SEQ ID NO: 625963 - protein, 9 aa, Homo Sapiens
QILNLYTKL

SEQ ID NO: 625964 - protein, 9 aa, Homo Sapiens
MASTGGTNL

SEQ ID NO: 625965 - protein, 9 aa, Homo Sapiens
IVELNHEIH

SEQ ID NO: 625966 - protein, 9 aa, Homo Sapiens
NDAVVSAKL

SEQ ID NO: 625967 - protein, 9 aa, Homo Sapiens
TTHGKCSLS

SEQ ID NO: 625968 - protein, 9 aa, Homo Sapiens
NIASKLPYA

SEQ ID NO: 625969 - protein, 9 aa, Homo Sapiens
SYKAMIQFA

SEQ ID NO: 625970 - protein, 9 aa, Homo Sapiens
YKKGNLAIQ

SEQ ID NO: 625971 - protein, 9 aa, Homo Sapiens
LMNNSSSGM

SEQ ID NO: 625972 - protein, 9 aa, Homo Sapiens
LTCTAPGDN

SEQ ID NO: 625973 - protein, 9 aa, Homo Sapiens
FSIPRLDWP

SEQ ID NO: 625974 - protein, 9 aa, Homo Sapiens
TNFKMNIVG

SEQ ID NO: 625975 - protein, 9 aa, Homo Sapiens
VIIEENITT

SEQ ID NO: 625976 - protein, 9 aa, Homo Sapiens
TSPRLIVDA

SEQ ID NO: 625977 - protein, 9 aa, Homo Sapiens
AGTYSCNAN

SEQ ID NO: 625978 - protein, 9 aa, Homo Sapiens
PEPGVADKD

SEQ ID NO: 625979 - protein, 9 aa, Homo Sapiens
DGVSNDAVV

SEQ ID NO: 625980 - protein, 9 aa, Homo Sapiens
QLIYIQLPD

SEQ ID NO: 625981 - protein, 9 aa, Homo Sapiens
LPGPKLGKC

SEQ ID NO: 625982 - protein, 9 aa, Homo Sapiens
CLSHFLCLM

SEQ ID NO: 625983 - protein, 9 aa, Homo Sapiens
INIYKKGNL

SEQ ID NO: 625984 - protein, 9 aa, Homo Sapiens
ELALTPKVL

SEQ ID NO: 625985 - protein, 9 aa, Homo Sapiens
MKKSWGIKS

SEQ ID NO: 625986 - protein, 9 aa, Homo Sapiens
DERLRALNN

SEQ ID NO: 625987 - protein, 9 aa, Homo Sapiens
LFLTPQFMV

SEQ ID NO: 625988 - protein, 9 aa, Homo Sapiens
LYAIAVLLS

SEQ ID NO: 625989 - protein, 9 aa, Homo Sapiens
KFKRPIIAV

SEQ ID NO: 625990 - protein, 9 aa, Homo Sapiens
ITRAETVST

SEQ ID NO: 625991 - protein, 9 aa, Homo Sapiens
NNGIYNQKF

SEQ ID NO: 625992 - protein, 9 aa, Homo Sapiens
ILPGNRDSA

SEQ ID NO: 625993 - protein, 9 aa, Homo Sapiens
LVCSGLDHD

SEQ ID NO: 625994 - protein, 9 aa, Homo Sapiens
LITRAETVS

SEQ ID NO: 625995 - protein, 9 aa, Homo Sapiens
SPPLCASAC

SEQ ID NO: 625996 - protein, 9 aa, Homo Sapiens
CQAARWRGW

SEQ ID NO: 625997 - protein, 9 aa, Homo Sapiens
NIKDKEAIF

SEQ ID NO: 625998 - protein, 9 aa, Homo Sapiens
PQVPVCLPR

SEQ ID NO: 625999 - protein, 9 aa, Homo Sapiens
PGVADKDQT

SEQ ID NO: 626000 - protein, 9 aa, Homo Sapiens
GPVLEWAVS

SEQ ID NO: 626001 - protein, 9 aa, Homo Sapiens
DDAGTYSCN

SEQ ID NO: 626002 - protein, 9 aa, Homo Sapiens
CCATRFPTL

SEQ ID NO: 626003 - protein, 9 aa, Homo Sapiens
YPGYYPDNN

SEQ ID NO: 626004 - protein, 9 aa, Homo Sapiens
CATRFPTLG

SEQ ID NO: 626005 - protein, 9 aa, Homo Sapiens
LTRFSPFFQ

SEQ ID NO: 626006 - protein, 9 aa, Homo Sapiens
MMSYFSKYH

SEQ ID NO: 626007 - protein, 9 aa, Homo Sapiens
PTVSMQEFL

SEQ ID NO: 626008 - protein, 9 aa, Homo Sapiens
MSYFSKYHI

SEQ ID NO: 626009 - protein, 9 aa, Homo Sapiens
TIEVPTILN

SEQ ID NO: 626010 - protein, 9 aa, Homo Sapiens
PGPEGFRGI

SEQ ID NO: 626011 - protein, 9 aa, Homo Sapiens
HSVALISTT

SEQ ID NO: 626012 - protein, 9 aa, Homo Sapiens
VGQMGLTAN

SEQ ID NO: 626013 - protein, 9 aa, Homo Sapiens
RAETVSTPL

SEQ ID NO: 626014 - protein, 9 aa, Homo Sapiens
SCLSHFLCL

SEQ ID NO: 626015 - protein, 9 aa, Homo Sapiens
GRGLVSHGT

SEQ ID NO: 626016 - protein, 9 aa, Homo Sapiens
CGLATYVII

SEQ ID NO: 626017 - protein, 9 aa, Homo Sapiens
GCQHPSSSS

SEQ ID NO: 626018 - protein, 9 aa, Homo Sapiens
DTDQSGTMN

SEQ ID NO: 626019 - protein, 9 aa, Homo Sapiens
RCVGLQDHL

SEQ ID NO: 626020 - protein, 9 aa, Homo Sapiens
AVLNHLLYA

SEQ ID NO: 626021 - protein, 9 aa, Homo Sapiens
IARQRKRGE

SEQ ID NO: 626022 - protein, 9 aa, Homo Sapiens
GFLKDNLRN

SEQ ID NO: 626023 - protein, 9 aa, Homo Sapiens
ARLQQDVLQ

SEQ ID NO: 626024 - protein, 9 aa, Homo Sapiens
EILVLLPGT

SEQ ID NO: 626025 - protein, 9 aa, Homo Sapiens
YFSKYHIQE

SEQ ID NO: 626026 - protein, 9 aa, Homo Sapiens
TMNSYEMRN

SEQ ID NO: 626027 - protein, 9 aa, Homo Sapiens
SFKLESSAP

SEQ ID NO: 626028 - protein, 9 aa, Homo Sapiens
SWHWSTRKS

SEQ ID NO: 626029 - protein, 9 aa, Homo Sapiens
ALKDAHKEE

SEQ ID NO: 626030 - protein, 9 aa, Homo Sapiens
LNPEIQKVR

SEQ ID NO: 626031 - protein, 9 aa, Homo Sapiens
QSGTMNSYE

SEQ ID NO: 626032 - protein, 9 aa, Homo Sapiens
SMQEFLMAE

SEQ ID NO: 626033 - protein, 9 aa, Homo Sapiens
SGSLSPSSY

SEQ ID NO: 626034 - protein, 9 aa, Homo Sapiens
KCLLQEAKD

SEQ ID NO: 626035 - protein, 9 aa, Homo Sapiens
NHLYKFAGG

SEQ ID NO: 626036 - protein, 9 aa, Homo Sapiens
DMGAGEDNE

SEQ ID NO: 626037 - protein, 9 aa, Homo Sapiens
GPKLGKCPS

SEQ ID NO: 626038 - protein, 9 aa, Homo Sapiens
VFSRKSSLQ

SEQ ID NO: 626039 - protein, 9 aa, Homo Sapiens
ECRKTFSWG

SEQ ID NO: 626040 - protein, 9 aa, Homo Sapiens
VNPELMNNS

SEQ ID NO: 626041 - protein, 9 aa, Homo Sapiens
SYSDCLVNR

SEQ ID NO: 626042 - protein, 9 aa, Homo Sapiens
AYQHCVSAA

SEQ ID NO: 626043 - protein, 9 aa, Homo Sapiens
IAVMEFSRS

SEQ ID NO: 626044 - protein, 9 aa, Homo Sapiens
HIQEHQPKV

SEQ ID NO: 626045 - protein, 9 aa, Homo Sapiens
TSRTLITRA

SEQ ID NO: 626046 - protein, 9 aa, Homo Sapiens
STTFLSIYV

SEQ ID NO: 626047 - protein, 9 aa, Homo Sapiens
IIEENITTV

SEQ ID NO: 626048 - protein, 9 aa, Homo Sapiens
QDLVNPELM

SEQ ID NO: 626049 - protein, 9 aa, Homo Sapiens
ALISTTFLS

SEQ ID NO: 626050 - protein, 9 aa, Homo Sapiens
HLYKFAGGW

SEQ ID NO: 626051 - protein, 9 aa, Homo Sapiens
SFYVPFIVN

SEQ ID NO: 626052 - protein, 9 aa, Homo Sapiens
CKPGCMCQG

SEQ ID NO: 626053 - protein, 9 aa, Homo Sapiens
NIYKKGNLA

SEQ ID NO: 626054 - protein, 9 aa, Homo Sapiens
LGHGYTNRV

SEQ ID NO: 626055 - protein, 9 aa, Homo Sapiens
KKTVIIEEN

SEQ ID NO: 626056 - protein, 9 aa, Homo Sapiens
GGERVSVLV

SEQ ID NO: 626057 - protein, 9 aa, Homo Sapiens
RVCPQVPVC

SEQ ID NO: 626058 - protein, 9 aa, Homo Sapiens
PHEESIKEF

SEQ ID NO: 626059 - protein, 9 aa, Homo Sapiens
RVGVCELPG

SEQ ID NO: 626060 - protein, 9 aa, Homo Sapiens
LSMTVSMDS

SEQ ID NO: 626061 - protein, 9 aa, Homo Sapiens
NNEIILFNG

SEQ ID NO: 626062 - protein, 9 aa, Homo Sapiens
AHKGGEEGH

SEQ ID NO: 626063 - protein, 9 aa, Homo Sapiens
LSHFLCLMA

SEQ ID NO: 626064 - protein, 9 aa, Homo Sapiens
TKVRLTFRD

SEQ ID NO: 626065 - protein, 9 aa, Homo Sapiens
IQQKTENYE

SEQ ID NO: 626066 - protein, 9 aa, Homo Sapiens
ISWLPITAK

SEQ ID NO: 626067 - protein, 9 aa, Homo Sapiens
QADAHKGGE

SEQ ID NO: 626068 - protein, 9 aa, Homo Sapiens
LNHLLYAVG

SEQ ID NO: 626069 - protein, 9 aa, Homo Sapiens
FVGQMGLTA

SEQ ID NO: 626070 - protein, 9 aa, Homo Sapiens
NGVALRVSS

SEQ ID NO: 626071 - protein, 9 aa, Homo Sapiens
MGLTANKHS

SEQ ID NO: 626072 - protein, 9 aa, Homo Sapiens
IVGLLIPFT

SEQ ID NO: 626073 - protein, 9 aa, Homo Sapiens
SIINIYKKG

SEQ ID NO: 626074 - protein, 9 aa, Homo Sapiens
SQESGAEQP

SEQ ID NO: 626075 - protein, 9 aa, Homo Sapiens
LPYAAAKSK

SEQ ID NO: 626076 - protein, 9 aa, Homo Sapiens
YYPDNNGIY

SEQ ID NO: 626077 - protein, 9 aa, Homo Sapiens
INKVSKPLA

SEQ ID NO: 626078 - protein, 9 aa, Homo Sapiens
SGAEQPRKG

SEQ ID NO: 626079 - protein, 9 aa, Homo Sapiens
GKPDGALLI

SEQ ID NO: 626080 - protein, 9 aa, Homo Sapiens
NRVAFQGDV

SEQ ID NO: 626081 - protein, 9 aa, Homo Sapiens
FAALKRQRR

SEQ ID NO: 626082 - protein, 9 aa, Homo Sapiens
ALKRQRRKE

SEQ ID NO: 626083 - protein, 9 aa, Homo Sapiens
DAHKEEIQQ

SEQ ID NO: 626084 - protein, 9 aa, Homo Sapiens
GSSSREGLS

SEQ ID NO: 626085 - protein, 9 aa, Homo Sapiens
HKEEIQQIL

SEQ ID NO: 626086 - protein, 9 aa, Homo Sapiens
DDVSFILKP

SEQ ID NO: 626087 - protein, 9 aa, Homo Sapiens
TAKYRRGQV

SEQ ID NO: 626088 - protein, 9 aa, Homo Sapiens
LEQADAHKG

SEQ ID NO: 626089 - protein, 9 aa, Homo Sapiens
QESCWEFFP

SEQ ID NO: 626090 - protein, 9 aa, Homo Sapiens
STGGTNLRD

SEQ ID NO: 626091 - protein, 9 aa, Homo Sapiens
PCFSIVGFF

SEQ ID NO: 626092 - protein, 9 aa, Homo Sapiens
PKLGKCPSR

SEQ ID NO: 626093 - protein, 9 aa, Homo Sapiens
RGCQAARWR

SEQ ID NO: 626094 - protein, 9 aa, Homo Sapiens
DLEHWQGRK

SEQ ID NO: 626095 - protein, 9 aa, Homo Sapiens
EVLGLPHEE

SEQ ID NO: 626096 - protein, 9 aa, Homo Sapiens
PCKPGCMCQ

SEQ ID NO: 626097 - protein, 9 aa, Homo Sapiens
ELMNNSSSG

SEQ ID NO: 626098 - protein, 9 aa, Homo Sapiens
HCVSAAHKG

SEQ ID NO: 626099 - protein, 9 aa, Homo Sapiens
DSDSNDDPL

SEQ ID NO: 626100 - protein, 9 aa, Homo Sapiens
PVCLPRGPG

SEQ ID NO: 626101 - protein, 9 aa, Homo Sapiens
LSGCEICIS

SEQ ID NO: 626102 - protein, 9 aa, Homo Sapiens
KVRLTFRDV

SEQ ID NO: 626103 - protein, 9 aa, Homo Sapiens
VDGTIWLQS

SEQ ID NO: 626104 - protein, 9 aa, Homo Sapiens
SGWQLVFSI

SEQ ID NO: 626105 - protein, 9 aa, Homo Sapiens
IMYCTDPVE

SEQ ID NO: 626106 - protein, 9 aa, Homo Sapiens
GLVSHGTSP

SEQ ID NO: 626107 - protein, 9 aa, Homo Sapiens
MGLLGSSAT

SEQ ID NO: 626108 - protein, 9 aa, Homo Sapiens
QMGLTANKH

SEQ ID NO: 626109 - protein, 9 aa, Homo Sapiens
LPGNRDSAE

SEQ ID NO: 626110 - protein, 9 aa, Homo Sapiens
SKAFNRFTT

SEQ ID NO: 626111 - protein, 9 aa, Homo Sapiens
NLSGTSRKV

SEQ ID NO: 626112 - protein, 9 aa, Homo Sapiens
DGYIARQRK

SEQ ID NO: 626113 - protein, 9 aa, Homo Sapiens
GSHACQTIE

SEQ ID NO: 626114 - protein, 9 aa, Homo Sapiens
RASVGGHRH

SEQ ID NO: 626115 - protein, 9 aa, Homo Sapiens
KEAIFITLV

SEQ ID NO: 626116 - protein, 9 aa, Homo Sapiens
YKAMIQFAI

SEQ ID NO: 626117 - protein, 9 aa, Homo Sapiens
YVPFIVNLL

SEQ ID NO: 626118 - protein, 9 aa, Homo Sapiens
VAFQGDVVR

SEQ ID NO: 626119 - protein, 9 aa, Homo Sapiens
DLGPVLEWA

SEQ ID NO: 626120 - protein, 9 aa, Homo Sapiens
KAMIQFAIN

SEQ ID NO: 626121 - protein, 9 aa, Homo Sapiens
DTPTKRLDV

SEQ ID NO: 626122 - protein, 9 aa, Homo Sapiens
INGCQHPSS

SEQ ID NO: 626123 - protein, 9 aa, Homo Sapiens
LESIQAEES

SEQ ID NO: 626124 - protein, 9 aa, Homo Sapiens
CEECSKAFN

SEQ ID NO: 626125 - protein, 9 aa, Homo Sapiens
NSCLSHFLC

SEQ ID NO: 626126 - protein, 9 aa, Homo Sapiens
SWLPITAKY

SEQ ID NO: 626127 - protein, 9 aa, Homo Sapiens
NGCQHPSSS

SEQ ID NO: 626128 - protein, 9 aa, Homo Sapiens
CFSTSTSPR

SEQ ID NO: 626129 - protein, 9 aa, Homo Sapiens
AVINGCQHP

SEQ ID NO: 626130 - protein, 9 aa, Homo Sapiens
VGLQDHLFE

SEQ ID NO: 626131 - protein, 9 aa, Homo Sapiens
PELMNNSSS

SEQ ID NO: 626132 - protein, 9 aa, Homo Sapiens
EPLVTVTAQ

SEQ ID NO: 626133 - protein, 9 aa, Homo Sapiens
IKCLLQEAK

SEQ ID NO: 626134 - protein, 9 aa, Homo Sapiens
SAVKEIQQK

SEQ ID NO: 626135 - protein, 9 aa, Homo Sapiens
LEHWQGRKT

SEQ ID NO: 626136 - protein, 9 aa, Homo Sapiens
IEENITTVV

SEQ ID NO: 626137 - protein, 9 aa, Homo Sapiens
TSWERVSTK

SEQ ID NO: 626138 - protein, 9 aa, Homo Sapiens
LTPDSYGGG

SEQ ID NO: 626139 - protein, 9 aa, Homo Sapiens
YIARQRKRG

SEQ ID NO: 626140 - protein, 9 aa, Homo Sapiens
AIANACCAT

SEQ ID NO: 626141 - protein, 9 aa, Homo Sapiens
LYGKPDGAL

SEQ ID NO: 626142 - protein, 9 aa, Homo Sapiens
PGCMCQGLA

SEQ ID NO: 626143 - protein, 9 aa, Homo Sapiens
ILGTATWDE

SEQ ID NO: 626144 - protein, 9 aa, Homo Sapiens
YPPSASVVR

SEQ ID NO: 626145 - protein, 9 aa, Homo Sapiens
DPVDGTIWL

SEQ ID NO: 626146 - protein, 9 aa, Homo Sapiens
VTVTAQCAF

SEQ ID NO: 626147 - protein, 9 aa, Homo Sapiens
HMRTLFGFL

SEQ ID NO: 626148 - protein, 9 aa, Homo Sapiens
LKRQRRKEP

SEQ ID NO: 626149 - protein, 9 aa, Homo Sapiens
IILTCTAPG

SEQ ID NO: 626150 - protein, 9 aa, Homo Sapiens
LKTLQRNYA

SEQ ID NO: 626151 - protein, 9 aa, Homo Sapiens
EAELALTPK

SEQ ID NO: 626152 - protein, 9 aa, Homo Sapiens
GVAVLNHLL

SEQ ID NO: 626153 - protein, 9 aa, Homo Sapiens
GGTLCSYIV

SEQ ID NO: 626154 - protein, 9 aa, Homo Sapiens
ELESIQAEE

SEQ ID NO: 626155 - protein, 9 aa, Homo Sapiens
ALTPKVLEA

SEQ ID NO: 626156 - protein, 9 aa, Homo Sapiens
RPIIAVMEF

SEQ ID NO: 626157 - protein, 9 aa, Homo Sapiens
VALRVSSMR

SEQ ID NO: 626158 - protein, 9 aa, Homo Sapiens
TRFPTLGGR

SEQ ID NO: 626159 - protein, 9 aa, Homo Sapiens
SHFLCLMAS

SEQ ID NO: 626160 - protein, 9 aa, Homo Sapiens
AELALTPKV

SEQ ID NO: 626161 - protein, 9 aa, Homo Sapiens
SSAPKPRLE

SEQ ID NO: 626162 - protein, 9 aa, Homo Sapiens
VWKMYQESC

SEQ ID NO: 626163 - protein, 9 aa, Homo Sapiens
SNDAVVSAK

SEQ ID NO: 626164 - protein, 9 aa, Homo Sapiens
VDSDSNDDP

SEQ ID NO: 626165 - protein, 9 aa, Homo Sapiens
CPQVPVCLP

SEQ ID NO: 626166 - protein, 9 aa, Homo Sapiens
TGTKGVKGD

SEQ ID NO: 626167 - protein, 9 aa, Homo Sapiens
LVTVTAQCA

SEQ ID NO: 626168 - protein, 9 aa, Homo Sapiens
ALVLGLRGC

SEQ ID NO: 626169 - protein, 9 aa, Homo Sapiens
PDNNGIYNQ

SEQ ID NO: 626170 - protein, 9 aa, Homo Sapiens
AGEDNEGFE

SEQ ID NO: 626171 - protein, 9 aa, Homo Sapiens
TKGVKGDLG

SEQ ID NO: 626172 - protein, 9 aa, Homo Sapiens
YHIQEHQPK

SEQ ID NO: 626173 - protein, 9 aa, Homo Sapiens
ENITTVVKS

SEQ ID NO: 626174 - protein, 9 aa, Homo Sapiens
EKTAAEQQR

SEQ ID NO: 626175 - protein, 9 aa, Homo Sapiens
TEFFLLDAL

SEQ ID NO: 626176 - protein, 9 aa, Homo Sapiens
ICISNETKD

SEQ ID NO: 626177 - protein, 9 aa, Homo Sapiens
IILFNGVFP

SEQ ID NO: 626178 - protein, 9 aa, Homo Sapiens
QGRKTDDLG

SEQ ID NO: 626179 - protein, 9 aa, Homo Sapiens
FLTPQFMVN

SEQ ID NO: 626180 - protein, 9 aa, Homo Sapiens
NRDSAEIRG

SEQ ID NO: 626181 - protein, 9 aa, Homo Sapiens
VRDLEHWQG

SEQ ID NO: 626182 - protein, 9 aa, Homo Sapiens
ERVSVLVLS

SEQ ID NO: 626183 - protein, 9 aa, Homo Sapiens
DGALLIRES

SEQ ID NO: 626184 - protein, 9 aa, Homo Sapiens
LPHEESIKE

SEQ ID NO: 626185 - protein, 9 aa, Homo Sapiens
PYAAAKSKP

SEQ ID NO: 626186 - protein, 9 aa, Homo Sapiens
EGLYAIAVL

SEQ ID NO: 626187 - protein, 9 aa, Homo Sapiens
LTPQFMVND

SEQ ID NO: 626188 - protein, 9 aa, Homo Sapiens
DNEGFEDDL

SEQ ID NO: 626189 - protein, 9 aa, Homo Sapiens
KDAHKEEIQ

SEQ ID NO: 626190 - protein, 9 aa, Homo Sapiens
GGAKVMAST

SEQ ID NO: 626191 - protein, 9 aa, Homo Sapiens
GVTEFFLLD

SEQ ID NO: 626192 - protein, 9 aa, Homo Sapiens
NITTVVKSP

SEQ ID NO: 626193 - protein, 9 aa, Homo Sapiens
ILFNGVFPP

SEQ ID NO: 626194 - protein, 9 aa, Homo Sapiens
SSRKEADSS

SEQ ID NO: 626195 - protein, 9 aa, Homo Sapiens
HKICFRCAI

SEQ ID NO: 626196 - protein, 9 aa, Homo Sapiens
IVSIIAEDK

SEQ ID NO: 626197 - protein, 9 aa, Homo Sapiens
VTYLVTVVG

SEQ ID NO: 626198 - protein, 9 aa, Homo Sapiens
SAEASGKPN

SEQ ID NO: 626199 - protein, 9 aa, Homo Sapiens
TCEEARCKF

SEQ ID NO: 626200 - protein, 9 aa, Homo Sapiens
LFDDEDEEN

SEQ ID NO: 626201 - protein, 9 aa, Homo Sapiens
PQPGTKSQE

SEQ ID NO: 626202 - protein, 9 aa, Homo Sapiens
HPPPLARAP

SEQ ID NO: 626203 - protein, 9 aa, Homo Sapiens
NKLKEDRAK

SEQ ID NO: 626204 - protein, 9 aa, Homo Sapiens
TRCETDVIH

SEQ ID NO: 626205 - protein, 9 aa, Homo Sapiens
PGPAAPAAG

SEQ ID NO: 626206 - protein, 9 aa, Homo Sapiens
PLSNLHSLG

SEQ ID NO: 626207 - protein, 9 aa, Homo Sapiens
NVTGMNPKT

SEQ ID NO: 626208 - protein, 9 aa, Homo Sapiens
IVDHVKFPR

SEQ ID NO: 626209 - protein, 9 aa, Homo Sapiens
KVESGQIYI

SEQ ID NO: 626210 - protein, 9 aa, Homo Sapiens
DRGERIEDC

SEQ ID NO: 626211 - protein, 9 aa, Homo Sapiens
GACRLTGIA

SEQ ID NO: 626212 - protein, 9 aa, Homo Sapiens
KGRAERVGA

SEQ ID NO: 626213 - protein, 9 aa, Homo Sapiens
LFSLFETIN

SEQ ID NO: 626214 - protein, 9 aa, Homo Sapiens
FEIVRLVVD

SEQ ID NO: 626215 - protein, 9 aa, Homo Sapiens
QGQERKGRA

SEQ ID NO: 626216 - protein, 9 aa, Homo Sapiens
NNLFGGTAA

SEQ ID NO: 626217 - protein, 9 aa, Homo Sapiens
LWAKVDKRG

SEQ ID NO: 626218 - protein, 9 aa, Homo Sapiens
HYFGFVNFG

SEQ ID NO: 626219 - protein, 9 aa, Homo Sapiens
KVTSKDKPA

SEQ ID NO: 626220 - protein, 9 aa, Homo Sapiens
ESVSFTDVA

SEQ ID NO: 626221 - protein, 9 aa, Homo Sapiens
ERKHRSIVQ

SEQ ID NO: 626222 - protein, 9 aa, Homo Sapiens
VSVTLKDIF

SEQ ID NO: 626223 - protein, 9 aa, Homo Sapiens
WPGPNVGIT

SEQ ID NO: 626224 - protein, 9 aa, Homo Sapiens
EEHIPHDLV

SEQ ID NO: 626225 - protein, 9 aa, Homo Sapiens
YNPEAEEDE

SEQ ID NO: 626226 - protein, 9 aa, Homo Sapiens
PGFSYSEDV

SEQ ID NO: 626227 - protein, 9 aa, Homo Sapiens
GSSPQRCGS

SEQ ID NO: 626228 - protein, 9 aa, Homo Sapiens
IVSKNAGET

SEQ ID NO: 626229 - protein, 9 aa, Homo Sapiens
APGPAAPAA

SEQ ID NO: 626230 - protein, 9 aa, Homo Sapiens
EWVKCCKQL

SEQ ID NO: 626231 - protein, 9 aa, Homo Sapiens
IPPAGLFHS

SEQ ID NO: 626232 - protein, 9 aa, Homo Sapiens
PDVVRQELF

SEQ ID NO: 626233 - protein, 9 aa, Homo Sapiens
PLDVLSGHE

SEQ ID NO: 626234 - protein, 9 aa, Homo Sapiens
AVMPHLVCL

SEQ ID NO: 626235 - protein, 9 aa, Homo Sapiens
RSKESVSFT

SEQ ID NO: 626236 - protein, 9 aa, Homo Sapiens
ALTNRRAQG

SEQ ID NO: 626237 - protein, 9 aa, Homo Sapiens
AEHVLMRLQ

SEQ ID NO: 626238 - protein, 9 aa, Homo Sapiens
HRGEVCVAN

SEQ ID NO: 626239 - protein, 9 aa, Homo Sapiens
ALKPTLAEL

SEQ ID NO: 626240 - protein, 9 aa, Homo Sapiens
FPSYKVNVT

SEQ ID NO: 626241 - protein, 9 aa, Homo Sapiens
RIVRDLTIP

SEQ ID NO: 626242 - protein, 9 aa, Homo Sapiens
HEQEYTNNI

SEQ ID NO: 626243 - protein, 9 aa, Homo Sapiens
YVVDTRPKR

SEQ ID NO: 626244 - protein, 9 aa, Homo Sapiens
SMQTGRPLD

SEQ ID NO: 626245 - protein, 9 aa, Homo Sapiens
SFNKVAEHV

SEQ ID NO: 626246 - protein, 9 aa, Homo Sapiens
DRAPRQPTS

SEQ ID NO: 626247 - protein, 9 aa, Homo Sapiens
RPKRNAMAN

SEQ ID NO: 626248 - protein, 9 aa, Homo Sapiens
VRLVVDEMG

SEQ ID NO: 626249 - protein, 9 aa, Homo Sapiens
RAIQGLASH

SEQ ID NO: 626250 - protein, 9 aa, Homo Sapiens
LGSVWRRMG

SEQ ID NO: 626251 - protein, 9 aa, Homo Sapiens
ERVGACRLT

SEQ ID NO: 626252 - protein, 9 aa, Homo Sapiens
PRPSSLGFE

SEQ ID NO: 626253 - protein, 9 aa, Homo Sapiens
ELELSVPKV

SEQ ID NO: 626254 - protein, 9 aa, Homo Sapiens
RSSRTAAVE

SEQ ID NO: 626255 - protein, 9 aa, Homo Sapiens
LKEDRAKAK

SEQ ID NO: 626256 - protein, 9 aa, Homo Sapiens
NLQPYSDPS

SEQ ID NO: 626257 - protein, 9 aa, Homo Sapiens
HVEKLCKAD

SEQ ID NO: 626258 - protein, 9 aa, Homo Sapiens
CTHWTYLLL

SEQ ID NO: 626259 - protein, 9 aa, Homo Sapiens
DITLYYSDV

SEQ ID NO: 626260 - protein, 9 aa, Homo Sapiens
RRQPPYHPP

SEQ ID NO: 626261 - protein, 9 aa, Homo Sapiens
IEEVAEELH

SEQ ID NO: 626262 - protein, 9 aa, Homo Sapiens
VEKAQKALT

SEQ ID NO: 626263 - protein, 9 aa, Homo Sapiens
QRCGSPPSA

SEQ ID NO: 626264 - protein, 9 aa, Homo Sapiens
GGGKPWHKI

SEQ ID NO: 626265 - protein, 9 aa, Homo Sapiens
KEMYTIKWS

SEQ ID NO: 626266 - protein, 9 aa, Homo Sapiens
YTNNIAKLV

SEQ ID NO: 626267 - protein, 9 aa, Homo Sapiens
SEEMEQSAE

SEQ ID NO: 626268 - protein, 9 aa, Homo Sapiens
CVHLAAAAG

SEQ ID NO: 626269 - protein, 9 aa, Homo Sapiens
YRTFGPYFL

SEQ ID NO: 626270 - protein, 9 aa, Homo Sapiens
TAVLGSSPF

SEQ ID NO: 626271 - protein, 9 aa, Homo Sapiens
SPPPVERKH

SEQ ID NO: 626272 - protein, 9 aa, Homo Sapiens
APRQPTSLG

SEQ ID NO: 626273 - protein, 9 aa, Homo Sapiens
GKTCVHLAA

SEQ ID NO: 626274 - protein, 9 aa, Homo Sapiens
RCETDVIHW

SEQ ID NO: 626275 - protein, 9 aa, Homo Sapiens
SCRLQGQER

SEQ ID NO: 626276 - protein, 9 aa, Homo Sapiens
DGTHKMQEE

SEQ ID NO: 626277 - protein, 9 aa, Homo Sapiens
ARMADRAPR

SEQ ID NO: 626278 - protein, 9 aa, Homo Sapiens
AITRVPSMR

SEQ ID NO: 626279 - protein, 9 aa, Homo Sapiens
PPDRGERIE

SEQ ID NO: 626280 - protein, 9 aa, Homo Sapiens
PLRAITRVP

SEQ ID NO: 626281 - protein, 9 aa, Homo Sapiens
EHVQGRIVR

SEQ ID NO: 626282 - protein, 9 aa, Homo Sapiens
QLLLTNPVP

SEQ ID NO: 626283 - protein, 9 aa, Homo Sapiens
TLYYSDVDS

SEQ ID NO: 626284 - protein, 9 aa, Homo Sapiens
TRCCFSEPL

SEQ ID NO: 626285 - protein, 9 aa, Homo Sapiens
KVLYRTFGP

SEQ ID NO: 626286 - protein, 9 aa, Homo Sapiens
NTGGYNPEA

SEQ ID NO: 626287 - protein, 9 aa, Homo Sapiens
RVLCSFTIN

SEQ ID NO: 626288 - protein, 9 aa, Homo Sapiens
ADSSPFVER

SEQ ID NO: 626289 - protein, 9 aa, Homo Sapiens
PLCPPVVGG

SEQ ID NO: 626290 - protein, 9 aa, Homo Sapiens
LGGFDWRLV

SEQ ID NO: 626291 - protein, 9 aa, Homo Sapiens
RSDPVSAVH

SEQ ID NO: 626292 - protein, 9 aa, Homo Sapiens
VPKVKIDEF

SEQ ID NO: 626293 - protein, 9 aa, Homo Sapiens
FCESLEAQG

SEQ ID NO: 626294 - protein, 9 aa, Homo Sapiens
DTTKSKVTS

SEQ ID NO: 626295 - protein, 9 aa, Homo Sapiens
TDVAAPCGG

SEQ ID NO: 626296 - protein, 9 aa, Homo Sapiens
DTRPKRNAM

SEQ ID NO: 626297 - protein, 9 aa, Homo Sapiens
YSEVATVIS

SEQ ID NO: 626298 - protein, 9 aa, Homo Sapiens
DRAKAKESL

SEQ ID NO: 626299 - protein, 9 aa, Homo Sapiens
KLKEDRAKA

SEQ ID NO: 626300 - protein, 9 aa, Homo Sapiens
AALKPTLAE

SEQ ID NO: 626301 - protein, 9 aa, Homo Sapiens
GRGGCALSR

SEQ ID NO: 626302 - protein, 9 aa, Homo Sapiens
TEKFWRNVL

SEQ ID NO: 626303 - protein, 9 aa, Homo Sapiens
MGASERGRL

SEQ ID NO: 626304 - protein, 9 aa, Homo Sapiens
DLSLLRSSR

SEQ ID NO: 626305 - protein, 9 aa, Homo Sapiens
CSFTINDSV

SEQ ID NO: 626306 - protein, 9 aa, Homo Sapiens
SYKVNVTGM

SEQ ID NO: 626307 - protein, 9 aa, Homo Sapiens
EARCKFLGR

SEQ ID NO: 626308 - protein, 9 aa, Homo Sapiens
VGACRLTGI

SEQ ID NO: 626309 - protein, 9 aa, Homo Sapiens
YYSDVDSFT

SEQ ID NO: 626310 - protein, 9 aa, Homo Sapiens
SRTAAVELV

SEQ ID NO: 626311 - protein, 9 aa, Homo Sapiens
RRRRRQPPY

SEQ ID NO: 626312 - protein, 9 aa, Homo Sapiens
RHLKSVQNS

SEQ ID NO: 626313 - protein, 9 aa, Homo Sapiens
LARAPPTIP

SEQ ID NO: 626314 - protein, 9 aa, Homo Sapiens
VMWVRREDF

SEQ ID NO: 626315 - protein, 9 aa, Homo Sapiens
ADRAPRQPT

SEQ ID NO: 626316 - protein, 9 aa, Homo Sapiens
VEVPMEMCH

SEQ ID NO: 626317 - protein, 9 aa, Homo Sapiens
GVCRSPSQE

SEQ ID NO: 626318 - protein, 9 aa, Homo Sapiens
AKDLFQQRH

SEQ ID NO: 626319 - protein, 9 aa, Homo Sapiens
KLFCESLEA

SEQ ID NO: 626320 - protein, 9 aa, Homo Sapiens
PPPDRGERI

SEQ ID NO: 626321 - protein, 9 aa, Homo Sapiens
VLVAGTVPV

SEQ ID NO: 626322 - protein, 9 aa, Homo Sapiens
CCFSEPLSN

SEQ ID NO: 626323 - protein, 9 aa, Homo Sapiens
KGCIWTITV

SEQ ID NO: 626324 - protein, 9 aa, Homo Sapiens
WSMQTGRPL

SEQ ID NO: 626325 - protein, 9 aa, Homo Sapiens
PDCGRFPSD

SEQ ID NO: 626326 - protein, 9 aa, Homo Sapiens
YRDLLPGIV

SEQ ID NO: 626327 - protein, 9 aa, Homo Sapiens
ARAPPTIPP

SEQ ID NO: 626328 - protein, 9 aa, Homo Sapiens
SLLFSLFET

SEQ ID NO: 626329 - protein, 9 aa, Homo Sapiens
LFHSCRLQG

SEQ ID NO: 626330 - protein, 9 aa, Homo Sapiens
PNVGITNFD

SEQ ID NO: 626331 - protein, 9 aa, Homo Sapiens
QYNKLKEDR

SEQ ID NO: 626332 - protein, 9 aa, Homo Sapiens
PKVKIDEFY

SEQ ID NO: 626333 - protein, 9 aa, Homo Sapiens
VCVANIRNV

SEQ ID NO: 626334 - protein, 9 aa, Homo Sapiens
SSAILKRNV

SEQ ID NO: 626335 - protein, 9 aa, Homo Sapiens
PTTPEWVKC

SEQ ID NO: 626336 - protein, 9 aa, Homo Sapiens
NVLFFDLRG

SEQ ID NO: 626337 - protein, 9 aa, Homo Sapiens
LDLLGLEKP

SEQ ID NO: 626338 - protein, 9 aa, Homo Sapiens
AVELVAGGV

SEQ ID NO: 626339 - protein, 9 aa, Homo Sapiens
IEDCLAPLC

SEQ ID NO: 626340 - protein, 9 aa, Homo Sapiens
RFLLMGTFL

SEQ ID NO: 626341 - protein, 9 aa, Homo Sapiens
RGRDGPAAW

SEQ ID NO: 626342 - protein, 9 aa, Homo Sapiens
PFNLFCTHW

SEQ ID NO: 626343 - protein, 9 aa, Homo Sapiens
WAKVDKRGS

SEQ ID NO: 626344 - protein, 9 aa, Homo Sapiens
ASVEKAQKA

SEQ ID NO: 626345 - protein, 9 aa, Homo Sapiens
ALWAKVDKR

SEQ ID NO: 626346 - protein, 9 aa, Homo Sapiens
ETINKDQVL

SEQ ID NO: 626347 - protein, 9 aa, Homo Sapiens
GRIVRDLTI

SEQ ID NO: 626348 - protein, 9 aa, Homo Sapiens
NLRQLLLTN

SEQ ID NO: 626349 - protein, 9 aa, Homo Sapiens
YKVNVTGMN

SEQ ID NO: 626350 - protein, 9 aa, Homo Sapiens
LLAKHVCND

SEQ ID NO: 626351 - protein, 9 aa, Homo Sapiens
TGRPLDVLS

SEQ ID NO: 626352 - protein, 9 aa, Homo Sapiens
LDYEQASNI

SEQ ID NO: 626353 - protein, 9 aa, Homo Sapiens
QKALTERQR

SEQ ID NO: 626354 - protein, 9 aa, Homo Sapiens
LFFLPNTSI

SEQ ID NO: 626355 - protein, 9 aa, Homo Sapiens
TLKDIFTGE

SEQ ID NO: 626356 - protein, 9 aa, Homo Sapiens
CGGVKQSGF

SEQ ID NO: 626357 - protein, 9 aa, Homo Sapiens
EKPDCGRFP

SEQ ID NO: 626358 - protein, 9 aa, Homo Sapiens
KHVCNDCPP

SEQ ID NO: 626359 - protein, 9 aa, Homo Sapiens
GGEFLLLYA

SEQ ID NO: 626360 - protein, 9 aa, Homo Sapiens
PTSLGSSPQ

SEQ ID NO: 626361 - protein, 9 aa, Homo Sapiens
DIFTGEEGP

SEQ ID NO: 626362 - protein, 9 aa, Homo Sapiens
RRLIVSKNA

SEQ ID NO: 626363 - protein, 9 aa, Homo Sapiens
CALSRFLPV

SEQ ID NO: 626364 - protein, 9 aa, Homo Sapiens
GGVCRSPSQ

SEQ ID NO: 626365 - protein, 9 aa, Homo Sapiens
LAPLCPPVV

SEQ ID NO: 626366 - protein, 9 aa, Homo Sapiens
PYHPPPLAR

SEQ ID NO: 626367 - protein, 9 aa, Homo Sapiens
RKHRSIVQI

SEQ ID NO: 626368 - protein, 9 aa, Homo Sapiens
PTIPPAGLF

SEQ ID NO: 626369 - protein, 9 aa, Homo Sapiens
TGGYNPEAE

SEQ ID NO: 626370 - protein, 9 aa, Homo Sapiens
MEQSAEASG

SEQ ID NO: 626371 - protein, 9 aa, Homo Sapiens
GEPQLGGFD

SEQ ID NO: 626372 - protein, 9 aa, Homo Sapiens
ACRLTGIAR

SEQ ID NO: 626373 - protein, 9 aa, Homo Sapiens
LLFSLFETI

SEQ ID NO: 626374 - protein, 9 aa, Homo Sapiens
KVAEHVLMR

SEQ ID NO: 626375 - protein, 9 aa, Homo Sapiens
APPPPPDRG

SEQ ID NO: 626376 - protein, 9 aa, Homo Sapiens
TSKDKPAVA

SEQ ID NO: 626377 - protein, 9 aa, Homo Sapiens
RVGACRLTG

SEQ ID NO: 626378 - protein, 9 aa, Homo Sapiens
FWRNVLVAG

SEQ ID NO: 626379 - protein, 9 aa, Homo Sapiens
CLKLTGWRG

SEQ ID NO: 626380 - protein, 9 aa, Homo Sapiens
CPPVVGGRG

SEQ ID NO: 626381 - protein, 9 aa, Homo Sapiens
FLPNTSIHG

SEQ ID NO: 626382 - protein, 9 aa, Homo Sapiens
ERLDDRDRE

SEQ ID NO: 626383 - protein, 9 aa, Homo Sapiens
NVYSDLKNL

SEQ ID NO: 626384 - protein, 9 aa, Homo Sapiens
VERKHRSIV

SEQ ID NO: 626385 - protein, 9 aa, Homo Sapiens
DPLLYSEVA

SEQ ID NO: 626386 - protein, 9 aa, Homo Sapiens
LPARSDPVS

SEQ ID NO: 626387 - protein, 9 aa, Homo Sapiens
HLKSVQNSH

SEQ ID NO: 626388 - protein, 9 aa, Homo Sapiens
RERLDDRDR

SEQ ID NO: 626389 - protein, 9 aa, Homo Sapiens
RGERIEDCL

SEQ ID NO: 626390 - protein, 9 aa, Homo Sapiens
TSEEMEQSA

SEQ ID NO: 626391 - protein, 9 aa, Homo Sapiens
CRCLRFLLM

SEQ ID NO: 626392 - protein, 9 aa, Homo Sapiens
EAEEDETAS

SEQ ID NO: 626393 - protein, 9 aa, Homo Sapiens
SLLRSSRTA

SEQ ID NO: 626394 - protein, 9 aa, Homo Sapiens
PSGKTAVLG

SEQ ID NO: 626395 - protein, 9 aa, Homo Sapiens
NKTDVAAPC

SEQ ID NO: 626396 - protein, 9 aa, Homo Sapiens
YSVPQPGTK

SEQ ID NO: 626397 - protein, 9 aa, Homo Sapiens
DPSGKTAVL

SEQ ID NO: 626398 - protein, 9 aa, Homo Sapiens
SNVLFFDLR

SEQ ID NO: 626399 - protein, 9 aa, Homo Sapiens
FLVTYLVTV

SEQ ID NO: 626400 - protein, 9 aa, Homo Sapiens
RAPRQPTSL

SEQ ID NO: 626401 - protein, 9 aa, Homo Sapiens
CETDVIHWY

SEQ ID NO: 626402 - protein, 9 aa, Homo Sapiens
KVDKRGSHK

SEQ ID NO: 626403 - protein, 9 aa, Homo Sapiens
EHIPHDLVT

SEQ ID NO: 626404 - protein, 9 aa, Homo Sapiens
TKSQEASPQ

SEQ ID NO: 626405 - protein, 9 aa, Homo Sapiens
EVPMEMCHF

SEQ ID NO: 626406 - protein, 9 aa, Homo Sapiens
LPDVVRQEL

SEQ ID NO: 626407 - protein, 9 aa, Homo Sapiens
KSHEQEYTN

SEQ ID NO: 626408 - protein, 9 aa, Homo Sapiens
KEDRAKAKE

SEQ ID NO: 626409 - protein, 9 aa, Homo Sapiens
HLAAAAGFS

SEQ ID NO: 626410 - protein, 9 aa, Homo Sapiens
PPPPDRGER

SEQ ID NO: 626411 - protein, 9 aa, Homo Sapiens
FFDLRGPIK

SEQ ID NO: 626412 - protein, 9 aa, Homo Sapiens
KIYHHRDVR

SEQ ID NO: 626413 - protein, 9 aa, Homo Sapiens
IYINPVTWL

SEQ ID NO: 626414 - protein, 9 aa, Homo Sapiens
PMEMCHFVS

SEQ ID NO: 626415 - protein, 9 aa, Homo Sapiens
CMRHVEKLC

SEQ ID NO: 626416 - protein, 9 aa, Homo Sapiens
EEVAEELHW

SEQ ID NO: 626417 - protein, 9 aa, Homo Sapiens
RVIWGIEEV

SEQ ID NO: 626418 - protein, 9 aa, Homo Sapiens
ALPEPGPES

SEQ ID NO: 626419 - protein, 9 aa, Homo Sapiens
EARRLIVSK

SEQ ID NO: 626420 - protein, 9 aa, Homo Sapiens
AGGVCRSPS

SEQ ID NO: 626421 - protein, 9 aa, Homo Sapiens
VQLPRPSSL

SEQ ID NO: 626422 - protein, 9 aa, Homo Sapiens
AEDKNSYTP

SEQ ID NO: 626423 - protein, 9 aa, Homo Sapiens
FSYSEDVCR

SEQ ID NO: 626424 - protein, 9 aa, Homo Sapiens
KRNVYSDLK

SEQ ID NO: 626425 - protein, 9 aa, Homo Sapiens
RTVTKRVLP

SEQ ID NO: 626426 - protein, 9 aa, Homo Sapiens
NIINHELKR

SEQ ID NO: 626427 - protein, 9 aa, Homo Sapiens
VTKPFFAAI

SEQ ID NO: 626428 - protein, 9 aa, Homo Sapiens
LSLLRSSRT

SEQ ID NO: 626429 - protein, 9 aa, Homo Sapiens
HIPHDLVTE

SEQ ID NO: 626430 - protein, 9 aa, Homo Sapiens
LALTNRRAQ

SEQ ID NO: 626431 - protein, 9 aa, Homo Sapiens
LVAGGVCRS

SEQ ID NO: 626432 - protein, 9 aa, Homo Sapiens
VDKRGSHKD

SEQ ID NO: 626433 - protein, 9 aa, Homo Sapiens
LPGIVPLPK

SEQ ID NO: 626434 - protein, 9 aa, Homo Sapiens
KSGKIYHHR

SEQ ID NO: 626435 - protein, 9 aa, Homo Sapiens
YNKLKEDRA

SEQ ID NO: 626436 - protein, 9 aa, Homo Sapiens
LYPPNKGCI

SEQ ID NO: 626437 - protein, 9 aa, Homo Sapiens
PPPLARAPP

SEQ ID NO: 626438 - protein, 9 aa, Homo Sapiens
RRLTRRALP

SEQ ID NO: 626439 - protein, 9 aa, Homo Sapiens
SKVTSKDKP

SEQ ID NO: 626440 - protein, 9 aa, Homo Sapiens
KLGNLQPYS

SEQ ID NO: 626441 - protein, 9 aa, Homo Sapiens
PVERKHRSI

SEQ ID NO: 626442 - protein, 9 aa, Homo Sapiens
QSFNKVAEH

SEQ ID NO: 626443 - protein, 9 aa, Homo Sapiens
RRRQPPYHP

SEQ ID NO: 626444 - protein, 9 aa, Homo Sapiens
LEKPDCGRF

SEQ ID NO: 626445 - protein, 9 aa, Homo Sapiens
KAKALWAKV

SEQ ID NO: 626446 - protein, 9 aa, Homo Sapiens
LAKHVCNDC

SEQ ID NO: 626447 - protein, 9 aa, Homo Sapiens
CKFLGRFPN

SEQ ID NO: 626448 - protein, 9 aa, Homo Sapiens
PEARRLIVS

SEQ ID NO: 626449 - protein, 9 aa, Homo Sapiens
GPAAPAAGS

SEQ ID NO: 626450 - protein, 9 aa, Homo Sapiens
IYHHRDVRL

SEQ ID NO: 626451 - protein, 9 aa, Homo Sapiens
PNKGCIWTI

SEQ ID NO: 626452 - protein, 9 aa, Homo Sapiens
SGKIYHHRD

SEQ ID NO: 626453 - protein, 9 aa, Homo Sapiens
WGIEEVAEE

SEQ ID NO: 626454 - protein, 9 aa, Homo Sapiens
RAERVGACR

SEQ ID NO: 626455 - protein, 9 aa, Homo Sapiens
LQPYSDPSV

SEQ ID NO: 626456 - protein, 9 aa, Homo Sapiens
RGEVCVANI

SEQ ID NO: 626457 - protein, 9 aa, Homo Sapiens
LSVPKVKID

SEQ ID NO: 626458 - protein, 9 aa, Homo Sapiens
SIIAEDKNS

SEQ ID NO: 626459 - protein, 9 aa, Homo Sapiens
LLYSEVATV

SEQ ID NO: 626460 - protein, 9 aa, Homo Sapiens
VANIRNVLD

SEQ ID NO: 626461 - protein, 9 aa, Homo Sapiens
AERVGACRL

SEQ ID NO: 626462 - protein, 9 aa, Homo Sapiens
SGKTCVHLA

SEQ ID NO: 626463 - protein, 9 aa, Homo Sapiens
QIYINPVTW

SEQ ID NO: 626464 - protein, 9 aa, Homo Sapiens
LKTLPARSD

SEQ ID NO: 626465 - protein, 9 aa, Homo Sapiens
EVCVANIRN

SEQ ID NO: 626466 - protein, 9 aa, Homo Sapiens
LKPTLAELK

SEQ ID NO: 626467 - protein, 9 aa, Homo Sapiens
EEVMWVRRE

SEQ ID NO: 626468 - protein, 9 aa, Homo Sapiens
PARSDPVSA

SEQ ID NO: 626469 - protein, 9 aa, Homo Sapiens
EMCHFVSLE

SEQ ID NO: 626470 - protein, 9 aa, Homo Sapiens
KAGGEFLLL

SEQ ID NO: 626471 - protein, 9 aa, Homo Sapiens
SASEEVMWV

SEQ ID NO: 626472 - protein, 9 aa, Homo Sapiens
LRGRDGPAA

SEQ ID NO: 626473 - protein, 9 aa, Homo Sapiens
AGGEFLLLY

SEQ ID NO: 626474 - protein, 9 aa, Homo Sapiens
LPCSLDPAT

SEQ ID NO: 626475 - protein, 9 aa, Homo Sapiens
SEAALKPTL

SEQ ID NO: 626476 - protein, 9 aa, Homo Sapiens
LLLTNPVPG

SEQ ID NO: 626477 - protein, 9 aa, Homo Sapiens
SAPPPPPDR

SEQ ID NO: 626478 - protein, 9 aa, Homo Sapiens
LYECLKLTG

SEQ ID NO: 626479 - protein, 9 aa, Homo Sapiens
RMFPSYKVN

SEQ ID NO: 626480 - protein, 9 aa, Homo Sapiens
GCIWTITVP

SEQ ID NO: 626481 - protein, 9 aa, Homo Sapiens
LFETINKDQ

SEQ ID NO: 626482 - protein, 9 aa, Homo Sapiens
LGNSGEPQL

SEQ ID NO: 626483 - protein, 9 aa, Homo Sapiens
RCLRFLLMG

SEQ ID NO: 626484 - protein, 9 aa, Homo Sapiens
RGGCALSRF

SEQ ID NO: 626485 - protein, 9 aa, Homo Sapiens
VMFLVTYLV

SEQ ID NO: 626486 - protein, 9 aa, Homo Sapiens
MACRCLRFL

SEQ ID NO: 626487 - protein, 9 aa, Homo Sapiens
PPNKGCIWT

SEQ ID NO: 626488 - protein, 9 aa, Homo Sapiens
LFCTHWTYL

SEQ ID NO: 626489 - protein, 9 aa, Homo Sapiens
LFVMFLVTY

SEQ ID NO: 626490 - protein, 9 aa, Homo Sapiens
TRRALPEPG

SEQ ID NO: 626491 - protein, 9 aa, Homo Sapiens
EPARHHRTH

SEQ ID NO: 626492 - protein, 9 aa, Homo Sapiens
PEWVKCCKQ

SEQ ID NO: 626493 - protein, 9 aa, Homo Sapiens
KTCVHLAAA

SEQ ID NO: 626494 - protein, 9 aa, Homo Sapiens
VKCCKQLFG

SEQ ID NO: 626495 - protein, 9 aa, Homo Sapiens
HVQGRIVRD

SEQ ID NO: 626496 - protein, 9 aa, Homo Sapiens
QEYTNNIAK

SEQ ID NO: 626497 - protein, 9 aa, Homo Sapiens
SFNWERHVS

SEQ ID NO: 626498 - protein, 9 aa, Homo Sapiens
YHPPPLARA

SEQ ID NO: 626499 - protein, 9 aa, Homo Sapiens
NSFNWERHV

SEQ ID NO: 626500 - protein, 9 aa, Homo Sapiens
QASNIQLSI

SEQ ID NO: 626501 - protein, 9 aa, Homo Sapiens
ESGQIYINP

SEQ ID NO: 626502 - protein, 9 aa, Homo Sapiens
PGPNVGITN

SEQ ID NO: 626503 - protein, 9 aa, Homo Sapiens
PLALTNRRA

SEQ ID NO: 626504 - protein, 9 aa, Homo Sapiens
GPNVGITNF

SEQ ID NO: 626505 - protein, 9 aa, Homo Sapiens
CRLTGIARM

SEQ ID NO: 626506 - protein, 9 aa, Homo Sapiens
PHDLVTELD

SEQ ID NO: 626507 - protein, 9 aa, Homo Sapiens
LVVDEMGFM

SEQ ID NO: 626508 - protein, 9 aa, Homo Sapiens
NKVAEHVLM

SEQ ID NO: 626509 - protein, 9 aa, Homo Sapiens
WRNVLVAGT

SEQ ID NO: 626510 - protein, 9 aa, Homo Sapiens
SVEKAQKAL

SEQ ID NO: 626511 - protein, 9 aa, Homo Sapiens
RCKFLGRFP

SEQ ID NO: 626512 - protein, 9 aa, Homo Sapiens
VDRVLCSFT

SEQ ID NO: 626513 - protein, 9 aa, Homo Sapiens
ANEEYQILS

SEQ ID NO: 626514 - protein, 9 aa, Homo Sapiens
QLGGFDWRL

SEQ ID NO: 626515 - protein, 9 aa, Homo Sapiens
NEHYFGFVN

SEQ ID NO: 626516 - protein, 9 aa, Homo Sapiens
TALEKVTKP

SEQ ID NO: 626517 - protein, 9 aa, Homo Sapiens
AYCGWCALG

SEQ ID NO: 626518 - protein, 9 aa, Homo Sapiens
VSIIAEDKN

SEQ ID NO: 626519 - protein, 9 aa, Homo Sapiens
AKHVCNDCP

SEQ ID NO: 626520 - protein, 9 aa, Homo Sapiens
EDCLAPLCP

SEQ ID NO: 626521 - protein, 9 aa, Homo Sapiens
EMYTIKWSP

SEQ ID NO: 626522 - protein, 9 aa, Homo Sapiens
VACLPDVVR

SEQ ID NO: 626523 - protein, 9 aa, Homo Sapiens
GDINLLAKH

SEQ ID NO: 626524 - protein, 9 aa, Homo Sapiens
GCALSRFLP

SEQ ID NO: 626525 - protein, 9 aa, Homo Sapiens
LQAHNKEMY

SEQ ID NO: 626526 - protein, 9 aa, Homo Sapiens
SGEPQLGGF

SEQ ID NO: 626527 - protein, 9 aa, Homo Sapiens
RNVYSDLKN

SEQ ID NO: 626528 - protein, 9 aa, Homo Sapiens
INPVTWLKD

SEQ ID NO: 626529 - protein, 9 aa, Homo Sapiens
VKLFCESLE

SEQ ID NO: 626530 - protein, 9 aa, Homo Sapiens
GERIEDCLA

SEQ ID NO: 626531 - protein, 9 aa, Homo Sapiens
ITLYYSDVD

SEQ ID NO: 626532 - protein, 9 aa, Homo Sapiens
AETLLALGG

SEQ ID NO: 626533 - protein, 9 aa, Homo Sapiens
YKQGNLYEC

SEQ ID NO: 626534 - protein, 9 aa, Homo Sapiens
VPLPKLFPR

SEQ ID NO: 626535 - protein, 9 aa, Homo Sapiens
YPPNKGCIW

SEQ ID NO: 626536 - protein, 9 aa, Homo Sapiens
ITEKFWRNV

SEQ ID NO: 626537 - protein, 9 aa, Homo Sapiens
VPQPGTKSQ

SEQ ID NO: 626538 - protein, 9 aa, Homo Sapiens
FSEPLSNLH

SEQ ID NO: 626539 - protein, 9 aa, Homo Sapiens
SAAPGPAAP

SEQ ID NO: 626540 - protein, 9 aa, Homo Sapiens
FDDEDEENN

SEQ ID NO: 626541 - protein, 9 aa, Homo Sapiens
EKLCKADLS

SEQ ID NO: 626542 - protein, 9 aa, Homo Sapiens
GTRCTLQQD

SEQ ID NO: 626543 - protein, 9 aa, Homo Sapiens
RSDEPARHH

SEQ ID NO: 626544 - protein, 9 aa, Homo Sapiens
ARCKFLGRF

SEQ ID NO: 626545 - protein, 9 aa, Homo Sapiens
SNSWRYSSA

SEQ ID NO: 626546 - protein, 9 aa, Homo Sapiens
TRPKRNAMA

SEQ ID NO: 626547 - protein, 9 aa, Homo Sapiens
PAAPAAGSA

SEQ ID NO: 626548 - protein, 9 aa, Homo Sapiens
VSKNAGETL

SEQ ID NO: 626549 - protein, 9 aa, Homo Sapiens
SYSEDVCRC

SEQ ID NO: 626550 - protein, 9 aa, Homo Sapiens
EADSSPFVE

SEQ ID NO: 626551 - protein, 9 aa, Homo Sapiens
ACLPDVVRQ

SEQ ID NO: 626552 - protein, 9 aa, Homo Sapiens
PPTIPPAGL

SEQ ID NO: 626553 - protein, 9 aa, Homo Sapiens
RKVSVTLKD

SEQ ID NO: 626554 - protein, 9 aa, Homo Sapiens
CHPSEAALK

SEQ ID NO: 626555 - protein, 9 aa, Homo Sapiens
KRVIWGIEE

SEQ ID NO: 626556 - protein, 9 aa, Homo Sapiens
LKDIFTGEE

SEQ ID NO: 626557 - protein, 9 aa, Homo Sapiens
KALFVMFLV

SEQ ID NO: 626558 - protein, 9 aa, Homo Sapiens
QPYSDPSVV

SEQ ID NO: 626559 - protein, 9 aa, Homo Sapiens
IDPLLYSEV

SEQ ID NO: 626560 - protein, 9 aa, Homo Sapiens
VGITNFDNI

SEQ ID NO: 626561 - protein, 9 aa, Homo Sapiens
AVSAAPGPA

SEQ ID NO: 626562 - protein, 9 aa, Homo Sapiens
GKTAVLGSS

SEQ ID NO: 626563 - protein, 9 aa, Homo Sapiens
GGKPWHKIC

SEQ ID NO: 626564 - protein, 9 aa, Homo Sapiens
KCLKTLPAR

SEQ ID NO: 626565 - protein, 9 aa, Homo Sapiens
HVSHAKEKL

SEQ ID NO: 626566 - protein, 9 aa, Homo Sapiens
HDLVTELDE

SEQ ID NO: 626567 - protein, 9 aa, Homo Sapiens
AIQGLASHL

SEQ ID NO: 626568 - protein, 9 aa, Homo Sapiens
TNRRAQGSG

SEQ ID NO: 626569 - protein, 9 aa, Homo Sapiens
LVTELDEIC

SEQ ID NO: 626570 - protein, 9 aa, Homo Sapiens
EVMWVRRED

SEQ ID NO: 626571 - protein, 9 aa, Homo Sapiens
LVIVDHVKF

SEQ ID NO: 626572 - protein, 9 aa, Homo Sapiens
TLPARSDPV

SEQ ID NO: 626573 - protein, 9 aa, Homo Sapiens
RDGPAAWRV

SEQ ID NO: 626574 - protein, 9 aa, Homo Sapiens
SKNAGETLL

SEQ ID NO: 626575 - protein, 9 aa, Homo Sapiens
PGTKSQEAS

SEQ ID NO: 626576 - protein, 9 aa, Homo Sapiens
RQPTSLGSS

SEQ ID NO: 626577 - protein, 9 aa, Homo Sapiens
LRQLLLTNP

SEQ ID NO: 626578 - protein, 9 aa, Homo Sapiens
LRPLRAITR

SEQ ID NO: 626579 - protein, 9 aa, Homo Sapiens
ILKRNVYSD

SEQ ID NO: 626580 - protein, 9 aa, Homo Sapiens
KAQKALTER

SEQ ID NO: 626581 - protein, 9 aa, Homo Sapiens
PVSPPPVER

SEQ ID NO: 626582 - protein, 9 aa, Homo Sapiens
VVDEMGFMK

SEQ ID NO: 626583 - protein, 9 aa, Homo Sapiens
SSRTAAVEL

SEQ ID NO: 626584 - protein, 9 aa, Homo Sapiens
IVRDLTIPG

SEQ ID NO: 626585 - protein, 9 aa, Homo Sapiens
ELRHLKSVQ

SEQ ID NO: 626586 - protein, 9 aa, Homo Sapiens
ANIRNVLDE

SEQ ID NO: 626587 - protein, 9 aa, Homo Sapiens
FLLLYARVA

SEQ ID NO: 626588 - protein, 9 aa, Homo Sapiens
VDLSLLRSS

SEQ ID NO: 626589 - protein, 9 aa, Homo Sapiens
RQLLLTNPV

SEQ ID NO: 626590 - protein, 9 aa, Homo Sapiens
PPYHPPPLA

SEQ ID NO: 626591 - protein, 9 aa, Homo Sapiens
FKVLYRTFG

SEQ ID NO: 626592 - protein, 9 aa, Homo Sapiens
RCCFSEPLS

SEQ ID NO: 626593 - protein, 9 aa, Homo Sapiens
RLVVDEMGF

SEQ ID NO: 626594 - protein, 9 aa, Homo Sapiens
WVKCCKQLF

SEQ ID NO: 626595 - protein, 9 aa, Homo Sapiens
LMPFNLFCT

SEQ ID NO: 626596 - protein, 9 aa, Homo Sapiens
TVTKRVLPC

SEQ ID NO: 626597 - protein, 9 aa, Homo Sapiens
IQGLASHLP

SEQ ID NO: 626598 - protein, 9 aa, Homo Sapiens
CGCWNAETL

SEQ ID NO: 626599 - protein, 9 aa, Homo Sapiens
KPWHKICFR

SEQ ID NO: 626600 - protein, 9 aa, Homo Sapiens
LCKADLSRN

SEQ ID NO: 626601 - protein, 9 aa, Homo Sapiens
FNLFCTHWT

SEQ ID NO: 626602 - protein, 9 aa, Homo Sapiens
APCGGVKQS

SEQ ID NO: 626603 - protein, 9 aa, Homo Sapiens
EDITLYYSD

SEQ ID NO: 626604 - protein, 9 aa, Homo Sapiens
RVLPCSLDP

SEQ ID NO: 626605 - protein, 9 aa, Homo Sapiens
IINHELKRH

SEQ ID NO: 626606 - protein, 9 aa, Homo Sapiens
QRHQYKRQL

SEQ ID NO: 626607 - protein, 9 aa, Homo Sapiens
NRRAQGSGC

SEQ ID NO: 626608 - protein, 9 aa, Homo Sapiens
LCMNIINHE

SEQ ID NO: 626609 - protein, 9 aa, Homo Sapiens
LGNLQPYSD

SEQ ID NO: 626610 - protein, 9 aa, Homo Sapiens
ARSDPVSAV

SEQ ID NO: 626611 - protein, 9 aa, Homo Sapiens
LGSSPQRCG

SEQ ID NO: 626612 - protein, 9 aa, Homo Sapiens
VRTVTKRVL

SEQ ID NO: 626613 - protein, 9 aa, Homo Sapiens
SGKTAVLGS

SEQ ID NO: 626614 - protein, 9 aa, Homo Sapiens
VESGQIYIN

SEQ ID NO: 626615 - protein, 9 aa, Homo Sapiens
GPLVIVDHV

SEQ ID NO: 626616 - protein, 9 aa, Homo Sapiens
LEDITLYYS

SEQ ID NO: 626617 - protein, 9 aa, Homo Sapiens
PQRCGSPPS

SEQ ID NO: 626618 - protein, 9 aa, Homo Sapiens
VSAAPGPAA

SEQ ID NO: 626619 - protein, 9 aa, Homo Sapiens
DEDEENNLF

SEQ ID NO: 626620 - protein, 9 aa, Homo Sapiens
MADRAPRQP

SEQ ID NO: 626621 - protein, 9 aa, Homo Sapiens
EKFWRNVLV

SEQ ID NO: 626622 - protein, 9 aa, Homo Sapiens
TINDSVTLN

SEQ ID NO: 626623 - protein, 9 aa, Homo Sapiens
MPHLVCLAD

SEQ ID NO: 626624 - protein, 9 aa, Homo Sapiens
LYRTFGPYF

SEQ ID NO: 626625 - protein, 9 aa, Homo Sapiens
EDEENNLFG

SEQ ID NO: 626626 - protein, 9 aa, Homo Sapiens
PRQPTSLGS

SEQ ID NO: 626627 - protein, 9 aa, Homo Sapiens
ERHVSHAKE

SEQ ID NO: 626628 - protein, 9 aa, Homo Sapiens
DLQAHNKEM

SEQ ID NO: 626629 - protein, 9 aa, Homo Sapiens
LNSFNWERH

SEQ ID NO: 626630 - protein, 9 aa, Homo Sapiens
QAHNKEMYT

SEQ ID NO: 626631 - protein, 9 aa, Homo Sapiens
IVPLPKLFP

SEQ ID NO: 626632 - protein, 9 aa, Homo Sapiens
EPGFSYSED

SEQ ID NO: 626633 - protein, 9 aa, Homo Sapiens
VGGRGGCAL

SEQ ID NO: 626634 - protein, 9 aa, Homo Sapiens
MEHVQGRIV

SEQ ID NO: 626635 - protein, 9 aa, Homo Sapiens
TGIARMADR

SEQ ID NO: 626636 - protein, 9 aa, Homo Sapiens
EHYFGFVNF

SEQ ID NO: 626637 - protein, 9 aa, Homo Sapiens
TTPEWVKCC

SEQ ID NO: 626638 - protein, 9 aa, Homo Sapiens
YINPVTWLK

SEQ ID NO: 626639 - protein, 9 aa, Homo Sapiens
RTFGPYFLM

SEQ ID NO: 626640 - protein, 9 aa, Homo Sapiens
FSLFETINK

SEQ ID NO: 626641 - protein, 9 aa, Homo Sapiens
SVPKVKIDE

SEQ ID NO: 626642 - protein, 9 aa, Homo Sapiens
SSPQRCGSP

SEQ ID NO: 626643 - protein, 9 aa, Homo Sapiens
RHVEKLCKA

SEQ ID NO: 626644 - protein, 9 aa, Homo Sapiens
RCGSPPSAP

SEQ ID NO: 626645 - protein, 9 aa, Homo Sapiens
KVNVTGMNP

SEQ ID NO: 626646 - protein, 9 aa, Homo Sapiens
PPLARAPPT

SEQ ID NO: 626647 - protein, 9 aa, Homo Sapiens
EYTNNIAKL

SEQ ID NO: 626648 - protein, 9 aa, Homo Sapiens
AQKALTERQ

SEQ ID NO: 626649 - protein, 9 aa, Homo Sapiens
RRAQGSGCQ

SEQ ID NO: 626650 - protein, 9 aa, Homo Sapiens
RNAMANRAA

SEQ ID NO: 626651 - protein, 9 aa, Homo Sapiens
KVLNVDGAY

SEQ ID NO: 626652 - protein, 9 aa, Homo Sapiens
ITRVPSMRI

SEQ ID NO: 626653 - protein, 9 aa, Homo Sapiens
GCWNAETLL

SEQ ID NO: 626654 - protein, 9 aa, Homo Sapiens
VVGGRGGCA

SEQ ID NO: 626655 - protein, 9 aa, Homo Sapiens
FFLPNTSIH

SEQ ID NO: 626656 - protein, 9 aa, Homo Sapiens
FCTHWTYLL

SEQ ID NO: 626657 - protein, 9 aa, Homo Sapiens
PSYKVNVTG

SEQ ID NO: 626658 - protein, 9 aa, Homo Sapiens
ACRCLRFLL

SEQ ID NO: 626659 - protein, 9 aa, Homo Sapiens
NKGCIWTIT

SEQ ID NO: 626660 - protein, 9 aa, Homo Sapiens
ARRLIVSKN

SEQ ID NO: 626661 - protein, 9 aa, Homo Sapiens
RDLLPGIVP

SEQ ID NO: 626662 - protein, 9 aa, Homo Sapiens
PVGKVLNVD

SEQ ID NO: 626663 - protein, 9 aa, Homo Sapiens
GALCMNIIN

SEQ ID NO: 626664 - protein, 9 aa, Homo Sapiens
ENNLFGGTA

SEQ ID NO: 626665 - protein, 9 aa, Homo Sapiens
SVTLKDIFT

SEQ ID NO: 626666 - protein, 9 aa, Homo Sapiens
RKEADSSPF

SEQ ID NO: 626667 - protein, 9 aa, Homo Sapiens
PCKISSTRC

SEQ ID NO: 626668 - protein, 9 aa, Homo Sapiens
LLLYARVAP

SEQ ID NO: 626669 - protein, 9 aa, Homo Sapiens
FNKVAEHVL

SEQ ID NO: 626670 - protein, 9 aa, Homo Sapiens
RDRERYWRE

SEQ ID NO: 626671 - protein, 9 aa, Homo Sapiens
ERKGRAERV

SEQ ID NO: 626672 - protein, 9 aa, Homo Sapiens
RPLDVLSGH

SEQ ID NO: 626673 - protein, 9 aa, Homo Sapiens
FGFVNFGNT

SEQ ID NO: 626674 - protein, 9 aa, Homo Sapiens
RLARAIQGL

SEQ ID NO: 626675 - protein, 9 aa, Homo Sapiens
VCMRHVEKL

SEQ ID NO: 626676 - protein, 9 aa, Homo Sapiens
AAPGPAAPA

SEQ ID NO: 626677 - protein, 9 aa, Homo Sapiens
KESVSFTDV

SEQ ID NO: 626678 - protein, 9 aa, Homo Sapiens
LKSHEQEYT

SEQ ID NO: 626679 - protein, 9 aa, Homo Sapiens
CFSEPLSNL

SEQ ID NO: 626680 - protein, 9 aa, Homo Sapiens
IAEDKNSYT

SEQ ID NO: 626681 - protein, 9 aa, Homo Sapiens
RLTGIARMA

SEQ ID NO: 626682 - protein, 9 aa, Homo Sapiens
SKESVSFTD

SEQ ID NO: 626683 - protein, 9 aa, Homo Sapiens
CKISSTRCE

SEQ ID NO: 626684 - protein, 9 aa, Homo Sapiens
LPVDLSLLR

SEQ ID NO: 626685 - protein, 9 aa, Homo Sapiens
INLLAKHVC

SEQ ID NO: 626686 - protein, 9 aa, Homo Sapiens
VELVAGGVC

SEQ ID NO: 626687 - protein, 9 aa, Homo Sapiens
RLQGQERKG

SEQ ID NO: 626688 - protein, 9 aa, Homo Sapiens
LELSVPKVK

SEQ ID NO: 626689 - protein, 9 aa, Homo Sapiens
ILSNSWRYS

SEQ ID NO: 626690 - protein, 9 aa, Homo Sapiens
IARMADRAP

SEQ ID NO: 626691 - protein, 9 aa, Homo Sapiens
YQILSNSWR

SEQ ID NO: 626692 - protein, 9 aa, Homo Sapiens
EPQLGGFDW

SEQ ID NO: 626693 - protein, 9 aa, Homo Sapiens
SRFLPVDLS

SEQ ID NO: 626694 - protein, 9 aa, Homo Sapiens
PARHHRTHT

SEQ ID NO: 626695 - protein, 9 aa, Homo Sapiens
EDRAKAKES

SEQ ID NO: 626696 - protein, 9 aa, Homo Sapiens
SSKSGKIYH

SEQ ID NO: 626697 - protein, 9 aa, Homo Sapiens
DINLLAKHV

SEQ ID NO: 626698 - protein, 9 aa, Homo Sapiens
PKRNAMANR

SEQ ID NO: 626699 - protein, 9 aa, Homo Sapiens
IIAEDKNSY

SEQ ID NO: 626700 - protein, 9 aa, Homo Sapiens
AKALWAKVD

SEQ ID NO: 626701 - protein, 9 aa, Homo Sapiens
TINKDQVLT

SEQ ID NO: 626702 - protein, 9 aa, Homo Sapiens
GTKSQEASP

SEQ ID NO: 626703 - protein, 9 aa, Homo Sapiens
TNPVPGRTL

SEQ ID NO: 626704 - protein, 9 aa, Homo Sapiens
RAKAKESLK

SEQ ID NO: 626705 - protein, 9 aa, Homo Sapiens
VDTRPKRNA

SEQ ID NO: 626706 - protein, 9 aa, Homo Sapiens
YQAVMPHLV

SEQ ID NO: 626707 - protein, 9 aa, Homo Sapiens
RQPPYHPPP

SEQ ID NO: 626708 - protein, 9 aa, Homo Sapiens
PDRGERIED

SEQ ID NO: 626709 - protein, 9 aa, Homo Sapiens
CEEARCKFL

SEQ ID NO: 626710 - protein, 9 aa, Homo Sapiens
QITALEKVT

SEQ ID NO: 626711 - protein, 9 aa, Homo Sapiens
RYASVEKAQ

SEQ ID NO: 626712 - protein, 9 aa, Homo Sapiens
ELVAGGVCR

SEQ ID NO: 626713 - protein, 9 aa, Homo Sapiens
CLAPLCPPV

SEQ ID NO: 626714 - protein, 9 aa, Homo Sapiens
FLPVDLSLL

SEQ ID NO: 626715 - protein, 9 aa, Homo Sapiens
GKIYHHRDV

SEQ ID NO: 626716 - protein, 9 aa, Homo Sapiens
EEYQILSNS

SEQ ID NO: 626717 - protein, 9 aa, Homo Sapiens
EDVCRCVPS

SEQ ID NO: 626718 - protein, 9 aa, Homo Sapiens
LKRNVYSDL

SEQ ID NO: 626719 - protein, 9 aa, Homo Sapiens
VKIDEFYVG

SEQ ID NO: 626720 - protein, 9 aa, Homo Sapiens
GKVLNVDGA

SEQ ID NO: 626721 - protein, 9 aa, Homo Sapiens
GIVPLPKLF

SEQ ID NO: 626722 - protein, 9 aa, Homo Sapiens
LNVDGAYVA

SEQ ID NO: 626723 - protein, 9 aa, Homo Sapiens
SCELRHLKS

SEQ ID NO: 626724 - protein, 9 aa, Homo Sapiens
PPVVGGRGG

SEQ ID NO: 626725 - protein, 9 aa, Homo Sapiens
VNGPLVIVD

SEQ ID NO: 626726 - protein, 9 aa, Homo Sapiens
VMPHLVCLA

SEQ ID NO: 626727 - protein, 9 aa, Homo Sapiens
QEVKLFCES

SEQ ID NO: 626728 - protein, 9 aa, Homo Sapiens
ITALEKVTK

SEQ ID NO: 626729 - protein, 9 aa, Homo Sapiens
RKGRAERVG

SEQ ID NO: 626730 - protein, 9 aa, Homo Sapiens
LGTRCTLQQ

SEQ ID NO: 626731 - protein, 9 aa, Homo Sapiens
SEDVCRCVP

SEQ ID NO: 626732 - protein, 9 aa, Homo Sapiens
NHELKRHEL

SEQ ID NO: 626733 - protein, 9 aa, Homo Sapiens
PPAGLFHSC

SEQ ID NO: 626734 - protein, 9 aa, Homo Sapiens
LLYARVAPP

SEQ ID NO: 626735 - protein, 9 aa, Homo Sapiens
TLIVSIIAE

SEQ ID NO: 626736 - protein, 9 aa, Homo Sapiens
ISSTRCETD

SEQ ID NO: 626737 - protein, 9 aa, Homo Sapiens
NLYECLKLT

SEQ ID NO: 626738 - protein, 9 aa, Homo Sapiens
NWRLARAIQ

SEQ ID NO: 626739 - protein, 9 aa, Homo Sapiens
LLTNPVPGR

SEQ ID NO: 626740 - protein, 9 aa, Homo Sapiens
TPEWVKCCK

SEQ ID NO: 626741 - protein, 9 aa, Homo Sapiens
NLFCTHWTY

SEQ ID NO: 626742 - protein, 9 aa, Homo Sapiens
LVEVPMEMC

SEQ ID NO: 626743 - protein, 9 aa, Homo Sapiens
KPTLAELKE

SEQ ID NO: 626744 - protein, 9 aa, Homo Sapiens
QSAEASGKP

SEQ ID NO: 626745 - protein, 9 aa, Homo Sapiens
LFCESLEAQ

SEQ ID NO: 626746 - protein, 9 aa, Homo Sapiens
PRMLRGRDG

SEQ ID NO: 626747 - protein, 9 aa, Homo Sapiens
EIVRLVVDE

SEQ ID NO: 626748 - protein, 9 aa, Homo Sapiens
LLGLEKPDC

SEQ ID NO: 626749 - protein, 9 aa, Homo Sapiens
VEKLCKADL

SEQ ID NO: 626750 - protein, 9 aa, Homo Sapiens
RFLPVDLSL

SEQ ID NO: 626751 - protein, 9 aa, Homo Sapiens
TKRVLPCSL

SEQ ID NO: 626752 - protein, 9 aa, Homo Sapiens
FHSCRLQGQ

SEQ ID NO: 626753 - protein, 9 aa, Homo Sapiens
PSAPPPPPD

SEQ ID NO: 626754 - protein, 9 aa, Homo Sapiens
LDDRDRERY

SEQ ID NO: 626755 - protein, 9 aa, Homo Sapiens
HPSEAALKP

SEQ ID NO: 626756 - protein, 9 aa, Homo Sapiens
EMEQSAEAS

SEQ ID NO: 626757 - protein, 9 aa, Homo Sapiens
YHHRDVRLL

SEQ ID NO: 626758 - protein, 9 aa, Homo Sapiens
GEFLLLYAR

SEQ ID NO: 626759 - protein, 9 aa, Homo Sapiens
FTDVAVDFT

SEQ ID NO: 626760 - protein, 9 aa, Homo Sapiens
FETINKDQV

SEQ ID NO: 626761 - protein, 9 aa, Homo Sapiens
VTKRVLPCS

SEQ ID NO: 626762 - protein, 9 aa, Homo Sapiens
LYSEVATVI

SEQ ID NO: 626763 - protein, 9 aa, Homo Sapiens
AEEDETASE

SEQ ID NO: 626764 - protein, 9 aa, Homo Sapiens
LYARVAPPG

SEQ ID NO: 626765 - protein, 9 aa, Homo Sapiens
VYSDLKNLD

SEQ ID NO: 626766 - protein, 9 aa, Homo Sapiens
EFLLLYARV

SEQ ID NO: 626767 - protein, 9 aa, Homo Sapiens
LAAAAGFSD

SEQ ID NO: 626768 - protein, 9 aa, Homo Sapiens
GKPWHKICF

SEQ ID NO: 626769 - protein, 9 aa, Homo Sapiens
PPVERKHRS

SEQ ID NO: 626770 - protein, 9 aa, Homo Sapiens
SNIQLSIGV

SEQ ID NO: 626771 - protein, 9 aa, Homo Sapiens
VNEHYFGFV

SEQ ID NO: 626772 - protein, 9 aa, Homo Sapiens
PGIVPLPKL

SEQ ID NO: 626773 - protein, 9 aa, Homo Sapiens
GFSVLFFLP

SEQ ID NO: 626774 - protein, 9 aa, Homo Sapiens
VILKLGNLQ

SEQ ID NO: 626775 - protein, 9 aa, Homo Sapiens
RLIVSKNAG

SEQ ID NO: 626776 - protein, 9 aa, Homo Sapiens
GGCALSRFL

SEQ ID NO: 626777 - protein, 9 aa, Homo Sapiens
VRDLTIPGL

SEQ ID NO: 626778 - protein, 9 aa, Homo Sapiens
ERIEDCLAP

SEQ ID NO: 626779 - protein, 9 aa, Homo Sapiens
VLFFDLRGP

SEQ ID NO: 626780 - protein, 9 aa, Homo Sapiens
RHVSHAKEK

SEQ ID NO: 626781 - protein, 9 aa, Homo Sapiens
LARAIQGLA

SEQ ID NO: 626782 - protein, 9 aa, Homo Sapiens
QILSNSWRY

SEQ ID NO: 626783 - protein, 9 aa, Homo Sapiens
GEVCVANIR

SEQ ID NO: 626784 - protein, 9 aa, Homo Sapiens
KICFRCAIC

SEQ ID NO: 626785 - protein, 9 aa, Homo Sapiens
LSRFLPVDL

SEQ ID NO: 626786 - protein, 9 aa, Homo Sapiens
APLCPPVVG

SEQ ID NO: 626787 - protein, 9 aa, Homo Sapiens
LEKVTKPFF

SEQ ID NO: 626788 - protein, 9 aa, Homo Sapiens
GIARMADRA

SEQ ID NO: 626789 - protein, 9 aa, Homo Sapiens
VSPPPVERK

SEQ ID NO: 626790 - protein, 9 aa, Homo Sapiens
KDLFQQRHQ

SEQ ID NO: 626791 - protein, 9 aa, Homo Sapiens
VAAPCGGVK

SEQ ID NO: 626792 - protein, 9 aa, Homo Sapiens
KKFARSDEP

SEQ ID NO: 626793 - protein, 9 aa, Homo Sapiens
RTAAVELVA

SEQ ID NO: 626794 - protein, 9 aa, Homo Sapiens
VLPCSLDPA

SEQ ID NO: 626795 - protein, 9 aa, Homo Sapiens
VVRQELFFK

SEQ ID NO: 626796 - protein, 9 aa, Homo Sapiens
GLFHSCRLQ

SEQ ID NO: 626797 - protein, 9 aa, Homo Sapiens
SKMDGTHKM

SEQ ID NO: 626798 - protein, 9 aa, Homo Sapiens
TDVAVDFTQ

SEQ ID NO: 626799 - protein, 9 aa, Homo Sapiens
YCGWCALGT

SEQ ID NO: 626800 - protein, 9 aa, Homo Sapiens
RMADRAPRQ

SEQ ID NO: 626801 - protein, 9 aa, Homo Sapiens
QPTSLGSSP

SEQ ID NO: 626802 - protein, 9 aa, Homo Sapiens
HLVCLADEF

SEQ ID NO: 626803 - protein, 9 aa, Homo Sapiens
DSCELRHLK

SEQ ID NO: 626804 - protein, 9 aa, Homo Sapiens
LKLGNLQPY

SEQ ID NO: 626805 - protein, 9 aa, Homo Sapiens
SSTRCETDV

SEQ ID NO: 626806 - protein, 9 aa, Homo Sapiens
KTAVLGSSP

SEQ ID NO: 626807 - protein, 9 aa, Homo Sapiens
QAVMPHLVC

SEQ ID NO: 626808 - protein, 9 aa, Homo Sapiens
VLFFLPNTS

SEQ ID NO: 626809 - protein, 9 aa, Homo Sapiens
GNDSCELRH

SEQ ID NO: 626810 - protein, 9 aa, Homo Sapiens
CWNAETLLA

SEQ ID NO: 626811 - protein, 9 aa, Homo Sapiens
RALPEPGPE

SEQ ID NO: 626812 - protein, 9 aa, Homo Sapiens
DCLAPLCPP

SEQ ID NO: 626813 - protein, 9 aa, Homo Sapiens
GRAERVGAC

SEQ ID NO: 626814 - protein, 9 aa, Homo Sapiens
LESASEEVM

SEQ ID NO: 626815 - protein, 9 aa, Homo Sapiens
LSNSWRYSS

SEQ ID NO: 626816 - protein, 9 aa, Homo Sapiens
VDHVKFPRY

SEQ ID NO: 626817 - protein, 9 aa, Homo Sapiens
FNWERHVSH

SEQ ID NO: 626818 - protein, 9 aa, Homo Sapiens
TCGCWNAET

SEQ ID NO: 626819 - protein, 9 aa, Homo Sapiens
KFEIVRLVV

SEQ ID NO: 626820 - protein, 9 aa, Homo Sapiens
WRRMGASER

SEQ ID NO: 626821 - protein, 9 aa, Homo Sapiens
SFTINDSVT

SEQ ID NO: 626822 - protein, 9 aa, Homo Sapiens
AEASGKPNR

SEQ ID NO: 626823 - protein, 9 aa, Homo Sapiens
NLLAKHVCN

SEQ ID NO: 626824 - protein, 9 aa, Homo Sapiens
GASERGRLL

SEQ ID NO: 626825 - protein, 9 aa, Homo Sapiens
VWSMQTGRP

SEQ ID NO: 626826 - protein, 9 aa, Homo Sapiens
DEENNLFGG

SEQ ID NO: 626827 - protein, 9 aa, Homo Sapiens
GNLYECLKL

SEQ ID NO: 626828 - protein, 9 aa, Homo Sapiens
ESASEEVMW

SEQ ID NO: 626829 - protein, 9 aa, Homo Sapiens
WGFSVLFFL

SEQ ID NO: 626830 - protein, 9 aa, Homo Sapiens
IQITALEKV

SEQ ID NO: 626831 - protein, 9 aa, Homo Sapiens
KVSVTLKDI

SEQ ID NO: 626832 - protein, 9 aa, Homo Sapiens
DVAAPCGGV

SEQ ID NO: 626833 - protein, 9 aa, Homo Sapiens
CLKTLPARS

SEQ ID NO: 626834 - protein, 9 aa, Homo Sapiens
KCCKQLFGG

SEQ ID NO: 626835 - protein, 9 aa, Homo Sapiens
PSEAALKPT

SEQ ID NO: 626836 - protein, 9 aa, Homo Sapiens
CLPDVVRQE

SEQ ID NO: 626837 - protein, 9 aa, Homo Sapiens
NVGITNFDN

SEQ ID NO: 626838 - protein, 9 aa, Homo Sapiens
WCALGTRCT

SEQ ID NO: 626839 - protein, 9 aa, Homo Sapiens
ILKLGNLQP

SEQ ID NO: 626840 - protein, 9 aa, Homo Sapiens
RAPPTIPPA

SEQ ID NO: 626841 - protein, 9 aa, Homo Sapiens
LVCLADEFP

SEQ ID NO: 626842 - protein, 9 aa, Homo Sapiens
DLVTELDEI

SEQ ID NO: 626843 - protein, 9 aa, Homo Sapiens
TCVHLAAAA

SEQ ID NO: 626844 - protein, 9 aa, Homo Sapiens
VLNVDGAYV

SEQ ID NO: 626845 - protein, 9 aa, Homo Sapiens
KLQEVKLFC

SEQ ID NO: 626846 - protein, 9 aa, Homo Sapiens
VWRRMGASE

SEQ ID NO: 626847 - protein, 9 aa, Homo Sapiens
QPGTKSQEA

SEQ ID NO: 626848 - protein, 9 aa, Homo Sapiens
DDEDEENNL

SEQ ID NO: 626849 - protein, 9 aa, Homo Sapiens
ARAIQGLAS

SEQ ID NO: 626850 - protein, 9 aa, Homo Sapiens
DVVRQELFF

SEQ ID NO: 626851 - protein, 9 aa, Homo Sapiens
FSVLFFLPN

SEQ ID NO: 626852 - protein, 9 aa, Homo Sapiens
NWERHVSHA

SEQ ID NO: 626853 - protein, 9 aa, Homo Sapiens
FQQRHQYKR

SEQ ID NO: 626854 - protein, 9 aa, Homo Sapiens
VLCSFTIND

SEQ ID NO: 626855 - protein, 9 aa, Homo Sapiens
QERKGRAER

SEQ ID NO: 626856 - protein, 9 aa, Homo Sapiens
MLDYEQASN

SEQ ID NO: 626857 - protein, 9 aa, Homo Sapiens
EQSAEASGK

SEQ ID NO: 626858 - protein, 9 aa, Homo Sapiens
NVPVGKVLN

SEQ ID NO: 626859 - protein, 9 aa, Homo Sapiens
PWHKICFRC

SEQ ID NO: 626860 - protein, 9 aa, Homo Sapiens
RRMGASERG

SEQ ID NO: 626861 - protein, 9 aa, Homo Sapiens
KTLPARSDP

SEQ ID NO: 626862 - protein, 9 aa, Homo Sapiens
YECLKLTGW

SEQ ID NO: 626863 - protein, 9 aa, Homo Sapiens
SEPLSNLHS

SEQ ID NO: 626864 - protein, 9 aa, Homo Sapiens
GPRMLRGRD

SEQ ID NO: 626865 - protein, 9 aa, Homo Sapiens
KEADSSPFV

SEQ ID NO: 626866 - protein, 9 aa, Homo Sapiens
NKEMYTIKW

SEQ ID NO: 626867 - protein, 9 aa, Homo Sapiens
MFLVTYLVT

SEQ ID NO: 626868 - protein, 9 aa, Homo Sapiens
VATVISGWF

SEQ ID NO: 626869 - protein, 9 aa, Homo Sapiens
MQTGRPLDV

SEQ ID NO: 626870 - protein, 9 aa, Homo Sapiens
HLEDITLYY

SEQ ID NO: 626871 - protein, 9 aa, Homo Sapiens
GWCALGTRC

SEQ ID NO: 626872 - protein, 9 aa, Homo Sapiens
PSSLGFEDS

SEQ ID NO: 626873 - protein, 9 aa, Homo Sapiens
VPMEMCHFV

SEQ ID NO: 626874 - protein, 9 aa, Homo Sapiens
SVWRRMGAS

SEQ ID NO: 626875 - protein, 9 aa, Homo Sapiens
PPPVERKHR

SEQ ID NO: 626876 - protein, 9 aa, Homo Sapiens
SGQIYINPV

SEQ ID NO: 626877 - protein, 9 aa, Homo Sapiens
ASNIQLSIG

SEQ ID NO: 626878 - protein, 9 aa, Homo Sapiens
LQEVKLFCE

SEQ ID NO: 626879 - protein, 9 aa, Homo Sapiens
NVLVAGTVP

SEQ ID NO: 626880 - protein, 9 aa, Homo Sapiens
EEARCKFLG

SEQ ID NO: 626881 - protein, 9 aa, Homo Sapiens
PLVIVDHVK

SEQ ID NO: 626882 - protein, 9 aa, Homo Sapiens
YEQASNIQL

SEQ ID NO: 626883 - protein, 9 aa, Homo Sapiens
QLPRPSSLG

SEQ ID NO: 626884 - protein, 9 aa, Homo Sapiens
SVLFFLPNT

SEQ ID NO: 626885 - protein, 9 aa, Homo Sapiens
KFARSDEPA

SEQ ID NO: 626886 - protein, 9 aa, Homo Sapiens
AAPCGGVKQ

SEQ ID NO: 626887 - protein, 9 aa, Homo Sapiens
GNSGEPQLG

SEQ ID NO: 626888 - protein, 9 aa, Homo Sapiens
EYQILSNSW

SEQ ID NO: 626889 - protein, 9 aa, Homo Sapiens
HNKEMYTIK

SEQ ID NO: 626890 - protein, 9 aa, Homo Sapiens
EKAQKALTE

SEQ ID NO: 626891 - protein, 9 aa, Homo Sapiens
GSPPSAPPP

SEQ ID NO: 626892 - protein, 9 aa, Homo Sapiens
VCRSPSQEN

SEQ ID NO: 626893 - protein, 9 aa, Homo Sapiens
VHLAAAAGF

SEQ ID NO: 626894 - protein, 9 aa, Homo Sapiens
SRKEADSSP

SEQ ID NO: 626895 - protein, 9 aa, Homo Sapiens
VAGGVCRSP

SEQ ID NO: 626896 - protein, 9 aa, Homo Sapiens
DEPARHHRT

SEQ ID NO: 626897 - protein, 9 aa, Homo Sapiens
KALWAKVDK

SEQ ID NO: 626898 - protein, 9 aa, Homo Sapiens
MEMCHFVSL

SEQ ID NO: 626899 - protein, 9 aa, Homo Sapiens
KSESKMDGT

SEQ ID NO: 626900 - protein, 9 aa, Homo Sapiens
APPTIPPAG

SEQ ID NO: 626901 - protein, 9 aa, Homo Sapiens
DDRDRERYW

SEQ ID NO: 626902 - protein, 9 aa, Homo Sapiens
ELSVPKVKI

SEQ ID NO: 626903 - protein, 9 aa, Homo Sapiens
LTNRRAQGS

SEQ ID NO: 626904 - protein, 9 aa, Homo Sapiens
KVKIDEFYV

SEQ ID NO: 626905 - protein, 9 aa, Homo Sapiens
ALGTRCTLQ

SEQ ID NO: 626906 - protein, 9 aa, Homo Sapiens
VVDTRPKRN

SEQ ID NO: 626907 - protein, 9 aa, Homo Sapiens
IPHDLVTEL

SEQ ID NO: 626908 - protein, 9 aa, Homo Sapiens
LPRPSSLGF

SEQ ID NO: 626909 - protein, 9 aa, Homo Sapiens
EQEYTNNIA

SEQ ID NO: 626910 - protein, 9 aa, Homo Sapiens
VTSKDKPAV

SEQ ID NO: 626911 - protein, 9 aa, Homo Sapiens
MERERLDDR

SEQ ID NO: 626912 - protein, 9 aa, Homo Sapiens
LYSVPQPGT

SEQ ID NO: 626913 - protein, 9 aa, Homo Sapiens
EVKLFCESL

SEQ ID NO: 626914 - protein, 9 aa, Homo Sapiens
PLLYSEVAT

SEQ ID NO: 626915 - protein, 9 aa, Homo Sapiens
VNVTGMNPK

SEQ ID NO: 626916 - protein, 9 aa, Homo Sapiens
EEMEQSAEA

SEQ ID NO: 626917 - protein, 9 aa, Homo Sapiens
GLSNVLFFD

SEQ ID NO: 626918 - protein, 9 aa, Homo Sapiens
RRALPEPGP

SEQ ID NO: 626919 - protein, 9 aa, Homo Sapiens
TIPPAGLFH

SEQ ID NO: 626920 - protein, 9 aa, Homo Sapiens
LPEPGPESG

SEQ ID NO: 626921 - protein, 9 aa, Homo Sapiens
GVNGPLVIV

SEQ ID NO: 626922 - protein, 9 aa, Homo Sapiens
VRQELFFKL

SEQ ID NO: 626923 - protein, 9 aa, Homo Sapiens
RPLRAITRV

SEQ ID NO: 626924 - protein, 9 aa, Homo Sapiens
DLLPGIVPL

SEQ ID NO: 626925 - protein, 9 aa, Homo Sapiens
PCGGVKQSG

SEQ ID NO: 626926 - protein, 9 aa, Homo Sapiens
YASVEKAQK

SEQ ID NO: 626927 - protein, 9 aa, Homo Sapiens
CGWCALGTR

SEQ ID NO: 626928 - protein, 9 aa, Homo Sapiens
LRHLKSVQN

SEQ ID NO: 626929 - protein, 9 aa, Homo Sapiens
CVANIRNVL

SEQ ID NO: 626930 - protein, 9 aa, Homo Sapiens
TVQLPRPSS

SEQ ID NO: 626931 - protein, 9 aa, Homo Sapiens
GYNPEAEED

SEQ ID NO: 626932 - protein, 9 aa, Homo Sapiens
RSEDPSGKT

SEQ ID NO: 626933 - protein, 9 aa, Homo Sapiens
PQLGGFDWR

SEQ ID NO: 626934 - protein, 9 aa, Homo Sapiens
EDPSGKTAV

SEQ ID NO: 626935 - protein, 9 aa, Homo Sapiens
SAILKRNVY

SEQ ID NO: 626936 - protein, 9 aa, Homo Sapiens
MNIINHELK

SEQ ID NO: 626937 - protein, 9 aa, Homo Sapiens
LYYSDVDSF

SEQ ID NO: 626938 - protein, 9 aa, Homo Sapiens
IHLEDITLY

SEQ ID NO: 626939 - protein, 9 aa, Homo Sapiens
FTINDSVTL

SEQ ID NO: 626940 - protein, 9 aa, Homo Sapiens
RNVLVAGTV

SEQ ID NO: 626941 - protein, 9 aa, Homo Sapiens
QTGRPLDVL

SEQ ID NO: 626942 - protein, 9 aa, Homo Sapiens
FVNFGNTCY

SEQ ID NO: 626943 - protein, 9 aa, Homo Sapiens
LRAITRVPS

SEQ ID NO: 626944 - protein, 9 aa, Homo Sapiens
CESLEAQGS

SEQ ID NO: 626945 - protein, 9 aa, Homo Sapiens
TLLALGGED

SEQ ID NO: 626946 - protein, 9 aa, Homo Sapiens
VQGRIVRDL

SEQ ID NO: 626947 - protein, 9 aa, Homo Sapiens
IVRLVVDEM

SEQ ID NO: 626948 - protein, 9 aa, Homo Sapiens
FDLRGPIKE

SEQ ID NO: 626949 - protein, 9 aa, Homo Sapiens
ASEEVMWVR

SEQ ID NO: 626950 - protein, 9 aa, Homo Sapiens
LTGIARMAD

SEQ ID NO: 626951 - protein, 9 aa, Homo Sapiens
VGKVLNVDG

SEQ ID NO: 626952 - protein, 9 aa, Homo Sapiens
ICFRCAICG

SEQ ID NO: 626953 - protein, 9 aa, Homo Sapiens
MPFNLFCTH

SEQ ID NO: 626954 - protein, 9 aa, Homo Sapiens
WRLARAIQG

SEQ ID NO: 626955 - protein, 9 aa, Homo Sapiens
GRDGPAAWR

SEQ ID NO: 626956 - protein, 9 aa, Homo Sapiens
AGSSRKEAD

SEQ ID NO: 626957 - protein, 9 aa, Homo Sapiens
DLRGPIKEH

SEQ ID NO: 626958 - protein, 9 aa, Homo Sapiens
KRNAMANRA

SEQ ID NO: 626959 - protein, 9 aa, Homo Sapiens
LCSFTINDS

SEQ ID NO: 626960 - protein, 9 aa, Homo Sapiens
NEEYQILSN

SEQ ID NO: 626961 - protein, 9 aa, Homo Sapiens
SFTDVAVDF

SEQ ID NO: 626962 - protein, 9 aa, Homo Sapiens
STRCETDVI

SEQ ID NO: 626963 - protein, 9 aa, Homo Sapiens
DRVLCSFTI

SEQ ID NO: 626964 - protein, 9 aa, Homo Sapiens
WHKICFRCA

SEQ ID NO: 626965 - protein, 9 aa, Homo Sapiens
AHNKEMYTI

SEQ ID NO: 626966 - protein, 9 aa, Homo Sapiens
DLLGLEKPD

SEQ ID NO: 626967 - protein, 9 aa, Homo Sapiens
SHEQEYTNN

SEQ ID NO: 626968 - protein, 9 aa, Homo Sapiens
EQASNIQLS

SEQ ID NO: 626969 - protein, 9 aa, Homo Sapiens
KLCKADLSR

SEQ ID NO: 626970 - protein, 9 aa, Homo Sapiens
MDGTHKMQE

SEQ ID NO: 626971 - protein, 9 aa, Homo Sapiens
HVCNDCPPG

SEQ ID NO: 626972 - protein, 9 aa, Homo Sapiens
KRVLPCSLD

SEQ ID NO: 626973 - protein, 9 aa, Homo Sapiens
GLEKPDCGR

SEQ ID NO: 626974 - protein, 9 aa, Homo Sapiens
LPLALTNRR

SEQ ID NO: 626975 - protein, 9 aa, Homo Sapiens
CCKQLFGGF

SEQ ID NO: 626976 - protein, 9 aa, Homo Sapiens
SVPQPGTKS

SEQ ID NO: 626977 - protein, 9 aa, Homo Sapiens
MRHVEKLCK

SEQ ID NO: 626978 - protein, 9 aa, Homo Sapiens
RMLRGRDGP

SEQ ID NO: 626979 - protein, 9 aa, Homo Sapiens
ATRCCFSEP

SEQ ID NO: 626980 - protein, 9 aa, Homo Sapiens
GIEEVAEEL

SEQ ID NO: 626981 - protein, 9 aa, Homo Sapiens
PLARAPPTI

SEQ ID NO: 626982 - protein, 9 aa, Homo Sapiens
RRRRQPPYH

SEQ ID NO: 626983 - protein, 9 aa, Homo Sapiens
KMDGTHKMQ

SEQ ID NO: 626984 - protein, 9 aa, Homo Sapiens
FVMFLVTYL

SEQ ID NO: 626985 - protein, 9 aa, Homo Sapiens
SKDKPAVAP

SEQ ID NO: 626986 - protein, 9 aa, Homo Sapiens
LIVSKNAGE

SEQ ID NO: 626987 - protein, 9 aa, Homo Sapiens
NDSCELRHL

SEQ ID NO: 626988 - protein, 9 aa, Homo Sapiens
YWPGPNVGI

SEQ ID NO: 626989 - protein, 9 aa, Homo Sapiens
VWGFSVLFF

SEQ ID NO: 626990 - protein, 9 aa, Homo Sapiens
PPPPPDRGE

SEQ ID NO: 626991 - protein, 9 aa, Homo Sapiens
EKVTKPFFA

SEQ ID NO: 626992 - protein, 9 aa, Homo Sapiens
LRFLLMGTF

SEQ ID NO: 626993 - protein, 9 aa, Homo Sapiens
RRRLTRRAL

SEQ ID NO: 626994 - protein, 9 aa, Homo Sapiens
PSLFKVLYR

SEQ ID NO: 626995 - protein, 9 aa, Homo Sapiens
ECLKLTGWR

SEQ ID NO: 626996 - protein, 9 aa, Homo Sapiens
ESKMDGTHK

SEQ ID NO: 626997 - protein, 9 aa, Homo Sapiens
QGRIVRDLT

SEQ ID NO: 626998 - protein, 9 aa, Homo Sapiens
LLRSSRTAA

SEQ ID NO: 626999 - protein, 9 aa, Homo Sapiens
VIVDHVKFP

SEQ ID NO: 627000 - protein, 9 aa, Homo Sapiens
TNNIAKLVS

SEQ ID NO: 627001 - protein, 9 aa, Homo Sapiens
SDEPARHHR

SEQ ID NO: 627002 - protein, 9 aa, Homo Sapiens
KPDCGRFPS

SEQ ID NO: 627003 - protein, 9 aa, Homo Sapiens
PNLYPPNKG

SEQ ID NO: 627004 - protein, 9 aa, Homo Sapiens
THKMQEENV

SEQ ID NO: 627005 - protein, 9 aa, Homo Sapiens
NPEAEEDET

SEQ ID NO: 627006 - protein, 9 aa, Homo Sapiens
LVTYLVTVV

SEQ ID NO: 627007 - protein, 9 aa, Homo Sapiens
KTDVAAPCG

SEQ ID NO: 627008 - protein, 9 aa, Homo Sapiens
PEAEEDETA

SEQ ID NO: 627009 - protein, 9 aa, Homo Sapiens
LTNPVPGRT

SEQ ID NO: 627010 - protein, 9 aa, Homo Sapiens
GSVWRRMGA

SEQ ID NO: 627011 - protein, 9 aa, Homo Sapiens
YFGFVNFGN

SEQ ID NO: 627012 - protein, 9 aa, Homo Sapiens
ERERLDDRD

SEQ ID NO: 627013 - protein, 9 aa, Homo Sapiens
LFQQRHQYK

SEQ ID NO: 627014 - protein, 9 aa, Homo Sapiens
NAETLLALG

SEQ ID NO: 627015 - protein, 9 aa, Homo Sapiens
HHRDVRLLF

SEQ ID NO: 627016 - protein, 9 aa, Homo Sapiens
THWTYLLLY

SEQ ID NO: 627017 - protein, 9 aa, Homo Sapiens
ITLIVSIIA

SEQ ID NO: 627018 - protein, 9 aa, Homo Sapiens
VAVSAAPGP

SEQ ID NO: 627019 - protein, 9 aa, Homo Sapiens
CRLQGQERK

SEQ ID NO: 627020 - protein, 9 aa, Homo Sapiens
GGPRMLRGR

SEQ ID NO: 627021 - protein, 9 aa, Homo Sapiens
LTRRALPEP

SEQ ID NO: 627022 - protein, 9 aa, Homo Sapiens
LFKVLYRTF

SEQ ID NO: 627023 - protein, 9 aa, Homo Sapiens
EENNLFGGT

SEQ ID NO: 627024 - protein, 9 aa, Homo Sapiens
WNWRLARAI

SEQ ID NO: 627025 - protein, 9 aa, Homo Sapiens
STVQLPRPS

SEQ ID NO: 627026 - protein, 9 aa, Homo Sapiens
GNLQPYSDP

SEQ ID NO: 627027 - protein, 9 aa, Homo Sapiens
YSEDVCRCV

SEQ ID NO: 627028 - protein, 9 aa, Homo Sapiens
TAAVELVAG

SEQ ID NO: 627029 - protein, 9 aa, Homo Sapiens
HHRGEVCVA

SEQ ID NO: 627030 - protein, 9 aa, Homo Sapiens
PVNEHYFGF

SEQ ID NO: 627031 - protein, 9 aa, Homo Sapiens
DYEQASNIQ

SEQ ID NO: 627032 - protein, 9 aa, Homo Sapiens
CALGTRCTL

SEQ ID NO: 627033 - protein, 9 aa, Homo Sapiens
ALEKVTKPF

SEQ ID NO: 627034 - protein, 9 aa, Homo Sapiens
EYWPGPNVG

SEQ ID NO: 627035 - protein, 9 aa, Homo Sapiens
ALFVMFLVT

SEQ ID NO: 627036 - protein, 9 aa, Homo Sapiens
DRDRERYWR

SEQ ID NO: 627037 - protein, 9 aa, Homo Sapiens
TSLGSSPQR

SEQ ID NO: 627038 - protein, 9 aa, Homo Sapiens
IWGIEEVAE

SEQ ID NO: 627039 - protein, 9 aa, Homo Sapiens
CMNIINHEL

SEQ ID NO: 627040 - protein, 9 aa, Homo Sapiens
SESKMDGTH

SEQ ID NO: 627041 - protein, 9 aa, Homo Sapiens
VIWGIEEVA

SEQ ID NO: 627042 - protein, 9 aa, Homo Sapiens
QPPYHPPPL

SEQ ID NO: 627043 - protein, 9 aa, Homo Sapiens
GTHKMQEEN

SEQ ID NO: 627044 - protein, 9 aa, Homo Sapiens
VLRPLRAIT

SEQ ID NO: 627045 - protein, 9 aa, Homo Sapiens
QQRHQYKRQ

SEQ ID NO: 627046 - protein, 9 aa, Homo Sapiens
RAITRVPSM

SEQ ID NO: 627047 - protein, 9 aa, Homo Sapiens
KFWRNVLVA

SEQ ID NO: 627048 - protein, 9 aa, Homo Sapiens
FARSDEPAR

SEQ ID NO: 627049 - protein, 9 aa, Homo Sapiens
GGYNPEAEE

SEQ ID NO: 627050 - protein, 9 aa, Homo Sapiens
NPVPGRTLM

SEQ ID NO: 627051 - protein, 9 aa, Homo Sapiens
SKSGKIYHH

SEQ ID NO: 627052 - protein, 9 aa, Homo Sapiens
SLGSSPQRC

SEQ ID NO: 627053 - protein, 9 aa, Homo Sapiens
KVTKPFFAA

SEQ ID NO: 627054 - protein, 9 aa, Homo Sapiens
ESGKTCVHL

SEQ ID NO: 627055 - protein, 9 aa, Homo Sapiens
GFVNFGNTC

SEQ ID NO: 627056 - protein, 9 aa, Homo Sapiens
MYTIKWSPT

SEQ ID NO: 627057 - protein, 9 aa, Homo Sapiens
ALSRFLPVD

SEQ ID NO: 627058 - protein, 9 aa, Homo Sapiens
VSFTDVAVD

SEQ ID NO: 627059 - protein, 9 aa, Homo Sapiens
PVDLSLLRS

SEQ ID NO: 627060 - protein, 9 aa, Homo Sapiens
EPLSNLHSL

SEQ ID NO: 627061 - protein, 9 aa, Homo Sapiens
QGNLYECLK

SEQ ID NO: 627062 - protein, 9 aa, Homo Sapiens
EAALKPTLA

SEQ ID NO: 627063 - protein, 9 aa, Homo Sapiens
GFSYSEDVC

SEQ ID NO: 627064 - protein, 9 aa, Homo Sapiens
MFPSYKVNV

SEQ ID NO: 627065 - protein, 9 aa, Homo Sapiens
GQIYINPVT

SEQ ID NO: 627066 - protein, 9 aa, Homo Sapiens
KSKVTSKDK

SEQ ID NO: 627067 - protein, 9 aa, Homo Sapiens
SYQAVMPHL

SEQ ID NO: 627068 - protein, 9 aa, Homo Sapiens
MWVRREDFA

SEQ ID NO: 627069 - protein, 9 aa, Homo Sapiens
SPQRCGSPP

SEQ ID NO: 627070 - protein, 9 aa, Homo Sapiens
RLPLALTNR

SEQ ID NO: 627071 - protein, 9 aa, Homo Sapiens
ALCMNIINH

SEQ ID NO: 627072 - protein, 9 aa, Homo Sapiens
AAVELVAGG

SEQ ID NO: 627073 - protein, 9 aa, Homo Sapiens
LCPPVVGGR

SEQ ID NO: 627074 - protein, 9 aa, Homo Sapiens
LLPGIVPLP

SEQ ID NO: 627075 - protein, 9 aa, Homo Sapiens
AKVDKRGSH

SEQ ID NO: 627076 - protein, 9 aa, Homo Sapiens
RIEDCLAPL

SEQ ID NO: 627077 - protein, 9 aa, Homo Sapiens
CGSPPSAPP

SEQ ID NO: 627078 - protein, 9 aa, Homo Sapiens
NGPLVIVDH

SEQ ID NO: 627079 - protein, 9 aa, Homo Sapiens
SVSFTDVAV

SEQ ID NO: 627080 - protein, 9 aa, Homo Sapiens
HQYKRQLER

SEQ ID NO: 627081 - protein, 9 aa, Homo Sapiens
PAGLFHSCR

SEQ ID NO: 627082 - protein, 9 aa, Homo Sapiens
PVVGGRGGC

SEQ ID NO: 627083 - protein, 9 aa, Homo Sapiens
AILKRNVYS

SEQ ID NO: 627084 - protein, 9 aa, Homo Sapiens
RQELFFKLT

SEQ ID NO: 627085 - protein, 9 aa, Homo Sapiens
LIVSIIAED

SEQ ID NO: 627086 - protein, 9 aa, Homo Sapiens
EHVLMRLQE

SEQ ID NO: 627087 - protein, 9 aa, Homo Sapiens
TTKSKVTSK

SEQ ID NO: 627088 - protein, 9 aa, Homo Sapiens
TKSKVTSKD

SEQ ID NO: 627089 - protein, 9 aa, Homo Sapiens
INHELKRHE

SEQ ID NO: 627090 - protein, 9 aa, Homo Sapiens
GGRGGCALS

SEQ ID NO: 627091 - protein, 9 aa, Homo Sapiens
KISSTRCET

SEQ ID NO: 627092 - protein, 9 aa, Homo Sapiens
ETLLALGGE

SEQ ID NO: 627093 - protein, 9 aa, Homo Sapiens
GSSRKEADS

SEQ ID NO: 627094 - protein, 9 aa, Homo Sapiens
HVLMRLQEK

SEQ ID NO: 627095 - protein, 9 aa, Homo Sapiens
FLGRFPNGK

SEQ ID NO: 627096 - protein, 9 aa, Homo Sapiens
VPVGKVLNV

SEQ ID NO: 627097 - protein, 9 aa, Homo Sapiens
KFLGRFPNG

SEQ ID NO: 627098 - protein, 9 aa, Homo Sapiens
RPSSLGFED

SEQ ID NO: 627099 - protein, 9 aa, Homo Sapiens
PHLVCLADE

SEQ ID NO: 627100 - protein, 9 aa, Homo Sapiens
WERHVSHAK

SEQ ID NO: 627101 - protein, 9 aa, Homo Sapiens
TRVPSMRIL

SEQ ID NO: 627102 - protein, 9 aa, Homo Sapiens
LFFDLRGPI

SEQ ID NO: 627103 - protein, 9 aa, Homo Sapiens
EVATVISGW

SEQ ID NO: 627104 - protein, 9 aa, Homo Sapiens
SEEVMWVRR

SEQ ID NO: 627105 - protein, 9 aa, Homo Sapiens
REYWPGPNV

SEQ ID NO: 627106 - protein, 9 aa, Homo Sapiens
VAEHVLMRL

SEQ ID NO: 627107 - protein, 9 aa, Homo Sapiens
ARSDEPARH

SEQ ID NO: 627108 - protein, 9 aa, Homo Sapiens
DSSPFVERL

SEQ ID NO: 627109 - protein, 9 aa, Homo Sapiens
KQGNLYECL

SEQ ID NO: 627110 - protein, 9 aa, Homo Sapiens
SLFKVLYRT

SEQ ID NO: 627111 - protein, 9 aa, Homo Sapiens
SEVATVISG

SEQ ID NO: 627112 - protein, 9 aa, Homo Sapiens
RLVEVPMEM

SEQ ID NO: 627113 - protein, 9 aa, Homo Sapiens
VDEMGFMKT

SEQ ID NO: 627114 - protein, 9 aa, Homo Sapiens
LSNVLFFDL

SEQ ID NO: 627115 - protein, 9 aa, Homo Sapiens
LRSSRTAAV

SEQ ID NO: 627116 - protein, 9 aa, Homo Sapiens
RMGASERGR

SEQ ID NO: 627117 - protein, 9 aa, Homo Sapiens
VTLKDIFTG

SEQ ID NO: 627118 - protein, 9 aa, Homo Sapiens
VLYRTFGPY

SEQ ID NO: 627119 - protein, 9 aa, Homo Sapiens
CLRFLLMGT

SEQ ID NO: 627120 - protein, 9 aa, Homo Sapiens
GRPLDVLSG

SEQ ID NO: 627121 - protein, 9 aa, Homo Sapiens
AGLFHSCRL

SEQ ID NO: 627122 - protein, 9 aa, Homo Sapiens
LQGQERKGR

SEQ ID NO: 627123 - protein, 9 aa, Homo Sapiens
RLDDRDRER

SEQ ID NO: 627124 - protein, 9 aa, Homo Sapiens
WNAETLLAL

SEQ ID NO: 627125 - protein, 9 aa, Homo Sapiens
DLFQQRHQY

SEQ ID NO: 627126 - protein, 9 aa, Homo Sapiens
SEDPSGKTA

SEQ ID NO: 627127 - protein, 9 aa, Homo Sapiens
NSGEPQLGG

SEQ ID NO: 627128 - protein, 9 aa, Homo Sapiens
GQERKGRAE

SEQ ID NO: 627129 - protein, 9 aa, Homo Sapiens
DVCRCVPSY

SEQ ID NO: 627130 - protein, 9 aa, Homo Sapiens
LGLEKPDCG

SEQ ID NO: 627131 - protein, 9 aa, Homo Sapiens
MCHFVSLEI

SEQ ID NO: 627132 - protein, 9 aa, Homo Sapiens
KDIFTGEEG

SEQ ID NO: 627133 - protein, 9 aa, Homo Sapiens
SLFETINKD

SEQ ID NO: 627134 - protein, 9 aa, Homo Sapiens
GSTVQLPRP

SEQ ID NO: 627135 - protein, 9 aa, Homo Sapiens
VTELDEICW

SEQ ID NO: 627136 - protein, 9 aa, Homo Sapiens
CELRHLKSV

SEQ ID NO: 627137 - protein, 9 aa, Homo Sapiens
RHQYKRQLE

SEQ ID NO: 627138 - protein, 9 aa, Homo Sapiens
RLTRRALPE

SEQ ID NO: 627139 - protein, 9 aa, Homo Sapiens
MLRGRDGPA

SEQ ID NO: 627140 - protein, 9 aa, Homo Sapiens
NVDGAYVAV

SEQ ID NO: 627141 - protein, 9 aa, Homo Sapiens
KMLDYEQAS

SEQ ID NO: 627142 - protein, 9 aa, Homo Sapiens
HSCRLQGQE

SEQ ID NO: 627143 - protein, 9 aa, Homo Sapiens
NLYPPNKGC

SEQ ID NO: 627144 - protein, 9 aa, Homo Sapiens
RQPEKEPSP

SEQ ID NO: 627145 - protein, 9 aa, Homo Sapiens
EFTVQSHGV

SEQ ID NO: 627146 - protein, 9 aa, Homo Sapiens
NVGEGNHPE

SEQ ID NO: 627147 - protein, 9 aa, Homo Sapiens
HDFVPQEIK

SEQ ID NO: 627148 - protein, 9 aa, Homo Sapiens
KKMTVKDIV

SEQ ID NO: 627149 - protein, 9 aa, Homo Sapiens
SNPFPRSNS

SEQ ID NO: 627150 - protein, 9 aa, Homo Sapiens
VSRGTAAGP

SEQ ID NO: 627151 - protein, 9 aa, Homo Sapiens
VPQHGNTKI

SEQ ID NO: 627152 - protein, 9 aa, Homo Sapiens
DQSLDEEQA

SEQ ID NO: 627153 - protein, 9 aa, Homo Sapiens
NETCNIFIN

SEQ ID NO: 627154 - protein, 9 aa, Homo Sapiens
EPRPPGGQW

SEQ ID NO: 627155 - protein, 9 aa, Homo Sapiens
SMNVNEIFI

SEQ ID NO: 627156 - protein, 9 aa, Homo Sapiens
KAENKIRSL

SEQ ID NO: 627157 - protein, 9 aa, Homo Sapiens
GRLNSSSLS

SEQ ID NO: 627158 - protein, 9 aa, Homo Sapiens
VRSRLQCIE

SEQ ID NO: 627159 - protein, 9 aa, Homo Sapiens
AWGAVSNSQ

SEQ ID NO: 627160 - protein, 9 aa, Homo Sapiens
GNVSFVLVE

SEQ ID NO: 627161 - protein, 9 aa, Homo Sapiens
SRSVMDSSR

SEQ ID NO: 627162 - protein, 9 aa, Homo Sapiens
RPAFKLLFF

SEQ ID NO: 627163 - protein, 9 aa, Homo Sapiens
DALHPVPYN

SEQ ID NO: 627164 - protein, 9 aa, Homo Sapiens
PAPQHKKSV

SEQ ID NO: 627165 - protein, 9 aa, Homo Sapiens
CVRFDCDKS

SEQ ID NO: 627166 - protein, 9 aa, Homo Sapiens
TQWEYPRLE

SEQ ID NO: 627167 - protein, 9 aa, Homo Sapiens
HYCGRDPSG

SEQ ID NO: 627168 - protein, 9 aa, Homo Sapiens
KAVRMAVVV

SEQ ID NO: 627169 - protein, 9 aa, Homo Sapiens
ELLSWYPVI

SEQ ID NO: 627170 - protein, 9 aa, Homo Sapiens
LLYALKTVI

SEQ ID NO: 627171 - protein, 9 aa, Homo Sapiens
PNSVYENFR

SEQ ID NO: 627172 - protein, 9 aa, Homo Sapiens
LRSNNMGVG

SEQ ID NO: 627173 - protein, 9 aa, Homo Sapiens
PKFHPGLMF

SEQ ID NO: 627174 - protein, 9 aa, Homo Sapiens
KGSKGSQAP

SEQ ID NO: 627175 - protein, 9 aa, Homo Sapiens
PLPQAAAGI

SEQ ID NO: 627176 - protein, 9 aa, Homo Sapiens
QSLSNALHS

SEQ ID NO: 627177 - protein, 9 aa, Homo Sapiens
AVLHWLGCT

SEQ ID NO: 627178 - protein, 9 aa, Homo Sapiens
DVVWLTEGL

SEQ ID NO: 627179 - protein, 9 aa, Homo Sapiens
FSMDSMEGM

SEQ ID NO: 627180 - protein, 9 aa, Homo Sapiens
LEGRMVLLS

SEQ ID NO: 627181 - protein, 9 aa, Homo Sapiens
LCFCLEEPQ

SEQ ID NO: 627182 - protein, 9 aa, Homo Sapiens
VQTLGYTKS

SEQ ID NO: 627183 - protein, 9 aa, Homo Sapiens
YLIEFSGDI

SEQ ID NO: 627184 - protein, 9 aa, Homo Sapiens
HMSGYCFYL

SEQ ID NO: 627185 - protein, 9 aa, Homo Sapiens
VCEESYLSV

SEQ ID NO: 627186 - protein, 9 aa, Homo Sapiens
SGRPVQKGE

SEQ ID NO: 627187 - protein, 9 aa, Homo Sapiens
VSDFCLSRF

SEQ ID NO: 627188 - protein, 9 aa, Homo Sapiens
IELKLSECP

SEQ ID NO: 627189 - protein, 9 aa, Homo Sapiens
GTLWSSRSV

SEQ ID NO: 627190 - protein, 9 aa, Homo Sapiens
HSRVPTLER

SEQ ID NO: 627191 - protein, 9 aa, Homo Sapiens
RDIKIGPFA

SEQ ID NO: 627192 - protein, 9 aa, Homo Sapiens
FLELGTLER

SEQ ID NO: 627193 - protein, 9 aa, Homo Sapiens
MAEQLINPF

SEQ ID NO: 627194 - protein, 9 aa, Homo Sapiens
GLLMAVGHD

SEQ ID NO: 627195 - protein, 9 aa, Homo Sapiens
KLTITLTDV

SEQ ID NO: 627196 - protein, 9 aa, Homo Sapiens
TCMGVDRYQ

SEQ ID NO: 627197 - protein, 9 aa, Homo Sapiens
VDTDGKGTI

SEQ ID NO: 627198 - protein, 9 aa, Homo Sapiens
RICPAPWGP

SEQ ID NO: 627199 - protein, 9 aa, Homo Sapiens
GYEKDSSST

SEQ ID NO: 627200 - protein, 9 aa, Homo Sapiens
EDLIIQHNC

SEQ ID NO: 627201 - protein, 9 aa, Homo Sapiens
GTGLGSHQP

SEQ ID NO: 627202 - protein, 9 aa, Homo Sapiens
RAGYGAGVV

SEQ ID NO: 627203 - protein, 9 aa, Homo Sapiens
YICPHIVKE

SEQ ID NO: 627204 - protein, 9 aa, Homo Sapiens
SGFYKSSSQ

SEQ ID NO: 627205 - protein, 9 aa, Homo Sapiens
SSKRGLFRV

SEQ ID NO: 627206 - protein, 9 aa, Homo Sapiens
RTINRCNLD

SEQ ID NO: 627207 - protein, 9 aa, Homo Sapiens
IGDLRTQQQ

SEQ ID NO: 627208 - protein, 9 aa, Homo Sapiens
ETGIFLLIN

SEQ ID NO: 627209 - protein, 9 aa, Homo Sapiens
QTVRNGINM

SEQ ID NO: 627210 - protein, 9 aa, Homo Sapiens
NSSSLSNLA

SEQ ID NO: 627211 - protein, 9 aa, Homo Sapiens
HWKHQGQQY

SEQ ID NO: 627212 - protein, 9 aa, Homo Sapiens
RDVQRHDVE

SEQ ID NO: 627213 - protein, 9 aa, Homo Sapiens
GPAPHILGL

SEQ ID NO: 627214 - protein, 9 aa, Homo Sapiens
NLKRIMKVL

SEQ ID NO: 627215 - protein, 9 aa, Homo Sapiens
RTLRPSLVQ

SEQ ID NO: 627216 - protein, 9 aa, Homo Sapiens
PHQGAPIGP

SEQ ID NO: 627217 - protein, 9 aa, Homo Sapiens
NGIPTDDST

SEQ ID NO: 627218 - protein, 9 aa, Homo Sapiens
KLASSAGAS

SEQ ID NO: 627219 - protein, 9 aa, Homo Sapiens
LAAVLTFGG

SEQ ID NO: 627220 - protein, 9 aa, Homo Sapiens
LLMAVGHDL

SEQ ID NO: 627221 - protein, 9 aa, Homo Sapiens
CSVAFSPRS

SEQ ID NO: 627222 - protein, 9 aa, Homo Sapiens
AAAANTSVA

SEQ ID NO: 627223 - protein, 9 aa, Homo Sapiens
NGWPSLCID

SEQ ID NO: 627224 - protein, 9 aa, Homo Sapiens
SKAQLKALF

SEQ ID NO: 627225 - protein, 9 aa, Homo Sapiens
EVSRGTAAG

SEQ ID NO: 627226 - protein, 9 aa, Homo Sapiens
DLHKIMQLQ

SEQ ID NO: 627227 - protein, 9 aa, Homo Sapiens
DPCEMCPAQ

SEQ ID NO: 627228 - protein, 9 aa, Homo Sapiens
KWRPRKGPK

SEQ ID NO: 627229 - protein, 9 aa, Homo Sapiens
NVSFVLVEN

SEQ ID NO: 627230 - protein, 9 aa, Homo Sapiens
CSVAPCEGI

SEQ ID NO: 627231 - protein, 9 aa, Homo Sapiens
CWEPIPYRT

SEQ ID NO: 627232 - protein, 9 aa, Homo Sapiens
VELVAFVIS

SEQ ID NO: 627233 - protein, 9 aa, Homo Sapiens
STCPSHILV

SEQ ID NO: 627234 - protein, 9 aa, Homo Sapiens
LSWGPFHTF

SEQ ID NO: 627235 - protein, 9 aa, Homo Sapiens
SSMLLGDDL

SEQ ID NO: 627236 - protein, 9 aa, Homo Sapiens
AKDKTAQQI

SEQ ID NO: 627237 - protein, 9 aa, Homo Sapiens
DFQARSHRE

SEQ ID NO: 627238 - protein, 9 aa, Homo Sapiens
EQSCLGTLL

SEQ ID NO: 627239 - protein, 9 aa, Homo Sapiens
YWISSGNRT

SEQ ID NO: 627240 - protein, 9 aa, Homo Sapiens
AHCSCCHQC

SEQ ID NO: 627241 - protein, 9 aa, Homo Sapiens
IFSICNMAR

SEQ ID NO: 627242 - protein, 9 aa, Homo Sapiens
VNAIRGLQS

SEQ ID NO: 627243 - protein, 9 aa, Homo Sapiens
QKVTDHSTT

SEQ ID NO: 627244 - protein, 9 aa, Homo Sapiens
ELGPGFRAG

SEQ ID NO: 627245 - protein, 9 aa, Homo Sapiens
PKRSWMTAV

SEQ ID NO: 627246 - protein, 9 aa, Homo Sapiens
PNPLANSNI

SEQ ID NO: 627247 - protein, 9 aa, Homo Sapiens
TSSGTLWSS

SEQ ID NO: 627248 - protein, 9 aa, Homo Sapiens
WDSEGLDGA

SEQ ID NO: 627249 - protein, 9 aa, Homo Sapiens
WYNTHPCNP

SEQ ID NO: 627250 - protein, 9 aa, Homo Sapiens
LVDFIIEVH

SEQ ID NO: 627251 - protein, 9 aa, Homo Sapiens
RMILVHQLF

SEQ ID NO: 627252 - protein, 9 aa, Homo Sapiens
TRPAFKLLF

SEQ ID NO: 627253 - protein, 9 aa, Homo Sapiens
LVAWLKAYS

SEQ ID NO: 627254 - protein, 9 aa, Homo Sapiens
CLPCHAFCR

SEQ ID NO: 627255 - protein, 9 aa, Homo Sapiens
SLWQTLEWL

SEQ ID NO: 627256 - protein, 9 aa, Homo Sapiens
GKTLHHRIE

SEQ ID NO: 627257 - protein, 9 aa, Homo Sapiens
LFYTAILSY

SEQ ID NO: 627258 - protein, 9 aa, Homo Sapiens
GPQWQPGTG

SEQ ID NO: 627259 - protein, 9 aa, Homo Sapiens
VSKLFSNFT

SEQ ID NO: 627260 - protein, 9 aa, Homo Sapiens
GLKTTTLGP

SEQ ID NO: 627261 - protein, 9 aa, Homo Sapiens
WAGPCGGRR

SEQ ID NO: 627262 - protein, 9 aa, Homo Sapiens
QLFHPWGIA

SEQ ID NO: 627263 - protein, 9 aa, Homo Sapiens
VDRYSRQGL

SEQ ID NO: 627264 - protein, 9 aa, Homo Sapiens
ECSTLHNII

SEQ ID NO: 627265 - protein, 9 aa, Homo Sapiens
CPAPPPPLP

SEQ ID NO: 627266 - protein, 9 aa, Homo Sapiens
KHQDEIASQ

SEQ ID NO: 627267 - protein, 9 aa, Homo Sapiens
HVKHIHLEN

SEQ ID NO: 627268 - protein, 9 aa, Homo Sapiens
VPKFLVSMA

SEQ ID NO: 627269 - protein, 9 aa, Homo Sapiens
GTSTSSGTL

SEQ ID NO: 627270 - protein, 9 aa, Homo Sapiens
AEVRHPKGP

SEQ ID NO: 627271 - protein, 9 aa, Homo Sapiens
MATQNAYAC

SEQ ID NO: 627272 - protein, 9 aa, Homo Sapiens
KSSLQFSRC

SEQ ID NO: 627273 - protein, 9 aa, Homo Sapiens
KHSTVQNFH

SEQ ID NO: 627274 - protein, 9 aa, Homo Sapiens
VGDVEDVIY

SEQ ID NO: 627275 - protein, 9 aa, Homo Sapiens
AALQECQDL

SEQ ID NO: 627276 - protein, 9 aa, Homo Sapiens
YNLKDRYGY

SEQ ID NO: 627277 - protein, 9 aa, Homo Sapiens
FKVSAGHGA

SEQ ID NO: 627278 - protein, 9 aa, Homo Sapiens
TVLKVNGII

SEQ ID NO: 627279 - protein, 9 aa, Homo Sapiens
VNGEIDILG

SEQ ID NO: 627280 - protein, 9 aa, Homo Sapiens
VDEGLSIMH

SEQ ID NO: 627281 - protein, 9 aa, Homo Sapiens
KLIPYLDPY

SEQ ID NO: 627282 - protein, 9 aa, Homo Sapiens
SVLLDLKQA

SEQ ID NO: 627283 - protein, 9 aa, Homo Sapiens
LIIQHNCSR

SEQ ID NO: 627284 - protein, 9 aa, Homo Sapiens
KKSAACGQP

SEQ ID NO: 627285 - protein, 9 aa, Homo Sapiens
QYIVPLVFA

SEQ ID NO: 627286 - protein, 9 aa, Homo Sapiens
PHMHKMMRK

SEQ ID NO: 627287 - protein, 9 aa, Homo Sapiens
MSNQYVIKA

SEQ ID NO: 627288 - protein, 9 aa, Homo Sapiens
WPVTQPLRA

SEQ ID NO: 627289 - protein, 9 aa, Homo Sapiens
NKALVSHES

SEQ ID NO: 627290 - protein, 9 aa, Homo Sapiens
NIGILPALE

SEQ ID NO: 627291 - protein, 9 aa, Homo Sapiens
VNEIFIAIA

SEQ ID NO: 627292 - protein, 9 aa, Homo Sapiens
AAAGIPLPR

SEQ ID NO: 627293 - protein, 9 aa, Homo Sapiens
GPQSGPPPL

SEQ ID NO: 627294 - protein, 9 aa, Homo Sapiens
PLRAPQYQN

SEQ ID NO: 627295 - protein, 9 aa, Homo Sapiens
DYVPDHPHP

SEQ ID NO: 627296 - protein, 9 aa, Homo Sapiens
DLIAQELKR

SEQ ID NO: 627297 - protein, 9 aa, Homo Sapiens
DSHDESQSS

SEQ ID NO: 627298 - protein, 9 aa, Homo Sapiens
ASTQIRLAL

SEQ ID NO: 627299 - protein, 9 aa, Homo Sapiens
HSGDHYNEA

SEQ ID NO: 627300 - protein, 9 aa, Homo Sapiens
RMLFAGFPQ

SEQ ID NO: 627301 - protein, 9 aa, Homo Sapiens
NLEKQTNKG

SEQ ID NO: 627302 - protein, 9 aa, Homo Sapiens
TPQSQSQNM

SEQ ID NO: 627303 - protein, 9 aa, Homo Sapiens
EDSRGDARY

SEQ ID NO: 627304 - protein, 9 aa, Homo Sapiens
LKGFLSVEE

SEQ ID NO: 627305 - protein, 9 aa, Homo Sapiens
IYTHNTNNL

SEQ ID NO: 627306 - protein, 9 aa, Homo Sapiens
PLWRTVLKV

SEQ ID NO: 627307 - protein, 9 aa, Homo Sapiens
GSAHSLGPD

SEQ ID NO: 627308 - protein, 9 aa, Homo Sapiens
KKAREEGSG

SEQ ID NO: 627309 - protein, 9 aa, Homo Sapiens
TESTLDACA

SEQ ID NO: 627310 - protein, 9 aa, Homo Sapiens
SPPLSLWAG

SEQ ID NO: 627311 - protein, 9 aa, Homo Sapiens
NAIDRTEQA

SEQ ID NO: 627312 - protein, 9 aa, Homo Sapiens
YGALTQTVR

SEQ ID NO: 627313 - protein, 9 aa, Homo Sapiens
LEDSSVNLL

SEQ ID NO: 627314 - protein, 9 aa, Homo Sapiens
FKGPPVNET

SEQ ID NO: 627315 - protein, 9 aa, Homo Sapiens
IQFLVFLVL

SEQ ID NO: 627316 - protein, 9 aa, Homo Sapiens
AGHGLPGSK

SEQ ID NO: 627317 - protein, 9 aa, Homo Sapiens
IDFVVNNAG

SEQ ID NO: 627318 - protein, 9 aa, Homo Sapiens
TQRALVAMA

SEQ ID NO: 627319 - protein, 9 aa, Homo Sapiens
LAGAESSQE

SEQ ID NO: 627320 - protein, 9 aa, Homo Sapiens
AVSNSQLHD

SEQ ID NO: 627321 - protein, 9 aa, Homo Sapiens
SEYKIVCSL

SEQ ID NO: 627322 - protein, 9 aa, Homo Sapiens
KMLFPKSSA

SEQ ID NO: 627323 - protein, 9 aa, Homo Sapiens
VLRGNVSFV

SEQ ID NO: 627324 - protein, 9 aa, Homo Sapiens
ALKSASKDD

SEQ ID NO: 627325 - protein, 9 aa, Homo Sapiens
EEAAVRAAA

SEQ ID NO: 627326 - protein, 9 aa, Homo Sapiens
HHHYHHSGT

SEQ ID NO: 627327 - protein, 9 aa, Homo Sapiens
HHGITGDKE

SEQ ID NO: 627328 - protein, 9 aa, Homo Sapiens
LVIKLDKVL

SEQ ID NO: 627329 - protein, 9 aa, Homo Sapiens
TTPSPGRFL

SEQ ID NO: 627330 - protein, 9 aa, Homo Sapiens
CKRPLDSPE

SEQ ID NO: 627331 - protein, 9 aa, Homo Sapiens
IINDENFLC

SEQ ID NO: 627332 - protein, 9 aa, Homo Sapiens
HQGAPIGPP

SEQ ID NO: 627333 - protein, 9 aa, Homo Sapiens
LGLLGNAVV

SEQ ID NO: 627334 - protein, 9 aa, Homo Sapiens
FVVNNAGIL

SEQ ID NO: 627335 - protein, 9 aa, Homo Sapiens
VALSLMHPS

SEQ ID NO: 627336 - protein, 9 aa, Homo Sapiens
DRDFHGRCY

SEQ ID NO: 627337 - protein, 9 aa, Homo Sapiens
SKGHHGITG

SEQ ID NO: 627338 - protein, 9 aa, Homo Sapiens
WLVNLQELA

SEQ ID NO: 627339 - protein, 9 aa, Homo Sapiens
HHHHYHHSG

SEQ ID NO: 627340 - protein, 9 aa, Homo Sapiens
IALSTSNVS

SEQ ID NO: 627341 - protein, 9 aa, Homo Sapiens
WNQGRTWSP

SEQ ID NO: 627342 - protein, 9 aa, Homo Sapiens
PLAPKPAVK

SEQ ID NO: 627343 - protein, 9 aa, Homo Sapiens
QRTEQAAAI

SEQ ID NO: 627344 - protein, 9 aa, Homo Sapiens
YIVPLVFAT

SEQ ID NO: 627345 - protein, 9 aa, Homo Sapiens
VSITPPSSG

SEQ ID NO: 627346 - protein, 9 aa, Homo Sapiens
NIKRTQWEY

SEQ ID NO: 627347 - protein, 9 aa, Homo Sapiens
TPLIVEVWP

SEQ ID NO: 627348 - protein, 9 aa, Homo Sapiens
CGKTFRQFS

SEQ ID NO: 627349 - protein, 9 aa, Homo Sapiens
GINMYTVYQ

SEQ ID NO: 627350 - protein, 9 aa, Homo Sapiens
RWDGVAKGV

SEQ ID NO: 627351 - protein, 9 aa, Homo Sapiens
FVLSEGSYL

SEQ ID NO: 627352 - protein, 9 aa, Homo Sapiens
YFPYDYSAS

SEQ ID NO: 627353 - protein, 9 aa, Homo Sapiens
SFAFADIGP

SEQ ID NO: 627354 - protein, 9 aa, Homo Sapiens
TYCGIILLA

SEQ ID NO: 627355 - protein, 9 aa, Homo Sapiens
INMYTVYQL

SEQ ID NO: 627356 - protein, 9 aa, Homo Sapiens
YYFDSTCEH

SEQ ID NO: 627357 - protein, 9 aa, Homo Sapiens
RDMGARGGR

SEQ ID NO: 627358 - protein, 9 aa, Homo Sapiens
YERGTKVTP

SEQ ID NO: 627359 - protein, 9 aa, Homo Sapiens
QHLSIWGYR

SEQ ID NO: 627360 - protein, 9 aa, Homo Sapiens
LVDRQPCDR

SEQ ID NO: 627361 - protein, 9 aa, Homo Sapiens
VKKGETPSA

SEQ ID NO: 627362 - protein, 9 aa, Homo Sapiens
VESDLLGQL

SEQ ID NO: 627363 - protein, 9 aa, Homo Sapiens
VFASVYTRK

SEQ ID NO: 627364 - protein, 9 aa, Homo Sapiens
NLCISCINL

SEQ ID NO: 627365 - protein, 9 aa, Homo Sapiens
MGSASSSAI

SEQ ID NO: 627366 - protein, 9 aa, Homo Sapiens
PSIDGRDPG

SEQ ID NO: 627367 - protein, 9 aa, Homo Sapiens
GKPTNLLSE

SEQ ID NO: 627368 - protein, 9 aa, Homo Sapiens
MRGVMEGKQ

SEQ ID NO: 627369 - protein, 9 aa, Homo Sapiens
SLSSQASVA

SEQ ID NO: 627370 - protein, 9 aa, Homo Sapiens
FQAFTGIEN

SEQ ID NO: 627371 - protein, 9 aa, Homo Sapiens
MGKTHREQQ

SEQ ID NO: 627372 - protein, 9 aa, Homo Sapiens
KLLAADGTA

SEQ ID NO: 627373 - protein, 9 aa, Homo Sapiens
SLKLVDFII

SEQ ID NO: 627374 - protein, 9 aa, Homo Sapiens
LCFRKNSAA

SEQ ID NO: 627375 - protein, 9 aa, Homo Sapiens
PRPTSHDLA

SEQ ID NO: 627376 - protein, 9 aa, Homo Sapiens
ELFHTIYTH

SEQ ID NO: 627377 - protein, 9 aa, Homo Sapiens
SLDVDANRQ

SEQ ID NO: 627378 - protein, 9 aa, Homo Sapiens
AWFRIAFNM

SEQ ID NO: 627379 - protein, 9 aa, Homo Sapiens
TCQQYLCSI

SEQ ID NO: 627380 - protein, 9 aa, Homo Sapiens
PAPPTTSSA

SEQ ID NO: 627381 - protein, 9 aa, Homo Sapiens
PILLIVGHD

SEQ ID NO: 627382 - protein, 9 aa, Homo Sapiens
AVHFSTVSS

SEQ ID NO: 627383 - protein, 9 aa, Homo Sapiens
ADEIGLIPL

SEQ ID NO: 627384 - protein, 9 aa, Homo Sapiens
LAVPKCQRW

SEQ ID NO: 627385 - protein, 9 aa, Homo Sapiens
TSYTANLAA

SEQ ID NO: 627386 - protein, 9 aa, Homo Sapiens
GMELLSWYP

SEQ ID NO: 627387 - protein, 9 aa, Homo Sapiens
KAFLYSSPI

SEQ ID NO: 627388 - protein, 9 aa, Homo Sapiens
QLKQMFHLK

SEQ ID NO: 627389 - protein, 9 aa, Homo Sapiens
KSRCSEATS

SEQ ID NO: 627390 - protein, 9 aa, Homo Sapiens
VPKGLSEQV

SEQ ID NO: 627391 - protein, 9 aa, Homo Sapiens
WGDPCEMCP

SEQ ID NO: 627392 - protein, 9 aa, Homo Sapiens
QRALVAMAT

SEQ ID NO: 627393 - protein, 9 aa, Homo Sapiens
HGGKGLPAA

SEQ ID NO: 627394 - protein, 9 aa, Homo Sapiens
LANGMRRGL

SEQ ID NO: 627395 - protein, 9 aa, Homo Sapiens
YAHTVNPNW

SEQ ID NO: 627396 - protein, 9 aa, Homo Sapiens
VSLRSQHTH

SEQ ID NO: 627397 - protein, 9 aa, Homo Sapiens
IFHPWKKQE

SEQ ID NO: 627398 - protein, 9 aa, Homo Sapiens
YVIKAVDEG

SEQ ID NO: 627399 - protein, 9 aa, Homo Sapiens
TASDDTSNP

SEQ ID NO: 627400 - protein, 9 aa, Homo Sapiens
MNILYPVIF

SEQ ID NO: 627401 - protein, 9 aa, Homo Sapiens
RAARPTMYP

SEQ ID NO: 627402 - protein, 9 aa, Homo Sapiens
GGGGTRPCH

SEQ ID NO: 627403 - protein, 9 aa, Homo Sapiens
AKQIGAATD

SEQ ID NO: 627404 - protein, 9 aa, Homo Sapiens
ILVHADRDN

SEQ ID NO: 627405 - protein, 9 aa, Homo Sapiens
TYIKILQAL

SEQ ID NO: 627406 - protein, 9 aa, Homo Sapiens
RAETGMEYR

SEQ ID NO: 627407 - protein, 9 aa, Homo Sapiens
HCMKLMQQQ

SEQ ID NO: 627408 - protein, 9 aa, Homo Sapiens
FHFAGGQIF

SEQ ID NO: 627409 - protein, 9 aa, Homo Sapiens
QTELADGDI

SEQ ID NO: 627410 - protein, 9 aa, Homo Sapiens
CFKGILVHA

SEQ ID NO: 627411 - protein, 9 aa, Homo Sapiens
SSSRQLDCK

SEQ ID NO: 627412 - protein, 9 aa, Homo Sapiens
HILGLVAGW

SEQ ID NO: 627413 - protein, 9 aa, Homo Sapiens
PPLNSTNSF

SEQ ID NO: 627414 - protein, 9 aa, Homo Sapiens
VTQTPQSQS

SEQ ID NO: 627415 - protein, 9 aa, Homo Sapiens
KSPVSKTYK

SEQ ID NO: 627416 - protein, 9 aa, Homo Sapiens
QKPAFGQYT

SEQ ID NO: 627417 - protein, 9 aa, Homo Sapiens
LRFDAIAEL

SEQ ID NO: 627418 - protein, 9 aa, Homo Sapiens
AYFPSLSLE

SEQ ID NO: 627419 - protein, 9 aa, Homo Sapiens
DIVSVTSSA

SEQ ID NO: 627420 - protein, 9 aa, Homo Sapiens
DKPLGCCWP

SEQ ID NO: 627421 - protein, 9 aa, Homo Sapiens
SMRGHEDWG

SEQ ID NO: 627422 - protein, 9 aa, Homo Sapiens
LVGPLAMEQ

SEQ ID NO: 627423 - protein, 9 aa, Homo Sapiens
LHLVFTQFS

SEQ ID NO: 627424 - protein, 9 aa, Homo Sapiens
GIRIKNVVL

SEQ ID NO: 627425 - protein, 9 aa, Homo Sapiens
CGLREAVDC

SEQ ID NO: 627426 - protein, 9 aa, Homo Sapiens
RAWNQGRTW

SEQ ID NO: 627427 - protein, 9 aa, Homo Sapiens
SLAKDHCMK

SEQ ID NO: 627428 - protein, 9 aa, Homo Sapiens
AKKKDFSIK

SEQ ID NO: 627429 - protein, 9 aa, Homo Sapiens
AFSKGLHYW

SEQ ID NO: 627430 - protein, 9 aa, Homo Sapiens
RAGIALDER

SEQ ID NO: 627431 - protein, 9 aa, Homo Sapiens
RSVQWFGDG

SEQ ID NO: 627432 - protein, 9 aa, Homo Sapiens
GYPLYPGSD

SEQ ID NO: 627433 - protein, 9 aa, Homo Sapiens
IVTAFFSSY

SEQ ID NO: 627434 - protein, 9 aa, Homo Sapiens
LGAGPNVSA

SEQ ID NO: 627435 - protein, 9 aa, Homo Sapiens
AQGETALHI

SEQ ID NO: 627436 - protein, 9 aa, Homo Sapiens
PNEVYLDRK

SEQ ID NO: 627437 - protein, 9 aa, Homo Sapiens
SWRPLFTGG

SEQ ID NO: 627438 - protein, 9 aa, Homo Sapiens
EERYHAYLK

SEQ ID NO: 627439 - protein, 9 aa, Homo Sapiens
VSFVLVENK

SEQ ID NO: 627440 - protein, 9 aa, Homo Sapiens
GGQHSRGQH

SEQ ID NO: 627441 - protein, 9 aa, Homo Sapiens
ERDGLSRVH

SEQ ID NO: 627442 - protein, 9 aa, Homo Sapiens
LGPGFRAGP

SEQ ID NO: 627443 - protein, 9 aa, Homo Sapiens
VSRRTLHSM

SEQ ID NO: 627444 - protein, 9 aa, Homo Sapiens
GINLSGLVP

SEQ ID NO: 627445 - protein, 9 aa, Homo Sapiens
AIFVCNYGH

SEQ ID NO: 627446 - protein, 9 aa, Homo Sapiens
GLPEQRSCL

SEQ ID NO: 627447 - protein, 9 aa, Homo Sapiens
IFSMKVSLE

SEQ ID NO: 627448 - protein, 9 aa, Homo Sapiens
ESPRLEEEL

SEQ ID NO: 627449 - protein, 9 aa, Homo Sapiens
SSVDDFETQ

SEQ ID NO: 627450 - protein, 9 aa, Homo Sapiens
IVWMYLPPH

SEQ ID NO: 627451 - protein, 9 aa, Homo Sapiens
HTLAAATCE

SEQ ID NO: 627452 - protein, 9 aa, Homo Sapiens
GVVVVAPTG

SEQ ID NO: 627453 - protein, 9 aa, Homo Sapiens
SSFNLPFPN

SEQ ID NO: 627454 - protein, 9 aa, Homo Sapiens
DDSTFEEAS

SEQ ID NO: 627455 - protein, 9 aa, Homo Sapiens
NGINMYTVY

SEQ ID NO: 627456 - protein, 9 aa, Homo Sapiens
YAFTKVGNG

SEQ ID NO: 627457 - protein, 9 aa, Homo Sapiens
LFHTIYTHN

SEQ ID NO: 627458 - protein, 9 aa, Homo Sapiens
DEPGHPVNR

SEQ ID NO: 627459 - protein, 9 aa, Homo Sapiens
LQALVAWLK

SEQ ID NO: 627460 - protein, 9 aa, Homo Sapiens
KGKANTSKA

SEQ ID NO: 627461 - protein, 9 aa, Homo Sapiens
SSCVYASGN

SEQ ID NO: 627462 - protein, 9 aa, Homo Sapiens
RCREFVPSR

SEQ ID NO: 627463 - protein, 9 aa, Homo Sapiens
QHDFVPQEI

SEQ ID NO: 627464 - protein, 9 aa, Homo Sapiens
DPYQPVLWL

SEQ ID NO: 627465 - protein, 9 aa, Homo Sapiens
FDRIHCQSL

SEQ ID NO: 627466 - protein, 9 aa, Homo Sapiens
WVTNPDSMA

SEQ ID NO: 627467 - protein, 9 aa, Homo Sapiens
PPTLHLVFT

SEQ ID NO: 627468 - protein, 9 aa, Homo Sapiens
FCLSRFLED

SEQ ID NO: 627469 - protein, 9 aa, Homo Sapiens
QRLHREMLR

SEQ ID NO: 627470 - protein, 9 aa, Homo Sapiens
AGMHLFYME

SEQ ID NO: 627471 - protein, 9 aa, Homo Sapiens
GEDGKDVSP

SEQ ID NO: 627472 - protein, 9 aa, Homo Sapiens
EATPVSGYR

SEQ ID NO: 627473 - protein, 9 aa, Homo Sapiens
GPGLYCVPE

SEQ ID NO: 627474 - protein, 9 aa, Homo Sapiens
DILLLFCIF

SEQ ID NO: 627475 - protein, 9 aa, Homo Sapiens
VRSSGDSQP

SEQ ID NO: 627476 - protein, 9 aa, Homo Sapiens
LRQPEKEPS

SEQ ID NO: 627477 - protein, 9 aa, Homo Sapiens
TRFFHVVQA

SEQ ID NO: 627478 - protein, 9 aa, Homo Sapiens
WSGLDGQWP

SEQ ID NO: 627479 - protein, 9 aa, Homo Sapiens
CMPIGIPAE

SEQ ID NO: 627480 - protein, 9 aa, Homo Sapiens
RTVLKVNGI

SEQ ID NO: 627481 - protein, 9 aa, Homo Sapiens
HGYFVEAQP

SEQ ID NO: 627482 - protein, 9 aa, Homo Sapiens
GYWMIYTYS

SEQ ID NO: 627483 - protein, 9 aa, Homo Sapiens
DMGARGGRP

SEQ ID NO: 627484 - protein, 9 aa, Homo Sapiens
NMLTAQQYE

SEQ ID NO: 627485 - protein, 9 aa, Homo Sapiens
TGQKILHHR

SEQ ID NO: 627486 - protein, 9 aa, Homo Sapiens
ERNNGSFLT

SEQ ID NO: 627487 - protein, 9 aa, Homo Sapiens
EKNATYNIS

SEQ ID NO: 627488 - protein, 9 aa, Homo Sapiens
KLLVELNEQ

SEQ ID NO: 627489 - protein, 9 aa, Homo Sapiens
LRLWGASPT

SEQ ID NO: 627490 - protein, 9 aa, Homo Sapiens
SSFVLSEGS

SEQ ID NO: 627491 - protein, 9 aa, Homo Sapiens
KLKNQNKNI

SEQ ID NO: 627492 - protein, 9 aa, Homo Sapiens
AFKLLFFSI

SEQ ID NO: 627493 - protein, 9 aa, Homo Sapiens
SGPPPLSRT

SEQ ID NO: 627494 - protein, 9 aa, Homo Sapiens
FSLVHYAVT

SEQ ID NO: 627495 - protein, 9 aa, Homo Sapiens
VDLWALGVL

SEQ ID NO: 627496 - protein, 9 aa, Homo Sapiens
VFNGHLGQR

SEQ ID NO: 627497 - protein, 9 aa, Homo Sapiens
QNEIIFVLN

SEQ ID NO: 627498 - protein, 9 aa, Homo Sapiens
EIQAPVASR

SEQ ID NO: 627499 - protein, 9 aa, Homo Sapiens
YRKISQMLL

SEQ ID NO: 627500 - protein, 9 aa, Homo Sapiens
SVCRHTAVL

SEQ ID NO: 627501 - protein, 9 aa, Homo Sapiens
IVNLLLDFG

SEQ ID NO: 627502 - protein, 9 aa, Homo Sapiens
VWPEMQTLA

SEQ ID NO: 627503 - protein, 9 aa, Homo Sapiens
VTTPSSEKL

SEQ ID NO: 627504 - protein, 9 aa, Homo Sapiens
PLKKEYTED

SEQ ID NO: 627505 - protein, 9 aa, Homo Sapiens
FLRGDVLRV

SEQ ID NO: 627506 - protein, 9 aa, Homo Sapiens
DGSSFVLSE

SEQ ID NO: 627507 - protein, 9 aa, Homo Sapiens
PRLWEKLTL

SEQ ID NO: 627508 - protein, 9 aa, Homo Sapiens
HGRYMQDPI

SEQ ID NO: 627509 - protein, 9 aa, Homo Sapiens
ENGWPSLCI

SEQ ID NO: 627510 - protein, 9 aa, Homo Sapiens
QQKPEIKQL

SEQ ID NO: 627511 - protein, 9 aa, Homo Sapiens
RPRDARDGG

SEQ ID NO: 627512 - protein, 9 aa, Homo Sapiens
KNNTYCGII

SEQ ID NO: 627513 - protein, 9 aa, Homo Sapiens
YFHCDDLPS

SEQ ID NO: 627514 - protein, 9 aa, Homo Sapiens
LSYWIQEKP

SEQ ID NO: 627515 - protein, 9 aa, Homo Sapiens
VLSEGSYLD

SEQ ID NO: 627516 - protein, 9 aa, Homo Sapiens
PIKEKSRKR

SEQ ID NO: 627517 - protein, 9 aa, Homo Sapiens
GRQDTRSWR

SEQ ID NO: 627518 - protein, 9 aa, Homo Sapiens
GSIDLSDVQ

SEQ ID NO: 627519 - protein, 9 aa, Homo Sapiens
ICAGKTDFL

SEQ ID NO: 627520 - protein, 9 aa, Homo Sapiens
LARWRQNLG

SEQ ID NO: 627521 - protein, 9 aa, Homo Sapiens
QGWSQGPGL

SEQ ID NO: 627522 - protein, 9 aa, Homo Sapiens
CQLAAPPCK

SEQ ID NO: 627523 - protein, 9 aa, Homo Sapiens
FVEDNFSKL

SEQ ID NO: 627524 - protein, 9 aa, Homo Sapiens
SAGTYQRLE

SEQ ID NO: 627525 - protein, 9 aa, Homo Sapiens
QYPDYKSNA

SEQ ID NO: 627526 - protein, 9 aa, Homo Sapiens
EEAFRALAS

SEQ ID NO: 627527 - protein, 9 aa, Homo Sapiens
LERAFWDVH

SEQ ID NO: 627528 - protein, 9 aa, Homo Sapiens
KSLTLSRIQ

SEQ ID NO: 627529 - protein, 9 aa, Homo Sapiens
LFSTYLATC

SEQ ID NO: 627530 - protein, 9 aa, Homo Sapiens
FIGNQVLKV

SEQ ID NO: 627531 - protein, 9 aa, Homo Sapiens
DSVLQMWSG

SEQ ID NO: 627532 - protein, 9 aa, Homo Sapiens
KDFSRKSNL

SEQ ID NO: 627533 - protein, 9 aa, Homo Sapiens
VFTQFSLYL

SEQ ID NO: 627534 - protein, 9 aa, Homo Sapiens
WLVETLKCR

SEQ ID NO: 627535 - protein, 9 aa, Homo Sapiens
RRIADPYQP

SEQ ID NO: 627536 - protein, 9 aa, Homo Sapiens
PKSVSKEAV

SEQ ID NO: 627537 - protein, 9 aa, Homo Sapiens
RGSRPSLQW

SEQ ID NO: 627538 - protein, 9 aa, Homo Sapiens
PLEVAEGYP

SEQ ID NO: 627539 - protein, 9 aa, Homo Sapiens
YHQAALRRS

SEQ ID NO: 627540 - protein, 9 aa, Homo Sapiens
GYRSFSISG

SEQ ID NO: 627541 - protein, 9 aa, Homo Sapiens
QHVQTLGYT

SEQ ID NO: 627542 - protein, 9 aa, Homo Sapiens
YHREMMAME

SEQ ID NO: 627543 - protein, 9 aa, Homo Sapiens
SQNPRVQPN

SEQ ID NO: 627544 - protein, 9 aa, Homo Sapiens
FCAFTTSSL

SEQ ID NO: 627545 - protein, 9 aa, Homo Sapiens
KTSVRSHDP

SEQ ID NO: 627546 - protein, 9 aa, Homo Sapiens
VRVLCTCYP

SEQ ID NO: 627547 - protein, 9 aa, Homo Sapiens
RLNSSSLSN

SEQ ID NO: 627548 - protein, 9 aa, Homo Sapiens
RTVEIKRCV

SEQ ID NO: 627549 - protein, 9 aa, Homo Sapiens
KREQEDADI

SEQ ID NO: 627550 - protein, 9 aa, Homo Sapiens
KCSVSRDPF

SEQ ID NO: 627551 - protein, 9 aa, Homo Sapiens
LVVGRARPC

SEQ ID NO: 627552 - protein, 9 aa, Homo Sapiens
RDTRRLLER

SEQ ID NO: 627553 - protein, 9 aa, Homo Sapiens
LVTRTTLCQ

SEQ ID NO: 627554 - protein, 9 aa, Homo Sapiens
VTATDLFVS

SEQ ID NO: 627555 - protein, 9 aa, Homo Sapiens
KDQQKPEIK

SEQ ID NO: 627556 - protein, 9 aa, Homo Sapiens
FGNMFVLDH

SEQ ID NO: 627557 - protein, 9 aa, Homo Sapiens
HPRPTSHDL

SEQ ID NO: 627558 - protein, 9 aa, Homo Sapiens
SGFLYSATT

SEQ ID NO: 627559 - protein, 9 aa, Homo Sapiens
TSSLISASV

SEQ ID NO: 627560 - protein, 9 aa, Homo Sapiens
KDGATYTDR

SEQ ID NO: 627561 - protein, 9 aa, Homo Sapiens
KYVRSRLQC

SEQ ID NO: 627562 - protein, 9 aa, Homo Sapiens
YNEAYSRGR

SEQ ID NO: 627563 - protein, 9 aa, Homo Sapiens
HQLFHPWGI

SEQ ID NO: 627564 - protein, 9 aa, Homo Sapiens
MRLVDRRWD

SEQ ID NO: 627565 - protein, 9 aa, Homo Sapiens
TAPPVIAPL

SEQ ID NO: 627566 - protein, 9 aa, Homo Sapiens
KIMERIKEV

SEQ ID NO: 627567 - protein, 9 aa, Homo Sapiens
DQCFHGYYG

SEQ ID NO: 627568 - protein, 9 aa, Homo Sapiens
GSGICVDEE

SEQ ID NO: 627569 - protein, 9 aa, Homo Sapiens
QRALLIRGF

SEQ ID NO: 627570 - protein, 9 aa, Homo Sapiens
PVSNITSSI

SEQ ID NO: 627571 - protein, 9 aa, Homo Sapiens
HVLTRHTQL

SEQ ID NO: 627572 - protein, 9 aa, Homo Sapiens
LQMWSGMLN

SEQ ID NO: 627573 - protein, 9 aa, Homo Sapiens
LSNFTQRAL

SEQ ID NO: 627574 - protein, 9 aa, Homo Sapiens
PIVQAFALD

SEQ ID NO: 627575 - protein, 9 aa, Homo Sapiens
AHHLPGHVL

SEQ ID NO: 627576 - protein, 9 aa, Homo Sapiens
AREEGPSRR

SEQ ID NO: 627577 - protein, 9 aa, Homo Sapiens
TLPPSKGLP

SEQ ID NO: 627578 - protein, 9 aa, Homo Sapiens
APPCKHLSD

SEQ ID NO: 627579 - protein, 9 aa, Homo Sapiens
LSVTRSIHE

SEQ ID NO: 627580 - protein, 9 aa, Homo Sapiens
DHTDGSILA

SEQ ID NO: 627581 - protein, 9 aa, Homo Sapiens
VVAALEIIL

SEQ ID NO: 627582 - protein, 9 aa, Homo Sapiens
TELVLGARI

SEQ ID NO: 627583 - protein, 9 aa, Homo Sapiens
LALWLVAER

SEQ ID NO: 627584 - protein, 9 aa, Homo Sapiens
AAHSADLEN

SEQ ID NO: 627585 - protein, 9 aa, Homo Sapiens
HTPNHRCIN

SEQ ID NO: 627586 - protein, 9 aa, Homo Sapiens
GLPPSVRGN

SEQ ID NO: 627587 - protein, 9 aa, Homo Sapiens
PSSQYIVPL

SEQ ID NO: 627588 - protein, 9 aa, Homo Sapiens
ISGVLGSGF

SEQ ID NO: 627589 - protein, 9 aa, Homo Sapiens
TGECMDLIY

SEQ ID NO: 627590 - protein, 9 aa, Homo Sapiens
NPLLSHTGI

SEQ ID NO: 627591 - protein, 9 aa, Homo Sapiens
YYHAKFGIR

SEQ ID NO: 627592 - protein, 9 aa, Homo Sapiens
PRPLAHQLR

SEQ ID NO: 627593 - protein, 9 aa, Homo Sapiens
ITSYTANLA

SEQ ID NO: 627594 - protein, 9 aa, Homo Sapiens
LLLAAYFFS

SEQ ID NO: 627595 - protein, 9 aa, Homo Sapiens
PPVNETCNI

SEQ ID NO: 627596 - protein, 9 aa, Homo Sapiens
NMGRVTKRD

SEQ ID NO: 627597 - protein, 9 aa, Homo Sapiens
AKDHCMKLM

SEQ ID NO: 627598 - protein, 9 aa, Homo Sapiens
GGGTRPCHP

SEQ ID NO: 627599 - protein, 9 aa, Homo Sapiens
KQNVTDIDF

SEQ ID NO: 627600 - protein, 9 aa, Homo Sapiens
SSLQFSRCY

SEQ ID NO: 627601 - protein, 9 aa, Homo Sapiens
PSSWPGELG

SEQ ID NO: 627602 - protein, 9 aa, Homo Sapiens
AYHIPSRLD

SEQ ID NO: 627603 - protein, 9 aa, Homo Sapiens
DVLKNMTDN

SEQ ID NO: 627604 - protein, 9 aa, Homo Sapiens
RVVAPGFRM

SEQ ID NO: 627605 - protein, 9 aa, Homo Sapiens
DHFVIVSAS

SEQ ID NO: 627606 - protein, 9 aa, Homo Sapiens
VLVEMAHHF

SEQ ID NO: 627607 - protein, 9 aa, Homo Sapiens
AAFQPVLDG

SEQ ID NO: 627608 - protein, 9 aa, Homo Sapiens
KTKSRLARK

SEQ ID NO: 627609 - protein, 9 aa, Homo Sapiens
CPPTKCPEP

SEQ ID NO: 627610 - protein, 9 aa, Homo Sapiens
FLLAAMAND

SEQ ID NO: 627611 - protein, 9 aa, Homo Sapiens
LPGAPRSEA

SEQ ID NO: 627612 - protein, 9 aa, Homo Sapiens
GVSRGGSHG

SEQ ID NO: 627613 - protein, 9 aa, Homo Sapiens
LLLDFGADV

SEQ ID NO: 627614 - protein, 9 aa, Homo Sapiens
DIEWIICKD

SEQ ID NO: 627615 - protein, 9 aa, Homo Sapiens
VSRDPFTSL

SEQ ID NO: 627616 - protein, 9 aa, Homo Sapiens
RLVCCGRHY

SEQ ID NO: 627617 - protein, 9 aa, Homo Sapiens
PECGKRFSL

SEQ ID NO: 627618 - protein, 9 aa, Homo Sapiens
ALVAMATWS

SEQ ID NO: 627619 - protein, 9 aa, Homo Sapiens
DCVRFIADH

SEQ ID NO: 627620 - protein, 9 aa, Homo Sapiens
NVFPSSVDF

SEQ ID NO: 627621 - protein, 9 aa, Homo Sapiens
ELVESPRLE

SEQ ID NO: 627622 - protein, 9 aa, Homo Sapiens
SVHLQGKPQ

SEQ ID NO: 627623 - protein, 9 aa, Homo Sapiens
FRIPVSRPI

SEQ ID NO: 627624 - protein, 9 aa, Homo Sapiens
AHQLRGQPG

SEQ ID NO: 627625 - protein, 9 aa, Homo Sapiens
FRSKYHTEQ

SEQ ID NO: 627626 - protein, 9 aa, Homo Sapiens
LERAYQMVW

SEQ ID NO: 627627 - protein, 9 aa, Homo Sapiens
LPQLPLPCI

SEQ ID NO: 627628 - protein, 9 aa, Homo Sapiens
PQAAAGIPL

SEQ ID NO: 627629 - protein, 9 aa, Homo Sapiens
DQYRKKSRC

SEQ ID NO: 627630 - protein, 9 aa, Homo Sapiens
ADGSIAKEE

SEQ ID NO: 627631 - protein, 9 aa, Homo Sapiens
DKMPHMHKM

SEQ ID NO: 627632 - protein, 9 aa, Homo Sapiens
CGKDFSRKS

SEQ ID NO: 627633 - protein, 9 aa, Homo Sapiens
KDWSCFLCL

SEQ ID NO: 627634 - protein, 9 aa, Homo Sapiens
EQQRRILQL

SEQ ID NO: 627635 - protein, 9 aa, Homo Sapiens
GFLPSKDIK

SEQ ID NO: 627636 - protein, 9 aa, Homo Sapiens
DFCLSRFLE

SEQ ID NO: 627637 - protein, 9 aa, Homo Sapiens
KVYTLCFCL

SEQ ID NO: 627638 - protein, 9 aa, Homo Sapiens
SFCHILIRN

SEQ ID NO: 627639 - protein, 9 aa, Homo Sapiens
ALDDEETGG

SEQ ID NO: 627640 - protein, 9 aa, Homo Sapiens
KGLGVYSLG

SEQ ID NO: 627641 - protein, 9 aa, Homo Sapiens
VSKEAVAIC

SEQ ID NO: 627642 - protein, 9 aa, Homo Sapiens
LWEIYLSPR

SEQ ID NO: 627643 - protein, 9 aa, Homo Sapiens
CVENGWPSL

SEQ ID NO: 627644 - protein, 9 aa, Homo Sapiens
FGRIDFVVN

SEQ ID NO: 627645 - protein, 9 aa, Homo Sapiens
LAGMEFQYE

SEQ ID NO: 627646 - protein, 9 aa, Homo Sapiens
LAMERFPYV

SEQ ID NO: 627647 - protein, 9 aa, Homo Sapiens
LIPYLDPYI

SEQ ID NO: 627648 - protein, 9 aa, Homo Sapiens
RHKEYYRGR

SEQ ID NO: 627649 - protein, 9 aa, Homo Sapiens
GELILSMNI

SEQ ID NO: 627650 - protein, 9 aa, Homo Sapiens
PTLQQAYRM

SEQ ID NO: 627651 - protein, 9 aa, Homo Sapiens
DRRLSAHVW

SEQ ID NO: 627652 - protein, 9 aa, Homo Sapiens
AICIGSLPP

SEQ ID NO: 627653 - protein, 9 aa, Homo Sapiens
EIAFEKPNI

SEQ ID NO: 627654 - protein, 9 aa, Homo Sapiens
SVMDSSRPQ

SEQ ID NO: 627655 - protein, 9 aa, Homo Sapiens
TWKANTTTN

SEQ ID NO: 627656 - protein, 9 aa, Homo Sapiens
SIKIACALN

SEQ ID NO: 627657 - protein, 9 aa, Homo Sapiens
WAEEAALET

SEQ ID NO: 627658 - protein, 9 aa, Homo Sapiens
KIYVEVVFK

SEQ ID NO: 627659 - protein, 9 aa, Homo Sapiens
SKLGANAIL

SEQ ID NO: 627660 - protein, 9 aa, Homo Sapiens
REQQLRPKK

SEQ ID NO: 627661 - protein, 9 aa, Homo Sapiens
SHESSAEEE

SEQ ID NO: 627662 - protein, 9 aa, Homo Sapiens
QQCDQCFHG

SEQ ID NO: 627663 - protein, 9 aa, Homo Sapiens
TSAATTNIE

SEQ ID NO: 627664 - protein, 9 aa, Homo Sapiens
PQAVRVEPS

SEQ ID NO: 627665 - protein, 9 aa, Homo Sapiens
IDHHKFHPL

SEQ ID NO: 627666 - protein, 9 aa, Homo Sapiens
MGTFDWLVN

SEQ ID NO: 627667 - protein, 9 aa, Homo Sapiens
SSHDPKYPV

SEQ ID NO: 627668 - protein, 9 aa, Homo Sapiens
LLPQKTWYS

SEQ ID NO: 627669 - protein, 9 aa, Homo Sapiens
MAFDRYMAF

SEQ ID NO: 627670 - protein, 9 aa, Homo Sapiens
RRTTLPIKG

SEQ ID NO: 627671 - protein, 9 aa, Homo Sapiens
GHIEEHDKV

SEQ ID NO: 627672 - protein, 9 aa, Homo Sapiens
LFDIVTSQI

SEQ ID NO: 627673 - protein, 9 aa, Homo Sapiens
DTCEPCGSG

SEQ ID NO: 627674 - protein, 9 aa, Homo Sapiens
DNTAVRNRG

SEQ ID NO: 627675 - protein, 9 aa, Homo Sapiens
AILRVLGPG

SEQ ID NO: 627676 - protein, 9 aa, Homo Sapiens
TLMLHFFHP

SEQ ID NO: 627677 - protein, 9 aa, Homo Sapiens
AEAWEATCI

SEQ ID NO: 627678 - protein, 9 aa, Homo Sapiens
FQLNEDVPS

SEQ ID NO: 627679 - protein, 9 aa, Homo Sapiens
VHFLRDVMV

SEQ ID NO: 627680 - protein, 9 aa, Homo Sapiens
VDKLLALWL

SEQ ID NO: 627681 - protein, 9 aa, Homo Sapiens
SDFGCRAAA

SEQ ID NO: 627682 - protein, 9 aa, Homo Sapiens
LRHGYFVEA

SEQ ID NO: 627683 - protein, 9 aa, Homo Sapiens
GTHSHSLPD

SEQ ID NO: 627684 - protein, 9 aa, Homo Sapiens
CDTFHYVTT

SEQ ID NO: 627685 - protein, 9 aa, Homo Sapiens
IADGSSFVL

SEQ ID NO: 627686 - protein, 9 aa, Homo Sapiens
FFFHFAGGQ

SEQ ID NO: 627687 - protein, 9 aa, Homo Sapiens
LLTLGFERL

SEQ ID NO: 627688 - protein, 9 aa, Homo Sapiens
KALVSHESS

SEQ ID NO: 627689 - protein, 9 aa, Homo Sapiens
CQLRSNNMG

SEQ ID NO: 627690 - protein, 9 aa, Homo Sapiens
AISPYRKLR

SEQ ID NO: 627691 - protein, 9 aa, Homo Sapiens
QKENPLTLA

SEQ ID NO: 627692 - protein, 9 aa, Homo Sapiens
KCAKEVGNA

SEQ ID NO: 627693 - protein, 9 aa, Homo Sapiens
KLIFRPPEI

SEQ ID NO: 627694 - protein, 9 aa, Homo Sapiens
SQHNGTMYQ

SEQ ID NO: 627695 - protein, 9 aa, Homo Sapiens
GTTKLTITL

SEQ ID NO: 627696 - protein, 9 aa, Homo Sapiens
KDSKFKIPK

SEQ ID NO: 627697 - protein, 9 aa, Homo Sapiens
QPSLCLLVR

SEQ ID NO: 627698 - protein, 9 aa, Homo Sapiens
NYHHYFPYD

SEQ ID NO: 627699 - protein, 9 aa, Homo Sapiens
GPPWAEEAA

SEQ ID NO: 627700 - protein, 9 aa, Homo Sapiens
TEEKRHRKR

SEQ ID NO: 627701 - protein, 9 aa, Homo Sapiens
VRMAVVVAA

SEQ ID NO: 627702 - protein, 9 aa, Homo Sapiens
QHLTVVMQR

SEQ ID NO: 627703 - protein, 9 aa, Homo Sapiens
ARIGSLARW

SEQ ID NO: 627704 - protein, 9 aa, Homo Sapiens
AVQYNEPLI

SEQ ID NO: 627705 - protein, 9 aa, Homo Sapiens
RDLHKIMQL

SEQ ID NO: 627706 - protein, 9 aa, Homo Sapiens
RKKVKFNTF

SEQ ID NO: 627707 - protein, 9 aa, Homo Sapiens
PSPLPQAAA

SEQ ID NO: 627708 - protein, 9 aa, Homo Sapiens
LFLTILMPC

SEQ ID NO: 627709 - protein, 9 aa, Homo Sapiens
PGPQGPAGH

SEQ ID NO: 627710 - protein, 9 aa, Homo Sapiens
ILIRFLCCS

SEQ ID NO: 627711 - protein, 9 aa, Homo Sapiens
TSPPPHDSL

SEQ ID NO: 627712 - protein, 9 aa, Homo Sapiens
KHGKLHTAD

SEQ ID NO: 627713 - protein, 9 aa, Homo Sapiens
LLLALSSIA

SEQ ID NO: 627714 - protein, 9 aa, Homo Sapiens
GRDCERDGL

SEQ ID NO: 627715 - protein, 9 aa, Homo Sapiens
VSVSTDQGI

SEQ ID NO: 627716 - protein, 9 aa, Homo Sapiens
QGKPQTLAV

SEQ ID NO: 627717 - protein, 9 aa, Homo Sapiens
AGLFSHGGK

SEQ ID NO: 627718 - protein, 9 aa, Homo Sapiens
RDAGLPPLG

SEQ ID NO: 627719 - protein, 9 aa, Homo Sapiens
TIVFLVGLL

SEQ ID NO: 627720 - protein, 9 aa, Homo Sapiens
LHVVCPEEH

SEQ ID NO: 627721 - protein, 9 aa, Homo Sapiens
DIPMGTFDW

SEQ ID NO: 627722 - protein, 9 aa, Homo Sapiens
AIAELETVK

SEQ ID NO: 627723 - protein, 9 aa, Homo Sapiens
KKERERCSN

SEQ ID NO: 627724 - protein, 9 aa, Homo Sapiens
GQPGHAGAG

SEQ ID NO: 627725 - protein, 9 aa, Homo Sapiens
MAINGIPTD

SEQ ID NO: 627726 - protein, 9 aa, Homo Sapiens
FNIGNMTVL

SEQ ID NO: 627727 - protein, 9 aa, Homo Sapiens
EDQSDDSSA

SEQ ID NO: 627728 - protein, 9 aa, Homo Sapiens
VPSGGLLPN

SEQ ID NO: 627729 - protein, 9 aa, Homo Sapiens
KCISQLELS

SEQ ID NO: 627730 - protein, 9 aa, Homo Sapiens
ASLWKEGLR

SEQ ID NO: 627731 - protein, 9 aa, Homo Sapiens
GDSQPSPYP

SEQ ID NO: 627732 - protein, 9 aa, Homo Sapiens
GDGTPYDHI

SEQ ID NO: 627733 - protein, 9 aa, Homo Sapiens
LKGIFSMKV

SEQ ID NO: 627734 - protein, 9 aa, Homo Sapiens
PPPWAQGAP

SEQ ID NO: 627735 - protein, 9 aa, Homo Sapiens
AHSQVDEGL

SEQ ID NO: 627736 - protein, 9 aa, Homo Sapiens
AEGSHCSPG

SEQ ID NO: 627737 - protein, 9 aa, Homo Sapiens
TLFGESEGA

SEQ ID NO: 627738 - protein, 9 aa, Homo Sapiens
HLIKTRGQK

SEQ ID NO: 627739 - protein, 9 aa, Homo Sapiens
SMAPAEEAE

SEQ ID NO: 627740 - protein, 9 aa, Homo Sapiens
LKNSILKNS

SEQ ID NO: 627741 - protein, 9 aa, Homo Sapiens
EIDILGEDT

SEQ ID NO: 627742 - protein, 9 aa, Homo Sapiens
ILCTRERIS

SEQ ID NO: 627743 - protein, 9 aa, Homo Sapiens
SLSNALHSL

SEQ ID NO: 627744 - protein, 9 aa, Homo Sapiens
IDADVEERY

SEQ ID NO: 627745 - protein, 9 aa, Homo Sapiens
RIQITWFVS

SEQ ID NO: 627746 - protein, 9 aa, Homo Sapiens
VLDEDSRSE

SEQ ID NO: 627747 - protein, 9 aa, Homo Sapiens
VIKLDKVLQ

SEQ ID NO: 627748 - protein, 9 aa, Homo Sapiens
GNETLPPSK

SEQ ID NO: 627749 - protein, 9 aa, Homo Sapiens
SDLLSPSEF

SEQ ID NO: 627750 - protein, 9 aa, Homo Sapiens
TSNPFPRSN

SEQ ID NO: 627751 - protein, 9 aa, Homo Sapiens
GDKGNLLDE

SEQ ID NO: 627752 - protein, 9 aa, Homo Sapiens
SRSKSSDPV

SEQ ID NO: 627753 - protein, 9 aa, Homo Sapiens
TWYSATRFR

SEQ ID NO: 627754 - protein, 9 aa, Homo Sapiens
RFKRLWSED

SEQ ID NO: 627755 - protein, 9 aa, Homo Sapiens
FIIVWMYLP

SEQ ID NO: 627756 - protein, 9 aa, Homo Sapiens
SRYNLCISC

SEQ ID NO: 627757 - protein, 9 aa, Homo Sapiens
SLSAHGRGP

SEQ ID NO: 627758 - protein, 9 aa, Homo Sapiens
EMVERKEED

SEQ ID NO: 627759 - protein, 9 aa, Homo Sapiens
SFIAINKEL

SEQ ID NO: 627760 - protein, 9 aa, Homo Sapiens
GLVVEGVPN

SEQ ID NO: 627761 - protein, 9 aa, Homo Sapiens
KREHSPIKE

SEQ ID NO: 627762 - protein, 9 aa, Homo Sapiens
PYIRYCMEK

SEQ ID NO: 627763 - protein, 9 aa, Homo Sapiens
TVVFYELAH

SEQ ID NO: 627764 - protein, 9 aa, Homo Sapiens
HLNMQHQEC

SEQ ID NO: 627765 - protein, 9 aa, Homo Sapiens
LRKRERSCR

SEQ ID NO: 627766 - protein, 9 aa, Homo Sapiens
QYVGTFYEE

SEQ ID NO: 627767 - protein, 9 aa, Homo Sapiens
SPYEWYNTH

SEQ ID NO: 627768 - protein, 9 aa, Homo Sapiens
APTETSPGA

SEQ ID NO: 627769 - protein, 9 aa, Homo Sapiens
SVYPVAGGG

SEQ ID NO: 627770 - protein, 9 aa, Homo Sapiens
AGRQDTRSW

SEQ ID NO: 627771 - protein, 9 aa, Homo Sapiens
SVSKLFSNF

SEQ ID NO: 627772 - protein, 9 aa, Homo Sapiens
GTTVDTTHM

SEQ ID NO: 627773 - protein, 9 aa, Homo Sapiens
HWKTILINS

SEQ ID NO: 627774 - protein, 9 aa, Homo Sapiens
AGAGGGGGT

SEQ ID NO: 627775 - protein, 9 aa, Homo Sapiens
PFCGKTLHH

SEQ ID NO: 627776 - protein, 9 aa, Homo Sapiens
TYTVYCWCV

SEQ ID NO: 627777 - protein, 9 aa, Homo Sapiens
PPHDSLSLK

SEQ ID NO: 627778 - protein, 9 aa, Homo Sapiens
KRRKEWLKL

SEQ ID NO: 627779 - protein, 9 aa, Homo Sapiens
KRHQDMFHD

SEQ ID NO: 627780 - protein, 9 aa, Homo Sapiens
SLGTSSLFF

SEQ ID NO: 627781 - protein, 9 aa, Homo Sapiens
LLVELNEQR

SEQ ID NO: 627782 - protein, 9 aa, Homo Sapiens
ANHVACFHT

SEQ ID NO: 627783 - protein, 9 aa, Homo Sapiens
THPNDEEAH

SEQ ID NO: 627784 - protein, 9 aa, Homo Sapiens
VKQLEKTFN

SEQ ID NO: 627785 - protein, 9 aa, Homo Sapiens
PGYAPGLYH

SEQ ID NO: 627786 - protein, 9 aa, Homo Sapiens
RRRDLGIRL

SEQ ID NO: 627787 - protein, 9 aa, Homo Sapiens
SMSSSQVAT

SEQ ID NO: 627788 - protein, 9 aa, Homo Sapiens
NNFICDHFV

SEQ ID NO: 627789 - protein, 9 aa, Homo Sapiens
RSSAYQELI

SEQ ID NO: 627790 - protein, 9 aa, Homo Sapiens
YKEASGLSS

SEQ ID NO: 627791 - protein, 9 aa, Homo Sapiens
LNNAALAGK

SEQ ID NO: 627792 - protein, 9 aa, Homo Sapiens
VSKDTDIIV

SEQ ID NO: 627793 - protein, 9 aa, Homo Sapiens
TYQRLEEYR

SEQ ID NO: 627794 - protein, 9 aa, Homo Sapiens
PIFSPGRVY

SEQ ID NO: 627795 - protein, 9 aa, Homo Sapiens
HKAQRDPLQ

SEQ ID NO: 627796 - protein, 9 aa, Homo Sapiens
RLKEKSRPT

SEQ ID NO: 627797 - protein, 9 aa, Homo Sapiens
TPYDHITSR

SEQ ID NO: 627798 - protein, 9 aa, Homo Sapiens
SLKHPSNKG

SEQ ID NO: 627799 - protein, 9 aa, Homo Sapiens
EESYLSVTL

SEQ ID NO: 627800 - protein, 9 aa, Homo Sapiens
CPTGWQVQT

SEQ ID NO: 627801 - protein, 9 aa, Homo Sapiens
GEAINECKG

SEQ ID NO: 627802 - protein, 9 aa, Homo Sapiens
SEGKVYTLC

SEQ ID NO: 627803 - protein, 9 aa, Homo Sapiens
SLNKLRKRE

SEQ ID NO: 627804 - protein, 9 aa, Homo Sapiens
IQNGPMNGY

SEQ ID NO: 627805 - protein, 9 aa, Homo Sapiens
DEDDGVGVG

SEQ ID NO: 627806 - protein, 9 aa, Homo Sapiens
LGPTPCFSL

SEQ ID NO: 627807 - protein, 9 aa, Homo Sapiens
SQASVAELL

SEQ ID NO: 627808 - protein, 9 aa, Homo Sapiens
SQWVDLHIQ

SEQ ID NO: 627809 - protein, 9 aa, Homo Sapiens
FHPGGMMKL

SEQ ID NO: 627810 - protein, 9 aa, Homo Sapiens
IIFHPWKKQ

SEQ ID NO: 627811 - protein, 9 aa, Homo Sapiens
CEAYYHAKF

SEQ ID NO: 627812 - protein, 9 aa, Homo Sapiens
SLHNCKAKS

SEQ ID NO: 627813 - protein, 9 aa, Homo Sapiens
WRTVLKVNG

SEQ ID NO: 627814 - protein, 9 aa, Homo Sapiens
LQLDWSDLM

SEQ ID NO: 627815 - protein, 9 aa, Homo Sapiens
VEIKRCVIC

SEQ ID NO: 627816 - protein, 9 aa, Homo Sapiens
HRYLGLSML

SEQ ID NO: 627817 - protein, 9 aa, Homo Sapiens
VQKGEPGLP

SEQ ID NO: 627818 - protein, 9 aa, Homo Sapiens
VVMKFDAIY

SEQ ID NO: 627819 - protein, 9 aa, Homo Sapiens
RRIQITWFV

SEQ ID NO: 627820 - protein, 9 aa, Homo Sapiens
MGARGGRPS

SEQ ID NO: 627821 - protein, 9 aa, Homo Sapiens
YPWQSCKVL

SEQ ID NO: 627822 - protein, 9 aa, Homo Sapiens
DRRWDGVAK

SEQ ID NO: 627823 - protein, 9 aa, Homo Sapiens
QVMDYIVST

SEQ ID NO: 627824 - protein, 9 aa, Homo Sapiens
NLVGLRAIL

SEQ ID NO: 627825 - protein, 9 aa, Homo Sapiens
KTAQQIKKV

SEQ ID NO: 627826 - protein, 9 aa, Homo Sapiens
FGNSTTFQH

SEQ ID NO: 627827 - protein, 9 aa, Homo Sapiens
YLEDEWCAG

SEQ ID NO: 627828 - protein, 9 aa, Homo Sapiens
LFVNSRKDR

SEQ ID NO: 627829 - protein, 9 aa, Homo Sapiens
CRHNIVDET

SEQ ID NO: 627830 - protein, 9 aa, Homo Sapiens
FASGMKDKH

SEQ ID NO: 627831 - protein, 9 aa, Homo Sapiens
PGAECAHCS

SEQ ID NO: 627832 - protein, 9 aa, Homo Sapiens
LNDHGTNWR

SEQ ID NO: 627833 - protein, 9 aa, Homo Sapiens
CVYASGNFN

SEQ ID NO: 627834 - protein, 9 aa, Homo Sapiens
YKGREAIYP

SEQ ID NO: 627835 - protein, 9 aa, Homo Sapiens
YVIEDGKVE

SEQ ID NO: 627836 - protein, 9 aa, Homo Sapiens
GTRSSGLKL

SEQ ID NO: 627837 - protein, 9 aa, Homo Sapiens
WAFTLIIIT

SEQ ID NO: 627838 - protein, 9 aa, Homo Sapiens
LKLIHLVSG

SEQ ID NO: 627839 - protein, 9 aa, Homo Sapiens
PMTEAGPVG

SEQ ID NO: 627840 - protein, 9 aa, Homo Sapiens
LKKEYTEDN

SEQ ID NO: 627841 - protein, 9 aa, Homo Sapiens
YAVATWDAL

SEQ ID NO: 627842 - protein, 9 aa, Homo Sapiens
GKRFSLSSS

SEQ ID NO: 627843 - protein, 9 aa, Homo Sapiens
GAEGNGVGR

SEQ ID NO: 627844 - protein, 9 aa, Homo Sapiens
IYGDQYASL

SEQ ID NO: 627845 - protein, 9 aa, Homo Sapiens
STQIRLALE

SEQ ID NO: 627846 - protein, 9 aa, Homo Sapiens
RDCDHLVAC

SEQ ID NO: 627847 - protein, 9 aa, Homo Sapiens
LRAPQYQNG

SEQ ID NO: 627848 - protein, 9 aa, Homo Sapiens
LAHLWVVDL

SEQ ID NO: 627849 - protein, 9 aa, Homo Sapiens
YSEYKIVCS

SEQ ID NO: 627850 - protein, 9 aa, Homo Sapiens
FPWTVHLAP

SEQ ID NO: 627851 - protein, 9 aa, Homo Sapiens
FRDALRLGA

SEQ ID NO: 627852 - protein, 9 aa, Homo Sapiens
NGHKRLCLF

SEQ ID NO: 627853 - protein, 9 aa, Homo Sapiens
SGHSPAISS

SEQ ID NO: 627854 - protein, 9 aa, Homo Sapiens
SLTILIRFL

SEQ ID NO: 627855 - protein, 9 aa, Homo Sapiens
EDWGIRLEC

SEQ ID NO: 627856 - protein, 9 aa, Homo Sapiens
NSKPSSILN

SEQ ID NO: 627857 - protein, 9 aa, Homo Sapiens
YIDSDGNGP

SEQ ID NO: 627858 - protein, 9 aa, Homo Sapiens
LFMIVLDRL

SEQ ID NO: 627859 - protein, 9 aa, Homo Sapiens
VPLVFATYL

SEQ ID NO: 627860 - protein, 9 aa, Homo Sapiens
EMVRPSELL

SEQ ID NO: 627861 - protein, 9 aa, Homo Sapiens
SSLLKRFAC

SEQ ID NO: 627862 - protein, 9 aa, Homo Sapiens
ACTSRVCFH

SEQ ID NO: 627863 - protein, 9 aa, Homo Sapiens
KLLHQFVEQ

SEQ ID NO: 627864 - protein, 9 aa, Homo Sapiens
REGPPKTDL

SEQ ID NO: 627865 - protein, 9 aa, Homo Sapiens
AWSSHVAES

SEQ ID NO: 627866 - protein, 9 aa, Homo Sapiens
LDRLKYLNL

SEQ ID NO: 627867 - protein, 9 aa, Homo Sapiens
CMLGPGLLR

SEQ ID NO: 627868 - protein, 9 aa, Homo Sapiens
SEEEFGVDD

SEQ ID NO: 627869 - protein, 9 aa, Homo Sapiens
PSLKHPSNK

SEQ ID NO: 627870 - protein, 9 aa, Homo Sapiens
RIKEVAAQS

SEQ ID NO: 627871 - protein, 9 aa, Homo Sapiens
RLDRDQQEW

SEQ ID NO: 627872 - protein, 9 aa, Homo Sapiens
VRTSAFPWE

SEQ ID NO: 627873 - protein, 9 aa, Homo Sapiens
LLLLHGYRG

SEQ ID NO: 627874 - protein, 9 aa, Homo Sapiens
SQGPGLQGF

SEQ ID NO: 627875 - protein, 9 aa, Homo Sapiens
SLLPQHLSI

SEQ ID NO: 627876 - protein, 9 aa, Homo Sapiens
GAPIGPPGS

SEQ ID NO: 627877 - protein, 9 aa, Homo Sapiens
HFFHPHHIV

SEQ ID NO: 627878 - protein, 9 aa, Homo Sapiens
CMKLMQQQQ

SEQ ID NO: 627879 - protein, 9 aa, Homo Sapiens
VVLIPWMEY

SEQ ID NO: 627880 - protein, 9 aa, Homo Sapiens
QSWCQGQLQ

SEQ ID NO: 627881 - protein, 9 aa, Homo Sapiens
GRCPTAFLV

SEQ ID NO: 627882 - protein, 9 aa, Homo Sapiens
IVGTVTLIP

SEQ ID NO: 627883 - protein, 9 aa, Homo Sapiens
LQECQDLDT

SEQ ID NO: 627884 - protein, 9 aa, Homo Sapiens
DALLEKQLK

SEQ ID NO: 627885 - protein, 9 aa, Homo Sapiens
TLITMNVPY

SEQ ID NO: 627886 - protein, 9 aa, Homo Sapiens
KGNSSSSAT

SEQ ID NO: 627887 - protein, 9 aa, Homo Sapiens
SFRKQRKAV

SEQ ID NO: 627888 - protein, 9 aa, Homo Sapiens
QLPLPCINS

SEQ ID NO: 627889 - protein, 9 aa, Homo Sapiens
FNPLLSHTG

SEQ ID NO: 627890 - protein, 9 aa, Homo Sapiens
AFGRIDFVV

SEQ ID NO: 627891 - protein, 9 aa, Homo Sapiens
ICCPLCRGV

SEQ ID NO: 627892 - protein, 9 aa, Homo Sapiens
KLIEVISMY

SEQ ID NO: 627893 - protein, 9 aa, Homo Sapiens
DWSCFLCLV

SEQ ID NO: 627894 - protein, 9 aa, Homo Sapiens
AEELFMIVL

SEQ ID NO: 627895 - protein, 9 aa, Homo Sapiens
CQLVGLNSP

SEQ ID NO: 627896 - protein, 9 aa, Homo Sapiens
SVEPQRQWQ

SEQ ID NO: 627897 - protein, 9 aa, Homo Sapiens
AKGTSGGDC

SEQ ID NO: 627898 - protein, 9 aa, Homo Sapiens
KRGLFRVTL

SEQ ID NO: 627899 - protein, 9 aa, Homo Sapiens
RTEQAEADK

SEQ ID NO: 627900 - protein, 9 aa, Homo Sapiens
GLREAVDCV

SEQ ID NO: 627901 - protein, 9 aa, Homo Sapiens
EEGELILSM

SEQ ID NO: 627902 - protein, 9 aa, Homo Sapiens
ASVEPQRQW

SEQ ID NO: 627903 - protein, 9 aa, Homo Sapiens
FLALLTCLL

SEQ ID NO: 627904 - protein, 9 aa, Homo Sapiens
GGSVSKLFS

SEQ ID NO: 627905 - protein, 9 aa, Homo Sapiens
YSRQGLVAR

SEQ ID NO: 627906 - protein, 9 aa, Homo Sapiens
ITPDEYMLS

SEQ ID NO: 627907 - protein, 9 aa, Homo Sapiens
NPDRLSYFH

SEQ ID NO: 627908 - protein, 9 aa, Homo Sapiens
QVLAGAESS

SEQ ID NO: 627909 - protein, 9 aa, Homo Sapiens
VGLVVEGVP

SEQ ID NO: 627910 - protein, 9 aa, Homo Sapiens
SGMRSVQWF

SEQ ID NO: 627911 - protein, 9 aa, Homo Sapiens
ALSSEVLVC

SEQ ID NO: 627912 - protein, 9 aa, Homo Sapiens
SLALDSKSL

SEQ ID NO: 627913 - protein, 9 aa, Homo Sapiens
DDDVEEMET

SEQ ID NO: 627914 - protein, 9 aa, Homo Sapiens
TPSRANPSP

SEQ ID NO: 627915 - protein, 9 aa, Homo Sapiens
TITSVSGGR

SEQ ID NO: 627916 - protein, 9 aa, Homo Sapiens
SLCFRKNSA

SEQ ID NO: 627917 - protein, 9 aa, Homo Sapiens
SLSTFGFVV

SEQ ID NO: 627918 - protein, 9 aa, Homo Sapiens
PAPGSPSQV

SEQ ID NO: 627919 - protein, 9 aa, Homo Sapiens
IKEECSTLH

SEQ ID NO: 627920 - protein, 9 aa, Homo Sapiens
TSLSAHGRG

SEQ ID NO: 627921 - protein, 9 aa, Homo Sapiens
LEVAHTCAF

SEQ ID NO: 627922 - protein, 9 aa, Homo Sapiens
TTHYCMFLK

SEQ ID NO: 627923 - protein, 9 aa, Homo Sapiens
EQQRLIFAG

SEQ ID NO: 627924 - protein, 9 aa, Homo Sapiens
LSFVDLAGS

SEQ ID NO: 627925 - protein, 9 aa, Homo Sapiens
NLAAVLTFG

SEQ ID NO: 627926 - protein, 9 aa, Homo Sapiens
KLQAQRSTT

SEQ ID NO: 627927 - protein, 9 aa, Homo Sapiens
PVTPGVVLV

SEQ ID NO: 627928 - protein, 9 aa, Homo Sapiens
DGSSRYGPS

SEQ ID NO: 627929 - protein, 9 aa, Homo Sapiens
FFKTLSNIG

SEQ ID NO: 627930 - protein, 9 aa, Homo Sapiens
DTEEKRHRK

SEQ ID NO: 627931 - protein, 9 aa, Homo Sapiens
EATCIWDHG

SEQ ID NO: 627932 - protein, 9 aa, Homo Sapiens
TEEIGKTFK

SEQ ID NO: 627933 - protein, 9 aa, Homo Sapiens
SPIKEKSRK

SEQ ID NO: 627934 - protein, 9 aa, Homo Sapiens
PIGPPGSPY

SEQ ID NO: 627935 - protein, 9 aa, Homo Sapiens
FKSLRDDFG

SEQ ID NO: 627936 - protein, 9 aa, Homo Sapiens
KTVFGYLKA

SEQ ID NO: 627937 - protein, 9 aa, Homo Sapiens
EKTFNCKMS

SEQ ID NO: 627938 - protein, 9 aa, Homo Sapiens
ITSVHLRRE

SEQ ID NO: 627939 - protein, 9 aa, Homo Sapiens
LYLAHLWVV

SEQ ID NO: 627940 - protein, 9 aa, Homo Sapiens
CVDEEKWHQ

SEQ ID NO: 627941 - protein, 9 aa, Homo Sapiens
NCSVAPCEG

SEQ ID NO: 627942 - protein, 9 aa, Homo Sapiens
QQWSAQTPH

SEQ ID NO: 627943 - protein, 9 aa, Homo Sapiens
QPHTTPSPG

SEQ ID NO: 627944 - protein, 9 aa, Homo Sapiens
AQRCHSLLS

SEQ ID NO: 627945 - protein, 9 aa, Homo Sapiens
DLLSRVHGH

SEQ ID NO: 627946 - protein, 9 aa, Homo Sapiens
INPDRLSYF

SEQ ID NO: 627947 - protein, 9 aa, Homo Sapiens
GVSIHSQWV

SEQ ID NO: 627948 - protein, 9 aa, Homo Sapiens
NKGKYFVTF

SEQ ID NO: 627949 - protein, 9 aa, Homo Sapiens
RRLSAHVWR

SEQ ID NO: 627950 - protein, 9 aa, Homo Sapiens
HNLERKNAG

SEQ ID NO: 627951 - protein, 9 aa, Homo Sapiens
LKGNLHNLE

SEQ ID NO: 627952 - protein, 9 aa, Homo Sapiens
WEYPRLENV

SEQ ID NO: 627953 - protein, 9 aa, Homo Sapiens
IGKESWFER

SEQ ID NO: 627954 - protein, 9 aa, Homo Sapiens
SSFTSFIAI

SEQ ID NO: 627955 - protein, 9 aa, Homo Sapiens
VYSLGLSFA

SEQ ID NO: 627956 - protein, 9 aa, Homo Sapiens
ELFQDPSEG

SEQ ID NO: 627957 - protein, 9 aa, Homo Sapiens
VVCPEEHVH

SEQ ID NO: 627958 - protein, 9 aa, Homo Sapiens
TILIRFLCC

SEQ ID NO: 627959 - protein, 9 aa, Homo Sapiens
EKINKIMWL

SEQ ID NO: 627960 - protein, 9 aa, Homo Sapiens
YCRPGFDLA

SEQ ID NO: 627961 - protein, 9 aa, Homo Sapiens
ESLSCEYEA

SEQ ID NO: 627962 - protein, 9 aa, Homo Sapiens
KAVLLLALS

SEQ ID NO: 627963 - protein, 9 aa, Homo Sapiens
EHSPIKEKS

SEQ ID NO: 627964 - protein, 9 aa, Homo Sapiens
EGTMPPYKE

SEQ ID NO: 627965 - protein, 9 aa, Homo Sapiens
EEMISTLLK

SEQ ID NO: 627966 - protein, 9 aa, Homo Sapiens
PQYQNGNPS

SEQ ID NO: 627967 - protein, 9 aa, Homo Sapiens
TLSISGIFK

SEQ ID NO: 627968 - protein, 9 aa, Homo Sapiens
SNQYVIKAV

SEQ ID NO: 627969 - protein, 9 aa, Homo Sapiens
VVEEDKEDE

SEQ ID NO: 627970 - protein, 9 aa, Homo Sapiens
KNKGSRPYS

SEQ ID NO: 627971 - protein, 9 aa, Homo Sapiens
FDLYSYDYF

SEQ ID NO: 627972 - protein, 9 aa, Homo Sapiens
LAEMTSSVK

SEQ ID NO: 627973 - protein, 9 aa, Homo Sapiens
QSSRSERLV

SEQ ID NO: 627974 - protein, 9 aa, Homo Sapiens
WEAIRQASR

SEQ ID NO: 627975 - protein, 9 aa, Homo Sapiens
EIDKTEKSV

SEQ ID NO: 627976 - protein, 9 aa, Homo Sapiens
YEEEKRHLH

SEQ ID NO: 627977 - protein, 9 aa, Homo Sapiens
PLIVFLHLA

SEQ ID NO: 627978 - protein, 9 aa, Homo Sapiens
CNNRDFPEW

SEQ ID NO: 627979 - protein, 9 aa, Homo Sapiens
HDPKYPVEN

SEQ ID NO: 627980 - protein, 9 aa, Homo Sapiens
TTGADVCFA

SEQ ID NO: 627981 - protein, 9 aa, Homo Sapiens
AKTGILWLL

SEQ ID NO: 627982 - protein, 9 aa, Homo Sapiens
IFSAAKNCS

SEQ ID NO: 627983 - protein, 9 aa, Homo Sapiens
APGFRMALK

SEQ ID NO: 627984 - protein, 9 aa, Homo Sapiens
CQGLLFDIV

SEQ ID NO: 627985 - protein, 9 aa, Homo Sapiens
IRPNEVYLD

SEQ ID NO: 627986 - protein, 9 aa, Homo Sapiens
SQDGKDTIR

SEQ ID NO: 627987 - protein, 9 aa, Homo Sapiens
VGNITSVHL

SEQ ID NO: 627988 - protein, 9 aa, Homo Sapiens
QHPLGSKHV

SEQ ID NO: 627989 - protein, 9 aa, Homo Sapiens
AHKAQRDPL

SEQ ID NO: 627990 - protein, 9 aa, Homo Sapiens
PVAVAYACN

SEQ ID NO: 627991 - protein, 9 aa, Homo Sapiens
YCGRDPSGS

SEQ ID NO: 627992 - protein, 9 aa, Homo Sapiens
YCVPEGDAL

SEQ ID NO: 627993 - protein, 9 aa, Homo Sapiens
NIRDMSENV

SEQ ID NO: 627994 - protein, 9 aa, Homo Sapiens
TPKGGVACY

SEQ ID NO: 627995 - protein, 9 aa, Homo Sapiens
DSMEGMRSP

SEQ ID NO: 627996 - protein, 9 aa, Homo Sapiens
IPPEQQRLI

SEQ ID NO: 627997 - protein, 9 aa, Homo Sapiens
MESLPPVRS

SEQ ID NO: 627998 - protein, 9 aa, Homo Sapiens
GKAGLVSVA

SEQ ID NO: 627999 - protein, 9 aa, Homo Sapiens
PFEEMISTL

SEQ ID NO: 628000 - protein, 9 aa, Homo Sapiens
SHVVSFSSH

SEQ ID NO: 628001 - protein, 9 aa, Homo Sapiens
WQQLNEIHS

SEQ ID NO: 628002 - protein, 9 aa, Homo Sapiens
IFDGSAMAA

SEQ ID NO: 628003 - protein, 9 aa, Homo Sapiens
SHDESQSSH

SEQ ID NO: 628004 - protein, 9 aa, Homo Sapiens
QRIVALSLM

SEQ ID NO: 628005 - protein, 9 aa, Homo Sapiens
LIQAKKKSG

SEQ ID NO: 628006 - protein, 9 aa, Homo Sapiens
HGRGPLATG

SEQ ID NO: 628007 - protein, 9 aa, Homo Sapiens
VVGGYRGVS

SEQ ID NO: 628008 - protein, 9 aa, Homo Sapiens
AQVVFNPLL

SEQ ID NO: 628009 - protein, 9 aa, Homo Sapiens
GHLQVEPPA

SEQ ID NO: 628010 - protein, 9 aa, Homo Sapiens
IEKIRFFRV

SEQ ID NO: 628011 - protein, 9 aa, Homo Sapiens
IAGLLRAHE

SEQ ID NO: 628012 - protein, 9 aa, Homo Sapiens
CKALGSARS

SEQ ID NO: 628013 - protein, 9 aa, Homo Sapiens
PQGLYYAVR

SEQ ID NO: 628014 - protein, 9 aa, Homo Sapiens
TDCADKENP

SEQ ID NO: 628015 - protein, 9 aa, Homo Sapiens
EGPGAEGSR

SEQ ID NO: 628016 - protein, 9 aa, Homo Sapiens
LAWPLWDLG

SEQ ID NO: 628017 - protein, 9 aa, Homo Sapiens
HSPPPVPGE

SEQ ID NO: 628018 - protein, 9 aa, Homo Sapiens
IHAFPSSLI

SEQ ID NO: 628019 - protein, 9 aa, Homo Sapiens
HGRCPTAFL

SEQ ID NO: 628020 - protein, 9 aa, Homo Sapiens
QGDLPWLIQ

SEQ ID NO: 628021 - protein, 9 aa, Homo Sapiens
SFNLPFPNS

SEQ ID NO: 628022 - protein, 9 aa, Homo Sapiens
KEDSGTVPS

SEQ ID NO: 628023 - protein, 9 aa, Homo Sapiens
NPFVEDNFS

SEQ ID NO: 628024 - protein, 9 aa, Homo Sapiens
NVTLLCLSW

SEQ ID NO: 628025 - protein, 9 aa, Homo Sapiens
NQRPHQFRR

SEQ ID NO: 628026 - protein, 9 aa, Homo Sapiens
CPEEHVHLR

SEQ ID NO: 628027 - protein, 9 aa, Homo Sapiens
VTTSQLECC

SEQ ID NO: 628028 - protein, 9 aa, Homo Sapiens
HVQTLGYTK

SEQ ID NO: 628029 - protein, 9 aa, Homo Sapiens
SLFVGLIIP

SEQ ID NO: 628030 - protein, 9 aa, Homo Sapiens
DMTSLNVKA

SEQ ID NO: 628031 - protein, 9 aa, Homo Sapiens
LLLASSVEL

SEQ ID NO: 628032 - protein, 9 aa, Homo Sapiens
SNYLNWVVR

SEQ ID NO: 628033 - protein, 9 aa, Homo Sapiens
AGYVSVLFL

SEQ ID NO: 628034 - protein, 9 aa, Homo Sapiens
TVTDLQEIL

SEQ ID NO: 628035 - protein, 9 aa, Homo Sapiens
NTHVHDAQC

SEQ ID NO: 628036 - protein, 9 aa, Homo Sapiens
LPTSPPPHD

SEQ ID NO: 628037 - protein, 9 aa, Homo Sapiens
IVSVTSSAS

SEQ ID NO: 628038 - protein, 9 aa, Homo Sapiens
PSSTMVRTS

SEQ ID NO: 628039 - protein, 9 aa, Homo Sapiens
VSFCHILIR

SEQ ID NO: 628040 - protein, 9 aa, Homo Sapiens
GFRLLFYTM

SEQ ID NO: 628041 - protein, 9 aa, Homo Sapiens
GRARPCLCS

SEQ ID NO: 628042 - protein, 9 aa, Homo Sapiens
SKYHTEQSL

SEQ ID NO: 628043 - protein, 9 aa, Homo Sapiens
PLSHPMTEA

SEQ ID NO: 628044 - protein, 9 aa, Homo Sapiens
GRIDFVVNN

SEQ ID NO: 628045 - protein, 9 aa, Homo Sapiens
DGKDVSPGE

SEQ ID NO: 628046 - protein, 9 aa, Homo Sapiens
GHYTVIENS

SEQ ID NO: 628047 - protein, 9 aa, Homo Sapiens
IQSHPHLVE

SEQ ID NO: 628048 - protein, 9 aa, Homo Sapiens
LTGECMDLI

SEQ ID NO: 628049 - protein, 9 aa, Homo Sapiens
MNHPHMQAP

SEQ ID NO: 628050 - protein, 9 aa, Homo Sapiens
DLQEILGCL

SEQ ID NO: 628051 - protein, 9 aa, Homo Sapiens
RVQNAYTLR

SEQ ID NO: 628052 - protein, 9 aa, Homo Sapiens
GKLQAQRST

SEQ ID NO: 628053 - protein, 9 aa, Homo Sapiens
ALEDLHMVL

SEQ ID NO: 628054 - protein, 9 aa, Homo Sapiens
RLARKAHVA

SEQ ID NO: 628055 - protein, 9 aa, Homo Sapiens
PVTQPLRAT

SEQ ID NO: 628056 - protein, 9 aa, Homo Sapiens
HVDACTSRV

SEQ ID NO: 628057 - protein, 9 aa, Homo Sapiens
LRRLVMYCA

SEQ ID NO: 628058 - protein, 9 aa, Homo Sapiens
YEFDKMNES

SEQ ID NO: 628059 - protein, 9 aa, Homo Sapiens
ERLVADEAW

SEQ ID NO: 628060 - protein, 9 aa, Homo Sapiens
AANCMPIGI

SEQ ID NO: 628061 - protein, 9 aa, Homo Sapiens
IPGSLLDVS

SEQ ID NO: 628062 - protein, 9 aa, Homo Sapiens
CVSSLTILI

SEQ ID NO: 628063 - protein, 9 aa, Homo Sapiens
EFQLFFANG

SEQ ID NO: 628064 - protein, 9 aa, Homo Sapiens
EIEKDIQDF

SEQ ID NO: 628065 - protein, 9 aa, Homo Sapiens
RLPENIIHA

SEQ ID NO: 628066 - protein, 9 aa, Homo Sapiens
PLVWKPGDW

SEQ ID NO: 628067 - protein, 9 aa, Homo Sapiens
SYVTATDLF

SEQ ID NO: 628068 - protein, 9 aa, Homo Sapiens
LSSIAIQYT

SEQ ID NO: 628069 - protein, 9 aa, Homo Sapiens
EEDVVWLTE

SEQ ID NO: 628070 - protein, 9 aa, Homo Sapiens
VAESFQMHI

SEQ ID NO: 628071 - protein, 9 aa, Homo Sapiens
ILLLFCIFI

SEQ ID NO: 628072 - protein, 9 aa, Homo Sapiens
LICCDELNL

SEQ ID NO: 628073 - protein, 9 aa, Homo Sapiens
PLDNTAVRN

SEQ ID NO: 628074 - protein, 9 aa, Homo Sapiens
TSVKKGETP

SEQ ID NO: 628075 - protein, 9 aa, Homo Sapiens
LGCVRFDCD

SEQ ID NO: 628076 - protein, 9 aa, Homo Sapiens
SYTIHAEGY

SEQ ID NO: 628077 - protein, 9 aa, Homo Sapiens
LLLLFLIIR

SEQ ID NO: 628078 - protein, 9 aa, Homo Sapiens
LLGLALVLL

SEQ ID NO: 628079 - protein, 9 aa, Homo Sapiens
SKFPLDNTA

SEQ ID NO: 628080 - protein, 9 aa, Homo Sapiens
LGPGLLRGP

SEQ ID NO: 628081 - protein, 9 aa, Homo Sapiens
VISGYSLEV

SEQ ID NO: 628082 - protein, 9 aa, Homo Sapiens
ELSQLIGTG

SEQ ID NO: 628083 - protein, 9 aa, Homo Sapiens
IRYCMEKEG

SEQ ID NO: 628084 - protein, 9 aa, Homo Sapiens
VENGWPSLC

SEQ ID NO: 628085 - protein, 9 aa, Homo Sapiens
TNMANHVAC

SEQ ID NO: 628086 - protein, 9 aa, Homo Sapiens
HGLVVQAKV

SEQ ID NO: 628087 - protein, 9 aa, Homo Sapiens
EGNGVGRPP

SEQ ID NO: 628088 - protein, 9 aa, Homo Sapiens
PWTVHLAPK

SEQ ID NO: 628089 - protein, 9 aa, Homo Sapiens
WPEVSRGTA

SEQ ID NO: 628090 - protein, 9 aa, Homo Sapiens
GPRQPSPWP

SEQ ID NO: 628091 - protein, 9 aa, Homo Sapiens
YSWDKKNKE

SEQ ID NO: 628092 - protein, 9 aa, Homo Sapiens
LPRLRAELP

SEQ ID NO: 628093 - protein, 9 aa, Homo Sapiens
WRRIADPYQ

SEQ ID NO: 628094 - protein, 9 aa, Homo Sapiens
GEWNLKSPN

SEQ ID NO: 628095 - protein, 9 aa, Homo Sapiens
LLDRLDRDQ

SEQ ID NO: 628096 - protein, 9 aa, Homo Sapiens
SVVGSWSYS

SEQ ID NO: 628097 - protein, 9 aa, Homo Sapiens
VPPLMGSFK

SEQ ID NO: 628098 - protein, 9 aa, Homo Sapiens
VMIGLLMFS

SEQ ID NO: 628099 - protein, 9 aa, Homo Sapiens
MASCGPQVG

SEQ ID NO: 628100 - protein, 9 aa, Homo Sapiens
RAARFGAHH

SEQ ID NO: 628101 - protein, 9 aa, Homo Sapiens
AGAESSQEE

SEQ ID NO: 628102 - protein, 9 aa, Homo Sapiens
GADIRQNRS

SEQ ID NO: 628103 - protein, 9 aa, Homo Sapiens
SAPFVPRDV

SEQ ID NO: 628104 - protein, 9 aa, Homo Sapiens
HGITGDKEG

SEQ ID NO: 628105 - protein, 9 aa, Homo Sapiens
RSHYVAKTG

SEQ ID NO: 628106 - protein, 9 aa, Homo Sapiens
LGPSLSQGV

SEQ ID NO: 628107 - protein, 9 aa, Homo Sapiens
PFRHCEPAL

SEQ ID NO: 628108 - protein, 9 aa, Homo Sapiens
QSQSQNMFT

SEQ ID NO: 628109 - protein, 9 aa, Homo Sapiens
SEDSRGDAR

SEQ ID NO: 628110 - protein, 9 aa, Homo Sapiens
GHTEIDHHK

SEQ ID NO: 628111 - protein, 9 aa, Homo Sapiens
TPGSTAISP

SEQ ID NO: 628112 - protein, 9 aa, Homo Sapiens
ADAQSSRSE

SEQ ID NO: 628113 - protein, 9 aa, Homo Sapiens
SISLPVIGS

SEQ ID NO: 628114 - protein, 9 aa, Homo Sapiens
ENVLYQNRN

SEQ ID NO: 628115 - protein, 9 aa, Homo Sapiens
SAVDTDGKG

SEQ ID NO: 628116 - protein, 9 aa, Homo Sapiens
SVWDKNATD

SEQ ID NO: 628117 - protein, 9 aa, Homo Sapiens
ADNRGGEVI

SEQ ID NO: 628118 - protein, 9 aa, Homo Sapiens
MDFNATGRI

SEQ ID NO: 628119 - protein, 9 aa, Homo Sapiens
GHGLPGSKG

SEQ ID NO: 628120 - protein, 9 aa, Homo Sapiens
YALKTVIND

SEQ ID NO: 628121 - protein, 9 aa, Homo Sapiens
QRVCSREGP

SEQ ID NO: 628122 - protein, 9 aa, Homo Sapiens
LVKKGLRHG

SEQ ID NO: 628123 - protein, 9 aa, Homo Sapiens
RASELRFYV

SEQ ID NO: 628124 - protein, 9 aa, Homo Sapiens
CCIYEFDKM

SEQ ID NO: 628125 - protein, 9 aa, Homo Sapiens
NIHSSISHD

SEQ ID NO: 628126 - protein, 9 aa, Homo Sapiens
SEGDYAPLQ

SEQ ID NO: 628127 - protein, 9 aa, Homo Sapiens
PESRASTIT

SEQ ID NO: 628128 - protein, 9 aa, Homo Sapiens
PDSMAPAEE

SEQ ID NO: 628129 - protein, 9 aa, Homo Sapiens
NSSESTSNP

SEQ ID NO: 628130 - protein, 9 aa, Homo Sapiens
GAETGIFLL

SEQ ID NO: 628131 - protein, 9 aa, Homo Sapiens
PPSVRGNVW

SEQ ID NO: 628132 - protein, 9 aa, Homo Sapiens
EEQYVGTFY

SEQ ID NO: 628133 - protein, 9 aa, Homo Sapiens
NSTVCEHFD

SEQ ID NO: 628134 - protein, 9 aa, Homo Sapiens
STFGFVVAA

SEQ ID NO: 628135 - protein, 9 aa, Homo Sapiens
AGTQGKKSA

SEQ ID NO: 628136 - protein, 9 aa, Homo Sapiens
SPQELSFLR

SEQ ID NO: 628137 - protein, 9 aa, Homo Sapiens
EWMKVHHVN

SEQ ID NO: 628138 - protein, 9 aa, Homo Sapiens
TVTYDWNAL

SEQ ID NO: 628139 - protein, 9 aa, Homo Sapiens
MERFPYVAL

SEQ ID NO: 628140 - protein, 9 aa, Homo Sapiens
VGLLPETPR

SEQ ID NO: 628141 - protein, 9 aa, Homo Sapiens
LLASSVELE

SEQ ID NO: 628142 - protein, 9 aa, Homo Sapiens
EYEAIKQQQ

SEQ ID NO: 628143 - protein, 9 aa, Homo Sapiens
FYMQSVHLQ

SEQ ID NO: 628144 - protein, 9 aa, Homo Sapiens
YWIQEKPDV

SEQ ID NO: 628145 - protein, 9 aa, Homo Sapiens
PELYGKTAK

SEQ ID NO: 628146 - protein, 9 aa, Homo Sapiens
KRTQWEYPR

SEQ ID NO: 628147 - protein, 9 aa, Homo Sapiens
GPQGPAGHG

SEQ ID NO: 628148 - protein, 9 aa, Homo Sapiens
GIPTDDSTF

SEQ ID NO: 628149 - protein, 9 aa, Homo Sapiens
LTLITMNVP

SEQ ID NO: 628150 - protein, 9 aa, Homo Sapiens
EHLPFMGSI

SEQ ID NO: 628151 - protein, 9 aa, Homo Sapiens
SPAPQHKKS

SEQ ID NO: 628152 - protein, 9 aa, Homo Sapiens
SAHCSVVYL

SEQ ID NO: 628153 - protein, 9 aa, Homo Sapiens
YYKATKCHG

SEQ ID NO: 628154 - protein, 9 aa, Homo Sapiens
EGVPNVILS

SEQ ID NO: 628155 - protein, 9 aa, Homo Sapiens
VGTVTLIPL

SEQ ID NO: 628156 - protein, 9 aa, Homo Sapiens
HFAGGQIFF

SEQ ID NO: 628157 - protein, 9 aa, Homo Sapiens
YDFQARSHR

SEQ ID NO: 628158 - protein, 9 aa, Homo Sapiens
RYLPDCDYL

SEQ ID NO: 628159 - protein, 9 aa, Homo Sapiens
SLVGLLNSM

SEQ ID NO: 628160 - protein, 9 aa, Homo Sapiens
LDSLSMSTR

SEQ ID NO: 628161 - protein, 9 aa, Homo Sapiens
QSSPENLVS

SEQ ID NO: 628162 - protein, 9 aa, Homo Sapiens
TDLQEILGC

SEQ ID NO: 628163 - protein, 9 aa, Homo Sapiens
PPGTPEIQA

SEQ ID NO: 628164 - protein, 9 aa, Homo Sapiens
PEVSRGTAA

SEQ ID NO: 628165 - protein, 9 aa, Homo Sapiens
VCSSVVGSW

SEQ ID NO: 628166 - protein, 9 aa, Homo Sapiens
SSQHNGTMY

SEQ ID NO: 628167 - protein, 9 aa, Homo Sapiens
NEAGHRKDL

SEQ ID NO: 628168 - protein, 9 aa, Homo Sapiens
RSMAVRIQA

SEQ ID NO: 628169 - protein, 9 aa, Homo Sapiens
QVEPPAQAP

SEQ ID NO: 628170 - protein, 9 aa, Homo Sapiens
ACLPGPPGT

SEQ ID NO: 628171 - protein, 9 aa, Homo Sapiens
VHCPAEKFS

SEQ ID NO: 628172 - protein, 9 aa, Homo Sapiens
STLHNIIKG

SEQ ID NO: 628173 - protein, 9 aa, Homo Sapiens
GLALVLLKA

SEQ ID NO: 628174 - protein, 9 aa, Homo Sapiens
GFAQHGHTL

SEQ ID NO: 628175 - protein, 9 aa, Homo Sapiens
MLAFDLNDE

SEQ ID NO: 628176 - protein, 9 aa, Homo Sapiens
KEIGDLRTQ

SEQ ID NO: 628177 - protein, 9 aa, Homo Sapiens
FLEAVVMKF

SEQ ID NO: 628178 - protein, 9 aa, Homo Sapiens
LALFLTILM

SEQ ID NO: 628179 - protein, 9 aa, Homo Sapiens
GGEDDDVEE

SEQ ID NO: 628180 - protein, 9 aa, Homo Sapiens
QKETKKYED

SEQ ID NO: 628181 - protein, 9 aa, Homo Sapiens
DEHHGASCM

SEQ ID NO: 628182 - protein, 9 aa, Homo Sapiens
SGGDCPHGP

SEQ ID NO: 628183 - protein, 9 aa, Homo Sapiens
YVVPCPVRF

SEQ ID NO: 628184 - protein, 9 aa, Homo Sapiens
FLWKNCEFL

SEQ ID NO: 628185 - protein, 9 aa, Homo Sapiens
SLSSSLVIH

SEQ ID NO: 628186 - protein, 9 aa, Homo Sapiens
RLEEELADI

SEQ ID NO: 628187 - protein, 9 aa, Homo Sapiens
PVCEESYLS

SEQ ID NO: 628188 - protein, 9 aa, Homo Sapiens
RLTVEESSR

SEQ ID NO: 628189 - protein, 9 aa, Homo Sapiens
ESLPPVRSS

SEQ ID NO: 628190 - protein, 9 aa, Homo Sapiens
EVLNMLTAQ

SEQ ID NO: 628191 - protein, 9 aa, Homo Sapiens
HCLDGEDVS

SEQ ID NO: 628192 - protein, 9 aa, Homo Sapiens
LYYAVRLRE

SEQ ID NO: 628193 - protein, 9 aa, Homo Sapiens
SMGLLYPSV

SEQ ID NO: 628194 - protein, 9 aa, Homo Sapiens
PKGGVACYC

SEQ ID NO: 628195 - protein, 9 aa, Homo Sapiens
VMERHHFAK

SEQ ID NO: 628196 - protein, 9 aa, Homo Sapiens
SEGTMPPYK

SEQ ID NO: 628197 - protein, 9 aa, Homo Sapiens
SECNCENLI

SEQ ID NO: 628198 - protein, 9 aa, Homo Sapiens
TEGHYTVIE

SEQ ID NO: 628199 - protein, 9 aa, Homo Sapiens
LDICVKYFS

SEQ ID NO: 628200 - protein, 9 aa, Homo Sapiens
KPSGRQTLS

SEQ ID NO: 628201 - protein, 9 aa, Homo Sapiens
FEFPIGCEQ

SEQ ID NO: 628202 - protein, 9 aa, Homo Sapiens
AVGFDIITM

SEQ ID NO: 628203 - protein, 9 aa, Homo Sapiens
LLSLVLGLS

SEQ ID NO: 628204 - protein, 9 aa, Homo Sapiens
REEGPSRRP

SEQ ID NO: 628205 - protein, 9 aa, Homo Sapiens
ELDSLSMST

SEQ ID NO: 628206 - protein, 9 aa, Homo Sapiens
CDGSSQSSS

SEQ ID NO: 628207 - protein, 9 aa, Homo Sapiens
VTLKDGATY

SEQ ID NO: 628208 - protein, 9 aa, Homo Sapiens
FGVDTSSLI

SEQ ID NO: 628209 - protein, 9 aa, Homo Sapiens
FKTLSNIGI

SEQ ID NO: 628210 - protein, 9 aa, Homo Sapiens
CFLYQHLPV

SEQ ID NO: 628211 - protein, 9 aa, Homo Sapiens
LRAILTCSV

SEQ ID NO: 628212 - protein, 9 aa, Homo Sapiens
VPFEEMIST

SEQ ID NO: 628213 - protein, 9 aa, Homo Sapiens
RYPIMYVAY

SEQ ID NO: 628214 - protein, 9 aa, Homo Sapiens
GTFDWLVNL

SEQ ID NO: 628215 - protein, 9 aa, Homo Sapiens
SSISLPVIG

SEQ ID NO: 628216 - protein, 9 aa, Homo Sapiens
KRPSIDGRD

SEQ ID NO: 628217 - protein, 9 aa, Homo Sapiens
GLPYCEAYY

SEQ ID NO: 628218 - protein, 9 aa, Homo Sapiens
PKGDCAKGD

SEQ ID NO: 628219 - protein, 9 aa, Homo Sapiens
KWRRIADPY

SEQ ID NO: 628220 - protein, 9 aa, Homo Sapiens
SPPPHDSLS

SEQ ID NO: 628221 - protein, 9 aa, Homo Sapiens
FANGVLNEK

SEQ ID NO: 628222 - protein, 9 aa, Homo Sapiens
ILGYTPVSN

SEQ ID NO: 628223 - protein, 9 aa, Homo Sapiens
HKEYYRGRN

SEQ ID NO: 628224 - protein, 9 aa, Homo Sapiens
ATKIGKESW

SEQ ID NO: 628225 - protein, 9 aa, Homo Sapiens
MKSLKQEKS

SEQ ID NO: 628226 - protein, 9 aa, Homo Sapiens
GDFRLATVK

SEQ ID NO: 628227 - protein, 9 aa, Homo Sapiens
SSLFFSVNK

SEQ ID NO: 628228 - protein, 9 aa, Homo Sapiens
PSKDIKPDL

SEQ ID NO: 628229 - protein, 9 aa, Homo Sapiens
YYVITTQHW

SEQ ID NO: 628230 - protein, 9 aa, Homo Sapiens
YVGFTKKWR

SEQ ID NO: 628231 - protein, 9 aa, Homo Sapiens
TSSLFFSVN

SEQ ID NO: 628232 - protein, 9 aa, Homo Sapiens
VTEDALHPV

SEQ ID NO: 628233 - protein, 9 aa, Homo Sapiens
SLALFLTIL

SEQ ID NO: 628234 - protein, 9 aa, Homo Sapiens
RLVADEAWV

SEQ ID NO: 628235 - protein, 9 aa, Homo Sapiens
SHVTADVVL

SEQ ID NO: 628236 - protein, 9 aa, Homo Sapiens
CEESYLSVT

SEQ ID NO: 628237 - protein, 9 aa, Homo Sapiens
VESPRLEEE

SEQ ID NO: 628238 - protein, 9 aa, Homo Sapiens
FVNTIAYRP

SEQ ID NO: 628239 - protein, 9 aa, Homo Sapiens
GSDGCADRY

SEQ ID NO: 628240 - protein, 9 aa, Homo Sapiens
PDDSCKPNS

SEQ ID NO: 628241 - protein, 9 aa, Homo Sapiens
TGLKTTTLG

SEQ ID NO: 628242 - protein, 9 aa, Homo Sapiens
SPLVLEGTN

SEQ ID NO: 628243 - protein, 9 aa, Homo Sapiens
RLSYFHFVG

SEQ ID NO: 628244 - protein, 9 aa, Homo Sapiens
LWKDPSWAA

SEQ ID NO: 628245 - protein, 9 aa, Homo Sapiens
ARCSAIGTW

SEQ ID NO: 628246 - protein, 9 aa, Homo Sapiens
LRRLLHWEE

SEQ ID NO: 628247 - protein, 9 aa, Homo Sapiens
ASWVYRKIS

SEQ ID NO: 628248 - protein, 9 aa, Homo Sapiens
RNLAKSLTV

SEQ ID NO: 628249 - protein, 9 aa, Homo Sapiens
TGWQVQTCE

SEQ ID NO: 628250 - protein, 9 aa, Homo Sapiens
FVIVSASYS

SEQ ID NO: 628251 - protein, 9 aa, Homo Sapiens
VIENSQAIL

SEQ ID NO: 628252 - protein, 9 aa, Homo Sapiens
YFDSTCEHC

SEQ ID NO: 628253 - protein, 9 aa, Homo Sapiens
IVIGILVAK

SEQ ID NO: 628254 - protein, 9 aa, Homo Sapiens
PVQKGEPGL

SEQ ID NO: 628255 - protein, 9 aa, Homo Sapiens
ENEGTSAAL

SEQ ID NO: 628256 - protein, 9 aa, Homo Sapiens
FCEKTLFCF

SEQ ID NO: 628257 - protein, 9 aa, Homo Sapiens
GGKVSQPEP

SEQ ID NO: 628258 - protein, 9 aa, Homo Sapiens
FLMANLVSG

SEQ ID NO: 628259 - protein, 9 aa, Homo Sapiens
KTRSGTHSH

SEQ ID NO: 628260 - protein, 9 aa, Homo Sapiens
KVNGVKNIT

SEQ ID NO: 628261 - protein, 9 aa, Homo Sapiens
DIKNEVGDV

SEQ ID NO: 628262 - protein, 9 aa, Homo Sapiens
QALLDKLWI

SEQ ID NO: 628263 - protein, 9 aa, Homo Sapiens
KKRPSIDGR

SEQ ID NO: 628264 - protein, 9 aa, Homo Sapiens
GGDCPHGPP

SEQ ID NO: 628265 - protein, 9 aa, Homo Sapiens
QSTSLHNCK

SEQ ID NO: 628266 - protein, 9 aa, Homo Sapiens
LTLSLPPEP

SEQ ID NO: 628267 - protein, 9 aa, Homo Sapiens
APIPGSLLD

SEQ ID NO: 628268 - protein, 9 aa, Homo Sapiens
LSPSQGQNT

SEQ ID NO: 628269 - protein, 9 aa, Homo Sapiens
CSTIIQHQR

SEQ ID NO: 628270 - protein, 9 aa, Homo Sapiens
HSADLENPL

SEQ ID NO: 628271 - protein, 9 aa, Homo Sapiens
GGGKVSQPE

SEQ ID NO: 628272 - protein, 9 aa, Homo Sapiens
TTTNKEKEE

SEQ ID NO: 628273 - protein, 9 aa, Homo Sapiens
FLIIAGMHL

SEQ ID NO: 628274 - protein, 9 aa, Homo Sapiens
LRREVETEP

SEQ ID NO: 628275 - protein, 9 aa, Homo Sapiens
RKRHQDMFH

SEQ ID NO: 628276 - protein, 9 aa, Homo Sapiens
VPRKEDHTP

SEQ ID NO: 628277 - protein, 9 aa, Homo Sapiens
HNCSVAPCE

SEQ ID NO: 628278 - protein, 9 aa, Homo Sapiens
RRTLHSMPL

SEQ ID NO: 628279 - protein, 9 aa, Homo Sapiens
LEKNATYNI

SEQ ID NO: 628280 - protein, 9 aa, Homo Sapiens
ALNSAPSPP

SEQ ID NO: 628281 - protein, 9 aa, Homo Sapiens
DVCRVGGQR

SEQ ID NO: 628282 - protein, 9 aa, Homo Sapiens
EAPPAASSI

SEQ ID NO: 628283 - protein, 9 aa, Homo Sapiens
AFIAFGVDT

SEQ ID NO: 628284 - protein, 9 aa, Homo Sapiens
RILNPGEYS

SEQ ID NO: 628285 - protein, 9 aa, Homo Sapiens
LLLLRLRRW

SEQ ID NO: 628286 - protein, 9 aa, Homo Sapiens
TDLFVSVCF

SEQ ID NO: 628287 - protein, 9 aa, Homo Sapiens
PQAREEGPS

SEQ ID NO: 628288 - protein, 9 aa, Homo Sapiens
IMWLPQQNA

SEQ ID NO: 628289 - protein, 9 aa, Homo Sapiens
KILDSLERA

SEQ ID NO: 628290 - protein, 9 aa, Homo Sapiens
TLWSSRSVM

SEQ ID NO: 628291 - protein, 9 aa, Homo Sapiens
EVISMYREL

SEQ ID NO: 628292 - protein, 9 aa, Homo Sapiens
EPALGNETV

SEQ ID NO: 628293 - protein, 9 aa, Homo Sapiens
LSSQASVAE

SEQ ID NO: 628294 - protein, 9 aa, Homo Sapiens
SEKLSKAEN

SEQ ID NO: 628295 - protein, 9 aa, Homo Sapiens
LLTLNDTFF

SEQ ID NO: 628296 - protein, 9 aa, Homo Sapiens
QQLGRGSPC

SEQ ID NO: 628297 - protein, 9 aa, Homo Sapiens
DGKWKSLTL

SEQ ID NO: 628298 - protein, 9 aa, Homo Sapiens
RPCLCSGPE

SEQ ID NO: 628299 - protein, 9 aa, Homo Sapiens
VFFQGNKYW

SEQ ID NO: 628300 - protein, 9 aa, Homo Sapiens
LLSEKLSKA

SEQ ID NO: 628301 - protein, 9 aa, Homo Sapiens
VYGQGDLPW

SEQ ID NO: 628302 - protein, 9 aa, Homo Sapiens
AYACPRLRL

SEQ ID NO: 628303 - protein, 9 aa, Homo Sapiens
EKSPVSKTY

SEQ ID NO: 628304 - protein, 9 aa, Homo Sapiens
ERPFLPFFL

SEQ ID NO: 628305 - protein, 9 aa, Homo Sapiens
CGIILLANP

SEQ ID NO: 628306 - protein, 9 aa, Homo Sapiens
QVAQPWPEV

SEQ ID NO: 628307 - protein, 9 aa, Homo Sapiens
ECEHVCSCT

SEQ ID NO: 628308 - protein, 9 aa, Homo Sapiens
PGLYHYPCF

SEQ ID NO: 628309 - protein, 9 aa, Homo Sapiens
GPARWMPPP

SEQ ID NO: 628310 - protein, 9 aa, Homo Sapiens
GSGGSVSKL

SEQ ID NO: 628311 - protein, 9 aa, Homo Sapiens
RLASVSKDT

SEQ ID NO: 628312 - protein, 9 aa, Homo Sapiens
RQRDLHKIM

SEQ ID NO: 628313 - protein, 9 aa, Homo Sapiens
FYLEDEWCA

SEQ ID NO: 628314 - protein, 9 aa, Homo Sapiens
MAAAAGHLD

SEQ ID NO: 628315 - protein, 9 aa, Homo Sapiens
SFKKAREEG

SEQ ID NO: 628316 - protein, 9 aa, Homo Sapiens
SGTVPSTGP

SEQ ID NO: 628317 - protein, 9 aa, Homo Sapiens
LPLQNSTVM

SEQ ID NO: 628318 - protein, 9 aa, Homo Sapiens
LVSITFRIP

SEQ ID NO: 628319 - protein, 9 aa, Homo Sapiens
TWHGDIISG

SEQ ID NO: 628320 - protein, 9 aa, Homo Sapiens
WDGVAKGVG

SEQ ID NO: 628321 - protein, 9 aa, Homo Sapiens
MTEAGPVGG

SEQ ID NO: 628322 - protein, 9 aa, Homo Sapiens
ANGMRRGLL

SEQ ID NO: 628323 - protein, 9 aa, Homo Sapiens
GAYLLTLND

SEQ ID NO: 628324 - protein, 9 aa, Homo Sapiens
LVADEAWVL

SEQ ID NO: 628325 - protein, 9 aa, Homo Sapiens
IKFCDMTVF

SEQ ID NO: 628326 - protein, 9 aa, Homo Sapiens
FINDEQQGS

SEQ ID NO: 628327 - protein, 9 aa, Homo Sapiens
NEQSSPPLS

SEQ ID NO: 628328 - protein, 9 aa, Homo Sapiens
LNQVAISQS

SEQ ID NO: 628329 - protein, 9 aa, Homo Sapiens
ALSVLMYLE

SEQ ID NO: 628330 - protein, 9 aa, Homo Sapiens
SFNQPLRQL

SEQ ID NO: 628331 - protein, 9 aa, Homo Sapiens
FITAICIGS

SEQ ID NO: 628332 - protein, 9 aa, Homo Sapiens
NDDYYVGEW

SEQ ID NO: 628333 - protein, 9 aa, Homo Sapiens
VLSSLQAII

SEQ ID NO: 628334 - protein, 9 aa, Homo Sapiens
IPQLQSSPE

SEQ ID NO: 628335 - protein, 9 aa, Homo Sapiens
HTTGIIEYP

SEQ ID NO: 628336 - protein, 9 aa, Homo Sapiens
GGRLASVSK

SEQ ID NO: 628337 - protein, 9 aa, Homo Sapiens
AARHHNLDM

SEQ ID NO: 628338 - protein, 9 aa, Homo Sapiens
SLSVTRSIH

SEQ ID NO: 628339 - protein, 9 aa, Homo Sapiens
PPLMGSFKP

SEQ ID NO: 628340 - protein, 9 aa, Homo Sapiens
EDEQSWCQG

SEQ ID NO: 628341 - protein, 9 aa, Homo Sapiens
ANCMPIGIP

SEQ ID NO: 628342 - protein, 9 aa, Homo Sapiens
CKLLAADGT

SEQ ID NO: 628343 - protein, 9 aa, Homo Sapiens
IYRHKEYYR

SEQ ID NO: 628344 - protein, 9 aa, Homo Sapiens
LKGLRVAAC

SEQ ID NO: 628345 - protein, 9 aa, Homo Sapiens
GALTQTVRV

SEQ ID NO: 628346 - protein, 9 aa, Homo Sapiens
KTSRLTLSL

SEQ ID NO: 628347 - protein, 9 aa, Homo Sapiens
IFKNKGSRP

SEQ ID NO: 628348 - protein, 9 aa, Homo Sapiens
PGSPSQVKG

SEQ ID NO: 628349 - protein, 9 aa, Homo Sapiens
SRDPFTSLH

SEQ ID NO: 628350 - protein, 9 aa, Homo Sapiens
SWDSYLVLH

SEQ ID NO: 628351 - protein, 9 aa, Homo Sapiens
AHVWRPSTD

SEQ ID NO: 628352 - protein, 9 aa, Homo Sapiens
MLLGHIEEH

SEQ ID NO: 628353 - protein, 9 aa, Homo Sapiens
PSPSLWQTL

SEQ ID NO: 628354 - protein, 9 aa, Homo Sapiens
PPFGDVFRS

SEQ ID NO: 628355 - protein, 9 aa, Homo Sapiens
GKPQGPHQQ

SEQ ID NO: 628356 - protein, 9 aa, Homo Sapiens
WNFSLEISF

SEQ ID NO: 628357 - protein, 9 aa, Homo Sapiens
FAREQQRLH

SEQ ID NO: 628358 - protein, 9 aa, Homo Sapiens
HQLRGQPGH

SEQ ID NO: 628359 - protein, 9 aa, Homo Sapiens
LFVFAFTCA

SEQ ID NO: 628360 - protein, 9 aa, Homo Sapiens
LYHYPCFHS

SEQ ID NO: 628361 - protein, 9 aa, Homo Sapiens
RSQHTHSMA

SEQ ID NO: 628362 - protein, 9 aa, Homo Sapiens
LRGNVSFVL

SEQ ID NO: 628363 - protein, 9 aa, Homo Sapiens
DQDPVSLHE

SEQ ID NO: 628364 - protein, 9 aa, Homo Sapiens
PKLLHQFVE

SEQ ID NO: 628365 - protein, 9 aa, Homo Sapiens
RAPQYQNGN

SEQ ID NO: 628366 - protein, 9 aa, Homo Sapiens
KMSEAGSEL

SEQ ID NO: 628367 - protein, 9 aa, Homo Sapiens
TVVSTVMIG

SEQ ID NO: 628368 - protein, 9 aa, Homo Sapiens
INGFLPSKD

SEQ ID NO: 628369 - protein, 9 aa, Homo Sapiens
MYTDCADKE

SEQ ID NO: 628370 - protein, 9 aa, Homo Sapiens
PPCGCKCSK

SEQ ID NO: 628371 - protein, 9 aa, Homo Sapiens
NENSGGILE

SEQ ID NO: 628372 - protein, 9 aa, Homo Sapiens
ISRLKDRLP

SEQ ID NO: 628373 - protein, 9 aa, Homo Sapiens
RFSLSSSLV

SEQ ID NO: 628374 - protein, 9 aa, Homo Sapiens
GPLEGHTEI

SEQ ID NO: 628375 - protein, 9 aa, Homo Sapiens
GAESFRDAL

SEQ ID NO: 628376 - protein, 9 aa, Homo Sapiens
GLLRAHEEQ

SEQ ID NO: 628377 - protein, 9 aa, Homo Sapiens
AVDVLSQLS

SEQ ID NO: 628378 - protein, 9 aa, Homo Sapiens
DHILAVLLE

SEQ ID NO: 628379 - protein, 9 aa, Homo Sapiens
APPKSSQHN

SEQ ID NO: 628380 - protein, 9 aa, Homo Sapiens
LLPQHLSIW

SEQ ID NO: 628381 - protein, 9 aa, Homo Sapiens
ADPYQPVLW

SEQ ID NO: 628382 - protein, 9 aa, Homo Sapiens
GPNQRPHQF

SEQ ID NO: 628383 - protein, 9 aa, Homo Sapiens
VLNAELSSV

SEQ ID NO: 628384 - protein, 9 aa, Homo Sapiens
LTVEESSRI

SEQ ID NO: 628385 - protein, 9 aa, Homo Sapiens
HLTVVMQRP

SEQ ID NO: 628386 - protein, 9 aa, Homo Sapiens
DLDTFEPQK

SEQ ID NO: 628387 - protein, 9 aa, Homo Sapiens
HLGAGPNVS

SEQ ID NO: 628388 - protein, 9 aa, Homo Sapiens
NFVFFQGNK

SEQ ID NO: 628389 - protein, 9 aa, Homo Sapiens
FEKLVIYGD

SEQ ID NO: 628390 - protein, 9 aa, Homo Sapiens
EVHTKVINE

SEQ ID NO: 628391 - protein, 9 aa, Homo Sapiens
HRFCDRVQN

SEQ ID NO: 628392 - protein, 9 aa, Homo Sapiens
QVSLSLLII

SEQ ID NO: 628393 - protein, 9 aa, Homo Sapiens
VLAGAESSQ

SEQ ID NO: 628394 - protein, 9 aa, Homo Sapiens
VLRVRVHTT

SEQ ID NO: 628395 - protein, 9 aa, Homo Sapiens
PWIMKPSTL

SEQ ID NO: 628396 - protein, 9 aa, Homo Sapiens
QEILGCLYE

SEQ ID NO: 628397 - protein, 9 aa, Homo Sapiens
GCPAPPPPL

SEQ ID NO: 628398 - protein, 9 aa, Homo Sapiens
ASPAPQHKK

SEQ ID NO: 628399 - protein, 9 aa, Homo Sapiens
GSLCSPRAR

SEQ ID NO: 628400 - protein, 9 aa, Homo Sapiens
PSRLDGSPR

SEQ ID NO: 628401 - protein, 9 aa, Homo Sapiens
SLKQEKSPV

SEQ ID NO: 628402 - protein, 9 aa, Homo Sapiens
THPCNPDSD

SEQ ID NO: 628403 - protein, 9 aa, Homo Sapiens
YPSVEETFR

SEQ ID NO: 628404 - protein, 9 aa, Homo Sapiens
RMRWWMACT

SEQ ID NO: 628405 - protein, 9 aa, Homo Sapiens
PEGTYAVTL

SEQ ID NO: 628406 - protein, 9 aa, Homo Sapiens
IPPGAISPY

SEQ ID NO: 628407 - protein, 9 aa, Homo Sapiens
DFPEWAHCY

SEQ ID NO: 628408 - protein, 9 aa, Homo Sapiens
WEKIMERIK

SEQ ID NO: 628409 - protein, 9 aa, Homo Sapiens
SSQYIVPLV

SEQ ID NO: 628410 - protein, 9 aa, Homo Sapiens
LHNCKAKSI

SEQ ID NO: 628411 - protein, 9 aa, Homo Sapiens
QSLNVLEQF

SEQ ID NO: 628412 - protein, 9 aa, Homo Sapiens
DPKFYSYFE

SEQ ID NO: 628413 - protein, 9 aa, Homo Sapiens
NQKSIKIAC

SEQ ID NO: 628414 - protein, 9 aa, Homo Sapiens
AISKKRDHI

SEQ ID NO: 628415 - protein, 9 aa, Homo Sapiens
AIKEDYLRH

SEQ ID NO: 628416 - protein, 9 aa, Homo Sapiens
APGSPSQVK

SEQ ID NO: 628417 - protein, 9 aa, Homo Sapiens
WYVPEAVEW

SEQ ID NO: 628418 - protein, 9 aa, Homo Sapiens
SAGHGAGGR

SEQ ID NO: 628419 - protein, 9 aa, Homo Sapiens
HYVAKTGIL

SEQ ID NO: 628420 - protein, 9 aa, Homo Sapiens
SSISHDSPA

SEQ ID NO: 628421 - protein, 9 aa, Homo Sapiens
ENFLCKRPL

SEQ ID NO: 628422 - protein, 9 aa, Homo Sapiens
DSGLLPVAS

SEQ ID NO: 628423 - protein, 9 aa, Homo Sapiens
TDGKGTINA

SEQ ID NO: 628424 - protein, 9 aa, Homo Sapiens
AVAGYVSVL

SEQ ID NO: 628425 - protein, 9 aa, Homo Sapiens
LPLLFLSVG

SEQ ID NO: 628426 - protein, 9 aa, Homo Sapiens
SLCLLVRTY

SEQ ID NO: 628427 - protein, 9 aa, Homo Sapiens
KTLHHRIET

SEQ ID NO: 628428 - protein, 9 aa, Homo Sapiens
DEEQARKHA

SEQ ID NO: 628429 - protein, 9 aa, Homo Sapiens
ELVLGARIT

SEQ ID NO: 628430 - protein, 9 aa, Homo Sapiens
LQIPMKTQQ

SEQ ID NO: 628431 - protein, 9 aa, Homo Sapiens
KCQVPASEV

SEQ ID NO: 628432 - protein, 9 aa, Homo Sapiens
SVDLWALGV

SEQ ID NO: 628433 - protein, 9 aa, Homo Sapiens
LGSGICVDE

SEQ ID NO: 628434 - protein, 9 aa, Homo Sapiens
FQACSISDA

SEQ ID NO: 628435 - protein, 9 aa, Homo Sapiens
PRYTGVALQ

SEQ ID NO: 628436 - protein, 9 aa, Homo Sapiens
TSIAGIRQA

SEQ ID NO: 628437 - protein, 9 aa, Homo Sapiens
LGQLKASLQ

SEQ ID NO: 628438 - protein, 9 aa, Homo Sapiens
PNLGDKPLG

SEQ ID NO: 628439 - protein, 9 aa, Homo Sapiens
WSKAQLKAL

SEQ ID NO: 628440 - protein, 9 aa, Homo Sapiens
KSPLRMSLQ

SEQ ID NO: 628441 - protein, 9 aa, Homo Sapiens
KTLSNIGIL

SEQ ID NO: 628442 - protein, 9 aa, Homo Sapiens
LLCLDCVKF

SEQ ID NO: 628443 - protein, 9 aa, Homo Sapiens
FMMKYPHMV

SEQ ID NO: 628444 - protein, 9 aa, Homo Sapiens
VGQYVHSSF

SEQ ID NO: 628445 - protein, 9 aa, Homo Sapiens
PWPTPPPFP

SEQ ID NO: 628446 - protein, 9 aa, Homo Sapiens
RAAAPRSES

SEQ ID NO: 628447 - protein, 9 aa, Homo Sapiens
PGLLMAVGH

SEQ ID NO: 628448 - protein, 9 aa, Homo Sapiens
FACIAAFFC

SEQ ID NO: 628449 - protein, 9 aa, Homo Sapiens
DVPSSENLE

SEQ ID NO: 628450 - protein, 9 aa, Homo Sapiens
WKSLTLSRI

SEQ ID NO: 628451 - protein, 9 aa, Homo Sapiens
ALMRLICCP

SEQ ID NO: 628452 - protein, 9 aa, Homo Sapiens
DVSPGEPGA

SEQ ID NO: 628453 - protein, 9 aa, Homo Sapiens
LPFSNYFPT

SEQ ID NO: 628454 - protein, 9 aa, Homo Sapiens
LDKLWIFLV

SEQ ID NO: 628455 - protein, 9 aa, Homo Sapiens
EEEAEVRHP

SEQ ID NO: 628456 - protein, 9 aa, Homo Sapiens
LQLFMDDIN

SEQ ID NO: 628457 - protein, 9 aa, Homo Sapiens
FVLNDGYYG

SEQ ID NO: 628458 - protein, 9 aa, Homo Sapiens
MDRASELRF

SEQ ID NO: 628459 - protein, 9 aa, Homo Sapiens
RPLLFTYAL

SEQ ID NO: 628460 - protein, 9 aa, Homo Sapiens
AAAAGHLDG

SEQ ID NO: 628461 - protein, 9 aa, Homo Sapiens
GKKSAACGQ

SEQ ID NO: 628462 - protein, 9 aa, Homo Sapiens
VADEAWVLT

SEQ ID NO: 628463 - protein, 9 aa, Homo Sapiens
DKMLFPKSS

SEQ ID NO: 628464 - protein, 9 aa, Homo Sapiens
HLIHHQRIQ

SEQ ID NO: 628465 - protein, 9 aa, Homo Sapiens
NFPKPKGDC

SEQ ID NO: 628466 - protein, 9 aa, Homo Sapiens
WRALVDGQT

SEQ ID NO: 628467 - protein, 9 aa, Homo Sapiens
RARPCLCSG

SEQ ID NO: 628468 - protein, 9 aa, Homo Sapiens
EAQMKEDRR

SEQ ID NO: 628469 - protein, 9 aa, Homo Sapiens
RQDTRSWRD

SEQ ID NO: 628470 - protein, 9 aa, Homo Sapiens
NIENQELKQ

SEQ ID NO: 628471 - protein, 9 aa, Homo Sapiens
VGFLDAIMK

SEQ ID NO: 628472 - protein, 9 aa, Homo Sapiens
QVVFNPLLS

SEQ ID NO: 628473 - protein, 9 aa, Homo Sapiens
PFKSVWSGL

SEQ ID NO: 628474 - protein, 9 aa, Homo Sapiens
VKHIHLENQ

SEQ ID NO: 628475 - protein, 9 aa, Homo Sapiens
TTSSAFVEL

SEQ ID NO: 628476 - protein, 9 aa, Homo Sapiens
LMGKTHREQ

SEQ ID NO: 628477 - protein, 9 aa, Homo Sapiens
VLIPWMEYE

SEQ ID NO: 628478 - protein, 9 aa, Homo Sapiens
SFRSVRSQL

SEQ ID NO: 628479 - protein, 9 aa, Homo Sapiens
VSYVVLVIL

SEQ ID NO: 628480 - protein, 9 aa, Homo Sapiens
DICVKYFSG

SEQ ID NO: 628481 - protein, 9 aa, Homo Sapiens
GWPSLCIDL

SEQ ID NO: 628482 - protein, 9 aa, Homo Sapiens
AAKNCSIIK

SEQ ID NO: 628483 - protein, 9 aa, Homo Sapiens
KIPQLQSSP

SEQ ID NO: 628484 - protein, 9 aa, Homo Sapiens
SLGPNATRP

SEQ ID NO: 628485 - protein, 9 aa, Homo Sapiens
DADIAARRH

SEQ ID NO: 628486 - protein, 9 aa, Homo Sapiens
EHDKVLHCQ

SEQ ID NO: 628487 - protein, 9 aa, Homo Sapiens
LFAGFPQGG

SEQ ID NO: 628488 - protein, 9 aa, Homo Sapiens
TLLHMPCPA

SEQ ID NO: 628489 - protein, 9 aa, Homo Sapiens
KTNLDFKFP

SEQ ID NO: 628490 - protein, 9 aa, Homo Sapiens
FDAIAELET

SEQ ID NO: 628491 - protein, 9 aa, Homo Sapiens
QLTEADLRL

SEQ ID NO: 628492 - protein, 9 aa, Homo Sapiens
PQWQPGTGL

SEQ ID NO: 628493 - protein, 9 aa, Homo Sapiens
LAWDISGTS

SEQ ID NO: 628494 - protein, 9 aa, Homo Sapiens
YNLKPYTGG

SEQ ID NO: 628495 - protein, 9 aa, Homo Sapiens
CAVWRPQCG

SEQ ID NO: 628496 - protein, 9 aa, Homo Sapiens
KGFPVRPGL

SEQ ID NO: 628497 - protein, 9 aa, Homo Sapiens
ECWKTFGRS

SEQ ID NO: 628498 - protein, 9 aa, Homo Sapiens
LAWSSHVAE

SEQ ID NO: 628499 - protein, 9 aa, Homo Sapiens
RSSSMLLGD

SEQ ID NO: 628500 - protein, 9 aa, Homo Sapiens
EELCYQNEF

SEQ ID NO: 628501 - protein, 9 aa, Homo Sapiens
IFVNTIAYR

SEQ ID NO: 628502 - protein, 9 aa, Homo Sapiens
LKHPSNKGY

SEQ ID NO: 628503 - protein, 9 aa, Homo Sapiens
PSEFKIILG

SEQ ID NO: 628504 - protein, 9 aa, Homo Sapiens
SADKMPHMH

SEQ ID NO: 628505 - protein, 9 aa, Homo Sapiens
QCCPTWHSE

SEQ ID NO: 628506 - protein, 8 aa, Homo Sapiens
SPRGTGCS

SEQ ID NO: 628507 - protein, 9 aa, Homo Sapiens
GPCGGRRPG

SEQ ID NO: 628508 - protein, 9 aa, Homo Sapiens
GESEGAASV

SEQ ID NO: 628509 - protein, 9 aa, Homo Sapiens
HQFVEQLQK

SEQ ID NO: 628510 - protein, 9 aa, Homo Sapiens
KRFACIAAF

SEQ ID NO: 628511 - protein, 9 aa, Homo Sapiens
STCEHCQKK

SEQ ID NO: 628512 - protein, 9 aa, Homo Sapiens
SGFQSSRME

SEQ ID NO: 628513 - protein, 9 aa, Homo Sapiens
ACGAAVSDS

SEQ ID NO: 628514 - protein, 9 aa, Homo Sapiens
STKDLPNDV

SEQ ID NO: 628515 - protein, 9 aa, Homo Sapiens
FYSYFEFPI

SEQ ID NO: 628516 - protein, 9 aa, Homo Sapiens
SDYKHVLGP

SEQ ID NO: 628517 - protein, 9 aa, Homo Sapiens
KRPDSVATG

SEQ ID NO: 628518 - protein, 9 aa, Homo Sapiens
LMSPRDCDH

SEQ ID NO: 628519 - protein, 9 aa, Homo Sapiens
ASNLEKQTN

SEQ ID NO: 628520 - protein, 9 aa, Homo Sapiens
MKTQQPNVP

SEQ ID NO: 628521 - protein, 9 aa, Homo Sapiens
HEERKPSAT

SEQ ID NO: 628522 - protein, 9 aa, Homo Sapiens
CPEKNCAHG

SEQ ID NO: 628523 - protein, 9 aa, Homo Sapiens
AAHEPSTPG

SEQ ID NO: 628524 - protein, 9 aa, Homo Sapiens
GGSGSHART

SEQ ID NO: 628525 - protein, 9 aa, Homo Sapiens
SGTTKLTIT

SEQ ID NO: 628526 - protein, 9 aa, Homo Sapiens
PPWAEEAAL

SEQ ID NO: 628527 - protein, 9 aa, Homo Sapiens
KHCLDGEDV

SEQ ID NO: 628528 - protein, 9 aa, Homo Sapiens
GAKGERVAK

SEQ ID NO: 628529 - protein, 9 aa, Homo Sapiens
LWQTLEWLR

SEQ ID NO: 628530 - protein, 9 aa, Homo Sapiens
SRGGSHGAR

SEQ ID NO: 628531 - protein, 9 aa, Homo Sapiens
SQLSFVDLA

SEQ ID NO: 628532 - protein, 9 aa, Homo Sapiens
CHSLLSWSL

SEQ ID NO: 628533 - protein, 9 aa, Homo Sapiens
FAIAAFVIV

SEQ ID NO: 628534 - protein, 9 aa, Homo Sapiens
GVVGEFPIF

SEQ ID NO: 628535 - protein, 9 aa, Homo Sapiens
NEIFIAIAK

SEQ ID NO: 628536 - protein, 9 aa, Homo Sapiens
DYGCVHCPA

SEQ ID NO: 628537 - protein, 9 aa, Homo Sapiens
GLGVYSLGL

SEQ ID NO: 628538 - protein, 9 aa, Homo Sapiens
LTILMPCTR

SEQ ID NO: 628539 - protein, 9 aa, Homo Sapiens
REWGPQSGP

SEQ ID NO: 628540 - protein, 9 aa, Homo Sapiens
GGINSPSFD

SEQ ID NO: 628541 - protein, 9 aa, Homo Sapiens
PVLKVNGVK

SEQ ID NO: 628542 - protein, 9 aa, Homo Sapiens
RSEHGRYMQ

SEQ ID NO: 628543 - protein, 9 aa, Homo Sapiens
HTCQQWSAQ

SEQ ID NO: 628544 - protein, 9 aa, Homo Sapiens
YTIHAEGYE

SEQ ID NO: 628545 - protein, 9 aa, Homo Sapiens
ERKILDSLE

SEQ ID NO: 628546 - protein, 9 aa, Homo Sapiens
YYPKFHPGL

SEQ ID NO: 628547 - protein, 9 aa, Homo Sapiens
KDVSPGEPG

SEQ ID NO: 628548 - protein, 9 aa, Homo Sapiens
QLFFANGVL

SEQ ID NO: 628549 - protein, 9 aa, Homo Sapiens
VSFPSYSAY

SEQ ID NO: 628550 - protein, 9 aa, Homo Sapiens
MQDPIVSID

SEQ ID NO: 628551 - protein, 9 aa, Homo Sapiens
VISVVVILS

SEQ ID NO: 628552 - protein, 9 aa, Homo Sapiens
SAPSQSSSF

SEQ ID NO: 628553 - protein, 9 aa, Homo Sapiens
TEAGPVGGS

SEQ ID NO: 628554 - protein, 9 aa, Homo Sapiens
DFLSQPSLC

SEQ ID NO: 628555 - protein, 9 aa, Homo Sapiens
ARPTMYPSA

SEQ ID NO: 628556 - protein, 9 aa, Homo Sapiens
GNLLDEGSD

SEQ ID NO: 628557 - protein, 9 aa, Homo Sapiens
FSSLIKKKR

SEQ ID NO: 628558 - protein, 9 aa, Homo Sapiens
SYVVLVILA

SEQ ID NO: 628559 - protein, 9 aa, Homo Sapiens
NSNVTRPSE

SEQ ID NO: 628560 - protein, 9 aa, Homo Sapiens
GEIALSTSN

SEQ ID NO: 628561 - protein, 9 aa, Homo Sapiens
LPGGINSPS

SEQ ID NO: 628562 - protein, 9 aa, Homo Sapiens
HGAWGAVSN

SEQ ID NO: 628563 - protein, 9 aa, Homo Sapiens
SIRVYAFTK

SEQ ID NO: 628564 - protein, 9 aa, Homo Sapiens
AKIPRRDEG

SEQ ID NO: 628565 - protein, 9 aa, Homo Sapiens
GSFNQPLRQ

SEQ ID NO: 628566 - protein, 9 aa, Homo Sapiens
GAISPYRKL

SEQ ID NO: 628567 - protein, 9 aa, Homo Sapiens
LKGEWNLKS

SEQ ID NO: 628568 - protein, 9 aa, Homo Sapiens
VVPDSTPSR

SEQ ID NO: 628569 - protein, 9 aa, Homo Sapiens
KQGVLEVAH

SEQ ID NO: 628570 - protein, 9 aa, Homo Sapiens
NCAHGEGSM

SEQ ID NO: 628571 - protein, 9 aa, Homo Sapiens
LAYKQLYSW

SEQ ID NO: 628572 - protein, 9 aa, Homo Sapiens
QDPSEGPLG

SEQ ID NO: 628573 - protein, 9 aa, Homo Sapiens
EMISTLLKW

SEQ ID NO: 628574 - protein, 9 aa, Homo Sapiens
PVPRMGSNS

SEQ ID NO: 628575 - protein, 9 aa, Homo Sapiens
AGLLRAHEE

SEQ ID NO: 628576 - protein, 9 aa, Homo Sapiens
CPFRHCEPA

SEQ ID NO: 628577 - protein, 9 aa, Homo Sapiens
SVKSVKMLL

SEQ ID NO: 628578 - protein, 9 aa, Homo Sapiens
HGSRLEKPI

SEQ ID NO: 628579 - protein, 9 aa, Homo Sapiens
KTDFLWKNC

SEQ ID NO: 628580 - protein, 9 aa, Homo Sapiens
NPLANSNIS

SEQ ID NO: 628581 - protein, 9 aa, Homo Sapiens
KSELGQRSK

SEQ ID NO: 628582 - protein, 9 aa, Homo Sapiens
KKQYYFDST

SEQ ID NO: 628583 - protein, 9 aa, Homo Sapiens
GALERIHMG

SEQ ID NO: 628584 - protein, 9 aa, Homo Sapiens
CGCKCSKCD

SEQ ID NO: 628585 - protein, 9 aa, Homo Sapiens
LPDIEWIIC

SEQ ID NO: 628586 - protein, 9 aa, Homo Sapiens
GFLYSATTG

SEQ ID NO: 628587 - protein, 9 aa, Homo Sapiens
ITCMGVDRY

SEQ ID NO: 628588 - protein, 9 aa, Homo Sapiens
GGQIFFSSL

SEQ ID NO: 628589 - protein, 9 aa, Homo Sapiens
FTCAFGGAL

SEQ ID NO: 628590 - protein, 9 aa, Homo Sapiens
NLDFSKGHH

SEQ ID NO: 628591 - protein, 9 aa, Homo Sapiens
LRVAACQPA

SEQ ID NO: 628592 - protein, 9 aa, Homo Sapiens
VSVSQGFRL

SEQ ID NO: 628593 - protein, 9 aa, Homo Sapiens
LDSEQHRHR

SEQ ID NO: 628594 - protein, 9 aa, Homo Sapiens
LPQDRVAEL

SEQ ID NO: 628595 - protein, 9 aa, Homo Sapiens
EKVGCQLRS

SEQ ID NO: 628596 - protein, 9 aa, Homo Sapiens
GRKGFPVRP

SEQ ID NO: 628597 - protein, 9 aa, Homo Sapiens
RASYPTSQE

SEQ ID NO: 628598 - protein, 9 aa, Homo Sapiens
VLLGAKDKT

SEQ ID NO: 628599 - protein, 9 aa, Homo Sapiens
GNVFASVYT

SEQ ID NO: 628600 - protein, 9 aa, Homo Sapiens
QVYAVNDDY

SEQ ID NO: 628601 - protein, 9 aa, Homo Sapiens
CFRKNSAAE

SEQ ID NO: 628602 - protein, 9 aa, Homo Sapiens
DAFGRIDFV

SEQ ID NO: 628603 - protein, 9 aa, Homo Sapiens
LDFKFPNGL

SEQ ID NO: 628604 - protein, 9 aa, Homo Sapiens
DSEVLQRLS

SEQ ID NO: 628605 - protein, 9 aa, Homo Sapiens
FTFFSHRFV

SEQ ID NO: 628606 - protein, 9 aa, Homo Sapiens
VLVPTEILP

SEQ ID NO: 628607 - protein, 9 aa, Homo Sapiens
WKTFGRSSN

SEQ ID NO: 628608 - protein, 9 aa, Homo Sapiens
NEPLIVFLH

SEQ ID NO: 628609 - protein, 9 aa, Homo Sapiens
DHLVACTWA

SEQ ID NO: 628610 - protein, 9 aa, Homo Sapiens
SHGGKGLPA

SEQ ID NO: 628611 - protein, 9 aa, Homo Sapiens
VVGLVVEGV

SEQ ID NO: 628612 - protein, 9 aa, Homo Sapiens
KVCDGGWGL

SEQ ID NO: 628613 - protein, 9 aa, Homo Sapiens
SRYGPSTYG

SEQ ID NO: 628614 - protein, 9 aa, Homo Sapiens
MVMSMDFNA

SEQ ID NO: 628615 - protein, 9 aa, Homo Sapiens
PSLQWPVTQ

SEQ ID NO: 628616 - protein, 9 aa, Homo Sapiens
GVYLCEDTI

SEQ ID NO: 628617 - protein, 9 aa, Homo Sapiens
DSPVSITPP

SEQ ID NO: 628618 - protein, 9 aa, Homo Sapiens
DGVAKGVGT

SEQ ID NO: 628619 - protein, 9 aa, Homo Sapiens
LSFLRGDVL

SEQ ID NO: 628620 - protein, 9 aa, Homo Sapiens
SPTLAPLLD

SEQ ID NO: 628621 - protein, 9 aa, Homo Sapiens
ENAIDRTEQ

SEQ ID NO: 628622 - protein, 9 aa, Homo Sapiens
GRYMQDPIV

SEQ ID NO: 628623 - protein, 9 aa, Homo Sapiens
DSHVDACTS

SEQ ID NO: 628624 - protein, 9 aa, Homo Sapiens
CDLRRLVMY

SEQ ID NO: 628625 - protein, 9 aa, Homo Sapiens
VDVEDCDGS

SEQ ID NO: 628626 - protein, 9 aa, Homo Sapiens
GKYYNLKPY

SEQ ID NO: 628627 - protein, 9 aa, Homo Sapiens
ALGAQRAAE

SEQ ID NO: 628628 - protein, 9 aa, Homo Sapiens
LNSMTHPGD

SEQ ID NO: 628629 - protein, 9 aa, Homo Sapiens
RTITLNVYN

SEQ ID NO: 628630 - protein, 9 aa, Homo Sapiens
YACHECWKT

SEQ ID NO: 628631 - protein, 9 aa, Homo Sapiens
GCKCSKCDM

SEQ ID NO: 628632 - protein, 9 aa, Homo Sapiens
QVEFVLEKC

SEQ ID NO: 628633 - protein, 9 aa, Homo Sapiens
SEAGSELEG

SEQ ID NO: 628634 - protein, 9 aa, Homo Sapiens
PAFGQYTGY

SEQ ID NO: 628635 - protein, 9 aa, Homo Sapiens
GDAPSPLPQ

SEQ ID NO: 628636 - protein, 9 aa, Homo Sapiens
PHDSLSLKV

SEQ ID NO: 628637 - protein, 9 aa, Homo Sapiens
VVPCPVRFQ

SEQ ID NO: 628638 - protein, 9 aa, Homo Sapiens
QISLCFRKN

SEQ ID NO: 628639 - protein, 9 aa, Homo Sapiens
IYTIEARNT

SEQ ID NO: 628640 - protein, 9 aa, Homo Sapiens
QAQRSTTKG

SEQ ID NO: 628641 - protein, 9 aa, Homo Sapiens
QNCVDTPSE

SEQ ID NO: 628642 - protein, 9 aa, Homo Sapiens
VYLCEDTIC

SEQ ID NO: 628643 - protein, 9 aa, Homo Sapiens
AFALDGIGG

SEQ ID NO: 628644 - protein, 9 aa, Homo Sapiens
PKQRLESNR

SEQ ID NO: 628645 - protein, 9 aa, Homo Sapiens
EYPRLENVA

SEQ ID NO: 628646 - protein, 9 aa, Homo Sapiens
SDDFRSKYH

SEQ ID NO: 628647 - protein, 9 aa, Homo Sapiens
GIPPEQQRL

SEQ ID NO: 628648 - protein, 9 aa, Homo Sapiens
SLSQLELQD

SEQ ID NO: 628649 - protein, 9 aa, Homo Sapiens
AVGHDLYCY

SEQ ID NO: 628650 - protein, 9 aa, Homo Sapiens
LARCPGCGK

SEQ ID NO: 628651 - protein, 9 aa, Homo Sapiens
NSRKDREEL

SEQ ID NO: 628652 - protein, 9 aa, Homo Sapiens
ATICSMERR

SEQ ID NO: 628653 - protein, 9 aa, Homo Sapiens
RMGSNSLMY

SEQ ID NO: 628654 - protein, 9 aa, Homo Sapiens
AQLRAPTKQ

SEQ ID NO: 628655 - protein, 9 aa, Homo Sapiens
AQHPQAREE

SEQ ID NO: 628656 - protein, 9 aa, Homo Sapiens
SIKEECSTL

SEQ ID NO: 628657 - protein, 9 aa, Homo Sapiens
QALMRLICC

SEQ ID NO: 628658 - protein, 9 aa, Homo Sapiens
CASIAYLKA

SEQ ID NO: 628659 - protein, 9 aa, Homo Sapiens
PTLHLVFTQ

SEQ ID NO: 628660 - protein, 9 aa, Homo Sapiens
IGILVAKIF

SEQ ID NO: 628661 - protein, 9 aa, Homo Sapiens
EDTICGTQL

SEQ ID NO: 628662 - protein, 9 aa, Homo Sapiens
STEQMLSHV

SEQ ID NO: 628663 - protein, 9 aa, Homo Sapiens
SQSQRHRPT

SEQ ID NO: 628664 - protein, 9 aa, Homo Sapiens
CRSSVSRRT

SEQ ID NO: 628665 - protein, 9 aa, Homo Sapiens
RACSEQEWR

SEQ ID NO: 628666 - protein, 9 aa, Homo Sapiens
GLVARAGTR

SEQ ID NO: 628667 - protein, 9 aa, Homo Sapiens
EEACYQQPQ

SEQ ID NO: 628668 - protein, 9 aa, Homo Sapiens
RRRILICCD

SEQ ID NO: 628669 - protein, 9 aa, Homo Sapiens
RGHEDWGIR

SEQ ID NO: 628670 - protein, 9 aa, Homo Sapiens
SDARYLYDQ

SEQ ID NO: 628671 - protein, 9 aa, Homo Sapiens
LCLSWGPFH

SEQ ID NO: 628672 - protein, 9 aa, Homo Sapiens
VHPQQEDQN

SEQ ID NO: 628673 - protein, 9 aa, Homo Sapiens
CIFENIVGT

SEQ ID NO: 628674 - protein, 9 aa, Homo Sapiens
TEHVNAIRG

SEQ ID NO: 628675 - protein, 9 aa, Homo Sapiens
QNAYACPRL

SEQ ID NO: 628676 - protein, 9 aa, Homo Sapiens
LTTAWGGQL

SEQ ID NO: 628677 - protein, 9 aa, Homo Sapiens
VMVIFVYIG

SEQ ID NO: 628678 - protein, 9 aa, Homo Sapiens
LRRSPRRTS

SEQ ID NO: 628679 - protein, 9 aa, Homo Sapiens
TGRQSPAVI

SEQ ID NO: 628680 - protein, 9 aa, Homo Sapiens
LLLLLFLII

SEQ ID NO: 628681 - protein, 9 aa, Homo Sapiens
TRFSMVMSM

SEQ ID NO: 628682 - protein, 9 aa, Homo Sapiens
YFEKLVIYG

SEQ ID NO: 628683 - protein, 9 aa, Homo Sapiens
YPSAHRSRA

SEQ ID NO: 628684 - protein, 9 aa, Homo Sapiens
AAAFQPVLD

SEQ ID NO: 628685 - protein, 9 aa, Homo Sapiens
HSQNCGAET

SEQ ID NO: 628686 - protein, 9 aa, Homo Sapiens
QLAHCLRGS

SEQ ID NO: 628687 - protein, 9 aa, Homo Sapiens
FRSVTTSQL

SEQ ID NO: 628688 - protein, 9 aa, Homo Sapiens
EELFMIVLD

SEQ ID NO: 628689 - protein, 9 aa, Homo Sapiens
CALVISGYS

SEQ ID NO: 628690 - protein, 9 aa, Homo Sapiens
ADFQAFTGI

SEQ ID NO: 628691 - protein, 9 aa, Homo Sapiens
AWDISGTST

SEQ ID NO: 628692 - protein, 9 aa, Homo Sapiens
YFFLWNFSL

SEQ ID NO: 628693 - protein, 9 aa, Homo Sapiens
EGYERGTKV

SEQ ID NO: 628694 - protein, 9 aa, Homo Sapiens
EKIRFFRVE

SEQ ID NO: 628695 - protein, 9 aa, Homo Sapiens
MALDFRGKT

SEQ ID NO: 628696 - protein, 9 aa, Homo Sapiens
ARQLVGPLA

SEQ ID NO: 628697 - protein, 9 aa, Homo Sapiens
GLLFDIVTS

SEQ ID NO: 628698 - protein, 9 aa, Homo Sapiens
FRLLFYTMK

SEQ ID NO: 628699 - protein, 9 aa, Homo Sapiens
YKQLYSWEE

SEQ ID NO: 628700 - protein, 9 aa, Homo Sapiens
LQAAAANTS

SEQ ID NO: 628701 - protein, 9 aa, Homo Sapiens
FFSHRFVGH

SEQ ID NO: 628702 - protein, 9 aa, Homo Sapiens
LCLLVRTYP

SEQ ID NO: 628703 - protein, 9 aa, Homo Sapiens
IEDLLLRGA

SEQ ID NO: 628704 - protein, 9 aa, Homo Sapiens
SSSFTPPAS

SEQ ID NO: 628705 - protein, 9 aa, Homo Sapiens
SRQLDCKAL

SEQ ID NO: 628706 - protein, 9 aa, Homo Sapiens
RANPSPTPV

SEQ ID NO: 628707 - protein, 9 aa, Homo Sapiens
KVNGIILVT

SEQ ID NO: 628708 - protein, 9 aa, Homo Sapiens
AFFTFFSHR

SEQ ID NO: 628709 - protein, 9 aa, Homo Sapiens
IADPYQPVL

SEQ ID NO: 628710 - protein, 9 aa, Homo Sapiens
PMDSTKRNN

SEQ ID NO: 628711 - protein, 9 aa, Homo Sapiens
AGSLKGFLS

SEQ ID NO: 628712 - protein, 9 aa, Homo Sapiens
RQRVCSREG

SEQ ID NO: 628713 - protein, 9 aa, Homo Sapiens
PGAEGSRLA

SEQ ID NO: 628714 - protein, 9 aa, Homo Sapiens
DQQKPEIKQ

SEQ ID NO: 628715 - protein, 9 aa, Homo Sapiens
RGNVFASVY

SEQ ID NO: 628716 - protein, 9 aa, Homo Sapiens
VLVCVLVLD

SEQ ID NO: 628717 - protein, 9 aa, Homo Sapiens
LGPQWQPGT

SEQ ID NO: 628718 - protein, 9 aa, Homo Sapiens
RGVSRGGSH

SEQ ID NO: 628719 - protein, 9 aa, Homo Sapiens
ATPVSGYRA

SEQ ID NO: 628720 - protein, 9 aa, Homo Sapiens
PGIRCWVTC

SEQ ID NO: 628721 - protein, 9 aa, Homo Sapiens
MRSPYAGLQ

SEQ ID NO: 628722 - protein, 9 aa, Homo Sapiens
ACSEQEWRL

SEQ ID NO: 628723 - protein, 9 aa, Homo Sapiens
LDLSVLAKE

SEQ ID NO: 628724 - protein, 9 aa, Homo Sapiens
RDLAYKQLY

SEQ ID NO: 628725 - protein, 9 aa, Homo Sapiens
GGPLSVYPV

SEQ ID NO: 628726 - protein, 9 aa, Homo Sapiens
GNHPERVKV

SEQ ID NO: 628727 - protein, 9 aa, Homo Sapiens
SPPLNSTNS

SEQ ID NO: 628728 - protein, 9 aa, Homo Sapiens
PGRKGFPVR

SEQ ID NO: 628729 - protein, 9 aa, Homo Sapiens
IKEDYLRHE

SEQ ID NO: 628730 - protein, 9 aa, Homo Sapiens
QMLSHVTAD

SEQ ID NO: 628731 - protein, 9 aa, Homo Sapiens
KGDCAKGDV

SEQ ID NO: 628732 - protein, 9 aa, Homo Sapiens
GVVIVLGAE

SEQ ID NO: 628733 - protein, 9 aa, Homo Sapiens
SFDLYSYDY

SEQ ID NO: 628734 - protein, 9 aa, Homo Sapiens
SGPNIYELS

SEQ ID NO: 628735 - protein, 9 aa, Homo Sapiens
TLQQAYRMR

SEQ ID NO: 628736 - protein, 9 aa, Homo Sapiens
GTYAHTVNP

SEQ ID NO: 628737 - protein, 9 aa, Homo Sapiens
LLGSDGCAD

SEQ ID NO: 628738 - protein, 9 aa, Homo Sapiens
LYPWQSCKV

SEQ ID NO: 628739 - protein, 9 aa, Homo Sapiens
LNVTDLGLV

SEQ ID NO: 628740 - protein, 9 aa, Homo Sapiens
LSGTTKLTI

SEQ ID NO: 628741 - protein, 9 aa, Homo Sapiens
YINLVGLRA

SEQ ID NO: 628742 - protein, 9 aa, Homo Sapiens
SRLTLSLPP

SEQ ID NO: 628743 - protein, 9 aa, Homo Sapiens
PPKSSQHNG

SEQ ID NO: 628744 - protein, 9 aa, Homo Sapiens
LEAVVMKFD

SEQ ID NO: 628745 - protein, 9 aa, Homo Sapiens
VGEFPIFSP

SEQ ID NO: 628746 - protein, 9 aa, Homo Sapiens
WQVQTCEVD

SEQ ID NO: 628747 - protein, 9 aa, Homo Sapiens
HNCKAKSII

SEQ ID NO: 628748 - protein, 9 aa, Homo Sapiens
TTPGSTAIS

SEQ ID NO: 628749 - protein, 9 aa, Homo Sapiens
NNAALAGKA

SEQ ID NO: 628750 - protein, 9 aa, Homo Sapiens
VPNVFPSSV

SEQ ID NO: 628751 - protein, 9 aa, Homo Sapiens
WGASPTDPA

SEQ ID NO: 628752 - protein, 9 aa, Homo Sapiens
RCPGCGKGV

SEQ ID NO: 628753 - protein, 9 aa, Homo Sapiens
LSEGSYLDI

SEQ ID NO: 628754 - protein, 9 aa, Homo Sapiens
VLEVAHTCA

SEQ ID NO: 628755 - protein, 9 aa, Homo Sapiens
GGSDFGCRA

SEQ ID NO: 628756 - protein, 9 aa, Homo Sapiens
KVSQPEPPS

SEQ ID NO: 628757 - protein, 9 aa, Homo Sapiens
VISRENRSF

SEQ ID NO: 628758 - protein, 9 aa, Homo Sapiens
MPHMHKMMR

SEQ ID NO: 628759 - protein, 9 aa, Homo Sapiens
FFAIGMSPA

SEQ ID NO: 628760 - protein, 9 aa, Homo Sapiens
SNVSETRYV

SEQ ID NO: 628761 - protein, 9 aa, Homo Sapiens
HQDEIASQC

SEQ ID NO: 628762 - protein, 9 aa, Homo Sapiens
IQHWQQVLC

SEQ ID NO: 628763 - protein, 9 aa, Homo Sapiens
GDSMLTSVS

SEQ ID NO: 628764 - protein, 9 aa, Homo Sapiens
NGICCIYEF

SEQ ID NO: 628765 - protein, 9 aa, Homo Sapiens
VSAIREIME

SEQ ID NO: 628766 - protein, 9 aa, Homo Sapiens
PAAHSADLE

SEQ ID NO: 628767 - protein, 9 aa, Homo Sapiens
LESVSFPSY

SEQ ID NO: 628768 - protein, 9 aa, Homo Sapiens
HFHSPPPVP

SEQ ID NO: 628769 - protein, 9 aa, Homo Sapiens
KTLCIHMTA

SEQ ID NO: 628770 - protein, 9 aa, Homo Sapiens
FRIMNNEKM

SEQ ID NO: 628771 - protein, 9 aa, Homo Sapiens
KYEDPENKI

SEQ ID NO: 628772 - protein, 9 aa, Homo Sapiens
FSIKGAEDN

SEQ ID NO: 628773 - protein, 9 aa, Homo Sapiens
KPQKETKKY

SEQ ID NO: 628774 - protein, 9 aa, Homo Sapiens
TSSVKSVKM

SEQ ID NO: 628775 - protein, 9 aa, Homo Sapiens
GYLKADNRG

SEQ ID NO: 628776 - protein, 9 aa, Homo Sapiens
GTIKWRRTT

SEQ ID NO: 628777 - protein, 9 aa, Homo Sapiens
MKPSTLPPL

SEQ ID NO: 628778 - protein, 9 aa, Homo Sapiens
VSTMNHPHM

SEQ ID NO: 628779 - protein, 9 aa, Homo Sapiens
SGTHSHSLP

SEQ ID NO: 628780 - protein, 9 aa, Homo Sapiens
VIEDGKVEV

SEQ ID NO: 628781 - protein, 9 aa, Homo Sapiens
VWRPSTDPQ

SEQ ID NO: 628782 - protein, 9 aa, Homo Sapiens
QAYRMRWWM

SEQ ID NO: 628783 - protein, 9 aa, Homo Sapiens
RSGAEGNGV

SEQ ID NO: 628784 - protein, 9 aa, Homo Sapiens
SGGEDDDVE

SEQ ID NO: 628785 - protein, 9 aa, Homo Sapiens
VRWRTEIGS

SEQ ID NO: 628786 - protein, 9 aa, Homo Sapiens
GKEKSELGQ

SEQ ID NO: 628787 - protein, 9 aa, Homo Sapiens
LMAVYSWDK

SEQ ID NO: 628788 - protein, 9 aa, Homo Sapiens
RILQLDWSD

SEQ ID NO: 628789 - protein, 9 aa, Homo Sapiens
INDENFLCK

SEQ ID NO: 628790 - protein, 9 aa, Homo Sapiens
CLICFENEV

SEQ ID NO: 628791 - protein, 9 aa, Homo Sapiens
VLHWLGCTE

SEQ ID NO: 628792 - protein, 9 aa, Homo Sapiens
SAMAAYEDV

SEQ ID NO: 628793 - protein, 9 aa, Homo Sapiens
AKNCSIIKW

SEQ ID NO: 628794 - protein, 9 aa, Homo Sapiens
EWEDRERFS

SEQ ID NO: 628795 - protein, 9 aa, Homo Sapiens
TPEIQQFPD

SEQ ID NO: 628796 - protein, 9 aa, Homo Sapiens
MVLLSLVLG

SEQ ID NO: 628797 - protein, 9 aa, Homo Sapiens
MSPRDCDHL

SEQ ID NO: 628798 - protein, 9 aa, Homo Sapiens
NRKTKSRLA

SEQ ID NO: 628799 - protein, 9 aa, Homo Sapiens
QVAISQSLS

SEQ ID NO: 628800 - protein, 9 aa, Homo Sapiens
PRTCHLNMQ

SEQ ID NO: 628801 - protein, 9 aa, Homo Sapiens
PSTRMSDAR

SEQ ID NO: 628802 - protein, 9 aa, Homo Sapiens
YSAIQREEI

SEQ ID NO: 628803 - protein, 9 aa, Homo Sapiens
YFGDDGSLY

SEQ ID NO: 628804 - protein, 9 aa, Homo Sapiens
SCMLGPGLL

SEQ ID NO: 628805 - protein, 9 aa, Homo Sapiens
SNPELVSFI

SEQ ID NO: 628806 - protein, 9 aa, Homo Sapiens
RVKQLEKTF

SEQ ID NO: 628807 - protein, 9 aa, Homo Sapiens
DAGTMAETS

SEQ ID NO: 628808 - protein, 9 aa, Homo Sapiens
QSHPHLVEE

SEQ ID NO: 628809 - protein, 9 aa, Homo Sapiens
ATCQQYLCS

SEQ ID NO: 628810 - protein, 9 aa, Homo Sapiens
EDLHMVLDE

SEQ ID NO: 628811 - protein, 9 aa, Homo Sapiens
MYCAYPVPR

SEQ ID NO: 628812 - protein, 9 aa, Homo Sapiens
GAHFINALV

SEQ ID NO: 628813 - protein, 9 aa, Homo Sapiens
IEKGNSSSS

SEQ ID NO: 628814 - protein, 9 aa, Homo Sapiens
APFVPRDVQ

SEQ ID NO: 628815 - protein, 9 aa, Homo Sapiens
VAVGMSIDI

SEQ ID NO: 628816 - protein, 9 aa, Homo Sapiens
SAIFSAAKN

SEQ ID NO: 628817 - protein, 9 aa, Homo Sapiens
SSLELMALH

SEQ ID NO: 628818 - protein, 9 aa, Homo Sapiens
IRSRYNLCI

SEQ ID NO: 628819 - protein, 9 aa, Homo Sapiens
VDSSAAQRC

SEQ ID NO: 628820 - protein, 9 aa, Homo Sapiens
ASPTDPARR

SEQ ID NO: 628821 - protein, 9 aa, Homo Sapiens
AQLKALFSE

SEQ ID NO: 628822 - protein, 9 aa, Homo Sapiens
ESSKRGLFR

SEQ ID NO: 628823 - protein, 9 aa, Homo Sapiens
SGYCFYLED

SEQ ID NO: 628824 - protein, 9 aa, Homo Sapiens
PYYPKFHPG

SEQ ID NO: 628825 - protein, 9 aa, Homo Sapiens
GAECAHCSC

SEQ ID NO: 628826 - protein, 9 aa, Homo Sapiens
MTSSVKSVK

SEQ ID NO: 628827 - protein, 9 aa, Homo Sapiens
SIDLSDVQW

SEQ ID NO: 628828 - protein, 9 aa, Homo Sapiens
IRAHKAGLA

SEQ ID NO: 628829 - protein, 9 aa, Homo Sapiens
LNKCQGLLF

SEQ ID NO: 628830 - protein, 9 aa, Homo Sapiens
WKKQENGNQ

SEQ ID NO: 628831 - protein, 9 aa, Homo Sapiens
APGQAKIAC

SEQ ID NO: 628832 - protein, 9 aa, Homo Sapiens
LHFFHPHHI

SEQ ID NO: 628833 - protein, 9 aa, Homo Sapiens
INTPVHFHS

SEQ ID NO: 628834 - protein, 9 aa, Homo Sapiens
KVGLSGLFD

SEQ ID NO: 628835 - protein, 9 aa, Homo Sapiens
QYHRADAQS

SEQ ID NO: 628836 - protein, 9 aa, Homo Sapiens
TTVYVPKFL

SEQ ID NO: 628837 - protein, 9 aa, Homo Sapiens
FPSSVDFTQ

SEQ ID NO: 628838 - protein, 9 aa, Homo Sapiens
FYEEYDACQ

SEQ ID NO: 628839 - protein, 9 aa, Homo Sapiens
EEKINKIMW

SEQ ID NO: 628840 - protein, 9 aa, Homo Sapiens
AKIFGLELI

SEQ ID NO: 628841 - protein, 9 aa, Homo Sapiens
AYPVPRMGS

SEQ ID NO: 628842 - protein, 9 aa, Homo Sapiens
QAAAIKEDY

SEQ ID NO: 628843 - protein, 9 aa, Homo Sapiens
KCQGLLFDI

SEQ ID NO: 628844 - protein, 9 aa, Homo Sapiens
GHHGITGDK

SEQ ID NO: 628845 - protein, 9 aa, Homo Sapiens
GESGRPVQK

SEQ ID NO: 628846 - protein, 9 aa, Homo Sapiens
VYSWDKKNK

SEQ ID NO: 628847 - protein, 9 aa, Homo Sapiens
VTDLQEILG

SEQ ID NO: 628848 - protein, 9 aa, Homo Sapiens
THYCMFLKH

SEQ ID NO: 628849 - protein, 9 aa, Homo Sapiens
QNTHVHDAQ

SEQ ID NO: 628850 - protein, 9 aa, Homo Sapiens
LVIDIQTIQ

SEQ ID NO: 628851 - protein, 9 aa, Homo Sapiens
QLKGEWNLK

SEQ ID NO: 628852 - protein, 9 aa, Homo Sapiens
SAHVWRPST

SEQ ID NO: 628853 - protein, 9 aa, Homo Sapiens
AMAHFTIHT

SEQ ID NO: 628854 - protein, 9 aa, Homo Sapiens
TLDACAKMR

SEQ ID NO: 628855 - protein, 9 aa, Homo Sapiens
VLFLRITGG

SEQ ID NO: 628856 - protein, 9 aa, Homo Sapiens
SRRKHDCLI

SEQ ID NO: 628857 - protein, 9 aa, Homo Sapiens
FVGLIIPFV

SEQ ID NO: 628858 - protein, 9 aa, Homo Sapiens
TGAYLLTLN

SEQ ID NO: 628859 - protein, 9 aa, Homo Sapiens
VSVVNVLYV

SEQ ID NO: 628860 - protein, 9 aa, Homo Sapiens
AYLKAKSES

SEQ ID NO: 628861 - protein, 9 aa, Homo Sapiens
LQAWWASKV

SEQ ID NO: 628862 - protein, 9 aa, Homo Sapiens
DGVGVGDED

SEQ ID NO: 628863 - protein, 9 aa, Homo Sapiens
WLKMAEQLI

SEQ ID NO: 628864 - protein, 9 aa, Homo Sapiens
NSARHWKTI

SEQ ID NO: 628865 - protein, 9 aa, Homo Sapiens
LLNSMTHPG

SEQ ID NO: 628866 - protein, 9 aa, Homo Sapiens
PTASDDTSN

SEQ ID NO: 628867 - protein, 9 aa, Homo Sapiens
MWSGMLNPG

SEQ ID NO: 628868 - protein, 9 aa, Homo Sapiens
EAKGGLPEQ

SEQ ID NO: 628869 - protein, 9 aa, Homo Sapiens
QKKQLLLLE

SEQ ID NO: 628870 - protein, 9 aa, Homo Sapiens
WPEWMKVHH

SEQ ID NO: 628871 - protein, 9 aa, Homo Sapiens
FHPGLMFPF

SEQ ID NO: 628872 - protein, 9 aa, Homo Sapiens
ESLSSQASV

SEQ ID NO: 628873 - protein, 9 aa, Homo Sapiens
HSPTALNSA

SEQ ID NO: 628874 - protein, 9 aa, Homo Sapiens
KADRSLLNC

SEQ ID NO: 628875 - protein, 9 aa, Homo Sapiens
RKMGARDTR

SEQ ID NO: 628876 - protein, 9 aa, Homo Sapiens
GECMDLIYH

SEQ ID NO: 628877 - protein, 9 aa, Homo Sapiens
NLILANTNT

SEQ ID NO: 628878 - protein, 9 aa, Homo Sapiens
WIICKDIKK

SEQ ID NO: 628879 - protein, 9 aa, Homo Sapiens
DCAKGDVID

SEQ ID NO: 628880 - protein, 9 aa, Homo Sapiens
AINECKGAV

SEQ ID NO: 628881 - protein, 9 aa, Homo Sapiens
AFAIAAFVI

SEQ ID NO: 628882 - protein, 9 aa, Homo Sapiens
YTLCFCLEE

SEQ ID NO: 628883 - protein, 9 aa, Homo Sapiens
AATDIECSA

SEQ ID NO: 628884 - protein, 9 aa, Homo Sapiens
TDSGLLPVA

SEQ ID NO: 628885 - protein, 9 aa, Homo Sapiens
APSGMELLS

SEQ ID NO: 628886 - protein, 9 aa, Homo Sapiens
RRWDGVAKG

SEQ ID NO: 628887 - protein, 9 aa, Homo Sapiens
NQYHREMMA

SEQ ID NO: 628888 - protein, 9 aa, Homo Sapiens
ENLAAVLTF

SEQ ID NO: 628889 - protein, 9 aa, Homo Sapiens
IAKEEREPA

SEQ ID NO: 628890 - protein, 9 aa, Homo Sapiens
RDVMVKENK

SEQ ID NO: 628891 - protein, 9 aa, Homo Sapiens
FLPVAVAYA

SEQ ID NO: 628892 - protein, 9 aa, Homo Sapiens
NQGRTWSPV

SEQ ID NO: 628893 - protein, 9 aa, Homo Sapiens
QYNDYVDVF

SEQ ID NO: 628894 - protein, 9 aa, Homo Sapiens
CHECWKTFG

SEQ ID NO: 628895 - protein, 9 aa, Homo Sapiens
DHITSRDLG

SEQ ID NO: 628896 - protein, 9 aa, Homo Sapiens
GVALQDQCK

SEQ ID NO: 628897 - protein, 9 aa, Homo Sapiens
LFIIVWMYL

SEQ ID NO: 628898 - protein, 9 aa, Homo Sapiens
ELIYTIEAR

SEQ ID NO: 628899 - protein, 9 aa, Homo Sapiens
KLTYFLPVA

SEQ ID NO: 628900 - protein, 9 aa, Homo Sapiens
CLDGEDVSA

SEQ ID NO: 628901 - protein, 9 aa, Homo Sapiens
EVSGCPAPP

SEQ ID NO: 628902 - protein, 9 aa, Homo Sapiens
AEEHTELEA

SEQ ID NO: 628903 - protein, 9 aa, Homo Sapiens
RLHVRCSQS

SEQ ID NO: 628904 - protein, 9 aa, Homo Sapiens
KFNTFTTIP

SEQ ID NO: 628905 - protein, 9 aa, Homo Sapiens
ERFLAGSLA

SEQ ID NO: 628906 - protein, 9 aa, Homo Sapiens
WEIYLSPRS

SEQ ID NO: 628907 - protein, 9 aa, Homo Sapiens
TCEPCGSGF

SEQ ID NO: 628908 - protein, 9 aa, Homo Sapiens
PCGCKCSKC

SEQ ID NO: 628909 - protein, 9 aa, Homo Sapiens
AVGGGTCLP

SEQ ID NO: 628910 - protein, 9 aa, Homo Sapiens
QRLNACQWF

SEQ ID NO: 628911 - protein, 9 aa, Homo Sapiens
ALVTTPMCC

SEQ ID NO: 628912 - protein, 9 aa, Homo Sapiens
LASWVYRKI

SEQ ID NO: 628913 - protein, 9 aa, Homo Sapiens
PYDHITSRD

SEQ ID NO: 628914 - protein, 9 aa, Homo Sapiens
GNLHNLERK

SEQ ID NO: 628915 - protein, 9 aa, Homo Sapiens
SVRSQLYVG

SEQ ID NO: 628916 - protein, 9 aa, Homo Sapiens
SMDFNATGR

SEQ ID NO: 628917 - protein, 9 aa, Homo Sapiens
KLVDFIIEV

SEQ ID NO: 628918 - protein, 9 aa, Homo Sapiens
PYEHPENYI

SEQ ID NO: 628919 - protein, 9 aa, Homo Sapiens
LSQSQRHRP

SEQ ID NO: 628920 - protein, 9 aa, Homo Sapiens
KQPKLLHQF

SEQ ID NO: 628921 - protein, 9 aa, Homo Sapiens
GLFSHGGKG

SEQ ID NO: 628922 - protein, 9 aa, Homo Sapiens
GKAVRMAVV

SEQ ID NO: 628923 - protein, 9 aa, Homo Sapiens
SMNILYPVI

SEQ ID NO: 628924 - protein, 9 aa, Homo Sapiens
TAISPGTPP

SEQ ID NO: 628925 - protein, 9 aa, Homo Sapiens
GHLDGKVAA

SEQ ID NO: 628926 - protein, 9 aa, Homo Sapiens
ASCGPQVGV

SEQ ID NO: 628927 - protein, 9 aa, Homo Sapiens
DLHMVLDED

SEQ ID NO: 628928 - protein, 9 aa, Homo Sapiens
EVSCIYGYV

SEQ ID NO: 628929 - protein, 9 aa, Homo Sapiens
TKIGKESWF

SEQ ID NO: 628930 - protein, 9 aa, Homo Sapiens
AFFKTLSNI

SEQ ID NO: 628931 - protein, 9 aa, Homo Sapiens
SAAAGACAR

SEQ ID NO: 628932 - protein, 9 aa, Homo Sapiens
SCRHNIVDE

SEQ ID NO: 628933 - protein, 9 aa, Homo Sapiens
TLAVPKCQR

SEQ ID NO: 628934 - protein, 9 aa, Homo Sapiens
MLKGLQHTN

SEQ ID NO: 628935 - protein, 9 aa, Homo Sapiens
CAKEVGNAN

SEQ ID NO: 628936 - protein, 9 aa, Homo Sapiens
VRVHTTGII

SEQ ID NO: 628937 - protein, 9 aa, Homo Sapiens
GPENEGTSA

SEQ ID NO: 628938 - protein, 9 aa, Homo Sapiens
SSACIQRVN

SEQ ID NO: 628939 - protein, 9 aa, Homo Sapiens
PDIEWIICK

SEQ ID NO: 628940 - protein, 9 aa, Homo Sapiens
VGLRAILTC

SEQ ID NO: 628941 - protein, 9 aa, Homo Sapiens
FTELRYHVR

SEQ ID NO: 628942 - protein, 9 aa, Homo Sapiens
MVLLGAKDK

SEQ ID NO: 628943 - protein, 9 aa, Homo Sapiens
PQGKPQGPH

SEQ ID NO: 628944 - protein, 9 aa, Homo Sapiens
ICVYGQGDL

SEQ ID NO: 628945 - protein, 9 aa, Homo Sapiens
DCIQAWAQQ

SEQ ID NO: 628946 - protein, 9 aa, Homo Sapiens
CGYRSFSIS

SEQ ID NO: 628947 - protein, 9 aa, Homo Sapiens
TEQMLSHVT

SEQ ID NO: 628948 - protein, 9 aa, Homo Sapiens
PAFKLLFFS

SEQ ID NO: 628949 - protein, 9 aa, Homo Sapiens
EDVDSMDGL

SEQ ID NO: 628950 - protein, 9 aa, Homo Sapiens
AMERFPYVA

SEQ ID NO: 628951 - protein, 9 aa, Homo Sapiens
ERCSNLAFM

SEQ ID NO: 628952 - protein, 9 aa, Homo Sapiens
MLLLNEAGH

SEQ ID NO: 628953 - protein, 9 aa, Homo Sapiens
QGFRLLFYT

SEQ ID NO: 628954 - protein, 9 aa, Homo Sapiens
HNVAYPKSV

SEQ ID NO: 628955 - protein, 9 aa, Homo Sapiens
KARISLLTN

SEQ ID NO: 628956 - protein, 9 aa, Homo Sapiens
EAYGALTQT

SEQ ID NO: 628957 - protein, 9 aa, Homo Sapiens
HIKRKGLLV

SEQ ID NO: 628958 - protein, 9 aa, Homo Sapiens
CSISDARYL

SEQ ID NO: 628959 - protein, 9 aa, Homo Sapiens
FNPVSLCAN

SEQ ID NO: 628960 - protein, 9 aa, Homo Sapiens
TSRVCFHVG

SEQ ID NO: 628961 - protein, 9 aa, Homo Sapiens
TEDNIQLVA

SEQ ID NO: 628962 - protein, 9 aa, Homo Sapiens
GRHYCGRDP

SEQ ID NO: 628963 - protein, 9 aa, Homo Sapiens
KKGKANTSK

SEQ ID NO: 628964 - protein, 9 aa, Homo Sapiens
QLSEGDYAP

SEQ ID NO: 628965 - protein, 9 aa, Homo Sapiens
IMKVLQGKF

SEQ ID NO: 628966 - protein, 9 aa, Homo Sapiens
QTQLQIPMK

SEQ ID NO: 628967 - protein, 9 aa, Homo Sapiens
EPGGHWMPK

SEQ ID NO: 628968 - protein, 9 aa, Homo Sapiens
WLSYWIQEK

SEQ ID NO: 628969 - protein, 9 aa, Homo Sapiens
QGKEKSELG

SEQ ID NO: 628970 - protein, 9 aa, Homo Sapiens
YRKYVRSRL

SEQ ID NO: 628971 - protein, 9 aa, Homo Sapiens
IAAFVIVAV

SEQ ID NO: 628972 - protein, 9 aa, Homo Sapiens
YESLKKTRC

SEQ ID NO: 628973 - protein, 9 aa, Homo Sapiens
CDYACGPHG

SEQ ID NO: 628974 - protein, 9 aa, Homo Sapiens
TLALESVLL

SEQ ID NO: 628975 - protein, 9 aa, Homo Sapiens
WMPKDCKPR

SEQ ID NO: 628976 - protein, 9 aa, Homo Sapiens
LPVAVAYAC

SEQ ID NO: 628977 - protein, 9 aa, Homo Sapiens
GASPTDPAR

SEQ ID NO: 628978 - protein, 9 aa, Homo Sapiens
FGCRAAAPR

SEQ ID NO: 628979 - protein, 9 aa, Homo Sapiens
KDALLEKQL

SEQ ID NO: 628980 - protein, 9 aa, Homo Sapiens
PTLVCSSVV

SEQ ID NO: 628981 - protein, 9 aa, Homo Sapiens
DPNSNVTRP

SEQ ID NO: 628982 - protein, 9 aa, Homo Sapiens
IRGCRASYP

SEQ ID NO: 628983 - protein, 9 aa, Homo Sapiens
KPLWRTVLK

SEQ ID NO: 628984 - protein, 9 aa, Homo Sapiens
PSCWHVRWR

SEQ ID NO: 628985 - protein, 9 aa, Homo Sapiens
YGPSTYGTT

SEQ ID NO: 628986 - protein, 9 aa, Homo Sapiens
ITISQLSFV

SEQ ID NO: 628987 - protein, 9 aa, Homo Sapiens
GAAGTQGKK

SEQ ID NO: 628988 - protein, 9 aa, Homo Sapiens
MSKTLCIHM

SEQ ID NO: 628989 - protein, 9 aa, Homo Sapiens
AVSLGWLPG

SEQ ID NO: 628990 - protein, 9 aa, Homo Sapiens
NDSTSPVSE

SEQ ID NO: 628991 - protein, 9 aa, Homo Sapiens
YKHVLGPQC

SEQ ID NO: 628992 - protein, 9 aa, Homo Sapiens
RVRVHTTGI

SEQ ID NO: 628993 - protein, 9 aa, Homo Sapiens
YSTCPSHIL

SEQ ID NO: 628994 - protein, 9 aa, Homo Sapiens
APGLYHYPC

SEQ ID NO: 628995 - protein, 9 aa, Homo Sapiens
VGLPLLFLS

SEQ ID NO: 628996 - protein, 9 aa, Homo Sapiens
LLRAHEEQG

SEQ ID NO: 628997 - protein, 9 aa, Homo Sapiens
IQITWFVSW

SEQ ID NO: 628998 - protein, 9 aa, Homo Sapiens
ICKLLAADG

SEQ ID NO: 628999 - protein, 9 aa, Homo Sapiens
KYCYICPHI

SEQ ID NO: 629000 - protein, 9 aa, Homo Sapiens
GRMVLLSLV

SEQ ID NO: 629001 - protein, 9 aa, Homo Sapiens
PYIRDYPAL

SEQ ID NO: 629002 - protein, 9 aa, Homo Sapiens
RFFIGNQVL

SEQ ID NO: 629003 - protein, 9 aa, Homo Sapiens
RKRSKGVRV

SEQ ID NO: 629004 - protein, 9 aa, Homo Sapiens
RFYVNGRKV

SEQ ID NO: 629005 - protein, 9 aa, Homo Sapiens
PGRAGRQDT

SEQ ID NO: 629006 - protein, 9 aa, Homo Sapiens
PIGIPAERL

SEQ ID NO: 629007 - protein, 9 aa, Homo Sapiens
LKVNGVKNI

SEQ ID NO: 629008 - protein, 9 aa, Homo Sapiens
DVGSLALDS

SEQ ID NO: 629009 - protein, 9 aa, Homo Sapiens
CPVRFQYVL

SEQ ID NO: 629010 - protein, 9 aa, Homo Sapiens
LQLHVKHIH

SEQ ID NO: 629011 - protein, 9 aa, Homo Sapiens
SFVLVENKT

SEQ ID NO: 629012 - protein, 9 aa, Homo Sapiens
RAPTKQLFP

SEQ ID NO: 629013 - protein, 9 aa, Homo Sapiens
HHLPGHVLQ

SEQ ID NO: 629014 - protein, 9 aa, Homo Sapiens
RLNACQWFL

SEQ ID NO: 629015 - protein, 9 aa, Homo Sapiens
MFHDLNRKL

SEQ ID NO: 629016 - protein, 9 aa, Homo Sapiens
QQGSIAFDN

SEQ ID NO: 629017 - protein, 9 aa, Homo Sapiens
KGREAIYPL

SEQ ID NO: 629018 - protein, 9 aa, Homo Sapiens
SKRKKVKFN

SEQ ID NO: 629019 - protein, 9 aa, Homo Sapiens
DAPSPLPQA

SEQ ID NO: 629020 - protein, 9 aa, Homo Sapiens
TFRIPVSRP

SEQ ID NO: 629021 - protein, 9 aa, Homo Sapiens
HMENVSPRP

SEQ ID NO: 629022 - protein, 9 aa, Homo Sapiens
GSGSHARTS

SEQ ID NO: 629023 - protein, 9 aa, Homo Sapiens
YGVYCYRQL

SEQ ID NO: 629024 - protein, 9 aa, Homo Sapiens
WENLAAVLT

SEQ ID NO: 629025 - protein, 9 aa, Homo Sapiens
AEKKQAQEE

SEQ ID NO: 629026 - protein, 9 aa, Homo Sapiens
DAGSSVGTR

SEQ ID NO: 629027 - protein, 9 aa, Homo Sapiens
TNIETTHPS

SEQ ID NO: 629028 - protein, 9 aa, Homo Sapiens
HLQKKQLLL

SEQ ID NO: 629029 - protein, 9 aa, Homo Sapiens
EKKERERCS

SEQ ID NO: 629030 - protein, 9 aa, Homo Sapiens
QASSLIDNI

SEQ ID NO: 629031 - protein, 9 aa, Homo Sapiens
DNNLVRHQD

SEQ ID NO: 629032 - protein, 9 aa, Homo Sapiens
DICVYGQGD

SEQ ID NO: 629033 - protein, 9 aa, Homo Sapiens
QSLKLIHLV

SEQ ID NO: 629034 - protein, 9 aa, Homo Sapiens
FYRKDWSCF

SEQ ID NO: 629035 - protein, 9 aa, Homo Sapiens
ENGSFNQPL

SEQ ID NO: 629036 - protein, 9 aa, Homo Sapiens
RPTMYPSAH

SEQ ID NO: 629037 - protein, 9 aa, Homo Sapiens
VRSHDPGQR

SEQ ID NO: 629038 - protein, 9 aa, Homo Sapiens
GIFSMKVSL

SEQ ID NO: 629039 - protein, 9 aa, Homo Sapiens
SAPKEDSGT

SEQ ID NO: 629040 - protein, 9 aa, Homo Sapiens
NKKETTADS

SEQ ID NO: 629041 - protein, 9 aa, Homo Sapiens
SLPTSPPPH

SEQ ID NO: 629042 - protein, 9 aa, Homo Sapiens
TRTTLCQWK

SEQ ID NO: 629043 - protein, 9 aa, Homo Sapiens
ECAEGSHCS

SEQ ID NO: 629044 - protein, 9 aa, Homo Sapiens
FPLDNTAVR

SEQ ID NO: 629045 - protein, 9 aa, Homo Sapiens
MVRPSELLA

SEQ ID NO: 629046 - protein, 9 aa, Homo Sapiens
KGLQHTNIV

SEQ ID NO: 629047 - protein, 9 aa, Homo Sapiens
NTYCGIILL

SEQ ID NO: 629048 - protein, 9 aa, Homo Sapiens
PPPKNLTSW

SEQ ID NO: 629049 - protein, 9 aa, Homo Sapiens
AALRRSPRR

SEQ ID NO: 629050 - protein, 9 aa, Homo Sapiens
KTLALESVL

SEQ ID NO: 629051 - protein, 9 aa, Homo Sapiens
ARPCLCSGP

SEQ ID NO: 629052 - protein, 9 aa, Homo Sapiens
EAVDCVRFI

SEQ ID NO: 629053 - protein, 9 aa, Homo Sapiens
RDDFGNMFV

SEQ ID NO: 629054 - protein, 9 aa, Homo Sapiens
YRMRWWMAC

SEQ ID NO: 629055 - protein, 9 aa, Homo Sapiens
QTLWLLILA

SEQ ID NO: 629056 - protein, 9 aa, Homo Sapiens
WGNFLSRFE

SEQ ID NO: 629057 - protein, 9 aa, Homo Sapiens
AVPEAVGFD

SEQ ID NO: 629058 - protein, 9 aa, Homo Sapiens
RIPSVRTLL

SEQ ID NO: 629059 - protein, 9 aa, Homo Sapiens
QEHFLLDPN

SEQ ID NO: 629060 - protein, 9 aa, Homo Sapiens
MNGYEKDSS

SEQ ID NO: 629061 - protein, 9 aa, Homo Sapiens
NGSVPFEEM

SEQ ID NO: 629062 - protein, 9 aa, Homo Sapiens
NTIAYRPLL

SEQ ID NO: 629063 - protein, 9 aa, Homo Sapiens
HATGAEIDK

SEQ ID NO: 629064 - protein, 9 aa, Homo Sapiens
FRVAPWIMK

SEQ ID NO: 629065 - protein, 9 aa, Homo Sapiens
SKQAQLRAP

SEQ ID NO: 629066 - protein, 9 aa, Homo Sapiens
SDSCDSETT

SEQ ID NO: 629067 - protein, 9 aa, Homo Sapiens
VPDSSVCRH

SEQ ID NO: 629068 - protein, 9 aa, Homo Sapiens
AIFSAAKNC

SEQ ID NO: 629069 - protein, 9 aa, Homo Sapiens
SLLKRFACI

SEQ ID NO: 629070 - protein, 9 aa, Homo Sapiens
EHLWKLMVV

SEQ ID NO: 629071 - protein, 9 aa, Homo Sapiens
GETPSAITT

SEQ ID NO: 629072 - protein, 9 aa, Homo Sapiens
WGPQSGPPP

SEQ ID NO: 629073 - protein, 9 aa, Homo Sapiens
TRAETGMEY

SEQ ID NO: 629074 - protein, 9 aa, Homo Sapiens
LPEQRSCLA

SEQ ID NO: 629075 - protein, 9 aa, Homo Sapiens
EDHTPLNPA

SEQ ID NO: 629076 - protein, 9 aa, Homo Sapiens
YEEYDACQR

SEQ ID NO: 629077 - protein, 9 aa, Homo Sapiens
KPLGCCWPS

SEQ ID NO: 629078 - protein, 9 aa, Homo Sapiens
FTLIIITSY

SEQ ID NO: 629079 - protein, 9 aa, Homo Sapiens
RKPLCAVWR

SEQ ID NO: 629080 - protein, 9 aa, Homo Sapiens
NVMVIFVYI

SEQ ID NO: 629081 - protein, 9 aa, Homo Sapiens
GGGGGTRPC

SEQ ID NO: 629082 - protein, 9 aa, Homo Sapiens
HTQLSEKAD

SEQ ID NO: 629083 - protein, 9 aa, Homo Sapiens
DGLSRVHND

SEQ ID NO: 629084 - protein, 9 aa, Homo Sapiens
YGQGDLPWL

SEQ ID NO: 629085 - protein, 9 aa, Homo Sapiens
TELRYHVRR

SEQ ID NO: 629086 - protein, 9 aa, Homo Sapiens
PRQPSPWPT

SEQ ID NO: 629087 - protein, 9 aa, Homo Sapiens
LIRNHREKK

SEQ ID NO: 629088 - protein, 9 aa, Homo Sapiens
DGNGPLEPF

SEQ ID NO: 629089 - protein, 9 aa, Homo Sapiens
PSTYGTTTA

SEQ ID NO: 629090 - protein, 9 aa, Homo Sapiens
ILGDKGNLL

SEQ ID NO: 629091 - protein, 9 aa, Homo Sapiens
LLKQALANG

SEQ ID NO: 629092 - protein, 9 aa, Homo Sapiens
ATASLWKEG

SEQ ID NO: 629093 - protein, 9 aa, Homo Sapiens
DARDGGMSS

SEQ ID NO: 629094 - protein, 9 aa, Homo Sapiens
VGFTKKWRP

SEQ ID NO: 629095 - protein, 9 aa, Homo Sapiens
SSRQLDCKA

SEQ ID NO: 629096 - protein, 9 aa, Homo Sapiens
SQVDEGLSI

SEQ ID NO: 629097 - protein, 9 aa, Homo Sapiens
GGPPREVGA

SEQ ID NO: 629098 - protein, 9 aa, Homo Sapiens
FVLVENKTG

SEQ ID NO: 629099 - protein, 9 aa, Homo Sapiens
KSVSFFAIG

SEQ ID NO: 629100 - protein, 9 aa, Homo Sapiens
HTNIVRFYD

SEQ ID NO: 629101 - protein, 9 aa, Homo Sapiens
PVSSFNLPF

SEQ ID NO: 629102 - protein, 9 aa, Homo Sapiens
EKSRPTGVP

SEQ ID NO: 629103 - protein, 9 aa, Homo Sapiens
ADKMPHMHK

SEQ ID NO: 629104 - protein, 9 aa, Homo Sapiens
MSSSQVATR

SEQ ID NO: 629105 - protein, 9 aa, Homo Sapiens
HNLKRIMKV

SEQ ID NO: 629106 - protein, 9 aa, Homo Sapiens
FNTFTTIPP

SEQ ID NO: 629107 - protein, 9 aa, Homo Sapiens
LDFRGKTKV

SEQ ID NO: 629108 - protein, 9 aa, Homo Sapiens
VLRLEIYER

SEQ ID NO: 629109 - protein, 9 aa, Homo Sapiens
VSTDQGIPD

SEQ ID NO: 629110 - protein, 9 aa, Homo Sapiens
RFLAGSLAV

SEQ ID NO: 629111 - protein, 9 aa, Homo Sapiens
EKLASSAGA

SEQ ID NO: 629112 - protein, 9 aa, Homo Sapiens
NKLQHVQTL

SEQ ID NO: 629113 - protein, 9 aa, Homo Sapiens
GYNATTQEM

SEQ ID NO: 629114 - protein, 9 aa, Homo Sapiens
LGTLERYTV

SEQ ID NO: 629115 - protein, 9 aa, Homo Sapiens
EAARAVVLI

SEQ ID NO: 629116 - protein, 9 aa, Homo Sapiens
VLKNMTDNA

SEQ ID NO: 629117 - protein, 9 aa, Homo Sapiens
LPNDVITFA

SEQ ID NO: 629118 - protein, 9 aa, Homo Sapiens
GPNVSAIRE

SEQ ID NO: 629119 - protein, 9 aa, Homo Sapiens
ASELRFYVN

SEQ ID NO: 629120 - protein, 9 aa, Homo Sapiens
TGGGGGKPL

SEQ ID NO: 629121 - protein, 9 aa, Homo Sapiens
VVPVPPLMG

SEQ ID NO: 629122 - protein, 9 aa, Homo Sapiens
QVPKGLSEQ

SEQ ID NO: 629123 - protein, 9 aa, Homo Sapiens
PPCAVVGLL

SEQ ID NO: 629124 - protein, 9 aa, Homo Sapiens
GEHPQPHTT

SEQ ID NO: 629125 - protein, 9 aa, Homo Sapiens
ISYSLFQAT

SEQ ID NO: 629126 - protein, 9 aa, Homo Sapiens
VAKGPKGEN

SEQ ID NO: 629127 - protein, 9 aa, Homo Sapiens
NLVRHQDAC

SEQ ID NO: 629128 - protein, 9 aa, Homo Sapiens
LPALGLLEG

SEQ ID NO: 629129 - protein, 9 aa, Homo Sapiens
SGMKDKHSS

SEQ ID NO: 629130 - protein, 9 aa, Homo Sapiens
HPVPYNPEE

SEQ ID NO: 629131 - protein, 9 aa, Homo Sapiens
KSGPRKDGS

SEQ ID NO: 629132 - protein, 9 aa, Homo Sapiens
ILIEDSGQP

SEQ ID NO: 629133 - protein, 9 aa, Homo Sapiens
GMHLFYMEL

SEQ ID NO: 629134 - protein, 9 aa, Homo Sapiens
TICSMERRR

SEQ ID NO: 629135 - protein, 9 aa, Homo Sapiens
MDSSRPQAG

SEQ ID NO: 629136 - protein, 9 aa, Homo Sapiens
FTVSGTHMV

SEQ ID NO: 629137 - protein, 9 aa, Homo Sapiens
PNDEEAHSS

SEQ ID NO: 629138 - protein, 9 aa, Homo Sapiens
LSNIGILPA

SEQ ID NO: 629139 - protein, 9 aa, Homo Sapiens
DDSCKPNSV

SEQ ID NO: 629140 - protein, 9 aa, Homo Sapiens
LKLRFKRLW

SEQ ID NO: 629141 - protein, 9 aa, Homo Sapiens
MFHLKNSIL

SEQ ID NO: 629142 - protein, 9 aa, Homo Sapiens
FLLDPNSNV

SEQ ID NO: 629143 - protein, 9 aa, Homo Sapiens
QGSGREVLG

SEQ ID NO: 629144 - protein, 9 aa, Homo Sapiens
ISQSLSNAL

SEQ ID NO: 629145 - protein, 9 aa, Homo Sapiens
TCWGYTREG

SEQ ID NO: 629146 - protein, 9 aa, Homo Sapiens
PCINSSATR

SEQ ID NO: 629147 - protein, 9 aa, Homo Sapiens
DPREQSCLG

SEQ ID NO: 629148 - protein, 9 aa, Homo Sapiens
DCADKENPE

SEQ ID NO: 629149 - protein, 9 aa, Homo Sapiens
TSVHLRREV

SEQ ID NO: 629150 - protein, 9 aa, Homo Sapiens
SRVHGHSSL

SEQ ID NO: 629151 - protein, 9 aa, Homo Sapiens
MEKEGCMEY

SEQ ID NO: 629152 - protein, 9 aa, Homo Sapiens
DILGEDTEI

SEQ ID NO: 629153 - protein, 9 aa, Homo Sapiens
YSVLYVVPC

SEQ ID NO: 629154 - protein, 9 aa, Homo Sapiens
IYPLLSKMT

SEQ ID NO: 629155 - protein, 9 aa, Homo Sapiens
PDSSVCRHT

SEQ ID NO: 629156 - protein, 9 aa, Homo Sapiens
HLRGKEGHF

SEQ ID NO: 629157 - protein, 9 aa, Homo Sapiens
VIDIQTIQP

SEQ ID NO: 629158 - protein, 9 aa, Homo Sapiens
MGSVNEAGH

SEQ ID NO: 629159 - protein, 9 aa, Homo Sapiens
MFHGQPLFP

SEQ ID NO: 629160 - protein, 9 aa, Homo Sapiens
VSARDAGLP

SEQ ID NO: 629161 - protein, 9 aa, Homo Sapiens
HVCDKSYKS

SEQ ID NO: 629162 - protein, 9 aa, Homo Sapiens
LLAGKGSKG

SEQ ID NO: 629163 - protein, 9 aa, Homo Sapiens
ACARPCFST

SEQ ID NO: 629164 - protein, 9 aa, Homo Sapiens
SVRTLQAHE

SEQ ID NO: 629165 - protein, 9 aa, Homo Sapiens
KTPMYFFLW

SEQ ID NO: 629166 - protein, 9 aa, Homo Sapiens
STRRVVEED

SEQ ID NO: 629167 - protein, 9 aa, Homo Sapiens
LITENGSFN

SEQ ID NO: 629168 - protein, 9 aa, Homo Sapiens
LSPRSPGWM

SEQ ID NO: 629169 - protein, 9 aa, Homo Sapiens
LQVLAGAES

SEQ ID NO: 629170 - protein, 9 aa, Homo Sapiens
IDILGEDTE

SEQ ID NO: 629171 - protein, 9 aa, Homo Sapiens
DSTSPVSEF

SEQ ID NO: 629172 - protein, 9 aa, Homo Sapiens
IHKDEPGHP

SEQ ID NO: 629173 - protein, 9 aa, Homo Sapiens
GSPSQVKGQ

SEQ ID NO: 629174 - protein, 9 aa, Homo Sapiens
CDVRQRGAQ

SEQ ID NO: 629175 - protein, 9 aa, Homo Sapiens
ATQAEDCIQ

SEQ ID NO: 629176 - protein, 9 aa, Homo Sapiens
AISPGTPPS

SEQ ID NO: 629177 - protein, 9 aa, Homo Sapiens
FSTVSSLPD

SEQ ID NO: 629178 - protein, 9 aa, Homo Sapiens
LRGDVLRVL

SEQ ID NO: 629179 - protein, 9 aa, Homo Sapiens
SWAEGSFVS

SEQ ID NO: 629180 - protein, 9 aa, Homo Sapiens
EGIPPEQQR

SEQ ID NO: 629181 - protein, 9 aa, Homo Sapiens
YLSPRSPGW

SEQ ID NO: 629182 - protein, 9 aa, Homo Sapiens
VEEMETGNV

SEQ ID NO: 629183 - protein, 9 aa, Homo Sapiens
WVDLHIQYL

SEQ ID NO: 629184 - protein, 9 aa, Homo Sapiens
SIAKEEREP

SEQ ID NO: 629185 - protein, 9 aa, Homo Sapiens
RDYLVDAST

SEQ ID NO: 629186 - protein, 9 aa, Homo Sapiens
FLPFFLQMP

SEQ ID NO: 629187 - protein, 9 aa, Homo Sapiens
PHYRWKQNV

SEQ ID NO: 629188 - protein, 9 aa, Homo Sapiens
SIEKIRFFR

SEQ ID NO: 629189 - protein, 9 aa, Homo Sapiens
EVLVLRLEI

SEQ ID NO: 629190 - protein, 9 aa, Homo Sapiens
QEDIQKGYV

SEQ ID NO: 629191 - protein, 9 aa, Homo Sapiens
SIAYLKAKS

SEQ ID NO: 629192 - protein, 9 aa, Homo Sapiens
VEGVPNVIL

SEQ ID NO: 629193 - protein, 9 aa, Homo Sapiens
FADSKGDVW

SEQ ID NO: 629194 - protein, 9 aa, Homo Sapiens
GPRKAPHFS

SEQ ID NO: 629195 - protein, 9 aa, Homo Sapiens
ITLEDSSVN

SEQ ID NO: 629196 - protein, 9 aa, Homo Sapiens
LVHADRDNR

SEQ ID NO: 629197 - protein, 9 aa, Homo Sapiens
IEEHDKVLH

SEQ ID NO: 629198 - protein, 9 aa, Homo Sapiens
NGNIKVLNQ

SEQ ID NO: 629199 - protein, 9 aa, Homo Sapiens
IQALLDKLW

SEQ ID NO: 629200 - protein, 9 aa, Homo Sapiens
LKRFACIAA

SEQ ID NO: 629201 - protein, 9 aa, Homo Sapiens
KLMIDLLGD

SEQ ID NO: 629202 - protein, 9 aa, Homo Sapiens
WSRVLVEMA

SEQ ID NO: 629203 - protein, 9 aa, Homo Sapiens
EHVNAIRGL

SEQ ID NO: 629204 - protein, 9 aa, Homo Sapiens
LLHDILQEP

SEQ ID NO: 629205 - protein, 9 aa, Homo Sapiens
IADILLLFC

SEQ ID NO: 629206 - protein, 9 aa, Homo Sapiens
QEIEKDIQD

SEQ ID NO: 629207 - protein, 9 aa, Homo Sapiens
FICDHFVIV

SEQ ID NO: 629208 - protein, 9 aa, Homo Sapiens
CWHVRWRTE

SEQ ID NO: 629209 - protein, 9 aa, Homo Sapiens
ILQAGLGQL

SEQ ID NO: 629210 - protein, 9 aa, Homo Sapiens
FMGSIDLSD

SEQ ID NO: 629211 - protein, 9 aa, Homo Sapiens
NALVTAKVP

SEQ ID NO: 629212 - protein, 9 aa, Homo Sapiens
VQFAKAMDE

SEQ ID NO: 629213 - protein, 9 aa, Homo Sapiens
TTSQLECCS

SEQ ID NO: 629214 - protein, 9 aa, Homo Sapiens
FGSICTGTF

SEQ ID NO: 629215 - protein, 9 aa, Homo Sapiens
AESFRDALR

SEQ ID NO: 629216 - protein, 9 aa, Homo Sapiens
QCDYACGPH

SEQ ID NO: 629217 - protein, 9 aa, Homo Sapiens
PQAGGQHSR

SEQ ID NO: 629218 - protein, 9 aa, Homo Sapiens
HTEQSLRLL

SEQ ID NO: 629219 - protein, 9 aa, Homo Sapiens
VCDKSYKSN

SEQ ID NO: 629220 - protein, 9 aa, Homo Sapiens
YCGIILLAN

SEQ ID NO: 629221 - protein, 9 aa, Homo Sapiens
GSRPSLQWP

SEQ ID NO: 629222 - protein, 9 aa, Homo Sapiens
LDYWSKAQL

SEQ ID NO: 629223 - protein, 9 aa, Homo Sapiens
HIHLENQGK

SEQ ID NO: 629224 - protein, 9 aa, Homo Sapiens
FLLTLITMN

SEQ ID NO: 629225 - protein, 9 aa, Homo Sapiens
PFKGSSSAA

SEQ ID NO: 629226 - protein, 9 aa, Homo Sapiens
PSLCIDLTL

SEQ ID NO: 629227 - protein, 9 aa, Homo Sapiens
TASLWKEGL

SEQ ID NO: 629228 - protein, 9 aa, Homo Sapiens
RKDREELCG

SEQ ID NO: 629229 - protein, 9 aa, Homo Sapiens
VAPCEGIVC

SEQ ID NO: 629230 - protein, 9 aa, Homo Sapiens
GFLLTLITM

SEQ ID NO: 629231 - protein, 9 aa, Homo Sapiens
RCSNLAFMF

SEQ ID NO: 629232 - protein, 9 aa, Homo Sapiens
SSVVGSWSY

SEQ ID NO: 629233 - protein, 9 aa, Homo Sapiens
PYEWYNTHP

SEQ ID NO: 629234 - protein, 9 aa, Homo Sapiens
LGPNATRPD

SEQ ID NO: 629235 - protein, 9 aa, Homo Sapiens
NDEQQGSIA

SEQ ID NO: 629236 - protein, 9 aa, Homo Sapiens
NNYDMTSLN

SEQ ID NO: 629237 - protein, 9 aa, Homo Sapiens
ISNVRKITC

SEQ ID NO: 629238 - protein, 9 aa, Homo Sapiens
EDTAFDCAT

SEQ ID NO: 629239 - protein, 9 aa, Homo Sapiens
HLHSVKTAS

SEQ ID NO: 629240 - protein, 9 aa, Homo Sapiens
HDLYCYSYS

SEQ ID NO: 629241 - protein, 9 aa, Homo Sapiens
QDTRSWRDG

SEQ ID NO: 629242 - protein, 9 aa, Homo Sapiens
YVSVLFLRI

SEQ ID NO: 629243 - protein, 9 aa, Homo Sapiens
NHRCINCFF

SEQ ID NO: 629244 - protein, 9 aa, Homo Sapiens
VGHDLYCYS

SEQ ID NO: 629245 - protein, 9 aa, Homo Sapiens
MFAEWEDRE

SEQ ID NO: 629246 - protein, 9 aa, Homo Sapiens
NVPLMLFLH

SEQ ID NO: 629247 - protein, 9 aa, Homo Sapiens
FLVFLVLMV

SEQ ID NO: 629248 - protein, 9 aa, Homo Sapiens
FKGSSSAAA

SEQ ID NO: 629249 - protein, 9 aa, Homo Sapiens
EDDSPVSIT

SEQ ID NO: 629250 - protein, 9 aa, Homo Sapiens
EQVMDYIVS

SEQ ID NO: 629251 - protein, 9 aa, Homo Sapiens
RGQPGHAGA

SEQ ID NO: 629252 - protein, 9 aa, Homo Sapiens
SLKKTRCRE

SEQ ID NO: 629253 - protein, 9 aa, Homo Sapiens
HCPAEKFSK

SEQ ID NO: 629254 - protein, 9 aa, Homo Sapiens
PHLRGKEGH

SEQ ID NO: 629255 - protein, 9 aa, Homo Sapiens
ISLPVIGSA

SEQ ID NO: 629256 - protein, 9 aa, Homo Sapiens
SVLMYLECL

SEQ ID NO: 629257 - protein, 9 aa, Homo Sapiens
RTQWEYPRL

SEQ ID NO: 629258 - protein, 9 aa, Homo Sapiens
AGPNVSAIR

SEQ ID NO: 629259 - protein, 9 aa, Homo Sapiens
IKILQALNI

SEQ ID NO: 629260 - protein, 9 aa, Homo Sapiens
EERLKGLGV

SEQ ID NO: 629261 - protein, 9 aa, Homo Sapiens
PASGTKSSL

SEQ ID NO: 629262 - protein, 9 aa, Homo Sapiens
IITDIQLHT

SEQ ID NO: 629263 - protein, 9 aa, Homo Sapiens
HEIMRALKS

SEQ ID NO: 629264 - protein, 9 aa, Homo Sapiens
KEVAAQSGF

SEQ ID NO: 629265 - protein, 9 aa, Homo Sapiens
VLKVNGIIL

SEQ ID NO: 629266 - protein, 9 aa, Homo Sapiens
PLIVEVWPG

SEQ ID NO: 629267 - protein, 9 aa, Homo Sapiens
KQGASEGPQ

SEQ ID NO: 629268 - protein, 9 aa, Homo Sapiens
TDIECSALQ

SEQ ID NO: 629269 - protein, 9 aa, Homo Sapiens
SVDDFETQD

SEQ ID NO: 629270 - protein, 9 aa, Homo Sapiens
SNNMGVGVV

SEQ ID NO: 629271 - protein, 9 aa, Homo Sapiens
KMKIYVEVV

SEQ ID NO: 629272 - protein, 9 aa, Homo Sapiens
KIVCSLDLY

SEQ ID NO: 629273 - protein, 9 aa, Homo Sapiens
EAIRQASRL

SEQ ID NO: 629274 - protein, 9 aa, Homo Sapiens
SSTHSVIEK

SEQ ID NO: 629275 - protein, 9 aa, Homo Sapiens
TKKYEDPEN

SEQ ID NO: 629276 - protein, 9 aa, Homo Sapiens
TTNIETTHP

SEQ ID NO: 629277 - protein, 9 aa, Homo Sapiens
EAWEATCIW

SEQ ID NO: 629278 - protein, 9 aa, Homo Sapiens
LGNAVVLWT

SEQ ID NO: 629279 - protein, 9 aa, Homo Sapiens
RGQGWSQGP

SEQ ID NO: 629280 - protein, 9 aa, Homo Sapiens
FINALVTTP

SEQ ID NO: 629281 - protein, 9 aa, Homo Sapiens
EGPSRRPGQ

SEQ ID NO: 629282 - protein, 9 aa, Homo Sapiens
SEELPPQSC

SEQ ID NO: 629283 - protein, 9 aa, Homo Sapiens
KRDHILAVL

SEQ ID NO: 629284 - protein, 9 aa, Homo Sapiens
SSRMEKYGN

SEQ ID NO: 629285 - protein, 9 aa, Homo Sapiens
MDANQRWYV

SEQ ID NO: 629286 - protein, 9 aa, Homo Sapiens
LSRFEKKTK

SEQ ID NO: 629287 - protein, 9 aa, Homo Sapiens
NSTTFQHDF

SEQ ID NO: 629288 - protein, 9 aa, Homo Sapiens
LSNLAAVGD

SEQ ID NO: 629289 - protein, 9 aa, Homo Sapiens
SKVFANSCT

SEQ ID NO: 629290 - protein, 9 aa, Homo Sapiens
FPLSHPMTE

SEQ ID NO: 629291 - protein, 9 aa, Homo Sapiens
SPEVTGQKI

SEQ ID NO: 629292 - protein, 9 aa, Homo Sapiens
NTTTNKEKE

SEQ ID NO: 629293 - protein, 9 aa, Homo Sapiens
TTNKEKEEI

SEQ ID NO: 629294 - protein, 9 aa, Homo Sapiens
DLLYALKTV

SEQ ID NO: 629295 - protein, 9 aa, Homo Sapiens
LTLGFERLL

SEQ ID NO: 629296 - protein, 9 aa, Homo Sapiens
VLVVWVSAQ

SEQ ID NO: 629297 - protein, 9 aa, Homo Sapiens
NSPGSSSAF

SEQ ID NO: 629298 - protein, 9 aa, Homo Sapiens
GGKDADGSI

SEQ ID NO: 629299 - protein, 9 aa, Homo Sapiens
NLHNLERKN

SEQ ID NO: 629300 - protein, 9 aa, Homo Sapiens
SELRFYVNG

SEQ ID NO: 629301 - protein, 9 aa, Homo Sapiens
GVGEAAQWG

SEQ ID NO: 629302 - protein, 9 aa, Homo Sapiens
DSRGDARYG

SEQ ID NO: 629303 - protein, 9 aa, Homo Sapiens
IVDKLLALW

SEQ ID NO: 629304 - protein, 9 aa, Homo Sapiens
NNLAHFHTL

SEQ ID NO: 629305 - protein, 9 aa, Homo Sapiens
VRHQDACET

SEQ ID NO: 629306 - protein, 9 aa, Homo Sapiens
CCPLCRGVP

SEQ ID NO: 629307 - protein, 9 aa, Homo Sapiens
FEVSCIYGY

SEQ ID NO: 629308 - protein, 9 aa, Homo Sapiens
CDGGWGLKE

SEQ ID NO: 629309 - protein, 9 aa, Homo Sapiens
QTSFCGYRS

SEQ ID NO: 629310 - protein, 9 aa, Homo Sapiens
MEYRNLGKS

SEQ ID NO: 629311 - protein, 9 aa, Homo Sapiens
VGLIIPFVI

SEQ ID NO: 629312 - protein, 9 aa, Homo Sapiens
SGRQTLSPD

SEQ ID NO: 629313 - protein, 9 aa, Homo Sapiens
YTEDNIQLV

SEQ ID NO: 629314 - protein, 9 aa, Homo Sapiens
ELSSYQLRP

SEQ ID NO: 629315 - protein, 9 aa, Homo Sapiens
LVAKIFGLE

SEQ ID NO: 629316 - protein, 9 aa, Homo Sapiens
TSQVSNLNK

SEQ ID NO: 629317 - protein, 9 aa, Homo Sapiens
ICCIYEFDK

SEQ ID NO: 629318 - protein, 9 aa, Homo Sapiens
QEVRLLPQD

SEQ ID NO: 629319 - protein, 9 aa, Homo Sapiens
SVSRDPFTS

SEQ ID NO: 629320 - protein, 9 aa, Homo Sapiens
ANRRIQITW

SEQ ID NO: 629321 - protein, 9 aa, Homo Sapiens
ICPHIVKEF

SEQ ID NO: 629322 - protein, 9 aa, Homo Sapiens
NGVLNEKEL

SEQ ID NO: 629323 - protein, 9 aa, Homo Sapiens
ASGMKDKHS

SEQ ID NO: 629324 - protein, 9 aa, Homo Sapiens
TFRQFSHLK

SEQ ID NO: 629325 - protein, 9 aa, Homo Sapiens
VRPGLDGVK

SEQ ID NO: 629326 - protein, 9 aa, Homo Sapiens
IFVLNDGYY

SEQ ID NO: 629327 - protein, 9 aa, Homo Sapiens
TGDSMLTSV

SEQ ID NO: 629328 - protein, 9 aa, Homo Sapiens
FHSPPPVPG

SEQ ID NO: 629329 - protein, 9 aa, Homo Sapiens
DASRLDDKE

SEQ ID NO: 629330 - protein, 9 aa, Homo Sapiens
CIHMTAGAY

SEQ ID NO: 629331 - protein, 9 aa, Homo Sapiens
FSMKVSLEQ

SEQ ID NO: 629332 - protein, 9 aa, Homo Sapiens
VRAAAAVTW

SEQ ID NO: 629333 - protein, 9 aa, Homo Sapiens
AGGQHSRGQ

SEQ ID NO: 629334 - protein, 9 aa, Homo Sapiens
SVSQGFRLL

SEQ ID NO: 629335 - protein, 9 aa, Homo Sapiens
PSRANPSPT

SEQ ID NO: 629336 - protein, 9 aa, Homo Sapiens
VSLESVSFP

SEQ ID NO: 629337 - protein, 9 aa, Homo Sapiens
EKQGASEGP

SEQ ID NO: 629338 - protein, 9 aa, Homo Sapiens
PVAVGMSID

SEQ ID NO: 629339 - protein, 9 aa, Homo Sapiens
PILIEDSGQ

SEQ ID NO: 629340 - protein, 9 aa, Homo Sapiens
AMDHCGEPR

SEQ ID NO: 629341 - protein, 9 aa, Homo Sapiens
VSHESSAEE

SEQ ID NO: 629342 - protein, 9 aa, Homo Sapiens
EIHKDEPGH

SEQ ID NO: 629343 - protein, 9 aa, Homo Sapiens
ILTKPHAWF

SEQ ID NO: 629344 - protein, 9 aa, Homo Sapiens
FAGFPQGGV

SEQ ID NO: 629345 - protein, 9 aa, Homo Sapiens
SPAVISLGS

SEQ ID NO: 629346 - protein, 9 aa, Homo Sapiens
NMANHVACF

SEQ ID NO: 629347 - protein, 9 aa, Homo Sapiens
PEEHEERKP

SEQ ID NO: 629348 - protein, 9 aa, Homo Sapiens
TFYEDRDFH

SEQ ID NO: 629349 - protein, 9 aa, Homo Sapiens
GKDVSPGEP

SEQ ID NO: 629350 - protein, 9 aa, Homo Sapiens
KFKIPKFKM

SEQ ID NO: 629351 - protein, 9 aa, Homo Sapiens
TEHIKRKGL

SEQ ID NO: 629352 - protein, 9 aa, Homo Sapiens
REKQGASEG

SEQ ID NO: 629353 - protein, 9 aa, Homo Sapiens
QDLDTFEPQ

SEQ ID NO: 629354 - protein, 9 aa, Homo Sapiens
DLGLVYETK

SEQ ID NO: 629355 - protein, 9 aa, Homo Sapiens
NFLSRFEKK

SEQ ID NO: 629356 - protein, 9 aa, Homo Sapiens
SLSLEELRP

SEQ ID NO: 629357 - protein, 9 aa, Homo Sapiens
ETVHCIACS

SEQ ID NO: 629358 - protein, 9 aa, Homo Sapiens
VSLFVGLII

SEQ ID NO: 629359 - protein, 9 aa, Homo Sapiens
NIQHWQQVL

SEQ ID NO: 629360 - protein, 9 aa, Homo Sapiens
PGGGKVSQP

SEQ ID NO: 629361 - protein, 9 aa, Homo Sapiens
LHHSGHSPA

SEQ ID NO: 629362 - protein, 9 aa, Homo Sapiens
LECLLRRWL

SEQ ID NO: 629363 - protein, 9 aa, Homo Sapiens
EVAHTCAFT

SEQ ID NO: 629364 - protein, 9 aa, Homo Sapiens
LVGLLNSMT

SEQ ID NO: 629365 - protein, 9 aa, Homo Sapiens
FIIEVHDAR

SEQ ID NO: 629366 - protein, 9 aa, Homo Sapiens
HSGHSPAIS

SEQ ID NO: 629367 - protein, 9 aa, Homo Sapiens
VQTCEVDIN

SEQ ID NO: 629368 - protein, 9 aa, Homo Sapiens
QTGGTIWLL

SEQ ID NO: 629369 - protein, 9 aa, Homo Sapiens
PLAAVASWL

SEQ ID NO: 629370 - protein, 9 aa, Homo Sapiens
NSLSDYKHV

SEQ ID NO: 629371 - protein, 9 aa, Homo Sapiens
FSHGGKGLP

SEQ ID NO: 629372 - protein, 9 aa, Homo Sapiens
KPSKSTLSA

SEQ ID NO: 629373 - protein, 9 aa, Homo Sapiens
RLLGKVCDG

SEQ ID NO: 629374 - protein, 9 aa, Homo Sapiens
SQNCGAETG

SEQ ID NO: 629375 - protein, 9 aa, Homo Sapiens
NLAHFHTLK

SEQ ID NO: 629376 - protein, 9 aa, Homo Sapiens
FSKGLHYWE

SEQ ID NO: 629377 - protein, 9 aa, Homo Sapiens
CINSSATRV

SEQ ID NO: 629378 - protein, 9 aa, Homo Sapiens
DWGIRLECI

SEQ ID NO: 629379 - protein, 9 aa, Homo Sapiens
PSEDSRGDA

SEQ ID NO: 629380 - protein, 9 aa, Homo Sapiens
RWRTEIGSG

SEQ ID NO: 629381 - protein, 9 aa, Homo Sapiens
DFSRKSNLI

SEQ ID NO: 629382 - protein, 9 aa, Homo Sapiens
GPSTYGTTT

SEQ ID NO: 629383 - protein, 9 aa, Homo Sapiens
DEAWVLTEE

SEQ ID NO: 629384 - protein, 9 aa, Homo Sapiens
LHHRIETKS

SEQ ID NO: 629385 - protein, 9 aa, Homo Sapiens
NISGYSESK

SEQ ID NO: 629386 - protein, 9 aa, Homo Sapiens
EVSIKEECS

SEQ ID NO: 629387 - protein, 9 aa, Homo Sapiens
ERYHAYLKP

SEQ ID NO: 629388 - protein, 9 aa, Homo Sapiens
EDVGSLALD

SEQ ID NO: 629389 - protein, 9 aa, Homo Sapiens
FRQFSHLKR

SEQ ID NO: 629390 - protein, 9 aa, Homo Sapiens
LLDFGADVN

SEQ ID NO: 629391 - protein, 9 aa, Homo Sapiens
KPLAAVASW

SEQ ID NO: 629392 - protein, 9 aa, Homo Sapiens
AAPPCKHLS

SEQ ID NO: 629393 - protein, 9 aa, Homo Sapiens
RLEIYERQQ

SEQ ID NO: 629394 - protein, 9 aa, Homo Sapiens
DPDARPGGR

SEQ ID NO: 629395 - protein, 9 aa, Homo Sapiens
AVLTFGGTF

SEQ ID NO: 629396 - protein, 9 aa, Homo Sapiens
IMYVAYHCY

SEQ ID NO: 629397 - protein, 9 aa, Homo Sapiens
TIPHLRGKE

SEQ ID NO: 629398 - protein, 9 aa, Homo Sapiens
VQIGQSLNV

SEQ ID NO: 629399 - protein, 9 aa, Homo Sapiens
VAQPWPEVS

SEQ ID NO: 629400 - protein, 9 aa, Homo Sapiens
LSLSADEAA

SEQ ID NO: 629401 - protein, 9 aa, Homo Sapiens
YVSLFVGLI

SEQ ID NO: 629402 - protein, 9 aa, Homo Sapiens
GGKPLAAVA

SEQ ID NO: 629403 - protein, 9 aa, Homo Sapiens
FMYTDCADK

SEQ ID NO: 629404 - protein, 9 aa, Homo Sapiens
ENKLKEAST

SEQ ID NO: 629405 - protein, 9 aa, Homo Sapiens
PHAWFRIAF

SEQ ID NO: 629406 - protein, 9 aa, Homo Sapiens
LVLSSLQAI

SEQ ID NO: 629407 - protein, 9 aa, Homo Sapiens
HKFSAGTYQ

SEQ ID NO: 629408 - protein, 9 aa, Homo Sapiens
MNKKARISL

SEQ ID NO: 629409 - protein, 9 aa, Homo Sapiens
HLLSGSTDC

SEQ ID NO: 629410 - protein, 9 aa, Homo Sapiens
TAFLVSCAQ

SEQ ID NO: 629411 - protein, 9 aa, Homo Sapiens
LPPEDQSDD

SEQ ID NO: 629412 - protein, 9 aa, Homo Sapiens
FLEAISEVF

SEQ ID NO: 629413 - protein, 9 aa, Homo Sapiens
DIGPPPGHY

SEQ ID NO: 629414 - protein, 9 aa, Homo Sapiens
DIQDFEFQS

SEQ ID NO: 629415 - protein, 9 aa, Homo Sapiens
SYDRYAAIR

SEQ ID NO: 629416 - protein, 9 aa, Homo Sapiens
TDIQLHTPM

SEQ ID NO: 629417 - protein, 9 aa, Homo Sapiens
ASKVFANSC

SEQ ID NO: 629418 - protein, 9 aa, Homo Sapiens
KSADKMPHM

SEQ ID NO: 629419 - protein, 9 aa, Homo Sapiens
LQGKPQTLA

SEQ ID NO: 629420 - protein, 9 aa, Homo Sapiens
INLSGLVPS

SEQ ID NO: 629421 - protein, 9 aa, Homo Sapiens
THMVHMLCP

SEQ ID NO: 629422 - protein, 9 aa, Homo Sapiens
TPDEYMLSL

SEQ ID NO: 629423 - protein, 9 aa, Homo Sapiens
FSHLKRHQR

SEQ ID NO: 629424 - protein, 9 aa, Homo Sapiens
FPEWAHCYS

SEQ ID NO: 629425 - protein, 9 aa, Homo Sapiens
PLQAAAANT

SEQ ID NO: 629426 - protein, 9 aa, Homo Sapiens
AYNLEAGQC

SEQ ID NO: 629427 - protein, 9 aa, Homo Sapiens
ERFPYYREN

SEQ ID NO: 629428 - protein, 9 aa, Homo Sapiens
LKNNTYCGI

SEQ ID NO: 629429 - protein, 9 aa, Homo Sapiens
DENFLCKRP

SEQ ID NO: 629430 - protein, 9 aa, Homo Sapiens
AQELKRILE

SEQ ID NO: 629431 - protein, 9 aa, Homo Sapiens
YGFSVDLWA

SEQ ID NO: 629432 - protein, 9 aa, Homo Sapiens
SMCRPSLAL

SEQ ID NO: 629433 - protein, 9 aa, Homo Sapiens
HQAALRRSP

SEQ ID NO: 629434 - protein, 9 aa, Homo Sapiens
NETLPPSKG

SEQ ID NO: 629435 - protein, 9 aa, Homo Sapiens
SYWIQEKPD

SEQ ID NO: 629436 - protein, 9 aa, Homo Sapiens
LELGTLERY

SEQ ID NO: 629437 - protein, 9 aa, Homo Sapiens
KSVSKEAVA

SEQ ID NO: 629438 - protein, 9 aa, Homo Sapiens
KGERVAKGP

SEQ ID NO: 629439 - protein, 9 aa, Homo Sapiens
WVESFKKAR

SEQ ID NO: 629440 - protein, 9 aa, Homo Sapiens
KYEFTVQSH

SEQ ID NO: 629441 - protein, 9 aa, Homo Sapiens
NPAARHHNL

SEQ ID NO: 629442 - protein, 9 aa, Homo Sapiens
TFDWLVNLQ

SEQ ID NO: 629443 - protein, 9 aa, Homo Sapiens
ELGDYDPYE

SEQ ID NO: 629444 - protein, 9 aa, Homo Sapiens
FKAVHFSTV

SEQ ID NO: 629445 - protein, 9 aa, Homo Sapiens
LYSLGTSSL

SEQ ID NO: 629446 - protein, 9 aa, Homo Sapiens
RCLSPGSAH

SEQ ID NO: 629447 - protein, 9 aa, Homo Sapiens
GSDFGCRAA

SEQ ID NO: 629448 - protein, 9 aa, Homo Sapiens
RPSSQYIVP

SEQ ID NO: 629449 - protein, 9 aa, Homo Sapiens
PSSVDFTQT

SEQ ID NO: 629450 - protein, 9 aa, Homo Sapiens
LYIVRLVWR

SEQ ID NO: 629451 - protein, 9 aa, Homo Sapiens
YPVAGGGSG

SEQ ID NO: 629452 - protein, 9 aa, Homo Sapiens
KLSECPEPG

SEQ ID NO: 629453 - protein, 9 aa, Homo Sapiens
ENIIHAFPS

SEQ ID NO: 629454 - protein, 9 aa, Homo Sapiens
QCIADESIA

SEQ ID NO: 629455 - protein, 9 aa, Homo Sapiens
IPLAMERFP

SEQ ID NO: 629456 - protein, 9 aa, Homo Sapiens
AYPKSVSKE

SEQ ID NO: 629457 - protein, 9 aa, Homo Sapiens
IRCWVTCWG

SEQ ID NO: 629458 - protein, 9 aa, Homo Sapiens
RGVMEGKQV

SEQ ID NO: 629459 - protein, 9 aa, Homo Sapiens
EIALSTSNV

SEQ ID NO: 629460 - protein, 9 aa, Homo Sapiens
TLRPSLVQT

SEQ ID NO: 629461 - protein, 9 aa, Homo Sapiens
SWKFEFEIQ

SEQ ID NO: 629462 - protein, 9 aa, Homo Sapiens
GPHQQGGHP

SEQ ID NO: 629463 - protein, 9 aa, Homo Sapiens
ELPPEDQSD

SEQ ID NO: 629464 - protein, 9 aa, Homo Sapiens
EASTAHWQG

SEQ ID NO: 629465 - protein, 9 aa, Homo Sapiens
KDSEDSQYN

SEQ ID NO: 629466 - protein, 9 aa, Homo Sapiens
TVCEHFDPC

SEQ ID NO: 629467 - protein, 9 aa, Homo Sapiens
CEKQYPDYK

SEQ ID NO: 629468 - protein, 9 aa, Homo Sapiens
ALYELFQDP

SEQ ID NO: 629469 - protein, 9 aa, Homo Sapiens
QTLKQQHQL

SEQ ID NO: 629470 - protein, 9 aa, Homo Sapiens
WQSCKVLPG

SEQ ID NO: 629471 - protein, 9 aa, Homo Sapiens
MMKYPHMVV

SEQ ID NO: 629472 - protein, 9 aa, Homo Sapiens
SQSQNMFTI

SEQ ID NO: 629473 - protein, 9 aa, Homo Sapiens
YKLPFGSIC

SEQ ID NO: 629474 - protein, 9 aa, Homo Sapiens
PPITHPNDE

SEQ ID NO: 629475 - protein, 9 aa, Homo Sapiens
FLSLWEIYL

SEQ ID NO: 629476 - protein, 9 aa, Homo Sapiens
GSASSSAIL

SEQ ID NO: 629477 - protein, 9 aa, Homo Sapiens
VSAQASSLI

SEQ ID NO: 629478 - protein, 9 aa, Homo Sapiens
LGDKIAISL

SEQ ID NO: 629479 - protein, 9 aa, Homo Sapiens
IACALNKGI

SEQ ID NO: 629480 - protein, 9 aa, Homo Sapiens
AQNKGKKAE

SEQ ID NO: 629481 - protein, 9 aa, Homo Sapiens
SSVSRRTLH

SEQ ID NO: 629482 - protein, 9 aa, Homo Sapiens
YQNGNPSAS

SEQ ID NO: 629483 - protein, 9 aa, Homo Sapiens
LWGASPTDP

SEQ ID NO: 629484 - protein, 9 aa, Homo Sapiens
REHSPIKEK

SEQ ID NO: 629485 - protein, 9 aa, Homo Sapiens
PPEDQSDDS

SEQ ID NO: 629486 - protein, 9 aa, Homo Sapiens
FLWNFSLEI

SEQ ID NO: 629487 - protein, 9 aa, Homo Sapiens
LCSPRARQF

SEQ ID NO: 629488 - protein, 9 aa, Homo Sapiens
HSECNCENL

SEQ ID NO: 629489 - protein, 9 aa, Homo Sapiens
NSLGPNATR

SEQ ID NO: 629490 - protein, 9 aa, Homo Sapiens
GIPLPRLRA

SEQ ID NO: 629491 - protein, 9 aa, Homo Sapiens
LKRPDSVAT

SEQ ID NO: 629492 - protein, 9 aa, Homo Sapiens
TCLPCHAFC

SEQ ID NO: 629493 - protein, 9 aa, Homo Sapiens
HRKDLGAPK

SEQ ID NO: 629494 - protein, 9 aa, Homo Sapiens
EGTLMLHFF

SEQ ID NO: 629495 - protein, 9 aa, Homo Sapiens
QDACETMGN

SEQ ID NO: 629496 - protein, 9 aa, Homo Sapiens
FPKPKGDCA

SEQ ID NO: 629497 - protein, 9 aa, Homo Sapiens
REMRTLRPS

SEQ ID NO: 629498 - protein, 9 aa, Homo Sapiens
VFQKVTDHS

SEQ ID NO: 629499 - protein, 9 aa, Homo Sapiens
DFPAFLEAI

SEQ ID NO: 629500 - protein, 9 aa, Homo Sapiens
QLHVKHIHL

SEQ ID NO: 629501 - protein, 9 aa, Homo Sapiens
QLIRCCNFS

SEQ ID NO: 629502 - protein, 9 aa, Homo Sapiens
APLQAAAAN

SEQ ID NO: 629503 - protein, 9 aa, Homo Sapiens
LDFEVSCIY

SEQ ID NO: 629504 - protein, 9 aa, Homo Sapiens
NTAAVWPEM

SEQ ID NO: 629505 - protein, 9 aa, Homo Sapiens
QSGPPPLSR

SEQ ID NO: 629506 - protein, 9 aa, Homo Sapiens
PEVTGQKIL

SEQ ID NO: 629507 - protein, 9 aa, Homo Sapiens
HTIVFLVGL

SEQ ID NO: 629508 - protein, 9 aa, Homo Sapiens
TSGGDCPHG

SEQ ID NO: 629509 - protein, 9 aa, Homo Sapiens
CLPLQNSTV

SEQ ID NO: 629510 - protein, 9 aa, Homo Sapiens
NLVSVLSWA

SEQ ID NO: 629511 - protein, 9 aa, Homo Sapiens
NFTVSGTHM

SEQ ID NO: 629512 - protein, 9 aa, Homo Sapiens
GETEELDSL

SEQ ID NO: 629513 - protein, 9 aa, Homo Sapiens
INVHLQTHT

SEQ ID NO: 629514 - protein, 9 aa, Homo Sapiens
AAAIKEDYL

SEQ ID NO: 629515 - protein, 9 aa, Homo Sapiens
PRSEAAPVC

SEQ ID NO: 629516 - protein, 9 aa, Homo Sapiens
GNWPEWMKV

SEQ ID NO: 629517 - protein, 9 aa, Homo Sapiens
AALSQSQRH

SEQ ID NO: 629518 - protein, 9 aa, Homo Sapiens
TDCLVMAWS

SEQ ID NO: 629519 - protein, 9 aa, Homo Sapiens
LGIQEAQMK

SEQ ID NO: 629520 - protein, 9 aa, Homo Sapiens
LNKKETTAD

SEQ ID NO: 629521 - protein, 9 aa, Homo Sapiens
SECPEPGRS

SEQ ID NO: 629522 - protein, 9 aa, Homo Sapiens
IDRTEQAEA

SEQ ID NO: 629523 - protein, 9 aa, Homo Sapiens
INKDSSCVY

SEQ ID NO: 629524 - protein, 9 aa, Homo Sapiens
ADIGPPPGH

SEQ ID NO: 629525 - protein, 9 aa, Homo Sapiens
PYYVITTQH

SEQ ID NO: 629526 - protein, 9 aa, Homo Sapiens
GAPRSEAAP

SEQ ID NO: 629527 - protein, 9 aa, Homo Sapiens
LVCCGRHYC

SEQ ID NO: 629528 - protein, 9 aa, Homo Sapiens
PHILGLVAG

SEQ ID NO: 629529 - protein, 9 aa, Homo Sapiens
RILICCDEL

SEQ ID NO: 629530 - protein, 9 aa, Homo Sapiens
PHFSPVCLR

SEQ ID NO: 629531 - protein, 9 aa, Homo Sapiens
VLNMLTAQQ

SEQ ID NO: 629532 - protein, 9 aa, Homo Sapiens
IITLEDSSV

SEQ ID NO: 629533 - protein, 9 aa, Homo Sapiens
HGASPAPQH

SEQ ID NO: 629534 - protein, 9 aa, Homo Sapiens
YASGNFNIS

SEQ ID NO: 629535 - protein, 9 aa, Homo Sapiens
CLDCVKFLP

SEQ ID NO: 629536 - protein, 9 aa, Homo Sapiens
KPTLVCSSV

SEQ ID NO: 629537 - protein, 9 aa, Homo Sapiens
HAGAGGGGG

SEQ ID NO: 629538 - protein, 9 aa, Homo Sapiens
GRGNVPLML

SEQ ID NO: 629539 - protein, 9 aa, Homo Sapiens
EPLLGAIEG

SEQ ID NO: 629540 - protein, 9 aa, Homo Sapiens
MPIGIPAER

SEQ ID NO: 629541 - protein, 9 aa, Homo Sapiens
PRRRRDLGI

SEQ ID NO: 629542 - protein, 9 aa, Homo Sapiens
QEMVRPSEL

SEQ ID NO: 629543 - protein, 9 aa, Homo Sapiens
DNSSLLKRF

SEQ ID NO: 629544 - protein, 9 aa, Homo Sapiens
STSFYKLFY

SEQ ID NO: 629545 - protein, 9 aa, Homo Sapiens
VWDKNATDE

SEQ ID NO: 629546 - protein, 9 aa, Homo Sapiens
IFIAIAKKL

SEQ ID NO: 629547 - protein, 9 aa, Homo Sapiens
LHSQNCGAE

SEQ ID NO: 629548 - protein, 9 aa, Homo Sapiens
WGQDINNLS

SEQ ID NO: 629549 - protein, 9 aa, Homo Sapiens
VAVCDTFHY

SEQ ID NO: 629550 - protein, 9 aa, Homo Sapiens
QYQNGNPSA

SEQ ID NO: 629551 - protein, 9 aa, Homo Sapiens
EIQCHPCHH

SEQ ID NO: 629552 - protein, 9 aa, Homo Sapiens
SRGDARYGQ

SEQ ID NO: 629553 - protein, 9 aa, Homo Sapiens
QVQRRFFIG

SEQ ID NO: 629554 - protein, 9 aa, Homo Sapiens
TAICIGSLP

SEQ ID NO: 629555 - protein, 9 aa, Homo Sapiens
GVMEGKQVQ

SEQ ID NO: 629556 - protein, 9 aa, Homo Sapiens
WSSRSVMDS

SEQ ID NO: 629557 - protein, 9 aa, Homo Sapiens
MSSTDLLYA

SEQ ID NO: 629558 - protein, 9 aa, Homo Sapiens
AKGGLPEQR

SEQ ID NO: 629559 - protein, 9 aa, Homo Sapiens
EDIQKGYVS

SEQ ID NO: 629560 - protein, 9 aa, Homo Sapiens
ALVISGYSL

SEQ ID NO: 629561 - protein, 9 aa, Homo Sapiens
TLAGMEFQY

SEQ ID NO: 629562 - protein, 9 aa, Homo Sapiens
NGYEKDSSS

SEQ ID NO: 629563 - protein, 9 aa, Homo Sapiens
EGKVYTLCF

SEQ ID NO: 629564 - protein, 9 aa, Homo Sapiens
GPSSTMVRT

SEQ ID NO: 629565 - protein, 9 aa, Homo Sapiens
QEYCDRIPE

SEQ ID NO: 629566 - protein, 9 aa, Homo Sapiens
GPPVNETCN

SEQ ID NO: 629567 - protein, 9 aa, Homo Sapiens
LLGAIEGVS

SEQ ID NO: 629568 - protein, 9 aa, Homo Sapiens
DGSIAKEER

SEQ ID NO: 629569 - protein, 9 aa, Homo Sapiens
SNLEKQTNK

SEQ ID NO: 629570 - protein, 9 aa, Homo Sapiens
KINKIMWLP

SEQ ID NO: 629571 - protein, 9 aa, Homo Sapiens
SWRDYVPDH

SEQ ID NO: 629572 - protein, 9 aa, Homo Sapiens
CIACSVYIP

SEQ ID NO: 629573 - protein, 9 aa, Homo Sapiens
EHGRYMQDP

SEQ ID NO: 629574 - protein, 9 aa, Homo Sapiens
AAFSKGLHY

SEQ ID NO: 629575 - protein, 9 aa, Homo Sapiens
STSNPELQA

SEQ ID NO: 629576 - protein, 9 aa, Homo Sapiens
GSHGARGLM

SEQ ID NO: 629577 - protein, 9 aa, Homo Sapiens
DRFNLILAN

SEQ ID NO: 629578 - protein, 9 aa, Homo Sapiens
ELPREGLGR

SEQ ID NO: 629579 - protein, 9 aa, Homo Sapiens
ILADFQAFT

SEQ ID NO: 629580 - protein, 9 aa, Homo Sapiens
LVLRLEIYE

SEQ ID NO: 629581 - protein, 9 aa, Homo Sapiens
AALDDEETG

SEQ ID NO: 629582 - protein, 9 aa, Homo Sapiens
RRSPRRTSL

SEQ ID NO: 629583 - protein, 9 aa, Homo Sapiens
YNNLKGNLH

SEQ ID NO: 629584 - protein, 9 aa, Homo Sapiens
AKGERVAKG

SEQ ID NO: 629585 - protein, 9 aa, Homo Sapiens
LADAQVVFN

SEQ ID NO: 629586 - protein, 9 aa, Homo Sapiens
IVCSLDLYK

SEQ ID NO: 629587 - protein, 9 aa, Homo Sapiens
LPANRRIQI

SEQ ID NO: 629588 - protein, 9 aa, Homo Sapiens
LFGTPIVNP

SEQ ID NO: 629589 - protein, 9 aa, Homo Sapiens
KKEYTEDNI

SEQ ID NO: 629590 - protein, 9 aa, Homo Sapiens
ARSLNKLRK

SEQ ID NO: 629591 - protein, 9 aa, Homo Sapiens
RAYQMVWTP

SEQ ID NO: 629592 - protein, 9 aa, Homo Sapiens
LRYHVRRED

SEQ ID NO: 629593 - protein, 9 aa, Homo Sapiens
WKDPSWAAP

SEQ ID NO: 629594 - protein, 9 aa, Homo Sapiens
LGLALVLLK

SEQ ID NO: 629595 - protein, 9 aa, Homo Sapiens
NRTINRCNL

SEQ ID NO: 629596 - protein, 9 aa, Homo Sapiens
KKGETPSAI

SEQ ID NO: 629597 - protein, 9 aa, Homo Sapiens
IAYRPLLFT

SEQ ID NO: 629598 - protein, 9 aa, Homo Sapiens
SATNENSGG

SEQ ID NO: 629599 - protein, 9 aa, Homo Sapiens
PGELGPGFR

SEQ ID NO: 629600 - protein, 9 aa, Homo Sapiens
GYSLEVCLK

SEQ ID NO: 629601 - protein, 9 aa, Homo Sapiens
KCFRIMNNE

SEQ ID NO: 629602 - protein, 9 aa, Homo Sapiens
GRAWGDPCE

SEQ ID NO: 629603 - protein, 9 aa, Homo Sapiens
LLLMAVYSW

SEQ ID NO: 629604 - protein, 9 aa, Homo Sapiens
FFHVVQAGL

SEQ ID NO: 629605 - protein, 9 aa, Homo Sapiens
KPEVLTGDV

SEQ ID NO: 629606 - protein, 9 aa, Homo Sapiens
CFRLPENII

SEQ ID NO: 629607 - protein, 9 aa, Homo Sapiens
SFLRGDVLR

SEQ ID NO: 629608 - protein, 9 aa, Homo Sapiens
LIREMRTLR

SEQ ID NO: 629609 - protein, 9 aa, Homo Sapiens
LRGTESTLD

SEQ ID NO: 629610 - protein, 9 aa, Homo Sapiens
QVDLKKSPL

SEQ ID NO: 629611 - protein, 9 aa, Homo Sapiens
YFPSLSLEE

SEQ ID NO: 629612 - protein, 9 aa, Homo Sapiens
PSLALFLTI

SEQ ID NO: 629613 - protein, 9 aa, Homo Sapiens
IRNLSLDVD

SEQ ID NO: 629614 - protein, 9 aa, Homo Sapiens
SIKGAEDNM

SEQ ID NO: 629615 - protein, 9 aa, Homo Sapiens
IIRHRRQGK

SEQ ID NO: 629616 - protein, 9 aa, Homo Sapiens
ESVLLDLKQ

SEQ ID NO: 629617 - protein, 9 aa, Homo Sapiens
HHQRIQTGE

SEQ ID NO: 629618 - protein, 9 aa, Homo Sapiens
QSPYLEFPW

SEQ ID NO: 629619 - protein, 9 aa, Homo Sapiens
NLNYSAIQR

SEQ ID NO: 629620 - protein, 9 aa, Homo Sapiens
EMAHHFFAY

SEQ ID NO: 629621 - protein, 9 aa, Homo Sapiens
PLNKCQGLL

SEQ ID NO: 629622 - protein, 9 aa, Homo Sapiens
WPVSSFNLP

SEQ ID NO: 629623 - protein, 9 aa, Homo Sapiens
TTRAETGME

SEQ ID NO: 629624 - protein, 9 aa, Homo Sapiens
ILRLLLYIV

SEQ ID NO: 629625 - protein, 9 aa, Homo Sapiens
NCGAETGIF

SEQ ID NO: 629626 - protein, 9 aa, Homo Sapiens
CQGSGREVL

SEQ ID NO: 629627 - protein, 9 aa, Homo Sapiens
GAVSNSQLH

SEQ ID NO: 629628 - protein, 9 aa, Homo Sapiens
ALAGKALLT

SEQ ID NO: 629629 - protein, 9 aa, Homo Sapiens
TVSSLPDTS

SEQ ID NO: 629630 - protein, 9 aa, Homo Sapiens
ALGEAINEC

SEQ ID NO: 629631 - protein, 9 aa, Homo Sapiens
PCANPPCAV

SEQ ID NO: 629632 - protein, 9 aa, Homo Sapiens
PRPPGGQWG

SEQ ID NO: 629633 - protein, 9 aa, Homo Sapiens
DCPHGPPGE

SEQ ID NO: 629634 - protein, 9 aa, Homo Sapiens
SSEKLASSA

SEQ ID NO: 629635 - protein, 9 aa, Homo Sapiens
LKREQEDAD

SEQ ID NO: 629636 - protein, 9 aa, Homo Sapiens
LVELNEQRK

SEQ ID NO: 629637 - protein, 9 aa, Homo Sapiens
LGAAGTQGK

SEQ ID NO: 629638 - protein, 9 aa, Homo Sapiens
SSGTLWSSR

SEQ ID NO: 629639 - protein, 9 aa, Homo Sapiens
FLECEHVCS

SEQ ID NO: 629640 - protein, 9 aa, Homo Sapiens
GEPRPDSWS

SEQ ID NO: 629641 - protein, 9 aa, Homo Sapiens
MAPLGPPRS

SEQ ID NO: 629642 - protein, 9 aa, Homo Sapiens
GSLFGTPIV

SEQ ID NO: 629643 - protein, 9 aa, Homo Sapiens
LSYFHCDDL

SEQ ID NO: 629644 - protein, 9 aa, Homo Sapiens
EAAQWGEPG

SEQ ID NO: 629645 - protein, 9 aa, Homo Sapiens
LILSMNILY

SEQ ID NO: 629646 - protein, 9 aa, Homo Sapiens
SHPHLVEEA

SEQ ID NO: 629647 - protein, 9 aa, Homo Sapiens
SEQAAGLYV

SEQ ID NO: 629648 - protein, 9 aa, Homo Sapiens
SFKSLRDDF

SEQ ID NO: 629649 - protein, 9 aa, Homo Sapiens
PGALERIHM

SEQ ID NO: 629650 - protein, 9 aa, Homo Sapiens
VNIRDMSEN

SEQ ID NO: 629651 - protein, 9 aa, Homo Sapiens
DAFITAICI

SEQ ID NO: 629652 - protein, 9 aa, Homo Sapiens
QHWQQVLCQ

SEQ ID NO: 629653 - protein, 9 aa, Homo Sapiens
HSTVQNFHS

SEQ ID NO: 629654 - protein, 9 aa, Homo Sapiens
ALSQSQRHR

SEQ ID NO: 629655 - protein, 9 aa, Homo Sapiens
RQLDCKALG

SEQ ID NO: 629656 - protein, 9 aa, Homo Sapiens
YEDRDFHGR

SEQ ID NO: 629657 - protein, 9 aa, Homo Sapiens
RERFSFEDS

SEQ ID NO: 629658 - protein, 9 aa, Homo Sapiens
VYVPKFLVS

SEQ ID NO: 629659 - protein, 9 aa, Homo Sapiens
DSKGDVWLG

SEQ ID NO: 629660 - protein, 9 aa, Homo Sapiens
MSGAPWRHL

SEQ ID NO: 629661 - protein, 9 aa, Homo Sapiens
ANPPCAVVG

SEQ ID NO: 629662 - protein, 9 aa, Homo Sapiens
SQQALNHHL

SEQ ID NO: 629663 - protein, 9 aa, Homo Sapiens
HHSGTATLP

SEQ ID NO: 629664 - protein, 9 aa, Homo Sapiens
ENTAAVWPE

SEQ ID NO: 629665 - protein, 9 aa, Homo Sapiens
SNIGILPAL

SEQ ID NO: 629666 - protein, 9 aa, Homo Sapiens
GSFAFADIG

SEQ ID NO: 629667 - protein, 9 aa, Homo Sapiens
FHPWKKQEN

SEQ ID NO: 629668 - protein, 9 aa, Homo Sapiens
IRVYAFTKV

SEQ ID NO: 629669 - protein, 9 aa, Homo Sapiens
DSMLTSVSV

SEQ ID NO: 629670 - protein, 9 aa, Homo Sapiens
VTLFGESEG

SEQ ID NO: 629671 - protein, 9 aa, Homo Sapiens
LGRGSPCIQ

SEQ ID NO: 629672 - protein, 9 aa, Homo Sapiens
WVESYLSCR

SEQ ID NO: 629673 - protein, 9 aa, Homo Sapiens
LDGFLLTLI

SEQ ID NO: 629674 - protein, 9 aa, Homo Sapiens
CPEPCPPTK

SEQ ID NO: 629675 - protein, 9 aa, Homo Sapiens
LNEAQEVIA

SEQ ID NO: 629676 - protein, 9 aa, Homo Sapiens
AHTVNPNWY

SEQ ID NO: 629677 - protein, 9 aa, Homo Sapiens
ATDIECSAL

SEQ ID NO: 629678 - protein, 9 aa, Homo Sapiens
PMYFFLWNF

SEQ ID NO: 629679 - protein, 9 aa, Homo Sapiens
VKIGDFRLA

SEQ ID NO: 629680 - protein, 9 aa, Homo Sapiens
NITSVHLRR

SEQ ID NO: 629681 - protein, 9 aa, Homo Sapiens
GLVPSGGLL

SEQ ID NO: 629682 - protein, 9 aa, Homo Sapiens
EEMIATLQL

SEQ ID NO: 629683 - protein, 9 aa, Homo Sapiens
FGADVNKCS

SEQ ID NO: 629684 - protein, 9 aa, Homo Sapiens
KVRSSGDSQ

SEQ ID NO: 629685 - protein, 9 aa, Homo Sapiens
LSSYQLRPG

SEQ ID NO: 629686 - protein, 9 aa, Homo Sapiens
DAHSQVDEG

SEQ ID NO: 629687 - protein, 9 aa, Homo Sapiens
EIYLSPRSP

SEQ ID NO: 629688 - protein, 9 aa, Homo Sapiens
KKFESLIKK

SEQ ID NO: 629689 - protein, 9 aa, Homo Sapiens
GKVYTLCFC

SEQ ID NO: 629690 - protein, 9 aa, Homo Sapiens
LWLVAERRE

SEQ ID NO: 629691 - protein, 9 aa, Homo Sapiens
FQFDRIHCQ

SEQ ID NO: 629692 - protein, 9 aa, Homo Sapiens
TSHTELVLG

SEQ ID NO: 629693 - protein, 9 aa, Homo Sapiens
CQWFLKTDP

SEQ ID NO: 629694 - protein, 9 aa, Homo Sapiens
KVETVHCIA

SEQ ID NO: 629695 - protein, 9 aa, Homo Sapiens
IIAGMHLFY

SEQ ID NO: 629696 - protein, 9 aa, Homo Sapiens
PNSNVTRPS

SEQ ID NO: 629697 - protein, 9 aa, Homo Sapiens
NVTNMANHV

SEQ ID NO: 629698 - protein, 9 aa, Homo Sapiens
PYPYYPKFH

SEQ ID NO: 629699 - protein, 9 aa, Homo Sapiens
VMCVSSLTI

SEQ ID NO: 629700 - protein, 9 aa, Homo Sapiens
KKSRCSEAT

SEQ ID NO: 629701 - protein, 9 aa, Homo Sapiens
KPHAWFRIA

SEQ ID NO: 629702 - protein, 9 aa, Homo Sapiens
LVYETKEEL

SEQ ID NO: 629703 - protein, 9 aa, Homo Sapiens
AKLLVELNE

SEQ ID NO: 629704 - protein, 9 aa, Homo Sapiens
NSSVEARDS

SEQ ID NO: 629705 - protein, 9 aa, Homo Sapiens
NHQQLGRGS

SEQ ID NO: 629706 - protein, 9 aa, Homo Sapiens
GRGPLATGL

SEQ ID NO: 629707 - protein, 9 aa, Homo Sapiens
CIYEFDKMN

SEQ ID NO: 629708 - protein, 9 aa, Homo Sapiens
PEDQSDDSS

SEQ ID NO: 629709 - protein, 9 aa, Homo Sapiens
GLGQLKASL

SEQ ID NO: 629710 - protein, 9 aa, Homo Sapiens
VESYLSCRH

SEQ ID NO: 629711 - protein, 9 aa, Homo Sapiens
PPMDSTKRN

SEQ ID NO: 629712 - protein, 9 aa, Homo Sapiens
TKCHGSTGQ

SEQ ID NO: 629713 - protein, 9 aa, Homo Sapiens
AFDLNDEKN

SEQ ID NO: 629714 - protein, 9 aa, Homo Sapiens
VPDHPHPEI

SEQ ID NO: 629715 - protein, 9 aa, Homo Sapiens
QLHSTQQAV

SEQ ID NO: 629716 - protein, 9 aa, Homo Sapiens
RSPFLLTLE

SEQ ID NO: 629717 - protein, 9 aa, Homo Sapiens
SLGWLPGRP

SEQ ID NO: 629718 - protein, 9 aa, Homo Sapiens
NLSGADIRQ

SEQ ID NO: 629719 - protein, 9 aa, Homo Sapiens
PTKCPEPCP

SEQ ID NO: 629720 - protein, 9 aa, Homo Sapiens
VCCGRHYCG

SEQ ID NO: 629721 - protein, 9 aa, Homo Sapiens
NAELSSVDD

SEQ ID NO: 629722 - protein, 9 aa, Homo Sapiens
NLDFEVSCI

SEQ ID NO: 629723 - protein, 9 aa, Homo Sapiens
SEGAASVGM

SEQ ID NO: 629724 - protein, 9 aa, Homo Sapiens
LGSSVMAPL

SEQ ID NO: 629725 - protein, 9 aa, Homo Sapiens
LVCKVSDFC

SEQ ID NO: 629726 - protein, 9 aa, Homo Sapiens
PLMGSFKPG

SEQ ID NO: 629727 - protein, 9 aa, Homo Sapiens
KPYACHECW

SEQ ID NO: 629728 - protein, 9 aa, Homo Sapiens
ALAAAFQPV

SEQ ID NO: 629729 - protein, 9 aa, Homo Sapiens
AHEPSTPGG

SEQ ID NO: 629730 - protein, 9 aa, Homo Sapiens
VVLVILAAV

SEQ ID NO: 629731 - protein, 9 aa, Homo Sapiens
CLGTLLGLD

SEQ ID NO: 629732 - protein, 9 aa, Homo Sapiens
RVRMSAVAM

SEQ ID NO: 629733 - protein, 9 aa, Homo Sapiens
SIAFDNVEG

SEQ ID NO: 629734 - protein, 9 aa, Homo Sapiens
YDWNALVTA

SEQ ID NO: 629735 - protein, 9 aa, Homo Sapiens
FSSRMQSSI

SEQ ID NO: 629736 - protein, 9 aa, Homo Sapiens
SCLRPRDAR

SEQ ID NO: 629737 - protein, 9 aa, Homo Sapiens
SPSFDLRTA

SEQ ID NO: 629738 - protein, 9 aa, Homo Sapiens
SCWHVRWRT

SEQ ID NO: 629739 - protein, 9 aa, Homo Sapiens
TEELDSLSM

SEQ ID NO: 629740 - protein, 9 aa, Homo Sapiens
SGNRTINRC

SEQ ID NO: 629741 - protein, 9 aa, Homo Sapiens
LVTLLHMPC

SEQ ID NO: 629742 - protein, 9 aa, Homo Sapiens
HMHKMMRKP

SEQ ID NO: 629743 - protein, 9 aa, Homo Sapiens
LKQCRLLVI

SEQ ID NO: 629744 - protein, 9 aa, Homo Sapiens
HSQWVDLHI

SEQ ID NO: 629745 - protein, 9 aa, Homo Sapiens
TDHTDGSIL

SEQ ID NO: 629746 - protein, 9 aa, Homo Sapiens
PCGGGAAGG

SEQ ID NO: 629747 - protein, 9 aa, Homo Sapiens
YVPKFLVSM

SEQ ID NO: 629748 - protein, 9 aa, Homo Sapiens
GMLAAWFMM

SEQ ID NO: 629749 - protein, 9 aa, Homo Sapiens
LPYCEAYYH

SEQ ID NO: 629750 - protein, 9 aa, Homo Sapiens
LALAAAFQP

SEQ ID NO: 629751 - protein, 9 aa, Homo Sapiens
VVSAVSLGW

SEQ ID NO: 629752 - protein, 9 aa, Homo Sapiens
WKKDNETIL

SEQ ID NO: 629753 - protein, 9 aa, Homo Sapiens
AAAGACARP

SEQ ID NO: 629754 - protein, 9 aa, Homo Sapiens
GVVLVPTEI

SEQ ID NO: 629755 - protein, 9 aa, Homo Sapiens
FLTLLLCLD

SEQ ID NO: 629756 - protein, 9 aa, Homo Sapiens
RIHCQSLRF

SEQ ID NO: 629757 - protein, 9 aa, Homo Sapiens
LVLEGTNEQ

SEQ ID NO: 629758 - protein, 9 aa, Homo Sapiens
VTKKDALLE

SEQ ID NO: 629759 - protein, 9 aa, Homo Sapiens
DLRLTVEES

SEQ ID NO: 629760 - protein, 9 aa, Homo Sapiens
ILFVNSRKD

SEQ ID NO: 629761 - protein, 9 aa, Homo Sapiens
KHKLIEVIS

SEQ ID NO: 629762 - protein, 9 aa, Homo Sapiens
VHYAVTVDY

SEQ ID NO: 629763 - protein, 9 aa, Homo Sapiens
YNTHPCNPD

SEQ ID NO: 629764 - protein, 9 aa, Homo Sapiens
SRPSLQWPV

SEQ ID NO: 629765 - protein, 9 aa, Homo Sapiens
SVGTRSSGL

SEQ ID NO: 629766 - protein, 9 aa, Homo Sapiens
YRIGRKKRV

SEQ ID NO: 629767 - protein, 9 aa, Homo Sapiens
MAPAEEAEG

SEQ ID NO: 629768 - protein, 9 aa, Homo Sapiens
QLGRGSPCI

SEQ ID NO: 629769 - protein, 9 aa, Homo Sapiens
KMALDFRGK

SEQ ID NO: 629770 - protein, 9 aa, Homo Sapiens
AVMSYDRYA

SEQ ID NO: 629771 - protein, 9 aa, Homo Sapiens
IQKGYVSSV

SEQ ID NO: 629772 - protein, 9 aa, Homo Sapiens
HGTNWRHVY

SEQ ID NO: 629773 - protein, 9 aa, Homo Sapiens
NAALAGKAL

SEQ ID NO: 629774 - protein, 9 aa, Homo Sapiens
ALLTCLLLL

SEQ ID NO: 629775 - protein, 9 aa, Homo Sapiens
GDPCEMCPA

SEQ ID NO: 629776 - protein, 9 aa, Homo Sapiens
DFRSKYHTE

SEQ ID NO: 629777 - protein, 9 aa, Homo Sapiens
ETMKDQQKP

SEQ ID NO: 629778 - protein, 9 aa, Homo Sapiens
KPRFQSVTL

SEQ ID NO: 629779 - protein, 9 aa, Homo Sapiens
SHGSRLEKP

SEQ ID NO: 629780 - protein, 9 aa, Homo Sapiens
RPEGTYAVT

SEQ ID NO: 629781 - protein, 9 aa, Homo Sapiens
EIMRALKSA

SEQ ID NO: 629782 - protein, 9 aa, Homo Sapiens
FMDASRLDD

SEQ ID NO: 629783 - protein, 9 aa, Homo Sapiens
YLLKQALAN

SEQ ID NO: 629784 - protein, 9 aa, Homo Sapiens
VALKAKAPT

SEQ ID NO: 629785 - protein, 9 aa, Homo Sapiens
EDIIHRIFS

SEQ ID NO: 629786 - protein, 9 aa, Homo Sapiens
NTHPCNPDS

SEQ ID NO: 629787 - protein, 9 aa, Homo Sapiens
QKEIGDLRT

SEQ ID NO: 629788 - protein, 9 aa, Homo Sapiens
CPHGPPGER

SEQ ID NO: 629789 - protein, 9 aa, Homo Sapiens
AGPPQENCF

SEQ ID NO: 629790 - protein, 9 aa, Homo Sapiens
DEIASQCIS

SEQ ID NO: 629791 - protein, 9 aa, Homo Sapiens
GLASRKPLC

SEQ ID NO: 629792 - protein, 9 aa, Homo Sapiens
NYSLMENGN

SEQ ID NO: 629793 - protein, 9 aa, Homo Sapiens
GSSVMAPLG

SEQ ID NO: 629794 - protein, 9 aa, Homo Sapiens
VSAVSLGWL

SEQ ID NO: 629795 - protein, 9 aa, Homo Sapiens
LCAVWRPQC

SEQ ID NO: 629796 - protein, 9 aa, Homo Sapiens
YLATCQQYL

SEQ ID NO: 629797 - protein, 9 aa, Homo Sapiens
EDRDFHGRC

SEQ ID NO: 629798 - protein, 9 aa, Homo Sapiens
KGNLHNLER

SEQ ID NO: 629799 - protein, 9 aa, Homo Sapiens
PLKLRFKRL

SEQ ID NO: 629800 - protein, 9 aa, Homo Sapiens
AFADIGPPP

SEQ ID NO: 629801 - protein, 9 aa, Homo Sapiens
LNEIHSLGG

SEQ ID NO: 629802 - protein, 9 aa, Homo Sapiens
QPKLLHQFV

SEQ ID NO: 629803 - protein, 9 aa, Homo Sapiens
DKFILKSIL

SEQ ID NO: 629804 - protein, 9 aa, Homo Sapiens
IILVIITDI

SEQ ID NO: 629805 - protein, 9 aa, Homo Sapiens
KDHCMKLMQ

SEQ ID NO: 629806 - protein, 9 aa, Homo Sapiens
PYKEASGLS

SEQ ID NO: 629807 - protein, 9 aa, Homo Sapiens
YYAVRLRER

SEQ ID NO: 629808 - protein, 9 aa, Homo Sapiens
LAVEQIAKA

SEQ ID NO: 629809 - protein, 9 aa, Homo Sapiens
YPLLSKMTL

SEQ ID NO: 629810 - protein, 9 aa, Homo Sapiens
QLRAPTKQL

SEQ ID NO: 629811 - protein, 9 aa, Homo Sapiens
ARAARFGAH

SEQ ID NO: 629812 - protein, 9 aa, Homo Sapiens
SLWKEGLRL

SEQ ID NO: 629813 - protein, 9 aa, Homo Sapiens
VPYNPEEIC

SEQ ID NO: 629814 - protein, 9 aa, Homo Sapiens
GLHYWELHV

SEQ ID NO: 629815 - protein, 9 aa, Homo Sapiens
LTRHTQLSE

SEQ ID NO: 629816 - protein, 9 aa, Homo Sapiens
SPVSITPPS

SEQ ID NO: 629817 - protein, 9 aa, Homo Sapiens
IPKQRLESN

SEQ ID NO: 629818 - protein, 9 aa, Homo Sapiens
ERDRRRRIL

SEQ ID NO: 629819 - protein, 9 aa, Homo Sapiens
LLDSEQHRH

SEQ ID NO: 629820 - protein, 9 aa, Homo Sapiens
GNRTINRCN

SEQ ID NO: 629821 - protein, 9 aa, Homo Sapiens
VIVLLLLRL

SEQ ID NO: 629822 - protein, 9 aa, Homo Sapiens
GGAAGGPRP

SEQ ID NO: 629823 - protein, 9 aa, Homo Sapiens
LLALWLVAE

SEQ ID NO: 629824 - protein, 9 aa, Homo Sapiens
LGARITYQC

SEQ ID NO: 629825 - protein, 9 aa, Homo Sapiens
DANRQAISR

SEQ ID NO: 629826 - protein, 9 aa, Homo Sapiens
SARDAGLPP

SEQ ID NO: 629827 - protein, 9 aa, Homo Sapiens
RLKGLGVYS

SEQ ID NO: 629828 - protein, 9 aa, Homo Sapiens
PEQSLKLIH

SEQ ID NO: 629829 - protein, 9 aa, Homo Sapiens
TAVRNRGDG

SEQ ID NO: 629830 - protein, 9 aa, Homo Sapiens
NATDEDSTN

SEQ ID NO: 629831 - protein, 9 aa, Homo Sapiens
SYSLFQATE

SEQ ID NO: 629832 - protein, 9 aa, Homo Sapiens
TLYNHQQLG

SEQ ID NO: 629833 - protein, 9 aa, Homo Sapiens
ITYIKILQA

SEQ ID NO: 629834 - protein, 9 aa, Homo Sapiens
RVTKRDIKI

SEQ ID NO: 629835 - protein, 9 aa, Homo Sapiens
GSHARTSFS

SEQ ID NO: 629836 - protein, 9 aa, Homo Sapiens
SCLGTLLGL

SEQ ID NO: 629837 - protein, 9 aa, Homo Sapiens
GPILLIVGH

SEQ ID NO: 629838 - protein, 9 aa, Homo Sapiens
GSDILRADY

SEQ ID NO: 629839 - protein, 9 aa, Homo Sapiens
MRGHEDWGI

SEQ ID NO: 629840 - protein, 9 aa, Homo Sapiens
VHHVNITKK

SEQ ID NO: 629841 - protein, 9 aa, Homo Sapiens
PLASLRVRD

SEQ ID NO: 629842 - protein, 9 aa, Homo Sapiens
LLHGYRGLR

SEQ ID NO: 629843 - protein, 9 aa, Homo Sapiens
NEDVPSSEN

SEQ ID NO: 629844 - protein, 9 aa, Homo Sapiens
CPRSGAEGN

SEQ ID NO: 629845 - protein, 9 aa, Homo Sapiens
YMQSVHLQG

SEQ ID NO: 629846 - protein, 9 aa, Homo Sapiens
EEVSGCPAP

SEQ ID NO: 629847 - protein, 9 aa, Homo Sapiens
NFKGPPVNE

SEQ ID NO: 629848 - protein, 9 aa, Homo Sapiens
IMQLQQTVR

SEQ ID NO: 629849 - protein, 9 aa, Homo Sapiens
QMFHLKNSI

SEQ ID NO: 629850 - protein, 9 aa, Homo Sapiens
SGTKSSLQF

SEQ ID NO: 629851 - protein, 9 aa, Homo Sapiens
AAFFTFFSH

SEQ ID NO: 629852 - protein, 9 aa, Homo Sapiens
SYFEFPIGC

SEQ ID NO: 629853 - protein, 9 aa, Homo Sapiens
RYCMEKEGC

SEQ ID NO: 629854 - protein, 9 aa, Homo Sapiens
ASEILVASS

SEQ ID NO: 629855 - protein, 9 aa, Homo Sapiens
RGGRPSLIA

SEQ ID NO: 629856 - protein, 9 aa, Homo Sapiens
SSMGLLYPS

SEQ ID NO: 629857 - protein, 9 aa, Homo Sapiens
PSQSSSFTP

SEQ ID NO: 629858 - protein, 9 aa, Homo Sapiens
KANTSKANV

SEQ ID NO: 629859 - protein, 9 aa, Homo Sapiens
MGSSSDSCD

SEQ ID NO: 629860 - protein, 9 aa, Homo Sapiens
CAGKTDFLW

SEQ ID NO: 629861 - protein, 9 aa, Homo Sapiens
SCGPQVGVG

SEQ ID NO: 629862 - protein, 9 aa, Homo Sapiens
SLARWRQNL

SEQ ID NO: 629863 - protein, 9 aa, Homo Sapiens
AHWVESFKK

SEQ ID NO: 629864 - protein, 9 aa, Homo Sapiens
IEDSGQPVL

SEQ ID NO: 629865 - protein, 9 aa, Homo Sapiens
PLCAVWRPQ

SEQ ID NO: 629866 - protein, 9 aa, Homo Sapiens
CRRSKETVV

SEQ ID NO: 629867 - protein, 9 aa, Homo Sapiens
QSSLKLVDF

SEQ ID NO: 629868 - protein, 9 aa, Homo Sapiens
TNLDFKFPN

SEQ ID NO: 629869 - protein, 9 aa, Homo Sapiens
VGVGDEDTD

SEQ ID NO: 629870 - protein, 9 aa, Homo Sapiens
FADIGPPPG

SEQ ID NO: 629871 - protein, 9 aa, Homo Sapiens
SWSEAPIPG

SEQ ID NO: 629872 - protein, 9 aa, Homo Sapiens
YVGWLKMAE

SEQ ID NO: 629873 - protein, 9 aa, Homo Sapiens
PGETEELDS

SEQ ID NO: 629874 - protein, 9 aa, Homo Sapiens
NSWSEAPIP

SEQ ID NO: 629875 - protein, 9 aa, Homo Sapiens
FKFPNGLIK

SEQ ID NO: 629876 - protein, 9 aa, Homo Sapiens
WRPSTDPQP

SEQ ID NO: 629877 - protein, 9 aa, Homo Sapiens
CGKGVQAGC

SEQ ID NO: 629878 - protein, 9 aa, Homo Sapiens
PPGGQWGDA

SEQ ID NO: 629879 - protein, 9 aa, Homo Sapiens
STYLATCQQ

SEQ ID NO: 629880 - protein, 9 aa, Homo Sapiens
ANSNISGYS

SEQ ID NO: 629881 - protein, 9 aa, Homo Sapiens
HLNGHKRLC

SEQ ID NO: 629882 - protein, 9 aa, Homo Sapiens
FQVPLSRKM

SEQ ID NO: 629883 - protein, 9 aa, Homo Sapiens
SRYHTCGGA

SEQ ID NO: 629884 - protein, 9 aa, Homo Sapiens
YRHKEYYRG

SEQ ID NO: 629885 - protein, 9 aa, Homo Sapiens
PIVNPPQSA

SEQ ID NO: 629886 - protein, 9 aa, Homo Sapiens
DMSENVLYQ

SEQ ID NO: 629887 - protein, 9 aa, Homo Sapiens
RSCDLRRLV

SEQ ID NO: 629888 - protein, 9 aa, Homo Sapiens
FLQHLTVVM

SEQ ID NO: 629889 - protein, 9 aa, Homo Sapiens
VDFTQTAVF

SEQ ID NO: 629890 - protein, 9 aa, Homo Sapiens
YNMAHSSTH

SEQ ID NO: 629891 - protein, 9 aa, Homo Sapiens
ALYLAHLWV

SEQ ID NO: 629892 - protein, 9 aa, Homo Sapiens
RRVVEEDKE

SEQ ID NO: 629893 - protein, 9 aa, Homo Sapiens
GINGFLPSK

SEQ ID NO: 629894 - protein, 9 aa, Homo Sapiens
SQGKEKSEL

SEQ ID NO: 629895 - protein, 9 aa, Homo Sapiens
EVLTGDVEE

SEQ ID NO: 629896 - protein, 9 aa, Homo Sapiens
PKPKGDCAK

SEQ ID NO: 629897 - protein, 9 aa, Homo Sapiens
LSGADIRQN

SEQ ID NO: 629898 - protein, 9 aa, Homo Sapiens
SCKPNSVYE

SEQ ID NO: 629899 - protein, 9 aa, Homo Sapiens
KQEKSPVSK

SEQ ID NO: 629900 - protein, 9 aa, Homo Sapiens
VLKNNTYCG

SEQ ID NO: 629901 - protein, 9 aa, Homo Sapiens
NMNSKWKAE

SEQ ID NO: 629902 - protein, 9 aa, Homo Sapiens
EHCIFENIV

SEQ ID NO: 629903 - protein, 9 aa, Homo Sapiens
LRFYVNGRK

SEQ ID NO: 629904 - protein, 9 aa, Homo Sapiens
AEGSRLASP

SEQ ID NO: 629905 - protein, 9 aa, Homo Sapiens
GSCGPGLYC

SEQ ID NO: 629906 - protein, 9 aa, Homo Sapiens
HCSCCHQCK

SEQ ID NO: 629907 - protein, 9 aa, Homo Sapiens
RLLRQNCVD

SEQ ID NO: 629908 - protein, 9 aa, Homo Sapiens
LLMAVYSWD

SEQ ID NO: 629909 - protein, 9 aa, Homo Sapiens
DHDVTQTEL

SEQ ID NO: 629910 - protein, 9 aa, Homo Sapiens
NSMTHPGDT

SEQ ID NO: 629911 - protein, 9 aa, Homo Sapiens
TDHSTTALL

SEQ ID NO: 629912 - protein, 9 aa, Homo Sapiens
EADEIGLIP

SEQ ID NO: 629913 - protein, 9 aa, Homo Sapiens
LIFRPPEIV

SEQ ID NO: 629914 - protein, 9 aa, Homo Sapiens
LVLGARITY

SEQ ID NO: 629915 - protein, 9 aa, Homo Sapiens
LFLHVVCPE

SEQ ID NO: 629916 - protein, 9 aa, Homo Sapiens
NTFTTIPPD

SEQ ID NO: 629917 - protein, 9 aa, Homo Sapiens
LMFAEWEDR

SEQ ID NO: 629918 - protein, 9 aa, Homo Sapiens
SVWSGLDGQ

SEQ ID NO: 629919 - protein, 9 aa, Homo Sapiens
ETGGRPAME

SEQ ID NO: 629920 - protein, 9 aa, Homo Sapiens
SVVNVLYVN

SEQ ID NO: 629921 - protein, 9 aa, Homo Sapiens
ELKRILEMG

SEQ ID NO: 629922 - protein, 9 aa, Homo Sapiens
AHGEGSMAK

SEQ ID NO: 629923 - protein, 9 aa, Homo Sapiens
QAGSLKGFL

SEQ ID NO: 629924 - protein, 9 aa, Homo Sapiens
DYKHVLGPQ

SEQ ID NO: 629925 - protein, 9 aa, Homo Sapiens
CPEPGRSPE

SEQ ID NO: 629926 - protein, 9 aa, Homo Sapiens
YTRKGKSTL

SEQ ID NO: 629927 - protein, 9 aa, Homo Sapiens
FCQLAAPPC

SEQ ID NO: 629928 - protein, 9 aa, Homo Sapiens
STPGGLDAR

SEQ ID NO: 629929 - protein, 9 aa, Homo Sapiens
GQRALLIRG

SEQ ID NO: 629930 - protein, 9 aa, Homo Sapiens
AVLFPAAQR

SEQ ID NO: 629931 - protein, 9 aa, Homo Sapiens
GTNWRHVYK

SEQ ID NO: 629932 - protein, 9 aa, Homo Sapiens
GKAFGDCST

SEQ ID NO: 629933 - protein, 9 aa, Homo Sapiens
ASRLDDKEM

SEQ ID NO: 629934 - protein, 9 aa, Homo Sapiens
QGNKYWVFK

SEQ ID NO: 629935 - protein, 9 aa, Homo Sapiens
ANTSVAIAL

SEQ ID NO: 629936 - protein, 9 aa, Homo Sapiens
PEKEPSPLP

SEQ ID NO: 629937 - protein, 9 aa, Homo Sapiens
LDSLERAFW

SEQ ID NO: 629938 - protein, 9 aa, Homo Sapiens
APLQQVDPV

SEQ ID NO: 629939 - protein, 9 aa, Homo Sapiens
TCLLLLLVQ

SEQ ID NO: 629940 - protein, 9 aa, Homo Sapiens
CSREGPPKT

SEQ ID NO: 629941 - protein, 9 aa, Homo Sapiens
VKPLVWKPG

SEQ ID NO: 629942 - protein, 9 aa, Homo Sapiens
RPCHPLAPR

SEQ ID NO: 629943 - protein, 9 aa, Homo Sapiens
EKNCAHGEG

SEQ ID NO: 629944 - protein, 9 aa, Homo Sapiens
SLQAMGSSS

SEQ ID NO: 629945 - protein, 9 aa, Homo Sapiens
MIMCPICDQ

SEQ ID NO: 629946 - protein, 9 aa, Homo Sapiens
FQVLIILTA

SEQ ID NO: 629947 - protein, 9 aa, Homo Sapiens
SEPEDDSPV

SEQ ID NO: 629948 - protein, 9 aa, Homo Sapiens
TNSFAIKIL

SEQ ID NO: 629949 - protein, 9 aa, Homo Sapiens
LMANLVSGL

SEQ ID NO: 629950 - protein, 9 aa, Homo Sapiens
NPDSMAPAE

SEQ ID NO: 629951 - protein, 9 aa, Homo Sapiens
LESNRRTTS

SEQ ID NO: 629952 - protein, 9 aa, Homo Sapiens
TSQLECCSV

SEQ ID NO: 629953 - protein, 9 aa, Homo Sapiens
GGGAAGGPR

SEQ ID NO: 629954 - protein, 9 aa, Homo Sapiens
SPRDCDHLV

SEQ ID NO: 629955 - protein, 9 aa, Homo Sapiens
VLCQLVGLN

SEQ ID NO: 629956 - protein, 9 aa, Homo Sapiens
SHFNMYLIF

SEQ ID NO: 629957 - protein, 9 aa, Homo Sapiens
EAQEVIARN

SEQ ID NO: 629958 - protein, 9 aa, Homo Sapiens
EYPSVADFP

SEQ ID NO: 629959 - protein, 9 aa, Homo Sapiens
LKHLNLCSL

SEQ ID NO: 629960 - protein, 9 aa, Homo Sapiens
LTLNDTFFD

SEQ ID NO: 629961 - protein, 9 aa, Homo Sapiens
PQHLSIWGY

SEQ ID NO: 629962 - protein, 9 aa, Homo Sapiens
CNNYDMTSL

SEQ ID NO: 629963 - protein, 9 aa, Homo Sapiens
FAGGQIFFS

SEQ ID NO: 629964 - protein, 9 aa, Homo Sapiens
EQAAGLYVG

SEQ ID NO: 629965 - protein, 9 aa, Homo Sapiens
RDYPALQFL

SEQ ID NO: 629966 - protein, 9 aa, Homo Sapiens
LDFSKGHHG

SEQ ID NO: 629967 - protein, 9 aa, Homo Sapiens
SAVSLGWLP

SEQ ID NO: 629968 - protein, 9 aa, Homo Sapiens
AASVEPQRQ

SEQ ID NO: 629969 - protein, 9 aa, Homo Sapiens
HSTQQAVQF

SEQ ID NO: 629970 - protein, 9 aa, Homo Sapiens
LDRDQQEWE

SEQ ID NO: 629971 - protein, 9 aa, Homo Sapiens
EDYGFSVDL

SEQ ID NO: 629972 - protein, 9 aa, Homo Sapiens
LLKTVKPLV

SEQ ID NO: 629973 - protein, 9 aa, Homo Sapiens
YNLCISCIN

SEQ ID NO: 629974 - protein, 9 aa, Homo Sapiens
AFKVSAGHG

SEQ ID NO: 629975 - protein, 9 aa, Homo Sapiens
SLDEEQARK

SEQ ID NO: 629976 - protein, 9 aa, Homo Sapiens
GWSQGPGLQ

SEQ ID NO: 629977 - protein, 9 aa, Homo Sapiens
CPGCGKGVQ

SEQ ID NO: 629978 - protein, 9 aa, Homo Sapiens
PGSCGPGLY

SEQ ID NO: 629979 - protein, 9 aa, Homo Sapiens
EDNIQLVAD

SEQ ID NO: 629980 - protein, 9 aa, Homo Sapiens
SGVIVGGGY

SEQ ID NO: 629981 - protein, 9 aa, Homo Sapiens
EKGNSSSSA

SEQ ID NO: 629982 - protein, 9 aa, Homo Sapiens
ASIFDGSAM

SEQ ID NO: 629983 - protein, 9 aa, Homo Sapiens
LAAMANDRY

SEQ ID NO: 629984 - protein, 9 aa, Homo Sapiens
PPPHDSLSL

SEQ ID NO: 629985 - protein, 9 aa, Homo Sapiens
YLKADNRGG

SEQ ID NO: 629986 - protein, 9 aa, Homo Sapiens
QAMGSSSDS

SEQ ID NO: 629987 - protein, 9 aa, Homo Sapiens
LRKHCLDGE

SEQ ID NO: 629988 - protein, 9 aa, Homo Sapiens
FLVSCAQAA

SEQ ID NO: 629989 - protein, 9 aa, Homo Sapiens
MLSHVTADV

SEQ ID NO: 629990 - protein, 9 aa, Homo Sapiens
NVDNQAMLH

SEQ ID NO: 629991 - protein, 9 aa, Homo Sapiens
SVATGLPGR

SEQ ID NO: 629992 - protein, 9 aa, Homo Sapiens
QLGCEVLNM

SEQ ID NO: 629993 - protein, 9 aa, Homo Sapiens
PLLPGAPRS

SEQ ID NO: 629994 - protein, 9 aa, Homo Sapiens
DPLQDSLAR

SEQ ID NO: 629995 - protein, 9 aa, Homo Sapiens
RRLKREQED

SEQ ID NO: 629996 - protein, 9 aa, Homo Sapiens
THTPNHRCI

SEQ ID NO: 629997 - protein, 9 aa, Homo Sapiens
GQCDYACGP

SEQ ID NO: 629998 - protein, 9 aa, Homo Sapiens
LFLIIAGMH

SEQ ID NO: 629999 - protein, 9 aa, Homo Sapiens
RVNVGEGNH

SEQ ID NO: 630000 - protein, 9 aa, Homo Sapiens
EGELILSMN

SEQ ID NO: 630001 - protein, 9 aa, Homo Sapiens
LSTSNVSET

SEQ ID NO: 630002 - protein, 9 aa, Homo Sapiens
AIIYRGGYN

SEQ ID NO: 630003 - protein, 9 aa, Homo Sapiens
PSPLPPSQN

SEQ ID NO: 630004 - protein, 9 aa, Homo Sapiens
DVEEMETGN

SEQ ID NO: 630005 - protein, 9 aa, Homo Sapiens
AYLLTLNDT

SEQ ID NO: 630006 - protein, 9 aa, Homo Sapiens
AGEHPQPHT

SEQ ID NO: 630007 - protein, 9 aa, Homo Sapiens
NWPEWMKVH

SEQ ID NO: 630008 - protein, 9 aa, Homo Sapiens
MENQYHREM

SEQ ID NO: 630009 - protein, 9 aa, Homo Sapiens
RVAKGPKGE

SEQ ID NO: 630010 - protein, 9 aa, Homo Sapiens
SEKLASSAG

SEQ ID NO: 630011 - protein, 9 aa, Homo Sapiens
KYFKSWRPL

SEQ ID NO: 630012 - protein, 9 aa, Homo Sapiens
RYHAYLKPF

SEQ ID NO: 630013 - protein, 9 aa, Homo Sapiens
EWGPQSGPP

SEQ ID NO: 630014 - protein, 9 aa, Homo Sapiens
AATICSMER

SEQ ID NO: 630015 - protein, 9 aa, Homo Sapiens
RDGLSRVHN

SEQ ID NO: 630016 - protein, 9 aa, Homo Sapiens
YFFSFRKQR

SEQ ID NO: 630017 - protein, 9 aa, Homo Sapiens
DKNATDEDS

SEQ ID NO: 630018 - protein, 9 aa, Homo Sapiens
YCKLIPYLD

SEQ ID NO: 630019 - protein, 9 aa, Homo Sapiens
KMTVKDIVT

SEQ ID NO: 630020 - protein, 9 aa, Homo Sapiens
SYFHCDDLP

SEQ ID NO: 630021 - protein, 9 aa, Homo Sapiens
KTYMLAFDL

SEQ ID NO: 630022 - protein, 9 aa, Homo Sapiens
GFPTRPAFK

SEQ ID NO: 630023 - protein, 9 aa, Homo Sapiens
TSLHNCKAK

SEQ ID NO: 630024 - protein, 9 aa, Homo Sapiens
GTQGKKSAA

SEQ ID NO: 630025 - protein, 9 aa, Homo Sapiens
EGAQNKGKK

SEQ ID NO: 630026 - protein, 9 aa, Homo Sapiens
EIIFVLNDG

SEQ ID NO: 630027 - protein, 9 aa, Homo Sapiens
ALGGNTVIP

SEQ ID NO: 630028 - protein, 9 aa, Homo Sapiens
RGCRASYPT

SEQ ID NO: 630029 - protein, 9 aa, Homo Sapiens
YVGTFYEEY

SEQ ID NO: 630030 - protein, 9 aa, Homo Sapiens
RSHDPGQRR

SEQ ID NO: 630031 - protein, 9 aa, Homo Sapiens
AIELKLSEC

SEQ ID NO: 630032 - protein, 9 aa, Homo Sapiens
EKPNIPSAA

SEQ ID NO: 630033 - protein, 9 aa, Homo Sapiens
LNACQWFLK

SEQ ID NO: 630034 - protein, 9 aa, Homo Sapiens
WSVWDKNAT

SEQ ID NO: 630035 - protein, 9 aa, Homo Sapiens
MQLQQTVRD

SEQ ID NO: 630036 - protein, 9 aa, Homo Sapiens
LITYIKILQ

SEQ ID NO: 630037 - protein, 9 aa, Homo Sapiens
SATTGADVC

SEQ ID NO: 630038 - protein, 9 aa, Homo Sapiens
FALDGIGGD

SEQ ID NO: 630039 - protein, 9 aa, Homo Sapiens
VIPQAVRVE

SEQ ID NO: 630040 - protein, 9 aa, Homo Sapiens
MVWTPNMSA

SEQ ID NO: 630041 - protein, 9 aa, Homo Sapiens
LRLTGSSRL

SEQ ID NO: 630042 - protein, 9 aa, Homo Sapiens
PSSILNTTL

SEQ ID NO: 630043 - protein, 9 aa, Homo Sapiens
EIYERQQQE

SEQ ID NO: 630044 - protein, 9 aa, Homo Sapiens
MQDKFILKS

SEQ ID NO: 630045 - protein, 9 aa, Homo Sapiens
INWSRVLVE

SEQ ID NO: 630046 - protein, 9 aa, Homo Sapiens
KEKSELGQR

SEQ ID NO: 630047 - protein, 9 aa, Homo Sapiens
SVRSHDPGQ

SEQ ID NO: 630048 - protein, 9 aa, Homo Sapiens
LGEFAREQQ

SEQ ID NO: 630049 - protein, 9 aa, Homo Sapiens
DSSINPDRL

SEQ ID NO: 630050 - protein, 9 aa, Homo Sapiens
RAVDVLSQL

SEQ ID NO: 630051 - protein, 9 aa, Homo Sapiens
WRRTTLPIK

SEQ ID NO: 630052 - protein, 9 aa, Homo Sapiens
FVIVLLLLR

SEQ ID NO: 630053 - protein, 9 aa, Homo Sapiens
LDPNSNVTR

SEQ ID NO: 630054 - protein, 9 aa, Homo Sapiens
LHGYRGLRL

SEQ ID NO: 630055 - protein, 9 aa, Homo Sapiens
GGNTVIPQA

SEQ ID NO: 630056 - protein, 9 aa, Homo Sapiens
SGMLNPGRS

SEQ ID NO: 630057 - protein, 9 aa, Homo Sapiens
VTQTELADG

SEQ ID NO: 630058 - protein, 9 aa, Homo Sapiens
FRGKYYNLK

SEQ ID NO: 630059 - protein, 9 aa, Homo Sapiens
NAQEYCDRI

SEQ ID NO: 630060 - protein, 9 aa, Homo Sapiens
VEELCYQNE

SEQ ID NO: 630061 - protein, 9 aa, Homo Sapiens
MKIYVEVVF

SEQ ID NO: 630062 - protein, 9 aa, Homo Sapiens
EDALHPVPY

SEQ ID NO: 630063 - protein, 9 aa, Homo Sapiens
GSTDCLVMA

SEQ ID NO: 630064 - protein, 9 aa, Homo Sapiens
QLQIPMKTQ

SEQ ID NO: 630065 - protein, 9 aa, Homo Sapiens
SLCANPKYV

SEQ ID NO: 630066 - protein, 9 aa, Homo Sapiens
HSSISHDSP

SEQ ID NO: 630067 - protein, 9 aa, Homo Sapiens
WDSYLVLHN

SEQ ID NO: 630068 - protein, 9 aa, Homo Sapiens
FGGKEYPSV

SEQ ID NO: 630069 - protein, 9 aa, Homo Sapiens
REQSCLGTL

SEQ ID NO: 630070 - protein, 9 aa, Homo Sapiens
RQPCDREAV

SEQ ID NO: 630071 - protein, 9 aa, Homo Sapiens
HYTVIENSQ

SEQ ID NO: 630072 - protein, 9 aa, Homo Sapiens
HIFQLNEDV

SEQ ID NO: 630073 - protein, 9 aa, Homo Sapiens
TTESEPLLG

SEQ ID NO: 630074 - protein, 9 aa, Homo Sapiens
TLGPSLSQG

SEQ ID NO: 630075 - protein, 9 aa, Homo Sapiens
EGNHPERVK

SEQ ID NO: 630076 - protein, 9 aa, Homo Sapiens
LKKSPLRMS

SEQ ID NO: 630077 - protein, 9 aa, Homo Sapiens
SFVDLAGSE

SEQ ID NO: 630078 - protein, 9 aa, Homo Sapiens
YFKSWRPLF

SEQ ID NO: 630079 - protein, 9 aa, Homo Sapiens
ILMPCTRGQ

SEQ ID NO: 630080 - protein, 9 aa, Homo Sapiens
QALNHHLHS

SEQ ID NO: 630081 - protein, 9 aa, Homo Sapiens
TLATDHTDG

SEQ ID NO: 630082 - protein, 9 aa, Homo Sapiens
TISQLSFVD

SEQ ID NO: 630083 - protein, 9 aa, Homo Sapiens
GMMKLRSRE

SEQ ID NO: 630084 - protein, 9 aa, Homo Sapiens
IFVCNYGHA

SEQ ID NO: 630085 - protein, 9 aa, Homo Sapiens
CAVVGLLAG

SEQ ID NO: 630086 - protein, 9 aa, Homo Sapiens
GQHSRGQHA

SEQ ID NO: 630087 - protein, 9 aa, Homo Sapiens
RKPEVLTGD

SEQ ID NO: 630088 - protein, 9 aa, Homo Sapiens
NCSIIKWSV

SEQ ID NO: 630089 - protein, 9 aa, Homo Sapiens
ALRLGAEVY

SEQ ID NO: 630090 - protein, 9 aa, Homo Sapiens
FSTYLATCQ

SEQ ID NO: 630091 - protein, 9 aa, Homo Sapiens
NSTRHPLAL

SEQ ID NO: 630092 - protein, 9 aa, Homo Sapiens
HGNTKIPEP

SEQ ID NO: 630093 - protein, 9 aa, Homo Sapiens
APLGPPRSE

SEQ ID NO: 630094 - protein, 9 aa, Homo Sapiens
SSYQLRPGT

SEQ ID NO: 630095 - protein, 9 aa, Homo Sapiens
SGGSGSHAR

SEQ ID NO: 630096 - protein, 9 aa, Homo Sapiens
DSTPSRANP

SEQ ID NO: 630097 - protein, 9 aa, Homo Sapiens
KGLRVAACQ

SEQ ID NO: 630098 - protein, 9 aa, Homo Sapiens
DLRRLVMYC

SEQ ID NO: 630099 - protein, 9 aa, Homo Sapiens
QVSARDAGL

SEQ ID NO: 630100 - protein, 9 aa, Homo Sapiens
STSSGTLWS

SEQ ID NO: 630101 - protein, 9 aa, Homo Sapiens
CTEHIKRKG

SEQ ID NO: 630102 - protein, 9 aa, Homo Sapiens
FITCMGVDR

SEQ ID NO: 630103 - protein, 9 aa, Homo Sapiens
SVPPPKNLT

SEQ ID NO: 630104 - protein, 9 aa, Homo Sapiens
SAQASSLID

SEQ ID NO: 630105 - protein, 9 aa, Homo Sapiens
VFPSSVDFT

SEQ ID NO: 630106 - protein, 9 aa, Homo Sapiens
YHYPCFHSP

SEQ ID NO: 630107 - protein, 9 aa, Homo Sapiens
DPVLRRSLD

SEQ ID NO: 630108 - protein, 9 aa, Homo Sapiens
NDGKWKSLT

SEQ ID NO: 630109 - protein, 9 aa, Homo Sapiens
KGEDGKDVS

SEQ ID NO: 630110 - protein, 9 aa, Homo Sapiens
PLQDSLARL

SEQ ID NO: 630111 - protein, 9 aa, Homo Sapiens
EWLVETLKC

SEQ ID NO: 630112 - protein, 9 aa, Homo Sapiens
VVGEFPIFS

SEQ ID NO: 630113 - protein, 9 aa, Homo Sapiens
ICDQVCDYW

SEQ ID NO: 630114 - protein, 9 aa, Homo Sapiens
VPLSRKMAE

SEQ ID NO: 630115 - protein, 9 aa, Homo Sapiens
PLVTLLHMP

SEQ ID NO: 630116 - protein, 9 aa, Homo Sapiens
LALSSIAIQ

SEQ ID NO: 630117 - protein, 9 aa, Homo Sapiens
CFLLAAMAN

SEQ ID NO: 630118 - protein, 9 aa, Homo Sapiens
GRKDDDSHD

SEQ ID NO: 630119 - protein, 9 aa, Homo Sapiens
SMAAAAGHL

SEQ ID NO: 630120 - protein, 9 aa, Homo Sapiens
DRYMAFGNP

SEQ ID NO: 630121 - protein, 9 aa, Homo Sapiens
AVGTRSSGL

SEQ ID NO: 630122 - protein, 9 aa, Homo Sapiens
SNLNKKETT

SEQ ID NO: 630123 - protein, 9 aa, Homo Sapiens
LVMYCAPLK

SEQ ID NO: 630124 - protein, 9 aa, Homo Sapiens
GSPSMSSSQ

SEQ ID NO: 630125 - protein, 9 aa, Homo Sapiens
GKPLAAVAS

SEQ ID NO: 630126 - protein, 9 aa, Homo Sapiens
DNRSDNFNI

SEQ ID NO: 630127 - protein, 9 aa, Homo Sapiens
SPFLLTLEP

SEQ ID NO: 630128 - protein, 9 aa, Homo Sapiens
LHMPCPAHG

SEQ ID NO: 630129 - protein, 9 aa, Homo Sapiens
HPLGSKHVS

SEQ ID NO: 630130 - protein, 9 aa, Homo Sapiens
SCVYASGNF

SEQ ID NO: 630131 - protein, 9 aa, Homo Sapiens
GVVGGYRGV

SEQ ID NO: 630132 - protein, 9 aa, Homo Sapiens
MYVAYHCYP

SEQ ID NO: 630133 - protein, 9 aa, Homo Sapiens
VHSRVPTLE

SEQ ID NO: 630134 - protein, 9 aa, Homo Sapiens
LKEASTAHW

SEQ ID NO: 630135 - protein, 9 aa, Homo Sapiens
KTFNCKMSL

SEQ ID NO: 630136 - protein, 9 aa, Homo Sapiens
SVSVARDCG

SEQ ID NO: 630137 - protein, 9 aa, Homo Sapiens
KDDDSHDES

SEQ ID NO: 630138 - protein, 9 aa, Homo Sapiens
GTFNPVSLC

SEQ ID NO: 630139 - protein, 9 aa, Homo Sapiens
MENVSPRPK

SEQ ID NO: 630140 - protein, 9 aa, Homo Sapiens
AVNDDYYVG

SEQ ID NO: 630141 - protein, 9 aa, Homo Sapiens
SIFDGSAMA

SEQ ID NO: 630142 - protein, 9 aa, Homo Sapiens
ISPGTPPSY

SEQ ID NO: 630143 - protein, 9 aa, Homo Sapiens
SLKLIHLVS

SEQ ID NO: 630144 - protein, 9 aa, Homo Sapiens
CLAENSLGP

SEQ ID NO: 630145 - protein, 9 aa, Homo Sapiens
LSLSQLELQ

SEQ ID NO: 630146 - protein, 9 aa, Homo Sapiens
FIEKGNSSS

SEQ ID NO: 630147 - protein, 9 aa, Homo Sapiens
DLETSFQVP

SEQ ID NO: 630148 - protein, 9 aa, Homo Sapiens
VVVVAPTGI

SEQ ID NO: 630149 - protein, 9 aa, Homo Sapiens
MRSHYVAKT

SEQ ID NO: 630150 - protein, 9 aa, Homo Sapiens
DHSTTALLH

SEQ ID NO: 630151 - protein, 9 aa, Homo Sapiens
LKQGVLEVA

SEQ ID NO: 630152 - protein, 9 aa, Homo Sapiens
LFHPWGIAV

SEQ ID NO: 630153 - protein, 9 aa, Homo Sapiens
YPKSVSKEA

SEQ ID NO: 630154 - protein, 9 aa, Homo Sapiens
EIVGSHGSR

SEQ ID NO: 630155 - protein, 9 aa, Homo Sapiens
IKGAEDNMV

SEQ ID NO: 630156 - protein, 9 aa, Homo Sapiens
PPWAQGAPE

SEQ ID NO: 630157 - protein, 9 aa, Homo Sapiens
NKLRKRERS

SEQ ID NO: 630158 - protein, 9 aa, Homo Sapiens
QGLVARAGT

SEQ ID NO: 630159 - protein, 9 aa, Homo Sapiens
DTTHYCMFL

SEQ ID NO: 630160 - protein, 9 aa, Homo Sapiens
CVICALIGI

SEQ ID NO: 630161 - protein, 9 aa, Homo Sapiens
GCEVLNMLT

SEQ ID NO: 630162 - protein, 9 aa, Homo Sapiens
EMRTLRPSL

SEQ ID NO: 630163 - protein, 9 aa, Homo Sapiens
TVMIGLLMF

SEQ ID NO: 630164 - protein, 9 aa, Homo Sapiens
NVLEQFVGR

SEQ ID NO: 630165 - protein, 9 aa, Homo Sapiens
DALYELFQD

SEQ ID NO: 630166 - protein, 9 aa, Homo Sapiens
HEEQGRSLG

SEQ ID NO: 630167 - protein, 9 aa, Homo Sapiens
HSNKKRPSI

SEQ ID NO: 630168 - protein, 9 aa, Homo Sapiens
AVLLLALSS

SEQ ID NO: 630169 - protein, 9 aa, Homo Sapiens
EDDDVEEME

SEQ ID NO: 630170 - protein, 9 aa, Homo Sapiens
AHSPGCLEE

SEQ ID NO: 630171 - protein, 9 aa, Homo Sapiens
LHVRCSQSP

SEQ ID NO: 630172 - protein, 9 aa, Homo Sapiens
NECAEGSHC

SEQ ID NO: 630173 - protein, 9 aa, Homo Sapiens
FGYLKADNR

SEQ ID NO: 630174 - protein, 9 aa, Homo Sapiens
VAMLKALLG

SEQ ID NO: 630175 - protein, 9 aa, Homo Sapiens
PCHPLAPRG

SEQ ID NO: 630176 - protein, 9 aa, Homo Sapiens
KVSYVTATD

SEQ ID NO: 630177 - protein, 9 aa, Homo Sapiens
SHRFVGHNI

SEQ ID NO: 630178 - protein, 9 aa, Homo Sapiens
PWQSCKVLP

SEQ ID NO: 630179 - protein, 9 aa, Homo Sapiens
ITTESEPLL

SEQ ID NO: 630180 - protein, 9 aa, Homo Sapiens
GWQVQTCEV

SEQ ID NO: 630181 - protein, 9 aa, Homo Sapiens
EWAHCYSDL

SEQ ID NO: 630182 - protein, 9 aa, Homo Sapiens
SWDKKNKEM

SEQ ID NO: 630183 - protein, 9 aa, Homo Sapiens
NSGGILEVS

SEQ ID NO: 630184 - protein, 9 aa, Homo Sapiens
SPSLWQTLE

SEQ ID NO: 630185 - protein, 9 aa, Homo Sapiens
PEGPAPHIL

SEQ ID NO: 630186 - protein, 9 aa, Homo Sapiens
LTLSRIQKQ

SEQ ID NO: 630187 - protein, 9 aa, Homo Sapiens
GDHYNEAYS

SEQ ID NO: 630188 - protein, 9 aa, Homo Sapiens
VQASLLPQH

SEQ ID NO: 630189 - protein, 9 aa, Homo Sapiens
EMLKGLQHT

SEQ ID NO: 630190 - protein, 9 aa, Homo Sapiens
TLLLGLALV

SEQ ID NO: 630191 - protein, 8 aa, Homo Sapiens
DNGMFSGF

SEQ ID NO: 630192 - protein, 9 aa, Homo Sapiens
EWSSPVTPT

SEQ ID NO: 630193 - protein, 9 aa, Homo Sapiens
SICNMARPQ

SEQ ID NO: 630194 - protein, 9 aa, Homo Sapiens
LPILIEDSG

SEQ ID NO: 630195 - protein, 9 aa, Homo Sapiens
TAHLNGHKR

SEQ ID NO: 630196 - protein, 9 aa, Homo Sapiens
YVPDHPHPE

SEQ ID NO: 630197 - protein, 9 aa, Homo Sapiens
FFITCMGVD

SEQ ID NO: 630198 - protein, 9 aa, Homo Sapiens
MDRPGEGAT

SEQ ID NO: 630199 - protein, 9 aa, Homo Sapiens
LSGSTDCLV

SEQ ID NO: 630200 - protein, 9 aa, Homo Sapiens
CNYGHAGNF

SEQ ID NO: 630201 - protein, 9 aa, Homo Sapiens
RGADPDARP

SEQ ID NO: 630202 - protein, 9 aa, Homo Sapiens
PNSTRHPLA

SEQ ID NO: 630203 - protein, 9 aa, Homo Sapiens
RQTLSPDRQ

SEQ ID NO: 630204 - protein, 9 aa, Homo Sapiens
NEAYSRGRD

SEQ ID NO: 630205 - protein, 9 aa, Homo Sapiens
ENCEKQYPD

SEQ ID NO: 630206 - protein, 9 aa, Homo Sapiens
PTPCFSLSN

SEQ ID NO: 630207 - protein, 9 aa, Homo Sapiens
GACARPCFS

SEQ ID NO: 630208 - protein, 9 aa, Homo Sapiens
ELGQRSKVD

SEQ ID NO: 630209 - protein, 9 aa, Homo Sapiens
LLGKVCDGG

SEQ ID NO: 630210 - protein, 9 aa, Homo Sapiens
IAFSPLLHT

SEQ ID NO: 630211 - protein, 9 aa, Homo Sapiens
FGAHHLPGH

SEQ ID NO: 630212 - protein, 9 aa, Homo Sapiens
DCERDGLSR

SEQ ID NO: 630213 - protein, 9 aa, Homo Sapiens
GCRAAAPRS

SEQ ID NO: 630214 - protein, 9 aa, Homo Sapiens
VDANRQAIS

SEQ ID NO: 630215 - protein, 9 aa, Homo Sapiens
LCLLLLHGY

SEQ ID NO: 630216 - protein, 9 aa, Homo Sapiens
EKLVIYGDQ

SEQ ID NO: 630217 - protein, 9 aa, Homo Sapiens
GVLRGNVSF

SEQ ID NO: 630218 - protein, 9 aa, Homo Sapiens
EARDSGLES

SEQ ID NO: 630219 - protein, 9 aa, Homo Sapiens
LLTSGCDSS

SEQ ID NO: 630220 - protein, 9 aa, Homo Sapiens
HWQQVLCQR

SEQ ID NO: 630221 - protein, 9 aa, Homo Sapiens
VVWLTEGLL

SEQ ID NO: 630222 - protein, 9 aa, Homo Sapiens
PNHRCINCF

SEQ ID NO: 630223 - protein, 9 aa, Homo Sapiens
LGQRSKVDI

SEQ ID NO: 630224 - protein, 9 aa, Homo Sapiens
QLERLVADE

SEQ ID NO: 630225 - protein, 9 aa, Homo Sapiens
RQMGYPVLK

SEQ ID NO: 630226 - protein, 9 aa, Homo Sapiens
ESGRPVQKG

SEQ ID NO: 630227 - protein, 9 aa, Homo Sapiens
AGLYVGQYV

SEQ ID NO: 630228 - protein, 9 aa, Homo Sapiens
LAGKALLTG

SEQ ID NO: 630229 - protein, 9 aa, Homo Sapiens
PEPPGTPEI

SEQ ID NO: 630230 - protein, 9 aa, Homo Sapiens
FPIFSPGRV

SEQ ID NO: 630231 - protein, 9 aa, Homo Sapiens
ELVGFLDAI

SEQ ID NO: 630232 - protein, 9 aa, Homo Sapiens
GPRPLAHQL

SEQ ID NO: 630233 - protein, 9 aa, Homo Sapiens
FFSWDSYLV

SEQ ID NO: 630234 - protein, 9 aa, Homo Sapiens
SIPGETEEL

SEQ ID NO: 630235 - protein, 9 aa, Homo Sapiens
CSCCHQCKL

SEQ ID NO: 630236 - protein, 9 aa, Homo Sapiens
LGMTLATDH

SEQ ID NO: 630237 - protein, 9 aa, Homo Sapiens
SILKNSARH

SEQ ID NO: 630238 - protein, 9 aa, Homo Sapiens
DGLFIIVWM

SEQ ID NO: 630239 - protein, 9 aa, Homo Sapiens
RYSRQGLVA

SEQ ID NO: 630240 - protein, 9 aa, Homo Sapiens
RDFHGRCYN

SEQ ID NO: 630241 - protein, 9 aa, Homo Sapiens
RFSLSAIRA

SEQ ID NO: 630242 - protein, 9 aa, Homo Sapiens
KGGLPEQRS

SEQ ID NO: 630243 - protein, 9 aa, Homo Sapiens
CWVTCWGYT

SEQ ID NO: 630244 - protein, 9 aa, Homo Sapiens
LRDVMVKEN

SEQ ID NO: 630245 - protein, 9 aa, Homo Sapiens
KLFSNFTGS

SEQ ID NO: 630246 - protein, 9 aa, Homo Sapiens
RYHTCGGAL

SEQ ID NO: 630247 - protein, 9 aa, Homo Sapiens
EPSPSLWQT

SEQ ID NO: 630248 - protein, 9 aa, Homo Sapiens
QGVSLESVS

SEQ ID NO: 630249 - protein, 9 aa, Homo Sapiens
HEDWGIRLE

SEQ ID NO: 630250 - protein, 9 aa, Homo Sapiens
GGLCRAWNQ

SEQ ID NO: 630251 - protein, 9 aa, Homo Sapiens
SVTLFGESE

SEQ ID NO: 630252 - protein, 9 aa, Homo Sapiens
EGPAPHILG

SEQ ID NO: 630253 - protein, 9 aa, Homo Sapiens
AYQELIQAK

SEQ ID NO: 630254 - protein, 9 aa, Homo Sapiens
VRMSAVAML

SEQ ID NO: 630255 - protein, 9 aa, Homo Sapiens
TTSHTELVL

SEQ ID NO: 630256 - protein, 9 aa, Homo Sapiens
SASGGSGSH

SEQ ID NO: 630257 - protein, 9 aa, Homo Sapiens
EDEEPPMDS

SEQ ID NO: 630258 - protein, 9 aa, Homo Sapiens
PCEGIVCSC

SEQ ID NO: 630259 - protein, 9 aa, Homo Sapiens
GHDDHNWRS

SEQ ID NO: 630260 - protein, 9 aa, Homo Sapiens
KSRTPEIQQ

SEQ ID NO: 630261 - protein, 9 aa, Homo Sapiens
QASVAELLG

SEQ ID NO: 630262 - protein, 9 aa, Homo Sapiens
RSKYHTEQS

SEQ ID NO: 630263 - protein, 9 aa, Homo Sapiens
IACGAAVSD

SEQ ID NO: 630264 - protein, 9 aa, Homo Sapiens
STVSSLPDT

SEQ ID NO: 630265 - protein, 9 aa, Homo Sapiens
SHDPKYPVE

SEQ ID NO: 630266 - protein, 9 aa, Homo Sapiens
RLATVKSRW

SEQ ID NO: 630267 - protein, 9 aa, Homo Sapiens
SLSDYKHVL

SEQ ID NO: 630268 - protein, 9 aa, Homo Sapiens
SEIHKDEPG

SEQ ID NO: 630269 - protein, 9 aa, Homo Sapiens
QRPKRSSSL

SEQ ID NO: 630270 - protein, 9 aa, Homo Sapiens
IKRKGLLVT

SEQ ID NO: 630271 - protein, 9 aa, Homo Sapiens
ICTGTFHPA

SEQ ID NO: 630272 - protein, 9 aa, Homo Sapiens
PPLRAPQYQ

SEQ ID NO: 630273 - protein, 9 aa, Homo Sapiens
YRKDWSCFL

SEQ ID NO: 630274 - protein, 9 aa, Homo Sapiens
NPPCAVVGL

SEQ ID NO: 630275 - protein, 9 aa, Homo Sapiens
PGPPGTPGI

SEQ ID NO: 630276 - protein, 9 aa, Homo Sapiens
PEEHVHLRV

SEQ ID NO: 630277 - protein, 9 aa, Homo Sapiens
MNSKWKAET

SEQ ID NO: 630278 - protein, 9 aa, Homo Sapiens
MKVETVHCI

SEQ ID NO: 630279 - protein, 9 aa, Homo Sapiens
LICKLLAAD

SEQ ID NO: 630280 - protein, 9 aa, Homo Sapiens
PMKTQQPNV

SEQ ID NO: 630281 - protein, 9 aa, Homo Sapiens
SSINPDRLS

SEQ ID NO: 630282 - protein, 9 aa, Homo Sapiens
QGIPDTCSG

SEQ ID NO: 630283 - protein, 9 aa, Homo Sapiens
RKKSRCSEA

SEQ ID NO: 630284 - protein, 9 aa, Homo Sapiens
EEDEQSWCQ

SEQ ID NO: 630285 - protein, 9 aa, Homo Sapiens
WHSECNCEN

SEQ ID NO: 630286 - protein, 9 aa, Homo Sapiens
AQEVIARNL

SEQ ID NO: 630287 - protein, 9 aa, Homo Sapiens
VAFKVSAGH

SEQ ID NO: 630288 - protein, 9 aa, Homo Sapiens
IYELSSYQL

SEQ ID NO: 630289 - protein, 9 aa, Homo Sapiens
ADAQVVFNP

SEQ ID NO: 630290 - protein, 9 aa, Homo Sapiens
FTGRQSPAV

SEQ ID NO: 630291 - protein, 9 aa, Homo Sapiens
ICIGSLPPH

SEQ ID NO: 630292 - protein, 9 aa, Homo Sapiens
VNDDYYVGE

SEQ ID NO: 630293 - protein, 9 aa, Homo Sapiens
GLRAPPKSS

SEQ ID NO: 630294 - protein, 9 aa, Homo Sapiens
IYVEVVFKC

SEQ ID NO: 630295 - protein, 9 aa, Homo Sapiens
VQPNSTRHP

SEQ ID NO: 630296 - protein, 9 aa, Homo Sapiens
DKWRTEERL

SEQ ID NO: 630297 - protein, 9 aa, Homo Sapiens
QHTNIVRFY

SEQ ID NO: 630298 - protein, 9 aa, Homo Sapiens
RMSAVAMLK

SEQ ID NO: 630299 - protein, 9 aa, Homo Sapiens
DRYVAVCDT

SEQ ID NO: 630300 - protein, 9 aa, Homo Sapiens
QFVEQLQKV

SEQ ID NO: 630301 - protein, 9 aa, Homo Sapiens
KKTSVRSHD

SEQ ID NO: 630302 - protein, 9 aa, Homo Sapiens
DVLSQLSYA

SEQ ID NO: 630303 - protein, 9 aa, Homo Sapiens
DSSCVYASG

SEQ ID NO: 630304 - protein, 9 aa, Homo Sapiens
ETITIPHLR

SEQ ID NO: 630305 - protein, 9 aa, Homo Sapiens
ALVSIIKLI

SEQ ID NO: 630306 - protein, 9 aa, Homo Sapiens
EIRPNEVYL

SEQ ID NO: 630307 - protein, 9 aa, Homo Sapiens
PRAVDVLSQ

SEQ ID NO: 630308 - protein, 9 aa, Homo Sapiens
LHPVPYNPE

SEQ ID NO: 630309 - protein, 9 aa, Homo Sapiens
PFTKYEFTV

SEQ ID NO: 630310 - protein, 9 aa, Homo Sapiens
NGEIDILGE

SEQ ID NO: 630311 - protein, 9 aa, Homo Sapiens
VQISSRMLF

SEQ ID NO: 630312 - protein, 9 aa, Homo Sapiens
CHTYTVYCW

SEQ ID NO: 630313 - protein, 9 aa, Homo Sapiens
LKSPNLSKC

SEQ ID NO: 630314 - protein, 9 aa, Homo Sapiens
SCEYEAIKQ

SEQ ID NO: 630315 - protein, 9 aa, Homo Sapiens
EDYGCVHCP

SEQ ID NO: 630316 - protein, 9 aa, Homo Sapiens
ETFLYVTSI

SEQ ID NO: 630317 - protein, 9 aa, Homo Sapiens
LNSSSLSNL

SEQ ID NO: 630318 - protein, 9 aa, Homo Sapiens
LSHVTADVV

SEQ ID NO: 630319 - protein, 9 aa, Homo Sapiens
EHSQISGQA

SEQ ID NO: 630320 - protein, 9 aa, Homo Sapiens
LRLSQKHST

SEQ ID NO: 630321 - protein, 9 aa, Homo Sapiens
GLSGTTKLT

SEQ ID NO: 630322 - protein, 9 aa, Homo Sapiens
AHSSTHSVI

SEQ ID NO: 630323 - protein, 9 aa, Homo Sapiens
VLGDIVDAS

SEQ ID NO: 630324 - protein, 9 aa, Homo Sapiens
IFLVIKLDK

SEQ ID NO: 630325 - protein, 9 aa, Homo Sapiens
FREWGPQSG

SEQ ID NO: 630326 - protein, 9 aa, Homo Sapiens
PRFQSVTLY

SEQ ID NO: 630327 - protein, 9 aa, Homo Sapiens
HGPYIRDYP

SEQ ID NO: 630328 - protein, 9 aa, Homo Sapiens
SVLHDVAVL

SEQ ID NO: 630329 - protein, 9 aa, Homo Sapiens
RKEWLKLGA

SEQ ID NO: 630330 - protein, 9 aa, Homo Sapiens
LNSDRSSSM

SEQ ID NO: 630331 - protein, 9 aa, Homo Sapiens
QEEVSGCPA

SEQ ID NO: 630332 - protein, 9 aa, Homo Sapiens
GQKVTLRCS

SEQ ID NO: 630333 - protein, 9 aa, Homo Sapiens
QAAAANTSV

SEQ ID NO: 630334 - protein, 9 aa, Homo Sapiens
HYCMFLKHL

SEQ ID NO: 630335 - protein, 9 aa, Homo Sapiens
ILSMNILYP

SEQ ID NO: 630336 - protein, 9 aa, Homo Sapiens
TNENSGGIL

SEQ ID NO: 630337 - protein, 9 aa, Homo Sapiens
VHLGSGICV

SEQ ID NO: 630338 - protein, 9 aa, Homo Sapiens
TVHHRIHVC

SEQ ID NO: 630339 - protein, 9 aa, Homo Sapiens
RFFHVVQAG

SEQ ID NO: 630340 - protein, 9 aa, Homo Sapiens
IGLAWSSHV

SEQ ID NO: 630341 - protein, 9 aa, Homo Sapiens
SMAVRIQAY

SEQ ID NO: 630342 - protein, 9 aa, Homo Sapiens
PGSSKSGPR

SEQ ID NO: 630343 - protein, 9 aa, Homo Sapiens
MYLECLLRR

SEQ ID NO: 630344 - protein, 9 aa, Homo Sapiens
KRDYLVDAS

SEQ ID NO: 630345 - protein, 9 aa, Homo Sapiens
ELPPQSCSI

SEQ ID NO: 630346 - protein, 9 aa, Homo Sapiens
LRLTVEESS

SEQ ID NO: 630347 - protein, 9 aa, Homo Sapiens
ESYLSCRHN

SEQ ID NO: 630348 - protein, 9 aa, Homo Sapiens
KEDHTPLNP

SEQ ID NO: 630349 - protein, 9 aa, Homo Sapiens
AVCDTFHYV

SEQ ID NO: 630350 - protein, 9 aa, Homo Sapiens
GGAHFINAL

SEQ ID NO: 630351 - protein, 9 aa, Homo Sapiens
QSEGKVYTL

SEQ ID NO: 630352 - protein, 9 aa, Homo Sapiens
VKSVKMLLL

SEQ ID NO: 630353 - protein, 9 aa, Homo Sapiens
DINNLSTPL

SEQ ID NO: 630354 - protein, 9 aa, Homo Sapiens
PQCGKDFSR

SEQ ID NO: 630355 - protein, 9 aa, Homo Sapiens
SAFTELRYH

SEQ ID NO: 630356 - protein, 9 aa, Homo Sapiens
QHKKSVNGE

SEQ ID NO: 630357 - protein, 9 aa, Homo Sapiens
RRLLHWEEF

SEQ ID NO: 630358 - protein, 9 aa, Homo Sapiens
WSSHVAESF

SEQ ID NO: 630359 - protein, 9 aa, Homo Sapiens
LFVGLIIPF

SEQ ID NO: 630360 - protein, 9 aa, Homo Sapiens
NGFLPSKDI

SEQ ID NO: 630361 - protein, 9 aa, Homo Sapiens
QLSQRCPEQ

SEQ ID NO: 630362 - protein, 9 aa, Homo Sapiens
TCAFGGALN

SEQ ID NO: 630363 - protein, 9 aa, Homo Sapiens
EGVGEAAQW

SEQ ID NO: 630364 - protein, 9 aa, Homo Sapiens
SKFKIPKFK

SEQ ID NO: 630365 - protein, 9 aa, Homo Sapiens
TAHWQGCRK

SEQ ID NO: 630366 - protein, 9 aa, Homo Sapiens
FKGILVHAD

SEQ ID NO: 630367 - protein, 9 aa, Homo Sapiens
MGELTRAGI

SEQ ID NO: 630368 - protein, 9 aa, Homo Sapiens
MFMDASRLD

SEQ ID NO: 630369 - protein, 9 aa, Homo Sapiens
VPYHQAALR

SEQ ID NO: 630370 - protein, 9 aa, Homo Sapiens
TLAPLLDSE

SEQ ID NO: 630371 - protein, 9 aa, Homo Sapiens
IEVISMYRE

SEQ ID NO: 630372 - protein, 9 aa, Homo Sapiens
DRERFSFED

SEQ ID NO: 630373 - protein, 9 aa, Homo Sapiens
EDSGTVPST

SEQ ID NO: 630374 - protein, 9 aa, Homo Sapiens
YVFNGHLGQ

SEQ ID NO: 630375 - protein, 9 aa, Homo Sapiens
LEVAEGYPL

SEQ ID NO: 630376 - protein, 9 aa, Homo Sapiens
VGHDDHNWR

SEQ ID NO: 630377 - protein, 9 aa, Homo Sapiens
KSKLGANAI

SEQ ID NO: 630378 - protein, 9 aa, Homo Sapiens
EPEDDSPVS

SEQ ID NO: 630379 - protein, 9 aa, Homo Sapiens
HRVVAPGFR

SEQ ID NO: 630380 - protein, 9 aa, Homo Sapiens
VPRYTGVAL

SEQ ID NO: 630381 - protein, 9 aa, Homo Sapiens
RKHCLDGED

SEQ ID NO: 630382 - protein, 9 aa, Homo Sapiens
EEHVHLRVP

SEQ ID NO: 630383 - protein, 9 aa, Homo Sapiens
TNIVRFYDS

SEQ ID NO: 630384 - protein, 9 aa, Homo Sapiens
VYTRKGKST

SEQ ID NO: 630385 - protein, 9 aa, Homo Sapiens
VFAFTCAFG

SEQ ID NO: 630386 - protein, 9 aa, Homo Sapiens
SFRDALRLG

SEQ ID NO: 630387 - protein, 9 aa, Homo Sapiens
QQRLHREML

SEQ ID NO: 630388 - protein, 9 aa, Homo Sapiens
HWEEFDEQR

SEQ ID NO: 630389 - protein, 9 aa, Homo Sapiens
NTSVAIALT

SEQ ID NO: 630390 - protein, 9 aa, Homo Sapiens
YYNLKPYTG

SEQ ID NO: 630391 - protein, 9 aa, Homo Sapiens
HDCLICFEN

SEQ ID NO: 630392 - protein, 9 aa, Homo Sapiens
ATDEDSTNV

SEQ ID NO: 630393 - protein, 9 aa, Homo Sapiens
DFSKGHHGI

SEQ ID NO: 630394 - protein, 9 aa, Homo Sapiens
LMRLICCPL

SEQ ID NO: 630395 - protein, 9 aa, Homo Sapiens
HLKWLSYWI

SEQ ID NO: 630396 - protein, 9 aa, Homo Sapiens
IGSLARWRQ

SEQ ID NO: 630397 - protein, 9 aa, Homo Sapiens
LQVEEAAVR

SEQ ID NO: 630398 - protein, 9 aa, Homo Sapiens
DFIIEVHDA

SEQ ID NO: 630399 - protein, 9 aa, Homo Sapiens
NLLSEEEFG

SEQ ID NO: 630400 - protein, 9 aa, Homo Sapiens
LCPGALERI

SEQ ID NO: 630401 - protein, 9 aa, Homo Sapiens
RLWSEDCRL

SEQ ID NO: 630402 - protein, 9 aa, Homo Sapiens
RKRERSCRA

SEQ ID NO: 630403 - protein, 9 aa, Homo Sapiens
GLSRVHNDH

SEQ ID NO: 630404 - protein, 9 aa, Homo Sapiens
LQCIEDRNA

SEQ ID NO: 630405 - protein, 9 aa, Homo Sapiens
EGPENEGTS

SEQ ID NO: 630406 - protein, 9 aa, Homo Sapiens
DKKGKANTS

SEQ ID NO: 630407 - protein, 9 aa, Homo Sapiens
GILVHADRD

SEQ ID NO: 630408 - protein, 9 aa, Homo Sapiens
QCDQCFHGY

SEQ ID NO: 630409 - protein, 9 aa, Homo Sapiens
IVLLLLRLR

SEQ ID NO: 630410 - protein, 9 aa, Homo Sapiens
KGSQAPQAL

SEQ ID NO: 630411 - protein, 9 aa, Homo Sapiens
HVRWRTEIG

SEQ ID NO: 630412 - protein, 9 aa, Homo Sapiens
ECGKTFRQF

SEQ ID NO: 630413 - protein, 9 aa, Homo Sapiens
NLLLDFGAD

SEQ ID NO: 630414 - protein, 9 aa, Homo Sapiens
IEWIICKDI

SEQ ID NO: 630415 - protein, 9 aa, Homo Sapiens
NCKAKSIIP

SEQ ID NO: 630416 - protein, 9 aa, Homo Sapiens
LWVVDLLAA

SEQ ID NO: 630417 - protein, 9 aa, Homo Sapiens
HCLRGSILF

SEQ ID NO: 630418 - protein, 9 aa, Homo Sapiens
LTGDVEEER

SEQ ID NO: 630419 - protein, 9 aa, Homo Sapiens
QLAAPPCKH

SEQ ID NO: 630420 - protein, 9 aa, Homo Sapiens
LGKVCDGGW

SEQ ID NO: 630421 - protein, 9 aa, Homo Sapiens
PDCDYLAPA

SEQ ID NO: 630422 - protein, 9 aa, Homo Sapiens
RASTITSVS

SEQ ID NO: 630423 - protein, 9 aa, Homo Sapiens
IIHRIFSIC

SEQ ID NO: 630424 - protein, 9 aa, Homo Sapiens
NATYNISKL

SEQ ID NO: 630425 - protein, 9 aa, Homo Sapiens
AFGNPLLYG

SEQ ID NO: 630426 - protein, 9 aa, Homo Sapiens
SHVDACTSR

SEQ ID NO: 630427 - protein, 9 aa, Homo Sapiens
SLQAIIYRG

SEQ ID NO: 630428 - protein, 9 aa, Homo Sapiens
SARFSPEVT

SEQ ID NO: 630429 - protein, 9 aa, Homo Sapiens
RVSTMNHPH

SEQ ID NO: 630430 - protein, 9 aa, Homo Sapiens
VAVAYACNP

SEQ ID NO: 630431 - protein, 9 aa, Homo Sapiens
SSLSNLAAV

SEQ ID NO: 630432 - protein, 9 aa, Homo Sapiens
QWPVTQPLR

SEQ ID NO: 630433 - protein, 9 aa, Homo Sapiens
DTKMKIYVE

SEQ ID NO: 630434 - protein, 9 aa, Homo Sapiens
GCADRYDVT

SEQ ID NO: 630435 - protein, 9 aa, Homo Sapiens
SAIGTWESP

SEQ ID NO: 630436 - protein, 9 aa, Homo Sapiens
GPPVAVGMS

SEQ ID NO: 630437 - protein, 9 aa, Homo Sapiens
LGSGGSVSK

SEQ ID NO: 630438 - protein, 9 aa, Homo Sapiens
NDSEVLQRL

SEQ ID NO: 630439 - protein, 9 aa, Homo Sapiens
PNWYSDADM

SEQ ID NO: 630440 - protein, 9 aa, Homo Sapiens
QAKIACGAA

SEQ ID NO: 630441 - protein, 9 aa, Homo Sapiens
GGPRPLAHQ

SEQ ID NO: 630442 - protein, 9 aa, Homo Sapiens
AYRMRWWMA

SEQ ID NO: 630443 - protein, 9 aa, Homo Sapiens
LELVESPRL

SEQ ID NO: 630444 - protein, 9 aa, Homo Sapiens
RVYAFTKVG

SEQ ID NO: 630445 - protein, 9 aa, Homo Sapiens
SVMAPLGPP

SEQ ID NO: 630446 - protein, 9 aa, Homo Sapiens
MGARDTRRL

SEQ ID NO: 630447 - protein, 9 aa, Homo Sapiens
TENKSKLGA

SEQ ID NO: 630448 - protein, 9 aa, Homo Sapiens
VATGLPGRP

SEQ ID NO: 630449 - protein, 9 aa, Homo Sapiens
AAGACARPC

SEQ ID NO: 630450 - protein, 9 aa, Homo Sapiens
RSSVSRRTL

SEQ ID NO: 630451 - protein, 9 aa, Homo Sapiens
YWEMSNQYV

SEQ ID NO: 630452 - protein, 9 aa, Homo Sapiens
CALNKGIKA

SEQ ID NO: 630453 - protein, 9 aa, Homo Sapiens
YSSPINVHL

SEQ ID NO: 630454 - protein, 9 aa, Homo Sapiens
HYFPYDYSA

SEQ ID NO: 630455 - protein, 9 aa, Homo Sapiens
GSTAISPGT

SEQ ID NO: 630456 - protein, 9 aa, Homo Sapiens
AQRDLAYKQ

SEQ ID NO: 630457 - protein, 9 aa, Homo Sapiens
GTENKSKLG

SEQ ID NO: 630458 - protein, 9 aa, Homo Sapiens
ALESVLLDL

SEQ ID NO: 630459 - protein, 9 aa, Homo Sapiens
DAGLPPLGS

SEQ ID NO: 630460 - protein, 9 aa, Homo Sapiens
RASSVLHDV

SEQ ID NO: 630461 - protein, 9 aa, Homo Sapiens
EDGKDVSPG

SEQ ID NO: 630462 - protein, 9 aa, Homo Sapiens
VVDGLFIIV

SEQ ID NO: 630463 - protein, 9 aa, Homo Sapiens
FDSTKDLPN

SEQ ID NO: 630464 - protein, 9 aa, Homo Sapiens
KNQNKNIEN

SEQ ID NO: 630465 - protein, 9 aa, Homo Sapiens
KRLNDHGTN

SEQ ID NO: 630466 - protein, 9 aa, Homo Sapiens
ARPGGRGAL

SEQ ID NO: 630467 - protein, 9 aa, Homo Sapiens
VYPVAGGGS

SEQ ID NO: 630468 - protein, 9 aa, Homo Sapiens
AFGDCSTII

SEQ ID NO: 630469 - protein, 9 aa, Homo Sapiens
VVMLITYIK

SEQ ID NO: 630470 - protein, 9 aa, Homo Sapiens
GEAAQWGEP

SEQ ID NO: 630471 - protein, 9 aa, Homo Sapiens
TPVSGYRAS

SEQ ID NO: 630472 - protein, 9 aa, Homo Sapiens
ALDSKSLQS

SEQ ID NO: 630473 - protein, 9 aa, Homo Sapiens
KDSSCVYAS

SEQ ID NO: 630474 - protein, 9 aa, Homo Sapiens
ISSGNRTIN

SEQ ID NO: 630475 - protein, 9 aa, Homo Sapiens
SGINDYLTG

SEQ ID NO: 630476 - protein, 9 aa, Homo Sapiens
DEETGGRPA

SEQ ID NO: 630477 - protein, 9 aa, Homo Sapiens
DSMAPAEEA

SEQ ID NO: 630478 - protein, 9 aa, Homo Sapiens
LPPTLHLVF

SEQ ID NO: 630479 - protein, 9 aa, Homo Sapiens
KDYCNNYDM

SEQ ID NO: 630480 - protein, 9 aa, Homo Sapiens
SLLIIHPSE

SEQ ID NO: 630481 - protein, 9 aa, Homo Sapiens
HPGARQLVG

SEQ ID NO: 630482 - protein, 9 aa, Homo Sapiens
SRRTLHSMP

SEQ ID NO: 630483 - protein, 9 aa, Homo Sapiens
VSAGRGNVP

SEQ ID NO: 630484 - protein, 9 aa, Homo Sapiens
GQTLWLLIL

SEQ ID NO: 630485 - protein, 9 aa, Homo Sapiens
RQQAYSTCP

SEQ ID NO: 630486 - protein, 9 aa, Homo Sapiens
QKVTLRCSS

SEQ ID NO: 630487 - protein, 9 aa, Homo Sapiens
NNGSFLTDS

SEQ ID NO: 630488 - protein, 9 aa, Homo Sapiens
VMSTKIYTP

SEQ ID NO: 630489 - protein, 9 aa, Homo Sapiens
RSVRSQLYV

SEQ ID NO: 630490 - protein, 9 aa, Homo Sapiens
VSCLRPRDA

SEQ ID NO: 630491 - protein, 9 aa, Homo Sapiens
LSADEAACR

SEQ ID NO: 630492 - protein, 9 aa, Homo Sapiens
ENSLGPNAT

SEQ ID NO: 630493 - protein, 9 aa, Homo Sapiens
VPNVILSVW

SEQ ID NO: 630494 - protein, 9 aa, Homo Sapiens
SGQLSSQSF

SEQ ID NO: 630495 - protein, 9 aa, Homo Sapiens
EDDGVGVGD

SEQ ID NO: 630496 - protein, 9 aa, Homo Sapiens
SVAPCEGIV

SEQ ID NO: 630497 - protein, 9 aa, Homo Sapiens
GLWKDPSWA

SEQ ID NO: 630498 - protein, 9 aa, Homo Sapiens
GPMNGYEKD

SEQ ID NO: 630499 - protein, 9 aa, Homo Sapiens
EGRMVLLSL

SEQ ID NO: 630500 - protein, 9 aa, Homo Sapiens
YDHITSRDL

SEQ ID NO: 630501 - protein, 9 aa, Homo Sapiens
HMVLDEDSR

SEQ ID NO: 630502 - protein, 9 aa, Homo Sapiens
NSVYENFRL

SEQ ID NO: 630503 - protein, 9 aa, Homo Sapiens
AQEYCDRIP

SEQ ID NO: 630504 - protein, 9 aa, Homo Sapiens
SDNGICCIY

SEQ ID NO: 630505 - protein, 9 aa, Homo Sapiens
IHSSISHDS

SEQ ID NO: 630506 - protein, 9 aa, Homo Sapiens
LGQRWHLGS

SEQ ID NO: 630507 - protein, 9 aa, Homo Sapiens
HHSGHSPAI

SEQ ID NO: 630508 - protein, 9 aa, Homo Sapiens
FLYSATTGA

SEQ ID NO: 630509 - protein, 9 aa, Homo Sapiens
ENKSKLGAN

SEQ ID NO: 630510 - protein, 9 aa, Homo Sapiens
DLQLHVKHI

SEQ ID NO: 630511 - protein, 9 aa, Homo Sapiens
CIFIEMFHG

SEQ ID NO: 630512 - protein, 9 aa, Homo Sapiens
TKSRLARKA

SEQ ID NO: 630513 - protein, 9 aa, Homo Sapiens
QHSRGQHAM

SEQ ID NO: 630514 - protein, 9 aa, Homo Sapiens
LLLLEAMVE

SEQ ID NO: 630515 - protein, 9 aa, Homo Sapiens
VMSMDFNAT

SEQ ID NO: 630516 - protein, 9 aa, Homo Sapiens
DSCKPNSVY

SEQ ID NO: 630517 - protein, 9 aa, Homo Sapiens
HLVFTQFSL

SEQ ID NO: 630518 - protein, 9 aa, Homo Sapiens
CILTKPHAW

SEQ ID NO: 630519 - protein, 9 aa, Homo Sapiens
TPIVNPPQS

SEQ ID NO: 630520 - protein, 9 aa, Homo Sapiens
DVMVKENKE

SEQ ID NO: 630521 - protein, 9 aa, Homo Sapiens
PSGMELLSW

SEQ ID NO: 630522 - protein, 9 aa, Homo Sapiens
QLNEDVPSS

SEQ ID NO: 630523 - protein, 9 aa, Homo Sapiens
HYNEAYSRG

SEQ ID NO: 630524 - protein, 9 aa, Homo Sapiens
CVKYFSGLL

SEQ ID NO: 630525 - protein, 9 aa, Homo Sapiens
VPRDVQRHD

SEQ ID NO: 630526 - protein, 9 aa, Homo Sapiens
SADLENPLL

SEQ ID NO: 630527 - protein, 9 aa, Homo Sapiens
LKKQYYFDS

SEQ ID NO: 630528 - protein, 9 aa, Homo Sapiens
HREQQLRPK

SEQ ID NO: 630529 - protein, 9 aa, Homo Sapiens
SRTPEVHSR

SEQ ID NO: 630530 - protein, 9 aa, Homo Sapiens
CDRIPELRQ

SEQ ID NO: 630531 - protein, 9 aa, Homo Sapiens
LHDILQEPT

SEQ ID NO: 630532 - protein, 9 aa, Homo Sapiens
KCHGSTGQC

SEQ ID NO: 630533 - protein, 9 aa, Homo Sapiens
HRPTKKHKG

SEQ ID NO: 630534 - protein, 9 aa, Homo Sapiens
GVLGSGFRS

SEQ ID NO: 630535 - protein, 9 aa, Homo Sapiens
QQHQLAVEQ

SEQ ID NO: 630536 - protein, 9 aa, Homo Sapiens
CEVLNMLTA

SEQ ID NO: 630537 - protein, 9 aa, Homo Sapiens
GSSRYGPST

SEQ ID NO: 630538 - protein, 9 aa, Homo Sapiens
KAPHFSPVC

SEQ ID NO: 630539 - protein, 9 aa, Homo Sapiens
FPTRPAFKL

SEQ ID NO: 630540 - protein, 9 aa, Homo Sapiens
ELCPGALER

SEQ ID NO: 630541 - protein, 9 aa, Homo Sapiens
KAGLVSVAC

SEQ ID NO: 630542 - protein, 9 aa, Homo Sapiens
RKYTVVAGG

SEQ ID NO: 630543 - protein, 9 aa, Homo Sapiens
VVAPGFRMA

SEQ ID NO: 630544 - protein, 9 aa, Homo Sapiens
PINVHLQTH

SEQ ID NO: 630545 - protein, 9 aa, Homo Sapiens
GDLTVLVIA

SEQ ID NO: 630546 - protein, 9 aa, Homo Sapiens
PQLQSSPEN

SEQ ID NO: 630547 - protein, 9 aa, Homo Sapiens
QNGPMNGYE

SEQ ID NO: 630548 - protein, 9 aa, Homo Sapiens
TELEAQIVK

SEQ ID NO: 630549 - protein, 9 aa, Homo Sapiens
SGLLPVASE

SEQ ID NO: 630550 - protein, 9 aa, Homo Sapiens
GGALIRQNW

SEQ ID NO: 630551 - protein, 9 aa, Homo Sapiens
YVTATDLFV

SEQ ID NO: 630552 - protein, 9 aa, Homo Sapiens
MYTVYQLKQ

SEQ ID NO: 630553 - protein, 9 aa, Homo Sapiens
SLFGTPIVN

SEQ ID NO: 630554 - protein, 9 aa, Homo Sapiens
LLSEEEFGV

SEQ ID NO: 630555 - protein, 9 aa, Homo Sapiens
RHCEPALGN

SEQ ID NO: 630556 - protein, 9 aa, Homo Sapiens
LECCSVAFS

SEQ ID NO: 630557 - protein, 9 aa, Homo Sapiens
PKGLSEQVM

SEQ ID NO: 630558 - protein, 9 aa, Homo Sapiens
LDEDSRSES

SEQ ID NO: 630559 - protein, 9 aa, Homo Sapiens
NLKDRYGYW

SEQ ID NO: 630560 - protein, 9 aa, Homo Sapiens
LIKHQDEIA

SEQ ID NO: 630561 - protein, 9 aa, Homo Sapiens
QVSNLNKKE

SEQ ID NO: 630562 - protein, 9 aa, Homo Sapiens
LLPQDRVAE

SEQ ID NO: 630563 - protein, 9 aa, Homo Sapiens
DSGTVPSTG

SEQ ID NO: 630564 - protein, 9 aa, Homo Sapiens
VHPYYVITT

SEQ ID NO: 630565 - protein, 9 aa, Homo Sapiens
RSPGREKQG

SEQ ID NO: 630566 - protein, 9 aa, Homo Sapiens
RKAPHFSPV

SEQ ID NO: 630567 - protein, 9 aa, Homo Sapiens
IENSQAILP

SEQ ID NO: 630568 - protein, 9 aa, Homo Sapiens
ICVDEEKWH

SEQ ID NO: 630569 - protein, 9 aa, Homo Sapiens
RKSRTPEIQ

SEQ ID NO: 630570 - protein, 9 aa, Homo Sapiens
RRILICCDE

SEQ ID NO: 630571 - protein, 9 aa, Homo Sapiens
TPLPDIEWI

SEQ ID NO: 630572 - protein, 9 aa, Homo Sapiens
AHGRGPLAT

SEQ ID NO: 630573 - protein, 9 aa, Homo Sapiens
WDISGTSTS

SEQ ID NO: 630574 - protein, 9 aa, Homo Sapiens
QERCQLPAL

SEQ ID NO: 630575 - protein, 9 aa, Homo Sapiens
NAEELVGFL

SEQ ID NO: 630576 - protein, 9 aa, Homo Sapiens
RCPTAFLVS

SEQ ID NO: 630577 - protein, 9 aa, Homo Sapiens
GQQCDQCFH

SEQ ID NO: 630578 - protein, 9 aa, Homo Sapiens
EMKYVLCQL

SEQ ID NO: 630579 - protein, 9 aa, Homo Sapiens
QDKFILKSI

SEQ ID NO: 630580 - protein, 9 aa, Homo Sapiens
DFVVNNAGI

SEQ ID NO: 630581 - protein, 9 aa, Homo Sapiens
FENTAAVWP

SEQ ID NO: 630582 - protein, 9 aa, Homo Sapiens
TSNPELQAP

SEQ ID NO: 630583 - protein, 9 aa, Homo Sapiens
MGRVTKRDI

SEQ ID NO: 630584 - protein, 9 aa, Homo Sapiens
FFLWNFSLE

SEQ ID NO: 630585 - protein, 9 aa, Homo Sapiens
ALANGMRRG

SEQ ID NO: 630586 - protein, 9 aa, Homo Sapiens
IHVCDKSYK

SEQ ID NO: 630587 - protein, 9 aa, Homo Sapiens
DNIVLTTAW

SEQ ID NO: 630588 - protein, 9 aa, Homo Sapiens
TYMLAFDLN

SEQ ID NO: 630589 - protein, 9 aa, Homo Sapiens
QAPWDSEGL

SEQ ID NO: 630590 - protein, 9 aa, Homo Sapiens
LYCVPEGDA

SEQ ID NO: 630591 - protein, 9 aa, Homo Sapiens
LDLEDINYF

SEQ ID NO: 630592 - protein, 9 aa, Homo Sapiens
HLQEVRLLP

SEQ ID NO: 630593 - protein, 9 aa, Homo Sapiens
HPGGMMKLR

SEQ ID NO: 630594 - protein, 9 aa, Homo Sapiens
DSQPSPYPV

SEQ ID NO: 630595 - protein, 9 aa, Homo Sapiens
DLMFHPGGM

SEQ ID NO: 630596 - protein, 9 aa, Homo Sapiens
IQGGKTLSL

SEQ ID NO: 630597 - protein, 9 aa, Homo Sapiens
QRSTTKGRA

SEQ ID NO: 630598 - protein, 9 aa, Homo Sapiens
SLELMALHL

SEQ ID NO: 630599 - protein, 9 aa, Homo Sapiens
FYKLFYTAI

SEQ ID NO: 630600 - protein, 9 aa, Homo Sapiens
EVLGDIVDA

SEQ ID NO: 630601 - protein, 9 aa, Homo Sapiens
VQAFALDGI

SEQ ID NO: 630602 - protein, 9 aa, Homo Sapiens
KGVQAGCPG

SEQ ID NO: 630603 - protein, 9 aa, Homo Sapiens
GQDINNLST

SEQ ID NO: 630604 - protein, 9 aa, Homo Sapiens
QGLYYAVRL

SEQ ID NO: 630605 - protein, 9 aa, Homo Sapiens
AVAMLKALL

SEQ ID NO: 630606 - protein, 9 aa, Homo Sapiens
DQGIPDTCS

SEQ ID NO: 630607 - protein, 9 aa, Homo Sapiens
TARLLRQNC

SEQ ID NO: 630608 - protein, 9 aa, Homo Sapiens
GLPPLGSNV

SEQ ID NO: 630609 - protein, 9 aa, Homo Sapiens
YRKKSRCSE

SEQ ID NO: 630610 - protein, 9 aa, Homo Sapiens
TKKDALLEK

SEQ ID NO: 630611 - protein, 9 aa, Homo Sapiens
MTVFENSRA

SEQ ID NO: 630612 - protein, 9 aa, Homo Sapiens
NPVSLCANP

SEQ ID NO: 630613 - protein, 9 aa, Homo Sapiens
CDHFVIVSA

SEQ ID NO: 630614 - protein, 9 aa, Homo Sapiens
LIHNLKRIM

SEQ ID NO: 630615 - protein, 9 aa, Homo Sapiens
LLYIVRLVW

SEQ ID NO: 630616 - protein, 9 aa, Homo Sapiens
ICVKYFSGL

SEQ ID NO: 630617 - protein, 9 aa, Homo Sapiens
KGLRHGYFV

SEQ ID NO: 630618 - protein, 9 aa, Homo Sapiens
APHFSPVCL

SEQ ID NO: 630619 - protein, 9 aa, Homo Sapiens
QATEEIGKT

SEQ ID NO: 630620 - protein, 9 aa, Homo Sapiens
HFLLDPNSN

SEQ ID NO: 630621 - protein, 9 aa, Homo Sapiens
SLKGFLSVE

SEQ ID NO: 630622 - protein, 9 aa, Homo Sapiens
ENQGVFFSW

SEQ ID NO: 630623 - protein, 9 aa, Homo Sapiens
QPGAKGERV

SEQ ID NO: 630624 - protein, 9 aa, Homo Sapiens
TLCQWKIFT

SEQ ID NO: 630625 - protein, 9 aa, Homo Sapiens
CTLLLGLAL

SEQ ID NO: 630626 - protein, 9 aa, Homo Sapiens
SLKRPDSVA

SEQ ID NO: 630627 - protein, 9 aa, Homo Sapiens
HLPILIEDS

SEQ ID NO: 630628 - protein, 9 aa, Homo Sapiens
LLGHIEEHD

SEQ ID NO: 630629 - protein, 9 aa, Homo Sapiens
TIEARNTGN

SEQ ID NO: 630630 - protein, 9 aa, Homo Sapiens
PITPDEYML

SEQ ID NO: 630631 - protein, 9 aa, Homo Sapiens
TSGFASGMK

SEQ ID NO: 630632 - protein, 9 aa, Homo Sapiens
EQSWCQGQL

SEQ ID NO: 630633 - protein, 9 aa, Homo Sapiens
HWVESFKKA

SEQ ID NO: 630634 - protein, 9 aa, Homo Sapiens
PSGGEDDDV

SEQ ID NO: 630635 - protein, 9 aa, Homo Sapiens
TQEDIQKGY

SEQ ID NO: 630636 - protein, 9 aa, Homo Sapiens
VLLSLVLGL

SEQ ID NO: 630637 - protein, 9 aa, Homo Sapiens
YAVTVDYNI

SEQ ID NO: 630638 - protein, 9 aa, Homo Sapiens
IKLIFRPPE

SEQ ID NO: 630639 - protein, 9 aa, Homo Sapiens
EDVPSSENL

SEQ ID NO: 630640 - protein, 9 aa, Homo Sapiens
VYDSLHEEW

SEQ ID NO: 630641 - protein, 9 aa, Homo Sapiens
LHWLGCTEC

SEQ ID NO: 630642 - protein, 9 aa, Homo Sapiens
LNVYNVDNQ

SEQ ID NO: 630643 - protein, 9 aa, Homo Sapiens
KPLCAVWRP

SEQ ID NO: 630644 - protein, 9 aa, Homo Sapiens
EEVGLPLLF

SEQ ID NO: 630645 - protein, 9 aa, Homo Sapiens
GHAGNFANM

SEQ ID NO: 630646 - protein, 9 aa, Homo Sapiens
LMLLLNEAG

SEQ ID NO: 630647 - protein, 9 aa, Homo Sapiens
CGKAFGDCS

SEQ ID NO: 630648 - protein, 9 aa, Homo Sapiens
VQCHTYTVY

SEQ ID NO: 630649 - protein, 9 aa, Homo Sapiens
AVDTDGKGT

SEQ ID NO: 630650 - protein, 9 aa, Homo Sapiens
AGTMAETSA

SEQ ID NO: 630651 - protein, 9 aa, Homo Sapiens
QLSFVDLAG

SEQ ID NO: 630652 - protein, 9 aa, Homo Sapiens
GDARYGQRA

SEQ ID NO: 630653 - protein, 9 aa, Homo Sapiens
HLVSGKREL

SEQ ID NO: 630654 - protein, 9 aa, Homo Sapiens
LFGESEGAA

SEQ ID NO: 630655 - protein, 9 aa, Homo Sapiens
TPMYFFLWN

SEQ ID NO: 630656 - protein, 9 aa, Homo Sapiens
RPDSWSLRL

SEQ ID NO: 630657 - protein, 9 aa, Homo Sapiens
FLPSKDIKP

SEQ ID NO: 630658 - protein, 9 aa, Homo Sapiens
ASVYTRKGK

SEQ ID NO: 630659 - protein, 9 aa, Homo Sapiens
KMSEEDEQS

SEQ ID NO: 630660 - protein, 9 aa, Homo Sapiens
TRGQGWSQG

SEQ ID NO: 630661 - protein, 9 aa, Homo Sapiens
DGATYTDRS

SEQ ID NO: 630662 - protein, 9 aa, Homo Sapiens
GLRLTGSSR

SEQ ID NO: 630663 - protein, 9 aa, Homo Sapiens
ASPSNDSTS

SEQ ID NO: 630664 - protein, 9 aa, Homo Sapiens
VSLCANPKY

SEQ ID NO: 630665 - protein, 9 aa, Homo Sapiens
EMSNQYVIK

SEQ ID NO: 630666 - protein, 9 aa, Homo Sapiens
NSSLLKRFA

SEQ ID NO: 630667 - protein, 9 aa, Homo Sapiens
FTKKWRPRK

SEQ ID NO: 630668 - protein, 9 aa, Homo Sapiens
AATQAEDCI

SEQ ID NO: 630669 - protein, 9 aa, Homo Sapiens
RSSGDSQPS

SEQ ID NO: 630670 - protein, 9 aa, Homo Sapiens
LYAYAVATW

SEQ ID NO: 630671 - protein, 9 aa, Homo Sapiens
DPLASLRVR

SEQ ID NO: 630672 - protein, 9 aa, Homo Sapiens
PSLWQTLEW

SEQ ID NO: 630673 - protein, 9 aa, Homo Sapiens
NEIIFVLND

SEQ ID NO: 630674 - protein, 9 aa, Homo Sapiens
QGVLEVAHT

SEQ ID NO: 630675 - protein, 9 aa, Homo Sapiens
GKTLSLSQL

SEQ ID NO: 630676 - protein, 9 aa, Homo Sapiens
RGDARYGQR

SEQ ID NO: 630677 - protein, 9 aa, Homo Sapiens
LLYPSVEET

SEQ ID NO: 630678 - protein, 9 aa, Homo Sapiens
FSSHDPKYP

SEQ ID NO: 630679 - protein, 9 aa, Homo Sapiens
IDLSDVQWY

SEQ ID NO: 630680 - protein, 9 aa, Homo Sapiens
SLMENGNIK

SEQ ID NO: 630681 - protein, 9 aa, Homo Sapiens
EGSHCSPGW

SEQ ID NO: 630682 - protein, 9 aa, Homo Sapiens
RLAWPLWDL

SEQ ID NO: 630683 - protein, 9 aa, Homo Sapiens
PEAVGFDII

SEQ ID NO: 630684 - protein, 9 aa, Homo Sapiens
YHAYLKPFR

SEQ ID NO: 630685 - protein, 9 aa, Homo Sapiens
VLWTFLFRV

SEQ ID NO: 630686 - protein, 9 aa, Homo Sapiens
GYVSVLFLR

SEQ ID NO: 630687 - protein, 9 aa, Homo Sapiens
GVGDEDTDS

SEQ ID NO: 630688 - protein, 9 aa, Homo Sapiens
GELCPGALE

SEQ ID NO: 630689 - protein, 9 aa, Homo Sapiens
KRIGAYFPS

SEQ ID NO: 630690 - protein, 9 aa, Homo Sapiens
IVGHDDHNW

SEQ ID NO: 630691 - protein, 9 aa, Homo Sapiens
CKADRSLLN

SEQ ID NO: 630692 - protein, 9 aa, Homo Sapiens
KAMRKCAKE

SEQ ID NO: 630693 - protein, 9 aa, Homo Sapiens
PTETSPGAA

SEQ ID NO: 630694 - protein, 9 aa, Homo Sapiens
MTMDRPGEG

SEQ ID NO: 630695 - protein, 9 aa, Homo Sapiens
NEAQEVIAR

SEQ ID NO: 630696 - protein, 9 aa, Homo Sapiens
SPVSKTYKV

SEQ ID NO: 630697 - protein, 9 aa, Homo Sapiens
NIYELSSYQ

SEQ ID NO: 630698 - protein, 9 aa, Homo Sapiens
HPWKKQENG

SEQ ID NO: 630699 - protein, 9 aa, Homo Sapiens
EAGQCDYAC

SEQ ID NO: 630700 - protein, 9 aa, Homo Sapiens
NLSTPLECG

SEQ ID NO: 630701 - protein, 9 aa, Homo Sapiens
YQQPQEEEE

SEQ ID NO: 630702 - protein, 9 aa, Homo Sapiens
SEHGRYMQD

SEQ ID NO: 630703 - protein, 9 aa, Homo Sapiens
GVNGEIDIL

SEQ ID NO: 630704 - protein, 9 aa, Homo Sapiens
NKCQGLLFD

SEQ ID NO: 630705 - protein, 9 aa, Homo Sapiens
IQLHTPMYF

SEQ ID NO: 630706 - protein, 9 aa, Homo Sapiens
IRGLQSSKE

SEQ ID NO: 630707 - protein, 9 aa, Homo Sapiens
VEEAAVRAA

SEQ ID NO: 630708 - protein, 9 aa, Homo Sapiens
YLEFPWTVH

SEQ ID NO: 630709 - protein, 9 aa, Homo Sapiens
EWRLLGNVV

SEQ ID NO: 630710 - protein, 9 aa, Homo Sapiens
CRASYPTSQ

SEQ ID NO: 630711 - protein, 9 aa, Homo Sapiens
EWNLKSPNL

SEQ ID NO: 630712 - protein, 9 aa, Homo Sapiens
WLDLSVLAK

SEQ ID NO: 630713 - protein, 9 aa, Homo Sapiens
LAHFHTLKL

SEQ ID NO: 630714 - protein, 9 aa, Homo Sapiens
GARQLVGPL

SEQ ID NO: 630715 - protein, 9 aa, Homo Sapiens
APPTTSSAF

SEQ ID NO: 630716 - protein, 9 aa, Homo Sapiens
MILVHQLFH

SEQ ID NO: 630717 - protein, 9 aa, Homo Sapiens
ARACSEQEW

SEQ ID NO: 630718 - protein, 9 aa, Homo Sapiens
KVTLRCSSQ

SEQ ID NO: 630719 - protein, 9 aa, Homo Sapiens
VAFSPRSLA

SEQ ID NO: 630720 - protein, 9 aa, Homo Sapiens
NGPMNGYEK

SEQ ID NO: 630721 - protein, 9 aa, Homo Sapiens
LKDGATYTD

SEQ ID NO: 630722 - protein, 9 aa, Homo Sapiens
VFLVLMVTY

SEQ ID NO: 630723 - protein, 9 aa, Homo Sapiens
FLAGSLAVA

SEQ ID NO: 630724 - protein, 9 aa, Homo Sapiens
DSDLLSPSE

SEQ ID NO: 630725 - protein, 9 aa, Homo Sapiens
ALFQVLIIL

SEQ ID NO: 630726 - protein, 9 aa, Homo Sapiens
NFSSRMQSS

SEQ ID NO: 630727 - protein, 9 aa, Homo Sapiens
QHTHSMARG

SEQ ID NO: 630728 - protein, 9 aa, Homo Sapiens
FLQMPFNVV

SEQ ID NO: 630729 - protein, 9 aa, Homo Sapiens
CNWQEATSF

SEQ ID NO: 630730 - protein, 9 aa, Homo Sapiens
EQQLRPKKM

SEQ ID NO: 630731 - protein, 9 aa, Homo Sapiens
TLGEIVGSH

SEQ ID NO: 630732 - protein, 9 aa, Homo Sapiens
LSEEEFGVD

SEQ ID NO: 630733 - protein, 9 aa, Homo Sapiens
HRIFSICNM

SEQ ID NO: 630734 - protein, 9 aa, Homo Sapiens
RSKSSDPVL

SEQ ID NO: 630735 - protein, 9 aa, Homo Sapiens
NGDLIAQEL

SEQ ID NO: 630736 - protein, 9 aa, Homo Sapiens
LLHQFVEQL

SEQ ID NO: 630737 - protein, 9 aa, Homo Sapiens
VLFPAAQRP

SEQ ID NO: 630738 - protein, 9 aa, Homo Sapiens
EDRVKQLEK

SEQ ID NO: 630739 - protein, 9 aa, Homo Sapiens
DFQAFTGIE

SEQ ID NO: 630740 - protein, 9 aa, Homo Sapiens
HTYTVYCWC

SEQ ID NO: 630741 - protein, 9 aa, Homo Sapiens
LFFCFLMAN

SEQ ID NO: 630742 - protein, 9 aa, Homo Sapiens
APSQSSSFT

SEQ ID NO: 630743 - protein, 9 aa, Homo Sapiens
FIAIAKKLP

SEQ ID NO: 630744 - protein, 9 aa, Homo Sapiens
MRSVQWFGD

SEQ ID NO: 630745 - protein, 9 aa, Homo Sapiens
ELRKHKLIE

SEQ ID NO: 630746 - protein, 9 aa, Homo Sapiens
LELSQLIGT

SEQ ID NO: 630747 - protein, 9 aa, Homo Sapiens
QEKSPVSKT

SEQ ID NO: 630748 - protein, 9 aa, Homo Sapiens
LLDKLWIFL

SEQ ID NO: 630749 - protein, 9 aa, Homo Sapiens
RATASLWKE

SEQ ID NO: 630750 - protein, 9 aa, Homo Sapiens
AELSSVDDF

SEQ ID NO: 630751 - protein, 9 aa, Homo Sapiens
DAIAELETV

SEQ ID NO: 630752 - protein, 9 aa, Homo Sapiens
GKGSKGSQA

SEQ ID NO: 630753 - protein, 9 aa, Homo Sapiens
RMSDARKYT

SEQ ID NO: 630754 - protein, 9 aa, Homo Sapiens
LVTAKVPSS

SEQ ID NO: 630755 - protein, 9 aa, Homo Sapiens
LTGSSRLAW

SEQ ID NO: 630756 - protein, 9 aa, Homo Sapiens
QLDCKALGS

SEQ ID NO: 630757 - protein, 9 aa, Homo Sapiens
VSITFRIPV

SEQ ID NO: 630758 - protein, 9 aa, Homo Sapiens
PKFQFDRIH

SEQ ID NO: 630759 - protein, 9 aa, Homo Sapiens
ESTLDACAK

SEQ ID NO: 630760 - protein, 9 aa, Homo Sapiens
AQWGEPGQP

SEQ ID NO: 630761 - protein, 9 aa, Homo Sapiens
RHPKGPDPD

SEQ ID NO: 630762 - protein, 9 aa, Homo Sapiens
SNRKTKSRL

SEQ ID NO: 630763 - protein, 9 aa, Homo Sapiens
GSGREVLGD

SEQ ID NO: 630764 - protein, 9 aa, Homo Sapiens
ALVTAKVPS

SEQ ID NO: 630765 - protein, 9 aa, Homo Sapiens
SLSNLAAVG

SEQ ID NO: 630766 - protein, 9 aa, Homo Sapiens
AFSPRSLAW

SEQ ID NO: 630767 - protein, 9 aa, Homo Sapiens
HAEGYERGT

SEQ ID NO: 630768 - protein, 9 aa, Homo Sapiens
LLGNAVVLW

SEQ ID NO: 630769 - protein, 9 aa, Homo Sapiens
LWPTWHGDI

SEQ ID NO: 630770 - protein, 9 aa, Homo Sapiens
TELADGDIM

SEQ ID NO: 630771 - protein, 9 aa, Homo Sapiens
VSSLTILIR

SEQ ID NO: 630772 - protein, 9 aa, Homo Sapiens
TVEELCYQN

SEQ ID NO: 630773 - protein, 9 aa, Homo Sapiens
PENIIHAFP

SEQ ID NO: 630774 - protein, 9 aa, Homo Sapiens
GAAHEPSTP

SEQ ID NO: 630775 - protein, 9 aa, Homo Sapiens
NPGEYSVTA

SEQ ID NO: 630776 - protein, 9 aa, Homo Sapiens
CLRPRDARD

SEQ ID NO: 630777 - protein, 9 aa, Homo Sapiens
KGKKAEGAQ

SEQ ID NO: 630778 - protein, 9 aa, Homo Sapiens
RDPFTSLHE

SEQ ID NO: 630779 - protein, 9 aa, Homo Sapiens
GICVDEEKW

SEQ ID NO: 630780 - protein, 9 aa, Homo Sapiens
TTQEMVRPS

SEQ ID NO: 630781 - protein, 9 aa, Homo Sapiens
RFSPEVTGQ

SEQ ID NO: 630782 - protein, 9 aa, Homo Sapiens
ERYLPDCDY

SEQ ID NO: 630783 - protein, 9 aa, Homo Sapiens
CAHCSCCHQ

SEQ ID NO: 630784 - protein, 9 aa, Homo Sapiens
GPAGHGLPG

SEQ ID NO: 630785 - protein, 9 aa, Homo Sapiens
RLLTSGCDS

SEQ ID NO: 630786 - protein, 9 aa, Homo Sapiens
VTNPDSMAP

SEQ ID NO: 630787 - protein, 9 aa, Homo Sapiens
QYRKKSRCS

SEQ ID NO: 630788 - protein, 9 aa, Homo Sapiens
TCQQWSAQT

SEQ ID NO: 630789 - protein, 9 aa, Homo Sapiens
NLAKSLTVE

SEQ ID NO: 630790 - protein, 9 aa, Homo Sapiens
VEPPAQAPV

SEQ ID NO: 630791 - protein, 9 aa, Homo Sapiens
RTQQQQVLK

SEQ ID NO: 630792 - protein, 9 aa, Homo Sapiens
SRMEKYGNV

SEQ ID NO: 630793 - protein, 9 aa, Homo Sapiens
KTTFGSRHQ

SEQ ID NO: 630794 - protein, 9 aa, Homo Sapiens
RSFRSVRSQ

SEQ ID NO: 630795 - protein, 9 aa, Homo Sapiens
VTGQKILHH

SEQ ID NO: 630796 - protein, 9 aa, Homo Sapiens
DDLLLASSV

SEQ ID NO: 630797 - protein, 9 aa, Homo Sapiens
ISVKMSEAG

SEQ ID NO: 630798 - protein, 9 aa, Homo Sapiens
AHCSVVYLI

SEQ ID NO: 630799 - protein, 9 aa, Homo Sapiens
VFTKPSGRQ

SEQ ID NO: 630800 - protein, 9 aa, Homo Sapiens
IKRTQWEYP

SEQ ID NO: 630801 - protein, 9 aa, Homo Sapiens
KGETPSAIT

SEQ ID NO: 630802 - protein, 9 aa, Homo Sapiens
GNTVIPQAV

SEQ ID NO: 630803 - protein, 9 aa, Homo Sapiens
GVPNVILSV

SEQ ID NO: 630804 - protein, 9 aa, Homo Sapiens
LTTVEELCY

SEQ ID NO: 630805 - protein, 9 aa, Homo Sapiens
SSAAAGACA

SEQ ID NO: 630806 - protein, 9 aa, Homo Sapiens
LIIPFVIII

SEQ ID NO: 630807 - protein, 9 aa, Homo Sapiens
CDDEHHGAS

SEQ ID NO: 630808 - protein, 9 aa, Homo Sapiens
ELTRAGIAL

SEQ ID NO: 630809 - protein, 9 aa, Homo Sapiens
WLLYVFGQC

SEQ ID NO: 630810 - protein, 9 aa, Homo Sapiens
IQDFEFQSQ

SEQ ID NO: 630811 - protein, 9 aa, Homo Sapiens
EKKQAQEER

SEQ ID NO: 630812 - protein, 9 aa, Homo Sapiens
YLRFDAIAE

SEQ ID NO: 630813 - protein, 9 aa, Homo Sapiens
MVSNYLNWV

SEQ ID NO: 630814 - protein, 9 aa, Homo Sapiens
VTLSCADLP

SEQ ID NO: 630815 - protein, 9 aa, Homo Sapiens
KQAQEERKL

SEQ ID NO: 630816 - protein, 9 aa, Homo Sapiens
LIQFLVFLV

SEQ ID NO: 630817 - protein, 9 aa, Homo Sapiens
GMDPPFGDV

SEQ ID NO: 630818 - protein, 9 aa, Homo Sapiens
FSTGRFSLS

SEQ ID NO: 630819 - protein, 9 aa, Homo Sapiens
GLCRAWNQG

SEQ ID NO: 630820 - protein, 9 aa, Homo Sapiens
QHQLAVEQI

SEQ ID NO: 630821 - protein, 9 aa, Homo Sapiens
SPRLEEELA

SEQ ID NO: 630822 - protein, 9 aa, Homo Sapiens
QRRQRVCSR

SEQ ID NO: 630823 - protein, 9 aa, Homo Sapiens
VFFSWDSYL

SEQ ID NO: 630824 - protein, 9 aa, Homo Sapiens
RMVILRLLL

SEQ ID NO: 630825 - protein, 9 aa, Homo Sapiens
VVWVSAQAS

SEQ ID NO: 630826 - protein, 9 aa, Homo Sapiens
TDLLYALKT

SEQ ID NO: 630827 - protein, 9 aa, Homo Sapiens
GVIVGGGYN

SEQ ID NO: 630828 - protein, 9 aa, Homo Sapiens
VTSQVSNLN

SEQ ID NO: 630829 - protein, 9 aa, Homo Sapiens
QDEIASQCI

SEQ ID NO: 630830 - protein, 9 aa, Homo Sapiens
CYICPHIVK

SEQ ID NO: 630831 - protein, 9 aa, Homo Sapiens
VYCKLIPYL

SEQ ID NO: 630832 - protein, 9 aa, Homo Sapiens
LRATASLWK

SEQ ID NO: 630833 - protein, 9 aa, Homo Sapiens
RVHGHSSLH

SEQ ID NO: 630834 - protein, 9 aa, Homo Sapiens
EPPGHLQVE

SEQ ID NO: 630835 - protein, 9 aa, Homo Sapiens
LGCEVLNML

SEQ ID NO: 630836 - protein, 9 aa, Homo Sapiens
GPEGPACLP

SEQ ID NO: 630837 - protein, 9 aa, Homo Sapiens
ICPAPWGPR

SEQ ID NO: 630838 - protein, 9 aa, Homo Sapiens
RFCDRVQNA

SEQ ID NO: 630839 - protein, 9 aa, Homo Sapiens
CVRFIADHM

SEQ ID NO: 630840 - protein, 9 aa, Homo Sapiens
DRDQQEWER

SEQ ID NO: 630841 - protein, 9 aa, Homo Sapiens
AVEKVSIEK

SEQ ID NO: 630842 - protein, 9 aa, Homo Sapiens
VHHRIHVCD

SEQ ID NO: 630843 - protein, 9 aa, Homo Sapiens
EELPPQSCS

SEQ ID NO: 630844 - protein, 9 aa, Homo Sapiens
MLTAQQYEI

SEQ ID NO: 630845 - protein, 9 aa, Homo Sapiens
YTHNTNNLD

SEQ ID NO: 630846 - protein, 9 aa, Homo Sapiens
SASSSAILR

SEQ ID NO: 630847 - protein, 9 aa, Homo Sapiens
SSWPGELGP

SEQ ID NO: 630848 - protein, 9 aa, Homo Sapiens
IGILPALEV

SEQ ID NO: 630849 - protein, 9 aa, Homo Sapiens
LTLAVPKCQ

SEQ ID NO: 630850 - protein, 9 aa, Homo Sapiens
QIGQSLNVL

SEQ ID NO: 630851 - protein, 9 aa, Homo Sapiens
VEDNFSKLT

SEQ ID NO: 630852 - protein, 9 aa, Homo Sapiens
AGGPRPLAH

SEQ ID NO: 630853 - protein, 9 aa, Homo Sapiens
AWWASKVFA

SEQ ID NO: 630854 - protein, 9 aa, Homo Sapiens
SCPFRHCEP

SEQ ID NO: 630855 - protein, 9 aa, Homo Sapiens
KEWLKLGAI

SEQ ID NO: 630856 - protein, 9 aa, Homo Sapiens
STTVTECDQ

SEQ ID NO: 630857 - protein, 9 aa, Homo Sapiens
SLQALVAWL

SEQ ID NO: 630858 - protein, 9 aa, Homo Sapiens
IDSDGNGPL

SEQ ID NO: 630859 - protein, 9 aa, Homo Sapiens
EHFLLDPNS

SEQ ID NO: 630860 - protein, 9 aa, Homo Sapiens
AAHWVESFK

SEQ ID NO: 630861 - protein, 9 aa, Homo Sapiens
GSSRLAWPL

SEQ ID NO: 630862 - protein, 9 aa, Homo Sapiens
FNGHLGQRW

SEQ ID NO: 630863 - protein, 9 aa, Homo Sapiens
VTECDQDPV

SEQ ID NO: 630864 - protein, 9 aa, Homo Sapiens
ECDQDPVSL

SEQ ID NO: 630865 - protein, 9 aa, Homo Sapiens
LRPSLVQTQ

SEQ ID NO: 630866 - protein, 9 aa, Homo Sapiens
SLESVSFPS

SEQ ID NO: 630867 - protein, 9 aa, Homo Sapiens
LIIAGMHLF

SEQ ID NO: 630868 - protein, 9 aa, Homo Sapiens
FLVGLLPET

SEQ ID NO: 630869 - protein, 9 aa, Homo Sapiens
LSQRCPEQC

SEQ ID NO: 630870 - protein, 9 aa, Homo Sapiens
YSLMENGNI

SEQ ID NO: 630871 - protein, 9 aa, Homo Sapiens
QCLPFSNYF

SEQ ID NO: 630872 - protein, 9 aa, Homo Sapiens
LLRLSQKHS

SEQ ID NO: 630873 - protein, 9 aa, Homo Sapiens
EIGDLRTQQ

SEQ ID NO: 630874 - protein, 9 aa, Homo Sapiens
LRFKRLWSE

SEQ ID NO: 630875 - protein, 9 aa, Homo Sapiens
QITISQLSF

SEQ ID NO: 630876 - protein, 9 aa, Homo Sapiens
CQDLDTFEP

SEQ ID NO: 630877 - protein, 9 aa, Homo Sapiens
VGWLKMAEQ

SEQ ID NO: 630878 - protein, 9 aa, Homo Sapiens
FASVYTRKG

SEQ ID NO: 630879 - protein, 9 aa, Homo Sapiens
AVVMKFDAI

SEQ ID NO: 630880 - protein, 9 aa, Homo Sapiens
KRLWSEDCR

SEQ ID NO: 630881 - protein, 9 aa, Homo Sapiens
PTLAPLLDS

SEQ ID NO: 630882 - protein, 9 aa, Homo Sapiens
LQRLNACQW

SEQ ID NO: 630883 - protein, 9 aa, Homo Sapiens
WNPFVEDNF

SEQ ID NO: 630884 - protein, 9 aa, Homo Sapiens
TNKGKYFVT

SEQ ID NO: 630885 - protein, 9 aa, Homo Sapiens
APQHKKSVN

SEQ ID NO: 630886 - protein, 9 aa, Homo Sapiens
IVNPPQSAI

SEQ ID NO: 630887 - protein, 9 aa, Homo Sapiens
SPSQGQNTH

SEQ ID NO: 630888 - protein, 9 aa, Homo Sapiens
SPGCLEEGA

SEQ ID NO: 630889 - protein, 9 aa, Homo Sapiens
FHGRCYNCI

SEQ ID NO: 630890 - protein, 9 aa, Homo Sapiens
EIQQFPDTE

SEQ ID NO: 630891 - protein, 9 aa, Homo Sapiens
EEFQLFFAN

SEQ ID NO: 630892 - protein, 9 aa, Homo Sapiens
WRPLFTGGL

SEQ ID NO: 630893 - protein, 9 aa, Homo Sapiens
SLVHYAVTV

SEQ ID NO: 630894 - protein, 9 aa, Homo Sapiens
GFRMALKLH

SEQ ID NO: 630895 - protein, 9 aa, Homo Sapiens
ARGGRPSLI

SEQ ID NO: 630896 - protein, 9 aa, Homo Sapiens
ENSGGILEV

SEQ ID NO: 630897 - protein, 9 aa, Homo Sapiens
SVAFSPRSL

SEQ ID NO: 630898 - protein, 9 aa, Homo Sapiens
TLGYTKSPN

SEQ ID NO: 630899 - protein, 9 aa, Homo Sapiens
VGEAAQWGE

SEQ ID NO: 630900 - protein, 9 aa, Homo Sapiens
IPYLDPYIT

SEQ ID NO: 630901 - protein, 9 aa, Homo Sapiens
EEAHSSICW

SEQ ID NO: 630902 - protein, 9 aa, Homo Sapiens
VDGQTLWLL

SEQ ID NO: 630903 - protein, 9 aa, Homo Sapiens
KWRRTTLPI

SEQ ID NO: 630904 - protein, 9 aa, Homo Sapiens
IHHQRIQTG

SEQ ID NO: 630905 - protein, 9 aa, Homo Sapiens
TECDQDPVS

SEQ ID NO: 630906 - protein, 9 aa, Homo Sapiens
FPAFLEAIS

SEQ ID NO: 630907 - protein, 9 aa, Homo Sapiens
FQEIEKDIQ

SEQ ID NO: 630908 - protein, 9 aa, Homo Sapiens
QVEEAAVRA

SEQ ID NO: 630909 - protein, 9 aa, Homo Sapiens
YEAIKQQQK

SEQ ID NO: 630910 - protein, 9 aa, Homo Sapiens
EGDYAPLQQ

SEQ ID NO: 630911 - protein, 9 aa, Homo Sapiens
KKRDHILAV

SEQ ID NO: 630912 - protein, 9 aa, Homo Sapiens
DSSMGLLYP

SEQ ID NO: 630913 - protein, 9 aa, Homo Sapiens
TLERAYQMV

SEQ ID NO: 630914 - protein, 9 aa, Homo Sapiens
VQRRFFIGN

SEQ ID NO: 630915 - protein, 9 aa, Homo Sapiens
VVNVLYVNC

SEQ ID NO: 630916 - protein, 9 aa, Homo Sapiens
AEMVERKEE

SEQ ID NO: 630917 - protein, 9 aa, Homo Sapiens
VIAPLPDHT

SEQ ID NO: 630918 - protein, 9 aa, Homo Sapiens
AGQCDYACG

SEQ ID NO: 630919 - protein, 9 aa, Homo Sapiens
LPPLGSNVT

SEQ ID NO: 630920 - protein, 9 aa, Homo Sapiens
QPDMCVYRI

SEQ ID NO: 630921 - protein, 9 aa, Homo Sapiens
PQKTWYSAT

SEQ ID NO: 630922 - protein, 9 aa, Homo Sapiens
EGSRLASPS

SEQ ID NO: 630923 - protein, 9 aa, Homo Sapiens
IAYLKAKSE

SEQ ID NO: 630924 - protein, 9 aa, Homo Sapiens
SGDHYNEAY

SEQ ID NO: 630925 - protein, 9 aa, Homo Sapiens
NSQLHDFWR

SEQ ID NO: 630926 - protein, 9 aa, Homo Sapiens
LEDEWCAGF

SEQ ID NO: 630927 - protein, 9 aa, Homo Sapiens
ESVSFPSYS

SEQ ID NO: 630928 - protein, 9 aa, Homo Sapiens
KRCVICALI

SEQ ID NO: 630929 - protein, 9 aa, Homo Sapiens
GRSMAVRIQ

SEQ ID NO: 630930 - protein, 9 aa, Homo Sapiens
ARISLLTNR

SEQ ID NO: 630931 - protein, 9 aa, Homo Sapiens
NAYTLRCCP

SEQ ID NO: 630932 - protein, 9 aa, Homo Sapiens
WIMKPSTLP

SEQ ID NO: 630933 - protein, 9 aa, Homo Sapiens
IHSQWVDLH

SEQ ID NO: 630934 - protein, 9 aa, Homo Sapiens
NATTQEMVR

SEQ ID NO: 630935 - protein, 9 aa, Homo Sapiens
SSIAIQYTA

SEQ ID NO: 630936 - protein, 9 aa, Homo Sapiens
QLGGRLASV

SEQ ID NO: 630937 - protein, 9 aa, Homo Sapiens
NAIRGLQSS

SEQ ID NO: 630938 - protein, 9 aa, Homo Sapiens
IAELETVKA

SEQ ID NO: 630939 - protein, 9 aa, Homo Sapiens
LKAKAPTET

SEQ ID NO: 630940 - protein, 9 aa, Homo Sapiens
EHVCSCTEC

SEQ ID NO: 630941 - protein, 9 aa, Homo Sapiens
RSPLGSVMS

SEQ ID NO: 630942 - protein, 9 aa, Homo Sapiens
CLASWVYRK

SEQ ID NO: 630943 - protein, 9 aa, Homo Sapiens
LALDSKSLQ

SEQ ID NO: 630944 - protein, 9 aa, Homo Sapiens
GPLSTRRVV

SEQ ID NO: 630945 - protein, 9 aa, Homo Sapiens
KYFSGLLEV

SEQ ID NO: 630946 - protein, 9 aa, Homo Sapiens
ERERCSNLA

SEQ ID NO: 630947 - protein, 9 aa, Homo Sapiens
CLLLLHGYR

SEQ ID NO: 630948 - protein, 9 aa, Homo Sapiens
GLVVQAKVG

SEQ ID NO: 630949 - protein, 9 aa, Homo Sapiens
VAISQSLSN

SEQ ID NO: 630950 - protein, 9 aa, Homo Sapiens
SDFCLSRFL

SEQ ID NO: 630951 - protein, 9 aa, Homo Sapiens
TRMSDARKY

SEQ ID NO: 630952 - protein, 9 aa, Homo Sapiens
GRGSRPSLQ

SEQ ID NO: 630953 - protein, 9 aa, Homo Sapiens
QNKGKKAEG

SEQ ID NO: 630954 - protein, 9 aa, Homo Sapiens
SLLTNRVPP

SEQ ID NO: 630955 - protein, 9 aa, Homo Sapiens
RRKEWLKLG

SEQ ID NO: 630956 - protein, 9 aa, Homo Sapiens
RLVMYCAPL

SEQ ID NO: 630957 - protein, 9 aa, Homo Sapiens
AGKGSKGSQ

SEQ ID NO: 630958 - protein, 9 aa, Homo Sapiens
ATDHTDGSI

SEQ ID NO: 630959 - protein, 9 aa, Homo Sapiens
TADKWRTEE

SEQ ID NO: 630960 - protein, 9 aa, Homo Sapiens
AVYSWDKKN

SEQ ID NO: 630961 - protein, 9 aa, Homo Sapiens
LEDINYFGD

SEQ ID NO: 630962 - protein, 9 aa, Homo Sapiens
HLKNSILKN

SEQ ID NO: 630963 - protein, 9 aa, Homo Sapiens
WKEGLRLTG

SEQ ID NO: 630964 - protein, 9 aa, Homo Sapiens
WFMMKYPHM

SEQ ID NO: 630965 - protein, 9 aa, Homo Sapiens
AEDTAFDCA

SEQ ID NO: 630966 - protein, 9 aa, Homo Sapiens
VCDDEHHGA

SEQ ID NO: 630967 - protein, 9 aa, Homo Sapiens
QNCGAETGI

SEQ ID NO: 630968 - protein, 9 aa, Homo Sapiens
INNFICDHF

SEQ ID NO: 630969 - protein, 9 aa, Homo Sapiens
LSQLIGTGV

SEQ ID NO: 630970 - protein, 9 aa, Homo Sapiens
VMLITYIKI

SEQ ID NO: 630971 - protein, 9 aa, Homo Sapiens
LVSGGGYAG

SEQ ID NO: 630972 - protein, 9 aa, Homo Sapiens
TKPHAWFRI

SEQ ID NO: 630973 - protein, 9 aa, Homo Sapiens
WTVHLAPKL

SEQ ID NO: 630974 - protein, 9 aa, Homo Sapiens
NTAVRNRGD

SEQ ID NO: 630975 - protein, 9 aa, Homo Sapiens
TYSIRVYAF

SEQ ID NO: 630976 - protein, 9 aa, Homo Sapiens
GNVPLMLFL

SEQ ID NO: 630977 - protein, 9 aa, Homo Sapiens
VGNKALVSH

SEQ ID NO: 630978 - protein, 9 aa, Homo Sapiens
GPACLPGPP

SEQ ID NO: 630979 - protein, 9 aa, Homo Sapiens
LAYVFNGHL

SEQ ID NO: 630980 - protein, 9 aa, Homo Sapiens
IIHPSEGAS

SEQ ID NO: 630981 - protein, 9 aa, Homo Sapiens
EEPPMDSTK

SEQ ID NO: 630982 - protein, 9 aa, Homo Sapiens
LKNQNKNIE

SEQ ID NO: 630983 - protein, 9 aa, Homo Sapiens
VSKQAQLRA

SEQ ID NO: 630984 - protein, 9 aa, Homo Sapiens
PEIAVPELY

SEQ ID NO: 630985 - protein, 9 aa, Homo Sapiens
LLGDKIAIS

SEQ ID NO: 630986 - protein, 9 aa, Homo Sapiens
PGESGRPVQ

SEQ ID NO: 630987 - protein, 9 aa, Homo Sapiens
IMNNEKMLS

SEQ ID NO: 630988 - protein, 9 aa, Homo Sapiens
GLLGNAVVL

SEQ ID NO: 630989 - protein, 9 aa, Homo Sapiens
NQVAISQSL

SEQ ID NO: 630990 - protein, 9 aa, Homo Sapiens
IEARNTGNM

SEQ ID NO: 630991 - protein, 9 aa, Homo Sapiens
IHCQSLRFH

SEQ ID NO: 630992 - protein, 9 aa, Homo Sapiens
FHTLKLVSR

SEQ ID NO: 630993 - protein, 9 aa, Homo Sapiens
AISRLKDRL

SEQ ID NO: 630994 - protein, 9 aa, Homo Sapiens
KERERCSNL

SEQ ID NO: 630995 - protein, 9 aa, Homo Sapiens
LSPSEFKII

SEQ ID NO: 630996 - protein, 9 aa, Homo Sapiens
HYAVTVDYN

SEQ ID NO: 630997 - protein, 9 aa, Homo Sapiens
TEPGGGKVS

SEQ ID NO: 630998 - protein, 9 aa, Homo Sapiens
MERHHFAKA

SEQ ID NO: 630999 - protein, 9 aa, Homo Sapiens
GKTAVEDVD

SEQ ID NO: 631000 - protein, 9 aa, Homo Sapiens
RLSAHVWRP

SEQ ID NO: 631001 - protein, 9 aa, Homo Sapiens
EPHRFNDSE

SEQ ID NO: 631002 - protein, 9 aa, Homo Sapiens
MVLDEDSRS

SEQ ID NO: 631003 - protein, 9 aa, Homo Sapiens
CDQDPVSLH

SEQ ID NO: 631004 - protein, 9 aa, Homo Sapiens
SKDVWVYDS

SEQ ID NO: 631005 - protein, 9 aa, Homo Sapiens
RSRYNLCIS

SEQ ID NO: 631006 - protein, 9 aa, Homo Sapiens
WNALVTAKV

SEQ ID NO: 631007 - protein, 9 aa, Homo Sapiens
VGAHITQPC

SEQ ID NO: 631008 - protein, 9 aa, Homo Sapiens
SHTELVLGA

SEQ ID NO: 631009 - protein, 9 aa, Homo Sapiens
WRTEERLQC

SEQ ID NO: 631010 - protein, 9 aa, Homo Sapiens
VNECAEGSH

SEQ ID NO: 631011 - protein, 9 aa, Homo Sapiens
LVYVIEDGK

SEQ ID NO: 631012 - protein, 9 aa, Homo Sapiens
LTVVMQRPV

SEQ ID NO: 631013 - protein, 9 aa, Homo Sapiens
DNLSGADIR

SEQ ID NO: 631014 - protein, 9 aa, Homo Sapiens
CSVSRDPFT

SEQ ID NO: 631015 - protein, 9 aa, Homo Sapiens
ETLKQGVLE

SEQ ID NO: 631016 - protein, 9 aa, Homo Sapiens
LASVSKDTD

SEQ ID NO: 631017 - protein, 9 aa, Homo Sapiens
YAYAVATWD

SEQ ID NO: 631018 - protein, 9 aa, Homo Sapiens
KYHTEQSLR

SEQ ID NO: 631019 - protein, 9 aa, Homo Sapiens
LPDCPIVLK

SEQ ID NO: 631020 - protein, 9 aa, Homo Sapiens
AARPTMYPS

SEQ ID NO: 631021 - protein, 9 aa, Homo Sapiens
PQRSAPSQS

SEQ ID NO: 631022 - protein, 9 aa, Homo Sapiens
RDLGIRLQA

SEQ ID NO: 631023 - protein, 9 aa, Homo Sapiens
LYGKTAKMY

SEQ ID NO: 631024 - protein, 9 aa, Homo Sapiens
PLDYRSPFL

SEQ ID NO: 631025 - protein, 9 aa, Homo Sapiens
VCPTGWQVQ

SEQ ID NO: 631026 - protein, 9 aa, Homo Sapiens
DARYLYDQL

SEQ ID NO: 631027 - protein, 9 aa, Homo Sapiens
TVDTTHMEN

SEQ ID NO: 631028 - protein, 9 aa, Homo Sapiens
LSKAENKIR

SEQ ID NO: 631029 - protein, 9 aa, Homo Sapiens
KSAEAWEAT

SEQ ID NO: 631030 - protein, 9 aa, Homo Sapiens
SVTLYIIGG

SEQ ID NO: 631031 - protein, 9 aa, Homo Sapiens
SIAGIRQAF

SEQ ID NO: 631032 - protein, 9 aa, Homo Sapiens
KRSPLGSVM

SEQ ID NO: 631033 - protein, 9 aa, Homo Sapiens
WVTCWGYTR

SEQ ID NO: 631034 - protein, 9 aa, Homo Sapiens
LTVTLSCAD

SEQ ID NO: 631035 - protein, 9 aa, Homo Sapiens
CHILIRNHR

SEQ ID NO: 631036 - protein, 9 aa, Homo Sapiens
INNLSTPLE

SEQ ID NO: 631037 - protein, 9 aa, Homo Sapiens
KISNVRKIT

SEQ ID NO: 631038 - protein, 9 aa, Homo Sapiens
IKWRRTTLP

SEQ ID NO: 631039 - protein, 9 aa, Homo Sapiens
VHQLFHPWG

SEQ ID NO: 631040 - protein, 9 aa, Homo Sapiens
RHQDMFHDL

SEQ ID NO: 631041 - protein, 9 aa, Homo Sapiens
RIKNVVLVV

SEQ ID NO: 631042 - protein, 9 aa, Homo Sapiens
IKTRGQKVT

SEQ ID NO: 631043 - protein, 9 aa, Homo Sapiens
VPVPPLMGS

SEQ ID NO: 631044 - protein, 9 aa, Homo Sapiens
LCQLVGLNS

SEQ ID NO: 631045 - protein, 9 aa, Homo Sapiens
LSQKHSTVQ

SEQ ID NO: 631046 - protein, 9 aa, Homo Sapiens
IMKPSTLPP

SEQ ID NO: 631047 - protein, 9 aa, Homo Sapiens
RRRRILICC

SEQ ID NO: 631048 - protein, 9 aa, Homo Sapiens
SQVKGQEVR

SEQ ID NO: 631049 - protein, 9 aa, Homo Sapiens
RTTLCQWKI

SEQ ID NO: 631050 - protein, 9 aa, Homo Sapiens
LLDLKQAQH

SEQ ID NO: 631051 - protein, 9 aa, Homo Sapiens
IKLDKVLQQ

SEQ ID NO: 631052 - protein, 9 aa, Homo Sapiens
LYNHQQLGR

SEQ ID NO: 631053 - protein, 9 aa, Homo Sapiens
ALSSIAIQY

SEQ ID NO: 631054 - protein, 9 aa, Homo Sapiens
TDNFVRVLC

SEQ ID NO: 631055 - protein, 9 aa, Homo Sapiens
LKQQHQLAV

SEQ ID NO: 631056 - protein, 9 aa, Homo Sapiens
EYCDRIPEL

SEQ ID NO: 631057 - protein, 9 aa, Homo Sapiens
HSPIKEKSR

SEQ ID NO: 631058 - protein, 9 aa, Homo Sapiens
ECPEPGRSP

SEQ ID NO: 631059 - protein, 9 aa, Homo Sapiens
FSPVCLRAF

SEQ ID NO: 631060 - protein, 9 aa, Homo Sapiens
TSSAFVELS

SEQ ID NO: 631061 - protein, 9 aa, Homo Sapiens
FFYVGWLKM

SEQ ID NO: 631062 - protein, 9 aa, Homo Sapiens
CKVSDFCLS

SEQ ID NO: 631063 - protein, 9 aa, Homo Sapiens
QAGLGQLKA

SEQ ID NO: 631064 - protein, 9 aa, Homo Sapiens
SVFCEKTLF

SEQ ID NO: 631065 - protein, 9 aa, Homo Sapiens
CFRIMNNEK

SEQ ID NO: 631066 - protein, 9 aa, Homo Sapiens
LDRLDRDQQ

SEQ ID NO: 631067 - protein, 9 aa, Homo Sapiens
FKKAREEGS

SEQ ID NO: 631068 - protein, 9 aa, Homo Sapiens
PPCTEHIKR

SEQ ID NO: 631069 - protein, 9 aa, Homo Sapiens
DSEDSQYND

SEQ ID NO: 631070 - protein, 9 aa, Homo Sapiens
KSCVFLECE

SEQ ID NO: 631071 - protein, 9 aa, Homo Sapiens
LVAFVISVV

SEQ ID NO: 631072 - protein, 9 aa, Homo Sapiens
SDGVTPLIV

SEQ ID NO: 631073 - protein, 9 aa, Homo Sapiens
SPSEFKIIL

SEQ ID NO: 631074 - protein, 9 aa, Homo Sapiens
SVTTSQLEC

SEQ ID NO: 631075 - protein, 9 aa, Homo Sapiens
SKAENKIRS

SEQ ID NO: 631076 - protein, 9 aa, Homo Sapiens
DITFEHIMS

SEQ ID NO: 631077 - protein, 9 aa, Homo Sapiens
VEDVDSMDG

SEQ ID NO: 631078 - protein, 9 aa, Homo Sapiens
ISRENRSFS

SEQ ID NO: 631079 - protein, 9 aa, Homo Sapiens
TPVHFHSPP

SEQ ID NO: 631080 - protein, 9 aa, Homo Sapiens
LLAADGTAT

SEQ ID NO: 631081 - protein, 9 aa, Homo Sapiens
SSSQVATRF

SEQ ID NO: 631082 - protein, 9 aa, Homo Sapiens
DARYGQRAQ

SEQ ID NO: 631083 - protein, 9 aa, Homo Sapiens
CVHFLRDVM

SEQ ID NO: 631084 - protein, 9 aa, Homo Sapiens
TPCFSLSNF

SEQ ID NO: 631085 - protein, 9 aa, Homo Sapiens
SSPGHWKHQ

SEQ ID NO: 631086 - protein, 9 aa, Homo Sapiens
MERNNGSFL

SEQ ID NO: 631087 - protein, 9 aa, Homo Sapiens
DKEGIPPEQ

SEQ ID NO: 631088 - protein, 9 aa, Homo Sapiens
ILGEDTEIC

SEQ ID NO: 631089 - protein, 9 aa, Homo Sapiens
IKNVVLVVP

SEQ ID NO: 631090 - protein, 9 aa, Homo Sapiens
LSRVHNDHS

SEQ ID NO: 631091 - protein, 9 aa, Homo Sapiens
PFVPRDVQR

SEQ ID NO: 631092 - protein, 9 aa, Homo Sapiens
SGPRKDGSR

SEQ ID NO: 631093 - protein, 9 aa, Homo Sapiens
VDRRWDGVA

SEQ ID NO: 631094 - protein, 9 aa, Homo Sapiens
EQMLSHVTA

SEQ ID NO: 631095 - protein, 9 aa, Homo Sapiens
NMAHSSTHS

SEQ ID NO: 631096 - protein, 9 aa, Homo Sapiens
APLLDSEQH

SEQ ID NO: 631097 - protein, 9 aa, Homo Sapiens
TVPSTGPSQ

SEQ ID NO: 631098 - protein, 9 aa, Homo Sapiens
VEVVFKCEN

SEQ ID NO: 631099 - protein, 9 aa, Homo Sapiens
QIPMKTQQP

SEQ ID NO: 631100 - protein, 9 aa, Homo Sapiens
VARMKEAMA

SEQ ID NO: 631101 - protein, 9 aa, Homo Sapiens
AGGGGGTRP

SEQ ID NO: 631102 - protein, 9 aa, Homo Sapiens
RHQDACETM

SEQ ID NO: 631103 - protein, 9 aa, Homo Sapiens
FGQYTGYSP

SEQ ID NO: 631104 - protein, 9 aa, Homo Sapiens
TVKDIVTAF

SEQ ID NO: 631105 - protein, 9 aa, Homo Sapiens
TKCPEPCPP

SEQ ID NO: 631106 - protein, 9 aa, Homo Sapiens
HIEEHDKVL

SEQ ID NO: 631107 - protein, 9 aa, Homo Sapiens
ITFRIPVSR

SEQ ID NO: 631108 - protein, 9 aa, Homo Sapiens
AVATWDALL

SEQ ID NO: 631109 - protein, 9 aa, Homo Sapiens
GMFISGVLG

SEQ ID NO: 631110 - protein, 9 aa, Homo Sapiens
FTQRALVAM

SEQ ID NO: 631111 - protein, 9 aa, Homo Sapiens
WDKNATDED

SEQ ID NO: 631112 - protein, 9 aa, Homo Sapiens
YMAFGNPLL

SEQ ID NO: 631113 - protein, 9 aa, Homo Sapiens
NPFPRSNST

SEQ ID NO: 631114 - protein, 9 aa, Homo Sapiens
ISGYSESKK

SEQ ID NO: 631115 - protein, 9 aa, Homo Sapiens
ELCPRTCHL

SEQ ID NO: 631116 - protein, 9 aa, Homo Sapiens
SQLELSQLI

SEQ ID NO: 631117 - protein, 9 aa, Homo Sapiens
QLRSNNMGV

SEQ ID NO: 631118 - protein, 9 aa, Homo Sapiens
AKDSKFKIP

SEQ ID NO: 631119 - protein, 9 aa, Homo Sapiens
AVISLGSDV

SEQ ID NO: 631120 - protein, 9 aa, Homo Sapiens
SKETVVFYE

SEQ ID NO: 631121 - protein, 9 aa, Homo Sapiens
TLAAATCEY

SEQ ID NO: 631122 - protein, 9 aa, Homo Sapiens
YEEVGLPLL

SEQ ID NO: 631123 - protein, 9 aa, Homo Sapiens
SREGPPKTD

SEQ ID NO: 631124 - protein, 9 aa, Homo Sapiens
LATDHTDGS

SEQ ID NO: 631125 - protein, 9 aa, Homo Sapiens
VLGSGFRSV

SEQ ID NO: 631126 - protein, 9 aa, Homo Sapiens
YCFYLEDEW

SEQ ID NO: 631127 - protein, 9 aa, Homo Sapiens
VVVAPTGIP

SEQ ID NO: 631128 - protein, 9 aa, Homo Sapiens
KQLEKTFNC

SEQ ID NO: 631129 - protein, 9 aa, Homo Sapiens
HVWRPSTDP

SEQ ID NO: 631130 - protein, 9 aa, Homo Sapiens
DFRLATVKS

SEQ ID NO: 631131 - protein, 9 aa, Homo Sapiens
TICGTQLQN

SEQ ID NO: 631132 - protein, 9 aa, Homo Sapiens
RVGGQRALL

SEQ ID NO: 631133 - protein, 9 aa, Homo Sapiens
PCKHLSDAL

SEQ ID NO: 631134 - protein, 9 aa, Homo Sapiens
DSEQHRHRL

SEQ ID NO: 631135 - protein, 9 aa, Homo Sapiens
ATGAEIDKT

SEQ ID NO: 631136 - protein, 9 aa, Homo Sapiens
YQELIQAKK

SEQ ID NO: 631137 - protein, 9 aa, Homo Sapiens
DGKDTIRGH

SEQ ID NO: 631138 - protein, 9 aa, Homo Sapiens
GAESSQEES

SEQ ID NO: 631139 - protein, 9 aa, Homo Sapiens
GALIRQNWV

SEQ ID NO: 631140 - protein, 9 aa, Homo Sapiens
VNLLGRNSF

SEQ ID NO: 631141 - protein, 9 aa, Homo Sapiens
GPGLQGFLC

SEQ ID NO: 631142 - protein, 9 aa, Homo Sapiens
EAPIPGSLL

SEQ ID NO: 631143 - protein, 9 aa, Homo Sapiens
MAAYEDVLV

SEQ ID NO: 631144 - protein, 9 aa, Homo Sapiens
WVVDLLAAA

SEQ ID NO: 631145 - protein, 9 aa, Homo Sapiens
FHPWGIAVH

SEQ ID NO: 631146 - protein, 9 aa, Homo Sapiens
QSFSRRTTP

SEQ ID NO: 631147 - protein, 9 aa, Homo Sapiens
ALVDGQTLW

SEQ ID NO: 631148 - protein, 9 aa, Homo Sapiens
SSSMLLGDD

SEQ ID NO: 631149 - protein, 9 aa, Homo Sapiens
SGAPWRHLF

SEQ ID NO: 631150 - protein, 9 aa, Homo Sapiens
HHGASCMLG

SEQ ID NO: 631151 - protein, 9 aa, Homo Sapiens
VMDSSRPQA

SEQ ID NO: 631152 - protein, 9 aa, Homo Sapiens
SEQVMDYIV

SEQ ID NO: 631153 - protein, 9 aa, Homo Sapiens
STSNVSETR

SEQ ID NO: 631154 - protein, 9 aa, Homo Sapiens
AYFFSFRKQ

SEQ ID NO: 631155 - protein, 9 aa, Homo Sapiens
PHMQAPSGM

SEQ ID NO: 631156 - protein, 9 aa, Homo Sapiens
KLPLDYRSP

SEQ ID NO: 631157 - protein, 9 aa, Homo Sapiens
AFTLIIITS

SEQ ID NO: 631158 - protein, 9 aa, Homo Sapiens
STDCLVMAW

SEQ ID NO: 631159 - protein, 9 aa, Homo Sapiens
LIILTALQP

SEQ ID NO: 631160 - protein, 9 aa, Homo Sapiens
FDCDKSLLK

SEQ ID NO: 631161 - protein, 9 aa, Homo Sapiens
SVHLRREVE

SEQ ID NO: 631162 - protein, 9 aa, Homo Sapiens
ENIVGTVTL

SEQ ID NO: 631163 - protein, 9 aa, Homo Sapiens
VWVYDSLHE

SEQ ID NO: 631164 - protein, 9 aa, Homo Sapiens
EKDIQDFEF

SEQ ID NO: 631165 - protein, 9 aa, Homo Sapiens
EARNTGNMF

SEQ ID NO: 631166 - protein, 9 aa, Homo Sapiens
YGKTAKMYR

SEQ ID NO: 631167 - protein, 9 aa, Homo Sapiens
YCMFLKHLN

SEQ ID NO: 631168 - protein, 9 aa, Homo Sapiens
QAKVGLSGL

SEQ ID NO: 631169 - protein, 9 aa, Homo Sapiens
AYVFNGHLG

SEQ ID NO: 631170 - protein, 9 aa, Homo Sapiens
DGLPYCEAY

SEQ ID NO: 631171 - protein, 9 aa, Homo Sapiens
NLTSWFTSK

SEQ ID NO: 631172 - protein, 9 aa, Homo Sapiens
NKGKKAEGA

SEQ ID NO: 631173 - protein, 9 aa, Homo Sapiens
DLPSEPRLG

SEQ ID NO: 631174 - protein, 9 aa, Homo Sapiens
RQLERLVAD

SEQ ID NO: 631175 - protein, 9 aa, Homo Sapiens
SRASTITSV

SEQ ID NO: 631176 - protein, 9 aa, Homo Sapiens
DPIRKPEVL

SEQ ID NO: 631177 - protein, 9 aa, Homo Sapiens
ILGCLYESQ

SEQ ID NO: 631178 - protein, 9 aa, Homo Sapiens
FDSTCEHCQ

SEQ ID NO: 631179 - protein, 9 aa, Homo Sapiens
PCGSGFYKS

SEQ ID NO: 631180 - protein, 9 aa, Homo Sapiens
LYVGQYVHS

SEQ ID NO: 631181 - protein, 9 aa, Homo Sapiens
DIQKGYVSS

SEQ ID NO: 631182 - protein, 9 aa, Homo Sapiens
CRAAAPRSE

SEQ ID NO: 631183 - protein, 9 aa, Homo Sapiens
LLFLIIRHR

SEQ ID NO: 631184 - protein, 9 aa, Homo Sapiens
LKRIMKVLQ

SEQ ID NO: 631185 - protein, 9 aa, Homo Sapiens
SEEDVVWLT

SEQ ID NO: 631186 - protein, 9 aa, Homo Sapiens
AGYGAGVVG

SEQ ID NO: 631187 - protein, 9 aa, Homo Sapiens
QMERNNGSF

SEQ ID NO: 631188 - protein, 9 aa, Homo Sapiens
HSGLWPTWH

SEQ ID NO: 631189 - protein, 9 aa, Homo Sapiens
TIAYRPLLF

SEQ ID NO: 631190 - protein, 9 aa, Homo Sapiens
KAPTETSPG

SEQ ID NO: 631191 - protein, 9 aa, Homo Sapiens
AEDCIQAWA

SEQ ID NO: 631192 - protein, 9 aa, Homo Sapiens
LTNYLMLLL

SEQ ID NO: 631193 - protein, 9 aa, Homo Sapiens
PRPDSWSLR

SEQ ID NO: 631194 - protein, 9 aa, Homo Sapiens
AQHPLGSKH

SEQ ID NO: 631195 - protein, 9 aa, Homo Sapiens
KKTRCREFV

SEQ ID NO: 631196 - protein, 9 aa, Homo Sapiens
AENSLGPNA

SEQ ID NO: 631197 - protein, 9 aa, Homo Sapiens
DMSGWNPFV

SEQ ID NO: 631198 - protein, 9 aa, Homo Sapiens
NVCSCVSVV

SEQ ID NO: 631199 - protein, 9 aa, Homo Sapiens
TYLATCQQY

SEQ ID NO: 631200 - protein, 9 aa, Homo Sapiens
IKLTYFLPV

SEQ ID NO: 631201 - protein, 9 aa, Homo Sapiens
RSEAAPVCC

SEQ ID NO: 631202 - protein, 9 aa, Homo Sapiens
VADFPHPSD

SEQ ID NO: 631203 - protein, 9 aa, Homo Sapiens
MSGMRSVQW

SEQ ID NO: 631204 - protein, 9 aa, Homo Sapiens
LIVFLHLAD

SEQ ID NO: 631205 - protein, 9 aa, Homo Sapiens
VNEAGHRKD

SEQ ID NO: 631206 - protein, 9 aa, Homo Sapiens
LVSCAQAAG

SEQ ID NO: 631207 - protein, 9 aa, Homo Sapiens
NEIHSLGGG

SEQ ID NO: 631208 - protein, 9 aa, Homo Sapiens
SAVEKVSIE

SEQ ID NO: 631209 - protein, 9 aa, Homo Sapiens
CGKRFSLSS

SEQ ID NO: 631210 - protein, 9 aa, Homo Sapiens
EAACRIPSV

SEQ ID NO: 631211 - protein, 9 aa, Homo Sapiens
DLNDEKNWG

SEQ ID NO: 631212 - protein, 9 aa, Homo Sapiens
LFFANGVLN

SEQ ID NO: 631213 - protein, 9 aa, Homo Sapiens
IGPPGSPYM

SEQ ID NO: 631214 - protein, 9 aa, Homo Sapiens
ITDQSLDEE

SEQ ID NO: 631215 - protein, 9 aa, Homo Sapiens
SRLDDKEMV

SEQ ID NO: 631216 - protein, 9 aa, Homo Sapiens
LSECPEPGR

SEQ ID NO: 631217 - protein, 9 aa, Homo Sapiens
GAVAGYVSV

SEQ ID NO: 631218 - protein, 9 aa, Homo Sapiens
IQQFPDTEN

SEQ ID NO: 631219 - protein, 9 aa, Homo Sapiens
LRRVRMSAV

SEQ ID NO: 631220 - protein, 9 aa, Homo Sapiens
RCWVTCWGY

SEQ ID NO: 631221 - protein, 9 aa, Homo Sapiens
GTAAFSKGL

SEQ ID NO: 631222 - protein, 9 aa, Homo Sapiens
ECGKAFGDC

SEQ ID NO: 631223 - protein, 9 aa, Homo Sapiens
LPDHTKSIY

SEQ ID NO: 631224 - protein, 9 aa, Homo Sapiens
GGSPSMSSS

SEQ ID NO: 631225 - protein, 9 aa, Homo Sapiens
KVSIEKIRF

SEQ ID NO: 631226 - protein, 9 aa, Homo Sapiens
IGAYFPSLS

SEQ ID NO: 631227 - protein, 9 aa, Homo Sapiens
AHKAGLAVD

SEQ ID NO: 631228 - protein, 9 aa, Homo Sapiens
CCNFSSRMQ

SEQ ID NO: 631229 - protein, 9 aa, Homo Sapiens
MKDKHSSDA

SEQ ID NO: 631230 - protein, 9 aa, Homo Sapiens
SGLDGQWPD

SEQ ID NO: 631231 - protein, 9 aa, Homo Sapiens
SRMLFAGFP

SEQ ID NO: 631232 - protein, 9 aa, Homo Sapiens
PLQQVDPVL

SEQ ID NO: 631233 - protein, 9 aa, Homo Sapiens
PIRKPEVLT

SEQ ID NO: 631234 - protein, 9 aa, Homo Sapiens
LGYLRFDAI

SEQ ID NO: 631235 - protein, 9 aa, Homo Sapiens
TSSLELMAL

SEQ ID NO: 631236 - protein, 9 aa, Homo Sapiens
SGDSQPSPY

SEQ ID NO: 631237 - protein, 9 aa, Homo Sapiens
QFRRFRQPQ

SEQ ID NO: 631238 - protein, 9 aa, Homo Sapiens
NYFPTPADL

SEQ ID NO: 631239 - protein, 9 aa, Homo Sapiens
QGSIAFDNV

SEQ ID NO: 631240 - protein, 9 aa, Homo Sapiens
VRCSQSPPL

SEQ ID NO: 631241 - protein, 9 aa, Homo Sapiens
SASQDGKDT

SEQ ID NO: 631242 - protein, 9 aa, Homo Sapiens
QRDLHKIMQ

SEQ ID NO: 631243 - protein, 9 aa, Homo Sapiens
GREAIYPLL

SEQ ID NO: 631244 - protein, 9 aa, Homo Sapiens
KPLVWKPGD

SEQ ID NO: 631245 - protein, 9 aa, Homo Sapiens
VVGSWSYSQ

SEQ ID NO: 631246 - protein, 9 aa, Homo Sapiens
SAWAGPCGG

SEQ ID NO: 631247 - protein, 9 aa, Homo Sapiens
VTDLGLVYE

SEQ ID NO: 631248 - protein, 9 aa, Homo Sapiens
VVSFSSHDP

SEQ ID NO: 631249 - protein, 9 aa, Homo Sapiens
EEIRPNEVY

SEQ ID NO: 631250 - protein, 9 aa, Homo Sapiens
RTSAFPWEE

SEQ ID NO: 631251 - protein, 9 aa, Homo Sapiens
LTKPHAWFR

SEQ ID NO: 631252 - protein, 9 aa, Homo Sapiens
EKKTKVSQS

SEQ ID NO: 631253 - protein, 9 aa, Homo Sapiens
VWSGLDGQW

SEQ ID NO: 631254 - protein, 9 aa, Homo Sapiens
SIHEEAPSG

SEQ ID NO: 631255 - protein, 9 aa, Homo Sapiens
EGPSSTMVR

SEQ ID NO: 631256 - protein, 9 aa, Homo Sapiens
DHINAVIPG

SEQ ID NO: 631257 - protein, 9 aa, Homo Sapiens
RRDEGEEAE

SEQ ID NO: 631258 - protein, 9 aa, Homo Sapiens
LEGHTEIDH

SEQ ID NO: 631259 - protein, 9 aa, Homo Sapiens
LQTTLAGME

SEQ ID NO: 631260 - protein, 9 aa, Homo Sapiens
TLGFERLLT

SEQ ID NO: 631261 - protein, 9 aa, Homo Sapiens
VLIIFKNKG

SEQ ID NO: 631262 - protein, 9 aa, Homo Sapiens
LRPRDARDG

SEQ ID NO: 631263 - protein, 9 aa, Homo Sapiens
QKGYVSSVR

SEQ ID NO: 631264 - protein, 9 aa, Homo Sapiens
HITSRDLGS

SEQ ID NO: 631265 - protein, 9 aa, Homo Sapiens
KGGVACYCR

SEQ ID NO: 631266 - protein, 9 aa, Homo Sapiens
FKRLWSEDC

SEQ ID NO: 631267 - protein, 9 aa, Homo Sapiens
CAHGEGSMA

SEQ ID NO: 631268 - protein, 9 aa, Homo Sapiens
TSFCGYRSF

SEQ ID NO: 631269 - protein, 9 aa, Homo Sapiens
LSEKLSKAE

SEQ ID NO: 631270 - protein, 9 aa, Homo Sapiens
CSVVYLIEF

SEQ ID NO: 631271 - protein, 9 aa, Homo Sapiens
HCIFENIVG

SEQ ID NO: 631272 - protein, 9 aa, Homo Sapiens
SVSFPSYSA

SEQ ID NO: 631273 - protein, 9 aa, Homo Sapiens
DEGEEAEEW

SEQ ID NO: 631274 - protein, 9 aa, Homo Sapiens
GRVTKRDIK

SEQ ID NO: 631275 - protein, 9 aa, Homo Sapiens
VDTSSLISA

SEQ ID NO: 631276 - protein, 9 aa, Homo Sapiens
THMENVSPR

SEQ ID NO: 631277 - protein, 9 aa, Homo Sapiens
TLLCLSWGP

SEQ ID NO: 631278 - protein, 9 aa, Homo Sapiens
IKEKSRKRS

SEQ ID NO: 631279 - protein, 9 aa, Homo Sapiens
LQKKQLLLL

SEQ ID NO: 631280 - protein, 9 aa, Homo Sapiens
VSSFNLPFP

SEQ ID NO: 631281 - protein, 9 aa, Homo Sapiens
FVISVVVIL

SEQ ID NO: 631282 - protein, 9 aa, Homo Sapiens
QAQLRAPTK

SEQ ID NO: 631283 - protein, 9 aa, Homo Sapiens
PFGSICTGT

SEQ ID NO: 631284 - protein, 9 aa, Homo Sapiens
LCYQNEFHG

SEQ ID NO: 631285 - protein, 9 aa, Homo Sapiens
IATLQLFMD

SEQ ID NO: 631286 - protein, 9 aa, Homo Sapiens
STLSADDLE

SEQ ID NO: 631287 - protein, 9 aa, Homo Sapiens
EYSVTAHAE

SEQ ID NO: 631288 - protein, 9 aa, Homo Sapiens
WASKVFANS

SEQ ID NO: 631289 - protein, 9 aa, Homo Sapiens
LSVYPVAGG

SEQ ID NO: 631290 - protein, 9 aa, Homo Sapiens
SSAILRVLG

SEQ ID NO: 631291 - protein, 9 aa, Homo Sapiens
FKRKMGARD

SEQ ID NO: 631292 - protein, 9 aa, Homo Sapiens
TYDWNALVT

SEQ ID NO: 631293 - protein, 9 aa, Homo Sapiens
PGCGKGVQA

SEQ ID NO: 631294 - protein, 9 aa, Homo Sapiens
MLTSVSVAR

SEQ ID NO: 631295 - protein, 9 aa, Homo Sapiens
NRRTTSSHC

SEQ ID NO: 631296 - protein, 9 aa, Homo Sapiens
QEDQNKPYW

SEQ ID NO: 631297 - protein, 9 aa, Homo Sapiens
PWKKQENGN

SEQ ID NO: 631298 - protein, 9 aa, Homo Sapiens
LKRWEAIRQ

SEQ ID NO: 631299 - protein, 9 aa, Homo Sapiens
GSVPFEEMI

SEQ ID NO: 631300 - protein, 9 aa, Homo Sapiens
SVNEAGHRK

SEQ ID NO: 631301 - protein, 9 aa, Homo Sapiens
SVKKGETPS

SEQ ID NO: 631302 - protein, 9 aa, Homo Sapiens
IFVYIGIVA

SEQ ID NO: 631303 - protein, 9 aa, Homo Sapiens
PTWHSECNC

SEQ ID NO: 631304 - protein, 9 aa, Homo Sapiens
PGQAKIACG

SEQ ID NO: 631305 - protein, 9 aa, Homo Sapiens
TESEPLLGA

SEQ ID NO: 631306 - protein, 9 aa, Homo Sapiens
VYCWCVTPD

SEQ ID NO: 631307 - protein, 9 aa, Homo Sapiens
RSRLQCIED

SEQ ID NO: 631308 - protein, 9 aa, Homo Sapiens
LIVEVWPGQ

SEQ ID NO: 631309 - protein, 9 aa, Homo Sapiens
LPFFLQMPF

SEQ ID NO: 631310 - protein, 9 aa, Homo Sapiens
RRLVMYCAP

SEQ ID NO: 631311 - protein, 9 aa, Homo Sapiens
SVEARDSGL

SEQ ID NO: 631312 - protein, 9 aa, Homo Sapiens
LRAPPKSSQ

SEQ ID NO: 631313 - protein, 9 aa, Homo Sapiens
RAVCRGGSL

SEQ ID NO: 631314 - protein, 9 aa, Homo Sapiens
VEEFPETSL

SEQ ID NO: 631315 - protein, 9 aa, Homo Sapiens
ADEAWVLTE

SEQ ID NO: 631316 - protein, 9 aa, Homo Sapiens
KESWFERIV

SEQ ID NO: 631317 - protein, 9 aa, Homo Sapiens
AASSISLPV

SEQ ID NO: 631318 - protein, 9 aa, Homo Sapiens
HFVIVSASY

SEQ ID NO: 631319 - protein, 9 aa, Homo Sapiens
ARFGAHHLP

SEQ ID NO: 631320 - protein, 9 aa, Homo Sapiens
TVHPQQEDQ

SEQ ID NO: 631321 - protein, 9 aa, Homo Sapiens
QTNKGKYFV

SEQ ID NO: 631322 - protein, 9 aa, Homo Sapiens
TLKQQHQLA

SEQ ID NO: 631323 - protein, 9 aa, Homo Sapiens
MILLIAFSP

SEQ ID NO: 631324 - protein, 9 aa, Homo Sapiens
YSLFQATEE

SEQ ID NO: 631325 - protein, 9 aa, Homo Sapiens
SAVGGGTCL

SEQ ID NO: 631326 - protein, 9 aa, Homo Sapiens
ITSRDLGSH

SEQ ID NO: 631327 - protein, 9 aa, Homo Sapiens
TAKDSKFKI

SEQ ID NO: 631328 - protein, 9 aa, Homo Sapiens
TAAFSKGLH

SEQ ID NO: 631329 - protein, 9 aa, Homo Sapiens
LSVRTLQAH

SEQ ID NO: 631330 - protein, 9 aa, Homo Sapiens
GGMMKLRSR

SEQ ID NO: 631331 - protein, 9 aa, Homo Sapiens
LSSVDDFET

SEQ ID NO: 631332 - protein, 9 aa, Homo Sapiens
EMEEEACYQ

SEQ ID NO: 631333 - protein, 9 aa, Homo Sapiens
ATIGRAWGD

SEQ ID NO: 631334 - protein, 9 aa, Homo Sapiens
NACQWFLKT

SEQ ID NO: 631335 - protein, 9 aa, Homo Sapiens
VLEKCQVPA

SEQ ID NO: 631336 - protein, 9 aa, Homo Sapiens
APWIMKPST

SEQ ID NO: 631337 - protein, 9 aa, Homo Sapiens
GLAWSSHVA

SEQ ID NO: 631338 - protein, 9 aa, Homo Sapiens
TSVRSHDPG

SEQ ID NO: 631339 - protein, 9 aa, Homo Sapiens
DRYSRQGLV

SEQ ID NO: 631340 - protein, 9 aa, Homo Sapiens
RRSKETVVF

SEQ ID NO: 631341 - protein, 9 aa, Homo Sapiens
VAGYVSVLF

SEQ ID NO: 631342 - protein, 9 aa, Homo Sapiens
HKMRQLKGL

SEQ ID NO: 631343 - protein, 9 aa, Homo Sapiens
PAFLEAISE

SEQ ID NO: 631344 - protein, 9 aa, Homo Sapiens
TGGTIWLLY

SEQ ID NO: 631345 - protein, 9 aa, Homo Sapiens
STVTDLQEI

SEQ ID NO: 631346 - protein, 9 aa, Homo Sapiens
ELISVKMSE

SEQ ID NO: 631347 - protein, 9 aa, Homo Sapiens
ISLLTNRVP

SEQ ID NO: 631348 - protein, 9 aa, Homo Sapiens
RVHTTGIIE

SEQ ID NO: 631349 - protein, 9 aa, Homo Sapiens
PAVISLGSD

SEQ ID NO: 631350 - protein, 9 aa, Homo Sapiens
PPVAVGMSI

SEQ ID NO: 631351 - protein, 9 aa, Homo Sapiens
IKNEVGDVE

SEQ ID NO: 631352 - protein, 9 aa, Homo Sapiens
VNLLLDFGA

SEQ ID NO: 631353 - protein, 9 aa, Homo Sapiens
FQERFLAGS

SEQ ID NO: 631354 - protein, 9 aa, Homo Sapiens
ESWFERIVS

SEQ ID NO: 631355 - protein, 9 aa, Homo Sapiens
SPSMSSSQV

SEQ ID NO: 631356 - protein, 9 aa, Homo Sapiens
IMRALKSAS

SEQ ID NO: 631357 - protein, 9 aa, Homo Sapiens
EPEEHEERK

SEQ ID NO: 631358 - protein, 9 aa, Homo Sapiens
PVLRRSLDK

SEQ ID NO: 631359 - protein, 9 aa, Homo Sapiens
SAHGRGPLA

SEQ ID NO: 631360 - protein, 9 aa, Homo Sapiens
LFPAAQRPK

SEQ ID NO: 631361 - protein, 9 aa, Homo Sapiens
LGMILLIAF

SEQ ID NO: 631362 - protein, 9 aa, Homo Sapiens
KKMENQYHR

SEQ ID NO: 631363 - protein, 9 aa, Homo Sapiens
EVGLPLLFL

SEQ ID NO: 631364 - protein, 9 aa, Homo Sapiens
DYPALQFLP

SEQ ID NO: 631365 - protein, 9 aa, Homo Sapiens
VIGILVAKI

SEQ ID NO: 631366 - protein, 9 aa, Homo Sapiens
EDSLSSACI

SEQ ID NO: 631367 - protein, 9 aa, Homo Sapiens
ATNENSGGI

SEQ ID NO: 631368 - protein, 9 aa, Homo Sapiens
IRDMSENVL

SEQ ID NO: 631369 - protein, 9 aa, Homo Sapiens
VLAKIPRRD

SEQ ID NO: 631370 - protein, 9 aa, Homo Sapiens
CGAAVSDSS

SEQ ID NO: 631371 - protein, 9 aa, Homo Sapiens
SQYNDYVDV

SEQ ID NO: 631372 - protein, 9 aa, Homo Sapiens
LQEPTCQIS

SEQ ID NO: 631373 - protein, 9 aa, Homo Sapiens
FLLLGSDGC

SEQ ID NO: 631374 - protein, 9 aa, Homo Sapiens
LFLALLTCL

SEQ ID NO: 631375 - protein, 9 aa, Homo Sapiens
LLTCLLLLL

SEQ ID NO: 631376 - protein, 9 aa, Homo Sapiens
GDKIAISLS

SEQ ID NO: 631377 - protein, 9 aa, Homo Sapiens
DEIGLIPLH

SEQ ID NO: 631378 - protein, 9 aa, Homo Sapiens
LWNFSLEIS

SEQ ID NO: 631379 - protein, 9 aa, Homo Sapiens
DAANCMPIG

SEQ ID NO: 631380 - protein, 9 aa, Homo Sapiens
QAPQDGPPW

SEQ ID NO: 631381 - protein, 9 aa, Homo Sapiens
HRIHVCDKS

SEQ ID NO: 631382 - protein, 9 aa, Homo Sapiens
DDVEEMETG

SEQ ID NO: 631383 - protein, 9 aa, Homo Sapiens
TEQAAAIKE

SEQ ID NO: 631384 - protein, 9 aa, Homo Sapiens
HTDGSILAC

SEQ ID NO: 631385 - protein, 9 aa, Homo Sapiens
DFHGRCYNC

SEQ ID NO: 631386 - protein, 9 aa, Homo Sapiens
PLGSVMSTK

SEQ ID NO: 631387 - protein, 9 aa, Homo Sapiens
HPQAREEGP

SEQ ID NO: 631388 - protein, 9 aa, Homo Sapiens
QSDDSSADP

SEQ ID NO: 631389 - protein, 9 aa, Homo Sapiens
LNRKTSRLT

SEQ ID NO: 631390 - protein, 9 aa, Homo Sapiens
DPCGGGAAG

SEQ ID NO: 631391 - protein, 9 aa, Homo Sapiens
KWLSYWIQE

SEQ ID NO: 631392 - protein, 9 aa, Homo Sapiens
LVDASTQIR

SEQ ID NO: 631393 - protein, 9 aa, Homo Sapiens
LYWISSGNR

SEQ ID NO: 631394 - protein, 9 aa, Homo Sapiens
ELSSVDDFE

SEQ ID NO: 631395 - protein, 9 aa, Homo Sapiens
GLDGQWPDG

SEQ ID NO: 631396 - protein, 9 aa, Homo Sapiens
KWKSLTLSR

SEQ ID NO: 631397 - protein, 9 aa, Homo Sapiens
ESEGAASVG

SEQ ID NO: 631398 - protein, 9 aa, Homo Sapiens
AHFINALVT

SEQ ID NO: 631399 - protein, 9 aa, Homo Sapiens
GLLPETPRE

SEQ ID NO: 631400 - protein, 9 aa, Homo Sapiens
GKTTFGSRH

SEQ ID NO: 631401 - protein, 9 aa, Homo Sapiens
HFNMYLIFI

SEQ ID NO: 631402 - protein, 9 aa, Homo Sapiens
ALKAKAPTE

SEQ ID NO: 631403 - protein, 9 aa, Homo Sapiens
QQALNHHLH

SEQ ID NO: 631404 - protein, 9 aa, Homo Sapiens
TGLGSHQPH

SEQ ID NO: 631405 - protein, 9 aa, Homo Sapiens
LVFTQFSLY

SEQ ID NO: 631406 - protein, 9 aa, Homo Sapiens
SGFASGMKD

SEQ ID NO: 631407 - protein, 9 aa, Homo Sapiens
PAISSQNVT

SEQ ID NO: 631408 - protein, 9 aa, Homo Sapiens
NLSLDVDAN

SEQ ID NO: 631409 - protein, 9 aa, Homo Sapiens
WAEGSFVSS

SEQ ID NO: 631410 - protein, 9 aa, Homo Sapiens
SMLLGDDLS

SEQ ID NO: 631411 - protein, 9 aa, Homo Sapiens
KSRPTGVPI

SEQ ID NO: 631412 - protein, 9 aa, Homo Sapiens
LLSVRTLQA

SEQ ID NO: 631413 - protein, 9 aa, Homo Sapiens
LQVEPPAQA

SEQ ID NO: 631414 - protein, 9 aa, Homo Sapiens
KHLTGECMD

SEQ ID NO: 631415 - protein, 9 aa, Homo Sapiens
CDGAHSPGC

SEQ ID NO: 631416 - protein, 9 aa, Homo Sapiens
LIIRHRRQG

SEQ ID NO: 631417 - protein, 9 aa, Homo Sapiens
NVFASVYTR

SEQ ID NO: 631418 - protein, 9 aa, Homo Sapiens
LNKLRKRER

SEQ ID NO: 631419 - protein, 9 aa, Homo Sapiens
KVPQHGNTK

SEQ ID NO: 631420 - protein, 9 aa, Homo Sapiens
FNLPFPNSP

SEQ ID NO: 631421 - protein, 9 aa, Homo Sapiens
ACQWFLKTD

SEQ ID NO: 631422 - protein, 9 aa, Homo Sapiens
FQSSRMEKY

SEQ ID NO: 631423 - protein, 9 aa, Homo Sapiens
MEGMRSPYA

SEQ ID NO: 631424 - protein, 9 aa, Homo Sapiens
IGQSLNVLE

SEQ ID NO: 631425 - protein, 9 aa, Homo Sapiens
RQNCVDTPS

SEQ ID NO: 631426 - protein, 9 aa, Homo Sapiens
EELDSLSMS

SEQ ID NO: 631427 - protein, 9 aa, Homo Sapiens
TVKPLVWKP

SEQ ID NO: 631428 - protein, 9 aa, Homo Sapiens
LEDLHMVLD

SEQ ID NO: 631429 - protein, 9 aa, Homo Sapiens
DSSVNLLGR

SEQ ID NO: 631430 - protein, 9 aa, Homo Sapiens
AAQRPKRSS

SEQ ID NO: 631431 - protein, 9 aa, Homo Sapiens
HLQGKPQTL

SEQ ID NO: 631432 - protein, 9 aa, Homo Sapiens
KKSPLRMSL

SEQ ID NO: 631433 - protein, 9 aa, Homo Sapiens
AYAVATWDA

SEQ ID NO: 631434 - protein, 9 aa, Homo Sapiens
NKPDIFELI

SEQ ID NO: 631435 - protein, 9 aa, Homo Sapiens
FERLLTSGC

SEQ ID NO: 631436 - protein, 9 aa, Homo Sapiens
LLIVGHDDH

SEQ ID NO: 631437 - protein, 9 aa, Homo Sapiens
INECKGAVI

SEQ ID NO: 631438 - protein, 9 aa, Homo Sapiens
GCTVQYAVL

SEQ ID NO: 631439 - protein, 9 aa, Homo Sapiens
AAQRCHSLL

SEQ ID NO: 631440 - protein, 9 aa, Homo Sapiens
LTILIRFLC

SEQ ID NO: 631441 - protein, 9 aa, Homo Sapiens
GSSSPKRSW

SEQ ID NO: 631442 - protein, 9 aa, Homo Sapiens
APPVIAPLP

SEQ ID NO: 631443 - protein, 9 aa, Homo Sapiens
RAHEEQGRS

SEQ ID NO: 631444 - protein, 9 aa, Homo Sapiens
AICAGKTDF

SEQ ID NO: 631445 - protein, 9 aa, Homo Sapiens
FNMYLIFIM

SEQ ID NO: 631446 - protein, 9 aa, Homo Sapiens
GGQTGGTIW

SEQ ID NO: 631447 - protein, 9 aa, Homo Sapiens
HQLAVEQIA

SEQ ID NO: 631448 - protein, 9 aa, Homo Sapiens
KGNLLDEGS

SEQ ID NO: 631449 - protein, 9 aa, Homo Sapiens
TGGRPAMEP

SEQ ID NO: 631450 - protein, 9 aa, Homo Sapiens
GNGPLEPFL

SEQ ID NO: 631451 - protein, 9 aa, Homo Sapiens
AAVRAAAAV

SEQ ID NO: 631452 - protein, 9 aa, Homo Sapiens
RCSQSPPLS

SEQ ID NO: 631453 - protein, 9 aa, Homo Sapiens
QDPVSLHED

SEQ ID NO: 631454 - protein, 9 aa, Homo Sapiens
EFVLEKCQV

SEQ ID NO: 631455 - protein, 9 aa, Homo Sapiens
LSSEVLVCV

SEQ ID NO: 631456 - protein, 9 aa, Homo Sapiens
RLSQKHSTV

SEQ ID NO: 631457 - protein, 9 aa, Homo Sapiens
GNFVFFQGN

SEQ ID NO: 631458 - protein, 9 aa, Homo Sapiens
HLPFMGSID

SEQ ID NO: 631459 - protein, 9 aa, Homo Sapiens
CMGVDRYQS

SEQ ID NO: 631460 - protein, 9 aa, Homo Sapiens
VRTLQAHEL

SEQ ID NO: 631461 - protein, 9 aa, Homo Sapiens
TFQACSISD

SEQ ID NO: 631462 - protein, 9 aa, Homo Sapiens
EKEPSPLPP

SEQ ID NO: 631463 - protein, 9 aa, Homo Sapiens
VQYAVLHWL

SEQ ID NO: 631464 - protein, 9 aa, Homo Sapiens
GATYTDRSD

SEQ ID NO: 631465 - protein, 9 aa, Homo Sapiens
VFLAETRFF

SEQ ID NO: 631466 - protein, 9 aa, Homo Sapiens
VDTTHMENV

SEQ ID NO: 631467 - protein, 9 aa, Homo Sapiens
LIVGHDDHN

SEQ ID NO: 631468 - protein, 9 aa, Homo Sapiens
DFKFPNGLI

SEQ ID NO: 631469 - protein, 9 aa, Homo Sapiens
PREQSCLGT

SEQ ID NO: 631470 - protein, 9 aa, Homo Sapiens
AHSGDHYNE

SEQ ID NO: 631471 - protein, 9 aa, Homo Sapiens
YPYYPKFHP

SEQ ID NO: 631472 - protein, 9 aa, Homo Sapiens
GMFMDASRL

SEQ ID NO: 631473 - protein, 9 aa, Homo Sapiens
SSVCRHTAV

SEQ ID NO: 631474 - protein, 9 aa, Homo Sapiens
VGLSGLFDG

SEQ ID NO: 631475 - protein, 9 aa, Homo Sapiens
YCMEKEGCM

SEQ ID NO: 631476 - protein, 9 aa, Homo Sapiens
KVARMKEAM

SEQ ID NO: 631477 - protein, 9 aa, Homo Sapiens
EKQTNKGKY

SEQ ID NO: 631478 - protein, 9 aa, Homo Sapiens
ECGKRFSLS

SEQ ID NO: 631479 - protein, 9 aa, Homo Sapiens
NMEAARAVV

SEQ ID NO: 631480 - protein, 9 aa, Homo Sapiens
LLRLRRWHK

SEQ ID NO: 631481 - protein, 9 aa, Homo Sapiens
CSMERRRLG

SEQ ID NO: 631482 - protein, 9 aa, Homo Sapiens
SRCSEATSS

SEQ ID NO: 631483 - protein, 9 aa, Homo Sapiens
MPCTRGQGW

SEQ ID NO: 631484 - protein, 9 aa, Homo Sapiens
LPSKDIKPD

SEQ ID NO: 631485 - protein, 9 aa, Homo Sapiens
LLDEGSDVE

SEQ ID NO: 631486 - protein, 9 aa, Homo Sapiens
VGGGYNGML

SEQ ID NO: 631487 - protein, 9 aa, Homo Sapiens
QNMNSKWKA

SEQ ID NO: 631488 - protein, 9 aa, Homo Sapiens
KAFGDCSTI

SEQ ID NO: 631489 - protein, 9 aa, Homo Sapiens
DDTSNPFPR

SEQ ID NO: 631490 - protein, 9 aa, Homo Sapiens
IHLVSGKRE

SEQ ID NO: 631491 - protein, 9 aa, Homo Sapiens
DWNALVTAK

SEQ ID NO: 631492 - protein, 9 aa, Homo Sapiens
QRDLAYKQL

SEQ ID NO: 631493 - protein, 9 aa, Homo Sapiens
FLLFFWLDL

SEQ ID NO: 631494 - protein, 9 aa, Homo Sapiens
MRALKSASK

SEQ ID NO: 631495 - protein, 9 aa, Homo Sapiens
CVCPTGWQV

SEQ ID NO: 631496 - protein, 9 aa, Homo Sapiens
GQMIMCPIC

SEQ ID NO: 631497 - protein, 9 aa, Homo Sapiens
PSNKGYSLA

SEQ ID NO: 631498 - protein, 9 aa, Homo Sapiens
QRRFFIGNQ

SEQ ID NO: 631499 - protein, 9 aa, Homo Sapiens
ASRKPLCAV

SEQ ID NO: 631500 - protein, 9 aa, Homo Sapiens
PGGMMKLRS

SEQ ID NO: 631501 - protein, 9 aa, Homo Sapiens
LVDGQTLWL

SEQ ID NO: 631502 - protein, 9 aa, Homo Sapiens
ARAVVLIPW

SEQ ID NO: 631503 - protein, 9 aa, Homo Sapiens
QPEKEPSPL

SEQ ID NO: 631504 - protein, 9 aa, Homo Sapiens
NAHPRPTSH

SEQ ID NO: 631505 - protein, 9 aa, Homo Sapiens
GTIWLLYVF

SEQ ID NO: 631506 - protein, 9 aa, Homo Sapiens
LGAIEGVSA

SEQ ID NO: 631507 - protein, 9 aa, Homo Sapiens
SRGDLTVLV

SEQ ID NO: 631508 - protein, 9 aa, Homo Sapiens
SQHTHSMAR

SEQ ID NO: 631509 - protein, 9 aa, Homo Sapiens
QAALRRSPR

SEQ ID NO: 631510 - protein, 9 aa, Homo Sapiens
ISQLELSQL

SEQ ID NO: 631511 - protein, 9 aa, Homo Sapiens
RCVICALIG

SEQ ID NO: 631512 - protein, 9 aa, Homo Sapiens
PLLGAIEGV

SEQ ID NO: 631513 - protein, 9 aa, Homo Sapiens
LKQMFHLKN

SEQ ID NO: 631514 - protein, 9 aa, Homo Sapiens
ADKWRTEER

SEQ ID NO: 631515 - protein, 9 aa, Homo Sapiens
VTLLHMPCP

SEQ ID NO: 631516 - protein, 9 aa, Homo Sapiens
DDPKFYSYF

SEQ ID NO: 631517 - protein, 9 aa, Homo Sapiens
KGLPTPSDE

SEQ ID NO: 631518 - protein, 9 aa, Homo Sapiens
SPKRSWMTA

SEQ ID NO: 631519 - protein, 9 aa, Homo Sapiens
YDMTSLNVK

SEQ ID NO: 631520 - protein, 9 aa, Homo Sapiens
VVYLIEFSG

SEQ ID NO: 631521 - protein, 9 aa, Homo Sapiens
KRKGLLVTA

SEQ ID NO: 631522 - protein, 9 aa, Homo Sapiens
LHDVAVLRP

SEQ ID NO: 631523 - protein, 9 aa, Homo Sapiens
DKGNLLDEG

SEQ ID NO: 631524 - protein, 9 aa, Homo Sapiens
IVEVWPGQT

SEQ ID NO: 631525 - protein, 9 aa, Homo Sapiens
SDGNFVFFQ

SEQ ID NO: 631526 - protein, 9 aa, Homo Sapiens
PPPLAPKPA

SEQ ID NO: 631527 - protein, 9 aa, Homo Sapiens
PTRPAFKLL

SEQ ID NO: 631528 - protein, 9 aa, Homo Sapiens
YHRADAQSS

SEQ ID NO: 631529 - protein, 9 aa, Homo Sapiens
GPSSWPGEL

SEQ ID NO: 631530 - protein, 9 aa, Homo Sapiens
NFNIGNMTV

SEQ ID NO: 631531 - protein, 9 aa, Homo Sapiens
NIPSAADWS

SEQ ID NO: 631532 - protein, 9 aa, Homo Sapiens
MANHVACFH

SEQ ID NO: 631533 - protein, 9 aa, Homo Sapiens
EHFDPCTKC

SEQ ID NO: 631534 - protein, 9 aa, Homo Sapiens
CRVGGQRAL

SEQ ID NO: 631535 - protein, 9 aa, Homo Sapiens
DELQERCQL

SEQ ID NO: 631536 - protein, 9 aa, Homo Sapiens
GDQYASLIP

SEQ ID NO: 631537 - protein, 9 aa, Homo Sapiens
VQGVSLESV

SEQ ID NO: 631538 - protein, 9 aa, Homo Sapiens
YCYICPHIV

SEQ ID NO: 631539 - protein, 9 aa, Homo Sapiens
CKVLPGRTE

SEQ ID NO: 631540 - protein, 9 aa, Homo Sapiens
QGAPIGPPG

SEQ ID NO: 631541 - protein, 9 aa, Homo Sapiens
LESVLLDLK

SEQ ID NO: 631542 - protein, 9 aa, Homo Sapiens
TILMPCTRG

SEQ ID NO: 631543 - protein, 9 aa, Homo Sapiens
SSQASVAEL

SEQ ID NO: 631544 - protein, 9 aa, Homo Sapiens
NMNEHFSSL

SEQ ID NO: 631545 - protein, 9 aa, Homo Sapiens
FILKSILCF

SEQ ID NO: 631546 - protein, 9 aa, Homo Sapiens
QELIQAKKK

SEQ ID NO: 631547 - protein, 9 aa, Homo Sapiens
PSVRGNVWS

SEQ ID NO: 631548 - protein, 9 aa, Homo Sapiens
ESIADCVEA

SEQ ID NO: 631549 - protein, 9 aa, Homo Sapiens
HTLKLVSRN

SEQ ID NO: 631550 - protein, 9 aa, Homo Sapiens
PEKNCAHGE

SEQ ID NO: 631551 - protein, 9 aa, Homo Sapiens
PSMSSSQVA

SEQ ID NO: 631552 - protein, 9 aa, Homo Sapiens
DDLPSPSPG

SEQ ID NO: 631553 - protein, 9 aa, Homo Sapiens
LNEDVPSSE

SEQ ID NO: 631554 - protein, 9 aa, Homo Sapiens
EIDHHKFHP

SEQ ID NO: 631555 - protein, 9 aa, Homo Sapiens
HNYHHYFPY

SEQ ID NO: 631556 - protein, 9 aa, Homo Sapiens
HPQQEDQNK

SEQ ID NO: 631557 - protein, 9 aa, Homo Sapiens
FLYSSPINV

SEQ ID NO: 631558 - protein, 9 aa, Homo Sapiens
SAILRVLGP

SEQ ID NO: 631559 - protein, 9 aa, Homo Sapiens
IEMFHGQPL

SEQ ID NO: 631560 - protein, 9 aa, Homo Sapiens
SCQVTGLWK

SEQ ID NO: 631561 - protein, 9 aa, Homo Sapiens
PGGHWMPKD

SEQ ID NO: 631562 - protein, 9 aa, Homo Sapiens
ESRRKHDCL

SEQ ID NO: 631563 - protein, 9 aa, Homo Sapiens
SFENTAAVW

SEQ ID NO: 631564 - protein, 9 aa, Homo Sapiens
FEIQCHPCH

SEQ ID NO: 631565 - protein, 9 aa, Homo Sapiens
ASDDTSNPF

SEQ ID NO: 631566 - protein, 9 aa, Homo Sapiens
RGTESTLDA

SEQ ID NO: 631567 - protein, 9 aa, Homo Sapiens
LRLLLYIVR

SEQ ID NO: 631568 - protein, 9 aa, Homo Sapiens
AVCRGGSLC

SEQ ID NO: 631569 - protein, 9 aa, Homo Sapiens
LCGGMASCG

SEQ ID NO: 631570 - protein, 9 aa, Homo Sapiens
LENPLLQTS

SEQ ID NO: 631571 - protein, 9 aa, Homo Sapiens
EEPSPSLWQ

SEQ ID NO: 631572 - protein, 9 aa, Homo Sapiens
CFSLSNFLS

SEQ ID NO: 631573 - protein, 9 aa, Homo Sapiens
FIMCNSVMD

SEQ ID NO: 631574 - protein, 9 aa, Homo Sapiens
AFVISVVVI

SEQ ID NO: 631575 - protein, 9 aa, Homo Sapiens
EMFHGQPLF

SEQ ID NO: 631576 - protein, 9 aa, Homo Sapiens
KRIMKVLQG

SEQ ID NO: 631577 - protein, 9 aa, Homo Sapiens
SQVYAVNDD

SEQ ID NO: 631578 - protein, 9 aa, Homo Sapiens
AYRPLLFTY

SEQ ID NO: 631579 - protein, 9 aa, Homo Sapiens
PSNDSTSPV

SEQ ID NO: 631580 - protein, 9 aa, Homo Sapiens
AARAVVLIP

SEQ ID NO: 631581 - protein, 9 aa, Homo Sapiens
KIMWLPQQN

SEQ ID NO: 631582 - protein, 9 aa, Homo Sapiens
TIATVTKKD

SEQ ID NO: 631583 - protein, 9 aa, Homo Sapiens
AEGYERGTK

SEQ ID NO: 631584 - protein, 9 aa, Homo Sapiens
KCPEPCPPT

SEQ ID NO: 631585 - protein, 9 aa, Homo Sapiens
CPHIVKEFA

SEQ ID NO: 631586 - protein, 9 aa, Homo Sapiens
EPGHPVNRT

SEQ ID NO: 631587 - protein, 9 aa, Homo Sapiens
SFYKLFYTA

SEQ ID NO: 631588 - protein, 9 aa, Homo Sapiens
FRMALKLHQ

SEQ ID NO: 631589 - protein, 9 aa, Homo Sapiens
PTWHGDIIS

SEQ ID NO: 631590 - protein, 9 aa, Homo Sapiens
VVQAKVGLS

SEQ ID NO: 631591 - protein, 9 aa, Homo Sapiens
QQAVQFAKA

SEQ ID NO: 631592 - protein, 9 aa, Homo Sapiens
QELSFLRGD

SEQ ID NO: 631593 - protein, 9 aa, Homo Sapiens
LGDKGNLLD

SEQ ID NO: 631594 - protein, 9 aa, Homo Sapiens
WRPRKGPKT

SEQ ID NO: 631595 - protein, 9 aa, Homo Sapiens
PPSKGLPTP

SEQ ID NO: 631596 - protein, 9 aa, Homo Sapiens
CDRVQNAYT

SEQ ID NO: 631597 - protein, 9 aa, Homo Sapiens
KIACGAAVS

SEQ ID NO: 631598 - protein, 9 aa, Homo Sapiens
GEADEIGLI

SEQ ID NO: 631599 - protein, 9 aa, Homo Sapiens
ERIHMGHSC

SEQ ID NO: 631600 - protein, 9 aa, Homo Sapiens
CPIVLKVAG

SEQ ID NO: 631601 - protein, 9 aa, Homo Sapiens
HIMSLTKMS

SEQ ID NO: 631602 - protein, 9 aa, Homo Sapiens
KGIFSMKVS

SEQ ID NO: 631603 - protein, 9 aa, Homo Sapiens
RADAQSSRS

SEQ ID NO: 631604 - protein, 9 aa, Homo Sapiens
SSRLAWPLW

SEQ ID NO: 631605 - protein, 9 aa, Homo Sapiens
GSVNEAGHR

SEQ ID NO: 631606 - protein, 9 aa, Homo Sapiens
SACIQRVNT

SEQ ID NO: 631607 - protein, 9 aa, Homo Sapiens
GCQLRSNNM

SEQ ID NO: 631608 - protein, 9 aa, Homo Sapiens
NAYACPRLR

SEQ ID NO: 631609 - protein, 9 aa, Homo Sapiens
ELKLSECPE

SEQ ID NO: 631610 - protein, 9 aa, Homo Sapiens
SEPRLGKTT

SEQ ID NO: 631611 - protein, 9 aa, Homo Sapiens
PSGRQTLSP

SEQ ID NO: 631612 - protein, 9 aa, Homo Sapiens
KENAIDRTE

SEQ ID NO: 631613 - protein, 9 aa, Homo Sapiens
QLSSQSFSR

SEQ ID NO: 631614 - protein, 9 aa, Homo Sapiens
KFMYTDCAD

SEQ ID NO: 631615 - protein, 9 aa, Homo Sapiens
LTCLLLLLV

SEQ ID NO: 631616 - protein, 9 aa, Homo Sapiens
PMNGYEKDS

SEQ ID NO: 631617 - protein, 9 aa, Homo Sapiens
ERFPYVALS

SEQ ID NO: 631618 - protein, 9 aa, Homo Sapiens
PEDDSPVSI

SEQ ID NO: 631619 - protein, 9 aa, Homo Sapiens
FHATGAEID

SEQ ID NO: 631620 - protein, 9 aa, Homo Sapiens
VSFSSHDPK

SEQ ID NO: 631621 - protein, 9 aa, Homo Sapiens
SPGREKQGA

SEQ ID NO: 631622 - protein, 9 aa, Homo Sapiens
YQPVLWLDQ

SEQ ID NO: 631623 - protein, 9 aa, Homo Sapiens
SESTSNPEL

SEQ ID NO: 631624 - protein, 9 aa, Homo Sapiens
VMAPLGPPR

SEQ ID NO: 631625 - protein, 9 aa, Homo Sapiens
RIDFVVNNA

SEQ ID NO: 631626 - protein, 9 aa, Homo Sapiens
AEGAQNKGK

SEQ ID NO: 631627 - protein, 9 aa, Homo Sapiens
TLKDGATYT

SEQ ID NO: 631628 - protein, 9 aa, Homo Sapiens
PLLDSEQHR

SEQ ID NO: 631629 - protein, 9 aa, Homo Sapiens
TPNHRCINC

SEQ ID NO: 631630 - protein, 9 aa, Homo Sapiens
LQEVRLLPQ

SEQ ID NO: 631631 - protein, 9 aa, Homo Sapiens
LKKTRCREF

SEQ ID NO: 631632 - protein, 9 aa, Homo Sapiens
IYERQQQEV

SEQ ID NO: 631633 - protein, 9 aa, Homo Sapiens
VMYCAPLKP

SEQ ID NO: 631634 - protein, 9 aa, Homo Sapiens
LIEVISMYR

SEQ ID NO: 631635 - protein, 9 aa, Homo Sapiens
SPGTPPSYS

SEQ ID NO: 631636 - protein, 9 aa, Homo Sapiens
DDFGNMFVL

SEQ ID NO: 631637 - protein, 9 aa, Homo Sapiens
RIHVCDKSY

SEQ ID NO: 631638 - protein, 9 aa, Homo Sapiens
DGGWGLKEA

SEQ ID NO: 631639 - protein, 9 aa, Homo Sapiens
LRLEIYERQ

SEQ ID NO: 631640 - protein, 9 aa, Homo Sapiens
RQRIVALSL

SEQ ID NO: 631641 - protein, 9 aa, Homo Sapiens
PHIVKEFAK

SEQ ID NO: 631642 - protein, 9 aa, Homo Sapiens
YHTCGGALI

SEQ ID NO: 631643 - protein, 9 aa, Homo Sapiens
LKDSEDSQY

SEQ ID NO: 631644 - protein, 9 aa, Homo Sapiens
GTESTLDAC

SEQ ID NO: 631645 - protein, 9 aa, Homo Sapiens
DLKKSPLRM

SEQ ID NO: 631646 - protein, 9 aa, Homo Sapiens
LVSIIKLIF

SEQ ID NO: 631647 - protein, 9 aa, Homo Sapiens
AKKRVHPYY

SEQ ID NO: 631648 - protein, 9 aa, Homo Sapiens
WPSLCIDLT

SEQ ID NO: 631649 - protein, 9 aa, Homo Sapiens
GGTRPCHPL

SEQ ID NO: 631650 - protein, 9 aa, Homo Sapiens
FTGIENIDE

SEQ ID NO: 631651 - protein, 9 aa, Homo Sapiens
FAQHGHTLA

SEQ ID NO: 631652 - protein, 9 aa, Homo Sapiens
EATTGEATP

SEQ ID NO: 631653 - protein, 9 aa, Homo Sapiens
ARIPPCGCK

SEQ ID NO: 631654 - protein, 9 aa, Homo Sapiens
YHTEQSLRL

SEQ ID NO: 631655 - protein, 9 aa, Homo Sapiens
DFGADVNKC

SEQ ID NO: 631656 - protein, 9 aa, Homo Sapiens
LLSGSTDCL

SEQ ID NO: 631657 - protein, 9 aa, Homo Sapiens
PSWKFEFEI

SEQ ID NO: 631658 - protein, 9 aa, Homo Sapiens
DMCVYRIGR

SEQ ID NO: 631659 - protein, 9 aa, Homo Sapiens
RLLHWEEFD

SEQ ID NO: 631660 - protein, 9 aa, Homo Sapiens
NKLEKNATY

SEQ ID NO: 631661 - protein, 9 aa, Homo Sapiens
RWNKYFKSW

SEQ ID NO: 631662 - protein, 9 aa, Homo Sapiens
AHFLEAVVM

SEQ ID NO: 631663 - protein, 9 aa, Homo Sapiens
FTCKIQALL

SEQ ID NO: 631664 - protein, 9 aa, Homo Sapiens
LTRAGIALD

SEQ ID NO: 631665 - protein, 9 aa, Homo Sapiens
EIASQCISA

SEQ ID NO: 631666 - protein, 9 aa, Homo Sapiens
ATTQEMVRP

SEQ ID NO: 631667 - protein, 9 aa, Homo Sapiens
SADEAACRI

SEQ ID NO: 631668 - protein, 9 aa, Homo Sapiens
LSQPSLCLL

SEQ ID NO: 631669 - protein, 9 aa, Homo Sapiens
SSVDFTQTA

SEQ ID NO: 631670 - protein, 9 aa, Homo Sapiens
ICIKFCDMT

SEQ ID NO: 631671 - protein, 9 aa, Homo Sapiens
QRDPLQDSL

SEQ ID NO: 631672 - protein, 9 aa, Homo Sapiens
KRWEAIRQA

SEQ ID NO: 631673 - protein, 9 aa, Homo Sapiens
DVQRHDVEL

SEQ ID NO: 631674 - protein, 9 aa, Homo Sapiens
NVTDIDFTM

SEQ ID NO: 631675 - protein, 9 aa, Homo Sapiens
DGFLLTLIT

SEQ ID NO: 631676 - protein, 9 aa, Homo Sapiens
VNVGEGNHP

SEQ ID NO: 631677 - protein, 9 aa, Homo Sapiens
VPRMGSNSL

SEQ ID NO: 631678 - protein, 9 aa, Homo Sapiens
PGSAHSLGP

SEQ ID NO: 631679 - protein, 9 aa, Homo Sapiens
YMLAFDLND

SEQ ID NO: 631680 - protein, 9 aa, Homo Sapiens
SRTPEIQQF

SEQ ID NO: 631681 - protein, 9 aa, Homo Sapiens
SEAAPVCCS

SEQ ID NO: 631682 - protein, 9 aa, Homo Sapiens
VSVLFLRIT

SEQ ID NO: 631683 - protein, 9 aa, Homo Sapiens
LALESVLLD

SEQ ID NO: 631684 - protein, 9 aa, Homo Sapiens
RWEAIRQAS

SEQ ID NO: 631685 - protein, 9 aa, Homo Sapiens
YPLYPGSDG

SEQ ID NO: 631686 - protein, 9 aa, Homo Sapiens
FREAYGALT

SEQ ID NO: 631687 - protein, 9 aa, Homo Sapiens
AQAPWDSEG

SEQ ID NO: 631688 - protein, 9 aa, Homo Sapiens
HRKRSKGVR

SEQ ID NO: 631689 - protein, 9 aa, Homo Sapiens
KPNIPSAAD

SEQ ID NO: 631690 - protein, 9 aa, Homo Sapiens
TMVRTSAFP

SEQ ID NO: 631691 - protein, 9 aa, Homo Sapiens
LMENGNIKV

SEQ ID NO: 631692 - protein, 9 aa, Homo Sapiens
KKYEDPENK

SEQ ID NO: 631693 - protein, 9 aa, Homo Sapiens
AESSQEESK

SEQ ID NO: 631694 - protein, 9 aa, Homo Sapiens
VVSATNENS

SEQ ID NO: 631695 - protein, 9 aa, Homo Sapiens
RIGSLARWR

SEQ ID NO: 631696 - protein, 9 aa, Homo Sapiens
RALVDGQTL

SEQ ID NO: 631697 - protein, 9 aa, Homo Sapiens
LDAFGRIDF

SEQ ID NO: 631698 - protein, 9 aa, Homo Sapiens
LTWKANTTT

SEQ ID NO: 631699 - protein, 9 aa, Homo Sapiens
LGTSSLFFS

SEQ ID NO: 631700 - protein, 9 aa, Homo Sapiens
GARDTRRLL

SEQ ID NO: 631701 - protein, 9 aa, Homo Sapiens
MPPYKEASG

SEQ ID NO: 631702 - protein, 9 aa, Homo Sapiens
LPPQSCSIK

SEQ ID NO: 631703 - protein, 9 aa, Homo Sapiens
MAETSASPS

SEQ ID NO: 631704 - protein, 9 aa, Homo Sapiens
YDSLHEEWS

SEQ ID NO: 631705 - protein, 9 aa, Homo Sapiens
PTGVPIYIK

SEQ ID NO: 631706 - protein, 9 aa, Homo Sapiens
ADGSSFVLS

SEQ ID NO: 631707 - protein, 9 aa, Homo Sapiens
SRPQAGPLW

SEQ ID NO: 631708 - protein, 9 aa, Homo Sapiens
KQRLESNRR

SEQ ID NO: 631709 - protein, 9 aa, Homo Sapiens
HCSVVYLIE

SEQ ID NO: 631710 - protein, 9 aa, Homo Sapiens
GHRKDLGAP

SEQ ID NO: 631711 - protein, 9 aa, Homo Sapiens
TMYPSAHRS

SEQ ID NO: 631712 - protein, 9 aa, Homo Sapiens
RGSFAFADI

SEQ ID NO: 631713 - protein, 9 aa, Homo Sapiens
DKLLALWLV

SEQ ID NO: 631714 - protein, 9 aa, Homo Sapiens
WKHQGQQYS

SEQ ID NO: 631715 - protein, 9 aa, Homo Sapiens
AETSASPSK

SEQ ID NO: 631716 - protein, 9 aa, Homo Sapiens
GTWESPKES

SEQ ID NO: 631717 - protein, 9 aa, Homo Sapiens
FVFAFTCAF

SEQ ID NO: 631718 - protein, 9 aa, Homo Sapiens
TLSLSQLEL

SEQ ID NO: 631719 - protein, 9 aa, Homo Sapiens
YKPLPDCPI

SEQ ID NO: 631720 - protein, 9 aa, Homo Sapiens
AVRNRGDGD

SEQ ID NO: 631721 - protein, 9 aa, Homo Sapiens
NEVYLDRKL

SEQ ID NO: 631722 - protein, 9 aa, Homo Sapiens
DQSDDSSAD

SEQ ID NO: 631723 - protein, 9 aa, Homo Sapiens
PLSTRRVVE

SEQ ID NO: 631724 - protein, 9 aa, Homo Sapiens
AHSADLENP

SEQ ID NO: 631725 - protein, 9 aa, Homo Sapiens
GSLKGFLSV

SEQ ID NO: 631726 - protein, 9 aa, Homo Sapiens
VGTRSSGLK

SEQ ID NO: 631727 - protein, 9 aa, Homo Sapiens
ISNLKGIFS

SEQ ID NO: 631728 - protein, 9 aa, Homo Sapiens
VQGTIKWRR

SEQ ID NO: 631729 - protein, 9 aa, Homo Sapiens
RDFPEWAHC

SEQ ID NO: 631730 - protein, 9 aa, Homo Sapiens
QDGKDTIRG

SEQ ID NO: 631731 - protein, 9 aa, Homo Sapiens
ELGTLERYT

SEQ ID NO: 631732 - protein, 9 aa, Homo Sapiens
ELQERCQLP

SEQ ID NO: 631733 - protein, 9 aa, Homo Sapiens
CEHVCSCTE

SEQ ID NO: 631734 - protein, 9 aa, Homo Sapiens
WKFEFEIQC

SEQ ID NO: 631735 - protein, 9 aa, Homo Sapiens
RPVQKGEPG

SEQ ID NO: 631736 - protein, 9 aa, Homo Sapiens
EPGESGRPV

SEQ ID NO: 631737 - protein, 9 aa, Homo Sapiens
QAFTGIENI

SEQ ID NO: 631738 - protein, 9 aa, Homo Sapiens
LDCKALGSA

SEQ ID NO: 631739 - protein, 9 aa, Homo Sapiens
LWKLMVVES

SEQ ID NO: 631740 - protein, 9 aa, Homo Sapiens
VLSWAEGSF

SEQ ID NO: 631741 - protein, 9 aa, Homo Sapiens
DSSADPCGG

SEQ ID NO: 631742 - protein, 9 aa, Homo Sapiens
NRSDNFNIG

SEQ ID NO: 631743 - protein, 9 aa, Homo Sapiens
DSSRPQAGP

SEQ ID NO: 631744 - protein, 9 aa, Homo Sapiens
RAEKKQAQE

SEQ ID NO: 631745 - protein, 9 aa, Homo Sapiens
GTCLPCHAF

SEQ ID NO: 631746 - protein, 9 aa, Homo Sapiens
FKSWRPLFT

SEQ ID NO: 631747 - protein, 9 aa, Homo Sapiens
NFVRVLCTC

SEQ ID NO: 631748 - protein, 9 aa, Homo Sapiens
VNVLYVNCE

SEQ ID NO: 631749 - protein, 9 aa, Homo Sapiens
QRLEEYRRG

SEQ ID NO: 631750 - protein, 9 aa, Homo Sapiens
KSWRPLFTG

SEQ ID NO: 631751 - protein, 9 aa, Homo Sapiens
QERRGKAVR

SEQ ID NO: 631752 - protein, 9 aa, Homo Sapiens
VSGHTCQQW

SEQ ID NO: 631753 - protein, 9 aa, Homo Sapiens
GGRLNSSSL

SEQ ID NO: 631754 - protein, 9 aa, Homo Sapiens
PVPYNPEEI

SEQ ID NO: 631755 - protein, 9 aa, Homo Sapiens
STVCEHFDP

SEQ ID NO: 631756 - protein, 9 aa, Homo Sapiens
KGFLSVEEQ

SEQ ID NO: 631757 - protein, 9 aa, Homo Sapiens
DHPHPEIPY

SEQ ID NO: 631758 - protein, 9 aa, Homo Sapiens
HAWFRIAFN

SEQ ID NO: 631759 - protein, 9 aa, Homo Sapiens
ARSHREVTM

SEQ ID NO: 631760 - protein, 9 aa, Homo Sapiens
VGTFYEEYD

SEQ ID NO: 631761 - protein, 9 aa, Homo Sapiens
KSLKQEKSP

SEQ ID NO: 631762 - protein, 9 aa, Homo Sapiens
DDEHHGASC

SEQ ID NO: 631763 - protein, 9 aa, Homo Sapiens
NIETTHPSI

SEQ ID NO: 631764 - protein, 9 aa, Homo Sapiens
PGVVVVAPT

SEQ ID NO: 631765 - protein, 9 aa, Homo Sapiens
KLFYTAILS

SEQ ID NO: 631766 - protein, 9 aa, Homo Sapiens
DDFRSKYHT

SEQ ID NO: 631767 - protein, 9 aa, Homo Sapiens
GLVYETKEE

SEQ ID NO: 631768 - protein, 9 aa, Homo Sapiens
LHKIMQLQQ

SEQ ID NO: 631769 - protein, 9 aa, Homo Sapiens
DLWALGVLM

SEQ ID NO: 631770 - protein, 9 aa, Homo Sapiens
SQLSYAPMT

SEQ ID NO: 631771 - protein, 9 aa, Homo Sapiens
YLVDASTQI

SEQ ID NO: 631772 - protein, 9 aa, Homo Sapiens
LFFWLDLSV

SEQ ID NO: 631773 - protein, 9 aa, Homo Sapiens
YSATRFRWS

SEQ ID NO: 631774 - protein, 9 aa, Homo Sapiens
GGQMIMCPI

SEQ ID NO: 631775 - protein, 9 aa, Homo Sapiens
SRYPIMYVA

SEQ ID NO: 631776 - protein, 9 aa, Homo Sapiens
WDVLVDRQP

SEQ ID NO: 631777 - protein, 9 aa, Homo Sapiens
RLDGSPRSS

SEQ ID NO: 631778 - protein, 9 aa, Homo Sapiens
SSTMVRTSA

SEQ ID NO: 631779 - protein, 9 aa, Homo Sapiens
SSSPKRSWM

SEQ ID NO: 631780 - protein, 9 aa, Homo Sapiens
AQERRGKAV

SEQ ID NO: 631781 - protein, 9 aa, Homo Sapiens
AINGIPTDD

SEQ ID NO: 631782 - protein, 9 aa, Homo Sapiens
VACYCRPGF

SEQ ID NO: 631783 - protein, 9 aa, Homo Sapiens
ALERIHMGH

SEQ ID NO: 631784 - protein, 9 aa, Homo Sapiens
DAQVVFNPL

SEQ ID NO: 631785 - protein, 9 aa, Homo Sapiens
RNHREKKLQ

SEQ ID NO: 631786 - protein, 9 aa, Homo Sapiens
SLTLSRIQK

SEQ ID NO: 631787 - protein, 9 aa, Homo Sapiens
SVSFFAIGM

SEQ ID NO: 631788 - protein, 9 aa, Homo Sapiens
HYKGREAIY

SEQ ID NO: 631789 - protein, 9 aa, Homo Sapiens
RPLAHQLRG

SEQ ID NO: 631790 - protein, 9 aa, Homo Sapiens
MTLATDHTD

SEQ ID NO: 631791 - protein, 9 aa, Homo Sapiens
SFCGYRSFS

SEQ ID NO: 631792 - protein, 9 aa, Homo Sapiens
GPGLLRGPP

SEQ ID NO: 631793 - protein, 9 aa, Homo Sapiens
LYDFQARSH

SEQ ID NO: 631794 - protein, 9 aa, Homo Sapiens
YVEVVFKCE

SEQ ID NO: 631795 - protein, 9 aa, Homo Sapiens
YKLFYTAIL

SEQ ID NO: 631796 - protein, 9 aa, Homo Sapiens
HDVTQTELA

SEQ ID NO: 631797 - protein, 9 aa, Homo Sapiens
ASSVLHDVA

SEQ ID NO: 631798 - protein, 9 aa, Homo Sapiens
TPYPYYPKF

SEQ ID NO: 631799 - protein, 9 aa, Homo Sapiens
PQENCFLYQ

SEQ ID NO: 631800 - protein, 9 aa, Homo Sapiens
MDKCSVSRD

SEQ ID NO: 631801 - protein, 9 aa, Homo Sapiens
EKLPLDYRS

SEQ ID NO: 631802 - protein, 9 aa, Homo Sapiens
KYVLCQLVG

SEQ ID NO: 631803 - protein, 9 aa, Homo Sapiens
FWLDLSVLA

SEQ ID NO: 631804 - protein, 9 aa, Homo Sapiens
IQAKKKSGN

SEQ ID NO: 631805 - protein, 9 aa, Homo Sapiens
SGGPPREVG

SEQ ID NO: 631806 - protein, 9 aa, Homo Sapiens
AAGIPLPRL

SEQ ID NO: 631807 - protein, 9 aa, Homo Sapiens
IVVAYYFCW

SEQ ID NO: 631808 - protein, 9 aa, Homo Sapiens
PNVFPSSVD

SEQ ID NO: 631809 - protein, 9 aa, Homo Sapiens
QSVTLYIIG

SEQ ID NO: 631810 - protein, 9 aa, Homo Sapiens
YAPLQQVDP

SEQ ID NO: 631811 - protein, 9 aa, Homo Sapiens
GELTRAGIA

SEQ ID NO: 631812 - protein, 9 aa, Homo Sapiens
SDPVLRRSL

SEQ ID NO: 631813 - protein, 9 aa, Homo Sapiens
LAFAIAAFV

SEQ ID NO: 631814 - protein, 9 aa, Homo Sapiens
KQLYSWEEA

SEQ ID NO: 631815 - protein, 9 aa, Homo Sapiens
MKVHHVNIT

SEQ ID NO: 631816 - protein, 9 aa, Homo Sapiens
RLRAELPPE

SEQ ID NO: 631817 - protein, 9 aa, Homo Sapiens
KSIKIACAL

SEQ ID NO: 631818 - protein, 9 aa, Homo Sapiens
TDDGRSMAV

SEQ ID NO: 631819 - protein, 9 aa, Homo Sapiens
GQSLNVLEQ

SEQ ID NO: 631820 - protein, 9 aa, Homo Sapiens
FLAETRFFH

SEQ ID NO: 631821 - protein, 9 aa, Homo Sapiens
LLLGSDGCA

SEQ ID NO: 631822 - protein, 9 aa, Homo Sapiens
AELGDYDPY

SEQ ID NO: 631823 - protein, 9 aa, Homo Sapiens
VVFNPLLSH

SEQ ID NO: 631824 - protein, 9 aa, Homo Sapiens
NALVTTPMC

SEQ ID NO: 631825 - protein, 9 aa, Homo Sapiens
PLEGHTEID

SEQ ID NO: 631826 - protein, 9 aa, Homo Sapiens
LDGIGGDGF

SEQ ID NO: 631827 - protein, 9 aa, Homo Sapiens
LHVKHIHLE

SEQ ID NO: 631828 - protein, 9 aa, Homo Sapiens
LNYSAIQRE

SEQ ID NO: 631829 - protein, 9 aa, Homo Sapiens
DSLSSACIQ

SEQ ID NO: 631830 - protein, 9 aa, Homo Sapiens
HPNDEEAHS

SEQ ID NO: 631831 - protein, 9 aa, Homo Sapiens
MPKDCKPRW

SEQ ID NO: 631832 - protein, 9 aa, Homo Sapiens
DVLVDRQPC

SEQ ID NO: 631833 - protein, 9 aa, Homo Sapiens
LCQWKIFTE

SEQ ID NO: 631834 - protein, 9 aa, Homo Sapiens
EPPMDSTKR

SEQ ID NO: 631835 - protein, 9 aa, Homo Sapiens
MLDPREQSC

SEQ ID NO: 631836 - protein, 9 aa, Homo Sapiens
LLPGAPRSE

SEQ ID NO: 631837 - protein, 9 aa, Homo Sapiens
GYCFYLEDE

SEQ ID NO: 631838 - protein, 9 aa, Homo Sapiens
VSFFAIGMS

SEQ ID NO: 631839 - protein, 9 aa, Homo Sapiens
GAKKKDFSI

SEQ ID NO: 631840 - protein, 9 aa, Homo Sapiens
TVQSHGVDM

SEQ ID NO: 631841 - protein, 9 aa, Homo Sapiens
QKHSTVQNF

SEQ ID NO: 631842 - protein, 9 aa, Homo Sapiens
VFLECEHVC

SEQ ID NO: 631843 - protein, 9 aa, Homo Sapiens
AAANTSVAI

SEQ ID NO: 631844 - protein, 9 aa, Homo Sapiens
YQRLEEYRR

SEQ ID NO: 631845 - protein, 9 aa, Homo Sapiens
PQDGPPWAE

SEQ ID NO: 631846 - protein, 9 aa, Homo Sapiens
LTVKIGDFR

SEQ ID NO: 631847 - protein, 9 aa, Homo Sapiens
DLSVLAKEL

SEQ ID NO: 631848 - protein, 9 aa, Homo Sapiens
CPRTCHLNM

SEQ ID NO: 631849 - protein, 9 aa, Homo Sapiens
SGVISSFTS

SEQ ID NO: 631850 - protein, 9 aa, Homo Sapiens
AHLNGHKRL

SEQ ID NO: 631851 - protein, 9 aa, Homo Sapiens
FGIRIKNVV

SEQ ID NO: 631852 - protein, 9 aa, Homo Sapiens
LLLHGYRGL

SEQ ID NO: 631853 - protein, 9 aa, Homo Sapiens
ECPEKNCAH

SEQ ID NO: 631854 - protein, 9 aa, Homo Sapiens
CIKFCDMTV

SEQ ID NO: 631855 - protein, 9 aa, Homo Sapiens
KHVLGPQCL

SEQ ID NO: 631856 - protein, 9 aa, Homo Sapiens
RKHDCLICF

SEQ ID NO: 631857 - protein, 9 aa, Homo Sapiens
FHNYHHYFP

SEQ ID NO: 631858 - protein, 9 aa, Homo Sapiens
VSAGHGAGG

SEQ ID NO: 631859 - protein, 9 aa, Homo Sapiens
QALLSVRTL

SEQ ID NO: 631860 - protein, 9 aa, Homo Sapiens
LTEADLRLT

SEQ ID NO: 631861 - protein, 9 aa, Homo Sapiens
SPLPPSQNS

SEQ ID NO: 631862 - protein, 9 aa, Homo Sapiens
DHCMKLMQQ

SEQ ID NO: 631863 - protein, 9 aa, Homo Sapiens
IMSLTKMSS

SEQ ID NO: 631864 - protein, 9 aa, Homo Sapiens
DWNSRGDLT

SEQ ID NO: 631865 - protein, 9 aa, Homo Sapiens
DNETILCTR

SEQ ID NO: 631866 - protein, 9 aa, Homo Sapiens
YPVPRMGSN

SEQ ID NO: 631867 - protein, 9 aa, Homo Sapiens
SNITSSIMQ

SEQ ID NO: 631868 - protein, 9 aa, Homo Sapiens
HGEGSMAKK

SEQ ID NO: 631869 - protein, 9 aa, Homo Sapiens
AVGMSIDIA

SEQ ID NO: 631870 - protein, 9 aa, Homo Sapiens
DKCSVSRDP

SEQ ID NO: 631871 - protein, 9 aa, Homo Sapiens
TKKWRPRKG

SEQ ID NO: 631872 - protein, 9 aa, Homo Sapiens
KQAQLRAPT

SEQ ID NO: 631873 - protein, 9 aa, Homo Sapiens
AFTCAFGGA

SEQ ID NO: 631874 - protein, 9 aa, Homo Sapiens
TPSSEKLAS

SEQ ID NO: 631875 - protein, 9 aa, Homo Sapiens
FRRFRQPQW

SEQ ID NO: 631876 - protein, 9 aa, Homo Sapiens
MSMDFNATG

SEQ ID NO: 631877 - protein, 9 aa, Homo Sapiens
LYALKTVIN

SEQ ID NO: 631878 - protein, 9 aa, Homo Sapiens
VCSREGPPK

SEQ ID NO: 631879 - protein, 9 aa, Homo Sapiens
TITIPHLRG

SEQ ID NO: 631880 - protein, 9 aa, Homo Sapiens
LEIYERQQQ

SEQ ID NO: 631881 - protein, 9 aa, Homo Sapiens
QYVIKAVDE

SEQ ID NO: 631882 - protein, 9 aa, Homo Sapiens
NNLSTPLEC

SEQ ID NO: 631883 - protein, 9 aa, Homo Sapiens
PRDCDHLVA

SEQ ID NO: 631884 - protein, 9 aa, Homo Sapiens
KFHPGLMFP

SEQ ID NO: 631885 - protein, 9 aa, Homo Sapiens
PDRLSYFHF

SEQ ID NO: 631886 - protein, 9 aa, Homo Sapiens
VSNSQLHDF

SEQ ID NO: 631887 - protein, 9 aa, Homo Sapiens
AGLPPLGSN

SEQ ID NO: 631888 - protein, 9 aa, Homo Sapiens
LILGYTPVS

SEQ ID NO: 631889 - protein, 9 aa, Homo Sapiens
RTKPRFQSV

SEQ ID NO: 631890 - protein, 9 aa, Homo Sapiens
ILQLDWSDL

SEQ ID NO: 631891 - protein, 9 aa, Homo Sapiens
PELCPRTCH

SEQ ID NO: 631892 - protein, 9 aa, Homo Sapiens
GERVAKGPK

SEQ ID NO: 631893 - protein, 9 aa, Homo Sapiens
HVNAIRGLQ

SEQ ID NO: 631894 - protein, 9 aa, Homo Sapiens
LNGHKRLCL

SEQ ID NO: 631895 - protein, 9 aa, Homo Sapiens
LNVSLRSQH

SEQ ID NO: 631896 - protein, 9 aa, Homo Sapiens
FLCKRPLDS

SEQ ID NO: 631897 - protein, 9 aa, Homo Sapiens
KTVKPLVWK

SEQ ID NO: 631898 - protein, 9 aa, Homo Sapiens
KGLHYWELH

SEQ ID NO: 631899 - protein, 9 aa, Homo Sapiens
AWNQGRTWS

SEQ ID NO: 631900 - protein, 9 aa, Homo Sapiens
VPPPKNLTS

SEQ ID NO: 631901 - protein, 9 aa, Homo Sapiens
NSNISGYSE

SEQ ID NO: 631902 - protein, 9 aa, Homo Sapiens
LKQALANGM

SEQ ID NO: 631903 - protein, 9 aa, Homo Sapiens
ILQEPTCQI

SEQ ID NO: 631904 - protein, 9 aa, Homo Sapiens
YEKDSSSTD

SEQ ID NO: 631905 - protein, 9 aa, Homo Sapiens
ARWRQNLGN

SEQ ID NO: 631906 - protein, 9 aa, Homo Sapiens
EEKRHRKRS

SEQ ID NO: 631907 - protein, 9 aa, Homo Sapiens
KFESLIKKD

SEQ ID NO: 631908 - protein, 9 aa, Homo Sapiens
DEQQGSIAF

SEQ ID NO: 631909 - protein, 9 aa, Homo Sapiens
KFCDMTVFE

SEQ ID NO: 631910 - protein, 9 aa, Homo Sapiens
LPENIIHAF

SEQ ID NO: 631911 - protein, 9 aa, Homo Sapiens
FVRVLCTCY

SEQ ID NO: 631912 - protein, 9 aa, Homo Sapiens
IFSPGRVYE

SEQ ID NO: 631913 - protein, 9 aa, Homo Sapiens
VTRSIHEEA

SEQ ID NO: 631914 - protein, 9 aa, Homo Sapiens
LAENSLGPN

SEQ ID NO: 631915 - protein, 9 aa, Homo Sapiens
LIEDSGQPV

SEQ ID NO: 631916 - protein, 9 aa, Homo Sapiens
ADLRLTVEE

SEQ ID NO: 631917 - protein, 9 aa, Homo Sapiens
AFSPLLHTP

SEQ ID NO: 631918 - protein, 9 aa, Homo Sapiens
DLEDINYFG

SEQ ID NO: 631919 - protein, 9 aa, Homo Sapiens
DSPAVKLMK

SEQ ID NO: 631920 - protein, 9 aa, Homo Sapiens
THLSIADIL

SEQ ID NO: 631921 - protein, 9 aa, Homo Sapiens
ADILLLFCI

SEQ ID NO: 631922 - protein, 9 aa, Homo Sapiens
ATDLFVSVC

SEQ ID NO: 631923 - protein, 9 aa, Homo Sapiens
FVLEKCQVP

SEQ ID NO: 631924 - protein, 9 aa, Homo Sapiens
HCEPALGNE

SEQ ID NO: 631925 - protein, 9 aa, Homo Sapiens
VALQDQCKL

SEQ ID NO: 631926 - protein, 9 aa, Homo Sapiens
FAFADIGPP

SEQ ID NO: 631927 - protein, 9 aa, Homo Sapiens
PGSDILRAD

SEQ ID NO: 631928 - protein, 9 aa, Homo Sapiens
DGIGGDGFF

SEQ ID NO: 631929 - protein, 9 aa, Homo Sapiens
TYAHTVNPN

SEQ ID NO: 631930 - protein, 9 aa, Homo Sapiens
HTPLNPASQ

SEQ ID NO: 631931 - protein, 9 aa, Homo Sapiens
GLQHTNIVR

SEQ ID NO: 631932 - protein, 9 aa, Homo Sapiens
NLKPYTGGG

SEQ ID NO: 631933 - protein, 9 aa, Homo Sapiens
LCRAWNQGR

SEQ ID NO: 631934 - protein, 9 aa, Homo Sapiens
DINYFGDDG

SEQ ID NO: 631935 - protein, 9 aa, Homo Sapiens
AYSTCPSHI

SEQ ID NO: 631936 - protein, 9 aa, Homo Sapiens
QENGNQSRV

SEQ ID NO: 631937 - protein, 9 aa, Homo Sapiens
AFVIVLLLL

SEQ ID NO: 631938 - protein, 9 aa, Homo Sapiens
VDVLSQLSY

SEQ ID NO: 631939 - protein, 9 aa, Homo Sapiens
IEDGKVEVT

SEQ ID NO: 631940 - protein, 9 aa, Homo Sapiens
KAQLKALFS

SEQ ID NO: 631941 - protein, 9 aa, Homo Sapiens
CLRGSILFK

SEQ ID NO: 631942 - protein, 9 aa, Homo Sapiens
DILRADYIP

SEQ ID NO: 631943 - protein, 9 aa, Homo Sapiens
KIPRRDEGE

SEQ ID NO: 631944 - protein, 9 aa, Homo Sapiens
SPAISSQNV

SEQ ID NO: 631945 - protein, 9 aa, Homo Sapiens
AYYFCWEPI

SEQ ID NO: 631946 - protein, 9 aa, Homo Sapiens
GQGDLPWLI

SEQ ID NO: 631947 - protein, 9 aa, Homo Sapiens
KSVWSGLDG

SEQ ID NO: 631948 - protein, 9 aa, Homo Sapiens
QYYFDSTCE

SEQ ID NO: 631949 - protein, 9 aa, Homo Sapiens
DRVQNAYTL

SEQ ID NO: 631950 - protein, 9 aa, Homo Sapiens
GQSEELPPQ

SEQ ID NO: 631951 - protein, 9 aa, Homo Sapiens
KIRERNKPD

SEQ ID NO: 631952 - protein, 9 aa, Homo Sapiens
EMRSHYVAK

SEQ ID NO: 631953 - protein, 9 aa, Homo Sapiens
PLVKKGLRH

SEQ ID NO: 631954 - protein, 9 aa, Homo Sapiens
ESLAKDHCM

SEQ ID NO: 631955 - protein, 9 aa, Homo Sapiens
AGIALDERG

SEQ ID NO: 631956 - protein, 9 aa, Homo Sapiens
GMRSPYAGL

SEQ ID NO: 631957 - protein, 9 aa, Homo Sapiens
FRHCEPALG

SEQ ID NO: 631958 - protein, 9 aa, Homo Sapiens
CHLNMQHQE

SEQ ID NO: 631959 - protein, 9 aa, Homo Sapiens
KKQLLLLEA

SEQ ID NO: 631960 - protein, 9 aa, Homo Sapiens
VKTNLDFKF

SEQ ID NO: 631961 - protein, 9 aa, Homo Sapiens
GHSPAISSQ

SEQ ID NO: 631962 - protein, 9 aa, Homo Sapiens
SKGDVWLGL

SEQ ID NO: 631963 - protein, 9 aa, Homo Sapiens
YVPEAVEWM

SEQ ID NO: 631964 - protein, 9 aa, Homo Sapiens
ISSFTSFIA

SEQ ID NO: 631965 - protein, 9 aa, Homo Sapiens
ISVVVILSS

SEQ ID NO: 631966 - protein, 9 aa, Homo Sapiens
QSQRHRPTK

SEQ ID NO: 631967 - protein, 9 aa, Homo Sapiens
LVLMVTYIV

SEQ ID NO: 631968 - protein, 9 aa, Homo Sapiens
MCVSSLTIL

SEQ ID NO: 631969 - protein, 9 aa, Homo Sapiens
EGHTEIDHH

SEQ ID NO: 631970 - protein, 9 aa, Homo Sapiens
TLKQGVLEV

SEQ ID NO: 631971 - protein, 9 aa, Homo Sapiens
SLRDDFGNM

SEQ ID NO: 631972 - protein, 9 aa, Homo Sapiens
SPKFQFDRI

SEQ ID NO: 631973 - protein, 9 aa, Homo Sapiens
PGTGLGSHQ

SEQ ID NO: 631974 - protein, 9 aa, Homo Sapiens
PVHFHSPPP

SEQ ID NO: 631975 - protein, 9 aa, Homo Sapiens
PARIPPCGC

SEQ ID NO: 631976 - protein, 9 aa, Homo Sapiens
NTVIPQAVR

SEQ ID NO: 631977 - protein, 9 aa, Homo Sapiens
RTPEVHSRV

SEQ ID NO: 631978 - protein, 9 aa, Homo Sapiens
YAVRLRERP

SEQ ID NO: 631979 - protein, 9 aa, Homo Sapiens
GAGPNVSAI

SEQ ID NO: 631980 - protein, 9 aa, Homo Sapiens
IPGSDILRA

SEQ ID NO: 631981 - protein, 9 aa, Homo Sapiens
SLIREMRTL

SEQ ID NO: 631982 - protein, 9 aa, Homo Sapiens
PVTPTPSKY

SEQ ID NO: 631983 - protein, 9 aa, Homo Sapiens
LARKAHVAT

SEQ ID NO: 631984 - protein, 9 aa, Homo Sapiens
ITFEHIMSL

SEQ ID NO: 631985 - protein, 9 aa, Homo Sapiens
SSSAFLKAE

SEQ ID NO: 631986 - protein, 9 aa, Homo Sapiens
APEPEEHEE

SEQ ID NO: 631987 - protein, 9 aa, Homo Sapiens
KNCAHGEGS

SEQ ID NO: 631988 - protein, 9 aa, Homo Sapiens
YSLEVCLKY

SEQ ID NO: 631989 - protein, 9 aa, Homo Sapiens
MIVLDRLKY

SEQ ID NO: 631990 - protein, 9 aa, Homo Sapiens
AMANDRYVA

SEQ ID NO: 631991 - protein, 9 aa, Homo Sapiens
ACRIPSVRT

SEQ ID NO: 631992 - protein, 9 aa, Homo Sapiens
AAGLYVGQY

SEQ ID NO: 631993 - protein, 9 aa, Homo Sapiens
RSHREVTMK

SEQ ID NO: 631994 - protein, 9 aa, Homo Sapiens
MTDNAPPGV

SEQ ID NO: 631995 - protein, 9 aa, Homo Sapiens
VIYGDQYAS

SEQ ID NO: 631996 - protein, 9 aa, Homo Sapiens
ELADGDIMD

SEQ ID NO: 631997 - protein, 9 aa, Homo Sapiens
CGSGFYKSS

SEQ ID NO: 631998 - protein, 9 aa, Homo Sapiens
ERKEEDDAL

SEQ ID NO: 631999 - protein, 9 aa, Homo Sapiens
PAARHHNLD

SEQ ID NO: 632000 - protein, 9 aa, Homo Sapiens
GYYKATKCH

SEQ ID NO: 632001 - protein, 9 aa, Homo Sapiens
CQTSFCGYR

SEQ ID NO: 632002 - protein, 9 aa, Homo Sapiens
PCTEHIKRK

SEQ ID NO: 632003 - protein, 9 aa, Homo Sapiens
RSQLYVGRE

SEQ ID NO: 632004 - protein, 9 aa, Homo Sapiens
DDGVGVGDE

SEQ ID NO: 632005 - protein, 9 aa, Homo Sapiens
APSPLPQAA

SEQ ID NO: 632006 - protein, 9 aa, Homo Sapiens
TNYLMLLLN

SEQ ID NO: 632007 - protein, 9 aa, Homo Sapiens
SISHDSPAV

SEQ ID NO: 632008 - protein, 9 aa, Homo Sapiens
SHVAESFQM

SEQ ID NO: 632009 - protein, 9 aa, Homo Sapiens
VNPNWYSDA

SEQ ID NO: 632010 - protein, 9 aa, Homo Sapiens
GLQVEEAAV

SEQ ID NO: 632011 - protein, 9 aa, Homo Sapiens
IFFITCMGV

SEQ ID NO: 632012 - protein, 9 aa, Homo Sapiens
ECAHCSCCH

SEQ ID NO: 632013 - protein, 9 aa, Homo Sapiens
GCGKGVQAG

SEQ ID NO: 632014 - protein, 9 aa, Homo Sapiens
YLPDCDYLA

SEQ ID NO: 632015 - protein, 9 aa, Homo Sapiens
IGDFRLATV

SEQ ID NO: 632016 - protein, 9 aa, Homo Sapiens
LVILAAVQV

SEQ ID NO: 632017 - protein, 9 aa, Homo Sapiens
QRWYVPEAV

SEQ ID NO: 632018 - protein, 9 aa, Homo Sapiens
FSHRFVGHN

SEQ ID NO: 632019 - protein, 9 aa, Homo Sapiens
ELVEQRKRK

SEQ ID NO: 632020 - protein, 9 aa, Homo Sapiens
NSKWKAETW

SEQ ID NO: 632021 - protein, 9 aa, Homo Sapiens
RSFSGKNKS

SEQ ID NO: 632022 - protein, 9 aa, Homo Sapiens
GYVSSVRYR

SEQ ID NO: 632023 - protein, 9 aa, Homo Sapiens
FGTPIVNPP

SEQ ID NO: 632024 - protein, 9 aa, Homo Sapiens
EEGPSRRPG

SEQ ID NO: 632025 - protein, 9 aa, Homo Sapiens
AAPEPEEHE

SEQ ID NO: 632026 - protein, 9 aa, Homo Sapiens
SSAFVELST

SEQ ID NO: 632027 - protein, 9 aa, Homo Sapiens
LRSQHTHSM

SEQ ID NO: 632028 - protein, 9 aa, Homo Sapiens
KPSSILNTT

SEQ ID NO: 632029 - protein, 9 aa, Homo Sapiens
EPPGTPEIQ

SEQ ID NO: 632030 - protein, 9 aa, Homo Sapiens
VGLLNSMTH

SEQ ID NO: 632031 - protein, 9 aa, Homo Sapiens
PYWEMSNQY

SEQ ID NO: 632032 - protein, 9 aa, Homo Sapiens
GDYDPYEHP

SEQ ID NO: 632033 - protein, 9 aa, Homo Sapiens
PPFKSVWSG

SEQ ID NO: 632034 - protein, 9 aa, Homo Sapiens
SVYTRKGKS

SEQ ID NO: 632035 - protein, 9 aa, Homo Sapiens
YPVLKVNGV

SEQ ID NO: 632036 - protein, 9 aa, Homo Sapiens
VFHLPILIE

SEQ ID NO: 632037 - protein, 9 aa, Homo Sapiens
KGDVWLGLV

SEQ ID NO: 632038 - protein, 9 aa, Homo Sapiens
GTSGGDCPH

SEQ ID NO: 632039 - protein, 9 aa, Homo Sapiens
QSPAVISLG

SEQ ID NO: 632040 - protein, 9 aa, Homo Sapiens
VTAHLNGHK

SEQ ID NO: 632041 - protein, 9 aa, Homo Sapiens
AQMKEDRRC

SEQ ID NO: 632042 - protein, 9 aa, Homo Sapiens
NVWSLAVGN

SEQ ID NO: 632043 - protein, 9 aa, Homo Sapiens
CAFTTSSLE

SEQ ID NO: 632044 - protein, 9 aa, Homo Sapiens
AGHGAGGRR

SEQ ID NO: 632045 - protein, 9 aa, Homo Sapiens
TRCREFVPS

SEQ ID NO: 632046 - protein, 9 aa, Homo Sapiens
YTDCADKEN

SEQ ID NO: 632047 - protein, 9 aa, Homo Sapiens
LAAAFQPVL

SEQ ID NO: 632048 - protein, 9 aa, Homo Sapiens
PGAISPYRK

SEQ ID NO: 632049 - protein, 9 aa, Homo Sapiens
GSKHVSLSL

SEQ ID NO: 632050 - protein, 9 aa, Homo Sapiens
SVAELLGAG

SEQ ID NO: 632051 - protein, 9 aa, Homo Sapiens
HLVEEAFRA

SEQ ID NO: 632052 - protein, 9 aa, Homo Sapiens
ELCYQNEFH

SEQ ID NO: 632053 - protein, 9 aa, Homo Sapiens
DADVEERYH

SEQ ID NO: 632054 - protein, 9 aa, Homo Sapiens
LVHYAVTVD

SEQ ID NO: 632055 - protein, 9 aa, Homo Sapiens
LPDCDYLAP

SEQ ID NO: 632056 - protein, 9 aa, Homo Sapiens
APVTPGVVL

SEQ ID NO: 632057 - protein, 9 aa, Homo Sapiens
LSSSLVIHR

SEQ ID NO: 632058 - protein, 9 aa, Homo Sapiens
QDWNSRGDL

SEQ ID NO: 632059 - protein, 9 aa, Homo Sapiens
QEWRLLGNV

SEQ ID NO: 632060 - protein, 9 aa, Homo Sapiens
QAYSTCPSH

SEQ ID NO: 632061 - protein, 9 aa, Homo Sapiens
LYPAKMALD

SEQ ID NO: 632062 - protein, 9 aa, Homo Sapiens
TEDALHPVP

SEQ ID NO: 632063 - protein, 9 aa, Homo Sapiens
TVTKKDALL

SEQ ID NO: 632064 - protein, 9 aa, Homo Sapiens
CINCFFPEL

SEQ ID NO: 632065 - protein, 9 aa, Homo Sapiens
GDYAPLQQV

SEQ ID NO: 632066 - protein, 9 aa, Homo Sapiens
RERCSNLAF

SEQ ID NO: 632067 - protein, 9 aa, Homo Sapiens
EMIATLQLF

SEQ ID NO: 632068 - protein, 9 aa, Homo Sapiens
GLRHGYFVE

SEQ ID NO: 632069 - protein, 9 aa, Homo Sapiens
MLAAWFMMK

SEQ ID NO: 632070 - protein, 9 aa, Homo Sapiens
YSLGTSSLF

SEQ ID NO: 632071 - protein, 9 aa, Homo Sapiens
SCDLRRLVM

SEQ ID NO: 632072 - protein, 9 aa, Homo Sapiens
TDEDSTNVA

SEQ ID NO: 632073 - protein, 9 aa, Homo Sapiens
RRILQLDWS

SEQ ID NO: 632074 - protein, 9 aa, Homo Sapiens
ILNPGEYSV

SEQ ID NO: 632075 - protein, 9 aa, Homo Sapiens
RHWKTILIN

SEQ ID NO: 632076 - protein, 9 aa, Homo Sapiens
KYYNLKPYT

SEQ ID NO: 632077 - protein, 9 aa, Homo Sapiens
EESSKRGLF

SEQ ID NO: 632078 - protein, 9 aa, Homo Sapiens
ATYNISKLF

SEQ ID NO: 632079 - protein, 9 aa, Homo Sapiens
EHPQPHTTP

SEQ ID NO: 632080 - protein, 9 aa, Homo Sapiens
TGSSRLAWP

SEQ ID NO: 632081 - protein, 9 aa, Homo Sapiens
LQAGLGQLK

SEQ ID NO: 632082 - protein, 9 aa, Homo Sapiens
TMPPYKEAS

SEQ ID NO: 632083 - protein, 9 aa, Homo Sapiens
PVPPLMGSF

SEQ ID NO: 632084 - protein, 9 aa, Homo Sapiens
YQMVWTPNM

SEQ ID NO: 632085 - protein, 9 aa, Homo Sapiens
AAFVIVAVN

SEQ ID NO: 632086 - protein, 9 aa, Homo Sapiens
AVVLWTFLF

SEQ ID NO: 632087 - protein, 9 aa, Homo Sapiens
LNDTFFDRA

SEQ ID NO: 632088 - protein, 9 aa, Homo Sapiens
GASCMLGPG

SEQ ID NO: 632089 - protein, 9 aa, Homo Sapiens
IPSAADWSE

SEQ ID NO: 632090 - protein, 9 aa, Homo Sapiens
AGVVGGYRG

SEQ ID NO: 632091 - protein, 9 aa, Homo Sapiens
LGSKHVSLS

SEQ ID NO: 632092 - protein, 9 aa, Homo Sapiens
CDQCFHGYY

SEQ ID NO: 632093 - protein, 9 aa, Homo Sapiens
IDGRDPGNG

SEQ ID NO: 632094 - protein, 9 aa, Homo Sapiens
GCVRFDCDK

SEQ ID NO: 632095 - protein, 9 aa, Homo Sapiens
YCWVSINHM

SEQ ID NO: 632096 - protein, 9 aa, Homo Sapiens
ETSFQVPLS

SEQ ID NO: 632097 - protein, 9 aa, Homo Sapiens
LMLHFFHPH

SEQ ID NO: 632098 - protein, 9 aa, Homo Sapiens
RLKREQEDA

SEQ ID NO: 632099 - protein, 9 aa, Homo Sapiens
TFGGTFDLV

SEQ ID NO: 632100 - protein, 9 aa, Homo Sapiens
EVRLLPQDR

SEQ ID NO: 632101 - protein, 9 aa, Homo Sapiens
MSENVLYQN

SEQ ID NO: 632102 - protein, 9 aa, Homo Sapiens
PQQEDQNKP

SEQ ID NO: 632103 - protein, 9 aa, Homo Sapiens
LSGLVPSGG

SEQ ID NO: 632104 - protein, 9 aa, Homo Sapiens
PGVVLVPTE

SEQ ID NO: 632105 - protein, 9 aa, Homo Sapiens
AMQDKFILK

SEQ ID NO: 632106 - protein, 9 aa, Homo Sapiens
LISVKMSEA

SEQ ID NO: 632107 - protein, 9 aa, Homo Sapiens
ARTSLSAHG

SEQ ID NO: 632108 - protein, 9 aa, Homo Sapiens
PFLPFFLQM

SEQ ID NO: 632109 - protein, 9 aa, Homo Sapiens
SGGILEVSY

SEQ ID NO: 632110 - protein, 9 aa, Homo Sapiens
GAKDKTAQQ

SEQ ID NO: 632111 - protein, 9 aa, Homo Sapiens
GDCPHGPPG

SEQ ID NO: 632112 - protein, 9 aa, Homo Sapiens
MVNIRDMSE

SEQ ID NO: 632113 - protein, 9 aa, Homo Sapiens
CMEKEGCME

SEQ ID NO: 632114 - protein, 9 aa, Homo Sapiens
GYPVLKVNG

SEQ ID NO: 632115 - protein, 9 aa, Homo Sapiens
HSLGPDGGG

SEQ ID NO: 632116 - protein, 9 aa, Homo Sapiens
ITHPNDEEA

SEQ ID NO: 632117 - protein, 9 aa, Homo Sapiens
LSRVHGHSS

SEQ ID NO: 632118 - protein, 9 aa, Homo Sapiens
AAYFFSFRK

SEQ ID NO: 632119 - protein, 9 aa, Homo Sapiens
IIHAFPSSL

SEQ ID NO: 632120 - protein, 9 aa, Homo Sapiens
PLPDIEWII

SEQ ID NO: 632121 - protein, 9 aa, Homo Sapiens
YLLTLNDTF

SEQ ID NO: 632122 - protein, 9 aa, Homo Sapiens
TRPCHPLAP

SEQ ID NO: 632123 - protein, 9 aa, Homo Sapiens
AMRKCAKEV

SEQ ID NO: 632124 - protein, 9 aa, Homo Sapiens
TGAEIDKTE

SEQ ID NO: 632125 - protein, 9 aa, Homo Sapiens
TTLCQWKIF

SEQ ID NO: 632126 - protein, 9 aa, Homo Sapiens
FEFEIQCHP

SEQ ID NO: 632127 - protein, 9 aa, Homo Sapiens
QERFLAGSL

SEQ ID NO: 632128 - protein, 9 aa, Homo Sapiens
CEYEAIKQQ

SEQ ID NO: 632129 - protein, 9 aa, Homo Sapiens
RKITCDVNI

SEQ ID NO: 632130 - protein, 9 aa, Homo Sapiens
SLRSQHTHS

SEQ ID NO: 632131 - protein, 9 aa, Homo Sapiens
FQKVTDHST

SEQ ID NO: 632132 - protein, 9 aa, Homo Sapiens
GHDLYCYSY

SEQ ID NO: 632133 - protein, 9 aa, Homo Sapiens
AQTQLQIPM

SEQ ID NO: 632134 - protein, 9 aa, Homo Sapiens
GNAVVLWTF

SEQ ID NO: 632135 - protein, 9 aa, Homo Sapiens
TSVSVARDC

SEQ ID NO: 632136 - protein, 9 aa, Homo Sapiens
EQQRLHREM

SEQ ID NO: 632137 - protein, 9 aa, Homo Sapiens
YVRSRLQCI

SEQ ID NO: 632138 - protein, 9 aa, Homo Sapiens
HELFHTIYT

SEQ ID NO: 632139 - protein, 9 aa, Homo Sapiens
PQELSFLRG

SEQ ID NO: 632140 - protein, 9 aa, Homo Sapiens
KAGLAVDVA

SEQ ID NO: 632141 - protein, 9 aa, Homo Sapiens
AKQKTPPPL

SEQ ID NO: 632142 - protein, 9 aa, Homo Sapiens
ANDRYVAIC

SEQ ID NO: 632143 - protein, 9 aa, Homo Sapiens
HYHHSGTAT

SEQ ID NO: 632144 - protein, 9 aa, Homo Sapiens
TLHHRIETK

SEQ ID NO: 632145 - protein, 9 aa, Homo Sapiens
HHHHHHYHH

SEQ ID NO: 632146 - protein, 9 aa, Homo Sapiens
CHLQKKQLL

SEQ ID NO: 632147 - protein, 9 aa, Homo Sapiens
DEIKKFESL

SEQ ID NO: 632148 - protein, 9 aa, Homo Sapiens
GGGGGKPLA

SEQ ID NO: 632149 - protein, 9 aa, Homo Sapiens
SLAWDISGT

SEQ ID NO: 632150 - protein, 9 aa, Homo Sapiens
LTITLTDVN

SEQ ID NO: 632151 - protein, 9 aa, Homo Sapiens
LSQDKMLFP

SEQ ID NO: 632152 - protein, 9 aa, Homo Sapiens
VRLLPQDRV

SEQ ID NO: 632153 - protein, 9 aa, Homo Sapiens
NGSFNQPLR

SEQ ID NO: 632154 - protein, 9 aa, Homo Sapiens
CSSAAAGAC

SEQ ID NO: 632155 - protein, 9 aa, Homo Sapiens
WNSRGDLTV

SEQ ID NO: 632156 - protein, 9 aa, Homo Sapiens
EKRHLHEMA

SEQ ID NO: 632157 - protein, 9 aa, Homo Sapiens
NLDFKFPNG

SEQ ID NO: 632158 - protein, 9 aa, Homo Sapiens
QWEYPRLEN

SEQ ID NO: 632159 - protein, 9 aa, Homo Sapiens
ATLQLFMDD

SEQ ID NO: 632160 - protein, 9 aa, Homo Sapiens
WRLLGNVVA

SEQ ID NO: 632161 - protein, 9 aa, Homo Sapiens
SLGGGDEPE

SEQ ID NO: 632162 - protein, 9 aa, Homo Sapiens
ENVTLLCLS

SEQ ID NO: 632163 - protein, 9 aa, Homo Sapiens
GILFVNSRK

SEQ ID NO: 632164 - protein, 9 aa, Homo Sapiens
VSTYSIRVY

SEQ ID NO: 632165 - protein, 9 aa, Homo Sapiens
PGTPEIQAP

SEQ ID NO: 632166 - protein, 9 aa, Homo Sapiens
GENCEKQYP

SEQ ID NO: 632167 - protein, 9 aa, Homo Sapiens
NELISVKMS

SEQ ID NO: 632168 - protein, 9 aa, Homo Sapiens
LMAVGHDLY

SEQ ID NO: 632169 - protein, 9 aa, Homo Sapiens
DCDHLVACT

SEQ ID NO: 632170 - protein, 9 aa, Homo Sapiens
KEDRRCTGY

SEQ ID NO: 632171 - protein, 9 aa, Homo Sapiens
QMVWTPNMS

SEQ ID NO: 632172 - protein, 9 aa, Homo Sapiens
HHFAKAIAI

SEQ ID NO: 632173 - protein, 9 aa, Homo Sapiens
MMSKTLCIH

SEQ ID NO: 632174 - protein, 9 aa, Homo Sapiens
EHIKRKGLL

SEQ ID NO: 632175 - protein, 9 aa, Homo Sapiens
STYSIRVYA

SEQ ID NO: 632176 - protein, 9 aa, Homo Sapiens
KKAEGAQNK

SEQ ID NO: 632177 - protein, 9 aa, Homo Sapiens
LKDRLPLRA

SEQ ID NO: 632178 - protein, 9 aa, Homo Sapiens
QHGPYIRDY

SEQ ID NO: 632179 - protein, 9 aa, Homo Sapiens
QACSISDAR

SEQ ID NO: 632180 - protein, 9 aa, Homo Sapiens
FGDVFRSHT

SEQ ID NO: 632181 - protein, 9 aa, Homo Sapiens
LREAVDCVR

SEQ ID NO: 632182 - protein, 9 aa, Homo Sapiens
AGGQIFFSS

SEQ ID NO: 632183 - protein, 9 aa, Homo Sapiens
LEKKERERC

SEQ ID NO: 632184 - protein, 9 aa, Homo Sapiens
ARHHNLDMF

SEQ ID NO: 632185 - protein, 9 aa, Homo Sapiens
GRGADPDAR

SEQ ID NO: 632186 - protein, 9 aa, Homo Sapiens
GHLGQRWHL

SEQ ID NO: 632187 - protein, 9 aa, Homo Sapiens
KSLRDDFGN

SEQ ID NO: 632188 - protein, 9 aa, Homo Sapiens
NVSAIREIM

SEQ ID NO: 632189 - protein, 9 aa, Homo Sapiens
WNKYFKSWR

SEQ ID NO: 632190 - protein, 9 aa, Homo Sapiens
LEKCQVPAS

SEQ ID NO: 632191 - protein, 9 aa, Homo Sapiens
LSNSPGSSS

SEQ ID NO: 632192 - protein, 9 aa, Homo Sapiens
WEATCIWDH

SEQ ID NO: 632193 - protein, 9 aa, Homo Sapiens
AAVLTFGGT

SEQ ID NO: 632194 - protein, 9 aa, Homo Sapiens
FMIVLDRLK

SEQ ID NO: 632195 - protein, 9 aa, Homo Sapiens
AIAAFVIVA

SEQ ID NO: 632196 - protein, 9 aa, Homo Sapiens
EGPACLPGP

SEQ ID NO: 632197 - protein, 9 aa, Homo Sapiens
VHLRREVET

SEQ ID NO: 632198 - protein, 9 aa, Homo Sapiens
VEPQRQWQE

SEQ ID NO: 632199 - protein, 9 aa, Homo Sapiens
YLMLLLNEA

SEQ ID NO: 632200 - protein, 9 aa, Homo Sapiens
KIACALNKG

SEQ ID NO: 632201 - protein, 9 aa, Homo Sapiens
YDPYEHPEN

SEQ ID NO: 632202 - protein, 9 aa, Homo Sapiens
MENGNIKVL

SEQ ID NO: 632203 - protein, 9 aa, Homo Sapiens
KVRQRIVAL

SEQ ID NO: 632204 - protein, 9 aa, Homo Sapiens
LNDEKNWGL

SEQ ID NO: 632205 - protein, 9 aa, Homo Sapiens
RRGKAVRMA

SEQ ID NO: 632206 - protein, 9 aa, Homo Sapiens
FLTILMPCT

SEQ ID NO: 632207 - protein, 9 aa, Homo Sapiens
LVSHESSAE

SEQ ID NO: 632208 - protein, 9 aa, Homo Sapiens
HQQLGRGSP

SEQ ID NO: 632209 - protein, 9 aa, Homo Sapiens
CKPNSVYEN

SEQ ID NO: 632210 - protein, 9 aa, Homo Sapiens
QDLRKHCLD

SEQ ID NO: 632211 - protein, 9 aa, Homo Sapiens
HKKSVNGES

SEQ ID NO: 632212 - protein, 9 aa, Homo Sapiens
LKTTTLGPS

SEQ ID NO: 632213 - protein, 9 aa, Homo Sapiens
SSVKSVKML

SEQ ID NO: 632214 - protein, 9 aa, Homo Sapiens
VGGQRALLI

SEQ ID NO: 632215 - protein, 9 aa, Homo Sapiens
AEGYPLYPG

SEQ ID NO: 632216 - protein, 9 aa, Homo Sapiens
TFQHDFVPQ

SEQ ID NO: 632217 - protein, 9 aa, Homo Sapiens
QVTGLWKDP

SEQ ID NO: 632218 - protein, 9 aa, Homo Sapiens
TVKIGDFRL

SEQ ID NO: 632219 - protein, 9 aa, Homo Sapiens
GSAMAAYED

SEQ ID NO: 632220 - protein, 9 aa, Homo Sapiens
YLSCRHNIV

SEQ ID NO: 632221 - protein, 9 aa, Homo Sapiens
MDSTKRNNR

SEQ ID NO: 632222 - protein, 9 aa, Homo Sapiens
MFLKHLNLC

SEQ ID NO: 632223 - protein, 9 aa, Homo Sapiens
EKVSIEKIR

SEQ ID NO: 632224 - protein, 9 aa, Homo Sapiens
VSGCPAPPP

SEQ ID NO: 632225 - protein, 9 aa, Homo Sapiens
QLNEIHSLG

SEQ ID NO: 632226 - protein, 9 aa, Homo Sapiens
EAISEVFEY

SEQ ID NO: 632227 - protein, 9 aa, Homo Sapiens
VTPGVVLVP

SEQ ID NO: 632228 - protein, 9 aa, Homo Sapiens
YCEAYYHAK

SEQ ID NO: 632229 - protein, 9 aa, Homo Sapiens
LRAELPPED

SEQ ID NO: 632230 - protein, 9 aa, Homo Sapiens
QIGAATDIE

SEQ ID NO: 632231 - protein, 9 aa, Homo Sapiens
LLLNEAGHA

SEQ ID NO: 632232 - protein, 9 aa, Homo Sapiens
LSADDLEIK

SEQ ID NO: 632233 - protein, 9 aa, Homo Sapiens
CIADESIAD

SEQ ID NO: 632234 - protein, 9 aa, Homo Sapiens
PQGPHQQGG

SEQ ID NO: 632235 - protein, 9 aa, Homo Sapiens
DALYLAHLW

SEQ ID NO: 632236 - protein, 9 aa, Homo Sapiens
LAKDHCMKL

SEQ ID NO: 632237 - protein, 9 aa, Homo Sapiens
RSLQALVAW

SEQ ID NO: 632238 - protein, 9 aa, Homo Sapiens
SPLPQAAAG

SEQ ID NO: 632239 - protein, 9 aa, Homo Sapiens
KGILVHADR

SEQ ID NO: 632240 - protein, 9 aa, Homo Sapiens
APCEGIVCS

SEQ ID NO: 632241 - protein, 9 aa, Homo Sapiens
IRNHREKKL

SEQ ID NO: 632242 - protein, 9 aa, Homo Sapiens
HARTSFSSV

SEQ ID NO: 632243 - protein, 9 aa, Homo Sapiens
ILLVSGGGY

SEQ ID NO: 632244 - protein, 9 aa, Homo Sapiens
LLFYTMKPS

SEQ ID NO: 632245 - protein, 9 aa, Homo Sapiens
SLASDRFNL

SEQ ID NO: 632246 - protein, 9 aa, Homo Sapiens
RVVEEDKED

SEQ ID NO: 632247 - protein, 9 aa, Homo Sapiens
LPLRAREDY

SEQ ID NO: 632248 - protein, 9 aa, Homo Sapiens
QWGEPGQPA

SEQ ID NO: 632249 - protein, 9 aa, Homo Sapiens
DCVHFLRDV

SEQ ID NO: 632250 - protein, 9 aa, Homo Sapiens
NKDSSCVYA

SEQ ID NO: 632251 - protein, 9 aa, Homo Sapiens
QGKPQGPHQ

SEQ ID NO: 632252 - protein, 9 aa, Homo Sapiens
QAEDCIQAW

SEQ ID NO: 632253 - protein, 9 aa, Homo Sapiens
PPITPDEYM

SEQ ID NO: 632254 - protein, 9 aa, Homo Sapiens
RLWGASPTD

SEQ ID NO: 632255 - protein, 9 aa, Homo Sapiens
LGKTTFGSR

SEQ ID NO: 632256 - protein, 9 aa, Homo Sapiens
TTFQHDFVP

SEQ ID NO: 632257 - protein, 9 aa, Homo Sapiens
LLVIDIQTI

SEQ ID NO: 632258 - protein, 9 aa, Homo Sapiens
IRIKNVVLV

SEQ ID NO: 632259 - protein, 9 aa, Homo Sapiens
TFEHIMSLT

SEQ ID NO: 632260 - protein, 9 aa, Homo Sapiens
MNVNEIFIA

SEQ ID NO: 632261 - protein, 9 aa, Homo Sapiens
TGYSPQGLQ

SEQ ID NO: 632262 - protein, 9 aa, Homo Sapiens
SYYAKLLVE

SEQ ID NO: 632263 - protein, 9 aa, Homo Sapiens
GGTCLPCHA

SEQ ID NO: 632264 - protein, 9 aa, Homo Sapiens
LPQHLSIWG

SEQ ID NO: 632265 - protein, 9 aa, Homo Sapiens
PDSVATGLP

SEQ ID NO: 632266 - protein, 9 aa, Homo Sapiens
HTEIDHHKF

SEQ ID NO: 632267 - protein, 9 aa, Homo Sapiens
PTAFLVSCA

SEQ ID NO: 632268 - protein, 9 aa, Homo Sapiens
FYYIDSDGN

SEQ ID NO: 632269 - protein, 9 aa, Homo Sapiens
NKGSRPYSI

SEQ ID NO: 632270 - protein, 9 aa, Homo Sapiens
GTYQRLEEY

SEQ ID NO: 632271 - protein, 9 aa, Homo Sapiens
CKGAVIVVS

SEQ ID NO: 632272 - protein, 9 aa, Homo Sapiens
ANGVLNEKE

SEQ ID NO: 632273 - protein, 9 aa, Homo Sapiens
RLPLRARED

SEQ ID NO: 632274 - protein, 9 aa, Homo Sapiens
DGVTPLIVE

SEQ ID NO: 632275 - protein, 9 aa, Homo Sapiens
ASGGSGSHA

SEQ ID NO: 632276 - protein, 9 aa, Homo Sapiens
NQPLRQLTG

SEQ ID NO: 632277 - protein, 9 aa, Homo Sapiens
LVAMATWSL

SEQ ID NO: 632278 - protein, 9 aa, Homo Sapiens
ECMDLIYHM

SEQ ID NO: 632279 - protein, 9 aa, Homo Sapiens
TVVMQRPVV

SEQ ID NO: 632280 - protein, 9 aa, Homo Sapiens
KNVVLVVPV

SEQ ID NO: 632281 - protein, 9 aa, Homo Sapiens
FLSQPSLCL

SEQ ID NO: 632282 - protein, 9 aa, Homo Sapiens
TQEMVRPSE

SEQ ID NO: 632283 - protein, 9 aa, Homo Sapiens
KEEDDALDS

SEQ ID NO: 632284 - protein, 9 aa, Homo Sapiens
SIPPGAISP

SEQ ID NO: 632285 - protein, 9 aa, Homo Sapiens
CSTLHNIIK

SEQ ID NO: 632286 - protein, 9 aa, Homo Sapiens
DRSSSMLLG

SEQ ID NO: 632287 - protein, 9 aa, Homo Sapiens
WRQNLGNGR

SEQ ID NO: 632288 - protein, 9 aa, Homo Sapiens
TGLWKDPSW

SEQ ID NO: 632289 - protein, 9 aa, Homo Sapiens
IKQELICKL

SEQ ID NO: 632290 - protein, 9 aa, Homo Sapiens
HFSLVHYAV

SEQ ID NO: 632291 - protein, 9 aa, Homo Sapiens
PKNLTSWFT

SEQ ID NO: 632292 - protein, 9 aa, Homo Sapiens
KLKEASTAH

SEQ ID NO: 632293 - protein, 9 aa, Homo Sapiens
KETVVFYEL

SEQ ID NO: 632294 - protein, 9 aa, Homo Sapiens
FTSFIAINK

SEQ ID NO: 632295 - protein, 9 aa, Homo Sapiens
ILKSILCFG

SEQ ID NO: 632296 - protein, 9 aa, Homo Sapiens
PVDVEDCDG

SEQ ID NO: 632297 - protein, 9 aa, Homo Sapiens
HVAESFQMH

SEQ ID NO: 632298 - protein, 9 aa, Homo Sapiens
NSAPSPPNG

SEQ ID NO: 632299 - protein, 9 aa, Homo Sapiens
EPRLGKTTF

SEQ ID NO: 632300 - protein, 9 aa, Homo Sapiens
TTVDTTHME

SEQ ID NO: 632301 - protein, 9 aa, Homo Sapiens
FFHFAGGQI

SEQ ID NO: 632302 - protein, 9 aa, Homo Sapiens
FFQGNKYWV

SEQ ID NO: 632303 - protein, 9 aa, Homo Sapiens
APRSEAAPV

SEQ ID NO: 632304 - protein, 9 aa, Homo Sapiens
AYGALTQTV

SEQ ID NO: 632305 - protein, 9 aa, Homo Sapiens
VVIVLGAED

SEQ ID NO: 632306 - protein, 9 aa, Homo Sapiens
ESSCQLSQR

SEQ ID NO: 632307 - protein, 9 aa, Homo Sapiens
SAAQRCHSL

SEQ ID NO: 632308 - protein, 9 aa, Homo Sapiens
NHPHMQAPS

SEQ ID NO: 632309 - protein, 9 aa, Homo Sapiens
KQYYFDSTC

SEQ ID NO: 632310 - protein, 9 aa, Homo Sapiens
IPMGTFDWL

SEQ ID NO: 632311 - protein, 9 aa, Homo Sapiens
YRSFSISGT

SEQ ID NO: 632312 - protein, 9 aa, Homo Sapiens
SISGIFKEV

SEQ ID NO: 632313 - protein, 9 aa, Homo Sapiens
LITEQLAHC

SEQ ID NO: 632314 - protein, 9 aa, Homo Sapiens
FSGLLEVIT

SEQ ID NO: 632315 - protein, 9 aa, Homo Sapiens
LSMNILYPV

SEQ ID NO: 632316 - protein, 9 aa, Homo Sapiens
GLGRAGTLP

SEQ ID NO: 632317 - protein, 9 aa, Homo Sapiens
NLNKKETTA

SEQ ID NO: 632318 - protein, 9 aa, Homo Sapiens
VAEGYPLYP

SEQ ID NO: 632319 - protein, 9 aa, Homo Sapiens
DSTCEHCQK

SEQ ID NO: 632320 - protein, 9 aa, Homo Sapiens
ACALNKGIK

SEQ ID NO: 632321 - protein, 9 aa, Homo Sapiens
NLGDKPLGC

SEQ ID NO: 632322 - protein, 9 aa, Homo Sapiens
EECSTLHNI

SEQ ID NO: 632323 - protein, 9 aa, Homo Sapiens
TPVVPVPPL

SEQ ID NO: 632324 - protein, 9 aa, Homo Sapiens
MERIKEVAA

SEQ ID NO: 632325 - protein, 9 aa, Homo Sapiens
VSQPEPPSL

SEQ ID NO: 632326 - protein, 9 aa, Homo Sapiens
QGETALHIA

SEQ ID NO: 632327 - protein, 9 aa, Homo Sapiens
MAVYSWDKK

SEQ ID NO: 632328 - protein, 9 aa, Homo Sapiens
AQRSTTKGR

SEQ ID NO: 632329 - protein, 9 aa, Homo Sapiens
DDYYVGEWK

SEQ ID NO: 632330 - protein, 9 aa, Homo Sapiens
EGLRLTGSS

SEQ ID NO: 632331 - protein, 9 aa, Homo Sapiens
PLGPPRSEG

SEQ ID NO: 632332 - protein, 9 aa, Homo Sapiens
GGVACYCRP

SEQ ID NO: 632333 - protein, 9 aa, Homo Sapiens
RSVTTSQLE

SEQ ID NO: 632334 - protein, 9 aa, Homo Sapiens
LSQLSYAPM

SEQ ID NO: 632335 - protein, 9 aa, Homo Sapiens
KLVTRTTLC

SEQ ID NO: 632336 - protein, 9 aa, Homo Sapiens
VWMYLPPHD

SEQ ID NO: 632337 - protein, 9 aa, Homo Sapiens
LDDEETGGR

SEQ ID NO: 632338 - protein, 9 aa, Homo Sapiens
HNDGKWKSL

SEQ ID NO: 632339 - protein, 9 aa, Homo Sapiens
EDVVWLTEG

SEQ ID NO: 632340 - protein, 9 aa, Homo Sapiens
RARAEKKQA

SEQ ID NO: 632341 - protein, 9 aa, Homo Sapiens
SVVVILSSC

SEQ ID NO: 632342 - protein, 9 aa, Homo Sapiens
SGLVSITFR

SEQ ID NO: 632343 - protein, 9 aa, Homo Sapiens
TLSCADLPS

SEQ ID NO: 632344 - protein, 9 aa, Homo Sapiens
LLAAMANDR

SEQ ID NO: 632345 - protein, 9 aa, Homo Sapiens
MLGPGLLRG

SEQ ID NO: 632346 - protein, 9 aa, Homo Sapiens
LSHPMTEAG

SEQ ID NO: 632347 - protein, 9 aa, Homo Sapiens
QECQDLDTF

SEQ ID NO: 632348 - protein, 9 aa, Homo Sapiens
LLDPNSNVT

SEQ ID NO: 632349 - protein, 9 aa, Homo Sapiens
GSSGGGGSP

SEQ ID NO: 632350 - protein, 9 aa, Homo Sapiens
HGASCMLGP

SEQ ID NO: 632351 - protein, 9 aa, Homo Sapiens
MKDQQKPEI

SEQ ID NO: 632352 - protein, 9 aa, Homo Sapiens
RPGAECAHC

SEQ ID NO: 632353 - protein, 9 aa, Homo Sapiens
ALSTSNVSE

SEQ ID NO: 632354 - protein, 9 aa, Homo Sapiens
DSTKDLPND

SEQ ID NO: 632355 - protein, 9 aa, Homo Sapiens
QCTDNFVRV

SEQ ID NO: 632356 - protein, 9 aa, Homo Sapiens
IGLIPLHKA

SEQ ID NO: 632357 - protein, 9 aa, Homo Sapiens
FLSQDKMLF

SEQ ID NO: 632358 - protein, 9 aa, Homo Sapiens
DLLGDKIAI

SEQ ID NO: 632359 - protein, 9 aa, Homo Sapiens
STHSVIEKT

SEQ ID NO: 632360 - protein, 9 aa, Homo Sapiens
KDRLPLRAR

SEQ ID NO: 632361 - protein, 9 aa, Homo Sapiens
FDGSAMAAY

SEQ ID NO: 632362 - protein, 9 aa, Homo Sapiens
ERCQLPALG

SEQ ID NO: 632363 - protein, 9 aa, Homo Sapiens
NRSFSGKNK

SEQ ID NO: 632364 - protein, 9 aa, Homo Sapiens
MVVESDLLG

SEQ ID NO: 632365 - protein, 9 aa, Homo Sapiens
GYTPVSNIT

SEQ ID NO: 632366 - protein, 9 aa, Homo Sapiens
AGINLSGLV

SEQ ID NO: 632367 - protein, 9 aa, Homo Sapiens
ESIASTPQG

SEQ ID NO: 632368 - protein, 9 aa, Homo Sapiens
QLDWSDLMA

SEQ ID NO: 632369 - protein, 9 aa, Homo Sapiens
LTSMCRPSL

SEQ ID NO: 632370 - protein, 9 aa, Homo Sapiens
DTSNPFPRS

SEQ ID NO: 632371 - protein, 9 aa, Homo Sapiens
ERRGKAVRM

SEQ ID NO: 632372 - protein, 9 aa, Homo Sapiens
QELICKLLA

SEQ ID NO: 632373 - protein, 9 aa, Homo Sapiens
GDALYELFQ

SEQ ID NO: 632374 - protein, 9 aa, Homo Sapiens
AVDCVRFIA

SEQ ID NO: 632375 - protein, 9 aa, Homo Sapiens
DHCGEPRPD

SEQ ID NO: 632376 - protein, 9 aa, Homo Sapiens
NCMPIGIPA

SEQ ID NO: 632377 - protein, 9 aa, Homo Sapiens
LGKAGLVSV

SEQ ID NO: 632378 - protein, 9 aa, Homo Sapiens
PRKSRTPEI

SEQ ID NO: 632379 - protein, 9 aa, Homo Sapiens
DPEEIRPNE

SEQ ID NO: 632380 - protein, 9 aa, Homo Sapiens
SAATTNIET

SEQ ID NO: 632381 - protein, 9 aa, Homo Sapiens
TYTDRSDTF

SEQ ID NO: 632382 - protein, 9 aa, Homo Sapiens
PEWAHCYSD

SEQ ID NO: 632383 - protein, 9 aa, Homo Sapiens
SITFRIPVS

SEQ ID NO: 632384 - protein, 9 aa, Homo Sapiens
KWRTEERLQ

SEQ ID NO: 632385 - protein, 9 aa, Homo Sapiens
GCVHCPAEK

SEQ ID NO: 632386 - protein, 9 aa, Homo Sapiens
TEQLAHCLR

SEQ ID NO: 632387 - protein, 9 aa, Homo Sapiens
DLLLASSVE

SEQ ID NO: 632388 - protein, 9 aa, Homo Sapiens
AKAPTETSP

SEQ ID NO: 632389 - protein, 9 aa, Homo Sapiens
KPFTKYEFT

SEQ ID NO: 632390 - protein, 9 aa, Homo Sapiens
SYLSVTLRT

SEQ ID NO: 632391 - protein, 9 aa, Homo Sapiens
GSIAKEERE

SEQ ID NO: 632392 - protein, 9 aa, Homo Sapiens
EEQDLRKHC

SEQ ID NO: 632393 - protein, 9 aa, Homo Sapiens
PLQNSTVMN

SEQ ID NO: 632394 - protein, 9 aa, Homo Sapiens
PVSITPPSS

SEQ ID NO: 632395 - protein, 9 aa, Homo Sapiens
PGLYCVPEG

SEQ ID NO: 632396 - protein, 9 aa, Homo Sapiens
CGEPRPDSW

SEQ ID NO: 632397 - protein, 9 aa, Homo Sapiens
SQVSNLNKK

SEQ ID NO: 632398 - protein, 9 aa, Homo Sapiens
TTGEATPVS

SEQ ID NO: 632399 - protein, 9 aa, Homo Sapiens
LIHHQRIQT

SEQ ID NO: 632400 - protein, 9 aa, Homo Sapiens
HLWKLMVVE

SEQ ID NO: 632401 - protein, 9 aa, Homo Sapiens
DILQEPTCQ

SEQ ID NO: 632402 - protein, 9 aa, Homo Sapiens
INKIMWLPQ

SEQ ID NO: 632403 - protein, 9 aa, Homo Sapiens
GTSSLFFSV

SEQ ID NO: 632404 - protein, 9 aa, Homo Sapiens
GSSVGTRSS

SEQ ID NO: 632405 - protein, 9 aa, Homo Sapiens
RAPPKSSQH

SEQ ID NO: 632406 - protein, 9 aa, Homo Sapiens
GTPYDHITS

SEQ ID NO: 632407 - protein, 9 aa, Homo Sapiens
EHEERKPSA

SEQ ID NO: 632408 - protein, 9 aa, Homo Sapiens
PPFQERFLA

SEQ ID NO: 632409 - protein, 9 aa, Homo Sapiens
HGYRGLRLH

SEQ ID NO: 632410 - protein, 9 aa, Homo Sapiens
VIFVYIGIV

SEQ ID NO: 632411 - protein, 9 aa, Homo Sapiens
QCFHGYYGL

SEQ ID NO: 632412 - protein, 9 aa, Homo Sapiens
FSLSSSLVI

SEQ ID NO: 632413 - protein, 9 aa, Homo Sapiens
LNVLEQFVG

SEQ ID NO: 632414 - protein, 9 aa, Homo Sapiens
ELELVESPR

SEQ ID NO: 632415 - protein, 9 aa, Homo Sapiens
SKTLCIHMT

SEQ ID NO: 632416 - protein, 9 aa, Homo Sapiens
PLPQLPLPC

SEQ ID NO: 632417 - protein, 9 aa, Homo Sapiens
QLLLLEAMV

SEQ ID NO: 632418 - protein, 9 aa, Homo Sapiens
QTTLAGMEF

SEQ ID NO: 632419 - protein, 9 aa, Homo Sapiens
AYYHAKFGI

SEQ ID NO: 632420 - protein, 9 aa, Homo Sapiens
LEKQTNKGK

SEQ ID NO: 632421 - protein, 9 aa, Homo Sapiens
EVRHPKGPD

SEQ ID NO: 632422 - protein, 9 aa, Homo Sapiens
TRGQKVTLR

SEQ ID NO: 632423 - protein, 9 aa, Homo Sapiens
DVRQRGAQG

SEQ ID NO: 632424 - protein, 9 aa, Homo Sapiens
GTKSSLQFS

SEQ ID NO: 632425 - protein, 9 aa, Homo Sapiens
GPRKDGSRK

SEQ ID NO: 632426 - protein, 9 aa, Homo Sapiens
EELVGFLDA

SEQ ID NO: 632427 - protein, 9 aa, Homo Sapiens
LDLLSRVHG

SEQ ID NO: 632428 - protein, 9 aa, Homo Sapiens
HVVCPEEHV

SEQ ID NO: 632429 - protein, 9 aa, Homo Sapiens
MNEHFSSLI

SEQ ID NO: 632430 - protein, 9 aa, Homo Sapiens
DASTQIRLA

SEQ ID NO: 632431 - protein, 9 aa, Homo Sapiens
PTMYPSAHR

SEQ ID NO: 632432 - protein, 9 aa, Homo Sapiens
ELICKLLAA

SEQ ID NO: 632433 - protein, 9 aa, Homo Sapiens
PDEYMLSLY

SEQ ID NO: 632434 - protein, 9 aa, Homo Sapiens
PSPWPTPPP

SEQ ID NO: 632435 - protein, 9 aa, Homo Sapiens
DRRRRILIC

SEQ ID NO: 632436 - protein, 9 aa, Homo Sapiens
LLSLVGLLN

SEQ ID NO: 632437 - protein, 9 aa, Homo Sapiens
PHQQGGHPP

SEQ ID NO: 632438 - protein, 9 aa, Homo Sapiens
TYESLKKTR

SEQ ID NO: 632439 - protein, 9 aa, Homo Sapiens
YALDYWSKA

SEQ ID NO: 632440 - protein, 9 aa, Homo Sapiens
KKQENGNQS

SEQ ID NO: 632441 - protein, 9 aa, Homo Sapiens
LRKHKLIEV

SEQ ID NO: 632442 - protein, 9 aa, Homo Sapiens
LFRVTLCCD

SEQ ID NO: 632443 - protein, 9 aa, Homo Sapiens
QDVLRVRVH

SEQ ID NO: 632444 - protein, 9 aa, Homo Sapiens
ASIAYLKAK

SEQ ID NO: 632445 - protein, 9 aa, Homo Sapiens
MEEEACYQQ

SEQ ID NO: 632446 - protein, 9 aa, Homo Sapiens
LEMEEEACY

SEQ ID NO: 632447 - protein, 9 aa, Homo Sapiens
NVSLRSQHT

SEQ ID NO: 632448 - protein, 9 aa, Homo Sapiens
APHILGLVA

SEQ ID NO: 632449 - protein, 9 aa, Homo Sapiens
KDPSWAAPA

SEQ ID NO: 632450 - protein, 9 aa, Homo Sapiens
AFGQYTGYS

SEQ ID NO: 632451 - protein, 9 aa, Homo Sapiens
GLVSITFRI

SEQ ID NO: 632452 - protein, 9 aa, Homo Sapiens
IPHLRGKEG

SEQ ID NO: 632453 - protein, 9 aa, Homo Sapiens
HTEQCIADE

SEQ ID NO: 632454 - protein, 9 aa, Homo Sapiens
YNATTQEMV

SEQ ID NO: 632455 - protein, 9 aa, Homo Sapiens
PGAKGERVA

SEQ ID NO: 632456 - protein, 9 aa, Homo Sapiens
LLSPSEFKI

SEQ ID NO: 632457 - protein, 9 aa, Homo Sapiens
IAQELKRIL

SEQ ID NO: 632458 - protein, 9 aa, Homo Sapiens
AVTVDYNIA

SEQ ID NO: 632459 - protein, 9 aa, Homo Sapiens
GCRASYPTS

SEQ ID NO: 632460 - protein, 9 aa, Homo Sapiens
QSSSFTPPA

SEQ ID NO: 632461 - protein, 9 aa, Homo Sapiens
CIYGYVMLD

SEQ ID NO: 632462 - protein, 9 aa, Homo Sapiens
SFFAIGMSP

SEQ ID NO: 632463 - protein, 9 aa, Homo Sapiens
EDRERFSFE

SEQ ID NO: 632464 - protein, 9 aa, Homo Sapiens
LANSNISGY

SEQ ID NO: 632465 - protein, 9 aa, Homo Sapiens
MEAARAVVL

SEQ ID NO: 632466 - protein, 9 aa, Homo Sapiens
RLESNRRTT

SEQ ID NO: 632467 - protein, 9 aa, Homo Sapiens
EIHSLGGGD

SEQ ID NO: 632468 - protein, 9 aa, Homo Sapiens
FQPVLDGGG

SEQ ID NO: 632469 - protein, 9 aa, Homo Sapiens
DLLNNAALA

SEQ ID NO: 632470 - protein, 9 aa, Homo Sapiens
KANTTTNKE

SEQ ID NO: 632471 - protein, 9 aa, Homo Sapiens
ARNTGNMFK

SEQ ID NO: 632472 - protein, 9 aa, Homo Sapiens
RTEERLQCP

SEQ ID NO: 632473 - protein, 9 aa, Homo Sapiens
LDYRSPFLL

SEQ ID NO: 632474 - protein, 9 aa, Homo Sapiens
DRVKQLEKT

SEQ ID NO: 632475 - protein, 9 aa, Homo Sapiens
GPPQENCFL

SEQ ID NO: 632476 - protein, 9 aa, Homo Sapiens
SIPGSDILR

SEQ ID NO: 632477 - protein, 9 aa, Homo Sapiens
AIDRTEQAE

SEQ ID NO: 632478 - protein, 9 aa, Homo Sapiens
PLAHQLRGQ

SEQ ID NO: 632479 - protein, 9 aa, Homo Sapiens
HCGEPRPDS

SEQ ID NO: 632480 - protein, 9 aa, Homo Sapiens
DAPSGMELL

SEQ ID NO: 632481 - protein, 9 aa, Homo Sapiens
IMCPICDQV

SEQ ID NO: 632482 - protein, 9 aa, Homo Sapiens
APQYQNGNP

SEQ ID NO: 632483 - protein, 9 aa, Homo Sapiens
FHDLNRKLQ

SEQ ID NO: 632484 - protein, 9 aa, Homo Sapiens
IHSLGGGDE

SEQ ID NO: 632485 - protein, 9 aa, Homo Sapiens
QYHREMMAM

SEQ ID NO: 632486 - protein, 9 aa, Homo Sapiens
AALSVLMYL

SEQ ID NO: 632487 - protein, 9 aa, Homo Sapiens
TEIDHHKFH

SEQ ID NO: 632488 - protein, 9 aa, Homo Sapiens
KDKTAQQIK

SEQ ID NO: 632489 - protein, 9 aa, Homo Sapiens
SNFTQRALV

SEQ ID NO: 632490 - protein, 9 aa, Homo Sapiens
LRTQQQQVL

SEQ ID NO: 632491 - protein, 9 aa, Homo Sapiens
PMLQDFPPY

SEQ ID NO: 632492 - protein, 9 aa, Homo Sapiens
SGGSVSKLF

SEQ ID NO: 632493 - protein, 9 aa, Homo Sapiens
TVRNGINMY

SEQ ID NO: 632494 - protein, 9 aa, Homo Sapiens
EQEDADIAA

SEQ ID NO: 632495 - protein, 9 aa, Homo Sapiens
GAQCLPFSN

SEQ ID NO: 632496 - protein, 9 aa, Homo Sapiens
QDMFHDLNR

SEQ ID NO: 632497 - protein, 9 aa, Homo Sapiens
PAPWGPRLW

SEQ ID NO: 632498 - protein, 9 aa, Homo Sapiens
LQAMGSSSD

SEQ ID NO: 632499 - protein, 9 aa, Homo Sapiens
GGQRALLIR

SEQ ID NO: 632500 - protein, 9 aa, Homo Sapiens
SLCIDLTLC

SEQ ID NO: 632501 - protein, 9 aa, Homo Sapiens
EEQGRSLGL

SEQ ID NO: 632502 - protein, 9 aa, Homo Sapiens
QNFPKPKGD

SEQ ID NO: 632503 - protein, 9 aa, Homo Sapiens
SKGLHYWEL

SEQ ID NO: 632504 - protein, 9 aa, Homo Sapiens
LGDYDPYEH

SEQ ID NO: 632505 - protein, 9 aa, Homo Sapiens
PTTSSAFVE

SEQ ID NO: 632506 - protein, 9 aa, Homo Sapiens
FHGYYGLDS

SEQ ID NO: 632507 - protein, 9 aa, Homo Sapiens
PHRFNDSEV

SEQ ID NO: 632508 - protein, 9 aa, Homo Sapiens
TVYCWCVTP

SEQ ID NO: 632509 - protein, 9 aa, Homo Sapiens
GSSSDSCDS

SEQ ID NO: 632510 - protein, 9 aa, Homo Sapiens
MTSLNVKAG

SEQ ID NO: 632511 - protein, 9 aa, Homo Sapiens
IKEVAAQSG

SEQ ID NO: 632512 - protein, 9 aa, Homo Sapiens
VGGYRGVSR

SEQ ID NO: 632513 - protein, 9 aa, Homo Sapiens
LLFFWLDLS

SEQ ID NO: 632514 - protein, 9 aa, Homo Sapiens
QQLNEIHSL

SEQ ID NO: 632515 - protein, 9 aa, Homo Sapiens
TKLTITLTD

SEQ ID NO: 632516 - protein, 9 aa, Homo Sapiens
NLLDEGSDV

SEQ ID NO: 632517 - protein, 9 aa, Homo Sapiens
STDQGIPDT

SEQ ID NO: 632518 - protein, 9 aa, Homo Sapiens
DGTENKSKL

SEQ ID NO: 632519 - protein, 9 aa, Homo Sapiens
FASRYPIMY

SEQ ID NO: 632520 - protein, 9 aa, Homo Sapiens
HMPCPAHGL

SEQ ID NO: 632521 - protein, 9 aa, Homo Sapiens
FPSLSLEEL

SEQ ID NO: 632522 - protein, 9 aa, Homo Sapiens
NGCPQCGKD

SEQ ID NO: 632523 - protein, 9 aa, Homo Sapiens
PDAANCMPI

SEQ ID NO: 632524 - protein, 9 aa, Homo Sapiens
RPDSVATGL

SEQ ID NO: 632525 - protein, 9 aa, Homo Sapiens
NRLPANRRI

SEQ ID NO: 632526 - protein, 9 aa, Homo Sapiens
MIDLLGDKI

SEQ ID NO: 632527 - protein, 9 aa, Homo Sapiens
LEGTNEQSS

SEQ ID NO: 632528 - protein, 9 aa, Homo Sapiens
QFLVFLVLM

SEQ ID NO: 632529 - protein, 9 aa, Homo Sapiens
RSIHEEAPS

SEQ ID NO: 632530 - protein, 9 aa, Homo Sapiens
GVACYCRPG

SEQ ID NO: 632531 - protein, 9 aa, Homo Sapiens
GGGTCLPCH

SEQ ID NO: 632532 - protein, 9 aa, Homo Sapiens
GVDRYQSVI

SEQ ID NO: 632533 - protein, 9 aa, Homo Sapiens
GWNPFVEDN

SEQ ID NO: 632534 - protein, 9 aa, Homo Sapiens
GRPVQKGEP

SEQ ID NO: 632535 - protein, 9 aa, Homo Sapiens
LDDKEMVIE

SEQ ID NO: 632536 - protein, 9 aa, Homo Sapiens
LGYTPVSNI

SEQ ID NO: 632537 - protein, 9 aa, Homo Sapiens
QRGAQGETA

SEQ ID NO: 632538 - protein, 9 aa, Homo Sapiens
KEGLRLTGS

SEQ ID NO: 632539 - protein, 9 aa, Homo Sapiens
HFAKAIAIL

SEQ ID NO: 632540 - protein, 9 aa, Homo Sapiens
RDRRRRILI

SEQ ID NO: 632541 - protein, 9 aa, Homo Sapiens
QRCPEQCTC

SEQ ID NO: 632542 - protein, 9 aa, Homo Sapiens
HSSTHSVIE

SEQ ID NO: 632543 - protein, 9 aa, Homo Sapiens
KLGANAILG

SEQ ID NO: 632544 - protein, 9 aa, Homo Sapiens
GVTPLIVEV

SEQ ID NO: 632545 - protein, 9 aa, Homo Sapiens
NVAYPKSVS

SEQ ID NO: 632546 - protein, 9 aa, Homo Sapiens
VSGTHMVHM

SEQ ID NO: 632547 - protein, 9 aa, Homo Sapiens
PCFSLSNFL

SEQ ID NO: 632548 - protein, 9 aa, Homo Sapiens
VYAFTKVGN

SEQ ID NO: 632549 - protein, 9 aa, Homo Sapiens
MCRPSLALF

SEQ ID NO: 632550 - protein, 9 aa, Homo Sapiens
FESLIKKDL

SEQ ID NO: 632551 - protein, 9 aa, Homo Sapiens
SQSSSFTPP

SEQ ID NO: 632552 - protein, 9 aa, Homo Sapiens
KKREHSPIK

SEQ ID NO: 632553 - protein, 9 aa, Homo Sapiens
MKFDAIYKY

SEQ ID NO: 632554 - protein, 9 aa, Homo Sapiens
PDCPIVLKV

SEQ ID NO: 632555 - protein, 9 aa, Homo Sapiens
SAIREIMEE

SEQ ID NO: 632556 - protein, 9 aa, Homo Sapiens
RLGKTTFGS

SEQ ID NO: 632557 - protein, 9 aa, Homo Sapiens
FRSVRSQLY

SEQ ID NO: 632558 - protein, 9 aa, Homo Sapiens
YVSAGRGNV

SEQ ID NO: 632559 - protein, 9 aa, Homo Sapiens
TRNNLAHFH

SEQ ID NO: 632560 - protein, 9 aa, Homo Sapiens
AVWPEMQTL

SEQ ID NO: 632561 - protein, 9 aa, Homo Sapiens
KFYSYFEFP

SEQ ID NO: 632562 - protein, 9 aa, Homo Sapiens
QPVLDGGGD

SEQ ID NO: 632563 - protein, 9 aa, Homo Sapiens
SAPSPPNGF

SEQ ID NO: 632564 - protein, 9 aa, Homo Sapiens
YCDNIVLTT

SEQ ID NO: 632565 - protein, 9 aa, Homo Sapiens
FSMVMSMDF

SEQ ID NO: 632566 - protein, 9 aa, Homo Sapiens
TMAETSASP

SEQ ID NO: 632567 - protein, 9 aa, Homo Sapiens
NLDLEDINY

SEQ ID NO: 632568 - protein, 9 aa, Homo Sapiens
ADVCRVGGQ

SEQ ID NO: 632569 - protein, 9 aa, Homo Sapiens
FVVAALEII

SEQ ID NO: 632570 - protein, 9 aa, Homo Sapiens
SVCDDEHHG

SEQ ID NO: 632571 - protein, 9 aa, Homo Sapiens
THSHSLPDS

SEQ ID NO: 632572 - protein, 9 aa, Homo Sapiens
KPTNLLSEE

SEQ ID NO: 632573 - protein, 9 aa, Homo Sapiens
SVDFTQTAV

SEQ ID NO: 632574 - protein, 9 aa, Homo Sapiens
IAFYRKDWS

SEQ ID NO: 632575 - protein, 9 aa, Homo Sapiens
PLRMSLQEK

SEQ ID NO: 632576 - protein, 9 aa, Homo Sapiens
LIIITSYTA

SEQ ID NO: 632577 - protein, 9 aa, Homo Sapiens
RSSGLKLGA

SEQ ID NO: 632578 - protein, 9 aa, Homo Sapiens
GFSVDLWAL

SEQ ID NO: 632579 - protein, 9 aa, Homo Sapiens
HEEAPSGPP

SEQ ID NO: 632580 - protein, 9 aa, Homo Sapiens
GQAKIACGA

SEQ ID NO: 632581 - protein, 9 aa, Homo Sapiens
CGGALIRQN

SEQ ID NO: 632582 - protein, 9 aa, Homo Sapiens
QGTIKWRRT

SEQ ID NO: 632583 - protein, 9 aa, Homo Sapiens
QASLLPQHL

SEQ ID NO: 632584 - protein, 9 aa, Homo Sapiens
FQGNKYWVF

SEQ ID NO: 632585 - protein, 9 aa, Homo Sapiens
MAHSSTHSV

SEQ ID NO: 632586 - protein, 9 aa, Homo Sapiens
YLECLLRRW

SEQ ID NO: 632587 - protein, 9 aa, Homo Sapiens
GYGAGVVGG

SEQ ID NO: 632588 - protein, 9 aa, Homo Sapiens
LDNTAVRNR

SEQ ID NO: 632589 - protein, 9 aa, Homo Sapiens
PFHATGAEI

SEQ ID NO: 632590 - protein, 9 aa, Homo Sapiens
AKAIAILNT

SEQ ID NO: 632591 - protein, 9 aa, Homo Sapiens
SSSAILRVL

SEQ ID NO: 632592 - protein, 9 aa, Homo Sapiens
QLLLMAVYS

SEQ ID NO: 632593 - protein, 9 aa, Homo Sapiens
MYLIFIMCN

SEQ ID NO: 632594 - protein, 9 aa, Homo Sapiens
RFEKKTKVS

SEQ ID NO: 632595 - protein, 9 aa, Homo Sapiens
QLSYAPMTP

SEQ ID NO: 632596 - protein, 9 aa, Homo Sapiens
NVTDLGLVY

SEQ ID NO: 632597 - protein, 9 aa, Homo Sapiens
QPNSTRHPL

SEQ ID NO: 632598 - protein, 9 aa, Homo Sapiens
INAEELVGF

SEQ ID NO: 632599 - protein, 9 aa, Homo Sapiens
VSGGGYAGY

SEQ ID NO: 632600 - protein, 9 aa, Homo Sapiens
LNMLTAQQY

SEQ ID NO: 632601 - protein, 9 aa, Homo Sapiens
WMTAVPQHL

SEQ ID NO: 632602 - protein, 9 aa, Homo Sapiens
MAASVEPQR

SEQ ID NO: 632603 - protein, 9 aa, Homo Sapiens
LNAELSSVD

SEQ ID NO: 632604 - protein, 9 aa, Homo Sapiens
HSASQDGKD

SEQ ID NO: 632605 - protein, 9 aa, Homo Sapiens
GSHCSPGWC

SEQ ID NO: 632606 - protein, 9 aa, Homo Sapiens
HSGTATLPR

SEQ ID NO: 632607 - protein, 9 aa, Homo Sapiens
EWIICKDIK

SEQ ID NO: 632608 - protein, 9 aa, Homo Sapiens
YTPVSNITS

SEQ ID NO: 632609 - protein, 9 aa, Homo Sapiens
LLLCLDCVK

SEQ ID NO: 632610 - protein, 9 aa, Homo Sapiens
RQISLCFRK

SEQ ID NO: 632611 - protein, 9 aa, Homo Sapiens
ETEELDSLS

SEQ ID NO: 632612 - protein, 9 aa, Homo Sapiens
MLHFFHPHH

SEQ ID NO: 632613 - protein, 9 aa, Homo Sapiens
LAPVTPGVV

SEQ ID NO: 632614 - protein, 9 aa, Homo Sapiens
GSGFRSVTT

SEQ ID NO: 632615 - protein, 9 aa, Homo Sapiens
HWMPKDCKP

SEQ ID NO: 632616 - protein, 9 aa, Homo Sapiens
LGWLPGRPL

SEQ ID NO: 632617 - protein, 9 aa, Homo Sapiens
PGVYLCEDT

SEQ ID NO: 632618 - protein, 9 aa, Homo Sapiens
IPDTCSGVA

SEQ ID NO: 632619 - protein, 9 aa, Homo Sapiens
LTFGGTFDL

SEQ ID NO: 632620 - protein, 9 aa, Homo Sapiens
NNLVRHQDA

SEQ ID NO: 632621 - protein, 9 aa, Homo Sapiens
TKYEFTVQS

SEQ ID NO: 632622 - protein, 9 aa, Homo Sapiens
SQRHRPTKK

SEQ ID NO: 632623 - protein, 9 aa, Homo Sapiens
IASQCISAL

SEQ ID NO: 632624 - protein, 9 aa, Homo Sapiens
DLRTQQQQV

SEQ ID NO: 632625 - protein, 9 aa, Homo Sapiens
TEQAEADKK

SEQ ID NO: 632626 - protein, 9 aa, Homo Sapiens
QMIMCPICD

SEQ ID NO: 632627 - protein, 9 aa, Homo Sapiens
VLLPQKTWY

SEQ ID NO: 632628 - protein, 9 aa, Homo Sapiens
RQGLVARAG

SEQ ID NO: 632629 - protein, 9 aa, Homo Sapiens
EMRGVMEGK

SEQ ID NO: 632630 - protein, 9 aa, Homo Sapiens
KFSAGTYQR

SEQ ID NO: 632631 - protein, 9 aa, Homo Sapiens
VGEGNHPER

SEQ ID NO: 632632 - protein, 9 aa, Homo Sapiens
AVHGIEDLI

SEQ ID NO: 632633 - protein, 9 aa, Homo Sapiens
KELQTTLAG

SEQ ID NO: 632634 - protein, 9 aa, Homo Sapiens
IHLENQGKV

SEQ ID NO: 632635 - protein, 9 aa, Homo Sapiens
GPNIYELSS

SEQ ID NO: 632636 - protein, 9 aa, Homo Sapiens
FQATEEIGK

SEQ ID NO: 632637 - protein, 9 aa, Homo Sapiens
RIVALSLMH

SEQ ID NO: 632638 - protein, 9 aa, Homo Sapiens
HIVKEFAKY

SEQ ID NO: 632639 - protein, 9 aa, Homo Sapiens
KMPHMHKMM

SEQ ID NO: 632640 - protein, 9 aa, Homo Sapiens
NVRKITCDV

SEQ ID NO: 632641 - protein, 9 aa, Homo Sapiens
TFHYVTTMS

SEQ ID NO: 632642 - protein, 9 aa, Homo Sapiens
YLKAKSESS

SEQ ID NO: 632643 - protein, 9 aa, Homo Sapiens
YGYWMIYTY

SEQ ID NO: 632644 - protein, 9 aa, Homo Sapiens
SWCQGQLQS

SEQ ID NO: 632645 - protein, 9 aa, Homo Sapiens
FIEMFHGQP

SEQ ID NO: 632646 - protein, 9 aa, Homo Sapiens
ILLIAFSPL

SEQ ID NO: 632647 - protein, 9 aa, Homo Sapiens
AGTYQRLEE

SEQ ID NO: 632648 - protein, 9 aa, Homo Sapiens
QHGHTLAAA

SEQ ID NO: 632649 - protein, 9 aa, Homo Sapiens
TQLSEKADL

SEQ ID NO: 632650 - protein, 9 aa, Homo Sapiens
YAVNDDYYV

SEQ ID NO: 632651 - protein, 9 aa, Homo Sapiens
PTGWQVQTC

SEQ ID NO: 632652 - protein, 9 aa, Homo Sapiens
TIYTHNTNN

SEQ ID NO: 632653 - protein, 9 aa, Homo Sapiens
RGDLTVLVI

SEQ ID NO: 632654 - protein, 9 aa, Homo Sapiens
LTEHVNAIR

SEQ ID NO: 632655 - protein, 9 aa, Homo Sapiens
ERHHFAKAI

SEQ ID NO: 632656 - protein, 9 aa, Homo Sapiens
IMVPRKEDH

SEQ ID NO: 632657 - protein, 9 aa, Homo Sapiens
LQEEVSGCP

SEQ ID NO: 632658 - protein, 9 aa, Homo Sapiens
SSRSERLVA

SEQ ID NO: 632659 - protein, 9 aa, Homo Sapiens
QGPHQQGGH

SEQ ID NO: 632660 - protein, 9 aa, Homo Sapiens
EAVVMKFDA

SEQ ID NO: 632661 - protein, 9 aa, Homo Sapiens
LLFDIVTSQ

SEQ ID NO: 632662 - protein, 9 aa, Homo Sapiens
VLEQFVGRM

SEQ ID NO: 632663 - protein, 9 aa, Homo Sapiens
PAASSISLP

SEQ ID NO: 632664 - protein, 9 aa, Homo Sapiens
LLFLALLTC

SEQ ID NO: 632665 - protein, 9 aa, Homo Sapiens
PELPREGLG

SEQ ID NO: 632666 - protein, 9 aa, Homo Sapiens
YKATKCHGS

SEQ ID NO: 632667 - protein, 9 aa, Homo Sapiens
GSGFYKSSS

SEQ ID NO: 632668 - protein, 9 aa, Homo Sapiens
YRDMGARGG

SEQ ID NO: 632669 - protein, 9 aa, Homo Sapiens
LPREGLGRA

SEQ ID NO: 632670 - protein, 9 aa, Homo Sapiens
EPSTPGGLD

SEQ ID NO: 632671 - protein, 9 aa, Homo Sapiens
ALQDQCKLT

SEQ ID NO: 632672 - protein, 9 aa, Homo Sapiens
INGIPTDDS

SEQ ID NO: 632673 - protein, 9 aa, Homo Sapiens
QWGDAPSPL

SEQ ID NO: 632674 - protein, 9 aa, Homo Sapiens
DQNKPYWIL

SEQ ID NO: 632675 - protein, 9 aa, Homo Sapiens
NIVGTVTLI

SEQ ID NO: 632676 - protein, 9 aa, Homo Sapiens
LKELQTTLA

SEQ ID NO: 632677 - protein, 9 aa, Homo Sapiens
SVSKEAVAI

SEQ ID NO: 632678 - protein, 9 aa, Homo Sapiens
ENQYHREMM

SEQ ID NO: 632679 - protein, 9 aa, Homo Sapiens
HLDGKVAAL

SEQ ID NO: 632680 - protein, 9 aa, Homo Sapiens
EAFLQHLTV

SEQ ID NO: 632681 - protein, 9 aa, Homo Sapiens
CKAKSIIPN

SEQ ID NO: 632682 - protein, 9 aa, Homo Sapiens
DTRRLLERV

SEQ ID NO: 632683 - protein, 9 aa, Homo Sapiens
CYQNEFHGS

SEQ ID NO: 632684 - protein, 9 aa, Homo Sapiens
HTELVLGAR

SEQ ID NO: 632685 - protein, 9 aa, Homo Sapiens
GAFGIRIKN

SEQ ID NO: 632686 - protein, 9 aa, Homo Sapiens
KFQFDRIHC

SEQ ID NO: 632687 - protein, 9 aa, Homo Sapiens
IKIACALNK

SEQ ID NO: 632688 - protein, 9 aa, Homo Sapiens
DGRGSRPSL

SEQ ID NO: 632689 - protein, 9 aa, Homo Sapiens
LADFQAFTG

SEQ ID NO: 632690 - protein, 9 aa, Homo Sapiens
YAYHIPSRL

SEQ ID NO: 632691 - protein, 9 aa, Homo Sapiens
SHCSPGWCE

SEQ ID NO: 632692 - protein, 9 aa, Homo Sapiens
LNHHLHSVK

SEQ ID NO: 632693 - protein, 9 aa, Homo Sapiens
CTSRVCFHV

SEQ ID NO: 632694 - protein, 9 aa, Homo Sapiens
GAATDIECS

SEQ ID NO: 632695 - protein, 9 aa, Homo Sapiens
ENRSFSGKN

SEQ ID NO: 632696 - protein, 9 aa, Homo Sapiens
PGGQWGDAP

SEQ ID NO: 632697 - protein, 9 aa, Homo Sapiens
KGTSGGDCP

SEQ ID NO: 632698 - protein, 9 aa, Homo Sapiens
KDFSIKGAE

SEQ ID NO: 632699 - protein, 9 aa, Homo Sapiens
ATEEIGKTF

SEQ ID NO: 632700 - protein, 9 aa, Homo Sapiens
YEVISRENR

SEQ ID NO: 632701 - protein, 9 aa, Homo Sapiens
FCLAENSLG

SEQ ID NO: 632702 - protein, 9 aa, Homo Sapiens
GLRAILTCS

SEQ ID NO: 632703 - protein, 9 aa, Homo Sapiens
ALVAWLKAY

SEQ ID NO: 632704 - protein, 9 aa, Homo Sapiens
EQSLKLIHL

SEQ ID NO: 632705 - protein, 9 aa, Homo Sapiens
DAHSGDHYN

SEQ ID NO: 632706 - protein, 9 aa, Homo Sapiens
CERDGLSRV

SEQ ID NO: 632707 - protein, 9 aa, Homo Sapiens
DVYCKLIPY

SEQ ID NO: 632708 - protein, 9 aa, Homo Sapiens
RSWMTAVPQ

SEQ ID NO: 632709 - protein, 9 aa, Homo Sapiens
RLLPQDRVA

SEQ ID NO: 632710 - protein, 9 aa, Homo Sapiens
RFKISNVRK

SEQ ID NO: 632711 - protein, 9 aa, Homo Sapiens
YAKLLVELN

SEQ ID NO: 632712 - protein, 9 aa, Homo Sapiens
QKIPQLQSS

SEQ ID NO: 632713 - protein, 9 aa, Homo Sapiens
RTADKWRTE

SEQ ID NO: 632714 - protein, 9 aa, Homo Sapiens
HHYHHSGTA

SEQ ID NO: 632715 - protein, 9 aa, Homo Sapiens
GLLRGPPGG

SEQ ID NO: 632716 - protein, 9 aa, Homo Sapiens
SSQSFSRRT

SEQ ID NO: 632717 - protein, 9 aa, Homo Sapiens
AAQWGEPGQ

SEQ ID NO: 632718 - protein, 9 aa, Homo Sapiens
SPRSLAWDI

SEQ ID NO: 632719 - protein, 9 aa, Homo Sapiens
VWTPNMSAA

SEQ ID NO: 632720 - protein, 9 aa, Homo Sapiens
EMTSSVKSV

SEQ ID NO: 632721 - protein, 9 aa, Homo Sapiens
CIQRVNTEL

SEQ ID NO: 632722 - protein, 9 aa, Homo Sapiens
RVSKQAQLR

SEQ ID NO: 632723 - protein, 9 aa, Homo Sapiens
SAHSLGPDG

SEQ ID NO: 632724 - protein, 9 aa, Homo Sapiens
GMRSVQWFG

SEQ ID NO: 632725 - protein, 9 aa, Homo Sapiens
EFAEMVERK

SEQ ID NO: 632726 - protein, 9 aa, Homo Sapiens
LEKKHRYLG

SEQ ID NO: 632727 - protein, 9 aa, Homo Sapiens
TDDSTFEEA

SEQ ID NO: 632728 - protein, 9 aa, Homo Sapiens
KCKADRSLL

SEQ ID NO: 632729 - protein, 9 aa, Homo Sapiens
GKANTSKAN

SEQ ID NO: 632730 - protein, 9 aa, Homo Sapiens
PSSEKLASS

SEQ ID NO: 632731 - protein, 9 aa, Homo Sapiens
TLQRLNACQ

SEQ ID NO: 632732 - protein, 9 aa, Homo Sapiens
FAKAIAILN

SEQ ID NO: 632733 - protein, 9 aa, Homo Sapiens
DPPFGDVFR

SEQ ID NO: 632734 - protein, 9 aa, Homo Sapiens
LGYTKSPNQ

SEQ ID NO: 632735 - protein, 9 aa, Homo Sapiens
KGHHGITGD

SEQ ID NO: 632736 - protein, 9 aa, Homo Sapiens
GYLRFDAIA

SEQ ID NO: 632737 - protein, 9 aa, Homo Sapiens
EPCGSGFYK

SEQ ID NO: 632738 - protein, 9 aa, Homo Sapiens
KLQHVQTLG

SEQ ID NO: 632739 - protein, 9 aa, Homo Sapiens
SSLQAIIYR

SEQ ID NO: 632740 - protein, 9 aa, Homo Sapiens
MKEDRRCTG

SEQ ID NO: 632741 - protein, 9 aa, Homo Sapiens
VCRHTAVLY

SEQ ID NO: 632742 - protein, 9 aa, Homo Sapiens
VEARDSGLE

SEQ ID NO: 632743 - protein, 9 aa, Homo Sapiens
DGSAMAAYE

SEQ ID NO: 632744 - protein, 9 aa, Homo Sapiens
RYGPSTYGT

SEQ ID NO: 632745 - protein, 9 aa, Homo Sapiens
CPGALERIH

SEQ ID NO: 632746 - protein, 9 aa, Homo Sapiens
DISGTSTSS

SEQ ID NO: 632747 - protein, 9 aa, Homo Sapiens
DIQLHTPMY

SEQ ID NO: 632748 - protein, 9 aa, Homo Sapiens
NEHFSSLIK

SEQ ID NO: 632749 - protein, 9 aa, Homo Sapiens
SLTLSISGI

SEQ ID NO: 632750 - protein, 9 aa, Homo Sapiens
QYTGYSPQG

SEQ ID NO: 632751 - protein, 9 aa, Homo Sapiens
TVIENSQAI

SEQ ID NO: 632752 - protein, 9 aa, Homo Sapiens
SSPINVHLQ

SEQ ID NO: 632753 - protein, 9 aa, Homo Sapiens
TVYQLKQMF

SEQ ID NO: 632754 - protein, 9 aa, Homo Sapiens
YNGMLILYN

SEQ ID NO: 632755 - protein, 9 aa, Homo Sapiens
RDCERDGLS

SEQ ID NO: 632756 - protein, 9 aa, Homo Sapiens
KNSILKNSA

SEQ ID NO: 632757 - protein, 9 aa, Homo Sapiens
LASSVELEV

SEQ ID NO: 632758 - protein, 9 aa, Homo Sapiens
NGPLEPFLL

SEQ ID NO: 632759 - protein, 9 aa, Homo Sapiens
PPQGLYYAV

SEQ ID NO: 632760 - protein, 9 aa, Homo Sapiens
HSTTALLHY

SEQ ID NO: 632761 - protein, 9 aa, Homo Sapiens
RHTQLSEKA

SEQ ID NO: 632762 - protein, 9 aa, Homo Sapiens
RYTGVALQD

SEQ ID NO: 632763 - protein, 9 aa, Homo Sapiens
ESTSNPELV

SEQ ID NO: 632764 - protein, 9 aa, Homo Sapiens
ESTSNPELQ

SEQ ID NO: 632765 - protein, 9 aa, Homo Sapiens
LNTTLQGSF

SEQ ID NO: 632766 - protein, 9 aa, Homo Sapiens
DCSTIIQHQ

SEQ ID NO: 632767 - protein, 9 aa, Homo Sapiens
FQSVTLYII

SEQ ID NO: 632768 - protein, 9 aa, Homo Sapiens
SSSLSNLAA

SEQ ID NO: 632769 - protein, 9 aa, Homo Sapiens
WMPPPWAQG

SEQ ID NO: 632770 - protein, 9 aa, Homo Sapiens
RRTADKWRT

SEQ ID NO: 632771 - protein, 9 aa, Homo Sapiens
FVPRDVQRH

SEQ ID NO: 632772 - protein, 9 aa, Homo Sapiens
HLSIWGYRC

SEQ ID NO: 632773 - protein, 9 aa, Homo Sapiens
SDDTSNPFP

SEQ ID NO: 632774 - protein, 9 aa, Homo Sapiens
SKVPQHGNT

SEQ ID NO: 632775 - protein, 9 aa, Homo Sapiens
ISEVFEYRQ

SEQ ID NO: 632776 - protein, 9 aa, Homo Sapiens
ASSISLPVI

SEQ ID NO: 632777 - protein, 9 aa, Homo Sapiens
SPAVGTRSS

SEQ ID NO: 632778 - protein, 9 aa, Homo Sapiens
DTSSLISAS

SEQ ID NO: 632779 - protein, 9 aa, Homo Sapiens
LGSDGCADR

SEQ ID NO: 632780 - protein, 9 aa, Homo Sapiens
PCGGRRPGP

SEQ ID NO: 632781 - protein, 9 aa, Homo Sapiens
LVIITDIQL

SEQ ID NO: 632782 - protein, 9 aa, Homo Sapiens
RHHNLDMFD

SEQ ID NO: 632783 - protein, 9 aa, Homo Sapiens
PYCEAYYHA

SEQ ID NO: 632784 - protein, 9 aa, Homo Sapiens
VLEGTNEQS

SEQ ID NO: 632785 - protein, 9 aa, Homo Sapiens
GTAGLFSHG

SEQ ID NO: 632786 - protein, 9 aa, Homo Sapiens
LQRAATICS

SEQ ID NO: 632787 - protein, 9 aa, Homo Sapiens
GFTKKWRPR

SEQ ID NO: 632788 - protein, 9 aa, Homo Sapiens
QRRILQLDW

SEQ ID NO: 632789 - protein, 9 aa, Homo Sapiens
GARGGRPSL

SEQ ID NO: 632790 - protein, 9 aa, Homo Sapiens
TQQQQVLKH

SEQ ID NO: 632791 - protein, 9 aa, Homo Sapiens
CFYLEDEWC

SEQ ID NO: 632792 - protein, 9 aa, Homo Sapiens
AEMTSSVKS

SEQ ID NO: 632793 - protein, 9 aa, Homo Sapiens
ACHECWKTF

SEQ ID NO: 632794 - protein, 9 aa, Homo Sapiens
DHTPLNPAS

SEQ ID NO: 632795 - protein, 9 aa, Homo Sapiens
LHRVVAPGF

SEQ ID NO: 632796 - protein, 9 aa, Homo Sapiens
QNAYTLRCC

SEQ ID NO: 632797 - protein, 9 aa, Homo Sapiens
ESEPLLGAI

SEQ ID NO: 632798 - protein, 9 aa, Homo Sapiens
PWAQGAPEL

SEQ ID NO: 632799 - protein, 9 aa, Homo Sapiens
MGVDRYQSV

SEQ ID NO: 632800 - protein, 9 aa, Homo Sapiens
AWGDPCEMC

SEQ ID NO: 632801 - protein, 9 aa, Homo Sapiens
TGADVCFAR

SEQ ID NO: 632802 - protein, 9 aa, Homo Sapiens
LPPSKGLPT

SEQ ID NO: 632803 - protein, 9 aa, Homo Sapiens
IAVPELYGK

SEQ ID NO: 632804 - protein, 9 aa, Homo Sapiens
FDLNDEKNW

SEQ ID NO: 632805 - protein, 9 aa, Homo Sapiens
NKLKEASTA

SEQ ID NO: 632806 - protein, 9 aa, Homo Sapiens
SQSPPLSLW

SEQ ID NO: 632807 - protein, 9 aa, Homo Sapiens
SVQWFGDGK

SEQ ID NO: 632808 - protein, 9 aa, Homo Sapiens
LQSSPENLV

SEQ ID NO: 632809 - protein, 9 aa, Homo Sapiens
RTTLPIKGP

SEQ ID NO: 632810 - protein, 9 aa, Homo Sapiens
QQCTDNFVR

SEQ ID NO: 632811 - protein, 9 aa, Homo Sapiens
HLSIADILL

SEQ ID NO: 632812 - protein, 9 aa, Homo Sapiens
IVLTTAWGG

SEQ ID NO: 632813 - protein, 9 aa, Homo Sapiens
WLKLGAIFL

SEQ ID NO: 632814 - protein, 9 aa, Homo Sapiens
ETLPPSKGL

SEQ ID NO: 632815 - protein, 9 aa, Homo Sapiens
RPLPILLVS

SEQ ID NO: 632816 - protein, 9 aa, Homo Sapiens
FQDPSEGPL

SEQ ID NO: 632817 - protein, 9 aa, Homo Sapiens
GDAHSQVDE

SEQ ID NO: 632818 - protein, 9 aa, Homo Sapiens
GADPDARPG

SEQ ID NO: 632819 - protein, 9 aa, Homo Sapiens
GDVFRSHTF

SEQ ID NO: 632820 - protein, 9 aa, Homo Sapiens
GKDADGSIA

SEQ ID NO: 632821 - protein, 9 aa, Homo Sapiens
EFKIILGKH

SEQ ID NO: 632822 - protein, 9 aa, Homo Sapiens
NVNEIFIAI

SEQ ID NO: 632823 - protein, 9 aa, Homo Sapiens
EAGHRKDLG

SEQ ID NO: 632824 - protein, 9 aa, Homo Sapiens
FFANGVLNE

SEQ ID NO: 632825 - protein, 9 aa, Homo Sapiens
LLTLITMNV

SEQ ID NO: 632826 - protein, 9 aa, Homo Sapiens
AFTTSSLEL

SEQ ID NO: 632827 - protein, 9 aa, Homo Sapiens
AKVGLSGLF

SEQ ID NO: 632828 - protein, 9 aa, Homo Sapiens
QDIKNEVGD

SEQ ID NO: 632829 - protein, 9 aa, Homo Sapiens
LKGLGVYSL

SEQ ID NO: 632830 - protein, 9 aa, Homo Sapiens
SRLAWPLWD

SEQ ID NO: 632831 - protein, 9 aa, Homo Sapiens
RCSEATSSW

SEQ ID NO: 632832 - protein, 9 aa, Homo Sapiens
IFENIVGTV

SEQ ID NO: 632833 - protein, 9 aa, Homo Sapiens
PSMAAAAGH

SEQ ID NO: 632834 - protein, 9 aa, Homo Sapiens
CLVMAWSMV

SEQ ID NO: 632835 - protein, 9 aa, Homo Sapiens
FRVNVGEGN

SEQ ID NO: 632836 - protein, 9 aa, Homo Sapiens
LFQDPSEGP

SEQ ID NO: 632837 - protein, 9 aa, Homo Sapiens
VCKVSDFCL

SEQ ID NO: 632838 - protein, 9 aa, Homo Sapiens
SFQNMNSKW

SEQ ID NO: 632839 - protein, 9 aa, Homo Sapiens
QSCSIKNRE

SEQ ID NO: 632840 - protein, 9 aa, Homo Sapiens
INLVGLRAI

SEQ ID NO: 632841 - protein, 9 aa, Homo Sapiens
PRLRAELPP

SEQ ID NO: 632842 - protein, 9 aa, Homo Sapiens
QGEDRKSPR

SEQ ID NO: 632843 - protein, 9 aa, Homo Sapiens
MGAAHEPST

SEQ ID NO: 632844 - protein, 9 aa, Homo Sapiens
RRQRVCSRE

SEQ ID NO: 632845 - protein, 9 aa, Homo Sapiens
CIGSLPPHY

SEQ ID NO: 632846 - protein, 9 aa, Homo Sapiens
RLKDRLPLR

SEQ ID NO: 632847 - protein, 9 aa, Homo Sapiens
AYKQLYSWE

SEQ ID NO: 632848 - protein, 9 aa, Homo Sapiens
DSKSLQSRL

SEQ ID NO: 632849 - protein, 9 aa, Homo Sapiens
FELPDDLLL

SEQ ID NO: 632850 - protein, 9 aa, Homo Sapiens
LVGFLDAIM

SEQ ID NO: 632851 - protein, 9 aa, Homo Sapiens
PKFYSYFEF

SEQ ID NO: 632852 - protein, 9 aa, Homo Sapiens
GFLTLLLCL

SEQ ID NO: 632853 - protein, 9 aa, Homo Sapiens
EPLIVFLHL

SEQ ID NO: 632854 - protein, 9 aa, Homo Sapiens
QALGAQRAA

SEQ ID NO: 632855 - protein, 9 aa, Homo Sapiens
KMGARDTRR

SEQ ID NO: 632856 - protein, 9 aa, Homo Sapiens
RSDNFNIGN

SEQ ID NO: 632857 - protein, 9 aa, Homo Sapiens
CHSKVPQHG

SEQ ID NO: 632858 - protein, 9 aa, Homo Sapiens
PHMADIVSV

SEQ ID NO: 632859 - protein, 9 aa, Homo Sapiens
EQEWRLLGN

SEQ ID NO: 632860 - protein, 9 aa, Homo Sapiens
GLYVGQYVH

SEQ ID NO: 632861 - protein, 9 aa, Homo Sapiens
WYSATRFRW

SEQ ID NO: 632862 - protein, 9 aa, Homo Sapiens
KRVHPYYVI

SEQ ID NO: 632863 - protein, 9 aa, Homo Sapiens
GSICTGTFH

SEQ ID NO: 632864 - protein, 9 aa, Homo Sapiens
AQASSLIDN

SEQ ID NO: 632865 - protein, 9 aa, Homo Sapiens
WVYDSLHEE

SEQ ID NO: 632866 - protein, 9 aa, Homo Sapiens
VVGRARPCL

SEQ ID NO: 632867 - protein, 9 aa, Homo Sapiens
LSLVGLLNS

SEQ ID NO: 632868 - protein, 9 aa, Homo Sapiens
GPPREVGAH

SEQ ID NO: 632869 - protein, 9 aa, Homo Sapiens
CCGRHYCGR

SEQ ID NO: 632870 - protein, 9 aa, Homo Sapiens
ATWDALLEK

SEQ ID NO: 632871 - protein, 9 aa, Homo Sapiens
ALWLVAERR

SEQ ID NO: 632872 - protein, 9 aa, Homo Sapiens
KNCSIIKWS

SEQ ID NO: 632873 - protein, 9 aa, Homo Sapiens
ESLKKTRCR

SEQ ID NO: 632874 - protein, 9 aa, Homo Sapiens
EAMQDKFIL

SEQ ID NO: 632875 - protein, 9 aa, Homo Sapiens
EESSCQLSQ

SEQ ID NO: 632876 - protein, 9 aa, Homo Sapiens
MMAEEHTEL

SEQ ID NO: 632877 - protein, 9 aa, Homo Sapiens
VSYVTATDL

SEQ ID NO: 632878 - protein, 9 aa, Homo Sapiens
VQRHDVELL

SEQ ID NO: 632879 - protein, 9 aa, Homo Sapiens
QVQTCEVDI

SEQ ID NO: 632880 - protein, 9 aa, Homo Sapiens
PFSNYFPTP

SEQ ID NO: 632881 - protein, 9 aa, Homo Sapiens
RDSVLQMWS

SEQ ID NO: 632882 - protein, 9 aa, Homo Sapiens
ENGNIKVLN

SEQ ID NO: 632883 - protein, 9 aa, Homo Sapiens
LAFVIVLLL

SEQ ID NO: 632884 - protein, 9 aa, Homo Sapiens
TTLGPSLSQ

SEQ ID NO: 632885 - protein, 9 aa, Homo Sapiens
KEAMAHFTI

SEQ ID NO: 632886 - protein, 9 aa, Homo Sapiens
DYLVDASTQ

SEQ ID NO: 632887 - protein, 9 aa, Homo Sapiens
AEGNGVGRP

SEQ ID NO: 632888 - protein, 9 aa, Homo Sapiens
NSTVMNSRA

SEQ ID NO: 632889 - protein, 9 aa, Homo Sapiens
RISNLKGIF

SEQ ID NO: 632890 - protein, 9 aa, Homo Sapiens
PVNETCNIF

SEQ ID NO: 632891 - protein, 9 aa, Homo Sapiens
GGMASCGPQ

SEQ ID NO: 632892 - protein, 9 aa, Homo Sapiens
DKSVSFFAI

SEQ ID NO: 632893 - protein, 9 aa, Homo Sapiens
LQHVQTLGY

SEQ ID NO: 632894 - protein, 9 aa, Homo Sapiens
SHREVTMKK

SEQ ID NO: 632895 - protein, 9 aa, Homo Sapiens
DNIQLVADG

SEQ ID NO: 632896 - protein, 9 aa, Homo Sapiens
IMERIKEVA

SEQ ID NO: 632897 - protein, 9 aa, Homo Sapiens
MISTLLKWL

SEQ ID NO: 632898 - protein, 9 aa, Homo Sapiens
QSEELPPQS

SEQ ID NO: 632899 - protein, 9 aa, Homo Sapiens
DRYGYWMIY

SEQ ID NO: 632900 - protein, 9 aa, Homo Sapiens
TTSVKKGET

SEQ ID NO: 632901 - protein, 9 aa, Homo Sapiens
ELLRLSQKH

SEQ ID NO: 632902 - protein, 9 aa, Homo Sapiens
ELPDDLLLA

SEQ ID NO: 632903 - protein, 9 aa, Homo Sapiens
LKRILEMGI

SEQ ID NO: 632904 - protein, 9 aa, Homo Sapiens
LWSEDCRLE

SEQ ID NO: 632905 - protein, 9 aa, Homo Sapiens
ILIRNHREK

SEQ ID NO: 632906 - protein, 9 aa, Homo Sapiens
VIVGGGYNG

SEQ ID NO: 632907 - protein, 9 aa, Homo Sapiens
LQNSTVMNS

SEQ ID NO: 632908 - protein, 9 aa, Homo Sapiens
PREVGAHIT

SEQ ID NO: 632909 - protein, 9 aa, Homo Sapiens
SKSSDPVLR

SEQ ID NO: 632910 - protein, 9 aa, Homo Sapiens
YTGYSPQGL

SEQ ID NO: 632911 - protein, 9 aa, Homo Sapiens
VYIGIVASG

SEQ ID NO: 632912 - protein, 9 aa, Homo Sapiens
SAEWSSPVT

SEQ ID NO: 632913 - protein, 9 aa, Homo Sapiens
CANPKYVRA

SEQ ID NO: 632914 - protein, 9 aa, Homo Sapiens
HSPGCLEEG

SEQ ID NO: 632915 - protein, 9 aa, Homo Sapiens
LGRAGTLPR

SEQ ID NO: 632916 - protein, 9 aa, Homo Sapiens
RLVDRRWDG

SEQ ID NO: 632917 - protein, 9 aa, Homo Sapiens
DNGICCIYE

SEQ ID NO: 632918 - protein, 9 aa, Homo Sapiens
IQREEIKFS

SEQ ID NO: 632919 - protein, 9 aa, Homo Sapiens
QAWWASKVF

SEQ ID NO: 632920 - protein, 9 aa, Homo Sapiens
GFLDAIMKK

SEQ ID NO: 632921 - protein, 9 aa, Homo Sapiens
GTSAALAAA

SEQ ID NO: 632922 - protein, 9 aa, Homo Sapiens
QNKNIENQE

SEQ ID NO: 632923 - protein, 9 aa, Homo Sapiens
ETCNIFINS

SEQ ID NO: 632924 - protein, 9 aa, Homo Sapiens
LILANTNTD

SEQ ID NO: 632925 - protein, 9 aa, Homo Sapiens
HREMMAMEE

SEQ ID NO: 632926 - protein, 9 aa, Homo Sapiens
TVFGYLKAD

SEQ ID NO: 632927 - protein, 9 aa, Homo Sapiens
YHHYFPYDY

SEQ ID NO: 632928 - protein, 9 aa, Homo Sapiens
RSFENTAAV

SEQ ID NO: 632929 - protein, 9 aa, Homo Sapiens
DLYSYDYFW

SEQ ID NO: 632930 - protein, 9 aa, Homo Sapiens
FALFQVLII

SEQ ID NO: 632931 - protein, 9 aa, Homo Sapiens
TRSGTHSHS

SEQ ID NO: 632932 - protein, 9 aa, Homo Sapiens
TAVEDVDSM

SEQ ID NO: 632933 - protein, 9 aa, Homo Sapiens
KPLPDCPIV

SEQ ID NO: 632934 - protein, 9 aa, Homo Sapiens
TGMEYRNLG

SEQ ID NO: 632935 - protein, 9 aa, Homo Sapiens
ESNRRTTSS

SEQ ID NO: 632936 - protein, 9 aa, Homo Sapiens
HAGNFANMP

SEQ ID NO: 632937 - protein, 9 aa, Homo Sapiens
VAWLKAYST

SEQ ID NO: 632938 - protein, 9 aa, Homo Sapiens
KENFLELGT

SEQ ID NO: 632939 - protein, 9 aa, Homo Sapiens
SPSQVKGQE

SEQ ID NO: 632940 - protein, 9 aa, Homo Sapiens
QNVTDIDFT

SEQ ID NO: 632941 - protein, 9 aa, Homo Sapiens
RRKHDCLIC

SEQ ID NO: 632942 - protein, 9 aa, Homo Sapiens
RFQSVTLYI

SEQ ID NO: 632943 - protein, 9 aa, Homo Sapiens
GRLASVSKD

SEQ ID NO: 632944 - protein, 9 aa, Homo Sapiens
STTKGRAGG

SEQ ID NO: 632945 - protein, 9 aa, Homo Sapiens
SGGGGSPQS

SEQ ID NO: 632946 - protein, 9 aa, Homo Sapiens
ANMNEHFSS

SEQ ID NO: 632947 - protein, 9 aa, Homo Sapiens
GSGFQSSRM

SEQ ID NO: 632948 - protein, 9 aa, Homo Sapiens
KRSWMTAVP

SEQ ID NO: 632949 - protein, 9 aa, Homo Sapiens
SKHVSLSLS

SEQ ID NO: 632950 - protein, 9 aa, Homo Sapiens
VEANIQHWQ

SEQ ID NO: 632951 - protein, 9 aa, Homo Sapiens
GAHHLPGHV

SEQ ID NO: 632952 - protein, 9 aa, Homo Sapiens
EHHGASCML

SEQ ID NO: 632953 - protein, 9 aa, Homo Sapiens
LEFPWTVHL

SEQ ID NO: 632954 - protein, 9 aa, Homo Sapiens
KNFTVSGTH

SEQ ID NO: 632955 - protein, 9 aa, Homo Sapiens
AFITAICIG

SEQ ID NO: 632956 - protein, 9 aa, Homo Sapiens
TLQEEVSGC

SEQ ID NO: 632957 - protein, 9 aa, Homo Sapiens
HLHEMANSL

SEQ ID NO: 632958 - protein, 9 aa, Homo Sapiens
TLQAHELND

SEQ ID NO: 632959 - protein, 9 aa, Homo Sapiens
SSVLHDVAV

SEQ ID NO: 632960 - protein, 9 aa, Homo Sapiens
CYQQPQEEE

SEQ ID NO: 632961 - protein, 9 aa, Homo Sapiens
KGRKDDDSH

SEQ ID NO: 632962 - protein, 9 aa, Homo Sapiens
VLNVSLRSQ

SEQ ID NO: 632963 - protein, 9 aa, Homo Sapiens
LVARAGTRG

SEQ ID NO: 632964 - protein, 9 aa, Homo Sapiens
GSKGSQAPQ

SEQ ID NO: 632965 - protein, 9 aa, Homo Sapiens
TCKIQALLD

SEQ ID NO: 632966 - protein, 9 aa, Homo Sapiens
KNMTDNAPP

SEQ ID NO: 632967 - protein, 9 aa, Homo Sapiens
AEWSSPVTP

SEQ ID NO: 632968 - protein, 9 aa, Homo Sapiens
GMSIDIASI

SEQ ID NO: 632969 - protein, 9 aa, Homo Sapiens
DCKALGSAR

SEQ ID NO: 632970 - protein, 9 aa, Homo Sapiens
ETILCTRER

SEQ ID NO: 632971 - protein, 9 aa, Homo Sapiens
VRQRGAQGE

SEQ ID NO: 632972 - protein, 9 aa, Homo Sapiens
IRCCNFSSR

SEQ ID NO: 632973 - protein, 9 aa, Homo Sapiens
GIRCWVTCW

SEQ ID NO: 632974 - protein, 9 aa, Homo Sapiens
FVNSRKDRE

SEQ ID NO: 632975 - protein, 9 aa, Homo Sapiens
ARDAGLPPL

SEQ ID NO: 632976 - protein, 9 aa, Homo Sapiens
MLQDFPPYC

SEQ ID NO: 632977 - protein, 9 aa, Homo Sapiens
AFTELRYHV

SEQ ID NO: 632978 - protein, 9 aa, Homo Sapiens
LVIYGDQYA

SEQ ID NO: 632979 - protein, 9 aa, Homo Sapiens
IPPCGCKCS

SEQ ID NO: 632980 - protein, 9 aa, Homo Sapiens
GELGPGFRA

SEQ ID NO: 632981 - protein, 9 aa, Homo Sapiens
MVIFVYIGI

SEQ ID NO: 632982 - protein, 9 aa, Homo Sapiens
FGFLTLLLC

SEQ ID NO: 632983 - protein, 9 aa, Homo Sapiens
GGKTLSLSQ

SEQ ID NO: 632984 - protein, 9 aa, Homo Sapiens
ITICLPLQN

SEQ ID NO: 632985 - protein, 9 aa, Homo Sapiens
TEEMKYVLC

SEQ ID NO: 632986 - protein, 9 aa, Homo Sapiens
GDLRTQQQQ

SEQ ID NO: 632987 - protein, 9 aa, Homo Sapiens
VHADRDNRE

SEQ ID NO: 632988 - protein, 9 aa, Homo Sapiens
LMPCTRGQG

SEQ ID NO: 632989 - protein, 9 aa, Homo Sapiens
NQNEIIFVL

SEQ ID NO: 632990 - protein, 9 aa, Homo Sapiens
VLGARITYQ

SEQ ID NO: 632991 - protein, 9 aa, Homo Sapiens
TVNPNWYSD

SEQ ID NO: 632992 - protein, 9 aa, Homo Sapiens
TLCFCLEEP

SEQ ID NO: 632993 - protein, 9 aa, Homo Sapiens
QRHRPTKKH

SEQ ID NO: 632994 - protein, 9 aa, Homo Sapiens
NIKVLNQEL

SEQ ID NO: 632995 - protein, 9 aa, Homo Sapiens
FAEMVERKE

SEQ ID NO: 632996 - protein, 9 aa, Homo Sapiens
MDPPFGDVF

SEQ ID NO: 632997 - protein, 9 aa, Homo Sapiens
WLKAYSTWE

SEQ ID NO: 632998 - protein, 9 aa, Homo Sapiens
LPPSVRGNV

SEQ ID NO: 632999 - protein, 9 aa, Homo Sapiens
KQKTPPPLA

SEQ ID NO: 633000 - protein, 9 aa, Homo Sapiens
CCPTWHSEC

SEQ ID NO: 633001 - protein, 9 aa, Homo Sapiens
QGPGLQGFL

SEQ ID NO: 633002 - protein, 9 aa, Homo Sapiens
MDASRLDDK

SEQ ID NO: 633003 - protein, 9 aa, Homo Sapiens
AFTGIENID

SEQ ID NO: 633004 - protein, 9 aa, Homo Sapiens
GGPRQPSPW

SEQ ID NO: 633005 - protein, 9 aa, Homo Sapiens
ERLLTSGCD

SEQ ID NO: 633006 - protein, 9 aa, Homo Sapiens
VSATNENSG

SEQ ID NO: 633007 - protein, 9 aa, Homo Sapiens
QLKDSEDSQ

SEQ ID NO: 633008 - protein, 9 aa, Homo Sapiens
PAVGTRSSG

SEQ ID NO: 633009 - protein, 9 aa, Homo Sapiens
MHLFYMELA

SEQ ID NO: 633010 - protein, 9 aa, Homo Sapiens
LTVLVIAHR

SEQ ID NO: 633011 - protein, 9 aa, Homo Sapiens
FSICNMARP

SEQ ID NO: 633012 - protein, 9 aa, Homo Sapiens
AVRAAAAVT

SEQ ID NO: 633013 - protein, 9 aa, Homo Sapiens
FLVLMVTYI

SEQ ID NO: 633014 - protein, 9 aa, Homo Sapiens
VLTTAWGGQ

SEQ ID NO: 633015 - protein, 9 aa, Homo Sapiens
CVYRIGRKK

SEQ ID NO: 633016 - protein, 9 aa, Homo Sapiens
FCGYRSFSI

SEQ ID NO: 633017 - protein, 9 aa, Homo Sapiens
FAIGMSPAV

SEQ ID NO: 633018 - protein, 9 aa, Homo Sapiens
SLQWPVTQP

SEQ ID NO: 633019 - protein, 9 aa, Homo Sapiens
RLTEHVNAI

SEQ ID NO: 633020 - protein, 9 aa, Homo Sapiens
KTRPRLGKA

SEQ ID NO: 633021 - protein, 9 aa, Homo Sapiens
ANPAARHHN

SEQ ID NO: 633022 - protein, 9 aa, Homo Sapiens
VTNMANHVA

SEQ ID NO: 633023 - protein, 9 aa, Homo Sapiens
ANLVSGLKK

SEQ ID NO: 633024 - protein, 9 aa, Homo Sapiens
CISQLELSQ

SEQ ID NO: 633025 - protein, 9 aa, Homo Sapiens
SPDAANCMP

SEQ ID NO: 633026 - protein, 9 aa, Homo Sapiens
PEIPLAMER

SEQ ID NO: 633027 - protein, 9 aa, Homo Sapiens
ESPQELSFL

SEQ ID NO: 633028 - protein, 9 aa, Homo Sapiens
RLPSLKHPS

SEQ ID NO: 633029 - protein, 9 aa, Homo Sapiens
TGVALQDQC

SEQ ID NO: 633030 - protein, 9 aa, Homo Sapiens
PWPEVSRGT

SEQ ID NO: 633031 - protein, 9 aa, Homo Sapiens
LESLSCEYE

SEQ ID NO: 633032 - protein, 9 aa, Homo Sapiens
PPGHLQVEP

SEQ ID NO: 633033 - protein, 9 aa, Homo Sapiens
HLGSGICVD

SEQ ID NO: 633034 - protein, 9 aa, Homo Sapiens
PSLSLEELR

SEQ ID NO: 633035 - protein, 9 aa, Homo Sapiens
RCHSLLSWS

SEQ ID NO: 633036 - protein, 9 aa, Homo Sapiens
IVALSLMHP

SEQ ID NO: 633037 - protein, 9 aa, Homo Sapiens
AGRGNVPLM

SEQ ID NO: 633038 - protein, 9 aa, Homo Sapiens
FRLPENIIH

SEQ ID NO: 633039 - protein, 9 aa, Homo Sapiens
TRLAQMERN

SEQ ID NO: 633040 - protein, 9 aa, Homo Sapiens
CTDNFVRVL

SEQ ID NO: 633041 - protein, 9 aa, Homo Sapiens
TSFIAINKE

SEQ ID NO: 633042 - protein, 9 aa, Homo Sapiens
PPTTSSAFV

SEQ ID NO: 633043 - protein, 9 aa, Homo Sapiens
SNISGYSES

SEQ ID NO: 633044 - protein, 9 aa, Homo Sapiens
ISHDSPAVK

SEQ ID NO: 633045 - protein, 9 aa, Homo Sapiens
NCVDTPSES

SEQ ID NO: 633046 - protein, 9 aa, Homo Sapiens
VTLYIIGGK

SEQ ID NO: 633047 - protein, 9 aa, Homo Sapiens
AREQQRLHR

SEQ ID NO: 633048 - protein, 9 aa, Homo Sapiens
YHHSGTATL

SEQ ID NO: 633049 - protein, 9 aa, Homo Sapiens
QCGKDFSRK

SEQ ID NO: 633050 - protein, 9 aa, Homo Sapiens
SMDSMEGMR

SEQ ID NO: 633051 - protein, 9 aa, Homo Sapiens
MNNEKMLSD

SEQ ID NO: 633052 - protein, 9 aa, Homo Sapiens
RVAPWIMKP

SEQ ID NO: 633053 - protein, 9 aa, Homo Sapiens
YMQDPIVSI

SEQ ID NO: 633054 - protein, 9 aa, Homo Sapiens
VISSFTSFI

SEQ ID NO: 633055 - protein, 9 aa, Homo Sapiens
PRRDEGEEA

SEQ ID NO: 633056 - protein, 9 aa, Homo Sapiens
VNPPQSAIL

SEQ ID NO: 633057 - protein, 9 aa, Homo Sapiens
CLSRFLEDD

SEQ ID NO: 633058 - protein, 9 aa, Homo Sapiens
AHFHTLKLV

SEQ ID NO: 633059 - protein, 9 aa, Homo Sapiens
CGRHYCGRD

SEQ ID NO: 633060 - protein, 9 aa, Homo Sapiens
FPCANPPCA

SEQ ID NO: 633061 - protein, 9 aa, Homo Sapiens
LVHQLFHPW

SEQ ID NO: 633062 - protein, 9 aa, Homo Sapiens
LVESPRLEE

SEQ ID NO: 633063 - protein, 9 aa, Homo Sapiens
GAGGGGGTR

SEQ ID NO: 633064 - protein, 9 aa, Homo Sapiens
NNTYCGIIL

SEQ ID NO: 633065 - protein, 9 aa, Homo Sapiens
VGRARPCLC

SEQ ID NO: 633066 - protein, 9 aa, Homo Sapiens
MANLVSGLK

SEQ ID NO: 633067 - protein, 9 aa, Homo Sapiens
SLIKKDLQA

SEQ ID NO: 633068 - protein, 9 aa, Homo Sapiens
DLLSPSEFK

SEQ ID NO: 633069 - protein, 9 aa, Homo Sapiens
INSPSFDLR

SEQ ID NO: 633070 - protein, 9 aa, Homo Sapiens
KPSTLPPLE

SEQ ID NO: 633071 - protein, 9 aa, Homo Sapiens
YVSSVRYRF

SEQ ID NO: 633072 - protein, 9 aa, Homo Sapiens
MTVKDIVTA

SEQ ID NO: 633073 - protein, 9 aa, Homo Sapiens
KHQGQQYSH

SEQ ID NO: 633074 - protein, 9 aa, Homo Sapiens
STITSVSGG

SEQ ID NO: 633075 - protein, 9 aa, Homo Sapiens
VQKENPLTL

SEQ ID NO: 633076 - protein, 9 aa, Homo Sapiens
QLSNSPGSS

SEQ ID NO: 633077 - protein, 9 aa, Homo Sapiens
RGGSHGARG

SEQ ID NO: 633078 - protein, 9 aa, Homo Sapiens
LLGAKDKTA

SEQ ID NO: 633079 - protein, 9 aa, Homo Sapiens
FISGVLGSG

SEQ ID NO: 633080 - protein, 9 aa, Homo Sapiens
KAKAPTETS

SEQ ID NO: 633081 - protein, 9 aa, Homo Sapiens
MVILRLLLY

SEQ ID NO: 633082 - protein, 9 aa, Homo Sapiens
CGGRRPGPP

SEQ ID NO: 633083 - protein, 9 aa, Homo Sapiens
AKMALDFRG

SEQ ID NO: 633084 - protein, 9 aa, Homo Sapiens
RSVMDSSRP

SEQ ID NO: 633085 - protein, 9 aa, Homo Sapiens
MSIDIASID

SEQ ID NO: 633086 - protein, 9 aa, Homo Sapiens
VDRQPCDRE

SEQ ID NO: 633087 - protein, 9 aa, Homo Sapiens
PLSPSQGQN

SEQ ID NO: 633088 - protein, 9 aa, Homo Sapiens
ELCGGMASC

SEQ ID NO: 633089 - protein, 9 aa, Homo Sapiens
SRKPLCAVW

SEQ ID NO: 633090 - protein, 9 aa, Homo Sapiens
IPRRDEGEE

SEQ ID NO: 633091 - protein, 9 aa, Homo Sapiens
LSLLIIHPS

SEQ ID NO: 633092 - protein, 9 aa, Homo Sapiens
DLCLLLLHG

SEQ ID NO: 633093 - protein, 9 aa, Homo Sapiens
TKRDIKIGP

SEQ ID NO: 633094 - protein, 9 aa, Homo Sapiens
MGSIDLSDV

SEQ ID NO: 633095 - protein, 9 aa, Homo Sapiens
KLSEIHKDE

SEQ ID NO: 633096 - protein, 9 aa, Homo Sapiens
LKNSARHWK

SEQ ID NO: 633097 - protein, 9 aa, Homo Sapiens
MLFAGFPQG

SEQ ID NO: 633098 - protein, 9 aa, Homo Sapiens
FYVGWLKMA

SEQ ID NO: 633099 - protein, 9 aa, Homo Sapiens
STTFQHDFV

SEQ ID NO: 633100 - protein, 9 aa, Homo Sapiens
SGHTCQQWS

SEQ ID NO: 633101 - protein, 9 aa, Homo Sapiens
PRLGKAGLV

SEQ ID NO: 633102 - protein, 9 aa, Homo Sapiens
VFRSHTFSE

SEQ ID NO: 633103 - protein, 9 aa, Homo Sapiens
DYGFSVDLW

SEQ ID NO: 633104 - protein, 9 aa, Homo Sapiens
TITLNVYNV

SEQ ID NO: 633105 - protein, 9 aa, Homo Sapiens
ENCFLYQHL

SEQ ID NO: 633106 - protein, 9 aa, Homo Sapiens
APWDSEGLD

SEQ ID NO: 633107 - protein, 9 aa, Homo Sapiens
IHRIFSICN

SEQ ID NO: 633108 - protein, 9 aa, Homo Sapiens
VESFKKARE

SEQ ID NO: 633109 - protein, 9 aa, Homo Sapiens
DAISKKRDH

SEQ ID NO: 633110 - protein, 9 aa, Homo Sapiens
EFREWGPQS

SEQ ID NO: 633111 - protein, 9 aa, Homo Sapiens
QFDRIHCQS

SEQ ID NO: 633112 - protein, 9 aa, Homo Sapiens
GSPPFQERF

SEQ ID NO: 633113 - protein, 9 aa, Homo Sapiens
GHTCQQWSA

SEQ ID NO: 633114 - protein, 9 aa, Homo Sapiens
QRAATICSM

SEQ ID NO: 633115 - protein, 9 aa, Homo Sapiens
VTADVVLEA

SEQ ID NO: 633116 - protein, 9 aa, Homo Sapiens
REQEDADIA

SEQ ID NO: 633117 - protein, 9 aa, Homo Sapiens
GRFSLSAIR

SEQ ID NO: 633118 - protein, 9 aa, Homo Sapiens
GFHNYHHYF

SEQ ID NO: 633119 - protein, 9 aa, Homo Sapiens
SPWPTPPPF

SEQ ID NO: 633120 - protein, 9 aa, Homo Sapiens
KQALANGMR

SEQ ID NO: 633121 - protein, 9 aa, Homo Sapiens
LHEMANSLP

SEQ ID NO: 633122 - protein, 9 aa, Homo Sapiens
LLALSSIAI

SEQ ID NO: 633123 - protein, 9 aa, Homo Sapiens
TPEVHSRVP

SEQ ID NO: 633124 - protein, 9 aa, Homo Sapiens
CTRGQGWSQ

SEQ ID NO: 633125 - protein, 9 aa, Homo Sapiens
KFILKSILC

SEQ ID NO: 633126 - protein, 9 aa, Homo Sapiens
DEGLSIMHT

SEQ ID NO: 633127 - protein, 9 aa, Homo Sapiens
VSIIKLIFR

SEQ ID NO: 633128 - protein, 9 aa, Homo Sapiens
GNSLSDYKH

SEQ ID NO: 633129 - protein, 9 aa, Homo Sapiens
STQQAVQFA

SEQ ID NO: 633130 - protein, 9 aa, Homo Sapiens
RDPLQDSLA

SEQ ID NO: 633131 - protein, 9 aa, Homo Sapiens
PLPILLVSG

SEQ ID NO: 633132 - protein, 9 aa, Homo Sapiens
NRKTSRLTL

SEQ ID NO: 633133 - protein, 9 aa, Homo Sapiens
WSEAPIPGS

SEQ ID NO: 633134 - protein, 9 aa, Homo Sapiens
DFGNMFVLD

SEQ ID NO: 633135 - protein, 9 aa, Homo Sapiens
KMRQLKGLR

SEQ ID NO: 633136 - protein, 9 aa, Homo Sapiens
IKFMYTDCA

SEQ ID NO: 633137 - protein, 9 aa, Homo Sapiens
GYNGMLILY

SEQ ID NO: 633138 - protein, 9 aa, Homo Sapiens
TMNHPHMQA

SEQ ID NO: 633139 - protein, 9 aa, Homo Sapiens
SHNCSVAPC

SEQ ID NO: 633140 - protein, 9 aa, Homo Sapiens
RYGYWMIYT

SEQ ID NO: 633141 - protein, 9 aa, Homo Sapiens
TCGGALIRQ

SEQ ID NO: 633142 - protein, 9 aa, Homo Sapiens
VRHPKGPDP

SEQ ID NO: 633143 - protein, 9 aa, Homo Sapiens
DSLERAFWD

SEQ ID NO: 633144 - protein, 9 aa, Homo Sapiens
QAGGQHSRG

SEQ ID NO: 633145 - protein, 9 aa, Homo Sapiens
IDIQTIQPS

SEQ ID NO: 633146 - protein, 9 aa, Homo Sapiens
CPTWHSECN

SEQ ID NO: 633147 - protein, 9 aa, Homo Sapiens
RTLQAHELN

SEQ ID NO: 633148 - protein, 9 aa, Homo Sapiens
AECAHCSCC

SEQ ID NO: 633149 - protein, 9 aa, Homo Sapiens
EVFTKPSGR

SEQ ID NO: 633150 - protein, 9 aa, Homo Sapiens
NRRIQITWF

SEQ ID NO: 633151 - protein, 9 aa, Homo Sapiens
HLWVVDLLA

SEQ ID NO: 633152 - protein, 9 aa, Homo Sapiens
QHLQEVRLL

SEQ ID NO: 633153 - protein, 9 aa, Homo Sapiens
ATVTKKDAL

SEQ ID NO: 633154 - protein, 9 aa, Homo Sapiens
GIPDTCSGV

SEQ ID NO: 633155 - protein, 9 aa, Homo Sapiens
RHYCGRDPS

SEQ ID NO: 633156 - protein, 9 aa, Homo Sapiens
VGSHGSRLE

SEQ ID NO: 633157 - protein, 9 aa, Homo Sapiens
LLNNAALAG

SEQ ID NO: 633158 - protein, 9 aa, Homo Sapiens
AIYPLLSKM

SEQ ID NO: 633159 - protein, 9 aa, Homo Sapiens
PLGSKHVSL

SEQ ID NO: 633160 - protein, 9 aa, Homo Sapiens
AFGVDTSSL

SEQ ID NO: 633161 - protein, 9 aa, Homo Sapiens
FCGKTLHHR

SEQ ID NO: 633162 - protein, 9 aa, Homo Sapiens
EVSCLRPRD

SEQ ID NO: 633163 - protein, 9 aa, Homo Sapiens
PCFKGILVH

SEQ ID NO: 633164 - protein, 9 aa, Homo Sapiens
FGFVVAALE

SEQ ID NO: 633165 - protein, 9 aa, Homo Sapiens
TALVSIIKL

SEQ ID NO: 633166 - protein, 9 aa, Homo Sapiens
VSGINDYLT

SEQ ID NO: 633167 - protein, 9 aa, Homo Sapiens
EQRSCLAEV

SEQ ID NO: 633168 - protein, 9 aa, Homo Sapiens
SPSNDSTSP

SEQ ID NO: 633169 - protein, 9 aa, Homo Sapiens
FGNPLLYGS

SEQ ID NO: 633170 - protein, 9 aa, Homo Sapiens
EKKHRYLGL

SEQ ID NO: 633171 - protein, 9 aa, Homo Sapiens
IGPPPGHYD

SEQ ID NO: 633172 - protein, 9 aa, Homo Sapiens
LVCSSVVGS

SEQ ID NO: 633173 - protein, 9 aa, Homo Sapiens
DALRLGAEV

SEQ ID NO: 633174 - protein, 9 aa, Homo Sapiens
NNLKGNLHN

SEQ ID NO: 633175 - protein, 9 aa, Homo Sapiens
DSLHEEWSK

SEQ ID NO: 633176 - protein, 9 aa, Homo Sapiens
RENRSFSGK

SEQ ID NO: 633177 - protein, 9 aa, Homo Sapiens
IIVWMYLPP

SEQ ID NO: 633178 - protein, 9 aa, Homo Sapiens
VRKITCDVN

SEQ ID NO: 633179 - protein, 9 aa, Homo Sapiens
TPPPLAPKP

SEQ ID NO: 633180 - protein, 9 aa, Homo Sapiens
EIAFYRKDW

SEQ ID NO: 633181 - protein, 9 aa, Homo Sapiens
FQDIKNEVG

SEQ ID NO: 633182 - protein, 9 aa, Homo Sapiens
QQEWERQKK

SEQ ID NO: 633183 - protein, 9 aa, Homo Sapiens
REVHTKVIN

SEQ ID NO: 633184 - protein, 9 aa, Homo Sapiens
SGLVPSGGL

SEQ ID NO: 633185 - protein, 9 aa, Homo Sapiens
SMLTSVSVA

SEQ ID NO: 633186 - protein, 9 aa, Homo Sapiens
LRDDFGNMF

SEQ ID NO: 633187 - protein, 9 aa, Homo Sapiens
GSRLASPSG

SEQ ID NO: 633188 - protein, 9 aa, Homo Sapiens
TPEIQAPVA

SEQ ID NO: 633189 - protein, 9 aa, Homo Sapiens
NKIMWLPQQ

SEQ ID NO: 633190 - protein, 9 aa, Homo Sapiens
RPSLALFLT

SEQ ID NO: 633191 - protein, 9 aa, Homo Sapiens
SRVLVEMAH

SEQ ID NO: 633192 - protein, 9 aa, Homo Sapiens
GGLSGTTKL

SEQ ID NO: 633193 - protein, 9 aa, Homo Sapiens
LVRHQDACE

SEQ ID NO: 633194 - protein, 9 aa, Homo Sapiens
PGLLRGPPG

SEQ ID NO: 633195 - protein, 9 aa, Homo Sapiens
SGTHMVHML

SEQ ID NO: 633196 - protein, 9 aa, Homo Sapiens
RRDLGIRLQ

SEQ ID NO: 633197 - protein, 9 aa, Homo Sapiens
DVWLGLVKE

SEQ ID NO: 633198 - protein, 9 aa, Homo Sapiens
CFHGYYGLD

SEQ ID NO: 633199 - protein, 9 aa, Homo Sapiens
IDCVHFLRD

SEQ ID NO: 633200 - protein, 9 aa, Homo Sapiens
QELKRILEM

SEQ ID NO: 633201 - protein, 9 aa, Homo Sapiens
KAHKAQRDP

SEQ ID NO: 633202 - protein, 9 aa, Homo Sapiens
RHHFAKAIA

SEQ ID NO: 633203 - protein, 9 aa, Homo Sapiens
FLIIRHRRQ

SEQ ID NO: 633204 - protein, 9 aa, Homo Sapiens
PPAASSISL

SEQ ID NO: 633205 - protein, 9 aa, Homo Sapiens
GLYRDMGAR

SEQ ID NO: 633206 - protein, 9 aa, Homo Sapiens
CVSVVNVLY

SEQ ID NO: 633207 - protein, 9 aa, Homo Sapiens
CDMTVFENS

SEQ ID NO: 633208 - protein, 9 aa, Homo Sapiens
TRSSGLKLG

SEQ ID NO: 633209 - protein, 9 aa, Homo Sapiens
PGGINSPSF

SEQ ID NO: 633210 - protein, 9 aa, Homo Sapiens
SNSPGSSSA

SEQ ID NO: 633211 - protein, 9 aa, Homo Sapiens
TALNSAPSP

SEQ ID NO: 633212 - protein, 9 aa, Homo Sapiens
EKSELGQRS

SEQ ID NO: 633213 - protein, 9 aa, Homo Sapiens
HHLHSVKTA

SEQ ID NO: 633214 - protein, 9 aa, Homo Sapiens
GAGVVGGYR

SEQ ID NO: 633215 - protein, 9 aa, Homo Sapiens
TTHMENVSP

SEQ ID NO: 633216 - protein, 9 aa, Homo Sapiens
VVESDLLGQ

SEQ ID NO: 633217 - protein, 9 aa, Homo Sapiens
QSVHLQGKP

SEQ ID NO: 633218 - protein, 9 aa, Homo Sapiens
SVTSAATTN

SEQ ID NO: 633219 - protein, 9 aa, Homo Sapiens
TCPSHILVV

SEQ ID NO: 633220 - protein, 9 aa, Homo Sapiens
ALHPVPYNP

SEQ ID NO: 633221 - protein, 9 aa, Homo Sapiens
SHARTSFSS

SEQ ID NO: 633222 - protein, 9 aa, Homo Sapiens
DKENAIDRT

SEQ ID NO: 633223 - protein, 9 aa, Homo Sapiens
EQQGSIAFD

SEQ ID NO: 633224 - protein, 9 aa, Homo Sapiens
DMDKCSVSR

SEQ ID NO: 633225 - protein, 9 aa, Homo Sapiens
ITAICIGSL

SEQ ID NO: 633226 - protein, 9 aa, Homo Sapiens
HINAVIPGR

SEQ ID NO: 633227 - protein, 9 aa, Homo Sapiens
FPAAQRPKR

SEQ ID NO: 633228 - protein, 9 aa, Homo Sapiens
VCRVGGQRA

SEQ ID NO: 633229 - protein, 9 aa, Homo Sapiens
STLDACAKM

SEQ ID NO: 633230 - protein, 9 aa, Homo Sapiens
HQGQQYSHV

SEQ ID NO: 633231 - protein, 9 aa, Homo Sapiens
ECKGAVIVV

SEQ ID NO: 633232 - protein, 9 aa, Homo Sapiens
CISCINLGA

SEQ ID NO: 633233 - protein, 9 aa, Homo Sapiens
AWLKAYSTW

SEQ ID NO: 633234 - protein, 9 aa, Homo Sapiens
GLYYAVRLR

SEQ ID NO: 633235 - protein, 9 aa, Homo Sapiens
CWGYTREGE

SEQ ID NO: 633236 - protein, 9 aa, Homo Sapiens
PAANMNEHF

SEQ ID NO: 633237 - protein, 9 aa, Homo Sapiens
GHAGAGGGG

SEQ ID NO: 633238 - protein, 9 aa, Homo Sapiens
HHNLDMFDD

SEQ ID NO: 633239 - protein, 9 aa, Homo Sapiens
LRAPTKQLF

SEQ ID NO: 633240 - protein, 9 aa, Homo Sapiens
SDILRADYI

SEQ ID NO: 633241 - protein, 9 aa, Homo Sapiens
RKNSAAELY

SEQ ID NO: 633242 - protein, 9 aa, Homo Sapiens
QGTAGLFSH

SEQ ID NO: 633243 - protein, 9 aa, Homo Sapiens
ARCPGCGKG

SEQ ID NO: 633244 - protein, 9 aa, Homo Sapiens
HPQPHTTPS

SEQ ID NO: 633245 - protein, 9 aa, Homo Sapiens
LVVWVSAQA

SEQ ID NO: 633246 - protein, 9 aa, Homo Sapiens
GHEDWGIRL

SEQ ID NO: 633247 - protein, 9 aa, Homo Sapiens
LKVNGIILV

SEQ ID NO: 633248 - protein, 9 aa, Homo Sapiens
NKSKLGANA

SEQ ID NO: 633249 - protein, 9 aa, Homo Sapiens
LPCINSSAT

SEQ ID NO: 633250 - protein, 9 aa, Homo Sapiens
SSPKRSWMT

SEQ ID NO: 633251 - protein, 9 aa, Homo Sapiens
KGPPVNETC

SEQ ID NO: 633252 - protein, 9 aa, Homo Sapiens
GEDDDVEEM

SEQ ID NO: 633253 - protein, 9 aa, Homo Sapiens
DFPPYCWVS

SEQ ID NO: 633254 - protein, 9 aa, Homo Sapiens
QSCLGTLLG

SEQ ID NO: 633255 - protein, 9 aa, Homo Sapiens
SHGARGLMN

SEQ ID NO: 633256 - protein, 9 aa, Homo Sapiens
HLLKTVKPL

SEQ ID NO: 633257 - protein, 9 aa, Homo Sapiens
VHCIACSVY

SEQ ID NO: 633258 - protein, 9 aa, Homo Sapiens
DTVSGINDY

SEQ ID NO: 633259 - protein, 9 aa, Homo Sapiens
VSVLSWAEG

SEQ ID NO: 633260 - protein, 9 aa, Homo Sapiens
LGEIVGSHG

SEQ ID NO: 633261 - protein, 9 aa, Homo Sapiens
FSVDLWALG

SEQ ID NO: 633262 - protein, 9 aa, Homo Sapiens
ASGTKSSLQ

SEQ ID NO: 633263 - protein, 9 aa, Homo Sapiens
DHGTNWRHV

SEQ ID NO: 633264 - protein, 9 aa, Homo Sapiens
DCLVMAWSM

SEQ ID NO: 633265 - protein, 9 aa, Homo Sapiens
KSEGTMPPY

SEQ ID NO: 633266 - protein, 9 aa, Homo Sapiens
YTIEARNTG

SEQ ID NO: 633267 - protein, 9 aa, Homo Sapiens
SAEAWEATC

SEQ ID NO: 633268 - protein, 9 aa, Homo Sapiens
LASRKPLCA

SEQ ID NO: 633269 - protein, 9 aa, Homo Sapiens
HLFYMELAL

SEQ ID NO: 633270 - protein, 9 aa, Homo Sapiens
PNDVITFAR

SEQ ID NO: 633271 - protein, 9 aa, Homo Sapiens
VMGELTRAG

SEQ ID NO: 633272 - protein, 9 aa, Homo Sapiens
LLIIHPSEG

SEQ ID NO: 633273 - protein, 9 aa, Homo Sapiens
SVLQMWSGM

SEQ ID NO: 633274 - protein, 9 aa, Homo Sapiens
RSAPSQSSS

SEQ ID NO: 633275 - protein, 9 aa, Homo Sapiens
ADVYCKLIP

SEQ ID NO: 633276 - protein, 9 aa, Homo Sapiens
RCSAIGTWE

SEQ ID NO: 633277 - protein, 9 aa, Homo Sapiens
TLLLCLDCV

SEQ ID NO: 633278 - protein, 9 aa, Homo Sapiens
QGGKTLSLS

SEQ ID NO: 633279 - protein, 9 aa, Homo Sapiens
QQEDQNKPY

SEQ ID NO: 633280 - protein, 9 aa, Homo Sapiens
KEGIPPEQQ

SEQ ID NO: 633281 - protein, 9 aa, Homo Sapiens
GAQNKGKKA

SEQ ID NO: 633282 - protein, 9 aa, Homo Sapiens
QGASEGPQR

SEQ ID NO: 633283 - protein, 9 aa, Homo Sapiens
CRHTAVLYR

SEQ ID NO: 633284 - protein, 9 aa, Homo Sapiens
VTGDSMLTS

SEQ ID NO: 633285 - protein, 9 aa, Homo Sapiens
RDALRLGAE

SEQ ID NO: 633286 - protein, 9 aa, Homo Sapiens
QQAYSTCPS

SEQ ID NO: 633287 - protein, 9 aa, Homo Sapiens
NDRYVAICH

SEQ ID NO: 633288 - protein, 9 aa, Homo Sapiens
LIEFSGDIS

SEQ ID NO: 633289 - protein, 9 aa, Homo Sapiens
GREKQGASE

SEQ ID NO: 633290 - protein, 9 aa, Homo Sapiens
DMFHDLNRK

SEQ ID NO: 633291 - protein, 9 aa, Homo Sapiens
LVEMAHHFF

SEQ ID NO: 633292 - protein, 9 aa, Homo Sapiens
DIEPGGHWM

SEQ ID NO: 633293 - protein, 9 aa, Homo Sapiens
SFTTVYVPK

SEQ ID NO: 633294 - protein, 9 aa, Homo Sapiens
LIRCCNFSS

SEQ ID NO: 633295 - protein, 9 aa, Homo Sapiens
SGGGYAGYR

SEQ ID NO: 633296 - protein, 9 aa, Homo Sapiens
NKKRPSIDG

SEQ ID NO: 633297 - protein, 9 aa, Homo Sapiens
RQPSPWPTP

SEQ ID NO: 633298 - protein, 9 aa, Homo Sapiens
AIGTWESPK

SEQ ID NO: 633299 - protein, 9 aa, Homo Sapiens
MRQLKGLRV

SEQ ID NO: 633300 - protein, 9 aa, Homo Sapiens
PGTPGIPGN

SEQ ID NO: 633301 - protein, 9 aa, Homo Sapiens
KAQRDPLQD

SEQ ID NO: 633302 - protein, 9 aa, Homo Sapiens
ELGCVRFDC

SEQ ID NO: 633303 - protein, 9 aa, Homo Sapiens
EWYNTHPCN

SEQ ID NO: 633304 - protein, 9 aa, Homo Sapiens
FCFLMANLV

SEQ ID NO: 633305 - protein, 9 aa, Homo Sapiens
FSLSAIRAV

SEQ ID NO: 633306 - protein, 9 aa, Homo Sapiens
QLFMDDINY

SEQ ID NO: 633307 - protein, 9 aa, Homo Sapiens
GKDFSRKSN

SEQ ID NO: 633308 - protein, 9 aa, Homo Sapiens
LAAPPCKHL

SEQ ID NO: 633309 - protein, 9 aa, Homo Sapiens
GTMAETSAS

SEQ ID NO: 633310 - protein, 9 aa, Homo Sapiens
LEAGQCDYA

SEQ ID NO: 633311 - protein, 9 aa, Homo Sapiens
TFKEMRGVM

SEQ ID NO: 633312 - protein, 9 aa, Homo Sapiens
DHYNEAYSR

SEQ ID NO: 633313 - protein, 9 aa, Homo Sapiens
RAGRQDTRS

SEQ ID NO: 633314 - protein, 9 aa, Homo Sapiens
DYWSKAQLK

SEQ ID NO: 633315 - protein, 9 aa, Homo Sapiens
PLANSNISG

SEQ ID NO: 633316 - protein, 9 aa, Homo Sapiens
FLYQHLPVT

SEQ ID NO: 633317 - protein, 9 aa, Homo Sapiens
VPLMLFLHG

SEQ ID NO: 633318 - protein, 9 aa, Homo Sapiens
KKGLRHGYF

SEQ ID NO: 633319 - protein, 9 aa, Homo Sapiens
SFKAVHFST

SEQ ID NO: 633320 - protein, 9 aa, Homo Sapiens
EPSPLPPSQ

SEQ ID NO: 633321 - protein, 9 aa, Homo Sapiens
SNYFPTPAD

SEQ ID NO: 633322 - protein, 9 aa, Homo Sapiens
STEGHYTVI

SEQ ID NO: 633323 - protein, 9 aa, Homo Sapiens
SNSQLHDFW

SEQ ID NO: 633324 - protein, 9 aa, Homo Sapiens
RPFLPFFLQ

SEQ ID NO: 633325 - protein, 9 aa, Homo Sapiens
DFEVSCIYG

SEQ ID NO: 633326 - protein, 9 aa, Homo Sapiens
HPPVDVEDC

SEQ ID NO: 633327 - protein, 9 aa, Homo Sapiens
TSNPELVSF

SEQ ID NO: 633328 - protein, 9 aa, Homo Sapiens
KSSDPVLRR

SEQ ID NO: 633329 - protein, 9 aa, Homo Sapiens
TDQSLDEEQ

SEQ ID NO: 633330 - protein, 9 aa, Homo Sapiens
AVQFAKAMD

SEQ ID NO: 633331 - protein, 9 aa, Homo Sapiens
ALVLLKARL

SEQ ID NO: 633332 - protein, 9 aa, Homo Sapiens
CLPGPPGTM

SEQ ID NO: 633333 - protein, 9 aa, Homo Sapiens
KDRYGYWMI

SEQ ID NO: 633334 - protein, 9 aa, Homo Sapiens
YCNNYDMTS

SEQ ID NO: 633335 - protein, 9 aa, Homo Sapiens
CFLMANLVS

SEQ ID NO: 633336 - protein, 9 aa, Homo Sapiens
DYLAPAATV

SEQ ID NO: 633337 - protein, 9 aa, Homo Sapiens
LRVFSTGRF

SEQ ID NO: 633338 - protein, 9 aa, Homo Sapiens
GYRGLRLHF

SEQ ID NO: 633339 - protein, 9 aa, Homo Sapiens
MRKCAKEVG

SEQ ID NO: 633340 - protein, 9 aa, Homo Sapiens
QKTWYSATR

SEQ ID NO: 633341 - protein, 9 aa, Homo Sapiens
RMVLLSLVL

SEQ ID NO: 633342 - protein, 9 aa, Homo Sapiens
RIADPYQPV

SEQ ID NO: 633343 - protein, 9 aa, Homo Sapiens
LSWYPVIKQ

SEQ ID NO: 633344 - protein, 9 aa, Homo Sapiens
LGPPRSEGS

SEQ ID NO: 633345 - protein, 9 aa, Homo Sapiens
CSCVSVVNV

SEQ ID NO: 633346 - protein, 9 aa, Homo Sapiens
APELPREGL

SEQ ID NO: 633347 - protein, 9 aa, Homo Sapiens
HLRREVETE

SEQ ID NO: 633348 - protein, 9 aa, Homo Sapiens
WYVGFTKKW

SEQ ID NO: 633349 - protein, 9 aa, Homo Sapiens
VVFYELAHE

SEQ ID NO: 633350 - protein, 9 aa, Homo Sapiens
MILADFQAF

SEQ ID NO: 633351 - protein, 9 aa, Homo Sapiens
FGESEGAAS

SEQ ID NO: 633352 - protein, 9 aa, Homo Sapiens
LLSWYPVIK

SEQ ID NO: 633353 - protein, 9 aa, Homo Sapiens
QPGRKGFPV

SEQ ID NO: 633354 - protein, 9 aa, Homo Sapiens
AINTPVHFH

SEQ ID NO: 633355 - protein, 9 aa, Homo Sapiens
SQLIRCCNF

SEQ ID NO: 633356 - protein, 9 aa, Homo Sapiens
DSAFTELRY

SEQ ID NO: 633357 - protein, 9 aa, Homo Sapiens
FENIVGTVT

SEQ ID NO: 633358 - protein, 9 aa, Homo Sapiens
EHTIVFLVG

SEQ ID NO: 633359 - protein, 9 aa, Homo Sapiens
SSRYGPSTY

SEQ ID NO: 633360 - protein, 9 aa, Homo Sapiens
CRPSLALFL

SEQ ID NO: 633361 - protein, 9 aa, Homo Sapiens
RGYNAQEYC

SEQ ID NO: 633362 - protein, 9 aa, Homo Sapiens
PVVPVPPLM

SEQ ID NO: 633363 - protein, 9 aa, Homo Sapiens
VWVSAQASS

SEQ ID NO: 633364 - protein, 9 aa, Homo Sapiens
REVLGDIVD

SEQ ID NO: 633365 - protein, 9 aa, Homo Sapiens
DYAPLQQVD

SEQ ID NO: 633366 - protein, 9 aa, Homo Sapiens
AHSGLWPTW

SEQ ID NO: 633367 - protein, 9 aa, Homo Sapiens
GHWKHQGQQ

SEQ ID NO: 633368 - protein, 9 aa, Homo Sapiens
LAPKPAVKS

SEQ ID NO: 633369 - protein, 9 aa, Homo Sapiens
MYPSAHRSR

SEQ ID NO: 633370 - protein, 9 aa, Homo Sapiens
QAIIYRGGY

SEQ ID NO: 633371 - protein, 9 aa, Homo Sapiens
VHGIEDLII

SEQ ID NO: 633372 - protein, 9 aa, Homo Sapiens
ASRYPIMYV

SEQ ID NO: 633373 - protein, 9 aa, Homo Sapiens
DSPAVGTRS

SEQ ID NO: 633374 - protein, 9 aa, Homo Sapiens
PGARQLVGP

SEQ ID NO: 633375 - protein, 9 aa, Homo Sapiens
PAAPEPEEH

SEQ ID NO: 633376 - protein, 9 aa, Homo Sapiens
STVMIGLLM

SEQ ID NO: 633377 - protein, 9 aa, Homo Sapiens
SEVLVCVLV

SEQ ID NO: 633378 - protein, 9 aa, Homo Sapiens
GHTLAAATC

SEQ ID NO: 633379 - protein, 9 aa, Homo Sapiens
QDFEFQSQK

SEQ ID NO: 633380 - protein, 9 aa, Homo Sapiens
FGKRRKEWL

SEQ ID NO: 633381 - protein, 9 aa, Homo Sapiens
SPTDPARRE

SEQ ID NO: 633382 - protein, 9 aa, Homo Sapiens
WWASKVFAN

SEQ ID NO: 633383 - protein, 9 aa, Homo Sapiens
EAIYPLLSK

SEQ ID NO: 633384 - protein, 9 aa, Homo Sapiens
DLPNDVITF

SEQ ID NO: 633385 - protein, 9 aa, Homo Sapiens
SSRPQAGPL

SEQ ID NO: 633386 - protein, 9 aa, Homo Sapiens
MLITYIKIL

SEQ ID NO: 633387 - protein, 9 aa, Homo Sapiens
HYRWKQNVT

SEQ ID NO: 633388 - protein, 9 aa, Homo Sapiens
HTVNPNWYS

SEQ ID NO: 633389 - protein, 9 aa, Homo Sapiens
QFSHLKRHQ

SEQ ID NO: 633390 - protein, 9 aa, Homo Sapiens
KQIGAATDI

SEQ ID NO: 633391 - protein, 9 aa, Homo Sapiens
VISLGSDVS

SEQ ID NO: 633392 - protein, 9 aa, Homo Sapiens
EEHEERKPS

SEQ ID NO: 633393 - protein, 9 aa, Homo Sapiens
GGNLNYSAI

SEQ ID NO: 633394 - protein, 9 aa, Homo Sapiens
ALIRQNWVM

SEQ ID NO: 633395 - protein, 9 aa, Homo Sapiens
PPQENCFLY

SEQ ID NO: 633396 - protein, 9 aa, Homo Sapiens
PLAMERFPY

SEQ ID NO: 633397 - protein, 9 aa, Homo Sapiens
KLPFGSICT

SEQ ID NO: 633398 - protein, 9 aa, Homo Sapiens
TILCTRERI

SEQ ID NO: 633399 - protein, 9 aa, Homo Sapiens
RKAMRKCAK

SEQ ID NO: 633400 - protein, 9 aa, Homo Sapiens
LGVYSLGLS

SEQ ID NO: 633401 - protein, 9 aa, Homo Sapiens
QSSRMEKYG

SEQ ID NO: 633402 - protein, 9 aa, Homo Sapiens
PPEQQRLIF

SEQ ID NO: 633403 - protein, 9 aa, Homo Sapiens
AMGSSSDSC

SEQ ID NO: 633404 - protein, 9 aa, Homo Sapiens
SSADPCGGG

SEQ ID NO: 633405 - protein, 9 aa, Homo Sapiens
GGGYNGMLI

SEQ ID NO: 633406 - protein, 9 aa, Homo Sapiens
KQELICKLL

SEQ ID NO: 633407 - protein, 9 aa, Homo Sapiens
LCISCINLG

SEQ ID NO: 633408 - protein, 9 aa, Homo Sapiens
WKLMVVESD

SEQ ID NO: 633409 - protein, 9 aa, Homo Sapiens
LKGLQHTNI

SEQ ID NO: 633410 - protein, 9 aa, Homo Sapiens
WFREAYGAL

SEQ ID NO: 633411 - protein, 9 aa, Homo Sapiens
YPAKMALDF

SEQ ID NO: 633412 - protein, 9 aa, Homo Sapiens
GKGTINAQE

SEQ ID NO: 633413 - protein, 9 aa, Homo Sapiens
LYELFQDPS

SEQ ID NO: 633414 - protein, 9 aa, Homo Sapiens
RFGAHHLPG

SEQ ID NO: 633415 - protein, 9 aa, Homo Sapiens
DTTHMENVS

SEQ ID NO: 633416 - protein, 9 aa, Homo Sapiens
KKHRYLGLS

SEQ ID NO: 633417 - protein, 9 aa, Homo Sapiens
VAPWIMKPS

SEQ ID NO: 633418 - protein, 9 aa, Homo Sapiens
GKTFRQFSH

SEQ ID NO: 633419 - protein, 9 aa, Homo Sapiens
TFFSHRFVG

SEQ ID NO: 633420 - protein, 9 aa, Homo Sapiens
QALANGMRR

SEQ ID NO: 633421 - protein, 9 aa, Homo Sapiens
AMAAYEDVL

SEQ ID NO: 633422 - protein, 9 aa, Homo Sapiens
ILNTTLQGS

SEQ ID NO: 633423 - protein, 9 aa, Homo Sapiens
SDRSSSMLL

SEQ ID NO: 633424 - protein, 9 aa, Homo Sapiens
DLTNYLMLL

SEQ ID NO: 633425 - protein, 9 aa, Homo Sapiens
VYVIEDGKV

SEQ ID NO: 633426 - protein, 9 aa, Homo Sapiens
VPCPVRFQY

SEQ ID NO: 633427 - protein, 9 aa, Homo Sapiens
SEAPIPGSL

SEQ ID NO: 633428 - protein, 9 aa, Homo Sapiens
RFACIAAFF

SEQ ID NO: 633429 - protein, 9 aa, Homo Sapiens
TVHCIACSV

SEQ ID NO: 633430 - protein, 9 aa, Homo Sapiens
YNLEAGQCD

SEQ ID NO: 633431 - protein, 9 aa, Homo Sapiens
LDTFEPQKF

SEQ ID NO: 633432 - protein, 9 aa, Homo Sapiens
DDDSHDESQ

SEQ ID NO: 633433 - protein, 9 aa, Homo Sapiens
TVSGTHMVH

SEQ ID NO: 633434 - protein, 9 aa, Homo Sapiens
ALVSHESSA

SEQ ID NO: 633435 - protein, 9 aa, Homo Sapiens
PVSLCANPK

SEQ ID NO: 633436 - protein, 9 aa, Homo Sapiens
LAFDLNDEK

SEQ ID NO: 633437 - protein, 9 aa, Homo Sapiens
VELNEQRKR

SEQ ID NO: 633438 - protein, 9 aa, Homo Sapiens
EAINECKGA

SEQ ID NO: 633439 - protein, 9 aa, Homo Sapiens
MIATLQLFM

SEQ ID NO: 633440 - protein, 9 aa, Homo Sapiens
IKHQDEIAS

SEQ ID NO: 633441 - protein, 9 aa, Homo Sapiens
TDLGLVYET

SEQ ID NO: 633442 - protein, 9 aa, Homo Sapiens
SLSCEYEAI

SEQ ID NO: 633443 - protein, 9 aa, Homo Sapiens
ISGYSLEVC

SEQ ID NO: 633444 - protein, 9 aa, Homo Sapiens
WVVSYVVLV

SEQ ID NO: 633445 - protein, 9 aa, Homo Sapiens
LAAWFMMKY

SEQ ID NO: 633446 - protein, 9 aa, Homo Sapiens
EVGDVEDVI

SEQ ID NO: 633447 - protein, 9 aa, Homo Sapiens
PPCKHLSDA

SEQ ID NO: 633448 - protein, 9 aa, Homo Sapiens
ARDTRRLLE

SEQ ID NO: 633449 - protein, 9 aa, Homo Sapiens
HPKGPDPDS

SEQ ID NO: 633450 - protein, 9 aa, Homo Sapiens
NPLTLAVPK

SEQ ID NO: 633451 - protein, 9 aa, Homo Sapiens
STFKEMRGV

SEQ ID NO: 633452 - protein, 9 aa, Homo Sapiens
NGHLGQRWH

SEQ ID NO: 633453 - protein, 9 aa, Homo Sapiens
EIKKFESLI

SEQ ID NO: 633454 - protein, 9 aa, Homo Sapiens
DRLPLRARE

SEQ ID NO: 633455 - protein, 9 aa, Homo Sapiens
QTLGYTKSP

SEQ ID NO: 633456 - protein, 9 aa, Homo Sapiens
MMKLRSREA

SEQ ID NO: 633457 - protein, 9 aa, Homo Sapiens
LKEKSRPTG

SEQ ID NO: 633458 - protein, 9 aa, Homo Sapiens
KNSARHWKT

SEQ ID NO: 633459 - protein, 9 aa, Homo Sapiens
RRKAMRKCA

SEQ ID NO: 633460 - protein, 9 aa, Homo Sapiens
STMVRTSAF

SEQ ID NO: 633461 - protein, 9 aa, Homo Sapiens
TERKILDSL

SEQ ID NO: 633462 - protein, 9 aa, Homo Sapiens
KRKMGARDT

SEQ ID NO: 633463 - protein, 9 aa, Homo Sapiens
HDSLSLKVF

SEQ ID NO: 633464 - protein, 9 aa, Homo Sapiens
TQNAYACPR

SEQ ID NO: 633465 - protein, 9 aa, Homo Sapiens
QKPEIKQLL

SEQ ID NO: 633466 - protein, 9 aa, Homo Sapiens
STPQGEDRK

SEQ ID NO: 633467 - protein, 9 aa, Homo Sapiens
PEQQRLIFA

SEQ ID NO: 633468 - protein, 9 aa, Homo Sapiens
SDSSMGLLY

SEQ ID NO: 633469 - protein, 9 aa, Homo Sapiens
DGAHSPGCL

SEQ ID NO: 633470 - protein, 9 aa, Homo Sapiens
TSTSFYKLF

SEQ ID NO: 633471 - protein, 9 aa, Homo Sapiens
GNLVSVLSW

SEQ ID NO: 633472 - protein, 9 aa, Homo Sapiens
GPYIRDYPA

SEQ ID NO: 633473 - protein, 9 aa, Homo Sapiens
DCLICFENE

SEQ ID NO: 633474 - protein, 9 aa, Homo Sapiens
LETSFQVPL

SEQ ID NO: 633475 - protein, 9 aa, Homo Sapiens
GRAGRQDTR

SEQ ID NO: 633476 - protein, 9 aa, Homo Sapiens
TIWLLYVFG

SEQ ID NO: 633477 - protein, 9 aa, Homo Sapiens
SHDSPAVKL

SEQ ID NO: 633478 - protein, 9 aa, Homo Sapiens
KGSRPYSIS

SEQ ID NO: 633479 - protein, 9 aa, Homo Sapiens
LAGKGSKGS

SEQ ID NO: 633480 - protein, 9 aa, Homo Sapiens
HPHLVEEAF

SEQ ID NO: 633481 - protein, 9 aa, Homo Sapiens
LGSVMSTKI

SEQ ID NO: 633482 - protein, 9 aa, Homo Sapiens
HEPSTPGGL

SEQ ID NO: 633483 - protein, 9 aa, Homo Sapiens
SSLTILIRF

SEQ ID NO: 633484 - protein, 9 aa, Homo Sapiens
GYSEYKIVC

SEQ ID NO: 633485 - protein, 9 aa, Homo Sapiens
KHVLTRHTQ

SEQ ID NO: 633486 - protein, 9 aa, Homo Sapiens
QLPALGLLE

SEQ ID NO: 633487 - protein, 9 aa, Homo Sapiens
PGHAGAGGG

SEQ ID NO: 633488 - protein, 9 aa, Homo Sapiens
IIQHNCSRQ

SEQ ID NO: 633489 - protein, 9 aa, Homo Sapiens
MGYPVLKVN

SEQ ID NO: 633490 - protein, 9 aa, Homo Sapiens
KVKFNTFTT

SEQ ID NO: 633491 - protein, 9 aa, Homo Sapiens
EDSGQPVLS

SEQ ID NO: 633492 - protein, 9 aa, Homo Sapiens
FSRRTTPFV

SEQ ID NO: 633493 - protein, 9 aa, Homo Sapiens
ELFMIVLDR

SEQ ID NO: 633494 - protein, 9 aa, Homo Sapiens
TSRLTLSLP

SEQ ID NO: 633495 - protein, 9 aa, Homo Sapiens
HILIRNHRE

SEQ ID NO: 633496 - protein, 9 aa, Homo Sapiens
SSGGGGSPQ

SEQ ID NO: 633497 - protein, 9 aa, Homo Sapiens
SGCPAPPPP

SEQ ID NO: 633498 - protein, 9 aa, Homo Sapiens
NKKARISLL

SEQ ID NO: 633499 - protein, 9 aa, Homo Sapiens
KLFVFAFTC

SEQ ID NO: 633500 - protein, 9 aa, Homo Sapiens
KKDALLEKQ

SEQ ID NO: 633501 - protein, 9 aa, Homo Sapiens
YKTRPRLGK

SEQ ID NO: 633502 - protein, 9 aa, Homo Sapiens
GMTLATDHT

SEQ ID NO: 633503 - protein, 9 aa, Homo Sapiens
ANIQHWQQV

SEQ ID NO: 633504 - protein, 9 aa, Homo Sapiens
RERLRRLLH

SEQ ID NO: 633505 - protein, 9 aa, Homo Sapiens
DVEDCDGSS

SEQ ID NO: 633506 - protein, 9 aa, Homo Sapiens
KPQGPHQQG

SEQ ID NO: 633507 - protein, 9 aa, Homo Sapiens
ECQDLDTFE

SEQ ID NO: 633508 - protein, 9 aa, Homo Sapiens
VSLSLLIIH

SEQ ID NO: 633509 - protein, 9 aa, Homo Sapiens
HFDPCTKCE

SEQ ID NO: 633510 - protein, 9 aa, Homo Sapiens
VRFDCDKSL

SEQ ID NO: 633511 - protein, 9 aa, Homo Sapiens
MFISGVLGS

SEQ ID NO: 633512 - protein, 9 aa, Homo Sapiens
VIARNLNVM

SEQ ID NO: 633513 - protein, 9 aa, Homo Sapiens
LALLTCLLL

SEQ ID NO: 633514 - protein, 9 aa, Homo Sapiens
IAIAKKLPK

SEQ ID NO: 633515 - protein, 9 aa, Homo Sapiens
MKYVLCQLV

SEQ ID NO: 633516 - protein, 9 aa, Homo Sapiens
SSESTSNPE

SEQ ID NO: 633517 - protein, 9 aa, Homo Sapiens
QTTSVKKGE

SEQ ID NO: 633518 - protein, 9 aa, Homo Sapiens
DGNFVFFQG

SEQ ID NO: 633519 - protein, 9 aa, Homo Sapiens
ELEKKHRYL

SEQ ID NO: 633520 - protein, 9 aa, Homo Sapiens
FTVQSHGVD

SEQ ID NO: 633521 - protein, 9 aa, Homo Sapiens
VMEGKQVQW

SEQ ID NO: 633522 - protein, 9 aa, Homo Sapiens
GLRVAACQP

SEQ ID NO: 633523 - protein, 9 aa, Homo Sapiens
WKRLNDHGT

SEQ ID NO: 633524 - protein, 9 aa, Homo Sapiens
LSAHGRGPL

SEQ ID NO: 633525 - protein, 9 aa, Homo Sapiens
LFLIIRHRR

SEQ ID NO: 633526 - protein, 9 aa, Homo Sapiens
GFASGMKDK

SEQ ID NO: 633527 - protein, 9 aa, Homo Sapiens
EETGGRPAM

SEQ ID NO: 633528 - protein, 9 aa, Homo Sapiens
GEYSVTAHA

SEQ ID NO: 633529 - protein, 9 aa, Homo Sapiens
PVAGGGSGG

SEQ ID NO: 633530 - protein, 9 aa, Homo Sapiens
SGFRSVTTS

SEQ ID NO: 633531 - protein, 9 aa, Homo Sapiens
KQTNKGKYF

SEQ ID NO: 633532 - protein, 9 aa, Homo Sapiens
VGMSIDIAS

SEQ ID NO: 633533 - protein, 9 aa, Homo Sapiens
CRLLVIDIQ

SEQ ID NO: 633534 - protein, 9 aa, Homo Sapiens
QLKGLRVAA

SEQ ID NO: 633535 - protein, 9 aa, Homo Sapiens
GAEDTAFDC

SEQ ID NO: 633536 - protein, 9 aa, Homo Sapiens
HQDACETMG

SEQ ID NO: 633537 - protein, 9 aa, Homo Sapiens
CLLVRTYPE

SEQ ID NO: 633538 - protein, 9 aa, Homo Sapiens
RAILTCSVF

SEQ ID NO: 633539 - protein, 9 aa, Homo Sapiens
EPCPPTKCP

SEQ ID NO: 633540 - protein, 9 aa, Homo Sapiens
HILAVLLEA

SEQ ID NO: 633541 - protein, 9 aa, Homo Sapiens
VAYYFCWEP

SEQ ID NO: 633542 - protein, 9 aa, Homo Sapiens
CIQAWAQQL

SEQ ID NO: 633543 - protein, 9 aa, Homo Sapiens
SGYSLEVCL

SEQ ID NO: 633544 - protein, 9 aa, Homo Sapiens
EEHDKVLHC

SEQ ID NO: 633545 - protein, 9 aa, Homo Sapiens
IIYRGGYNR

SEQ ID NO: 633546 - protein, 9 aa, Homo Sapiens
AELPPEDQS

SEQ ID NO: 633547 - protein, 9 aa, Homo Sapiens
SRLARKAHV

SEQ ID NO: 633548 - protein, 9 aa, Homo Sapiens
LCPRTCHLN

SEQ ID NO: 633549 - protein, 9 aa, Homo Sapiens
RPPGGQWGD

SEQ ID NO: 633550 - protein, 9 aa, Homo Sapiens
SWPGELGPG

SEQ ID NO: 633551 - protein, 9 aa, Homo Sapiens
VQTVRNGIN

SEQ ID NO: 633552 - protein, 9 aa, Homo Sapiens
VTVDYNIAG

SEQ ID NO: 633553 - protein, 9 aa, Homo Sapiens
STSLHNCKA

SEQ ID NO: 633554 - protein, 9 aa, Homo Sapiens
RERNKPDIF

SEQ ID NO: 633555 - protein, 9 aa, Homo Sapiens
DVLRVRVHT

SEQ ID NO: 633556 - protein, 9 aa, Homo Sapiens
EGTSAALAA

SEQ ID NO: 633557 - protein, 9 aa, Homo Sapiens
EIFIAIAKK

SEQ ID NO: 633558 - protein, 9 aa, Homo Sapiens
DIVNLLLDF

SEQ ID NO: 633559 - protein, 9 aa, Homo Sapiens
SSCQLSQRC

SEQ ID NO: 633560 - protein, 9 aa, Homo Sapiens
SAGRGNVPL

SEQ ID NO: 633561 - protein, 9 aa, Homo Sapiens
RNLSLDVDA

SEQ ID NO: 633562 - protein, 9 aa, Homo Sapiens
EVLVCVLVL

SEQ ID NO: 633563 - protein, 9 aa, Homo Sapiens
CQLSQRCPE

SEQ ID NO: 633564 - protein, 9 aa, Homo Sapiens
GQLKASLQA

SEQ ID NO: 633565 - protein, 9 aa, Homo Sapiens
QRPHQFRRF

SEQ ID NO: 633566 - protein, 9 aa, Homo Sapiens
QGQNTHVHD

SEQ ID NO: 633567 - protein, 9 aa, Homo Sapiens
ADVEERYHA

SEQ ID NO: 633568 - protein, 9 aa, Homo Sapiens
KGEWNLKSP

SEQ ID NO: 633569 - protein, 9 aa, Homo Sapiens
GEPRPPGGQ

SEQ ID NO: 633570 - protein, 9 aa, Homo Sapiens
PQSCSIKNR

SEQ ID NO: 633571 - protein, 9 aa, Homo Sapiens
GSIAFDNVE

SEQ ID NO: 633572 - protein, 9 aa, Homo Sapiens
HCSPGWCEN

SEQ ID NO: 633573 - protein, 9 aa, Homo Sapiens
VLHDVAVLR

SEQ ID NO: 633574 - protein, 9 aa, Homo Sapiens
PTDDSTFEE

SEQ ID NO: 633575 - protein, 9 aa, Homo Sapiens
PAKMALDFR

SEQ ID NO: 633576 - protein, 9 aa, Homo Sapiens
AAGHLDGKV

SEQ ID NO: 633577 - protein, 9 aa, Homo Sapiens
NQTTSVKKG

SEQ ID NO: 633578 - protein, 9 aa, Homo Sapiens
LICCPLCRG

SEQ ID NO: 633579 - protein, 9 aa, Homo Sapiens
NSFAIKILD

SEQ ID NO: 633580 - protein, 9 aa, Homo Sapiens
PKVSYVTAT

SEQ ID NO: 633581 - protein, 9 aa, Homo Sapiens
EGMRSPYAG

SEQ ID NO: 633582 - protein, 9 aa, Homo Sapiens
SPVTPTPSK

SEQ ID NO: 633583 - protein, 9 aa, Homo Sapiens
FIAFGVDTS

SEQ ID NO: 633584 - protein, 9 aa, Homo Sapiens
RAVVLIPWM

SEQ ID NO: 633585 - protein, 9 aa, Homo Sapiens
VHFSTVSSL

SEQ ID NO: 633586 - protein, 9 aa, Homo Sapiens
GIALDERGQ

SEQ ID NO: 633587 - protein, 9 aa, Homo Sapiens
ADSKGDVWL

SEQ ID NO: 633588 - protein, 9 aa, Homo Sapiens
EDGAQAPWD

SEQ ID NO: 633589 - protein, 9 aa, Homo Sapiens
RNGINMYTV

SEQ ID NO: 633590 - protein, 9 aa, Homo Sapiens
YELSSYQLR

SEQ ID NO: 633591 - protein, 9 aa, Homo Sapiens
STPLECGRE

SEQ ID NO: 633592 - protein, 9 aa, Homo Sapiens
LQHLTVVMQ

SEQ ID NO: 633593 - protein, 9 aa, Homo Sapiens
LHYWELHVD

SEQ ID NO: 633594 - protein, 9 aa, Homo Sapiens
KPEIKQLLS

SEQ ID NO: 633595 - protein, 9 aa, Homo Sapiens
SASKDDSII

SEQ ID NO: 633596 - protein, 9 aa, Homo Sapiens
TSSLTLSIS

SEQ ID NO: 633597 - protein, 9 aa, Homo Sapiens
FFHPHHIVG

SEQ ID NO: 633598 - protein, 9 aa, Homo Sapiens
TLIIITSYT

SEQ ID NO: 633599 - protein, 9 aa, Homo Sapiens
FVFFQGNKY

SEQ ID NO: 633600 - protein, 9 aa, Homo Sapiens
TPTPSKYTS

SEQ ID NO: 633601 - protein, 9 aa, Homo Sapiens
IDAGTMAET

SEQ ID NO: 633602 - protein, 9 aa, Homo Sapiens
GLIPLHKAA

SEQ ID NO: 633603 - protein, 9 aa, Homo Sapiens
SSLTLSISG

SEQ ID NO: 633604 - protein, 9 aa, Homo Sapiens
RLPANRRIQ

SEQ ID NO: 633605 - protein, 9 aa, Homo Sapiens
LDNLSGADI

SEQ ID NO: 633606 - protein, 9 aa, Homo Sapiens
EKVRQRIVA

SEQ ID NO: 633607 - protein, 9 aa, Homo Sapiens
ISGIFKEVC

SEQ ID NO: 633608 - protein, 9 aa, Homo Sapiens
SLNVLEQFV

SEQ ID NO: 633609 - protein, 9 aa, Homo Sapiens
DCALVISGY

SEQ ID NO: 633610 - protein, 9 aa, Homo Sapiens
PPNLGDKPL

SEQ ID NO: 633611 - protein, 9 aa, Homo Sapiens
ADIVSVTSS

SEQ ID NO: 633612 - protein, 9 aa, Homo Sapiens
MYFFLWNFS

SEQ ID NO: 633613 - protein, 9 aa, Homo Sapiens
SGMELLSWY

SEQ ID NO: 633614 - protein, 9 aa, Homo Sapiens
QSPPLSLWA

SEQ ID NO: 633615 - protein, 9 aa, Homo Sapiens
VYTLCFCLE

SEQ ID NO: 633616 - protein, 9 aa, Homo Sapiens
PQGPAGHGL

SEQ ID NO: 633617 - protein, 9 aa, Homo Sapiens
REGLGRAGT

SEQ ID NO: 633618 - protein, 9 aa, Homo Sapiens
ARFKISNVR

SEQ ID NO: 633619 - protein, 9 aa, Homo Sapiens
LQDQCKLTC

SEQ ID NO: 633620 - protein, 9 aa, Homo Sapiens
ERLRRLLHW

SEQ ID NO: 633621 - protein, 9 aa, Homo Sapiens
TMSSTDLLY

SEQ ID NO: 633622 - protein, 9 aa, Homo Sapiens
YYIDSDGNG

SEQ ID NO: 633623 - protein, 9 aa, Homo Sapiens
MANDRYVAI

SEQ ID NO: 633624 - protein, 9 aa, Homo Sapiens
IRKPEVLTG

SEQ ID NO: 633625 - protein, 9 aa, Homo Sapiens
LETITIPHL

SEQ ID NO: 633626 - protein, 9 aa, Homo Sapiens
LLLGLALVL

SEQ ID NO: 633627 - protein, 9 aa, Homo Sapiens
LLLRGAYGA

SEQ ID NO: 633628 - protein, 9 aa, Homo Sapiens
DGCADRYDV

SEQ ID NO: 633629 - protein, 9 aa, Homo Sapiens
LIFIMCNSV

SEQ ID NO: 633630 - protein, 9 aa, Homo Sapiens
EKLSKAENK

SEQ ID NO: 633631 - protein, 9 aa, Homo Sapiens
REAYGALTQ

SEQ ID NO: 633632 - protein, 9 aa, Homo Sapiens
TVQYAVLHW

SEQ ID NO: 633633 - protein, 9 aa, Homo Sapiens
IEEKINKIM

SEQ ID NO: 633634 - protein, 9 aa, Homo Sapiens
QQLRPKKMD

SEQ ID NO: 633635 - protein, 9 aa, Homo Sapiens
HRFNDSEVL

SEQ ID NO: 633636 - protein, 9 aa, Homo Sapiens
GREVLGDIV

SEQ ID NO: 633637 - protein, 9 aa, Homo Sapiens
DARKYTVVA

SEQ ID NO: 633638 - protein, 9 aa, Homo Sapiens
RKYVRSRLQ

SEQ ID NO: 633639 - protein, 9 aa, Homo Sapiens
RYMQDPIVS

SEQ ID NO: 633640 - protein, 9 aa, Homo Sapiens
SMATQNAYA

SEQ ID NO: 633641 - protein, 9 aa, Homo Sapiens
LDACAKMRA

SEQ ID NO: 633642 - protein, 9 aa, Homo Sapiens
RVHPYYVIT

SEQ ID NO: 633643 - protein, 9 aa, Homo Sapiens
SPYLEFPWT

SEQ ID NO: 633644 - protein, 9 aa, Homo Sapiens
HQDMFHDLN

SEQ ID NO: 633645 - protein, 9 aa, Homo Sapiens
IFQLNEDVP

SEQ ID NO: 633646 - protein, 9 aa, Homo Sapiens
SEDSQYNDY

SEQ ID NO: 633647 - protein, 9 aa, Homo Sapiens
IDLLGDKIA

SEQ ID NO: 633648 - protein, 9 aa, Homo Sapiens
YSIRVYAFT

SEQ ID NO: 633649 - protein, 9 aa, Homo Sapiens
CQVPASEVI

SEQ ID NO: 633650 - protein, 9 aa, Homo Sapiens
ENPLTLAVP

SEQ ID NO: 633651 - protein, 9 aa, Homo Sapiens
TENGSFNQP

SEQ ID NO: 633652 - protein, 9 aa, Homo Sapiens
PARWMPPPW

SEQ ID NO: 633653 - protein, 9 aa, Homo Sapiens
KPNSVYENF

SEQ ID NO: 633654 - protein, 9 aa, Homo Sapiens
PEQRSCLAE

SEQ ID NO: 633655 - protein, 9 aa, Homo Sapiens
SSSDSCDSE

SEQ ID NO: 633656 - protein, 9 aa, Homo Sapiens
RKKMENQYH

SEQ ID NO: 633657 - protein, 9 aa, Homo Sapiens
PRMGSNSLM

SEQ ID NO: 633658 - protein, 9 aa, Homo Sapiens
DIECSALQS

SEQ ID NO: 633659 - protein, 9 aa, Homo Sapiens
KTAVEDVDS

SEQ ID NO: 633660 - protein, 9 aa, Homo Sapiens
KIGDFRLAT

SEQ ID NO: 633661 - protein, 9 aa, Homo Sapiens
YCDRIPELR

SEQ ID NO: 633662 - protein, 9 aa, Homo Sapiens
KNATYNISK

SEQ ID NO: 633663 - protein, 9 aa, Homo Sapiens
ETGMEYRNL

SEQ ID NO: 633664 - protein, 9 aa, Homo Sapiens
VSVTSSASG

SEQ ID NO: 633665 - protein, 9 aa, Homo Sapiens
EAEVRHPKG

SEQ ID NO: 633666 - protein, 9 aa, Homo Sapiens
SGICVDEEK

SEQ ID NO: 633667 - protein, 9 aa, Homo Sapiens
QWQPGTGLG

SEQ ID NO: 633668 - protein, 9 aa, Homo Sapiens
LCTRERISM

SEQ ID NO: 633669 - protein, 9 aa, Homo Sapiens
AFLEAISEV

SEQ ID NO: 633670 - protein, 9 aa, Homo Sapiens
LQMPFNVVY

SEQ ID NO: 633671 - protein, 9 aa, Homo Sapiens
PEIQQFPDT

SEQ ID NO: 633672 - protein, 9 aa, Homo Sapiens
AAGTQGKKS

SEQ ID NO: 633673 - protein, 9 aa, Homo Sapiens
KHRYLGLSM

SEQ ID NO: 633674 - protein, 9 aa, Homo Sapiens
SDCDGAHSP

SEQ ID NO: 633675 - protein, 9 aa, Homo Sapiens
LVDRRWDGV

SEQ ID NO: 633676 - protein, 9 aa, Homo Sapiens
GAEIDKTEK

SEQ ID NO: 633677 - protein, 9 aa, Homo Sapiens
FAEWEDRER

SEQ ID NO: 633678 - protein, 9 aa, Homo Sapiens
DCPIVLKVA

SEQ ID NO: 633679 - protein, 9 aa, Homo Sapiens
FLRDVMVKE

SEQ ID NO: 633680 - protein, 9 aa, Homo Sapiens
VCDTFHYVT

SEQ ID NO: 633681 - protein, 9 aa, Homo Sapiens
RPNEVYLDR

SEQ ID NO: 633682 - protein, 9 aa, Homo Sapiens
TRPRLGKAG

SEQ ID NO: 633683 - protein, 9 aa, Homo Sapiens
TLNDTFFDR

SEQ ID NO: 633684 - protein, 9 aa, Homo Sapiens
AVEDVDSMD

SEQ ID NO: 633685 - protein, 9 aa, Homo Sapiens
FLVIKLDKV

SEQ ID NO: 633686 - protein, 9 aa, Homo Sapiens
VYRIGRKKR

SEQ ID NO: 633687 - protein, 9 aa, Homo Sapiens
PVRTDDGRS

SEQ ID NO: 633688 - protein, 9 aa, Homo Sapiens
SKPSSILNT

SEQ ID NO: 633689 - protein, 9 aa, Homo Sapiens
LSQLELQDS

SEQ ID NO: 633690 - protein, 9 aa, Homo Sapiens
HFSPVCLRA

SEQ ID NO: 633691 - protein, 9 aa, Homo Sapiens
GASPAPQHK

SEQ ID NO: 633692 - protein, 9 aa, Homo Sapiens
SSQVATRFK

SEQ ID NO: 633693 - protein, 9 aa, Homo Sapiens
CDKSYKSNR

SEQ ID NO: 633694 - protein, 9 aa, Homo Sapiens
LICLASWVY

SEQ ID NO: 633695 - protein, 9 aa, Homo Sapiens
VYETKEELI

SEQ ID NO: 633696 - protein, 9 aa, Homo Sapiens
TQLQIPMKT

SEQ ID NO: 633697 - protein, 9 aa, Homo Sapiens
SSVEARDSG

SEQ ID NO: 633698 - protein, 9 aa, Homo Sapiens
PEGTLMLHF

SEQ ID NO: 633699 - protein, 9 aa, Homo Sapiens
LRVRVHTTG

SEQ ID NO: 633700 - protein, 9 aa, Homo Sapiens
DIVTAFFSS

SEQ ID NO: 633701 - protein, 9 aa, Homo Sapiens
CKCSKCDMR

SEQ ID NO: 633702 - protein, 9 aa, Homo Sapiens
PCAVVGLLA

SEQ ID NO: 633703 - protein, 9 aa, Homo Sapiens
LFQATEEIG

SEQ ID NO: 633704 - protein, 9 aa, Homo Sapiens
QHGNTKIPE

SEQ ID NO: 633705 - protein, 9 aa, Homo Sapiens
YRYNMAHSS

SEQ ID NO: 633706 - protein, 9 aa, Homo Sapiens
NGMRRGLLA

SEQ ID NO: 633707 - protein, 9 aa, Homo Sapiens
ANVMVIFVY

SEQ ID NO: 633708 - protein, 9 aa, Homo Sapiens
YVAVCDTFH

SEQ ID NO: 633709 - protein, 9 aa, Homo Sapiens
SKRGLFRVT

SEQ ID NO: 633710 - protein, 9 aa, Homo Sapiens
LDPREQSCL

SEQ ID NO: 633711 - protein, 9 aa, Homo Sapiens
HECWKTFGR

SEQ ID NO: 633712 - protein, 9 aa, Homo Sapiens
LAAYFFSFR

SEQ ID NO: 633713 - protein, 9 aa, Homo Sapiens
QLVGPLAME

SEQ ID NO: 633714 - protein, 9 aa, Homo Sapiens
LASLRVRDI

SEQ ID NO: 633715 - protein, 9 aa, Homo Sapiens
RQLKGLRVA

SEQ ID NO: 633716 - protein, 9 aa, Homo Sapiens
GTEPGGGKV

SEQ ID NO: 633717 - protein, 9 aa, Homo Sapiens
GNKALVSHE

SEQ ID NO: 633718 - protein, 9 aa, Homo Sapiens
SWFERIVSR

SEQ ID NO: 633719 - protein, 9 aa, Homo Sapiens
FSAGTYQRL

SEQ ID NO: 633720 - protein, 9 aa, Homo Sapiens
LKMAEQLIN

SEQ ID NO: 633721 - protein, 9 aa, Homo Sapiens
QCHTYTVYC

SEQ ID NO: 633722 - protein, 9 aa, Homo Sapiens
KDNNLVRHQ

SEQ ID NO: 633723 - protein, 9 aa, Homo Sapiens
RVCSREGPP

SEQ ID NO: 633724 - protein, 9 aa, Homo Sapiens
PQHGNTKIP

SEQ ID NO: 633725 - protein, 9 aa, Homo Sapiens
RGKTAVEDV

SEQ ID NO: 633726 - protein, 9 aa, Homo Sapiens
RANPAARHH

SEQ ID NO: 633727 - protein, 9 aa, Homo Sapiens
ILRVLGPGM

SEQ ID NO: 633728 - protein, 9 aa, Homo Sapiens
ADEIKKFES

SEQ ID NO: 633729 - protein, 9 aa, Homo Sapiens
LYRDMGARG

SEQ ID NO: 633730 - protein, 9 aa, Homo Sapiens
TQPLRATAS

SEQ ID NO: 633731 - protein, 9 aa, Homo Sapiens
VSQGFRLLF

SEQ ID NO: 633732 - protein, 9 aa, Homo Sapiens
MEKYGNVFK

SEQ ID NO: 633733 - protein, 9 aa, Homo Sapiens
AWFMMKYPH

SEQ ID NO: 633734 - protein, 9 aa, Homo Sapiens
NTPVHFHSP

SEQ ID NO: 633735 - protein, 9 aa, Homo Sapiens
TVEIKRCVI

SEQ ID NO: 633736 - protein, 9 aa, Homo Sapiens
HLGQRWHLG

SEQ ID NO: 633737 - protein, 9 aa, Homo Sapiens
HQFRRFRQP

SEQ ID NO: 633738 - protein, 9 aa, Homo Sapiens
KSVKMLLLS

SEQ ID NO: 633739 - protein, 9 aa, Homo Sapiens
AAGGPRPLA

SEQ ID NO: 633740 - protein, 9 aa, Homo Sapiens
LFSHGGKGL

SEQ ID NO: 633741 - protein, 9 aa, Homo Sapiens
LIKTRGQKV

SEQ ID NO: 633742 - protein, 9 aa, Homo Sapiens
TWESPKESA

SEQ ID NO: 633743 - protein, 9 aa, Homo Sapiens
SFQVPLSRK

SEQ ID NO: 633744 - protein, 9 aa, Homo Sapiens
IENQELKQE

SEQ ID NO: 633745 - protein, 9 aa, Homo Sapiens
DVTQTELAD

SEQ ID NO: 633746 - protein, 9 aa, Homo Sapiens
YWSKAQLKA

SEQ ID NO: 633747 - protein, 9 aa, Homo Sapiens
VFSTGRFSL

SEQ ID NO: 633748 - protein, 9 aa, Homo Sapiens
PQSGPPPLS

SEQ ID NO: 633749 - protein, 9 aa, Homo Sapiens
KDLPNDVIT

SEQ ID NO: 633750 - protein, 9 aa, Homo Sapiens
ERIKEVAAQ

SEQ ID NO: 633751 - protein, 9 aa, Homo Sapiens
HSQISGQAK

SEQ ID NO: 633752 - protein, 9 aa, Homo Sapiens
KPKGDCAKG

SEQ ID NO: 633753 - protein, 9 aa, Homo Sapiens
AGACARPCF

SEQ ID NO: 633754 - protein, 9 aa, Homo Sapiens
ANSWSEAPI

SEQ ID NO: 633755 - protein, 9 aa, Homo Sapiens
GMASCGPQV

SEQ ID NO: 633756 - protein, 9 aa, Homo Sapiens
SCVSVVNVL

SEQ ID NO: 633757 - protein, 9 aa, Homo Sapiens
EADLRLTVE

SEQ ID NO: 633758 - protein, 9 aa, Homo Sapiens
NPELQAPPN

SEQ ID NO: 633759 - protein, 9 aa, Homo Sapiens
FEVTIYRHK

SEQ ID NO: 633760 - protein, 9 aa, Homo Sapiens
VLTGDVEEE

SEQ ID NO: 633761 - protein, 9 aa, Homo Sapiens
LSRTPEVHS

SEQ ID NO: 633762 - protein, 9 aa, Homo Sapiens
EIAVPELYG

SEQ ID NO: 633763 - protein, 9 aa, Homo Sapiens
LERIHMGHS

SEQ ID NO: 633764 - protein, 9 aa, Homo Sapiens
SEFKIILGK

SEQ ID NO: 633765 - protein, 9 aa, Homo Sapiens
VSIKEECST

SEQ ID NO: 633766 - protein, 9 aa, Homo Sapiens
SKGSQAPQA

SEQ ID NO: 633767 - protein, 9 aa, Homo Sapiens
KHPSNKGYS

SEQ ID NO: 633768 - protein, 9 aa, Homo Sapiens
LTQTVRVVA

SEQ ID NO: 633769 - protein, 9 aa, Homo Sapiens
LAQMERNNG

SEQ ID NO: 633770 - protein, 9 aa, Homo Sapiens
INYFGDDGS

SEQ ID NO: 633771 - protein, 9 aa, Homo Sapiens
IRQASRLRH

SEQ ID NO: 633772 - protein, 9 aa, Homo Sapiens
FVCNYGHAG

SEQ ID NO: 633773 - protein, 9 aa, Homo Sapiens
DGKGTINAQ

SEQ ID NO: 633774 - protein, 9 aa, Homo Sapiens
NMTDNAPPG

SEQ ID NO: 633775 - protein, 9 aa, Homo Sapiens
PQIRGCRAS

SEQ ID NO: 633776 - protein, 9 aa, Homo Sapiens
LKWLSYWIQ

SEQ ID NO: 633777 - protein, 9 aa, Homo Sapiens
SSVMAPLGP

SEQ ID NO: 633778 - protein, 9 aa, Homo Sapiens
SDNFNIGNM

SEQ ID NO: 633779 - protein, 9 aa, Homo Sapiens
PDARPGGRG

SEQ ID NO: 633780 - protein, 9 aa, Homo Sapiens
AEEPSPSLW

SEQ ID NO: 633781 - protein, 9 aa, Homo Sapiens
DEQSWCQGQ

SEQ ID NO: 633782 - protein, 9 aa, Homo Sapiens
HSLGGGDEP

SEQ ID NO: 633783 - protein, 9 aa, Homo Sapiens
PKEDSGTVP

SEQ ID NO: 633784 - protein, 9 aa, Homo Sapiens
ARMKEAMAH

SEQ ID NO: 633785 - protein, 9 aa, Homo Sapiens
PLLFLSVGI

SEQ ID NO: 633786 - protein, 9 aa, Homo Sapiens
MDHCGEPRP

SEQ ID NO: 633787 - protein, 9 aa, Homo Sapiens
ALFLTILMP

SEQ ID NO: 633788 - protein, 9 aa, Homo Sapiens
HGAGGRRPW

SEQ ID NO: 633789 - protein, 9 aa, Homo Sapiens
QKTPPPLAP

SEQ ID NO: 633790 - protein, 9 aa, Homo Sapiens
EEEACYQQP

SEQ ID NO: 633791 - protein, 9 aa, Homo Sapiens
LPFGSICTG

SEQ ID NO: 633792 - protein, 9 aa, Homo Sapiens
EEMKYVLCQ

SEQ ID NO: 633793 - protein, 9 aa, Homo Sapiens
SKWKAETWK

SEQ ID NO: 633794 - protein, 9 aa, Homo Sapiens
GDTCEPCGS

SEQ ID NO: 633795 - protein, 9 aa, Homo Sapiens
RKHKLIEVI

SEQ ID NO: 633796 - protein, 9 aa, Homo Sapiens
TIYRHKEYY

SEQ ID NO: 633797 - protein, 9 aa, Homo Sapiens
DCDYLAPAA

SEQ ID NO: 633798 - protein, 9 aa, Homo Sapiens
QDKEGIPPE

SEQ ID NO: 633799 - protein, 9 aa, Homo Sapiens
ISGTSTSSG

SEQ ID NO: 633800 - protein, 9 aa, Homo Sapiens
SPVCLRAFP

SEQ ID NO: 633801 - protein, 9 aa, Homo Sapiens
KAVHFSTVS

SEQ ID NO: 633802 - protein, 9 aa, Homo Sapiens
KLVIYGDQY

SEQ ID NO: 633803 - protein, 9 aa, Homo Sapiens
SVSTDQGIP

SEQ ID NO: 633804 - protein, 9 aa, Homo Sapiens
WGAVSNSQL

SEQ ID NO: 633805 - protein, 9 aa, Homo Sapiens
YNHQQLGRG

SEQ ID NO: 633806 - protein, 9 aa, Homo Sapiens
AISEVFEYR

SEQ ID NO: 633807 - protein, 9 aa, Homo Sapiens
GVTAHLNGH

SEQ ID NO: 633808 - protein, 9 aa, Homo Sapiens
HDESQSSHT

SEQ ID NO: 633809 - protein, 9 aa, Homo Sapiens
LLIAFSPLL

SEQ ID NO: 633810 - protein, 9 aa, Homo Sapiens
GNVWSLAVG

SEQ ID NO: 633811 - protein, 9 aa, Homo Sapiens
HHRIHVCDK

SEQ ID NO: 633812 - protein, 9 aa, Homo Sapiens
GNSTTFQHD

SEQ ID NO: 633813 - protein, 9 aa, Homo Sapiens
VDDFETQDD

SEQ ID NO: 633814 - protein, 9 aa, Homo Sapiens
CGKTLHHRI

SEQ ID NO: 633815 - protein, 9 aa, Homo Sapiens
VHTKVINEE

SEQ ID NO: 633816 - protein, 9 aa, Homo Sapiens
MSAVAMLKA

SEQ ID NO: 633817 - protein, 9 aa, Homo Sapiens
SSPVTPTPS

SEQ ID NO: 633818 - protein, 9 aa, Homo Sapiens
KKKDFSIKG

SEQ ID NO: 633819 - protein, 9 aa, Homo Sapiens
NECKGAVIV

SEQ ID NO: 633820 - protein, 9 aa, Homo Sapiens
YGENCEKQY

SEQ ID NO: 633821 - protein, 9 aa, Homo Sapiens
ESSQEESKD

SEQ ID NO: 633822 - protein, 9 aa, Homo Sapiens
PPREVGAHI

SEQ ID NO: 633823 - protein, 9 aa, Homo Sapiens
REAVDCVRF

SEQ ID NO: 633824 - protein, 9 aa, Homo Sapiens
RFSMVMSMD

SEQ ID NO: 633825 - protein, 9 aa, Homo Sapiens
RRRRDLGIR

SEQ ID NO: 633826 - protein, 9 aa, Homo Sapiens
KGSSSAAAA

SEQ ID NO: 633827 - protein, 9 aa, Homo Sapiens
LLCLSWGPF

SEQ ID NO: 633828 - protein, 9 aa, Homo Sapiens
LWSSRSVMD

SEQ ID NO: 633829 - protein, 9 aa, Homo Sapiens
HMTAGAYLA

SEQ ID NO: 633830 - protein, 9 aa, Homo Sapiens
HEMANSLPH

SEQ ID NO: 633831 - protein, 9 aa, Homo Sapiens
KFEFEIQCH

SEQ ID NO: 633832 - protein, 9 aa, Homo Sapiens
CVHCPAEKF

SEQ ID NO: 633833 - protein, 9 aa, Homo Sapiens
GPRLWEKLT

SEQ ID NO: 633834 - protein, 9 aa, Homo Sapiens
SMVMSMDFN

SEQ ID NO: 633835 - protein, 9 aa, Homo Sapiens
ELQTTLAGM

SEQ ID NO: 633836 - protein, 9 aa, Homo Sapiens
LRLGAEVYH

SEQ ID NO: 633837 - protein, 9 aa, Homo Sapiens
RSFSISGTC

SEQ ID NO: 633838 - protein, 9 aa, Homo Sapiens
EDLLNNAAL

SEQ ID NO: 633839 - protein, 9 aa, Homo Sapiens
TICLPLQNS

SEQ ID NO: 633840 - protein, 9 aa, Homo Sapiens
HFHTLKLVS

SEQ ID NO: 633841 - protein, 9 aa, Homo Sapiens
KAEGAQNKG

SEQ ID NO: 633842 - protein, 9 aa, Homo Sapiens
RQSPAVISL

SEQ ID NO: 633843 - protein, 9 aa, Homo Sapiens
GVLEVAHTC

SEQ ID NO: 633844 - protein, 9 aa, Homo Sapiens
APLPDHTKS

SEQ ID NO: 633845 - protein, 9 aa, Homo Sapiens
FPPYCWVSI

SEQ ID NO: 633846 - protein, 9 aa, Homo Sapiens
QWVDLHIQY

SEQ ID NO: 633847 - protein, 9 aa, Homo Sapiens
GFLSVEEQL

SEQ ID NO: 633848 - protein, 9 aa, Homo Sapiens
VPLVTLLHM

SEQ ID NO: 633849 - protein, 9 aa, Homo Sapiens
AMSGMRSVQ

SEQ ID NO: 633850 - protein, 9 aa, Homo Sapiens
IFIEMFHGQ

SEQ ID NO: 633851 - protein, 9 aa, Homo Sapiens
IAFEKPNIP

SEQ ID NO: 633852 - protein, 9 aa, Homo Sapiens
SGLWPTWHG

SEQ ID NO: 633853 - protein, 9 aa, Homo Sapiens
DVFRSHTFS

SEQ ID NO: 633854 - protein, 9 aa, Homo Sapiens
SIFFITCMG

SEQ ID NO: 633855 - protein, 9 aa, Homo Sapiens
EKIMERIKE

SEQ ID NO: 633856 - protein, 9 aa, Homo Sapiens
VVAYYFCWE

SEQ ID NO: 633857 - protein, 9 aa, Homo Sapiens
VNETCNIFI

SEQ ID NO: 633858 - protein, 9 aa, Homo Sapiens
GNIKVLNQE

SEQ ID NO: 633859 - protein, 9 aa, Homo Sapiens
HDSPAVKLM

SEQ ID NO: 633860 - protein, 9 aa, Homo Sapiens
PPYKEASGL

SEQ ID NO: 633861 - protein, 9 aa, Homo Sapiens
CKLIPYLDP

SEQ ID NO: 633862 - protein, 9 aa, Homo Sapiens
MKEAMAHFT

SEQ ID NO: 633863 - protein, 9 aa, Homo Sapiens
NLEAGQCDY

SEQ ID NO: 633864 - protein, 9 aa, Homo Sapiens
TTVTECDQD

SEQ ID NO: 633865 - protein, 9 aa, Homo Sapiens
YWMIYTYSG

SEQ ID NO: 633866 - protein, 9 aa, Homo Sapiens
LDVDANRQA

SEQ ID NO: 633867 - protein, 9 aa, Homo Sapiens
SFVLSEGSY

SEQ ID NO: 633868 - protein, 9 aa, Homo Sapiens
DLGIRLQAQ

SEQ ID NO: 633869 - protein, 9 aa, Homo Sapiens
GEFAREQQR

SEQ ID NO: 633870 - protein, 9 aa, Homo Sapiens
LCIDLTLCF

SEQ ID NO: 633871 - protein, 9 aa, Homo Sapiens
ILICCDELN

SEQ ID NO: 633872 - protein, 9 aa, Homo Sapiens
AAIKEDYLR

SEQ ID NO: 633873 - protein, 9 aa, Homo Sapiens
TLCIHMTAG

SEQ ID NO: 633874 - protein, 9 aa, Homo Sapiens
RLAQMERNN

SEQ ID NO: 633875 - protein, 9 aa, Homo Sapiens
SFTSFIAIN

SEQ ID NO: 633876 - protein, 9 aa, Homo Sapiens
AGSSVGTRS

SEQ ID NO: 633877 - protein, 9 aa, Homo Sapiens
EIEDLLLRG

SEQ ID NO: 633878 - protein, 9 aa, Homo Sapiens
AEIDKTEKS

SEQ ID NO: 633879 - protein, 9 aa, Homo Sapiens
DESIADCVE

SEQ ID NO: 633880 - protein, 9 aa, Homo Sapiens
LLAFAIAAF

SEQ ID NO: 633881 - protein, 9 aa, Homo Sapiens
STGLKTTTL

SEQ ID NO: 633882 - protein, 9 aa, Homo Sapiens
EQLKGEWNL

SEQ ID NO: 633883 - protein, 9 aa, Homo Sapiens
QLAVEQIAK

SEQ ID NO: 633884 - protein, 9 aa, Homo Sapiens
TTPSSEKLA

SEQ ID NO: 633885 - protein, 9 aa, Homo Sapiens
YCNNRDFPE

SEQ ID NO: 633886 - protein, 9 aa, Homo Sapiens
PEPCPPTKC

SEQ ID NO: 633887 - protein, 9 aa, Homo Sapiens
RLLVIDIQT

SEQ ID NO: 633888 - protein, 9 aa, Homo Sapiens
LRGAYGAIM

SEQ ID NO: 633889 - protein, 9 aa, Homo Sapiens
QQRRILQLD

SEQ ID NO: 633890 - protein, 9 aa, Homo Sapiens
SRFEKKTKV

SEQ ID NO: 633891 - protein, 9 aa, Homo Sapiens
EKHVLTRHT

SEQ ID NO: 633892 - protein, 9 aa, Homo Sapiens
LFQVLIILT

SEQ ID NO: 633893 - protein, 9 aa, Homo Sapiens
LQEILGCLY

SEQ ID NO: 633894 - protein, 9 aa, Homo Sapiens
MDSMEGMRS

SEQ ID NO: 633895 - protein, 9 aa, Homo Sapiens
FSLLHDILQ

SEQ ID NO: 633896 - protein, 9 aa, Homo Sapiens
LKQEKSPVS

SEQ ID NO: 633897 - protein, 9 aa, Homo Sapiens
ETSASPSKR

SEQ ID NO: 633898 - protein, 9 aa, Homo Sapiens
FSPLLHTPM

SEQ ID NO: 633899 - protein, 9 aa, Homo Sapiens
KRDIKIGPF

SEQ ID NO: 633900 - protein, 9 aa, Homo Sapiens
HMQAPSGMN

SEQ ID NO: 633901 - protein, 9 aa, Homo Sapiens
KEYPSVADF

SEQ ID NO: 633902 - protein, 9 aa, Homo Sapiens
LGANAILGV

SEQ ID NO: 633903 - protein, 9 aa, Homo Sapiens
FSNYFPTPA

SEQ ID NO: 633904 - protein, 9 aa, Homo Sapiens
HFQDIKNEV

SEQ ID NO: 633905 - protein, 9 aa, Homo Sapiens
YIGIVASGC

SEQ ID NO: 633906 - protein, 9 aa, Homo Sapiens
FSFRKQRKA

SEQ ID NO: 633907 - protein, 9 aa, Homo Sapiens
PDDLLLASS

SEQ ID NO: 633908 - protein, 9 aa, Homo Sapiens
MAFGNPLLY

SEQ ID NO: 633909 - protein, 9 aa, Homo Sapiens
GKVCDGGWG

SEQ ID NO: 633910 - protein, 9 aa, Homo Sapiens
PNQRPHQFR

SEQ ID NO: 633911 - protein, 9 aa, Homo Sapiens
PAPHILGLV

SEQ ID NO: 633912 - protein, 9 aa, Homo Sapiens
LGPLSTRRV

SEQ ID NO: 633913 - protein, 9 aa, Homo Sapiens
CVLVLDAND

SEQ ID NO: 633914 - protein, 9 aa, Homo Sapiens
EAYYHAKFG

SEQ ID NO: 633915 - protein, 9 aa, Homo Sapiens
LYINLVGLR

SEQ ID NO: 633916 - protein, 9 aa, Homo Sapiens
SPGSSSAFL

SEQ ID NO: 633917 - protein, 9 aa, Homo Sapiens
MSEEDEQSW

SEQ ID NO: 633918 - protein, 9 aa, Homo Sapiens
SADDLEIKL

SEQ ID NO: 633919 - protein, 9 aa, Homo Sapiens
VQNAYTLRC

SEQ ID NO: 633920 - protein, 9 aa, Homo Sapiens
SKDIKPDLQ

SEQ ID NO: 633921 - protein, 9 aa, Homo Sapiens
CEPALGNET

SEQ ID NO: 633922 - protein, 9 aa, Homo Sapiens
DIFELIQEI

SEQ ID NO: 633923 - protein, 9 aa, Homo Sapiens
SRKDREELC

SEQ ID NO: 633924 - protein, 9 aa, Homo Sapiens
EYTEDNIQL

SEQ ID NO: 633925 - protein, 9 aa, Homo Sapiens
ARDSGLESK

SEQ ID NO: 633926 - protein, 9 aa, Homo Sapiens
RLGKAGLVS

SEQ ID NO: 633927 - protein, 9 aa, Homo Sapiens
GVGVGDEDT

SEQ ID NO: 633928 - protein, 9 aa, Homo Sapiens
KKEIEDLLL

SEQ ID NO: 633929 - protein, 9 aa, Homo Sapiens
HVTADVVLE

SEQ ID NO: 633930 - protein, 9 aa, Homo Sapiens
CSLDLYKFS

SEQ ID NO: 633931 - protein, 9 aa, Homo Sapiens
KDKHSSDAS

SEQ ID NO: 633932 - protein, 9 aa, Homo Sapiens
QWSAQTPHT

SEQ ID NO: 633933 - protein, 9 aa, Homo Sapiens
KNIENQELK

SEQ ID NO: 633934 - protein, 9 aa, Homo Sapiens
YNSKPSSIL

SEQ ID NO: 633935 - protein, 9 aa, Homo Sapiens
LTSVSVARD

SEQ ID NO: 633936 - protein, 9 aa, Homo Sapiens
AKIACGAAV

SEQ ID NO: 633937 - protein, 9 aa, Homo Sapiens
GPTPCFSLS

SEQ ID NO: 633938 - protein, 9 aa, Homo Sapiens
FTKPSGRQT

SEQ ID NO: 633939 - protein, 9 aa, Homo Sapiens
VSRGGSHGA

SEQ ID NO: 633940 - protein, 9 aa, Homo Sapiens
SQVQRRFFI

SEQ ID NO: 633941 - protein, 9 aa, Homo Sapiens
QYLYPWQSC

SEQ ID NO: 633942 - protein, 9 aa, Homo Sapiens
PSGLVSITF

SEQ ID NO: 633943 - protein, 9 aa, Homo Sapiens
CAFGGALNR

SEQ ID NO: 633944 - protein, 9 aa, Homo Sapiens
LHSVKTASI

SEQ ID NO: 633945 - protein, 9 aa, Homo Sapiens
DLLAGKGSK

SEQ ID NO: 633946 - protein, 9 aa, Homo Sapiens
RDARDGGMS

SEQ ID NO: 633947 - protein, 9 aa, Homo Sapiens
GTVPSTGPS

SEQ ID NO: 633948 - protein, 9 aa, Homo Sapiens
VDCVRFIAD

SEQ ID NO: 633949 - protein, 9 aa, Homo Sapiens
ADLQAWWAS

SEQ ID NO: 633950 - protein, 9 aa, Homo Sapiens
ISMRGHEDW

SEQ ID NO: 633951 - protein, 9 aa, Homo Sapiens
RLDDKEMVI

SEQ ID NO: 633952 - protein, 9 aa, Homo Sapiens
LWRTVLKVN

SEQ ID NO: 633953 - protein, 9 aa, Homo Sapiens
LSCADLPSE

SEQ ID NO: 633954 - protein, 9 aa, Homo Sapiens
RIMNNEKML

SEQ ID NO: 633955 - protein, 9 aa, Homo Sapiens
NQYVIKAVD

SEQ ID NO: 633956 - protein, 9 aa, Homo Sapiens
ARRKAMRKC

SEQ ID NO: 633957 - protein, 9 aa, Homo Sapiens
GVDTSSLIS

SEQ ID NO: 633958 - protein, 9 aa, Homo Sapiens
GDKPLGCCW

SEQ ID NO: 633959 - protein, 9 aa, Homo Sapiens
IRDYPALQF

SEQ ID NO: 633960 - protein, 9 aa, Homo Sapiens
EGFHNYHHY

SEQ ID NO: 633961 - protein, 9 aa, Homo Sapiens
AQPWPEVSR

SEQ ID NO: 633962 - protein, 9 aa, Homo Sapiens
MAEEHTELE

SEQ ID NO: 633963 - protein, 9 aa, Homo Sapiens
YTVIENSQA

SEQ ID NO: 633964 - protein, 9 aa, Homo Sapiens
FSPEVTGQK

SEQ ID NO: 633965 - protein, 9 aa, Homo Sapiens
CRAWNQGRT

SEQ ID NO: 633966 - protein, 9 aa, Homo Sapiens
VAELLGAGG

SEQ ID NO: 633967 - protein, 9 aa, Homo Sapiens
QPSPWPTPP

SEQ ID NO: 633968 - protein, 9 aa, Homo Sapiens
NGVSIHSQW

SEQ ID NO: 633969 - protein, 9 aa, Homo Sapiens
IHEEAPSGP

SEQ ID NO: 633970 - protein, 9 aa, Homo Sapiens
QIRGCRASY

SEQ ID NO: 633971 - protein, 9 aa, Homo Sapiens
ADPCGGGAA

SEQ ID NO: 633972 - protein, 9 aa, Homo Sapiens
RKDGSRKEV

SEQ ID NO: 633973 - protein, 9 aa, Homo Sapiens
VYNVDNQAM

SEQ ID NO: 633974 - protein, 9 aa, Homo Sapiens
LLLFCIFIL

SEQ ID NO: 633975 - protein, 9 aa, Homo Sapiens
DACTSRVCF

SEQ ID NO: 633976 - protein, 9 aa, Homo Sapiens
IVTQTPQSQ

SEQ ID NO: 633977 - protein, 9 aa, Homo Sapiens
VKMSEAGSE

SEQ ID NO: 633978 - protein, 9 aa, Homo Sapiens
VPSCWHVRW

SEQ ID NO: 633979 - protein, 9 aa, Homo Sapiens
KADNRGGEV

SEQ ID NO: 633980 - protein, 9 aa, Homo Sapiens
YLAPAATVA

SEQ ID NO: 633981 - protein, 9 aa, Homo Sapiens
CARPCFSTC

SEQ ID NO: 633982 - protein, 9 aa, Homo Sapiens
LSTFGFVVA

SEQ ID NO: 633983 - protein, 9 aa, Homo Sapiens
RLTLSLPPE

SEQ ID NO: 633984 - protein, 9 aa, Homo Sapiens
CMFLKHLNL

SEQ ID NO: 633985 - protein, 9 aa, Homo Sapiens
FKISNVRKI

SEQ ID NO: 633986 - protein, 9 aa, Homo Sapiens
GKTDFLWKN

SEQ ID NO: 633987 - protein, 9 aa, Homo Sapiens
FQARSHREV

SEQ ID NO: 633988 - protein, 9 aa, Homo Sapiens
LKPYTGGGV

SEQ ID NO: 633989 - protein, 9 aa, Homo Sapiens
ISDARYLYD

SEQ ID NO: 633990 - protein, 9 aa, Homo Sapiens
LSEIHKDEP

SEQ ID NO: 633991 - protein, 9 aa, Homo Sapiens
ETKKYEDPE

SEQ ID NO: 633992 - protein, 9 aa, Homo Sapiens
ASSSAILRV

SEQ ID NO: 633993 - protein, 9 aa, Homo Sapiens
SPTALNSAP

SEQ ID NO: 633994 - protein, 9 aa, Homo Sapiens
VTYDWNALV

SEQ ID NO: 633995 - protein, 9 aa, Homo Sapiens
CVYGQGDLP

SEQ ID NO: 633996 - protein, 9 aa, Homo Sapiens
ATTGEATPV

SEQ ID NO: 633997 - protein, 9 aa, Homo Sapiens
SCIYGYVML

SEQ ID NO: 633998 - protein, 9 aa, Homo Sapiens
GSLALDSKS

SEQ ID NO: 633999 - protein, 9 aa, Homo Sapiens
YRWKQNVTD

SEQ ID NO: 634000 - protein, 9 aa, Homo Sapiens
SQYIVPLVF

SEQ ID NO: 634001 - protein, 9 aa, Homo Sapiens
SGVLGSGFR

SEQ ID NO: 634002 - protein, 9 aa, Homo Sapiens
SGADIRQNR

SEQ ID NO: 634003 - protein, 9 aa, Homo Sapiens
FYEDRDFHG

SEQ ID NO: 634004 - protein, 9 aa, Homo Sapiens
GSAWAGPCG

SEQ ID NO: 634005 - protein, 9 aa, Homo Sapiens
GILGDKGNL

SEQ ID NO: 634006 - protein, 9 aa, Homo Sapiens
PIVLKVAGP

SEQ ID NO: 634007 - protein, 9 aa, Homo Sapiens
LSIPGSDIL

SEQ ID NO: 634008 - protein, 9 aa, Homo Sapiens
NSTNSFAIK

SEQ ID NO: 634009 - protein, 9 aa, Homo Sapiens
AEGPGAEGS

SEQ ID NO: 634010 - protein, 9 aa, Homo Sapiens
SRANPSPTP

SEQ ID NO: 634011 - protein, 9 aa, Homo Sapiens
NTSKANVTP

SEQ ID NO: 634012 - protein, 9 aa, Homo Sapiens
RKDDDSHDE

SEQ ID NO: 634013 - protein, 9 aa, Homo Sapiens
WFERIVSRF

SEQ ID NO: 634014 - protein, 9 aa, Homo Sapiens
TGEATPVSG

SEQ ID NO: 634015 - protein, 9 aa, Homo Sapiens
VVLVPTEIL

SEQ ID NO: 634016 - protein, 9 aa, Homo Sapiens
LVVQAKVGL

SEQ ID NO: 634017 - protein, 9 aa, Homo Sapiens
IIFKNKGSR

SEQ ID NO: 634018 - protein, 9 aa, Homo Sapiens
NLKSPNLSK

SEQ ID NO: 634019 - protein, 9 aa, Homo Sapiens
TKPSGRQTL

SEQ ID NO: 634020 - protein, 9 aa, Homo Sapiens
PPGPEGPAC

SEQ ID NO: 634021 - protein, 9 aa, Homo Sapiens
AATTNIETT

SEQ ID NO: 634022 - protein, 9 aa, Homo Sapiens
LAVDVAELP

SEQ ID NO: 634023 - protein, 9 aa, Homo Sapiens
VDACTSRVC

SEQ ID NO: 634024 - protein, 9 aa, Homo Sapiens
FNDSEVLQR

SEQ ID NO: 634025 - protein, 9 aa, Homo Sapiens
IPTDDSTFE

SEQ ID NO: 634026 - protein, 9 aa, Homo Sapiens
TDQGIPDTC

SEQ ID NO: 634027 - protein, 9 aa, Homo Sapiens
TGKPTNLLS

SEQ ID NO: 634028 - protein, 9 aa, Homo Sapiens
QSQNMFTIN

SEQ ID NO: 634029 - protein, 9 aa, Homo Sapiens
IADESIADC

SEQ ID NO: 634030 - protein, 9 aa, Homo Sapiens
ELRGTESTL

SEQ ID NO: 634031 - protein, 9 aa, Homo Sapiens
FFPCANPPC

SEQ ID NO: 634032 - protein, 9 aa, Homo Sapiens
SSAYQELIQ

SEQ ID NO: 634033 - protein, 9 aa, Homo Sapiens
SSEVLVCVL

SEQ ID NO: 634034 - protein, 9 aa, Homo Sapiens
YVAKTGILW

SEQ ID NO: 634035 - protein, 9 aa, Homo Sapiens
GQNTHVHDA

SEQ ID NO: 634036 - protein, 9 aa, Homo Sapiens
FCHILIRNH

SEQ ID NO: 634037 - protein, 9 aa, Homo Sapiens
HYVSLFVGL

SEQ ID NO: 634038 - protein, 9 aa, Homo Sapiens
RNNGSFLTD

SEQ ID NO: 634039 - protein, 9 aa, Homo Sapiens
RDYVPDHPH

SEQ ID NO: 634040 - protein, 9 aa, Homo Sapiens
GRQSPAVIS

SEQ ID NO: 634041 - protein, 9 aa, Homo Sapiens
GILVAKIFG

SEQ ID NO: 634042 - protein, 9 aa, Homo Sapiens
KALLAFAIA

SEQ ID NO: 634043 - protein, 9 aa, Homo Sapiens
RYVAVCDTF

SEQ ID NO: 634044 - protein, 9 aa, Homo Sapiens
GICCIYEFD

SEQ ID NO: 634045 - protein, 9 aa, Homo Sapiens
LLLRLRRWH

SEQ ID NO: 634046 - protein, 9 aa, Homo Sapiens
VCDGGWGLK

SEQ ID NO: 634047 - protein, 9 aa, Homo Sapiens
LSDYKHVLG

SEQ ID NO: 634048 - protein, 9 aa, Homo Sapiens
SNDSTSPVS

SEQ ID NO: 634049 - protein, 9 aa, Homo Sapiens
RIGRKKRVP

SEQ ID NO: 634050 - protein, 9 aa, Homo Sapiens
CRGGSLCSP

SEQ ID NO: 634051 - protein, 9 aa, Homo Sapiens
TLHSMPLYP

SEQ ID NO: 634052 - protein, 9 aa, Homo Sapiens
LIAFSPLLH

SEQ ID NO: 634053 - protein, 9 aa, Homo Sapiens
TKMKIYVEV

SEQ ID NO: 634054 - protein, 9 aa, Homo Sapiens
FHTIYTHNT

SEQ ID NO: 634055 - protein, 9 aa, Homo Sapiens
EDCDGSSQS

SEQ ID NO: 634056 - protein, 9 aa, Homo Sapiens
KEKDPLASL

SEQ ID NO: 634057 - protein, 9 aa, Homo Sapiens
LIHLVSGKR

SEQ ID NO: 634058 - protein, 9 aa, Homo Sapiens
AGHLDGKVA

SEQ ID NO: 634059 - protein, 9 aa, Homo Sapiens
WLGLVKEGL

SEQ ID NO: 634060 - protein, 9 aa, Homo Sapiens
RWYVPEAVE

SEQ ID NO: 634061 - protein, 9 aa, Homo Sapiens
IGRKKRVPY

SEQ ID NO: 634062 - protein, 9 aa, Homo Sapiens
RLTGSSRLA

SEQ ID NO: 634063 - protein, 9 aa, Homo Sapiens
SRLASPSGS

SEQ ID NO: 634064 - protein, 9 aa, Homo Sapiens
RVFSTGRFS

SEQ ID NO: 634065 - protein, 9 aa, Homo Sapiens
VWLTEGLLP

SEQ ID NO: 634066 - protein, 9 aa, Homo Sapiens
SSLKLVDFI

SEQ ID NO: 634067 - protein, 9 aa, Homo Sapiens
IGRAWGDPC

SEQ ID NO: 634068 - protein, 9 aa, Homo Sapiens
ISLCFRKNS

SEQ ID NO: 634069 - protein, 9 aa, Homo Sapiens
KQCRLLVID

SEQ ID NO: 634070 - protein, 9 aa, Homo Sapiens
IVLGAEDTA

SEQ ID NO: 634071 - protein, 9 aa, Homo Sapiens
SQDKMLFPK

SEQ ID NO: 634072 - protein, 9 aa, Homo Sapiens
NESIASTPQ

SEQ ID NO: 634073 - protein, 9 aa, Homo Sapiens
SAALAAAGL

SEQ ID NO: 634074 - protein, 9 aa, Homo Sapiens
TRHTQLSEK

SEQ ID NO: 634075 - protein, 9 aa, Homo Sapiens
RLLFYTMKP

SEQ ID NO: 634076 - protein, 9 aa, Homo Sapiens
VNSRKDREE

SEQ ID NO: 634077 - protein, 9 aa, Homo Sapiens
WQTLEWLRK

SEQ ID NO: 634078 - protein, 9 aa, Homo Sapiens
PTDPARREL

SEQ ID NO: 634079 - protein, 9 aa, Homo Sapiens
FTTVYVPKF

SEQ ID NO: 634080 - protein, 9 aa, Homo Sapiens
SKANVTPQS

SEQ ID NO: 634081 - protein, 9 aa, Homo Sapiens
KDIQDFEFQ

SEQ ID NO: 634082 - protein, 9 aa, Homo Sapiens
QSYYAKLLV

SEQ ID NO: 634083 - protein, 9 aa, Homo Sapiens
SLVYVIEDG

SEQ ID NO: 634084 - protein, 9 aa, Homo Sapiens
DLENPLLQT

SEQ ID NO: 634085 - protein, 9 aa, Homo Sapiens
LWKEGLRLT

SEQ ID NO: 634086 - protein, 9 aa, Homo Sapiens
KPDIFELIQ

SEQ ID NO: 634087 - protein, 9 aa, Homo Sapiens
QEDADIAAR

SEQ ID NO: 634088 - protein, 9 aa, Homo Sapiens
PGPEGPACL

SEQ ID NO: 634089 - protein, 9 aa, Homo Sapiens
ASQCISALS

SEQ ID NO: 634090 - protein, 9 aa, Homo Sapiens
VVAPTGIPA

SEQ ID NO: 634091 - protein, 9 aa, Homo Sapiens
QEPTCQISH

SEQ ID NO: 634092 - protein, 9 aa, Homo Sapiens
SVRGNVWSL

SEQ ID NO: 634093 - protein, 9 aa, Homo Sapiens
QPLRATASL

SEQ ID NO: 634094 - protein, 9 aa, Homo Sapiens
FPKSSALFY

SEQ ID NO: 634095 - protein, 9 aa, Homo Sapiens
KHDCLICFE

SEQ ID NO: 634096 - protein, 9 aa, Homo Sapiens
GTPGIPGNH

SEQ ID NO: 634097 - protein, 9 aa, Homo Sapiens
LHMVLDEDS

SEQ ID NO: 634098 - protein, 9 aa, Homo Sapiens
WRTEIGSGP

SEQ ID NO: 634099 - protein, 9 aa, Homo Sapiens
SQRCPEQCT

SEQ ID NO: 634100 - protein, 9 aa, Homo Sapiens
IRLQAQRRA

SEQ ID NO: 634101 - protein, 9 aa, Homo Sapiens
TVFENSRAK

SEQ ID NO: 634102 - protein, 9 aa, Homo Sapiens
NQNKNIENQ

SEQ ID NO: 634103 - protein, 9 aa, Homo Sapiens
LVSVLSWAE

SEQ ID NO: 634104 - protein, 9 aa, Homo Sapiens
LFPKSSALF

SEQ ID NO: 634105 - protein, 9 aa, Homo Sapiens
AEWEDRERF

SEQ ID NO: 634106 - protein, 9 aa, Homo Sapiens
MLLGDDLSL

SEQ ID NO: 634107 - protein, 9 aa, Homo Sapiens
YGDQYASLI

SEQ ID NO: 634108 - protein, 9 aa, Homo Sapiens
GPLSVYPVA

SEQ ID NO: 634109 - protein, 9 aa, Homo Sapiens
VAKTGILWL

SEQ ID NO: 634110 - protein, 9 aa, Homo Sapiens
KSRLARKAH

SEQ ID NO: 634111 - protein, 9 aa, Homo Sapiens
DEPPGHLQV

SEQ ID NO: 634112 - protein, 9 aa, Homo Sapiens
LRQNCVDTP

SEQ ID NO: 634113 - protein, 9 aa, Homo Sapiens
KATKCHGST

SEQ ID NO: 634114 - protein, 9 aa, Homo Sapiens
LNSAPSPPN

SEQ ID NO: 634115 - protein, 9 aa, Homo Sapiens
YTDRSDTFY

SEQ ID NO: 634116 - protein, 9 aa, Homo Sapiens
LDQYRKKSR

SEQ ID NO: 634117 - protein, 9 aa, Homo Sapiens
PDHPHPEIP

SEQ ID NO: 634118 - protein, 9 aa, Homo Sapiens
QNKPYWILR

SEQ ID NO: 634119 - protein, 9 aa, Homo Sapiens
NDHGTNWRH

SEQ ID NO: 634120 - protein, 9 aa, Homo Sapiens
AARFGAHHL

SEQ ID NO: 634121 - protein, 9 aa, Homo Sapiens
RHGYFVEAQ

SEQ ID NO: 634122 - protein, 9 aa, Homo Sapiens
ALKCFRIMN

SEQ ID NO: 634123 - protein, 9 aa, Homo Sapiens
EIKRCVICA

SEQ ID NO: 634124 - protein, 9 aa, Homo Sapiens
RAWGDPCEM

SEQ ID NO: 634125 - protein, 9 aa, Homo Sapiens
GGLPEQRSC

SEQ ID NO: 634126 - protein, 9 aa, Homo Sapiens
AGPCGGRRP

SEQ ID NO: 634127 - protein, 9 aa, Homo Sapiens
YEFTVQSHG

SEQ ID NO: 634128 - protein, 9 aa, Homo Sapiens
VLLLALSSI

SEQ ID NO: 634129 - protein, 9 aa, Homo Sapiens
HVVSFSSHD

SEQ ID NO: 634130 - protein, 9 aa, Homo Sapiens
SNRRTTSSH

SEQ ID NO: 634131 - protein, 9 aa, Homo Sapiens
KAKSESSIE

SEQ ID NO: 634132 - protein, 9 aa, Homo Sapiens
KTLSLSQLE

SEQ ID NO: 634133 - protein, 9 aa, Homo Sapiens
PSKGLPTPS

SEQ ID NO: 634134 - protein, 9 aa, Homo Sapiens
HGKLHTADR

SEQ ID NO: 634135 - protein, 9 aa, Homo Sapiens
IGNQVLKVF

SEQ ID NO: 634136 - protein, 9 aa, Homo Sapiens
KRHLHEMAN

SEQ ID NO: 634137 - protein, 9 aa, Homo Sapiens
ATPASGTKS

SEQ ID NO: 634138 - protein, 9 aa, Homo Sapiens
HDDSAFTEL

SEQ ID NO: 634139 - protein, 9 aa, Homo Sapiens
ESLIKKDLQ

SEQ ID NO: 634140 - protein, 9 aa, Homo Sapiens
VYASGNFNI

SEQ ID NO: 634141 - protein, 9 aa, Homo Sapiens
GNITSVHLR

SEQ ID NO: 634142 - protein, 9 aa, Homo Sapiens
IVGSHGSRL

SEQ ID NO: 634143 - protein, 9 aa, Homo Sapiens
GLYHYPCFH

SEQ ID NO: 634144 - protein, 9 aa, Homo Sapiens
LVGLRAILT

SEQ ID NO: 634145 - protein, 9 aa, Homo Sapiens
TDFLWKNCE

SEQ ID NO: 634146 - protein, 9 aa, Homo Sapiens
FKLLFFSIF

SEQ ID NO: 634147 - protein, 9 aa, Homo Sapiens
DGINGFLPS

SEQ ID NO: 634148 - protein, 9 aa, Homo Sapiens
STAISPGTP

SEQ ID NO: 634149 - protein, 9 aa, Homo Sapiens
STNSFAIKI

SEQ ID NO: 634150 - protein, 9 aa, Homo Sapiens
LRAHEEQGR

SEQ ID NO: 634151 - protein, 9 aa, Homo Sapiens
QPLEVAEGY

SEQ ID NO: 634152 - protein, 9 aa, Homo Sapiens
ALDGIGGDG

SEQ ID NO: 634153 - protein, 9 aa, Homo Sapiens
ITENGSFNQ

SEQ ID NO: 634154 - protein, 9 aa, Homo Sapiens
YQNEFHGSQ

SEQ ID NO: 634155 - protein, 9 aa, Homo Sapiens
IVFLHLADI

SEQ ID NO: 634156 - protein, 9 aa, Homo Sapiens
GCIFIEMFH

SEQ ID NO: 634157 - protein, 9 aa, Homo Sapiens
MHLHAGEHV

SEQ ID NO: 634158 - protein, 9 aa, Homo Sapiens
IGNMTVLSP

SEQ ID NO: 634159 - protein, 9 aa, Homo Sapiens
QRCHSLLSW

SEQ ID NO: 634160 - protein, 9 aa, Homo Sapiens
YHIPSRLDG

SEQ ID NO: 634161 - protein, 9 aa, Homo Sapiens
WNLKSPNLS

SEQ ID NO: 634162 - protein, 9 aa, Homo Sapiens
VRTDDGRSM

SEQ ID NO: 634163 - protein, 9 aa, Homo Sapiens
EDCIQAWAQ

SEQ ID NO: 634164 - protein, 9 aa, Homo Sapiens
DGRSMAVRI

SEQ ID NO: 634165 - protein, 9 aa, Homo Sapiens
LLLEAMVEE

SEQ ID NO: 634166 - protein, 9 aa, Homo Sapiens
DSDGNGPLE

SEQ ID NO: 634167 - protein, 9 aa, Homo Sapiens
SFSRRTTPF

SEQ ID NO: 634168 - protein, 9 aa, Homo Sapiens
VLIILTALQ

SEQ ID NO: 634169 - protein, 9 aa, Homo Sapiens
PMGTFDWLV

SEQ ID NO: 634170 - protein, 9 aa, Homo Sapiens
QEVIARNLN

SEQ ID NO: 634171 - protein, 9 aa, Homo Sapiens
QDKMLFPKS

SEQ ID NO: 634172 - protein, 9 aa, Homo Sapiens
PFVEDNFSK

SEQ ID NO: 634173 - protein, 9 aa, Homo Sapiens
AFQPVLDGG

SEQ ID NO: 634174 - protein, 9 aa, Homo Sapiens
FDPCTKCEH

SEQ ID NO: 634175 - protein, 9 aa, Homo Sapiens
KEYTEDNIQ

SEQ ID NO: 634176 - protein, 9 aa, Homo Sapiens
WSQGPGLQG

SEQ ID NO: 634177 - protein, 9 aa, Homo Sapiens
MVRTSAFPW

SEQ ID NO: 634178 - protein, 9 aa, Homo Sapiens
WSCFLCLVD

SEQ ID NO: 634179 - protein, 9 aa, Homo Sapiens
GRASSVLHD

SEQ ID NO: 634180 - protein, 9 aa, Homo Sapiens
SDGNGPLEP

SEQ ID NO: 634181 - protein, 9 aa, Homo Sapiens
NNPFKGSSS

SEQ ID NO: 634182 - protein, 9 aa, Homo Sapiens
LVCVLVLDA

SEQ ID NO: 634183 - protein, 9 aa, Homo Sapiens
KEKSRPTGV

SEQ ID NO: 634184 - protein, 9 aa, Homo Sapiens
TLVCSSVVG

SEQ ID NO: 634185 - protein, 9 aa, Homo Sapiens
VLSQLSYAP

SEQ ID NO: 634186 - protein, 9 aa, Homo Sapiens
NKYFKSWRP

SEQ ID NO: 634187 - protein, 9 aa, Homo Sapiens
SELGQRSKV

SEQ ID NO: 634188 - protein, 9 aa, Homo Sapiens
YPSVADFPH

SEQ ID NO: 634189 - protein, 9 aa, Homo Sapiens
EKQYPDYKS

SEQ ID NO: 634190 - protein, 9 aa, Homo Sapiens
LSWAEGSFV

SEQ ID NO: 634191 - protein, 9 aa, Homo Sapiens
HPHPEIPYQ

SEQ ID NO: 634192 - protein, 9 aa, Homo Sapiens
CGGMASCGP

SEQ ID NO: 634193 - protein, 9 aa, Homo Sapiens
YSVTAHAEG

SEQ ID NO: 634194 - protein, 9 aa, Homo Sapiens
ASLLPQHLS

SEQ ID NO: 634195 - protein, 9 aa, Homo Sapiens
GKRRKEWLK

SEQ ID NO: 634196 - protein, 9 aa, Homo Sapiens
PRVQPNSTR

SEQ ID NO: 634197 - protein, 9 aa, Homo Sapiens
PENEGTSAA

SEQ ID NO: 634198 - protein, 9 aa, Homo Sapiens
SKSGPRKDG

SEQ ID NO: 634199 - protein, 9 aa, Homo Sapiens
LQAQRSTTK

SEQ ID NO: 634200 - protein, 9 aa, Homo Sapiens
DRTEQAEAD

SEQ ID NO: 634201 - protein, 9 aa, Homo Sapiens
SGIFKEVCT

SEQ ID NO: 634202 - protein, 9 aa, Homo Sapiens
NHHLHSVKT

SEQ ID NO: 634203 - protein, 9 aa, Homo Sapiens
GTRPCHPLA

SEQ ID NO: 634204 - protein, 9 aa, Homo Sapiens
LMFHPGGMM

SEQ ID NO: 634205 - protein, 9 aa, Homo Sapiens
NQRWYVPEA

SEQ ID NO: 634206 - protein, 9 aa, Homo Sapiens
TIKFMYTDC

SEQ ID NO: 634207 - protein, 9 aa, Homo Sapiens
LLTNRVPPT

SEQ ID NO: 634208 - protein, 9 aa, Homo Sapiens
LYPSVEETF

SEQ ID NO: 634209 - protein, 9 aa, Homo Sapiens
HLQVEPPAQ

SEQ ID NO: 634210 - protein, 9 aa, Homo Sapiens
IDKTEKSVL

SEQ ID NO: 634211 - protein, 9 aa, Homo Sapiens
HTAVLYRIC

SEQ ID NO: 634212 - protein, 9 aa, Homo Sapiens
ASVSKDTDI

SEQ ID NO: 634213 - protein, 9 aa, Homo Sapiens
QLKASLQAQ

SEQ ID NO: 634214 - protein, 9 aa, Homo Sapiens
DDGRSMAVR

SEQ ID NO: 634215 - protein, 9 aa, Homo Sapiens
CSNLAFMFR

SEQ ID NO: 634216 - protein, 9 aa, Homo Sapiens
PTSPPPHDS

SEQ ID NO: 634217 - protein, 9 aa, Homo Sapiens
EDSQYNDYV

SEQ ID NO: 634218 - protein, 9 aa, Homo Sapiens
RPHQFRRFR

SEQ ID NO: 634219 - protein, 9 aa, Homo Sapiens
HVRCSQSPP

SEQ ID NO: 634220 - protein, 9 aa, Homo Sapiens
HHHHHYHHS

SEQ ID NO: 634221 - protein, 9 aa, Homo Sapiens
HKAGLAVDV

SEQ ID NO: 634222 - protein, 9 aa, Homo Sapiens
PNVSAIREI

SEQ ID NO: 634223 - protein, 9 aa, Homo Sapiens
ARFSPEVTG

SEQ ID NO: 634224 - protein, 9 aa, Homo Sapiens
KDREELCGR

SEQ ID NO: 634225 - protein, 9 aa, Homo Sapiens
HKIMQLQQT

SEQ ID NO: 634226 - protein, 9 aa, Homo Sapiens
GGGGSPQSY

SEQ ID NO: 634227 - protein, 9 aa, Homo Sapiens
NLKGNLHNL

SEQ ID NO: 634228 - protein, 9 aa, Homo Sapiens
KFPLDNTAV

SEQ ID NO: 634229 - protein, 9 aa, Homo Sapiens
MRTLRPSLV

SEQ ID NO: 634230 - protein, 9 aa, Homo Sapiens
LIYTIEARN

SEQ ID NO: 634231 - protein, 9 aa, Homo Sapiens
ALQECQDLD

SEQ ID NO: 634232 - protein, 9 aa, Homo Sapiens
TPGRAGRQD

SEQ ID NO: 634233 - protein, 9 aa, Homo Sapiens
FLSRFEKKT

SEQ ID NO: 634234 - protein, 9 aa, Homo Sapiens
HFSSLIKKK

SEQ ID NO: 634235 - protein, 9 aa, Homo Sapiens
SPLRMSLQE

SEQ ID NO: 634236 - protein, 9 aa, Homo Sapiens
VVSTVMIGL

SEQ ID NO: 634237 - protein, 9 aa, Homo Sapiens
MWLPQQNAA

SEQ ID NO: 634238 - protein, 9 aa, Homo Sapiens
YIKILQALN

SEQ ID NO: 634239 - protein, 9 aa, Homo Sapiens
KQYPDYKSN

SEQ ID NO: 634240 - protein, 9 aa, Homo Sapiens
FSEEDVVWL

SEQ ID NO: 634241 - protein, 9 aa, Homo Sapiens
RKILDSLER

SEQ ID NO: 634242 - protein, 9 aa, Homo Sapiens
PFFLQMPFN

SEQ ID NO: 634243 - protein, 9 aa, Homo Sapiens
LSISGIFKE

SEQ ID NO: 634244 - protein, 9 aa, Homo Sapiens
RALKSASKD

SEQ ID NO: 634245 - protein, 9 aa, Homo Sapiens
RLLLYIVRL

SEQ ID NO: 634246 - protein, 9 aa, Homo Sapiens
TLNVYNVDN

SEQ ID NO: 634247 - protein, 9 aa, Homo Sapiens
VTGLWKDPS

SEQ ID NO: 634248 - protein, 9 aa, Homo Sapiens
IITSYTANL

SEQ ID NO: 634249 - protein, 9 aa, Homo Sapiens
TKDLPNDVI

SEQ ID NO: 634250 - protein, 9 aa, Homo Sapiens
PWAEEAALE

SEQ ID NO: 634251 - protein, 9 aa, Homo Sapiens
PPYCWVSIN

SEQ ID NO: 634252 - protein, 9 aa, Homo Sapiens
IVFLVGLLP

SEQ ID NO: 634253 - protein, 9 aa, Homo Sapiens
LDKVLQQGD

SEQ ID NO: 634254 - protein, 9 aa, Homo Sapiens
ITIPHLRGK

SEQ ID NO: 634255 - protein, 9 aa, Homo Sapiens
ADEAACRIP

SEQ ID NO: 634256 - protein, 9 aa, Homo Sapiens
NLSGLVPSG

SEQ ID NO: 634257 - protein, 9 aa, Homo Sapiens
DEDYGCVHC

SEQ ID NO: 634258 - protein, 9 aa, Homo Sapiens
PGEYSVTAH

SEQ ID NO: 634259 - protein, 9 aa, Homo Sapiens
CRIPSVRTL

SEQ ID NO: 634260 - protein, 9 aa, Homo Sapiens
ANTTTNKEK

SEQ ID NO: 634261 - protein, 9 aa, Homo Sapiens
RNKPDIFEL

SEQ ID NO: 634262 - protein, 9 aa, Homo Sapiens
KTWYSATRF

SEQ ID NO: 634263 - protein, 9 aa, Homo Sapiens
EEAEVRHPK

SEQ ID NO: 634264 - protein, 9 aa, Homo Sapiens
RSKETVVFY

SEQ ID NO: 634265 - protein, 9 aa, Homo Sapiens
AIQREEIKF

SEQ ID NO: 634266 - protein, 9 aa, Homo Sapiens
IARNLNVMS

SEQ ID NO: 634267 - protein, 9 aa, Homo Sapiens
NSILKNSAR

SEQ ID NO: 634268 - protein, 9 aa, Homo Sapiens
QVLKNNTYC

SEQ ID NO: 634269 - protein, 9 aa, Homo Sapiens
VLMVTYIVT

SEQ ID NO: 634270 - protein, 9 aa, Homo Sapiens
GKEKDPLAS

SEQ ID NO: 634271 - protein, 9 aa, Homo Sapiens
LESLAKDHC

SEQ ID NO: 634272 - protein, 9 aa, Homo Sapiens
QGPAGHGLP

SEQ ID NO: 634273 - protein, 9 aa, Homo Sapiens
RGLFRVTLC

SEQ ID NO: 634274 - protein, 9 aa, Homo Sapiens
HHYFPYDYS

SEQ ID NO: 634275 - protein, 9 aa, Homo Sapiens
DIKIGPFAN

SEQ ID NO: 634276 - protein, 9 aa, Homo Sapiens
IACSVYIPA

SEQ ID NO: 634277 - protein, 9 aa, Homo Sapiens
KKRVHPYYV

SEQ ID NO: 634278 - protein, 9 aa, Homo Sapiens
PILLVSGGG

SEQ ID NO: 634279 - protein, 9 aa, Homo Sapiens
EPRPDSWSL

SEQ ID NO: 634280 - protein, 9 aa, Homo Sapiens
CADRYDVTD

SEQ ID NO: 634281 - protein, 9 aa, Homo Sapiens
CDHLVACTW

SEQ ID NO: 634282 - protein, 9 aa, Homo Sapiens
ELVAFVISV

SEQ ID NO: 634283 - protein, 9 aa, Homo Sapiens
QAQEERKLA

SEQ ID NO: 634284 - protein, 9 aa, Homo Sapiens
NYGHAGNFA

SEQ ID NO: 634285 - protein, 9 aa, Homo Sapiens
VSPGEPGAN

SEQ ID NO: 634286 - protein, 9 aa, Homo Sapiens
ALTQTVRVV

SEQ ID NO: 634287 - protein, 9 aa, Homo Sapiens
FLKHLNLCS

SEQ ID NO: 634288 - protein, 9 aa, Homo Sapiens
IKSIPPGAI

SEQ ID NO: 634289 - protein, 9 aa, Homo Sapiens
DEEAHSSIC

SEQ ID NO: 634290 - protein, 9 aa, Homo Sapiens
SLLHDILQE

SEQ ID NO: 634291 - protein, 9 aa, Homo Sapiens
DLPSPSPGK

SEQ ID NO: 634292 - protein, 9 aa, Homo Sapiens
LALVLLKAR

SEQ ID NO: 634293 - protein, 9 aa, Homo Sapiens
SVADFPHPS

SEQ ID NO: 634294 - protein, 9 aa, Homo Sapiens
LTSWFTSKG

SEQ ID NO: 634295 - protein, 9 aa, Homo Sapiens
AHLWVVDLL

SEQ ID NO: 634296 - protein, 9 aa, Homo Sapiens
EGHYTVIEN

SEQ ID NO: 634297 - protein, 9 aa, Homo Sapiens
RGNVPLMLF

SEQ ID NO: 634298 - protein, 9 aa, Homo Sapiens
GVYSLGLSF

SEQ ID NO: 634299 - protein, 9 aa, Homo Sapiens
TTLQRLNAC

SEQ ID NO: 634300 - protein, 9 aa, Homo Sapiens
KRHRKRSKG

SEQ ID NO: 634301 - protein, 9 aa, Homo Sapiens
RAVLFPAAQ

SEQ ID NO: 634302 - protein, 9 aa, Homo Sapiens
PAGHGLPGS

SEQ ID NO: 634303 - protein, 9 aa, Homo Sapiens
KQLLLLEAM

SEQ ID NO: 634304 - protein, 9 aa, Homo Sapiens
LERLVADEA

SEQ ID NO: 634305 - protein, 9 aa, Homo Sapiens
INDEQQGSI

SEQ ID NO: 634306 - protein, 9 aa, Homo Sapiens
RLRRLLHWE

SEQ ID NO: 634307 - protein, 9 aa, Homo Sapiens
TLEDSSVNL

SEQ ID NO: 634308 - protein, 9 aa, Homo Sapiens
VEFVLEKCQ

SEQ ID NO: 634309 - protein, 9 aa, Homo Sapiens
TTVEELCYQ

SEQ ID NO: 634310 - protein, 9 aa, Homo Sapiens
CLLLLLVQR

SEQ ID NO: 634311 - protein, 9 aa, Homo Sapiens
GNSSSSATV

SEQ ID NO: 634312 - protein, 9 aa, Homo Sapiens
IYCDNIVLT

SEQ ID NO: 634313 - protein, 9 aa, Homo Sapiens
ERLKGLGVY

SEQ ID NO: 634314 - protein, 9 aa, Homo Sapiens
ASLKRPDSV

SEQ ID NO: 634315 - protein, 9 aa, Homo Sapiens
QVDEGLSIM

SEQ ID NO: 634316 - protein, 9 aa, Homo Sapiens
RYNMAHSST

SEQ ID NO: 634317 - protein, 9 aa, Homo Sapiens
KKDNETILC

SEQ ID NO: 634318 - protein, 9 aa, Homo Sapiens
NSDRSSSML

SEQ ID NO: 634319 - protein, 9 aa, Homo Sapiens
YPKFHPGLM

SEQ ID NO: 634320 - protein, 9 aa, Homo Sapiens
EAMAHFTIH

SEQ ID NO: 634321 - protein, 9 aa, Homo Sapiens
RSGTHSHSL

SEQ ID NO: 634322 - protein, 9 aa, Homo Sapiens
HDPGQRRVL

SEQ ID NO: 634323 - protein, 9 aa, Homo Sapiens
NYLMLLLNE

SEQ ID NO: 634324 - protein, 9 aa, Homo Sapiens
DIIHRIFSI

SEQ ID NO: 634325 - protein, 9 aa, Homo Sapiens
DRQPCDREA

SEQ ID NO: 634326 - protein, 9 aa, Homo Sapiens
KIGKESWFE

SEQ ID NO: 634327 - protein, 9 aa, Homo Sapiens
SLWEIYLSP

SEQ ID NO: 634328 - protein, 9 aa, Homo Sapiens
IICKDIKKC

SEQ ID NO: 634329 - protein, 9 aa, Homo Sapiens
LGIRLQAQR

SEQ ID NO: 634330 - protein, 9 aa, Homo Sapiens
CLPFSNYFP

SEQ ID NO: 634331 - protein, 9 aa, Homo Sapiens
GDLIAQELK

SEQ ID NO: 634332 - protein, 9 aa, Homo Sapiens
GTPGRAGRQ

SEQ ID NO: 634333 - protein, 9 aa, Homo Sapiens
SLERAFWDV

SEQ ID NO: 634334 - protein, 9 aa, Homo Sapiens
LKSASKDDS

SEQ ID NO: 634335 - protein, 9 aa, Homo Sapiens
VDASTQIRL

SEQ ID NO: 634336 - protein, 9 aa, Homo Sapiens
LLAAYFFSF

SEQ ID NO: 634337 - protein, 9 aa, Homo Sapiens
LSAHVWRPS

SEQ ID NO: 634338 - protein, 9 aa, Homo Sapiens
CSAIGTWES

SEQ ID NO: 634339 - protein, 9 aa, Homo Sapiens
DLQAWWASK

SEQ ID NO: 634340 - protein, 9 aa, Homo Sapiens
SFSSHDPKY

SEQ ID NO: 634341 - protein, 9 aa, Homo Sapiens
RPRLGKAGL

SEQ ID NO: 634342 - protein, 9 aa, Homo Sapiens
DDSHDESQS

SEQ ID NO: 634343 - protein, 9 aa, Homo Sapiens
MEAMQDKFI

SEQ ID NO: 634344 - protein, 9 aa, Homo Sapiens
TVSGINDYL

SEQ ID NO: 634345 - protein, 9 aa, Homo Sapiens
YGCVHCPAE

SEQ ID NO: 634346 - protein, 9 aa, Homo Sapiens
SINPDRLSY

SEQ ID NO: 634347 - protein, 9 aa, Homo Sapiens
PQPHTTPSP

SEQ ID NO: 634348 - protein, 9 aa, Homo Sapiens
TLSNIGILP

SEQ ID NO: 634349 - protein, 9 aa, Homo Sapiens
LQWDVLVDR

SEQ ID NO: 634350 - protein, 9 aa, Homo Sapiens
GTNEQSSPP

SEQ ID NO: 634351 - protein, 9 aa, Homo Sapiens
SSGNRTINR

SEQ ID NO: 634352 - protein, 9 aa, Homo Sapiens
VCPEEHVHL

SEQ ID NO: 634353 - protein, 9 aa, Homo Sapiens
KIFGLELIL

SEQ ID NO: 634354 - protein, 9 aa, Homo Sapiens
FAFTCAFGG

SEQ ID NO: 634355 - protein, 9 aa, Homo Sapiens
WRDYVPDHP

SEQ ID NO: 634356 - protein, 9 aa, Homo Sapiens
IGLLMFSLG

SEQ ID NO: 634357 - protein, 9 aa, Homo Sapiens
RIFSICNMA

SEQ ID NO: 634358 - protein, 9 aa, Homo Sapiens
QNSTVMNSR

SEQ ID NO: 634359 - protein, 9 aa, Homo Sapiens
PIMYVAYHC

SEQ ID NO: 634360 - protein, 9 aa, Homo Sapiens
KLDKVLQQG

SEQ ID NO: 634361 - protein, 9 aa, Homo Sapiens
FLSVEEQLS

SEQ ID NO: 634362 - protein, 9 aa, Homo Sapiens
NEGTSAALA

SEQ ID NO: 634363 - protein, 9 aa, Homo Sapiens
PIPGSLLDV

SEQ ID NO: 634364 - protein, 9 aa, Homo Sapiens
CPTAFLVSC

SEQ ID NO: 634365 - protein, 9 aa, Homo Sapiens
CEDTICGTQ

SEQ ID NO: 634366 - protein, 9 aa, Homo Sapiens
GPEIPLAME

SEQ ID NO: 634367 - protein, 9 aa, Homo Sapiens
GENVTLLCL

SEQ ID NO: 634368 - protein, 9 aa, Homo Sapiens
RPSLQWPVT

SEQ ID NO: 634369 - protein, 9 aa, Homo Sapiens
SSRSVMDSS

SEQ ID NO: 634370 - protein, 9 aa, Homo Sapiens
SLSLLIIHP

SEQ ID NO: 634371 - protein, 9 aa, Homo Sapiens
SIDIASIDM

SEQ ID NO: 634372 - protein, 9 aa, Homo Sapiens
MLESLSCEY

SEQ ID NO: 634373 - protein, 9 aa, Homo Sapiens
PEGPACLPG

SEQ ID NO: 634374 - protein, 9 aa, Homo Sapiens
YRSPFLLTL

SEQ ID NO: 634375 - protein, 9 aa, Homo Sapiens
AWAGPCGGR

SEQ ID NO: 634376 - protein, 9 aa, Homo Sapiens
DRLDRDQQE

SEQ ID NO: 634377 - protein, 9 aa, Homo Sapiens
KLRKRERSC

SEQ ID NO: 634378 - protein, 9 aa, Homo Sapiens
WDALLEKLC

SEQ ID NO: 634379 - protein, 9 aa, Homo Sapiens
PGHLQVEPP

SEQ ID NO: 634380 - protein, 9 aa, Homo Sapiens
IILTALQPS

SEQ ID NO: 634381 - protein, 9 aa, Homo Sapiens
DFSIKGAED

SEQ ID NO: 634382 - protein, 9 aa, Homo Sapiens
GTHMVHMLC

SEQ ID NO: 634383 - protein, 9 aa, Homo Sapiens
LSPGSAHSL

SEQ ID NO: 634384 - protein, 9 aa, Homo Sapiens
VLVILAAVQ

SEQ ID NO: 634385 - protein, 9 aa, Homo Sapiens
LLLFLIIRH

SEQ ID NO: 634386 - protein, 9 aa, Homo Sapiens
STSNPELVS

SEQ ID NO: 634387 - protein, 9 aa, Homo Sapiens
VSFTTVYVP

SEQ ID NO: 634388 - protein, 9 aa, Homo Sapiens
LKLSECPEP

SEQ ID NO: 634389 - protein, 9 aa, Homo Sapiens
ASTITSVSG

SEQ ID NO: 634390 - protein, 9 aa, Homo Sapiens
RFNLILANT

SEQ ID NO: 634391 - protein, 9 aa, Homo Sapiens
GTPIVNPPQ

SEQ ID NO: 634392 - protein, 9 aa, Homo Sapiens
LKDRYGYWM

SEQ ID NO: 634393 - protein, 9 aa, Homo Sapiens
RMEKYGNVF

SEQ ID NO: 634394 - protein, 9 aa, Homo Sapiens
LHNLERKNA

SEQ ID NO: 634395 - protein, 9 aa, Homo Sapiens
RSQVYAVND

SEQ ID NO: 634396 - protein, 9 aa, Homo Sapiens
LPVASEILV

SEQ ID NO: 634397 - protein, 9 aa, Homo Sapiens
GAHSPGCLE

SEQ ID NO: 634398 - protein, 9 aa, Homo Sapiens
LPFMGSIDL

SEQ ID NO: 634399 - protein, 9 aa, Homo Sapiens
RPSIDGRDP

SEQ ID NO: 634400 - protein, 9 aa, Homo Sapiens
GLLPVASEI

SEQ ID NO: 634401 - protein, 9 aa, Homo Sapiens
TPGGLDARQ

SEQ ID NO: 634402 - protein, 9 aa, Homo Sapiens
HGRCYNCIS

SEQ ID NO: 634403 - protein, 9 aa, Homo Sapiens
NQGVFFSWD

SEQ ID NO: 634404 - protein, 9 aa, Homo Sapiens
ESFRDALRL

SEQ ID NO: 634405 - protein, 9 aa, Homo Sapiens
GLAVDVAEL

SEQ ID NO: 634406 - protein, 9 aa, Homo Sapiens
LCEDTICGT

SEQ ID NO: 634407 - protein, 9 aa, Homo Sapiens
GSLVYVIED

SEQ ID NO: 634408 - protein, 9 aa, Homo Sapiens
EDADIAARR

SEQ ID NO: 634409 - protein, 9 aa, Homo Sapiens
VAALEIILI

SEQ ID NO: 634410 - protein, 9 aa, Homo Sapiens
DGQTLWLLI

SEQ ID NO: 634411 - protein, 9 aa, Homo Sapiens
VSIEKIRFF

SEQ ID NO: 634412 - protein, 9 aa, Homo Sapiens
PVRPGLDGV

SEQ ID NO: 634413 - protein, 9 aa, Homo Sapiens
TPQGEDRKS

SEQ ID NO: 634414 - protein, 9 aa, Homo Sapiens
LLPVASEIL

SEQ ID NO: 634415 - protein, 9 aa, Homo Sapiens
PSQVKGQEV

SEQ ID NO: 634416 - protein, 9 aa, Homo Sapiens
WHVRWRTEI

SEQ ID NO: 634417 - protein, 9 aa, Homo Sapiens
YIRDYPALQ

SEQ ID NO: 634418 - protein, 9 aa, Homo Sapiens
VPEAVGFDI

SEQ ID NO: 634419 - protein, 9 aa, Homo Sapiens
QPGHAGAGG

SEQ ID NO: 634420 - protein, 9 aa, Homo Sapiens
LHQFVEQLQ

SEQ ID NO: 634421 - protein, 9 aa, Homo Sapiens
ALLAFAIAA

SEQ ID NO: 634422 - protein, 9 aa, Homo Sapiens
EEEEAEVRH

SEQ ID NO: 634423 - protein, 9 aa, Homo Sapiens
TGVPIYIKN

SEQ ID NO: 634424 - protein, 9 aa, Homo Sapiens
ASTPQGEDR

SEQ ID NO: 634425 - protein, 9 aa, Homo Sapiens
SLHEEWSKA

SEQ ID NO: 634426 - protein, 9 aa, Homo Sapiens
FHVVQAGLE

SEQ ID NO: 634427 - protein, 9 aa, Homo Sapiens
ADLPSEPRL

SEQ ID NO: 634428 - protein, 9 aa, Homo Sapiens
IIKLIFRPP

SEQ ID NO: 634429 - protein, 9 aa, Homo Sapiens
TRSIHEEAP

SEQ ID NO: 634430 - protein, 9 aa, Homo Sapiens
EDQNKPYWI

SEQ ID NO: 634431 - protein, 9 aa, Homo Sapiens
FNLILANTN

SEQ ID NO: 634432 - protein, 9 aa, Homo Sapiens
GGMLAAWFM

SEQ ID NO: 634433 - protein, 9 aa, Homo Sapiens
TIGRAWGDP

SEQ ID NO: 634434 - protein, 9 aa, Homo Sapiens
PEVHSRVPT

SEQ ID NO: 634435 - protein, 9 aa, Homo Sapiens
VLVLRLEIY

SEQ ID NO: 634436 - protein, 9 aa, Homo Sapiens
LRGQPGHAG

SEQ ID NO: 634437 - protein, 9 aa, Homo Sapiens
SCQLSQRCP

SEQ ID NO: 634438 - protein, 9 aa, Homo Sapiens
SRLQCIEDR

SEQ ID NO: 634439 - protein, 9 aa, Homo Sapiens
LATCQQYLC

SEQ ID NO: 634440 - protein, 9 aa, Homo Sapiens
WMKVHHVNI

SEQ ID NO: 634441 - protein, 9 aa, Homo Sapiens
MMDANQRWY

SEQ ID NO: 634442 - protein, 9 aa, Homo Sapiens
PQHKKSVNG

SEQ ID NO: 634443 - protein, 9 aa, Homo Sapiens
ARWMPPPWA

SEQ ID NO: 634444 - protein, 9 aa, Homo Sapiens
LKLVDFIIE

SEQ ID NO: 634445 - protein, 9 aa, Homo Sapiens
FQLFFANGV

SEQ ID NO: 634446 - protein, 9 aa, Homo Sapiens
LVPSGGLLP

SEQ ID NO: 634447 - protein, 9 aa, Homo Sapiens
EFEIQCHPC

SEQ ID NO: 634448 - protein, 9 aa, Homo Sapiens
FFLQMPFNV

SEQ ID NO: 634449 - protein, 9 aa, Homo Sapiens
VLGAEDTAF

SEQ ID NO: 634450 - protein, 9 aa, Homo Sapiens
EVISRENRS

SEQ ID NO: 634451 - protein, 9 aa, Homo Sapiens
EEKRHLHEM

SEQ ID NO: 634452 - protein, 9 aa, Homo Sapiens
HTELEAQIV

SEQ ID NO: 634453 - protein, 9 aa, Homo Sapiens
SILNTTLQG

SEQ ID NO: 634454 - protein, 9 aa, Homo Sapiens
SNPELQAPP

SEQ ID NO: 634455 - protein, 9 aa, Homo Sapiens
LKCFRIMNN

SEQ ID NO: 634456 - protein, 9 aa, Homo Sapiens
KWKAETWKK

SEQ ID NO: 634457 - protein, 9 aa, Homo Sapiens
IIFVLNDGY

SEQ ID NO: 634458 - protein, 9 aa, Homo Sapiens
FQSTSLHNC

SEQ ID NO: 634459 - protein, 9 aa, Homo Sapiens
DDSSADPCG

SEQ ID NO: 634460 - protein, 9 aa, Homo Sapiens
KPESRASTI

SEQ ID NO: 634461 - protein, 9 aa, Homo Sapiens
LSVLAKELK

SEQ ID NO: 634462 - protein, 9 aa, Homo Sapiens
WSGMLNPGR

SEQ ID NO: 634463 - protein, 9 aa, Homo Sapiens
GAQGETALH

SEQ ID NO: 634464 - protein, 9 aa, Homo Sapiens
WEDRERFSF

SEQ ID NO: 634465 - protein, 9 aa, Homo Sapiens
FSPYEWYNT

SEQ ID NO: 634466 - protein, 9 aa, Homo Sapiens
LLLYIVRLV

SEQ ID NO: 634467 - protein, 9 aa, Homo Sapiens
KPAFGQYTG

SEQ ID NO: 634468 - protein, 9 aa, Homo Sapiens
APKEDSGTV

SEQ ID NO: 634469 - protein, 9 aa, Homo Sapiens
TSASPSKRR

SEQ ID NO: 634470 - protein, 9 aa, Homo Sapiens
SPVSEFLLI

SEQ ID NO: 634471 - protein, 9 aa, Homo Sapiens
AWEATCIWD

SEQ ID NO: 634472 - protein, 9 aa, Homo Sapiens
SSRMLFAGF

SEQ ID NO: 634473 - protein, 9 aa, Homo Sapiens
SGTSTSSGT

SEQ ID NO: 634474 - protein, 9 aa, Homo Sapiens
CYEEVGLPL

SEQ ID NO: 634475 - protein, 9 aa, Homo Sapiens
CADLPSEPR

SEQ ID NO: 634476 - protein, 9 aa, Homo Sapiens
QQAYRMRWW

SEQ ID NO: 634477 - protein, 9 aa, Homo Sapiens
AHPRPTSHD

SEQ ID NO: 634478 - protein, 9 aa, Homo Sapiens
QVPLSRKMA

SEQ ID NO: 634479 - protein, 9 aa, Homo Sapiens
LASSAGASH

SEQ ID NO: 634480 - protein, 9 aa, Homo Sapiens
LPSPSPGKR

SEQ ID NO: 634481 - protein, 9 aa, Homo Sapiens
PSHILVVLL

SEQ ID NO: 634482 - protein, 9 aa, Homo Sapiens
PRLEEELAD

SEQ ID NO: 634483 - protein, 9 aa, Homo Sapiens
PLSRKMAEL

SEQ ID NO: 634484 - protein, 9 aa, Homo Sapiens
AANTSVAIA

SEQ ID NO: 634485 - protein, 9 aa, Homo Sapiens
EPEGPAPHI

SEQ ID NO: 634486 - protein, 9 aa, Homo Sapiens
DDSAFTELR

SEQ ID NO: 634487 - protein, 9 aa, Homo Sapiens
LIAQELKRI

SEQ ID NO: 634488 - protein, 9 aa, Homo Sapiens
GMEYRNLGK

SEQ ID NO: 634489 - protein, 9 aa, Homo Sapiens
KSIPPGAIS

SEQ ID NO: 634490 - protein, 9 aa, Homo Sapiens
EQLAHCLRG

SEQ ID NO: 634491 - protein, 9 aa, Homo Sapiens
LAKSAEAWE

SEQ ID NO: 634492 - protein, 9 aa, Homo Sapiens
VVSYVVLVI

SEQ ID NO: 634493 - protein, 9 aa, Homo Sapiens
LSLDVDANR

SEQ ID NO: 634494 - protein, 9 aa, Homo Sapiens
PPQIRGCRA

SEQ ID NO: 634495 - protein, 9 aa, Homo Sapiens
ADESIADCV

SEQ ID NO: 634496 - protein, 9 aa, Homo Sapiens
PPTKCPEPC

SEQ ID NO: 634497 - protein, 9 aa, Homo Sapiens
NSSSSATVS

SEQ ID NO: 634498 - protein, 9 aa, Homo Sapiens
VFGYLKADN

SEQ ID NO: 634499 - protein, 9 aa, Homo Sapiens
GSHGSRLEK

SEQ ID NO: 634500 - protein, 9 aa, Homo Sapiens
FVYIGIVAS

SEQ ID NO: 634501 - protein, 9 aa, Homo Sapiens
RGGSLCSPR

SEQ ID NO: 634502 - protein, 9 aa, Homo Sapiens
RLQCIEDRN

SEQ ID NO: 634503 - protein, 9 aa, Homo Sapiens
ICLPLQNST

SEQ ID NO: 634504 - protein, 9 aa, Homo Sapiens
LSTPLECGR

SEQ ID NO: 634505 - protein, 9 aa, Homo Sapiens
IQAPVASRR

SEQ ID NO: 634506 - protein, 9 aa, Homo Sapiens
TCHLNMQHQ

SEQ ID NO: 634507 - protein, 9 aa, Homo Sapiens
REAIYPLLS

SEQ ID NO: 634508 - protein, 9 aa, Homo Sapiens
RKDWSCFLC

SEQ ID NO: 634509 - protein, 9 aa, Homo Sapiens
SQLECCSVA

SEQ ID NO: 634510 - protein, 9 aa, Homo Sapiens
MKVLQGKFH

SEQ ID NO: 634511 - protein, 9 aa, Homo Sapiens
CGAETGIFL

SEQ ID NO: 634512 - protein, 9 aa, Homo Sapiens
DFLWKNCEF

SEQ ID NO: 634513 - protein, 9 aa, Homo Sapiens
PTSHDLAGF

SEQ ID NO: 634514 - protein, 9 aa, Homo Sapiens
LAVPEAVGF

SEQ ID NO: 634515 - protein, 9 aa, Homo Sapiens
MLFPKSSAL

SEQ ID NO: 634516 - protein, 9 aa, Homo Sapiens
GRLRKHGKL

SEQ ID NO: 634517 - protein, 9 aa, Homo Sapiens
DLAYKQLYS

SEQ ID NO: 634518 - protein, 9 aa, Homo Sapiens
DEPPQGLYY

SEQ ID NO: 634519 - protein, 9 aa, Homo Sapiens
DLDLLSRVH

SEQ ID NO: 634520 - protein, 9 aa, Homo Sapiens
RQASRLRHK

SEQ ID NO: 634521 - protein, 9 aa, Homo Sapiens
FKEMRGVME

SEQ ID NO: 634522 - protein, 9 aa, Homo Sapiens
QPWPEVSRG

SEQ ID NO: 634523 - protein, 9 aa, Homo Sapiens
GAYFPSLSL

SEQ ID NO: 634524 - protein, 9 aa, Homo Sapiens
RWRQNLGNG

SEQ ID NO: 634525 - protein, 9 aa, Homo Sapiens
SSQEESKDL

SEQ ID NO: 634526 - protein, 9 aa, Homo Sapiens
AEELVGFLD

SEQ ID NO: 634527 - protein, 9 aa, Homo Sapiens
LSVLMYLEC

SEQ ID NO: 634528 - protein, 9 aa, Homo Sapiens
KTGILWLLM

SEQ ID NO: 634529 - protein, 9 aa, Homo Sapiens
IAGMHLFYM

SEQ ID NO: 634530 - protein, 9 aa, Homo Sapiens
LPQAAAGIP

SEQ ID NO: 634531 - protein, 9 aa, Homo Sapiens
MVERKEEDD

SEQ ID NO: 634532 - protein, 9 aa, Homo Sapiens
NQKIPQLQS

SEQ ID NO: 634533 - protein, 9 aa, Homo Sapiens
QVQCHTYTV

SEQ ID NO: 634534 - protein, 9 aa, Homo Sapiens
IICQEHSQI

SEQ ID NO: 634535 - protein, 9 aa, Homo Sapiens
CGGGAAGGP

SEQ ID NO: 634536 - protein, 9 aa, Homo Sapiens
KDADGSIAK

SEQ ID NO: 634537 - protein, 9 aa, Homo Sapiens
LGAKDKTAQ

SEQ ID NO: 634538 - protein, 9 aa, Homo Sapiens
SPINVHLQT

SEQ ID NO: 634539 - protein, 9 aa, Homo Sapiens
VLRRSLDKQ

SEQ ID NO: 634540 - protein, 9 aa, Homo Sapiens
PEIQAPVAS

SEQ ID NO: 634541 - protein, 9 aa, Homo Sapiens
RYNLCISCI

SEQ ID NO: 634542 - protein, 9 aa, Homo Sapiens
PRDARDGGM

SEQ ID NO: 634543 - protein, 9 aa, Homo Sapiens
IAGIRQAFR

SEQ ID NO: 634544 - protein, 9 aa, Homo Sapiens
GGQWGDAPS

SEQ ID NO: 634545 - protein, 9 aa, Homo Sapiens
VASEILVAS

SEQ ID NO: 634546 - protein, 9 aa, Homo Sapiens
LNPGEYSVT

SEQ ID NO: 634547 - protein, 9 aa, Homo Sapiens
QMGYPVLKV

SEQ ID NO: 634548 - protein, 9 aa, Homo Sapiens
KHVSLSLSV

SEQ ID NO: 634549 - protein, 9 aa, Homo Sapiens
ACYCRPGFD

SEQ ID NO: 634550 - protein, 9 aa, Homo Sapiens
LQQAYRMRW

SEQ ID NO: 634551 - protein, 9 aa, Homo Sapiens
WISSGNRTI

SEQ ID NO: 634552 - protein, 9 aa, Homo Sapiens
WGEPGQPAQ

SEQ ID NO: 634553 - protein, 9 aa, Homo Sapiens
TPVSNITSS

SEQ ID NO: 634554 - protein, 9 aa, Homo Sapiens
AIRQASRLR

SEQ ID NO: 634555 - protein, 9 aa, Homo Sapiens
GMILLIAFS

SEQ ID NO: 634556 - protein, 9 aa, Homo Sapiens
NGVGRPPPA

SEQ ID NO: 634557 - protein, 9 aa, Homo Sapiens
LGDKPLGCC

SEQ ID NO: 634558 - protein, 9 aa, Homo Sapiens
WEPIPYRTL

SEQ ID NO: 634559 - protein, 9 aa, Homo Sapiens
PITHPNDEE

SEQ ID NO: 634560 - protein, 9 aa, Homo Sapiens
ALRRSPRRT

SEQ ID NO: 634561 - protein, 9 aa, Homo Sapiens
DEYMLSLYR

SEQ ID NO: 634562 - protein, 9 aa, Homo Sapiens
ANTSKANVT

SEQ ID NO: 634563 - protein, 9 aa, Homo Sapiens
MFHPGGMMK

SEQ ID NO: 634564 - protein, 9 aa, Homo Sapiens
VCSLDLYKF

SEQ ID NO: 634565 - protein, 9 aa, Homo Sapiens
PEEIRPNEV

SEQ ID NO: 634566 - protein, 9 aa, Homo Sapiens
CQEHSQISG

SEQ ID NO: 634567 - protein, 9 aa, Homo Sapiens
WKPSKSTLS

SEQ ID NO: 634568 - protein, 9 aa, Homo Sapiens
VFNPLLSHT

SEQ ID NO: 634569 - protein, 9 aa, Homo Sapiens
RTLHSMPLY

SEQ ID NO: 634570 - protein, 9 aa, Homo Sapiens
DYRSPFLLT

SEQ ID NO: 634571 - protein, 9 aa, Homo Sapiens
SLFFSVNKT

SEQ ID NO: 634572 - protein, 9 aa, Homo Sapiens
VGSLVYVIE

SEQ ID NO: 634573 - protein, 9 aa, Homo Sapiens
MIGLLMFSL

SEQ ID NO: 634574 - protein, 9 aa, Homo Sapiens
LKFIEKGNS

SEQ ID NO: 634575 - protein, 9 aa, Homo Sapiens
PYQPVLWLD

SEQ ID NO: 634576 - protein, 9 aa, Homo Sapiens
VYAVNDDYY

SEQ ID NO: 634577 - protein, 9 aa, Homo Sapiens
ATYTDRSDT

SEQ ID NO: 634578 - protein, 9 aa, Homo Sapiens
KDEPGHPVN

SEQ ID NO: 634579 - protein, 9 aa, Homo Sapiens
KNATDEDST

SEQ ID NO: 634580 - protein, 9 aa, Homo Sapiens
QYAVLHWLG

SEQ ID NO: 634581 - protein, 9 aa, Homo Sapiens
AHCLRGSIL

SEQ ID NO: 634582 - protein, 9 aa, Homo Sapiens
LFFSVNKTN

SEQ ID NO: 634583 - protein, 9 aa, Homo Sapiens
SKHLTGECM

SEQ ID NO: 634584 - protein, 9 aa, Homo Sapiens
IVLKVAGPA

SEQ ID NO: 634585 - protein, 9 aa, Homo Sapiens
RPTSHDLAG

SEQ ID NO: 634586 - protein, 9 aa, Homo Sapiens
HMADIVSVT

SEQ ID NO: 634587 - protein, 9 aa, Homo Sapiens
HPYYVITTQ

SEQ ID NO: 634588 - protein, 9 aa, Homo Sapiens
MADIVSVTS

SEQ ID NO: 634589 - protein, 9 aa, Homo Sapiens
DAQSSRSER

SEQ ID NO: 634590 - protein, 9 aa, Homo Sapiens
LGLVYETKE

SEQ ID NO: 634591 - protein, 9 aa, Homo Sapiens
EVHSRVPTL

SEQ ID NO: 634592 - protein, 9 aa, Homo Sapiens
CLSPGSAHS

SEQ ID NO: 634593 - protein, 9 aa, Homo Sapiens
TPASGTKSS

SEQ ID NO: 634594 - protein, 9 aa, Homo Sapiens
LHWEEFDEQ

SEQ ID NO: 634595 - protein, 9 aa, Homo Sapiens
YEHPENYIS

SEQ ID NO: 634596 - protein, 9 aa, Homo Sapiens
RLNDHGTNW

SEQ ID NO: 634597 - protein, 9 aa, Homo Sapiens
SLRVRDILS

SEQ ID NO: 634598 - protein, 9 aa, Homo Sapiens
NWVESYLSC

SEQ ID NO: 634599 - protein, 9 aa, Homo Sapiens
ILGLVAGWG

SEQ ID NO: 634600 - protein, 9 aa, Homo Sapiens
ILVHQLFHP

SEQ ID NO: 634601 - protein, 9 aa, Homo Sapiens
ELRYHVRRE

SEQ ID NO: 634602 - protein, 9 aa, Homo Sapiens
EFAREQQRL

SEQ ID NO: 634603 - protein, 9 aa, Homo Sapiens
RSTTKGRAG

SEQ ID NO: 634604 - protein, 9 aa, Homo Sapiens
YNVDNQAML

SEQ ID NO: 634605 - protein, 9 aa, Homo Sapiens
TDPARRELG

SEQ ID NO: 634606 - protein, 9 aa, Homo Sapiens
DCDGSSQSS

SEQ ID NO: 634607 - protein, 9 aa, Homo Sapiens
TSHDLAGFW

SEQ ID NO: 634608 - protein, 9 aa, Homo Sapiens
ELSFLRGDV

SEQ ID NO: 634609 - protein, 9 aa, Homo Sapiens
EVSFTTVYV

SEQ ID NO: 634610 - protein, 9 aa, Homo Sapiens
GSPPLNSTN

SEQ ID NO: 634611 - protein, 9 aa, Homo Sapiens
FEKPNIPSA

SEQ ID NO: 634612 - protein, 9 aa, Homo Sapiens
YVLCQLVGL

SEQ ID NO: 634613 - protein, 9 aa, Homo Sapiens
VILRLLLYI

SEQ ID NO: 634614 - protein, 9 aa, Homo Sapiens
TLWLLILAR

SEQ ID NO: 634615 - protein, 9 aa, Homo Sapiens
SQALGAQRA

SEQ ID NO: 634616 - protein, 9 aa, Homo Sapiens
ELILSMNIL

SEQ ID NO: 634617 - protein, 9 aa, Homo Sapiens
EVTGQKILH

SEQ ID NO: 634618 - protein, 9 aa, Homo Sapiens
LQERCQLPA

SEQ ID NO: 634619 - protein, 9 aa, Homo Sapiens
KDIVTAFFS

SEQ ID NO: 634620 - protein, 9 aa, Homo Sapiens
VSNYLNWVV

SEQ ID NO: 634621 - protein, 9 aa, Homo Sapiens
RLRKHGKLH

SEQ ID NO: 634622 - protein, 9 aa, Homo Sapiens
ATQNAYACP

SEQ ID NO: 634623 - protein, 9 aa, Homo Sapiens
PGAPRSEAA

SEQ ID NO: 634624 - protein, 9 aa, Homo Sapiens
EQCIADESI

SEQ ID NO: 634625 - protein, 9 aa, Homo Sapiens
TGRFSLSAI

SEQ ID NO: 634626 - protein, 9 aa, Homo Sapiens
SGSHARTSF

SEQ ID NO: 634627 - protein, 9 aa, Homo Sapiens
NHGVTAHLN

SEQ ID NO: 634628 - protein, 9 aa, Homo Sapiens
IATVTKKDA

SEQ ID NO: 634629 - protein, 9 aa, Homo Sapiens
TTKLTITLT

SEQ ID NO: 634630 - protein, 9 aa, Homo Sapiens
QNPRVQPNS

SEQ ID NO: 634631 - protein, 9 aa, Homo Sapiens
ASQDGKDTI

SEQ ID NO: 634632 - protein, 9 aa, Homo Sapiens
QAAGLYVGQ

SEQ ID NO: 634633 - protein, 9 aa, Homo Sapiens
VWLGLVKEG

SEQ ID NO: 634634 - protein, 9 aa, Homo Sapiens
LELMALHLQ

SEQ ID NO: 634635 - protein, 9 aa, Homo Sapiens
RPDDSCKPN

SEQ ID NO: 634636 - protein, 9 aa, Homo Sapiens
AGEIALSTS

SEQ ID NO: 634637 - protein, 9 aa, Homo Sapiens
MSTKIYTPG

SEQ ID NO: 634638 - protein, 9 aa, Homo Sapiens
SQSFSRRTT

SEQ ID NO: 634639 - protein, 9 aa, Homo Sapiens
SWVYRKISQ

SEQ ID NO: 634640 - protein, 9 aa, Homo Sapiens
NPRVQPNST

SEQ ID NO: 634641 - protein, 9 aa, Homo Sapiens
CMDLIYHML

SEQ ID NO: 634642 - protein, 9 aa, Homo Sapiens
ERAYQMVWT

SEQ ID NO: 634643 - protein, 9 aa, Homo Sapiens
ACIQRVNTE

SEQ ID NO: 634644 - protein, 9 aa, Homo Sapiens
LPLDYRSPF

SEQ ID NO: 634645 - protein, 9 aa, Homo Sapiens
FVEANIQHW

SEQ ID NO: 634646 - protein, 9 aa, Homo Sapiens
VELVEQRKR

SEQ ID NO: 634647 - protein, 9 aa, Homo Sapiens
LSEGDYAPL

SEQ ID NO: 634648 - protein, 9 aa, Homo Sapiens
VYQLKQMFH

SEQ ID NO: 634649 - protein, 9 aa, Homo Sapiens
RDSGLESKK

SEQ ID NO: 634650 - protein, 9 aa, Homo Sapiens
ILKNSARHW

SEQ ID NO: 634651 - protein, 9 aa, Homo Sapiens
CEPCGSGFY

SEQ ID NO: 634652 - protein, 9 aa, Homo Sapiens
ICQEHSQIS

SEQ ID NO: 634653 - protein, 9 aa, Homo Sapiens
SHDPGQRRV

SEQ ID NO: 634654 - protein, 9 aa, Homo Sapiens
PDSSINPDR

SEQ ID NO: 634655 - protein, 9 aa, Homo Sapiens
GINDYLTGD

SEQ ID NO: 634656 - protein, 9 aa, Homo Sapiens
WPTPPPFPG

SEQ ID NO: 634657 - protein, 9 aa, Homo Sapiens
SFLEGRMVL

SEQ ID NO: 634658 - protein, 9 aa, Homo Sapiens
NYDMTSLNV

SEQ ID NO: 634659 - protein, 9 aa, Homo Sapiens
SCADLPSEP

SEQ ID NO: 634660 - protein, 9 aa, Homo Sapiens
DSVATGLPG

SEQ ID NO: 634661 - protein, 9 aa, Homo Sapiens
VSCIYGYVM

SEQ ID NO: 634662 - protein, 9 aa, Homo Sapiens
HGIEDLIIQ

SEQ ID NO: 634663 - protein, 9 aa, Homo Sapiens
YLSVTLRTA

SEQ ID NO: 634664 - protein, 9 aa, Homo Sapiens
KTHREQQLR

SEQ ID NO: 634665 - protein, 9 aa, Homo Sapiens
GAWGAVSNS

SEQ ID NO: 634666 - protein, 9 aa, Homo Sapiens
VSNLNKKET

SEQ ID NO: 634667 - protein, 9 aa, Homo Sapiens
CEKTLFCFC

SEQ ID NO: 634668 - protein, 9 aa, Homo Sapiens
HREVTMKKG

SEQ ID NO: 634669 - protein, 9 aa, Homo Sapiens
SQLYVGREK

SEQ ID NO: 634670 - protein, 9 aa, Homo Sapiens
GDSHVDACT

SEQ ID NO: 634671 - protein, 9 aa, Homo Sapiens
PSKSTLSAD

SEQ ID NO: 634672 - protein, 9 aa, Homo Sapiens
TSMCRPSLA

SEQ ID NO: 634673 - protein, 9 aa, Homo Sapiens
CDYLAPAAT

SEQ ID NO: 634674 - protein, 9 aa, Homo Sapiens
THREQQLRP

SEQ ID NO: 634675 - protein, 9 aa, Homo Sapiens
LEKTFNCKM

SEQ ID NO: 634676 - protein, 9 aa, Homo Sapiens
IPSVRTLLR

SEQ ID NO: 634677 - protein, 9 aa, Homo Sapiens
ITDIQLHTP

SEQ ID NO: 634678 - protein, 9 aa, Homo Sapiens
VDSMDGLET

SEQ ID NO: 634679 - protein, 9 aa, Homo Sapiens
ASLRVRDIL

SEQ ID NO: 634680 - protein, 9 aa, Homo Sapiens
HDKVLHCQF

SEQ ID NO: 634681 - protein, 9 aa, Homo Sapiens
QSLDEEQAR

SEQ ID NO: 634682 - protein, 9 aa, Homo Sapiens
VLKFIEKGN

SEQ ID NO: 634683 - protein, 9 aa, Homo Sapiens
RWKQNVTDI

SEQ ID NO: 634684 - protein, 9 aa, Homo Sapiens
AYQMVWTPN

SEQ ID NO: 634685 - protein, 9 aa, Homo Sapiens
SISDARYLY

SEQ ID NO: 634686 - protein, 9 aa, Homo Sapiens
PLPRLRAEL

SEQ ID NO: 634687 - protein, 9 aa, Homo Sapiens
VERKEEDDA

SEQ ID NO: 634688 - protein, 9 aa, Homo Sapiens
LGHIEEHDK

SEQ ID NO: 634689 - protein, 9 aa, Homo Sapiens
CPAPWGPRL

SEQ ID NO: 634690 - protein, 9 aa, Homo Sapiens
MGLLYPSVE

SEQ ID NO: 634691 - protein, 9 aa, Homo Sapiens
VLVDRQPCD

SEQ ID NO: 634692 - protein, 9 aa, Homo Sapiens
AGLGQLKAS

SEQ ID NO: 634693 - protein, 9 aa, Homo Sapiens
RQRGAQGET

SEQ ID NO: 634694 - protein, 9 aa, Homo Sapiens
PCTRGQGWS

SEQ ID NO: 634695 - protein, 9 aa, Homo Sapiens
RGKYYNLKP

SEQ ID NO: 634696 - protein, 9 aa, Homo Sapiens
YPDYKSNAV

SEQ ID NO: 634697 - protein, 9 aa, Homo Sapiens
AVWRPQCGT

SEQ ID NO: 634698 - protein, 9 aa, Homo Sapiens
EVIARNLNV

SEQ ID NO: 634699 - protein, 9 aa, Homo Sapiens
IVPLVFATY

SEQ ID NO: 634700 - protein, 9 aa, Homo Sapiens
IRHRRQGKH

SEQ ID NO: 634701 - protein, 9 aa, Homo Sapiens
VHTTGIIEY

SEQ ID NO: 634702 - protein, 9 aa, Homo Sapiens
RTARLLRQN

SEQ ID NO: 634703 - protein, 9 aa, Homo Sapiens
CLCSGPELS

SEQ ID NO: 634704 - protein, 9 aa, Homo Sapiens
LTLSISGIF

SEQ ID NO: 634705 - protein, 9 aa, Homo Sapiens
KENSSVEAR

SEQ ID NO: 634706 - protein, 9 aa, Homo Sapiens
YFEFPIGCE

SEQ ID NO: 634707 - protein, 9 aa, Homo Sapiens
LKASLQAQR

SEQ ID NO: 634708 - protein, 9 aa, Homo Sapiens
LPSLKHPSN

SEQ ID NO: 634709 - protein, 9 aa, Homo Sapiens
QLQSSPENL

SEQ ID NO: 634710 - protein, 9 aa, Homo Sapiens
WQPGTGLGS

SEQ ID NO: 634711 - protein, 9 aa, Homo Sapiens
EYAYHIPSR

SEQ ID NO: 634712 - protein, 9 aa, Homo Sapiens
TTPAPPTTS

SEQ ID NO: 634713 - protein, 9 aa, Homo Sapiens
PQSQSQNMF

SEQ ID NO: 634714 - protein, 9 aa, Homo Sapiens
SSIICQEHS

SEQ ID NO: 634715 - protein, 9 aa, Homo Sapiens
SRENRSFSG

SEQ ID NO: 634716 - protein, 9 aa, Homo Sapiens
VRSQLYVGR

SEQ ID NO: 634717 - protein, 9 aa, Homo Sapiens
NYFGDDGSL

SEQ ID NO: 634718 - protein, 9 aa, Homo Sapiens
ERVAKGPKG

SEQ ID NO: 634719 - protein, 9 aa, Homo Sapiens
KKARISLLT

SEQ ID NO: 634720 - protein, 9 aa, Homo Sapiens
SFGKRRKEW

SEQ ID NO: 634721 - protein, 9 aa, Homo Sapiens
VAAFFTFFS

SEQ ID NO: 634722 - protein, 9 aa, Homo Sapiens
AHEEQGRSL

SEQ ID NO: 634723 - protein, 9 aa, Homo Sapiens
TPGVVLVPT

SEQ ID NO: 634724 - protein, 9 aa, Homo Sapiens
FEKVRQRIV

SEQ ID NO: 634725 - protein, 9 aa, Homo Sapiens
LDFGADVNK

SEQ ID NO: 634726 - protein, 9 aa, Homo Sapiens
SQGQNTHVH

SEQ ID NO: 634727 - protein, 9 aa, Homo Sapiens
MSGYCFYLE

SEQ ID NO: 634728 - protein, 9 aa, Homo Sapiens
KNEVGDVED

SEQ ID NO: 634729 - protein, 9 aa, Homo Sapiens
PLVLEGTNE

SEQ ID NO: 634730 - protein, 9 aa, Homo Sapiens
ILYPAKMAL

SEQ ID NO: 634731 - protein, 9 aa, Homo Sapiens
LPQKTWYSA

SEQ ID NO: 634732 - protein, 9 aa, Homo Sapiens
MIYCDNIVL

SEQ ID NO: 634733 - protein, 9 aa, Homo Sapiens
YIRSRYNLC

SEQ ID NO: 634734 - protein, 9 aa, Homo Sapiens
SSTDLLYAL

SEQ ID NO: 634735 - protein, 9 aa, Homo Sapiens
REVGAHITQ

SEQ ID NO: 634736 - protein, 9 aa, Homo Sapiens
RKGLLVTAS

SEQ ID NO: 634737 - protein, 9 aa, Homo Sapiens
FQNMNSKWK

SEQ ID NO: 634738 - protein, 9 aa, Homo Sapiens
VGGGTCLPC

SEQ ID NO: 634739 - protein, 9 aa, Homo Sapiens
ECCSVAFSP

SEQ ID NO: 634740 - protein, 9 aa, Homo Sapiens
RTPEIQQFP

SEQ ID NO: 634741 - protein, 9 aa, Homo Sapiens
KTRGQKVTL

SEQ ID NO: 634742 - protein, 9 aa, Homo Sapiens
GYERGTKVT

SEQ ID NO: 634743 - protein, 9 aa, Homo Sapiens
IEDLIIQHN

SEQ ID NO: 634744 - protein, 9 aa, Homo Sapiens
GKGVQAGCP

SEQ ID NO: 634745 - protein, 9 aa, Homo Sapiens
VTLLCLSWG

SEQ ID NO: 634746 - protein, 9 aa, Homo Sapiens
GFPVRPGLD

SEQ ID NO: 634747 - protein, 9 aa, Homo Sapiens
GSSSAFLKA

SEQ ID NO: 634748 - protein, 9 aa, Homo Sapiens
FTKYEFTVQ

SEQ ID NO: 634749 - protein, 9 aa, Homo Sapiens
SAAKNCSII

SEQ ID NO: 634750 - protein, 9 aa, Homo Sapiens
FNQPLRQLT

SEQ ID NO: 634751 - protein, 9 aa, Homo Sapiens
IYLSPRSPG

SEQ ID NO: 634752 - protein, 9 aa, Homo Sapiens
PLDICVKYF

SEQ ID NO: 634753 - protein, 9 aa, Homo Sapiens
SHDLAGFWD

SEQ ID NO: 634754 - protein, 9 aa, Homo Sapiens
ELLSEKLSK

SEQ ID NO: 634755 - protein, 9 aa, Homo Sapiens
FEEMISTLL

SEQ ID NO: 634756 - protein, 9 aa, Homo Sapiens
LAHCLRGSI

SEQ ID NO: 634757 - protein, 9 aa, Homo Sapiens
PGSTAISPG

SEQ ID NO: 634758 - protein, 9 aa, Homo Sapiens
HKDEPGHPV

SEQ ID NO: 634759 - protein, 9 aa, Homo Sapiens
RKEEDDALD

SEQ ID NO: 634760 - protein, 9 aa, Homo Sapiens
KLLFFSIFL

SEQ ID NO: 634761 - protein, 9 aa, Homo Sapiens
DTDGKGTIN

SEQ ID NO: 634762 - protein, 9 aa, Homo Sapiens
VCVLVLDAN

SEQ ID NO: 634763 - protein, 9 aa, Homo Sapiens
NFTQRALVA

SEQ ID NO: 634764 - protein, 9 aa, Homo Sapiens
EDEDDGVGV

SEQ ID NO: 634765 - protein, 9 aa, Homo Sapiens
AISSQNVTV

SEQ ID NO: 634766 - protein, 9 aa, Homo Sapiens
MVPRKEDHT

SEQ ID NO: 634767 - protein, 9 aa, Homo Sapiens
KKWRPRKGP

SEQ ID NO: 634768 - protein, 9 aa, Homo Sapiens
VLMSPRDCD

SEQ ID NO: 634769 - protein, 9 aa, Homo Sapiens
QDFPPYCWV

SEQ ID NO: 634770 - protein, 9 aa, Homo Sapiens
AACRIPSVR

SEQ ID NO: 634771 - protein, 9 aa, Homo Sapiens
VEDICVYGQ

SEQ ID NO: 634772 - protein, 9 aa, Homo Sapiens
LGFERLLTS

SEQ ID NO: 634773 - protein, 9 aa, Homo Sapiens
GPFCGKTLH

SEQ ID NO: 634774 - protein, 9 aa, Homo Sapiens
LSCEYEAIK

SEQ ID NO: 634775 - protein, 9 aa, Homo Sapiens
QLRGQPGHA

SEQ ID NO: 634776 - protein, 9 aa, Homo Sapiens
EDSPAVGTR

SEQ ID NO: 634777 - protein, 9 aa, Homo Sapiens
SLSSACIQR

SEQ ID NO: 634778 - protein, 9 aa, Homo Sapiens
GNLNYSAIQ

SEQ ID NO: 634779 - protein, 9 aa, Homo Sapiens
LSSQSFSRR

SEQ ID NO: 634780 - protein, 9 aa, Homo Sapiens
EQQCTDNFV

SEQ ID NO: 634781 - protein, 9 aa, Homo Sapiens
PWGPRLWEK

SEQ ID NO: 634782 - protein, 9 aa, Homo Sapiens
GKTHREQQL

SEQ ID NO: 634783 - protein, 9 aa, Homo Sapiens
GEGNHPERV

SEQ ID NO: 634784 - protein, 9 aa, Homo Sapiens
SVTRSIHEE

SEQ ID NO: 634785 - protein, 9 aa, Homo Sapiens
DRASELRFY

SEQ ID NO: 634786 - protein, 9 aa, Homo Sapiens
AISQSLSNA

SEQ ID NO: 634787 - protein, 9 aa, Homo Sapiens
SQKHSTVQN

SEQ ID NO: 634788 - protein, 9 aa, Homo Sapiens
LVVSAVSLG

SEQ ID NO: 634789 - protein, 9 aa, Homo Sapiens
KTRCREFVP

SEQ ID NO: 634790 - protein, 9 aa, Homo Sapiens
CANPPCAVV

SEQ ID NO: 634791 - protein, 9 aa, Homo Sapiens
VTPTPSKYT

SEQ ID NO: 634792 - protein, 9 aa, Homo Sapiens
ACSISDARY

SEQ ID NO: 634793 - protein, 9 aa, Homo Sapiens
HSRGQHAMQ

SEQ ID NO: 634794 - protein, 9 aa, Homo Sapiens
PPGAISPYR

SEQ ID NO: 634795 - protein, 9 aa, Homo Sapiens
FDWLVNLQE

SEQ ID NO: 634796 - protein, 9 aa, Homo Sapiens
KSTLSADDL

SEQ ID NO: 634797 - protein, 9 aa, Homo Sapiens
SVTAHAEGY

SEQ ID NO: 634798 - protein, 9 aa, Homo Sapiens
SPPLRAPQY

SEQ ID NO: 634799 - protein, 9 aa, Homo Sapiens
GLNRKTSRL

SEQ ID NO: 634800 - protein, 9 aa, Homo Sapiens
VDGLFIIVW

SEQ ID NO: 634801 - protein, 9 aa, Homo Sapiens
LSTRRVVEE

SEQ ID NO: 634802 - protein, 9 aa, Homo Sapiens
KVSAGHGAG

SEQ ID NO: 634803 - protein, 9 aa, Homo Sapiens
RDQQEWERQ

SEQ ID NO: 634804 - protein, 9 aa, Homo Sapiens
LWALGVLMF

SEQ ID NO: 634805 - protein, 9 aa, Homo Sapiens
SWMTAVPQH

SEQ ID NO: 634806 - protein, 9 aa, Homo Sapiens
ILLIVGHDD

SEQ ID NO: 634807 - protein, 9 aa, Homo Sapiens
GIRLQAQRR

SEQ ID NO: 634808 - protein, 9 aa, Homo Sapiens
EEHTELEAQ

SEQ ID NO: 634809 - protein, 9 aa, Homo Sapiens
IGTWESPKE

SEQ ID NO: 634810 - protein, 9 aa, Homo Sapiens
EKTLFCFCF

SEQ ID NO: 634811 - protein, 9 aa, Homo Sapiens
EKCQVPASE

SEQ ID NO: 634812 - protein, 9 aa, Homo Sapiens
LTYFLPVAV

SEQ ID NO: 634813 - protein, 9 aa, Homo Sapiens
FPRNLAKSL

SEQ ID NO: 634814 - protein, 9 aa, Homo Sapiens
KNLTSWFTS

SEQ ID NO: 634815 - protein, 9 aa, Homo Sapiens
LPCHAFCRG

SEQ ID NO: 634816 - protein, 9 aa, Homo Sapiens
SEQEWRLLG

SEQ ID NO: 634817 - protein, 9 aa, Homo Sapiens
LSSLQAIIY

SEQ ID NO: 634818 - protein, 9 aa, Homo Sapiens
ADLENPLLQ

SEQ ID NO: 634819 - protein, 9 aa, Homo Sapiens
AGEPRPPGG

SEQ ID NO: 634820 - protein, 9 aa, Homo Sapiens
PLPDCPIVL

SEQ ID NO: 634821 - protein, 9 aa, Homo Sapiens
CTVQYAVLH

SEQ ID NO: 634822 - protein, 9 aa, Homo Sapiens
AQRPKRSSS

SEQ ID NO: 634823 - protein, 9 aa, Homo Sapiens
LNSTNSFAI

SEQ ID NO: 634824 - protein, 9 aa, Homo Sapiens
EHIMSLTKM

SEQ ID NO: 634825 - protein, 9 aa, Homo Sapiens
PLNSTNSFA

SEQ ID NO: 634826 - protein, 9 aa, Homo Sapiens
LTEGLLPLE

SEQ ID NO: 634827 - protein, 9 aa, Homo Sapiens
YPRLENVAI

SEQ ID NO: 634828 - protein, 9 aa, Homo Sapiens
RPTGVPIYI

SEQ ID NO: 634829 - protein, 9 aa, Homo Sapiens
NVYNVDNQA

SEQ ID NO: 634830 - protein, 9 aa, Homo Sapiens
QMWSGMLNP

SEQ ID NO: 634831 - protein, 9 aa, Homo Sapiens
PRQISLCFR

SEQ ID NO: 634832 - protein, 9 aa, Homo Sapiens
RRPEGTYAV

SEQ ID NO: 634833 - protein, 9 aa, Homo Sapiens
HRCINCFFP

SEQ ID NO: 634834 - protein, 9 aa, Homo Sapiens
TYFLPVAVA

SEQ ID NO: 634835 - protein, 9 aa, Homo Sapiens
NPELVSFIY

SEQ ID NO: 634836 - protein, 9 aa, Homo Sapiens
NEVGDVEDV

SEQ ID NO: 634837 - protein, 9 aa, Homo Sapiens
LAKIPRRDE

SEQ ID NO: 634838 - protein, 9 aa, Homo Sapiens
TMDRPGEGA

SEQ ID NO: 634839 - protein, 9 aa, Homo Sapiens
GGTIWLLYV

SEQ ID NO: 634840 - protein, 9 aa, Homo Sapiens
SGREVLGDI

SEQ ID NO: 634841 - protein, 9 aa, Homo Sapiens
QRSAPSQSS

SEQ ID NO: 634842 - protein, 9 aa, Homo Sapiens
VEKVSIEKI

SEQ ID NO: 634843 - protein, 9 aa, Homo Sapiens
STGRFSLSA

SEQ ID NO: 634844 - protein, 9 aa, Homo Sapiens
PQGEDRKSP

SEQ ID NO: 634845 - protein, 9 aa, Homo Sapiens
YYFCWEPIP

SEQ ID NO: 634846 - protein, 9 aa, Homo Sapiens
NCFLYQHLP

SEQ ID NO: 634847 - protein, 9 aa, Homo Sapiens
PRKAPHFSP

SEQ ID NO: 634848 - protein, 9 aa, Homo Sapiens
KRARAEKKQ

SEQ ID NO: 634849 - protein, 9 aa, Homo Sapiens
IPLPRLRAE

SEQ ID NO: 634850 - protein, 9 aa, Homo Sapiens
NSSPGHWKH

SEQ ID NO: 634851 - protein, 9 aa, Homo Sapiens
FNLDFEVSC

SEQ ID NO: 634852 - protein, 9 aa, Homo Sapiens
AETGIFLLI

SEQ ID NO: 634853 - protein, 9 aa, Homo Sapiens
VEDCDGSSQ

SEQ ID NO: 634854 - protein, 9 aa, Homo Sapiens
SSVGTRSSG

SEQ ID NO: 634855 - protein, 9 aa, Homo Sapiens
AETGMEYRN

SEQ ID NO: 634856 - protein, 9 aa, Homo Sapiens
GFRSVTTSQ

SEQ ID NO: 634857 - protein, 9 aa, Homo Sapiens
KVHHVNITK

SEQ ID NO: 634858 - protein, 9 aa, Homo Sapiens
PAAQRPKRS

SEQ ID NO: 634859 - protein, 9 aa, Homo Sapiens
PSTPGGLDA

SEQ ID NO: 634860 - protein, 9 aa, Homo Sapiens
DFGCRAAAP

SEQ ID NO: 634861 - protein, 9 aa, Homo Sapiens
PPGTPGIPG

SEQ ID NO: 634862 - protein, 9 aa, Homo Sapiens
DTICGTQLQ

SEQ ID NO: 634863 - protein, 9 aa, Homo Sapiens
EWPVSSFNL

SEQ ID NO: 634864 - protein, 9 aa, Homo Sapiens
ARSEHGRYM

SEQ ID NO: 634865 - protein, 9 aa, Homo Sapiens
ENFLELGTL

SEQ ID NO: 634866 - protein, 9 aa, Homo Sapiens
CAEGSHCSP

SEQ ID NO: 634867 - protein, 9 aa, Homo Sapiens
SQALMRLIC

SEQ ID NO: 634868 - protein, 9 aa, Homo Sapiens
KQMFHLKNS

SEQ ID NO: 634869 - protein, 9 aa, Homo Sapiens
VEERYHAYL

SEQ ID NO: 634870 - protein, 9 aa, Homo Sapiens
FEKKTKVSQ

SEQ ID NO: 634871 - protein, 9 aa, Homo Sapiens
GYAPGLYHY

SEQ ID NO: 634872 - protein, 9 aa, Homo Sapiens
GQCCPTWHS

SEQ ID NO: 634873 - protein, 9 aa, Homo Sapiens
DGPPWAEEA

SEQ ID NO: 634874 - protein, 9 aa, Homo Sapiens
EDINYFGDD

SEQ ID NO: 634875 - protein, 9 aa, Homo Sapiens
SPLGSVMST

SEQ ID NO: 634876 - protein, 9 aa, Homo Sapiens
VKKMTVKDI

SEQ ID NO: 634877 - protein, 9 aa, Homo Sapiens
LLKRFACIA

SEQ ID NO: 634878 - protein, 9 aa, Homo Sapiens
NHPERVKVY

SEQ ID NO: 634879 - protein, 9 aa, Homo Sapiens
TIKWRRTTL

SEQ ID NO: 634880 - protein, 9 aa, Homo Sapiens
RHTAVLYRI

SEQ ID NO: 634881 - protein, 9 aa, Homo Sapiens
DSSAAQRCH

SEQ ID NO: 634882 - protein, 9 aa, Homo Sapiens
ALLDKLWIF

SEQ ID NO: 634883 - protein, 9 aa, Homo Sapiens
PSQGQNTHV

SEQ ID NO: 634884 - protein, 9 aa, Homo Sapiens
PRNLAKSLT

SEQ ID NO: 634885 - protein, 9 aa, Homo Sapiens
LSEQVMDYI

SEQ ID NO: 634886 - protein, 9 aa, Homo Sapiens
PALGNETVC

SEQ ID NO: 634887 - protein, 9 aa, Homo Sapiens
ARAEKKQAQ

SEQ ID NO: 634888 - protein, 9 aa, Homo Sapiens
STTALLHYQ

SEQ ID NO: 634889 - protein, 9 aa, Homo Sapiens
KGYVSSVRY

SEQ ID NO: 634890 - protein, 9 aa, Homo Sapiens
RCINCFFPE

SEQ ID NO: 634891 - protein, 9 aa, Homo Sapiens
RGNVSFVLV

SEQ ID NO: 634892 - protein, 9 aa, Homo Sapiens
IAPLPDHTK

SEQ ID NO: 634893 - protein, 9 aa, Homo Sapiens
GQTGGTIWL

SEQ ID NO: 634894 - protein, 9 aa, Homo Sapiens
RRFFIGNQV

SEQ ID NO: 634895 - protein, 9 aa, Homo Sapiens
GVISSFTSF

SEQ ID NO: 634896 - protein, 9 aa, Homo Sapiens
FHGQPLFPG

SEQ ID NO: 634897 - protein, 9 aa, Homo Sapiens
SIDGRDPGN

SEQ ID NO: 634898 - protein, 9 aa, Homo Sapiens
HDLNRKLQH

SEQ ID NO: 634899 - protein, 9 aa, Homo Sapiens
AVPELYGKT

SEQ ID NO: 634900 - protein, 9 aa, Homo Sapiens
LCKRPLDSP

SEQ ID NO: 634901 - protein, 9 aa, Homo Sapiens
VGFDIITMD

SEQ ID NO: 634902 - protein, 9 aa, Homo Sapiens
PGSSSAFLK

SEQ ID NO: 634903 - protein, 9 aa, Homo Sapiens
YTVYQLKQM

SEQ ID NO: 634904 - protein, 9 aa, Homo Sapiens
IGAATDIEC

SEQ ID NO: 634905 - protein, 9 aa, Homo Sapiens
YACPRLRLL

SEQ ID NO: 634906 - protein, 9 aa, Homo Sapiens
REQQRLHRE

SEQ ID NO: 634907 - protein, 9 aa, Homo Sapiens
SQPSPYPVH

SEQ ID NO: 634908 - protein, 9 aa, Homo Sapiens
CSQSPPLSL

SEQ ID NO: 634909 - protein, 9 aa, Homo Sapiens
FKSVWSGLD

SEQ ID NO: 634910 - protein, 9 aa, Homo Sapiens
YFLPVAVAY

SEQ ID NO: 634911 - protein, 9 aa, Homo Sapiens
KKVKFNTFT

SEQ ID NO: 634912 - protein, 9 aa, Homo Sapiens
GGKEYPSVA

SEQ ID NO: 634913 - protein, 9 aa, Homo Sapiens
SDGCADRYD

SEQ ID NO: 634914 - protein, 9 aa, Homo Sapiens
VHFHSPPPV

SEQ ID NO: 634915 - protein, 9 aa, Homo Sapiens
SEEDEQSWC

SEQ ID NO: 634916 - protein, 9 aa, Homo Sapiens
QRLESNRRT

SEQ ID NO: 634917 - protein, 9 aa, Homo Sapiens
GLSEQVMDY

SEQ ID NO: 634918 - protein, 9 aa, Homo Sapiens
WFCQLAAPP

SEQ ID NO: 634919 - protein, 9 aa, Homo Sapiens
TIHAEGYER

SEQ ID NO: 634920 - protein, 9 aa, Homo Sapiens
APIGPPGSP

SEQ ID NO: 634921 - protein, 9 aa, Homo Sapiens
SVVYLIEFS

SEQ ID NO: 634922 - protein, 9 aa, Homo Sapiens
LLHMPCPAH

SEQ ID NO: 634923 - protein, 9 aa, Homo Sapiens
RCCNFSSRM

SEQ ID NO: 634924 - protein, 9 aa, Homo Sapiens
PLPCINSSA

SEQ ID NO: 634925 - protein, 9 aa, Homo Sapiens
KVGCQLRSN

SEQ ID NO: 634926 - protein, 9 aa, Homo Sapiens
KLIHLVSGK

SEQ ID NO: 634927 - protein, 9 aa, Homo Sapiens
VHLQGKPQT

SEQ ID NO: 634928 - protein, 9 aa, Homo Sapiens
AGKTDFLWK

SEQ ID NO: 634929 - protein, 9 aa, Homo Sapiens
ISQLSFVDL

SEQ ID NO: 634930 - protein, 9 aa, Homo Sapiens
GHGAGGRRP

SEQ ID NO: 634931 - protein, 9 aa, Homo Sapiens
AIRAHKAGL

SEQ ID NO: 634932 - protein, 9 aa, Homo Sapiens
FLEGRMVLL

SEQ ID NO: 634933 - protein, 9 aa, Homo Sapiens
SEPLLGAIE

SEQ ID NO: 634934 - protein, 9 aa, Homo Sapiens
SIASTPQGE

SEQ ID NO: 634935 - protein, 9 aa, Homo Sapiens
CAYPVPRMG

SEQ ID NO: 634936 - protein, 9 aa, Homo Sapiens
ATTNIETTH

SEQ ID NO: 634937 - protein, 9 aa, Homo Sapiens
EPGGGKVSQ

SEQ ID NO: 634938 - protein, 9 aa, Homo Sapiens
PRLGKTTFG

SEQ ID NO: 634939 - protein, 9 aa, Homo Sapiens
GKEYPSVAD

SEQ ID NO: 634940 - protein, 9 aa, Homo Sapiens
PQLPLPCIN

SEQ ID NO: 634941 - protein, 9 aa, Homo Sapiens
ANQRWYVPE

SEQ ID NO: 634942 - protein, 9 aa, Homo Sapiens
SVSRRTLHS

SEQ ID NO: 634943 - protein, 9 aa, Homo Sapiens
FFWLDLSVL

SEQ ID NO: 634944 - protein, 9 aa, Homo Sapiens
IPQAVRVEP

SEQ ID NO: 634945 - protein, 9 aa, Homo Sapiens
CDKSLLKIY

SEQ ID NO: 634946 - protein, 9 aa, Homo Sapiens
RFDCDKSLL

SEQ ID NO: 634947 - protein, 9 aa, Homo Sapiens
QLELSQLIG

SEQ ID NO: 634948 - protein, 9 aa, Homo Sapiens
AQCLPFSNY

SEQ ID NO: 634949 - protein, 9 aa, Homo Sapiens
EDICVYGQG

SEQ ID NO: 634950 - protein, 9 aa, Homo Sapiens
LVGLLPETP

SEQ ID NO: 634951 - protein, 9 aa, Homo Sapiens
SKLFSNFTG

SEQ ID NO: 634952 - protein, 9 aa, Homo Sapiens
KDTIRGHPG

SEQ ID NO: 634953 - protein, 9 aa, Homo Sapiens
GLLNSMTHP

SEQ ID NO: 634954 - protein, 9 aa, Homo Sapiens
IQEAQMKED

SEQ ID NO: 634955 - protein, 9 aa, Homo Sapiens
PWDSEGLDG

SEQ ID NO: 634956 - protein, 9 aa, Homo Sapiens
QALVAWLKA

SEQ ID NO: 634957 - protein, 9 aa, Homo Sapiens
VPSSENLEE

SEQ ID NO: 634958 - protein, 9 aa, Homo Sapiens
RYMAFGNPL

SEQ ID NO: 634959 - protein, 9 aa, Homo Sapiens
DLLLRGAYG

SEQ ID NO: 634960 - protein, 9 aa, Homo Sapiens
MAHFTIHTA

SEQ ID NO: 634961 - protein, 9 aa, Homo Sapiens
CPSHILVVL

SEQ ID NO: 634962 - protein, 9 aa, Homo Sapiens
IFIMCNSVM

SEQ ID NO: 634963 - protein, 9 aa, Homo Sapiens
YVVLVILAA

SEQ ID NO: 634964 - protein, 9 aa, Homo Sapiens
QAALDDEET

SEQ ID NO: 634965 - protein, 9 aa, Homo Sapiens
GGSHGARGL

SEQ ID NO: 634966 - protein, 9 aa, Homo Sapiens
GEIVGSHGS

SEQ ID NO: 634967 - protein, 9 aa, Homo Sapiens
PSLCLLVRT

SEQ ID NO: 634968 - protein, 9 aa, Homo Sapiens
DEGRLRKHG

SEQ ID NO: 634969 - protein, 9 aa, Homo Sapiens
IHNLKRIMK

SEQ ID NO: 634970 - protein, 9 aa, Homo Sapiens
DYDPYEHPE

SEQ ID NO: 634971 - protein, 9 aa, Homo Sapiens
VTSAATTNI

SEQ ID NO: 634972 - protein, 9 aa, Homo Sapiens
LKADNRGGE

SEQ ID NO: 634973 - protein, 9 aa, Homo Sapiens
KQQHQLAVE

SEQ ID NO: 634974 - protein, 9 aa, Homo Sapiens
AAWFMMKYP

SEQ ID NO: 634975 - protein, 9 aa, Homo Sapiens
AKSAEAWEA

SEQ ID NO: 634976 - protein, 9 aa, Homo Sapiens
KRKKVKFNT

SEQ ID NO: 634977 - protein, 9 aa, Homo Sapiens
TPAPPTTSS

SEQ ID NO: 634978 - protein, 9 aa, Homo Sapiens
VPQAGGQHS

SEQ ID NO: 634979 - protein, 9 aa, Homo Sapiens
RAELPPEDQ

SEQ ID NO: 634980 - protein, 9 aa, Homo Sapiens
TSPVSEFLL

SEQ ID NO: 634981 - protein, 9 aa, Homo Sapiens
TMKDQQKPE

SEQ ID NO: 634982 - protein, 9 aa, Homo Sapiens
HVLGPQCLS

SEQ ID NO: 634983 - protein, 9 aa, Homo Sapiens
EIGLIPLHK

SEQ ID NO: 634984 - protein, 9 aa, Homo Sapiens
RHLHEMANS

SEQ ID NO: 634985 - protein, 9 aa, Homo Sapiens
FRPPPITPD

SEQ ID NO: 634986 - protein, 9 aa, Homo Sapiens
RHRPTKKHK

SEQ ID NO: 634987 - protein, 9 aa, Homo Sapiens
TSTSSGTLW

SEQ ID NO: 634988 - protein, 9 aa, Homo Sapiens
VQYNEPLIV

SEQ ID NO: 634989 - protein, 9 aa, Homo Sapiens
GDCSTIIQH

SEQ ID NO: 634990 - protein, 9 aa, Homo Sapiens
LGEDTEICL

SEQ ID NO: 634991 - protein, 9 aa, Homo Sapiens
VKDIVTAFF

SEQ ID NO: 634992 - protein, 9 aa, Homo Sapiens
LIIHPSEGA

SEQ ID NO: 634993 - protein, 9 aa, Homo Sapiens
QAFALDGIG

SEQ ID NO: 634994 - protein, 9 aa, Homo Sapiens
STRMSDARK

SEQ ID NO: 634995 - protein, 9 aa, Homo Sapiens
GKLHTADRP

SEQ ID NO: 634996 - protein, 9 aa, Homo Sapiens
TLSADDLEI

SEQ ID NO: 634997 - protein, 9 aa, Homo Sapiens
FHCDDLPSP

SEQ ID NO: 634998 - protein, 9 aa, Homo Sapiens
YLAHLWVVD

SEQ ID NO: 634999 - protein, 9 aa, Homo Sapiens
VATWDALLE

SEQ ID NO: 635000 - protein, 9 aa, Homo Sapiens
HGQPLFPGV

SEQ ID NO: 635001 - protein, 9 aa, Homo Sapiens
LPSEPRLGK

SEQ ID NO: 635002 - protein, 9 aa, Homo Sapiens
HGHTLAAAT

SEQ ID NO: 635003 - protein, 9 aa, Homo Sapiens
FPVRPGLDG

SEQ ID NO: 635004 - protein, 9 aa, Homo Sapiens
IWLLYVFGQ

SEQ ID NO: 635005 - protein, 9 aa, Homo Sapiens
QCRLLVIDI

SEQ ID NO: 635006 - protein, 9 aa, Homo Sapiens
ELEAQIVKD

SEQ ID NO: 635007 - protein, 9 aa, Homo Sapiens
PVASEILVA

SEQ ID NO: 635008 - protein, 9 aa, Homo Sapiens
PLSVYPVAG

SEQ ID NO: 635009 - protein, 9 aa, Homo Sapiens
QAREEGPSR

SEQ ID NO: 635010 - protein, 9 aa, Homo Sapiens
GEFPIFSPG

SEQ ID NO: 635011 - protein, 9 aa, Homo Sapiens
VDFIIEVHD

SEQ ID NO: 635012 - protein, 9 aa, Homo Sapiens
VAPGFRMAL

SEQ ID NO: 635013 - protein, 9 aa, Homo Sapiens
HGLPGSKGE

SEQ ID NO: 635014 - protein, 9 aa, Homo Sapiens
WKAETWKKN

SEQ ID NO: 635015 - protein, 9 aa, Homo Sapiens
EAAVRAAAA

SEQ ID NO: 635016 - protein, 9 aa, Homo Sapiens
WVVRNLADM

SEQ ID NO: 635017 - protein, 9 aa, Homo Sapiens
GNFLSRFEK

SEQ ID NO: 635018 - protein, 9 aa, Homo Sapiens
NFLELGTLE

SEQ ID NO: 635019 - protein, 9 aa, Homo Sapiens
GDVWLGLVK

SEQ ID NO: 635020 - protein, 9 aa, Homo Sapiens
WGPRLWEKL

SEQ ID NO: 635021 - protein, 9 aa, Homo Sapiens
TQTPQSQSQ

SEQ ID NO: 635022 - protein, 9 aa, Homo Sapiens
SSKSGPRKD

SEQ ID NO: 635023 - protein, 9 aa, Homo Sapiens
LLVSGGGYA

SEQ ID NO: 635024 - protein, 9 aa, Homo Sapiens
NMYTVYQLK

SEQ ID NO: 635025 - protein, 9 aa, Homo Sapiens
PPLAPKPAV

SEQ ID NO: 635026 - protein, 9 aa, Homo Sapiens
PRSLAWDIS

SEQ ID NO: 635027 - protein, 9 aa, Homo Sapiens
KDEDYGCVH

SEQ ID NO: 635028 - protein, 9 aa, Homo Sapiens
QLEKTFNCK

SEQ ID NO: 635029 - protein, 9 aa, Homo Sapiens
DGTPYDHIT

SEQ ID NO: 635030 - protein, 9 aa, Homo Sapiens
VCRGGSLCS

SEQ ID NO: 635031 - protein, 9 aa, Homo Sapiens
IPSRLDGSP

SEQ ID NO: 635032 - protein, 9 aa, Homo Sapiens
HDILQEPTC

SEQ ID NO: 635033 - protein, 9 aa, Homo Sapiens
CKIQALLDK

SEQ ID NO: 635034 - protein, 9 aa, Homo Sapiens
PTALNSAPS

SEQ ID NO: 635035 - protein, 9 aa, Homo Sapiens
NIIHAFPSS

SEQ ID NO: 635036 - protein, 9 aa, Homo Sapiens
SSGDSQPSP

SEQ ID NO: 635037 - protein, 9 aa, Homo Sapiens
IPGETEELD

SEQ ID NO: 635038 - protein, 9 aa, Homo Sapiens
EIPLAMERF

SEQ ID NO: 635039 - protein, 9 aa, Homo Sapiens
EACYQQPQE

SEQ ID NO: 635040 - protein, 9 aa, Homo Sapiens
HHRIETKSN

SEQ ID NO: 635041 - protein, 9 aa, Homo Sapiens
EFPIFSPGR

SEQ ID NO: 635042 - protein, 9 aa, Homo Sapiens
DCHLKWLSY

SEQ ID NO: 635043 - protein, 9 aa, Homo Sapiens
YRYPPGVVV

SEQ ID NO: 635044 - protein, 9 aa, Homo Sapiens
VNTIAYRPL

SEQ ID NO: 635045 - protein, 9 aa, Homo Sapiens
PCPPTKCPE

SEQ ID NO: 635046 - protein, 9 aa, Homo Sapiens
LLRGPPGGD

SEQ ID NO: 635047 - protein, 9 aa, Homo Sapiens
GQLSSQSFS

SEQ ID NO: 635048 - protein, 9 aa, Homo Sapiens
ADIRQNRSK

SEQ ID NO: 635049 - protein, 9 aa, Homo Sapiens
SHSPTALNS

SEQ ID NO: 635050 - protein, 9 aa, Homo Sapiens
ARKYTVVAG

SEQ ID NO: 635051 - protein, 9 aa, Homo Sapiens
EHFSSLIKK

SEQ ID NO: 635052 - protein, 9 aa, Homo Sapiens
VTQPLRATA

SEQ ID NO: 635053 - protein, 9 aa, Homo Sapiens
GTLMLHFFH

SEQ ID NO: 635054 - protein, 9 aa, Homo Sapiens
KVHLGSGIC

SEQ ID NO: 635055 - protein, 9 aa, Homo Sapiens
IHMTAGAYL

SEQ ID NO: 635056 - protein, 9 aa, Homo Sapiens
GLFIIVWMY

SEQ ID NO: 635057 - protein, 9 aa, Homo Sapiens
KVTDHSTTA

SEQ ID NO: 635058 - protein, 9 aa, Homo Sapiens
DRLSYFHFV

SEQ ID NO: 635059 - protein, 9 aa, Homo Sapiens
KLLALWLVA

SEQ ID NO: 635060 - protein, 9 aa, Homo Sapiens
DVEERYHAY

SEQ ID NO: 635061 - protein, 9 aa, Homo Sapiens
DVDSMDGLE

SEQ ID NO: 635062 - protein, 9 aa, Homo Sapiens
KGTINAQEL

SEQ ID NO: 635063 - protein, 9 aa, Homo Sapiens
YFSGLLEVI

SEQ ID NO: 635064 - protein, 9 aa, Homo Sapiens
VSNITSSIM

SEQ ID NO: 635065 - protein, 9 aa, Homo Sapiens
ESRASTITS

SEQ ID NO: 635066 - protein, 9 aa, Homo Sapiens
RRVRMSAVA

SEQ ID NO: 635067 - protein, 9 aa, Homo Sapiens
LIPLHKAAV

SEQ ID NO: 635068 - protein, 9 aa, Homo Sapiens
GHPGARQLV

SEQ ID NO: 635069 - protein, 9 aa, Homo Sapiens
SDDSSADPC

SEQ ID NO: 635070 - protein, 9 aa, Homo Sapiens
GSGGPPREV

SEQ ID NO: 635071 - protein, 9 aa, Homo Sapiens
RFNDSEVLQ

SEQ ID NO: 635072 - protein, 9 aa, Homo Sapiens
ATKCHGSTG

SEQ ID NO: 635073 - protein, 9 aa, Homo Sapiens
EEQARKHAL

SEQ ID NO: 635074 - protein, 9 aa, Homo Sapiens
KGLSEQVMD

SEQ ID NO: 635075 - protein, 9 aa, Homo Sapiens
SQSLSNALH

SEQ ID NO: 635076 - protein, 9 aa, Homo Sapiens
QRSCLAEVS

SEQ ID NO: 635077 - protein, 9 aa, Homo Sapiens
SRAARPTMY

SEQ ID NO: 635078 - protein, 9 aa, Homo Sapiens
EDSSVNLLG

SEQ ID NO: 635079 - protein, 9 aa, Homo Sapiens
HTIYTHNTN

SEQ ID NO: 635080 - protein, 9 aa, Homo Sapiens
LITMNVPYC

SEQ ID NO: 635081 - protein, 9 aa, Homo Sapiens
PGFRMALKL

SEQ ID NO: 635082 - protein, 9 aa, Homo Sapiens
HADRDNREH

SEQ ID NO: 635083 - protein, 9 aa, Homo Sapiens
LMYLECLLR

SEQ ID NO: 635084 - protein, 9 aa, Homo Sapiens
FFTFFSHRF

SEQ ID NO: 635085 - protein, 9 aa, Homo Sapiens
PSVADFPHP

SEQ ID NO: 635086 - protein, 9 aa, Homo Sapiens
HLTGECMDL

SEQ ID NO: 635087 - protein, 9 aa, Homo Sapiens
GMKDKHSSD

SEQ ID NO: 635088 - protein, 9 aa, Homo Sapiens
AFYRKDWSC

SEQ ID NO: 635089 - protein, 9 aa, Homo Sapiens
SLFQATEEI

SEQ ID NO: 635090 - protein, 9 aa, Homo Sapiens
VPDSTPSRA

SEQ ID NO: 635091 - protein, 9 aa, Homo Sapiens
GFQSSRMEK

SEQ ID NO: 635092 - protein, 9 aa, Homo Sapiens
RMPHQGAPI

SEQ ID NO: 635093 - protein, 9 aa, Homo Sapiens
LSIADILLL

SEQ ID NO: 635094 - protein, 9 aa, Homo Sapiens
EWLKLGAIF

SEQ ID NO: 635095 - protein, 9 aa, Homo Sapiens
SPVCEESYL

SEQ ID NO: 635096 - protein, 9 aa, Homo Sapiens
ELRFYVNGR

SEQ ID NO: 635097 - protein, 9 aa, Homo Sapiens
CVFLECEHV

SEQ ID NO: 635098 - protein, 9 aa, Homo Sapiens
QARSHREVT

SEQ ID NO: 635099 - protein, 9 aa, Homo Sapiens
TQAEDCIQA

SEQ ID NO: 635100 - protein, 9 aa, Homo Sapiens
RTDDGRSMA

SEQ ID NO: 635101 - protein, 9 aa, Homo Sapiens
TNEQSSPPL

SEQ ID NO: 635102 - protein, 9 aa, Homo Sapiens
SARHWKTIL

SEQ ID NO: 635103 - protein, 9 aa, Homo Sapiens
QNQKIPQLQ

SEQ ID NO: 635104 - protein, 9 aa, Homo Sapiens
IEKDIQDFE

SEQ ID NO: 635105 - protein, 9 aa, Homo Sapiens
IIITSYTAN

SEQ ID NO: 635106 - protein, 9 aa, Homo Sapiens
TLQLFMDDI

SEQ ID NO: 635107 - protein, 9 aa, Homo Sapiens
KKDFSIKGA

SEQ ID NO: 635108 - protein, 9 aa, Homo Sapiens
HTHTPNHRC

SEQ ID NO: 635109 - protein, 9 aa, Homo Sapiens
SIICQEHSQ

SEQ ID NO: 635110 - protein, 9 aa, Homo Sapiens
QTPQSQSQN

SEQ ID NO: 635111 - protein, 9 aa, Homo Sapiens
VYKLPFGSI

SEQ ID NO: 635112 - protein, 9 aa, Homo Sapiens
LVLLKARLV

SEQ ID NO: 635113 - protein, 9 aa, Homo Sapiens
GFERLLTSG

SEQ ID NO: 635114 - protein, 9 aa, Homo Sapiens
FSPGRVYEY

SEQ ID NO: 635115 - protein, 9 aa, Homo Sapiens
ALDFRGKTK

SEQ ID NO: 635116 - protein, 9 aa, Homo Sapiens
HPSNKGYSL

SEQ ID NO: 635117 - protein, 9 aa, Homo Sapiens
SVNLLGRNS

SEQ ID NO: 635118 - protein, 9 aa, Homo Sapiens
NIVLTTAWG

SEQ ID NO: 635119 - protein, 9 aa, Homo Sapiens
LVFLVLMVT

SEQ ID NO: 635120 - protein, 9 aa, Homo Sapiens
DANQRWYVP

SEQ ID NO: 635121 - protein, 9 aa, Homo Sapiens
LQLSNSPGS

SEQ ID NO: 635122 - protein, 9 aa, Homo Sapiens
GGHWMPKDC

SEQ ID NO: 635123 - protein, 9 aa, Homo Sapiens
YKIVCSLDL

SEQ ID NO: 635124 - protein, 9 aa, Homo Sapiens
PPKNLTSWF

SEQ ID NO: 635125 - protein, 9 aa, Homo Sapiens
PLPDHTKSI

SEQ ID NO: 635126 - protein, 9 aa, Homo Sapiens
MCVYRIGRK

SEQ ID NO: 635127 - protein, 9 aa, Homo Sapiens
DADGSIAKE

SEQ ID NO: 635128 - protein, 9 aa, Homo Sapiens
AWVTNPDSM

SEQ ID NO: 635129 - protein, 9 aa, Homo Sapiens
ILVAKIFGL

SEQ ID NO: 635130 - protein, 9 aa, Homo Sapiens
YEDPENKIE

SEQ ID NO: 635131 - protein, 9 aa, Homo Sapiens
RSLAWDISG

SEQ ID NO: 635132 - protein, 9 aa, Homo Sapiens
FSWDSYLVL

SEQ ID NO: 635133 - protein, 9 aa, Homo Sapiens
PANRRIQIT

SEQ ID NO: 635134 - protein, 9 aa, Homo Sapiens
LAETRFFHV

SEQ ID NO: 635135 - protein, 9 aa, Homo Sapiens
APPAASSIS

SEQ ID NO: 635136 - protein, 9 aa, Homo Sapiens
YTGVALQDQ

SEQ ID NO: 635137 - protein, 9 aa, Homo Sapiens
LVTTPMCCP

SEQ ID NO: 635138 - protein, 9 aa, Homo Sapiens
YIRYCMEKE

SEQ ID NO: 635139 - protein, 9 aa, Homo Sapiens
SCGPGLYCV

SEQ ID NO: 635140 - protein, 9 aa, Homo Sapiens
EEGYYKATK

SEQ ID NO: 635141 - protein, 9 aa, Homo Sapiens
ALLSVRTLQ

SEQ ID NO: 635142 - protein, 9 aa, Homo Sapiens
LAKKRVHPY

SEQ ID NO: 635143 - protein, 9 aa, Homo Sapiens
PYHQAALRR

SEQ ID NO: 635144 - protein, 9 aa, Homo Sapiens
HPMTEAGPV

SEQ ID NO: 635145 - protein, 9 aa, Homo Sapiens
MSGWNPFVE

SEQ ID NO: 635146 - protein, 9 aa, Homo Sapiens
RFDAIAELE

SEQ ID NO: 635147 - protein, 9 aa, Homo Sapiens
PYCWVSINH

SEQ ID NO: 635148 - protein, 9 aa, Homo Sapiens
RIMKVLQGK

SEQ ID NO: 635149 - protein, 9 aa, Homo Sapiens
QASRLRHKK

SEQ ID NO: 635150 - protein, 9 aa, Homo Sapiens
PGSAWAGPC

SEQ ID NO: 635151 - protein, 9 aa, Homo Sapiens
VTSIAGIRQ

SEQ ID NO: 635152 - protein, 9 aa, Homo Sapiens
ARLLRQNCV

SEQ ID NO: 635153 - protein, 9 aa, Homo Sapiens
RDMSENVLY

SEQ ID NO: 635154 - protein, 9 aa, Homo Sapiens
DDEETGGRP

SEQ ID NO: 635155 - protein, 9 aa, Homo Sapiens
FTQFSLYLV

SEQ ID NO: 635156 - protein, 9 aa, Homo Sapiens
TADVYCKLI

SEQ ID NO: 635157 - protein, 9 aa, Homo Sapiens
QGRTWSPVT

SEQ ID NO: 635158 - protein, 9 aa, Homo Sapiens
RDEGEEAEE

SEQ ID NO: 635159 - protein, 9 aa, Homo Sapiens
TRAGIALDE

SEQ ID NO: 635160 - protein, 9 aa, Homo Sapiens
PEWMKVHHV

SEQ ID NO: 635161 - protein, 9 aa, Homo Sapiens
CNSSESTSN

SEQ ID NO: 635162 - protein, 9 aa, Homo Sapiens
VKYFSGLLE

SEQ ID NO: 635163 - protein, 9 aa, Homo Sapiens
IKSADKMPH

SEQ ID NO: 635164 - protein, 9 aa, Homo Sapiens
RAHKAGLAV

SEQ ID NO: 635165 - protein, 9 aa, Homo Sapiens
PCHSKVPQH

SEQ ID NO: 635166 - protein, 9 aa, Homo Sapiens
PNIPSAADW

SEQ ID NO: 635167 - protein, 9 aa, Homo Sapiens
VKFNTFTTI

SEQ ID NO: 635168 - protein, 9 aa, Homo Sapiens
DIRQNRSKE

SEQ ID NO: 635169 - protein, 9 aa, Homo Sapiens
QYNEPLIVF

SEQ ID NO: 635170 - protein, 9 aa, Homo Sapiens
DIFLVIKLD

SEQ ID NO: 635171 - protein, 9 aa, Homo Sapiens
WKANTTTNK

SEQ ID NO: 635172 - protein, 9 aa, Homo Sapiens
IEPGGHWMP

SEQ ID NO: 635173 - protein, 9 aa, Homo Sapiens
CHPLAPRGA

SEQ ID NO: 635174 - protein, 9 aa, Homo Sapiens
SPAPGSPSQ

SEQ ID NO: 635175 - protein, 9 aa, Homo Sapiens
RHRKRSKGV

SEQ ID NO: 635176 - protein, 9 aa, Homo Sapiens
RNNLAHFHT

SEQ ID NO: 635177 - protein, 9 aa, Homo Sapiens
SHYVAKTGI

SEQ ID NO: 635178 - protein, 9 aa, Homo Sapiens
LSSACIQRV

SEQ ID NO: 635179 - protein, 9 aa, Homo Sapiens
VLAVPEAVG

SEQ ID NO: 635180 - protein, 9 aa, Homo Sapiens
DLRKHCLDG

SEQ ID NO: 635181 - protein, 9 aa, Homo Sapiens
SGSTDCLVM

SEQ ID NO: 635182 - protein, 9 aa, Homo Sapiens
LTLLLCLDC

SEQ ID NO: 635183 - protein, 9 aa, Homo Sapiens
EILGCLYES

SEQ ID NO: 635184 - protein, 9 aa, Homo Sapiens
YVGQYVHSS

SEQ ID NO: 635185 - protein, 9 aa, Homo Sapiens
IVGGGYNGM

SEQ ID NO: 635186 - protein, 9 aa, Homo Sapiens
DQQEWERQK

SEQ ID NO: 635187 - protein, 9 aa, Homo Sapiens
SRLDGSPRS

SEQ ID NO: 635188 - protein, 9 aa, Homo Sapiens
FCWEPIPYR

SEQ ID NO: 635189 - protein, 9 aa, Homo Sapiens
FTTSSLELM

SEQ ID NO: 635190 - protein, 9 aa, Homo Sapiens
AFLYSSPIN

SEQ ID NO: 635191 - protein, 9 aa, Homo Sapiens
QKSIKIACA

SEQ ID NO: 635192 - protein, 9 aa, Homo Sapiens
WEMSNQYVI

SEQ ID NO: 635193 - protein, 9 aa, Homo Sapiens
TEADLRLTV

SEQ ID NO: 635194 - protein, 9 aa, Homo Sapiens
ASVAELLGA

SEQ ID NO: 635195 - protein, 9 aa, Homo Sapiens
EKDPLASLR

SEQ ID NO: 635196 - protein, 9 aa, Homo Sapiens
RVLVEMAHH

SEQ ID NO: 635197 - protein, 9 aa, Homo Sapiens
LVVEGVPNV

SEQ ID NO: 635198 - protein, 9 aa, Homo Sapiens
IVLDRLKYL

SEQ ID NO: 635199 - protein, 9 aa, Homo Sapiens
IPMKTQQPN

SEQ ID NO: 635200 - protein, 9 aa, Homo Sapiens
ISSRMLFAG

SEQ ID NO: 635201 - protein, 9 aa, Homo Sapiens
DSTKRNNRS

SEQ ID NO: 635202 - protein, 9 aa, Homo Sapiens
ETRFFHVVQ

SEQ ID NO: 635203 - protein, 9 aa, Homo Sapiens
HTCGGALIR

SEQ ID NO: 635204 - protein, 9 aa, Homo Sapiens
VFLVGLLPE

SEQ ID NO: 635205 - protein, 9 aa, Homo Sapiens
WGDAPSPLP

SEQ ID NO: 635206 - protein, 9 aa, Homo Sapiens
KKQAQEERK

SEQ ID NO: 635207 - protein, 9 aa, Homo Sapiens
YLYPWQSCK

SEQ ID NO: 635208 - protein, 9 aa, Homo Sapiens
ETVVFYELA

SEQ ID NO: 635209 - protein, 9 aa, Homo Sapiens
RALVAMATW

SEQ ID NO: 635210 - protein, 9 aa, Homo Sapiens
ALNHHLHSV

SEQ ID NO: 635211 - protein, 9 aa, Homo Sapiens
TYNISKLFP

SEQ ID NO: 635212 - protein, 9 aa, Homo Sapiens
KEECSTLHN

SEQ ID NO: 635213 - protein, 9 aa, Homo Sapiens
WSSPVTPTP

SEQ ID NO: 635214 - protein, 9 aa, Homo Sapiens
EANIQHWQQ

SEQ ID NO: 635215 - protein, 9 aa, Homo Sapiens
GKESWFERI

SEQ ID NO: 635216 - protein, 9 aa, Homo Sapiens
RNTGNMFKI

SEQ ID NO: 635217 - protein, 9 aa, Homo Sapiens
TVSGHTCQQ

SEQ ID NO: 635218 - protein, 9 aa, Homo Sapiens
PHLVEEAFR

SEQ ID NO: 635219 - protein, 9 aa, Homo Sapiens
ITSVSGGRN

SEQ ID NO: 635220 - protein, 9 aa, Homo Sapiens
CYCRPGFDL

SEQ ID NO: 635221 - protein, 9 aa, Homo Sapiens
RSLNKLRKR

SEQ ID NO: 635222 - protein, 9 aa, Homo Sapiens
SVLSWAEGS

SEQ ID NO: 635223 - protein, 9 aa, Homo Sapiens
GKVSQPEPP

SEQ ID NO: 635224 - protein, 9 aa, Homo Sapiens
RGQKVTLRC

SEQ ID NO: 635225 - protein, 9 aa, Homo Sapiens
ELIQAKKKS

SEQ ID NO: 635226 - protein, 9 aa, Homo Sapiens
HSPAISSQN

SEQ ID NO: 635227 - protein, 9 aa, Homo Sapiens
YAVLHWLGC

SEQ ID NO: 635228 - protein, 9 aa, Homo Sapiens
SVLYVVPCP

SEQ ID NO: 635229 - protein, 9 aa, Homo Sapiens
GLLYPSVEE

SEQ ID NO: 635230 - protein, 9 aa, Homo Sapiens
TQTELADGD

SEQ ID NO: 635231 - protein, 9 aa, Homo Sapiens
IREMRTLRP

SEQ ID NO: 635232 - protein, 9 aa, Homo Sapiens
TVIPQAVRV

SEQ ID NO: 635233 - protein, 9 aa, Homo Sapiens
DQALLSVRT

SEQ ID NO: 635234 - protein, 9 aa, Homo Sapiens
CQQWSAQTP

SEQ ID NO: 635235 - protein, 9 aa, Homo Sapiens
VEMAHHFFA

SEQ ID NO: 635236 - protein, 9 aa, Homo Sapiens
HCIACSVYI

SEQ ID NO: 635237 - protein, 9 aa, Homo Sapiens
YYAKLLVEL

SEQ ID NO: 635238 - protein, 9 aa, Homo Sapiens
SLCSPRARQ

SEQ ID NO: 635239 - protein, 9 aa, Homo Sapiens
GSVPPPKNL

SEQ ID NO: 635240 - protein, 9 aa, Homo Sapiens
ESFKKAREE

SEQ ID NO: 635241 - protein, 9 aa, Homo Sapiens
PRKDGSRKE

SEQ ID NO: 635242 - protein, 9 aa, Homo Sapiens
WSVCDDEHH

SEQ ID NO: 635243 - protein, 9 aa, Homo Sapiens
CSEQEWRLL

SEQ ID NO: 635244 - protein, 9 aa, Homo Sapiens
LCLDCVKFL

SEQ ID NO: 635245 - protein, 9 aa, Homo Sapiens
EVAEGYPLY

SEQ ID NO: 635246 - protein, 9 aa, Homo Sapiens
RKCAKEVGN

SEQ ID NO: 635247 - protein, 9 aa, Homo Sapiens
AETRFFHVV

SEQ ID NO: 635248 - protein, 9 aa, Homo Sapiens
LGSGFRSVT

SEQ ID NO: 635249 - protein, 9 aa, Homo Sapiens
FKNKGSRPY

SEQ ID NO: 635250 - protein, 9 aa, Homo Sapiens
NIGNMTVLS

SEQ ID NO: 635251 - protein, 9 aa, Homo Sapiens
PSEPRLGKT

SEQ ID NO: 635252 - protein, 9 aa, Homo Sapiens
GFVVAALEI

SEQ ID NO: 635253 - protein, 9 aa, Homo Sapiens
QGVFFSWDS

SEQ ID NO: 635254 - protein, 9 aa, Homo Sapiens
VIVLGAEDT

SEQ ID NO: 635255 - protein, 9 aa, Homo Sapiens
VTIYRHKEY

SEQ ID NO: 635256 - protein, 9 aa, Homo Sapiens
SQLIGTGVK

SEQ ID NO: 635257 - protein, 9 aa, Homo Sapiens
GIQEAQMKE

SEQ ID NO: 635258 - protein, 9 aa, Homo Sapiens
SIADILLLF

SEQ ID NO: 635259 - protein, 9 aa, Homo Sapiens
NYSAIQREE

SEQ ID NO: 635260 - protein, 9 aa, Homo Sapiens
LGGNTVIPQ

SEQ ID NO: 635261 - protein, 9 aa, Homo Sapiens
YELFQDPSE

SEQ ID NO: 635262 - protein, 9 aa, Homo Sapiens
ERNKPDIFE

SEQ ID NO: 635263 - protein, 9 aa, Homo Sapiens
LDSKSLQSR

SEQ ID NO: 635264 - protein, 9 aa, Homo Sapiens
AWKENFLEL

SEQ ID NO: 635265 - protein, 9 aa, Homo Sapiens
VAFVISVVV

SEQ ID NO: 635266 - protein, 9 aa, Homo Sapiens
STKRNNRST

SEQ ID NO: 635267 - protein, 9 aa, Homo Sapiens
GHWMPKDCK

SEQ ID NO: 635268 - protein, 9 aa, Homo Sapiens
FRTVEIKRC

SEQ ID NO: 635269 - protein, 9 aa, Homo Sapiens
TSFQVPLSR

SEQ ID NO: 635270 - protein, 9 aa, Homo Sapiens
TEQCIADES

SEQ ID NO: 635271 - protein, 9 aa, Homo Sapiens
KSASKDDSI

SEQ ID NO: 635272 - protein, 9 aa, Homo Sapiens
GSSFVLSEG

SEQ ID NO: 635273 - protein, 9 aa, Homo Sapiens
LVWKPGDWS

SEQ ID NO: 635274 - protein, 9 aa, Homo Sapiens
VMKFDAIYK

SEQ ID NO: 635275 - protein, 9 aa, Homo Sapiens
WVSAQASSL

SEQ ID NO: 635276 - protein, 9 aa, Homo Sapiens
HRADAQSSR

SEQ ID NO: 635277 - protein, 9 aa, Homo Sapiens
TNKEKEEIL

SEQ ID NO: 635278 - protein, 9 aa, Homo Sapiens
EALKCFRIM

SEQ ID NO: 635279 - protein, 9 aa, Homo Sapiens
EKKTSVRSH

SEQ ID NO: 635280 - protein, 9 aa, Homo Sapiens
HFLEAVVMK

SEQ ID NO: 635281 - protein, 9 aa, Homo Sapiens
TNWRHVYKA

SEQ ID NO: 635282 - protein, 9 aa, Homo Sapiens
GDCAKGDVI

SEQ ID NO: 635283 - protein, 9 aa, Homo Sapiens
DSSVCRHTA

SEQ ID NO: 635284 - protein, 9 aa, Homo Sapiens
NDEEAHSSI

SEQ ID NO: 635285 - protein, 9 aa, Homo Sapiens
LHSTQQAVQ

SEQ ID NO: 635286 - protein, 9 aa, Homo Sapiens
DMTVFENSR

SEQ ID NO: 635287 - protein, 9 aa, Homo Sapiens
NRDFPEWAH

SEQ ID NO: 635288 - protein, 9 aa, Homo Sapiens
QDINNLSTP

SEQ ID NO: 635289 - protein, 9 aa, Homo Sapiens
YNAQEYCDR

SEQ ID NO: 635290 - protein, 9 aa, Homo Sapiens
APQDGPPWA

SEQ ID NO: 635291 - protein, 9 aa, Homo Sapiens
AGLTSMCRP

SEQ ID NO: 635292 - protein, 9 aa, Homo Sapiens
ICDHFVIVS

SEQ ID NO: 635293 - protein, 9 aa, Homo Sapiens
QAVQFAKAM

SEQ ID NO: 635294 - protein, 9 aa, Homo Sapiens
EFPWTVHLA

SEQ ID NO: 635295 - protein, 9 aa, Homo Sapiens
EGYPLYPGS

SEQ ID NO: 635296 - protein, 9 aa, Homo Sapiens
RGKLQAQRS

SEQ ID NO: 635297 - protein, 9 aa, Homo Sapiens
QGLLFDIVT

SEQ ID NO: 635298 - protein, 9 aa, Homo Sapiens
ASTAHWQGC

SEQ ID NO: 635299 - protein, 9 aa, Homo Sapiens
DCDKSLLKI

SEQ ID NO: 635300 - protein, 9 aa, Homo Sapiens
AKSESSIEK

SEQ ID NO: 635301 - protein, 9 aa, Homo Sapiens
ESYLSVTLR

SEQ ID NO: 635302 - protein, 9 aa, Homo Sapiens
CQVTGLWKD

SEQ ID NO: 635303 - protein, 9 aa, Homo Sapiens
LIIFKNKGS

SEQ ID NO: 635304 - protein, 9 aa, Homo Sapiens
KRSKGVRVP

SEQ ID NO: 635305 - protein, 9 aa, Homo Sapiens
HCDDLPSPS

SEQ ID NO: 635306 - protein, 9 aa, Homo Sapiens
PDMCVYRIG

SEQ ID NO: 635307 - protein, 9 aa, Homo Sapiens
TKSSLQFSR

SEQ ID NO: 635308 - protein, 9 aa, Homo Sapiens
YELCGGMAS

SEQ ID NO: 635309 - protein, 9 aa, Homo Sapiens
LQDFPPYCW

SEQ ID NO: 635310 - protein, 9 aa, Homo Sapiens
GLYCVPEGD

SEQ ID NO: 635311 - protein, 9 aa, Homo Sapiens
NKNIENQEL

SEQ ID NO: 635312 - protein, 9 aa, Homo Sapiens
VTCWGYTRE

SEQ ID NO: 635313 - protein, 9 aa, Homo Sapiens
AVRMAVVVA

SEQ ID NO: 635314 - protein, 9 aa, Homo Sapiens
LYVTSIAGI

SEQ ID NO: 635315 - protein, 9 aa, Homo Sapiens
GSVMSTKIY

SEQ ID NO: 635316 - protein, 9 aa, Homo Sapiens
TLSRTPEVH

SEQ ID NO: 635317 - protein, 9 aa, Homo Sapiens
NETILCTRE

SEQ ID NO: 635318 - protein, 9 aa, Homo Sapiens
FHLKNSILK

SEQ ID NO: 635319 - protein, 9 aa, Homo Sapiens
SKKREHSPI

SEQ ID NO: 635320 - protein, 9 aa, Homo Sapiens
ICSMERRRL

SEQ ID NO: 635321 - protein, 9 aa, Homo Sapiens
EQAAAIKED

SEQ ID NO: 635322 - protein, 9 aa, Homo Sapiens
ARHWKTILI

SEQ ID NO: 635323 - protein, 9 aa, Homo Sapiens
VGDEDTDSA

SEQ ID NO: 635324 - protein, 9 aa, Homo Sapiens
ARSPGREKQ

SEQ ID NO: 635325 - protein, 9 aa, Homo Sapiens
RGKAVRMAV

SEQ ID NO: 635326 - protein, 9 aa, Homo Sapiens
VLDRLKYLN

SEQ ID NO: 635327 - protein, 9 aa, Homo Sapiens
SPGHWKHQG

SEQ ID NO: 635328 - protein, 9 aa, Homo Sapiens
LVISGYSLE

SEQ ID NO: 635329 - protein, 9 aa, Homo Sapiens
EVGAHITQP

SEQ ID NO: 635330 - protein, 9 aa, Homo Sapiens
KEIEDLLLR

SEQ ID NO: 635331 - protein, 9 aa, Homo Sapiens
IGMFISGVL

SEQ ID NO: 635332 - protein, 9 aa, Homo Sapiens
NLKGIFSMK

SEQ ID NO: 635333 - protein, 9 aa, Homo Sapiens
RGNVWSLAV

SEQ ID NO: 635334 - protein, 9 aa, Homo Sapiens
SVLFLRITG

SEQ ID NO: 635335 - protein, 9 aa, Homo Sapiens
RKTKSRLAR

SEQ ID NO: 635336 - protein, 9 aa, Homo Sapiens
HQQGGHPPP

SEQ ID NO: 635337 - protein, 9 aa, Homo Sapiens
FVEQLQKVH

SEQ ID NO: 635338 - protein, 9 aa, Homo Sapiens
EQAGSLKGF

SEQ ID NO: 635339 - protein, 9 aa, Homo Sapiens
KEASTAHWQ

SEQ ID NO: 635340 - protein, 9 aa, Homo Sapiens
TGQQCDQCF

SEQ ID NO: 635341 - protein, 9 aa, Homo Sapiens
NDTFFDRAK

SEQ ID NO: 635342 - protein, 9 aa, Homo Sapiens
PFMGSIDLS

SEQ ID NO: 635343 - protein, 9 aa, Homo Sapiens
EYKIVCSLD

SEQ ID NO: 635344 - protein, 9 aa, Homo Sapiens
AGIPLPRLR

SEQ ID NO: 635345 - protein, 9 aa, Homo Sapiens
VCEHFDPCT

SEQ ID NO: 635346 - protein, 9 aa, Homo Sapiens
VVVMLITYI

SEQ ID NO: 635347 - protein, 9 aa, Homo Sapiens
TWHSECNCE

SEQ ID NO: 635348 - protein, 9 aa, Homo Sapiens
RYLGLSMLL

SEQ ID NO: 635349 - protein, 9 aa, Homo Sapiens
FFSFRKQRK

SEQ ID NO: 635350 - protein, 9 aa, Homo Sapiens
SNVRKITCD

SEQ ID NO: 635351 - protein, 9 aa, Homo Sapiens
SELEKKHRY

SEQ ID NO: 635352 - protein, 9 aa, Homo Sapiens
FSAAKNCSI

SEQ ID NO: 635353 - protein, 9 aa, Homo Sapiens
TEERLQCPA

SEQ ID NO: 635354 - protein, 9 aa, Homo Sapiens
LQHTNIVRF

SEQ ID NO: 635355 - protein, 9 aa, Homo Sapiens
AGLAVDVAE

SEQ ID NO: 635356 - protein, 9 aa, Homo Sapiens
LAAVASWLA

SEQ ID NO: 635357 - protein, 9 aa, Homo Sapiens
INALVTTPM

SEQ ID NO: 635358 - protein, 9 aa, Homo Sapiens
DWLVNLQEL

SEQ ID NO: 635359 - protein, 9 aa, Homo Sapiens
DPYEHPENY

SEQ ID NO: 635360 - protein, 9 aa, Homo Sapiens
GVSLESVSF

SEQ ID NO: 635361 - protein, 9 aa, Homo Sapiens
GQWGDAPSP

SEQ ID NO: 635362 - protein, 9 aa, Homo Sapiens
NAVVLWTFL

SEQ ID NO: 635363 - protein, 9 aa, Homo Sapiens
TWDALLEKL

SEQ ID NO: 635364 - protein, 9 aa, Homo Sapiens
ILRADYIPS

SEQ ID NO: 635365 - protein, 9 aa, Homo Sapiens
QPGTGLGSH

SEQ ID NO: 635366 - protein, 9 aa, Homo Sapiens
PLRATASLW

SEQ ID NO: 635367 - protein, 9 aa, Homo Sapiens
LEAISEVFE

SEQ ID NO: 635368 - protein, 9 aa, Homo Sapiens
LHELFHTIY

SEQ ID NO: 635369 - protein, 9 aa, Homo Sapiens
QHPQAREEG

SEQ ID NO: 635370 - protein, 9 aa, Homo Sapiens
SCVFLECEH

SEQ ID NO: 635371 - protein, 9 aa, Homo Sapiens
EGTNEQSSP

SEQ ID NO: 635372 - protein, 9 aa, Homo Sapiens
LLRQNCVDT

SEQ ID NO: 635373 - protein, 9 aa, Homo Sapiens
WESPKESAQ

SEQ ID NO: 635374 - protein, 9 aa, Homo Sapiens
SPPQIRGCR

SEQ ID NO: 635375 - protein, 9 aa, Homo Sapiens
HGARGLMNG

SEQ ID NO: 635376 - protein, 9 aa, Homo Sapiens
HDVAVLRPE

SEQ ID NO: 635377 - protein, 9 aa, Homo Sapiens
YPALQFLPS

SEQ ID NO: 635378 - protein, 9 aa, Homo Sapiens
FRLATVKSR

SEQ ID NO: 635379 - protein, 9 aa, Homo Sapiens
SAAAAAAVA

SEQ ID NO: 635380 - protein, 9 aa, Homo Sapiens
WLVAERREL

SEQ ID NO: 635381 - protein, 9 aa, Homo Sapiens
VCSCVSVVN

SEQ ID NO: 635382 - protein, 9 aa, Homo Sapiens
YGAGVVGGY

SEQ ID NO: 635383 - protein, 9 aa, Homo Sapiens
RKHGKLHTA

SEQ ID NO: 635384 - protein, 9 aa, Homo Sapiens
EVTIYRHKE

SEQ ID NO: 635385 - protein, 9 aa, Homo Sapiens
LYSSPINVH

SEQ ID NO: 635386 - protein, 9 aa, Homo Sapiens
NLFSTYLAT

SEQ ID NO: 635387 - protein, 9 aa, Homo Sapiens
SVKMSEAGS

SEQ ID NO: 635388 - protein, 9 aa, Homo Sapiens
HSQVDEGLS

SEQ ID NO: 635389 - protein, 9 aa, Homo Sapiens
LQWPVTQPL

SEQ ID NO: 635390 - protein, 9 aa, Homo Sapiens
DCDGAHSPG

SEQ ID NO: 635391 - protein, 9 aa, Homo Sapiens
VLTRHTQLS

SEQ ID NO: 635392 - protein, 9 aa, Homo Sapiens
LGGRLASVS

SEQ ID NO: 635393 - protein, 9 aa, Homo Sapiens
DRIHCQSLR

SEQ ID NO: 635394 - protein, 9 aa, Homo Sapiens
HGRASSVLH

SEQ ID NO: 635395 - protein, 9 aa, Homo Sapiens
VEEAFRALA

SEQ ID NO: 635396 - protein, 9 aa, Homo Sapiens
CADKENPET

SEQ ID NO: 635397 - protein, 9 aa, Homo Sapiens
HSKVPQHGN

SEQ ID NO: 635398 - protein, 9 aa, Homo Sapiens
PGHWKHQGQ

SEQ ID NO: 635399 - protein, 9 aa, Homo Sapiens
GIEDLIIQH

SEQ ID NO: 635400 - protein, 9 aa, Homo Sapiens
QPSPYPVHS

SEQ ID NO: 635401 - protein, 9 aa, Homo Sapiens
KEPSPLPPS

SEQ ID NO: 635402 - protein, 9 aa, Homo Sapiens
PVPLVTLLH

SEQ ID NO: 635403 - protein, 9 aa, Homo Sapiens
MRWWMACTA

SEQ ID NO: 635404 - protein, 9 aa, Homo Sapiens
KFIEKGNSS

SEQ ID NO: 635405 - protein, 9 aa, Homo Sapiens
SLPPVRSSL

SEQ ID NO: 635406 - protein, 9 aa, Homo Sapiens
GEATPVSGY

SEQ ID NO: 635407 - protein, 9 aa, Homo Sapiens
VLNDGYYGA

SEQ ID NO: 635408 - protein, 9 aa, Homo Sapiens
SAYQELIQA

SEQ ID NO: 635409 - protein, 9 aa, Homo Sapiens
QWDVLVDRQ

SEQ ID NO: 635410 - protein, 9 aa, Homo Sapiens
CNFSSRMQS

SEQ ID NO: 635411 - protein, 9 aa, Homo Sapiens
TLHLVFTQF

SEQ ID NO: 635412 - protein, 9 aa, Homo Sapiens
LSLWEIYLS

SEQ ID NO: 635413 - protein, 9 aa, Homo Sapiens
TFGFVVAAL

SEQ ID NO: 635414 - protein, 9 aa, Homo Sapiens
VAKIFGLEL

SEQ ID NO: 635415 - protein, 9 aa, Homo Sapiens
NPAAHSADL

SEQ ID NO: 635416 - protein, 9 aa, Homo Sapiens
DNFNIGNMT

SEQ ID NO: 635417 - protein, 9 aa, Homo Sapiens
VFCEKTLFC

SEQ ID NO: 635418 - protein, 9 aa, Homo Sapiens
VRGNVWSLA

SEQ ID NO: 635419 - protein, 9 aa, Homo Sapiens
AQHGHTLAA

SEQ ID NO: 635420 - protein, 9 aa, Homo Sapiens
GGWGLKEAD

SEQ ID NO: 635421 - protein, 9 aa, Homo Sapiens
PLVFATYLL

SEQ ID NO: 635422 - protein, 9 aa, Homo Sapiens
PYACHECWK

SEQ ID NO: 635423 - protein, 9 aa, Homo Sapiens
TATDLFVSV

SEQ ID NO: 635424 - protein, 9 aa, Homo Sapiens
AGHRKDLGA

SEQ ID NO: 635425 - protein, 9 aa, Homo Sapiens
GQGWSQGPG

SEQ ID NO: 635426 - protein, 9 aa, Homo Sapiens
QSCKVLPGR

SEQ ID NO: 635427 - protein, 9 aa, Homo Sapiens
NLVSGLKKV

SEQ ID NO: 635428 - protein, 9 aa, Homo Sapiens
VAPHMADIV

SEQ ID NO: 635429 - protein, 9 aa, Homo Sapiens
TVTECDQDP

SEQ ID NO: 635430 - protein, 9 aa, Homo Sapiens
AFLQHLTVV

SEQ ID NO: 635431 - protein, 9 aa, Homo Sapiens
QLYVGREKK

SEQ ID NO: 635432 - protein, 9 aa, Homo Sapiens
IASTPQGED

SEQ ID NO: 635433 - protein, 9 aa, Homo Sapiens
NDVITFARS

SEQ ID NO: 635434 - protein, 9 aa, Homo Sapiens
KEMRGVMEG

SEQ ID NO: 635435 - protein, 9 aa, Homo Sapiens
SNLKGIFSM

SEQ ID NO: 635436 - protein, 9 aa, Homo Sapiens
MCPICDQVC

SEQ ID NO: 635437 - protein, 9 aa, Homo Sapiens
SEVLQRLSC

SEQ ID NO: 635438 - protein, 9 aa, Homo Sapiens
VGSLALDSK

SEQ ID NO: 635439 - protein, 9 aa, Homo Sapiens
AQMERNNGS

SEQ ID NO: 635440 - protein, 9 aa, Homo Sapiens
MSLTKMSSP

SEQ ID NO: 635441 - protein, 9 aa, Homo Sapiens
ILDSLERAF

SEQ ID NO: 635442 - protein, 9 aa, Homo Sapiens
NWSRVLVEM

SEQ ID NO: 635443 - protein, 9 aa, Homo Sapiens
VTDIDFTMS

SEQ ID NO: 635444 - protein, 9 aa, Homo Sapiens
VQAKVGLSG

SEQ ID NO: 635445 - protein, 9 aa, Homo Sapiens
AANMNEHFS

SEQ ID NO: 635446 - protein, 9 aa, Homo Sapiens
RTSLSAHGR

SEQ ID NO: 635447 - protein, 9 aa, Homo Sapiens
PPGVVVVAP

SEQ ID NO: 635448 - protein, 9 aa, Homo Sapiens
ITLNVYNVD

SEQ ID NO: 635449 - protein, 9 aa, Homo Sapiens
LVETLKCRQ

SEQ ID NO: 635450 - protein, 9 aa, Homo Sapiens
DVGSLVYVI

SEQ ID NO: 635451 - protein, 9 aa, Homo Sapiens
STSPVSEFL

SEQ ID NO: 635452 - protein, 9 aa, Homo Sapiens
AQRDPLQDS

SEQ ID NO: 635453 - protein, 9 aa, Homo Sapiens
CHLKWLSYW

SEQ ID NO: 635454 - protein, 9 aa, Homo Sapiens
IAFGVDTSS

SEQ ID NO: 635455 - protein, 9 aa, Homo Sapiens
SLTKMSSPS

SEQ ID NO: 635456 - protein, 9 aa, Homo Sapiens
TVTLSCADL

SEQ ID NO: 635457 - protein, 9 aa, Homo Sapiens
DTFHYVTTM

SEQ ID NO: 635458 - protein, 9 aa, Homo Sapiens
SVMSTKIYT

SEQ ID NO: 635459 - protein, 9 aa, Homo Sapiens
PDIFELIQE

SEQ ID NO: 635460 - protein, 9 aa, Homo Sapiens
TAAVWPEMQ

SEQ ID NO: 635461 - protein, 9 aa, Homo Sapiens
CDDLPSPSP

SEQ ID NO: 635462 - protein, 9 aa, Homo Sapiens
HFLRDVMVK

SEQ ID NO: 635463 - protein, 9 aa, Homo Sapiens
GTFYEEYDA

SEQ ID NO: 635464 - protein, 9 aa, Homo Sapiens
HIPSRLDGS

SEQ ID NO: 635465 - protein, 9 aa, Homo Sapiens
KFALFQVLI

SEQ ID NO: 635466 - protein, 9 aa, Homo Sapiens
IKRCVICAL

SEQ ID NO: 635467 - protein, 9 aa, Homo Sapiens
ILVIITDIQ

SEQ ID NO: 635468 - protein, 9 aa, Homo Sapiens
LLHWEEFDE

SEQ ID NO: 635469 - protein, 9 aa, Homo Sapiens
PLTLAVPKC

SEQ ID NO: 635470 - protein, 9 aa, Homo Sapiens
PICDQVCDY

SEQ ID NO: 635471 - protein, 9 aa, Homo Sapiens
TETSPGAAA

SEQ ID NO: 635472 - protein, 9 aa, Homo Sapiens
VLQMWSGML

SEQ ID NO: 635473 - protein, 9 aa, Homo Sapiens
GLFRVTLCC

SEQ ID NO: 635474 - protein, 9 aa, Homo Sapiens
MDLIYHMLQ

SEQ ID NO: 635475 - protein, 9 aa, Homo Sapiens
YSATTGADV

SEQ ID NO: 635476 - protein, 9 aa, Homo Sapiens
PGREKQGAS

SEQ ID NO: 635477 - protein, 9 aa, Homo Sapiens
VIITDIQLH

SEQ ID NO: 635478 - protein, 9 aa, Homo Sapiens
ALDYWSKAQ

SEQ ID NO: 635479 - protein, 9 aa, Homo Sapiens
AIRGLQSSK

SEQ ID NO: 635480 - protein, 9 aa, Homo Sapiens
PEIKQLLSE

SEQ ID NO: 635481 - protein, 9 aa, Homo Sapiens
RIGAYFPSL

SEQ ID NO: 635482 - protein, 9 aa, Homo Sapiens
QDGPPWAEE

SEQ ID NO: 635483 - protein, 9 aa, Homo Sapiens
APWGPRLWE

SEQ ID NO: 635484 - protein, 9 aa, Homo Sapiens
FSKGHHGIT

SEQ ID NO: 635485 - protein, 9 aa, Homo Sapiens
GLIIPFVII

SEQ ID NO: 635486 - protein, 9 aa, Homo Sapiens
PFRGKYYNL

SEQ ID NO: 635487 - protein, 9 aa, Homo Sapiens
ISVFCEKTL

SEQ ID NO: 635488 - protein, 9 aa, Homo Sapiens
TNPDSMAPA

SEQ ID NO: 635489 - protein, 9 aa, Homo Sapiens
VSIHSQWVD

SEQ ID NO: 635490 - protein, 9 aa, Homo Sapiens
SLNEAQEVI

SEQ ID NO: 635491 - protein, 9 aa, Homo Sapiens
MAVGHDLYC

SEQ ID NO: 635492 - protein, 9 aa, Homo Sapiens
GKWKSLTLS

SEQ ID NO: 635493 - protein, 9 aa, Homo Sapiens
TSFYKLFYT

SEQ ID NO: 635494 - protein, 9 aa, Homo Sapiens
DKTAQQIKK

SEQ ID NO: 635495 - protein, 9 aa, Homo Sapiens
ENSSVEARD

SEQ ID NO: 635496 - protein, 9 aa, Homo Sapiens
KQENGNQSR

SEQ ID NO: 635497 - protein, 9 aa, Homo Sapiens
PYLEFPWTV

SEQ ID NO: 635498 - protein, 9 aa, Homo Sapiens
CCSVAFSPR

SEQ ID NO: 635499 - protein, 9 aa, Homo Sapiens
NFICDHFVI

SEQ ID NO: 635500 - protein, 9 aa, Homo Sapiens
SCKVLPGRT

SEQ ID NO: 635501 - protein, 9 aa, Homo Sapiens
PPPITPDEY

SEQ ID NO: 635502 - protein, 9 aa, Homo Sapiens
FRKNSAAEL

SEQ ID NO: 635503 - protein, 9 aa, Homo Sapiens
DYCNNYDMT

SEQ ID NO: 635504 - protein, 9 aa, Homo Sapiens
LSVTLRTAE

SEQ ID NO: 635505 - protein, 9 aa, Homo Sapiens
IKKFESLIK

SEQ ID NO: 635506 - protein, 9 aa, Homo Sapiens
FSAVDTDGK

SEQ ID NO: 635507 - protein, 9 aa, Homo Sapiens
GLWPTWHGD

SEQ ID NO: 635508 - protein, 9 aa, Homo Sapiens
KMENQYHRE

SEQ ID NO: 635509 - protein, 9 aa, Homo Sapiens
VTPLIVEVW

SEQ ID NO: 635510 - protein, 9 aa, Homo Sapiens
KDPLASLRV

SEQ ID NO: 635511 - protein, 9 aa, Homo Sapiens
GSMATQNAY

SEQ ID NO: 635512 - protein, 9 aa, Homo Sapiens
SRLKDRLPL

SEQ ID NO: 635513 - protein, 9 aa, Homo Sapiens
VVLWTFLFR

SEQ ID NO: 635514 - protein, 9 aa, Homo Sapiens
SQVATRFKL

SEQ ID NO: 635515 - protein, 9 aa, Homo Sapiens
EGLGRAGTL

SEQ ID NO: 635516 - protein, 9 aa, Homo Sapiens
SSVNLLGRN

SEQ ID NO: 635517 - protein, 9 aa, Homo Sapiens
KTTTLGPSL

SEQ ID NO: 635518 - protein, 9 aa, Homo Sapiens
TNLLSEEEF

SEQ ID NO: 635519 - protein, 9 aa, Homo Sapiens
IYEFDKMNE

SEQ ID NO: 635520 - protein, 9 aa, Homo Sapiens
YGHAGNFAN

SEQ ID NO: 635521 - protein, 9 aa, Homo Sapiens
FFCFLMANL

SEQ ID NO: 635522 - protein, 9 aa, Homo Sapiens
LECEHVCSC

SEQ ID NO: 635523 - protein, 9 aa, Homo Sapiens
LCIHMTAGA

SEQ ID NO: 635524 - protein, 9 aa, Homo Sapiens
MSDARKYTV

SEQ ID NO: 635525 - protein, 9 aa, Homo Sapiens
DEEPPMDST

SEQ ID NO: 635526 - protein, 9 aa, Homo Sapiens
SSILNTTLQ

SEQ ID NO: 635527 - protein, 9 aa, Homo Sapiens
QCYEEVGLP

SEQ ID NO: 635528 - protein, 9 aa, Homo Sapiens
YFCWEPIPY

SEQ ID NO: 635529 - protein, 9 aa, Homo Sapiens
EAVGFDIIT

SEQ ID NO: 635530 - protein, 9 aa, Homo Sapiens
IQCHPCHHT

SEQ ID NO: 635531 - protein, 9 aa, Homo Sapiens
KLSKAENKI

SEQ ID NO: 635532 - protein, 9 aa, Homo Sapiens
RDHILAVLL

SEQ ID NO: 635533 - protein, 9 aa, Homo Sapiens
SKGLPTPSD

SEQ ID NO: 635534 - protein, 9 aa, Homo Sapiens
VILAAVQVG

SEQ ID NO: 635535 - protein, 9 aa, Homo Sapiens
RTEQAAAIK

SEQ ID NO: 635536 - protein, 9 aa, Homo Sapiens
EGAASVGMH

SEQ ID NO: 635537 - protein, 9 aa, Homo Sapiens
TAGLFSHGG

SEQ ID NO: 635538 - protein, 9 aa, Homo Sapiens
DSKFKIPKF

SEQ ID NO: 635539 - protein, 9 aa, Homo Sapiens
LMVVESDLL

SEQ ID NO: 635540 - protein, 9 aa, Homo Sapiens
LKAKSESSI

SEQ ID NO: 635541 - protein, 9 aa, Homo Sapiens
GAQAPWDSE

SEQ ID NO: 635542 - protein, 9 aa, Homo Sapiens
RAATICSME

SEQ ID NO: 635543 - protein, 9 aa, Homo Sapiens
LFMDDINYI

SEQ ID NO: 635544 - protein, 9 aa, Homo Sapiens
GRQTLSPDR

SEQ ID NO: 635545 - protein, 9 aa, Homo Sapiens
TSKANVTPQ

SEQ ID NO: 635546 - protein, 9 aa, Homo Sapiens
STYGTTTAP

SEQ ID NO: 635547 - protein, 9 aa, Homo Sapiens
FSPRSLAWD

SEQ ID NO: 635548 - protein, 9 aa, Homo Sapiens
VTDHSTTAL

SEQ ID NO: 635549 - protein, 9 aa, Homo Sapiens
ITEQLAHCL

SEQ ID NO: 635550 - protein, 9 aa, Homo Sapiens
VLLLLRLRR

SEQ ID NO: 635551 - protein, 9 aa, Homo Sapiens
LLLPGGINS

SEQ ID NO: 635552 - protein, 9 aa, Homo Sapiens
VSTVMIGLL

SEQ ID NO: 635553 - protein, 9 aa, Homo Sapiens
EGYYKATKC

SEQ ID NO: 635554 - protein, 9 aa, Homo Sapiens
LICFENEVI

SEQ ID NO: 635555 - protein, 9 aa, Homo Sapiens
FQHDFVPQE

SEQ ID NO: 635556 - protein, 9 aa, Homo Sapiens
AAVWPEMQT

SEQ ID NO: 635557 - protein, 9 aa, Homo Sapiens
VYRKISQML

SEQ ID NO: 635558 - protein, 9 aa, Homo Sapiens
FEHIMSLTK

SEQ ID NO: 635559 - protein, 9 aa, Homo Sapiens
GQVDLKKSP

SEQ ID NO: 635560 - protein, 9 aa, Homo Sapiens
ASCMLGPGL

SEQ ID NO: 635561 - protein, 9 aa, Homo Sapiens
EKEGCMEYM

SEQ ID NO: 635562 - protein, 9 aa, Homo Sapiens
RKTSRLTLS

SEQ ID NO: 635563 - protein, 9 aa, Homo Sapiens
LPILLVSGG

SEQ ID NO: 635564 - protein, 9 aa, Homo Sapiens
QAATQAEDC

SEQ ID NO: 635565 - protein, 9 aa, Homo Sapiens
SVPFEEMIS

SEQ ID NO: 635566 - protein, 9 aa, Homo Sapiens
YSYFEFPIG

SEQ ID NO: 635567 - protein, 9 aa, Homo Sapiens
VVRNLADME

SEQ ID NO: 635568 - protein, 9 aa, Homo Sapiens
ELETITIPH

SEQ ID NO: 635569 - protein, 9 aa, Homo Sapiens
KMAEQLINP

SEQ ID NO: 635570 - protein, 9 aa, Homo Sapiens
GGSLCSPRA

SEQ ID NO: 635571 - protein, 9 aa, Homo Sapiens
PDSTPSRAN

SEQ ID NO: 635572 - protein, 9 aa, Homo Sapiens
CEGIVCSCP

SEQ ID NO: 635573 - protein, 9 aa, Homo Sapiens
TFYEEYDAC

SEQ ID NO: 635574 - protein, 9 aa, Homo Sapiens
RPPPITPDE

SEQ ID NO: 635575 - protein, 9 aa, Homo Sapiens
FLHVVCPEE

SEQ ID NO: 635576 - protein, 9 aa, Homo Sapiens
FCDRVQNAY

SEQ ID NO: 635577 - protein, 9 aa, Homo Sapiens
KETKKYEDP

SEQ ID NO: 635578 - protein, 9 aa, Homo Sapiens
WLTEGLLPL

SEQ ID NO: 635579 - protein, 9 aa, Homo Sapiens
VRNGINMYT

SEQ ID NO: 635580 - protein, 9 aa, Homo Sapiens
GYNAQEYCD

SEQ ID NO: 635581 - protein, 9 aa, Homo Sapiens
IRERNKPDI

SEQ ID NO: 635582 - protein, 9 aa, Homo Sapiens
WKENFLELG

SEQ ID NO: 635583 - protein, 9 aa, Homo Sapiens
AFLVSCAQA

SEQ ID NO: 635584 - protein, 9 aa, Homo Sapiens
VLKVNGVKN

SEQ ID NO: 635585 - protein, 9 aa, Homo Sapiens
SSDPVLRRS

SEQ ID NO: 635586 - protein, 9 aa, Homo Sapiens
VLMYLECLL

SEQ ID NO: 635587 - protein, 9 aa, Homo Sapiens
PHQFRRFRQ

SEQ ID NO: 635588 - protein, 9 aa, Homo Sapiens
HNLDMFDDF

SEQ ID NO: 635589 - protein, 9 aa, Homo Sapiens
CEHFDPCTK

SEQ ID NO: 635590 - protein, 9 aa, Homo Sapiens
QENCFLYQH

SEQ ID NO: 635591 - protein, 9 aa, Homo Sapiens
VLTFGGTFD

SEQ ID NO: 635592 - protein, 9 aa, Homo Sapiens
SSSSRQLDC

SEQ ID NO: 635593 - protein, 9 aa, Homo Sapiens
CLSWGPFHT

SEQ ID NO: 635594 - protein, 9 aa, Homo Sapiens
DLTVLVIAH

SEQ ID NO: 635595 - protein, 9 aa, Homo Sapiens
SPPFQERFL

SEQ ID NO: 635596 - protein, 9 aa, Homo Sapiens
LYVVPCPVR

SEQ ID NO: 635597 - protein, 9 aa, Homo Sapiens
VDLKKSPLR

SEQ ID NO: 635598 - protein, 9 aa, Homo Sapiens
ISDCDGAHS

SEQ ID NO: 635599 - protein, 9 aa, Homo Sapiens
PCPVRFQYV

SEQ ID NO: 635600 - protein, 9 aa, Homo Sapiens
FGDCSTIIQ

SEQ ID NO: 635601 - protein, 9 aa, Homo Sapiens
SQGFRLLFY

SEQ ID NO: 635602 - protein, 9 aa, Homo Sapiens
LDWSDLMAD

SEQ ID NO: 635603 - protein, 9 aa, Homo Sapiens
NPFKGSSSA

SEQ ID NO: 635604 - protein, 9 aa, Homo Sapiens
LLSRVHGHS

SEQ ID NO: 635605 - protein, 9 aa, Homo Sapiens
WPGELGPGF

SEQ ID NO: 635606 - protein, 9 aa, Homo Sapiens
QAMSGMRSV

SEQ ID NO: 635607 - protein, 9 aa, Homo Sapiens
PFQERFLAG

SEQ ID NO: 635608 - protein, 9 aa, Homo Sapiens
EQARKHALN

SEQ ID NO: 635609 - protein, 9 aa, Homo Sapiens
GSVSKLFSN

SEQ ID NO: 635610 - protein, 9 aa, Homo Sapiens
VEVWPGQTV

SEQ ID NO: 635611 - protein, 9 aa, Homo Sapiens
NSRGDLTVL

SEQ ID NO: 635612 - protein, 9 aa, Homo Sapiens
WVYRKISQM

SEQ ID NO: 635613 - protein, 9 aa, Homo Sapiens
QGDAHSQVD

SEQ ID NO: 635614 - protein, 9 aa, Homo Sapiens
CNSTVCEHF

SEQ ID NO: 635615 - protein, 9 aa, Homo Sapiens
SSDSCDSET

SEQ ID NO: 635616 - protein, 9 aa, Homo Sapiens
LLPGGINSP

SEQ ID NO: 635617 - protein, 9 aa, Homo Sapiens
AVVLIPWME

SEQ ID NO: 635618 - protein, 9 aa, Homo Sapiens
AFGIRIKNV

SEQ ID NO: 635619 - protein, 9 aa, Homo Sapiens
LEPHRFNDS

SEQ ID NO: 635620 - protein, 9 aa, Homo Sapiens
SMEGMRSPY

SEQ ID NO: 635621 - protein, 9 aa, Homo Sapiens
EYRNLGKSG

SEQ ID NO: 635622 - protein, 9 aa, Homo Sapiens
NCEKQYPDY

SEQ ID NO: 635623 - protein, 9 aa, Homo Sapiens
YEWYNTHPC

SEQ ID NO: 635624 - protein, 9 aa, Homo Sapiens
LAPLLDSEQ

SEQ ID NO: 635625 - protein, 9 aa, Homo Sapiens
RYPPGVVVV

SEQ ID NO: 635626 - protein, 9 aa, Homo Sapiens
WGIRLECIS

SEQ ID NO: 635627 - protein, 9 aa, Homo Sapiens
ELYGKTAKM

SEQ ID NO: 635628 - protein, 9 aa, Homo Sapiens
LADGDIMDG

SEQ ID NO: 635629 - protein, 9 aa, Homo Sapiens
VRLPSLKHP

SEQ ID NO: 635630 - protein, 9 aa, Homo Sapiens
STPSRANPS

SEQ ID NO: 635631 - protein, 9 aa, Homo Sapiens
RNQNEIIFV

SEQ ID NO: 635632 - protein, 9 aa, Homo Sapiens
SQPSLCLLV

SEQ ID NO: 635633 - protein, 9 aa, Homo Sapiens
GSLARWRQN

SEQ ID NO: 635634 - protein, 9 aa, Homo Sapiens
HGHSSLHAA

SEQ ID NO: 635635 - protein, 9 aa, Homo Sapiens
PPVIAPLPD

SEQ ID NO: 635636 - protein, 9 aa, Homo Sapiens
LAAATCEYP

SEQ ID NO: 635637 - protein, 9 aa, Homo Sapiens
ISKKRDHIL

SEQ ID NO: 635638 - protein, 9 aa, Homo Sapiens
TFLYVTSIA

SEQ ID NO: 635639 - protein, 9 aa, Homo Sapiens
KVSDFCLSR

SEQ ID NO: 635640 - protein, 9 aa, Homo Sapiens
RKEDHTPLN

SEQ ID NO: 635641 - protein, 9 aa, Homo Sapiens
SGAEGNGVG

SEQ ID NO: 635642 - protein, 9 aa, Homo Sapiens
ISPYRKLRR

SEQ ID NO: 635643 - protein, 9 aa, Homo Sapiens
VTRTTLCQW

SEQ ID NO: 635644 - protein, 9 aa, Homo Sapiens
AAMANDRYV

SEQ ID NO: 635645 - protein, 9 aa, Homo Sapiens
NFLCKRPLD

SEQ ID NO: 635646 - protein, 9 aa, Homo Sapiens
EQYVGTFYE

SEQ ID NO: 635647 - protein, 9 aa, Homo Sapiens
RWMPPPWAQ

SEQ ID NO: 635648 - protein, 9 aa, Homo Sapiens
DEDSLSSAC

SEQ ID NO: 635649 - protein, 9 aa, Homo Sapiens
VGPLAMEQT

SEQ ID NO: 635650 - protein, 9 aa, Homo Sapiens
VAYPKSVSK

SEQ ID NO: 635651 - protein, 9 aa, Homo Sapiens
PEPEEHEER

SEQ ID NO: 635652 - protein, 9 aa, Homo Sapiens
RMKEAMAHF

SEQ ID NO: 635653 - protein, 9 aa, Homo Sapiens
RTCHLNMQH

SEQ ID NO: 635654 - protein, 9 aa, Homo Sapiens
KIQALLDKL

SEQ ID NO: 635655 - protein, 9 aa, Homo Sapiens
FYTAILSYS

SEQ ID NO: 635656 - protein, 9 aa, Homo Sapiens
YRPLLFTYA

SEQ ID NO: 635657 - protein, 9 aa, Homo Sapiens
FCDMTVFEN

SEQ ID NO: 635658 - protein, 9 aa, Homo Sapiens
SAIQREEIK

SEQ ID NO: 635659 - protein, 9 aa, Homo Sapiens
KTFRQFSHL

SEQ ID NO: 635660 - protein, 9 aa, Homo Sapiens
EDLLLRGAY

SEQ ID NO: 635661 - protein, 9 aa, Homo Sapiens
GTPEIQAPV

SEQ ID NO: 635662 - protein, 9 aa, Homo Sapiens
APHMADIVS

SEQ ID NO: 635663 - protein, 9 aa, Homo Sapiens
VYLIEFSGD

SEQ ID NO: 635664 - protein, 9 aa, Homo Sapiens
VLYVVPCPV

SEQ ID NO: 635665 - protein, 9 aa, Homo Sapiens
RQFSHLKRH

SEQ ID NO: 635666 - protein, 9 aa, Homo Sapiens
IGSLPPHYA

SEQ ID NO: 635667 - protein, 9 aa, Homo Sapiens
HMVHMLCPS

SEQ ID NO: 635668 - protein, 9 aa, Homo Sapiens
EAGPVGGSL

SEQ ID NO: 635669 - protein, 9 aa, Homo Sapiens
IRQNRSKEN

SEQ ID NO: 635670 - protein, 9 aa, Homo Sapiens
LGDIVDASG

SEQ ID NO: 635671 - protein, 9 aa, Homo Sapiens
SRQGLVARA

SEQ ID NO: 635672 - protein, 9 aa, Homo Sapiens
GWLKMAEQL

SEQ ID NO: 635673 - protein, 9 aa, Homo Sapiens
FGEADEIGL

SEQ ID NO: 635674 - protein, 9 aa, Homo Sapiens
EKYCYICPH

SEQ ID NO: 635675 - protein, 9 aa, Homo Sapiens
GGGSDFGCR

SEQ ID NO: 635676 - protein, 9 aa, Homo Sapiens
QAAAGIPLP

SEQ ID NO: 635677 - protein, 9 aa, Homo Sapiens
RIPPCGCKC

SEQ ID NO: 635678 - protein, 9 aa, Homo Sapiens
DARPGGRGA

SEQ ID NO: 635679 - protein, 9 aa, Homo Sapiens
MSEAGSELE

SEQ ID NO: 635680 - protein, 9 aa, Homo Sapiens
TKPRFQSVT

SEQ ID NO: 635681 - protein, 9 aa, Homo Sapiens
FLYVTSIAG

SEQ ID NO: 635682 - protein, 9 aa, Homo Sapiens
LCANPKYVR

SEQ ID NO: 635683 - protein, 9 aa, Homo Sapiens
STDLLYALK

SEQ ID NO: 635684 - protein, 9 aa, Homo Sapiens
DLIIQHNCS

SEQ ID NO: 635685 - protein, 9 aa, Homo Sapiens
YLGLSMLLQ

SEQ ID NO: 635686 - protein, 9 aa, Homo Sapiens
TLKELQTTL

SEQ ID NO: 635687 - protein, 9 aa, Homo Sapiens
TFNPVSLCA

SEQ ID NO: 635688 - protein, 9 aa, Homo Sapiens
LKTVKPLVW

SEQ ID NO: 635689 - protein, 9 aa, Homo Sapiens
SPGSAHSLG

SEQ ID NO: 635690 - protein, 9 aa, Homo Sapiens
GPGAEGSRL

SEQ ID NO: 635691 - protein, 9 aa, Homo Sapiens
DDSPVSITP

SEQ ID NO: 635692 - protein, 9 aa, Homo Sapiens
LGEAINECK

SEQ ID NO: 635693 - protein, 9 aa, Homo Sapiens
EPPQGLYYA

SEQ ID NO: 635694 - protein, 9 aa, Homo Sapiens
PRSGAEGNG

SEQ ID NO: 635695 - protein, 9 aa, Homo Sapiens
HFSTVSSLP

SEQ ID NO: 635696 - protein, 9 aa, Homo Sapiens
VVMQRPVVK

SEQ ID NO: 635697 - protein, 9 aa, Homo Sapiens
LVEEAFRAL

SEQ ID NO: 635698 - protein, 9 aa, Homo Sapiens
LKNMTDNAP

SEQ ID NO: 635699 - protein, 9 aa, Homo Sapiens
IHAEGYERG

SEQ ID NO: 635700 - protein, 9 aa, Homo Sapiens
YNEPLIVFL

SEQ ID NO: 635701 - protein, 9 aa, Homo Sapiens
KDVWVYDSL

SEQ ID NO: 635702 - protein, 9 aa, Homo Sapiens
ARYGQRAQL

SEQ ID NO: 635703 - protein, 9 aa, Homo Sapiens
TTSSLELMA

SEQ ID NO: 635704 - protein, 9 aa, Homo Sapiens
LMIDLLGDK

SEQ ID NO: 635705 - protein, 9 aa, Homo Sapiens
WHGDIISGY

SEQ ID NO: 635706 - protein, 9 aa, Homo Sapiens
QISSRMLFA

SEQ ID NO: 635707 - protein, 9 aa, Homo Sapiens
SKKRDHILA

SEQ ID NO: 635708 - protein, 9 aa, Homo Sapiens
PFGDVFRSH

SEQ ID NO: 635709 - protein, 9 aa, Homo Sapiens
KTPPPLAPK

SEQ ID NO: 635710 - protein, 9 aa, Homo Sapiens
ALALAAAFQ

SEQ ID NO: 635711 - protein, 9 aa, Homo Sapiens
STAHWQGCR

SEQ ID NO: 635712 - protein, 9 aa, Homo Sapiens
TPGIPGNHG

SEQ ID NO: 635713 - protein, 9 aa, Homo Sapiens
PPQSCSIKN

SEQ ID NO: 635714 - protein, 9 aa, Homo Sapiens
ATTGADVCF

SEQ ID NO: 635715 - protein, 9 aa, Homo Sapiens
PACLPGPPG

SEQ ID NO: 635716 - protein, 9 aa, Homo Sapiens
QEHSQISGQ

SEQ ID NO: 635717 - protein, 9 aa, Homo Sapiens
RHSASQDGK

SEQ ID NO: 635718 - protein, 9 aa, Homo Sapiens
RLICCPLCR

SEQ ID NO: 635719 - protein, 9 aa, Homo Sapiens
EKRHRKRSK

SEQ ID NO: 635720 - protein, 9 aa, Homo Sapiens
YAPGLYHYP

SEQ ID NO: 635721 - protein, 9 aa, Homo Sapiens
AHSLGPDGG

SEQ ID NO: 635722 - protein, 9 aa, Homo Sapiens
AALAGKALL

SEQ ID NO: 635723 - protein, 9 aa, Homo Sapiens
CWKTFGRSS

SEQ ID NO: 635724 - protein, 9 aa, Homo Sapiens
VLLDLKQAQ

SEQ ID NO: 635725 - protein, 9 aa, Homo Sapiens
SHPMTEAGP

SEQ ID NO: 635726 - protein, 9 aa, Homo Sapiens
PEVLTGDVE

SEQ ID NO: 635727 - protein, 9 aa, Homo Sapiens
PREGLGRAG

SEQ ID NO: 635728 - protein, 9 aa, Homo Sapiens
GLTSMCRPS

SEQ ID NO: 635729 - protein, 9 aa, Homo Sapiens
SRGQHAMQF

SEQ ID NO: 635730 - protein, 9 aa, Homo Sapiens
GVFFSWDSY

SEQ ID NO: 635731 - protein, 9 aa, Homo Sapiens
WPTWHGDII

SEQ ID NO: 635732 - protein, 9 aa, Homo Sapiens
RSNNMGVGV

SEQ ID NO: 635733 - protein, 9 aa, Homo Sapiens
YVTSIAGIR

SEQ ID NO: 635734 - protein, 9 aa, Homo Sapiens
FFIGNQVLK

SEQ ID NO: 635735 - protein, 9 aa, Homo Sapiens
SLSADEAAC

SEQ ID NO: 635736 - protein, 9 aa, Homo Sapiens
PRKEDHTPL

SEQ ID NO: 635737 - protein, 9 aa, Homo Sapiens
AIGMSPAVL

SEQ ID NO: 635738 - protein, 9 aa, Homo Sapiens
PCLCSGPEL

SEQ ID NO: 635739 - protein, 9 aa, Homo Sapiens
CDNIVLTTA

SEQ ID NO: 635740 - protein, 9 aa, Homo Sapiens
HAQHPLGSK

SEQ ID NO: 635741 - protein, 9 aa, Homo Sapiens
NNRDFPEWA

SEQ ID NO: 635742 - protein, 9 aa, Homo Sapiens
KLRFKRLWS

SEQ ID NO: 635743 - protein, 9 aa, Homo Sapiens
SGTLWSSRS

SEQ ID NO: 635744 - protein, 9 aa, Homo Sapiens
KENPLTLAV

SEQ ID NO: 635745 - protein, 9 aa, Homo Sapiens
WKQNVTDID

SEQ ID NO: 635746 - protein, 9 aa, Homo Sapiens
SVSKDTDII

SEQ ID NO: 635747 - protein, 9 aa, Homo Sapiens
AQSSRSERL

SEQ ID NO: 635748 - protein, 9 aa, Homo Sapiens
SIIKLIFRP

SEQ ID NO: 635749 - protein, 9 aa, Homo Sapiens
KIMQLQQTV

SEQ ID NO: 635750 - protein, 9 aa, Homo Sapiens
TSAALAAAG

SEQ ID NO: 635751 - protein, 9 aa, Homo Sapiens
ADPDARPGG

SEQ ID NO: 635752 - protein, 9 aa, Homo Sapiens
SIHSQWVDL

SEQ ID NO: 635753 - protein, 9 aa, Homo Sapiens
AKGEDGKDV

SEQ ID NO: 635754 - protein, 9 aa, Homo Sapiens
NDENFLCKR

SEQ ID NO: 635755 - protein, 9 aa, Homo Sapiens
SADPCGGGA

SEQ ID NO: 635756 - protein, 9 aa, Homo Sapiens
KDNETILCT

SEQ ID NO: 635757 - protein, 9 aa, Homo Sapiens
GSRPYSISA

SEQ ID NO: 635758 - protein, 9 aa, Homo Sapiens
LPDDLLLAS

SEQ ID NO: 635759 - protein, 9 aa, Homo Sapiens
VKKGLRHGY

SEQ ID NO: 635760 - protein, 9 aa, Homo Sapiens
LMGSFKPGG

SEQ ID NO: 635761 - protein, 9 aa, Homo Sapiens
EGRLRKHGK

SEQ ID NO: 635762 - protein, 9 aa, Homo Sapiens
VHGHSSLHA

SEQ ID NO: 635763 - protein, 9 aa, Homo Sapiens
KEYYRGRNN

SEQ ID NO: 635764 - protein, 9 aa, Homo Sapiens
VSLGWLPGR

SEQ ID NO: 635765 - protein, 9 aa, Homo Sapiens
YLCEDTICG

SEQ ID NO: 635766 - protein, 9 aa, Homo Sapiens
ICLASWVYR

SEQ ID NO: 635767 - protein, 9 aa, Homo Sapiens
IEDGAQAPW

SEQ ID NO: 635768 - protein, 9 aa, Homo Sapiens
LDEEQARKH

SEQ ID NO: 635769 - protein, 9 aa, Homo Sapiens
MPHQGAPIG

SEQ ID NO: 635770 - protein, 9 aa, Homo Sapiens
EQDLRKHCL

SEQ ID NO: 635771 - protein, 9 aa, Homo Sapiens
HFINALVTT

SEQ ID NO: 635772 - protein, 9 aa, Homo Sapiens
RVQPNSTRH

SEQ ID NO: 635773 - protein, 9 aa, Homo Sapiens
GPPGTPGIP

SEQ ID NO: 635774 - protein, 9 aa, Homo Sapiens
KHIHLENQG

SEQ ID NO: 635775 - protein, 9 aa, Homo Sapiens
KSSQHNGTM

SEQ ID NO: 635776 - protein, 9 aa, Homo Sapiens
HYPCFHSPR

SEQ ID NO: 635777 - protein, 9 aa, Homo Sapiens
HPHMQAPSG

SEQ ID NO: 635778 - protein, 9 aa, Homo Sapiens
AAAGHLDGK

SEQ ID NO: 635779 - protein, 9 aa, Homo Sapiens
FRVTLCCDR

SEQ ID NO: 635780 - protein, 9 aa, Homo Sapiens
DKVLQQGDI

SEQ ID NO: 635781 - protein, 9 aa, Homo Sapiens
NPNWYSDAD

SEQ ID NO: 635782 - protein, 9 aa, Homo Sapiens
DGAFGIRIK

SEQ ID NO: 635783 - protein, 9 aa, Homo Sapiens
SICTGTFHP

SEQ ID NO: 635784 - protein, 9 aa, Homo Sapiens
GGGKPLAAV

SEQ ID NO: 635785 - protein, 9 aa, Homo Sapiens
TTLAGMEFQ

SEQ ID NO: 635786 - protein, 9 aa, Homo Sapiens
YNISKLFPA

SEQ ID NO: 635787 - protein, 9 aa, Homo Sapiens
RQAMSGMRS

SEQ ID NO: 635788 - protein, 9 aa, Homo Sapiens
TQQAVQFAK

SEQ ID NO: 635789 - protein, 9 aa, Homo Sapiens
HESSAEEEE

SEQ ID NO: 635790 - protein, 9 aa, Homo Sapiens
GEIDILGED

SEQ ID NO: 635791 - protein, 9 aa, Homo Sapiens
YQLKQMFHL

SEQ ID NO: 635792 - protein, 9 aa, Homo Sapiens
LAHQLRGQP

SEQ ID NO: 635793 - protein, 9 aa, Homo Sapiens
FHLPILIED

SEQ ID NO: 635794 - protein, 9 aa, Homo Sapiens
GAAGGPRPL

SEQ ID NO: 635795 - protein, 9 aa, Homo Sapiens
RQLVGPLAM

SEQ ID NO: 635796 - protein, 9 aa, Homo Sapiens
SQISGQAKI

SEQ ID NO: 635797 - protein, 9 aa, Homo Sapiens
GSPAPGSPS

SEQ ID NO: 635798 - protein, 9 aa, Homo Sapiens
VTKRDIKIG

SEQ ID NO: 635799 - protein, 9 aa, Homo Sapiens
LGAEDTAFD

SEQ ID NO: 635800 - protein, 9 aa, Homo Sapiens
RGAQGETAL

SEQ ID NO: 635801 - protein, 9 aa, Homo Sapiens
DGAQAPWDS

SEQ ID NO: 635802 - protein, 9 aa, Homo Sapiens
GGGGKPLAA

SEQ ID NO: 635803 - protein, 9 aa, Homo Sapiens
GTMPPYKEA

SEQ ID NO: 635804 - protein, 9 aa, Homo Sapiens
WQQVLCQRR

SEQ ID NO: 635805 - protein, 9 aa, Homo Sapiens
RISLLTNRV

SEQ ID NO: 635806 - protein, 9 aa, Homo Sapiens
QEAQMKEDR

SEQ ID NO: 635807 - protein, 9 aa, Homo Sapiens
ASFDLYSYD

SEQ ID NO: 635808 - protein, 9 aa, Homo Sapiens
GLPLLFLSV

SEQ ID NO: 635809 - protein, 9 aa, Homo Sapiens
WFRIAFNMF

SEQ ID NO: 635810 - protein, 9 aa, Homo Sapiens
MPPPWAQGA

SEQ ID NO: 635811 - protein, 9 aa, Homo Sapiens
DNFVRVLCT

SEQ ID NO: 635812 - protein, 9 aa, Homo Sapiens
SDARKYTVV

SEQ ID NO: 635813 - protein, 9 aa, Homo Sapiens
VRQRIVALS

SEQ ID NO: 635814 - protein, 9 aa, Homo Sapiens
MQSVHLQGK

SEQ ID NO: 635815 - protein, 9 aa, Homo Sapiens
PRDVQRHDV

SEQ ID NO: 635816 - protein, 9 aa, Homo Sapiens
AARSLNKLR

SEQ ID NO: 635817 - protein, 9 aa, Homo Sapiens
LLRGAYGAI

SEQ ID NO: 635818 - protein, 9 aa, Homo Sapiens
PNIYELSSY

SEQ ID NO: 635819 - protein, 9 aa, Homo Sapiens
SENVLYQNR

SEQ ID NO: 635820 - protein, 9 aa, Homo Sapiens
LYSATTGAD

SEQ ID NO: 635821 - protein, 9 aa, Homo Sapiens
GAEGSRLAS

SEQ ID NO: 635822 - protein, 9 aa, Homo Sapiens
QLYSWEEAK

SEQ ID NO: 635823 - protein, 9 aa, Homo Sapiens
VVLAVPEAV

SEQ ID NO: 635824 - protein, 9 aa, Homo Sapiens
LQAIIYRGG

SEQ ID NO: 635825 - protein, 9 aa, Homo Sapiens
KLEKNATYN

SEQ ID NO: 635826 - protein, 9 aa, Homo Sapiens
SSHVAESFQ

SEQ ID NO: 635827 - protein, 9 aa, Homo Sapiens
TVYVPKFLV

SEQ ID NO: 635828 - protein, 9 aa, Homo Sapiens
NMYLIFIMC

SEQ ID NO: 635829 - protein, 9 aa, Homo Sapiens
CSSVVGSWS

SEQ ID NO: 635830 - protein, 9 aa, Homo Sapiens
DVWVYDSLH

SEQ ID NO: 635831 - protein, 9 aa, Homo Sapiens
AFDRYMAFG

SEQ ID NO: 635832 - protein, 9 aa, Homo Sapiens
HTTPSPGRF

SEQ ID NO: 635833 - protein, 9 aa, Homo Sapiens
KAIAILNTH

SEQ ID NO: 635834 - protein, 9 aa, Homo Sapiens
DSQYNDYVD

SEQ ID NO: 635835 - protein, 9 aa, Homo Sapiens
QGKKSAACG

SEQ ID NO: 635836 - protein, 9 aa, Homo Sapiens
RCRRSKETV

SEQ ID NO: 635837 - protein, 9 aa, Homo Sapiens
HKLIEVISM

SEQ ID NO: 635838 - protein, 9 aa, Homo Sapiens
CPICDQVCD

SEQ ID NO: 635839 - protein, 9 aa, Homo Sapiens
GDLTNYLML

SEQ ID NO: 635840 - protein, 9 aa, Homo Sapiens
SYLSCRHNI

SEQ ID NO: 635841 - protein, 9 aa, Homo Sapiens
FLDAIMKKY

SEQ ID NO: 635842 - protein, 9 aa, Homo Sapiens
PVIAPLPDH

SEQ ID NO: 635843 - protein, 9 aa, Homo Sapiens
LRKHGKLHT

SEQ ID NO: 635844 - protein, 9 aa, Homo Sapiens
SLDGFLLTL

SEQ ID NO: 635845 - protein, 9 aa, Homo Sapiens
LRADYIPSH

SEQ ID NO: 635846 - protein, 9 aa, Homo Sapiens
TRRVVEEDK

SEQ ID NO: 635847 - protein, 9 aa, Homo Sapiens
SKSTLSADD

SEQ ID NO: 635848 - protein, 9 aa, Homo Sapiens
GKDTIRGHP

SEQ ID NO: 635849 - protein, 9 aa, Homo Sapiens
GNGVGRPPP

SEQ ID NO: 635850 - protein, 9 aa, Homo Sapiens
PTNLLSEEE

SEQ ID NO: 635851 - protein, 9 aa, Homo Sapiens
TQGKKSAAC

SEQ ID NO: 635852 - protein, 9 aa, Homo Sapiens
ACYQQPQEE

SEQ ID NO: 635853 - protein, 9 aa, Homo Sapiens
CQWKIFTEG

SEQ ID NO: 635854 - protein, 9 aa, Homo Sapiens
SAVAMLKAL

SEQ ID NO: 635855 - protein, 9 aa, Homo Sapiens
YLIFIMCNS

SEQ ID NO: 635856 - protein, 9 aa, Homo Sapiens
QMKEDRRCT

SEQ ID NO: 635857 - protein, 9 aa, Homo Sapiens
YCAYPVPRM

SEQ ID NO: 635858 - protein, 9 aa, Homo Sapiens
KLQRAATIC

SEQ ID NO: 635859 - protein, 9 aa, Homo Sapiens
EEEKRHLHE

SEQ ID NO: 635860 - protein, 9 aa, Homo Sapiens
NSPSFDLRT

SEQ ID NO: 635861 - protein, 9 aa, Homo Sapiens
DVDANRQAI

SEQ ID NO: 635862 - protein, 9 aa, Homo Sapiens
ADPEEIRPN

SEQ ID NO: 635863 - protein, 9 aa, Homo Sapiens
VCNYGHAGN

SEQ ID NO: 635864 - protein, 9 aa, Homo Sapiens
KEGCMEYMR

SEQ ID NO: 635865 - protein, 9 aa, Homo Sapiens
HDDHNWRSE

SEQ ID NO: 635866 - protein, 9 aa, Homo Sapiens
QLECCSVAF

SEQ ID NO: 635867 - protein, 9 aa, Homo Sapiens
DEAACRIPS

SEQ ID NO: 635868 - protein, 9 aa, Homo Sapiens
GQVSLSLLI

SEQ ID NO: 635869 - protein, 9 aa, Homo Sapiens
YPPGVVVVA

SEQ ID NO: 635870 - protein, 9 aa, Homo Sapiens
HGVTAHLNG

SEQ ID NO: 635871 - protein, 9 aa, Homo Sapiens
FTVVSTVMI

SEQ ID NO: 635872 - protein, 9 aa, Homo Sapiens
HDLAGFWDM

SEQ ID NO: 635873 - protein, 9 aa, Homo Sapiens
MELLSWYPV

SEQ ID NO: 635874 - protein, 9 aa, Homo Sapiens
PPVDVEDCD

SEQ ID NO: 635875 - protein, 9 aa, Homo Sapiens
SNKKRPSID

SEQ ID NO: 635876 - protein, 9 aa, Homo Sapiens
IVQAFALDG

SEQ ID NO: 635877 - protein, 9 aa, Homo Sapiens
KLTVTLSCA

SEQ ID NO: 635878 - protein, 9 aa, Homo Sapiens
PKLMIDLLG

SEQ ID NO: 635879 - protein, 9 aa, Homo Sapiens
PHTTPSPGR

SEQ ID NO: 635880 - protein, 9 aa, Homo Sapiens
PQKETKKYE

SEQ ID NO: 635881 - protein, 9 aa, Homo Sapiens
LSCRHNIVD

SEQ ID NO: 635882 - protein, 9 aa, Homo Sapiens
EEATTGEAT

SEQ ID NO: 635883 - protein, 9 aa, Homo Sapiens
GINSPSFDL

SEQ ID NO: 635884 - protein, 9 aa, Homo Sapiens
RKGFPVRPG

SEQ ID NO: 635885 - protein, 9 aa, Homo Sapiens
VETVHCIAC

SEQ ID NO: 635886 - protein, 9 aa, Homo Sapiens
GSSKSGPRK

SEQ ID NO: 635887 - protein, 9 aa, Homo Sapiens
YTVYCWCVT

SEQ ID NO: 635888 - protein, 9 aa, Homo Sapiens
TSNVSETRY

SEQ ID NO: 635889 - protein, 9 aa, Homo Sapiens
AFEKPNIPS

SEQ ID NO: 635890 - protein, 9 aa, Homo Sapiens
VGCQLRSNN

SEQ ID NO: 635891 - protein, 9 aa, Homo Sapiens
KLMVVESDL

SEQ ID NO: 635892 - protein, 9 aa, Homo Sapiens
YVAYHCYPN

SEQ ID NO: 635893 - protein, 9 aa, Homo Sapiens
CGPGLYCVP

SEQ ID NO: 635894 - protein, 9 aa, Homo Sapiens
RPGGRGALH

SEQ ID NO: 635895 - protein, 9 aa, Homo Sapiens
SGWNPFVED

SEQ ID NO: 635896 - protein, 9 aa, Homo Sapiens
GQYTGYSPQ

SEQ ID NO: 635897 - protein, 9 aa, Homo Sapiens
KRFSLSSSL

SEQ ID NO: 635898 - protein, 9 aa, Homo Sapiens
EHTELEAQI

SEQ ID NO: 635899 - protein, 9 aa, Homo Sapiens
LPLPCINSS

SEQ ID NO: 635900 - protein, 9 aa, Homo Sapiens
YPIMYVAYH

SEQ ID NO: 635901 - protein, 9 aa, Homo Sapiens
GGYNGMLIL

SEQ ID NO: 635902 - protein, 9 aa, Homo Sapiens
VVEGVPNVI

SEQ ID NO: 635903 - protein, 9 aa, Homo Sapiens
FDRYMAFGN

SEQ ID NO: 635904 - protein, 9 aa, Homo Sapiens
STMNHPHMQ

SEQ ID NO: 635905 - protein, 9 aa, Homo Sapiens
PKSSQHNGT

SEQ ID NO: 635906 - protein, 9 aa, Homo Sapiens
QESQREEAI

SEQ ID NO: 635907 - protein, 9 aa, Homo Sapiens
SSAAQRCHS

SEQ ID NO: 635908 - protein, 9 aa, Homo Sapiens
MRLICCPLC

SEQ ID NO: 635909 - protein, 9 aa, Homo Sapiens
TTTLGPSLS

SEQ ID NO: 635910 - protein, 9 aa, Homo Sapiens
ADTKMKIYV

SEQ ID NO: 635911 - protein, 9 aa, Homo Sapiens
VPELYGKTA

SEQ ID NO: 635912 - protein, 9 aa, Homo Sapiens
QVLIILTAL

SEQ ID NO: 635913 - protein, 9 aa, Homo Sapiens
NTLYNHQQL

SEQ ID NO: 635914 - protein, 9 aa, Homo Sapiens
VFCLAENSL

SEQ ID NO: 635915 - protein, 9 aa, Homo Sapiens
SRPTGVPIY

SEQ ID NO: 635916 - protein, 9 aa, Homo Sapiens
RDSTDPLYE

SEQ ID NO: 635917 - protein, 9 aa, Homo Sapiens
SFAITAKYL

SEQ ID NO: 635918 - protein, 9 aa, Homo Sapiens
PHLVKFVDI

SEQ ID NO: 635919 - protein, 9 aa, Homo Sapiens
EALQRHGRG

SEQ ID NO: 635920 - protein, 9 aa, Homo Sapiens
LHDGHNLIS

SEQ ID NO: 635921 - protein, 9 aa, Homo Sapiens
LNFPSSPRI

SEQ ID NO: 635922 - protein, 9 aa, Homo Sapiens
EPPNDPCVR

SEQ ID NO: 635923 - protein, 9 aa, Homo Sapiens
SSVLSQVRI

SEQ ID NO: 635924 - protein, 9 aa, Homo Sapiens
NHLLYGSKM

SEQ ID NO: 635925 - protein, 9 aa, Homo Sapiens
LSSVLSQVR

SEQ ID NO: 635926 - protein, 9 aa, Homo Sapiens
CFRIKPLGH

SEQ ID NO: 635927 - protein, 9 aa, Homo Sapiens
IVRRPHAAT

SEQ ID NO: 635928 - protein, 9 aa, Homo Sapiens
PQRCLQGAG

SEQ ID NO: 635929 - protein, 9 aa, Homo Sapiens
ATVCTLGFA

SEQ ID NO: 635930 - protein, 9 aa, Homo Sapiens
SKTSGITFI

SEQ ID NO: 635931 - protein, 9 aa, Homo Sapiens
YMAGCNHLL

SEQ ID NO: 635932 - protein, 9 aa, Homo Sapiens
HGHHDALGP

SEQ ID NO: 635933 - protein, 9 aa, Homo Sapiens
PLPENQRSK

SEQ ID NO: 635934 - protein, 9 aa, Homo Sapiens
GEVWQRAAA

SEQ ID NO: 635935 - protein, 9 aa, Homo Sapiens
EVNETISNP

SEQ ID NO: 635936 - protein, 9 aa, Homo Sapiens
LYEPKLGAS

SEQ ID NO: 635937 - protein, 9 aa, Homo Sapiens
ASVAAERHL

SEQ ID NO: 635938 - protein, 9 aa, Homo Sapiens
VPNMTEQRR

SEQ ID NO: 635939 - protein, 9 aa, Homo Sapiens
RLDEDAAFK

SEQ ID NO: 635940 - protein, 9 aa, Homo Sapiens
QCKPCPGNA

SEQ ID NO: 635941 - protein, 9 aa, Homo Sapiens
AAGADQNLD

SEQ ID NO: 635942 - protein, 9 aa, Homo Sapiens
QLVVLEEKD

SEQ ID NO: 635943 - protein, 9 aa, Homo Sapiens
LQSLDELGQ

SEQ ID NO: 635944 - protein, 9 aa, Homo Sapiens
FPLGPANHG

SEQ ID NO: 635945 - protein, 9 aa, Homo Sapiens
WALPTTEGP

SEQ ID NO: 635946 - protein, 9 aa, Homo Sapiens
YVAVCRPIH

SEQ ID NO: 635947 - protein, 9 aa, Homo Sapiens
AEVNETISN

SEQ ID NO: 635948 - protein, 9 aa, Homo Sapiens
VPKFSISRD

SEQ ID NO: 635949 - protein, 9 aa, Homo Sapiens
VFTMMLKSR

SEQ ID NO: 635950 - protein, 9 aa, Homo Sapiens
GNPEPYQAF

SEQ ID NO: 635951 - protein, 9 aa, Homo Sapiens
PGEIMFIPV

SEQ ID NO: 635952 - protein, 9 aa, Homo Sapiens
SPRIMFSVQ

SEQ ID NO: 635953 - protein, 9 aa, Homo Sapiens
KDTAKIAEK

SEQ ID NO: 635954 - protein, 9 aa, Homo Sapiens
SPPLLAPLS

SEQ ID NO: 635955 - protein, 9 aa, Homo Sapiens
FQHEKVEII

SEQ ID NO: 635956 - protein, 9 aa, Homo Sapiens
DFPSPTSSL

SEQ ID NO: 635957 - protein, 9 aa, Homo Sapiens
LDEKEQAAL

SEQ ID NO: 635958 - protein, 9 aa, Homo Sapiens
VLHKTCTRK

SEQ ID NO: 635959 - protein, 9 aa, Homo Sapiens
SPPKRNLYY

SEQ ID NO: 635960 - protein, 9 aa, Homo Sapiens
VRVARGGEG

SEQ ID NO: 635961 - protein, 9 aa, Homo Sapiens
VASTTSPKP

SEQ ID NO: 635962 - protein, 9 aa, Homo Sapiens
EGRKRTGKQ

SEQ ID NO: 635963 - protein, 9 aa, Homo Sapiens
LPRVPCFSS

SEQ ID NO: 635964 - protein, 9 aa, Homo Sapiens
MYVDVLPEE

SEQ ID NO: 635965 - protein, 9 aa, Homo Sapiens
LGLTLGTVW

SEQ ID NO: 635966 - protein, 9 aa, Homo Sapiens
DSHSQQMQQ

SEQ ID NO: 635967 - protein, 9 aa, Homo Sapiens
TVELTVEGR

SEQ ID NO: 635968 - protein, 9 aa, Homo Sapiens
SQAIKKNPG

SEQ ID NO: 635969 - protein, 9 aa, Homo Sapiens
KDGQDRHDG

SEQ ID NO: 635970 - protein, 9 aa, Homo Sapiens
ERTNLDLPL

SEQ ID NO: 635971 - protein, 9 aa, Homo Sapiens
NPISGNPEP

SEQ ID NO: 635972 - protein, 9 aa, Homo Sapiens
AATTAPFDT

SEQ ID NO: 635973 - protein, 9 aa, Homo Sapiens
SFNKLLKKL

SEQ ID NO: 635974 - protein, 9 aa, Homo Sapiens
TLSTNGTME

SEQ ID NO: 635975 - protein, 9 aa, Homo Sapiens
ESRISQSNI

SEQ ID NO: 635976 - protein, 9 aa, Homo Sapiens
ELECVRCFS

SEQ ID NO: 635977 - protein, 9 aa, Homo Sapiens
GSSMATMEA

SEQ ID NO: 635978 - protein, 9 aa, Homo Sapiens
QSTIVRRPH

SEQ ID NO: 635979 - protein, 9 aa, Homo Sapiens
MWCATKANY

SEQ ID NO: 635980 - protein, 9 aa, Homo Sapiens
CAPLFSGTE

SEQ ID NO: 635981 - protein, 9 aa, Homo Sapiens
VLISRPSVK

SEQ ID NO: 635982 - protein, 9 aa, Homo Sapiens
RQEVPPGVF

SEQ ID NO: 635983 - protein, 9 aa, Homo Sapiens
QYSRQKNPM

SEQ ID NO: 635984 - protein, 9 aa, Homo Sapiens
LDFEQEIAT

SEQ ID NO: 635985 - protein, 9 aa, Homo Sapiens
EATPPAHPA

SEQ ID NO: 635986 - protein, 9 aa, Homo Sapiens
ERRQNPKHQ

SEQ ID NO: 635987 - protein, 9 aa, Homo Sapiens
GDIDLDSDE

SEQ ID NO: 635988 - protein, 9 aa, Homo Sapiens
APSPSPTRK

SEQ ID NO: 635989 - protein, 9 aa, Homo Sapiens
IFVVSISVA

SEQ ID NO: 635990 - protein, 9 aa, Homo Sapiens
SPPKTAEPV

SEQ ID NO: 635991 - protein, 9 aa, Homo Sapiens
REIGELYVP

SEQ ID NO: 635992 - protein, 9 aa, Homo Sapiens
VPHLVKFVD

SEQ ID NO: 635993 - protein, 9 aa, Homo Sapiens
IEESRPLDS

SEQ ID NO: 635994 - protein, 9 aa, Homo Sapiens
YINEKNFVG

SEQ ID NO: 635995 - protein, 9 aa, Homo Sapiens
GLVELFSTP

SEQ ID NO: 635996 - protein, 9 aa, Homo Sapiens
AHGGQCPLG

SEQ ID NO: 635997 - protein, 9 aa, Homo Sapiens
ALCCQSGYV

SEQ ID NO: 635998 - protein, 9 aa, Homo Sapiens
FDTEEASLS

SEQ ID NO: 635999 - protein, 9 aa, Homo Sapiens
EMRMKLLQE

SEQ ID NO: 636000 - protein, 9 aa, Homo Sapiens
KPCPGNAQN

SEQ ID NO: 636001 - protein, 9 aa, Homo Sapiens
PLVPGPLQG

SEQ ID NO: 636002 - protein, 9 aa, Homo Sapiens
LCPEELPGQ

SEQ ID NO: 636003 - protein, 9 aa, Homo Sapiens
TLLVSRKCQ

SEQ ID NO: 636004 - protein, 9 aa, Homo Sapiens
ILRLIKGTK

SEQ ID NO: 636005 - protein, 9 aa, Homo Sapiens
LARVNIVGT

SEQ ID NO: 636006 - protein, 9 aa, Homo Sapiens
QQHVLAFQG

SEQ ID NO: 636007 - protein, 9 aa, Homo Sapiens
DVWNSSNGV

SEQ ID NO: 636008 - protein, 9 aa, Homo Sapiens
CNVRVKFGQ

SEQ ID NO: 636009 - protein, 9 aa, Homo Sapiens
VRCEYCNLT

SEQ ID NO: 636010 - protein, 9 aa, Homo Sapiens
AVLPPFARG

SEQ ID NO: 636011 - protein, 9 aa, Homo Sapiens
FFNRRKRKT

SEQ ID NO: 636012 - protein, 9 aa, Homo Sapiens
DIRSLSDAL

SEQ ID NO: 636013 - protein, 9 aa, Homo Sapiens
KKKSEVILN

SEQ ID NO: 636014 - protein, 9 aa, Homo Sapiens
VVTVHRQSF

SEQ ID NO: 636015 - protein, 9 aa, Homo Sapiens
RILRLIKGT

SEQ ID NO: 636016 - protein, 9 aa, Homo Sapiens
TRCWNDYVN

SEQ ID NO: 636017 - protein, 9 aa, Homo Sapiens
QTPAAPQRC

SEQ ID NO: 636018 - protein, 9 aa, Homo Sapiens
MVKAVVLPT

SEQ ID NO: 636019 - protein, 9 aa, Homo Sapiens
RNWENEQPV

SEQ ID NO: 636020 - protein, 9 aa, Homo Sapiens
RYDSGGQVY

SEQ ID NO: 636021 - protein, 9 aa, Homo Sapiens
PRIMFSVQE

SEQ ID NO: 636022 - protein, 9 aa, Homo Sapiens
YRSGCVCGP

SEQ ID NO: 636023 - protein, 9 aa, Homo Sapiens
CVCGPSPPC

SEQ ID NO: 636024 - protein, 9 aa, Homo Sapiens
RLQCKVCKM

SEQ ID NO: 636025 - protein, 9 aa, Homo Sapiens
SVSVGREGR

SEQ ID NO: 636026 - protein, 9 aa, Homo Sapiens
MDPSVRCEY

SEQ ID NO: 636027 - protein, 9 aa, Homo Sapiens
IIAAPDTII

SEQ ID NO: 636028 - protein, 9 aa, Homo Sapiens
QEIATVASS

SEQ ID NO: 636029 - protein, 9 aa, Homo Sapiens
AFKVAARGT

SEQ ID NO: 636030 - protein, 9 aa, Homo Sapiens
CLRSFKGYI

SEQ ID NO: 636031 - protein, 9 aa, Homo Sapiens
TFLWALPTT

SEQ ID NO: 636032 - protein, 9 aa, Homo Sapiens
RERLIDSLE

SEQ ID NO: 636033 - protein, 9 aa, Homo Sapiens
GLPSIPVNP

SEQ ID NO: 636034 - protein, 9 aa, Homo Sapiens
EISRKAERR

SEQ ID NO: 636035 - protein, 9 aa, Homo Sapiens
CTSQSTIVR

SEQ ID NO: 636036 - protein, 9 aa, Homo Sapiens
TCYTLSTNG

SEQ ID NO: 636037 - protein, 9 aa, Homo Sapiens
DPSTRNWEN

SEQ ID NO: 636038 - protein, 9 aa, Homo Sapiens
MRTVTHIFL

SEQ ID NO: 636039 - protein, 9 aa, Homo Sapiens
TTEKPTVPE

SEQ ID NO: 636040 - protein, 9 aa, Homo Sapiens
GVCNVRVKF

SEQ ID NO: 636041 - protein, 9 aa, Homo Sapiens
RHDGDRGDS

SEQ ID NO: 636042 - protein, 9 aa, Homo Sapiens
EQEGEAYLG

SEQ ID NO: 636043 - protein, 9 aa, Homo Sapiens
YTVPENIKR

SEQ ID NO: 636044 - protein, 9 aa, Homo Sapiens
QSAGRLMRT

SEQ ID NO: 636045 - protein, 9 aa, Homo Sapiens
GQGSSMATM

SEQ ID NO: 636046 - protein, 9 aa, Homo Sapiens
SKEQKHLLS

SEQ ID NO: 636047 - protein, 9 aa, Homo Sapiens
NLSGSKSIS

SEQ ID NO: 636048 - protein, 9 aa, Homo Sapiens
WERTNLDLP

SEQ ID NO: 636049 - protein, 9 aa, Homo Sapiens
TTYSGNSLQ

SEQ ID NO: 636050 - protein, 9 aa, Homo Sapiens
NSVLQSRNS

SEQ ID NO: 636051 - protein, 9 aa, Homo Sapiens
LEHRPQHPG

SEQ ID NO: 636052 - protein, 9 aa, Homo Sapiens
RLLRPAGLQ

SEQ ID NO: 636053 - protein, 9 aa, Homo Sapiens
GLALPRVPC

SEQ ID NO: 636054 - protein, 9 aa, Homo Sapiens
GEALQRHGR

SEQ ID NO: 636055 - protein, 9 aa, Homo Sapiens
WQRAAAHGG

SEQ ID NO: 636056 - protein, 9 aa, Homo Sapiens
GIESRISQS

SEQ ID NO: 636057 - protein, 9 aa, Homo Sapiens
MEPSGEVPR

SEQ ID NO: 636058 - protein, 9 aa, Homo Sapiens
LVEEEASIL

SEQ ID NO: 636059 - protein, 9 aa, Homo Sapiens
SIPVNPIGY

SEQ ID NO: 636060 - protein, 9 aa, Homo Sapiens
QEGEAYLGE

SEQ ID NO: 636061 - protein, 9 aa, Homo Sapiens
SCLEGAFRG

SEQ ID NO: 636062 - protein, 9 aa, Homo Sapiens
LKKRYTTSS

SEQ ID NO: 636063 - protein, 9 aa, Homo Sapiens
SGTGDVIDD

SEQ ID NO: 636064 - protein, 9 aa, Homo Sapiens
EFADLTRVQ

SEQ ID NO: 636065 - protein, 9 aa, Homo Sapiens
LKDTAKIAE

SEQ ID NO: 636066 - protein, 9 aa, Homo Sapiens
HSGLGEYAA

SEQ ID NO: 636067 - protein, 9 aa, Homo Sapiens
TPFSNPRVL

SEQ ID NO: 636068 - protein, 9 aa, Homo Sapiens
NQTEHRRVN

SEQ ID NO: 636069 - protein, 9 aa, Homo Sapiens
PRNVNIGDI

SEQ ID NO: 636070 - protein, 9 aa, Homo Sapiens
GKVGSFKFM

SEQ ID NO: 636071 - protein, 9 aa, Homo Sapiens
LTLMERVQR

SEQ ID NO: 636072 - protein, 9 aa, Homo Sapiens
TTEGPTDAS

SEQ ID NO: 636073 - protein, 9 aa, Homo Sapiens
QYYLYATTY

SEQ ID NO: 636074 - protein, 9 aa, Homo Sapiens
LLEERRPSD

SEQ ID NO: 636075 - protein, 9 aa, Homo Sapiens
TIERNSFLG

SEQ ID NO: 636076 - protein, 9 aa, Homo Sapiens
VTYCTMGFL

SEQ ID NO: 636077 - protein, 9 aa, Homo Sapiens
LARVLLQTP

SEQ ID NO: 636078 - protein, 9 aa, Homo Sapiens
NPIGYYDAQ

SEQ ID NO: 636079 - protein, 9 aa, Homo Sapiens
SIAGDIDLD

SEQ ID NO: 636080 - protein, 9 aa, Homo Sapiens
KPGSPSDQE

SEQ ID NO: 636081 - protein, 9 aa, Homo Sapiens
TGKAGSRGL

SEQ ID NO: 636082 - protein, 9 aa, Homo Sapiens
MAGCNHLLY

SEQ ID NO: 636083 - protein, 9 aa, Homo Sapiens
DKLRSSILP

SEQ ID NO: 636084 - protein, 9 aa, Homo Sapiens
FEQEIATVA

SEQ ID NO: 636085 - protein, 9 aa, Homo Sapiens
FPDLEPRDQ

SEQ ID NO: 636086 - protein, 9 aa, Homo Sapiens
DGQLVVLEE

SEQ ID NO: 636087 - protein, 9 aa, Homo Sapiens
PIHYTVLMH

SEQ ID NO: 636088 - protein, 9 aa, Homo Sapiens
LFSILHSSN

SEQ ID NO: 636089 - protein, 9 aa, Homo Sapiens
GTLRRSNVS

SEQ ID NO: 636090 - protein, 9 aa, Homo Sapiens
LTNKQMQIE

SEQ ID NO: 636091 - protein, 9 aa, Homo Sapiens
ARRAVLPAE

SEQ ID NO: 636092 - protein, 9 aa, Homo Sapiens
TVGYRDMCP

SEQ ID NO: 636093 - protein, 9 aa, Homo Sapiens
EEASILGRK

SEQ ID NO: 636094 - protein, 9 aa, Homo Sapiens
REGRLLRPA

SEQ ID NO: 636095 - protein, 9 aa, Homo Sapiens
PISGNPEPY

SEQ ID NO: 636096 - protein, 9 aa, Homo Sapiens
PPAHPAAAN

SEQ ID NO: 636097 - protein, 9 aa, Homo Sapiens
HFKKARENQ

SEQ ID NO: 636098 - protein, 9 aa, Homo Sapiens
SVNTQQIHT

SEQ ID NO: 636099 - protein, 9 aa, Homo Sapiens
RTRCWNDYV

SEQ ID NO: 636100 - protein, 9 aa, Homo Sapiens
FQGLAMSPF

SEQ ID NO: 636101 - protein, 9 aa, Homo Sapiens
DLYSALASA

SEQ ID NO: 636102 - protein, 9 aa, Homo Sapiens
PAAPQRCLQ

SEQ ID NO: 636103 - protein, 9 aa, Homo Sapiens
STEPRSCPH

SEQ ID NO: 636104 - protein, 9 aa, Homo Sapiens
SITFLIIAA

SEQ ID NO: 636105 - protein, 9 aa, Homo Sapiens
PLHHLDRIH

SEQ ID NO: 636106 - protein, 9 aa, Homo Sapiens
AFRPDFPSP

SEQ ID NO: 636107 - protein, 9 aa, Homo Sapiens
MRSPQYLHS

SEQ ID NO: 636108 - protein, 9 aa, Homo Sapiens
GTPPPPPPE

SEQ ID NO: 636109 - protein, 9 aa, Homo Sapiens
DIDCLQRLQ

SEQ ID NO: 636110 - protein, 9 aa, Homo Sapiens
ASILGRKIV

SEQ ID NO: 636111 - protein, 9 aa, Homo Sapiens
PILDKEDSW

SEQ ID NO: 636112 - protein, 9 aa, Homo Sapiens
QPGKERRQN

SEQ ID NO: 636113 - protein, 9 aa, Homo Sapiens
LKLTLSQKL

SEQ ID NO: 636114 - protein, 9 aa, Homo Sapiens
VDSNGGMTA

SEQ ID NO: 636115 - protein, 9 aa, Homo Sapiens
TCVSGAIVH

SEQ ID NO: 636116 - protein, 9 aa, Homo Sapiens
TSGITFIKP

SEQ ID NO: 636117 - protein, 9 aa, Homo Sapiens
NPGLGEALQ

SEQ ID NO: 636118 - protein, 9 aa, Homo Sapiens
ERYKMLTPF

SEQ ID NO: 636119 - protein, 9 aa, Homo Sapiens
FVKVLSQTT

SEQ ID NO: 636120 - protein, 9 aa, Homo Sapiens
HILASGSVL

SEQ ID NO: 636121 - protein, 9 aa, Homo Sapiens
SLDELGQST

SEQ ID NO: 636122 - protein, 9 aa, Homo Sapiens
AGEVTYCTM

SEQ ID NO: 636123 - protein, 9 aa, Homo Sapiens
SSWIASEVT

SEQ ID NO: 636124 - protein, 9 aa, Homo Sapiens
SPSPTRKDL

SEQ ID NO: 636125 - protein, 9 aa, Homo Sapiens
LSNMSRDPL

SEQ ID NO: 636126 - protein, 9 aa, Homo Sapiens
GRKRTGKQN

SEQ ID NO: 636127 - protein, 9 aa, Homo Sapiens
LYETIISYF

SEQ ID NO: 636128 - protein, 9 aa, Homo Sapiens
DDSRTDKLR

SEQ ID NO: 636129 - protein, 9 aa, Homo Sapiens
KMDNTTFAN

SEQ ID NO: 636130 - protein, 9 aa, Homo Sapiens
LKLTFSSFQ

SEQ ID NO: 636131 - protein, 9 aa, Homo Sapiens
GYCVPHTTR

SEQ ID NO: 636132 - protein, 9 aa, Homo Sapiens
HKFGYCVPH

SEQ ID NO: 636133 - protein, 9 aa, Homo Sapiens
GQLARVLLQ

SEQ ID NO: 636134 - protein, 9 aa, Homo Sapiens
QRAAAHGGQ

SEQ ID NO: 636135 - protein, 9 aa, Homo Sapiens
FTVTPKYQV

SEQ ID NO: 636136 - protein, 9 aa, Homo Sapiens
LNLSSPPKT

SEQ ID NO: 636137 - protein, 9 aa, Homo Sapiens
VLPMKKRKT

SEQ ID NO: 636138 - protein, 9 aa, Homo Sapiens
LDIRFIRSL

SEQ ID NO: 636139 - protein, 9 aa, Homo Sapiens
SSCMGGMNP

SEQ ID NO: 636140 - protein, 9 aa, Homo Sapiens
MSVVTESSG

SEQ ID NO: 636141 - protein, 9 aa, Homo Sapiens
PPESPPKRN

SEQ ID NO: 636142 - protein, 9 aa, Homo Sapiens
SMATMEASQ

SEQ ID NO: 636143 - protein, 9 aa, Homo Sapiens
VDSYGECLQ

SEQ ID NO: 636144 - protein, 9 aa, Homo Sapiens
LLQTPAAPQ

SEQ ID NO: 636145 - protein, 9 aa, Homo Sapiens
GVFQHEKVE

SEQ ID NO: 636146 - protein, 9 aa, Homo Sapiens
CASHMIAVS

SEQ ID NO: 636147 - protein, 9 aa, Homo Sapiens
SLAQSLSPE

SEQ ID NO: 636148 - protein, 9 aa, Homo Sapiens
MTTVGYRDM

SEQ ID NO: 636149 - protein, 9 aa, Homo Sapiens
FGPQCKPCP

SEQ ID NO: 636150 - protein, 9 aa, Homo Sapiens
QSVSVGREG

SEQ ID NO: 636151 - protein, 9 aa, Homo Sapiens
KASLQCLTY

SEQ ID NO: 636152 - protein, 9 aa, Homo Sapiens
KGVGTIVIS

SEQ ID NO: 636153 - protein, 9 aa, Homo Sapiens
HVFCCEIKE

SEQ ID NO: 636154 - protein, 9 aa, Homo Sapiens
ERGRSKEQK

SEQ ID NO: 636155 - protein, 9 aa, Homo Sapiens
KENVSGQFC

SEQ ID NO: 636156 - protein, 9 aa, Homo Sapiens
LLAAGADQN

SEQ ID NO: 636157 - protein, 9 aa, Homo Sapiens
MGFCFFNSF

SEQ ID NO: 636158 - protein, 9 aa, Homo Sapiens
AVGALFVKV

SEQ ID NO: 636159 - protein, 9 aa, Homo Sapiens
VEALTELRN

SEQ ID NO: 636160 - protein, 9 aa, Homo Sapiens
KMCRTPEDQ

SEQ ID NO: 636161 - protein, 9 aa, Homo Sapiens
RPDSSCTSL

SEQ ID NO: 636162 - protein, 9 aa, Homo Sapiens
ACIVVQLFK

SEQ ID NO: 636163 - protein, 9 aa, Homo Sapiens
KPTVPEEKP

SEQ ID NO: 636164 - protein, 9 aa, Homo Sapiens
LECVRCFSR

SEQ ID NO: 636165 - protein, 9 aa, Homo Sapiens
TEYRPPPPP

SEQ ID NO: 636166 - protein, 9 aa, Homo Sapiens
LYEILDFGY

SEQ ID NO: 636167 - protein, 9 aa, Homo Sapiens
TASIPELAS

SEQ ID NO: 636168 - protein, 9 aa, Homo Sapiens
NVKFQYYLY

SEQ ID NO: 636169 - protein, 9 aa, Homo Sapiens
GCNHLLYGS

SEQ ID NO: 636170 - protein, 9 aa, Homo Sapiens
FCFFNSFAI

SEQ ID NO: 636171 - protein, 9 aa, Homo Sapiens
PSLRRVGIF

SEQ ID NO: 636172 - protein, 9 aa, Homo Sapiens
WKLKYTVPE

SEQ ID NO: 636173 - protein, 9 aa, Homo Sapiens
VSLNMENNG

SEQ ID NO: 636174 - protein, 9 aa, Homo Sapiens
LWGLLRQRL

SEQ ID NO: 636175 - protein, 9 aa, Homo Sapiens
SQVLWINAC

SEQ ID NO: 636176 - protein, 9 aa, Homo Sapiens
RYVAVCRPI

SEQ ID NO: 636177 - protein, 9 aa, Homo Sapiens
GEGQLARVL

SEQ ID NO: 636178 - protein, 9 aa, Homo Sapiens
PDPTLARSH

SEQ ID NO: 636179 - protein, 9 aa, Homo Sapiens
KHQRLRPDE

SEQ ID NO: 636180 - protein, 9 aa, Homo Sapiens
FEDVWNSSN

SEQ ID NO: 636181 - protein, 9 aa, Homo Sapiens
GGPCALCAP

SEQ ID NO: 636182 - protein, 9 aa, Homo Sapiens
LICLYMVTM

SEQ ID NO: 636183 - protein, 9 aa, Homo Sapiens
SFLGLSFES

SEQ ID NO: 636184 - protein, 9 aa, Homo Sapiens
AENEPSEVT

SEQ ID NO: 636185 - protein, 9 aa, Homo Sapiens
ILGQSYLNS

SEQ ID NO: 636186 - protein, 9 aa, Homo Sapiens
RDPLLHRVM

SEQ ID NO: 636187 - protein, 9 aa, Homo Sapiens
NSLQRLQEI

SEQ ID NO: 636188 - protein, 9 aa, Homo Sapiens
PDLEPRDQE

SEQ ID NO: 636189 - protein, 9 aa, Homo Sapiens
FYVLTSSTG

SEQ ID NO: 636190 - protein, 9 aa, Homo Sapiens
SPILDKEDS

SEQ ID NO: 636191 - protein, 9 aa, Homo Sapiens
DRAPAVRLR

SEQ ID NO: 636192 - protein, 9 aa, Homo Sapiens
RYTPVGRSS

SEQ ID NO: 636193 - protein, 9 aa, Homo Sapiens
PYMTSISYH

SEQ ID NO: 636194 - protein, 9 aa, Homo Sapiens
KKQPGKERR

SEQ ID NO: 636195 - protein, 9 aa, Homo Sapiens
LKTDPSATD

SEQ ID NO: 636196 - protein, 9 aa, Homo Sapiens
VKGNVCHRK

SEQ ID NO: 636197 - protein, 9 aa, Homo Sapiens
EQSFNKLLK

SEQ ID NO: 636198 - protein, 9 aa, Homo Sapiens
RPQHPGDHD

SEQ ID NO: 636199 - protein, 9 aa, Homo Sapiens
NSLGNCTSQ

SEQ ID NO: 636200 - protein, 9 aa, Homo Sapiens
RNVNIGDIS

SEQ ID NO: 636201 - protein, 9 aa, Homo Sapiens
VGALFVKVL

SEQ ID NO: 636202 - protein, 9 aa, Homo Sapiens
GQCPLGHPA

SEQ ID NO: 636203 - protein, 9 aa, Homo Sapiens
TREVPRKPK

SEQ ID NO: 636204 - protein, 9 aa, Homo Sapiens
TNLDLPLQC

SEQ ID NO: 636205 - protein, 9 aa, Homo Sapiens
LLYEILDFG

SEQ ID NO: 636206 - protein, 9 aa, Homo Sapiens
ADLTRVQTF

SEQ ID NO: 636207 - protein, 9 aa, Homo Sapiens
HLVKFVDIL

SEQ ID NO: 636208 - protein, 9 aa, Homo Sapiens
AADLDPRGC

SEQ ID NO: 636209 - protein, 9 aa, Homo Sapiens
NDPCVRGEK

SEQ ID NO: 636210 - protein, 9 aa, Homo Sapiens
LGPANHGGT

SEQ ID NO: 636211 - protein, 9 aa, Homo Sapiens
PKYQVVLEE

SEQ ID NO: 636212 - protein, 9 aa, Homo Sapiens
RAKINQTEH

SEQ ID NO: 636213 - protein, 9 aa, Homo Sapiens
QGMVKAVVL

SEQ ID NO: 636214 - protein, 9 aa, Homo Sapiens
EILLEHGIN

SEQ ID NO: 636215 - protein, 9 aa, Homo Sapiens
PPPPPLAPT

SEQ ID NO: 636216 - protein, 9 aa, Homo Sapiens
LAVGVCNVR

SEQ ID NO: 636217 - protein, 9 aa, Homo Sapiens
EPSEQELAD

SEQ ID NO: 636218 - protein, 9 aa, Homo Sapiens
TFEACLQIN

SEQ ID NO: 636219 - protein, 9 aa, Homo Sapiens
LVELFSTPG

SEQ ID NO: 636220 - protein, 9 aa, Homo Sapiens
LVPLPFACF

SEQ ID NO: 636221 - protein, 9 aa, Homo Sapiens
SFTASEGCS

SEQ ID NO: 636222 - protein, 9 aa, Homo Sapiens
EVPRKPKVL

SEQ ID NO: 636223 - protein, 9 aa, Homo Sapiens
CRPIHYTVL

SEQ ID NO: 636224 - protein, 9 aa, Homo Sapiens
PPPPPEFRR

SEQ ID NO: 636225 - protein, 9 aa, Homo Sapiens
SRKHCPLDI

SEQ ID NO: 636226 - protein, 9 aa, Homo Sapiens
FPSSPRIRK

SEQ ID NO: 636227 - protein, 9 aa, Homo Sapiens
KGTKGIRTL

SEQ ID NO: 636228 - protein, 9 aa, Homo Sapiens
MFSLCLTAV

SEQ ID NO: 636229 - protein, 9 aa, Homo Sapiens
YTSPDSLTI

SEQ ID NO: 636230 - protein, 9 aa, Homo Sapiens
VSNGSPSGA

SEQ ID NO: 636231 - protein, 9 aa, Homo Sapiens
LTRCAPLFS

SEQ ID NO: 636232 - protein, 9 aa, Homo Sapiens
GKERRQNPK

SEQ ID NO: 636233 - protein, 9 aa, Homo Sapiens
TSPILDKED

SEQ ID NO: 636234 - protein, 9 aa, Homo Sapiens
VTPKYQVVL

SEQ ID NO: 636235 - protein, 9 aa, Homo Sapiens
SGSVLIPRF

SEQ ID NO: 636236 - protein, 9 aa, Homo Sapiens
VVQLFKGKF

SEQ ID NO: 636237 - protein, 9 aa, Homo Sapiens
HLQQHVLAF

SEQ ID NO: 636238 - protein, 9 aa, Homo Sapiens
ETSDPRKSQ

SEQ ID NO: 636239 - protein, 9 aa, Homo Sapiens
PFDTEEASL

SEQ ID NO: 636240 - protein, 9 aa, Homo Sapiens
LTHVLVPVS

SEQ ID NO: 636241 - protein, 9 aa, Homo Sapiens
LRPGGPRRV

SEQ ID NO: 636242 - protein, 9 aa, Homo Sapiens
RRVNPGLGE

SEQ ID NO: 636243 - protein, 9 aa, Homo Sapiens
APSSGSWST

SEQ ID NO: 636244 - protein, 9 aa, Homo Sapiens
AVVNAFYSL

SEQ ID NO: 636245 - protein, 9 aa, Homo Sapiens
LYVPKFSIS

SEQ ID NO: 636246 - protein, 9 aa, Homo Sapiens
VALCCHASA

SEQ ID NO: 636247 - protein, 9 aa, Homo Sapiens
EELPGGTVS

SEQ ID NO: 636248 - protein, 9 aa, Homo Sapiens
NIEPSEQEL

SEQ ID NO: 636249 - protein, 9 aa, Homo Sapiens
RGNLAQPVG

SEQ ID NO: 636250 - protein, 9 aa, Homo Sapiens
SGSHKSSPT

SEQ ID NO: 636251 - protein, 9 aa, Homo Sapiens
SHNVINVIV

SEQ ID NO: 636252 - protein, 9 aa, Homo Sapiens
WNDYVNLRL

SEQ ID NO: 636253 - protein, 9 aa, Homo Sapiens
FLQRFVKFS

SEQ ID NO: 636254 - protein, 9 aa, Homo Sapiens
YREKKTELW

SEQ ID NO: 636255 - protein, 9 aa, Homo Sapiens
QSSLKKRYT

SEQ ID NO: 636256 - protein, 9 aa, Homo Sapiens
KRFVHDGNR

SEQ ID NO: 636257 - protein, 9 aa, Homo Sapiens
AALVMPLRL

SEQ ID NO: 636258 - protein, 9 aa, Homo Sapiens
NMRLTLMER

SEQ ID NO: 636259 - protein, 9 aa, Homo Sapiens
EPSEVTCLP

SEQ ID NO: 636260 - protein, 9 aa, Homo Sapiens
GEDTDRAHS

SEQ ID NO: 636261 - protein, 9 aa, Homo Sapiens
AKWAINRVA

SEQ ID NO: 636262 - protein, 9 aa, Homo Sapiens
LGLVELFST

SEQ ID NO: 636263 - protein, 9 aa, Homo Sapiens
FLEYVRCFR

SEQ ID NO: 636264 - protein, 9 aa, Homo Sapiens
DSAMKTLSS

SEQ ID NO: 636265 - protein, 9 aa, Homo Sapiens
ADQNLDPLN

SEQ ID NO: 636266 - protein, 9 aa, Homo Sapiens
EDDLGRLGK

SEQ ID NO: 636267 - protein, 9 aa, Homo Sapiens
VLPPFARGN

SEQ ID NO: 636268 - protein, 9 aa, Homo Sapiens
VDDCGDRSD

SEQ ID NO: 636269 - protein, 9 aa, Homo Sapiens
GPVAARRAV

SEQ ID NO: 636270 - protein, 9 aa, Homo Sapiens
ELEHRPQHP

SEQ ID NO: 636271 - protein, 9 aa, Homo Sapiens
ALGPTGKAG

SEQ ID NO: 636272 - protein, 9 aa, Homo Sapiens
EKDAHLANL

SEQ ID NO: 636273 - protein, 9 aa, Homo Sapiens
DERMRSPQY

SEQ ID NO: 636274 - protein, 9 aa, Homo Sapiens
GSHLSFEFR

SEQ ID NO: 636275 - protein, 9 aa, Homo Sapiens
DMRNMRFAL

SEQ ID NO: 636276 - protein, 9 aa, Homo Sapiens
EALTELRNS

SEQ ID NO: 636277 - protein, 9 aa, Homo Sapiens
VWGNYGWME

SEQ ID NO: 636278 - protein, 9 aa, Homo Sapiens
AEEDEDKMF

SEQ ID NO: 636279 - protein, 9 aa, Homo Sapiens
EYYNWGRLS

SEQ ID NO: 636280 - protein, 9 aa, Homo Sapiens
KQILCPEEL

SEQ ID NO: 636281 - protein, 9 aa, Homo Sapiens
SEVILNKST

SEQ ID NO: 636282 - protein, 9 aa, Homo Sapiens
EKASLQCLT

SEQ ID NO: 636283 - protein, 9 aa, Homo Sapiens
TSSPQGMVK

SEQ ID NO: 636284 - protein, 9 aa, Homo Sapiens
VAENEPSEV

SEQ ID NO: 636285 - protein, 9 aa, Homo Sapiens
IAGDIDLDS

SEQ ID NO: 636286 - protein, 9 aa, Homo Sapiens
HVLVPVSRD

SEQ ID NO: 636287 - protein, 9 aa, Homo Sapiens
ICLLQMFSL

SEQ ID NO: 636288 - protein, 9 aa, Homo Sapiens
LFPDLEPRD

SEQ ID NO: 636289 - protein, 9 aa, Homo Sapiens
ETLYETIIS

SEQ ID NO: 636290 - protein, 9 aa, Homo Sapiens
EETSDPRKS

SEQ ID NO: 636291 - protein, 9 aa, Homo Sapiens
PCWMVYFQM

SEQ ID NO: 636292 - protein, 9 aa, Homo Sapiens
TTYLDKVTE

SEQ ID NO: 636293 - protein, 9 aa, Homo Sapiens
EHLVNFPRS

SEQ ID NO: 636294 - protein, 9 aa, Homo Sapiens
WGPALADCS

SEQ ID NO: 636295 - protein, 9 aa, Homo Sapiens
EMHENDISA

SEQ ID NO: 636296 - protein, 9 aa, Homo Sapiens
KMWCATKAN

SEQ ID NO: 636297 - protein, 9 aa, Homo Sapiens
LRSSILPPL

SEQ ID NO: 636298 - protein, 9 aa, Homo Sapiens
SALASAAPS

SEQ ID NO: 636299 - protein, 9 aa, Homo Sapiens
GNSLQRLQE

SEQ ID NO: 636300 - protein, 9 aa, Homo Sapiens
EFRRWDYSV

SEQ ID NO: 636301 - protein, 9 aa, Homo Sapiens
FSSQVLWIN

SEQ ID NO: 636302 - protein, 9 aa, Homo Sapiens
LAPLSLPAS

SEQ ID NO: 636303 - protein, 9 aa, Homo Sapiens
YRLYTVVPH

SEQ ID NO: 636304 - protein, 9 aa, Homo Sapiens
EAQHGFLHS

SEQ ID NO: 636305 - protein, 9 aa, Homo Sapiens
LTPFSNPRV

SEQ ID NO: 636306 - protein, 9 aa, Homo Sapiens
RSKEQKHLL

SEQ ID NO: 636307 - protein, 9 aa, Homo Sapiens
YGYNIEPSE

SEQ ID NO: 636308 - protein, 9 aa, Homo Sapiens
SPDTQAKHP

SEQ ID NO: 636309 - protein, 9 aa, Homo Sapiens
RITFTPSSW

SEQ ID NO: 636310 - protein, 9 aa, Homo Sapiens
FIRSLNGCR

SEQ ID NO: 636311 - protein, 9 aa, Homo Sapiens
CFSSLSSCN

SEQ ID NO: 636312 - protein, 9 aa, Homo Sapiens
CPLGHPAAG

SEQ ID NO: 636313 - protein, 9 aa, Homo Sapiens
VKENVSGQF

SEQ ID NO: 636314 - protein, 9 aa, Homo Sapiens
DNASSPLAS

SEQ ID NO: 636315 - protein, 9 aa, Homo Sapiens
PSSLSKDCI

SEQ ID NO: 636316 - protein, 9 aa, Homo Sapiens
LEHGINDSF

SEQ ID NO: 636317 - protein, 9 aa, Homo Sapiens
PGPVAARRA

SEQ ID NO: 636318 - protein, 9 aa, Homo Sapiens
SHMIAVSVF

SEQ ID NO: 636319 - protein, 9 aa, Homo Sapiens
ACDWLRAAA

SEQ ID NO: 636320 - protein, 9 aa, Homo Sapiens
TFILAPAST

SEQ ID NO: 636321 - protein, 9 aa, Homo Sapiens
CTSPILDKE

SEQ ID NO: 636322 - protein, 9 aa, Homo Sapiens
RLIDSLESH

SEQ ID NO: 636323 - protein, 9 aa, Homo Sapiens
RRLSALCCQ

SEQ ID NO: 636324 - protein, 9 aa, Homo Sapiens
TDPSATDAQ

SEQ ID NO: 636325 - protein, 9 aa, Homo Sapiens
VSGAIVHLI

SEQ ID NO: 636326 - protein, 9 aa, Homo Sapiens
HAANGPAPL

SEQ ID NO: 636327 - protein, 9 aa, Homo Sapiens
AFGREHAAN

SEQ ID NO: 636328 - protein, 9 aa, Homo Sapiens
VRQEVPPGV

SEQ ID NO: 636329 - protein, 9 aa, Homo Sapiens
GFEELEAQH

SEQ ID NO: 636330 - protein, 9 aa, Homo Sapiens
ITFTPSSWI

SEQ ID NO: 636331 - protein, 9 aa, Homo Sapiens
TIVISKPLD

SEQ ID NO: 636332 - protein, 9 aa, Homo Sapiens
PPNDPCVRG

SEQ ID NO: 636333 - protein, 9 aa, Homo Sapiens
DSLESHHDT

SEQ ID NO: 636334 - protein, 9 aa, Homo Sapiens
LTNVVTVHR

SEQ ID NO: 636335 - protein, 9 aa, Homo Sapiens
AEGDRGPAQ

SEQ ID NO: 636336 - protein, 9 aa, Homo Sapiens
CSRPSSGTF

SEQ ID NO: 636337 - protein, 9 aa, Homo Sapiens
CVPNMTEQR

SEQ ID NO: 636338 - protein, 9 aa, Homo Sapiens
RLTLMERVQ

SEQ ID NO: 636339 - protein, 9 aa, Homo Sapiens
LAPASTEPR

SEQ ID NO: 636340 - protein, 9 aa, Homo Sapiens
YHEVQYAPK

SEQ ID NO: 636341 - protein, 9 aa, Homo Sapiens
NFYNAVSLN

SEQ ID NO: 636342 - protein, 9 aa, Homo Sapiens
RLRPDEDSS

SEQ ID NO: 636343 - protein, 9 aa, Homo Sapiens
RGRSKEQKH

SEQ ID NO: 636344 - protein, 9 aa, Homo Sapiens
QKEHLVNFP

SEQ ID NO: 636345 - protein, 9 aa, Homo Sapiens
GTKGIRTLL

SEQ ID NO: 636346 - protein, 9 aa, Homo Sapiens
GINDSFQKV

SEQ ID NO: 636347 - protein, 9 aa, Homo Sapiens
ALFETLCFA

SEQ ID NO: 636348 - protein, 9 aa, Homo Sapiens
QLARVLLQT

SEQ ID NO: 636349 - protein, 9 aa, Homo Sapiens
GCVQALLGS

SEQ ID NO: 636350 - protein, 9 aa, Homo Sapiens
VWNSSNGVN

SEQ ID NO: 636351 - protein, 9 aa, Homo Sapiens
SGNSLQRLQ

SEQ ID NO: 636352 - protein, 9 aa, Homo Sapiens
PAAANGLMQ

SEQ ID NO: 636353 - protein, 9 aa, Homo Sapiens
IKKKSEVIL

SEQ ID NO: 636354 - protein, 9 aa, Homo Sapiens
HWLLGDPTC

SEQ ID NO: 636355 - protein, 9 aa, Homo Sapiens
YSALASAAP

SEQ ID NO: 636356 - protein, 9 aa, Homo Sapiens
SRRSLPCLS

SEQ ID NO: 636357 - protein, 9 aa, Homo Sapiens
PLRPGGPRR

SEQ ID NO: 636358 - protein, 9 aa, Homo Sapiens
LHHLDRIHL

SEQ ID NO: 636359 - protein, 9 aa, Homo Sapiens
LLESAFVNY

SEQ ID NO: 636360 - protein, 9 aa, Homo Sapiens
RPPAVLPPF

SEQ ID NO: 636361 - protein, 9 aa, Homo Sapiens
TVHRQSFGT

SEQ ID NO: 636362 - protein, 9 aa, Homo Sapiens
TSSAALLKV

SEQ ID NO: 636363 - protein, 9 aa, Homo Sapiens
SRTDKLRSS

SEQ ID NO: 636364 - protein, 9 aa, Homo Sapiens
NICLLQMFS

SEQ ID NO: 636365 - protein, 9 aa, Homo Sapiens
LSPGEIMFI

SEQ ID NO: 636366 - protein, 9 aa, Homo Sapiens
LAAGADQNL

SEQ ID NO: 636367 - protein, 9 aa, Homo Sapiens
SSPPKTAEP

SEQ ID NO: 636368 - protein, 9 aa, Homo Sapiens
YTPVGRSSF

SEQ ID NO: 636369 - protein, 9 aa, Homo Sapiens
CVRGEKDPK

SEQ ID NO: 636370 - protein, 9 aa, Homo Sapiens
NVNIGDISI

SEQ ID NO: 636371 - protein, 9 aa, Homo Sapiens
EDPLMLDVV

SEQ ID NO: 636372 - protein, 9 aa, Homo Sapiens
KKARENQQI

SEQ ID NO: 636373 - protein, 9 aa, Homo Sapiens
HVDTEKPYT

SEQ ID NO: 636374 - protein, 9 aa, Homo Sapiens
YKMLTPFSN

SEQ ID NO: 636375 - protein, 9 aa, Homo Sapiens
SMWREFYVL

SEQ ID NO: 636376 - protein, 9 aa, Homo Sapiens
VGSFKFMYV

SEQ ID NO: 636377 - protein, 9 aa, Homo Sapiens
APAVRLRQS

SEQ ID NO: 636378 - protein, 9 aa, Homo Sapiens
LSWGPALAD

SEQ ID NO: 636379 - protein, 9 aa, Homo Sapiens
HHELNVQKR

SEQ ID NO: 636380 - protein, 9 aa, Homo Sapiens
HAKNVFTMM

SEQ ID NO: 636381 - protein, 9 aa, Homo Sapiens
ENQRSKAPE

SEQ ID NO: 636382 - protein, 9 aa, Homo Sapiens
WGNYGWMER

SEQ ID NO: 636383 - protein, 9 aa, Homo Sapiens
FTPSSWIAS

SEQ ID NO: 636384 - protein, 9 aa, Homo Sapiens
LLRQRLQCK

SEQ ID NO: 636385 - protein, 9 aa, Homo Sapiens
IMILICLYM

SEQ ID NO: 636386 - protein, 9 aa, Homo Sapiens
IQNRDGVLF

SEQ ID NO: 636387 - protein, 9 aa, Homo Sapiens
PNVNEDTTA

SEQ ID NO: 636388 - protein, 9 aa, Homo Sapiens
MLKDTAKIA

SEQ ID NO: 636389 - protein, 9 aa, Homo Sapiens
GPDPTLARS

SEQ ID NO: 636390 - protein, 9 aa, Homo Sapiens
FAVVGNLVA

SEQ ID NO: 636391 - protein, 9 aa, Homo Sapiens
FVKFSRDVF

SEQ ID NO: 636392 - protein, 9 aa, Homo Sapiens
APLFSGTEH

SEQ ID NO: 636393 - protein, 9 aa, Homo Sapiens
ARGGEGQLA

SEQ ID NO: 636394 - protein, 9 aa, Homo Sapiens
WCVLHKTCT

SEQ ID NO: 636395 - protein, 9 aa, Homo Sapiens
KSLKTDPSA

SEQ ID NO: 636396 - protein, 9 aa, Homo Sapiens
AFYSLNRNQ

SEQ ID NO: 636397 - protein, 9 aa, Homo Sapiens
PLRLVHELS

SEQ ID NO: 636398 - protein, 9 aa, Homo Sapiens
DFTFDLYSA

SEQ ID NO: 636399 - protein, 9 aa, Homo Sapiens
LFSPQTRTV

SEQ ID NO: 636400 - protein, 9 aa, Homo Sapiens
LEAQHGFLH

SEQ ID NO: 636401 - protein, 9 aa, Homo Sapiens
QANVMLFLD

SEQ ID NO: 636402 - protein, 9 aa, Homo Sapiens
NVTEENASI

SEQ ID NO: 636403 - protein, 9 aa, Homo Sapiens
AVDPVAVLS

SEQ ID NO: 636404 - protein, 9 aa, Homo Sapiens
NRRKRKTIQ

SEQ ID NO: 636405 - protein, 9 aa, Homo Sapiens
VHSLSRIWD

SEQ ID NO: 636406 - protein, 9 aa, Homo Sapiens
CTQCGPNGK

SEQ ID NO: 636407 - protein, 9 aa, Homo Sapiens
LSGSHKSSP

SEQ ID NO: 636408 - protein, 9 aa, Homo Sapiens
VTVHCSTDF

SEQ ID NO: 636409 - protein, 9 aa, Homo Sapiens
VNEDTTADF

SEQ ID NO: 636410 - protein, 9 aa, Homo Sapiens
PSSWIASEV

SEQ ID NO: 636411 - protein, 9 aa, Homo Sapiens
GKQLEDGHS

SEQ ID NO: 636412 - protein, 9 aa, Homo Sapiens
HRELRNLEL

SEQ ID NO: 636413 - protein, 9 aa, Homo Sapiens
PKMVPSKDR

SEQ ID NO: 636414 - protein, 9 aa, Homo Sapiens
ANVMLFLDE

SEQ ID NO: 636415 - protein, 9 aa, Homo Sapiens
DKVTEPGVP

SEQ ID NO: 636416 - protein, 9 aa, Homo Sapiens
DEDKMFTMV

SEQ ID NO: 636417 - protein, 9 aa, Homo Sapiens
GCVCGPSPP

SEQ ID NO: 636418 - protein, 9 aa, Homo Sapiens
LISRPSVKG

SEQ ID NO: 636419 - protein, 9 aa, Homo Sapiens
STLSSESWE

SEQ ID NO: 636420 - protein, 9 aa, Homo Sapiens
KFMYVDVLP

SEQ ID NO: 636421 - protein, 9 aa, Homo Sapiens
CFVAQAPNN

SEQ ID NO: 636422 - protein, 9 aa, Homo Sapiens
AVSLNMENN

SEQ ID NO: 636423 - protein, 9 aa, Homo Sapiens
NVNEDTTAD

SEQ ID NO: 636424 - protein, 9 aa, Homo Sapiens
VPEEKPTIP

SEQ ID NO: 636425 - protein, 9 aa, Homo Sapiens
YPHCEERSS

SEQ ID NO: 636426 - protein, 9 aa, Homo Sapiens
SYGECLQNK

SEQ ID NO: 636427 - protein, 9 aa, Homo Sapiens
SQQMQQGFP

SEQ ID NO: 636428 - protein, 9 aa, Homo Sapiens
RTQYSRQKN

SEQ ID NO: 636429 - protein, 9 aa, Homo Sapiens
LQQHVLAFQ

SEQ ID NO: 636430 - protein, 9 aa, Homo Sapiens
QEDLRVGGR

SEQ ID NO: 636431 - protein, 9 aa, Homo Sapiens
PESPPKRNL

SEQ ID NO: 636432 - protein, 9 aa, Homo Sapiens
RVQTFGFRG

SEQ ID NO: 636433 - protein, 9 aa, Homo Sapiens
HEVQYAPKL

SEQ ID NO: 636434 - protein, 9 aa, Homo Sapiens
RVNPGLGEA

SEQ ID NO: 636435 - protein, 9 aa, Homo Sapiens
TTVGYRDMC

SEQ ID NO: 636436 - protein, 9 aa, Homo Sapiens
AMCFTTLAT

SEQ ID NO: 636437 - protein, 9 aa, Homo Sapiens
PDLANMRLT

SEQ ID NO: 636438 - protein, 9 aa, Homo Sapiens
TIAEGGVLP

SEQ ID NO: 636439 - protein, 9 aa, Homo Sapiens
YSITFLIIA

SEQ ID NO: 636440 - protein, 9 aa, Homo Sapiens
RWLRARNFE

SEQ ID NO: 636441 - protein, 9 aa, Homo Sapiens
RSAADLDPR

SEQ ID NO: 636442 - protein, 9 aa, Homo Sapiens
EEGRKRTGK

SEQ ID NO: 636443 - protein, 9 aa, Homo Sapiens
QAGGAPQAL

SEQ ID NO: 636444 - protein, 9 aa, Homo Sapiens
PISSLDGQL

SEQ ID NO: 636445 - protein, 9 aa, Homo Sapiens
QRLQCKVCK

SEQ ID NO: 636446 - protein, 9 aa, Homo Sapiens
PATLGLVEL

SEQ ID NO: 636447 - protein, 9 aa, Homo Sapiens
QSRNSPLPS

SEQ ID NO: 636448 - protein, 9 aa, Homo Sapiens
TAEILLEHG

SEQ ID NO: 636449 - protein, 9 aa, Homo Sapiens
ARNFELQKS

SEQ ID NO: 636450 - protein, 9 aa, Homo Sapiens
PSKDRAKAN

SEQ ID NO: 636451 - protein, 9 aa, Homo Sapiens
LCCQSGYVR

SEQ ID NO: 636452 - protein, 9 aa, Homo Sapiens
EGQLARVLL

SEQ ID NO: 636453 - protein, 9 aa, Homo Sapiens
VSRKCQIDI

SEQ ID NO: 636454 - protein, 9 aa, Homo Sapiens
TKANYDDDR

SEQ ID NO: 636455 - protein, 9 aa, Homo Sapiens
TSCLEGAFR

SEQ ID NO: 636456 - protein, 9 aa, Homo Sapiens
MYHEVQYAP

SEQ ID NO: 636457 - protein, 9 aa, Homo Sapiens
TTILTPNVN

SEQ ID NO: 636458 - protein, 9 aa, Homo Sapiens
GPCALCAPG

SEQ ID NO: 636459 - protein, 9 aa, Homo Sapiens
DLEDDLGRL

SEQ ID NO: 636460 - protein, 9 aa, Homo Sapiens
FQIHVFCCE

SEQ ID NO: 636461 - protein, 9 aa, Homo Sapiens
SFEFRHCST

SEQ ID NO: 636462 - protein, 9 aa, Homo Sapiens
LSVFENIHV

SEQ ID NO: 636463 - protein, 9 aa, Homo Sapiens
RIWDELYLE

SEQ ID NO: 636464 - protein, 9 aa, Homo Sapiens
TEDLGEDTD

SEQ ID NO: 636465 - protein, 9 aa, Homo Sapiens
LHKTCTRKE

SEQ ID NO: 636466 - protein, 9 aa, Homo Sapiens
HIFRRNQSL

SEQ ID NO: 636467 - protein, 9 aa, Homo Sapiens
TPLEVALCC

SEQ ID NO: 636468 - protein, 9 aa, Homo Sapiens
ALGLQEPLR

SEQ ID NO: 636469 - protein, 9 aa, Homo Sapiens
DVEALTELR

SEQ ID NO: 636470 - protein, 9 aa, Homo Sapiens
SLLKHQRLR

SEQ ID NO: 636471 - protein, 9 aa, Homo Sapiens
TPNVNEDTT

SEQ ID NO: 636472 - protein, 9 aa, Homo Sapiens
KNVKGNVCH

SEQ ID NO: 636473 - protein, 9 aa, Homo Sapiens
SLFSILHSS

SEQ ID NO: 636474 - protein, 9 aa, Homo Sapiens
TPEDQLSEL

SEQ ID NO: 636475 - protein, 9 aa, Homo Sapiens
EGVYTCLAR

SEQ ID NO: 636476 - protein, 9 aa, Homo Sapiens
FPLGSHLEP

SEQ ID NO: 636477 - protein, 9 aa, Homo Sapiens
SGNPEPYQA

SEQ ID NO: 636478 - protein, 9 aa, Homo Sapiens
LLKHQRLRP

SEQ ID NO: 636479 - protein, 9 aa, Homo Sapiens
MTDQLTEEQ

SEQ ID NO: 636480 - protein, 9 aa, Homo Sapiens
YAKKDSKKG

SEQ ID NO: 636481 - protein, 9 aa, Homo Sapiens
LDEDAAFKK

SEQ ID NO: 636482 - protein, 9 aa, Homo Sapiens
SGAIVHLIS

SEQ ID NO: 636483 - protein, 9 aa, Homo Sapiens
PLDSHSQQM

SEQ ID NO: 636484 - protein, 9 aa, Homo Sapiens
GPSPRIMFS

SEQ ID NO: 636485 - protein, 9 aa, Homo Sapiens
VNIGDISIK

SEQ ID NO: 636486 - protein, 9 aa, Homo Sapiens
PSSGSWSTF

SEQ ID NO: 636487 - protein, 9 aa, Homo Sapiens
SVAAERHLQ

SEQ ID NO: 636488 - protein, 9 aa, Homo Sapiens
QGSSMATME

SEQ ID NO: 636489 - protein, 9 aa, Homo Sapiens
VWLCGKLLG

SEQ ID NO: 636490 - protein, 9 aa, Homo Sapiens
PLNLSSPPK

SEQ ID NO: 636491 - protein, 9 aa, Homo Sapiens
RMRSPQYLH

SEQ ID NO: 636492 - protein, 9 aa, Homo Sapiens
SVSQPVMVQ

SEQ ID NO: 636493 - protein, 9 aa, Homo Sapiens
SGCVCGPSP

SEQ ID NO: 636494 - protein, 9 aa, Homo Sapiens
DLAERSAAD

SEQ ID NO: 636495 - protein, 9 aa, Homo Sapiens
PRGQVRVAR

SEQ ID NO: 636496 - protein, 9 aa, Homo Sapiens
KWTFEACLQ

SEQ ID NO: 636497 - protein, 9 aa, Homo Sapiens
LDNASSPLA

SEQ ID NO: 636498 - protein, 9 aa, Homo Sapiens
GREGRLLRP

SEQ ID NO: 636499 - protein, 9 aa, Homo Sapiens
VCNVRVKFG

SEQ ID NO: 636500 - protein, 9 aa, Homo Sapiens
LSKDCILGQ

SEQ ID NO: 636501 - protein, 9 aa, Homo Sapiens
RHGRGEPAQ

SEQ ID NO: 636502 - protein, 9 aa, Homo Sapiens
NPYEASPQV

SEQ ID NO: 636503 - protein, 9 aa, Homo Sapiens
TAFGREHAA

SEQ ID NO: 636504 - protein, 9 aa, Homo Sapiens
REPPGGAFN

SEQ ID NO: 636505 - protein, 9 aa, Homo Sapiens
VKFQYYLYA

SEQ ID NO: 636506 - protein, 9 aa, Homo Sapiens
SEVTCLPSH

SEQ ID NO: 636507 - protein, 9 aa, Homo Sapiens
LEQNVTEEN

SEQ ID NO: 636508 - protein, 9 aa, Homo Sapiens
EESRPLDSR

SEQ ID NO: 636509 - protein, 9 aa, Homo Sapiens
GDHDRAPAV

SEQ ID NO: 636510 - protein, 9 aa, Homo Sapiens
RTPEDQLSE

SEQ ID NO: 636511 - protein, 9 aa, Homo Sapiens
GHGHHDALG

SEQ ID NO: 636512 - protein, 9 aa, Homo Sapiens
AARGTLRRS

SEQ ID NO: 636513 - protein, 9 aa, Homo Sapiens
HAFKVAARG

SEQ ID NO: 636514 - protein, 9 aa, Homo Sapiens
RLKLTFSSF

SEQ ID NO: 636515 - protein, 9 aa, Homo Sapiens
SEQELADSA

SEQ ID NO: 636516 - protein, 9 aa, Homo Sapiens
NGSPSGADG

SEQ ID NO: 636517 - protein, 9 aa, Homo Sapiens
KVLPHSHVE

SEQ ID NO: 636518 - protein, 9 aa, Homo Sapiens
LDRIHLHHN

SEQ ID NO: 636519 - protein, 9 aa, Homo Sapiens
GYRSGCVCG

SEQ ID NO: 636520 - protein, 9 aa, Homo Sapiens
NGGMTASRL

SEQ ID NO: 636521 - protein, 9 aa, Homo Sapiens
LFPCGQWPW

SEQ ID NO: 636522 - protein, 9 aa, Homo Sapiens
LEERRPSDS

SEQ ID NO: 636523 - protein, 9 aa, Homo Sapiens
TCGAHVTGV

SEQ ID NO: 636524 - protein, 9 aa, Homo Sapiens
CGWCVLHKT

SEQ ID NO: 636525 - protein, 9 aa, Homo Sapiens
TWGIESDEE

SEQ ID NO: 636526 - protein, 9 aa, Homo Sapiens
LLAPLSLPA

SEQ ID NO: 636527 - protein, 9 aa, Homo Sapiens
MRHNWKLKY

SEQ ID NO: 636528 - protein, 9 aa, Homo Sapiens
IIIFHHELN

SEQ ID NO: 636529 - protein, 9 aa, Homo Sapiens
GKDGQDRHD

SEQ ID NO: 636530 - protein, 9 aa, Homo Sapiens
NLVEYLDVN

SEQ ID NO: 636531 - protein, 9 aa, Homo Sapiens
PTTEGPTDA

SEQ ID NO: 636532 - protein, 9 aa, Homo Sapiens
PWRWLPVAG

SEQ ID NO: 636533 - protein, 9 aa, Homo Sapiens
GSKTSGITF

SEQ ID NO: 636534 - protein, 9 aa, Homo Sapiens
LLSNMSRDP

SEQ ID NO: 636535 - protein, 9 aa, Homo Sapiens
NVVTVHRQS

SEQ ID NO: 636536 - protein, 9 aa, Homo Sapiens
RKPWAQPTP

SEQ ID NO: 636537 - protein, 9 aa, Homo Sapiens
DRASVAAER

SEQ ID NO: 636538 - protein, 9 aa, Homo Sapiens
SPQGMVKAV

SEQ ID NO: 636539 - protein, 9 aa, Homo Sapiens
KKTELWITR

SEQ ID NO: 636540 - protein, 9 aa, Homo Sapiens
DCSRPSSGT

SEQ ID NO: 636541 - protein, 9 aa, Homo Sapiens
LTVEGRFAK

SEQ ID NO: 636542 - protein, 9 aa, Homo Sapiens
GAISDLEDD

SEQ ID NO: 636543 - protein, 9 aa, Homo Sapiens
MTSGRSWVG

SEQ ID NO: 636544 - protein, 9 aa, Homo Sapiens
QAIKKNPGI

SEQ ID NO: 636545 - protein, 9 aa, Homo Sapiens
IIKMHLIVA

SEQ ID NO: 636546 - protein, 9 aa, Homo Sapiens
MRMKLLQEE

SEQ ID NO: 636547 - protein, 9 aa, Homo Sapiens
RKPKVLPHS

SEQ ID NO: 636548 - protein, 9 aa, Homo Sapiens
HAATTAPFD

SEQ ID NO: 636549 - protein, 9 aa, Homo Sapiens
FGYRSGCVC

SEQ ID NO: 636550 - protein, 9 aa, Homo Sapiens
NSVLISRPS

SEQ ID NO: 636551 - protein, 9 aa, Homo Sapiens
GPSGAGPGG

SEQ ID NO: 636552 - protein, 9 aa, Homo Sapiens
GADPSTRNW

SEQ ID NO: 636553 - protein, 9 aa, Homo Sapiens
PLVPLPFAC

SEQ ID NO: 636554 - protein, 9 aa, Homo Sapiens
RFSESQTPR

SEQ ID NO: 636555 - protein, 9 aa, Homo Sapiens
QFTVTPKYQ

SEQ ID NO: 636556 - protein, 9 aa, Homo Sapiens
ERHLQGRLR

SEQ ID NO: 636557 - protein, 9 aa, Homo Sapiens
SPGEGGPVQ

SEQ ID NO: 636558 - protein, 9 aa, Homo Sapiens
LCCAVHCLL

SEQ ID NO: 636559 - protein, 9 aa, Homo Sapiens
AGFFGPQCK

SEQ ID NO: 636560 - protein, 9 aa, Homo Sapiens
AVHCLLGAV

SEQ ID NO: 636561 - protein, 9 aa, Homo Sapiens
SLAEKDAHL

SEQ ID NO: 636562 - protein, 9 aa, Homo Sapiens
AQHGFLHST

SEQ ID NO: 636563 - protein, 9 aa, Homo Sapiens
HENDISAYT

SEQ ID NO: 636564 - protein, 9 aa, Homo Sapiens
ANSVLISRP

SEQ ID NO: 636565 - protein, 9 aa, Homo Sapiens
SAFVNYIFF

SEQ ID NO: 636566 - protein, 9 aa, Homo Sapiens
MEVAMAVRV

SEQ ID NO: 636567 - protein, 9 aa, Homo Sapiens
HHLDRIHLH

SEQ ID NO: 636568 - protein, 9 aa, Homo Sapiens
AALLKVVAA

SEQ ID NO: 636569 - protein, 9 aa, Homo Sapiens
HLSFEFRHC

SEQ ID NO: 636570 - protein, 9 aa, Homo Sapiens
NHGGTYRCF

SEQ ID NO: 636571 - protein, 9 aa, Homo Sapiens
SPQYLHSQE

SEQ ID NO: 636572 - protein, 9 aa, Homo Sapiens
QVKELNPYE

SEQ ID NO: 636573 - protein, 9 aa, Homo Sapiens
KGYINEKNF

SEQ ID NO: 636574 - protein, 9 aa, Homo Sapiens
CIVVQLFKG

SEQ ID NO: 636575 - protein, 9 aa, Homo Sapiens
SHKSSPTSA

SEQ ID NO: 636576 - protein, 9 aa, Homo Sapiens
HENLVEYLD

SEQ ID NO: 636577 - protein, 9 aa, Homo Sapiens
PTEYRPPPP

SEQ ID NO: 636578 - protein, 9 aa, Homo Sapiens
PDEGVYTCL

SEQ ID NO: 636579 - protein, 9 aa, Homo Sapiens
EKEKIIMKQ

SEQ ID NO: 636580 - protein, 9 aa, Homo Sapiens
YDGSPRAHI

SEQ ID NO: 636581 - protein, 9 aa, Homo Sapiens
MTASRLLQL

SEQ ID NO: 636582 - protein, 9 aa, Homo Sapiens
DHSVSQPVM

SEQ ID NO: 636583 - protein, 9 aa, Homo Sapiens
QHHLQTHTG

SEQ ID NO: 636584 - protein, 9 aa, Homo Sapiens
SPKDLIGVL

SEQ ID NO: 636585 - protein, 9 aa, Homo Sapiens
RFVKFSRDV

SEQ ID NO: 636586 - protein, 9 aa, Homo Sapiens
GSFKFMYVD

SEQ ID NO: 636587 - protein, 9 aa, Homo Sapiens
PAVLPPFAR

SEQ ID NO: 636588 - protein, 9 aa, Homo Sapiens
SIEESRPLD

SEQ ID NO: 636589 - protein, 9 aa, Homo Sapiens
DFPLGPANH

SEQ ID NO: 636590 - protein, 9 aa, Homo Sapiens
ERSFECLMC

SEQ ID NO: 636591 - protein, 9 aa, Homo Sapiens
FFNSFAITA

SEQ ID NO: 636592 - protein, 9 aa, Homo Sapiens
MCWMLAREV

SEQ ID NO: 636593 - protein, 9 aa, Homo Sapiens
YNAVSLNME

SEQ ID NO: 636594 - protein, 9 aa, Homo Sapiens
QEPLRPGGP

SEQ ID NO: 636595 - protein, 9 aa, Homo Sapiens
PQYLHSQED

SEQ ID NO: 636596 - protein, 9 aa, Homo Sapiens
GAGAGEPGC

SEQ ID NO: 636597 - protein, 9 aa, Homo Sapiens
YDSGGQVYL

SEQ ID NO: 636598 - protein, 9 aa, Homo Sapiens
SFKGYINEK

SEQ ID NO: 636599 - protein, 9 aa, Homo Sapiens
RDDIRSLSD

SEQ ID NO: 636600 - protein, 9 aa, Homo Sapiens
CFFNRRKRK

SEQ ID NO: 636601 - protein, 9 aa, Homo Sapiens
TIFEIVLNR

SEQ ID NO: 636602 - protein, 9 aa, Homo Sapiens
GDEDKDESG

SEQ ID NO: 636603 - protein, 9 aa, Homo Sapiens
RLMRTIFEI

SEQ ID NO: 636604 - protein, 9 aa, Homo Sapiens
YNNPQNQER

SEQ ID NO: 636605 - protein, 9 aa, Homo Sapiens
ANHGGTYRC

SEQ ID NO: 636606 - protein, 9 aa, Homo Sapiens
EKPYTASIP

SEQ ID NO: 636607 - protein, 9 aa, Homo Sapiens
PCLSQSYAY

SEQ ID NO: 636608 - protein, 9 aa, Homo Sapiens
GTCYTLSTN

SEQ ID NO: 636609 - protein, 9 aa, Homo Sapiens
ASPDTQAKH

SEQ ID NO: 636610 - protein, 9 aa, Homo Sapiens
EELEAQHGF

SEQ ID NO: 636611 - protein, 9 aa, Homo Sapiens
AQVEFRFSE

SEQ ID NO: 636612 - protein, 9 aa, Homo Sapiens
DSLFSILHS

SEQ ID NO: 636613 - protein, 9 aa, Homo Sapiens
VQEDLRVGG

SEQ ID NO: 636614 - protein, 9 aa, Homo Sapiens
RIMFSVQEP

SEQ ID NO: 636615 - protein, 9 aa, Homo Sapiens
ELQSLDELG

SEQ ID NO: 636616 - protein, 9 aa, Homo Sapiens
DCILGQSYL

SEQ ID NO: 636617 - protein, 9 aa, Homo Sapiens
LQRFVKFSR

SEQ ID NO: 636618 - protein, 9 aa, Homo Sapiens
GDRSDEPDD

SEQ ID NO: 636619 - protein, 9 aa, Homo Sapiens
RPSVKGPIY

SEQ ID NO: 636620 - protein, 9 aa, Homo Sapiens
RKQILCPEE

SEQ ID NO: 636621 - protein, 9 aa, Homo Sapiens
CCLALEQNV

SEQ ID NO: 636622 - protein, 9 aa, Homo Sapiens
PGSPSDQEN

SEQ ID NO: 636623 - protein, 9 aa, Homo Sapiens
RRWDYSVWL

SEQ ID NO: 636624 - protein, 9 aa, Homo Sapiens
WAQPTPGMS

SEQ ID NO: 636625 - protein, 9 aa, Homo Sapiens
NWENEQPVH

SEQ ID NO: 636626 - protein, 9 aa, Homo Sapiens
LLKNLDIRF

SEQ ID NO: 636627 - protein, 9 aa, Homo Sapiens
LSMWREFYV

SEQ ID NO: 636628 - protein, 9 aa, Homo Sapiens
LTDLAERSA

SEQ ID NO: 636629 - protein, 9 aa, Homo Sapiens
PDSSCTSLS

SEQ ID NO: 636630 - protein, 9 aa, Homo Sapiens
SDYGVTVHC

SEQ ID NO: 636631 - protein, 9 aa, Homo Sapiens
YSLNRNQIV

SEQ ID NO: 636632 - protein, 9 aa, Homo Sapiens
ALGPGGGGQ

SEQ ID NO: 636633 - protein, 9 aa, Homo Sapiens
HAWTLQIHE

SEQ ID NO: 636634 - protein, 9 aa, Homo Sapiens
WELTDTHTS

SEQ ID NO: 636635 - protein, 9 aa, Homo Sapiens
DFEQEIATV

SEQ ID NO: 636636 - protein, 9 aa, Homo Sapiens
HLKSLKTDP

SEQ ID NO: 636637 - protein, 9 aa, Homo Sapiens
VELFSTPGH

SEQ ID NO: 636638 - protein, 9 aa, Homo Sapiens
GITFIKPRT

SEQ ID NO: 636639 - protein, 9 aa, Homo Sapiens
ERNSFLGLS

SEQ ID NO: 636640 - protein, 9 aa, Homo Sapiens
ILTNKQMQI

SEQ ID NO: 636641 - protein, 9 aa, Homo Sapiens
RPDFPSPTS

SEQ ID NO: 636642 - protein, 9 aa, Homo Sapiens
GQLVVLEEK

SEQ ID NO: 636643 - protein, 9 aa, Homo Sapiens
SGSSSSSNG

SEQ ID NO: 636644 - protein, 9 aa, Homo Sapiens
EASLSWGPA

SEQ ID NO: 636645 - protein, 9 aa, Homo Sapiens
LQHHLQTHT

SEQ ID NO: 636646 - protein, 9 aa, Homo Sapiens
IEAAAVAST

SEQ ID NO: 636647 - protein, 9 aa, Homo Sapiens
PTFLWALPT

SEQ ID NO: 636648 - protein, 9 aa, Homo Sapiens
LQRLQEIRE

SEQ ID NO: 636649 - protein, 9 aa, Homo Sapiens
GASFLQRFV

SEQ ID NO: 636650 - protein, 9 aa, Homo Sapiens
RIQKEHLVN

SEQ ID NO: 636651 - protein, 9 aa, Homo Sapiens
ALTHVLVPV

SEQ ID NO: 636652 - protein, 9 aa, Homo Sapiens
LPANGGRDS

SEQ ID NO: 636653 - protein, 9 aa, Homo Sapiens
ILAPASTEP

SEQ ID NO: 636654 - protein, 9 aa, Homo Sapiens
PANHGGTYR

SEQ ID NO: 636655 - protein, 9 aa, Homo Sapiens
FIKPRTRNE

SEQ ID NO: 636656 - protein, 9 aa, Homo Sapiens
MKQIENLEV

SEQ ID NO: 636657 - protein, 9 aa, Homo Sapiens
GEAYLGEVW

SEQ ID NO: 636658 - protein, 9 aa, Homo Sapiens
TVWLCGKLL

SEQ ID NO: 636659 - protein, 9 aa, Homo Sapiens
VGVVGMGHW

SEQ ID NO: 636660 - protein, 9 aa, Homo Sapiens
PVGSSWRRI

SEQ ID NO: 636661 - protein, 9 aa, Homo Sapiens
MEYYNWGRL

SEQ ID NO: 636662 - protein, 9 aa, Homo Sapiens
EKIIMKQIE

SEQ ID NO: 636663 - protein, 9 aa, Homo Sapiens
ILTPNVNED

SEQ ID NO: 636664 - protein, 9 aa, Homo Sapiens
RTLPLVPGP

SEQ ID NO: 636665 - protein, 9 aa, Homo Sapiens
QLDWTVCFG

SEQ ID NO: 636666 - protein, 9 aa, Homo Sapiens
WCATKANYD

SEQ ID NO: 636667 - protein, 9 aa, Homo Sapiens
RQNPKHQNE

SEQ ID NO: 636668 - protein, 9 aa, Homo Sapiens
SPSDQENAT

SEQ ID NO: 636669 - protein, 9 aa, Homo Sapiens
ATPPAHPAA

SEQ ID NO: 636670 - protein, 9 aa, Homo Sapiens
LNPYEASPQ

SEQ ID NO: 636671 - protein, 9 aa, Homo Sapiens
VAQRKPWAQ

SEQ ID NO: 636672 - protein, 9 aa, Homo Sapiens
PPGGAFNWG

SEQ ID NO: 636673 - protein, 9 aa, Homo Sapiens
LVMPLRLVH

SEQ ID NO: 636674 - protein, 9 aa, Homo Sapiens
LPVAGEAPV

SEQ ID NO: 636675 - protein, 9 aa, Homo Sapiens
AFQLLFAEG

SEQ ID NO: 636676 - protein, 9 aa, Homo Sapiens
HGGQCPLGH

SEQ ID NO: 636677 - protein, 9 aa, Homo Sapiens
VGRCGYYVE

SEQ ID NO: 636678 - protein, 9 aa, Homo Sapiens
LAQPVGSSW

SEQ ID NO: 636679 - protein, 9 aa, Homo Sapiens
LFVKVLSQT

SEQ ID NO: 636680 - protein, 9 aa, Homo Sapiens
EKKTELWIT

SEQ ID NO: 636681 - protein, 9 aa, Homo Sapiens
LEKNWIPFA

SEQ ID NO: 636682 - protein, 9 aa, Homo Sapiens
NNLKVDKFI

SEQ ID NO: 636683 - protein, 9 aa, Homo Sapiens
KIIMKQIEN

SEQ ID NO: 636684 - protein, 9 aa, Homo Sapiens
EGGVLPNIQ

SEQ ID NO: 636685 - protein, 9 aa, Homo Sapiens
PSYRPAMCF

SEQ ID NO: 636686 - protein, 9 aa, Homo Sapiens
SGYPSQQPP

SEQ ID NO: 636687 - protein, 9 aa, Homo Sapiens
PEDQLSELK

SEQ ID NO: 636688 - protein, 9 aa, Homo Sapiens
AVGRCGYYV

SEQ ID NO: 636689 - protein, 9 aa, Homo Sapiens
DSTDPLYEE

SEQ ID NO: 636690 - protein, 9 aa, Homo Sapiens
VAARRAVLP

SEQ ID NO: 636691 - protein, 9 aa, Homo Sapiens
GFRVSDYFQ

SEQ ID NO: 636692 - protein, 9 aa, Homo Sapiens
EHAANGPAP

SEQ ID NO: 636693 - protein, 9 aa, Homo Sapiens
LEYVRCFRI

SEQ ID NO: 636694 - protein, 9 aa, Homo Sapiens
ALEQNVTEE

SEQ ID NO: 636695 - protein, 9 aa, Homo Sapiens
CNHLLYGSK

SEQ ID NO: 636696 - protein, 9 aa, Homo Sapiens
VYTCLARNY

SEQ ID NO: 636697 - protein, 9 aa, Homo Sapiens
YVLTSSTGE

SEQ ID NO: 636698 - protein, 9 aa, Homo Sapiens
RARGVPPTE

SEQ ID NO: 636699 - protein, 9 aa, Homo Sapiens
SWVGVAVTM

SEQ ID NO: 636700 - protein, 9 aa, Homo Sapiens
KSILAVGVC

SEQ ID NO: 636701 - protein, 9 aa, Homo Sapiens
LSDYGVTVH

SEQ ID NO: 636702 - protein, 9 aa, Homo Sapiens
SNGVNDSFP

SEQ ID NO: 636703 - protein, 9 aa, Homo Sapiens
LLGLTLGTV

SEQ ID NO: 636704 - protein, 9 aa, Homo Sapiens
FTMMLKSRQ

SEQ ID NO: 636705 - protein, 9 aa, Homo Sapiens
LPSIPVNPI

SEQ ID NO: 636706 - protein, 9 aa, Homo Sapiens
MFSVQEPEP

SEQ ID NO: 636707 - protein, 9 aa, Homo Sapiens
LERASSSLA

SEQ ID NO: 636708 - protein, 9 aa, Homo Sapiens
FECLMCGKA

SEQ ID NO: 636709 - protein, 9 aa, Homo Sapiens
QVEFRFSES

SEQ ID NO: 636710 - protein, 9 aa, Homo Sapiens
PIIPADYAA

SEQ ID NO: 636711 - protein, 9 aa, Homo Sapiens
LGPGGGGQQ

SEQ ID NO: 636712 - protein, 9 aa, Homo Sapiens
RMTSGRSWV

SEQ ID NO: 636713 - protein, 9 aa, Homo Sapiens
SNGGMTASR

SEQ ID NO: 636714 - protein, 9 aa, Homo Sapiens
PSGAGPGGA

SEQ ID NO: 636715 - protein, 9 aa, Homo Sapiens
LQMFSLCLT

SEQ ID NO: 636716 - protein, 9 aa, Homo Sapiens
LPLVPGPLQ

SEQ ID NO: 636717 - protein, 9 aa, Homo Sapiens
ATMEASQPA

SEQ ID NO: 636718 - protein, 9 aa, Homo Sapiens
PPKTAEPVK

SEQ ID NO: 636719 - protein, 9 aa, Homo Sapiens
SLSGSHKSS

SEQ ID NO: 636720 - protein, 9 aa, Homo Sapiens
VNAFYSLNR

SEQ ID NO: 636721 - protein, 9 aa, Homo Sapiens
ILCPEELPG

SEQ ID NO: 636722 - protein, 9 aa, Homo Sapiens
MCRTPEDQL

SEQ ID NO: 636723 - protein, 9 aa, Homo Sapiens
EGDRGPAQV

SEQ ID NO: 636724 - protein, 9 aa, Homo Sapiens
VTIAEGGVL

SEQ ID NO: 636725 - protein, 9 aa, Homo Sapiens
TSGRSWVGV

SEQ ID NO: 636726 - protein, 9 aa, Homo Sapiens
PCVRGEKDP

SEQ ID NO: 636727 - protein, 9 aa, Homo Sapiens
DLPRKQILC

SEQ ID NO: 636728 - protein, 9 aa, Homo Sapiens
FKTALFETL

SEQ ID NO: 636729 - protein, 9 aa, Homo Sapiens
EKLYAKKDS

SEQ ID NO: 636730 - protein, 9 aa, Homo Sapiens
SVFYGTMLF

SEQ ID NO: 636731 - protein, 9 aa, Homo Sapiens
KELNPYEAS

SEQ ID NO: 636732 - protein, 9 aa, Homo Sapiens
GHWHREELE

SEQ ID NO: 636733 - protein, 9 aa, Homo Sapiens
CLYMVTMMV

SEQ ID NO: 636734 - protein, 9 aa, Homo Sapiens
KEHLVNFPR

SEQ ID NO: 636735 - protein, 9 aa, Homo Sapiens
TLVPCWMVY

SEQ ID NO: 636736 - protein, 9 aa, Homo Sapiens
PGSLDNASS

SEQ ID NO: 636737 - protein, 9 aa, Homo Sapiens
TGDVIDDWC

SEQ ID NO: 636738 - protein, 9 aa, Homo Sapiens
GHPAAGHGH

SEQ ID NO: 636739 - protein, 9 aa, Homo Sapiens
VRLRQSVSV

SEQ ID NO: 636740 - protein, 9 aa, Homo Sapiens
GKMDNTTFA

SEQ ID NO: 636741 - protein, 9 aa, Homo Sapiens
RPAMCFTTL

SEQ ID NO: 636742 - protein, 9 aa, Homo Sapiens
AGTEMRMKL

SEQ ID NO: 636743 - protein, 9 aa, Homo Sapiens
PHWSKCGTC

SEQ ID NO: 636744 - protein, 9 aa, Homo Sapiens
QPLNLSSPP

SEQ ID NO: 636745 - protein, 9 aa, Homo Sapiens
LIYELLYEI

SEQ ID NO: 636746 - protein, 9 aa, Homo Sapiens
GYNIEPSEQ

SEQ ID NO: 636747 - protein, 9 aa, Homo Sapiens
VSVFYGTML

SEQ ID NO: 636748 - protein, 9 aa, Homo Sapiens
NGVNDSFPD

SEQ ID NO: 636749 - protein, 9 aa, Homo Sapiens
DGSPRAHIF

SEQ ID NO: 636750 - protein, 9 aa, Homo Sapiens
SSGSWSTFQ

SEQ ID NO: 636751 - protein, 9 aa, Homo Sapiens
SLDGQLVVL

SEQ ID NO: 636752 - protein, 9 aa, Homo Sapiens
YEDLHDGHN

SEQ ID NO: 636753 - protein, 9 aa, Homo Sapiens
MLKSRQNLQ

SEQ ID NO: 636754 - protein, 9 aa, Homo Sapiens
PVAVALTLH

SEQ ID NO: 636755 - protein, 9 aa, Homo Sapiens
AMKTLSSKM

SEQ ID NO: 636756 - protein, 9 aa, Homo Sapiens
VGSFFEAHD

SEQ ID NO: 636757 - protein, 9 aa, Homo Sapiens
VSQQRVQGK

SEQ ID NO: 636758 - protein, 9 aa, Homo Sapiens
WSLFPDLEP

SEQ ID NO: 636759 - protein, 9 aa, Homo Sapiens
QSMYHEVQY

SEQ ID NO: 636760 - protein, 9 aa, Homo Sapiens
LLFPCGQWP

SEQ ID NO: 636761 - protein, 9 aa, Homo Sapiens
GGRDSTDPL

SEQ ID NO: 636762 - protein, 9 aa, Homo Sapiens
IGVLPLAME

SEQ ID NO: 636763 - protein, 9 aa, Homo Sapiens
WGLLRQRLQ

SEQ ID NO: 636764 - protein, 9 aa, Homo Sapiens
NLSIEDPVD

SEQ ID NO: 636765 - protein, 9 aa, Homo Sapiens
ESWELTDTH

SEQ ID NO: 636766 - protein, 9 aa, Homo Sapiens
EQERAKINQ

SEQ ID NO: 636767 - protein, 9 aa, Homo Sapiens
IMFSVQEPE

SEQ ID NO: 636768 - protein, 9 aa, Homo Sapiens
EPRDQEGQV

SEQ ID NO: 636769 - protein, 9 aa, Homo Sapiens
RLSKPPEDD

SEQ ID NO: 636770 - protein, 9 aa, Homo Sapiens
EAEEDEDKM

SEQ ID NO: 636771 - protein, 9 aa, Homo Sapiens
TGRHKNPNP

SEQ ID NO: 636772 - protein, 9 aa, Homo Sapiens
EPRSCPHWS

SEQ ID NO: 636773 - protein, 9 aa, Homo Sapiens
SWELTDTHT

SEQ ID NO: 636774 - protein, 9 aa, Homo Sapiens
QNRDGVLFF

SEQ ID NO: 636775 - protein, 9 aa, Homo Sapiens
PIAPSPSPT

SEQ ID NO: 636776 - protein, 9 aa, Homo Sapiens
LQFMFACIV

SEQ ID NO: 636777 - protein, 9 aa, Homo Sapiens
GALFVKVLS

SEQ ID NO: 636778 - protein, 9 aa, Homo Sapiens
PNGYTSPDS

SEQ ID NO: 636779 - protein, 9 aa, Homo Sapiens
TDLAERSAA

SEQ ID NO: 636780 - protein, 9 aa, Homo Sapiens
YLSSVLSQV

SEQ ID NO: 636781 - protein, 9 aa, Homo Sapiens
AVGVCNVRV

SEQ ID NO: 636782 - protein, 9 aa, Homo Sapiens
GMGHWHREE

SEQ ID NO: 636783 - protein, 9 aa, Homo Sapiens
VHLISRQYD

SEQ ID NO: 636784 - protein, 9 aa, Homo Sapiens
GFFGPQCKP

SEQ ID NO: 636785 - protein, 9 aa, Homo Sapiens
GEVTYCTMG

SEQ ID NO: 636786 - protein, 9 aa, Homo Sapiens
LKHQRLRPD

SEQ ID NO: 636787 - protein, 9 aa, Homo Sapiens
LQPVLDGPP

SEQ ID NO: 636788 - protein, 9 aa, Homo Sapiens
RCEYCNLTQ

SEQ ID NO: 636789 - protein, 9 aa, Homo Sapiens
SLVNLSGSK

SEQ ID NO: 636790 - protein, 9 aa, Homo Sapiens
YMTSISYHP

SEQ ID NO: 636791 - protein, 9 aa, Homo Sapiens
EYVRCFRIK

SEQ ID NO: 636792 - protein, 9 aa, Homo Sapiens
ENLVEYLDV

SEQ ID NO: 636793 - protein, 9 aa, Homo Sapiens
DFPLGSHLE

SEQ ID NO: 636794 - protein, 9 aa, Homo Sapiens
MSDLLAPIL

SEQ ID NO: 636795 - protein, 9 aa, Homo Sapiens
LMRTIFEIV

SEQ ID NO: 636796 - protein, 9 aa, Homo Sapiens
FVLIYELLY

SEQ ID NO: 636797 - protein, 9 aa, Homo Sapiens
EDAAFKKGD

SEQ ID NO: 636798 - protein, 9 aa, Homo Sapiens
ERIPASPSL

SEQ ID NO: 636799 - protein, 9 aa, Homo Sapiens
GGAPQALGL

SEQ ID NO: 636800 - protein, 9 aa, Homo Sapiens
HCGWCVLHK

SEQ ID NO: 636801 - protein, 9 aa, Homo Sapiens
QAAQRSAKW

SEQ ID NO: 636802 - protein, 9 aa, Homo Sapiens
LSSKMGKWC

SEQ ID NO: 636803 - protein, 9 aa, Homo Sapiens
RAAAHGGQC

SEQ ID NO: 636804 - protein, 9 aa, Homo Sapiens
TMEASQPAP

SEQ ID NO: 636805 - protein, 9 aa, Homo Sapiens
LAERSAADL

SEQ ID NO: 636806 - protein, 9 aa, Homo Sapiens
CCAVHCLLG

SEQ ID NO: 636807 - protein, 9 aa, Homo Sapiens
EIGELYVPK

SEQ ID NO: 636808 - protein, 9 aa, Homo Sapiens
DSQSMYHEV

SEQ ID NO: 636809 - protein, 9 aa, Homo Sapiens
WMERKQFMG

SEQ ID NO: 636810 - protein, 9 aa, Homo Sapiens
ECLQNKDLP

SEQ ID NO: 636811 - protein, 9 aa, Homo Sapiens
RNFELQKSE

SEQ ID NO: 636812 - protein, 9 aa, Homo Sapiens
RRPDSSCTS

SEQ ID NO: 636813 - protein, 9 aa, Homo Sapiens
APGFPAVGR

SEQ ID NO: 636814 - protein, 9 aa, Homo Sapiens
MMLKSRQNL

SEQ ID NO: 636815 - protein, 9 aa, Homo Sapiens
NMTEQRRDE

SEQ ID NO: 636816 - protein, 9 aa, Homo Sapiens
FEDFLHENL

SEQ ID NO: 636817 - protein, 9 aa, Homo Sapiens
VALDFEQEI

SEQ ID NO: 636818 - protein, 9 aa, Homo Sapiens
LLLPWRWLP

SEQ ID NO: 636819 - protein, 9 aa, Homo Sapiens
GPALADCSR

SEQ ID NO: 636820 - protein, 9 aa, Homo Sapiens
PHAATTAPF

SEQ ID NO: 636821 - protein, 9 aa, Homo Sapiens
FFEAHDTVD

SEQ ID NO: 636822 - protein, 9 aa, Homo Sapiens
SQSYAYSKS

SEQ ID NO: 636823 - protein, 9 aa, Homo Sapiens
APPPESPPK

SEQ ID NO: 636824 - protein, 9 aa, Homo Sapiens
PCFSSLSSC

SEQ ID NO: 636825 - protein, 9 aa, Homo Sapiens
TSDMLKDTA

SEQ ID NO: 636826 - protein, 9 aa, Homo Sapiens
CAVHCLLGA

SEQ ID NO: 636827 - protein, 9 aa, Homo Sapiens
KQMQIEVAE

SEQ ID NO: 636828 - protein, 9 aa, Homo Sapiens
VFHAWTLQI

SEQ ID NO: 636829 - protein, 9 aa, Homo Sapiens
TSISYHPAC

SEQ ID NO: 636830 - protein, 9 aa, Homo Sapiens
LNRNQIVFP

SEQ ID NO: 636831 - protein, 9 aa, Homo Sapiens
MDNTTFANS

SEQ ID NO: 636832 - protein, 9 aa, Homo Sapiens
DRYMAGCNH

SEQ ID NO: 636833 - protein, 9 aa, Homo Sapiens
LDELGQSTD

SEQ ID NO: 636834 - protein, 9 aa, Homo Sapiens
QVRIDALSE

SEQ ID NO: 636835 - protein, 9 aa, Homo Sapiens
DEGVYTCLA

SEQ ID NO: 636836 - protein, 9 aa, Homo Sapiens
QDRHDGDRG

SEQ ID NO: 636837 - protein, 9 aa, Homo Sapiens
SDYFQYMEI

SEQ ID NO: 636838 - protein, 9 aa, Homo Sapiens
CTSLSGMTS

SEQ ID NO: 636839 - protein, 9 aa, Homo Sapiens
LGPSIFAVV

SEQ ID NO: 636840 - protein, 9 aa, Homo Sapiens
DDSAMKTLS

SEQ ID NO: 636841 - protein, 9 aa, Homo Sapiens
RAPAVRLRQ

SEQ ID NO: 636842 - protein, 9 aa, Homo Sapiens
YPEKRFVHD

SEQ ID NO: 636843 - protein, 9 aa, Homo Sapiens
QFREQLDWT

SEQ ID NO: 636844 - protein, 9 aa, Homo Sapiens
VGVCNVRVK

SEQ ID NO: 636845 - protein, 9 aa, Homo Sapiens
IVISKPLDA

SEQ ID NO: 636846 - protein, 9 aa, Homo Sapiens
TVLPMKKRK

SEQ ID NO: 636847 - protein, 9 aa, Homo Sapiens
FRTLPLVPG

SEQ ID NO: 636848 - protein, 9 aa, Homo Sapiens
DELQHHLQT

SEQ ID NO: 636849 - protein, 9 aa, Homo Sapiens
CTMGFLEKN

SEQ ID NO: 636850 - protein, 9 aa, Homo Sapiens
LKNLDIRFI

SEQ ID NO: 636851 - protein, 9 aa, Homo Sapiens
FSILHSSND

SEQ ID NO: 636852 - protein, 9 aa, Homo Sapiens
WTARRNAWY

SEQ ID NO: 636853 - protein, 9 aa, Homo Sapiens
EARYKAFGK

SEQ ID NO: 636854 - protein, 9 aa, Homo Sapiens
SLNRNQIVF

SEQ ID NO: 636855 - protein, 9 aa, Homo Sapiens
LYSALASAA

SEQ ID NO: 636856 - protein, 9 aa, Homo Sapiens
KDAHLANLR

SEQ ID NO: 636857 - protein, 9 aa, Homo Sapiens
NSPLPSLQN

SEQ ID NO: 636858 - protein, 9 aa, Homo Sapiens
RSSILPPLT

SEQ ID NO: 636859 - protein, 9 aa, Homo Sapiens
SQVRIDALS

SEQ ID NO: 636860 - protein, 9 aa, Homo Sapiens
VARGGEGQL

SEQ ID NO: 636861 - protein, 9 aa, Homo Sapiens
RGGEGQLAR

SEQ ID NO: 636862 - protein, 9 aa, Homo Sapiens
TFANSVLIS

SEQ ID NO: 636863 - protein, 9 aa, Homo Sapiens
LLAPILAEV

SEQ ID NO: 636864 - protein, 9 aa, Homo Sapiens
TQAKHPQDL

SEQ ID NO: 636865 - protein, 9 aa, Homo Sapiens
PPLAPTLIM

SEQ ID NO: 636866 - protein, 9 aa, Homo Sapiens
TPPPPPPEF

SEQ ID NO: 636867 - protein, 9 aa, Homo Sapiens
VPLPFACFV

SEQ ID NO: 636868 - protein, 9 aa, Homo Sapiens
GVQEDLRVG

SEQ ID NO: 636869 - protein, 9 aa, Homo Sapiens
MLRIQKEHL

SEQ ID NO: 636870 - protein, 9 aa, Homo Sapiens
SFQVLSLLL

SEQ ID NO: 636871 - protein, 9 aa, Homo Sapiens
SALCCQSGY

SEQ ID NO: 636872 - protein, 9 aa, Homo Sapiens
SRRLSALCC

SEQ ID NO: 636873 - protein, 9 aa, Homo Sapiens
PQGMVKAVV

SEQ ID NO: 636874 - protein, 9 aa, Homo Sapiens
NMSLLKHQR

SEQ ID NO: 636875 - protein, 9 aa, Homo Sapiens
KNLDIRFIR

SEQ ID NO: 636876 - protein, 9 aa, Homo Sapiens
LWTARRNAW

SEQ ID NO: 636877 - protein, 9 aa, Homo Sapiens
VNPIGYYDA

SEQ ID NO: 636878 - protein, 9 aa, Homo Sapiens
GWCVLHKTC

SEQ ID NO: 636879 - protein, 9 aa, Homo Sapiens
CLQGAGAGE

SEQ ID NO: 636880 - protein, 9 aa, Homo Sapiens
RSFECLMCG

SEQ ID NO: 636881 - protein, 9 aa, Homo Sapiens
SGYTRGGSS

SEQ ID NO: 636882 - protein, 9 aa, Homo Sapiens
TEKPTVPEE

SEQ ID NO: 636883 - protein, 9 aa, Homo Sapiens
EPLRPGGPR

SEQ ID NO: 636884 - protein, 9 aa, Homo Sapiens
CYEKASLQC

SEQ ID NO: 636885 - protein, 9 aa, Homo Sapiens
RDGVLFFLT

SEQ ID NO: 636886 - protein, 9 aa, Homo Sapiens
QERAKINQT

SEQ ID NO: 636887 - protein, 9 aa, Homo Sapiens
TFIKPRTRN

SEQ ID NO: 636888 - protein, 9 aa, Homo Sapiens
SYDGSPRAH

SEQ ID NO: 636889 - protein, 9 aa, Homo Sapiens
SDLYEDLHD

SEQ ID NO: 636890 - protein, 9 aa, Homo Sapiens
ADCSRPSSG

SEQ ID NO: 636891 - protein, 9 aa, Homo Sapiens
PHCEERSSG

SEQ ID NO: 636892 - protein, 9 aa, Homo Sapiens
SSGALTHVL

SEQ ID NO: 636893 - protein, 9 aa, Homo Sapiens
TLCFASILS

SEQ ID NO: 636894 - protein, 9 aa, Homo Sapiens
IFAVVGNLV

SEQ ID NO: 636895 - protein, 9 aa, Homo Sapiens
AAERHLQGR

SEQ ID NO: 636896 - protein, 9 aa, Homo Sapiens
GRQAGGAPQ

SEQ ID NO: 636897 - protein, 9 aa, Homo Sapiens
IWDELYLEP

SEQ ID NO: 636898 - protein, 9 aa, Homo Sapiens
PPPLAPTLI

SEQ ID NO: 636899 - protein, 9 aa, Homo Sapiens
IRSLSDALN

SEQ ID NO: 636900 - protein, 9 aa, Homo Sapiens
FPDWERTNL

SEQ ID NO: 636901 - protein, 9 aa, Homo Sapiens
ARGTLRRSN

SEQ ID NO: 636902 - protein, 9 aa, Homo Sapiens
VGMGHWHRE

SEQ ID NO: 636903 - protein, 9 aa, Homo Sapiens
PPLLAPLSL

SEQ ID NO: 636904 - protein, 9 aa, Homo Sapiens
ILSPGEIMF

SEQ ID NO: 636905 - protein, 9 aa, Homo Sapiens
GYINEKNFV

SEQ ID NO: 636906 - protein, 9 aa, Homo Sapiens
DELGQSTDN

SEQ ID NO: 636907 - protein, 9 aa, Homo Sapiens
HPIIPADYA

SEQ ID NO: 636908 - protein, 9 aa, Homo Sapiens
RGEPAQVEF

SEQ ID NO: 636909 - protein, 9 aa, Homo Sapiens
YQVVLEEHA

SEQ ID NO: 636910 - protein, 9 aa, Homo Sapiens
SLSDALNYP

SEQ ID NO: 636911 - protein, 9 aa, Homo Sapiens
NTQQIHTRM

SEQ ID NO: 636912 - protein, 9 aa, Homo Sapiens
MRLTLMERV

SEQ ID NO: 636913 - protein, 9 aa, Homo Sapiens
SISVADMLV

SEQ ID NO: 636914 - protein, 9 aa, Homo Sapiens
EQKHLLSPD

SEQ ID NO: 636915 - protein, 9 aa, Homo Sapiens
RFRGSHLSF

SEQ ID NO: 636916 - protein, 9 aa, Homo Sapiens
ASFLQRFVK

SEQ ID NO: 636917 - protein, 9 aa, Homo Sapiens
KHSGLGEYA

SEQ ID NO: 636918 - protein, 9 aa, Homo Sapiens
PTVPEEKPT

SEQ ID NO: 636919 - protein, 9 aa, Homo Sapiens
LMCGKAFKR

SEQ ID NO: 636920 - protein, 9 aa, Homo Sapiens
NSFLGLSFE

SEQ ID NO: 636921 - protein, 9 aa, Homo Sapiens
KLTFSSFQV

SEQ ID NO: 636922 - protein, 9 aa, Homo Sapiens
KVTEPGVPT

SEQ ID NO: 636923 - protein, 9 aa, Homo Sapiens
MIAVSVFYG

SEQ ID NO: 636924 - protein, 9 aa, Homo Sapiens
LWRTSCLEG

SEQ ID NO: 636925 - protein, 9 aa, Homo Sapiens
VRGEKDPKG

SEQ ID NO: 636926 - protein, 9 aa, Homo Sapiens
ALCAPGPDG

SEQ ID NO: 636927 - protein, 9 aa, Homo Sapiens
QPVMVQRRP

SEQ ID NO: 636928 - protein, 9 aa, Homo Sapiens
LVPGPLQGL

SEQ ID NO: 636929 - protein, 9 aa, Homo Sapiens
KPAYPLIWL

SEQ ID NO: 636930 - protein, 9 aa, Homo Sapiens
NIFVVSISV

SEQ ID NO: 636931 - protein, 9 aa, Homo Sapiens
DCGDRSDEP

SEQ ID NO: 636932 - protein, 9 aa, Homo Sapiens
KNWIPFANC

SEQ ID NO: 636933 - protein, 9 aa, Homo Sapiens
LEVALCCHA

SEQ ID NO: 636934 - protein, 9 aa, Homo Sapiens
WNKRGINLY

SEQ ID NO: 636935 - protein, 9 aa, Homo Sapiens
VVAARAAGS

SEQ ID NO: 636936 - protein, 9 aa, Homo Sapiens
PAVGRCGYY

SEQ ID NO: 636937 - protein, 9 aa, Homo Sapiens
TPPAHPAAA

SEQ ID NO: 636938 - protein, 9 aa, Homo Sapiens
PSDQENATP

SEQ ID NO: 636939 - protein, 9 aa, Homo Sapiens
NPRPILTII

SEQ ID NO: 636940 - protein, 9 aa, Homo Sapiens
HDGNRISWD

SEQ ID NO: 636941 - protein, 9 aa, Homo Sapiens
RGVPPTEYR

SEQ ID NO: 636942 - protein, 9 aa, Homo Sapiens
TMGFLEKNN

SEQ ID NO: 636943 - protein, 9 aa, Homo Sapiens
KLKYTVPEN

SEQ ID NO: 636944 - protein, 9 aa, Homo Sapiens
VAAKHSGLG

SEQ ID NO: 636945 - protein, 9 aa, Homo Sapiens
LALPRVPCF

SEQ ID NO: 636946 - protein, 9 aa, Homo Sapiens
VRIDALSEV

SEQ ID NO: 636947 - protein, 9 aa, Homo Sapiens
PEIPRNVNI

SEQ ID NO: 636948 - protein, 9 aa, Homo Sapiens
VDTEKPYTA

SEQ ID NO: 636949 - protein, 9 aa, Homo Sapiens
SPSGADGRQ

SEQ ID NO: 636950 - protein, 9 aa, Homo Sapiens
CVLHKTCTR

SEQ ID NO: 636951 - protein, 9 aa, Homo Sapiens
HGFLHSTCG

SEQ ID NO: 636952 - protein, 9 aa, Homo Sapiens
VGGRGCEDY

SEQ ID NO: 636953 - protein, 9 aa, Homo Sapiens
EDEDKMFTM

SEQ ID NO: 636954 - protein, 9 aa, Homo Sapiens
FARGNSEPG

SEQ ID NO: 636955 - protein, 9 aa, Homo Sapiens
ATQKNLSIE

SEQ ID NO: 636956 - protein, 9 aa, Homo Sapiens
DEILTNKQM

SEQ ID NO: 636957 - protein, 9 aa, Homo Sapiens
QILCPEELP

SEQ ID NO: 636958 - protein, 9 aa, Homo Sapiens
AAFKKGDDM

SEQ ID NO: 636959 - protein, 9 aa, Homo Sapiens
LKLVEEEAS

SEQ ID NO: 636960 - protein, 9 aa, Homo Sapiens
QSFNKLLKK

SEQ ID NO: 636961 - protein, 9 aa, Homo Sapiens
ESPPKRNLY

SEQ ID NO: 636962 - protein, 9 aa, Homo Sapiens
HPGDHDRAP

SEQ ID NO: 636963 - protein, 9 aa, Homo Sapiens
TFTPSSWIA

SEQ ID NO: 636964 - protein, 9 aa, Homo Sapiens
HEKVEIIAN

SEQ ID NO: 636965 - protein, 9 aa, Homo Sapiens
DKEDSWRDS

SEQ ID NO: 636966 - protein, 9 aa, Homo Sapiens
DAIHLGSLI

SEQ ID NO: 636967 - protein, 9 aa, Homo Sapiens
YETIISYFD

SEQ ID NO: 636968 - protein, 9 aa, Homo Sapiens
ETVLPMKKR

SEQ ID NO: 636969 - protein, 9 aa, Homo Sapiens
SSLAAVGSL

SEQ ID NO: 636970 - protein, 9 aa, Homo Sapiens
LGAGPSGAG

SEQ ID NO: 636971 - protein, 9 aa, Homo Sapiens
VVEMHENDI

SEQ ID NO: 636972 - protein, 9 aa, Homo Sapiens
SPTKECIEP

SEQ ID NO: 636973 - protein, 9 aa, Homo Sapiens
TAVAQRKPW

SEQ ID NO: 636974 - protein, 9 aa, Homo Sapiens
RVRQEVPPG

SEQ ID NO: 636975 - protein, 9 aa, Homo Sapiens
ERASSSLAA

SEQ ID NO: 636976 - protein, 9 aa, Homo Sapiens
KTELWITRI

SEQ ID NO: 636977 - protein, 9 aa, Homo Sapiens
RAKANPSCS

SEQ ID NO: 636978 - protein, 9 aa, Homo Sapiens
GYTRGGSSY

SEQ ID NO: 636979 - protein, 9 aa, Homo Sapiens
MAAPSSGSW

SEQ ID NO: 636980 - protein, 9 aa, Homo Sapiens
VPPTEYRPP

SEQ ID NO: 636981 - protein, 9 aa, Homo Sapiens
PSIPVNPIG

SEQ ID NO: 636982 - protein, 9 aa, Homo Sapiens
LLASPDTQA

SEQ ID NO: 636983 - protein, 9 aa, Homo Sapiens
CVGVFQHEK

SEQ ID NO: 636984 - protein, 9 aa, Homo Sapiens
VQETVLPMK

SEQ ID NO: 636985 - protein, 9 aa, Homo Sapiens
FDLYSALAS

SEQ ID NO: 636986 - protein, 9 aa, Homo Sapiens
RLYTVVPHL

SEQ ID NO: 636987 - protein, 9 aa, Homo Sapiens
NGTMEPSGE

SEQ ID NO: 636988 - protein, 9 aa, Homo Sapiens
EPGCQREPP

SEQ ID NO: 636989 - protein, 9 aa, Homo Sapiens
EQELADSAV

SEQ ID NO: 636990 - protein, 9 aa, Homo Sapiens
VKELNPYEA

SEQ ID NO: 636991 - protein, 9 aa, Homo Sapiens
AYLGEVWQR

SEQ ID NO: 636992 - protein, 9 aa, Homo Sapiens
HTIERNSFL

SEQ ID NO: 636993 - protein, 9 aa, Homo Sapiens
WTLQIHESH

SEQ ID NO: 636994 - protein, 9 aa, Homo Sapiens
ELYVPKFSI

SEQ ID NO: 636995 - protein, 9 aa, Homo Sapiens
SSPQGMVKA

SEQ ID NO: 636996 - protein, 9 aa, Homo Sapiens
SILHSSNDT

SEQ ID NO: 636997 - protein, 9 aa, Homo Sapiens
TARRNAWYA

SEQ ID NO: 636998 - protein, 9 aa, Homo Sapiens
IRSQAIKKN

SEQ ID NO: 636999 - protein, 9 aa, Homo Sapiens
GQVRVARGG

SEQ ID NO: 637000 - protein, 9 aa, Homo Sapiens
PKVLPHSHV

SEQ ID NO: 637001 - protein, 9 aa, Homo Sapiens
GEPAQVEFR

SEQ ID NO: 637002 - protein, 9 aa, Homo Sapiens
TLPLVPGPL

SEQ ID NO: 637003 - protein, 9 aa, Homo Sapiens
GTVWLCGKL

SEQ ID NO: 637004 - protein, 9 aa, Homo Sapiens
YTASIPELA

SEQ ID NO: 637005 - protein, 9 aa, Homo Sapiens
PLDIDCLQR

SEQ ID NO: 637006 - protein, 9 aa, Homo Sapiens
QKLFSPQTR

SEQ ID NO: 637007 - protein, 9 aa, Homo Sapiens
NLYEPKLGA

SEQ ID NO: 637008 - protein, 9 aa, Homo Sapiens
NTTFANSVL

SEQ ID NO: 637009 - protein, 9 aa, Homo Sapiens
VEGRFAKQL

SEQ ID NO: 637010 - protein, 9 aa, Homo Sapiens
PTLARSHNV

SEQ ID NO: 637011 - protein, 9 aa, Homo Sapiens
SRLWTARRN

SEQ ID NO: 637012 - protein, 9 aa, Homo Sapiens
HSVSQPVMV

SEQ ID NO: 637013 - protein, 9 aa, Homo Sapiens
FREIGELYV

SEQ ID NO: 637014 - protein, 9 aa, Homo Sapiens
MGGMNPRPI

SEQ ID NO: 637015 - protein, 9 aa, Homo Sapiens
ALVMPLRLV

SEQ ID NO: 637016 - protein, 9 aa, Homo Sapiens
ECVRCFSRL

SEQ ID NO: 637017 - protein, 9 aa, Homo Sapiens
GVCDFPLGS

SEQ ID NO: 637018 - protein, 9 aa, Homo Sapiens
GVVGMGHWH

SEQ ID NO: 637019 - protein, 9 aa, Homo Sapiens
TDRFAFQLL

SEQ ID NO: 637020 - protein, 9 aa, Homo Sapiens
FLWALPTTE

SEQ ID NO: 637021 - protein, 9 aa, Homo Sapiens
EAYLGEVWQ

SEQ ID NO: 637022 - protein, 9 aa, Homo Sapiens
SGITFIKPR

SEQ ID NO: 637023 - protein, 9 aa, Homo Sapiens
SISYHPACY

SEQ ID NO: 637024 - protein, 9 aa, Homo Sapiens
QGAGAGEPG

SEQ ID NO: 637025 - protein, 9 aa, Homo Sapiens
VGSSWRRIA

SEQ ID NO: 637026 - protein, 9 aa, Homo Sapiens
TDQLTEEQV

SEQ ID NO: 637027 - protein, 9 aa, Homo Sapiens
LPRKQILCP

SEQ ID NO: 637028 - protein, 9 aa, Homo Sapiens
AGPSPRIMF

SEQ ID NO: 637029 - protein, 9 aa, Homo Sapiens
GPANHGGTY

SEQ ID NO: 637030 - protein, 9 aa, Homo Sapiens
QSLAEKDAH

SEQ ID NO: 637031 - protein, 9 aa, Homo Sapiens
VHCSTDFRG

SEQ ID NO: 637032 - protein, 9 aa, Homo Sapiens
YRTQYSRQK

SEQ ID NO: 637033 - protein, 9 aa, Homo Sapiens
PSSGTFILA

SEQ ID NO: 637034 - protein, 9 aa, Homo Sapiens
SDPRKSQLH

SEQ ID NO: 637035 - protein, 9 aa, Homo Sapiens
NVKGNVCHR

SEQ ID NO: 637036 - protein, 9 aa, Homo Sapiens
SRKAERRTT

SEQ ID NO: 637037 - protein, 9 aa, Homo Sapiens
APTLIMENL

SEQ ID NO: 637038 - protein, 9 aa, Homo Sapiens
EAAKIKKKS

SEQ ID NO: 637039 - protein, 9 aa, Homo Sapiens
KEQKHLLSP

SEQ ID NO: 637040 - protein, 9 aa, Homo Sapiens
KQPGKERRQ

SEQ ID NO: 637041 - protein, 9 aa, Homo Sapiens
HVTGVSIYY

SEQ ID NO: 637042 - protein, 9 aa, Homo Sapiens
FKGYINEKN

SEQ ID NO: 637043 - protein, 9 aa, Homo Sapiens
KEATSDMLK

SEQ ID NO: 637044 - protein, 9 aa, Homo Sapiens
VQALLGSQP

SEQ ID NO: 637045 - protein, 9 aa, Homo Sapiens
NLEKMCRTP

SEQ ID NO: 637046 - protein, 9 aa, Homo Sapiens
LEPRDQEGQ

SEQ ID NO: 637047 - protein, 9 aa, Homo Sapiens
SSQVLWINA

SEQ ID NO: 637048 - protein, 9 aa, Homo Sapiens
GVYTCLARN

SEQ ID NO: 637049 - protein, 9 aa, Homo Sapiens
SSKMGKWCR

SEQ ID NO: 637050 - protein, 9 aa, Homo Sapiens
GINLYEPKL

SEQ ID NO: 637051 - protein, 9 aa, Homo Sapiens
IIYSVNTQQ

SEQ ID NO: 637052 - protein, 9 aa, Homo Sapiens
CPHWSKCGT

SEQ ID NO: 637053 - protein, 9 aa, Homo Sapiens
AVLSVFENI

SEQ ID NO: 637054 - protein, 9 aa, Homo Sapiens
VTLLVSRKC

SEQ ID NO: 637055 - protein, 9 aa, Homo Sapiens
PPPPPPEFR

SEQ ID NO: 637056 - protein, 9 aa, Homo Sapiens
VTEPGVPTE

SEQ ID NO: 637057 - protein, 9 aa, Homo Sapiens
TLIMENLKN

SEQ ID NO: 637058 - protein, 9 aa, Homo Sapiens
THIFLLSLA

SEQ ID NO: 637059 - protein, 9 aa, Homo Sapiens
KEDSWRDSA

SEQ ID NO: 637060 - protein, 9 aa, Homo Sapiens
WCCCFFNRR

SEQ ID NO: 637061 - protein, 9 aa, Homo Sapiens
SWIASEVTV

SEQ ID NO: 637062 - protein, 9 aa, Homo Sapiens
QERSFECLM

SEQ ID NO: 637063 - protein, 9 aa, Homo Sapiens
GTIVISKPL

SEQ ID NO: 637064 - protein, 9 aa, Homo Sapiens
YNWGRLSKP

SEQ ID NO: 637065 - protein, 9 aa, Homo Sapiens
SISSILARV

SEQ ID NO: 637066 - protein, 9 aa, Homo Sapiens
HDRAPAVRL

SEQ ID NO: 637067 - protein, 9 aa, Homo Sapiens
IVWGNYGWM

SEQ ID NO: 637068 - protein, 9 aa, Homo Sapiens
SGAGPGGAR

SEQ ID NO: 637069 - protein, 9 aa, Homo Sapiens
VLLEERRPS

SEQ ID NO: 637070 - protein, 9 aa, Homo Sapiens
CQREPPGGA

SEQ ID NO: 637071 - protein, 9 aa, Homo Sapiens
EATSDMLKD

SEQ ID NO: 637072 - protein, 9 aa, Homo Sapiens
CCCFFNRRK

SEQ ID NO: 637073 - protein, 9 aa, Homo Sapiens
PGPLQGLTN

SEQ ID NO: 637074 - protein, 9 aa, Homo Sapiens
PLGPANHGG

SEQ ID NO: 637075 - protein, 9 aa, Homo Sapiens
DPLMLDVVR

SEQ ID NO: 637076 - protein, 9 aa, Homo Sapiens
SQGFGNSLG

SEQ ID NO: 637077 - protein, 9 aa, Homo Sapiens
WREFYVLTS

SEQ ID NO: 637078 - protein, 9 aa, Homo Sapiens
LGHPAAGHG

SEQ ID NO: 637079 - protein, 9 aa, Homo Sapiens
EDLRVGGRG

SEQ ID NO: 637080 - protein, 9 aa, Homo Sapiens
LRERLIDSL

SEQ ID NO: 637081 - protein, 9 aa, Homo Sapiens
VEEEASILG

SEQ ID NO: 637082 - protein, 9 aa, Homo Sapiens
DLANMRLTL

SEQ ID NO: 637083 - protein, 9 aa, Homo Sapiens
REVPRKPKV

SEQ ID NO: 637084 - protein, 9 aa, Homo Sapiens
SLSKDCILG

SEQ ID NO: 637085 - protein, 9 aa, Homo Sapiens
LAEKDAHLA

SEQ ID NO: 637086 - protein, 9 aa, Homo Sapiens
PHKFGYCVP

SEQ ID NO: 637087 - protein, 9 aa, Homo Sapiens
NASSPLASA

SEQ ID NO: 637088 - protein, 9 aa, Homo Sapiens
SGTEHHASL

SEQ ID NO: 637089 - protein, 9 aa, Homo Sapiens
YKKHSSLAQ

SEQ ID NO: 637090 - protein, 9 aa, Homo Sapiens
MWREFYVLT

SEQ ID NO: 637091 - protein, 9 aa, Homo Sapiens
WEETSDPRK

SEQ ID NO: 637092 - protein, 9 aa, Homo Sapiens
PPAVLPPFA

SEQ ID NO: 637093 - protein, 9 aa, Homo Sapiens
PSQGFGNSL

SEQ ID NO: 637094 - protein, 9 aa, Homo Sapiens
QENATPKLF

SEQ ID NO: 637095 - protein, 9 aa, Homo Sapiens
YEKASLQCL

SEQ ID NO: 637096 - protein, 9 aa, Homo Sapiens
PPPESPPKR

SEQ ID NO: 637097 - protein, 9 aa, Homo Sapiens
AVLPAEGDR

SEQ ID NO: 637098 - protein, 9 aa, Homo Sapiens
VTMTTVGYR

SEQ ID NO: 637099 - protein, 9 aa, Homo Sapiens
HREELEHRP

SEQ ID NO: 637100 - protein, 9 aa, Homo Sapiens
GPNGKQLHP

SEQ ID NO: 637101 - protein, 9 aa, Homo Sapiens
FVHDGNRIS

SEQ ID NO: 637102 - protein, 9 aa, Homo Sapiens
ELTVEGRFA

SEQ ID NO: 637103 - protein, 9 aa, Homo Sapiens
PSGADGRQA

SEQ ID NO: 637104 - protein, 9 aa, Homo Sapiens
IATVASSSS

SEQ ID NO: 637105 - protein, 9 aa, Homo Sapiens
AERRTTLVL

SEQ ID NO: 637106 - protein, 9 aa, Homo Sapiens
QVRVARGGE

SEQ ID NO: 637107 - protein, 9 aa, Homo Sapiens
KVGSFKFMY

SEQ ID NO: 637108 - protein, 9 aa, Homo Sapiens
VTLVPCWMV

SEQ ID NO: 637109 - protein, 9 aa, Homo Sapiens
GNTCYEKAS

SEQ ID NO: 637110 - protein, 9 aa, Homo Sapiens
GMNPRPILT

SEQ ID NO: 637111 - protein, 9 aa, Homo Sapiens
GYPSQQPPS

SEQ ID NO: 637112 - protein, 9 aa, Homo Sapiens
GAHSVGLMC

SEQ ID NO: 637113 - protein, 9 aa, Homo Sapiens
TESSGNYGY

SEQ ID NO: 637114 - protein, 9 aa, Homo Sapiens
LHWLLGDPT

SEQ ID NO: 637115 - protein, 9 aa, Homo Sapiens
GYPHCEERS

SEQ ID NO: 637116 - protein, 9 aa, Homo Sapiens
CYSGYTRGG

SEQ ID NO: 637117 - protein, 9 aa, Homo Sapiens
HDALGPGGG

SEQ ID NO: 637118 - protein, 9 aa, Homo Sapiens
TTAPFDTEE

SEQ ID NO: 637119 - protein, 9 aa, Homo Sapiens
NLDIRFIRS

SEQ ID NO: 637120 - protein, 9 aa, Homo Sapiens
PAYPLIWLA

SEQ ID NO: 637121 - protein, 9 aa, Homo Sapiens
GLLRQRLQC

SEQ ID NO: 637122 - protein, 9 aa, Homo Sapiens
SNYLEKNWI

SEQ ID NO: 637123 - protein, 9 aa, Homo Sapiens
IESRISQSN

SEQ ID NO: 637124 - protein, 9 aa, Homo Sapiens
CGAHVTGVS

SEQ ID NO: 637125 - protein, 9 aa, Homo Sapiens
YATGRHKNP

SEQ ID NO: 637126 - protein, 9 aa, Homo Sapiens
RSFGYRSGC

SEQ ID NO: 637127 - protein, 9 aa, Homo Sapiens
TEMRMKLLQ

SEQ ID NO: 637128 - protein, 9 aa, Homo Sapiens
SVLSQVRID

SEQ ID NO: 637129 - protein, 9 aa, Homo Sapiens
PSEQELADS

SEQ ID NO: 637130 - protein, 9 aa, Homo Sapiens
RSSFTASEG

SEQ ID NO: 637131 - protein, 9 aa, Homo Sapiens
SLCIPNGYT

SEQ ID NO: 637132 - protein, 9 aa, Homo Sapiens
TPVGRSSFT

SEQ ID NO: 637133 - protein, 9 aa, Homo Sapiens
SSSLAAVGS

SEQ ID NO: 637134 - protein, 9 aa, Homo Sapiens
CALCAPGPD

SEQ ID NO: 637135 - protein, 9 aa, Homo Sapiens
YTRGGSSYP

SEQ ID NO: 637136 - protein, 9 aa, Homo Sapiens
TISNPYPPS

SEQ ID NO: 637137 - protein, 9 aa, Homo Sapiens
VPSKDRAKA

SEQ ID NO: 637138 - protein, 9 aa, Homo Sapiens
PPPIAPSPS

SEQ ID NO: 637139 - protein, 9 aa, Homo Sapiens
GLTLGTVWL

SEQ ID NO: 637140 - protein, 9 aa, Homo Sapiens
GSQEWEETS

SEQ ID NO: 637141 - protein, 9 aa, Homo Sapiens
ALPTTEGPT

SEQ ID NO: 637142 - protein, 9 aa, Homo Sapiens
KCVSHIGAI

SEQ ID NO: 637143 - protein, 9 aa, Homo Sapiens
PRPILTIIT

SEQ ID NO: 637144 - protein, 9 aa, Homo Sapiens
TQKNLSIEE

SEQ ID NO: 637145 - protein, 9 aa, Homo Sapiens
TPPDSPPLL

SEQ ID NO: 637146 - protein, 9 aa, Homo Sapiens
VSLSGSHKS

SEQ ID NO: 637147 - protein, 9 aa, Homo Sapiens
PENQRSKAP

SEQ ID NO: 637148 - protein, 9 aa, Homo Sapiens
RPGGPRRVN

SEQ ID NO: 637149 - protein, 9 aa, Homo Sapiens
RLWTARRNA

SEQ ID NO: 637150 - protein, 9 aa, Homo Sapiens
GWMERKQFM

SEQ ID NO: 637151 - protein, 9 aa, Homo Sapiens
ERRPSDSAQ

SEQ ID NO: 637152 - protein, 9 aa, Homo Sapiens
NKRMRTVTH

SEQ ID NO: 637153 - protein, 9 aa, Homo Sapiens
QNQERSLKF

SEQ ID NO: 637154 - protein, 9 aa, Homo Sapiens
AAGDEDKDE

SEQ ID NO: 637155 - protein, 9 aa, Homo Sapiens
SFGYRSGCV

SEQ ID NO: 637156 - protein, 9 aa, Homo Sapiens
SKPLDAEQR

SEQ ID NO: 637157 - protein, 9 aa, Homo Sapiens
RENQQIGRV

SEQ ID NO: 637158 - protein, 9 aa, Homo Sapiens
RRVRQEVPP

SEQ ID NO: 637159 - protein, 9 aa, Homo Sapiens
MKKRKTRET

SEQ ID NO: 637160 - protein, 9 aa, Homo Sapiens
PGGPRRVNP

SEQ ID NO: 637161 - protein, 9 aa, Homo Sapiens
VGLMCWMLA

SEQ ID NO: 637162 - protein, 9 aa, Homo Sapiens
GALTHVLVP

SEQ ID NO: 637163 - protein, 9 aa, Homo Sapiens
DPTLARSHN

SEQ ID NO: 637164 - protein, 9 aa, Homo Sapiens
AEKDAHLAN

SEQ ID NO: 637165 - protein, 9 aa, Homo Sapiens
CYSITFLII

SEQ ID NO: 637166 - protein, 9 aa, Homo Sapiens
WDELYLEPL

SEQ ID NO: 637167 - protein, 9 aa, Homo Sapiens
ANGGRDSTD

SEQ ID NO: 637168 - protein, 9 aa, Homo Sapiens
TLGLVELFS

SEQ ID NO: 637169 - protein, 9 aa, Homo Sapiens
HRPQHPGDH

SEQ ID NO: 637170 - protein, 9 aa, Homo Sapiens
EDTDRAHST

SEQ ID NO: 637171 - protein, 9 aa, Homo Sapiens
ASPSLRRVG

SEQ ID NO: 637172 - protein, 9 aa, Homo Sapiens
CLLQMFSLC

SEQ ID NO: 637173 - protein, 9 aa, Homo Sapiens
HPAAANGLM

SEQ ID NO: 637174 - protein, 9 aa, Homo Sapiens
LAFRPDFPS

SEQ ID NO: 637175 - protein, 9 aa, Homo Sapiens
YVRCFRIKP

SEQ ID NO: 637176 - protein, 9 aa, Homo Sapiens
ARRNAWYAA

SEQ ID NO: 637177 - protein, 9 aa, Homo Sapiens
PRKQILCPE

SEQ ID NO: 637178 - protein, 9 aa, Homo Sapiens
PPDSPPLLA

SEQ ID NO: 637179 - protein, 9 aa, Homo Sapiens
LVNLSGSKS

SEQ ID NO: 637180 - protein, 9 aa, Homo Sapiens
VKVVTLLVS

SEQ ID NO: 637181 - protein, 9 aa, Homo Sapiens
FSSFQVLSL

SEQ ID NO: 637182 - protein, 9 aa, Homo Sapiens
DQYPYRTQY

SEQ ID NO: 637183 - protein, 9 aa, Homo Sapiens
PDTQAKHPQ

SEQ ID NO: 637184 - protein, 9 aa, Homo Sapiens
MTSISYHPA

SEQ ID NO: 637185 - protein, 9 aa, Homo Sapiens
LIVVIVHYS

SEQ ID NO: 637186 - protein, 9 aa, Homo Sapiens
SHHHHHHHP

SEQ ID NO: 637187 - protein, 9 aa, Homo Sapiens
EVALCCHAS

SEQ ID NO: 637188 - protein, 9 aa, Homo Sapiens
SVGREGRLL

SEQ ID NO: 637189 - protein, 9 aa, Homo Sapiens
MDGYPHCEE

SEQ ID NO: 637190 - protein, 9 aa, Homo Sapiens
AGEPGCQRE

SEQ ID NO: 637191 - protein, 9 aa, Homo Sapiens
WHREELEHR

SEQ ID NO: 637192 - protein, 9 aa, Homo Sapiens
LYREKKTEL

SEQ ID NO: 637193 - protein, 9 aa, Homo Sapiens
MSTLSSESW

SEQ ID NO: 637194 - protein, 9 aa, Homo Sapiens
DPLLHRVMG

SEQ ID NO: 637195 - protein, 9 aa, Homo Sapiens
LLCCAVHCL

SEQ ID NO: 637196 - protein, 9 aa, Homo Sapiens
GPTGKAGSR

SEQ ID NO: 637197 - protein, 9 aa, Homo Sapiens
NFEDFLHEN

SEQ ID NO: 637198 - protein, 9 aa, Homo Sapiens
LANMRLTLM

SEQ ID NO: 637199 - protein, 9 aa, Homo Sapiens
GNSLGNCTS

SEQ ID NO: 637200 - protein, 9 aa, Homo Sapiens
ISSILARVN

SEQ ID NO: 637201 - protein, 9 aa, Homo Sapiens
HSGGPCALC

SEQ ID NO: 637202 - protein, 9 aa, Homo Sapiens
TLSSESWEL

SEQ ID NO: 637203 - protein, 9 aa, Homo Sapiens
MWCCCFFNR

SEQ ID NO: 637204 - protein, 9 aa, Homo Sapiens
AHIFRRNQS

SEQ ID NO: 637205 - protein, 9 aa, Homo Sapiens
LYVDSNGGM

SEQ ID NO: 637206 - protein, 9 aa, Homo Sapiens
GSLDNASSP

SEQ ID NO: 637207 - protein, 9 aa, Homo Sapiens
QETVLPMKK

SEQ ID NO: 637208 - protein, 9 aa, Homo Sapiens
TYCTMGFLE

SEQ ID NO: 637209 - protein, 9 aa, Homo Sapiens
SILAVGVCN

SEQ ID NO: 637210 - protein, 9 aa, Homo Sapiens
VFLALLESA

SEQ ID NO: 637211 - protein, 9 aa, Homo Sapiens
YSQGMSDLL

SEQ ID NO: 637212 - protein, 9 aa, Homo Sapiens
YSRQKNPMT

SEQ ID NO: 637213 - protein, 9 aa, Homo Sapiens
KQIENLEVS

SEQ ID NO: 637214 - protein, 9 aa, Homo Sapiens
KERRQNPKH

SEQ ID NO: 637215 - protein, 9 aa, Homo Sapiens
GVLPLAMEA

SEQ ID NO: 637216 - protein, 9 aa, Homo Sapiens
PADYAAIKA

SEQ ID NO: 637217 - protein, 9 aa, Homo Sapiens
RVSDYFQYM

SEQ ID NO: 637218 - protein, 9 aa, Homo Sapiens
KNVFTMMLK

SEQ ID NO: 637219 - protein, 9 aa, Homo Sapiens
AISDLEDDL

SEQ ID NO: 637220 - protein, 9 aa, Homo Sapiens
FHHELNVQK

SEQ ID NO: 637221 - protein, 9 aa, Homo Sapiens
NYGWMERKQ

SEQ ID NO: 637222 - protein, 9 aa, Homo Sapiens
TFDLYSALA

SEQ ID NO: 637223 - protein, 9 aa, Homo Sapiens
VAAERHLQG

SEQ ID NO: 637224 - protein, 9 aa, Homo Sapiens
LPCLSQSYA

SEQ ID NO: 637225 - protein, 9 aa, Homo Sapiens
PIIYSVNTQ

SEQ ID NO: 637226 - protein, 9 aa, Homo Sapiens
VGTIVISKP

SEQ ID NO: 637227 - protein, 9 aa, Homo Sapiens
DPVAVLSVF

SEQ ID NO: 637228 - protein, 9 aa, Homo Sapiens
PLGSHLEPT

SEQ ID NO: 637229 - protein, 9 aa, Homo Sapiens
LSSESWELT

SEQ ID NO: 637230 - protein, 9 aa, Homo Sapiens
QQMQQGFPN

SEQ ID NO: 637231 - protein, 9 aa, Homo Sapiens
VEMHENDIS

SEQ ID NO: 637232 - protein, 9 aa, Homo Sapiens
YPSQQPPST

SEQ ID NO: 637233 - protein, 9 aa, Homo Sapiens
FYNAVSLNM

SEQ ID NO: 637234 - protein, 9 aa, Homo Sapiens
EEFQIHVFC

SEQ ID NO: 637235 - protein, 9 aa, Homo Sapiens
ALLGSQPSQ

SEQ ID NO: 637236 - protein, 9 aa, Homo Sapiens
WLRAAAFPQ

SEQ ID NO: 637237 - protein, 9 aa, Homo Sapiens
RYKAFGKCV

SEQ ID NO: 637238 - protein, 9 aa, Homo Sapiens
EASILGRKI

SEQ ID NO: 637239 - protein, 9 aa, Homo Sapiens
HMIAVSVFY

SEQ ID NO: 637240 - protein, 9 aa, Homo Sapiens
DKMFTMVTD

SEQ ID NO: 637241 - protein, 9 aa, Homo Sapiens
AGKQLEDGH

SEQ ID NO: 637242 - protein, 9 aa, Homo Sapiens
CEYCNLTQC

SEQ ID NO: 637243 - protein, 9 aa, Homo Sapiens
VAARGTLRR

SEQ ID NO: 637244 - protein, 9 aa, Homo Sapiens
RCFRIKPLG

SEQ ID NO: 637245 - protein, 9 aa, Homo Sapiens
YNIEPSEQE

SEQ ID NO: 637246 - protein, 9 aa, Homo Sapiens
LQEPLRPGG

SEQ ID NO: 637247 - protein, 9 aa, Homo Sapiens
HSGLWRTSC

SEQ ID NO: 637248 - protein, 9 aa, Homo Sapiens
EFQIHVFCC

SEQ ID NO: 637249 - protein, 9 aa, Homo Sapiens
SILGRKIVE

SEQ ID NO: 637250 - protein, 9 aa, Homo Sapiens
CIPNGYTSP

SEQ ID NO: 637251 - protein, 9 aa, Homo Sapiens
EGVCDFPLG

SEQ ID NO: 637252 - protein, 9 aa, Homo Sapiens
SAALLKVVA

SEQ ID NO: 637253 - protein, 9 aa, Homo Sapiens
ENDISAYTY

SEQ ID NO: 637254 - protein, 9 aa, Homo Sapiens
KMHLIVALL

SEQ ID NO: 637255 - protein, 9 aa, Homo Sapiens
RSWVGVAVT

SEQ ID NO: 637256 - protein, 9 aa, Homo Sapiens
DFHSIAGDI

SEQ ID NO: 637257 - protein, 9 aa, Homo Sapiens
DEDAAFKKG

SEQ ID NO: 637258 - protein, 9 aa, Homo Sapiens
VVPHLVKFV

SEQ ID NO: 637259 - protein, 9 aa, Homo Sapiens
GFPAVGRCG

SEQ ID NO: 637260 - protein, 9 aa, Homo Sapiens
RQRLQCKVC

SEQ ID NO: 637261 - protein, 9 aa, Homo Sapiens
ISVADMLVA

SEQ ID NO: 637262 - protein, 9 aa, Homo Sapiens
SILARVNIV

SEQ ID NO: 637263 - protein, 9 aa, Homo Sapiens
HVLAFQGLA

SEQ ID NO: 637264 - protein, 9 aa, Homo Sapiens
TQCGPNGKQ

SEQ ID NO: 637265 - protein, 9 aa, Homo Sapiens
GKMWCATKA

SEQ ID NO: 637266 - protein, 9 aa, Homo Sapiens
IDSLESHHD

SEQ ID NO: 637267 - protein, 9 aa, Homo Sapiens
GRLSKPPED

SEQ ID NO: 637268 - protein, 9 aa, Homo Sapiens
AQPVGSSWR

SEQ ID NO: 637269 - protein, 9 aa, Homo Sapiens
PTLIMENLK

SEQ ID NO: 637270 - protein, 9 aa, Homo Sapiens
ACDVEALTE

SEQ ID NO: 637271 - protein, 9 aa, Homo Sapiens
TKWTFEACL

SEQ ID NO: 637272 - protein, 9 aa, Homo Sapiens
NMRFALKQE

SEQ ID NO: 637273 - protein, 9 aa, Homo Sapiens
NPNPHQNMN

SEQ ID NO: 637274 - protein, 9 aa, Homo Sapiens
FQLLFAEGA

SEQ ID NO: 637275 - protein, 9 aa, Homo Sapiens
SDQENATPK

SEQ ID NO: 637276 - protein, 9 aa, Homo Sapiens
GAHVTGVSI

SEQ ID NO: 637277 - protein, 9 aa, Homo Sapiens
REQLDWTVC

SEQ ID NO: 637278 - protein, 9 aa, Homo Sapiens
VLLAAGADQ

SEQ ID NO: 637279 - protein, 9 aa, Homo Sapiens
RWDYSVWLH

SEQ ID NO: 637280 - protein, 9 aa, Homo Sapiens
PVDAIHLGS

SEQ ID NO: 637281 - protein, 9 aa, Homo Sapiens
EKNWIPFAN

SEQ ID NO: 637282 - protein, 9 aa, Homo Sapiens
TDKLRSSIL

SEQ ID NO: 637283 - protein, 9 aa, Homo Sapiens
LHQFREQLD

SEQ ID NO: 637284 - protein, 9 aa, Homo Sapiens
CYELNFPSS

SEQ ID NO: 637285 - protein, 9 aa, Homo Sapiens
LDKEDSWRD

SEQ ID NO: 637286 - protein, 9 aa, Homo Sapiens
KDCILGQSY

SEQ ID NO: 637287 - protein, 9 aa, Homo Sapiens
INLYEPKLG

SEQ ID NO: 637288 - protein, 9 aa, Homo Sapiens
LSQSYAYSK

SEQ ID NO: 637289 - protein, 9 aa, Homo Sapiens
EEDEDKMFT

SEQ ID NO: 637290 - protein, 9 aa, Homo Sapiens
LGEVWQRAA

SEQ ID NO: 637291 - protein, 9 aa, Homo Sapiens
DEPEEGRKR

SEQ ID NO: 637292 - protein, 9 aa, Homo Sapiens
VGVFQHEKV

SEQ ID NO: 637293 - protein, 9 aa, Homo Sapiens
EDGHSLSDY

SEQ ID NO: 637294 - protein, 9 aa, Homo Sapiens
LGLSFESVI

SEQ ID NO: 637295 - protein, 9 aa, Homo Sapiens
SLSWGPALA

SEQ ID NO: 637296 - protein, 9 aa, Homo Sapiens
APQRCLQGA

SEQ ID NO: 637297 - protein, 9 aa, Homo Sapiens
ARVNIVGTL

SEQ ID NO: 637298 - protein, 9 aa, Homo Sapiens
FVVSISVAD

SEQ ID NO: 637299 - protein, 9 aa, Homo Sapiens
LGLQEPLRP

SEQ ID NO: 637300 - protein, 9 aa, Homo Sapiens
TSQSTIVRR

SEQ ID NO: 637301 - protein, 9 aa, Homo Sapiens
VAVCRPIHY

SEQ ID NO: 637302 - protein, 9 aa, Homo Sapiens
CLMCGKAFK

SEQ ID NO: 637303 - protein, 9 aa, Homo Sapiens
MAERYKMLT

SEQ ID NO: 637304 - protein, 9 aa, Homo Sapiens
DLTRVQTFG

SEQ ID NO: 637305 - protein, 9 aa, Homo Sapiens
PDWERTNLD

SEQ ID NO: 637306 - protein, 9 aa, Homo Sapiens
LYAKKDSKK

SEQ ID NO: 637307 - protein, 9 aa, Homo Sapiens
VEFRFSESQ

SEQ ID NO: 637308 - protein, 9 aa, Homo Sapiens
HNWKLKYTV

SEQ ID NO: 637309 - protein, 9 aa, Homo Sapiens
QEATPPAHP

SEQ ID NO: 637310 - protein, 9 aa, Homo Sapiens
DRAKANPSC

SEQ ID NO: 637311 - protein, 9 aa, Homo Sapiens
RMRTVTHIF

SEQ ID NO: 637312 - protein, 9 aa, Homo Sapiens
WPWRGAGSF

SEQ ID NO: 637313 - protein, 9 aa, Homo Sapiens
IAVSVFYGT

SEQ ID NO: 637314 - protein, 9 aa, Homo Sapiens
ALFVKVLSQ

SEQ ID NO: 637315 - protein, 9 aa, Homo Sapiens
MVRYDSGGQ

SEQ ID NO: 637316 - protein, 9 aa, Homo Sapiens
TVVPHLVKF

SEQ ID NO: 637317 - protein, 9 aa, Homo Sapiens
AQPLNLSSP

SEQ ID NO: 637318 - protein, 9 aa, Homo Sapiens
ESQTPRGQV

SEQ ID NO: 637319 - protein, 9 aa, Homo Sapiens
AAQRSAKWA

SEQ ID NO: 637320 - protein, 9 aa, Homo Sapiens
WVGVAVTME

SEQ ID NO: 637321 - protein, 9 aa, Homo Sapiens
GQFCPTWHC

SEQ ID NO: 637322 - protein, 9 aa, Homo Sapiens
EGEAYLGEV

SEQ ID NO: 637323 - protein, 9 aa, Homo Sapiens
EAEVGRRVR

SEQ ID NO: 637324 - protein, 9 aa, Homo Sapiens
DDLGRLGKT

SEQ ID NO: 637325 - protein, 9 aa, Homo Sapiens
EGRLLRPAG

SEQ ID NO: 637326 - protein, 9 aa, Homo Sapiens
PLSMWREFY

SEQ ID NO: 637327 - protein, 9 aa, Homo Sapiens
ICLYMVTMM

SEQ ID NO: 637328 - protein, 9 aa, Homo Sapiens
AEILLEHGI

SEQ ID NO: 637329 - protein, 9 aa, Homo Sapiens
EHRPQHPGD

SEQ ID NO: 637330 - protein, 9 aa, Homo Sapiens
GPQCKPCPG

SEQ ID NO: 637331 - protein, 9 aa, Homo Sapiens
KKRYTTSSC

SEQ ID NO: 637332 - protein, 9 aa, Homo Sapiens
LTELRNSGG

SEQ ID NO: 637333 - protein, 9 aa, Homo Sapiens
LTTYLDKVT

SEQ ID NO: 637334 - protein, 9 aa, Homo Sapiens
EIEAAAVAS

SEQ ID NO: 637335 - protein, 9 aa, Homo Sapiens
LSRIWDELY

SEQ ID NO: 637336 - protein, 9 aa, Homo Sapiens
ERLIDSLES

SEQ ID NO: 637337 - protein, 9 aa, Homo Sapiens
VLHQFREQL

SEQ ID NO: 637338 - protein, 9 aa, Homo Sapiens
ETTRTRCWN

SEQ ID NO: 637339 - protein, 9 aa, Homo Sapiens
CKPCPGNAQ

SEQ ID NO: 637340 - protein, 9 aa, Homo Sapiens
QSLDELGQS

SEQ ID NO: 637341 - protein, 9 aa, Homo Sapiens
SRPSVKGPI

SEQ ID NO: 637342 - protein, 9 aa, Homo Sapiens
RRPHAATTA

SEQ ID NO: 637343 - protein, 9 aa, Homo Sapiens
VVAENEPSE

SEQ ID NO: 637344 - protein, 9 aa, Homo Sapiens
VGRSSFTAS

SEQ ID NO: 637345 - protein, 9 aa, Homo Sapiens
QYLHSQEDD

SEQ ID NO: 637346 - protein, 9 aa, Homo Sapiens
HKSSPTSAS

SEQ ID NO: 637347 - protein, 9 aa, Homo Sapiens
YSVWLHGEF

SEQ ID NO: 637348 - protein, 9 aa, Homo Sapiens
ENEPSEVTC

SEQ ID NO: 637349 - protein, 9 aa, Homo Sapiens
DYFQYMEIL

SEQ ID NO: 637350 - protein, 9 aa, Homo Sapiens
CKQKPAYPL

SEQ ID NO: 637351 - protein, 9 aa, Homo Sapiens
KDMRNMRFA

SEQ ID NO: 637352 - protein, 9 aa, Homo Sapiens
GHSLSDYNI

SEQ ID NO: 637353 - protein, 9 aa, Homo Sapiens
YFQYMEILE

SEQ ID NO: 637354 - protein, 9 aa, Homo Sapiens
IEPSEQELA

SEQ ID NO: 637355 - protein, 9 aa, Homo Sapiens
ELWITRIPQ

SEQ ID NO: 637356 - protein, 9 aa, Homo Sapiens
KLYKCKVCD

SEQ ID NO: 637357 - protein, 9 aa, Homo Sapiens
SVLIPRFML

SEQ ID NO: 637358 - protein, 9 aa, Homo Sapiens
GGTVSQQRV

SEQ ID NO: 637359 - protein, 9 aa, Homo Sapiens
QGMSDLLAP

SEQ ID NO: 637360 - protein, 9 aa, Homo Sapiens
WIPFANCSY

SEQ ID NO: 637361 - protein, 9 aa, Homo Sapiens
LPFACFVAQ

SEQ ID NO: 637362 - protein, 9 aa, Homo Sapiens
LQGAGAGEP

SEQ ID NO: 637363 - protein, 9 aa, Homo Sapiens
GGMTASRLL

SEQ ID NO: 637364 - protein, 9 aa, Homo Sapiens
VSAAGDEDK

SEQ ID NO: 637365 - protein, 9 aa, Homo Sapiens
FRGSHLSFE

SEQ ID NO: 637366 - protein, 9 aa, Homo Sapiens
QRHGRGEPA

SEQ ID NO: 637367 - protein, 9 aa, Homo Sapiens
SVRCEYCNL

SEQ ID NO: 637368 - protein, 9 aa, Homo Sapiens
FPGKDGQDR

SEQ ID NO: 637369 - protein, 9 aa, Homo Sapiens
ELGQSTDNP

SEQ ID NO: 637370 - protein, 9 aa, Homo Sapiens
GMGKLLTEH

SEQ ID NO: 637371 - protein, 9 aa, Homo Sapiens
FKFMYVDVL

SEQ ID NO: 637372 - protein, 9 aa, Homo Sapiens
RRSLPCLSQ

SEQ ID NO: 637373 - protein, 9 aa, Homo Sapiens
KTCTRKERC

SEQ ID NO: 637374 - protein, 9 aa, Homo Sapiens
YLDKVTEPG

SEQ ID NO: 637375 - protein, 9 aa, Homo Sapiens
SSLSKDCIL

SEQ ID NO: 637376 - protein, 9 aa, Homo Sapiens
KTDPSATDA

SEQ ID NO: 637377 - protein, 9 aa, Homo Sapiens
RSGCVCGPS

SEQ ID NO: 637378 - protein, 9 aa, Homo Sapiens
QERSLKFDG

SEQ ID NO: 637379 - protein, 9 aa, Homo Sapiens
PTGKAGSRG

SEQ ID NO: 637380 - protein, 9 aa, Homo Sapiens
PVAGEAPVL

SEQ ID NO: 637381 - protein, 9 aa, Homo Sapiens
ILLEHGIND

SEQ ID NO: 637382 - protein, 9 aa, Homo Sapiens
FPSPTSSLP

SEQ ID NO: 637383 - protein, 9 aa, Homo Sapiens
YPLIWLADW

SEQ ID NO: 637384 - protein, 9 aa, Homo Sapiens
MLTPFSNPR

SEQ ID NO: 637385 - protein, 9 aa, Homo Sapiens
FFGPQCKPC

SEQ ID NO: 637386 - protein, 9 aa, Homo Sapiens
ITFIKPRTR

SEQ ID NO: 637387 - protein, 9 aa, Homo Sapiens
DGPPHREPG

SEQ ID NO: 637388 - protein, 9 aa, Homo Sapiens
CILGQSYLN

SEQ ID NO: 637389 - protein, 8 aa, Homo Sapiens
APVKISHV

SEQ ID NO: 637390 - protein, 9 aa, Homo Sapiens
ALLKVVAAR

SEQ ID NO: 637391 - protein, 9 aa, Homo Sapiens
SYATGRHKN

SEQ ID NO: 637392 - protein, 9 aa, Homo Sapiens
MPLRLVHEL

SEQ ID NO: 637393 - protein, 9 aa, Homo Sapiens
NFPSSPRIR

SEQ ID NO: 637394 - protein, 9 aa, Homo Sapiens
GNYGYNPSP

SEQ ID NO: 637395 - protein, 9 aa, Homo Sapiens
MRFALKQEG

SEQ ID NO: 637396 - protein, 9 aa, Homo Sapiens
GFGNSLGNC

SEQ ID NO: 637397 - protein, 9 aa, Homo Sapiens
ATTYSGNSL

SEQ ID NO: 637398 - protein, 9 aa, Homo Sapiens
LIGVLPLAM

SEQ ID NO: 637399 - protein, 9 aa, Homo Sapiens
SSSGNGINV

SEQ ID NO: 637400 - protein, 9 aa, Homo Sapiens
SCAVWGRHR

SEQ ID NO: 637401 - protein, 9 aa, Homo Sapiens
VPCWMVYFQ

SEQ ID NO: 637402 - protein, 9 aa, Homo Sapiens
SKDRAKANP

SEQ ID NO: 637403 - protein, 9 aa, Homo Sapiens
NKLLKKLTS

SEQ ID NO: 637404 - protein, 9 aa, Homo Sapiens
TFGIESRIS

SEQ ID NO: 637405 - protein, 9 aa, Homo Sapiens
SGNYGYNPS

SEQ ID NO: 637406 - protein, 9 aa, Homo Sapiens
DEDKDESGE

SEQ ID NO: 637407 - protein, 9 aa, Homo Sapiens
SCEIEAAAV

SEQ ID NO: 637408 - protein, 9 aa, Homo Sapiens
LARSHNVIN

SEQ ID NO: 637409 - protein, 9 aa, Homo Sapiens
SGNIFVVSI

SEQ ID NO: 637410 - protein, 9 aa, Homo Sapiens
HQRLRPDED

SEQ ID NO: 637411 - protein, 9 aa, Homo Sapiens
LFSGTEHHA

SEQ ID NO: 637412 - protein, 9 aa, Homo Sapiens
NWKLKYTVP

SEQ ID NO: 637413 - protein, 9 aa, Homo Sapiens
FGREHAANG

SEQ ID NO: 637414 - protein, 9 aa, Homo Sapiens
QKHLLSPDV

SEQ ID NO: 637415 - protein, 9 aa, Homo Sapiens
RVPCFSSLS

SEQ ID NO: 637416 - protein, 9 aa, Homo Sapiens
TCLARNYLG

SEQ ID NO: 637417 - protein, 9 aa, Homo Sapiens
LSIEDPVDA

SEQ ID NO: 637418 - protein, 9 aa, Homo Sapiens
VHRQSFGTN

SEQ ID NO: 637419 - protein, 9 aa, Homo Sapiens
NFELQKSEA

SEQ ID NO: 637420 - protein, 9 aa, Homo Sapiens
PLLAPLSLP

SEQ ID NO: 637421 - protein, 9 aa, Homo Sapiens
PVMVQRRPG

SEQ ID NO: 637422 - protein, 9 aa, Homo Sapiens
GRGEPAQVE

SEQ ID NO: 637423 - protein, 9 aa, Homo Sapiens
QLEDGHSLS

SEQ ID NO: 637424 - protein, 9 aa, Homo Sapiens
DAVAAKHSG

SEQ ID NO: 637425 - protein, 9 aa, Homo Sapiens
LLWGLLRQR

SEQ ID NO: 637426 - protein, 9 aa, Homo Sapiens
QPVLDGPPH

SEQ ID NO: 637427 - protein, 9 aa, Homo Sapiens
MCFTTLATG

SEQ ID NO: 637428 - protein, 9 aa, Homo Sapiens
KARENQQIG

SEQ ID NO: 637429 - protein, 9 aa, Homo Sapiens
LLEHGINDS

SEQ ID NO: 637430 - protein, 9 aa, Homo Sapiens
SSLDGQLVV

SEQ ID NO: 637431 - protein, 9 aa, Homo Sapiens
FMYVDVLPE

SEQ ID NO: 637432 - protein, 9 aa, Homo Sapiens
VAMAVRVTA

SEQ ID NO: 637433 - protein, 9 aa, Homo Sapiens
PNGKQLHPG

SEQ ID NO: 637434 - protein, 9 aa, Homo Sapiens
SVFENIHVN

SEQ ID NO: 637435 - protein, 9 aa, Homo Sapiens
CVSGAIVHL

SEQ ID NO: 637436 - protein, 9 aa, Homo Sapiens
PEKRFVHDG

SEQ ID NO: 637437 - protein, 9 aa, Homo Sapiens
VSVGREGRL

SEQ ID NO: 637438 - protein, 9 aa, Homo Sapiens
VPCFSSLSS

SEQ ID NO: 637439 - protein, 9 aa, Homo Sapiens
REVFHAWTL

SEQ ID NO: 637440 - protein, 9 aa, Homo Sapiens
VLSQVRIDA

SEQ ID NO: 637441 - protein, 9 aa, Homo Sapiens
DSTGIQNRD

SEQ ID NO: 637442 - protein, 9 aa, Homo Sapiens
SSPRIRKRF

SEQ ID NO: 637443 - protein, 9 aa, Homo Sapiens
RYMAGCNHL

SEQ ID NO: 637444 - protein, 9 aa, Homo Sapiens
ADPSTRNWE

SEQ ID NO: 637445 - protein, 9 aa, Homo Sapiens
MTEQRRDEL

SEQ ID NO: 637446 - protein, 9 aa, Homo Sapiens
IMFIPVKYW

SEQ ID NO: 637447 - protein, 9 aa, Homo Sapiens
DIRFIRSLN

SEQ ID NO: 637448 - protein, 9 aa, Homo Sapiens
STDPLYEEK

SEQ ID NO: 637449 - protein, 9 aa, Homo Sapiens
VALTLHWLL

SEQ ID NO: 637450 - protein, 9 aa, Homo Sapiens
FLHENLVEY

SEQ ID NO: 637451 - protein, 9 aa, Homo Sapiens
KSEVILNKS

SEQ ID NO: 637452 - protein, 9 aa, Homo Sapiens
KDRAKANPS

SEQ ID NO: 637453 - protein, 9 aa, Homo Sapiens
EQNVTEENA

SEQ ID NO: 637454 - protein, 9 aa, Homo Sapiens
KQKPAYPLI

SEQ ID NO: 637455 - protein, 9 aa, Homo Sapiens
DSRTDKLRS

SEQ ID NO: 637456 - protein, 9 aa, Homo Sapiens
ESVSLSGSH

SEQ ID NO: 637457 - protein, 9 aa, Homo Sapiens
IKKNPGIAA

SEQ ID NO: 637458 - protein, 9 aa, Homo Sapiens
HLIVALLFI

SEQ ID NO: 637459 - protein, 9 aa, Homo Sapiens
PAMCFTTLA

SEQ ID NO: 637460 - protein, 9 aa, Homo Sapiens
QMQIEVAEK

SEQ ID NO: 637461 - protein, 9 aa, Homo Sapiens
CCQSGYVRV

SEQ ID NO: 637462 - protein, 9 aa, Homo Sapiens
LCAPGPDGY

SEQ ID NO: 637463 - protein, 9 aa, Homo Sapiens
RRTTLVLWG

SEQ ID NO: 637464 - protein, 9 aa, Homo Sapiens
KMLTPFSNP

SEQ ID NO: 637465 - protein, 9 aa, Homo Sapiens
STCGAHVTG

SEQ ID NO: 637466 - protein, 9 aa, Homo Sapiens
GKLLTEHFL

SEQ ID NO: 637467 - protein, 9 aa, Homo Sapiens
LGEALQRHG

SEQ ID NO: 637468 - protein, 9 aa, Homo Sapiens
SRISQSNIN

SEQ ID NO: 637469 - protein, 9 aa, Homo Sapiens
VLNNLKVDK

SEQ ID NO: 637470 - protein, 9 aa, Homo Sapiens
KATWGIESD

SEQ ID NO: 637471 - protein, 9 aa, Homo Sapiens
TVDDCGDRS

SEQ ID NO: 637472 - protein, 9 aa, Homo Sapiens
LNNLKVDKF

SEQ ID NO: 637473 - protein, 9 aa, Homo Sapiens
SVLISRPSV

SEQ ID NO: 637474 - protein, 9 aa, Homo Sapiens
PGKDGQDRH

SEQ ID NO: 637475 - protein, 9 aa, Homo Sapiens
KTALFETLC

SEQ ID NO: 637476 - protein, 9 aa, Homo Sapiens
RARNFELQK

SEQ ID NO: 637477 - protein, 9 aa, Homo Sapiens
ASTEPRSCP

SEQ ID NO: 637478 - protein, 9 aa, Homo Sapiens
DSPPLLAPL

SEQ ID NO: 637479 - protein, 9 aa, Homo Sapiens
VGRRVRQEV

SEQ ID NO: 637480 - protein, 9 aa, Homo Sapiens
QEWEETSDP

SEQ ID NO: 637481 - protein, 9 aa, Homo Sapiens
WSKCGTCYT

SEQ ID NO: 637482 - protein, 9 aa, Homo Sapiens
RQAGGAPQA

SEQ ID NO: 637483 - protein, 9 aa, Homo Sapiens
ELPGGTVSQ

SEQ ID NO: 637484 - protein, 9 aa, Homo Sapiens
AYPLIWLAD

SEQ ID NO: 637485 - protein, 9 aa, Homo Sapiens
NEPSEVTCL

SEQ ID NO: 637486 - protein, 9 aa, Homo Sapiens
QNKDLPQQL

SEQ ID NO: 637487 - protein, 9 aa, Homo Sapiens
IDDWCRCDS

SEQ ID NO: 637488 - protein, 9 aa, Homo Sapiens
ETIISYFDK

SEQ ID NO: 637489 - protein, 9 aa, Homo Sapiens
GHALSVKVM

SEQ ID NO: 637490 - protein, 9 aa, Homo Sapiens
QTFGFRGEA

SEQ ID NO: 637491 - protein, 9 aa, Homo Sapiens
DDWCRCDST

SEQ ID NO: 637492 - protein, 9 aa, Homo Sapiens
IATVCTLGF

SEQ ID NO: 637493 - protein, 9 aa, Homo Sapiens
NPEPYQAFT

SEQ ID NO: 637494 - protein, 9 aa, Homo Sapiens
QRCLQGAGA

SEQ ID NO: 637495 - protein, 9 aa, Homo Sapiens
PWAQPTPGM

SEQ ID NO: 637496 - protein, 9 aa, Homo Sapiens
TIKLKATWG

SEQ ID NO: 637497 - protein, 9 aa, Homo Sapiens
TQQSLAEKD

SEQ ID NO: 637498 - protein, 9 aa, Homo Sapiens
RSAKWAINR

SEQ ID NO: 637499 - protein, 9 aa, Homo Sapiens
NDISAYTYE

SEQ ID NO: 637500 - protein, 9 aa, Homo Sapiens
GRHRELRNL

SEQ ID NO: 637501 - protein, 9 aa, Homo Sapiens
EDVWNSSNG

SEQ ID NO: 637502 - protein, 9 aa, Homo Sapiens
SLSGMTSAA

SEQ ID NO: 637503 - protein, 9 aa, Homo Sapiens
KIIKMHLIV

SEQ ID NO: 637504 - protein, 9 aa, Homo Sapiens
IGELYVPKF

SEQ ID NO: 637505 - protein, 9 aa, Homo Sapiens
VCRPIHYTV

SEQ ID NO: 637506 - protein, 9 aa, Homo Sapiens
DMLKDTAKI

SEQ ID NO: 637507 - protein, 9 aa, Homo Sapiens
QRRDELSEE

SEQ ID NO: 637508 - protein, 9 aa, Homo Sapiens
GAIVHLISR

SEQ ID NO: 637509 - protein, 9 aa, Homo Sapiens
LPLAMEAEI

SEQ ID NO: 637510 - protein, 9 aa, Homo Sapiens
FLIATVCTL

SEQ ID NO: 637511 - protein, 9 aa, Homo Sapiens
LGSHLEPTN

SEQ ID NO: 637512 - protein, 9 aa, Homo Sapiens
LLTNVVTVH

SEQ ID NO: 637513 - protein, 9 aa, Homo Sapiens
GRLMRTIFE

SEQ ID NO: 637514 - protein, 9 aa, Homo Sapiens
GSFFEAHDT

SEQ ID NO: 637515 - protein, 9 aa, Homo Sapiens
DTEKPYTAS

SEQ ID NO: 637516 - protein, 9 aa, Homo Sapiens
TNGTMEPSG

SEQ ID NO: 637517 - protein, 9 aa, Homo Sapiens
FPAVGRCGY

SEQ ID NO: 637518 - protein, 9 aa, Homo Sapiens
KDLFGKFGH

SEQ ID NO: 637519 - protein, 9 aa, Homo Sapiens
LIIAAPDTI

SEQ ID NO: 637520 - protein, 9 aa, Homo Sapiens
WLRARNFEL

SEQ ID NO: 637521 - protein, 9 aa, Homo Sapiens
TNKQMQIEV

SEQ ID NO: 637522 - protein, 9 aa, Homo Sapiens
RSCPHWSKC

SEQ ID NO: 637523 - protein, 9 aa, Homo Sapiens
QAAKKNVKG

SEQ ID NO: 637524 - protein, 9 aa, Homo Sapiens
EIPRNVNIG

SEQ ID NO: 637525 - protein, 9 aa, Homo Sapiens
LRARNFELQ

SEQ ID NO: 637526 - protein, 9 aa, Homo Sapiens
NLPEIPRNV

SEQ ID NO: 637527 - protein, 9 aa, Homo Sapiens
AGPSGAGPG

SEQ ID NO: 637528 - protein, 9 aa, Homo Sapiens
LLGSQPSQG

SEQ ID NO: 637529 - protein, 9 aa, Homo Sapiens
SNMSRDPLL

SEQ ID NO: 637530 - protein, 9 aa, Homo Sapiens
PSDSAQLLS

SEQ ID NO: 637531 - protein, 9 aa, Homo Sapiens
DWERTNLDL

SEQ ID NO: 637532 - protein, 9 aa, Homo Sapiens
FQYMEILEQ

SEQ ID NO: 637533 - protein, 9 aa, Homo Sapiens
ISDLYEDLH

SEQ ID NO: 637534 - protein, 9 aa, Homo Sapiens
DAHLANLRI

SEQ ID NO: 637535 - protein, 9 aa, Homo Sapiens
KVYIIIFHH

SEQ ID NO: 637536 - protein, 9 aa, Homo Sapiens
ISRKAERRT

SEQ ID NO: 637537 - protein, 9 aa, Homo Sapiens
HSLSDYNIQ

SEQ ID NO: 637538 - protein, 9 aa, Homo Sapiens
FADLTRVQT

SEQ ID NO: 637539 - protein, 9 aa, Homo Sapiens
SGGPCALCA

SEQ ID NO: 637540 - protein, 9 aa, Homo Sapiens
NPIIYSVNT

SEQ ID NO: 637541 - protein, 9 aa, Homo Sapiens
SHLSFEFRH

SEQ ID NO: 637542 - protein, 9 aa, Homo Sapiens
REPPNDPCV

SEQ ID NO: 637543 - protein, 9 aa, Homo Sapiens
MQIEVAEKK

SEQ ID NO: 637544 - protein, 9 aa, Homo Sapiens
CATKANYDD

SEQ ID NO: 637545 - protein, 9 aa, Homo Sapiens
LYNNPQNQE

SEQ ID NO: 637546 - protein, 9 aa, Homo Sapiens
QGFGNSLGN

SEQ ID NO: 637547 - protein, 9 aa, Homo Sapiens
ATKANYDDD

SEQ ID NO: 637548 - protein, 9 aa, Homo Sapiens
LSTNGTMEP

SEQ ID NO: 637549 - protein, 9 aa, Homo Sapiens
LCCHASAVA

SEQ ID NO: 637550 - protein, 9 aa, Homo Sapiens
GNCTSQSTI

SEQ ID NO: 637551 - protein, 9 aa, Homo Sapiens
QRSAKWAIN

SEQ ID NO: 637552 - protein, 9 aa, Homo Sapiens
CCEIKEAVS

SEQ ID NO: 637553 - protein, 9 aa, Homo Sapiens
MRNMRFALK

SEQ ID NO: 637554 - protein, 9 aa, Homo Sapiens
VSISVADML

SEQ ID NO: 637555 - protein, 9 aa, Homo Sapiens
CDVEALTEL

SEQ ID NO: 637556 - protein, 9 aa, Homo Sapiens
PGDHDRAPA

SEQ ID NO: 637557 - protein, 9 aa, Homo Sapiens
AKKNVKGNV

SEQ ID NO: 637558 - protein, 9 aa, Homo Sapiens
RIPASPSLR

SEQ ID NO: 637559 - protein, 9 aa, Homo Sapiens
YEPKLGASQ

SEQ ID NO: 637560 - protein, 9 aa, Homo Sapiens
PSVKGPIYI

SEQ ID NO: 637561 - protein, 9 aa, Homo Sapiens
PPEFRRWDY

SEQ ID NO: 637562 - protein, 9 aa, Homo Sapiens
RVSNGSPSG

SEQ ID NO: 637563 - protein, 9 aa, Homo Sapiens
EKPTVPEEK

SEQ ID NO: 637564 - protein, 9 aa, Homo Sapiens
DGYPHCEER

SEQ ID NO: 637565 - protein, 9 aa, Homo Sapiens
AVRLRQSVS

SEQ ID NO: 637566 - protein, 9 aa, Homo Sapiens
FHSIAGDID

SEQ ID NO: 637567 - protein, 9 aa, Homo Sapiens
QRFVKFSRD

SEQ ID NO: 637568 - protein, 9 aa, Homo Sapiens
MHENDISAY

SEQ ID NO: 637569 - protein, 9 aa, Homo Sapiens
VNLSGSKSI

SEQ ID NO: 637570 - protein, 9 aa, Homo Sapiens
GEGGPVQMS

SEQ ID NO: 637571 - protein, 9 aa, Homo Sapiens
AQRKPWAQP

SEQ ID NO: 637572 - protein, 9 aa, Homo Sapiens
AVAAKHSGL

SEQ ID NO: 637573 - protein, 9 aa, Homo Sapiens
MSLLKHQRL

SEQ ID NO: 637574 - protein, 9 aa, Homo Sapiens
FNSFAITAK

SEQ ID NO: 637575 - protein, 9 aa, Homo Sapiens
SSGNYGYNP

SEQ ID NO: 637576 - protein, 9 aa, Homo Sapiens
SRSLVNLSG

SEQ ID NO: 637577 - protein, 9 aa, Homo Sapiens
FGKFGHALS

SEQ ID NO: 637578 - protein, 9 aa, Homo Sapiens
VKAVVLPTV

SEQ ID NO: 637579 - protein, 9 aa, Homo Sapiens
KNLSIEESR

SEQ ID NO: 637580 - protein, 9 aa, Homo Sapiens
TMDPSVRCE

SEQ ID NO: 637581 - protein, 9 aa, Homo Sapiens
EHGINDSFQ

SEQ ID NO: 637582 - protein, 9 aa, Homo Sapiens
DQAGTEMRM

SEQ ID NO: 637583 - protein, 9 aa, Homo Sapiens
APFDTEEAS

SEQ ID NO: 637584 - protein, 9 aa, Homo Sapiens
LPGGTVSQQ

SEQ ID NO: 637585 - protein, 9 aa, Homo Sapiens
TEPGVPTET

SEQ ID NO: 637586 - protein, 9 aa, Homo Sapiens
TILTPNVNE

SEQ ID NO: 637587 - protein, 9 aa, Homo Sapiens
EIATVASSS

SEQ ID NO: 637588 - protein, 9 aa, Homo Sapiens
KYQVVLEEH

SEQ ID NO: 637589 - protein, 9 aa, Homo Sapiens
SCTSLSGMT

SEQ ID NO: 637590 - protein, 9 aa, Homo Sapiens
CLSQSYAYS

SEQ ID NO: 637591 - protein, 9 aa, Homo Sapiens
SSNGVNDSF

SEQ ID NO: 637592 - protein, 9 aa, Homo Sapiens
TKECIEPCT

SEQ ID NO: 637593 - protein, 9 aa, Homo Sapiens
YELNFPSSP

SEQ ID NO: 637594 - protein, 9 aa, Homo Sapiens
GQDRHDGDR

SEQ ID NO: 637595 - protein, 9 aa, Homo Sapiens
RLYREKKTE

SEQ ID NO: 637596 - protein, 9 aa, Homo Sapiens
DRFAFQLLF

SEQ ID NO: 637597 - protein, 9 aa, Homo Sapiens
YYNWGRLSK

SEQ ID NO: 637598 - protein, 9 aa, Homo Sapiens
RHNWKLKYT

SEQ ID NO: 637599 - protein, 9 aa, Homo Sapiens
EYRPPPPPP

SEQ ID NO: 637600 - protein, 9 aa, Homo Sapiens
RSRLWTARR

SEQ ID NO: 637601 - protein, 9 aa, Homo Sapiens
SLLASPDTQ

SEQ ID NO: 637602 - protein, 9 aa, Homo Sapiens
AEVGRRVRQ

SEQ ID NO: 637603 - protein, 9 aa, Homo Sapiens
WLPVAGEAP

SEQ ID NO: 637604 - protein, 9 aa, Homo Sapiens
SLWDVDELE

SEQ ID NO: 637605 - protein, 9 aa, Homo Sapiens
TLSQKLFSP

SEQ ID NO: 637606 - protein, 9 aa, Homo Sapiens
IAPSPSPTR

SEQ ID NO: 637607 - protein, 9 aa, Homo Sapiens
SYHPACYRP

SEQ ID NO: 637608 - protein, 9 aa, Homo Sapiens
ATGRHKNPN

SEQ ID NO: 637609 - protein, 9 aa, Homo Sapiens
FTRSDELQH

SEQ ID NO: 637610 - protein, 9 aa, Homo Sapiens
SPATLGLVE

SEQ ID NO: 637611 - protein, 9 aa, Homo Sapiens
EERRPSDSA

SEQ ID NO: 637612 - protein, 9 aa, Homo Sapiens
YLGEVWQRA

SEQ ID NO: 637613 - protein, 9 aa, Homo Sapiens
NKRGINLYE

SEQ ID NO: 637614 - protein, 9 aa, Homo Sapiens
PKDLIGVLP

SEQ ID NO: 637615 - protein, 9 aa, Homo Sapiens
IKLKATWGI

SEQ ID NO: 637616 - protein, 9 aa, Homo Sapiens
IVVQLFKGK

SEQ ID NO: 637617 - protein, 9 aa, Homo Sapiens
LAFQGLAMS

SEQ ID NO: 637618 - protein, 9 aa, Homo Sapiens
PYTASIPEL

SEQ ID NO: 637619 - protein, 9 aa, Homo Sapiens
PKTPLEVAL

SEQ ID NO: 637620 - protein, 9 aa, Homo Sapiens
SPGSLDNAS

SEQ ID NO: 637621 - protein, 9 aa, Homo Sapiens
AFKKGDDMP

SEQ ID NO: 637622 - protein, 9 aa, Homo Sapiens
SRDPLLHRV

SEQ ID NO: 637623 - protein, 9 aa, Homo Sapiens
LLCTQCGPN

SEQ ID NO: 637624 - protein, 9 aa, Homo Sapiens
RTGLGAGPS

SEQ ID NO: 637625 - protein, 9 aa, Homo Sapiens
STLDSLFSI

SEQ ID NO: 637626 - protein, 9 aa, Homo Sapiens
SRPSSGTFI

SEQ ID NO: 637627 - protein, 9 aa, Homo Sapiens
RPSSGTFIL

SEQ ID NO: 637628 - protein, 9 aa, Homo Sapiens
KRMRTVTHI

SEQ ID NO: 637629 - protein, 9 aa, Homo Sapiens
FREQLDWTV

SEQ ID NO: 637630 - protein, 9 aa, Homo Sapiens
DQENATPKL

SEQ ID NO: 637631 - protein, 9 aa, Homo Sapiens
RLIKGTKGI

SEQ ID NO: 637632 - protein, 9 aa, Homo Sapiens
PPFARGNSE

SEQ ID NO: 637633 - protein, 9 aa, Homo Sapiens
SSMATMEAS

SEQ ID NO: 637634 - protein, 9 aa, Homo Sapiens
QCGPNGKQL

SEQ ID NO: 637635 - protein, 9 aa, Homo Sapiens
AGEQSFNKL

SEQ ID NO: 637636 - protein, 9 aa, Homo Sapiens
YRDMCPTTP

SEQ ID NO: 637637 - protein, 9 aa, Homo Sapiens
AERYKMLTP

SEQ ID NO: 637638 - protein, 9 aa, Homo Sapiens
VVNAFYSLN

SEQ ID NO: 637639 - protein, 9 aa, Homo Sapiens
RVLLQTPAA

SEQ ID NO: 637640 - protein, 9 aa, Homo Sapiens
LVSRKCQID

SEQ ID NO: 637641 - protein, 9 aa, Homo Sapiens
NMENNGLHE

SEQ ID NO: 637642 - protein, 9 aa, Homo Sapiens
PPKRNLYYF

SEQ ID NO: 637643 - protein, 9 aa, Homo Sapiens
MHQSSLKKR

SEQ ID NO: 637644 - protein, 9 aa, Homo Sapiens
QDSQSMYHE

SEQ ID NO: 637645 - protein, 9 aa, Homo Sapiens
LLQMFSLCL

SEQ ID NO: 637646 - protein, 9 aa, Homo Sapiens
AAAVASTTS

SEQ ID NO: 637647 - protein, 9 aa, Homo Sapiens
MKTLSSKMG

SEQ ID NO: 637648 - protein, 9 aa, Homo Sapiens
MTIKLKATW

SEQ ID NO: 637649 - protein, 9 aa, Homo Sapiens
KVDKFIKCR

SEQ ID NO: 637650 - protein, 9 aa, Homo Sapiens
CLQNKDLPQ

SEQ ID NO: 637651 - protein, 9 aa, Homo Sapiens
PSTRNWENE

SEQ ID NO: 637652 - protein, 9 aa, Homo Sapiens
ALTLHWLLG

SEQ ID NO: 637653 - protein, 9 aa, Homo Sapiens
DSNGGMTAS

SEQ ID NO: 637654 - protein, 9 aa, Homo Sapiens
QTPRGQVRV

SEQ ID NO: 637655 - protein, 9 aa, Homo Sapiens
SNPYPPSSF

SEQ ID NO: 637656 - protein, 9 aa, Homo Sapiens
IKMHLIVAL

SEQ ID NO: 637657 - protein, 9 aa, Homo Sapiens
AKNVFTMML

SEQ ID NO: 637658 - protein, 9 aa, Homo Sapiens
AAGHGHHDA

SEQ ID NO: 637659 - protein, 9 aa, Homo Sapiens
AGDIDLDSD

SEQ ID NO: 637660 - protein, 9 aa, Homo Sapiens
LRAAAFPQY

SEQ ID NO: 637661 - protein, 9 aa, Homo Sapiens
TNVVTVHRQ

SEQ ID NO: 637662 - protein, 9 aa, Homo Sapiens
HPACYRPCY

SEQ ID NO: 637663 - protein, 9 aa, Homo Sapiens
LKATWGIES

SEQ ID NO: 637664 - protein, 9 aa, Homo Sapiens
FMFACIVVQ

SEQ ID NO: 637665 - protein, 9 aa, Homo Sapiens
PPTEYRPPP

SEQ ID NO: 637666 - protein, 9 aa, Homo Sapiens
DHDRAPAVR

SEQ ID NO: 637667 - protein, 9 aa, Homo Sapiens
QRSKAPEPL

SEQ ID NO: 637668 - protein, 9 aa, Homo Sapiens
GELYVPKFS

SEQ ID NO: 637669 - protein, 9 aa, Homo Sapiens
DEKEQAALS

SEQ ID NO: 637670 - protein, 9 aa, Homo Sapiens
ADYAAIKAP

SEQ ID NO: 637671 - protein, 9 aa, Homo Sapiens
DPSVRCEYC

SEQ ID NO: 637672 - protein, 9 aa, Homo Sapiens
TRSDELQHH

SEQ ID NO: 637673 - protein, 9 aa, Homo Sapiens
DKDESGEER

SEQ ID NO: 637674 - protein, 9 aa, Homo Sapiens
EAAAVASTT

SEQ ID NO: 637675 - protein, 9 aa, Homo Sapiens
GSPRAHIFR

SEQ ID NO: 637676 - protein, 9 aa, Homo Sapiens
GTGDVIDDW

SEQ ID NO: 637677 - protein, 9 aa, Homo Sapiens
LSSPPKTAE

SEQ ID NO: 637678 - protein, 9 aa, Homo Sapiens
QEQERAKIN

SEQ ID NO: 637679 - protein, 9 aa, Homo Sapiens
HALSVKVMT

SEQ ID NO: 637680 - protein, 9 aa, Homo Sapiens
PRRVNPGLG

SEQ ID NO: 637681 - protein, 9 aa, Homo Sapiens
LYMVTMMVE

SEQ ID NO: 637682 - protein, 9 aa, Homo Sapiens
GTEMRMKLL

SEQ ID NO: 637683 - protein, 9 aa, Homo Sapiens
RGSHLSFEF

SEQ ID NO: 637684 - protein, 9 aa, Homo Sapiens
KVQAAKKNV

SEQ ID NO: 637685 - protein, 9 aa, Homo Sapiens
RTDKLRSSI

SEQ ID NO: 637686 - protein, 9 aa, Homo Sapiens
IPNGYTSPD

SEQ ID NO: 637687 - protein, 9 aa, Homo Sapiens
KMFTMVTDL

SEQ ID NO: 637688 - protein, 9 aa, Homo Sapiens
VLIPRFMLL

SEQ ID NO: 637689 - protein, 9 aa, Homo Sapiens
NAVSLNMEN

SEQ ID NO: 637690 - protein, 9 aa, Homo Sapiens
GRSKEQKHL

SEQ ID NO: 637691 - protein, 9 aa, Homo Sapiens
LCTQCGPNG

SEQ ID NO: 637692 - protein, 9 aa, Homo Sapiens
AQRSAKWAI

SEQ ID NO: 637693 - protein, 9 aa, Homo Sapiens
ASPPPIAPS

SEQ ID NO: 637694 - protein, 9 aa, Homo Sapiens
RMNPISGNP

SEQ ID NO: 637695 - protein, 9 aa, Homo Sapiens
TAPFDTEEA

SEQ ID NO: 637696 - protein, 9 aa, Homo Sapiens
PRSCPHWSK

SEQ ID NO: 637697 - protein, 9 aa, Homo Sapiens
GVTVHCSTD

SEQ ID NO: 637698 - protein, 9 aa, Homo Sapiens
LEKMCRTPE

SEQ ID NO: 637699 - protein, 9 aa, Homo Sapiens
RFAKQLGQP

SEQ ID NO: 637700 - protein, 9 aa, Homo Sapiens
LKYTVPENI

SEQ ID NO: 637701 - protein, 9 aa, Homo Sapiens
LKVDKFIKC

SEQ ID NO: 637702 - protein, 9 aa, Homo Sapiens
AAFPQYAQL

SEQ ID NO: 637703 - protein, 9 aa, Homo Sapiens
LQNKDLPQQ

SEQ ID NO: 637704 - protein, 9 aa, Homo Sapiens
LVVLEEKDP

SEQ ID NO: 637705 - protein, 9 aa, Homo Sapiens
CSGTGDVID

SEQ ID NO: 637706 - protein, 9 aa, Homo Sapiens
AKINQTEHR

SEQ ID NO: 637707 - protein, 9 aa, Homo Sapiens
AAHGGQCPL

SEQ ID NO: 637708 - protein, 9 aa, Homo Sapiens
GYFLIATVC

SEQ ID NO: 637709 - protein, 9 aa, Homo Sapiens
CAPGPDGYR

SEQ ID NO: 637710 - protein, 9 aa, Homo Sapiens
TEQRRDELS

SEQ ID NO: 637711 - protein, 9 aa, Homo Sapiens
RSHNVINVI

SEQ ID NO: 637712 - protein, 9 aa, Homo Sapiens
SLESHHDTW

SEQ ID NO: 637713 - protein, 9 aa, Homo Sapiens
AAKIKKKSE

SEQ ID NO: 637714 - protein, 9 aa, Homo Sapiens
NSFAITAKY

SEQ ID NO: 637715 - protein, 9 aa, Homo Sapiens
KTLSSKMGK

SEQ ID NO: 637716 - protein, 9 aa, Homo Sapiens
YTCLARNYL

SEQ ID NO: 637717 - protein, 9 aa, Homo Sapiens
SDLLAPILA

SEQ ID NO: 637718 - protein, 9 aa, Homo Sapiens
QIHVFCCEI

SEQ ID NO: 637719 - protein, 9 aa, Homo Sapiens
IPRNVNIGD

SEQ ID NO: 637720 - protein, 9 aa, Homo Sapiens
VLSVFENIH

SEQ ID NO: 637721 - protein, 9 aa, Homo Sapiens
VWLHGEFSY

SEQ ID NO: 637722 - protein, 9 aa, Homo Sapiens
ARSHNVINV

SEQ ID NO: 637723 - protein, 9 aa, Homo Sapiens
AQSLSPEKI

SEQ ID NO: 637724 - protein, 9 aa, Homo Sapiens
MQQGFPNLG

SEQ ID NO: 637725 - protein, 9 aa, Homo Sapiens
RSLVNLSGS

SEQ ID NO: 637726 - protein, 9 aa, Homo Sapiens
EGGPVQMSK

SEQ ID NO: 637727 - protein, 9 aa, Homo Sapiens
RASSSLAAV

SEQ ID NO: 637728 - protein, 9 aa, Homo Sapiens
LERIPASPS

SEQ ID NO: 637729 - protein, 9 aa, Homo Sapiens
PKRNLYYFS

SEQ ID NO: 637730 - protein, 9 aa, Homo Sapiens
GRSSFTASE

SEQ ID NO: 637731 - protein, 9 aa, Homo Sapiens
DTQAKHPQD

SEQ ID NO: 637732 - protein, 9 aa, Homo Sapiens
PCALCAPGP

SEQ ID NO: 637733 - protein, 9 aa, Homo Sapiens
SQERSFECL

SEQ ID NO: 637734 - protein, 9 aa, Homo Sapiens
CDFPLGSHL

SEQ ID NO: 637735 - protein, 9 aa, Homo Sapiens
MGKLLTEHF

SEQ ID NO: 637736 - protein, 9 aa, Homo Sapiens
RDMCPTTPG

SEQ ID NO: 637737 - protein, 9 aa, Homo Sapiens
YCVPHTTRP

SEQ ID NO: 637738 - protein, 9 aa, Homo Sapiens
SRDDIRSLS

SEQ ID NO: 637739 - protein, 9 aa, Homo Sapiens
VPRKPKVLP

SEQ ID NO: 637740 - protein, 9 aa, Homo Sapiens
SLKKRYTTS

SEQ ID NO: 637741 - protein, 9 aa, Homo Sapiens
PMKKRKTRE

SEQ ID NO: 637742 - protein, 9 aa, Homo Sapiens
PSPRIMFSV

SEQ ID NO: 637743 - protein, 9 aa, Homo Sapiens
TEEASLSWG

SEQ ID NO: 637744 - protein, 9 aa, Homo Sapiens
ILASGSVLI

SEQ ID NO: 637745 - protein, 9 aa, Homo Sapiens
WENEQPVHL

SEQ ID NO: 637746 - protein, 9 aa, Homo Sapiens
VLPLAMEAE

SEQ ID NO: 637747 - protein, 9 aa, Homo Sapiens
KLTLSQKLF

SEQ ID NO: 637748 - protein, 9 aa, Homo Sapiens
PASTEPRSC

SEQ ID NO: 637749 - protein, 9 aa, Homo Sapiens
LASGSVLIP

SEQ ID NO: 637750 - protein, 9 aa, Homo Sapiens
LLKVVAARA

SEQ ID NO: 637751 - protein, 9 aa, Homo Sapiens
QKNLSIEES

SEQ ID NO: 637752 - protein, 9 aa, Homo Sapiens
FLDEKEQAA

SEQ ID NO: 637753 - protein, 9 aa, Homo Sapiens
PNDPCVRGE

SEQ ID NO: 637754 - protein, 9 aa, Homo Sapiens
EFPHKFGYC

SEQ ID NO: 637755 - protein, 9 aa, Homo Sapiens
MNPRPILTI

SEQ ID NO: 637756 - protein, 9 aa, Homo Sapiens
RCAPLFSGT

SEQ ID NO: 637757 - protein, 9 aa, Homo Sapiens
DLIGVLPLA

SEQ ID NO: 637758 - protein, 9 aa, Homo Sapiens
AAAFPQYAQ

SEQ ID NO: 637759 - protein, 9 aa, Homo Sapiens
GEQSFNKLL

SEQ ID NO: 637760 - protein, 9 aa, Homo Sapiens
ALAFRPDFP

SEQ ID NO: 637761 - protein, 9 aa, Homo Sapiens
RQSVSVGRE

SEQ ID NO: 637762 - protein, 9 aa, Homo Sapiens
SQSMYHEVQ

SEQ ID NO: 637763 - protein, 9 aa, Homo Sapiens
PAVRLRQSV

SEQ ID NO: 637764 - protein, 9 aa, Homo Sapiens
TSLSGMTSA

SEQ ID NO: 637765 - protein, 9 aa, Homo Sapiens
SGTFILAPA

SEQ ID NO: 637766 - protein, 9 aa, Homo Sapiens
GNLAQPVGS

SEQ ID NO: 637767 - protein, 9 aa, Homo Sapiens
DTEEASLSW

SEQ ID NO: 637768 - protein, 9 aa, Homo Sapiens
SDSAQLLSL

SEQ ID NO: 637769 - protein, 9 aa, Homo Sapiens
RHRELRNLE

SEQ ID NO: 637770 - protein, 9 aa, Homo Sapiens
NETISNPYP

SEQ ID NO: 637771 - protein, 9 aa, Homo Sapiens
CFTTLATGY

SEQ ID NO: 637772 - protein, 9 aa, Homo Sapiens
LIRSQAIKK

SEQ ID NO: 637773 - protein, 9 aa, Homo Sapiens
FPHKFGYCV

SEQ ID NO: 637774 - protein, 9 aa, Homo Sapiens
KCGTCYTLS

SEQ ID NO: 637775 - protein, 9 aa, Homo Sapiens
EFRFSESQT

SEQ ID NO: 637776 - protein, 9 aa, Homo Sapiens
ILICLYMVT

SEQ ID NO: 637777 - protein, 9 aa, Homo Sapiens
SSLKKRYTT

SEQ ID NO: 637778 - protein, 9 aa, Homo Sapiens
EVTYCTMGF

SEQ ID NO: 637779 - protein, 9 aa, Homo Sapiens
IQKEHLVNF

SEQ ID NO: 637780 - protein, 9 aa, Homo Sapiens
QQVKELNPY

SEQ ID NO: 637781 - protein, 9 aa, Homo Sapiens
TCKDMRNMR

SEQ ID NO: 637782 - protein, 9 aa, Homo Sapiens
MSRDPLLHR

SEQ ID NO: 637783 - protein, 9 aa, Homo Sapiens
SFKFMYVDV

SEQ ID NO: 637784 - protein, 9 aa, Homo Sapiens
LDVVRSFES

SEQ ID NO: 637785 - protein, 9 aa, Homo Sapiens
LQRHGRGEP

SEQ ID NO: 637786 - protein, 9 aa, Homo Sapiens
TELWITRIP

SEQ ID NO: 637787 - protein, 9 aa, Homo Sapiens
RAVLPAEGD

SEQ ID NO: 637788 - protein, 9 aa, Homo Sapiens
CRTPEDQLS

SEQ ID NO: 637789 - protein, 9 aa, Homo Sapiens
FETLCFASI

SEQ ID NO: 637790 - protein, 9 aa, Homo Sapiens
DPCVRGEKD

SEQ ID NO: 637791 - protein, 9 aa, Homo Sapiens
STGIQNRDG

SEQ ID NO: 637792 - protein, 9 aa, Homo Sapiens
TCYEKASLQ

SEQ ID NO: 637793 - protein, 9 aa, Homo Sapiens
IHYTVLMHI

SEQ ID NO: 637794 - protein, 9 aa, Homo Sapiens
LESAFVNYI

SEQ ID NO: 637795 - protein, 9 aa, Homo Sapiens
KKSEVILNK

SEQ ID NO: 637796 - protein, 9 aa, Homo Sapiens
RISQSNING

SEQ ID NO: 637797 - protein, 9 aa, Homo Sapiens
PAQVEFRFS

SEQ ID NO: 637798 - protein, 9 aa, Homo Sapiens
SQQPPSTLG

SEQ ID NO: 637799 - protein, 9 aa, Homo Sapiens
GGQCPLGHP

SEQ ID NO: 637800 - protein, 9 aa, Homo Sapiens
SAGRLMRTI

SEQ ID NO: 637801 - protein, 9 aa, Homo Sapiens
SLQRLQEIR

SEQ ID NO: 637802 - protein, 9 aa, Homo Sapiens
EDKMFTMVT

SEQ ID NO: 637803 - protein, 9 aa, Homo Sapiens
RFIRSLNGC

SEQ ID NO: 637804 - protein, 9 aa, Homo Sapiens
DFLHENLVE

SEQ ID NO: 637805 - protein, 9 aa, Homo Sapiens
ASLSWGPAL

SEQ ID NO: 637806 - protein, 9 aa, Homo Sapiens
KHCPLDIDC

SEQ ID NO: 637807 - protein, 9 aa, Homo Sapiens
MGFLEKNND

SEQ ID NO: 637808 - protein, 9 aa, Homo Sapiens
GAGEPGCQR

SEQ ID NO: 637809 - protein, 9 aa, Homo Sapiens
THVLVPVSR

SEQ ID NO: 637810 - protein, 9 aa, Homo Sapiens
ELEAQHGFL

SEQ ID NO: 637811 - protein, 9 aa, Homo Sapiens
ALCCHASAV

SEQ ID NO: 637812 - protein, 9 aa, Homo Sapiens
GLGEALQRH

SEQ ID NO: 637813 - protein, 9 aa, Homo Sapiens
LYKCKVCDT

SEQ ID NO: 637814 - protein, 9 aa, Homo Sapiens
PYEASPQVN

SEQ ID NO: 637815 - protein, 9 aa, Homo Sapiens
FLALLESAF

SEQ ID NO: 637816 - protein, 9 aa, Homo Sapiens
LDKVTEPGV

SEQ ID NO: 637817 - protein, 9 aa, Homo Sapiens
YAGPSPRIM

SEQ ID NO: 637818 - protein, 9 aa, Homo Sapiens
ATWGIESDE

SEQ ID NO: 637819 - protein, 9 aa, Homo Sapiens
LTLSQKLFS

SEQ ID NO: 637820 - protein, 9 aa, Homo Sapiens
REELEHRPQ

SEQ ID NO: 637821 - protein, 9 aa, Homo Sapiens
VCTLGFAIC

SEQ ID NO: 637822 - protein, 9 aa, Homo Sapiens
LPEIPRNVN

SEQ ID NO: 637823 - protein, 9 aa, Homo Sapiens
RCWNDYVNL

SEQ ID NO: 637824 - protein, 9 aa, Homo Sapiens
SQTPRGQVR

SEQ ID NO: 637825 - protein, 9 aa, Homo Sapiens
LGSQPSQGF

SEQ ID NO: 637826 - protein, 9 aa, Homo Sapiens
QWPWRGAGS

SEQ ID NO: 637827 - protein, 9 aa, Homo Sapiens
AVHSLSRIW

SEQ ID NO: 637828 - protein, 9 aa, Homo Sapiens
LIDSLESHH

SEQ ID NO: 637829 - protein, 9 aa, Homo Sapiens
LYEDLHDGH

SEQ ID NO: 637830 - protein, 9 aa, Homo Sapiens
AARRAVLPA

SEQ ID NO: 637831 - protein, 9 aa, Homo Sapiens
PQNQERSLK

SEQ ID NO: 637832 - protein, 9 aa, Homo Sapiens
GPSPGSLDN

SEQ ID NO: 637833 - protein, 9 aa, Homo Sapiens
YGWMERKQF

SEQ ID NO: 637834 - protein, 9 aa, Homo Sapiens
GGEGQLARV

SEQ ID NO: 637835 - protein, 9 aa, Homo Sapiens
CRLLCCAVH

SEQ ID NO: 637836 - protein, 9 aa, Homo Sapiens
PLEVALCCH

SEQ ID NO: 637837 - protein, 9 aa, Homo Sapiens
LSDALNYPA

SEQ ID NO: 637838 - protein, 9 aa, Homo Sapiens
YTMDPSVRC

SEQ ID NO: 637839 - protein, 9 aa, Homo Sapiens
NTCYEKASL

SEQ ID NO: 637840 - protein, 9 aa, Homo Sapiens
LRSFKGYIN

SEQ ID NO: 637841 - protein, 9 aa, Homo Sapiens
SSFQVLSLL

SEQ ID NO: 637842 - protein, 9 aa, Homo Sapiens
LDGPPHREP

SEQ ID NO: 637843 - protein, 9 aa, Homo Sapiens
PPPEFRRWD

SEQ ID NO: 637844 - protein, 9 aa, Homo Sapiens
GTVSQQRVQ

SEQ ID NO: 637845 - protein, 9 aa, Homo Sapiens
FKVAARGTL

SEQ ID NO: 637846 - protein, 9 aa, Homo Sapiens
PGEGGPVQM

SEQ ID NO: 637847 - protein, 9 aa, Homo Sapiens
DSLGPSIFA

SEQ ID NO: 637848 - protein, 9 aa, Homo Sapiens
PGQGSSMAT

SEQ ID NO: 637849 - protein, 9 aa, Homo Sapiens
YSVNTQQIH

SEQ ID NO: 637850 - protein, 9 aa, Homo Sapiens
FGIESRISQ

SEQ ID NO: 637851 - protein, 9 aa, Homo Sapiens
GIAVGALFV

SEQ ID NO: 637852 - protein, 9 aa, Homo Sapiens
ILHSSNDTV

SEQ ID NO: 637853 - protein, 9 aa, Homo Sapiens
QMQQGFPNL

SEQ ID NO: 637854 - protein, 9 aa, Homo Sapiens
SRALGPTGK

SEQ ID NO: 637855 - protein, 9 aa, Homo Sapiens
ISKPLDAEQ

SEQ ID NO: 637856 - protein, 9 aa, Homo Sapiens
SSAALLKVV

SEQ ID NO: 637857 - protein, 9 aa, Homo Sapiens
YFLIATVCT

SEQ ID NO: 637858 - protein, 9 aa, Homo Sapiens
SLPCLSQSY

SEQ ID NO: 637859 - protein, 9 aa, Homo Sapiens
QCPLGHPAA

SEQ ID NO: 637860 - protein, 9 aa, Homo Sapiens
ELLYEILDF

SEQ ID NO: 637861 - protein, 9 aa, Homo Sapiens
DRHDGDRGD

SEQ ID NO: 637862 - protein, 9 aa, Homo Sapiens
RLSALCCQS

SEQ ID NO: 637863 - protein, 9 aa, Homo Sapiens
ITFLIIAAP

SEQ ID NO: 637864 - protein, 9 aa, Homo Sapiens
DYSVWLHGE

SEQ ID NO: 637865 - protein, 9 aa, Homo Sapiens
VTVHRQSFG

SEQ ID NO: 637866 - protein, 9 aa, Homo Sapiens
EVAMAVRVT

SEQ ID NO: 637867 - protein, 9 aa, Homo Sapiens
GRFAKQLGQ

SEQ ID NO: 637868 - protein, 9 aa, Homo Sapiens
GRSWVGVAV

SEQ ID NO: 637869 - protein, 9 aa, Homo Sapiens
ARYKAFGKC

SEQ ID NO: 637870 - protein, 9 aa, Homo Sapiens
AVCRPIHYT

SEQ ID NO: 637871 - protein, 9 aa, Homo Sapiens
KGKEEKLYA

SEQ ID NO: 637872 - protein, 9 aa, Homo Sapiens
DNTTFANSV

SEQ ID NO: 637873 - protein, 9 aa, Homo Sapiens
NGGRDSTDP

SEQ ID NO: 637874 - protein, 9 aa, Homo Sapiens
LTLHWLLGD

SEQ ID NO: 637875 - protein, 9 aa, Homo Sapiens
ELNFPSSPR

SEQ ID NO: 637876 - protein, 9 aa, Homo Sapiens
CYTLSTNGT

SEQ ID NO: 637877 - protein, 9 aa, Homo Sapiens
GREHAANGP

SEQ ID NO: 637878 - protein, 9 aa, Homo Sapiens
VTNVKFQYY

SEQ ID NO: 637879 - protein, 9 aa, Homo Sapiens
QPVGSSWRR

SEQ ID NO: 637880 - protein, 9 aa, Homo Sapiens
HAPGFPAVG

SEQ ID NO: 637881 - protein, 9 aa, Homo Sapiens
IAEGGVLPN

SEQ ID NO: 637882 - protein, 9 aa, Homo Sapiens
QALGLQEPL

SEQ ID NO: 637883 - protein, 9 aa, Homo Sapiens
PRVPCFSSL

SEQ ID NO: 637884 - protein, 9 aa, Homo Sapiens
TRGGSSYPS

SEQ ID NO: 637885 - protein, 9 aa, Homo Sapiens
TLSSKMGKW

SEQ ID NO: 637886 - protein, 9 aa, Homo Sapiens
DGHSLSDYN

SEQ ID NO: 637887 - protein, 9 aa, Homo Sapiens
EDLGEDTDR

SEQ ID NO: 637888 - protein, 9 aa, Homo Sapiens
NPQNQERSL

SEQ ID NO: 637889 - protein, 9 aa, Homo Sapiens
LALLESAFV

SEQ ID NO: 637890 - protein, 9 aa, Homo Sapiens
SVVTESSGN

SEQ ID NO: 637891 - protein, 9 aa, Homo Sapiens
RFVHDGNRI

SEQ ID NO: 637892 - protein, 9 aa, Homo Sapiens
LPWRWLPVA

SEQ ID NO: 637893 - protein, 9 aa, Homo Sapiens
TRVQTFGFR

SEQ ID NO: 637894 - protein, 9 aa, Homo Sapiens
KPKVLPHSH

SEQ ID NO: 637895 - protein, 9 aa, Homo Sapiens
AERSAADLD

SEQ ID NO: 637896 - protein, 9 aa, Homo Sapiens
LDIDCLQRL

SEQ ID NO: 637897 - protein, 9 aa, Homo Sapiens
DQNLDPLNC

SEQ ID NO: 637898 - protein, 9 aa, Homo Sapiens
PRAHIFRRN

SEQ ID NO: 637899 - protein, 9 aa, Homo Sapiens
LPTTEGPTD

SEQ ID NO: 637900 - protein, 9 aa, Homo Sapiens
AVWGRHREL

SEQ ID NO: 637901 - protein, 9 aa, Homo Sapiens
NTTILTPNV

SEQ ID NO: 637902 - protein, 9 aa, Homo Sapiens
NMWCCCFFN

SEQ ID NO: 637903 - protein, 9 aa, Homo Sapiens
LAQSLSPEK

SEQ ID NO: 637904 - protein, 9 aa, Homo Sapiens
LQSRNSPLP

SEQ ID NO: 637905 - protein, 9 aa, Homo Sapiens
ELQKSEALL

SEQ ID NO: 637906 - protein, 9 aa, Homo Sapiens
LTRVQTFGF

SEQ ID NO: 637907 - protein, 9 aa, Homo Sapiens
LARNYLGAA

SEQ ID NO: 637908 - protein, 9 aa, Homo Sapiens
YYLYATTYI

SEQ ID NO: 637909 - protein, 9 aa, Homo Sapiens
AVASTTSPK

SEQ ID NO: 637910 - protein, 9 aa, Homo Sapiens
RSVLNNLKV

SEQ ID NO: 637911 - protein, 9 aa, Homo Sapiens
LSQKLFSPQ

SEQ ID NO: 637912 - protein, 9 aa, Homo Sapiens
KQLEDGHSL

SEQ ID NO: 637913 - protein, 9 aa, Homo Sapiens
EEEASILGR

SEQ ID NO: 637914 - protein, 9 aa, Homo Sapiens
TKGIRTLLF

SEQ ID NO: 637915 - protein, 9 aa, Homo Sapiens
TACDVEALT

SEQ ID NO: 637916 - protein, 9 aa, Homo Sapiens
FCPTWHCEC

SEQ ID NO: 637917 - protein, 9 aa, Homo Sapiens
CVQALLGSQ

SEQ ID NO: 637918 - protein, 9 aa, Homo Sapiens
AFTFGIESR

SEQ ID NO: 637919 - protein, 9 aa, Homo Sapiens
LLGKVTIAE

SEQ ID NO: 637920 - protein, 9 aa, Homo Sapiens
GGAFNWGSG

SEQ ID NO: 637921 - protein, 9 aa, Homo Sapiens
TPAAPQRCL

SEQ ID NO: 637922 - protein, 9 aa, Homo Sapiens
YHPACYRPC

SEQ ID NO: 637923 - protein, 9 aa, Homo Sapiens
SDELQHHLQ

SEQ ID NO: 637924 - protein, 9 aa, Homo Sapiens
DLFGKFGHA

SEQ ID NO: 637925 - protein, 9 aa, Homo Sapiens
HQFREQLDW

SEQ ID NO: 637926 - protein, 9 aa, Homo Sapiens
PVQMSKFSY

SEQ ID NO: 637927 - protein, 9 aa, Homo Sapiens
LFETLCFAS

SEQ ID NO: 637928 - protein, 9 aa, Homo Sapiens
YSGNSLQRL

SEQ ID NO: 637929 - protein, 9 aa, Homo Sapiens
EGRFAKQLG

SEQ ID NO: 637930 - protein, 9 aa, Homo Sapiens
CGQWPWRGA

SEQ ID NO: 637931 - protein, 9 aa, Homo Sapiens
VDELECVRC

SEQ ID NO: 637932 - protein, 9 aa, Homo Sapiens
KIKKKSEVI

SEQ ID NO: 637933 - protein, 9 aa, Homo Sapiens
VISKPLDAE

SEQ ID NO: 637934 - protein, 9 aa, Homo Sapiens
NLKVDKFIK

SEQ ID NO: 637935 - protein, 9 aa, Homo Sapiens
HDGHNLISL

SEQ ID NO: 637936 - protein, 9 aa, Homo Sapiens
TFSSFQVLS

SEQ ID NO: 637937 - protein, 9 aa, Homo Sapiens
SGLWRTSCL

SEQ ID NO: 637938 - protein, 9 aa, Homo Sapiens
VLLTNVVTV

SEQ ID NO: 637939 - protein, 9 aa, Homo Sapiens
EDKDESGEE

SEQ ID NO: 637940 - protein, 9 aa, Homo Sapiens
EVFHAWTLQ

SEQ ID NO: 637941 - protein, 9 aa, Homo Sapiens
LKPGSPSDQ

SEQ ID NO: 637942 - protein, 9 aa, Homo Sapiens
HLLYGSKMS

SEQ ID NO: 637943 - protein, 9 aa, Homo Sapiens
TPKYQVVLE

SEQ ID NO: 637944 - protein, 9 aa, Homo Sapiens
VWQRAAAHG

SEQ ID NO: 637945 - protein, 9 aa, Homo Sapiens
YCTMGFLEK

SEQ ID NO: 637946 - protein, 9 aa, Homo Sapiens
VVTLLVSRK

SEQ ID NO: 637947 - protein, 9 aa, Homo Sapiens
GSQPSQGFG

SEQ ID NO: 637948 - protein, 9 aa, Homo Sapiens
CPLDIDCLQ

SEQ ID NO: 637949 - protein, 9 aa, Homo Sapiens
NHLKSLKTD

SEQ ID NO: 637950 - protein, 9 aa, Homo Sapiens
SIEDPVDAI

SEQ ID NO: 637951 - protein, 9 aa, Homo Sapiens
VDAIHLGSL

SEQ ID NO: 637952 - protein, 9 aa, Homo Sapiens
LPMKKRKTR

SEQ ID NO: 637953 - protein, 9 aa, Homo Sapiens
TSRRLSALC

SEQ ID NO: 637954 - protein, 9 aa, Homo Sapiens
EVGRRVRQE

SEQ ID NO: 637955 - protein, 9 aa, Homo Sapiens
CCFFNRRKR

SEQ ID NO: 637956 - protein, 9 aa, Homo Sapiens
IYSVNTQQI

SEQ ID NO: 637957 - protein, 9 aa, Homo Sapiens
LGEDTDRAH

SEQ ID NO: 637958 - protein, 9 aa, Homo Sapiens
ELNPYEASP

SEQ ID NO: 637959 - protein, 9 aa, Homo Sapiens
RRQNPKHQN

SEQ ID NO: 637960 - protein, 9 aa, Homo Sapiens
EDPVDAIHL

SEQ ID NO: 637961 - protein, 9 aa, Homo Sapiens
LALEQNVTE

SEQ ID NO: 637962 - protein, 9 aa, Homo Sapiens
FSESQTPRG

SEQ ID NO: 637963 - protein, 9 aa, Homo Sapiens
NAFYSLNRN

SEQ ID NO: 637964 - protein, 9 aa, Homo Sapiens
HCLLGAVPM

SEQ ID NO: 637965 - protein, 9 aa, Homo Sapiens
QREPPGGAF

SEQ ID NO: 637966 - protein, 9 aa, Homo Sapiens
YTVVPHLVK

SEQ ID NO: 637967 - protein, 9 aa, Homo Sapiens
SFLQRFVKF

SEQ ID NO: 637968 - protein, 9 aa, Homo Sapiens
WGIESDEEI

SEQ ID NO: 637969 - protein, 9 aa, Homo Sapiens
LCYSITFLI

SEQ ID NO: 637970 - protein, 9 aa, Homo Sapiens
LIKGTKGIR

SEQ ID NO: 637971 - protein, 9 aa, Homo Sapiens
SASSSPTKE

SEQ ID NO: 637972 - protein, 9 aa, Homo Sapiens
PEEKPTIPT

SEQ ID NO: 637973 - protein, 9 aa, Homo Sapiens
EQRRDELSE

SEQ ID NO: 637974 - protein, 9 aa, Homo Sapiens
IEDPVDAIH

SEQ ID NO: 637975 - protein, 9 aa, Homo Sapiens
SSPTKECIE

SEQ ID NO: 637976 - protein, 9 aa, Homo Sapiens
HGINDSFQK

SEQ ID NO: 637977 - protein, 9 aa, Homo Sapiens
VHCLLGAVP

SEQ ID NO: 637978 - protein, 9 aa, Homo Sapiens
ISNPYPPSS

SEQ ID NO: 637979 - protein, 9 aa, Homo Sapiens
AGLQPVLDG

SEQ ID NO: 637980 - protein, 9 aa, Homo Sapiens
DDEPEEGRK

SEQ ID NO: 637981 - protein, 9 aa, Homo Sapiens
ATACDVEAL

SEQ ID NO: 637982 - protein, 9 aa, Homo Sapiens
VSGQFCPTW

SEQ ID NO: 637983 - protein, 9 aa, Homo Sapiens
QYPYRTQYS

SEQ ID NO: 637984 - protein, 9 aa, Homo Sapiens
GPPHREPGP

SEQ ID NO: 637985 - protein, 9 aa, Homo Sapiens
LWDVDELEC

SEQ ID NO: 637986 - protein, 9 aa, Homo Sapiens
LWALPTTEG

SEQ ID NO: 637987 - protein, 9 aa, Homo Sapiens
INQTEHRRV

SEQ ID NO: 637988 - protein, 9 aa, Homo Sapiens
TLARSHNVI

SEQ ID NO: 637989 - protein, 9 aa, Homo Sapiens
VQTFGFRGE

SEQ ID NO: 637990 - protein, 9 aa, Homo Sapiens
TLHWLLGDP

SEQ ID NO: 637991 - protein, 9 aa, Homo Sapiens
VMLFLDEKE

SEQ ID NO: 637992 - protein, 9 aa, Homo Sapiens
SDPLPENQR

SEQ ID NO: 637993 - protein, 9 aa, Homo Sapiens
LQTHFKKAR

SEQ ID NO: 637994 - protein, 9 aa, Homo Sapiens
GAGPSGAGP

SEQ ID NO: 637995 - protein, 9 aa, Homo Sapiens
KAERRTTLV

SEQ ID NO: 637996 - protein, 9 aa, Homo Sapiens
PPMHQSSLK

SEQ ID NO: 637997 - protein, 9 aa, Homo Sapiens
TEPRSCPHW

SEQ ID NO: 637998 - protein, 9 aa, Homo Sapiens
TMEPSGEVP

SEQ ID NO: 637999 - protein, 9 aa, Homo Sapiens
TLRERLIDS

SEQ ID NO: 638000 - protein, 9 aa, Homo Sapiens
PELQSLDEL

SEQ ID NO: 638001 - protein, 9 aa, Homo Sapiens
QPSQGFGNS

SEQ ID NO: 638002 - protein, 9 aa, Homo Sapiens
GRHKNPNPH

SEQ ID NO: 638003 - protein, 9 aa, Homo Sapiens
LSFEFRHCS

SEQ ID NO: 638004 - protein, 9 aa, Homo Sapiens
DGQDRHDGD

SEQ ID NO: 638005 - protein, 9 aa, Homo Sapiens
LLPWRWLPV

SEQ ID NO: 638006 - protein, 9 aa, Homo Sapiens
RTNLDLPLQ

SEQ ID NO: 638007 - protein, 9 aa, Homo Sapiens
SCMGGMNPR

SEQ ID NO: 638008 - protein, 9 aa, Homo Sapiens
QSNYLEKNW

SEQ ID NO: 638009 - protein, 9 aa, Homo Sapiens
VGLPSIPVN

SEQ ID NO: 638010 - protein, 9 aa, Homo Sapiens
ANGPAPLGQ

SEQ ID NO: 638011 - protein, 9 aa, Homo Sapiens
KSPATLGLV

SEQ ID NO: 638012 - protein, 9 aa, Homo Sapiens
PGLGEALQR

SEQ ID NO: 638013 - protein, 9 aa, Homo Sapiens
YKAFGKCVS

SEQ ID NO: 638014 - protein, 9 aa, Homo Sapiens
EEKLYAKKD

SEQ ID NO: 638015 - protein, 9 aa, Homo Sapiens
LAPILAEVL

SEQ ID NO: 638016 - protein, 9 aa, Homo Sapiens
CGTCYTLST

SEQ ID NO: 638017 - protein, 9 aa, Homo Sapiens
LGPTGKAGS

SEQ ID NO: 638018 - protein, 9 aa, Homo Sapiens
TVHCSTDFR

SEQ ID NO: 638019 - protein, 9 aa, Homo Sapiens
QLLFAEGAG

SEQ ID NO: 638020 - protein, 9 aa, Homo Sapiens
YEASPQVNT

SEQ ID NO: 638021 - protein, 9 aa, Homo Sapiens
SCTSPILDK

SEQ ID NO: 638022 - protein, 9 aa, Homo Sapiens
IYELLYEIL

SEQ ID NO: 638023 - protein, 9 aa, Homo Sapiens
GEPGCQREP

SEQ ID NO: 638024 - protein, 9 aa, Homo Sapiens
HELNVQKRK

SEQ ID NO: 638025 - protein, 9 aa, Homo Sapiens
LPPFARGNS

SEQ ID NO: 638026 - protein, 9 aa, Homo Sapiens
GFSSQVLWI

SEQ ID NO: 638027 - protein, 9 aa, Homo Sapiens
LMLDVVRSF

SEQ ID NO: 638028 - protein, 9 aa, Homo Sapiens
HSIAGDIDL

SEQ ID NO: 638029 - protein, 9 aa, Homo Sapiens
LKSLKTDPS

SEQ ID NO: 638030 - protein, 9 aa, Homo Sapiens
RSPQYLHSQ

SEQ ID NO: 638031 - protein, 9 aa, Homo Sapiens
CFFNSFAIT

SEQ ID NO: 638032 - protein, 9 aa, Homo Sapiens
EILTNKQMQ

SEQ ID NO: 638033 - protein, 9 aa, Homo Sapiens
SKCGTCYTL

SEQ ID NO: 638034 - protein, 9 aa, Homo Sapiens
RDFTFDLYS

SEQ ID NO: 638035 - protein, 9 aa, Homo Sapiens
RAAAFPQYA

SEQ ID NO: 638036 - protein, 9 aa, Homo Sapiens
IIPADYAAI

SEQ ID NO: 638037 - protein, 9 aa, Homo Sapiens
THSGLWRTS

SEQ ID NO: 638038 - protein, 9 aa, Homo Sapiens
TNVKFQYYL

SEQ ID NO: 638039 - protein, 9 aa, Homo Sapiens
HSSLAQSLS

SEQ ID NO: 638040 - protein, 9 aa, Homo Sapiens
PGAISDLED

SEQ ID NO: 638041 - protein, 9 aa, Homo Sapiens
DYAAIKAPM

SEQ ID NO: 638042 - protein, 9 aa, Homo Sapiens
DRSDEPDDC

SEQ ID NO: 638043 - protein, 9 aa, Homo Sapiens
ARVLLQTPA

SEQ ID NO: 638044 - protein, 9 aa, Homo Sapiens
RTVTHIFLL

SEQ ID NO: 638045 - protein, 9 aa, Homo Sapiens
YLYATTYIL

SEQ ID NO: 638046 - protein, 9 aa, Homo Sapiens
QFMFACIVV

SEQ ID NO: 638047 - protein, 9 aa, Homo Sapiens
SSSPTKECI

SEQ ID NO: 638048 - protein, 9 aa, Homo Sapiens
KAVVLPTVG

SEQ ID NO: 638049 - protein, 9 aa, Homo Sapiens
GSVLIPRFM

SEQ ID NO: 638050 - protein, 9 aa, Homo Sapiens
SKDCILGQS

SEQ ID NO: 638051 - protein, 9 aa, Homo Sapiens
RGTLRRSNV

SEQ ID NO: 638052 - protein, 9 aa, Homo Sapiens
TIISYFDKG

SEQ ID NO: 638053 - protein, 9 aa, Homo Sapiens
RVGGRGCED

SEQ ID NO: 638054 - protein, 9 aa, Homo Sapiens
AFGKCVSHI

SEQ ID NO: 638055 - protein, 9 aa, Homo Sapiens
REKKTELWI

SEQ ID NO: 638056 - protein, 9 aa, Homo Sapiens
FSGTEHHAS

SEQ ID NO: 638057 - protein, 9 aa, Homo Sapiens
PSPGSLDNA

SEQ ID NO: 638058 - protein, 9 aa, Homo Sapiens
FKKGDDMPE

SEQ ID NO: 638059 - protein, 9 aa, Homo Sapiens
DTVDDCGDR

SEQ ID NO: 638060 - protein, 9 aa, Homo Sapiens
TPLHHLDRI

SEQ ID NO: 638061 - protein, 9 aa, Homo Sapiens
GSRSLVNLS

SEQ ID NO: 638062 - protein, 9 aa, Homo Sapiens
LRLVHELSG

SEQ ID NO: 638063 - protein, 9 aa, Homo Sapiens
FSLCIPNGY

SEQ ID NO: 638064 - protein, 9 aa, Homo Sapiens
RPSDSAQLL

SEQ ID NO: 638065 - protein, 9 aa, Homo Sapiens
IIMKQIENL

SEQ ID NO: 638066 - protein, 9 aa, Homo Sapiens
DWLRAAAFP

SEQ ID NO: 638067 - protein, 9 aa, Homo Sapiens
ECLMCGKAF

SEQ ID NO: 638068 - protein, 9 aa, Homo Sapiens
LADCSRPSS

SEQ ID NO: 638069 - protein, 9 aa, Homo Sapiens
SVLNNLKVD

SEQ ID NO: 638070 - protein, 9 aa, Homo Sapiens
LSKPPEDDD

SEQ ID NO: 638071 - protein, 9 aa, Homo Sapiens
WRTSCLEGA

SEQ ID NO: 638072 - protein, 9 aa, Homo Sapiens
VYKKHSSLA

SEQ ID NO: 638073 - protein, 9 aa, Homo Sapiens
APQALGLQE

SEQ ID NO: 638074 - protein, 9 aa, Homo Sapiens
VAVLSVFEN

SEQ ID NO: 638075 - protein, 9 aa, Homo Sapiens
PVLDGPPHR

SEQ ID NO: 638076 - protein, 9 aa, Homo Sapiens
VWGRHRELR

SEQ ID NO: 638077 - protein, 9 aa, Homo Sapiens
FEAHDTVDL

SEQ ID NO: 638078 - protein, 9 aa, Homo Sapiens
CWMVYFQMQ

SEQ ID NO: 638079 - protein, 9 aa, Homo Sapiens
RNMRFALKQ

SEQ ID NO: 638080 - protein, 9 aa, Homo Sapiens
VIVWGNYGW

SEQ ID NO: 638081 - protein, 9 aa, Homo Sapiens
MVTLVPCWM

SEQ ID NO: 638082 - protein, 9 aa, Homo Sapiens
SDMLKDTAK

SEQ ID NO: 638083 - protein, 9 aa, Homo Sapiens
CMGGMNPRP

SEQ ID NO: 638084 - protein, 9 aa, Homo Sapiens
ACVPNMTEQ

SEQ ID NO: 638085 - protein, 9 aa, Homo Sapiens
AIKKNPGIA

SEQ ID NO: 638086 - protein, 9 aa, Homo Sapiens
NREVFHAWT

SEQ ID NO: 638087 - protein, 9 aa, Homo Sapiens
TRTRCWNDY

SEQ ID NO: 638088 - protein, 9 aa, Homo Sapiens
CILSPGEIM

SEQ ID NO: 638089 - protein, 9 aa, Homo Sapiens
QMFSLCLTA

SEQ ID NO: 638090 - protein, 9 aa, Homo Sapiens
ARGVPPTEY

SEQ ID NO: 638091 - protein, 9 aa, Homo Sapiens
YLCYSGYTR

SEQ ID NO: 638092 - protein, 9 aa, Homo Sapiens
ALADCSRPS

SEQ ID NO: 638093 - protein, 9 aa, Homo Sapiens
ITCKDMRNM

SEQ ID NO: 638094 - protein, 9 aa, Homo Sapiens
MRTIFEIVL

SEQ ID NO: 638095 - protein, 9 aa, Homo Sapiens
CPEELPGQT

SEQ ID NO: 638096 - protein, 9 aa, Homo Sapiens
LSQVRIDAL

SEQ ID NO: 638097 - protein, 9 aa, Homo Sapiens
GGRGCEDYR

SEQ ID NO: 638098 - protein, 9 aa, Homo Sapiens
AAPQRCLQG

SEQ ID NO: 638099 - protein, 9 aa, Homo Sapiens
PNMTEQRRD

SEQ ID NO: 638100 - protein, 9 aa, Homo Sapiens
RENICLLQM

SEQ ID NO: 638101 - protein, 9 aa, Homo Sapiens
EDFLHENLV

SEQ ID NO: 638102 - protein, 9 aa, Homo Sapiens
KYTVPENIK

SEQ ID NO: 638103 - protein, 9 aa, Homo Sapiens
ADFPLGPAN

SEQ ID NO: 638104 - protein, 9 aa, Homo Sapiens
AANGPAPLG

SEQ ID NO: 638105 - protein, 9 aa, Homo Sapiens
EEASLSWGP

SEQ ID NO: 638106 - protein, 9 aa, Homo Sapiens
NGKQLHPGP

SEQ ID NO: 638107 - protein, 9 aa, Homo Sapiens
WGRHRELRN

SEQ ID NO: 638108 - protein, 9 aa, Homo Sapiens
GADGRQAGG

SEQ ID NO: 638109 - protein, 9 aa, Homo Sapiens
RERGRSKEQ

SEQ ID NO: 638110 - protein, 9 aa, Homo Sapiens
YPYRTQYSR

SEQ ID NO: 638111 - protein, 9 aa, Homo Sapiens
GDRASVAAE

SEQ ID NO: 638112 - protein, 9 aa, Homo Sapiens
PGGAFNWGS

SEQ ID NO: 638113 - protein, 9 aa, Homo Sapiens
TQYSRQKNP

SEQ ID NO: 638114 - protein, 9 aa, Homo Sapiens
SSCTSLSGM

SEQ ID NO: 638115 - protein, 9 aa, Homo Sapiens
EPAQVEFRF

SEQ ID NO: 638116 - protein, 9 aa, Homo Sapiens
GKCVSHIGA

SEQ ID NO: 638117 - protein, 9 aa, Homo Sapiens
PHAPGFPAV

SEQ ID NO: 638118 - protein, 9 aa, Homo Sapiens
ESAFVNYIF

SEQ ID NO: 638119 - protein, 9 aa, Homo Sapiens
KWAINRVAM

SEQ ID NO: 638120 - protein, 9 aa, Homo Sapiens
IPDLANMRL

SEQ ID NO: 638121 - protein, 9 aa, Homo Sapiens
SGLGEYAAC

SEQ ID NO: 638122 - protein, 9 aa, Homo Sapiens
DRFRGSHLS

SEQ ID NO: 638123 - protein, 9 aa, Homo Sapiens
ALDFEQEIA

SEQ ID NO: 638124 - protein, 9 aa, Homo Sapiens
SVGLMCWML

SEQ ID NO: 638125 - protein, 9 aa, Homo Sapiens
VVTESSGNY

SEQ ID NO: 638126 - protein, 9 aa, Homo Sapiens
TSPGEGGPV

SEQ ID NO: 638127 - protein, 9 aa, Homo Sapiens
KKNVKGNVC

SEQ ID NO: 638128 - protein, 9 aa, Homo Sapiens
CDWLRAAAF

SEQ ID NO: 638129 - protein, 9 aa, Homo Sapiens
CWNDYVNLR

SEQ ID NO: 638130 - protein, 9 aa, Homo Sapiens
FGKCVSHIG

SEQ ID NO: 638131 - protein, 9 aa, Homo Sapiens
GLQEPLRPG

SEQ ID NO: 638132 - protein, 9 aa, Homo Sapiens
PSVRCEYCN

SEQ ID NO: 638133 - protein, 9 aa, Homo Sapiens
RSKAPEPLF

SEQ ID NO: 638134 - protein, 9 aa, Homo Sapiens
ATLGLVELF

SEQ ID NO: 638135 - protein, 9 aa, Homo Sapiens
QHVLAFQGL

SEQ ID NO: 638136 - protein, 9 aa, Homo Sapiens
TLGTVWLCG

SEQ ID NO: 638137 - protein, 9 aa, Homo Sapiens
RSLSDALNY

SEQ ID NO: 638138 - protein, 9 aa, Homo Sapiens
THFKKAREN

SEQ ID NO: 638139 - protein, 9 aa, Homo Sapiens
LNMENNGLH

SEQ ID NO: 638140 - protein, 9 aa, Homo Sapiens
VTEENASIS

SEQ ID NO: 638141 - protein, 9 aa, Homo Sapiens
WIASEVTVP

SEQ ID NO: 638142 - protein, 9 aa, Homo Sapiens
LCYELNFPS

SEQ ID NO: 638143 - protein, 9 aa, Homo Sapiens
SQPVMVQRR

SEQ ID NO: 638144 - protein, 9 aa, Homo Sapiens
PAHPAAANG

SEQ ID NO: 638145 - protein, 9 aa, Homo Sapiens
KKHSSLAQS

SEQ ID NO: 638146 - protein, 9 aa, Homo Sapiens
PSIFAVVGN

SEQ ID NO: 638147 - protein, 9 aa, Homo Sapiens
AVVGNLVAI

SEQ ID NO: 638148 - protein, 9 aa, Homo Sapiens
ACFVAQAPN

SEQ ID NO: 638149 - protein, 9 aa, Homo Sapiens
GSSSSSNGR

SEQ ID NO: 638150 - protein, 9 aa, Homo Sapiens
QHGFLHSTC

SEQ ID NO: 638151 - protein, 9 aa, Homo Sapiens
EKMCRTPED

SEQ ID NO: 638152 - protein, 9 aa, Homo Sapiens
QSRKHCPLD

SEQ ID NO: 638153 - protein, 9 aa, Homo Sapiens
LDGQLVVLE

SEQ ID NO: 638154 - protein, 9 aa, Homo Sapiens
CLALEQNVT

SEQ ID NO: 638155 - protein, 9 aa, Homo Sapiens
VLIYELLYE

SEQ ID NO: 638156 - protein, 9 aa, Homo Sapiens
SLDNASSPL

SEQ ID NO: 638157 - protein, 9 aa, Homo Sapiens
TEKPYTASI

SEQ ID NO: 638158 - protein, 9 aa, Homo Sapiens
WRWLPVAGE

SEQ ID NO: 638159 - protein, 9 aa, Homo Sapiens
YVPKFSISR

SEQ ID NO: 638160 - protein, 9 aa, Homo Sapiens
PANGGRDST

SEQ ID NO: 638161 - protein, 9 aa, Homo Sapiens
SNAGEQSFN

SEQ ID NO: 638162 - protein, 9 aa, Homo Sapiens
GMVKAVVLP

SEQ ID NO: 638163 - protein, 9 aa, Homo Sapiens
LAPTLIMEN

SEQ ID NO: 638164 - protein, 9 aa, Homo Sapiens
LHENLVEYL

SEQ ID NO: 638165 - protein, 9 aa, Homo Sapiens
YGECLQNKD

SEQ ID NO: 638166 - protein, 9 aa, Homo Sapiens
CGPNGKQLH

SEQ ID NO: 638167 - protein, 9 aa, Homo Sapiens
KPYTASIPE

SEQ ID NO: 638168 - protein, 9 aa, Homo Sapiens
CWMLAREVL

SEQ ID NO: 638169 - protein, 9 aa, Homo Sapiens
CVGSFFEAH

SEQ ID NO: 638170 - protein, 9 aa, Homo Sapiens
SVSLSGSHK

SEQ ID NO: 638171 - protein, 9 aa, Homo Sapiens
ISDLEDDLG

SEQ ID NO: 638172 - protein, 9 aa, Homo Sapiens
LRPAGLQPV

SEQ ID NO: 638173 - protein, 9 aa, Homo Sapiens
NCTSQSTIV

SEQ ID NO: 638174 - protein, 9 aa, Homo Sapiens
VSDYFQYME

SEQ ID NO: 638175 - protein, 9 aa, Homo Sapiens
FNKLLKKLT

SEQ ID NO: 638176 - protein, 9 aa, Homo Sapiens
LDSHSQQMQ

SEQ ID NO: 638177 - protein, 9 aa, Homo Sapiens
FQYYLYATT

SEQ ID NO: 638178 - protein, 9 aa, Homo Sapiens
DSSCTSLSG

SEQ ID NO: 638179 - protein, 9 aa, Homo Sapiens
GADQNLDPL

SEQ ID NO: 638180 - protein, 9 aa, Homo Sapiens
RLLCCAVHC

SEQ ID NO: 638181 - protein, 9 aa, Homo Sapiens
IRFIRSLNG

SEQ ID NO: 638182 - protein, 9 aa, Homo Sapiens
LRQRLQCKV

SEQ ID NO: 638183 - protein, 9 aa, Homo Sapiens
KLFSPQTRT

SEQ ID NO: 638184 - protein, 9 aa, Homo Sapiens
QEKEKIIMK

SEQ ID NO: 638185 - protein, 9 aa, Homo Sapiens
KKQKIIKMH

SEQ ID NO: 638186 - protein, 9 aa, Homo Sapiens
DLYEDLHDG

SEQ ID NO: 638187 - protein, 9 aa, Homo Sapiens
QKPAYPLIW

SEQ ID NO: 638188 - protein, 9 aa, Homo Sapiens
AGRLMRTIF

SEQ ID NO: 638189 - protein, 9 aa, Homo Sapiens
FRVSDYFQY

SEQ ID NO: 638190 - protein, 9 aa, Homo Sapiens
QRKPWAQPT

SEQ ID NO: 638191 - protein, 9 aa, Homo Sapiens
VKFSRDVFL

SEQ ID NO: 638192 - protein, 9 aa, Homo Sapiens
NLAQPVGSS

SEQ ID NO: 638193 - protein, 9 aa, Homo Sapiens
SGSWSTFQH

SEQ ID NO: 638194 - protein, 9 aa, Homo Sapiens
AAPSSGSWS

SEQ ID NO: 638195 - protein, 9 aa, Homo Sapiens
LTFSSFQVL

SEQ ID NO: 638196 - protein, 9 aa, Homo Sapiens
HIFLLSLAV

SEQ ID NO: 638197 - protein, 9 aa, Homo Sapiens
FVFLALLES

SEQ ID NO: 638198 - protein, 9 aa, Homo Sapiens
RFAFQLLFA

SEQ ID NO: 638199 - protein, 9 aa, Homo Sapiens
GRLLRPAGL

SEQ ID NO: 638200 - protein, 9 aa, Homo Sapiens
DAAFKKGDD

SEQ ID NO: 638201 - protein, 9 aa, Homo Sapiens
PGFPAVGRC

SEQ ID NO: 638202 - protein, 9 aa, Homo Sapiens
LQAAQRSAK

SEQ ID NO: 638203 - protein, 9 aa, Homo Sapiens
ERMNPISGN

SEQ ID NO: 638204 - protein, 9 aa, Homo Sapiens
IFLEYVRCF

SEQ ID NO: 638205 - protein, 9 aa, Homo Sapiens
KPWAQPTPG

SEQ ID NO: 638206 - protein, 9 aa, Homo Sapiens
TYLDKVTEP

SEQ ID NO: 638207 - protein, 9 aa, Homo Sapiens
EIMFIPVKY

SEQ ID NO: 638208 - protein, 9 aa, Homo Sapiens
LCYSGYTRG

SEQ ID NO: 638209 - protein, 9 aa, Homo Sapiens
QNSGYPSQQ

SEQ ID NO: 638210 - protein, 9 aa, Homo Sapiens
AAKHSGLGE

SEQ ID NO: 638211 - protein, 9 aa, Homo Sapiens
ILDKEDSWR

SEQ ID NO: 638212 - protein, 9 aa, Homo Sapiens
RYKMLTPFS

SEQ ID NO: 638213 - protein, 9 aa, Homo Sapiens
ISSLDGQLV

SEQ ID NO: 638214 - protein, 9 aa, Homo Sapiens
KEEKLYAKK

SEQ ID NO: 638215 - protein, 9 aa, Homo Sapiens
TGLGAGPSG

SEQ ID NO: 638216 - protein, 9 aa, Homo Sapiens
DALGPGGGG

SEQ ID NO: 638217 - protein, 9 aa, Homo Sapiens
QHEKVEIIA

SEQ ID NO: 638218 - protein, 9 aa, Homo Sapiens
SPGEIMFIP

SEQ ID NO: 638219 - protein, 9 aa, Homo Sapiens
STRNWENEQ

SEQ ID NO: 638220 - protein, 9 aa, Homo Sapiens
ATTAPFDTE

SEQ ID NO: 638221 - protein, 9 aa, Homo Sapiens
VYIIIFHHE

SEQ ID NO: 638222 - protein, 9 aa, Homo Sapiens
HSQQMQQGF

SEQ ID NO: 638223 - protein, 9 aa, Homo Sapiens
TSDPRKSQL

SEQ ID NO: 638224 - protein, 9 aa, Homo Sapiens
GQDSQSMYH

SEQ ID NO: 638225 - protein, 9 aa, Homo Sapiens
SAKWAINRV

SEQ ID NO: 638226 - protein, 9 aa, Homo Sapiens
DVDELECVR

SEQ ID NO: 638227 - protein, 9 aa, Homo Sapiens
QYMEILEQN

SEQ ID NO: 638228 - protein, 9 aa, Homo Sapiens
PPHREPGPV

SEQ ID NO: 638229 - protein, 9 aa, Homo Sapiens
DGVLFFLTT

SEQ ID NO: 638230 - protein, 9 aa, Homo Sapiens
AEGGVLPNI

SEQ ID NO: 638231 - protein, 9 aa, Homo Sapiens
SYRPAMCFT

SEQ ID NO: 638232 - protein, 9 aa, Homo Sapiens
EEKPTIPTE

SEQ ID NO: 638233 - protein, 9 aa, Homo Sapiens
HWHREELEH

SEQ ID NO: 638234 - protein, 9 aa, Homo Sapiens
VMVTLVPCW

SEQ ID NO: 638235 - protein, 9 aa, Homo Sapiens
SLNMENNGL

SEQ ID NO: 638236 - protein, 9 aa, Homo Sapiens
ATSDMLKDT

SEQ ID NO: 638237 - protein, 9 aa, Homo Sapiens
NNPQNQERS

SEQ ID NO: 638238 - protein, 9 aa, Homo Sapiens
REPGPVAAR

SEQ ID NO: 638239 - protein, 9 aa, Homo Sapiens
ALLESAFVN

SEQ ID NO: 638240 - protein, 9 aa, Homo Sapiens
FKKARENQQ

SEQ ID NO: 638241 - protein, 9 aa, Homo Sapiens
VVSISVADM

SEQ ID NO: 638242 - protein, 9 aa, Homo Sapiens
ELIRSQAIK

SEQ ID NO: 638243 - protein, 9 aa, Homo Sapiens
HLDRIHLHH

SEQ ID NO: 638244 - protein, 9 aa, Homo Sapiens
ERAKINQTE

SEQ ID NO: 638245 - protein, 9 aa, Homo Sapiens
MFACIVVQL

SEQ ID NO: 638246 - protein, 9 aa, Homo Sapiens
ALQRHGRGE

SEQ ID NO: 638247 - protein, 9 aa, Homo Sapiens
KEDPLMLDV

SEQ ID NO: 638248 - protein, 9 aa, Homo Sapiens
MLDVVRSFE

SEQ ID NO: 638249 - protein, 9 aa, Homo Sapiens
GSPSGADGR

SEQ ID NO: 638250 - protein, 9 aa, Homo Sapiens
KANYDDDRK

SEQ ID NO: 638251 - protein, 9 aa, Homo Sapiens
KLKATWGIE

SEQ ID NO: 638252 - protein, 9 aa, Homo Sapiens
KDLIGVLPL

SEQ ID NO: 638253 - protein, 9 aa, Homo Sapiens
LVVAENEPS

SEQ ID NO: 638254 - protein, 9 aa, Homo Sapiens
VFCCEIKEA

SEQ ID NO: 638255 - protein, 9 aa, Homo Sapiens
DLGEDTDRA

SEQ ID NO: 638256 - protein, 9 aa, Homo Sapiens
FGYCVPHTT

SEQ ID NO: 638257 - protein, 9 aa, Homo Sapiens
HHDALGPGG

SEQ ID NO: 638258 - protein, 9 aa, Homo Sapiens
NVMLFLDEK

SEQ ID NO: 638259 - protein, 9 aa, Homo Sapiens
EKRFVHDGN

SEQ ID NO: 638260 - protein, 9 aa, Homo Sapiens
VSQPVMVQR

SEQ ID NO: 638261 - protein, 9 aa, Homo Sapiens
KVVAARAAG

SEQ ID NO: 638262 - protein, 9 aa, Homo Sapiens
LTLGTVWLC

SEQ ID NO: 638263 - protein, 9 aa, Homo Sapiens
ETISNPYPP

SEQ ID NO: 638264 - protein, 9 aa, Homo Sapiens
GRRVRQEVP

SEQ ID NO: 638265 - protein, 9 aa, Homo Sapiens
SIMILICLY

SEQ ID NO: 638266 - protein, 9 aa, Homo Sapiens
PALADCSRP

SEQ ID NO: 638267 - protein, 9 aa, Homo Sapiens
RKHCPLDID

SEQ ID NO: 638268 - protein, 9 aa, Homo Sapiens
HAEVNETIS

SEQ ID NO: 638269 - protein, 9 aa, Homo Sapiens
FTFDLYSAL

SEQ ID NO: 638270 - protein, 9 aa, Homo Sapiens
GMSDLLAPI

SEQ ID NO: 638271 - protein, 9 aa, Homo Sapiens
HLVNFPRSK

SEQ ID NO: 638272 - protein, 9 aa, Homo Sapiens
STIVRRPHA

SEQ ID NO: 638273 - protein, 9 aa, Homo Sapiens
SDALNYPAG

SEQ ID NO: 638274 - protein, 9 aa, Homo Sapiens
AGDEDKDES

SEQ ID NO: 638275 - protein, 9 aa, Homo Sapiens
LQTPAAPQR

SEQ ID NO: 638276 - protein, 9 aa, Homo Sapiens
AVAQRKPWA

SEQ ID NO: 638277 - protein, 9 aa, Homo Sapiens
PLAPTLIME

SEQ ID NO: 638278 - protein, 9 aa, Homo Sapiens
ERMRSPQYL

SEQ ID NO: 638279 - protein, 9 aa, Homo Sapiens
QKIIKMHLI

SEQ ID NO: 638280 - protein, 9 aa, Homo Sapiens
TPRGQVRVA

SEQ ID NO: 638281 - protein, 9 aa, Homo Sapiens
FQQNSGYPS

SEQ ID NO: 638282 - protein, 9 aa, Homo Sapiens
PEEGRKRTG

SEQ ID NO: 638283 - protein, 9 aa, Homo Sapiens
HCPLDIDCL

SEQ ID NO: 638284 - protein, 9 aa, Homo Sapiens
LVPCWMVYF

SEQ ID NO: 638285 - protein, 9 aa, Homo Sapiens
PLGHPAAGH

SEQ ID NO: 638286 - protein, 9 aa, Homo Sapiens
IAVGALFVK

SEQ ID NO: 638287 - protein, 9 aa, Homo Sapiens
ARENQQIGR

SEQ ID NO: 638288 - protein, 9 aa, Homo Sapiens
ISGNPEPYQ

SEQ ID NO: 638289 - protein, 9 aa, Homo Sapiens
GNYGWMERK

SEQ ID NO: 638290 - protein, 9 aa, Homo Sapiens
VDKFIKCRM

SEQ ID NO: 638291 - protein, 9 aa, Homo Sapiens
GECLQNKDL

SEQ ID NO: 638292 - protein, 9 aa, Homo Sapiens
YVDSNGGMT

SEQ ID NO: 638293 - protein, 9 aa, Homo Sapiens
SGRSWVGVA

SEQ ID NO: 638294 - protein, 9 aa, Homo Sapiens
SPRAHIFRR

SEQ ID NO: 638295 - protein, 9 aa, Homo Sapiens
LLLFPCGQW

SEQ ID NO: 638296 - protein, 9 aa, Homo Sapiens
SDHSVSQPV

SEQ ID NO: 638297 - protein, 9 aa, Homo Sapiens
LRIQKEHLV

SEQ ID NO: 638298 - protein, 9 aa, Homo Sapiens
SFECLMCGK

SEQ ID NO: 638299 - protein, 9 aa, Homo Sapiens
TTRTRCWND

SEQ ID NO: 638300 - protein, 9 aa, Homo Sapiens
EPPGGAFNW

SEQ ID NO: 638301 - protein, 9 aa, Homo Sapiens
PGGTVSQQR

SEQ ID NO: 638302 - protein, 9 aa, Homo Sapiens
ASHMIAVSV

SEQ ID NO: 638303 - protein, 9 aa, Homo Sapiens
FNRRKRKTI

SEQ ID NO: 638304 - protein, 9 aa, Homo Sapiens
AHSVGLMCW

SEQ ID NO: 638305 - protein, 9 aa, Homo Sapiens
GEAEEDEDK

SEQ ID NO: 638306 - protein, 9 aa, Homo Sapiens
GAPQALGLQ

SEQ ID NO: 638307 - protein, 9 aa, Homo Sapiens
MNPIIYSVN

SEQ ID NO: 638308 - protein, 9 aa, Homo Sapiens
IPVNPIGYY

SEQ ID NO: 638309 - protein, 9 aa, Homo Sapiens
DDIRSLSDA

SEQ ID NO: 638310 - protein, 9 aa, Homo Sapiens
TRMTSGRSW

SEQ ID NO: 638311 - protein, 9 aa, Homo Sapiens
AKHSGLGEY

SEQ ID NO: 638312 - protein, 9 aa, Homo Sapiens
GLMCWMLAR

SEQ ID NO: 638313 - protein, 9 aa, Homo Sapiens
GLQPVLDGP

SEQ ID NO: 638314 - protein, 9 aa, Homo Sapiens
YMVTMMVET

SEQ ID NO: 638315 - protein, 9 aa, Homo Sapiens
VQMSKFSYP

SEQ ID NO: 638316 - protein, 9 aa, Homo Sapiens
TTFANSVLI

SEQ ID NO: 638317 - protein, 9 aa, Homo Sapiens
EKGKEEKLY

SEQ ID NO: 638318 - protein, 9 aa, Homo Sapiens
LFGKFGHAL

SEQ ID NO: 638319 - protein, 9 aa, Homo Sapiens
SQKLFSPQT

SEQ ID NO: 638320 - protein, 9 aa, Homo Sapiens
KVVTLLVSR

SEQ ID NO: 638321 - protein, 9 aa, Homo Sapiens
SVWLHGEFS

SEQ ID NO: 638322 - protein, 9 aa, Homo Sapiens
PPPPEFRRW

SEQ ID NO: 638323 - protein, 9 aa, Homo Sapiens
KLRSSILPP

SEQ ID NO: 638324 - protein, 9 aa, Homo Sapiens
GKVTIAEGG

SEQ ID NO: 638325 - protein, 9 aa, Homo Sapiens
MILICLYMV

SEQ ID NO: 638326 - protein, 9 aa, Homo Sapiens
GLWRTSCLE

SEQ ID NO: 638327 - protein, 9 aa, Homo Sapiens
SAMKTLSSK

SEQ ID NO: 638328 - protein, 9 aa, Homo Sapiens
AAKKNVKGN

SEQ ID NO: 638329 - protein, 9 aa, Homo Sapiens
RPIHYTVLM

SEQ ID NO: 638330 - protein, 9 aa, Homo Sapiens
KVAARGTLR

SEQ ID NO: 638331 - protein, 9 aa, Homo Sapiens
AFQGLAMSP

SEQ ID NO: 638332 - protein, 9 aa, Homo Sapiens
SSILARVNI

SEQ ID NO: 638333 - protein, 9 aa, Homo Sapiens
HGRGEPAQV

SEQ ID NO: 638334 - protein, 9 aa, Homo Sapiens
SPLPSLQNG

SEQ ID NO: 638335 - protein, 9 aa, Homo Sapiens
EFYVLTSST

SEQ ID NO: 638336 - protein, 9 aa, Homo Sapiens
GVPPTEYRP

SEQ ID NO: 638337 - protein, 9 aa, Homo Sapiens
CGDRSDEPD

SEQ ID NO: 638338 - protein, 9 aa, Homo Sapiens
TPSSWIASE

SEQ ID NO: 638339 - protein, 9 aa, Homo Sapiens
VGREGRLLR

SEQ ID NO: 638340 - protein, 9 aa, Homo Sapiens
SGQFCPTWH

SEQ ID NO: 638341 - protein, 9 aa, Homo Sapiens
AWTLQIHES

SEQ ID NO: 638342 - protein, 9 aa, Homo Sapiens
PAPPPESPP

SEQ ID NO: 638343 - protein, 9 aa, Homo Sapiens
SMYHEVQYA

SEQ ID NO: 638344 - protein, 9 aa, Homo Sapiens
EELEHRPQH

SEQ ID NO: 638345 - protein, 9 aa, Homo Sapiens
DLLAPILAE

SEQ ID NO: 638346 - protein, 9 aa, Homo Sapiens
RKAERRTTL

SEQ ID NO: 638347 - protein, 9 aa, Homo Sapiens
VMVQRRPGQ

SEQ ID NO: 638348 - protein, 9 aa, Homo Sapiens
SSFTASEGC

SEQ ID NO: 638349 - protein, 9 aa, Homo Sapiens
GKFGHALSV

SEQ ID NO: 638350 - protein, 9 aa, Homo Sapiens
LGTVWLCGK

SEQ ID NO: 638351 - protein, 9 aa, Homo Sapiens
SSESWELTD

SEQ ID NO: 638352 - protein, 9 aa, Homo Sapiens
GSHLEPTNH

SEQ ID NO: 638353 - protein, 9 aa, Homo Sapiens
PEELPGGTV

SEQ ID NO: 638354 - protein, 9 aa, Homo Sapiens
PPPPLAPTL

SEQ ID NO: 638355 - protein, 9 aa, Homo Sapiens
CEIEAAAVA

SEQ ID NO: 638356 - protein, 9 aa, Homo Sapiens
QAGTEMRMK

SEQ ID NO: 638357 - protein, 9 aa, Homo Sapiens
MGNTCYEKA

SEQ ID NO: 638358 - protein, 9 aa, Homo Sapiens
IPADYAAIK

SEQ ID NO: 638359 - protein, 9 aa, Homo Sapiens
LDSLFSILH

SEQ ID NO: 638360 - protein, 9 aa, Homo Sapiens
RPAGLQPVL

SEQ ID NO: 638361 - protein, 9 aa, Homo Sapiens
GNIFVVSIS

SEQ ID NO: 638362 - protein, 9 aa, Homo Sapiens
AVSVFYGTM

SEQ ID NO: 638363 - protein, 9 aa, Homo Sapiens
RKRTGKQNE

SEQ ID NO: 638364 - protein, 9 aa, Homo Sapiens
SSGTFILAP

SEQ ID NO: 638365 - protein, 9 aa, Homo Sapiens
MNPISGNPE

SEQ ID NO: 638366 - protein, 9 aa, Homo Sapiens
PASPSLRRV

SEQ ID NO: 638367 - protein, 9 aa, Homo Sapiens
ENVSGQFCP

SEQ ID NO: 638368 - protein, 9 aa, Homo Sapiens
GYRDMCPTT

SEQ ID NO: 638369 - protein, 9 aa, Homo Sapiens
NYLEKNWIP

SEQ ID NO: 638370 - protein, 9 aa, Homo Sapiens
SLKTDPSAT

SEQ ID NO: 638371 - protein, 9 aa, Homo Sapiens
TFLIIAAPD

SEQ ID NO: 638372 - protein, 9 aa, Homo Sapiens
ADGRQAGGA

SEQ ID NO: 638373 - protein, 9 aa, Homo Sapiens
SVQETVLPM

SEQ ID NO: 638374 - protein, 9 aa, Homo Sapiens
FPCGQWPWR

SEQ ID NO: 638375 - protein, 9 aa, Homo Sapiens
AGAGEPGCQ

SEQ ID NO: 638376 - protein, 9 aa, Homo Sapiens
PDFPSPTSS

SEQ ID NO: 638377 - protein, 9 aa, Homo Sapiens
GYTSPDSLT

SEQ ID NO: 638378 - protein, 9 aa, Homo Sapiens
PLFSGTEHH

SEQ ID NO: 638379 - protein, 9 aa, Homo Sapiens
RCLQGAGAG

SEQ ID NO: 638380 - protein, 9 aa, Homo Sapiens
PSQQPPSTL

SEQ ID NO: 638381 - protein, 9 aa, Homo Sapiens
TVCTLGFAI

SEQ ID NO: 638382 - protein, 9 aa, Homo Sapiens
EQLDWTVCF

SEQ ID NO: 638383 - protein, 9 aa, Homo Sapiens
AGGAPQALG

SEQ ID NO: 638384 - protein, 9 aa, Homo Sapiens
PGKERRQNP

SEQ ID NO: 638385 - protein, 9 aa, Homo Sapiens
FATCASHLI

SEQ ID NO: 638386 - protein, 9 aa, Homo Sapiens
SESQTPRGQ

SEQ ID NO: 638387 - protein, 9 aa, Homo Sapiens
NWGRLSKPP

SEQ ID NO: 638388 - protein, 9 aa, Homo Sapiens
LYTVVPHLV

SEQ ID NO: 638389 - protein, 9 aa, Homo Sapiens
DLRVGGRGC

SEQ ID NO: 638390 - protein, 9 aa, Homo Sapiens
LTPNVNEDT

SEQ ID NO: 638391 - protein, 9 aa, Homo Sapiens
FILAPASTE

SEQ ID NO: 638392 - protein, 9 aa, Homo Sapiens
SNGSPSGAD

SEQ ID NO: 638393 - protein, 9 aa, Homo Sapiens
LSLLASPDT

SEQ ID NO: 638394 - protein, 9 aa, Homo Sapiens
VFSTCGAHV

SEQ ID NO: 638395 - protein, 9 aa, Homo Sapiens
GYLCYSGYT

SEQ ID NO: 638396 - protein, 9 aa, Homo Sapiens
DDAVAAKHS

SEQ ID NO: 638397 - protein, 9 aa, Homo Sapiens
FAFQLLFAE

SEQ ID NO: 638398 - protein, 9 aa, Homo Sapiens
AAAHGGQCP

SEQ ID NO: 638399 - protein, 9 aa, Homo Sapiens
RSLPCLSQS

SEQ ID NO: 638400 - protein, 9 aa, Homo Sapiens
LFLDEKEQA

SEQ ID NO: 638401 - protein, 9 aa, Homo Sapiens
WTFEACLQI

SEQ ID NO: 638402 - protein, 9 aa, Homo Sapiens
NLSSPPKTA

SEQ ID NO: 638403 - protein, 9 aa, Homo Sapiens
GPSIFAVVG

SEQ ID NO: 638404 - protein, 9 aa, Homo Sapiens
SQPSQGFGN

SEQ ID NO: 638405 - protein, 9 aa, Homo Sapiens
KFGYCVPHT

SEQ ID NO: 638406 - protein, 9 aa, Homo Sapiens
PGCQREPPG

SEQ ID NO: 638407 - protein, 9 aa, Homo Sapiens
RALGPTGKA

SEQ ID NO: 638408 - protein, 9 aa, Homo Sapiens
NGYTSPDSL

SEQ ID NO: 638409 - protein, 9 aa, Homo Sapiens
RAHIFRRNQ

SEQ ID NO: 638410 - protein, 9 aa, Homo Sapiens
RYPEKRFVH

SEQ ID NO: 638411 - protein, 9 aa, Homo Sapiens
ESISSILAR

SEQ ID NO: 638412 - protein, 9 aa, Homo Sapiens
FGHALSVKV

SEQ ID NO: 638413 - protein, 9 aa, Homo Sapiens
PVAVLSVFE

SEQ ID NO: 638414 - protein, 9 aa, Homo Sapiens
YIIIFHHEL

SEQ ID NO: 638415 - protein, 9 aa, Homo Sapiens
HCSTDFRGR

SEQ ID NO: 638416 - protein, 9 aa, Homo Sapiens
LVNFPRSKH

SEQ ID NO: 638417 - protein, 9 aa, Homo Sapiens
PVMVTLVPC

SEQ ID NO: 638418 - protein, 9 aa, Homo Sapiens
RPHAATTAP

SEQ ID NO: 638419 - protein, 9 aa, Homo Sapiens
ISRPSVKGP

SEQ ID NO: 638420 - protein, 9 aa, Homo Sapiens
AFPQYAQLY

SEQ ID NO: 638421 - protein, 9 aa, Homo Sapiens
NLDLPLQCY

SEQ ID NO: 638422 - protein, 9 aa, Homo Sapiens
ERRTTLVLW

SEQ ID NO: 638423 - protein, 9 aa, Homo Sapiens
TRNWENEQP

SEQ ID NO: 638424 - protein, 9 aa, Homo Sapiens
VPGPLQGLT

SEQ ID NO: 638425 - protein, 9 aa, Homo Sapiens
LMCWMLARE

SEQ ID NO: 638426 - protein, 9 aa, Homo Sapiens
SPPPIAPSP

SEQ ID NO: 638427 - protein, 9 aa, Homo Sapiens
AAIKAPMFS

SEQ ID NO: 638428 - protein, 9 aa, Homo Sapiens
ATCASHLIV

SEQ ID NO: 638429 - protein, 9 aa, Homo Sapiens
NDYVNLRLE

SEQ ID NO: 638430 - protein, 9 aa, Homo Sapiens
YCLRSFKGY

SEQ ID NO: 638431 - protein, 9 aa, Homo Sapiens
FLIIAAPDT

SEQ ID NO: 638432 - protein, 9 aa, Homo Sapiens
LRLIKGTKG

SEQ ID NO: 638433 - protein, 9 aa, Homo Sapiens
DRAHSTLDE

SEQ ID NO: 638434 - protein, 9 aa, Homo Sapiens
FACFVAQAP

SEQ ID NO: 638435 - protein, 9 aa, Homo Sapiens
NSSNGVNDS

SEQ ID NO: 638436 - protein, 9 aa, Homo Sapiens
NKQMQIEVA

SEQ ID NO: 638437 - protein, 9 aa, Homo Sapiens
PLPFACFVA

SEQ ID NO: 638438 - protein, 9 aa, Homo Sapiens
LGQSTDNPQ

SEQ ID NO: 638439 - protein, 9 aa, Homo Sapiens
PSEVTCLPS

SEQ ID NO: 638440 - protein, 9 aa, Homo Sapiens
SRIWDELYL

SEQ ID NO: 638441 - protein, 9 aa, Homo Sapiens
KAFGKCVSH

SEQ ID NO: 638442 - protein, 9 aa, Homo Sapiens
ILAVGVCNV

SEQ ID NO: 638443 - protein, 9 aa, Homo Sapiens
ETLCFASIL

SEQ ID NO: 638444 - protein, 9 aa, Homo Sapiens
GPVQMSKFS

SEQ ID NO: 638445 - protein, 9 aa, Homo Sapiens
DCVGSFFEA

SEQ ID NO: 638446 - protein, 9 aa, Homo Sapiens
DELECVRCF

SEQ ID NO: 638447 - protein, 9 aa, Homo Sapiens
DPVDAIHLG

SEQ ID NO: 638448 - protein, 9 aa, Homo Sapiens
RVARGGEGQ

SEQ ID NO: 638449 - protein, 9 aa, Homo Sapiens
GPRRVNPGL

SEQ ID NO: 638450 - protein, 9 aa, Homo Sapiens
MLFLDEKEQ

SEQ ID NO: 638451 - protein, 9 aa, Homo Sapiens
PAGLQPVLD

SEQ ID NO: 638452 - protein, 9 aa, Homo Sapiens
CKDMRNMRF

SEQ ID NO: 638453 - protein, 9 aa, Homo Sapiens
ILARVNIVG

SEQ ID NO: 638454 - protein, 9 aa, Homo Sapiens
EVWQRAAAH

SEQ ID NO: 638455 - protein, 9 aa, Homo Sapiens
VCDFPLGSH

SEQ ID NO: 638456 - protein, 9 aa, Homo Sapiens
LPAEGDRGP

SEQ ID NO: 638457 - protein, 9 aa, Homo Sapiens
KQKIIKMHL

SEQ ID NO: 638458 - protein, 9 aa, Homo Sapiens
DGRQAGGAP

SEQ ID NO: 638459 - protein, 9 aa, Homo Sapiens
PVNPIGYYD

SEQ ID NO: 638460 - protein, 9 aa, Homo Sapiens
WDVDELECV

SEQ ID NO: 638461 - protein, 9 aa, Homo Sapiens
PSPSPTRKD

SEQ ID NO: 638462 - protein, 9 aa, Homo Sapiens
TYSGNSLQR

SEQ ID NO: 638463 - protein, 9 aa, Homo Sapiens
RGQVRVARG

SEQ ID NO: 638464 - protein, 9 aa, Homo Sapiens
SQGMSDLLA

SEQ ID NO: 638465 - protein, 9 aa, Homo Sapiens
RTIFEIVLN

SEQ ID NO: 638466 - protein, 9 aa, Homo Sapiens
ERSAADLDP

SEQ ID NO: 638467 - protein, 9 aa, Homo Sapiens
QFCPTWHCE

SEQ ID NO: 638468 - protein, 9 aa, Homo Sapiens
VNTQQIHTR

SEQ ID NO: 638469 - protein, 9 aa, Homo Sapiens
DYGVTVHCS

SEQ ID NO: 638470 - protein, 9 aa, Homo Sapiens
KLVEEEASI

SEQ ID NO: 638471 - protein, 9 aa, Homo Sapiens
NLSIEESRP

SEQ ID NO: 638472 - protein, 9 aa, Homo Sapiens
VNETISNPY

SEQ ID NO: 638473 - protein, 9 aa, Homo Sapiens
SLERASSSL

SEQ ID NO: 638474 - protein, 9 aa, Homo Sapiens
TLYETIISY

SEQ ID NO: 638475 - protein, 9 aa, Homo Sapiens
FTFGIESRI

SEQ ID NO: 638476 - protein, 9 aa, Homo Sapiens
VTHIFLLSL

SEQ ID NO: 638477 - protein, 9 aa, Homo Sapiens
KECIEPCTS

SEQ ID NO: 638478 - protein, 9 aa, Homo Sapiens
HKNPNPHQN

SEQ ID NO: 638479 - protein, 9 aa, Homo Sapiens
NAGEQSFNK

SEQ ID NO: 638480 - protein, 9 aa, Homo Sapiens
EKVEIIAND

SEQ ID NO: 638481 - protein, 9 aa, Homo Sapiens
LFAEGAGDG

SEQ ID NO: 638482 - protein, 9 aa, Homo Sapiens
PQALGLQEP

SEQ ID NO: 638483 - protein, 9 aa, Homo Sapiens
AHPAAANGL

SEQ ID NO: 638484 - protein, 9 aa, Homo Sapiens
HPAAGHGHH

SEQ ID NO: 638485 - protein, 9 aa, Homo Sapiens
EDLHDGHNL

SEQ ID NO: 638486 - protein, 9 aa, Homo Sapiens
KAGSRGLTF

SEQ ID NO: 638487 - protein, 9 aa, Homo Sapiens
LPENQRSKA

SEQ ID NO: 638488 - protein, 9 aa, Homo Sapiens
RHKNPNPHQ

SEQ ID NO: 638489 - protein, 9 aa, Homo Sapiens
IERNSFLGL

SEQ ID NO: 638490 - protein, 9 aa, Homo Sapiens
GQWPWRGAG

SEQ ID NO: 638491 - protein, 9 aa, Homo Sapiens
YSGYTRGGS

SEQ ID NO: 638492 - protein, 9 aa, Homo Sapiens
SFFEAHDTV

SEQ ID NO: 638493 - protein, 9 aa, Homo Sapiens
PDSPPLLAP

SEQ ID NO: 638494 - protein, 9 aa, Homo Sapiens
RNAWYAALA

SEQ ID NO: 638495 - protein, 9 aa, Homo Sapiens
SGSKSISIS

SEQ ID NO: 638496 - protein, 9 aa, Homo Sapiens
YELLYEILD

SEQ ID NO: 638497 - protein, 9 aa, Homo Sapiens
RGINLYEPK

SEQ ID NO: 638498 - protein, 9 aa, Homo Sapiens
DLHDGHNLI

SEQ ID NO: 638499 - protein, 9 aa, Homo Sapiens
LLRPAGLQP

SEQ ID NO: 638500 - protein, 9 aa, Homo Sapiens
YRPAMCFTT

SEQ ID NO: 638501 - protein, 9 aa, Homo Sapiens
GPLQGLTNQ

SEQ ID NO: 638502 - protein, 9 aa, Homo Sapiens
RWLPVAGEA

SEQ ID NO: 638503 - protein, 9 aa, Homo Sapiens
SGADGRQAG

SEQ ID NO: 638504 - protein, 9 aa, Homo Sapiens
PMHQSSLKK

SEQ ID NO: 638505 - protein, 9 aa, Homo Sapiens
AGADQNLDP

SEQ ID NO: 638506 - protein, 9 aa, Homo Sapiens
YAAIKAPMF

SEQ ID NO: 638507 - protein, 9 aa, Homo Sapiens
SGALTHVLV

SEQ ID NO: 638508 - protein, 9 aa, Homo Sapiens
FCCEIKEAV

SEQ ID NO: 638509 - protein, 9 aa, Homo Sapiens
TVSQQRVQG

SEQ ID NO: 638510 - protein, 9 aa, Homo Sapiens
SPSYRPAMC

SEQ ID NO: 638511 - protein, 9 aa, Homo Sapiens
SLRRVGIFL

SEQ ID NO: 638512 - protein, 9 aa, Homo Sapiens
SPSLRRVGI

SEQ ID NO: 638513 - protein, 9 aa, Homo Sapiens
NRLKLTFSS

SEQ ID NO: 638514 - protein, 9 aa, Homo Sapiens
TVTPKYQVV

SEQ ID NO: 638515 - protein, 9 aa, Homo Sapiens
CTLGFAICS

SEQ ID NO: 638516 - protein, 9 aa, Homo Sapiens
SESWELTDT

SEQ ID NO: 638517 - protein, 9 aa, Homo Sapiens
QALLGSQPS

SEQ ID NO: 638518 - protein, 9 aa, Homo Sapiens
NWIPFANCS

SEQ ID NO: 638519 - protein, 9 aa, Homo Sapiens
FTPLHHLDR

SEQ ID NO: 638520 - protein, 9 aa, Homo Sapiens
TLDSLFSIL

SEQ ID NO: 638521 - protein, 9 aa, Homo Sapiens
EPGPVAARR

SEQ ID NO: 638522 - protein, 9 aa, Homo Sapiens
PAEGDRGPA

SEQ ID NO: 638523 - protein, 9 aa, Homo Sapiens
FACIVVQLF

SEQ ID NO: 638524 - protein, 9 aa, Homo Sapiens
QQNSGYPSQ

SEQ ID NO: 638525 - protein, 9 aa, Homo Sapiens
VALAFRPDF

SEQ ID NO: 638526 - protein, 9 aa, Homo Sapiens
LCKQKPAYP

SEQ ID NO: 638527 - protein, 9 aa, Homo Sapiens
ESSGNYGYN

SEQ ID NO: 638528 - protein, 9 aa, Homo Sapiens
GSPSDQENA

SEQ ID NO: 638529 - protein, 9 aa, Homo Sapiens
NMSRDPLLH

SEQ ID NO: 638530 - protein, 9 aa, Homo Sapiens
EQEIATVAS

SEQ ID NO: 638531 - protein, 9 aa, Homo Sapiens
DSYGECLQN

SEQ ID NO: 638532 - protein, 9 aa, Homo Sapiens
CPDGLGFSS

SEQ ID NO: 638533 - protein, 9 aa, Homo Sapiens
TNHLKSLKT

SEQ ID NO: 638534 - protein, 9 aa, Homo Sapiens
NQERSLKFD

SEQ ID NO: 638535 - protein, 9 aa, Homo Sapiens
KMVPSKDRA

SEQ ID NO: 638536 - protein, 9 aa, Homo Sapiens
SEFPHKFGY

SEQ ID NO: 638537 - protein, 9 aa, Homo Sapiens
SRNSPLPSL

SEQ ID NO: 638538 - protein, 9 aa, Homo Sapiens
EWEETSDPR

SEQ ID NO: 638539 - protein, 9 aa, Homo Sapiens
IIFHHELNV

SEQ ID NO: 638540 - protein, 9 aa, Homo Sapiens
GDCVGSFFE

SEQ ID NO: 638541 - protein, 9 aa, Homo Sapiens
NRDGVLFFL

SEQ ID NO: 638542 - protein, 9 aa, Homo Sapiens
AKIKKKSEV

SEQ ID NO: 638543 - protein, 9 aa, Homo Sapiens
APASTEPRS

SEQ ID NO: 638544 - protein, 9 aa, Homo Sapiens
YEILDFGYP

SEQ ID NO: 638545 - protein, 9 aa, Homo Sapiens
KKGDDMPEI

SEQ ID NO: 638546 - protein, 9 aa, Homo Sapiens
SCPHWSKCG

SEQ ID NO: 638547 - protein, 9 aa, Homo Sapiens
PFARGNSEP

SEQ ID NO: 638548 - protein, 9 aa, Homo Sapiens
LFTPLHHLD

SEQ ID NO: 638549 - protein, 9 aa, Homo Sapiens
ECIEPCTST

SEQ ID NO: 638550 - protein, 9 aa, Homo Sapiens
VQAAKKNVK

SEQ ID NO: 638551 - protein, 9 aa, Homo Sapiens
VKVLSQTTI

SEQ ID NO: 638552 - protein, 9 aa, Homo Sapiens
FRRWDYSVW

SEQ ID NO: 638553 - protein, 9 aa, Homo Sapiens
TMMLKSRQN

SEQ ID NO: 638554 - protein, 9 aa, Homo Sapiens
DGKMWCATK

SEQ ID NO: 638555 - protein, 9 aa, Homo Sapiens
LCFASILSI

SEQ ID NO: 638556 - protein, 9 aa, Homo Sapiens
PYRTQYSRQ

SEQ ID NO: 638557 - protein, 9 aa, Homo Sapiens
GTMEPSGEV

SEQ ID NO: 638558 - protein, 9 aa, Homo Sapiens
DPLPENQRS

SEQ ID NO: 638559 - protein, 9 aa, Homo Sapiens
NQRSKAPEP

SEQ ID NO: 638560 - protein, 9 aa, Homo Sapiens
SLAAVGSLT

SEQ ID NO: 638561 - protein, 9 aa, Homo Sapiens
GGPVQMSKF

SEQ ID NO: 638562 - protein, 9 aa, Homo Sapiens
FAITAKYLR

SEQ ID NO: 638563 - protein, 9 aa, Homo Sapiens
SWGPALADC

SEQ ID NO: 638564 - protein, 9 aa, Homo Sapiens
RRAVLPAEG

SEQ ID NO: 638565 - protein, 9 aa, Homo Sapiens
QHPGDHDRA

SEQ ID NO: 638566 - protein, 9 aa, Homo Sapiens
VLPAEGDRG

SEQ ID NO: 638567 - protein, 9 aa, Homo Sapiens
AGHGHHDAL

SEQ ID NO: 638568 - protein, 9 aa, Homo Sapiens
WNSSNGVND

SEQ ID NO: 638569 - protein, 9 aa, Homo Sapiens
VLVPVSRDG

SEQ ID NO: 638570 - protein, 9 aa, Homo Sapiens
ASSSLAAVG

SEQ ID NO: 638571 - protein, 9 aa, Homo Sapiens
IFHHELNVQ

SEQ ID NO: 638572 - protein, 9 aa, Homo Sapiens
LSALCCQSG

SEQ ID NO: 638573 - protein, 9 aa, Homo Sapiens
RNSPLPSLQ

SEQ ID NO: 638574 - protein, 9 aa, Homo Sapiens
GRDSTDPLY

SEQ ID NO: 638575 - protein, 9 aa, Homo Sapiens
VAVALTLHW

SEQ ID NO: 638576 - protein, 9 aa, Homo Sapiens
HWSKCGTCY

SEQ ID NO: 638577 - protein, 9 aa, Homo Sapiens
VVRSFESVD

SEQ ID NO: 638578 - protein, 9 aa, Homo Sapiens
HGCVQALLG

SEQ ID NO: 638579 - protein, 9 aa, Homo Sapiens
PQFTVTPKY

SEQ ID NO: 638580 - protein, 9 aa, Homo Sapiens
YTLSTNGTM

SEQ ID NO: 638581 - protein, 9 aa, Homo Sapiens
QQSLAEKDA

SEQ ID NO: 638582 - protein, 9 aa, Homo Sapiens
PRKPKVLPH

SEQ ID NO: 638583 - protein, 9 aa, Homo Sapiens
GMTASRLLQ

SEQ ID NO: 638584 - protein, 9 aa, Homo Sapiens
RTSCLEGAF

SEQ ID NO: 638585 - protein, 9 aa, Homo Sapiens
AVALTLHWL

SEQ ID NO: 638586 - protein, 9 aa, Homo Sapiens
RVLHQFREQ

SEQ ID NO: 638587 - protein, 9 aa, Homo Sapiens
VHDGNRISW

SEQ ID NO: 638588 - protein, 9 aa, Homo Sapiens
VEVVEMHEN

SEQ ID NO: 638589 - protein, 9 aa, Homo Sapiens
AHVTGVSIY

SEQ ID NO: 638590 - protein, 9 aa, Homo Sapiens
FRPDFPSPT

SEQ ID NO: 638591 - protein, 9 aa, Homo Sapiens
LRQSVSVGR

SEQ ID NO: 638592 - protein, 9 aa, Homo Sapiens
LGKVTIAEG

SEQ ID NO: 638593 - protein, 9 aa, Homo Sapiens
KFQYYLYAT

SEQ ID NO: 638594 - protein, 9 aa, Homo Sapiens
SQEWEETSD

SEQ ID NO: 638595 - protein, 9 aa, Homo Sapiens
KFGHALSVK

SEQ ID NO: 638596 - protein, 9 aa, Homo Sapiens
IPASPSLRR

SEQ ID NO: 638597 - protein, 9 aa, Homo Sapiens
ANMRLTLME

SEQ ID NO: 638598 - protein, 9 aa, Homo Sapiens
SLLSNMSRD

SEQ ID NO: 638599 - protein, 9 aa, Homo Sapiens
QRLRPDEDS

SEQ ID NO: 638600 - protein, 9 aa, Homo Sapiens
HREPGPVAA

SEQ ID NO: 638601 - protein, 9 aa, Homo Sapiens
RLVHELSGR

SEQ ID NO: 638602 - protein, 9 aa, Homo Sapiens
MATMEASQP

SEQ ID NO: 638603 - protein, 9 aa, Homo Sapiens
KHSSLAQSL

SEQ ID NO: 638604 - protein, 9 aa, Homo Sapiens
SIFAVVGNL

SEQ ID NO: 638605 - protein, 9 aa, Homo Sapiens
PAAGHGHHD

SEQ ID NO: 638606 - protein, 9 aa, Homo Sapiens
RRPSDSAQL

SEQ ID NO: 638607 - protein, 9 aa, Homo Sapiens
ISYHPACYR

SEQ ID NO: 638608 - protein, 9 aa, Homo Sapiens
KEKIIMKQI

SEQ ID NO: 638609 - protein, 9 aa, Homo Sapiens
VRRPHAATT

SEQ ID NO: 638610 - protein, 9 aa, Homo Sapiens
FRFSESQTP

SEQ ID NO: 638611 - protein, 9 aa, Homo Sapiens
RSDEPDDCP

SEQ ID NO: 638612 - protein, 9 aa, Homo Sapiens
PSSGALTHV

SEQ ID NO: 638613 - protein, 9 aa, Homo Sapiens
KDESGEERL

SEQ ID NO: 638614 - protein, 9 aa, Homo Sapiens
SDDEPEEGR

SEQ ID NO: 638615 - protein, 9 aa, Homo Sapiens
HQSSLKKRY

SEQ ID NO: 638616 - protein, 9 aa, Homo Sapiens
HLISRQYDK

SEQ ID NO: 638617 - protein, 9 aa, Homo Sapiens
YLEKNWIPF

SEQ ID NO: 638618 - protein, 9 aa, Homo Sapiens
IEISRKAER

SEQ ID NO: 638619 - protein, 9 aa, Homo Sapiens
MGHWHREEL

SEQ ID NO: 638620 - protein, 9 aa, Homo Sapiens
LSGSKSISI

SEQ ID NO: 638621 - protein, 9 aa, Homo Sapiens
GGPRRVNPG

SEQ ID NO: 638622 - protein, 9 aa, Homo Sapiens
PWSLFPDLE

SEQ ID NO: 638623 - protein, 9 aa, Homo Sapiens
WLHGEFSYV

SEQ ID NO: 638624 - protein, 9 aa, Homo Sapiens
YLHSQEDDD

SEQ ID NO: 638625 - protein, 9 aa, Homo Sapiens
GNREVFHAW

SEQ ID NO: 638626 - protein, 9 aa, Homo Sapiens
VDPVAVLSV

SEQ ID NO: 638627 - protein, 9 aa, Homo Sapiens
CLARNYLGA

SEQ ID NO: 638628 - protein, 9 aa, Homo Sapiens
SVLQSRNSP

SEQ ID NO: 638629 - protein, 9 aa, Homo Sapiens
ELYNNPQNQ

SEQ ID NO: 638630 - protein, 9 aa, Homo Sapiens
TVPEEKPTI

SEQ ID NO: 638631 - protein, 9 aa, Homo Sapiens
GFCFFNSFA

SEQ ID NO: 638632 - protein, 9 aa, Homo Sapiens
VELTVEGRF

SEQ ID NO: 638633 - protein, 9 aa, Homo Sapiens
WGRLSKPPE

SEQ ID NO: 638634 - protein, 9 aa, Homo Sapiens
PVAARRAVL

SEQ ID NO: 638635 - protein, 9 aa, Homo Sapiens
IKGTKGIRT

SEQ ID NO: 638636 - protein, 9 aa, Homo Sapiens
SLGPSIFAV

SEQ ID NO: 638637 - protein, 9 aa, Homo Sapiens
ASGSVLIPR

SEQ ID NO: 638638 - protein, 9 aa, Homo Sapiens
KNPNPHQNM

SEQ ID NO: 638639 - protein, 9 aa, Homo Sapiens
TALFETLCF

SEQ ID NO: 638640 - protein, 9 aa, Homo Sapiens
FEELEAQHG

SEQ ID NO: 638641 - protein, 9 aa, Homo Sapiens
SLFPDLEPR

SEQ ID NO: 638642 - protein, 9 aa, Homo Sapiens
VLLQTPAAP

SEQ ID NO: 638643 - protein, 9 aa, Homo Sapiens
GIQNRDGVL

SEQ ID NO: 638644 - protein, 9 aa, Homo Sapiens
PQHPGDHDR

SEQ ID NO: 638645 - protein, 9 aa, Homo Sapiens
GGMNPRPIL

SEQ ID NO: 638646 - protein, 9 aa, Homo Sapiens
GTFILAPAS

SEQ ID NO: 638647 - protein, 9 aa, Homo Sapiens
VAALVMPLR

SEQ ID NO: 638648 - protein, 9 aa, Homo Sapiens
LAAVGSLTP

SEQ ID NO: 638649 - protein, 9 aa, Homo Sapiens
LGFSSQVLW

SEQ ID NO: 638650 - protein, 9 aa, Homo Sapiens
SAAGDEDKD

SEQ ID NO: 638651 - protein, 9 aa, Homo Sapiens
VMPLRLVHE

SEQ ID NO: 638652 - protein, 9 aa, Homo Sapiens
IHVFCCEIK

SEQ ID NO: 638653 - protein, 9 aa, Homo Sapiens
ALPRVPCFS

SEQ ID NO: 638654 - protein, 9 aa, Homo Sapiens
KTPLEVALC

SEQ ID NO: 638655 - protein, 9 aa, Homo Sapiens
LASPDTQAK

SEQ ID NO: 638656 - protein, 9 aa, Homo Sapiens
QNLDPLNCL

SEQ ID NO: 638657 - protein, 9 aa, Homo Sapiens
VNPGLGEAL

SEQ ID NO: 638658 - protein, 9 aa, Homo Sapiens
DGLGFSSQV

SEQ ID NO: 638659 - protein, 9 aa, Homo Sapiens
SLSRIWDEL

SEQ ID NO: 638660 - protein, 9 aa, Homo Sapiens
IVVIVHYSC

SEQ ID NO: 638661 - protein, 9 aa, Homo Sapiens
VTGVSIYYG

SEQ ID NO: 638662 - protein, 9 aa, Homo Sapiens
MHLIVALLF

SEQ ID NO: 638663 - protein, 9 aa, Homo Sapiens
PTKECIEPC

SEQ ID NO: 638664 - protein, 9 aa, Homo Sapiens
VFQHEKVEI

SEQ ID NO: 638665 - protein, 9 aa, Homo Sapiens
TMTTVGYRD

SEQ ID NO: 638666 - protein, 9 aa, Homo Sapiens
VTESSGNYG

SEQ ID NO: 638667 - protein, 9 aa, Homo Sapiens
LGDCVGSFF

SEQ ID NO: 638668 - protein, 9 aa, Homo Sapiens
GLGAGPSGA

SEQ ID NO: 638669 - protein, 9 aa, Homo Sapiens
PHREPGPVA

SEQ ID NO: 638670 - protein, 9 aa, Homo Sapiens
SCVGVFQHE

SEQ ID NO: 638671 - protein, 9 aa, Homo Sapiens
LGNCTSQST

SEQ ID NO: 638672 - protein, 9 aa, Homo Sapiens
CAVWGRHRE

SEQ ID NO: 638673 - protein, 9 aa, Homo Sapiens
SDLEDDLGR

SEQ ID NO: 638674 - protein, 9 aa, Homo Sapiens
NVSGQFCPT

SEQ ID NO: 638675 - protein, 9 aa, Homo Sapiens
VRCFRIKPL

SEQ ID NO: 638676 - protein, 9 aa, Homo Sapiens
GKAGSRGLT

SEQ ID NO: 638677 - protein, 9 aa, Homo Sapiens
KRGINLYEP

SEQ ID NO: 638678 - protein, 9 aa, Homo Sapiens
LLFAEGAGD

SEQ ID NO: 638679 - protein, 9 aa, Homo Sapiens
AERHLQGRL

SEQ ID NO: 638680 - protein, 9 aa, Homo Sapiens
SAADLDPRG

SEQ ID NO: 638681 - protein, 9 aa, Homo Sapiens
TDRAHSTLD

SEQ ID NO: 638682 - protein, 9 aa, Homo Sapiens
STNGTMEPS

SEQ ID NO: 638683 - protein, 9 aa, Homo Sapiens
IVHLISRQY

SEQ ID NO: 638684 - protein, 9 aa, Homo Sapiens
IMKQIENLE

SEQ ID NO: 638685 - protein, 9 aa, Homo Sapiens
FGNSLGNCT

SEQ ID NO: 638686 - protein, 9 aa, Homo Sapiens
AGCNHLLYG

SEQ ID NO: 638687 - protein, 9 aa, Homo Sapiens
EVVEMHEND

SEQ ID NO: 638688 - protein, 9 aa, Homo Sapiens
LKVVAARAA

SEQ ID NO: 638689 - protein, 9 aa, Homo Sapiens
PSSPRIRKR

SEQ ID NO: 638690 - protein, 9 aa, Homo Sapiens
HKTCTRKER

SEQ ID NO: 638691 - protein, 9 aa, Homo Sapiens
RSFKGYINE

SEQ ID NO: 638692 - protein, 9 aa, Homo Sapiens
LLVSRKCQI

SEQ ID NO: 638693 - protein, 9 aa, Homo Sapiens
DTDRAHSTL

SEQ ID NO: 638694 - protein, 9 aa, Homo Sapiens
DVVRSFESV

SEQ ID NO: 638695 - protein, 9 aa, Homo Sapiens
LEDGHSLSD

SEQ ID NO: 638696 - protein, 9 aa, Homo Sapiens
MFIPVKYWH

SEQ ID NO: 638697 - protein, 9 aa, Homo Sapiens
PLMLDVVRS

SEQ ID NO: 638698 - protein, 9 aa, Homo Sapiens
EPEEGRKRT

SEQ ID NO: 638699 - protein, 9 aa, Homo Sapiens
KTSGITFIK

SEQ ID NO: 638700 - protein, 9 aa, Homo Sapiens
AAVASTTSP

SEQ ID NO: 638701 - protein, 9 aa, Homo Sapiens
GLGFSSQVL

SEQ ID NO: 638702 - protein, 9 aa, Homo Sapiens
TGIQNRDGV

SEQ ID NO: 638703 - protein, 9 aa, Homo Sapiens
VLAFQGLAM

SEQ ID NO: 638704 - protein, 9 aa, Homo Sapiens
RNSFLGLSF

SEQ ID NO: 638705 - protein, 9 aa, Homo Sapiens
SRKCQIDIY

SEQ ID NO: 638706 - protein, 9 aa, Homo Sapiens
REHAANGPA

SEQ ID NO: 638707 - protein, 9 aa, Homo Sapiens
KVTIAEGGV

SEQ ID NO: 638708 - protein, 9 aa, Homo Sapiens
HHLQTHTGT

SEQ ID NO: 638709 - protein, 9 aa, Homo Sapiens
ELQHHLQTH

SEQ ID NO: 638710 - protein, 9 aa, Homo Sapiens
LIATVCTLG

SEQ ID NO: 638711 - protein, 9 aa, Homo Sapiens
QNVTEENAS

SEQ ID NO: 638712 - protein, 9 aa, Homo Sapiens
PCGQWPWRG

SEQ ID NO: 638713 - protein, 9 aa, Homo Sapiens
LRVGGRGCE

SEQ ID NO: 638714 - protein, 9 aa, Homo Sapiens
FLGLSFESV

SEQ ID NO: 638715 - protein, 9 aa, Homo Sapiens
VRYDSGGQV

SEQ ID NO: 638716 - protein, 9 aa, Homo Sapiens
GSHKSSPTS

SEQ ID NO: 638717 - protein, 9 aa, Homo Sapiens
GCQREPPGG

SEQ ID NO: 638718 - protein, 9 aa, Homo Sapiens
HSVGLMCWM

SEQ ID NO: 638719 - protein, 9 aa, Homo Sapiens
ENICLLQMF

SEQ ID NO: 638720 - protein, 9 aa, Homo Sapiens
RASVAAERH

SEQ ID NO: 638721 - protein, 9 aa, Homo Sapiens
DRIHLHHNP

SEQ ID NO: 638722 - protein, 9 aa, Homo Sapiens
VGYRDMCPT

SEQ ID NO: 638723 - protein, 9 aa, Homo Sapiens
PEFRRWDYS

SEQ ID NO: 638724 - protein, 9 aa, Homo Sapiens
ALTELRNSG

SEQ ID NO: 638725 - protein, 9 aa, Homo Sapiens
FIFLEYVRC

SEQ ID NO: 638726 - protein, 9 aa, Homo Sapiens
LSIEESRPL

SEQ ID NO: 638727 - protein, 9 aa, Homo Sapiens
PPIAPSPSP

SEQ ID NO: 638728 - protein, 9 aa, Homo Sapiens
LIPRFMLLE

SEQ ID NO: 638729 - protein, 9 aa, Homo Sapiens
MGMGKLLTE

SEQ ID NO: 638730 - protein, 9 aa, Homo Sapiens
LCIPNGYTS

SEQ ID NO: 638731 - protein, 9 aa, Homo Sapiens
REFYVLTSS

SEQ ID NO: 638732 - protein, 9 aa, Homo Sapiens
TVEGRFAKQ

SEQ ID NO: 638733 - protein, 9 aa, Homo Sapiens
VLQSRNSPL

SEQ ID NO: 638734 - protein, 9 aa, Homo Sapiens
LSCAVWGRH

SEQ ID NO: 638735 - protein, 9 aa, Homo Sapiens
GVGTIVISK

SEQ ID NO: 638736 - protein, 9 aa, Homo Sapiens
FELQKSEAL

SEQ ID NO: 638737 - protein, 9 aa, Homo Sapiens
GHHDALGPG

SEQ ID NO: 638738 - protein, 9 aa, Homo Sapiens
FANSVLISR

SEQ ID NO: 638739 - protein, 9 aa, Homo Sapiens
GKEEKLYAK

SEQ ID NO: 638740 - protein, 9 aa, Homo Sapiens
TVTHIFLLS

SEQ ID NO: 638741 - protein, 9 aa, Homo Sapiens
QTHFKKARE

SEQ ID NO: 638742 - protein, 9 aa, Homo Sapiens
GEIMFIPVK

SEQ ID NO: 638743 - protein, 9 aa, Homo Sapiens
RLRQSVSVG

SEQ ID NO: 638744 - protein, 9 aa, Homo Sapiens
HSLSRIWDE

SEQ ID NO: 638745 - protein, 9 aa, Homo Sapiens
PDGLGFSSQ

SEQ ID NO: 638746 - protein, 9 aa, Homo Sapiens
RRNAWYAAL

SEQ ID NO: 638747 - protein, 9 aa, Homo Sapiens
RELIRSQAI

SEQ ID NO: 638748 - protein, 9 aa, Homo Sapiens
AIVHLISRQ

SEQ ID NO: 638749 - protein, 9 aa, Homo Sapiens
TIVRRPHAA

SEQ ID NO: 638750 - protein, 9 aa, Homo Sapiens
SQSTIVRRP

SEQ ID NO: 638751 - protein, 9 aa, Homo Sapiens
PFACFVAQA

SEQ ID NO: 638752 - protein, 9 aa, Homo Sapiens
YGVTVHCST

SEQ ID NO: 638753 - protein, 9 aa, Homo Sapiens
WDYSVWLHG

SEQ ID NO: 638754 - protein, 9 aa, Homo Sapiens
SHSQQMQQG

SEQ ID NO: 638755 - protein, 9 aa, Homo Sapiens
SLGNCTSQS

SEQ ID NO: 638756 - protein, 9 aa, Homo Sapiens
SRGNLAQPV

SEQ ID NO: 638757 - protein, 9 aa, Homo Sapiens
ELCKQKPAY

SEQ ID NO: 638758 - protein, 9 aa, Homo Sapiens
FYSLNRNQI

SEQ ID NO: 638759 - protein, 9 aa, Homo Sapiens
RVNIVGTLL

SEQ ID NO: 638760 - protein, 9 aa, Homo Sapiens
FHAWTLQIH

SEQ ID NO: 638761 - protein, 9 aa, Homo Sapiens
LEDDLGRLG

SEQ ID NO: 638762 - protein, 9 aa, Homo Sapiens
RSQAIKKNP

SEQ ID NO: 638763 - protein, 9 aa, Homo Sapiens
VLDGPPHRE

SEQ ID NO: 638764 - protein, 9 aa, Homo Sapiens
MVPSKDRAK

SEQ ID NO: 638765 - protein, 9 aa, Homo Sapiens
PVGRSSFTA

SEQ ID NO: 638766 - protein, 9 aa, Homo Sapiens
NSGYPSQQP

SEQ ID NO: 638767 - protein, 9 aa, Homo Sapiens
PQCKPCPGN

SEQ ID NO: 638768 - protein, 9 aa, Homo Sapiens
TRCAPLFSG

SEQ ID NO: 638769 - protein, 9 aa, Homo Sapiens
KLYAKKDSK

SEQ ID NO: 638770 - protein, 9 aa, Homo Sapiens
ASSSPTKEC

SEQ ID NO: 638771 - protein, 9 aa, Homo Sapiens
DLEPRDQEG

SEQ ID NO: 638772 - protein, 9 aa, Homo Sapiens
NVFTMMLKS

SEQ ID NO: 638773 - protein, 9 aa, Homo Sapiens
SSLAQSLSP

SEQ ID NO: 638774 - protein, 9 aa, Homo Sapiens
RSDELQHHL

SEQ ID NO: 638775 - protein, 9 aa, Homo Sapiens
NMGNTCYEK

SEQ ID NO: 638776 - protein, 9 aa, Homo Sapiens
KINQTEHRR

SEQ ID NO: 638777 - protein, 9 aa, Homo Sapiens
VVGMGHWHR

SEQ ID NO: 638778 - protein, 9 aa, Homo Sapiens
RTCGVCPLN

SEQ ID NO: 638779 - protein, 9 aa, Homo Sapiens
TCGVCPLNQ

SEQ ID NO: 638780 - protein, 9 aa, Homo Sapiens
GVCPLNQLK

SEQ ID NO: 638781 - protein, 9 aa, Homo Sapiens
DGVGKSALT

SEQ ID NO: 638782 - protein, 9 aa, Homo Sapiens
QRTFSARDC

SEQ ID NO: 638783 - protein, 9 aa, Homo Sapiens
VVVGADGVG

SEQ ID NO: 638784 - protein, 9 aa, Homo Sapiens
YWRSQINCL

SEQ ID NO: 638785 - protein, 9 aa, Homo Sapiens
ARDCAYVAS

SEQ ID NO: 638786 - protein, 9 aa, Homo Sapiens
VVGADGVGK

SEQ ID NO: 638787 - protein, 9 aa, Homo Sapiens
CGVCPLNQL

SEQ ID NO: 638788 - protein, 9 aa, Homo Sapiens
RTFSARDCA

SEQ ID NO: 638789 - protein, 9 aa, Homo Sapiens
SQINCLHCH

SEQ ID NO: 638790 - protein, 9 aa, Homo Sapiens
ADGVGKSAL

SEQ ID NO: 638791 - protein, 9 aa, Homo Sapiens
QINCLHCHG

SEQ ID NO: 638792 - protein, 9 aa, Homo Sapiens
QFSDMRTCG

SEQ ID NO: 638793 - protein, 9 aa, Homo Sapiens
LVVVGADGV

SEQ ID NO: 638794 - protein, 9 aa, Homo Sapiens
FSDMRTCGV

SEQ ID NO: 638795 - protein, 9 aa, Homo Sapiens
GYWRSQINC

SEQ ID NO: 638796 - protein, 9 aa, Homo Sapiens
GGYWRSQIN

SEQ ID NO: 638797 - protein, 9 aa, Homo Sapiens
MRTCGVCPL

SEQ ID NO: 638798 - protein, 9 aa, Homo Sapiens
GADGVGKSA

SEQ ID NO: 638799 - protein, 9 aa, Homo Sapiens
FSARDCAYV

SEQ ID NO: 638800 - protein, 9 aa, Homo Sapiens
DCAYVASLL

SEQ ID NO: 638801 - protein, 9 aa, Homo Sapiens
SDMRTCGVC

SEQ ID NO: 638802 - protein, 9 aa, Homo Sapiens
DMRTCGVCP

SEQ ID NO: 638803 - protein, 9 aa, Homo Sapiens
NCLHCHGIS

SEQ ID NO: 638804 - protein, 9 aa, Homo Sapiens
TFSARDCAY

SEQ ID NO: 638805 - protein, 9 aa, Homo Sapiens
CAYVASLLT

SEQ ID NO: 638806 - protein, 9 aa, Homo Sapiens
YKLVVVGAD

SEQ ID NO: 638807 - protein, 9 aa, Homo Sapiens
INCLHCHGI

SEQ ID NO: 638808 - protein, 9 aa, Homo Sapiens
KLVVVGADG

SEQ ID NO: 638809 - protein, 9 aa, Homo Sapiens
RDCAYVASL

SEQ ID NO: 638810 - protein, 9 aa, Homo Sapiens
WRSQINCLH

SEQ ID NO: 638811 - protein, 9 aa, Homo Sapiens
VGADGVGKS

SEQ ID NO: 638812 - protein, 9 aa, Homo Sapiens
RSQINCLHC

SEQ ID NO: 638813 - protein, 9 aa, Homo Sapiens
SARDCAYVA

SEQ ID NO: 638814 - protein, 9 aa, Homo Sapiens
MRIRIIDWY

SEQ ID NO: 638815 - protein, 9 aa, Homo Sapiens
IMGNSVMVL

SEQ ID NO: 638816 - protein, 9 aa, Homo Sapiens
ASCCRPCAL

SEQ ID NO: 638817 - protein, 9 aa, Homo Sapiens
ELQASAPRM

SEQ ID NO: 638818 - protein, 9 aa, Homo Sapiens
QDPHFDAEA

SEQ ID NO: 638819 - protein, 9 aa, Homo Sapiens
LAFFCALLN

SEQ ID NO: 638820 - protein, 9 aa, Homo Sapiens
PCPLPLFTC

SEQ ID NO: 638821 - protein, 9 aa, Homo Sapiens
EKKTRPVSQ

SEQ ID NO: 638822 - protein, 9 aa, Homo Sapiens
SPGARGPLN

SEQ ID NO: 638823 - protein, 9 aa, Homo Sapiens
LNYSYVGCI

SEQ ID NO: 638824 - protein, 9 aa, Homo Sapiens
SYPFTKNPS

SEQ ID NO: 638825 - protein, 9 aa, Homo Sapiens
EAWQETMLS

SEQ ID NO: 638826 - protein, 9 aa, Homo Sapiens
YSRPGRTGP

SEQ ID NO: 638827 - protein, 9 aa, Homo Sapiens
PPSAACLDM

SEQ ID NO: 638828 - protein, 9 aa, Homo Sapiens
EGTFKVLQP

SEQ ID NO: 638829 - protein, 9 aa, Homo Sapiens
SCSEIPAAN

SEQ ID NO: 638830 - protein, 9 aa, Homo Sapiens
LCVVGEERL

SEQ ID NO: 638831 - protein, 9 aa, Homo Sapiens
KTNSCLKRS

SEQ ID NO: 638832 - protein, 9 aa, Homo Sapiens
PFPVTDASS

SEQ ID NO: 638833 - protein, 9 aa, Homo Sapiens
NGNAPPSEV

SEQ ID NO: 638834 - protein, 9 aa, Homo Sapiens
PPYVGYMVQ

SEQ ID NO: 638835 - protein, 9 aa, Homo Sapiens
VVASLAFGT

SEQ ID NO: 638836 - protein, 9 aa, Homo Sapiens
HRLTARLSS

SEQ ID NO: 638837 - protein, 9 aa, Homo Sapiens
PAARAPGPP

SEQ ID NO: 638838 - protein, 9 aa, Homo Sapiens
HNANPLDAT

SEQ ID NO: 638839 - protein, 9 aa, Homo Sapiens
DQMRRYLTA

SEQ ID NO: 638840 - protein, 9 aa, Homo Sapiens
PFTSYPFTK

SEQ ID NO: 638841 - protein, 9 aa, Homo Sapiens
TFTVTIEDL

SEQ ID NO: 638842 - protein, 9 aa, Homo Sapiens
ASVSTLLME

SEQ ID NO: 638843 - protein, 9 aa, Homo Sapiens
EAAWAQGRA

SEQ ID NO: 638844 - protein, 9 aa, Homo Sapiens
EECGKAFVC

SEQ ID NO: 638845 - protein, 9 aa, Homo Sapiens
TALDQVQQD

SEQ ID NO: 638846 - protein, 9 aa, Homo Sapiens
EMPSPQELQ

SEQ ID NO: 638847 - protein, 9 aa, Homo Sapiens
CECLHACSS

SEQ ID NO: 638848 - protein, 9 aa, Homo Sapiens
PGLGRITWL

SEQ ID NO: 638849 - protein, 9 aa, Homo Sapiens
SDEQGMSKN

SEQ ID NO: 638850 - protein, 9 aa, Homo Sapiens
TKDCGFLSL

SEQ ID NO: 638851 - protein, 9 aa, Homo Sapiens
KKVLAKALR

SEQ ID NO: 638852 - protein, 9 aa, Homo Sapiens
GMDTAAKVI

SEQ ID NO: 638853 - protein, 9 aa, Homo Sapiens
FEDFLKEMA

SEQ ID NO: 638854 - protein, 9 aa, Homo Sapiens
GRREQPQRQ

SEQ ID NO: 638855 - protein, 9 aa, Homo Sapiens
STGDTTPFP

SEQ ID NO: 638856 - protein, 9 aa, Homo Sapiens
DLEPLFQEL

SEQ ID NO: 638857 - protein, 9 aa, Homo Sapiens
IAVLHRLTA

SEQ ID NO: 638858 - protein, 9 aa, Homo Sapiens
IAFLKKLHK

SEQ ID NO: 638859 - protein, 9 aa, Homo Sapiens
RQDAADAWK

SEQ ID NO: 638860 - protein, 9 aa, Homo Sapiens
AQRRRACPR

SEQ ID NO: 638861 - protein, 9 aa, Homo Sapiens
PAAGRGASA

SEQ ID NO: 638862 - protein, 9 aa, Homo Sapiens
LSVWVREQC

SEQ ID NO: 638863 - protein, 9 aa, Homo Sapiens
EAEPQEAAW

SEQ ID NO: 638864 - protein, 9 aa, Homo Sapiens
RRACPRQVL

SEQ ID NO: 638865 - protein, 9 aa, Homo Sapiens
EDSEVEAPA

SEQ ID NO: 638866 - protein, 9 aa, Homo Sapiens
GAILQDAIP

SEQ ID NO: 638867 - protein, 9 aa, Homo Sapiens
CVPGPDVLC

SEQ ID NO: 638868 - protein, 9 aa, Homo Sapiens
YTIYRPCSE

SEQ ID NO: 638869 - protein, 9 aa, Homo Sapiens
FSTWAFHLT

SEQ ID NO: 638870 - protein, 9 aa, Homo Sapiens
TKAFSSAHP

SEQ ID NO: 638871 - protein, 9 aa, Homo Sapiens
MLHKIYIQK

SEQ ID NO: 638872 - protein, 9 aa, Homo Sapiens
QNGNAHGNP

SEQ ID NO: 638873 - protein, 9 aa, Homo Sapiens
LDVIDGSDN

SEQ ID NO: 638874 - protein, 9 aa, Homo Sapiens
CRVPQGGYY

SEQ ID NO: 638875 - protein, 9 aa, Homo Sapiens
QAIENCERK

SEQ ID NO: 638876 - protein, 9 aa, Homo Sapiens
LQHLIIHNG

SEQ ID NO: 638877 - protein, 9 aa, Homo Sapiens
SRRFFSLTE

SEQ ID NO: 638878 - protein, 9 aa, Homo Sapiens
NAPEILYSA

SEQ ID NO: 638879 - protein, 9 aa, Homo Sapiens
NVSGSFVCQ

SEQ ID NO: 638880 - protein, 9 aa, Homo Sapiens
LGEHLGVRE

SEQ ID NO: 638881 - protein, 9 aa, Homo Sapiens
NEPEHNVSY

SEQ ID NO: 638882 - protein, 9 aa, Homo Sapiens
VLWQHAGLE

SEQ ID NO: 638883 - protein, 9 aa, Homo Sapiens
TIACLVMAQ

SEQ ID NO: 638884 - protein, 9 aa, Homo Sapiens
AIIKLANTD

SEQ ID NO: 638885 - protein, 9 aa, Homo Sapiens
FLSLSLGFK

SEQ ID NO: 638886 - protein, 9 aa, Homo Sapiens
IRGLSQHQQ

SEQ ID NO: 638887 - protein, 9 aa, Homo Sapiens
LALNQKTHI

SEQ ID NO: 638888 - protein, 9 aa, Homo Sapiens
EELRQLAES

SEQ ID NO: 638889 - protein, 9 aa, Homo Sapiens
HHVTFINKV

SEQ ID NO: 638890 - protein, 9 aa, Homo Sapiens
SWTFLLYRL

SEQ ID NO: 638891 - protein, 9 aa, Homo Sapiens
GAALLTAHV

SEQ ID NO: 638892 - protein, 9 aa, Homo Sapiens
CADYESFCA

SEQ ID NO: 638893 - protein, 9 aa, Homo Sapiens
SKIRFLLET

SEQ ID NO: 638894 - protein, 9 aa, Homo Sapiens
CIGAELGLD

SEQ ID NO: 638895 - protein, 9 aa, Homo Sapiens
RMPPERNHI

SEQ ID NO: 638896 - protein, 9 aa, Homo Sapiens
MKLLLPDDD

SEQ ID NO: 638897 - protein, 9 aa, Homo Sapiens
MRAAALVIS

SEQ ID NO: 638898 - protein, 9 aa, Homo Sapiens
CRRPSGTGT

SEQ ID NO: 638899 - protein, 9 aa, Homo Sapiens
LPPSPTAKS

SEQ ID NO: 638900 - protein, 9 aa, Homo Sapiens
LFLNHSENE

SEQ ID NO: 638901 - protein, 9 aa, Homo Sapiens
PTCGKCFIK

SEQ ID NO: 638902 - protein, 9 aa, Homo Sapiens
NSLIEDLIL

SEQ ID NO: 638903 - protein, 9 aa, Homo Sapiens
TIEDLMKTD

SEQ ID NO: 638904 - protein, 9 aa, Homo Sapiens
LLYWAANVY

SEQ ID NO: 638905 - protein, 9 aa, Homo Sapiens
AVTMALHCC

SEQ ID NO: 638906 - protein, 9 aa, Homo Sapiens
FSVAIMGNS

SEQ ID NO: 638907 - protein, 9 aa, Homo Sapiens
VYCRVPQGG

SEQ ID NO: 638908 - protein, 9 aa, Homo Sapiens
LVIHGLELG

SEQ ID NO: 638909 - protein, 9 aa, Homo Sapiens
LQSQLRREQ

SEQ ID NO: 638910 - protein, 9 aa, Homo Sapiens
ALALRNCIT

SEQ ID NO: 638911 - protein, 9 aa, Homo Sapiens
AVEHGPGLG

SEQ ID NO: 638912 - protein, 9 aa, Homo Sapiens
TDAFRSSKF

SEQ ID NO: 638913 - protein, 9 aa, Homo Sapiens
LWLWAPICA

SEQ ID NO: 638914 - protein, 9 aa, Homo Sapiens
RGSGGPVLQ

SEQ ID NO: 638915 - protein, 9 aa, Homo Sapiens
WNGSVSSRV

SEQ ID NO: 638916 - protein, 9 aa, Homo Sapiens
VRILDRCSV

SEQ ID NO: 638917 - protein, 9 aa, Homo Sapiens
LWQHAGLEK

SEQ ID NO: 638918 - protein, 9 aa, Homo Sapiens
MLEPDSEHR

SEQ ID NO: 638919 - protein, 9 aa, Homo Sapiens
DIEQQAVFV

SEQ ID NO: 638920 - protein, 9 aa, Homo Sapiens
AGGSGSLSA

SEQ ID NO: 638921 - protein, 9 aa, Homo Sapiens
PVHPENALK

SEQ ID NO: 638922 - protein, 9 aa, Homo Sapiens
DGHSNIYQL

SEQ ID NO: 638923 - protein, 9 aa, Homo Sapiens
MKRNKHIKT

SEQ ID NO: 638924 - protein, 9 aa, Homo Sapiens
DKPYKCADC

SEQ ID NO: 638925 - protein, 9 aa, Homo Sapiens
QGQMWKRPQ

SEQ ID NO: 638926 - protein, 9 aa, Homo Sapiens
TLELTLTTQ

SEQ ID NO: 638927 - protein, 9 aa, Homo Sapiens
GSLFVGGLV

SEQ ID NO: 638928 - protein, 9 aa, Homo Sapiens
GNTTLSGCK

SEQ ID NO: 638929 - protein, 9 aa, Homo Sapiens
DAADAWKPQ

SEQ ID NO: 638930 - protein, 9 aa, Homo Sapiens
DFWNGSVSS

SEQ ID NO: 638931 - protein, 9 aa, Homo Sapiens
CERKQTEPV

SEQ ID NO: 638932 - protein, 9 aa, Homo Sapiens
LCPCQASFT

SEQ ID NO: 638933 - protein, 9 aa, Homo Sapiens
PAAAQLTHN

SEQ ID NO: 638934 - protein, 9 aa, Homo Sapiens
VPGPHGLRR

SEQ ID NO: 638935 - protein, 9 aa, Homo Sapiens
APGKPCQMG

SEQ ID NO: 638936 - protein, 9 aa, Homo Sapiens
RWYPEVNRF

SEQ ID NO: 638937 - protein, 9 aa, Homo Sapiens
EVFAIQETK

SEQ ID NO: 638938 - protein, 9 aa, Homo Sapiens
IAINNLSYW

SEQ ID NO: 638939 - protein, 9 aa, Homo Sapiens
IEKQLQQGF

SEQ ID NO: 638940 - protein, 9 aa, Homo Sapiens
LGAGYPRSR

SEQ ID NO: 638941 - protein, 9 aa, Homo Sapiens
SEHRPDIFQ

SEQ ID NO: 638942 - protein, 9 aa, Homo Sapiens
RQKSSLIVH

SEQ ID NO: 638943 - protein, 9 aa, Homo Sapiens
GFRILNSQS

SEQ ID NO: 638944 - protein, 9 aa, Homo Sapiens
KFGMNFGGD

SEQ ID NO: 638945 - protein, 9 aa, Homo Sapiens
LNNHPGAEL

SEQ ID NO: 638946 - protein, 9 aa, Homo Sapiens
RTKHPQDLD

SEQ ID NO: 638947 - protein, 9 aa, Homo Sapiens
RPPSKLTWS

SEQ ID NO: 638948 - protein, 9 aa, Homo Sapiens
EAEFLSLSL

SEQ ID NO: 638949 - protein, 9 aa, Homo Sapiens
CCADYESFC

SEQ ID NO: 638950 - protein, 9 aa, Homo Sapiens
VKTSSFLCQ

SEQ ID NO: 638951 - protein, 9 aa, Homo Sapiens
GTPSPAPPP

SEQ ID NO: 638952 - protein, 9 aa, Homo Sapiens
GHAEPCVLR

SEQ ID NO: 638953 - protein, 9 aa, Homo Sapiens
SDRDFMETF

SEQ ID NO: 638954 - protein, 9 aa, Homo Sapiens
VCSLEKSKP

SEQ ID NO: 638955 - protein, 9 aa, Homo Sapiens
SLGAHTVAE

SEQ ID NO: 638956 - protein, 9 aa, Homo Sapiens
QNHDTFDFY

SEQ ID NO: 638957 - protein, 9 aa, Homo Sapiens
QLTLGNLKP

SEQ ID NO: 638958 - protein, 9 aa, Homo Sapiens
VDFKKEAFR

SEQ ID NO: 638959 - protein, 9 aa, Homo Sapiens
GGADRAFPV

SEQ ID NO: 638960 - protein, 9 aa, Homo Sapiens
FRDQLSCHG

SEQ ID NO: 638961 - protein, 9 aa, Homo Sapiens
FNIAQVLWQ

SEQ ID NO: 638962 - protein, 9 aa, Homo Sapiens
WLSRFFEYR

SEQ ID NO: 638963 - protein, 9 aa, Homo Sapiens
IEDLMKTDA

SEQ ID NO: 638964 - protein, 9 aa, Homo Sapiens
PGRERRTEE

SEQ ID NO: 638965 - protein, 9 aa, Homo Sapiens
CGKCFIKSS

SEQ ID NO: 638966 - protein, 9 aa, Homo Sapiens
KAFIRCIGA

SEQ ID NO: 638967 - protein, 9 aa, Homo Sapiens
PPAAAQLTH

SEQ ID NO: 638968 - protein, 9 aa, Homo Sapiens
ILLKTDMYS

SEQ ID NO: 638969 - protein, 9 aa, Homo Sapiens
TYQDVTLRN

SEQ ID NO: 638970 - protein, 9 aa, Homo Sapiens
CEQLCVNVS

SEQ ID NO: 638971 - protein, 9 aa, Homo Sapiens
GLLWGSLFV

SEQ ID NO: 638972 - protein, 9 aa, Homo Sapiens
DYNMLRSPV

SEQ ID NO: 638973 - protein, 9 aa, Homo Sapiens
LEGPWGRCT

SEQ ID NO: 638974 - protein, 9 aa, Homo Sapiens
LANENTTQS

SEQ ID NO: 638975 - protein, 9 aa, Homo Sapiens
IPEDAQQGT

SEQ ID NO: 638976 - protein, 9 aa, Homo Sapiens
LVWLDNTAV

SEQ ID NO: 638977 - protein, 9 aa, Homo Sapiens
VPLSYTDCA

SEQ ID NO: 638978 - protein, 9 aa, Homo Sapiens
SVEPEWELD

SEQ ID NO: 638979 - protein, 9 aa, Homo Sapiens
VIYDGEERA

SEQ ID NO: 638980 - protein, 9 aa, Homo Sapiens
GHSLGAHTV

SEQ ID NO: 638981 - protein, 9 aa, Homo Sapiens
LTARELLLK

SEQ ID NO: 638982 - protein, 9 aa, Homo Sapiens
LLGGGVSWA

SEQ ID NO: 638983 - protein, 9 aa, Homo Sapiens
IIKLANTDI

SEQ ID NO: 638984 - protein, 9 aa, Homo Sapiens
LKEMAAIEE

SEQ ID NO: 638985 - protein, 9 aa, Homo Sapiens
VRIFLHKPE

SEQ ID NO: 638986 - protein, 9 aa, Homo Sapiens
RTFTVTIED

SEQ ID NO: 638987 - protein, 9 aa, Homo Sapiens
ADSKHHVTF

SEQ ID NO: 638988 - protein, 9 aa, Homo Sapiens
NYSYVGCIR

SEQ ID NO: 638989 - protein, 9 aa, Homo Sapiens
HSRALWSCT

SEQ ID NO: 638990 - protein, 9 aa, Homo Sapiens
DTESTIVML

SEQ ID NO: 638991 - protein, 9 aa, Homo Sapiens
FESRNMMKE

SEQ ID NO: 638992 - protein, 9 aa, Homo Sapiens
LGASWGSLW

SEQ ID NO: 638993 - protein, 9 aa, Homo Sapiens
GDPSKKDLL

SEQ ID NO: 638994 - protein, 9 aa, Homo Sapiens
KRNKHIKTF

SEQ ID NO: 638995 - protein, 9 aa, Homo Sapiens
MLSLSGAAA

SEQ ID NO: 638996 - protein, 9 aa, Homo Sapiens
AAPFQLSNN

SEQ ID NO: 638997 - protein, 9 aa, Homo Sapiens
EGMFHYGVP

SEQ ID NO: 638998 - protein, 9 aa, Homo Sapiens
HEHTSMLVE

SEQ ID NO: 638999 - protein, 9 aa, Homo Sapiens
SVQSGQKLI

SEQ ID NO: 639000 - protein, 9 aa, Homo Sapiens
ILKRRGCGC

SEQ ID NO: 639001 - protein, 9 aa, Homo Sapiens
ENGGQHRAA

SEQ ID NO: 639002 - protein, 9 aa, Homo Sapiens
IHRLPVLDS

SEQ ID NO: 639003 - protein, 9 aa, Homo Sapiens
NHDKLFPLL

SEQ ID NO: 639004 - protein, 9 aa, Homo Sapiens
FYLEDITSP

SEQ ID NO: 639005 - protein, 9 aa, Homo Sapiens
LCQLGFWWL

SEQ ID NO: 639006 - protein, 9 aa, Homo Sapiens
VTQGWRTSL

SEQ ID NO: 639007 - protein, 9 aa, Homo Sapiens
GLGRACVPG

SEQ ID NO: 639008 - protein, 9 aa, Homo Sapiens
PTVTNFFIA

SEQ ID NO: 639009 - protein, 9 aa, Homo Sapiens
SGSHIPFDP

SEQ ID NO: 639010 - protein, 9 aa, Homo Sapiens
GSPSAVEHG

SEQ ID NO: 639011 - protein, 9 aa, Homo Sapiens
LSQAIMHEP

SEQ ID NO: 639012 - protein, 9 aa, Homo Sapiens
SGAAADDVV

SEQ ID NO: 639013 - protein, 9 aa, Homo Sapiens
CTFCRMKMS

SEQ ID NO: 639014 - protein, 9 aa, Homo Sapiens
LTVSELETV

SEQ ID NO: 639015 - protein, 9 aa, Homo Sapiens
GADRAFPVL

SEQ ID NO: 639016 - protein, 9 aa, Homo Sapiens
DGVSLVLPV

SEQ ID NO: 639017 - protein, 9 aa, Homo Sapiens
EGPWGRCTG

SEQ ID NO: 639018 - protein, 9 aa, Homo Sapiens
QIAPCRPLA

SEQ ID NO: 639019 - protein, 9 aa, Homo Sapiens
SMLVEVANL

SEQ ID NO: 639020 - protein, 9 aa, Homo Sapiens
ARVVVVDFK

SEQ ID NO: 639021 - protein, 9 aa, Homo Sapiens
IRSRRFFSL

SEQ ID NO: 639022 - protein, 9 aa, Homo Sapiens
LCGVLGFKF

SEQ ID NO: 639023 - protein, 9 aa, Homo Sapiens
SLSGAAADD

SEQ ID NO: 639024 - protein, 9 aa, Homo Sapiens
TPESFAQAV

SEQ ID NO: 639025 - protein, 9 aa, Homo Sapiens
RDCFRPSSP

SEQ ID NO: 639026 - protein, 9 aa, Homo Sapiens
IENCERKQT

SEQ ID NO: 639027 - protein, 9 aa, Homo Sapiens
AVHLLKDHL

SEQ ID NO: 639028 - protein, 9 aa, Homo Sapiens
ESRNMMKEI

SEQ ID NO: 639029 - protein, 9 aa, Homo Sapiens
CEKRCDSET

SEQ ID NO: 639030 - protein, 9 aa, Homo Sapiens
SLGSPKWQQ

SEQ ID NO: 639031 - protein, 9 aa, Homo Sapiens
ECILEPSSV

SEQ ID NO: 639032 - protein, 9 aa, Homo Sapiens
ENSLIEDLI

SEQ ID NO: 639033 - protein, 9 aa, Homo Sapiens
DVVASLAFG

SEQ ID NO: 639034 - protein, 9 aa, Homo Sapiens
KQLCVLPQL

SEQ ID NO: 639035 - protein, 9 aa, Homo Sapiens
LREQFGPLL

SEQ ID NO: 639036 - protein, 9 aa, Homo Sapiens
RFMLEPDSE

SEQ ID NO: 639037 - protein, 9 aa, Homo Sapiens
KYKKQNDIE

SEQ ID NO: 639038 - protein, 9 aa, Homo Sapiens
LQECAKGPL

SEQ ID NO: 639039 - protein, 9 aa, Homo Sapiens
VIVCLLAIS

SEQ ID NO: 639040 - protein, 9 aa, Homo Sapiens
TQGQMWKRP

SEQ ID NO: 639041 - protein, 9 aa, Homo Sapiens
GSQATSPRR

SEQ ID NO: 639042 - protein, 9 aa, Homo Sapiens
PSQHEATPW

SEQ ID NO: 639043 - protein, 9 aa, Homo Sapiens
SPTNFLVAP

SEQ ID NO: 639044 - protein, 9 aa, Homo Sapiens
SSTPCATRV

SEQ ID NO: 639045 - protein, 9 aa, Homo Sapiens
TVTLPHASE

SEQ ID NO: 639046 - protein, 9 aa, Homo Sapiens
YLRVHGVVV

SEQ ID NO: 639047 - protein, 9 aa, Homo Sapiens
LYFFHILGS

SEQ ID NO: 639048 - protein, 9 aa, Homo Sapiens
AAELRCQCL

SEQ ID NO: 639049 - protein, 9 aa, Homo Sapiens
VEAPAVPVV

SEQ ID NO: 639050 - protein, 9 aa, Homo Sapiens
ECCNDMTVR

SEQ ID NO: 639051 - protein, 9 aa, Homo Sapiens
TYSNRIYRM

SEQ ID NO: 639052 - protein, 9 aa, Homo Sapiens
GNPVPQHYL

SEQ ID NO: 639053 - protein, 9 aa, Homo Sapiens
MDHVFLLLS

SEQ ID NO: 639054 - protein, 9 aa, Homo Sapiens
SLSIASEKR

SEQ ID NO: 639055 - protein, 9 aa, Homo Sapiens
VEAEFLSLS

SEQ ID NO: 639056 - protein, 9 aa, Homo Sapiens
LAFGTPVDS

SEQ ID NO: 639057 - protein, 9 aa, Homo Sapiens
AKEENGGQH

SEQ ID NO: 639058 - protein, 9 aa, Homo Sapiens
MDYDRYLAI

SEQ ID NO: 639059 - protein, 9 aa, Homo Sapiens
EVVRCRTRE

SEQ ID NO: 639060 - protein, 9 aa, Homo Sapiens
AMAYDRCAA

SEQ ID NO: 639061 - protein, 9 aa, Homo Sapiens
ATGIIRPGG

SEQ ID NO: 639062 - protein, 9 aa, Homo Sapiens
NAHGNPENR

SEQ ID NO: 639063 - protein, 9 aa, Homo Sapiens
CLHCGGGPK

SEQ ID NO: 639064 - protein, 9 aa, Homo Sapiens
TTLKECILE

SEQ ID NO: 639065 - protein, 9 aa, Homo Sapiens
NKIPQVTLN

SEQ ID NO: 639066 - protein, 9 aa, Homo Sapiens
QSLKLTNLE

SEQ ID NO: 639067 - protein, 9 aa, Homo Sapiens
KKLHKEEIQ

SEQ ID NO: 639068 - protein, 9 aa, Homo Sapiens
KHMRDQNNY

SEQ ID NO: 639069 - protein, 9 aa, Homo Sapiens
FNTLKYANR

SEQ ID NO: 639070 - protein, 9 aa, Homo Sapiens
FRPSSPAAR

SEQ ID NO: 639071 - protein, 9 aa, Homo Sapiens
ENLSLEPKV

SEQ ID NO: 639072 - protein, 9 aa, Homo Sapiens
GPWSEVVRC

SEQ ID NO: 639073 - protein, 9 aa, Homo Sapiens
FHLTSITIF

SEQ ID NO: 639074 - protein, 9 aa, Homo Sapiens
HKEEIQELQ

SEQ ID NO: 639075 - protein, 9 aa, Homo Sapiens
NDLRLKLSC

SEQ ID NO: 639076 - protein, 9 aa, Homo Sapiens
VDVMGNLRV

SEQ ID NO: 639077 - protein, 9 aa, Homo Sapiens
RSLKNAGSL

SEQ ID NO: 639078 - protein, 9 aa, Homo Sapiens
PGVLGASWG

SEQ ID NO: 639079 - protein, 9 aa, Homo Sapiens
QLDIPLGLE

SEQ ID NO: 639080 - protein, 9 aa, Homo Sapiens
SDYPSYNGA

SEQ ID NO: 639081 - protein, 9 aa, Homo Sapiens
ALCKASRGC

SEQ ID NO: 639082 - protein, 9 aa, Homo Sapiens
YRHVCTYDP

SEQ ID NO: 639083 - protein, 9 aa, Homo Sapiens
SGCCCLGIM

SEQ ID NO: 639084 - protein, 9 aa, Homo Sapiens
LGTPDIRSL

SEQ ID NO: 639085 - protein, 9 aa, Homo Sapiens
LLLSFGKAF

SEQ ID NO: 639086 - protein, 9 aa, Homo Sapiens
YHSRLSLIA

SEQ ID NO: 639087 - protein, 9 aa, Homo Sapiens
QEAAWAQGR

SEQ ID NO: 639088 - protein, 9 aa, Homo Sapiens
LQKATWLSL

SEQ ID NO: 639089 - protein, 9 aa, Homo Sapiens
SQLRREQEE

SEQ ID NO: 639090 - protein, 9 aa, Homo Sapiens
CMAILDNPN

SEQ ID NO: 639091 - protein, 9 aa, Homo Sapiens
VPQHYLWEK

SEQ ID NO: 639092 - protein, 9 aa, Homo Sapiens
YRYGPPVAT

SEQ ID NO: 639093 - protein, 9 aa, Homo Sapiens
NETAKDIAP

SEQ ID NO: 639094 - protein, 9 aa, Homo Sapiens
RYVLECSFD

SEQ ID NO: 639095 - protein, 9 aa, Homo Sapiens
DIHFRWHRA

SEQ ID NO: 639096 - protein, 9 aa, Homo Sapiens
PNVISLFEQ

SEQ ID NO: 639097 - protein, 9 aa, Homo Sapiens
YEGTMYPSQ

SEQ ID NO: 639098 - protein, 9 aa, Homo Sapiens
VATCSVDKK

SEQ ID NO: 639099 - protein, 9 aa, Homo Sapiens
FLSQSGAGS

SEQ ID NO: 639100 - protein, 9 aa, Homo Sapiens
DTDVLNVLT

SEQ ID NO: 639101 - protein, 9 aa, Homo Sapiens
PLLNTVIYS

SEQ ID NO: 639102 - protein, 9 aa, Homo Sapiens
PLLDDPTEK

SEQ ID NO: 639103 - protein, 9 aa, Homo Sapiens
PAPNWARYP

SEQ ID NO: 639104 - protein, 9 aa, Homo Sapiens
CAQRRRACP

SEQ ID NO: 639105 - protein, 9 aa, Homo Sapiens
IMPMRSRGP

SEQ ID NO: 639106 - protein, 9 aa, Homo Sapiens
SAGLFFSSV

SEQ ID NO: 639107 - protein, 9 aa, Homo Sapiens
KVIILEQSG

SEQ ID NO: 639108 - protein, 9 aa, Homo Sapiens
FQAQQSVDI

SEQ ID NO: 639109 - protein, 9 aa, Homo Sapiens
FGVGFPIGM

SEQ ID NO: 639110 - protein, 9 aa, Homo Sapiens
MQHSVAAGA

SEQ ID NO: 639111 - protein, 9 aa, Homo Sapiens
GFNFRNNFG

SEQ ID NO: 639112 - protein, 9 aa, Homo Sapiens
IGIGCGGSQ

SEQ ID NO: 639113 - protein, 9 aa, Homo Sapiens
LYSDRDRDL

SEQ ID NO: 639114 - protein, 9 aa, Homo Sapiens
KSRHLGQSL

SEQ ID NO: 639115 - protein, 9 aa, Homo Sapiens
SCKGQNGNA

SEQ ID NO: 639116 - protein, 9 aa, Homo Sapiens
HGIRCAFGH

SEQ ID NO: 639117 - protein, 9 aa, Homo Sapiens
TKISNDVCQ

SEQ ID NO: 639118 - protein, 9 aa, Homo Sapiens
IATDLETGL

SEQ ID NO: 639119 - protein, 9 aa, Homo Sapiens
KKELHEAQP

SEQ ID NO: 639120 - protein, 9 aa, Homo Sapiens
LQPQELEDG

SEQ ID NO: 639121 - protein, 9 aa, Homo Sapiens
KAKKPIVGL

SEQ ID NO: 639122 - protein, 9 aa, Homo Sapiens
PAPAFCCAP

SEQ ID NO: 639123 - protein, 9 aa, Homo Sapiens
VAEKSLRRA

SEQ ID NO: 639124 - protein, 9 aa, Homo Sapiens
CCRPCALEA

SEQ ID NO: 639125 - protein, 9 aa, Homo Sapiens
GFTYQDVTL

SEQ ID NO: 639126 - protein, 9 aa, Homo Sapiens
SAHPSSGTP

SEQ ID NO: 639127 - protein, 9 aa, Homo Sapiens
TYLTRLHEN

SEQ ID NO: 639128 - protein, 9 aa, Homo Sapiens
AVEPDTGEV

SEQ ID NO: 639129 - protein, 9 aa, Homo Sapiens
DAQQGTVIT

SEQ ID NO: 639130 - protein, 9 aa, Homo Sapiens
VHPENALKR

SEQ ID NO: 639131 - protein, 9 aa, Homo Sapiens
QLVIHGLEL

SEQ ID NO: 639132 - protein, 9 aa, Homo Sapiens
NIRDPEHSA

SEQ ID NO: 639133 - protein, 9 aa, Homo Sapiens
MYPSQVPEH

SEQ ID NO: 639134 - protein, 9 aa, Homo Sapiens
FHEHTSMLV

SEQ ID NO: 639135 - protein, 9 aa, Homo Sapiens
TSCMQHSVA

SEQ ID NO: 639136 - protein, 9 aa, Homo Sapiens
QDAIPSTAR

SEQ ID NO: 639137 - protein, 9 aa, Homo Sapiens
LLYRLTAVL

SEQ ID NO: 639138 - protein, 9 aa, Homo Sapiens
AHGQPAAPA

SEQ ID NO: 639139 - protein, 9 aa, Homo Sapiens
GGTLVWLDN

SEQ ID NO: 639140 - protein, 9 aa, Homo Sapiens
YQFGGRLRR

SEQ ID NO: 639141 - protein, 9 aa, Homo Sapiens
EDSDLDGDS

SEQ ID NO: 639142 - protein, 9 aa, Homo Sapiens
TKNKAGKES

SEQ ID NO: 639143 - protein, 9 aa, Homo Sapiens
FRNNFGIGE

SEQ ID NO: 639144 - protein, 9 aa, Homo Sapiens
APLACADFL

SEQ ID NO: 639145 - protein, 9 aa, Homo Sapiens
FQHWASWGK

SEQ ID NO: 639146 - protein, 9 aa, Homo Sapiens
MTNLRSSHP

SEQ ID NO: 639147 - protein, 9 aa, Homo Sapiens
VNVSGSFVC

SEQ ID NO: 639148 - protein, 9 aa, Homo Sapiens
RCAAVCRPL

SEQ ID NO: 639149 - protein, 9 aa, Homo Sapiens
ESRRKAFNT

SEQ ID NO: 639150 - protein, 9 aa, Homo Sapiens
VVRIFLHKP

SEQ ID NO: 639151 - protein, 9 aa, Homo Sapiens
IIAKREGAG

SEQ ID NO: 639152 - protein, 9 aa, Homo Sapiens
LLGLIGAEF

SEQ ID NO: 639153 - protein, 9 aa, Homo Sapiens
RRSLPVFQA

SEQ ID NO: 639154 - protein, 9 aa, Homo Sapiens
DCGFLSLAL

SEQ ID NO: 639155 - protein, 9 aa, Homo Sapiens
LFEQKKEPW

SEQ ID NO: 639156 - protein, 9 aa, Homo Sapiens
IIYLLPKSK

SEQ ID NO: 639157 - protein, 9 aa, Homo Sapiens
PSYPGMDST

SEQ ID NO: 639158 - protein, 9 aa, Homo Sapiens
LFGVWPHNG

SEQ ID NO: 639159 - protein, 9 aa, Homo Sapiens
VAVTMALHC

SEQ ID NO: 639160 - protein, 9 aa, Homo Sapiens
ALNRFQAQQ

SEQ ID NO: 639161 - protein, 9 aa, Homo Sapiens
VQDKPYKCA

SEQ ID NO: 639162 - protein, 9 aa, Homo Sapiens
IKSSNLSEH

SEQ ID NO: 639163 - protein, 9 aa, Homo Sapiens
TMPVGIFTL

SEQ ID NO: 639164 - protein, 9 aa, Homo Sapiens
RENSLIEDL

SEQ ID NO: 639165 - protein, 9 aa, Homo Sapiens
IHPERDGDV

SEQ ID NO: 639166 - protein, 9 aa, Homo Sapiens
LLAISSSFA

SEQ ID NO: 639167 - protein, 9 aa, Homo Sapiens
SMFDQKSSS

SEQ ID NO: 639168 - protein, 9 aa, Homo Sapiens
RTKAFSSAH

SEQ ID NO: 639169 - protein, 9 aa, Homo Sapiens
TRRIQEKCE

SEQ ID NO: 639170 - protein, 9 aa, Homo Sapiens
KWKMRSDTD

SEQ ID NO: 639171 - protein, 9 aa, Homo Sapiens
KLEGPWGRC

SEQ ID NO: 639172 - protein, 9 aa, Homo Sapiens
CGSYSWETG

SEQ ID NO: 639173 - protein, 9 aa, Homo Sapiens
SGGGSHHRH

SEQ ID NO: 639174 - protein, 9 aa, Homo Sapiens
QQIKIWNIG

SEQ ID NO: 639175 - protein, 9 aa, Homo Sapiens
RHRPKCFED

SEQ ID NO: 639176 - protein, 9 aa, Homo Sapiens
IFVKRSQQK

SEQ ID NO: 639177 - protein, 9 aa, Homo Sapiens
CLLLSIRGL

SEQ ID NO: 639178 - protein, 9 aa, Homo Sapiens
GESRRKAFN

SEQ ID NO: 639179 - protein, 9 aa, Homo Sapiens
RAEKGINSF

SEQ ID NO: 639180 - protein, 9 aa, Homo Sapiens
AEDLREPVP

SEQ ID NO: 639181 - protein, 9 aa, Homo Sapiens
DGGLLGGGV

SEQ ID NO: 639182 - protein, 9 aa, Homo Sapiens
IVEIVNNST

SEQ ID NO: 639183 - protein, 9 aa, Homo Sapiens
LHRTTPSVF

SEQ ID NO: 639184 - protein, 9 aa, Homo Sapiens
SRLLFELCI

SEQ ID NO: 639185 - protein, 9 aa, Homo Sapiens
TGEAWQETM

SEQ ID NO: 639186 - protein, 9 aa, Homo Sapiens
KLTNLELLR

SEQ ID NO: 639187 - protein, 9 aa, Homo Sapiens
MNPSKNNST

SEQ ID NO: 639188 - protein, 9 aa, Homo Sapiens
VIISQEKEI

SEQ ID NO: 639189 - protein, 9 aa, Homo Sapiens
KDHLGRNNG

SEQ ID NO: 639190 - protein, 9 aa, Homo Sapiens
PCQMGNSGK

SEQ ID NO: 639191 - protein, 9 aa, Homo Sapiens
KLYECEECG

SEQ ID NO: 639192 - protein, 9 aa, Homo Sapiens
LGAHTVAEA

SEQ ID NO: 639193 - protein, 9 aa, Homo Sapiens
QVTLNFSEV

SEQ ID NO: 639194 - protein, 9 aa, Homo Sapiens
TWLDPAGPF

SEQ ID NO: 639195 - protein, 9 aa, Homo Sapiens
VIKFKSMPT

SEQ ID NO: 639196 - protein, 9 aa, Homo Sapiens
SSIEVIISQ

SEQ ID NO: 639197 - protein, 9 aa, Homo Sapiens
SCHGSSVTR

SEQ ID NO: 639198 - protein, 9 aa, Homo Sapiens
NTTQSPAEP

SEQ ID NO: 639199 - protein, 9 aa, Homo Sapiens
GSSLQANSW

SEQ ID NO: 639200 - protein, 9 aa, Homo Sapiens
IWTEDGHSN

SEQ ID NO: 639201 - protein, 9 aa, Homo Sapiens
YKASGCPSV

SEQ ID NO: 639202 - protein, 9 aa, Homo Sapiens
PSASQSSLD

SEQ ID NO: 639203 - protein, 9 aa, Homo Sapiens
KAGKESIMS

SEQ ID NO: 639204 - protein, 9 aa, Homo Sapiens
MQRAGISNQ

SEQ ID NO: 639205 - protein, 9 aa, Homo Sapiens
CSVMIRETP

SEQ ID NO: 639206 - protein, 9 aa, Homo Sapiens
LRNGNISMK

SEQ ID NO: 639207 - protein, 9 aa, Homo Sapiens
FVKRSQQKK

SEQ ID NO: 639208 - protein, 9 aa, Homo Sapiens
YYYQFGGRL

SEQ ID NO: 639209 - protein, 9 aa, Homo Sapiens
TMALHCCDE

SEQ ID NO: 639210 - protein, 9 aa, Homo Sapiens
CPSRGCPQM

SEQ ID NO: 639211 - protein, 9 aa, Homo Sapiens
VTMALHCCD

SEQ ID NO: 639212 - protein, 9 aa, Homo Sapiens
HNPAIRERH

SEQ ID NO: 639213 - protein, 9 aa, Homo Sapiens
HKLESLWVP

SEQ ID NO: 639214 - protein, 9 aa, Homo Sapiens
KMSTMRRIL

SEQ ID NO: 639215 - protein, 9 aa, Homo Sapiens
TSLPTHYPL

SEQ ID NO: 639216 - protein, 9 aa, Homo Sapiens
NTVIYSLRN

SEQ ID NO: 639217 - protein, 9 aa, Homo Sapiens
LSTKAKKPI

SEQ ID NO: 639218 - protein, 9 aa, Homo Sapiens
DSRRKHGRE

SEQ ID NO: 639219 - protein, 9 aa, Homo Sapiens
CTEAQRLDC

SEQ ID NO: 639220 - protein, 9 aa, Homo Sapiens
SQHLEIRDE

SEQ ID NO: 639221 - protein, 9 aa, Homo Sapiens
GETLRNVTI

SEQ ID NO: 639222 - protein, 9 aa, Homo Sapiens
VILESIFVK

SEQ ID NO: 639223 - protein, 9 aa, Homo Sapiens
LLKDHLGRN

SEQ ID NO: 639224 - protein, 9 aa, Homo Sapiens
CPGRERRTE

SEQ ID NO: 639225 - protein, 9 aa, Homo Sapiens
LMLNSQEEE

SEQ ID NO: 639226 - protein, 9 aa, Homo Sapiens
HCCDEVAVA

SEQ ID NO: 639227 - protein, 9 aa, Homo Sapiens
QAYTLALLG

SEQ ID NO: 639228 - protein, 9 aa, Homo Sapiens
RVVVVDFKK

SEQ ID NO: 639229 - protein, 9 aa, Homo Sapiens
DSLKTKQIR

SEQ ID NO: 639230 - protein, 9 aa, Homo Sapiens
IDQVVLSYE

SEQ ID NO: 639231 - protein, 9 aa, Homo Sapiens
LSYEGLRGA

SEQ ID NO: 639232 - protein, 9 aa, Homo Sapiens
LEDITSPRV

SEQ ID NO: 639233 - protein, 9 aa, Homo Sapiens
HNGERPFKC

SEQ ID NO: 639234 - protein, 9 aa, Homo Sapiens
AADAWKPQR

SEQ ID NO: 639235 - protein, 9 aa, Homo Sapiens
ECLDDRDQE

SEQ ID NO: 639236 - protein, 9 aa, Homo Sapiens
ADYESFCAE

SEQ ID NO: 639237 - protein, 9 aa, Homo Sapiens
YDVPNASCG

SEQ ID NO: 639238 - protein, 9 aa, Homo Sapiens
SGCKWKMRS

SEQ ID NO: 639239 - protein, 9 aa, Homo Sapiens
NNIAVRKRR

SEQ ID NO: 639240 - protein, 9 aa, Homo Sapiens
ISHLVLPVH

SEQ ID NO: 639241 - protein, 9 aa, Homo Sapiens
MLNSQEEEI

SEQ ID NO: 639242 - protein, 9 aa, Homo Sapiens
FPLLLQLTS

SEQ ID NO: 639243 - protein, 9 aa, Homo Sapiens
YKLRLGHKG

SEQ ID NO: 639244 - protein, 9 aa, Homo Sapiens
KALQATHSV

SEQ ID NO: 639245 - protein, 9 aa, Homo Sapiens
CRMKMSSGS

SEQ ID NO: 639246 - protein, 9 aa, Homo Sapiens
ELTLTTQSR

SEQ ID NO: 639247 - protein, 9 aa, Homo Sapiens
RLSVWVREQ

SEQ ID NO: 639248 - protein, 9 aa, Homo Sapiens
LEDGGVRIV

SEQ ID NO: 639249 - protein, 9 aa, Homo Sapiens
STLLMENIS

SEQ ID NO: 639250 - protein, 9 aa, Homo Sapiens
DDIKDLKLG

SEQ ID NO: 639251 - protein, 9 aa, Homo Sapiens
ESFAQAVSP

SEQ ID NO: 639252 - protein, 9 aa, Homo Sapiens
AFIRCIGAE

SEQ ID NO: 639253 - protein, 9 aa, Homo Sapiens
EENLFLAPL

SEQ ID NO: 639254 - protein, 9 aa, Homo Sapiens
PDRNDSVAV

SEQ ID NO: 639255 - protein, 9 aa, Homo Sapiens
FPDVPQALS

SEQ ID NO: 639256 - protein, 9 aa, Homo Sapiens
HSENETAKD

SEQ ID NO: 639257 - protein, 9 aa, Homo Sapiens
SERSEQNQR

SEQ ID NO: 639258 - protein, 9 aa, Homo Sapiens
QDSPGARGP

SEQ ID NO: 639259 - protein, 9 aa, Homo Sapiens
RQVMDHVFL

SEQ ID NO: 639260 - protein, 9 aa, Homo Sapiens
SGRKIASFI

SEQ ID NO: 639261 - protein, 9 aa, Homo Sapiens
YRLTHNDIV

SEQ ID NO: 639262 - protein, 9 aa, Homo Sapiens
CQRLQPTRN

SEQ ID NO: 639263 - protein, 9 aa, Homo Sapiens
YRPCSEGFL

SEQ ID NO: 639264 - protein, 9 aa, Homo Sapiens
SIRGLSQHQ

SEQ ID NO: 639265 - protein, 9 aa, Homo Sapiens
VTATGIIRP

SEQ ID NO: 639266 - protein, 9 aa, Homo Sapiens
FLPPSPTAK

SEQ ID NO: 639267 - protein, 9 aa, Homo Sapiens
QPTRNDLGD

SEQ ID NO: 639268 - protein, 9 aa, Homo Sapiens
RDIEQLPQQ

SEQ ID NO: 639269 - protein, 9 aa, Homo Sapiens
IKLANTDIH

SEQ ID NO: 639270 - protein, 9 aa, Homo Sapiens
HQCRRIRQP

SEQ ID NO: 639271 - protein, 9 aa, Homo Sapiens
GNLQGSTLS

SEQ ID NO: 639272 - protein, 9 aa, Homo Sapiens
NITDTTFGQ

SEQ ID NO: 639273 - protein, 9 aa, Homo Sapiens
CILRTFKFI

SEQ ID NO: 639274 - protein, 9 aa, Homo Sapiens
LAPSTVRQL

SEQ ID NO: 639275 - protein, 9 aa, Homo Sapiens
HSVAAGAAT

SEQ ID NO: 639276 - protein, 9 aa, Homo Sapiens
GEERLSLCR

SEQ ID NO: 639277 - protein, 9 aa, Homo Sapiens
HIDSAYFYE

SEQ ID NO: 639278 - protein, 9 aa, Homo Sapiens
GPDQQAYTL

SEQ ID NO: 639279 - protein, 9 aa, Homo Sapiens
VIVNATDLD

SEQ ID NO: 639280 - protein, 9 aa, Homo Sapiens
YHIQACTTT

SEQ ID NO: 639281 - protein, 9 aa, Homo Sapiens
ESIMSSDTN

SEQ ID NO: 639282 - protein, 9 aa, Homo Sapiens
CERPFPCAT

SEQ ID NO: 639283 - protein, 9 aa, Homo Sapiens
LDRCSVMIR

SEQ ID NO: 639284 - protein, 9 aa, Homo Sapiens
SHRSRYVLE

SEQ ID NO: 639285 - protein, 9 aa, Homo Sapiens
GTPDIRSLA

SEQ ID NO: 639286 - protein, 9 aa, Homo Sapiens
PQTYSNRIY

SEQ ID NO: 639287 - protein, 9 aa, Homo Sapiens
AWLSRFFEY

SEQ ID NO: 639288 - protein, 9 aa, Homo Sapiens
VLPIPVPRV

SEQ ID NO: 639289 - protein, 9 aa, Homo Sapiens
SLQKATWLS

SEQ ID NO: 639290 - protein, 9 aa, Homo Sapiens
TRAHAVERL

SEQ ID NO: 639291 - protein, 9 aa, Homo Sapiens
GMNFGGDPS

SEQ ID NO: 639292 - protein, 9 aa, Homo Sapiens
AGSQHLEIR

SEQ ID NO: 639293 - protein, 9 aa, Homo Sapiens
YLLAAVRCE

SEQ ID NO: 639294 - protein, 9 aa, Homo Sapiens
FSTDDRFVA

SEQ ID NO: 639295 - protein, 9 aa, Homo Sapiens
EIVNNSTVY

SEQ ID NO: 639296 - protein, 9 aa, Homo Sapiens
VTLPHASET

SEQ ID NO: 639297 - protein, 9 aa, Homo Sapiens
RRAAVCGNT

SEQ ID NO: 639298 - protein, 9 aa, Homo Sapiens
GAETSTALH

SEQ ID NO: 639299 - protein, 9 aa, Homo Sapiens
GIYETIYHR

SEQ ID NO: 639300 - protein, 9 aa, Homo Sapiens
LPDDDKFHG

SEQ ID NO: 639301 - protein, 9 aa, Homo Sapiens
LLGHHKTKA

SEQ ID NO: 639302 - protein, 9 aa, Homo Sapiens
SSETPTSEQ

SEQ ID NO: 639303 - protein, 9 aa, Homo Sapiens
LQASAPRMV

SEQ ID NO: 639304 - protein, 9 aa, Homo Sapiens
QIQSGCNYV

SEQ ID NO: 639305 - protein, 9 aa, Homo Sapiens
FVQVTRFGE

SEQ ID NO: 639306 - protein, 9 aa, Homo Sapiens
SPRRTKAFS

SEQ ID NO: 639307 - protein, 9 aa, Homo Sapiens
ETSTALHRT

SEQ ID NO: 639308 - protein, 9 aa, Homo Sapiens
DITSPRVIS

SEQ ID NO: 639309 - protein, 9 aa, Homo Sapiens
WKMRSDTDV

SEQ ID NO: 639310 - protein, 9 aa, Homo Sapiens
EQFGPLLQL

SEQ ID NO: 639311 - protein, 9 aa, Homo Sapiens
LTWSWRGSQ

SEQ ID NO: 639312 - protein, 9 aa, Homo Sapiens
YCRVPQGGY

SEQ ID NO: 639313 - protein, 9 aa, Homo Sapiens
DFPPLPTDC

SEQ ID NO: 639314 - protein, 9 aa, Homo Sapiens
LISVQQGSM

SEQ ID NO: 639315 - protein, 9 aa, Homo Sapiens
IFQDGVAGR

SEQ ID NO: 639316 - protein, 9 aa, Homo Sapiens
SSKFPTKRS

SEQ ID NO: 639317 - protein, 9 aa, Homo Sapiens
NRNGSDYPS

SEQ ID NO: 639318 - protein, 9 aa, Homo Sapiens
HEAQPWFEF

SEQ ID NO: 639319 - protein, 9 aa, Homo Sapiens
AERTFCCTF

SEQ ID NO: 639320 - protein, 9 aa, Homo Sapiens
AFSTDDRFV

SEQ ID NO: 639321 - protein, 9 aa, Homo Sapiens
ALWHKLESL

SEQ ID NO: 639322 - protein, 9 aa, Homo Sapiens
ASWGSLWLD

SEQ ID NO: 639323 - protein, 9 aa, Homo Sapiens
IPVPRVADG

SEQ ID NO: 639324 - protein, 9 aa, Homo Sapiens
NQAVVQQKP

SEQ ID NO: 639325 - protein, 9 aa, Homo Sapiens
ILTRRAAVC

SEQ ID NO: 639326 - protein, 9 aa, Homo Sapiens
HGVVVPMVH

SEQ ID NO: 639327 - protein, 9 aa, Homo Sapiens
PCGNTCLEE

SEQ ID NO: 639328 - protein, 9 aa, Homo Sapiens
QGSMGNFSD

SEQ ID NO: 639329 - protein, 9 aa, Homo Sapiens
LRLGHKGEG

SEQ ID NO: 639330 - protein, 9 aa, Homo Sapiens
PFPQGNQAV

SEQ ID NO: 639331 - protein, 9 aa, Homo Sapiens
LDGGNPFPD

SEQ ID NO: 639332 - protein, 9 aa, Homo Sapiens
RIKNANSHD

SEQ ID NO: 639333 - protein, 9 aa, Homo Sapiens
DRFVATCSV

SEQ ID NO: 639334 - protein, 9 aa, Homo Sapiens
FAQAVSPQA

SEQ ID NO: 639335 - protein, 9 aa, Homo Sapiens
MLELGCILR

SEQ ID NO: 639336 - protein, 9 aa, Homo Sapiens
EPDSEHRPD

SEQ ID NO: 639337 - protein, 9 aa, Homo Sapiens
CEQLYILLY

SEQ ID NO: 639338 - protein, 9 aa, Homo Sapiens
TARLPREDM

SEQ ID NO: 639339 - protein, 9 aa, Homo Sapiens
AILQDAIPS

SEQ ID NO: 639340 - protein, 9 aa, Homo Sapiens
PVPQHYLWE

SEQ ID NO: 639341 - protein, 9 aa, Homo Sapiens
QQAVFVVFD

SEQ ID NO: 639342 - protein, 9 aa, Homo Sapiens
WLWAPICAI

SEQ ID NO: 639343 - protein, 9 aa, Homo Sapiens
ALLNYSYVG

SEQ ID NO: 639344 - protein, 9 aa, Homo Sapiens
REGRDLGSF

SEQ ID NO: 639345 - protein, 9 aa, Homo Sapiens
AAVCGNTTL

SEQ ID NO: 639346 - protein, 9 aa, Homo Sapiens
MPTVTNFFI

SEQ ID NO: 639347 - protein, 9 aa, Homo Sapiens
WAEQPTKMG

SEQ ID NO: 639348 - protein, 9 aa, Homo Sapiens
DGDSGSGKA

SEQ ID NO: 639349 - protein, 9 aa, Homo Sapiens
KQTEPVSPV

SEQ ID NO: 639350 - protein, 9 aa, Homo Sapiens
PSSPAARAP

SEQ ID NO: 639351 - protein, 9 aa, Homo Sapiens
YRSVDYNML

SEQ ID NO: 639352 - protein, 9 aa, Homo Sapiens
IYWLTPHGL

SEQ ID NO: 639353 - protein, 9 aa, Homo Sapiens
TDVVASLAF

SEQ ID NO: 639354 - protein, 9 aa, Homo Sapiens
FSFEPKLQK

SEQ ID NO: 639355 - protein, 9 aa, Homo Sapiens
AELRCQCLQ

SEQ ID NO: 639356 - protein, 9 aa, Homo Sapiens
TEGSKQPSA

SEQ ID NO: 639357 - protein, 9 aa, Homo Sapiens
NFLIIFTLK

SEQ ID NO: 639358 - protein, 9 aa, Homo Sapiens
HSPHSRLRR

SEQ ID NO: 639359 - protein, 9 aa, Homo Sapiens
SETFSSTPC

SEQ ID NO: 639360 - protein, 9 aa, Homo Sapiens
SGSFVCQCY

SEQ ID NO: 639361 - protein, 9 aa, Homo Sapiens
KRRQQLRRT

SEQ ID NO: 639362 - protein, 9 aa, Homo Sapiens
LVVIVNATD

SEQ ID NO: 639363 - protein, 9 aa, Homo Sapiens
TLRNVTILR

SEQ ID NO: 639364 - protein, 9 aa, Homo Sapiens
KDNVCSLEK

SEQ ID NO: 639365 - protein, 9 aa, Homo Sapiens
KGDGVSLVL

SEQ ID NO: 639366 - protein, 9 aa, Homo Sapiens
QAVCGINRS

SEQ ID NO: 639367 - protein, 9 aa, Homo Sapiens
AKALRVNIL

SEQ ID NO: 639368 - protein, 9 aa, Homo Sapiens
QEELRQLAE

SEQ ID NO: 639369 - protein, 9 aa, Homo Sapiens
PMHPSGYRM

SEQ ID NO: 639370 - protein, 9 aa, Homo Sapiens
RVHGVVVPM

SEQ ID NO: 639371 - protein, 9 aa, Homo Sapiens
LGSVEEFQG

SEQ ID NO: 639372 - protein, 9 aa, Homo Sapiens
VIDKGDGVS

SEQ ID NO: 639373 - protein, 9 aa, Homo Sapiens
TFDFYRKNL

SEQ ID NO: 639374 - protein, 9 aa, Homo Sapiens
VQLESEVTV

SEQ ID NO: 639375 - protein, 9 aa, Homo Sapiens
ERNHIIYLR

SEQ ID NO: 639376 - protein, 9 aa, Homo Sapiens
EPEHNVSYL

SEQ ID NO: 639377 - protein, 9 aa, Homo Sapiens
ACVPGPHGL

SEQ ID NO: 639378 - protein, 9 aa, Homo Sapiens
YPRSRTSRF

SEQ ID NO: 639379 - protein, 9 aa, Homo Sapiens
LLNYSYVGC

SEQ ID NO: 639380 - protein, 9 aa, Homo Sapiens
IDSAYFYEN

SEQ ID NO: 639381 - protein, 9 aa, Homo Sapiens
AATWSPLVK

SEQ ID NO: 639382 - protein, 9 aa, Homo Sapiens
HVETRAHAV

SEQ ID NO: 639383 - protein, 9 aa, Homo Sapiens
IEQQAVFVV

SEQ ID NO: 639384 - protein, 9 aa, Homo Sapiens
PEMLDMLLI

SEQ ID NO: 639385 - protein, 9 aa, Homo Sapiens
VAIVEIVNN

SEQ ID NO: 639386 - protein, 9 aa, Homo Sapiens
ENTTQSPAE

SEQ ID NO: 639387 - protein, 9 aa, Homo Sapiens
NKKPEMLDM

SEQ ID NO: 639388 - protein, 9 aa, Homo Sapiens
QDKPYKCAD

SEQ ID NO: 639389 - protein, 9 aa, Homo Sapiens
AIMHEPMYI

SEQ ID NO: 639390 - protein, 9 aa, Homo Sapiens
NDIEEVKGQ

SEQ ID NO: 639391 - protein, 9 aa, Homo Sapiens
MSTMRRILD

SEQ ID NO: 639392 - protein, 9 aa, Homo Sapiens
KYEENLFLA

SEQ ID NO: 639393 - protein, 9 aa, Homo Sapiens
NSCLALNQK

SEQ ID NO: 639394 - protein, 9 aa, Homo Sapiens
VVRCRTRES

SEQ ID NO: 639395 - protein, 9 aa, Homo Sapiens
WKPYVRTLF

SEQ ID NO: 639396 - protein, 9 aa, Homo Sapiens
ASVNSISQT

SEQ ID NO: 639397 - protein, 9 aa, Homo Sapiens
NFGVGFPIG

SEQ ID NO: 639398 - protein, 9 aa, Homo Sapiens
GVASCCRPC

SEQ ID NO: 639399 - protein, 9 aa, Homo Sapiens
PIPPVEPLI

SEQ ID NO: 639400 - protein, 9 aa, Homo Sapiens
SPTTCRRPS

SEQ ID NO: 639401 - protein, 9 aa, Homo Sapiens
AYAQLSPSP

SEQ ID NO: 639402 - protein, 9 aa, Homo Sapiens
GISNQWNMG

SEQ ID NO: 639403 - protein, 9 aa, Homo Sapiens
DSVSGNVLH

SEQ ID NO: 639404 - protein, 9 aa, Homo Sapiens
SYEGLRGAV

SEQ ID NO: 639405 - protein, 9 aa, Homo Sapiens
SSRNFHATC

SEQ ID NO: 639406 - protein, 9 aa, Homo Sapiens
DGSPTTCRR

SEQ ID NO: 639407 - protein, 9 aa, Homo Sapiens
LPIPEDAQQ

SEQ ID NO: 639408 - protein, 9 aa, Homo Sapiens
LANYYKPHH

SEQ ID NO: 639409 - protein, 9 aa, Homo Sapiens
RHQSRGACT

SEQ ID NO: 639410 - protein, 9 aa, Homo Sapiens
AAAIRYSRP

SEQ ID NO: 639411 - protein, 9 aa, Homo Sapiens
AQLYFFHIL

SEQ ID NO: 639412 - protein, 9 aa, Homo Sapiens
FAVEPDTGE

SEQ ID NO: 639413 - protein, 9 aa, Homo Sapiens
SSQVCCNFL

SEQ ID NO: 639414 - protein, 9 aa, Homo Sapiens
KKYKKQNDI

SEQ ID NO: 639415 - protein, 9 aa, Homo Sapiens
TTMSCSEIP

SEQ ID NO: 639416 - protein, 9 aa, Homo Sapiens
AGQQHQTPI

SEQ ID NO: 639417 - protein, 9 aa, Homo Sapiens
ENLFLAPLP

SEQ ID NO: 639418 - protein, 9 aa, Homo Sapiens
RDFSAPLPE

SEQ ID NO: 639419 - protein, 9 aa, Homo Sapiens
CGKVFSYRA

SEQ ID NO: 639420 - protein, 9 aa, Homo Sapiens
NSGRKIASF

SEQ ID NO: 639421 - protein, 9 aa, Homo Sapiens
QQGSMGNFS

SEQ ID NO: 639422 - protein, 9 aa, Homo Sapiens
HGNPENRHR

SEQ ID NO: 639423 - protein, 9 aa, Homo Sapiens
LKLSCLFAG

SEQ ID NO: 639424 - protein, 9 aa, Homo Sapiens
GLFGVWPHN

SEQ ID NO: 639425 - protein, 9 aa, Homo Sapiens
EMGHPGPPG

SEQ ID NO: 639426 - protein, 9 aa, Homo Sapiens
LISAASPGP

SEQ ID NO: 639427 - protein, 9 aa, Homo Sapiens
DAFRSSKFP

SEQ ID NO: 639428 - protein, 9 aa, Homo Sapiens
QNDLLGHHK

SEQ ID NO: 639429 - protein, 9 aa, Homo Sapiens
CLEMDSESH

SEQ ID NO: 639430 - protein, 9 aa, Homo Sapiens
NMMKEIDKT

SEQ ID NO: 639431 - protein, 9 aa, Homo Sapiens
IPVQLESEV

SEQ ID NO: 639432 - protein, 9 aa, Homo Sapiens
WRTSLPTHY

SEQ ID NO: 639433 - protein, 9 aa, Homo Sapiens
VAEAGRRLG

SEQ ID NO: 639434 - protein, 9 aa, Homo Sapiens
MTQTMPVGI

SEQ ID NO: 639435 - protein, 9 aa, Homo Sapiens
TYIYASVST

SEQ ID NO: 639436 - protein, 9 aa, Homo Sapiens
LWLLVIRVE

SEQ ID NO: 639437 - protein, 9 aa, Homo Sapiens
DAILYYYQF

SEQ ID NO: 639438 - protein, 9 aa, Homo Sapiens
CSSMGFRIL

SEQ ID NO: 639439 - protein, 9 aa, Homo Sapiens
ELHEAQPWF

SEQ ID NO: 639440 - protein, 9 aa, Homo Sapiens
AGRGASAWD

SEQ ID NO: 639441 - protein, 9 aa, Homo Sapiens
DHVFLLLSS

SEQ ID NO: 639442 - protein, 9 aa, Homo Sapiens
VAAAASVTL

SEQ ID NO: 639443 - protein, 9 aa, Homo Sapiens
TPPLLYSDR

SEQ ID NO: 639444 - protein, 9 aa, Homo Sapiens
AELCECLDD

SEQ ID NO: 639445 - protein, 9 aa, Homo Sapiens
PQLKESEHH

SEQ ID NO: 639446 - protein, 9 aa, Homo Sapiens
SPQAVCGIN

SEQ ID NO: 639447 - protein, 9 aa, Homo Sapiens
RSEQNQRSE

SEQ ID NO: 639448 - protein, 9 aa, Homo Sapiens
NVMNGVASC

SEQ ID NO: 639449 - protein, 9 aa, Homo Sapiens
ENCERKQTE

SEQ ID NO: 639450 - protein, 9 aa, Homo Sapiens
TFKNLTSVV

SEQ ID NO: 639451 - protein, 9 aa, Homo Sapiens
EWIQMDSMV

SEQ ID NO: 639452 - protein, 9 aa, Homo Sapiens
KLTWSWRGS

SEQ ID NO: 639453 - protein, 9 aa, Homo Sapiens
FLDVIYWFL

SEQ ID NO: 639454 - protein, 9 aa, Homo Sapiens
LGRACVPGP

SEQ ID NO: 639455 - protein, 9 aa, Homo Sapiens
SSLGEHLGV

SEQ ID NO: 639456 - protein, 9 aa, Homo Sapiens
PSPQELQAS

SEQ ID NO: 639457 - protein, 9 aa, Homo Sapiens
PVLDSVSGN

SEQ ID NO: 639458 - protein, 9 aa, Homo Sapiens
KLLYFEPKD

SEQ ID NO: 639459 - protein, 9 aa, Homo Sapiens
SVNSISQTA

SEQ ID NO: 639460 - protein, 9 aa, Homo Sapiens
MNFGGDPSK

SEQ ID NO: 639461 - protein, 9 aa, Homo Sapiens
ILSQAIMHE

SEQ ID NO: 639462 - protein, 9 aa, Homo Sapiens
FSSVERRST

SEQ ID NO: 639463 - protein, 9 aa, Homo Sapiens
IRDPEHSAV

SEQ ID NO: 639464 - protein, 9 aa, Homo Sapiens
WTTKISNDV

SEQ ID NO: 639465 - protein, 9 aa, Homo Sapiens
YLTRLHENN

SEQ ID NO: 639466 - protein, 9 aa, Homo Sapiens
ILLAFSFEP

SEQ ID NO: 639467 - protein, 9 aa, Homo Sapiens
KILLAFSFE

SEQ ID NO: 639468 - protein, 9 aa, Homo Sapiens
RGSSLQANS

SEQ ID NO: 639469 - protein, 9 aa, Homo Sapiens
QFRKINTWK

SEQ ID NO: 639470 - protein, 9 aa, Homo Sapiens
MRRYLTAFT

SEQ ID NO: 639471 - protein, 9 aa, Homo Sapiens
TFRQKSSLI

SEQ ID NO: 639472 - protein, 9 aa, Homo Sapiens
SPHPPVGTK

SEQ ID NO: 639473 - protein, 9 aa, Homo Sapiens
CLKNDLGNH

SEQ ID NO: 639474 - protein, 9 aa, Homo Sapiens
LKLTNLELL

SEQ ID NO: 639475 - protein, 9 aa, Homo Sapiens
LEPKVQDSV

SEQ ID NO: 639476 - protein, 9 aa, Homo Sapiens
VAPLACADF

SEQ ID NO: 639477 - protein, 9 aa, Homo Sapiens
PVEPLISAA

SEQ ID NO: 639478 - protein, 9 aa, Homo Sapiens
SSASSETPT

SEQ ID NO: 639479 - protein, 9 aa, Homo Sapiens
LSTAIETPA

SEQ ID NO: 639480 - protein, 9 aa, Homo Sapiens
LLMKAKENE

SEQ ID NO: 639481 - protein, 9 aa, Homo Sapiens
RTPPLLYSD

SEQ ID NO: 639482 - protein, 9 aa, Homo Sapiens
PYFSVEQKT

SEQ ID NO: 639483 - protein, 9 aa, Homo Sapiens
PENRHRPDS

SEQ ID NO: 639484 - protein, 9 aa, Homo Sapiens
MPGVLGASW

SEQ ID NO: 639485 - protein, 9 aa, Homo Sapiens
DYDRYLAIC

SEQ ID NO: 639486 - protein, 9 aa, Homo Sapiens
SSVERRSTS

SEQ ID NO: 639487 - protein, 9 aa, Homo Sapiens
LCVLPQLKE

SEQ ID NO: 639488 - protein, 9 aa, Homo Sapiens
RIRQPQWQL

SEQ ID NO: 639489 - protein, 9 aa, Homo Sapiens
DKGDGVSLV

SEQ ID NO: 639490 - protein, 9 aa, Homo Sapiens
NCERKQTEP

SEQ ID NO: 639491 - protein, 9 aa, Homo Sapiens
SRYVLECSF

SEQ ID NO: 639492 - protein, 9 aa, Homo Sapiens
AQLTHNANP

SEQ ID NO: 639493 - protein, 9 aa, Homo Sapiens
WEEKLWRTE

SEQ ID NO: 639494 - protein, 9 aa, Homo Sapiens
LDDIKDLKL

SEQ ID NO: 639495 - protein, 9 aa, Homo Sapiens
RPPPACQSQ

SEQ ID NO: 639496 - protein, 9 aa, Homo Sapiens
HPERDGDVQ

SEQ ID NO: 639497 - protein, 9 aa, Homo Sapiens
SALCKASRG

SEQ ID NO: 639498 - protein, 9 aa, Homo Sapiens
SFAQAVSPQ

SEQ ID NO: 639499 - protein, 9 aa, Homo Sapiens
FGSCGSYSW

SEQ ID NO: 639500 - protein, 9 aa, Homo Sapiens
QCRRIRQPQ

SEQ ID NO: 639501 - protein, 9 aa, Homo Sapiens
NRFQAQQSV

SEQ ID NO: 639502 - protein, 9 aa, Homo Sapiens
RSVELDVID

SEQ ID NO: 639503 - protein, 9 aa, Homo Sapiens
AGQAEVLKV

SEQ ID NO: 639504 - protein, 9 aa, Homo Sapiens
IAGQQHQTP

SEQ ID NO: 639505 - protein, 9 aa, Homo Sapiens
LTNLELLRK

SEQ ID NO: 639506 - protein, 9 aa, Homo Sapiens
LKSRCSSMG

SEQ ID NO: 639507 - protein, 9 aa, Homo Sapiens
LQAVTDNHI

SEQ ID NO: 639508 - protein, 9 aa, Homo Sapiens
GDTPVELFG

SEQ ID NO: 639509 - protein, 9 aa, Homo Sapiens
YEGLRGAVA

SEQ ID NO: 639510 - protein, 9 aa, Homo Sapiens
PQAVCGINR

SEQ ID NO: 639511 - protein, 9 aa, Homo Sapiens
SQFRKINTW

SEQ ID NO: 639512 - protein, 9 aa, Homo Sapiens
RKIASFIAE

SEQ ID NO: 639513 - protein, 9 aa, Homo Sapiens
GPVYPAPNW

SEQ ID NO: 639514 - protein, 9 aa, Homo Sapiens
KHRGSKPAP

SEQ ID NO: 639515 - protein, 9 aa, Homo Sapiens
LWSCTWHSC

SEQ ID NO: 639516 - protein, 9 aa, Homo Sapiens
VHAVYDLKV

SEQ ID NO: 639517 - protein, 9 aa, Homo Sapiens
KPEMLDMLL

SEQ ID NO: 639518 - protein, 9 aa, Homo Sapiens
HEDSTTSRD

SEQ ID NO: 639519 - protein, 9 aa, Homo Sapiens
RDQLSCHGS

SEQ ID NO: 639520 - protein, 9 aa, Homo Sapiens
QDLEPLFQE

SEQ ID NO: 639521 - protein, 9 aa, Homo Sapiens
QHSVAAGAA

SEQ ID NO: 639522 - protein, 9 aa, Homo Sapiens
PHGLRFLRA

SEQ ID NO: 639523 - protein, 9 aa, Homo Sapiens
FGSYICKSH

SEQ ID NO: 639524 - protein, 9 aa, Homo Sapiens
SHHRHQSRG

SEQ ID NO: 639525 - protein, 9 aa, Homo Sapiens
TPLLNTVIY

SEQ ID NO: 639526 - protein, 9 aa, Homo Sapiens
CAWEAVNPE

SEQ ID NO: 639527 - protein, 9 aa, Homo Sapiens
FKEADLQKE

SEQ ID NO: 639528 - protein, 9 aa, Homo Sapiens
VMLVLRDMN

SEQ ID NO: 639529 - protein, 9 aa, Homo Sapiens
AQGPGGAVG

SEQ ID NO: 639530 - protein, 9 aa, Homo Sapiens
YVLECSFDF

SEQ ID NO: 639531 - protein, 9 aa, Homo Sapiens
HPPYVGYMV

SEQ ID NO: 639532 - protein, 9 aa, Homo Sapiens
QYLLGDFYV

SEQ ID NO: 639533 - protein, 9 aa, Homo Sapiens
FLGRESLGS

SEQ ID NO: 639534 - protein, 9 aa, Homo Sapiens
LEDSDLDGD

SEQ ID NO: 639535 - protein, 9 aa, Homo Sapiens
SLFVGGLVE

SEQ ID NO: 639536 - protein, 9 aa, Homo Sapiens
KQNDIEEVK

SEQ ID NO: 639537 - protein, 9 aa, Homo Sapiens
FWRQIRSRR

SEQ ID NO: 639538 - protein, 9 aa, Homo Sapiens
CLLAISSSF

SEQ ID NO: 639539 - protein, 9 aa, Homo Sapiens
ALNQKTHIG

SEQ ID NO: 639540 - protein, 9 aa, Homo Sapiens
VSQPTPFAL

SEQ ID NO: 639541 - protein, 9 aa, Homo Sapiens
SQSISHTQG

SEQ ID NO: 639542 - protein, 9 aa, Homo Sapiens
GVWPHNGEV

SEQ ID NO: 639543 - protein, 9 aa, Homo Sapiens
GFRRTIIAK

SEQ ID NO: 639544 - protein, 9 aa, Homo Sapiens
ILQDAIPST

SEQ ID NO: 639545 - protein, 9 aa, Homo Sapiens
YPDGRREQP

SEQ ID NO: 639546 - protein, 9 aa, Homo Sapiens
TDTTFGQNE

SEQ ID NO: 639547 - protein, 9 aa, Homo Sapiens
SLQLTLGNL

SEQ ID NO: 639548 - protein, 9 aa, Homo Sapiens
YKRRQQLRR

SEQ ID NO: 639549 - protein, 9 aa, Homo Sapiens
ISGSLSIAS

SEQ ID NO: 639550 - protein, 9 aa, Homo Sapiens
QSGQKLIDF

SEQ ID NO: 639551 - protein, 9 aa, Homo Sapiens
QLSCHGSSV

SEQ ID NO: 639552 - protein, 9 aa, Homo Sapiens
CFPCPSRGC

SEQ ID NO: 639553 - protein, 9 aa, Homo Sapiens
CPCQASFTQ

SEQ ID NO: 639554 - protein, 9 aa, Homo Sapiens
DVSLWIGRV

SEQ ID NO: 639555 - protein, 9 aa, Homo Sapiens
PQGNQAVVQ

SEQ ID NO: 639556 - protein, 9 aa, Homo Sapiens
YRHIDSAYF

SEQ ID NO: 639557 - protein, 9 aa, Homo Sapiens
RKSCQRRTG

SEQ ID NO: 639558 - protein, 9 aa, Homo Sapiens
TTDVVASLA

SEQ ID NO: 639559 - protein, 9 aa, Homo Sapiens
SIYVPDRVR

SEQ ID NO: 639560 - protein, 9 aa, Homo Sapiens
MAWLSRFFE

SEQ ID NO: 639561 - protein, 9 aa, Homo Sapiens
RLKLSCLFA

SEQ ID NO: 639562 - protein, 9 aa, Homo Sapiens
SFIAESMQS

SEQ ID NO: 639563 - protein, 9 aa, Homo Sapiens
KAASSFRSG

SEQ ID NO: 639564 - protein, 9 aa, Homo Sapiens
FTVMTQTMP

SEQ ID NO: 639565 - protein, 9 aa, Homo Sapiens
GDHLVISDI

SEQ ID NO: 639566 - protein, 9 aa, Homo Sapiens
VAAELRCQC

SEQ ID NO: 639567 - protein, 9 aa, Homo Sapiens
LGNIAERTF

SEQ ID NO: 639568 - protein, 9 aa, Homo Sapiens
HERERPTAS

SEQ ID NO: 639569 - protein, 9 aa, Homo Sapiens
EGKPKTRRI

SEQ ID NO: 639570 - protein, 9 aa, Homo Sapiens
LRREQEELL

SEQ ID NO: 639571 - protein, 9 aa, Homo Sapiens
KCCADYESF

SEQ ID NO: 639572 - protein, 9 aa, Homo Sapiens
EQLYILLYW

SEQ ID NO: 639573 - protein, 9 aa, Homo Sapiens
AAAAEGTFK

SEQ ID NO: 639574 - protein, 9 aa, Homo Sapiens
PWSEVVRCR

SEQ ID NO: 639575 - protein, 9 aa, Homo Sapiens
NELNFAFEE

SEQ ID NO: 639576 - protein, 9 aa, Homo Sapiens
QANSWKMAV

SEQ ID NO: 639577 - protein, 9 aa, Homo Sapiens
EQQAVFVVF

SEQ ID NO: 639578 - protein, 9 aa, Homo Sapiens
LYILLYWAA

SEQ ID NO: 639579 - protein, 9 aa, Homo Sapiens
AKEVFGNTL

SEQ ID NO: 639580 - protein, 9 aa, Homo Sapiens
GAIAVDRYV

SEQ ID NO: 639581 - protein, 9 aa, Homo Sapiens
THELTAREL

SEQ ID NO: 639582 - protein, 9 aa, Homo Sapiens
YTFIPLNSD

SEQ ID NO: 639583 - protein, 9 aa, Homo Sapiens
VIHGLELGH

SEQ ID NO: 639584 - protein, 9 aa, Homo Sapiens
EIPAANSFL

SEQ ID NO: 639585 - protein, 9 aa, Homo Sapiens
ETMLSCLGE

SEQ ID NO: 639586 - protein, 9 aa, Homo Sapiens
FFGDTPVEL

SEQ ID NO: 639587 - protein, 9 aa, Homo Sapiens
FFLEVMAFD

SEQ ID NO: 639588 - protein, 9 aa, Homo Sapiens
PQDRPSYPG

SEQ ID NO: 639589 - protein, 9 aa, Homo Sapiens
GIAFILLVL

SEQ ID NO: 639590 - protein, 9 aa, Homo Sapiens
LEMDSESHI

SEQ ID NO: 639591 - protein, 9 aa, Homo Sapiens
DVYSGYLLL

SEQ ID NO: 639592 - protein, 9 aa, Homo Sapiens
GGSGSLSAS

SEQ ID NO: 639593 - protein, 9 aa, Homo Sapiens
PSVVSVQSG

SEQ ID NO: 639594 - protein, 9 aa, Homo Sapiens
GHAGQGVSQ

SEQ ID NO: 639595 - protein, 9 aa, Homo Sapiens
MPPERNHII

SEQ ID NO: 639596 - protein, 9 aa, Homo Sapiens
NGSVEPEWE

SEQ ID NO: 639597 - protein, 9 aa, Homo Sapiens
HLYGTYLTR

SEQ ID NO: 639598 - protein, 9 aa, Homo Sapiens
PQVSFKEAD

SEQ ID NO: 639599 - protein, 9 aa, Homo Sapiens
AARAPGPPR

SEQ ID NO: 639600 - protein, 9 aa, Homo Sapiens
KVLAKALRV

SEQ ID NO: 639601 - protein, 9 aa, Homo Sapiens
MPMRSRGPA

SEQ ID NO: 639602 - protein, 9 aa, Homo Sapiens
TDDRFVATC

SEQ ID NO: 639603 - protein, 9 aa, Homo Sapiens
NAGSLSSSR

SEQ ID NO: 639604 - protein, 9 aa, Homo Sapiens
RHIDSAYFY

SEQ ID NO: 639605 - protein, 9 aa, Homo Sapiens
RGASAWDAG

SEQ ID NO: 639606 - protein, 9 aa, Homo Sapiens
SRPPSKLTW

SEQ ID NO: 639607 - protein, 9 aa, Homo Sapiens
SGSTPAPAF

SEQ ID NO: 639608 - protein, 9 aa, Homo Sapiens
FIKSSNLSE

SEQ ID NO: 639609 - protein, 9 aa, Homo Sapiens
QAVTDNHIR

SEQ ID NO: 639610 - protein, 9 aa, Homo Sapiens
EDFLKEMAA

SEQ ID NO: 639611 - protein, 9 aa, Homo Sapiens
PSAVEHGPG

SEQ ID NO: 639612 - protein, 9 aa, Homo Sapiens
AAAAAEGTF

SEQ ID NO: 639613 - protein, 9 aa, Homo Sapiens
PIKMGNNPF

SEQ ID NO: 639614 - protein, 9 aa, Homo Sapiens
GNFLIIFTL

SEQ ID NO: 639615 - protein, 9 aa, Homo Sapiens
AVDTQHGET

SEQ ID NO: 639616 - protein, 9 aa, Homo Sapiens
GYNHDKLFP

SEQ ID NO: 639617 - protein, 9 aa, Homo Sapiens
ILDPITFSE

SEQ ID NO: 639618 - protein, 9 aa, Homo Sapiens
YSFMMHSSA

SEQ ID NO: 639619 - protein, 9 aa, Homo Sapiens
GSQHLEIRD

SEQ ID NO: 639620 - protein, 9 aa, Homo Sapiens
AGQPSTSAH

SEQ ID NO: 639621 - protein, 9 aa, Homo Sapiens
LNRFQAQQS

SEQ ID NO: 639622 - protein, 9 aa, Homo Sapiens
LYDVPNASC

SEQ ID NO: 639623 - protein, 9 aa, Homo Sapiens
AMASFPETV

SEQ ID NO: 639624 - protein, 9 aa, Homo Sapiens
HGREEGSSV

SEQ ID NO: 639625 - protein, 9 aa, Homo Sapiens
LTARLSSRA

SEQ ID NO: 639626 - protein, 9 aa, Homo Sapiens
SFKEADLQK

SEQ ID NO: 639627 - protein, 9 aa, Homo Sapiens
PYVGYMVQH

SEQ ID NO: 639628 - protein, 9 aa, Homo Sapiens
SAVLLTAVE

SEQ ID NO: 639629 - protein, 9 aa, Homo Sapiens
PCSPEVQAP

SEQ ID NO: 639630 - protein, 9 aa, Homo Sapiens
RNKYKLTAL

SEQ ID NO: 639631 - protein, 9 aa, Homo Sapiens
RKINTWKVW

SEQ ID NO: 639632 - protein, 9 aa, Homo Sapiens
AWQETMLSC

SEQ ID NO: 639633 - protein, 9 aa, Homo Sapiens
GKTFRQKSS

SEQ ID NO: 639634 - protein, 9 aa, Homo Sapiens
MMLHKIYIQ

SEQ ID NO: 639635 - protein, 9 aa, Homo Sapiens
HVTFINKVA

SEQ ID NO: 639636 - protein, 9 aa, Homo Sapiens
VIQLPFLWA

SEQ ID NO: 639637 - protein, 9 aa, Homo Sapiens
RDTDAFRSS

SEQ ID NO: 639638 - protein, 9 aa, Homo Sapiens
EKKELHEAQ

SEQ ID NO: 639639 - protein, 9 aa, Homo Sapiens
HTSMLVEVA

SEQ ID NO: 639640 - protein, 9 aa, Homo Sapiens
LGHHKTKAF

SEQ ID NO: 639641 - protein, 9 aa, Homo Sapiens
VYSGYLLLE

SEQ ID NO: 639642 - protein, 9 aa, Homo Sapiens
LLTAHVGHS

SEQ ID NO: 639643 - protein, 9 aa, Homo Sapiens
LGNLKPEAM

SEQ ID NO: 639644 - protein, 9 aa, Homo Sapiens
QLSTAIETP

SEQ ID NO: 639645 - protein, 9 aa, Homo Sapiens
DIEQLPQQP

SEQ ID NO: 639646 - protein, 9 aa, Homo Sapiens
EIEHPAGDE

SEQ ID NO: 639647 - protein, 9 aa, Homo Sapiens
VDAEVSRLL

SEQ ID NO: 639648 - protein, 9 aa, Homo Sapiens
SLEAFLRAT

SEQ ID NO: 639649 - protein, 9 aa, Homo Sapiens
GRENSLIED

SEQ ID NO: 639650 - protein, 9 aa, Homo Sapiens
NPFPDVPQA

SEQ ID NO: 639651 - protein, 9 aa, Homo Sapiens
RVPQGGYYK

SEQ ID NO: 639652 - protein, 9 aa, Homo Sapiens
LNTVIYSLR

SEQ ID NO: 639653 - protein, 9 aa, Homo Sapiens
SENTAFLPP

SEQ ID NO: 639654 - protein, 9 aa, Homo Sapiens
RLFLSQSGA

SEQ ID NO: 639655 - protein, 9 aa, Homo Sapiens
NLPRLSVWV

SEQ ID NO: 639656 - protein, 9 aa, Homo Sapiens
QKCFCRIIL

SEQ ID NO: 639657 - protein, 9 aa, Homo Sapiens
NLGVAIVEI

SEQ ID NO: 639658 - protein, 9 aa, Homo Sapiens
SPEVQAPAQ

SEQ ID NO: 639659 - protein, 9 aa, Homo Sapiens
AHGNPENRH

SEQ ID NO: 639660 - protein, 9 aa, Homo Sapiens
KAIIKLANT

SEQ ID NO: 639661 - protein, 9 aa, Homo Sapiens
YCVCGMHEM

SEQ ID NO: 639662 - protein, 9 aa, Homo Sapiens
IPPVEPLIS

SEQ ID NO: 639663 - protein, 9 aa, Homo Sapiens
NTCSSHLSV

SEQ ID NO: 639664 - protein, 9 aa, Homo Sapiens
GAPGKPCQM

SEQ ID NO: 639665 - protein, 9 aa, Homo Sapiens
VLWHISVLM

SEQ ID NO: 639666 - protein, 9 aa, Homo Sapiens
RPDSRTPES

SEQ ID NO: 639667 - protein, 9 aa, Homo Sapiens
AEYKASGCP

SEQ ID NO: 639668 - protein, 9 aa, Homo Sapiens
TQSPAEPTE

SEQ ID NO: 639669 - protein, 9 aa, Homo Sapiens
PPIAMITLN

SEQ ID NO: 639670 - protein, 9 aa, Homo Sapiens
AIFSVAIMG

SEQ ID NO: 639671 - protein, 9 aa, Homo Sapiens
MKLTEMAWR

SEQ ID NO: 639672 - protein, 9 aa, Homo Sapiens
FEPKLQKFL

SEQ ID NO: 639673 - protein, 9 aa, Homo Sapiens
RIRIIDWYR

SEQ ID NO: 639674 - protein, 9 aa, Homo Sapiens
SLPQMKHFL

SEQ ID NO: 639675 - protein, 9 aa, Homo Sapiens
YSALPTDGS

SEQ ID NO: 639676 - protein, 9 aa, Homo Sapiens
GKVFSYRAN

SEQ ID NO: 639677 - protein, 9 aa, Homo Sapiens
RGSQATSPR

SEQ ID NO: 639678 - protein, 9 aa, Homo Sapiens
EKQLQQGFF

SEQ ID NO: 639679 - protein, 9 aa, Homo Sapiens
ASLVIAFIL

SEQ ID NO: 639680 - protein, 9 aa, Homo Sapiens
CKEFTYLLA

SEQ ID NO: 639681 - protein, 9 aa, Homo Sapiens
ALHRTTPSV

SEQ ID NO: 639682 - protein, 9 aa, Homo Sapiens
RAAVCGNTT

SEQ ID NO: 639683 - protein, 9 aa, Homo Sapiens
MLVEVANLA

SEQ ID NO: 639684 - protein, 9 aa, Homo Sapiens
ITFSEARFR

SEQ ID NO: 639685 - protein, 9 aa, Homo Sapiens
LRDCFRPSS

SEQ ID NO: 639686 - protein, 9 aa, Homo Sapiens
KMQIGIGCG

SEQ ID NO: 639687 - protein, 9 aa, Homo Sapiens
GVPLSYTDC

SEQ ID NO: 639688 - protein, 9 aa, Homo Sapiens
RSRTSRFIH

SEQ ID NO: 639689 - protein, 9 aa, Homo Sapiens
KKPIVGLGT

SEQ ID NO: 639690 - protein, 9 aa, Homo Sapiens
TSSFLCQRP

SEQ ID NO: 639691 - protein, 9 aa, Homo Sapiens
WTALLNYSY

SEQ ID NO: 639692 - protein, 9 aa, Homo Sapiens
QDGSPTTCR

SEQ ID NO: 639693 - protein, 9 aa, Homo Sapiens
FSIYVPDRV

SEQ ID NO: 639694 - protein, 9 aa, Homo Sapiens
VYDLCVVGE

SEQ ID NO: 639695 - protein, 9 aa, Homo Sapiens
SLLKAASSF

SEQ ID NO: 639696 - protein, 9 aa, Homo Sapiens
SGCPSVFQK

SEQ ID NO: 639697 - protein, 9 aa, Homo Sapiens
LPAHAYAQL

SEQ ID NO: 639698 - protein, 9 aa, Homo Sapiens
KLGSVEEFQ

SEQ ID NO: 639699 - protein, 9 aa, Homo Sapiens
KNRLLILIL

SEQ ID NO: 639700 - protein, 9 aa, Homo Sapiens
HAVERLLKK

SEQ ID NO: 639701 - protein, 9 aa, Homo Sapiens
GSKIRFLLE

SEQ ID NO: 639702 - protein, 9 aa, Homo Sapiens
VLRNGNISM

SEQ ID NO: 639703 - protein, 9 aa, Homo Sapiens
TRPVSQPTP

SEQ ID NO: 639704 - protein, 9 aa, Homo Sapiens
SGYLLLEAL

SEQ ID NO: 639705 - protein, 9 aa, Homo Sapiens
MAYDRCAAV

SEQ ID NO: 639706 - protein, 9 aa, Homo Sapiens
VLLGLIGAE

SEQ ID NO: 639707 - protein, 9 aa, Homo Sapiens
RKQTEPVSP

SEQ ID NO: 639708 - protein, 9 aa, Homo Sapiens
RFCKKVPII

SEQ ID NO: 639709 - protein, 9 aa, Homo Sapiens
TAIETPAEE

SEQ ID NO: 639710 - protein, 9 aa, Homo Sapiens
GIGCGGSQT

SEQ ID NO: 639711 - protein, 9 aa, Homo Sapiens
HKTKAFITH

SEQ ID NO: 639712 - protein, 9 aa, Homo Sapiens
SSKPFAVDV

SEQ ID NO: 639713 - protein, 9 aa, Homo Sapiens
ASGCPSVFQ

SEQ ID NO: 639714 - protein, 9 aa, Homo Sapiens
GGQHRAANV

SEQ ID NO: 639715 - protein, 9 aa, Homo Sapiens
FDFYRKNLK

SEQ ID NO: 639716 - protein, 9 aa, Homo Sapiens
KNEPEHNVS

SEQ ID NO: 639717 - protein, 9 aa, Homo Sapiens
WQHAGLEKY

SEQ ID NO: 639718 - protein, 9 aa, Homo Sapiens
SPHSRLRRS

SEQ ID NO: 639719 - protein, 9 aa, Homo Sapiens
GFIHPERDG

SEQ ID NO: 639720 - protein, 9 aa, Homo Sapiens
QPQDSPGAR

SEQ ID NO: 639721 - protein, 9 aa, Homo Sapiens
QGPGGAVGN

SEQ ID NO: 639722 - protein, 9 aa, Homo Sapiens
CRRIRQPQW

SEQ ID NO: 639723 - protein, 9 aa, Homo Sapiens
TEAYYRAGE

SEQ ID NO: 639724 - protein, 9 aa, Homo Sapiens
WRQIRSRRF

SEQ ID NO: 639725 - protein, 9 aa, Homo Sapiens
LHPAGSCSR

SEQ ID NO: 639726 - protein, 9 aa, Homo Sapiens
PARVVVVDF

SEQ ID NO: 639727 - protein, 9 aa, Homo Sapiens
PVPRVADGA

SEQ ID NO: 639728 - protein, 9 aa, Homo Sapiens
STKAKKPIV

SEQ ID NO: 639729 - protein, 9 aa, Homo Sapiens
MMKEIDKTS

SEQ ID NO: 639730 - protein, 9 aa, Homo Sapiens
DPITFSEAR

SEQ ID NO: 639731 - protein, 9 aa, Homo Sapiens
HRGSKPAPK

SEQ ID NO: 639732 - protein, 9 aa, Homo Sapiens
TYTIYRPCS

SEQ ID NO: 639733 - protein, 9 aa, Homo Sapiens
VPLLLLRYL

SEQ ID NO: 639734 - protein, 9 aa, Homo Sapiens
LLNGSQLVI

SEQ ID NO: 639735 - protein, 9 aa, Homo Sapiens
CPESYATQQ

SEQ ID NO: 639736 - protein, 9 aa, Homo Sapiens
WSEVVRCRT

SEQ ID NO: 639737 - protein, 9 aa, Homo Sapiens
DYLHKDTGD

SEQ ID NO: 639738 - protein, 9 aa, Homo Sapiens
LRFLRACQV

SEQ ID NO: 639739 - protein, 9 aa, Homo Sapiens
SLAFFCALL

SEQ ID NO: 639740 - protein, 9 aa, Homo Sapiens
LLQLAAVCR

SEQ ID NO: 639741 - protein, 9 aa, Homo Sapiens
PTDCAWEAV

SEQ ID NO: 639742 - protein, 9 aa, Homo Sapiens
AEVSRLLFE

SEQ ID NO: 639743 - protein, 9 aa, Homo Sapiens
DIAVLHRLT

SEQ ID NO: 639744 - protein, 9 aa, Homo Sapiens
ARAPGPPRR

SEQ ID NO: 639745 - protein, 9 aa, Homo Sapiens
RLITEHLPE

SEQ ID NO: 639746 - protein, 9 aa, Homo Sapiens
SCLEMDSES

SEQ ID NO: 639747 - protein, 9 aa, Homo Sapiens
FSSRNFHAT

SEQ ID NO: 639748 - protein, 9 aa, Homo Sapiens
PGGSGGSHD

SEQ ID NO: 639749 - protein, 9 aa, Homo Sapiens
KKWTSIHEW

SEQ ID NO: 639750 - protein, 9 aa, Homo Sapiens
EVLKVLVTN

SEQ ID NO: 639751 - protein, 9 aa, Homo Sapiens
VQKKKPISC

SEQ ID NO: 639752 - protein, 9 aa, Homo Sapiens
MSNASLVIA

SEQ ID NO: 639753 - protein, 9 aa, Homo Sapiens
YKLTALERW

SEQ ID NO: 639754 - protein, 9 aa, Homo Sapiens
RLWFLLPDD

SEQ ID NO: 639755 - protein, 9 aa, Homo Sapiens
ETWEEKLWR

SEQ ID NO: 639756 - protein, 9 aa, Homo Sapiens
LGRESLGSF

SEQ ID NO: 639757 - protein, 9 aa, Homo Sapiens
HRAANVCAG

SEQ ID NO: 639758 - protein, 9 aa, Homo Sapiens
YLAPSTVRQ

SEQ ID NO: 639759 - protein, 9 aa, Homo Sapiens
AIRYSRPGR

SEQ ID NO: 639760 - protein, 9 aa, Homo Sapiens
QETMLSCLG

SEQ ID NO: 639761 - protein, 9 aa, Homo Sapiens
GCCRIFQDG

SEQ ID NO: 639762 - protein, 9 aa, Homo Sapiens
HFRWHRAEK

SEQ ID NO: 639763 - protein, 9 aa, Homo Sapiens
LRAVAELHN

SEQ ID NO: 639764 - protein, 9 aa, Homo Sapiens
LSNKKPEML

SEQ ID NO: 639765 - protein, 9 aa, Homo Sapiens
VNLWSFGSK

SEQ ID NO: 639766 - protein, 9 aa, Homo Sapiens
AALVISLPH

SEQ ID NO: 639767 - protein, 9 aa, Homo Sapiens
TPPSLGSVW

SEQ ID NO: 639768 - protein, 9 aa, Homo Sapiens
RQIRSRRFF

SEQ ID NO: 639769 - protein, 9 aa, Homo Sapiens
EYKASGCPS

SEQ ID NO: 639770 - protein, 9 aa, Homo Sapiens
ERTFCCTFC

SEQ ID NO: 639771 - protein, 9 aa, Homo Sapiens
GDVYCRVPQ

SEQ ID NO: 639772 - protein, 9 aa, Homo Sapiens
GKYHIQACT

SEQ ID NO: 639773 - protein, 9 aa, Homo Sapiens
TIIAKREGA

SEQ ID NO: 639774 - protein, 9 aa, Homo Sapiens
ACECLHACS

SEQ ID NO: 639775 - protein, 9 aa, Homo Sapiens
LFQHWASWG

SEQ ID NO: 639776 - protein, 9 aa, Homo Sapiens
YALKAEELQ

SEQ ID NO: 639777 - protein, 9 aa, Homo Sapiens
HRLPVLDSV

SEQ ID NO: 639778 - protein, 9 aa, Homo Sapiens
TGDTSMLKR

SEQ ID NO: 639779 - protein, 9 aa, Homo Sapiens
NKCFPCPSR

SEQ ID NO: 639780 - protein, 9 aa, Homo Sapiens
PERNHIIYL

SEQ ID NO: 639781 - protein, 9 aa, Homo Sapiens
SALPTDGST

SEQ ID NO: 639782 - protein, 9 aa, Homo Sapiens
ILVIQLPFL

SEQ ID NO: 639783 - protein, 9 aa, Homo Sapiens
WTFLLYRLT

SEQ ID NO: 639784 - protein, 9 aa, Homo Sapiens
KKTRPVSQP

SEQ ID NO: 639785 - protein, 9 aa, Homo Sapiens
TPAPAFCCA

SEQ ID NO: 639786 - protein, 9 aa, Homo Sapiens
DPQTYSNRI

SEQ ID NO: 639787 - protein, 9 aa, Homo Sapiens
STDDRFVAT

SEQ ID NO: 639788 - protein, 9 aa, Homo Sapiens
PPMKLTEMA

SEQ ID NO: 639789 - protein, 9 aa, Homo Sapiens
KTSSFLCQR

SEQ ID NO: 639790 - protein, 9 aa, Homo Sapiens
HSGTVGVPL

SEQ ID NO: 639791 - protein, 9 aa, Homo Sapiens
PCEKRCDSE

SEQ ID NO: 639792 - protein, 9 aa, Homo Sapiens
GSTECFFLE

SEQ ID NO: 639793 - protein, 9 aa, Homo Sapiens
SCCRPCALE

SEQ ID NO: 639794 - protein, 9 aa, Homo Sapiens
MPRLRNTGW

SEQ ID NO: 639795 - protein, 9 aa, Homo Sapiens
AFNTCSSHL

SEQ ID NO: 639796 - protein, 9 aa, Homo Sapiens
GEMGHPGPP

SEQ ID NO: 639797 - protein, 9 aa, Homo Sapiens
CVILSQAIM

SEQ ID NO: 639798 - protein, 9 aa, Homo Sapiens
NNGAALLTA

SEQ ID NO: 639799 - protein, 9 aa, Homo Sapiens
AQQRDWGGA

SEQ ID NO: 639800 - protein, 9 aa, Homo Sapiens
YAQLSPSPI

SEQ ID NO: 639801 - protein, 9 aa, Homo Sapiens
SFGSKIRFL

SEQ ID NO: 639802 - protein, 9 aa, Homo Sapiens
LPQMKHFLF

SEQ ID NO: 639803 - protein, 9 aa, Homo Sapiens
LKPTNLNNK

SEQ ID NO: 639804 - protein, 9 aa, Homo Sapiens
SLPMHPSGY

SEQ ID NO: 639805 - protein, 9 aa, Homo Sapiens
IDSFNELNF

SEQ ID NO: 639806 - protein, 9 aa, Homo Sapiens
LPKSKSASD

SEQ ID NO: 639807 - protein, 9 aa, Homo Sapiens
NKYKLTALE

SEQ ID NO: 639808 - protein, 9 aa, Homo Sapiens
RQPLFFQFL

SEQ ID NO: 639809 - protein, 9 aa, Homo Sapiens
CSEIPAANS

SEQ ID NO: 639810 - protein, 9 aa, Homo Sapiens
NENTTQSPA

SEQ ID NO: 639811 - protein, 9 aa, Homo Sapiens
VHHRTHAGE

SEQ ID NO: 639812 - protein, 9 aa, Homo Sapiens
LVAPLACAD

SEQ ID NO: 639813 - protein, 9 aa, Homo Sapiens
MESLVPLLL

SEQ ID NO: 639814 - protein, 9 aa, Homo Sapiens
AAVRCEQWT

SEQ ID NO: 639815 - protein, 9 aa, Homo Sapiens
LSGTSLPQS

SEQ ID NO: 639816 - protein, 9 aa, Homo Sapiens
NPNLNAGII

SEQ ID NO: 639817 - protein, 9 aa, Homo Sapiens
PSKLTWSWR

SEQ ID NO: 639818 - protein, 9 aa, Homo Sapiens
HFYLEDITS

SEQ ID NO: 639819 - protein, 9 aa, Homo Sapiens
CSRNKYKLT

SEQ ID NO: 639820 - protein, 9 aa, Homo Sapiens
RMKAFIRCI

SEQ ID NO: 639821 - protein, 9 aa, Homo Sapiens
LKEKVNTAP

SEQ ID NO: 639822 - protein, 9 aa, Homo Sapiens
FNCHLQECA

SEQ ID NO: 639823 - protein, 9 aa, Homo Sapiens
SLEPKVQDS

SEQ ID NO: 639824 - protein, 9 aa, Homo Sapiens
GQAACECLH

SEQ ID NO: 639825 - protein, 9 aa, Homo Sapiens
LLYSDRDRD

SEQ ID NO: 639826 - protein, 9 aa, Homo Sapiens
PRSRTSRFI

SEQ ID NO: 639827 - protein, 9 aa, Homo Sapiens
VPQGGYYKT

SEQ ID NO: 639828 - protein, 9 aa, Homo Sapiens
VEIVNNSTV

SEQ ID NO: 639829 - protein, 9 aa, Homo Sapiens
AALLTAHVG

SEQ ID NO: 639830 - protein, 9 aa, Homo Sapiens
QILTRRAAV

SEQ ID NO: 639831 - protein, 9 aa, Homo Sapiens
WFLQIIAVV

SEQ ID NO: 639832 - protein, 9 aa, Homo Sapiens
SNASLVIAF

SEQ ID NO: 639833 - protein, 9 aa, Homo Sapiens
MLVLRDMNL

SEQ ID NO: 639834 - protein, 9 aa, Homo Sapiens
ALLTAHVGH

SEQ ID NO: 639835 - protein, 9 aa, Homo Sapiens
KLETKAETQ

SEQ ID NO: 639836 - protein, 9 aa, Homo Sapiens
GKKGEMGHP

SEQ ID NO: 639837 - protein, 9 aa, Homo Sapiens
CKCSMQEWV

SEQ ID NO: 639838 - protein, 9 aa, Homo Sapiens
CGFLSLALS

SEQ ID NO: 639839 - protein, 9 aa, Homo Sapiens
INNLSYWDA

SEQ ID NO: 639840 - protein, 9 aa, Homo Sapiens
QAVSPQAVC

SEQ ID NO: 639841 - protein, 9 aa, Homo Sapiens
MRSDTDVLN

SEQ ID NO: 639842 - protein, 9 aa, Homo Sapiens
TTPFPVTDA

SEQ ID NO: 639843 - protein, 9 aa, Homo Sapiens
QLRRTRCLL

SEQ ID NO: 639844 - protein, 9 aa, Homo Sapiens
RDLGSFARK

SEQ ID NO: 639845 - protein, 9 aa, Homo Sapiens
SLVGYLRVH

SEQ ID NO: 639846 - protein, 9 aa, Homo Sapiens
HSVACLAIF

SEQ ID NO: 639847 - protein, 9 aa, Homo Sapiens
FGDTPVELF

SEQ ID NO: 639848 - protein, 9 aa, Homo Sapiens
IDKGDGVSL

SEQ ID NO: 639849 - protein, 9 aa, Homo Sapiens
KSCQRRTGK

SEQ ID NO: 639850 - protein, 9 aa, Homo Sapiens
LSCHGSSVT

SEQ ID NO: 639851 - protein, 9 aa, Homo Sapiens
IEEVKGQET

SEQ ID NO: 639852 - protein, 9 aa, Homo Sapiens
PLISAASPG

SEQ ID NO: 639853 - protein, 9 aa, Homo Sapiens
EWAEQPTKM

SEQ ID NO: 639854 - protein, 9 aa, Homo Sapiens
VKLLYFEPK

SEQ ID NO: 639855 - protein, 9 aa, Homo Sapiens
VSLVLPVVE

SEQ ID NO: 639856 - protein, 9 aa, Homo Sapiens
YHRIPMVGI

SEQ ID NO: 639857 - protein, 9 aa, Homo Sapiens
PWGGFTYQD

SEQ ID NO: 639858 - protein, 9 aa, Homo Sapiens
EFTYLLAQD

SEQ ID NO: 639859 - protein, 9 aa, Homo Sapiens
DPEHSAVLL

SEQ ID NO: 639860 - protein, 9 aa, Homo Sapiens
STMRRILDL

SEQ ID NO: 639861 - protein, 9 aa, Homo Sapiens
LNHSENETA

SEQ ID NO: 639862 - protein, 9 aa, Homo Sapiens
FVVFDENKS

SEQ ID NO: 639863 - protein, 9 aa, Homo Sapiens
EAHRRVEAM

SEQ ID NO: 639864 - protein, 9 aa, Homo Sapiens
SAVEHGPGL

SEQ ID NO: 639865 - protein, 9 aa, Homo Sapiens
ALWSCTWHS

SEQ ID NO: 639866 - protein, 9 aa, Homo Sapiens
GSYSWETGA

SEQ ID NO: 639867 - protein, 9 aa, Homo Sapiens
YRKSCQRRT

SEQ ID NO: 639868 - protein, 9 aa, Homo Sapiens
PVYPAPNWA

SEQ ID NO: 639869 - protein, 9 aa, Homo Sapiens
QHSPHSRLR

SEQ ID NO: 639870 - protein, 9 aa, Homo Sapiens
IEVIISQEK

SEQ ID NO: 639871 - protein, 9 aa, Homo Sapiens
GREGRDLGS

SEQ ID NO: 639872 - protein, 9 aa, Homo Sapiens
WSFGSKIRF

SEQ ID NO: 639873 - protein, 9 aa, Homo Sapiens
DYLAPSTVR

SEQ ID NO: 639874 - protein, 9 aa, Homo Sapiens
QDRPSYPGM

SEQ ID NO: 639875 - protein, 9 aa, Homo Sapiens
AIQETKGNN

SEQ ID NO: 639876 - protein, 9 aa, Homo Sapiens
LELQQIKIW

SEQ ID NO: 639877 - protein, 9 aa, Homo Sapiens
AAEGTFKVL

SEQ ID NO: 639878 - protein, 9 aa, Homo Sapiens
WHKLESLWV

SEQ ID NO: 639879 - protein, 9 aa, Homo Sapiens
NVCSLEKSK

SEQ ID NO: 639880 - protein, 9 aa, Homo Sapiens
LFIIDSFNE

SEQ ID NO: 639881 - protein, 9 aa, Homo Sapiens
SDRDRDLYP

SEQ ID NO: 639882 - protein, 9 aa, Homo Sapiens
EVSRLLFEL

SEQ ID NO: 639883 - protein, 9 aa, Homo Sapiens
EDGHSNIYQ

SEQ ID NO: 639884 - protein, 9 aa, Homo Sapiens
EIRDEVAEK

SEQ ID NO: 639885 - protein, 9 aa, Homo Sapiens
SCFLTRGDL

SEQ ID NO: 639886 - protein, 9 aa, Homo Sapiens
RLSLIATAG

SEQ ID NO: 639887 - protein, 9 aa, Homo Sapiens
HASETFPPG

SEQ ID NO: 639888 - protein, 9 aa, Homo Sapiens
AKVIILEQS

SEQ ID NO: 639889 - protein, 9 aa, Homo Sapiens
APCRPLAAA

SEQ ID NO: 639890 - protein, 9 aa, Homo Sapiens
HAGERPYGC

SEQ ID NO: 639891 - protein, 9 aa, Homo Sapiens
VQVTRFGEV

SEQ ID NO: 639892 - protein, 9 aa, Homo Sapiens
QLLMKAKEN

SEQ ID NO: 639893 - protein, 9 aa, Homo Sapiens
VACEDSRSH

SEQ ID NO: 639894 - protein, 9 aa, Homo Sapiens
FTYLLAQDR

SEQ ID NO: 639895 - protein, 9 aa, Homo Sapiens
RPVSQPTPF

SEQ ID NO: 639896 - protein, 9 aa, Homo Sapiens
ERAASERLN

SEQ ID NO: 639897 - protein, 9 aa, Homo Sapiens
VRPAAEDLR

SEQ ID NO: 639898 - protein, 9 aa, Homo Sapiens
SCQRRTGKK

SEQ ID NO: 639899 - protein, 9 aa, Homo Sapiens
RRIQEKCEG

SEQ ID NO: 639900 - protein, 9 aa, Homo Sapiens
PDYLGRVRL

SEQ ID NO: 639901 - protein, 9 aa, Homo Sapiens
VTIEDLMKT

SEQ ID NO: 639902 - protein, 9 aa, Homo Sapiens
AEKGINSFR

SEQ ID NO: 639903 - protein, 9 aa, Homo Sapiens
NIAVRKRRD

SEQ ID NO: 639904 - protein, 9 aa, Homo Sapiens
APSTVRQLM

SEQ ID NO: 639905 - protein, 9 aa, Homo Sapiens
TLSLFLDER

SEQ ID NO: 639906 - protein, 9 aa, Homo Sapiens
CPSVFQKPV

SEQ ID NO: 639907 - protein, 9 aa, Homo Sapiens
ERQVMDHVF

SEQ ID NO: 639908 - protein, 9 aa, Homo Sapiens
GHSRALWSC

SEQ ID NO: 639909 - protein, 9 aa, Homo Sapiens
LYHKLEGPW

SEQ ID NO: 639910 - protein, 9 aa, Homo Sapiens
RILDLAKHR

SEQ ID NO: 639911 - protein, 9 aa, Homo Sapiens
MPREGMFHY

SEQ ID NO: 639912 - protein, 9 aa, Homo Sapiens
ITSPRVIST

SEQ ID NO: 639913 - protein, 9 aa, Homo Sapiens
KPNVISLFE

SEQ ID NO: 639914 - protein, 9 aa, Homo Sapiens
RTKRLWFLL

SEQ ID NO: 639915 - protein, 9 aa, Homo Sapiens
GQHLYGTYL

SEQ ID NO: 639916 - protein, 9 aa, Homo Sapiens
GGLLGGGVS

SEQ ID NO: 639917 - protein, 9 aa, Homo Sapiens
SKQPSASQS

SEQ ID NO: 639918 - protein, 9 aa, Homo Sapiens
LWFLLPDDI

SEQ ID NO: 639919 - protein, 9 aa, Homo Sapiens
SYSWETGAM

SEQ ID NO: 639920 - protein, 9 aa, Homo Sapiens
QRRTGKKSQ

SEQ ID NO: 639921 - protein, 9 aa, Homo Sapiens
EHLPELQLV

SEQ ID NO: 639922 - protein, 9 aa, Homo Sapiens
VFSIAINNL

SEQ ID NO: 639923 - protein, 9 aa, Homo Sapiens
MQASPSPSA

SEQ ID NO: 639924 - protein, 9 aa, Homo Sapiens
KPYKCADCG

SEQ ID NO: 639925 - protein, 9 aa, Homo Sapiens
QQGTVITLI

SEQ ID NO: 639926 - protein, 9 aa, Homo Sapiens
DVYCRVPQG

SEQ ID NO: 639927 - protein, 9 aa, Homo Sapiens
REDLCGHAE

SEQ ID NO: 639928 - protein, 9 aa, Homo Sapiens
GTPTSSASS

SEQ ID NO: 639929 - protein, 9 aa, Homo Sapiens
STVRQLMAQ

SEQ ID NO: 639930 - protein, 9 aa, Homo Sapiens
GSTLSLFLD

SEQ ID NO: 639931 - protein, 9 aa, Homo Sapiens
QLESEVTVT

SEQ ID NO: 639932 - protein, 9 aa, Homo Sapiens
GGIGDEIEH

SEQ ID NO: 639933 - protein, 9 aa, Homo Sapiens
SLVLPVVEG

SEQ ID NO: 639934 - protein, 9 aa, Homo Sapiens
LVTATGIIR

SEQ ID NO: 639935 - protein, 9 aa, Homo Sapiens
VLGPDQQAY

SEQ ID NO: 639936 - protein, 9 aa, Homo Sapiens
AILYYYQFG

SEQ ID NO: 639937 - protein, 9 aa, Homo Sapiens
LDVIYWFLQ

SEQ ID NO: 639938 - protein, 9 aa, Homo Sapiens
YLHKDTGDT

SEQ ID NO: 639939 - protein, 9 aa, Homo Sapiens
EVMAFDRYL

SEQ ID NO: 639940 - protein, 9 aa, Homo Sapiens
VSGSFVCQC

SEQ ID NO: 639941 - protein, 9 aa, Homo Sapiens
WACSARVAS

SEQ ID NO: 639942 - protein, 9 aa, Homo Sapiens
PGDHLVISD

SEQ ID NO: 639943 - protein, 9 aa, Homo Sapiens
VSTLLMENI

SEQ ID NO: 639944 - protein, 9 aa, Homo Sapiens
HKGEGFGPS

SEQ ID NO: 639945 - protein, 9 aa, Homo Sapiens
INKTLTDNG

SEQ ID NO: 639946 - protein, 9 aa, Homo Sapiens
HHKTKAFIT

SEQ ID NO: 639947 - protein, 9 aa, Homo Sapiens
QQSVDILET

SEQ ID NO: 639948 - protein, 9 aa, Homo Sapiens
EHSGQGIAK

SEQ ID NO: 639949 - protein, 9 aa, Homo Sapiens
DTAAKVIIL

SEQ ID NO: 639950 - protein, 9 aa, Homo Sapiens
ITQLLMKAK

SEQ ID NO: 639951 - protein, 9 aa, Homo Sapiens
AKVELIPVQ

SEQ ID NO: 639952 - protein, 9 aa, Homo Sapiens
LAFAIILLK

SEQ ID NO: 639953 - protein, 9 aa, Homo Sapiens
PCSEGFLKG

SEQ ID NO: 639954 - protein, 9 aa, Homo Sapiens
LLAFSFEPK

SEQ ID NO: 639955 - protein, 9 aa, Homo Sapiens
LSLIATAGI

SEQ ID NO: 639956 - protein, 9 aa, Homo Sapiens
AASVTLLSG

SEQ ID NO: 639957 - protein, 9 aa, Homo Sapiens
ELCECLDDR

SEQ ID NO: 639958 - protein, 9 aa, Homo Sapiens
KTRRIQEKC

SEQ ID NO: 639959 - protein, 9 aa, Homo Sapiens
SDLDGDSGS

SEQ ID NO: 639960 - protein, 9 aa, Homo Sapiens
QGPHQCRRI

SEQ ID NO: 639961 - protein, 9 aa, Homo Sapiens
GVLGASWGS

SEQ ID NO: 639962 - protein, 9 aa, Homo Sapiens
AWKPQRKFG

SEQ ID NO: 639963 - protein, 9 aa, Homo Sapiens
SFHRGLQSI

SEQ ID NO: 639964 - protein, 9 aa, Homo Sapiens
LKDHLGRNN

SEQ ID NO: 639965 - protein, 9 aa, Homo Sapiens
DYALKAEEL

SEQ ID NO: 639966 - protein, 9 aa, Homo Sapiens
FNFRNNFGI

SEQ ID NO: 639967 - protein, 9 aa, Homo Sapiens
GLRNLGNAC

SEQ ID NO: 639968 - protein, 9 aa, Homo Sapiens
FLLPDDILK

SEQ ID NO: 639969 - protein, 9 aa, Homo Sapiens
HRHQSRGAC

SEQ ID NO: 639970 - protein, 9 aa, Homo Sapiens
AVSPQAVCG

SEQ ID NO: 639971 - protein, 9 aa, Homo Sapiens
KGGADRAFP

SEQ ID NO: 639972 - protein, 9 aa, Homo Sapiens
ASRGCVSWS

SEQ ID NO: 639973 - protein, 9 aa, Homo Sapiens
EKLWRTEAI

SEQ ID NO: 639974 - protein, 9 aa, Homo Sapiens
SSGSHIPFD

SEQ ID NO: 639975 - protein, 9 aa, Homo Sapiens
VPCSPEVQA

SEQ ID NO: 639976 - protein, 9 aa, Homo Sapiens
LSLSLGFKC

SEQ ID NO: 639977 - protein, 9 aa, Homo Sapiens
QQHQTPIKM

SEQ ID NO: 639978 - protein, 9 aa, Homo Sapiens
AALWHKLES

SEQ ID NO: 639979 - protein, 9 aa, Homo Sapiens
QHLEIRDEV

SEQ ID NO: 639980 - protein, 9 aa, Homo Sapiens
CQASFTQSH

SEQ ID NO: 639981 - protein, 9 aa, Homo Sapiens
NPENRHRPD

SEQ ID NO: 639982 - protein, 9 aa, Homo Sapiens
CSSKPFAVD

SEQ ID NO: 639983 - protein, 9 aa, Homo Sapiens
KPKTRRIQE

SEQ ID NO: 639984 - protein, 9 aa, Homo Sapiens
LLRTGRLHP

SEQ ID NO: 639985 - protein, 9 aa, Homo Sapiens
QPSTSAHGQ

SEQ ID NO: 639986 - protein, 9 aa, Homo Sapiens
VLNPIIDSL

SEQ ID NO: 639987 - protein, 9 aa, Homo Sapiens
GASVNSISQ

SEQ ID NO: 639988 - protein, 9 aa, Homo Sapiens
VASCCRPCA

SEQ ID NO: 639989 - protein, 9 aa, Homo Sapiens
KSEKVVQEA

SEQ ID NO: 639990 - protein, 9 aa, Homo Sapiens
VSFKEADLQ

SEQ ID NO: 639991 - protein, 9 aa, Homo Sapiens
NSQSISHTQ

SEQ ID NO: 639992 - protein, 8 aa, Homo Sapiens
DLHKQWEN

SEQ ID NO: 639993 - protein, 9 aa, Homo Sapiens
AASVKHRGS

SEQ ID NO: 639994 - protein, 9 aa, Homo Sapiens
EKHIRSHTC

SEQ ID NO: 639995 - protein, 9 aa, Homo Sapiens
FIRCIGAEL

SEQ ID NO: 639996 - protein, 9 aa, Homo Sapiens
AAWAQGRAG

SEQ ID NO: 639997 - protein, 9 aa, Homo Sapiens
IIDSLKTKQ

SEQ ID NO: 639998 - protein, 9 aa, Homo Sapiens
GNPENRHRP

SEQ ID NO: 639999 - protein, 9 aa, Homo Sapiens
IIGHAGQGV

SEQ ID NO: 640000 - protein, 9 aa, Homo Sapiens
LVISLPHPW

SEQ ID NO: 640001 - protein, 9 aa, Homo Sapiens
KQHILWPKI

SEQ ID NO: 640002 - protein, 9 aa, Homo Sapiens
QKATWLSLD

SEQ ID NO: 640003 - protein, 9 aa, Homo Sapiens
CECLDDRDQ

SEQ ID NO: 640004 - protein, 9 aa, Homo Sapiens
PNWARYPYG

SEQ ID NO: 640005 - protein, 9 aa, Homo Sapiens
LHKIYIQKH

SEQ ID NO: 640006 - protein, 9 aa, Homo Sapiens
WTSIHEWIQ

SEQ ID NO: 640007 - protein, 9 aa, Homo Sapiens
VALNRFQAQ

SEQ ID NO: 640008 - protein, 9 aa, Homo Sapiens
IQDGSPTTC

SEQ ID NO: 640009 - protein, 9 aa, Homo Sapiens
GRESLGSFG

SEQ ID NO: 640010 - protein, 9 aa, Homo Sapiens
RGYNPNLNA

SEQ ID NO: 640011 - protein, 9 aa, Homo Sapiens
LDFVNAMKR

SEQ ID NO: 640012 - protein, 9 aa, Homo Sapiens
EHSAVLLTA

SEQ ID NO: 640013 - protein, 9 aa, Homo Sapiens
LEKSKPCVS

SEQ ID NO: 640014 - protein, 9 aa, Homo Sapiens
STAIETPAE

SEQ ID NO: 640015 - protein, 9 aa, Homo Sapiens
LLQHLIIHN

SEQ ID NO: 640016 - protein, 9 aa, Homo Sapiens
QVCMAILDN

SEQ ID NO: 640017 - protein, 9 aa, Homo Sapiens
MGHPGPPGH

SEQ ID NO: 640018 - protein, 9 aa, Homo Sapiens
FKKEAFRLQ

SEQ ID NO: 640019 - protein, 9 aa, Homo Sapiens
CQLGFWWLI

SEQ ID NO: 640020 - protein, 9 aa, Homo Sapiens
PIGMVDSSM

SEQ ID NO: 640021 - protein, 9 aa, Homo Sapiens
HKLEGPWGR

SEQ ID NO: 640022 - protein, 9 aa, Homo Sapiens
QRRRACPRQ

SEQ ID NO: 640023 - protein, 9 aa, Homo Sapiens
IVNATDLDE

SEQ ID NO: 640024 - protein, 9 aa, Homo Sapiens
RTLFIELLP

SEQ ID NO: 640025 - protein, 9 aa, Homo Sapiens
KIPQVTLNF

SEQ ID NO: 640026 - protein, 9 aa, Homo Sapiens
FLLSSEYDE

SEQ ID NO: 640027 - protein, 9 aa, Homo Sapiens
NLRSSHPHF

SEQ ID NO: 640028 - protein, 9 aa, Homo Sapiens
AFCCAPYDS

SEQ ID NO: 640029 - protein, 9 aa, Homo Sapiens
LQATHSVAC

SEQ ID NO: 640030 - protein, 9 aa, Homo Sapiens
SWGKWNKYQ

SEQ ID NO: 640031 - protein, 9 aa, Homo Sapiens
CVLVPPLLD

SEQ ID NO: 640032 - protein, 9 aa, Homo Sapiens
GSLSIASEK

SEQ ID NO: 640033 - protein, 9 aa, Homo Sapiens
SCMQHSVAA

SEQ ID NO: 640034 - protein, 9 aa, Homo Sapiens
GGAVGNRHA

SEQ ID NO: 640035 - protein, 9 aa, Homo Sapiens
KIASFIAES

SEQ ID NO: 640036 - protein, 9 aa, Homo Sapiens
DLDGDSGSG

SEQ ID NO: 640037 - protein, 9 aa, Homo Sapiens
RKRRDKAKR

SEQ ID NO: 640038 - protein, 9 aa, Homo Sapiens
GWRTSLPTH

SEQ ID NO: 640039 - protein, 9 aa, Homo Sapiens
PSTSAHGQP

SEQ ID NO: 640040 - protein, 9 aa, Homo Sapiens
ELQRRSLPV

SEQ ID NO: 640041 - protein, 9 aa, Homo Sapiens
AEELCQLGF

SEQ ID NO: 640042 - protein, 9 aa, Homo Sapiens
KLLLSFGKA

SEQ ID NO: 640043 - protein, 9 aa, Homo Sapiens
LLPDDILKN

SEQ ID NO: 640044 - protein, 9 aa, Homo Sapiens
CGCCRIFQD

SEQ ID NO: 640045 - protein, 9 aa, Homo Sapiens
DFYRKNLKS

SEQ ID NO: 640046 - protein, 9 aa, Homo Sapiens
PDIRSLAFF

SEQ ID NO: 640047 - protein, 9 aa, Homo Sapiens
HLIIHNGEK

SEQ ID NO: 640048 - protein, 9 aa, Homo Sapiens
EHPAGDEYE

SEQ ID NO: 640049 - protein, 9 aa, Homo Sapiens
TEMAWRVCF

SEQ ID NO: 640050 - protein, 9 aa, Homo Sapiens
TGEVWLRQP

SEQ ID NO: 640051 - protein, 9 aa, Homo Sapiens
GMSKNRLLI

SEQ ID NO: 640052 - protein, 9 aa, Homo Sapiens
QIKIWNIGK

SEQ ID NO: 640053 - protein, 9 aa, Homo Sapiens
AIENCERKQ

SEQ ID NO: 640054 - protein, 9 aa, Homo Sapiens
QKTGVIKTA

SEQ ID NO: 640055 - protein, 9 aa, Homo Sapiens
DNVCSLEKS

SEQ ID NO: 640056 - protein, 9 aa, Homo Sapiens
PTVPEPTAL

SEQ ID NO: 640057 - protein, 9 aa, Homo Sapiens
DIKDLKLGS

SEQ ID NO: 640058 - protein, 9 aa, Homo Sapiens
LPREDMRGQ

SEQ ID NO: 640059 - protein, 9 aa, Homo Sapiens
LGLQPQELE

SEQ ID NO: 640060 - protein, 9 aa, Homo Sapiens
LSLEPKVQD

SEQ ID NO: 640061 - protein, 9 aa, Homo Sapiens
AAEFSCLEM

SEQ ID NO: 640062 - protein, 9 aa, Homo Sapiens
FMLEPDSEH

SEQ ID NO: 640063 - protein, 9 aa, Homo Sapiens
LDGDSGSGK

SEQ ID NO: 640064 - protein, 9 aa, Homo Sapiens
AACLDMQAS

SEQ ID NO: 640065 - protein, 9 aa, Homo Sapiens
RPKCFEDTK

SEQ ID NO: 640066 - protein, 9 aa, Homo Sapiens
ENRHRPDSR

SEQ ID NO: 640067 - protein, 9 aa, Homo Sapiens
IVKHMRDQN

SEQ ID NO: 640068 - protein, 9 aa, Homo Sapiens
SVEQKTGVI

SEQ ID NO: 640069 - protein, 9 aa, Homo Sapiens
FIPCEKRCD

SEQ ID NO: 640070 - protein, 9 aa, Homo Sapiens
IQSGCNYVA

SEQ ID NO: 640071 - protein, 9 aa, Homo Sapiens
IGHAGQGVS

SEQ ID NO: 640072 - protein, 9 aa, Homo Sapiens
LLLLRYLTW

SEQ ID NO: 640073 - protein, 9 aa, Homo Sapiens
QPTKMGRGK

SEQ ID NO: 640074 - protein, 9 aa, Homo Sapiens
VASSALCKA

SEQ ID NO: 640075 - protein, 9 aa, Homo Sapiens
ECTEAQRLD

SEQ ID NO: 640076 - protein, 9 aa, Homo Sapiens
AFVACEDSR

SEQ ID NO: 640077 - protein, 9 aa, Homo Sapiens
GSLSASWEP

SEQ ID NO: 640078 - protein, 9 aa, Homo Sapiens
IVCLLAISS

SEQ ID NO: 640079 - protein, 9 aa, Homo Sapiens
SSGQPPSGP

SEQ ID NO: 640080 - protein, 9 aa, Homo Sapiens
LSIRGLSQH

SEQ ID NO: 640081 - protein, 9 aa, Homo Sapiens
KAASVKHRG

SEQ ID NO: 640082 - protein, 9 aa, Homo Sapiens
DQKVIQASM

SEQ ID NO: 640083 - protein, 9 aa, Homo Sapiens
ISLFEQKKE

SEQ ID NO: 640084 - protein, 9 aa, Homo Sapiens
GKPCQMGNS

SEQ ID NO: 640085 - protein, 9 aa, Homo Sapiens
KHGREEGSS

SEQ ID NO: 640086 - protein, 9 aa, Homo Sapiens
AAALVISLP

SEQ ID NO: 640087 - protein, 9 aa, Homo Sapiens
TEDGHSNIY

SEQ ID NO: 640088 - protein, 9 aa, Homo Sapiens
VAQLYFFHI

SEQ ID NO: 640089 - protein, 9 aa, Homo Sapiens
LPVFQARGQ

SEQ ID NO: 640090 - protein, 9 aa, Homo Sapiens
LVLGPDQQA

SEQ ID NO: 640091 - protein, 9 aa, Homo Sapiens
QLYPECTEA

SEQ ID NO: 640092 - protein, 9 aa, Homo Sapiens
NHIRMHKVL

SEQ ID NO: 640093 - protein, 9 aa, Homo Sapiens
LTHELTARE

SEQ ID NO: 640094 - protein, 9 aa, Homo Sapiens
ICCVPGPDV

SEQ ID NO: 640095 - protein, 9 aa, Homo Sapiens
GGNPFPDVP

SEQ ID NO: 640096 - protein, 9 aa, Homo Sapiens
NGSDYPSYN

SEQ ID NO: 640097 - protein, 9 aa, Homo Sapiens
TAHVGHSVA

SEQ ID NO: 640098 - protein, 9 aa, Homo Sapiens
SEQNQRSEE

SEQ ID NO: 640099 - protein, 9 aa, Homo Sapiens
NGRLFLSQS

SEQ ID NO: 640100 - protein, 9 aa, Homo Sapiens
LDQIQSGCN

SEQ ID NO: 640101 - protein, 9 aa, Homo Sapiens
LVSGLSSLG

SEQ ID NO: 640102 - protein, 9 aa, Homo Sapiens
RQIAPCRPL

SEQ ID NO: 640103 - protein, 9 aa, Homo Sapiens
CRIFQDGVA

SEQ ID NO: 640104 - protein, 9 aa, Homo Sapiens
ALHCCDEVA

SEQ ID NO: 640105 - protein, 9 aa, Homo Sapiens
EHNVSYLYE

SEQ ID NO: 640106 - protein, 9 aa, Homo Sapiens
IGGTLVKLL

SEQ ID NO: 640107 - protein, 9 aa, Homo Sapiens
PDTGEVWLR

SEQ ID NO: 640108 - protein, 9 aa, Homo Sapiens
EEKLWRTEA

SEQ ID NO: 640109 - protein, 9 aa, Homo Sapiens
VLFQHWASW

SEQ ID NO: 640110 - protein, 9 aa, Homo Sapiens
WPEKKTRPV

SEQ ID NO: 640111 - protein, 9 aa, Homo Sapiens
KEKVNTAPC

SEQ ID NO: 640112 - protein, 9 aa, Homo Sapiens
ESIFVKRSQ

SEQ ID NO: 640113 - protein, 9 aa, Homo Sapiens
KCPESYATQ

SEQ ID NO: 640114 - protein, 9 aa, Homo Sapiens
PPLLYSDRD

SEQ ID NO: 640115 - protein, 9 aa, Homo Sapiens
AICCVPGPD

SEQ ID NO: 640116 - protein, 9 aa, Homo Sapiens
VCMAILDNP

SEQ ID NO: 640117 - protein, 9 aa, Homo Sapiens
VGYLRVHGV

SEQ ID NO: 640118 - protein, 9 aa, Homo Sapiens
TWLSLDTMK

SEQ ID NO: 640119 - protein, 9 aa, Homo Sapiens
LETKAETQT

SEQ ID NO: 640120 - protein, 9 aa, Homo Sapiens
LPQQPTYVQ

SEQ ID NO: 640121 - protein, 9 aa, Homo Sapiens
RHRPDSRTP

SEQ ID NO: 640122 - protein, 9 aa, Homo Sapiens
AFLKKLHKE

SEQ ID NO: 640123 - protein, 9 aa, Homo Sapiens
WYPEVNRFC

SEQ ID NO: 640124 - protein, 9 aa, Homo Sapiens
TLDSKLKNA

SEQ ID NO: 640125 - protein, 9 aa, Homo Sapiens
SKFPTKRSK

SEQ ID NO: 640126 - protein, 9 aa, Homo Sapiens
ATEAYYRAG

SEQ ID NO: 640127 - protein, 9 aa, Homo Sapiens
YILLYWAAN

SEQ ID NO: 640128 - protein, 9 aa, Homo Sapiens
YVRTLFIEL

SEQ ID NO: 640129 - protein, 9 aa, Homo Sapiens
EGLRGAVAF

SEQ ID NO: 640130 - protein, 9 aa, Homo Sapiens
ACAENWTTK

SEQ ID NO: 640131 - protein, 9 aa, Homo Sapiens
AIILLKTDM

SEQ ID NO: 640132 - protein, 9 aa, Homo Sapiens
CMMQFYLFC

SEQ ID NO: 640133 - protein, 9 aa, Homo Sapiens
ETAKDIAPT

SEQ ID NO: 640134 - protein, 9 aa, Homo Sapiens
MGKKGEMGH

SEQ ID NO: 640135 - protein, 9 aa, Homo Sapiens
PKGGTLVWL

SEQ ID NO: 640136 - protein, 9 aa, Homo Sapiens
VKDHERERP

SEQ ID NO: 640137 - protein, 9 aa, Homo Sapiens
TWAFHLTSI

SEQ ID NO: 640138 - protein, 9 aa, Homo Sapiens
TLVKLLYFE

SEQ ID NO: 640139 - protein, 9 aa, Homo Sapiens
ITEHLPELQ

SEQ ID NO: 640140 - protein, 9 aa, Homo Sapiens
WAPICAICC

SEQ ID NO: 640141 - protein, 9 aa, Homo Sapiens
CFTCMEQPL

SEQ ID NO: 640142 - protein, 9 aa, Homo Sapiens
NSNAELCEC

SEQ ID NO: 640143 - protein, 9 aa, Homo Sapiens
SAYFYENQH

SEQ ID NO: 640144 - protein, 9 aa, Homo Sapiens
EAMPRLRNT

SEQ ID NO: 640145 - protein, 9 aa, Homo Sapiens
SSQRYLLKC

SEQ ID NO: 640146 - protein, 9 aa, Homo Sapiens
RRRACPRQV

SEQ ID NO: 640147 - protein, 9 aa, Homo Sapiens
SCGSYSWET

SEQ ID NO: 640148 - protein, 9 aa, Homo Sapiens
FSVEQKTGV

SEQ ID NO: 640149 - protein, 9 aa, Homo Sapiens
LNPIIDSLK

SEQ ID NO: 640150 - protein, 9 aa, Homo Sapiens
QHYLWEKEG

SEQ ID NO: 640151 - protein, 9 aa, Homo Sapiens
VADIHCLHC

SEQ ID NO: 640152 - protein, 9 aa, Homo Sapiens
SELMLELGC

SEQ ID NO: 640153 - protein, 9 aa, Homo Sapiens
VMTQTMPVG

SEQ ID NO: 640154 - protein, 9 aa, Homo Sapiens
VFSYRANLA

SEQ ID NO: 640155 - protein, 9 aa, Homo Sapiens
DDRLSQSKS

SEQ ID NO: 640156 - protein, 9 aa, Homo Sapiens
DRPSYPGMD

SEQ ID NO: 640157 - protein, 9 aa, Homo Sapiens
SLPVFQARG

SEQ ID NO: 640158 - protein, 9 aa, Homo Sapiens
VWMSTALAT

SEQ ID NO: 640159 - protein, 9 aa, Homo Sapiens
PGPPRRPIP

SEQ ID NO: 640160 - protein, 9 aa, Homo Sapiens
CHLQECAKG

SEQ ID NO: 640161 - protein, 9 aa, Homo Sapiens
FFHILGSTE

SEQ ID NO: 640162 - protein, 9 aa, Homo Sapiens
SGLPAHAYA

SEQ ID NO: 640163 - protein, 9 aa, Homo Sapiens
MLRSPVEMD

SEQ ID NO: 640164 - protein, 9 aa, Homo Sapiens
YDLKVRTIR

SEQ ID NO: 640165 - protein, 9 aa, Homo Sapiens
GNPFPDVPQ

SEQ ID NO: 640166 - protein, 9 aa, Homo Sapiens
NTCLEERDN

SEQ ID NO: 640167 - protein, 9 aa, Homo Sapiens
LAILGGIAF

SEQ ID NO: 640168 - protein, 9 aa, Homo Sapiens
KISNDVCQL

SEQ ID NO: 640169 - protein, 9 aa, Homo Sapiens
TALHRTTPS

SEQ ID NO: 640170 - protein, 9 aa, Homo Sapiens
FCCTFCKCP

SEQ ID NO: 640171 - protein, 9 aa, Homo Sapiens
EPTALDQVQ

SEQ ID NO: 640172 - protein, 9 aa, Homo Sapiens
CRSVELDVI

SEQ ID NO: 640173 - protein, 9 aa, Homo Sapiens
GLEVISHTE

SEQ ID NO: 640174 - protein, 9 aa, Homo Sapiens
QVSFKEADL

SEQ ID NO: 640175 - protein, 9 aa, Homo Sapiens
YDRCAAVCR

SEQ ID NO: 640176 - protein, 9 aa, Homo Sapiens
SEVEAPAVP

SEQ ID NO: 640177 - protein, 9 aa, Homo Sapiens
VVIVNATDL

SEQ ID NO: 640178 - protein, 9 aa, Homo Sapiens
DSTTSRDIK

SEQ ID NO: 640179 - protein, 9 aa, Homo Sapiens
MRQLADGSV

SEQ ID NO: 640180 - protein, 9 aa, Homo Sapiens
AFHLTSITI

SEQ ID NO: 640181 - protein, 9 aa, Homo Sapiens
SFNELNFAF

SEQ ID NO: 640182 - protein, 9 aa, Homo Sapiens
ASDQMRRYL

SEQ ID NO: 640183 - protein, 9 aa, Homo Sapiens
RNNFGIGEK

SEQ ID NO: 640184 - protein, 9 aa, Homo Sapiens
EQVQLDIPL

SEQ ID NO: 640185 - protein, 9 aa, Homo Sapiens
DQVVLSYEG

SEQ ID NO: 640186 - protein, 9 aa, Homo Sapiens
RAAALVISL

SEQ ID NO: 640187 - protein, 9 aa, Homo Sapiens
CAKGPLPVD

SEQ ID NO: 640188 - protein, 9 aa, Homo Sapiens
ARLPREDMR

SEQ ID NO: 640189 - protein, 9 aa, Homo Sapiens
LILEDSDLD

SEQ ID NO: 640190 - protein, 9 aa, Homo Sapiens
NFCSRNKYK

SEQ ID NO: 640191 - protein, 9 aa, Homo Sapiens
ELVLGPDQQ

SEQ ID NO: 640192 - protein, 9 aa, Homo Sapiens
RIFQDGVAG

SEQ ID NO: 640193 - protein, 9 aa, Homo Sapiens
LPMHPSGYR

SEQ ID NO: 640194 - protein, 9 aa, Homo Sapiens
PCATRVGNT

SEQ ID NO: 640195 - protein, 9 aa, Homo Sapiens
PDSRTPESF

SEQ ID NO: 640196 - protein, 9 aa, Homo Sapiens
PESYATQQR

SEQ ID NO: 640197 - protein, 9 aa, Homo Sapiens
DNRYEFSDC

SEQ ID NO: 640198 - protein, 9 aa, Homo Sapiens
QAVFVVFDE

SEQ ID NO: 640199 - protein, 9 aa, Homo Sapiens
IENRKVVVT

SEQ ID NO: 640200 - protein, 9 aa, Homo Sapiens
ISPSRDNRY

SEQ ID NO: 640201 - protein, 9 aa, Homo Sapiens
EKAIAQCFT

SEQ ID NO: 640202 - protein, 9 aa, Homo Sapiens
RIFGFIHPE

SEQ ID NO: 640203 - protein, 9 aa, Homo Sapiens
CKWKMRSDT

SEQ ID NO: 640204 - protein, 9 aa, Homo Sapiens
EYDEPSRQV

SEQ ID NO: 640205 - protein, 9 aa, Homo Sapiens
RRKHGREEG

SEQ ID NO: 640206 - protein, 9 aa, Homo Sapiens
ICKSHKGFD

SEQ ID NO: 640207 - protein, 9 aa, Homo Sapiens
VNTAPCPLP

SEQ ID NO: 640208 - protein, 9 aa, Homo Sapiens
QGTVITLIS

SEQ ID NO: 640209 - protein, 9 aa, Homo Sapiens
AVAELHNPA

SEQ ID NO: 640210 - protein, 9 aa, Homo Sapiens
PVSQPTPFA

SEQ ID NO: 640211 - protein, 9 aa, Homo Sapiens
SVACLAIFV

SEQ ID NO: 640212 - protein, 9 aa, Homo Sapiens
LVVADIHCL

SEQ ID NO: 640213 - protein, 9 aa, Homo Sapiens
VFFFPFPIF

SEQ ID NO: 640214 - protein, 9 aa, Homo Sapiens
LYSALPTDG

SEQ ID NO: 640215 - protein, 9 aa, Homo Sapiens
LEPLFQELQ

SEQ ID NO: 640216 - protein, 9 aa, Homo Sapiens
RNLGNACYM

SEQ ID NO: 640217 - protein, 9 aa, Homo Sapiens
GRLHPAGSC

SEQ ID NO: 640218 - protein, 9 aa, Homo Sapiens
VHLLKDHLG

SEQ ID NO: 640219 - protein, 9 aa, Homo Sapiens
VDYNMLRSP

SEQ ID NO: 640220 - protein, 9 aa, Homo Sapiens
QVALNFANG

SEQ ID NO: 640221 - protein, 9 aa, Homo Sapiens
RPQDRPSYP

SEQ ID NO: 640222 - protein, 9 aa, Homo Sapiens
CKKYDKCCA

SEQ ID NO: 640223 - protein, 9 aa, Homo Sapiens
VFSTCGSHM

SEQ ID NO: 640224 - protein, 9 aa, Homo Sapiens
EPDTGEVWL

SEQ ID NO: 640225 - protein, 9 aa, Homo Sapiens
FSLEDPQTY

SEQ ID NO: 640226 - protein, 9 aa, Homo Sapiens
VLNVLTASR

SEQ ID NO: 640227 - protein, 9 aa, Homo Sapiens
KDCGFLSLA

SEQ ID NO: 640228 - protein, 9 aa, Homo Sapiens
FMMHSSAGA

SEQ ID NO: 640229 - protein, 9 aa, Homo Sapiens
CLGIMPMRS

SEQ ID NO: 640230 - protein, 9 aa, Homo Sapiens
TKHPQDLDS

SEQ ID NO: 640231 - protein, 9 aa, Homo Sapiens
IGNLNKSVT

SEQ ID NO: 640232 - protein, 9 aa, Homo Sapiens
WARLLLRIT

SEQ ID NO: 640233 - protein, 9 aa, Homo Sapiens
LDSLQKATW

SEQ ID NO: 640234 - protein, 9 aa, Homo Sapiens
FNTCSSHLS

SEQ ID NO: 640235 - protein, 9 aa, Homo Sapiens
QFGGRLRRP

SEQ ID NO: 640236 - protein, 9 aa, Homo Sapiens
YNHDKLFPL

SEQ ID NO: 640237 - protein, 9 aa, Homo Sapiens
KDITQLLMK

SEQ ID NO: 640238 - protein, 9 aa, Homo Sapiens
LTASRPPSK

SEQ ID NO: 640239 - protein, 9 aa, Homo Sapiens
VPFFGDTPV

SEQ ID NO: 640240 - protein, 9 aa, Homo Sapiens
SPHEDSTTS

SEQ ID NO: 640241 - protein, 9 aa, Homo Sapiens
IISQEKEIT

SEQ ID NO: 640242 - protein, 9 aa, Homo Sapiens
GAATWSPLV

SEQ ID NO: 640243 - protein, 9 aa, Homo Sapiens
FLIIFTLKS

SEQ ID NO: 640244 - protein, 9 aa, Homo Sapiens
ENWTTKISN

SEQ ID NO: 640245 - protein, 9 aa, Homo Sapiens
SQEEEILAK

SEQ ID NO: 640246 - protein, 9 aa, Homo Sapiens
PDFWNGSVS

SEQ ID NO: 640247 - protein, 9 aa, Homo Sapiens
HLRSHNGER

SEQ ID NO: 640248 - protein, 9 aa, Homo Sapiens
QLSKDYALK

SEQ ID NO: 640249 - protein, 9 aa, Homo Sapiens
RLPREDMRG

SEQ ID NO: 640250 - protein, 9 aa, Homo Sapiens
SIASEKRLT

SEQ ID NO: 640251 - protein, 9 aa, Homo Sapiens
DSFNELNFA

SEQ ID NO: 640252 - protein, 9 aa, Homo Sapiens
KDYALKAEE

SEQ ID NO: 640253 - protein, 9 aa, Homo Sapiens
ETFSSTPCA

SEQ ID NO: 640254 - protein, 9 aa, Homo Sapiens
HRIPMVGIP

SEQ ID NO: 640255 - protein, 9 aa, Homo Sapiens
IDGSDNEPI

SEQ ID NO: 640256 - protein, 9 aa, Homo Sapiens
FCLYRKSCQ

SEQ ID NO: 640257 - protein, 9 aa, Homo Sapiens
MALKPTNLN

SEQ ID NO: 640258 - protein, 9 aa, Homo Sapiens
FFQFLVIYI

SEQ ID NO: 640259 - protein, 9 aa, Homo Sapiens
SGQGIAKAL

SEQ ID NO: 640260 - protein, 9 aa, Homo Sapiens
GCLCPCQAS

SEQ ID NO: 640261 - protein, 9 aa, Homo Sapiens
VHTVTLPHA

SEQ ID NO: 640262 - protein, 9 aa, Homo Sapiens
SFEPKLQKF

SEQ ID NO: 640263 - protein, 9 aa, Homo Sapiens
QEDMMLHKI

SEQ ID NO: 640264 - protein, 9 aa, Homo Sapiens
DAEVSRLLF

SEQ ID NO: 640265 - protein, 9 aa, Homo Sapiens
VELSTKAKK

SEQ ID NO: 640266 - protein, 9 aa, Homo Sapiens
MPVGIFTLL

SEQ ID NO: 640267 - protein, 9 aa, Homo Sapiens
SFMMHSSAG

SEQ ID NO: 640268 - protein, 9 aa, Homo Sapiens
DVIYWFLQI

SEQ ID NO: 640269 - protein, 9 aa, Homo Sapiens
SGSLSASWE

SEQ ID NO: 640270 - protein, 9 aa, Homo Sapiens
MAAIEERYG

SEQ ID NO: 640271 - protein, 9 aa, Homo Sapiens
VWTALLNYS

SEQ ID NO: 640272 - protein, 9 aa, Homo Sapiens
VWNDLRLKL

SEQ ID NO: 640273 - protein, 9 aa, Homo Sapiens
LEQDLEPLF

SEQ ID NO: 640274 - protein, 9 aa, Homo Sapiens
SPRIDPDYL

SEQ ID NO: 640275 - protein, 9 aa, Homo Sapiens
VFQARGQLL

SEQ ID NO: 640276 - protein, 9 aa, Homo Sapiens
LHCCDEVAV

SEQ ID NO: 640277 - protein, 9 aa, Homo Sapiens
CVVRDFSAP

SEQ ID NO: 640278 - protein, 9 aa, Homo Sapiens
GSTISAFCA

SEQ ID NO: 640279 - protein, 9 aa, Homo Sapiens
SGSTISAFC

SEQ ID NO: 640280 - protein, 9 aa, Homo Sapiens
QRDWGGAAQ

SEQ ID NO: 640281 - protein, 9 aa, Homo Sapiens
IHGLELGHS

SEQ ID NO: 640282 - protein, 9 aa, Homo Sapiens
SVAAELRCQ

SEQ ID NO: 640283 - protein, 9 aa, Homo Sapiens
RMRAAALVI

SEQ ID NO: 640284 - protein, 9 aa, Homo Sapiens
DLDSTPPPG

SEQ ID NO: 640285 - protein, 9 aa, Homo Sapiens
CSVPLGHVD

SEQ ID NO: 640286 - protein, 9 aa, Homo Sapiens
LFIELLPWA

SEQ ID NO: 640287 - protein, 9 aa, Homo Sapiens
REQFGPLLQ

SEQ ID NO: 640288 - protein, 9 aa, Homo Sapiens
EKDYLAPST

SEQ ID NO: 640289 - protein, 9 aa, Homo Sapiens
EVNRFCKKV

SEQ ID NO: 640290 - protein, 9 aa, Homo Sapiens
LPDDILKNK

SEQ ID NO: 640291 - protein, 9 aa, Homo Sapiens
LMKAKENEE

SEQ ID NO: 640292 - protein, 9 aa, Homo Sapiens
GQQHQTPIK

SEQ ID NO: 640293 - protein, 9 aa, Homo Sapiens
LSSSRENRA

SEQ ID NO: 640294 - protein, 9 aa, Homo Sapiens
METFNTLKY

SEQ ID NO: 640295 - protein, 9 aa, Homo Sapiens
ELANYYKPH

SEQ ID NO: 640296 - protein, 9 aa, Homo Sapiens
ALPTVPEPT

SEQ ID NO: 640297 - protein, 9 aa, Homo Sapiens
RRSTSCKGQ

SEQ ID NO: 640298 - protein, 9 aa, Homo Sapiens
SNNTGRIKV

SEQ ID NO: 640299 - protein, 9 aa, Homo Sapiens
HIPFDPYAT

SEQ ID NO: 640300 - protein, 9 aa, Homo Sapiens
QGFFPIKNG

SEQ ID NO: 640301 - protein, 9 aa, Homo Sapiens
LHKEEIQEL

SEQ ID NO: 640302 - protein, 9 aa, Homo Sapiens
DGPAAMASF

SEQ ID NO: 640303 - protein, 9 aa, Homo Sapiens
LRGAILQDA

SEQ ID NO: 640304 - protein, 9 aa, Homo Sapiens
GREEGSSVW

SEQ ID NO: 640305 - protein, 9 aa, Homo Sapiens
WIQMDSMVI

SEQ ID NO: 640306 - protein, 9 aa, Homo Sapiens
SRNMMKEID

SEQ ID NO: 640307 - protein, 9 aa, Homo Sapiens
QFGPLLQLA

SEQ ID NO: 640308 - protein, 9 aa, Homo Sapiens
AHAVERLLK

SEQ ID NO: 640309 - protein, 9 aa, Homo Sapiens
RTTSILKRR

SEQ ID NO: 640310 - protein, 9 aa, Homo Sapiens
APFQLSNNT

SEQ ID NO: 640311 - protein, 9 aa, Homo Sapiens
EQPQRQKVG

SEQ ID NO: 640312 - protein, 9 aa, Homo Sapiens
QFLVIYIVT

SEQ ID NO: 640313 - protein, 9 aa, Homo Sapiens
GSHHRHQSR

SEQ ID NO: 640314 - protein, 9 aa, Homo Sapiens
HRSRYVLEC

SEQ ID NO: 640315 - protein, 9 aa, Homo Sapiens
LSWTFLLYR

SEQ ID NO: 640316 - protein, 9 aa, Homo Sapiens
LNVLTASRP

SEQ ID NO: 640317 - protein, 9 aa, Homo Sapiens
YLLKCSVPL

SEQ ID NO: 640318 - protein, 9 aa, Homo Sapiens
SGYRMIDEL

SEQ ID NO: 640319 - protein, 9 aa, Homo Sapiens
GYRGYNPNL

SEQ ID NO: 640320 - protein, 9 aa, Homo Sapiens
RPQILTRRA

SEQ ID NO: 640321 - protein, 9 aa, Homo Sapiens
LLKAASSFR

SEQ ID NO: 640322 - protein, 9 aa, Homo Sapiens
HLEIRDEVA

SEQ ID NO: 640323 - protein, 9 aa, Homo Sapiens
AASSFRSGK

SEQ ID NO: 640324 - protein, 9 aa, Homo Sapiens
NYYKPHHIQ

SEQ ID NO: 640325 - protein, 9 aa, Homo Sapiens
KVLVDVTYP

SEQ ID NO: 640326 - protein, 9 aa, Homo Sapiens
TAEKLYECE

SEQ ID NO: 640327 - protein, 9 aa, Homo Sapiens
IAVRKRRDK

SEQ ID NO: 640328 - protein, 9 aa, Homo Sapiens
PEHSAVLLT

SEQ ID NO: 640329 - protein, 9 aa, Homo Sapiens
RAVAELHNP

SEQ ID NO: 640330 - protein, 9 aa, Homo Sapiens
GMPGVLGAS

SEQ ID NO: 640331 - protein, 9 aa, Homo Sapiens
VQNHDTFDF

SEQ ID NO: 640332 - protein, 9 aa, Homo Sapiens
LRDIEQLPQ

SEQ ID NO: 640333 - protein, 9 aa, Homo Sapiens
TWEEKLWRT

SEQ ID NO: 640334 - protein, 9 aa, Homo Sapiens
KFKSMPTVT

SEQ ID NO: 640335 - protein, 9 aa, Homo Sapiens
LSKDYALKA

SEQ ID NO: 640336 - protein, 9 aa, Homo Sapiens
GDEIEHPAG

SEQ ID NO: 640337 - protein, 9 aa, Homo Sapiens
GLLAVLWLW

SEQ ID NO: 640338 - protein, 9 aa, Homo Sapiens
YLTAFTREQ

SEQ ID NO: 640339 - protein, 9 aa, Homo Sapiens
NAKQEDMML

SEQ ID NO: 640340 - protein, 9 aa, Homo Sapiens
ISQTAAQVT

SEQ ID NO: 640341 - protein, 9 aa, Homo Sapiens
RFAKQAMRR

SEQ ID NO: 640342 - protein, 9 aa, Homo Sapiens
DWGGAAQLA

SEQ ID NO: 640343 - protein, 9 aa, Homo Sapiens
TDLETGLGP

SEQ ID NO: 640344 - protein, 9 aa, Homo Sapiens
PAPPPSTAR

SEQ ID NO: 640345 - protein, 9 aa, Homo Sapiens
YYTEEANGN

SEQ ID NO: 640346 - protein, 9 aa, Homo Sapiens
NNTGRIKVV

SEQ ID NO: 640347 - protein, 9 aa, Homo Sapiens
LLWGSLFVG

SEQ ID NO: 640348 - protein, 9 aa, Homo Sapiens
HSRLSLIAT

SEQ ID NO: 640349 - protein, 9 aa, Homo Sapiens
QPQRQKVGT

SEQ ID NO: 640350 - protein, 9 aa, Homo Sapiens
NCSSTLRNI

SEQ ID NO: 640351 - protein, 9 aa, Homo Sapiens
SVQQGSMGN

SEQ ID NO: 640352 - protein, 9 aa, Homo Sapiens
RAEYKASGC

SEQ ID NO: 640353 - protein, 9 aa, Homo Sapiens
KTFRQKSSL

SEQ ID NO: 640354 - protein, 9 aa, Homo Sapiens
GSLSSSREN

SEQ ID NO: 640355 - protein, 9 aa, Homo Sapiens
KNAVPQNHF

SEQ ID NO: 640356 - protein, 9 aa, Homo Sapiens
YPFTKNPSL

SEQ ID NO: 640357 - protein, 9 aa, Homo Sapiens
SFLGCMMQF

SEQ ID NO: 640358 - protein, 9 aa, Homo Sapiens
FLGFNFRNN

SEQ ID NO: 640359 - protein, 9 aa, Homo Sapiens
ACYMNSILQ

SEQ ID NO: 640360 - protein, 9 aa, Homo Sapiens
DYPSYNGAI

SEQ ID NO: 640361 - protein, 9 aa, Homo Sapiens
ATSALDTKS

SEQ ID NO: 640362 - protein, 9 aa, Homo Sapiens
SEHPDRNDS

SEQ ID NO: 640363 - protein, 9 aa, Homo Sapiens
YLEDITSPR

SEQ ID NO: 640364 - protein, 9 aa, Homo Sapiens
NHRGTLQDG

SEQ ID NO: 640365 - protein, 9 aa, Homo Sapiens
VGGLVEGAK

SEQ ID NO: 640366 - protein, 9 aa, Homo Sapiens
KGGTLVWLD

SEQ ID NO: 640367 - protein, 9 aa, Homo Sapiens
VDGPAAMAS

SEQ ID NO: 640368 - protein, 9 aa, Homo Sapiens
LSERSEQNQ

SEQ ID NO: 640369 - protein, 9 aa, Homo Sapiens
MSSIEVIIS

SEQ ID NO: 640370 - protein, 9 aa, Homo Sapiens
LETGLGPWN

SEQ ID NO: 640371 - protein, 9 aa, Homo Sapiens
NKIILDPIT

SEQ ID NO: 640372 - protein, 9 aa, Homo Sapiens
EDAQQGTVI

SEQ ID NO: 640373 - protein, 9 aa, Homo Sapiens
ISFLGCMMQ

SEQ ID NO: 640374 - protein, 9 aa, Homo Sapiens
CFIKSSNLS

SEQ ID NO: 640375 - protein, 9 aa, Homo Sapiens
AIETPAEEA

SEQ ID NO: 640376 - protein, 9 aa, Homo Sapiens
AAAQLTHNA

SEQ ID NO: 640377 - protein, 9 aa, Homo Sapiens
LLPKSKSAS

SEQ ID NO: 640378 - protein, 9 aa, Homo Sapiens
MQFYLFCTC

SEQ ID NO: 640379 - protein, 9 aa, Homo Sapiens
SKDYALKAE

SEQ ID NO: 640380 - protein, 9 aa, Homo Sapiens
SSFRSGKNS

SEQ ID NO: 640381 - protein, 9 aa, Homo Sapiens
IRCAFGHGL

SEQ ID NO: 640382 - protein, 9 aa, Homo Sapiens
GYSFMMHSS

SEQ ID NO: 640383 - protein, 9 aa, Homo Sapiens
QPSASQSSL

SEQ ID NO: 640384 - protein, 9 aa, Homo Sapiens
YQDPHFDAE

SEQ ID NO: 640385 - protein, 9 aa, Homo Sapiens
CHGSSVTRS

SEQ ID NO: 640386 - protein, 9 aa, Homo Sapiens
LSDEQGMSK

SEQ ID NO: 640387 - protein, 9 aa, Homo Sapiens
FRILNSQSI

SEQ ID NO: 640388 - protein, 9 aa, Homo Sapiens
TDVYLLDGS

SEQ ID NO: 640389 - protein, 9 aa, Homo Sapiens
RHVKSRHLG

SEQ ID NO: 640390 - protein, 9 aa, Homo Sapiens
LARHAVSCF

SEQ ID NO: 640391 - protein, 9 aa, Homo Sapiens
HPGPPGHLG

SEQ ID NO: 640392 - protein, 9 aa, Homo Sapiens
RLLAEIRTI

SEQ ID NO: 640393 - protein, 9 aa, Homo Sapiens
SPSRDNRYE

SEQ ID NO: 640394 - protein, 9 aa, Homo Sapiens
RDPEHSAVL

SEQ ID NO: 640395 - protein, 9 aa, Homo Sapiens
IVLLGLIGA

SEQ ID NO: 640396 - protein, 9 aa, Homo Sapiens
IFSVAIMGN

SEQ ID NO: 640397 - protein, 9 aa, Homo Sapiens
GGDPSKKDL

SEQ ID NO: 640398 - protein, 9 aa, Homo Sapiens
AGYPRSRTS

SEQ ID NO: 640399 - protein, 9 aa, Homo Sapiens
VVLYHKLEG

SEQ ID NO: 640400 - protein, 9 aa, Homo Sapiens
KKGEMGHPG

SEQ ID NO: 640401 - protein, 9 aa, Homo Sapiens
PQELQASAP

SEQ ID NO: 640402 - protein, 9 aa, Homo Sapiens
CGNTCLEER

SEQ ID NO: 640403 - protein, 9 aa, Homo Sapiens
GCCCLGIMP

SEQ ID NO: 640404 - protein, 9 aa, Homo Sapiens
VLPGHAGGA

SEQ ID NO: 640405 - protein, 9 aa, Homo Sapiens
NHQIMSGST

SEQ ID NO: 640406 - protein, 9 aa, Homo Sapiens
LRSSHPHFV

SEQ ID NO: 640407 - protein, 9 aa, Homo Sapiens
DIPLGLEIH

SEQ ID NO: 640408 - protein, 9 aa, Homo Sapiens
HDTFDFYRK

SEQ ID NO: 640409 - protein, 9 aa, Homo Sapiens
LLLTSMDYD

SEQ ID NO: 640410 - protein, 9 aa, Homo Sapiens
SVFSIAINN

SEQ ID NO: 640411 - protein, 9 aa, Homo Sapiens
QGNQAVVQQ

SEQ ID NO: 640412 - protein, 9 aa, Homo Sapiens
VEPDTGEVW

SEQ ID NO: 640413 - protein, 9 aa, Homo Sapiens
VSYLYESLS

SEQ ID NO: 640414 - protein, 9 aa, Homo Sapiens
EGHSRALWS

SEQ ID NO: 640415 - protein, 9 aa, Homo Sapiens
KYDKCCADY

SEQ ID NO: 640416 - protein, 9 aa, Homo Sapiens
NLFLAPLPC

SEQ ID NO: 640417 - protein, 9 aa, Homo Sapiens
TSTALHRTT

SEQ ID NO: 640418 - protein, 9 aa, Homo Sapiens
HILGSTECF

SEQ ID NO: 640419 - protein, 9 aa, Homo Sapiens
VLPVHPENA

SEQ ID NO: 640420 - protein, 9 aa, Homo Sapiens
DKFHGGWAL

SEQ ID NO: 640421 - protein, 9 aa, Homo Sapiens
YLLPKSKSA

SEQ ID NO: 640422 - protein, 9 aa, Homo Sapiens
THGRENSLI

SEQ ID NO: 640423 - protein, 9 aa, Homo Sapiens
LHPPYVGYM

SEQ ID NO: 640424 - protein, 9 aa, Homo Sapiens
TMYPSQVPE

SEQ ID NO: 640425 - protein, 9 aa, Homo Sapiens
TARELLLKK

SEQ ID NO: 640426 - protein, 9 aa, Homo Sapiens
HRRVEAMPR

SEQ ID NO: 640427 - protein, 9 aa, Homo Sapiens
IRQPQWQLL

SEQ ID NO: 640428 - protein, 9 aa, Homo Sapiens
HISVLMPCF

SEQ ID NO: 640429 - protein, 9 aa, Homo Sapiens
NTGRIKVVF

SEQ ID NO: 640430 - protein, 9 aa, Homo Sapiens
VCVVRDFSA

SEQ ID NO: 640431 - protein, 9 aa, Homo Sapiens
LVLRDMNLS

SEQ ID NO: 640432 - protein, 9 aa, Homo Sapiens
KECILEPSS

SEQ ID NO: 640433 - protein, 9 aa, Homo Sapiens
GASVAAELR

SEQ ID NO: 640434 - protein, 9 aa, Homo Sapiens
PSPTAKSER

SEQ ID NO: 640435 - protein, 9 aa, Homo Sapiens
SRNSCLALN

SEQ ID NO: 640436 - protein, 9 aa, Homo Sapiens
ISQEKEITI

SEQ ID NO: 640437 - protein, 9 aa, Homo Sapiens
IYASVSTLL

SEQ ID NO: 640438 - protein, 9 aa, Homo Sapiens
GDGVSLVLP

SEQ ID NO: 640439 - protein, 9 aa, Homo Sapiens
ILDNPNSLL

SEQ ID NO: 640440 - protein, 9 aa, Homo Sapiens
EFRDQLSCH

SEQ ID NO: 640441 - protein, 9 aa, Homo Sapiens
VCGNTTLSG

SEQ ID NO: 640442 - protein, 9 aa, Homo Sapiens
QASMFDQKS

SEQ ID NO: 640443 - protein, 9 aa, Homo Sapiens
TGAPGKPCQ

SEQ ID NO: 640444 - protein, 9 aa, Homo Sapiens
DSLQKATWL

SEQ ID NO: 640445 - protein, 9 aa, Homo Sapiens
GGGSHHRHQ

SEQ ID NO: 640446 - protein, 9 aa, Homo Sapiens
SKVVNLWSF

SEQ ID NO: 640447 - protein, 9 aa, Homo Sapiens
HTQGQMWKR

SEQ ID NO: 640448 - protein, 9 aa, Homo Sapiens
VKSRHLGQS

SEQ ID NO: 640449 - protein, 9 aa, Homo Sapiens
CRIILVSKR

SEQ ID NO: 640450 - protein, 9 aa, Homo Sapiens
PKVQDSVLL

SEQ ID NO: 640451 - protein, 9 aa, Homo Sapiens
DNGNAPPSE

SEQ ID NO: 640452 - protein, 9 aa, Homo Sapiens
SVWVREQCP

SEQ ID NO: 640453 - protein, 9 aa, Homo Sapiens
PCSLTVSEL

SEQ ID NO: 640454 - protein, 9 aa, Homo Sapiens
TIVMLVLRD

SEQ ID NO: 640455 - protein, 9 aa, Homo Sapiens
PPSLGSVWK

SEQ ID NO: 640456 - protein, 9 aa, Homo Sapiens
LTSVVRIFL

SEQ ID NO: 640457 - protein, 9 aa, Homo Sapiens
CRGNLQGST

SEQ ID NO: 640458 - protein, 9 aa, Homo Sapiens
RITWLDPAG

SEQ ID NO: 640459 - protein, 9 aa, Homo Sapiens
LSQSGAGST

SEQ ID NO: 640460 - protein, 9 aa, Homo Sapiens
NGEEAKKFR

SEQ ID NO: 640461 - protein, 9 aa, Homo Sapiens
RRAAQRALS

SEQ ID NO: 640462 - protein, 9 aa, Homo Sapiens
RRTKAFSSA

SEQ ID NO: 640463 - protein, 9 aa, Homo Sapiens
NIYQLLNSG

SEQ ID NO: 640464 - protein, 9 aa, Homo Sapiens
SNLGIIGHA

SEQ ID NO: 640465 - protein, 9 aa, Homo Sapiens
TNLPERPSS

SEQ ID NO: 640466 - protein, 9 aa, Homo Sapiens
NLNKSVTPA

SEQ ID NO: 640467 - protein, 9 aa, Homo Sapiens
RYEFSDCEK

SEQ ID NO: 640468 - protein, 9 aa, Homo Sapiens
LFFQFLVIY

SEQ ID NO: 640469 - protein, 9 aa, Homo Sapiens
TEKAGSSGQ

SEQ ID NO: 640470 - protein, 9 aa, Homo Sapiens
LTRLHENNW

SEQ ID NO: 640471 - protein, 9 aa, Homo Sapiens
PEWELDLPV

SEQ ID NO: 640472 - protein, 9 aa, Homo Sapiens
MRVTHGREN

SEQ ID NO: 640473 - protein, 9 aa, Homo Sapiens
NSISQTAAQ

SEQ ID NO: 640474 - protein, 9 aa, Homo Sapiens
NFVQVTRFG

SEQ ID NO: 640475 - protein, 9 aa, Homo Sapiens
SNAELCECL

SEQ ID NO: 640476 - protein, 9 aa, Homo Sapiens
EVWLRQPLD

SEQ ID NO: 640477 - protein, 9 aa, Homo Sapiens
KRCDSETER

SEQ ID NO: 640478 - protein, 9 aa, Homo Sapiens
DLKVRTIRM

SEQ ID NO: 640479 - protein, 9 aa, Homo Sapiens
VNSISQTAA

SEQ ID NO: 640480 - protein, 9 aa, Homo Sapiens
PERPSSVLT

SEQ ID NO: 640481 - protein, 9 aa, Homo Sapiens
EELCQLGFW

SEQ ID NO: 640482 - protein, 9 aa, Homo Sapiens
STKNKAGKE

SEQ ID NO: 640483 - protein, 9 aa, Homo Sapiens
LWHISVLMP

SEQ ID NO: 640484 - protein, 9 aa, Homo Sapiens
APNWARYPY

SEQ ID NO: 640485 - protein, 9 aa, Homo Sapiens
TYLLAQDRS

SEQ ID NO: 640486 - protein, 9 aa, Homo Sapiens
KELANYYKP

SEQ ID NO: 640487 - protein, 9 aa, Homo Sapiens
VCLSLHYMA

SEQ ID NO: 640488 - protein, 9 aa, Homo Sapiens
QHGETLRNV

SEQ ID NO: 640489 - protein, 9 aa, Homo Sapiens
NDLLGHHKT

SEQ ID NO: 640490 - protein, 9 aa, Homo Sapiens
GSTALPTVV

SEQ ID NO: 640491 - protein, 9 aa, Homo Sapiens
RFLVTATGI

SEQ ID NO: 640492 - protein, 9 aa, Homo Sapiens
PEILYSALP

SEQ ID NO: 640493 - protein, 9 aa, Homo Sapiens
MNGVASCCR

SEQ ID NO: 640494 - protein, 9 aa, Homo Sapiens
NKTLTDNGN

SEQ ID NO: 640495 - protein, 9 aa, Homo Sapiens
GTLVVIVNA

SEQ ID NO: 640496 - protein, 9 aa, Homo Sapiens
FPCPSRGCP

SEQ ID NO: 640497 - protein, 9 aa, Homo Sapiens
VTPLLNTVI

SEQ ID NO: 640498 - protein, 9 aa, Homo Sapiens
SASSETPTS

SEQ ID NO: 640499 - protein, 9 aa, Homo Sapiens
LKECILEPS

SEQ ID NO: 640500 - protein, 9 aa, Homo Sapiens
EVISHTEFE

SEQ ID NO: 640501 - protein, 9 aa, Homo Sapiens
LRWSAGLFF

SEQ ID NO: 640502 - protein, 9 aa, Homo Sapiens
WGGFTYQDV

SEQ ID NO: 640503 - protein, 9 aa, Homo Sapiens
KGKQYLLGD

SEQ ID NO: 640504 - protein, 9 aa, Homo Sapiens
TDIHVADRR

SEQ ID NO: 640505 - protein, 9 aa, Homo Sapiens
KLTSEEVIK

SEQ ID NO: 640506 - protein, 9 aa, Homo Sapiens
LPQLKESEH

SEQ ID NO: 640507 - protein, 9 aa, Homo Sapiens
SILKRRGCG

SEQ ID NO: 640508 - protein, 9 aa, Homo Sapiens
CVLPQLKES

SEQ ID NO: 640509 - protein, 9 aa, Homo Sapiens
ECLHACSSL

SEQ ID NO: 640510 - protein, 9 aa, Homo Sapiens
VFLLLSSER

SEQ ID NO: 640511 - protein, 9 aa, Homo Sapiens
LAIFSVAIM

SEQ ID NO: 640512 - protein, 9 aa, Homo Sapiens
SPNGEPCGN

SEQ ID NO: 640513 - protein, 9 aa, Homo Sapiens
PQDSPGARG

SEQ ID NO: 640514 - protein, 9 aa, Homo Sapiens
ERERPTASM

SEQ ID NO: 640515 - protein, 9 aa, Homo Sapiens
WHRAEKGIN

SEQ ID NO: 640516 - protein, 9 aa, Homo Sapiens
AWAQGRAGA

SEQ ID NO: 640517 - protein, 9 aa, Homo Sapiens
KEMAAIEER

SEQ ID NO: 640518 - protein, 9 aa, Homo Sapiens
AAASVTLLS

SEQ ID NO: 640519 - protein, 9 aa, Homo Sapiens
AAQRALSHF

SEQ ID NO: 640520 - protein, 9 aa, Homo Sapiens
LKAEELQAT

SEQ ID NO: 640521 - protein, 9 aa, Homo Sapiens
FYFVFFFPF

SEQ ID NO: 640522 - protein, 9 aa, Homo Sapiens
KVNTAPCPL

SEQ ID NO: 640523 - protein, 9 aa, Homo Sapiens
KKPEMLDML

SEQ ID NO: 640524 - protein, 9 aa, Homo Sapiens
ESLVPLLLL

SEQ ID NO: 640525 - protein, 9 aa, Homo Sapiens
QATHSVACL

SEQ ID NO: 640526 - protein, 9 aa, Homo Sapiens
MALHCCDEV

SEQ ID NO: 640527 - protein, 9 aa, Homo Sapiens
LQLTLGNLK

SEQ ID NO: 640528 - protein, 9 aa, Homo Sapiens
NGVASCCRP

SEQ ID NO: 640529 - protein, 9 aa, Homo Sapiens
KQYLLGDFY

SEQ ID NO: 640530 - protein, 9 aa, Homo Sapiens
DAKLTSEEV

SEQ ID NO: 640531 - protein, 9 aa, Homo Sapiens
ISVQQGSMG

SEQ ID NO: 640532 - protein, 9 aa, Homo Sapiens
CSARVASSA

SEQ ID NO: 640533 - protein, 9 aa, Homo Sapiens
EPLISAASP

SEQ ID NO: 640534 - protein, 9 aa, Homo Sapiens
KRRDKAKRR

SEQ ID NO: 640535 - protein, 9 aa, Homo Sapiens
GSVEPEWEL

SEQ ID NO: 640536 - protein, 9 aa, Homo Sapiens
AQVLWQHAG

SEQ ID NO: 640537 - protein, 9 aa, Homo Sapiens
HMLPFYGCA

SEQ ID NO: 640538 - protein, 9 aa, Homo Sapiens
PSGYRMIDE

SEQ ID NO: 640539 - protein, 9 aa, Homo Sapiens
EFEDFLKEM

SEQ ID NO: 640540 - protein, 9 aa, Homo Sapiens
PPRRPIPAT

SEQ ID NO: 640541 - protein, 9 aa, Homo Sapiens
IATPPSLGS

SEQ ID NO: 640542 - protein, 9 aa, Homo Sapiens
RACVPGPHG

SEQ ID NO: 640543 - protein, 9 aa, Homo Sapiens
SFRSGKNSS

SEQ ID NO: 640544 - protein, 9 aa, Homo Sapiens
RRTTSILKR

SEQ ID NO: 640545 - protein, 9 aa, Homo Sapiens
DLKLGSVEE

SEQ ID NO: 640546 - protein, 9 aa, Homo Sapiens
LQRRSLPVF

SEQ ID NO: 640547 - protein, 9 aa, Homo Sapiens
TALLNYSYV

SEQ ID NO: 640548 - protein, 9 aa, Homo Sapiens
KPKCPESYA

SEQ ID NO: 640549 - protein, 9 aa, Homo Sapiens
GCKWKMRSD

SEQ ID NO: 640550 - protein, 9 aa, Homo Sapiens
ASIIYLLPK

SEQ ID NO: 640551 - protein, 9 aa, Homo Sapiens
LLEALVYSD

SEQ ID NO: 640552 - protein, 9 aa, Homo Sapiens
FYRKNLKSS

SEQ ID NO: 640553 - protein, 9 aa, Homo Sapiens
PEPTALDQV

SEQ ID NO: 640554 - protein, 9 aa, Homo Sapiens
AKLTSEEVI

SEQ ID NO: 640555 - protein, 9 aa, Homo Sapiens
FAIILLKTD

SEQ ID NO: 640556 - protein, 9 aa, Homo Sapiens
NVLRNGNIS

SEQ ID NO: 640557 - protein, 9 aa, Homo Sapiens
PPFPQGNQA

SEQ ID NO: 640558 - protein, 9 aa, Homo Sapiens
DYLGRVRLQ

SEQ ID NO: 640559 - protein, 9 aa, Homo Sapiens
VLRWSAGLF

SEQ ID NO: 640560 - protein, 9 aa, Homo Sapiens
PAAEFSCLE

SEQ ID NO: 640561 - protein, 9 aa, Homo Sapiens
ITDTTFGQN

SEQ ID NO: 640562 - protein, 9 aa, Homo Sapiens
MASFPETVP

SEQ ID NO: 640563 - protein, 9 aa, Homo Sapiens
KMRSDTDVL

SEQ ID NO: 640564 - protein, 9 aa, Homo Sapiens
ILLYWAANV

SEQ ID NO: 640565 - protein, 9 aa, Homo Sapiens
GIVDGPAAM

SEQ ID NO: 640566 - protein, 9 aa, Homo Sapiens
EGRQKVFST

SEQ ID NO: 640567 - protein, 9 aa, Homo Sapiens
RERRTEEEN

SEQ ID NO: 640568 - protein, 9 aa, Homo Sapiens
KQICKEFTY

SEQ ID NO: 640569 - protein, 9 aa, Homo Sapiens
QSGAGSTCQ

SEQ ID NO: 640570 - protein, 9 aa, Homo Sapiens
ERSEQNQRS

SEQ ID NO: 640571 - protein, 9 aa, Homo Sapiens
KFIPCEKRC

SEQ ID NO: 640572 - protein, 9 aa, Homo Sapiens
RPCSLTVSE

SEQ ID NO: 640573 - protein, 9 aa, Homo Sapiens
SSMGFRILN

SEQ ID NO: 640574 - protein, 9 aa, Homo Sapiens
IVDGPAAMA

SEQ ID NO: 640575 - protein, 9 aa, Homo Sapiens
FEQKKEPWM

SEQ ID NO: 640576 - protein, 9 aa, Homo Sapiens
GHKGEGFGP

SEQ ID NO: 640577 - protein, 9 aa, Homo Sapiens
AQCFTCMEQ

SEQ ID NO: 640578 - protein, 9 aa, Homo Sapiens
HACSSLYDP

SEQ ID NO: 640579 - protein, 9 aa, Homo Sapiens
STALPTVVL

SEQ ID NO: 640580 - protein, 9 aa, Homo Sapiens
DMTVRRKVS

SEQ ID NO: 640581 - protein, 9 aa, Homo Sapiens
NHDTFDFYR

SEQ ID NO: 640582 - protein, 9 aa, Homo Sapiens
CLDDRDQEA

SEQ ID NO: 640583 - protein, 9 aa, Homo Sapiens
LAVVHAVYD

SEQ ID NO: 640584 - protein, 9 aa, Homo Sapiens
FPIGMVDSS

SEQ ID NO: 640585 - protein, 9 aa, Homo Sapiens
NSQEEEILA

SEQ ID NO: 640586 - protein, 9 aa, Homo Sapiens
QDYYTEEAN

SEQ ID NO: 640587 - protein, 9 aa, Homo Sapiens
LLKCSVPLG

SEQ ID NO: 640588 - protein, 9 aa, Homo Sapiens
SLALSFRFG

SEQ ID NO: 640589 - protein, 9 aa, Homo Sapiens
PPPACQSQD

SEQ ID NO: 640590 - protein, 9 aa, Homo Sapiens
SSPAARAPG

SEQ ID NO: 640591 - protein, 9 aa, Homo Sapiens
ESYATQQRP

SEQ ID NO: 640592 - protein, 9 aa, Homo Sapiens
KAFSSAHPS

SEQ ID NO: 640593 - protein, 9 aa, Homo Sapiens
IILLKTDMY

SEQ ID NO: 640594 - protein, 9 aa, Homo Sapiens
AFRSSKFPT

SEQ ID NO: 640595 - protein, 9 aa, Homo Sapiens
APGREGRDL

SEQ ID NO: 640596 - protein, 9 aa, Homo Sapiens
TSIHEWIQM

SEQ ID NO: 640597 - protein, 9 aa, Homo Sapiens
LFLGFNFRN

SEQ ID NO: 640598 - protein, 9 aa, Homo Sapiens
GYQDYYTEE

SEQ ID NO: 640599 - protein, 9 aa, Homo Sapiens
SCLGPSCDR

SEQ ID NO: 640600 - protein, 9 aa, Homo Sapiens
LYPECTEAQ

SEQ ID NO: 640601 - protein, 9 aa, Homo Sapiens
CHMLPFYGC

SEQ ID NO: 640602 - protein, 9 aa, Homo Sapiens
TVDVMGNLR

SEQ ID NO: 640603 - protein, 9 aa, Homo Sapiens
FLVAPLACA

SEQ ID NO: 640604 - protein, 9 aa, Homo Sapiens
TVSELETVI

SEQ ID NO: 640605 - protein, 9 aa, Homo Sapiens
EQLCVNVSG

SEQ ID NO: 640606 - protein, 9 aa, Homo Sapiens
TLRGAILQD

SEQ ID NO: 640607 - protein, 9 aa, Homo Sapiens
MTSSQVCCN

SEQ ID NO: 640608 - protein, 9 aa, Homo Sapiens
PSEDSEVEA

SEQ ID NO: 640609 - protein, 9 aa, Homo Sapiens
FALLGAIAV

SEQ ID NO: 640610 - protein, 9 aa, Homo Sapiens
RRQQLRRTR

SEQ ID NO: 640611 - protein, 9 aa, Homo Sapiens
PHASECSGQ

SEQ ID NO: 640612 - protein, 9 aa, Homo Sapiens
MFHYGVPIP

SEQ ID NO: 640613 - protein, 9 aa, Homo Sapiens
DSTPPPGPM

SEQ ID NO: 640614 - protein, 9 aa, Homo Sapiens
EAPMAWLSR

SEQ ID NO: 640615 - protein, 9 aa, Homo Sapiens
TRNDLGDKY

SEQ ID NO: 640616 - protein, 9 aa, Homo Sapiens
NASCGQAGG

SEQ ID NO: 640617 - protein, 9 aa, Homo Sapiens
PITFSEARF

SEQ ID NO: 640618 - protein, 9 aa, Homo Sapiens
RATEAYYRA

SEQ ID NO: 640619 - protein, 9 aa, Homo Sapiens
WYRLTHNDI

SEQ ID NO: 640620 - protein, 9 aa, Homo Sapiens
SGSLSIASE

SEQ ID NO: 640621 - protein, 9 aa, Homo Sapiens
WGSLFVGGL

SEQ ID NO: 640622 - protein, 9 aa, Homo Sapiens
LQPTRNDLG

SEQ ID NO: 640623 - protein, 9 aa, Homo Sapiens
FPVTDASSA

SEQ ID NO: 640624 - protein, 9 aa, Homo Sapiens
RCSVMIRET

SEQ ID NO: 640625 - protein, 9 aa, Homo Sapiens
APMAWLSRF

SEQ ID NO: 640626 - protein, 9 aa, Homo Sapiens
QQGFFPIKN

SEQ ID NO: 640627 - protein, 9 aa, Homo Sapiens
RGLSQHQQK

SEQ ID NO: 640628 - protein, 9 aa, Homo Sapiens
VMDHVFLLL

SEQ ID NO: 640629 - protein, 9 aa, Homo Sapiens
CLHACSSLY

SEQ ID NO: 640630 - protein, 9 aa, Homo Sapiens
IYWFLQIIA

SEQ ID NO: 640631 - protein, 9 aa, Homo Sapiens
TCRRPSGTG

SEQ ID NO: 640632 - protein, 9 aa, Homo Sapiens
HDKLFPLLL

SEQ ID NO: 640633 - protein, 9 aa, Homo Sapiens
LKRCLCGVL

SEQ ID NO: 640634 - protein, 9 aa, Homo Sapiens
DEGTLELTL

SEQ ID NO: 640635 - protein, 9 aa, Homo Sapiens
ASCGQAGGP

SEQ ID NO: 640636 - protein, 9 aa, Homo Sapiens
NGNISMKDP

SEQ ID NO: 640637 - protein, 9 aa, Homo Sapiens
LAQGPGGAV

SEQ ID NO: 640638 - protein, 9 aa, Homo Sapiens
IEQLPQQPT

SEQ ID NO: 640639 - protein, 9 aa, Homo Sapiens
PICAICCVP

SEQ ID NO: 640640 - protein, 9 aa, Homo Sapiens
PSRGCPQMG

SEQ ID NO: 640641 - protein, 9 aa, Homo Sapiens
TQLLMKAKE

SEQ ID NO: 640642 - protein, 9 aa, Homo Sapiens
SMDYDRYLA

SEQ ID NO: 640643 - protein, 9 aa, Homo Sapiens
THNANPLDA

SEQ ID NO: 640644 - protein, 9 aa, Homo Sapiens
SVAVLRQKR

SEQ ID NO: 640645 - protein, 9 aa, Homo Sapiens
GPPRRPIPA

SEQ ID NO: 640646 - protein, 9 aa, Homo Sapiens
VDTQHGETL

SEQ ID NO: 640647 - protein, 9 aa, Homo Sapiens
GRQIGAAAH

SEQ ID NO: 640648 - protein, 9 aa, Homo Sapiens
FKAEIRQPC

SEQ ID NO: 640649 - protein, 9 aa, Homo Sapiens
LIIFTLKSD

SEQ ID NO: 640650 - protein, 9 aa, Homo Sapiens
PREDMRGQW

SEQ ID NO: 640651 - protein, 9 aa, Homo Sapiens
ANYRYGPPV

SEQ ID NO: 640652 - protein, 9 aa, Homo Sapiens
LPTDCAWEA

SEQ ID NO: 640653 - protein, 9 aa, Homo Sapiens
VRTLFIELL

SEQ ID NO: 640654 - protein, 9 aa, Homo Sapiens
KWTSIHEWI

SEQ ID NO: 640655 - protein, 9 aa, Homo Sapiens
GGVSWACSA

SEQ ID NO: 640656 - protein, 9 aa, Homo Sapiens
DSDLDGDSG

SEQ ID NO: 640657 - protein, 9 aa, Homo Sapiens
LGIMPMRSR

SEQ ID NO: 640658 - protein, 9 aa, Homo Sapiens
KTDMYSPNI

SEQ ID NO: 640659 - protein, 9 aa, Homo Sapiens
KTLTDNGNA

SEQ ID NO: 640660 - protein, 9 aa, Homo Sapiens
HRGLQSIQE

SEQ ID NO: 640661 - protein, 9 aa, Homo Sapiens
SLKTKQIRK

SEQ ID NO: 640662 - protein, 9 aa, Homo Sapiens
LDTEGSKQP

SEQ ID NO: 640663 - protein, 9 aa, Homo Sapiens
EYRHIDSAY

SEQ ID NO: 640664 - protein, 9 aa, Homo Sapiens
CFRPSSPAA

SEQ ID NO: 640665 - protein, 9 aa, Homo Sapiens
IEHPAGDEY

SEQ ID NO: 640666 - protein, 9 aa, Homo Sapiens
ISNQWNMGK

SEQ ID NO: 640667 - protein, 9 aa, Homo Sapiens
LGNHRGTLQ

SEQ ID NO: 640668 - protein, 9 aa, Homo Sapiens
LDLAKHRTK

SEQ ID NO: 640669 - protein, 9 aa, Homo Sapiens
RTPESFAQA

SEQ ID NO: 640670 - protein, 9 aa, Homo Sapiens
SKGGADRAF

SEQ ID NO: 640671 - protein, 9 aa, Homo Sapiens
QECAKGPLP

SEQ ID NO: 640672 - protein, 9 aa, Homo Sapiens
TEEANGNTG

SEQ ID NO: 640673 - protein, 9 aa, Homo Sapiens
HIQACTTTP

SEQ ID NO: 640674 - protein, 9 aa, Homo Sapiens
GRLFLSQSG

SEQ ID NO: 640675 - protein, 9 aa, Homo Sapiens
NLNAGIINS

SEQ ID NO: 640676 - protein, 9 aa, Homo Sapiens
AYTFIPLNS

SEQ ID NO: 640677 - protein, 9 aa, Homo Sapiens
NDMTVRRKV

SEQ ID NO: 640678 - protein, 9 aa, Homo Sapiens
GLPAHAYAQ

SEQ ID NO: 640679 - protein, 9 aa, Homo Sapiens
TWSPLVKPP

SEQ ID NO: 640680 - protein, 9 aa, Homo Sapiens
GGSHDGAGG

SEQ ID NO: 640681 - protein, 9 aa, Homo Sapiens
SVDNEHSGQ

SEQ ID NO: 640682 - protein, 9 aa, Homo Sapiens
EQDLEPLFQ

SEQ ID NO: 640683 - protein, 9 aa, Homo Sapiens
AGASVAAEL

SEQ ID NO: 640684 - protein, 9 aa, Homo Sapiens
WKPQRKFGQ

SEQ ID NO: 640685 - protein, 9 aa, Homo Sapiens
SFSIYVPDR

SEQ ID NO: 640686 - protein, 9 aa, Homo Sapiens
SNIYQLLNS

SEQ ID NO: 640687 - protein, 9 aa, Homo Sapiens
GSVFSIAIN

SEQ ID NO: 640688 - protein, 9 aa, Homo Sapiens
NGERPFKCN

SEQ ID NO: 640689 - protein, 9 aa, Homo Sapiens
GRRTTSILK

SEQ ID NO: 640690 - protein, 9 aa, Homo Sapiens
CEQWTPIEP

SEQ ID NO: 640691 - protein, 9 aa, Homo Sapiens
ILNSQSISH

SEQ ID NO: 640692 - protein, 9 aa, Homo Sapiens
AISSSFAAG

SEQ ID NO: 640693 - protein, 9 aa, Homo Sapiens
GNQAVVQQK

SEQ ID NO: 640694 - protein, 9 aa, Homo Sapiens
MVQHDSVPM

SEQ ID NO: 640695 - protein, 9 aa, Homo Sapiens
TFGSYICKS

SEQ ID NO: 640696 - protein, 9 aa, Homo Sapiens
IGYSFMMHS

SEQ ID NO: 640697 - protein, 9 aa, Homo Sapiens
FQFLVIYIV

SEQ ID NO: 640698 - protein, 9 aa, Homo Sapiens
ILWPKIADC

SEQ ID NO: 640699 - protein, 9 aa, Homo Sapiens
KNRTFTVTI

SEQ ID NO: 640700 - protein, 9 aa, Homo Sapiens
TLTDNGNAP

SEQ ID NO: 640701 - protein, 9 aa, Homo Sapiens
MRRKVELEW

SEQ ID NO: 640702 - protein, 9 aa, Homo Sapiens
FRKINTWKV

SEQ ID NO: 640703 - protein, 9 aa, Homo Sapiens
DSRSHGPVR

SEQ ID NO: 640704 - protein, 9 aa, Homo Sapiens
PQNDLLGHH

SEQ ID NO: 640705 - protein, 9 aa, Homo Sapiens
YLGRVRLQK

SEQ ID NO: 640706 - protein, 9 aa, Homo Sapiens
EGYQDYYTE

SEQ ID NO: 640707 - protein, 9 aa, Homo Sapiens
NWTTKISND

SEQ ID NO: 640708 - protein, 9 aa, Homo Sapiens
HPPVGTKSN

SEQ ID NO: 640709 - protein, 9 aa, Homo Sapiens
LPTVVLEIP

SEQ ID NO: 640710 - protein, 9 aa, Homo Sapiens
FFFPFPIFG

SEQ ID NO: 640711 - protein, 9 aa, Homo Sapiens
EERLSLCRG

SEQ ID NO: 640712 - protein, 9 aa, Homo Sapiens
GRERRTEEE

SEQ ID NO: 640713 - protein, 9 aa, Homo Sapiens
STTSRDIKE

SEQ ID NO: 640714 - protein, 9 aa, Homo Sapiens
FLLAILGGI

SEQ ID NO: 640715 - protein, 9 aa, Homo Sapiens
TSLPQSLPR

SEQ ID NO: 640716 - protein, 9 aa, Homo Sapiens
HPDRNDSVA

SEQ ID NO: 640717 - protein, 9 aa, Homo Sapiens
FLSHRSRYV

SEQ ID NO: 640718 - protein, 9 aa, Homo Sapiens
CQAFTSAYT

SEQ ID NO: 640719 - protein, 9 aa, Homo Sapiens
DLREPVPNC

SEQ ID NO: 640720 - protein, 9 aa, Homo Sapiens
RQQLRRTRC

SEQ ID NO: 640721 - protein, 9 aa, Homo Sapiens
TVMTQTMPV

SEQ ID NO: 640722 - protein, 9 aa, Homo Sapiens
PPPIAMITL

SEQ ID NO: 640723 - protein, 9 aa, Homo Sapiens
GRKIASFIA

SEQ ID NO: 640724 - protein, 9 aa, Homo Sapiens
PNGFKAEIR

SEQ ID NO: 640725 - protein, 9 aa, Homo Sapiens
ATGEAWQET

SEQ ID NO: 640726 - protein, 9 aa, Homo Sapiens
GSDYPSYNG

SEQ ID NO: 640727 - protein, 9 aa, Homo Sapiens
LEIRDEVAE

SEQ ID NO: 640728 - protein, 9 aa, Homo Sapiens
SNFVQVTRF

SEQ ID NO: 640729 - protein, 9 aa, Homo Sapiens
LLYFEPKDI

SEQ ID NO: 640730 - protein, 9 aa, Homo Sapiens
VEQKTGVIK

SEQ ID NO: 640731 - protein, 9 aa, Homo Sapiens
TQDEGTLEL

SEQ ID NO: 640732 - protein, 9 aa, Homo Sapiens
LEAFLRATE

SEQ ID NO: 640733 - protein, 9 aa, Homo Sapiens
PDGRREQPQ

SEQ ID NO: 640734 - protein, 9 aa, Homo Sapiens
ASLAFGTPV

SEQ ID NO: 640735 - protein, 9 aa, Homo Sapiens
ANFIVKHMR

SEQ ID NO: 640736 - protein, 9 aa, Homo Sapiens
RYSRPGRTG

SEQ ID NO: 640737 - protein, 9 aa, Homo Sapiens
KASRGCVSW

SEQ ID NO: 640738 - protein, 9 aa, Homo Sapiens
IRSLAFFCA

SEQ ID NO: 640739 - protein, 9 aa, Homo Sapiens
SRQDAADAW

SEQ ID NO: 640740 - protein, 9 aa, Homo Sapiens
HLVISDIKK

SEQ ID NO: 640741 - protein, 9 aa, Homo Sapiens
STALHRTTP

SEQ ID NO: 640742 - protein, 9 aa, Homo Sapiens
KAETQTEEL

SEQ ID NO: 640743 - protein, 9 aa, Homo Sapiens
PSAACLDMQ

SEQ ID NO: 640744 - protein, 9 aa, Homo Sapiens
FGGRLRRPV

SEQ ID NO: 640745 - protein, 9 aa, Homo Sapiens
DSAYFYENQ

SEQ ID NO: 640746 - protein, 9 aa, Homo Sapiens
PNGEPCGNT

SEQ ID NO: 640747 - protein, 9 aa, Homo Sapiens
YKKQNDIEE

SEQ ID NO: 640748 - protein, 9 aa, Homo Sapiens
IRIIDWYRL

SEQ ID NO: 640749 - protein, 9 aa, Homo Sapiens
YFFHILGST

SEQ ID NO: 640750 - protein, 9 aa, Homo Sapiens
TSSHCPTDV

SEQ ID NO: 640751 - protein, 9 aa, Homo Sapiens
NGEKPYKCM

SEQ ID NO: 640752 - protein, 9 aa, Homo Sapiens
RKHGREEGS

SEQ ID NO: 640753 - protein, 9 aa, Homo Sapiens
GTSSHCPTD

SEQ ID NO: 640754 - protein, 9 aa, Homo Sapiens
TVVLMLNSQ

SEQ ID NO: 640755 - protein, 9 aa, Homo Sapiens
QLCVLPQLK

SEQ ID NO: 640756 - protein, 9 aa, Homo Sapiens
SCNHQIMSG

SEQ ID NO: 640757 - protein, 9 aa, Homo Sapiens
VMGNLRVTK

SEQ ID NO: 640758 - protein, 9 aa, Homo Sapiens
PLSYTDCAP

SEQ ID NO: 640759 - protein, 9 aa, Homo Sapiens
PHASETFPP

SEQ ID NO: 640760 - protein, 9 aa, Homo Sapiens
HLARHAVSC

SEQ ID NO: 640761 - protein, 9 aa, Homo Sapiens
VVVDFKKEA

SEQ ID NO: 640762 - protein, 9 aa, Homo Sapiens
ASTGDTTPF

SEQ ID NO: 640763 - protein, 9 aa, Homo Sapiens
LTYIYASVS

SEQ ID NO: 640764 - protein, 9 aa, Homo Sapiens
KMNPSKNNS

SEQ ID NO: 640765 - protein, 9 aa, Homo Sapiens
AKQAMRRKV

SEQ ID NO: 640766 - protein, 9 aa, Homo Sapiens
LWPKIADCT

SEQ ID NO: 640767 - protein, 9 aa, Homo Sapiens
QLGFWWLIE

SEQ ID NO: 640768 - protein, 9 aa, Homo Sapiens
YRLTAVLGL

SEQ ID NO: 640769 - protein, 9 aa, Homo Sapiens
VDQPQVSFK

SEQ ID NO: 640770 - protein, 9 aa, Homo Sapiens
QLRREQEEL

SEQ ID NO: 640771 - protein, 9 aa, Homo Sapiens
SAPLPESTV

SEQ ID NO: 640772 - protein, 9 aa, Homo Sapiens
QHEATPWAR

SEQ ID NO: 640773 - protein, 9 aa, Homo Sapiens
FLQIIAVVL

SEQ ID NO: 640774 - protein, 9 aa, Homo Sapiens
GAVGNRHAV

SEQ ID NO: 640775 - protein, 9 aa, Homo Sapiens
PGAVLPIPV

SEQ ID NO: 640776 - protein, 9 aa, Homo Sapiens
LRSPVEMDE

SEQ ID NO: 640777 - protein, 9 aa, Homo Sapiens
ANTDIHVAD

SEQ ID NO: 640778 - protein, 9 aa, Homo Sapiens
TQGWRTSLP

SEQ ID NO: 640779 - protein, 9 aa, Homo Sapiens
CYQQYTNLP

SEQ ID NO: 640780 - protein, 9 aa, Homo Sapiens
LREPVPNCA

SEQ ID NO: 640781 - protein, 9 aa, Homo Sapiens
LHEAQPWFE

SEQ ID NO: 640782 - protein, 9 aa, Homo Sapiens
EDSRSHGPV

SEQ ID NO: 640783 - protein, 9 aa, Homo Sapiens
STALATYCM

SEQ ID NO: 640784 - protein, 9 aa, Homo Sapiens
YATQQRPAF

SEQ ID NO: 640785 - protein, 9 aa, Homo Sapiens
NPVPQHYLW

SEQ ID NO: 640786 - protein, 9 aa, Homo Sapiens
NTLNESRDP

SEQ ID NO: 640787 - protein, 9 aa, Homo Sapiens
DRCAAVCRP

SEQ ID NO: 640788 - protein, 9 aa, Homo Sapiens
LDPITFSEA

SEQ ID NO: 640789 - protein, 9 aa, Homo Sapiens
NGNAHGNPE

SEQ ID NO: 640790 - protein, 9 aa, Homo Sapiens
LNSQEEEIL

SEQ ID NO: 640791 - protein, 9 aa, Homo Sapiens
ICAICCVPG

SEQ ID NO: 640792 - protein, 9 aa, Homo Sapiens
ENNGAALLT

SEQ ID NO: 640793 - protein, 9 aa, Homo Sapiens
EQGMSKNRL

SEQ ID NO: 640794 - protein, 9 aa, Homo Sapiens
SLKLTNLEL

SEQ ID NO: 640795 - protein, 9 aa, Homo Sapiens
VFAIQETKG

SEQ ID NO: 640796 - protein, 9 aa, Homo Sapiens
NAMKRNKHI

SEQ ID NO: 640797 - protein, 9 aa, Homo Sapiens
TTLRGAILQ

SEQ ID NO: 640798 - protein, 9 aa, Homo Sapiens
PANYRYGPP

SEQ ID NO: 640799 - protein, 9 aa, Homo Sapiens
QASFTQSHL

SEQ ID NO: 640800 - protein, 9 aa, Homo Sapiens
QSPTEKAGS

SEQ ID NO: 640801 - protein, 9 aa, Homo Sapiens
CAICCVPGP

SEQ ID NO: 640802 - protein, 9 aa, Homo Sapiens
SPEGKPKTR

SEQ ID NO: 640803 - protein, 9 aa, Homo Sapiens
TVIYSLRNK

SEQ ID NO: 640804 - protein, 9 aa, Homo Sapiens
AYLLKCHML

SEQ ID NO: 640805 - protein, 9 aa, Homo Sapiens
LVPLLLLRY

SEQ ID NO: 640806 - protein, 9 aa, Homo Sapiens
IFLRDIEQL

SEQ ID NO: 640807 - protein, 9 aa, Homo Sapiens
VSVLRGSGG

SEQ ID NO: 640808 - protein, 9 aa, Homo Sapiens
QTPIKMGNN

SEQ ID NO: 640809 - protein, 9 aa, Homo Sapiens
GSHDGAGGS

SEQ ID NO: 640810 - protein, 9 aa, Homo Sapiens
HLPELQLVE

SEQ ID NO: 640811 - protein, 9 aa, Homo Sapiens
SLEDPQTYS

SEQ ID NO: 640812 - protein, 9 aa, Homo Sapiens
SGGSHDGAG

SEQ ID NO: 640813 - protein, 9 aa, Homo Sapiens
RHILYCKCS

SEQ ID NO: 640814 - protein, 9 aa, Homo Sapiens
RSSHPHFVR

SEQ ID NO: 640815 - protein, 9 aa, Homo Sapiens
AILGGIAFI

SEQ ID NO: 640816 - protein, 9 aa, Homo Sapiens
DSKLKNAVP

SEQ ID NO: 640817 - protein, 9 aa, Homo Sapiens
IAQCFTCME

SEQ ID NO: 640818 - protein, 9 aa, Homo Sapiens
SIFVKRSQQ

SEQ ID NO: 640819 - protein, 9 aa, Homo Sapiens
PVAEAVPEA

SEQ ID NO: 640820 - protein, 9 aa, Homo Sapiens
AKKPIVGLG

SEQ ID NO: 640821 - protein, 9 aa, Homo Sapiens
VLTASRPPS

SEQ ID NO: 640822 - protein, 9 aa, Homo Sapiens
SEIPAANSF

SEQ ID NO: 640823 - protein, 9 aa, Homo Sapiens
FHILGSTEC

SEQ ID NO: 640824 - protein, 9 aa, Homo Sapiens
NTAPCPLPL

SEQ ID NO: 640825 - protein, 9 aa, Homo Sapiens
WRRFLDNKL

SEQ ID NO: 640826 - protein, 9 aa, Homo Sapiens
LRQLAESWR

SEQ ID NO: 640827 - protein, 9 aa, Homo Sapiens
SRGSSLQAN

SEQ ID NO: 640828 - protein, 9 aa, Homo Sapiens
EHTSMLVEV

SEQ ID NO: 640829 - protein, 9 aa, Homo Sapiens
SVSSRVKGP

SEQ ID NO: 640830 - protein, 9 aa, Homo Sapiens
NIAQVLWQH

SEQ ID NO: 640831 - protein, 9 aa, Homo Sapiens
RDWGGAAQL

SEQ ID NO: 640832 - protein, 9 aa, Homo Sapiens
YGDVYCRVP

SEQ ID NO: 640833 - protein, 9 aa, Homo Sapiens
TKNDPFTSY

SEQ ID NO: 640834 - protein, 9 aa, Homo Sapiens
GFPIGMVDS

SEQ ID NO: 640835 - protein, 9 aa, Homo Sapiens
LVGYLRVHG

SEQ ID NO: 640836 - protein, 9 aa, Homo Sapiens
VNRFCKKVP

SEQ ID NO: 640837 - protein, 9 aa, Homo Sapiens
KELHEAQPW

SEQ ID NO: 640838 - protein, 9 aa, Homo Sapiens
WSPLVKPPY

SEQ ID NO: 640839 - protein, 9 aa, Homo Sapiens
NRQLYPECT

SEQ ID NO: 640840 - protein, 9 aa, Homo Sapiens
PSTVRQLMA

SEQ ID NO: 640841 - protein, 9 aa, Homo Sapiens
SDTDVLNVL

SEQ ID NO: 640842 - protein, 9 aa, Homo Sapiens
IDAKLTSEE

SEQ ID NO: 640843 - protein, 9 aa, Homo Sapiens
DTFDFYRKN

SEQ ID NO: 640844 - protein, 9 aa, Homo Sapiens
ANVLRNGNI

SEQ ID NO: 640845 - protein, 9 aa, Homo Sapiens
PTRNDLGDK

SEQ ID NO: 640846 - protein, 9 aa, Homo Sapiens
FRNRNGSDY

SEQ ID NO: 640847 - protein, 9 aa, Homo Sapiens
FAKQAMRRK

SEQ ID NO: 640848 - protein, 9 aa, Homo Sapiens
VVIKFKSMP

SEQ ID NO: 640849 - protein, 9 aa, Homo Sapiens
YNPNLNAGI

SEQ ID NO: 640850 - protein, 9 aa, Homo Sapiens
ANGEEAKKF

SEQ ID NO: 640851 - protein, 9 aa, Homo Sapiens
TCTDCHGIR

SEQ ID NO: 640852 - protein, 9 aa, Homo Sapiens
TAIVLLGLI

SEQ ID NO: 640853 - protein, 9 aa, Homo Sapiens
IRQPCCAFF

SEQ ID NO: 640854 - protein, 9 aa, Homo Sapiens
RRTRCLLLS

SEQ ID NO: 640855 - protein, 9 aa, Homo Sapiens
LRATEAYYR

SEQ ID NO: 640856 - protein, 9 aa, Homo Sapiens
AAALWHKLE

SEQ ID NO: 640857 - protein, 9 aa, Homo Sapiens
NLWSFGSKI

SEQ ID NO: 640858 - protein, 9 aa, Homo Sapiens
QHWASWGKW

SEQ ID NO: 640859 - protein, 9 aa, Homo Sapiens
EGLEVISHT

SEQ ID NO: 640860 - protein, 9 aa, Homo Sapiens
AILDNPNSL

SEQ ID NO: 640861 - protein, 9 aa, Homo Sapiens
PLLQLAAVC

SEQ ID NO: 640862 - protein, 9 aa, Homo Sapiens
GQKLIDFMY

SEQ ID NO: 640863 - protein, 9 aa, Homo Sapiens
GGIAFILLV

SEQ ID NO: 640864 - protein, 9 aa, Homo Sapiens
ASEKRLTKL

SEQ ID NO: 640865 - protein, 9 aa, Homo Sapiens
KMSSGSQQC

SEQ ID NO: 640866 - protein, 9 aa, Homo Sapiens
DKCCADYES

SEQ ID NO: 640867 - protein, 9 aa, Homo Sapiens
SIAINNLSY

SEQ ID NO: 640868 - protein, 9 aa, Homo Sapiens
FWNGSVSSR

SEQ ID NO: 640869 - protein, 9 aa, Homo Sapiens
LDNKLLLSF

SEQ ID NO: 640870 - protein, 9 aa, Homo Sapiens
YSGYLLLEA

SEQ ID NO: 640871 - protein, 9 aa, Homo Sapiens
HTCERPFPC

SEQ ID NO: 640872 - protein, 9 aa, Homo Sapiens
VAEAVPEAA

SEQ ID NO: 640873 - protein, 9 aa, Homo Sapiens
SLKRCLCGV

SEQ ID NO: 640874 - protein, 9 aa, Homo Sapiens
PEVNRFCKK

SEQ ID NO: 640875 - protein, 9 aa, Homo Sapiens
STLSLFLDE

SEQ ID NO: 640876 - protein, 9 aa, Homo Sapiens
QSQLRREQE

SEQ ID NO: 640877 - protein, 9 aa, Homo Sapiens
AGSLSSSRE

SEQ ID NO: 640878 - protein, 9 aa, Homo Sapiens
HGLGRACVP

SEQ ID NO: 640879 - protein, 9 aa, Homo Sapiens
LADGSVDVV

SEQ ID NO: 640880 - protein, 9 aa, Homo Sapiens
CRTRESVPS

SEQ ID NO: 640881 - protein, 9 aa, Homo Sapiens
STSCKGQNG

SEQ ID NO: 640882 - protein, 9 aa, Homo Sapiens
KHHVTFINK

SEQ ID NO: 640883 - protein, 9 aa, Homo Sapiens
LEVMAFDRY

SEQ ID NO: 640884 - protein, 9 aa, Homo Sapiens
TRARRCPGV

SEQ ID NO: 640885 - protein, 9 aa, Homo Sapiens
RYLTAFTRE

SEQ ID NO: 640886 - protein, 9 aa, Homo Sapiens
QHQTPIKMG

SEQ ID NO: 640887 - protein, 9 aa, Homo Sapiens
VLVDVTYPA

SEQ ID NO: 640888 - protein, 9 aa, Homo Sapiens
SMGFRILNS

SEQ ID NO: 640889 - protein, 9 aa, Homo Sapiens
RSRRFFSLT

SEQ ID NO: 640890 - protein, 9 aa, Homo Sapiens
NKLETKAET

SEQ ID NO: 640891 - protein, 9 aa, Homo Sapiens
LELLRKGSS

SEQ ID NO: 640892 - protein, 9 aa, Homo Sapiens
ALKPTNLNN

SEQ ID NO: 640893 - protein, 9 aa, Homo Sapiens
MRRILDLAK

SEQ ID NO: 640894 - protein, 9 aa, Homo Sapiens
GASAWDAGP

SEQ ID NO: 640895 - protein, 9 aa, Homo Sapiens
VDSNLGIIG

SEQ ID NO: 640896 - protein, 9 aa, Homo Sapiens
PHQCRRIRQ

SEQ ID NO: 640897 - protein, 9 aa, Homo Sapiens
RVEAMPRLR

SEQ ID NO: 640898 - protein, 9 aa, Homo Sapiens
LGCMMQFYL

SEQ ID NO: 640899 - protein, 9 aa, Homo Sapiens
ALKAEELQA

SEQ ID NO: 640900 - protein, 9 aa, Homo Sapiens
EFALLGAIA

SEQ ID NO: 640901 - protein, 9 aa, Homo Sapiens
GSLQLTLGN

SEQ ID NO: 640902 - protein, 9 aa, Homo Sapiens
RSSKFPTKR

SEQ ID NO: 640903 - protein, 9 aa, Homo Sapiens
VILSQAIMH

SEQ ID NO: 640904 - protein, 9 aa, Homo Sapiens
LGSPKWQQA

SEQ ID NO: 640905 - protein, 9 aa, Homo Sapiens
HRAEKGINS

SEQ ID NO: 640906 - protein, 9 aa, Homo Sapiens
LSSLGEHLG

SEQ ID NO: 640907 - protein, 9 aa, Homo Sapiens
RGPLNFGPL

SEQ ID NO: 640908 - protein, 9 aa, Homo Sapiens
SKDNVCSLE

SEQ ID NO: 640909 - protein, 9 aa, Homo Sapiens
AYQDPHFDA

SEQ ID NO: 640910 - protein, 9 aa, Homo Sapiens
VLGASWGSL

SEQ ID NO: 640911 - protein, 9 aa, Homo Sapiens
PLACADFLV

SEQ ID NO: 640912 - protein, 9 aa, Homo Sapiens
DCAWEAVNP

SEQ ID NO: 640913 - protein, 9 aa, Homo Sapiens
FLNHSENET

SEQ ID NO: 640914 - protein, 9 aa, Homo Sapiens
PESFAQAVS

SEQ ID NO: 640915 - protein, 9 aa, Homo Sapiens
LVLPVHPEN

SEQ ID NO: 640916 - protein, 9 aa, Homo Sapiens
AFSFEPKLQ

SEQ ID NO: 640917 - protein, 9 aa, Homo Sapiens
QEEEILAKA

SEQ ID NO: 640918 - protein, 9 aa, Homo Sapiens
QPLFFQFLV

SEQ ID NO: 640919 - protein, 9 aa, Homo Sapiens
SQRYLLKCS

SEQ ID NO: 640920 - protein, 9 aa, Homo Sapiens
NRKVVVTTI

SEQ ID NO: 640921 - protein, 9 aa, Homo Sapiens
RSRYVLECS

SEQ ID NO: 640922 - protein, 9 aa, Homo Sapiens
TINKIPQVT

SEQ ID NO: 640923 - protein, 9 aa, Homo Sapiens
CFCRIILVS

SEQ ID NO: 640924 - protein, 9 aa, Homo Sapiens
SKNNSTCTD

SEQ ID NO: 640925 - protein, 9 aa, Homo Sapiens
ATSPRRTKA

SEQ ID NO: 640926 - protein, 9 aa, Homo Sapiens
LRSHNGERP

SEQ ID NO: 640927 - protein, 9 aa, Homo Sapiens
AGPGSPSAV

SEQ ID NO: 640928 - protein, 9 aa, Homo Sapiens
ISCLGPSCD

SEQ ID NO: 640929 - protein, 9 aa, Homo Sapiens
PRIDPDYLG

SEQ ID NO: 640930 - protein, 9 aa, Homo Sapiens
QIRSRRFFS

SEQ ID NO: 640931 - protein, 9 aa, Homo Sapiens
SGTPSPAPP

SEQ ID NO: 640932 - protein, 9 aa, Homo Sapiens
AAIENRKVV

SEQ ID NO: 640933 - protein, 9 aa, Homo Sapiens
DYHSRLSLI

SEQ ID NO: 640934 - protein, 9 aa, Homo Sapiens
TESTIVMLV

SEQ ID NO: 640935 - protein, 9 aa, Homo Sapiens
ISVIYDGEE

SEQ ID NO: 640936 - protein, 9 aa, Homo Sapiens
PLTHELTAR

SEQ ID NO: 640937 - protein, 9 aa, Homo Sapiens
DTKSEKVVQ

SEQ ID NO: 640938 - protein, 9 aa, Homo Sapiens
SLIATAGIN

SEQ ID NO: 640939 - protein, 9 aa, Homo Sapiens
PQELEDGGV

SEQ ID NO: 640940 - protein, 9 aa, Homo Sapiens
FGPLLQLAA

SEQ ID NO: 640941 - protein, 9 aa, Homo Sapiens
QHILWPKIA

SEQ ID NO: 640942 - protein, 9 aa, Homo Sapiens
LQDAIPSTA

SEQ ID NO: 640943 - protein, 9 aa, Homo Sapiens
SLEQDLEPL

SEQ ID NO: 640944 - protein, 9 aa, Homo Sapiens
YFVFFFPFP

SEQ ID NO: 640945 - protein, 9 aa, Homo Sapiens
KVMNFTVDV

SEQ ID NO: 640946 - protein, 9 aa, Homo Sapiens
PSNTSCMQH

SEQ ID NO: 640947 - protein, 9 aa, Homo Sapiens
FSCLEMDSE

SEQ ID NO: 640948 - protein, 9 aa, Homo Sapiens
AVCLSLHYM

SEQ ID NO: 640949 - protein, 9 aa, Homo Sapiens
SFLCQRPDG

SEQ ID NO: 640950 - protein, 9 aa, Homo Sapiens
NGSQLVIHG

SEQ ID NO: 640951 - protein, 9 aa, Homo Sapiens
KSHKGFDLM

SEQ ID NO: 640952 - protein, 9 aa, Homo Sapiens
IAERTFCCT

SEQ ID NO: 640953 - protein, 9 aa, Homo Sapiens
LKVLVTNGA

SEQ ID NO: 640954 - protein, 9 aa, Homo Sapiens
FPVLIIGIL

SEQ ID NO: 640955 - protein, 9 aa, Homo Sapiens
LDIPLGLEI

SEQ ID NO: 640956 - protein, 9 aa, Homo Sapiens
KEFTYLLAQ

SEQ ID NO: 640957 - protein, 9 aa, Homo Sapiens
SVKHRGSKP

SEQ ID NO: 640958 - protein, 9 aa, Homo Sapiens
FFPIKNGRK

SEQ ID NO: 640959 - protein, 9 aa, Homo Sapiens
EATPWARLL

SEQ ID NO: 640960 - protein, 9 aa, Homo Sapiens
GEHLGVREE

SEQ ID NO: 640961 - protein, 9 aa, Homo Sapiens
LSHRSRYVL

SEQ ID NO: 640962 - protein, 9 aa, Homo Sapiens
SPPVAEAVP

SEQ ID NO: 640963 - protein, 9 aa, Homo Sapiens
NGAALLTAH

SEQ ID NO: 640964 - protein, 9 aa, Homo Sapiens
EATSALDTK

SEQ ID NO: 640965 - protein, 9 aa, Homo Sapiens
ELRQLAESW

SEQ ID NO: 640966 - protein, 9 aa, Homo Sapiens
YDKCCADYE

SEQ ID NO: 640967 - protein, 9 aa, Homo Sapiens
GIGDEIEHP

SEQ ID NO: 640968 - protein, 9 aa, Homo Sapiens
KIILDPITF

SEQ ID NO: 640969 - protein, 9 aa, Homo Sapiens
TDNGNAPPS

SEQ ID NO: 640970 - protein, 9 aa, Homo Sapiens
SHPHFVRCL

SEQ ID NO: 640971 - protein, 9 aa, Homo Sapiens
PVELFGQVV

SEQ ID NO: 640972 - protein, 9 aa, Homo Sapiens
VEPLISAAS

SEQ ID NO: 640973 - protein, 9 aa, Homo Sapiens
KDYLAPSTV

SEQ ID NO: 640974 - protein, 9 aa, Homo Sapiens
TEFALLGAI

SEQ ID NO: 640975 - protein, 9 aa, Homo Sapiens
TYDPKTCSF

SEQ ID NO: 640976 - protein, 9 aa, Homo Sapiens
PGPDVLCTC

SEQ ID NO: 640977 - protein, 9 aa, Homo Sapiens
VVNLWSFGS

SEQ ID NO: 640978 - protein, 9 aa, Homo Sapiens
EQGCLCPCQ

SEQ ID NO: 640979 - protein, 9 aa, Homo Sapiens
SEDSEVEAP

SEQ ID NO: 640980 - protein, 9 aa, Homo Sapiens
PYVRTLFIE

SEQ ID NO: 640981 - protein, 9 aa, Homo Sapiens
INKIPQVTL

SEQ ID NO: 640982 - protein, 9 aa, Homo Sapiens
MAWRVCFHS

SEQ ID NO: 640983 - protein, 9 aa, Homo Sapiens
GSPTTCRRP

SEQ ID NO: 640984 - protein, 9 aa, Homo Sapiens
TDCAWEAVN

SEQ ID NO: 640985 - protein, 9 aa, Homo Sapiens
LKCHMLPFY

SEQ ID NO: 640986 - protein, 9 aa, Homo Sapiens
ATDLETGLG

SEQ ID NO: 640987 - protein, 9 aa, Homo Sapiens
FTYQDVTLR

SEQ ID NO: 640988 - protein, 9 aa, Homo Sapiens
HIATDLETG

SEQ ID NO: 640989 - protein, 9 aa, Homo Sapiens
EFRHRPKCF

SEQ ID NO: 640990 - protein, 9 aa, Homo Sapiens
PPSKLTWSW

SEQ ID NO: 640991 - protein, 9 aa, Homo Sapiens
GKESIMSSD

SEQ ID NO: 640992 - protein, 9 aa, Homo Sapiens
AFPVLIIGI

SEQ ID NO: 640993 - protein, 9 aa, Homo Sapiens
PLFQELQPL

SEQ ID NO: 640994 - protein, 9 aa, Homo Sapiens
HHRTHAGER

SEQ ID NO: 640995 - protein, 9 aa, Homo Sapiens
FTVDVMGNL

SEQ ID NO: 640996 - protein, 9 aa, Homo Sapiens
VLSYEGLRG

SEQ ID NO: 640997 - protein, 9 aa, Homo Sapiens
QAVVQQKPA

SEQ ID NO: 640998 - protein, 9 aa, Homo Sapiens
LANTDIHVA

SEQ ID NO: 640999 - protein, 9 aa, Homo Sapiens
ACLDMQASP

SEQ ID NO: 641000 - protein, 9 aa, Homo Sapiens
LGGIAFILL

SEQ ID NO: 641001 - protein, 9 aa, Homo Sapiens
RYLLKCSVP

SEQ ID NO: 641002 - protein, 9 aa, Homo Sapiens
FLKKLHKEE

SEQ ID NO: 641003 - protein, 9 aa, Homo Sapiens
CSSTLRNIR

SEQ ID NO: 641004 - protein, 9 aa, Homo Sapiens
GIRCAFGHG

SEQ ID NO: 641005 - protein, 9 aa, Homo Sapiens
SIIYLLPKS

SEQ ID NO: 641006 - protein, 9 aa, Homo Sapiens
CKMNPSKNN

SEQ ID NO: 641007 - protein, 9 aa, Homo Sapiens
KRPQILTRR

SEQ ID NO: 641008 - protein, 9 aa, Homo Sapiens
KNDLGNHRG

SEQ ID NO: 641009 - protein, 9 aa, Homo Sapiens
GLLGGGVSW

SEQ ID NO: 641010 - protein, 9 aa, Homo Sapiens
NKAGKESIM

SEQ ID NO: 641011 - protein, 9 aa, Homo Sapiens
PCQASFTQS

SEQ ID NO: 641012 - protein, 9 aa, Homo Sapiens
EQKTGVIKT

SEQ ID NO: 641013 - protein, 9 aa, Homo Sapiens
ALVISLPHP

SEQ ID NO: 641014 - protein, 9 aa, Homo Sapiens
RLLFELCIC

SEQ ID NO: 641015 - protein, 9 aa, Homo Sapiens
YDLCVVGEE

SEQ ID NO: 641016 - protein, 9 aa, Homo Sapiens
QGSTLSLFL

SEQ ID NO: 641017 - protein, 9 aa, Homo Sapiens
ARHAVSCFL

SEQ ID NO: 641018 - protein, 9 aa, Homo Sapiens
AQRALSHFP

SEQ ID NO: 641019 - protein, 9 aa, Homo Sapiens
PTTMSCSEI

SEQ ID NO: 641020 - protein, 9 aa, Homo Sapiens
CASIIYLLP

SEQ ID NO: 641021 - protein, 9 aa, Homo Sapiens
KLYIGNLNK

SEQ ID NO: 641022 - protein, 9 aa, Homo Sapiens
CLCPCQASF

SEQ ID NO: 641023 - protein, 9 aa, Homo Sapiens
TPWARLLLR

SEQ ID NO: 641024 - protein, 9 aa, Homo Sapiens
FRHRPKCFE

SEQ ID NO: 641025 - protein, 9 aa, Homo Sapiens
SLGEHLGVR

SEQ ID NO: 641026 - protein, 9 aa, Homo Sapiens
RPCSEGFLK

SEQ ID NO: 641027 - protein, 9 aa, Homo Sapiens
HDRYVAVCL

SEQ ID NO: 641028 - protein, 9 aa, Homo Sapiens
KNLTSVVRI

SEQ ID NO: 641029 - protein, 9 aa, Homo Sapiens
GSGSLSASW

SEQ ID NO: 641030 - protein, 9 aa, Homo Sapiens
KAFSTWAFH

SEQ ID NO: 641031 - protein, 9 aa, Homo Sapiens
RNHIIYLRP

SEQ ID NO: 641032 - protein, 9 aa, Homo Sapiens
NSQHQGRQI

SEQ ID NO: 641033 - protein, 9 aa, Homo Sapiens
HQIMSGSTI

SEQ ID NO: 641034 - protein, 9 aa, Homo Sapiens
HVFLLLSSE

SEQ ID NO: 641035 - protein, 9 aa, Homo Sapiens
VFESRNMMK

SEQ ID NO: 641036 - protein, 9 aa, Homo Sapiens
YFSVEQKTG

SEQ ID NO: 641037 - protein, 9 aa, Homo Sapiens
KCFCRIILV

SEQ ID NO: 641038 - protein, 9 aa, Homo Sapiens
RLPVLDSVS

SEQ ID NO: 641039 - protein, 9 aa, Homo Sapiens
LEPSSVSQT

SEQ ID NO: 641040 - protein, 9 aa, Homo Sapiens
NTSCMQHSV

SEQ ID NO: 641041 - protein, 9 aa, Homo Sapiens
SLTVSELET

SEQ ID NO: 641042 - protein, 9 aa, Homo Sapiens
PSLEQDLEP

SEQ ID NO: 641043 - protein, 9 aa, Homo Sapiens
AVLPIPVPR

SEQ ID NO: 641044 - protein, 9 aa, Homo Sapiens
AYDRCAAVC

SEQ ID NO: 641045 - protein, 9 aa, Homo Sapiens
GAAVAEKSL

SEQ ID NO: 641046 - protein, 9 aa, Homo Sapiens
IFTLKSDPG

SEQ ID NO: 641047 - protein, 9 aa, Homo Sapiens
LLGDFYVGA

SEQ ID NO: 641048 - protein, 9 aa, Homo Sapiens
GFFPIKNGR

SEQ ID NO: 641049 - protein, 9 aa, Homo Sapiens
HSAVLLTAV

SEQ ID NO: 641050 - protein, 9 aa, Homo Sapiens
RDFMETFNT

SEQ ID NO: 641051 - protein, 9 aa, Homo Sapiens
ERKQTEPVS

SEQ ID NO: 641052 - protein, 9 aa, Homo Sapiens
SWACSARVA

SEQ ID NO: 641053 - protein, 9 aa, Homo Sapiens
RKAHILNNH

SEQ ID NO: 641054 - protein, 9 aa, Homo Sapiens
GCNYVAGGQ

SEQ ID NO: 641055 - protein, 9 aa, Homo Sapiens
RALSHFPGS

SEQ ID NO: 641056 - protein, 9 aa, Homo Sapiens
TNLELLRKG

SEQ ID NO: 641057 - protein, 9 aa, Homo Sapiens
LKNAGSLSS

SEQ ID NO: 641058 - protein, 9 aa, Homo Sapiens
GPGGAVGNR

SEQ ID NO: 641059 - protein, 9 aa, Homo Sapiens
NLELLRKGS

SEQ ID NO: 641060 - protein, 9 aa, Homo Sapiens
RLQPTRNDL

SEQ ID NO: 641061 - protein, 9 aa, Homo Sapiens
NLGIIGHAG

SEQ ID NO: 641062 - protein, 9 aa, Homo Sapiens
VPPLLDDPT

SEQ ID NO: 641063 - protein, 9 aa, Homo Sapiens
ATAIVLLGL

SEQ ID NO: 641064 - protein, 9 aa, Homo Sapiens
KSVTPADLE

SEQ ID NO: 641065 - protein, 9 aa, Homo Sapiens
PTVVLEIPV

SEQ ID NO: 641066 - protein, 9 aa, Homo Sapiens
HSRLRRSGR

SEQ ID NO: 641067 - protein, 9 aa, Homo Sapiens
NRTFTVTIE

SEQ ID NO: 641068 - protein, 9 aa, Homo Sapiens
FIIDSFNEL

SEQ ID NO: 641069 - protein, 9 aa, Homo Sapiens
MWKRPQILT

SEQ ID NO: 641070 - protein, 9 aa, Homo Sapiens
VEPEWELDL

SEQ ID NO: 641071 - protein, 9 aa, Homo Sapiens
AEVLKVLVT

SEQ ID NO: 641072 - protein, 9 aa, Homo Sapiens
SQATSPRRT

SEQ ID NO: 641073 - protein, 9 aa, Homo Sapiens
VAELHNPAI

SEQ ID NO: 641074 - protein, 9 aa, Homo Sapiens
GPHQCRRIR

SEQ ID NO: 641075 - protein, 9 aa, Homo Sapiens
FIVKHMRDQ

SEQ ID NO: 641076 - protein, 9 aa, Homo Sapiens
PGARGPLNF

SEQ ID NO: 641077 - protein, 9 aa, Homo Sapiens
YQDYYTEEA

SEQ ID NO: 641078 - protein, 9 aa, Homo Sapiens
QICKEFTYL

SEQ ID NO: 641079 - protein, 9 aa, Homo Sapiens
IILDPITFS

SEQ ID NO: 641080 - protein, 9 aa, Homo Sapiens
CCRIFQDGV

SEQ ID NO: 641081 - protein, 9 aa, Homo Sapiens
LSSEYDEPS

SEQ ID NO: 641082 - protein, 9 aa, Homo Sapiens
VVSVLRGSG

SEQ ID NO: 641083 - protein, 9 aa, Homo Sapiens
IASEKRLTK

SEQ ID NO: 641084 - protein, 9 aa, Homo Sapiens
ASMFDQKSS

SEQ ID NO: 641085 - protein, 9 aa, Homo Sapiens
KAEIRQPCC

SEQ ID NO: 641086 - protein, 9 aa, Homo Sapiens
GQNGNAHGN

SEQ ID NO: 641087 - protein, 9 aa, Homo Sapiens
KTRPVSQPT

SEQ ID NO: 641088 - protein, 9 aa, Homo Sapiens
VGNRHAVYW

SEQ ID NO: 641089 - protein, 9 aa, Homo Sapiens
VRCRTRESV

SEQ ID NO: 641090 - protein, 9 aa, Homo Sapiens
GNHRGTLQD

SEQ ID NO: 641091 - protein, 9 aa, Homo Sapiens
EPGLFGVWP

SEQ ID NO: 641092 - protein, 9 aa, Homo Sapiens
IQACTTTPC

SEQ ID NO: 641093 - protein, 9 aa, Homo Sapiens
GRRKGKQYL

SEQ ID NO: 641094 - protein, 9 aa, Homo Sapiens
LHNPAIRER

SEQ ID NO: 641095 - protein, 9 aa, Homo Sapiens
GNISMKDPS

SEQ ID NO: 641096 - protein, 9 aa, Homo Sapiens
FTSAYTFIP

SEQ ID NO: 641097 - protein, 9 aa, Homo Sapiens
GPAAMASFP

SEQ ID NO: 641098 - protein, 9 aa, Homo Sapiens
ECAKGPLPV

SEQ ID NO: 641099 - protein, 9 aa, Homo Sapiens
TPSPAPPPS

SEQ ID NO: 641100 - protein, 9 aa, Homo Sapiens
DLGNHRGTL

SEQ ID NO: 641101 - protein, 9 aa, Homo Sapiens
QELPANYRY

SEQ ID NO: 641102 - protein, 9 aa, Homo Sapiens
SYPGMDSTP

SEQ ID NO: 641103 - protein, 9 aa, Homo Sapiens
TLSGCKWKM

SEQ ID NO: 641104 - protein, 9 aa, Homo Sapiens
KKQNDIEEV

SEQ ID NO: 641105 - protein, 9 aa, Homo Sapiens
LSLHYMAVM

SEQ ID NO: 641106 - protein, 9 aa, Homo Sapiens
QGCVLVPPL

SEQ ID NO: 641107 - protein, 9 aa, Homo Sapiens
RAAGASVAA

SEQ ID NO: 641108 - protein, 9 aa, Homo Sapiens
GRGASAWDA

SEQ ID NO: 641109 - protein, 9 aa, Homo Sapiens
QVTRFGEVA

SEQ ID NO: 641110 - protein, 9 aa, Homo Sapiens
GVLPGHAGG

SEQ ID NO: 641111 - protein, 9 aa, Homo Sapiens
TGRGFNITD

SEQ ID NO: 641112 - protein, 9 aa, Homo Sapiens
QAFTSAYTF

SEQ ID NO: 641113 - protein, 9 aa, Homo Sapiens
LAVLWLWAP

SEQ ID NO: 641114 - protein, 9 aa, Homo Sapiens
NIAERTFCC

SEQ ID NO: 641115 - protein, 9 aa, Homo Sapiens
NTAFLPPSP

SEQ ID NO: 641116 - protein, 9 aa, Homo Sapiens
RPAAEDLRE

SEQ ID NO: 641117 - protein, 9 aa, Homo Sapiens
SKDITQLLM

SEQ ID NO: 641118 - protein, 9 aa, Homo Sapiens
GIMPMRSRG

SEQ ID NO: 641119 - protein, 9 aa, Homo Sapiens
QGCLCPCQA

SEQ ID NO: 641120 - protein, 9 aa, Homo Sapiens
AETSTALHR

SEQ ID NO: 641121 - protein, 9 aa, Homo Sapiens
EFSCLEMDS

SEQ ID NO: 641122 - protein, 9 aa, Homo Sapiens
WHISVLMPC

SEQ ID NO: 641123 - protein, 9 aa, Homo Sapiens
LYFEPKDIT

SEQ ID NO: 641124 - protein, 9 aa, Homo Sapiens
PSGGAATWS

SEQ ID NO: 641125 - protein, 9 aa, Homo Sapiens
CFFLEVMAF

SEQ ID NO: 641126 - protein, 9 aa, Homo Sapiens
DIFRIATPP

SEQ ID NO: 641127 - protein, 9 aa, Homo Sapiens
CKASRGCVS

SEQ ID NO: 641128 - protein, 9 aa, Homo Sapiens
ASSALCKAS

SEQ ID NO: 641129 - protein, 9 aa, Homo Sapiens
DKFIPCEKR

SEQ ID NO: 641130 - protein, 9 aa, Homo Sapiens
LDSKLKNAV

SEQ ID NO: 641131 - protein, 9 aa, Homo Sapiens
TSSQVCCNF

SEQ ID NO: 641132 - protein, 9 aa, Homo Sapiens
EFLSLSLGF

SEQ ID NO: 641133 - protein, 9 aa, Homo Sapiens
AAQQRDWGG

SEQ ID NO: 641134 - protein, 9 aa, Homo Sapiens
QRSEEAHRA

SEQ ID NO: 641135 - protein, 9 aa, Homo Sapiens
EGLLLTSMD

SEQ ID NO: 641136 - protein, 9 aa, Homo Sapiens
KVIQASMFD

SEQ ID NO: 641137 - protein, 9 aa, Homo Sapiens
YYKPHHIQL

SEQ ID NO: 641138 - protein, 9 aa, Homo Sapiens
SDAYQDPHF

SEQ ID NO: 641139 - protein, 9 aa, Homo Sapiens
QRRSLPVFQ

SEQ ID NO: 641140 - protein, 9 aa, Homo Sapiens
VCACPGRER

SEQ ID NO: 641141 - protein, 9 aa, Homo Sapiens
RLQAVTDNH

SEQ ID NO: 641142 - protein, 9 aa, Homo Sapiens
SWETGAMVR

SEQ ID NO: 641143 - protein, 9 aa, Homo Sapiens
LIIHNGEKP

SEQ ID NO: 641144 - protein, 9 aa, Homo Sapiens
RVCACPGRE

SEQ ID NO: 641145 - protein, 9 aa, Homo Sapiens
DPSKKDLLE

SEQ ID NO: 641146 - protein, 9 aa, Homo Sapiens
LPHASETFP

SEQ ID NO: 641147 - protein, 9 aa, Homo Sapiens
YGVPIPVPP

SEQ ID NO: 641148 - protein, 9 aa, Homo Sapiens
SLVPLLLLR

SEQ ID NO: 641149 - protein, 9 aa, Homo Sapiens
KIDGKVLVD

SEQ ID NO: 641150 - protein, 9 aa, Homo Sapiens
PKCFEDTKP

SEQ ID NO: 641151 - protein, 9 aa, Homo Sapiens
FRQKSSLIV

SEQ ID NO: 641152 - protein, 9 aa, Homo Sapiens
ISDAYQDPH

SEQ ID NO: 641153 - protein, 9 aa, Homo Sapiens
QHLYGTYLT

SEQ ID NO: 641154 - protein, 9 aa, Homo Sapiens
RQLADGSVD

SEQ ID NO: 641155 - protein, 9 aa, Homo Sapiens
GGSGGSHDG

SEQ ID NO: 641156 - protein, 9 aa, Homo Sapiens
VISLFEQKK

SEQ ID NO: 641157 - protein, 9 aa, Homo Sapiens
GGGVSWACS

SEQ ID NO: 641158 - protein, 9 aa, Homo Sapiens
DCHGIRCAF

SEQ ID NO: 641159 - protein, 9 aa, Homo Sapiens
DSEHRPDIF

SEQ ID NO: 641160 - protein, 9 aa, Homo Sapiens
DFKKEAFRL

SEQ ID NO: 641161 - protein, 9 aa, Homo Sapiens
GKCFIKSSN

SEQ ID NO: 641162 - protein, 9 aa, Homo Sapiens
FPQGNQAVV

SEQ ID NO: 641163 - protein, 9 aa, Homo Sapiens
RSHNGERPF

SEQ ID NO: 641164 - protein, 9 aa, Homo Sapiens
IIDSFNELN

SEQ ID NO: 641165 - protein, 9 aa, Homo Sapiens
QVVLSYEGL

SEQ ID NO: 641166 - protein, 9 aa, Homo Sapiens
TARLSSRAE

SEQ ID NO: 641167 - protein, 9 aa, Homo Sapiens
ICKEFTYLL

SEQ ID NO: 641168 - protein, 9 aa, Homo Sapiens
FSSAHPSSG

SEQ ID NO: 641169 - protein, 9 aa, Homo Sapiens
LLPDDDKFH

SEQ ID NO: 641170 - protein, 9 aa, Homo Sapiens
GAHTVAEAG

SEQ ID NO: 641171 - protein, 9 aa, Homo Sapiens
SHNGERPFK

SEQ ID NO: 641172 - protein, 9 aa, Homo Sapiens
VLYSFSIYV

SEQ ID NO: 641173 - protein, 9 aa, Homo Sapiens
SRKPGDHLV

SEQ ID NO: 641174 - protein, 9 aa, Homo Sapiens
VSGLSSLGE

SEQ ID NO: 641175 - protein, 9 aa, Homo Sapiens
GANFIVKHM

SEQ ID NO: 641176 - protein, 9 aa, Homo Sapiens
AVCGNTTLS

SEQ ID NO: 641177 - protein, 9 aa, Homo Sapiens
LYYYQFGGR

SEQ ID NO: 641178 - protein, 9 aa, Homo Sapiens
MALASSTIG

SEQ ID NO: 641179 - protein, 9 aa, Homo Sapiens
IPQVTLNFS

SEQ ID NO: 641180 - protein, 9 aa, Homo Sapiens
DYYTEEANG

SEQ ID NO: 641181 - protein, 9 aa, Homo Sapiens
AEPQEAAWA

SEQ ID NO: 641182 - protein, 9 aa, Homo Sapiens
AVVQEELRQ

SEQ ID NO: 641183 - protein, 9 aa, Homo Sapiens
RVASSALCK

SEQ ID NO: 641184 - protein, 9 aa, Homo Sapiens
GNTCLEERD

SEQ ID NO: 641185 - protein, 9 aa, Homo Sapiens
LWHKLESLW

SEQ ID NO: 641186 - protein, 9 aa, Homo Sapiens
KESIMSSDT

SEQ ID NO: 641187 - protein, 9 aa, Homo Sapiens
CPTDVYLLD

SEQ ID NO: 641188 - protein, 9 aa, Homo Sapiens
VWVREQCPG

SEQ ID NO: 641189 - protein, 9 aa, Homo Sapiens
INTWKVWMS

SEQ ID NO: 641190 - protein, 9 aa, Homo Sapiens
ETKAETQTE

SEQ ID NO: 641191 - protein, 9 aa, Homo Sapiens
KPYVRTLFI

SEQ ID NO: 641192 - protein, 9 aa, Homo Sapiens
CKYRHVCTY

SEQ ID NO: 641193 - protein, 9 aa, Homo Sapiens
AAIRYSRPG

SEQ ID NO: 641194 - protein, 9 aa, Homo Sapiens
RTSLPTHYP

SEQ ID NO: 641195 - protein, 9 aa, Homo Sapiens
IGDEIEHPA

SEQ ID NO: 641196 - protein, 9 aa, Homo Sapiens
VDQKVIQAS

SEQ ID NO: 641197 - protein, 9 aa, Homo Sapiens
EDLREPVPN

SEQ ID NO: 641198 - protein, 9 aa, Homo Sapiens
LAIDAKLTS

SEQ ID NO: 641199 - protein, 9 aa, Homo Sapiens
AGKESIMSS

SEQ ID NO: 641200 - protein, 9 aa, Homo Sapiens
RIATPPSLG

SEQ ID NO: 641201 - protein, 9 aa, Homo Sapiens
QVMDHVFLL

SEQ ID NO: 641202 - protein, 9 aa, Homo Sapiens
PSLKRCLCG

SEQ ID NO: 641203 - protein, 9 aa, Homo Sapiens
YHKLEGPWG

SEQ ID NO: 641204 - protein, 9 aa, Homo Sapiens
LKTDMYSPN

SEQ ID NO: 641205 - protein, 9 aa, Homo Sapiens
VRESFHRGL

SEQ ID NO: 641206 - protein, 9 aa, Homo Sapiens
IIEAPMAWL

SEQ ID NO: 641207 - protein, 9 aa, Homo Sapiens
DFLKEMAAI

SEQ ID NO: 641208 - protein, 9 aa, Homo Sapiens
EGTLELTLT

SEQ ID NO: 641209 - protein, 9 aa, Homo Sapiens
ENETAKDIA

SEQ ID NO: 641210 - protein, 9 aa, Homo Sapiens
PNGSVEPEW

SEQ ID NO: 641211 - protein, 9 aa, Homo Sapiens
TGRLHPAGS

SEQ ID NO: 641212 - protein, 9 aa, Homo Sapiens
TTQSPAEPT

SEQ ID NO: 641213 - protein, 9 aa, Homo Sapiens
ALNFANGEE

SEQ ID NO: 641214 - protein, 9 aa, Homo Sapiens
LGFNFRNNF

SEQ ID NO: 641215 - protein, 9 aa, Homo Sapiens
IKNANSHDD

SEQ ID NO: 641216 - protein, 9 aa, Homo Sapiens
HSAEGRQKV

SEQ ID NO: 641217 - protein, 9 aa, Homo Sapiens
DPHFDAEAD

SEQ ID NO: 641218 - protein, 9 aa, Homo Sapiens
DTTPFPVTD

SEQ ID NO: 641219 - protein, 9 aa, Homo Sapiens
EYCVCGMHE

SEQ ID NO: 641220 - protein, 9 aa, Homo Sapiens
YSNRIYRMI

SEQ ID NO: 641221 - protein, 9 aa, Homo Sapiens
FCCAPYDSR

SEQ ID NO: 641222 - protein, 9 aa, Homo Sapiens
PLSIRIALP

SEQ ID NO: 641223 - protein, 9 aa, Homo Sapiens
PTNFLVAPL

SEQ ID NO: 641224 - protein, 9 aa, Homo Sapiens
PDVPQALSA

SEQ ID NO: 641225 - protein, 9 aa, Homo Sapiens
ESLGSFGSI

SEQ ID NO: 641226 - protein, 9 aa, Homo Sapiens
NASLVIAFI

SEQ ID NO: 641227 - protein, 9 aa, Homo Sapiens
LAFSFEPKL

SEQ ID NO: 641228 - protein, 9 aa, Homo Sapiens
PIPEDAQQG

SEQ ID NO: 641229 - protein, 9 aa, Homo Sapiens
TCGKCFIKS

SEQ ID NO: 641230 - protein, 9 aa, Homo Sapiens
VSVQSGQKL

SEQ ID NO: 641231 - protein, 9 aa, Homo Sapiens
PTASMAQVL

SEQ ID NO: 641232 - protein, 9 aa, Homo Sapiens
FGSKIRFLL

SEQ ID NO: 641233 - protein, 9 aa, Homo Sapiens
CPRQVLFPL

SEQ ID NO: 641234 - protein, 9 aa, Homo Sapiens
IRCIGAELG

SEQ ID NO: 641235 - protein, 9 aa, Homo Sapiens
ASVAAELRC

SEQ ID NO: 641236 - protein, 9 aa, Homo Sapiens
STIVMLVLR

SEQ ID NO: 641237 - protein, 9 aa, Homo Sapiens
PRFLVTATG

SEQ ID NO: 641238 - protein, 9 aa, Homo Sapiens
CCVPGPDVL

SEQ ID NO: 641239 - protein, 9 aa, Homo Sapiens
YRMIDELNK

SEQ ID NO: 641240 - protein, 9 aa, Homo Sapiens
HSSAGAEGS

SEQ ID NO: 641241 - protein, 9 aa, Homo Sapiens
GKPKTRRIQ

SEQ ID NO: 641242 - protein, 9 aa, Homo Sapiens
TLGNLKPEA

SEQ ID NO: 641243 - protein, 9 aa, Homo Sapiens
SETPTSEQN

SEQ ID NO: 641244 - protein, 9 aa, Homo Sapiens
LGRVRLQKG

SEQ ID NO: 641245 - protein, 9 aa, Homo Sapiens
EIRTIACLV

SEQ ID NO: 641246 - protein, 9 aa, Homo Sapiens
WSAGLFFSS

SEQ ID NO: 641247 - protein, 9 aa, Homo Sapiens
TSPHEDSTT

SEQ ID NO: 641248 - protein, 9 aa, Homo Sapiens
GPDVLCTCT

SEQ ID NO: 641249 - protein, 9 aa, Homo Sapiens
RELQLSTAI

SEQ ID NO: 641250 - protein, 9 aa, Homo Sapiens
CVVGEERLS

SEQ ID NO: 641251 - protein, 9 aa, Homo Sapiens
PMAWLSRFF

SEQ ID NO: 641252 - protein, 9 aa, Homo Sapiens
VVLSYEGLR

SEQ ID NO: 641253 - protein, 9 aa, Homo Sapiens
SSRKPGDHL

SEQ ID NO: 641254 - protein, 9 aa, Homo Sapiens
VQGASVNSI

SEQ ID NO: 641255 - protein, 9 aa, Homo Sapiens
KLRLGHKGE

SEQ ID NO: 641256 - protein, 9 aa, Homo Sapiens
CNYVAGGQE

SEQ ID NO: 641257 - protein, 9 aa, Homo Sapiens
RNSCLALNQ

SEQ ID NO: 641258 - protein, 9 aa, Homo Sapiens
PPLLDDPTE

SEQ ID NO: 641259 - protein, 9 aa, Homo Sapiens
PAAMASFPE

SEQ ID NO: 641260 - protein, 9 aa, Homo Sapiens
KPGDHLVIS

SEQ ID NO: 641261 - protein, 9 aa, Homo Sapiens
HEWIQMDSM

SEQ ID NO: 641262 - protein, 9 aa, Homo Sapiens
RRFLDNKLL

SEQ ID NO: 641263 - protein, 9 aa, Homo Sapiens
NGEPCGNTC

SEQ ID NO: 641264 - protein, 9 aa, Homo Sapiens
TFNTLKYAN

SEQ ID NO: 641265 - protein, 9 aa, Homo Sapiens
GNLNKSVTP

SEQ ID NO: 641266 - protein, 9 aa, Homo Sapiens
ACEDSRSHG

SEQ ID NO: 641267 - protein, 9 aa, Homo Sapiens
LELTLTTQS

SEQ ID NO: 641268 - protein, 9 aa, Homo Sapiens
KYGDVYCRV

SEQ ID NO: 641269 - protein, 9 aa, Homo Sapiens
LFQVCMAIL

SEQ ID NO: 641270 - protein, 9 aa, Homo Sapiens
YGPPVATSP

SEQ ID NO: 641271 - protein, 9 aa, Homo Sapiens
GTLVKLLYF

SEQ ID NO: 641272 - protein, 9 aa, Homo Sapiens
TFEGHSRAL

SEQ ID NO: 641273 - protein, 9 aa, Homo Sapiens
IMHEPMYIF

SEQ ID NO: 641274 - protein, 9 aa, Homo Sapiens
PGSLQLTLG

SEQ ID NO: 641275 - protein, 9 aa, Homo Sapiens
RHAVSCFLT

SEQ ID NO: 641276 - protein, 9 aa, Homo Sapiens
IFHEHTSML

SEQ ID NO: 641277 - protein, 9 aa, Homo Sapiens
WMSTALATY

SEQ ID NO: 641278 - protein, 9 aa, Homo Sapiens
FEGHSRALW

SEQ ID NO: 641279 - protein, 9 aa, Homo Sapiens
AEFLSLSLG

SEQ ID NO: 641280 - protein, 9 aa, Homo Sapiens
TFCRMKMSS

SEQ ID NO: 641281 - protein, 9 aa, Homo Sapiens
IRTIACLVM

SEQ ID NO: 641282 - protein, 9 aa, Homo Sapiens
CGHAEPCVL

SEQ ID NO: 641283 - protein, 9 aa, Homo Sapiens
ENRKKKTNS

SEQ ID NO: 641284 - protein, 9 aa, Homo Sapiens
PFPDVPQAL

SEQ ID NO: 641285 - protein, 9 aa, Homo Sapiens
DTGDTSMLK

SEQ ID NO: 641286 - protein, 9 aa, Homo Sapiens
LFVGGLVEG

SEQ ID NO: 641287 - protein, 9 aa, Homo Sapiens
CRPLAAAAS

SEQ ID NO: 641288 - protein, 9 aa, Homo Sapiens
QLQQGFFPI

SEQ ID NO: 641289 - protein, 9 aa, Homo Sapiens
IDPDYLGRV

SEQ ID NO: 641290 - protein, 9 aa, Homo Sapiens
QTYSNRIYR

SEQ ID NO: 641291 - protein, 9 aa, Homo Sapiens
KEEIQELQA

SEQ ID NO: 641292 - protein, 9 aa, Homo Sapiens
ILDGGNPFP

SEQ ID NO: 641293 - protein, 9 aa, Homo Sapiens
IEAPMAWLS

SEQ ID NO: 641294 - protein, 9 aa, Homo Sapiens
YLLLEALVY

SEQ ID NO: 641295 - protein, 9 aa, Homo Sapiens
HLQECAKGP

SEQ ID NO: 641296 - protein, 9 aa, Homo Sapiens
DIHCLHCGG

SEQ ID NO: 641297 - protein, 9 aa, Homo Sapiens
RRDKAKRRI

SEQ ID NO: 641298 - protein, 9 aa, Homo Sapiens
PDDDKFHGG

SEQ ID NO: 641299 - protein, 9 aa, Homo Sapiens
RCLCGVLGF

SEQ ID NO: 641300 - protein, 9 aa, Homo Sapiens
AFSSAHPSS

SEQ ID NO: 641301 - protein, 9 aa, Homo Sapiens
WPMPLCPFL

SEQ ID NO: 641302 - protein, 9 aa, Homo Sapiens
HTEFEVVLY

SEQ ID NO: 641303 - protein, 9 aa, Homo Sapiens
TSCKGQNGN

SEQ ID NO: 641304 - protein, 9 aa, Homo Sapiens
PHNGEVRTA

SEQ ID NO: 641305 - protein, 9 aa, Homo Sapiens
TWKVWMSTA

SEQ ID NO: 641306 - protein, 9 aa, Homo Sapiens
DQIQSGCNY

SEQ ID NO: 641307 - protein, 9 aa, Homo Sapiens
AEFSCLEMD

SEQ ID NO: 641308 - protein, 9 aa, Homo Sapiens
AELHNPAIR

SEQ ID NO: 641309 - protein, 9 aa, Homo Sapiens
DTPVELFGQ

SEQ ID NO: 641310 - protein, 9 aa, Homo Sapiens
DIRSLAFFC

SEQ ID NO: 641311 - protein, 9 aa, Homo Sapiens
AAKVIILEQ

SEQ ID NO: 641312 - protein, 9 aa, Homo Sapiens
SYVGCIRDL

SEQ ID NO: 641313 - protein, 9 aa, Homo Sapiens
EPCGNTCLE

SEQ ID NO: 641314 - protein, 9 aa, Homo Sapiens
IKDLKLGSV

SEQ ID NO: 641315 - protein, 9 aa, Homo Sapiens
SLSASWEPL

SEQ ID NO: 641316 - protein, 9 aa, Homo Sapiens
NLGNACYMN

SEQ ID NO: 641317 - protein, 9 aa, Homo Sapiens
TSPRRTKAF

SEQ ID NO: 641318 - protein, 9 aa, Homo Sapiens
DRNDSVAVL

SEQ ID NO: 641319 - protein, 9 aa, Homo Sapiens
DVMGNLRVT

SEQ ID NO: 641320 - protein, 9 aa, Homo Sapiens
SISQTAAQV

SEQ ID NO: 641321 - protein, 9 aa, Homo Sapiens
ELSTKAKKP

SEQ ID NO: 641322 - protein, 9 aa, Homo Sapiens
FAIQETKGN

SEQ ID NO: 641323 - protein, 9 aa, Homo Sapiens
QLQSQLRRE

SEQ ID NO: 641324 - protein, 9 aa, Homo Sapiens
CLSLHYMAV

SEQ ID NO: 641325 - protein, 9 aa, Homo Sapiens
KNANSHDDR

SEQ ID NO: 641326 - protein, 9 aa, Homo Sapiens
PEVQAPAQL

SEQ ID NO: 641327 - protein, 9 aa, Homo Sapiens
VLYHKLEGP

SEQ ID NO: 641328 - protein, 9 aa, Homo Sapiens
IYETIYHRI

SEQ ID NO: 641329 - protein, 9 aa, Homo Sapiens
LHRLTARLS

SEQ ID NO: 641330 - protein, 9 aa, Homo Sapiens
TLVVIVNAT

SEQ ID NO: 641331 - protein, 9 aa, Homo Sapiens
GTSLPQSLP

SEQ ID NO: 641332 - protein, 9 aa, Homo Sapiens
KASGCPSVF

SEQ ID NO: 641333 - protein, 9 aa, Homo Sapiens
EGRDLGSFA

SEQ ID NO: 641334 - protein, 9 aa, Homo Sapiens
VLKVLVTNG

SEQ ID NO: 641335 - protein, 9 aa, Homo Sapiens
NFRNNFGIG

SEQ ID NO: 641336 - protein, 9 aa, Homo Sapiens
GEENRKKKT

SEQ ID NO: 641337 - protein, 9 aa, Homo Sapiens
GHPGPPGHL

SEQ ID NO: 641338 - protein, 9 aa, Homo Sapiens
TPFPVTDAS

SEQ ID NO: 641339 - protein, 9 aa, Homo Sapiens
TCMEQPLQE

SEQ ID NO: 641340 - protein, 9 aa, Homo Sapiens
RRKGKQYLL

SEQ ID NO: 641341 - protein, 9 aa, Homo Sapiens
GVGFPIGMV

SEQ ID NO: 641342 - protein, 9 aa, Homo Sapiens
DNEHSGQGI

SEQ ID NO: 641343 - protein, 9 aa, Homo Sapiens
TALPTVVLE

SEQ ID NO: 641344 - protein, 9 aa, Homo Sapiens
CMQHSVAAG

SEQ ID NO: 641345 - protein, 9 aa, Homo Sapiens
SSEYDEPSR

SEQ ID NO: 641346 - protein, 9 aa, Homo Sapiens
GRQKVFSTC

SEQ ID NO: 641347 - protein, 9 aa, Homo Sapiens
QNQRSEEAH

SEQ ID NO: 641348 - protein, 9 aa, Homo Sapiens
GHHKTKAFI

SEQ ID NO: 641349 - protein, 9 aa, Homo Sapiens
KVQDSVLLE

SEQ ID NO: 641350 - protein, 9 aa, Homo Sapiens
DLETGLGPW

SEQ ID NO: 641351 - protein, 9 aa, Homo Sapiens
HGLRFLRAC

SEQ ID NO: 641352 - protein, 9 aa, Homo Sapiens
ESTIVMLVL

SEQ ID NO: 641353 - protein, 9 aa, Homo Sapiens
LLFELCICQ

SEQ ID NO: 641354 - protein, 9 aa, Homo Sapiens
IASFIAESM

SEQ ID NO: 641355 - protein, 9 aa, Homo Sapiens
QKSSLIVHQ

SEQ ID NO: 641356 - protein, 9 aa, Homo Sapiens
KVELIPVQL

SEQ ID NO: 641357 - protein, 9 aa, Homo Sapiens
GGTLVKLLY

SEQ ID NO: 641358 - protein, 9 aa, Homo Sapiens
NLTSVVRIF

SEQ ID NO: 641359 - protein, 9 aa, Homo Sapiens
RKVVVTTIM

SEQ ID NO: 641360 - protein, 9 aa, Homo Sapiens
QIMSGSTIS

SEQ ID NO: 641361 - protein, 9 aa, Homo Sapiens
IYLLAAVRC

SEQ ID NO: 641362 - protein, 9 aa, Homo Sapiens
REWAEQPTK

SEQ ID NO: 641363 - protein, 9 aa, Homo Sapiens
CSLTVSELE

SEQ ID NO: 641364 - protein, 9 aa, Homo Sapiens
LGGGVSWAC

SEQ ID NO: 641365 - protein, 9 aa, Homo Sapiens
ERRSTSCKG

SEQ ID NO: 641366 - protein, 9 aa, Homo Sapiens
YPSCQKCFC

SEQ ID NO: 641367 - protein, 9 aa, Homo Sapiens
RIDPDYLGR

SEQ ID NO: 641368 - protein, 9 aa, Homo Sapiens
RREQPQRQK

SEQ ID NO: 641369 - protein, 9 aa, Homo Sapiens
AENWTTKIS

SEQ ID NO: 641370 - protein, 9 aa, Homo Sapiens
FRWHRAEKG

SEQ ID NO: 641371 - protein, 9 aa, Homo Sapiens
TLLSGIIQL

SEQ ID NO: 641372 - protein, 9 aa, Homo Sapiens
IADCTESYP

SEQ ID NO: 641373 - protein, 9 aa, Homo Sapiens
GSMGNFSDL

SEQ ID NO: 641374 - protein, 9 aa, Homo Sapiens
LRNLGNACY

SEQ ID NO: 641375 - protein, 9 aa, Homo Sapiens
NLSLEPKVQ

SEQ ID NO: 641376 - protein, 9 aa, Homo Sapiens
SQVCCNFLN

SEQ ID NO: 641377 - protein, 9 aa, Homo Sapiens
LKNAVPQNH

SEQ ID NO: 641378 - protein, 9 aa, Homo Sapiens
APGPPRRPI

SEQ ID NO: 641379 - protein, 9 aa, Homo Sapiens
GCGGSQTNT

SEQ ID NO: 641380 - protein, 9 aa, Homo Sapiens
DTSPHEDST

SEQ ID NO: 641381 - protein, 9 aa, Homo Sapiens
RAYLLKCHM

SEQ ID NO: 641382 - protein, 9 aa, Homo Sapiens
GKAASVKHR

SEQ ID NO: 641383 - protein, 9 aa, Homo Sapiens
IRYSRPGRT

SEQ ID NO: 641384 - protein, 9 aa, Homo Sapiens
WTEDGHSNI

SEQ ID NO: 641385 - protein, 9 aa, Homo Sapiens
GPRFLVTAT

SEQ ID NO: 641386 - protein, 9 aa, Homo Sapiens
AGSSGQPPS

SEQ ID NO: 641387 - protein, 9 aa, Homo Sapiens
ESLWVPGGQ

SEQ ID NO: 641388 - protein, 9 aa, Homo Sapiens
SANVLRNGN

SEQ ID NO: 641389 - protein, 9 aa, Homo Sapiens
EHPDRNDSV

SEQ ID NO: 641390 - protein, 9 aa, Homo Sapiens
PECTEAQRL

SEQ ID NO: 641391 - protein, 9 aa, Homo Sapiens
NRFCKKVPI

SEQ ID NO: 641392 - protein, 9 aa, Homo Sapiens
GTVGVPLSY

SEQ ID NO: 641393 - protein, 9 aa, Homo Sapiens
LSIRIALPG

SEQ ID NO: 641394 - protein, 9 aa, Homo Sapiens
PGKAASVKH

SEQ ID NO: 641395 - protein, 9 aa, Homo Sapiens
CACPGRERR

SEQ ID NO: 641396 - protein, 9 aa, Homo Sapiens
TALATYCMK

SEQ ID NO: 641397 - protein, 9 aa, Homo Sapiens
VTHGRENSL

SEQ ID NO: 641398 - protein, 9 aa, Homo Sapiens
SEEVIKELA

SEQ ID NO: 641399 - protein, 9 aa, Homo Sapiens
KYRHVCTYD

SEQ ID NO: 641400 - protein, 9 aa, Homo Sapiens
ASVTLLSGI

SEQ ID NO: 641401 - protein, 9 aa, Homo Sapiens
HVHTVTLPH

SEQ ID NO: 641402 - protein, 9 aa, Homo Sapiens
GLMALASST

SEQ ID NO: 641403 - protein, 9 aa, Homo Sapiens
KEVFGNTLN

SEQ ID NO: 641404 - protein, 9 aa, Homo Sapiens
CVTQGWRTS

SEQ ID NO: 641405 - protein, 9 aa, Homo Sapiens
PFWRQIRSR

SEQ ID NO: 641406 - protein, 9 aa, Homo Sapiens
VSWACSARV

SEQ ID NO: 641407 - protein, 9 aa, Homo Sapiens
EMLDMLLIT

SEQ ID NO: 641408 - protein, 9 aa, Homo Sapiens
LIVHHRTHA

SEQ ID NO: 641409 - protein, 9 aa, Homo Sapiens
LQIHLRSHN

SEQ ID NO: 641410 - protein, 9 aa, Homo Sapiens
CLDMQASPS

SEQ ID NO: 641411 - protein, 9 aa, Homo Sapiens
DLLGHHKTK

SEQ ID NO: 641412 - protein, 9 aa, Homo Sapiens
NVISLFEQK

SEQ ID NO: 641413 - protein, 9 aa, Homo Sapiens
RRVEAMPRL

SEQ ID NO: 641414 - protein, 9 aa, Homo Sapiens
ASSETPTSE

SEQ ID NO: 641415 - protein, 9 aa, Homo Sapiens
YWFLQIIAV

SEQ ID NO: 641416 - protein, 9 aa, Homo Sapiens
FTSYPFTKN

SEQ ID NO: 641417 - protein, 9 aa, Homo Sapiens
KIWNIGKCE

SEQ ID NO: 641418 - protein, 9 aa, Homo Sapiens
RFVATCSVD

SEQ ID NO: 641419 - protein, 9 aa, Homo Sapiens
EPQEAAWAQ

SEQ ID NO: 641420 - protein, 9 aa, Homo Sapiens
RYVAVCLSL

SEQ ID NO: 641421 - protein, 9 aa, Homo Sapiens
REEGSSVWW

SEQ ID NO: 641422 - protein, 9 aa, Homo Sapiens
DVLCTCTDC

SEQ ID NO: 641423 - protein, 9 aa, Homo Sapiens
LTHNANPLD

SEQ ID NO: 641424 - protein, 9 aa, Homo Sapiens
HEMLDSVPE

SEQ ID NO: 641425 - protein, 9 aa, Homo Sapiens
RPSSPAARA

SEQ ID NO: 641426 - protein, 9 aa, Homo Sapiens
ELHNPAIRE

SEQ ID NO: 641427 - protein, 9 aa, Homo Sapiens
HIIYLRPMQ

SEQ ID NO: 641428 - protein, 9 aa, Homo Sapiens
CLFQVCMAI

SEQ ID NO: 641429 - protein, 9 aa, Homo Sapiens
GCPSVFQKP

SEQ ID NO: 641430 - protein, 9 aa, Homo Sapiens
SVIYDGEER

SEQ ID NO: 641431 - protein, 9 aa, Homo Sapiens
RVTHGRENS

SEQ ID NO: 641432 - protein, 9 aa, Homo Sapiens
NKSVTPADL

SEQ ID NO: 641433 - protein, 9 aa, Homo Sapiens
KLKNAVPQN

SEQ ID NO: 641434 - protein, 9 aa, Homo Sapiens
RQKVFSTCG

SEQ ID NO: 641435 - protein, 9 aa, Homo Sapiens
CILEPSSVS

SEQ ID NO: 641436 - protein, 9 aa, Homo Sapiens
RGCPQMGHY

SEQ ID NO: 641437 - protein, 9 aa, Homo Sapiens
KVFSTCGSH

SEQ ID NO: 641438 - protein, 9 aa, Homo Sapiens
LESIFVKRS

SEQ ID NO: 641439 - protein, 9 aa, Homo Sapiens
YNMLRSPVE

SEQ ID NO: 641440 - protein, 9 aa, Homo Sapiens
GSVSSRVKG

SEQ ID NO: 641441 - protein, 9 aa, Homo Sapiens
AMRRKVELE

SEQ ID NO: 641442 - protein, 9 aa, Homo Sapiens
RESLGSFGS

SEQ ID NO: 641443 - protein, 9 aa, Homo Sapiens
YDPKTCSFQ

SEQ ID NO: 641444 - protein, 9 aa, Homo Sapiens
VDVSLWIGR

SEQ ID NO: 641445 - protein, 9 aa, Homo Sapiens
RGFNITDTT

SEQ ID NO: 641446 - protein, 9 aa, Homo Sapiens
LLNTVIYSL

SEQ ID NO: 641447 - protein, 9 aa, Homo Sapiens
PQILTRRAA

SEQ ID NO: 641448 - protein, 9 aa, Homo Sapiens
SPMQRAGIS

SEQ ID NO: 641449 - protein, 9 aa, Homo Sapiens
KLHKEEIQE

SEQ ID NO: 641450 - protein, 9 aa, Homo Sapiens
TMSCSEIPA

SEQ ID NO: 641451 - protein, 9 aa, Homo Sapiens
EDITSPRVI

SEQ ID NO: 641452 - protein, 9 aa, Homo Sapiens
QAACECLHA

SEQ ID NO: 641453 - protein, 9 aa, Homo Sapiens
SRLSLIATA

SEQ ID NO: 641454 - protein, 9 aa, Homo Sapiens
DREDLCGHA

SEQ ID NO: 641455 - protein, 9 aa, Homo Sapiens
LWRTEAIRM

SEQ ID NO: 641456 - protein, 9 aa, Homo Sapiens
KINTWKVWM

SEQ ID NO: 641457 - protein, 9 aa, Homo Sapiens
SGGAATWSP

SEQ ID NO: 641458 - protein, 9 aa, Homo Sapiens
PQSLPRATG

SEQ ID NO: 641459 - protein, 9 aa, Homo Sapiens
SARVASSAL

SEQ ID NO: 641460 - protein, 9 aa, Homo Sapiens
PDQQAYTLA

SEQ ID NO: 641461 - protein, 9 aa, Homo Sapiens
SRALWSCTW

SEQ ID NO: 641462 - protein, 9 aa, Homo Sapiens
RAPGPPRRP

SEQ ID NO: 641463 - protein, 9 aa, Homo Sapiens
RDNRYEFSD

SEQ ID NO: 641464 - protein, 9 aa, Homo Sapiens
YASVSTLLM

SEQ ID NO: 641465 - protein, 9 aa, Homo Sapiens
PPVEPLISA

SEQ ID NO: 641466 - protein, 9 aa, Homo Sapiens
VASLAFGTP

SEQ ID NO: 641467 - protein, 9 aa, Homo Sapiens
KSMPTVTNF

SEQ ID NO: 641468 - protein, 9 aa, Homo Sapiens
GTMYPSQVP

SEQ ID NO: 641469 - protein, 9 aa, Homo Sapiens
GNTLNESRD

SEQ ID NO: 641470 - protein, 9 aa, Homo Sapiens
PVCVVRDFS

SEQ ID NO: 641471 - protein, 9 aa, Homo Sapiens
VMNGVASCC

SEQ ID NO: 641472 - protein, 9 aa, Homo Sapiens
CSPEVQAPA

SEQ ID NO: 641473 - protein, 9 aa, Homo Sapiens
ASSFRSGKN

SEQ ID NO: 641474 - protein, 9 aa, Homo Sapiens
RWHRAEKGI

SEQ ID NO: 641475 - protein, 9 aa, Homo Sapiens
GAGSQHLEI

SEQ ID NO: 641476 - protein, 9 aa, Homo Sapiens
RKKKTNSCL

SEQ ID NO: 641477 - protein, 9 aa, Homo Sapiens
LLLEALVYS

SEQ ID NO: 641478 - protein, 9 aa, Homo Sapiens
VQDSVLLEK

SEQ ID NO: 641479 - protein, 9 aa, Homo Sapiens
KPGTARLPR

SEQ ID NO: 641480 - protein, 9 aa, Homo Sapiens
DSVAVLRQK

SEQ ID NO: 641481 - protein, 9 aa, Homo Sapiens
LNAGIINSF

SEQ ID NO: 641482 - protein, 9 aa, Homo Sapiens
YPECTEAQR

SEQ ID NO: 641483 - protein, 9 aa, Homo Sapiens
FRQPLFFQF

SEQ ID NO: 641484 - protein, 9 aa, Homo Sapiens
HRGTLQDGT

SEQ ID NO: 641485 - protein, 9 aa, Homo Sapiens
TGIIRPGGN

SEQ ID NO: 641486 - protein, 9 aa, Homo Sapiens
LCPFLSPLF

SEQ ID NO: 641487 - protein, 9 aa, Homo Sapiens
AVILESIFV

SEQ ID NO: 641488 - protein, 9 aa, Homo Sapiens
DFMETFNTL

SEQ ID NO: 641489 - protein, 9 aa, Homo Sapiens
AVSCFLTRG

SEQ ID NO: 641490 - protein, 9 aa, Homo Sapiens
TLVWLDNTA

SEQ ID NO: 641491 - protein, 9 aa, Homo Sapiens
LSYTDCAPS

SEQ ID NO: 641492 - protein, 9 aa, Homo Sapiens
PGVLPGHAG

SEQ ID NO: 641493 - protein, 9 aa, Homo Sapiens
SRRKAFNTC

SEQ ID NO: 641494 - protein, 9 aa, Homo Sapiens
DSNLGIIGH

SEQ ID NO: 641495 - protein, 9 aa, Homo Sapiens
FSYRANLAQ

SEQ ID NO: 641496 - protein, 9 aa, Homo Sapiens
QSPAEPTEN

SEQ ID NO: 641497 - protein, 9 aa, Homo Sapiens
IQASMFDQK

SEQ ID NO: 641498 - protein, 9 aa, Homo Sapiens
VELFGQVVS

SEQ ID NO: 641499 - protein, 9 aa, Homo Sapiens
RRRAAQRAL

SEQ ID NO: 641500 - protein, 9 aa, Homo Sapiens
VCLLAISSS

SEQ ID NO: 641501 - protein, 9 aa, Homo Sapiens
PKDGEAEQC

SEQ ID NO: 641502 - protein, 9 aa, Homo Sapiens
NMLRSPVEM

SEQ ID NO: 641503 - protein, 9 aa, Homo Sapiens
LYWAANVYG

SEQ ID NO: 641504 - protein, 9 aa, Homo Sapiens
RFQAQQSVD

SEQ ID NO: 641505 - protein, 9 aa, Homo Sapiens
VTEVPCSPE

SEQ ID NO: 641506 - protein, 9 aa, Homo Sapiens
AAQLTHNAN

SEQ ID NO: 641507 - protein, 9 aa, Homo Sapiens
LGCILRTFK

SEQ ID NO: 641508 - protein, 9 aa, Homo Sapiens
FLGCMMQFY

SEQ ID NO: 641509 - protein, 9 aa, Homo Sapiens
VFGNTLNES

SEQ ID NO: 641510 - protein, 9 aa, Homo Sapiens
PTALDQVQQ

SEQ ID NO: 641511 - protein, 9 aa, Homo Sapiens
RTGRLHPAG

SEQ ID NO: 641512 - protein, 9 aa, Homo Sapiens
KKKPISCLG

SEQ ID NO: 641513 - protein, 9 aa, Homo Sapiens
HPSSGTPSP

SEQ ID NO: 641514 - protein, 9 aa, Homo Sapiens
LGVAIVEIV

SEQ ID NO: 641515 - protein, 9 aa, Homo Sapiens
ILEDSDLDG

SEQ ID NO: 641516 - protein, 9 aa, Homo Sapiens
GVSLVLPVV

SEQ ID NO: 641517 - protein, 9 aa, Homo Sapiens
ACPRQVLFP

SEQ ID NO: 641518 - protein, 9 aa, Homo Sapiens
LCPSLKRCL

SEQ ID NO: 641519 - protein, 9 aa, Homo Sapiens
LKLGSVEEF

SEQ ID NO: 641520 - protein, 9 aa, Homo Sapiens
RSHTCERPF

SEQ ID NO: 641521 - protein, 9 aa, Homo Sapiens
QVCCNFLNM

SEQ ID NO: 641522 - protein, 9 aa, Homo Sapiens
YPSQVPEHW

SEQ ID NO: 641523 - protein, 9 aa, Homo Sapiens
LHACSSLYD

SEQ ID NO: 641524 - protein, 9 aa, Homo Sapiens
VEAMPRLRN

SEQ ID NO: 641525 - protein, 9 aa, Homo Sapiens
SADSKHHVT

SEQ ID NO: 641526 - protein, 9 aa, Homo Sapiens
QGASVNSIS

SEQ ID NO: 641527 - protein, 9 aa, Homo Sapiens
VVFDENKSW

SEQ ID NO: 641528 - protein, 9 aa, Homo Sapiens
GAAADDVVY

SEQ ID NO: 641529 - protein, 9 aa, Homo Sapiens
PMKLTEMAW

SEQ ID NO: 641530 - protein, 9 aa, Homo Sapiens
SVRESFHRG

SEQ ID NO: 641531 - protein, 9 aa, Homo Sapiens
EMAWRVCFH

SEQ ID NO: 641532 - protein, 9 aa, Homo Sapiens
TPTSSASSE

SEQ ID NO: 641533 - protein, 9 aa, Homo Sapiens
EQNQRSEEA

SEQ ID NO: 641534 - protein, 9 aa, Homo Sapiens
PGGAVGNRH

SEQ ID NO: 641535 - protein, 9 aa, Homo Sapiens
WPHNGEVRT

SEQ ID NO: 641536 - protein, 9 aa, Homo Sapiens
WQQADGYVG

SEQ ID NO: 641537 - protein, 9 aa, Homo Sapiens
HYGVPIPVP

SEQ ID NO: 641538 - protein, 9 aa, Homo Sapiens
SENETAKDI

SEQ ID NO: 641539 - protein, 9 aa, Homo Sapiens
FGFIHPERD

SEQ ID NO: 641540 - protein, 9 aa, Homo Sapiens
LIGSGLMAL

SEQ ID NO: 641541 - protein, 9 aa, Homo Sapiens
LYRKSCQRR

SEQ ID NO: 641542 - protein, 9 aa, Homo Sapiens
VTFINKVAS

SEQ ID NO: 641543 - protein, 9 aa, Homo Sapiens
DAYQDPHFD

SEQ ID NO: 641544 - protein, 9 aa, Homo Sapiens
VQQGSMGNF

SEQ ID NO: 641545 - protein, 9 aa, Homo Sapiens
RHVCTYDPK

SEQ ID NO: 641546 - protein, 9 aa, Homo Sapiens
CCNDMTVRR

SEQ ID NO: 641547 - protein, 9 aa, Homo Sapiens
LLLSIRGLS

SEQ ID NO: 641548 - protein, 9 aa, Homo Sapiens
KLDQIQSGC

SEQ ID NO: 641549 - protein, 9 aa, Homo Sapiens
RNKHIKTFS

SEQ ID NO: 641550 - protein, 9 aa, Homo Sapiens
HGRENSLIE

SEQ ID NO: 641551 - protein, 9 aa, Homo Sapiens
FSSTPCATR

SEQ ID NO: 641552 - protein, 9 aa, Homo Sapiens
SKVWNDLRL

SEQ ID NO: 641553 - protein, 9 aa, Homo Sapiens
LCVNVSGSF

SEQ ID NO: 641554 - protein, 9 aa, Homo Sapiens
TPCATRVGN

SEQ ID NO: 641555 - protein, 9 aa, Homo Sapiens
EVVLYHKLE

SEQ ID NO: 641556 - protein, 9 aa, Homo Sapiens
VLVPPLLDD

SEQ ID NO: 641557 - protein, 9 aa, Homo Sapiens
PCPSRGCPQ

SEQ ID NO: 641558 - protein, 9 aa, Homo Sapiens
GEVLYSFSI

SEQ ID NO: 641559 - protein, 9 aa, Homo Sapiens
HAEPCVLRF

SEQ ID NO: 641560 - protein, 9 aa, Homo Sapiens
HLSVDNEHS

SEQ ID NO: 641561 - protein, 9 aa, Homo Sapiens
TNFLVAPLA

SEQ ID NO: 641562 - protein, 9 aa, Homo Sapiens
MKEIDKTSF

SEQ ID NO: 641563 - protein, 9 aa, Homo Sapiens
EENGGQHRA

SEQ ID NO: 641564 - protein, 9 aa, Homo Sapiens
TRFGEVANE

SEQ ID NO: 641565 - protein, 9 aa, Homo Sapiens
RSLPVFQAR

SEQ ID NO: 641566 - protein, 9 aa, Homo Sapiens
AQAVSPQAV

SEQ ID NO: 641567 - protein, 9 aa, Homo Sapiens
ACPGRERRT

SEQ ID NO: 641568 - protein, 9 aa, Homo Sapiens
LLGAIAVDR

SEQ ID NO: 641569 - protein, 9 aa, Homo Sapiens
TSEEVIKEL

SEQ ID NO: 641570 - protein, 9 aa, Homo Sapiens
LMTNLRSSH

SEQ ID NO: 641571 - protein, 9 aa, Homo Sapiens
KDSRRKHGR

SEQ ID NO: 641572 - protein, 9 aa, Homo Sapiens
TWSWRGSQA

SEQ ID NO: 641573 - protein, 9 aa, Homo Sapiens
SYLYESLSE

SEQ ID NO: 641574 - protein, 9 aa, Homo Sapiens
SAYTFIPLN

SEQ ID NO: 641575 - protein, 9 aa, Homo Sapiens
LTEMAWRVC

SEQ ID NO: 641576 - protein, 9 aa, Homo Sapiens
TVAEAGRRL

SEQ ID NO: 641577 - protein, 9 aa, Homo Sapiens
WKVWMSTAL

SEQ ID NO: 641578 - protein, 9 aa, Homo Sapiens
ATPWARLLL

SEQ ID NO: 641579 - protein, 9 aa, Homo Sapiens
QASAPRMVQ

SEQ ID NO: 641580 - protein, 9 aa, Homo Sapiens
APAFCCAPY

SEQ ID NO: 641581 - protein, 9 aa, Homo Sapiens
QDLDSTPPP

SEQ ID NO: 641582 - protein, 9 aa, Homo Sapiens
DGGNPFPDV

SEQ ID NO: 641583 - protein, 9 aa, Homo Sapiens
FEQASSGSH

SEQ ID NO: 641584 - protein, 9 aa, Homo Sapiens
DSEVEAPAV

SEQ ID NO: 641585 - protein, 9 aa, Homo Sapiens
HHRHQSRGA

SEQ ID NO: 641586 - protein, 9 aa, Homo Sapiens
FIKIDGKVL

SEQ ID NO: 641587 - protein, 9 aa, Homo Sapiens
GFLSLALSF

SEQ ID NO: 641588 - protein, 9 aa, Homo Sapiens
SPAPPPSTA

SEQ ID NO: 641589 - protein, 9 aa, Homo Sapiens
MMHSSAGAE

SEQ ID NO: 641590 - protein, 9 aa, Homo Sapiens
SRTPESFAQ

SEQ ID NO: 641591 - protein, 9 aa, Homo Sapiens
GYRMIDELN

SEQ ID NO: 641592 - protein, 9 aa, Homo Sapiens
DHLGRNNGN

SEQ ID NO: 641593 - protein, 9 aa, Homo Sapiens
SSLQANSWK

SEQ ID NO: 641594 - protein, 9 aa, Homo Sapiens
ATPPSLGSV

SEQ ID NO: 641595 - protein, 9 aa, Homo Sapiens
GYLLLEALV

SEQ ID NO: 641596 - protein, 9 aa, Homo Sapiens
VIQASMFDQ

SEQ ID NO: 641597 - protein, 9 aa, Homo Sapiens
MGNFSDLHI

SEQ ID NO: 641598 - protein, 9 aa, Homo Sapiens
VLPQLKESE

SEQ ID NO: 641599 - protein, 9 aa, Homo Sapiens
LTRRAAVCG

SEQ ID NO: 641600 - protein, 9 aa, Homo Sapiens
VVRDFSAPL

SEQ ID NO: 641601 - protein, 9 aa, Homo Sapiens
DQQAYTLAL

SEQ ID NO: 641602 - protein, 9 aa, Homo Sapiens
PGKPCQMGN

SEQ ID NO: 641603 - protein, 9 aa, Homo Sapiens
VDNEHSGQG

SEQ ID NO: 641604 - protein, 9 aa, Homo Sapiens
ESFHRGLQS

SEQ ID NO: 641605 - protein, 9 aa, Homo Sapiens
FKSMPTVTN

SEQ ID NO: 641606 - protein, 9 aa, Homo Sapiens
MEYCVCGMH

SEQ ID NO: 641607 - protein, 9 aa, Homo Sapiens
RPSYPGMDS

SEQ ID NO: 641608 - protein, 9 aa, Homo Sapiens
NLQGSTLSL

SEQ ID NO: 641609 - protein, 9 aa, Homo Sapiens
FCRMKMSSG

SEQ ID NO: 641610 - protein, 9 aa, Homo Sapiens
PNFGVGFPI

SEQ ID NO: 641611 - protein, 9 aa, Homo Sapiens
MSTALATYC

SEQ ID NO: 641612 - protein, 9 aa, Homo Sapiens
SHDDRLSQS

SEQ ID NO: 641613 - protein, 9 aa, Homo Sapiens
EERAASERL

SEQ ID NO: 641614 - protein, 9 aa, Homo Sapiens
FTVTIEDLM

SEQ ID NO: 641615 - protein, 9 aa, Homo Sapiens
SVVSVQSGQ

SEQ ID NO: 641616 - protein, 9 aa, Homo Sapiens
RCIGAELGL

SEQ ID NO: 641617 - protein, 9 aa, Homo Sapiens
FVATCSVDK

SEQ ID NO: 641618 - protein, 9 aa, Homo Sapiens
DSKHHVTFI

SEQ ID NO: 641619 - protein, 9 aa, Homo Sapiens
PFAVDVSLW

SEQ ID NO: 641620 - protein, 9 aa, Homo Sapiens
RGNPVPQHY

SEQ ID NO: 641621 - protein, 9 aa, Homo Sapiens
SRLRRSGRC

SEQ ID NO: 641622 - protein, 9 aa, Homo Sapiens
FGGDPSKKD

SEQ ID NO: 641623 - protein, 9 aa, Homo Sapiens
ESPPVAEAV

SEQ ID NO: 641624 - protein, 9 aa, Homo Sapiens
YNFCSRNKY

SEQ ID NO: 641625 - protein, 9 aa, Homo Sapiens
IRFMLEPDS

SEQ ID NO: 641626 - protein, 9 aa, Homo Sapiens
QQLRRTRCL

SEQ ID NO: 641627 - protein, 9 aa, Homo Sapiens
IGAELGLDC

SEQ ID NO: 641628 - protein, 9 aa, Homo Sapiens
NCHLQECAK

SEQ ID NO: 641629 - protein, 9 aa, Homo Sapiens
LQIIAVVLG

SEQ ID NO: 641630 - protein, 9 aa, Homo Sapiens
YTEEANGNT

SEQ ID NO: 641631 - protein, 9 aa, Homo Sapiens
HILYCKCSM

SEQ ID NO: 641632 - protein, 9 aa, Homo Sapiens
LLELQQIKI

SEQ ID NO: 641633 - protein, 9 aa, Homo Sapiens
SKRKAHILN

SEQ ID NO: 641634 - protein, 9 aa, Homo Sapiens
LNGSQLVIH

SEQ ID NO: 641635 - protein, 9 aa, Homo Sapiens
DKLFPLLLQ

SEQ ID NO: 641636 - protein, 9 aa, Homo Sapiens
AFAIILLKT

SEQ ID NO: 641637 - protein, 9 aa, Homo Sapiens
GAVLPIPVP

SEQ ID NO: 641638 - protein, 9 aa, Homo Sapiens
KGEMGHPGP

SEQ ID NO: 641639 - protein, 9 aa, Homo Sapiens
IGAAAHPPM

SEQ ID NO: 641640 - protein, 9 aa, Homo Sapiens
TDCHGIRCA

SEQ ID NO: 641641 - protein, 9 aa, Homo Sapiens
VISHTEFEV

SEQ ID NO: 641642 - protein, 9 aa, Homo Sapiens
LYSFSIYVP

SEQ ID NO: 641643 - protein, 9 aa, Homo Sapiens
KPIVGLGTW

SEQ ID NO: 641644 - protein, 9 aa, Homo Sapiens
ISAASPGPP

SEQ ID NO: 641645 - protein, 9 aa, Homo Sapiens
KNAGSLSSS

SEQ ID NO: 641646 - protein, 9 aa, Homo Sapiens
SLVIAFILT

SEQ ID NO: 641647 - protein, 9 aa, Homo Sapiens
DWYRLTHND

SEQ ID NO: 641648 - protein, 9 aa, Homo Sapiens
ADAWKPQRK

SEQ ID NO: 641649 - protein, 9 aa, Homo Sapiens
GSGGSHDGA

SEQ ID NO: 641650 - protein, 9 aa, Homo Sapiens
LAAVRCEQW

SEQ ID NO: 641651 - protein, 9 aa, Homo Sapiens
SLFEQKKEP

SEQ ID NO: 641652 - protein, 9 aa, Homo Sapiens
AIVEIVNNS

SEQ ID NO: 641653 - protein, 9 aa, Homo Sapiens
AAAAAAEGT

SEQ ID NO: 641654 - protein, 9 aa, Homo Sapiens
LTLGNLKPE

SEQ ID NO: 641655 - protein, 9 aa, Homo Sapiens
PLPTDCAWE

SEQ ID NO: 641656 - protein, 9 aa, Homo Sapiens
AVLWLWAPI

SEQ ID NO: 641657 - protein, 9 aa, Homo Sapiens
SGTVGVPLS

SEQ ID NO: 641658 - protein, 9 aa, Homo Sapiens
FYEFRHRPK

SEQ ID NO: 641659 - protein, 9 aa, Homo Sapiens
QDGVAGREQ

SEQ ID NO: 641660 - protein, 9 aa, Homo Sapiens
PHEDSTTSR

SEQ ID NO: 641661 - protein, 9 aa, Homo Sapiens
LESLWVPGG

SEQ ID NO: 641662 - protein, 9 aa, Homo Sapiens
VKHMRDQNN

SEQ ID NO: 641663 - protein, 9 aa, Homo Sapiens
DTSMLKRPV

SEQ ID NO: 641664 - protein, 9 aa, Homo Sapiens
THSVACLAI

SEQ ID NO: 641665 - protein, 9 aa, Homo Sapiens
TAFVACEDS

SEQ ID NO: 641666 - protein, 9 aa, Homo Sapiens
FRIATPPSL

SEQ ID NO: 641667 - protein, 9 aa, Homo Sapiens
SHIPFDPYA

SEQ ID NO: 641668 - protein, 9 aa, Homo Sapiens
GQAEVLKVL

SEQ ID NO: 641669 - protein, 9 aa, Homo Sapiens
TSGLPAHAY

SEQ ID NO: 641670 - protein, 9 aa, Homo Sapiens
ALPTVVLEI

SEQ ID NO: 641671 - protein, 9 aa, Homo Sapiens
MMQFYLFCT

SEQ ID NO: 641672 - protein, 9 aa, Homo Sapiens
VELIPVQLE

SEQ ID NO: 641673 - protein, 9 aa, Homo Sapiens
SKPFAVDVS

SEQ ID NO: 641674 - protein, 9 aa, Homo Sapiens
IKFKSMPTV

SEQ ID NO: 641675 - protein, 9 aa, Homo Sapiens
STPCATRVG

SEQ ID NO: 641676 - protein, 9 aa, Homo Sapiens
NTWKVWMST

SEQ ID NO: 641677 - protein, 9 aa, Homo Sapiens
SEKRLTKLL

SEQ ID NO: 641678 - protein, 9 aa, Homo Sapiens
AQQGTVITL

SEQ ID NO: 641679 - protein, 9 aa, Homo Sapiens
VLECSFDFP

SEQ ID NO: 641680 - protein, 9 aa, Homo Sapiens
CGRHIATDL

SEQ ID NO: 641681 - protein, 9 aa, Homo Sapiens
GVAIVEIVN

SEQ ID NO: 641682 - protein, 9 aa, Homo Sapiens
PAAEDLREP

SEQ ID NO: 641683 - protein, 9 aa, Homo Sapiens
PLLLLRYLT

SEQ ID NO: 641684 - protein, 9 aa, Homo Sapiens
DTEGSKQPS

SEQ ID NO: 641685 - protein, 9 aa, Homo Sapiens
QKVIQASMF

SEQ ID NO: 641686 - protein, 9 aa, Homo Sapiens
IACLVMAQL

SEQ ID NO: 641687 - protein, 9 aa, Homo Sapiens
STGAPGKPC

SEQ ID NO: 641688 - protein, 9 aa, Homo Sapiens
RKGKQYLLG

SEQ ID NO: 641689 - protein, 9 aa, Homo Sapiens
TPHGLRFLR

SEQ ID NO: 641690 - protein, 9 aa, Homo Sapiens
HLGQSLLAK

SEQ ID NO: 641691 - protein, 9 aa, Homo Sapiens
LMPCFLTFP

SEQ ID NO: 641692 - protein, 9 aa, Homo Sapiens
LTDNGNAPP

SEQ ID NO: 641693 - protein, 9 aa, Homo Sapiens
SSALCKASR

SEQ ID NO: 641694 - protein, 9 aa, Homo Sapiens
NDPFTSYPF

SEQ ID NO: 641695 - protein, 9 aa, Homo Sapiens
QACTTTPCM

SEQ ID NO: 641696 - protein, 9 aa, Homo Sapiens
RGAILQDAI

SEQ ID NO: 641697 - protein, 9 aa, Homo Sapiens
FSIAINNLS

SEQ ID NO: 641698 - protein, 9 aa, Homo Sapiens
RGNLQGSTL

SEQ ID NO: 641699 - protein, 9 aa, Homo Sapiens
VPFLLSSEY

SEQ ID NO: 641700 - protein, 9 aa, Homo Sapiens
QKKKPISCL

SEQ ID NO: 641701 - protein, 9 aa, Homo Sapiens
IHFRWHRAE

SEQ ID NO: 641702 - protein, 9 aa, Homo Sapiens
PHSRLRRSG

SEQ ID NO: 641703 - protein, 9 aa, Homo Sapiens
AADDVVYTV

SEQ ID NO: 641704 - protein, 9 aa, Homo Sapiens
QELEDGGVR

SEQ ID NO: 641705 - protein, 9 aa, Homo Sapiens
STECFFLEV

SEQ ID NO: 641706 - protein, 9 aa, Homo Sapiens
RRTIIAKRE

SEQ ID NO: 641707 - protein, 9 aa, Homo Sapiens
IAMITLNNS

SEQ ID NO: 641708 - protein, 9 aa, Homo Sapiens
DTGEVWLRQ

SEQ ID NO: 641709 - protein, 9 aa, Homo Sapiens
TREWAEQPT

SEQ ID NO: 641710 - protein, 9 aa, Homo Sapiens
AGERPYGCD

SEQ ID NO: 641711 - protein, 9 aa, Homo Sapiens
VVGEERLSL

SEQ ID NO: 641712 - protein, 9 aa, Homo Sapiens
PKCPESYAT

SEQ ID NO: 641713 - protein, 9 aa, Homo Sapiens
LVPPLLDDP

SEQ ID NO: 641714 - protein, 9 aa, Homo Sapiens
PPVGTKSNR

SEQ ID NO: 641715 - protein, 9 aa, Homo Sapiens
LPRLSVWVR

SEQ ID NO: 641716 - protein, 9 aa, Homo Sapiens
LPNLPRLSV

SEQ ID NO: 641717 - protein, 9 aa, Homo Sapiens
KNKAGKESI

SEQ ID NO: 641718 - protein, 9 aa, Homo Sapiens
EKRCDSETE

SEQ ID NO: 641719 - protein, 9 aa, Homo Sapiens
SGAGSTCQI

SEQ ID NO: 641720 - protein, 9 aa, Homo Sapiens
FDYHSRLSL

SEQ ID NO: 641721 - protein, 9 aa, Homo Sapiens
APLAAAIRY

SEQ ID NO: 641722 - protein, 9 aa, Homo Sapiens
VSSRVKGPR

SEQ ID NO: 641723 - protein, 9 aa, Homo Sapiens
LDMQASPSP

SEQ ID NO: 641724 - protein, 9 aa, Homo Sapiens
PSPAPPPST

SEQ ID NO: 641725 - protein, 9 aa, Homo Sapiens
QNDIEEVKG

SEQ ID NO: 641726 - protein, 9 aa, Homo Sapiens
EVIISQEKE

SEQ ID NO: 641727 - protein, 9 aa, Homo Sapiens
KYHIQACTT

SEQ ID NO: 641728 - protein, 9 aa, Homo Sapiens
VALNFANGE

SEQ ID NO: 641729 - protein, 9 aa, Homo Sapiens
YTNLPERPS

SEQ ID NO: 641730 - protein, 9 aa, Homo Sapiens
AQLQSQLRR

SEQ ID NO: 641731 - protein, 9 aa, Homo Sapiens
GDTSMLKRP

SEQ ID NO: 641732 - protein, 9 aa, Homo Sapiens
HEATPWARL

SEQ ID NO: 641733 - protein, 9 aa, Homo Sapiens
VLDSVSGNV

SEQ ID NO: 641734 - protein, 9 aa, Homo Sapiens
RFGEVANEV

SEQ ID NO: 641735 - protein, 9 aa, Homo Sapiens
RKPGDHLVI

SEQ ID NO: 641736 - protein, 9 aa, Homo Sapiens
DIEEVKGQE

SEQ ID NO: 641737 - protein, 9 aa, Homo Sapiens
SMGNFSDLH

SEQ ID NO: 641738 - protein, 9 aa, Homo Sapiens
QDVTLRNLS

SEQ ID NO: 641739 - protein, 9 aa, Homo Sapiens
NAVPQNHFL

SEQ ID NO: 641740 - protein, 9 aa, Homo Sapiens
PLLRTGRLH

SEQ ID NO: 641741 - protein, 9 aa, Homo Sapiens
PQHYLWEKE

SEQ ID NO: 641742 - protein, 9 aa, Homo Sapiens
VLCTCTDCH

SEQ ID NO: 641743 - protein, 9 aa, Homo Sapiens
GNIAERTFC

SEQ ID NO: 641744 - protein, 9 aa, Homo Sapiens
EPLFQELQP

SEQ ID NO: 641745 - protein, 9 aa, Homo Sapiens
VIYWFLQII

SEQ ID NO: 641746 - protein, 9 aa, Homo Sapiens
VTLNFSEVK

SEQ ID NO: 641747 - protein, 9 aa, Homo Sapiens
DRDFMETFN

SEQ ID NO: 641748 - protein, 9 aa, Homo Sapiens
PLANENTTQ

SEQ ID NO: 641749 - protein, 9 aa, Homo Sapiens
RRFFSLTES

SEQ ID NO: 641750 - protein, 9 aa, Homo Sapiens
RAQLQSQLR

SEQ ID NO: 641751 - protein, 9 aa, Homo Sapiens
QLADGSVDV

SEQ ID NO: 641752 - protein, 9 aa, Homo Sapiens
TKSEKVVQE

SEQ ID NO: 641753 - protein, 9 aa, Homo Sapiens
EGSKQPSAS

SEQ ID NO: 641754 - protein, 9 aa, Homo Sapiens
NRHRPDSRT

SEQ ID NO: 641755 - protein, 9 aa, Homo Sapiens
AVERLLKKL

SEQ ID NO: 641756 - protein, 9 aa, Homo Sapiens
VCGMHEMLD

SEQ ID NO: 641757 - protein, 9 aa, Homo Sapiens
AEQPTKMGR

SEQ ID NO: 641758 - protein, 9 aa, Homo Sapiens
SLKNAGSLS

SEQ ID NO: 641759 - protein, 9 aa, Homo Sapiens
EILYSALPT

SEQ ID NO: 641760 - protein, 9 aa, Homo Sapiens
LLFIIDSFN

SEQ ID NO: 641761 - protein, 9 aa, Homo Sapiens
CPTCGKCFI

SEQ ID NO: 641762 - protein, 9 aa, Homo Sapiens
HLGRNNGNG

SEQ ID NO: 641763 - protein, 9 aa, Homo Sapiens
RQLAESWRA

SEQ ID NO: 641764 - protein, 9 aa, Homo Sapiens
TFNCHLQEC

SEQ ID NO: 641765 - protein, 9 aa, Homo Sapiens
AEYRHIDSA

SEQ ID NO: 641766 - protein, 9 aa, Homo Sapiens
TDVLNVLTA

SEQ ID NO: 641767 - protein, 9 aa, Homo Sapiens
DGDRLITEH

SEQ ID NO: 641768 - protein, 9 aa, Homo Sapiens
NLVVSVLRG

SEQ ID NO: 641769 - protein, 9 aa, Homo Sapiens
IGSGLMALA

SEQ ID NO: 641770 - protein, 9 aa, Homo Sapiens
IIDWYRLTH

SEQ ID NO: 641771 - protein, 9 aa, Homo Sapiens
WETGAMVRC

SEQ ID NO: 641772 - protein, 9 aa, Homo Sapiens
RARRCPGVL

SEQ ID NO: 641773 - protein, 9 aa, Homo Sapiens
WRTEAIRME

SEQ ID NO: 641774 - protein, 9 aa, Homo Sapiens
EPKLQKFLK

SEQ ID NO: 641775 - protein, 9 aa, Homo Sapiens
LSNNTGRIK

SEQ ID NO: 641776 - protein, 9 aa, Homo Sapiens
QTLDSKLKN

SEQ ID NO: 641777 - protein, 9 aa, Homo Sapiens
DRFAKQAMR

SEQ ID NO: 641778 - protein, 9 aa, Homo Sapiens
YPSYNGAII

SEQ ID NO: 641779 - protein, 9 aa, Homo Sapiens
NGGQHRAAN

SEQ ID NO: 641780 - protein, 9 aa, Homo Sapiens
SRNKYKLTA

SEQ ID NO: 641781 - protein, 9 aa, Homo Sapiens
SCAQRRRAC

SEQ ID NO: 641782 - protein, 9 aa, Homo Sapiens
CQKCFCRII

SEQ ID NO: 641783 - protein, 9 aa, Homo Sapiens
AIENRKVVV

SEQ ID NO: 641784 - protein, 9 aa, Homo Sapiens
NHSENETAK

SEQ ID NO: 641785 - protein, 9 aa, Homo Sapiens
ISHTQGQMW

SEQ ID NO: 641786 - protein, 9 aa, Homo Sapiens
DGRREQPQR

SEQ ID NO: 641787 - protein, 9 aa, Homo Sapiens
NSWKMAVLF

SEQ ID NO: 641788 - protein, 9 aa, Homo Sapiens
TRCLLLSIR

SEQ ID NO: 641789 - protein, 9 aa, Homo Sapiens
LDTKSEKVV

SEQ ID NO: 641790 - protein, 9 aa, Homo Sapiens
QQAYTLALL

SEQ ID NO: 641791 - protein, 9 aa, Homo Sapiens
LMLELGCIL

SEQ ID NO: 641792 - protein, 9 aa, Homo Sapiens
KRLWFLLPD

SEQ ID NO: 641793 - protein, 9 aa, Homo Sapiens
SIHEWIQMD

SEQ ID NO: 641794 - protein, 9 aa, Homo Sapiens
DMMLHKIYI

SEQ ID NO: 641795 - protein, 9 aa, Homo Sapiens
QRPQDRPSY

SEQ ID NO: 641796 - protein, 9 aa, Homo Sapiens
IALPGDKQH

SEQ ID NO: 641797 - protein, 9 aa, Homo Sapiens
PSCQKCFCR

SEQ ID NO: 641798 - protein, 9 aa, Homo Sapiens
SRPCSLTVS

SEQ ID NO: 641799 - protein, 9 aa, Homo Sapiens
GDKFIPCEK

SEQ ID NO: 641800 - protein, 9 aa, Homo Sapiens
QGMSKNRLL

SEQ ID NO: 641801 - protein, 9 aa, Homo Sapiens
EDLCGHAEP

SEQ ID NO: 641802 - protein, 9 aa, Homo Sapiens
DEQGMSKNR

SEQ ID NO: 641803 - protein, 9 aa, Homo Sapiens
SQAIMHEPM

SEQ ID NO: 641804 - protein, 9 aa, Homo Sapiens
HIRSHTCER

SEQ ID NO: 641805 - protein, 9 aa, Homo Sapiens
RQLYPECTE

SEQ ID NO: 641806 - protein, 9 aa, Homo Sapiens
CCLGIMPMR

SEQ ID NO: 641807 - protein, 9 aa, Homo Sapiens
ERDGDVQFS

SEQ ID NO: 641808 - protein, 9 aa, Homo Sapiens
CGNTTLSGC

SEQ ID NO: 641809 - protein, 9 aa, Homo Sapiens
AHAYAQLSP

SEQ ID NO: 641810 - protein, 9 aa, Homo Sapiens
VTRFGEVAN

SEQ ID NO: 641811 - protein, 9 aa, Homo Sapiens
RANLAQHGK

SEQ ID NO: 641812 - protein, 9 aa, Homo Sapiens
CHGIRCAFG

SEQ ID NO: 641813 - protein, 9 aa, Homo Sapiens
RPTASMAQV

SEQ ID NO: 641814 - protein, 9 aa, Homo Sapiens
LKTKQIRKA

SEQ ID NO: 641815 - protein, 9 aa, Homo Sapiens
VNAMKRNKH

SEQ ID NO: 641816 - protein, 9 aa, Homo Sapiens
TPDIRSLAF

SEQ ID NO: 641817 - protein, 9 aa, Homo Sapiens
NGSVFSIAI

SEQ ID NO: 641818 - protein, 9 aa, Homo Sapiens
LPERPSSVL

SEQ ID NO: 641819 - protein, 9 aa, Homo Sapiens
SALDTKSEK

SEQ ID NO: 641820 - protein, 9 aa, Homo Sapiens
RLGHKGEGF

SEQ ID NO: 641821 - protein, 9 aa, Homo Sapiens
VEHGPGLGL

SEQ ID NO: 641822 - protein, 9 aa, Homo Sapiens
QYTNLPERP

SEQ ID NO: 641823 - protein, 9 aa, Homo Sapiens
KLTEMAWRV

SEQ ID NO: 641824 - protein, 9 aa, Homo Sapiens
LKCSVPLGH

SEQ ID NO: 641825 - protein, 9 aa, Homo Sapiens
VPGPDVLCT

SEQ ID NO: 641826 - protein, 9 aa, Homo Sapiens
HKDTGDTSM

SEQ ID NO: 641827 - protein, 9 aa, Homo Sapiens
QRYLLKCSV

SEQ ID NO: 641828 - protein, 9 aa, Homo Sapiens
REKDYLAPS

SEQ ID NO: 641829 - protein, 9 aa, Homo Sapiens
LKNDLGNHR

SEQ ID NO: 641830 - protein, 9 aa, Homo Sapiens
ELQQIKIWN

SEQ ID NO: 641831 - protein, 9 aa, Homo Sapiens
TSAYTFIPL

SEQ ID NO: 641832 - protein, 9 aa, Homo Sapiens
ASAWDAGPG

SEQ ID NO: 641833 - protein, 9 aa, Homo Sapiens
PGREGRDLG

SEQ ID NO: 641834 - protein, 9 aa, Homo Sapiens
WLSLDTMKR

SEQ ID NO: 641835 - protein, 9 aa, Homo Sapiens
HYLWEKEGS

SEQ ID NO: 641836 - protein, 9 aa, Homo Sapiens
KDTGDTSML

SEQ ID NO: 641837 - protein, 9 aa, Homo Sapiens
QQRDWGGAA

SEQ ID NO: 641838 - protein, 9 aa, Homo Sapiens
ELCQLGFWW

SEQ ID NO: 641839 - protein, 9 aa, Homo Sapiens
PERDGDVQF

SEQ ID NO: 641840 - protein, 9 aa, Homo Sapiens
SVRILDRCS

SEQ ID NO: 641841 - protein, 9 aa, Homo Sapiens
SYATQQRPA

SEQ ID NO: 641842 - protein, 9 aa, Homo Sapiens
IPCEKRCDS

SEQ ID NO: 641843 - protein, 9 aa, Homo Sapiens
ILEPSSVSQ

SEQ ID NO: 641844 - protein, 9 aa, Homo Sapiens
TTLSGCKWK

SEQ ID NO: 641845 - protein, 9 aa, Homo Sapiens
TSVVRIFLH

SEQ ID NO: 641846 - protein, 9 aa, Homo Sapiens
AVRCEQWTP

SEQ ID NO: 641847 - protein, 9 aa, Homo Sapiens
DPRQIAPCR

SEQ ID NO: 641848 - protein, 9 aa, Homo Sapiens
LRMPPERNH

SEQ ID NO: 641849 - protein, 9 aa, Homo Sapiens
TKPNVISLF

SEQ ID NO: 641850 - protein, 9 aa, Homo Sapiens
AAMASFPET

SEQ ID NO: 641851 - protein, 9 aa, Homo Sapiens
IPLGLEIHT

SEQ ID NO: 641852 - protein, 9 aa, Homo Sapiens
GLSSLGEHL

SEQ ID NO: 641853 - protein, 9 aa, Homo Sapiens
NYRYGPPVA

SEQ ID NO: 641854 - protein, 9 aa, Homo Sapiens
ALQATHSVA

SEQ ID NO: 641855 - protein, 9 aa, Homo Sapiens
TASRPPSKL

SEQ ID NO: 641856 - protein, 9 aa, Homo Sapiens
AEKSLRRAE

SEQ ID NO: 641857 - protein, 9 aa, Homo Sapiens
SYRANLAQH

SEQ ID NO: 641858 - protein, 9 aa, Homo Sapiens
KAGSSGQPP

SEQ ID NO: 641859 - protein, 9 aa, Homo Sapiens
AFLPPSPTA

SEQ ID NO: 641860 - protein, 9 aa, Homo Sapiens
DEIEHPAGD

SEQ ID NO: 641861 - protein, 9 aa, Homo Sapiens
LLRYLTWRA

SEQ ID NO: 641862 - protein, 9 aa, Homo Sapiens
MVTEVPCSP

SEQ ID NO: 641863 - protein, 9 aa, Homo Sapiens
AQQSVDILE

SEQ ID NO: 641864 - protein, 9 aa, Homo Sapiens
PGSPSAVEH

SEQ ID NO: 641865 - protein, 9 aa, Homo Sapiens
PISCLGPSC

SEQ ID NO: 641866 - protein, 9 aa, Homo Sapiens
LWSFGSKIR

SEQ ID NO: 641867 - protein, 9 aa, Homo Sapiens
EFRQPLFFQ

SEQ ID NO: 641868 - protein, 9 aa, Homo Sapiens
IMSGSTISA

SEQ ID NO: 641869 - protein, 9 aa, Homo Sapiens
GRITWLDPA

SEQ ID NO: 641870 - protein, 9 aa, Homo Sapiens
CQMGNSGKP

SEQ ID NO: 641871 - protein, 9 aa, Homo Sapiens
GQPSTSAHG

SEQ ID NO: 641872 - protein, 9 aa, Homo Sapiens
EQLPQQPTY

SEQ ID NO: 641873 - protein, 9 aa, Homo Sapiens
WASWGKWNK

SEQ ID NO: 641874 - protein, 9 aa, Homo Sapiens
GRACVPGPH

SEQ ID NO: 641875 - protein, 9 aa, Homo Sapiens
EDPQTYSNR

SEQ ID NO: 641876 - protein, 9 aa, Homo Sapiens
LAKALRVNI

SEQ ID NO: 641877 - protein, 9 aa, Homo Sapiens
QHQGRQIGA

SEQ ID NO: 641878 - protein, 9 aa, Homo Sapiens
VLMLNSQEE

SEQ ID NO: 641879 - protein, 9 aa, Homo Sapiens
VLAKALRVN

SEQ ID NO: 641880 - protein, 9 aa, Homo Sapiens
ELEDGGVRI

SEQ ID NO: 641881 - protein, 9 aa, Homo Sapiens
PKIADCTES

SEQ ID NO: 641882 - protein, 9 aa, Homo Sapiens
LKAASSFRS

SEQ ID NO: 641883 - protein, 9 aa, Homo Sapiens
RREQEELLA

SEQ ID NO: 641884 - protein, 9 aa, Homo Sapiens
EPEWELDLP

SEQ ID NO: 641885 - protein, 9 aa, Homo Sapiens
RLHPAGSCS

SEQ ID NO: 641886 - protein, 9 aa, Homo Sapiens
KSRCSSMGF

SEQ ID NO: 641887 - protein, 9 aa, Homo Sapiens
VGEERLSLC

SEQ ID NO: 641888 - protein, 9 aa, Homo Sapiens
GHSNIYQLL

SEQ ID NO: 641889 - protein, 9 aa, Homo Sapiens
KPFAVDVSL

SEQ ID NO: 641890 - protein, 9 aa, Homo Sapiens
TLKECILEP

SEQ ID NO: 641891 - protein, 9 aa, Homo Sapiens
QQADGYVGD

SEQ ID NO: 641892 - protein, 9 aa, Homo Sapiens
LCECLDDRD

SEQ ID NO: 641893 - protein, 9 aa, Homo Sapiens
NQKTHIGEK

SEQ ID NO: 641894 - protein, 9 aa, Homo Sapiens
TKSNRGHSV

SEQ ID NO: 641895 - protein, 9 aa, Homo Sapiens
SCLALNQKT

SEQ ID NO: 641896 - protein, 9 aa, Homo Sapiens
STSAHGQPA

SEQ ID NO: 641897 - protein, 9 aa, Homo Sapiens
LSPMQRAGI

SEQ ID NO: 641898 - protein, 9 aa, Homo Sapiens
AMPRLRNTG

SEQ ID NO: 641899 - protein, 9 aa, Homo Sapiens
GRGFNITDT

SEQ ID NO: 641900 - protein, 9 aa, Homo Sapiens
LASSTIGIV

SEQ ID NO: 641901 - protein, 9 aa, Homo Sapiens
VVVVDFKKE

SEQ ID NO: 641902 - protein, 9 aa, Homo Sapiens
EDSTTSRDI

SEQ ID NO: 641903 - protein, 9 aa, Homo Sapiens
ILYCKCSMQ

SEQ ID NO: 641904 - protein, 9 aa, Homo Sapiens
SKYEENLFL

SEQ ID NO: 641905 - protein, 9 aa, Homo Sapiens
ERPTASMAQ

SEQ ID NO: 641906 - protein, 9 aa, Homo Sapiens
AHILNNHPG

SEQ ID NO: 641907 - protein, 9 aa, Homo Sapiens
PFLLSSEYD

SEQ ID NO: 641908 - protein, 9 aa, Homo Sapiens
SSSFAAGIR

SEQ ID NO: 641909 - protein, 9 aa, Homo Sapiens
AAVAEKSLR

SEQ ID NO: 641910 - protein, 9 aa, Homo Sapiens
PNLNAGIIN

SEQ ID NO: 641911 - protein, 9 aa, Homo Sapiens
LPIPVPRVA

SEQ ID NO: 641912 - protein, 9 aa, Homo Sapiens
KDGEAEQCV

SEQ ID NO: 641913 - protein, 9 aa, Homo Sapiens
SLPTHYPLC

SEQ ID NO: 641914 - protein, 9 aa, Homo Sapiens
GYMVQHDSV

SEQ ID NO: 641915 - protein, 9 aa, Homo Sapiens
GSPKWQQAD

SEQ ID NO: 641916 - protein, 9 aa, Homo Sapiens
VIILEQSGK

SEQ ID NO: 641917 - protein, 9 aa, Homo Sapiens
DNKIILDPI

SEQ ID NO: 641918 - protein, 9 aa, Homo Sapiens
GTYLTRLHE

SEQ ID NO: 641919 - protein, 9 aa, Homo Sapiens
DQLSCHGSS

SEQ ID NO: 641920 - protein, 9 aa, Homo Sapiens
ATWSPLVKP

SEQ ID NO: 641921 - protein, 9 aa, Homo Sapiens
LDPRQIAPC

SEQ ID NO: 641922 - protein, 9 aa, Homo Sapiens
IDGKVLVDV

SEQ ID NO: 641923 - protein, 9 aa, Homo Sapiens
GTARLPRED

SEQ ID NO: 641924 - protein, 9 aa, Homo Sapiens
TEVPCSPEV

SEQ ID NO: 641925 - protein, 9 aa, Homo Sapiens
FLKEMAAIE

SEQ ID NO: 641926 - protein, 9 aa, Homo Sapiens
PRLQAVTDN

SEQ ID NO: 641927 - protein, 9 aa, Homo Sapiens
MKAFIRCIG

SEQ ID NO: 641928 - protein, 9 aa, Homo Sapiens
PLCPFLSPL

SEQ ID NO: 641929 - protein, 9 aa, Homo Sapiens
WARYPYGSM

SEQ ID NO: 641930 - protein, 9 aa, Homo Sapiens
TCERPFPCA

SEQ ID NO: 641931 - protein, 9 aa, Homo Sapiens
HPAGSCSRS

SEQ ID NO: 641932 - protein, 9 aa, Homo Sapiens
LLSIRGLSQ

SEQ ID NO: 641933 - protein, 9 aa, Homo Sapiens
GGAATWSPL

SEQ ID NO: 641934 - protein, 9 aa, Homo Sapiens
HAVSCFLTR

SEQ ID NO: 641935 - protein, 9 aa, Homo Sapiens
QPYFSVEQK

SEQ ID NO: 641936 - protein, 9 aa, Homo Sapiens
HQTPIKMGN

SEQ ID NO: 641937 - protein, 9 aa, Homo Sapiens
MTVRRKVSE

SEQ ID NO: 641938 - protein, 9 aa, Homo Sapiens
ILYYYQFGG

SEQ ID NO: 641939 - protein, 9 aa, Homo Sapiens
GQPYFSVEQ

SEQ ID NO: 641940 - protein, 9 aa, Homo Sapiens
CPGVLPGHA

SEQ ID NO: 641941 - protein, 9 aa, Homo Sapiens
LLLPDDDKF

SEQ ID NO: 641942 - protein, 9 aa, Homo Sapiens
TIYHRIPMV

SEQ ID NO: 641943 - protein, 9 aa, Homo Sapiens
KEVEAEFLS

SEQ ID NO: 641944 - protein, 9 aa, Homo Sapiens
HWASWGKWN

SEQ ID NO: 641945 - protein, 9 aa, Homo Sapiens
QPQVSFKEA

SEQ ID NO: 641946 - protein, 9 aa, Homo Sapiens
PGLFGVWPH

SEQ ID NO: 641947 - protein, 9 aa, Homo Sapiens
CVCGMHEML

SEQ ID NO: 641948 - protein, 9 aa, Homo Sapiens
SGTSLPQSL

SEQ ID NO: 641949 - protein, 9 aa, Homo Sapiens
ELDVIDGSD

SEQ ID NO: 641950 - protein, 9 aa, Homo Sapiens
YPGMDSTPW

SEQ ID NO: 641951 - protein, 9 aa, Homo Sapiens
RRYLTAFTR

SEQ ID NO: 641952 - protein, 9 aa, Homo Sapiens
VVADIHCLH

SEQ ID NO: 641953 - protein, 9 aa, Homo Sapiens
PEHNVSYLY

SEQ ID NO: 641954 - protein, 9 aa, Homo Sapiens
QSISHTQGQ

SEQ ID NO: 641955 - protein, 9 aa, Homo Sapiens
NGFKAEIRQ

SEQ ID NO: 641956 - protein, 9 aa, Homo Sapiens
AFSTWAFHL

SEQ ID NO: 641957 - protein, 9 aa, Homo Sapiens
NTTLSGCKW

SEQ ID NO: 641958 - protein, 9 aa, Homo Sapiens
AFDYHSRLS

SEQ ID NO: 641959 - protein, 9 aa, Homo Sapiens
SLEKSKPCV

SEQ ID NO: 641960 - protein, 9 aa, Homo Sapiens
IPAANSFLV

SEQ ID NO: 641961 - protein, 9 aa, Homo Sapiens
THAGERPYG

SEQ ID NO: 641962 - protein, 9 aa, Homo Sapiens
FGNTLNESR

SEQ ID NO: 641963 - protein, 9 aa, Homo Sapiens
QRALSHFPG

SEQ ID NO: 641964 - protein, 9 aa, Homo Sapiens
FPPLPTDCA

SEQ ID NO: 641965 - protein, 9 aa, Homo Sapiens
RIPMVGIPL

SEQ ID NO: 641966 - protein, 9 aa, Homo Sapiens
AFTSAYTFI

SEQ ID NO: 641967 - protein, 9 aa, Homo Sapiens
FINKTLTDN

SEQ ID NO: 641968 - protein, 9 aa, Homo Sapiens
IQLPFLWAQ

SEQ ID NO: 641969 - protein, 9 aa, Homo Sapiens
CAAVCRPLH

SEQ ID NO: 641970 - protein, 9 aa, Homo Sapiens
SQLVIHGLE

SEQ ID NO: 641971 - protein, 9 aa, Homo Sapiens
LPVHPENAL

SEQ ID NO: 641972 - protein, 9 aa, Homo Sapiens
IAPCRPLAA

SEQ ID NO: 641973 - protein, 9 aa, Homo Sapiens
AQPWFEFLV

SEQ ID NO: 641974 - protein, 9 aa, Homo Sapiens
GRGNPVPQH

SEQ ID NO: 641975 - protein, 9 aa, Homo Sapiens
ILSNKKPEM

SEQ ID NO: 641976 - protein, 9 aa, Homo Sapiens
LLAAVRCEQ

SEQ ID NO: 641977 - protein, 9 aa, Homo Sapiens
LLAVLWLWA

SEQ ID NO: 641978 - protein, 9 aa, Homo Sapiens
QMWKRPQIL

SEQ ID NO: 641979 - protein, 9 aa, Homo Sapiens
AHTVAEAGR

SEQ ID NO: 641980 - protein, 9 aa, Homo Sapiens
GQHRAANVC

SEQ ID NO: 641981 - protein, 9 aa, Homo Sapiens
RPPPIAMIT

SEQ ID NO: 641982 - protein, 9 aa, Homo Sapiens
VETRAHAVE

SEQ ID NO: 641983 - protein, 9 aa, Homo Sapiens
CLALNQKTH

SEQ ID NO: 641984 - protein, 9 aa, Homo Sapiens
QHLIIHNGE

SEQ ID NO: 641985 - protein, 9 aa, Homo Sapiens
LNSQSISHT

SEQ ID NO: 641986 - protein, 9 aa, Homo Sapiens
ALPGDKQHP

SEQ ID NO: 641987 - protein, 9 aa, Homo Sapiens
HNSGRKIAS

SEQ ID NO: 641988 - protein, 9 aa, Homo Sapiens
QLCVNVSGS

SEQ ID NO: 641989 - protein, 9 aa, Homo Sapiens
TAHFYLEDI

SEQ ID NO: 641990 - protein, 9 aa, Homo Sapiens
AVRKRRDKA

SEQ ID NO: 641991 - protein, 9 aa, Homo Sapiens
RQPCCAFFA

SEQ ID NO: 641992 - protein, 9 aa, Homo Sapiens
VLAIFSVAI

SEQ ID NO: 641993 - protein, 9 aa, Homo Sapiens
PMQRAGISN

SEQ ID NO: 641994 - protein, 9 aa, Homo Sapiens
HQGRQIGAA

SEQ ID NO: 641995 - protein, 9 aa, Homo Sapiens
IVNNSTVYV

SEQ ID NO: 641996 - protein, 9 aa, Homo Sapiens
KDLKLGSVE

SEQ ID NO: 641997 - protein, 9 aa, Homo Sapiens
LSHFPGSAP

SEQ ID NO: 641998 - protein, 9 aa, Homo Sapiens
PTDVYLLDG

SEQ ID NO: 641999 - protein, 9 aa, Homo Sapiens
LYRLTAVLG

SEQ ID NO: 642000 - protein, 9 aa, Homo Sapiens
AGYNHDKLF

SEQ ID NO: 642001 - protein, 9 aa, Homo Sapiens
PIIDSLKTK

SEQ ID NO: 642002 - protein, 9 aa, Homo Sapiens
AVLHRLTAR

SEQ ID NO: 642003 - protein, 9 aa, Homo Sapiens
MPCFLTFPK

SEQ ID NO: 642004 - protein, 9 aa, Homo Sapiens
VDGANFIVK

SEQ ID NO: 642005 - protein, 9 aa, Homo Sapiens
VPEPTALDQ

SEQ ID NO: 642006 - protein, 9 aa, Homo Sapiens
SPAAEFSCL

SEQ ID NO: 642007 - protein, 9 aa, Homo Sapiens
TVGVPLSYT

SEQ ID NO: 642008 - protein, 9 aa, Homo Sapiens
LPANYRYGP

SEQ ID NO: 642009 - protein, 9 aa, Homo Sapiens
LQLSTAIET

SEQ ID NO: 642010 - protein, 9 aa, Homo Sapiens
EKAGSSGQP

SEQ ID NO: 642011 - protein, 9 aa, Homo Sapiens
SLQANSWKM

SEQ ID NO: 642012 - protein, 9 aa, Homo Sapiens
MPLCPFLSP

SEQ ID NO: 642013 - protein, 9 aa, Homo Sapiens
EVEAPAVPV

SEQ ID NO: 642014 - protein, 9 aa, Homo Sapiens
KCHMLPFYG

SEQ ID NO: 642015 - protein, 9 aa, Homo Sapiens
NDSVAVLRQ

SEQ ID NO: 642016 - protein, 9 aa, Homo Sapiens
ISHTEFEVV

SEQ ID NO: 642017 - protein, 9 aa, Homo Sapiens
TQTMPVGIF

SEQ ID NO: 642018 - protein, 9 aa, Homo Sapiens
IETPAEEAP

SEQ ID NO: 642019 - protein, 9 aa, Homo Sapiens
AVDVSLWIG

SEQ ID NO: 642020 - protein, 9 aa, Homo Sapiens
LDSTPPPGP

SEQ ID NO: 642021 - protein, 9 aa, Homo Sapiens
AGLFFSSVE

SEQ ID NO: 642022 - protein, 9 aa, Homo Sapiens
RCSSMGFRI

SEQ ID NO: 642023 - protein, 9 aa, Homo Sapiens
FNITDTTFG

SEQ ID NO: 642024 - protein, 9 aa, Homo Sapiens
LLDDPTEKG

SEQ ID NO: 642025 - protein, 9 aa, Homo Sapiens
YQQYTNLPE

SEQ ID NO: 642026 - protein, 9 aa, Homo Sapiens
LLTSMDYDR

SEQ ID NO: 642027 - protein, 9 aa, Homo Sapiens
TVVLEIPVF

SEQ ID NO: 642028 - protein, 9 aa, Homo Sapiens
HILNNHPGA

SEQ ID NO: 642029 - protein, 9 aa, Homo Sapiens
TQHGETLRN

SEQ ID NO: 642030 - protein, 9 aa, Homo Sapiens
KATWLSLDT

SEQ ID NO: 642031 - protein, 9 aa, Homo Sapiens
FVFFFPFPI

SEQ ID NO: 642032 - protein, 9 aa, Homo Sapiens
DITQLLMKA

SEQ ID NO: 642033 - protein, 9 aa, Homo Sapiens
DTAAIENRK

SEQ ID NO: 642034 - protein, 9 aa, Homo Sapiens
VWPHNGEVR

SEQ ID NO: 642035 - protein, 9 aa, Homo Sapiens
RTRCLLLSI

SEQ ID NO: 642036 - protein, 9 aa, Homo Sapiens
LYECEECGK

SEQ ID NO: 642037 - protein, 9 aa, Homo Sapiens
DRLITEHLP

SEQ ID NO: 642038 - protein, 9 aa, Homo Sapiens
LIPVQLESE

SEQ ID NO: 642039 - protein, 9 aa, Homo Sapiens
QLTHNANPL

SEQ ID NO: 642040 - protein, 9 aa, Homo Sapiens
NANSHDDRL

SEQ ID NO: 642041 - protein, 9 aa, Homo Sapiens
RHLGQSLLA

SEQ ID NO: 642042 - protein, 9 aa, Homo Sapiens
TAFLPPSPT

SEQ ID NO: 642043 - protein, 9 aa, Homo Sapiens
WGGAAQLAG

SEQ ID NO: 642044 - protein, 9 aa, Homo Sapiens
HSGQGIAKA

SEQ ID NO: 642045 - protein, 9 aa, Homo Sapiens
YYQFGGRLR

SEQ ID NO: 642046 - protein, 9 aa, Homo Sapiens
ASFIAESMQ

SEQ ID NO: 642047 - protein, 9 aa, Homo Sapiens
YKPHHIQLK

SEQ ID NO: 642048 - protein, 9 aa, Homo Sapiens
KMLSLSGAA

SEQ ID NO: 642049 - protein, 9 aa, Homo Sapiens
PLAAAIRYS

SEQ ID NO: 642050 - protein, 9 aa, Homo Sapiens
KPISCLGPS

SEQ ID NO: 642051 - protein, 9 aa, Homo Sapiens
RTIACLVMA

SEQ ID NO: 642052 - protein, 9 aa, Homo Sapiens
QIGAAAHPP

SEQ ID NO: 642053 - protein, 9 aa, Homo Sapiens
LAAAIRYSR

SEQ ID NO: 642054 - protein, 9 aa, Homo Sapiens
KAIAQCFTC

SEQ ID NO: 642055 - protein, 9 aa, Homo Sapiens
TKRLWFLLP

SEQ ID NO: 642056 - protein, 9 aa, Homo Sapiens
VELDVIDGS

SEQ ID NO: 642057 - protein, 9 aa, Homo Sapiens
PKWQQADGY

SEQ ID NO: 642058 - protein, 9 aa, Homo Sapiens
KRCLCGVLG

SEQ ID NO: 642059 - protein, 9 aa, Homo Sapiens
AEGRQKVFS

SEQ ID NO: 642060 - protein, 9 aa, Homo Sapiens
PHPPVGTKS

SEQ ID NO: 642061 - protein, 9 aa, Homo Sapiens
EVEAEFLSL

SEQ ID NO: 642062 - protein, 9 aa, Homo Sapiens
ILESIFVKR

SEQ ID NO: 642063 - protein, 9 aa, Homo Sapiens
DGKVLVDVT

SEQ ID NO: 642064 - protein, 9 aa, Homo Sapiens
GDRLITEHL

SEQ ID NO: 642065 - protein, 9 aa, Homo Sapiens
RTFCCTFCK

SEQ ID NO: 642066 - protein, 9 aa, Homo Sapiens
GVKTSSFLC

SEQ ID NO: 642067 - protein, 9 aa, Homo Sapiens
SEFRDQLSC

SEQ ID NO: 642068 - protein, 9 aa, Homo Sapiens
LKSDPGLTA

SEQ ID NO: 642069 - protein, 9 aa, Homo Sapiens
HGQPAAPAP

SEQ ID NO: 642070 - protein, 9 aa, Homo Sapiens
NVLTASRPP

SEQ ID NO: 642071 - protein, 9 aa, Homo Sapiens
WLTPHGLRF

SEQ ID NO: 642072 - protein, 9 aa, Homo Sapiens
LWAPICAIC

SEQ ID NO: 642073 - protein, 9 aa, Homo Sapiens
PTTCRRPSG

SEQ ID NO: 642074 - protein, 9 aa, Homo Sapiens
TLPHASETF

SEQ ID NO: 642075 - protein, 9 aa, Homo Sapiens
ASVRILDRC

SEQ ID NO: 642076 - protein, 9 aa, Homo Sapiens
TTCRRPSGT

SEQ ID NO: 642077 - protein, 9 aa, Homo Sapiens
SVELDVIDG

SEQ ID NO: 642078 - protein, 9 aa, Homo Sapiens
TKAKKPIVG

SEQ ID NO: 642079 - protein, 9 aa, Homo Sapiens
DNAPEILYS

SEQ ID NO: 642080 - protein, 9 aa, Homo Sapiens
DTTFGQNEC

SEQ ID NO: 642081 - protein, 9 aa, Homo Sapiens
FPFPIFGIL

SEQ ID NO: 642082 - protein, 9 aa, Homo Sapiens
VYKLRLGHK

SEQ ID NO: 642083 - protein, 9 aa, Homo Sapiens
DDKFHGGWA

SEQ ID NO: 642084 - protein, 9 aa, Homo Sapiens
PHFDAEADQ

SEQ ID NO: 642085 - protein, 9 aa, Homo Sapiens
SPKWQQADG

SEQ ID NO: 642086 - protein, 9 aa, Homo Sapiens
SCQAFTSAY

SEQ ID NO: 642087 - protein, 9 aa, Homo Sapiens
GFKAEIRQP

SEQ ID NO: 642088 - protein, 9 aa, Homo Sapiens
YSDRDRDLY

SEQ ID NO: 642089 - protein, 9 aa, Homo Sapiens
SVLRGSGGP

SEQ ID NO: 642090 - protein, 9 aa, Homo Sapiens
VVHAVYDLK

SEQ ID NO: 642091 - protein, 9 aa, Homo Sapiens
KDHERERPT

SEQ ID NO: 642092 - protein, 9 aa, Homo Sapiens
VRDFSAPLP

SEQ ID NO: 642093 - protein, 9 aa, Homo Sapiens
VLHRLTARL

SEQ ID NO: 642094 - protein, 9 aa, Homo Sapiens
LSLPQMKHF

SEQ ID NO: 642095 - protein, 9 aa, Homo Sapiens
LCGHAEPCV

SEQ ID NO: 642096 - protein, 9 aa, Homo Sapiens
RQIGAAAHP

SEQ ID NO: 642097 - protein, 9 aa, Homo Sapiens
FRSGKNSSP

SEQ ID NO: 642098 - protein, 9 aa, Homo Sapiens
RWSAGLFFS

SEQ ID NO: 642099 - protein, 9 aa, Homo Sapiens
AEPCVLRFQ

SEQ ID NO: 642100 - protein, 9 aa, Homo Sapiens
HILWPKIAD

SEQ ID NO: 642101 - protein, 9 aa, Homo Sapiens
ANENTTQSP

SEQ ID NO: 642102 - protein, 9 aa, Homo Sapiens
EENRKKKTN

SEQ ID NO: 642103 - protein, 9 aa, Homo Sapiens
QVLFQHWAS

SEQ ID NO: 642104 - protein, 9 aa, Homo Sapiens
SHKGFDLMY

SEQ ID NO: 642105 - protein, 9 aa, Homo Sapiens
SKLKNAVPQ

SEQ ID NO: 642106 - protein, 9 aa, Homo Sapiens
HSLGAHTVA

SEQ ID NO: 642107 - protein, 9 aa, Homo Sapiens
NHIIYLRPM

SEQ ID NO: 642108 - protein, 9 aa, Homo Sapiens
FGEVANEVT

SEQ ID NO: 642109 - protein, 9 aa, Homo Sapiens
SSGTPSPAP

SEQ ID NO: 642110 - protein, 9 aa, Homo Sapiens
LKKLHKEEI

SEQ ID NO: 642111 - protein, 9 aa, Homo Sapiens
LEPDSEHRP

SEQ ID NO: 642112 - protein, 9 aa, Homo Sapiens
RTHAGERPY

SEQ ID NO: 642113 - protein, 9 aa, Homo Sapiens
QIGIGCGGS

SEQ ID NO: 642114 - protein, 9 aa, Homo Sapiens
PPVAEAVPE

SEQ ID NO: 642115 - protein, 9 aa, Homo Sapiens
FGVWPHNGE

SEQ ID NO: 642116 - protein, 9 aa, Homo Sapiens
VQEELRQLA

SEQ ID NO: 642117 - protein, 9 aa, Homo Sapiens
VPRVADGAW

SEQ ID NO: 642118 - protein, 9 aa, Homo Sapiens
SAACLDMQA

SEQ ID NO: 642119 - protein, 9 aa, Homo Sapiens
NETWEEKLW

SEQ ID NO: 642120 - protein, 9 aa, Homo Sapiens
ELIPVQLES

SEQ ID NO: 642121 - protein, 9 aa, Homo Sapiens
GPAAGRGAS

SEQ ID NO: 642122 - protein, 9 aa, Homo Sapiens
ENKLETKAE

SEQ ID NO: 642123 - protein, 9 aa, Homo Sapiens
FTLKSDPGL

SEQ ID NO: 642124 - protein, 9 aa, Homo Sapiens
EKKQLCVLP

SEQ ID NO: 642125 - protein, 9 aa, Homo Sapiens
CNHQIMSGS

SEQ ID NO: 642126 - protein, 9 aa, Homo Sapiens
EQPTKMGRG

SEQ ID NO: 642127 - protein, 9 aa, Homo Sapiens
WRGSQATSP

SEQ ID NO: 642128 - protein, 9 aa, Homo Sapiens
GGRRTTSIL

SEQ ID NO: 642129 - protein, 9 aa, Homo Sapiens
LQQGFFPIK

SEQ ID NO: 642130 - protein, 9 aa, Homo Sapiens
NISMKDPSG

SEQ ID NO: 642131 - protein, 9 aa, Homo Sapiens
NRYEFSDCE

SEQ ID NO: 642132 - protein, 9 aa, Homo Sapiens
EVPFLLSSE

SEQ ID NO: 642133 - protein, 9 aa, Homo Sapiens
GVSWACSAR

SEQ ID NO: 642134 - protein, 9 aa, Homo Sapiens
FCRIILVSK

SEQ ID NO: 642135 - protein, 9 aa, Homo Sapiens
YEENLFLAP

SEQ ID NO: 642136 - protein, 9 aa, Homo Sapiens
SAHGQPAAP

SEQ ID NO: 642137 - protein, 9 aa, Homo Sapiens
DRAFPVLII

SEQ ID NO: 642138 - protein, 9 aa, Homo Sapiens
FFPFPIFGI

SEQ ID NO: 642139 - protein, 9 aa, Homo Sapiens
DVPNASCGQ

SEQ ID NO: 642140 - protein, 9 aa, Homo Sapiens
RERPTASMA

SEQ ID NO: 642141 - protein, 9 aa, Homo Sapiens
FIHPERDGD

SEQ ID NO: 642142 - protein, 9 aa, Homo Sapiens
PEKKTRPVS

SEQ ID NO: 642143 - protein, 9 aa, Homo Sapiens
DTDAFRSSK

SEQ ID NO: 642144 - protein, 9 aa, Homo Sapiens
TSMDYDRYL

SEQ ID NO: 642145 - protein, 9 aa, Homo Sapiens
ARGPLNFGP

SEQ ID NO: 642146 - protein, 9 aa, Homo Sapiens
LGQSLLAKA

SEQ ID NO: 642147 - protein, 9 aa, Homo Sapiens
PDVLCTCTD

SEQ ID NO: 642148 - protein, 9 aa, Homo Sapiens
KAHILNNHP

SEQ ID NO: 642149 - protein, 9 aa, Homo Sapiens
HGETLRNVT

SEQ ID NO: 642150 - protein, 9 aa, Homo Sapiens
DLVVADIHC

SEQ ID NO: 642151 - protein, 9 aa, Homo Sapiens
QELQASAPR

SEQ ID NO: 642152 - protein, 9 aa, Homo Sapiens
SISHTQGQM

SEQ ID NO: 642153 - protein, 9 aa, Homo Sapiens
VGTKSNRGH

SEQ ID NO: 642154 - protein, 9 aa, Homo Sapiens
AVGNRHAVY

SEQ ID NO: 642155 - protein, 9 aa, Homo Sapiens
RNRNGSDYP

SEQ ID NO: 642156 - protein, 9 aa, Homo Sapiens
CQRRTGKKS

SEQ ID NO: 642157 - protein, 9 aa, Homo Sapiens
SRDNRYEFS

SEQ ID NO: 642158 - protein, 9 aa, Homo Sapiens
TTSILKRRG

SEQ ID NO: 642159 - protein, 9 aa, Homo Sapiens
SFTVMTQTM

SEQ ID NO: 642160 - protein, 9 aa, Homo Sapiens
DAEYRHIDS

SEQ ID NO: 642161 - protein, 9 aa, Homo Sapiens
PSLGSVWKI

SEQ ID NO: 642162 - protein, 9 aa, Homo Sapiens
AIFHEHTSM

SEQ ID NO: 642163 - protein, 9 aa, Homo Sapiens
FNELNFAFE

SEQ ID NO: 642164 - protein, 9 aa, Homo Sapiens
PAFCCAPYD

SEQ ID NO: 642165 - protein, 9 aa, Homo Sapiens
GCMMQFYLF

SEQ ID NO: 642166 - protein, 9 aa, Homo Sapiens
YVGYMVQHD

SEQ ID NO: 642167 - protein, 9 aa, Homo Sapiens
CVNVSGSFV

SEQ ID NO: 642168 - protein, 9 aa, Homo Sapiens
PTSSASSET

SEQ ID NO: 642169 - protein, 9 aa, Homo Sapiens
FQVCMAILD

SEQ ID NO: 642170 - protein, 9 aa, Homo Sapiens
SVAIMGNSV

SEQ ID NO: 642171 - protein, 9 aa, Homo Sapiens
PQDLDSTPP

SEQ ID NO: 642172 - protein, 9 aa, Homo Sapiens
IYVPDRVRE

SEQ ID NO: 642173 - protein, 9 aa, Homo Sapiens
TVPEPTALD

SEQ ID NO: 642174 - protein, 9 aa, Homo Sapiens
WFLLPDDIL

SEQ ID NO: 642175 - protein, 9 aa, Homo Sapiens
LPQSLPRAT

SEQ ID NO: 642176 - protein, 9 aa, Homo Sapiens
FHRGLQSIQ

SEQ ID NO: 642177 - protein, 9 aa, Homo Sapiens
SPQELQASA

SEQ ID NO: 642178 - protein, 9 aa, Homo Sapiens
QASSGSHIP

SEQ ID NO: 642179 - protein, 9 aa, Homo Sapiens
LRVHGVVVP

SEQ ID NO: 642180 - protein, 9 aa, Homo Sapiens
AVYDLKVRT

SEQ ID NO: 642181 - protein, 9 aa, Homo Sapiens
VAVCLSLHY

SEQ ID NO: 642182 - protein, 9 aa, Homo Sapiens
YLLGDFYVG

SEQ ID NO: 642183 - protein, 9 aa, Homo Sapiens
LQLAAVCRL

SEQ ID NO: 642184 - protein, 9 aa, Homo Sapiens
GSGGGSHHR

SEQ ID NO: 642185 - protein, 9 aa, Homo Sapiens
QLPQQPTYV

SEQ ID NO: 642186 - protein, 9 aa, Homo Sapiens
APNFGVGFP

SEQ ID NO: 642187 - protein, 9 aa, Homo Sapiens
FMETFNTLK

SEQ ID NO: 642188 - protein, 9 aa, Homo Sapiens
VFVVFDENK

SEQ ID NO: 642189 - protein, 9 aa, Homo Sapiens
GEVWLRQPL

SEQ ID NO: 642190 - protein, 9 aa, Homo Sapiens
IHSKYEENL

SEQ ID NO: 642191 - protein, 9 aa, Homo Sapiens
SHTQGQMWK

SEQ ID NO: 642192 - protein, 9 aa, Homo Sapiens
GMFHYGVPI

SEQ ID NO: 642193 - protein, 9 aa, Homo Sapiens
AAEDLREPV

SEQ ID NO: 642194 - protein, 9 aa, Homo Sapiens
TLKSDPGLT

SEQ ID NO: 642195 - protein, 9 aa, Homo Sapiens
GSHIPFDPY

SEQ ID NO: 642196 - protein, 9 aa, Homo Sapiens
QQLSKDYAL

SEQ ID NO: 642197 - protein, 9 aa, Homo Sapiens
LEVISHTEF

SEQ ID NO: 642198 - protein, 9 aa, Homo Sapiens
VLWLWAPIC

SEQ ID NO: 642199 - protein, 9 aa, Homo Sapiens
ALFYFVFFF

SEQ ID NO: 642200 - protein, 9 aa, Homo Sapiens
GTLVWLDNT

SEQ ID NO: 642201 - protein, 9 aa, Homo Sapiens
FVGGLVEGA

SEQ ID NO: 642202 - protein, 9 aa, Homo Sapiens
DPDYLGRVR

SEQ ID NO: 642203 - protein, 9 aa, Homo Sapiens
GSLGSPKWQ

SEQ ID NO: 642204 - protein, 9 aa, Homo Sapiens
SQSGAGSTC

SEQ ID NO: 642205 - protein, 9 aa, Homo Sapiens
QSGCNYVAG

SEQ ID NO: 642206 - protein, 9 aa, Homo Sapiens
IAQVLWQHA

SEQ ID NO: 642207 - protein, 9 aa, Homo Sapiens
KLANTDIHV

SEQ ID NO: 642208 - protein, 9 aa, Homo Sapiens
VSEAGGSGS

SEQ ID NO: 642209 - protein, 9 aa, Homo Sapiens
LSIASEKRL

SEQ ID NO: 642210 - protein, 9 aa, Homo Sapiens
VKHRGSKPA

SEQ ID NO: 642211 - protein, 9 aa, Homo Sapiens
PDSEHRPDI

SEQ ID NO: 642212 - protein, 9 aa, Homo Sapiens
DVLNVLTAS

SEQ ID NO: 642213 - protein, 9 aa, Homo Sapiens
AHPSSGTPS

SEQ ID NO: 642214 - protein, 9 aa, Homo Sapiens
RSLAFFCAL

SEQ ID NO: 642215 - protein, 9 aa, Homo Sapiens
TWGFRRTII

SEQ ID NO: 642216 - protein, 9 aa, Homo Sapiens
LAGQAEVLK

SEQ ID NO: 642217 - protein, 9 aa, Homo Sapiens
TFSSRNFHA

SEQ ID NO: 642218 - protein, 9 aa, Homo Sapiens
HLLKDHLGR

SEQ ID NO: 642219 - protein, 9 aa, Homo Sapiens
LGLIGAEFG

SEQ ID NO: 642220 - protein, 9 aa, Homo Sapiens
FLLYRLTAV

SEQ ID NO: 642221 - protein, 9 aa, Homo Sapiens
ECGKVFSYR

SEQ ID NO: 642222 - protein, 9 aa, Homo Sapiens
GYLRVHGVV

SEQ ID NO: 642223 - protein, 9 aa, Homo Sapiens
PPLPTDCAW

SEQ ID NO: 642224 - protein, 9 aa, Homo Sapiens
AYPDGRREQ

SEQ ID NO: 642225 - protein, 9 aa, Homo Sapiens
ETLRNVTIL

SEQ ID NO: 642226 - protein, 9 aa, Homo Sapiens
LGRNNGNGL

SEQ ID NO: 642227 - protein, 9 aa, Homo Sapiens
PPSPTAKSE

SEQ ID NO: 642228 - protein, 9 aa, Homo Sapiens
EMAAIEERY

SEQ ID NO: 642229 - protein, 9 aa, Homo Sapiens
TGLRNLGNA

SEQ ID NO: 642230 - protein, 9 aa, Homo Sapiens
KLMTNLRSS

SEQ ID NO: 642231 - protein, 9 aa, Homo Sapiens
RLTAVLGLG

SEQ ID NO: 642232 - protein, 9 aa, Homo Sapiens
SLGSFGSIT

SEQ ID NO: 642233 - protein, 9 aa, Homo Sapiens
PLFFQFLVI

SEQ ID NO: 642234 - protein, 9 aa, Homo Sapiens
SHDGAGGSK

SEQ ID NO: 642235 - protein, 9 aa, Homo Sapiens
GARGPLNFG

SEQ ID NO: 642236 - protein, 9 aa, Homo Sapiens
IVHHRTHAG

SEQ ID NO: 642237 - protein, 9 aa, Homo Sapiens
VGVPLSYTD

SEQ ID NO: 642238 - protein, 9 aa, Homo Sapiens
SLSLGFKCD

SEQ ID NO: 642239 - protein, 9 aa, Homo Sapiens
YPEVNRFCK

SEQ ID NO: 642240 - protein, 9 aa, Homo Sapiens
AFNCSSTLR

SEQ ID NO: 642241 - protein, 9 aa, Homo Sapiens
LNIRDPEHS

SEQ ID NO: 642242 - protein, 9 aa, Homo Sapiens
VIAFILTGL

SEQ ID NO: 642243 - protein, 9 aa, Homo Sapiens
PMPLCPFLS

SEQ ID NO: 642244 - protein, 9 aa, Homo Sapiens
YKPKCPESY

SEQ ID NO: 642245 - protein, 9 aa, Homo Sapiens
ISSSFAAGI

SEQ ID NO: 642246 - protein, 9 aa, Homo Sapiens
LFFSSVERR

SEQ ID NO: 642247 - protein, 9 aa, Homo Sapiens
ELRDCFRPS

SEQ ID NO: 642248 - protein, 9 aa, Homo Sapiens
HRPDSRTPE

SEQ ID NO: 642249 - protein, 9 aa, Homo Sapiens
TPIKMGNNP

SEQ ID NO: 642250 - protein, 9 aa, Homo Sapiens
EWELDLPVD

SEQ ID NO: 642251 - protein, 9 aa, Homo Sapiens
ISVLMPCFL

SEQ ID NO: 642252 - protein, 9 aa, Homo Sapiens
IKIWNIGKC

SEQ ID NO: 642253 - protein, 9 aa, Homo Sapiens
EVDQPQVSF

SEQ ID NO: 642254 - protein, 9 aa, Homo Sapiens
SRRKHGREE

SEQ ID NO: 642255 - protein, 9 aa, Homo Sapiens
RRKVSEANG

SEQ ID NO: 642256 - protein, 9 aa, Homo Sapiens
QGWRTSLPT

SEQ ID NO: 642257 - protein, 9 aa, Homo Sapiens
RCPGVLPGH

SEQ ID NO: 642258 - protein, 9 aa, Homo Sapiens
QLYFFHILG

SEQ ID NO: 642259 - protein, 9 aa, Homo Sapiens
CSLEKSKPC

SEQ ID NO: 642260 - protein, 9 aa, Homo Sapiens
MHSSAGAEG

SEQ ID NO: 642261 - protein, 9 aa, Homo Sapiens
IAFILTGLP

SEQ ID NO: 642262 - protein, 9 aa, Homo Sapiens
AGISNQWNM

SEQ ID NO: 642263 - protein, 9 aa, Homo Sapiens
WGFRRTIIA

SEQ ID NO: 642264 - protein, 9 aa, Homo Sapiens
VHGVVVPMV

SEQ ID NO: 642265 - protein, 9 aa, Homo Sapiens
RKSRPCSLT

SEQ ID NO: 642266 - protein, 9 aa, Homo Sapiens
AFLRATEAY

SEQ ID NO: 642267 - protein, 9 aa, Homo Sapiens
GCILRTFKF

SEQ ID NO: 642268 - protein, 9 aa, Homo Sapiens
RRILDLAKH

SEQ ID NO: 642269 - protein, 9 aa, Homo Sapiens
IYRPCSEGF

SEQ ID NO: 642270 - protein, 9 aa, Homo Sapiens
VERRSTSCK

SEQ ID NO: 642271 - protein, 9 aa, Homo Sapiens
FSAPLPEST

SEQ ID NO: 642272 - protein, 9 aa, Homo Sapiens
HRTHAGERP

SEQ ID NO: 642273 - protein, 9 aa, Homo Sapiens
TVTIEDLMK

SEQ ID NO: 642274 - protein, 9 aa, Homo Sapiens
DSRTPESFA

SEQ ID NO: 642275 - protein, 9 aa, Homo Sapiens
SSHCPTDVY

SEQ ID NO: 642276 - protein, 9 aa, Homo Sapiens
HLVLPVHPE

SEQ ID NO: 642277 - protein, 9 aa, Homo Sapiens
SCGQAGGPQ

SEQ ID NO: 642278 - protein, 9 aa, Homo Sapiens
DVIDGSDNE

SEQ ID NO: 642279 - protein, 9 aa, Homo Sapiens
ETIYHRIPM

SEQ ID NO: 642280 - protein, 9 aa, Homo Sapiens
PVGTKSNRG

SEQ ID NO: 642281 - protein, 9 aa, Homo Sapiens
WLDNTAVNY

SEQ ID NO: 642282 - protein, 9 aa, Homo Sapiens
LFLSQSGAG

SEQ ID NO: 642283 - protein, 9 aa, Homo Sapiens
APNGTLVVI

SEQ ID NO: 642284 - protein, 9 aa, Homo Sapiens
LIGAEFGAE

SEQ ID NO: 642285 - protein, 9 aa, Homo Sapiens
SDQMRRYLT

SEQ ID NO: 642286 - protein, 9 aa, Homo Sapiens
QSKVVNLWS

SEQ ID NO: 642287 - protein, 9 aa, Homo Sapiens
ANSWKMAVL

SEQ ID NO: 642288 - protein, 9 aa, Homo Sapiens
TSSASSETP

SEQ ID NO: 642289 - protein, 9 aa, Homo Sapiens
HELTARELL

SEQ ID NO: 642290 - protein, 9 aa, Homo Sapiens
YVAVCLSLH

SEQ ID NO: 642291 - protein, 9 aa, Homo Sapiens
STINKIPQV

SEQ ID NO: 642292 - protein, 9 aa, Homo Sapiens
QDAADAWKP

SEQ ID NO: 642293 - protein, 9 aa, Homo Sapiens
SNECKMNPS

SEQ ID NO: 642294 - protein, 9 aa, Homo Sapiens
TVRRKVSEA

SEQ ID NO: 642295 - protein, 9 aa, Homo Sapiens
IRDEVAEKC

SEQ ID NO: 642296 - protein, 9 aa, Homo Sapiens
VSCFLTRGD

SEQ ID NO: 642297 - protein, 9 aa, Homo Sapiens
SLSSSRENR

SEQ ID NO: 642298 - protein, 9 aa, Homo Sapiens
PCRPLAAAA

SEQ ID NO: 642299 - protein, 9 aa, Homo Sapiens
ASWGKWNKY

SEQ ID NO: 642300 - protein, 9 aa, Homo Sapiens
KQEDMMLHK

SEQ ID NO: 642301 - protein, 9 aa, Homo Sapiens
KSSLIVHQR

SEQ ID NO: 642302 - protein, 9 aa, Homo Sapiens
MAILDNPNS

SEQ ID NO: 642303 - protein, 9 aa, Homo Sapiens
GLLLTSMDY

SEQ ID NO: 642304 - protein, 9 aa, Homo Sapiens
IKIDGKVLV

SEQ ID NO: 642305 - protein, 9 aa, Homo Sapiens
LSRFFEYRA

SEQ ID NO: 642306 - protein, 9 aa, Homo Sapiens
YIGNLNKSV

SEQ ID NO: 642307 - protein, 9 aa, Homo Sapiens
GTLELTLTT

SEQ ID NO: 642308 - protein, 9 aa, Homo Sapiens
FGDFLGRES

SEQ ID NO: 642309 - protein, 9 aa, Homo Sapiens
AAGASVAAE

SEQ ID NO: 642310 - protein, 9 aa, Homo Sapiens
VVSVQSGQK

SEQ ID NO: 642311 - protein, 9 aa, Homo Sapiens
GDRFAKQAM

SEQ ID NO: 642312 - protein, 9 aa, Homo Sapiens
SSFLCQRPD

SEQ ID NO: 642313 - protein, 9 aa, Homo Sapiens
SGLMALASS

SEQ ID NO: 642314 - protein, 9 aa, Homo Sapiens
VPNASCGQA

SEQ ID NO: 642315 - protein, 9 aa, Homo Sapiens
SEVVRCRTR

SEQ ID NO: 642316 - protein, 9 aa, Homo Sapiens
VAIMGNSVM

SEQ ID NO: 642317 - protein, 9 aa, Homo Sapiens
LHKDTGDTS

SEQ ID NO: 642318 - protein, 9 aa, Homo Sapiens
EPGGSGGSH

SEQ ID NO: 642319 - protein, 9 aa, Homo Sapiens
STWAFHLTS

SEQ ID NO: 642320 - protein, 9 aa, Homo Sapiens
LGRITWLDP

SEQ ID NO: 642321 - protein, 9 aa, Homo Sapiens
NFTVDVMGN

SEQ ID NO: 642322 - protein, 9 aa, Homo Sapiens
EKSLRRAEM

SEQ ID NO: 642323 - protein, 9 aa, Homo Sapiens
KCFPCPSRG

SEQ ID NO: 642324 - protein, 9 aa, Homo Sapiens
ERHVKSRHL

SEQ ID NO: 642325 - protein, 9 aa, Homo Sapiens
GIIGHAGQG

SEQ ID NO: 642326 - protein, 9 aa, Homo Sapiens
EVPCSPEVQ

SEQ ID NO: 642327 - protein, 9 aa, Homo Sapiens
YSYVGCIRD

SEQ ID NO: 642328 - protein, 9 aa, Homo Sapiens
WKRPQILTR

SEQ ID NO: 642329 - protein, 9 aa, Homo Sapiens
CTYDPKTCS

SEQ ID NO: 642330 - protein, 9 aa, Homo Sapiens
LAEIRTIAC

SEQ ID NO: 642331 - protein, 9 aa, Homo Sapiens
AIMGNSVMV

SEQ ID NO: 642332 - protein, 9 aa, Homo Sapiens
ARELLLKKM

SEQ ID NO: 642333 - protein, 9 aa, Homo Sapiens
MSSGSQQCH

SEQ ID NO: 642334 - protein, 9 aa, Homo Sapiens
MQIGIGCGG

SEQ ID NO: 642335 - protein, 9 aa, Homo Sapiens
LSGCKWKMR

SEQ ID NO: 642336 - protein, 9 aa, Homo Sapiens
CLCGVLGFK

SEQ ID NO: 642337 - protein, 9 aa, Homo Sapiens
SHTEFEVVL

SEQ ID NO: 642338 - protein, 9 aa, Homo Sapiens
SENKLETKA

SEQ ID NO: 642339 - protein, 9 aa, Homo Sapiens
DCFRPSSPA

SEQ ID NO: 642340 - protein, 9 aa, Homo Sapiens
KNDPFTSYP

SEQ ID NO: 642341 - protein, 9 aa, Homo Sapiens
ILGSTECFL

SEQ ID NO: 642342 - protein, 9 aa, Homo Sapiens
AINNLSYWD

SEQ ID NO: 642343 - protein, 9 aa, Homo Sapiens
ARRCPGVLP

SEQ ID NO: 642344 - protein, 9 aa, Homo Sapiens
HDGAGGSKL

SEQ ID NO: 642345 - protein, 9 aa, Homo Sapiens
AISFLGCMM

SEQ ID NO: 642346 - protein, 9 aa, Homo Sapiens
MHEMLDSVP

SEQ ID NO: 642347 - protein, 9 aa, Homo Sapiens
QRLQPTRND

SEQ ID NO: 642348 - protein, 9 aa, Homo Sapiens
GSTPAPAFC

SEQ ID NO: 642349 - protein, 9 aa, Homo Sapiens
RAFPVLIIG

SEQ ID NO: 642350 - protein, 9 aa, Homo Sapiens
RRCPGVLPG

SEQ ID NO: 642351 - protein, 9 aa, Homo Sapiens
SKHHVTFIN

SEQ ID NO: 642352 - protein, 9 aa, Homo Sapiens
CCDEVAVAG

SEQ ID NO: 642353 - protein, 9 aa, Homo Sapiens
MGFRILNSQ

SEQ ID NO: 642354 - protein, 9 aa, Homo Sapiens
SENYEGTMY

SEQ ID NO: 642355 - protein, 9 aa, Homo Sapiens
KKKTNSCLK

SEQ ID NO: 642356 - protein, 9 aa, Homo Sapiens
APWGGFTYQ

SEQ ID NO: 642357 - protein, 9 aa, Homo Sapiens
LYGTYLTRL

SEQ ID NO: 642358 - protein, 9 aa, Homo Sapiens
YCKCSMQEW

SEQ ID NO: 642359 - protein, 9 aa, Homo Sapiens
ECFFLEVMA

SEQ ID NO: 642360 - protein, 9 aa, Homo Sapiens
HPSGYRMID

SEQ ID NO: 642361 - protein, 9 aa, Homo Sapiens
QHRAANVCA

SEQ ID NO: 642362 - protein, 9 aa, Homo Sapiens
WNRQLYPEC

SEQ ID NO: 642363 - protein, 9 aa, Homo Sapiens
TNLRSSHPH

SEQ ID NO: 642364 - protein, 9 aa, Homo Sapiens
SEYDEPSRQ

SEQ ID NO: 642365 - protein, 9 aa, Homo Sapiens
MPSPQELQA

SEQ ID NO: 642366 - protein, 9 aa, Homo Sapiens
SRPPPACQS

SEQ ID NO: 642367 - protein, 9 aa, Homo Sapiens
ANSHDDRLS

SEQ ID NO: 642368 - protein, 9 aa, Homo Sapiens
SRTSRFIHT

SEQ ID NO: 642369 - protein, 9 aa, Homo Sapiens
ECKMNPSKN

SEQ ID NO: 642370 - protein, 9 aa, Homo Sapiens
MDTAAKVII

SEQ ID NO: 642371 - protein, 9 aa, Homo Sapiens
VRKRRDKAK

SEQ ID NO: 642372 - protein, 9 aa, Homo Sapiens
CVPGPHGLR

SEQ ID NO: 642373 - protein, 9 aa, Homo Sapiens
LSKDNVCSL

SEQ ID NO: 642374 - protein, 9 aa, Homo Sapiens
CTDCHGIRC

SEQ ID NO: 642375 - protein, 9 aa, Homo Sapiens
FVNAMKRNK

SEQ ID NO: 642376 - protein, 9 aa, Homo Sapiens
IQSLKLTNL

SEQ ID NO: 642377 - protein, 9 aa, Homo Sapiens
IHEWIQMDS

SEQ ID NO: 642378 - protein, 9 aa, Homo Sapiens
KTREWAEQP

SEQ ID NO: 642379 - protein, 9 aa, Homo Sapiens
IIFTLKSDP

SEQ ID NO: 642380 - protein, 9 aa, Homo Sapiens
SGLSSLGEH

SEQ ID NO: 642381 - protein, 9 aa, Homo Sapiens
LPVLDSVSG

SEQ ID NO: 642382 - protein, 9 aa, Homo Sapiens
SNTSCMQHS

SEQ ID NO: 642383 - protein, 9 aa, Homo Sapiens
RMKMSSGSQ

SEQ ID NO: 642384 - protein, 9 aa, Homo Sapiens
PFQLSNNTG

SEQ ID NO: 642385 - protein, 9 aa, Homo Sapiens
RHIATDLET

SEQ ID NO: 642386 - protein, 9 aa, Homo Sapiens
QLAESWRAL

SEQ ID NO: 642387 - protein, 9 aa, Homo Sapiens
SIRIALPGD

SEQ ID NO: 642388 - protein, 9 aa, Homo Sapiens
VQSGQKLID

SEQ ID NO: 642389 - protein, 9 aa, Homo Sapiens
LTLTTQSRQ

SEQ ID NO: 642390 - protein, 9 aa, Homo Sapiens
FKNLTSVVR

SEQ ID NO: 642391 - protein, 9 aa, Homo Sapiens
AACECLHAC

SEQ ID NO: 642392 - protein, 9 aa, Homo Sapiens
NQRSEEAHR

SEQ ID NO: 642393 - protein, 9 aa, Homo Sapiens
LRTGRLHPA

SEQ ID NO: 642394 - protein, 9 aa, Homo Sapiens
HFDAEADQI

SEQ ID NO: 642395 - protein, 9 aa, Homo Sapiens
TFCCTFCKC

SEQ ID NO: 642396 - protein, 9 aa, Homo Sapiens
AAMAYDRCA

SEQ ID NO: 642397 - protein, 9 aa, Homo Sapiens
CAENWTTKI

SEQ ID NO: 642398 - protein, 9 aa, Homo Sapiens
MHEPMYIFL

SEQ ID NO: 642399 - protein, 9 aa, Homo Sapiens
ENRKVVVTT

SEQ ID NO: 642400 - protein, 9 aa, Homo Sapiens
NRKKKTNSC

SEQ ID NO: 642401 - protein, 9 aa, Homo Sapiens
DGANFIVKH

SEQ ID NO: 642402 - protein, 9 aa, Homo Sapiens
PEDAQQGTV

SEQ ID NO: 642403 - protein, 9 aa, Homo Sapiens
PIPVPRVAD

SEQ ID NO: 642404 - protein, 9 aa, Homo Sapiens
FAVDVSLWI

SEQ ID NO: 642405 - protein, 9 aa, Homo Sapiens
NPSKNNSTC

SEQ ID NO: 642406 - protein, 9 aa, Homo Sapiens
ASPESPPVA

SEQ ID NO: 642407 - protein, 9 aa, Homo Sapiens
VIDGSDNEP

SEQ ID NO: 642408 - protein, 9 aa, Homo Sapiens
RLTARLSSR

SEQ ID NO: 642409 - protein, 9 aa, Homo Sapiens
HDDRLSQSK

SEQ ID NO: 642410 - protein, 9 aa, Homo Sapiens
STPAPAFCC

SEQ ID NO: 642411 - protein, 9 aa, Homo Sapiens
TVVTPLLNT

SEQ ID NO: 642412 - protein, 9 aa, Homo Sapiens
LYIGNLNKS

SEQ ID NO: 642413 - protein, 9 aa, Homo Sapiens
ENYEGTMYP

SEQ ID NO: 642414 - protein, 9 aa, Homo Sapiens
TMRRILDLA

SEQ ID NO: 642415 - protein, 9 aa, Homo Sapiens
PVFQARGQL

SEQ ID NO: 642416 - protein, 9 aa, Homo Sapiens
IDWYRLTHN

SEQ ID NO: 642417 - protein, 9 aa, Homo Sapiens
FGEENRKKK

SEQ ID NO: 642418 - protein, 9 aa, Homo Sapiens
AVTDNHIRM

SEQ ID NO: 642419 - protein, 9 aa, Homo Sapiens
LEQVQLDIP

SEQ ID NO: 642420 - protein, 9 aa, Homo Sapiens
LVIQLPFLW

SEQ ID NO: 642421 - protein, 9 aa, Homo Sapiens
VVLMLNSQE

SEQ ID NO: 642422 - protein, 9 aa, Homo Sapiens
HCPTDVYLL

SEQ ID NO: 642423 - protein, 9 aa, Homo Sapiens
PLLYSDRDR

SEQ ID NO: 642424 - protein, 9 aa, Homo Sapiens
ERRTEEENL

SEQ ID NO: 642425 - protein, 9 aa, Homo Sapiens
RNMMKEIDK

SEQ ID NO: 642426 - protein, 9 aa, Homo Sapiens
KQAMRRKVE

SEQ ID NO: 642427 - protein, 9 aa, Homo Sapiens
HASECSGQY

SEQ ID NO: 642428 - protein, 9 aa, Homo Sapiens
LFPLLLQLT

SEQ ID NO: 642429 - protein, 9 aa, Homo Sapiens
HKAFSTWAF

SEQ ID NO: 642430 - protein, 9 aa, Homo Sapiens
DRYVAVCLS

SEQ ID NO: 642431 - protein, 9 aa, Homo Sapiens
YRGYNPNLN

SEQ ID NO: 642432 - protein, 9 aa, Homo Sapiens
ACTTTPCML

SEQ ID NO: 642433 - protein, 9 aa, Homo Sapiens
LSLSGAAAD

SEQ ID NO: 642434 - protein, 9 aa, Homo Sapiens
NRWYPEVNR

SEQ ID NO: 642435 - protein, 9 aa, Homo Sapiens
GLRFLRACQ

SEQ ID NO: 642436 - protein, 9 aa, Homo Sapiens
LVKLLYFEP

SEQ ID NO: 642437 - protein, 9 aa, Homo Sapiens
QILGVKTSS

SEQ ID NO: 642438 - protein, 9 aa, Homo Sapiens
QTYTIYRPC

SEQ ID NO: 642439 - protein, 9 aa, Homo Sapiens
APCPLPLFT

SEQ ID NO: 642440 - protein, 9 aa, Homo Sapiens
PNASCGQAG

SEQ ID NO: 642441 - protein, 9 aa, Homo Sapiens
DQPQVSFKE

SEQ ID NO: 642442 - protein, 9 aa, Homo Sapiens
PKTRRIQEK

SEQ ID NO: 642443 - protein, 9 aa, Homo Sapiens
YETIYHRIP

SEQ ID NO: 642444 - protein, 9 aa, Homo Sapiens
KVVNLWSFG

SEQ ID NO: 642445 - protein, 9 aa, Homo Sapiens
FNCSSTLRN

SEQ ID NO: 642446 - protein, 9 aa, Homo Sapiens
WNDLRLKLS

SEQ ID NO: 642447 - protein, 9 aa, Homo Sapiens
DRCSVMIRE

SEQ ID NO: 642448 - protein, 9 aa, Homo Sapiens
AVDAEVSRL

SEQ ID NO: 642449 - protein, 9 aa, Homo Sapiens
VGKYHIQAC

SEQ ID NO: 642450 - protein, 9 aa, Homo Sapiens
RNGNISMKD

SEQ ID NO: 642451 - protein, 9 aa, Homo Sapiens
EDMMLHKIY

SEQ ID NO: 642452 - protein, 9 aa, Homo Sapiens
PTEKAGSSG

SEQ ID NO: 642453 - protein, 9 aa, Homo Sapiens
EDGGVRIVS

SEQ ID NO: 642454 - protein, 9 aa, Homo Sapiens
CSEGFLKGP

SEQ ID NO: 642455 - protein, 9 aa, Homo Sapiens
VSRLLFELC

SEQ ID NO: 642456 - protein, 9 aa, Homo Sapiens
KPHHIQLKD

SEQ ID NO: 642457 - protein, 9 aa, Homo Sapiens
HRPKCFEDT

SEQ ID NO: 642458 - protein, 9 aa, Homo Sapiens
KVVVTTIME

SEQ ID NO: 642459 - protein, 9 aa, Homo Sapiens
VWLDNTAVN

SEQ ID NO: 642460 - protein, 9 aa, Homo Sapiens
GSQLVIHGL

SEQ ID NO: 642461 - protein, 9 aa, Homo Sapiens
LTSMDYDRY

SEQ ID NO: 642462 - protein, 9 aa, Homo Sapiens
IRSHTCERP

SEQ ID NO: 642463 - protein, 9 aa, Homo Sapiens
QAIMHEPMY

SEQ ID NO: 642464 - protein, 9 aa, Homo Sapiens
PGTARLPRE

SEQ ID NO: 642465 - protein, 9 aa, Homo Sapiens
GRHIATDLE

SEQ ID NO: 642466 - protein, 9 aa, Homo Sapiens
LRRTRCLLL

SEQ ID NO: 642467 - protein, 9 aa, Homo Sapiens
GYPRSRTSR

SEQ ID NO: 642468 - protein, 9 aa, Homo Sapiens
FVACEDSRS

SEQ ID NO: 642469 - protein, 9 aa, Homo Sapiens
ITWLDPAGP

SEQ ID NO: 642470 - protein, 9 aa, Homo Sapiens
ALDTKSEKV

SEQ ID NO: 642471 - protein, 9 aa, Homo Sapiens
NYEGTMYPS

SEQ ID NO: 642472 - protein, 9 aa, Homo Sapiens
RYGPPVATS

SEQ ID NO: 642473 - protein, 9 aa, Homo Sapiens
FFSSVERRS

SEQ ID NO: 642474 - protein, 9 aa, Homo Sapiens
QPLSIRIAL

SEQ ID NO: 642475 - protein, 9 aa, Homo Sapiens
PQMKHFLFS

SEQ ID NO: 642476 - protein, 9 aa, Homo Sapiens
RIIDWYRLT

SEQ ID NO: 642477 - protein, 9 aa, Homo Sapiens
TPVELFGQV

SEQ ID NO: 642478 - protein, 9 aa, Homo Sapiens
TLFIELLPW

SEQ ID NO: 642479 - protein, 9 aa, Homo Sapiens
DVLRWSAGL

SEQ ID NO: 642480 - protein, 9 aa, Homo Sapiens
LQGSTLSLF

SEQ ID NO: 642481 - protein, 9 aa, Homo Sapiens
SYICKSHKG

SEQ ID NO: 642482 - protein, 9 aa, Homo Sapiens
SLPRATGNS

SEQ ID NO: 642483 - protein, 9 aa, Homo Sapiens
IPGLGRITW

SEQ ID NO: 642484 - protein, 9 aa, Homo Sapiens
EIRQPCCAF

SEQ ID NO: 642485 - protein, 9 aa, Homo Sapiens
CKSHKGFDL

SEQ ID NO: 642486 - protein, 9 aa, Homo Sapiens
NTDIHVADR

SEQ ID NO: 642487 - protein, 9 aa, Homo Sapiens
EPDFWNGSV

SEQ ID NO: 642488 - protein, 9 aa, Homo Sapiens
LCKASRGCV

SEQ ID NO: 642489 - protein, 9 aa, Homo Sapiens
LRGSGGPVL

SEQ ID NO: 642490 - protein, 9 aa, Homo Sapiens
QRAGISNQW

SEQ ID NO: 642491 - protein, 9 aa, Homo Sapiens
SCQKCFCRI

SEQ ID NO: 642492 - protein, 9 aa, Homo Sapiens
PPERNHIIY

SEQ ID NO: 642493 - protein, 9 aa, Homo Sapiens
SVFESRNMM

SEQ ID NO: 642494 - protein, 9 aa, Homo Sapiens
VMNFTVDVM

SEQ ID NO: 642495 - protein, 9 aa, Homo Sapiens
GEERAASER

SEQ ID NO: 642496 - protein, 9 aa, Homo Sapiens
YGTYLTRLH

SEQ ID NO: 642497 - protein, 9 aa, Homo Sapiens
GYNPNLNAG

SEQ ID NO: 642498 - protein, 9 aa, Homo Sapiens
KVWNDLRLK

SEQ ID NO: 642499 - protein, 9 aa, Homo Sapiens
YQDVTLRNL

SEQ ID NO: 642500 - protein, 9 aa, Homo Sapiens
ADRAFPVLI

SEQ ID NO: 642501 - protein, 9 aa, Homo Sapiens
LNKSVTPAD

SEQ ID NO: 642502 - protein, 9 aa, Homo Sapiens
CPSLKRCLC

SEQ ID NO: 642503 - protein, 9 aa, Homo Sapiens
EAQPWFEFL

SEQ ID NO: 642504 - protein, 9 aa, Homo Sapiens
QAMRRKVEL

SEQ ID NO: 642505 - protein, 9 aa, Homo Sapiens
ATWLSLDTM

SEQ ID NO: 642506 - protein, 9 aa, Homo Sapiens
SCTFCRMKM

SEQ ID NO: 642507 - protein, 9 aa, Homo Sapiens
RGLQSIQET

SEQ ID NO: 642508 - protein, 9 aa, Homo Sapiens
QCFTCMEQP

SEQ ID NO: 642509 - protein, 9 aa, Homo Sapiens
LFYFVFFFP

SEQ ID NO: 642510 - protein, 9 aa, Homo Sapiens
AEIRTIACL

SEQ ID NO: 642511 - protein, 9 aa, Homo Sapiens
AVAEKSLRR

SEQ ID NO: 642512 - protein, 9 aa, Homo Sapiens
DFSAPLPES

SEQ ID NO: 642513 - protein, 9 aa, Homo Sapiens
RNNIAVRKR

SEQ ID NO: 642514 - protein, 9 aa, Homo Sapiens
PSKNNSTCT

SEQ ID NO: 642515 - protein, 9 aa, Homo Sapiens
LLKTDMYSP

SEQ ID NO: 642516 - protein, 9 aa, Homo Sapiens
VCTYDPKTC

SEQ ID NO: 642517 - protein, 9 aa, Homo Sapiens
RAHAVERLL

SEQ ID NO: 642518 - protein, 9 aa, Homo Sapiens
PRQIAPCRP

SEQ ID NO: 642519 - protein, 9 aa, Homo Sapiens
SQHEATPWA

SEQ ID NO: 642520 - protein, 9 aa, Homo Sapiens
REGMFHYGV

SEQ ID NO: 642521 - protein, 9 aa, Homo Sapiens
PGGRRTTSI

SEQ ID NO: 642522 - protein, 9 aa, Homo Sapiens
FTCMEQPLQ

SEQ ID NO: 642523 - protein, 9 aa, Homo Sapiens
SHCPTDVYL

SEQ ID NO: 642524 - protein, 9 aa, Homo Sapiens
RSVDYNMLR

SEQ ID NO: 642525 - protein, 9 aa, Homo Sapiens
PSSRKPGDH

SEQ ID NO: 642526 - protein, 9 aa, Homo Sapiens
MKMSSGSQQ

SEQ ID NO: 642527 - protein, 9 aa, Homo Sapiens
DFVNAMKRN

SEQ ID NO: 642528 - protein, 9 aa, Homo Sapiens
REDMRGQWR

SEQ ID NO: 642529 - protein, 9 aa, Homo Sapiens
NWARYPYGS

SEQ ID NO: 642530 - protein, 9 aa, Homo Sapiens
EPSEDSEVE

SEQ ID NO: 642531 - protein, 9 aa, Homo Sapiens
QQSKVVNLW

SEQ ID NO: 642532 - protein, 9 aa, Homo Sapiens
HSNIYQLLN

SEQ ID NO: 642533 - protein, 9 aa, Homo Sapiens
EVLYSFSIY

SEQ ID NO: 642534 - protein, 9 aa, Homo Sapiens
AEGTFKVLQ

SEQ ID NO: 642535 - protein, 9 aa, Homo Sapiens
IGCGGSQTN

SEQ ID NO: 642536 - protein, 9 aa, Homo Sapiens
GEPCGNTCL

SEQ ID NO: 642537 - protein, 9 aa, Homo Sapiens
YWLTPHGLR

SEQ ID NO: 642538 - protein, 9 aa, Homo Sapiens
FLSLALSFR

SEQ ID NO: 642539 - protein, 9 aa, Homo Sapiens
NPIIDSLKT

SEQ ID NO: 642540 - protein, 9 aa, Homo Sapiens
IHCLHCGGG

SEQ ID NO: 642541 - protein, 9 aa, Homo Sapiens
YLLKCHMLP

SEQ ID NO: 642542 - protein, 9 aa, Homo Sapiens
GKVLVDVTY

SEQ ID NO: 642543 - protein, 9 aa, Homo Sapiens
QIHLRSHNG

SEQ ID NO: 642544 - protein, 9 aa, Homo Sapiens
LDSVSGNVL

SEQ ID NO: 642545 - protein, 9 aa, Homo Sapiens
GPGSPSAVE

SEQ ID NO: 642546 - protein, 9 aa, Homo Sapiens
YSFSIYVPD

SEQ ID NO: 642547 - protein, 9 aa, Homo Sapiens
SSHPHFVRC

SEQ ID NO: 642548 - protein, 9 aa, Homo Sapiens
QATSPRRTK

SEQ ID NO: 642549 - protein, 9 aa, Homo Sapiens
EKVNTAPCP

SEQ ID NO: 642550 - protein, 9 aa, Homo Sapiens
KGEGFGPSW

SEQ ID NO: 642551 - protein, 9 aa, Homo Sapiens
LALSFRFGD

SEQ ID NO: 642552 - protein, 9 aa, Homo Sapiens
SGQKLIDFM

SEQ ID NO: 642553 - protein, 9 aa, Homo Sapiens
LSLALSFRF

SEQ ID NO: 642554 - protein, 9 aa, Homo Sapiens
RESFHRGLQ

SEQ ID NO: 642555 - protein, 9 aa, Homo Sapiens
KLFPLLLQL

SEQ ID NO: 642556 - protein, 9 aa, Homo Sapiens
SVSGNVLHI

SEQ ID NO: 642557 - protein, 9 aa, Homo Sapiens
AAAASVTLL

SEQ ID NO: 642558 - protein, 9 aa, Homo Sapiens
ASVKHRGSK

SEQ ID NO: 642559 - protein, 9 aa, Homo Sapiens
IWNIGKCEL

SEQ ID NO: 642560 - protein, 9 aa, Homo Sapiens
TSAHGQPAA

SEQ ID NO: 642561 - protein, 9 aa, Homo Sapiens
HRTTPSVFN

SEQ ID NO: 642562 - protein, 9 aa, Homo Sapiens
RCRTRESVP

SEQ ID NO: 642563 - protein, 9 aa, Homo Sapiens
AVFVVFDEN

SEQ ID NO: 642564 - protein, 9 aa, Homo Sapiens
QQYTNLPER

SEQ ID NO: 642565 - protein, 9 aa, Homo Sapiens
PHHIQLKDV

SEQ ID NO: 642566 - protein, 9 aa, Homo Sapiens
QGRQIGAAA

SEQ ID NO: 642567 - protein, 9 aa, Homo Sapiens
GDFLGRESL

SEQ ID NO: 642568 - protein, 9 aa, Homo Sapiens
GPLLQLAAV

SEQ ID NO: 642569 - protein, 9 aa, Homo Sapiens
HTVTLPHAS

SEQ ID NO: 642570 - protein, 9 aa, Homo Sapiens
GTKSNRGHS

SEQ ID NO: 642571 - protein, 9 aa, Homo Sapiens
FLRDIEQLP

SEQ ID NO: 642572 - protein, 9 aa, Homo Sapiens
IYLLPKSKS

SEQ ID NO: 642573 - protein, 9 aa, Homo Sapiens
HVCTYDPKT

SEQ ID NO: 642574 - protein, 9 aa, Homo Sapiens
HPAGDEYEI

SEQ ID NO: 642575 - protein, 9 aa, Homo Sapiens
RAGISNQWN

SEQ ID NO: 642576 - protein, 9 aa, Homo Sapiens
SAWDAGPGE

SEQ ID NO: 642577 - protein, 9 aa, Homo Sapiens
KHIRSHTCE

SEQ ID NO: 642578 - protein, 9 aa, Homo Sapiens
QMRRYLTAF

SEQ ID NO: 642579 - protein, 9 aa, Homo Sapiens
QLSNNTGRI

SEQ ID NO: 642580 - protein, 9 aa, Homo Sapiens
FQDGVAGRE

SEQ ID NO: 642581 - protein, 9 aa, Homo Sapiens
LVVSVLRGS

SEQ ID NO: 642582 - protein, 9 aa, Homo Sapiens
ILNNHPGAE

SEQ ID NO: 642583 - protein, 9 aa, Homo Sapiens
GMHEMLDSV

SEQ ID NO: 642584 - protein, 9 aa, Homo Sapiens
SRCSSMGFR

SEQ ID NO: 642585 - protein, 9 aa, Homo Sapiens
VLRGSGGPV

SEQ ID NO: 642586 - protein, 9 aa, Homo Sapiens
TAPCPLPLF

SEQ ID NO: 642587 - protein, 9 aa, Homo Sapiens
KTWGFRRTI

SEQ ID NO: 642588 - protein, 9 aa, Homo Sapiens
GLFFSSVER

SEQ ID NO: 642589 - protein, 9 aa, Homo Sapiens
CEDSRSHGP

SEQ ID NO: 642590 - protein, 9 aa, Homo Sapiens
NLPERPSSV

SEQ ID NO: 642591 - protein, 9 aa, Homo Sapiens
VVQEELRQL

SEQ ID NO: 642592 - protein, 9 aa, Homo Sapiens
REPVPNCAD

SEQ ID NO: 642593 - protein, 9 aa, Homo Sapiens
RNDSVAVLR

SEQ ID NO: 642594 - protein, 9 aa, Homo Sapiens
LDMRPPPIA

SEQ ID NO: 642595 - protein, 9 aa, Homo Sapiens
FLVTATGII

SEQ ID NO: 642596 - protein, 9 aa, Homo Sapiens
REQPQRQKV

SEQ ID NO: 642597 - protein, 9 aa, Homo Sapiens
TDNHIRMHK

SEQ ID NO: 642598 - protein, 9 aa, Homo Sapiens
TAAKVIILE

SEQ ID NO: 642599 - protein, 9 aa, Homo Sapiens
QTMPVGIFT

SEQ ID NO: 642600 - protein, 9 aa, Homo Sapiens
WELDLPVDL

SEQ ID NO: 642601 - protein, 9 aa, Homo Sapiens
AEIRQPCCA

SEQ ID NO: 642602 - protein, 9 aa, Homo Sapiens
LLAILGGIA

SEQ ID NO: 642603 - protein, 9 aa, Homo Sapiens
QLYILLYWA

SEQ ID NO: 642604 - protein, 9 aa, Homo Sapiens
YEGLEVISH

SEQ ID NO: 642605 - protein, 9 aa, Homo Sapiens
TRRAAVCGN

SEQ ID NO: 642606 - protein, 9 aa, Homo Sapiens
APICAICCV

SEQ ID NO: 642607 - protein, 9 aa, Homo Sapiens
GGFTYQDVT

SEQ ID NO: 642608 - protein, 9 aa, Homo Sapiens
QPGSLQLTL

SEQ ID NO: 642609 - protein, 9 aa, Homo Sapiens
DHLVISDIK

SEQ ID NO: 642610 - protein, 9 aa, Homo Sapiens
HCLHCGGGP

SEQ ID NO: 642611 - protein, 9 aa, Homo Sapiens
LSADSKHHV

SEQ ID NO: 642612 - protein, 9 aa, Homo Sapiens
NFGGDPSKK

SEQ ID NO: 642613 - protein, 9 aa, Homo Sapiens
HTVAEAGRR

SEQ ID NO: 642614 - protein, 9 aa, Homo Sapiens
ALLGAIAVD

SEQ ID NO: 642615 - protein, 9 aa, Homo Sapiens
PPSGGAATW

SEQ ID NO: 642616 - protein, 9 aa, Homo Sapiens
WAFHLTSIT

SEQ ID NO: 642617 - protein, 9 aa, Homo Sapiens
IAFILLVLL

SEQ ID NO: 642618 - protein, 9 aa, Homo Sapiens
AHFYLEDIT

SEQ ID NO: 642619 - protein, 9 aa, Homo Sapiens
RRIRQPQWQ

SEQ ID NO: 642620 - protein, 9 aa, Homo Sapiens
YEFRHRPKC

SEQ ID NO: 642621 - protein, 9 aa, Homo Sapiens
DGSTALPTV

SEQ ID NO: 642622 - protein, 9 aa, Homo Sapiens
WIHSKYEEN

SEQ ID NO: 642623 - protein, 9 aa, Homo Sapiens
TTKISNDVC

SEQ ID NO: 642624 - protein, 9 aa, Homo Sapiens
PTTLKECIL

SEQ ID NO: 642625 - protein, 9 aa, Homo Sapiens
LLLRYLTWR

SEQ ID NO: 642626 - protein, 9 aa, Homo Sapiens
GCASIIYLL

SEQ ID NO: 642627 - protein, 9 aa, Homo Sapiens
QKVFSTCGS

SEQ ID NO: 642628 - protein, 9 aa, Homo Sapiens
EKMQIGIGC

SEQ ID NO: 642629 - protein, 9 aa, Homo Sapiens
LSPHPPVGT

SEQ ID NO: 642630 - protein, 9 aa, Homo Sapiens
CLYRKSCQR

SEQ ID NO: 642631 - protein, 9 aa, Homo Sapiens
RTIIAKREG

SEQ ID NO: 642632 - protein, 9 aa, Homo Sapiens
ETFNTLKYA

SEQ ID NO: 642633 - protein, 9 aa, Homo Sapiens
WPKIADCTE

SEQ ID NO: 642634 - protein, 9 aa, Homo Sapiens
SSAHPSSGT

SEQ ID NO: 642635 - protein, 9 aa, Homo Sapiens
LTPHGLRFL

SEQ ID NO: 642636 - protein, 9 aa, Homo Sapiens
TMLSCLGEK

SEQ ID NO: 642637 - protein, 9 aa, Homo Sapiens
EPKVQDSVL

SEQ ID NO: 642638 - protein, 9 aa, Homo Sapiens
GCVLVPPLL

SEQ ID NO: 642639 - protein, 9 aa, Homo Sapiens
IYHRIPMVG

SEQ ID NO: 642640 - protein, 9 aa, Homo Sapiens
VERLLKKLF

SEQ ID NO: 642641 - protein, 9 aa, Homo Sapiens
MSKNRLLIL

SEQ ID NO: 642642 - protein, 9 aa, Homo Sapiens
KKQLCVLPQ

SEQ ID NO: 642643 - protein, 9 aa, Homo Sapiens
TAAIENRKV

SEQ ID NO: 642644 - protein, 9 aa, Homo Sapiens
HPQDLDSTP

SEQ ID NO: 642645 - protein, 9 aa, Homo Sapiens
TATGIIRPG

SEQ ID NO: 642646 - protein, 9 aa, Homo Sapiens
SVERRSTSC

SEQ ID NO: 642647 - protein, 9 aa, Homo Sapiens
NFLVAPLAC

SEQ ID NO: 642648 - protein, 9 aa, Homo Sapiens
SHTCERPFP

SEQ ID NO: 642649 - protein, 9 aa, Homo Sapiens
YMVQHDSVP

SEQ ID NO: 642650 - protein, 9 aa, Homo Sapiens
VYDLKVRTI

SEQ ID NO: 642651 - protein, 9 aa, Homo Sapiens
VRCEQWTPI

SEQ ID NO: 642652 - protein, 9 aa, Homo Sapiens
DLCGHAEPC

SEQ ID NO: 642653 - protein, 9 aa, Homo Sapiens
KKPISCLGP

SEQ ID NO: 642654 - protein, 9 aa, Homo Sapiens
VDGSTALPT

SEQ ID NO: 642655 - protein, 9 aa, Homo Sapiens
WLDPAGPFF

SEQ ID NO: 642656 - protein, 9 aa, Homo Sapiens
GNACYMNSI

SEQ ID NO: 642657 - protein, 9 aa, Homo Sapiens
SLAGQAEVL

SEQ ID NO: 642658 - protein, 9 aa, Homo Sapiens
RALWSCTWH

SEQ ID NO: 642659 - protein, 9 aa, Homo Sapiens
PSSGTPSPA

SEQ ID NO: 642660 - protein, 9 aa, Homo Sapiens
VLEQVQLDI

SEQ ID NO: 642661 - protein, 9 aa, Homo Sapiens
VGFPIGMVD

SEQ ID NO: 642662 - protein, 9 aa, Homo Sapiens
YPAPNWARY

SEQ ID NO: 642663 - protein, 9 aa, Homo Sapiens
VSPQAVCGI

SEQ ID NO: 642664 - protein, 9 aa, Homo Sapiens
ANYYKPHHI

SEQ ID NO: 642665 - protein, 9 aa, Homo Sapiens
DFLGRESLG

SEQ ID NO: 642666 - protein, 9 aa, Homo Sapiens
AMKRNKHIK

SEQ ID NO: 642667 - protein, 9 aa, Homo Sapiens
GLGRITWLD

SEQ ID NO: 642668 - protein, 9 aa, Homo Sapiens
YRANLAQHG

SEQ ID NO: 642669 - protein, 9 aa, Homo Sapiens
SEAGGSGSL

SEQ ID NO: 642670 - protein, 9 aa, Homo Sapiens
ILDRCSVMI

SEQ ID NO: 642671 - protein, 9 aa, Homo Sapiens
CGGSQTNTI

SEQ ID NO: 642672 - protein, 9 aa, Homo Sapiens
TSALDTKSE

SEQ ID NO: 642673 - protein, 9 aa, Homo Sapiens
SRNFHATCY

SEQ ID NO: 642674 - protein, 9 aa, Homo Sapiens
ASRPPSKLT

SEQ ID NO: 642675 - protein, 9 aa, Homo Sapiens
TGTSSHCPT

SEQ ID NO: 642676 - protein, 9 aa, Homo Sapiens
ILGVKTSSF

SEQ ID NO: 642677 - protein, 9 aa, Homo Sapiens
SVDYNMLRS

SEQ ID NO: 642678 - protein, 9 aa, Homo Sapiens
EAGGSGSLS

SEQ ID NO: 642679 - protein, 9 aa, Homo Sapiens
NEHSGQGIA

SEQ ID NO: 642680 - protein, 9 aa, Homo Sapiens
DSPGARGPL

SEQ ID NO: 642681 - protein, 9 aa, Homo Sapiens
LITEHLPEL

SEQ ID NO: 642682 - protein, 9 aa, Homo Sapiens
EQASSGSHI

SEQ ID NO: 642683 - protein, 9 aa, Homo Sapiens
LGPDQQAYT

SEQ ID NO: 642684 - protein, 9 aa, Homo Sapiens
DGEERAASE

SEQ ID NO: 642685 - protein, 9 aa, Homo Sapiens
DMQASPSPS

SEQ ID NO: 642686 - protein, 9 aa, Homo Sapiens
YWAANVYGS

SEQ ID NO: 642687 - protein, 9 aa, Homo Sapiens
QAQQSVDIL

SEQ ID NO: 642688 - protein, 9 aa, Homo Sapiens
EGTMYPSQV

SEQ ID NO: 642689 - protein, 9 aa, Homo Sapiens
PIAMITLNN

SEQ ID NO: 642690 - protein, 9 aa, Homo Sapiens
MKAKENEEF

SEQ ID NO: 642691 - protein, 9 aa, Homo Sapiens
GSKQPSASQ

SEQ ID NO: 642692 - protein, 9 aa, Homo Sapiens
EERQVMDHV

SEQ ID NO: 642693 - protein, 9 aa, Homo Sapiens
NFIVKHMRD

SEQ ID NO: 642694 - protein, 9 aa, Homo Sapiens
GRDLGSFAR

SEQ ID NO: 642695 - protein, 9 aa, Homo Sapiens
IDSLKTKQI

SEQ ID NO: 642696 - protein, 9 aa, Homo Sapiens
KEENGGQHR

SEQ ID NO: 642697 - protein, 9 aa, Homo Sapiens
DPFTSYPFT

SEQ ID NO: 642698 - protein, 9 aa, Homo Sapiens
RTSRFIHTD

SEQ ID NO: 642699 - protein, 9 aa, Homo Sapiens
SLPQSLPRA

SEQ ID NO: 642700 - protein, 9 aa, Homo Sapiens
HCQRLQPTR

SEQ ID NO: 642701 - protein, 9 aa, Homo Sapiens
MNFTVDVMG

SEQ ID NO: 642702 - protein, 9 aa, Homo Sapiens
SPESPPVAE

SEQ ID NO: 642703 - protein, 9 aa, Homo Sapiens
NAELCECLD

SEQ ID NO: 642704 - protein, 9 aa, Homo Sapiens
ELPANYRYG

SEQ ID NO: 642705 - protein, 9 aa, Homo Sapiens
QAEVLKVLV

SEQ ID NO: 642706 - protein, 9 aa, Homo Sapiens
GQMWKRPQI

SEQ ID NO: 642707 - protein, 9 aa, Homo Sapiens
GFNITDTTF

SEQ ID NO: 642708 - protein, 9 aa, Homo Sapiens
LEALVYSDY

SEQ ID NO: 642709 - protein, 9 aa, Homo Sapiens
MSGSTISAF

SEQ ID NO: 642710 - protein, 9 aa, Homo Sapiens
PFFGDTPVE

SEQ ID NO: 642711 - protein, 9 aa, Homo Sapiens
SLAFGTPVD

SEQ ID NO: 642712 - protein, 9 aa, Homo Sapiens
FIELLPWAL

SEQ ID NO: 642713 - protein, 9 aa, Homo Sapiens
GLIGAEFGA

SEQ ID NO: 642714 - protein, 9 aa, Homo Sapiens
VISLPHPWA

SEQ ID NO: 642715 - protein, 9 aa, Homo Sapiens
LKALQATHS

SEQ ID NO: 642716 - protein, 9 aa, Homo Sapiens
DAWKPQRKF

SEQ ID NO: 642717 - protein, 9 aa, Homo Sapiens
CATRVGNTV

SEQ ID NO: 642718 - protein, 9 aa, Homo Sapiens
ETRAHAVER

SEQ ID NO: 642719 - protein, 9 aa, Homo Sapiens
PNLVVSVLR

SEQ ID NO: 642720 - protein, 9 aa, Homo Sapiens
FCGCCRIFQ

SEQ ID NO: 642721 - protein, 9 aa, Homo Sapiens
GASWGSLWL

SEQ ID NO: 642722 - protein, 9 aa, Homo Sapiens
ACSARVASS

SEQ ID NO: 642723 - protein, 9 aa, Homo Sapiens
PSRDNRYEF

SEQ ID NO: 642724 - protein, 9 aa, Homo Sapiens
VRRKVSEAN

SEQ ID NO: 642725 - protein, 9 aa, Homo Sapiens
SNKKPEMLD

SEQ ID NO: 642726 - protein, 9 aa, Homo Sapiens
LQANSWKMA

SEQ ID NO: 642727 - protein, 9 aa, Homo Sapiens
NGSVSSRVK

SEQ ID NO: 642728 - protein, 9 aa, Homo Sapiens
RELRDCFRP

SEQ ID NO: 642729 - protein, 9 aa, Homo Sapiens
SSAGAEGSG

SEQ ID NO: 642730 - protein, 9 aa, Homo Sapiens
YDGEERAAS

SEQ ID NO: 642731 - protein, 9 aa, Homo Sapiens
NKLLLSFGK

SEQ ID NO: 642732 - protein, 9 aa, Homo Sapiens
LRLKLSCLF

SEQ ID NO: 642733 - protein, 9 aa, Homo Sapiens
SLRAVAELH

SEQ ID NO: 642734 - protein, 9 aa, Homo Sapiens
GLQPQELED

SEQ ID NO: 642735 - protein, 9 aa, Homo Sapiens
DRTPPLLYS

SEQ ID NO: 642736 - protein, 9 aa, Homo Sapiens
LLKCHMLPF

SEQ ID NO: 642737 - protein, 9 aa, Homo Sapiens
PVGKYHIQA

SEQ ID NO: 642738 - protein, 9 aa, Homo Sapiens
VGMDTAAKV

SEQ ID NO: 642739 - protein, 9 aa, Homo Sapiens
NACYMNSIL

SEQ ID NO: 642740 - protein, 9 aa, Homo Sapiens
ALAKEVFGN

SEQ ID NO: 642741 - protein, 9 aa, Homo Sapiens
LYCKCSMQE

SEQ ID NO: 642742 - protein, 9 aa, Homo Sapiens
SVLMPCFLT

SEQ ID NO: 642743 - protein, 9 aa, Homo Sapiens
DNHIRMHKV

SEQ ID NO: 642744 - protein, 9 aa, Homo Sapiens
ALASSTIGI

SEQ ID NO: 642745 - protein, 9 aa, Homo Sapiens
RIALPGDKQ

SEQ ID NO: 642746 - protein, 9 aa, Homo Sapiens
SVVRIFLHK

SEQ ID NO: 642747 - protein, 9 aa, Homo Sapiens
WSWRGSQAT

SEQ ID NO: 642748 - protein, 9 aa, Homo Sapiens
TECFFLEVM

SEQ ID NO: 642749 - protein, 9 aa, Homo Sapiens
DTQHGETLR

SEQ ID NO: 642750 - protein, 9 aa, Homo Sapiens
LNQKTHIGE

SEQ ID NO: 642751 - protein, 9 aa, Homo Sapiens
LGNACYMNS

SEQ ID NO: 642752 - protein, 9 aa, Homo Sapiens
GEAWQETML

SEQ ID NO: 642753 - protein, 9 aa, Homo Sapiens
HNVSYLYES

SEQ ID NO: 642754 - protein, 9 aa, Homo Sapiens
LDNTAVNYS

SEQ ID NO: 642755 - protein, 9 aa, Homo Sapiens
KQPSASQSS

SEQ ID NO: 642756 - protein, 9 aa, Homo Sapiens
GEEAKKFRK

SEQ ID NO: 642757 - protein, 9 aa, Homo Sapiens
HHLARHAVS

SEQ ID NO: 642758 - protein, 9 aa, Homo Sapiens
PNGTLVVIV

SEQ ID NO: 642759 - protein, 9 aa, Homo Sapiens
FMSSIEVII

SEQ ID NO: 642760 - protein, 9 aa, Homo Sapiens
LGIIGHAGQ

SEQ ID NO: 642761 - protein, 9 aa, Homo Sapiens
VLMPCFLTF

SEQ ID NO: 642762 - protein, 9 aa, Homo Sapiens
RACPRQVLF

SEQ ID NO: 642763 - protein, 9 aa, Homo Sapiens
RILNSQSIS

SEQ ID NO: 642764 - protein, 9 aa, Homo Sapiens
FLRATEAYY

SEQ ID NO: 642765 - protein, 9 aa, Homo Sapiens
LLDMRPPPI

SEQ ID NO: 642766 - protein, 9 aa, Homo Sapiens
AIVLLGLIG

SEQ ID NO: 642767 - protein, 9 aa, Homo Sapiens
GSSGQPPSG

SEQ ID NO: 642768 - protein, 9 aa, Homo Sapiens
PAHAYAQLS

SEQ ID NO: 642769 - protein, 9 aa, Homo Sapiens
KIADCTESY

SEQ ID NO: 642770 - protein, 9 aa, Homo Sapiens
QVLWQHAGL

SEQ ID NO: 642771 - protein, 9 aa, Homo Sapiens
APEILYSAL

SEQ ID NO: 642772 - protein, 9 aa, Homo Sapiens
YLLAQDRSP

SEQ ID NO: 642773 - protein, 9 aa, Homo Sapiens
AVVHAVYDL

SEQ ID NO: 642774 - protein, 9 aa, Homo Sapiens
AEKLYECEE

SEQ ID NO: 642775 - protein, 9 aa, Homo Sapiens
ISLPHPWAL

SEQ ID NO: 642776 - protein, 9 aa, Homo Sapiens
FQLSNNTGR

SEQ ID NO: 642777 - protein, 9 aa, Homo Sapiens
RCLLLSIRG

SEQ ID NO: 642778 - protein, 9 aa, Homo Sapiens
KKTNSCLKR

SEQ ID NO: 642779 - protein, 9 aa, Homo Sapiens
GNAHGNPEN

SEQ ID NO: 642780 - protein, 9 aa, Homo Sapiens
VGYMVQHDS

SEQ ID NO: 642781 - protein, 9 aa, Homo Sapiens
TFSSTPCAT

SEQ ID NO: 642782 - protein, 9 aa, Homo Sapiens
KHPQDLDST

SEQ ID NO: 642783 - protein, 9 aa, Homo Sapiens
KLLLPDDDK

SEQ ID NO: 642784 - protein, 9 aa, Homo Sapiens
QDEGTLELT

SEQ ID NO: 642785 - protein, 9 aa, Homo Sapiens
LCTCTDCHG

SEQ ID NO: 642786 - protein, 9 aa, Homo Sapiens
GGSHHRHQS

SEQ ID NO: 642787 - protein, 9 aa, Homo Sapiens
IFGFIHPER

SEQ ID NO: 642788 - protein, 9 aa, Homo Sapiens
YTTDVVASL

SEQ ID NO: 642789 - protein, 9 aa, Homo Sapiens
DLCVVGEER

SEQ ID NO: 642790 - protein, 9 aa, Homo Sapiens
TKAETQTEE

SEQ ID NO: 642791 - protein, 9 aa, Homo Sapiens
DDRFVATCS

SEQ ID NO: 642792 - protein, 9 aa, Homo Sapiens
PQVTLNFSE

SEQ ID NO: 642793 - protein, 9 aa, Homo Sapiens
LLSSEYDEP

SEQ ID NO: 642794 - protein, 9 aa, Homo Sapiens
IYDGEERAA

SEQ ID NO: 642795 - protein, 9 aa, Homo Sapiens
SQHQGRQIG

SEQ ID NO: 642796 - protein, 9 aa, Homo Sapiens
NVSYLYESL

SEQ ID NO: 642797 - protein, 9 aa, Homo Sapiens
LGFWWLIEL

SEQ ID NO: 642798 - protein, 9 aa, Homo Sapiens
CADCGKSFN

SEQ ID NO: 642799 - protein, 9 aa, Homo Sapiens
SAEGRQKVF

SEQ ID NO: 642800 - protein, 9 aa, Homo Sapiens
FRSSKFPTK

SEQ ID NO: 642801 - protein, 9 aa, Homo Sapiens
ARVASSALC

SEQ ID NO: 642802 - protein, 9 aa, Homo Sapiens
LSVDNEHSG

SEQ ID NO: 642803 - protein, 9 aa, Homo Sapiens
NGTLVVIVN

SEQ ID NO: 642804 - protein, 9 aa, Homo Sapiens
LLAEIRTIA

SEQ ID NO: 642805 - protein, 9 aa, Homo Sapiens
SKNRLLILI

SEQ ID NO: 642806 - protein, 9 aa, Homo Sapiens
GKQYLLGDF

SEQ ID NO: 642807 - protein, 9 aa, Homo Sapiens
DNKLLLSFG

SEQ ID NO: 642808 - protein, 9 aa, Homo Sapiens
AAADDVVYT

SEQ ID NO: 642809 - protein, 9 aa, Homo Sapiens
GSCGSYSWE

SEQ ID NO: 642810 - protein, 9 aa, Homo Sapiens
EAFLRATEA

SEQ ID NO: 642811 - protein, 9 aa, Homo Sapiens
LSGAAADDV

SEQ ID NO: 642812 - protein, 9 aa, Homo Sapiens
KWQQADGYV

SEQ ID NO: 642813 - protein, 9 aa, Homo Sapiens
CKGQNGNAH

SEQ ID NO: 642814 - protein, 9 aa, Homo Sapiens
SRHLGQSLL

SEQ ID NO: 642815 - protein, 9 aa, Homo Sapiens
HAYAQLSPS

SEQ ID NO: 642816 - protein, 9 aa, Homo Sapiens
QPQELEDGG

SEQ ID NO: 642817 - protein, 9 aa, Homo Sapiens
IVMLVLRDM

SEQ ID NO: 642818 - protein, 9 aa, Homo Sapiens
QEPSEDSEV

SEQ ID NO: 642819 - protein, 9 aa, Homo Sapiens
SRGCPQMGH

SEQ ID NO: 642820 - protein, 9 aa, Homo Sapiens
VKRSQQKKK

SEQ ID NO: 642821 - protein, 9 aa, Homo Sapiens
GSYICKSHK

SEQ ID NO: 642822 - protein, 9 aa, Homo Sapiens
PREGMFHYG

SEQ ID NO: 642823 - protein, 9 aa, Homo Sapiens
QISPSRDNR

SEQ ID NO: 642824 - protein, 9 aa, Homo Sapiens
SPTEKAGSS

SEQ ID NO: 642825 - protein, 9 aa, Homo Sapiens
PQEAAWAQG

SEQ ID NO: 642826 - protein, 9 aa, Homo Sapiens
PESPPVAEA

SEQ ID NO: 642827 - protein, 9 aa, Homo Sapiens
DHERERPTA

SEQ ID NO: 642828 - protein, 9 aa, Homo Sapiens
LPGDKQHPT

SEQ ID NO: 642829 - protein, 9 aa, Homo Sapiens
LTSEEVIKE

SEQ ID NO: 642830 - protein, 9 aa, Homo Sapiens
LAISSSFAA

SEQ ID NO: 642831 - protein, 9 aa, Homo Sapiens
ILGGIAFIL

SEQ ID NO: 642832 - protein, 9 aa, Homo Sapiens
GDTTPFPVT

SEQ ID NO: 642833 - protein, 9 aa, Homo Sapiens
QSLPRATGN

SEQ ID NO: 642834 - protein, 9 aa, Homo Sapiens
PPPFPQGNQ

SEQ ID NO: 642835 - protein, 9 aa, Homo Sapiens
PEGKPKTRR

SEQ ID NO: 642836 - protein, 9 aa, Homo Sapiens
TTFSSRNFH

SEQ ID NO: 642837 - protein, 9 aa, Homo Sapiens
AAAEGTFKV

SEQ ID NO: 642838 - protein, 9 aa, Homo Sapiens
NSHDDRLSQ

SEQ ID NO: 642839 - protein, 9 aa, Homo Sapiens
FGMNFGGDP

SEQ ID NO: 642840 - protein, 9 aa, Homo Sapiens
ELTARELLL

SEQ ID NO: 642841 - protein, 9 aa, Homo Sapiens
VVDFKKEAF

SEQ ID NO: 642842 - protein, 9 aa, Homo Sapiens
KKYDKCCAD

SEQ ID NO: 642843 - protein, 9 aa, Homo Sapiens
KCFIKSSNL

SEQ ID NO: 642844 - protein, 9 aa, Homo Sapiens
KLESLWVPG

SEQ ID NO: 642845 - protein, 9 aa, Homo Sapiens
TSMLVEVAN

SEQ ID NO: 642846 - protein, 9 aa, Homo Sapiens
LGHKGEGFG

SEQ ID NO: 642847 - protein, 9 aa, Homo Sapiens
LLKSRCSSM

SEQ ID NO: 642848 - protein, 9 aa, Homo Sapiens
EVFGNTLNE

SEQ ID NO: 642849 - protein, 9 aa, Homo Sapiens
ILDLAKHRT

SEQ ID NO: 642850 - protein, 9 aa, Homo Sapiens
WQETMLSCL

SEQ ID NO: 642851 - protein, 9 aa, Homo Sapiens
PVQLESEVT

SEQ ID NO: 642852 - protein, 9 aa, Homo Sapiens
LLSGIIQLA

SEQ ID NO: 642853 - protein, 9 aa, Homo Sapiens
TSYPFTKNP

SEQ ID NO: 642854 - protein, 9 aa, Homo Sapiens
KVWMSTALA

SEQ ID NO: 642855 - protein, 9 aa, Homo Sapiens
QPWFEFLVQ

SEQ ID NO: 642856 - protein, 9 aa, Homo Sapiens
KGQNGNAHG

SEQ ID NO: 642857 - protein, 9 aa, Homo Sapiens
PRLSVWVRE

SEQ ID NO: 642858 - protein, 9 aa, Homo Sapiens
FCSRNKYKL

SEQ ID NO: 642859 - protein, 9 aa, Homo Sapiens
TTSRDIKET

SEQ ID NO: 642860 - protein, 9 aa, Homo Sapiens
GSGLMALAS

SEQ ID NO: 642861 - protein, 9 aa, Homo Sapiens
NDLGNHRGT

SEQ ID NO: 642862 - protein, 9 aa, Homo Sapiens
SKLTWSWRG

SEQ ID NO: 642863 - protein, 9 aa, Homo Sapiens
CNDMTVRRK

SEQ ID NO: 642864 - protein, 9 aa, Homo Sapiens
YIYASVSTL

SEQ ID NO: 642865 - protein, 9 aa, Homo Sapiens
FLEVMAFDR

SEQ ID NO: 642866 - protein, 9 aa, Homo Sapiens
HVKSRHLGQ

SEQ ID NO: 642867 - protein, 9 aa, Homo Sapiens
KPTNLNNKM

SEQ ID NO: 642868 - protein, 9 aa, Homo Sapiens
QVQLDIPLG

SEQ ID NO: 642869 - protein, 9 aa, Homo Sapiens
TEHLPELQL

SEQ ID NO: 642870 - protein, 9 aa, Homo Sapiens
LTAFTREQI

SEQ ID NO: 642871 - protein, 9 aa, Homo Sapiens
CCCLGIMPM

SEQ ID NO: 642872 - protein, 9 aa, Homo Sapiens
HSKYEENLF

SEQ ID NO: 642873 - protein, 9 aa, Homo Sapiens
SIEVIISQE

SEQ ID NO: 642874 - protein, 9 aa, Homo Sapiens
RELLLKKMF

SEQ ID NO: 642875 - protein, 9 aa, Homo Sapiens
GASPESPPV

SEQ ID NO: 642876 - protein, 9 aa, Homo Sapiens
RSTSCKGQN

SEQ ID NO: 642877 - protein, 9 aa, Homo Sapiens
NNHPGAELP

SEQ ID NO: 642878 - protein, 9 aa, Homo Sapiens
ADIHCLHCG

SEQ ID NO: 642879 - protein, 9 aa, Homo Sapiens
LAKEVFGNT

SEQ ID NO: 642880 - protein, 9 aa, Homo Sapiens
KVFSYRANL

SEQ ID NO: 642881 - protein, 9 aa, Homo Sapiens
SVSTLLMEN

SEQ ID NO: 642882 - protein, 9 aa, Homo Sapiens
GFNIAQVLW

SEQ ID NO: 642883 - protein, 9 aa, Homo Sapiens
AIAQCFTCM

SEQ ID NO: 642884 - protein, 9 aa, Homo Sapiens
DMRPPPIAM

SEQ ID NO: 642885 - protein, 9 aa, Homo Sapiens
NNFGIGEKM

SEQ ID NO: 642886 - protein, 9 aa, Homo Sapiens
RSDTDVLNV

SEQ ID NO: 642887 - protein, 9 aa, Homo Sapiens
VYPAPNWAR

SEQ ID NO: 642888 - protein, 9 aa, Homo Sapiens
AHRRVEAMP

SEQ ID NO: 642889 - protein, 9 aa, Homo Sapiens
RNDLGDKYN

SEQ ID NO: 642890 - protein, 9 aa, Homo Sapiens
SPAARAPGP

SEQ ID NO: 642891 - protein, 9 aa, Homo Sapiens
SMPTVTNFF

SEQ ID NO: 642892 - protein, 9 aa, Homo Sapiens
IHLRSHNGE

SEQ ID NO: 642893 - protein, 9 aa, Homo Sapiens
SRSHGPVRF

SEQ ID NO: 642894 - protein, 9 aa, Homo Sapiens
ASSGSHIPF

SEQ ID NO: 642895 - protein, 9 aa, Homo Sapiens
LWGSLFVGG

SEQ ID NO: 642896 - protein, 9 aa, Homo Sapiens
LQQIKIWNI

SEQ ID NO: 642897 - protein, 9 aa, Homo Sapiens
DLRLKLSCL

SEQ ID NO: 642898 - protein, 9 aa, Homo Sapiens
VTDNHIRMH

SEQ ID NO: 642899 - protein, 9 aa, Homo Sapiens
ATHSVACLA

SEQ ID NO: 642900 - protein, 9 aa, Homo Sapiens
NECKMNPSK

SEQ ID NO: 642901 - protein, 9 aa, Homo Sapiens
PTKMGRGKH

SEQ ID NO: 642902 - protein, 9 aa, Homo Sapiens
RAAQRALSH

SEQ ID NO: 642903 - protein, 9 aa, Homo Sapiens
SPSAVEHGP

SEQ ID NO: 642904 - protein, 9 aa, Homo Sapiens
AAGRGASAW

SEQ ID NO: 642905 - protein, 9 aa, Homo Sapiens
MAAQQRDWG

SEQ ID NO: 642906 - protein, 9 aa, Homo Sapiens
PRHILYCKC

SEQ ID NO: 642907 - protein, 9 aa, Homo Sapiens
HPENALKRG

SEQ ID NO: 642908 - protein, 9 aa, Homo Sapiens
VVTPLLNTV

SEQ ID NO: 642909 - protein, 9 aa, Homo Sapiens
PWARLLLRI

SEQ ID NO: 642910 - protein, 9 aa, Homo Sapiens
LTAHVGHSV

SEQ ID NO: 642911 - protein, 9 aa, Homo Sapiens
LVDVTYPAG

SEQ ID NO: 642912 - protein, 9 aa, Homo Sapiens
WAQGRAGAP

SEQ ID NO: 642913 - protein, 9 aa, Homo Sapiens
FHYGVPIPV

SEQ ID NO: 642914 - protein, 9 aa, Homo Sapiens
FRRTIIAKR

SEQ ID NO: 642915 - protein, 9 aa, Homo Sapiens
YSWETGAMV

SEQ ID NO: 642916 - protein, 9 aa, Homo Sapiens
PNLPRLSVW

SEQ ID NO: 642917 - protein, 9 aa, Homo Sapiens
CGMHEMLDS

SEQ ID NO: 642918 - protein, 9 aa, Homo Sapiens
LMALASSTI

SEQ ID NO: 642919 - protein, 9 aa, Homo Sapiens
RCEQWTPIE

SEQ ID NO: 642920 - protein, 9 aa, Homo Sapiens
ILYSALPTD

SEQ ID NO: 642921 - protein, 9 aa, Homo Sapiens
IRIALPGDK

SEQ ID NO: 642922 - protein, 9 aa, Homo Sapiens
MHPSGYRMI

SEQ ID NO: 642923 - protein, 9 aa, Homo Sapiens
AIDAKLTSE

SEQ ID NO: 642924 - protein, 9 aa, Homo Sapiens
TGDTTPFPV

SEQ ID NO: 642925 - protein, 9 aa, Homo Sapiens
LELGCILRT

SEQ ID NO: 642926 - protein, 9 aa, Homo Sapiens
LNFANGEEA

SEQ ID NO: 642927 - protein, 9 aa, Homo Sapiens
KRKAHILNN

SEQ ID NO: 642928 - protein, 9 aa, Homo Sapiens
MRPPPIAMI

SEQ ID NO: 642929 - protein, 9 aa, Homo Sapiens
DDDKFHGGW

SEQ ID NO: 642930 - protein, 9 aa, Homo Sapiens
TSILKRRGC

SEQ ID NO: 642931 - protein, 9 aa, Homo Sapiens
RNGSDYPSY

SEQ ID NO: 642932 - protein, 9 aa, Homo Sapiens
SHLVLPVHP

SEQ ID NO: 642933 - protein, 9 aa, Homo Sapiens
CTCTDCHGI

SEQ ID NO: 642934 - protein, 9 aa, Homo Sapiens
LPTVPEPTA

SEQ ID NO: 642935 - protein, 9 aa, Homo Sapiens
KQLQQGFFP

SEQ ID NO: 642936 - protein, 9 aa, Homo Sapiens
KCSVPLGHV

SEQ ID NO: 642937 - protein, 9 aa, Homo Sapiens
HAVYDLKVR

SEQ ID NO: 642938 - protein, 9 aa, Homo Sapiens
GAGYPRSRT

SEQ ID NO: 642939 - protein, 9 aa, Homo Sapiens
ELGCILRTF

SEQ ID NO: 642940 - protein, 9 aa, Homo Sapiens
NFANGEEAK

SEQ ID NO: 642941 - protein, 9 aa, Homo Sapiens
KSRPCSLTV

SEQ ID NO: 642942 - protein, 9 aa, Homo Sapiens
FANGEEAKK

SEQ ID NO: 642943 - protein, 9 aa, Homo Sapiens
LGVKTSSFL

SEQ ID NO: 642944 - protein, 9 aa, Homo Sapiens
LHGLGRACV

SEQ ID NO: 642945 - protein, 9 aa, Homo Sapiens
ELQLSTAIE

SEQ ID NO: 642946 - protein, 9 aa, Homo Sapiens
LVIAFILTG

SEQ ID NO: 642947 - protein, 9 aa, Homo Sapiens
ADCGKSFNH

SEQ ID NO: 642948 - protein, 9 aa, Homo Sapiens
YICKSHKGF

SEQ ID NO: 642949 - protein, 9 aa, Homo Sapiens
IFRIATPPS

SEQ ID NO: 642950 - protein, 9 aa, Homo Sapiens
MLPFYGCAF

SEQ ID NO: 642951 - protein, 9 aa, Homo Sapiens
CGQAGGPQR

SEQ ID NO: 642952 - protein, 9 aa, Homo Sapiens
RILDRCSVM

SEQ ID NO: 642953 - protein, 9 aa, Homo Sapiens
VQLDIPLGL

SEQ ID NO: 642954 - protein, 9 aa, Homo Sapiens
MSCSEIPAA

SEQ ID NO: 642955 - protein, 9 aa, Homo Sapiens
SWRGSQATS

SEQ ID NO: 642956 - protein, 9 aa, Homo Sapiens
PRRTKAFSS

SEQ ID NO: 642957 - protein, 9 aa, Homo Sapiens
KYKLTALER

SEQ ID NO: 642958 - protein, 9 aa, Homo Sapiens
MLDMLLITN

SEQ ID NO: 642959 - protein, 9 aa, Homo Sapiens
KCFEDTKPA

SEQ ID NO: 642960 - protein, 9 aa, Homo Sapiens
KEGYQDYYT

SEQ ID NO: 642961 - protein, 9 aa, Homo Sapiens
AKQEDMMLH

SEQ ID NO: 642962 - protein, 9 aa, Homo Sapiens
TIYRPCSEG

SEQ ID NO: 642963 - protein, 9 aa, Homo Sapiens
TFLLYRLTA

SEQ ID NO: 642964 - protein, 9 aa, Homo Sapiens
KPCQMGNSG

SEQ ID NO: 642965 - protein, 9 aa, Homo Sapiens
KLWRTEAIR

SEQ ID NO: 642966 - protein, 9 aa, Homo Sapiens
LEDPQTYSN

SEQ ID NO: 642967 - protein, 9 aa, Homo Sapiens
ALSHFPGSA

SEQ ID NO: 642968 - protein, 9 aa, Homo Sapiens
ELMLELGCI

SEQ ID NO: 642969 - protein, 9 aa, Homo Sapiens
ENTAFLPPS

SEQ ID NO: 642970 - protein, 9 aa, Homo Sapiens
GLQSIQETL

SEQ ID NO: 642971 - protein, 9 aa, Homo Sapiens
SGCNYVAGG

SEQ ID NO: 642972 - protein, 9 aa, Homo Sapiens
HHSAVLLDQ

SEQ ID NO: 642973 - protein, 9 aa, Homo Sapiens
EQDLSMADS

SEQ ID NO: 642974 - protein, 9 aa, Homo Sapiens
KRFSCPYPH

SEQ ID NO: 642975 - protein, 9 aa, Homo Sapiens
QGAPAGVEK

SEQ ID NO: 642976 - protein, 9 aa, Homo Sapiens
ASTWNTDAS

SEQ ID NO: 642977 - protein, 9 aa, Homo Sapiens
GLDALKNNP

SEQ ID NO: 642978 - protein, 9 aa, Homo Sapiens
LLLRALKLH

SEQ ID NO: 642979 - protein, 9 aa, Homo Sapiens
YYPMAPGTY

SEQ ID NO: 642980 - protein, 9 aa, Homo Sapiens
GEQRLQQER

SEQ ID NO: 642981 - protein, 9 aa, Homo Sapiens
MADSAATAG

SEQ ID NO: 642982 - protein, 9 aa, Homo Sapiens
LQVLVAQPG

SEQ ID NO: 642983 - protein, 9 aa, Homo Sapiens
ALQAQENSD

SEQ ID NO: 642984 - protein, 9 aa, Homo Sapiens
SKEQLVVFN

SEQ ID NO: 642985 - protein, 9 aa, Homo Sapiens
QDQHQPQQQ

SEQ ID NO: 642986 - protein, 9 aa, Homo Sapiens
ADQDQHQPQ

SEQ ID NO: 642987 - protein, 9 aa, Homo Sapiens
QLTLLLRAL

SEQ ID NO: 642988 - protein, 9 aa, Homo Sapiens
LKELKLHRC

SEQ ID NO: 642989 - protein, 9 aa, Homo Sapiens
LLHPPQQPP

SEQ ID NO: 642990 - protein, 9 aa, Homo Sapiens
GGTFLNVGC

SEQ ID NO: 642991 - protein, 9 aa, Homo Sapiens
PSPSLALPA

SEQ ID NO: 642992 - protein, 9 aa, Homo Sapiens
FSLWPALSL

SEQ ID NO: 642993 - protein, 9 aa, Homo Sapiens
SLALPAHHN

SEQ ID NO: 642994 - protein, 9 aa, Homo Sapiens
IENVGGRLH

SEQ ID NO: 642995 - protein, 9 aa, Homo Sapiens
KKTQQLAKT

SEQ ID NO: 642996 - protein, 9 aa, Homo Sapiens
TNLSHTVDV

SEQ ID NO: 642997 - protein, 9 aa, Homo Sapiens
EKLAIILKE

SEQ ID NO: 642998 - protein, 9 aa, Homo Sapiens
RGLGSILIV

SEQ ID NO: 642999 - protein, 9 aa, Homo Sapiens
RTHSREKPY

SEQ ID NO: 643000 - protein, 9 aa, Homo Sapiens
THSFFNVSQ

SEQ ID NO: 643001 - protein, 9 aa, Homo Sapiens
RCCFCGEHH

SEQ ID NO: 643002 - protein, 9 aa, Homo Sapiens
QQEQEGGQH

SEQ ID NO: 643003 - protein, 9 aa, Homo Sapiens
RVLGPAAAG

SEQ ID NO: 643004 - protein, 9 aa, Homo Sapiens
TSYRVVPAS

SEQ ID NO: 643005 - protein, 9 aa, Homo Sapiens
ATSQTLATC

SEQ ID NO: 643006 - protein, 9 aa, Homo Sapiens
NNLILGTRR

SEQ ID NO: 643007 - protein, 9 aa, Homo Sapiens
CAHAQPAGA

SEQ ID NO: 643008 - protein, 9 aa, Homo Sapiens
LWDEVPDDF

SEQ ID NO: 643009 - protein, 9 aa, Homo Sapiens
CATGGGGYK

SEQ ID NO: 643010 - protein, 9 aa, Homo Sapiens
ALSQFFDRV

SEQ ID NO: 643011 - protein, 9 aa, Homo Sapiens
HAAELILPL

SEQ ID NO: 643012 - protein, 9 aa, Homo Sapiens
LQEEFHRYS

SEQ ID NO: 643013 - protein, 9 aa, Homo Sapiens
AEGWWPEEP

SEQ ID NO: 643014 - protein, 9 aa, Homo Sapiens
QNVLFYHTT

SEQ ID NO: 643015 - protein, 9 aa, Homo Sapiens
YDQEELMAT

SEQ ID NO: 643016 - protein, 9 aa, Homo Sapiens
FRGPKGVPG

SEQ ID NO: 643017 - protein, 9 aa, Homo Sapiens
LSASGKEMD

SEQ ID NO: 643018 - protein, 9 aa, Homo Sapiens
GSKRKYRMG

SEQ ID NO: 643019 - protein, 9 aa, Homo Sapiens
SSLRRNRWA

SEQ ID NO: 643020 - protein, 9 aa, Homo Sapiens
LSPIKDQDR

SEQ ID NO: 643021 - protein, 9 aa, Homo Sapiens
RRSKCSGPK

SEQ ID NO: 643022 - protein, 9 aa, Homo Sapiens
MVHKAVEDG

SEQ ID NO: 643023 - protein, 9 aa, Homo Sapiens
VEAFLLALP

SEQ ID NO: 643024 - protein, 9 aa, Homo Sapiens
EHVIWRLFS

SEQ ID NO: 643025 - protein, 9 aa, Homo Sapiens
RWAVARVVG

SEQ ID NO: 643026 - protein, 9 aa, Homo Sapiens
SAGIPGADS

SEQ ID NO: 643027 - protein, 9 aa, Homo Sapiens
GSSCIGADT

SEQ ID NO: 643028 - protein, 9 aa, Homo Sapiens
TESKLLEKI

SEQ ID NO: 643029 - protein, 9 aa, Homo Sapiens
RPGIDREAS

SEQ ID NO: 643030 - protein, 9 aa, Homo Sapiens
TTPSKKKLK

SEQ ID NO: 643031 - protein, 9 aa, Homo Sapiens
AAFMTTQTV

SEQ ID NO: 643032 - protein, 9 aa, Homo Sapiens
MGNAWPLVA

SEQ ID NO: 643033 - protein, 9 aa, Homo Sapiens
PQLLLVPPQ

SEQ ID NO: 643034 - protein, 9 aa, Homo Sapiens
KRKYRMGNL

SEQ ID NO: 643035 - protein, 9 aa, Homo Sapiens
DNREKLAII

SEQ ID NO: 643036 - protein, 9 aa, Homo Sapiens
NTSSKEQLV

SEQ ID NO: 643037 - protein, 9 aa, Homo Sapiens
LALHVLHQQ

SEQ ID NO: 643038 - protein, 9 aa, Homo Sapiens
SGVGARANQ

SEQ ID NO: 643039 - protein, 9 aa, Homo Sapiens
IIREGAVVK

SEQ ID NO: 643040 - protein, 9 aa, Homo Sapiens
NHTHSFFNV

SEQ ID NO: 643041 - protein, 9 aa, Homo Sapiens
TAASTWNTD

SEQ ID NO: 643042 - protein, 9 aa, Homo Sapiens
PPKALQAQE

SEQ ID NO: 643043 - protein, 9 aa, Homo Sapiens
RVAQTLLQL

SEQ ID NO: 643044 - protein, 9 aa, Homo Sapiens
PMAPGTYIV

SEQ ID NO: 643045 - protein, 9 aa, Homo Sapiens
SWYQHQLSH

SEQ ID NO: 643046 - protein, 9 aa, Homo Sapiens
AATPASCAH

SEQ ID NO: 643047 - protein, 9 aa, Homo Sapiens
RSVWEEKQR

SEQ ID NO: 643048 - protein, 9 aa, Homo Sapiens
DGAEGPLGA

SEQ ID NO: 643049 - protein, 9 aa, Homo Sapiens
GQHHSAVLL

SEQ ID NO: 643050 - protein, 9 aa, Homo Sapiens
CIGADTNRN

SEQ ID NO: 643051 - protein, 9 aa, Homo Sapiens
DLEMMTPDD

SEQ ID NO: 643052 - protein, 9 aa, Homo Sapiens
LGQEVRGLS

SEQ ID NO: 643053 - protein, 9 aa, Homo Sapiens
FAKGVPAVS

SEQ ID NO: 643054 - protein, 9 aa, Homo Sapiens
LSKDHIYPM

SEQ ID NO: 643055 - protein, 9 aa, Homo Sapiens
EGFPGAVYL

SEQ ID NO: 643056 - protein, 9 aa, Homo Sapiens
GMWPSSLRR

SEQ ID NO: 643057 - protein, 9 aa, Homo Sapiens
DIIQCCRRR

SEQ ID NO: 643058 - protein, 9 aa, Homo Sapiens
WGPSASVVP

SEQ ID NO: 643059 - protein, 9 aa, Homo Sapiens
DSPIRLRRG

SEQ ID NO: 643060 - protein, 9 aa, Homo Sapiens
GEFSLLHDN

SEQ ID NO: 643061 - protein, 9 aa, Homo Sapiens
AQENSDGLI

SEQ ID NO: 643062 - protein, 9 aa, Homo Sapiens
KKLKLAPLQ

SEQ ID NO: 643063 - protein, 9 aa, Homo Sapiens
SMADSPHQR

SEQ ID NO: 643064 - protein, 9 aa, Homo Sapiens
KAKESSLMD

SEQ ID NO: 643065 - protein, 9 aa, Homo Sapiens
QQLAKTISK

SEQ ID NO: 643066 - protein, 9 aa, Homo Sapiens
GVLKYHNLY

SEQ ID NO: 643067 - protein, 9 aa, Homo Sapiens
VCNKFTTDS

SEQ ID NO: 643068 - protein, 9 aa, Homo Sapiens
WPEEPLPYS

SEQ ID NO: 643069 - protein, 9 aa, Homo Sapiens
VNNRRNCFR

SEQ ID NO: 643070 - protein, 9 aa, Homo Sapiens
PAAFMTTQT

SEQ ID NO: 643071 - protein, 9 aa, Homo Sapiens
PCRQAGLEG

SEQ ID NO: 643072 - protein, 9 aa, Homo Sapiens
RRLFSLWPA

SEQ ID NO: 643073 - protein, 9 aa, Homo Sapiens
PSSWGCCGS

SEQ ID NO: 643074 - protein, 9 aa, Homo Sapiens
SALFVKKEM

SEQ ID NO: 643075 - protein, 9 aa, Homo Sapiens
HVDCSGLPP

SEQ ID NO: 643076 - protein, 9 aa, Homo Sapiens
PRVAKLASD

SEQ ID NO: 643077 - protein, 9 aa, Homo Sapiens
TQLIKEGCR

SEQ ID NO: 643078 - protein, 9 aa, Homo Sapiens
MKGCINVLK

SEQ ID NO: 643079 - protein, 9 aa, Homo Sapiens
ADKLTPPCP

SEQ ID NO: 643080 - protein, 9 aa, Homo Sapiens
YGFEYYPMA

SEQ ID NO: 643081 - protein, 9 aa, Homo Sapiens
RKNFAKGVP

SEQ ID NO: 643082 - protein, 9 aa, Homo Sapiens
SGPGPPSSR

SEQ ID NO: 643083 - protein, 9 aa, Homo Sapiens
SPRVAQTLL

SEQ ID NO: 643084 - protein, 9 aa, Homo Sapiens
LLLHPPQQP

SEQ ID NO: 643085 - protein, 9 aa, Homo Sapiens
GGQHHSAVL

SEQ ID NO: 643086 - protein, 9 aa, Homo Sapiens
AASYFKVNN

SEQ ID NO: 643087 - protein, 9 aa, Homo Sapiens
YPFPHHERP

SEQ ID NO: 643088 - protein, 9 aa, Homo Sapiens
SSLRSSSSG

SEQ ID NO: 643089 - protein, 9 aa, Homo Sapiens
VVWSIREWI

SEQ ID NO: 643090 - protein, 9 aa, Homo Sapiens
RRFSGVGAR

SEQ ID NO: 643091 - protein, 9 aa, Homo Sapiens
ALGSTNLSH

SEQ ID NO: 643092 - protein, 9 aa, Homo Sapiens
YYRITSSYR

SEQ ID NO: 643093 - protein, 9 aa, Homo Sapiens
QLVVFNHVY

SEQ ID NO: 643094 - protein, 9 aa, Homo Sapiens
MMGNAWPLV

SEQ ID NO: 643095 - protein, 9 aa, Homo Sapiens
DLEINKALT

SEQ ID NO: 643096 - protein, 9 aa, Homo Sapiens
GSSAGIPGA

SEQ ID NO: 643097 - protein, 9 aa, Homo Sapiens
GGGSSLLLH

SEQ ID NO: 643098 - protein, 9 aa, Homo Sapiens
PVPCRQAGL

SEQ ID NO: 643099 - protein, 9 aa, Homo Sapiens
YGKVTGSAC

SEQ ID NO: 643100 - protein, 9 aa, Homo Sapiens
AKPLLLWDE

SEQ ID NO: 643101 - protein, 9 aa, Homo Sapiens
QTLWQEHFK

SEQ ID NO: 643102 - protein, 9 aa, Homo Sapiens
VVGALGAAA

SEQ ID NO: 643103 - protein, 9 aa, Homo Sapiens
VIDLLDSIA

SEQ ID NO: 643104 - protein, 9 aa, Homo Sapiens
SLRSSSSGF

SEQ ID NO: 643105 - protein, 9 aa, Homo Sapiens
QRDLRRKFF

SEQ ID NO: 643106 - protein, 9 aa, Homo Sapiens
IKPIMLKAK

SEQ ID NO: 643107 - protein, 9 aa, Homo Sapiens
GWWPEEPLP

SEQ ID NO: 643108 - protein, 9 aa, Homo Sapiens
GYGHRSCRP

SEQ ID NO: 643109 - protein, 9 aa, Homo Sapiens
RADGITGLH

SEQ ID NO: 643110 - protein, 9 aa, Homo Sapiens
SIREWIRKF

SEQ ID NO: 643111 - protein, 9 aa, Homo Sapiens
HSSLRSSSS

SEQ ID NO: 643112 - protein, 9 aa, Homo Sapiens
LGSLSKDHI

SEQ ID NO: 643113 - protein, 9 aa, Homo Sapiens
EAFLLALPL

SEQ ID NO: 643114 - protein, 9 aa, Homo Sapiens
LKLILVMLE

SEQ ID NO: 643115 - protein, 9 aa, Homo Sapiens
LYAVGLFLE

SEQ ID NO: 643116 - protein, 9 aa, Homo Sapiens
VGLSGGGAS

SEQ ID NO: 643117 - protein, 9 aa, Homo Sapiens
RTVTHSFCL

SEQ ID NO: 643118 - protein, 9 aa, Homo Sapiens
AVGLFLERV

SEQ ID NO: 643119 - protein, 9 aa, Homo Sapiens
TWNTDASSV

SEQ ID NO: 643120 - protein, 9 aa, Homo Sapiens
WAVARVVGL

SEQ ID NO: 643121 - protein, 9 aa, Homo Sapiens
EVIKPIMLK

SEQ ID NO: 643122 - protein, 9 aa, Homo Sapiens
QPQQQEQEG

SEQ ID NO: 643123 - protein, 9 aa, Homo Sapiens
AHKVRVKEI

SEQ ID NO: 643124 - protein, 9 aa, Homo Sapiens
STNLSHTVD

SEQ ID NO: 643125 - protein, 9 aa, Homo Sapiens
DCIRRCNNG

SEQ ID NO: 643126 - protein, 9 aa, Homo Sapiens
APLQVTTTL

SEQ ID NO: 643127 - protein, 9 aa, Homo Sapiens
FPGAVYLLS

SEQ ID NO: 643128 - protein, 9 aa, Homo Sapiens
QSHADQDQH

SEQ ID NO: 643129 - protein, 9 aa, Homo Sapiens
TTLKLILVM

SEQ ID NO: 643130 - protein, 9 aa, Homo Sapiens
GADSPIRLR

SEQ ID NO: 643131 - protein, 9 aa, Homo Sapiens
YNTSSKEQL

SEQ ID NO: 643132 - protein, 9 aa, Homo Sapiens
PLIGCKKPL

SEQ ID NO: 643133 - protein, 9 aa, Homo Sapiens
YKHSSWSEG

SEQ ID NO: 643134 - protein, 9 aa, Homo Sapiens
GHKSGYKHS

SEQ ID NO: 643135 - protein, 9 aa, Homo Sapiens
RIPSVTSGT

SEQ ID NO: 643136 - protein, 9 aa, Homo Sapiens
FGGYGHRSC

SEQ ID NO: 643137 - protein, 9 aa, Homo Sapiens
GDYNDSAFM

SEQ ID NO: 643138 - protein, 9 aa, Homo Sapiens
ATGGGGYKF

SEQ ID NO: 643139 - protein, 9 aa, Homo Sapiens
CRALCEDLA

SEQ ID NO: 643140 - protein, 9 aa, Homo Sapiens
HLERARRSK

SEQ ID NO: 643141 - protein, 9 aa, Homo Sapiens
GVEKSGALP

SEQ ID NO: 643142 - protein, 9 aa, Homo Sapiens
DLQDEIDYR

SEQ ID NO: 643143 - protein, 9 aa, Homo Sapiens
GGRLQSHAD

SEQ ID NO: 643144 - protein, 9 aa, Homo Sapiens
FVTLALVLA

SEQ ID NO: 643145 - protein, 9 aa, Homo Sapiens
DQHQPQQQE

SEQ ID NO: 643146 - protein, 9 aa, Homo Sapiens
RRKFFCFVQ

SEQ ID NO: 643147 - protein, 9 aa, Homo Sapiens
VLTFLEYIT

SEQ ID NO: 643148 - protein, 9 aa, Homo Sapiens
PKRATPLDS

SEQ ID NO: 643149 - protein, 9 aa, Homo Sapiens
GSLVVWSIR

SEQ ID NO: 643150 - protein, 9 aa, Homo Sapiens
INKALTYLR

SEQ ID NO: 643151 - protein, 9 aa, Homo Sapiens
LEMMTPDDP

SEQ ID NO: 643152 - protein, 9 aa, Homo Sapiens
RSKCSGPKR

SEQ ID NO: 643153 - protein, 9 aa, Homo Sapiens
PKVLTFLEY

SEQ ID NO: 643154 - protein, 9 aa, Homo Sapiens
GITGLHRGF

SEQ ID NO: 643155 - protein, 9 aa, Homo Sapiens
KVNNRRNCF

SEQ ID NO: 643156 - protein, 9 aa, Homo Sapiens
YGHRSCRPS

SEQ ID NO: 643157 - protein, 9 aa, Homo Sapiens
FVCNGLQNC

SEQ ID NO: 643158 - protein, 9 aa, Homo Sapiens
SGPKRATPL

SEQ ID NO: 643159 - protein, 9 aa, Homo Sapiens
TSSKEQLVV

SEQ ID NO: 643160 - protein, 9 aa, Homo Sapiens
EDGAGDTWR

SEQ ID NO: 643161 - protein, 9 aa, Homo Sapiens
RCNNGIPED

SEQ ID NO: 643162 - protein, 9 aa, Homo Sapiens
TGRPPDLPA

SEQ ID NO: 643163 - protein, 9 aa, Homo Sapiens
LASDAAWVL

SEQ ID NO: 643164 - protein, 9 aa, Homo Sapiens
AGVEKSGAL

SEQ ID NO: 643165 - protein, 9 aa, Homo Sapiens
DALKNNPQL

SEQ ID NO: 643166 - protein, 9 aa, Homo Sapiens
NMCINNTFV

SEQ ID NO: 643167 - protein, 9 aa, Homo Sapiens
LSIRNINQE

SEQ ID NO: 643168 - protein, 9 aa, Homo Sapiens
HQNVLFYHT

SEQ ID NO: 643169 - protein, 9 aa, Homo Sapiens
TTDSLEALS

SEQ ID NO: 643170 - protein, 9 aa, Homo Sapiens
FARADELTR

SEQ ID NO: 643171 - protein, 9 aa, Homo Sapiens
SGTLGQEVR

SEQ ID NO: 643172 - protein, 9 aa, Homo Sapiens
PGPPSSRDS

SEQ ID NO: 643173 - protein, 9 aa, Homo Sapiens
DKSIVKKTQ

SEQ ID NO: 643174 - protein, 9 aa, Homo Sapiens
NDSAFMEPR

SEQ ID NO: 643175 - protein, 9 aa, Homo Sapiens
PAYTSTTNF

SEQ ID NO: 643176 - protein, 9 aa, Homo Sapiens
GPKRATPLD

SEQ ID NO: 643177 - protein, 9 aa, Homo Sapiens
TMLGNVRMI

SEQ ID NO: 643178 - protein, 9 aa, Homo Sapiens
SISQAKVMM

SEQ ID NO: 643179 - protein, 9 aa, Homo Sapiens
HCTSYRVVP

SEQ ID NO: 643180 - protein, 9 aa, Homo Sapiens
HERPGGAVL

SEQ ID NO: 643181 - protein, 9 aa, Homo Sapiens
RLGQFVTLA

SEQ ID NO: 643182 - protein, 9 aa, Homo Sapiens
SRAFTHKSF

SEQ ID NO: 643183 - protein, 9 aa, Homo Sapiens
TDREEEEEI

SEQ ID NO: 643184 - protein, 9 aa, Homo Sapiens
RFSPRVAQT

SEQ ID NO: 643185 - protein, 9 aa, Homo Sapiens
PGADSPIRL

SEQ ID NO: 643186 - protein, 9 aa, Homo Sapiens
LCRFSPRVA

SEQ ID NO: 643187 - protein, 9 aa, Homo Sapiens
NKALTYLRQ

SEQ ID NO: 643188 - protein, 9 aa, Homo Sapiens
SSSWDLSLS

SEQ ID NO: 643189 - protein, 9 aa, Homo Sapiens
SVHCTSYRV

SEQ ID NO: 643190 - protein, 9 aa, Homo Sapiens
IDLLDSIAS

SEQ ID NO: 643191 - protein, 9 aa, Homo Sapiens
DLRPLEGNT

SEQ ID NO: 643192 - protein, 9 aa, Homo Sapiens
GATSQTLAT

SEQ ID NO: 643193 - protein, 9 aa, Homo Sapiens
GRSRAFTHK

SEQ ID NO: 643194 - protein, 9 aa, Homo Sapiens
FQTSHVDCS

SEQ ID NO: 643195 - protein, 9 aa, Homo Sapiens
RQPQLLLVP

SEQ ID NO: 643196 - protein, 9 aa, Homo Sapiens
GKVTGSACD

SEQ ID NO: 643197 - protein, 9 aa, Homo Sapiens
ENVGGRLHL

SEQ ID NO: 643198 - protein, 9 aa, Homo Sapiens
GLGSILIVL

SEQ ID NO: 643199 - protein, 9 aa, Homo Sapiens
GSTNLSHTV

SEQ ID NO: 643200 - protein, 9 aa, Homo Sapiens
SIVKKTQQL

SEQ ID NO: 643201 - protein, 9 aa, Homo Sapiens
LILPLGFYF

SEQ ID NO: 643202 - protein, 9 aa, Homo Sapiens
INQEERLKL

SEQ ID NO: 643203 - protein, 9 aa, Homo Sapiens
RVVSNDKKH

SEQ ID NO: 643204 - protein, 9 aa, Homo Sapiens
PFHDQLPNG

SEQ ID NO: 643205 - protein, 9 aa, Homo Sapiens
FPHHERPGG

SEQ ID NO: 643206 - protein, 9 aa, Homo Sapiens
RMQTLWQEH

SEQ ID NO: 643207 - protein, 9 aa, Homo Sapiens
GLHRGFLVN

SEQ ID NO: 643208 - protein, 9 aa, Homo Sapiens
PLVAHKYDF

SEQ ID NO: 643209 - protein, 9 aa, Homo Sapiens
SQAKVMMEV

SEQ ID NO: 643210 - protein, 9 aa, Homo Sapiens
KRATPLDSG

SEQ ID NO: 643211 - protein, 9 aa, Homo Sapiens
DGITGLHRG

SEQ ID NO: 643212 - protein, 9 aa, Homo Sapiens
PPAAFMTTQ

SEQ ID NO: 643213 - protein, 9 aa, Homo Sapiens
RVLSIRNIN

SEQ ID NO: 643214 - protein, 9 aa, Homo Sapiens
TRAVIFEDF

SEQ ID NO: 643215 - protein, 9 aa, Homo Sapiens
WPALSLQAL

SEQ ID NO: 643216 - protein, 9 aa, Homo Sapiens
INVLKEQAP

SEQ ID NO: 643217 - protein, 9 aa, Homo Sapiens
GIPGADSPI

SEQ ID NO: 643218 - protein, 9 aa, Homo Sapiens
VRGLSFLLK

SEQ ID NO: 643219 - protein, 9 aa, Homo Sapiens
EEIDDEAII

SEQ ID NO: 643220 - protein, 9 aa, Homo Sapiens
LKCMTWERR

SEQ ID NO: 643221 - protein, 9 aa, Homo Sapiens
ADELTRHYR

SEQ ID NO: 643222 - protein, 9 aa, Homo Sapiens
FCGEHHPQQ

SEQ ID NO: 643223 - protein, 9 aa, Homo Sapiens
REGAVVKKM

SEQ ID NO: 643224 - protein, 9 aa, Homo Sapiens
IREWIRKFN

SEQ ID NO: 643225 - protein, 9 aa, Homo Sapiens
APVPCYGYY

SEQ ID NO: 643226 - protein, 9 aa, Homo Sapiens
PEQAHKVRV

SEQ ID NO: 643227 - protein, 9 aa, Homo Sapiens
LRPPQLLLC

SEQ ID NO: 643228 - protein, 9 aa, Homo Sapiens
EEFHRYSGY

SEQ ID NO: 643229 - protein, 9 aa, Homo Sapiens
RHEEDGAGD

SEQ ID NO: 643230 - protein, 9 aa, Homo Sapiens
VAQPGLLVL

SEQ ID NO: 643231 - protein, 9 aa, Homo Sapiens
MWPSSLRRN

SEQ ID NO: 643232 - protein, 9 aa, Homo Sapiens
KPLLLWDEV

SEQ ID NO: 643233 - protein, 9 aa, Homo Sapiens
SFGRRKSFS

SEQ ID NO: 643234 - protein, 9 aa, Homo Sapiens
CGQARRQTS

SEQ ID NO: 643235 - protein, 9 aa, Homo Sapiens
QTRTVTHSF

SEQ ID NO: 643236 - protein, 9 aa, Homo Sapiens
SCSRSPLVS

SEQ ID NO: 643237 - protein, 9 aa, Homo Sapiens
VRVKEIKRL

SEQ ID NO: 643238 - protein, 9 aa, Homo Sapiens
AADGAEGPL

SEQ ID NO: 643239 - protein, 9 aa, Homo Sapiens
LLWDEVPDD

SEQ ID NO: 643240 - protein, 9 aa, Homo Sapiens
VIFEDFAVP

SEQ ID NO: 643241 - protein, 9 aa, Homo Sapiens
DLSMADSPH

SEQ ID NO: 643242 - protein, 9 aa, Homo Sapiens
NAWPLVAHK

SEQ ID NO: 643243 - protein, 9 aa, Homo Sapiens
EGCRSYCTD

SEQ ID NO: 643244 - protein, 9 aa, Homo Sapiens
ALKNNPQLH

SEQ ID NO: 643245 - protein, 9 aa, Homo Sapiens
LGQFVTLAL

SEQ ID NO: 643246 - protein, 9 aa, Homo Sapiens
LPEEGFPGA

SEQ ID NO: 643247 - protein, 9 aa, Homo Sapiens
SKLLEKIKE

SEQ ID NO: 643248 - protein, 9 aa, Homo Sapiens
FLCQTEAQY

SEQ ID NO: 643249 - protein, 9 aa, Homo Sapiens
AVLLDQRVL

SEQ ID NO: 643250 - protein, 9 aa, Homo Sapiens
RRCNNGIPE

SEQ ID NO: 643251 - protein, 9 aa, Homo Sapiens
RLHLRYVGL

SEQ ID NO: 643252 - protein, 9 aa, Homo Sapiens
GSLSKDHIY

SEQ ID NO: 643253 - protein, 9 aa, Homo Sapiens
HRGFLVNTF

SEQ ID NO: 643254 - protein, 9 aa, Homo Sapiens
VLCATGGGG

SEQ ID NO: 643255 - protein, 9 aa, Homo Sapiens
VPPQGMWPS

SEQ ID NO: 643256 - protein, 9 aa, Homo Sapiens
EMMTPDDPR

SEQ ID NO: 643257 - protein, 9 aa, Homo Sapiens
PCSCSRSPL

SEQ ID NO: 643258 - protein, 9 aa, Homo Sapiens
GGYGHRSCR

SEQ ID NO: 643259 - protein, 9 aa, Homo Sapiens
RALCEDLAS

SEQ ID NO: 643260 - protein, 9 aa, Homo Sapiens
AGLEGTASL

SEQ ID NO: 643261 - protein, 9 aa, Homo Sapiens
TGSACDCAL

SEQ ID NO: 643262 - protein, 9 aa, Homo Sapiens
ADGITGLHR

SEQ ID NO: 643263 - protein, 9 aa, Homo Sapiens
VLGPAAAGV

SEQ ID NO: 643264 - protein, 9 aa, Homo Sapiens
RLLRPPQLL

SEQ ID NO: 643265 - protein, 9 aa, Homo Sapiens
PPQGMWPSS

SEQ ID NO: 643266 - protein, 9 aa, Homo Sapiens
CPPSGPRDV

SEQ ID NO: 643267 - protein, 9 aa, Homo Sapiens
ELSRSVWEE

SEQ ID NO: 643268 - protein, 9 aa, Homo Sapiens
NTGRPPDLP

SEQ ID NO: 643269 - protein, 9 aa, Homo Sapiens
LQLRQPQLL

SEQ ID NO: 643270 - protein, 9 aa, Homo Sapiens
GSILIVLQV

SEQ ID NO: 643271 - protein, 9 aa, Homo Sapiens
SCCGPSSWG

SEQ ID NO: 643272 - protein, 9 aa, Homo Sapiens
DHSVKRKST

SEQ ID NO: 643273 - protein, 9 aa, Homo Sapiens
GNLSPIKDQ

SEQ ID NO: 643274 - protein, 9 aa, Homo Sapiens
HQQGLVPEH

SEQ ID NO: 643275 - protein, 9 aa, Homo Sapiens
GLDYPRLEK

SEQ ID NO: 643276 - protein, 9 aa, Homo Sapiens
TQEGIMTVK

SEQ ID NO: 643277 - protein, 9 aa, Homo Sapiens
FDLRPLEGN

SEQ ID NO: 643278 - protein, 9 aa, Homo Sapiens
AAADGAEGP

SEQ ID NO: 643279 - protein, 9 aa, Homo Sapiens
SSLMDRMKI

SEQ ID NO: 643280 - protein, 9 aa, Homo Sapiens
PCGQARRQT

SEQ ID NO: 643281 - protein, 9 aa, Homo Sapiens
LEGTASLKA

SEQ ID NO: 643282 - protein, 9 aa, Homo Sapiens
QDCIRRCNN

SEQ ID NO: 643283 - protein, 9 aa, Homo Sapiens
HSVKRKSTV

SEQ ID NO: 643284 - protein, 9 aa, Homo Sapiens
QLRQPQLLL

SEQ ID NO: 643285 - protein, 9 aa, Homo Sapiens
LGAADGSSA

SEQ ID NO: 643286 - protein, 9 aa, Homo Sapiens
RLGAPVGLS

SEQ ID NO: 643287 - protein, 9 aa, Homo Sapiens
LQDCIRRCN

SEQ ID NO: 643288 - protein, 9 aa, Homo Sapiens
LPISFSKGF

SEQ ID NO: 643289 - protein, 9 aa, Homo Sapiens
YRIPSVTSG

SEQ ID NO: 643290 - protein, 9 aa, Homo Sapiens
QPQLLLVPP

SEQ ID NO: 643291 - protein, 9 aa, Homo Sapiens
CCGPSSWGC

SEQ ID NO: 643292 - protein, 9 aa, Homo Sapiens
EENVNFLCQ

SEQ ID NO: 643293 - protein, 9 aa, Homo Sapiens
FLNLPISFS

SEQ ID NO: 643294 - protein, 9 aa, Homo Sapiens
FKVNNRRNC

SEQ ID NO: 643295 - protein, 9 aa, Homo Sapiens
YFVAVFFDL

SEQ ID NO: 643296 - protein, 9 aa, Homo Sapiens
VAVELFGVL

SEQ ID NO: 643297 - protein, 9 aa, Homo Sapiens
LQHHFLATA

SEQ ID NO: 643298 - protein, 9 aa, Homo Sapiens
GSSLLLHPP

SEQ ID NO: 643299 - protein, 9 aa, Homo Sapiens
VLHQQGLVP

SEQ ID NO: 643300 - protein, 9 aa, Homo Sapiens
APKMVHKAV

SEQ ID NO: 643301 - protein, 9 aa, Homo Sapiens
VDCSGLPPL

SEQ ID NO: 643302 - protein, 9 aa, Homo Sapiens
PSSRDSSKA

SEQ ID NO: 643303 - protein, 9 aa, Homo Sapiens
LTIQQVIDL

SEQ ID NO: 643304 - protein, 9 aa, Homo Sapiens
PIPDLRPDQ

SEQ ID NO: 643305 - protein, 9 aa, Homo Sapiens
EAPKMVHKA

SEQ ID NO: 643306 - protein, 9 aa, Homo Sapiens
SDNREKLAI

SEQ ID NO: 643307 - protein, 9 aa, Homo Sapiens
QHHSAVLLD

SEQ ID NO: 643308 - protein, 9 aa, Homo Sapiens
VASIYDQEE

SEQ ID NO: 643309 - protein, 9 aa, Homo Sapiens
TDHSVKRKS

SEQ ID NO: 643310 - protein, 9 aa, Homo Sapiens
WTTAAPFHD

SEQ ID NO: 643311 - protein, 9 aa, Homo Sapiens
EFVLLVFHG

SEQ ID NO: 643312 - protein, 9 aa, Homo Sapiens
IIQCCRRRL

SEQ ID NO: 643313 - protein, 9 aa, Homo Sapiens
DDEEKEEEE

SEQ ID NO: 643314 - protein, 9 aa, Homo Sapiens
QQQEQEGGQ

SEQ ID NO: 643315 - protein, 9 aa, Homo Sapiens
PPCPPSGPR

SEQ ID NO: 643316 - protein, 9 aa, Homo Sapiens
PTVHTRPHN

SEQ ID NO: 643317 - protein, 9 aa, Homo Sapiens
YFKVNNRRN

SEQ ID NO: 643318 - protein, 9 aa, Homo Sapiens
PGRSRAFTH

SEQ ID NO: 643319 - protein, 9 aa, Homo Sapiens
AVEAFLLAL

SEQ ID NO: 643320 - protein, 9 aa, Homo Sapiens
RLYAVGLFL

SEQ ID NO: 643321 - protein, 9 aa, Homo Sapiens
EDLQDEIDY

SEQ ID NO: 643322 - protein, 9 aa, Homo Sapiens
KDHIYPMKL

SEQ ID NO: 643323 - protein, 9 aa, Homo Sapiens
RAFTHKSFH

SEQ ID NO: 643324 - protein, 9 aa, Homo Sapiens
VCDNDTLPS

SEQ ID NO: 643325 - protein, 9 aa, Homo Sapiens
CTLELSRSV

SEQ ID NO: 643326 - protein, 9 aa, Homo Sapiens
QEQEGGQHH

SEQ ID NO: 643327 - protein, 9 aa, Homo Sapiens
LLVPPQGMW

SEQ ID NO: 643328 - protein, 9 aa, Homo Sapiens
HGFVNHTHS

SEQ ID NO: 643329 - protein, 9 aa, Homo Sapiens
FRTHSREKP

SEQ ID NO: 643330 - protein, 9 aa, Homo Sapiens
NMMGNAWPL

SEQ ID NO: 643331 - protein, 9 aa, Homo Sapiens
QLQRRMQTL

SEQ ID NO: 643332 - protein, 9 aa, Homo Sapiens
ALCEDLASL

SEQ ID NO: 643333 - protein, 9 aa, Homo Sapiens
NDTLPSVSS

SEQ ID NO: 643334 - protein, 9 aa, Homo Sapiens
QQVIDLLDS

SEQ ID NO: 643335 - protein, 9 aa, Homo Sapiens
LALPLCWVP

SEQ ID NO: 643336 - protein, 9 aa, Homo Sapiens
SSFGSISQA

SEQ ID NO: 643337 - protein, 9 aa, Homo Sapiens
NLSHTVDVY

SEQ ID NO: 643338 - protein, 9 aa, Homo Sapiens
LGTRRFNLC

SEQ ID NO: 643339 - protein, 9 aa, Homo Sapiens
RVVGLPGRT

SEQ ID NO: 643340 - protein, 9 aa, Homo Sapiens
HTHSFFNVS

SEQ ID NO: 643341 - protein, 9 aa, Homo Sapiens
SVKRKSTVW

SEQ ID NO: 643342 - protein, 9 aa, Homo Sapiens
LRLYAVGLF

SEQ ID NO: 643343 - protein, 9 aa, Homo Sapiens
PLQVTTTLK

SEQ ID NO: 643344 - protein, 9 aa, Homo Sapiens
QAGLEGTAS

SEQ ID NO: 643345 - protein, 9 aa, Homo Sapiens
IGFRGPKGV

SEQ ID NO: 643346 - protein, 9 aa, Homo Sapiens
GENEDDEEK

SEQ ID NO: 643347 - protein, 9 aa, Homo Sapiens
GCKKPLSAS

SEQ ID NO: 643348 - protein, 9 aa, Homo Sapiens
CQTRTVTHS

SEQ ID NO: 643349 - protein, 9 aa, Homo Sapiens
QAKVMMEVG

SEQ ID NO: 643350 - protein, 9 aa, Homo Sapiens
HHSSLRSSS

SEQ ID NO: 643351 - protein, 9 aa, Homo Sapiens
SAKPLLLWD

SEQ ID NO: 643352 - protein, 9 aa, Homo Sapiens
SAATAGAGG

SEQ ID NO: 643353 - protein, 9 aa, Homo Sapiens
AQLTLLLRA

SEQ ID NO: 643354 - protein, 9 aa, Homo Sapiens
FVKKEMQLQ

SEQ ID NO: 643355 - protein, 9 aa, Homo Sapiens
SPHQRRLFS

SEQ ID NO: 643356 - protein, 9 aa, Homo Sapiens
DSPCSCSRS

SEQ ID NO: 643357 - protein, 9 aa, Homo Sapiens
CGEHHPQQG

SEQ ID NO: 643358 - protein, 9 aa, Homo Sapiens
SLQALQAPQ

SEQ ID NO: 643359 - protein, 9 aa, Homo Sapiens
ELKLHRCLN

SEQ ID NO: 643360 - protein, 9 aa, Homo Sapiens
KELKLHRCL

SEQ ID NO: 643361 - protein, 9 aa, Homo Sapiens
SFGSISQAK

SEQ ID NO: 643362 - protein, 9 aa, Homo Sapiens
LATCGGEAV

SEQ ID NO: 643363 - protein, 9 aa, Homo Sapiens
LLVFHGQRE

SEQ ID NO: 643364 - protein, 9 aa, Homo Sapiens
LAIILKESL

SEQ ID NO: 643365 - protein, 9 aa, Homo Sapiens
ILVMLEIVT

SEQ ID NO: 643366 - protein, 9 aa, Homo Sapiens
QLLLNRIKT

SEQ ID NO: 643367 - protein, 9 aa, Homo Sapiens
CGPSSWGCC

SEQ ID NO: 643368 - protein, 9 aa, Homo Sapiens
ENEDDEEKE

SEQ ID NO: 643369 - protein, 9 aa, Homo Sapiens
FPPAAFMTT

SEQ ID NO: 643370 - protein, 9 aa, Homo Sapiens
LSRSVWEEK

SEQ ID NO: 643371 - protein, 9 aa, Homo Sapiens
QNQLYHVKH

SEQ ID NO: 643372 - protein, 9 aa, Homo Sapiens
ITTPSKKKL

SEQ ID NO: 643373 - protein, 9 aa, Homo Sapiens
YIIREGAVV

SEQ ID NO: 643374 - protein, 9 aa, Homo Sapiens
MGNLKSRKR

SEQ ID NO: 643375 - protein, 9 aa, Homo Sapiens
LTLLLRALK

SEQ ID NO: 643376 - protein, 9 aa, Homo Sapiens
DMKGCINVL

SEQ ID NO: 643377 - protein, 9 aa, Homo Sapiens
PGHKSGYKH

SEQ ID NO: 643378 - protein, 9 aa, Homo Sapiens
SDAAWVLSL

SEQ ID NO: 643379 - protein, 9 aa, Homo Sapiens
GNVRMILII

SEQ ID NO: 643380 - protein, 9 aa, Homo Sapiens
DREEEEEID

SEQ ID NO: 643381 - protein, 9 aa, Homo Sapiens
SLTDHSVKR

SEQ ID NO: 643382 - protein, 9 aa, Homo Sapiens
RQAGLEGTA

SEQ ID NO: 643383 - protein, 9 aa, Homo Sapiens
YCQTRTVTH

SEQ ID NO: 643384 - protein, 9 aa, Homo Sapiens
LVPPQGMWP

SEQ ID NO: 643385 - protein, 9 aa, Homo Sapiens
SLSKDHIYP

SEQ ID NO: 643386 - protein, 9 aa, Homo Sapiens
TRPHNLLPG

SEQ ID NO: 643387 - protein, 9 aa, Homo Sapiens
EGIMTVKKP

SEQ ID NO: 643388 - protein, 9 aa, Homo Sapiens
RKYRMGNLK

SEQ ID NO: 643389 - protein, 9 aa, Homo Sapiens
HPPAYTSTT

SEQ ID NO: 643390 - protein, 9 aa, Homo Sapiens
LLLVPPQGM

SEQ ID NO: 643391 - protein, 9 aa, Homo Sapiens
TLPSVSSIN

SEQ ID NO: 643392 - protein, 9 aa, Homo Sapiens
SLSAPRLLR

SEQ ID NO: 643393 - protein, 9 aa, Homo Sapiens
RAVIFEDFA

SEQ ID NO: 643394 - protein, 9 aa, Homo Sapiens
VPCYGYYPC

SEQ ID NO: 643395 - protein, 9 aa, Homo Sapiens
SPIRLRRGL

SEQ ID NO: 643396 - protein, 9 aa, Homo Sapiens
LVVPEVVSP

SEQ ID NO: 643397 - protein, 9 aa, Homo Sapiens
FPIPDLRPD

SEQ ID NO: 643398 - protein, 9 aa, Homo Sapiens
HADQDQHQP

SEQ ID NO: 643399 - protein, 9 aa, Homo Sapiens
RGPKGVPGF

SEQ ID NO: 643400 - protein, 9 aa, Homo Sapiens
VLVAQPGLL

SEQ ID NO: 643401 - protein, 9 aa, Homo Sapiens
SVIRLDVAL

SEQ ID NO: 643402 - protein, 9 aa, Homo Sapiens
SSWDLSLSA

SEQ ID NO: 643403 - protein, 9 aa, Homo Sapiens
LNTGRPPDL

SEQ ID NO: 643404 - protein, 9 aa, Homo Sapiens
VIRLDVALH

SEQ ID NO: 643405 - protein, 9 aa, Homo Sapiens
RMILIIRLD

SEQ ID NO: 643406 - protein, 9 aa, Homo Sapiens
EPTVHTRPH

SEQ ID NO: 643407 - protein, 9 aa, Homo Sapiens
PSASVVPNA

SEQ ID NO: 643408 - protein, 9 aa, Homo Sapiens
HRLQLDINT

SEQ ID NO: 643409 - protein, 9 aa, Homo Sapiens
FCFVQNSIG

SEQ ID NO: 643410 - protein, 9 aa, Homo Sapiens
QGGGQGGPL

SEQ ID NO: 643411 - protein, 9 aa, Homo Sapiens
GNAWPLVAH

SEQ ID NO: 643412 - protein, 9 aa, Homo Sapiens
GAVVKKMYF

SEQ ID NO: 643413 - protein, 9 aa, Homo Sapiens
VILDNEDQR

SEQ ID NO: 643414 - protein, 9 aa, Homo Sapiens
IEGPIGFRG

SEQ ID NO: 643415 - protein, 9 aa, Homo Sapiens
SEENVNFLC

SEQ ID NO: 643416 - protein, 9 aa, Homo Sapiens
LSAPRLLRP

SEQ ID NO: 643417 - protein, 9 aa, Homo Sapiens
EEEIDDEAI

SEQ ID NO: 643418 - protein, 9 aa, Homo Sapiens
IFKADFHNL

SEQ ID NO: 643419 - protein, 9 aa, Homo Sapiens
EEEEIDDEA

SEQ ID NO: 643420 - protein, 9 aa, Homo Sapiens
ILDNEDQRE

SEQ ID NO: 643421 - protein, 9 aa, Homo Sapiens
KGCINVLKE

SEQ ID NO: 643422 - protein, 9 aa, Homo Sapiens
WDLSLSASP

SEQ ID NO: 643423 - protein, 9 aa, Homo Sapiens
NTFVCNGLQ

SEQ ID NO: 643424 - protein, 9 aa, Homo Sapiens
TLLLRALKL

SEQ ID NO: 643425 - protein, 9 aa, Homo Sapiens
IPDLRPDQE

SEQ ID NO: 643426 - protein, 9 aa, Homo Sapiens
AFMTTQTVM

SEQ ID NO: 643427 - protein, 9 aa, Homo Sapiens
APQSLSAPR

SEQ ID NO: 643428 - protein, 9 aa, Homo Sapiens
TFVCNGLQN

SEQ ID NO: 643429 - protein, 9 aa, Homo Sapiens
RSRAFTHKS

SEQ ID NO: 643430 - protein, 9 aa, Homo Sapiens
EEGATSQTL

SEQ ID NO: 643431 - protein, 9 aa, Homo Sapiens
VARVVGLPG

SEQ ID NO: 643432 - protein, 9 aa, Homo Sapiens
FHRYSGYWW

SEQ ID NO: 643433 - protein, 9 aa, Homo Sapiens
TFLNVGCIP

SEQ ID NO: 643434 - protein, 9 aa, Homo Sapiens
DTQEGIMTV

SEQ ID NO: 643435 - protein, 9 aa, Homo Sapiens
FVTEFVLLV

SEQ ID NO: 643436 - protein, 9 aa, Homo Sapiens
KSIVKKTQQ

SEQ ID NO: 643437 - protein, 9 aa, Homo Sapiens
EVVSPAGFH

SEQ ID NO: 643438 - protein, 9 aa, Homo Sapiens
IPGADSPIR

SEQ ID NO: 643439 - protein, 9 aa, Homo Sapiens
TTAAPFHDQ

SEQ ID NO: 643440 - protein, 9 aa, Homo Sapiens
PSLALPAHH

SEQ ID NO: 643441 - protein, 9 aa, Homo Sapiens
FLEYITSLS

SEQ ID NO: 643442 - protein, 9 aa, Homo Sapiens
ETLHQLSAS

SEQ ID NO: 643443 - protein, 9 aa, Homo Sapiens
DLASLQSFD

SEQ ID NO: 643444 - protein, 9 aa, Homo Sapiens
QTSHVDCSG

SEQ ID NO: 643445 - protein, 9 aa, Homo Sapiens
EDGLDYPRL

SEQ ID NO: 643446 - protein, 9 aa, Homo Sapiens
TWRGGRLQS

SEQ ID NO: 643447 - protein, 9 aa, Homo Sapiens
EGGQHHSAV

SEQ ID NO: 643448 - protein, 9 aa, Homo Sapiens
MTWERRAWD

SEQ ID NO: 643449 - protein, 9 aa, Homo Sapiens
PPDLPARAT

SEQ ID NO: 643450 - protein, 9 aa, Homo Sapiens
TLGQEVRGL

SEQ ID NO: 643451 - protein, 9 aa, Homo Sapiens
VVPASKPEP

SEQ ID NO: 643452 - protein, 9 aa, Homo Sapiens
GPPSSRDSS

SEQ ID NO: 643453 - protein, 9 aa, Homo Sapiens
KPIMLKAKN

SEQ ID NO: 643454 - protein, 9 aa, Homo Sapiens
MTPDDPRMR

SEQ ID NO: 643455 - protein, 9 aa, Homo Sapiens
AQPGLLVLV

SEQ ID NO: 643456 - protein, 9 aa, Homo Sapiens
ALDQAQLTL

SEQ ID NO: 643457 - protein, 9 aa, Homo Sapiens
LKYHNLYSE

SEQ ID NO: 643458 - protein, 9 aa, Homo Sapiens
EQAHKVRVK

SEQ ID NO: 643459 - protein, 9 aa, Homo Sapiens
RLALHVLHQ

SEQ ID NO: 643460 - protein, 9 aa, Homo Sapiens
AAAGVVGAL

SEQ ID NO: 643461 - protein, 9 aa, Homo Sapiens
PQQQEQEGG

SEQ ID NO: 643462 - protein, 9 aa, Homo Sapiens
KFFQNQLYH

SEQ ID NO: 643463 - protein, 9 aa, Homo Sapiens
AAPFHDQLP

SEQ ID NO: 643464 - protein, 9 aa, Homo Sapiens
KTKHIQEGV

SEQ ID NO: 643465 - protein, 9 aa, Homo Sapiens
YPHCRKETC

SEQ ID NO: 643466 - protein, 9 aa, Homo Sapiens
LLHDNEAWS

SEQ ID NO: 643467 - protein, 9 aa, Homo Sapiens
PIMLKAKNL

SEQ ID NO: 643468 - protein, 9 aa, Homo Sapiens
LLLWDEVPD

SEQ ID NO: 643469 - protein, 9 aa, Homo Sapiens
FSPRVAQTL

SEQ ID NO: 643470 - protein, 9 aa, Homo Sapiens
SYRVVPASK

SEQ ID NO: 643471 - protein, 9 aa, Homo Sapiens
GGSSLLLHP

SEQ ID NO: 643472 - protein, 9 aa, Homo Sapiens
NKFTTDSLE

SEQ ID NO: 643473 - protein, 9 aa, Homo Sapiens
PQGMWPSSL

SEQ ID NO: 643474 - protein, 9 aa, Homo Sapiens
QCEDIIQCC

SEQ ID NO: 643475 - protein, 9 aa, Homo Sapiens
MADSPHQRR

SEQ ID NO: 643476 - protein, 9 aa, Homo Sapiens
THSREKPYK

SEQ ID NO: 643477 - protein, 9 aa, Homo Sapiens
IVLQVLVAQ

SEQ ID NO: 643478 - protein, 9 aa, Homo Sapiens
EEAPKMVHK

SEQ ID NO: 643479 - protein, 9 aa, Homo Sapiens
KRQHLGEQR

SEQ ID NO: 643480 - protein, 9 aa, Homo Sapiens
KWLGARIQP

SEQ ID NO: 643481 - protein, 9 aa, Homo Sapiens
PVPCYGYYP

SEQ ID NO: 643482 - protein, 9 aa, Homo Sapiens
VIKPIMLKA

SEQ ID NO: 643483 - protein, 9 aa, Homo Sapiens
TGGGGYKFE

SEQ ID NO: 643484 - protein, 9 aa, Homo Sapiens
PVEVIKPIM

SEQ ID NO: 643485 - protein, 9 aa, Homo Sapiens
RSKRKEKHK

SEQ ID NO: 643486 - protein, 9 aa, Homo Sapiens
LPSVSSINR

SEQ ID NO: 643487 - protein, 9 aa, Homo Sapiens
CSGPKRATP

SEQ ID NO: 643488 - protein, 9 aa, Homo Sapiens
ALGAAADGA

SEQ ID NO: 643489 - protein, 9 aa, Homo Sapiens
PSLPEEGFP

SEQ ID NO: 643490 - protein, 9 aa, Homo Sapiens
HTRPHNLLP

SEQ ID NO: 643491 - protein, 9 aa, Homo Sapiens
IIKFFQNQL

SEQ ID NO: 643492 - protein, 9 aa, Homo Sapiens
HIYPMKLKG

SEQ ID NO: 643493 - protein, 9 aa, Homo Sapiens
LEYITSLSD

SEQ ID NO: 643494 - protein, 9 aa, Homo Sapiens
SPAGFHVVP

SEQ ID NO: 643495 - protein, 9 aa, Homo Sapiens
LSHEDPAAL

SEQ ID NO: 643496 - protein, 9 aa, Homo Sapiens
FSGSLNEYG

SEQ ID NO: 643497 - protein, 9 aa, Homo Sapiens
RLFSGSLNE

SEQ ID NO: 643498 - protein, 9 aa, Homo Sapiens
RATPLDSGP

SEQ ID NO: 643499 - protein, 9 aa, Homo Sapiens
NKMPPHPPA

SEQ ID NO: 643500 - protein, 9 aa, Homo Sapiens
QHQLSHEDP

SEQ ID NO: 643501 - protein, 9 aa, Homo Sapiens
HFRTHSREK

SEQ ID NO: 643502 - protein, 9 aa, Homo Sapiens
CEDLASLQS

SEQ ID NO: 643503 - protein, 9 aa, Homo Sapiens
VKRFSCPYP

SEQ ID NO: 643504 - protein, 9 aa, Homo Sapiens
FVLLVFHGQ

SEQ ID NO: 643505 - protein, 9 aa, Homo Sapiens
TLKLILVML

SEQ ID NO: 643506 - protein, 9 aa, Homo Sapiens
RDFLARTYP

SEQ ID NO: 643507 - protein, 9 aa, Homo Sapiens
AADKLTPPC

SEQ ID NO: 643508 - protein, 9 aa, Homo Sapiens
FAVPVANRI

SEQ ID NO: 643509 - protein, 9 aa, Homo Sapiens
FKADFHNLM

SEQ ID NO: 643510 - protein, 9 aa, Homo Sapiens
SLGSLSKDH

SEQ ID NO: 643511 - protein, 9 aa, Homo Sapiens
PPAYTSTTN

SEQ ID NO: 643512 - protein, 9 aa, Homo Sapiens
AEEAPKMVH

SEQ ID NO: 643513 - protein, 9 aa, Homo Sapiens
GLEGTASLK

SEQ ID NO: 643514 - protein, 9 aa, Homo Sapiens
LRQPQLLLV

SEQ ID NO: 643515 - protein, 9 aa, Homo Sapiens
KMPPHPPAY

SEQ ID NO: 643516 - protein, 9 aa, Homo Sapiens
KVGAWGDYN

SEQ ID NO: 643517 - protein, 9 aa, Homo Sapiens
VSHLERARR

SEQ ID NO: 643518 - protein, 9 aa, Homo Sapiens
LVVWSIREW

SEQ ID NO: 643519 - protein, 9 aa, Homo Sapiens
LGEQRLQQE

SEQ ID NO: 643520 - protein, 9 aa, Homo Sapiens
KALQAQENS

SEQ ID NO: 643521 - protein, 9 aa, Homo Sapiens
QSLSAPRLL

SEQ ID NO: 643522 - protein, 9 aa, Homo Sapiens
LWPALSLQA

SEQ ID NO: 643523 - protein, 9 aa, Homo Sapiens
PHNLLPGRA

SEQ ID NO: 643524 - protein, 9 aa, Homo Sapiens
VKKTQQLAK

SEQ ID NO: 643525 - protein, 9 aa, Homo Sapiens
GSLTIQQVI

SEQ ID NO: 643526 - protein, 9 aa, Homo Sapiens
ASAKPLLLW

SEQ ID NO: 643527 - protein, 9 aa, Homo Sapiens
GTFLNVGCI

SEQ ID NO: 643528 - protein, 9 aa, Homo Sapiens
PGIDREASY

SEQ ID NO: 643529 - protein, 9 aa, Homo Sapiens
PYPHCRKET

SEQ ID NO: 643530 - protein, 9 aa, Homo Sapiens
LHQLSASYF

SEQ ID NO: 643531 - protein, 9 aa, Homo Sapiens
QHLGEQRLQ

SEQ ID NO: 643532 - protein, 9 aa, Homo Sapiens
ETESKLLEK

SEQ ID NO: 643533 - protein, 9 aa, Homo Sapiens
SKRKYRMGN

SEQ ID NO: 643534 - protein, 9 aa, Homo Sapiens
RFPIPDLRP

SEQ ID NO: 643535 - protein, 9 aa, Homo Sapiens
IKDQDRLLQ

SEQ ID NO: 643536 - protein, 9 aa, Homo Sapiens
KLKLAPLQV

SEQ ID NO: 643537 - protein, 9 aa, Homo Sapiens
EARHEEDGA

SEQ ID NO: 643538 - protein, 9 aa, Homo Sapiens
QAHKVRVKE

SEQ ID NO: 643539 - protein, 9 aa, Homo Sapiens
LAPLQVTTT

SEQ ID NO: 643540 - protein, 9 aa, Homo Sapiens
DVKRFSCPY

SEQ ID NO: 643541 - protein, 9 aa, Homo Sapiens
LHLRYVGLE

SEQ ID NO: 643542 - protein, 9 aa, Homo Sapiens
LVFHGQREM

SEQ ID NO: 643543 - protein, 9 aa, Homo Sapiens
ATPSPSLAL

SEQ ID NO: 643544 - protein, 9 aa, Homo Sapiens
EEDGAGDTW

SEQ ID NO: 643545 - protein, 9 aa, Homo Sapiens
SNDKKHRLQ

SEQ ID NO: 643546 - protein, 9 aa, Homo Sapiens
PKALQAQEN

SEQ ID NO: 643547 - protein, 9 aa, Homo Sapiens
DPKVLTFLE

SEQ ID NO: 643548 - protein, 9 aa, Homo Sapiens
VIWRLFSGS

SEQ ID NO: 643549 - protein, 9 aa, Homo Sapiens
LEKIKEGYY

SEQ ID NO: 643550 - protein, 9 aa, Homo Sapiens
SLETLHQLS

SEQ ID NO: 643551 - protein, 9 aa, Homo Sapiens
TTTLKLILV

SEQ ID NO: 643552 - protein, 9 aa, Homo Sapiens
ADSAATAGA

SEQ ID NO: 643553 - protein, 9 aa, Homo Sapiens
TPGHKSGYK

SEQ ID NO: 643554 - protein, 9 aa, Homo Sapiens
RMGNLKSRK

SEQ ID NO: 643555 - protein, 9 aa, Homo Sapiens
QALQAPQSL

SEQ ID NO: 643556 - protein, 9 aa, Homo Sapiens
AFTHKSFHG

SEQ ID NO: 643557 - protein, 9 aa, Homo Sapiens
SHLERARRS

SEQ ID NO: 643558 - protein, 9 aa, Homo Sapiens
SLVAFLPGY

SEQ ID NO: 643559 - protein, 9 aa, Homo Sapiens
VWSIREWIR

SEQ ID NO: 643560 - protein, 9 aa, Homo Sapiens
TQQLAKTIS

SEQ ID NO: 643561 - protein, 9 aa, Homo Sapiens
FVLQEEFHR

SEQ ID NO: 643562 - protein, 9 aa, Homo Sapiens
PGLLVLVSH

SEQ ID NO: 643563 - protein, 9 aa, Homo Sapiens
LIKEGCRSY

SEQ ID NO: 643564 - protein, 9 aa, Homo Sapiens
AVARVVGLP

SEQ ID NO: 643565 - protein, 9 aa, Homo Sapiens
GVVGALGAA

SEQ ID NO: 643566 - protein, 9 aa, Homo Sapiens
ENGYPFPHH

SEQ ID NO: 643567 - protein, 9 aa, Homo Sapiens
LRRKFFCFV

SEQ ID NO: 643568 - protein, 9 aa, Homo Sapiens
PAGVEKSGA

SEQ ID NO: 643569 - protein, 9 aa, Homo Sapiens
IVKKTQQLA

SEQ ID NO: 643570 - protein, 9 aa, Homo Sapiens
LCEDLASLQ

SEQ ID NO: 643571 - protein, 9 aa, Homo Sapiens
ATPASCAHA

SEQ ID NO: 643572 - protein, 9 aa, Homo Sapiens
SNMCINNTF

SEQ ID NO: 643573 - protein, 9 aa, Homo Sapiens
RFSCPYPHC

SEQ ID NO: 643574 - protein, 9 aa, Homo Sapiens
RKFFCFVQN

SEQ ID NO: 643575 - protein, 9 aa, Homo Sapiens
GRYRERDFL

SEQ ID NO: 643576 - protein, 9 aa, Homo Sapiens
TQEDGLDYP

SEQ ID NO: 643577 - protein, 9 aa, Homo Sapiens
GTQEDGLDY

SEQ ID NO: 643578 - protein, 9 aa, Homo Sapiens
CINNTFVCN

SEQ ID NO: 643579 - protein, 9 aa, Homo Sapiens
THHQNVLFY

SEQ ID NO: 643580 - protein, 9 aa, Homo Sapiens
HFLATAHYV

SEQ ID NO: 643581 - protein, 9 aa, Homo Sapiens
YNDSAFMEP

SEQ ID NO: 643582 - protein, 9 aa, Homo Sapiens
NLPISFSKG

SEQ ID NO: 643583 - protein, 9 aa, Homo Sapiens
DLRRKFFCF

SEQ ID NO: 643584 - protein, 9 aa, Homo Sapiens
LTPPCPPSG

SEQ ID NO: 643585 - protein, 9 aa, Homo Sapiens
RVILDNEDQ

SEQ ID NO: 643586 - protein, 9 aa, Homo Sapiens
KHSSWSEGE

SEQ ID NO: 643587 - protein, 9 aa, Homo Sapiens
MDGLKELKL

SEQ ID NO: 643588 - protein, 9 aa, Homo Sapiens
TNKMPPHPP

SEQ ID NO: 643589 - protein, 9 aa, Homo Sapiens
GVGARANQS

SEQ ID NO: 643590 - protein, 9 aa, Homo Sapiens
CNKFTTDSL

SEQ ID NO: 643591 - protein, 9 aa, Homo Sapiens
PIGFRGPKG

SEQ ID NO: 643592 - protein, 9 aa, Homo Sapiens
ASCAHAQPA

SEQ ID NO: 643593 - protein, 9 aa, Homo Sapiens
MAPGTYIVT

SEQ ID NO: 643594 - protein, 9 aa, Homo Sapiens
KCMTWERRA

SEQ ID NO: 643595 - protein, 9 aa, Homo Sapiens
TWERRAWDY

SEQ ID NO: 643596 - protein, 9 aa, Homo Sapiens
ARPGIDREA

SEQ ID NO: 643597 - protein, 9 aa, Homo Sapiens
KEQLVVFNH

SEQ ID NO: 643598 - protein, 9 aa, Homo Sapiens
GIEGPIGFR

SEQ ID NO: 643599 - protein, 9 aa, Homo Sapiens
RDSSKASSM

SEQ ID NO: 643600 - protein, 9 aa, Homo Sapiens
LVVFNHVYN

SEQ ID NO: 643601 - protein, 9 aa, Homo Sapiens
ALFVKKEMQ

SEQ ID NO: 643602 - protein, 9 aa, Homo Sapiens
WNTDASSVT

SEQ ID NO: 643603 - protein, 9 aa, Homo Sapiens
TGSAEGWWP

SEQ ID NO: 643604 - protein, 9 aa, Homo Sapiens
VLQVLVAQP

SEQ ID NO: 643605 - protein, 9 aa, Homo Sapiens
EGAVVKKMY

SEQ ID NO: 643606 - protein, 9 aa, Homo Sapiens
TSSYRIPSV

SEQ ID NO: 643607 - protein, 9 aa, Homo Sapiens
LLVLVSHLE

SEQ ID NO: 643608 - protein, 9 aa, Homo Sapiens
NDLEINKAL

SEQ ID NO: 643609 - protein, 9 aa, Homo Sapiens
HCTLELSRS

SEQ ID NO: 643610 - protein, 9 aa, Homo Sapiens
VSPAGFHVV

SEQ ID NO: 643611 - protein, 9 aa, Homo Sapiens
DTWRGGRLQ

SEQ ID NO: 643612 - protein, 9 aa, Homo Sapiens
LASLQSFDS

SEQ ID NO: 643613 - protein, 9 aa, Homo Sapiens
CIRRCNNGI

SEQ ID NO: 643614 - protein, 9 aa, Homo Sapiens
EFSLLHDNE

SEQ ID NO: 643615 - protein, 9 aa, Homo Sapiens
RLFSLWPAL

SEQ ID NO: 643616 - protein, 9 aa, Homo Sapiens
HVLHQQGLV

SEQ ID NO: 643617 - protein, 9 aa, Homo Sapiens
FVNHTHSFF

SEQ ID NO: 643618 - protein, 9 aa, Homo Sapiens
TKHIQEGVI

SEQ ID NO: 643619 - protein, 9 aa, Homo Sapiens
GFPGAVYLL

SEQ ID NO: 643620 - protein, 9 aa, Homo Sapiens
LQAQENSDG

SEQ ID NO: 643621 - protein, 9 aa, Homo Sapiens
LVSHLERAR

SEQ ID NO: 643622 - protein, 9 aa, Homo Sapiens
GRLQSHADQ

SEQ ID NO: 643623 - protein, 9 aa, Homo Sapiens
NETLGGTFL

SEQ ID NO: 643624 - protein, 9 aa, Homo Sapiens
KGVPAVSMD

SEQ ID NO: 643625 - protein, 9 aa, Homo Sapiens
NTAASTWNT

SEQ ID NO: 643626 - protein, 9 aa, Homo Sapiens
EMQLQANFL

SEQ ID NO: 643627 - protein, 9 aa, Homo Sapiens
EDGCPQAPV

SEQ ID NO: 643628 - protein, 9 aa, Homo Sapiens
LRSSSSGFK

SEQ ID NO: 643629 - protein, 9 aa, Homo Sapiens
DGLDALKNN

SEQ ID NO: 643630 - protein, 9 aa, Homo Sapiens
IDMKGCINV

SEQ ID NO: 643631 - protein, 9 aa, Homo Sapiens
SQFFDRVPS

SEQ ID NO: 643632 - protein, 9 aa, Homo Sapiens
FLNVGCIPS

SEQ ID NO: 643633 - protein, 9 aa, Homo Sapiens
LRPDQERGP

SEQ ID NO: 643634 - protein, 9 aa, Homo Sapiens
MVPLSAPPC

SEQ ID NO: 643635 - protein, 9 aa, Homo Sapiens
PASCAHAQP

SEQ ID NO: 643636 - protein, 9 aa, Homo Sapiens
KEGCRSYCT

SEQ ID NO: 643637 - protein, 9 aa, Homo Sapiens
VAVFFDLRP

SEQ ID NO: 643638 - protein, 9 aa, Homo Sapiens
HHFLATAHY

SEQ ID NO: 643639 - protein, 9 aa, Homo Sapiens
GARIQPLAI

SEQ ID NO: 643640 - protein, 9 aa, Homo Sapiens
QEGGQHHSA

SEQ ID NO: 643641 - protein, 9 aa, Homo Sapiens
ALQAPQSLS

SEQ ID NO: 643642 - protein, 9 aa, Homo Sapiens
DSFSSSWDL

SEQ ID NO: 643643 - protein, 9 aa, Homo Sapiens
LHRGFLVNT

SEQ ID NO: 643644 - protein, 9 aa, Homo Sapiens
PCPPSGPRD

SEQ ID NO: 643645 - protein, 9 aa, Homo Sapiens
LYFVAVFFD

SEQ ID NO: 643646 - protein, 9 aa, Homo Sapiens
EGVCDNDTL

SEQ ID NO: 643647 - protein, 9 aa, Homo Sapiens
PHQRRLFSL

SEQ ID NO: 643648 - protein, 9 aa, Homo Sapiens
KWLSYCQTR

SEQ ID NO: 643649 - protein, 9 aa, Homo Sapiens
RNIFKADFH

SEQ ID NO: 643650 - protein, 9 aa, Homo Sapiens
WPLVAHKYD

SEQ ID NO: 643651 - protein, 9 aa, Homo Sapiens
SAVLLDQRV

SEQ ID NO: 643652 - protein, 9 aa, Homo Sapiens
AVLQDCIRR

SEQ ID NO: 643653 - protein, 9 aa, Homo Sapiens
ETLRLYAVG

SEQ ID NO: 643654 - protein, 9 aa, Homo Sapiens
LDALKNNPQ

SEQ ID NO: 643655 - protein, 9 aa, Homo Sapiens
AGDTWRGGR

SEQ ID NO: 643656 - protein, 9 aa, Homo Sapiens
SMLNWGRAA

SEQ ID NO: 643657 - protein, 9 aa, Homo Sapiens
LDQAQLTLL

SEQ ID NO: 643658 - protein, 9 aa, Homo Sapiens
VRMILIIRL

SEQ ID NO: 643659 - protein, 9 aa, Homo Sapiens
KASSMLNWG

SEQ ID NO: 643660 - protein, 9 aa, Homo Sapiens
GTLGQEVRG

SEQ ID NO: 643661 - protein, 9 aa, Homo Sapiens
ALHVLHQQG

SEQ ID NO: 643662 - protein, 9 aa, Homo Sapiens
HKVRVKEIK

SEQ ID NO: 643663 - protein, 9 aa, Homo Sapiens
STWNTDASS

SEQ ID NO: 643664 - protein, 9 aa, Homo Sapiens
VNHTHSFFN

SEQ ID NO: 643665 - protein, 9 aa, Homo Sapiens
QRVLGPAAA

SEQ ID NO: 643666 - protein, 9 aa, Homo Sapiens
LAKRQHLGE

SEQ ID NO: 643667 - protein, 9 aa, Homo Sapiens
GPIGFRGPK

SEQ ID NO: 643668 - protein, 9 aa, Homo Sapiens
DGCPQAPVP

SEQ ID NO: 643669 - protein, 9 aa, Homo Sapiens
GIDREASYG

SEQ ID NO: 643670 - protein, 9 aa, Homo Sapiens
DREASYGDL

SEQ ID NO: 643671 - protein, 9 aa, Homo Sapiens
SWDLSLSAS

SEQ ID NO: 643672 - protein, 9 aa, Homo Sapiens
CRFSPRVAQ

SEQ ID NO: 643673 - protein, 9 aa, Homo Sapiens
WWPEEPLPY

SEQ ID NO: 643674 - protein, 9 aa, Homo Sapiens
DEIDYRYKT

SEQ ID NO: 643675 - protein, 9 aa, Homo Sapiens
GCINVLKEQ

SEQ ID NO: 643676 - protein, 9 aa, Homo Sapiens
VPNAWSTTS

SEQ ID NO: 643677 - protein, 9 aa, Homo Sapiens
KLAPLQVTT

SEQ ID NO: 643678 - protein, 9 aa, Homo Sapiens
SSCIGADTN

SEQ ID NO: 643679 - protein, 9 aa, Homo Sapiens
ACDCALCAC

SEQ ID NO: 643680 - protein, 9 aa, Homo Sapiens
AEGPLGAAD

SEQ ID NO: 643681 - protein, 9 aa, Homo Sapiens
IYDQEELMA

SEQ ID NO: 643682 - protein, 9 aa, Homo Sapiens
TDSLEALSV

SEQ ID NO: 643683 - protein, 9 aa, Homo Sapiens
RIKTWQKTH

SEQ ID NO: 643684 - protein, 9 aa, Homo Sapiens
TLLQLRQPQ

SEQ ID NO: 643685 - protein, 9 aa, Homo Sapiens
DQRELQKLE

SEQ ID NO: 643686 - protein, 9 aa, Homo Sapiens
APVGLSGGG

SEQ ID NO: 643687 - protein, 9 aa, Homo Sapiens
ARIQPLAID

SEQ ID NO: 643688 - protein, 9 aa, Homo Sapiens
VTLALVLAT

SEQ ID NO: 643689 - protein, 9 aa, Homo Sapiens
CHKALSQFF

SEQ ID NO: 643690 - protein, 9 aa, Homo Sapiens
SLPEEGFPG

SEQ ID NO: 643691 - protein, 9 aa, Homo Sapiens
NEDQRELQK

SEQ ID NO: 643692 - protein, 9 aa, Homo Sapiens
CPQAPVPCY

SEQ ID NO: 643693 - protein, 9 aa, Homo Sapiens
VLLVFHGQR

SEQ ID NO: 643694 - protein, 9 aa, Homo Sapiens
DYPRLEKLW

SEQ ID NO: 643695 - protein, 9 aa, Homo Sapiens
CINVLKEQA

SEQ ID NO: 643696 - protein, 9 aa, Homo Sapiens
KTWQKTHQG

SEQ ID NO: 643697 - protein, 9 aa, Homo Sapiens
YRITSSYRI

SEQ ID NO: 643698 - protein, 9 aa, Homo Sapiens
SWGCCGSSS

SEQ ID NO: 643699 - protein, 9 aa, Homo Sapiens
NNPQLHSMV

SEQ ID NO: 643700 - protein, 9 aa, Homo Sapiens
GAPVGLSGG

SEQ ID NO: 643701 - protein, 9 aa, Homo Sapiens
KRNIFKADF

SEQ ID NO: 643702 - protein, 9 aa, Homo Sapiens
CFLNLPISF

SEQ ID NO: 643703 - protein, 9 aa, Homo Sapiens
GAAADGAEG

SEQ ID NO: 643704 - protein, 9 aa, Homo Sapiens
EDFAVPVAN

SEQ ID NO: 643705 - protein, 9 aa, Homo Sapiens
SLLHDNEAW

SEQ ID NO: 643706 - protein, 9 aa, Homo Sapiens
IMLKAKNLP

SEQ ID NO: 643707 - protein, 9 aa, Homo Sapiens
ESKLLEKIK

SEQ ID NO: 643708 - protein, 9 aa, Homo Sapiens
KRKSTVWRI

SEQ ID NO: 643709 - protein, 9 aa, Homo Sapiens
YRCCFCGEH

SEQ ID NO: 643710 - protein, 9 aa, Homo Sapiens
PDQERGPWF

SEQ ID NO: 643711 - protein, 9 aa, Homo Sapiens
DLPARATAT

SEQ ID NO: 643712 - protein, 9 aa, Homo Sapiens
LHGFVNHTH

SEQ ID NO: 643713 - protein, 9 aa, Homo Sapiens
EASYGDLIG

SEQ ID NO: 643714 - protein, 9 aa, Homo Sapiens
GEAERSKRK

SEQ ID NO: 643715 - protein, 9 aa, Homo Sapiens
HSAVLLDQR

SEQ ID NO: 643716 - protein, 9 aa, Homo Sapiens
RERDFLART

SEQ ID NO: 643717 - protein, 9 aa, Homo Sapiens
KCSGPKRAT

SEQ ID NO: 643718 - protein, 9 aa, Homo Sapiens
EKDTQEGIM

SEQ ID NO: 643719 - protein, 9 aa, Homo Sapiens
KKPLSASGK

SEQ ID NO: 643720 - protein, 9 aa, Homo Sapiens
AAASYFKVN

SEQ ID NO: 643721 - protein, 9 aa, Homo Sapiens
LETLHQLSA

SEQ ID NO: 643722 - protein, 9 aa, Homo Sapiens
NGSLVVWSI

SEQ ID NO: 643723 - protein, 9 aa, Homo Sapiens
NREKLAIIL

SEQ ID NO: 643724 - protein, 9 aa, Homo Sapiens
WRLFSGSLN

SEQ ID NO: 643725 - protein, 9 aa, Homo Sapiens
LSLQALQAP

SEQ ID NO: 643726 - protein, 9 aa, Homo Sapiens
GSISQAKVM

SEQ ID NO: 643727 - protein, 9 aa, Homo Sapiens
SVQGGGQGG

SEQ ID NO: 643728 - protein, 9 aa, Homo Sapiens
REKPYKCQI

SEQ ID NO: 643729 - protein, 9 aa, Homo Sapiens
ASGTLGQEV

SEQ ID NO: 643730 - protein, 9 aa, Homo Sapiens
RGGRLQSHA

SEQ ID NO: 643731 - protein, 9 aa, Homo Sapiens
LKLHRCLNL

SEQ ID NO: 643732 - protein, 9 aa, Homo Sapiens
HLGEQRLQQ

SEQ ID NO: 643733 - protein, 9 aa, Homo Sapiens
KFARADELT

SEQ ID NO: 643734 - protein, 9 aa, Homo Sapiens
VVPEVVSPA

SEQ ID NO: 643735 - protein, 9 aa, Homo Sapiens
AASTWNTDA

SEQ ID NO: 643736 - protein, 9 aa, Homo Sapiens
GFRGPKGVP

SEQ ID NO: 643737 - protein, 9 aa, Homo Sapiens
FTTDSLEAL

SEQ ID NO: 643738 - protein, 9 aa, Homo Sapiens
VWGPSASVV

SEQ ID NO: 643739 - protein, 9 aa, Homo Sapiens
REKLAIILK

SEQ ID NO: 643740 - protein, 9 aa, Homo Sapiens
TRTVTHSFC

SEQ ID NO: 643741 - protein, 9 aa, Homo Sapiens
GADTNRNWN

SEQ ID NO: 643742 - protein, 9 aa, Homo Sapiens
QRRLFSLWP

SEQ ID NO: 643743 - protein, 9 aa, Homo Sapiens
GLLVLVSHL

SEQ ID NO: 643744 - protein, 9 aa, Homo Sapiens
QAQLTLLLR

SEQ ID NO: 643745 - protein, 9 aa, Homo Sapiens
DYFQTSHVD

SEQ ID NO: 643746 - protein, 9 aa, Homo Sapiens
DKKHRLQLD

SEQ ID NO: 643747 - protein, 9 aa, Homo Sapiens
SVASIYDQE

SEQ ID NO: 643748 - protein, 9 aa, Homo Sapiens
KTQLIKEGC

SEQ ID NO: 643749 - protein, 9 aa, Homo Sapiens
QFPPAAFMT

SEQ ID NO: 643750 - protein, 9 aa, Homo Sapiens
WLGARIQPL

SEQ ID NO: 643751 - protein, 9 aa, Homo Sapiens
RKEKHKKIQ

SEQ ID NO: 643752 - protein, 9 aa, Homo Sapiens
THDLEMMTP

SEQ ID NO: 643753 - protein, 9 aa, Homo Sapiens
VKTKHIQEG

SEQ ID NO: 643754 - protein, 9 aa, Homo Sapiens
HHERPGGAV

SEQ ID NO: 643755 - protein, 9 aa, Homo Sapiens
SCIGADTNR

SEQ ID NO: 643756 - protein, 9 aa, Homo Sapiens
GSACDCALC

SEQ ID NO: 643757 - protein, 9 aa, Homo Sapiens
LKNNPQLHS

SEQ ID NO: 643758 - protein, 9 aa, Homo Sapiens
LERARRSKC

SEQ ID NO: 643759 - protein, 9 aa, Homo Sapiens
PFPHHERPG

SEQ ID NO: 643760 - protein, 9 aa, Homo Sapiens
CMTWERRAW

SEQ ID NO: 643761 - protein, 9 aa, Homo Sapiens
YSWYQHQLS

SEQ ID NO: 643762 - protein, 9 aa, Homo Sapiens
ADGAEGPLG

SEQ ID NO: 643763 - protein, 9 aa, Homo Sapiens
SAEGWWPEE

SEQ ID NO: 643764 - protein, 9 aa, Homo Sapiens
LGARIQPLA

SEQ ID NO: 643765 - protein, 9 aa, Homo Sapiens
RKCHKALSQ

SEQ ID NO: 643766 - protein, 9 aa, Homo Sapiens
LGGTFLNVG

SEQ ID NO: 643767 - protein, 9 aa, Homo Sapiens
VAQTLLQLR

SEQ ID NO: 643768 - protein, 9 aa, Homo Sapiens
MLGNVRMIL

SEQ ID NO: 643769 - protein, 9 aa, Homo Sapiens
SREKPYKCQ

SEQ ID NO: 643770 - protein, 9 aa, Homo Sapiens
DRMKIQNAH

SEQ ID NO: 643771 - protein, 9 aa, Homo Sapiens
LIVLQVLVA

SEQ ID NO: 643772 - protein, 9 aa, Homo Sapiens
HRYSGYWWC

SEQ ID NO: 643773 - protein, 9 aa, Homo Sapiens
SSAGIPGAD

SEQ ID NO: 643774 - protein, 9 aa, Homo Sapiens
SCAHAQPAG

SEQ ID NO: 643775 - protein, 9 aa, Homo Sapiens
SKKKLKLAP

SEQ ID NO: 643776 - protein, 9 aa, Homo Sapiens
HDNEAWSSS

SEQ ID NO: 643777 - protein, 9 aa, Homo Sapiens
HEEDGAGDT

SEQ ID NO: 643778 - protein, 9 aa, Homo Sapiens
VGGRLHLRY

SEQ ID NO: 643779 - protein, 9 aa, Homo Sapiens
RYRERDFLA

SEQ ID NO: 643780 - protein, 9 aa, Homo Sapiens
MTVKKPLDY

SEQ ID NO: 643781 - protein, 9 aa, Homo Sapiens
PASAKPLLL

SEQ ID NO: 643782 - protein, 9 aa, Homo Sapiens
ADSPIRLRR

SEQ ID NO: 643783 - protein, 9 aa, Homo Sapiens
IWRLFSGSL

SEQ ID NO: 643784 - protein, 9 aa, Homo Sapiens
ALSLQALQA

SEQ ID NO: 643785 - protein, 9 aa, Homo Sapiens
AKESSLMDR

SEQ ID NO: 643786 - protein, 9 aa, Homo Sapiens
KFTTDSLEA

SEQ ID NO: 643787 - protein, 9 aa, Homo Sapiens
VGARANQSL

SEQ ID NO: 643788 - protein, 9 aa, Homo Sapiens
LEINKALTY

SEQ ID NO: 643789 - protein, 9 aa, Homo Sapiens
FEYYPMAPG

SEQ ID NO: 643790 - protein, 9 aa, Homo Sapiens
VKKMYFIQH

SEQ ID NO: 643791 - protein, 9 aa, Homo Sapiens
FLQGAPAGV

SEQ ID NO: 643792 - protein, 9 aa, Homo Sapiens
QTLATCGGE

SEQ ID NO: 643793 - protein, 9 aa, Homo Sapiens
KESSLMDRM

SEQ ID NO: 643794 - protein, 9 aa, Homo Sapiens
YLEDLQDEI

SEQ ID NO: 643795 - protein, 9 aa, Homo Sapiens
GAWGDYNDS

SEQ ID NO: 643796 - protein, 9 aa, Homo Sapiens
DFLARTYPH

SEQ ID NO: 643797 - protein, 9 aa, Homo Sapiens
EQLVVFNHV

SEQ ID NO: 643798 - protein, 9 aa, Homo Sapiens
TPASCAHAQ

SEQ ID NO: 643799 - protein, 9 aa, Homo Sapiens
PVGLSGGGA

SEQ ID NO: 643800 - protein, 9 aa, Homo Sapiens
VYGVKTKHI

SEQ ID NO: 643801 - protein, 9 aa, Homo Sapiens
HAQPAGATA

SEQ ID NO: 643802 - protein, 9 aa, Homo Sapiens
SPCGQARRQ

SEQ ID NO: 643803 - protein, 9 aa, Homo Sapiens
YRMGNLKSR

SEQ ID NO: 643804 - protein, 9 aa, Homo Sapiens
ILKIPSSFG

SEQ ID NO: 643805 - protein, 9 aa, Homo Sapiens
RRNRWAVAR

SEQ ID NO: 643806 - protein, 9 aa, Homo Sapiens
FSGVGARAN

SEQ ID NO: 643807 - protein, 9 aa, Homo Sapiens
VVPNAWSTT

SEQ ID NO: 643808 - protein, 9 aa, Homo Sapiens
CRQAGLEGT

SEQ ID NO: 643809 - protein, 9 aa, Homo Sapiens
KRKEKHKKI

SEQ ID NO: 643810 - protein, 9 aa, Homo Sapiens
CCRRRLPIL

SEQ ID NO: 643811 - protein, 9 aa, Homo Sapiens
AVIFEDFAV

SEQ ID NO: 643812 - protein, 9 aa, Homo Sapiens
GDDSFSSSW

SEQ ID NO: 643813 - protein, 9 aa, Homo Sapiens
QHAAELILP

SEQ ID NO: 643814 - protein, 9 aa, Homo Sapiens
HQRRLFSLW

SEQ ID NO: 643815 - protein, 9 aa, Homo Sapiens
FSAAAAAAA

SEQ ID NO: 643816 - protein, 9 aa, Homo Sapiens
SILIVLQVL

SEQ ID NO: 643817 - protein, 9 aa, Homo Sapiens
VAKLASDAA

SEQ ID NO: 643818 - protein, 9 aa, Homo Sapiens
FLARTYPHP

SEQ ID NO: 643819 - protein, 9 aa, Homo Sapiens
FGSISQAKV

SEQ ID NO: 643820 - protein, 9 aa, Homo Sapiens
NLILGTRRF

SEQ ID NO: 643821 - protein, 9 aa, Homo Sapiens
DTNRNWNAS

SEQ ID NO: 643822 - protein, 9 aa, Homo Sapiens
QAPVPCYGY

SEQ ID NO: 643823 - protein, 9 aa, Homo Sapiens
MLSRKNFAK

SEQ ID NO: 643824 - protein, 9 aa, Homo Sapiens
LTDHSVKRK

SEQ ID NO: 643825 - protein, 9 aa, Homo Sapiens
SSCCGPSSW

SEQ ID NO: 643826 - protein, 9 aa, Homo Sapiens
ERLGQFVTL

SEQ ID NO: 643827 - protein, 9 aa, Homo Sapiens
VLKYHNLYS

SEQ ID NO: 643828 - protein, 9 aa, Homo Sapiens
PLLLWDEVP

SEQ ID NO: 643829 - protein, 9 aa, Homo Sapiens
SASVVPNAW

SEQ ID NO: 643830 - protein, 9 aa, Homo Sapiens
SPCSCSRSP

SEQ ID NO: 643831 - protein, 9 aa, Homo Sapiens
TSQTLATCG

SEQ ID NO: 643832 - protein, 9 aa, Homo Sapiens
KVTGSACDC

SEQ ID NO: 643833 - protein, 9 aa, Homo Sapiens
LDYPRLEKL

SEQ ID NO: 643834 - protein, 9 aa, Homo Sapiens
AKGVPAVSM

SEQ ID NO: 643835 - protein, 9 aa, Homo Sapiens
TSHVDCSGL

SEQ ID NO: 643836 - protein, 9 aa, Homo Sapiens
HDLEMMTPD

SEQ ID NO: 643837 - protein, 9 aa, Homo Sapiens
DSPHQRRLF

SEQ ID NO: 643838 - protein, 9 aa, Homo Sapiens
LGPAAAGVV

SEQ ID NO: 643839 - protein, 9 aa, Homo Sapiens
HHQNVLFYH

SEQ ID NO: 643840 - protein, 9 aa, Homo Sapiens
YRERDFLAR

SEQ ID NO: 643841 - protein, 9 aa, Homo Sapiens
QKRNIFKAD

SEQ ID NO: 643842 - protein, 9 aa, Homo Sapiens
VFFDLRPLE

SEQ ID NO: 643843 - protein, 9 aa, Homo Sapiens
AGVVGALGA

SEQ ID NO: 643844 - protein, 9 aa, Homo Sapiens
QGMWPSSLR

SEQ ID NO: 643845 - protein, 9 aa, Homo Sapiens
AVVKKMYFI

SEQ ID NO: 643846 - protein, 9 aa, Homo Sapiens
CSCSRSPLV

SEQ ID NO: 643847 - protein, 9 aa, Homo Sapiens
LLLCRFSPR

SEQ ID NO: 643848 - protein, 9 aa, Homo Sapiens
MTTQTVMPL

SEQ ID NO: 643849 - protein, 9 aa, Homo Sapiens
NPQLHSMVA

SEQ ID NO: 643850 - protein, 9 aa, Homo Sapiens
NVLKEQAPD

SEQ ID NO: 643851 - protein, 9 aa, Homo Sapiens
YFQTSHVDC

SEQ ID NO: 643852 - protein, 9 aa, Homo Sapiens
NVRMILIIR

SEQ ID NO: 643853 - protein, 9 aa, Homo Sapiens
IFEDFAVPV

SEQ ID NO: 643854 - protein, 9 aa, Homo Sapiens
SGYKHSSWS

SEQ ID NO: 643855 - protein, 9 aa, Homo Sapiens
VSNDKKHRL

SEQ ID NO: 643856 - protein, 9 aa, Homo Sapiens
VLQDCIRRC

SEQ ID NO: 643857 - protein, 9 aa, Homo Sapiens
LVAFLPGYR

SEQ ID NO: 643858 - protein, 9 aa, Homo Sapiens
MQLQANFLG

SEQ ID NO: 643859 - protein, 9 aa, Homo Sapiens
SVVPNAWST

SEQ ID NO: 643860 - protein, 9 aa, Homo Sapiens
EGWWPEEPL

SEQ ID NO: 643861 - protein, 9 aa, Homo Sapiens
LKETLRLYA

SEQ ID NO: 643862 - protein, 9 aa, Homo Sapiens
LQALQAPQS

SEQ ID NO: 643863 - protein, 9 aa, Homo Sapiens
AERSKRKEK

SEQ ID NO: 643864 - protein, 9 aa, Homo Sapiens
VPCRQAGLE

SEQ ID NO: 643865 - protein, 9 aa, Homo Sapiens
SGGGGSSLL

SEQ ID NO: 643866 - protein, 9 aa, Homo Sapiens
CAERLGQFV

SEQ ID NO: 643867 - protein, 9 aa, Homo Sapiens
QFVTLALVL

SEQ ID NO: 643868 - protein, 9 aa, Homo Sapiens
SSWGCCGSS

SEQ ID NO: 643869 - protein, 9 aa, Homo Sapiens
GGSKRKYRM

SEQ ID NO: 643870 - protein, 9 aa, Homo Sapiens
EAERSKRKE

SEQ ID NO: 643871 - protein, 9 aa, Homo Sapiens
TPLDSGPGP

SEQ ID NO: 643872 - protein, 9 aa, Homo Sapiens
VAFLPGYRN

SEQ ID NO: 643873 - protein, 9 aa, Homo Sapiens
KLHRCLNLI

SEQ ID NO: 643874 - protein, 9 aa, Homo Sapiens
LLQLRQPQL

SEQ ID NO: 643875 - protein, 9 aa, Homo Sapiens
HRSCRPSCY

SEQ ID NO: 643876 - protein, 9 aa, Homo Sapiens
RRMQTLWQE

SEQ ID NO: 643877 - protein, 9 aa, Homo Sapiens
ASYFKVNNR

SEQ ID NO: 643878 - protein, 9 aa, Homo Sapiens
LNLPISFSK

SEQ ID NO: 643879 - protein, 9 aa, Homo Sapiens
PPSLPEEGF

SEQ ID NO: 643880 - protein, 9 aa, Homo Sapiens
PTHDLEMMT

SEQ ID NO: 643881 - protein, 9 aa, Homo Sapiens
SASYFIDRE

SEQ ID NO: 643882 - protein, 9 aa, Homo Sapiens
QLLLVPPQG

SEQ ID NO: 643883 - protein, 9 aa, Homo Sapiens
LLDQRVLGP

SEQ ID NO: 643884 - protein, 9 aa, Homo Sapiens
NEAWSSSGS

SEQ ID NO: 643885 - protein, 9 aa, Homo Sapiens
PLNQRSSEF

SEQ ID NO: 643886 - protein, 9 aa, Homo Sapiens
RNMMGNAWP

SEQ ID NO: 643887 - protein, 9 aa, Homo Sapiens
TTQTVMPLP

SEQ ID NO: 643888 - protein, 9 aa, Homo Sapiens
SSYRIPSVT

SEQ ID NO: 643889 - protein, 9 aa, Homo Sapiens
IQCCRRRLP

SEQ ID NO: 643890 - protein, 9 aa, Homo Sapiens
DQDQHQPQQ

SEQ ID NO: 643891 - protein, 9 aa, Homo Sapiens
SKRKEKHKK

SEQ ID NO: 643892 - protein, 9 aa, Homo Sapiens
VLFYHTTSV

SEQ ID NO: 643893 - protein, 9 aa, Homo Sapiens
SIRNINQEE

SEQ ID NO: 643894 - protein, 9 aa, Homo Sapiens
IPLNQRSSE

SEQ ID NO: 643895 - protein, 9 aa, Homo Sapiens
SYCQTRTVT

SEQ ID NO: 643896 - protein, 9 aa, Homo Sapiens
PKMVHKAVE

SEQ ID NO: 643897 - protein, 9 aa, Homo Sapiens
RFSGVGARA

SEQ ID NO: 643898 - protein, 9 aa, Homo Sapiens
MCINNTFVC

SEQ ID NO: 643899 - protein, 9 aa, Homo Sapiens
ITGLHRGFL

SEQ ID NO: 643900 - protein, 9 aa, Homo Sapiens
PLDSGPGPP

SEQ ID NO: 643901 - protein, 9 aa, Homo Sapiens
APFHDQLPN

SEQ ID NO: 643902 - protein, 9 aa, Homo Sapiens
SRDSSKASS

SEQ ID NO: 643903 - protein, 9 aa, Homo Sapiens
NINQEERLK

SEQ ID NO: 643904 - protein, 9 aa, Homo Sapiens
KNETLGGTF

SEQ ID NO: 643905 - protein, 9 aa, Homo Sapiens
HDQLPNGLS

SEQ ID NO: 643906 - protein, 9 aa, Homo Sapiens
KSGYKHSSW

SEQ ID NO: 643907 - protein, 9 aa, Homo Sapiens
MQTLWQEHF

SEQ ID NO: 643908 - protein, 9 aa, Homo Sapiens
GRLHLRYVG

SEQ ID NO: 643909 - protein, 9 aa, Homo Sapiens
FHDQLPNGL

SEQ ID NO: 643910 - protein, 9 aa, Homo Sapiens
SPSLALPAH

SEQ ID NO: 643911 - protein, 9 aa, Homo Sapiens
SQTLATCGG

SEQ ID NO: 643912 - protein, 9 aa, Homo Sapiens
CFCGEHHPQ

SEQ ID NO: 643913 - protein, 9 aa, Homo Sapiens
YAVGLFLER

SEQ ID NO: 643914 - protein, 9 aa, Homo Sapiens
ARHEEDGAG

SEQ ID NO: 643915 - protein, 9 aa, Homo Sapiens
VVSNDKKHR

SEQ ID NO: 643916 - protein, 9 aa, Homo Sapiens
FFDLRPLEG

SEQ ID NO: 643917 - protein, 9 aa, Homo Sapiens
PEEGFPGAV

SEQ ID NO: 643918 - protein, 9 aa, Homo Sapiens
VEKSGALPQ

SEQ ID NO: 643919 - protein, 9 aa, Homo Sapiens
IRRCNNGIP

SEQ ID NO: 643920 - protein, 9 aa, Homo Sapiens
INNTFVCNG

SEQ ID NO: 643921 - protein, 9 aa, Homo Sapiens
TPPCPPSGP

SEQ ID NO: 643922 - protein, 9 aa, Homo Sapiens
MARPGIDRE

SEQ ID NO: 643923 - protein, 9 aa, Homo Sapiens
PRVAQTLLQ

SEQ ID NO: 643924 - protein, 9 aa, Homo Sapiens
RNINQEERL

SEQ ID NO: 643925 - protein, 9 aa, Homo Sapiens
DHIYPMKLK

SEQ ID NO: 643926 - protein, 9 aa, Homo Sapiens
YPRLEKLWH

SEQ ID NO: 643927 - protein, 9 aa, Homo Sapiens
DYNDSAFME

SEQ ID NO: 643928 - protein, 9 aa, Homo Sapiens
QNTAASTWN

SEQ ID NO: 643929 - protein, 9 aa, Homo Sapiens
FSVIRLDVA

SEQ ID NO: 643930 - protein, 9 aa, Homo Sapiens
YEETESKLL

SEQ ID NO: 643931 - protein, 9 aa, Homo Sapiens
QDLSMADSP

SEQ ID NO: 643932 - protein, 9 aa, Homo Sapiens
SCPYPHCRK

SEQ ID NO: 643933 - protein, 9 aa, Homo Sapiens
LSQFFDRVP

SEQ ID NO: 643934 - protein, 9 aa, Homo Sapiens
DTLPSVSSI

SEQ ID NO: 643935 - protein, 9 aa, Homo Sapiens
ADGSSAGIP

SEQ ID NO: 643936 - protein, 9 aa, Homo Sapiens
AGIPGADSP

SEQ ID NO: 643937 - protein, 9 aa, Homo Sapiens
WPSSLRRNR

SEQ ID NO: 643938 - protein, 9 aa, Homo Sapiens
VPEVVSPAG

SEQ ID NO: 643939 - protein, 9 aa, Homo Sapiens
WLSYCQTRT

SEQ ID NO: 643940 - protein, 9 aa, Homo Sapiens
AKRQHLGEQ

SEQ ID NO: 643941 - protein, 9 aa, Homo Sapiens
IKFFQNQLY

SEQ ID NO: 643942 - protein, 9 aa, Homo Sapiens
EDLASLQSF

SEQ ID NO: 643943 - protein, 9 aa, Homo Sapiens
PATPSPSLA

SEQ ID NO: 643944 - protein, 9 aa, Homo Sapiens
RPHNLLPGR

SEQ ID NO: 643945 - protein, 9 aa, Homo Sapiens
GPSSWGCCG

SEQ ID NO: 643946 - protein, 9 aa, Homo Sapiens
MLNWGRAAL

SEQ ID NO: 643947 - protein, 9 aa, Homo Sapiens
VLQEEFHRY

SEQ ID NO: 643948 - protein, 9 aa, Homo Sapiens
MSPCGQARR

SEQ ID NO: 643949 - protein, 9 aa, Homo Sapiens
SSKEQLVVF

SEQ ID NO: 643950 - protein, 9 aa, Homo Sapiens
VKKEMQLQA

SEQ ID NO: 643951 - protein, 9 aa, Homo Sapiens
HHPQQGSTL

SEQ ID NO: 643952 - protein, 9 aa, Homo Sapiens
QLIKEGCRS

SEQ ID NO: 643953 - protein, 9 aa, Homo Sapiens
TAAPFHDQL

SEQ ID NO: 643954 - protein, 9 aa, Homo Sapiens
KEMQLQANF

SEQ ID NO: 643955 - protein, 9 aa, Homo Sapiens
IPSSFGRRK

SEQ ID NO: 643956 - protein, 9 aa, Homo Sapiens
LCATGGGGY

SEQ ID NO: 643957 - protein, 9 aa, Homo Sapiens
HSFFNVSQL

SEQ ID NO: 643958 - protein, 9 aa, Homo Sapiens
IGADTNRNW

SEQ ID NO: 643959 - protein, 9 aa, Homo Sapiens
RVVPASKPE

SEQ ID NO: 643960 - protein, 9 aa, Homo Sapiens
MMTPDDPRM

SEQ ID NO: 643961 - protein, 9 aa, Homo Sapiens
WERRAWDYP

SEQ ID NO: 643962 - protein, 9 aa, Homo Sapiens
DNDTLPSVS

SEQ ID NO: 643963 - protein, 9 aa, Homo Sapiens
DGSSAGIPG

SEQ ID NO: 643964 - protein, 9 aa, Homo Sapiens
RPDQERGPW

SEQ ID NO: 643965 - protein, 9 aa, Homo Sapiens
CDNDTLPSV

SEQ ID NO: 643966 - protein, 9 aa, Homo Sapiens
QLLLCRFSP

SEQ ID NO: 643967 - protein, 9 aa, Homo Sapiens
VGKWLGARI

SEQ ID NO: 643968 - protein, 9 aa, Homo Sapiens
NRIKTWQKT

SEQ ID NO: 643969 - protein, 9 aa, Homo Sapiens
AHAQPAGAT

SEQ ID NO: 643970 - protein, 9 aa, Homo Sapiens
SFSSSWDLS

SEQ ID NO: 643971 - protein, 9 aa, Homo Sapiens
FGVLKYHNL

SEQ ID NO: 643972 - protein, 9 aa, Homo Sapiens
PSSFGRRKS

SEQ ID NO: 643973 - protein, 9 aa, Homo Sapiens
RDPKVLTFL

SEQ ID NO: 643974 - protein, 9 aa, Homo Sapiens
ILGTRRFNL

SEQ ID NO: 643975 - protein, 9 aa, Homo Sapiens
AADGSSAGI

SEQ ID NO: 643976 - protein, 9 aa, Homo Sapiens
PQLLLCRFS

SEQ ID NO: 643977 - protein, 9 aa, Homo Sapiens
ADSPHQRRL

SEQ ID NO: 643978 - protein, 9 aa, Homo Sapiens
GSAEGWWPE

SEQ ID NO: 643979 - protein, 9 aa, Homo Sapiens
HNLLPGRAE

SEQ ID NO: 643980 - protein, 9 aa, Homo Sapiens
LMDRMKIQN

SEQ ID NO: 643981 - protein, 9 aa, Homo Sapiens
CQTEAQYHL

SEQ ID NO: 643982 - protein, 9 aa, Homo Sapiens
DGLDYPRLE

SEQ ID NO: 643983 - protein, 9 aa, Homo Sapiens
MHFRTHSRE

SEQ ID NO: 643984 - protein, 9 aa, Homo Sapiens
KLILVMLEI

SEQ ID NO: 643985 - protein, 9 aa, Homo Sapiens
TNRNWNASF

SEQ ID NO: 643986 - protein, 9 aa, Homo Sapiens
ARRSKCSGP

SEQ ID NO: 643987 - protein, 9 aa, Homo Sapiens
KMVHKAVED

SEQ ID NO: 643988 - protein, 9 aa, Homo Sapiens
LGNVRMILI

SEQ ID NO: 643989 - protein, 9 aa, Homo Sapiens
IFSVIRLDV

SEQ ID NO: 643990 - protein, 9 aa, Homo Sapiens
LNRIKTWQK

SEQ ID NO: 643991 - protein, 9 aa, Homo Sapiens
EHHPQQGST

SEQ ID NO: 643992 - protein, 9 aa, Homo Sapiens
PHHERPGGA

SEQ ID NO: 643993 - protein, 9 aa, Homo Sapiens
KPLSASGKE

SEQ ID NO: 643994 - protein, 9 aa, Homo Sapiens
IGCKKPLSA

SEQ ID NO: 643995 - protein, 9 aa, Homo Sapiens
LQDEIDYRY

SEQ ID NO: 643996 - protein, 9 aa, Homo Sapiens
PHPPAYTST

SEQ ID NO: 643997 - protein, 9 aa, Homo Sapiens
GFVNHTHSF

SEQ ID NO: 643998 - protein, 9 aa, Homo Sapiens
LIGCKKPLS

SEQ ID NO: 643999 - protein, 9 aa, Homo Sapiens
PPATPSPSL

SEQ ID NO: 644000 - protein, 9 aa, Homo Sapiens
DGAGDTWRG

SEQ ID NO: 644001 - protein, 9 aa, Homo Sapiens
ALTYLRQKD

SEQ ID NO: 644002 - protein, 9 aa, Homo Sapiens
FLLALPLCW

SEQ ID NO: 644003 - protein, 9 aa, Homo Sapiens
SKASSMLNW

SEQ ID NO: 644004 - protein, 9 aa, Homo Sapiens
FFCFVQNSI

SEQ ID NO: 644005 - protein, 9 aa, Homo Sapiens
LCQLQRRMQ

SEQ ID NO: 644006 - protein, 9 aa, Homo Sapiens
LMDGLKELK

SEQ ID NO: 644007 - protein, 9 aa, Homo Sapiens
LCQTEAQYH

SEQ ID NO: 644008 - protein, 9 aa, Homo Sapiens
KKKLKLAPL

SEQ ID NO: 644009 - protein, 9 aa, Homo Sapiens
LVMLEIVTE

SEQ ID NO: 644010 - protein, 9 aa, Homo Sapiens
WSIREWIRK

SEQ ID NO: 644011 - protein, 9 aa, Homo Sapiens
QLYHVKHHG

SEQ ID NO: 644012 - protein, 9 aa, Homo Sapiens
SLLKCMTWE

SEQ ID NO: 644013 - protein, 9 aa, Homo Sapiens
RVAKLASDA

SEQ ID NO: 644014 - protein, 9 aa, Homo Sapiens
LILVMLEIV

SEQ ID NO: 644015 - protein, 9 aa, Homo Sapiens
LSMADSPHQ

SEQ ID NO: 644016 - protein, 9 aa, Homo Sapiens
DGLKELKLH

SEQ ID NO: 644017 - protein, 9 aa, Homo Sapiens
EVGKWLGAR

SEQ ID NO: 644018 - protein, 9 aa, Homo Sapiens
NLSPIKDQD

SEQ ID NO: 644019 - protein, 9 aa, Homo Sapiens
GYKHSSWSE

SEQ ID NO: 644020 - protein, 9 aa, Homo Sapiens
LRRNRWAVA

SEQ ID NO: 644021 - protein, 9 aa, Homo Sapiens
NRWAVARVV

SEQ ID NO: 644022 - protein, 9 aa, Homo Sapiens
TFVLQEEFH

SEQ ID NO: 644023 - protein, 9 aa, Homo Sapiens
GVCDNDTLP

SEQ ID NO: 644024 - protein, 9 aa, Homo Sapiens
FCFLNLPIS

SEQ ID NO: 644025 - protein, 9 aa, Homo Sapiens
ALVVPEVVS

SEQ ID NO: 644026 - protein, 9 aa, Homo Sapiens
HLRYVGLED

SEQ ID NO: 644027 - protein, 9 aa, Homo Sapiens
DLRPDQERG

SEQ ID NO: 644028 - protein, 9 aa, Homo Sapiens
LQGAPAGVE

SEQ ID NO: 644029 - protein, 9 aa, Homo Sapiens
KLLEKIKEG

SEQ ID NO: 644030 - protein, 9 aa, Homo Sapiens
KLTPPCPPS

SEQ ID NO: 644031 - protein, 9 aa, Homo Sapiens
YGVKTKHIQ

SEQ ID NO: 644032 - protein, 9 aa, Homo Sapiens
GGGGYKFEK

SEQ ID NO: 644033 - protein, 9 aa, Homo Sapiens
RNRWAVARV

SEQ ID NO: 644034 - protein, 9 aa, Homo Sapiens
LLRPPQLLL

SEQ ID NO: 644035 - protein, 9 aa, Homo Sapiens
EDIIQCCRR

SEQ ID NO: 644036 - protein, 9 aa, Homo Sapiens
GFCFLNLPI

SEQ ID NO: 644037 - protein, 9 aa, Homo Sapiens
IKTWQKTHQ

SEQ ID NO: 644038 - protein, 9 aa, Homo Sapiens
SIYDQEELM

SEQ ID NO: 644039 - protein, 9 aa, Homo Sapiens
GEHHPQQGS

SEQ ID NO: 644040 - protein, 9 aa, Homo Sapiens
VHTRPHNLL

SEQ ID NO: 644041 - protein, 9 aa, Homo Sapiens
GHRSCRPSC

SEQ ID NO: 644042 - protein, 9 aa, Homo Sapiens
KETLRLYAV

SEQ ID NO: 644043 - protein, 9 aa, Homo Sapiens
ISQAKVMME

SEQ ID NO: 644044 - protein, 9 aa, Homo Sapiens
FVAVFFDLR

SEQ ID NO: 644045 - protein, 9 aa, Homo Sapiens
PPSSRDSSK

SEQ ID NO: 644046 - protein, 9 aa, Homo Sapiens
QEGIMTVKK

SEQ ID NO: 644047 - protein, 9 aa, Homo Sapiens
EETESKLLE

SEQ ID NO: 644048 - protein, 9 aa, Homo Sapiens
TLHQLSASY

SEQ ID NO: 644049 - protein, 9 aa, Homo Sapiens
VELFGVLKY

SEQ ID NO: 644050 - protein, 9 aa, Homo Sapiens
CDCALCACP

SEQ ID NO: 644051 - protein, 9 aa, Homo Sapiens
RVKEIKRLK

SEQ ID NO: 644052 - protein, 9 aa, Homo Sapiens
ARVVGLPGR

SEQ ID NO: 644053 - protein, 9 aa, Homo Sapiens
QTLLQLRQP

SEQ ID NO: 644054 - protein, 9 aa, Homo Sapiens
GCRSYCTDS

SEQ ID NO: 644055 - protein, 9 aa, Homo Sapiens
CTSYRVVPA

SEQ ID NO: 644056 - protein, 9 aa, Homo Sapiens
KRTHTGEIP

SEQ ID NO: 644057 - protein, 9 aa, Homo Sapiens
FSSFGSISQ

SEQ ID NO: 644058 - protein, 9 aa, Homo Sapiens
ERLALHVLH

SEQ ID NO: 644059 - protein, 9 aa, Homo Sapiens
LSYCQTRTV

SEQ ID NO: 644060 - protein, 9 aa, Homo Sapiens
LHVLHQQGL

SEQ ID NO: 644061 - protein, 9 aa, Homo Sapiens
DQRVLGPAA

SEQ ID NO: 644062 - protein, 9 aa, Homo Sapiens
LDSGPGPPS

SEQ ID NO: 644063 - protein, 9 aa, Homo Sapiens
PDLRPDQER

SEQ ID NO: 644064 - protein, 9 aa, Homo Sapiens
AKLASDAAW

SEQ ID NO: 644065 - protein, 9 aa, Homo Sapiens
LKLAPLQVT

SEQ ID NO: 644066 - protein, 9 aa, Homo Sapiens
KLAIILKES

SEQ ID NO: 644067 - protein, 9 aa, Homo Sapiens
NVGGRLHLR

SEQ ID NO: 644068 - protein, 9 aa, Homo Sapiens
KCHKALSQF

SEQ ID NO: 644069 - protein, 9 aa, Homo Sapiens
EDQRELQKL

SEQ ID NO: 644070 - protein, 9 aa, Homo Sapiens
SPIKDQDRL

SEQ ID NO: 644071 - protein, 9 aa, Homo Sapiens
KYRMGNLKS

SEQ ID NO: 644072 - protein, 9 aa, Homo Sapiens
KLASDAAWV

SEQ ID NO: 644073 - protein, 9 aa, Homo Sapiens
PIRLRRGLG

SEQ ID NO: 644074 - protein, 9 aa, Homo Sapiens
WRGGRLQSH

SEQ ID NO: 644075 - protein, 9 aa, Homo Sapiens
SHTVDVYFG

SEQ ID NO: 644076 - protein, 9 aa, Homo Sapiens
HQLSASYFI

SEQ ID NO: 644077 - protein, 9 aa, Homo Sapiens
GCGWKFARA

SEQ ID NO: 644078 - protein, 9 aa, Homo Sapiens
SLLLHPPQQ

SEQ ID NO: 644079 - protein, 9 aa, Homo Sapiens
SHADQDQHQ

SEQ ID NO: 644080 - protein, 9 aa, Homo Sapiens
VTGSAEGWW

SEQ ID NO: 644081 - protein, 9 aa, Homo Sapiens
IRLDVALHT

SEQ ID NO: 644082 - protein, 9 aa, Homo Sapiens
KNNPQLHSM

SEQ ID NO: 644083 - protein, 9 aa, Homo Sapiens
VHCTLELSR

SEQ ID NO: 644084 - protein, 9 aa, Homo Sapiens
ESSLMDRMK

SEQ ID NO: 644085 - protein, 9 aa, Homo Sapiens
PSKKKLKLA

SEQ ID NO: 644086 - protein, 9 aa, Homo Sapiens
ELILPLGFY

SEQ ID NO: 644087 - protein, 9 aa, Homo Sapiens
LFSGSLNEY

SEQ ID NO: 644088 - protein, 9 aa, Homo Sapiens
AERLGQFVT

SEQ ID NO: 644089 - protein, 9 aa, Homo Sapiens
PLSASGKEM

SEQ ID NO: 644090 - protein, 9 aa, Homo Sapiens
VTGSACDCA

SEQ ID NO: 644091 - protein, 9 aa, Homo Sapiens
QSLVAFLPG

SEQ ID NO: 644092 - protein, 9 aa, Homo Sapiens
DFAVPVANR

SEQ ID NO: 644093 - protein, 9 aa, Homo Sapiens
PALSLQALQ

SEQ ID NO: 644094 - protein, 9 aa, Homo Sapiens
LSRKNFAKG

SEQ ID NO: 644095 - protein, 9 aa, Homo Sapiens
GQEVRGLSF

SEQ ID NO: 644096 - protein, 9 aa, Homo Sapiens
RRKCHKALS

SEQ ID NO: 644097 - protein, 9 aa, Homo Sapiens
QENSDGLIL

SEQ ID NO: 644098 - protein, 9 aa, Homo Sapiens
PPHPPAYTS

SEQ ID NO: 644099 - protein, 9 aa, Homo Sapiens
NQHAAELIL

SEQ ID NO: 644100 - protein, 9 aa, Homo Sapiens
SQLLLNRIK

SEQ ID NO: 644101 - protein, 9 aa, Homo Sapiens
YRVVPASKP

SEQ ID NO: 644102 - protein, 9 aa, Homo Sapiens
RLRRGLGSI

SEQ ID NO: 644103 - protein, 9 aa, Homo Sapiens
KDTQEGIMT

SEQ ID NO: 644104 - protein, 9 aa, Homo Sapiens
GCPQAPVPC

SEQ ID NO: 644105 - protein, 9 aa, Homo Sapiens
LLNRIKTWQ

SEQ ID NO: 644106 - protein, 9 aa, Homo Sapiens
KNFAKGVPA

SEQ ID NO: 644107 - protein, 9 aa, Homo Sapiens
QAPQSLSAP

SEQ ID NO: 644108 - protein, 9 aa, Homo Sapiens
EIDYRYKTI

SEQ ID NO: 644109 - protein, 9 aa, Homo Sapiens
LTYLRQKDY

SEQ ID NO: 644110 - protein, 9 aa, Homo Sapiens
SRSVWEEKQ

SEQ ID NO: 644111 - protein, 9 aa, Homo Sapiens
AAELILPLG

SEQ ID NO: 644112 - protein, 9 aa, Homo Sapiens
MPEQAHKVR

SEQ ID NO: 644113 - protein, 9 aa, Homo Sapiens
SYRIPSVTS

SEQ ID NO: 644114 - protein, 9 aa, Homo Sapiens
TGLHRGFLV

SEQ ID NO: 644115 - protein, 9 aa, Homo Sapiens
FLATAHYVT

SEQ ID NO: 644116 - protein, 9 aa, Homo Sapiens
ATPLDSGPG

SEQ ID NO: 644117 - protein, 9 aa, Homo Sapiens
WYQHQLSHE

SEQ ID NO: 644118 - protein, 9 aa, Homo Sapiens
AWPLVAHKY

SEQ ID NO: 644119 - protein, 9 aa, Homo Sapiens
LQAPQSLSA

SEQ ID NO: 644120 - protein, 9 aa, Homo Sapiens
FEDFAVPVA

SEQ ID NO: 644121 - protein, 9 aa, Homo Sapiens
IQQVIDLLD

SEQ ID NO: 644122 - protein, 9 aa, Homo Sapiens
QAQENSDGL

SEQ ID NO: 644123 - protein, 9 aa, Homo Sapiens
HKSGYKHSS

SEQ ID NO: 644124 - protein, 9 aa, Homo Sapiens
KADFHNLMA

SEQ ID NO: 644125 - protein, 9 aa, Homo Sapiens
KKEMQLQAN

SEQ ID NO: 644126 - protein, 9 aa, Homo Sapiens
LHDNEAWSS

SEQ ID NO: 644127 - protein, 9 aa, Homo Sapiens
YHTTSVLLN

SEQ ID NO: 644128 - protein, 9 aa, Homo Sapiens
QRRMQTLWQ

SEQ ID NO: 644129 - protein, 9 aa, Homo Sapiens
ELFGVLKYH

SEQ ID NO: 644130 - protein, 9 aa, Homo Sapiens
GYPFPHHER

SEQ ID NO: 644131 - protein, 9 aa, Homo Sapiens
KKHRLQLDI

SEQ ID NO: 644132 - protein, 9 aa, Homo Sapiens
GIMTVKKPL

SEQ ID NO: 644133 - protein, 9 aa, Homo Sapiens
KVRVKEIKR

SEQ ID NO: 644134 - protein, 9 aa, Homo Sapiens
DAAWVLSLC

SEQ ID NO: 644135 - protein, 9 aa, Homo Sapiens
GWKFARADE

SEQ ID NO: 644136 - protein, 9 aa, Homo Sapiens
PIKDQDRLL

SEQ ID NO: 644137 - protein, 9 aa, Homo Sapiens
GLSGGGASA

SEQ ID NO: 644138 - protein, 9 aa, Homo Sapiens
AVFFDLRPL

SEQ ID NO: 644139 - protein, 9 aa, Homo Sapiens
APGTYIVTI

SEQ ID NO: 644140 - protein, 9 aa, Homo Sapiens
QLSASYFID

SEQ ID NO: 644141 - protein, 9 aa, Homo Sapiens
GNQHAAELI

SEQ ID NO: 644142 - protein, 9 aa, Homo Sapiens
PQNTAASTW

SEQ ID NO: 644143 - protein, 9 aa, Homo Sapiens
ISVASIYDQ

SEQ ID NO: 644144 - protein, 9 aa, Homo Sapiens
VLVSHLERA

SEQ ID NO: 644145 - protein, 9 aa, Homo Sapiens
THKSFHGCL

SEQ ID NO: 644146 - protein, 9 aa, Homo Sapiens
LQSHADQDQ

SEQ ID NO: 644147 - protein, 9 aa, Homo Sapiens
RQHLGEQRL

SEQ ID NO: 644148 - protein, 9 aa, Homo Sapiens
AYSWYQHQL

SEQ ID NO: 644149 - protein, 9 aa, Homo Sapiens
RPPDLPARA

SEQ ID NO: 644150 - protein, 9 aa, Homo Sapiens
YPMAPGTYI

SEQ ID NO: 644151 - protein, 9 aa, Homo Sapiens
ISFSKGFPF

SEQ ID NO: 644152 - protein, 9 aa, Homo Sapiens
LELSRSVWE

SEQ ID NO: 644153 - protein, 9 aa, Homo Sapiens
EINKALTYL

SEQ ID NO: 644154 - protein, 9 aa, Homo Sapiens
CSRSPLVSP

SEQ ID NO: 644155 - protein, 9 aa, Homo Sapiens
VHKAVEDGI

SEQ ID NO: 644156 - protein, 9 aa, Homo Sapiens
LGAPVGLSG

SEQ ID NO: 644157 - protein, 9 aa, Homo Sapiens
VTEFVLLVF

SEQ ID NO: 644158 - protein, 9 aa, Homo Sapiens
GPGPPSSRD

SEQ ID NO: 644159 - protein, 9 aa, Homo Sapiens
LGSILIVLQ

SEQ ID NO: 644160 - protein, 9 aa, Homo Sapiens
VALHTPMYH

SEQ ID NO: 644161 - protein, 9 aa, Homo Sapiens
NEDDEEKEE

SEQ ID NO: 644162 - protein, 9 aa, Homo Sapiens
ILIVLQVLV

SEQ ID NO: 644163 - protein, 9 aa, Homo Sapiens
GAAASYFKV

SEQ ID NO: 644164 - protein, 9 aa, Homo Sapiens
NVNFLCQTE

SEQ ID NO: 644165 - protein, 9 aa, Homo Sapiens
KVLTFLEYI

SEQ ID NO: 644166 - protein, 9 aa, Homo Sapiens
IDREASYGD

SEQ ID NO: 644167 - protein, 9 aa, Homo Sapiens
QDEIDYRYK

SEQ ID NO: 644168 - protein, 9 aa, Homo Sapiens
KIPSSFGRR

SEQ ID NO: 644169 - protein, 9 aa, Homo Sapiens
TLATCGGEA

SEQ ID NO: 644170 - protein, 9 aa, Homo Sapiens
GKWLGARIQ

SEQ ID NO: 644171 - protein, 9 aa, Homo Sapiens
GAEGPLGAA

SEQ ID NO: 644172 - protein, 9 aa, Homo Sapiens
LDNEDQREL

SEQ ID NO: 644173 - protein, 9 aa, Homo Sapiens
TLELSRSVW

SEQ ID NO: 644174 - protein, 9 aa, Homo Sapiens
RPFSAAAAA

SEQ ID NO: 644175 - protein, 9 aa, Homo Sapiens
ATAHYVTTR

SEQ ID NO: 644176 - protein, 9 aa, Homo Sapiens
GTRRFNLCF

SEQ ID NO: 644177 - protein, 9 aa, Homo Sapiens
LLCRFSPRV

SEQ ID NO: 644178 - protein, 9 aa, Homo Sapiens
YQHQLSHED

SEQ ID NO: 644179 - protein, 9 aa, Homo Sapiens
GAADGSSAG

SEQ ID NO: 644180 - protein, 9 aa, Homo Sapiens
GGGQGGPLL

SEQ ID NO: 644181 - protein, 9 aa, Homo Sapiens
SSLLKCMTW

SEQ ID NO: 644182 - protein, 9 aa, Homo Sapiens
LLALPLCWV

SEQ ID NO: 644183 - protein, 9 aa, Homo Sapiens
ASSMLNWGR

SEQ ID NO: 644184 - protein, 9 aa, Homo Sapiens
GALGAAADG

SEQ ID NO: 644185 - protein, 9 aa, Homo Sapiens
VGAWGDYND

SEQ ID NO: 644186 - protein, 9 aa, Homo Sapiens
KALSQFFDR

SEQ ID NO: 644187 - protein, 9 aa, Homo Sapiens
GPLGAADGS

SEQ ID NO: 644188 - protein, 9 aa, Homo Sapiens
SSRDSSKAS

SEQ ID NO: 644189 - protein, 9 aa, Homo Sapiens
TRRFNLCFC

SEQ ID NO: 644190 - protein, 9 aa, Homo Sapiens
GAGDTWRGG

SEQ ID NO: 644191 - protein, 9 aa, Homo Sapiens
PLGAADGSS

SEQ ID NO: 644192 - protein, 9 aa, Homo Sapiens
CPYPHCRKE

SEQ ID NO: 644193 - protein, 9 aa, Homo Sapiens
IRLRRGLGS

SEQ ID NO: 644194 - protein, 9 aa, Homo Sapiens
AQTLLQLRQ

SEQ ID NO: 644195 - protein, 9 aa, Homo Sapiens
FSSSWDLSL

SEQ ID NO: 644196 - protein, 9 aa, Homo Sapiens
GLKELKLHR

SEQ ID NO: 644197 - protein, 9 aa, Homo Sapiens
CKKPLSASG

SEQ ID NO: 644198 - protein, 9 aa, Homo Sapiens
LLEKIKEGY

SEQ ID NO: 644199 - protein, 9 aa, Homo Sapiens
DSAATAGAG

SEQ ID NO: 644200 - protein, 9 aa, Homo Sapiens
QVIDLLDSI

SEQ ID NO: 644201 - protein, 9 aa, Homo Sapiens
EMHFRTHSR

SEQ ID NO: 644202 - protein, 9 aa, Homo Sapiens
FTHKSFHGC

SEQ ID NO: 644203 - protein, 9 aa, Homo Sapiens
QEDGLDYPR

SEQ ID NO: 644204 - protein, 9 aa, Homo Sapiens
ENVNFLCQT

SEQ ID NO: 644205 - protein, 9 aa, Homo Sapiens
PQSLSAPRL

SEQ ID NO: 644206 - protein, 9 aa, Homo Sapiens
GQARRQTSR

SEQ ID NO: 644207 - protein, 9 aa, Homo Sapiens
PQAPVPCYG

SEQ ID NO: 644208 - protein, 9 aa, Homo Sapiens
QPGLLVLVS

SEQ ID NO: 644209 - protein, 9 aa, Homo Sapiens
PRLLRPPQL

SEQ ID NO: 644210 - protein, 9 aa, Homo Sapiens
LPPATPSPS

SEQ ID NO: 644211 - protein, 9 aa, Homo Sapiens
CCFCGEHHP

SEQ ID NO: 644212 - protein, 9 aa, Homo Sapiens
NEVGKWLGA

SEQ ID NO: 644213 - protein, 9 aa, Homo Sapiens
MDQRRFSGV

SEQ ID NO: 644214 - protein, 9 aa, Homo Sapiens
WGDYNDSAF

SEQ ID NO: 644215 - protein, 9 aa, Homo Sapiens
RDSPCSCSR

SEQ ID NO: 644216 - protein, 9 aa, Homo Sapiens
FSCPYPHCR

SEQ ID NO: 644217 - protein, 9 aa, Homo Sapiens
HIQEGVIKF

SEQ ID NO: 644218 - protein, 9 aa, Homo Sapiens
PSSLRRNRW

SEQ ID NO: 644219 - protein, 9 aa, Homo Sapiens
MPPHPPAYT

SEQ ID NO: 644220 - protein, 9 aa, Homo Sapiens
SLMDRMKIQ

SEQ ID NO: 644221 - protein, 9 aa, Homo Sapiens
RLDVALHTP

SEQ ID NO: 644222 - protein, 9 aa, Homo Sapiens
EEGFPGAVY

SEQ ID NO: 644223 - protein, 9 aa, Homo Sapiens
QLAKRQHLG

SEQ ID NO: 644224 - protein, 9 aa, Homo Sapiens
IMTVKKPLD

SEQ ID NO: 644225 - protein, 9 aa, Homo Sapiens
DVALHTPMY

SEQ ID NO: 644226 - protein, 9 aa, Homo Sapiens
PPPKALQAQ

SEQ ID NO: 644227 - protein, 9 aa, Homo Sapiens
SHVDCSGLP

SEQ ID NO: 644228 - protein, 9 aa, Homo Sapiens
APRLLRPPQ

SEQ ID NO: 644229 - protein, 9 aa, Homo Sapiens
QCCRRRLPI

SEQ ID NO: 644230 - protein, 9 aa, Homo Sapiens
DQRRFSGVG

SEQ ID NO: 644231 - protein, 9 aa, Homo Sapiens
FGRRKSFST

SEQ ID NO: 644232 - protein, 9 aa, Homo Sapiens
TLRLYAVGL

SEQ ID NO: 644233 - protein, 9 aa, Homo Sapiens
LLLNRIKTW

SEQ ID NO: 644234 - protein, 9 aa, Homo Sapiens
VGALGAAAD

SEQ ID NO: 644235 - protein, 9 aa, Homo Sapiens
WKFARADEL

SEQ ID NO: 644236 - protein, 9 aa, Homo Sapiens
DNEDQRELQ

SEQ ID NO: 644237 - protein, 9 aa, Homo Sapiens
SACDCALCA

SEQ ID NO: 644238 - protein, 9 aa, Homo Sapiens
LSASYFIDR

SEQ ID NO: 644239 - protein, 9 aa, Homo Sapiens
FMTTQTVMP

SEQ ID NO: 644240 - protein, 9 aa, Homo Sapiens
TLNTGRPPD

SEQ ID NO: 644241 - protein, 9 aa, Homo Sapiens
LITMLGNVR

SEQ ID NO: 644242 - protein, 9 aa, Homo Sapiens
AWGDYNDSA

SEQ ID NO: 644243 - protein, 9 aa, Homo Sapiens
AVELFGVLK

SEQ ID NO: 644244 - protein, 9 aa, Homo Sapiens
GDTWRGGRL

SEQ ID NO: 644245 - protein, 9 aa, Homo Sapiens
AIILKESLN

SEQ ID NO: 644246 - protein, 9 aa, Homo Sapiens
EYYPMAPGT

SEQ ID NO: 644247 - protein, 9 aa, Homo Sapiens
ERSKRKEKH

SEQ ID NO: 644248 - protein, 9 aa, Homo Sapiens
QRRFSGVGA

SEQ ID NO: 644249 - protein, 9 aa, Homo Sapiens
GFGGYGHRS

SEQ ID NO: 644250 - protein, 9 aa, Homo Sapiens
GGGYKFEKD

SEQ ID NO: 644251 - protein, 9 aa, Homo Sapiens
REASYGDLI

SEQ ID NO: 644252 - protein, 9 aa, Homo Sapiens
HTVDVYFGP

SEQ ID NO: 644253 - protein, 9 aa, Homo Sapiens
IDDEAIIAA

SEQ ID NO: 644254 - protein, 9 aa, Homo Sapiens
FQNQLYHVK

SEQ ID NO: 644255 - protein, 9 aa, Homo Sapiens
KFFCFVQNS

SEQ ID NO: 644256 - protein, 9 aa, Homo Sapiens
ERDFLARTY

SEQ ID NO: 644257 - protein, 9 aa, Homo Sapiens
LFSLWPALS

SEQ ID NO: 644258 - protein, 9 aa, Homo Sapiens
SRKNFAKGV

SEQ ID NO: 644259 - protein, 9 aa, Homo Sapiens
VLLDQRVLG

SEQ ID NO: 644260 - protein, 9 aa, Homo Sapiens
GGRDSPCSC

SEQ ID NO: 644261 - protein, 9 aa, Homo Sapiens
TVHTRPHNL

SEQ ID NO: 644262 - protein, 9 aa, Homo Sapiens
TIQQVIDLL

SEQ ID NO: 644263 - protein, 9 aa, Homo Sapiens
TLGGTFLNV

SEQ ID NO: 644264 - protein, 9 aa, Homo Sapiens
NVLFYHTTS

SEQ ID NO: 644265 - protein, 9 aa, Homo Sapiens
ADFHNLMAV

SEQ ID NO: 644266 - protein, 9 aa, Homo Sapiens
QVTTTLKLI

SEQ ID NO: 644267 - protein, 9 aa, Homo Sapiens
KHIQEGVIK

SEQ ID NO: 644268 - protein, 9 aa, Homo Sapiens
ARADELTRH

SEQ ID NO: 644269 - protein, 9 aa, Homo Sapiens
HKRTHTGEI

SEQ ID NO: 644270 - protein, 9 aa, Homo Sapiens
LVAQPGLLV

SEQ ID NO: 644271 - protein, 9 aa, Homo Sapiens
SLRRNRWAV

SEQ ID NO: 644272 - protein, 9 aa, Homo Sapiens
GPSASVVPN

SEQ ID NO: 644273 - protein, 9 aa, Homo Sapiens
DQLPNGLSP

SEQ ID NO: 644274 - protein, 9 aa, Homo Sapiens
ETLGGTFLN

SEQ ID NO: 644275 - protein, 9 aa, Homo Sapiens
SSLLLHPPQ

SEQ ID NO: 644276 - protein, 9 aa, Homo Sapiens
GQFVTLALV

SEQ ID NO: 644277 - protein, 9 aa, Homo Sapiens
GVKTKHIQE

SEQ ID NO: 644278 - protein, 9 aa, Homo Sapiens
SSFGRRKSF

SEQ ID NO: 644279 - protein, 9 aa, Homo Sapiens
LDYFQTSHV

SEQ ID NO: 644280 - protein, 9 aa, Homo Sapiens
REEEEEIDD

SEQ ID NO: 644281 - protein, 9 aa, Homo Sapiens
MRVILDNED

SEQ ID NO: 644282 - protein, 9 aa, Homo Sapiens
SSKASSMLN

SEQ ID NO: 644283 - protein, 9 aa, Homo Sapiens
TAHYVTTRK

SEQ ID NO: 644284 - protein, 9 aa, Homo Sapiens
VQGGGQGGP

SEQ ID NO: 644285 - protein, 9 aa, Homo Sapiens
SLWPALSLQ

SEQ ID NO: 644286 - protein, 9 aa, Homo Sapiens
LYHVKHHGK

SEQ ID NO: 644287 - protein, 9 aa, Homo Sapiens
RITSSYRIP

SEQ ID NO: 644288 - protein, 9 aa, Homo Sapiens
QHHFLATAH

SEQ ID NO: 644289 - protein, 9 aa, Homo Sapiens
LDVALHTPM

SEQ ID NO: 644290 - protein, 9 aa, Homo Sapiens
LHQQGLVPE

SEQ ID NO: 644291 - protein, 9 aa, Homo Sapiens
LSHTVDVYF

SEQ ID NO: 644292 - protein, 9 aa, Homo Sapiens
PAAAGVVGA

SEQ ID NO: 644293 - protein, 9 aa, Homo Sapiens
QEEFHRYSG

SEQ ID NO: 644294 - protein, 9 aa, Homo Sapiens
EDDEEKEEE

SEQ ID NO: 644295 - protein, 9 aa, Homo Sapiens
VLSIRNINQ

SEQ ID NO: 644296 - protein, 9 aa, Homo Sapiens
LVLVSHLER

SEQ ID NO: 644297 - protein, 9 aa, Homo Sapiens
NIFKADFHN

SEQ ID NO: 644298 - protein, 9 aa, Homo Sapiens
KIDMKGCIN

SEQ ID NO: 644299 - protein, 9 aa, Homo Sapiens
FSLLHDNEA

SEQ ID NO: 644300 - protein, 9 aa, Homo Sapiens
TFLEYITSL

SEQ ID NO: 644301 - protein, 9 aa, Homo Sapiens
SLTIQQVID

SEQ ID NO: 644302 - protein, 9 aa, Homo Sapiens
PISFSKGFP

SEQ ID NO: 644303 - protein, 9 aa, Homo Sapiens
LGAAADGAE

SEQ ID NO: 644304 - protein, 9 aa, Homo Sapiens
SAPRLLRPP

SEQ ID NO: 644305 - protein, 9 aa, Homo Sapiens
RDLRRKFFC

SEQ ID NO: 644306 - protein, 9 aa, Homo Sapiens
GRDSPCSCS

SEQ ID NO: 644307 - protein, 9 aa, Homo Sapiens
GRPPDLPAR

SEQ ID NO: 644308 - protein, 9 aa, Homo Sapiens
LILGTRRFN

SEQ ID NO: 644309 - protein, 9 aa, Homo Sapiens
QHQPQQQEQ

SEQ ID NO: 644310 - protein, 9 aa, Homo Sapiens
EFHRYSGYW

SEQ ID NO: 644311 - protein, 9 aa, Homo Sapiens
GRLGAPVGL

SEQ ID NO: 644312 - protein, 9 aa, Homo Sapiens
EISVASIYD

SEQ ID NO: 644313 - protein, 9 aa, Homo Sapiens
QLSHEDPAA

SEQ ID NO: 644314 - protein, 9 aa, Homo Sapiens
HKAVEDGIK

SEQ ID NO: 644315 - protein, 9 aa, Homo Sapiens
LFGVLKYHN

SEQ ID NO: 644316 - protein, 9 aa, Homo Sapiens
NQLYHVKHH

SEQ ID NO: 644317 - protein, 9 aa, Homo Sapiens
QARRQTSRG

SEQ ID NO: 644318 - protein, 9 aa, Homo Sapiens
KDQDRLLQD

SEQ ID NO: 644319 - protein, 9 aa, Homo Sapiens
RPPQLLLCR

SEQ ID NO: 644320 - protein, 9 aa, Homo Sapiens
LCRALCEDL

SEQ ID NO: 644321 - protein, 9 aa, Homo Sapiens
DKLTPPCPP

SEQ ID NO: 644322 - protein, 9 aa, Homo Sapiens
NFAKGVPAV

SEQ ID NO: 644323 - protein, 9 aa, Homo Sapiens
CEDIIQCCR

SEQ ID NO: 644324 - protein, 9 aa, Homo Sapiens
MLKAKNLPQ

SEQ ID NO: 644325 - protein, 9 aa, Homo Sapiens
ERARRSKCS

SEQ ID NO: 644326 - protein, 9 aa, Homo Sapiens
IVYGVKTKH

SEQ ID NO: 644327 - protein, 9 aa, Homo Sapiens
VPLSAPPCT

SEQ ID NO: 644328 - protein, 9 aa, Homo Sapiens
DNEAWSSSG

SEQ ID NO: 644329 - protein, 9 aa, Homo Sapiens
SKCSGPKRA

SEQ ID NO: 644330 - protein, 9 aa, Homo Sapiens
NQEERLKLK

SEQ ID NO: 644331 - protein, 9 aa, Homo Sapiens
RLQSHADQD

SEQ ID NO: 644332 - protein, 9 aa, Homo Sapiens
TPSPSLALP

SEQ ID NO: 644333 - protein, 9 aa, Homo Sapiens
ITMLGNVRM

SEQ ID NO: 644334 - protein, 9 aa, Homo Sapiens
HVIWRLFSG

SEQ ID NO: 644335 - protein, 9 aa, Homo Sapiens
IREGAVVKK

SEQ ID NO: 644336 - protein, 9 aa, Homo Sapiens
EGATSQTLA

SEQ ID NO: 644337 - protein, 9 aa, Homo Sapiens
HKSFHGCLE

SEQ ID NO: 644338 - protein, 9 aa, Homo Sapiens
GAPAGVEKS

SEQ ID NO: 644339 - protein, 9 aa, Homo Sapiens
VTTTLKLIL

SEQ ID NO: 644340 - protein, 9 aa, Homo Sapiens
VEVIKPIML

SEQ ID NO: 644341 - protein, 9 aa, Homo Sapiens
KTQQLAKTI

SEQ ID NO: 644342 - protein, 9 aa, Homo Sapiens
LFYHTTSVL

SEQ ID NO: 644343 - protein, 9 aa, Homo Sapiens
VFHGQREMQ

SEQ ID NO: 644344 - protein, 9 aa, Homo Sapiens
IRNINQEER

SEQ ID NO: 644345 - protein, 9 aa, Homo Sapiens
WGCCGSSSG

SEQ ID NO: 644346 - protein, 9 aa, Homo Sapiens
FYHTTSVLL

SEQ ID NO: 644347 - protein, 9 aa, Homo Sapiens
RRGLGSILI

SEQ ID NO: 644348 - protein, 9 aa, Homo Sapiens
QEVRGLSFL

SEQ ID NO: 644349 - protein, 9 aa, Homo Sapiens
CGWKFARAD

SEQ ID NO: 644350 - protein, 9 aa, Homo Sapiens
LRRGLGSIL

SEQ ID NO: 644351 - protein, 9 aa, Homo Sapiens
PFSAAAAAA

SEQ ID NO: 644352 - protein, 9 aa, Homo Sapiens
GGGGSSLLL

SEQ ID NO: 644353 - protein, 9 aa, Homo Sapiens
IKEGCRSYC

SEQ ID NO: 644354 - protein, 9 aa, Homo Sapiens
TILKIPSSF

SEQ ID NO: 644355 - protein, 9 aa, Homo Sapiens
VHCTSYRVV

SEQ ID NO: 644356 - protein, 9 aa, Homo Sapiens
LKIPSSFGR

SEQ ID NO: 644357 - protein, 9 aa, Homo Sapiens
ADTNRNWNA

SEQ ID NO: 644358 - protein, 9 aa, Homo Sapiens
SGFGGYGHR

SEQ ID NO: 644359 - protein, 9 aa, Homo Sapiens
MDRMKIQNA

SEQ ID NO: 644360 - protein, 9 aa, Homo Sapiens
NNTFVCNGL

SEQ ID NO: 644361 - protein, 9 aa, Homo Sapiens
LGSTNLSHT

SEQ ID NO: 644362 - protein, 9 aa, Homo Sapiens
GGRLHLRYV

SEQ ID NO: 644363 - protein, 9 aa, Homo Sapiens
LQVTTTLKL

SEQ ID NO: 644364 - protein, 9 aa, Homo Sapiens
GPAAAGVVG

SEQ ID NO: 644365 - protein, 9 aa, Homo Sapiens
VVKKMYFIQ

SEQ ID NO: 644366 - protein, 9 aa, Homo Sapiens
ITSSYRIPS

SEQ ID NO: 644367 - protein, 9 aa, Homo Sapiens
GEISVASIY

SEQ ID NO: 644368 - protein, 9 aa, Homo Sapiens
GGYKFEKDF

SEQ ID NO: 644369 - protein, 9 aa, Homo Sapiens
LEDLQDEID

SEQ ID NO: 644370 - protein, 9 aa, Homo Sapiens
QVLVAQPGL

SEQ ID NO: 644371 - protein, 9 aa, Homo Sapiens
VNFLCQTEA

SEQ ID NO: 644372 - protein, 9 aa, Homo Sapiens
AFLLALPLC

SEQ ID NO: 644373 - protein, 9 aa, Homo Sapiens
SKDHIYPMK

SEQ ID NO: 644374 - protein, 9 aa, Homo Sapiens
PPQLLLCRF

SEQ ID NO: 644375 - protein, 9 aa, Homo Sapiens
ASIYDQEEL

SEQ ID NO: 644376 - protein, 9 aa, Homo Sapiens
KEKHKKIQP

SEQ ID NO: 644377 - protein, 9 aa, Homo Sapiens
SEHVIWRLF

SEQ ID NO: 644378 - protein, 9 aa, Homo Sapiens
HQPQQQEQE

SEQ ID NO: 644379 - protein, 9 aa, Homo Sapiens
QDRLLQDVD

SEQ ID NO: 644380 - protein, 9 aa, Homo Sapiens
KALTYLRQK

SEQ ID NO: 644381 - protein, 9 aa, Homo Sapiens
IDYRYKTIQ

SEQ ID NO: 644382 - protein, 9 aa, Homo Sapiens
PQCEDIIQC

SEQ ID NO: 644383 - protein, 9 aa, Homo Sapiens
LFVKKEMQL

SEQ ID NO: 644384 - protein, 9 aa, Homo Sapiens
LTFLEYITS

SEQ ID NO: 644385 - protein, 9 aa, Homo Sapiens
RARRSKCSG

SEQ ID NO: 644386 - protein, 9 aa, Homo Sapiens
TPSKKKLKL

SEQ ID NO: 644387 - protein, 9 aa, Homo Sapiens
EQEGGQHHS

SEQ ID NO: 644388 - protein, 9 aa, Homo Sapiens
VQKRNIFKA

SEQ ID NO: 644389 - protein, 9 aa, Homo Sapiens
IILKESLNL

SEQ ID NO: 644390 - protein, 9 aa, Homo Sapiens
RADELTRHY

SEQ ID NO: 644391 - protein, 9 aa, Homo Sapiens
SSMLNWGRA

SEQ ID NO: 644392 - protein, 9 aa, Homo Sapiens
ASVVPNAWS

SEQ ID NO: 644393 - protein, 9 aa, Homo Sapiens
DDSFSSSWD

SEQ ID NO: 644394 - protein, 9 aa, Homo Sapiens
TEFVLLVFH

SEQ ID NO: 644395 - protein, 9 aa, Homo Sapiens
EGPIGFRGP

SEQ ID NO: 644396 - protein, 9 aa, Homo Sapiens
GSGFGGYGH

SEQ ID NO: 644397 - protein, 9 aa, Homo Sapiens
LSGGGASAR

SEQ ID NO: 644398 - protein, 9 aa, Homo Sapiens
PDLPARATA

SEQ ID NO: 644399 - protein, 9 aa, Homo Sapiens
AAGVVGALG

SEQ ID NO: 644400 - protein, 9 aa, Homo Sapiens
SLVVWSIRE

SEQ ID NO: 644401 - protein, 9 aa, Homo Sapiens
HQLSHEDPA

SEQ ID NO: 644402 - protein, 9 aa, Homo Sapiens
VKRKSTVWR

SEQ ID NO: 644403 - protein, 9 aa, Homo Sapiens
HKALSQFFD

SEQ ID NO: 644404 - protein, 9 aa, Homo Sapiens
FFQNQLYHV

SEQ ID NO: 644405 - protein, 9 aa, Homo Sapiens
LQRRMQTLW

SEQ ID NO: 644406 - protein, 9 aa, Homo Sapiens
NGYPFPHHE

SEQ ID NO: 644407 - protein, 9 aa, Homo Sapiens
LDQRVLGPA

SEQ ID NO: 644408 - protein, 9 aa, Homo Sapiens
TPDDPRMRE

SEQ ID NO: 644409 - protein, 9 aa, Homo Sapiens
AELILPLGF

SEQ ID NO: 644410 - protein, 9 aa, Homo Sapiens
DQAQLTLLL

SEQ ID NO: 644411 - protein, 9 aa, Homo Sapiens
VVSPAGFHV

SEQ ID NO: 644412 - protein, 9 aa, Homo Sapiens
EGPLGAADG

SEQ ID NO: 644413 - protein, 9 aa, Homo Sapiens
RKSTVWRIG

SEQ ID NO: 644414 - protein, 9 aa, Homo Sapiens
DSSKASSML

SEQ ID NO: 644415 - protein, 9 aa, Homo Sapiens
APAGVEKSG

SEQ ID NO: 644416 - protein, 9 aa, Homo Sapiens
LLKCMTWER

SEQ ID NO: 644417 - protein, 9 aa, Homo Sapiens
SYFKVNNRR

SEQ ID NO: 644418 - protein, 9 aa, Homo Sapiens
FGRYRERDF

SEQ ID NO: 644419 - protein, 9 aa, Homo Sapiens
GFEYYPMAP

SEQ ID NO: 644420 - protein, 9 aa, Homo Sapiens
KHRLQLDIN

SEQ ID NO: 644421 - protein, 9 aa, Homo Sapiens
LAVEAFLLA

SEQ ID NO: 644422 - protein, 9 aa, Homo Sapiens
CQLQRRMQT

SEQ ID NO: 644423 - protein, 9 aa, Homo Sapiens
DQDRLLQDV

SEQ ID NO: 644424 - protein, 9 aa, Homo Sapiens
NDKKHRLQL

SEQ ID NO: 644425 - protein, 9 aa, Homo Sapiens
PEVVSPAGF

SEQ ID NO: 644426 - protein, 9 aa, Homo Sapiens
EVRGLSFLL

SEQ ID NO: 644427 - protein, 9 aa, Homo Sapiens
EIDDEAIIA

SEQ ID NO: 644428 - protein, 9 aa, Homo Sapiens
PLAVEAFLL

SEQ ID NO: 644429 - protein, 9 aa, Homo Sapiens
GYKFEKDFR

SEQ ID NO: 644430 - protein, 9 aa, Homo Sapiens
NFLCQTEAQ

SEQ ID NO: 644431 - protein, 9 aa, Homo Sapiens
LATAHYVTT

SEQ ID NO: 644432 - protein, 9 aa, Homo Sapiens
AHYVTTRKG

SEQ ID NO: 644433 - protein, 9 aa, Homo Sapiens
ASDAAWVLS

SEQ ID NO: 644434 - protein, 9 aa, Homo Sapiens
ASDLFPAEM

SEQ ID NO: 644435 - protein, 9 aa, Homo Sapiens
KFEDDDPLP

SEQ ID NO: 644436 - protein, 9 aa, Homo Sapiens
ITCRLYGED

SEQ ID NO: 644437 - protein, 9 aa, Homo Sapiens
WERGLERDE

SEQ ID NO: 644438 - protein, 9 aa, Homo Sapiens
NWTCLLSLL

SEQ ID NO: 644439 - protein, 9 aa, Homo Sapiens
MIQNGILIE

SEQ ID NO: 644440 - protein, 9 aa, Homo Sapiens
IDTWVYEGT

SEQ ID NO: 644441 - protein, 9 aa, Homo Sapiens
TRASHTKAN

SEQ ID NO: 644442 - protein, 9 aa, Homo Sapiens
SEAPMEGFQ

SEQ ID NO: 644443 - protein, 9 aa, Homo Sapiens
IKLSFFKVP

SEQ ID NO: 644444 - protein, 9 aa, Homo Sapiens
MKDNFWEMD

SEQ ID NO: 644445 - protein, 9 aa, Homo Sapiens
YTAGADTGD

SEQ ID NO: 644446 - protein, 9 aa, Homo Sapiens
CVFHALLGI

SEQ ID NO: 644447 - protein, 9 aa, Homo Sapiens
NTNVADFII

SEQ ID NO: 644448 - protein, 9 aa, Homo Sapiens
FWRKEEKEL

SEQ ID NO: 644449 - protein, 9 aa, Homo Sapiens
LGKYMDIEF

SEQ ID NO: 644450 - protein, 9 aa, Homo Sapiens
AAAASSPTR

SEQ ID NO: 644451 - protein, 9 aa, Homo Sapiens
HPGDKYPET

SEQ ID NO: 644452 - protein, 9 aa, Homo Sapiens
QSQKWTFVA

SEQ ID NO: 644453 - protein, 9 aa, Homo Sapiens
LMRVIFGPN

SEQ ID NO: 644454 - protein, 9 aa, Homo Sapiens
EAVAGIIGR

SEQ ID NO: 644455 - protein, 9 aa, Homo Sapiens
RTGWPSPAG

SEQ ID NO: 644456 - protein, 9 aa, Homo Sapiens
KYRPELIDM

SEQ ID NO: 644457 - protein, 9 aa, Homo Sapiens
IKSRMMKEF

SEQ ID NO: 644458 - protein, 9 aa, Homo Sapiens
VNYHPAKYT

SEQ ID NO: 644459 - protein, 9 aa, Homo Sapiens
QNGILIESG

SEQ ID NO: 644460 - protein, 9 aa, Homo Sapiens
IIYKVRIEH

SEQ ID NO: 644461 - protein, 9 aa, Homo Sapiens
WAMMKTNRG

SEQ ID NO: 644462 - protein, 9 aa, Homo Sapiens
LVKEDVPFP

SEQ ID NO: 644463 - protein, 9 aa, Homo Sapiens
APQDQTNQM

SEQ ID NO: 644464 - protein, 9 aa, Homo Sapiens
LKPERYYVG

SEQ ID NO: 644465 - protein, 9 aa, Homo Sapiens
RWDPQSQKW

SEQ ID NO: 644466 - protein, 9 aa, Homo Sapiens
CKAVWPFLL

SEQ ID NO: 644467 - protein, 9 aa, Homo Sapiens
KLTMHIEQA

SEQ ID NO: 644468 - protein, 9 aa, Homo Sapiens
KVSSVLNTS

SEQ ID NO: 644469 - protein, 9 aa, Homo Sapiens
VVTLMCNIS

SEQ ID NO: 644470 - protein, 9 aa, Homo Sapiens
MLDLAWERS

SEQ ID NO: 644471 - protein, 9 aa, Homo Sapiens
LEGFSWRLP

SEQ ID NO: 644472 - protein, 9 aa, Homo Sapiens
VYMLLDPVR

SEQ ID NO: 644473 - protein, 9 aa, Homo Sapiens
RSMQMPCRR

SEQ ID NO: 644474 - protein, 9 aa, Homo Sapiens
DVLVYLAED

SEQ ID NO: 644475 - protein, 9 aa, Homo Sapiens
YLLRVVIQS

SEQ ID NO: 644476 - protein, 9 aa, Homo Sapiens
TGLSATAIT

SEQ ID NO: 644477 - protein, 9 aa, Homo Sapiens
ISDDDTKDH

SEQ ID NO: 644478 - protein, 9 aa, Homo Sapiens
RGAFRSARP

SEQ ID NO: 644479 - protein, 9 aa, Homo Sapiens
AMVTLACID

SEQ ID NO: 644480 - protein, 9 aa, Homo Sapiens
DTPQRSYRD

SEQ ID NO: 644481 - protein, 9 aa, Homo Sapiens
LDTPQRSYR

SEQ ID NO: 644482 - protein, 9 aa, Homo Sapiens
MCNISIIVL

SEQ ID NO: 644483 - protein, 9 aa, Homo Sapiens
PQSQKWTFV

SEQ ID NO: 644484 - protein, 9 aa, Homo Sapiens
KSISFTRCG

SEQ ID NO: 644485 - protein, 9 aa, Homo Sapiens
ALITQAVQT

SEQ ID NO: 644486 - protein, 9 aa, Homo Sapiens
RLSTLEHAH

SEQ ID NO: 644487 - protein, 9 aa, Homo Sapiens
KISCDKDLH

SEQ ID NO: 644488 - protein, 9 aa, Homo Sapiens
DIKLSFFKV

SEQ ID NO: 644489 - protein, 9 aa, Homo Sapiens
AIDFTEEEW

SEQ ID NO: 644490 - protein, 9 aa, Homo Sapiens
GRLAIRLVR

SEQ ID NO: 644491 - protein, 9 aa, Homo Sapiens
AKAKKQQIQ

SEQ ID NO: 644492 - protein, 9 aa, Homo Sapiens
LNFAFLDIL

SEQ ID NO: 644493 - protein, 9 aa, Homo Sapiens
LSGSIAMHL

SEQ ID NO: 644494 - protein, 9 aa, Homo Sapiens
AIRLVRCPP

SEQ ID NO: 644495 - protein, 9 aa, Homo Sapiens
VGLWAMMKT

SEQ ID NO: 644496 - protein, 9 aa, Homo Sapiens
PAAPASPPF

SEQ ID NO: 644497 - protein, 9 aa, Homo Sapiens
FAHITCRLY

SEQ ID NO: 644498 - protein, 9 aa, Homo Sapiens
AEGGGGGGG

SEQ ID NO: 644499 - protein, 9 aa, Homo Sapiens
YVTVFGLSN

SEQ ID NO: 644500 - protein, 9 aa, Homo Sapiens
NAERLLDDN

SEQ ID NO: 644501 - protein, 9 aa, Homo Sapiens
SGSIAMHLS

SEQ ID NO: 644502 - protein, 9 aa, Homo Sapiens
GASTLLLSF

SEQ ID NO: 644503 - protein, 9 aa, Homo Sapiens
ECVKAFLQK

SEQ ID NO: 644504 - protein, 9 aa, Homo Sapiens
KLSSMDVTN

SEQ ID NO: 644505 - protein, 9 aa, Homo Sapiens
TMKRHLIEG

SEQ ID NO: 644506 - protein, 9 aa, Homo Sapiens
PNFQQDDAG

SEQ ID NO: 644507 - protein, 9 aa, Homo Sapiens
RYYSAVLGT

SEQ ID NO: 644508 - protein, 9 aa, Homo Sapiens
FRTVYLKMA

SEQ ID NO: 644509 - protein, 9 aa, Homo Sapiens
CNWKCTGLS

SEQ ID NO: 644510 - protein, 9 aa, Homo Sapiens
QFPPILVVM

SEQ ID NO: 644511 - protein, 9 aa, Homo Sapiens
STMKTLTSK

SEQ ID NO: 644512 - protein, 9 aa, Homo Sapiens
AAIMNNDSN

SEQ ID NO: 644513 - protein, 9 aa, Homo Sapiens
ADTTSVGFC

SEQ ID NO: 644514 - protein, 9 aa, Homo Sapiens
QGHQENTAT

SEQ ID NO: 644515 - protein, 9 aa, Homo Sapiens
QFCVSFFVE

SEQ ID NO: 644516 - protein, 9 aa, Homo Sapiens
LTWELENTA

SEQ ID NO: 644517 - protein, 9 aa, Homo Sapiens
HSVPGSTET

SEQ ID NO: 644518 - protein, 9 aa, Homo Sapiens
INPLSTLQS

SEQ ID NO: 644519 - protein, 9 aa, Homo Sapiens
KAAARSAAL

SEQ ID NO: 644520 - protein, 9 aa, Homo Sapiens
MMKTNRGTI

SEQ ID NO: 644521 - protein, 9 aa, Homo Sapiens
AELVLRLLR

SEQ ID NO: 644522 - protein, 9 aa, Homo Sapiens
ADGAVSSSL

SEQ ID NO: 644523 - protein, 9 aa, Homo Sapiens
IIAHRLSTL

SEQ ID NO: 644524 - protein, 9 aa, Homo Sapiens
IGLDYLLRV

SEQ ID NO: 644525 - protein, 9 aa, Homo Sapiens
KMQICIGRG

SEQ ID NO: 644526 - protein, 9 aa, Homo Sapiens
NATPKLLLE

SEQ ID NO: 644527 - protein, 9 aa, Homo Sapiens
KQGHQENTA

SEQ ID NO: 644528 - protein, 9 aa, Homo Sapiens
VPSTSKSKG

SEQ ID NO: 644529 - protein, 9 aa, Homo Sapiens
GGSTDTDKH

SEQ ID NO: 644530 - protein, 9 aa, Homo Sapiens
FEDAANILK

SEQ ID NO: 644531 - protein, 9 aa, Homo Sapiens
KTQVLVWIS

SEQ ID NO: 644532 - protein, 9 aa, Homo Sapiens
PRLEDPQSF

SEQ ID NO: 644533 - protein, 9 aa, Homo Sapiens
HTEAVAGII

SEQ ID NO: 644534 - protein, 9 aa, Homo Sapiens
EGGGGGGGS

SEQ ID NO: 644535 - protein, 9 aa, Homo Sapiens
QAARTGDVP

SEQ ID NO: 644536 - protein, 9 aa, Homo Sapiens
FNEISTILI

SEQ ID NO: 644537 - protein, 9 aa, Homo Sapiens
ILVVQVLGM

SEQ ID NO: 644538 - protein, 9 aa, Homo Sapiens
IEGQRVIQI

SEQ ID NO: 644539 - protein, 9 aa, Homo Sapiens
PTPTPPLGY

SEQ ID NO: 644540 - protein, 9 aa, Homo Sapiens
ARQQRKQME

SEQ ID NO: 644541 - protein, 9 aa, Homo Sapiens
CVKAFLQKA

SEQ ID NO: 644542 - protein, 9 aa, Homo Sapiens
AGHHRNASD

SEQ ID NO: 644543 - protein, 9 aa, Homo Sapiens
SLIMFRTVY

SEQ ID NO: 644544 - protein, 9 aa, Homo Sapiens
TFGKDMSKL

SEQ ID NO: 644545 - protein, 9 aa, Homo Sapiens
KKPQAKQGH

SEQ ID NO: 644546 - protein, 9 aa, Homo Sapiens
SKWIPYMAD

SEQ ID NO: 644547 - protein, 9 aa, Homo Sapiens
GKIRDSNCS

SEQ ID NO: 644548 - protein, 9 aa, Homo Sapiens
KAHLTKHQN

SEQ ID NO: 644549 - protein, 9 aa, Homo Sapiens
GRAQSVPTP

SEQ ID NO: 644550 - protein, 9 aa, Homo Sapiens
LQQLPSSIK

SEQ ID NO: 644551 - protein, 9 aa, Homo Sapiens
PADTTSVGF

SEQ ID NO: 644552 - protein, 9 aa, Homo Sapiens
RHRVIQPTL

SEQ ID NO: 644553 - protein, 9 aa, Homo Sapiens
PGKIRDSNC

SEQ ID NO: 644554 - protein, 9 aa, Homo Sapiens
VFTSSTISV

SEQ ID NO: 644555 - protein, 9 aa, Homo Sapiens
FDIYTAGAD

SEQ ID NO: 644556 - protein, 9 aa, Homo Sapiens
PLDLSVPKQ

SEQ ID NO: 644557 - protein, 9 aa, Homo Sapiens
PTPPAPVLL

SEQ ID NO: 644558 - protein, 9 aa, Homo Sapiens
YRLNSHYGN

SEQ ID NO: 644559 - protein, 9 aa, Homo Sapiens
RCPPVCSDA

SEQ ID NO: 644560 - protein, 9 aa, Homo Sapiens
SENGQDYFD

SEQ ID NO: 644561 - protein, 9 aa, Homo Sapiens
EVKESKEED

SEQ ID NO: 644562 - protein, 9 aa, Homo Sapiens
PRPIHPAGR

SEQ ID NO: 644563 - protein, 9 aa, Homo Sapiens
LAYPCVATV

SEQ ID NO: 644564 - protein, 9 aa, Homo Sapiens
KCESNTSTQ

SEQ ID NO: 644565 - protein, 9 aa, Homo Sapiens
APERNVEIQ

SEQ ID NO: 644566 - protein, 9 aa, Homo Sapiens
NSFFQVFQT

SEQ ID NO: 644567 - protein, 9 aa, Homo Sapiens
IVIIRYISR

SEQ ID NO: 644568 - protein, 9 aa, Homo Sapiens
DYHKDIHTY

SEQ ID NO: 644569 - protein, 9 aa, Homo Sapiens
INKRLYLRT

SEQ ID NO: 644570 - protein, 9 aa, Homo Sapiens
LRVVIQSND

SEQ ID NO: 644571 - protein, 9 aa, Homo Sapiens
LLVYYITRR

SEQ ID NO: 644572 - protein, 9 aa, Homo Sapiens
RMMKEFRKL

SEQ ID NO: 644573 - protein, 9 aa, Homo Sapiens
NVADFIIMG

SEQ ID NO: 644574 - protein, 9 aa, Homo Sapiens
LMCNISIIV

SEQ ID NO: 644575 - protein, 9 aa, Homo Sapiens
EFDDKFEDD

SEQ ID NO: 644576 - protein, 9 aa, Homo Sapiens
DGGENSPCM

SEQ ID NO: 644577 - protein, 9 aa, Homo Sapiens
PVRKWGGFL

SEQ ID NO: 644578 - protein, 9 aa, Homo Sapiens
FKLRLAKWR

SEQ ID NO: 644579 - protein, 9 aa, Homo Sapiens
QASDLFPAE

SEQ ID NO: 644580 - protein, 9 aa, Homo Sapiens
KDEQVPILV

SEQ ID NO: 644581 - protein, 9 aa, Homo Sapiens
RAELVLRLL

SEQ ID NO: 644582 - protein, 9 aa, Homo Sapiens
SEGKSTTKT

SEQ ID NO: 644583 - protein, 9 aa, Homo Sapiens
LIEGLKFRQ

SEQ ID NO: 644584 - protein, 9 aa, Homo Sapiens
NVEIQPSSP

SEQ ID NO: 644585 - protein, 9 aa, Homo Sapiens
KEDIWPSGG

SEQ ID NO: 644586 - protein, 9 aa, Homo Sapiens
KGIPQMAPP

SEQ ID NO: 644587 - protein, 9 aa, Homo Sapiens
LNKRIRTVL

SEQ ID NO: 644588 - protein, 9 aa, Homo Sapiens
FPAEVKDLN

SEQ ID NO: 644589 - protein, 9 aa, Homo Sapiens
MQMPCRRSS

SEQ ID NO: 644590 - protein, 9 aa, Homo Sapiens
SRSMPGLPW

SEQ ID NO: 644591 - protein, 9 aa, Homo Sapiens
EKEKLKKWR

SEQ ID NO: 644592 - protein, 9 aa, Homo Sapiens
NILSAQTHE

SEQ ID NO: 644593 - protein, 9 aa, Homo Sapiens
DQTNQMPTS

SEQ ID NO: 644594 - protein, 9 aa, Homo Sapiens
APSLPGQYP

SEQ ID NO: 644595 - protein, 9 aa, Homo Sapiens
QQFIFQQSE

SEQ ID NO: 644596 - protein, 9 aa, Homo Sapiens
QQRGLSCDV

SEQ ID NO: 644597 - protein, 9 aa, Homo Sapiens
GAFRSARPL

SEQ ID NO: 644598 - protein, 9 aa, Homo Sapiens
PFIPSGPSP

SEQ ID NO: 644599 - protein, 9 aa, Homo Sapiens
TSPGHHVYM

SEQ ID NO: 644600 - protein, 9 aa, Homo Sapiens
RLGQDIKLS

SEQ ID NO: 644601 - protein, 9 aa, Homo Sapiens
STLLLSFLG

SEQ ID NO: 644602 - protein, 9 aa, Homo Sapiens
HRVIQPTLE

SEQ ID NO: 644603 - protein, 9 aa, Homo Sapiens
LHWNPGRKL

SEQ ID NO: 644604 - protein, 9 aa, Homo Sapiens
WFQIDEARG

SEQ ID NO: 644605 - protein, 9 aa, Homo Sapiens
TGTRASHTK

SEQ ID NO: 644606 - protein, 9 aa, Homo Sapiens
FLMRVIFGP

SEQ ID NO: 644607 - protein, 9 aa, Homo Sapiens
WAVNYHPAK

SEQ ID NO: 644608 - protein, 9 aa, Homo Sapiens
TILIILTSY

SEQ ID NO: 644609 - protein, 9 aa, Homo Sapiens
SDDDLRVIV

SEQ ID NO: 644610 - protein, 9 aa, Homo Sapiens
ILTGMPCHL

SEQ ID NO: 644611 - protein, 9 aa, Homo Sapiens
KHRIEQDML

SEQ ID NO: 644612 - protein, 9 aa, Homo Sapiens
PAGRQPTKP

SEQ ID NO: 644613 - protein, 9 aa, Homo Sapiens
QTRTQEGSF

SEQ ID NO: 644614 - protein, 9 aa, Homo Sapiens
IFSACLVKE

SEQ ID NO: 644615 - protein, 9 aa, Homo Sapiens
LIEVKESKE

SEQ ID NO: 644616 - protein, 9 aa, Homo Sapiens
SSPAIPPFL

SEQ ID NO: 644617 - protein, 9 aa, Homo Sapiens
EDEPQQKEI

SEQ ID NO: 644618 - protein, 9 aa, Homo Sapiens
LAELDEFLQ

SEQ ID NO: 644619 - protein, 9 aa, Homo Sapiens
GWEYCAIKT

SEQ ID NO: 644620 - protein, 9 aa, Homo Sapiens
EDTVVPLAV

SEQ ID NO: 644621 - protein, 9 aa, Homo Sapiens
DLAWERSFV

SEQ ID NO: 644622 - protein, 9 aa, Homo Sapiens
ERLLDDNDS

SEQ ID NO: 644623 - protein, 9 aa, Homo Sapiens
PPLNFAFLD

SEQ ID NO: 644624 - protein, 9 aa, Homo Sapiens
LLERAELVL

SEQ ID NO: 644625 - protein, 9 aa, Homo Sapiens
GQAARTGDV

SEQ ID NO: 644626 - protein, 9 aa, Homo Sapiens
QIPVRKWGG

SEQ ID NO: 644627 - protein, 9 aa, Homo Sapiens
FWDDWQSID

SEQ ID NO: 644628 - protein, 9 aa, Homo Sapiens
LQVMSRNSG

SEQ ID NO: 644629 - protein, 9 aa, Homo Sapiens
SPNAFSENG

SEQ ID NO: 644630 - protein, 9 aa, Homo Sapiens
LTTRKTSLK

SEQ ID NO: 644631 - protein, 9 aa, Homo Sapiens
SISFTRCGI

SEQ ID NO: 644632 - protein, 9 aa, Homo Sapiens
DASPPGRAQ

SEQ ID NO: 644633 - protein, 9 aa, Homo Sapiens
GIIDNDGGL

SEQ ID NO: 644634 - protein, 9 aa, Homo Sapiens
ILRPGFHYR

SEQ ID NO: 644635 - protein, 9 aa, Homo Sapiens
QGSDPRPIS

SEQ ID NO: 644636 - protein, 9 aa, Homo Sapiens
SFVSQYECD

SEQ ID NO: 644637 - protein, 9 aa, Homo Sapiens
HLSVPFPTI

SEQ ID NO: 644638 - protein, 9 aa, Homo Sapiens
IFGPNKVEF

SEQ ID NO: 644639 - protein, 9 aa, Homo Sapiens
LIFSACLVK

SEQ ID NO: 644640 - protein, 9 aa, Homo Sapiens
PKFRSQNQS

SEQ ID NO: 644641 - protein, 9 aa, Homo Sapiens
DWQSIDTYG

SEQ ID NO: 644642 - protein, 9 aa, Homo Sapiens
GESHPPLNF

SEQ ID NO: 644643 - protein, 9 aa, Homo Sapiens
SPYCYTRDP

SEQ ID NO: 644644 - protein, 9 aa, Homo Sapiens
TRGPRLCLR

SEQ ID NO: 644645 - protein, 9 aa, Homo Sapiens
KGDIVARDV

SEQ ID NO: 644646 - protein, 9 aa, Homo Sapiens
QQDDAGLYE

SEQ ID NO: 644647 - protein, 9 aa, Homo Sapiens
ETSLYEIFM

SEQ ID NO: 644648 - protein, 9 aa, Homo Sapiens
RYSSMCITA

SEQ ID NO: 644649 - protein, 9 aa, Homo Sapiens
HALLGIPLN

SEQ ID NO: 644650 - protein, 9 aa, Homo Sapiens
LLDDNDSEN

SEQ ID NO: 644651 - protein, 9 aa, Homo Sapiens
HLIEGLKFR

SEQ ID NO: 644652 - protein, 9 aa, Homo Sapiens
QIDEARGHH

SEQ ID NO: 644653 - protein, 9 aa, Homo Sapiens
LTKNKKLTY

SEQ ID NO: 644654 - protein, 9 aa, Homo Sapiens
PCLTRVVAQ

SEQ ID NO: 644655 - protein, 9 aa, Homo Sapiens
PHLSSRPEE

SEQ ID NO: 644656 - protein, 9 aa, Homo Sapiens
HPAGRQPTK

SEQ ID NO: 644657 - protein, 9 aa, Homo Sapiens
AVLAYPCVA

SEQ ID NO: 644658 - protein, 9 aa, Homo Sapiens
EVLRAGHHR

SEQ ID NO: 644659 - protein, 9 aa, Homo Sapiens
GLTWELENT

SEQ ID NO: 644660 - protein, 9 aa, Homo Sapiens
PFNGIFNGL

SEQ ID NO: 644661 - protein, 9 aa, Homo Sapiens
HVYMLLDPV

SEQ ID NO: 644662 - protein, 9 aa, Homo Sapiens
VLINNASSG

SEQ ID NO: 644663 - protein, 9 aa, Homo Sapiens
CIDTWVYEG

SEQ ID NO: 644664 - protein, 9 aa, Homo Sapiens
PDYHKDIHT

SEQ ID NO: 644665 - protein, 9 aa, Homo Sapiens
LCSQILLIY

SEQ ID NO: 644666 - protein, 9 aa, Homo Sapiens
GILIESGII

SEQ ID NO: 644667 - protein, 9 aa, Homo Sapiens
TTGTRASHT

SEQ ID NO: 644668 - protein, 9 aa, Homo Sapiens
FALVQLKVI

SEQ ID NO: 644669 - protein, 9 aa, Homo Sapiens
KFRSQNQSY

SEQ ID NO: 644670 - protein, 9 aa, Homo Sapiens
SQKWTFVAS

SEQ ID NO: 644671 - protein, 9 aa, Homo Sapiens
FTTSPLILQ

SEQ ID NO: 644672 - protein, 9 aa, Homo Sapiens
NEISTILII

SEQ ID NO: 644673 - protein, 9 aa, Homo Sapiens
SCRGAFRSA

SEQ ID NO: 644674 - protein, 9 aa, Homo Sapiens
YEHFSAFGN

SEQ ID NO: 644675 - protein, 9 aa, Homo Sapiens
DIEGQRVIQ

SEQ ID NO: 644676 - protein, 9 aa, Homo Sapiens
FSARWPVAG

SEQ ID NO: 644677 - protein, 9 aa, Homo Sapiens
CDKDLHAVG

SEQ ID NO: 644678 - protein, 9 aa, Homo Sapiens
VVAQLRAEN

SEQ ID NO: 644679 - protein, 9 aa, Homo Sapiens
VPGTRRSPA

SEQ ID NO: 644680 - protein, 9 aa, Homo Sapiens
CKECVKAFL

SEQ ID NO: 644681 - protein, 9 aa, Homo Sapiens
NNNDPNYLC

SEQ ID NO: 644682 - protein, 9 aa, Homo Sapiens
ETYLQVMSR

SEQ ID NO: 644683 - protein, 9 aa, Homo Sapiens
SRMMKEFRK

SEQ ID NO: 644684 - protein, 9 aa, Homo Sapiens
CFKWFQIDE

SEQ ID NO: 644685 - protein, 9 aa, Homo Sapiens
RLEDPQSFR

SEQ ID NO: 644686 - protein, 9 aa, Homo Sapiens
TEKLHIPQF

SEQ ID NO: 644687 - protein, 9 aa, Homo Sapiens
GLHLDFAQS

SEQ ID NO: 644688 - protein, 9 aa, Homo Sapiens
VLGASTLLL

SEQ ID NO: 644689 - protein, 9 aa, Homo Sapiens
DVQAFKFWD

SEQ ID NO: 644690 - protein, 9 aa, Homo Sapiens
GGELKPERY

SEQ ID NO: 644691 - protein, 9 aa, Homo Sapiens
TEEERKHRI

SEQ ID NO: 644692 - protein, 9 aa, Homo Sapiens
GEDSQDAPV

SEQ ID NO: 644693 - protein, 9 aa, Homo Sapiens
MCITADLQL

SEQ ID NO: 644694 - protein, 9 aa, Homo Sapiens
MKRHLIEGL

SEQ ID NO: 644695 - protein, 9 aa, Homo Sapiens
LNSVINTVF

SEQ ID NO: 644696 - protein, 9 aa, Homo Sapiens
IWSFELQGN

SEQ ID NO: 644697 - protein, 9 aa, Homo Sapiens
KCTGLSATA

SEQ ID NO: 644698 - protein, 9 aa, Homo Sapiens
CPARSVPSI

SEQ ID NO: 644699 - protein, 9 aa, Homo Sapiens
RYPTPTPPL

SEQ ID NO: 644700 - protein, 9 aa, Homo Sapiens
HFNSFFQVF

SEQ ID NO: 644701 - protein, 9 aa, Homo Sapiens
TTTRYPTPT

SEQ ID NO: 644702 - protein, 9 aa, Homo Sapiens
LTRVVAQLR

SEQ ID NO: 644703 - protein, 9 aa, Homo Sapiens
RLASSDDDL

SEQ ID NO: 644704 - protein, 9 aa, Homo Sapiens
STLQSVLNN

SEQ ID NO: 644705 - protein, 9 aa, Homo Sapiens
CGMFATELE

SEQ ID NO: 644706 - protein, 9 aa, Homo Sapiens
HSCSRFYTT

SEQ ID NO: 644707 - protein, 9 aa, Homo Sapiens
ASQFFMGGE

SEQ ID NO: 644708 - protein, 9 aa, Homo Sapiens
PSPRPLPPP

SEQ ID NO: 644709 - protein, 9 aa, Homo Sapiens
FLLQGSCSA

SEQ ID NO: 644710 - protein, 9 aa, Homo Sapiens
VPFNGIFNG

SEQ ID NO: 644711 - protein, 9 aa, Homo Sapiens
PVFNKHRST

SEQ ID NO: 644712 - protein, 9 aa, Homo Sapiens
LGGREKEES

SEQ ID NO: 644713 - protein, 9 aa, Homo Sapiens
SAFGNILSS

SEQ ID NO: 644714 - protein, 9 aa, Homo Sapiens
YPYRQLHFL

SEQ ID NO: 644715 - protein, 9 aa, Homo Sapiens
GKDMSKLAT

SEQ ID NO: 644716 - protein, 9 aa, Homo Sapiens
SPGHHVYML

SEQ ID NO: 644717 - protein, 9 aa, Homo Sapiens
EFLQNLNHI

SEQ ID NO: 644718 - protein, 9 aa, Homo Sapiens
AVNYHPAKY

SEQ ID NO: 644719 - protein, 9 aa, Homo Sapiens
IEGLKFRQK

SEQ ID NO: 644720 - protein, 9 aa, Homo Sapiens
NSHYGNTYG

SEQ ID NO: 644721 - protein, 9 aa, Homo Sapiens
DEFLQNLNH

SEQ ID NO: 644722 - protein, 9 aa, Homo Sapiens
MNNDSNFTE

SEQ ID NO: 644723 - protein, 9 aa, Homo Sapiens
VLNLSCSET

SEQ ID NO: 644724 - protein, 9 aa, Homo Sapiens
QGGEDAHHT

SEQ ID NO: 644725 - protein, 9 aa, Homo Sapiens
KICTYQKPT

SEQ ID NO: 644726 - protein, 9 aa, Homo Sapiens
LHLDFAQSP

SEQ ID NO: 644727 - protein, 9 aa, Homo Sapiens
MNYCTSGAY

SEQ ID NO: 644728 - protein, 9 aa, Homo Sapiens
PPILVVMAS

SEQ ID NO: 644729 - protein, 9 aa, Homo Sapiens
PNAFSENGQ

SEQ ID NO: 644730 - protein, 9 aa, Homo Sapiens
YPQTPNNRR

SEQ ID NO: 644731 - protein, 9 aa, Homo Sapiens
LITQAVQTE

SEQ ID NO: 644732 - protein, 9 aa, Homo Sapiens
KKPRLEDPQ

SEQ ID NO: 644733 - protein, 9 aa, Homo Sapiens
WELENTALE

SEQ ID NO: 644734 - protein, 9 aa, Homo Sapiens
GNAIHMTEK

SEQ ID NO: 644735 - protein, 9 aa, Homo Sapiens
CRVEGHKPS

SEQ ID NO: 644736 - protein, 9 aa, Homo Sapiens
LDDNDSENN

SEQ ID NO: 644737 - protein, 9 aa, Homo Sapiens
NMPTSKENL

SEQ ID NO: 644738 - protein, 9 aa, Homo Sapiens
ISFSTLLLE

SEQ ID NO: 644739 - protein, 9 aa, Homo Sapiens
FSTLLLEPF

SEQ ID NO: 644740 - protein, 9 aa, Homo Sapiens
GHHNEFDDK

SEQ ID NO: 644741 - protein, 9 aa, Homo Sapiens
AFVCKAHLT

SEQ ID NO: 644742 - protein, 9 aa, Homo Sapiens
PPRTGWPSP

SEQ ID NO: 644743 - protein, 9 aa, Homo Sapiens
PPVTFDEKG

SEQ ID NO: 644744 - protein, 9 aa, Homo Sapiens
RLARCPASC

SEQ ID NO: 644745 - protein, 9 aa, Homo Sapiens
LLLLCSQIL

SEQ ID NO: 644746 - protein, 9 aa, Homo Sapiens
GLPDLRDLL

SEQ ID NO: 644747 - protein, 9 aa, Homo Sapiens
ASTLLLSFL

SEQ ID NO: 644748 - protein, 9 aa, Homo Sapiens
VQLLNLFMT

SEQ ID NO: 644749 - protein, 9 aa, Homo Sapiens
TRPAKWNGQ

SEQ ID NO: 644750 - protein, 9 aa, Homo Sapiens
PDSAAERCG

SEQ ID NO: 644751 - protein, 9 aa, Homo Sapiens
PLPPPPATT

SEQ ID NO: 644752 - protein, 9 aa, Homo Sapiens
PPAPVLLSP

SEQ ID NO: 644753 - protein, 9 aa, Homo Sapiens
ISSEFDEKQ

SEQ ID NO: 644754 - protein, 9 aa, Homo Sapiens
MQICIGRGG

SEQ ID NO: 644755 - protein, 9 aa, Homo Sapiens
SAIKAAARS

SEQ ID NO: 644756 - protein, 9 aa, Homo Sapiens
GLSCDVTSN

SEQ ID NO: 644757 - protein, 9 aa, Homo Sapiens
KFKEEEKTK

SEQ ID NO: 644758 - protein, 9 aa, Homo Sapiens
DVPGSPLRP

SEQ ID NO: 644759 - protein, 9 aa, Homo Sapiens
AFSENGQDY

SEQ ID NO: 644760 - protein, 9 aa, Homo Sapiens
IRNNNSSRL

SEQ ID NO: 644761 - protein, 9 aa, Homo Sapiens
WNWTCLLSL

SEQ ID NO: 644762 - protein, 9 aa, Homo Sapiens
FDEKGELRK

SEQ ID NO: 644763 - protein, 9 aa, Homo Sapiens
HPHRPPPFI

SEQ ID NO: 644764 - protein, 9 aa, Homo Sapiens
ILIVIIRYI

SEQ ID NO: 644765 - protein, 9 aa, Homo Sapiens
GAPQPGAEG

SEQ ID NO: 644766 - protein, 9 aa, Homo Sapiens
PPGRAQSVP

SEQ ID NO: 644767 - protein, 9 aa, Homo Sapiens
TSYILDARK

SEQ ID NO: 644768 - protein, 9 aa, Homo Sapiens
PGFHYRFLS

SEQ ID NO: 644769 - protein, 9 aa, Homo Sapiens
RQGSDPRPI

SEQ ID NO: 644770 - protein, 9 aa, Homo Sapiens
MAKLTMHIE

SEQ ID NO: 644771 - protein, 9 aa, Homo Sapiens
VWTGRIPIY

SEQ ID NO: 644772 - protein, 9 aa, Homo Sapiens
VCFIEPDSA

SEQ ID NO: 644773 - protein, 9 aa, Homo Sapiens
KQQIQPSQL

SEQ ID NO: 644774 - protein, 9 aa, Homo Sapiens
VLNTSQSYA

SEQ ID NO: 644775 - protein, 9 aa, Homo Sapiens
SSCSMSSRS

SEQ ID NO: 644776 - protein, 9 aa, Homo Sapiens
IDFTEEEWD

SEQ ID NO: 644777 - protein, 9 aa, Homo Sapiens
FLNSVINTV

SEQ ID NO: 644778 - protein, 9 aa, Homo Sapiens
GGIQPEICK

SEQ ID NO: 644779 - protein, 9 aa, Homo Sapiens
GNKSISFTR

SEQ ID NO: 644780 - protein, 9 aa, Homo Sapiens
LVLSMILIV

SEQ ID NO: 644781 - protein, 9 aa, Homo Sapiens
RRSSRSGTS

SEQ ID NO: 644782 - protein, 9 aa, Homo Sapiens
FELQGNLIV

SEQ ID NO: 644783 - protein, 9 aa, Homo Sapiens
AVQKDLSDM

SEQ ID NO: 644784 - protein, 9 aa, Homo Sapiens
LPSSIKQLE

SEQ ID NO: 644785 - protein, 9 aa, Homo Sapiens
ENSHVKKED

SEQ ID NO: 644786 - protein, 9 aa, Homo Sapiens
TLACIDTWV

SEQ ID NO: 644787 - protein, 9 aa, Homo Sapiens
VSQPPEEVC

SEQ ID NO: 644788 - protein, 9 aa, Homo Sapiens
NGEKMQICI

SEQ ID NO: 644789 - protein, 9 aa, Homo Sapiens
YNSPKFRSQ

SEQ ID NO: 644790 - protein, 9 aa, Homo Sapiens
KLLERAELV

SEQ ID NO: 644791 - protein, 9 aa, Homo Sapiens
SPPGRAQSV

SEQ ID NO: 644792 - protein, 9 aa, Homo Sapiens
ALAQSVSLQ

SEQ ID NO: 644793 - protein, 9 aa, Homo Sapiens
DRRLQQLPS

SEQ ID NO: 644794 - protein, 9 aa, Homo Sapiens
AHITCRLYG

SEQ ID NO: 644795 - protein, 9 aa, Homo Sapiens
IIGRADVLA

SEQ ID NO: 644796 - protein, 9 aa, Homo Sapiens
DAHHTRSPY

SEQ ID NO: 644797 - protein, 9 aa, Homo Sapiens
VNPSQQPVL

SEQ ID NO: 644798 - protein, 9 aa, Homo Sapiens
ARKKHWKEN

SEQ ID NO: 644799 - protein, 9 aa, Homo Sapiens
VSSVLNTSQ

SEQ ID NO: 644800 - protein, 9 aa, Homo Sapiens
YVNILTGMP

SEQ ID NO: 644801 - protein, 9 aa, Homo Sapiens
KVQERYYSA

SEQ ID NO: 644802 - protein, 9 aa, Homo Sapiens
EPDSAAERC

SEQ ID NO: 644803 - protein, 9 aa, Homo Sapiens
GGASLELPE

SEQ ID NO: 644804 - protein, 9 aa, Homo Sapiens
GAISDLEEG

SEQ ID NO: 644805 - protein, 9 aa, Homo Sapiens
VGIIYKVRI

SEQ ID NO: 644806 - protein, 9 aa, Homo Sapiens
VTFDEKGEL

SEQ ID NO: 644807 - protein, 9 aa, Homo Sapiens
EKKARKHFN

SEQ ID NO: 644808 - protein, 9 aa, Homo Sapiens
SACLVKEDV

SEQ ID NO: 644809 - protein, 9 aa, Homo Sapiens
DTFEDAANI

SEQ ID NO: 644810 - protein, 9 aa, Homo Sapiens
TISVGYAEY

SEQ ID NO: 644811 - protein, 9 aa, Homo Sapiens
LAEDTVVPL

SEQ ID NO: 644812 - protein, 9 aa, Homo Sapiens
PEGLPDLRD

SEQ ID NO: 644813 - protein, 9 aa, Homo Sapiens
TKLLERAEL

SEQ ID NO: 644814 - protein, 9 aa, Homo Sapiens
QYPTEEPQH

SEQ ID NO: 644815 - protein, 9 aa, Homo Sapiens
SLCPARSVP

SEQ ID NO: 644816 - protein, 9 aa, Homo Sapiens
EDVPWCRVE

SEQ ID NO: 644817 - protein, 9 aa, Homo Sapiens
VWMIQNGIL

SEQ ID NO: 644818 - protein, 9 aa, Homo Sapiens
LSTLEHAHL

SEQ ID NO: 644819 - protein, 9 aa, Homo Sapiens
ISVGYAEYA

SEQ ID NO: 644820 - protein, 9 aa, Homo Sapiens
TQFLIEVKE

SEQ ID NO: 644821 - protein, 9 aa, Homo Sapiens
LENTALEEG

SEQ ID NO: 644822 - protein, 9 aa, Homo Sapiens
AASSPTRIP

SEQ ID NO: 644823 - protein, 9 aa, Homo Sapiens
LSAQTHEPR

SEQ ID NO: 644824 - protein, 9 aa, Homo Sapiens
GGGASLELP

SEQ ID NO: 644825 - protein, 9 aa, Homo Sapiens
PPGFKGHTC

SEQ ID NO: 644826 - protein, 9 aa, Homo Sapiens
RFVDCGMFA

SEQ ID NO: 644827 - protein, 9 aa, Homo Sapiens
AVLNLSCSE

SEQ ID NO: 644828 - protein, 9 aa, Homo Sapiens
NKRSNEDCV

SEQ ID NO: 644829 - protein, 9 aa, Homo Sapiens
VCKAHLTKH

SEQ ID NO: 644830 - protein, 9 aa, Homo Sapiens
RSQNQSYMR

SEQ ID NO: 644831 - protein, 9 aa, Homo Sapiens
TEVLRAGHH

SEQ ID NO: 644832 - protein, 9 aa, Homo Sapiens
QMPCRRSSR

SEQ ID NO: 644833 - protein, 9 aa, Homo Sapiens
SDDDTKDHS

SEQ ID NO: 644834 - protein, 9 aa, Homo Sapiens
TAGADTGDV

SEQ ID NO: 644835 - protein, 9 aa, Homo Sapiens
EPFVPVFNK

SEQ ID NO: 644836 - protein, 9 aa, Homo Sapiens
LARCPASCS

SEQ ID NO: 644837 - protein, 9 aa, Homo Sapiens
TWTNQERPK

SEQ ID NO: 644838 - protein, 9 aa, Homo Sapiens
PVTFDEKGE

SEQ ID NO: 644839 - protein, 9 aa, Homo Sapiens
IQPEICKAV

SEQ ID NO: 644840 - protein, 9 aa, Homo Sapiens
SSSLGISVR

SEQ ID NO: 644841 - protein, 9 aa, Homo Sapiens
PPPFIPSGP

SEQ ID NO: 644842 - protein, 9 aa, Homo Sapiens
AWERSFVSQ

SEQ ID NO: 644843 - protein, 9 aa, Homo Sapiens
VQASDLFPA

SEQ ID NO: 644844 - protein, 9 aa, Homo Sapiens
DGLEYDFIS

SEQ ID NO: 644845 - protein, 9 aa, Homo Sapiens
YLSETDGIQ

SEQ ID NO: 644846 - protein, 9 aa, Homo Sapiens
ACLVKEDVP

SEQ ID NO: 644847 - protein, 9 aa, Homo Sapiens
KDPSPRTGC

SEQ ID NO: 644848 - protein, 9 aa, Homo Sapiens
ELGVNPSQQ

SEQ ID NO: 644849 - protein, 9 aa, Homo Sapiens
PLQMARQQR

SEQ ID NO: 644850 - protein, 9 aa, Homo Sapiens
EVLAGLLTK

SEQ ID NO: 644851 - protein, 9 aa, Homo Sapiens
ICEKAFVCK

SEQ ID NO: 644852 - protein, 9 aa, Homo Sapiens
MSSRSMPGL

SEQ ID NO: 644853 - protein, 9 aa, Homo Sapiens
RSNERHREH

SEQ ID NO: 644854 - protein, 9 aa, Homo Sapiens
GWLFWDDWQ

SEQ ID NO: 644855 - protein, 9 aa, Homo Sapiens
ASRVQPEPR

SEQ ID NO: 644856 - protein, 9 aa, Homo Sapiens
AFSHTCRCG

SEQ ID NO: 644857 - protein, 9 aa, Homo Sapiens
AFRSARPLP

SEQ ID NO: 644858 - protein, 9 aa, Homo Sapiens
DLSVPKQMK

SEQ ID NO: 644859 - protein, 9 aa, Homo Sapiens
GDFLDCEHG

SEQ ID NO: 644860 - protein, 9 aa, Homo Sapiens
RGKLTASER

SEQ ID NO: 644861 - protein, 9 aa, Homo Sapiens
TGWPSPAGP

SEQ ID NO: 644862 - protein, 9 aa, Homo Sapiens
IIHKYRPEL

SEQ ID NO: 644863 - protein, 9 aa, Homo Sapiens
QLPSSIKQL

SEQ ID NO: 644864 - protein, 9 aa, Homo Sapiens
KWTFVASMS

SEQ ID NO: 644865 - protein, 9 aa, Homo Sapiens
MVRYTFADG

SEQ ID NO: 644866 - protein, 9 aa, Homo Sapiens
CRRSSRSGT

SEQ ID NO: 644867 - protein, 9 aa, Homo Sapiens
ERNVEIQPS

SEQ ID NO: 644868 - protein, 9 aa, Homo Sapiens
YRPELIDMN

SEQ ID NO: 644869 - protein, 9 aa, Homo Sapiens
APASPPFSS

SEQ ID NO: 644870 - protein, 9 aa, Homo Sapiens
FWDFVLKSG

SEQ ID NO: 644871 - protein, 9 aa, Homo Sapiens
CRNPDAVAS

SEQ ID NO: 644872 - protein, 9 aa, Homo Sapiens
GQRVIQIAV

SEQ ID NO: 644873 - protein, 9 aa, Homo Sapiens
RLAIRLVRC

SEQ ID NO: 644874 - protein, 9 aa, Homo Sapiens
IMGLTLSEE

SEQ ID NO: 644875 - protein, 9 aa, Homo Sapiens
APHHSGIYP

SEQ ID NO: 644876 - protein, 9 aa, Homo Sapiens
VKVQERYYS

SEQ ID NO: 644877 - protein, 9 aa, Homo Sapiens
KRENAERLL

SEQ ID NO: 644878 - protein, 9 aa, Homo Sapiens
TQFCVSFFV

SEQ ID NO: 644879 - protein, 9 aa, Homo Sapiens
CYTLDPHTG

SEQ ID NO: 644880 - protein, 9 aa, Homo Sapiens
DDWQSIDTY

SEQ ID NO: 644881 - protein, 9 aa, Homo Sapiens
QKEIPTHLS

SEQ ID NO: 644882 - protein, 9 aa, Homo Sapiens
DAHIRDSWL

SEQ ID NO: 644883 - protein, 9 aa, Homo Sapiens
STLEHAHLI

SEQ ID NO: 644884 - protein, 9 aa, Homo Sapiens
ADAILSTTP

SEQ ID NO: 644885 - protein, 9 aa, Homo Sapiens
LDLAWERSF

SEQ ID NO: 644886 - protein, 9 aa, Homo Sapiens
TRPALGPLS

SEQ ID NO: 644887 - protein, 9 aa, Homo Sapiens
ISSMAKLTM

SEQ ID NO: 644888 - protein, 9 aa, Homo Sapiens
IHMTEKLHI

SEQ ID NO: 644889 - protein, 9 aa, Homo Sapiens
NWKCTGLSA

SEQ ID NO: 644890 - protein, 9 aa, Homo Sapiens
LPCINPLST

SEQ ID NO: 644891 - protein, 9 aa, Homo Sapiens
NTALEEGNY

SEQ ID NO: 644892 - protein, 9 aa, Homo Sapiens
VKESKEEDF

SEQ ID NO: 644893 - protein, 9 aa, Homo Sapiens
CSMSSRSMP

SEQ ID NO: 644894 - protein, 9 aa, Homo Sapiens
KQVFPGMNY

SEQ ID NO: 644895 - protein, 9 aa, Homo Sapiens
KQSTEFLSF

SEQ ID NO: 644896 - protein, 9 aa, Homo Sapiens
TNVADFIIM

SEQ ID NO: 644897 - protein, 9 aa, Homo Sapiens
PLVIQKLEK

SEQ ID NO: 644898 - protein, 9 aa, Homo Sapiens
RIKCESNTS

SEQ ID NO: 644899 - protein, 9 aa, Homo Sapiens
AVASPYCYT

SEQ ID NO: 644900 - protein, 9 aa, Homo Sapiens
QVMSRNSGR

SEQ ID NO: 644901 - protein, 9 aa, Homo Sapiens
YCKGARRSH

SEQ ID NO: 644902 - protein, 9 aa, Homo Sapiens
TSPLILQYI

SEQ ID NO: 644903 - protein, 9 aa, Homo Sapiens
RKKHWKENM

SEQ ID NO: 644904 - protein, 9 aa, Homo Sapiens
SPLILQYIP

SEQ ID NO: 644905 - protein, 9 aa, Homo Sapiens
ANILKPSTI

SEQ ID NO: 644906 - protein, 9 aa, Homo Sapiens
KRGKLTASE

SEQ ID NO: 644907 - protein, 9 aa, Homo Sapiens
GLKFRQKVN

SEQ ID NO: 644908 - protein, 9 aa, Homo Sapiens
VAPSISIAI

SEQ ID NO: 644909 - protein, 9 aa, Homo Sapiens
EETQKWFKL

SEQ ID NO: 644910 - protein, 9 aa, Homo Sapiens
WPSPAGPAA

SEQ ID NO: 644911 - protein, 9 aa, Homo Sapiens
APLVLHWNP

SEQ ID NO: 644912 - protein, 9 aa, Homo Sapiens
MQAKGIPQM

SEQ ID NO: 644913 - protein, 9 aa, Homo Sapiens
EWERGLERD

SEQ ID NO: 644914 - protein, 9 aa, Homo Sapiens
RSFVSQYEC

SEQ ID NO: 644915 - protein, 9 aa, Homo Sapiens
NVGIIYKVR

SEQ ID NO: 644916 - protein, 9 aa, Homo Sapiens
VMASAESED

SEQ ID NO: 644917 - protein, 9 aa, Homo Sapiens
QKWTFVASM

SEQ ID NO: 644918 - protein, 9 aa, Homo Sapiens
SEPINKRLY

SEQ ID NO: 644919 - protein, 9 aa, Homo Sapiens
EIPNFQQDD

SEQ ID NO: 644920 - protein, 9 aa, Homo Sapiens
ATTRPALGP

SEQ ID NO: 644921 - protein, 9 aa, Homo Sapiens
QRSYRDLSP

SEQ ID NO: 644922 - protein, 9 aa, Homo Sapiens
GCDLLVQQH

SEQ ID NO: 644923 - protein, 9 aa, Homo Sapiens
RGPRLCLRF

SEQ ID NO: 644924 - protein, 9 aa, Homo Sapiens
FGPNKVEFI

SEQ ID NO: 644925 - protein, 9 aa, Homo Sapiens
PLSCKLNEV

SEQ ID NO: 644926 - protein, 9 aa, Homo Sapiens
TEWERGLER

SEQ ID NO: 644927 - protein, 9 aa, Homo Sapiens
RENAERLLD

SEQ ID NO: 644928 - protein, 9 aa, Homo Sapiens
RSAALQVTK

SEQ ID NO: 644929 - protein, 9 aa, Homo Sapiens
KARKHFNSF

SEQ ID NO: 644930 - protein, 9 aa, Homo Sapiens
KRSNEDCVE

SEQ ID NO: 644931 - protein, 9 aa, Homo Sapiens
EICKAVWPF

SEQ ID NO: 644932 - protein, 9 aa, Homo Sapiens
VAIDFTEEE

SEQ ID NO: 644933 - protein, 9 aa, Homo Sapiens
GRSNERHRE

SEQ ID NO: 644934 - protein, 9 aa, Homo Sapiens
FWEMDDTGP

SEQ ID NO: 644935 - protein, 9 aa, Homo Sapiens
DSAAERCGL

SEQ ID NO: 644936 - protein, 9 aa, Homo Sapiens
AAASSPTRI

SEQ ID NO: 644937 - protein, 9 aa, Homo Sapiens
MASAESEDE

SEQ ID NO: 644938 - protein, 9 aa, Homo Sapiens
VLSMILIVI

SEQ ID NO: 644939 - protein, 9 aa, Homo Sapiens
RGKCRNECH

SEQ ID NO: 644940 - protein, 9 aa, Homo Sapiens
ADIATLEGF

SEQ ID NO: 644941 - protein, 9 aa, Homo Sapiens
KWRPVSVSP

SEQ ID NO: 644942 - protein, 9 aa, Homo Sapiens
PVLINNASS

SEQ ID NO: 644943 - protein, 9 aa, Homo Sapiens
SVDEFHLLQ

SEQ ID NO: 644944 - protein, 9 aa, Homo Sapiens
KKFKEEEKT

SEQ ID NO: 644945 - protein, 9 aa, Homo Sapiens
NETTVKTSY

SEQ ID NO: 644946 - protein, 9 aa, Homo Sapiens
SVPGSTETT

SEQ ID NO: 644947 - protein, 9 aa, Homo Sapiens
HNEFDDKFE

SEQ ID NO: 644948 - protein, 9 aa, Homo Sapiens
YLISIPITG

SEQ ID NO: 644949 - protein, 9 aa, Homo Sapiens
AQRDEPVPG

SEQ ID NO: 644950 - protein, 9 aa, Homo Sapiens
NEPNNKRSN

SEQ ID NO: 644951 - protein, 9 aa, Homo Sapiens
IPQMAPPKR

SEQ ID NO: 644952 - protein, 9 aa, Homo Sapiens
SLPGQYPTE

SEQ ID NO: 644953 - protein, 9 aa, Homo Sapiens
EHFSAFGNI

SEQ ID NO: 644954 - protein, 9 aa, Homo Sapiens
AHIRDSWLD

SEQ ID NO: 644955 - protein, 9 aa, Homo Sapiens
PAFSHTCRC

SEQ ID NO: 644956 - protein, 9 aa, Homo Sapiens
KKEDIWPSG

SEQ ID NO: 644957 - protein, 9 aa, Homo Sapiens
MMKEFRKLE

SEQ ID NO: 644958 - protein, 9 aa, Homo Sapiens
RCCNWKCTG

SEQ ID NO: 644959 - protein, 9 aa, Homo Sapiens
RPIHPAGRQ

SEQ ID NO: 644960 - protein, 9 aa, Homo Sapiens
IPSGPSPRP

SEQ ID NO: 644961 - protein, 9 aa, Homo Sapiens
PNNNDPNYL

SEQ ID NO: 644962 - protein, 9 aa, Homo Sapiens
LYSLIMFRT

SEQ ID NO: 644963 - protein, 9 aa, Homo Sapiens
KDMSKLATW

SEQ ID NO: 644964 - protein, 9 aa, Homo Sapiens
GLVDITRQG

SEQ ID NO: 644965 - protein, 9 aa, Homo Sapiens
PQKICTYQK

SEQ ID NO: 644966 - protein, 9 aa, Homo Sapiens
YQKPTSGRQ

SEQ ID NO: 644967 - protein, 9 aa, Homo Sapiens
QLVPADQVY

SEQ ID NO: 644968 - protein, 9 aa, Homo Sapiens
KYPETSGAL

SEQ ID NO: 644969 - protein, 9 aa, Homo Sapiens
MKTLTSKMG

SEQ ID NO: 644970 - protein, 9 aa, Homo Sapiens
FIIMGLTLS

SEQ ID NO: 644971 - protein, 9 aa, Homo Sapiens
VNIQLYLSE

SEQ ID NO: 644972 - protein, 9 aa, Homo Sapiens
AVGLWAMMK

SEQ ID NO: 644973 - protein, 9 aa, Homo Sapiens
DRVVLMYDE

SEQ ID NO: 644974 - protein, 9 aa, Homo Sapiens
GHRHPHRPP

SEQ ID NO: 644975 - protein, 9 aa, Homo Sapiens
PVVVRGSGY

SEQ ID NO: 644976 - protein, 9 aa, Homo Sapiens
QDDAGLYEC

SEQ ID NO: 644977 - protein, 9 aa, Homo Sapiens
FGLFSKWIP

SEQ ID NO: 644978 - protein, 9 aa, Homo Sapiens
KKHWKENMF

SEQ ID NO: 644979 - protein, 9 aa, Homo Sapiens
WRTLMERVQ

SEQ ID NO: 644980 - protein, 9 aa, Homo Sapiens
GSIWSFELQ

SEQ ID NO: 644981 - protein, 9 aa, Homo Sapiens
SMILIVIIR

SEQ ID NO: 644982 - protein, 9 aa, Homo Sapiens
FIEPDSAAE

SEQ ID NO: 644983 - protein, 9 aa, Homo Sapiens
IGEYVNILT

SEQ ID NO: 644984 - protein, 9 aa, Homo Sapiens
PVPGTRRSP

SEQ ID NO: 644985 - protein, 9 aa, Homo Sapiens
DLRDLLPSE

SEQ ID NO: 644986 - protein, 9 aa, Homo Sapiens
KHFNSFFQV

SEQ ID NO: 644987 - protein, 9 aa, Homo Sapiens
LGVNPSQQP

SEQ ID NO: 644988 - protein, 9 aa, Homo Sapiens
ARSAALQVT

SEQ ID NO: 644989 - protein, 9 aa, Homo Sapiens
AMMKTNRGT

SEQ ID NO: 644990 - protein, 9 aa, Homo Sapiens
SNFTETIDE

SEQ ID NO: 644991 - protein, 9 aa, Homo Sapiens
ARDVVDSLM

SEQ ID NO: 644992 - protein, 9 aa, Homo Sapiens
QTPNNRRPS

SEQ ID NO: 644993 - protein, 9 aa, Homo Sapiens
LVLHWNPGR

SEQ ID NO: 644994 - protein, 9 aa, Homo Sapiens
ASSDDDLRV

SEQ ID NO: 644995 - protein, 9 aa, Homo Sapiens
TSGALPGDD

SEQ ID NO: 644996 - protein, 9 aa, Homo Sapiens
NECHDFEKP

SEQ ID NO: 644997 - protein, 9 aa, Homo Sapiens
VKDLNKRIR

SEQ ID NO: 644998 - protein, 9 aa, Homo Sapiens
SSPADTTSV

SEQ ID NO: 644999 - protein, 9 aa, Homo Sapiens
QTNQMPTSE

SEQ ID NO: 645000 - protein, 9 aa, Homo Sapiens
DKFEDDDPL

SEQ ID NO: 645001 - protein, 9 aa, Homo Sapiens
TEEEWDMMD

SEQ ID NO: 645002 - protein, 9 aa, Homo Sapiens
NALAQSVSL

SEQ ID NO: 645003 - protein, 9 aa, Homo Sapiens
TTRPALGPL

SEQ ID NO: 645004 - protein, 9 aa, Homo Sapiens
GAPSLPGQY

SEQ ID NO: 645005 - protein, 9 aa, Homo Sapiens
LFWDDWQSI

SEQ ID NO: 645006 - protein, 9 aa, Homo Sapiens
PPWKEHPRD

SEQ ID NO: 645007 - protein, 9 aa, Homo Sapiens
NILSSKVMS

SEQ ID NO: 645008 - protein, 9 aa, Homo Sapiens
CKGARRSHR

SEQ ID NO: 645009 - protein, 9 aa, Homo Sapiens
EKMQICIGR

SEQ ID NO: 645010 - protein, 9 aa, Homo Sapiens
DCGMFATEL

SEQ ID NO: 645011 - protein, 9 aa, Homo Sapiens
AKQGHQENT

SEQ ID NO: 645012 - protein, 9 aa, Homo Sapiens
HRLSTLEHA

SEQ ID NO: 645013 - protein, 9 aa, Homo Sapiens
YLRTWTNQE

SEQ ID NO: 645014 - protein, 9 aa, Homo Sapiens
ELDEFLQNL

SEQ ID NO: 645015 - protein, 9 aa, Homo Sapiens
HYRFLSQLS

SEQ ID NO: 645016 - protein, 9 aa, Homo Sapiens
TVDRVVLMY

SEQ ID NO: 645017 - protein, 9 aa, Homo Sapiens
ARTGDVPGS

SEQ ID NO: 645018 - protein, 9 aa, Homo Sapiens
VLHLIDQYF

SEQ ID NO: 645019 - protein, 9 aa, Homo Sapiens
RVVLMYDEH

SEQ ID NO: 645020 - protein, 9 aa, Homo Sapiens
VLAYPCVAT

SEQ ID NO: 645021 - protein, 9 aa, Homo Sapiens
RLNSHYGNT

SEQ ID NO: 645022 - protein, 9 aa, Homo Sapiens
EEVCATSAD

SEQ ID NO: 645023 - protein, 9 aa, Homo Sapiens
VFLEKPTLP

SEQ ID NO: 645024 - protein, 9 aa, Homo Sapiens
KDLHAVGGK

SEQ ID NO: 645025 - protein, 9 aa, Homo Sapiens
GIIYKVRIE

SEQ ID NO: 645026 - protein, 9 aa, Homo Sapiens
STQSRLITI

SEQ ID NO: 645027 - protein, 9 aa, Homo Sapiens
ESNTSTQSR

SEQ ID NO: 645028 - protein, 9 aa, Homo Sapiens
SARYSSMCI

SEQ ID NO: 645029 - protein, 9 aa, Homo Sapiens
RIPIYSFHG

SEQ ID NO: 645030 - protein, 9 aa, Homo Sapiens
SNTSTQSRL

SEQ ID NO: 645031 - protein, 9 aa, Homo Sapiens
FMTSLDATV

SEQ ID NO: 645032 - protein, 9 aa, Homo Sapiens
PGDKYPETS

SEQ ID NO: 645033 - protein, 9 aa, Homo Sapiens
PHRPPPFIP

SEQ ID NO: 645034 - protein, 9 aa, Homo Sapiens
DKHIKENDY

SEQ ID NO: 645035 - protein, 9 aa, Homo Sapiens
RGLSCDVTS

SEQ ID NO: 645036 - protein, 9 aa, Homo Sapiens
GGPLSCKLN

SEQ ID NO: 645037 - protein, 9 aa, Homo Sapiens
DYLLRVVIQ

SEQ ID NO: 645038 - protein, 9 aa, Homo Sapiens
KAKKQQIQP

SEQ ID NO: 645039 - protein, 9 aa, Homo Sapiens
PRPISFSTL

SEQ ID NO: 645040 - protein, 9 aa, Homo Sapiens
TTSPLILQY

SEQ ID NO: 645041 - protein, 9 aa, Homo Sapiens
WSFELQGNL

SEQ ID NO: 645042 - protein, 9 aa, Homo Sapiens
SHRSSKENF

SEQ ID NO: 645043 - protein, 9 aa, Homo Sapiens
SPADTTSVG

SEQ ID NO: 645044 - protein, 9 aa, Homo Sapiens
TQAVQTEML

SEQ ID NO: 645045 - protein, 9 aa, Homo Sapiens
AEYENALEK

SEQ ID NO: 645046 - protein, 9 aa, Homo Sapiens
GIIGRADVL

SEQ ID NO: 645047 - protein, 9 aa, Homo Sapiens
GRIQEAPKF

SEQ ID NO: 645048 - protein, 9 aa, Homo Sapiens
DVPWCRVEG

SEQ ID NO: 645049 - protein, 9 aa, Homo Sapiens
AQSVPTPRP

SEQ ID NO: 645050 - protein, 9 aa, Homo Sapiens
TTFHSVPGS

SEQ ID NO: 645051 - protein, 9 aa, Homo Sapiens
GADTGDVAV

SEQ ID NO: 645052 - protein, 9 aa, Homo Sapiens
LRPGFHYRF

SEQ ID NO: 645053 - protein, 9 aa, Homo Sapiens
RLFFTSVLG

SEQ ID NO: 645054 - protein, 9 aa, Homo Sapiens
WMIQNGILI

SEQ ID NO: 645055 - protein, 9 aa, Homo Sapiens
CSQILLIYA

SEQ ID NO: 645056 - protein, 9 aa, Homo Sapiens
EIRNYPYRQ

SEQ ID NO: 645057 - protein, 9 aa, Homo Sapiens
RASHTKANP

SEQ ID NO: 645058 - protein, 9 aa, Homo Sapiens
PGRAQSVPT

SEQ ID NO: 645059 - protein, 9 aa, Homo Sapiens
LEDPQSFRN

SEQ ID NO: 645060 - protein, 9 aa, Homo Sapiens
VLHWNPGRK

SEQ ID NO: 645061 - protein, 9 aa, Homo Sapiens
MTEKLHIPQ

SEQ ID NO: 645062 - protein, 9 aa, Homo Sapiens
ELPEGKILP

SEQ ID NO: 645063 - protein, 9 aa, Homo Sapiens
LPFLDIQTP

SEQ ID NO: 645064 - protein, 9 aa, Homo Sapiens
PGHHVYMLL

SEQ ID NO: 645065 - protein, 9 aa, Homo Sapiens
HEPRQWGVK

SEQ ID NO: 645066 - protein, 9 aa, Homo Sapiens
IPYMADVKT

SEQ ID NO: 645067 - protein, 9 aa, Homo Sapiens
SETSLYEIF

SEQ ID NO: 645068 - protein, 9 aa, Homo Sapiens
KENYAAEYE

SEQ ID NO: 645069 - protein, 9 aa, Homo Sapiens
NTSTQSRLI

SEQ ID NO: 645070 - protein, 9 aa, Homo Sapiens
DTGDVAVVI

SEQ ID NO: 645071 - protein, 9 aa, Homo Sapiens
GQYPTEEPQ

SEQ ID NO: 645072 - protein, 9 aa, Homo Sapiens
SSTISVGYA

SEQ ID NO: 645073 - protein, 9 aa, Homo Sapiens
DNDGGLVDI

SEQ ID NO: 645074 - protein, 9 aa, Homo Sapiens
KSEPINKRL

SEQ ID NO: 645075 - protein, 9 aa, Homo Sapiens
LLEPFSGLR

SEQ ID NO: 645076 - protein, 9 aa, Homo Sapiens
SSRPEEPHL

SEQ ID NO: 645077 - protein, 9 aa, Homo Sapiens
EKLKKWRPV

SEQ ID NO: 645078 - protein, 9 aa, Homo Sapiens
ENYAAEYEN

SEQ ID NO: 645079 - protein, 9 aa, Homo Sapiens
RDLLPSEDR

SEQ ID NO: 645080 - protein, 9 aa, Homo Sapiens
QSVPTPRPF

SEQ ID NO: 645081 - protein, 9 aa, Homo Sapiens
KAAVQKDLS

SEQ ID NO: 645082 - protein, 9 aa, Homo Sapiens
RSLLKKDYD

SEQ ID NO: 645083 - protein, 9 aa, Homo Sapiens
ISSSPADTT

SEQ ID NO: 645084 - protein, 9 aa, Homo Sapiens
YPTEEPQHE

SEQ ID NO: 645085 - protein, 9 aa, Homo Sapiens
IEVKESKEE

SEQ ID NO: 645086 - protein, 9 aa, Homo Sapiens
AIIEEVDKD

SEQ ID NO: 645087 - protein, 9 aa, Homo Sapiens
EQVPILVVQ

SEQ ID NO: 645088 - protein, 9 aa, Homo Sapiens
QRGLSCDVT

SEQ ID NO: 645089 - protein, 9 aa, Homo Sapiens
RMIDFAHIT

SEQ ID NO: 645090 - protein, 9 aa, Homo Sapiens
SCSRFYTTG

SEQ ID NO: 645091 - protein, 9 aa, Homo Sapiens
HTHTRVPFN

SEQ ID NO: 645092 - protein, 9 aa, Homo Sapiens
PGAEGGGGG

SEQ ID NO: 645093 - protein, 9 aa, Homo Sapiens
ICKAVWPFL

SEQ ID NO: 645094 - protein, 9 aa, Homo Sapiens
IHKYRPELI

SEQ ID NO: 645095 - protein, 9 aa, Homo Sapiens
TCLLSLLLM

SEQ ID NO: 645096 - protein, 9 aa, Homo Sapiens
CIGRGGSQT

SEQ ID NO: 645097 - protein, 9 aa, Homo Sapiens
QDGGEHNGG

SEQ ID NO: 645098 - protein, 9 aa, Homo Sapiens
SSMCITADL

SEQ ID NO: 645099 - protein, 9 aa, Homo Sapiens
LNLSCSETS

SEQ ID NO: 645100 - protein, 9 aa, Homo Sapiens
TQEGSFSAR

SEQ ID NO: 645101 - protein, 9 aa, Homo Sapiens
LTMHIEQAN

SEQ ID NO: 645102 - protein, 9 aa, Homo Sapiens
PTSGRQGSD

SEQ ID NO: 645103 - protein, 9 aa, Homo Sapiens
ISTILIILT

SEQ ID NO: 645104 - protein, 9 aa, Homo Sapiens
YPTPTPPLG

SEQ ID NO: 645105 - protein, 9 aa, Homo Sapiens
SYILDARKT

SEQ ID NO: 645106 - protein, 9 aa, Homo Sapiens
GGTSLLYLI

SEQ ID NO: 645107 - protein, 9 aa, Homo Sapiens
QRNRSLLKK

SEQ ID NO: 645108 - protein, 9 aa, Homo Sapiens
LAWERSFVS

SEQ ID NO: 645109 - protein, 9 aa, Homo Sapiens
SLLIKFWRK

SEQ ID NO: 645110 - protein, 9 aa, Homo Sapiens
KWFQIDEAR

SEQ ID NO: 645111 - protein, 9 aa, Homo Sapiens
QQLVLKICL

SEQ ID NO: 645112 - protein, 9 aa, Homo Sapiens
SRPEEPHLS

SEQ ID NO: 645113 - protein, 9 aa, Homo Sapiens
VYLAEDTVV

SEQ ID NO: 645114 - protein, 9 aa, Homo Sapiens
YITEFYNKS

SEQ ID NO: 645115 - protein, 9 aa, Homo Sapiens
GIYPVHVQL

SEQ ID NO: 645116 - protein, 9 aa, Homo Sapiens
TFNEISTIL

SEQ ID NO: 645117 - protein, 9 aa, Homo Sapiens
IQPSSPNPD

SEQ ID NO: 645118 - protein, 9 aa, Homo Sapiens
STISVGYAE

SEQ ID NO: 645119 - protein, 9 aa, Homo Sapiens
GMNYCTSGA

SEQ ID NO: 645120 - protein, 9 aa, Homo Sapiens
GARRSHRSS

SEQ ID NO: 645121 - protein, 9 aa, Homo Sapiens
IFQQSEAPM

SEQ ID NO: 645122 - protein, 9 aa, Homo Sapiens
LAPGALTCC

SEQ ID NO: 645123 - protein, 9 aa, Homo Sapiens
MAAASGPSF

SEQ ID NO: 645124 - protein, 9 aa, Homo Sapiens
LDYLLRVVI

SEQ ID NO: 645125 - protein, 9 aa, Homo Sapiens
LCSEGKSTT

SEQ ID NO: 645126 - protein, 9 aa, Homo Sapiens
NNSSRLGKY

SEQ ID NO: 645127 - protein, 9 aa, Homo Sapiens
RSSRSGTSL

SEQ ID NO: 645128 - protein, 9 aa, Homo Sapiens
DLLPSEDRN

SEQ ID NO: 645129 - protein, 9 aa, Homo Sapiens
LLTTRKTSL

SEQ ID NO: 645130 - protein, 9 aa, Homo Sapiens
GALTCCPVA

SEQ ID NO: 645131 - protein, 9 aa, Homo Sapiens
SQPPEEVCA

SEQ ID NO: 645132 - protein, 9 aa, Homo Sapiens
SGPSFWLGN

SEQ ID NO: 645133 - protein, 9 aa, Homo Sapiens
FAKVVLHLI

SEQ ID NO: 645134 - protein, 9 aa, Homo Sapiens
KACLQGCDL

SEQ ID NO: 645135 - protein, 9 aa, Homo Sapiens
LSCDVTSNT

SEQ ID NO: 645136 - protein, 9 aa, Homo Sapiens
IKCESNTST

SEQ ID NO: 645137 - protein, 9 aa, Homo Sapiens
GSDPRPISF

SEQ ID NO: 645138 - protein, 9 aa, Homo Sapiens
FSKWIPYMA

SEQ ID NO: 645139 - protein, 9 aa, Homo Sapiens
FVPVFNKHR

SEQ ID NO: 645140 - protein, 9 aa, Homo Sapiens
DLGLPFLDI

SEQ ID NO: 645141 - protein, 9 aa, Homo Sapiens
SSDDDLRVI

SEQ ID NO: 645142 - protein, 9 aa, Homo Sapiens
SRSGTSLLT

SEQ ID NO: 645143 - protein, 9 aa, Homo Sapiens
NPLSTLQSV

SEQ ID NO: 645144 - protein, 9 aa, Homo Sapiens
GLGRLGKTV

SEQ ID NO: 645145 - protein, 9 aa, Homo Sapiens
IQPTLEQTQ

SEQ ID NO: 645146 - protein, 9 aa, Homo Sapiens
PGMNYCTSG

SEQ ID NO: 645147 - protein, 9 aa, Homo Sapiens
SGRSNERHR

SEQ ID NO: 645148 - protein, 9 aa, Homo Sapiens
SVPKQMKEP

SEQ ID NO: 645149 - protein, 9 aa, Homo Sapiens
YHKDIHTYL

SEQ ID NO: 645150 - protein, 9 aa, Homo Sapiens
SGTSLLTTR

SEQ ID NO: 645151 - protein, 9 aa, Homo Sapiens
GPSPRPLPP

SEQ ID NO: 645152 - protein, 9 aa, Homo Sapiens
PEGKILPGV

SEQ ID NO: 645153 - protein, 9 aa, Homo Sapiens
TSSTISVGY

SEQ ID NO: 645154 - protein, 9 aa, Homo Sapiens
DSSSLCPAR

SEQ ID NO: 645155 - protein, 9 aa, Homo Sapiens
SSGRSNERH

SEQ ID NO: 645156 - protein, 9 aa, Homo Sapiens
KKQQIQPSQ

SEQ ID NO: 645157 - protein, 9 aa, Homo Sapiens
TRKTSLKSE

SEQ ID NO: 645158 - protein, 9 aa, Homo Sapiens
SDRRLQQLP

SEQ ID NO: 645159 - protein, 9 aa, Homo Sapiens
FGNILSSKV

SEQ ID NO: 645160 - protein, 9 aa, Homo Sapiens
LVVMASAES

SEQ ID NO: 645161 - protein, 9 aa, Homo Sapiens
PHTGWEYCA

SEQ ID NO: 645162 - protein, 9 aa, Homo Sapiens
NFQQDDAGL

SEQ ID NO: 645163 - protein, 9 aa, Homo Sapiens
SPSADGAVS

SEQ ID NO: 645164 - protein, 9 aa, Homo Sapiens
DARKKHWKE

SEQ ID NO: 645165 - protein, 9 aa, Homo Sapiens
KTLTSKMGK

SEQ ID NO: 645166 - protein, 9 aa, Homo Sapiens
FERELGVNP

SEQ ID NO: 645167 - protein, 9 aa, Homo Sapiens
PGEADAILS

SEQ ID NO: 645168 - protein, 9 aa, Homo Sapiens
RPPPFIPSG

SEQ ID NO: 645169 - protein, 9 aa, Homo Sapiens
EDSQDAPVN

SEQ ID NO: 645170 - protein, 9 aa, Homo Sapiens
ASPPGRAQS

SEQ ID NO: 645171 - protein, 9 aa, Homo Sapiens
FNKHRSTVL

SEQ ID NO: 645172 - protein, 9 aa, Homo Sapiens
KRTEEERKH

SEQ ID NO: 645173 - protein, 9 aa, Homo Sapiens
NCLLMNSVS

SEQ ID NO: 645174 - protein, 9 aa, Homo Sapiens
QVPGEADAI

SEQ ID NO: 645175 - protein, 9 aa, Homo Sapiens
AIPPFLLQG

SEQ ID NO: 645176 - protein, 9 aa, Homo Sapiens
VRRDEEGGL

SEQ ID NO: 645177 - protein, 9 aa, Homo Sapiens
GLEYDFISD

SEQ ID NO: 645178 - protein, 9 aa, Homo Sapiens
WVLVWTGRI

SEQ ID NO: 645179 - protein, 9 aa, Homo Sapiens
SVINTVFYF

SEQ ID NO: 645180 - protein, 9 aa, Homo Sapiens
THEPRQWGV

SEQ ID NO: 645181 - protein, 9 aa, Homo Sapiens
GVPAFSHTC

SEQ ID NO: 645182 - protein, 9 aa, Homo Sapiens
MARQQRKQM

SEQ ID NO: 645183 - protein, 9 aa, Homo Sapiens
QKPTSGRQG

SEQ ID NO: 645184 - protein, 9 aa, Homo Sapiens
FPPILVVMA

SEQ ID NO: 645185 - protein, 9 aa, Homo Sapiens
LSCSETSLY

SEQ ID NO: 645186 - protein, 9 aa, Homo Sapiens
LAGLLTKNK

SEQ ID NO: 645187 - protein, 9 aa, Homo Sapiens
NNRRPSTEP

SEQ ID NO: 645188 - protein, 9 aa, Homo Sapiens
RKHFNSFFQ

SEQ ID NO: 645189 - protein, 9 aa, Homo Sapiens
NYFLNRDAH

SEQ ID NO: 645190 - protein, 9 aa, Homo Sapiens
LLMNSVSVE

SEQ ID NO: 645191 - protein, 9 aa, Homo Sapiens
LVVQVLGMV

SEQ ID NO: 645192 - protein, 9 aa, Homo Sapiens
VKAKAKKQQ

SEQ ID NO: 645193 - protein, 9 aa, Homo Sapiens
EGFSWRLPS

SEQ ID NO: 645194 - protein, 9 aa, Homo Sapiens
LAQSVSLQV

SEQ ID NO: 645195 - protein, 9 aa, Homo Sapiens
GTKLLERAE

SEQ ID NO: 645196 - protein, 9 aa, Homo Sapiens
IKAAARSAA

SEQ ID NO: 645197 - protein, 9 aa, Homo Sapiens
PAFGSPGRP

SEQ ID NO: 645198 - protein, 9 aa, Homo Sapiens
LVYLAEDTV

SEQ ID NO: 645199 - protein, 9 aa, Homo Sapiens
QSPFGTLYD

SEQ ID NO: 645200 - protein, 9 aa, Homo Sapiens
TLMCNISII

SEQ ID NO: 645201 - protein, 9 aa, Homo Sapiens
MDVTNAHLV

SEQ ID NO: 645202 - protein, 9 aa, Homo Sapiens
SPAIPPFLL

SEQ ID NO: 645203 - protein, 9 aa, Homo Sapiens
TLQSVLNNH

SEQ ID NO: 645204 - protein, 9 aa, Homo Sapiens
EGGLKFTWV

SEQ ID NO: 645205 - protein, 9 aa, Homo Sapiens
TEAVAGIIG

SEQ ID NO: 645206 - protein, 9 aa, Homo Sapiens
DFAHITCRL

SEQ ID NO: 645207 - protein, 9 aa, Homo Sapiens
FIPSGPSPR

SEQ ID NO: 645208 - protein, 9 aa, Homo Sapiens
KCRNECHDF

SEQ ID NO: 645209 - protein, 9 aa, Homo Sapiens
IDEARGHHR

SEQ ID NO: 645210 - protein, 9 aa, Homo Sapiens
CLRFLGSYR

SEQ ID NO: 645211 - protein, 9 aa, Homo Sapiens
WKCTGLSAT

SEQ ID NO: 645212 - protein, 9 aa, Homo Sapiens
ETDGIQKII

SEQ ID NO: 645213 - protein, 9 aa, Homo Sapiens
AGRQPTKPL

SEQ ID NO: 645214 - protein, 9 aa, Homo Sapiens
VFNKHRSTV

SEQ ID NO: 645215 - protein, 9 aa, Homo Sapiens
DTDKHIKEN

SEQ ID NO: 645216 - protein, 9 aa, Homo Sapiens
PDLRDLLPS

SEQ ID NO: 645217 - protein, 9 aa, Homo Sapiens
QQQFIFQQS

SEQ ID NO: 645218 - protein, 9 aa, Homo Sapiens
GYVTVFGLS

SEQ ID NO: 645219 - protein, 9 aa, Homo Sapiens
SDPRPISFS

SEQ ID NO: 645220 - protein, 9 aa, Homo Sapiens
SIAIIMVGI

SEQ ID NO: 645221 - protein, 9 aa, Homo Sapiens
KRHLIEGLK

SEQ ID NO: 645222 - protein, 9 aa, Homo Sapiens
NRRPSTEPS

SEQ ID NO: 645223 - protein, 9 aa, Homo Sapiens
SHTHTRVPF

SEQ ID NO: 645224 - protein, 9 aa, Homo Sapiens
CPASCSCTK

SEQ ID NO: 645225 - protein, 9 aa, Homo Sapiens
AAASGPSFW

SEQ ID NO: 645226 - protein, 9 aa, Homo Sapiens
RDLSPPCSN

SEQ ID NO: 645227 - protein, 9 aa, Homo Sapiens
PFSGLRSMQ

SEQ ID NO: 645228 - protein, 9 aa, Homo Sapiens
GGLKFTWVP

SEQ ID NO: 645229 - protein, 9 aa, Homo Sapiens
SGRQGSDPR

SEQ ID NO: 645230 - protein, 9 aa, Homo Sapiens
CEPFVPVFN

SEQ ID NO: 645231 - protein, 9 aa, Homo Sapiens
PELIDMNTV

SEQ ID NO: 645232 - protein, 9 aa, Homo Sapiens
AGQVFCVFH

SEQ ID NO: 645233 - protein, 9 aa, Homo Sapiens
GHHVYMLLD

SEQ ID NO: 645234 - protein, 9 aa, Homo Sapiens
QSEAPMEGF

SEQ ID NO: 645235 - protein, 9 aa, Homo Sapiens
FLLTYALVG

SEQ ID NO: 645236 - protein, 9 aa, Homo Sapiens
NPDAVASPY

SEQ ID NO: 645237 - protein, 9 aa, Homo Sapiens
ENAERLLDD

SEQ ID NO: 645238 - protein, 9 aa, Homo Sapiens
WEMDDTGPC

SEQ ID NO: 645239 - protein, 9 aa, Homo Sapiens
HPAKYTRIL

SEQ ID NO: 645240 - protein, 9 aa, Homo Sapiens
LEIPNFQQD

SEQ ID NO: 645241 - protein, 9 aa, Homo Sapiens
EEKTKKEAE

SEQ ID NO: 645242 - protein, 9 aa, Homo Sapiens
FCVFHALLG

SEQ ID NO: 645243 - protein, 9 aa, Homo Sapiens
LDCRKLPNN

SEQ ID NO: 645244 - protein, 9 aa, Homo Sapiens
LDLSVPKQM

SEQ ID NO: 645245 - protein, 9 aa, Homo Sapiens
FHYRFLSQL

SEQ ID NO: 645246 - protein, 9 aa, Homo Sapiens
FAFLDILSE

SEQ ID NO: 645247 - protein, 9 aa, Homo Sapiens
HEDVPWCRV

SEQ ID NO: 645248 - protein, 9 aa, Homo Sapiens
VPDYHKDIH

SEQ ID NO: 645249 - protein, 9 aa, Homo Sapiens
RQPTKPLVA

SEQ ID NO: 645250 - protein, 9 aa, Homo Sapiens
LCPARSVPS

SEQ ID NO: 645251 - protein, 9 aa, Homo Sapiens
AGIIGRADV

SEQ ID NO: 645252 - protein, 9 aa, Homo Sapiens
DKDLHAVGG

SEQ ID NO: 645253 - protein, 9 aa, Homo Sapiens
IGRADVLAC

SEQ ID NO: 645254 - protein, 9 aa, Homo Sapiens
KDLSDMDYL

SEQ ID NO: 645255 - protein, 9 aa, Homo Sapiens
SETDGIQKI

SEQ ID NO: 645256 - protein, 9 aa, Homo Sapiens
DHSSMSSYS

SEQ ID NO: 645257 - protein, 9 aa, Homo Sapiens
GPCLTRVVA

SEQ ID NO: 645258 - protein, 9 aa, Homo Sapiens
VADFIIMGL

SEQ ID NO: 645259 - protein, 9 aa, Homo Sapiens
KKWRPVSVS

SEQ ID NO: 645260 - protein, 9 aa, Homo Sapiens
LLIKFWRKE

SEQ ID NO: 645261 - protein, 9 aa, Homo Sapiens
PQSFRNTIE

SEQ ID NO: 645262 - protein, 9 aa, Homo Sapiens
VMSRNSGRR

SEQ ID NO: 645263 - protein, 9 aa, Homo Sapiens
SMSSRSMPG

SEQ ID NO: 645264 - protein, 9 aa, Homo Sapiens
PAPPWKEHP

SEQ ID NO: 645265 - protein, 9 aa, Homo Sapiens
WDFVLKSGL

SEQ ID NO: 645266 - protein, 9 aa, Homo Sapiens
ILSRATTRP

SEQ ID NO: 645267 - protein, 9 aa, Homo Sapiens
CVVQASDLF

SEQ ID NO: 645268 - protein, 9 aa, Homo Sapiens
ETQKWFKLR

SEQ ID NO: 645269 - protein, 9 aa, Homo Sapiens
SQDAPVNAL

SEQ ID NO: 645270 - protein, 9 aa, Homo Sapiens
CTVDRVVLM

SEQ ID NO: 645271 - protein, 9 aa, Homo Sapiens
LEKPTLPHA

SEQ ID NO: 645272 - protein, 9 aa, Homo Sapiens
WFKLRLAKW

SEQ ID NO: 645273 - protein, 9 aa, Homo Sapiens
HRSSKENFI

SEQ ID NO: 645274 - protein, 9 aa, Homo Sapiens
GNYFASQFF

SEQ ID NO: 645275 - protein, 9 aa, Homo Sapiens
ASSPTRIPT

SEQ ID NO: 645276 - protein, 9 aa, Homo Sapiens
QAKGIPQMA

SEQ ID NO: 645277 - protein, 9 aa, Homo Sapiens
TRYPTPTPP

SEQ ID NO: 645278 - protein, 9 aa, Homo Sapiens
VTLACIDTW

SEQ ID NO: 645279 - protein, 9 aa, Homo Sapiens
IPDLANMWR

SEQ ID NO: 645280 - protein, 9 aa, Homo Sapiens
VPWCRVEGH

SEQ ID NO: 645281 - protein, 9 aa, Homo Sapiens
TFHSVPGST

SEQ ID NO: 645282 - protein, 9 aa, Homo Sapiens
LCFLCFLLT

SEQ ID NO: 645283 - protein, 9 aa, Homo Sapiens
YITRRDTFN

SEQ ID NO: 645284 - protein, 9 aa, Homo Sapiens
RAVLAYPCV

SEQ ID NO: 645285 - protein, 9 aa, Homo Sapiens
AEVKDLNKR

SEQ ID NO: 645286 - protein, 9 aa, Homo Sapiens
ENATPKLLL

SEQ ID NO: 645287 - protein, 9 aa, Homo Sapiens
PTTSPGHHV

SEQ ID NO: 645288 - protein, 9 aa, Homo Sapiens
DEQVPILVV

SEQ ID NO: 645289 - protein, 9 aa, Homo Sapiens
PASCSCTKE

SEQ ID NO: 645290 - protein, 9 aa, Homo Sapiens
AKLTMHIEQ

SEQ ID NO: 645291 - protein, 9 aa, Homo Sapiens
VKKEDIWPS

SEQ ID NO: 645292 - protein, 9 aa, Homo Sapiens
EERKHRIEQ

SEQ ID NO: 645293 - protein, 9 aa, Homo Sapiens
GLSATAITV

SEQ ID NO: 645294 - protein, 9 aa, Homo Sapiens
DVWMIQNGI

SEQ ID NO: 645295 - protein, 9 aa, Homo Sapiens
MPCRRSSRS

SEQ ID NO: 645296 - protein, 9 aa, Homo Sapiens
GSFSARWPV

SEQ ID NO: 645297 - protein, 9 aa, Homo Sapiens
ERKHRIEQD

SEQ ID NO: 645298 - protein, 9 aa, Homo Sapiens
AMHLSITHR

SEQ ID NO: 645299 - protein, 9 aa, Homo Sapiens
PQQKEIPTH

SEQ ID NO: 645300 - protein, 9 aa, Homo Sapiens
EVKDLNKRI

SEQ ID NO: 645301 - protein, 9 aa, Homo Sapiens
VYITEFYNK

SEQ ID NO: 645302 - protein, 9 aa, Homo Sapiens
GKLTASERI

SEQ ID NO: 645303 - protein, 9 aa, Homo Sapiens
MGQGGEDAH

SEQ ID NO: 645304 - protein, 9 aa, Homo Sapiens
EDVAIDFTE

SEQ ID NO: 645305 - protein, 9 aa, Homo Sapiens
LFERELGVN

SEQ ID NO: 645306 - protein, 9 aa, Homo Sapiens
PILVVQVLG

SEQ ID NO: 645307 - protein, 9 aa, Homo Sapiens
KRLYLRTWT

SEQ ID NO: 645308 - protein, 9 aa, Homo Sapiens
PLVLHWNPG

SEQ ID NO: 645309 - protein, 9 aa, Homo Sapiens
AFQRNRSLL

SEQ ID NO: 645310 - protein, 9 aa, Homo Sapiens
NYHPAKYTR

SEQ ID NO: 645311 - protein, 9 aa, Homo Sapiens
SSRSGTSLL

SEQ ID NO: 645312 - protein, 9 aa, Homo Sapiens
WDDWQSIDT

SEQ ID NO: 645313 - protein, 9 aa, Homo Sapiens
RVPFNGIFN

SEQ ID NO: 645314 - protein, 9 aa, Homo Sapiens
AGADTGDVA

SEQ ID NO: 645315 - protein, 9 aa, Homo Sapiens
QKWFKLRLA

SEQ ID NO: 645316 - protein, 9 aa, Homo Sapiens
GGWLFWDDW

SEQ ID NO: 645317 - protein, 9 aa, Homo Sapiens
KGARRSHRS

SEQ ID NO: 645318 - protein, 9 aa, Homo Sapiens
TRVVAQLRA

SEQ ID NO: 645319 - protein, 9 aa, Homo Sapiens
KEFRKLEES

SEQ ID NO: 645320 - protein, 9 aa, Homo Sapiens
MKYKTTKQS

SEQ ID NO: 645321 - protein, 9 aa, Homo Sapiens
VLVWISYQV

SEQ ID NO: 645322 - protein, 9 aa, Homo Sapiens
RNNNSSRLG

SEQ ID NO: 645323 - protein, 9 aa, Homo Sapiens
LVYYITRRD

SEQ ID NO: 645324 - protein, 9 aa, Homo Sapiens
LPGQYPTEE

SEQ ID NO: 645325 - protein, 9 aa, Homo Sapiens
KAKAKKQQI

SEQ ID NO: 645326 - protein, 9 aa, Homo Sapiens
SSEFDEKQI

SEQ ID NO: 645327 - protein, 9 aa, Homo Sapiens
TCCPVAWGH

SEQ ID NO: 645328 - protein, 9 aa, Homo Sapiens
GAPQKICTY

SEQ ID NO: 645329 - protein, 9 aa, Homo Sapiens
FQQSEAPME

SEQ ID NO: 645330 - protein, 9 aa, Homo Sapiens
CLLMNSVSV

SEQ ID NO: 645331 - protein, 9 aa, Homo Sapiens
QLVLKICLA

SEQ ID NO: 645332 - protein, 9 aa, Homo Sapiens
IRLVRCPPV

SEQ ID NO: 645333 - protein, 9 aa, Homo Sapiens
NFAFLDILS

SEQ ID NO: 645334 - protein, 9 aa, Homo Sapiens
TGWEYCAIK

SEQ ID NO: 645335 - protein, 9 aa, Homo Sapiens
LEYDFISDC

SEQ ID NO: 645336 - protein, 9 aa, Homo Sapiens
IEPDSAAER

SEQ ID NO: 645337 - protein, 9 aa, Homo Sapiens
YRDLSPPCS

SEQ ID NO: 645338 - protein, 9 aa, Homo Sapiens
NPVLINNAS

SEQ ID NO: 645339 - protein, 9 aa, Homo Sapiens
FTEEEWDMM

SEQ ID NO: 645340 - protein, 9 aa, Homo Sapiens
GLCFLCFLL

SEQ ID NO: 645341 - protein, 9 aa, Homo Sapiens
YENALEKGL

SEQ ID NO: 645342 - protein, 9 aa, Homo Sapiens
AGALLVYYI

SEQ ID NO: 645343 - protein, 9 aa, Homo Sapiens
TLEGFSWRL

SEQ ID NO: 645344 - protein, 9 aa, Homo Sapiens
QPPEEVCAT

SEQ ID NO: 645345 - protein, 9 aa, Homo Sapiens
SVKVQERYY

SEQ ID NO: 645346 - protein, 9 aa, Homo Sapiens
QLHSVDEFH

SEQ ID NO: 645347 - protein, 9 aa, Homo Sapiens
FHALLGIPL

SEQ ID NO: 645348 - protein, 9 aa, Homo Sapiens
ASLELPEGK

SEQ ID NO: 645349 - protein, 9 aa, Homo Sapiens
NRSLLKKDY

SEQ ID NO: 645350 - protein, 9 aa, Homo Sapiens
NCSTLLATI

SEQ ID NO: 645351 - protein, 9 aa, Homo Sapiens
LGQDIKLSF

SEQ ID NO: 645352 - protein, 9 aa, Homo Sapiens
PLNFAFLDI

SEQ ID NO: 645353 - protein, 9 aa, Homo Sapiens
SEFDEKQIN

SEQ ID NO: 645354 - protein, 9 aa, Homo Sapiens
DVTNAHLVN

SEQ ID NO: 645355 - protein, 9 aa, Homo Sapiens
SVEEGSNIQ

SEQ ID NO: 645356 - protein, 9 aa, Homo Sapiens
TKANPVWLD

SEQ ID NO: 645357 - protein, 9 aa, Homo Sapiens
MSRNSGRRG

SEQ ID NO: 645358 - protein, 9 aa, Homo Sapiens
YRFLSQLSK

SEQ ID NO: 645359 - protein, 9 aa, Homo Sapiens
SRVISSSPA

SEQ ID NO: 645360 - protein, 9 aa, Homo Sapiens
SRVQPEPRA

SEQ ID NO: 645361 - protein, 9 aa, Homo Sapiens
VNALAQSVS

SEQ ID NO: 645362 - protein, 9 aa, Homo Sapiens
LLTYALVGA

SEQ ID NO: 645363 - protein, 9 aa, Homo Sapiens
SHYGNTYGG

SEQ ID NO: 645364 - protein, 9 aa, Homo Sapiens
FDEKQINVA

SEQ ID NO: 645365 - protein, 9 aa, Homo Sapiens
VTLMCNISI

SEQ ID NO: 645366 - protein, 9 aa, Homo Sapiens
LQMARQQRK

SEQ ID NO: 645367 - protein, 9 aa, Homo Sapiens
KLDTVGDFL

SEQ ID NO: 645368 - protein, 9 aa, Homo Sapiens
AEPLDLSVP

SEQ ID NO: 645369 - protein, 9 aa, Homo Sapiens
SNMKYKTTK

SEQ ID NO: 645370 - protein, 9 aa, Homo Sapiens
TFEDAANIL

SEQ ID NO: 645371 - protein, 9 aa, Homo Sapiens
RKVFLEKPT

SEQ ID NO: 645372 - protein, 9 aa, Homo Sapiens
VQERYYSAV

SEQ ID NO: 645373 - protein, 9 aa, Homo Sapiens
SSVLNTSQS

SEQ ID NO: 645374 - protein, 9 aa, Homo Sapiens
LPPPPATTT

SEQ ID NO: 645375 - protein, 9 aa, Homo Sapiens
ESHPPLNFA

SEQ ID NO: 645376 - protein, 9 aa, Homo Sapiens
EPINKRLYL

SEQ ID NO: 645377 - protein, 9 aa, Homo Sapiens
GYRLNSHYG

SEQ ID NO: 645378 - protein, 9 aa, Homo Sapiens
RELGVNPSQ

SEQ ID NO: 645379 - protein, 9 aa, Homo Sapiens
TLQASRVQP

SEQ ID NO: 645380 - protein, 9 aa, Homo Sapiens
TRCGIQSFF

SEQ ID NO: 645381 - protein, 9 aa, Homo Sapiens
NDSNFTETI

SEQ ID NO: 645382 - protein, 9 aa, Homo Sapiens
MIDFAHITC

SEQ ID NO: 645383 - protein, 9 aa, Homo Sapiens
SCKLNEVWH

SEQ ID NO: 645384 - protein, 9 aa, Homo Sapiens
MTDPAFGSP

SEQ ID NO: 645385 - protein, 9 aa, Homo Sapiens
YFLNRDAHI

SEQ ID NO: 645386 - protein, 9 aa, Homo Sapiens
DLANMWRTL

SEQ ID NO: 645387 - protein, 9 aa, Homo Sapiens
PRHRVIQPT

SEQ ID NO: 645388 - protein, 9 aa, Homo Sapiens
PILVVMASA

SEQ ID NO: 645389 - protein, 9 aa, Homo Sapiens
RGGYRLNSH

SEQ ID NO: 645390 - protein, 9 aa, Homo Sapiens
MKEFRKLEE

SEQ ID NO: 645391 - protein, 9 aa, Homo Sapiens
ALLVYYITR

SEQ ID NO: 645392 - protein, 9 aa, Homo Sapiens
VKAFLQKAH

SEQ ID NO: 645393 - protein, 9 aa, Homo Sapiens
RHPHRPPPF

SEQ ID NO: 645394 - protein, 9 aa, Homo Sapiens
RRLQQLPSS

SEQ ID NO: 645395 - protein, 9 aa, Homo Sapiens
CGVPAFSHT

SEQ ID NO: 645396 - protein, 9 aa, Homo Sapiens
SSSGRSNER

SEQ ID NO: 645397 - protein, 9 aa, Homo Sapiens
RRSSSGRSN

SEQ ID NO: 645398 - protein, 9 aa, Homo Sapiens
NAHLVNKFW

SEQ ID NO: 645399 - protein, 9 aa, Homo Sapiens
KEIPTHLSL

SEQ ID NO: 645400 - protein, 9 aa, Homo Sapiens
DNEPNNKRS

SEQ ID NO: 645401 - protein, 9 aa, Homo Sapiens
EYENALEKG

SEQ ID NO: 645402 - protein, 9 aa, Homo Sapiens
QRDEPVPGT

SEQ ID NO: 645403 - protein, 9 aa, Homo Sapiens
QCEPFVPVF

SEQ ID NO: 645404 - protein, 9 aa, Homo Sapiens
DAVASPYCY

SEQ ID NO: 645405 - protein, 9 aa, Homo Sapiens
TEMLETIPE

SEQ ID NO: 645406 - protein, 9 aa, Homo Sapiens
PKQDGGEHN

SEQ ID NO: 645407 - protein, 9 aa, Homo Sapiens
QQKEIPTHL

SEQ ID NO: 645408 - protein, 9 aa, Homo Sapiens
DIATLEGFS

SEQ ID NO: 645409 - protein, 9 aa, Homo Sapiens
VQAFKFWDF

SEQ ID NO: 645410 - protein, 9 aa, Homo Sapiens
PNNKRSNED

SEQ ID NO: 645411 - protein, 9 aa, Homo Sapiens
EEEWDMMDT

SEQ ID NO: 645412 - protein, 9 aa, Homo Sapiens
NGILIESGI

SEQ ID NO: 645413 - protein, 9 aa, Homo Sapiens
VGDFLDCEH

SEQ ID NO: 645414 - protein, 9 aa, Homo Sapiens
ASERISLLL

SEQ ID NO: 645415 - protein, 9 aa, Homo Sapiens
VLLSPAPPP

SEQ ID NO: 645416 - protein, 9 aa, Homo Sapiens
IMNNDSNFT

SEQ ID NO: 645417 - protein, 9 aa, Homo Sapiens
GEDAHHTRS

SEQ ID NO: 645418 - protein, 9 aa, Homo Sapiens
KKEKDLGLP

SEQ ID NO: 645419 - protein, 9 aa, Homo Sapiens
VRPLVIQKL

SEQ ID NO: 645420 - protein, 9 aa, Homo Sapiens
LAHFAPISP

SEQ ID NO: 645421 - protein, 9 aa, Homo Sapiens
ITLQASRVQ

SEQ ID NO: 645422 - protein, 9 aa, Homo Sapiens
EFHLLQLRS

SEQ ID NO: 645423 - protein, 9 aa, Homo Sapiens
NNDSNFTET

SEQ ID NO: 645424 - protein, 9 aa, Homo Sapiens
YSENLSYVE

SEQ ID NO: 645425 - protein, 9 aa, Homo Sapiens
QQLPSSIKQ

SEQ ID NO: 645426 - protein, 9 aa, Homo Sapiens
HTRGPRLCL

SEQ ID NO: 645427 - protein, 9 aa, Homo Sapiens
TCDSGAPGP

SEQ ID NO: 645428 - protein, 9 aa, Homo Sapiens
LVWISYQVE

SEQ ID NO: 645429 - protein, 9 aa, Homo Sapiens
ERWDPQSQK

SEQ ID NO: 645430 - protein, 9 aa, Homo Sapiens
FAQSPFGTL

SEQ ID NO: 645431 - protein, 9 aa, Homo Sapiens
VFHALLGIP

SEQ ID NO: 645432 - protein, 9 aa, Homo Sapiens
IENSHVKKE

SEQ ID NO: 645433 - protein, 9 aa, Homo Sapiens
PPPPATTTR

SEQ ID NO: 645434 - protein, 9 aa, Homo Sapiens
NSVSVEEGS

SEQ ID NO: 645435 - protein, 9 aa, Homo Sapiens
PQMAPPKRK

SEQ ID NO: 645436 - protein, 9 aa, Homo Sapiens
SYVVPSTSK

SEQ ID NO: 645437 - protein, 9 aa, Homo Sapiens
HLIDQYFKN

SEQ ID NO: 645438 - protein, 9 aa, Homo Sapiens
GIYVVTLMC

SEQ ID NO: 645439 - protein, 9 aa, Homo Sapiens
SGYVTVFGL

SEQ ID NO: 645440 - protein, 9 aa, Homo Sapiens
KPTPPAPVL

SEQ ID NO: 645441 - protein, 9 aa, Homo Sapiens
VRYTFADGE

SEQ ID NO: 645442 - protein, 9 aa, Homo Sapiens
DTVGDFLDC

SEQ ID NO: 645443 - protein, 9 aa, Homo Sapiens
HEIRNYPYR

SEQ ID NO: 645444 - protein, 9 aa, Homo Sapiens
GLFSKWIPY

SEQ ID NO: 645445 - protein, 9 aa, Homo Sapiens
APSISIAII

SEQ ID NO: 645446 - protein, 9 aa, Homo Sapiens
HKYRPELID

SEQ ID NO: 645447 - protein, 9 aa, Homo Sapiens
EDIWPSGGQ

SEQ ID NO: 645448 - protein, 9 aa, Homo Sapiens
VPGSPLRPA

SEQ ID NO: 645449 - protein, 9 aa, Homo Sapiens
WDPQSQKWT

SEQ ID NO: 645450 - protein, 9 aa, Homo Sapiens
ADQVYITEF

SEQ ID NO: 645451 - protein, 9 aa, Homo Sapiens
NKSISFTRC

SEQ ID NO: 645452 - protein, 9 aa, Homo Sapiens
SMTEWERGL

SEQ ID NO: 645453 - protein, 9 aa, Homo Sapiens
NKRLYLRTW

SEQ ID NO: 645454 - protein, 9 aa, Homo Sapiens
RRLARCPAS

SEQ ID NO: 645455 - protein, 9 aa, Homo Sapiens
ERELGVNPS

SEQ ID NO: 645456 - protein, 9 aa, Homo Sapiens
VRKWGGFLG

SEQ ID NO: 645457 - protein, 9 aa, Homo Sapiens
MKDVYTEKK

SEQ ID NO: 645458 - protein, 9 aa, Homo Sapiens
NMKYKTTKQ

SEQ ID NO: 645459 - protein, 9 aa, Homo Sapiens
EGQRVIQIA

SEQ ID NO: 645460 - protein, 9 aa, Homo Sapiens
CKLNEVWHL

SEQ ID NO: 645461 - protein, 9 aa, Homo Sapiens
LEHAHLIVV

SEQ ID NO: 645462 - protein, 9 aa, Homo Sapiens
TWELENTAL

SEQ ID NO: 645463 - protein, 9 aa, Homo Sapiens
YAAEYENAL

SEQ ID NO: 645464 - protein, 9 aa, Homo Sapiens
AIIHKYRPE

SEQ ID NO: 645465 - protein, 9 aa, Homo Sapiens
VSVEEGSNI

SEQ ID NO: 645466 - protein, 9 aa, Homo Sapiens
FSACLVKED

SEQ ID NO: 645467 - protein, 9 aa, Homo Sapiens
PEICKAVWP

SEQ ID NO: 645468 - protein, 9 aa, Homo Sapiens
PQIPVRKWG

SEQ ID NO: 645469 - protein, 9 aa, Homo Sapiens
SVRPLVIQK

SEQ ID NO: 645470 - protein, 9 aa, Homo Sapiens
QLLNAHLSV

SEQ ID NO: 645471 - protein, 9 aa, Homo Sapiens
YILDARKTN

SEQ ID NO: 645472 - protein, 9 aa, Homo Sapiens
IAMHLSITH

SEQ ID NO: 645473 - protein, 9 aa, Homo Sapiens
SGIYPVHVQ

SEQ ID NO: 645474 - protein, 9 aa, Homo Sapiens
AAARSAALQ

SEQ ID NO: 645475 - protein, 9 aa, Homo Sapiens
ETTVKTSYI

SEQ ID NO: 645476 - protein, 9 aa, Homo Sapiens
HYGNTYGGD

SEQ ID NO: 645477 - protein, 9 aa, Homo Sapiens
RLYLRTWTN

SEQ ID NO: 645478 - protein, 9 aa, Homo Sapiens
KHVRPQIPV

SEQ ID NO: 645479 - protein, 9 aa, Homo Sapiens
LSNPVLINN

SEQ ID NO: 645480 - protein, 9 aa, Homo Sapiens
GEHNGGMQC

SEQ ID NO: 645481 - protein, 9 aa, Homo Sapiens
EKTKKEAEK

SEQ ID NO: 645482 - protein, 9 aa, Homo Sapiens
HKRGKLTAS

SEQ ID NO: 645483 - protein, 9 aa, Homo Sapiens
CRKLPNNND

SEQ ID NO: 645484 - protein, 9 aa, Homo Sapiens
KWFKLRLAK

SEQ ID NO: 645485 - protein, 9 aa, Homo Sapiens
RNECHDFEK

SEQ ID NO: 645486 - protein, 9 aa, Homo Sapiens
TGRIPIYSF

SEQ ID NO: 645487 - protein, 9 aa, Homo Sapiens
RYTFADGET

SEQ ID NO: 645488 - protein, 9 aa, Homo Sapiens
ARPLPKSGQ

SEQ ID NO: 645489 - protein, 9 aa, Homo Sapiens
LMNSVSVEE

SEQ ID NO: 645490 - protein, 9 aa, Homo Sapiens
DPRPISFST

SEQ ID NO: 645491 - protein, 9 aa, Homo Sapiens
AGAQRDEPV

SEQ ID NO: 645492 - protein, 9 aa, Homo Sapiens
LTYALVGAV

SEQ ID NO: 645493 - protein, 9 aa, Homo Sapiens
LSSWAVNYH

SEQ ID NO: 645494 - protein, 9 aa, Homo Sapiens
RNPDAVASP

SEQ ID NO: 645495 - protein, 9 aa, Homo Sapiens
NYAAEYENA

SEQ ID NO: 645496 - protein, 9 aa, Homo Sapiens
PVNALAQSV

SEQ ID NO: 645497 - protein, 9 aa, Homo Sapiens
RVIFGPNKV

SEQ ID NO: 645498 - protein, 9 aa, Homo Sapiens
LGGGTSLLY

SEQ ID NO: 645499 - protein, 9 aa, Homo Sapiens
FKGHTCDSG

SEQ ID NO: 645500 - protein, 9 aa, Homo Sapiens
KLRLAKWRR

SEQ ID NO: 645501 - protein, 9 aa, Homo Sapiens
SKLATWDSE

SEQ ID NO: 645502 - protein, 9 aa, Homo Sapiens
KYMVRYTFA

SEQ ID NO: 645503 - protein, 9 aa, Homo Sapiens
GQGGEDAHH

SEQ ID NO: 645504 - protein, 9 aa, Homo Sapiens
GPVLNMPTS

SEQ ID NO: 645505 - protein, 9 aa, Homo Sapiens
WTCLLSLLL

SEQ ID NO: 645506 - protein, 9 aa, Homo Sapiens
AERLLDDND

SEQ ID NO: 645507 - protein, 9 aa, Homo Sapiens
NMWRTLMER

SEQ ID NO: 645508 - protein, 9 aa, Homo Sapiens
GNILSSKVM

SEQ ID NO: 645509 - protein, 9 aa, Homo Sapiens
FFTSVLGGR

SEQ ID NO: 645510 - protein, 9 aa, Homo Sapiens
YVVTLMCNI

SEQ ID NO: 645511 - protein, 9 aa, Homo Sapiens
HWNPGRKLP

SEQ ID NO: 645512 - protein, 9 aa, Homo Sapiens
NEFDDKFED

SEQ ID NO: 645513 - protein, 9 aa, Homo Sapiens
EKPTLPHAP

SEQ ID NO: 645514 - protein, 9 aa, Homo Sapiens
LLSLLLMVG

SEQ ID NO: 645515 - protein, 9 aa, Homo Sapiens
QMARQQRKQ

SEQ ID NO: 645516 - protein, 9 aa, Homo Sapiens
TYQKPTSGR

SEQ ID NO: 645517 - protein, 9 aa, Homo Sapiens
QPSSPNPDG

SEQ ID NO: 645518 - protein, 9 aa, Homo Sapiens
GLRSMQMPC

SEQ ID NO: 645519 - protein, 9 aa, Homo Sapiens
ISDLEEGLG

SEQ ID NO: 645520 - protein, 9 aa, Homo Sapiens
MYDEHGERR

SEQ ID NO: 645521 - protein, 9 aa, Homo Sapiens
GHTCDSGAP

SEQ ID NO: 645522 - protein, 9 aa, Homo Sapiens
AVQTEMLET

SEQ ID NO: 645523 - protein, 9 aa, Homo Sapiens
EFDEKQINV

SEQ ID NO: 645524 - protein, 9 aa, Homo Sapiens
AAPASPPFS

SEQ ID NO: 645525 - protein, 9 aa, Homo Sapiens
ASCSCTKES

SEQ ID NO: 645526 - protein, 9 aa, Homo Sapiens
CITADLQLN

SEQ ID NO: 645527 - protein, 9 aa, Homo Sapiens
HSGEKPYKF

SEQ ID NO: 645528 - protein, 9 aa, Homo Sapiens
RLQLLNAHL

SEQ ID NO: 645529 - protein, 9 aa, Homo Sapiens
GIQPEICKA

SEQ ID NO: 645530 - protein, 9 aa, Homo Sapiens
DQVYITEFY

SEQ ID NO: 645531 - protein, 9 aa, Homo Sapiens
PLLSNPVLI

SEQ ID NO: 645532 - protein, 9 aa, Homo Sapiens
YVEDDHIPA

SEQ ID NO: 645533 - protein, 9 aa, Homo Sapiens
GVVLLLAAV

SEQ ID NO: 645534 - protein, 9 aa, Homo Sapiens
EPQQKEIPT

SEQ ID NO: 645535 - protein, 9 aa, Homo Sapiens
DDTKDHSSM

SEQ ID NO: 645536 - protein, 9 aa, Homo Sapiens
VRMIDFAHI

SEQ ID NO: 645537 - protein, 9 aa, Homo Sapiens
RNEYGPVLN

SEQ ID NO: 645538 - protein, 9 aa, Homo Sapiens
LLSNPVLIN

SEQ ID NO: 645539 - protein, 9 aa, Homo Sapiens
VYYITRRDT

SEQ ID NO: 645540 - protein, 9 aa, Homo Sapiens
SAPLVLHWN

SEQ ID NO: 645541 - protein, 9 aa, Homo Sapiens
LWAMMKTNR

SEQ ID NO: 645542 - protein, 9 aa, Homo Sapiens
PFLLQGSCS

SEQ ID NO: 645543 - protein, 9 aa, Homo Sapiens
SFGLFSKWI

SEQ ID NO: 645544 - protein, 9 aa, Homo Sapiens
HTGWEYCAI

SEQ ID NO: 645545 - protein, 9 aa, Homo Sapiens
PPASPAPPW

SEQ ID NO: 645546 - protein, 9 aa, Homo Sapiens
PSLPGQYPT

SEQ ID NO: 645547 - protein, 9 aa, Homo Sapiens
TRLASSDDD

SEQ ID NO: 645548 - protein, 9 aa, Homo Sapiens
LSTLQSVLN

SEQ ID NO: 645549 - protein, 9 aa, Homo Sapiens
GGEHNGGMQ

SEQ ID NO: 645550 - protein, 9 aa, Homo Sapiens
PGALTCCPV

SEQ ID NO: 645551 - protein, 9 aa, Homo Sapiens
SHTKANPVW

SEQ ID NO: 645552 - protein, 9 aa, Homo Sapiens
AFGNILSSK

SEQ ID NO: 645553 - protein, 9 aa, Homo Sapiens
VLGGREKEE

SEQ ID NO: 645554 - protein, 9 aa, Homo Sapiens
SSRLGKYMD

SEQ ID NO: 645555 - protein, 9 aa, Homo Sapiens
SLLKKDYDD

SEQ ID NO: 645556 - protein, 9 aa, Homo Sapiens
SVLNTSQSY

SEQ ID NO: 645557 - protein, 9 aa, Homo Sapiens
VPKQMKEPK

SEQ ID NO: 645558 - protein, 9 aa, Homo Sapiens
TKKEAEKKA

SEQ ID NO: 645559 - protein, 9 aa, Homo Sapiens
SEGPHLSSR

SEQ ID NO: 645560 - protein, 9 aa, Homo Sapiens
EEGLGRLGK

SEQ ID NO: 645561 - protein, 9 aa, Homo Sapiens
KYKTTKQST

SEQ ID NO: 645562 - protein, 9 aa, Homo Sapiens
PDLANMWRT

SEQ ID NO: 645563 - protein, 9 aa, Homo Sapiens
ISFTRCGIQ

SEQ ID NO: 645564 - protein, 9 aa, Homo Sapiens
QAKQGHQEN

SEQ ID NO: 645565 - protein, 9 aa, Homo Sapiens
MGCVVQASD

SEQ ID NO: 645566 - protein, 9 aa, Homo Sapiens
QAFKFWDFV

SEQ ID NO: 645567 - protein, 9 aa, Homo Sapiens
PFVPVFNKH

SEQ ID NO: 645568 - protein, 9 aa, Homo Sapiens
GKDEQVPIL

SEQ ID NO: 645569 - protein, 9 aa, Homo Sapiens
EYGPVLNMP

SEQ ID NO: 645570 - protein, 9 aa, Homo Sapiens
FVDCGMFAT

SEQ ID NO: 645571 - protein, 9 aa, Homo Sapiens
DFISDCQVF

SEQ ID NO: 645572 - protein, 9 aa, Homo Sapiens
GEYVNILTG

SEQ ID NO: 645573 - protein, 9 aa, Homo Sapiens
VDCGMFATE

SEQ ID NO: 645574 - protein, 9 aa, Homo Sapiens
DVYTEKKAR

SEQ ID NO: 645575 - protein, 9 aa, Homo Sapiens
AKVVLHLID

SEQ ID NO: 645576 - protein, 9 aa, Homo Sapiens
VISSSPADT

SEQ ID NO: 645577 - protein, 9 aa, Homo Sapiens
EGKSTTKTV

SEQ ID NO: 645578 - protein, 9 aa, Homo Sapiens
SFELQGNLI

SEQ ID NO: 645579 - protein, 9 aa, Homo Sapiens
ASPPFSSSS

SEQ ID NO: 645580 - protein, 9 aa, Homo Sapiens
SNERHREHR

SEQ ID NO: 645581 - protein, 9 aa, Homo Sapiens
TRTQEGSFS

SEQ ID NO: 645582 - protein, 9 aa, Homo Sapiens
HHVYMLLDP

SEQ ID NO: 645583 - protein, 9 aa, Homo Sapiens
RLQQLPSSI

SEQ ID NO: 645584 - protein, 9 aa, Homo Sapiens
RPSTEPSEI

SEQ ID NO: 645585 - protein, 9 aa, Homo Sapiens
RTGDVPGSP

SEQ ID NO: 645586 - protein, 9 aa, Homo Sapiens
NTVFYFLLG

SEQ ID NO: 645587 - protein, 9 aa, Homo Sapiens
EPKAAVQKD

SEQ ID NO: 645588 - protein, 9 aa, Homo Sapiens
APVNALAQS

SEQ ID NO: 645589 - protein, 9 aa, Homo Sapiens
EGLPDLRDL

SEQ ID NO: 645590 - protein, 9 aa, Homo Sapiens
FRSARPLPK

SEQ ID NO: 645591 - protein, 9 aa, Homo Sapiens
HPPLNFAFL

SEQ ID NO: 645592 - protein, 9 aa, Homo Sapiens
IGGSTDTDK

SEQ ID NO: 645593 - protein, 9 aa, Homo Sapiens
NILTGMPCH

SEQ ID NO: 645594 - protein, 9 aa, Homo Sapiens
LERAELVLR

SEQ ID NO: 645595 - protein, 9 aa, Homo Sapiens
AEGPCLTRV

SEQ ID NO: 645596 - protein, 9 aa, Homo Sapiens
GVNPSQQPV

SEQ ID NO: 645597 - protein, 9 aa, Homo Sapiens
SFDGLEYDF

SEQ ID NO: 645598 - protein, 9 aa, Homo Sapiens
NNKRSNEDC

SEQ ID NO: 645599 - protein, 9 aa, Homo Sapiens
EMDDTGPCG

SEQ ID NO: 645600 - protein, 9 aa, Homo Sapiens
PLPRAVLAY

SEQ ID NO: 645601 - protein, 9 aa, Homo Sapiens
LLLLLCSQI

SEQ ID NO: 645602 - protein, 9 aa, Homo Sapiens
IVSPLLYNV

SEQ ID NO: 645603 - protein, 9 aa, Homo Sapiens
CKQVFPGMN

SEQ ID NO: 645604 - protein, 9 aa, Homo Sapiens
ANMWRTLME

SEQ ID NO: 645605 - protein, 9 aa, Homo Sapiens
FIMRGKCRN

SEQ ID NO: 645606 - protein, 9 aa, Homo Sapiens
FYTTGKRRS

SEQ ID NO: 645607 - protein, 9 aa, Homo Sapiens
CDSGAPGPR

SEQ ID NO: 645608 - protein, 9 aa, Homo Sapiens
SLFTTSPLI

SEQ ID NO: 645609 - protein, 9 aa, Homo Sapiens
DKYMVRYTF

SEQ ID NO: 645610 - protein, 9 aa, Homo Sapiens
EDAHHTRSP

SEQ ID NO: 645611 - protein, 9 aa, Homo Sapiens
DSQDAPVNA

SEQ ID NO: 645612 - protein, 9 aa, Homo Sapiens
ELYGVVLLL

SEQ ID NO: 645613 - protein, 9 aa, Homo Sapiens
EIQPSSPNP

SEQ ID NO: 645614 - protein, 9 aa, Homo Sapiens
GAEGGGGGG

SEQ ID NO: 645615 - protein, 9 aa, Homo Sapiens
TVGDFLDCE

SEQ ID NO: 645616 - protein, 9 aa, Homo Sapiens
ARCPASCSC

SEQ ID NO: 645617 - protein, 9 aa, Homo Sapiens
EKLHIPQFT

SEQ ID NO: 645618 - protein, 9 aa, Homo Sapiens
RAPQDQTNQ

SEQ ID NO: 645619 - protein, 9 aa, Homo Sapiens
VLAGLLTKN

SEQ ID NO: 645620 - protein, 9 aa, Homo Sapiens
CEKAFVCKA

SEQ ID NO: 645621 - protein, 9 aa, Homo Sapiens
QTHEPRQWG

SEQ ID NO: 645622 - protein, 9 aa, Homo Sapiens
IEEVDKDGS

SEQ ID NO: 645623 - protein, 9 aa, Homo Sapiens
LVLKICLAH

SEQ ID NO: 645624 - protein, 9 aa, Homo Sapiens
KPQAKQGHQ

SEQ ID NO: 645625 - protein, 9 aa, Homo Sapiens
CSSPAIPPF

SEQ ID NO: 645626 - protein, 9 aa, Homo Sapiens
RKLAELDEF

SEQ ID NO: 645627 - protein, 9 aa, Homo Sapiens
LENATPKLL

SEQ ID NO: 645628 - protein, 9 aa, Homo Sapiens
KTDSSSLCP

SEQ ID NO: 645629 - protein, 9 aa, Homo Sapiens
ENTALEEGN

SEQ ID NO: 645630 - protein, 9 aa, Homo Sapiens
YRQLHFLAL

SEQ ID NO: 645631 - protein, 9 aa, Homo Sapiens
YKVSSVLNT

SEQ ID NO: 645632 - protein, 9 aa, Homo Sapiens
PWSPRHRVI

SEQ ID NO: 645633 - protein, 9 aa, Homo Sapiens
KIRDSNCST

SEQ ID NO: 645634 - protein, 9 aa, Homo Sapiens
FDGLEYDFI

SEQ ID NO: 645635 - protein, 9 aa, Homo Sapiens
VRPQIPVRK

SEQ ID NO: 645636 - protein, 9 aa, Homo Sapiens
SVSVEEGSN

SEQ ID NO: 645637 - protein, 9 aa, Homo Sapiens
SPRHRVIQP

SEQ ID NO: 645638 - protein, 9 aa, Homo Sapiens
FEECGKAFN

SEQ ID NO: 645639 - protein, 9 aa, Homo Sapiens
LCLRFLGSY

SEQ ID NO: 645640 - protein, 9 aa, Homo Sapiens
SLKSEPINK

SEQ ID NO: 645641 - protein, 9 aa, Homo Sapiens
PGRPLLVLS

SEQ ID NO: 645642 - protein, 9 aa, Homo Sapiens
VAWGHRHPH

SEQ ID NO: 645643 - protein, 9 aa, Homo Sapiens
PLLYSLIMF

SEQ ID NO: 645644 - protein, 9 aa, Homo Sapiens
CTYQKPTSG

SEQ ID NO: 645645 - protein, 9 aa, Homo Sapiens
VLNMPTSKE

SEQ ID NO: 645646 - protein, 9 aa, Homo Sapiens
LNSHYGNTY

SEQ ID NO: 645647 - protein, 9 aa, Homo Sapiens
GKKPQAKQG

SEQ ID NO: 645648 - protein, 9 aa, Homo Sapiens
INTVFYFLL

SEQ ID NO: 645649 - protein, 9 aa, Homo Sapiens
IAHRLSTLE

SEQ ID NO: 645650 - protein, 9 aa, Homo Sapiens
WQSIDTYGK

SEQ ID NO: 645651 - protein, 9 aa, Homo Sapiens
VDDSYVVPS

SEQ ID NO: 645652 - protein, 9 aa, Homo Sapiens
PAIPPFLLQ

SEQ ID NO: 645653 - protein, 9 aa, Homo Sapiens
QVFCVFHAL

SEQ ID NO: 645654 - protein, 9 aa, Homo Sapiens
APPWKEHPR

SEQ ID NO: 645655 - protein, 9 aa, Homo Sapiens
SAEGSIWSF

SEQ ID NO: 645656 - protein, 9 aa, Homo Sapiens
MILIVIIRY

SEQ ID NO: 645657 - protein, 9 aa, Homo Sapiens
YDFISDCQV

SEQ ID NO: 645658 - protein, 9 aa, Homo Sapiens
NLSYVEDDH

SEQ ID NO: 645659 - protein, 9 aa, Homo Sapiens
RDVVDSLMC

SEQ ID NO: 645660 - protein, 9 aa, Homo Sapiens
CSETSLYEI

SEQ ID NO: 645661 - protein, 9 aa, Homo Sapiens
VVRGSGYVT

SEQ ID NO: 645662 - protein, 9 aa, Homo Sapiens
VDKDGSGTI

SEQ ID NO: 645663 - protein, 9 aa, Homo Sapiens
GEKMQICIG

SEQ ID NO: 645664 - protein, 9 aa, Homo Sapiens
AAEYENALE

SEQ ID NO: 645665 - protein, 9 aa, Homo Sapiens
GDKYPETSG

SEQ ID NO: 645666 - protein, 9 aa, Homo Sapiens
RGLERDEFA

SEQ ID NO: 645667 - protein, 9 aa, Homo Sapiens
AHRLSTLEH

SEQ ID NO: 645668 - protein, 9 aa, Homo Sapiens
RDEEGGLKF

SEQ ID NO: 645669 - protein, 9 aa, Homo Sapiens
SLPLLSNPV

SEQ ID NO: 645670 - protein, 9 aa, Homo Sapiens
GQDYFDYES

SEQ ID NO: 645671 - protein, 9 aa, Homo Sapiens
LVPADQVYI

SEQ ID NO: 645672 - protein, 9 aa, Homo Sapiens
YHPAKYTRI

SEQ ID NO: 645673 - protein, 9 aa, Homo Sapiens
FWSKTQVLV

SEQ ID NO: 645674 - protein, 9 aa, Homo Sapiens
SDLEEGLGR

SEQ ID NO: 645675 - protein, 9 aa, Homo Sapiens
QVLVWISYQ

SEQ ID NO: 645676 - protein, 9 aa, Homo Sapiens
IPVRKWGGF

SEQ ID NO: 645677 - protein, 9 aa, Homo Sapiens
GDVPGSPLR

SEQ ID NO: 645678 - protein, 9 aa, Homo Sapiens
EKKPRLEDP

SEQ ID NO: 645679 - protein, 9 aa, Homo Sapiens
IPTVKLQKQ

SEQ ID NO: 645680 - protein, 9 aa, Homo Sapiens
CFIEPDSAA

SEQ ID NO: 645681 - protein, 9 aa, Homo Sapiens
SWAVNYHPA

SEQ ID NO: 645682 - protein, 9 aa, Homo Sapiens
HTRVPFNGI

SEQ ID NO: 645683 - protein, 9 aa, Homo Sapiens
LGASTLLLS

SEQ ID NO: 645684 - protein, 9 aa, Homo Sapiens
ASSCSMSSR

SEQ ID NO: 645685 - protein, 9 aa, Homo Sapiens
ILIESGIIG

SEQ ID NO: 645686 - protein, 9 aa, Homo Sapiens
DNFWEMDDT

SEQ ID NO: 645687 - protein, 9 aa, Homo Sapiens
TLLLEPFSG

SEQ ID NO: 645688 - protein, 9 aa, Homo Sapiens
SRLGKYMDI

SEQ ID NO: 645689 - protein, 9 aa, Homo Sapiens
TKQSTEFLS

SEQ ID NO: 645690 - protein, 9 aa, Homo Sapiens
KWIPYMADV

SEQ ID NO: 645691 - protein, 9 aa, Homo Sapiens
QVYITEFYN

SEQ ID NO: 645692 - protein, 9 aa, Homo Sapiens
ASHTKANPV

SEQ ID NO: 645693 - protein, 9 aa, Homo Sapiens
CDLLVQQHF

SEQ ID NO: 645694 - protein, 9 aa, Homo Sapiens
PINKRLYLR

SEQ ID NO: 645695 - protein, 9 aa, Homo Sapiens
WLFWDDWQS

SEQ ID NO: 645696 - protein, 9 aa, Homo Sapiens
LPDLRDLLP

SEQ ID NO: 645697 - protein, 9 aa, Homo Sapiens
VVPSTSKSK

SEQ ID NO: 645698 - protein, 9 aa, Homo Sapiens
ALTQFCVSF

SEQ ID NO: 645699 - protein, 9 aa, Homo Sapiens
DPQSQKWTF

SEQ ID NO: 645700 - protein, 9 aa, Homo Sapiens
ASPAPPWKE

SEQ ID NO: 645701 - protein, 9 aa, Homo Sapiens
FTSVLGGRE

SEQ ID NO: 645702 - protein, 9 aa, Homo Sapiens
MVTLACIDT

SEQ ID NO: 645703 - protein, 9 aa, Homo Sapiens
LLLEPFSGL

SEQ ID NO: 645704 - protein, 9 aa, Homo Sapiens
DGAVSSSLG

SEQ ID NO: 645705 - protein, 9 aa, Homo Sapiens
LANMWRTLM

SEQ ID NO: 645706 - protein, 9 aa, Homo Sapiens
VVVRGSGYV

SEQ ID NO: 645707 - protein, 9 aa, Homo Sapiens
LQASRVQPE

SEQ ID NO: 645708 - protein, 9 aa, Homo Sapiens
LMYDEHGER

SEQ ID NO: 645709 - protein, 9 aa, Homo Sapiens
RDSNCSTLL

SEQ ID NO: 645710 - protein, 9 aa, Homo Sapiens
NDIEGQRVI

SEQ ID NO: 645711 - protein, 9 aa, Homo Sapiens
IDNDGGLVD

SEQ ID NO: 645712 - protein, 9 aa, Homo Sapiens
PDAVASPYC

SEQ ID NO: 645713 - protein, 9 aa, Homo Sapiens
GIPQMAPPK

SEQ ID NO: 645714 - protein, 9 aa, Homo Sapiens
LPEGKILPG

SEQ ID NO: 645715 - protein, 9 aa, Homo Sapiens
NDGGLVDIT

SEQ ID NO: 645716 - protein, 9 aa, Homo Sapiens
QLYLSETDG

SEQ ID NO: 645717 - protein, 9 aa, Homo Sapiens
SERISLLLD

SEQ ID NO: 645718 - protein, 9 aa, Homo Sapiens
YNVAMSDRK

SEQ ID NO: 645719 - protein, 9 aa, Homo Sapiens
LELPEGKIL

SEQ ID NO: 645720 - protein, 9 aa, Homo Sapiens
HTCDSGAPG

SEQ ID NO: 645721 - protein, 9 aa, Homo Sapiens
WRPVSVSPS

SEQ ID NO: 645722 - protein, 9 aa, Homo Sapiens
VVQLLNLFM

SEQ ID NO: 645723 - protein, 9 aa, Homo Sapiens
TSLLTTRKT

SEQ ID NO: 645724 - protein, 9 aa, Homo Sapiens
FRSQNQSYM

SEQ ID NO: 645725 - protein, 9 aa, Homo Sapiens
DMSKLATWD

SEQ ID NO: 645726 - protein, 9 aa, Homo Sapiens
QEYKVSSVL

SEQ ID NO: 645727 - protein, 9 aa, Homo Sapiens
KDLNKRIRT

SEQ ID NO: 645728 - protein, 9 aa, Homo Sapiens
HRIEQDMLE

SEQ ID NO: 645729 - protein, 9 aa, Homo Sapiens
AQTHEPRQW

SEQ ID NO: 645730 - protein, 9 aa, Homo Sapiens
PEEVCATSA

SEQ ID NO: 645731 - protein, 9 aa, Homo Sapiens
TSGRQGSDP

SEQ ID NO: 645732 - protein, 9 aa, Homo Sapiens
SSITLQASR

SEQ ID NO: 645733 - protein, 9 aa, Homo Sapiens
VQKDLSDMD

SEQ ID NO: 645734 - protein, 9 aa, Homo Sapiens
EDPQSFRNT

SEQ ID NO: 645735 - protein, 9 aa, Homo Sapiens
LYLISIPIT

SEQ ID NO: 645736 - protein, 9 aa, Homo Sapiens
ARYSSMCIT

SEQ ID NO: 645737 - protein, 9 aa, Homo Sapiens
GSGYVTVFG

SEQ ID NO: 645738 - protein, 9 aa, Homo Sapiens
LLAPGALTC

SEQ ID NO: 645739 - protein, 9 aa, Homo Sapiens
AGLLTKNKK

SEQ ID NO: 645740 - protein, 9 aa, Homo Sapiens
GALLVYYIT

SEQ ID NO: 645741 - protein, 9 aa, Homo Sapiens
LTGMPCHLH

SEQ ID NO: 645742 - protein, 9 aa, Homo Sapiens
EVDKDGSGT

SEQ ID NO: 645743 - protein, 9 aa, Homo Sapiens
HHRNASDLL

SEQ ID NO: 645744 - protein, 9 aa, Homo Sapiens
FSGLRSMQM

SEQ ID NO: 645745 - protein, 9 aa, Homo Sapiens
CCPVAWGHR

SEQ ID NO: 645746 - protein, 9 aa, Homo Sapiens
FIFQQSEAP

SEQ ID NO: 645747 - protein, 9 aa, Homo Sapiens
QKICTYQKP

SEQ ID NO: 645748 - protein, 9 aa, Homo Sapiens
NIQLYLSET

SEQ ID NO: 645749 - protein, 9 aa, Homo Sapiens
FQQDDAGLY

SEQ ID NO: 645750 - protein, 9 aa, Homo Sapiens
GLDYLLRVV

SEQ ID NO: 645751 - protein, 9 aa, Homo Sapiens
PLLYNVAMS

SEQ ID NO: 645752 - protein, 9 aa, Homo Sapiens
TQQRGLSCD

SEQ ID NO: 645753 - protein, 9 aa, Homo Sapiens
YTCIPTVKL

SEQ ID NO: 645754 - protein, 9 aa, Homo Sapiens
SGTQQRGLS

SEQ ID NO: 645755 - protein, 9 aa, Homo Sapiens
RIQEAPKFT

SEQ ID NO: 645756 - protein, 9 aa, Homo Sapiens
YGGIQPEIC

SEQ ID NO: 645757 - protein, 9 aa, Homo Sapiens
LSVPKQMKE

SEQ ID NO: 645758 - protein, 9 aa, Homo Sapiens
SGEKPYKFE

SEQ ID NO: 645759 - protein, 9 aa, Homo Sapiens
SPKPAAPAS

SEQ ID NO: 645760 - protein, 9 aa, Homo Sapiens
LPNNNDPNY

SEQ ID NO: 645761 - protein, 9 aa, Homo Sapiens
DAANILKPS

SEQ ID NO: 645762 - protein, 9 aa, Homo Sapiens
ERFVDCGMF

SEQ ID NO: 645763 - protein, 9 aa, Homo Sapiens
DGSSFALVQ

SEQ ID NO: 645764 - protein, 9 aa, Homo Sapiens
SCSCTKESI

SEQ ID NO: 645765 - protein, 9 aa, Homo Sapiens
LIGLDYLLR

SEQ ID NO: 645766 - protein, 9 aa, Homo Sapiens
APQPGAEGG

SEQ ID NO: 645767 - protein, 9 aa, Homo Sapiens
TPNNRRPST

SEQ ID NO: 645768 - protein, 9 aa, Homo Sapiens
GSGTQQRGL

SEQ ID NO: 645769 - protein, 9 aa, Homo Sapiens
SFSTLLLEP

SEQ ID NO: 645770 - protein, 9 aa, Homo Sapiens
ITQAVQTEM

SEQ ID NO: 645771 - protein, 9 aa, Homo Sapiens
AVAPHHSGI

SEQ ID NO: 645772 - protein, 9 aa, Homo Sapiens
QVPILVVQV

SEQ ID NO: 645773 - protein, 9 aa, Homo Sapiens
PAEVKDLNK

SEQ ID NO: 645774 - protein, 9 aa, Homo Sapiens
IYTAGADTG

SEQ ID NO: 645775 - protein, 9 aa, Homo Sapiens
NEYGPVLNM

SEQ ID NO: 645776 - protein, 9 aa, Homo Sapiens
NFWEMDDTG

SEQ ID NO: 645777 - protein, 9 aa, Homo Sapiens
LSMILIVII

SEQ ID NO: 645778 - protein, 9 aa, Homo Sapiens
LLIFSACLV

SEQ ID NO: 645779 - protein, 9 aa, Homo Sapiens
RSEGPHLSS

SEQ ID NO: 645780 - protein, 9 aa, Homo Sapiens
KSGNYFASQ

SEQ ID NO: 645781 - protein, 9 aa, Homo Sapiens
ILSTTPLSP

SEQ ID NO: 645782 - protein, 9 aa, Homo Sapiens
GLERDEFAR

SEQ ID NO: 645783 - protein, 9 aa, Homo Sapiens
AWGHRHPHR

SEQ ID NO: 645784 - protein, 9 aa, Homo Sapiens
VLVWTGRIP

SEQ ID NO: 645785 - protein, 9 aa, Homo Sapiens
PQDQTNQMP

SEQ ID NO: 645786 - protein, 9 aa, Homo Sapiens
DAAIMNNDS

SEQ ID NO: 645787 - protein, 9 aa, Homo Sapiens
YSLIMFRTV

SEQ ID NO: 645788 - protein, 9 aa, Homo Sapiens
LNTSQSYAK

SEQ ID NO: 645789 - protein, 9 aa, Homo Sapiens
LSCKLNEVW

SEQ ID NO: 645790 - protein, 9 aa, Homo Sapiens
SHPPLNFAF

SEQ ID NO: 645791 - protein, 9 aa, Homo Sapiens
QQRKQMEAV

SEQ ID NO: 645792 - protein, 9 aa, Homo Sapiens
RLCLRFLGS

SEQ ID NO: 645793 - protein, 9 aa, Homo Sapiens
FNSFFQVFQ

SEQ ID NO: 645794 - protein, 9 aa, Homo Sapiens
IIDNDGGLV

SEQ ID NO: 645795 - protein, 9 aa, Homo Sapiens
ICLAHFAPI

SEQ ID NO: 645796 - protein, 9 aa, Homo Sapiens
CLTRVVAQL

SEQ ID NO: 645797 - protein, 9 aa, Homo Sapiens
AAAAASSPT

SEQ ID NO: 645798 - protein, 9 aa, Homo Sapiens
HSVDEFHLL

SEQ ID NO: 645799 - protein, 9 aa, Homo Sapiens
RAGHHRNAS

SEQ ID NO: 645800 - protein, 9 aa, Homo Sapiens
ASPYCYTRD

SEQ ID NO: 645801 - protein, 9 aa, Homo Sapiens
HTQFLIEVK

SEQ ID NO: 645802 - protein, 9 aa, Homo Sapiens
SNCSTLLAT

SEQ ID NO: 645803 - protein, 9 aa, Homo Sapiens
EDAANILKP

SEQ ID NO: 645804 - protein, 9 aa, Homo Sapiens
AFILSRATT

SEQ ID NO: 645805 - protein, 9 aa, Homo Sapiens
YYITRRDTF

SEQ ID NO: 645806 - protein, 9 aa, Homo Sapiens
TFADGETRE

SEQ ID NO: 645807 - protein, 9 aa, Homo Sapiens
TLDPHTGWE

SEQ ID NO: 645808 - protein, 9 aa, Homo Sapiens
DFLDCEHGQ

SEQ ID NO: 645809 - protein, 9 aa, Homo Sapiens
SITLQASRV

SEQ ID NO: 645810 - protein, 9 aa, Homo Sapiens
EPLDLSVPK

SEQ ID NO: 645811 - protein, 9 aa, Homo Sapiens
VAGIIGRAD

SEQ ID NO: 645812 - protein, 9 aa, Homo Sapiens
LYLRTWTNQ

SEQ ID NO: 645813 - protein, 9 aa, Homo Sapiens
QICIGRGGS

SEQ ID NO: 645814 - protein, 9 aa, Homo Sapiens
KKPPVTFDE

SEQ ID NO: 645815 - protein, 9 aa, Homo Sapiens
ALVQLKVIN

SEQ ID NO: 645816 - protein, 9 aa, Homo Sapiens
LFFTSVLGG

SEQ ID NO: 645817 - protein, 9 aa, Homo Sapiens
AYPCVATVT

SEQ ID NO: 645818 - protein, 9 aa, Homo Sapiens
FSWRLPSAP

SEQ ID NO: 645819 - protein, 9 aa, Homo Sapiens
TSKMGKWCC

SEQ ID NO: 645820 - protein, 9 aa, Homo Sapiens
RKQMEAVWK

SEQ ID NO: 645821 - protein, 9 aa, Homo Sapiens
INGEKMQIC

SEQ ID NO: 645822 - protein, 9 aa, Homo Sapiens
QPGAEGGGG

SEQ ID NO: 645823 - protein, 9 aa, Homo Sapiens
AAGALLVYY

SEQ ID NO: 645824 - protein, 9 aa, Homo Sapiens
VPGEADAIL

SEQ ID NO: 645825 - protein, 9 aa, Homo Sapiens
IAPERFVDC

SEQ ID NO: 645826 - protein, 9 aa, Homo Sapiens
TTKTVRKNK

SEQ ID NO: 645827 - protein, 9 aa, Homo Sapiens
GPLSCKLNE

SEQ ID NO: 645828 - protein, 9 aa, Homo Sapiens
IRNYPYRQL

SEQ ID NO: 645829 - protein, 9 aa, Homo Sapiens
DIYTAGADT

SEQ ID NO: 645830 - protein, 9 aa, Homo Sapiens
GFKGHTCDS

SEQ ID NO: 645831 - protein, 9 aa, Homo Sapiens
GFHYRFLSQ

SEQ ID NO: 645832 - protein, 9 aa, Homo Sapiens
VVLMYDEHG

SEQ ID NO: 645833 - protein, 9 aa, Homo Sapiens
SLLYLISIP

SEQ ID NO: 645834 - protein, 9 aa, Homo Sapiens
SCSETSLYE

SEQ ID NO: 645835 - protein, 9 aa, Homo Sapiens
CSTLLATIQ

SEQ ID NO: 645836 - protein, 9 aa, Homo Sapiens
KDVYTEKKA

SEQ ID NO: 645837 - protein, 9 aa, Homo Sapiens
LQGCDLLVQ

SEQ ID NO: 645838 - protein, 9 aa, Homo Sapiens
AARSAALQV

SEQ ID NO: 645839 - protein, 9 aa, Homo Sapiens
PQRSYRDLS

SEQ ID NO: 645840 - protein, 9 aa, Homo Sapiens
DPHTGWEYC

SEQ ID NO: 645841 - protein, 9 aa, Homo Sapiens
AQSVSLQVV

SEQ ID NO: 645842 - protein, 9 aa, Homo Sapiens
KTTKQSTEF

SEQ ID NO: 645843 - protein, 9 aa, Homo Sapiens
GPHLSSRPE

SEQ ID NO: 645844 - protein, 9 aa, Homo Sapiens
EKQINVARL

SEQ ID NO: 645845 - protein, 9 aa, Homo Sapiens
AKKPPVTFD

SEQ ID NO: 645846 - protein, 9 aa, Homo Sapiens
SGGELKPER

SEQ ID NO: 645847 - protein, 9 aa, Homo Sapiens
PETSGALPG

SEQ ID NO: 645848 - protein, 9 aa, Homo Sapiens
MKTNRGTIG

SEQ ID NO: 645849 - protein, 9 aa, Homo Sapiens
STTFHSVPG

SEQ ID NO: 645850 - protein, 9 aa, Homo Sapiens
MHLSITHRM

SEQ ID NO: 645851 - protein, 9 aa, Homo Sapiens
PADQVYITE

SEQ ID NO: 645852 - protein, 9 aa, Homo Sapiens
LVDITRQGR

SEQ ID NO: 645853 - protein, 9 aa, Homo Sapiens
LNRDAHIRD

SEQ ID NO: 645854 - protein, 9 aa, Homo Sapiens
SGLRSMQMP

SEQ ID NO: 645855 - protein, 9 aa, Homo Sapiens
MFRTVYLKM

SEQ ID NO: 645856 - protein, 9 aa, Homo Sapiens
QASRVQPEP

SEQ ID NO: 645857 - protein, 9 aa, Homo Sapiens
TGEDSQDAP

SEQ ID NO: 645858 - protein, 9 aa, Homo Sapiens
ISIAIIMVG

SEQ ID NO: 645859 - protein, 9 aa, Homo Sapiens
KFFAKVVLH

SEQ ID NO: 645860 - protein, 9 aa, Homo Sapiens
VTNAHLVNK

SEQ ID NO: 645861 - protein, 9 aa, Homo Sapiens
NNVGIIYKV

SEQ ID NO: 645862 - protein, 9 aa, Homo Sapiens
LKSEPINKR

SEQ ID NO: 645863 - protein, 9 aa, Homo Sapiens
GAQRDEPVP

SEQ ID NO: 645864 - protein, 9 aa, Homo Sapiens
IKFWRKEEK

SEQ ID NO: 645865 - protein, 9 aa, Homo Sapiens
SENLSYVED

SEQ ID NO: 645866 - protein, 9 aa, Homo Sapiens
ACIDTWVYE

SEQ ID NO: 645867 - protein, 9 aa, Homo Sapiens
ETRPAKWNG

SEQ ID NO: 645868 - protein, 9 aa, Homo Sapiens
EYDFISDCQ

SEQ ID NO: 645869 - protein, 9 aa, Homo Sapiens
VALTQFCVS

SEQ ID NO: 645870 - protein, 9 aa, Homo Sapiens
DGGLVDITR

SEQ ID NO: 645871 - protein, 9 aa, Homo Sapiens
IIMGLTLSE

SEQ ID NO: 645872 - protein, 9 aa, Homo Sapiens
MAVGLWAMM

SEQ ID NO: 645873 - protein, 9 aa, Homo Sapiens
QERYYSAVL

SEQ ID NO: 645874 - protein, 9 aa, Homo Sapiens
KLHIPQFTF

SEQ ID NO: 645875 - protein, 9 aa, Homo Sapiens
AIHMTEKLH

SEQ ID NO: 645876 - protein, 9 aa, Homo Sapiens
SAAERCGLL

SEQ ID NO: 645877 - protein, 9 aa, Homo Sapiens
KDHSSMSSY

SEQ ID NO: 645878 - protein, 9 aa, Homo Sapiens
EGLGRLGKT

SEQ ID NO: 645879 - protein, 9 aa, Homo Sapiens
KPAAPASPP

SEQ ID NO: 645880 - protein, 9 aa, Homo Sapiens
NAIHMTEKL

SEQ ID NO: 645881 - protein, 9 aa, Homo Sapiens
CNISIIVLI

SEQ ID NO: 645882 - protein, 9 aa, Homo Sapiens
NLFMTSLDA

SEQ ID NO: 645883 - protein, 9 aa, Homo Sapiens
IYVVTLMCN

SEQ ID NO: 645884 - protein, 9 aa, Homo Sapiens
KDIHTYLRE

SEQ ID NO: 645885 - protein, 9 aa, Homo Sapiens
KAFQRNRSL

SEQ ID NO: 645886 - protein, 9 aa, Homo Sapiens
LIVIIRYIS

SEQ ID NO: 645887 - protein, 9 aa, Homo Sapiens
GELKPERYY

SEQ ID NO: 645888 - protein, 9 aa, Homo Sapiens
LLNAHLSVP

SEQ ID NO: 645889 - protein, 9 aa, Homo Sapiens
HVRPQIPVR

SEQ ID NO: 645890 - protein, 9 aa, Homo Sapiens
VARDVVDSL

SEQ ID NO: 645891 - protein, 9 aa, Homo Sapiens
DEARGHHRL

SEQ ID NO: 645892 - protein, 9 aa, Homo Sapiens
GVLGASTLL

SEQ ID NO: 645893 - protein, 9 aa, Homo Sapiens
SYVEDDHIP

SEQ ID NO: 645894 - protein, 9 aa, Homo Sapiens
KKARKHFNS

SEQ ID NO: 645895 - protein, 9 aa, Homo Sapiens
APVLLSPAP

SEQ ID NO: 645896 - protein, 9 aa, Homo Sapiens
LYLSETDGI

SEQ ID NO: 645897 - protein, 9 aa, Homo Sapiens
SFALVQLKV

SEQ ID NO: 645898 - protein, 9 aa, Homo Sapiens
HRHPHRPPP

SEQ ID NO: 645899 - protein, 9 aa, Homo Sapiens
MAFVAPSIS

SEQ ID NO: 645900 - protein, 9 aa, Homo Sapiens
KTKKEAEKK

SEQ ID NO: 645901 - protein, 9 aa, Homo Sapiens
QVFPGMNYC

SEQ ID NO: 645902 - protein, 9 aa, Homo Sapiens
LHSVDEFHL

SEQ ID NO: 645903 - protein, 9 aa, Homo Sapiens
FCVSFFVED

SEQ ID NO: 645904 - protein, 9 aa, Homo Sapiens
QKDLSDMDY

SEQ ID NO: 645905 - protein, 9 aa, Homo Sapiens
GIGEYVNIL

SEQ ID NO: 645906 - protein, 9 aa, Homo Sapiens
PKAAVQKDL

SEQ ID NO: 645907 - protein, 9 aa, Homo Sapiens
SSWAVNYHP

SEQ ID NO: 645908 - protein, 9 aa, Homo Sapiens
FDDKFEDDD

SEQ ID NO: 645909 - protein, 9 aa, Homo Sapiens
RPISFSTLL

SEQ ID NO: 645910 - protein, 9 aa, Homo Sapiens
RSNEDCVEI

SEQ ID NO: 645911 - protein, 9 aa, Homo Sapiens
GGGTSLLYL

SEQ ID NO: 645912 - protein, 9 aa, Homo Sapiens
LLRVVIQSN

SEQ ID NO: 645913 - protein, 9 aa, Homo Sapiens
ERSFVSQYE

SEQ ID NO: 645914 - protein, 9 aa, Homo Sapiens
YDVQAFKFW

SEQ ID NO: 645915 - protein, 9 aa, Homo Sapiens
DEKQINVAR

SEQ ID NO: 645916 - protein, 9 aa, Homo Sapiens
PRTGWPSPA

SEQ ID NO: 645917 - protein, 9 aa, Homo Sapiens
HVKKEDIWP

SEQ ID NO: 645918 - protein, 9 aa, Homo Sapiens
TEKKARKHF

SEQ ID NO: 645919 - protein, 9 aa, Homo Sapiens
ISHTHTRVP

SEQ ID NO: 645920 - protein, 9 aa, Homo Sapiens
EGSIWSFEL

SEQ ID NO: 645921 - protein, 9 aa, Homo Sapiens
GRQGSDPRP

SEQ ID NO: 645922 - protein, 9 aa, Homo Sapiens
CRNECHDFE

SEQ ID NO: 645923 - protein, 9 aa, Homo Sapiens
YTLDPHTGW

SEQ ID NO: 645924 - protein, 9 aa, Homo Sapiens
HTKANPVWL

SEQ ID NO: 645925 - protein, 9 aa, Homo Sapiens
TCIPTVKLQ

SEQ ID NO: 645926 - protein, 9 aa, Homo Sapiens
GTRASHTKA

SEQ ID NO: 645927 - protein, 9 aa, Homo Sapiens
GPRLCLRFL

SEQ ID NO: 645928 - protein, 9 aa, Homo Sapiens
LAIRLVRCP

SEQ ID NO: 645929 - protein, 9 aa, Homo Sapiens
QFIFQQSEA

SEQ ID NO: 645930 - protein, 9 aa, Homo Sapiens
RPELIDMNT

SEQ ID NO: 645931 - protein, 9 aa, Homo Sapiens
DDDLRVIVW

SEQ ID NO: 645932 - protein, 9 aa, Homo Sapiens
SQFFMGGEK

SEQ ID NO: 645933 - protein, 9 aa, Homo Sapiens
DLSDMDYLK

SEQ ID NO: 645934 - protein, 9 aa, Homo Sapiens
SDLFPAEMR

SEQ ID NO: 645935 - protein, 9 aa, Homo Sapiens
AVSSSLGIS

SEQ ID NO: 645936 - protein, 9 aa, Homo Sapiens
LSETDGIQK

SEQ ID NO: 645937 - protein, 9 aa, Homo Sapiens
FKWFQIDEA

SEQ ID NO: 645938 - protein, 9 aa, Homo Sapiens
LLCSQILLI

SEQ ID NO: 645939 - protein, 9 aa, Homo Sapiens
KNKKLTYLN

SEQ ID NO: 645940 - protein, 9 aa, Homo Sapiens
LLYSLIMFR

SEQ ID NO: 645941 - protein, 9 aa, Homo Sapiens
ISCDKDLHA

SEQ ID NO: 645942 - protein, 9 aa, Homo Sapiens
RSARPLPKS

SEQ ID NO: 645943 - protein, 9 aa, Homo Sapiens
PASPPFSSS

SEQ ID NO: 645944 - protein, 9 aa, Homo Sapiens
LKKWRPVSV

SEQ ID NO: 645945 - protein, 9 aa, Homo Sapiens
VAPHHSGIY

SEQ ID NO: 645946 - protein, 9 aa, Homo Sapiens
NKRIRTVLM

SEQ ID NO: 645947 - protein, 9 aa, Homo Sapiens
VIQPTLEQT

SEQ ID NO: 645948 - protein, 9 aa, Homo Sapiens
HLSSRPEEP

SEQ ID NO: 645949 - protein, 9 aa, Homo Sapiens
EGLKFRQKV

SEQ ID NO: 645950 - protein, 9 aa, Homo Sapiens
IMFRTVYLK

SEQ ID NO: 645951 - protein, 9 aa, Homo Sapiens
SQNQSYMRA

SEQ ID NO: 645952 - protein, 9 aa, Homo Sapiens
RIGGSTDTD

SEQ ID NO: 645953 - protein, 9 aa, Homo Sapiens
LLTKNKKLT

SEQ ID NO: 645954 - protein, 9 aa, Homo Sapiens
PQPGAEGGG

SEQ ID NO: 645955 - protein, 9 aa, Homo Sapiens
CLLSLLLMV

SEQ ID NO: 645956 - protein, 9 aa, Homo Sapiens
QRVIQIAVI

SEQ ID NO: 645957 - protein, 9 aa, Homo Sapiens
SADGAVSSS

SEQ ID NO: 645958 - protein, 9 aa, Homo Sapiens
GHSCSRFYT

SEQ ID NO: 645959 - protein, 9 aa, Homo Sapiens
AIVSPLLYN

SEQ ID NO: 645960 - protein, 9 aa, Homo Sapiens
FLIEVKESK

SEQ ID NO: 645961 - protein, 9 aa, Homo Sapiens
PATTTRYPT

SEQ ID NO: 645962 - protein, 9 aa, Homo Sapiens
TLTSKMGKW

SEQ ID NO: 645963 - protein, 9 aa, Homo Sapiens
LVIQKLEKG

SEQ ID NO: 645964 - protein, 9 aa, Homo Sapiens
SFFVEDSIL

SEQ ID NO: 645965 - protein, 9 aa, Homo Sapiens
DILRPGFHY

SEQ ID NO: 645966 - protein, 9 aa, Homo Sapiens
LTQFCVSFF

SEQ ID NO: 645967 - protein, 9 aa, Homo Sapiens
DSYVVPSTS

SEQ ID NO: 645968 - protein, 9 aa, Homo Sapiens
PERFVDCGM

SEQ ID NO: 645969 - protein, 9 aa, Homo Sapiens
ADTGDVAVV

SEQ ID NO: 645970 - protein, 9 aa, Homo Sapiens
GDIVARDVV

SEQ ID NO: 645971 - protein, 9 aa, Homo Sapiens
SRFYTTGKR

SEQ ID NO: 645972 - protein, 9 aa, Homo Sapiens
QMPTSELGR

SEQ ID NO: 645973 - protein, 9 aa, Homo Sapiens
TSVLGGREK

SEQ ID NO: 645974 - protein, 9 aa, Homo Sapiens
AAERCGLLQ

SEQ ID NO: 645975 - protein, 9 aa, Homo Sapiens
VRCPPVCSD

SEQ ID NO: 645976 - protein, 9 aa, Homo Sapiens
ICIGRGGSQ

SEQ ID NO: 645977 - protein, 9 aa, Homo Sapiens
RRDEEGGLK

SEQ ID NO: 645978 - protein, 9 aa, Homo Sapiens
HQVDDSYVV

SEQ ID NO: 645979 - protein, 9 aa, Homo Sapiens
LIMFRTVYL

SEQ ID NO: 645980 - protein, 9 aa, Homo Sapiens
VLLLAAVMV

SEQ ID NO: 645981 - protein, 9 aa, Homo Sapiens
YVVPSTSKS

SEQ ID NO: 645982 - protein, 9 aa, Homo Sapiens
DFIIMGLTL

SEQ ID NO: 645983 - protein, 9 aa, Homo Sapiens
GAVSSSLGI

SEQ ID NO: 645984 - protein, 9 aa, Homo Sapiens
DAIIEEVDK

SEQ ID NO: 645985 - protein, 9 aa, Homo Sapiens
PCINPLSTL

SEQ ID NO: 645986 - protein, 9 aa, Homo Sapiens
DPQSFRNTI

SEQ ID NO: 645987 - protein, 9 aa, Homo Sapiens
MNSVSVEEG

SEQ ID NO: 645988 - protein, 9 aa, Homo Sapiens
AKACLQGCD

SEQ ID NO: 645989 - protein, 9 aa, Homo Sapiens
KICLAHFAP

SEQ ID NO: 645990 - protein, 9 aa, Homo Sapiens
RPGFHYRFL

SEQ ID NO: 645991 - protein, 9 aa, Homo Sapiens
GTSLLYLIS

SEQ ID NO: 645992 - protein, 9 aa, Homo Sapiens
HRNASDLLD

SEQ ID NO: 645993 - protein, 9 aa, Homo Sapiens
FHSVPGSTE

SEQ ID NO: 645994 - protein, 9 aa, Homo Sapiens
RSGTSLLTT

SEQ ID NO: 645995 - protein, 9 aa, Homo Sapiens
KEEEKTKKE

SEQ ID NO: 645996 - protein, 9 aa, Homo Sapiens
FVCKAHLTK

SEQ ID NO: 645997 - protein, 9 aa, Homo Sapiens
FGKDMSKLA

SEQ ID NO: 645998 - protein, 9 aa, Homo Sapiens
NLSCSETSL

SEQ ID NO: 645999 - protein, 9 aa, Homo Sapiens
GSPGRPLLV

SEQ ID NO: 646000 - protein, 9 aa, Homo Sapiens
FQRNRSLLK

SEQ ID NO: 646001 - protein, 9 aa, Homo Sapiens
ENLSYVEDD

SEQ ID NO: 646002 - protein, 9 aa, Homo Sapiens
CLVKEDVPF

SEQ ID NO: 646003 - protein, 9 aa, Homo Sapiens
EPNNKRSNE

SEQ ID NO: 646004 - protein, 9 aa, Homo Sapiens
LIKFWRKEE

SEQ ID NO: 646005 - protein, 9 aa, Homo Sapiens
ICTYQKPTS

SEQ ID NO: 646006 - protein, 9 aa, Homo Sapiens
SIWSFELQG

SEQ ID NO: 646007 - protein, 9 aa, Homo Sapiens
ELIDMNTVA

SEQ ID NO: 646008 - protein, 9 aa, Homo Sapiens
RPQIPVRKW

SEQ ID NO: 646009 - protein, 9 aa, Homo Sapiens
QEVSVRPLV

SEQ ID NO: 646010 - protein, 9 aa, Homo Sapiens
PRKVFLEKP

SEQ ID NO: 646011 - protein, 9 aa, Homo Sapiens
SLELPEGKI

SEQ ID NO: 646012 - protein, 9 aa, Homo Sapiens
RCGIQSFFF

SEQ ID NO: 646013 - protein, 9 aa, Homo Sapiens
ELVLRLLRA

SEQ ID NO: 646014 - protein, 9 aa, Homo Sapiens
SMDVTNAHL

SEQ ID NO: 646015 - protein, 9 aa, Homo Sapiens
ALTCCPVAW

SEQ ID NO: 646016 - protein, 9 aa, Homo Sapiens
IPDTFEDAA

SEQ ID NO: 646017 - protein, 9 aa, Homo Sapiens
IPTHLSLGA

SEQ ID NO: 646018 - protein, 9 aa, Homo Sapiens
DFTEEEWDM

SEQ ID NO: 646019 - protein, 9 aa, Homo Sapiens
YTEKKARKH

SEQ ID NO: 646020 - protein, 9 aa, Homo Sapiens
CAGAPQKIC

SEQ ID NO: 646021 - protein, 9 aa, Homo Sapiens
DVAIDFTEE

SEQ ID NO: 646022 - protein, 9 aa, Homo Sapiens
APERFVDCG

SEQ ID NO: 646023 - protein, 9 aa, Homo Sapiens
PTVKLQKQK

SEQ ID NO: 646024 - protein, 9 aa, Homo Sapiens
DGGEHNGGM

SEQ ID NO: 646025 - protein, 9 aa, Homo Sapiens
GQDIKLSFF

SEQ ID NO: 646026 - protein, 9 aa, Homo Sapiens
SMQMPCRRS

SEQ ID NO: 646027 - protein, 9 aa, Homo Sapiens
VVDSLMCEK

SEQ ID NO: 646028 - protein, 9 aa, Homo Sapiens
YPETSGALP

SEQ ID NO: 646029 - protein, 9 aa, Homo Sapiens
ERAELVLRL

SEQ ID NO: 646030 - protein, 9 aa, Homo Sapiens
RTWTNQERP

SEQ ID NO: 646031 - protein, 9 aa, Homo Sapiens
PRLCLRFLG

SEQ ID NO: 646032 - protein, 9 aa, Homo Sapiens
RGTRLASSD

SEQ ID NO: 646033 - protein, 9 aa, Homo Sapiens
AFLNSVINT

SEQ ID NO: 646034 - protein, 9 aa, Homo Sapiens
CFLLTYALV

SEQ ID NO: 646035 - protein, 9 aa, Homo Sapiens
VDRVVLMYD

SEQ ID NO: 646036 - protein, 9 aa, Homo Sapiens
ERLQLLNAH

SEQ ID NO: 646037 - protein, 9 aa, Homo Sapiens
PVLNMPTSK

SEQ ID NO: 646038 - protein, 9 aa, Homo Sapiens
QDQTNQMPT

SEQ ID NO: 646039 - protein, 9 aa, Homo Sapiens
RGSGYVTVF

SEQ ID NO: 646040 - protein, 9 aa, Homo Sapiens
CLAHFAPIS

SEQ ID NO: 646041 - protein, 9 aa, Homo Sapiens
SSFALVQLK

SEQ ID NO: 646042 - protein, 9 aa, Homo Sapiens
KTSLKSEPI

SEQ ID NO: 646043 - protein, 9 aa, Homo Sapiens
LQGPPRTGW

SEQ ID NO: 646044 - protein, 9 aa, Homo Sapiens
PVLLSPAPP

SEQ ID NO: 646045 - protein, 9 aa, Homo Sapiens
MDDTGPCGP

SEQ ID NO: 646046 - protein, 9 aa, Homo Sapiens
CSRFYTTGK

SEQ ID NO: 646047 - protein, 9 aa, Homo Sapiens
TDKHIKEND

SEQ ID NO: 646048 - protein, 9 aa, Homo Sapiens
EEEKTKKEA

SEQ ID NO: 646049 - protein, 9 aa, Homo Sapiens
CKAHLTKHQ

SEQ ID NO: 646050 - protein, 9 aa, Homo Sapiens
ERLGQDIKL

SEQ ID NO: 646051 - protein, 9 aa, Homo Sapiens
DTKDHSSMS

SEQ ID NO: 646052 - protein, 9 aa, Homo Sapiens
MAPPKRKRK

SEQ ID NO: 646053 - protein, 9 aa, Homo Sapiens
VLVYLAEDT

SEQ ID NO: 646054 - protein, 9 aa, Homo Sapiens
TAASLLIKF

SEQ ID NO: 646055 - protein, 9 aa, Homo Sapiens
TLEHAHLIV

SEQ ID NO: 646056 - protein, 9 aa, Homo Sapiens
LLLCSQILL

SEQ ID NO: 646057 - protein, 9 aa, Homo Sapiens
QEAPKFTHL

SEQ ID NO: 646058 - protein, 9 aa, Homo Sapiens
DAILSTTPL

SEQ ID NO: 646059 - protein, 9 aa, Homo Sapiens
RLGKYMDIE

SEQ ID NO: 646060 - protein, 9 aa, Homo Sapiens
RVRTNNVGI

SEQ ID NO: 646061 - protein, 9 aa, Homo Sapiens
RNVEIQPSS

SEQ ID NO: 646062 - protein, 9 aa, Homo Sapiens
MSGGELKPE

SEQ ID NO: 646063 - protein, 9 aa, Homo Sapiens
QRKQMEAVW

SEQ ID NO: 646064 - protein, 9 aa, Homo Sapiens
FILSRATTR

SEQ ID NO: 646065 - protein, 9 aa, Homo Sapiens
RVIQPTLEQ

SEQ ID NO: 646066 - protein, 9 aa, Homo Sapiens
FLQNLNHIQ

SEQ ID NO: 646067 - protein, 9 aa, Homo Sapiens
FPGMNYCTS

SEQ ID NO: 646068 - protein, 9 aa, Homo Sapiens
TPQRSYRDL

SEQ ID NO: 646069 - protein, 9 aa, Homo Sapiens
KLSFFKVPP

SEQ ID NO: 646070 - protein, 9 aa, Homo Sapiens
FLMGQGGED

SEQ ID NO: 646071 - protein, 9 aa, Homo Sapiens
LRLAKWRRS

SEQ ID NO: 646072 - protein, 9 aa, Homo Sapiens
LRSMQMPCR

SEQ ID NO: 646073 - protein, 9 aa, Homo Sapiens
LDTVGDFLD

SEQ ID NO: 646074 - protein, 9 aa, Homo Sapiens
LSSRPEEPH

SEQ ID NO: 646075 - protein, 9 aa, Homo Sapiens
KVFLEKPTL

SEQ ID NO: 646076 - protein, 9 aa, Homo Sapiens
ELKPERYYV

SEQ ID NO: 646077 - protein, 9 aa, Homo Sapiens
TDSSSLCPA

SEQ ID NO: 646078 - protein, 9 aa, Homo Sapiens
GTQQRGLSC

SEQ ID NO: 646079 - protein, 9 aa, Homo Sapiens
FVAPSISIA

SEQ ID NO: 646080 - protein, 9 aa, Homo Sapiens
PSAIKAAAR

SEQ ID NO: 646081 - protein, 9 aa, Homo Sapiens
CESNTSTQS

SEQ ID NO: 646082 - protein, 9 aa, Homo Sapiens
ALLLLLLCS

SEQ ID NO: 646083 - protein, 9 aa, Homo Sapiens
RTEEERKHR

SEQ ID NO: 646084 - protein, 9 aa, Homo Sapiens
IQEAPKFTH

SEQ ID NO: 646085 - protein, 9 aa, Homo Sapiens
LERDEFARA

SEQ ID NO: 646086 - protein, 9 aa, Homo Sapiens
PERNVEIQP

SEQ ID NO: 646087 - protein, 9 aa, Homo Sapiens
VWISYQVEK

SEQ ID NO: 646088 - protein, 9 aa, Homo Sapiens
LLNLFMTSL

SEQ ID NO: 646089 - protein, 9 aa, Homo Sapiens
KLNEVWHLV

SEQ ID NO: 646090 - protein, 9 aa, Homo Sapiens
RTQEGSFSA

SEQ ID NO: 646091 - protein, 9 aa, Homo Sapiens
SSPTRIPTV

SEQ ID NO: 646092 - protein, 9 aa, Homo Sapiens
IQLYLSETD

SEQ ID NO: 646093 - protein, 9 aa, Homo Sapiens
PQTPNNRRP

SEQ ID NO: 646094 - protein, 9 aa, Homo Sapiens
TSLKSEPIN

SEQ ID NO: 646095 - protein, 9 aa, Homo Sapiens
DSTMKTLTS

SEQ ID NO: 646096 - protein, 9 aa, Homo Sapiens
AHLSVPFPT

SEQ ID NO: 646097 - protein, 9 aa, Homo Sapiens
VEDDHIPAH

SEQ ID NO: 646098 - protein, 9 aa, Homo Sapiens
SCDKDLHAV

SEQ ID NO: 646099 - protein, 9 aa, Homo Sapiens
AVGVLGAST

SEQ ID NO: 646100 - protein, 9 aa, Homo Sapiens
WERSFVSQY

SEQ ID NO: 646101 - protein, 9 aa, Homo Sapiens
RNYPYRQLH

SEQ ID NO: 646102 - protein, 9 aa, Homo Sapiens
GASLELPEG

SEQ ID NO: 646103 - protein, 9 aa, Homo Sapiens
CSEGKSTTK

SEQ ID NO: 646104 - protein, 9 aa, Homo Sapiens
SKTQVLVWI

SEQ ID NO: 646105 - protein, 9 aa, Homo Sapiens
NNNSSRLGK

SEQ ID NO: 646106 - protein, 9 aa, Homo Sapiens
TVKLQKQKV

SEQ ID NO: 646107 - protein, 9 aa, Homo Sapiens
QMAPPKRKR

SEQ ID NO: 646108 - protein, 9 aa, Homo Sapiens
LRTWTNQER

SEQ ID NO: 646109 - protein, 9 aa, Homo Sapiens
CFLCFLLTY

SEQ ID NO: 646110 - protein, 9 aa, Homo Sapiens
IMRGKCRNE

SEQ ID NO: 646111 - protein, 9 aa, Homo Sapiens
TFDEKGELR

SEQ ID NO: 646112 - protein, 9 aa, Homo Sapiens
GGYRLNSHY

SEQ ID NO: 646113 - protein, 9 aa, Homo Sapiens
VPGSTETTL

SEQ ID NO: 646114 - protein, 9 aa, Homo Sapiens
SGPSPRPLP

SEQ ID NO: 646115 - protein, 9 aa, Homo Sapiens
SARPLPKSG

SEQ ID NO: 646116 - protein, 9 aa, Homo Sapiens
DSNFTETID

SEQ ID NO: 646117 - protein, 9 aa, Homo Sapiens
KLLLEGEKE

SEQ ID NO: 646118 - protein, 9 aa, Homo Sapiens
LSFFKVPPL

SEQ ID NO: 646119 - protein, 9 aa, Homo Sapiens
GHHRNASDL

SEQ ID NO: 646120 - protein, 9 aa, Homo Sapiens
SSLCPARSV

SEQ ID NO: 646121 - protein, 9 aa, Homo Sapiens
RVISSSPAD

SEQ ID NO: 646122 - protein, 9 aa, Homo Sapiens
QVDDSYVVP

SEQ ID NO: 646123 - protein, 9 aa, Homo Sapiens
VASPYCYTR

SEQ ID NO: 646124 - protein, 9 aa, Homo Sapiens
TMKTLTSKM

SEQ ID NO: 646125 - protein, 9 aa, Homo Sapiens
PKLLLEGEK

SEQ ID NO: 646126 - protein, 9 aa, Homo Sapiens
SYRDLSPPC

SEQ ID NO: 646127 - protein, 9 aa, Homo Sapiens
PSSIKQLEI

SEQ ID NO: 646128 - protein, 9 aa, Homo Sapiens
FTSSTISVG

SEQ ID NO: 646129 - protein, 9 aa, Homo Sapiens
LNLFMTSLD

SEQ ID NO: 646130 - protein, 9 aa, Homo Sapiens
VINTVFYFL

SEQ ID NO: 646131 - protein, 9 aa, Homo Sapiens
RSHRSSKEN

SEQ ID NO: 646132 - protein, 9 aa, Homo Sapiens
LILQYIPKP

SEQ ID NO: 646133 - protein, 9 aa, Homo Sapiens
LCFLLTYAL

SEQ ID NO: 646134 - protein, 9 aa, Homo Sapiens
EADAILSTT

SEQ ID NO: 646135 - protein, 9 aa, Homo Sapiens
FQIDEARGH

SEQ ID NO: 646136 - protein, 9 aa, Homo Sapiens
TMHIEQANE

SEQ ID NO: 646137 - protein, 9 aa, Homo Sapiens
DEPQQKEIP

SEQ ID NO: 646138 - protein, 9 aa, Homo Sapiens
KPPVTFDEK

SEQ ID NO: 646139 - protein, 9 aa, Homo Sapiens
DDTGPCGPC

SEQ ID NO: 646140 - protein, 9 aa, Homo Sapiens
VSAPLVLHW

SEQ ID NO: 646141 - protein, 9 aa, Homo Sapiens
DIVARDVVD

SEQ ID NO: 646142 - protein, 9 aa, Homo Sapiens
KLKKWRPVS

SEQ ID NO: 646143 - protein, 9 aa, Homo Sapiens
DDKFEDDDP

SEQ ID NO: 646144 - protein, 9 aa, Homo Sapiens
SGGPLSCKL

SEQ ID NO: 646145 - protein, 9 aa, Homo Sapiens
VEGHKPSIA

SEQ ID NO: 646146 - protein, 9 aa, Homo Sapiens
VCKQVFPGM

SEQ ID NO: 646147 - protein, 9 aa, Homo Sapiens
TSLLYLISI

SEQ ID NO: 646148 - protein, 9 aa, Homo Sapiens
VIFGPNKVE

SEQ ID NO: 646149 - protein, 9 aa, Homo Sapiens
YYSAVLGTM

SEQ ID NO: 646150 - protein, 9 aa, Homo Sapiens
TNAHLVNKF

SEQ ID NO: 646151 - protein, 9 aa, Homo Sapiens
FRLFFTSVL

SEQ ID NO: 646152 - protein, 9 aa, Homo Sapiens
KEKLKKWRP

SEQ ID NO: 646153 - protein, 9 aa, Homo Sapiens
DFAQSPFGT

SEQ ID NO: 646154 - protein, 9 aa, Homo Sapiens
STGEDSQDA

SEQ ID NO: 646155 - protein, 9 aa, Homo Sapiens
ETFGKDMSK

SEQ ID NO: 646156 - protein, 9 aa, Homo Sapiens
PQAKQGHQE

SEQ ID NO: 646157 - protein, 9 aa, Homo Sapiens
HHNEFDDKF

SEQ ID NO: 646158 - protein, 9 aa, Homo Sapiens
EGPCLTRVV

SEQ ID NO: 646159 - protein, 9 aa, Homo Sapiens
SFTRCGIQS

SEQ ID NO: 646160 - protein, 9 aa, Homo Sapiens
AVAGIIGRA

SEQ ID NO: 646161 - protein, 9 aa, Homo Sapiens
GEADAILST

SEQ ID NO: 646162 - protein, 9 aa, Homo Sapiens
TTKQSTEFL

SEQ ID NO: 646163 - protein, 9 aa, Homo Sapiens
AFVAPSISI

SEQ ID NO: 646164 - protein, 9 aa, Homo Sapiens
RVIQIAVIL

SEQ ID NO: 646165 - protein, 9 aa, Homo Sapiens
VSPLLYNVA

SEQ ID NO: 646166 - protein, 9 aa, Homo Sapiens
VYTEKKARK

SEQ ID NO: 646167 - protein, 9 aa, Homo Sapiens
STILIILTS

SEQ ID NO: 646168 - protein, 9 aa, Homo Sapiens
TPPAPVLLS

SEQ ID NO: 646169 - protein, 9 aa, Homo Sapiens
GLLTKNKKL

SEQ ID NO: 646170 - protein, 9 aa, Homo Sapiens
EVKAKAKKQ

SEQ ID NO: 646171 - protein, 9 aa, Homo Sapiens
TALEEGNYF

SEQ ID NO: 646172 - protein, 9 aa, Homo Sapiens
CINPLSTLQ

SEQ ID NO: 646173 - protein, 9 aa, Homo Sapiens
NQMPTSELG

SEQ ID NO: 646174 - protein, 9 aa, Homo Sapiens
SPGRPLLVL

SEQ ID NO: 646175 - protein, 9 aa, Homo Sapiens
CVSFFVEDS

SEQ ID NO: 646176 - protein, 9 aa, Homo Sapiens
TKTVRKNKK

SEQ ID NO: 646177 - protein, 9 aa, Homo Sapiens
FFAKVVLHL

SEQ ID NO: 646178 - protein, 9 aa, Homo Sapiens
NSVINTVFY

SEQ ID NO: 646179 - protein, 9 aa, Homo Sapiens
RLLDDNDSE

SEQ ID NO: 646180 - protein, 9 aa, Homo Sapiens
ILQYIPKPT

SEQ ID NO: 646181 - protein, 9 aa, Homo Sapiens
LPLLSNPVL

SEQ ID NO: 646182 - protein, 9 aa, Homo Sapiens
SFSARWPVA

SEQ ID NO: 646183 - protein, 9 aa, Homo Sapiens
SSSLCPARS

SEQ ID NO: 646184 - protein, 9 aa, Homo Sapiens
AGAPQKICT

SEQ ID NO: 646185 - protein, 9 aa, Homo Sapiens
VCATSADRY

SEQ ID NO: 646186 - protein, 9 aa, Homo Sapiens
VGYAEYALA

SEQ ID NO: 646187 - protein, 9 aa, Homo Sapiens
KDNFWEMDD

SEQ ID NO: 646188 - protein, 9 aa, Homo Sapiens
ADFIIMGLT

SEQ ID NO: 646189 - protein, 9 aa, Homo Sapiens
PNNRRPSTE

SEQ ID NO: 646190 - protein, 9 aa, Homo Sapiens
SISIAIIMV

SEQ ID NO: 646191 - protein, 9 aa, Homo Sapiens
CTGLSATAI

SEQ ID NO: 646192 - protein, 9 aa, Homo Sapiens
GKCRNECHD

SEQ ID NO: 646193 - protein, 9 aa, Homo Sapiens
CHCGVPAFS

SEQ ID NO: 646194 - protein, 9 aa, Homo Sapiens
KPTSGRQGS

SEQ ID NO: 646195 - protein, 9 aa, Homo Sapiens
ASLLIKFWR

SEQ ID NO: 646196 - protein, 9 aa, Homo Sapiens
TNNVGIIYK

SEQ ID NO: 646197 - protein, 9 aa, Homo Sapiens
SRATTRPAL

SEQ ID NO: 646198 - protein, 9 aa, Homo Sapiens
SPLLYNVAM

SEQ ID NO: 646199 - protein, 9 aa, Homo Sapiens
GHTRGPRLC

SEQ ID NO: 646200 - protein, 9 aa, Homo Sapiens
RHLIEGLKF

SEQ ID NO: 646201 - protein, 9 aa, Homo Sapiens
LVWTGRIPI

SEQ ID NO: 646202 - protein, 9 aa, Homo Sapiens
KVVLHLIDQ

SEQ ID NO: 646203 - protein, 9 aa, Homo Sapiens
HRPPPFIPS

SEQ ID NO: 646204 - protein, 9 aa, Homo Sapiens
ENGQDYFDY

SEQ ID NO: 646205 - protein, 9 aa, Homo Sapiens
IYPVHVQLY

SEQ ID NO: 646206 - protein, 9 aa, Homo Sapiens
VVMASAESE

SEQ ID NO: 646207 - protein, 9 aa, Homo Sapiens
IQNGILIES

SEQ ID NO: 646208 - protein, 9 aa, Homo Sapiens
IPNFQQDDA

SEQ ID NO: 646209 - protein, 9 aa, Homo Sapiens
AAVQKDLSD

SEQ ID NO: 646210 - protein, 9 aa, Homo Sapiens
PPATTTRYP

SEQ ID NO: 646211 - protein, 9 aa, Homo Sapiens
PYRQLHFLA

SEQ ID NO: 646212 - protein, 9 aa, Homo Sapiens
ESTTFHSVP

SEQ ID NO: 646213 - protein, 9 aa, Homo Sapiens
LFSKWIPYM

SEQ ID NO: 646214 - protein, 9 aa, Homo Sapiens
VNEVPDYHK

SEQ ID NO: 646215 - protein, 9 aa, Homo Sapiens
AILSTTPLS

SEQ ID NO: 646216 - protein, 9 aa, Homo Sapiens
KKLDTVGDF

SEQ ID NO: 646217 - protein, 9 aa, Homo Sapiens
LVQLKVINK

SEQ ID NO: 646218 - protein, 9 aa, Homo Sapiens
AASGPSFWL

SEQ ID NO: 646219 - protein, 9 aa, Homo Sapiens
AEDTVVPLA

SEQ ID NO: 646220 - protein, 9 aa, Homo Sapiens
HFSAFGNIL

SEQ ID NO: 646221 - protein, 9 aa, Homo Sapiens
LLEGEKESV

SEQ ID NO: 646222 - protein, 9 aa, Homo Sapiens
SGNYFASQF

SEQ ID NO: 646223 - protein, 9 aa, Homo Sapiens
IIEEVDKDG

SEQ ID NO: 646224 - protein, 9 aa, Homo Sapiens
PWCRVEGHK

SEQ ID NO: 646225 - protein, 9 aa, Homo Sapiens
WKEHPRDLK

SEQ ID NO: 646226 - protein, 9 aa, Homo Sapiens
ELIGLDYLL

SEQ ID NO: 646227 - protein, 9 aa, Homo Sapiens
MHIEQANEC

SEQ ID NO: 646228 - protein, 9 aa, Homo Sapiens
AIMNNDSNF

SEQ ID NO: 646229 - protein, 9 aa, Homo Sapiens
GRQPTKPLV

SEQ ID NO: 646230 - protein, 9 aa, Homo Sapiens
FLCFLLTYA

SEQ ID NO: 646231 - protein, 9 aa, Homo Sapiens
IQIAVILRN

SEQ ID NO: 646232 - protein, 9 aa, Homo Sapiens
ELENTALEE

SEQ ID NO: 646233 - protein, 9 aa, Homo Sapiens
QQSEAPMEG

SEQ ID NO: 646234 - protein, 9 aa, Homo Sapiens
PSISIAIIM

SEQ ID NO: 646235 - protein, 9 aa, Homo Sapiens
EKAFVCKAH

SEQ ID NO: 646236 - protein, 9 aa, Homo Sapiens
GKTDSSSLC

SEQ ID NO: 646237 - protein, 9 aa, Homo Sapiens
EPVPGTRRS

SEQ ID NO: 646238 - protein, 9 aa, Homo Sapiens
NAHLSVPFP

SEQ ID NO: 646239 - protein, 9 aa, Homo Sapiens
VSVRPLVIQ

SEQ ID NO: 646240 - protein, 9 aa, Homo Sapiens
THTRVPFNG

SEQ ID NO: 646241 - protein, 9 aa, Homo Sapiens
LASSDDDLR

SEQ ID NO: 646242 - protein, 9 aa, Homo Sapiens
LNAHLSVPF

SEQ ID NO: 646243 - protein, 9 aa, Homo Sapiens
ATFNEISTI

SEQ ID NO: 646244 - protein, 9 aa, Homo Sapiens
SETFGKDMS

SEQ ID NO: 646245 - protein, 9 aa, Homo Sapiens
GCVVQASDL

SEQ ID NO: 646246 - protein, 9 aa, Homo Sapiens
KECVKAFLQ

SEQ ID NO: 646247 - protein, 9 aa, Homo Sapiens
FKFWDFVLK

SEQ ID NO: 646248 - protein, 9 aa, Homo Sapiens
ALETYLQVM

SEQ ID NO: 646249 - protein, 9 aa, Homo Sapiens
TCHCGVPAF

SEQ ID NO: 646250 - protein, 9 aa, Homo Sapiens
ARRSHRSSK

SEQ ID NO: 646251 - protein, 9 aa, Homo Sapiens
AFKFWDFVL

SEQ ID NO: 646252 - protein, 9 aa, Homo Sapiens
PKPAAPASP

SEQ ID NO: 646253 - protein, 9 aa, Homo Sapiens
PPEEVCATS

SEQ ID NO: 646254 - protein, 9 aa, Homo Sapiens
MWRTLMERV

SEQ ID NO: 646255 - protein, 9 aa, Homo Sapiens
ECKECVKAF

SEQ ID NO: 646256 - protein, 9 aa, Homo Sapiens
VKEDVPFPL

SEQ ID NO: 646257 - protein, 9 aa, Homo Sapiens
EFLMRVIFG

SEQ ID NO: 646258 - protein, 9 aa, Homo Sapiens
PRAVLAYPC

SEQ ID NO: 646259 - protein, 9 aa, Homo Sapiens
RLVRCPPVC

SEQ ID NO: 646260 - protein, 9 aa, Homo Sapiens
SPRPLPPPP

SEQ ID NO: 646261 - protein, 9 aa, Homo Sapiens
VEIQPSSPN

SEQ ID NO: 646262 - protein, 9 aa, Homo Sapiens
VNILSAQTH

SEQ ID NO: 646263 - protein, 9 aa, Homo Sapiens
DEKGELRKS

SEQ ID NO: 646264 - protein, 9 aa, Homo Sapiens
PVIKSRMMK

SEQ ID NO: 646265 - protein, 9 aa, Homo Sapiens
LSSMDVTNA

SEQ ID NO: 646266 - protein, 9 aa, Homo Sapiens
TTSPGHHVY

SEQ ID NO: 646267 - protein, 9 aa, Homo Sapiens
PPFLLQGSC

SEQ ID NO: 646268 - protein, 9 aa, Homo Sapiens
AKKQQIQPS

SEQ ID NO: 646269 - protein, 9 aa, Homo Sapiens
ARKHFNSFF

SEQ ID NO: 646270 - protein, 9 aa, Homo Sapiens
PDTFEDAAN

SEQ ID NO: 646271 - protein, 9 aa, Homo Sapiens
SMCITADLQ

SEQ ID NO: 646272 - protein, 9 aa, Homo Sapiens
LPRAVLAYP

SEQ ID NO: 646273 - protein, 9 aa, Homo Sapiens
YGVVLLLAA

SEQ ID NO: 646274 - protein, 9 aa, Homo Sapiens
GPRKVFLEK

SEQ ID NO: 646275 - protein, 9 aa, Homo Sapiens
TVFYFLLGD

SEQ ID NO: 646276 - protein, 9 aa, Homo Sapiens
SPKFRSQNQ

SEQ ID NO: 646277 - protein, 9 aa, Homo Sapiens
EEVDKDGSG

SEQ ID NO: 646278 - protein, 9 aa, Homo Sapiens
WIPYMADVK

SEQ ID NO: 646279 - protein, 9 aa, Homo Sapiens
RQLHFLALQ

SEQ ID NO: 646280 - protein, 9 aa, Homo Sapiens
IRDSNCSTL

SEQ ID NO: 646281 - protein, 9 aa, Homo Sapiens
NERHREHRR

SEQ ID NO: 646282 - protein, 9 aa, Homo Sapiens
QGPPRTGWP

SEQ ID NO: 646283 - protein, 9 aa, Homo Sapiens
IPPFLLQGS

SEQ ID NO: 646284 - protein, 9 aa, Homo Sapiens
TDPAFGSPG

SEQ ID NO: 646285 - protein, 9 aa, Homo Sapiens
DEPVPGTRR

SEQ ID NO: 646286 - protein, 9 aa, Homo Sapiens
PLSTLQSVL

SEQ ID NO: 646287 - protein, 9 aa, Homo Sapiens
GWPSPAGPA

SEQ ID NO: 646288 - protein, 9 aa, Homo Sapiens
YKTTKQSTE

SEQ ID NO: 646289 - protein, 9 aa, Homo Sapiens
NRDAHIRDS

SEQ ID NO: 646290 - protein, 9 aa, Homo Sapiens
NEVPDYHKD

SEQ ID NO: 646291 - protein, 9 aa, Homo Sapiens
DLFPAEMRE

SEQ ID NO: 646292 - protein, 9 aa, Homo Sapiens
YPCVATVTI

SEQ ID NO: 646293 - protein, 9 aa, Homo Sapiens
LGLPFLDIQ

SEQ ID NO: 646294 - protein, 9 aa, Homo Sapiens
EEERKHRIE

SEQ ID NO: 646295 - protein, 9 aa, Homo Sapiens
WISSEFDEK

SEQ ID NO: 646296 - protein, 9 aa, Homo Sapiens
YSSMCITAD

SEQ ID NO: 646297 - protein, 9 aa, Homo Sapiens
PLILQYIPK

SEQ ID NO: 646298 - protein, 9 aa, Homo Sapiens
GGLVDITRQ

SEQ ID NO: 646299 - protein, 9 aa, Homo Sapiens
NSHVKKEDI

SEQ ID NO: 646300 - protein, 9 aa, Homo Sapiens
MRGKCRNEC

SEQ ID NO: 646301 - protein, 9 aa, Homo Sapiens
FYTCIPTVK

SEQ ID NO: 646302 - protein, 9 aa, Homo Sapiens
FASQFFMGG

SEQ ID NO: 646303 - protein, 9 aa, Homo Sapiens
QAEPLDLSV

SEQ ID NO: 646304 - protein, 9 aa, Homo Sapiens
GLWAMMKTN

SEQ ID NO: 646305 - protein, 9 aa, Homo Sapiens
WCRVEGHKP

SEQ ID NO: 646306 - protein, 9 aa, Homo Sapiens
IHPAGRQPT

SEQ ID NO: 646307 - protein, 9 aa, Homo Sapiens
VIKSRMMKE

SEQ ID NO: 646308 - protein, 9 aa, Homo Sapiens
SSSITLQAS

SEQ ID NO: 646309 - protein, 9 aa, Homo Sapiens
EVCATSADR

SEQ ID NO: 646310 - protein, 9 aa, Homo Sapiens
GLPFLDIQT

SEQ ID NO: 646311 - protein, 9 aa, Homo Sapiens
DLNKRIRTV

SEQ ID NO: 646312 - protein, 9 aa, Homo Sapiens
YGPVLNMPT

SEQ ID NO: 646313 - protein, 9 aa, Homo Sapiens
SHVKKEDIW

SEQ ID NO: 646314 - protein, 9 aa, Homo Sapiens
TQVLVWISY

SEQ ID NO: 646315 - protein, 9 aa, Homo Sapiens
RPLVIQKLE

SEQ ID NO: 646316 - protein, 9 aa, Homo Sapiens
PCRRSSRSG

SEQ ID NO: 646317 - protein, 9 aa, Homo Sapiens
QPEICKAVW

SEQ ID NO: 646318 - protein, 9 aa, Homo Sapiens
TQKWFKLRL

SEQ ID NO: 646319 - protein, 9 aa, Homo Sapiens
EFYTCIPTV

SEQ ID NO: 646320 - protein, 9 aa, Homo Sapiens
SPAPPWKEH

SEQ ID NO: 646321 - protein, 9 aa, Homo Sapiens
CLQGCDLLV

SEQ ID NO: 646322 - protein, 9 aa, Homo Sapiens
GSIAMHLSI

SEQ ID NO: 646323 - protein, 9 aa, Homo Sapiens
TKDHSSMSS

SEQ ID NO: 646324 - protein, 9 aa, Homo Sapiens
ATTTRYPTP

SEQ ID NO: 646325 - protein, 9 aa, Homo Sapiens
GSTDTDKHI

SEQ ID NO: 646326 - protein, 9 aa, Homo Sapiens
TRVPFNGIF

SEQ ID NO: 646327 - protein, 9 aa, Homo Sapiens
RGLHLDFAQ

SEQ ID NO: 646328 - protein, 9 aa, Homo Sapiens
QNQSYMRAV

SEQ ID NO: 646329 - protein, 9 aa, Homo Sapiens
KGHTCDSGA

SEQ ID NO: 646330 - protein, 9 aa, Homo Sapiens
YGPRKVFLE

SEQ ID NO: 646331 - protein, 9 aa, Homo Sapiens
PPFIPSGPS

SEQ ID NO: 646332 - protein, 9 aa, Homo Sapiens
LDEFLQNLN

SEQ ID NO: 646333 - protein, 9 aa, Homo Sapiens
RSMPGLPWL

SEQ ID NO: 646334 - protein, 9 aa, Homo Sapiens
CRGAFRSAR

SEQ ID NO: 646335 - protein, 9 aa, Homo Sapiens
STDTDKHIK

SEQ ID NO: 646336 - protein, 9 aa, Homo Sapiens
LSLLLMVGM

SEQ ID NO: 646337 - protein, 9 aa, Homo Sapiens
CCNWKCTGL

SEQ ID NO: 646338 - protein, 9 aa, Homo Sapiens
SMAKLTMHI

SEQ ID NO: 646339 - protein, 9 aa, Homo Sapiens
FHLLQLRSE

SEQ ID NO: 646340 - protein, 9 aa, Homo Sapiens
PHHSGIYPV

SEQ ID NO: 646341 - protein, 9 aa, Homo Sapiens
LSYVEDDHI

SEQ ID NO: 646342 - protein, 9 aa, Homo Sapiens
APGALTCCP

SEQ ID NO: 646343 - protein, 9 aa, Homo Sapiens
GGEDAHHTR

SEQ ID NO: 646344 - protein, 9 aa, Homo Sapiens
AQSPFGTLY

SEQ ID NO: 646345 - protein, 9 aa, Homo Sapiens
IVARDVVDS

SEQ ID NO: 646346 - protein, 9 aa, Homo Sapiens
SLVLSMILI

SEQ ID NO: 646347 - protein, 9 aa, Homo Sapiens
LFMTSLDAT

SEQ ID NO: 646348 - protein, 9 aa, Homo Sapiens
DAPVNALAQ

SEQ ID NO: 646349 - protein, 9 aa, Homo Sapiens
ILSAQTHEP

SEQ ID NO: 646350 - protein, 9 aa, Homo Sapiens
VLKICLAHF

SEQ ID NO: 646351 - protein, 9 aa, Homo Sapiens
DCRKLPNNN

SEQ ID NO: 646352 - protein, 9 aa, Homo Sapiens
LRDLLPSED

SEQ ID NO: 646353 - protein, 9 aa, Homo Sapiens
QQIQPSQLE

SEQ ID NO: 646354 - protein, 9 aa, Homo Sapiens
EGPHLSSRP

SEQ ID NO: 646355 - protein, 9 aa, Homo Sapiens
AARTGDVPG

SEQ ID NO: 646356 - protein, 9 aa, Homo Sapiens
YEFYTCIPT

SEQ ID NO: 646357 - protein, 9 aa, Homo Sapiens
VVLHLIDQY

SEQ ID NO: 646358 - protein, 9 aa, Homo Sapiens
LYNVAMSDR

SEQ ID NO: 646359 - protein, 9 aa, Homo Sapiens
EISTILIIL

SEQ ID NO: 646360 - protein, 9 aa, Homo Sapiens
GKSTTKTVR

SEQ ID NO: 646361 - protein, 9 aa, Homo Sapiens
PIHPAGRQP

SEQ ID NO: 646362 - protein, 9 aa, Homo Sapiens
STLLLEPFS

SEQ ID NO: 646363 - protein, 9 aa, Homo Sapiens
SVLGGREKE

SEQ ID NO: 646364 - protein, 9 aa, Homo Sapiens
EIPTHLSLG

SEQ ID NO: 646365 - protein, 9 aa, Homo Sapiens
PASPAPPWK

SEQ ID NO: 646366 - protein, 9 aa, Homo Sapiens
LHLIDQYFK

SEQ ID NO: 646367 - protein, 9 aa, Homo Sapiens
VPADQVYIT

SEQ ID NO: 646368 - protein, 9 aa, Homo Sapiens
YSAVLGTMH

SEQ ID NO: 646369 - protein, 9 aa, Homo Sapiens
QAVQTEMLE

SEQ ID NO: 646370 - protein, 9 aa, Homo Sapiens
SSMDVTNAH

SEQ ID NO: 646371 - protein, 9 aa, Homo Sapiens
DKDGSGTID

SEQ ID NO: 646372 - protein, 9 aa, Homo Sapiens
AISDLEEGL

SEQ ID NO: 646373 - protein, 9 aa, Homo Sapiens
PAMVTLACI

SEQ ID NO: 646374 - protein, 9 aa, Homo Sapiens
VPVFNKHRS

SEQ ID NO: 646375 - protein, 9 aa, Homo Sapiens
FTRCGIQSF

SEQ ID NO: 646376 - protein, 9 aa, Homo Sapiens
WSPRHRVIQ

SEQ ID NO: 646377 - protein, 9 aa, Homo Sapiens
FSENGQDYF

SEQ ID NO: 646378 - protein, 9 aa, Homo Sapiens
ETSGALPGD

SEQ ID NO: 646379 - protein, 9 aa, Homo Sapiens
RVYECKECV

SEQ ID NO: 646380 - protein, 9 aa, Homo Sapiens
LLLMVGMGS

SEQ ID NO: 646381 - protein, 9 aa, Homo Sapiens
AELDEFLQN

SEQ ID NO: 646382 - protein, 9 aa, Homo Sapiens
KAFVCKAHL

SEQ ID NO: 646383 - protein, 9 aa, Homo Sapiens
YTFADGETR

SEQ ID NO: 646384 - protein, 9 aa, Homo Sapiens
SLLLMVGMG

SEQ ID NO: 646385 - protein, 9 aa, Homo Sapiens
NSSRLGKYM

SEQ ID NO: 646386 - protein, 9 aa, Homo Sapiens
MTSLDATVN

SEQ ID NO: 646387 - protein, 9 aa, Homo Sapiens
LGKKPQAKQ

SEQ ID NO: 646388 - protein, 9 aa, Homo Sapiens
GKKEKDLGL

SEQ ID NO: 646389 - protein, 9 aa, Homo Sapiens
HSSMSSYSV

SEQ ID NO: 646390 - protein, 9 aa, Homo Sapiens
WALLLLLLC

SEQ ID NO: 646391 - protein, 9 aa, Homo Sapiens
SLLTTRKTS

SEQ ID NO: 646392 - protein, 9 aa, Homo Sapiens
ILELYGVVL

SEQ ID NO: 646393 - protein, 9 aa, Homo Sapiens
LLSPAPPPG

SEQ ID NO: 646394 - protein, 9 aa, Homo Sapiens
TTVKTSYIL

SEQ ID NO: 646395 - protein, 9 aa, Homo Sapiens
KSTTKTVRK

SEQ ID NO: 646396 - protein, 9 aa, Homo Sapiens
YTTGKRRSR

SEQ ID NO: 646397 - protein, 9 aa, Homo Sapiens
CATSADRYT

SEQ ID NO: 646398 - protein, 9 aa, Homo Sapiens
TTRKTSLKS

SEQ ID NO: 646399 - protein, 9 aa, Homo Sapiens
VNILTGMPC

SEQ ID NO: 646400 - protein, 9 aa, Homo Sapiens
HMTEKLHIP

SEQ ID NO: 646401 - protein, 9 aa, Homo Sapiens
LFTTSPLIL

SEQ ID NO: 646402 - protein, 9 aa, Homo Sapiens
TGDVPGSPL

SEQ ID NO: 646403 - protein, 9 aa, Homo Sapiens
VYECKECVK

SEQ ID NO: 646404 - protein, 9 aa, Homo Sapiens
MTEWERGLE

SEQ ID NO: 646405 - protein, 9 aa, Homo Sapiens
WSKTQVLVW

SEQ ID NO: 646406 - protein, 9 aa, Homo Sapiens
WTGRIPIYS

SEQ ID NO: 646407 - protein, 9 aa, Homo Sapiens
HNGGMQCKP

SEQ ID NO: 646408 - protein, 9 aa, Homo Sapiens
CIPTVKLQK

SEQ ID NO: 646409 - protein, 9 aa, Homo Sapiens
HITCRLYGE

SEQ ID NO: 646410 - protein, 9 aa, Homo Sapiens
TVKTSYILD

SEQ ID NO: 646411 - protein, 9 aa, Homo Sapiens
LLLLLLCSQ

SEQ ID NO: 646412 - protein, 9 aa, Homo Sapiens
KLAELDEFL

SEQ ID NO: 646413 - protein, 9 aa, Homo Sapiens
GSSFALVQL

SEQ ID NO: 646414 - protein, 9 aa, Homo Sapiens
KLTASERIS

SEQ ID NO: 646415 - protein, 9 aa, Homo Sapiens
NYPYRQLHF

SEQ ID NO: 646416 - protein, 9 aa, Homo Sapiens
VLRAGHHRN

SEQ ID NO: 646417 - protein, 9 aa, Homo Sapiens
VFPGMNYCT

SEQ ID NO: 646418 - protein, 9 aa, Homo Sapiens
GPNKVEFIK

SEQ ID NO: 646419 - protein, 9 aa, Homo Sapiens
LTSKMGKWC

SEQ ID NO: 646420 - protein, 9 aa, Homo Sapiens
KFWRKEEKE

SEQ ID NO: 646421 - protein, 9 aa, Homo Sapiens
LNEVWHLVG

SEQ ID NO: 646422 - protein, 9 aa, Homo Sapiens
ATPKLLLEG

SEQ ID NO: 646423 - protein, 9 aa, Homo Sapiens
VRTNNVGII

SEQ ID NO: 646424 - protein, 9 aa, Homo Sapiens
KEKDLGLPF

SEQ ID NO: 646425 - protein, 9 aa, Homo Sapiens
IWVLVWTGR

SEQ ID NO: 646426 - protein, 9 aa, Homo Sapiens
TQEVSVRPL

SEQ ID NO: 646427 - protein, 9 aa, Homo Sapiens
EARGHHRLV

SEQ ID NO: 646428 - protein, 9 aa, Homo Sapiens
KFWDFVLKS

SEQ ID NO: 646429 - protein, 9 aa, Homo Sapiens
GQVFCVFHA

SEQ ID NO: 646430 - protein, 9 aa, Homo Sapiens
AEGSIWSFE

SEQ ID NO: 646431 - protein, 9 aa, Homo Sapiens
KLPNNNDPN

SEQ ID NO: 646432 - protein, 9 aa, Homo Sapiens
LVRCPPVCS

SEQ ID NO: 646433 - protein, 9 aa, Homo Sapiens
DDDTKDHSS

SEQ ID NO: 646434 - protein, 9 aa, Homo Sapiens
LKICLAHFA

SEQ ID NO: 646435 - protein, 9 aa, Homo Sapiens
LACIDTWVY

SEQ ID NO: 646436 - protein, 9 aa, Homo Sapiens
GTRLASSDD

SEQ ID NO: 646437 - protein, 9 aa, Homo Sapiens
FGSPGRPLL

SEQ ID NO: 646438 - protein, 9 aa, Homo Sapiens
RSSSGRSNE

SEQ ID NO: 646439 - protein, 9 aa, Homo Sapiens
SCSMSSRSM

SEQ ID NO: 646440 - protein, 9 aa, Homo Sapiens
VVSAPLVLH

SEQ ID NO: 646441 - protein, 9 aa, Homo Sapiens
VQTEMLETI

SEQ ID NO: 646442 - protein, 9 aa, Homo Sapiens
LMGQGGEDA

SEQ ID NO: 646443 - protein, 9 aa, Homo Sapiens
VPILVVQVL

SEQ ID NO: 646444 - protein, 9 aa, Homo Sapiens
PISFSTLLL

SEQ ID NO: 646445 - protein, 9 aa, Homo Sapiens
RRPSTEPSE

SEQ ID NO: 646446 - protein, 9 aa, Homo Sapiens
EKDLGLPFL

SEQ ID NO: 646447 - protein, 9 aa, Homo Sapiens
DSNCSTLLA

SEQ ID NO: 646448 - protein, 9 aa, Homo Sapiens
VIQIAVILR

SEQ ID NO: 646449 - protein, 9 aa, Homo Sapiens
MRVIFGPNK

SEQ ID NO: 646450 - protein, 9 aa, Homo Sapiens
LYGVVLLLA

SEQ ID NO: 646451 - protein, 9 aa, Homo Sapiens
TPKLLLEGE

SEQ ID NO: 646452 - protein, 9 aa, Homo Sapiens
QDGSSFALV

SEQ ID NO: 646453 - protein, 9 aa, Homo Sapiens
QEGSFSARW

SEQ ID NO: 646454 - protein, 9 aa, Homo Sapiens
EVSVRPLVI

SEQ ID NO: 646455 - protein, 9 aa, Homo Sapiens
HIRDSWLDN

SEQ ID NO: 646456 - protein, 9 aa, Homo Sapiens
ADVLVYLAE

SEQ ID NO: 646457 - protein, 9 aa, Homo Sapiens
RAQSVPTPR

SEQ ID NO: 646458 - protein, 9 aa, Homo Sapiens
PAPVLLSPA

SEQ ID NO: 646459 - protein, 9 aa, Homo Sapiens
DHTQFLIEV

SEQ ID NO: 646460 - protein, 9 aa, Homo Sapiens
WGHRHPHRP

SEQ ID NO: 646461 - protein, 9 aa, Homo Sapiens
NNDPNYLCM

SEQ ID NO: 646462 - protein, 9 aa, Homo Sapiens
VQLKVINKM

SEQ ID NO: 646463 - protein, 9 aa, Homo Sapiens
HCGVPAFSH

SEQ ID NO: 646464 - protein, 9 aa, Homo Sapiens
YMVRYTFAD

SEQ ID NO: 646465 - protein, 9 aa, Homo Sapiens
EKKLDTVGD

SEQ ID NO: 646466 - protein, 9 aa, Homo Sapiens
ILVVMASAE

SEQ ID NO: 646467 - protein, 9 aa, Homo Sapiens
GPPRTGWPS

SEQ ID NO: 646468 - protein, 9 aa, Homo Sapiens
SSRSMPGLP

SEQ ID NO: 646469 - protein, 9 aa, Homo Sapiens
KPRLEDPQS

SEQ ID NO: 646470 - protein, 9 aa, Homo Sapiens
KSRMMKEFR

SEQ ID NO: 646471 - protein, 9 aa, Homo Sapiens
QGCDLLVQQ

SEQ ID NO: 646472 - protein, 9 aa, Homo Sapiens
ILIILTSYA

SEQ ID NO: 646473 - protein, 9 aa, Homo Sapiens
LNMPTSKEN

SEQ ID NO: 646474 - protein, 9 aa, Homo Sapiens
TASERISLL

SEQ ID NO: 646475 - protein, 9 aa, Homo Sapiens
LEEGLGRLG

SEQ ID NO: 646476 - protein, 9 aa, Homo Sapiens
RTNNVGIIY

SEQ ID NO: 646477 - protein, 9 aa, Homo Sapiens
IAKACLQGC

SEQ ID NO: 646478 - protein, 9 aa, Homo Sapiens
MGKDPSPRT

SEQ ID NO: 646479 - protein, 9 aa, Homo Sapiens
KDGSGTIDF

SEQ ID NO: 646480 - protein, 9 aa, Homo Sapiens
DPAFGSPGR

SEQ ID NO: 646481 - protein, 9 aa, Homo Sapiens
DLEEGLGRL

SEQ ID NO: 646482 - protein, 9 aa, Homo Sapiens
TTRYPTPTP

SEQ ID NO: 646483 - protein, 9 aa, Homo Sapiens
ERGLERDEF

SEQ ID NO: 646484 - protein, 9 aa, Homo Sapiens
LTCCPVAWG

SEQ ID NO: 646485 - protein, 9 aa, Homo Sapiens
PESTTFHSV

SEQ ID NO: 646486 - protein, 9 aa, Homo Sapiens
SSSPADTTS

SEQ ID NO: 646487 - protein, 9 aa, Homo Sapiens
VSSSLGISV

SEQ ID NO: 646488 - protein, 9 aa, Homo Sapiens
RSYRDLSPP

SEQ ID NO: 646489 - protein, 9 aa, Homo Sapiens
ASGPSFWLG

SEQ ID NO: 646490 - protein, 9 aa, Homo Sapiens
RAVGVLGAS

SEQ ID NO: 646491 - protein, 9 aa, Homo Sapiens
RCPASCSCT

SEQ ID NO: 646492 - protein, 9 aa, Homo Sapiens
GRIPIYSFH

SEQ ID NO: 646493 - protein, 9 aa, Homo Sapiens
YLQVMSRNS

SEQ ID NO: 646494 - protein, 9 aa, Homo Sapiens
QFLIEVKES

SEQ ID NO: 646495 - protein, 9 aa, Homo Sapiens
FKEEEKTKK

SEQ ID NO: 646496 - protein, 9 aa, Homo Sapiens
LSRATTRPA

SEQ ID NO: 646497 - protein, 9 aa, Homo Sapiens
LETYLQVMS

SEQ ID NO: 646498 - protein, 9 aa, Homo Sapiens
LRAGHHRNA

SEQ ID NO: 646499 - protein, 9 aa, Homo Sapiens
EGSFSARWP

SEQ ID NO: 646500 - protein, 9 aa, Homo Sapiens
PGQYPTEEP

SEQ ID NO: 646501 - protein, 9 aa, Homo Sapiens
NSPKFRSQN

SEQ ID NO: 646502 - protein, 9 aa, Homo Sapiens
SIAMHLSIT

SEQ ID NO: 646503 - protein, 9 aa, Homo Sapiens
ERYYSAVLG

SEQ ID NO: 646504 - protein, 9 aa, Homo Sapiens
FLEKPTLPH

SEQ ID NO: 646505 - protein, 9 aa, Homo Sapiens
DKYPETSGA

SEQ ID NO: 646506 - protein, 9 aa, Homo Sapiens
DDSYVVPST

SEQ ID NO: 646507 - protein, 9 aa, Homo Sapiens
LQLLNAHLS

SEQ ID NO: 646508 - protein, 9 aa, Homo Sapiens
YLAEDTVVP

SEQ ID NO: 646509 - protein, 9 aa, Homo Sapiens
TSTQSRLIT

SEQ ID NO: 646510 - protein, 9 aa, Homo Sapiens
VFCVFHALL

SEQ ID NO: 646511 - protein, 9 aa, Homo Sapiens
QFFMGGEKF

SEQ ID NO: 646512 - protein, 9 aa, Homo Sapiens
ACLQGCDLL

SEQ ID NO: 646513 - protein, 9 aa, Homo Sapiens
LDPHTGWEY

SEQ ID NO: 646514 - protein, 9 aa, Homo Sapiens
LDFAQSPFG

SEQ ID NO: 646515 - protein, 9 aa, Homo Sapiens
PPPATTTRY

SEQ ID NO: 646516 - protein, 9 aa, Homo Sapiens
GTSLLTTRK

SEQ ID NO: 646517 - protein, 9 aa, Homo Sapiens
HKDIHTYLR

SEQ ID NO: 646518 - protein, 9 aa, Homo Sapiens
STTKTVRKN

SEQ ID NO: 646519 - protein, 9 aa, Homo Sapiens
YFASQFFMG

SEQ ID NO: 646520 - protein, 9 aa, Homo Sapiens
SNPVLINNA

SEQ ID NO: 646521 - protein, 9 aa, Homo Sapiens
HSGIYPVHV

SEQ ID NO: 646522 - protein, 9 aa, Homo Sapiens
IDFAHITCR

SEQ ID NO: 646523 - protein, 9 aa, Homo Sapiens
TDTDKHIKE

SEQ ID NO: 646524 - protein, 9 aa, Homo Sapiens
GFSWRLPSA

SEQ ID NO: 646525 - protein, 9 aa, Homo Sapiens
FLNRDAHIR

SEQ ID NO: 646526 - protein, 9 aa, Homo Sapiens
NPSQQPVLM

SEQ ID NO: 646527 - protein, 9 aa, Homo Sapiens
LKFTWVPKQ

SEQ ID NO: 646528 - protein, 9 aa, Homo Sapiens
RPLPPPPAT

SEQ ID NO: 646529 - protein, 9 aa, Homo Sapiens
VSFFVEDSI

SEQ ID NO: 646530 - protein, 9 aa, Homo Sapiens
EHNGGMQCK

SEQ ID NO: 646531 - protein, 9 aa, Homo Sapiens
IATLEGFSW

SEQ ID NO: 646532 - protein, 9 aa, Homo Sapiens
TTGKRRSRR

SEQ ID NO: 646533 - protein, 9 aa, Homo Sapiens
WILELYGVV

SEQ ID NO: 646534 - protein, 9 aa, Homo Sapiens
APQKICTYQ

SEQ ID NO: 646535 - protein, 9 aa, Homo Sapiens
SPPFSSSSG

SEQ ID NO: 646536 - protein, 9 aa, Homo Sapiens
LELYGVVLL

SEQ ID NO: 646537 - protein, 9 aa, Homo Sapiens
DEEGGLKFT

SEQ ID NO: 646538 - protein, 9 aa, Homo Sapiens
RDEPVPGTR

SEQ ID NO: 646539 - protein, 9 aa, Homo Sapiens
RNRSLLKKD

SEQ ID NO: 646540 - protein, 9 aa, Homo Sapiens
LLKKDYDDF

SEQ ID NO: 646541 - protein, 9 aa, Homo Sapiens
GLKFTWVPK

SEQ ID NO: 646542 - protein, 9 aa, Homo Sapiens
ATLEGFSWR

SEQ ID NO: 646543 - protein, 9 aa, Homo Sapiens
PGFKGHTCD

SEQ ID NO: 646544 - protein, 9 aa, Homo Sapiens
QDAPVNALA

SEQ ID NO: 646545 - protein, 9 aa, Homo Sapiens
PSADGAVSS

SEQ ID NO: 646546 - protein, 9 aa, Homo Sapiens
LLYNVAMSD

SEQ ID NO: 646547 - protein, 9 aa, Homo Sapiens
RKHRIEQDM

SEQ ID NO: 646548 - protein, 9 aa, Homo Sapiens
AFGSPGRPL

SEQ ID NO: 646549 - protein, 9 aa, Homo Sapiens
DEKEKLKKW

SEQ ID NO: 646550 - protein, 9 aa, Homo Sapiens
DEFHLLQLR

SEQ ID NO: 646551 - protein, 9 aa, Homo Sapiens
VVQASDLFP

SEQ ID NO: 646552 - protein, 9 aa, Homo Sapiens
HLDFAQSPF

SEQ ID NO: 646553 - protein, 9 aa, Homo Sapiens
RVEGHKPSI

SEQ ID NO: 646554 - protein, 9 aa, Homo Sapiens
PRPLPPPPA

SEQ ID NO: 646555 - protein, 9 aa, Homo Sapiens
FISDCQVFL

SEQ ID NO: 646556 - protein, 9 aa, Homo Sapiens
RFYTTGKRR

SEQ ID NO: 646557 - protein, 9 aa, Homo Sapiens
AASLLIKFW

SEQ ID NO: 646558 - protein, 9 aa, Homo Sapiens
FADGETREV

SEQ ID NO: 646559 - protein, 9 aa, Homo Sapiens
DVVDSLMCE

SEQ ID NO: 646560 - protein, 9 aa, Homo Sapiens
EYKVSSVLN

SEQ ID NO: 646561 - protein, 9 aa, Homo Sapiens
DDSTMKTLT

SEQ ID NO: 646562 - protein, 9 aa, Homo Sapiens
TNQMPTSEL

SEQ ID NO: 646563 - protein, 9 aa, Homo Sapiens
MSKLATWDS

SEQ ID NO: 646564 - protein, 9 aa, Homo Sapiens
VLMYDEHGE

SEQ ID NO: 646565 - protein, 9 aa, Homo Sapiens
RDAHIRDSW

SEQ ID NO: 646566 - protein, 9 aa, Homo Sapiens
TKNKKLTYL

SEQ ID NO: 646567 - protein, 9 aa, Homo Sapiens
QLLNLFMTS

SEQ ID NO: 646568 - protein, 9 aa, Homo Sapiens
IPKQDGGEH

SEQ ID NO: 646569 - protein, 9 aa, Homo Sapiens
SAQTHEPRQ

SEQ ID NO: 646570 - protein, 9 aa, Homo Sapiens
EVPDYHKDI

SEQ ID NO: 646571 - protein, 9 aa, Homo Sapiens
LEPFSGLRS

SEQ ID NO: 646572 - protein, 9 aa, Homo Sapiens
PVAWGHRHP

SEQ ID NO: 646573 - protein, 9 aa, Homo Sapiens
PSGPSPRPL

SEQ ID NO: 646574 - protein, 9 aa, Homo Sapiens
VVLLLAAVM

SEQ ID NO: 646575 - protein, 9 aa, Homo Sapiens
QDIKLSFFK

SEQ ID NO: 646576 - protein, 9 aa, Homo Sapiens
SNEDCVEIY

SEQ ID NO: 646577 - protein, 9 aa, Homo Sapiens
AANILKPST

SEQ ID NO: 646578 - protein, 9 aa, Homo Sapiens
CPVAWGHRH

SEQ ID NO: 646579 - protein, 9 aa, Homo Sapiens
YECKECVKA

SEQ ID NO: 646580 - protein, 9 aa, Homo Sapiens
ENALEKGLP

SEQ ID NO: 646581 - protein, 9 aa, Homo Sapiens
HHSGIYPVH

SEQ ID NO: 646582 - protein, 9 aa, Homo Sapiens
RQQRKQMEA

SEQ ID NO: 646583 - protein, 9 aa, Homo Sapiens
VGVLGASTL

SEQ ID NO: 646584 - protein, 9 aa, Homo Sapiens
EYVNILTGM

SEQ ID NO: 646585 - protein, 9 aa, Homo Sapiens
RKLPNNNDP

SEQ ID NO: 646586 - protein, 9 aa, Homo Sapiens
AIKAAARSA

SEQ ID NO: 646587 - protein, 9 aa, Homo Sapiens
NSARYSSMC

SEQ ID NO: 646588 - protein, 9 aa, Homo Sapiens
RRSHRSSKE

SEQ ID NO: 646589 - protein, 9 aa, Homo Sapiens
KTSYILDAR

SEQ ID NO: 646590 - protein, 9 aa, Homo Sapiens
FSHTCRCGV

SEQ ID NO: 646591 - protein, 9 aa, Homo Sapiens
VPAFSHTCR

SEQ ID NO: 646592 - protein, 9 aa, Homo Sapiens
QTEMLETIP

SEQ ID NO: 646593 - protein, 9 aa, Homo Sapiens
SSMAKLTMH

SEQ ID NO: 646594 - protein, 9 aa, Homo Sapiens
TYLQVMSRN

SEQ ID NO: 646595 - protein, 9 aa, Homo Sapiens
NVAMSDRKC

SEQ ID NO: 646596 - protein, 9 aa, Homo Sapiens
GGAPQPGAE

SEQ ID NO: 646597 - protein, 9 aa, Homo Sapiens
MDARKKHWK

SEQ ID NO: 646598 - protein, 9 aa, Homo Sapiens
RYSENLSYV

SEQ ID NO: 646599 - protein, 9 aa, Homo Sapiens
KDLGLPFLD

SEQ ID NO: 646600 - protein, 9 aa, Homo Sapiens
VRGSGYVTV

SEQ ID NO: 646601 - protein, 9 aa, Homo Sapiens
GIPDLANMW

SEQ ID NO: 646602 - protein, 9 aa, Homo Sapiens
LLLEGEKES

SEQ ID NO: 646603 - protein, 9 aa, Homo Sapiens
PWKEHPRDL

SEQ ID NO: 646604 - protein, 9 aa, Homo Sapiens
GKDPSPRTG

SEQ ID NO: 646605 - protein, 9 aa, Homo Sapiens
LTASERISL

SEQ ID NO: 646606 - protein, 9 aa, Homo Sapiens
RVVAQLRAE

SEQ ID NO: 646607 - protein, 9 aa, Homo Sapiens
SVGYAEYAL

SEQ ID NO: 646608 - protein, 9 aa, Homo Sapiens
LLYLISIPI

SEQ ID NO: 646609 - protein, 9 aa, Homo Sapiens
EEGGLKFTW

SEQ ID NO: 646610 - protein, 9 aa, Homo Sapiens
VKTSYILDA

SEQ ID NO: 646611 - protein, 9 aa, Homo Sapiens
NYFASQFFM

SEQ ID NO: 646612 - protein, 9 aa, Homo Sapiens
EPFSGLRSM

SEQ ID NO: 646613 - protein, 9 aa, Homo Sapiens
NGQDYFDYE

SEQ ID NO: 646614 - protein, 9 aa, Homo Sapiens
VDEFHLLQL

SEQ ID NO: 646615 - protein, 9 aa, Homo Sapiens
AKGIPQMAP

SEQ ID NO: 646616 - protein, 9 aa, Homo Sapiens
NAFSENGQD

SEQ ID NO: 646617 - protein, 9 aa, Homo Sapiens
KQDGGEHNG

SEQ ID NO: 646618 - protein, 9 aa, Homo Sapiens
LSTGEDSQD

SEQ ID NO: 646619 - protein, 9 aa, Homo Sapiens
RKTSLKSEP

SEQ ID NO: 646620 - protein, 9 aa, Homo Sapiens
RATTRPALG

SEQ ID NO: 646621 - protein, 9 aa, Homo Sapiens
GQLHSVDEF

SEQ ID NO: 646622 - protein, 9 aa, Homo Sapiens
MTFLLFLMA

SEQ ID NO: 646623 - protein, 9 aa, Homo Sapiens
AHANARSAV

SEQ ID NO: 646624 - protein, 9 aa, Homo Sapiens
GKQIVQPKT

SEQ ID NO: 646625 - protein, 9 aa, Homo Sapiens
GHRCEKKAG

SEQ ID NO: 646626 - protein, 9 aa, Homo Sapiens
FLPLAPASS

SEQ ID NO: 646627 - protein, 9 aa, Homo Sapiens
NAGEDVQLS

SEQ ID NO: 646628 - protein, 9 aa, Homo Sapiens
VNGKQIVQP

SEQ ID NO: 646629 - protein, 9 aa, Homo Sapiens
AGEDVQLSV

SEQ ID NO: 646630 - protein, 9 aa, Homo Sapiens
ITEIDPVNA

SEQ ID NO: 646631 - protein, 9 aa, Homo Sapiens
SPSWFRSCS

SEQ ID NO: 646632 - protein, 9 aa, Homo Sapiens
SSCYFFLPL

SEQ ID NO: 646633 - protein, 9 aa, Homo Sapiens
WDSALRLWE

SEQ ID NO: 646634 - protein, 9 aa, Homo Sapiens
SSHPLVLPN

SEQ ID NO: 646635 - protein, 9 aa, Homo Sapiens
LDAVRVVRK

SEQ ID NO: 646636 - protein, 9 aa, Homo Sapiens
DSEPPPASG

SEQ ID NO: 646637 - protein, 9 aa, Homo Sapiens
KHSALLYTV

SEQ ID NO: 646638 - protein, 9 aa, Homo Sapiens
AESKHSALL

SEQ ID NO: 646639 - protein, 9 aa, Homo Sapiens
RRRQWGSFP

SEQ ID NO: 646640 - protein, 9 aa, Homo Sapiens
WEGPVQELR

SEQ ID NO: 646641 - protein, 9 aa, Homo Sapiens
EDVQLSVMC

SEQ ID NO: 646642 - protein, 9 aa, Homo Sapiens
EFDPFFRSE

SEQ ID NO: 646643 - protein, 9 aa, Homo Sapiens
TNLLNTYSD

SEQ ID NO: 646644 - protein, 9 aa, Homo Sapiens
CVGRRRQWG

SEQ ID NO: 646645 - protein, 9 aa, Homo Sapiens
VLFLDAVRV

SEQ ID NO: 646646 - protein, 9 aa, Homo Sapiens
TLSAPQNKS

SEQ ID NO: 646647 - protein, 9 aa, Homo Sapiens
EGMKRSSTL

SEQ ID NO: 646648 - protein, 9 aa, Homo Sapiens
YSSGYMEQG

SEQ ID NO: 646649 - protein, 9 aa, Homo Sapiens
HAALLYTMT

SEQ ID NO: 646650 - protein, 9 aa, Homo Sapiens
VNALQAAME

SEQ ID NO: 646651 - protein, 9 aa, Homo Sapiens
FFLPLAPAS

SEQ ID NO: 646652 - protein, 9 aa, Homo Sapiens
LQCWGRRRR

SEQ ID NO: 646653 - protein, 9 aa, Homo Sapiens
ELIMPMSNV

SEQ ID NO: 646654 - protein, 9 aa, Homo Sapiens
SIFLCVHVK

SEQ ID NO: 646655 - protein, 9 aa, Homo Sapiens
GDFLSRSQI

SEQ ID NO: 646656 - protein, 9 aa, Homo Sapiens
VQELRKLRE

SEQ ID NO: 646657 - protein, 9 aa, Homo Sapiens
FRSCSWDSA

SEQ ID NO: 646658 - protein, 9 aa, Homo Sapiens
DAVRVVRKY

SEQ ID NO: 646659 - protein, 9 aa, Homo Sapiens
PPAPGSSCY

SEQ ID NO: 646660 - protein, 9 aa, Homo Sapiens
STLEHRPPA

SEQ ID NO: 646661 - protein, 9 aa, Homo Sapiens
WGSFPLQCV

SEQ ID NO: 646662 - protein, 9 aa, Homo Sapiens
MYIKYSSGY

SEQ ID NO: 646663 - protein, 9 aa, Homo Sapiens
KLVVVGAAG

SEQ ID NO: 646664 - protein, 9 aa, Homo Sapiens
LMLFFCGDF

SEQ ID NO: 646665 - protein, 9 aa, Homo Sapiens
PPASGAQRA

SEQ ID NO: 646666 - protein, 9 aa, Homo Sapiens
PKVDFDVPD

SEQ ID NO: 646667 - protein, 9 aa, Homo Sapiens
VVRKYSSVH

SEQ ID NO: 646668 - protein, 9 aa, Homo Sapiens
RELIMPMSN

SEQ ID NO: 646669 - protein, 9 aa, Homo Sapiens
SEPPPASGA

SEQ ID NO: 646670 - protein, 9 aa, Homo Sapiens
ALRLWEGPV

SEQ ID NO: 646671 - protein, 9 aa, Homo Sapiens
RIFLSWSHW

SEQ ID NO: 646672 - protein, 9 aa, Homo Sapiens
EPPPASGAQ

SEQ ID NO: 646673 - protein, 9 aa, Homo Sapiens
PGSSCYFFL

SEQ ID NO: 646674 - protein, 9 aa, Homo Sapiens
HANARSAVL

SEQ ID NO: 646675 - protein, 9 aa, Homo Sapiens
FRSEIPATH

SEQ ID NO: 646676 - protein, 9 aa, Homo Sapiens
RSAVLKEQL

SEQ ID NO: 646677 - protein, 9 aa, Homo Sapiens
AALLYTMTF

SEQ ID NO: 646678 - protein, 9 aa, Homo Sapiens
VVSRELIMP

SEQ ID NO: 646679 - protein, 9 aa, Homo Sapiens
VQLSVMCAM

SEQ ID NO: 646680 - protein, 9 aa, Homo Sapiens
QMEVINLQC

SEQ ID NO: 646681 - protein, 9 aa, Homo Sapiens
AETLSAPQN

SEQ ID NO: 646682 - protein, 9 aa, Homo Sapiens
YNAGEDVQL

SEQ ID NO: 646683 - protein, 9 aa, Homo Sapiens
ELRKLRENL

SEQ ID NO: 646684 - protein, 9 aa, Homo Sapiens
DPFFRSEIP

SEQ ID NO: 646685 - protein, 9 aa, Homo Sapiens
QTTTNLLNT

SEQ ID NO: 646686 - protein, 9 aa, Homo Sapiens
SWSHWATAQ

SEQ ID NO: 646687 - protein, 9 aa, Homo Sapiens
TAGQTTTNL

SEQ ID NO: 646688 - protein, 9 aa, Homo Sapiens
APQNKSDSK

SEQ ID NO: 646689 - protein, 9 aa, Homo Sapiens
DCARPSPSW

SEQ ID NO: 646690 - protein, 9 aa, Homo Sapiens
WGSFPQHCA

SEQ ID NO: 646691 - protein, 9 aa, Homo Sapiens
PPPASGAQR

SEQ ID NO: 646692 - protein, 9 aa, Homo Sapiens
SGHRCEKKA

SEQ ID NO: 646693 - protein, 9 aa, Homo Sapiens
LAPASSHPL

SEQ ID NO: 646694 - protein, 9 aa, Homo Sapiens
SHPLVLPNK

SEQ ID NO: 646695 - protein, 9 aa, Homo Sapiens
GYSIFLCVH

SEQ ID NO: 646696 - protein, 9 aa, Homo Sapiens
NLQCNTVLK

SEQ ID NO: 646697 - protein, 9 aa, Homo Sapiens
GDSEPPPAS

SEQ ID NO: 646698 - protein, 9 aa, Homo Sapiens
AGVGKSALT

SEQ ID NO: 646699 - protein, 9 aa, Homo Sapiens
HWATAQWAW

SEQ ID NO: 646700 - protein, 9 aa, Homo Sapiens
AVRVVRKYS

SEQ ID NO: 646701 - protein, 9 aa, Homo Sapiens
LSWSHWATA

SEQ ID NO: 646702 - protein, 9 aa, Homo Sapiens
IKYSSGYME

SEQ ID NO: 646703 - protein, 9 aa, Homo Sapiens
LFLDAVRVV

SEQ ID NO: 646704 - protein, 9 aa, Homo Sapiens
PASSHPLVL

SEQ ID NO: 646705 - protein, 9 aa, Homo Sapiens
WGSFPLQCW

SEQ ID NO: 646706 - protein, 9 aa, Homo Sapiens
QHCAGRRRQ

SEQ ID NO: 646707 - protein, 9 aa, Homo Sapiens
NGKQIVQPK

SEQ ID NO: 646708 - protein, 9 aa, Homo Sapiens
SSGHRCEKK

SEQ ID NO: 646709 - protein, 9 aa, Homo Sapiens
HRCEKKAGT

SEQ ID NO: 646710 - protein, 9 aa, Homo Sapiens
APASSHPLV

SEQ ID NO: 646711 - protein, 9 aa, Homo Sapiens
KGPKVDFDV

SEQ ID NO: 646712 - protein, 9 aa, Homo Sapiens
IAFGYSIFL

SEQ ID NO: 646713 - protein, 9 aa, Homo Sapiens
LLYTMTFLL

SEQ ID NO: 646714 - protein, 9 aa, Homo Sapiens
YTMTFLLFL

SEQ ID NO: 646715 - protein, 9 aa, Homo Sapiens
MKRSSTLEH

SEQ ID NO: 646716 - protein, 9 aa, Homo Sapiens
VIITEIDPV

SEQ ID NO: 646717 - protein, 9 aa, Homo Sapiens
GPWSSEAWD

SEQ ID NO: 646718 - protein, 9 aa, Homo Sapiens
PQHCAGRRR

SEQ ID NO: 646719 - protein, 9 aa, Homo Sapiens
LFAESKHSA

SEQ ID NO: 646720 - protein, 9 aa, Homo Sapiens
EGPVQELRK

SEQ ID NO: 646721 - protein, 9 aa, Homo Sapiens
LIMPMSNVH

SEQ ID NO: 646722 - protein, 9 aa, Homo Sapiens
YFFLPLAPA

SEQ ID NO: 646723 - protein, 9 aa, Homo Sapiens
FPQHCAGRR

SEQ ID NO: 646724 - protein, 9 aa, Homo Sapiens
CSWDSALRL

SEQ ID NO: 646725 - protein, 9 aa, Homo Sapiens
SAVLKEQLE

SEQ ID NO: 646726 - protein, 9 aa, Homo Sapiens
RRQDCARPS

SEQ ID NO: 646727 - protein, 9 aa, Homo Sapiens
SALLYTVTF

SEQ ID NO: 646728 - protein, 9 aa, Homo Sapiens
SAPQNKSDS

SEQ ID NO: 646729 - protein, 9 aa, Homo Sapiens
APGSSCYFF

SEQ ID NO: 646730 - protein, 9 aa, Homo Sapiens
VVVGAAGVG

SEQ ID NO: 646731 - protein, 9 aa, Homo Sapiens
RENLAGPWS

SEQ ID NO: 646732 - protein, 9 aa, Homo Sapiens
IDPVNALQA

SEQ ID NO: 646733 - protein, 9 aa, Homo Sapiens
CAGRRRQDC

SEQ ID NO: 646734 - protein, 9 aa, Homo Sapiens
QWGSFPQHC

SEQ ID NO: 646735 - protein, 9 aa, Homo Sapiens
TIVNGKQIV

SEQ ID NO: 646736 - protein, 9 aa, Homo Sapiens
IFLSWSHWA

SEQ ID NO: 646737 - protein, 9 aa, Homo Sapiens
RRRRQWGSF

SEQ ID NO: 646738 - protein, 9 aa, Homo Sapiens
DFDVPDVNV

SEQ ID NO: 646739 - protein, 9 aa, Homo Sapiens
LRLWEGPVQ

SEQ ID NO: 646740 - protein, 9 aa, Homo Sapiens
LKGPKVDFD

SEQ ID NO: 646741 - protein, 9 aa, Homo Sapiens
TTTNLLNTY

SEQ ID NO: 646742 - protein, 9 aa, Homo Sapiens
WSSEAWDSE

SEQ ID NO: 646743 - protein, 9 aa, Homo Sapiens
LSAPQNKSD

SEQ ID NO: 646744 - protein, 9 aa, Homo Sapiens
GYMEQGKVS

SEQ ID NO: 646745 - protein, 9 aa, Homo Sapiens
ENLAGPWSS

SEQ ID NO: 646746 - protein, 9 aa, Homo Sapiens
NLLNTYSDD

SEQ ID NO: 646747 - protein, 9 aa, Homo Sapiens
GSSCYFFLP

SEQ ID NO: 646748 - protein, 9 aa, Homo Sapiens
RPSPSWFRS

SEQ ID NO: 646749 - protein, 9 aa, Homo Sapiens
SCYFFLPLA

SEQ ID NO: 646750 - protein, 9 aa, Homo Sapiens
HPLVLPNKL

SEQ ID NO: 646751 - protein, 9 aa, Homo Sapiens
FPLQCVGRR

SEQ ID NO: 646752 - protein, 9 aa, Homo Sapiens
SHWATAQWA

SEQ ID NO: 646753 - protein, 9 aa, Homo Sapiens
SGAQRAQMG

SEQ ID NO: 646754 - protein, 9 aa, Homo Sapiens
PLQCWGRRR

SEQ ID NO: 646755 - protein, 9 aa, Homo Sapiens
HSALLYTVT

SEQ ID NO: 646756 - protein, 9 aa, Homo Sapiens
GAAGVGKSA

SEQ ID NO: 646757 - protein, 9 aa, Homo Sapiens
MEVINLQCN

SEQ ID NO: 646758 - protein, 9 aa, Homo Sapiens
TTNLLNTYS

SEQ ID NO: 646759 - protein, 9 aa, Homo Sapiens
YSIFLCVHV

SEQ ID NO: 646760 - protein, 9 aa, Homo Sapiens
FVIAFGYSI

SEQ ID NO: 646761 - protein, 9 aa, Homo Sapiens
DLKGPKVDF

SEQ ID NO: 646762 - protein, 9 aa, Homo Sapiens
GMKRSSTLE

SEQ ID NO: 646763 - protein, 9 aa, Homo Sapiens
FAESKHSAL

SEQ ID NO: 646764 - protein, 9 aa, Homo Sapiens
FDVPDVNVQ

SEQ ID NO: 646765 - protein, 9 aa, Homo Sapiens
PLQCVGRRR

SEQ ID NO: 646766 - protein, 9 aa, Homo Sapiens
ELQMEVINL

SEQ ID NO: 646767 - protein, 9 aa, Homo Sapiens
RQWGSFPQH

SEQ ID NO: 646768 - protein, 9 aa, Homo Sapiens
EHRPPAPGS

SEQ ID NO: 646769 - protein, 9 aa, Homo Sapiens
RPPAPGSSC

SEQ ID NO: 646770 - protein, 9 aa, Homo Sapiens
ASGAQRAQM

SEQ ID NO: 646771 - protein, 9 aa, Homo Sapiens
KLRENLAGP

SEQ ID NO: 646772 - protein, 9 aa, Homo Sapiens
PVQELRKLR

SEQ ID NO: 646773 - protein, 9 aa, Homo Sapiens
RKLRENLAG

SEQ ID NO: 646774 - protein, 9 aa, Homo Sapiens
LPIHHDLVF

SEQ ID NO: 646775 - protein, 9 aa, Homo Sapiens
ALLYTMTFL

SEQ ID NO: 646776 - protein, 9 aa, Homo Sapiens
AWDSEGMKR

SEQ ID NO: 646777 - protein, 9 aa, Homo Sapiens
PSWFRSCSW

SEQ ID NO: 646778 - protein, 9 aa, Homo Sapiens
VVGAAGVGK

SEQ ID NO: 646779 - protein, 9 aa, Homo Sapiens
LQCVGRRRQ

SEQ ID NO: 646780 - protein, 9 aa, Homo Sapiens
LVVVGAAGV

SEQ ID NO: 646781 - protein, 9 aa, Homo Sapiens
FLSWSHWAT

SEQ ID NO: 646782 - protein, 9 aa, Homo Sapiens
SEGMKRSST

SEQ ID NO: 646783 - protein, 9 aa, Homo Sapiens
PFFRSEIPA

SEQ ID NO: 646784 - protein, 9 aa, Homo Sapiens
SGAAETLSA

SEQ ID NO: 646785 - protein, 9 aa, Homo Sapiens
DTAGQTTTN

SEQ ID NO: 646786 - protein, 9 aa, Homo Sapiens
SEIPATHLY

SEQ ID NO: 646787 - protein, 9 aa, Homo Sapiens
KAHANARSA

SEQ ID NO: 646788 - protein, 9 aa, Homo Sapiens
KQIVQPKTK

SEQ ID NO: 646789 - protein, 9 aa, Homo Sapiens
TLEHRPPAP

SEQ ID NO: 646790 - protein, 9 aa, Homo Sapiens
SWDSALRLW

SEQ ID NO: 646791 - protein, 9 aa, Homo Sapiens
EIDPVNALQ

SEQ ID NO: 646792 - protein, 9 aa, Homo Sapiens
SSTLEHRPP

SEQ ID NO: 646793 - protein, 9 aa, Homo Sapiens
SFPLQCWGR

SEQ ID NO: 646794 - protein, 9 aa, Homo Sapiens
EEFDPFFRS

SEQ ID NO: 646795 - protein, 9 aa, Homo Sapiens
EELQMEVIN

SEQ ID NO: 646796 - protein, 9 aa, Homo Sapiens
PAPGSSCYF

SEQ ID NO: 646797 - protein, 9 aa, Homo Sapiens
KVDFDVPDV

SEQ ID NO: 646798 - protein, 9 aa, Homo Sapiens
DPVNALQAA

SEQ ID NO: 646799 - protein, 9 aa, Homo Sapiens
SKHSALLYT

SEQ ID NO: 646800 - protein, 9 aa, Homo Sapiens
DFLSRSQIF

SEQ ID NO: 646801 - protein, 9 aa, Homo Sapiens
VIAFGYSIF

SEQ ID NO: 646802 - protein, 9 aa, Homo Sapiens
WFRSCSWDS

SEQ ID NO: 646803 - protein, 9 aa, Homo Sapiens
LEHRPPAPG

SEQ ID NO: 646804 - protein, 9 aa, Homo Sapiens
FLSRSQIFY

SEQ ID NO: 646805 - protein, 9 aa, Homo Sapiens
IVQPKTKCD

SEQ ID NO: 646806 - protein, 9 aa, Homo Sapiens
IVNGKQIVQ

SEQ ID NO: 646807 - protein, 9 aa, Homo Sapiens
SFPLQCVGR

SEQ ID NO: 646808 - protein, 9 aa, Homo Sapiens
RVVRKYSSV

SEQ ID NO: 646809 - protein, 9 aa, Homo Sapiens
YKLVVVGAA

SEQ ID NO: 646810 - protein, 9 aa, Homo Sapiens
QVVSRELIM

SEQ ID NO: 646811 - protein, 9 aa, Homo Sapiens
GPKVDFDVP

SEQ ID NO: 646812 - protein, 9 aa, Homo Sapiens
LWEGPVQEL

SEQ ID NO: 646813 - protein, 9 aa, Homo Sapiens
LAGPWSSEA

SEQ ID NO: 646814 - protein, 9 aa, Homo Sapiens
VDFDVPDVN

SEQ ID NO: 646815 - protein, 9 aa, Homo Sapiens
QWGSFPLQC

SEQ ID NO: 646816 - protein, 9 aa, Homo Sapiens
AAETLSAPQ

SEQ ID NO: 646817 - protein, 9 aa, Homo Sapiens
GRRRRQWGS

SEQ ID NO: 646818 - protein, 9 aa, Homo Sapiens
GPVQELRKL

SEQ ID NO: 646819 - protein, 9 aa, Homo Sapiens
EVINLQCNT

SEQ ID NO: 646820 - protein, 9 aa, Homo Sapiens
ESKHSALLY

SEQ ID NO: 646821 - protein, 9 aa, Homo Sapiens
PWSSEAWDS

SEQ ID NO: 646822 - protein, 9 aa, Homo Sapiens
DVQLSVMCA

SEQ ID NO: 646823 - protein, 9 aa, Homo Sapiens
FFRSEIPAT

SEQ ID NO: 646824 - protein, 9 aa, Homo Sapiens
DSEGMKRSS

SEQ ID NO: 646825 - protein, 9 aa, Homo Sapiens
NARSAVLKE

SEQ ID NO: 646826 - protein, 9 aa, Homo Sapiens
LQMEVINLQ

SEQ ID NO: 646827 - protein, 9 aa, Homo Sapiens
YIKYSSGYM

SEQ ID NO: 646828 - protein, 9 aa, Homo Sapiens
TRALPIHHD

SEQ ID NO: 646829 - protein, 9 aa, Homo Sapiens
GAAETLSAP

SEQ ID NO: 646830 - protein, 9 aa, Homo Sapiens
DSALRLWEG

SEQ ID NO: 646831 - protein, 9 aa, Homo Sapiens
FGYSIFLCV

SEQ ID NO: 646832 - protein, 9 aa, Homo Sapiens
ALPIHHDLV

SEQ ID NO: 646833 - protein, 9 aa, Homo Sapiens
VRVVRKYSS

SEQ ID NO: 646834 - protein, 9 aa, Homo Sapiens
QELRKLREN

SEQ ID NO: 646835 - protein, 9 aa, Homo Sapiens
CWGRRRRQW

SEQ ID NO: 646836 - protein, 9 aa, Homo Sapiens
SWFRSCSWD

SEQ ID NO: 646837 - protein, 9 aa, Homo Sapiens
RRQWGSFPQ

SEQ ID NO: 646838 - protein, 9 aa, Homo Sapiens
GQTTTNLLN

SEQ ID NO: 646839 - protein, 9 aa, Homo Sapiens
WDSEGMKRS

SEQ ID NO: 646840 - protein, 9 aa, Homo Sapiens
ANARSAVLK

SEQ ID NO: 646841 - protein, 9 aa, Homo Sapiens
SALRLWEGP

SEQ ID NO: 646842 - protein, 9 aa, Homo Sapiens
AFGYSIFLC

SEQ ID NO: 646843 - protein, 9 aa, Homo Sapiens
PLAPASSHP

SEQ ID NO: 646844 - protein, 9 aa, Homo Sapiens
QLSVMCAMS

SEQ ID NO: 646845 - protein, 9 aa, Homo Sapiens
SCSWDSALR

SEQ ID NO: 646846 - protein, 9 aa, Homo Sapiens
LPLAPASSH

SEQ ID NO: 646847 - protein, 9 aa, Homo Sapiens
VGRRRQWGS

SEQ ID NO: 646848 - protein, 9 aa, Homo Sapiens
SFPQHCAGR

SEQ ID NO: 646849 - protein, 9 aa, Homo Sapiens
IQVVSRELI

SEQ ID NO: 646850 - protein, 9 aa, Homo Sapiens
GSFPLQCWG

SEQ ID NO: 646851 - protein, 9 aa, Homo Sapiens
LYTMTFLLF

SEQ ID NO: 646852 - protein, 9 aa, Homo Sapiens
GSFPQHCAG

SEQ ID NO: 646853 - protein, 9 aa, Homo Sapiens
FLDAVRVVR

SEQ ID NO: 646854 - protein, 9 aa, Homo Sapiens
LRKLRENLA

SEQ ID NO: 646855 - protein, 9 aa, Homo Sapiens
KYSSGYMEQ

SEQ ID NO: 646856 - protein, 9 aa, Homo Sapiens
RQDCARPSP

SEQ ID NO: 646857 - protein, 9 aa, Homo Sapiens
AGRRRQDCA

SEQ ID NO: 646858 - protein, 9 aa, Homo Sapiens
SEAWDSEGM

SEQ ID NO: 646859 - protein, 9 aa, Homo Sapiens
INLQCNTVL

SEQ ID NO: 646860 - protein, 9 aa, Homo Sapiens
LRENLAGPW

SEQ ID NO: 646861 - protein, 9 aa, Homo Sapiens
PSPSWFRSC

SEQ ID NO: 646862 - protein, 9 aa, Homo Sapiens
QIVQPKTKC

SEQ ID NO: 646863 - protein, 9 aa, Homo Sapiens
CGDFLSRSQ

SEQ ID NO: 646864 - protein, 9 aa, Homo Sapiens
LKAHANARS

SEQ ID NO: 646865 - protein, 9 aa, Homo Sapiens
CARPSPSWF

SEQ ID NO: 646866 - protein, 9 aa, Homo Sapiens
WSHWATAQW

SEQ ID NO: 646867 - protein, 9 aa, Homo Sapiens
LFFCGDFLS

SEQ ID NO: 646868 - protein, 9 aa, Homo Sapiens
NLAGPWSSE

SEQ ID NO: 646869 - protein, 9 aa, Homo Sapiens
RSCSWDSAL

SEQ ID NO: 646870 - protein, 9 aa, Homo Sapiens
QDCARPSPS

SEQ ID NO: 646871 - protein, 9 aa, Homo Sapiens
HRPPAPGSS

SEQ ID NO: 646872 - protein, 9 aa, Homo Sapiens
ETLSAPQNK

SEQ ID NO: 646873 - protein, 9 aa, Homo Sapiens
FCGDFLSRS

SEQ ID NO: 646874 - protein, 9 aa, Homo Sapiens
RRQWGSFPL

SEQ ID NO: 646875 - protein, 9 aa, Homo Sapiens
MLFFCGDFL

SEQ ID NO: 646876 - protein, 9 aa, Homo Sapiens
EAWDSEGMK

SEQ ID NO: 646877 - protein, 9 aa, Homo Sapiens
ARSAVLKEQ

SEQ ID NO: 646878 - protein, 9 aa, Homo Sapiens
IMPMSNVHL

SEQ ID NO: 646879 - protein, 9 aa, Homo Sapiens
KRSSTLEHR

SEQ ID NO: 646880 - protein, 9 aa, Homo Sapiens
SGYMEQGKV

SEQ ID NO: 646881 - protein, 9 aa, Homo Sapiens
RSSTLEHRP

SEQ ID NO: 646882 - protein, 9 aa, Homo Sapiens
RALPIHHDL

SEQ ID NO: 646883 - protein, 9 aa, Homo Sapiens
SSGYMEQGK

SEQ ID NO: 646884 - protein, 9 aa, Homo Sapiens
FDPFFRSEI

SEQ ID NO: 646885 - protein, 9 aa, Homo Sapiens
IFLCVHVKL

SEQ ID NO: 646886 - protein, 9 aa, Homo Sapiens
IITEIDPVN

SEQ ID NO: 646887 - protein, 9 aa, Homo Sapiens
AAGVGKSAL

SEQ ID NO: 646888 - protein, 9 aa, Homo Sapiens
KHAALLYTM

SEQ ID NO: 646889 - protein, 9 aa, Homo Sapiens
VQPKTKCDP

SEQ ID NO: 646890 - protein, 9 aa, Homo Sapiens
VSSGHRCEK

SEQ ID NO: 646891 - protein, 9 aa, Homo Sapiens
AGPWSSEAW

SEQ ID NO: 646892 - protein, 9 aa, Homo Sapiens
AGQTTTNLL

SEQ ID NO: 646893 - protein, 9 aa, Homo Sapiens
WGRRRRQWG

SEQ ID NO: 646894 - protein, 9 aa, Homo Sapiens
HCAGRRRQD

SEQ ID NO: 646895 - protein, 9 aa, Homo Sapiens
RSEIPATHL

SEQ ID NO: 646896 - protein, 9 aa, Homo Sapiens
GSFPLQCVG

SEQ ID NO: 646897 - protein, 9 aa, Homo Sapiens
GEDVQLSVM

SEQ ID NO: 646898 - protein, 9 aa, Homo Sapiens
GLFAESKHS

SEQ ID NO: 646899 - protein, 9 aa, Homo Sapiens
VGAAGVGKS

SEQ ID NO: 646900 - protein, 9 aa, Homo Sapiens
QCVGRRRQW

SEQ ID NO: 646901 - protein, 9 aa, Homo Sapiens
ARPSPSWFR

SEQ ID NO: 646902 - protein, 9 aa, Homo Sapiens
RRIFLSWSH

SEQ ID NO: 646903 - protein, 9 aa, Homo Sapiens
TEIDPVNAL

SEQ ID NO: 646904 - protein, 9 aa, Homo Sapiens
SSEAWDSEG

SEQ ID NO: 646905 - protein, 9 aa, Homo Sapiens
PASGAQRAQ

SEQ ID NO: 646906 - protein, 9 aa, Homo Sapiens
LSVMCAMSE

SEQ ID NO: 646907 - protein, 9 aa, Homo Sapiens
CYFFLPLAP

SEQ ID NO: 646908 - protein, 9 aa, Homo Sapiens
FFCGDFLSR

SEQ ID NO: 646909 - protein, 9 aa, Homo Sapiens
ATRALPIHH

SEQ ID NO: 646910 - protein, 9 aa, Homo Sapiens
GRRRQWGSF

SEQ ID NO: 646911 - protein, 9 aa, Homo Sapiens
YMEQGKVSS

SEQ ID NO: 646912 - protein, 9 aa, Homo Sapiens
SRELIMPMS

SEQ ID NO: 646913 - protein, 9 aa, Homo Sapiens
RRRQDCARP

SEQ ID NO: 646914 - protein, 9 aa, Homo Sapiens
RLWEGPVQE

SEQ ID NO: 646915 - protein, 9 aa, Homo Sapiens
TMTFLLFLM

SEQ ID NO: 646916 - protein, 9 aa, Homo Sapiens
RQWGSFPLQ

SEQ ID NO: 646917 - protein, 9 aa, Homo Sapiens
VSRELIMPM

SEQ ID NO: 646918 - protein, 9 aa, Homo Sapiens
QCWGRRRRQ

SEQ ID NO: 646919 - protein, 9 aa, Homo Sapiens
PVNALQAAM

SEQ ID NO: 646920 - protein, 9 aa, Homo Sapiens
ASSHPLVLP

SEQ ID NO: 646921 - protein, 9 aa, Homo Sapiens
FPLQCWGRR

SEQ ID NO: 646922 - protein, 9 aa, Homo Sapiens
VINLQCNTV

SEQ ID NO: 646923 - protein, 9 aa, Homo Sapiens
GRRRQDCAR

SEQ ID NO: 646924 - protein, 9 aa, Homo Sapiens
EVLKGLGGG

SEQ ID NO: 646925 - protein, 9 aa, Homo Sapiens
TVVLDDPTS

SEQ ID NO: 646926 - protein, 9 aa, Homo Sapiens
LLRLEHLLQ

SEQ ID NO: 646927 - protein, 9 aa, Homo Sapiens
PSKAITSSR

SEQ ID NO: 646928 - protein, 9 aa, Homo Sapiens
LTPSSLSPS

SEQ ID NO: 646929 - protein, 9 aa, Homo Sapiens
FYKDNINAG

SEQ ID NO: 646930 - protein, 9 aa, Homo Sapiens
ENVAVSPTP

SEQ ID NO: 646931 - protein, 9 aa, Homo Sapiens
ARKRAQTIL

SEQ ID NO: 646932 - protein, 9 aa, Homo Sapiens
HNHLESHNL

SEQ ID NO: 646933 - protein, 9 aa, Homo Sapiens
QPQRAESPA

SEQ ID NO: 646934 - protein, 9 aa, Homo Sapiens
ELAKKPASR

SEQ ID NO: 646935 - protein, 9 aa, Homo Sapiens
EGTNGVVER

SEQ ID NO: 646936 - protein, 9 aa, Homo Sapiens
SGIHFGATT

SEQ ID NO: 646937 - protein, 9 aa, Homo Sapiens
RRSPGEALT

SEQ ID NO: 646938 - protein, 9 aa, Homo Sapiens
EPEVLQDSQ

SEQ ID NO: 646939 - protein, 9 aa, Homo Sapiens
RGLPGAATA

SEQ ID NO: 646940 - protein, 9 aa, Homo Sapiens
EAKSETSQE

SEQ ID NO: 646941 - protein, 9 aa, Homo Sapiens
VAILGIMLR

SEQ ID NO: 646942 - protein, 9 aa, Homo Sapiens
VGVEPHFLD

SEQ ID NO: 646943 - protein, 9 aa, Homo Sapiens
SNGKNQPTL

SEQ ID NO: 646944 - protein, 9 aa, Homo Sapiens
AQVKKQSTK

SEQ ID NO: 646945 - protein, 9 aa, Homo Sapiens
NALHSLLGC

SEQ ID NO: 646946 - protein, 9 aa, Homo Sapiens
MELSWLETR

SEQ ID NO: 646947 - protein, 9 aa, Homo Sapiens
PLPSPGDTP

SEQ ID NO: 646948 - protein, 9 aa, Homo Sapiens
TQLTLAPFV

SEQ ID NO: 646949 - protein, 9 aa, Homo Sapiens
FSPAGTPTP

SEQ ID NO: 646950 - protein, 9 aa, Homo Sapiens
LLWPCPGSP

SEQ ID NO: 646951 - protein, 9 aa, Homo Sapiens
RGRSRTWEA

SEQ ID NO: 646952 - protein, 9 aa, Homo Sapiens
MSPNALNQF

SEQ ID NO: 646953 - protein, 9 aa, Homo Sapiens
TVKGTLGNA

SEQ ID NO: 646954 - protein, 9 aa, Homo Sapiens
NELLEREST

SEQ ID NO: 646955 - protein, 9 aa, Homo Sapiens
EDPLPSPGD

SEQ ID NO: 646956 - protein, 9 aa, Homo Sapiens
YKLTAAVMH

SEQ ID NO: 646957 - protein, 9 aa, Homo Sapiens
FLDRNYEKG

SEQ ID NO: 646958 - protein, 9 aa, Homo Sapiens
MLSYSELWK

SEQ ID NO: 646959 - protein, 9 aa, Homo Sapiens
DGIRAPSGL

SEQ ID NO: 646960 - protein, 9 aa, Homo Sapiens
HGVMDPAPA

SEQ ID NO: 646961 - protein, 9 aa, Homo Sapiens
TFKRENKKL

SEQ ID NO: 646962 - protein, 9 aa, Homo Sapiens
VSERSNNGM

SEQ ID NO: 646963 - protein, 9 aa, Homo Sapiens
KLVLNDKLL

SEQ ID NO: 646964 - protein, 9 aa, Homo Sapiens
FFQPTAKPR

SEQ ID NO: 646965 - protein, 9 aa, Homo Sapiens
VQLHVYEAW

SEQ ID NO: 646966 - protein, 9 aa, Homo Sapiens
WEMMTFGSK

SEQ ID NO: 646967 - protein, 9 aa, Homo Sapiens
RKQAHRSQP

SEQ ID NO: 646968 - protein, 9 aa, Homo Sapiens
TRRVGVGVA

SEQ ID NO: 646969 - protein, 9 aa, Homo Sapiens
FYSSNNKQP

SEQ ID NO: 646970 - protein, 9 aa, Homo Sapiens
EALGHKPRV

SEQ ID NO: 646971 - protein, 9 aa, Homo Sapiens
DCTTMIDRG

SEQ ID NO: 646972 - protein, 9 aa, Homo Sapiens
LEVFRKNGF

SEQ ID NO: 646973 - protein, 9 aa, Homo Sapiens
LAGGAGEMQ

SEQ ID NO: 646974 - protein, 9 aa, Homo Sapiens
RRVGVGVAV

SEQ ID NO: 646975 - protein, 9 aa, Homo Sapiens
YSAVYAVAN

SEQ ID NO: 646976 - protein, 9 aa, Homo Sapiens
AGEMQMMSI

SEQ ID NO: 646977 - protein, 9 aa, Homo Sapiens
DVGREAVRL

SEQ ID NO: 646978 - protein, 9 aa, Homo Sapiens
HLRSTCYGA

SEQ ID NO: 646979 - protein, 9 aa, Homo Sapiens
YAKRENWKP

SEQ ID NO: 646980 - protein, 9 aa, Homo Sapiens
SFSVADTVS

SEQ ID NO: 646981 - protein, 9 aa, Homo Sapiens
ANSGCGSSG

SEQ ID NO: 646982 - protein, 9 aa, Homo Sapiens
RRSCGSGTK

SEQ ID NO: 646983 - protein, 9 aa, Homo Sapiens
PSSLSPSMS

SEQ ID NO: 646984 - protein, 9 aa, Homo Sapiens
KLQEEISDL

SEQ ID NO: 646985 - protein, 9 aa, Homo Sapiens
EYEADRDSM

SEQ ID NO: 646986 - protein, 9 aa, Homo Sapiens
SPAGTPTPF

SEQ ID NO: 646987 - protein, 9 aa, Homo Sapiens
HAPSPATRW

SEQ ID NO: 646988 - protein, 9 aa, Homo Sapiens
WPGLGSQGM

SEQ ID NO: 646989 - protein, 9 aa, Homo Sapiens
CGSSGGASG

SEQ ID NO: 646990 - protein, 9 aa, Homo Sapiens
GNGEGRRPQ

SEQ ID NO: 646991 - protein, 9 aa, Homo Sapiens
HSCQHMGDC

SEQ ID NO: 646992 - protein, 9 aa, Homo Sapiens
LSFLNGKWF

SEQ ID NO: 646993 - protein, 9 aa, Homo Sapiens
AMSPNALNQ

SEQ ID NO: 646994 - protein, 9 aa, Homo Sapiens
GDHPFMCKH

SEQ ID NO: 646995 - protein, 9 aa, Homo Sapiens
LHPCGSYET

SEQ ID NO: 646996 - protein, 9 aa, Homo Sapiens
VAPMLTRRV

SEQ ID NO: 646997 - protein, 9 aa, Homo Sapiens
TQVKGQAES

SEQ ID NO: 646998 - protein, 9 aa, Homo Sapiens
SAGLPKASA

SEQ ID NO: 646999 - protein, 9 aa, Homo Sapiens
GKIAWILGL

SEQ ID NO: 647000 - protein, 9 aa, Homo Sapiens
ESQSQTSSV

SEQ ID NO: 647001 - protein, 9 aa, Homo Sapiens
PQLSLKPLL

SEQ ID NO: 647002 - protein, 9 aa, Homo Sapiens
RTVVLDDPT

SEQ ID NO: 647003 - protein, 9 aa, Homo Sapiens
EQLANISME

SEQ ID NO: 647004 - protein, 9 aa, Homo Sapiens
SRNRHQEEV

SEQ ID NO: 647005 - protein, 9 aa, Homo Sapiens
FLTNNALGD

SEQ ID NO: 647006 - protein, 9 aa, Homo Sapiens
AESQSQTSS

SEQ ID NO: 647007 - protein, 9 aa, Homo Sapiens
HPCGSYETE

SEQ ID NO: 647008 - protein, 9 aa, Homo Sapiens
KTLSESAEE

SEQ ID NO: 647009 - protein, 9 aa, Homo Sapiens
RDEAGGGPG

SEQ ID NO: 647010 - protein, 9 aa, Homo Sapiens
IFVHGVSTS

SEQ ID NO: 647011 - protein, 9 aa, Homo Sapiens
INVAILGIM

SEQ ID NO: 647012 - protein, 9 aa, Homo Sapiens
IGHLDGIWD

SEQ ID NO: 647013 - protein, 9 aa, Homo Sapiens
HKAEREVSR

SEQ ID NO: 647014 - protein, 9 aa, Homo Sapiens
LSFITPGAL

SEQ ID NO: 647015 - protein, 9 aa, Homo Sapiens
KEEKVTFDP

SEQ ID NO: 647016 - protein, 9 aa, Homo Sapiens
TRDCALQFT

SEQ ID NO: 647017 - protein, 9 aa, Homo Sapiens
PLLVGPSSR

SEQ ID NO: 647018 - protein, 9 aa, Homo Sapiens
VWEMMTFGS

SEQ ID NO: 647019 - protein, 9 aa, Homo Sapiens
WDLCNSVMI

SEQ ID NO: 647020 - protein, 9 aa, Homo Sapiens
KGTLGNASK

SEQ ID NO: 647021 - protein, 9 aa, Homo Sapiens
NLRSNDAGL

SEQ ID NO: 647022 - protein, 9 aa, Homo Sapiens
LRSTCYGAI

SEQ ID NO: 647023 - protein, 9 aa, Homo Sapiens
PTCCRCELG

SEQ ID NO: 647024 - protein, 9 aa, Homo Sapiens
LTRRVGVGV

SEQ ID NO: 647025 - protein, 9 aa, Homo Sapiens
ATIVGIVGS

SEQ ID NO: 647026 - protein, 9 aa, Homo Sapiens
KTRRAIWVF

SEQ ID NO: 647027 - protein, 9 aa, Homo Sapiens
SQPQQNQTQ

SEQ ID NO: 647028 - protein, 9 aa, Homo Sapiens
LKCPKPAAH

SEQ ID NO: 647029 - protein, 9 aa, Homo Sapiens
RLLRVLRPL

SEQ ID NO: 647030 - protein, 9 aa, Homo Sapiens
CAVAVLSVH

SEQ ID NO: 647031 - protein, 9 aa, Homo Sapiens
NDKLLPKLK

SEQ ID NO: 647032 - protein, 9 aa, Homo Sapiens
DLRQMFAKE

SEQ ID NO: 647033 - protein, 9 aa, Homo Sapiens
KQPLADPEE

SEQ ID NO: 647034 - protein, 9 aa, Homo Sapiens
GSYETETGG

SEQ ID NO: 647035 - protein, 9 aa, Homo Sapiens
PSSAWWGLG

SEQ ID NO: 647036 - protein, 9 aa, Homo Sapiens
ERGEKHLGV

SEQ ID NO: 647037 - protein, 9 aa, Homo Sapiens
ECKDYGKAF

SEQ ID NO: 647038 - protein, 9 aa, Homo Sapiens
TAFYHKYFN

SEQ ID NO: 647039 - protein, 9 aa, Homo Sapiens
LCERMSQQI

SEQ ID NO: 647040 - protein, 9 aa, Homo Sapiens
EPSLRKLVW

SEQ ID NO: 647041 - protein, 9 aa, Homo Sapiens
ACSWSTGMQ

SEQ ID NO: 647042 - protein, 9 aa, Homo Sapiens
TKPGAEKAK

SEQ ID NO: 647043 - protein, 9 aa, Homo Sapiens
KPYECKDYG

SEQ ID NO: 647044 - protein, 9 aa, Homo Sapiens
KTIKSLRLL

SEQ ID NO: 647045 - protein, 9 aa, Homo Sapiens
TPWLCQSSE

SEQ ID NO: 647046 - protein, 9 aa, Homo Sapiens
AWWGLGLGQ

SEQ ID NO: 647047 - protein, 9 aa, Homo Sapiens
CPPYLTSTR

SEQ ID NO: 647048 - protein, 9 aa, Homo Sapiens
RVSPCLPGW

SEQ ID NO: 647049 - protein, 9 aa, Homo Sapiens
DTGETSMLR

SEQ ID NO: 647050 - protein, 9 aa, Homo Sapiens
ITSFSVADT

SEQ ID NO: 647051 - protein, 9 aa, Homo Sapiens
VPAQVKKQS

SEQ ID NO: 647052 - protein, 9 aa, Homo Sapiens
EFTEENVLF

SEQ ID NO: 647053 - protein, 9 aa, Homo Sapiens
FISCPPYLT

SEQ ID NO: 647054 - protein, 9 aa, Homo Sapiens
RYWHGDYLP

SEQ ID NO: 647055 - protein, 9 aa, Homo Sapiens
NWSSHLSQH

SEQ ID NO: 647056 - protein, 9 aa, Homo Sapiens
TGVLLSLNG

SEQ ID NO: 647057 - protein, 9 aa, Homo Sapiens
CTLLTMFDQ

SEQ ID NO: 647058 - protein, 9 aa, Homo Sapiens
ENKKLQEEI

SEQ ID NO: 647059 - protein, 9 aa, Homo Sapiens
ENICNTNKF

SEQ ID NO: 647060 - protein, 9 aa, Homo Sapiens
TFQPGMGQF

SEQ ID NO: 647061 - protein, 9 aa, Homo Sapiens
LQLYLRKSL

SEQ ID NO: 647062 - protein, 9 aa, Homo Sapiens
GGDLVENVD

SEQ ID NO: 647063 - protein, 9 aa, Homo Sapiens
VGETITEEQ

SEQ ID NO: 647064 - protein, 9 aa, Homo Sapiens
QVEFYINEN

SEQ ID NO: 647065 - protein, 9 aa, Homo Sapiens
NGEGRRPQR

SEQ ID NO: 647066 - protein, 9 aa, Homo Sapiens
IKTIKSLRL

SEQ ID NO: 647067 - protein, 9 aa, Homo Sapiens
RCPAKHYMC

SEQ ID NO: 647068 - protein, 9 aa, Homo Sapiens
CKSNWRSGW

SEQ ID NO: 647069 - protein, 9 aa, Homo Sapiens
SFISCPPYL

SEQ ID NO: 647070 - protein, 9 aa, Homo Sapiens
YYCTWPAEG

SEQ ID NO: 647071 - protein, 9 aa, Homo Sapiens
ATLVSERSN

SEQ ID NO: 647072 - protein, 9 aa, Homo Sapiens
GEGRRPQRY

SEQ ID NO: 647073 - protein, 9 aa, Homo Sapiens
GQVCVSEQE

SEQ ID NO: 647074 - protein, 9 aa, Homo Sapiens
KPYKCNECV

SEQ ID NO: 647075 - protein, 9 aa, Homo Sapiens
SRKEHRKHK

SEQ ID NO: 647076 - protein, 9 aa, Homo Sapiens
TIEAAKALL

SEQ ID NO: 647077 - protein, 9 aa, Homo Sapiens
EDESDSPHI

SEQ ID NO: 647078 - protein, 9 aa, Homo Sapiens
PSGGGGCGG

SEQ ID NO: 647079 - protein, 9 aa, Homo Sapiens
QGKKSGTSR

SEQ ID NO: 647080 - protein, 9 aa, Homo Sapiens
EAEAGGGGP

SEQ ID NO: 647081 - protein, 9 aa, Homo Sapiens
IVGSMISNM

SEQ ID NO: 647082 - protein, 9 aa, Homo Sapiens
TFDSLEALS

SEQ ID NO: 647083 - protein, 9 aa, Homo Sapiens
NDAGLLGNV

SEQ ID NO: 647084 - protein, 9 aa, Homo Sapiens
ALQGLCLCI

SEQ ID NO: 647085 - protein, 9 aa, Homo Sapiens
DAPGPQGPS

SEQ ID NO: 647086 - protein, 9 aa, Homo Sapiens
YEVPSKTML

SEQ ID NO: 647087 - protein, 9 aa, Homo Sapiens
ALPGSSTIV

SEQ ID NO: 647088 - protein, 9 aa, Homo Sapiens
EHLQTHRCP

SEQ ID NO: 647089 - protein, 9 aa, Homo Sapiens
LESEPYIFQ

SEQ ID NO: 647090 - protein, 9 aa, Homo Sapiens
LKKEFTEEN

SEQ ID NO: 647091 - protein, 9 aa, Homo Sapiens
MSIVDSVAV

SEQ ID NO: 647092 - protein, 9 aa, Homo Sapiens
KMDSKKWSS

SEQ ID NO: 647093 - protein, 9 aa, Homo Sapiens
LRNLAGSLV

SEQ ID NO: 647094 - protein, 9 aa, Homo Sapiens
GCVDDTILS

SEQ ID NO: 647095 - protein, 9 aa, Homo Sapiens
NGAVIARQR

SEQ ID NO: 647096 - protein, 9 aa, Homo Sapiens
QTVRIVGRT

SEQ ID NO: 647097 - protein, 9 aa, Homo Sapiens
RDGIRAPSG

SEQ ID NO: 647098 - protein, 9 aa, Homo Sapiens
TTLSQPQQN

SEQ ID NO: 647099 - protein, 9 aa, Homo Sapiens
AYNSKGAGL

SEQ ID NO: 647100 - protein, 9 aa, Homo Sapiens
NVAQALPGS

SEQ ID NO: 647101 - protein, 9 aa, Homo Sapiens
KEEDESDSP

SEQ ID NO: 647102 - protein, 9 aa, Homo Sapiens
AVSAFEIFK

SEQ ID NO: 647103 - protein, 9 aa, Homo Sapiens
RQRLAGGAG

SEQ ID NO: 647104 - protein, 9 aa, Homo Sapiens
CDKEFSPRQ

SEQ ID NO: 647105 - protein, 9 aa, Homo Sapiens
HYPDLYVRE

SEQ ID NO: 647106 - protein, 9 aa, Homo Sapiens
RARLIASGA

SEQ ID NO: 647107 - protein, 9 aa, Homo Sapiens
LERESTAQY

SEQ ID NO: 647108 - protein, 9 aa, Homo Sapiens
NLNATSKAG

SEQ ID NO: 647109 - protein, 9 aa, Homo Sapiens
SGCGSSGGA

SEQ ID NO: 647110 - protein, 9 aa, Homo Sapiens
EMMTFGSKP

SEQ ID NO: 647111 - protein, 9 aa, Homo Sapiens
YMNVTEAAK

SEQ ID NO: 647112 - protein, 9 aa, Homo Sapiens
KPLLVGPSS

SEQ ID NO: 647113 - protein, 9 aa, Homo Sapiens
DTWFFMNLE

SEQ ID NO: 647114 - protein, 9 aa, Homo Sapiens
TSYLFTSEL

SEQ ID NO: 647115 - protein, 9 aa, Homo Sapiens
ANRSITSFS

SEQ ID NO: 647116 - protein, 9 aa, Homo Sapiens
TGIKEVLDD

SEQ ID NO: 647117 - protein, 9 aa, Homo Sapiens
GPGHGSGGG

SEQ ID NO: 647118 - protein, 9 aa, Homo Sapiens
FFMSICRTE

SEQ ID NO: 647119 - protein, 9 aa, Homo Sapiens
MDSKKWSSR

SEQ ID NO: 647120 - protein, 9 aa, Homo Sapiens
REALLELLC

SEQ ID NO: 647121 - protein, 9 aa, Homo Sapiens
NRHQEEVAY

SEQ ID NO: 647122 - protein, 9 aa, Homo Sapiens
AAASVSSAA

SEQ ID NO: 647123 - protein, 9 aa, Homo Sapiens
EGRRPQRYT

SEQ ID NO: 647124 - protein, 9 aa, Homo Sapiens
EFLKKEFTE

SEQ ID NO: 647125 - protein, 9 aa, Homo Sapiens
GDAPLLGIM

SEQ ID NO: 647126 - protein, 9 aa, Homo Sapiens
EDCTTMIDR

SEQ ID NO: 647127 - protein, 9 aa, Homo Sapiens
ILLVRGSEQ

SEQ ID NO: 647128 - protein, 9 aa, Homo Sapiens
STRAVNVLS

SEQ ID NO: 647129 - protein, 9 aa, Homo Sapiens
CSSISQLKT

SEQ ID NO: 647130 - protein, 9 aa, Homo Sapiens
FAARIHNHL

SEQ ID NO: 647131 - protein, 9 aa, Homo Sapiens
YGPHSCQHM

SEQ ID NO: 647132 - protein, 9 aa, Homo Sapiens
SKTMLSYSE

SEQ ID NO: 647133 - protein, 9 aa, Homo Sapiens
VSMVLTGTA

SEQ ID NO: 647134 - protein, 9 aa, Homo Sapiens
AEDPEENVA

SEQ ID NO: 647135 - protein, 9 aa, Homo Sapiens
IHYNHELYM

SEQ ID NO: 647136 - protein, 9 aa, Homo Sapiens
FQPTAKPRA

SEQ ID NO: 647137 - protein, 9 aa, Homo Sapiens
AAVAMPRIS

SEQ ID NO: 647138 - protein, 9 aa, Homo Sapiens
SAGDAPLLG

SEQ ID NO: 647139 - protein, 9 aa, Homo Sapiens
VPAMSPNAL

SEQ ID NO: 647140 - protein, 9 aa, Homo Sapiens
MSFVNLVEC

SEQ ID NO: 647141 - protein, 9 aa, Homo Sapiens
KLAANDFFG

SEQ ID NO: 647142 - protein, 9 aa, Homo Sapiens
SGVALAGPV

SEQ ID NO: 647143 - protein, 9 aa, Homo Sapiens
LELLCCTNV

SEQ ID NO: 647144 - protein, 9 aa, Homo Sapiens
FDSLEALSV

SEQ ID NO: 647145 - protein, 9 aa, Homo Sapiens
RPIMSELEE

SEQ ID NO: 647146 - protein, 9 aa, Homo Sapiens
GTISNGKNQ

SEQ ID NO: 647147 - protein, 9 aa, Homo Sapiens
KKEFTEENV

SEQ ID NO: 647148 - protein, 9 aa, Homo Sapiens
NEGEHSSRR

SEQ ID NO: 647149 - protein, 9 aa, Homo Sapiens
VIEAIAESA

SEQ ID NO: 647150 - protein, 9 aa, Homo Sapiens
AKALLNMDS

SEQ ID NO: 647151 - protein, 9 aa, Homo Sapiens
VSSAAAVAP

SEQ ID NO: 647152 - protein, 9 aa, Homo Sapiens
ELSWLETRW

SEQ ID NO: 647153 - protein, 9 aa, Homo Sapiens
GGAGEMQMM

SEQ ID NO: 647154 - protein, 9 aa, Homo Sapiens
WWGLGLGQR

SEQ ID NO: 647155 - protein, 9 aa, Homo Sapiens
TTRDCALQF

SEQ ID NO: 647156 - protein, 9 aa, Homo Sapiens
VALAGPVGA

SEQ ID NO: 647157 - protein, 9 aa, Homo Sapiens
QTHRCPAKH

SEQ ID NO: 647158 - protein, 9 aa, Homo Sapiens
LLVRGSEQD

SEQ ID NO: 647159 - protein, 9 aa, Homo Sapiens
ANDFFGRLL

SEQ ID NO: 647160 - protein, 9 aa, Homo Sapiens
HEISSLADS

SEQ ID NO: 647161 - protein, 9 aa, Homo Sapiens
FLKKEFTEE

SEQ ID NO: 647162 - protein, 9 aa, Homo Sapiens
YIGHLDGIW

SEQ ID NO: 647163 - protein, 9 aa, Homo Sapiens
TLQPHQHIP

SEQ ID NO: 647164 - protein, 9 aa, Homo Sapiens
GDADAPGPQ

SEQ ID NO: 647165 - protein, 9 aa, Homo Sapiens
TITEEQSQS

SEQ ID NO: 647166 - protein, 9 aa, Homo Sapiens
HRCPAKHYM

SEQ ID NO: 647167 - protein, 9 aa, Homo Sapiens
VQVEFYINE

SEQ ID NO: 647168 - protein, 9 aa, Homo Sapiens
QPLADPEET

SEQ ID NO: 647169 - protein, 9 aa, Homo Sapiens
ENLEVFRKN

SEQ ID NO: 647170 - protein, 9 aa, Homo Sapiens
HEILNIFQG

SEQ ID NO: 647171 - protein, 9 aa, Homo Sapiens
QTVLQLKQN

SEQ ID NO: 647172 - protein, 9 aa, Homo Sapiens
QSVHVAFKV

SEQ ID NO: 647173 - protein, 9 aa, Homo Sapiens
PYKCNECVK

SEQ ID NO: 647174 - protein, 9 aa, Homo Sapiens
VPEDLRQMF

SEQ ID NO: 647175 - protein, 9 aa, Homo Sapiens
SKHSMVNSL

SEQ ID NO: 647176 - protein, 9 aa, Homo Sapiens
RHQEEVAYG

SEQ ID NO: 647177 - protein, 9 aa, Homo Sapiens
HRPIPPSRV

SEQ ID NO: 647178 - protein, 9 aa, Homo Sapiens
VSAFEIFKE

SEQ ID NO: 647179 - protein, 9 aa, Homo Sapiens
LFSASLGGP

SEQ ID NO: 647180 - protein, 9 aa, Homo Sapiens
KKYNLESAS

SEQ ID NO: 647181 - protein, 9 aa, Homo Sapiens
AFFMSICRT

SEQ ID NO: 647182 - protein, 9 aa, Homo Sapiens
ATQWVTHLQ

SEQ ID NO: 647183 - protein, 9 aa, Homo Sapiens
HKRNHTGDI

SEQ ID NO: 647184 - protein, 9 aa, Homo Sapiens
RRIRCNICN

SEQ ID NO: 647185 - protein, 9 aa, Homo Sapiens
TVTSGDYSL

SEQ ID NO: 647186 - protein, 9 aa, Homo Sapiens
FTWTLVGSR

SEQ ID NO: 647187 - protein, 9 aa, Homo Sapiens
CVDTHLRST

SEQ ID NO: 647188 - protein, 9 aa, Homo Sapiens
SIVDSVAVL

SEQ ID NO: 647189 - protein, 9 aa, Homo Sapiens
QFSFSPAGT

SEQ ID NO: 647190 - protein, 9 aa, Homo Sapiens
KPASRQKEL

SEQ ID NO: 647191 - protein, 9 aa, Homo Sapiens
QNVAQALPG

SEQ ID NO: 647192 - protein, 9 aa, Homo Sapiens
SQCSSISQL

SEQ ID NO: 647193 - protein, 9 aa, Homo Sapiens
YSDENGPLM

SEQ ID NO: 647194 - protein, 9 aa, Homo Sapiens
VSIYKLTAA

SEQ ID NO: 647195 - protein, 9 aa, Homo Sapiens
SLKPLLVGP

SEQ ID NO: 647196 - protein, 9 aa, Homo Sapiens
AVLIENLEV

SEQ ID NO: 647197 - protein, 9 aa, Homo Sapiens
PYINDTHFY

SEQ ID NO: 647198 - protein, 9 aa, Homo Sapiens
LQNYQNLLA

SEQ ID NO: 647199 - protein, 9 aa, Homo Sapiens
MRVRGRARL

SEQ ID NO: 647200 - protein, 9 aa, Homo Sapiens
VKGTLGNAS

SEQ ID NO: 647201 - protein, 9 aa, Homo Sapiens
LCLCIDFQF

SEQ ID NO: 647202 - protein, 9 aa, Homo Sapiens
NLESASAIL

SEQ ID NO: 647203 - protein, 9 aa, Homo Sapiens
KIAWILGLH

SEQ ID NO: 647204 - protein, 9 aa, Homo Sapiens
VVDEFSTLV

SEQ ID NO: 647205 - protein, 9 aa, Homo Sapiens
SYGVTVWEM

SEQ ID NO: 647206 - protein, 9 aa, Homo Sapiens
EFYINENTF

SEQ ID NO: 647207 - protein, 9 aa, Homo Sapiens
GHLDGIWDV

SEQ ID NO: 647208 - protein, 9 aa, Homo Sapiens
LQQCWATPR

SEQ ID NO: 647209 - protein, 9 aa, Homo Sapiens
PNLFRVIRL

SEQ ID NO: 647210 - protein, 9 aa, Homo Sapiens
SEAAFTTSY

SEQ ID NO: 647211 - protein, 9 aa, Homo Sapiens
FDPELEEAL

SEQ ID NO: 647212 - protein, 9 aa, Homo Sapiens
KPAAHEISS

SEQ ID NO: 647213 - protein, 9 aa, Homo Sapiens
PLAKKLEPV

SEQ ID NO: 647214 - protein, 9 aa, Homo Sapiens
RRDEAGGGP

SEQ ID NO: 647215 - protein, 9 aa, Homo Sapiens
FVIASFTFQ

SEQ ID NO: 647216 - protein, 9 aa, Homo Sapiens
PMFTWTLVG

SEQ ID NO: 647217 - protein, 9 aa, Homo Sapiens
VLLSLNGSE

SEQ ID NO: 647218 - protein, 9 aa, Homo Sapiens
WPCPGSPAL

SEQ ID NO: 647219 - protein, 9 aa, Homo Sapiens
DPDVGREAV

SEQ ID NO: 647220 - protein, 9 aa, Homo Sapiens
IARQRLAGG

SEQ ID NO: 647221 - protein, 9 aa, Homo Sapiens
ESATTHKAE

SEQ ID NO: 647222 - protein, 9 aa, Homo Sapiens
EEKVTFDPE

SEQ ID NO: 647223 - protein, 9 aa, Homo Sapiens
RGSSRSPVR

SEQ ID NO: 647224 - protein, 9 aa, Homo Sapiens
ATELALKLL

SEQ ID NO: 647225 - protein, 9 aa, Homo Sapiens
IASGNHVSN

SEQ ID NO: 647226 - protein, 9 aa, Homo Sapiens
WSSHLSQHK

SEQ ID NO: 647227 - protein, 9 aa, Homo Sapiens
FTFDSLEAL

SEQ ID NO: 647228 - protein, 9 aa, Homo Sapiens
LSLKPLLVG

SEQ ID NO: 647229 - protein, 9 aa, Homo Sapiens
NVAVSPTPP

SEQ ID NO: 647230 - protein, 9 aa, Homo Sapiens
MFTWTLVGS

SEQ ID NO: 647231 - protein, 9 aa, Homo Sapiens
TMLSYSELW

SEQ ID NO: 647232 - protein, 9 aa, Homo Sapiens
CLEPAQRTL

SEQ ID NO: 647233 - protein, 9 aa, Homo Sapiens
ACHEATQWV

SEQ ID NO: 647234 - protein, 9 aa, Homo Sapiens
SFSPAGTPT

SEQ ID NO: 647235 - protein, 9 aa, Homo Sapiens
PPARKQAHR

SEQ ID NO: 647236 - protein, 9 aa, Homo Sapiens
FQAGSQPQE

SEQ ID NO: 647237 - protein, 9 aa, Homo Sapiens
LHTGDHPFM

SEQ ID NO: 647238 - protein, 9 aa, Homo Sapiens
IMDELVRVL

SEQ ID NO: 647239 - protein, 9 aa, Homo Sapiens
VPGDAPGQP

SEQ ID NO: 647240 - protein, 9 aa, Homo Sapiens
HHRARCLAM

SEQ ID NO: 647241 - protein, 9 aa, Homo Sapiens
RLWCTGYIK

SEQ ID NO: 647242 - protein, 9 aa, Homo Sapiens
ISCPPYLTS

SEQ ID NO: 647243 - protein, 9 aa, Homo Sapiens
QVKGQAESQ

SEQ ID NO: 647244 - protein, 9 aa, Homo Sapiens
AVCNKFTFD

SEQ ID NO: 647245 - protein, 9 aa, Homo Sapiens
PGSAVAAPP

SEQ ID NO: 647246 - protein, 9 aa, Homo Sapiens
GSGTKMDSR

SEQ ID NO: 647247 - protein, 9 aa, Homo Sapiens
LVKEYIGHL

SEQ ID NO: 647248 - protein, 9 aa, Homo Sapiens
SSAAAVAPS

SEQ ID NO: 647249 - protein, 9 aa, Homo Sapiens
QPSGGGGCG

SEQ ID NO: 647250 - protein, 9 aa, Homo Sapiens
PTLLKNFLL

SEQ ID NO: 647251 - protein, 9 aa, Homo Sapiens
EERHERGEK

SEQ ID NO: 647252 - protein, 9 aa, Homo Sapiens
GLAATFQQL

SEQ ID NO: 647253 - protein, 9 aa, Homo Sapiens
PSMSPAPQA

SEQ ID NO: 647254 - protein, 9 aa, Homo Sapiens
MKGKKKYNL

SEQ ID NO: 647255 - protein, 9 aa, Homo Sapiens
PSAGLPKAS

SEQ ID NO: 647256 - protein, 9 aa, Homo Sapiens
GVVDLPQEN

SEQ ID NO: 647257 - protein, 9 aa, Homo Sapiens
TSGDYSLFQ

SEQ ID NO: 647258 - protein, 9 aa, Homo Sapiens
TSESGELVS

SEQ ID NO: 647259 - protein, 9 aa, Homo Sapiens
KGAGLESEP

SEQ ID NO: 647260 - protein, 9 aa, Homo Sapiens
WFKKEREES

SEQ ID NO: 647261 - protein, 9 aa, Homo Sapiens
KGQILKMAN

SEQ ID NO: 647262 - protein, 9 aa, Homo Sapiens
AGHTVRDEP

SEQ ID NO: 647263 - protein, 9 aa, Homo Sapiens
NVAILGIML

SEQ ID NO: 647264 - protein, 9 aa, Homo Sapiens
IYKLTAAVM

SEQ ID NO: 647265 - protein, 9 aa, Homo Sapiens
ESAINVAIL

SEQ ID NO: 647266 - protein, 9 aa, Homo Sapiens
DPEENVAVS

SEQ ID NO: 647267 - protein, 9 aa, Homo Sapiens
LRSNDAGLL

SEQ ID NO: 647268 - protein, 9 aa, Homo Sapiens
KGLGGGFRQ

SEQ ID NO: 647269 - protein, 9 aa, Homo Sapiens
TWFFMNLEE

SEQ ID NO: 647270 - protein, 9 aa, Homo Sapiens
CIDFQFDTV

SEQ ID NO: 647271 - protein, 9 aa, Homo Sapiens
SSTRAVNVL

SEQ ID NO: 647272 - protein, 9 aa, Homo Sapiens
GGCVDDTIL

SEQ ID NO: 647273 - protein, 9 aa, Homo Sapiens
NVSVSGQSV

SEQ ID NO: 647274 - protein, 9 aa, Homo Sapiens
NESVVSSTR

SEQ ID NO: 647275 - protein, 9 aa, Homo Sapiens
KLESRLQYL

SEQ ID NO: 647276 - protein, 9 aa, Homo Sapiens
LNDKLLPKL

SEQ ID NO: 647277 - protein, 9 aa, Homo Sapiens
KIFAARIHN

SEQ ID NO: 647278 - protein, 9 aa, Homo Sapiens
DLYVREQLA

SEQ ID NO: 647279 - protein, 9 aa, Homo Sapiens
GCGSSGGAS

SEQ ID NO: 647280 - protein, 9 aa, Homo Sapiens
EGGTCLFSA

SEQ ID NO: 647281 - protein, 9 aa, Homo Sapiens
MMTFGSKPY

SEQ ID NO: 647282 - protein, 9 aa, Homo Sapiens
VEYTVHLWA

SEQ ID NO: 647283 - protein, 9 aa, Homo Sapiens
IFAARIHNH

SEQ ID NO: 647284 - protein, 9 aa, Homo Sapiens
VKVFNQLSN

SEQ ID NO: 647285 - protein, 9 aa, Homo Sapiens
SEARGRSRT

SEQ ID NO: 647286 - protein, 9 aa, Homo Sapiens
ASEGAITVK

SEQ ID NO: 647287 - protein, 9 aa, Homo Sapiens
LRKLVWRYL

SEQ ID NO: 647288 - protein, 9 aa, Homo Sapiens
MYRLWCTGY

SEQ ID NO: 647289 - protein, 9 aa, Homo Sapiens
YNSKGAGLE

SEQ ID NO: 647290 - protein, 9 aa, Homo Sapiens
SLRLLRVLR

SEQ ID NO: 647291 - protein, 9 aa, Homo Sapiens
SAAGAQHEA

SEQ ID NO: 647292 - protein, 9 aa, Homo Sapiens
FHNHLESHN

SEQ ID NO: 647293 - protein, 9 aa, Homo Sapiens
HHHKSRKEH

SEQ ID NO: 647294 - protein, 9 aa, Homo Sapiens
QLKQNIALL

SEQ ID NO: 647295 - protein, 9 aa, Homo Sapiens
NHTGDIPYK

SEQ ID NO: 647296 - protein, 9 aa, Homo Sapiens
SVHGAGNLV

SEQ ID NO: 647297 - protein, 9 aa, Homo Sapiens
FFSEARGRS

SEQ ID NO: 647298 - protein, 9 aa, Homo Sapiens
RPQRYTKPG

SEQ ID NO: 647299 - protein, 9 aa, Homo Sapiens
GPPGTVITM

SEQ ID NO: 647300 - protein, 9 aa, Homo Sapiens
SYETETGGD

SEQ ID NO: 647301 - protein, 9 aa, Homo Sapiens
TGETSMLRR

SEQ ID NO: 647302 - protein, 9 aa, Homo Sapiens
DRVSPCLPG

SEQ ID NO: 647303 - protein, 9 aa, Homo Sapiens
TSMLRRPVL

SEQ ID NO: 647304 - protein, 9 aa, Homo Sapiens
STFLLRLEH

SEQ ID NO: 647305 - protein, 9 aa, Homo Sapiens
PSEDCTTMI

SEQ ID NO: 647306 - protein, 9 aa, Homo Sapiens
QENREAAYN

SEQ ID NO: 647307 - protein, 9 aa, Homo Sapiens
TDKENGPSA

SEQ ID NO: 647308 - protein, 9 aa, Homo Sapiens
CNKFTFDSL

SEQ ID NO: 647309 - protein, 9 aa, Homo Sapiens
DTHLRSTCY

SEQ ID NO: 647310 - protein, 9 aa, Homo Sapiens
RANILLVRG

SEQ ID NO: 647311 - protein, 9 aa, Homo Sapiens
TVSVLRGQG

SEQ ID NO: 647312 - protein, 9 aa, Homo Sapiens
LSHSEEFFK

SEQ ID NO: 647313 - protein, 9 aa, Homo Sapiens
MSIPEHVLT

SEQ ID NO: 647314 - protein, 9 aa, Homo Sapiens
KITLHLKDN

SEQ ID NO: 647315 - protein, 9 aa, Homo Sapiens
GRFLRRSPG

SEQ ID NO: 647316 - protein, 9 aa, Homo Sapiens
RVQVEFYIN

SEQ ID NO: 647317 - protein, 9 aa, Homo Sapiens
NNLLLRKDA

SEQ ID NO: 647318 - protein, 9 aa, Homo Sapiens
GAWPGLGSQ

SEQ ID NO: 647319 - protein, 9 aa, Homo Sapiens
RRLWYATHY

SEQ ID NO: 647320 - protein, 9 aa, Homo Sapiens
INENTFKER

SEQ ID NO: 647321 - protein, 9 aa, Homo Sapiens
CGSGTKMDS

SEQ ID NO: 647322 - protein, 9 aa, Homo Sapiens
ARKQAHRSQ

SEQ ID NO: 647323 - protein, 9 aa, Homo Sapiens
VHGVMDPAP

SEQ ID NO: 647324 - protein, 9 aa, Homo Sapiens
CRSAMPHAP

SEQ ID NO: 647325 - protein, 9 aa, Homo Sapiens
SFLNGKWFK

SEQ ID NO: 647326 - protein, 9 aa, Homo Sapiens
CPAKHYMCP

SEQ ID NO: 647327 - protein, 9 aa, Homo Sapiens
QKGDADAPG

SEQ ID NO: 647328 - protein, 9 aa, Homo Sapiens
YRDGIRAPS

SEQ ID NO: 647329 - protein, 9 aa, Homo Sapiens
RRPPARKQA

SEQ ID NO: 647330 - protein, 9 aa, Homo Sapiens
LAFFMSICR

SEQ ID NO: 647331 - protein, 9 aa, Homo Sapiens
NALNQFPAA

SEQ ID NO: 647332 - protein, 9 aa, Homo Sapiens
GGPGSAVAA

SEQ ID NO: 647333 - protein, 9 aa, Homo Sapiens
KQPNSILTN

SEQ ID NO: 647334 - protein, 9 aa, Homo Sapiens
TLGNASKQA

SEQ ID NO: 647335 - protein, 9 aa, Homo Sapiens
GAGEMQMMS

SEQ ID NO: 647336 - protein, 9 aa, Homo Sapiens
PCLPGWSRT

SEQ ID NO: 647337 - protein, 9 aa, Homo Sapiens
INAGQQGLS

SEQ ID NO: 647338 - protein, 9 aa, Homo Sapiens
GNASPGAST

SEQ ID NO: 647339 - protein, 9 aa, Homo Sapiens
EKPSKAITS

SEQ ID NO: 647340 - protein, 9 aa, Homo Sapiens
AGLESEPYI

SEQ ID NO: 647341 - protein, 9 aa, Homo Sapiens
HPCRSAMPH

SEQ ID NO: 647342 - protein, 9 aa, Homo Sapiens
TVRIVGRTG

SEQ ID NO: 647343 - protein, 9 aa, Homo Sapiens
VGVGVAVLN

SEQ ID NO: 647344 - protein, 9 aa, Homo Sapiens
PMLTRRVGV

SEQ ID NO: 647345 - protein, 9 aa, Homo Sapiens
LADPEETSE

SEQ ID NO: 647346 - protein, 9 aa, Homo Sapiens
QVKKQSTKD

SEQ ID NO: 647347 - protein, 9 aa, Homo Sapiens
CAVCNKFTF

SEQ ID NO: 647348 - protein, 9 aa, Homo Sapiens
LYRSRYLML

SEQ ID NO: 647349 - protein, 9 aa, Homo Sapiens
SMSPAPQAP

SEQ ID NO: 647350 - protein, 9 aa, Homo Sapiens
KVTFDPELE

SEQ ID NO: 647351 - protein, 9 aa, Homo Sapiens
MSQQIFTNV

SEQ ID NO: 647352 - protein, 9 aa, Homo Sapiens
PQVNGAFSS

SEQ ID NO: 647353 - protein, 9 aa, Homo Sapiens
RMSIVDSVA

SEQ ID NO: 647354 - protein, 9 aa, Homo Sapiens
SVHVAFKVP

SEQ ID NO: 647355 - protein, 9 aa, Homo Sapiens
AFTTSYLFT

SEQ ID NO: 647356 - protein, 9 aa, Homo Sapiens
SMLRRPVLL

SEQ ID NO: 647357 - protein, 9 aa, Homo Sapiens
ARYWHGDYL

SEQ ID NO: 647358 - protein, 9 aa, Homo Sapiens
VVVGAVGVG

SEQ ID NO: 647359 - protein, 9 aa, Homo Sapiens
KLVWRYLLN

SEQ ID NO: 647360 - protein, 9 aa, Homo Sapiens
DSKKWSSRG

SEQ ID NO: 647361 - protein, 9 aa, Homo Sapiens
NGKWFKKER

SEQ ID NO: 647362 - protein, 9 aa, Homo Sapiens
KRENWKPVT

SEQ ID NO: 647363 - protein, 9 aa, Homo Sapiens
DYLPFDGPG

SEQ ID NO: 647364 - protein, 9 aa, Homo Sapiens
ILGLHSKIS

SEQ ID NO: 647365 - protein, 9 aa, Homo Sapiens
AGQKGDADA

SEQ ID NO: 647366 - protein, 9 aa, Homo Sapiens
SIVSSEEDW

SEQ ID NO: 647367 - protein, 9 aa, Homo Sapiens
PHPCRSAMP

SEQ ID NO: 647368 - protein, 9 aa, Homo Sapiens
IEKFYALDS

SEQ ID NO: 647369 - protein, 9 aa, Homo Sapiens
NNGMQRILI

SEQ ID NO: 647370 - protein, 9 aa, Homo Sapiens
QMMSIWYSQ

SEQ ID NO: 647371 - protein, 9 aa, Homo Sapiens
RISCRKGSK

SEQ ID NO: 647372 - protein, 9 aa, Homo Sapiens
RVCVDTHLR

SEQ ID NO: 647373 - protein, 9 aa, Homo Sapiens
VDFSSIAVP

SEQ ID NO: 647374 - protein, 9 aa, Homo Sapiens
CGILGHLAR

SEQ ID NO: 647375 - protein, 9 aa, Homo Sapiens
CNTNKFYMS

SEQ ID NO: 647376 - protein, 9 aa, Homo Sapiens
SSLSPSMSP

SEQ ID NO: 647377 - protein, 9 aa, Homo Sapiens
GGAGHTVRD

SEQ ID NO: 647378 - protein, 9 aa, Homo Sapiens
PEENVAVSP

SEQ ID NO: 647379 - protein, 9 aa, Homo Sapiens
VTVWEMMTF

SEQ ID NO: 647380 - protein, 9 aa, Homo Sapiens
GKMAAADGQ

SEQ ID NO: 647381 - protein, 9 aa, Homo Sapiens
LDGIWDVSV

SEQ ID NO: 647382 - protein, 9 aa, Homo Sapiens
ESGELVSSL

SEQ ID NO: 647383 - protein, 9 aa, Homo Sapiens
SAWWGLGLG

SEQ ID NO: 647384 - protein, 9 aa, Homo Sapiens
SDCSDAEYE

SEQ ID NO: 647385 - protein, 9 aa, Homo Sapiens
FSFSPAGTP

SEQ ID NO: 647386 - protein, 9 aa, Homo Sapiens
FMARFSRGS

SEQ ID NO: 647387 - protein, 9 aa, Homo Sapiens
RKRAQTILF

SEQ ID NO: 647388 - protein, 9 aa, Homo Sapiens
LSWLETRWA

SEQ ID NO: 647389 - protein, 9 aa, Homo Sapiens
SAVAAPPAA

SEQ ID NO: 647390 - protein, 9 aa, Homo Sapiens
AKPSAAGAQ

SEQ ID NO: 647391 - protein, 9 aa, Homo Sapiens
PVTEHEILN

SEQ ID NO: 647392 - protein, 9 aa, Homo Sapiens
SEQEQASCR

SEQ ID NO: 647393 - protein, 9 aa, Homo Sapiens
PAPQAPLLE

SEQ ID NO: 647394 - protein, 9 aa, Homo Sapiens
QAGSQPQEA

SEQ ID NO: 647395 - protein, 9 aa, Homo Sapiens
EGGAVYYCT

SEQ ID NO: 647396 - protein, 9 aa, Homo Sapiens
ILKMANPII

SEQ ID NO: 647397 - protein, 9 aa, Homo Sapiens
NNKQPNSIL

SEQ ID NO: 647398 - protein, 9 aa, Homo Sapiens
NRSITSFSV

SEQ ID NO: 647399 - protein, 9 aa, Homo Sapiens
RTDPLSQPQ

SEQ ID NO: 647400 - protein, 9 aa, Homo Sapiens
SNGAVIARQ

SEQ ID NO: 647401 - protein, 9 aa, Homo Sapiens
HSEEFFKKE

SEQ ID NO: 647402 - protein, 9 aa, Homo Sapiens
AEAGGGGPG

SEQ ID NO: 647403 - protein, 9 aa, Homo Sapiens
PHSCQHMGD

SEQ ID NO: 647404 - protein, 9 aa, Homo Sapiens
MARFSRGSS

SEQ ID NO: 647405 - protein, 9 aa, Homo Sapiens
RSIQHRAFA

SEQ ID NO: 647406 - protein, 9 aa, Homo Sapiens
MFFSEARGR

SEQ ID NO: 647407 - protein, 9 aa, Homo Sapiens
PNQFNLDTQ

SEQ ID NO: 647408 - protein, 9 aa, Homo Sapiens
RLWYATHYP

SEQ ID NO: 647409 - protein, 9 aa, Homo Sapiens
RPVRQRPEP

SEQ ID NO: 647410 - protein, 9 aa, Homo Sapiens
ILGHLARDC

SEQ ID NO: 647411 - protein, 9 aa, Homo Sapiens
MLTRRVGVG

SEQ ID NO: 647412 - protein, 9 aa, Homo Sapiens
NSKGAGLES

SEQ ID NO: 647413 - protein, 9 aa, Homo Sapiens
QHEAEAGGG

SEQ ID NO: 647414 - protein, 9 aa, Homo Sapiens
YRSRYLMLL

SEQ ID NO: 647415 - protein, 9 aa, Homo Sapiens
GASQRTAAP

SEQ ID NO: 647416 - protein, 9 aa, Homo Sapiens
QEQASCRKE

SEQ ID NO: 647417 - protein, 9 aa, Homo Sapiens
DVMLQNYQN

SEQ ID NO: 647418 - protein, 9 aa, Homo Sapiens
GQAGPEIMD

SEQ ID NO: 647419 - protein, 9 aa, Homo Sapiens
SPTCCRCEL

SEQ ID NO: 647420 - protein, 9 aa, Homo Sapiens
KDACSWSTG

SEQ ID NO: 647421 - protein, 9 aa, Homo Sapiens
KKSGTSRKL

SEQ ID NO: 647422 - protein, 9 aa, Homo Sapiens
LKQNIALLP

SEQ ID NO: 647423 - protein, 9 aa, Homo Sapiens
VEPHFLDRN

SEQ ID NO: 647424 - protein, 9 aa, Homo Sapiens
AVYYCTWPA

SEQ ID NO: 647425 - protein, 9 aa, Homo Sapiens
KLTAAVMHY

SEQ ID NO: 647426 - protein, 9 aa, Homo Sapiens
CYTCGILGH

SEQ ID NO: 647427 - protein, 9 aa, Homo Sapiens
GHKPRVNMF

SEQ ID NO: 647428 - protein, 9 aa, Homo Sapiens
FSRGSSRSP

SEQ ID NO: 647429 - protein, 9 aa, Homo Sapiens
HLLQKAVHK

SEQ ID NO: 647430 - protein, 9 aa, Homo Sapiens
HACTLLTMF

SEQ ID NO: 647431 - protein, 9 aa, Homo Sapiens
ASFISCPPY

SEQ ID NO: 647432 - protein, 9 aa, Homo Sapiens
YPDLYVREQ

SEQ ID NO: 647433 - protein, 9 aa, Homo Sapiens
SRDRVSPCL

SEQ ID NO: 647434 - protein, 9 aa, Homo Sapiens
SPAGRFLRR

SEQ ID NO: 647435 - protein, 9 aa, Homo Sapiens
RDRATELAL

SEQ ID NO: 647436 - protein, 9 aa, Homo Sapiens
TVHRPIPPS

SEQ ID NO: 647437 - protein, 9 aa, Homo Sapiens
MAAADGQDG

SEQ ID NO: 647438 - protein, 9 aa, Homo Sapiens
APSGLGLPV

SEQ ID NO: 647439 - protein, 9 aa, Homo Sapiens
WRSGWDWSQ

SEQ ID NO: 647440 - protein, 9 aa, Homo Sapiens
HVAFKVPPL

SEQ ID NO: 647441 - protein, 9 aa, Homo Sapiens
MSWESGAWP

SEQ ID NO: 647442 - protein, 9 aa, Homo Sapiens
SEPGDEESV

SEQ ID NO: 647443 - protein, 9 aa, Homo Sapiens
ILAEYSDEN

SEQ ID NO: 647444 - protein, 9 aa, Homo Sapiens
MDPAPASTQ

SEQ ID NO: 647445 - protein, 9 aa, Homo Sapiens
LILAFFMSI

SEQ ID NO: 647446 - protein, 9 aa, Homo Sapiens
GAVYYCTWP

SEQ ID NO: 647447 - protein, 9 aa, Homo Sapiens
GANSGCGSS

SEQ ID NO: 647448 - protein, 9 aa, Homo Sapiens
ATRWAAWTV

SEQ ID NO: 647449 - protein, 9 aa, Homo Sapiens
ECVKVFNQL

SEQ ID NO: 647450 - protein, 9 aa, Homo Sapiens
RVDGRGNLN

SEQ ID NO: 647451 - protein, 9 aa, Homo Sapiens
DIPYKCEEC

SEQ ID NO: 647452 - protein, 9 aa, Homo Sapiens
LASKHSMVN

SEQ ID NO: 647453 - protein, 9 aa, Homo Sapiens
SDSPHIVRY

SEQ ID NO: 647454 - protein, 9 aa, Homo Sapiens
IGNKMSAIF

SEQ ID NO: 647455 - protein, 9 aa, Homo Sapiens
PKPAAHEIS

SEQ ID NO: 647456 - protein, 9 aa, Homo Sapiens
ATNQPVTEH

SEQ ID NO: 647457 - protein, 9 aa, Homo Sapiens
GHGSGGGRG

SEQ ID NO: 647458 - protein, 9 aa, Homo Sapiens
LHCKIAVTY

SEQ ID NO: 647459 - protein, 9 aa, Homo Sapiens
KTHYPDLYV

SEQ ID NO: 647460 - protein, 9 aa, Homo Sapiens
SVSGQSVLL

SEQ ID NO: 647461 - protein, 9 aa, Homo Sapiens
YNLESASAI

SEQ ID NO: 647462 - protein, 9 aa, Homo Sapiens
GDAPGQPYR

SEQ ID NO: 647463 - protein, 9 aa, Homo Sapiens
CKIAVTYWA

SEQ ID NO: 647464 - protein, 9 aa, Homo Sapiens
KKWSSRGSE

SEQ ID NO: 647465 - protein, 9 aa, Homo Sapiens
LLGGCVDDT

SEQ ID NO: 647466 - protein, 9 aa, Homo Sapiens
ITEEQSQSF

SEQ ID NO: 647467 - protein, 9 aa, Homo Sapiens
RNKLRGVLR

SEQ ID NO: 647468 - protein, 9 aa, Homo Sapiens
QCSSISQLK

SEQ ID NO: 647469 - protein, 9 aa, Homo Sapiens
LENICNTNK

SEQ ID NO: 647470 - protein, 9 aa, Homo Sapiens
QGPATDAGK

SEQ ID NO: 647471 - protein, 9 aa, Homo Sapiens
HGDYLPFDG

SEQ ID NO: 647472 - protein, 9 aa, Homo Sapiens
RDIREALLE

SEQ ID NO: 647473 - protein, 9 aa, Homo Sapiens
VTFDPELEE

SEQ ID NO: 647474 - protein, 9 aa, Homo Sapiens
NKKLQEEIS

SEQ ID NO: 647475 - protein, 9 aa, Homo Sapiens
EEDESDSPH

SEQ ID NO: 647476 - protein, 9 aa, Homo Sapiens
QKTHYPDLY

SEQ ID NO: 647477 - protein, 9 aa, Homo Sapiens
VYAVANALH

SEQ ID NO: 647478 - protein, 9 aa, Homo Sapiens
KMSAIFVHG

SEQ ID NO: 647479 - protein, 9 aa, Homo Sapiens
TRRAIWVFF

SEQ ID NO: 647480 - protein, 9 aa, Homo Sapiens
AWILGLHSK

SEQ ID NO: 647481 - protein, 9 aa, Homo Sapiens
HRAFAKNPH

SEQ ID NO: 647482 - protein, 9 aa, Homo Sapiens
GVVERMSVI

SEQ ID NO: 647483 - protein, 9 aa, Homo Sapiens
RGVPAMSPN

SEQ ID NO: 647484 - protein, 9 aa, Homo Sapiens
GWDLCNSVM

SEQ ID NO: 647485 - protein, 9 aa, Homo Sapiens
CNSVMIKDY

SEQ ID NO: 647486 - protein, 9 aa, Homo Sapiens
VSPCLPGWS

SEQ ID NO: 647487 - protein, 9 aa, Homo Sapiens
FYALDSSFP

SEQ ID NO: 647488 - protein, 9 aa, Homo Sapiens
EGSLFEVQW

SEQ ID NO: 647489 - protein, 9 aa, Homo Sapiens
QMFAKEAAH

SEQ ID NO: 647490 - protein, 9 aa, Homo Sapiens
QYLSIAHCG

SEQ ID NO: 647491 - protein, 9 aa, Homo Sapiens
TPRTDPLSQ

SEQ ID NO: 647492 - protein, 9 aa, Homo Sapiens
DYVPGDAPG

SEQ ID NO: 647493 - protein, 9 aa, Homo Sapiens
TRAVNVLSV

SEQ ID NO: 647494 - protein, 9 aa, Homo Sapiens
VENVDLIDK

SEQ ID NO: 647495 - protein, 9 aa, Homo Sapiens
YECKDYGKA

SEQ ID NO: 647496 - protein, 9 aa, Homo Sapiens
SRKLSVKDF

SEQ ID NO: 647497 - protein, 9 aa, Homo Sapiens
TVLDEANND

SEQ ID NO: 647498 - protein, 9 aa, Homo Sapiens
RSNDAGLLG

SEQ ID NO: 647499 - protein, 9 aa, Homo Sapiens
DTPWLCQSS

SEQ ID NO: 647500 - protein, 9 aa, Homo Sapiens
LTMFDQNLL

SEQ ID NO: 647501 - protein, 9 aa, Homo Sapiens
FNLDTQDEA

SEQ ID NO: 647502 - protein, 9 aa, Homo Sapiens
SDENGPLMM

SEQ ID NO: 647503 - protein, 9 aa, Homo Sapiens
QVQLHVYEA

SEQ ID NO: 647504 - protein, 9 aa, Homo Sapiens
RLHPCGSYE

SEQ ID NO: 647505 - protein, 9 aa, Homo Sapiens
IIPIGSDYV

SEQ ID NO: 647506 - protein, 9 aa, Homo Sapiens
NQPTLKPVP

SEQ ID NO: 647507 - protein, 9 aa, Homo Sapiens
VFRKNGFDF

SEQ ID NO: 647508 - protein, 9 aa, Homo Sapiens
CKDYGKAFS

SEQ ID NO: 647509 - protein, 9 aa, Homo Sapiens
AVLSVHGAG

SEQ ID NO: 647510 - protein, 9 aa, Homo Sapiens
QVHGVMDPA

SEQ ID NO: 647511 - protein, 9 aa, Homo Sapiens
PAEVLKGLG

SEQ ID NO: 647512 - protein, 9 aa, Homo Sapiens
GVLRNLAGS

SEQ ID NO: 647513 - protein, 9 aa, Homo Sapiens
LEERHERGE

SEQ ID NO: 647514 - protein, 9 aa, Homo Sapiens
AWPGLGSQG

SEQ ID NO: 647515 - protein, 9 aa, Homo Sapiens
GDIPYKCEE

SEQ ID NO: 647516 - protein, 9 aa, Homo Sapiens
SSKFRMSIV

SEQ ID NO: 647517 - protein, 9 aa, Homo Sapiens
ISMEELDEI

SEQ ID NO: 647518 - protein, 9 aa, Homo Sapiens
EACGSQESG

SEQ ID NO: 647519 - protein, 9 aa, Homo Sapiens
RNHTGDIPY

SEQ ID NO: 647520 - protein, 9 aa, Homo Sapiens
RAKRNTVLD

SEQ ID NO: 647521 - protein, 9 aa, Homo Sapiens
LEAKSETSQ

SEQ ID NO: 647522 - protein, 9 aa, Homo Sapiens
NKQPNSILT

SEQ ID NO: 647523 - protein, 9 aa, Homo Sapiens
FFKKEPLSD

SEQ ID NO: 647524 - protein, 9 aa, Homo Sapiens
LRSIQHRAF

SEQ ID NO: 647525 - protein, 9 aa, Homo Sapiens
GKWFKKERE

SEQ ID NO: 647526 - protein, 9 aa, Homo Sapiens
LVWRYLLNV

SEQ ID NO: 647527 - protein, 9 aa, Homo Sapiens
PSPATRWAA

SEQ ID NO: 647528 - protein, 9 aa, Homo Sapiens
PSSPSAGLP

SEQ ID NO: 647529 - protein, 9 aa, Homo Sapiens
SGLRSIQHR

SEQ ID NO: 647530 - protein, 9 aa, Homo Sapiens
LLGIMNVDV

SEQ ID NO: 647531 - protein, 9 aa, Homo Sapiens
RATELALKL

SEQ ID NO: 647532 - protein, 9 aa, Homo Sapiens
PCGSYETET

SEQ ID NO: 647533 - protein, 9 aa, Homo Sapiens
KFYMSYHLF

SEQ ID NO: 647534 - protein, 9 aa, Homo Sapiens
SGWDWSQGK

SEQ ID NO: 647535 - protein, 9 aa, Homo Sapiens
GKGSFFQPT

SEQ ID NO: 647536 - protein, 9 aa, Homo Sapiens
AAQVHGVMD

SEQ ID NO: 647537 - protein, 9 aa, Homo Sapiens
ELALLRRFH

SEQ ID NO: 647538 - protein, 9 aa, Homo Sapiens
EKVTFDPEL

SEQ ID NO: 647539 - protein, 9 aa, Homo Sapiens
NQPRVDFSS

SEQ ID NO: 647540 - protein, 9 aa, Homo Sapiens
CRGSGPQVN

SEQ ID NO: 647541 - protein, 9 aa, Homo Sapiens
ITPGALKGL

SEQ ID NO: 647542 - protein, 9 aa, Homo Sapiens
VHVAFKVPP

SEQ ID NO: 647543 - protein, 9 aa, Homo Sapiens
PDVGREAVR

SEQ ID NO: 647544 - protein, 9 aa, Homo Sapiens
FTPQFSFSP

SEQ ID NO: 647545 - protein, 9 aa, Homo Sapiens
LTLAPFVDS

SEQ ID NO: 647546 - protein, 9 aa, Homo Sapiens
NLEVFRKNG

SEQ ID NO: 647547 - protein, 9 aa, Homo Sapiens
SKGAGLESE

SEQ ID NO: 647548 - protein, 9 aa, Homo Sapiens
PAAHEISSL

SEQ ID NO: 647549 - protein, 9 aa, Homo Sapiens
RGRARLIAS

SEQ ID NO: 647550 - protein, 9 aa, Homo Sapiens
VLCERMSQQ

SEQ ID NO: 647551 - protein, 9 aa, Homo Sapiens
EEDWLHLVT

SEQ ID NO: 647552 - protein, 9 aa, Homo Sapiens
TKMDSRVQV

SEQ ID NO: 647553 - protein, 9 aa, Homo Sapiens
AAKALLNMD

SEQ ID NO: 647554 - protein, 9 aa, Homo Sapiens
VCPVRVLGD

SEQ ID NO: 647555 - protein, 9 aa, Homo Sapiens
RSGWDWSQG

SEQ ID NO: 647556 - protein, 9 aa, Homo Sapiens
HCFSPCCQP

SEQ ID NO: 647557 - protein, 9 aa, Homo Sapiens
SPGDTPAPS

SEQ ID NO: 647558 - protein, 9 aa, Homo Sapiens
QHCYTCGIL

SEQ ID NO: 647559 - protein, 9 aa, Homo Sapiens
LCQSSEPGD

SEQ ID NO: 647560 - protein, 9 aa, Homo Sapiens
HLDGIWDVS

SEQ ID NO: 647561 - protein, 9 aa, Homo Sapiens
EVIEAIAES

SEQ ID NO: 647562 - protein, 9 aa, Homo Sapiens
EARGRSRTW

SEQ ID NO: 647563 - protein, 9 aa, Homo Sapiens
CERMSQQIF

SEQ ID NO: 647564 - protein, 9 aa, Homo Sapiens
SSEEDWLHL

SEQ ID NO: 647565 - protein, 9 aa, Homo Sapiens
IMSELEERA

SEQ ID NO: 647566 - protein, 9 aa, Homo Sapiens
AEVLKGLGG

SEQ ID NO: 647567 - protein, 9 aa, Homo Sapiens
LAGPVGASQ

SEQ ID NO: 647568 - protein, 9 aa, Homo Sapiens
GIFGLILAF

SEQ ID NO: 647569 - protein, 9 aa, Homo Sapiens
VAAPPAARS

SEQ ID NO: 647570 - protein, 9 aa, Homo Sapiens
EYTVHLWAQ

SEQ ID NO: 647571 - protein, 9 aa, Homo Sapiens
PQAPLLEGG

SEQ ID NO: 647572 - protein, 9 aa, Homo Sapiens
TVRDEPPSV

SEQ ID NO: 647573 - protein, 9 aa, Homo Sapiens
PGDAPGQPY

SEQ ID NO: 647574 - protein, 9 aa, Homo Sapiens
QLHTGIKEV

SEQ ID NO: 647575 - protein, 9 aa, Homo Sapiens
HVYEAWRLG

SEQ ID NO: 647576 - protein, 9 aa, Homo Sapiens
SWESGAWPG

SEQ ID NO: 647577 - protein, 9 aa, Homo Sapiens
LESRLQYLS

SEQ ID NO: 647578 - protein, 9 aa, Homo Sapiens
RTRSTVSVL

SEQ ID NO: 647579 - protein, 9 aa, Homo Sapiens
HGSGGGRGP

SEQ ID NO: 647580 - protein, 9 aa, Homo Sapiens
LRLLRVLRP

SEQ ID NO: 647581 - protein, 9 aa, Homo Sapiens
VSSEEDWLH

SEQ ID NO: 647582 - protein, 9 aa, Homo Sapiens
VSPNLFRVI

SEQ ID NO: 647583 - protein, 9 aa, Homo Sapiens
VGVGKSALT

SEQ ID NO: 647584 - protein, 9 aa, Homo Sapiens
GGAQDPTNL

SEQ ID NO: 647585 - protein, 9 aa, Homo Sapiens
SGTKMDSRV

SEQ ID NO: 647586 - protein, 9 aa, Homo Sapiens
SCPPYLTST

SEQ ID NO: 647587 - protein, 9 aa, Homo Sapiens
GDLVENVDL

SEQ ID NO: 647588 - protein, 9 aa, Homo Sapiens
PSLRKLVWR

SEQ ID NO: 647589 - protein, 9 aa, Homo Sapiens
AQHEAEAGG

SEQ ID NO: 647590 - protein, 9 aa, Homo Sapiens
FGLILAFFM

SEQ ID NO: 647591 - protein, 9 aa, Homo Sapiens
PCPGSPALW

SEQ ID NO: 647592 - protein, 9 aa, Homo Sapiens
AQALPGSST

SEQ ID NO: 647593 - protein, 9 aa, Homo Sapiens
IVSSEEDWL

SEQ ID NO: 647594 - protein, 9 aa, Homo Sapiens
SVSSAAAVA

SEQ ID NO: 647595 - protein, 9 aa, Homo Sapiens
VRIVGRTGS

SEQ ID NO: 647596 - protein, 9 aa, Homo Sapiens
AILGIMLRR

SEQ ID NO: 647597 - protein, 9 aa, Homo Sapiens
LQYLSIAHC

SEQ ID NO: 647598 - protein, 9 aa, Homo Sapiens
SAIFVHGVS

SEQ ID NO: 647599 - protein, 9 aa, Homo Sapiens
QEALGHKPR

SEQ ID NO: 647600 - protein, 9 aa, Homo Sapiens
AACHEATQW

SEQ ID NO: 647601 - protein, 9 aa, Homo Sapiens
QNIALLPNN

SEQ ID NO: 647602 - protein, 9 aa, Homo Sapiens
ICNTNKFYM

SEQ ID NO: 647603 - protein, 9 aa, Homo Sapiens
DLPQENREA

SEQ ID NO: 647604 - protein, 9 aa, Homo Sapiens
KQSTKDLSR

SEQ ID NO: 647605 - protein, 9 aa, Homo Sapiens
ANILLVRGS

SEQ ID NO: 647606 - protein, 9 aa, Homo Sapiens
FAKEAAHKD

SEQ ID NO: 647607 - protein, 9 aa, Homo Sapiens
RVGVGVAVL

SEQ ID NO: 647608 - protein, 9 aa, Homo Sapiens
LSVHGAGNL

SEQ ID NO: 647609 - protein, 9 aa, Homo Sapiens
AANDFFGRL

SEQ ID NO: 647610 - protein, 9 aa, Homo Sapiens
NRSDINDTW

SEQ ID NO: 647611 - protein, 9 aa, Homo Sapiens
RRRLWYATH

SEQ ID NO: 647612 - protein, 9 aa, Homo Sapiens
RDPDVGREA

SEQ ID NO: 647613 - protein, 9 aa, Homo Sapiens
SMSIPEHVL

SEQ ID NO: 647614 - protein, 9 aa, Homo Sapiens
QFNLDTQDE

SEQ ID NO: 647615 - protein, 9 aa, Homo Sapiens
GGGAGHTVR

SEQ ID NO: 647616 - protein, 9 aa, Homo Sapiens
VLRNLAGSL

SEQ ID NO: 647617 - protein, 9 aa, Homo Sapiens
TEHSGLAAT

SEQ ID NO: 647618 - protein, 9 aa, Homo Sapiens
TCKSNWRSG

SEQ ID NO: 647619 - protein, 9 aa, Homo Sapiens
GDQVQLHVY

SEQ ID NO: 647620 - protein, 9 aa, Homo Sapiens
TALSLLYRS

SEQ ID NO: 647621 - protein, 9 aa, Homo Sapiens
GLRSIQHRA

SEQ ID NO: 647622 - protein, 9 aa, Homo Sapiens
QSSEPGDEE

SEQ ID NO: 647623 - protein, 9 aa, Homo Sapiens
VLQLKQNIA

SEQ ID NO: 647624 - protein, 9 aa, Homo Sapiens
LVQLHTGIK

SEQ ID NO: 647625 - protein, 9 aa, Homo Sapiens
QHMGDCLCH

SEQ ID NO: 647626 - protein, 9 aa, Homo Sapiens
ITLPSEDCT

SEQ ID NO: 647627 - protein, 9 aa, Homo Sapiens
RENKKLQEE

SEQ ID NO: 647628 - protein, 9 aa, Homo Sapiens
AVIARQRLA

SEQ ID NO: 647629 - protein, 9 aa, Homo Sapiens
TQWVTHLQA

SEQ ID NO: 647630 - protein, 9 aa, Homo Sapiens
RQRPEPQLK

SEQ ID NO: 647631 - protein, 9 aa, Homo Sapiens
GRRRRLWYA

SEQ ID NO: 647632 - protein, 9 aa, Homo Sapiens
SFFQPTAKP

SEQ ID NO: 647633 - protein, 9 aa, Homo Sapiens
VSGQSVLLF

SEQ ID NO: 647634 - protein, 9 aa, Homo Sapiens
TKITLHLKD

SEQ ID NO: 647635 - protein, 9 aa, Homo Sapiens
LDDPTSGVD

SEQ ID NO: 647636 - protein, 9 aa, Homo Sapiens
SSAWWGLGL

SEQ ID NO: 647637 - protein, 9 aa, Homo Sapiens
GCAVAVLSV

SEQ ID NO: 647638 - protein, 9 aa, Homo Sapiens
RMSQQIFTN

SEQ ID NO: 647639 - protein, 9 aa, Homo Sapiens
FKRENKKLQ

SEQ ID NO: 647640 - protein, 9 aa, Homo Sapiens
SAVYAVANA

SEQ ID NO: 647641 - protein, 9 aa, Homo Sapiens
PFKEEDESD

SEQ ID NO: 647642 - protein, 9 aa, Homo Sapiens
CVKVFNQLS

SEQ ID NO: 647643 - protein, 9 aa, Homo Sapiens
PGASTHDSL

SEQ ID NO: 647644 - protein, 9 aa, Homo Sapiens
ALGHKPRVN

SEQ ID NO: 647645 - protein, 9 aa, Homo Sapiens
TSQENYWLI

SEQ ID NO: 647646 - protein, 9 aa, Homo Sapiens
ALDSSFPRM

SEQ ID NO: 647647 - protein, 9 aa, Homo Sapiens
YTCKSNWRS

SEQ ID NO: 647648 - protein, 9 aa, Homo Sapiens
AINVAILGI

SEQ ID NO: 647649 - protein, 9 aa, Homo Sapiens
NLFRVIRLA

SEQ ID NO: 647650 - protein, 9 aa, Homo Sapiens
SNNKQPNSI

SEQ ID NO: 647651 - protein, 9 aa, Homo Sapiens
LRGQGMVLL

SEQ ID NO: 647652 - protein, 9 aa, Homo Sapiens
EGEHSSRRI

SEQ ID NO: 647653 - protein, 9 aa, Homo Sapiens
ALKGLPRLA

SEQ ID NO: 647654 - protein, 9 aa, Homo Sapiens
GPQVNGAFS

SEQ ID NO: 647655 - protein, 9 aa, Homo Sapiens
FFGRLLMED

SEQ ID NO: 647656 - protein, 9 aa, Homo Sapiens
GLGQRRPPA

SEQ ID NO: 647657 - protein, 9 aa, Homo Sapiens
SGEKQPLAD

SEQ ID NO: 647658 - protein, 9 aa, Homo Sapiens
FSVADTVSS

SEQ ID NO: 647659 - protein, 9 aa, Homo Sapiens
PQENREAAY

SEQ ID NO: 647660 - protein, 9 aa, Homo Sapiens
GVEPSLRKL

SEQ ID NO: 647661 - protein, 9 aa, Homo Sapiens
DTKITLHLK

SEQ ID NO: 647662 - protein, 9 aa, Homo Sapiens
RLATPLAKK

SEQ ID NO: 647663 - protein, 9 aa, Homo Sapiens
WKPVTVMFD

SEQ ID NO: 647664 - protein, 9 aa, Homo Sapiens
ETSMLRRPV

SEQ ID NO: 647665 - protein, 9 aa, Homo Sapiens
LLVGPSSRQ

SEQ ID NO: 647666 - protein, 9 aa, Homo Sapiens
SCGSGTKMD

SEQ ID NO: 647667 - protein, 9 aa, Homo Sapiens
SGPQVNGAF

SEQ ID NO: 647668 - protein, 9 aa, Homo Sapiens
YALDSSFPR

SEQ ID NO: 647669 - protein, 9 aa, Homo Sapiens
SFVNLVECD

SEQ ID NO: 647670 - protein, 9 aa, Homo Sapiens
VRDEPPSVP

SEQ ID NO: 647671 - protein, 9 aa, Homo Sapiens
LDRNYEKGL

SEQ ID NO: 647672 - protein, 9 aa, Homo Sapiens
GPGRGLPGA

SEQ ID NO: 647673 - protein, 9 aa, Homo Sapiens
LRPIMSELE

SEQ ID NO: 647674 - protein, 9 aa, Homo Sapiens
GRGNLNATS

SEQ ID NO: 647675 - protein, 9 aa, Homo Sapiens
LGLGQRRPP

SEQ ID NO: 647676 - protein, 9 aa, Homo Sapiens
GRVCVDTHL

SEQ ID NO: 647677 - protein, 9 aa, Homo Sapiens
SFAHACTLL

SEQ ID NO: 647678 - protein, 9 aa, Homo Sapiens
VAVLSVHGA

SEQ ID NO: 647679 - protein, 9 aa, Homo Sapiens
RSHGNGEGR

SEQ ID NO: 647680 - protein, 9 aa, Homo Sapiens
VSGVALAGP

SEQ ID NO: 647681 - protein, 9 aa, Homo Sapiens
EEFFKKEPL

SEQ ID NO: 647682 - protein, 9 aa, Homo Sapiens
NKFYKDNIN

SEQ ID NO: 647683 - protein, 9 aa, Homo Sapiens
TCISRDTDK

SEQ ID NO: 647684 - protein, 9 aa, Homo Sapiens
SAINVAILG

SEQ ID NO: 647685 - protein, 9 aa, Homo Sapiens
LYRDVMLQN

SEQ ID NO: 647686 - protein, 9 aa, Homo Sapiens
IETIEAAKA

SEQ ID NO: 647687 - protein, 9 aa, Homo Sapiens
GGGGPGHGS

SEQ ID NO: 647688 - protein, 9 aa, Homo Sapiens
LVVVGAVGV

SEQ ID NO: 647689 - protein, 9 aa, Homo Sapiens
GNHVSNCWI

SEQ ID NO: 647690 - protein, 9 aa, Homo Sapiens
APLLGIMNV

SEQ ID NO: 647691 - protein, 9 aa, Homo Sapiens
WLCQSSEPG

SEQ ID NO: 647692 - protein, 9 aa, Homo Sapiens
PQRAESPAG

SEQ ID NO: 647693 - protein, 9 aa, Homo Sapiens
LAKKPASRQ

SEQ ID NO: 647694 - protein, 9 aa, Homo Sapiens
LKHLSQCSS

SEQ ID NO: 647695 - protein, 9 aa, Homo Sapiens
KEYIGHLDG

SEQ ID NO: 647696 - protein, 9 aa, Homo Sapiens
GSDCSDAEY

SEQ ID NO: 647697 - protein, 9 aa, Homo Sapiens
ESGAWPGLG

SEQ ID NO: 647698 - protein, 9 aa, Homo Sapiens
TLSESAEEA

SEQ ID NO: 647699 - protein, 9 aa, Homo Sapiens
RWAAWTVSG

SEQ ID NO: 647700 - protein, 9 aa, Homo Sapiens
ESAFKTSPF

SEQ ID NO: 647701 - protein, 9 aa, Homo Sapiens
AGGANSGCG

SEQ ID NO: 647702 - protein, 9 aa, Homo Sapiens
HLWAQKGAQ

SEQ ID NO: 647703 - protein, 9 aa, Homo Sapiens
CPKPAAHEI

SEQ ID NO: 647704 - protein, 9 aa, Homo Sapiens
LAEYSDENG

SEQ ID NO: 647705 - protein, 9 aa, Homo Sapiens
NHLESHNLI

SEQ ID NO: 647706 - protein, 9 aa, Homo Sapiens
LVECDKEFS

SEQ ID NO: 647707 - protein, 9 aa, Homo Sapiens
NECVKVFNQ

SEQ ID NO: 647708 - protein, 9 aa, Homo Sapiens
GETITEEQS

SEQ ID NO: 647709 - protein, 9 aa, Homo Sapiens
SNFGNAYIF

SEQ ID NO: 647710 - protein, 9 aa, Homo Sapiens
ENVDLIDKF

SEQ ID NO: 647711 - protein, 9 aa, Homo Sapiens
NKLRGVLRN

SEQ ID NO: 647712 - protein, 9 aa, Homo Sapiens
SHSEEFFKK

SEQ ID NO: 647713 - protein, 9 aa, Homo Sapiens
EYIGHLDGI

SEQ ID NO: 647714 - protein, 9 aa, Homo Sapiens
DYSLFQKDK

SEQ ID NO: 647715 - protein, 9 aa, Homo Sapiens
TFDPELEEA

SEQ ID NO: 647716 - protein, 9 aa, Homo Sapiens
KSRKEHRKH

SEQ ID NO: 647717 - protein, 9 aa, Homo Sapiens
LPSPGDTPA

SEQ ID NO: 647718 - protein, 9 aa, Homo Sapiens
RFHHRARCL

SEQ ID NO: 647719 - protein, 9 aa, Homo Sapiens
GDYSLFQKD

SEQ ID NO: 647720 - protein, 9 aa, Homo Sapiens
NHELYMNVT

SEQ ID NO: 647721 - protein, 9 aa, Homo Sapiens
AMPRISSPM

SEQ ID NO: 647722 - protein, 9 aa, Homo Sapiens
RAPSGLGLP

SEQ ID NO: 647723 - protein, 9 aa, Homo Sapiens
TVWEMMTFG

SEQ ID NO: 647724 - protein, 9 aa, Homo Sapiens
ADGQDGGGG

SEQ ID NO: 647725 - protein, 9 aa, Homo Sapiens
RKLVWRYLL

SEQ ID NO: 647726 - protein, 9 aa, Homo Sapiens
AVAMPRISS

SEQ ID NO: 647727 - protein, 9 aa, Homo Sapiens
ERYAKRENW

SEQ ID NO: 647728 - protein, 9 aa, Homo Sapiens
HELYMNVTE

SEQ ID NO: 647729 - protein, 9 aa, Homo Sapiens
GSGGGRGPG

SEQ ID NO: 647730 - protein, 9 aa, Homo Sapiens
IPEGTNGVV

SEQ ID NO: 647731 - protein, 9 aa, Homo Sapiens
RTAAPEDPL

SEQ ID NO: 647732 - protein, 9 aa, Homo Sapiens
RSITSFSVA

SEQ ID NO: 647733 - protein, 9 aa, Homo Sapiens
PGAEKAKPS

SEQ ID NO: 647734 - protein, 9 aa, Homo Sapiens
NDFFGRLLM

SEQ ID NO: 647735 - protein, 9 aa, Homo Sapiens
SASMSIPEH

SEQ ID NO: 647736 - protein, 9 aa, Homo Sapiens
INDTWFFMN

SEQ ID NO: 647737 - protein, 9 aa, Homo Sapiens
QETPAHADV

SEQ ID NO: 647738 - protein, 9 aa, Homo Sapiens
HTGDIPYKC

SEQ ID NO: 647739 - protein, 9 aa, Homo Sapiens
AMPHAPSPA

SEQ ID NO: 647740 - protein, 9 aa, Homo Sapiens
AGPVGASQR

SEQ ID NO: 647741 - protein, 9 aa, Homo Sapiens
LYLRKSLSN

SEQ ID NO: 647742 - protein, 9 aa, Homo Sapiens
CVDDTILSR

SEQ ID NO: 647743 - protein, 9 aa, Homo Sapiens
SGELVSSLS

SEQ ID NO: 647744 - protein, 9 aa, Homo Sapiens
EDPEENVAV

SEQ ID NO: 647745 - protein, 9 aa, Homo Sapiens
AGGGGPGHG

SEQ ID NO: 647746 - protein, 9 aa, Homo Sapiens
GGGPGSAVA

SEQ ID NO: 647747 - protein, 9 aa, Homo Sapiens
RCVPEKPSK

SEQ ID NO: 647748 - protein, 9 aa, Homo Sapiens
NISMEELDE

SEQ ID NO: 647749 - protein, 9 aa, Homo Sapiens
DAMYRLWCT

SEQ ID NO: 647750 - protein, 9 aa, Homo Sapiens
RSDINDTWF

SEQ ID NO: 647751 - protein, 9 aa, Homo Sapiens
ELLERESTA

SEQ ID NO: 647752 - protein, 9 aa, Homo Sapiens
ETITEEQSQ

SEQ ID NO: 647753 - protein, 9 aa, Homo Sapiens
LRRFHHRAR

SEQ ID NO: 647754 - protein, 9 aa, Homo Sapiens
EYGVLMAMA

SEQ ID NO: 647755 - protein, 9 aa, Homo Sapiens
SFTFQPGMG

SEQ ID NO: 647756 - protein, 9 aa, Homo Sapiens
CTGYIKDSV

SEQ ID NO: 647757 - protein, 9 aa, Homo Sapiens
QPTLKPVPP

SEQ ID NO: 647758 - protein, 9 aa, Homo Sapiens
PIPPSRVIE

SEQ ID NO: 647759 - protein, 9 aa, Homo Sapiens
ACTLLTMFD

SEQ ID NO: 647760 - protein, 9 aa, Homo Sapiens
KTMLSYSEL

SEQ ID NO: 647761 - protein, 9 aa, Homo Sapiens
GLCLCIDFQ

SEQ ID NO: 647762 - protein, 9 aa, Homo Sapiens
PPGTVITMP

SEQ ID NO: 647763 - protein, 9 aa, Homo Sapiens
DTPAPSSAW

SEQ ID NO: 647764 - protein, 9 aa, Homo Sapiens
DGQDGGGGG

SEQ ID NO: 647765 - protein, 9 aa, Homo Sapiens
QRAESPAGR

SEQ ID NO: 647766 - protein, 9 aa, Homo Sapiens
AAHEISSLA

SEQ ID NO: 647767 - protein, 9 aa, Homo Sapiens
RRAIWVFFM

SEQ ID NO: 647768 - protein, 9 aa, Homo Sapiens
QIAAVAMPR

SEQ ID NO: 647769 - protein, 9 aa, Homo Sapiens
MPNQFNLDT

SEQ ID NO: 647770 - protein, 9 aa, Homo Sapiens
VRQRPEPQL

SEQ ID NO: 647771 - protein, 9 aa, Homo Sapiens
SLSPSMSPA

SEQ ID NO: 647772 - protein, 9 aa, Homo Sapiens
GETSMLRRP

SEQ ID NO: 647773 - protein, 9 aa, Homo Sapiens
QAHRSQPQR

SEQ ID NO: 647774 - protein, 9 aa, Homo Sapiens
ANISMEELD

SEQ ID NO: 647775 - protein, 9 aa, Homo Sapiens
TRKEEKVTF

SEQ ID NO: 647776 - protein, 9 aa, Homo Sapiens
ITVTSGDYS

SEQ ID NO: 647777 - protein, 9 aa, Homo Sapiens
RQEALGHKP

SEQ ID NO: 647778 - protein, 9 aa, Homo Sapiens
KSGTSRKLS

SEQ ID NO: 647779 - protein, 9 aa, Homo Sapiens
VTVACKADG

SEQ ID NO: 647780 - protein, 9 aa, Homo Sapiens
CQHMGDCLC

SEQ ID NO: 647781 - protein, 9 aa, Homo Sapiens
WFFMNLEED

SEQ ID NO: 647782 - protein, 9 aa, Homo Sapiens
PSPRISCRK

SEQ ID NO: 647783 - protein, 9 aa, Homo Sapiens
ASFTFQPGM

SEQ ID NO: 647784 - protein, 9 aa, Homo Sapiens
LKGLPRLAE

SEQ ID NO: 647785 - protein, 9 aa, Homo Sapiens
LPLLGGCVD

SEQ ID NO: 647786 - protein, 9 aa, Homo Sapiens
IKEVLDDNA

SEQ ID NO: 647787 - protein, 9 aa, Homo Sapiens
LLELLCCTN

SEQ ID NO: 647788 - protein, 9 aa, Homo Sapiens
TEHEILNIF

SEQ ID NO: 647789 - protein, 9 aa, Homo Sapiens
RTFQAGSQP

SEQ ID NO: 647790 - protein, 9 aa, Homo Sapiens
IVVDEFSTL

SEQ ID NO: 647791 - protein, 9 aa, Homo Sapiens
HTLQPHQHI

SEQ ID NO: 647792 - protein, 9 aa, Homo Sapiens
CRQQETPAH

SEQ ID NO: 647793 - protein, 9 aa, Homo Sapiens
RFSRGSSRS

SEQ ID NO: 647794 - protein, 9 aa, Homo Sapiens
LAKKLEPVS

SEQ ID NO: 647795 - protein, 9 aa, Homo Sapiens
AFSSVEYGV

SEQ ID NO: 647796 - protein, 9 aa, Homo Sapiens
MRQEALGHK

SEQ ID NO: 647797 - protein, 9 aa, Homo Sapiens
FEVQWQLAQ

SEQ ID NO: 647798 - protein, 9 aa, Homo Sapiens
AFFFKTAVV

SEQ ID NO: 647799 - protein, 9 aa, Homo Sapiens
GKIVVDEFS

SEQ ID NO: 647800 - protein, 9 aa, Homo Sapiens
NNVSVSGQS

SEQ ID NO: 647801 - protein, 9 aa, Homo Sapiens
TEDDTKITL

SEQ ID NO: 647802 - protein, 9 aa, Homo Sapiens
RKLSVKDFE

SEQ ID NO: 647803 - protein, 9 aa, Homo Sapiens
VMLQNYQNL

SEQ ID NO: 647804 - protein, 9 aa, Homo Sapiens
ARGRSRTWE

SEQ ID NO: 647805 - protein, 9 aa, Homo Sapiens
VPPHAPPYW

SEQ ID NO: 647806 - protein, 9 aa, Homo Sapiens
GIVGSMISN

SEQ ID NO: 647807 - protein, 9 aa, Homo Sapiens
GSPTCCRCE

SEQ ID NO: 647808 - protein, 9 aa, Homo Sapiens
YINENTFKE

SEQ ID NO: 647809 - protein, 9 aa, Homo Sapiens
FRMSIVDSV

SEQ ID NO: 647810 - protein, 9 aa, Homo Sapiens
PASRQKELL

SEQ ID NO: 647811 - protein, 9 aa, Homo Sapiens
YLDSGIHFG

SEQ ID NO: 647812 - protein, 9 aa, Homo Sapiens
RSAMPHAPS

SEQ ID NO: 647813 - protein, 9 aa, Homo Sapiens
AQTILFSYF

SEQ ID NO: 647814 - protein, 9 aa, Homo Sapiens
SLPSSPSAG

SEQ ID NO: 647815 - protein, 9 aa, Homo Sapiens
MLRRPVLLH

SEQ ID NO: 647816 - protein, 9 aa, Homo Sapiens
SYLDSGIHF

SEQ ID NO: 647817 - protein, 9 aa, Homo Sapiens
ETIEAAKAL

SEQ ID NO: 647818 - protein, 9 aa, Homo Sapiens
SIQHRAFAK

SEQ ID NO: 647819 - protein, 9 aa, Homo Sapiens
SESAEEACG

SEQ ID NO: 647820 - protein, 9 aa, Homo Sapiens
GGTCLFSAS

SEQ ID NO: 647821 - protein, 9 aa, Homo Sapiens
SSEPGDEES

SEQ ID NO: 647822 - protein, 9 aa, Homo Sapiens
LRQMFAKEA

SEQ ID NO: 647823 - protein, 9 aa, Homo Sapiens
KNQPTLKPV

SEQ ID NO: 647824 - protein, 9 aa, Homo Sapiens
DAGLLGNVV

SEQ ID NO: 647825 - protein, 9 aa, Homo Sapiens
TNKFYMSYH

SEQ ID NO: 647826 - protein, 9 aa, Homo Sapiens
WVFFMLRSL

SEQ ID NO: 647827 - protein, 9 aa, Homo Sapiens
PYECKDYGK

SEQ ID NO: 647828 - protein, 9 aa, Homo Sapiens
VSEQEQASC

SEQ ID NO: 647829 - protein, 9 aa, Homo Sapiens
EEGVGETIT

SEQ ID NO: 647830 - protein, 9 aa, Homo Sapiens
LNATSKAGT

SEQ ID NO: 647831 - protein, 9 aa, Homo Sapiens
VVLSAVSAF

SEQ ID NO: 647832 - protein, 9 aa, Homo Sapiens
QLHVYEAWR

SEQ ID NO: 647833 - protein, 9 aa, Homo Sapiens
EPHFLDRNY

SEQ ID NO: 647834 - protein, 9 aa, Homo Sapiens
PGRGLPGAA

SEQ ID NO: 647835 - protein, 9 aa, Homo Sapiens
LDSGIHFGA

SEQ ID NO: 647836 - protein, 9 aa, Homo Sapiens
TVITMPFQF

SEQ ID NO: 647837 - protein, 9 aa, Homo Sapiens
PGWDLCNSV

SEQ ID NO: 647838 - protein, 9 aa, Homo Sapiens
AGRFLRRSP

SEQ ID NO: 647839 - protein, 9 aa, Homo Sapiens
TYFYSSNNK

SEQ ID NO: 647840 - protein, 9 aa, Homo Sapiens
VYYCTWPAE

SEQ ID NO: 647841 - protein, 9 aa, Homo Sapiens
TLAPFVDSS

SEQ ID NO: 647842 - protein, 9 aa, Homo Sapiens
SIPEHVLTG

SEQ ID NO: 647843 - protein, 9 aa, Homo Sapiens
EYSDENGPL

SEQ ID NO: 647844 - protein, 9 aa, Homo Sapiens
WNLRSNDAG

SEQ ID NO: 647845 - protein, 9 aa, Homo Sapiens
PRVDFSSIA

SEQ ID NO: 647846 - protein, 9 aa, Homo Sapiens
RENWKPVTV

SEQ ID NO: 647847 - protein, 9 aa, Homo Sapiens
KPSKAITSS

SEQ ID NO: 647848 - protein, 9 aa, Homo Sapiens
TAAPEDPLP

SEQ ID NO: 647849 - protein, 9 aa, Homo Sapiens
RGSGPQVNG

SEQ ID NO: 647850 - protein, 9 aa, Homo Sapiens
ETFKRENKK

SEQ ID NO: 647851 - protein, 9 aa, Homo Sapiens
PQLASKHSM

SEQ ID NO: 647852 - protein, 9 aa, Homo Sapiens
TLVGSRLLD

SEQ ID NO: 647853 - protein, 9 aa, Homo Sapiens
KHLSQCSSI

SEQ ID NO: 647854 - protein, 9 aa, Homo Sapiens
YGVTVWEMM

SEQ ID NO: 647855 - protein, 9 aa, Homo Sapiens
LHVYEAWRL

SEQ ID NO: 647856 - protein, 9 aa, Homo Sapiens
RSTVSVLRG

SEQ ID NO: 647857 - protein, 9 aa, Homo Sapiens
VEFYINENT

SEQ ID NO: 647858 - protein, 9 aa, Homo Sapiens
SMVLTGTAF

SEQ ID NO: 647859 - protein, 9 aa, Homo Sapiens
LLTMFDQNL

SEQ ID NO: 647860 - protein, 9 aa, Homo Sapiens
PGTVITMPF

SEQ ID NO: 647861 - protein, 9 aa, Homo Sapiens
AMYRLWCTG

SEQ ID NO: 647862 - protein, 9 aa, Homo Sapiens
GASTHDSLS

SEQ ID NO: 647863 - protein, 9 aa, Homo Sapiens
IVDSVAVLE

SEQ ID NO: 647864 - protein, 9 aa, Homo Sapiens
ELEAKSETS

SEQ ID NO: 647865 - protein, 9 aa, Homo Sapiens
ERHERGEKH

SEQ ID NO: 647866 - protein, 9 aa, Homo Sapiens
PVRQRPEPQ

SEQ ID NO: 647867 - protein, 9 aa, Homo Sapiens
LCIDFQFDT

SEQ ID NO: 647868 - protein, 9 aa, Homo Sapiens
PFVDSSAGH

SEQ ID NO: 647869 - protein, 9 aa, Homo Sapiens
HLQTHRCPA

SEQ ID NO: 647870 - protein, 9 aa, Homo Sapiens
DYVTLTWTT

SEQ ID NO: 647871 - protein, 9 aa, Homo Sapiens
GVLLSLNGS

SEQ ID NO: 647872 - protein, 9 aa, Homo Sapiens
FQKTHYPDL

SEQ ID NO: 647873 - protein, 9 aa, Homo Sapiens
PTEDDTKIT

SEQ ID NO: 647874 - protein, 9 aa, Homo Sapiens
GQKGDADAP

SEQ ID NO: 647875 - protein, 9 aa, Homo Sapiens
VAFKVPPLI

SEQ ID NO: 647876 - protein, 9 aa, Homo Sapiens
SVCPVRVLG

SEQ ID NO: 647877 - protein, 9 aa, Homo Sapiens
REHLQTHRC

SEQ ID NO: 647878 - protein, 9 aa, Homo Sapiens
PLADPEETS

SEQ ID NO: 647879 - protein, 9 aa, Homo Sapiens
HGNGEGRRP

SEQ ID NO: 647880 - protein, 9 aa, Homo Sapiens
KSNWRSGWD

SEQ ID NO: 647881 - protein, 9 aa, Homo Sapiens
SQENYWLIQ

SEQ ID NO: 647882 - protein, 9 aa, Homo Sapiens
MFAKEAAHK

SEQ ID NO: 647883 - protein, 9 aa, Homo Sapiens
LGDYVPGDA

SEQ ID NO: 647884 - protein, 9 aa, Homo Sapiens
LQPHQHIPV

SEQ ID NO: 647885 - protein, 9 aa, Homo Sapiens
PEDPLPSPG

SEQ ID NO: 647886 - protein, 9 aa, Homo Sapiens
HCYTCGILG

SEQ ID NO: 647887 - protein, 9 aa, Homo Sapiens
GDGKIVVDE

SEQ ID NO: 647888 - protein, 9 aa, Homo Sapiens
HKSRKEHRK

SEQ ID NO: 647889 - protein, 9 aa, Homo Sapiens
LGNASKQAG

SEQ ID NO: 647890 - protein, 9 aa, Homo Sapiens
FKEEDESDS

SEQ ID NO: 647891 - protein, 9 aa, Homo Sapiens
DRVQVEFYI

SEQ ID NO: 647892 - protein, 9 aa, Homo Sapiens
NATGVLLSL

SEQ ID NO: 647893 - protein, 9 aa, Homo Sapiens
SGRKRPVRQ

SEQ ID NO: 647894 - protein, 9 aa, Homo Sapiens
HFGATTTAP

SEQ ID NO: 647895 - protein, 9 aa, Homo Sapiens
ARQRLAGGA

SEQ ID NO: 647896 - protein, 9 aa, Homo Sapiens
YTCGILGHL

SEQ ID NO: 647897 - protein, 9 aa, Homo Sapiens
CIPHACRQQ

SEQ ID NO: 647898 - protein, 9 aa, Homo Sapiens
TPGALKGLP

SEQ ID NO: 647899 - protein, 9 aa, Homo Sapiens
SRGSESHEL

SEQ ID NO: 647900 - protein, 9 aa, Homo Sapiens
LSQPQQNQT

SEQ ID NO: 647901 - protein, 9 aa, Homo Sapiens
IENLEVFRK

SEQ ID NO: 647902 - protein, 9 aa, Homo Sapiens
NPQLASKHS

SEQ ID NO: 647903 - protein, 9 aa, Homo Sapiens
QILKMANPI

SEQ ID NO: 647904 - protein, 9 aa, Homo Sapiens
FATIVGIVG

SEQ ID NO: 647905 - protein, 9 aa, Homo Sapiens
QPVTEHEIL

SEQ ID NO: 647906 - protein, 9 aa, Homo Sapiens
VLQDSQDRC

SEQ ID NO: 647907 - protein, 9 aa, Homo Sapiens
AASVSSAAA

SEQ ID NO: 647908 - protein, 9 aa, Homo Sapiens
TNQPVTEHE

SEQ ID NO: 647909 - protein, 9 aa, Homo Sapiens
SGQTVRIVG

SEQ ID NO: 647910 - protein, 9 aa, Homo Sapiens
ALTPSSLSP

SEQ ID NO: 647911 - protein, 9 aa, Homo Sapiens
GQILKMANP

SEQ ID NO: 647912 - protein, 9 aa, Homo Sapiens
ELALKLLQK

SEQ ID NO: 647913 - protein, 9 aa, Homo Sapiens
ETSQENYWL

SEQ ID NO: 647914 - protein, 9 aa, Homo Sapiens
ACRQQETPA

SEQ ID NO: 647915 - protein, 9 aa, Homo Sapiens
GPEIMDELV

SEQ ID NO: 647916 - protein, 9 aa, Homo Sapiens
VITMPFQFA

SEQ ID NO: 647917 - protein, 9 aa, Homo Sapiens
TRWAAWTVS

SEQ ID NO: 647918 - protein, 9 aa, Homo Sapiens
AGAQHEAEA

SEQ ID NO: 647919 - protein, 9 aa, Homo Sapiens
NQPVTEHEI

SEQ ID NO: 647920 - protein, 9 aa, Homo Sapiens
TTVHRPIPP

SEQ ID NO: 647921 - protein, 9 aa, Homo Sapiens
AERRAYSNF

SEQ ID NO: 647922 - protein, 9 aa, Homo Sapiens
ESGKGSFFQ

SEQ ID NO: 647923 - protein, 9 aa, Homo Sapiens
SDYVTLTWT

SEQ ID NO: 647924 - protein, 9 aa, Homo Sapiens
VTQLTLAPF

SEQ ID NO: 647925 - protein, 9 aa, Homo Sapiens
TFLLRLEHL

SEQ ID NO: 647926 - protein, 9 aa, Homo Sapiens
AARIHNHLL

SEQ ID NO: 647927 - protein, 9 aa, Homo Sapiens
GHTVRDEPP

SEQ ID NO: 647928 - protein, 9 aa, Homo Sapiens
FKVPPLIQP

SEQ ID NO: 647929 - protein, 9 aa, Homo Sapiens
GRKRPVRQR

SEQ ID NO: 647930 - protein, 9 aa, Homo Sapiens
SNWRSGWDW

SEQ ID NO: 647931 - protein, 9 aa, Homo Sapiens
YTVHLWAQK

SEQ ID NO: 647932 - protein, 9 aa, Homo Sapiens
NRANILLVR

SEQ ID NO: 647933 - protein, 9 aa, Homo Sapiens
TTHKAEREV

SEQ ID NO: 647934 - protein, 9 aa, Homo Sapiens
LPSSPSAGL

SEQ ID NO: 647935 - protein, 9 aa, Homo Sapiens
ANKPTKNLR

SEQ ID NO: 647936 - protein, 9 aa, Homo Sapiens
SEGAITVKV

SEQ ID NO: 647937 - protein, 9 aa, Homo Sapiens
CISRDTDKE

SEQ ID NO: 647938 - protein, 9 aa, Homo Sapiens
DCSDAEYEA

SEQ ID NO: 647939 - protein, 9 aa, Homo Sapiens
GTLGNASKQ

SEQ ID NO: 647940 - protein, 9 aa, Homo Sapiens
CLCIDFQFD

SEQ ID NO: 647941 - protein, 9 aa, Homo Sapiens
AKSETSQEN

SEQ ID NO: 647942 - protein, 9 aa, Homo Sapiens
QQIFTNVTQ

SEQ ID NO: 647943 - protein, 9 aa, Homo Sapiens
GAGKMAAAD

SEQ ID NO: 647944 - protein, 9 aa, Homo Sapiens
VVGAVGVGK

SEQ ID NO: 647945 - protein, 9 aa, Homo Sapiens
MPRISSPMA

SEQ ID NO: 647946 - protein, 9 aa, Homo Sapiens
SQLRPIMSE

SEQ ID NO: 647947 - protein, 9 aa, Homo Sapiens
YTKPGAEKA

SEQ ID NO: 647948 - protein, 9 aa, Homo Sapiens
TGDIPYKCE

SEQ ID NO: 647949 - protein, 9 aa, Homo Sapiens
EKTRRAIWV

SEQ ID NO: 647950 - protein, 9 aa, Homo Sapiens
LILAEYSDE

SEQ ID NO: 647951 - protein, 9 aa, Homo Sapiens
GNLNATSKA

SEQ ID NO: 647952 - protein, 9 aa, Homo Sapiens
IFGLILAFF

SEQ ID NO: 647953 - protein, 9 aa, Homo Sapiens
DQVQLHVYE

SEQ ID NO: 647954 - protein, 9 aa, Homo Sapiens
GSGPQVNGA

SEQ ID NO: 647955 - protein, 9 aa, Homo Sapiens
LSRDPDVGR

SEQ ID NO: 647956 - protein, 9 aa, Homo Sapiens
VGQVCVSEQ

SEQ ID NO: 647957 - protein, 9 aa, Homo Sapiens
KGDADAPGP

SEQ ID NO: 647958 - protein, 9 aa, Homo Sapiens
GRGPGRGLP

SEQ ID NO: 647959 - protein, 9 aa, Homo Sapiens
ELVQLHTGI

SEQ ID NO: 647960 - protein, 9 aa, Homo Sapiens
ASGNHVSNC

SEQ ID NO: 647961 - protein, 9 aa, Homo Sapiens
PYWAQPLLM

SEQ ID NO: 647962 - protein, 9 aa, Homo Sapiens
TFQAGSQPQ

SEQ ID NO: 647963 - protein, 9 aa, Homo Sapiens
PEPMFTWTL

SEQ ID NO: 647964 - protein, 9 aa, Homo Sapiens
LPGSSTIVT

SEQ ID NO: 647965 - protein, 9 aa, Homo Sapiens
NLINKVDKT

SEQ ID NO: 647966 - protein, 9 aa, Homo Sapiens
QRLAGGAGE

SEQ ID NO: 647967 - protein, 9 aa, Homo Sapiens
KLGINNVSV

SEQ ID NO: 647968 - protein, 9 aa, Homo Sapiens
HACRQQETP

SEQ ID NO: 647969 - protein, 9 aa, Homo Sapiens
NGKNQPTLK

SEQ ID NO: 647970 - protein, 9 aa, Homo Sapiens
HSKPTTRDC

SEQ ID NO: 647971 - protein, 9 aa, Homo Sapiens
NASKQAGAL

SEQ ID NO: 647972 - protein, 9 aa, Homo Sapiens
GELVSSLSS

SEQ ID NO: 647973 - protein, 9 aa, Homo Sapiens
DLCNSVMIK

SEQ ID NO: 647974 - protein, 9 aa, Homo Sapiens
HEAEAGGGG

SEQ ID NO: 647975 - protein, 9 aa, Homo Sapiens
TVSGVALAG

SEQ ID NO: 647976 - protein, 9 aa, Homo Sapiens
EANRSITSF

SEQ ID NO: 647977 - protein, 9 aa, Homo Sapiens
THLRSTCYG

SEQ ID NO: 647978 - protein, 9 aa, Homo Sapiens
SRDIREALL

SEQ ID NO: 647979 - protein, 9 aa, Homo Sapiens
KCLEPAQRT

SEQ ID NO: 647980 - protein, 9 aa, Homo Sapiens
GGANSGCGS

SEQ ID NO: 647981 - protein, 9 aa, Homo Sapiens
WGHASFISC

SEQ ID NO: 647982 - protein, 9 aa, Homo Sapiens
AAGKLVLND

SEQ ID NO: 647983 - protein, 9 aa, Homo Sapiens
NGVVERMSV

SEQ ID NO: 647984 - protein, 9 aa, Homo Sapiens
RGPPGTVIT

SEQ ID NO: 647985 - protein, 9 aa, Homo Sapiens
KEHRKHKKH

SEQ ID NO: 647986 - protein, 9 aa, Homo Sapiens
LQTHRCPAK

SEQ ID NO: 647987 - protein, 9 aa, Homo Sapiens
AGRRRRLWY

SEQ ID NO: 647988 - protein, 9 aa, Homo Sapiens
KYNLESASA

SEQ ID NO: 647989 - protein, 9 aa, Homo Sapiens
GRARLIASG

SEQ ID NO: 647990 - protein, 9 aa, Homo Sapiens
HMGDCLCHQ

SEQ ID NO: 647991 - protein, 9 aa, Homo Sapiens
TVACKADGS

SEQ ID NO: 647992 - protein, 9 aa, Homo Sapiens
SRDPDVGRE

SEQ ID NO: 647993 - protein, 9 aa, Homo Sapiens
SHGNGEGRR

SEQ ID NO: 647994 - protein, 9 aa, Homo Sapiens
SPAPATTLS

SEQ ID NO: 647995 - protein, 9 aa, Homo Sapiens
WAAWTVSGV

SEQ ID NO: 647996 - protein, 9 aa, Homo Sapiens
LWPCPGSPA

SEQ ID NO: 647997 - protein, 9 aa, Homo Sapiens
WTLVGSRLL

SEQ ID NO: 647998 - protein, 9 aa, Homo Sapiens
LQDSQDRCY

SEQ ID NO: 647999 - protein, 9 aa, Homo Sapiens
YEADRDSMS

SEQ ID NO: 648000 - protein, 9 aa, Homo Sapiens
PEIMDELVR

SEQ ID NO: 648001 - protein, 9 aa, Homo Sapiens
LVGSRLLDG

SEQ ID NO: 648002 - protein, 9 aa, Homo Sapiens
QRAKRNTVL

SEQ ID NO: 648003 - protein, 9 aa, Homo Sapiens
ERMSQQIFT

SEQ ID NO: 648004 - protein, 9 aa, Homo Sapiens
LHSPGGAQD

SEQ ID NO: 648005 - protein, 9 aa, Homo Sapiens
QLASKHSMV

SEQ ID NO: 648006 - protein, 9 aa, Homo Sapiens
KKLEPVSWS

SEQ ID NO: 648007 - protein, 9 aa, Homo Sapiens
KSLRLLRVL

SEQ ID NO: 648008 - protein, 9 aa, Homo Sapiens
FSSVEYGVL

SEQ ID NO: 648009 - protein, 9 aa, Homo Sapiens
NILLVRGSE

SEQ ID NO: 648010 - protein, 9 aa, Homo Sapiens
AHEISSLAD

SEQ ID NO: 648011 - protein, 9 aa, Homo Sapiens
GKNQPTLKP

SEQ ID NO: 648012 - protein, 9 aa, Homo Sapiens
YLRKSLSNS

SEQ ID NO: 648013 - protein, 9 aa, Homo Sapiens
PEKPSKAIT

SEQ ID NO: 648014 - protein, 9 aa, Homo Sapiens
YEAWRLGCM

SEQ ID NO: 648015 - protein, 9 aa, Homo Sapiens
ALYRDVMLQ

SEQ ID NO: 648016 - protein, 9 aa, Homo Sapiens
PSPGDTPAP

SEQ ID NO: 648017 - protein, 9 aa, Homo Sapiens
SITSFSVAD

SEQ ID NO: 648018 - protein, 9 aa, Homo Sapiens
SGGGRGPGR

SEQ ID NO: 648019 - protein, 9 aa, Homo Sapiens
THRCPAKHY

SEQ ID NO: 648020 - protein, 9 aa, Homo Sapiens
RDVMLQNYQ

SEQ ID NO: 648021 - protein, 9 aa, Homo Sapiens
NICNTNKFY

SEQ ID NO: 648022 - protein, 9 aa, Homo Sapiens
AGLLGNVVN

SEQ ID NO: 648023 - protein, 9 aa, Homo Sapiens
AKKLEPVSW

SEQ ID NO: 648024 - protein, 9 aa, Homo Sapiens
GVEPHFLDR

SEQ ID NO: 648025 - protein, 9 aa, Homo Sapiens
LCNSVMIKD

SEQ ID NO: 648026 - protein, 9 aa, Homo Sapiens
KRENKKLQE

SEQ ID NO: 648027 - protein, 9 aa, Homo Sapiens
EGAITVKVP

SEQ ID NO: 648028 - protein, 9 aa, Homo Sapiens
SDAEYEADR

SEQ ID NO: 648029 - protein, 9 aa, Homo Sapiens
VLSAVSAFE

SEQ ID NO: 648030 - protein, 9 aa, Homo Sapiens
HNHLLLFVN

SEQ ID NO: 648031 - protein, 9 aa, Homo Sapiens
YCTWPAEGS

SEQ ID NO: 648032 - protein, 9 aa, Homo Sapiens
SVEYGVLMA

SEQ ID NO: 648033 - protein, 9 aa, Homo Sapiens
ESSKFRMSI

SEQ ID NO: 648034 - protein, 9 aa, Homo Sapiens
SSFPRMNLL

SEQ ID NO: 648035 - protein, 9 aa, Homo Sapiens
TGTAFYHKY

SEQ ID NO: 648036 - protein, 9 aa, Homo Sapiens
PARKQAHRS

SEQ ID NO: 648037 - protein, 9 aa, Homo Sapiens
TNELLERES

SEQ ID NO: 648038 - protein, 9 aa, Homo Sapiens
SESGELVSS

SEQ ID NO: 648039 - protein, 9 aa, Homo Sapiens
VGAVGVGKS

SEQ ID NO: 648040 - protein, 9 aa, Homo Sapiens
LSESAEEAC

SEQ ID NO: 648041 - protein, 9 aa, Homo Sapiens
ALLRRFHHR

SEQ ID NO: 648042 - protein, 9 aa, Homo Sapiens
SPSMSPAPQ

SEQ ID NO: 648043 - protein, 9 aa, Homo Sapiens
QQETPAHAD

SEQ ID NO: 648044 - protein, 9 aa, Homo Sapiens
VANALHSLL

SEQ ID NO: 648045 - protein, 9 aa, Homo Sapiens
LTGTAFYHK

SEQ ID NO: 648046 - protein, 9 aa, Homo Sapiens
THTLQPHQH

SEQ ID NO: 648047 - protein, 9 aa, Homo Sapiens
ARIHNHLLL

SEQ ID NO: 648048 - protein, 9 aa, Homo Sapiens
SRCVPEKPS

SEQ ID NO: 648049 - protein, 9 aa, Homo Sapiens
IPIGSDYVT

SEQ ID NO: 648050 - protein, 9 aa, Homo Sapiens
TSRKLSVKD

SEQ ID NO: 648051 - protein, 9 aa, Homo Sapiens
GGCGGDDFF

SEQ ID NO: 648052 - protein, 9 aa, Homo Sapiens
LLLRKDACS

SEQ ID NO: 648053 - protein, 9 aa, Homo Sapiens
ELYMNVTEA

SEQ ID NO: 648054 - protein, 9 aa, Homo Sapiens
AEYSDENGP

SEQ ID NO: 648055 - protein, 9 aa, Homo Sapiens
GNKMSAIFV

SEQ ID NO: 648056 - protein, 9 aa, Homo Sapiens
EKYFVSPNL

SEQ ID NO: 648057 - protein, 9 aa, Homo Sapiens
MPHAPSPAT

SEQ ID NO: 648058 - protein, 9 aa, Homo Sapiens
PELAAFFFK

SEQ ID NO: 648059 - protein, 9 aa, Homo Sapiens
TEENVLFWL

SEQ ID NO: 648060 - protein, 9 aa, Homo Sapiens
IATNELLER

SEQ ID NO: 648061 - protein, 9 aa, Homo Sapiens
EDDTKITLH

SEQ ID NO: 648062 - protein, 9 aa, Homo Sapiens
CALQFTQQT

SEQ ID NO: 648063 - protein, 9 aa, Homo Sapiens
IPHACRQQE

SEQ ID NO: 648064 - protein, 9 aa, Homo Sapiens
HYNHELYMN

SEQ ID NO: 648065 - protein, 9 aa, Homo Sapiens
KMANPIIGN

SEQ ID NO: 648066 - protein, 9 aa, Homo Sapiens
PGAVTVACK

SEQ ID NO: 648067 - protein, 9 aa, Homo Sapiens
HCKIAVTYW

SEQ ID NO: 648068 - protein, 9 aa, Homo Sapiens
SMEELDEIR

SEQ ID NO: 648069 - protein, 9 aa, Homo Sapiens
LQGLCLCID

SEQ ID NO: 648070 - protein, 9 aa, Homo Sapiens
LGGCVDDTI

SEQ ID NO: 648071 - protein, 9 aa, Homo Sapiens
KMAAADGQD

SEQ ID NO: 648072 - protein, 9 aa, Homo Sapiens
IDVVLSAVS

SEQ ID NO: 648073 - protein, 9 aa, Homo Sapiens
IREALLELL

SEQ ID NO: 648074 - protein, 9 aa, Homo Sapiens
SVLRGQGMV

SEQ ID NO: 648075 - protein, 9 aa, Homo Sapiens
NINAGQQGL

SEQ ID NO: 648076 - protein, 9 aa, Homo Sapiens
KDGDGKIVV

SEQ ID NO: 648077 - protein, 9 aa, Homo Sapiens
LGIMNVDVS

SEQ ID NO: 648078 - protein, 9 aa, Homo Sapiens
KKQSTKDLS
